United States Patent 11,421,016 (CANCER NEOEPITOPES) - sequence listing, part 16

SEQ ID NO: 694428 - protein, 9 aa, Homo Sapiens
SQRPICLPC

SEQ ID NO: 694429 - protein, 9 aa, Homo Sapiens
QFQGRRRSK

SEQ ID NO: 694430 - protein, 9 aa, Homo Sapiens
AGLPPLALL

SEQ ID NO: 694431 - protein, 9 aa, Homo Sapiens
LFQSMATFF

SEQ ID NO: 694432 - protein, 9 aa, Homo Sapiens
REQLVKYQN

SEQ ID NO: 694433 - protein, 9 aa, Homo Sapiens
PFHTDLLRY

SEQ ID NO: 694434 - protein, 9 aa, Homo Sapiens
SLPLDPVET

SEQ ID NO: 694435 - protein, 9 aa, Homo Sapiens
QLVPEIRKE

SEQ ID NO: 694436 - protein, 9 aa, Homo Sapiens
QDLKSAEVT

SEQ ID NO: 694437 - protein, 9 aa, Homo Sapiens
EIAWISTMP

SEQ ID NO: 694438 - protein, 9 aa, Homo Sapiens
EVIYPDSVD

SEQ ID NO: 694439 - protein, 9 aa, Homo Sapiens
NYRYFFHHA

SEQ ID NO: 694440 - protein, 9 aa, Homo Sapiens
TWLYEAEAL

SEQ ID NO: 694441 - protein, 9 aa, Homo Sapiens
DPALYPQGS

SEQ ID NO: 694442 - protein, 9 aa, Homo Sapiens
VKYQNEYNA

SEQ ID NO: 694443 - protein, 9 aa, Homo Sapiens
IWFHNRRMK

SEQ ID NO: 694444 - protein, 9 aa, Homo Sapiens
TGQPLQCIN

SEQ ID NO: 694445 - protein, 9 aa, Homo Sapiens
QLEEENRIL

SEQ ID NO: 694446 - protein, 9 aa, Homo Sapiens
QRLLSAHRA

SEQ ID NO: 694447 - protein, 9 aa, Homo Sapiens
SYHYVCRTR

SEQ ID NO: 694448 - protein, 9 aa, Homo Sapiens
TLMVDGEDT

SEQ ID NO: 694449 - protein, 9 aa, Homo Sapiens
LQCINTGSQ

SEQ ID NO: 694450 - protein, 9 aa, Homo Sapiens
QHSLLLLLE

SEQ ID NO: 694451 - protein, 9 aa, Homo Sapiens
SHFMPSYHH

SEQ ID NO: 694452 - protein, 9 aa, Homo Sapiens
IAKLSLAVT

SEQ ID NO: 694453 - protein, 9 aa, Homo Sapiens
SCFYIITYL

SEQ ID NO: 694454 - protein, 9 aa, Homo Sapiens
IISMSFPSS

SEQ ID NO: 694455 - protein, 9 aa, Homo Sapiens
IEWLTIVRA

SEQ ID NO: 694456 - protein, 9 aa, Homo Sapiens
ETEKYNQEL

SEQ ID NO: 694457 - protein, 9 aa, Homo Sapiens
ERQEIGSRS

SEQ ID NO: 694458 - protein, 9 aa, Homo Sapiens
IINAGKDGD

SEQ ID NO: 694459 - protein, 9 aa, Homo Sapiens
GSPRMAYPT

SEQ ID NO: 694460 - protein, 9 aa, Homo Sapiens
PLQCINTGS

SEQ ID NO: 694461 - protein, 9 aa, Homo Sapiens
SDVPEGVIL

SEQ ID NO: 694462 - protein, 9 aa, Homo Sapiens
SHIGVILSF

SEQ ID NO: 694463 - protein, 9 aa, Homo Sapiens
EWLTIVRAT

SEQ ID NO: 694464 - protein, 9 aa, Homo Sapiens
FLDALIDED

SEQ ID NO: 694465 - protein, 9 aa, Homo Sapiens
PRGLSGSEG

SEQ ID NO: 694466 - protein, 9 aa, Homo Sapiens
SKSATKHTP

SEQ ID NO: 694467 - protein, 9 aa, Homo Sapiens
ISHTMILQA

SEQ ID NO: 694468 - protein, 9 aa, Homo Sapiens
GWDQCLQPE

SEQ ID NO: 694469 - protein, 9 aa, Homo Sapiens
FLVNISDQG

SEQ ID NO: 694470 - protein, 9 aa, Homo Sapiens
PLKVFEEQK

SEQ ID NO: 694471 - protein, 9 aa, Homo Sapiens
VSITTFCME

SEQ ID NO: 694472 - protein, 9 aa, Homo Sapiens
ILCITISHT

SEQ ID NO: 694473 - protein, 9 aa, Homo Sapiens
STPSVYLEL

SEQ ID NO: 694474 - protein, 9 aa, Homo Sapiens
GLSGSEGPS

SEQ ID NO: 694475 - protein, 9 aa, Homo Sapiens
PKVVKNPSA

SEQ ID NO: 694476 - protein, 9 aa, Homo Sapiens
HGASPSEAS

SEQ ID NO: 694477 - protein, 9 aa, Homo Sapiens
RQLEEENRI

SEQ ID NO: 694478 - protein, 9 aa, Homo Sapiens
GSLLYYREI

SEQ ID NO: 694479 - protein, 9 aa, Homo Sapiens
PGPSVPQPP

SEQ ID NO: 694480 - protein, 9 aa, Homo Sapiens
SSGNAAFVN

SEQ ID NO: 694481 - protein, 9 aa, Homo Sapiens
CRDVAGGIS

SEQ ID NO: 694482 - protein, 9 aa, Homo Sapiens
SLFGSQTVF

SEQ ID NO: 694483 - protein, 9 aa, Homo Sapiens
CQADGVSAP

SEQ ID NO: 694484 - protein, 9 aa, Homo Sapiens
YELDYGKQE

SEQ ID NO: 694485 - protein, 9 aa, Homo Sapiens
SVYLELTDS

SEQ ID NO: 694486 - protein, 9 aa, Homo Sapiens
EDPSACTTD

SEQ ID NO: 694487 - protein, 9 aa, Homo Sapiens
VFEEQKSMV

SEQ ID NO: 694488 - protein, 9 aa, Homo Sapiens
MTLVKHQAP

SEQ ID NO: 694489 - protein, 9 aa, Homo Sapiens
HILEMDHFT

SEQ ID NO: 694490 - protein, 9 aa, Homo Sapiens
SRMRNMLDE

SEQ ID NO: 694491 - protein, 9 aa, Homo Sapiens
CESSTPPTI

SEQ ID NO: 694492 - protein, 9 aa, Homo Sapiens
EEKGCGIRT

SEQ ID NO: 694493 - protein, 9 aa, Homo Sapiens
TVQKPCNCQ

SEQ ID NO: 694494 - protein, 9 aa, Homo Sapiens
EWYLRDIDF

SEQ ID NO: 694495 - protein, 9 aa, Homo Sapiens
LDEVWHLDP

SEQ ID NO: 694496 - protein, 9 aa, Homo Sapiens
LQCHLPGSQ

SEQ ID NO: 694497 - protein, 9 aa, Homo Sapiens
ITLPVEEVL

SEQ ID NO: 694498 - protein, 9 aa, Homo Sapiens
IGWAAEECK

SEQ ID NO: 694499 - protein, 9 aa, Homo Sapiens
TELRFWQLT

SEQ ID NO: 694500 - protein, 9 aa, Homo Sapiens
ERHLQCHLP

SEQ ID NO: 694501 - protein, 9 aa, Homo Sapiens
FWQLTMEYQ

SEQ ID NO: 694502 - protein, 9 aa, Homo Sapiens
IPISHFMPS

SEQ ID NO: 694503 - protein, 9 aa, Homo Sapiens
NSPASPLTI

SEQ ID NO: 694504 - protein, 9 aa, Homo Sapiens
KYIAKLSLA

SEQ ID NO: 694505 - protein, 9 aa, Homo Sapiens
ECKEKLIKE

SEQ ID NO: 694506 - protein, 9 aa, Homo Sapiens
GTPSSSPDY

SEQ ID NO: 694507 - protein, 9 aa, Homo Sapiens
MKSSAQVGL

SEQ ID NO: 694508 - protein, 9 aa, Homo Sapiens
VQGGTAAIP

SEQ ID NO: 694509 - protein, 9 aa, Homo Sapiens
DEHSVMPPP

SEQ ID NO: 694510 - protein, 9 aa, Homo Sapiens
KPSFRGISE

SEQ ID NO: 694511 - protein, 9 aa, Homo Sapiens
HWLQKVTDQ

SEQ ID NO: 694512 - protein, 9 aa, Homo Sapiens
PSALELRSF

SEQ ID NO: 694513 - protein, 9 aa, Homo Sapiens
TGDKCVFNF

SEQ ID NO: 694514 - protein, 9 aa, Homo Sapiens
FCTTCCQHY

SEQ ID NO: 694515 - protein, 9 aa, Homo Sapiens
GSFCRCHLT

SEQ ID NO: 694516 - protein, 9 aa, Homo Sapiens
FQSFLDALI

SEQ ID NO: 694517 - protein, 9 aa, Homo Sapiens
GQTVQQVCN

SEQ ID NO: 694518 - protein, 9 aa, Homo Sapiens
SAGGCGLMT

SEQ ID NO: 694519 - protein, 9 aa, Homo Sapiens
TFCMETHEA

SEQ ID NO: 694520 - protein, 9 aa, Homo Sapiens
RQKRGYRDI

SEQ ID NO: 694521 - protein, 9 aa, Homo Sapiens
YDGKNLKIK

SEQ ID NO: 694522 - protein, 9 aa, Homo Sapiens
EGRHLDMVE

SEQ ID NO: 694523 - protein, 9 aa, Homo Sapiens
MLFLTTELF

SEQ ID NO: 694524 - protein, 9 aa, Homo Sapiens
LTTELFAAL

SEQ ID NO: 694525 - protein, 9 aa, Homo Sapiens
APSAFPCPV

SEQ ID NO: 694526 - protein, 9 aa, Homo Sapiens
KNILSLLVT

SEQ ID NO: 694527 - protein, 9 aa, Homo Sapiens
QGDDVVLTC

SEQ ID NO: 694528 - protein, 9 aa, Homo Sapiens
KLQRFQRIS

SEQ ID NO: 694529 - protein, 9 aa, Homo Sapiens
INHVSLTLS

SEQ ID NO: 694530 - protein, 9 aa, Homo Sapiens
GPLCLGASC

SEQ ID NO: 694531 - protein, 9 aa, Homo Sapiens
RAHHAKQSV

SEQ ID NO: 694532 - protein, 9 aa, Homo Sapiens
HCHIFQTLS

SEQ ID NO: 694533 - protein, 9 aa, Homo Sapiens
DHGTYSLSG

SEQ ID NO: 694534 - protein, 9 aa, Homo Sapiens
RCHLTEPGL

SEQ ID NO: 694535 - protein, 9 aa, Homo Sapiens
NESVSRMRN

SEQ ID NO: 694536 - protein, 9 aa, Homo Sapiens
GKQELVNIR

SEQ ID NO: 694537 - protein, 9 aa, Homo Sapiens
GPGARLGAS

SEQ ID NO: 694538 - protein, 9 aa, Homo Sapiens
IFHATVASK

SEQ ID NO: 694539 - protein, 9 aa, Homo Sapiens
PGDGCSGRK

SEQ ID NO: 694540 - protein, 9 aa, Homo Sapiens
ECRPHVTSR

SEQ ID NO: 694541 - protein, 9 aa, Homo Sapiens
VTQLQEISG

SEQ ID NO: 694542 - protein, 9 aa, Homo Sapiens
CPDHRLTSS

SEQ ID NO: 694543 - protein, 9 aa, Homo Sapiens
NETQWKGLT

SEQ ID NO: 694544 - protein, 9 aa, Homo Sapiens
HVVVTWNRR

SEQ ID NO: 694545 - protein, 9 aa, Homo Sapiens
ILQDSLGGS

SEQ ID NO: 694546 - protein, 9 aa, Homo Sapiens
LRALSQEFA

SEQ ID NO: 694547 - protein, 9 aa, Homo Sapiens
CLETQQLMD

SEQ ID NO: 694548 - protein, 9 aa, Homo Sapiens
LTLQYVQRP

SEQ ID NO: 694549 - protein, 9 aa, Homo Sapiens
LVTATLTID

SEQ ID NO: 694550 - protein, 9 aa, Homo Sapiens
RLEELVQEL

SEQ ID NO: 694551 - protein, 9 aa, Homo Sapiens
HHGVPMVGL

SEQ ID NO: 694552 - protein, 9 aa, Homo Sapiens
GAAAQQLQG

SEQ ID NO: 694553 - protein, 9 aa, Homo Sapiens
QCINTGSQV

SEQ ID NO: 694554 - protein, 9 aa, Homo Sapiens
SLSQLLLDD

SEQ ID NO: 694555 - protein, 9 aa, Homo Sapiens
INKECSRVY

SEQ ID NO: 694556 - protein, 9 aa, Homo Sapiens
QGVPRLPTW

SEQ ID NO: 694557 - protein, 9 aa, Homo Sapiens
SETATRISL

SEQ ID NO: 694558 - protein, 9 aa, Homo Sapiens
RFLLPPDPS

SEQ ID NO: 694559 - protein, 9 aa, Homo Sapiens
AITPLVCIL

SEQ ID NO: 694560 - protein, 9 aa, Homo Sapiens
VLKNYGTIC

SEQ ID NO: 694561 - protein, 9 aa, Homo Sapiens
LRGPQWWLK

SEQ ID NO: 694562 - protein, 9 aa, Homo Sapiens
AICEPSPCQ

SEQ ID NO: 694563 - protein, 9 aa, Homo Sapiens
TLAFSDILL

SEQ ID NO: 694564 - protein, 9 aa, Homo Sapiens
AKCVNYDGK

SEQ ID NO: 694565 - protein, 9 aa, Homo Sapiens
CDLAPRAVT

SEQ ID NO: 694566 - protein, 9 aa, Homo Sapiens
LLIREDTSL

SEQ ID NO: 694567 - protein, 9 aa, Homo Sapiens
SPSPLGSKS

SEQ ID NO: 694568 - protein, 9 aa, Homo Sapiens
FQRISDSDI

SEQ ID NO: 694569 - protein, 9 aa, Homo Sapiens
CNAVGALAK

SEQ ID NO: 694570 - protein, 9 aa, Homo Sapiens
GLWGWALGA

SEQ ID NO: 694571 - protein, 9 aa, Homo Sapiens
GASLKNQDL

SEQ ID NO: 694572 - protein, 9 aa, Homo Sapiens
YTDIGGMDI

SEQ ID NO: 694573 - protein, 9 aa, Homo Sapiens
IFITAPNGA

SEQ ID NO: 694574 - protein, 9 aa, Homo Sapiens
CCQAICEPS

SEQ ID NO: 694575 - protein, 9 aa, Homo Sapiens
MVACNSSGN

SEQ ID NO: 694576 - protein, 9 aa, Homo Sapiens
LKKYIAKLS

SEQ ID NO: 694577 - protein, 9 aa, Homo Sapiens
VECVLPSSS

SEQ ID NO: 694578 - protein, 9 aa, Homo Sapiens
SSKSQSKCK

SEQ ID NO: 694579 - protein, 9 aa, Homo Sapiens
KMKSNISVL

SEQ ID NO: 694580 - protein, 9 aa, Homo Sapiens
AASDSEPQR

SEQ ID NO: 694581 - protein, 9 aa, Homo Sapiens
PRKKRFTVK

SEQ ID NO: 694582 - protein, 9 aa, Homo Sapiens
LRDSAGGCG

SEQ ID NO: 694583 - protein, 9 aa, Homo Sapiens
PAPSAFPCP

SEQ ID NO: 694584 - protein, 9 aa, Homo Sapiens
IKRLEQRNL

SEQ ID NO: 694585 - protein, 9 aa, Homo Sapiens
VIMLFLTTE

SEQ ID NO: 694586 - protein, 9 aa, Homo Sapiens
SVMEAIHHG

SEQ ID NO: 694587 - protein, 9 aa, Homo Sapiens
DAVLEKLHL

SEQ ID NO: 694588 - protein, 9 aa, Homo Sapiens
LLYYREIKW

SEQ ID NO: 694589 - protein, 9 aa, Homo Sapiens
LSAHRAGLW

SEQ ID NO: 694590 - protein, 9 aa, Homo Sapiens
LWGWALGAR

SEQ ID NO: 694591 - protein, 9 aa, Homo Sapiens
KPSSKSQSK

SEQ ID NO: 694592 - protein, 9 aa, Homo Sapiens
KYEPQDFQE

SEQ ID NO: 694593 - protein, 9 aa, Homo Sapiens
ILCVMEAYH

SEQ ID NO: 694594 - protein, 9 aa, Homo Sapiens
EVQPKAFFL

SEQ ID NO: 694595 - protein, 9 aa, Homo Sapiens
ADRLEELVQ

SEQ ID NO: 694596 - protein, 9 aa, Homo Sapiens
KRLEQRNLT

SEQ ID NO: 694597 - protein, 9 aa, Homo Sapiens
YAEWYLRDI

SEQ ID NO: 694598 - protein, 9 aa, Homo Sapiens
AKPLSCLTP

SEQ ID NO: 694599 - protein, 9 aa, Homo Sapiens
VVHDSLFGS

SEQ ID NO: 694600 - protein, 9 aa, Homo Sapiens
PDTLEYNMK

SEQ ID NO: 694601 - protein, 9 aa, Homo Sapiens
DVAGGISGN

SEQ ID NO: 694602 - protein, 9 aa, Homo Sapiens
SRSCSEPAP

SEQ ID NO: 694603 - protein, 9 aa, Homo Sapiens
IIAAITLRG

SEQ ID NO: 694604 - protein, 9 aa, Homo Sapiens
TGTVWNPPR

SEQ ID NO: 694605 - protein, 9 aa, Homo Sapiens
QVLIMMVLS

SEQ ID NO: 694606 - protein, 9 aa, Homo Sapiens
LDKVLKNYG

SEQ ID NO: 694607 - protein, 9 aa, Homo Sapiens
ITPCTDVKF

SEQ ID NO: 694608 - protein, 9 aa, Homo Sapiens
GDYPRLSLS

SEQ ID NO: 694609 - protein, 9 aa, Homo Sapiens
TTASDSVCL

SEQ ID NO: 694610 - protein, 9 aa, Homo Sapiens
IMMVLSIVL

SEQ ID NO: 694611 - protein, 9 aa, Homo Sapiens
MVETETPGD

SEQ ID NO: 694612 - protein, 9 aa, Homo Sapiens
GQRLLSAHR

SEQ ID NO: 694613 - protein, 9 aa, Homo Sapiens
VKVIDAQRR

SEQ ID NO: 694614 - protein, 9 aa, Homo Sapiens
DSTLSHGIL

SEQ ID NO: 694615 - protein, 9 aa, Homo Sapiens
SPHCHIFQT

SEQ ID NO: 694616 - protein, 9 aa, Homo Sapiens
FDRQKRGYR

SEQ ID NO: 694617 - protein, 9 aa, Homo Sapiens
DSTWKSAIY

SEQ ID NO: 694618 - protein, 9 aa, Homo Sapiens
DMVECVLPS

SEQ ID NO: 694619 - protein, 9 aa, Homo Sapiens
EDVYERTLM

SEQ ID NO: 694620 - protein, 9 aa, Homo Sapiens
METHEAFNI

SEQ ID NO: 694621 - protein, 9 aa, Homo Sapiens
EEFKLCLET

SEQ ID NO: 694622 - protein, 9 aa, Homo Sapiens
VHDSLFGSQ

SEQ ID NO: 694623 - protein, 9 aa, Homo Sapiens
GKNMFFSSW

SEQ ID NO: 694624 - protein, 9 aa, Homo Sapiens
LPAGNIFHC

SEQ ID NO: 694625 - protein, 9 aa, Homo Sapiens
FDFGEKQKK

SEQ ID NO: 694626 - protein, 9 aa, Homo Sapiens
ILVHAPLLS

SEQ ID NO: 694627 - protein, 9 aa, Homo Sapiens
DSEPQRDEL

SEQ ID NO: 694628 - protein, 9 aa, Homo Sapiens
KLHLQNIHV

SEQ ID NO: 694629 - protein, 9 aa, Homo Sapiens
DHRLTSSTT

SEQ ID NO: 694630 - protein, 9 aa, Homo Sapiens
WHEAQGWAV

SEQ ID NO: 694631 - protein, 9 aa, Homo Sapiens
IITRPLEDQ

SEQ ID NO: 694632 - protein, 9 aa, Homo Sapiens
SSAQVGLAR

SEQ ID NO: 694633 - protein, 9 aa, Homo Sapiens
GDTRAAIAL

SEQ ID NO: 694634 - protein, 9 aa, Homo Sapiens
GLDGFPSLP

SEQ ID NO: 694635 - protein, 9 aa, Homo Sapiens
TAAPITLPV

SEQ ID NO: 694636 - protein, 9 aa, Homo Sapiens
HLDMVECVL

SEQ ID NO: 694637 - protein, 9 aa, Homo Sapiens
PRASGKPVN

SEQ ID NO: 694638 - protein, 9 aa, Homo Sapiens
YGTICQINS

SEQ ID NO: 694639 - protein, 9 aa, Homo Sapiens
CCQHYHGMC

SEQ ID NO: 694640 - protein, 9 aa, Homo Sapiens
PVEEKYEPQ

SEQ ID NO: 694641 - protein, 9 aa, Homo Sapiens
RNVVFATGD

SEQ ID NO: 694642 - protein, 9 aa, Homo Sapiens
QVQLERHEY

SEQ ID NO: 694643 - protein, 9 aa, Homo Sapiens
GDLSTALLS

SEQ ID NO: 694644 - protein, 9 aa, Homo Sapiens
YLQRRHTGE

SEQ ID NO: 694645 - protein, 9 aa, Homo Sapiens
QVCNAVGAL

SEQ ID NO: 694646 - protein, 9 aa, Homo Sapiens
LGGSCRTTI

SEQ ID NO: 694647 - protein, 9 aa, Homo Sapiens
ILLIREDTS

SEQ ID NO: 694648 - protein, 9 aa, Homo Sapiens
HLQNIHVHE

SEQ ID NO: 694649 - protein, 9 aa, Homo Sapiens
FTSTLLFFM

SEQ ID NO: 694650 - protein, 9 aa, Homo Sapiens
CSCSCSFQE

SEQ ID NO: 694651 - protein, 9 aa, Homo Sapiens
YAASDSEPQ

SEQ ID NO: 694652 - protein, 9 aa, Homo Sapiens
LALTHLCMG

SEQ ID NO: 694653 - protein, 9 aa, Homo Sapiens
GNVTDSTLS

SEQ ID NO: 694654 - protein, 9 aa, Homo Sapiens
DTLEYNMKV

SEQ ID NO: 694655 - protein, 9 aa, Homo Sapiens
EEKYEPQDF

SEQ ID NO: 694656 - protein, 9 aa, Homo Sapiens
IHPPYLVSR

SEQ ID NO: 694657 - protein, 9 aa, Homo Sapiens
EAIHHGVPM

SEQ ID NO: 694658 - protein, 9 aa, Homo Sapiens
SFVHHIRRN

SEQ ID NO: 694659 - protein, 9 aa, Homo Sapiens
RGDMKSSAQ

SEQ ID NO: 694660 - protein, 9 aa, Homo Sapiens
PSPAASSGC

SEQ ID NO: 694661 - protein, 9 aa, Homo Sapiens
ASDSEPQRD

SEQ ID NO: 694662 - protein, 9 aa, Homo Sapiens
QEGFDRQKR

SEQ ID NO: 694663 - protein, 9 aa, Homo Sapiens
ILPQASQNR

SEQ ID NO: 694664 - protein, 9 aa, Homo Sapiens
VSAPLVSWR

SEQ ID NO: 694665 - protein, 9 aa, Homo Sapiens
ACNSSGNAA

SEQ ID NO: 694666 - protein, 9 aa, Homo Sapiens
KNPSALELR

SEQ ID NO: 694667 - protein, 9 aa, Homo Sapiens
GLYEIYMNQ

SEQ ID NO: 694668 - protein, 9 aa, Homo Sapiens
GEKLGGNVI

SEQ ID NO: 694669 - protein, 9 aa, Homo Sapiens
TLLSCFYII

SEQ ID NO: 694670 - protein, 9 aa, Homo Sapiens
VKHQAPSDE

SEQ ID NO: 694671 - protein, 9 aa, Homo Sapiens
LEMDHFTLV

SEQ ID NO: 694672 - protein, 9 aa, Homo Sapiens
WALGARLYQ

SEQ ID NO: 694673 - protein, 9 aa, Homo Sapiens
MDSPKSAAD

SEQ ID NO: 694674 - protein, 9 aa, Homo Sapiens
AFTSGKYFW

SEQ ID NO: 694675 - protein, 9 aa, Homo Sapiens
YVEEANRET

SEQ ID NO: 694676 - protein, 9 aa, Homo Sapiens
ETPSSFLPW

SEQ ID NO: 694677 - protein, 9 aa, Homo Sapiens
DIGNYSCSA

SEQ ID NO: 694678 - protein, 9 aa, Homo Sapiens
ISDQGDDVV

SEQ ID NO: 694679 - protein, 9 aa, Homo Sapiens
HVSLTLSTL

SEQ ID NO: 694680 - protein, 9 aa, Homo Sapiens
CFTSTLLFF

SEQ ID NO: 694681 - protein, 9 aa, Homo Sapiens
TPRSILAKE

SEQ ID NO: 694682 - protein, 9 aa, Homo Sapiens
PCVQGGTAA

SEQ ID NO: 694683 - protein, 9 aa, Homo Sapiens
QVSETATRI

SEQ ID NO: 694684 - protein, 9 aa, Homo Sapiens
DIRYGCPSP

SEQ ID NO: 694685 - protein, 9 aa, Homo Sapiens
KAEENEVPE

SEQ ID NO: 694686 - protein, 9 aa, Homo Sapiens
QQLIRNGTK

SEQ ID NO: 694687 - protein, 9 aa, Homo Sapiens
ADGVSAPLV

SEQ ID NO: 694688 - protein, 9 aa, Homo Sapiens
FPCPVSAME

SEQ ID NO: 694689 - protein, 9 aa, Homo Sapiens
SGCESSTPP

SEQ ID NO: 694690 - protein, 9 aa, Homo Sapiens
GGTAAIPGA

SEQ ID NO: 694691 - protein, 9 aa, Homo Sapiens
FLINHVSLT

SEQ ID NO: 694692 - protein, 9 aa, Homo Sapiens
VPTVRVECC

SEQ ID NO: 694693 - protein, 9 aa, Homo Sapiens
PKNRIGRPM

SEQ ID NO: 694694 - protein, 9 aa, Homo Sapiens
SSKCTTASD

SEQ ID NO: 694695 - protein, 9 aa, Homo Sapiens
EDFTVFDSW

SEQ ID NO: 694696 - protein, 9 aa, Homo Sapiens
ILSLLVTAT

SEQ ID NO: 694697 - protein, 9 aa, Homo Sapiens
SFGQFHEGD

SEQ ID NO: 694698 - protein, 9 aa, Homo Sapiens
HFTLLLLFA

SEQ ID NO: 694699 - protein, 9 aa, Homo Sapiens
KIIAAITLR

SEQ ID NO: 694700 - protein, 9 aa, Homo Sapiens
VQELEAAPC

SEQ ID NO: 694701 - protein, 9 aa, Homo Sapiens
SILAKELEK

SEQ ID NO: 694702 - protein, 9 aa, Homo Sapiens
HKTGDKCVF

SEQ ID NO: 694703 - protein, 9 aa, Homo Sapiens
GLLAITPLV

SEQ ID NO: 694704 - protein, 9 aa, Homo Sapiens
GSQPPGQRL

SEQ ID NO: 694705 - protein, 9 aa, Homo Sapiens
CLGASCSLA

SEQ ID NO: 694706 - protein, 9 aa, Homo Sapiens
KLISRDVLY

SEQ ID NO: 694707 - protein, 9 aa, Homo Sapiens
CSRVYLTDP

SEQ ID NO: 694708 - protein, 9 aa, Homo Sapiens
CASDHVKVV

SEQ ID NO: 694709 - protein, 9 aa, Homo Sapiens
QCQRLTQRY

SEQ ID NO: 694710 - protein, 9 aa, Homo Sapiens
ITCSSHLTA

SEQ ID NO: 694711 - protein, 9 aa, Homo Sapiens
MTFGKGTQL

SEQ ID NO: 694712 - protein, 9 aa, Homo Sapiens
TMPVEDKSN

SEQ ID NO: 694713 - protein, 9 aa, Homo Sapiens
SFSTPAFFS

SEQ ID NO: 694714 - protein, 9 aa, Homo Sapiens
SLGGSCRTT

SEQ ID NO: 694715 - protein, 9 aa, Homo Sapiens
TLPVEEVLQ

SEQ ID NO: 694716 - protein, 9 aa, Homo Sapiens
SKCTTASDS

SEQ ID NO: 694717 - protein, 9 aa, Homo Sapiens
QSLQQNLPQ

SEQ ID NO: 694718 - protein, 9 aa, Homo Sapiens
KKGRCKAFI

SEQ ID NO: 694719 - protein, 9 aa, Homo Sapiens
DFTVFDSWF

SEQ ID NO: 694720 - protein, 9 aa, Homo Sapiens
GFPSLPGPP

SEQ ID NO: 694721 - protein, 9 aa, Homo Sapiens
PTTALCLFR

SEQ ID NO: 694722 - protein, 9 aa, Homo Sapiens
FFQSFLDAL

SEQ ID NO: 694723 - protein, 9 aa, Homo Sapiens
FVSCIIQSH

SEQ ID NO: 694724 - protein, 9 aa, Homo Sapiens
QQVCNAVGA

SEQ ID NO: 694725 - protein, 9 aa, Homo Sapiens
RNMLDEVWH

SEQ ID NO: 694726 - protein, 9 aa, Homo Sapiens
IVGSPEMTF

SEQ ID NO: 694727 - protein, 9 aa, Homo Sapiens
EFDNYAEWY

SEQ ID NO: 694728 - protein, 9 aa, Homo Sapiens
GTVWNPPRK

SEQ ID NO: 694729 - protein, 9 aa, Homo Sapiens
VSINKECSR

SEQ ID NO: 694730 - protein, 9 aa, Homo Sapiens
SDHKLDEKQ

SEQ ID NO: 694731 - protein, 9 aa, Homo Sapiens
LSLLVTATL

SEQ ID NO: 694732 - protein, 9 aa, Homo Sapiens
STLGGRRGM

SEQ ID NO: 694733 - protein, 9 aa, Homo Sapiens
NNKTLSQQT

SEQ ID NO: 694734 - protein, 9 aa, Homo Sapiens
RIFNLCKRC

SEQ ID NO: 694735 - protein, 9 aa, Homo Sapiens
FINSPASPL

SEQ ID NO: 694736 - protein, 9 aa, Homo Sapiens
CWEDLHKVS

SEQ ID NO: 694737 - protein, 9 aa, Homo Sapiens
PNTSVKVID

SEQ ID NO: 694738 - protein, 9 aa, Homo Sapiens
EENEVPEDS

SEQ ID NO: 694739 - protein, 9 aa, Homo Sapiens
PQKPSFRGI

SEQ ID NO: 694740 - protein, 9 aa, Homo Sapiens
NFGGSPRMA

SEQ ID NO: 694741 - protein, 9 aa, Homo Sapiens
KGECVITPC

SEQ ID NO: 694742 - protein, 9 aa, Homo Sapiens
QCCEQMLHA

SEQ ID NO: 694743 - protein, 9 aa, Homo Sapiens
VVFATGDYP

SEQ ID NO: 694744 - protein, 9 aa, Homo Sapiens
PPRRKHASL

SEQ ID NO: 694745 - protein, 9 aa, Homo Sapiens
TCAENRALC

SEQ ID NO: 694746 - protein, 9 aa, Homo Sapiens
PRSILAKEL

SEQ ID NO: 694747 - protein, 9 aa, Homo Sapiens
EEVQPKAFF

SEQ ID NO: 694748 - protein, 9 aa, Homo Sapiens
CRSGFHDHG

SEQ ID NO: 694749 - protein, 9 aa, Homo Sapiens
DPSACTTDS

SEQ ID NO: 694750 - protein, 9 aa, Homo Sapiens
KFEDFTVFD

SEQ ID NO: 694751 - protein, 9 aa, Homo Sapiens
HLDPVIAKL

SEQ ID NO: 694752 - protein, 9 aa, Homo Sapiens
VYLELTDSC

SEQ ID NO: 694753 - protein, 9 aa, Homo Sapiens
WGEDEDPSA

SEQ ID NO: 694754 - protein, 9 aa, Homo Sapiens
KLGGNVIVS

SEQ ID NO: 694755 - protein, 9 aa, Homo Sapiens
FAVGGLLAI

SEQ ID NO: 694756 - protein, 9 aa, Homo Sapiens
TDIGGMDIQ

SEQ ID NO: 694757 - protein, 9 aa, Homo Sapiens
TPSSFLPWL

SEQ ID NO: 694758 - protein, 9 aa, Homo Sapiens
VKNPSALEL

SEQ ID NO: 694759 - protein, 9 aa, Homo Sapiens
QFFCTTCCQ

SEQ ID NO: 694760 - protein, 9 aa, Homo Sapiens
HFVAGEWFL

SEQ ID NO: 694761 - protein, 9 aa, Homo Sapiens
LSKSATKHT

SEQ ID NO: 694762 - protein, 9 aa, Homo Sapiens
ASDHVKVVT

SEQ ID NO: 694763 - protein, 9 aa, Homo Sapiens
REEQKAEEN

SEQ ID NO: 694764 - protein, 9 aa, Homo Sapiens
FQQVQLERH

SEQ ID NO: 694765 - protein, 9 aa, Homo Sapiens
GQERRSPPT

SEQ ID NO: 694766 - protein, 9 aa, Homo Sapiens
EKSQGLPQK

SEQ ID NO: 694767 - protein, 9 aa, Homo Sapiens
SVKVIDAQR

SEQ ID NO: 694768 - protein, 9 aa, Homo Sapiens
SAQVGLARA

SEQ ID NO: 694769 - protein, 9 aa, Homo Sapiens
QELEAAPCC

SEQ ID NO: 694770 - protein, 9 aa, Homo Sapiens
VEEANRETE

SEQ ID NO: 694771 - protein, 9 aa, Homo Sapiens
SPASPLTIF

SEQ ID NO: 694772 - protein, 9 aa, Homo Sapiens
HTMILQAVV

SEQ ID NO: 694773 - protein, 9 aa, Homo Sapiens
GAKPGPGAR

SEQ ID NO: 694774 - protein, 9 aa, Homo Sapiens
VQPKAFFLL

SEQ ID NO: 694775 - protein, 9 aa, Homo Sapiens
LIREDTSLN

SEQ ID NO: 694776 - protein, 9 aa, Homo Sapiens
LSCLTPLII

SEQ ID NO: 694777 - protein, 9 aa, Homo Sapiens
HIDVPKENI

SEQ ID NO: 694778 - protein, 9 aa, Homo Sapiens
DEGDGDGED

SEQ ID NO: 694779 - protein, 9 aa, Homo Sapiens
RPHVTSRSC

SEQ ID NO: 694780 - protein, 9 aa, Homo Sapiens
FGEKQKKCS

SEQ ID NO: 694781 - protein, 9 aa, Homo Sapiens
CVIPISHFM

SEQ ID NO: 694782 - protein, 9 aa, Homo Sapiens
TTLMLGNIL

SEQ ID NO: 694783 - protein, 9 aa, Homo Sapiens
LKNYGTICQ

SEQ ID NO: 694784 - protein, 9 aa, Homo Sapiens
GGLYEIYMN

SEQ ID NO: 694785 - protein, 9 aa, Homo Sapiens
TPHIDVPKE

SEQ ID NO: 694786 - protein, 9 aa, Homo Sapiens
QKPDVMYTD

SEQ ID NO: 694787 - protein, 9 aa, Homo Sapiens
DDLADAVLE

SEQ ID NO: 694788 - protein, 9 aa, Homo Sapiens
KCVFNFKPC

SEQ ID NO: 694789 - protein, 9 aa, Homo Sapiens
CHLPGSQPP

SEQ ID NO: 694790 - protein, 9 aa, Homo Sapiens
QGLPQKPSF

SEQ ID NO: 694791 - protein, 9 aa, Homo Sapiens
QELVNIRKV

SEQ ID NO: 694792 - protein, 9 aa, Homo Sapiens
DEERQEIGS

SEQ ID NO: 694793 - protein, 9 aa, Homo Sapiens
NIHVHEPNR

SEQ ID NO: 694794 - protein, 9 aa, Homo Sapiens
DNYAEWYLR

SEQ ID NO: 694795 - protein, 9 aa, Homo Sapiens
GGEGLRDSA

SEQ ID NO: 694796 - protein, 9 aa, Homo Sapiens
KSAVGHQYQ

SEQ ID NO: 694797 - protein, 9 aa, Homo Sapiens
NYGTICQIN

SEQ ID NO: 694798 - protein, 9 aa, Homo Sapiens
VHKFLLVFS

SEQ ID NO: 694799 - protein, 9 aa, Homo Sapiens
PTWGEDEDP

SEQ ID NO: 694800 - protein, 9 aa, Homo Sapiens
RGPHGSISR

SEQ ID NO: 694801 - protein, 9 aa, Homo Sapiens
QVASVFYMI

SEQ ID NO: 694802 - protein, 9 aa, Homo Sapiens
SLKNQDLRY

SEQ ID NO: 694803 - protein, 9 aa, Homo Sapiens
ELMEQLFET

SEQ ID NO: 694804 - protein, 9 aa, Homo Sapiens
NVTDSTLSH

SEQ ID NO: 694805 - protein, 9 aa, Homo Sapiens
YSCSDWPHR

SEQ ID NO: 694806 - protein, 9 aa, Homo Sapiens
NATPRTNFK

SEQ ID NO: 694807 - protein, 9 aa, Homo Sapiens
LLSKSATKH

SEQ ID NO: 694808 - protein, 9 aa, Homo Sapiens
EERQEIGSR

SEQ ID NO: 694809 - protein, 9 aa, Homo Sapiens
AVGGLLAIT

SEQ ID NO: 694810 - protein, 9 aa, Homo Sapiens
IMQAHWLQK

SEQ ID NO: 694811 - protein, 9 aa, Homo Sapiens
SHTMILQAV

SEQ ID NO: 694812 - protein, 9 aa, Homo Sapiens
KAFITCSSH

SEQ ID NO: 694813 - protein, 9 aa, Homo Sapiens
VRGDLSTAL

SEQ ID NO: 694814 - protein, 9 aa, Homo Sapiens
VNISDQGDD

SEQ ID NO: 694815 - protein, 9 aa, Homo Sapiens
LSSPHCHIF

SEQ ID NO: 694816 - protein, 9 aa, Homo Sapiens
GGISGNMVD

SEQ ID NO: 694817 - protein, 9 aa, Homo Sapiens
ASLKNQDLR

SEQ ID NO: 694818 - protein, 9 aa, Homo Sapiens
VIAKLVLEV

SEQ ID NO: 694819 - protein, 9 aa, Homo Sapiens
QNIMQAHWL

SEQ ID NO: 694820 - protein, 9 aa, Homo Sapiens
LMVDGEDTT

SEQ ID NO: 694821 - protein, 9 aa, Homo Sapiens
ECRSGFHDH

SEQ ID NO: 694822 - protein, 9 aa, Homo Sapiens
PPTTALCLF

SEQ ID NO: 694823 - protein, 9 aa, Homo Sapiens
QPKAFFLLS

SEQ ID NO: 694824 - protein, 9 aa, Homo Sapiens
LKTPHIDVP

SEQ ID NO: 694825 - protein, 9 aa, Homo Sapiens
ESVMDVVTK

SEQ ID NO: 694826 - protein, 9 aa, Homo Sapiens
CAATIERHL

SEQ ID NO: 694827 - protein, 9 aa, Homo Sapiens
GGNVIVSLE

SEQ ID NO: 694828 - protein, 9 aa, Homo Sapiens
RDSAGGCGL

SEQ ID NO: 694829 - protein, 9 aa, Homo Sapiens
PVIITRPLE

SEQ ID NO: 694830 - protein, 9 aa, Homo Sapiens
KPGPGARLG

SEQ ID NO: 694831 - protein, 9 aa, Homo Sapiens
SQSKCKPSQ

SEQ ID NO: 694832 - protein, 9 aa, Homo Sapiens
EEENRILPQ

SEQ ID NO: 694833 - protein, 9 aa, Homo Sapiens
ERIFGLPAG

SEQ ID NO: 694834 - protein, 9 aa, Homo Sapiens
RRKHASLCA

SEQ ID NO: 694835 - protein, 9 aa, Homo Sapiens
QNSVMEAIH

SEQ ID NO: 694836 - protein, 9 aa, Homo Sapiens
TIINAGKDG

SEQ ID NO: 694837 - protein, 9 aa, Homo Sapiens
MIVIPMLNP

SEQ ID NO: 694838 - protein, 9 aa, Homo Sapiens
FLGSFCRCH

SEQ ID NO: 694839 - protein, 9 aa, Homo Sapiens
PREPQEYTL

SEQ ID NO: 694840 - protein, 9 aa, Homo Sapiens
EEVFKRACI

SEQ ID NO: 694841 - protein, 9 aa, Homo Sapiens
EKGCGIRTK

SEQ ID NO: 694842 - protein, 9 aa, Homo Sapiens
LCLVDGGGA

SEQ ID NO: 694843 - protein, 9 aa, Homo Sapiens
FEKDIEMQK

SEQ ID NO: 694844 - protein, 9 aa, Homo Sapiens
ATRISLLKA

SEQ ID NO: 694845 - protein, 9 aa, Homo Sapiens
RAEEKGCGI

SEQ ID NO: 694846 - protein, 9 aa, Homo Sapiens
PSDAANSPI

SEQ ID NO: 694847 - protein, 9 aa, Homo Sapiens
AFEKDIEMQ

SEQ ID NO: 694848 - protein, 9 aa, Homo Sapiens
RGGEGLRDS

SEQ ID NO: 694849 - protein, 9 aa, Homo Sapiens
LPWLSQQTR

SEQ ID NO: 694850 - protein, 9 aa, Homo Sapiens
RMAYPTYSP

SEQ ID NO: 694851 - protein, 9 aa, Homo Sapiens
SKFEDFTVF

SEQ ID NO: 694852 - protein, 9 aa, Homo Sapiens
SPEHVVVTW

SEQ ID NO: 694853 - protein, 9 aa, Homo Sapiens
ISGLSYVAL

SEQ ID NO: 694854 - protein, 9 aa, Homo Sapiens
AVTTDAAHP

SEQ ID NO: 694855 - protein, 9 aa, Homo Sapiens
YIAKLSLAV

SEQ ID NO: 694856 - protein, 9 aa, Homo Sapiens
TATRISLLK

SEQ ID NO: 694857 - protein, 9 aa, Homo Sapiens
EGANTHLEM

SEQ ID NO: 694858 - protein, 9 aa, Homo Sapiens
VQRPTNHVG

SEQ ID NO: 694859 - protein, 9 aa, Homo Sapiens
GSHIGVILS

SEQ ID NO: 694860 - protein, 9 aa, Homo Sapiens
CGIRTKEPL

SEQ ID NO: 694861 - protein, 9 aa, Homo Sapiens
VEDKSNPPE

SEQ ID NO: 694862 - protein, 9 aa, Homo Sapiens
EDTSLNTPM

SEQ ID NO: 694863 - protein, 9 aa, Homo Sapiens
EHVVVTWNR

SEQ ID NO: 694864 - protein, 9 aa, Homo Sapiens
VPNEAEVTS

SEQ ID NO: 694865 - protein, 9 aa, Homo Sapiens
FMGNSVMIL

SEQ ID NO: 694866 - protein, 9 aa, Homo Sapiens
PSSFLPWLS

SEQ ID NO: 694867 - protein, 9 aa, Homo Sapiens
PKQSFGQFH

SEQ ID NO: 694868 - protein, 9 aa, Homo Sapiens
DPTWGEDED

SEQ ID NO: 694869 - protein, 9 aa, Homo Sapiens
TYVTERIIS

SEQ ID NO: 694870 - protein, 9 aa, Homo Sapiens
VTMSYEEQN

SEQ ID NO: 694871 - protein, 9 aa, Homo Sapiens
NISDQGDDV

SEQ ID NO: 694872 - protein, 9 aa, Homo Sapiens
NTSVKVIDA

SEQ ID NO: 694873 - protein, 9 aa, Homo Sapiens
QGWAVPAAA

SEQ ID NO: 694874 - protein, 9 aa, Homo Sapiens
CKEKLIKEM

SEQ ID NO: 694875 - protein, 9 aa, Homo Sapiens
ITTFCMETH

SEQ ID NO: 694876 - protein, 9 aa, Homo Sapiens
CRCHLTEPG

SEQ ID NO: 694877 - protein, 9 aa, Homo Sapiens
EFETLKTPH

SEQ ID NO: 694878 - protein, 9 aa, Homo Sapiens
LFCPDHRLT

SEQ ID NO: 694879 - protein, 9 aa, Homo Sapiens
RCHLNFHPN

SEQ ID NO: 694880 - protein, 9 aa, Homo Sapiens
CHIFQTLSD

SEQ ID NO: 694881 - protein, 9 aa, Homo Sapiens
LRRGPHGSI

SEQ ID NO: 694882 - protein, 9 aa, Homo Sapiens
LNNKTLSQQ

SEQ ID NO: 694883 - protein, 9 aa, Homo Sapiens
IFNLCKRCH

SEQ ID NO: 694884 - protein, 9 aa, Homo Sapiens
TIVRATDDL

SEQ ID NO: 694885 - protein, 9 aa, Homo Sapiens
TMSYEEQNK

SEQ ID NO: 694886 - protein, 9 aa, Homo Sapiens
TGIKKYLNS

SEQ ID NO: 694887 - protein, 9 aa, Homo Sapiens
LSTTLMLGN

SEQ ID NO: 694888 - protein, 9 aa, Homo Sapiens
QAGISKTCE

SEQ ID NO: 694889 - protein, 9 aa, Homo Sapiens
IERHLQCHL

SEQ ID NO: 694890 - protein, 9 aa, Homo Sapiens
RKKRFTVKL

SEQ ID NO: 694891 - protein, 9 aa, Homo Sapiens
IIHIQHSLL

SEQ ID NO: 694892 - protein, 9 aa, Homo Sapiens
SSPSPLGSK

SEQ ID NO: 694893 - protein, 9 aa, Homo Sapiens
LLAITPLVC

SEQ ID NO: 694894 - protein, 9 aa, Homo Sapiens
SQPPGQRLL

SEQ ID NO: 694895 - protein, 9 aa, Homo Sapiens
YREIKWLSR

SEQ ID NO: 694896 - protein, 9 aa, Homo Sapiens
ARGARRQAG

SEQ ID NO: 694897 - protein, 9 aa, Homo Sapiens
LAPRAVTTD

SEQ ID NO: 694898 - protein, 9 aa, Homo Sapiens
FHPNSAPGV

SEQ ID NO: 694899 - protein, 9 aa, Homo Sapiens
AHRAGLWGW

SEQ ID NO: 694900 - protein, 9 aa, Homo Sapiens
KHASLCAME

SEQ ID NO: 694901 - protein, 9 aa, Homo Sapiens
LPCQADGVS

SEQ ID NO: 694902 - protein, 9 aa, Homo Sapiens
SLCAMEVLP

SEQ ID NO: 694903 - protein, 9 aa, Homo Sapiens
TDEERQEIG

SEQ ID NO: 694904 - protein, 9 aa, Homo Sapiens
PPRKKRFTV

SEQ ID NO: 694905 - protein, 9 aa, Homo Sapiens
QFDEGDGDG

SEQ ID NO: 694906 - protein, 9 aa, Homo Sapiens
SAQGKNMFF

SEQ ID NO: 694907 - protein, 9 aa, Homo Sapiens
SCSLRALSQ

SEQ ID NO: 694908 - protein, 9 aa, Homo Sapiens
TALLSAQSF

SEQ ID NO: 694909 - protein, 9 aa, Homo Sapiens
IKLQQLIRN

SEQ ID NO: 694910 - protein, 9 aa, Homo Sapiens
QSVANRSGV

SEQ ID NO: 694911 - protein, 9 aa, Homo Sapiens
VVKNPSALE

SEQ ID NO: 694912 - protein, 9 aa, Homo Sapiens
FAFEKDIEM

SEQ ID NO: 694913 - protein, 9 aa, Homo Sapiens
GNSVMILLI

SEQ ID NO: 694914 - protein, 9 aa, Homo Sapiens
LSMLALTHL

SEQ ID NO: 694915 - protein, 9 aa, Homo Sapiens
QCHLPGSQP

SEQ ID NO: 694916 - protein, 9 aa, Homo Sapiens
DPEDMACTP

SEQ ID NO: 694917 - protein, 9 aa, Homo Sapiens
SPPTTALCL

SEQ ID NO: 694918 - protein, 9 aa, Homo Sapiens
TLVKHQAPS

SEQ ID NO: 694919 - protein, 9 aa, Homo Sapiens
YLEYDRFLL

SEQ ID NO: 694920 - protein, 9 aa, Homo Sapiens
PYLVSRELM

SEQ ID NO: 694921 - protein, 9 aa, Homo Sapiens
LQQLIRNGT

SEQ ID NO: 694922 - protein, 9 aa, Homo Sapiens
ECVLPSSSH

SEQ ID NO: 694923 - protein, 9 aa, Homo Sapiens
KFMFVVGMF

SEQ ID NO: 694924 - protein, 9 aa, Homo Sapiens
IERELKEGR

SEQ ID NO: 694925 - protein, 9 aa, Homo Sapiens
GQPLQCINT

SEQ ID NO: 694926 - protein, 9 aa, Homo Sapiens
KGRCKAFIT

SEQ ID NO: 694927 - protein, 9 aa, Homo Sapiens
IGVILSFST

SEQ ID NO: 694928 - protein, 9 aa, Homo Sapiens
LSLFTSVLV

SEQ ID NO: 694929 - protein, 9 aa, Homo Sapiens
GDMKSSAQV

SEQ ID NO: 694930 - protein, 9 aa, Homo Sapiens
RILPQASQN

SEQ ID NO: 694931 - protein, 9 aa, Homo Sapiens
EEQKAEENE

SEQ ID NO: 694932 - protein, 9 aa, Homo Sapiens
KKYLNSYTL

SEQ ID NO: 694933 - protein, 9 aa, Homo Sapiens
EANRETEKY

SEQ ID NO: 694934 - protein, 9 aa, Homo Sapiens
LNSYTLTGR

SEQ ID NO: 694935 - protein, 9 aa, Homo Sapiens
FKFPISDDR

SEQ ID NO: 694936 - protein, 9 aa, Homo Sapiens
LQRRHTGEM

SEQ ID NO: 694937 - protein, 9 aa, Homo Sapiens
CIPRTLNEV

SEQ ID NO: 694938 - protein, 9 aa, Homo Sapiens
AGLFSISVK

SEQ ID NO: 694939 - protein, 9 aa, Homo Sapiens
YVQRPTNHV

SEQ ID NO: 694940 - protein, 9 aa, Homo Sapiens
TGDYPRLSL

SEQ ID NO: 694941 - protein, 9 aa, Homo Sapiens
GEQTWSQAG

SEQ ID NO: 694942 - protein, 9 aa, Homo Sapiens
WEDLHKVSC

SEQ ID NO: 694943 - protein, 9 aa, Homo Sapiens
MPSYHHHFA

SEQ ID NO: 694944 - protein, 9 aa, Homo Sapiens
SGSEGPSTS

SEQ ID NO: 694945 - protein, 9 aa, Homo Sapiens
GMDDIRYGC

SEQ ID NO: 694946 - protein, 9 aa, Homo Sapiens
TLEYNMKVG

SEQ ID NO: 694947 - protein, 9 aa, Homo Sapiens
RIISMSFPS

SEQ ID NO: 694948 - protein, 9 aa, Homo Sapiens
PMTLVKHQA

SEQ ID NO: 694949 - protein, 9 aa, Homo Sapiens
LSFINSPAS

SEQ ID NO: 694950 - protein, 9 aa, Homo Sapiens
HLYFFLGTT

SEQ ID NO: 694951 - protein, 9 aa, Homo Sapiens
ALCLVDGGG

SEQ ID NO: 694952 - protein, 9 aa, Homo Sapiens
ALHLACASD

SEQ ID NO: 694953 - protein, 9 aa, Homo Sapiens
SPKSAADFI

SEQ ID NO: 694954 - protein, 9 aa, Homo Sapiens
PSEDLNNKT

SEQ ID NO: 694955 - protein, 9 aa, Homo Sapiens
TEISLTSRS

SEQ ID NO: 694956 - protein, 9 aa, Homo Sapiens
THLEMRFLN

SEQ ID NO: 694957 - protein, 9 aa, Homo Sapiens
FMPSYHHHF

SEQ ID NO: 694958 - protein, 9 aa, Homo Sapiens
KSNPPEGSE

SEQ ID NO: 694959 - protein, 9 aa, Homo Sapiens
LHLACASDH

SEQ ID NO: 694960 - protein, 9 aa, Homo Sapiens
VQKPCNCQD

SEQ ID NO: 694961 - protein, 9 aa, Homo Sapiens
TWGEDEDPS

SEQ ID NO: 694962 - protein, 9 aa, Homo Sapiens
PENGKSTIF

SEQ ID NO: 694963 - protein, 9 aa, Homo Sapiens
NSKILCVME

SEQ ID NO: 694964 - protein, 9 aa, Homo Sapiens
ETQQLMDFW

SEQ ID NO: 694965 - protein, 9 aa, Homo Sapiens
NMISGLSYV

SEQ ID NO: 694966 - protein, 9 aa, Homo Sapiens
CLYSCSDWP

SEQ ID NO: 694967 - protein, 9 aa, Homo Sapiens
AITLRGPQW

SEQ ID NO: 694968 - protein, 9 aa, Homo Sapiens
ETELRFWQL

SEQ ID NO: 694969 - protein, 9 aa, Homo Sapiens
CSDWPHRLV

SEQ ID NO: 694970 - protein, 9 aa, Homo Sapiens
YYREIKWLS

SEQ ID NO: 694971 - protein, 9 aa, Homo Sapiens
DVPLRPTEI

SEQ ID NO: 694972 - protein, 9 aa, Homo Sapiens
VHEPNRGKL

SEQ ID NO: 694973 - protein, 9 aa, Homo Sapiens
GWAVPAAAP

SEQ ID NO: 694974 - protein, 9 aa, Homo Sapiens
KTGDKCVFN

SEQ ID NO: 694975 - protein, 9 aa, Homo Sapiens
PPVIITRPL

SEQ ID NO: 694976 - protein, 9 aa, Homo Sapiens
QQEGFDRQK

SEQ ID NO: 694977 - protein, 9 aa, Homo Sapiens
MFFSSWSIS

SEQ ID NO: 694978 - protein, 9 aa, Homo Sapiens
QSFQFDEGD

SEQ ID NO: 694979 - protein, 9 aa, Homo Sapiens
TTPRSILAK

SEQ ID NO: 694980 - protein, 9 aa, Homo Sapiens
GANTHLEMR

SEQ ID NO: 694981 - protein, 9 aa, Homo Sapiens
VTSRSCSEP

SEQ ID NO: 694982 - protein, 9 aa, Homo Sapiens
KLDEKQCQR

SEQ ID NO: 694983 - protein, 9 aa, Homo Sapiens
PGQRLLSAH

SEQ ID NO: 694984 - protein, 9 aa, Homo Sapiens
RPKNRIGRP

SEQ ID NO: 694985 - protein, 9 aa, Homo Sapiens
VKTPSDAAN

SEQ ID NO: 694986 - protein, 9 aa, Homo Sapiens
KGCGIRTKE

SEQ ID NO: 694987 - protein, 9 aa, Homo Sapiens
LLLLLEEQL

SEQ ID NO: 694988 - protein, 9 aa, Homo Sapiens
ISVKIWHLH

SEQ ID NO: 694989 - protein, 9 aa, Homo Sapiens
MVECVLPSS

SEQ ID NO: 694990 - protein, 9 aa, Homo Sapiens
KYLNSYTLT

SEQ ID NO: 694991 - protein, 9 aa, Homo Sapiens
LGSKSATPS

SEQ ID NO: 694992 - protein, 9 aa, Homo Sapiens
RACIPRTLN

SEQ ID NO: 694993 - protein, 9 aa, Homo Sapiens
KGQPREPQE

SEQ ID NO: 694994 - protein, 9 aa, Homo Sapiens
AGGISGNMV

SEQ ID NO: 694995 - protein, 9 aa, Homo Sapiens
QSPVEEKYE

SEQ ID NO: 694996 - protein, 9 aa, Homo Sapiens
GCRALNLSE

SEQ ID NO: 694997 - protein, 9 aa, Homo Sapiens
NLTWPRASG

SEQ ID NO: 694998 - protein, 9 aa, Homo Sapiens
KNRIGRPMV

SEQ ID NO: 694999 - protein, 9 aa, Homo Sapiens
KKVRRDIIP

SEQ ID NO: 695000 - protein, 9 aa, Homo Sapiens
APKCAATIE

SEQ ID NO: 695001 - protein, 9 aa, Homo Sapiens
VIVSLEGKP

SEQ ID NO: 695002 - protein, 9 aa, Homo Sapiens
DHVKVVTLL

SEQ ID NO: 695003 - protein, 9 aa, Homo Sapiens
TERIISMSF

SEQ ID NO: 695004 - protein, 9 aa, Homo Sapiens
VGMFVSGGV

SEQ ID NO: 695005 - protein, 9 aa, Homo Sapiens
LSIHDSTWK

SEQ ID NO: 695006 - protein, 9 aa, Homo Sapiens
WKGLTQYFG

SEQ ID NO: 695007 - protein, 9 aa, Homo Sapiens
AIALPRMAA

SEQ ID NO: 695008 - protein, 9 aa, Homo Sapiens
AAIEEKKVR

SEQ ID NO: 695009 - protein, 9 aa, Homo Sapiens
LQQEGFDRQ

SEQ ID NO: 695010 - protein, 9 aa, Homo Sapiens
VFNFKPCGL

SEQ ID NO: 695011 - protein, 9 aa, Homo Sapiens
PIDQELYVF

SEQ ID NO: 695012 - protein, 9 aa, Homo Sapiens
LFGSQTVFR

SEQ ID NO: 695013 - protein, 9 aa, Homo Sapiens
AAAPKCAAT

SEQ ID NO: 695014 - protein, 9 aa, Homo Sapiens
SSNETQWKG

SEQ ID NO: 695015 - protein, 9 aa, Homo Sapiens
KIAAGMFLN

SEQ ID NO: 695016 - protein, 9 aa, Homo Sapiens
LSTALLSAQ

SEQ ID NO: 695017 - protein, 9 aa, Homo Sapiens
CTTCCQHYH

SEQ ID NO: 695018 - protein, 9 aa, Homo Sapiens
LILLIREDT

SEQ ID NO: 695019 - protein, 9 aa, Homo Sapiens
LADAVLEKL

SEQ ID NO: 695020 - protein, 9 aa, Homo Sapiens
PTWRCLPRP

SEQ ID NO: 695021 - protein, 9 aa, Homo Sapiens
SAADFIQRG

SEQ ID NO: 695022 - protein, 9 aa, Homo Sapiens
EAHFVAGEW

SEQ ID NO: 695023 - protein, 9 aa, Homo Sapiens
VMILLIYLD

SEQ ID NO: 695024 - protein, 9 aa, Homo Sapiens
DIEWLTIVR

SEQ ID NO: 695025 - protein, 9 aa, Homo Sapiens
ESVSRMRNM

SEQ ID NO: 695026 - protein, 9 aa, Homo Sapiens
STIFHATVA

SEQ ID NO: 695027 - protein, 9 aa, Homo Sapiens
KKYIAKLSL

SEQ ID NO: 695028 - protein, 9 aa, Homo Sapiens
FVKEPPVII

SEQ ID NO: 695029 - protein, 9 aa, Homo Sapiens
MGNSVMILL

SEQ ID NO: 695030 - protein, 9 aa, Homo Sapiens
HHAKQSVAN

SEQ ID NO: 695031 - protein, 9 aa, Homo Sapiens
LTWPRASGK

SEQ ID NO: 695032 - protein, 9 aa, Homo Sapiens
AEEKGCGIR

SEQ ID NO: 695033 - protein, 9 aa, Homo Sapiens
HDSTWKSAI

SEQ ID NO: 695034 - protein, 9 aa, Homo Sapiens
SDSEPQRDE

SEQ ID NO: 695035 - protein, 9 aa, Homo Sapiens
KTIINAGKD

SEQ ID NO: 695036 - protein, 9 aa, Homo Sapiens
LTHLCMGLS

SEQ ID NO: 695037 - protein, 9 aa, Homo Sapiens
EDMACTPSG

SEQ ID NO: 695038 - protein, 9 aa, Homo Sapiens
TVRVECCFS

SEQ ID NO: 695039 - protein, 9 aa, Homo Sapiens
APAPSAFPC

SEQ ID NO: 695040 - protein, 9 aa, Homo Sapiens
LSFSTPAFF

SEQ ID NO: 695041 - protein, 9 aa, Homo Sapiens
MRCHLNFHP

SEQ ID NO: 695042 - protein, 9 aa, Homo Sapiens
AAITLRGPQ

SEQ ID NO: 695043 - protein, 9 aa, Homo Sapiens
TLRGPQWWL

SEQ ID NO: 695044 - protein, 9 aa, Homo Sapiens
QYQSKLSKH

SEQ ID NO: 695045 - protein, 9 aa, Homo Sapiens
NFKFPISDD

SEQ ID NO: 695046 - protein, 9 aa, Homo Sapiens
ATKHTPTNG

SEQ ID NO: 695047 - protein, 9 aa, Homo Sapiens
SCRTTIVIC

SEQ ID NO: 695048 - protein, 9 aa, Homo Sapiens
RLEQRNLTL

SEQ ID NO: 695049 - protein, 9 aa, Homo Sapiens
AVVTMSYEE

SEQ ID NO: 695050 - protein, 9 aa, Homo Sapiens
ENEVPEDSL

SEQ ID NO: 695051 - protein, 9 aa, Homo Sapiens
GEKLSLFTS

SEQ ID NO: 695052 - protein, 9 aa, Homo Sapiens
GDDVVLTCQ

SEQ ID NO: 695053 - protein, 9 aa, Homo Sapiens
PISHFMPSY

SEQ ID NO: 695054 - protein, 9 aa, Homo Sapiens
EEKKVRRDI

SEQ ID NO: 695055 - protein, 9 aa, Homo Sapiens
VNLTWPRAS

SEQ ID NO: 695056 - protein, 9 aa, Homo Sapiens
ESAQGKNMF

SEQ ID NO: 695057 - protein, 9 aa, Homo Sapiens
NSVMEAIHH

SEQ ID NO: 695058 - protein, 9 aa, Homo Sapiens
FSCAGVAGL

SEQ ID NO: 695059 - protein, 9 aa, Homo Sapiens
QEYTLPPSQ

SEQ ID NO: 695060 - protein, 9 aa, Homo Sapiens
EASGNLPLL

SEQ ID NO: 695061 - protein, 9 aa, Homo Sapiens
ASSGCESST

SEQ ID NO: 695062 - protein, 9 aa, Homo Sapiens
RFQRISDSD

SEQ ID NO: 695063 - protein, 9 aa, Homo Sapiens
TPSSSPDYK

SEQ ID NO: 695064 - protein, 9 aa, Homo Sapiens
ILLIYLDTQ

SEQ ID NO: 695065 - protein, 9 aa, Homo Sapiens
MSYEEQNKN

SEQ ID NO: 695066 - protein, 9 aa, Homo Sapiens
QKPCNCQDS

SEQ ID NO: 695067 - protein, 9 aa, Homo Sapiens
SLATDPSYL

SEQ ID NO: 695068 - protein, 9 aa, Homo Sapiens
GPHGSISRI

SEQ ID NO: 695069 - protein, 9 aa, Homo Sapiens
GKSTIFHAT

SEQ ID NO: 695070 - protein, 9 aa, Homo Sapiens
ELRFWQLTM

SEQ ID NO: 695071 - protein, 9 aa, Homo Sapiens
EPQEYTLPP

SEQ ID NO: 695072 - protein, 9 aa, Homo Sapiens
PPYLVSREL

SEQ ID NO: 695073 - protein, 9 aa, Homo Sapiens
WAAEECKEK

SEQ ID NO: 695074 - protein, 9 aa, Homo Sapiens
QRFQRISDS

SEQ ID NO: 695075 - protein, 9 aa, Homo Sapiens
TTFCMETHE

SEQ ID NO: 695076 - protein, 9 aa, Homo Sapiens
GSNVTQLQE

SEQ ID NO: 695077 - protein, 9 aa, Homo Sapiens
EEANRETEK

SEQ ID NO: 695078 - protein, 9 aa, Homo Sapiens
NELMEQLFE

SEQ ID NO: 695079 - protein, 9 aa, Homo Sapiens
AHFTLLLLF

SEQ ID NO: 695080 - protein, 9 aa, Homo Sapiens
FTQCCEQML

SEQ ID NO: 695081 - protein, 9 aa, Homo Sapiens
LSGRADEHS

SEQ ID NO: 695082 - protein, 9 aa, Homo Sapiens
IEMQKGTGL

SEQ ID NO: 695083 - protein, 9 aa, Homo Sapiens
LPRKYLSTT

SEQ ID NO: 695084 - protein, 9 aa, Homo Sapiens
YLNSYTLTG

SEQ ID NO: 695085 - protein, 9 aa, Homo Sapiens
GGSCRTTIV

SEQ ID NO: 695086 - protein, 9 aa, Homo Sapiens
NLSEHARGG

SEQ ID NO: 695087 - protein, 9 aa, Homo Sapiens
LDYGKQELV

SEQ ID NO: 695088 - protein, 9 aa, Homo Sapiens
IGNYSCSAQ

SEQ ID NO: 695089 - protein, 9 aa, Homo Sapiens
HYVCRTRQV

SEQ ID NO: 695090 - protein, 9 aa, Homo Sapiens
AEECKEKLI

SEQ ID NO: 695091 - protein, 9 aa, Homo Sapiens
EAFPSEDLN

SEQ ID NO: 695092 - protein, 9 aa, Homo Sapiens
EAQGWAVPA

SEQ ID NO: 695093 - protein, 9 aa, Homo Sapiens
VSRELMSLV

SEQ ID NO: 695094 - protein, 9 aa, Homo Sapiens
QRDELLVPA

SEQ ID NO: 695095 - protein, 9 aa, Homo Sapiens
WSQAGISKT

SEQ ID NO: 695096 - protein, 9 aa, Homo Sapiens
HAKCVNYDG

SEQ ID NO: 695097 - protein, 9 aa, Homo Sapiens
FWEVHMGDS

SEQ ID NO: 695098 - protein, 9 aa, Homo Sapiens
EYDRFLLPP

SEQ ID NO: 695099 - protein, 9 aa, Homo Sapiens
YGSLLYYRE

SEQ ID NO: 695100 - protein, 9 aa, Homo Sapiens
ERELKEGRY

SEQ ID NO: 695101 - protein, 9 aa, Homo Sapiens
SHLYFFLGT

SEQ ID NO: 695102 - protein, 9 aa, Homo Sapiens
IFGLPAGNI

SEQ ID NO: 695103 - protein, 9 aa, Homo Sapiens
NFHPNSAPG

SEQ ID NO: 695104 - protein, 9 aa, Homo Sapiens
LENLTKNTA

SEQ ID NO: 695105 - protein, 9 aa, Homo Sapiens
LNESVSRMR

SEQ ID NO: 695106 - protein, 9 aa, Homo Sapiens
LWKLQSLQQ

SEQ ID NO: 695107 - protein, 9 aa, Homo Sapiens
KVKFQKMKS

SEQ ID NO: 695108 - protein, 9 aa, Homo Sapiens
PTEISLTSR

SEQ ID NO: 695109 - protein, 9 aa, Homo Sapiens
QEWYHLPCR

SEQ ID NO: 695110 - protein, 9 aa, Homo Sapiens
DSAGGCGLM

SEQ ID NO: 695111 - protein, 9 aa, Homo Sapiens
AGAAAQQLQ

SEQ ID NO: 695112 - protein, 9 aa, Homo Sapiens
DLIKEAILH

SEQ ID NO: 695113 - protein, 9 aa, Homo Sapiens
TPGDGCSGR

SEQ ID NO: 695114 - protein, 9 aa, Homo Sapiens
PCTDVKFDP

SEQ ID NO: 695115 - protein, 9 aa, Homo Sapiens
TERSLENLT

SEQ ID NO: 695116 - protein, 9 aa, Homo Sapiens
LGSFCRCHL

SEQ ID NO: 695117 - protein, 9 aa, Homo Sapiens
HRAGLWGWA

SEQ ID NO: 695118 - protein, 9 aa, Homo Sapiens
QAICEPSPC

SEQ ID NO: 695119 - protein, 9 aa, Homo Sapiens
LIMMVLSIV

SEQ ID NO: 695120 - protein, 9 aa, Homo Sapiens
SVQLRRGPH

SEQ ID NO: 695121 - protein, 9 aa, Homo Sapiens
LDMNHSFVH

SEQ ID NO: 695122 - protein, 9 aa, Homo Sapiens
VYERTLMVD

SEQ ID NO: 695123 - protein, 9 aa, Homo Sapiens
DVYERTLMV

SEQ ID NO: 695124 - protein, 9 aa, Homo Sapiens
APEVPNEAE

SEQ ID NO: 695125 - protein, 9 aa, Homo Sapiens
QYGSLLYYR

SEQ ID NO: 695126 - protein, 9 aa, Homo Sapiens
RRGPHGSIS

SEQ ID NO: 695127 - protein, 9 aa, Homo Sapiens
VSLTLSTLT

SEQ ID NO: 695128 - protein, 9 aa, Homo Sapiens
ILAKELEKY

SEQ ID NO: 695129 - protein, 9 aa, Homo Sapiens
MSSKCTTAS

SEQ ID NO: 695130 - protein, 9 aa, Homo Sapiens
ECSRVYLTD

SEQ ID NO: 695131 - protein, 9 aa, Homo Sapiens
KVIDAQRRR

SEQ ID NO: 695132 - protein, 9 aa, Homo Sapiens
GKYFWEVHM

SEQ ID NO: 695133 - protein, 9 aa, Homo Sapiens
TLGGRRGMR

SEQ ID NO: 695134 - protein, 9 aa, Homo Sapiens
RAEADDPED

SEQ ID NO: 695135 - protein, 9 aa, Homo Sapiens
HVHEPNRGK

SEQ ID NO: 695136 - protein, 9 aa, Homo Sapiens
THLCMGLST

SEQ ID NO: 695137 - protein, 9 aa, Homo Sapiens
FLTTELFAA

SEQ ID NO: 695138 - protein, 9 aa, Homo Sapiens
CNSSGNAAF

SEQ ID NO: 695139 - protein, 9 aa, Homo Sapiens
SMRCHLNFH

SEQ ID NO: 695140 - protein, 9 aa, Homo Sapiens
LKNILSLLV

SEQ ID NO: 695141 - protein, 9 aa, Homo Sapiens
SSPDYKLLT

SEQ ID NO: 695142 - protein, 9 aa, Homo Sapiens
ACASDHVKV

SEQ ID NO: 695143 - protein, 9 aa, Homo Sapiens
YESRIKRLE

SEQ ID NO: 695144 - protein, 9 aa, Homo Sapiens
KGEQTWSQA

SEQ ID NO: 695145 - protein, 9 aa, Homo Sapiens
KHQAPSDEE

SEQ ID NO: 695146 - protein, 9 aa, Homo Sapiens
EECKEKLIK

SEQ ID NO: 695147 - protein, 9 aa, Homo Sapiens
SKCKPSQGL

SEQ ID NO: 695148 - protein, 9 aa, Homo Sapiens
YDIEWLTIV

SEQ ID NO: 695149 - protein, 9 aa, Homo Sapiens
AHWLQKVTD

SEQ ID NO: 695150 - protein, 9 aa, Homo Sapiens
HSFVHHIRR

SEQ ID NO: 695151 - protein, 9 aa, Homo Sapiens
LLSAQSFLS

SEQ ID NO: 695152 - protein, 9 aa, Homo Sapiens
FLPWLSQQT

SEQ ID NO: 695153 - protein, 9 aa, Homo Sapiens
DEKQCQRLT

SEQ ID NO: 695154 - protein, 9 aa, Homo Sapiens
AKFMFVVGM

SEQ ID NO: 695155 - protein, 9 aa, Homo Sapiens
CFYIITYLF

SEQ ID NO: 695156 - protein, 9 aa, Homo Sapiens
SEASGNLPL

SEQ ID NO: 695157 - protein, 9 aa, Homo Sapiens
CALNSKILC

SEQ ID NO: 695158 - protein, 9 aa, Homo Sapiens
ETQWKGLTQ

SEQ ID NO: 695159 - protein, 9 aa, Homo Sapiens
MSTLGGRRG

SEQ ID NO: 695160 - protein, 9 aa, Homo Sapiens
EDKSNPPEG

SEQ ID NO: 695161 - protein, 9 aa, Homo Sapiens
SSPCCQAIC

SEQ ID NO: 695162 - protein, 9 aa, Homo Sapiens
HIQHSLLLL

SEQ ID NO: 695163 - protein, 9 aa, Homo Sapiens
AKPGPGARL

SEQ ID NO: 695164 - protein, 9 aa, Homo Sapiens
MEQLFETFQ

SEQ ID NO: 695165 - protein, 9 aa, Homo Sapiens
DEGEKLSLF

SEQ ID NO: 695166 - protein, 9 aa, Homo Sapiens
HLALLTAHF

SEQ ID NO: 695167 - protein, 9 aa, Homo Sapiens
GTICQINSE

SEQ ID NO: 695168 - protein, 9 aa, Homo Sapiens
PIGSLNESV

SEQ ID NO: 695169 - protein, 9 aa, Homo Sapiens
RSILAKELE

SEQ ID NO: 695170 - protein, 9 aa, Homo Sapiens
EQLTEEVQP

SEQ ID NO: 695171 - protein, 9 aa, Homo Sapiens
DHFTLVVHE

SEQ ID NO: 695172 - protein, 9 aa, Homo Sapiens
IQHSLLLLL

SEQ ID NO: 695173 - protein, 9 aa, Homo Sapiens
VTDSTLSHG

SEQ ID NO: 695174 - protein, 9 aa, Homo Sapiens
SDHVKVVTL

SEQ ID NO: 695175 - protein, 9 aa, Homo Sapiens
DLNNKTLSQ

SEQ ID NO: 695176 - protein, 9 aa, Homo Sapiens
CVFNFKPCG

SEQ ID NO: 695177 - protein, 9 aa, Homo Sapiens
TDSQVSETA

SEQ ID NO: 695178 - protein, 9 aa, Homo Sapiens
DIRDLEKKK

SEQ ID NO: 695179 - protein, 9 aa, Homo Sapiens
PDHRLTSST

SEQ ID NO: 695180 - protein, 9 aa, Homo Sapiens
RADEHSVMP

SEQ ID NO: 695181 - protein, 9 aa, Homo Sapiens
KECWEDLHK

SEQ ID NO: 695182 - protein, 9 aa, Homo Sapiens
ITISHTMIL

SEQ ID NO: 695183 - protein, 9 aa, Homo Sapiens
PCPVSAMEL

SEQ ID NO: 695184 - protein, 9 aa, Homo Sapiens
VECCFSCPQ

SEQ ID NO: 695185 - protein, 9 aa, Homo Sapiens
VPTTTPRSI

SEQ ID NO: 695186 - protein, 9 aa, Homo Sapiens
LKVEGANTH

SEQ ID NO: 695187 - protein, 9 aa, Homo Sapiens
KFLLVFSKW

SEQ ID NO: 695188 - protein, 9 aa, Homo Sapiens
PSSKSQSKC

SEQ ID NO: 695189 - protein, 9 aa, Homo Sapiens
RIFGLPAGN

SEQ ID NO: 695190 - protein, 9 aa, Homo Sapiens
VWNPPRKKR

SEQ ID NO: 695191 - protein, 9 aa, Homo Sapiens
ALLTAHFTL

SEQ ID NO: 695192 - protein, 9 aa, Homo Sapiens
PDIRDLEKK

SEQ ID NO: 695193 - protein, 9 aa, Homo Sapiens
MFSCAGVAG

SEQ ID NO: 695194 - protein, 9 aa, Homo Sapiens
LTEELAYLR

SEQ ID NO: 695195 - protein, 9 aa, Homo Sapiens
PDVMYTDIG

SEQ ID NO: 695196 - protein, 9 aa, Homo Sapiens
ASPSEASGN

SEQ ID NO: 695197 - protein, 9 aa, Homo Sapiens
CRALNLSEH

SEQ ID NO: 695198 - protein, 9 aa, Homo Sapiens
LYVFDTTGK

SEQ ID NO: 695199 - protein, 9 aa, Homo Sapiens
GEKQKKCSW

SEQ ID NO: 695200 - protein, 9 aa, Homo Sapiens
SLNESVSRM

SEQ ID NO: 695201 - protein, 9 aa, Homo Sapiens
SKKLQRFQR

SEQ ID NO: 695202 - protein, 9 aa, Homo Sapiens
GLPAGNIFH

SEQ ID NO: 695203 - protein, 9 aa, Homo Sapiens
PVIAKLVLE

SEQ ID NO: 695204 - protein, 9 aa, Homo Sapiens
DYGKQELVN

SEQ ID NO: 695205 - protein, 9 aa, Homo Sapiens
GSEGPSTSR

SEQ ID NO: 695206 - protein, 9 aa, Homo Sapiens
PEVPNEAEV

SEQ ID NO: 695207 - protein, 9 aa, Homo Sapiens
KTERSLENL

SEQ ID NO: 695208 - protein, 9 aa, Homo Sapiens
LVSITTFCM

SEQ ID NO: 695209 - protein, 9 aa, Homo Sapiens
QRPTNHVGL

SEQ ID NO: 695210 - protein, 9 aa, Homo Sapiens
ESRIKRLEQ

SEQ ID NO: 695211 - protein, 9 aa, Homo Sapiens
AVPAAAPKC

SEQ ID NO: 695212 - protein, 9 aa, Homo Sapiens
TLQYVQRPT

SEQ ID NO: 695213 - protein, 9 aa, Homo Sapiens
LNFHPNSAP

SEQ ID NO: 695214 - protein, 9 aa, Homo Sapiens
SEDLNNKTL

SEQ ID NO: 695215 - protein, 9 aa, Homo Sapiens
RGLSGSEGP

SEQ ID NO: 695216 - protein, 9 aa, Homo Sapiens
AEADDPEDM

SEQ ID NO: 695217 - protein, 9 aa, Homo Sapiens
EGVILVHAP

SEQ ID NO: 695218 - protein, 9 aa, Homo Sapiens
WKLQSLQQN

SEQ ID NO: 695219 - protein, 9 aa, Homo Sapiens
LEELVQELE

SEQ ID NO: 695220 - protein, 9 aa, Homo Sapiens
AVLEKLHLS

SEQ ID NO: 695221 - protein, 9 aa, Homo Sapiens
AANSPIGFC

SEQ ID NO: 695222 - protein, 9 aa, Homo Sapiens
KNQDLRYSL

SEQ ID NO: 695223 - protein, 9 aa, Homo Sapiens
KPDVMYTDI

SEQ ID NO: 695224 - protein, 9 aa, Homo Sapiens
FGSNVTQLQ

SEQ ID NO: 695225 - protein, 9 aa, Homo Sapiens
KVEGANTHL

SEQ ID NO: 695226 - protein, 9 aa, Homo Sapiens
DAANSPIGF

SEQ ID NO: 695227 - protein, 9 aa, Homo Sapiens
FINLLSVGH

SEQ ID NO: 695228 - protein, 9 aa, Homo Sapiens
SLPGPPGDG

SEQ ID NO: 695229 - protein, 9 aa, Homo Sapiens
GNVIVSLEG

SEQ ID NO: 695230 - protein, 9 aa, Homo Sapiens
GLSYVALNA

SEQ ID NO: 695231 - protein, 9 aa, Homo Sapiens
QPPGQRLLS

SEQ ID NO: 695232 - protein, 9 aa, Homo Sapiens
FTSGKYFWE

SEQ ID NO: 695233 - protein, 9 aa, Homo Sapiens
VALNASYQA

SEQ ID NO: 695234 - protein, 9 aa, Homo Sapiens
WFLITSNNQ

SEQ ID NO: 695235 - protein, 9 aa, Homo Sapiens
KTPHIDVPK

SEQ ID NO: 695236 - protein, 9 aa, Homo Sapiens
PCCQAICEP

SEQ ID NO: 695237 - protein, 9 aa, Homo Sapiens
DKTIINAGK

SEQ ID NO: 695238 - protein, 9 aa, Homo Sapiens
SGPCSSRYL

SEQ ID NO: 695239 - protein, 9 aa, Homo Sapiens
DSQVSETAT

SEQ ID NO: 695240 - protein, 9 aa, Homo Sapiens
KSQGLPQKP

SEQ ID NO: 695241 - protein, 9 aa, Homo Sapiens
RLLSAHRAG

SEQ ID NO: 695242 - protein, 9 aa, Homo Sapiens
EAILHNDFM

SEQ ID NO: 695243 - protein, 9 aa, Homo Sapiens
NQDLRYSLH

SEQ ID NO: 695244 - protein, 9 aa, Homo Sapiens
TLAVVTMSY

SEQ ID NO: 695245 - protein, 9 aa, Homo Sapiens
LDEKQCQRL

SEQ ID NO: 695246 - protein, 9 aa, Homo Sapiens
TLMLGNILG

SEQ ID NO: 695247 - protein, 9 aa, Homo Sapiens
GFDRQKRGY

SEQ ID NO: 695248 - protein, 9 aa, Homo Sapiens
CQHYHGMCL

SEQ ID NO: 695249 - protein, 9 aa, Homo Sapiens
FEDFTVFDS

SEQ ID NO: 695250 - protein, 9 aa, Homo Sapiens
LKLAKPLSC

SEQ ID NO: 695251 - protein, 9 aa, Homo Sapiens
MTVAFLAIF

SEQ ID NO: 695252 - protein, 9 aa, Homo Sapiens
EGMDDIRYG

SEQ ID NO: 695253 - protein, 9 aa, Homo Sapiens
TPSDAANSP

SEQ ID NO: 695254 - protein, 9 aa, Homo Sapiens
LDWHEAQGW

SEQ ID NO: 695255 - protein, 9 aa, Homo Sapiens
SDQGDDVVL

SEQ ID NO: 695256 - protein, 9 aa, Homo Sapiens
FPCVQGGTA

SEQ ID NO: 695257 - protein, 9 aa, Homo Sapiens
AENRALCLV

SEQ ID NO: 695258 - protein, 9 aa, Homo Sapiens
FITAPNGAL

SEQ ID NO: 695259 - protein, 9 aa, Homo Sapiens
AGNIFHCAM

SEQ ID NO: 695260 - protein, 9 aa, Homo Sapiens
SLFTSVLVS

SEQ ID NO: 695261 - protein, 9 aa, Homo Sapiens
KSLSQLLLD

SEQ ID NO: 695262 - protein, 9 aa, Homo Sapiens
DFLGSFCRC

SEQ ID NO: 695263 - protein, 9 aa, Homo Sapiens
EDSMSTLGG

SEQ ID NO: 695264 - protein, 9 aa, Homo Sapiens
TISHTMILQ

SEQ ID NO: 695265 - protein, 9 aa, Homo Sapiens
PCQADGVSA

SEQ ID NO: 695266 - protein, 9 aa, Homo Sapiens
FITCSSHLT

SEQ ID NO: 695267 - protein, 9 aa, Homo Sapiens
FGSCSLRAL

SEQ ID NO: 695268 - protein, 9 aa, Homo Sapiens
LKLISRDVL

SEQ ID NO: 695269 - protein, 9 aa, Homo Sapiens
GLILLIRED

SEQ ID NO: 695270 - protein, 9 aa, Homo Sapiens
TVQQVCNAV

SEQ ID NO: 695271 - protein, 9 aa, Homo Sapiens
AASSGCESS

SEQ ID NO: 695272 - protein, 9 aa, Homo Sapiens
PKAFFLLSN

SEQ ID NO: 695273 - protein, 9 aa, Homo Sapiens
SEGPSTSRI

SEQ ID NO: 695274 - protein, 9 aa, Homo Sapiens
PSVPQPPPG

SEQ ID NO: 695275 - protein, 9 aa, Homo Sapiens
WLTIVRATD

SEQ ID NO: 695276 - protein, 9 aa, Homo Sapiens
SSRMDSPKS

SEQ ID NO: 695277 - protein, 9 aa, Homo Sapiens
AVGHQYQSK

SEQ ID NO: 695278 - protein, 9 aa, Homo Sapiens
EGLSIHDST

SEQ ID NO: 695279 - protein, 9 aa, Homo Sapiens
YSRLPKQSF

SEQ ID NO: 695280 - protein, 9 aa, Homo Sapiens
FTGIKKYLN

SEQ ID NO: 695281 - protein, 9 aa, Homo Sapiens
RAVTTDAAH

SEQ ID NO: 695282 - protein, 9 aa, Homo Sapiens
INAGKDGDG

SEQ ID NO: 695283 - protein, 9 aa, Homo Sapiens
FGQFHEGDA

SEQ ID NO: 695284 - protein, 9 aa, Homo Sapiens
YLCLAGPCT

SEQ ID NO: 695285 - protein, 9 aa, Homo Sapiens
HNDFMKNLE

SEQ ID NO: 695286 - protein, 9 aa, Homo Sapiens
FATGDYPRL

SEQ ID NO: 695287 - protein, 9 aa, Homo Sapiens
FVVGMFVSG

SEQ ID NO: 695288 - protein, 9 aa, Homo Sapiens
FTFAFEKDI

SEQ ID NO: 695289 - protein, 9 aa, Homo Sapiens
RALNLSEHA

SEQ ID NO: 695290 - protein, 9 aa, Homo Sapiens
DPIGSLNES

SEQ ID NO: 695291 - protein, 9 aa, Homo Sapiens
PLIKTERSL

SEQ ID NO: 695292 - protein, 9 aa, Homo Sapiens
GEPLKVFEE

SEQ ID NO: 695293 - protein, 9 aa, Homo Sapiens
FGLPAGNIF

SEQ ID NO: 695294 - protein, 9 aa, Homo Sapiens
PVKTPSDAA

SEQ ID NO: 695295 - protein, 9 aa, Homo Sapiens
ALNSKILCV

SEQ ID NO: 695296 - protein, 9 aa, Homo Sapiens
DLADAVLEK

SEQ ID NO: 695297 - protein, 9 aa, Homo Sapiens
THRILRRIF

SEQ ID NO: 695298 - protein, 9 aa, Homo Sapiens
HGTYSLSGE

SEQ ID NO: 695299 - protein, 9 aa, Homo Sapiens
PLGSKSATP

SEQ ID NO: 695300 - protein, 9 aa, Homo Sapiens
FTVFDSWFK

SEQ ID NO: 695301 - protein, 9 aa, Homo Sapiens
KCAATIERH

SEQ ID NO: 695302 - protein, 9 aa, Homo Sapiens
EFKLCLETQ

SEQ ID NO: 695303 - protein, 9 aa, Homo Sapiens
GSLNESVSR

SEQ ID NO: 695304 - protein, 9 aa, Homo Sapiens
DSLFGSQTV

SEQ ID NO: 695305 - protein, 9 aa, Homo Sapiens
TSVKVIDAQ

SEQ ID NO: 695306 - protein, 9 aa, Homo Sapiens
LPKQSFGQF

SEQ ID NO: 695307 - protein, 9 aa, Homo Sapiens
SSPHCHIFQ

SEQ ID NO: 695308 - protein, 9 aa, Homo Sapiens
KKLQRFQRI

SEQ ID NO: 695309 - protein, 9 aa, Homo Sapiens
IPKVVKNPS

SEQ ID NO: 695310 - protein, 9 aa, Homo Sapiens
HASLCAMEV

SEQ ID NO: 695311 - protein, 9 aa, Homo Sapiens
MFVVGMFVS

SEQ ID NO: 695312 - protein, 9 aa, Homo Sapiens
FCPDHRLTS

SEQ ID NO: 695313 - protein, 9 aa, Homo Sapiens
VFATGDYPR

SEQ ID NO: 695314 - protein, 9 aa, Homo Sapiens
YDRFLLPPD

SEQ ID NO: 695315 - protein, 9 aa, Homo Sapiens
WQLTMEYQA

SEQ ID NO: 695316 - protein, 9 aa, Homo Sapiens
MLDEVWHLD

SEQ ID NO: 695317 - protein, 9 aa, Homo Sapiens
IHDSTWKSA

SEQ ID NO: 695318 - protein, 9 aa, Homo Sapiens
PVKSLSQLL

SEQ ID NO: 695319 - protein, 9 aa, Homo Sapiens
IAHSSPSPL

SEQ ID NO: 695320 - protein, 9 aa, Homo Sapiens
TIFHATVAS

SEQ ID NO: 695321 - protein, 9 aa, Homo Sapiens
TLKKYIAKL

SEQ ID NO: 695322 - protein, 9 aa, Homo Sapiens
YLRDIDFVE

SEQ ID NO: 695323 - protein, 9 aa, Homo Sapiens
RQEIGSRSR

SEQ ID NO: 695324 - protein, 9 aa, Homo Sapiens
PSVYLELTD

SEQ ID NO: 695325 - protein, 9 aa, Homo Sapiens
TRAHQVLIM

SEQ ID NO: 695326 - protein, 9 aa, Homo Sapiens
AIFITAPNG

SEQ ID NO: 695327 - protein, 9 aa, Homo Sapiens
SCSLAGEFR

SEQ ID NO: 695328 - protein, 9 aa, Homo Sapiens
AQGWAVPAA

SEQ ID NO: 695329 - protein, 9 aa, Homo Sapiens
AQVGLARAR

SEQ ID NO: 695330 - protein, 9 aa, Homo Sapiens
GECVITPCT

SEQ ID NO: 695331 - protein, 9 aa, Homo Sapiens
VTTDAAHPG

SEQ ID NO: 695332 - protein, 9 aa, Homo Sapiens
REPQEYTLP

SEQ ID NO: 695333 - protein, 9 aa, Homo Sapiens
FDEGDGDGE

SEQ ID NO: 695334 - protein, 9 aa, Homo Sapiens
KYLSTTLML

SEQ ID NO: 695335 - protein, 9 aa, Homo Sapiens
EIYMNQDGL

SEQ ID NO: 695336 - protein, 9 aa, Homo Sapiens
DSSVSVQLW

SEQ ID NO: 695337 - protein, 9 aa, Homo Sapiens
ATLAFSDIL

SEQ ID NO: 695338 - protein, 9 aa, Homo Sapiens
SCIIQSHLY

SEQ ID NO: 695339 - protein, 9 aa, Homo Sapiens
QKRGYRDIN

SEQ ID NO: 695340 - protein, 9 aa, Homo Sapiens
GSPEMTFGK

SEQ ID NO: 695341 - protein, 9 aa, Homo Sapiens
NGKSTIFHA

SEQ ID NO: 695342 - protein, 9 aa, Homo Sapiens
QKPSFRGIS

SEQ ID NO: 695343 - protein, 9 aa, Homo Sapiens
GASPSEASG

SEQ ID NO: 695344 - protein, 9 aa, Homo Sapiens
DVVTKEAES

SEQ ID NO: 695345 - protein, 9 aa, Homo Sapiens
CRTRQVTRY

SEQ ID NO: 695346 - protein, 9 aa, Homo Sapiens
VTPIVHDVA

SEQ ID NO: 695347 - protein, 9 aa, Homo Sapiens
DVPEGVILV

SEQ ID NO: 695348 - protein, 9 aa, Homo Sapiens
DILCITISH

SEQ ID NO: 695349 - protein, 9 aa, Homo Sapiens
CVMEAYHLS

SEQ ID NO: 695350 - protein, 9 aa, Homo Sapiens
TAAIPGAFG

SEQ ID NO: 695351 - protein, 9 aa, Homo Sapiens
SLRALSQEF

SEQ ID NO: 695352 - protein, 9 aa, Homo Sapiens
GMGLLVPGG

SEQ ID NO: 695353 - protein, 9 aa, Homo Sapiens
HDSLFGSQT

SEQ ID NO: 695354 - protein, 9 aa, Homo Sapiens
STWKSAIYG

SEQ ID NO: 695355 - protein, 9 aa, Homo Sapiens
IKTERSLEN

SEQ ID NO: 695356 - protein, 9 aa, Homo Sapiens
VETETPGDG

SEQ ID NO: 695357 - protein, 9 aa, Homo Sapiens
VILVHAPLL

SEQ ID NO: 695358 - protein, 9 aa, Homo Sapiens
TQQLMDFWS

SEQ ID NO: 695359 - protein, 9 aa, Homo Sapiens
GMFLNVIYP

SEQ ID NO: 695360 - protein, 9 aa, Homo Sapiens
PPGQPSPVL

SEQ ID NO: 695361 - protein, 9 aa, Homo Sapiens
LLSSPHCHI

SEQ ID NO: 695362 - protein, 9 aa, Homo Sapiens
VSSPCCQAI

SEQ ID NO: 695363 - protein, 9 aa, Homo Sapiens
KEETELRFW

SEQ ID NO: 695364 - protein, 9 aa, Homo Sapiens
KPQGWDQCL

SEQ ID NO: 695365 - protein, 9 aa, Homo Sapiens
MRNMLDEVW

SEQ ID NO: 695366 - protein, 9 aa, Homo Sapiens
NYAEWYLRD

SEQ ID NO: 695367 - protein, 9 aa, Homo Sapiens
LGGNVIVSL

SEQ ID NO: 695368 - protein, 9 aa, Homo Sapiens
SVSINKECS

SEQ ID NO: 695369 - protein, 9 aa, Homo Sapiens
ATIERHLQC

SEQ ID NO: 695370 - protein, 9 aa, Homo Sapiens
EVFKRACIP

SEQ ID NO: 695371 - protein, 9 aa, Homo Sapiens
AKLSLAVTD

SEQ ID NO: 695372 - protein, 9 aa, Homo Sapiens
ALTHLCMGL

SEQ ID NO: 695373 - protein, 9 aa, Homo Sapiens
RGPQWWLKT

SEQ ID NO: 695374 - protein, 9 aa, Homo Sapiens
KEKLIKEMD

SEQ ID NO: 695375 - protein, 9 aa, Homo Sapiens
ERRSPPTTA

SEQ ID NO: 695376 - protein, 9 aa, Homo Sapiens
AFITCSSHL

SEQ ID NO: 695377 - protein, 9 aa, Homo Sapiens
PITLPVEEV

SEQ ID NO: 695378 - protein, 9 aa, Homo Sapiens
KSNISVLQK

SEQ ID NO: 695379 - protein, 9 aa, Homo Sapiens
GAKFMFVVG

SEQ ID NO: 695380 - protein, 9 aa, Homo Sapiens
EKLGGNVIV

SEQ ID NO: 695381 - protein, 9 aa, Homo Sapiens
NGEPLKVFE

SEQ ID NO: 695382 - protein, 9 aa, Homo Sapiens
NYDGKNLKI

SEQ ID NO: 695383 - protein, 9 aa, Homo Sapiens
EAHGGLYEI

SEQ ID NO: 695384 - protein, 9 aa, Homo Sapiens
VIITRPLED

SEQ ID NO: 695385 - protein, 9 aa, Homo Sapiens
TLDWHEAQG

SEQ ID NO: 695386 - protein, 9 aa, Homo Sapiens
RSPPTTALC

SEQ ID NO: 695387 - protein, 9 aa, Homo Sapiens
RLYQGVPRL

SEQ ID NO: 695388 - protein, 9 aa, Homo Sapiens
SAFPCPVSA

SEQ ID NO: 695389 - protein, 9 aa, Homo Sapiens
GEGLRDSAG

SEQ ID NO: 695390 - protein, 9 aa, Homo Sapiens
GFTQCCEQM

SEQ ID NO: 695391 - protein, 9 aa, Homo Sapiens
AGCRDVAGG

SEQ ID NO: 695392 - protein, 9 aa, Homo Sapiens
LFLTTELFA

SEQ ID NO: 695393 - protein, 9 aa, Homo Sapiens
LATDPSYLC

SEQ ID NO: 695394 - protein, 9 aa, Homo Sapiens
VPLRPTEIS

SEQ ID NO: 695395 - protein, 9 aa, Homo Sapiens
DGVSAPLVS

SEQ ID NO: 695396 - protein, 9 aa, Homo Sapiens
RDLEKKKGL

SEQ ID NO: 695397 - protein, 9 aa, Homo Sapiens
FGNVTDSTL

SEQ ID NO: 695398 - protein, 9 aa, Homo Sapiens
TCCQHYHGM

SEQ ID NO: 695399 - protein, 9 aa, Homo Sapiens
SSKKLQRFQ

SEQ ID NO: 695400 - protein, 9 aa, Homo Sapiens
AGMFLNVIY

SEQ ID NO: 695401 - protein, 9 aa, Homo Sapiens
KSTIFHATV

SEQ ID NO: 695402 - protein, 9 aa, Homo Sapiens
DHKLDEKQC

SEQ ID NO: 695403 - protein, 9 aa, Homo Sapiens
QSKCKPSQG

SEQ ID NO: 695404 - protein, 9 aa, Homo Sapiens
GPSVPQPPP

SEQ ID NO: 695405 - protein, 9 aa, Homo Sapiens
CVTPIVHDV

SEQ ID NO: 695406 - protein, 9 aa, Homo Sapiens
YQGVPRLPT

SEQ ID NO: 695407 - protein, 9 aa, Homo Sapiens
GDGDGEDEE

SEQ ID NO: 695408 - protein, 9 aa, Homo Sapiens
GWALGARLY

SEQ ID NO: 695409 - protein, 9 aa, Homo Sapiens
TLKVEGANT

SEQ ID NO: 695410 - protein, 9 aa, Homo Sapiens
NRIGRPMVA

SEQ ID NO: 695411 - protein, 9 aa, Homo Sapiens
SPEMTFGKG

SEQ ID NO: 695412 - protein, 9 aa, Homo Sapiens
PHIDVPKEN

SEQ ID NO: 695413 - protein, 9 aa, Homo Sapiens
ATPRTNFKF

SEQ ID NO: 695414 - protein, 9 aa, Homo Sapiens
HLPGSQPPG

SEQ ID NO: 695415 - protein, 9 aa, Homo Sapiens
LVNISDQGD

SEQ ID NO: 695416 - protein, 9 aa, Homo Sapiens
RHLDMVECV

SEQ ID NO: 695417 - protein, 9 aa, Homo Sapiens
FTSVLVSLT

SEQ ID NO: 695418 - protein, 9 aa, Homo Sapiens
PHCHIFQTL

SEQ ID NO: 695419 - protein, 9 aa, Homo Sapiens
SVLVIKLQQ

SEQ ID NO: 695420 - protein, 9 aa, Homo Sapiens
QAGAAAQQL

SEQ ID NO: 695421 - protein, 9 aa, Homo Sapiens
KLSLAVTDT

SEQ ID NO: 695422 - protein, 9 aa, Homo Sapiens
AAPKCAATI

SEQ ID NO: 695423 - protein, 9 aa, Homo Sapiens
LPRMAAAHG

SEQ ID NO: 695424 - protein, 9 aa, Homo Sapiens
SRMDSPKSA

SEQ ID NO: 695425 - protein, 9 aa, Homo Sapiens
AATIERHLQ

SEQ ID NO: 695426 - protein, 9 aa, Homo Sapiens
YVTERIISM

SEQ ID NO: 695427 - protein, 9 aa, Homo Sapiens
LIKEAILHN

SEQ ID NO: 695428 - protein, 9 aa, Homo Sapiens
VLVIKLQQL

SEQ ID NO: 695429 - protein, 9 aa, Homo Sapiens
DPSYLCLAG

SEQ ID NO: 695430 - protein, 9 aa, Homo Sapiens
CPVSAMELS

SEQ ID NO: 695431 - protein, 9 aa, Homo Sapiens
ELFAALGPI

SEQ ID NO: 695432 - protein, 9 aa, Homo Sapiens
EQTWSQAGI

SEQ ID NO: 695433 - protein, 9 aa, Homo Sapiens
RFFQSFLDA

SEQ ID NO: 695434 - protein, 9 aa, Homo Sapiens
NPSALELRS

SEQ ID NO: 695435 - protein, 9 aa, Homo Sapiens
AAGMFLNVI

SEQ ID NO: 695436 - protein, 9 aa, Homo Sapiens
RSLENLTKN

SEQ ID NO: 695437 - protein, 9 aa, Homo Sapiens
GKDGDGRIS

SEQ ID NO: 695438 - protein, 9 aa, Homo Sapiens
SQAGISKTC

SEQ ID NO: 695439 - protein, 9 aa, Homo Sapiens
AHSSPSPLG

SEQ ID NO: 695440 - protein, 9 aa, Homo Sapiens
SLLVTATLT

SEQ ID NO: 695441 - protein, 9 aa, Homo Sapiens
QSFGQFHEG

SEQ ID NO: 695442 - protein, 9 aa, Homo Sapiens
LHNDFMKNL

SEQ ID NO: 695443 - protein, 9 aa, Homo Sapiens
GLTQYFGVN

SEQ ID NO: 695444 - protein, 9 aa, Homo Sapiens
GNAAFVNQY

SEQ ID NO: 695445 - protein, 9 aa, Homo Sapiens
EYTLPPSQK

SEQ ID NO: 695446 - protein, 9 aa, Homo Sapiens
AASPDIRDL

SEQ ID NO: 695447 - protein, 9 aa, Homo Sapiens
TEEVQPKAF

SEQ ID NO: 695448 - protein, 9 aa, Homo Sapiens
FCRCHLTEP

SEQ ID NO: 695449 - protein, 9 aa, Homo Sapiens
QNIHVHEPN

SEQ ID NO: 695450 - protein, 9 aa, Homo Sapiens
GGLLAITPL

SEQ ID NO: 695451 - protein, 9 aa, Homo Sapiens
GGSPRMAYP

SEQ ID NO: 695452 - protein, 9 aa, Homo Sapiens
NEVPEDSLE

SEQ ID NO: 695453 - protein, 9 aa, Homo Sapiens
QDKIAAGMF

SEQ ID NO: 695454 - protein, 9 aa, Homo Sapiens
RPTEISLTS

SEQ ID NO: 695455 - protein, 9 aa, Homo Sapiens
SRIKRLEQR

SEQ ID NO: 695456 - protein, 9 aa, Homo Sapiens
LGARLYQGV

SEQ ID NO: 695457 - protein, 9 aa, Homo Sapiens
QPLQCINTG

SEQ ID NO: 695458 - protein, 9 aa, Homo Sapiens
PQRDELLVP

SEQ ID NO: 695459 - protein, 9 aa, Homo Sapiens
GVGGMGLLV

SEQ ID NO: 695460 - protein, 9 aa, Homo Sapiens
VITPCTDVK

SEQ ID NO: 695461 - protein, 9 aa, Homo Sapiens
LLVFSKWEW

SEQ ID NO: 695462 - protein, 9 aa, Homo Sapiens
STLLFFMVR

SEQ ID NO: 695463 - protein, 9 aa, Homo Sapiens
EGDGDGEDE

SEQ ID NO: 695464 - protein, 9 aa, Homo Sapiens
HIGVILSFS

SEQ ID NO: 695465 - protein, 9 aa, Homo Sapiens
LVKHQAPSD

SEQ ID NO: 695466 - protein, 9 aa, Homo Sapiens
CGGASLKNQ

SEQ ID NO: 695467 - protein, 9 aa, Homo Sapiens
LEKKKGLFR

SEQ ID NO: 695468 - protein, 9 aa, Homo Sapiens
WGWALGARL

SEQ ID NO: 695469 - protein, 9 aa, Homo Sapiens
YLSTTLMLG

SEQ ID NO: 695470 - protein, 9 aa, Homo Sapiens
QGGTAAIPG

SEQ ID NO: 695471 - protein, 9 aa, Homo Sapiens
LEYDRFLLP

SEQ ID NO: 695472 - protein, 9 aa, Homo Sapiens
ERSLENLTK

SEQ ID NO: 695473 - protein, 9 aa, Homo Sapiens
GVSAPLVSW

SEQ ID NO: 695474 - protein, 9 aa, Homo Sapiens
DDIRYGCPS

SEQ ID NO: 695475 - protein, 9 aa, Homo Sapiens
LGLILLIRE

SEQ ID NO: 695476 - protein, 9 aa, Homo Sapiens
NVVFATGDY

SEQ ID NO: 695477 - protein, 9 aa, Homo Sapiens
VKSLSQLLL

SEQ ID NO: 695478 - protein, 9 aa, Homo Sapiens
FFCTTCCQH

SEQ ID NO: 695479 - protein, 9 aa, Homo Sapiens
VGSPEMTFG

SEQ ID NO: 695480 - protein, 9 aa, Homo Sapiens
QLRRGPHGS

SEQ ID NO: 695481 - protein, 9 aa, Homo Sapiens
SVANRSGVN

SEQ ID NO: 695482 - protein, 9 aa, Homo Sapiens
DAQRRRSPS

SEQ ID NO: 695483 - protein, 9 aa, Homo Sapiens
DQELYVFDT

SEQ ID NO: 695484 - protein, 9 aa, Homo Sapiens
MDHFTLVVH

SEQ ID NO: 695485 - protein, 9 aa, Homo Sapiens
VEEKYEPQD

SEQ ID NO: 695486 - protein, 9 aa, Homo Sapiens
VWHLDPVIA

SEQ ID NO: 695487 - protein, 9 aa, Homo Sapiens
WHLDPVIAK

SEQ ID NO: 695488 - protein, 9 aa, Homo Sapiens
ANSPIGFCP

SEQ ID NO: 695489 - protein, 9 aa, Homo Sapiens
VSQGLFCPD

SEQ ID NO: 695490 - protein, 9 aa, Homo Sapiens
IFGNVTDST

SEQ ID NO: 695491 - protein, 9 aa, Homo Sapiens
LAITPLVCI

SEQ ID NO: 695492 - protein, 9 aa, Homo Sapiens
LACASDHVK

SEQ ID NO: 695493 - protein, 9 aa, Homo Sapiens
KEPPVIITR

SEQ ID NO: 695494 - protein, 9 aa, Homo Sapiens
KGQTVQQVC

SEQ ID NO: 695495 - protein, 9 aa, Homo Sapiens
NFINLLSVG

SEQ ID NO: 695496 - protein, 9 aa, Homo Sapiens
VAFLAIFIT

SEQ ID NO: 695497 - protein, 9 aa, Homo Sapiens
HVTSRSCSE

SEQ ID NO: 695498 - protein, 9 aa, Homo Sapiens
FQKMKSNIS

SEQ ID NO: 695499 - protein, 9 aa, Homo Sapiens
ILHNDFMKN

SEQ ID NO: 695500 - protein, 9 aa, Homo Sapiens
DKSNPPEGS

SEQ ID NO: 695501 - protein, 9 aa, Homo Sapiens
AAPITLPVE

SEQ ID NO: 695502 - protein, 9 aa, Homo Sapiens
PGARLGASL

SEQ ID NO: 695503 - protein, 9 aa, Homo Sapiens
VTWNRRSSA

SEQ ID NO: 695504 - protein, 9 aa, Homo Sapiens
LVHKFLLVF

SEQ ID NO: 695505 - protein, 9 aa, Homo Sapiens
CAENRALCL

SEQ ID NO: 695506 - protein, 9 aa, Homo Sapiens
KIFGNVTDS

SEQ ID NO: 695507 - protein, 9 aa, Homo Sapiens
RELMSLVSG

SEQ ID NO: 695508 - protein, 9 aa, Homo Sapiens
EGLRDSAGG

SEQ ID NO: 695509 - protein, 9 aa, Homo Sapiens
LLLLEEQLS

SEQ ID NO: 695510 - protein, 9 aa, Homo Sapiens
CECRPHVTS

SEQ ID NO: 695511 - protein, 9 aa, Homo Sapiens
LFFMVRKAM

SEQ ID NO: 695512 - protein, 9 aa, Homo Sapiens
NYSCSAQGT

SEQ ID NO: 695513 - protein, 9 aa, Homo Sapiens
INSPASPLT

SEQ ID NO: 695514 - protein, 9 aa, Homo Sapiens
MIVGSPEMT

SEQ ID NO: 695515 - protein, 9 aa, Homo Sapiens
GHQYQSKLS

SEQ ID NO: 695516 - protein, 9 aa, Homo Sapiens
SVSRMRNML

SEQ ID NO: 695517 - protein, 9 aa, Homo Sapiens
HIFQTLSDD

SEQ ID NO: 695518 - protein, 9 aa, Homo Sapiens
SFINSPASP

SEQ ID NO: 695519 - protein, 9 aa, Homo Sapiens
TTTPRSILA

SEQ ID NO: 695520 - protein, 9 aa, Homo Sapiens
MLENFINLL

SEQ ID NO: 695521 - protein, 9 aa, Homo Sapiens
TCVTPIVHD

SEQ ID NO: 695522 - protein, 9 aa, Homo Sapiens
VVTMSYEEQ

SEQ ID NO: 695523 - protein, 9 aa, Homo Sapiens
DTRAAIALP

SEQ ID NO: 695524 - protein, 9 aa, Homo Sapiens
NILSLLVTA

SEQ ID NO: 695525 - protein, 9 aa, Homo Sapiens
SKSQSKCKP

SEQ ID NO: 695526 - protein, 9 aa, Homo Sapiens
FCMETHEAF

SEQ ID NO: 695527 - protein, 9 aa, Homo Sapiens
PKSAADFIQ

SEQ ID NO: 695528 - protein, 9 aa, Homo Sapiens
SQVSETATR

SEQ ID NO: 695529 - protein, 9 aa, Homo Sapiens
PLSCLTPLI

SEQ ID NO: 695530 - protein, 9 aa, Homo Sapiens
LTIVRATDD

SEQ ID NO: 695531 - protein, 9 aa, Homo Sapiens
TETPGDGCS

SEQ ID NO: 695532 - protein, 9 aa, Homo Sapiens
EKKVRRDII

SEQ ID NO: 695533 - protein, 9 aa, Homo Sapiens
KCSVPTVRV

SEQ ID NO: 695534 - protein, 9 aa, Homo Sapiens
GVILVHAPL

SEQ ID NO: 695535 - protein, 9 aa, Homo Sapiens
PRRKHASLC

SEQ ID NO: 695536 - protein, 9 aa, Homo Sapiens
KAISYHYVC

SEQ ID NO: 695537 - protein, 9 aa, Homo Sapiens
EHGASPSEA

SEQ ID NO: 695538 - protein, 9 aa, Homo Sapiens
LTYLQRRHT

SEQ ID NO: 695539 - protein, 9 aa, Homo Sapiens
HDHGTYSLS

SEQ ID NO: 695540 - protein, 9 aa, Homo Sapiens
MFLNVIYPP

SEQ ID NO: 695541 - protein, 9 aa, Homo Sapiens
NILSFINSP

SEQ ID NO: 695542 - protein, 9 aa, Homo Sapiens
CHRPQSSDC

SEQ ID NO: 695543 - protein, 9 aa, Homo Sapiens
IAAITLRGP

SEQ ID NO: 695544 - protein, 9 aa, Homo Sapiens
NMLDEVWHL

SEQ ID NO: 695545 - protein, 9 aa, Homo Sapiens
HLCMGLSTV

SEQ ID NO: 695546 - protein, 9 aa, Homo Sapiens
YFWEVHMGD

SEQ ID NO: 695547 - protein, 9 aa, Homo Sapiens
IFQTLSDDC

SEQ ID NO: 695548 - protein, 9 aa, Homo Sapiens
SSSPDYKLL

SEQ ID NO: 695549 - protein, 9 aa, Homo Sapiens
VKFQKMKSN

SEQ ID NO: 695550 - protein, 9 aa, Homo Sapiens
FPSEDLNNK

SEQ ID NO: 695551 - protein, 9 aa, Homo Sapiens
SGLSYVALN

SEQ ID NO: 695552 - protein, 9 aa, Homo Sapiens
LAKPLSCLT

SEQ ID NO: 695553 - protein, 9 aa, Homo Sapiens
SGKYFWEVH

SEQ ID NO: 695554 - protein, 9 aa, Homo Sapiens
LIKTERSLE

SEQ ID NO: 695555 - protein, 9 aa, Homo Sapiens
RVECCFSCP

SEQ ID NO: 695556 - protein, 9 aa, Homo Sapiens
HLACASDHV

SEQ ID NO: 695557 - protein, 9 aa, Homo Sapiens
GRADEHSVM

SEQ ID NO: 695558 - protein, 9 aa, Homo Sapiens
LSEHARGGF

SEQ ID NO: 695559 - protein, 9 aa, Homo Sapiens
DGLDGFPSL

SEQ ID NO: 695560 - protein, 9 aa, Homo Sapiens
HGGLYEIYM

SEQ ID NO: 695561 - protein, 9 aa, Homo Sapiens
WAVPAAAPK

SEQ ID NO: 695562 - protein, 9 aa, Homo Sapiens
TVNLTWPRA

SEQ ID NO: 695563 - protein, 9 aa, Homo Sapiens
SPSEASGNL

SEQ ID NO: 695564 - protein, 9 aa, Homo Sapiens
IDAQRRRSP

SEQ ID NO: 695565 - protein, 9 aa, Homo Sapiens
FLSMLALTH

SEQ ID NO: 695566 - protein, 9 aa, Homo Sapiens
MILLIYLDT

SEQ ID NO: 695567 - protein, 9 aa, Homo Sapiens
ATGDYPRLS

SEQ ID NO: 695568 - protein, 9 aa, Homo Sapiens
DLHKVSCGK

SEQ ID NO: 695569 - protein, 9 aa, Homo Sapiens
AQVASVFYM

SEQ ID NO: 695570 - protein, 9 aa, Homo Sapiens
ETLKTPHID

SEQ ID NO: 695571 - protein, 9 aa, Homo Sapiens
VEGANTHLE

SEQ ID NO: 695572 - protein, 9 aa, Homo Sapiens
KVLKNYGTI

SEQ ID NO: 695573 - protein, 9 aa, Homo Sapiens
VIKLQQLIR

SEQ ID NO: 695574 - protein, 9 aa, Homo Sapiens
IHIQHSLLL

SEQ ID NO: 695575 - protein, 9 aa, Homo Sapiens
SFQFDEGDG

SEQ ID NO: 695576 - protein, 9 aa, Homo Sapiens
SQRFFQSFL

SEQ ID NO: 695577 - protein, 9 aa, Homo Sapiens
AFLAIFITA

SEQ ID NO: 695578 - protein, 9 aa, Homo Sapiens
LEEENRILP

SEQ ID NO: 695579 - protein, 9 aa, Homo Sapiens
YEIYMNQDG

SEQ ID NO: 695580 - protein, 9 aa, Homo Sapiens
GLTYLQRRH

SEQ ID NO: 695581 - protein, 9 aa, Homo Sapiens
CSFQEWYHL

SEQ ID NO: 695582 - protein, 9 aa, Homo Sapiens
SVPTVRVEC

SEQ ID NO: 695583 - protein, 9 aa, Homo Sapiens
NSVMILLIY

SEQ ID NO: 695584 - protein, 9 aa, Homo Sapiens
EDLNNKTLS

SEQ ID NO: 695585 - protein, 9 aa, Homo Sapiens
HLNFHPNSA

SEQ ID NO: 695586 - protein, 9 aa, Homo Sapiens
TAHFTLLLL

SEQ ID NO: 695587 - protein, 9 aa, Homo Sapiens
RQAGAAAQQ

SEQ ID NO: 695588 - protein, 9 aa, Homo Sapiens
DKCVFNFKP

SEQ ID NO: 695589 - protein, 9 aa, Homo Sapiens
SPIDQELYV

SEQ ID NO: 695590 - protein, 9 aa, Homo Sapiens
NHSFVHHIR

SEQ ID NO: 695591 - protein, 9 aa, Homo Sapiens
RFRAEEKGC

SEQ ID NO: 695592 - protein, 9 aa, Homo Sapiens
PMKTQTVQK

SEQ ID NO: 695593 - protein, 9 aa, Homo Sapiens
KDIGNYSCS

SEQ ID NO: 695594 - protein, 9 aa, Homo Sapiens
ELKNILSLL

SEQ ID NO: 695595 - protein, 9 aa, Homo Sapiens
LQRFQRISD

SEQ ID NO: 695596 - protein, 9 aa, Homo Sapiens
KQCQRLTQR

SEQ ID NO: 695597 - protein, 9 aa, Homo Sapiens
WYLRDIDFV

SEQ ID NO: 695598 - protein, 9 aa, Homo Sapiens
KEAILHNDF

SEQ ID NO: 695599 - protein, 9 aa, Homo Sapiens
EWYHLPCRH

SEQ ID NO: 695600 - protein, 9 aa, Homo Sapiens
FTLLLLFAL

SEQ ID NO: 695601 - protein, 9 aa, Homo Sapiens
AILHNDFMK

SEQ ID NO: 695602 - protein, 9 aa, Homo Sapiens
PAAAPKCAA

SEQ ID NO: 695603 - protein, 9 aa, Homo Sapiens
WEIERELKE

SEQ ID NO: 695604 - protein, 9 aa, Homo Sapiens
CSCSFQEWY

SEQ ID NO: 695605 - protein, 9 aa, Homo Sapiens
SIHDSTWKS

SEQ ID NO: 695606 - protein, 9 aa, Homo Sapiens
MISGLSYVA

SEQ ID NO: 695607 - protein, 9 aa, Homo Sapiens
ALGARLYQG

SEQ ID NO: 695608 - protein, 9 aa, Homo Sapiens
EENRILPQA

SEQ ID NO: 695609 - protein, 9 aa, Homo Sapiens
IDQELYVFD

SEQ ID NO: 695610 - protein, 9 aa, Homo Sapiens
HQSPVEEKY

SEQ ID NO: 695611 - protein, 9 aa, Homo Sapiens
KLSLFTSVL

SEQ ID NO: 695612 - protein, 9 aa, Homo Sapiens
MSKFEDFTV

SEQ ID NO: 695613 - protein, 9 aa, Homo Sapiens
DEEVFKRAC

SEQ ID NO: 695614 - protein, 9 aa, Homo Sapiens
TLLFFMVRK

SEQ ID NO: 695615 - protein, 9 aa, Homo Sapiens
ISYHYVCRT

SEQ ID NO: 695616 - protein, 9 aa, Homo Sapiens
DSMSTLGGR

SEQ ID NO: 695617 - protein, 9 aa, Homo Sapiens
QTVQQVCNA

SEQ ID NO: 695618 - protein, 9 aa, Homo Sapiens
DVMLENFIN

SEQ ID NO: 695619 - protein, 9 aa, Homo Sapiens
QTWSQAGIS

SEQ ID NO: 695620 - protein, 9 aa, Homo Sapiens
VIDAQRRRS

SEQ ID NO: 695621 - protein, 9 aa, Homo Sapiens
LLVTATLTI

SEQ ID NO: 695622 - protein, 9 aa, Homo Sapiens
PRMAYPTYS

SEQ ID NO: 695623 - protein, 9 aa, Homo Sapiens
VKIWHLHNY

SEQ ID NO: 695624 - protein, 9 aa, Homo Sapiens
RLPTWRCLP

SEQ ID NO: 695625 - protein, 9 aa, Homo Sapiens
HQAPSDEEL

SEQ ID NO: 695626 - protein, 9 aa, Homo Sapiens
MQAHWLQKV

SEQ ID NO: 695627 - protein, 9 aa, Homo Sapiens
IKEAILHND

SEQ ID NO: 695628 - protein, 9 aa, Homo Sapiens
GGRRGMRPK

SEQ ID NO: 695629 - protein, 9 aa, Homo Sapiens
EQLFETFQD

SEQ ID NO: 695630 - protein, 9 aa, Homo Sapiens
FSGPCSSRY

SEQ ID NO: 695631 - protein, 9 aa, Homo Sapiens
RAAIALPRM

SEQ ID NO: 695632 - protein, 9 aa, Homo Sapiens
GGAKPGPGA

SEQ ID NO: 695633 - protein, 9 aa, Homo Sapiens
SGFHDHGTY

SEQ ID NO: 695634 - protein, 9 aa, Homo Sapiens
SAQGTQTGS

SEQ ID NO: 695635 - protein, 9 aa, Homo Sapiens
FYMIVIPML

SEQ ID NO: 695636 - protein, 9 aa, Homo Sapiens
KILCVMEAY

SEQ ID NO: 695637 - protein, 9 aa, Homo Sapiens
SAVGHQYQS

SEQ ID NO: 695638 - protein, 9 aa, Homo Sapiens
CSSRYLGEF

SEQ ID NO: 695639 - protein, 9 aa, Homo Sapiens
CCEQMLHAL

SEQ ID NO: 695640 - protein, 9 aa, Homo Sapiens
AKPVKSLSQ

SEQ ID NO: 695641 - protein, 9 aa, Homo Sapiens
LALLTAHFT

SEQ ID NO: 695642 - protein, 9 aa, Homo Sapiens
KTQTVQKPC

SEQ ID NO: 695643 - protein, 9 aa, Homo Sapiens
SINKECSRV

SEQ ID NO: 695644 - protein, 9 aa, Homo Sapiens
LTLLSCFYI

SEQ ID NO: 695645 - protein, 9 aa, Homo Sapiens
TEQYLEYDR

SEQ ID NO: 695646 - protein, 9 aa, Homo Sapiens
LDPVIAKLV

SEQ ID NO: 695647 - protein, 9 aa, Homo Sapiens
ANRETEKYN

SEQ ID NO: 695648 - protein, 9 aa, Homo Sapiens
ADEHSVMPP

SEQ ID NO: 695649 - protein, 9 aa, Homo Sapiens
ETATRISLL

SEQ ID NO: 695650 - protein, 9 aa, Homo Sapiens
VVGMFVSGG

SEQ ID NO: 695651 - protein, 9 aa, Homo Sapiens
GLLVPGGLP

SEQ ID NO: 695652 - protein, 9 aa, Homo Sapiens
ELDYGKQEL

SEQ ID NO: 695653 - protein, 9 aa, Homo Sapiens
NRETEKYNQ

SEQ ID NO: 695654 - protein, 9 aa, Homo Sapiens
LLSLCCMPF

SEQ ID NO: 695655 - protein, 9 aa, Homo Sapiens
VASVFYMIV

SEQ ID NO: 695656 - protein, 9 aa, Homo Sapiens
GKNLKIKPF

SEQ ID NO: 695657 - protein, 9 aa, Homo Sapiens
KSSAQVGLA

SEQ ID NO: 695658 - protein, 9 aa, Homo Sapiens
QADGVSAPL

SEQ ID NO: 695659 - protein, 9 aa, Homo Sapiens
LCLAGPCTF

SEQ ID NO: 695660 - protein, 9 aa, Homo Sapiens
MDVVTKEAE

SEQ ID NO: 695661 - protein, 9 aa, Homo Sapiens
QPREPQEYT

SEQ ID NO: 695662 - protein, 9 aa, Homo Sapiens
SRELMSLVS

SEQ ID NO: 695663 - protein, 9 aa, Homo Sapiens
APITLPVEE

SEQ ID NO: 695664 - protein, 9 aa, Homo Sapiens
HAKQSVANR

SEQ ID NO: 695665 - protein, 9 aa, Homo Sapiens
KLQQLIRNG

SEQ ID NO: 695666 - protein, 9 aa, Homo Sapiens
ISHFMPSYH

SEQ ID NO: 695667 - protein, 9 aa, Homo Sapiens
IEYESRIKR

SEQ ID NO: 695668 - protein, 9 aa, Homo Sapiens
DQFFCTTCC

SEQ ID NO: 695669 - protein, 9 aa, Homo Sapiens
ITPLVCILV

SEQ ID NO: 695670 - protein, 9 aa, Homo Sapiens
LHLQNIHVH

SEQ ID NO: 695671 - protein, 9 aa, Homo Sapiens
PAASSGCES

SEQ ID NO: 695672 - protein, 9 aa, Homo Sapiens
PQGWDQCLQ

SEQ ID NO: 695673 - protein, 9 aa, Homo Sapiens
HQYQSKLSK

SEQ ID NO: 695674 - protein, 9 aa, Homo Sapiens
LFTSVLVSL

SEQ ID NO: 695675 - protein, 9 aa, Homo Sapiens
TVFDSWFKV

SEQ ID NO: 695676 - protein, 9 aa, Homo Sapiens
MAGLFSISV

SEQ ID NO: 695677 - protein, 9 aa, Homo Sapiens
LVHAPLLSK

SEQ ID NO: 695678 - protein, 9 aa, Homo Sapiens
MPVEDKSNP

SEQ ID NO: 695679 - protein, 9 aa, Homo Sapiens
QLFETFQDE

SEQ ID NO: 695680 - protein, 9 aa, Homo Sapiens
DEDPSACTT

SEQ ID NO: 695681 - protein, 9 aa, Homo Sapiens
ITLRGPQWW

SEQ ID NO: 695682 - protein, 9 aa, Homo Sapiens
QFTGIKKYL

SEQ ID NO: 695683 - protein, 9 aa, Homo Sapiens
TKHTPTNGK

SEQ ID NO: 695684 - protein, 9 aa, Homo Sapiens
DMNHSFVHH

SEQ ID NO: 695685 - protein, 9 aa, Homo Sapiens
LLSCFYIIT

SEQ ID NO: 695686 - protein, 9 aa, Homo Sapiens
SVFYMIVIP

SEQ ID NO: 695687 - protein, 9 aa, Homo Sapiens
SPLGSKSAT

SEQ ID NO: 695688 - protein, 9 aa, Homo Sapiens
PRTNFKFPI

SEQ ID NO: 695689 - protein, 9 aa, Homo Sapiens
LDALIDEDP

SEQ ID NO: 695690 - protein, 9 aa, Homo Sapiens
SEPQRDELL

SEQ ID NO: 695691 - protein, 9 aa, Homo Sapiens
SAPLVSWRK

SEQ ID NO: 695692 - protein, 9 aa, Homo Sapiens
YHYVCRTRQ

SEQ ID NO: 695693 - protein, 9 aa, Homo Sapiens
CKAFITCSS

SEQ ID NO: 695694 - protein, 9 aa, Homo Sapiens
LTRPKNRIG

SEQ ID NO: 695695 - protein, 9 aa, Homo Sapiens
SNVTQLQEI

SEQ ID NO: 695696 - protein, 9 aa, Homo Sapiens
TQTVQKPCN

SEQ ID NO: 695697 - protein, 9 aa, Homo Sapiens
VCNAVGALA

SEQ ID NO: 695698 - protein, 9 aa, Homo Sapiens
VCRTRQVTR

SEQ ID NO: 695699 - protein, 9 aa, Homo Sapiens
KLCLETQQL

SEQ ID NO: 695700 - protein, 9 aa, Homo Sapiens
ANTHLEMRF

SEQ ID NO: 695701 - protein, 9 aa, Homo Sapiens
SPDYKLLTS

SEQ ID NO: 695702 - protein, 9 aa, Homo Sapiens
EPQRDELLV

SEQ ID NO: 695703 - protein, 9 aa, Homo Sapiens
SMSFPSSGR

SEQ ID NO: 695704 - protein, 9 aa, Homo Sapiens
ENFINLLSV

SEQ ID NO: 695705 - protein, 9 aa, Homo Sapiens
KQKKCSWRS

SEQ ID NO: 695706 - protein, 9 aa, Homo Sapiens
INLLSVGHQ

SEQ ID NO: 695707 - protein, 9 aa, Homo Sapiens
GLFCPDHRL

SEQ ID NO: 695708 - protein, 9 aa, Homo Sapiens
GKPKECWED

SEQ ID NO: 695709 - protein, 9 aa, Homo Sapiens
HEAQGWAVP

SEQ ID NO: 695710 - protein, 9 aa, Homo Sapiens
QLIRNGTKL

SEQ ID NO: 695711 - protein, 9 aa, Homo Sapiens
EQKAEENEV

SEQ ID NO: 695712 - protein, 9 aa, Homo Sapiens
STTLMLGNI

SEQ ID NO: 695713 - protein, 9 aa, Homo Sapiens
AHGGLYEIY

SEQ ID NO: 695714 - protein, 9 aa, Homo Sapiens
NVTQLQEIS

SEQ ID NO: 695715 - protein, 9 aa, Homo Sapiens
EGFDRQKRG

SEQ ID NO: 695716 - protein, 9 aa, Homo Sapiens
LVSRELMSL

SEQ ID NO: 695717 - protein, 9 aa, Homo Sapiens
SSFLPWLSQ

SEQ ID NO: 695718 - protein, 9 aa, Homo Sapiens
HKFLLVFSK

SEQ ID NO: 695719 - protein, 9 aa, Homo Sapiens
MYTDIGGMD

SEQ ID NO: 695720 - protein, 9 aa, Homo Sapiens
ILEMDHFTL

SEQ ID NO: 695721 - protein, 9 aa, Homo Sapiens
EKLSLFTSV

SEQ ID NO: 695722 - protein, 9 aa, Homo Sapiens
YVALNASYQ

SEQ ID NO: 695723 - protein, 9 aa, Homo Sapiens
TRAAIALPR

SEQ ID NO: 695724 - protein, 9 aa, Homo Sapiens
DKIAAGMFL

SEQ ID NO: 695725 - protein, 9 aa, Homo Sapiens
AGCRALNLS

SEQ ID NO: 695726 - protein, 9 aa, Homo Sapiens
TGLTYLQRR

SEQ ID NO: 695727 - protein, 9 aa, Homo Sapiens
KPKECWEDL

SEQ ID NO: 695728 - protein, 9 aa, Homo Sapiens
LNLSEHARG

SEQ ID NO: 695729 - protein, 9 aa, Homo Sapiens
VRRDIIPET

SEQ ID NO: 695730 - protein, 9 aa, Homo Sapiens
TPSVYLELT

SEQ ID NO: 695731 - protein, 9 aa, Homo Sapiens
TAKPVKSLS

SEQ ID NO: 695732 - protein, 9 aa, Homo Sapiens
PTVRVECCF

SEQ ID NO: 695733 - protein, 9 aa, Homo Sapiens
NIMQAHWLQ

SEQ ID NO: 695734 - protein, 9 aa, Homo Sapiens
CQAICEPSP

SEQ ID NO: 695735 - protein, 9 aa, Homo Sapiens
VQLRRGPHG

SEQ ID NO: 695736 - protein, 9 aa, Homo Sapiens
QLQEISGRP

SEQ ID NO: 695737 - protein, 9 aa, Homo Sapiens
GARLYQGVP

SEQ ID NO: 695738 - protein, 9 aa, Homo Sapiens
LQNIHVHEP

SEQ ID NO: 695739 - protein, 9 aa, Homo Sapiens
NTPRGLSGS

SEQ ID NO: 695740 - protein, 9 aa, Homo Sapiens
VEHGASPSE

SEQ ID NO: 695741 - protein, 9 aa, Homo Sapiens
AHQVLIMMV

SEQ ID NO: 695742 - protein, 9 aa, Homo Sapiens
INTGSQVCN

SEQ ID NO: 695743 - protein, 9 aa, Homo Sapiens
YSCSAQGTQ

SEQ ID NO: 695744 - protein, 9 aa, Homo Sapiens
CQNIMQAHW

SEQ ID NO: 695745 - protein, 9 aa, Homo Sapiens
FKRACIPRT

SEQ ID NO: 695746 - protein, 9 aa, Homo Sapiens
ITGLTYLQR

SEQ ID NO: 695747 - protein, 9 aa, Homo Sapiens
QWKGLTQYF

SEQ ID NO: 695748 - protein, 9 aa, Homo Sapiens
TLVHKFLLV

SEQ ID NO: 695749 - protein, 9 aa, Homo Sapiens
AGEWFLITS

SEQ ID NO: 695750 - protein, 9 aa, Homo Sapiens
GPCSSRYLG

SEQ ID NO: 695751 - protein, 9 aa, Homo Sapiens
TWPRASGKP

SEQ ID NO: 695752 - protein, 9 aa, Homo Sapiens
SPVEEKYEP

SEQ ID NO: 695753 - protein, 9 aa, Homo Sapiens
ENRILPQAS

SEQ ID NO: 695754 - protein, 9 aa, Homo Sapiens
AIHHGVPMV

SEQ ID NO: 695755 - protein, 9 aa, Homo Sapiens
SYVALNASY

SEQ ID NO: 695756 - protein, 9 aa, Homo Sapiens
RDVLYIWAD

SEQ ID NO: 695757 - protein, 9 aa, Homo Sapiens
HFSGPCSSR

SEQ ID NO: 695758 - protein, 9 aa, Homo Sapiens
IALPRMAAA

SEQ ID NO: 695759 - protein, 9 aa, Homo Sapiens
MVDGEDTTL

SEQ ID NO: 695760 - protein, 9 aa, Homo Sapiens
RSGFHDHGT

SEQ ID NO: 695761 - protein, 9 aa, Homo Sapiens
VQLERHEYA

SEQ ID NO: 695762 - protein, 9 aa, Homo Sapiens
GWAAEECKE

SEQ ID NO: 695763 - protein, 9 aa, Homo Sapiens
LFVKEPPVI

SEQ ID NO: 695764 - protein, 9 aa, Homo Sapiens
KTPSDAANS

SEQ ID NO: 695765 - protein, 9 aa, Homo Sapiens
VYELDYGKQ

SEQ ID NO: 695766 - protein, 9 aa, Homo Sapiens
LVIKLQQLI

SEQ ID NO: 695767 - protein, 9 aa, Homo Sapiens
KFLINHVSL

SEQ ID NO: 695768 - protein, 9 aa, Homo Sapiens
NTHLEMRFL

SEQ ID NO: 695769 - protein, 9 aa, Homo Sapiens
TQCCEQMLH

SEQ ID NO: 695770 - protein, 9 aa, Homo Sapiens
QAFTSGKYF

SEQ ID NO: 695771 - protein, 9 aa, Homo Sapiens
NHVSLTLST

SEQ ID NO: 695772 - protein, 9 aa, Homo Sapiens
SAHRAGLWG

SEQ ID NO: 695773 - protein, 9 aa, Homo Sapiens
LYEIYMNQD

SEQ ID NO: 695774 - protein, 9 aa, Homo Sapiens
ASVFYMIVI

SEQ ID NO: 695775 - protein, 9 aa, Homo Sapiens
DEVWHLDPV

SEQ ID NO: 695776 - protein, 9 aa, Homo Sapiens
QYLEYDRFL

SEQ ID NO: 695777 - protein, 9 aa, Homo Sapiens
GCGIRTKEP

SEQ ID NO: 695778 - protein, 9 aa, Homo Sapiens
VGGMGLLVP

SEQ ID NO: 695779 - protein, 9 aa, Homo Sapiens
HFTLVVHEQ

SEQ ID NO: 695780 - protein, 9 aa, Homo Sapiens
VLIMMVLSI

SEQ ID NO: 695781 - protein, 9 aa, Homo Sapiens
VEEVLQTLQ

SEQ ID NO: 695782 - protein, 9 aa, Homo Sapiens
RETEKYNQE

SEQ ID NO: 695783 - protein, 9 aa, Homo Sapiens
FQEWYHLPC

SEQ ID NO: 695784 - protein, 9 aa, Homo Sapiens
LCLETQQLM

SEQ ID NO: 695785 - protein, 9 aa, Homo Sapiens
DKVLKNYGT

SEQ ID NO: 695786 - protein, 9 aa, Homo Sapiens
GFHDHGTYS

SEQ ID NO: 695787 - protein, 9 aa, Homo Sapiens
EVWHLDPVI

SEQ ID NO: 695788 - protein, 9 aa, Homo Sapiens
QKAEENEVP

SEQ ID NO: 695789 - protein, 9 aa, Homo Sapiens
LLFFMVRKA

SEQ ID NO: 695790 - protein, 9 aa, Homo Sapiens
SETPSSFLP

SEQ ID NO: 695791 - protein, 9 aa, Homo Sapiens
VSETATRIS

SEQ ID NO: 695792 - protein, 9 aa, Homo Sapiens
IREDTSLNT

SEQ ID NO: 695793 - protein, 9 aa, Homo Sapiens
LETQQLMDF

SEQ ID NO: 695794 - protein, 9 aa, Homo Sapiens
MGLLVPGGL

SEQ ID NO: 695795 - protein, 9 aa, Homo Sapiens
CSVPTVRVE

SEQ ID NO: 695796 - protein, 9 aa, Homo Sapiens
TPRGLSGSE

SEQ ID NO: 695797 - protein, 9 aa, Homo Sapiens
GLPQKPSFR

SEQ ID NO: 695798 - protein, 9 aa, Homo Sapiens
YKLLTSPRA

SEQ ID NO: 695799 - protein, 9 aa, Homo Sapiens
TSTLLFFMV

SEQ ID NO: 695800 - protein, 9 aa, Homo Sapiens
KLQSLQQNL

SEQ ID NO: 695801 - protein, 9 aa, Homo Sapiens
PKECWEDLH

SEQ ID NO: 695802 - protein, 9 aa, Homo Sapiens
SSVSVQLWE

SEQ ID NO: 695803 - protein, 9 aa, Homo Sapiens
GGAAPEVPN

SEQ ID NO: 695804 - protein, 9 aa, Homo Sapiens
LYQGVPRLP

SEQ ID NO: 695805 - protein, 9 aa, Homo Sapiens
VGGLLAITP

SEQ ID NO: 695806 - protein, 9 aa, Homo Sapiens
EDVPLRPTE

SEQ ID NO: 695807 - protein, 9 aa, Homo Sapiens
FSISVKIWH

SEQ ID NO: 695808 - protein, 9 aa, Homo Sapiens
FGGSPRMAY

SEQ ID NO: 695809 - protein, 9 aa, Homo Sapiens
LSGSEGPST

SEQ ID NO: 695810 - protein, 9 aa, Homo Sapiens
KTHRILRRI

SEQ ID NO: 695811 - protein, 9 aa, Homo Sapiens
QGLFCPDHR

SEQ ID NO: 695812 - protein, 9 aa, Homo Sapiens
GSCRTTIVI

SEQ ID NO: 695813 - protein, 9 aa, Homo Sapiens
GVPRLPTWR

SEQ ID NO: 695814 - protein, 9 aa, Homo Sapiens
TPCTDVKFD

SEQ ID NO: 695815 - protein, 9 aa, Homo Sapiens
GIKKYLNSY

SEQ ID NO: 695816 - protein, 9 aa, Homo Sapiens
ANFGGSPRM

SEQ ID NO: 695817 - protein, 9 aa, Homo Sapiens
MLALTHLCM

SEQ ID NO: 695818 - protein, 9 aa, Homo Sapiens
PVEDKSNPP

SEQ ID NO: 695819 - protein, 9 aa, Homo Sapiens
LQDSLGGSC

SEQ ID NO: 695820 - protein, 9 aa, Homo Sapiens
AEENEVPED

SEQ ID NO: 695821 - protein, 9 aa, Homo Sapiens
HCHRPQSSD

SEQ ID NO: 695822 - protein, 9 aa, Homo Sapiens
AKGGAAPEV

SEQ ID NO: 695823 - protein, 9 aa, Homo Sapiens
SGRADEHSV

SEQ ID NO: 695824 - protein, 9 aa, Homo Sapiens
LYYREIKWL

SEQ ID NO: 695825 - protein, 9 aa, Homo Sapiens
MNHSFVHHI

SEQ ID NO: 695826 - protein, 9 aa, Homo Sapiens
AGKDGDGRI

SEQ ID NO: 695827 - protein, 9 aa, Homo Sapiens
QMSKFEDFT

SEQ ID NO: 695828 - protein, 9 aa, Homo Sapiens
QKKCSWRSS

SEQ ID NO: 695829 - protein, 9 aa, Homo Sapiens
SYEEQNKNV

SEQ ID NO: 695830 - protein, 9 aa, Homo Sapiens
LVPGGLPGF

SEQ ID NO: 695831 - protein, 9 aa, Homo Sapiens
WNPPRKKRF

SEQ ID NO: 695832 - protein, 9 aa, Homo Sapiens
TEKYNQELE

SEQ ID NO: 695833 - protein, 9 aa, Homo Sapiens
KFQKMKSNI

SEQ ID NO: 695834 - protein, 9 aa, Homo Sapiens
SNPPEGSEE

SEQ ID NO: 695835 - protein, 9 aa, Homo Sapiens
PLTLQYVQR

SEQ ID NO: 695836 - protein, 9 aa, Homo Sapiens
PGSQPPGQR

SEQ ID NO: 695837 - protein, 9 aa, Homo Sapiens
GVILSFSTP

SEQ ID NO: 695838 - protein, 9 aa, Homo Sapiens
FSDILLSLC

SEQ ID NO: 695839 - protein, 9 aa, Homo Sapiens
IQSHLYFFL

SEQ ID NO: 695840 - protein, 9 aa, Homo Sapiens
HFMPSYHHH

SEQ ID NO: 695841 - protein, 9 aa, Homo Sapiens
DYKLLTSPR

SEQ ID NO: 695842 - protein, 9 aa, Homo Sapiens
APPRRKHAS

SEQ ID NO: 695843 - protein, 9 aa, Homo Sapiens
PSYLCLAGP

SEQ ID NO: 695844 - protein, 9 aa, Homo Sapiens
KECSRVYLT

SEQ ID NO: 695845 - protein, 9 aa, Homo Sapiens
PAAIEEKKV

SEQ ID NO: 695846 - protein, 9 aa, Homo Sapiens
LISRDVLYI

SEQ ID NO: 695847 - protein, 9 aa, Homo Sapiens
DGFPSLPGP

SEQ ID NO: 695848 - protein, 9 aa, Homo Sapiens
PSPLGSKSA

SEQ ID NO: 695849 - protein, 9 aa, Homo Sapiens
DPVIAKLVL

SEQ ID NO: 695850 - protein, 9 aa, Homo Sapiens
RGARRQAGA

SEQ ID NO: 695851 - protein, 9 aa, Homo Sapiens
TELFAALGP

SEQ ID NO: 695852 - protein, 9 aa, Homo Sapiens
TQQNKPQGW

SEQ ID NO: 695853 - protein, 9 aa, Homo Sapiens
LGGRRGMRP

SEQ ID NO: 695854 - protein, 9 aa, Homo Sapiens
CMETHEAFN

SEQ ID NO: 695855 - protein, 9 aa, Homo Sapiens
FDNYAEWYL

SEQ ID NO: 695856 - protein, 9 aa, Homo Sapiens
VGNGEPLKV

SEQ ID NO: 695857 - protein, 9 aa, Homo Sapiens
YMIVIPMLN

SEQ ID NO: 695858 - protein, 9 aa, Homo Sapiens
YMSSKCTTA

SEQ ID NO: 695859 - protein, 9 aa, Homo Sapiens
LGASCSLAG

SEQ ID NO: 695860 - protein, 9 aa, Homo Sapiens
DGFTQCCEQ

SEQ ID NO: 695861 - protein, 9 aa, Homo Sapiens
VIPISHFMP

SEQ ID NO: 695862 - protein, 9 aa, Homo Sapiens
ETETPGDGC

SEQ ID NO: 695863 - protein, 9 aa, Homo Sapiens
ADAVLEKLH

SEQ ID NO: 695864 - protein, 9 aa, Homo Sapiens
ICEPSPCQS

SEQ ID NO: 695865 - protein, 9 aa, Homo Sapiens
RAHQVLIMM

SEQ ID NO: 695866 - protein, 9 aa, Homo Sapiens
DQKPDVMYT

SEQ ID NO: 695867 - protein, 9 aa, Homo Sapiens
CVITPCTDV

SEQ ID NO: 695868 - protein, 9 aa, Homo Sapiens
LLVPGGLPG

SEQ ID NO: 695869 - protein, 9 aa, Homo Sapiens
PRKYLSTTL

SEQ ID NO: 695870 - protein, 9 aa, Homo Sapiens
SPRMAYPTY

SEQ ID NO: 695871 - protein, 9 aa, Homo Sapiens
SRDVLYIWA

SEQ ID NO: 695872 - protein, 9 aa, Homo Sapiens
SQGLFCPDH

SEQ ID NO: 695873 - protein, 9 aa, Homo Sapiens
STLSHGILI

SEQ ID NO: 695874 - protein, 9 aa, Homo Sapiens
LCLGASCSL

SEQ ID NO: 695875 - protein, 9 aa, Homo Sapiens
DYPRLSLSF

SEQ ID NO: 695876 - protein, 9 aa, Homo Sapiens
GAAPEVPNE

SEQ ID NO: 695877 - protein, 9 aa, Homo Sapiens
RDGLDGFPS

SEQ ID NO: 695878 - protein, 9 aa, Homo Sapiens
GLNLKLISR

SEQ ID NO: 695879 - protein, 9 aa, Homo Sapiens
KQSVANRSG

SEQ ID NO: 695880 - protein, 9 aa, Homo Sapiens
LSCFYIITY

SEQ ID NO: 695881 - protein, 9 aa, Homo Sapiens
CHLNFHPNS

SEQ ID NO: 695882 - protein, 9 aa, Homo Sapiens
QLTRPKNRI

SEQ ID NO: 695883 - protein, 9 aa, Homo Sapiens
PWLSQQTRW

SEQ ID NO: 695884 - protein, 9 aa, Homo Sapiens
GGASLKNQD

SEQ ID NO: 695885 - protein, 9 aa, Homo Sapiens
VPAAAPKCA

SEQ ID NO: 695886 - protein, 9 aa, Homo Sapiens
NMFFSSWSI

SEQ ID NO: 695887 - protein, 9 aa, Homo Sapiens
QKMKSNISV

SEQ ID NO: 695888 - protein, 9 aa, Homo Sapiens
PHVTSRSCS

SEQ ID NO: 695889 - protein, 9 aa, Homo Sapiens
IEEKKVRRD

SEQ ID NO: 695890 - protein, 9 aa, Homo Sapiens
LSLAVTDTE

SEQ ID NO: 695891 - protein, 9 aa, Homo Sapiens
EELVQELEA

SEQ ID NO: 695892 - protein, 9 aa, Homo Sapiens
AIEEKKVRR

SEQ ID NO: 695893 - protein, 9 aa, Homo Sapiens
NLKLISRDV

SEQ ID NO: 695894 - protein, 9 aa, Homo Sapiens
AHFSGPCSS

SEQ ID NO: 695895 - protein, 9 aa, Homo Sapiens
RFWQLTMEY

SEQ ID NO: 695896 - protein, 9 aa, Homo Sapiens
DLEKKKGLF

SEQ ID NO: 695897 - protein, 9 aa, Homo Sapiens
DDPEDMACT

SEQ ID NO: 695898 - protein, 9 aa, Homo Sapiens
PSLPGPPGD

SEQ ID NO: 695899 - protein, 9 aa, Homo Sapiens
QELYVFDTT

SEQ ID NO: 695900 - protein, 9 aa, Homo Sapiens
HQSFQFDEG

SEQ ID NO: 695901 - protein, 9 aa, Homo Sapiens
SFCRCHLTE

SEQ ID NO: 695902 - protein, 9 aa, Homo Sapiens
PEGVILVHA

SEQ ID NO: 695903 - protein, 9 aa, Homo Sapiens
TSGKYFWEV

SEQ ID NO: 695904 - protein, 9 aa, Homo Sapiens
LTAHFTLLL

SEQ ID NO: 695905 - protein, 9 aa, Homo Sapiens
CITISHTMI

SEQ ID NO: 695906 - protein, 9 aa, Homo Sapiens
TDPSYLCLA

SEQ ID NO: 695907 - protein, 9 aa, Homo Sapiens
TNFKFPISD

SEQ ID NO: 695908 - protein, 9 aa, Homo Sapiens
NAAFVNQYR

SEQ ID NO: 695909 - protein, 9 aa, Homo Sapiens
ETPGDGCSG

SEQ ID NO: 695910 - protein, 9 aa, Homo Sapiens
VAGGISGNM

SEQ ID NO: 695911 - protein, 9 aa, Homo Sapiens
TRPKNRIGR

SEQ ID NO: 695912 - protein, 9 aa, Homo Sapiens
HLWKLQSLQ

SEQ ID NO: 695913 - protein, 9 aa, Homo Sapiens
KSAADFIQR

SEQ ID NO: 695914 - protein, 9 aa, Homo Sapiens
TTCCQHYHG

SEQ ID NO: 695915 - protein, 9 aa, Homo Sapiens
VKEPPVIIT

SEQ ID NO: 695916 - protein, 9 aa, Homo Sapiens
SMSTLGGRR

SEQ ID NO: 695917 - protein, 9 aa, Homo Sapiens
GRCKAFITC

SEQ ID NO: 695918 - protein, 9 aa, Homo Sapiens
TFAFEKDIE

SEQ ID NO: 695919 - protein, 9 aa, Homo Sapiens
EKYEPQDFQ

SEQ ID NO: 695920 - protein, 9 aa, Homo Sapiens
ENGKSTIFH

SEQ ID NO: 695921 - protein, 9 aa, Homo Sapiens
FMFVVGMFV

SEQ ID NO: 695922 - protein, 9 aa, Homo Sapiens
VQQVCNAVG

SEQ ID NO: 695923 - protein, 9 aa, Homo Sapiens
GEDEDPSAC

SEQ ID NO: 695924 - protein, 9 aa, Homo Sapiens
ASDSVCLPC

SEQ ID NO: 695925 - protein, 9 aa, Homo Sapiens
FETLKTPHI

SEQ ID NO: 695926 - protein, 9 aa, Homo Sapiens
NAGKDGDGR

SEQ ID NO: 695927 - protein, 9 aa, Homo Sapiens
EYESRIKRL

SEQ ID NO: 695928 - protein, 9 aa, Homo Sapiens
PSCLYSCSD

SEQ ID NO: 695929 - protein, 9 aa, Homo Sapiens
QEISGRPEM

SEQ ID NO: 695930 - protein, 9 aa, Homo Sapiens
LEDVPLRPT

SEQ ID NO: 695931 - protein, 9 aa, Homo Sapiens
SISVKIWHL

SEQ ID NO: 695932 - protein, 9 aa, Homo Sapiens
IKKYLNSYT

SEQ ID NO: 695933 - protein, 9 aa, Homo Sapiens
RDVMLENFI

SEQ ID NO: 695934 - protein, 9 aa, Homo Sapiens
VVVTWNRRS

SEQ ID NO: 695935 - protein, 9 aa, Homo Sapiens
IHHGVPMVG

SEQ ID NO: 695936 - protein, 9 aa, Homo Sapiens
PEDMACTPS

SEQ ID NO: 695937 - protein, 9 aa, Homo Sapiens
KAQDGFTQC

SEQ ID NO: 695938 - protein, 9 aa, Homo Sapiens
GEWFLITSN

SEQ ID NO: 695939 - protein, 9 aa, Homo Sapiens
NKPQGWDQC

SEQ ID NO: 695940 - protein, 9 aa, Homo Sapiens
RRSPPTTAL

SEQ ID NO: 695941 - protein, 9 aa, Homo Sapiens
APRAVTTDA

SEQ ID NO: 695942 - protein, 9 aa, Homo Sapiens
PQLTRPKNR

SEQ ID NO: 695943 - protein, 9 aa, Homo Sapiens
CAGVAGLSA

SEQ ID NO: 695944 - protein, 9 aa, Homo Sapiens
FNFKPCGLF

SEQ ID NO: 695945 - protein, 9 aa, Homo Sapiens
SFLDALIDE

SEQ ID NO: 695946 - protein, 9 aa, Homo Sapiens
EGEKLSLFT

SEQ ID NO: 695947 - protein, 9 aa, Homo Sapiens
TQWKGLTQY

SEQ ID NO: 695948 - protein, 9 aa, Homo Sapiens
KNATPRTNF

SEQ ID NO: 695949 - protein, 9 aa, Homo Sapiens
NSSGNAAFV

SEQ ID NO: 695950 - protein, 9 aa, Homo Sapiens
MDKSAVGHQ

SEQ ID NO: 695951 - protein, 9 aa, Homo Sapiens
VSRMRNMLD

SEQ ID NO: 695952 - protein, 9 aa, Homo Sapiens
PFFLTLLSC

SEQ ID NO: 695953 - protein, 9 aa, Homo Sapiens
QDGFTQCCE

SEQ ID NO: 695954 - protein, 9 aa, Homo Sapiens
HKLDEKQCQ

SEQ ID NO: 695955 - protein, 9 aa, Homo Sapiens
SLLYYREIK

SEQ ID NO: 695956 - protein, 9 aa, Homo Sapiens
AFSDILLSL

SEQ ID NO: 695957 - protein, 9 aa, Homo Sapiens
WPRASGKPV

SEQ ID NO: 695958 - protein, 9 aa, Homo Sapiens
KVRRDIIPE

SEQ ID NO: 695959 - protein, 9 aa, Homo Sapiens
LNSKILCVM

SEQ ID NO: 695960 - protein, 9 aa, Homo Sapiens
ACIPRTLNE

SEQ ID NO: 695961 - protein, 9 aa, Homo Sapiens
IRDLEKKKG

SEQ ID NO: 695962 - protein, 9 aa, Homo Sapiens
LDMVECVLP

SEQ ID NO: 695963 - protein, 9 aa, Homo Sapiens
DILLSLCCM

SEQ ID NO: 695964 - protein, 9 aa, Homo Sapiens
DQGDDVVLT

SEQ ID NO: 695965 - protein, 9 aa, Homo Sapiens
VTKEAESCD

SEQ ID NO: 695966 - protein, 9 aa, Homo Sapiens
ASLCAMEVL

SEQ ID NO: 695967 - protein, 9 aa, Homo Sapiens
ALNLSEHAR

SEQ ID NO: 695968 - protein, 9 aa, Homo Sapiens
TYLQRRHTG

SEQ ID NO: 695969 - protein, 9 aa, Homo Sapiens
KHTPTNGKN

SEQ ID NO: 695970 - protein, 9 aa, Homo Sapiens
KNMFFSSWS

SEQ ID NO: 695971 - protein, 9 aa, Homo Sapiens
PPGQRLLSA

SEQ ID NO: 695972 - protein, 9 aa, Homo Sapiens
GRHLDMVEC

SEQ ID NO: 695973 - protein, 9 aa, Homo Sapiens
VRVECCFSC

SEQ ID NO: 695974 - protein, 9 aa, Homo Sapiens
NTGSQVCNL

SEQ ID NO: 695975 - protein, 9 aa, Homo Sapiens
VANRSGVNI

SEQ ID NO: 695976 - protein, 9 aa, Homo Sapiens
MKTQTVQKP

SEQ ID NO: 695977 - protein, 9 aa, Homo Sapiens
SSSKKLQRF

SEQ ID NO: 695978 - protein, 9 aa, Homo Sapiens
TQLQEISGR

SEQ ID NO: 695979 - protein, 9 aa, Homo Sapiens
DKFLINHVS

SEQ ID NO: 695980 - protein, 9 aa, Homo Sapiens
YGKQELVNI

SEQ ID NO: 695981 - protein, 9 aa, Homo Sapiens
QQVQLERHE

SEQ ID NO: 695982 - protein, 9 aa, Homo Sapiens
GNYSCSAQG

SEQ ID NO: 695983 - protein, 9 aa, Homo Sapiens
LKVFEEQKS

SEQ ID NO: 695984 - protein, 9 aa, Homo Sapiens
EMDHFTLVV

SEQ ID NO: 695985 - protein, 9 aa, Homo Sapiens
LRPTEISLT

SEQ ID NO: 695986 - protein, 9 aa, Homo Sapiens
GISGNMVDG

SEQ ID NO: 695987 - protein, 9 aa, Homo Sapiens
SVMILLIYL

SEQ ID NO: 695988 - protein, 9 aa, Homo Sapiens
SCLYSCSDW

SEQ ID NO: 695989 - protein, 9 aa, Homo Sapiens
LLSAHRAGL

SEQ ID NO: 695990 - protein, 9 aa, Homo Sapiens
AGLWGWALG

SEQ ID NO: 695991 - protein, 9 aa, Homo Sapiens
QRFFQSFLD

SEQ ID NO: 695992 - protein, 9 aa, Homo Sapiens
VILSFSTPA

SEQ ID NO: 695993 - protein, 9 aa, Homo Sapiens
KCTTASDSV

SEQ ID NO: 695994 - protein, 9 aa, Homo Sapiens
DVMYTDIGG

SEQ ID NO: 695995 - protein, 9 aa, Homo Sapiens
VNYDGKNLK

SEQ ID NO: 695996 - protein, 9 aa, Homo Sapiens
IGSLNESVS

SEQ ID NO: 695997 - protein, 9 aa, Homo Sapiens
LSQEFAVLS

SEQ ID NO: 695998 - protein, 9 aa, Homo Sapiens
FLAIFITAP

SEQ ID NO: 695999 - protein, 9 aa, Homo Sapiens
EGQERRSPP

SEQ ID NO: 696000 - protein, 9 aa, Homo Sapiens
PAHFSGPCS

SEQ ID NO: 696001 - protein, 9 aa, Homo Sapiens
RMDSPKSAA

SEQ ID NO: 696002 - protein, 9 aa, Homo Sapiens
LPTWRCLPR

SEQ ID NO: 696003 - protein, 9 aa, Homo Sapiens
SATKHTPTN

SEQ ID NO: 696004 - protein, 9 aa, Homo Sapiens
ALPRMAAAH

SEQ ID NO: 696005 - protein, 9 aa, Homo Sapiens
DWHEAQGWA

SEQ ID NO: 696006 - protein, 9 aa, Homo Sapiens
IRYGCPSPE

SEQ ID NO: 696007 - protein, 9 aa, Homo Sapiens
CSLRALSQE

SEQ ID NO: 696008 - protein, 9 aa, Homo Sapiens
QGWDQCLQP

SEQ ID NO: 696009 - protein, 9 aa, Homo Sapiens
LKEGRYCIC

SEQ ID NO: 696010 - protein, 9 aa, Homo Sapiens
SLLLLLEEQ

SEQ ID NO: 696011 - protein, 9 aa, Homo Sapiens
GDKCVFNFK

SEQ ID NO: 696012 - protein, 9 aa, Homo Sapiens
DGKNLKIKP

SEQ ID NO: 696013 - protein, 9 aa, Homo Sapiens
CLTPLIIAA

SEQ ID NO: 696014 - protein, 9 aa, Homo Sapiens
SEDSMSTLG

SEQ ID NO: 696015 - protein, 9 aa, Homo Sapiens
KDKFLINHV

SEQ ID NO: 696016 - protein, 9 aa, Homo Sapiens
ASTLVHKFL

SEQ ID NO: 696017 - protein, 9 aa, Homo Sapiens
KQELVNIRK

SEQ ID NO: 696018 - protein, 9 aa, Homo Sapiens
KGGAAPEVP

SEQ ID NO: 696019 - protein, 9 aa, Homo Sapiens
FQFDEGDGD

SEQ ID NO: 696020 - protein, 9 aa, Homo Sapiens
LQYVQRPTN

SEQ ID NO: 696021 - protein, 9 aa, Homo Sapiens
TWNRRSSAY

SEQ ID NO: 696022 - protein, 9 aa, Homo Sapiens
RILRRIFNL

SEQ ID NO: 696023 - protein, 9 aa, Homo Sapiens
DRQKRGYRD

SEQ ID NO: 696024 - protein, 9 aa, Homo Sapiens
ISMSFPSSG

SEQ ID NO: 696025 - protein, 9 aa, Homo Sapiens
NPPEGSEEA

SEQ ID NO: 696026 - protein, 9 aa, Homo Sapiens
AQDGFTQCC

SEQ ID NO: 696027 - protein, 9 aa, Homo Sapiens
SPAASSGCE

SEQ ID NO: 696028 - protein, 9 aa, Homo Sapiens
STLVHKFLL

SEQ ID NO: 696029 - protein, 9 aa, Homo Sapiens
REDTSLNTP

SEQ ID NO: 696030 - protein, 9 aa, Homo Sapiens
GLSIHDSTW

SEQ ID NO: 696031 - protein, 9 aa, Homo Sapiens
HITGLTYLQ

SEQ ID NO: 696032 - protein, 9 aa, Homo Sapiens
CLVDGGGAC

SEQ ID NO: 696033 - protein, 9 aa, Homo Sapiens
PLRPTEISL

SEQ ID NO: 696034 - protein, 9 aa, Homo Sapiens
VKEGMDDIR

SEQ ID NO: 696035 - protein, 9 aa, Homo Sapiens
KYFWEVHMG

SEQ ID NO: 696036 - protein, 9 aa, Homo Sapiens
ACDLAPRAV

SEQ ID NO: 696037 - protein, 9 aa, Homo Sapiens
VMYTDIGGM

SEQ ID NO: 696038 - protein, 9 aa, Homo Sapiens
DSPKSAADF

SEQ ID NO: 696039 - protein, 9 aa, Homo Sapiens
SITTFCMET

SEQ ID NO: 696040 - protein, 9 aa, Homo Sapiens
VPGGLPGFY

SEQ ID NO: 696041 - protein, 9 aa, Homo Sapiens
PEMTFGKGT

SEQ ID NO: 696042 - protein, 9 aa, Homo Sapiens
LMVETETPG

SEQ ID NO: 696043 - protein, 9 aa, Homo Sapiens
ASPDIRDLE

SEQ ID NO: 696044 - protein, 9 aa, Homo Sapiens
MEAIHHGVP

SEQ ID NO: 696045 - protein, 9 aa, Homo Sapiens
PQEYTLPPS

SEQ ID NO: 696046 - protein, 9 aa, Homo Sapiens
HLQCHLPGS

SEQ ID NO: 696047 - protein, 9 aa, Homo Sapiens
LCVMEAYHL

SEQ ID NO: 696048 - protein, 9 aa, Homo Sapiens
KCVNYDGKN

SEQ ID NO: 696049 - protein, 9 aa, Homo Sapiens
SNETQWKGL

SEQ ID NO: 696050 - protein, 9 aa, Homo Sapiens
AAPEVPNEA

SEQ ID NO: 696051 - protein, 9 aa, Homo Sapiens
SGNAAFVNQ

SEQ ID NO: 696052 - protein, 9 aa, Homo Sapiens
PRAVTTDAA

SEQ ID NO: 696053 - protein, 9 aa, Homo Sapiens
TLVVHEQIQ

SEQ ID NO: 696054 - protein, 9 aa, Homo Sapiens
DFGEKQKKC

SEQ ID NO: 696055 - protein, 9 aa, Homo Sapiens
QGKNMFFSS

SEQ ID NO: 696056 - protein, 9 aa, Homo Sapiens
AKQSVANRS

SEQ ID NO: 696057 - protein, 9 aa, Homo Sapiens
SCSAQGTQT

SEQ ID NO: 696058 - protein, 9 aa, Homo Sapiens
LRRIFNLCK

SEQ ID NO: 696059 - protein, 9 aa, Homo Sapiens
PSAFPCPVS

SEQ ID NO: 696060 - protein, 9 aa, Homo Sapiens
KSATKHTPT

SEQ ID NO: 696061 - protein, 9 aa, Homo Sapiens
EETELRFWQ

SEQ ID NO: 696062 - protein, 9 aa, Homo Sapiens
SPAHFSGPC

SEQ ID NO: 696063 - protein, 9 aa, Homo Sapiens
DRFLLPPDP

SEQ ID NO: 696064 - protein, 9 aa, Homo Sapiens
KSQSKCKPS

SEQ ID NO: 696065 - protein, 9 aa, Homo Sapiens
AISYHYVCR

SEQ ID NO: 696066 - protein, 9 aa, Homo Sapiens
TWSQAGISK

SEQ ID NO: 696067 - protein, 9 aa, Homo Sapiens
QERRSPPTT

SEQ ID NO: 696068 - protein, 9 aa, Homo Sapiens
FKLCLETQQ

SEQ ID NO: 696069 - protein, 9 aa, Homo Sapiens
LPQKPSFRG

SEQ ID NO: 696070 - protein, 9 aa, Homo Sapiens
PPPGQPSPV

SEQ ID NO: 696071 - protein, 9 aa, Homo Sapiens
EVNELMEQL

SEQ ID NO: 696072 - protein, 9 aa, Homo Sapiens
NPPRKKRFT

SEQ ID NO: 696073 - protein, 9 aa, Homo Sapiens
NRILPQASQ

SEQ ID NO: 696074 - protein, 9 aa, Homo Sapiens
KEGMDDIRY

SEQ ID NO: 696075 - protein, 9 aa, Homo Sapiens
PLCLGASCS

SEQ ID NO: 696076 - protein, 9 aa, Homo Sapiens
FLNVIYPPM

SEQ ID NO: 696077 - protein, 9 aa, Homo Sapiens
KQSFGQFHE

SEQ ID NO: 696078 - protein, 9 aa, Homo Sapiens
ATDPSYLCL

SEQ ID NO: 696079 - protein, 9 aa, Homo Sapiens
SFLPWLSQQ

SEQ ID NO: 696080 - protein, 9 aa, Homo Sapiens
EIERELKEG

SEQ ID NO: 696081 - protein, 9 aa, Homo Sapiens
SVPQPPPGQ

SEQ ID NO: 696082 - protein, 9 aa, Homo Sapiens
HSLLLLLEE

SEQ ID NO: 696083 - protein, 9 aa, Homo Sapiens
VNELMEQLF

SEQ ID NO: 696084 - protein, 9 aa, Homo Sapiens
PGPGARLGA

SEQ ID NO: 696085 - protein, 9 aa, Homo Sapiens
SYLCLAGPC

SEQ ID NO: 696086 - protein, 9 aa, Homo Sapiens
DIEMQKGTG

SEQ ID NO: 696087 - protein, 9 aa, Homo Sapiens
CTDVKFDPG

SEQ ID NO: 696088 - protein, 9 aa, Homo Sapiens
SPMTLVKHQ

SEQ ID NO: 696089 - protein, 9 aa, Homo Sapiens
SVKIWHLHN

SEQ ID NO: 696090 - protein, 9 aa, Homo Sapiens
PQPPPGQPS

SEQ ID NO: 696091 - protein, 9 aa, Homo Sapiens
ADDPEDMAC

SEQ ID NO: 696092 - protein, 9 aa, Homo Sapiens
IMLFLTTEL

SEQ ID NO: 696093 - protein, 9 aa, Homo Sapiens
TSRSCSEPA

SEQ ID NO: 696094 - protein, 9 aa, Homo Sapiens
GNGEPLKVF

SEQ ID NO: 696095 - protein, 9 aa, Homo Sapiens
GCESSTPPT

SEQ ID NO: 696096 - protein, 9 aa, Homo Sapiens
QYVQRPTNH

SEQ ID NO: 696097 - protein, 9 aa, Homo Sapiens
VFDTTGKHL

SEQ ID NO: 696098 - protein, 9 aa, Homo Sapiens
KDIEMQKGT

SEQ ID NO: 696099 - protein, 9 aa, Homo Sapiens
GDGCSGRKN

SEQ ID NO: 696100 - protein, 9 aa, Homo Sapiens
LLTAHFTLL

SEQ ID NO: 696101 - protein, 9 aa, Homo Sapiens
RGDLSTALL

SEQ ID NO: 696102 - protein, 9 aa, Homo Sapiens
EWFLITSNN

SEQ ID NO: 696103 - protein, 9 aa, Homo Sapiens
SPLTLQYVQ

SEQ ID NO: 696104 - protein, 9 aa, Homo Sapiens
GQPREPQEY

SEQ ID NO: 696105 - protein, 9 aa, Homo Sapiens
VFKRACIPR

SEQ ID NO: 696106 - protein, 9 aa, Homo Sapiens
SKILCVMEA

SEQ ID NO: 696107 - protein, 9 aa, Homo Sapiens
MKSNISVLQ

SEQ ID NO: 696108 - protein, 9 aa, Homo Sapiens
FVKEGMDDI

SEQ ID NO: 696109 - protein, 9 aa, Homo Sapiens
SQGLPQKPS

SEQ ID NO: 696110 - protein, 9 aa, Homo Sapiens
TIERHLQCH

SEQ ID NO: 696111 - protein, 9 aa, Homo Sapiens
GGMGLLVPG

SEQ ID NO: 696112 - protein, 9 aa, Homo Sapiens
DLAPRAVTT

SEQ ID NO: 696113 - protein, 9 aa, Homo Sapiens
GARLGASLL

SEQ ID NO: 696114 - protein, 9 aa, Homo Sapiens
SCAGVAGLS

SEQ ID NO: 696115 - protein, 9 aa, Homo Sapiens
ALLSAQSFL

SEQ ID NO: 696116 - protein, 9 aa, Homo Sapiens
SCLTPLIIA

SEQ ID NO: 696117 - protein, 9 aa, Homo Sapiens
GWEIERELK

SEQ ID NO: 696118 - protein, 9 aa, Homo Sapiens
DMKSSAQVG

SEQ ID NO: 696119 - protein, 9 aa, Homo Sapiens
SDILLSLCC

SEQ ID NO: 696120 - protein, 9 aa, Homo Sapiens
AHFVAGEWF

SEQ ID NO: 696121 - protein, 9 aa, Homo Sapiens
YVFDTTGKH

SEQ ID NO: 696122 - protein, 9 aa, Homo Sapiens
DLSTALLSA

SEQ ID NO: 696123 - protein, 9 aa, Homo Sapiens
VGHQYQSKL

SEQ ID NO: 696124 - protein, 9 aa, Homo Sapiens
YLVSRELMS

SEQ ID NO: 696125 - protein, 9 aa, Homo Sapiens
CHLTEPGLA

SEQ ID NO: 696126 - protein, 9 aa, Homo Sapiens
HPPYLVSRE

SEQ ID NO: 696127 - protein, 9 aa, Homo Sapiens
NRALCLVDG

SEQ ID NO: 696128 - protein, 9 aa, Homo Sapiens
ECVITPCTD

SEQ ID NO: 696129 - protein, 9 aa, Homo Sapiens
SCSDWPHRL

SEQ ID NO: 696130 - protein, 9 aa, Homo Sapiens
PSEASGNLP

SEQ ID NO: 696131 - protein, 9 aa, Homo Sapiens
TKEAESCDC

SEQ ID NO: 696132 - protein, 9 aa, Homo Sapiens
EQYLEYDRF

SEQ ID NO: 696133 - protein, 9 aa, Homo Sapiens
GGRLDMNHS

SEQ ID NO: 696134 - protein, 9 aa, Homo Sapiens
ISRDVLYIW

SEQ ID NO: 696135 - protein, 9 aa, Homo Sapiens
CMIVGSPEM

SEQ ID NO: 696136 - protein, 9 aa, Homo Sapiens
EKQKKCSWR

SEQ ID NO: 696137 - protein, 9 aa, Homo Sapiens
QPPPGQPSP

SEQ ID NO: 696138 - protein, 9 aa, Homo Sapiens
LINHVSLTL

SEQ ID NO: 696139 - protein, 9 aa, Homo Sapiens
PAGNIFHCA

SEQ ID NO: 696140 - protein, 9 aa, Homo Sapiens
WNRRSSAYK

SEQ ID NO: 696141 - protein, 9 aa, Homo Sapiens
LYSCSDWPH

SEQ ID NO: 696142 - protein, 9 aa, Homo Sapiens
SDWPHRLVP

SEQ ID NO: 696143 - protein, 9 aa, Homo Sapiens
TASDSVCLP

SEQ ID NO: 696144 - protein, 9 aa, Homo Sapiens
TTELFAALG

SEQ ID NO: 696145 - protein, 9 aa, Homo Sapiens
IHVHEPNRG

SEQ ID NO: 696146 - protein, 9 aa, Homo Sapiens
LAIFITAPN

SEQ ID NO: 696147 - protein, 9 aa, Homo Sapiens
ARRQAGAAA

SEQ ID NO: 696148 - protein, 9 aa, Homo Sapiens
PSSSPDYKL

SEQ ID NO: 696149 - protein, 9 aa, Homo Sapiens
IGAKFMFVV

SEQ ID NO: 696150 - protein, 9 aa, Homo Sapiens
VFYMIVIPM

SEQ ID NO: 696151 - protein, 9 aa, Homo Sapiens
AESAQGKNM

SEQ ID NO: 696152 - protein, 9 aa, Homo Sapiens
LPGSQPPGQ

SEQ ID NO: 696153 - protein, 9 aa, Homo Sapiens
GCRDVAGGI

SEQ ID NO: 696154 - protein, 9 aa, Homo Sapiens
QTVQKPCNC

SEQ ID NO: 696155 - protein, 9 aa, Homo Sapiens
VPQPPPGQP

SEQ ID NO: 696156 - protein, 9 aa, Homo Sapiens
RCGGASLKN

SEQ ID NO: 696157 - protein, 9 aa, Homo Sapiens
CTTASDSVC

SEQ ID NO: 696158 - protein, 9 aa, Homo Sapiens
HRILRRIFN

SEQ ID NO: 696159 - protein, 9 aa, Homo Sapiens
KPLSCLTPL

SEQ ID NO: 696160 - protein, 9 aa, Homo Sapiens
IVSLEGKPL

SEQ ID NO: 696161 - protein, 9 aa, Homo Sapiens
SVMDVVTKE

SEQ ID NO: 696162 - protein, 9 aa, Homo Sapiens
PEGLSIHDS

SEQ ID NO: 696163 - protein, 9 aa, Homo Sapiens
VDKTIINAG

SEQ ID NO: 696164 - protein, 9 aa, Homo Sapiens
VSCIIQSHL

SEQ ID NO: 696165 - protein, 9 aa, Homo Sapiens
FPSLPGPPG

SEQ ID NO: 696166 - protein, 9 aa, Homo Sapiens
RTLMVDGED

SEQ ID NO: 696167 - protein, 9 aa, Homo Sapiens
KGTVNLTWP

SEQ ID NO: 696168 - protein, 9 aa, Homo Sapiens
PHGSISRII

SEQ ID NO: 696169 - protein, 9 aa, Homo Sapiens
CSAQGTQTG

SEQ ID NO: 696170 - protein, 9 aa, Homo Sapiens
GASCSLAGE

SEQ ID NO: 696171 - protein, 9 aa, Homo Sapiens
AAIALPRMA

SEQ ID NO: 696172 - protein, 9 aa, Homo Sapiens
RRIFNLCKR

SEQ ID NO: 696173 - protein, 9 aa, Homo Sapiens
QVGLARART

SEQ ID NO: 696174 - protein, 9 aa, Homo Sapiens
FCFTSTLLF

SEQ ID NO: 696175 - protein, 9 aa, Homo Sapiens
SHITGLTYL

SEQ ID NO: 696176 - protein, 9 aa, Homo Sapiens
LVQELEAAP

SEQ ID NO: 696177 - protein, 9 aa, Homo Sapiens
PASPLTIFC

SEQ ID NO: 696178 - protein, 9 aa, Homo Sapiens
EKQCQRLTQ

SEQ ID NO: 696179 - protein, 9 aa, Homo Sapiens
ENRALCLVD

SEQ ID NO: 696180 - protein, 9 aa, Homo Sapiens
PVEEVLQTL

SEQ ID NO: 696181 - protein, 9 aa, Homo Sapiens
NEAHGGLYE

SEQ ID NO: 696182 - protein, 9 aa, Homo Sapiens
FVAGEWFLI

SEQ ID NO: 696183 - protein, 9 aa, Homo Sapiens
VVTWNRRSS

SEQ ID NO: 696184 - protein, 9 aa, Homo Sapiens
QQNKPQGWD

SEQ ID NO: 696185 - protein, 9 aa, Homo Sapiens
EPLKVFEEQ

SEQ ID NO: 696186 - protein, 9 aa, Homo Sapiens
ECWEDLHKV

SEQ ID NO: 696187 - protein, 9 aa, Homo Sapiens
FHDHGTYSL

SEQ ID NO: 696188 - protein, 9 aa, Homo Sapiens
RALCLVDGG

SEQ ID NO: 696189 - protein, 9 aa, Homo Sapiens
KVVKNPSAL

SEQ ID NO: 696190 - protein, 9 aa, Homo Sapiens
SFQEWYHLP

SEQ ID NO: 696191 - protein, 9 aa, Homo Sapiens
RALSQEFAV

SEQ ID NO: 696192 - protein, 9 aa, Homo Sapiens
LNLKLISRD

SEQ ID NO: 696193 - protein, 9 aa, Homo Sapiens
GTVNLTWPR

SEQ ID NO: 696194 - protein, 9 aa, Homo Sapiens
SPENGKSTI

SEQ ID NO: 696195 - protein, 9 aa, Homo Sapiens
LDGFPSLPG

SEQ ID NO: 696196 - protein, 9 aa, Homo Sapiens
QRAEADDPE

SEQ ID NO: 696197 - protein, 9 aa, Homo Sapiens
VRATDDLIN

SEQ ID NO: 696198 - protein, 9 aa, Homo Sapiens
ELVQELEAA

SEQ ID NO: 696199 - protein, 9 aa, Homo Sapiens
EDEDPSACT

SEQ ID NO: 696200 - protein, 9 aa, Homo Sapiens
TVWNPPRKK

SEQ ID NO: 696201 - protein, 9 aa, Homo Sapiens
VACNSSGNA

SEQ ID NO: 696202 - protein, 9 aa, Homo Sapiens
QLTEEVQPK

SEQ ID NO: 696203 - protein, 9 aa, Homo Sapiens
AFPCPVSAM

SEQ ID NO: 696204 - protein, 9 aa, Homo Sapiens
IAAGMFLNV

SEQ ID NO: 696205 - protein, 9 aa, Homo Sapiens
DKSAVGHQY

SEQ ID NO: 696206 - protein, 9 aa, Homo Sapiens
VMDVVTKEA

SEQ ID NO: 696207 - protein, 9 aa, Homo Sapiens
EDLHKVSCG

SEQ ID NO: 696208 - protein, 9 aa, Homo Sapiens
LCITISHTM

SEQ ID NO: 696209 - protein, 9 aa, Homo Sapiens
PDYKLLTSP

SEQ ID NO: 696210 - protein, 9 aa, Homo Sapiens
PTTTPRSIL

SEQ ID NO: 696211 - protein, 9 aa, Homo Sapiens
TVAFLAIFI

SEQ ID NO: 696212 - protein, 9 aa, Homo Sapiens
VTERIISMS

SEQ ID NO: 696213 - protein, 9 aa, Homo Sapiens
RIKRLEQRN

SEQ ID NO: 696214 - protein, 9 aa, Homo Sapiens
ALSQEFAVL

SEQ ID NO: 696215 - protein, 9 aa, Homo Sapiens
AEWYLRDID

SEQ ID NO: 696216 - protein, 9 aa, Homo Sapiens
WDQCLQPES

SEQ ID NO: 696217 - protein, 9 aa, Homo Sapiens
GTAAIPGAF

SEQ ID NO: 696218 - protein, 9 aa, Homo Sapiens
LENFINLLS

SEQ ID NO: 696219 - protein, 9 aa, Homo Sapiens
IIQSHLYFF

SEQ ID NO: 696220 - protein, 9 aa, Homo Sapiens
PKCAATIER

SEQ ID NO: 696221 - protein, 9 aa, Homo Sapiens
EAGCRALNL

SEQ ID NO: 696222 - protein, 9 aa, Homo Sapiens
LSYVALNAS

SEQ ID NO: 696223 - protein, 9 aa, Homo Sapiens
RTNFKFPIS

SEQ ID NO: 696224 - protein, 9 aa, Homo Sapiens
TPRTNFKFP

SEQ ID NO: 696225 - protein, 9 aa, Homo Sapiens
QSHLYFFLG

SEQ ID NO: 696226 - protein, 9 aa, Homo Sapiens
LAVVTMSYE

SEQ ID NO: 696227 - protein, 9 aa, Homo Sapiens
SSGCESSTP

SEQ ID NO: 696228 - protein, 9 aa, Homo Sapiens
GLRDSAGGC

SEQ ID NO: 696229 - protein, 9 aa, Homo Sapiens
AFPSEDLNN

SEQ ID NO: 696230 - protein, 9 aa, Homo Sapiens
TLKTPHIDV

SEQ ID NO: 696231 - protein, 9 aa, Homo Sapiens
RKHASLCAM

SEQ ID NO: 696232 - protein, 9 aa, Homo Sapiens
REIKWLSRG

SEQ ID NO: 696233 - protein, 9 aa, Homo Sapiens
QSFLDALID

SEQ ID NO: 696234 - protein, 9 aa, Homo Sapiens
TDSTLSHGI

SEQ ID NO: 696235 - protein, 9 aa, Homo Sapiens
SPDIRDLEK

SEQ ID NO: 696236 - protein, 9 aa, Homo Sapiens
SRLPKQSFG

SEQ ID NO: 696237 - protein, 9 aa, Homo Sapiens
MESVMDVVT

SEQ ID NO: 696238 - protein, 9 aa, Homo Sapiens
QDSLGGSCR

SEQ ID NO: 696239 - protein, 9 aa, Homo Sapiens
KPVKSLSQL

SEQ ID NO: 696240 - protein, 9 aa, Homo Sapiens
PCSSRYLGE

SEQ ID NO: 696241 - protein, 9 aa, Homo Sapiens
LPSCLYSCS

SEQ ID NO: 696242 - protein, 9 aa, Homo Sapiens
PPMKTQTVQ

SEQ ID NO: 696243 - protein, 9 aa, Homo Sapiens
MGPLCLGAS

SEQ ID NO: 696244 - protein, 9 aa, Homo Sapiens
RMRNMLDEV

SEQ ID NO: 696245 - protein, 9 aa, Homo Sapiens
ELKEGRYCI

SEQ ID NO: 696246 - protein, 9 aa, Homo Sapiens
GLFSISVKI

SEQ ID NO: 696247 - protein, 9 aa, Homo Sapiens
EVPNEAEVT

SEQ ID NO: 696248 - protein, 9 aa, Homo Sapiens
KRACIPRTL

SEQ ID NO: 696249 - protein, 9 aa, Homo Sapiens
SNISVLQKV

SEQ ID NO: 696250 - protein, 9 aa, Homo Sapiens
RCKAFITCS

SEQ ID NO: 696251 - protein, 9 aa, Homo Sapiens
SLENLTKNT

SEQ ID NO: 696252 - protein, 9 aa, Homo Sapiens
KNYGTICQI

SEQ ID NO: 696253 - protein, 9 aa, Homo Sapiens
LSQLLLDDD

SEQ ID NO: 696254 - protein, 9 aa, Homo Sapiens
ELYVFDTTG

SEQ ID NO: 696255 - protein, 9 aa, Homo Sapiens
PEHVVVTWN

SEQ ID NO: 696256 - protein, 9 aa, Homo Sapiens
RHLQCHLPG

SEQ ID NO: 696257 - protein, 9 aa, Homo Sapiens
HSSPSPLGS

SEQ ID NO: 696258 - protein, 9 aa, Homo Sapiens
EMTFGKGTQ

SEQ ID NO: 696259 - protein, 9 aa, Homo Sapiens
FLLVFSKWE

SEQ ID NO: 696260 - protein, 9 aa, Homo Sapiens
KLAKPLSCL

SEQ ID NO: 696261 - protein, 9 aa, Homo Sapiens
SPQLTRPKN

SEQ ID NO: 696262 - protein, 9 aa, Homo Sapiens
SPCCQAICE

SEQ ID NO: 696263 - protein, 9 aa, Homo Sapiens
SALELRSFT

SEQ ID NO: 696264 - protein, 9 aa, Homo Sapiens
IVRATDDLI

SEQ ID NO: 696265 - protein, 9 aa, Homo Sapiens
NDDLADAVL

SEQ ID NO: 696266 - protein, 9 aa, Homo Sapiens
RELKEGRYC

SEQ ID NO: 696267 - protein, 9 aa, Homo Sapiens
VPRLPTWRC

SEQ ID NO: 696268 - protein, 9 aa, Homo Sapiens
HQVLIMMVL

SEQ ID NO: 696269 - protein, 9 aa, Homo Sapiens
DSLGGSCRT

SEQ ID NO: 696270 - protein, 9 aa, Homo Sapiens
RDVAGGISG

SEQ ID NO: 696271 - protein, 9 aa, Homo Sapiens
QQNLPQWPA

SEQ ID NO: 696272 - protein, 9 aa, Homo Sapiens
RLDMNHSFV

SEQ ID NO: 696273 - protein, 9 aa, Homo Sapiens
SQLLLDDDC

SEQ ID NO: 696274 - protein, 9 aa, Homo Sapiens
KEGRYCICE

SEQ ID NO: 696275 - protein, 9 aa, Homo Sapiens
YSTPSVYLE

SEQ ID NO: 696276 - protein, 9 aa, Homo Sapiens
ASCSLAGEF

SEQ ID NO: 696277 - protein, 9 aa, Homo Sapiens
VLEKLHLSF

SEQ ID NO: 696278 - protein, 9 aa, Homo Sapiens
SDAANSPIG

SEQ ID NO: 696279 - protein, 9 aa, Homo Sapiens
AHHAKQSVA

SEQ ID NO: 696280 - protein, 9 aa, Homo Sapiens
NKECSRVYL

SEQ ID NO: 696281 - protein, 9 aa, Homo Sapiens
ARLYQGVPR

SEQ ID NO: 696282 - protein, 9 aa, Homo Sapiens
GKPSSKSQS

SEQ ID NO: 696283 - protein, 9 aa, Homo Sapiens
MAYPTYSPP

SEQ ID NO: 696284 - protein, 9 aa, Homo Sapiens
LFSISVKIW

SEQ ID NO: 696285 - protein, 9 aa, Homo Sapiens
EPPVIITRP

SEQ ID NO: 696286 - protein, 9 aa, Homo Sapiens
CRPHVTSRS

SEQ ID NO: 696287 - protein, 9 aa, Homo Sapiens
GKGEQTWSQ

SEQ ID NO: 696288 - protein, 9 aa, Homo Sapiens
AAIPGAFGC

SEQ ID NO: 696289 - protein, 9 aa, Homo Sapiens
LTLAVVTMS

SEQ ID NO: 696290 - protein, 9 aa, Homo Sapiens
LPVEEVLQT

SEQ ID NO: 696291 - protein, 9 aa, Homo Sapiens
PRLPTWRCL

SEQ ID NO: 696292 - protein, 9 aa, Homo Sapiens
EKDIEMQKG

SEQ ID NO: 696293 - protein, 9 aa, Homo Sapiens
ISVSINKEC

SEQ ID NO: 696294 - protein, 9 aa, Homo Sapiens
MDDIRYGCP

SEQ ID NO: 696295 - protein, 9 aa, Homo Sapiens
LAFSDILLS

SEQ ID NO: 696296 - protein, 9 aa, Homo Sapiens
QAHWLQKVT

SEQ ID NO: 696297 - protein, 9 aa, Homo Sapiens
ILLSLCCMP

SEQ ID NO: 696298 - protein, 9 aa, Homo Sapiens
VVTKEAESC

SEQ ID NO: 696299 - protein, 9 aa, Homo Sapiens
SCSCSFQEW

SEQ ID NO: 696300 - protein, 9 aa, Homo Sapiens
KGLTQYFGV

SEQ ID NO: 696301 - protein, 9 aa, Homo Sapiens
LRFWQLTME

SEQ ID NO: 696302 - protein, 9 aa, Homo Sapiens
SMLALTHLC

SEQ ID NO: 696303 - protein, 9 aa, Homo Sapiens
RLPKQSFGQ

SEQ ID NO: 696304 - protein, 9 aa, Homo Sapiens
LERIFGLPA

SEQ ID NO: 696305 - protein, 9 aa, Homo Sapiens
LTEEVQPKA

SEQ ID NO: 696306 - protein, 9 aa, Homo Sapiens
AAEECKEKL

SEQ ID NO: 696307 - protein, 9 aa, Homo Sapiens
ILSFINSPA

SEQ ID NO: 696308 - protein, 9 aa, Homo Sapiens
LKNQDLRYS

SEQ ID NO: 696309 - protein, 9 aa, Homo Sapiens
GRLDMNHSF

SEQ ID NO: 696310 - protein, 9 aa, Homo Sapiens
HPNSAPGVA

SEQ ID NO: 696311 - protein, 9 aa, Homo Sapiens
CVNYDGKNL

SEQ ID NO: 696312 - protein, 9 aa, Homo Sapiens
HTPTNGKNH

SEQ ID NO: 696313 - protein, 9 aa, Homo Sapiens
LQSLQQNLP

SEQ ID NO: 696314 - protein, 9 aa, Homo Sapiens
WLQKVTDQY

SEQ ID NO: 696315 - protein, 9 aa, Homo Sapiens
ILRRIFNLC

SEQ ID NO: 696316 - protein, 9 aa, Homo Sapiens
HTRAHQVLI

SEQ ID NO: 696317 - protein, 9 aa, Homo Sapiens
VMEAIHHGV

SEQ ID NO: 696318 - protein, 9 aa, Homo Sapiens
ARLGASLLA

SEQ ID NO: 696319 - protein, 9 aa, Homo Sapiens
KEVNELMEQ

SEQ ID NO: 696320 - protein, 9 aa, Homo Sapiens
VPEGVILVH

SEQ ID NO: 696321 - protein, 9 aa, Homo Sapiens
CINTGSQVC

SEQ ID NO: 696322 - protein, 9 aa, Homo Sapiens
CVQGGTAAI

SEQ ID NO: 696323 - protein, 9 aa, Homo Sapiens
RRQAGAAAQ

SEQ ID NO: 696324 - protein, 9 aa, Homo Sapiens
VMLENFINL

SEQ ID NO: 696325 - protein, 9 aa, Homo Sapiens
LMEQLFETF

SEQ ID NO: 696326 - protein, 9 aa, Homo Sapiens
VAGEWFLIT

SEQ ID NO: 696327 - protein, 9 aa, Homo Sapiens
QNKPQGWDQ

SEQ ID NO: 696328 - protein, 9 aa, Homo Sapiens
SLQQNLPQW

SEQ ID NO: 696329 - protein, 9 aa, Homo Sapiens
LQEISGRPE

SEQ ID NO: 696330 - protein, 9 aa, Homo Sapiens
EADDPEDMA

SEQ ID NO: 696331 - protein, 9 aa, Homo Sapiens
ANDDLADAV

SEQ ID NO: 696332 - protein, 9 aa, Homo Sapiens
RSPMTLVKH

SEQ ID NO: 696333 - protein, 9 aa, Homo Sapiens
YEPQDFQEA

SEQ ID NO: 696334 - protein, 9 aa, Homo Sapiens
NVIVSLEGK

SEQ ID NO: 696335 - protein, 9 aa, Homo Sapiens
AQGKNMFFS

SEQ ID NO: 696336 - protein, 9 aa, Homo Sapiens
KVFEEQKSM

SEQ ID NO: 696337 - protein, 9 aa, Homo Sapiens
DRLEELVQE

SEQ ID NO: 696338 - protein, 9 aa, Homo Sapiens
ILSFSTPAF

SEQ ID NO: 696339 - protein, 9 aa, Homo Sapiens
AFMGNSVMI

SEQ ID NO: 696340 - protein, 9 aa, Homo Sapiens
YVCRTRQVT

SEQ ID NO: 696341 - protein, 9 aa, Homo Sapiens
DFCFTSTLL

SEQ ID NO: 696342 - protein, 9 aa, Homo Sapiens
CIIQSHLYF

SEQ ID NO: 696343 - protein, 9 aa, Homo Sapiens
FRAEEKGCG

SEQ ID NO: 696344 - protein, 9 aa, Homo Sapiens
SCSFQEWYH

SEQ ID NO: 696345 - protein, 9 aa, Homo Sapiens
ERIISMSFP

SEQ ID NO: 696346 - protein, 9 aa, Homo Sapiens
GSCSLRALS

SEQ ID NO: 696347 - protein, 9 aa, Homo Sapiens
GARRQAGAA

SEQ ID NO: 696348 - protein, 9 aa, Homo Sapiens
STALLSAQS

SEQ ID NO: 696349 - protein, 9 aa, Homo Sapiens
HGSISRIIV

SEQ ID NO: 696350 - protein, 9 aa, Homo Sapiens
FTLVVHEQI

SEQ ID NO: 696351 - protein, 9 aa, Homo Sapiens
LQQNLPQWP

SEQ ID NO: 696352 - protein, 9 aa, Homo Sapiens
RKYLSTTLM

SEQ ID NO: 696353 - protein, 9 aa, Homo Sapiens
RAGLWGWAL

SEQ ID NO: 696354 - protein, 9 aa, Homo Sapiens
MRDLLYAQG

SEQ ID NO: 696355 - protein, 9 aa, Homo Sapiens
IANVKIENM

SEQ ID NO: 696356 - protein, 9 aa, Homo Sapiens
YQDRLFNDE

SEQ ID NO: 696357 - protein, 9 aa, Homo Sapiens
NLSSHIERN

SEQ ID NO: 696358 - protein, 9 aa, Homo Sapiens
NSLDSFRCH

SEQ ID NO: 696359 - protein, 9 aa, Homo Sapiens
ILLCHHVFC

SEQ ID NO: 696360 - protein, 9 aa, Homo Sapiens
YALECEMSY

SEQ ID NO: 696361 - protein, 9 aa, Homo Sapiens
SSSLEDVKT

SEQ ID NO: 696362 - protein, 9 aa, Homo Sapiens
EAEGALGAA

SEQ ID NO: 696363 - protein, 9 aa, Homo Sapiens
TREWKDAKI

SEQ ID NO: 696364 - protein, 9 aa, Homo Sapiens
TREAEVKLR

SEQ ID NO: 696365 - protein, 9 aa, Homo Sapiens
QNLAAGRSM

SEQ ID NO: 696366 - protein, 9 aa, Homo Sapiens
STDSSSADT

SEQ ID NO: 696367 - protein, 9 aa, Homo Sapiens
KKGRSVYVA

SEQ ID NO: 696368 - protein, 9 aa, Homo Sapiens
REWKDAKIV

SEQ ID NO: 696369 - protein, 9 aa, Homo Sapiens
YQNHKTTQL

SEQ ID NO: 696370 - protein, 9 aa, Homo Sapiens
DARGNILLS

SEQ ID NO: 696371 - protein, 9 aa, Homo Sapiens
TVPNLRNLD

SEQ ID NO: 696372 - protein, 9 aa, Homo Sapiens
PCPHAAPGS

SEQ ID NO: 696373 - protein, 9 aa, Homo Sapiens
FIDKTENLV

SEQ ID NO: 696374 - protein, 9 aa, Homo Sapiens
DSVVDDIFL

SEQ ID NO: 696375 - protein, 9 aa, Homo Sapiens
WDLLVLLAF

SEQ ID NO: 696376 - protein, 9 aa, Homo Sapiens
SLAGHLLRR

SEQ ID NO: 696377 - protein, 9 aa, Homo Sapiens
ITKEPKEAN

SEQ ID NO: 696378 - protein, 9 aa, Homo Sapiens
LYHHREFRF

SEQ ID NO: 696379 - protein, 9 aa, Homo Sapiens
GPSIQTLAC

SEQ ID NO: 696380 - protein, 9 aa, Homo Sapiens
GGLQGLGVK

SEQ ID NO: 696381 - protein, 9 aa, Homo Sapiens
FSMKNNTDQ

SEQ ID NO: 696382 - protein, 9 aa, Homo Sapiens
DRSCGLIAG

SEQ ID NO: 696383 - protein, 9 aa, Homo Sapiens
FQYLYFAIL

SEQ ID NO: 696384 - protein, 9 aa, Homo Sapiens
CLLDKHLYV

SEQ ID NO: 696385 - protein, 9 aa, Homo Sapiens
LDGNVFRIL

SEQ ID NO: 696386 - protein, 9 aa, Homo Sapiens
QVGTSRSSH

SEQ ID NO: 696387 - protein, 9 aa, Homo Sapiens
GAGRPPKRN

SEQ ID NO: 696388 - protein, 9 aa, Homo Sapiens
RKDSDEEDE

SEQ ID NO: 696389 - protein, 9 aa, Homo Sapiens
EGEAEGALG

SEQ ID NO: 696390 - protein, 9 aa, Homo Sapiens
IYALECEMS

SEQ ID NO: 696391 - protein, 9 aa, Homo Sapiens
YRDPEVRFT

SEQ ID NO: 696392 - protein, 9 aa, Homo Sapiens
WKLLVATIF

SEQ ID NO: 696393 - protein, 9 aa, Homo Sapiens
PEDIVENVL

SEQ ID NO: 696394 - protein, 9 aa, Homo Sapiens
ETGCLCPSW

SEQ ID NO: 696395 - protein, 9 aa, Homo Sapiens
LCSLYATMC

SEQ ID NO: 696396 - protein, 9 aa, Homo Sapiens
TTAGVGSDV

SEQ ID NO: 696397 - protein, 9 aa, Homo Sapiens
DKGEFATQT

SEQ ID NO: 696398 - protein, 9 aa, Homo Sapiens
PPAPPYPGP

SEQ ID NO: 696399 - protein, 9 aa, Homo Sapiens
HRTTLNTYY

SEQ ID NO: 696400 - protein, 9 aa, Homo Sapiens
QAAAPASDS

SEQ ID NO: 696401 - protein, 9 aa, Homo Sapiens
HDVKLTRET

SEQ ID NO: 696402 - protein, 9 aa, Homo Sapiens
TKFKGTVVE

SEQ ID NO: 696403 - protein, 9 aa, Homo Sapiens
DWFLLLLHG

SEQ ID NO: 696404 - protein, 9 aa, Homo Sapiens
LTLKYAEEL

SEQ ID NO: 696405 - protein, 9 aa, Homo Sapiens
QVRKELQAK

SEQ ID NO: 696406 - protein, 9 aa, Homo Sapiens
VLKKQSCLL

SEQ ID NO: 696407 - protein, 9 aa, Homo Sapiens
SESINEFGI

SEQ ID NO: 696408 - protein, 9 aa, Homo Sapiens
PPTPTPRLP

SEQ ID NO: 696409 - protein, 9 aa, Homo Sapiens
SSTGCDPSN

SEQ ID NO: 696410 - protein, 9 aa, Homo Sapiens
AHVDGSIKS

SEQ ID NO: 696411 - protein, 9 aa, Homo Sapiens
HCKRSKSKD

SEQ ID NO: 696412 - protein, 9 aa, Homo Sapiens
INLSSHIER

SEQ ID NO: 696413 - protein, 9 aa, Homo Sapiens
DALDPDGKL

SEQ ID NO: 696414 - protein, 9 aa, Homo Sapiens
KFKGTVVEL

SEQ ID NO: 696415 - protein, 9 aa, Homo Sapiens
LLRRPGGST

SEQ ID NO: 696416 - protein, 9 aa, Homo Sapiens
KYSTYAKIK

SEQ ID NO: 696417 - protein, 9 aa, Homo Sapiens
TSSKKRSYS

SEQ ID NO: 696418 - protein, 9 aa, Homo Sapiens
ACPDGFDKG

SEQ ID NO: 696419 - protein, 9 aa, Homo Sapiens
VMEDDPDVP

SEQ ID NO: 696420 - protein, 9 aa, Homo Sapiens
KEIQGEIKS

SEQ ID NO: 696421 - protein, 9 aa, Homo Sapiens
VDDIFLVDI

SEQ ID NO: 696422 - protein, 9 aa, Homo Sapiens
HNSVFQQGM

SEQ ID NO: 696423 - protein, 9 aa, Homo Sapiens
TWQRPLTLP

SEQ ID NO: 696424 - protein, 9 aa, Homo Sapiens
EESQEATRK

SEQ ID NO: 696425 - protein, 9 aa, Homo Sapiens
IEGHRVELR

SEQ ID NO: 696426 - protein, 9 aa, Homo Sapiens
SQNLAAGRS

SEQ ID NO: 696427 - protein, 9 aa, Homo Sapiens
CYSTATGHK

SEQ ID NO: 696428 - protein, 9 aa, Homo Sapiens
ETLAGMAAL

SEQ ID NO: 696429 - protein, 9 aa, Homo Sapiens
EDSRSPEAG

SEQ ID NO: 696430 - protein, 9 aa, Homo Sapiens
VFSTGVAEF

SEQ ID NO: 696431 - protein, 9 aa, Homo Sapiens
DVFNEGGEK

SEQ ID NO: 696432 - protein, 9 aa, Homo Sapiens
PLILLCHHV

SEQ ID NO: 696433 - protein, 9 aa, Homo Sapiens
APTSQNLAA

SEQ ID NO: 696434 - protein, 9 aa, Homo Sapiens
KLWKARLGG

SEQ ID NO: 696435 - protein, 9 aa, Homo Sapiens
SLLYVVESQ

SEQ ID NO: 696436 - protein, 9 aa, Homo Sapiens
HIFSMLVAS

SEQ ID NO: 696437 - protein, 9 aa, Homo Sapiens
ADALDPDGK

SEQ ID NO: 696438 - protein, 9 aa, Homo Sapiens
KKNDLPETA

SEQ ID NO: 696439 - protein, 9 aa, Homo Sapiens
PYNSVLFMY

SEQ ID NO: 696440 - protein, 9 aa, Homo Sapiens
LCQATAQPS

SEQ ID NO: 696441 - protein, 9 aa, Homo Sapiens
LKSGCRSLT

SEQ ID NO: 696442 - protein, 9 aa, Homo Sapiens
YLHKIKDSV

SEQ ID NO: 696443 - protein, 9 aa, Homo Sapiens
THLHTPMDF

SEQ ID NO: 696444 - protein, 9 aa, Homo Sapiens
VTTRPACGG

SEQ ID NO: 696445 - protein, 9 aa, Homo Sapiens
QNHKTTQLK

SEQ ID NO: 696446 - protein, 9 aa, Homo Sapiens
LLQFQVSAC

SEQ ID NO: 696447 - protein, 9 aa, Homo Sapiens
KEKYSTYAK

SEQ ID NO: 696448 - protein, 9 aa, Homo Sapiens
GKESDLVDV

SEQ ID NO: 696449 - protein, 9 aa, Homo Sapiens
VDTGPPSPT

SEQ ID NO: 696450 - protein, 9 aa, Homo Sapiens
PTSQNLAAG

SEQ ID NO: 696451 - protein, 9 aa, Homo Sapiens
IATAMAAVV

SEQ ID NO: 696452 - protein, 9 aa, Homo Sapiens
STSSLTLGL

SEQ ID NO: 696453 - protein, 9 aa, Homo Sapiens
DTKKPELVM

SEQ ID NO: 696454 - protein, 9 aa, Homo Sapiens
LDSFRCHCQ

SEQ ID NO: 696455 - protein, 9 aa, Homo Sapiens
WLLMLAAVL

SEQ ID NO: 696456 - protein, 9 aa, Homo Sapiens
EHISGYNIT

SEQ ID NO: 696457 - protein, 9 aa, Homo Sapiens
PGTCPVKLL

SEQ ID NO: 696458 - protein, 9 aa, Homo Sapiens
LFMYVRQSS

SEQ ID NO: 696459 - protein, 9 aa, Homo Sapiens
HCSLLHYSA

SEQ ID NO: 696460 - protein, 9 aa, Homo Sapiens
FYLLKIINF

SEQ ID NO: 696461 - protein, 9 aa, Homo Sapiens
HKTTQLKIE

SEQ ID NO: 696462 - protein, 9 aa, Homo Sapiens
LKSRVRTHT

SEQ ID NO: 696463 - protein, 9 aa, Homo Sapiens
ILELQVLHA

SEQ ID NO: 696464 - protein, 9 aa, Homo Sapiens
LELFIDKTE

SEQ ID NO: 696465 - protein, 9 aa, Homo Sapiens
FCEVTERCW

SEQ ID NO: 696466 - protein, 9 aa, Homo Sapiens
EGSSVTFRC

SEQ ID NO: 696467 - protein, 9 aa, Homo Sapiens
TVMEDDPDV

SEQ ID NO: 696468 - protein, 9 aa, Homo Sapiens
TNCRLSEVD

SEQ ID NO: 696469 - protein, 9 aa, Homo Sapiens
KEELATWQR

SEQ ID NO: 696470 - protein, 9 aa, Homo Sapiens
LECEMSYTT

SEQ ID NO: 696471 - protein, 9 aa, Homo Sapiens
TSANAKIYQ

SEQ ID NO: 696472 - protein, 9 aa, Homo Sapiens
TSLKEEFNG

SEQ ID NO: 696473 - protein, 9 aa, Homo Sapiens
IPSVWHLWR

SEQ ID NO: 696474 - protein, 9 aa, Homo Sapiens
VDVMHLSQS

SEQ ID NO: 696475 - protein, 9 aa, Homo Sapiens
LQSEAASLR

SEQ ID NO: 696476 - protein, 9 aa, Homo Sapiens
SFYACLLDK

SEQ ID NO: 696477 - protein, 9 aa, Homo Sapiens
NTGLPPSRN

SEQ ID NO: 696478 - protein, 9 aa, Homo Sapiens
PRSTKTSVR

SEQ ID NO: 696479 - protein, 9 aa, Homo Sapiens
HVDGSIKSN

SEQ ID NO: 696480 - protein, 9 aa, Homo Sapiens
TGWNNTQGK

SEQ ID NO: 696481 - protein, 9 aa, Homo Sapiens
SACDAGVPP

SEQ ID NO: 696482 - protein, 9 aa, Homo Sapiens
MGCDRSCGL

SEQ ID NO: 696483 - protein, 9 aa, Homo Sapiens
ILANLQNIS

SEQ ID NO: 696484 - protein, 9 aa, Homo Sapiens
NTGLPPSRR

SEQ ID NO: 696485 - protein, 9 aa, Homo Sapiens
PPAGIALKG

SEQ ID NO: 696486 - protein, 9 aa, Homo Sapiens
TPNWRPGFR

SEQ ID NO: 696487 - protein, 9 aa, Homo Sapiens
WAKRKHGQE

SEQ ID NO: 696488 - protein, 9 aa, Homo Sapiens
HTPMDFFLG

SEQ ID NO: 696489 - protein, 9 aa, Homo Sapiens
RPAVLKDFQ

SEQ ID NO: 696490 - protein, 9 aa, Homo Sapiens
NFISFPCLS

SEQ ID NO: 696491 - protein, 9 aa, Homo Sapiens
ILNTSLHIV

SEQ ID NO: 696492 - protein, 9 aa, Homo Sapiens
EELATWQRP

SEQ ID NO: 696493 - protein, 9 aa, Homo Sapiens
SMVIRWYKL

SEQ ID NO: 696494 - protein, 9 aa, Homo Sapiens
RGGSSPQRP

SEQ ID NO: 696495 - protein, 9 aa, Homo Sapiens
LLPFEDLGD

SEQ ID NO: 696496 - protein, 9 aa, Homo Sapiens
KPELVMAAV

SEQ ID NO: 696497 - protein, 9 aa, Homo Sapiens
SEVDVMHLS

SEQ ID NO: 696498 - protein, 9 aa, Homo Sapiens
SLVRILRSN

SEQ ID NO: 696499 - protein, 9 aa, Homo Sapiens
VTLSQDCSV

SEQ ID NO: 696500 - protein, 9 aa, Homo Sapiens
AFNDLFNLR

SEQ ID NO: 696501 - protein, 9 aa, Homo Sapiens
RPPAPPYPG

SEQ ID NO: 696502 - protein, 9 aa, Homo Sapiens
PSLPSQGTK

SEQ ID NO: 696503 - protein, 9 aa, Homo Sapiens
DILYFLLLV

SEQ ID NO: 696504 - protein, 9 aa, Homo Sapiens
RPSSLNLDH

SEQ ID NO: 696505 - protein, 9 aa, Homo Sapiens
VTGNSRHLP

SEQ ID NO: 696506 - protein, 9 aa, Homo Sapiens
IITILEDDV

SEQ ID NO: 696507 - protein, 9 aa, Homo Sapiens
WKACCCECS

SEQ ID NO: 696508 - protein, 9 aa, Homo Sapiens
PGSALGGSR

SEQ ID NO: 696509 - protein, 9 aa, Homo Sapiens
SSHEMARNE

SEQ ID NO: 696510 - protein, 9 aa, Homo Sapiens
LTICPVGCQ

SEQ ID NO: 696511 - protein, 9 aa, Homo Sapiens
PYYQMIAEI

SEQ ID NO: 696512 - protein, 9 aa, Homo Sapiens
RSTKTSVRG

SEQ ID NO: 696513 - protein, 9 aa, Homo Sapiens
NCCIRLGEK

SEQ ID NO: 696514 - protein, 9 aa, Homo Sapiens
FGLKLLKRR

SEQ ID NO: 696515 - protein, 9 aa, Homo Sapiens
LLESKLDAK

SEQ ID NO: 696516 - protein, 9 aa, Homo Sapiens
TPGLQPRAA

SEQ ID NO: 696517 - protein, 9 aa, Homo Sapiens
VKEEMKKND

SEQ ID NO: 696518 - protein, 9 aa, Homo Sapiens
VFSDSPGTT

SEQ ID NO: 696519 - protein, 9 aa, Homo Sapiens
FIYVWLFSS

SEQ ID NO: 696520 - protein, 9 aa, Homo Sapiens
NSASPPAEN

SEQ ID NO: 696521 - protein, 9 aa, Homo Sapiens
RFSHRTRRG

SEQ ID NO: 696522 - protein, 9 aa, Homo Sapiens
LLASLLVFY

SEQ ID NO: 696523 - protein, 9 aa, Homo Sapiens
PGAFNDLFN

SEQ ID NO: 696524 - protein, 9 aa, Homo Sapiens
GLPIWLLQD

SEQ ID NO: 696525 - protein, 9 aa, Homo Sapiens
SASPPAENE

SEQ ID NO: 696526 - protein, 9 aa, Homo Sapiens
RDRRLPGPL

SEQ ID NO: 696527 - protein, 9 aa, Homo Sapiens
EPHFFDSNY

SEQ ID NO: 696528 - protein, 9 aa, Homo Sapiens
AQRTLCRDV

SEQ ID NO: 696529 - protein, 9 aa, Homo Sapiens
GCTGWNNTQ

SEQ ID NO: 696530 - protein, 9 aa, Homo Sapiens
NWRPGFRYY

SEQ ID NO: 696531 - protein, 9 aa, Homo Sapiens
STATGHKML

SEQ ID NO: 696532 - protein, 9 aa, Homo Sapiens
GPPSPTVAP

SEQ ID NO: 696533 - protein, 9 aa, Homo Sapiens
AIPKSSIRV

SEQ ID NO: 696534 - protein, 9 aa, Homo Sapiens
LAKPSSTIT

SEQ ID NO: 696535 - protein, 9 aa, Homo Sapiens
PPAPEFPWK

SEQ ID NO: 696536 - protein, 9 aa, Homo Sapiens
AFLLCGCIV

SEQ ID NO: 696537 - protein, 9 aa, Homo Sapiens
ATGHKMLVD

SEQ ID NO: 696538 - protein, 9 aa, Homo Sapiens
PCGAPRQRP

SEQ ID NO: 696539 - protein, 9 aa, Homo Sapiens
CDAGVPPLS

SEQ ID NO: 696540 - protein, 9 aa, Homo Sapiens
LPNAYIYVV

SEQ ID NO: 696541 - protein, 9 aa, Homo Sapiens
RASFYACLL

SEQ ID NO: 696542 - protein, 9 aa, Homo Sapiens
PVCSTPKCP

SEQ ID NO: 696543 - protein, 9 aa, Homo Sapiens
GADALDPDG

SEQ ID NO: 696544 - protein, 9 aa, Homo Sapiens
FKGFGLKLL

SEQ ID NO: 696545 - protein, 9 aa, Homo Sapiens
RNRHGLLLP

SEQ ID NO: 696546 - protein, 9 aa, Homo Sapiens
CVIAKNAAG

SEQ ID NO: 696547 - protein, 9 aa, Homo Sapiens
PRLPLPVKS

SEQ ID NO: 696548 - protein, 9 aa, Homo Sapiens
PKLGVPPPS

SEQ ID NO: 696549 - protein, 9 aa, Homo Sapiens
LPLPVKSPA

SEQ ID NO: 696550 - protein, 9 aa, Homo Sapiens
TPNGLSNGA

SEQ ID NO: 696551 - protein, 9 aa, Homo Sapiens
EQLITKEPK

SEQ ID NO: 696552 - protein, 9 aa, Homo Sapiens
FSRWILWDG

SEQ ID NO: 696553 - protein, 9 aa, Homo Sapiens
ILDEVTLKY

SEQ ID NO: 696554 - protein, 9 aa, Homo Sapiens
CYIGLQGIV

SEQ ID NO: 696555 - protein, 9 aa, Homo Sapiens
EFLPNLDPV

SEQ ID NO: 696556 - protein, 9 aa, Homo Sapiens
LATWQRPLT

SEQ ID NO: 696557 - protein, 9 aa, Homo Sapiens
VDARGNILL

SEQ ID NO: 696558 - protein, 9 aa, Homo Sapiens
RRKYKMREP

SEQ ID NO: 696559 - protein, 9 aa, Homo Sapiens
AEVKLRLRL

SEQ ID NO: 696560 - protein, 9 aa, Homo Sapiens
EGALGAAEP

SEQ ID NO: 696561 - protein, 9 aa, Homo Sapiens
ADTVRLEFS

SEQ ID NO: 696562 - protein, 9 aa, Homo Sapiens
VCGCTMESL

SEQ ID NO: 696563 - protein, 9 aa, Homo Sapiens
HKLWKARLG

SEQ ID NO: 696564 - protein, 9 aa, Homo Sapiens
QEVINLSSH

SEQ ID NO: 696565 - protein, 9 aa, Homo Sapiens
KLVQHKRIH

SEQ ID NO: 696566 - protein, 9 aa, Homo Sapiens
PPSPTHGPA

SEQ ID NO: 696567 - protein, 9 aa, Homo Sapiens
PLFIPYNIA

SEQ ID NO: 696568 - protein, 9 aa, Homo Sapiens
ILLALLLAT

SEQ ID NO: 696569 - protein, 9 aa, Homo Sapiens
FIANVKIEN

SEQ ID NO: 696570 - protein, 9 aa, Homo Sapiens
IAMDILPVD

SEQ ID NO: 696571 - protein, 9 aa, Homo Sapiens
WRPGFRYYH

SEQ ID NO: 696572 - protein, 9 aa, Homo Sapiens
GLVNLTIIH

SEQ ID NO: 696573 - protein, 9 aa, Homo Sapiens
TAGVGSDVE

SEQ ID NO: 696574 - protein, 9 aa, Homo Sapiens
WKARLGGYE

SEQ ID NO: 696575 - protein, 9 aa, Homo Sapiens
YGHLAPDMN

SEQ ID NO: 696576 - protein, 9 aa, Homo Sapiens
TSRSSHEMA

SEQ ID NO: 696577 - protein, 9 aa, Homo Sapiens
SLLVMSVDN

SEQ ID NO: 696578 - protein, 9 aa, Homo Sapiens
QEVSLEVAS

SEQ ID NO: 696579 - protein, 9 aa, Homo Sapiens
LAVTLDEWR

SEQ ID NO: 696580 - protein, 9 aa, Homo Sapiens
LYSAVGRNG

SEQ ID NO: 696581 - protein, 9 aa, Homo Sapiens
ASDSGADSE

SEQ ID NO: 696582 - protein, 9 aa, Homo Sapiens
DGNSEVAEL

SEQ ID NO: 696583 - protein, 9 aa, Homo Sapiens
PAMLTLAST

SEQ ID NO: 696584 - protein, 9 aa, Homo Sapiens
KTTQLKIEN

SEQ ID NO: 696585 - protein, 9 aa, Homo Sapiens
SSVLSIKPK

SEQ ID NO: 696586 - protein, 9 aa, Homo Sapiens
TRKASHQNL

SEQ ID NO: 696587 - protein, 9 aa, Homo Sapiens
GPEPGRQEQ

SEQ ID NO: 696588 - protein, 9 aa, Homo Sapiens
LGGAPEYEC

SEQ ID NO: 696589 - protein, 9 aa, Homo Sapiens
PCLSYKDYK

SEQ ID NO: 696590 - protein, 9 aa, Homo Sapiens
LRQCLSGCW

SEQ ID NO: 696591 - protein, 9 aa, Homo Sapiens
GRQEQLVFG

SEQ ID NO: 696592 - protein, 9 aa, Homo Sapiens
LLVPHLQIL

SEQ ID NO: 696593 - protein, 9 aa, Homo Sapiens
PKTCSSTGC

SEQ ID NO: 696594 - protein, 9 aa, Homo Sapiens
RAHDVKLTR

SEQ ID NO: 696595 - protein, 9 aa, Homo Sapiens
SQEGRGHPR

SEQ ID NO: 696596 - protein, 9 aa, Homo Sapiens
RESEKTVSQ

SEQ ID NO: 696597 - protein, 9 aa, Homo Sapiens
VVLQSEAAS

SEQ ID NO: 696598 - protein, 9 aa, Homo Sapiens
SGSLCFHIF

SEQ ID NO: 696599 - protein, 9 aa, Homo Sapiens
RPGFRYYHW

SEQ ID NO: 696600 - protein, 9 aa, Homo Sapiens
EGNIIAFCV

SEQ ID NO: 696601 - protein, 9 aa, Homo Sapiens
SILFQQGVR

SEQ ID NO: 696602 - protein, 9 aa, Homo Sapiens
LDREHISGY

SEQ ID NO: 696603 - protein, 9 aa, Homo Sapiens
VPPPSPTHG

SEQ ID NO: 696604 - protein, 9 aa, Homo Sapiens
IIHLQHNRL

SEQ ID NO: 696605 - protein, 9 aa, Homo Sapiens
TDTDPMLQT

SEQ ID NO: 696606 - protein, 9 aa, Homo Sapiens
QTWAKRKHG

SEQ ID NO: 696607 - protein, 9 aa, Homo Sapiens
QENLERQKK

SEQ ID NO: 696608 - protein, 9 aa, Homo Sapiens
RMQLLLTPG

SEQ ID NO: 696609 - protein, 9 aa, Homo Sapiens
ERTLDREHI

SEQ ID NO: 696610 - protein, 9 aa, Homo Sapiens
VLKDFQYLY

SEQ ID NO: 696611 - protein, 9 aa, Homo Sapiens
LKKQSCLLQ

SEQ ID NO: 696612 - protein, 9 aa, Homo Sapiens
RKKEKRKKF

SEQ ID NO: 696613 - protein, 9 aa, Homo Sapiens
LGPSIQTLA

SEQ ID NO: 696614 - protein, 9 aa, Homo Sapiens
QEGRGHPRS

SEQ ID NO: 696615 - protein, 9 aa, Homo Sapiens
SFQDHLLHV

SEQ ID NO: 696616 - protein, 9 aa, Homo Sapiens
LPVDNKRYR

SEQ ID NO: 696617 - protein, 9 aa, Homo Sapiens
YFSVDKEIQ

SEQ ID NO: 696618 - protein, 9 aa, Homo Sapiens
PAQRTLCRD

SEQ ID NO: 696619 - protein, 9 aa, Homo Sapiens
PASDSGADS

SEQ ID NO: 696620 - protein, 9 aa, Homo Sapiens
RFGECCPIC

SEQ ID NO: 696621 - protein, 9 aa, Homo Sapiens
FSFQDHLLH

SEQ ID NO: 696622 - protein, 9 aa, Homo Sapiens
REPLILLCH

SEQ ID NO: 696623 - protein, 9 aa, Homo Sapiens
PPHPIAVAA

SEQ ID NO: 696624 - protein, 9 aa, Homo Sapiens
VNLNFMNVW

SEQ ID NO: 696625 - protein, 9 aa, Homo Sapiens
RVELRSQEF

SEQ ID NO: 696626 - protein, 9 aa, Homo Sapiens
SVTPLSFQV

SEQ ID NO: 696627 - protein, 9 aa, Homo Sapiens
LQWRPSLQY

SEQ ID NO: 696628 - protein, 9 aa, Homo Sapiens
NTTFQEIVA

SEQ ID NO: 696629 - protein, 9 aa, Homo Sapiens
VQHKRIHSG

SEQ ID NO: 696630 - protein, 9 aa, Homo Sapiens
PTGNEAIVP

SEQ ID NO: 696631 - protein, 9 aa, Homo Sapiens
SFPCLSYKD

SEQ ID NO: 696632 - protein, 9 aa, Homo Sapiens
LVMLISCVF

SEQ ID NO: 696633 - protein, 9 aa, Homo Sapiens
LVGPQGPLA

SEQ ID NO: 696634 - protein, 9 aa, Homo Sapiens
CVFLPLLRG

SEQ ID NO: 696635 - protein, 9 aa, Homo Sapiens
FYACLLDKH

SEQ ID NO: 696636 - protein, 9 aa, Homo Sapiens
ILFMYVRQS

SEQ ID NO: 696637 - protein, 9 aa, Homo Sapiens
STREAEVKL

SEQ ID NO: 696638 - protein, 9 aa, Homo Sapiens
FIRRKYKMR

SEQ ID NO: 696639 - protein, 9 aa, Homo Sapiens
DTSDWMPEA

SEQ ID NO: 696640 - protein, 9 aa, Homo Sapiens
SPEIRFGEC

SEQ ID NO: 696641 - protein, 9 aa, Homo Sapiens
GSALGGSRE

SEQ ID NO: 696642 - protein, 9 aa, Homo Sapiens
AMNLLTSMP

SEQ ID NO: 696643 - protein, 9 aa, Homo Sapiens
HEAGREDFA

SEQ ID NO: 696644 - protein, 9 aa, Homo Sapiens
AGAGRPPKR

SEQ ID NO: 696645 - protein, 9 aa, Homo Sapiens
EVPGPEPGR

SEQ ID NO: 696646 - protein, 9 aa, Homo Sapiens
DDPTCSCPA

SEQ ID NO: 696647 - protein, 9 aa, Homo Sapiens
SLLKWLRNR

SEQ ID NO: 696648 - protein, 9 aa, Homo Sapiens
ILINLTDED

SEQ ID NO: 696649 - protein, 9 aa, Homo Sapiens
CQATAQPSV

SEQ ID NO: 696650 - protein, 9 aa, Homo Sapiens
VGPQGPLAS

SEQ ID NO: 696651 - protein, 9 aa, Homo Sapiens
VLLIWLLML

SEQ ID NO: 696652 - protein, 9 aa, Homo Sapiens
SLNLDHAIP

SEQ ID NO: 696653 - protein, 9 aa, Homo Sapiens
EAWKDVTSA

SEQ ID NO: 696654 - protein, 9 aa, Homo Sapiens
TASTHDSSL

SEQ ID NO: 696655 - protein, 9 aa, Homo Sapiens
SRWILWDGN

SEQ ID NO: 696656 - protein, 9 aa, Homo Sapiens
FTLTFPSDH

SEQ ID NO: 696657 - protein, 9 aa, Homo Sapiens
IVTTRPACG

SEQ ID NO: 696658 - protein, 9 aa, Homo Sapiens
QSWTGFEAT

SEQ ID NO: 696659 - protein, 9 aa, Homo Sapiens
DDLDLGGAP

SEQ ID NO: 696660 - protein, 9 aa, Homo Sapiens
RRPGGSTSR

SEQ ID NO: 696661 - protein, 9 aa, Homo Sapiens
WDAFRPTLV

SEQ ID NO: 696662 - protein, 9 aa, Homo Sapiens
NTSLHIVTN

SEQ ID NO: 696663 - protein, 9 aa, Homo Sapiens
NVEPGAFND

SEQ ID NO: 696664 - protein, 9 aa, Homo Sapiens
VVTPMLNAI

SEQ ID NO: 696665 - protein, 9 aa, Homo Sapiens
AGIFSFQDH

SEQ ID NO: 696666 - protein, 9 aa, Homo Sapiens
LCYVFDREK

SEQ ID NO: 696667 - protein, 9 aa, Homo Sapiens
TSLHIVTNE

SEQ ID NO: 696668 - protein, 9 aa, Homo Sapiens
QEGSSVTFR

SEQ ID NO: 696669 - protein, 9 aa, Homo Sapiens
AAAPNPGLR

SEQ ID NO: 696670 - protein, 9 aa, Homo Sapiens
LHKIKDSVL

SEQ ID NO: 696671 - protein, 9 aa, Homo Sapiens
HATREWKDA

SEQ ID NO: 696672 - protein, 9 aa, Homo Sapiens
MEFSGILEL

SEQ ID NO: 696673 - protein, 9 aa, Homo Sapiens
SITSDVWAF

SEQ ID NO: 696674 - protein, 9 aa, Homo Sapiens
KSNYKMMVV

SEQ ID NO: 696675 - protein, 9 aa, Homo Sapiens
YCSSHAGEH

SEQ ID NO: 696676 - protein, 9 aa, Homo Sapiens
GQHRTTLNT

SEQ ID NO: 696677 - protein, 9 aa, Homo Sapiens
LRSKPPDLK

SEQ ID NO: 696678 - protein, 9 aa, Homo Sapiens
SSHAGEHVK

SEQ ID NO: 696679 - protein, 9 aa, Homo Sapiens
SNYEKGLEW

SEQ ID NO: 696680 - protein, 9 aa, Homo Sapiens
RKTDTDPML

SEQ ID NO: 696681 - protein, 9 aa, Homo Sapiens
AMTRFANKD

SEQ ID NO: 696682 - protein, 9 aa, Homo Sapiens
GGWGSGGQC

SEQ ID NO: 696683 - protein, 9 aa, Homo Sapiens
AYEFCVIAK

SEQ ID NO: 696684 - protein, 9 aa, Homo Sapiens
TFLLTCVFL

SEQ ID NO: 696685 - protein, 9 aa, Homo Sapiens
KQATSQENP

SEQ ID NO: 696686 - protein, 9 aa, Homo Sapiens
GFGLKLLKR

SEQ ID NO: 696687 - protein, 9 aa, Homo Sapiens
INISGLRFD

SEQ ID NO: 696688 - protein, 9 aa, Homo Sapiens
LTVNLNFMN

SEQ ID NO: 696689 - protein, 9 aa, Homo Sapiens
EIRFGECCP

SEQ ID NO: 696690 - protein, 9 aa, Homo Sapiens
TLASTDTWV

SEQ ID NO: 696691 - protein, 9 aa, Homo Sapiens
ICKTRHNSV

SEQ ID NO: 696692 - protein, 9 aa, Homo Sapiens
LLKKGRSVY

SEQ ID NO: 696693 - protein, 9 aa, Homo Sapiens
VDVQEGSSV

SEQ ID NO: 696694 - protein, 9 aa, Homo Sapiens
LKMDSNKEY

SEQ ID NO: 696695 - protein, 9 aa, Homo Sapiens
CPVGCQGPD

SEQ ID NO: 696696 - protein, 9 aa, Homo Sapiens
PKELVSCAD

SEQ ID NO: 696697 - protein, 9 aa, Homo Sapiens
ASTDTWVYE

SEQ ID NO: 696698 - protein, 9 aa, Homo Sapiens
SRSPEAGTE

SEQ ID NO: 696699 - protein, 9 aa, Homo Sapiens
LYPPGYGPI

SEQ ID NO: 696700 - protein, 9 aa, Homo Sapiens
AAYSSSLED

SEQ ID NO: 696701 - protein, 9 aa, Homo Sapiens
RGNILLSTL

SEQ ID NO: 696702 - protein, 9 aa, Homo Sapiens
LPLKRKQSR

SEQ ID NO: 696703 - protein, 9 aa, Homo Sapiens
QGLGVKKQD

SEQ ID NO: 696704 - protein, 9 aa, Homo Sapiens
LGDLEPLEL

SEQ ID NO: 696705 - protein, 9 aa, Homo Sapiens
QAKATVSGS

SEQ ID NO: 696706 - protein, 9 aa, Homo Sapiens
NRHGLLLPN

SEQ ID NO: 696707 - protein, 9 aa, Homo Sapiens
TILFMYVRQ

SEQ ID NO: 696708 - protein, 9 aa, Homo Sapiens
PGFCRKARG

SEQ ID NO: 696709 - protein, 9 aa, Homo Sapiens
GYGLKSRVR

SEQ ID NO: 696710 - protein, 9 aa, Homo Sapiens
LVQHKRIHS

SEQ ID NO: 696711 - protein, 9 aa, Homo Sapiens
DVKLTRETE

SEQ ID NO: 696712 - protein, 9 aa, Homo Sapiens
FYCSSHAGE

SEQ ID NO: 696713 - protein, 9 aa, Homo Sapiens
VNFTACNLT

SEQ ID NO: 696714 - protein, 9 aa, Homo Sapiens
TGMLAALTI

SEQ ID NO: 696715 - protein, 9 aa, Homo Sapiens
GIYALECEM

SEQ ID NO: 696716 - protein, 9 aa, Homo Sapiens
VRKELQAKA

SEQ ID NO: 696717 - protein, 9 aa, Homo Sapiens
LLKIINFSR

SEQ ID NO: 696718 - protein, 9 aa, Homo Sapiens
FRILANLQN

SEQ ID NO: 696719 - protein, 9 aa, Homo Sapiens
DSHCSVTPL

SEQ ID NO: 696720 - protein, 9 aa, Homo Sapiens
ALGAAEPFL

SEQ ID NO: 696721 - protein, 9 aa, Homo Sapiens
RELNADIVV

SEQ ID NO: 696722 - protein, 9 aa, Homo Sapiens
TLSQDCSVR

SEQ ID NO: 696723 - protein, 9 aa, Homo Sapiens
PEARLSDIE

SEQ ID NO: 696724 - protein, 9 aa, Homo Sapiens
SMKNNTDQF

SEQ ID NO: 696725 - protein, 9 aa, Homo Sapiens
LASLLVFYV

SEQ ID NO: 696726 - protein, 9 aa, Homo Sapiens
HLHTPMDFF

SEQ ID NO: 696727 - protein, 9 aa, Homo Sapiens
LLKQKKSPC

SEQ ID NO: 696728 - protein, 9 aa, Homo Sapiens
YRQNTVLNR

SEQ ID NO: 696729 - protein, 9 aa, Homo Sapiens
RPGGSTSRL

SEQ ID NO: 696730 - protein, 9 aa, Homo Sapiens
YYIAMDILP

SEQ ID NO: 696731 - protein, 9 aa, Homo Sapiens
AQRETGCLC

SEQ ID NO: 696732 - protein, 9 aa, Homo Sapiens
FKGTVVELS

SEQ ID NO: 696733 - protein, 9 aa, Homo Sapiens
GPSPGKSRV

SEQ ID NO: 696734 - protein, 9 aa, Homo Sapiens
TLTFPSDHA

SEQ ID NO: 696735 - protein, 9 aa, Homo Sapiens
MAVAFLLCG

SEQ ID NO: 696736 - protein, 9 aa, Homo Sapiens
SLPLGSTEC

SEQ ID NO: 696737 - protein, 9 aa, Homo Sapiens
EVINLSSHI

SEQ ID NO: 696738 - protein, 9 aa, Homo Sapiens
GEFLPNLDP

SEQ ID NO: 696739 - protein, 9 aa, Homo Sapiens
RQEQLVFGS

SEQ ID NO: 696740 - protein, 9 aa, Homo Sapiens
QQTWAKRKH

SEQ ID NO: 696741 - protein, 9 aa, Homo Sapiens
RRLIGCSSQ

SEQ ID NO: 696742 - protein, 9 aa, Homo Sapiens
KTGLLMTAL

SEQ ID NO: 696743 - protein, 9 aa, Homo Sapiens
ILKKTQKDG

SEQ ID NO: 696744 - protein, 9 aa, Homo Sapiens
EFPWKKEKK

SEQ ID NO: 696745 - protein, 9 aa, Homo Sapiens
PEAMVFQDS

SEQ ID NO: 696746 - protein, 9 aa, Homo Sapiens
LAGDKPANA

SEQ ID NO: 696747 - protein, 9 aa, Homo Sapiens
INFSRLIFH

SEQ ID NO: 696748 - protein, 9 aa, Homo Sapiens
PLRDSLLYV

SEQ ID NO: 696749 - protein, 9 aa, Homo Sapiens
QQDSHCSVT

SEQ ID NO: 696750 - protein, 9 aa, Homo Sapiens
AKRKHGQEM

SEQ ID NO: 696751 - protein, 9 aa, Homo Sapiens
PVFPVKGGF

SEQ ID NO: 696752 - protein, 9 aa, Homo Sapiens
NSLLVMSVD

SEQ ID NO: 696753 - protein, 9 aa, Homo Sapiens
TIIHLQHNR

SEQ ID NO: 696754 - protein, 9 aa, Homo Sapiens
LYRQNTVLN

SEQ ID NO: 696755 - protein, 9 aa, Homo Sapiens
ASAEDQSAS

SEQ ID NO: 696756 - protein, 9 aa, Homo Sapiens
YVADNRGWM

SEQ ID NO: 696757 - protein, 9 aa, Homo Sapiens
PPRSSLCAV

SEQ ID NO: 696758 - protein, 9 aa, Homo Sapiens
LRRPGGSTS

SEQ ID NO: 696759 - protein, 9 aa, Homo Sapiens
STTGMLAAL

SEQ ID NO: 696760 - protein, 9 aa, Homo Sapiens
FEATLTVME

SEQ ID NO: 696761 - protein, 9 aa, Homo Sapiens
RSVYVADNR

SEQ ID NO: 696762 - protein, 9 aa, Homo Sapiens
LWDGNSEVA

SEQ ID NO: 696763 - protein, 9 aa, Homo Sapiens
FSVDKEIQG

SEQ ID NO: 696764 - protein, 9 aa, Homo Sapiens
SQYIPPLPS

SEQ ID NO: 696765 - protein, 9 aa, Homo Sapiens
VAKGGTAWL

SEQ ID NO: 696766 - protein, 9 aa, Homo Sapiens
AKCRELNAD

SEQ ID NO: 696767 - protein, 9 aa, Homo Sapiens
MMFCEVLKK

SEQ ID NO: 696768 - protein, 9 aa, Homo Sapiens
FRSPPGFCR

SEQ ID NO: 696769 - protein, 9 aa, Homo Sapiens
KGEKGDRGL

SEQ ID NO: 696770 - protein, 9 aa, Homo Sapiens
YQFSMKNNT

SEQ ID NO: 696771 - protein, 9 aa, Homo Sapiens
VEDDLDLGG

SEQ ID NO: 696772 - protein, 9 aa, Homo Sapiens
CPDGFDKGE

SEQ ID NO: 696773 - protein, 9 aa, Homo Sapiens
TLGVFSDSP

SEQ ID NO: 696774 - protein, 9 aa, Homo Sapiens
ASFYACLLD

SEQ ID NO: 696775 - protein, 9 aa, Homo Sapiens
KRKDSDEED

SEQ ID NO: 696776 - protein, 9 aa, Homo Sapiens
SSWKQATSQ

SEQ ID NO: 696777 - protein, 9 aa, Homo Sapiens
SMKSVGDVM

SEQ ID NO: 696778 - protein, 9 aa, Homo Sapiens
GMAVAFLLC

SEQ ID NO: 696779 - protein, 9 aa, Homo Sapiens
TLASAEDQS

SEQ ID NO: 696780 - protein, 9 aa, Homo Sapiens
PEFPWKKEK

SEQ ID NO: 696781 - protein, 9 aa, Homo Sapiens
ARKKLEGEV

SEQ ID NO: 696782 - protein, 9 aa, Homo Sapiens
SALKEIPSV

SEQ ID NO: 696783 - protein, 9 aa, Homo Sapiens
MVAKILRLF

SEQ ID NO: 696784 - protein, 9 aa, Homo Sapiens
WLIPLWVYR

SEQ ID NO: 696785 - protein, 9 aa, Homo Sapiens
PALIALWLR

SEQ ID NO: 696786 - protein, 9 aa, Homo Sapiens
KTSVRGEEP

SEQ ID NO: 696787 - protein, 9 aa, Homo Sapiens
KAGANVNAA

SEQ ID NO: 696788 - protein, 9 aa, Homo Sapiens
IKSNKLKSA

SEQ ID NO: 696789 - protein, 9 aa, Homo Sapiens
KSVGDVMAI

SEQ ID NO: 696790 - protein, 9 aa, Homo Sapiens
RTTLNTYYS

SEQ ID NO: 696791 - protein, 9 aa, Homo Sapiens
DDEPQQEVS

SEQ ID NO: 696792 - protein, 9 aa, Homo Sapiens
LKAGANVNA

SEQ ID NO: 696793 - protein, 9 aa, Homo Sapiens
EFFHPLYHH

SEQ ID NO: 696794 - protein, 9 aa, Homo Sapiens
NVKIENMGI

SEQ ID NO: 696795 - protein, 9 aa, Homo Sapiens
MDLGGLPIW

SEQ ID NO: 696796 - protein, 9 aa, Homo Sapiens
AHDVKLTRE

SEQ ID NO: 696797 - protein, 9 aa, Homo Sapiens
EYEYPKKPL

SEQ ID NO: 696798 - protein, 9 aa, Homo Sapiens
LVLDSVVDD

SEQ ID NO: 696799 - protein, 9 aa, Homo Sapiens
NTSLKEEFN

SEQ ID NO: 696800 - protein, 9 aa, Homo Sapiens
KFYCSSHAG

SEQ ID NO: 696801 - protein, 9 aa, Homo Sapiens
FHPLYHHRE

SEQ ID NO: 696802 - protein, 9 aa, Homo Sapiens
GAFNDLFNL

SEQ ID NO: 696803 - protein, 9 aa, Homo Sapiens
AGAASNLYS

SEQ ID NO: 696804 - protein, 9 aa, Homo Sapiens
YESSKCWKA

SEQ ID NO: 696805 - protein, 9 aa, Homo Sapiens
EPKTCSSTG

SEQ ID NO: 696806 - protein, 9 aa, Homo Sapiens
STGVAEFPP

SEQ ID NO: 696807 - protein, 9 aa, Homo Sapiens
KDWDAFRPT

SEQ ID NO: 696808 - protein, 9 aa, Homo Sapiens
IERGQLAVA

SEQ ID NO: 696809 - protein, 9 aa, Homo Sapiens
KMDSNKEYV

SEQ ID NO: 696810 - protein, 9 aa, Homo Sapiens
AAIGSTTGM

SEQ ID NO: 696811 - protein, 9 aa, Homo Sapiens
GPCEPGAQL

SEQ ID NO: 696812 - protein, 9 aa, Homo Sapiens
VKLLPELPP

SEQ ID NO: 696813 - protein, 9 aa, Homo Sapiens
SDPSLPSQG

SEQ ID NO: 696814 - protein, 9 aa, Homo Sapiens
MNTLMYVLR

SEQ ID NO: 696815 - protein, 9 aa, Homo Sapiens
STSSKKRSY

SEQ ID NO: 696816 - protein, 9 aa, Homo Sapiens
WKDAKIVYS

SEQ ID NO: 696817 - protein, 9 aa, Homo Sapiens
KVLLKAGAN

SEQ ID NO: 696818 - protein, 9 aa, Homo Sapiens
NSVLFMYAL

SEQ ID NO: 696819 - protein, 9 aa, Homo Sapiens
GAHRLAHRL

SEQ ID NO: 696820 - protein, 9 aa, Homo Sapiens
RNLVVSFLN

SEQ ID NO: 696821 - protein, 9 aa, Homo Sapiens
TLDREHISG

SEQ ID NO: 696822 - protein, 9 aa, Homo Sapiens
SPLVVAKGG

SEQ ID NO: 696823 - protein, 9 aa, Homo Sapiens
KSSIRVIHA

SEQ ID NO: 696824 - protein, 9 aa, Homo Sapiens
SLRNLVVSF

SEQ ID NO: 696825 - protein, 9 aa, Homo Sapiens
DPRQPCPHA

SEQ ID NO: 696826 - protein, 9 aa, Homo Sapiens
KRKQSRSRT

SEQ ID NO: 696827 - protein, 9 aa, Homo Sapiens
AIIITILED

SEQ ID NO: 696828 - protein, 9 aa, Homo Sapiens
ACNLTWQGA

SEQ ID NO: 696829 - protein, 9 aa, Homo Sapiens
NVFRILANL

SEQ ID NO: 696830 - protein, 9 aa, Homo Sapiens
GFCRKARGF

SEQ ID NO: 696831 - protein, 9 aa, Homo Sapiens
SRSSHEMAR

SEQ ID NO: 696832 - protein, 9 aa, Homo Sapiens
REMLHSNAE

SEQ ID NO: 696833 - protein, 9 aa, Homo Sapiens
TTFQEIVAN

SEQ ID NO: 696834 - protein, 9 aa, Homo Sapiens
LCFFCPGLF

SEQ ID NO: 696835 - protein, 9 aa, Homo Sapiens
LPEAMVFQD

SEQ ID NO: 696836 - protein, 9 aa, Homo Sapiens
LTLAGIATA

SEQ ID NO: 696837 - protein, 9 aa, Homo Sapiens
TPRTASTHD

SEQ ID NO: 696838 - protein, 9 aa, Homo Sapiens
KDEVTRMRD

SEQ ID NO: 696839 - protein, 9 aa, Homo Sapiens
GLYPPGYGP

SEQ ID NO: 696840 - protein, 9 aa, Homo Sapiens
PQGPLASGQ

SEQ ID NO: 696841 - protein, 9 aa, Homo Sapiens
HGLLLPNAY

SEQ ID NO: 696842 - protein, 9 aa, Homo Sapiens
AEGALGAAE

SEQ ID NO: 696843 - protein, 9 aa, Homo Sapiens
VEPHFFDSN

SEQ ID NO: 696844 - protein, 9 aa, Homo Sapiens
PPPSPTHGP

SEQ ID NO: 696845 - protein, 9 aa, Homo Sapiens
VEAGFDCVY

SEQ ID NO: 696846 - protein, 9 aa, Homo Sapiens
RPPVLTPNG

SEQ ID NO: 696847 - protein, 9 aa, Homo Sapiens
WLAAMNTTT

SEQ ID NO: 696848 - protein, 9 aa, Homo Sapiens
CMRPGVAPE

SEQ ID NO: 696849 - protein, 9 aa, Homo Sapiens
INSLDSFRC

SEQ ID NO: 696850 - protein, 9 aa, Homo Sapiens
PGYYKDPLN

SEQ ID NO: 696851 - protein, 9 aa, Homo Sapiens
PRTASTHDS

SEQ ID NO: 696852 - protein, 9 aa, Homo Sapiens
TSDVWAFGV

SEQ ID NO: 696853 - protein, 9 aa, Homo Sapiens
LFMYALVRS

SEQ ID NO: 696854 - protein, 9 aa, Homo Sapiens
VIDKFAMNL

SEQ ID NO: 696855 - protein, 9 aa, Homo Sapiens
TACNLTWQG

SEQ ID NO: 696856 - protein, 9 aa, Homo Sapiens
RSPEAGTEG

SEQ ID NO: 696857 - protein, 9 aa, Homo Sapiens
QLYISLPLG

SEQ ID NO: 696858 - protein, 9 aa, Homo Sapiens
LTRETEKAH

SEQ ID NO: 696859 - protein, 9 aa, Homo Sapiens
MAVELYAPA

SEQ ID NO: 696860 - protein, 9 aa, Homo Sapiens
LKRTPRTAS

SEQ ID NO: 696861 - protein, 9 aa, Homo Sapiens
LIQKRGKLP

SEQ ID NO: 696862 - protein, 9 aa, Homo Sapiens
CIRLGEKAR

SEQ ID NO: 696863 - protein, 9 aa, Homo Sapiens
AQLRQCLSG

SEQ ID NO: 696864 - protein, 9 aa, Homo Sapiens
KGAVEGETL

SEQ ID NO: 696865 - protein, 9 aa, Homo Sapiens
LDCVKVLLK

SEQ ID NO: 696866 - protein, 9 aa, Homo Sapiens
LLLHGHLHA

SEQ ID NO: 696867 - protein, 9 aa, Homo Sapiens
EFSGNIKNW

SEQ ID NO: 696868 - protein, 9 aa, Homo Sapiens
EDRSVSSSC

SEQ ID NO: 696869 - protein, 9 aa, Homo Sapiens
RLPLPVKSP

SEQ ID NO: 696870 - protein, 9 aa, Homo Sapiens
HHHQSRHCK

SEQ ID NO: 696871 - protein, 9 aa, Homo Sapiens
KQHDGFRIS

SEQ ID NO: 696872 - protein, 9 aa, Homo Sapiens
QSRHCKRSK

SEQ ID NO: 696873 - protein, 9 aa, Homo Sapiens
PGKEYEYPK

SEQ ID NO: 696874 - protein, 9 aa, Homo Sapiens
QKRSKGIHS

SEQ ID NO: 696875 - protein, 9 aa, Homo Sapiens
PMQKFMLMK

SEQ ID NO: 696876 - protein, 9 aa, Homo Sapiens
DHLLHVSEC

SEQ ID NO: 696877 - protein, 9 aa, Homo Sapiens
GSEAYLPGT

SEQ ID NO: 696878 - protein, 9 aa, Homo Sapiens
DTKFKGTVV

SEQ ID NO: 696879 - protein, 9 aa, Homo Sapiens
SSMKSVGDV

SEQ ID NO: 696880 - protein, 9 aa, Homo Sapiens
NGLSNGANV

SEQ ID NO: 696881 - protein, 9 aa, Homo Sapiens
HEMARNEQE

SEQ ID NO: 696882 - protein, 9 aa, Homo Sapiens
AKIVYSYFI

SEQ ID NO: 696883 - protein, 9 aa, Homo Sapiens
GSCMRPGVA

SEQ ID NO: 696884 - protein, 9 aa, Homo Sapiens
HHQSRHCKR

SEQ ID NO: 696885 - protein, 9 aa, Homo Sapiens
ARLGGYEEA

SEQ ID NO: 696886 - protein, 9 aa, Homo Sapiens
SVLFMYALV

SEQ ID NO: 696887 - protein, 9 aa, Homo Sapiens
RRPLASMAK

SEQ ID NO: 696888 - protein, 9 aa, Homo Sapiens
SYQNHKTTQ

SEQ ID NO: 696889 - protein, 9 aa, Homo Sapiens
KQSCLLQNL

SEQ ID NO: 696890 - protein, 9 aa, Homo Sapiens
VWLFSSYSV

SEQ ID NO: 696891 - protein, 9 aa, Homo Sapiens
EVLKKQSCL

SEQ ID NO: 696892 - protein, 9 aa, Homo Sapiens
VKLTRETEK

SEQ ID NO: 696893 - protein, 9 aa, Homo Sapiens
KRSKGIHSS

SEQ ID NO: 696894 - protein, 9 aa, Homo Sapiens
KWVRCICEI

SEQ ID NO: 696895 - protein, 9 aa, Homo Sapiens
LGFGGWGSG

SEQ ID NO: 696896 - protein, 9 aa, Homo Sapiens
CIFIYVWLF

SEQ ID NO: 696897 - protein, 9 aa, Homo Sapiens
LYVVESQGA

SEQ ID NO: 696898 - protein, 9 aa, Homo Sapiens
EEQSWTGFE

SEQ ID NO: 696899 - protein, 9 aa, Homo Sapiens
YPPGYGPIP

SEQ ID NO: 696900 - protein, 9 aa, Homo Sapiens
EAGFDCVYY

SEQ ID NO: 696901 - protein, 9 aa, Homo Sapiens
AHSPPHPIA

SEQ ID NO: 696902 - protein, 9 aa, Homo Sapiens
GLQPRAAGA

SEQ ID NO: 696903 - protein, 9 aa, Homo Sapiens
YYELGVVRN

SEQ ID NO: 696904 - protein, 9 aa, Homo Sapiens
RPTLVAEGL

SEQ ID NO: 696905 - protein, 9 aa, Homo Sapiens
GLRFDTQLR

SEQ ID NO: 696906 - protein, 9 aa, Homo Sapiens
NDLFNLRSL

SEQ ID NO: 696907 - protein, 9 aa, Homo Sapiens
LMHFIRRKY

SEQ ID NO: 696908 - protein, 9 aa, Homo Sapiens
EVMQKRSKG

SEQ ID NO: 696909 - protein, 9 aa, Homo Sapiens
ELKDEVTRM

SEQ ID NO: 696910 - protein, 9 aa, Homo Sapiens
QNFRPPAPP

SEQ ID NO: 696911 - protein, 9 aa, Homo Sapiens
VTPMLNAII

SEQ ID NO: 696912 - protein, 9 aa, Homo Sapiens
DDIFLVDIV

SEQ ID NO: 696913 - protein, 9 aa, Homo Sapiens
TSQNLAAGR

SEQ ID NO: 696914 - protein, 9 aa, Homo Sapiens
YVWLFSSYS

SEQ ID NO: 696915 - protein, 9 aa, Homo Sapiens
LICRDQVTR

SEQ ID NO: 696916 - protein, 9 aa, Homo Sapiens
CHLASILAP

SEQ ID NO: 696917 - protein, 9 aa, Homo Sapiens
HISGYNITI

SEQ ID NO: 696918 - protein, 9 aa, Homo Sapiens
SLRYPIVTT

SEQ ID NO: 696919 - protein, 9 aa, Homo Sapiens
PNIVSPEDI

SEQ ID NO: 696920 - protein, 9 aa, Homo Sapiens
VPLLLAESE

SEQ ID NO: 696921 - protein, 9 aa, Homo Sapiens
PLASMAKDI

SEQ ID NO: 696922 - protein, 9 aa, Homo Sapiens
TSLSSVTTG

SEQ ID NO: 696923 - protein, 9 aa, Homo Sapiens
LPEPGKEYE

SEQ ID NO: 696924 - protein, 9 aa, Homo Sapiens
LQPRAAGAT

SEQ ID NO: 696925 - protein, 9 aa, Homo Sapiens
LQGIVHGTV

SEQ ID NO: 696926 - protein, 9 aa, Homo Sapiens
QRGERLELF

SEQ ID NO: 696927 - protein, 9 aa, Homo Sapiens
GAQLRQCLS

SEQ ID NO: 696928 - protein, 9 aa, Homo Sapiens
GTVVELSNQ

SEQ ID NO: 696929 - protein, 9 aa, Homo Sapiens
LQFQVSACD

SEQ ID NO: 696930 - protein, 9 aa, Homo Sapiens
SIFYLLKII

SEQ ID NO: 696931 - protein, 9 aa, Homo Sapiens
FFCPGLFIY

SEQ ID NO: 696932 - protein, 9 aa, Homo Sapiens
QYIPPLPSI

SEQ ID NO: 696933 - protein, 9 aa, Homo Sapiens
MLQTDELNQ

SEQ ID NO: 696934 - protein, 9 aa, Homo Sapiens
EAASLRQNN

SEQ ID NO: 696935 - protein, 9 aa, Homo Sapiens
GSIKSNKLK

SEQ ID NO: 696936 - protein, 9 aa, Homo Sapiens
DTVRLEFSR

SEQ ID NO: 696937 - protein, 9 aa, Homo Sapiens
VRNFQIPQE

SEQ ID NO: 696938 - protein, 9 aa, Homo Sapiens
LIICKTRHN

SEQ ID NO: 696939 - protein, 9 aa, Homo Sapiens
NEGNIIAFC

SEQ ID NO: 696940 - protein, 9 aa, Homo Sapiens
NLDPVKIPE

SEQ ID NO: 696941 - protein, 9 aa, Homo Sapiens
PKGKRELYM

SEQ ID NO: 696942 - protein, 9 aa, Homo Sapiens
ARGNILLST

SEQ ID NO: 696943 - protein, 9 aa, Homo Sapiens
TTQLKIENN

SEQ ID NO: 696944 - protein, 9 aa, Homo Sapiens
SKSLVRILR

SEQ ID NO: 696945 - protein, 9 aa, Homo Sapiens
FFHPLYHHR

SEQ ID NO: 696946 - protein, 9 aa, Homo Sapiens
RYPIVTTRP

SEQ ID NO: 696947 - protein, 9 aa, Homo Sapiens
QVVYLHKIK

SEQ ID NO: 696948 - protein, 9 aa, Homo Sapiens
SAHVDGSIK

SEQ ID NO: 696949 - protein, 9 aa, Homo Sapiens
QSEAASLRQ

SEQ ID NO: 696950 - protein, 9 aa, Homo Sapiens
VLSILICRD

SEQ ID NO: 696951 - protein, 9 aa, Homo Sapiens
MFTFLLTCV

SEQ ID NO: 696952 - protein, 9 aa, Homo Sapiens
GCSEDNVTK

SEQ ID NO: 696953 - protein, 9 aa, Homo Sapiens
GEVEELKAQ

SEQ ID NO: 696954 - protein, 9 aa, Homo Sapiens
CPASSPSSK

SEQ ID NO: 696955 - protein, 9 aa, Homo Sapiens
IALKGKPHY

SEQ ID NO: 696956 - protein, 9 aa, Homo Sapiens
SEEQLITKE

SEQ ID NO: 696957 - protein, 9 aa, Homo Sapiens
ATTLGVFSD

SEQ ID NO: 696958 - protein, 9 aa, Homo Sapiens
LQAKATVSG

SEQ ID NO: 696959 - protein, 9 aa, Homo Sapiens
LRYPIVTTR

SEQ ID NO: 696960 - protein, 9 aa, Homo Sapiens
TKKPELVMA

SEQ ID NO: 696961 - protein, 9 aa, Homo Sapiens
AMMVPYYQM

SEQ ID NO: 696962 - protein, 9 aa, Homo Sapiens
LPSIEEARQ

SEQ ID NO: 696963 - protein, 9 aa, Homo Sapiens
EEMKKNDLP

SEQ ID NO: 696964 - protein, 9 aa, Homo Sapiens
MLHSNAEEV

SEQ ID NO: 696965 - protein, 9 aa, Homo Sapiens
SWKQATSQE

SEQ ID NO: 696966 - protein, 9 aa, Homo Sapiens
EVEDDLDLG

SEQ ID NO: 696967 - protein, 9 aa, Homo Sapiens
DLDGNVFRI

SEQ ID NO: 696968 - protein, 9 aa, Homo Sapiens
PDGFDKGEF

SEQ ID NO: 696969 - protein, 9 aa, Homo Sapiens
AKILRLFKI

SEQ ID NO: 696970 - protein, 9 aa, Homo Sapiens
CKRSKSKDR

SEQ ID NO: 696971 - protein, 9 aa, Homo Sapiens
VAKILRLFK

SEQ ID NO: 696972 - protein, 9 aa, Homo Sapiens
ALEVAFACA

SEQ ID NO: 696973 - protein, 9 aa, Homo Sapiens
VDKEIQGEI

SEQ ID NO: 696974 - protein, 9 aa, Homo Sapiens
QSSSYASDH

SEQ ID NO: 696975 - protein, 9 aa, Homo Sapiens
HRTRRGGSS

SEQ ID NO: 696976 - protein, 9 aa, Homo Sapiens
CLSYKDYKT

SEQ ID NO: 696977 - protein, 9 aa, Homo Sapiens
IIITILEDD

SEQ ID NO: 696978 - protein, 9 aa, Homo Sapiens
LACSLSKCD

SEQ ID NO: 696979 - protein, 9 aa, Homo Sapiens
VQVDARGNI

SEQ ID NO: 696980 - protein, 9 aa, Homo Sapiens
MDSNKEYVT

SEQ ID NO: 696981 - protein, 9 aa, Homo Sapiens
KCWKACCCE

SEQ ID NO: 696982 - protein, 9 aa, Homo Sapiens
VYVADNRGW

SEQ ID NO: 696983 - protein, 9 aa, Homo Sapiens
KRESEKTVS

SEQ ID NO: 696984 - protein, 9 aa, Homo Sapiens
PNPGLRSKP

SEQ ID NO: 696985 - protein, 9 aa, Homo Sapiens
SVSIMVAKI

SEQ ID NO: 696986 - protein, 9 aa, Homo Sapiens
RDPGTPGVP

SEQ ID NO: 696987 - protein, 9 aa, Homo Sapiens
RCICEICGF

SEQ ID NO: 696988 - protein, 9 aa, Homo Sapiens
VTERCWKDH

SEQ ID NO: 696989 - protein, 9 aa, Homo Sapiens
PPLFIPYNI

SEQ ID NO: 696990 - protein, 9 aa, Homo Sapiens
YATMCTDQV

SEQ ID NO: 696991 - protein, 9 aa, Homo Sapiens
CQPPPVCST

SEQ ID NO: 696992 - protein, 9 aa, Homo Sapiens
ETFSQTTKI

SEQ ID NO: 696993 - protein, 9 aa, Homo Sapiens
GGAPEYECY

SEQ ID NO: 696994 - protein, 9 aa, Homo Sapiens
SIQTLACSL

SEQ ID NO: 696995 - protein, 9 aa, Homo Sapiens
LRNLVVSFL

SEQ ID NO: 696996 - protein, 9 aa, Homo Sapiens
PILNTSLHI

SEQ ID NO: 696997 - protein, 9 aa, Homo Sapiens
LIPLWVYRD

SEQ ID NO: 696998 - protein, 9 aa, Homo Sapiens
SPTVAPGPE

SEQ ID NO: 696999 - protein, 9 aa, Homo Sapiens
TRETEKAHK

SEQ ID NO: 697000 - protein, 9 aa, Homo Sapiens
QTESTSSLT

SEQ ID NO: 697001 - protein, 9 aa, Homo Sapiens
ALECEMSYT

SEQ ID NO: 697002 - protein, 9 aa, Homo Sapiens
LRTPNWRPG

SEQ ID NO: 697003 - protein, 9 aa, Homo Sapiens
VAQLGAHRL

SEQ ID NO: 697004 - protein, 9 aa, Homo Sapiens
AEEGADALD

SEQ ID NO: 697005 - protein, 9 aa, Homo Sapiens
LELQVLHAG

SEQ ID NO: 697006 - protein, 9 aa, Homo Sapiens
LWKARLGGY

SEQ ID NO: 697007 - protein, 9 aa, Homo Sapiens
CCLVMLISC

SEQ ID NO: 697008 - protein, 9 aa, Homo Sapiens
LAYNTFSIT

SEQ ID NO: 697009 - protein, 9 aa, Homo Sapiens
HLPVLIGTS

SEQ ID NO: 697010 - protein, 9 aa, Homo Sapiens
IICKTRHNS

SEQ ID NO: 697011 - protein, 9 aa, Homo Sapiens
LLKAGANVN

SEQ ID NO: 697012 - protein, 9 aa, Homo Sapiens
DLGDLEPLE

SEQ ID NO: 697013 - protein, 9 aa, Homo Sapiens
CEVTERCWK

SEQ ID NO: 697014 - protein, 9 aa, Homo Sapiens
TVGPVLSIL

SEQ ID NO: 697015 - protein, 9 aa, Homo Sapiens
KDPLNCEWV

SEQ ID NO: 697016 - protein, 9 aa, Homo Sapiens
TWAKRKHGQ

SEQ ID NO: 697017 - protein, 9 aa, Homo Sapiens
SKKRSYSRS

SEQ ID NO: 697018 - protein, 9 aa, Homo Sapiens
ATWQRPLTL

SEQ ID NO: 697019 - protein, 9 aa, Homo Sapiens
EATRKASHQ

SEQ ID NO: 697020 - protein, 9 aa, Homo Sapiens
DAKIVYSYF

SEQ ID NO: 697021 - protein, 9 aa, Homo Sapiens
DHCRKLVEL

SEQ ID NO: 697022 - protein, 9 aa, Homo Sapiens
IGLQGIVHG

SEQ ID NO: 697023 - protein, 9 aa, Homo Sapiens
SALEVAFAC

SEQ ID NO: 697024 - protein, 9 aa, Homo Sapiens
EAQQPEGTC

SEQ ID NO: 697025 - protein, 9 aa, Homo Sapiens
SGRPKELVS

SEQ ID NO: 697026 - protein, 9 aa, Homo Sapiens
MTALGVIFL

SEQ ID NO: 697027 - protein, 9 aa, Homo Sapiens
GGQCQDLRE

SEQ ID NO: 697028 - protein, 9 aa, Homo Sapiens
SRSTSSKKR

SEQ ID NO: 697029 - protein, 9 aa, Homo Sapiens
GVVTPMLNA

SEQ ID NO: 697030 - protein, 9 aa, Homo Sapiens
VAFLLCGCI

SEQ ID NO: 697031 - protein, 9 aa, Homo Sapiens
FRISWKETT

SEQ ID NO: 697032 - protein, 9 aa, Homo Sapiens
ALKEIPSVW

SEQ ID NO: 697033 - protein, 9 aa, Homo Sapiens
AYNTFSITS

SEQ ID NO: 697034 - protein, 9 aa, Homo Sapiens
DEPQQEVSL

SEQ ID NO: 697035 - protein, 9 aa, Homo Sapiens
CFHIFSMLV

SEQ ID NO: 697036 - protein, 9 aa, Homo Sapiens
PKTGLLMTA

SEQ ID NO: 697037 - protein, 9 aa, Homo Sapiens
KKQRKKEKR

SEQ ID NO: 697038 - protein, 9 aa, Homo Sapiens
LNTSLHIVT

SEQ ID NO: 697039 - protein, 9 aa, Homo Sapiens
NFRPPAPPY

SEQ ID NO: 697040 - protein, 9 aa, Homo Sapiens
SIMVAKILR

SEQ ID NO: 697041 - protein, 9 aa, Homo Sapiens
MNLLTSMPH

SEQ ID NO: 697042 - protein, 9 aa, Homo Sapiens
GVFSDSPGT

SEQ ID NO: 697043 - protein, 9 aa, Homo Sapiens
KHGFTLTFP

SEQ ID NO: 697044 - protein, 9 aa, Homo Sapiens
RSKGIHSSD

SEQ ID NO: 697045 - protein, 9 aa, Homo Sapiens
SHRTRRGGS

SEQ ID NO: 697046 - protein, 9 aa, Homo Sapiens
LKRKQSRSR

SEQ ID NO: 697047 - protein, 9 aa, Homo Sapiens
TLDEWRKKL

SEQ ID NO: 697048 - protein, 9 aa, Homo Sapiens
VLNAAPTVI

SEQ ID NO: 697049 - protein, 9 aa, Homo Sapiens
LKKTQKDGF

SEQ ID NO: 697050 - protein, 9 aa, Homo Sapiens
LLPNAYIYV

SEQ ID NO: 697051 - protein, 9 aa, Homo Sapiens
VRCICEICG

SEQ ID NO: 697052 - protein, 9 aa, Homo Sapiens
TAAMTRFAN

SEQ ID NO: 697053 - protein, 9 aa, Homo Sapiens
ISKSLVRIL

SEQ ID NO: 697054 - protein, 9 aa, Homo Sapiens
TTVFPRSTK

SEQ ID NO: 697055 - protein, 9 aa, Homo Sapiens
GEKGSRRDP

SEQ ID NO: 697056 - protein, 9 aa, Homo Sapiens
SELQQTWAK

SEQ ID NO: 697057 - protein, 9 aa, Homo Sapiens
PAPEFPWKK

SEQ ID NO: 697058 - protein, 9 aa, Homo Sapiens
CINSLDSFR

SEQ ID NO: 697059 - protein, 9 aa, Homo Sapiens
MRPALIALW

SEQ ID NO: 697060 - protein, 9 aa, Homo Sapiens
APEFPWKKE

SEQ ID NO: 697061 - protein, 9 aa, Homo Sapiens
HYALLGRGV

SEQ ID NO: 697062 - protein, 9 aa, Homo Sapiens
PSVWHLWRS

SEQ ID NO: 697063 - protein, 9 aa, Homo Sapiens
SVTGSAVAS

SEQ ID NO: 697064 - protein, 9 aa, Homo Sapiens
FQVSACDAG

SEQ ID NO: 697065 - protein, 9 aa, Homo Sapiens
PELLESKLD

SEQ ID NO: 697066 - protein, 9 aa, Homo Sapiens
SHVTTYLTQ

SEQ ID NO: 697067 - protein, 9 aa, Homo Sapiens
NLVVSFLNS

SEQ ID NO: 697068 - protein, 9 aa, Homo Sapiens
ISPLVVAKG

SEQ ID NO: 697069 - protein, 9 aa, Homo Sapiens
ICEICGFNP

SEQ ID NO: 697070 - protein, 9 aa, Homo Sapiens
GIEGHRVEL

SEQ ID NO: 697071 - protein, 9 aa, Homo Sapiens
PSTREAEVK

SEQ ID NO: 697072 - protein, 9 aa, Homo Sapiens
LDTVTLHSH

SEQ ID NO: 697073 - protein, 9 aa, Homo Sapiens
CIVVLCFFC

SEQ ID NO: 697074 - protein, 9 aa, Homo Sapiens
AGDKPANAV

SEQ ID NO: 697075 - protein, 9 aa, Homo Sapiens
LFNTGLPPS

SEQ ID NO: 697076 - protein, 9 aa, Homo Sapiens
REHISGYNI

SEQ ID NO: 697077 - protein, 9 aa, Homo Sapiens
FSRVYKLVQ

SEQ ID NO: 697078 - protein, 9 aa, Homo Sapiens
AGMLMHFIR

SEQ ID NO: 697079 - protein, 9 aa, Homo Sapiens
VSFLNSMKS

SEQ ID NO: 697080 - protein, 9 aa, Homo Sapiens
KGEFATQTC

SEQ ID NO: 697081 - protein, 9 aa, Homo Sapiens
GSYCYIGLQ

SEQ ID NO: 697082 - protein, 9 aa, Homo Sapiens
ADSKEPVFP

SEQ ID NO: 697083 - protein, 9 aa, Homo Sapiens
TLCRDVMLE

SEQ ID NO: 697084 - protein, 9 aa, Homo Sapiens
YFLLLVPHL

SEQ ID NO: 697085 - protein, 9 aa, Homo Sapiens
LYATMCTDQ

SEQ ID NO: 697086 - protein, 9 aa, Homo Sapiens
KGGTAWLEW

SEQ ID NO: 697087 - protein, 9 aa, Homo Sapiens
STYAKIKTF

SEQ ID NO: 697088 - protein, 9 aa, Homo Sapiens
QSASSDLLH

SEQ ID NO: 697089 - protein, 9 aa, Homo Sapiens
KPCLLKQKK

SEQ ID NO: 697090 - protein, 9 aa, Homo Sapiens
SEESQEATR

SEQ ID NO: 697091 - protein, 9 aa, Homo Sapiens
IETAAMTRF

SEQ ID NO: 697092 - protein, 9 aa, Homo Sapiens
PKSSIRVIH

SEQ ID NO: 697093 - protein, 9 aa, Homo Sapiens
PACPDGFDK

SEQ ID NO: 697094 - protein, 9 aa, Homo Sapiens
VLDSVVDDI

SEQ ID NO: 697095 - protein, 9 aa, Homo Sapiens
SEDNVTKEA

SEQ ID NO: 697096 - protein, 9 aa, Homo Sapiens
QPVDQALVA

SEQ ID NO: 697097 - protein, 9 aa, Homo Sapiens
PLGSTECIL

SEQ ID NO: 697098 - protein, 9 aa, Homo Sapiens
DLIICKTRH

SEQ ID NO: 697099 - protein, 9 aa, Homo Sapiens
VAEFPPDTR

SEQ ID NO: 697100 - protein, 9 aa, Homo Sapiens
LWVYRDPEV

SEQ ID NO: 697101 - protein, 9 aa, Homo Sapiens
ITLHYALLG

SEQ ID NO: 697102 - protein, 9 aa, Homo Sapiens
QPPPVCSTP

SEQ ID NO: 697103 - protein, 9 aa, Homo Sapiens
PPSPTVAPG

SEQ ID NO: 697104 - protein, 9 aa, Homo Sapiens
TPMDFFLGN

SEQ ID NO: 697105 - protein, 9 aa, Homo Sapiens
SVSSSCWNC

SEQ ID NO: 697106 - protein, 9 aa, Homo Sapiens
GFEATLARL

SEQ ID NO: 697107 - protein, 9 aa, Homo Sapiens
MQQVAVTLS

SEQ ID NO: 697108 - protein, 9 aa, Homo Sapiens
SRVVPSGGA

SEQ ID NO: 697109 - protein, 9 aa, Homo Sapiens
LDEWRKKLE

SEQ ID NO: 697110 - protein, 9 aa, Homo Sapiens
KQALLAKPS

SEQ ID NO: 697111 - protein, 9 aa, Homo Sapiens
LLSSWKQAT

SEQ ID NO: 697112 - protein, 9 aa, Homo Sapiens
APASDSGAD

SEQ ID NO: 697113 - protein, 9 aa, Homo Sapiens
DKEFFHPLY

SEQ ID NO: 697114 - protein, 9 aa, Homo Sapiens
AKSNYKMMV

SEQ ID NO: 697115 - protein, 9 aa, Homo Sapiens
PCLLKQKKS

SEQ ID NO: 697116 - protein, 9 aa, Homo Sapiens
FQEIVANQR

SEQ ID NO: 697117 - protein, 9 aa, Homo Sapiens
LPKCLPQCP

SEQ ID NO: 697118 - protein, 9 aa, Homo Sapiens
FLCSLYATM

SEQ ID NO: 697119 - protein, 9 aa, Homo Sapiens
GECINSLDS

SEQ ID NO: 697120 - protein, 9 aa, Homo Sapiens
SPEAGTEGG

SEQ ID NO: 697121 - protein, 9 aa, Homo Sapiens
TPTPRLPLP

SEQ ID NO: 697122 - protein, 9 aa, Homo Sapiens
KIKDSVLLK

SEQ ID NO: 697123 - protein, 9 aa, Homo Sapiens
KTFHTVPNL

SEQ ID NO: 697124 - protein, 9 aa, Homo Sapiens
YISLPLGST

SEQ ID NO: 697125 - protein, 9 aa, Homo Sapiens
AVTLSQDCS

SEQ ID NO: 697126 - protein, 9 aa, Homo Sapiens
HHVFCEECL

SEQ ID NO: 697127 - protein, 9 aa, Homo Sapiens
EPGAFNDLF

SEQ ID NO: 697128 - protein, 9 aa, Homo Sapiens
SDLVDVSEE

SEQ ID NO: 697129 - protein, 9 aa, Homo Sapiens
PLTICPVGC

SEQ ID NO: 697130 - protein, 9 aa, Homo Sapiens
THVETFSQT

SEQ ID NO: 697131 - protein, 9 aa, Homo Sapiens
RKKLEGEVE

SEQ ID NO: 697132 - protein, 9 aa, Homo Sapiens
ASQYIPPLP

SEQ ID NO: 697133 - protein, 9 aa, Homo Sapiens
DEVTRMRDL

SEQ ID NO: 697134 - protein, 9 aa, Homo Sapiens
PGPSPGKSR

SEQ ID NO: 697135 - protein, 9 aa, Homo Sapiens
GVVRNFQIP

SEQ ID NO: 697136 - protein, 9 aa, Homo Sapiens
DSRSPEAGT

SEQ ID NO: 697137 - protein, 9 aa, Homo Sapiens
ACDAGVPPL

SEQ ID NO: 697138 - protein, 9 aa, Homo Sapiens
LDPVKIPEA

SEQ ID NO: 697139 - protein, 9 aa, Homo Sapiens
KKTQKDGFL

SEQ ID NO: 697140 - protein, 9 aa, Homo Sapiens
GRSVYVADN

SEQ ID NO: 697141 - protein, 9 aa, Homo Sapiens
LPLGSTECI

SEQ ID NO: 697142 - protein, 9 aa, Homo Sapiens
RSPPGFCRK

SEQ ID NO: 697143 - protein, 9 aa, Homo Sapiens
VRKTDTDPM

SEQ ID NO: 697144 - protein, 9 aa, Homo Sapiens
PPAENELQA

SEQ ID NO: 697145 - protein, 9 aa, Homo Sapiens
LLIWLLMLA

SEQ ID NO: 697146 - protein, 9 aa, Homo Sapiens
LESKLDAKP

SEQ ID NO: 697147 - protein, 9 aa, Homo Sapiens
LGMAVAFLL

SEQ ID NO: 697148 - protein, 9 aa, Homo Sapiens
HGFTLTFPS

SEQ ID NO: 697149 - protein, 9 aa, Homo Sapiens
PDWFLLLLH

SEQ ID NO: 697150 - protein, 9 aa, Homo Sapiens
TLMNTLMYV

SEQ ID NO: 697151 - protein, 9 aa, Homo Sapiens
HSNAEEVLS

SEQ ID NO: 697152 - protein, 9 aa, Homo Sapiens
PAENELQAM

SEQ ID NO: 697153 - protein, 9 aa, Homo Sapiens
DTDPMLQTD

SEQ ID NO: 697154 - protein, 9 aa, Homo Sapiens
LEQEVINLS

SEQ ID NO: 697155 - protein, 9 aa, Homo Sapiens
EVEELKAQM

SEQ ID NO: 697156 - protein, 9 aa, Homo Sapiens
SKSKDRKTE

SEQ ID NO: 697157 - protein, 9 aa, Homo Sapiens
AIIYSLRNK

SEQ ID NO: 697158 - protein, 9 aa, Homo Sapiens
GFGGWGSGG

SEQ ID NO: 697159 - protein, 9 aa, Homo Sapiens
SLPSQGTKP

SEQ ID NO: 697160 - protein, 9 aa, Homo Sapiens
PAGIALKGK

SEQ ID NO: 697161 - protein, 9 aa, Homo Sapiens
ELQQTWAKR

SEQ ID NO: 697162 - protein, 9 aa, Homo Sapiens
VLLKAGANV

SEQ ID NO: 697163 - protein, 9 aa, Homo Sapiens
WRRPLASMA

SEQ ID NO: 697164 - protein, 9 aa, Homo Sapiens
GVPPPSPTH

SEQ ID NO: 697165 - protein, 9 aa, Homo Sapiens
NTTAGVGSD

SEQ ID NO: 697166 - protein, 9 aa, Homo Sapiens
ISGLRFDTQ

SEQ ID NO: 697167 - protein, 9 aa, Homo Sapiens
QGEIKSHDL

SEQ ID NO: 697168 - protein, 9 aa, Homo Sapiens
DFFLGNFSL

SEQ ID NO: 697169 - protein, 9 aa, Homo Sapiens
QFSMKNNTD

SEQ ID NO: 697170 - protein, 9 aa, Homo Sapiens
EPPLFIPYN

SEQ ID NO: 697171 - protein, 9 aa, Homo Sapiens
SWVAQLGAH

SEQ ID NO: 697172 - protein, 9 aa, Homo Sapiens
PIVTTRPAC

SEQ ID NO: 697173 - protein, 9 aa, Homo Sapiens
TTGMLAALT

SEQ ID NO: 697174 - protein, 9 aa, Homo Sapiens
HLAPDMNRC

SEQ ID NO: 697175 - protein, 9 aa, Homo Sapiens
PGLQPRAAG

SEQ ID NO: 697176 - protein, 9 aa, Homo Sapiens
ITSDVWAFG

SEQ ID NO: 697177 - protein, 9 aa, Homo Sapiens
EQENLERQK

SEQ ID NO: 697178 - protein, 9 aa, Homo Sapiens
PNLDPVKIP

SEQ ID NO: 697179 - protein, 9 aa, Homo Sapiens
RPKELVSCA

SEQ ID NO: 697180 - protein, 9 aa, Homo Sapiens
SCGLIAGAV

SEQ ID NO: 697181 - protein, 9 aa, Homo Sapiens
QYYIAMDIL

SEQ ID NO: 697182 - protein, 9 aa, Homo Sapiens
LKGKPHYRV

SEQ ID NO: 697183 - protein, 9 aa, Homo Sapiens
ELNADIVVN

SEQ ID NO: 697184 - protein, 9 aa, Homo Sapiens
QSALEVAFA

SEQ ID NO: 697185 - protein, 9 aa, Homo Sapiens
LAGIATAMA

SEQ ID NO: 697186 - protein, 9 aa, Homo Sapiens
IPPLPSIEE

SEQ ID NO: 697187 - protein, 9 aa, Homo Sapiens
YNGCSEDNV

SEQ ID NO: 697188 - protein, 9 aa, Homo Sapiens
HNKTFHTVP

SEQ ID NO: 697189 - protein, 9 aa, Homo Sapiens
RILANLQNI

SEQ ID NO: 697190 - protein, 9 aa, Homo Sapiens
FSHRTRRGG

SEQ ID NO: 697191 - protein, 9 aa, Homo Sapiens
SKGIHSSDE

SEQ ID NO: 697192 - protein, 9 aa, Homo Sapiens
LKQHDGFRI

SEQ ID NO: 697193 - protein, 9 aa, Homo Sapiens
TREMLHSNA

SEQ ID NO: 697194 - protein, 9 aa, Homo Sapiens
SADTVRLEF

SEQ ID NO: 697195 - protein, 9 aa, Homo Sapiens
CVKVLLKAG

SEQ ID NO: 697196 - protein, 9 aa, Homo Sapiens
PGYGPIPSL

SEQ ID NO: 697197 - protein, 9 aa, Homo Sapiens
VQSHSCIPP

SEQ ID NO: 697198 - protein, 9 aa, Homo Sapiens
KYVYPRDCI

SEQ ID NO: 697199 - protein, 9 aa, Homo Sapiens
DLGGLPIWL

SEQ ID NO: 697200 - protein, 9 aa, Homo Sapiens
LDLSSMVIR

SEQ ID NO: 697201 - protein, 9 aa, Homo Sapiens
EVELTVNLN

SEQ ID NO: 697202 - protein, 9 aa, Homo Sapiens
SLLTLAGIA

SEQ ID NO: 697203 - protein, 9 aa, Homo Sapiens
MQLLLTPGL

SEQ ID NO: 697204 - protein, 9 aa, Homo Sapiens
YVIDKFAMN

SEQ ID NO: 697205 - protein, 9 aa, Homo Sapiens
GWPGYYKDP

SEQ ID NO: 697206 - protein, 9 aa, Homo Sapiens
LFIPYNIAT

SEQ ID NO: 697207 - protein, 9 aa, Homo Sapiens
PKCLPKCLP

SEQ ID NO: 697208 - protein, 9 aa, Homo Sapiens
IGCSSQEGR

SEQ ID NO: 697209 - protein, 9 aa, Homo Sapiens
MIETAAMTR

SEQ ID NO: 697210 - protein, 9 aa, Homo Sapiens
GCSSQEGRG

SEQ ID NO: 697211 - protein, 9 aa, Homo Sapiens
MTRFANKDK

SEQ ID NO: 697212 - protein, 9 aa, Homo Sapiens
LHIVTNEPS

SEQ ID NO: 697213 - protein, 9 aa, Homo Sapiens
PIGEKGSRR

SEQ ID NO: 697214 - protein, 9 aa, Homo Sapiens
QRKKKKRKD

SEQ ID NO: 697215 - protein, 9 aa, Homo Sapiens
AMLTLASTD

SEQ ID NO: 697216 - protein, 9 aa, Homo Sapiens
EARLSDIEE

SEQ ID NO: 697217 - protein, 9 aa, Homo Sapiens
VVRNFQIPQ

SEQ ID NO: 697218 - protein, 9 aa, Homo Sapiens
RKLVELQIS

SEQ ID NO: 697219 - protein, 9 aa, Homo Sapiens
EAMVFQDSV

SEQ ID NO: 697220 - protein, 9 aa, Homo Sapiens
QRETGCLCP

SEQ ID NO: 697221 - protein, 9 aa, Homo Sapiens
SSQEGRGHP

SEQ ID NO: 697222 - protein, 9 aa, Homo Sapiens
ILPVDNKRY

SEQ ID NO: 697223 - protein, 9 aa, Homo Sapiens
RKARGFGLE

SEQ ID NO: 697224 - protein, 9 aa, Homo Sapiens
LVDVSEEHG

SEQ ID NO: 697225 - protein, 9 aa, Homo Sapiens
GPPGEKGEK

SEQ ID NO: 697226 - protein, 9 aa, Homo Sapiens
SCMRPGVAP

SEQ ID NO: 697227 - protein, 9 aa, Homo Sapiens
CSTPKCPEP

SEQ ID NO: 697228 - protein, 9 aa, Homo Sapiens
EMLHSNAEE

SEQ ID NO: 697229 - protein, 9 aa, Homo Sapiens
GSTTGMLAA

SEQ ID NO: 697230 - protein, 9 aa, Homo Sapiens
RTLCRDVML

SEQ ID NO: 697231 - protein, 9 aa, Homo Sapiens
RSLTPGPNC

SEQ ID NO: 697232 - protein, 9 aa, Homo Sapiens
RTREMLHSN

SEQ ID NO: 697233 - protein, 9 aa, Homo Sapiens
CSSHAGEHV

SEQ ID NO: 697234 - protein, 9 aa, Homo Sapiens
SKILKKTQK

SEQ ID NO: 697235 - protein, 9 aa, Homo Sapiens
KGEFLPNLD

SEQ ID NO: 697236 - protein, 9 aa, Homo Sapiens
GSSVLSIKP

SEQ ID NO: 697237 - protein, 9 aa, Homo Sapiens
LPGTTQRVP

SEQ ID NO: 697238 - protein, 9 aa, Homo Sapiens
SVWHLWRSV

SEQ ID NO: 697239 - protein, 9 aa, Homo Sapiens
QRTLCRDVM

SEQ ID NO: 697240 - protein, 9 aa, Homo Sapiens
VTLDEWRKK

SEQ ID NO: 697241 - protein, 9 aa, Homo Sapiens
QKFMLMKHF

SEQ ID NO: 697242 - protein, 9 aa, Homo Sapiens
KNDLPETAV

SEQ ID NO: 697243 - protein, 9 aa, Homo Sapiens
DLPLKRKQS

SEQ ID NO: 697244 - protein, 9 aa, Homo Sapiens
VEPGAFNDL

SEQ ID NO: 697245 - protein, 9 aa, Homo Sapiens
DQALVAHLK

SEQ ID NO: 697246 - protein, 9 aa, Homo Sapiens
TGCLCPSWL

SEQ ID NO: 697247 - protein, 9 aa, Homo Sapiens
NPGLRSKPP

SEQ ID NO: 697248 - protein, 9 aa, Homo Sapiens
SVLSIKPKG

SEQ ID NO: 697249 - protein, 9 aa, Homo Sapiens
RWDLLVLLA

SEQ ID NO: 697250 - protein, 9 aa, Homo Sapiens
PSLFNTGLP

SEQ ID NO: 697251 - protein, 9 aa, Homo Sapiens
KVQVDARGN

SEQ ID NO: 697252 - protein, 9 aa, Homo Sapiens
TCSCPASSP

SEQ ID NO: 697253 - protein, 9 aa, Homo Sapiens
MVFQDSVVF

SEQ ID NO: 697254 - protein, 9 aa, Homo Sapiens
TFSITSDVW

SEQ ID NO: 697255 - protein, 9 aa, Homo Sapiens
KKEKRKKFT

SEQ ID NO: 697256 - protein, 9 aa, Homo Sapiens
SSKKRSYSR

SEQ ID NO: 697257 - protein, 9 aa, Homo Sapiens
ALLGRGVEL

SEQ ID NO: 697258 - protein, 9 aa, Homo Sapiens
GHLLRRPGG

SEQ ID NO: 697259 - protein, 9 aa, Homo Sapiens
SVTGYRWAK

SEQ ID NO: 697260 - protein, 9 aa, Homo Sapiens
LLTPGLQPR

SEQ ID NO: 697261 - protein, 9 aa, Homo Sapiens
CPGLFIYLR

SEQ ID NO: 697262 - protein, 9 aa, Homo Sapiens
AEDYLDDEY

SEQ ID NO: 697263 - protein, 9 aa, Homo Sapiens
DLGGAPEYE

SEQ ID NO: 697264 - protein, 9 aa, Homo Sapiens
DRLFNDEID

SEQ ID NO: 697265 - protein, 9 aa, Homo Sapiens
MQKRSKGIH

SEQ ID NO: 697266 - protein, 9 aa, Homo Sapiens
PPLPSIEEA

SEQ ID NO: 697267 - protein, 9 aa, Homo Sapiens
PGATLVGPQ

SEQ ID NO: 697268 - protein, 9 aa, Homo Sapiens
VVLCFFCPG

SEQ ID NO: 697269 - protein, 9 aa, Homo Sapiens
NTLMYVLRH

SEQ ID NO: 697270 - protein, 9 aa, Homo Sapiens
VFNEGGEKE

SEQ ID NO: 697271 - protein, 9 aa, Homo Sapiens
LLLPFEDLG

SEQ ID NO: 697272 - protein, 9 aa, Homo Sapiens
TNRRQCHES

SEQ ID NO: 697273 - protein, 9 aa, Homo Sapiens
WRKKLESPN

SEQ ID NO: 697274 - protein, 9 aa, Homo Sapiens
CPHAAPGSA

SEQ ID NO: 697275 - protein, 9 aa, Homo Sapiens
ELTVNLNFM

SEQ ID NO: 697276 - protein, 9 aa, Homo Sapiens
FDCVYYESR

SEQ ID NO: 697277 - protein, 9 aa, Homo Sapiens
EPVDTGPPS

SEQ ID NO: 697278 - protein, 9 aa, Homo Sapiens
FLLTCVFLP

SEQ ID NO: 697279 - protein, 9 aa, Homo Sapiens
WRPPVLTPN

SEQ ID NO: 697280 - protein, 9 aa, Homo Sapiens
YKEFKGFGL

SEQ ID NO: 697281 - protein, 9 aa, Homo Sapiens
ASMAKDIGI

SEQ ID NO: 697282 - protein, 9 aa, Homo Sapiens
TSATVTKMI

SEQ ID NO: 697283 - protein, 9 aa, Homo Sapiens
IPKSSIRVI

SEQ ID NO: 697284 - protein, 9 aa, Homo Sapiens
YSTYAKIKT

SEQ ID NO: 697285 - protein, 9 aa, Homo Sapiens
DSDEEDEGE

SEQ ID NO: 697286 - protein, 9 aa, Homo Sapiens
MAKDIGIWY

SEQ ID NO: 697287 - protein, 9 aa, Homo Sapiens
GWNNTQGKD

SEQ ID NO: 697288 - protein, 9 aa, Homo Sapiens
VLTPNGLSN

SEQ ID NO: 697289 - protein, 9 aa, Homo Sapiens
RKKKKRKDS

SEQ ID NO: 697290 - protein, 9 aa, Homo Sapiens
PFQQDSHCS

SEQ ID NO: 697291 - protein, 9 aa, Homo Sapiens
EMDLGGLPI

SEQ ID NO: 697292 - protein, 9 aa, Homo Sapiens
KRQFIFDVF

SEQ ID NO: 697293 - protein, 9 aa, Homo Sapiens
SPGSALGGS

SEQ ID NO: 697294 - protein, 9 aa, Homo Sapiens
MFCEVLKKQ

SEQ ID NO: 697295 - protein, 9 aa, Homo Sapiens
GHKMLVDLL

SEQ ID NO: 697296 - protein, 9 aa, Homo Sapiens
QPRAAGATE

SEQ ID NO: 697297 - protein, 9 aa, Homo Sapiens
TGPPSPTVA

SEQ ID NO: 697298 - protein, 9 aa, Homo Sapiens
ETQSSESIN

SEQ ID NO: 697299 - protein, 9 aa, Homo Sapiens
AASNLYSAV

SEQ ID NO: 697300 - protein, 9 aa, Homo Sapiens
ALEDDEPQQ

SEQ ID NO: 697301 - protein, 9 aa, Homo Sapiens
EEQLITKEP

SEQ ID NO: 697302 - protein, 9 aa, Homo Sapiens
GHLAPDMNR

SEQ ID NO: 697303 - protein, 9 aa, Homo Sapiens
MQKFMLMKH

SEQ ID NO: 697304 - protein, 9 aa, Homo Sapiens
APPYPGPGG

SEQ ID NO: 697305 - protein, 9 aa, Homo Sapiens
LNLDHAIPI

SEQ ID NO: 697306 - protein, 9 aa, Homo Sapiens
MEDDPDVPW

SEQ ID NO: 697307 - protein, 9 aa, Homo Sapiens
CVDKKGRVF

SEQ ID NO: 697308 - protein, 9 aa, Homo Sapiens
VAVTLSQDC

SEQ ID NO: 697309 - protein, 9 aa, Homo Sapiens
VYLHKIKDS

SEQ ID NO: 697310 - protein, 9 aa, Homo Sapiens
SLLASLLVF

SEQ ID NO: 697311 - protein, 9 aa, Homo Sapiens
KDGSEAYLP

SEQ ID NO: 697312 - protein, 9 aa, Homo Sapiens
NAAPTVIFV

SEQ ID NO: 697313 - protein, 9 aa, Homo Sapiens
DLDLGGAPE

SEQ ID NO: 697314 - protein, 9 aa, Homo Sapiens
TGCTGWNNT

SEQ ID NO: 697315 - protein, 9 aa, Homo Sapiens
LPANTTAGV

SEQ ID NO: 697316 - protein, 9 aa, Homo Sapiens
VLNTSLKEE

SEQ ID NO: 697317 - protein, 9 aa, Homo Sapiens
ATSQENPSP

SEQ ID NO: 697318 - protein, 9 aa, Homo Sapiens
ESEKTVSQF

SEQ ID NO: 697319 - protein, 9 aa, Homo Sapiens
YALLGRGVE

SEQ ID NO: 697320 - protein, 9 aa, Homo Sapiens
SSKCWKACC

SEQ ID NO: 697321 - protein, 9 aa, Homo Sapiens
SALGGSREY

SEQ ID NO: 697322 - protein, 9 aa, Homo Sapiens
WQRPLTLPE

SEQ ID NO: 697323 - protein, 9 aa, Homo Sapiens
GLPANTTAG

SEQ ID NO: 697324 - protein, 9 aa, Homo Sapiens
GTCLRVADL

SEQ ID NO: 697325 - protein, 9 aa, Homo Sapiens
EFCVIAKNA

SEQ ID NO: 697326 - protein, 9 aa, Homo Sapiens
DPWKLLVAT

SEQ ID NO: 697327 - protein, 9 aa, Homo Sapiens
SAHSPPHPI

SEQ ID NO: 697328 - protein, 9 aa, Homo Sapiens
VAAYSSSLE

SEQ ID NO: 697329 - protein, 9 aa, Homo Sapiens
GSGGQCQDL

SEQ ID NO: 697330 - protein, 9 aa, Homo Sapiens
LGCVLIQKR

SEQ ID NO: 697331 - protein, 9 aa, Homo Sapiens
HDGFRISWK

SEQ ID NO: 697332 - protein, 9 aa, Homo Sapiens
WKDVTSANA

SEQ ID NO: 697333 - protein, 9 aa, Homo Sapiens
ESLLKWLRN

SEQ ID NO: 697334 - protein, 9 aa, Homo Sapiens
ISPTGNEAI

SEQ ID NO: 697335 - protein, 9 aa, Homo Sapiens
GWGSGGQCQ

SEQ ID NO: 697336 - protein, 9 aa, Homo Sapiens
KPSSTITYL

SEQ ID NO: 697337 - protein, 9 aa, Homo Sapiens
PSLQYIRGW

SEQ ID NO: 697338 - protein, 9 aa, Homo Sapiens
KRTPRTAST

SEQ ID NO: 697339 - protein, 9 aa, Homo Sapiens
YSSSLEDVK

SEQ ID NO: 697340 - protein, 9 aa, Homo Sapiens
VTSANAKIY

SEQ ID NO: 697341 - protein, 9 aa, Homo Sapiens
KDSDEEDEG

SEQ ID NO: 697342 - protein, 9 aa, Homo Sapiens
PSKPCLLKQ

SEQ ID NO: 697343 - protein, 9 aa, Homo Sapiens
EGADALDPD

SEQ ID NO: 697344 - protein, 9 aa, Homo Sapiens
SIRVIHALS

SEQ ID NO: 697345 - protein, 9 aa, Homo Sapiens
RRDPGTPGV

SEQ ID NO: 697346 - protein, 9 aa, Homo Sapiens
SSSADTVRL

SEQ ID NO: 697347 - protein, 9 aa, Homo Sapiens
PEPGKEYEY

SEQ ID NO: 697348 - protein, 9 aa, Homo Sapiens
PVLTPNGLS

SEQ ID NO: 697349 - protein, 9 aa, Homo Sapiens
VTSLSSVTT

SEQ ID NO: 697350 - protein, 9 aa, Homo Sapiens
LQISELNHR

SEQ ID NO: 697351 - protein, 9 aa, Homo Sapiens
FFLCSLYAT

SEQ ID NO: 697352 - protein, 9 aa, Homo Sapiens
QQKQALLAK

SEQ ID NO: 697353 - protein, 9 aa, Homo Sapiens
IINFSRLIF

SEQ ID NO: 697354 - protein, 9 aa, Homo Sapiens
VYRDPEVRF

SEQ ID NO: 697355 - protein, 9 aa, Homo Sapiens
TVNPPRSSL

SEQ ID NO: 697356 - protein, 9 aa, Homo Sapiens
QRPLTLPEL

SEQ ID NO: 697357 - protein, 9 aa, Homo Sapiens
VKEELATWQ

SEQ ID NO: 697358 - protein, 9 aa, Homo Sapiens
KFAMNLLTS

SEQ ID NO: 697359 - protein, 9 aa, Homo Sapiens
CLPKCLPQC

SEQ ID NO: 697360 - protein, 9 aa, Homo Sapiens
NFTACNLTW

SEQ ID NO: 697361 - protein, 9 aa, Homo Sapiens
QFQVSACDA

SEQ ID NO: 697362 - protein, 9 aa, Homo Sapiens
GFSRWILWD

SEQ ID NO: 697363 - protein, 9 aa, Homo Sapiens
PMLQTDELN

SEQ ID NO: 697364 - protein, 9 aa, Homo Sapiens
FRPTLVAEG

SEQ ID NO: 697365 - protein, 9 aa, Homo Sapiens
YVTSNESTE

SEQ ID NO: 697366 - protein, 9 aa, Homo Sapiens
GPVLSILIC

SEQ ID NO: 697367 - protein, 9 aa, Homo Sapiens
VYKLVQHKR

SEQ ID NO: 697368 - protein, 9 aa, Homo Sapiens
SPQPCGAPR

SEQ ID NO: 697369 - protein, 9 aa, Homo Sapiens
QSRSTSSKK

SEQ ID NO: 697370 - protein, 9 aa, Homo Sapiens
KEEMKKNDL

SEQ ID NO: 697371 - protein, 9 aa, Homo Sapiens
CLCPSWLPH

SEQ ID NO: 697372 - protein, 9 aa, Homo Sapiens
CSVTPLSFQ

SEQ ID NO: 697373 - protein, 9 aa, Homo Sapiens
AEGEAEGAL

SEQ ID NO: 697374 - protein, 9 aa, Homo Sapiens
CLVMLISCV

SEQ ID NO: 697375 - protein, 9 aa, Homo Sapiens
ALLAKPSST

SEQ ID NO: 697376 - protein, 9 aa, Homo Sapiens
TKEPKEANS

SEQ ID NO: 697377 - protein, 9 aa, Homo Sapiens
ASCSPGSAL

SEQ ID NO: 697378 - protein, 9 aa, Homo Sapiens
GCRSLTPGP

SEQ ID NO: 697379 - protein, 9 aa, Homo Sapiens
GFDKGEFAT

SEQ ID NO: 697380 - protein, 9 aa, Homo Sapiens
PPGEKGEKG

SEQ ID NO: 697381 - protein, 9 aa, Homo Sapiens
IFSFQDHLL

SEQ ID NO: 697382 - protein, 9 aa, Homo Sapiens
ETAAMTRFA

SEQ ID NO: 697383 - protein, 9 aa, Homo Sapiens
HPELKYGDG

SEQ ID NO: 697384 - protein, 9 aa, Homo Sapiens
LHSHVTTYL

SEQ ID NO: 697385 - protein, 9 aa, Homo Sapiens
KGRSVYVAD

SEQ ID NO: 697386 - protein, 9 aa, Homo Sapiens
AEELARAKA

SEQ ID NO: 697387 - protein, 9 aa, Homo Sapiens
SGYYGHLAP

SEQ ID NO: 697388 - protein, 9 aa, Homo Sapiens
GVRPTSDLL

SEQ ID NO: 697389 - protein, 9 aa, Homo Sapiens
FKGPELLES

SEQ ID NO: 697390 - protein, 9 aa, Homo Sapiens
YNIATIRRE

SEQ ID NO: 697391 - protein, 9 aa, Homo Sapiens
IKDSVLLKA

SEQ ID NO: 697392 - protein, 9 aa, Homo Sapiens
GYYGHLAPD

SEQ ID NO: 697393 - protein, 9 aa, Homo Sapiens
AVLKDFQYL

SEQ ID NO: 697394 - protein, 9 aa, Homo Sapiens
NPGTCPVKL

SEQ ID NO: 697395 - protein, 9 aa, Homo Sapiens
IGASSKSKD

SEQ ID NO: 697396 - protein, 9 aa, Homo Sapiens
RAELIVHPE

SEQ ID NO: 697397 - protein, 9 aa, Homo Sapiens
VINLSSHIE

SEQ ID NO: 697398 - protein, 9 aa, Homo Sapiens
YFKGPELLE

SEQ ID NO: 697399 - protein, 9 aa, Homo Sapiens
DCVKVLLKA

SEQ ID NO: 697400 - protein, 9 aa, Homo Sapiens
SHEMARNEQ

SEQ ID NO: 697401 - protein, 9 aa, Homo Sapiens
ENSLLVMSV

SEQ ID NO: 697402 - protein, 9 aa, Homo Sapiens
LMEFSGILE

SEQ ID NO: 697403 - protein, 9 aa, Homo Sapiens
EICGFNPTE

SEQ ID NO: 697404 - protein, 9 aa, Homo Sapiens
ETAAAIIIT

SEQ ID NO: 697405 - protein, 9 aa, Homo Sapiens
YGLKSRVRT

SEQ ID NO: 697406 - protein, 9 aa, Homo Sapiens
AWLIPLWVY

SEQ ID NO: 697407 - protein, 9 aa, Homo Sapiens
GEAEGALGA

SEQ ID NO: 697408 - protein, 9 aa, Homo Sapiens
AGTEGGAGE

SEQ ID NO: 697409 - protein, 9 aa, Homo Sapiens
QDHLLHVSE

SEQ ID NO: 697410 - protein, 9 aa, Homo Sapiens
QKQALLAKP

SEQ ID NO: 697411 - protein, 9 aa, Homo Sapiens
VNPPRSSLC

SEQ ID NO: 697412 - protein, 9 aa, Homo Sapiens
SLFNTGLPP

SEQ ID NO: 697413 - protein, 9 aa, Homo Sapiens
GFDCVYYES

SEQ ID NO: 697414 - protein, 9 aa, Homo Sapiens
GILELQVLH

SEQ ID NO: 697415 - protein, 9 aa, Homo Sapiens
VFDREKCAE

SEQ ID NO: 697416 - protein, 9 aa, Homo Sapiens
RQPPVAILI

SEQ ID NO: 697417 - protein, 9 aa, Homo Sapiens
ATAQPSVTG

SEQ ID NO: 697418 - protein, 9 aa, Homo Sapiens
IFYLLKIIN

SEQ ID NO: 697419 - protein, 9 aa, Homo Sapiens
CSCPASSPS

SEQ ID NO: 697420 - protein, 9 aa, Homo Sapiens
FSTGVAEFP

SEQ ID NO: 697421 - protein, 9 aa, Homo Sapiens
LSILFQQGV

SEQ ID NO: 697422 - protein, 9 aa, Homo Sapiens
WILWDGNSE

SEQ ID NO: 697423 - protein, 9 aa, Homo Sapiens
RAAGATEFS

SEQ ID NO: 697424 - protein, 9 aa, Homo Sapiens
CEPGAQLRQ

SEQ ID NO: 697425 - protein, 9 aa, Homo Sapiens
LEDDEPQQE

SEQ ID NO: 697426 - protein, 9 aa, Homo Sapiens
PGKSRVVPS

SEQ ID NO: 697427 - protein, 9 aa, Homo Sapiens
EAYLPGTTQ

SEQ ID NO: 697428 - protein, 9 aa, Homo Sapiens
SPTGNEAIV

SEQ ID NO: 697429 - protein, 9 aa, Homo Sapiens
ELPEAMVFQ

SEQ ID NO: 697430 - protein, 9 aa, Homo Sapiens
NKWVRCICE

SEQ ID NO: 697431 - protein, 9 aa, Homo Sapiens
GAFRCKLCP

SEQ ID NO: 697432 - protein, 9 aa, Homo Sapiens
MNKKSGRPK

SEQ ID NO: 697433 - protein, 9 aa, Homo Sapiens
DPVKIPEAG

SEQ ID NO: 697434 - protein, 9 aa, Homo Sapiens
RTASTHDSS

SEQ ID NO: 697435 - protein, 9 aa, Homo Sapiens
GQLAVAGST

SEQ ID NO: 697436 - protein, 9 aa, Homo Sapiens
RWILWDGNS

SEQ ID NO: 697437 - protein, 9 aa, Homo Sapiens
YIGLQGIVH

SEQ ID NO: 697438 - protein, 9 aa, Homo Sapiens
VWHLWRSVR

SEQ ID NO: 697439 - protein, 9 aa, Homo Sapiens
KAEQENLER

SEQ ID NO: 697440 - protein, 9 aa, Homo Sapiens
TTLNTYYSL

SEQ ID NO: 697441 - protein, 9 aa, Homo Sapiens
NFGGLQGLG

SEQ ID NO: 697442 - protein, 9 aa, Homo Sapiens
LVRILRSNR

SEQ ID NO: 697443 - protein, 9 aa, Homo Sapiens
QEIVANQRI

SEQ ID NO: 697444 - protein, 9 aa, Homo Sapiens
TVTKMIVDM

SEQ ID NO: 697445 - protein, 9 aa, Homo Sapiens
LGLPRPPIL

SEQ ID NO: 697446 - protein, 9 aa, Homo Sapiens
LHNKTFHTV

SEQ ID NO: 697447 - protein, 9 aa, Homo Sapiens
LMTALGVIF

SEQ ID NO: 697448 - protein, 9 aa, Homo Sapiens
NCRLSEVDV

SEQ ID NO: 697449 - protein, 9 aa, Homo Sapiens
NTNRRQCHE

SEQ ID NO: 697450 - protein, 9 aa, Homo Sapiens
SLLLPFEDL

SEQ ID NO: 697451 - protein, 9 aa, Homo Sapiens
DKFAMNLLT

SEQ ID NO: 697452 - protein, 9 aa, Homo Sapiens
LQYIRGWSG

SEQ ID NO: 697453 - protein, 9 aa, Homo Sapiens
NSGSLCFHI

SEQ ID NO: 697454 - protein, 9 aa, Homo Sapiens
PASQYIPPL

SEQ ID NO: 697455 - protein, 9 aa, Homo Sapiens
MAAVRTLSG

SEQ ID NO: 697456 - protein, 9 aa, Homo Sapiens
MKNNTDQFP

SEQ ID NO: 697457 - protein, 9 aa, Homo Sapiens
TVVELSNQI

SEQ ID NO: 697458 - protein, 9 aa, Homo Sapiens
APTVIFVAT

SEQ ID NO: 697459 - protein, 9 aa, Homo Sapiens
SPGKSRVVP

SEQ ID NO: 697460 - protein, 9 aa, Homo Sapiens
CEICGFNPT

SEQ ID NO: 697461 - protein, 9 aa, Homo Sapiens
WVYRDPEVR

SEQ ID NO: 697462 - protein, 9 aa, Homo Sapiens
PLVVAKGGT

SEQ ID NO: 697463 - protein, 9 aa, Homo Sapiens
SVTTGDTTP

SEQ ID NO: 697464 - protein, 9 aa, Homo Sapiens
KEKAEQENL

SEQ ID NO: 697465 - protein, 9 aa, Homo Sapiens
DTGPPSPTV

SEQ ID NO: 697466 - protein, 9 aa, Homo Sapiens
IFIYVWLFS

SEQ ID NO: 697467 - protein, 9 aa, Homo Sapiens
LIGCSSQEG

SEQ ID NO: 697468 - protein, 9 aa, Homo Sapiens
PSPGKSRVV

SEQ ID NO: 697469 - protein, 9 aa, Homo Sapiens
GCVLIQKRG

SEQ ID NO: 697470 - protein, 9 aa, Homo Sapiens
DKEIQGEIK

SEQ ID NO: 697471 - protein, 9 aa, Homo Sapiens
LLVMSVDNT

SEQ ID NO: 697472 - protein, 9 aa, Homo Sapiens
PGIYALECE

SEQ ID NO: 697473 - protein, 9 aa, Homo Sapiens
SYFKGPELL

SEQ ID NO: 697474 - protein, 9 aa, Homo Sapiens
KDCLSPEIR

SEQ ID NO: 697475 - protein, 9 aa, Homo Sapiens
EGETAAAII

SEQ ID NO: 697476 - protein, 9 aa, Homo Sapiens
DKVVLQSEA

SEQ ID NO: 697477 - protein, 9 aa, Homo Sapiens
ISWKETTNT

SEQ ID NO: 697478 - protein, 9 aa, Homo Sapiens
QQGVRPTSD

SEQ ID NO: 697479 - protein, 9 aa, Homo Sapiens
LLAKPSSTI

SEQ ID NO: 697480 - protein, 9 aa, Homo Sapiens
CSLLHYSAK

SEQ ID NO: 697481 - protein, 9 aa, Homo Sapiens
AQPSVTGYR

SEQ ID NO: 697482 - protein, 9 aa, Homo Sapiens
EPQQEVSLE

SEQ ID NO: 697483 - protein, 9 aa, Homo Sapiens
LKQKKSPCL

SEQ ID NO: 697484 - protein, 9 aa, Homo Sapiens
HSPPHPIAV

SEQ ID NO: 697485 - protein, 9 aa, Homo Sapiens
HHHHQSRHC

SEQ ID NO: 697486 - protein, 9 aa, Homo Sapiens
NADIVVNSA

SEQ ID NO: 697487 - protein, 9 aa, Homo Sapiens
KIERGQLAV

SEQ ID NO: 697488 - protein, 9 aa, Homo Sapiens
DKPANAVLH

SEQ ID NO: 697489 - protein, 9 aa, Homo Sapiens
QEATRKASH

SEQ ID NO: 697490 - protein, 9 aa, Homo Sapiens
HCSVTPLSF

SEQ ID NO: 697491 - protein, 9 aa, Homo Sapiens
SEAYLPGTT

SEQ ID NO: 697492 - protein, 9 aa, Homo Sapiens
SPPAENELQ

SEQ ID NO: 697493 - protein, 9 aa, Homo Sapiens
RRGGSSPQR

SEQ ID NO: 697494 - protein, 9 aa, Homo Sapiens
LAGHLLRRP

SEQ ID NO: 697495 - protein, 9 aa, Homo Sapiens
AELIVHPEL

SEQ ID NO: 697496 - protein, 9 aa, Homo Sapiens
LMRAELIVH

SEQ ID NO: 697497 - protein, 9 aa, Homo Sapiens
SSMVIRWYK

SEQ ID NO: 697498 - protein, 9 aa, Homo Sapiens
RQSSSYASD

SEQ ID NO: 697499 - protein, 9 aa, Homo Sapiens
EVTLKYVYP

SEQ ID NO: 697500 - protein, 9 aa, Homo Sapiens
FFDSNYEKG

SEQ ID NO: 697501 - protein, 9 aa, Homo Sapiens
MNCCIRLGE

SEQ ID NO: 697502 - protein, 9 aa, Homo Sapiens
AAIIITILE

SEQ ID NO: 697503 - protein, 9 aa, Homo Sapiens
WVRCICEIC

SEQ ID NO: 697504 - protein, 9 aa, Homo Sapiens
TQKDGFLHE

SEQ ID NO: 697505 - protein, 9 aa, Homo Sapiens
IMVAKILRL

SEQ ID NO: 697506 - protein, 9 aa, Homo Sapiens
GTCPVKLLP

SEQ ID NO: 697507 - protein, 9 aa, Homo Sapiens
FCVIAKNAA

SEQ ID NO: 697508 - protein, 9 aa, Homo Sapiens
SRVRTHTGE

SEQ ID NO: 697509 - protein, 9 aa, Homo Sapiens
CTMESLLKW

SEQ ID NO: 697510 - protein, 9 aa, Homo Sapiens
SIKPKGKRE

SEQ ID NO: 697511 - protein, 9 aa, Homo Sapiens
DIFLVDIVL

SEQ ID NO: 697512 - protein, 9 aa, Homo Sapiens
KCLPKCLPQ

SEQ ID NO: 697513 - protein, 9 aa, Homo Sapiens
KLGVPPPSP

SEQ ID NO: 697514 - protein, 9 aa, Homo Sapiens
NGSCMRPGV

SEQ ID NO: 697515 - protein, 9 aa, Homo Sapiens
HRVELRSQE

SEQ ID NO: 697516 - protein, 9 aa, Homo Sapiens
KPKGKRELY

SEQ ID NO: 697517 - protein, 9 aa, Homo Sapiens
HGECINSLD

SEQ ID NO: 697518 - protein, 9 aa, Homo Sapiens
SEAASLRQN

SEQ ID NO: 697519 - protein, 9 aa, Homo Sapiens
MKRIGASSK

SEQ ID NO: 697520 - protein, 9 aa, Homo Sapiens
LGGYEEALK

SEQ ID NO: 697521 - protein, 9 aa, Homo Sapiens
IVTNEPSVD

SEQ ID NO: 697522 - protein, 9 aa, Homo Sapiens
PSPTVAPGP

SEQ ID NO: 697523 - protein, 9 aa, Homo Sapiens
GHRVELRSQ

SEQ ID NO: 697524 - protein, 9 aa, Homo Sapiens
HQSRHCKRS

SEQ ID NO: 697525 - protein, 9 aa, Homo Sapiens
LVVSFLNSM

SEQ ID NO: 697526 - protein, 9 aa, Homo Sapiens
CPGPSPGKS

SEQ ID NO: 697527 - protein, 9 aa, Homo Sapiens
FIPYNIATI

SEQ ID NO: 697528 - protein, 9 aa, Homo Sapiens
ERLELFIDK

SEQ ID NO: 697529 - protein, 9 aa, Homo Sapiens
QVAVTLSQD

SEQ ID NO: 697530 - protein, 9 aa, Homo Sapiens
ILFQQGVRP

SEQ ID NO: 697531 - protein, 9 aa, Homo Sapiens
DEVTLKYVY

SEQ ID NO: 697532 - protein, 9 aa, Homo Sapiens
FLNSMKSII

SEQ ID NO: 697533 - protein, 9 aa, Homo Sapiens
AGRPPKRNA

SEQ ID NO: 697534 - protein, 9 aa, Homo Sapiens
KTVNFTACN

SEQ ID NO: 697535 - protein, 9 aa, Homo Sapiens
WKQATSQEN

SEQ ID NO: 697536 - protein, 9 aa, Homo Sapiens
SRFSHRTRR

SEQ ID NO: 697537 - protein, 9 aa, Homo Sapiens
SILICRDQV

SEQ ID NO: 697538 - protein, 9 aa, Homo Sapiens
VKATTLGVF

SEQ ID NO: 697539 - protein, 9 aa, Homo Sapiens
AFRCKLCPY

SEQ ID NO: 697540 - protein, 9 aa, Homo Sapiens
LKEIPSVWH

SEQ ID NO: 697541 - protein, 9 aa, Homo Sapiens
DRSVSSSCW

SEQ ID NO: 697542 - protein, 9 aa, Homo Sapiens
SLAGDKPAN

SEQ ID NO: 697543 - protein, 9 aa, Homo Sapiens
AILINLTDE

SEQ ID NO: 697544 - protein, 9 aa, Homo Sapiens
ECEMSYTTY

SEQ ID NO: 697545 - protein, 9 aa, Homo Sapiens
TLKYAEELA

SEQ ID NO: 697546 - protein, 9 aa, Homo Sapiens
CEPKTCSST

SEQ ID NO: 697547 - protein, 9 aa, Homo Sapiens
DSLLYVVES

SEQ ID NO: 697548 - protein, 9 aa, Homo Sapiens
EDENSLLVM

SEQ ID NO: 697549 - protein, 9 aa, Homo Sapiens
SNKEYVTSN

SEQ ID NO: 697550 - protein, 9 aa, Homo Sapiens
LLYVVESQG

SEQ ID NO: 697551 - protein, 9 aa, Homo Sapiens
LGAHRLAHR

SEQ ID NO: 697552 - protein, 9 aa, Homo Sapiens
IHYNGCSED

SEQ ID NO: 697553 - protein, 9 aa, Homo Sapiens
IDKFAMNLL

SEQ ID NO: 697554 - protein, 9 aa, Homo Sapiens
LGAGQHRTT

SEQ ID NO: 697555 - protein, 9 aa, Homo Sapiens
RPPKRNAFY

SEQ ID NO: 697556 - protein, 9 aa, Homo Sapiens
VNLTIIHLQ

SEQ ID NO: 697557 - protein, 9 aa, Homo Sapiens
GTSRSSHEM

SEQ ID NO: 697558 - protein, 9 aa, Homo Sapiens
MLMKHFDFP

SEQ ID NO: 697559 - protein, 9 aa, Homo Sapiens
PQQEVSLEV

SEQ ID NO: 697560 - protein, 9 aa, Homo Sapiens
KKRSYSRSP

SEQ ID NO: 697561 - protein, 9 aa, Homo Sapiens
EFNGKKIII

SEQ ID NO: 697562 - protein, 9 aa, Homo Sapiens
SRSRTTFTA

SEQ ID NO: 697563 - protein, 9 aa, Homo Sapiens
AGQHRTTLN

SEQ ID NO: 697564 - protein, 9 aa, Homo Sapiens
QSSESINEF

SEQ ID NO: 697565 - protein, 9 aa, Homo Sapiens
IISKSLVRI

SEQ ID NO: 697566 - protein, 9 aa, Homo Sapiens
TCPVKLLPE

SEQ ID NO: 697567 - protein, 9 aa, Homo Sapiens
ANVKIENMG

SEQ ID NO: 697568 - protein, 9 aa, Homo Sapiens
AASLRQNNQ

SEQ ID NO: 697569 - protein, 9 aa, Homo Sapiens
KLLPELPPV

SEQ ID NO: 697570 - protein, 9 aa, Homo Sapiens
SIKSNKLKS

SEQ ID NO: 697571 - protein, 9 aa, Homo Sapiens
GMLMHFIRR

SEQ ID NO: 697572 - protein, 9 aa, Homo Sapiens
IPLWVYRDP

SEQ ID NO: 697573 - protein, 9 aa, Homo Sapiens
FCVDKKGRV

SEQ ID NO: 697574 - protein, 9 aa, Homo Sapiens
DVMAIGRTF

SEQ ID NO: 697575 - protein, 9 aa, Homo Sapiens
TVRPGTPAD

SEQ ID NO: 697576 - protein, 9 aa, Homo Sapiens
FEGLVNLTI

SEQ ID NO: 697577 - protein, 9 aa, Homo Sapiens
WVAQLGAHR

SEQ ID NO: 697578 - protein, 9 aa, Homo Sapiens
KSGRPKELV

SEQ ID NO: 697579 - protein, 9 aa, Homo Sapiens
VIRWYKLFP

SEQ ID NO: 697580 - protein, 9 aa, Homo Sapiens
ELRSQEFVI

SEQ ID NO: 697581 - protein, 9 aa, Homo Sapiens
TGVAEFPPD

SEQ ID NO: 697582 - protein, 9 aa, Homo Sapiens
TFSRVYKLV

SEQ ID NO: 697583 - protein, 9 aa, Homo Sapiens
FCPGLFIYL

SEQ ID NO: 697584 - protein, 9 aa, Homo Sapiens
LLTLAGIAT

SEQ ID NO: 697585 - protein, 9 aa, Homo Sapiens
MHFIRRKYK

SEQ ID NO: 697586 - protein, 9 aa, Homo Sapiens
HYSAKTGNG

SEQ ID NO: 697587 - protein, 9 aa, Homo Sapiens
YAKIKTFED

SEQ ID NO: 697588 - protein, 9 aa, Homo Sapiens
TGHKMLVDL

SEQ ID NO: 697589 - protein, 9 aa, Homo Sapiens
LRSQEFVIP

SEQ ID NO: 697590 - protein, 9 aa, Homo Sapiens
CICEICGFN

SEQ ID NO: 697591 - protein, 9 aa, Homo Sapiens
VELYAPASA

SEQ ID NO: 697592 - protein, 9 aa, Homo Sapiens
LLMEFSGIL

SEQ ID NO: 697593 - protein, 9 aa, Homo Sapiens
RRLPGPLPP

SEQ ID NO: 697594 - protein, 9 aa, Homo Sapiens
FNTGLPPSR

SEQ ID NO: 697595 - protein, 9 aa, Homo Sapiens
PCEPGAQLR

SEQ ID NO: 697596 - protein, 9 aa, Homo Sapiens
PAGAASNLY

SEQ ID NO: 697597 - protein, 9 aa, Homo Sapiens
YNTTFQEIV

SEQ ID NO: 697598 - protein, 9 aa, Homo Sapiens
SGLRFDTQL

SEQ ID NO: 697599 - protein, 9 aa, Homo Sapiens
LDHAIPIAD

SEQ ID NO: 697600 - protein, 9 aa, Homo Sapiens
AGHLLRRPG

SEQ ID NO: 697601 - protein, 9 aa, Homo Sapiens
QNTVLNRPF

SEQ ID NO: 697602 - protein, 9 aa, Homo Sapiens
RETQSSESI

SEQ ID NO: 697603 - protein, 9 aa, Homo Sapiens
PIWLLQDPG

SEQ ID NO: 697604 - protein, 9 aa, Homo Sapiens
KRIGASSKS

SEQ ID NO: 697605 - protein, 9 aa, Homo Sapiens
MSVDNTMHC

SEQ ID NO: 697606 - protein, 9 aa, Homo Sapiens
VFPRSTKTS

SEQ ID NO: 697607 - protein, 9 aa, Homo Sapiens
MPPSSPQPC

SEQ ID NO: 697608 - protein, 9 aa, Homo Sapiens
IPHTFCEHM

SEQ ID NO: 697609 - protein, 9 aa, Homo Sapiens
DREHISGYN

SEQ ID NO: 697610 - protein, 9 aa, Homo Sapiens
CFFCPGLFI

SEQ ID NO: 697611 - protein, 9 aa, Homo Sapiens
KESLAGDKP

SEQ ID NO: 697612 - protein, 9 aa, Homo Sapiens
LLMLAAVLP

SEQ ID NO: 697613 - protein, 9 aa, Homo Sapiens
GDVMAIGRT

SEQ ID NO: 697614 - protein, 9 aa, Homo Sapiens
AYLPGTTQR

SEQ ID NO: 697615 - protein, 9 aa, Homo Sapiens
RETEKAHKD

SEQ ID NO: 697616 - protein, 9 aa, Homo Sapiens
SVTFRCRIS

SEQ ID NO: 697617 - protein, 9 aa, Homo Sapiens
GSLCFHIFS

SEQ ID NO: 697618 - protein, 9 aa, Homo Sapiens
PEAQQPEGT

SEQ ID NO: 697619 - protein, 9 aa, Homo Sapiens
LSKESLAGD

SEQ ID NO: 697620 - protein, 9 aa, Homo Sapiens
VETFSQTTK

SEQ ID NO: 697621 - protein, 9 aa, Homo Sapiens
SASSDLLHG

SEQ ID NO: 697622 - protein, 9 aa, Homo Sapiens
EGETLAGMA

SEQ ID NO: 697623 - protein, 9 aa, Homo Sapiens
SSSCWNCGI

SEQ ID NO: 697624 - protein, 9 aa, Homo Sapiens
PSSLNLDHA

SEQ ID NO: 697625 - protein, 9 aa, Homo Sapiens
KKSGRPKEL

SEQ ID NO: 697626 - protein, 9 aa, Homo Sapiens
SGILELQVL

SEQ ID NO: 697627 - protein, 9 aa, Homo Sapiens
PAVLKDFQY

SEQ ID NO: 697628 - protein, 9 aa, Homo Sapiens
GCDRSCGLI

SEQ ID NO: 697629 - protein, 9 aa, Homo Sapiens
DGSEAYLPG

SEQ ID NO: 697630 - protein, 9 aa, Homo Sapiens
GFRISWKET

SEQ ID NO: 697631 - protein, 9 aa, Homo Sapiens
LDEVTLKYV

SEQ ID NO: 697632 - protein, 9 aa, Homo Sapiens
FEDLGDLEP

SEQ ID NO: 697633 - protein, 9 aa, Homo Sapiens
HLCYVFDRE

SEQ ID NO: 697634 - protein, 9 aa, Homo Sapiens
LILLCHHVF

SEQ ID NO: 697635 - protein, 9 aa, Homo Sapiens
IQGEIKSHD

SEQ ID NO: 697636 - protein, 9 aa, Homo Sapiens
GIALKGKPH

SEQ ID NO: 697637 - protein, 9 aa, Homo Sapiens
IAVAAPGMP

SEQ ID NO: 697638 - protein, 9 aa, Homo Sapiens
SSLEDVKTA

SEQ ID NO: 697639 - protein, 9 aa, Homo Sapiens
SDSGADSEP

SEQ ID NO: 697640 - protein, 9 aa, Homo Sapiens
TLSILFQQG

SEQ ID NO: 697641 - protein, 9 aa, Homo Sapiens
LLCHHVFCE

SEQ ID NO: 697642 - protein, 9 aa, Homo Sapiens
VVDDIFLVD

SEQ ID NO: 697643 - protein, 9 aa, Homo Sapiens
VPYNSVLFM

SEQ ID NO: 697644 - protein, 9 aa, Homo Sapiens
GMKRIGASS

SEQ ID NO: 697645 - protein, 9 aa, Homo Sapiens
ETSRIQTES

SEQ ID NO: 697646 - protein, 9 aa, Homo Sapiens
SSESINEFG

SEQ ID NO: 697647 - protein, 9 aa, Homo Sapiens
CSSQEGRGH

SEQ ID NO: 697648 - protein, 9 aa, Homo Sapiens
RSCGLIAGA

SEQ ID NO: 697649 - protein, 9 aa, Homo Sapiens
NFQIPQEVL

SEQ ID NO: 697650 - protein, 9 aa, Homo Sapiens
SSVTTGDTT

SEQ ID NO: 697651 - protein, 9 aa, Homo Sapiens
KTCSSTGCD

SEQ ID NO: 697652 - protein, 9 aa, Homo Sapiens
QHLRDRRLP

SEQ ID NO: 697653 - protein, 9 aa, Homo Sapiens
SPPHPIAVA

SEQ ID NO: 697654 - protein, 9 aa, Homo Sapiens
LASMAKDIG

SEQ ID NO: 697655 - protein, 9 aa, Homo Sapiens
PWKKEKKSA

SEQ ID NO: 697656 - protein, 9 aa, Homo Sapiens
LKYVYPRDC

SEQ ID NO: 697657 - protein, 9 aa, Homo Sapiens
LCHHVFCEE

SEQ ID NO: 697658 - protein, 9 aa, Homo Sapiens
LSSVTTGDT

SEQ ID NO: 697659 - protein, 9 aa, Homo Sapiens
PHPIAVAAP

SEQ ID NO: 697660 - protein, 9 aa, Homo Sapiens
RLGGYEEAL

SEQ ID NO: 697661 - protein, 9 aa, Homo Sapiens
QRQNFRPPA

SEQ ID NO: 697662 - protein, 9 aa, Homo Sapiens
VMAAVRTLS

SEQ ID NO: 697663 - protein, 9 aa, Homo Sapiens
SRHCKRSKS

SEQ ID NO: 697664 - protein, 9 aa, Homo Sapiens
LIWLLMLAA

SEQ ID NO: 697665 - protein, 9 aa, Homo Sapiens
KMMVVKSSG

SEQ ID NO: 697666 - protein, 9 aa, Homo Sapiens
PMLNAIIYS

SEQ ID NO: 697667 - protein, 9 aa, Homo Sapiens
GLGVKKQDP

SEQ ID NO: 697668 - protein, 9 aa, Homo Sapiens
FRCKLCPYT

SEQ ID NO: 697669 - protein, 9 aa, Homo Sapiens
AAMTRFANK

SEQ ID NO: 697670 - protein, 9 aa, Homo Sapiens
LLLPNAYIY

SEQ ID NO: 697671 - protein, 9 aa, Homo Sapiens
SAVASAVCK

SEQ ID NO: 697672 - protein, 9 aa, Homo Sapiens
KLLVATIFL

SEQ ID NO: 697673 - protein, 9 aa, Homo Sapiens
AQQPEGTCL

SEQ ID NO: 697674 - protein, 9 aa, Homo Sapiens
LSEVDVMHL

SEQ ID NO: 697675 - protein, 9 aa, Homo Sapiens
VPKLGVPPP

SEQ ID NO: 697676 - protein, 9 aa, Homo Sapiens
DHCSLLHYS

SEQ ID NO: 697677 - protein, 9 aa, Homo Sapiens
VLFMYALVR

SEQ ID NO: 697678 - protein, 9 aa, Homo Sapiens
DQSFTTWLA

SEQ ID NO: 697679 - protein, 9 aa, Homo Sapiens
ELQAKATVS

SEQ ID NO: 697680 - protein, 9 aa, Homo Sapiens
LHGHLHAST

SEQ ID NO: 697681 - protein, 9 aa, Homo Sapiens
IVHPELKYG

SEQ ID NO: 697682 - protein, 9 aa, Homo Sapiens
CSSTGCDPS

SEQ ID NO: 697683 - protein, 9 aa, Homo Sapiens
KIQPVDQAL

SEQ ID NO: 697684 - protein, 9 aa, Homo Sapiens
QWRPSLQYI

SEQ ID NO: 697685 - protein, 9 aa, Homo Sapiens
DPMLQTDEL

SEQ ID NO: 697686 - protein, 9 aa, Homo Sapiens
ACLLDKHLY

SEQ ID NO: 697687 - protein, 9 aa, Homo Sapiens
RSVSSSCWN

SEQ ID NO: 697688 - protein, 9 aa, Homo Sapiens
WGSGGQCQD

SEQ ID NO: 697689 - protein, 9 aa, Homo Sapiens
AAGATEFSV

SEQ ID NO: 697690 - protein, 9 aa, Homo Sapiens
VAFACAATV

SEQ ID NO: 697691 - protein, 9 aa, Homo Sapiens
GFTSATVTK

SEQ ID NO: 697692 - protein, 9 aa, Homo Sapiens
EKRKKFTRQ

SEQ ID NO: 697693 - protein, 9 aa, Homo Sapiens
TLHSHVTTY

SEQ ID NO: 697694 - protein, 9 aa, Homo Sapiens
FCRKARGFG

SEQ ID NO: 697695 - protein, 9 aa, Homo Sapiens
KSRVVPSGG

SEQ ID NO: 697696 - protein, 9 aa, Homo Sapiens
NAEEVLSLE

SEQ ID NO: 697697 - protein, 9 aa, Homo Sapiens
LRDRRLPGP

SEQ ID NO: 697698 - protein, 9 aa, Homo Sapiens
AIGSTTGML

SEQ ID NO: 697699 - protein, 9 aa, Homo Sapiens
EQEVINLSS

SEQ ID NO: 697700 - protein, 9 aa, Homo Sapiens
AVAFLLCGC

SEQ ID NO: 697701 - protein, 9 aa, Homo Sapiens
EKTVSQFTA

SEQ ID NO: 697702 - protein, 9 aa, Homo Sapiens
LTVMEDDPD

SEQ ID NO: 697703 - protein, 9 aa, Homo Sapiens
LYISLPLGS

SEQ ID NO: 697704 - protein, 9 aa, Homo Sapiens
LCFHIFSML

SEQ ID NO: 697705 - protein, 9 aa, Homo Sapiens
AQLYISLPL

SEQ ID NO: 697706 - protein, 9 aa, Homo Sapiens
RGERLELFI

SEQ ID NO: 697707 - protein, 9 aa, Homo Sapiens
EATLTVMED

SEQ ID NO: 697708 - protein, 9 aa, Homo Sapiens
IGEKGSRRD

SEQ ID NO: 697709 - protein, 9 aa, Homo Sapiens
GASSKSKDR

SEQ ID NO: 697710 - protein, 9 aa, Homo Sapiens
AVEAGFDCV

SEQ ID NO: 697711 - protein, 9 aa, Homo Sapiens
VAQLYISLP

SEQ ID NO: 697712 - protein, 9 aa, Homo Sapiens
VGSGSMVCH

SEQ ID NO: 697713 - protein, 9 aa, Homo Sapiens
SGSMVCHLA

SEQ ID NO: 697714 - protein, 9 aa, Homo Sapiens
DWMPEARLS

SEQ ID NO: 697715 - protein, 9 aa, Homo Sapiens
TSPPSLFNT

SEQ ID NO: 697716 - protein, 9 aa, Homo Sapiens
DCVYYESRN

SEQ ID NO: 697717 - protein, 9 aa, Homo Sapiens
TLAGMAALG

SEQ ID NO: 697718 - protein, 9 aa, Homo Sapiens
AVASAVCKA

SEQ ID NO: 697719 - protein, 9 aa, Homo Sapiens
STGCDPSNS

SEQ ID NO: 697720 - protein, 9 aa, Homo Sapiens
FHTVPNLRN

SEQ ID NO: 697721 - protein, 9 aa, Homo Sapiens
PPVLTPNGL

SEQ ID NO: 697722 - protein, 9 aa, Homo Sapiens
VSPEDIVEN

SEQ ID NO: 697723 - protein, 9 aa, Homo Sapiens
CPPKCLPKC

SEQ ID NO: 697724 - protein, 9 aa, Homo Sapiens
RQPCPHAAP

SEQ ID NO: 697725 - protein, 9 aa, Homo Sapiens
PPKCLPKCL

SEQ ID NO: 697726 - protein, 9 aa, Homo Sapiens
SSELQQTWA

SEQ ID NO: 697727 - protein, 9 aa, Homo Sapiens
CSPGSALGG

SEQ ID NO: 697728 - protein, 9 aa, Homo Sapiens
RPALIALWL

SEQ ID NO: 697729 - protein, 9 aa, Homo Sapiens
HLLRRPGGS

SEQ ID NO: 697730 - protein, 9 aa, Homo Sapiens
REKCAEEIT

SEQ ID NO: 697731 - protein, 9 aa, Homo Sapiens
KILRLFKIP

SEQ ID NO: 697732 - protein, 9 aa, Homo Sapiens
KEPVFPVKG

SEQ ID NO: 697733 - protein, 9 aa, Homo Sapiens
GYGPIPSLS

SEQ ID NO: 697734 - protein, 9 aa, Homo Sapiens
KKKLYRQNT

SEQ ID NO: 697735 - protein, 9 aa, Homo Sapiens
KGFGLKLLK

SEQ ID NO: 697736 - protein, 9 aa, Homo Sapiens
TPPTPTPRL

SEQ ID NO: 697737 - protein, 9 aa, Homo Sapiens
LRFDTQLRT

SEQ ID NO: 697738 - protein, 9 aa, Homo Sapiens
NGFCEVTER

SEQ ID NO: 697739 - protein, 9 aa, Homo Sapiens
TLACSLSKC

SEQ ID NO: 697740 - protein, 9 aa, Homo Sapiens
QPEGTCLRV

SEQ ID NO: 697741 - protein, 9 aa, Homo Sapiens
YIRGWSGDP

SEQ ID NO: 697742 - protein, 9 aa, Homo Sapiens
FQQGVRPTS

SEQ ID NO: 697743 - protein, 9 aa, Homo Sapiens
NIVSPEDIV

SEQ ID NO: 697744 - protein, 9 aa, Homo Sapiens
CLSPEIRFG

SEQ ID NO: 697745 - protein, 9 aa, Homo Sapiens
FDVFNEGGE

SEQ ID NO: 697746 - protein, 9 aa, Homo Sapiens
LLKRTPRTA

SEQ ID NO: 697747 - protein, 9 aa, Homo Sapiens
DPTCSCPAS

SEQ ID NO: 697748 - protein, 9 aa, Homo Sapiens
PFEDLGDLE

SEQ ID NO: 697749 - protein, 9 aa, Homo Sapiens
AKPSSTITY

SEQ ID NO: 697750 - protein, 9 aa, Homo Sapiens
KSRVRTHTG

SEQ ID NO: 697751 - protein, 9 aa, Homo Sapiens
VRILRSNRE

SEQ ID NO: 697752 - protein, 9 aa, Homo Sapiens
IWLLMLAAV

SEQ ID NO: 697753 - protein, 9 aa, Homo Sapiens
QPCPHAAPG

SEQ ID NO: 697754 - protein, 9 aa, Homo Sapiens
NYKMMVVKS

SEQ ID NO: 697755 - protein, 9 aa, Homo Sapiens
TVNLNFMNV

SEQ ID NO: 697756 - protein, 9 aa, Homo Sapiens
CGCTMESLL

SEQ ID NO: 697757 - protein, 9 aa, Homo Sapiens
SDPQHLRDR

SEQ ID NO: 697758 - protein, 9 aa, Homo Sapiens
LLHGHLHAS

SEQ ID NO: 697759 - protein, 9 aa, Homo Sapiens
DPLNCEWVI

SEQ ID NO: 697760 - protein, 9 aa, Homo Sapiens
LDLHEAGRE

SEQ ID NO: 697761 - protein, 9 aa, Homo Sapiens
DIVVNSAKV

SEQ ID NO: 697762 - protein, 9 aa, Homo Sapiens
PPPVCSTPK

SEQ ID NO: 697763 - protein, 9 aa, Homo Sapiens
PPSLFNTGL

SEQ ID NO: 697764 - protein, 9 aa, Homo Sapiens
KPKQSDPSL

SEQ ID NO: 697765 - protein, 9 aa, Homo Sapiens
TLMYVLRHR

SEQ ID NO: 697766 - protein, 9 aa, Homo Sapiens
SNGFCEVTE

SEQ ID NO: 697767 - protein, 9 aa, Homo Sapiens
LSQDCSVRS

SEQ ID NO: 697768 - protein, 9 aa, Homo Sapiens
TRPACGGDK

SEQ ID NO: 697769 - protein, 9 aa, Homo Sapiens
RQNTVLNRP

SEQ ID NO: 697770 - protein, 9 aa, Homo Sapiens
ASLLVFYVI

SEQ ID NO: 697771 - protein, 9 aa, Homo Sapiens
AGIALKGKP

SEQ ID NO: 697772 - protein, 9 aa, Homo Sapiens
ESSKCWKAC

SEQ ID NO: 697773 - protein, 9 aa, Homo Sapiens
CRKLVELQI

SEQ ID NO: 697774 - protein, 9 aa, Homo Sapiens
EGHRVELRS

SEQ ID NO: 697775 - protein, 9 aa, Homo Sapiens
MESLLKWLR

SEQ ID NO: 697776 - protein, 9 aa, Homo Sapiens
LAESEFSGN

SEQ ID NO: 697777 - protein, 9 aa, Homo Sapiens
VCHLASILA

SEQ ID NO: 697778 - protein, 9 aa, Homo Sapiens
EPMQKFMLM

SEQ ID NO: 697779 - protein, 9 aa, Homo Sapiens
LDPAQRTLC

SEQ ID NO: 697780 - protein, 9 aa, Homo Sapiens
ELVMAAVRT

SEQ ID NO: 697781 - protein, 9 aa, Homo Sapiens
MMVVKSSGS

SEQ ID NO: 697782 - protein, 9 aa, Homo Sapiens
DEWRKKLES

SEQ ID NO: 697783 - protein, 9 aa, Homo Sapiens
VTKMIVDMQ

SEQ ID NO: 697784 - protein, 9 aa, Homo Sapiens
TRRGGSSPQ

SEQ ID NO: 697785 - protein, 9 aa, Homo Sapiens
MKKNDLPET

SEQ ID NO: 697786 - protein, 9 aa, Homo Sapiens
LLVFYVITV

SEQ ID NO: 697787 - protein, 9 aa, Homo Sapiens
GAGQHRTTL

SEQ ID NO: 697788 - protein, 9 aa, Homo Sapiens
TKMIVDMQS

SEQ ID NO: 697789 - protein, 9 aa, Homo Sapiens
RIGASSKSK

SEQ ID NO: 697790 - protein, 9 aa, Homo Sapiens
VEELKAQMA

SEQ ID NO: 697791 - protein, 9 aa, Homo Sapiens
FIFDVFNEG

SEQ ID NO: 697792 - protein, 9 aa, Homo Sapiens
QATSQENPS

SEQ ID NO: 697793 - protein, 9 aa, Homo Sapiens
CSEDNVTKE

SEQ ID NO: 697794 - protein, 9 aa, Homo Sapiens
VGPVLSILI

SEQ ID NO: 697795 - protein, 9 aa, Homo Sapiens
AESEFSGNI

SEQ ID NO: 697796 - protein, 9 aa, Homo Sapiens
KHLCYVFDR

SEQ ID NO: 697797 - protein, 9 aa, Homo Sapiens
PWKLLVATI

SEQ ID NO: 697798 - protein, 9 aa, Homo Sapiens
VAPEPLSAP

SEQ ID NO: 697799 - protein, 9 aa, Homo Sapiens
TLKYVYPRD

SEQ ID NO: 697800 - protein, 9 aa, Homo Sapiens
LHEVELTVN

SEQ ID NO: 697801 - protein, 9 aa, Homo Sapiens
IENMGIYSC

SEQ ID NO: 697802 - protein, 9 aa, Homo Sapiens
QLRQCLSGC

SEQ ID NO: 697803 - protein, 9 aa, Homo Sapiens
HPIAVAAPG

SEQ ID NO: 697804 - protein, 9 aa, Homo Sapiens
QPCGAPRQR

SEQ ID NO: 697805 - protein, 9 aa, Homo Sapiens
QFIFDVFNE

SEQ ID NO: 697806 - protein, 9 aa, Homo Sapiens
VDQALVAHL

SEQ ID NO: 697807 - protein, 9 aa, Homo Sapiens
DQSASSDLL

SEQ ID NO: 697808 - protein, 9 aa, Homo Sapiens
PYNTTFQEI

SEQ ID NO: 697809 - protein, 9 aa, Homo Sapiens
ASSKSKDRK

SEQ ID NO: 697810 - protein, 9 aa, Homo Sapiens
GYYKDPLNC

SEQ ID NO: 697811 - protein, 9 aa, Homo Sapiens
KDFQYLYFA

SEQ ID NO: 697812 - protein, 9 aa, Homo Sapiens
PVLNAAPTV

SEQ ID NO: 697813 - protein, 9 aa, Homo Sapiens
EEITLHYAL

SEQ ID NO: 697814 - protein, 9 aa, Homo Sapiens
RNFQIPQEV

SEQ ID NO: 697815 - protein, 9 aa, Homo Sapiens
LCYSTATGH

SEQ ID NO: 697816 - protein, 9 aa, Homo Sapiens
KATTLGVFS

SEQ ID NO: 697817 - protein, 9 aa, Homo Sapiens
HVETFSQTT

SEQ ID NO: 697818 - protein, 9 aa, Homo Sapiens
LDSVVDDIF

SEQ ID NO: 697819 - protein, 9 aa, Homo Sapiens
ENMGIYSCM

SEQ ID NO: 697820 - protein, 9 aa, Homo Sapiens
ALIALWLRL

SEQ ID NO: 697821 - protein, 9 aa, Homo Sapiens
YLLKIINFS

SEQ ID NO: 697822 - protein, 9 aa, Homo Sapiens
PQHLRDRRL

SEQ ID NO: 697823 - protein, 9 aa, Homo Sapiens
TPKCPPKCL

SEQ ID NO: 697824 - protein, 9 aa, Homo Sapiens
AKATVSGSP

SEQ ID NO: 697825 - protein, 9 aa, Homo Sapiens
VQEGSSVTF

SEQ ID NO: 697826 - protein, 9 aa, Homo Sapiens
EGLVNLTII

SEQ ID NO: 697827 - protein, 9 aa, Homo Sapiens
AVELYAPAS

SEQ ID NO: 697828 - protein, 9 aa, Homo Sapiens
VASAVCKAT

SEQ ID NO: 697829 - protein, 9 aa, Homo Sapiens
NLNFMNVWK

SEQ ID NO: 697830 - protein, 9 aa, Homo Sapiens
YVLLIWLLM

SEQ ID NO: 697831 - protein, 9 aa, Homo Sapiens
AAPASDSGA

SEQ ID NO: 697832 - protein, 9 aa, Homo Sapiens
TQSRSTSSK

SEQ ID NO: 697833 - protein, 9 aa, Homo Sapiens
QGVRPTSDL

SEQ ID NO: 697834 - protein, 9 aa, Homo Sapiens
HKIKDSVLL

SEQ ID NO: 697835 - protein, 9 aa, Homo Sapiens
LVATIFLNR

SEQ ID NO: 697836 - protein, 9 aa, Homo Sapiens
SLCFHIFSM

SEQ ID NO: 697837 - protein, 9 aa, Homo Sapiens
QRKKEKRKK

SEQ ID NO: 697838 - protein, 9 aa, Homo Sapiens
NTVLNRPFS

SEQ ID NO: 697839 - protein, 9 aa, Homo Sapiens
LITKEPKEA

SEQ ID NO: 697840 - protein, 9 aa, Homo Sapiens
CRLSEVDVM

SEQ ID NO: 697841 - protein, 9 aa, Homo Sapiens
IADSKEPVF

SEQ ID NO: 697842 - protein, 9 aa, Homo Sapiens
ESDLVDVSE

SEQ ID NO: 697843 - protein, 9 aa, Homo Sapiens
RRASFYACL

SEQ ID NO: 697844 - protein, 9 aa, Homo Sapiens
HLRDRRLPG

SEQ ID NO: 697845 - protein, 9 aa, Homo Sapiens
TLPVLNAAP

SEQ ID NO: 697846 - protein, 9 aa, Homo Sapiens
AQLGAHRLA

SEQ ID NO: 697847 - protein, 9 aa, Homo Sapiens
IFDVFNEGG

SEQ ID NO: 697848 - protein, 9 aa, Homo Sapiens
PHFFDSNYE

SEQ ID NO: 697849 - protein, 9 aa, Homo Sapiens
ICPVGCQGP

SEQ ID NO: 697850 - protein, 9 aa, Homo Sapiens
VELQISELN

SEQ ID NO: 697851 - protein, 9 aa, Homo Sapiens
FRPPAPPYP

SEQ ID NO: 697852 - protein, 9 aa, Homo Sapiens
TTRPACGGD

SEQ ID NO: 697853 - protein, 9 aa, Homo Sapiens
NHKTTQLKI

SEQ ID NO: 697854 - protein, 9 aa, Homo Sapiens
RISWKETTN

SEQ ID NO: 697855 - protein, 9 aa, Homo Sapiens
NSRHLPVLI

SEQ ID NO: 697856 - protein, 9 aa, Homo Sapiens
SLKEEFNGK

SEQ ID NO: 697857 - protein, 9 aa, Homo Sapiens
PLYHHREFR

SEQ ID NO: 697858 - protein, 9 aa, Homo Sapiens
DPDGKLLHS

SEQ ID NO: 697859 - protein, 9 aa, Homo Sapiens
GVEPHFFDS

SEQ ID NO: 697860 - protein, 9 aa, Homo Sapiens
VGDVMAIGR

SEQ ID NO: 697861 - protein, 9 aa, Homo Sapiens
PQSALEVAF

SEQ ID NO: 697862 - protein, 9 aa, Homo Sapiens
IIAFCVDKK

SEQ ID NO: 697863 - protein, 9 aa, Homo Sapiens
LMLAAVLPN

SEQ ID NO: 697864 - protein, 9 aa, Homo Sapiens
GLQGIVHGT

SEQ ID NO: 697865 - protein, 9 aa, Homo Sapiens
IRRKYKMRE

SEQ ID NO: 697866 - protein, 9 aa, Homo Sapiens
RWYKLFPPS

SEQ ID NO: 697867 - protein, 9 aa, Homo Sapiens
YYGHLAPDM

SEQ ID NO: 697868 - protein, 9 aa, Homo Sapiens
CGAPRQRPI

SEQ ID NO: 697869 - protein, 9 aa, Homo Sapiens
DKHGFTLTF

SEQ ID NO: 697870 - protein, 9 aa, Homo Sapiens
LCRDVMLEN

SEQ ID NO: 697871 - protein, 9 aa, Homo Sapiens
TMESLLKWL

SEQ ID NO: 697872 - protein, 9 aa, Homo Sapiens
PVAMMVPYY

SEQ ID NO: 697873 - protein, 9 aa, Homo Sapiens
ISFPCLSYK

SEQ ID NO: 697874 - protein, 9 aa, Homo Sapiens
YVRQSSSYA

SEQ ID NO: 697875 - protein, 9 aa, Homo Sapiens
LPIWLLQDP

SEQ ID NO: 697876 - protein, 9 aa, Homo Sapiens
DYLDDEYSD

SEQ ID NO: 697877 - protein, 9 aa, Homo Sapiens
SINEFGIFN

SEQ ID NO: 697878 - protein, 9 aa, Homo Sapiens
LVPHLQILI

SEQ ID NO: 697879 - protein, 9 aa, Homo Sapiens
SMAKDIGIW

SEQ ID NO: 697880 - protein, 9 aa, Homo Sapiens
KKEKKSAKK

SEQ ID NO: 697881 - protein, 9 aa, Homo Sapiens
SKESLAGDK

SEQ ID NO: 697882 - protein, 9 aa, Homo Sapiens
CEVLKKQSC

SEQ ID NO: 697883 - protein, 9 aa, Homo Sapiens
PTPRLPLPV

SEQ ID NO: 697884 - protein, 9 aa, Homo Sapiens
FMYVRQSSS

SEQ ID NO: 697885 - protein, 9 aa, Homo Sapiens
DEPPLFIPY

SEQ ID NO: 697886 - protein, 9 aa, Homo Sapiens
LEVAFACAA

SEQ ID NO: 697887 - protein, 9 aa, Homo Sapiens
GERLELFID

SEQ ID NO: 697888 - protein, 9 aa, Homo Sapiens
KDAKIVYSY

SEQ ID NO: 697889 - protein, 9 aa, Homo Sapiens
RPGTPADFI

SEQ ID NO: 697890 - protein, 9 aa, Homo Sapiens
TVRLEFSRD

SEQ ID NO: 697891 - protein, 9 aa, Homo Sapiens
ASPPAENEL

SEQ ID NO: 697892 - protein, 9 aa, Homo Sapiens
GPQGPLASG

SEQ ID NO: 697893 - protein, 9 aa, Homo Sapiens
SPPSLFNTG

SEQ ID NO: 697894 - protein, 9 aa, Homo Sapiens
FDKGEFATQ

SEQ ID NO: 697895 - protein, 9 aa, Homo Sapiens
PLWVYRDPE

SEQ ID NO: 697896 - protein, 9 aa, Homo Sapiens
LQQTWAKRK

SEQ ID NO: 697897 - protein, 9 aa, Homo Sapiens
LFNDEIDKL

SEQ ID NO: 697898 - protein, 9 aa, Homo Sapiens
FLPNLDPVK

SEQ ID NO: 697899 - protein, 9 aa, Homo Sapiens
LLHYSAKTG

SEQ ID NO: 697900 - protein, 9 aa, Homo Sapiens
RSTSSKKRS

SEQ ID NO: 697901 - protein, 9 aa, Homo Sapiens
GETAAAIII

SEQ ID NO: 697902 - protein, 9 aa, Homo Sapiens
CVYYESRNH

SEQ ID NO: 697903 - protein, 9 aa, Homo Sapiens
SKEPVFPVK

SEQ ID NO: 697904 - protein, 9 aa, Homo Sapiens
LASTDTWVY

SEQ ID NO: 697905 - protein, 9 aa, Homo Sapiens
VTLKYVYPR

SEQ ID NO: 697906 - protein, 9 aa, Homo Sapiens
RTPNWRPGF

SEQ ID NO: 697907 - protein, 9 aa, Homo Sapiens
GCLCPSWLP

SEQ ID NO: 697908 - protein, 9 aa, Homo Sapiens
PPVCSTPKC

SEQ ID NO: 697909 - protein, 9 aa, Homo Sapiens
QDRLFNDEI

SEQ ID NO: 697910 - protein, 9 aa, Homo Sapiens
TGSAVASAV

SEQ ID NO: 697911 - protein, 9 aa, Homo Sapiens
YYQMIAEII

SEQ ID NO: 697912 - protein, 9 aa, Homo Sapiens
VELTVNLNF

SEQ ID NO: 697913 - protein, 9 aa, Homo Sapiens
PELVMAAVR

SEQ ID NO: 697914 - protein, 9 aa, Homo Sapiens
ITQAPTSQN

SEQ ID NO: 697915 - protein, 9 aa, Homo Sapiens
ILRSNREVQ

SEQ ID NO: 697916 - protein, 9 aa, Homo Sapiens
LNTSLKEEF

SEQ ID NO: 697917 - protein, 9 aa, Homo Sapiens
SDWMPEARL

SEQ ID NO: 697918 - protein, 9 aa, Homo Sapiens
RKQSRSRTT

SEQ ID NO: 697919 - protein, 9 aa, Homo Sapiens
TSDWMPEAR

SEQ ID NO: 697920 - protein, 9 aa, Homo Sapiens
LKYAEELAR

SEQ ID NO: 697921 - protein, 9 aa, Homo Sapiens
TATGHKMLV

SEQ ID NO: 697922 - protein, 9 aa, Homo Sapiens
FAMNLLTSM

SEQ ID NO: 697923 - protein, 9 aa, Homo Sapiens
QGPLASGQL

SEQ ID NO: 697924 - protein, 9 aa, Homo Sapiens
VRQSSSYAS

SEQ ID NO: 697925 - protein, 9 aa, Homo Sapiens
TQAPTSQNL

SEQ ID NO: 697926 - protein, 9 aa, Homo Sapiens
VELRSQEFV

SEQ ID NO: 697927 - protein, 9 aa, Homo Sapiens
NLERQKKKK

SEQ ID NO: 697928 - protein, 9 aa, Homo Sapiens
SRIQTESTS

SEQ ID NO: 697929 - protein, 9 aa, Homo Sapiens
IVSPEDIVE

SEQ ID NO: 697930 - protein, 9 aa, Homo Sapiens
SSVSIMVAK

SEQ ID NO: 697931 - protein, 9 aa, Homo Sapiens
IKPKGKREL

SEQ ID NO: 697932 - protein, 9 aa, Homo Sapiens
HAAIGSTTG

SEQ ID NO: 697933 - protein, 9 aa, Homo Sapiens
NAIIYSLRN

SEQ ID NO: 697934 - protein, 9 aa, Homo Sapiens
MRWDLLVLL

SEQ ID NO: 697935 - protein, 9 aa, Homo Sapiens
MYALVRSQA

SEQ ID NO: 697936 - protein, 9 aa, Homo Sapiens
KCPPKCLPK

SEQ ID NO: 697937 - protein, 9 aa, Homo Sapiens
RKKLESPNR

SEQ ID NO: 697938 - protein, 9 aa, Homo Sapiens
FLGMAVAFL

SEQ ID NO: 697939 - protein, 9 aa, Homo Sapiens
QHDGFRISW

SEQ ID NO: 697940 - protein, 9 aa, Homo Sapiens
EDDLDLGGA

SEQ ID NO: 697941 - protein, 9 aa, Homo Sapiens
REAEVKLRL

SEQ ID NO: 697942 - protein, 9 aa, Homo Sapiens
KQSDPSLPS

SEQ ID NO: 697943 - protein, 9 aa, Homo Sapiens
RPGVAPEPL

SEQ ID NO: 697944 - protein, 9 aa, Homo Sapiens
ATREWKDAK

SEQ ID NO: 697945 - protein, 9 aa, Homo Sapiens
GYGAFRCKL

SEQ ID NO: 697946 - protein, 9 aa, Homo Sapiens
RNNAIPKSS

SEQ ID NO: 697947 - protein, 9 aa, Homo Sapiens
TVNFTACNL

SEQ ID NO: 697948 - protein, 9 aa, Homo Sapiens
HLASILAPF

SEQ ID NO: 697949 - protein, 9 aa, Homo Sapiens
KKKRKDSDE

SEQ ID NO: 697950 - protein, 9 aa, Homo Sapiens
AMVFQDSVV

SEQ ID NO: 697951 - protein, 9 aa, Homo Sapiens
TLVGPQGPL

SEQ ID NO: 697952 - protein, 9 aa, Homo Sapiens
TICPVGCQG

SEQ ID NO: 697953 - protein, 9 aa, Homo Sapiens
RLSEVDVMH

SEQ ID NO: 697954 - protein, 9 aa, Homo Sapiens
GLGLPRPPI

SEQ ID NO: 697955 - protein, 9 aa, Homo Sapiens
KSLVRILRS

SEQ ID NO: 697956 - protein, 9 aa, Homo Sapiens
LSSMVIRWY

SEQ ID NO: 697957 - protein, 9 aa, Homo Sapiens
KEYEYPKKP

SEQ ID NO: 697958 - protein, 9 aa, Homo Sapiens
PNWRPGFRY

SEQ ID NO: 697959 - protein, 9 aa, Homo Sapiens
RLGEKARGS

SEQ ID NO: 697960 - protein, 9 aa, Homo Sapiens
DLSSMVIRW

SEQ ID NO: 697961 - protein, 9 aa, Homo Sapiens
RILRSNREV

SEQ ID NO: 697962 - protein, 9 aa, Homo Sapiens
LAGMAALGS

SEQ ID NO: 697963 - protein, 9 aa, Homo Sapiens
LYFLLLVPH

SEQ ID NO: 697964 - protein, 9 aa, Homo Sapiens
RLELFIDKT

SEQ ID NO: 697965 - protein, 9 aa, Homo Sapiens
EAIVPSVCF

SEQ ID NO: 697966 - protein, 9 aa, Homo Sapiens
ALGGSREYK

SEQ ID NO: 697967 - protein, 9 aa, Homo Sapiens
PPVAILINL

SEQ ID NO: 697968 - protein, 9 aa, Homo Sapiens
KLYRQNTVL

SEQ ID NO: 697969 - protein, 9 aa, Homo Sapiens
PLLLAESEF

SEQ ID NO: 697970 - protein, 9 aa, Homo Sapiens
LLLLHGHLH

SEQ ID NO: 697971 - protein, 9 aa, Homo Sapiens
EWRKKLESP

SEQ ID NO: 697972 - protein, 9 aa, Homo Sapiens
ANTTAGVGS

SEQ ID NO: 697973 - protein, 9 aa, Homo Sapiens
TVTLHSHVT

SEQ ID NO: 697974 - protein, 9 aa, Homo Sapiens
RTLDREHIS

SEQ ID NO: 697975 - protein, 9 aa, Homo Sapiens
EVKLRLRLV

SEQ ID NO: 697976 - protein, 9 aa, Homo Sapiens
CKTRHNSVF

SEQ ID NO: 697977 - protein, 9 aa, Homo Sapiens
FKIERGQLA

SEQ ID NO: 697978 - protein, 9 aa, Homo Sapiens
FDREKCAEE

SEQ ID NO: 697979 - protein, 9 aa, Homo Sapiens
MDILPVDNK

SEQ ID NO: 697980 - protein, 9 aa, Homo Sapiens
RTRRGGSSP

SEQ ID NO: 697981 - protein, 9 aa, Homo Sapiens
AMDILPVDN

SEQ ID NO: 697982 - protein, 9 aa, Homo Sapiens
YNTFSITSD

SEQ ID NO: 697983 - protein, 9 aa, Homo Sapiens
LKIQPVDQA

SEQ ID NO: 697984 - protein, 9 aa, Homo Sapiens
SSKSKDRKT

SEQ ID NO: 697985 - protein, 9 aa, Homo Sapiens
AKEKAEQEN

SEQ ID NO: 697986 - protein, 9 aa, Homo Sapiens
DLHEAGRED

SEQ ID NO: 697987 - protein, 9 aa, Homo Sapiens
DRKDWDAFR

SEQ ID NO: 697988 - protein, 9 aa, Homo Sapiens
LDPDGKLLH

SEQ ID NO: 697989 - protein, 9 aa, Homo Sapiens
KKLEGEVEE

SEQ ID NO: 697990 - protein, 9 aa, Homo Sapiens
PGAQLRQCL

SEQ ID NO: 697991 - protein, 9 aa, Homo Sapiens
GLLMTALGV

SEQ ID NO: 697992 - protein, 9 aa, Homo Sapiens
AEDQSASSD

SEQ ID NO: 697993 - protein, 9 aa, Homo Sapiens
ATLTVMEDD

SEQ ID NO: 697994 - protein, 9 aa, Homo Sapiens
TRMRDLLYA

SEQ ID NO: 697995 - protein, 9 aa, Homo Sapiens
THPGIYALE

SEQ ID NO: 697996 - protein, 9 aa, Homo Sapiens
KCRELNADI

SEQ ID NO: 697997 - protein, 9 aa, Homo Sapiens
KRQPPVAIL

SEQ ID NO: 697998 - protein, 9 aa, Homo Sapiens
KKKKRKDSD

SEQ ID NO: 697999 - protein, 9 aa, Homo Sapiens
TSRIQTEST

SEQ ID NO: 698000 - protein, 9 aa, Homo Sapiens
MYVRQSSSY

SEQ ID NO: 698001 - protein, 9 aa, Homo Sapiens
DGFDKGEFA

SEQ ID NO: 698002 - protein, 9 aa, Homo Sapiens
SNLYSAVGR

SEQ ID NO: 698003 - protein, 9 aa, Homo Sapiens
YVYPRDCIP

SEQ ID NO: 698004 - protein, 9 aa, Homo Sapiens
SFTTWLAAM

SEQ ID NO: 698005 - protein, 9 aa, Homo Sapiens
MLAAVLPNL

SEQ ID NO: 698006 - protein, 9 aa, Homo Sapiens
GRPPKRNAF

SEQ ID NO: 698007 - protein, 9 aa, Homo Sapiens
DENSLLVMS

SEQ ID NO: 698008 - protein, 9 aa, Homo Sapiens
TDLKSGCRS

SEQ ID NO: 698009 - protein, 9 aa, Homo Sapiens
FTSPPSLFN

SEQ ID NO: 698010 - protein, 9 aa, Homo Sapiens
LHYSAKTGN

SEQ ID NO: 698011 - protein, 9 aa, Homo Sapiens
IGSTTGMLA

SEQ ID NO: 698012 - protein, 9 aa, Homo Sapiens
AGGAGAGRP

SEQ ID NO: 698013 - protein, 9 aa, Homo Sapiens
SSLNLDHAI

SEQ ID NO: 698014 - protein, 9 aa, Homo Sapiens
ESKILKKTQ

SEQ ID NO: 698015 - protein, 9 aa, Homo Sapiens
AGIATAMAA

SEQ ID NO: 698016 - protein, 9 aa, Homo Sapiens
VMQKRSKGI

SEQ ID NO: 698017 - protein, 9 aa, Homo Sapiens
EDAAYEFCV

SEQ ID NO: 698018 - protein, 9 aa, Homo Sapiens
SQDCSVRSG

SEQ ID NO: 698019 - protein, 9 aa, Homo Sapiens
MLTLASTDT

SEQ ID NO: 698020 - protein, 9 aa, Homo Sapiens
YLPGTTQRV

SEQ ID NO: 698021 - protein, 9 aa, Homo Sapiens
TQSSESINE

SEQ ID NO: 698022 - protein, 9 aa, Homo Sapiens
PTPTPRLPL

SEQ ID NO: 698023 - protein, 9 aa, Homo Sapiens
FQDHLLHVS

SEQ ID NO: 698024 - protein, 9 aa, Homo Sapiens
GLKSRVRTH

SEQ ID NO: 698025 - protein, 9 aa, Homo Sapiens
TGFEATLAR

SEQ ID NO: 698026 - protein, 9 aa, Homo Sapiens
DPAQRTLCR

SEQ ID NO: 698027 - protein, 9 aa, Homo Sapiens
LGLYPPGYG

SEQ ID NO: 698028 - protein, 9 aa, Homo Sapiens
VRPGTPADF

SEQ ID NO: 698029 - protein, 9 aa, Homo Sapiens
VHPELKYGD

SEQ ID NO: 698030 - protein, 9 aa, Homo Sapiens
SKPCLLKQK

SEQ ID NO: 698031 - protein, 9 aa, Homo Sapiens
LAVEAGFDC

SEQ ID NO: 698032 - protein, 9 aa, Homo Sapiens
PPGFCRKAR

SEQ ID NO: 698033 - protein, 9 aa, Homo Sapiens
LLGRGVELI

SEQ ID NO: 698034 - protein, 9 aa, Homo Sapiens
QATAQPSVT

SEQ ID NO: 698035 - protein, 9 aa, Homo Sapiens
LRDSLLYVV

SEQ ID NO: 698036 - protein, 9 aa, Homo Sapiens
KEKRKKFTR

SEQ ID NO: 698037 - protein, 9 aa, Homo Sapiens
EKAEQENLE

SEQ ID NO: 698038 - protein, 9 aa, Homo Sapiens
VSACDAGVP

SEQ ID NO: 698039 - protein, 9 aa, Homo Sapiens
SQEATRKAS

SEQ ID NO: 698040 - protein, 9 aa, Homo Sapiens
EVTRMRDLL

SEQ ID NO: 698041 - protein, 9 aa, Homo Sapiens
KKPELVMAA

SEQ ID NO: 698042 - protein, 9 aa, Homo Sapiens
GETLAGMAA

SEQ ID NO: 698043 - protein, 9 aa, Homo Sapiens
IVANQRIEF

SEQ ID NO: 698044 - protein, 9 aa, Homo Sapiens
PTCSCPASS

SEQ ID NO: 698045 - protein, 9 aa, Homo Sapiens
PGTPADFIL

SEQ ID NO: 698046 - protein, 9 aa, Homo Sapiens
DLLVLLAFL

SEQ ID NO: 698047 - protein, 9 aa, Homo Sapiens
KQGYGAFRC

SEQ ID NO: 698048 - protein, 9 aa, Homo Sapiens
DAAYEFCVI

SEQ ID NO: 698049 - protein, 9 aa, Homo Sapiens
KEIPSVWHL

SEQ ID NO: 698050 - protein, 9 aa, Homo Sapiens
LLPELPPVS

SEQ ID NO: 698051 - protein, 9 aa, Homo Sapiens
GTEGGAGEV

SEQ ID NO: 698052 - protein, 9 aa, Homo Sapiens
EMKKNDLPE

SEQ ID NO: 698053 - protein, 9 aa, Homo Sapiens
NLDHAIPIA

SEQ ID NO: 698054 - protein, 9 aa, Homo Sapiens
VKVLLKAGA

SEQ ID NO: 698055 - protein, 9 aa, Homo Sapiens
EDIVENVLK

SEQ ID NO: 698056 - protein, 9 aa, Homo Sapiens
AAAPASDSG

SEQ ID NO: 698057 - protein, 9 aa, Homo Sapiens
TVLNRPFSI

SEQ ID NO: 698058 - protein, 9 aa, Homo Sapiens
KATVSGSPE

SEQ ID NO: 698059 - protein, 9 aa, Homo Sapiens
RTPRTASTH

SEQ ID NO: 698060 - protein, 9 aa, Homo Sapiens
FDSNYEKGL

SEQ ID NO: 698061 - protein, 9 aa, Homo Sapiens
DAFRPTLVA

SEQ ID NO: 698062 - protein, 9 aa, Homo Sapiens
TMCTDQVST

SEQ ID NO: 698063 - protein, 9 aa, Homo Sapiens
VDGSIKSNK

SEQ ID NO: 698064 - protein, 9 aa, Homo Sapiens
NGCSEDNVT

SEQ ID NO: 698065 - protein, 9 aa, Homo Sapiens
TCLRVADLG

SEQ ID NO: 698066 - protein, 9 aa, Homo Sapiens
RDVAAYSSS

SEQ ID NO: 698067 - protein, 9 aa, Homo Sapiens
LHEAGREDF

SEQ ID NO: 698068 - protein, 9 aa, Homo Sapiens
VELSNQILS

SEQ ID NO: 698069 - protein, 9 aa, Homo Sapiens
FTTWLAAMN

SEQ ID NO: 698070 - protein, 9 aa, Homo Sapiens
LVELQISEL

SEQ ID NO: 698071 - protein, 9 aa, Homo Sapiens
AGVGSDVEL

SEQ ID NO: 698072 - protein, 9 aa, Homo Sapiens
PSIQTLACS

SEQ ID NO: 698073 - protein, 9 aa, Homo Sapiens
RSSHEMARN

SEQ ID NO: 698074 - protein, 9 aa, Homo Sapiens
KELVSCADC

SEQ ID NO: 698075 - protein, 9 aa, Homo Sapiens
LTPGLQPRA

SEQ ID NO: 698076 - protein, 9 aa, Homo Sapiens
DWDAFRPTL

SEQ ID NO: 698077 - protein, 9 aa, Homo Sapiens
ATLVGPQGP

SEQ ID NO: 698078 - protein, 9 aa, Homo Sapiens
AFACAATVI

SEQ ID NO: 698079 - protein, 9 aa, Homo Sapiens
QYIRGWSGD

SEQ ID NO: 698080 - protein, 9 aa, Homo Sapiens
ELLESKLDA

SEQ ID NO: 698081 - protein, 9 aa, Homo Sapiens
RHLPVLIGT

SEQ ID NO: 698082 - protein, 9 aa, Homo Sapiens
PTVRPGTPA

SEQ ID NO: 698083 - protein, 9 aa, Homo Sapiens
ILYFLLLVP

SEQ ID NO: 698084 - protein, 9 aa, Homo Sapiens
DPSLPSQGT

SEQ ID NO: 698085 - protein, 9 aa, Homo Sapiens
GSAVASAVC

SEQ ID NO: 698086 - protein, 9 aa, Homo Sapiens
DPQHLRDRR

SEQ ID NO: 698087 - protein, 9 aa, Homo Sapiens
DHAIPIADL

SEQ ID NO: 698088 - protein, 9 aa, Homo Sapiens
QSRSRTTFT

SEQ ID NO: 698089 - protein, 9 aa, Homo Sapiens
KLVELQISE

SEQ ID NO: 698090 - protein, 9 aa, Homo Sapiens
FHDPWKLLV

SEQ ID NO: 698091 - protein, 9 aa, Homo Sapiens
MVIRWYKLF

SEQ ID NO: 698092 - protein, 9 aa, Homo Sapiens
YIAMDILPV

SEQ ID NO: 698093 - protein, 9 aa, Homo Sapiens
YKDPLNCEW

SEQ ID NO: 698094 - protein, 9 aa, Homo Sapiens
NNTQGKDRL

SEQ ID NO: 698095 - protein, 9 aa, Homo Sapiens
ANAKIYQLP

SEQ ID NO: 698096 - protein, 9 aa, Homo Sapiens
PYNIATIRR

SEQ ID NO: 698097 - protein, 9 aa, Homo Sapiens
TAAAIIITI

SEQ ID NO: 698098 - protein, 9 aa, Homo Sapiens
SSCWNCGIS

SEQ ID NO: 698099 - protein, 9 aa, Homo Sapiens
EIQGEIKSH

SEQ ID NO: 698100 - protein, 9 aa, Homo Sapiens
VEDDPTCSC

SEQ ID NO: 698101 - protein, 9 aa, Homo Sapiens
VTLHSHVTT

SEQ ID NO: 698102 - protein, 9 aa, Homo Sapiens
FLLLLHGHL

SEQ ID NO: 698103 - protein, 9 aa, Homo Sapiens
ILWDGNSEV

SEQ ID NO: 698104 - protein, 9 aa, Homo Sapiens
WPGYYKDPL

SEQ ID NO: 698105 - protein, 9 aa, Homo Sapiens
KEFFHPLYH

SEQ ID NO: 698106 - protein, 9 aa, Homo Sapiens
QKRGKLPGP

SEQ ID NO: 698107 - protein, 9 aa, Homo Sapiens
PVAILINLT

SEQ ID NO: 698108 - protein, 9 aa, Homo Sapiens
RHNSVFQQG

SEQ ID NO: 698109 - protein, 9 aa, Homo Sapiens
EQSWTGFEA

SEQ ID NO: 698110 - protein, 9 aa, Homo Sapiens
GNEAIVPSV

SEQ ID NO: 698111 - protein, 9 aa, Homo Sapiens
DVAAYSSSL

SEQ ID NO: 698112 - protein, 9 aa, Homo Sapiens
YPIVTTRPA

SEQ ID NO: 698113 - protein, 9 aa, Homo Sapiens
DGSIKSNKL

SEQ ID NO: 698114 - protein, 9 aa, Homo Sapiens
SLLHYSAKT

SEQ ID NO: 698115 - protein, 9 aa, Homo Sapiens
EDQSASSDL

SEQ ID NO: 698116 - protein, 9 aa, Homo Sapiens
PRAAGATEF

SEQ ID NO: 698117 - protein, 9 aa, Homo Sapiens
KSGCRSLTP

SEQ ID NO: 698118 - protein, 9 aa, Homo Sapiens
LSPEIRFGE

SEQ ID NO: 698119 - protein, 9 aa, Homo Sapiens
GSGSMVCHL

SEQ ID NO: 698120 - protein, 9 aa, Homo Sapiens
YVLRHRPGW

SEQ ID NO: 698121 - protein, 9 aa, Homo Sapiens
LKDEVTRMR

SEQ ID NO: 698122 - protein, 9 aa, Homo Sapiens
DSGADSEPA

SEQ ID NO: 698123 - protein, 9 aa, Homo Sapiens
SLYATMCTD

SEQ ID NO: 698124 - protein, 9 aa, Homo Sapiens
MRPGVAPEP

SEQ ID NO: 698125 - protein, 9 aa, Homo Sapiens
RPSLQYIRG

SEQ ID NO: 698126 - protein, 9 aa, Homo Sapiens
ATMCTDQVS

SEQ ID NO: 698127 - protein, 9 aa, Homo Sapiens
KQSRSRTTF

SEQ ID NO: 698128 - protein, 9 aa, Homo Sapiens
QPPVAILIN

SEQ ID NO: 698129 - protein, 9 aa, Homo Sapiens
HIVTNEPSV

SEQ ID NO: 698130 - protein, 9 aa, Homo Sapiens
AEQENLERQ

SEQ ID NO: 698131 - protein, 9 aa, Homo Sapiens
LFIDKTENL

SEQ ID NO: 698132 - protein, 9 aa, Homo Sapiens
VVAKGGTAW

SEQ ID NO: 698133 - protein, 9 aa, Homo Sapiens
IGPPGEKGE

SEQ ID NO: 698134 - protein, 9 aa, Homo Sapiens
ELQISELNH

SEQ ID NO: 698135 - protein, 9 aa, Homo Sapiens
FGGLQGLGV

SEQ ID NO: 698136 - protein, 9 aa, Homo Sapiens
FCEVLKKQS

SEQ ID NO: 698137 - protein, 9 aa, Homo Sapiens
ELATWQRPL

SEQ ID NO: 698138 - protein, 9 aa, Homo Sapiens
PNGLSNGAN

SEQ ID NO: 698139 - protein, 9 aa, Homo Sapiens
AVEGETLAG

SEQ ID NO: 698140 - protein, 9 aa, Homo Sapiens
KTQKDGFLH

SEQ ID NO: 698141 - protein, 9 aa, Homo Sapiens
KKLYRQNTV

SEQ ID NO: 698142 - protein, 9 aa, Homo Sapiens
KGSRRDPGT

SEQ ID NO: 698143 - protein, 9 aa, Homo Sapiens
LMYVLRHRP

SEQ ID NO: 698144 - protein, 9 aa, Homo Sapiens
FTFLLTCVF

SEQ ID NO: 698145 - protein, 9 aa, Homo Sapiens
TGYGLKSRV

SEQ ID NO: 698146 - protein, 9 aa, Homo Sapiens
CCIRLGEKA

SEQ ID NO: 698147 - protein, 9 aa, Homo Sapiens
MDFFLGNFS

SEQ ID NO: 698148 - protein, 9 aa, Homo Sapiens
QLLLTPGLQ

SEQ ID NO: 698149 - protein, 9 aa, Homo Sapiens
RPVAMMVPY

SEQ ID NO: 698150 - protein, 9 aa, Homo Sapiens
LKKGRSVYV

SEQ ID NO: 698151 - protein, 9 aa, Homo Sapiens
ESLAGDKPA

SEQ ID NO: 698152 - protein, 9 aa, Homo Sapiens
FTACNLTWQ

SEQ ID NO: 698153 - protein, 9 aa, Homo Sapiens
VLCFFCPGL

SEQ ID NO: 698154 - protein, 9 aa, Homo Sapiens
GLQGLGVKK

SEQ ID NO: 698155 - protein, 9 aa, Homo Sapiens
QALVAHLKA

SEQ ID NO: 698156 - protein, 9 aa, Homo Sapiens
GIFSFQDHL

SEQ ID NO: 698157 - protein, 9 aa, Homo Sapiens
QSWVAQLGA

SEQ ID NO: 698158 - protein, 9 aa, Homo Sapiens
VTGSAVASA

SEQ ID NO: 698159 - protein, 9 aa, Homo Sapiens
FNDLFNLRS

SEQ ID NO: 698160 - protein, 9 aa, Homo Sapiens
RLFNDEIDK

SEQ ID NO: 698161 - protein, 9 aa, Homo Sapiens
GIATAMAAV

SEQ ID NO: 698162 - protein, 9 aa, Homo Sapiens
HCRKLVELQ

SEQ ID NO: 698163 - protein, 9 aa, Homo Sapiens
NMGIYSCMA

SEQ ID NO: 698164 - protein, 9 aa, Homo Sapiens
GHRIIPHTF

SEQ ID NO: 698165 - protein, 9 aa, Homo Sapiens
FQSWVAQLG

SEQ ID NO: 698166 - protein, 9 aa, Homo Sapiens
SAVCKATTH

SEQ ID NO: 698167 - protein, 9 aa, Homo Sapiens
MYVLRHRPG

SEQ ID NO: 698168 - protein, 9 aa, Homo Sapiens
LNAIIYSLR

SEQ ID NO: 698169 - protein, 9 aa, Homo Sapiens
LQGLGVKKQ

SEQ ID NO: 698170 - protein, 9 aa, Homo Sapiens
NLELPEAMV

SEQ ID NO: 698171 - protein, 9 aa, Homo Sapiens
DTVTLHSHV

SEQ ID NO: 698172 - protein, 9 aa, Homo Sapiens
KEFKGFGLK

SEQ ID NO: 698173 - protein, 9 aa, Homo Sapiens
AYQDRLFND

SEQ ID NO: 698174 - protein, 9 aa, Homo Sapiens
QLKIQPVDQ

SEQ ID NO: 698175 - protein, 9 aa, Homo Sapiens
RIIPHTFCE

SEQ ID NO: 698176 - protein, 9 aa, Homo Sapiens
DGNVFRILA

SEQ ID NO: 698177 - protein, 9 aa, Homo Sapiens
CSLYATMCT

SEQ ID NO: 698178 - protein, 9 aa, Homo Sapiens
GPLVQSHSC

SEQ ID NO: 698179 - protein, 9 aa, Homo Sapiens
MRAELIVHP

SEQ ID NO: 698180 - protein, 9 aa, Homo Sapiens
HSHVTTYLT

SEQ ID NO: 698181 - protein, 9 aa, Homo Sapiens
TTHVETFSQ

SEQ ID NO: 698182 - protein, 9 aa, Homo Sapiens
QALLAKPSS

SEQ ID NO: 698183 - protein, 9 aa, Homo Sapiens
EAEVKLRLR

SEQ ID NO: 698184 - protein, 9 aa, Homo Sapiens
GRDPRQPCP

SEQ ID NO: 698185 - protein, 9 aa, Homo Sapiens
VNTNRRQCH

SEQ ID NO: 698186 - protein, 9 aa, Homo Sapiens
TISPLVVAK

SEQ ID NO: 698187 - protein, 9 aa, Homo Sapiens
RGPLVQSHS

SEQ ID NO: 698188 - protein, 9 aa, Homo Sapiens
DIVENVLKD

SEQ ID NO: 698189 - protein, 9 aa, Homo Sapiens
KDSVLLKAG

SEQ ID NO: 698190 - protein, 9 aa, Homo Sapiens
IQTLACSLS

SEQ ID NO: 698191 - protein, 9 aa, Homo Sapiens
GQAAAPASD

SEQ ID NO: 698192 - protein, 9 aa, Homo Sapiens
SGACCLVML

SEQ ID NO: 698193 - protein, 9 aa, Homo Sapiens
NFYQFSMKN

SEQ ID NO: 698194 - protein, 9 aa, Homo Sapiens
VPAMLTLAS

SEQ ID NO: 698195 - protein, 9 aa, Homo Sapiens
SNYKMMVVK

SEQ ID NO: 698196 - protein, 9 aa, Homo Sapiens
VVELSNQIL

SEQ ID NO: 698197 - protein, 9 aa, Homo Sapiens
EPVFPVKGG

SEQ ID NO: 698198 - protein, 9 aa, Homo Sapiens
HFFDSNYEK

SEQ ID NO: 698199 - protein, 9 aa, Homo Sapiens
PEAGTEGGA

SEQ ID NO: 698200 - protein, 9 aa, Homo Sapiens
KKALTLKYA

SEQ ID NO: 698201 - protein, 9 aa, Homo Sapiens
VLSIKPKGK

SEQ ID NO: 698202 - protein, 9 aa, Homo Sapiens
KALTLKYAE

SEQ ID NO: 698203 - protein, 9 aa, Homo Sapiens
GIHSSDEDE

SEQ ID NO: 698204 - protein, 9 aa, Homo Sapiens
LNADIVVNS

SEQ ID NO: 698205 - protein, 9 aa, Homo Sapiens
ESINEFGIF

SEQ ID NO: 698206 - protein, 9 aa, Homo Sapiens
GVAEFPPDT

SEQ ID NO: 698207 - protein, 9 aa, Homo Sapiens
TYAKIKTFE

SEQ ID NO: 698208 - protein, 9 aa, Homo Sapiens
FSSSTTHVE

SEQ ID NO: 698209 - protein, 9 aa, Homo Sapiens
TERCWKDHC

SEQ ID NO: 698210 - protein, 9 aa, Homo Sapiens
SLSSVTTGD

SEQ ID NO: 698211 - protein, 9 aa, Homo Sapiens
FMYALVRSQ

SEQ ID NO: 698212 - protein, 9 aa, Homo Sapiens
SFLNSMKSI

SEQ ID NO: 698213 - protein, 9 aa, Homo Sapiens
DLVDVSEEH

SEQ ID NO: 698214 - protein, 9 aa, Homo Sapiens
ASNLYSAVG

SEQ ID NO: 698215 - protein, 9 aa, Homo Sapiens
FPPDTRNVV

SEQ ID NO: 698216 - protein, 9 aa, Homo Sapiens
PVDQALVAH

SEQ ID NO: 698217 - protein, 9 aa, Homo Sapiens
ITDLKSGCR

SEQ ID NO: 698218 - protein, 9 aa, Homo Sapiens
YGKESDLVD

SEQ ID NO: 698219 - protein, 9 aa, Homo Sapiens
VAMMVPYYQ

SEQ ID NO: 698220 - protein, 9 aa, Homo Sapiens
YKRQPPVAI

SEQ ID NO: 698221 - protein, 9 aa, Homo Sapiens
NKEYVTSNE

SEQ ID NO: 698222 - protein, 9 aa, Homo Sapiens
WFLLLLHGH

SEQ ID NO: 698223 - protein, 9 aa, Homo Sapiens
NYVIDKFAM

SEQ ID NO: 698224 - protein, 9 aa, Homo Sapiens
HKMLVDLLA

SEQ ID NO: 698225 - protein, 9 aa, Homo Sapiens
FSGILELQV

SEQ ID NO: 698226 - protein, 9 aa, Homo Sapiens
GLLLPNAYI

SEQ ID NO: 698227 - protein, 9 aa, Homo Sapiens
KESDLVDVS

SEQ ID NO: 698228 - protein, 9 aa, Homo Sapiens
RLYESSKCW

SEQ ID NO: 698229 - protein, 9 aa, Homo Sapiens
LLLAESEFS

SEQ ID NO: 698230 - protein, 9 aa, Homo Sapiens
DSSSADTVR

SEQ ID NO: 698231 - protein, 9 aa, Homo Sapiens
EPGAQLRQC

SEQ ID NO: 698232 - protein, 9 aa, Homo Sapiens
SVYVADNRG

SEQ ID NO: 698233 - protein, 9 aa, Homo Sapiens
GACCLVMLI

SEQ ID NO: 698234 - protein, 9 aa, Homo Sapiens
ECINSLDSF

SEQ ID NO: 698235 - protein, 9 aa, Homo Sapiens
CLGPSIQTL

SEQ ID NO: 698236 - protein, 9 aa, Homo Sapiens
EEGADALDP

SEQ ID NO: 698237 - protein, 9 aa, Homo Sapiens
SRHLPVLIG

SEQ ID NO: 698238 - protein, 9 aa, Homo Sapiens
LVMAAVRTL

SEQ ID NO: 698239 - protein, 9 aa, Homo Sapiens
GPAGAASNL

SEQ ID NO: 698240 - protein, 9 aa, Homo Sapiens
AGFDCVYYE

SEQ ID NO: 698241 - protein, 9 aa, Homo Sapiens
IRLGEKARG

SEQ ID NO: 698242 - protein, 9 aa, Homo Sapiens
PGFRYYHWT

SEQ ID NO: 698243 - protein, 9 aa, Homo Sapiens
LVMSVDNTM

SEQ ID NO: 698244 - protein, 9 aa, Homo Sapiens
TLAGIATAM

SEQ ID NO: 698245 - protein, 9 aa, Homo Sapiens
RETGCLCPS

SEQ ID NO: 698246 - protein, 9 aa, Homo Sapiens
IFKQGYGAF

SEQ ID NO: 698247 - protein, 9 aa, Homo Sapiens
TPLRDSLLY

SEQ ID NO: 698248 - protein, 9 aa, Homo Sapiens
SNLELPEAM

SEQ ID NO: 698249 - protein, 9 aa, Homo Sapiens
RLIGCSSQE

SEQ ID NO: 698250 - protein, 9 aa, Homo Sapiens
ESQEATRKA

SEQ ID NO: 698251 - protein, 9 aa, Homo Sapiens
LFSSYSVDK

SEQ ID NO: 698252 - protein, 9 aa, Homo Sapiens
FEATLARLR

SEQ ID NO: 698253 - protein, 9 aa, Homo Sapiens
CRSLTPGPN

SEQ ID NO: 698254 - protein, 9 aa, Homo Sapiens
ENLERQKKK

SEQ ID NO: 698255 - protein, 9 aa, Homo Sapiens
KLTRETEKA

SEQ ID NO: 698256 - protein, 9 aa, Homo Sapiens
EDDEPQQEV

SEQ ID NO: 698257 - protein, 9 aa, Homo Sapiens
FDTQLRTLS

SEQ ID NO: 698258 - protein, 9 aa, Homo Sapiens
TPRLPLPVK

SEQ ID NO: 698259 - protein, 9 aa, Homo Sapiens
TSQENPSPK

SEQ ID NO: 698260 - protein, 9 aa, Homo Sapiens
TRFANKDKQ

SEQ ID NO: 698261 - protein, 9 aa, Homo Sapiens
IAFCVDKKG

SEQ ID NO: 698262 - protein, 9 aa, Homo Sapiens
PVKLLPELP

SEQ ID NO: 698263 - protein, 9 aa, Homo Sapiens
HEVELTVNL

SEQ ID NO: 698264 - protein, 9 aa, Homo Sapiens
WLFSSYSVD

SEQ ID NO: 698265 - protein, 9 aa, Homo Sapiens
NKVQVDARG

SEQ ID NO: 698266 - protein, 9 aa, Homo Sapiens
SCEPKTCSS

SEQ ID NO: 698267 - protein, 9 aa, Homo Sapiens
EAGREDFAM

SEQ ID NO: 698268 - protein, 9 aa, Homo Sapiens
EWKDAKIVY

SEQ ID NO: 698269 - protein, 9 aa, Homo Sapiens
ELIVHPELK

SEQ ID NO: 698270 - protein, 9 aa, Homo Sapiens
LTPNGLSNG

SEQ ID NO: 698271 - protein, 9 aa, Homo Sapiens
IQPVDQALV

SEQ ID NO: 698272 - protein, 9 aa, Homo Sapiens
SSHIERNMV

SEQ ID NO: 698273 - protein, 9 aa, Homo Sapiens
ATVTKMIVD

SEQ ID NO: 698274 - protein, 9 aa, Homo Sapiens
LPRPPILLA

SEQ ID NO: 698275 - protein, 9 aa, Homo Sapiens
GSSVTFRCR

SEQ ID NO: 698276 - protein, 9 aa, Homo Sapiens
PLPSIEEAR

SEQ ID NO: 698277 - protein, 9 aa, Homo Sapiens
KTVSQFTAL

SEQ ID NO: 698278 - protein, 9 aa, Homo Sapiens
SCPASSPSS

SEQ ID NO: 698279 - protein, 9 aa, Homo Sapiens
YCYIGLQGI

SEQ ID NO: 698280 - protein, 9 aa, Homo Sapiens
PLKRKQSRS

SEQ ID NO: 698281 - protein, 9 aa, Homo Sapiens
ADIVVNSAK

SEQ ID NO: 698282 - protein, 9 aa, Homo Sapiens
KEEFNGKKI

SEQ ID NO: 698283 - protein, 9 aa, Homo Sapiens
GNVFRILAN

SEQ ID NO: 698284 - protein, 9 aa, Homo Sapiens
LASAEDQSA

SEQ ID NO: 698285 - protein, 9 aa, Homo Sapiens
LGAAEPFLA

SEQ ID NO: 698286 - protein, 9 aa, Homo Sapiens
SRRDPGTPG

SEQ ID NO: 698287 - protein, 9 aa, Homo Sapiens
IVENVLKDS

SEQ ID NO: 698288 - protein, 9 aa, Homo Sapiens
PTVIFVATG

SEQ ID NO: 698289 - protein, 9 aa, Homo Sapiens
CHESEEESE

SEQ ID NO: 698290 - protein, 9 aa, Homo Sapiens
AIVPSVCFT

SEQ ID NO: 698291 - protein, 9 aa, Homo Sapiens
ERDVAAYSS

SEQ ID NO: 698292 - protein, 9 aa, Homo Sapiens
LEGEVEELK

SEQ ID NO: 698293 - protein, 9 aa, Homo Sapiens
IRWYKLFPP

SEQ ID NO: 698294 - protein, 9 aa, Homo Sapiens
WVCGCTMES

SEQ ID NO: 698295 - protein, 9 aa, Homo Sapiens
LNAAPTVIF

SEQ ID NO: 698296 - protein, 9 aa, Homo Sapiens
QCHESEEES

SEQ ID NO: 698297 - protein, 9 aa, Homo Sapiens
VSIMVAKIL

SEQ ID NO: 698298 - protein, 9 aa, Homo Sapiens
HPGIYALEC

SEQ ID NO: 698299 - protein, 9 aa, Homo Sapiens
GREDFAMDE

SEQ ID NO: 698300 - protein, 9 aa, Homo Sapiens
LGGLPIWLL

SEQ ID NO: 698301 - protein, 9 aa, Homo Sapiens
SCWNCGIST

SEQ ID NO: 698302 - protein, 9 aa, Homo Sapiens
TLKTVNFTA

SEQ ID NO: 698303 - protein, 9 aa, Homo Sapiens
YKMMVVKSS

SEQ ID NO: 698304 - protein, 9 aa, Homo Sapiens
QQPEGTCLR

SEQ ID NO: 698305 - protein, 9 aa, Homo Sapiens
EKYSTYAKI

SEQ ID NO: 698306 - protein, 9 aa, Homo Sapiens
PMDFFLGNF

SEQ ID NO: 698307 - protein, 9 aa, Homo Sapiens
RAGGAGAGR

SEQ ID NO: 698308 - protein, 9 aa, Homo Sapiens
NENFYQFSM

SEQ ID NO: 698309 - protein, 9 aa, Homo Sapiens
GAASNLYSA

SEQ ID NO: 698310 - protein, 9 aa, Homo Sapiens
EPLILLCHH

SEQ ID NO: 698311 - protein, 9 aa, Homo Sapiens
PEIRFGECC

SEQ ID NO: 698312 - protein, 9 aa, Homo Sapiens
KRKKFTRQP

SEQ ID NO: 698313 - protein, 9 aa, Homo Sapiens
GKEYEYPKK

SEQ ID NO: 698314 - protein, 9 aa, Homo Sapiens
TGNSRHLPV

SEQ ID NO: 698315 - protein, 9 aa, Homo Sapiens
LHTPMDFFL

SEQ ID NO: 698316 - protein, 9 aa, Homo Sapiens
LVQSHSCIP

SEQ ID NO: 698317 - protein, 9 aa, Homo Sapiens
VKIENMGIY

SEQ ID NO: 698318 - protein, 9 aa, Homo Sapiens
DLFNLRSLR

SEQ ID NO: 698319 - protein, 9 aa, Homo Sapiens
PPGYGPIPS

SEQ ID NO: 698320 - protein, 9 aa, Homo Sapiens
YIPPLPSIE

SEQ ID NO: 698321 - protein, 9 aa, Homo Sapiens
LTIIHLQHN

SEQ ID NO: 698322 - protein, 9 aa, Homo Sapiens
PVDTGPPSP

SEQ ID NO: 698323 - protein, 9 aa, Homo Sapiens
EIPSVWHLW

SEQ ID NO: 698324 - protein, 9 aa, Homo Sapiens
TKTSVRGEE

SEQ ID NO: 698325 - protein, 9 aa, Homo Sapiens
KTRHNSVFQ

SEQ ID NO: 698326 - protein, 9 aa, Homo Sapiens
PNAYIYVVQ

SEQ ID NO: 698327 - protein, 9 aa, Homo Sapiens
CPVKLLPEL

SEQ ID NO: 698328 - protein, 9 aa, Homo Sapiens
CLLKQKKSP

SEQ ID NO: 698329 - protein, 9 aa, Homo Sapiens
WMPEARLSD

SEQ ID NO: 698330 - protein, 9 aa, Homo Sapiens
VPSKPCLLK

SEQ ID NO: 698331 - protein, 9 aa, Homo Sapiens
TVFPRSTKT

SEQ ID NO: 698332 - protein, 9 aa, Homo Sapiens
TDSSSADTV

SEQ ID NO: 698333 - protein, 9 aa, Homo Sapiens
RLLKRTPRT

SEQ ID NO: 698334 - protein, 9 aa, Homo Sapiens
GFTLTFPSD

SEQ ID NO: 698335 - protein, 9 aa, Homo Sapiens
ISLPLGSTE

SEQ ID NO: 698336 - protein, 9 aa, Homo Sapiens
LVNLTIIHL

SEQ ID NO: 698337 - protein, 9 aa, Homo Sapiens
CWNCGISTL

SEQ ID NO: 698338 - protein, 9 aa, Homo Sapiens
PLVQSHSCI

SEQ ID NO: 698339 - protein, 9 aa, Homo Sapiens
GGAGAGRPP

SEQ ID NO: 698340 - protein, 9 aa, Homo Sapiens
SLHIVTNEP

SEQ ID NO: 698341 - protein, 9 aa, Homo Sapiens
FYQFSMKNN

SEQ ID NO: 698342 - protein, 9 aa, Homo Sapiens
MVPYYQMIA

SEQ ID NO: 698343 - protein, 9 aa, Homo Sapiens
FPRSTKTSV

SEQ ID NO: 698344 - protein, 9 aa, Homo Sapiens
CNFISFPCL

SEQ ID NO: 698345 - protein, 9 aa, Homo Sapiens
GFCEVTERC

SEQ ID NO: 698346 - protein, 9 aa, Homo Sapiens
NPPRSSLCA

SEQ ID NO: 698347 - protein, 9 aa, Homo Sapiens
LPNLDPVKI

SEQ ID NO: 698348 - protein, 9 aa, Homo Sapiens
YACLLDKHL

SEQ ID NO: 698349 - protein, 9 aa, Homo Sapiens
EVDVMHLSQ

SEQ ID NO: 698350 - protein, 9 aa, Homo Sapiens
STDTWVYEY

SEQ ID NO: 698351 - protein, 9 aa, Homo Sapiens
QQEVSLEVA

SEQ ID NO: 698352 - protein, 9 aa, Homo Sapiens
TTLGVFSDS

SEQ ID NO: 698353 - protein, 9 aa, Homo Sapiens
QHRTTLNTY

SEQ ID NO: 698354 - protein, 9 aa, Homo Sapiens
FSITSDVWA

SEQ ID NO: 698355 - protein, 9 aa, Homo Sapiens
PSGYYGHLA

SEQ ID NO: 698356 - protein, 9 aa, Homo Sapiens
REEQSWTGF

SEQ ID NO: 698357 - protein, 9 aa, Homo Sapiens
YNSVLFMYA

SEQ ID NO: 698358 - protein, 9 aa, Homo Sapiens
SSVTFRCRI

SEQ ID NO: 698359 - protein, 9 aa, Homo Sapiens
TEDAAYEFC

SEQ ID NO: 698360 - protein, 9 aa, Homo Sapiens
LKDFQYLYF

SEQ ID NO: 698361 - protein, 9 aa, Homo Sapiens
APNPGLRSK

SEQ ID NO: 698362 - protein, 9 aa, Homo Sapiens
EGTCLRVAD

SEQ ID NO: 698363 - protein, 9 aa, Homo Sapiens
LLTCVFLPL

SEQ ID NO: 698364 - protein, 9 aa, Homo Sapiens
FGGWGSGGQ

SEQ ID NO: 698365 - protein, 9 aa, Homo Sapiens
YEFCVIAKN

SEQ ID NO: 698366 - protein, 9 aa, Homo Sapiens
LLDKHLYVI

SEQ ID NO: 698367 - protein, 9 aa, Homo Sapiens
FPWKKEKKS

SEQ ID NO: 698368 - protein, 9 aa, Homo Sapiens
AKGGTAWLE

SEQ ID NO: 698369 - protein, 9 aa, Homo Sapiens
FLLLVPHLQ

SEQ ID NO: 698370 - protein, 9 aa, Homo Sapiens
GRPKELVSC

SEQ ID NO: 698371 - protein, 9 aa, Homo Sapiens
EPGRQEQLV

SEQ ID NO: 698372 - protein, 9 aa, Homo Sapiens
CRELNADIV

SEQ ID NO: 698373 - protein, 9 aa, Homo Sapiens
PGRQEQLVF

SEQ ID NO: 698374 - protein, 9 aa, Homo Sapiens
PSPTHGPAP

SEQ ID NO: 698375 - protein, 9 aa, Homo Sapiens
RKELQAKAT

SEQ ID NO: 698376 - protein, 9 aa, Homo Sapiens
LLAESEFSG

SEQ ID NO: 698377 - protein, 9 aa, Homo Sapiens
TESTSSLTL

SEQ ID NO: 698378 - protein, 9 aa, Homo Sapiens
SSTTHVETF

SEQ ID NO: 698379 - protein, 9 aa, Homo Sapiens
WDTSDWMPE

SEQ ID NO: 698380 - protein, 9 aa, Homo Sapiens
LIGPPGEKG

SEQ ID NO: 698381 - protein, 9 aa, Homo Sapiens
GDKPANAVL

SEQ ID NO: 698382 - protein, 9 aa, Homo Sapiens
LGVKKQDPQ

SEQ ID NO: 698383 - protein, 9 aa, Homo Sapiens
QVSACDAGV

SEQ ID NO: 698384 - protein, 9 aa, Homo Sapiens
SNAEEVLSL

SEQ ID NO: 698385 - protein, 9 aa, Homo Sapiens
SGCRSLTPG

SEQ ID NO: 698386 - protein, 9 aa, Homo Sapiens
QPSVTGYRW

SEQ ID NO: 698387 - protein, 9 aa, Homo Sapiens
VLDLHEAGR

SEQ ID NO: 698388 - protein, 9 aa, Homo Sapiens
YLHNKTFHT

SEQ ID NO: 698389 - protein, 9 aa, Homo Sapiens
PSVTGYRWA

SEQ ID NO: 698390 - protein, 9 aa, Homo Sapiens
HPLYHHREF

SEQ ID NO: 698391 - protein, 9 aa, Homo Sapiens
SANAKIYQL

SEQ ID NO: 698392 - protein, 9 aa, Homo Sapiens
SRVYKLVQH

SEQ ID NO: 698393 - protein, 9 aa, Homo Sapiens
QSDPSLPSQ

SEQ ID NO: 698394 - protein, 9 aa, Homo Sapiens
DAYQDRLFN

SEQ ID NO: 698395 - protein, 9 aa, Homo Sapiens
LIVHPELKY

SEQ ID NO: 698396 - protein, 9 aa, Homo Sapiens
ATGYGLKSR

SEQ ID NO: 698397 - protein, 9 aa, Homo Sapiens
HYNGCSEDN

SEQ ID NO: 698398 - protein, 9 aa, Homo Sapiens
YVFDREKCA

SEQ ID NO: 698399 - protein, 9 aa, Homo Sapiens
MMVPYYQMI

SEQ ID NO: 698400 - protein, 9 aa, Homo Sapiens
KILKKTQKD

SEQ ID NO: 698401 - protein, 9 aa, Homo Sapiens
NISGLRFDT

SEQ ID NO: 698402 - protein, 9 aa, Homo Sapiens
LVFYVITVV

SEQ ID NO: 698403 - protein, 9 aa, Homo Sapiens
LTCVFLPLL

SEQ ID NO: 698404 - protein, 9 aa, Homo Sapiens
AGREDFAMD

SEQ ID NO: 698405 - protein, 9 aa, Homo Sapiens
GGLPIWLLQ

SEQ ID NO: 698406 - protein, 9 aa, Homo Sapiens
TSYQNHKTT

SEQ ID NO: 698407 - protein, 9 aa, Homo Sapiens
QAPTSQNLA

SEQ ID NO: 698408 - protein, 9 aa, Homo Sapiens
TVSQFTALK

SEQ ID NO: 698409 - protein, 9 aa, Homo Sapiens
PHTFCEHMG

SEQ ID NO: 698410 - protein, 9 aa, Homo Sapiens
SYCYIGLQG

SEQ ID NO: 698411 - protein, 9 aa, Homo Sapiens
EGEVEELKA

SEQ ID NO: 698412 - protein, 9 aa, Homo Sapiens
SEFSGNIKN

SEQ ID NO: 698413 - protein, 9 aa, Homo Sapiens
NKKSGRPKE

SEQ ID NO: 698414 - protein, 9 aa, Homo Sapiens
DTQLRTLSL

SEQ ID NO: 698415 - protein, 9 aa, Homo Sapiens
SGGQCQDLR

SEQ ID NO: 698416 - protein, 9 aa, Homo Sapiens
RKKFTRQPK

SEQ ID NO: 698417 - protein, 9 aa, Homo Sapiens
PDAYQDRLF

SEQ ID NO: 698418 - protein, 9 aa, Homo Sapiens
GFLGMAVAF

SEQ ID NO: 698419 - protein, 9 aa, Homo Sapiens
GLIGPPGEK

SEQ ID NO: 698420 - protein, 9 aa, Homo Sapiens
PIAVAAPGM

SEQ ID NO: 698421 - protein, 9 aa, Homo Sapiens
PGPEPGRQE

SEQ ID NO: 698422 - protein, 9 aa, Homo Sapiens
SLDSFRCHC

SEQ ID NO: 698423 - protein, 9 aa, Homo Sapiens
AFRPTLVAE

SEQ ID NO: 698424 - protein, 9 aa, Homo Sapiens
FNEGGEKEK

SEQ ID NO: 698425 - protein, 9 aa, Homo Sapiens
ADFILKVVI

SEQ ID NO: 698426 - protein, 9 aa, Homo Sapiens
GLGCVLIQK

SEQ ID NO: 698427 - protein, 9 aa, Homo Sapiens
AYSSSLEDV

SEQ ID NO: 698428 - protein, 9 aa, Homo Sapiens
QQVAVTLSQ

SEQ ID NO: 698429 - protein, 9 aa, Homo Sapiens
YVVESQGAA

SEQ ID NO: 698430 - protein, 9 aa, Homo Sapiens
TTLMNTLMY

SEQ ID NO: 698431 - protein, 9 aa, Homo Sapiens
QLITKEPKE

SEQ ID NO: 698432 - protein, 9 aa, Homo Sapiens
SSADTVRLE

SEQ ID NO: 698433 - protein, 9 aa, Homo Sapiens
AAMNTTTKE

SEQ ID NO: 698434 - protein, 9 aa, Homo Sapiens
VVSFLNSMK

SEQ ID NO: 698435 - protein, 9 aa, Homo Sapiens
ENPPAGIAL

SEQ ID NO: 698436 - protein, 9 aa, Homo Sapiens
SSSTTHVET

SEQ ID NO: 698437 - protein, 9 aa, Homo Sapiens
LDILYFLLL

SEQ ID NO: 698438 - protein, 9 aa, Homo Sapiens
EFSGILELQ

SEQ ID NO: 698439 - protein, 9 aa, Homo Sapiens
RGQLAVAGS

SEQ ID NO: 698440 - protein, 9 aa, Homo Sapiens
IQKRGKLPG

SEQ ID NO: 698441 - protein, 9 aa, Homo Sapiens
MKHFDFPLP

SEQ ID NO: 698442 - protein, 9 aa, Homo Sapiens
IPYNIATIR

SEQ ID NO: 698443 - protein, 9 aa, Homo Sapiens
ENFYQFSMK

SEQ ID NO: 698444 - protein, 9 aa, Homo Sapiens
GAVEGETLA

SEQ ID NO: 698445 - protein, 9 aa, Homo Sapiens
LGVPPPSPT

SEQ ID NO: 698446 - protein, 9 aa, Homo Sapiens
PCIFIYVWL

SEQ ID NO: 698447 - protein, 9 aa, Homo Sapiens
IVVLCFFCP

SEQ ID NO: 698448 - protein, 9 aa, Homo Sapiens
VLQSEAASL

SEQ ID NO: 698449 - protein, 9 aa, Homo Sapiens
PRSSLCAVQ

SEQ ID NO: 698450 - protein, 9 aa, Homo Sapiens
DSFRCHCQA

SEQ ID NO: 698451 - protein, 9 aa, Homo Sapiens
RVYKLVQHK

SEQ ID NO: 698452 - protein, 9 aa, Homo Sapiens
TALGVIFLN

SEQ ID NO: 698453 - protein, 9 aa, Homo Sapiens
NTFSITSDV

SEQ ID NO: 698454 - protein, 9 aa, Homo Sapiens
GFRYYHWTL

SEQ ID NO: 698455 - protein, 9 aa, Homo Sapiens
PILLALLLA

SEQ ID NO: 698456 - protein, 9 aa, Homo Sapiens
EDDPTCSCP

SEQ ID NO: 698457 - protein, 9 aa, Homo Sapiens
EDLGDLEPL

SEQ ID NO: 698458 - protein, 9 aa, Homo Sapiens
NKTFHTVPN

SEQ ID NO: 698459 - protein, 9 aa, Homo Sapiens
LCPSWLPHH

SEQ ID NO: 698460 - protein, 9 aa, Homo Sapiens
FACAATVIG

SEQ ID NO: 698461 - protein, 9 aa, Homo Sapiens
GNSRHLPVL

SEQ ID NO: 698462 - protein, 9 aa, Homo Sapiens
IGFTSATVT

SEQ ID NO: 698463 - protein, 9 aa, Homo Sapiens
EDDPDVPWR

SEQ ID NO: 698464 - protein, 9 aa, Homo Sapiens
DNVTKEAFV

SEQ ID NO: 698465 - protein, 9 aa, Homo Sapiens
PKQSDPSLP

SEQ ID NO: 698466 - protein, 9 aa, Homo Sapiens
GLGLYPPGY

SEQ ID NO: 698467 - protein, 9 aa, Homo Sapiens
CVLIQKRGK

SEQ ID NO: 698468 - protein, 9 aa, Homo Sapiens
SKCWKACCC

SEQ ID NO: 698469 - protein, 9 aa, Homo Sapiens
TCVFLPLLR

SEQ ID NO: 698470 - protein, 9 aa, Homo Sapiens
DTGCTGWNN

SEQ ID NO: 698471 - protein, 9 aa, Homo Sapiens
KYAEELARA

SEQ ID NO: 698472 - protein, 9 aa, Homo Sapiens
LFQQGVRPT

SEQ ID NO: 698473 - protein, 9 aa, Homo Sapiens
KGIHSSDED

SEQ ID NO: 698474 - protein, 9 aa, Homo Sapiens
LMKHFDFPL

SEQ ID NO: 698475 - protein, 9 aa, Homo Sapiens
EYVTSNEST

SEQ ID NO: 698476 - protein, 9 aa, Homo Sapiens
RQNFRPPAP

SEQ ID NO: 698477 - protein, 9 aa, Homo Sapiens
TCSSTGCDP

SEQ ID NO: 698478 - protein, 9 aa, Homo Sapiens
TWLAAMNTT

SEQ ID NO: 698479 - protein, 9 aa, Homo Sapiens
TPMLNAIIY

SEQ ID NO: 698480 - protein, 9 aa, Homo Sapiens
FLLCGCIVA

SEQ ID NO: 698481 - protein, 9 aa, Homo Sapiens
STKTSVRGE

SEQ ID NO: 698482 - protein, 9 aa, Homo Sapiens
IPKTGLLMT

SEQ ID NO: 698483 - protein, 9 aa, Homo Sapiens
RDSLLYVVE

SEQ ID NO: 698484 - protein, 9 aa, Homo Sapiens
FCEHMGIAR

SEQ ID NO: 698485 - protein, 9 aa, Homo Sapiens
SSLLTLAGI

SEQ ID NO: 698486 - protein, 9 aa, Homo Sapiens
GKSRVVPSG

SEQ ID NO: 698487 - protein, 9 aa, Homo Sapiens
VVYLHKIKD

SEQ ID NO: 698488 - protein, 9 aa, Homo Sapiens
EDNVTKEAF

SEQ ID NO: 698489 - protein, 9 aa, Homo Sapiens
MLISCVFCM

SEQ ID NO: 698490 - protein, 9 aa, Homo Sapiens
RRQCHESEE

SEQ ID NO: 698491 - protein, 9 aa, Homo Sapiens
DSNKEYVTS

SEQ ID NO: 698492 - protein, 9 aa, Homo Sapiens
LSYKDYKTS

SEQ ID NO: 698493 - protein, 9 aa, Homo Sapiens
FISFPCLSY

SEQ ID NO: 698494 - protein, 9 aa, Homo Sapiens
GVGSDVELL

SEQ ID NO: 698495 - protein, 9 aa, Homo Sapiens
CRDVMLENY

SEQ ID NO: 698496 - protein, 9 aa, Homo Sapiens
DSKEPVFPV

SEQ ID NO: 698497 - protein, 9 aa, Homo Sapiens
QVDARGNIL

SEQ ID NO: 698498 - protein, 9 aa, Homo Sapiens
PGVAPEPLS

SEQ ID NO: 698499 - protein, 9 aa, Homo Sapiens
VTFRCRISP

SEQ ID NO: 698500 - protein, 9 aa, Homo Sapiens
LHYALLGRG

SEQ ID NO: 698501 - protein, 9 aa, Homo Sapiens
PEGTCLRVA

SEQ ID NO: 698502 - protein, 9 aa, Homo Sapiens
NNAIPKSSI

SEQ ID NO: 698503 - protein, 9 aa, Homo Sapiens
GLRSKPPDL

SEQ ID NO: 698504 - protein, 9 aa, Homo Sapiens
MLNAIIYSL

SEQ ID NO: 698505 - protein, 9 aa, Homo Sapiens
TFHTVPNLR

SEQ ID NO: 698506 - protein, 9 aa, Homo Sapiens
VPYYQMIAE

SEQ ID NO: 698507 - protein, 9 aa, Homo Sapiens
KGPELLESK

SEQ ID NO: 698508 - protein, 9 aa, Homo Sapiens
RQCHESEEE

SEQ ID NO: 698509 - protein, 9 aa, Homo Sapiens
RMRDLLYAQ

SEQ ID NO: 698510 - protein, 9 aa, Homo Sapiens
DTHLHTPMD

SEQ ID NO: 698511 - protein, 9 aa, Homo Sapiens
LSSHIERNM

SEQ ID NO: 698512 - protein, 9 aa, Homo Sapiens
LKTVNFTAC

SEQ ID NO: 698513 - protein, 9 aa, Homo Sapiens
VSNGFCEVT

SEQ ID NO: 698514 - protein, 9 aa, Homo Sapiens
LKIINFSRL

SEQ ID NO: 698515 - protein, 9 aa, Homo Sapiens
SLLVFYVIT

SEQ ID NO: 698516 - protein, 9 aa, Homo Sapiens
KQRKKEKRK

SEQ ID NO: 698517 - protein, 9 aa, Homo Sapiens
RHCKRSKSK

SEQ ID NO: 698518 - protein, 9 aa, Homo Sapiens
AAYEFCVIA

SEQ ID NO: 698519 - protein, 9 aa, Homo Sapiens
PAPPYPGPG

SEQ ID NO: 698520 - protein, 9 aa, Homo Sapiens
TFQEIVANQ

SEQ ID NO: 698521 - protein, 9 aa, Homo Sapiens
AGSYCYIGL

SEQ ID NO: 698522 - protein, 9 aa, Homo Sapiens
LPVLIGTSV

SEQ ID NO: 698523 - protein, 9 aa, Homo Sapiens
VAILINLTD

SEQ ID NO: 698524 - protein, 9 aa, Homo Sapiens
LLLTPGLQP

SEQ ID NO: 698525 - protein, 9 aa, Homo Sapiens
LLVATIFLN

SEQ ID NO: 698526 - protein, 9 aa, Homo Sapiens
NLAAGRSMT

SEQ ID NO: 698527 - protein, 9 aa, Homo Sapiens
ASAVCKATT

SEQ ID NO: 698528 - protein, 9 aa, Homo Sapiens
EKGSRRDPG

SEQ ID NO: 698529 - protein, 9 aa, Homo Sapiens
LTFPSDHAT

SEQ ID NO: 698530 - protein, 9 aa, Homo Sapiens
TLNTYYSLA

SEQ ID NO: 698531 - protein, 9 aa, Homo Sapiens
EKGEKGDRG

SEQ ID NO: 698532 - protein, 9 aa, Homo Sapiens
LGVFSDSPG

SEQ ID NO: 698533 - protein, 9 aa, Homo Sapiens
EIVANQRIE

SEQ ID NO: 698534 - protein, 9 aa, Homo Sapiens
LHSNAEEVL

SEQ ID NO: 698535 - protein, 9 aa, Homo Sapiens
NAIPKSSIR

SEQ ID NO: 698536 - protein, 9 aa, Homo Sapiens
SAEDQSASS

SEQ ID NO: 698537 - protein, 9 aa, Homo Sapiens
RQFIFDVFN

SEQ ID NO: 698538 - protein, 9 aa, Homo Sapiens
PVTSLSSVT

SEQ ID NO: 698539 - protein, 9 aa, Homo Sapiens
ATRKASHQN

SEQ ID NO: 698540 - protein, 9 aa, Homo Sapiens
VFRILANLQ

SEQ ID NO: 698541 - protein, 9 aa, Homo Sapiens
KVVLQSEAA

SEQ ID NO: 698542 - protein, 9 aa, Homo Sapiens
EFKGFGLKL

SEQ ID NO: 698543 - protein, 9 aa, Homo Sapiens
VMLISCVFC

SEQ ID NO: 698544 - protein, 9 aa, Homo Sapiens
LKEEFNGKK

SEQ ID NO: 698545 - protein, 9 aa, Homo Sapiens
QGYGAFRCK

SEQ ID NO: 698546 - protein, 9 aa, Homo Sapiens
FPCLSYKDY

SEQ ID NO: 698547 - protein, 9 aa, Homo Sapiens
HVTTYLTQE

SEQ ID NO: 698548 - protein, 9 aa, Homo Sapiens
IKDGSEAYL

SEQ ID NO: 698549 - protein, 9 aa, Homo Sapiens
SEKTVSQFT

SEQ ID NO: 698550 - protein, 9 aa, Homo Sapiens
KKRKDSDEE

SEQ ID NO: 698551 - protein, 9 aa, Homo Sapiens
PCQPPPVCS

SEQ ID NO: 698552 - protein, 9 aa, Homo Sapiens
EESKILKKT

SEQ ID NO: 698553 - protein, 9 aa, Homo Sapiens
AGRDPRQPC

SEQ ID NO: 698554 - protein, 9 aa, Homo Sapiens
LGGSREYKV

SEQ ID NO: 698555 - protein, 9 aa, Homo Sapiens
DSNYEKGLE

SEQ ID NO: 698556 - protein, 9 aa, Homo Sapiens
HAIPIADLF

SEQ ID NO: 698557 - protein, 9 aa, Homo Sapiens
ELGVVRNFQ

SEQ ID NO: 698558 - protein, 9 aa, Homo Sapiens
ANSGSLCFH

SEQ ID NO: 698559 - protein, 9 aa, Homo Sapiens
IPDAYQDRL

SEQ ID NO: 698560 - protein, 9 aa, Homo Sapiens
DLKSGCRSL

SEQ ID NO: 698561 - protein, 9 aa, Homo Sapiens
SHCSVTPLS

SEQ ID NO: 698562 - protein, 9 aa, Homo Sapiens
AFCVDKKGR

SEQ ID NO: 698563 - protein, 9 aa, Homo Sapiens
AVTLDEWRK

SEQ ID NO: 698564 - protein, 9 aa, Homo Sapiens
PANTTAGVG

SEQ ID NO: 698565 - protein, 9 aa, Homo Sapiens
LTLASTDTW

SEQ ID NO: 698566 - protein, 9 aa, Homo Sapiens
RDPRQPCPH

SEQ ID NO: 698567 - protein, 9 aa, Homo Sapiens
KIINFSRLI

SEQ ID NO: 698568 - protein, 9 aa, Homo Sapiens
GNIIAFCVD

SEQ ID NO: 698569 - protein, 9 aa, Homo Sapiens
VPGPEPGRQ

SEQ ID NO: 698570 - protein, 9 aa, Homo Sapiens
STTHVETFS

SEQ ID NO: 698571 - protein, 9 aa, Homo Sapiens
LISCVFCMG

SEQ ID NO: 698572 - protein, 9 aa, Homo Sapiens
CHHVFCEEC

SEQ ID NO: 698573 - protein, 9 aa, Homo Sapiens
KGTVVELSN

SEQ ID NO: 698574 - protein, 9 aa, Homo Sapiens
ELFIDKTEN

SEQ ID NO: 698575 - protein, 9 aa, Homo Sapiens
ILICRDQVT

SEQ ID NO: 698576 - protein, 9 aa, Homo Sapiens
FSDSPGTTT

SEQ ID NO: 698577 - protein, 9 aa, Homo Sapiens
QSFTTWLAA

SEQ ID NO: 698578 - protein, 9 aa, Homo Sapiens
QLGAHRLAH

SEQ ID NO: 698579 - protein, 9 aa, Homo Sapiens
GPELLESKL

SEQ ID NO: 698580 - protein, 9 aa, Homo Sapiens
SVDKEIQGE

SEQ ID NO: 698581 - protein, 9 aa, Homo Sapiens
LHAAIGSTT

SEQ ID NO: 698582 - protein, 9 aa, Homo Sapiens
IWLLQDPGM

SEQ ID NO: 698583 - protein, 9 aa, Homo Sapiens
DGFRISWKE

SEQ ID NO: 698584 - protein, 9 aa, Homo Sapiens
TTWLAAMNT

SEQ ID NO: 698585 - protein, 9 aa, Homo Sapiens
MVCHLASIL

SEQ ID NO: 698586 - protein, 9 aa, Homo Sapiens
VATIFLNRT

SEQ ID NO: 698587 - protein, 9 aa, Homo Sapiens
VSLLASLLV

SEQ ID NO: 698588 - protein, 9 aa, Homo Sapiens
REDFAMDED

SEQ ID NO: 698589 - protein, 9 aa, Homo Sapiens
KTDTDPMLQ

SEQ ID NO: 698590 - protein, 9 aa, Homo Sapiens
PGLRSKPPD

SEQ ID NO: 698591 - protein, 9 aa, Homo Sapiens
SAKTGNGEI

SEQ ID NO: 698592 - protein, 9 aa, Homo Sapiens
RPLASMAKD

SEQ ID NO: 698593 - protein, 9 aa, Homo Sapiens
IRFGECCPI

SEQ ID NO: 698594 - protein, 9 aa, Homo Sapiens
RYGKESDLV

SEQ ID NO: 698595 - protein, 9 aa, Homo Sapiens
TPADFILKV

SEQ ID NO: 698596 - protein, 9 aa, Homo Sapiens
WNNTQGKDR

SEQ ID NO: 698597 - protein, 9 aa, Homo Sapiens
KKQSCLLQN

SEQ ID NO: 698598 - protein, 9 aa, Homo Sapiens
NTQGKDRLP

SEQ ID NO: 698599 - protein, 9 aa, Homo Sapiens
YSTATGHKM

SEQ ID NO: 698600 - protein, 9 aa, Homo Sapiens
GAGAGRPPK

SEQ ID NO: 698601 - protein, 9 aa, Homo Sapiens
ESTSSLTLG

SEQ ID NO: 698602 - protein, 9 aa, Homo Sapiens
LNFGGLQGL

SEQ ID NO: 698603 - protein, 9 aa, Homo Sapiens
LRKEKYSTY

SEQ ID NO: 698604 - protein, 9 aa, Homo Sapiens
STPKCPEPC

SEQ ID NO: 698605 - protein, 9 aa, Homo Sapiens
QLAVAGSTG

SEQ ID NO: 698606 - protein, 9 aa, Homo Sapiens
HDPWKLLVA

SEQ ID NO: 698607 - protein, 9 aa, Homo Sapiens
PPILLALLL

SEQ ID NO: 698608 - protein, 9 aa, Homo Sapiens
TGNEAIVPS

SEQ ID NO: 698609 - protein, 9 aa, Homo Sapiens
DVTSANAKI

SEQ ID NO: 698610 - protein, 9 aa, Homo Sapiens
PVLIGTSVV

SEQ ID NO: 698611 - protein, 9 aa, Homo Sapiens
YSAKTGNGE

SEQ ID NO: 698612 - protein, 9 aa, Homo Sapiens
LPVLNAAPT

SEQ ID NO: 698613 - protein, 9 aa, Homo Sapiens
WTGFEATLA

SEQ ID NO: 698614 - protein, 9 aa, Homo Sapiens
YELGVVRNF

SEQ ID NO: 698615 - protein, 9 aa, Homo Sapiens
TTGDTTPLP

SEQ ID NO: 698616 - protein, 9 aa, Homo Sapiens
PQPCGAPRQ

SEQ ID NO: 698617 - protein, 9 aa, Homo Sapiens
EDYLDDEYS

SEQ ID NO: 698618 - protein, 9 aa, Homo Sapiens
LELPEAMVF

SEQ ID NO: 698619 - protein, 9 aa, Homo Sapiens
GLPRPPILL

SEQ ID NO: 698620 - protein, 9 aa, Homo Sapiens
KIENMGIYS

SEQ ID NO: 698621 - protein, 9 aa, Homo Sapiens
DRRLPGPLP

SEQ ID NO: 698622 - protein, 9 aa, Homo Sapiens
MLMHFIRRK

SEQ ID NO: 698623 - protein, 9 aa, Homo Sapiens
EFPPDTRNV

SEQ ID NO: 698624 - protein, 9 aa, Homo Sapiens
AAPTVIFVA

SEQ ID NO: 698625 - protein, 9 aa, Homo Sapiens
CPSWLPHHQ

SEQ ID NO: 698626 - protein, 9 aa, Homo Sapiens
GSRRDPGTP

SEQ ID NO: 698627 - protein, 9 aa, Homo Sapiens
FKQGYGAFR

SEQ ID NO: 698628 - protein, 9 aa, Homo Sapiens
LLMTALGVI

SEQ ID NO: 698629 - protein, 9 aa, Homo Sapiens
KLEGEVEEL

SEQ ID NO: 698630 - protein, 9 aa, Homo Sapiens
ACCLVMLIS

SEQ ID NO: 698631 - protein, 9 aa, Homo Sapiens
YYKDPLNCE

SEQ ID NO: 698632 - protein, 9 aa, Homo Sapiens
YAEELARAK

SEQ ID NO: 698633 - protein, 9 aa, Homo Sapiens
GSSMKSVGD

SEQ ID NO: 698634 - protein, 9 aa, Homo Sapiens
VFLPLLRGH

SEQ ID NO: 698635 - protein, 9 aa, Homo Sapiens
LIALWLRLV

SEQ ID NO: 698636 - protein, 9 aa, Homo Sapiens
AWKDVTSAN

SEQ ID NO: 698637 - protein, 9 aa, Homo Sapiens
YEYPKKPLG

SEQ ID NO: 698638 - protein, 9 aa, Homo Sapiens
MPEARLSDI

SEQ ID NO: 698639 - protein, 9 aa, Homo Sapiens
ERGQLAVAG

SEQ ID NO: 698640 - protein, 9 aa, Homo Sapiens
ERMQLLLTP

SEQ ID NO: 698641 - protein, 9 aa, Homo Sapiens
SVVDDIFLV

SEQ ID NO: 698642 - protein, 9 aa, Homo Sapiens
KFMLMKHFD

SEQ ID NO: 698643 - protein, 9 aa, Homo Sapiens
IVPSVCFTV

SEQ ID NO: 698644 - protein, 9 aa, Homo Sapiens
DILPVDNKR

SEQ ID NO: 698645 - protein, 9 aa, Homo Sapiens
YKLVQHKRI

SEQ ID NO: 698646 - protein, 9 aa, Homo Sapiens
RFDTQLRTL

SEQ ID NO: 698647 - protein, 9 aa, Homo Sapiens
AAAIIITIL

SEQ ID NO: 698648 - protein, 9 aa, Homo Sapiens
DVQEGSSVT

SEQ ID NO: 698649 - protein, 9 aa, Homo Sapiens
EVTERCWKD

SEQ ID NO: 698650 - protein, 9 aa, Homo Sapiens
GGYEEALKI

SEQ ID NO: 698651 - protein, 9 aa, Homo Sapiens
DFQYLYFAI

SEQ ID NO: 698652 - protein, 9 aa, Homo Sapiens
SSPQPCGAP

SEQ ID NO: 698653 - protein, 9 aa, Homo Sapiens
VSSSCWNCG

SEQ ID NO: 698654 - protein, 9 aa, Homo Sapiens
TRHNSVFQQ

SEQ ID NO: 698655 - protein, 9 aa, Homo Sapiens
CYVFDREKC

SEQ ID NO: 698656 - protein, 9 aa, Homo Sapiens
SSIRVIHAL

SEQ ID NO: 698657 - protein, 9 aa, Homo Sapiens
QYLYFAILL

SEQ ID NO: 698658 - protein, 9 aa, Homo Sapiens
HTVPNLRNL

SEQ ID NO: 698659 - protein, 9 aa, Homo Sapiens
FMLMKHFDF

SEQ ID NO: 698660 - protein, 9 aa, Homo Sapiens
PADFILKVV

SEQ ID NO: 698661 - protein, 9 aa, Homo Sapiens
MKSVGDVMA

SEQ ID NO: 698662 - protein, 9 aa, Homo Sapiens
LPFEDLGDL

SEQ ID NO: 698663 - protein, 9 aa, Homo Sapiens
CDRSCGLIA

SEQ ID NO: 698664 - protein, 9 aa, Homo Sapiens
LAPDMNRCA

SEQ ID NO: 698665 - protein, 9 aa, Homo Sapiens
VMSVDNTMH

SEQ ID NO: 698666 - protein, 9 aa, Homo Sapiens
KDVTSANAK

SEQ ID NO: 698667 - protein, 9 aa, Homo Sapiens
LGLGLYPPG

SEQ ID NO: 698668 - protein, 9 aa, Homo Sapiens
RKDWDAFRP

SEQ ID NO: 698669 - protein, 9 aa, Homo Sapiens
TAQPSVTGY

SEQ ID NO: 698670 - protein, 9 aa, Homo Sapiens
TSEEQLITK

SEQ ID NO: 698671 - protein, 9 aa, Homo Sapiens
TFPSDHATW

SEQ ID NO: 698672 - protein, 9 aa, Homo Sapiens
NLYSAVGRN

SEQ ID NO: 698673 - protein, 9 aa, Homo Sapiens
KELQAKATV

SEQ ID NO: 698674 - protein, 9 aa, Homo Sapiens
FQQDSHCSV

SEQ ID NO: 698675 - protein, 9 aa, Homo Sapiens
HFIRRKYKM

SEQ ID NO: 698676 - protein, 9 aa, Homo Sapiens
SLQYIRGWS

SEQ ID NO: 698677 - protein, 9 aa, Homo Sapiens
QWRRPLASM

SEQ ID NO: 698678 - protein, 9 aa, Homo Sapiens
TLTVMEDDP

SEQ ID NO: 698679 - protein, 9 aa, Homo Sapiens
DCLSPEIRF

SEQ ID NO: 698680 - protein, 9 aa, Homo Sapiens
VTRMRDLLY

SEQ ID NO: 698681 - protein, 9 aa, Homo Sapiens
RVRTHTGEK

SEQ ID NO: 698682 - protein, 9 aa, Homo Sapiens
TLHYALLGR

SEQ ID NO: 698683 - protein, 9 aa, Homo Sapiens
SPPGFCRKA

SEQ ID NO: 698684 - protein, 9 aa, Homo Sapiens
EPGKEYEYP

SEQ ID NO: 698685 - protein, 9 aa, Homo Sapiens
GSMVCHLAS

SEQ ID NO: 698686 - protein, 9 aa, Homo Sapiens
CWKACCCEC

SEQ ID NO: 698687 - protein, 9 aa, Homo Sapiens
LSIKPKGKR

SEQ ID NO: 698688 - protein, 9 aa, Homo Sapiens
PPSSPQPCG

SEQ ID NO: 698689 - protein, 9 aa, Homo Sapiens
SWTGFEATL

SEQ ID NO: 698690 - protein, 9 aa, Homo Sapiens
FHIFSMLVA

SEQ ID NO: 698691 - protein, 9 aa, Homo Sapiens
AEFPPDTRN

SEQ ID NO: 698692 - protein, 9 aa, Homo Sapiens
CRKARGFGL

SEQ ID NO: 698693 - protein, 9 aa, Homo Sapiens
LGLGCVLIQ

SEQ ID NO: 698694 - protein, 9 aa, Homo Sapiens
GSEESQEAT

SEQ ID NO: 698695 - protein, 9 aa, Homo Sapiens
AAAAPNPGL

SEQ ID NO: 698696 - protein, 9 aa, Homo Sapiens
ALKGKPHYR

SEQ ID NO: 698697 - protein, 9 aa, Homo Sapiens
SMVCHLASI

SEQ ID NO: 698698 - protein, 9 aa, Homo Sapiens
KEYVTSNES

SEQ ID NO: 698699 - protein, 9 aa, Homo Sapiens
RIADSKEPV

SEQ ID NO: 698700 - protein, 9 aa, Homo Sapiens
AAPNPGLRS

SEQ ID NO: 698701 - protein, 9 aa, Homo Sapiens
PRQPCPHAA

SEQ ID NO: 698702 - protein, 9 aa, Homo Sapiens
NEAIVPSVC

SEQ ID NO: 698703 - protein, 9 aa, Homo Sapiens
LYESSKCWK

SEQ ID NO: 698704 - protein, 9 aa, Homo Sapiens
PPSTREAEV

SEQ ID NO: 698705 - protein, 9 aa, Homo Sapiens
RVPSKPCLL

SEQ ID NO: 698706 - protein, 9 aa, Homo Sapiens
HRIIPHTFC

SEQ ID NO: 698707 - protein, 9 aa, Homo Sapiens
VKLRLRLVE

SEQ ID NO: 698708 - protein, 9 aa, Homo Sapiens
PEPGRQEQL

SEQ ID NO: 698709 - protein, 9 aa, Homo Sapiens
WKKEKKSAK

SEQ ID NO: 698710 - protein, 9 aa, Homo Sapiens
PLNCEWVIE

SEQ ID NO: 698711 - protein, 9 aa, Homo Sapiens
GVAPEPLSA

SEQ ID NO: 698712 - protein, 9 aa, Homo Sapiens
FTSATVTKM

SEQ ID NO: 698713 - protein, 9 aa, Homo Sapiens
SATVTKMIV

SEQ ID NO: 698714 - protein, 9 aa, Homo Sapiens
RFANKDKQE

SEQ ID NO: 698715 - protein, 9 aa, Homo Sapiens
PSSPQPCGA

SEQ ID NO: 698716 - protein, 9 aa, Homo Sapiens
GATLVGPQG

SEQ ID NO: 698717 - protein, 9 aa, Homo Sapiens
HLLHVSECM

SEQ ID NO: 698718 - protein, 9 aa, Homo Sapiens
HDKEFFHPL

SEQ ID NO: 698719 - protein, 9 aa, Homo Sapiens
ALDPDGKLL

SEQ ID NO: 698720 - protein, 9 aa, Homo Sapiens
TDPMLQTDE

SEQ ID NO: 698721 - protein, 9 aa, Homo Sapiens
IYVWLFSSY

SEQ ID NO: 698722 - protein, 9 aa, Homo Sapiens
YGAFRCKLC

SEQ ID NO: 698723 - protein, 9 aa, Homo Sapiens
GTPADFILK

SEQ ID NO: 698724 - protein, 9 aa, Homo Sapiens
ALTLKYAEE

SEQ ID NO: 698725 - protein, 9 aa, Homo Sapiens
DREKCAEEI

SEQ ID NO: 698726 - protein, 9 aa, Homo Sapiens
FVNTNRRQC

SEQ ID NO: 698727 - protein, 9 aa, Homo Sapiens
NPPAGIALK

SEQ ID NO: 698728 - protein, 9 aa, Homo Sapiens
LGVVRNFQI

SEQ ID NO: 698729 - protein, 9 aa, Homo Sapiens
KEPKEANST

SEQ ID NO: 698730 - protein, 9 aa, Homo Sapiens
VGTSRSSHE

SEQ ID NO: 698731 - protein, 9 aa, Homo Sapiens
SPEDIVENV

SEQ ID NO: 698732 - protein, 9 aa, Homo Sapiens
TGLLMTALG

SEQ ID NO: 698733 - protein, 9 aa, Homo Sapiens
VTSYQNHKT

SEQ ID NO: 698734 - protein, 9 aa, Homo Sapiens
LVVAKGGTA

SEQ ID NO: 698735 - protein, 9 aa, Homo Sapiens
LSSWKQATS

SEQ ID NO: 698736 - protein, 9 aa, Homo Sapiens
LMNTLMYVL

SEQ ID NO: 698737 - protein, 9 aa, Homo Sapiens
LAAMNTTTK

SEQ ID NO: 698738 - protein, 9 aa, Homo Sapiens
RHGLLLPNA

SEQ ID NO: 698739 - protein, 9 aa, Homo Sapiens
NIIAFCVDK

SEQ ID NO: 698740 - protein, 9 aa, Homo Sapiens
INEFGIFNS

SEQ ID NO: 698741 - protein, 9 aa, Homo Sapiens
QTLACSLSK

SEQ ID NO: 698742 - protein, 9 aa, Homo Sapiens
RPPILLALL

SEQ ID NO: 698743 - protein, 9 aa, Homo Sapiens
DLPEPGKEY

SEQ ID NO: 698744 - protein, 9 aa, Homo Sapiens
MNKVQVDAR

SEQ ID NO: 698745 - protein, 9 aa, Homo Sapiens
ERIADSKEP

SEQ ID NO: 698746 - protein, 9 aa, Homo Sapiens
EEFNGKKII

SEQ ID NO: 698747 - protein, 9 aa, Homo Sapiens
EAGTEGGAG

SEQ ID NO: 698748 - protein, 9 aa, Homo Sapiens
KARLGGYEE

SEQ ID NO: 698749 - protein, 9 aa, Homo Sapiens
VFYVITVVW

SEQ ID NO: 698750 - protein, 9 aa, Homo Sapiens
GALGAAEPF

SEQ ID NO: 698751 - protein, 9 aa, Homo Sapiens
PRPPILLAL

SEQ ID NO: 698752 - protein, 9 aa, Homo Sapiens
NRRQCHESE

SEQ ID NO: 698753 - protein, 9 aa, Homo Sapiens
ITNCRLSEV

SEQ ID NO: 698754 - protein, 9 aa, Homo Sapiens
LPSQGTKPA

SEQ ID NO: 698755 - protein, 9 aa, Homo Sapiens
WRPSLQYIR

SEQ ID NO: 698756 - protein, 9 aa, Homo Sapiens
QDSHCSVTP

SEQ ID NO: 698757 - protein, 9 aa, Homo Sapiens
NLTIIHLQH

SEQ ID NO: 698758 - protein, 9 aa, Homo Sapiens
HGHLHASTT

SEQ ID NO: 698759 - protein, 9 aa, Homo Sapiens
TERTLDREH

SEQ ID NO: 698760 - protein, 9 aa, Homo Sapiens
GCTMESLLK

SEQ ID NO: 698761 - protein, 9 aa, Homo Sapiens
PVLSILICR

SEQ ID NO: 698762 - protein, 9 aa, Homo Sapiens
LLLVPHLQI

SEQ ID NO: 698763 - protein, 9 aa, Homo Sapiens
VEGETLAGM

SEQ ID NO: 698764 - protein, 9 aa, Homo Sapiens
VDVSEEHGE

SEQ ID NO: 698765 - protein, 9 aa, Homo Sapiens
EVAFACAAT

SEQ ID NO: 698766 - protein, 9 aa, Homo Sapiens
VCSTPKCPE

SEQ ID NO: 698767 - protein, 9 aa, Homo Sapiens
VTTGDTTPL

SEQ ID NO: 698768 - protein, 9 aa, Homo Sapiens
SDKHGFTLT

SEQ ID NO: 698769 - protein, 9 aa, Homo Sapiens
LSILICRDQ

SEQ ID NO: 698770 - protein, 9 aa, Homo Sapiens
RKEKYSTYA

SEQ ID NO: 698771 - protein, 9 aa, Homo Sapiens
SVGDVMAIG

SEQ ID NO: 698772 - protein, 9 aa, Homo Sapiens
SCSPGSALG

SEQ ID NO: 698773 - protein, 9 aa, Homo Sapiens
CTGWNNTQG

SEQ ID NO: 698774 - protein, 9 aa, Homo Sapiens
LDLGGAPEY

SEQ ID NO: 698775 - protein, 9 aa, Homo Sapiens
KSAHVDGSI

SEQ ID NO: 698776 - protein, 9 aa, Homo Sapiens
CPSGYYGHL

SEQ ID NO: 698777 - protein, 9 aa, Homo Sapiens
ESEFSGNIK

SEQ ID NO: 698778 - protein, 9 aa, Homo Sapiens
WDGNSEVAE

SEQ ID NO: 698779 - protein, 9 aa, Homo Sapiens
EITLHYALL

SEQ ID NO: 698780 - protein, 9 aa, Homo Sapiens
VLIQKRGKL

SEQ ID NO: 698781 - protein, 9 aa, Homo Sapiens
RKVQLVLFV

SEQ ID NO: 698782 - protein, 9 aa, Homo Sapiens
NSLPSDLLE

SEQ ID NO: 698783 - protein, 9 aa, Homo Sapiens
PGDRLRGMV

SEQ ID NO: 698784 - protein, 9 aa, Homo Sapiens
WPPSFSAPC

SEQ ID NO: 698785 - protein, 9 aa, Homo Sapiens
EACYEYKIN

SEQ ID NO: 698786 - protein, 9 aa, Homo Sapiens
RGMVSRLFP

SEQ ID NO: 698787 - protein, 9 aa, Homo Sapiens
VEKAVSSIL

SEQ ID NO: 698788 - protein, 9 aa, Homo Sapiens
CKCQECGKA

SEQ ID NO: 698789 - protein, 9 aa, Homo Sapiens
QPLPAPPDD

SEQ ID NO: 698790 - protein, 9 aa, Homo Sapiens
LYYTDDQYE

SEQ ID NO: 698791 - protein, 9 aa, Homo Sapiens
PILLFLAGY

SEQ ID NO: 698792 - protein, 9 aa, Homo Sapiens
PGGQLAELH

SEQ ID NO: 698793 - protein, 9 aa, Homo Sapiens
TAASSAMTY

SEQ ID NO: 698794 - protein, 9 aa, Homo Sapiens
AGSMQRVPS

SEQ ID NO: 698795 - protein, 9 aa, Homo Sapiens
HSSIAIQCV

SEQ ID NO: 698796 - protein, 9 aa, Homo Sapiens
EMEIIGLFN

SEQ ID NO: 698797 - protein, 9 aa, Homo Sapiens
YMCNSSCMC

SEQ ID NO: 698798 - protein, 9 aa, Homo Sapiens
CNDSRWSLL

SEQ ID NO: 698799 - protein, 9 aa, Homo Sapiens
TAMVASLSP

SEQ ID NO: 698800 - protein, 9 aa, Homo Sapiens
TKQLTETDL

SEQ ID NO: 698801 - protein, 9 aa, Homo Sapiens
LVSKEATAP

SEQ ID NO: 698802 - protein, 9 aa, Homo Sapiens
NSEVIRPGF

SEQ ID NO: 698803 - protein, 9 aa, Homo Sapiens
KREIQVAIK

SEQ ID NO: 698804 - protein, 9 aa, Homo Sapiens
FQDHNIVTA

SEQ ID NO: 698805 - protein, 9 aa, Homo Sapiens
CGSQLTVVF

SEQ ID NO: 698806 - protein, 9 aa, Homo Sapiens
DEMLVDITE

SEQ ID NO: 698807 - protein, 9 aa, Homo Sapiens
APLGSPFPF

SEQ ID NO: 698808 - protein, 9 aa, Homo Sapiens
FMLQCTCQH

SEQ ID NO: 698809 - protein, 9 aa, Homo Sapiens
AAAVLGSRI

SEQ ID NO: 698810 - protein, 9 aa, Homo Sapiens
PSFSAPCCW

SEQ ID NO: 698811 - protein, 9 aa, Homo Sapiens
VKGVDETGD

SEQ ID NO: 698812 - protein, 9 aa, Homo Sapiens
TNKFSHNWK

SEQ ID NO: 698813 - protein, 9 aa, Homo Sapiens
PSAQPAEVL

SEQ ID NO: 698814 - protein, 9 aa, Homo Sapiens
GSPASSLAR

SEQ ID NO: 698815 - protein, 9 aa, Homo Sapiens
LPSVTDASS

SEQ ID NO: 698816 - protein, 9 aa, Homo Sapiens
PPVFPNVPF

SEQ ID NO: 698817 - protein, 9 aa, Homo Sapiens
MSMKSFQPE

SEQ ID NO: 698818 - protein, 9 aa, Homo Sapiens
HQKTHSGMK

SEQ ID NO: 698819 - protein, 9 aa, Homo Sapiens
MWEAFSYVQ

SEQ ID NO: 698820 - protein, 9 aa, Homo Sapiens
ETRSRNEFL

SEQ ID NO: 698821 - protein, 9 aa, Homo Sapiens
YFYVNTIPD

SEQ ID NO: 698822 - protein, 9 aa, Homo Sapiens
HQKKVTPQD

SEQ ID NO: 698823 - protein, 9 aa, Homo Sapiens
LHHTIIMSR

SEQ ID NO: 698824 - protein, 9 aa, Homo Sapiens
PLPAPPDDG

SEQ ID NO: 698825 - protein, 9 aa, Homo Sapiens
DVAVSVGGL

SEQ ID NO: 698826 - protein, 9 aa, Homo Sapiens
PGMRSQEMT

SEQ ID NO: 698827 - protein, 9 aa, Homo Sapiens
AVIVGCLCY

SEQ ID NO: 698828 - protein, 9 aa, Homo Sapiens
CVTRSQEEL

SEQ ID NO: 698829 - protein, 9 aa, Homo Sapiens
EMLDPAGTR

SEQ ID NO: 698830 - protein, 9 aa, Homo Sapiens
TGQFCLIQT

SEQ ID NO: 698831 - protein, 9 aa, Homo Sapiens
IPILLFLAG

SEQ ID NO: 698832 - protein, 9 aa, Homo Sapiens
INDLGSIFG

SEQ ID NO: 698833 - protein, 9 aa, Homo Sapiens
IALGLGLMF

SEQ ID NO: 698834 - protein, 9 aa, Homo Sapiens
AIFYTVITP

SEQ ID NO: 698835 - protein, 9 aa, Homo Sapiens
AVSSILSRT

SEQ ID NO: 698836 - protein, 9 aa, Homo Sapiens
GLACVLSLL

SEQ ID NO: 698837 - protein, 9 aa, Homo Sapiens
ARPRVPEIE

SEQ ID NO: 698838 - protein, 9 aa, Homo Sapiens
LQPTRIRFL

SEQ ID NO: 698839 - protein, 9 aa, Homo Sapiens
LGSRIFIMG

SEQ ID NO: 698840 - protein, 9 aa, Homo Sapiens
KRQFKNSSY

SEQ ID NO: 698841 - protein, 9 aa, Homo Sapiens
VELLLPEDS

SEQ ID NO: 698842 - protein, 9 aa, Homo Sapiens
EAFSYVQKP

SEQ ID NO: 698843 - protein, 9 aa, Homo Sapiens
MCGMNRRPI

SEQ ID NO: 698844 - protein, 9 aa, Homo Sapiens
LSPPPGHTT

SEQ ID NO: 698845 - protein, 9 aa, Homo Sapiens
SPKGSPASS

SEQ ID NO: 698846 - protein, 9 aa, Homo Sapiens
QRYPPSYKA

SEQ ID NO: 698847 - protein, 9 aa, Homo Sapiens
GTAASSAMT

SEQ ID NO: 698848 - protein, 9 aa, Homo Sapiens
STFDIKSMA

SEQ ID NO: 698849 - protein, 9 aa, Homo Sapiens
RSEEDEWAV

SEQ ID NO: 698850 - protein, 9 aa, Homo Sapiens
LYLDECQSQ

SEQ ID NO: 698851 - protein, 9 aa, Homo Sapiens
LYQKYLSSA

SEQ ID NO: 698852 - protein, 9 aa, Homo Sapiens
LCRSVLRWL

SEQ ID NO: 698853 - protein, 9 aa, Homo Sapiens
SDLKTSTED

SEQ ID NO: 698854 - protein, 9 aa, Homo Sapiens
NPPLSSTSN

SEQ ID NO: 698855 - protein, 9 aa, Homo Sapiens
EEMLGEIVP

SEQ ID NO: 698856 - protein, 9 aa, Homo Sapiens
RLSLSCVEL

SEQ ID NO: 698857 - protein, 9 aa, Homo Sapiens
YQESNTSRN

SEQ ID NO: 698858 - protein, 9 aa, Homo Sapiens
EVSGHSKST

SEQ ID NO: 698859 - protein, 9 aa, Homo Sapiens
QADPTLAEI

SEQ ID NO: 698860 - protein, 9 aa, Homo Sapiens
PVCQGPSSP

SEQ ID NO: 698861 - protein, 9 aa, Homo Sapiens
NFRAPPVFP

SEQ ID NO: 698862 - protein, 9 aa, Homo Sapiens
MKSFQPEEN

SEQ ID NO: 698863 - protein, 9 aa, Homo Sapiens
DNRLPPKKL

SEQ ID NO: 698864 - protein, 9 aa, Homo Sapiens
GSPFPFPGP

SEQ ID NO: 698865 - protein, 9 aa, Homo Sapiens
PYESRAFAL

SEQ ID NO: 698866 - protein, 9 aa, Homo Sapiens
WDSPLVDDP

SEQ ID NO: 698867 - protein, 9 aa, Homo Sapiens
VFGRSENLK

SEQ ID NO: 698868 - protein, 9 aa, Homo Sapiens
VLGSRIFIM

SEQ ID NO: 698869 - protein, 9 aa, Homo Sapiens
AAIYRAFEG

SEQ ID NO: 698870 - protein, 9 aa, Homo Sapiens
CYDFWSNAG

SEQ ID NO: 698871 - protein, 9 aa, Homo Sapiens
RSLSRSRRE

SEQ ID NO: 698872 - protein, 9 aa, Homo Sapiens
PPTEDFPEP

SEQ ID NO: 698873 - protein, 9 aa, Homo Sapiens
DQASHCELR

SEQ ID NO: 698874 - protein, 9 aa, Homo Sapiens
VKDVELLLP

SEQ ID NO: 698875 - protein, 9 aa, Homo Sapiens
SQLTAIILF

SEQ ID NO: 698876 - protein, 9 aa, Homo Sapiens
AVSVGGLPC

SEQ ID NO: 698877 - protein, 9 aa, Homo Sapiens
QSKFRHLFG

SEQ ID NO: 698878 - protein, 9 aa, Homo Sapiens
DPHSPFATK

SEQ ID NO: 698879 - protein, 9 aa, Homo Sapiens
TPEIQASSF

SEQ ID NO: 698880 - protein, 9 aa, Homo Sapiens
AETQHFFLC

SEQ ID NO: 698881 - protein, 9 aa, Homo Sapiens
IYRAFEGVS

SEQ ID NO: 698882 - protein, 9 aa, Homo Sapiens
LQERGGVAT

SEQ ID NO: 698883 - protein, 9 aa, Homo Sapiens
AYHEACHAV

SEQ ID NO: 698884 - protein, 9 aa, Homo Sapiens
VKKKITERS

SEQ ID NO: 698885 - protein, 9 aa, Homo Sapiens
YRSQAPVLN

SEQ ID NO: 698886 - protein, 9 aa, Homo Sapiens
NISSLLPKP

SEQ ID NO: 698887 - protein, 9 aa, Homo Sapiens
VSHEKKLVI

SEQ ID NO: 698888 - protein, 9 aa, Homo Sapiens
LACVLSLLN

SEQ ID NO: 698889 - protein, 9 aa, Homo Sapiens
SMTSGNWLT

SEQ ID NO: 698890 - protein, 9 aa, Homo Sapiens
ADLPQPSAG

SEQ ID NO: 698891 - protein, 9 aa, Homo Sapiens
LVYFSDVKP

SEQ ID NO: 698892 - protein, 9 aa, Homo Sapiens
SLSRSRRER

SEQ ID NO: 698893 - protein, 9 aa, Homo Sapiens
SVAGGTSSN

SEQ ID NO: 698894 - protein, 9 aa, Homo Sapiens
RNDLQANSL

SEQ ID NO: 698895 - protein, 9 aa, Homo Sapiens
CYKICPTSF

SEQ ID NO: 698896 - protein, 9 aa, Homo Sapiens
FINNGSPTI

SEQ ID NO: 698897 - protein, 9 aa, Homo Sapiens
RKTYVQSAD

SEQ ID NO: 698898 - protein, 9 aa, Homo Sapiens
PSAGSMQRV

SEQ ID NO: 698899 - protein, 9 aa, Homo Sapiens
RTGTSMTSG

SEQ ID NO: 698900 - protein, 9 aa, Homo Sapiens
TYYTLTIKT

SEQ ID NO: 698901 - protein, 9 aa, Homo Sapiens
AWMAALVEA

SEQ ID NO: 698902 - protein, 9 aa, Homo Sapiens
FATKQETPE

SEQ ID NO: 698903 - protein, 9 aa, Homo Sapiens
AHCVWPCVP

SEQ ID NO: 698904 - protein, 9 aa, Homo Sapiens
LSCYDFWSN

SEQ ID NO: 698905 - protein, 9 aa, Homo Sapiens
NEAAWMAAL

SEQ ID NO: 698906 - protein, 9 aa, Homo Sapiens
QKLTLEERT

SEQ ID NO: 698907 - protein, 9 aa, Homo Sapiens
WEPLDFEAR

SEQ ID NO: 698908 - protein, 9 aa, Homo Sapiens
GSQLTVVFL

SEQ ID NO: 698909 - protein, 9 aa, Homo Sapiens
FWKKKSMIG

SEQ ID NO: 698910 - protein, 9 aa, Homo Sapiens
SCIHGGICT

SEQ ID NO: 698911 - protein, 9 aa, Homo Sapiens
PPYKRRNSE

SEQ ID NO: 698912 - protein, 9 aa, Homo Sapiens
EIPRQLVYI

SEQ ID NO: 698913 - protein, 9 aa, Homo Sapiens
SFANVSINM

SEQ ID NO: 698914 - protein, 9 aa, Homo Sapiens
SLLNTVSGI

SEQ ID NO: 698915 - protein, 9 aa, Homo Sapiens
SAGVPCAQA

SEQ ID NO: 698916 - protein, 9 aa, Homo Sapiens
HGGICTAIK

SEQ ID NO: 698917 - protein, 9 aa, Homo Sapiens
DREAASSAF

SEQ ID NO: 698918 - protein, 9 aa, Homo Sapiens
LVDITEENT

SEQ ID NO: 698919 - protein, 9 aa, Homo Sapiens
QWIPPPYKR

SEQ ID NO: 698920 - protein, 9 aa, Homo Sapiens
GADLDFVMS

SEQ ID NO: 698921 - protein, 9 aa, Homo Sapiens
LSRKEQERA

SEQ ID NO: 698922 - protein, 9 aa, Homo Sapiens
FMDNPKLEI

SEQ ID NO: 698923 - protein, 9 aa, Homo Sapiens
CSLAGLQEL

SEQ ID NO: 698924 - protein, 9 aa, Homo Sapiens
PTIYQKAVS

SEQ ID NO: 698925 - protein, 9 aa, Homo Sapiens
KGSLMSHQR

SEQ ID NO: 698926 - protein, 9 aa, Homo Sapiens
FNILCVRET

SEQ ID NO: 698927 - protein, 9 aa, Homo Sapiens
LIQTLKKGQ

SEQ ID NO: 698928 - protein, 9 aa, Homo Sapiens
NTTAHHEFY

SEQ ID NO: 698929 - protein, 9 aa, Homo Sapiens
KDTGVKKLP

SEQ ID NO: 698930 - protein, 9 aa, Homo Sapiens
RAPPVFPNV

SEQ ID NO: 698931 - protein, 9 aa, Homo Sapiens
DELLGTSQA

SEQ ID NO: 698932 - protein, 9 aa, Homo Sapiens
IVIAQAHGY

SEQ ID NO: 698933 - protein, 9 aa, Homo Sapiens
FSRSSSSNA

SEQ ID NO: 698934 - protein, 9 aa, Homo Sapiens
SEKEASLLN

SEQ ID NO: 698935 - protein, 9 aa, Homo Sapiens
LNLKEHASS

SEQ ID NO: 698936 - protein, 9 aa, Homo Sapiens
MLKDRWGTM

SEQ ID NO: 698937 - protein, 9 aa, Homo Sapiens
NFMYVFTWS

SEQ ID NO: 698938 - protein, 9 aa, Homo Sapiens
RGGVATPGR

SEQ ID NO: 698939 - protein, 9 aa, Homo Sapiens
KQEIPRQLV

SEQ ID NO: 698940 - protein, 9 aa, Homo Sapiens
KDGKNCQVF

SEQ ID NO: 698941 - protein, 9 aa, Homo Sapiens
AYRDTCDSD

SEQ ID NO: 698942 - protein, 9 aa, Homo Sapiens
AQEKVAQLQ

SEQ ID NO: 698943 - protein, 9 aa, Homo Sapiens
QPSAGVPCA

SEQ ID NO: 698944 - protein, 9 aa, Homo Sapiens
TQNMAQEKV

SEQ ID NO: 698945 - protein, 9 aa, Homo Sapiens
FFFGLFGVA

SEQ ID NO: 698946 - protein, 9 aa, Homo Sapiens
CSESHAANS

SEQ ID NO: 698947 - protein, 9 aa, Homo Sapiens
SARPRVPEI

SEQ ID NO: 698948 - protein, 9 aa, Homo Sapiens
AFSSLGHVY

SEQ ID NO: 698949 - protein, 9 aa, Homo Sapiens
FFHSHLSFV

SEQ ID NO: 698950 - protein, 9 aa, Homo Sapiens
ASSAGPSDH

SEQ ID NO: 698951 - protein, 9 aa, Homo Sapiens
LEALTSLAE

SEQ ID NO: 698952 - protein, 9 aa, Homo Sapiens
SSPSAQPAE

SEQ ID NO: 698953 - protein, 9 aa, Homo Sapiens
VLSLLNTVS

SEQ ID NO: 698954 - protein, 9 aa, Homo Sapiens
SEILQAPVT

SEQ ID NO: 698955 - protein, 9 aa, Homo Sapiens
LPSINDLGS

SEQ ID NO: 698956 - protein, 9 aa, Homo Sapiens
EEIMLPFSH

SEQ ID NO: 698957 - protein, 9 aa, Homo Sapiens
APPVFPNVP

SEQ ID NO: 698958 - protein, 9 aa, Homo Sapiens
KNDDKNSQT

SEQ ID NO: 698959 - protein, 9 aa, Homo Sapiens
IAYWVPRNS

SEQ ID NO: 698960 - protein, 9 aa, Homo Sapiens
AMMASYFLL

SEQ ID NO: 698961 - protein, 9 aa, Homo Sapiens
QEKVAQLQV

SEQ ID NO: 698962 - protein, 9 aa, Homo Sapiens
GTPENKCFC

SEQ ID NO: 698963 - protein, 9 aa, Homo Sapiens
ISSLLPKPQ

SEQ ID NO: 698964 - protein, 9 aa, Homo Sapiens
APPGTPVKQ

SEQ ID NO: 698965 - protein, 9 aa, Homo Sapiens
ANLVLSNFS

SEQ ID NO: 698966 - protein, 9 aa, Homo Sapiens
AIQPGGSKE

SEQ ID NO: 698967 - protein, 9 aa, Homo Sapiens
TFCTMRCPP

SEQ ID NO: 698968 - protein, 9 aa, Homo Sapiens
GEQRAVGVA

SEQ ID NO: 698969 - protein, 9 aa, Homo Sapiens
SFQPEENEI

SEQ ID NO: 698970 - protein, 9 aa, Homo Sapiens
GMRSQEMTK

SEQ ID NO: 698971 - protein, 9 aa, Homo Sapiens
RGGCFFGCA

SEQ ID NO: 698972 - protein, 9 aa, Homo Sapiens
RLIGPLLIC

SEQ ID NO: 698973 - protein, 9 aa, Homo Sapiens
ILMSMKSFQ

SEQ ID NO: 698974 - protein, 9 aa, Homo Sapiens
SATDLLSVA

SEQ ID NO: 698975 - protein, 9 aa, Homo Sapiens
FFGLFGVAD

SEQ ID NO: 698976 - protein, 9 aa, Homo Sapiens
TGLSQTRKV

SEQ ID NO: 698977 - protein, 9 aa, Homo Sapiens
AAGGGRLGR

SEQ ID NO: 698978 - protein, 9 aa, Homo Sapiens
GLSQTRKVQ

SEQ ID NO: 698979 - protein, 9 aa, Homo Sapiens
NSKGKRLLL

SEQ ID NO: 698980 - protein, 9 aa, Homo Sapiens
WSFFDAFRK

SEQ ID NO: 698981 - protein, 9 aa, Homo Sapiens
LERLSLSCV

SEQ ID NO: 698982 - protein, 9 aa, Homo Sapiens
GKRLLLYIG

SEQ ID NO: 698983 - protein, 9 aa, Homo Sapiens
AVNLDADDP

SEQ ID NO: 698984 - protein, 9 aa, Homo Sapiens
AISIAGLHW

SEQ ID NO: 698985 - protein, 9 aa, Homo Sapiens
YKSMYYGRT

SEQ ID NO: 698986 - protein, 9 aa, Homo Sapiens
GAGVQIAIM

SEQ ID NO: 698987 - protein, 9 aa, Homo Sapiens
NMAQEKVAQ

SEQ ID NO: 698988 - protein, 9 aa, Homo Sapiens
EGYGIEDDE

SEQ ID NO: 698989 - protein, 9 aa, Homo Sapiens
RYITVHKEL

SEQ ID NO: 698990 - protein, 9 aa, Homo Sapiens
PAPGLACGD

SEQ ID NO: 698991 - protein, 9 aa, Homo Sapiens
ILGADLDFV

SEQ ID NO: 698992 - protein, 9 aa, Homo Sapiens
QPQTNVSEL

SEQ ID NO: 698993 - protein, 9 aa, Homo Sapiens
ALTSLAEQC

SEQ ID NO: 698994 - protein, 9 aa, Homo Sapiens
TSQYPCLQV

SEQ ID NO: 698995 - protein, 9 aa, Homo Sapiens
ILMGFMDNP

SEQ ID NO: 698996 - protein, 9 aa, Homo Sapiens
PQNTLSWMQ

SEQ ID NO: 698997 - protein, 9 aa, Homo Sapiens
TPGRPWPPS

SEQ ID NO: 698998 - protein, 9 aa, Homo Sapiens
SSACFSLRV

SEQ ID NO: 698999 - protein, 9 aa, Homo Sapiens
DFHHRQEAL

SEQ ID NO: 699000 - protein, 9 aa, Homo Sapiens
GTRCQLYLD

SEQ ID NO: 699001 - protein, 9 aa, Homo Sapiens
LWCEKEVQV

SEQ ID NO: 699002 - protein, 9 aa, Homo Sapiens
VELEPVNVQ

SEQ ID NO: 699003 - protein, 9 aa, Homo Sapiens
FIAKSEACN

SEQ ID NO: 699004 - protein, 9 aa, Homo Sapiens
IGRGAQYCP

SEQ ID NO: 699005 - protein, 9 aa, Homo Sapiens
QSQTFNRET

SEQ ID NO: 699006 - protein, 9 aa, Homo Sapiens
MVITIGVIL

SEQ ID NO: 699007 - protein, 9 aa, Homo Sapiens
AQAAEEDVL

SEQ ID NO: 699008 - protein, 9 aa, Homo Sapiens
SRSSSSNAS

SEQ ID NO: 699009 - protein, 9 aa, Homo Sapiens
QKGSLMSHQ

SEQ ID NO: 699010 - protein, 9 aa, Homo Sapiens
NPIESSILS

SEQ ID NO: 699011 - protein, 9 aa, Homo Sapiens
DTREDYIEF

SEQ ID NO: 699012 - protein, 9 aa, Homo Sapiens
GRINTCQSL

SEQ ID NO: 699013 - protein, 9 aa, Homo Sapiens
LWDSPLVDD

SEQ ID NO: 699014 - protein, 9 aa, Homo Sapiens
SSADRDQIA

SEQ ID NO: 699015 - protein, 9 aa, Homo Sapiens
TSMTSGNWL

SEQ ID NO: 699016 - protein, 9 aa, Homo Sapiens
ADLDFVMSL

SEQ ID NO: 699017 - protein, 9 aa, Homo Sapiens
VGGLPCSFS

SEQ ID NO: 699018 - protein, 9 aa, Homo Sapiens
PSAGVPCAQ

SEQ ID NO: 699019 - protein, 9 aa, Homo Sapiens
EEDVLELHC

SEQ ID NO: 699020 - protein, 9 aa, Homo Sapiens
ITERSVTVG

SEQ ID NO: 699021 - protein, 9 aa, Homo Sapiens
SCSESHAAN

SEQ ID NO: 699022 - protein, 9 aa, Homo Sapiens
PGINIRNGI

SEQ ID NO: 699023 - protein, 9 aa, Homo Sapiens
GLACGDRPP

SEQ ID NO: 699024 - protein, 9 aa, Homo Sapiens
TPPKDGKNC

SEQ ID NO: 699025 - protein, 9 aa, Homo Sapiens
YHTEKGITV

SEQ ID NO: 699026 - protein, 9 aa, Homo Sapiens
YLDECQSQP

SEQ ID NO: 699027 - protein, 9 aa, Homo Sapiens
CAILENYHT

SEQ ID NO: 699028 - protein, 9 aa, Homo Sapiens
SSNASAPGT

SEQ ID NO: 699029 - protein, 9 aa, Homo Sapiens
VFQPQKNVV

SEQ ID NO: 699030 - protein, 9 aa, Homo Sapiens
FAKTFLICN

SEQ ID NO: 699031 - protein, 9 aa, Homo Sapiens
KKMSAKKAK

SEQ ID NO: 699032 - protein, 9 aa, Homo Sapiens
PFTTPSPAP

SEQ ID NO: 699033 - protein, 9 aa, Homo Sapiens
CANLAIYIY

SEQ ID NO: 699034 - protein, 9 aa, Homo Sapiens
PETGLITVW

SEQ ID NO: 699035 - protein, 9 aa, Homo Sapiens
GWAQNVNND

SEQ ID NO: 699036 - protein, 9 aa, Homo Sapiens
DEGTASIEV

SEQ ID NO: 699037 - protein, 9 aa, Homo Sapiens
SQEMTKILS

SEQ ID NO: 699038 - protein, 9 aa, Homo Sapiens
LASNKTLAI

SEQ ID NO: 699039 - protein, 9 aa, Homo Sapiens
TLEEIMLPF

SEQ ID NO: 699040 - protein, 9 aa, Homo Sapiens
KEPYSSSKS

SEQ ID NO: 699041 - protein, 9 aa, Homo Sapiens
FLNVHVPRL

SEQ ID NO: 699042 - protein, 9 aa, Homo Sapiens
YFSDVKPQH

SEQ ID NO: 699043 - protein, 9 aa, Homo Sapiens
TGDVFRATY

SEQ ID NO: 699044 - protein, 9 aa, Homo Sapiens
RRERSWRLQ

SEQ ID NO: 699045 - protein, 9 aa, Homo Sapiens
GCAVAPWKH

SEQ ID NO: 699046 - protein, 9 aa, Homo Sapiens
GGTSSNVGY

SEQ ID NO: 699047 - protein, 9 aa, Homo Sapiens
ASSLARPGT

SEQ ID NO: 699048 - protein, 9 aa, Homo Sapiens
MQRVPSGAA

SEQ ID NO: 699049 - protein, 9 aa, Homo Sapiens
RLLEYFRNN

SEQ ID NO: 699050 - protein, 9 aa, Homo Sapiens
KAKKRRRND

SEQ ID NO: 699051 - protein, 9 aa, Homo Sapiens
DPFDAQPLP

SEQ ID NO: 699052 - protein, 9 aa, Homo Sapiens
YWPMYVVRR

SEQ ID NO: 699053 - protein, 9 aa, Homo Sapiens
AEEDADERQ

SEQ ID NO: 699054 - protein, 9 aa, Homo Sapiens
SHAANSFLV

SEQ ID NO: 699055 - protein, 9 aa, Homo Sapiens
SGNWLTPNG

SEQ ID NO: 699056 - protein, 9 aa, Homo Sapiens
TDLRRTVEE

SEQ ID NO: 699057 - protein, 9 aa, Homo Sapiens
CVRETGIGK

SEQ ID NO: 699058 - protein, 9 aa, Homo Sapiens
QTNVSELVV

SEQ ID NO: 699059 - protein, 9 aa, Homo Sapiens
EQVKRYEGF

SEQ ID NO: 699060 - protein, 9 aa, Homo Sapiens
KEQVKRYEG

SEQ ID NO: 699061 - protein, 9 aa, Homo Sapiens
CKAFSRSST

SEQ ID NO: 699062 - protein, 9 aa, Homo Sapiens
ELEPVNVQA

SEQ ID NO: 699063 - protein, 9 aa, Homo Sapiens
APCCWRLWP

SEQ ID NO: 699064 - protein, 9 aa, Homo Sapiens
LIDVDIYVN

SEQ ID NO: 699065 - protein, 9 aa, Homo Sapiens
FSHEVLICK

SEQ ID NO: 699066 - protein, 9 aa, Homo Sapiens
GDRLRGMVS

SEQ ID NO: 699067 - protein, 9 aa, Homo Sapiens
DDQYEVIER

SEQ ID NO: 699068 - protein, 9 aa, Homo Sapiens
FFLCLNIRL

SEQ ID NO: 699069 - protein, 9 aa, Homo Sapiens
MPGAPSTLR

SEQ ID NO: 699070 - protein, 9 aa, Homo Sapiens
YPPGFSFAS

SEQ ID NO: 699071 - protein, 9 aa, Homo Sapiens
SNQELLGDH

SEQ ID NO: 699072 - protein, 9 aa, Homo Sapiens
GELAAHCVW

SEQ ID NO: 699073 - protein, 9 aa, Homo Sapiens
GIVPEPVQF

SEQ ID NO: 699074 - protein, 9 aa, Homo Sapiens
HEASCPVLT

SEQ ID NO: 699075 - protein, 9 aa, Homo Sapiens
HTIIMSRQK

SEQ ID NO: 699076 - protein, 9 aa, Homo Sapiens
FPPSAMTLS

SEQ ID NO: 699077 - protein, 9 aa, Homo Sapiens
GSPKGSPAS

SEQ ID NO: 699078 - protein, 9 aa, Homo Sapiens
TLAIFYTVI

SEQ ID NO: 699079 - protein, 9 aa, Homo Sapiens
LQDELLGTS

SEQ ID NO: 699080 - protein, 9 aa, Homo Sapiens
GCFFGCAVA

SEQ ID NO: 699081 - protein, 9 aa, Homo Sapiens
KKITERSVT

SEQ ID NO: 699082 - protein, 9 aa, Homo Sapiens
LSWILPAPP

SEQ ID NO: 699083 - protein, 9 aa, Homo Sapiens
VRQSKFRHL

SEQ ID NO: 699084 - protein, 9 aa, Homo Sapiens
NVNNDKVCL

SEQ ID NO: 699085 - protein, 9 aa, Homo Sapiens
VLPFASETL

SEQ ID NO: 699086 - protein, 9 aa, Homo Sapiens
PEIQASSFD

SEQ ID NO: 699087 - protein, 9 aa, Homo Sapiens
YQKYLSSAD

SEQ ID NO: 699088 - protein, 9 aa, Homo Sapiens
AANYFWPGS

SEQ ID NO: 699089 - protein, 9 aa, Homo Sapiens
APSVIFMDE

SEQ ID NO: 699090 - protein, 9 aa, Homo Sapiens
KTFLICNCS

SEQ ID NO: 699091 - protein, 9 aa, Homo Sapiens
SGFGHKSGT

SEQ ID NO: 699092 - protein, 9 aa, Homo Sapiens
PGAPSTLRV

SEQ ID NO: 699093 - protein, 9 aa, Homo Sapiens
TFLICNCSP

SEQ ID NO: 699094 - protein, 9 aa, Homo Sapiens
CTMRCPPGS

SEQ ID NO: 699095 - protein, 9 aa, Homo Sapiens
MTSSACFSL

SEQ ID NO: 699096 - protein, 9 aa, Homo Sapiens
HWLHLVILF

SEQ ID NO: 699097 - protein, 9 aa, Homo Sapiens
SAMMASYFL

SEQ ID NO: 699098 - protein, 9 aa, Homo Sapiens
LDLSRKEQE

SEQ ID NO: 699099 - protein, 9 aa, Homo Sapiens
TPAKVAPFI

SEQ ID NO: 699100 - protein, 9 aa, Homo Sapiens
PRKKRLQPS

SEQ ID NO: 699101 - protein, 9 aa, Homo Sapiens
SWILPAPPA

SEQ ID NO: 699102 - protein, 9 aa, Homo Sapiens
FGTNRNSIS

SEQ ID NO: 699103 - protein, 9 aa, Homo Sapiens
ESRAFALLG

SEQ ID NO: 699104 - protein, 9 aa, Homo Sapiens
LGSNLTLQE

SEQ ID NO: 699105 - protein, 9 aa, Homo Sapiens
IYFYVNTIP

SEQ ID NO: 699106 - protein, 9 aa, Homo Sapiens
LRRPRQSHA

SEQ ID NO: 699107 - protein, 9 aa, Homo Sapiens
VCCLSVMKD

SEQ ID NO: 699108 - protein, 9 aa, Homo Sapiens
AKVKCLTGE

SEQ ID NO: 699109 - protein, 9 aa, Homo Sapiens
TCFPPSAMT

SEQ ID NO: 699110 - protein, 9 aa, Homo Sapiens
GCWSQPRSL

SEQ ID NO: 699111 - protein, 9 aa, Homo Sapiens
SFGMVCIVQ

SEQ ID NO: 699112 - protein, 9 aa, Homo Sapiens
GDGCFPLPG

SEQ ID NO: 699113 - protein, 9 aa, Homo Sapiens
IDPLNFLPW

SEQ ID NO: 699114 - protein, 9 aa, Homo Sapiens
LISPSCLGT

SEQ ID NO: 699115 - protein, 9 aa, Homo Sapiens
AAVPSAGSM

SEQ ID NO: 699116 - protein, 9 aa, Homo Sapiens
ALGLLECVR

SEQ ID NO: 699117 - protein, 9 aa, Homo Sapiens
SHEKKLVIA

SEQ ID NO: 699118 - protein, 9 aa, Homo Sapiens
FPFPGPPSR

SEQ ID NO: 699119 - protein, 9 aa, Homo Sapiens
KGSFGMVCI

SEQ ID NO: 699120 - protein, 9 aa, Homo Sapiens
GDRFAYCAN

SEQ ID NO: 699121 - protein, 9 aa, Homo Sapiens
VYWKIYRAA

SEQ ID NO: 699122 - protein, 9 aa, Homo Sapiens
ESEGRYNAH

SEQ ID NO: 699123 - protein, 9 aa, Homo Sapiens
TTKDGYIIG

SEQ ID NO: 699124 - protein, 9 aa, Homo Sapiens
IYKSMYYGR

SEQ ID NO: 699125 - protein, 9 aa, Homo Sapiens
RETGIGKST

SEQ ID NO: 699126 - protein, 9 aa, Homo Sapiens
AEMEIIGLF

SEQ ID NO: 699127 - protein, 9 aa, Homo Sapiens
IKPTLIDVD

SEQ ID NO: 699128 - protein, 9 aa, Homo Sapiens
RGSYQDSLW

SEQ ID NO: 699129 - protein, 9 aa, Homo Sapiens
QVAIKTLKG

SEQ ID NO: 699130 - protein, 9 aa, Homo Sapiens
WTCFPPSAM

SEQ ID NO: 699131 - protein, 9 aa, Homo Sapiens
VALVLERLS

SEQ ID NO: 699132 - protein, 9 aa, Homo Sapiens
WKNRDITMQ

SEQ ID NO: 699133 - protein, 9 aa, Homo Sapiens
EVQVLLTTV

SEQ ID NO: 699134 - protein, 9 aa, Homo Sapiens
IHGHTVDLR

SEQ ID NO: 699135 - protein, 9 aa, Homo Sapiens
SLLNLKEHA

SEQ ID NO: 699136 - protein, 9 aa, Homo Sapiens
ITKSVIDYF

SEQ ID NO: 699137 - protein, 9 aa, Homo Sapiens
TKFQYLNYF

SEQ ID NO: 699138 - protein, 9 aa, Homo Sapiens
HSHLSFVDF

SEQ ID NO: 699139 - protein, 9 aa, Homo Sapiens
KPMKILMSM

SEQ ID NO: 699140 - protein, 9 aa, Homo Sapiens
QDSLWASIR

SEQ ID NO: 699141 - protein, 9 aa, Homo Sapiens
ERWQADPTL

SEQ ID NO: 699142 - protein, 9 aa, Homo Sapiens
VPDSMTSSA

SEQ ID NO: 699143 - protein, 9 aa, Homo Sapiens
VPSAGSMQR

SEQ ID NO: 699144 - protein, 9 aa, Homo Sapiens
TELCWVPLA

SEQ ID NO: 699145 - protein, 9 aa, Homo Sapiens
TIETSLKTE

SEQ ID NO: 699146 - protein, 9 aa, Homo Sapiens
KFVLWKDVK

SEQ ID NO: 699147 - protein, 9 aa, Homo Sapiens
MPPRKKRLQ

SEQ ID NO: 699148 - protein, 9 aa, Homo Sapiens
QERGGVATP

SEQ ID NO: 699149 - protein, 9 aa, Homo Sapiens
QVLHRQLSQ

SEQ ID NO: 699150 - protein, 9 aa, Homo Sapiens
VKNSMESGR

SEQ ID NO: 699151 - protein, 9 aa, Homo Sapiens
LPPAAAPPP

SEQ ID NO: 699152 - protein, 9 aa, Homo Sapiens
ASSAFSSLG

SEQ ID NO: 699153 - protein, 9 aa, Homo Sapiens
AVCCLSVMK

SEQ ID NO: 699154 - protein, 9 aa, Homo Sapiens
RCSSCNFKF

SEQ ID NO: 699155 - protein, 9 aa, Homo Sapiens
SRKTYVQSA

SEQ ID NO: 699156 - protein, 9 aa, Homo Sapiens
NVEDVQNRE

SEQ ID NO: 699157 - protein, 9 aa, Homo Sapiens
IKELIHMHG

SEQ ID NO: 699158 - protein, 9 aa, Homo Sapiens
ASVCGRCHT

SEQ ID NO: 699159 - protein, 9 aa, Homo Sapiens
MPIDALKDL

SEQ ID NO: 699160 - protein, 9 aa, Homo Sapiens
AEQCLKISA

SEQ ID NO: 699161 - protein, 9 aa, Homo Sapiens
FCTCGSQLT

SEQ ID NO: 699162 - protein, 9 aa, Homo Sapiens
YDFWSNAGS

SEQ ID NO: 699163 - protein, 9 aa, Homo Sapiens
LWASIRQRS

SEQ ID NO: 699164 - protein, 9 aa, Homo Sapiens
IEVNATEEM

SEQ ID NO: 699165 - protein, 9 aa, Homo Sapiens
QAEEDADER

SEQ ID NO: 699166 - protein, 9 aa, Homo Sapiens
DRLRGMVSR

SEQ ID NO: 699167 - protein, 9 aa, Homo Sapiens
TSRNNSEKL

SEQ ID NO: 699168 - protein, 9 aa, Homo Sapiens
QRPGPSLWL

SEQ ID NO: 699169 - protein, 9 aa, Homo Sapiens
ICPTSFWQQ

SEQ ID NO: 699170 - protein, 9 aa, Homo Sapiens
VIVGCLCYD

SEQ ID NO: 699171 - protein, 9 aa, Homo Sapiens
FKAFDHDSS

SEQ ID NO: 699172 - protein, 9 aa, Homo Sapiens
MLPFSHWTY

SEQ ID NO: 699173 - protein, 9 aa, Homo Sapiens
ERIYWADTR

SEQ ID NO: 699174 - protein, 9 aa, Homo Sapiens
GKPWGNQTI

SEQ ID NO: 699175 - protein, 9 aa, Homo Sapiens
WGTMKKLKL

SEQ ID NO: 699176 - protein, 9 aa, Homo Sapiens
FVADLPQPS

SEQ ID NO: 699177 - protein, 9 aa, Homo Sapiens
DEEHSSPLA

SEQ ID NO: 699178 - protein, 9 aa, Homo Sapiens
HSVDKKWNY

SEQ ID NO: 699179 - protein, 9 aa, Homo Sapiens
SRRERSWRL

SEQ ID NO: 699180 - protein, 9 aa, Homo Sapiens
CLEALTSLA

SEQ ID NO: 699181 - protein, 9 aa, Homo Sapiens
EFNQDTFMV

SEQ ID NO: 699182 - protein, 9 aa, Homo Sapiens
VVDCLPEFN

SEQ ID NO: 699183 - protein, 9 aa, Homo Sapiens
TDLNLLQAL

SEQ ID NO: 699184 - protein, 9 aa, Homo Sapiens
EGFLRKYPK

SEQ ID NO: 699185 - protein, 9 aa, Homo Sapiens
TERSVTVGK

SEQ ID NO: 699186 - protein, 9 aa, Homo Sapiens
PLSSTSNLT

SEQ ID NO: 699187 - protein, 9 aa, Homo Sapiens
PAPPTEDFP

SEQ ID NO: 699188 - protein, 9 aa, Homo Sapiens
IPTIKSAQG

SEQ ID NO: 699189 - protein, 9 aa, Homo Sapiens
ELPPAAAPP

SEQ ID NO: 699190 - protein, 9 aa, Homo Sapiens
SVTDASSAG

SEQ ID NO: 699191 - protein, 9 aa, Homo Sapiens
KSMDCVYGK

SEQ ID NO: 699192 - protein, 9 aa, Homo Sapiens
SAREVSGHS

SEQ ID NO: 699193 - protein, 9 aa, Homo Sapiens
KGTFSRSSS

SEQ ID NO: 699194 - protein, 9 aa, Homo Sapiens
PPSLPGAAI

SEQ ID NO: 699195 - protein, 9 aa, Homo Sapiens
LNLLQALRQ

SEQ ID NO: 699196 - protein, 9 aa, Homo Sapiens
SIPILLFLA

SEQ ID NO: 699197 - protein, 9 aa, Homo Sapiens
AEASVCGRC

SEQ ID NO: 699198 - protein, 9 aa, Homo Sapiens
VDLRSPAGA

SEQ ID NO: 699199 - protein, 9 aa, Homo Sapiens
NLTLQEFVL

SEQ ID NO: 699200 - protein, 9 aa, Homo Sapiens
FCLIQTLKK

SEQ ID NO: 699201 - protein, 9 aa, Homo Sapiens
YYGRTWVPF

SEQ ID NO: 699202 - protein, 9 aa, Homo Sapiens
LSSADRDQI

SEQ ID NO: 699203 - protein, 9 aa, Homo Sapiens
NFSQIIFAL

SEQ ID NO: 699204 - protein, 9 aa, Homo Sapiens
PYKRRNSEL

SEQ ID NO: 699205 - protein, 9 aa, Homo Sapiens
VRMGKRHLL

SEQ ID NO: 699206 - protein, 9 aa, Homo Sapiens
PPGHTTCRL

SEQ ID NO: 699207 - protein, 9 aa, Homo Sapiens
SSCNFKFES

SEQ ID NO: 699208 - protein, 9 aa, Homo Sapiens
TSTAWKNRD

SEQ ID NO: 699209 - protein, 9 aa, Homo Sapiens
LSQTRKVQL

SEQ ID NO: 699210 - protein, 9 aa, Homo Sapiens
PFSHWTYEY

SEQ ID NO: 699211 - protein, 9 aa, Homo Sapiens
TAHHEFYSF

SEQ ID NO: 699212 - protein, 9 aa, Homo Sapiens
SMNMKSTFD

SEQ ID NO: 699213 - protein, 9 aa, Homo Sapiens
SKGKRLLLY

SEQ ID NO: 699214 - protein, 9 aa, Homo Sapiens
WKHSSSRQR

SEQ ID NO: 699215 - protein, 9 aa, Homo Sapiens
KIRRLKGWI

SEQ ID NO: 699216 - protein, 9 aa, Homo Sapiens
MLGEIVPTI

SEQ ID NO: 699217 - protein, 9 aa, Homo Sapiens
INPELQTLA

SEQ ID NO: 699218 - protein, 9 aa, Homo Sapiens
HEKKLVIAH

SEQ ID NO: 699219 - protein, 9 aa, Homo Sapiens
TVALDLSRK

SEQ ID NO: 699220 - protein, 9 aa, Homo Sapiens
PMWQVTAFQ

SEQ ID NO: 699221 - protein, 9 aa, Homo Sapiens
IAQAHGYAK

SEQ ID NO: 699222 - protein, 9 aa, Homo Sapiens
HSVLVDEEH

SEQ ID NO: 699223 - protein, 9 aa, Homo Sapiens
SLSPADINY

SEQ ID NO: 699224 - protein, 9 aa, Homo Sapiens
QVKRYEGFL

SEQ ID NO: 699225 - protein, 9 aa, Homo Sapiens
QILRWAIAL

SEQ ID NO: 699226 - protein, 9 aa, Homo Sapiens
NQDKDTGVK

SEQ ID NO: 699227 - protein, 9 aa, Homo Sapiens
LMSHQRVHT

SEQ ID NO: 699228 - protein, 9 aa, Homo Sapiens
YVFTWSLPF

SEQ ID NO: 699229 - protein, 9 aa, Homo Sapiens
SSSNASAPG

SEQ ID NO: 699230 - protein, 9 aa, Homo Sapiens
LDGSSVLVD

SEQ ID NO: 699231 - protein, 9 aa, Homo Sapiens
PTLIDVDIY

SEQ ID NO: 699232 - protein, 9 aa, Homo Sapiens
KEASLLNLK

SEQ ID NO: 699233 - protein, 9 aa, Homo Sapiens
RRRNDVVVV

SEQ ID NO: 699234 - protein, 9 aa, Homo Sapiens
CIHGGICTA

SEQ ID NO: 699235 - protein, 9 aa, Homo Sapiens
ENGQEFSVI

SEQ ID NO: 699236 - protein, 9 aa, Homo Sapiens
DLSPPPGHT

SEQ ID NO: 699237 - protein, 9 aa, Homo Sapiens
VTTKDGYII

SEQ ID NO: 699238 - protein, 9 aa, Homo Sapiens
EQCLKISAS

SEQ ID NO: 699239 - protein, 9 aa, Homo Sapiens
CDSDSRGLS

SEQ ID NO: 699240 - protein, 9 aa, Homo Sapiens
TTVLVTFSI

SEQ ID NO: 699241 - protein, 9 aa, Homo Sapiens
SYSSSETFK

SEQ ID NO: 699242 - protein, 9 aa, Homo Sapiens
DFNSRLIGP

SEQ ID NO: 699243 - protein, 9 aa, Homo Sapiens
LGQYHGDAA

SEQ ID NO: 699244 - protein, 9 aa, Homo Sapiens
ILQAPVTAY

SEQ ID NO: 699245 - protein, 9 aa, Homo Sapiens
WPCVPGCQC

SEQ ID NO: 699246 - protein, 9 aa, Homo Sapiens
KPQSLHTKG

SEQ ID NO: 699247 - protein, 9 aa, Homo Sapiens
NMCAIIDRC

SEQ ID NO: 699248 - protein, 9 aa, Homo Sapiens
ALELSDLLL

SEQ ID NO: 699249 - protein, 9 aa, Homo Sapiens
FSSLGHVYT

SEQ ID NO: 699250 - protein, 9 aa, Homo Sapiens
SPSWTCFPP

SEQ ID NO: 699251 - protein, 9 aa, Homo Sapiens
LYCSLAGLQ

SEQ ID NO: 699252 - protein, 9 aa, Homo Sapiens
GKYNGYAPY

SEQ ID NO: 699253 - protein, 9 aa, Homo Sapiens
KRGDNQDKD

SEQ ID NO: 699254 - protein, 9 aa, Homo Sapiens
KAFCTCGSQ

SEQ ID NO: 699255 - protein, 9 aa, Homo Sapiens
SSKSMDCVY

SEQ ID NO: 699256 - protein, 9 aa, Homo Sapiens
TSPEQELPP

SEQ ID NO: 699257 - protein, 9 aa, Homo Sapiens
CVFSHEVLI

SEQ ID NO: 699258 - protein, 9 aa, Homo Sapiens
TSDVVRYDI

SEQ ID NO: 699259 - protein, 9 aa, Homo Sapiens
FSQIIFALN

SEQ ID NO: 699260 - protein, 9 aa, Homo Sapiens
ARFIAKSEA

SEQ ID NO: 699261 - protein, 9 aa, Homo Sapiens
ASIEVNATE

SEQ ID NO: 699262 - protein, 9 aa, Homo Sapiens
SPPEHRELR

SEQ ID NO: 699263 - protein, 9 aa, Homo Sapiens
CSSCNFKFE

SEQ ID NO: 699264 - protein, 9 aa, Homo Sapiens
ARVERVIAV

SEQ ID NO: 699265 - protein, 9 aa, Homo Sapiens
DPTDPFMLQ

SEQ ID NO: 699266 - protein, 9 aa, Homo Sapiens
CANLVLSNF

SEQ ID NO: 699267 - protein, 9 aa, Homo Sapiens
RRLHGAGVQ

SEQ ID NO: 699268 - protein, 9 aa, Homo Sapiens
LCQRYPPSY

SEQ ID NO: 699269 - protein, 9 aa, Homo Sapiens
VIHGHTVDL

SEQ ID NO: 699270 - protein, 9 aa, Homo Sapiens
SGGSVSLLF

SEQ ID NO: 699271 - protein, 9 aa, Homo Sapiens
IETSLKTEN

SEQ ID NO: 699272 - protein, 9 aa, Homo Sapiens
GYAPYIGFL

SEQ ID NO: 699273 - protein, 9 aa, Homo Sapiens
PDIGIKPTL

SEQ ID NO: 699274 - protein, 9 aa, Homo Sapiens
EKKLVIAHE

SEQ ID NO: 699275 - protein, 9 aa, Homo Sapiens
PKEQVKRYE

SEQ ID NO: 699276 - protein, 9 aa, Homo Sapiens
ECCKAFSRS

SEQ ID NO: 699277 - protein, 9 aa, Homo Sapiens
VFILTGRKE

SEQ ID NO: 699278 - protein, 9 aa, Homo Sapiens
SAYRDTCDS

SEQ ID NO: 699279 - protein, 9 aa, Homo Sapiens
RSVTVGKAL

SEQ ID NO: 699280 - protein, 9 aa, Homo Sapiens
SDVVRYDIL

SEQ ID NO: 699281 - protein, 9 aa, Homo Sapiens
FSYVQKPYR

SEQ ID NO: 699282 - protein, 9 aa, Homo Sapiens
KLRKKMSAK

SEQ ID NO: 699283 - protein, 9 aa, Homo Sapiens
EDDEYSCAY

SEQ ID NO: 699284 - protein, 9 aa, Homo Sapiens
ALSGDAGEY

SEQ ID NO: 699285 - protein, 9 aa, Homo Sapiens
QDKLSKKNF

SEQ ID NO: 699286 - protein, 9 aa, Homo Sapiens
LTGRKEDVE

SEQ ID NO: 699287 - protein, 9 aa, Homo Sapiens
FRNIFGNSS

SEQ ID NO: 699288 - protein, 9 aa, Homo Sapiens
ILQEVFGEV

SEQ ID NO: 699289 - protein, 9 aa, Homo Sapiens
PWNKGSRDQ

SEQ ID NO: 699290 - protein, 9 aa, Homo Sapiens
AASFFSFLV

SEQ ID NO: 699291 - protein, 9 aa, Homo Sapiens
EACNLAHKN

SEQ ID NO: 699292 - protein, 9 aa, Homo Sapiens
PELQTLATK

SEQ ID NO: 699293 - protein, 9 aa, Homo Sapiens
REMPGAPST

SEQ ID NO: 699294 - protein, 9 aa, Homo Sapiens
RNRTFCTMR

SEQ ID NO: 699295 - protein, 9 aa, Homo Sapiens
EKQRSEEDE

SEQ ID NO: 699296 - protein, 9 aa, Homo Sapiens
YSSSETFKA

SEQ ID NO: 699297 - protein, 9 aa, Homo Sapiens
FLTSPLEIV

SEQ ID NO: 699298 - protein, 9 aa, Homo Sapiens
AYWVPRNSL

SEQ ID NO: 699299 - protein, 9 aa, Homo Sapiens
EERTPLTLY

SEQ ID NO: 699300 - protein, 9 aa, Homo Sapiens
FNQDTFMVL

SEQ ID NO: 699301 - protein, 9 aa, Homo Sapiens
LATKFCLRQ

SEQ ID NO: 699302 - protein, 9 aa, Homo Sapiens
RNPRFRLAA

SEQ ID NO: 699303 - protein, 9 aa, Homo Sapiens
FANVSINMC

SEQ ID NO: 699304 - protein, 9 aa, Homo Sapiens
AMSSLYCSL

SEQ ID NO: 699305 - protein, 9 aa, Homo Sapiens
MFTTVLVTF

SEQ ID NO: 699306 - protein, 9 aa, Homo Sapiens
RLQVGPSPS

SEQ ID NO: 699307 - protein, 9 aa, Homo Sapiens
TLDGSSVLV

SEQ ID NO: 699308 - protein, 9 aa, Homo Sapiens
ERDFSPLQS

SEQ ID NO: 699309 - protein, 9 aa, Homo Sapiens
SPLEIVTQQ

SEQ ID NO: 699310 - protein, 9 aa, Homo Sapiens
SGSFIYQAS

SEQ ID NO: 699311 - protein, 9 aa, Homo Sapiens
TFSNCTSHL

SEQ ID NO: 699312 - protein, 9 aa, Homo Sapiens
DKDTGVKKL

SEQ ID NO: 699313 - protein, 9 aa, Homo Sapiens
SHNWKLKAH

SEQ ID NO: 699314 - protein, 9 aa, Homo Sapiens
QEFGFDVVP

SEQ ID NO: 699315 - protein, 9 aa, Homo Sapiens
RPWPPSFSA

SEQ ID NO: 699316 - protein, 9 aa, Homo Sapiens
SNLTLQEFV

SEQ ID NO: 699317 - protein, 9 aa, Homo Sapiens
ISIAGLHWY

SEQ ID NO: 699318 - protein, 9 aa, Homo Sapiens
YGGTRCQLY

SEQ ID NO: 699319 - protein, 9 aa, Homo Sapiens
LSRSRRERS

SEQ ID NO: 699320 - protein, 9 aa, Homo Sapiens
SNCTSHLTA

SEQ ID NO: 699321 - protein, 9 aa, Homo Sapiens
MESGRPPDP

SEQ ID NO: 699322 - protein, 9 aa, Homo Sapiens
LKQSMCEAV

SEQ ID NO: 699323 - protein, 9 aa, Homo Sapiens
EAIVSHEKK

SEQ ID NO: 699324 - protein, 9 aa, Homo Sapiens
ESIPILLFL

SEQ ID NO: 699325 - protein, 9 aa, Homo Sapiens
RRLKGWILL

SEQ ID NO: 699326 - protein, 9 aa, Homo Sapiens
AKVAPFINN

SEQ ID NO: 699327 - protein, 9 aa, Homo Sapiens
ISFWKKKSM

SEQ ID NO: 699328 - protein, 9 aa, Homo Sapiens
PSSTEEQYK

SEQ ID NO: 699329 - protein, 9 aa, Homo Sapiens
LLRQIAWAS

SEQ ID NO: 699330 - protein, 9 aa, Homo Sapiens
MTLSTQPRD

SEQ ID NO: 699331 - protein, 9 aa, Homo Sapiens
ALDLSWILP

SEQ ID NO: 699332 - protein, 9 aa, Homo Sapiens
IPAQNSKGK

SEQ ID NO: 699333 - protein, 9 aa, Homo Sapiens
TIKSAQGEG

SEQ ID NO: 699334 - protein, 9 aa, Homo Sapiens
CKPLHHTII

SEQ ID NO: 699335 - protein, 9 aa, Homo Sapiens
VAPARPPLK

SEQ ID NO: 699336 - protein, 9 aa, Homo Sapiens
LGTPTSQFL

SEQ ID NO: 699337 - protein, 9 aa, Homo Sapiens
NSRLIGPLL

SEQ ID NO: 699338 - protein, 9 aa, Homo Sapiens
LSFGQEIDY

SEQ ID NO: 699339 - protein, 9 aa, Homo Sapiens
CEECCKAFS

SEQ ID NO: 699340 - protein, 9 aa, Homo Sapiens
MYYGRTWVP

SEQ ID NO: 699341 - protein, 9 aa, Homo Sapiens
DRGRIAEAS

SEQ ID NO: 699342 - protein, 9 aa, Homo Sapiens
AAWMAALVE

SEQ ID NO: 699343 - protein, 9 aa, Homo Sapiens
EDADDEEAG

SEQ ID NO: 699344 - protein, 9 aa, Homo Sapiens
PWKHSSSRQ

SEQ ID NO: 699345 - protein, 9 aa, Homo Sapiens
ADSLSWHND

SEQ ID NO: 699346 - protein, 9 aa, Homo Sapiens
ENAKKDFFL

SEQ ID NO: 699347 - protein, 9 aa, Homo Sapiens
IHNFPSAKC

SEQ ID NO: 699348 - protein, 9 aa, Homo Sapiens
KIRALISPS

SEQ ID NO: 699349 - protein, 9 aa, Homo Sapiens
KSVIDYFEE

SEQ ID NO: 699350 - protein, 9 aa, Homo Sapiens
PGHTTCRLT

SEQ ID NO: 699351 - protein, 9 aa, Homo Sapiens
CLSVMKDYM

SEQ ID NO: 699352 - protein, 9 aa, Homo Sapiens
ISPSCLGTP

SEQ ID NO: 699353 - protein, 9 aa, Homo Sapiens
RPRVPEIEP

SEQ ID NO: 699354 - protein, 9 aa, Homo Sapiens
SFLVSQDAA

SEQ ID NO: 699355 - protein, 9 aa, Homo Sapiens
NGCHGAGTV

SEQ ID NO: 699356 - protein, 9 aa, Homo Sapiens
LTSPLEIVT

SEQ ID NO: 699357 - protein, 9 aa, Homo Sapiens
GIPPPPSLP

SEQ ID NO: 699358 - protein, 9 aa, Homo Sapiens
YLSSADRDQ

SEQ ID NO: 699359 - protein, 9 aa, Homo Sapiens
NSSYVDIGE

SEQ ID NO: 699360 - protein, 9 aa, Homo Sapiens
ISICDLWLQ

SEQ ID NO: 699361 - protein, 9 aa, Homo Sapiens
SQKGSLMSH

SEQ ID NO: 699362 - protein, 9 aa, Homo Sapiens
QDKDTGVKK

SEQ ID NO: 699363 - protein, 9 aa, Homo Sapiens
VEQLAQLLT

SEQ ID NO: 699364 - protein, 9 aa, Homo Sapiens
VRYDILLLK

SEQ ID NO: 699365 - protein, 9 aa, Homo Sapiens
EKPMKILMS

SEQ ID NO: 699366 - protein, 9 aa, Homo Sapiens
GQYHGDAAD

SEQ ID NO: 699367 - protein, 9 aa, Homo Sapiens
RYDILLLKN

SEQ ID NO: 699368 - protein, 9 aa, Homo Sapiens
GISIGRGAQ

SEQ ID NO: 699369 - protein, 9 aa, Homo Sapiens
STKFQYLNY

SEQ ID NO: 699370 - protein, 9 aa, Homo Sapiens
PKSSRLCRS

SEQ ID NO: 699371 - protein, 9 aa, Homo Sapiens
IESSILSDD

SEQ ID NO: 699372 - protein, 9 aa, Homo Sapiens
LLSFSGDGP

SEQ ID NO: 699373 - protein, 9 aa, Homo Sapiens
SWTCFPPSA

SEQ ID NO: 699374 - protein, 9 aa, Homo Sapiens
CPYESRAFA

SEQ ID NO: 699375 - protein, 9 aa, Homo Sapiens
RVKIRALIS

SEQ ID NO: 699376 - protein, 9 aa, Homo Sapiens
TNCDLLLRQ

SEQ ID NO: 699377 - protein, 9 aa, Homo Sapiens
EYFMKQMNV

SEQ ID NO: 699378 - protein, 9 aa, Homo Sapiens
ETFKAFDHD

SEQ ID NO: 699379 - protein, 9 aa, Homo Sapiens
AADSLSWHN

SEQ ID NO: 699380 - protein, 9 aa, Homo Sapiens
VFGEVMEEN

SEQ ID NO: 699381 - protein, 9 aa, Homo Sapiens
NNDKVCLIS

SEQ ID NO: 699382 - protein, 9 aa, Homo Sapiens
PFINNGSPT

SEQ ID NO: 699383 - protein, 9 aa, Homo Sapiens
EPYSSSKSA

SEQ ID NO: 699384 - protein, 9 aa, Homo Sapiens
TIVQLLKET

SEQ ID NO: 699385 - protein, 9 aa, Homo Sapiens
MRSQEMTKI

SEQ ID NO: 699386 - protein, 9 aa, Homo Sapiens
TDASSAGPS

SEQ ID NO: 699387 - protein, 9 aa, Homo Sapiens
CLTGEKGVR

SEQ ID NO: 699388 - protein, 9 aa, Homo Sapiens
KSYSSSETF

SEQ ID NO: 699389 - protein, 9 aa, Homo Sapiens
SADRDQIAQ

SEQ ID NO: 699390 - protein, 9 aa, Homo Sapiens
LTAAIYRAF

SEQ ID NO: 699391 - protein, 9 aa, Homo Sapiens
FGRSENLKI

SEQ ID NO: 699392 - protein, 9 aa, Homo Sapiens
HTVDLRSPA

SEQ ID NO: 699393 - protein, 9 aa, Homo Sapiens
TCQSLLQDI

SEQ ID NO: 699394 - protein, 9 aa, Homo Sapiens
VFPNVPFLW

SEQ ID NO: 699395 - protein, 9 aa, Homo Sapiens
GSNCMPIDA

SEQ ID NO: 699396 - protein, 9 aa, Homo Sapiens
KNRDITMQS

SEQ ID NO: 699397 - protein, 9 aa, Homo Sapiens
YCANLAIYI

SEQ ID NO: 699398 - protein, 9 aa, Homo Sapiens
KEEVGSCCN

SEQ ID NO: 699399 - protein, 9 aa, Homo Sapiens
HFGKSFRAK

SEQ ID NO: 699400 - protein, 9 aa, Homo Sapiens
AAVLGSRIF

SEQ ID NO: 699401 - protein, 9 aa, Homo Sapiens
FILTGRKED

SEQ ID NO: 699402 - protein, 9 aa, Homo Sapiens
ASCIHGGIC

SEQ ID NO: 699403 - protein, 9 aa, Homo Sapiens
EFNGMINEK

SEQ ID NO: 699404 - protein, 9 aa, Homo Sapiens
VFSHEVLIC

SEQ ID NO: 699405 - protein, 9 aa, Homo Sapiens
FLVSQDAAP

SEQ ID NO: 699406 - protein, 9 aa, Homo Sapiens
IIGIYRIPH

SEQ ID NO: 699407 - protein, 9 aa, Homo Sapiens
NRNSISMIR

SEQ ID NO: 699408 - protein, 9 aa, Homo Sapiens
AHHEFYSFE

SEQ ID NO: 699409 - protein, 9 aa, Homo Sapiens
PRVPEIEPR

SEQ ID NO: 699410 - protein, 9 aa, Homo Sapiens
KVLFSITTH

SEQ ID NO: 699411 - protein, 9 aa, Homo Sapiens
GQLALINAS

SEQ ID NO: 699412 - protein, 9 aa, Homo Sapiens
QTIVQLLKE

SEQ ID NO: 699413 - protein, 9 aa, Homo Sapiens
CFCTLCFIE

SEQ ID NO: 699414 - protein, 9 aa, Homo Sapiens
KRKAKKRRR

SEQ ID NO: 699415 - protein, 9 aa, Homo Sapiens
PSVTDASSA

SEQ ID NO: 699416 - protein, 9 aa, Homo Sapiens
NLTIRVCGC

SEQ ID NO: 699417 - protein, 9 aa, Homo Sapiens
LLYPPGFSF

SEQ ID NO: 699418 - protein, 9 aa, Homo Sapiens
FNGMINEKP

SEQ ID NO: 699419 - protein, 9 aa, Homo Sapiens
KLPGFCSFR

SEQ ID NO: 699420 - protein, 9 aa, Homo Sapiens
LAELHSVSP

SEQ ID NO: 699421 - protein, 9 aa, Homo Sapiens
LMSMKSFQP

SEQ ID NO: 699422 - protein, 9 aa, Homo Sapiens
YDLSPLTSL

SEQ ID NO: 699423 - protein, 9 aa, Homo Sapiens
KTLAIFYTV

SEQ ID NO: 699424 - protein, 9 aa, Homo Sapiens
YQDSLWASI

SEQ ID NO: 699425 - protein, 9 aa, Homo Sapiens
AMTLSTQPR

SEQ ID NO: 699426 - protein, 9 aa, Homo Sapiens
PAGTRSRLA

SEQ ID NO: 699427 - protein, 9 aa, Homo Sapiens
LTDRNIFDF

SEQ ID NO: 699428 - protein, 9 aa, Homo Sapiens
SMQADNPIE

SEQ ID NO: 699429 - protein, 9 aa, Homo Sapiens
PQTNVSELV

SEQ ID NO: 699430 - protein, 9 aa, Homo Sapiens
TITSSSPSA

SEQ ID NO: 699431 - protein, 9 aa, Homo Sapiens
NSSCMCGMN

SEQ ID NO: 699432 - protein, 9 aa, Homo Sapiens
NTQYTAAVV

SEQ ID NO: 699433 - protein, 9 aa, Homo Sapiens
LNLPHWIQQ

SEQ ID NO: 699434 - protein, 9 aa, Homo Sapiens
QPRSLSRSR

SEQ ID NO: 699435 - protein, 9 aa, Homo Sapiens
LFVYWKIYR

SEQ ID NO: 699436 - protein, 9 aa, Homo Sapiens
FSRSTLTKY

SEQ ID NO: 699437 - protein, 9 aa, Homo Sapiens
NRTFCTMRC

SEQ ID NO: 699438 - protein, 9 aa, Homo Sapiens
KLSKKNFSG

SEQ ID NO: 699439 - protein, 9 aa, Homo Sapiens
SCCNDSRWS

SEQ ID NO: 699440 - protein, 9 aa, Homo Sapiens
ENEIVRMGK

SEQ ID NO: 699441 - protein, 9 aa, Homo Sapiens
VSDFLTVVP

SEQ ID NO: 699442 - protein, 9 aa, Homo Sapiens
LLPEDSMFE

SEQ ID NO: 699443 - protein, 9 aa, Homo Sapiens
FYLPVCQGP

SEQ ID NO: 699444 - protein, 9 aa, Homo Sapiens
SNLTIRVCG

SEQ ID NO: 699445 - protein, 9 aa, Homo Sapiens
RARAKVKCL

SEQ ID NO: 699446 - protein, 9 aa, Homo Sapiens
PELPQRRNS

SEQ ID NO: 699447 - protein, 9 aa, Homo Sapiens
EKIKELIHM

SEQ ID NO: 699448 - protein, 9 aa, Homo Sapiens
ETSLKTENL

SEQ ID NO: 699449 - protein, 9 aa, Homo Sapiens
CELRPAPSL

SEQ ID NO: 699450 - protein, 9 aa, Homo Sapiens
LMGFMDNPK

SEQ ID NO: 699451 - protein, 9 aa, Homo Sapiens
DVELLLPED

SEQ ID NO: 699452 - protein, 9 aa, Homo Sapiens
LSNFSGRGG

SEQ ID NO: 699453 - protein, 9 aa, Homo Sapiens
DSMTSSACF

SEQ ID NO: 699454 - protein, 9 aa, Homo Sapiens
ITSSSPSAQ

SEQ ID NO: 699455 - protein, 9 aa, Homo Sapiens
ALISPSCLG

SEQ ID NO: 699456 - protein, 9 aa, Homo Sapiens
ERGLWCEKE

SEQ ID NO: 699457 - protein, 9 aa, Homo Sapiens
PGPGAAAGT

SEQ ID NO: 699458 - protein, 9 aa, Homo Sapiens
RAMSSLYCS

SEQ ID NO: 699459 - protein, 9 aa, Homo Sapiens
INTCQSLLQ

SEQ ID NO: 699460 - protein, 9 aa, Homo Sapiens
PPPYKRRNS

SEQ ID NO: 699461 - protein, 9 aa, Homo Sapiens
WPMYVVRRR

SEQ ID NO: 699462 - protein, 9 aa, Homo Sapiens
GQLAELHSV

SEQ ID NO: 699463 - protein, 9 aa, Homo Sapiens
RLQPSQKAP

SEQ ID NO: 699464 - protein, 9 aa, Homo Sapiens
LNAIRRLRL

SEQ ID NO: 699465 - protein, 9 aa, Homo Sapiens
CTHFGKSFR

SEQ ID NO: 699466 - protein, 9 aa, Homo Sapiens
AQNSKGKRL

SEQ ID NO: 699467 - protein, 9 aa, Homo Sapiens
SICDLWLQL

SEQ ID NO: 699468 - protein, 9 aa, Homo Sapiens
WCEKEVQVL

SEQ ID NO: 699469 - protein, 9 aa, Homo Sapiens
QESNTSRNN

SEQ ID NO: 699470 - protein, 9 aa, Homo Sapiens
ANITKSVID

SEQ ID NO: 699471 - protein, 9 aa, Homo Sapiens
PKGSPASSL

SEQ ID NO: 699472 - protein, 9 aa, Homo Sapiens
GGVATPGRP

SEQ ID NO: 699473 - protein, 9 aa, Homo Sapiens
MDRGRIAEA

SEQ ID NO: 699474 - protein, 9 aa, Homo Sapiens
TCRLTMGKW

SEQ ID NO: 699475 - protein, 9 aa, Homo Sapiens
CQVFRNPYV

SEQ ID NO: 699476 - protein, 9 aa, Homo Sapiens
NKFSHNWKL

SEQ ID NO: 699477 - protein, 9 aa, Homo Sapiens
RLDQIPAVN

SEQ ID NO: 699478 - protein, 9 aa, Homo Sapiens
TIPTIKSAQ

SEQ ID NO: 699479 - protein, 9 aa, Homo Sapiens
DGVPFTLPP

SEQ ID NO: 699480 - protein, 9 aa, Homo Sapiens
STCASQLTA

SEQ ID NO: 699481 - protein, 9 aa, Homo Sapiens
QVTAFQDHN

SEQ ID NO: 699482 - protein, 9 aa, Homo Sapiens
IVGCLCYDL

SEQ ID NO: 699483 - protein, 9 aa, Homo Sapiens
VAGGTSSNV

SEQ ID NO: 699484 - protein, 9 aa, Homo Sapiens
SETFKAFDH

SEQ ID NO: 699485 - protein, 9 aa, Homo Sapiens
TLEERTPLT

SEQ ID NO: 699486 - protein, 9 aa, Homo Sapiens
ARAKVKCLT

SEQ ID NO: 699487 - protein, 9 aa, Homo Sapiens
QNSKGKRLL

SEQ ID NO: 699488 - protein, 9 aa, Homo Sapiens
YITVHKELN

SEQ ID NO: 699489 - protein, 9 aa, Homo Sapiens
NSDNMFFPS

SEQ ID NO: 699490 - protein, 9 aa, Homo Sapiens
LTSLSELSV

SEQ ID NO: 699491 - protein, 9 aa, Homo Sapiens
RHQKTHSGM

SEQ ID NO: 699492 - protein, 9 aa, Homo Sapiens
CFFGCAVAP

SEQ ID NO: 699493 - protein, 9 aa, Homo Sapiens
QVEQLAQLL

SEQ ID NO: 699494 - protein, 9 aa, Homo Sapiens
ACQILRWAI

SEQ ID NO: 699495 - protein, 9 aa, Homo Sapiens
RPALGLLEC

SEQ ID NO: 699496 - protein, 9 aa, Homo Sapiens
GRSENLKIH

SEQ ID NO: 699497 - protein, 9 aa, Homo Sapiens
ATIIQKYWP

SEQ ID NO: 699498 - protein, 9 aa, Homo Sapiens
FCTMRCPPG

SEQ ID NO: 699499 - protein, 9 aa, Homo Sapiens
KELTAAIYR

SEQ ID NO: 699500 - protein, 9 aa, Homo Sapiens
PFASETLKH

SEQ ID NO: 699501 - protein, 9 aa, Homo Sapiens
YQGLKAANY

SEQ ID NO: 699502 - protein, 9 aa, Homo Sapiens
YWVPRNSLP

SEQ ID NO: 699503 - protein, 9 aa, Homo Sapiens
LHGAGVQIA

SEQ ID NO: 699504 - protein, 9 aa, Homo Sapiens
VSVGGLPCS

SEQ ID NO: 699505 - protein, 9 aa, Homo Sapiens
SGTGQSSGY

SEQ ID NO: 699506 - protein, 9 aa, Homo Sapiens
ITLSGNLCM

SEQ ID NO: 699507 - protein, 9 aa, Homo Sapiens
PNFMYVFTW

SEQ ID NO: 699508 - protein, 9 aa, Homo Sapiens
ERLIYFYVN

SEQ ID NO: 699509 - protein, 9 aa, Homo Sapiens
KSGTGQSSG

SEQ ID NO: 699510 - protein, 9 aa, Homo Sapiens
APWKHSSSR

SEQ ID NO: 699511 - protein, 9 aa, Homo Sapiens
LEEIMLPFS

SEQ ID NO: 699512 - protein, 9 aa, Homo Sapiens
AFSVRSNLT

SEQ ID NO: 699513 - protein, 9 aa, Homo Sapiens
GLITVWEPL

SEQ ID NO: 699514 - protein, 9 aa, Homo Sapiens
EPALVSKEA

SEQ ID NO: 699515 - protein, 9 aa, Homo Sapiens
SGHSKSTGE

SEQ ID NO: 699516 - protein, 9 aa, Homo Sapiens
PPSFSAPCC

SEQ ID NO: 699517 - protein, 9 aa, Homo Sapiens
VVRYDILLL

SEQ ID NO: 699518 - protein, 9 aa, Homo Sapiens
FSQKGSLMS

SEQ ID NO: 699519 - protein, 9 aa, Homo Sapiens
GGQTIVQLL

SEQ ID NO: 699520 - protein, 9 aa, Homo Sapiens
MGKRHLLHK

SEQ ID NO: 699521 - protein, 9 aa, Homo Sapiens
AVPSAGSMQ

SEQ ID NO: 699522 - protein, 9 aa, Homo Sapiens
ANFEPDENG

SEQ ID NO: 699523 - protein, 9 aa, Homo Sapiens
KVQLVLFVI

SEQ ID NO: 699524 - protein, 9 aa, Homo Sapiens
EVFGEVMEE

SEQ ID NO: 699525 - protein, 9 aa, Homo Sapiens
NMFFPSSTE

SEQ ID NO: 699526 - protein, 9 aa, Homo Sapiens
ISVAGGTSS

SEQ ID NO: 699527 - protein, 9 aa, Homo Sapiens
HTEKGITVP

SEQ ID NO: 699528 - protein, 9 aa, Homo Sapiens
DHQKKVTPQ

SEQ ID NO: 699529 - protein, 9 aa, Homo Sapiens
VDVINARET

SEQ ID NO: 699530 - protein, 9 aa, Homo Sapiens
EEDADERQE

SEQ ID NO: 699531 - protein, 9 aa, Homo Sapiens
GIEDDEYSC

SEQ ID NO: 699532 - protein, 9 aa, Homo Sapiens
NLRNDLQAN

SEQ ID NO: 699533 - protein, 9 aa, Homo Sapiens
FLTVVPLPD

SEQ ID NO: 699534 - protein, 9 aa, Homo Sapiens
KKWNYHYLV

SEQ ID NO: 699535 - protein, 9 aa, Homo Sapiens
KYWPMYVVR

SEQ ID NO: 699536 - protein, 9 aa, Homo Sapiens
EYFRNNRFP

SEQ ID NO: 699537 - protein, 9 aa, Homo Sapiens
WNDDFENHR

SEQ ID NO: 699538 - protein, 9 aa, Homo Sapiens
CTCGSQLTV

SEQ ID NO: 699539 - protein, 9 aa, Homo Sapiens
FIQTANTQY

SEQ ID NO: 699540 - protein, 9 aa, Homo Sapiens
PSWTCFPPS

SEQ ID NO: 699541 - protein, 9 aa, Homo Sapiens
NCDLLLRQI

SEQ ID NO: 699542 - protein, 9 aa, Homo Sapiens
GAISIAGLH

SEQ ID NO: 699543 - protein, 9 aa, Homo Sapiens
FLLLQTYVL

SEQ ID NO: 699544 - protein, 9 aa, Homo Sapiens
VADLPQPSA

SEQ ID NO: 699545 - protein, 9 aa, Homo Sapiens
WADTREDYI

SEQ ID NO: 699546 - protein, 9 aa, Homo Sapiens
FPGDRLRGM

SEQ ID NO: 699547 - protein, 9 aa, Homo Sapiens
DRYLCQRYP

SEQ ID NO: 699548 - protein, 9 aa, Homo Sapiens
ICTAIKADS

SEQ ID NO: 699549 - protein, 9 aa, Homo Sapiens
SMDGLERAL

SEQ ID NO: 699550 - protein, 9 aa, Homo Sapiens
STAWKNRDI

SEQ ID NO: 699551 - protein, 9 aa, Homo Sapiens
SFLYYTDDQ

SEQ ID NO: 699552 - protein, 9 aa, Homo Sapiens
IYQASTHEQ

SEQ ID NO: 699553 - protein, 9 aa, Homo Sapiens
LGRGMKDVE

SEQ ID NO: 699554 - protein, 9 aa, Homo Sapiens
LGTSQAKGK

SEQ ID NO: 699555 - protein, 9 aa, Homo Sapiens
TGQSSGYSQ

SEQ ID NO: 699556 - protein, 9 aa, Homo Sapiens
ASFFSFLVS

SEQ ID NO: 699557 - protein, 9 aa, Homo Sapiens
GSIFGPVLS

SEQ ID NO: 699558 - protein, 9 aa, Homo Sapiens
PQPSAGVPC

SEQ ID NO: 699559 - protein, 9 aa, Homo Sapiens
VQLLKETGA

SEQ ID NO: 699560 - protein, 9 aa, Homo Sapiens
PRFRLAAFA

SEQ ID NO: 699561 - protein, 9 aa, Homo Sapiens
VMKDYMLFR

SEQ ID NO: 699562 - protein, 9 aa, Homo Sapiens
PALELSDLL

SEQ ID NO: 699563 - protein, 9 aa, Homo Sapiens
RSTLTKYKR

SEQ ID NO: 699564 - protein, 9 aa, Homo Sapiens
IFDFLVKTY

SEQ ID NO: 699565 - protein, 9 aa, Homo Sapiens
DLGSIFGPV

SEQ ID NO: 699566 - protein, 9 aa, Homo Sapiens
EPPAYERTE

SEQ ID NO: 699567 - protein, 9 aa, Homo Sapiens
RFLNVHVPR

SEQ ID NO: 699568 - protein, 9 aa, Homo Sapiens
PGPGDGCFP

SEQ ID NO: 699569 - protein, 9 aa, Homo Sapiens
SCYDFWSNA

SEQ ID NO: 699570 - protein, 9 aa, Homo Sapiens
SVEKAVSSI

SEQ ID NO: 699571 - protein, 9 aa, Homo Sapiens
IGIYRIPHG

SEQ ID NO: 699572 - protein, 9 aa, Homo Sapiens
EIDYWGIDE

SEQ ID NO: 699573 - protein, 9 aa, Homo Sapiens
GKNCQVFRN

SEQ ID NO: 699574 - protein, 9 aa, Homo Sapiens
IVFQPQKNV

SEQ ID NO: 699575 - protein, 9 aa, Homo Sapiens
PGAAAGTAA

SEQ ID NO: 699576 - protein, 9 aa, Homo Sapiens
KQMNVAHHG

SEQ ID NO: 699577 - protein, 9 aa, Homo Sapiens
FPSSTEEQY

SEQ ID NO: 699578 - protein, 9 aa, Homo Sapiens
PVQWIPPPY

SEQ ID NO: 699579 - protein, 9 aa, Homo Sapiens
IGFIPRPLR

SEQ ID NO: 699580 - protein, 9 aa, Homo Sapiens
DLDFVMSLN

SEQ ID NO: 699581 - protein, 9 aa, Homo Sapiens
VIRPGFPPN

SEQ ID NO: 699582 - protein, 9 aa, Homo Sapiens
AASSAFSSL

SEQ ID NO: 699583 - protein, 9 aa, Homo Sapiens
PMKILMSMK

SEQ ID NO: 699584 - protein, 9 aa, Homo Sapiens
LPCSFSWRN

SEQ ID NO: 699585 - protein, 9 aa, Homo Sapiens
APVLNAIRR

SEQ ID NO: 699586 - protein, 9 aa, Homo Sapiens
IDYFEEYFA

SEQ ID NO: 699587 - protein, 9 aa, Homo Sapiens
PTDPFMLQC

SEQ ID NO: 699588 - protein, 9 aa, Homo Sapiens
RRLTGQFCL

SEQ ID NO: 699589 - protein, 9 aa, Homo Sapiens
DCLDGSHEA

SEQ ID NO: 699590 - protein, 9 aa, Homo Sapiens
WLHLVILFE

SEQ ID NO: 699591 - protein, 9 aa, Homo Sapiens
GTASIEVNA

SEQ ID NO: 699592 - protein, 9 aa, Homo Sapiens
SVRSNLTIH

SEQ ID NO: 699593 - protein, 9 aa, Homo Sapiens
GSMQRVPSG

SEQ ID NO: 699594 - protein, 9 aa, Homo Sapiens
ILRWAIALG

SEQ ID NO: 699595 - protein, 9 aa, Homo Sapiens
LAIFYTVIT

SEQ ID NO: 699596 - protein, 9 aa, Homo Sapiens
APRAQAAEE

SEQ ID NO: 699597 - protein, 9 aa, Homo Sapiens
LSLSCVELL

SEQ ID NO: 699598 - protein, 9 aa, Homo Sapiens
SQPRSLSRS

SEQ ID NO: 699599 - protein, 9 aa, Homo Sapiens
ASNKTLAIF

SEQ ID NO: 699600 - protein, 9 aa, Homo Sapiens
IDEMLVDIT

SEQ ID NO: 699601 - protein, 9 aa, Homo Sapiens
VQVLHRQLS

SEQ ID NO: 699602 - protein, 9 aa, Homo Sapiens
TTDEGTASI

SEQ ID NO: 699603 - protein, 9 aa, Homo Sapiens
WKIYRAAKF

SEQ ID NO: 699604 - protein, 9 aa, Homo Sapiens
FGKSFRAKG

SEQ ID NO: 699605 - protein, 9 aa, Homo Sapiens
SSLYCSLAG

SEQ ID NO: 699606 - protein, 9 aa, Homo Sapiens
STIPTIKSA

SEQ ID NO: 699607 - protein, 9 aa, Homo Sapiens
DENGQEFSV

SEQ ID NO: 699608 - protein, 9 aa, Homo Sapiens
ASEILQAPV

SEQ ID NO: 699609 - protein, 9 aa, Homo Sapiens
GCEIGFIPR

SEQ ID NO: 699610 - protein, 9 aa, Homo Sapiens
ILPAPPARP

SEQ ID NO: 699611 - protein, 9 aa, Homo Sapiens
SIEVNATEE

SEQ ID NO: 699612 - protein, 9 aa, Homo Sapiens
NTLEEIMLP

SEQ ID NO: 699613 - protein, 9 aa, Homo Sapiens
AQPLPAPPD

SEQ ID NO: 699614 - protein, 9 aa, Homo Sapiens
VLHRQLSQP

SEQ ID NO: 699615 - protein, 9 aa, Homo Sapiens
IASEILQAP

SEQ ID NO: 699616 - protein, 9 aa, Homo Sapiens
DLSRKEQER

SEQ ID NO: 699617 - protein, 9 aa, Homo Sapiens
EFVLDENDN

SEQ ID NO: 699618 - protein, 9 aa, Homo Sapiens
GSLMSHQRV

SEQ ID NO: 699619 - protein, 9 aa, Homo Sapiens
FTLDGSSVL

SEQ ID NO: 699620 - protein, 9 aa, Homo Sapiens
RLTGQFCLI

SEQ ID NO: 699621 - protein, 9 aa, Homo Sapiens
DDEDDEDAD

SEQ ID NO: 699622 - protein, 9 aa, Homo Sapiens
EGLRRLHGA

SEQ ID NO: 699623 - protein, 9 aa, Homo Sapiens
KAFSVRSNL

SEQ ID NO: 699624 - protein, 9 aa, Homo Sapiens
IHGGICTAI

SEQ ID NO: 699625 - protein, 9 aa, Homo Sapiens
PPPPSLPGA

SEQ ID NO: 699626 - protein, 9 aa, Homo Sapiens
LLKETGATI

SEQ ID NO: 699627 - protein, 9 aa, Homo Sapiens
GYDLSPLTS

SEQ ID NO: 699628 - protein, 9 aa, Homo Sapiens
APPTEDFPE

SEQ ID NO: 699629 - protein, 9 aa, Homo Sapiens
KKHNEHFER

SEQ ID NO: 699630 - protein, 9 aa, Homo Sapiens
SGRPPDPAD

SEQ ID NO: 699631 - protein, 9 aa, Homo Sapiens
QAAEEDVLE

SEQ ID NO: 699632 - protein, 9 aa, Homo Sapiens
FNTTIETSL

SEQ ID NO: 699633 - protein, 9 aa, Homo Sapiens
QECGKAFKH

SEQ ID NO: 699634 - protein, 9 aa, Homo Sapiens
GSGEQRAVG

SEQ ID NO: 699635 - protein, 9 aa, Homo Sapiens
NTIPDGFTI

SEQ ID NO: 699636 - protein, 9 aa, Homo Sapiens
SYFLLLQTY

SEQ ID NO: 699637 - protein, 9 aa, Homo Sapiens
DEDDEDADD

SEQ ID NO: 699638 - protein, 9 aa, Homo Sapiens
CRLTMGKWW

SEQ ID NO: 699639 - protein, 9 aa, Homo Sapiens
MGFMDNPKL

SEQ ID NO: 699640 - protein, 9 aa, Homo Sapiens
QTANTQYTA

SEQ ID NO: 699641 - protein, 9 aa, Homo Sapiens
QELLGDHQK

SEQ ID NO: 699642 - protein, 9 aa, Homo Sapiens
MSCSESHAA

SEQ ID NO: 699643 - protein, 9 aa, Homo Sapiens
LQAPVTAYD

SEQ ID NO: 699644 - protein, 9 aa, Homo Sapiens
LLFLAGYEL

SEQ ID NO: 699645 - protein, 9 aa, Homo Sapiens
PTIKSAQGE

SEQ ID NO: 699646 - protein, 9 aa, Homo Sapiens
SDLLLLAGP

SEQ ID NO: 699647 - protein, 9 aa, Homo Sapiens
IAGLHWYHG

SEQ ID NO: 699648 - protein, 9 aa, Homo Sapiens
DFFLNLPHW

SEQ ID NO: 699649 - protein, 9 aa, Homo Sapiens
AFCTCGSQL

SEQ ID NO: 699650 - protein, 9 aa, Homo Sapiens
GALSGDAGE

SEQ ID NO: 699651 - protein, 9 aa, Homo Sapiens
RNIFDFLVK

SEQ ID NO: 699652 - protein, 9 aa, Homo Sapiens
LRWAIALGL

SEQ ID NO: 699653 - protein, 9 aa, Homo Sapiens
GRGAQYCPC

SEQ ID NO: 699654 - protein, 9 aa, Homo Sapiens
TVHKELNFC

SEQ ID NO: 699655 - protein, 9 aa, Homo Sapiens
CGDRPPSVS

SEQ ID NO: 699656 - protein, 9 aa, Homo Sapiens
QIPAVNLDA

SEQ ID NO: 699657 - protein, 9 aa, Homo Sapiens
DKKWNYHYL

SEQ ID NO: 699658 - protein, 9 aa, Homo Sapiens
APGLACGDR

SEQ ID NO: 699659 - protein, 9 aa, Homo Sapiens
EFTDLNLLQ

SEQ ID NO: 699660 - protein, 9 aa, Homo Sapiens
RAFSTCASQ

SEQ ID NO: 699661 - protein, 9 aa, Homo Sapiens
FPGPPSRSR

SEQ ID NO: 699662 - protein, 9 aa, Homo Sapiens
WQKLTLEER

SEQ ID NO: 699663 - protein, 9 aa, Homo Sapiens
PVLNAIRRL

SEQ ID NO: 699664 - protein, 9 aa, Homo Sapiens
EKEVQVLLT

SEQ ID NO: 699665 - protein, 9 aa, Homo Sapiens
RLGRGMKDV

SEQ ID NO: 699666 - protein, 9 aa, Homo Sapiens
GRYNAHIQE

SEQ ID NO: 699667 - protein, 9 aa, Homo Sapiens
SQIIFALNQ

SEQ ID NO: 699668 - protein, 9 aa, Homo Sapiens
ILLFLAGYE

SEQ ID NO: 699669 - protein, 9 aa, Homo Sapiens
PSLWLVLQV

SEQ ID NO: 699670 - protein, 9 aa, Homo Sapiens
YLPGINIRN

SEQ ID NO: 699671 - protein, 9 aa, Homo Sapiens
NSDKFVLWK

SEQ ID NO: 699672 - protein, 9 aa, Homo Sapiens
FSITTHYFK

SEQ ID NO: 699673 - protein, 9 aa, Homo Sapiens
KLPSINDLG

SEQ ID NO: 699674 - protein, 9 aa, Homo Sapiens
WASIRQRSK

SEQ ID NO: 699675 - protein, 9 aa, Homo Sapiens
SIHNFPSAK

SEQ ID NO: 699676 - protein, 9 aa, Homo Sapiens
YKCNGCHGA

SEQ ID NO: 699677 - protein, 9 aa, Homo Sapiens
LRGMVSRLF

SEQ ID NO: 699678 - protein, 9 aa, Homo Sapiens
GFDVVPVCF

SEQ ID NO: 699679 - protein, 9 aa, Homo Sapiens
ILHWLHLVI

SEQ ID NO: 699680 - protein, 9 aa, Homo Sapiens
KKSVCDQGF

SEQ ID NO: 699681 - protein, 9 aa, Homo Sapiens
QFKNSSYVD

SEQ ID NO: 699682 - protein, 9 aa, Homo Sapiens
TSSSPSAQP

SEQ ID NO: 699683 - protein, 9 aa, Homo Sapiens
YGIEDDEYS

SEQ ID NO: 699684 - protein, 9 aa, Homo Sapiens
GEIVPTIYQ

SEQ ID NO: 699685 - protein, 9 aa, Homo Sapiens
REAASSAFS

SEQ ID NO: 699686 - protein, 9 aa, Homo Sapiens
HTTCRLTMG

SEQ ID NO: 699687 - protein, 9 aa, Homo Sapiens
SMQRVPSGA

SEQ ID NO: 699688 - protein, 9 aa, Homo Sapiens
GFIPRPLRL

SEQ ID NO: 699689 - protein, 9 aa, Homo Sapiens
NASMDGLER

SEQ ID NO: 699690 - protein, 9 aa, Homo Sapiens
SGMKTSGCN

SEQ ID NO: 699691 - protein, 9 aa, Homo Sapiens
IGISIGRGA

SEQ ID NO: 699692 - protein, 9 aa, Homo Sapiens
WEAFSYVQK

SEQ ID NO: 699693 - protein, 9 aa, Homo Sapiens
CQLYLDECQ

SEQ ID NO: 699694 - protein, 9 aa, Homo Sapiens
VDITEENTE

SEQ ID NO: 699695 - protein, 9 aa, Homo Sapiens
TVELRRPRQ

SEQ ID NO: 699696 - protein, 9 aa, Homo Sapiens
FEPPAYERT

SEQ ID NO: 699697 - protein, 9 aa, Homo Sapiens
EMLGEIVPT

SEQ ID NO: 699698 - protein, 9 aa, Homo Sapiens
RLAKNEAAW

SEQ ID NO: 699699 - protein, 9 aa, Homo Sapiens
STSDVVRYD

SEQ ID NO: 699700 - protein, 9 aa, Homo Sapiens
FGTPENKCF

SEQ ID NO: 699701 - protein, 9 aa, Homo Sapiens
GGTRCQLYL

SEQ ID NO: 699702 - protein, 9 aa, Homo Sapiens
RSGSFIYQA

SEQ ID NO: 699703 - protein, 9 aa, Homo Sapiens
SDFLTVVPL

SEQ ID NO: 699704 - protein, 9 aa, Homo Sapiens
NFKFESESE

SEQ ID NO: 699705 - protein, 9 aa, Homo Sapiens
IYRAAKFRV

SEQ ID NO: 699706 - protein, 9 aa, Homo Sapiens
PGTPVKQEN

SEQ ID NO: 699707 - protein, 9 aa, Homo Sapiens
QLCLEALTS

SEQ ID NO: 699708 - protein, 9 aa, Homo Sapiens
PDLPEMLDP

SEQ ID NO: 699709 - protein, 9 aa, Homo Sapiens
ANTQYTAAV

SEQ ID NO: 699710 - protein, 9 aa, Homo Sapiens
MLQCTCQHN

SEQ ID NO: 699711 - protein, 9 aa, Homo Sapiens
LCLEALTSL

SEQ ID NO: 699712 - protein, 9 aa, Homo Sapiens
QPTRIRFLN

SEQ ID NO: 699713 - protein, 9 aa, Homo Sapiens
PTFSALPSP

SEQ ID NO: 699714 - protein, 9 aa, Homo Sapiens
AKSKSSHME

SEQ ID NO: 699715 - protein, 9 aa, Homo Sapiens
QGSGEQRAV

SEQ ID NO: 699716 - protein, 9 aa, Homo Sapiens
VLAKSKSSH

SEQ ID NO: 699717 - protein, 9 aa, Homo Sapiens
GSCCNDSRW

SEQ ID NO: 699718 - protein, 9 aa, Homo Sapiens
RKIRRLPQG

SEQ ID NO: 699719 - protein, 9 aa, Homo Sapiens
HNWKLKAHI

SEQ ID NO: 699720 - protein, 9 aa, Homo Sapiens
AEEDVLELH

SEQ ID NO: 699721 - protein, 9 aa, Homo Sapiens
REIQVAIKT

SEQ ID NO: 699722 - protein, 9 aa, Homo Sapiens
HLWAIQPGG

SEQ ID NO: 699723 - protein, 9 aa, Homo Sapiens
INEKPMKIL

SEQ ID NO: 699724 - protein, 9 aa, Homo Sapiens
KGLKKSVCD

SEQ ID NO: 699725 - protein, 9 aa, Homo Sapiens
SRSTLTKYK

SEQ ID NO: 699726 - protein, 9 aa, Homo Sapiens
KFRVKIRAL

SEQ ID NO: 699727 - protein, 9 aa, Homo Sapiens
LRRLHGAGV

SEQ ID NO: 699728 - protein, 9 aa, Homo Sapiens
SAGSMQRVP

SEQ ID NO: 699729 - protein, 9 aa, Homo Sapiens
SVASAREVS

SEQ ID NO: 699730 - protein, 9 aa, Homo Sapiens
LGLLECVRG

SEQ ID NO: 699731 - protein, 9 aa, Homo Sapiens
KRRRNDVVV

SEQ ID NO: 699732 - protein, 9 aa, Homo Sapiens
GDRILQINV

SEQ ID NO: 699733 - protein, 9 aa, Homo Sapiens
RLKGWILLE

SEQ ID NO: 699734 - protein, 9 aa, Homo Sapiens
SIAGLHWYH

SEQ ID NO: 699735 - protein, 9 aa, Homo Sapiens
GRIAEASVC

SEQ ID NO: 699736 - protein, 9 aa, Homo Sapiens
CRSVLRWLQ

SEQ ID NO: 699737 - protein, 9 aa, Homo Sapiens
TTIETSLKT

SEQ ID NO: 699738 - protein, 9 aa, Homo Sapiens
FSAPCCWRL

SEQ ID NO: 699739 - protein, 9 aa, Homo Sapiens
ERGGVATPG

SEQ ID NO: 699740 - protein, 9 aa, Homo Sapiens
YDLDHRGTN

SEQ ID NO: 699741 - protein, 9 aa, Homo Sapiens
MASYFLLLQ

SEQ ID NO: 699742 - protein, 9 aa, Homo Sapiens
YYTDDQYEV

SEQ ID NO: 699743 - protein, 9 aa, Homo Sapiens
TLTIKTLMG

SEQ ID NO: 699744 - protein, 9 aa, Homo Sapiens
ELNFCANLV

SEQ ID NO: 699745 - protein, 9 aa, Homo Sapiens
KKRLQPSQK

SEQ ID NO: 699746 - protein, 9 aa, Homo Sapiens
HLQGFEPPA

SEQ ID NO: 699747 - protein, 9 aa, Homo Sapiens
AGIPPPPSL

SEQ ID NO: 699748 - protein, 9 aa, Homo Sapiens
RPAPSLGQA

SEQ ID NO: 699749 - protein, 9 aa, Homo Sapiens
NNSEKLRVD

SEQ ID NO: 699750 - protein, 9 aa, Homo Sapiens
VDKKWNYHY

SEQ ID NO: 699751 - protein, 9 aa, Homo Sapiens
VKSVLPFAS

SEQ ID NO: 699752 - protein, 9 aa, Homo Sapiens
ITVHKELNF

SEQ ID NO: 699753 - protein, 9 aa, Homo Sapiens
AMVASLSPA

SEQ ID NO: 699754 - protein, 9 aa, Homo Sapiens
ALVLERLSL

SEQ ID NO: 699755 - protein, 9 aa, Homo Sapiens
KCEECCKAF

SEQ ID NO: 699756 - protein, 9 aa, Homo Sapiens
LREEEKAKY

SEQ ID NO: 699757 - protein, 9 aa, Homo Sapiens
WRLQVGPSP

SEQ ID NO: 699758 - protein, 9 aa, Homo Sapiens
FIQKLWEGG

SEQ ID NO: 699759 - protein, 9 aa, Homo Sapiens
GVPFTLPPR

SEQ ID NO: 699760 - protein, 9 aa, Homo Sapiens
ELLLPEDSM

SEQ ID NO: 699761 - protein, 9 aa, Homo Sapiens
SLLFSNFTG

SEQ ID NO: 699762 - protein, 9 aa, Homo Sapiens
YLPVCQGPS

SEQ ID NO: 699763 - protein, 9 aa, Homo Sapiens
HEFTDLNLL

SEQ ID NO: 699764 - protein, 9 aa, Homo Sapiens
KSKTKMRNP

SEQ ID NO: 699765 - protein, 9 aa, Homo Sapiens
SFWKKKSMI

SEQ ID NO: 699766 - protein, 9 aa, Homo Sapiens
NTLSWMQLD

SEQ ID NO: 699767 - protein, 9 aa, Homo Sapiens
LLNTVSGIK

SEQ ID NO: 699768 - protein, 9 aa, Homo Sapiens
QAEQCLKIS

SEQ ID NO: 699769 - protein, 9 aa, Homo Sapiens
YTDDQYEVI

SEQ ID NO: 699770 - protein, 9 aa, Homo Sapiens
DGYFLIATV

SEQ ID NO: 699771 - protein, 9 aa, Homo Sapiens
RAAKFRVGS

SEQ ID NO: 699772 - protein, 9 aa, Homo Sapiens
TGLITVWEP

SEQ ID NO: 699773 - protein, 9 aa, Homo Sapiens
GVKNSMESG

SEQ ID NO: 699774 - protein, 9 aa, Homo Sapiens
ELIHMHGNN

SEQ ID NO: 699775 - protein, 9 aa, Homo Sapiens
SDNMFFPSS

SEQ ID NO: 699776 - protein, 9 aa, Homo Sapiens
YNKPTFSAL

SEQ ID NO: 699777 - protein, 9 aa, Homo Sapiens
NFCANLVLS

SEQ ID NO: 699778 - protein, 9 aa, Homo Sapiens
TVDLRSPAG

SEQ ID NO: 699779 - protein, 9 aa, Homo Sapiens
VQWIPPPYK

SEQ ID NO: 699780 - protein, 9 aa, Homo Sapiens
HSRYLPGIN

SEQ ID NO: 699781 - protein, 9 aa, Homo Sapiens
KCNGCHGAG

SEQ ID NO: 699782 - protein, 9 aa, Homo Sapiens
LRQIAWASL

SEQ ID NO: 699783 - protein, 9 aa, Homo Sapiens
FAIKVLFSI

SEQ ID NO: 699784 - protein, 9 aa, Homo Sapiens
DFSPLQSQT

SEQ ID NO: 699785 - protein, 9 aa, Homo Sapiens
DFENHRLTP

SEQ ID NO: 699786 - protein, 9 aa, Homo Sapiens
LLQALRQFL

SEQ ID NO: 699787 - protein, 9 aa, Homo Sapiens
TNYSVKKHN

SEQ ID NO: 699788 - protein, 9 aa, Homo Sapiens
SVGGLPCSF

SEQ ID NO: 699789 - protein, 9 aa, Homo Sapiens
PSCLGTPTS

SEQ ID NO: 699790 - protein, 9 aa, Homo Sapiens
FINQDLLVN

SEQ ID NO: 699791 - protein, 9 aa, Homo Sapiens
PEEALELRA

SEQ ID NO: 699792 - protein, 9 aa, Homo Sapiens
SFSAPCCWR

SEQ ID NO: 699793 - protein, 9 aa, Homo Sapiens
RIYWADTRE

SEQ ID NO: 699794 - protein, 9 aa, Homo Sapiens
FHVRFINQD

SEQ ID NO: 699795 - protein, 9 aa, Homo Sapiens
ILMTKGLKK

SEQ ID NO: 699796 - protein, 9 aa, Homo Sapiens
TFIQTANTQ

SEQ ID NO: 699797 - protein, 9 aa, Homo Sapiens
SMKSFQPEE

SEQ ID NO: 699798 - protein, 9 aa, Homo Sapiens
LTVVPLPDP

SEQ ID NO: 699799 - protein, 9 aa, Homo Sapiens
LLREEEKAK

SEQ ID NO: 699800 - protein, 9 aa, Homo Sapiens
GLHWYHGTE

SEQ ID NO: 699801 - protein, 9 aa, Homo Sapiens
GRSRLLEYF

SEQ ID NO: 699802 - protein, 9 aa, Homo Sapiens
FDVVPVCFL

SEQ ID NO: 699803 - protein, 9 aa, Homo Sapiens
LGEIVPTIY

SEQ ID NO: 699804 - protein, 9 aa, Homo Sapiens
VSGHSKSTG

SEQ ID NO: 699805 - protein, 9 aa, Homo Sapiens
LPPHLNISS

SEQ ID NO: 699806 - protein, 9 aa, Homo Sapiens
MYVFTWSLP

SEQ ID NO: 699807 - protein, 9 aa, Homo Sapiens
TLIDVDIYV

SEQ ID NO: 699808 - protein, 9 aa, Homo Sapiens
KTPGKREIQ

SEQ ID NO: 699809 - protein, 9 aa, Homo Sapiens
EAAWMAALV

SEQ ID NO: 699810 - protein, 9 aa, Homo Sapiens
QLQDELLGT

SEQ ID NO: 699811 - protein, 9 aa, Homo Sapiens
LPFSHWTYE

SEQ ID NO: 699812 - protein, 9 aa, Homo Sapiens
NENSEVIRP

SEQ ID NO: 699813 - protein, 9 aa, Homo Sapiens
PRSLSRSRR

SEQ ID NO: 699814 - protein, 9 aa, Homo Sapiens
TGTSMTSGN

SEQ ID NO: 699815 - protein, 9 aa, Homo Sapiens
ASQLTAIIL

SEQ ID NO: 699816 - protein, 9 aa, Homo Sapiens
SNCMPIDAL

SEQ ID NO: 699817 - protein, 9 aa, Homo Sapiens
KLWEGGFSY

SEQ ID NO: 699818 - protein, 9 aa, Homo Sapiens
TQPRDLSPP

SEQ ID NO: 699819 - protein, 9 aa, Homo Sapiens
IIVFQPQKN

SEQ ID NO: 699820 - protein, 9 aa, Homo Sapiens
EVIRPGFPP

SEQ ID NO: 699821 - protein, 9 aa, Homo Sapiens
NLIGISIGR

SEQ ID NO: 699822 - protein, 9 aa, Homo Sapiens
PIESSILSD

SEQ ID NO: 699823 - protein, 9 aa, Homo Sapiens
EVDFHHRQE

SEQ ID NO: 699824 - protein, 9 aa, Homo Sapiens
GICTAIKAD

SEQ ID NO: 699825 - protein, 9 aa, Homo Sapiens
GSHEASCPV

SEQ ID NO: 699826 - protein, 9 aa, Homo Sapiens
NHSSIAIQC

SEQ ID NO: 699827 - protein, 9 aa, Homo Sapiens
SPSTTPRPP

SEQ ID NO: 699828 - protein, 9 aa, Homo Sapiens
PAPAPAPPG

SEQ ID NO: 699829 - protein, 9 aa, Homo Sapiens
QDGGTVAAA

SEQ ID NO: 699830 - protein, 9 aa, Homo Sapiens
EVLICKMAA

SEQ ID NO: 699831 - protein, 9 aa, Homo Sapiens
YVNTIPDGF

SEQ ID NO: 699832 - protein, 9 aa, Homo Sapiens
EGVKDVELL

SEQ ID NO: 699833 - protein, 9 aa, Homo Sapiens
PLPGHREAF

SEQ ID NO: 699834 - protein, 9 aa, Homo Sapiens
YSPSSTLWD

SEQ ID NO: 699835 - protein, 9 aa, Homo Sapiens
SPEQELPPA

SEQ ID NO: 699836 - protein, 9 aa, Homo Sapiens
FGHKSGTGQ

SEQ ID NO: 699837 - protein, 9 aa, Homo Sapiens
KRYEGFLRK

SEQ ID NO: 699838 - protein, 9 aa, Homo Sapiens
AEILQEVFG

SEQ ID NO: 699839 - protein, 9 aa, Homo Sapiens
TLPPRFEGK

SEQ ID NO: 699840 - protein, 9 aa, Homo Sapiens
KVHIIVFQP

SEQ ID NO: 699841 - protein, 9 aa, Homo Sapiens
KTHSGMKTS

SEQ ID NO: 699842 - protein, 9 aa, Homo Sapiens
GKGSFGMVC

SEQ ID NO: 699843 - protein, 9 aa, Homo Sapiens
NYTSPSTTP

SEQ ID NO: 699844 - protein, 9 aa, Homo Sapiens
MGNFVTNAH

SEQ ID NO: 699845 - protein, 9 aa, Homo Sapiens
VCQGPSSPP

SEQ ID NO: 699846 - protein, 9 aa, Homo Sapiens
RHLFGQAVK

SEQ ID NO: 699847 - protein, 9 aa, Homo Sapiens
DQIPAVNLD

SEQ ID NO: 699848 - protein, 9 aa, Homo Sapiens
SRLLDLLLR

SEQ ID NO: 699849 - protein, 9 aa, Homo Sapiens
QKTHSGMKT

SEQ ID NO: 699850 - protein, 9 aa, Homo Sapiens
AKTFSNCTS

SEQ ID NO: 699851 - protein, 9 aa, Homo Sapiens
LVPQNTLSW

SEQ ID NO: 699852 - protein, 9 aa, Homo Sapiens
QTRKVQLVL

SEQ ID NO: 699853 - protein, 9 aa, Homo Sapiens
FRHLFGQAV

SEQ ID NO: 699854 - protein, 9 aa, Homo Sapiens
LNLRNDLQA

SEQ ID NO: 699855 - protein, 9 aa, Homo Sapiens
SMTSSACFS

SEQ ID NO: 699856 - protein, 9 aa, Homo Sapiens
SAPELPQRR

SEQ ID NO: 699857 - protein, 9 aa, Homo Sapiens
QLVKSVLPF

SEQ ID NO: 699858 - protein, 9 aa, Homo Sapiens
PALGLLECV

SEQ ID NO: 699859 - protein, 9 aa, Homo Sapiens
SEVIRPGFP

SEQ ID NO: 699860 - protein, 9 aa, Homo Sapiens
LQGFEPPAY

SEQ ID NO: 699861 - protein, 9 aa, Homo Sapiens
HGLVVQCLE

SEQ ID NO: 699862 - protein, 9 aa, Homo Sapiens
AKYAEMARE

SEQ ID NO: 699863 - protein, 9 aa, Homo Sapiens
DAADSLSWH

SEQ ID NO: 699864 - protein, 9 aa, Homo Sapiens
SPAPGLACG

SEQ ID NO: 699865 - protein, 9 aa, Homo Sapiens
ITVWEPLDF

SEQ ID NO: 699866 - protein, 9 aa, Homo Sapiens
DLTDRNIFD

SEQ ID NO: 699867 - protein, 9 aa, Homo Sapiens
AYERTELTL

SEQ ID NO: 699868 - protein, 9 aa, Homo Sapiens
RYLFIQKLW

SEQ ID NO: 699869 - protein, 9 aa, Homo Sapiens
LTGLSQTRK

SEQ ID NO: 699870 - protein, 9 aa, Homo Sapiens
SNAGSPDIH

SEQ ID NO: 699871 - protein, 9 aa, Homo Sapiens
LNISSLLPK

SEQ ID NO: 699872 - protein, 9 aa, Homo Sapiens
SLMSHQRVH

SEQ ID NO: 699873 - protein, 9 aa, Homo Sapiens
ACGDRPPSV

SEQ ID NO: 699874 - protein, 9 aa, Homo Sapiens
TFSALPSPV

SEQ ID NO: 699875 - protein, 9 aa, Homo Sapiens
CFEGKPWGN

SEQ ID NO: 699876 - protein, 9 aa, Homo Sapiens
KPLHHTIIM

SEQ ID NO: 699877 - protein, 9 aa, Homo Sapiens
MKILMSMKS

SEQ ID NO: 699878 - protein, 9 aa, Homo Sapiens
PAASHTPEI

SEQ ID NO: 699879 - protein, 9 aa, Homo Sapiens
GVATPGRPW

SEQ ID NO: 699880 - protein, 9 aa, Homo Sapiens
GLPCSFSWR

SEQ ID NO: 699881 - protein, 9 aa, Homo Sapiens
RERSWRLQV

SEQ ID NO: 699882 - protein, 9 aa, Homo Sapiens
ASTHEQSES

SEQ ID NO: 699883 - protein, 9 aa, Homo Sapiens
QINVEDVQN

SEQ ID NO: 699884 - protein, 9 aa, Homo Sapiens
FRVKIRALI

SEQ ID NO: 699885 - protein, 9 aa, Homo Sapiens
VAICKPLHH

SEQ ID NO: 699886 - protein, 9 aa, Homo Sapiens
CLNIRLYAG

SEQ ID NO: 699887 - protein, 9 aa, Homo Sapiens
NLTANDGYF

SEQ ID NO: 699888 - protein, 9 aa, Homo Sapiens
QRSEEDEWA

SEQ ID NO: 699889 - protein, 9 aa, Homo Sapiens
LMWEAFSYV

SEQ ID NO: 699890 - protein, 9 aa, Homo Sapiens
SPSAQPAEV

SEQ ID NO: 699891 - protein, 9 aa, Homo Sapiens
TKYKRIHTG

SEQ ID NO: 699892 - protein, 9 aa, Homo Sapiens
EGTASIEVN

SEQ ID NO: 699893 - protein, 9 aa, Homo Sapiens
RNSLHRKTP

SEQ ID NO: 699894 - protein, 9 aa, Homo Sapiens
ICLLSHWSF

SEQ ID NO: 699895 - protein, 9 aa, Homo Sapiens
KCLTGEKGV

SEQ ID NO: 699896 - protein, 9 aa, Homo Sapiens
VDEEHSSPL

SEQ ID NO: 699897 - protein, 9 aa, Homo Sapiens
RVFEVALPE

SEQ ID NO: 699898 - protein, 9 aa, Homo Sapiens
GMINEKPMK

SEQ ID NO: 699899 - protein, 9 aa, Homo Sapiens
CASQLTAII

SEQ ID NO: 699900 - protein, 9 aa, Homo Sapiens
LPEFNQDTF

SEQ ID NO: 699901 - protein, 9 aa, Homo Sapiens
SCTFIQTAN

SEQ ID NO: 699902 - protein, 9 aa, Homo Sapiens
GRPRNQGVM

SEQ ID NO: 699903 - protein, 9 aa, Homo Sapiens
FISICDLWL

SEQ ID NO: 699904 - protein, 9 aa, Homo Sapiens
NSMESGRPP

SEQ ID NO: 699905 - protein, 9 aa, Homo Sapiens
HSRLLDLLL

SEQ ID NO: 699906 - protein, 9 aa, Homo Sapiens
PTRIRFLNV

SEQ ID NO: 699907 - protein, 9 aa, Homo Sapiens
PSIVGRPRN

SEQ ID NO: 699908 - protein, 9 aa, Homo Sapiens
NPKLEIPLF

SEQ ID NO: 699909 - protein, 9 aa, Homo Sapiens
GTVELRRPR

SEQ ID NO: 699910 - protein, 9 aa, Homo Sapiens
QVFFYLPVC

SEQ ID NO: 699911 - protein, 9 aa, Homo Sapiens
KLTLEERTP

SEQ ID NO: 699912 - protein, 9 aa, Homo Sapiens
WAIALGLGL

SEQ ID NO: 699913 - protein, 9 aa, Homo Sapiens
DKEKLIKEK

SEQ ID NO: 699914 - protein, 9 aa, Homo Sapiens
EPVFILTGR

SEQ ID NO: 699915 - protein, 9 aa, Homo Sapiens
DADDEEAGP

SEQ ID NO: 699916 - protein, 9 aa, Homo Sapiens
PLGLNDRGI

SEQ ID NO: 699917 - protein, 9 aa, Homo Sapiens
AGLHWYHGT

SEQ ID NO: 699918 - protein, 9 aa, Homo Sapiens
DQEFGFDVV

SEQ ID NO: 699919 - protein, 9 aa, Homo Sapiens
VFFSGSFAS

SEQ ID NO: 699920 - protein, 9 aa, Homo Sapiens
CQGPSSPPC

SEQ ID NO: 699921 - protein, 9 aa, Homo Sapiens
PEGLRRLHG

SEQ ID NO: 699922 - protein, 9 aa, Homo Sapiens
ADERQESEE

SEQ ID NO: 699923 - protein, 9 aa, Homo Sapiens
KGKRLLLYI

SEQ ID NO: 699924 - protein, 9 aa, Homo Sapiens
LFNLGFIIT

SEQ ID NO: 699925 - protein, 9 aa, Homo Sapiens
FSTCASQLT

SEQ ID NO: 699926 - protein, 9 aa, Homo Sapiens
QQSYNHSPY

SEQ ID NO: 699927 - protein, 9 aa, Homo Sapiens
PSVIFMDEI

SEQ ID NO: 699928 - protein, 9 aa, Homo Sapiens
LSVMKDYML

SEQ ID NO: 699929 - protein, 9 aa, Homo Sapiens
TNYTSPSTT

SEQ ID NO: 699930 - protein, 9 aa, Homo Sapiens
RREERWQAD

SEQ ID NO: 699931 - protein, 9 aa, Homo Sapiens
PFQVEQLAQ

SEQ ID NO: 699932 - protein, 9 aa, Homo Sapiens
LVVSPLLSF

SEQ ID NO: 699933 - protein, 9 aa, Homo Sapiens
SYQDSLWAS

SEQ ID NO: 699934 - protein, 9 aa, Homo Sapiens
TDPFMLQCT

SEQ ID NO: 699935 - protein, 9 aa, Homo Sapiens
GLFNLGFII

SEQ ID NO: 699936 - protein, 9 aa, Homo Sapiens
RIFIMGGDT

SEQ ID NO: 699937 - protein, 9 aa, Homo Sapiens
AYCANLAIY

SEQ ID NO: 699938 - protein, 9 aa, Homo Sapiens
LPGFCSFRY

SEQ ID NO: 699939 - protein, 9 aa, Homo Sapiens
TREDYIEFA

SEQ ID NO: 699940 - protein, 9 aa, Homo Sapiens
VYFSDVKPQ

SEQ ID NO: 699941 - protein, 9 aa, Homo Sapiens
RKKMSAKKA

SEQ ID NO: 699942 - protein, 9 aa, Homo Sapiens
TLVYFSDVK

SEQ ID NO: 699943 - protein, 9 aa, Homo Sapiens
TLATKFCLR

SEQ ID NO: 699944 - protein, 9 aa, Homo Sapiens
LENYHTEKG

SEQ ID NO: 699945 - protein, 9 aa, Homo Sapiens
LQTLATKFC

SEQ ID NO: 699946 - protein, 9 aa, Homo Sapiens
YTSPSTTPR

SEQ ID NO: 699947 - protein, 9 aa, Homo Sapiens
ACVLSLLNT

SEQ ID NO: 699948 - protein, 9 aa, Homo Sapiens
NFLPWNKGS

SEQ ID NO: 699949 - protein, 9 aa, Homo Sapiens
IPTLVYFSD

SEQ ID NO: 699950 - protein, 9 aa, Homo Sapiens
EALTSLAEQ

SEQ ID NO: 699951 - protein, 9 aa, Homo Sapiens
VLNAIRRLR

SEQ ID NO: 699952 - protein, 9 aa, Homo Sapiens
NEKPMKILM

SEQ ID NO: 699953 - protein, 9 aa, Homo Sapiens
RLIYFYVNT

SEQ ID NO: 699954 - protein, 9 aa, Homo Sapiens
SSTLWDSPL

SEQ ID NO: 699955 - protein, 9 aa, Homo Sapiens
WMAALVEAE

SEQ ID NO: 699956 - protein, 9 aa, Homo Sapiens
VHIIVFQPQ

SEQ ID NO: 699957 - protein, 9 aa, Homo Sapiens
HRQEALVRT

SEQ ID NO: 699958 - protein, 9 aa, Homo Sapiens
DNQDKDTGV

SEQ ID NO: 699959 - protein, 9 aa, Homo Sapiens
NCTSHLTAV

SEQ ID NO: 699960 - protein, 9 aa, Homo Sapiens
PAKVAPFIN

SEQ ID NO: 699961 - protein, 9 aa, Homo Sapiens
RLLDLLLRG

SEQ ID NO: 699962 - protein, 9 aa, Homo Sapiens
LAKSKSSHM

SEQ ID NO: 699963 - protein, 9 aa, Homo Sapiens
QNFTLDGSS

SEQ ID NO: 699964 - protein, 9 aa, Homo Sapiens
EEKPCKCQE

SEQ ID NO: 699965 - protein, 9 aa, Homo Sapiens
MKTSGCNEG

SEQ ID NO: 699966 - protein, 9 aa, Homo Sapiens
LQVYVNNSE

SEQ ID NO: 699967 - protein, 9 aa, Homo Sapiens
WAIQPGGSK

SEQ ID NO: 699968 - protein, 9 aa, Homo Sapiens
EYLDTYYTL

SEQ ID NO: 699969 - protein, 9 aa, Homo Sapiens
LSTQPRDLS

SEQ ID NO: 699970 - protein, 9 aa, Homo Sapiens
QLALINASM

SEQ ID NO: 699971 - protein, 9 aa, Homo Sapiens
VANFEPDEN

SEQ ID NO: 699972 - protein, 9 aa, Homo Sapiens
PPPGHTTCR

SEQ ID NO: 699973 - protein, 9 aa, Homo Sapiens
TAWKNRDIT

SEQ ID NO: 699974 - protein, 9 aa, Homo Sapiens
PYRKSPPEH

SEQ ID NO: 699975 - protein, 9 aa, Homo Sapiens
TTGKVDVIN

SEQ ID NO: 699976 - protein, 9 aa, Homo Sapiens
TSGNWLTPN

SEQ ID NO: 699977 - protein, 9 aa, Homo Sapiens
NAHLGCVND

SEQ ID NO: 699978 - protein, 9 aa, Homo Sapiens
YKRRNSELF

SEQ ID NO: 699979 - protein, 9 aa, Homo Sapiens
PPSAMTLST

SEQ ID NO: 699980 - protein, 9 aa, Homo Sapiens
EQRAVGVAD

SEQ ID NO: 699981 - protein, 9 aa, Homo Sapiens
HAEILQEVF

SEQ ID NO: 699982 - protein, 9 aa, Homo Sapiens
ELRRPRQSH

SEQ ID NO: 699983 - protein, 9 aa, Homo Sapiens
VKNDDKNSQ

SEQ ID NO: 699984 - protein, 9 aa, Homo Sapiens
LGSIFGPVL

SEQ ID NO: 699985 - protein, 9 aa, Homo Sapiens
MKQMNVAHH

SEQ ID NO: 699986 - protein, 9 aa, Homo Sapiens
HCELRPAPS

SEQ ID NO: 699987 - protein, 9 aa, Homo Sapiens
HFFLCLNIR

SEQ ID NO: 699988 - protein, 9 aa, Homo Sapiens
LLEYFRNNR

SEQ ID NO: 699989 - protein, 9 aa, Homo Sapiens
QMQESTRVF

SEQ ID NO: 699990 - protein, 9 aa, Homo Sapiens
GSYQDSLWA

SEQ ID NO: 699991 - protein, 9 aa, Homo Sapiens
EQELPPAAA

SEQ ID NO: 699992 - protein, 9 aa, Homo Sapiens
LLPSVTDAS

SEQ ID NO: 699993 - protein, 9 aa, Homo Sapiens
LLNLKEHAS

SEQ ID NO: 699994 - protein, 9 aa, Homo Sapiens
IVGRPRNQG

SEQ ID NO: 699995 - protein, 9 aa, Homo Sapiens
QKYWPMYVV

SEQ ID NO: 699996 - protein, 9 aa, Homo Sapiens
SNKTLAIFY

SEQ ID NO: 699997 - protein, 9 aa, Homo Sapiens
VSINMCAII

SEQ ID NO: 699998 - protein, 9 aa, Homo Sapiens
DMVITIGVI

SEQ ID NO: 699999 - protein, 9 aa, Homo Sapiens
SLAEQCAKA

SEQ ID NO: 700000 - protein, 9 aa, Homo Sapiens
IAKSEACNL

SEQ ID NO: 700001 - protein, 9 aa, Homo Sapiens
GNFVTNAHL

SEQ ID NO: 700002 - protein, 9 aa, Homo Sapiens
ASHTPEIQA

SEQ ID NO: 700003 - protein, 9 aa, Homo Sapiens
MCEAVMILR

SEQ ID NO: 700004 - protein, 9 aa, Homo Sapiens
PRQSHAAVL

SEQ ID NO: 700005 - protein, 9 aa, Homo Sapiens
SRAFALLGW

SEQ ID NO: 700006 - protein, 9 aa, Homo Sapiens
SPLTSLSEL

SEQ ID NO: 700007 - protein, 9 aa, Homo Sapiens
NKPQSLHTK

SEQ ID NO: 700008 - protein, 9 aa, Homo Sapiens
DTYYTLTIK

SEQ ID NO: 700009 - protein, 9 aa, Homo Sapiens
LRMNSDKFV

SEQ ID NO: 700010 - protein, 9 aa, Homo Sapiens
SFFSFLVSQ

SEQ ID NO: 700011 - protein, 9 aa, Homo Sapiens
SKKNFSGDL

SEQ ID NO: 700012 - protein, 9 aa, Homo Sapiens
AASHTPEIQ

SEQ ID NO: 700013 - protein, 9 aa, Homo Sapiens
LGLNDRGIV

SEQ ID NO: 700014 - protein, 9 aa, Homo Sapiens
RNSISMIRP

SEQ ID NO: 700015 - protein, 9 aa, Homo Sapiens
NDKVCLISQ

SEQ ID NO: 700016 - protein, 9 aa, Homo Sapiens
DNPIESSIL

SEQ ID NO: 700017 - protein, 9 aa, Homo Sapiens
GHTVDLRSP

SEQ ID NO: 700018 - protein, 9 aa, Homo Sapiens
EEKAKYAEM

SEQ ID NO: 700019 - protein, 9 aa, Homo Sapiens
DLSWILPAP

SEQ ID NO: 700020 - protein, 9 aa, Homo Sapiens
RKFRVKIRA

SEQ ID NO: 700021 - protein, 9 aa, Homo Sapiens
LFGVADILC

SEQ ID NO: 700022 - protein, 9 aa, Homo Sapiens
KSTFDIKSM

SEQ ID NO: 700023 - protein, 9 aa, Homo Sapiens
AKKPYRKSP

SEQ ID NO: 700024 - protein, 9 aa, Homo Sapiens
TTPSPAPTG

SEQ ID NO: 700025 - protein, 9 aa, Homo Sapiens
CEIGFIPRP

SEQ ID NO: 700026 - protein, 9 aa, Homo Sapiens
RSRRERSWR

SEQ ID NO: 700027 - protein, 9 aa, Homo Sapiens
RDCLDGSHE

SEQ ID NO: 700028 - protein, 9 aa, Homo Sapiens
EIMLPFSHW

SEQ ID NO: 700029 - protein, 9 aa, Homo Sapiens
TPSPAPTGP

SEQ ID NO: 700030 - protein, 9 aa, Homo Sapiens
MFISTKFQY

SEQ ID NO: 700031 - protein, 9 aa, Homo Sapiens
RDTCDSDSR

SEQ ID NO: 700032 - protein, 9 aa, Homo Sapiens
SIVGRPRNQ

SEQ ID NO: 700033 - protein, 9 aa, Homo Sapiens
QLTETDLRR

SEQ ID NO: 700034 - protein, 9 aa, Homo Sapiens
AFQDHNIVT

SEQ ID NO: 700035 - protein, 9 aa, Homo Sapiens
VLSNFSGRG

SEQ ID NO: 700036 - protein, 9 aa, Homo Sapiens
FSFLVSQDA

SEQ ID NO: 700037 - protein, 9 aa, Homo Sapiens
ERVIAVSMN

SEQ ID NO: 700038 - protein, 9 aa, Homo Sapiens
QIIFALNQT

SEQ ID NO: 700039 - protein, 9 aa, Homo Sapiens
PLQSQTFNR

SEQ ID NO: 700040 - protein, 9 aa, Homo Sapiens
RNEFLRVKK

SEQ ID NO: 700041 - protein, 9 aa, Homo Sapiens
ETQNMAQEK

SEQ ID NO: 700042 - protein, 9 aa, Homo Sapiens
SKFRHLFGQ

SEQ ID NO: 700043 - protein, 9 aa, Homo Sapiens
NQDTFMVLA

SEQ ID NO: 700044 - protein, 9 aa, Homo Sapiens
LCVRETGIG

SEQ ID NO: 700045 - protein, 9 aa, Homo Sapiens
LDGSHEASC

SEQ ID NO: 700046 - protein, 9 aa, Homo Sapiens
RQSKFRHLF

SEQ ID NO: 700047 - protein, 9 aa, Homo Sapiens
LDPFDAQPL

SEQ ID NO: 700048 - protein, 9 aa, Homo Sapiens
PRNQGVMVG

SEQ ID NO: 700049 - protein, 9 aa, Homo Sapiens
RYLCQRYPP

SEQ ID NO: 700050 - protein, 9 aa, Homo Sapiens
VQARKAFSR

SEQ ID NO: 700051 - protein, 9 aa, Homo Sapiens
HLVILFEND

SEQ ID NO: 700052 - protein, 9 aa, Homo Sapiens
QDLLVNVLP

SEQ ID NO: 700053 - protein, 9 aa, Homo Sapiens
TEENTEIRI

SEQ ID NO: 700054 - protein, 9 aa, Homo Sapiens
GHKSGTGQS

SEQ ID NO: 700055 - protein, 9 aa, Homo Sapiens
RFIAKSEAC

SEQ ID NO: 700056 - protein, 9 aa, Homo Sapiens
LTSLAEQCA

SEQ ID NO: 700057 - protein, 9 aa, Homo Sapiens
VLERLSLSC

SEQ ID NO: 700058 - protein, 9 aa, Homo Sapiens
DCVYGKPRT

SEQ ID NO: 700059 - protein, 9 aa, Homo Sapiens
TIPTLVYFS

SEQ ID NO: 700060 - protein, 9 aa, Homo Sapiens
PSPAPTGPF

SEQ ID NO: 700061 - protein, 9 aa, Homo Sapiens
RYNAHIQEV

SEQ ID NO: 700062 - protein, 9 aa, Homo Sapiens
VFSRSTLTK

SEQ ID NO: 700063 - protein, 9 aa, Homo Sapiens
WVPRNSLPS

SEQ ID NO: 700064 - protein, 9 aa, Homo Sapiens
LKDRWGTMK

SEQ ID NO: 700065 - protein, 9 aa, Homo Sapiens
VEPALVSKE

SEQ ID NO: 700066 - protein, 9 aa, Homo Sapiens
NEFLRVKKK

SEQ ID NO: 700067 - protein, 9 aa, Homo Sapiens
SPGGQLAEL

SEQ ID NO: 700068 - protein, 9 aa, Homo Sapiens
FYFGSNCMP

SEQ ID NO: 700069 - protein, 9 aa, Homo Sapiens
TKSVIDYFE

SEQ ID NO: 700070 - protein, 9 aa, Homo Sapiens
ALLREEEKA

SEQ ID NO: 700071 - protein, 9 aa, Homo Sapiens
ASYFLLLQT

SEQ ID NO: 700072 - protein, 9 aa, Homo Sapiens
DLNLLQALR

SEQ ID NO: 700073 - protein, 9 aa, Homo Sapiens
INQDLLVNV

SEQ ID NO: 700074 - protein, 9 aa, Homo Sapiens
GQQQSYNHS

SEQ ID NO: 700075 - protein, 9 aa, Homo Sapiens
RKEQERAAV

SEQ ID NO: 700076 - protein, 9 aa, Homo Sapiens
SRIFIMGGD

SEQ ID NO: 700077 - protein, 9 aa, Homo Sapiens
DYDGSTIPT

SEQ ID NO: 700078 - protein, 9 aa, Homo Sapiens
WILLEDETY

SEQ ID NO: 700079 - protein, 9 aa, Homo Sapiens
PGCGKVFGR

SEQ ID NO: 700080 - protein, 9 aa, Homo Sapiens
IRLRFEKQR

SEQ ID NO: 700081 - protein, 9 aa, Homo Sapiens
RQLSQPAKE

SEQ ID NO: 700082 - protein, 9 aa, Homo Sapiens
HFTNCDLLL

SEQ ID NO: 700083 - protein, 9 aa, Homo Sapiens
SSHMETKSL

SEQ ID NO: 700084 - protein, 9 aa, Homo Sapiens
DGCFPLPGH

SEQ ID NO: 700085 - protein, 9 aa, Homo Sapiens
GSSVLVDGY

SEQ ID NO: 700086 - protein, 9 aa, Homo Sapiens
LVVQCLEPL

SEQ ID NO: 700087 - protein, 9 aa, Homo Sapiens
DYQRDMVIT

SEQ ID NO: 700088 - protein, 9 aa, Homo Sapiens
IFSMNMKST

SEQ ID NO: 700089 - protein, 9 aa, Homo Sapiens
LHSVSPEQG

SEQ ID NO: 700090 - protein, 9 aa, Homo Sapiens
WILPAPPAR

SEQ ID NO: 700091 - protein, 9 aa, Homo Sapiens
KMSAKKAKE

SEQ ID NO: 700092 - protein, 9 aa, Homo Sapiens
SVDKKWNYH

SEQ ID NO: 700093 - protein, 9 aa, Homo Sapiens
FSGDLTTNP

SEQ ID NO: 700094 - protein, 9 aa, Homo Sapiens
FVMSLNNLD

SEQ ID NO: 700095 - protein, 9 aa, Homo Sapiens
STSNLTIRV

SEQ ID NO: 700096 - protein, 9 aa, Homo Sapiens
RRNDVVVVK

SEQ ID NO: 700097 - protein, 9 aa, Homo Sapiens
DRGIVPEPV

SEQ ID NO: 700098 - protein, 9 aa, Homo Sapiens
TRKVQLVLF

SEQ ID NO: 700099 - protein, 9 aa, Homo Sapiens
RKKRLQPSQ

SEQ ID NO: 700100 - protein, 9 aa, Homo Sapiens
RNQGVMVGM

SEQ ID NO: 700101 - protein, 9 aa, Homo Sapiens
PIDALKDLL

SEQ ID NO: 700102 - protein, 9 aa, Homo Sapiens
PQGMGSVID

SEQ ID NO: 700103 - protein, 9 aa, Homo Sapiens
PASSLARPG

SEQ ID NO: 700104 - protein, 9 aa, Homo Sapiens
KPTFSALPS

SEQ ID NO: 700105 - protein, 9 aa, Homo Sapiens
LFLTSPLEI

SEQ ID NO: 700106 - protein, 9 aa, Homo Sapiens
IFYTVITPL

SEQ ID NO: 700107 - protein, 9 aa, Homo Sapiens
KGWILLEDE

SEQ ID NO: 700108 - protein, 9 aa, Homo Sapiens
ASSKSMDCV

SEQ ID NO: 700109 - protein, 9 aa, Homo Sapiens
LITLSGNLC

SEQ ID NO: 700110 - protein, 9 aa, Homo Sapiens
DGSTIPTIK

SEQ ID NO: 700111 - protein, 9 aa, Homo Sapiens
AKKRRRNDV

SEQ ID NO: 700112 - protein, 9 aa, Homo Sapiens
LPPRFEGKS

SEQ ID NO: 700113 - protein, 9 aa, Homo Sapiens
RLHGAGVQI

SEQ ID NO: 700114 - protein, 9 aa, Homo Sapiens
IPPIIKSVV

SEQ ID NO: 700115 - protein, 9 aa, Homo Sapiens
QPGGSKEER

SEQ ID NO: 700116 - protein, 9 aa, Homo Sapiens
NYHTEKGIT

SEQ ID NO: 700117 - protein, 9 aa, Homo Sapiens
PPRFEGKSC

SEQ ID NO: 700118 - protein, 9 aa, Homo Sapiens
KMRNPRFRL

SEQ ID NO: 700119 - protein, 9 aa, Homo Sapiens
SYNHSPYSN

SEQ ID NO: 700120 - protein, 9 aa, Homo Sapiens
TKMRNPRFR

SEQ ID NO: 700121 - protein, 9 aa, Homo Sapiens
ERTPLTLYY

SEQ ID NO: 700122 - protein, 9 aa, Homo Sapiens
VTAFQDHNI

SEQ ID NO: 700123 - protein, 9 aa, Homo Sapiens
REVSGHSKS

SEQ ID NO: 700124 - protein, 9 aa, Homo Sapiens
PSAMTLSTQ

SEQ ID NO: 700125 - protein, 9 aa, Homo Sapiens
SAFSSLGHV

SEQ ID NO: 700126 - protein, 9 aa, Homo Sapiens
SLLQDISDT

SEQ ID NO: 700127 - protein, 9 aa, Homo Sapiens
KYNGYAPYI

SEQ ID NO: 700128 - protein, 9 aa, Homo Sapiens
SSPALELSD

SEQ ID NO: 700129 - protein, 9 aa, Homo Sapiens
SQLTVVFLY

SEQ ID NO: 700130 - protein, 9 aa, Homo Sapiens
MAIYKSMYY

SEQ ID NO: 700131 - protein, 9 aa, Homo Sapiens
PLTSLSELS

SEQ ID NO: 700132 - protein, 9 aa, Homo Sapiens
QLAQLLTGS

SEQ ID NO: 700133 - protein, 9 aa, Homo Sapiens
SPLLSFSGD

SEQ ID NO: 700134 - protein, 9 aa, Homo Sapiens
YWLPNFMYV

SEQ ID NO: 700135 - protein, 9 aa, Homo Sapiens
VSMQADNPI

SEQ ID NO: 700136 - protein, 9 aa, Homo Sapiens
SMAIYKSMY

SEQ ID NO: 700137 - protein, 9 aa, Homo Sapiens
LVDEEHSSP

SEQ ID NO: 700138 - protein, 9 aa, Homo Sapiens
QGFEPPAYE

SEQ ID NO: 700139 - protein, 9 aa, Homo Sapiens
SYVDIGEKI

SEQ ID NO: 700140 - protein, 9 aa, Homo Sapiens
IYLITLSGN

SEQ ID NO: 700141 - protein, 9 aa, Homo Sapiens
TVLVTFSIV

SEQ ID NO: 700142 - protein, 9 aa, Homo Sapiens
FEGKPWGNQ

SEQ ID NO: 700143 - protein, 9 aa, Homo Sapiens
FCANLVLSN

SEQ ID NO: 700144 - protein, 9 aa, Homo Sapiens
ERSVTVGKA

SEQ ID NO: 700145 - protein, 9 aa, Homo Sapiens
NVQARKAFS

SEQ ID NO: 700146 - protein, 9 aa, Homo Sapiens
PSVEPALVS

SEQ ID NO: 700147 - protein, 9 aa, Homo Sapiens
TPMYFFHSH

SEQ ID NO: 700148 - protein, 9 aa, Homo Sapiens
FVLWKDVKS

SEQ ID NO: 700149 - protein, 9 aa, Homo Sapiens
STNYTSPST

SEQ ID NO: 700150 - protein, 9 aa, Homo Sapiens
KKKITERSV

SEQ ID NO: 700151 - protein, 9 aa, Homo Sapiens
LTEKIKELI

SEQ ID NO: 700152 - protein, 9 aa, Homo Sapiens
SDIYLNLRN

SEQ ID NO: 700153 - protein, 9 aa, Homo Sapiens
LFGQAVKND

SEQ ID NO: 700154 - protein, 9 aa, Homo Sapiens
FHSHLSFVD

SEQ ID NO: 700155 - protein, 9 aa, Homo Sapiens
LHRQLSQPA

SEQ ID NO: 700156 - protein, 9 aa, Homo Sapiens
APKVHIIVF

SEQ ID NO: 700157 - protein, 9 aa, Homo Sapiens
CAVAPWKHS

SEQ ID NO: 700158 - protein, 9 aa, Homo Sapiens
SMDCVYGKP

SEQ ID NO: 700159 - protein, 9 aa, Homo Sapiens
PWPPSFSAP

SEQ ID NO: 700160 - protein, 9 aa, Homo Sapiens
TEDFPEPSP

SEQ ID NO: 700161 - protein, 9 aa, Homo Sapiens
AIYLITLSG

SEQ ID NO: 700162 - protein, 9 aa, Homo Sapiens
SDKFVLWKD

SEQ ID NO: 700163 - protein, 9 aa, Homo Sapiens
GTSSNVGYL

SEQ ID NO: 700164 - protein, 9 aa, Homo Sapiens
LDLLLRGGT

SEQ ID NO: 700165 - protein, 9 aa, Homo Sapiens
SGRGGCFFG

SEQ ID NO: 700166 - protein, 9 aa, Homo Sapiens
NILCVRETG

SEQ ID NO: 700167 - protein, 9 aa, Homo Sapiens
YFFFGLFGV

SEQ ID NO: 700168 - protein, 9 aa, Homo Sapiens
GMGNFVTNA

SEQ ID NO: 700169 - protein, 9 aa, Homo Sapiens
QKTKKQEIP

SEQ ID NO: 700170 - protein, 9 aa, Homo Sapiens
FHTPMYFFH

SEQ ID NO: 700171 - protein, 9 aa, Homo Sapiens
LWAIQPGGS

SEQ ID NO: 700172 - protein, 9 aa, Homo Sapiens
SVLVDEEHS

SEQ ID NO: 700173 - protein, 9 aa, Homo Sapiens
FTTVLVTFS

SEQ ID NO: 700174 - protein, 9 aa, Homo Sapiens
DAQPLPAPP

SEQ ID NO: 700175 - protein, 9 aa, Homo Sapiens
LMQLQDELL

SEQ ID NO: 700176 - protein, 9 aa, Homo Sapiens
GRPWPPSFS

SEQ ID NO: 700177 - protein, 9 aa, Homo Sapiens
RQFKNSSYV

SEQ ID NO: 700178 - protein, 9 aa, Homo Sapiens
TNQAEQCLK

SEQ ID NO: 700179 - protein, 9 aa, Homo Sapiens
SLKTENLQQ

SEQ ID NO: 700180 - protein, 9 aa, Homo Sapiens
LGSGGSVSL

SEQ ID NO: 700181 - protein, 9 aa, Homo Sapiens
APSTLRVEL

SEQ ID NO: 700182 - protein, 9 aa, Homo Sapiens
SLQERGGVA

SEQ ID NO: 700183 - protein, 9 aa, Homo Sapiens
ETGDVFRAT

SEQ ID NO: 700184 - protein, 9 aa, Homo Sapiens
PAYERTELT

SEQ ID NO: 700185 - protein, 9 aa, Homo Sapiens
NRLPPKKLP

SEQ ID NO: 700186 - protein, 9 aa, Homo Sapiens
SLSELSVQC

SEQ ID NO: 700187 - protein, 9 aa, Homo Sapiens
KIKELIHMH

SEQ ID NO: 700188 - protein, 9 aa, Homo Sapiens
GRYKCNGCH

SEQ ID NO: 700189 - protein, 9 aa, Homo Sapiens
WLPNFMYVF

SEQ ID NO: 700190 - protein, 9 aa, Homo Sapiens
EEEKLRKKM

SEQ ID NO: 700191 - protein, 9 aa, Homo Sapiens
INIRNGILS

SEQ ID NO: 700192 - protein, 9 aa, Homo Sapiens
TMSCSESHA

SEQ ID NO: 700193 - protein, 9 aa, Homo Sapiens
TCDSDSRGL

SEQ ID NO: 700194 - protein, 9 aa, Homo Sapiens
LLFSNFTGS

SEQ ID NO: 700195 - protein, 9 aa, Homo Sapiens
CEKEVQVLL

SEQ ID NO: 700196 - protein, 9 aa, Homo Sapiens
GVDETGDVF

SEQ ID NO: 700197 - protein, 9 aa, Homo Sapiens
VKCLTGEKG

SEQ ID NO: 700198 - protein, 9 aa, Homo Sapiens
DPTLAEIPR

SEQ ID NO: 700199 - protein, 9 aa, Homo Sapiens
RMFGTNRNS

SEQ ID NO: 700200 - protein, 9 aa, Homo Sapiens
TKGLKKSVC

SEQ ID NO: 700201 - protein, 9 aa, Homo Sapiens
GYIIGIYRI

SEQ ID NO: 700202 - protein, 9 aa, Homo Sapiens
FMKQMNVAH

SEQ ID NO: 700203 - protein, 9 aa, Homo Sapiens
EDFNSRLIG

SEQ ID NO: 700204 - protein, 9 aa, Homo Sapiens
CNCSPCWLK

SEQ ID NO: 700205 - protein, 9 aa, Homo Sapiens
HLNISSLLP

SEQ ID NO: 700206 - protein, 9 aa, Homo Sapiens
PRDLSPPPG

SEQ ID NO: 700207 - protein, 9 aa, Homo Sapiens
IPAVNLDAD

SEQ ID NO: 700208 - protein, 9 aa, Homo Sapiens
HEGYGIEDD

SEQ ID NO: 700209 - protein, 9 aa, Homo Sapiens
DKFVLWKDV

SEQ ID NO: 700210 - protein, 9 aa, Homo Sapiens
GDHQKKVTP

SEQ ID NO: 700211 - protein, 9 aa, Homo Sapiens
FRAPPVFPN

SEQ ID NO: 700212 - protein, 9 aa, Homo Sapiens
NLVLSNFSG

SEQ ID NO: 700213 - protein, 9 aa, Homo Sapiens
DDEDADDEE

SEQ ID NO: 700214 - protein, 9 aa, Homo Sapiens
RGRIAEASV

SEQ ID NO: 700215 - protein, 9 aa, Homo Sapiens
VKKHNEHFE

SEQ ID NO: 700216 - protein, 9 aa, Homo Sapiens
SVIFMDEID

SEQ ID NO: 700217 - protein, 9 aa, Homo Sapiens
GGLPCSFSW

SEQ ID NO: 700218 - protein, 9 aa, Homo Sapiens
HSPYSNYGP

SEQ ID NO: 700219 - protein, 9 aa, Homo Sapiens
VASLSPADI

SEQ ID NO: 700220 - protein, 9 aa, Homo Sapiens
IRALISPSC

SEQ ID NO: 700221 - protein, 9 aa, Homo Sapiens
TQHFFLCLN

SEQ ID NO: 700222 - protein, 9 aa, Homo Sapiens
KKPYRKSPP

SEQ ID NO: 700223 - protein, 9 aa, Homo Sapiens
SLPSDLLEN

SEQ ID NO: 700224 - protein, 9 aa, Homo Sapiens
LSGNLCMIL

SEQ ID NO: 700225 - protein, 9 aa, Homo Sapiens
GPGDGCFPL

SEQ ID NO: 700226 - protein, 9 aa, Homo Sapiens
FHHRQEALV

SEQ ID NO: 700227 - protein, 9 aa, Homo Sapiens
FSNCTSHLT

SEQ ID NO: 700228 - protein, 9 aa, Homo Sapiens
MNVAHHGGW

SEQ ID NO: 700229 - protein, 9 aa, Homo Sapiens
PRNSLPSDL

SEQ ID NO: 700230 - protein, 9 aa, Homo Sapiens
CYDLDHRGT

SEQ ID NO: 700231 - protein, 9 aa, Homo Sapiens
DLKTSTEDE

SEQ ID NO: 700232 - protein, 9 aa, Homo Sapiens
WNKGSRDQE

SEQ ID NO: 700233 - protein, 9 aa, Homo Sapiens
YIGFLSSRE

SEQ ID NO: 700234 - protein, 9 aa, Homo Sapiens
ANLAIYIYQ

SEQ ID NO: 700235 - protein, 9 aa, Homo Sapiens
APAPPTEDF

SEQ ID NO: 700236 - protein, 9 aa, Homo Sapiens
DLRSPAGAR

SEQ ID NO: 700237 - protein, 9 aa, Homo Sapiens
SLWLVLQVM

SEQ ID NO: 700238 - protein, 9 aa, Homo Sapiens
ILENYHTEK

SEQ ID NO: 700239 - protein, 9 aa, Homo Sapiens
GGRLGRGMK

SEQ ID NO: 700240 - protein, 9 aa, Homo Sapiens
LDQIPAVNL

SEQ ID NO: 700241 - protein, 9 aa, Homo Sapiens
IRRLKGWIL

SEQ ID NO: 700242 - protein, 9 aa, Homo Sapiens
GKWWCFRLS

SEQ ID NO: 700243 - protein, 9 aa, Homo Sapiens
ERHGLVVQC

SEQ ID NO: 700244 - protein, 9 aa, Homo Sapiens
LKGWILLED

SEQ ID NO: 700245 - protein, 9 aa, Homo Sapiens
VMLKDRWGT

SEQ ID NO: 700246 - protein, 9 aa, Homo Sapiens
DGYIIGIYR

SEQ ID NO: 700247 - protein, 9 aa, Homo Sapiens
KTYVQSADG

SEQ ID NO: 700248 - protein, 9 aa, Homo Sapiens
DGSSVLVDG

SEQ ID NO: 700249 - protein, 9 aa, Homo Sapiens
EKLIKEKDK

SEQ ID NO: 700250 - protein, 9 aa, Homo Sapiens
NGMINEKPM

SEQ ID NO: 700251 - protein, 9 aa, Homo Sapiens
QEIDYWGID

SEQ ID NO: 700252 - protein, 9 aa, Homo Sapiens
LQALRQFLW

SEQ ID NO: 700253 - protein, 9 aa, Homo Sapiens
NGYAPYIGF

SEQ ID NO: 700254 - protein, 9 aa, Homo Sapiens
STLTKYKRI

SEQ ID NO: 700255 - protein, 9 aa, Homo Sapiens
PTEDFPEPS

SEQ ID NO: 700256 - protein, 9 aa, Homo Sapiens
ILTGRKEDV

SEQ ID NO: 700257 - protein, 9 aa, Homo Sapiens
HGYAKVIKK

SEQ ID NO: 700258 - protein, 9 aa, Homo Sapiens
LQVGPSPSW

SEQ ID NO: 700259 - protein, 9 aa, Homo Sapiens
LPPKKLPGF

SEQ ID NO: 700260 - protein, 9 aa, Homo Sapiens
LAAHCVWPC

SEQ ID NO: 700261 - protein, 9 aa, Homo Sapiens
AIQCVTRSQ

SEQ ID NO: 700262 - protein, 9 aa, Homo Sapiens
NQGVMVGMG

SEQ ID NO: 700263 - protein, 9 aa, Homo Sapiens
EEALELRAA

SEQ ID NO: 700264 - protein, 9 aa, Homo Sapiens
ADTREDYIE

SEQ ID NO: 700265 - protein, 9 aa, Homo Sapiens
SPCLLPGFV

SEQ ID NO: 700266 - protein, 9 aa, Homo Sapiens
SRYLPGINI

SEQ ID NO: 700267 - protein, 9 aa, Homo Sapiens
PPGTPVKQE

SEQ ID NO: 700268 - protein, 9 aa, Homo Sapiens
YSFEFGKRF

SEQ ID NO: 700269 - protein, 9 aa, Homo Sapiens
SNSVEKAVS

SEQ ID NO: 700270 - protein, 9 aa, Homo Sapiens
LPFASETLK

SEQ ID NO: 700271 - protein, 9 aa, Homo Sapiens
NITKSVIDY

SEQ ID NO: 700272 - protein, 9 aa, Homo Sapiens
YFGSNCMPI

SEQ ID NO: 700273 - protein, 9 aa, Homo Sapiens
DKLSKKNFS

SEQ ID NO: 700274 - protein, 9 aa, Homo Sapiens
NAKKDFFLN

SEQ ID NO: 700275 - protein, 9 aa, Homo Sapiens
YAPYIGFLS

SEQ ID NO: 700276 - protein, 9 aa, Homo Sapiens
VAHHGGWTT

SEQ ID NO: 700277 - protein, 9 aa, Homo Sapiens
DSLWASIRQ

SEQ ID NO: 700278 - protein, 9 aa, Homo Sapiens
CLDGSHEAS

SEQ ID NO: 700279 - protein, 9 aa, Homo Sapiens
RYLPGINIR

SEQ ID NO: 700280 - protein, 9 aa, Homo Sapiens
SSSPSAQPA

SEQ ID NO: 700281 - protein, 9 aa, Homo Sapiens
SQAKTFSNC

SEQ ID NO: 700282 - protein, 9 aa, Homo Sapiens
HGAGVQIAI

SEQ ID NO: 700283 - protein, 9 aa, Homo Sapiens
VWEPLDFEA

SEQ ID NO: 700284 - protein, 9 aa, Homo Sapiens
IYWADTRED

SEQ ID NO: 700285 - protein, 9 aa, Homo Sapiens
QPEENEIVR

SEQ ID NO: 700286 - protein, 9 aa, Homo Sapiens
YLSCYDFWS

SEQ ID NO: 700287 - protein, 9 aa, Homo Sapiens
LTETDLRRT

SEQ ID NO: 700288 - protein, 9 aa, Homo Sapiens
HGDAADSLS

SEQ ID NO: 700289 - protein, 9 aa, Homo Sapiens
TSSAYRDTC

SEQ ID NO: 700290 - protein, 9 aa, Homo Sapiens
RSRLLEYFR

SEQ ID NO: 700291 - protein, 9 aa, Homo Sapiens
RVERVIAVS

SEQ ID NO: 700292 - protein, 9 aa, Homo Sapiens
ADPHSPFAT

SEQ ID NO: 700293 - protein, 9 aa, Homo Sapiens
SSAGPSDHI

SEQ ID NO: 700294 - protein, 9 aa, Homo Sapiens
TIPPIIKSV

SEQ ID NO: 700295 - protein, 9 aa, Homo Sapiens
RDFSPLQSQ

SEQ ID NO: 700296 - protein, 9 aa, Homo Sapiens
EILQEVFGE

SEQ ID NO: 700297 - protein, 9 aa, Homo Sapiens
EIGFIPRPL

SEQ ID NO: 700298 - protein, 9 aa, Homo Sapiens
DRFAYCANL

SEQ ID NO: 700299 - protein, 9 aa, Homo Sapiens
INVEDVQNR

SEQ ID NO: 700300 - protein, 9 aa, Homo Sapiens
FKFESESEL

SEQ ID NO: 700301 - protein, 9 aa, Homo Sapiens
HHEFYSFEF

SEQ ID NO: 700302 - protein, 9 aa, Homo Sapiens
ELSDLLLLA

SEQ ID NO: 700303 - protein, 9 aa, Homo Sapiens
ALQPTRIRF

SEQ ID NO: 700304 - protein, 9 aa, Homo Sapiens
FSMNMKSTF

SEQ ID NO: 700305 - protein, 9 aa, Homo Sapiens
EAASSAFSS

SEQ ID NO: 700306 - protein, 9 aa, Homo Sapiens
TMYFFFGLF

SEQ ID NO: 700307 - protein, 9 aa, Homo Sapiens
QSLHTKGAE

SEQ ID NO: 700308 - protein, 9 aa, Homo Sapiens
PWGNQTIQA

SEQ ID NO: 700309 - protein, 9 aa, Homo Sapiens
SISMIRPLR

SEQ ID NO: 700310 - protein, 9 aa, Homo Sapiens
RISVAGGTS

SEQ ID NO: 700311 - protein, 9 aa, Homo Sapiens
DPAGTRSRL

SEQ ID NO: 700312 - protein, 9 aa, Homo Sapiens
SWEVDFHHR

SEQ ID NO: 700313 - protein, 9 aa, Homo Sapiens
KFSHNWKLK

SEQ ID NO: 700314 - protein, 9 aa, Homo Sapiens
ECVRGVLSR

SEQ ID NO: 700315 - protein, 9 aa, Homo Sapiens
KSPPEHREL

SEQ ID NO: 700316 - protein, 9 aa, Homo Sapiens
EERWQADPT

SEQ ID NO: 700317 - protein, 9 aa, Homo Sapiens
HGHTVDLRS

SEQ ID NO: 700318 - protein, 9 aa, Homo Sapiens
EEKLRKKMS

SEQ ID NO: 700319 - protein, 9 aa, Homo Sapiens
MDGVPFTLP

SEQ ID NO: 700320 - protein, 9 aa, Homo Sapiens
SEGRYNAHI

SEQ ID NO: 700321 - protein, 9 aa, Homo Sapiens
IPPPYKRRN

SEQ ID NO: 700322 - protein, 9 aa, Homo Sapiens
FTDLNLLQA

SEQ ID NO: 700323 - protein, 9 aa, Homo Sapiens
HRLTPTISE

SEQ ID NO: 700324 - protein, 9 aa, Homo Sapiens
LQINVEDVQ

SEQ ID NO: 700325 - protein, 9 aa, Homo Sapiens
FYSPSSTLW

SEQ ID NO: 700326 - protein, 9 aa, Homo Sapiens
EIASEILQA

SEQ ID NO: 700327 - protein, 9 aa, Homo Sapiens
RHGLVVQCL

SEQ ID NO: 700328 - protein, 9 aa, Homo Sapiens
SPASSLARP

SEQ ID NO: 700329 - protein, 9 aa, Homo Sapiens
DQASARPRV

SEQ ID NO: 700330 - protein, 9 aa, Homo Sapiens
PLLSFSGDG

SEQ ID NO: 700331 - protein, 9 aa, Homo Sapiens
ACHAVAGWY

SEQ ID NO: 700332 - protein, 9 aa, Homo Sapiens
PGLACGDRP

SEQ ID NO: 700333 - protein, 9 aa, Homo Sapiens
PVFILTGRK

SEQ ID NO: 700334 - protein, 9 aa, Homo Sapiens
AFSTCASQL

SEQ ID NO: 700335 - protein, 9 aa, Homo Sapiens
GFYNKPTFS

SEQ ID NO: 700336 - protein, 9 aa, Homo Sapiens
QTLATKFCL

SEQ ID NO: 700337 - protein, 9 aa, Homo Sapiens
AIDRYLCQR

SEQ ID NO: 700338 - protein, 9 aa, Homo Sapiens
LCLNIRLYA

SEQ ID NO: 700339 - protein, 9 aa, Homo Sapiens
FPLPGHREA

SEQ ID NO: 700340 - protein, 9 aa, Homo Sapiens
IGKGSFGMV

SEQ ID NO: 700341 - protein, 9 aa, Homo Sapiens
YKCEECCKA

SEQ ID NO: 700342 - protein, 9 aa, Homo Sapiens
KCFCTLCFI

SEQ ID NO: 700343 - protein, 9 aa, Homo Sapiens
AWRNRTFCT

SEQ ID NO: 700344 - protein, 9 aa, Homo Sapiens
GLNFSQIIF

SEQ ID NO: 700345 - protein, 9 aa, Homo Sapiens
SIGRGAQYC

SEQ ID NO: 700346 - protein, 9 aa, Homo Sapiens
KSVLPFASE

SEQ ID NO: 700347 - protein, 9 aa, Homo Sapiens
ENSEVIRPG

SEQ ID NO: 700348 - protein, 9 aa, Homo Sapiens
VERVIAVSM

SEQ ID NO: 700349 - protein, 9 aa, Homo Sapiens
LLEPFTTPS

SEQ ID NO: 700350 - protein, 9 aa, Homo Sapiens
ASLLNLKEH

SEQ ID NO: 700351 - protein, 9 aa, Homo Sapiens
PENKCFCTL

SEQ ID NO: 700352 - protein, 9 aa, Homo Sapiens
GYGIEDDEY

SEQ ID NO: 700353 - protein, 9 aa, Homo Sapiens
FAEMEIIGL

SEQ ID NO: 700354 - protein, 9 aa, Homo Sapiens
GLKAANYFW

SEQ ID NO: 700355 - protein, 9 aa, Homo Sapiens
YLDTYYTLT

SEQ ID NO: 700356 - protein, 9 aa, Homo Sapiens
TSSACFSLR

SEQ ID NO: 700357 - protein, 9 aa, Homo Sapiens
YRKSPPEHR

SEQ ID NO: 700358 - protein, 9 aa, Homo Sapiens
AAAPTFFVI

SEQ ID NO: 700359 - protein, 9 aa, Homo Sapiens
DPFMLQCTC

SEQ ID NO: 700360 - protein, 9 aa, Homo Sapiens
YHEACHAVA

SEQ ID NO: 700361 - protein, 9 aa, Homo Sapiens
AAGTAASSA

SEQ ID NO: 700362 - protein, 9 aa, Homo Sapiens
QSYNHSPYS

SEQ ID NO: 700363 - protein, 9 aa, Homo Sapiens
AAEEDVLEL

SEQ ID NO: 700364 - protein, 9 aa, Homo Sapiens
LNDRGIVPE

SEQ ID NO: 700365 - protein, 9 aa, Homo Sapiens
SNENSEVIR

SEQ ID NO: 700366 - protein, 9 aa, Homo Sapiens
LVSQDAAPG

SEQ ID NO: 700367 - protein, 9 aa, Homo Sapiens
MRNPRFRLA

SEQ ID NO: 700368 - protein, 9 aa, Homo Sapiens
GCFPLPGHR

SEQ ID NO: 700369 - protein, 9 aa, Homo Sapiens
GLWCEKEVQ

SEQ ID NO: 700370 - protein, 9 aa, Homo Sapiens
SDYQRDMVI

SEQ ID NO: 700371 - protein, 9 aa, Homo Sapiens
QADNPIESS

SEQ ID NO: 700372 - protein, 9 aa, Homo Sapiens
RLRGMVSRL

SEQ ID NO: 700373 - protein, 9 aa, Homo Sapiens
HGRGRYKCN

SEQ ID NO: 700374 - protein, 9 aa, Homo Sapiens
YPGMRSQEM

SEQ ID NO: 700375 - protein, 9 aa, Homo Sapiens
PGDGCFPLP

SEQ ID NO: 700376 - protein, 9 aa, Homo Sapiens
LNTVSGIKG

SEQ ID NO: 700377 - protein, 9 aa, Homo Sapiens
LCPYESRAF

SEQ ID NO: 700378 - protein, 9 aa, Homo Sapiens
FGNSSDYIL

SEQ ID NO: 700379 - protein, 9 aa, Homo Sapiens
IDRYLCQRY

SEQ ID NO: 700380 - protein, 9 aa, Homo Sapiens
LKAANYFWP

SEQ ID NO: 700381 - protein, 9 aa, Homo Sapiens
LAQLLTGSP

SEQ ID NO: 700382 - protein, 9 aa, Homo Sapiens
MQRPGPSLW

SEQ ID NO: 700383 - protein, 9 aa, Homo Sapiens
QPAPAPAPP

SEQ ID NO: 700384 - protein, 9 aa, Homo Sapiens
IAVSMNYRV

SEQ ID NO: 700385 - protein, 9 aa, Homo Sapiens
ICKPLHHTI

SEQ ID NO: 700386 - protein, 9 aa, Homo Sapiens
LWEGGFSYV

SEQ ID NO: 700387 - protein, 9 aa, Homo Sapiens
DRILQINVE

SEQ ID NO: 700388 - protein, 9 aa, Homo Sapiens
HRQLSQPAK

SEQ ID NO: 700389 - protein, 9 aa, Homo Sapiens
SRLLEYFRN

SEQ ID NO: 700390 - protein, 9 aa, Homo Sapiens
GPSLWLVLQ

SEQ ID NO: 700391 - protein, 9 aa, Homo Sapiens
KQSMCEAVM

SEQ ID NO: 700392 - protein, 9 aa, Homo Sapiens
QNVNNDKVC

SEQ ID NO: 700393 - protein, 9 aa, Homo Sapiens
MLLYPPGFS

SEQ ID NO: 700394 - protein, 9 aa, Homo Sapiens
CGKVFGRSE

SEQ ID NO: 700395 - protein, 9 aa, Homo Sapiens
NKCGKAFSV

SEQ ID NO: 700396 - protein, 9 aa, Homo Sapiens
FQKTKKQEI

SEQ ID NO: 700397 - protein, 9 aa, Homo Sapiens
KQRSEEDEW

SEQ ID NO: 700398 - protein, 9 aa, Homo Sapiens
NDGYFLIAT

SEQ ID NO: 700399 - protein, 9 aa, Homo Sapiens
FVTNAHLGC

SEQ ID NO: 700400 - protein, 9 aa, Homo Sapiens
FDFLVKTYP

SEQ ID NO: 700401 - protein, 9 aa, Homo Sapiens
VLVPQNTLS

SEQ ID NO: 700402 - protein, 9 aa, Homo Sapiens
PTLVYFSDV

SEQ ID NO: 700403 - protein, 9 aa, Homo Sapiens
EDDEDDEDA

SEQ ID NO: 700404 - protein, 9 aa, Homo Sapiens
MYFFHSHLS

SEQ ID NO: 700405 - protein, 9 aa, Homo Sapiens
TRCQLYLDE

SEQ ID NO: 700406 - protein, 9 aa, Homo Sapiens
PGKREIQVA

SEQ ID NO: 700407 - protein, 9 aa, Homo Sapiens
TANDGYFLI

SEQ ID NO: 700408 - protein, 9 aa, Homo Sapiens
SLHTKGAEI

SEQ ID NO: 700409 - protein, 9 aa, Homo Sapiens
RPGPSLWLV

SEQ ID NO: 700410 - protein, 9 aa, Homo Sapiens
KPYRKSPPE

SEQ ID NO: 700411 - protein, 9 aa, Homo Sapiens
CVRGVLSRS

SEQ ID NO: 700412 - protein, 9 aa, Homo Sapiens
LPAPPDDGY

SEQ ID NO: 700413 - protein, 9 aa, Homo Sapiens
YWKIYRAAK

SEQ ID NO: 700414 - protein, 9 aa, Homo Sapiens
QLAELHSVS

SEQ ID NO: 700415 - protein, 9 aa, Homo Sapiens
EMLVDITEE

SEQ ID NO: 700416 - protein, 9 aa, Homo Sapiens
TASIEVNAT

SEQ ID NO: 700417 - protein, 9 aa, Homo Sapiens
FFGCAVAPW

SEQ ID NO: 700418 - protein, 9 aa, Homo Sapiens
AAAGTAASS

SEQ ID NO: 700419 - protein, 9 aa, Homo Sapiens
TTPRPPAPG

SEQ ID NO: 700420 - protein, 9 aa, Homo Sapiens
ADNPIESSI

SEQ ID NO: 700421 - protein, 9 aa, Homo Sapiens
VFFGRQPQT

SEQ ID NO: 700422 - protein, 9 aa, Homo Sapiens
KAVCCLSVM

SEQ ID NO: 700423 - protein, 9 aa, Homo Sapiens
PRPLRLENI

SEQ ID NO: 700424 - protein, 9 aa, Homo Sapiens
QAKTFSNCT

SEQ ID NO: 700425 - protein, 9 aa, Homo Sapiens
IGIKPTLID

SEQ ID NO: 700426 - protein, 9 aa, Homo Sapiens
APFINNGSP

SEQ ID NO: 700427 - protein, 9 aa, Homo Sapiens
MWQVTAFQD

SEQ ID NO: 700428 - protein, 9 aa, Homo Sapiens
GKVFGRSEN

SEQ ID NO: 700429 - protein, 9 aa, Homo Sapiens
GKAFSVRSN

SEQ ID NO: 700430 - protein, 9 aa, Homo Sapiens
LACGDRPPS

SEQ ID NO: 700431 - protein, 9 aa, Homo Sapiens
GGTVAAAAP

SEQ ID NO: 700432 - protein, 9 aa, Homo Sapiens
GHSRLLDLL

SEQ ID NO: 700433 - protein, 9 aa, Homo Sapiens
PKVHIIVFQ

SEQ ID NO: 700434 - protein, 9 aa, Homo Sapiens
ERVSERHGL

SEQ ID NO: 700435 - protein, 9 aa, Homo Sapiens
DITEENTEI

SEQ ID NO: 700436 - protein, 9 aa, Homo Sapiens
GSVSLLFSN

SEQ ID NO: 700437 - protein, 9 aa, Homo Sapiens
NHSVDKKWN

SEQ ID NO: 700438 - protein, 9 aa, Homo Sapiens
MVCIVQKRD

SEQ ID NO: 700439 - protein, 9 aa, Homo Sapiens
SVMLKDRWG

SEQ ID NO: 700440 - protein, 9 aa, Homo Sapiens
SSLARPGTP

SEQ ID NO: 700441 - protein, 9 aa, Homo Sapiens
LMTKGLKKS

SEQ ID NO: 700442 - protein, 9 aa, Homo Sapiens
NLAIYIYQL

SEQ ID NO: 700443 - protein, 9 aa, Homo Sapiens
LDPAGTRSR

SEQ ID NO: 700444 - protein, 9 aa, Homo Sapiens
PPAYERTEL

SEQ ID NO: 700445 - protein, 9 aa, Homo Sapiens
NIFDFLVKT

SEQ ID NO: 700446 - protein, 9 aa, Homo Sapiens
RDMVITIGV

SEQ ID NO: 700447 - protein, 9 aa, Homo Sapiens
CVWPCVPGC

SEQ ID NO: 700448 - protein, 9 aa, Homo Sapiens
APYIGFLSS

SEQ ID NO: 700449 - protein, 9 aa, Homo Sapiens
YQASTHEQS

SEQ ID NO: 700450 - protein, 9 aa, Homo Sapiens
REEEKAKYA

SEQ ID NO: 700451 - protein, 9 aa, Homo Sapiens
IYLNLRNDL

SEQ ID NO: 700452 - protein, 9 aa, Homo Sapiens
GHTTCRLTM

SEQ ID NO: 700453 - protein, 9 aa, Homo Sapiens
NKPTFSALP

SEQ ID NO: 700454 - protein, 9 aa, Homo Sapiens
FGCAVAPWK

SEQ ID NO: 700455 - protein, 9 aa, Homo Sapiens
VILFENDRH

SEQ ID NO: 700456 - protein, 9 aa, Homo Sapiens
TMRCPPGSS

SEQ ID NO: 700457 - protein, 9 aa, Homo Sapiens
NFTLDGSSV

SEQ ID NO: 700458 - protein, 9 aa, Homo Sapiens
IQPGGSKEE

SEQ ID NO: 700459 - protein, 9 aa, Homo Sapiens
LDTYYTLTI

SEQ ID NO: 700460 - protein, 9 aa, Homo Sapiens
LIYFYVNTI

SEQ ID NO: 700461 - protein, 9 aa, Homo Sapiens
EKAKYAEMA

SEQ ID NO: 700462 - protein, 9 aa, Homo Sapiens
VIAQAHGYA

SEQ ID NO: 700463 - protein, 9 aa, Homo Sapiens
TVAYHEACH

SEQ ID NO: 700464 - protein, 9 aa, Homo Sapiens
MGKWWCFRL

SEQ ID NO: 700465 - protein, 9 aa, Homo Sapiens
GRTIPTLVY

SEQ ID NO: 700466 - protein, 9 aa, Homo Sapiens
AREVSGHSK

SEQ ID NO: 700467 - protein, 9 aa, Homo Sapiens
QAPVLNAIR

SEQ ID NO: 700468 - protein, 9 aa, Homo Sapiens
THFGKSFRA

SEQ ID NO: 700469 - protein, 9 aa, Homo Sapiens
FILMGFMDN

SEQ ID NO: 700470 - protein, 9 aa, Homo Sapiens
YMFISTKFQ

SEQ ID NO: 700471 - protein, 9 aa, Homo Sapiens
MTELCWVPL

SEQ ID NO: 700472 - protein, 9 aa, Homo Sapiens
PPLKPREVR

SEQ ID NO: 700473 - protein, 9 aa, Homo Sapiens
VGCLCYDLD

SEQ ID NO: 700474 - protein, 9 aa, Homo Sapiens
GGCFFGCAV

SEQ ID NO: 700475 - protein, 9 aa, Homo Sapiens
KARFIAKSE

SEQ ID NO: 700476 - protein, 9 aa, Homo Sapiens
VHKELNFCA

SEQ ID NO: 700477 - protein, 9 aa, Homo Sapiens
SVSLLFSNF

SEQ ID NO: 700478 - protein, 9 aa, Homo Sapiens
AAAAPTFFV

SEQ ID NO: 700479 - protein, 9 aa, Homo Sapiens
NDDKNSQTE

SEQ ID NO: 700480 - protein, 9 aa, Homo Sapiens
LTPAKVAPF

SEQ ID NO: 700481 - protein, 9 aa, Homo Sapiens
KWWCFRLSP

SEQ ID NO: 700482 - protein, 9 aa, Homo Sapiens
SVIDYFEEY

SEQ ID NO: 700483 - protein, 9 aa, Homo Sapiens
SSYVDIGEK

SEQ ID NO: 700484 - protein, 9 aa, Homo Sapiens
VRETGIGKS

SEQ ID NO: 700485 - protein, 9 aa, Homo Sapiens
RKHLWAIQP

SEQ ID NO: 700486 - protein, 9 aa, Homo Sapiens
CNSSCMCGM

SEQ ID NO: 700487 - protein, 9 aa, Homo Sapiens
GGGRLGRGM

SEQ ID NO: 700488 - protein, 9 aa, Homo Sapiens
RLPPKKLPG

SEQ ID NO: 700489 - protein, 9 aa, Homo Sapiens
PFECTHFGK

SEQ ID NO: 700490 - protein, 9 aa, Homo Sapiens
ELPQRRNSL

SEQ ID NO: 700491 - protein, 9 aa, Homo Sapiens
GRISVAGGT

SEQ ID NO: 700492 - protein, 9 aa, Homo Sapiens
FISTKFQYL

SEQ ID NO: 700493 - protein, 9 aa, Homo Sapiens
KTPFQVEQL

SEQ ID NO: 700494 - protein, 9 aa, Homo Sapiens
FFSFLVSQD

SEQ ID NO: 700495 - protein, 9 aa, Homo Sapiens
STLWDSPLV

SEQ ID NO: 700496 - protein, 9 aa, Homo Sapiens
RILQINVED

SEQ ID NO: 700497 - protein, 9 aa, Homo Sapiens
SVKKHNEHF

SEQ ID NO: 700498 - protein, 9 aa, Homo Sapiens
KEKLIKEKD

SEQ ID NO: 700499 - protein, 9 aa, Homo Sapiens
DISFWKKKS

SEQ ID NO: 700500 - protein, 9 aa, Homo Sapiens
IRRLPQGMG

SEQ ID NO: 700501 - protein, 9 aa, Homo Sapiens
QFVSDFLTV

SEQ ID NO: 700502 - protein, 9 aa, Homo Sapiens
CMPIDALKD

SEQ ID NO: 700503 - protein, 9 aa, Homo Sapiens
LLGDHQKKV

SEQ ID NO: 700504 - protein, 9 aa, Homo Sapiens
CGMNRRPIL

SEQ ID NO: 700505 - protein, 9 aa, Homo Sapiens
SGNLCMILL

SEQ ID NO: 700506 - protein, 9 aa, Homo Sapiens
TLTKYKRIH

SEQ ID NO: 700507 - protein, 9 aa, Homo Sapiens
RGIVPEPVQ

SEQ ID NO: 700508 - protein, 9 aa, Homo Sapiens
QLLKETGAT

SEQ ID NO: 700509 - protein, 9 aa, Homo Sapiens
EKAVSSILS

SEQ ID NO: 700510 - protein, 9 aa, Homo Sapiens
LTLQEFVLD

SEQ ID NO: 700511 - protein, 9 aa, Homo Sapiens
TGKVDVINA

SEQ ID NO: 700512 - protein, 9 aa, Homo Sapiens
RIRFLNVHV

SEQ ID NO: 700513 - protein, 9 aa, Homo Sapiens
HKELNFCAN

SEQ ID NO: 700514 - protein, 9 aa, Homo Sapiens
CQSLLQDIS

SEQ ID NO: 700515 - protein, 9 aa, Homo Sapiens
GPSPSWTCF

SEQ ID NO: 700516 - protein, 9 aa, Homo Sapiens
KAVSSILSR

SEQ ID NO: 700517 - protein, 9 aa, Homo Sapiens
YFFHSHLSF

SEQ ID NO: 700518 - protein, 9 aa, Homo Sapiens
FGLFGVADI

SEQ ID NO: 700519 - protein, 9 aa, Homo Sapiens
PRLDQIPAV

SEQ ID NO: 700520 - protein, 9 aa, Homo Sapiens
DERQESEEN

SEQ ID NO: 700521 - protein, 9 aa, Homo Sapiens
PFATKQETP

SEQ ID NO: 700522 - protein, 9 aa, Homo Sapiens
LSDLLLLAG

SEQ ID NO: 700523 - protein, 9 aa, Homo Sapiens
RWGTMKKLK

SEQ ID NO: 700524 - protein, 9 aa, Homo Sapiens
KDPTDPFML

SEQ ID NO: 700525 - protein, 9 aa, Homo Sapiens
TERIYWADT

SEQ ID NO: 700526 - protein, 9 aa, Homo Sapiens
LNFSQIIFA

SEQ ID NO: 700527 - protein, 9 aa, Homo Sapiens
KYLSSADRD

SEQ ID NO: 700528 - protein, 9 aa, Homo Sapiens
QVPDSMTSS

SEQ ID NO: 700529 - protein, 9 aa, Homo Sapiens
PFMLQCTCQ

SEQ ID NO: 700530 - protein, 9 aa, Homo Sapiens
QCLKISASL

SEQ ID NO: 700531 - protein, 9 aa, Homo Sapiens
VLRVQGALS

SEQ ID NO: 700532 - protein, 9 aa, Homo Sapiens
EHAPSVIFM

SEQ ID NO: 700533 - protein, 9 aa, Homo Sapiens
LPNFMYVFT

SEQ ID NO: 700534 - protein, 9 aa, Homo Sapiens
AKNEAAWMA

SEQ ID NO: 700535 - protein, 9 aa, Homo Sapiens
QGQQQSYNH

SEQ ID NO: 700536 - protein, 9 aa, Homo Sapiens
EGKPWGNQT

SEQ ID NO: 700537 - protein, 9 aa, Homo Sapiens
TAAAVLGSR

SEQ ID NO: 700538 - protein, 9 aa, Homo Sapiens
VAYHEACHA

SEQ ID NO: 700539 - protein, 9 aa, Homo Sapiens
FGRQPQTNV

SEQ ID NO: 700540 - protein, 9 aa, Homo Sapiens
ISIGRGAQY

SEQ ID NO: 700541 - protein, 9 aa, Homo Sapiens
KFAKTFLIC

SEQ ID NO: 700542 - protein, 9 aa, Homo Sapiens
IPRPLRLEN

SEQ ID NO: 700543 - protein, 9 aa, Homo Sapiens
VAPWKHSSS

SEQ ID NO: 700544 - protein, 9 aa, Homo Sapiens
KIRRLPQGM

SEQ ID NO: 700545 - protein, 9 aa, Homo Sapiens
SEACYEYKI

SEQ ID NO: 700546 - protein, 9 aa, Homo Sapiens
EASLLNLKE

SEQ ID NO: 700547 - protein, 9 aa, Homo Sapiens
EDLFLTSPL

SEQ ID NO: 700548 - protein, 9 aa, Homo Sapiens
NIFGNSSDY

SEQ ID NO: 700549 - protein, 9 aa, Homo Sapiens
VATPGRPWP

SEQ ID NO: 700550 - protein, 9 aa, Homo Sapiens
TLRVELWDW

SEQ ID NO: 700551 - protein, 9 aa, Homo Sapiens
PSAMMASYF

SEQ ID NO: 700552 - protein, 9 aa, Homo Sapiens
RIAEASVCG

SEQ ID NO: 700553 - protein, 9 aa, Homo Sapiens
DLFLTSPLE

SEQ ID NO: 700554 - protein, 9 aa, Homo Sapiens
TRCSSCNFK

SEQ ID NO: 700555 - protein, 9 aa, Homo Sapiens
ERARAKVKC

SEQ ID NO: 700556 - protein, 9 aa, Homo Sapiens
TSPSTTPRP

SEQ ID NO: 700557 - protein, 9 aa, Homo Sapiens
LHLVILFEN

SEQ ID NO: 700558 - protein, 9 aa, Homo Sapiens
PHLNISSLL

SEQ ID NO: 700559 - protein, 9 aa, Homo Sapiens
WKKKSMIGM

SEQ ID NO: 700560 - protein, 9 aa, Homo Sapiens
LSPLTSLSE

SEQ ID NO: 700561 - protein, 9 aa, Homo Sapiens
MAQEKVAQL

SEQ ID NO: 700562 - protein, 9 aa, Homo Sapiens
DFLTVVPLP

SEQ ID NO: 700563 - protein, 9 aa, Homo Sapiens
PVQVLHRQL

SEQ ID NO: 700564 - protein, 9 aa, Homo Sapiens
SHGCWSQPR

SEQ ID NO: 700565 - protein, 9 aa, Homo Sapiens
HKSGTGQSS

SEQ ID NO: 700566 - protein, 9 aa, Homo Sapiens
SSETFKAFD

SEQ ID NO: 700567 - protein, 9 aa, Homo Sapiens
VVSPLLSFS

SEQ ID NO: 700568 - protein, 9 aa, Homo Sapiens
QEIPRQLVY

SEQ ID NO: 700569 - protein, 9 aa, Homo Sapiens
GKYLMFTTV

SEQ ID NO: 700570 - protein, 9 aa, Homo Sapiens
RYKCNGCHG

SEQ ID NO: 700571 - protein, 9 aa, Homo Sapiens
RPSVEPALV

SEQ ID NO: 700572 - protein, 9 aa, Homo Sapiens
PQRRNSLHR

SEQ ID NO: 700573 - protein, 9 aa, Homo Sapiens
KSMYYGRTW

SEQ ID NO: 700574 - protein, 9 aa, Homo Sapiens
INASMDGLE

SEQ ID NO: 700575 - protein, 9 aa, Homo Sapiens
PALVSKEAT

SEQ ID NO: 700576 - protein, 9 aa, Homo Sapiens
TRIRFLNVH

SEQ ID NO: 700577 - protein, 9 aa, Homo Sapiens
EFLRVKKKM

SEQ ID NO: 700578 - protein, 9 aa, Homo Sapiens
VGVKNSMES

SEQ ID NO: 700579 - protein, 9 aa, Homo Sapiens
GTSMTSGNW

SEQ ID NO: 700580 - protein, 9 aa, Homo Sapiens
ISTKFQYLN

SEQ ID NO: 700581 - protein, 9 aa, Homo Sapiens
CALSFGQEI

SEQ ID NO: 700582 - protein, 9 aa, Homo Sapiens
AILENYHTE

SEQ ID NO: 700583 - protein, 9 aa, Homo Sapiens
EKEEVGSCC

SEQ ID NO: 700584 - protein, 9 aa, Homo Sapiens
RCQLYLDEC

SEQ ID NO: 700585 - protein, 9 aa, Homo Sapiens
YVQKPYRGM

SEQ ID NO: 700586 - protein, 9 aa, Homo Sapiens
MQLKQSMCE

SEQ ID NO: 700587 - protein, 9 aa, Homo Sapiens
LEPVNVQAR

SEQ ID NO: 700588 - protein, 9 aa, Homo Sapiens
PLEIVTQQD

SEQ ID NO: 700589 - protein, 9 aa, Homo Sapiens
CYEYKINGL

SEQ ID NO: 700590 - protein, 9 aa, Homo Sapiens
AREHAPSVI

SEQ ID NO: 700591 - protein, 9 aa, Homo Sapiens
LVLCPYESR

SEQ ID NO: 700592 - protein, 9 aa, Homo Sapiens
PPPSLPGAA

SEQ ID NO: 700593 - protein, 9 aa, Homo Sapiens
DRWGTMKKL

SEQ ID NO: 700594 - protein, 9 aa, Homo Sapiens
GRGMKDVES

SEQ ID NO: 700595 - protein, 9 aa, Homo Sapiens
VPTIYQKAV

SEQ ID NO: 700596 - protein, 9 aa, Homo Sapiens
QLYLDECQS

SEQ ID NO: 700597 - protein, 9 aa, Homo Sapiens
SCNFKFESE

SEQ ID NO: 700598 - protein, 9 aa, Homo Sapiens
IVQLLKETG

SEQ ID NO: 700599 - protein, 9 aa, Homo Sapiens
SHMETKSLS

SEQ ID NO: 700600 - protein, 9 aa, Homo Sapiens
WNYHYLVKW

SEQ ID NO: 700601 - protein, 9 aa, Homo Sapiens
DLVLCPYES

SEQ ID NO: 700602 - protein, 9 aa, Homo Sapiens
VSERHGLVV

SEQ ID NO: 700603 - protein, 9 aa, Homo Sapiens
SSTSDVVRY

SEQ ID NO: 700604 - protein, 9 aa, Homo Sapiens
PLHHTIIMS

SEQ ID NO: 700605 - protein, 9 aa, Homo Sapiens
SVMKDYMLF

SEQ ID NO: 700606 - protein, 9 aa, Homo Sapiens
EDDEDADDE

SEQ ID NO: 700607 - protein, 9 aa, Homo Sapiens
TCASQLTAI

SEQ ID NO: 700608 - protein, 9 aa, Homo Sapiens
ILLEDETYV

SEQ ID NO: 700609 - protein, 9 aa, Homo Sapiens
YKINGLSPR

SEQ ID NO: 700610 - protein, 9 aa, Homo Sapiens
VWPCVPGCQ

SEQ ID NO: 700611 - protein, 9 aa, Homo Sapiens
SAQPAEVLL

SEQ ID NO: 700612 - protein, 9 aa, Homo Sapiens
ICDLWLQLF

SEQ ID NO: 700613 - protein, 9 aa, Homo Sapiens
YVKGVDETG

SEQ ID NO: 700614 - protein, 9 aa, Homo Sapiens
LKETGATIK

SEQ ID NO: 700615 - protein, 9 aa, Homo Sapiens
PKDGKNCQV

SEQ ID NO: 700616 - protein, 9 aa, Homo Sapiens
NQAEQCLKI

SEQ ID NO: 700617 - protein, 9 aa, Homo Sapiens
MNSDKFVLW

SEQ ID NO: 700618 - protein, 9 aa, Homo Sapiens
ANYFWPGSE

SEQ ID NO: 700619 - protein, 9 aa, Homo Sapiens
SSSETFKAF

SEQ ID NO: 700620 - protein, 9 aa, Homo Sapiens
FWSNAGSPD

SEQ ID NO: 700621 - protein, 9 aa, Homo Sapiens
ESGRPPDPA

SEQ ID NO: 700622 - protein, 9 aa, Homo Sapiens
RIVKNDDKN

SEQ ID NO: 700623 - protein, 9 aa, Homo Sapiens
LITVWEPLD

SEQ ID NO: 700624 - protein, 9 aa, Homo Sapiens
FENHRLTPT

SEQ ID NO: 700625 - protein, 9 aa, Homo Sapiens
SGRSRLLEY

SEQ ID NO: 700626 - protein, 9 aa, Homo Sapiens
GMVSRLFPY

SEQ ID NO: 700627 - protein, 9 aa, Homo Sapiens
QRRNSLHRK

SEQ ID NO: 700628 - protein, 9 aa, Homo Sapiens
FYVNTIPDG

SEQ ID NO: 700629 - protein, 9 aa, Homo Sapiens
AWKNRDITM

SEQ ID NO: 700630 - protein, 9 aa, Homo Sapiens
YHGDAADSL

SEQ ID NO: 700631 - protein, 9 aa, Homo Sapiens
SKKPDKEKL

SEQ ID NO: 700632 - protein, 9 aa, Homo Sapiens
FTLPPRFEG

SEQ ID NO: 700633 - protein, 9 aa, Homo Sapiens
NDRGIVPEP

SEQ ID NO: 700634 - protein, 9 aa, Homo Sapiens
SRLIGPLLI

SEQ ID NO: 700635 - protein, 9 aa, Homo Sapiens
IRRCFEGKP

SEQ ID NO: 700636 - protein, 9 aa, Homo Sapiens
QMNVAHHGG

SEQ ID NO: 700637 - protein, 9 aa, Homo Sapiens
GIKPTLIDV

SEQ ID NO: 700638 - protein, 9 aa, Homo Sapiens
ISTKQLTET

SEQ ID NO: 700639 - protein, 9 aa, Homo Sapiens
QASARPRVP

SEQ ID NO: 700640 - protein, 9 aa, Homo Sapiens
PPLSSTSNL

SEQ ID NO: 700641 - protein, 9 aa, Homo Sapiens
LNFLPWNKG

SEQ ID NO: 700642 - protein, 9 aa, Homo Sapiens
KDVELLLPE

SEQ ID NO: 700643 - protein, 9 aa, Homo Sapiens
PDSMTSSAC

SEQ ID NO: 700644 - protein, 9 aa, Homo Sapiens
LLDLLLRGG

SEQ ID NO: 700645 - protein, 9 aa, Homo Sapiens
TIIQKYWPM

SEQ ID NO: 700646 - protein, 9 aa, Homo Sapiens
LEERTPLTL

SEQ ID NO: 700647 - protein, 9 aa, Homo Sapiens
YFQKTKKQE

SEQ ID NO: 700648 - protein, 9 aa, Homo Sapiens
LECVRGVLS

SEQ ID NO: 700649 - protein, 9 aa, Homo Sapiens
TKQETPEVS

SEQ ID NO: 700650 - protein, 9 aa, Homo Sapiens
ALVSKEATA

SEQ ID NO: 700651 - protein, 9 aa, Homo Sapiens
LMFTTVLVT

SEQ ID NO: 700652 - protein, 9 aa, Homo Sapiens
AIALGLGLM

SEQ ID NO: 700653 - protein, 9 aa, Homo Sapiens
LSSTSNLTI

SEQ ID NO: 700654 - protein, 9 aa, Homo Sapiens
RSQEMTKIL

SEQ ID NO: 700655 - protein, 9 aa, Homo Sapiens
VKIRALISP

SEQ ID NO: 700656 - protein, 9 aa, Homo Sapiens
RVSERHGLV

SEQ ID NO: 700657 - protein, 9 aa, Homo Sapiens
MSDLKTSTE

SEQ ID NO: 700658 - protein, 9 aa, Homo Sapiens
TPFQVEQLA

SEQ ID NO: 700659 - protein, 9 aa, Homo Sapiens
GSNLTLQEF

SEQ ID NO: 700660 - protein, 9 aa, Homo Sapiens
QLQNFTLDG

SEQ ID NO: 700661 - protein, 9 aa, Homo Sapiens
QFCLIQTLK

SEQ ID NO: 700662 - protein, 9 aa, Homo Sapiens
NYSVKKHNE

SEQ ID NO: 700663 - protein, 9 aa, Homo Sapiens
KPFECTHFG

SEQ ID NO: 700664 - protein, 9 aa, Homo Sapiens
SAMTLSTQP

SEQ ID NO: 700665 - protein, 9 aa, Homo Sapiens
KELNFCANL

SEQ ID NO: 700666 - protein, 9 aa, Homo Sapiens
QGALSGDAG

SEQ ID NO: 700667 - protein, 9 aa, Homo Sapiens
NFEPDENGQ

SEQ ID NO: 700668 - protein, 9 aa, Homo Sapiens
PFPGPPSRS

SEQ ID NO: 700669 - protein, 9 aa, Homo Sapiens
KPDKEKLIK

SEQ ID NO: 700670 - protein, 9 aa, Homo Sapiens
YNHSPYSNY

SEQ ID NO: 700671 - protein, 9 aa, Homo Sapiens
ESNTSRNNS

SEQ ID NO: 700672 - protein, 9 aa, Homo Sapiens
AKKDFFLNL

SEQ ID NO: 700673 - protein, 9 aa, Homo Sapiens
VEDVQNREE

SEQ ID NO: 700674 - protein, 9 aa, Homo Sapiens
FGWAQNVNN

SEQ ID NO: 700675 - protein, 9 aa, Homo Sapiens
ITSTAWKNR

SEQ ID NO: 700676 - protein, 9 aa, Homo Sapiens
PCKCQECGK

SEQ ID NO: 700677 - protein, 9 aa, Homo Sapiens
KKLVIAHEG

SEQ ID NO: 700678 - protein, 9 aa, Homo Sapiens
SFSQKGSLM

SEQ ID NO: 700679 - protein, 9 aa, Homo Sapiens
DLWLQLFSR

SEQ ID NO: 700680 - protein, 9 aa, Homo Sapiens
SSTEEQYKI

SEQ ID NO: 700681 - protein, 9 aa, Homo Sapiens
LRVQGALSG

SEQ ID NO: 700682 - protein, 9 aa, Homo Sapiens
TVVPLPDPL

SEQ ID NO: 700683 - protein, 9 aa, Homo Sapiens
VQSADGAEA

SEQ ID NO: 700684 - protein, 9 aa, Homo Sapiens
FQVEQLAQL

SEQ ID NO: 700685 - protein, 9 aa, Homo Sapiens
QLTAIILFY

SEQ ID NO: 700686 - protein, 9 aa, Homo Sapiens
VSPLLSFSG

SEQ ID NO: 700687 - protein, 9 aa, Homo Sapiens
LALINASMD

SEQ ID NO: 700688 - protein, 9 aa, Homo Sapiens
EIVRMGKRH

SEQ ID NO: 700689 - protein, 9 aa, Homo Sapiens
WSNAGSPDI

SEQ ID NO: 700690 - protein, 9 aa, Homo Sapiens
IIFALNQTL

SEQ ID NO: 700691 - protein, 9 aa, Homo Sapiens
DNPKLEIPL

SEQ ID NO: 700692 - protein, 9 aa, Homo Sapiens
ESTRVFEVA

SEQ ID NO: 700693 - protein, 9 aa, Homo Sapiens
FPGCGKVFG

SEQ ID NO: 700694 - protein, 9 aa, Homo Sapiens
GAAAGTAAS

SEQ ID NO: 700695 - protein, 9 aa, Homo Sapiens
QESTRVFEV

SEQ ID NO: 700696 - protein, 9 aa, Homo Sapiens
TFKAFDHDS

SEQ ID NO: 700697 - protein, 9 aa, Homo Sapiens
PKKLPGFCS

SEQ ID NO: 700698 - protein, 9 aa, Homo Sapiens
HIIVFQPQK

SEQ ID NO: 700699 - protein, 9 aa, Homo Sapiens
ANVSINMCA

SEQ ID NO: 700700 - protein, 9 aa, Homo Sapiens
EEHSSPLAL

SEQ ID NO: 700701 - protein, 9 aa, Homo Sapiens
TDDQYEVIE

SEQ ID NO: 700702 - protein, 9 aa, Homo Sapiens
LEIVTQQDI

SEQ ID NO: 700703 - protein, 9 aa, Homo Sapiens
RPGFPPNHD

SEQ ID NO: 700704 - protein, 9 aa, Homo Sapiens
SFFDAFRKF

SEQ ID NO: 700705 - protein, 9 aa, Homo Sapiens
TVAAAAPTF

SEQ ID NO: 700706 - protein, 9 aa, Homo Sapiens
VQGALSGDA

SEQ ID NO: 700707 - protein, 9 aa, Homo Sapiens
AQNVNNDKV

SEQ ID NO: 700708 - protein, 9 aa, Homo Sapiens
IIQKYWPMY

SEQ ID NO: 700709 - protein, 9 aa, Homo Sapiens
PRAQAAEED

SEQ ID NO: 700710 - protein, 9 aa, Homo Sapiens
FSVRSNLTI

SEQ ID NO: 700711 - protein, 9 aa, Homo Sapiens
SPSSTLWDS

SEQ ID NO: 700712 - protein, 9 aa, Homo Sapiens
WEVDFHHRQ

SEQ ID NO: 700713 - protein, 9 aa, Homo Sapiens
ERQESEENV

SEQ ID NO: 700714 - protein, 9 aa, Homo Sapiens
VAPFINNGS

SEQ ID NO: 700715 - protein, 9 aa, Homo Sapiens
LNGLNFSQI

SEQ ID NO: 700716 - protein, 9 aa, Homo Sapiens
PYSSSKSAT

SEQ ID NO: 700717 - protein, 9 aa, Homo Sapiens
RYCVFSHEV

SEQ ID NO: 700718 - protein, 9 aa, Homo Sapiens
CCLSVMKDY

SEQ ID NO: 700719 - protein, 9 aa, Homo Sapiens
SSEACYEYK

SEQ ID NO: 700720 - protein, 9 aa, Homo Sapiens
RSWEVDFHH

SEQ ID NO: 700721 - protein, 9 aa, Homo Sapiens
EVGSCCNDS

SEQ ID NO: 700722 - protein, 9 aa, Homo Sapiens
KTRCSSCNF

SEQ ID NO: 700723 - protein, 9 aa, Homo Sapiens
LFISICDLW

SEQ ID NO: 700724 - protein, 9 aa, Homo Sapiens
TAIDRYLCQ

SEQ ID NO: 700725 - protein, 9 aa, Homo Sapiens
FVYWKIYRA

SEQ ID NO: 700726 - protein, 9 aa, Homo Sapiens
PEENEIVRM

SEQ ID NO: 700727 - protein, 9 aa, Homo Sapiens
AAHCVWPCV

SEQ ID NO: 700728 - protein, 9 aa, Homo Sapiens
LESEGRYNA

SEQ ID NO: 700729 - protein, 9 aa, Homo Sapiens
GQEIDYWGI

SEQ ID NO: 700730 - protein, 9 aa, Homo Sapiens
VRGESIPIL

SEQ ID NO: 700731 - protein, 9 aa, Homo Sapiens
LKPREVRKI

SEQ ID NO: 700732 - protein, 9 aa, Homo Sapiens
FTTPSPAPT

SEQ ID NO: 700733 - protein, 9 aa, Homo Sapiens
QHFFLCLNI

SEQ ID NO: 700734 - protein, 9 aa, Homo Sapiens
ALPPHLNIS

SEQ ID NO: 700735 - protein, 9 aa, Homo Sapiens
GHSVLVDEE

SEQ ID NO: 700736 - protein, 9 aa, Homo Sapiens
LINASMDGL

SEQ ID NO: 700737 - protein, 9 aa, Homo Sapiens
SSRLCRSVL

SEQ ID NO: 700738 - protein, 9 aa, Homo Sapiens
YLMFTTVLV

SEQ ID NO: 700739 - protein, 9 aa, Homo Sapiens
FECTHFGKS

SEQ ID NO: 700740 - protein, 9 aa, Homo Sapiens
NKTLAIFYT

SEQ ID NO: 700741 - protein, 9 aa, Homo Sapiens
ERSWRLQVG

SEQ ID NO: 700742 - protein, 9 aa, Homo Sapiens
PAKKPYRKS

SEQ ID NO: 700743 - protein, 9 aa, Homo Sapiens
RNIFGNSSD

SEQ ID NO: 700744 - protein, 9 aa, Homo Sapiens
EGRYNAHIQ

SEQ ID NO: 700745 - protein, 9 aa, Homo Sapiens
IQVAIKTLK

SEQ ID NO: 700746 - protein, 9 aa, Homo Sapiens
TEKIKELIH

SEQ ID NO: 700747 - protein, 9 aa, Homo Sapiens
VAVSVGGLP

SEQ ID NO: 700748 - protein, 9 aa, Homo Sapiens
QAPVTAYDL

SEQ ID NO: 700749 - protein, 9 aa, Homo Sapiens
CLQVYVNNS

SEQ ID NO: 700750 - protein, 9 aa, Homo Sapiens
VSLQERGGV

SEQ ID NO: 700751 - protein, 9 aa, Homo Sapiens
GLVVQCLEP

SEQ ID NO: 700752 - protein, 9 aa, Homo Sapiens
CQECGKAFK

SEQ ID NO: 700753 - protein, 9 aa, Homo Sapiens
PGFSFASLK

SEQ ID NO: 700754 - protein, 9 aa, Homo Sapiens
AIYKSMYYG

SEQ ID NO: 700755 - protein, 9 aa, Homo Sapiens
MSSLYCSLA

SEQ ID NO: 700756 - protein, 9 aa, Homo Sapiens
KKRRRNDVV

SEQ ID NO: 700757 - protein, 9 aa, Homo Sapiens
PSLPGAAIP

SEQ ID NO: 700758 - protein, 9 aa, Homo Sapiens
GTGQSSGYS

SEQ ID NO: 700759 - protein, 9 aa, Homo Sapiens
DGSHEASCP

SEQ ID NO: 700760 - protein, 9 aa, Homo Sapiens
KSEACNLAH

SEQ ID NO: 700761 - protein, 9 aa, Homo Sapiens
LIEDFNSRL

SEQ ID NO: 700762 - protein, 9 aa, Homo Sapiens
CLCYDLDHR

SEQ ID NO: 700763 - protein, 9 aa, Homo Sapiens
HAANSFLVD

SEQ ID NO: 700764 - protein, 9 aa, Homo Sapiens
GCGKVFGRS

SEQ ID NO: 700765 - protein, 9 aa, Homo Sapiens
VLVDEEHSS

SEQ ID NO: 700766 - protein, 9 aa, Homo Sapiens
HSPEEALEL

SEQ ID NO: 700767 - protein, 9 aa, Homo Sapiens
ETDLRRTVE

SEQ ID NO: 700768 - protein, 9 aa, Homo Sapiens
PPKKLPGFC

SEQ ID NO: 700769 - protein, 9 aa, Homo Sapiens
VKRYEGFLR

SEQ ID NO: 700770 - protein, 9 aa, Homo Sapiens
IQKLWEGGF

SEQ ID NO: 700771 - protein, 9 aa, Homo Sapiens
ANDGYFLIA

SEQ ID NO: 700772 - protein, 9 aa, Homo Sapiens
NHRLTPTIS

SEQ ID NO: 700773 - protein, 9 aa, Homo Sapiens
SRKEQERAA

SEQ ID NO: 700774 - protein, 9 aa, Homo Sapiens
MAQGSGEQR

SEQ ID NO: 700775 - protein, 9 aa, Homo Sapiens
RDLSPPPGH

SEQ ID NO: 700776 - protein, 9 aa, Homo Sapiens
AVLGSRIFI

SEQ ID NO: 700777 - protein, 9 aa, Homo Sapiens
YCVFSHEVL

SEQ ID NO: 700778 - protein, 9 aa, Homo Sapiens
VNTIPDGFT

SEQ ID NO: 700779 - protein, 9 aa, Homo Sapiens
FVSDFLTVV

SEQ ID NO: 700780 - protein, 9 aa, Homo Sapiens
VNNDKVCLI

SEQ ID NO: 700781 - protein, 9 aa, Homo Sapiens
LNHEGYGIE

SEQ ID NO: 700782 - protein, 9 aa, Homo Sapiens
YRAAKFRVG

SEQ ID NO: 700783 - protein, 9 aa, Homo Sapiens
AHLGCVNDR

SEQ ID NO: 700784 - protein, 9 aa, Homo Sapiens
SNTSRNNSE

SEQ ID NO: 700785 - protein, 9 aa, Homo Sapiens
NWSSIHNFP

SEQ ID NO: 700786 - protein, 9 aa, Homo Sapiens
TSLKTENLQ

SEQ ID NO: 700787 - protein, 9 aa, Homo Sapiens
YFMKQMNVA

SEQ ID NO: 700788 - protein, 9 aa, Homo Sapiens
IDYWGIDEI

SEQ ID NO: 700789 - protein, 9 aa, Homo Sapiens
DIYLNLRND

SEQ ID NO: 700790 - protein, 9 aa, Homo Sapiens
WSSIHNFPS

SEQ ID NO: 700791 - protein, 9 aa, Homo Sapiens
RPLRLENIR

SEQ ID NO: 700792 - protein, 9 aa, Homo Sapiens
RAKVKCLTG

SEQ ID NO: 700793 - protein, 9 aa, Homo Sapiens
NAIRRLRLR

SEQ ID NO: 700794 - protein, 9 aa, Homo Sapiens
EKEASLLNL

SEQ ID NO: 700795 - protein, 9 aa, Homo Sapiens
ICNCSPCWL

SEQ ID NO: 700796 - protein, 9 aa, Homo Sapiens
LWLQLFSRD

SEQ ID NO: 700797 - protein, 9 aa, Homo Sapiens
EIQASSFDF

SEQ ID NO: 700798 - protein, 9 aa, Homo Sapiens
PARPPLKPR

SEQ ID NO: 700799 - protein, 9 aa, Homo Sapiens
QAHGYAKVI

SEQ ID NO: 700800 - protein, 9 aa, Homo Sapiens
KPCKCQECG

SEQ ID NO: 700801 - protein, 9 aa, Homo Sapiens
ERSNSVEKA

SEQ ID NO: 700802 - protein, 9 aa, Homo Sapiens
VPEIEPRGE

SEQ ID NO: 700803 - protein, 9 aa, Homo Sapiens
GINIRNGIL

SEQ ID NO: 700804 - protein, 9 aa, Homo Sapiens
EKVAQLQVE

SEQ ID NO: 700805 - protein, 9 aa, Homo Sapiens
STLRVELWD

SEQ ID NO: 700806 - protein, 9 aa, Homo Sapiens
SHTPEIQAS

SEQ ID NO: 700807 - protein, 9 aa, Homo Sapiens
YFGTPENKC

SEQ ID NO: 700808 - protein, 9 aa, Homo Sapiens
NIRNGILSN

SEQ ID NO: 700809 - protein, 9 aa, Homo Sapiens
YTNQAEQCL

SEQ ID NO: 700810 - protein, 9 aa, Homo Sapiens
QEYLDTYYT

SEQ ID NO: 700811 - protein, 9 aa, Homo Sapiens
DGSTIPPII

SEQ ID NO: 700812 - protein, 9 aa, Homo Sapiens
VGRPRNQGV

SEQ ID NO: 700813 - protein, 9 aa, Homo Sapiens
YNGYAPYIG

SEQ ID NO: 700814 - protein, 9 aa, Homo Sapiens
LARVERVIA

SEQ ID NO: 700815 - protein, 9 aa, Homo Sapiens
QELPPAAAP

SEQ ID NO: 700816 - protein, 9 aa, Homo Sapiens
LLLRQIAWA

SEQ ID NO: 700817 - protein, 9 aa, Homo Sapiens
FSHNWKLKA

SEQ ID NO: 700818 - protein, 9 aa, Homo Sapiens
HHTIIMSRQ

SEQ ID NO: 700819 - protein, 9 aa, Homo Sapiens
LLECVRGVL

SEQ ID NO: 700820 - protein, 9 aa, Homo Sapiens
YLNLRNDLQ

SEQ ID NO: 700821 - protein, 9 aa, Homo Sapiens
ELLGTSQAK

SEQ ID NO: 700822 - protein, 9 aa, Homo Sapiens
FQPEENEIV

SEQ ID NO: 700823 - protein, 9 aa, Homo Sapiens
CDLLLRQIA

SEQ ID NO: 700824 - protein, 9 aa, Homo Sapiens
TVWEPLDFE

SEQ ID NO: 700825 - protein, 9 aa, Homo Sapiens
LPQRRNSLH

SEQ ID NO: 700826 - protein, 9 aa, Homo Sapiens
APKSSRLCR

SEQ ID NO: 700827 - protein, 9 aa, Homo Sapiens
KSSRLCRSV

SEQ ID NO: 700828 - protein, 9 aa, Homo Sapiens
FLTEKIKEL

SEQ ID NO: 700829 - protein, 9 aa, Homo Sapiens
TDEGTASIE

SEQ ID NO: 700830 - protein, 9 aa, Homo Sapiens
RAPRAQAAE

SEQ ID NO: 700831 - protein, 9 aa, Homo Sapiens
TKDGYIIGI

SEQ ID NO: 700832 - protein, 9 aa, Homo Sapiens
TKGAEIEVD

SEQ ID NO: 700833 - protein, 9 aa, Homo Sapiens
LGDHQKKVT

SEQ ID NO: 700834 - protein, 9 aa, Homo Sapiens
YSSSKSATD

SEQ ID NO: 700835 - protein, 9 aa, Homo Sapiens
STRVFEVAL

SEQ ID NO: 700836 - protein, 9 aa, Homo Sapiens
SHWSFFDAF

SEQ ID NO: 700837 - protein, 9 aa, Homo Sapiens
DAPAPPTED

SEQ ID NO: 700838 - protein, 9 aa, Homo Sapiens
QDLTDRNIF

SEQ ID NO: 700839 - protein, 9 aa, Homo Sapiens
LTLEERTPL

SEQ ID NO: 700840 - protein, 9 aa, Homo Sapiens
NLLQALRQF

SEQ ID NO: 700841 - protein, 9 aa, Homo Sapiens
KPTLIDVDI

SEQ ID NO: 700842 - protein, 9 aa, Homo Sapiens
GLRRLHGAG

SEQ ID NO: 700843 - protein, 9 aa, Homo Sapiens
ETQHFFLCL

SEQ ID NO: 700844 - protein, 9 aa, Homo Sapiens
SCMCGMNRR

SEQ ID NO: 700845 - protein, 9 aa, Homo Sapiens
VDFHHRQEA

SEQ ID NO: 700846 - protein, 9 aa, Homo Sapiens
TFDIKSMAG

SEQ ID NO: 700847 - protein, 9 aa, Homo Sapiens
QVGPSPSWT

SEQ ID NO: 700848 - protein, 9 aa, Homo Sapiens
RDITMQSTK

SEQ ID NO: 700849 - protein, 9 aa, Homo Sapiens
IQCVTRSQE

SEQ ID NO: 700850 - protein, 9 aa, Homo Sapiens
PYIGFLSSR

SEQ ID NO: 700851 - protein, 9 aa, Homo Sapiens
RSWRLQVGP

SEQ ID NO: 700852 - protein, 9 aa, Homo Sapiens
AKDPTDPFM

SEQ ID NO: 700853 - protein, 9 aa, Homo Sapiens
LPWNKGSRD

SEQ ID NO: 700854 - protein, 9 aa, Homo Sapiens
SRNEFLRVK

SEQ ID NO: 700855 - protein, 9 aa, Homo Sapiens
LPEMLDPAG

SEQ ID NO: 700856 - protein, 9 aa, Homo Sapiens
LIHMHGNNY

SEQ ID NO: 700857 - protein, 9 aa, Homo Sapiens
IVRMGKRHL

SEQ ID NO: 700858 - protein, 9 aa, Homo Sapiens
AELHSVSPE

SEQ ID NO: 700859 - protein, 9 aa, Homo Sapiens
RYEGFLRKY

SEQ ID NO: 700860 - protein, 9 aa, Homo Sapiens
VTNAHLGCV

SEQ ID NO: 700861 - protein, 9 aa, Homo Sapiens
RRPRQSHAA

SEQ ID NO: 700862 - protein, 9 aa, Homo Sapiens
MQADNPIES

SEQ ID NO: 700863 - protein, 9 aa, Homo Sapiens
KSATDLLSV

SEQ ID NO: 700864 - protein, 9 aa, Homo Sapiens
LQNFTLDGS

SEQ ID NO: 700865 - protein, 9 aa, Homo Sapiens
LPAPPARPP

SEQ ID NO: 700866 - protein, 9 aa, Homo Sapiens
LICNCSPCW

SEQ ID NO: 700867 - protein, 9 aa, Homo Sapiens
HSGMKTSGC

SEQ ID NO: 700868 - protein, 9 aa, Homo Sapiens
QEVFGEVME

SEQ ID NO: 700869 - protein, 9 aa, Homo Sapiens
CLLSHWSFF

SEQ ID NO: 700870 - protein, 9 aa, Homo Sapiens
SHEVLICKM

SEQ ID NO: 700871 - protein, 9 aa, Homo Sapiens
RVIAVSMNY

SEQ ID NO: 700872 - protein, 9 aa, Homo Sapiens
LLSHWSFFD

SEQ ID NO: 700873 - protein, 9 aa, Homo Sapiens
CLIQTLKKG

SEQ ID NO: 700874 - protein, 9 aa, Homo Sapiens
ENKCFCTLC

SEQ ID NO: 700875 - protein, 9 aa, Homo Sapiens
EIVPTIYQK

SEQ ID NO: 700876 - protein, 9 aa, Homo Sapiens
NKCFCTLCF

SEQ ID NO: 700877 - protein, 9 aa, Homo Sapiens
PCLQVYVNN

SEQ ID NO: 700878 - protein, 9 aa, Homo Sapiens
SQTFNRETT

SEQ ID NO: 700879 - protein, 9 aa, Homo Sapiens
SEACNLAHK

SEQ ID NO: 700880 - protein, 9 aa, Homo Sapiens
LRSPAGARL

SEQ ID NO: 700881 - protein, 9 aa, Homo Sapiens
EASVCGRCH

SEQ ID NO: 700882 - protein, 9 aa, Homo Sapiens
RKSPPEHRE

SEQ ID NO: 700883 - protein, 9 aa, Homo Sapiens
KRLLLYIGI

SEQ ID NO: 700884 - protein, 9 aa, Homo Sapiens
KHSSSRQRE

SEQ ID NO: 700885 - protein, 9 aa, Homo Sapiens
KRKIRRLPQ

SEQ ID NO: 700886 - protein, 9 aa, Homo Sapiens
FFPSSTEEQ

SEQ ID NO: 700887 - protein, 9 aa, Homo Sapiens
GDAADSLSW

SEQ ID NO: 700888 - protein, 9 aa, Homo Sapiens
RMNSDKFVL

SEQ ID NO: 700889 - protein, 9 aa, Homo Sapiens
LIKEKDKGQ

SEQ ID NO: 700890 - protein, 9 aa, Homo Sapiens
RKELTAAIY

SEQ ID NO: 700891 - protein, 9 aa, Homo Sapiens
DLSPLTSLS

SEQ ID NO: 700892 - protein, 9 aa, Homo Sapiens
HGCWSQPRS

SEQ ID NO: 700893 - protein, 9 aa, Homo Sapiens
PEFNQDTFM

SEQ ID NO: 700894 - protein, 9 aa, Homo Sapiens
ESHAANSFL

SEQ ID NO: 700895 - protein, 9 aa, Homo Sapiens
ARPPLKPRE

SEQ ID NO: 700896 - protein, 9 aa, Homo Sapiens
RPRNQGVMV

SEQ ID NO: 700897 - protein, 9 aa, Homo Sapiens
ASAREVSGH

SEQ ID NO: 700898 - protein, 9 aa, Homo Sapiens
EPDENGQEF

SEQ ID NO: 700899 - protein, 9 aa, Homo Sapiens
KELIHMHGN

SEQ ID NO: 700900 - protein, 9 aa, Homo Sapiens
SINDLGSIF

SEQ ID NO: 700901 - protein, 9 aa, Homo Sapiens
RLRFEKQRS

SEQ ID NO: 700902 - protein, 9 aa, Homo Sapiens
KYKRIHTGE

SEQ ID NO: 700903 - protein, 9 aa, Homo Sapiens
QGLKAANYF

SEQ ID NO: 700904 - protein, 9 aa, Homo Sapiens
VFEVALPEY

SEQ ID NO: 700905 - protein, 9 aa, Homo Sapiens
IIKSVVQNE

SEQ ID NO: 700906 - protein, 9 aa, Homo Sapiens
PEQELPPAA

SEQ ID NO: 700907 - protein, 9 aa, Homo Sapiens
LRNDLQANS

SEQ ID NO: 700908 - protein, 9 aa, Homo Sapiens
FFHVRFINQ

SEQ ID NO: 700909 - protein, 9 aa, Homo Sapiens
QASTHEQSE

SEQ ID NO: 700910 - protein, 9 aa, Homo Sapiens
LRFEKQRSE

SEQ ID NO: 700911 - protein, 9 aa, Homo Sapiens
YLCQRYPPS

SEQ ID NO: 700912 - protein, 9 aa, Homo Sapiens
HWSFFDAFR

SEQ ID NO: 700913 - protein, 9 aa, Homo Sapiens
SNFSGRGGC

SEQ ID NO: 700914 - protein, 9 aa, Homo Sapiens
SSTSNLTIR

SEQ ID NO: 700915 - protein, 9 aa, Homo Sapiens
SYVQKPYRG

SEQ ID NO: 700916 - protein, 9 aa, Homo Sapiens
EIIGLFNLG

SEQ ID NO: 700917 - protein, 9 aa, Homo Sapiens
RTIPTLVYF

SEQ ID NO: 700918 - protein, 9 aa, Homo Sapiens
SRLCRSVLR

SEQ ID NO: 700919 - protein, 9 aa, Homo Sapiens
FGMVCIVQK

SEQ ID NO: 700920 - protein, 9 aa, Homo Sapiens
QQQSYNHSP

SEQ ID NO: 700921 - protein, 9 aa, Homo Sapiens
KIYRAAKFR

SEQ ID NO: 700922 - protein, 9 aa, Homo Sapiens
KKDFFLNLP

SEQ ID NO: 700923 - protein, 9 aa, Homo Sapiens
KQLTETDLR

SEQ ID NO: 700924 - protein, 9 aa, Homo Sapiens
GEEPVFILT

SEQ ID NO: 700925 - protein, 9 aa, Homo Sapiens
TRAMSSLYC

SEQ ID NO: 700926 - protein, 9 aa, Homo Sapiens
PGRPWPPSF

SEQ ID NO: 700927 - protein, 9 aa, Homo Sapiens
SSAYRDTCD

SEQ ID NO: 700928 - protein, 9 aa, Homo Sapiens
YTLTIKTLM

SEQ ID NO: 700929 - protein, 9 aa, Homo Sapiens
AGTAASSAM

SEQ ID NO: 700930 - protein, 9 aa, Homo Sapiens
MNMKSTFDI

SEQ ID NO: 700931 - protein, 9 aa, Homo Sapiens
GGSVSLLFS

SEQ ID NO: 700932 - protein, 9 aa, Homo Sapiens
RNNSEKLRV

SEQ ID NO: 700933 - protein, 9 aa, Homo Sapiens
HNFPSAKCV

SEQ ID NO: 700934 - protein, 9 aa, Homo Sapiens
FLRVKKKME

SEQ ID NO: 700935 - protein, 9 aa, Homo Sapiens
ASARPRVPE

SEQ ID NO: 700936 - protein, 9 aa, Homo Sapiens
LEPFTTPSP

SEQ ID NO: 700937 - protein, 9 aa, Homo Sapiens
QKPFECTHF

SEQ ID NO: 700938 - protein, 9 aa, Homo Sapiens
SAPCCWRLW

SEQ ID NO: 700939 - protein, 9 aa, Homo Sapiens
NVTTGKVDV

SEQ ID NO: 700940 - protein, 9 aa, Homo Sapiens
YQRDMVITI

SEQ ID NO: 700941 - protein, 9 aa, Homo Sapiens
NTCQSLLQD

SEQ ID NO: 700942 - protein, 9 aa, Homo Sapiens
WIPPPYKRR

SEQ ID NO: 700943 - protein, 9 aa, Homo Sapiens
LLGTSQAKG

SEQ ID NO: 700944 - protein, 9 aa, Homo Sapiens
RGLWCEKEV

SEQ ID NO: 700945 - protein, 9 aa, Homo Sapiens
LVLSNFSGR

SEQ ID NO: 700946 - protein, 9 aa, Homo Sapiens
YLFIQKLWE

SEQ ID NO: 700947 - protein, 9 aa, Homo Sapiens
SPPPGHTTC

SEQ ID NO: 700948 - protein, 9 aa, Homo Sapiens
AIYRAFEGV

SEQ ID NO: 700949 - protein, 9 aa, Homo Sapiens
KNFSGDLTT

SEQ ID NO: 700950 - protein, 9 aa, Homo Sapiens
TYVQSADGA

SEQ ID NO: 700951 - protein, 9 aa, Homo Sapiens
IGLFNLGFI

SEQ ID NO: 700952 - protein, 9 aa, Homo Sapiens
KDGYIIGIY

SEQ ID NO: 700953 - protein, 9 aa, Homo Sapiens
SACFSLRVC

SEQ ID NO: 700954 - protein, 9 aa, Homo Sapiens
VLCPYESRA

SEQ ID NO: 700955 - protein, 9 aa, Homo Sapiens
KNEAAWMAA

SEQ ID NO: 700956 - protein, 9 aa, Homo Sapiens
LQSQTFNRE

SEQ ID NO: 700957 - protein, 9 aa, Homo Sapiens
YKICPTSFW

SEQ ID NO: 700958 - protein, 9 aa, Homo Sapiens
KAANYFWPG

SEQ ID NO: 700959 - protein, 9 aa, Homo Sapiens
VDCLPEFNQ

SEQ ID NO: 700960 - protein, 9 aa, Homo Sapiens
TLSWMQLDA

SEQ ID NO: 700961 - protein, 9 aa, Homo Sapiens
MSHQRVHTG

SEQ ID NO: 700962 - protein, 9 aa, Homo Sapiens
SLSCVELLL

SEQ ID NO: 700963 - protein, 9 aa, Homo Sapiens
EEPVFILTG

SEQ ID NO: 700964 - protein, 9 aa, Homo Sapiens
DNMFFPSST

SEQ ID NO: 700965 - protein, 9 aa, Homo Sapiens
VINPELQTL

SEQ ID NO: 700966 - protein, 9 aa, Homo Sapiens
EEVGSCCND

SEQ ID NO: 700967 - protein, 9 aa, Homo Sapiens
AKSEACNLA

SEQ ID NO: 700968 - protein, 9 aa, Homo Sapiens
IFGNSSDYI

SEQ ID NO: 700969 - protein, 9 aa, Homo Sapiens
REHSPEEAL

SEQ ID NO: 700970 - protein, 9 aa, Homo Sapiens
DALPPHLNI

SEQ ID NO: 700971 - protein, 9 aa, Homo Sapiens
GFMDNPKLE

SEQ ID NO: 700972 - protein, 9 aa, Homo Sapiens
FSGRGGCFF

SEQ ID NO: 700973 - protein, 9 aa, Homo Sapiens
SFGQEIDYW

SEQ ID NO: 700974 - protein, 9 aa, Homo Sapiens
RQPQTNVSE

SEQ ID NO: 700975 - protein, 9 aa, Homo Sapiens
ATPGRPWPP

SEQ ID NO: 700976 - protein, 9 aa, Homo Sapiens
RWAIALGLG

SEQ ID NO: 700977 - protein, 9 aa, Homo Sapiens
LIGISIGRG

SEQ ID NO: 700978 - protein, 9 aa, Homo Sapiens
NLIEDFNSR

SEQ ID NO: 700979 - protein, 9 aa, Homo Sapiens
HIVIAQAHG

SEQ ID NO: 700980 - protein, 9 aa, Homo Sapiens
FFYLPVCQG

SEQ ID NO: 700981 - protein, 9 aa, Homo Sapiens
SFWQQQPLV

SEQ ID NO: 700982 - protein, 9 aa, Homo Sapiens
FLICNCSPC

SEQ ID NO: 700983 - protein, 9 aa, Homo Sapiens
EPVNVQARK

SEQ ID NO: 700984 - protein, 9 aa, Homo Sapiens
PAVNLDADD

SEQ ID NO: 700985 - protein, 9 aa, Homo Sapiens
AEEEKLRKK

SEQ ID NO: 700986 - protein, 9 aa, Homo Sapiens
PLGSPFPFP

SEQ ID NO: 700987 - protein, 9 aa, Homo Sapiens
KSFQPEENE

SEQ ID NO: 700988 - protein, 9 aa, Homo Sapiens
TETDLRRTV

SEQ ID NO: 700989 - protein, 9 aa, Homo Sapiens
SERHGLVVQ

SEQ ID NO: 700990 - protein, 9 aa, Homo Sapiens
QSLLQDISD

SEQ ID NO: 700991 - protein, 9 aa, Homo Sapiens
KRLQPSQKA

SEQ ID NO: 700992 - protein, 9 aa, Homo Sapiens
ENYHTEKGI

SEQ ID NO: 700993 - protein, 9 aa, Homo Sapiens
KVKCLTGEK

SEQ ID NO: 700994 - protein, 9 aa, Homo Sapiens
ADPTLAEIP

SEQ ID NO: 700995 - protein, 9 aa, Homo Sapiens
KILGADLDF

SEQ ID NO: 700996 - protein, 9 aa, Homo Sapiens
RRLPQGMGS

SEQ ID NO: 700997 - protein, 9 aa, Homo Sapiens
GRGRYKCNG

SEQ ID NO: 700998 - protein, 9 aa, Homo Sapiens
KNSSYVDIG

SEQ ID NO: 700999 - protein, 9 aa, Homo Sapiens
SSIHNFPSA

SEQ ID NO: 701000 - protein, 9 aa, Homo Sapiens
GNYSHAADN

SEQ ID NO: 701001 - protein, 9 aa, Homo Sapiens
VTDASSAGP

SEQ ID NO: 701002 - protein, 9 aa, Homo Sapiens
LAKNEAAWM

SEQ ID NO: 701003 - protein, 9 aa, Homo Sapiens
MDCVYGKPR

SEQ ID NO: 701004 - protein, 9 aa, Homo Sapiens
DGKNCQVFR

SEQ ID NO: 701005 - protein, 9 aa, Homo Sapiens
KLVIAHEGD

SEQ ID NO: 701006 - protein, 9 aa, Homo Sapiens
ERLSLSCVE

SEQ ID NO: 701007 - protein, 9 aa, Homo Sapiens
GSRIFIMGG

SEQ ID NO: 701008 - protein, 9 aa, Homo Sapiens
TMGKWWCFR

SEQ ID NO: 701009 - protein, 9 aa, Homo Sapiens
AGGTSSNVG

SEQ ID NO: 701010 - protein, 9 aa, Homo Sapiens
EEEKAKYAE

SEQ ID NO: 701011 - protein, 9 aa, Homo Sapiens
LELRAAVIQ

SEQ ID NO: 701012 - protein, 9 aa, Homo Sapiens
QDHNIVTAQ

SEQ ID NO: 701013 - protein, 9 aa, Homo Sapiens
FIYQASTHE

SEQ ID NO: 701014 - protein, 9 aa, Homo Sapiens
LPGINIRNG

SEQ ID NO: 701015 - protein, 9 aa, Homo Sapiens
YYTLTIKTL

SEQ ID NO: 701016 - protein, 9 aa, Homo Sapiens
EKLRKKMSA

SEQ ID NO: 701017 - protein, 9 aa, Homo Sapiens
KSPAPGLAC

SEQ ID NO: 701018 - protein, 9 aa, Homo Sapiens
YEGFLRKYP

SEQ ID NO: 701019 - protein, 9 aa, Homo Sapiens
YDILLLKNE

SEQ ID NO: 701020 - protein, 9 aa, Homo Sapiens
IQASSFDFN

SEQ ID NO: 701021 - protein, 9 aa, Homo Sapiens
SIAIQCVTR

SEQ ID NO: 701022 - protein, 9 aa, Homo Sapiens
VPQNTLSWM

SEQ ID NO: 701023 - protein, 9 aa, Homo Sapiens
FSDYQRDMV

SEQ ID NO: 701024 - protein, 9 aa, Homo Sapiens
YVDIGEKIE

SEQ ID NO: 701025 - protein, 9 aa, Homo Sapiens
IQMQLKQSM

SEQ ID NO: 701026 - protein, 9 aa, Homo Sapiens
ASHCELRPA

SEQ ID NO: 701027 - protein, 9 aa, Homo Sapiens
SSAFSSLGH

SEQ ID NO: 701028 - protein, 9 aa, Homo Sapiens
PIIKSVVQN

SEQ ID NO: 701029 - protein, 9 aa, Homo Sapiens
IKVLFSITT

SEQ ID NO: 701030 - protein, 9 aa, Homo Sapiens
VPRNSLPSD

SEQ ID NO: 701031 - protein, 9 aa, Homo Sapiens
ELTAAIYRA

SEQ ID NO: 701032 - protein, 9 aa, Homo Sapiens
SRSRRERSW

SEQ ID NO: 701033 - protein, 9 aa, Homo Sapiens
FASETLKHK

SEQ ID NO: 701034 - protein, 9 aa, Homo Sapiens
FAPKVHIIV

SEQ ID NO: 701035 - protein, 9 aa, Homo Sapiens
AIVSHEKKL

SEQ ID NO: 701036 - protein, 9 aa, Homo Sapiens
PDENGQEFS

SEQ ID NO: 701037 - protein, 9 aa, Homo Sapiens
YCSLAGLQE

SEQ ID NO: 701038 - protein, 9 aa, Homo Sapiens
HEVLICKMA

SEQ ID NO: 701039 - protein, 9 aa, Homo Sapiens
ALSFGQEID

SEQ ID NO: 701040 - protein, 9 aa, Homo Sapiens
TKTVQEKED

SEQ ID NO: 701041 - protein, 9 aa, Homo Sapiens
AQAHGYAKV

SEQ ID NO: 701042 - protein, 9 aa, Homo Sapiens
FSPLQSQTF

SEQ ID NO: 701043 - protein, 9 aa, Homo Sapiens
LQPSQKAPL

SEQ ID NO: 701044 - protein, 9 aa, Homo Sapiens
DTGVKKLPG

SEQ ID NO: 701045 - protein, 9 aa, Homo Sapiens
GGQLAELHS

SEQ ID NO: 701046 - protein, 9 aa, Homo Sapiens
GLFGVADIL

SEQ ID NO: 701047 - protein, 9 aa, Homo Sapiens
MQLQDELLG

SEQ ID NO: 701048 - protein, 9 aa, Homo Sapiens
DGGTVAAAA

SEQ ID NO: 701049 - protein, 9 aa, Homo Sapiens
SNKPQSLHT

SEQ ID NO: 701050 - protein, 9 aa, Homo Sapiens
LQEVFGEVM

SEQ ID NO: 701051 - protein, 9 aa, Homo Sapiens
KKPDKEKLI

SEQ ID NO: 701052 - protein, 9 aa, Homo Sapiens
TLQEFVLDE

SEQ ID NO: 701053 - protein, 9 aa, Homo Sapiens
FLYYTDDQY

SEQ ID NO: 701054 - protein, 9 aa, Homo Sapiens
YDGSTIPTI

SEQ ID NO: 701055 - protein, 9 aa, Homo Sapiens
PAPPGTPVK

SEQ ID NO: 701056 - protein, 9 aa, Homo Sapiens
SSSKSATDL

SEQ ID NO: 701057 - protein, 9 aa, Homo Sapiens
YFRNNRFPN

SEQ ID NO: 701058 - protein, 9 aa, Homo Sapiens
VNVQARKAF

SEQ ID NO: 701059 - protein, 9 aa, Homo Sapiens
TRSRNEFLR

SEQ ID NO: 701060 - protein, 9 aa, Homo Sapiens
CHAVAGWYL

SEQ ID NO: 701061 - protein, 9 aa, Homo Sapiens
RFAYCANLA

SEQ ID NO: 701062 - protein, 9 aa, Homo Sapiens
GGICTAIKA

SEQ ID NO: 701063 - protein, 9 aa, Homo Sapiens
PYVKGVDET

SEQ ID NO: 701064 - protein, 9 aa, Homo Sapiens
TDRNIFDFL

SEQ ID NO: 701065 - protein, 9 aa, Homo Sapiens
TNRNSISMI

SEQ ID NO: 701066 - protein, 9 aa, Homo Sapiens
KLIKEKDKG

SEQ ID NO: 701067 - protein, 9 aa, Homo Sapiens
RSNSVEKAV

SEQ ID NO: 701068 - protein, 9 aa, Homo Sapiens
LSQPAKESS

SEQ ID NO: 701069 - protein, 9 aa, Homo Sapiens
SINMCAIID

SEQ ID NO: 701070 - protein, 9 aa, Homo Sapiens
LTNYSVKKH

SEQ ID NO: 701071 - protein, 9 aa, Homo Sapiens
SPAPTGPFL

SEQ ID NO: 701072 - protein, 9 aa, Homo Sapiens
DDFENHRLT

SEQ ID NO: 701073 - protein, 9 aa, Homo Sapiens
LFIQKLWEG

SEQ ID NO: 701074 - protein, 9 aa, Homo Sapiens
LELSDLLLL

SEQ ID NO: 701075 - protein, 9 aa, Homo Sapiens
VIAVSMNYR

SEQ ID NO: 701076 - protein, 9 aa, Homo Sapiens
MLVDITEEN

SEQ ID NO: 701077 - protein, 9 aa, Homo Sapiens
EIQVAIKTL

SEQ ID NO: 701078 - protein, 9 aa, Homo Sapiens
DFVMSLNNL

SEQ ID NO: 701079 - protein, 9 aa, Homo Sapiens
HHRQEALVR

SEQ ID NO: 701080 - protein, 9 aa, Homo Sapiens
LSSEACYEY

SEQ ID NO: 701081 - protein, 9 aa, Homo Sapiens
QDELLGTSQ

SEQ ID NO: 701082 - protein, 9 aa, Homo Sapiens
GFGHKSGTG

SEQ ID NO: 701083 - protein, 9 aa, Homo Sapiens
VELRRPRQS

SEQ ID NO: 701084 - protein, 9 aa, Homo Sapiens
NGLNFSQII

SEQ ID NO: 701085 - protein, 9 aa, Homo Sapiens
QPRDLSPPP

SEQ ID NO: 701086 - protein, 9 aa, Homo Sapiens
GQFCLIQTL

SEQ ID NO: 701087 - protein, 9 aa, Homo Sapiens
VFFYLPVCQ

SEQ ID NO: 701088 - protein, 9 aa, Homo Sapiens
STTPRPPAP

SEQ ID NO: 701089 - protein, 9 aa, Homo Sapiens
DEDADDEEA

SEQ ID NO: 701090 - protein, 9 aa, Homo Sapiens
GMVCIVQKR

SEQ ID NO: 701091 - protein, 9 aa, Homo Sapiens
KKNFSGDLT

SEQ ID NO: 701092 - protein, 9 aa, Homo Sapiens
DVINARETV

SEQ ID NO: 701093 - protein, 9 aa, Homo Sapiens
EDADERQES

SEQ ID NO: 701094 - protein, 9 aa, Homo Sapiens
YNVTTGKVD

SEQ ID NO: 701095 - protein, 9 aa, Homo Sapiens
APVTAYDLY

SEQ ID NO: 701096 - protein, 9 aa, Homo Sapiens
GAGIPPPPS

SEQ ID NO: 701097 - protein, 9 aa, Homo Sapiens
QKYLSSADR

SEQ ID NO: 701098 - protein, 9 aa, Homo Sapiens
TFNILCVRE

SEQ ID NO: 701099 - protein, 9 aa, Homo Sapiens
SFIYQASTH

SEQ ID NO: 701100 - protein, 9 aa, Homo Sapiens
PCLLPGFVS

SEQ ID NO: 701101 - protein, 9 aa, Homo Sapiens
SLWASIRQR

SEQ ID NO: 701102 - protein, 9 aa, Homo Sapiens
RAQAAEEDV

SEQ ID NO: 701103 - protein, 9 aa, Homo Sapiens
ANWSSIHNF

SEQ ID NO: 701104 - protein, 9 aa, Homo Sapiens
FFLNLPHWI

SEQ ID NO: 701105 - protein, 9 aa, Homo Sapiens
IEDFNSRLI

SEQ ID NO: 701106 - protein, 9 aa, Homo Sapiens
PAAAPPPPR

SEQ ID NO: 701107 - protein, 9 aa, Homo Sapiens
LPQGMGSVI

SEQ ID NO: 701108 - protein, 9 aa, Homo Sapiens
ISNNLTAND

SEQ ID NO: 701109 - protein, 9 aa, Homo Sapiens
IVPTIYQKA

SEQ ID NO: 701110 - protein, 9 aa, Homo Sapiens
HLTNYSVKK

SEQ ID NO: 701111 - protein, 9 aa, Homo Sapiens
FYSFEFGKR

SEQ ID NO: 701112 - protein, 9 aa, Homo Sapiens
GSTIPTIKS

SEQ ID NO: 701113 - protein, 9 aa, Homo Sapiens
PMYVVRRRY

SEQ ID NO: 701114 - protein, 9 aa, Homo Sapiens
LVKSVLPFA

SEQ ID NO: 701115 - protein, 9 aa, Homo Sapiens
RVAPARPPL

SEQ ID NO: 701116 - protein, 9 aa, Homo Sapiens
AGGGRLGRG

SEQ ID NO: 701117 - protein, 9 aa, Homo Sapiens
EHSPEEALE

SEQ ID NO: 701118 - protein, 9 aa, Homo Sapiens
YSVKKHNEH

SEQ ID NO: 701119 - protein, 9 aa, Homo Sapiens
GTSQYPCLQ

SEQ ID NO: 701120 - protein, 9 aa, Homo Sapiens
PLNFLPWNK

SEQ ID NO: 701121 - protein, 9 aa, Homo Sapiens
LVLERLSLS

SEQ ID NO: 701122 - protein, 9 aa, Homo Sapiens
PTSFWQQQP

SEQ ID NO: 701123 - protein, 9 aa, Homo Sapiens
FLNLPHWIQ

SEQ ID NO: 701124 - protein, 9 aa, Homo Sapiens
SPLQSQTFN

SEQ ID NO: 701125 - protein, 9 aa, Homo Sapiens
SKSMDCVYG

SEQ ID NO: 701126 - protein, 9 aa, Homo Sapiens
DADERQESE

SEQ ID NO: 701127 - protein, 9 aa, Homo Sapiens
WAQNVNNDK

SEQ ID NO: 701128 - protein, 9 aa, Homo Sapiens
IAEASVCGR

SEQ ID NO: 701129 - protein, 9 aa, Homo Sapiens
GKREIQVAI

SEQ ID NO: 701130 - protein, 9 aa, Homo Sapiens
AKTFLICNC

SEQ ID NO: 701131 - protein, 9 aa, Homo Sapiens
LTGQFCLIQ

SEQ ID NO: 701132 - protein, 9 aa, Homo Sapiens
TSNLTIRVC

SEQ ID NO: 701133 - protein, 9 aa, Homo Sapiens
LGSPFPFPG

SEQ ID NO: 701134 - protein, 9 aa, Homo Sapiens
CFPLPGHRE

SEQ ID NO: 701135 - protein, 9 aa, Homo Sapiens
TGAISIAGL

SEQ ID NO: 701136 - protein, 9 aa, Homo Sapiens
HTPEIQASS

SEQ ID NO: 701137 - protein, 9 aa, Homo Sapiens
IRPGFPPNH

SEQ ID NO: 701138 - protein, 9 aa, Homo Sapiens
NTSRNNSEK

SEQ ID NO: 701139 - protein, 9 aa, Homo Sapiens
NPRFRLAAF

SEQ ID NO: 701140 - protein, 9 aa, Homo Sapiens
EALELRAAV

SEQ ID NO: 701141 - protein, 9 aa, Homo Sapiens
ILCVRETGI

SEQ ID NO: 701142 - protein, 9 aa, Homo Sapiens
NEIVRMGKR

SEQ ID NO: 701143 - protein, 9 aa, Homo Sapiens
TSFWQQQPL

SEQ ID NO: 701144 - protein, 9 aa, Homo Sapiens
HTPMYFFHS

SEQ ID NO: 701145 - protein, 9 aa, Homo Sapiens
LSFSGDGPI

SEQ ID NO: 701146 - protein, 9 aa, Homo Sapiens
SMCEAVMIL

SEQ ID NO: 701147 - protein, 9 aa, Homo Sapiens
RWQADPTLA

SEQ ID NO: 701148 - protein, 9 aa, Homo Sapiens
PPKDGKNCQ

SEQ ID NO: 701149 - protein, 9 aa, Homo Sapiens
KYLMFTTVL

SEQ ID NO: 701150 - protein, 9 aa, Homo Sapiens
ELQTLATKF

SEQ ID NO: 701151 - protein, 9 aa, Homo Sapiens
LKISASLQS

SEQ ID NO: 701152 - protein, 9 aa, Homo Sapiens
SPEEALELR

SEQ ID NO: 701153 - protein, 9 aa, Homo Sapiens
PVFPNVPFL

SEQ ID NO: 701154 - protein, 9 aa, Homo Sapiens
LPVCQGPSS

SEQ ID NO: 701155 - protein, 9 aa, Homo Sapiens
QRDMVITIG

SEQ ID NO: 701156 - protein, 9 aa, Homo Sapiens
LRKKMSAKK

SEQ ID NO: 701157 - protein, 9 aa, Homo Sapiens
APARPPLKP

SEQ ID NO: 701158 - protein, 9 aa, Homo Sapiens
LRYITVHKE

SEQ ID NO: 701159 - protein, 9 aa, Homo Sapiens
MMASYFLLL

SEQ ID NO: 701160 - protein, 9 aa, Homo Sapiens
QASHCELRP

SEQ ID NO: 701161 - protein, 9 aa, Homo Sapiens
SQTRKVQLV

SEQ ID NO: 701162 - protein, 9 aa, Homo Sapiens
GVKDVELLL

SEQ ID NO: 701163 - protein, 9 aa, Homo Sapiens
CLGTPTSQF

SEQ ID NO: 701164 - protein, 9 aa, Homo Sapiens
QLTVVFLYY

SEQ ID NO: 701165 - protein, 9 aa, Homo Sapiens
FGVADILCF

SEQ ID NO: 701166 - protein, 9 aa, Homo Sapiens
VQKPYRGMK

SEQ ID NO: 701167 - protein, 9 aa, Homo Sapiens
TLSTQPRDL

SEQ ID NO: 701168 - protein, 9 aa, Homo Sapiens
ASLSPADIN

SEQ ID NO: 701169 - protein, 9 aa, Homo Sapiens
GCLCYDLDH

SEQ ID NO: 701170 - protein, 9 aa, Homo Sapiens
EQLAQLLTG

SEQ ID NO: 701171 - protein, 9 aa, Homo Sapiens
TGFYNKPTF

SEQ ID NO: 701172 - protein, 9 aa, Homo Sapiens
GDNQDKDTG

SEQ ID NO: 701173 - protein, 9 aa, Homo Sapiens
NSRTAMVAS

SEQ ID NO: 701174 - protein, 9 aa, Homo Sapiens
STKQLTETD

SEQ ID NO: 701175 - protein, 9 aa, Homo Sapiens
FNSRLIGPL

SEQ ID NO: 701176 - protein, 9 aa, Homo Sapiens
YLITLSGNL

SEQ ID NO: 701177 - protein, 9 aa, Homo Sapiens
YFLLLQTYV

SEQ ID NO: 701178 - protein, 9 aa, Homo Sapiens
PRPSVEPAL

SEQ ID NO: 701179 - protein, 9 aa, Homo Sapiens
INMCAIIDR

SEQ ID NO: 701180 - protein, 9 aa, Homo Sapiens
YVQSADGAE

SEQ ID NO: 701181 - protein, 9 aa, Homo Sapiens
RLTMGKWWC

SEQ ID NO: 701182 - protein, 9 aa, Homo Sapiens
SHCELRPAP

SEQ ID NO: 701183 - protein, 9 aa, Homo Sapiens
FLCLNIRLY

SEQ ID NO: 701184 - protein, 9 aa, Homo Sapiens
DGRISVAGG

SEQ ID NO: 701185 - protein, 9 aa, Homo Sapiens
WRNRTFCTM

SEQ ID NO: 701186 - protein, 9 aa, Homo Sapiens
LFSITTHYF

SEQ ID NO: 701187 - protein, 9 aa, Homo Sapiens
RGEEPVFIL

SEQ ID NO: 701188 - protein, 9 aa, Homo Sapiens
RQLVVSPLL

SEQ ID NO: 701189 - protein, 9 aa, Homo Sapiens
TTMSCSESH

SEQ ID NO: 701190 - protein, 9 aa, Homo Sapiens
TFSRSSSSN

SEQ ID NO: 701191 - protein, 9 aa, Homo Sapiens
KCGKAFSVR

SEQ ID NO: 701192 - protein, 9 aa, Homo Sapiens
WSQPRSLSR

SEQ ID NO: 701193 - protein, 9 aa, Homo Sapiens
PSTTPRPPA

SEQ ID NO: 701194 - protein, 9 aa, Homo Sapiens
AVSMNYRVG

SEQ ID NO: 701195 - protein, 9 aa, Homo Sapiens
SESHAANSF

SEQ ID NO: 701196 - protein, 9 aa, Homo Sapiens
HAPKSSRLC

SEQ ID NO: 701197 - protein, 9 aa, Homo Sapiens
HEFYSFEFG

SEQ ID NO: 701198 - protein, 9 aa, Homo Sapiens
TPENKCFCT

SEQ ID NO: 701199 - protein, 9 aa, Homo Sapiens
PGPSLWLVL

SEQ ID NO: 701200 - protein, 9 aa, Homo Sapiens
HMETKSLSN

SEQ ID NO: 701201 - protein, 9 aa, Homo Sapiens
MAREHAPSV

SEQ ID NO: 701202 - protein, 9 aa, Homo Sapiens
NVAHHGGWT

SEQ ID NO: 701203 - protein, 9 aa, Homo Sapiens
NQDLLVNVL

SEQ ID NO: 701204 - protein, 9 aa, Homo Sapiens
CLKISASLQ

SEQ ID NO: 701205 - protein, 9 aa, Homo Sapiens
LRPAPSLGQ

SEQ ID NO: 701206 - protein, 9 aa, Homo Sapiens
RNDVVVVKG

SEQ ID NO: 701207 - protein, 9 aa, Homo Sapiens
SWMQLDAKA

SEQ ID NO: 701208 - protein, 9 aa, Homo Sapiens
APAPPGTPV

SEQ ID NO: 701209 - protein, 9 aa, Homo Sapiens
IAIQCVTRS

SEQ ID NO: 701210 - protein, 9 aa, Homo Sapiens
KVFGRSENL

SEQ ID NO: 701211 - protein, 9 aa, Homo Sapiens
LEYFRNNRF

SEQ ID NO: 701212 - protein, 9 aa, Homo Sapiens
VTTGKVDVI

SEQ ID NO: 701213 - protein, 9 aa, Homo Sapiens
MQESTRVFE

SEQ ID NO: 701214 - protein, 9 aa, Homo Sapiens
MEIIGLFNL

SEQ ID NO: 701215 - protein, 9 aa, Homo Sapiens
ALDLSRKEQ

SEQ ID NO: 701216 - protein, 9 aa, Homo Sapiens
LSGDAGEYL

SEQ ID NO: 701217 - protein, 9 aa, Homo Sapiens
TNAHLGCVN

SEQ ID NO: 701218 - protein, 9 aa, Homo Sapiens
LAASFFSFL

SEQ ID NO: 701219 - protein, 9 aa, Homo Sapiens
RVQGALSGD

SEQ ID NO: 701220 - protein, 9 aa, Homo Sapiens
ASMDGLERA

SEQ ID NO: 701221 - protein, 9 aa, Homo Sapiens
GTVAAAAPT

SEQ ID NO: 701222 - protein, 9 aa, Homo Sapiens
KGVDETGDV

SEQ ID NO: 701223 - protein, 9 aa, Homo Sapiens
IMLPFSHWT

SEQ ID NO: 701224 - protein, 9 aa, Homo Sapiens
TNVSELVVG

SEQ ID NO: 701225 - protein, 9 aa, Homo Sapiens
NPELQTLAT

SEQ ID NO: 701226 - protein, 9 aa, Homo Sapiens
QEMTKILSK

SEQ ID NO: 701227 - protein, 9 aa, Homo Sapiens
KPWGNQTIQ

SEQ ID NO: 701228 - protein, 9 aa, Homo Sapiens
ELHSVSPEQ

SEQ ID NO: 701229 - protein, 9 aa, Homo Sapiens
ELLGDHQKK

SEQ ID NO: 701230 - protein, 9 aa, Homo Sapiens
PSPSWTCFP

SEQ ID NO: 701231 - protein, 9 aa, Homo Sapiens
KKLPGFCSF

SEQ ID NO: 701232 - protein, 9 aa, Homo Sapiens
NFSGDLTTN

SEQ ID NO: 701233 - protein, 9 aa, Homo Sapiens
EASCIHGGI

SEQ ID NO: 701234 - protein, 9 aa, Homo Sapiens
GAPSTLRVE

SEQ ID NO: 701235 - protein, 9 aa, Homo Sapiens
NHSPYSNYG

SEQ ID NO: 701236 - protein, 9 aa, Homo Sapiens
YGRINTCQS

SEQ ID NO: 701237 - protein, 9 aa, Homo Sapiens
KHLWAIQPG

SEQ ID NO: 701238 - protein, 9 aa, Homo Sapiens
YWADTREDY

SEQ ID NO: 701239 - protein, 9 aa, Homo Sapiens
DLPQPSAGV

SEQ ID NO: 701240 - protein, 9 aa, Homo Sapiens
GSFIYQAST

SEQ ID NO: 701241 - protein, 9 aa, Homo Sapiens
KILMSMKSF

SEQ ID NO: 701242 - protein, 9 aa, Homo Sapiens
TLSGNLCMI

SEQ ID NO: 701243 - protein, 9 aa, Homo Sapiens
HESRKTYVQ

SEQ ID NO: 701244 - protein, 9 aa, Homo Sapiens
PYWLPNFMY

SEQ ID NO: 701245 - protein, 9 aa, Homo Sapiens
GMKTSGCNE

SEQ ID NO: 701246 - protein, 9 aa, Homo Sapiens
TSPLEIVTQ

SEQ ID NO: 701247 - protein, 9 aa, Homo Sapiens
FYNKPTFSA

SEQ ID NO: 701248 - protein, 9 aa, Homo Sapiens
LQMQESTRV

SEQ ID NO: 701249 - protein, 9 aa, Homo Sapiens
SMESGRPPD

SEQ ID NO: 701250 - protein, 9 aa, Homo Sapiens
SVEPALVSK

SEQ ID NO: 701251 - protein, 9 aa, Homo Sapiens
LPQPSAGVP

SEQ ID NO: 701252 - protein, 9 aa, Homo Sapiens
SCLGTPTSQ

SEQ ID NO: 701253 - protein, 9 aa, Homo Sapiens
QSMCEAVMI

SEQ ID NO: 701254 - protein, 9 aa, Homo Sapiens
PPIIKSVVQ

SEQ ID NO: 701255 - protein, 9 aa, Homo Sapiens
MKSTFDIKS

SEQ ID NO: 701256 - protein, 9 aa, Homo Sapiens
GQTIVQLLK

SEQ ID NO: 701257 - protein, 9 aa, Homo Sapiens
PVNVQARKA

SEQ ID NO: 701258 - protein, 9 aa, Homo Sapiens
ICAILENYH

SEQ ID NO: 701259 - protein, 9 aa, Homo Sapiens
ASSPALELS

SEQ ID NO: 701260 - protein, 9 aa, Homo Sapiens
NCQVFRNPY

SEQ ID NO: 701261 - protein, 9 aa, Homo Sapiens
FSALPSPVV

SEQ ID NO: 701262 - protein, 9 aa, Homo Sapiens
APELPQRRN

SEQ ID NO: 701263 - protein, 9 aa, Homo Sapiens
HEDAPAPPT

SEQ ID NO: 701264 - protein, 9 aa, Homo Sapiens
FAYCANLAI

SEQ ID NO: 701265 - protein, 9 aa, Homo Sapiens
MHLTNYSVK

SEQ ID NO: 701266 - protein, 9 aa, Homo Sapiens
LDFVMSLNN

SEQ ID NO: 701267 - protein, 9 aa, Homo Sapiens
ILFENDRHF

SEQ ID NO: 701268 - protein, 9 aa, Homo Sapiens
QLVVSPLLS

SEQ ID NO: 701269 - protein, 9 aa, Homo Sapiens
RGDNQDKDT

SEQ ID NO: 701270 - protein, 9 aa, Homo Sapiens
NDLGSIFGP

SEQ ID NO: 701271 - protein, 9 aa, Homo Sapiens
DLPEMLDPA

SEQ ID NO: 701272 - protein, 9 aa, Homo Sapiens
KDFFLNLPH

SEQ ID NO: 701273 - protein, 9 aa, Homo Sapiens
AVAPWKHSS

SEQ ID NO: 701274 - protein, 9 aa, Homo Sapiens
IQTANTQYT

SEQ ID NO: 701275 - protein, 9 aa, Homo Sapiens
FGQEIDYWG

SEQ ID NO: 701276 - protein, 9 aa, Homo Sapiens
TTAHHEFYS

SEQ ID NO: 701277 - protein, 9 aa, Homo Sapiens
KGSPASSLA

SEQ ID NO: 701278 - protein, 9 aa, Homo Sapiens
AQGSGEQRA

SEQ ID NO: 701279 - protein, 9 aa, Homo Sapiens
RGESIPILL

SEQ ID NO: 701280 - protein, 9 aa, Homo Sapiens
KKQEIPRQL

SEQ ID NO: 701281 - protein, 9 aa, Homo Sapiens
GTNRNSISM

SEQ ID NO: 701282 - protein, 9 aa, Homo Sapiens
ITTHYFKVE

SEQ ID NO: 701283 - protein, 9 aa, Homo Sapiens
ILQINVEDV

SEQ ID NO: 701284 - protein, 9 aa, Homo Sapiens
PSTLRVELW

SEQ ID NO: 701285 - protein, 9 aa, Homo Sapiens
RPPLKPREV

SEQ ID NO: 701286 - protein, 9 aa, Homo Sapiens
PPRKKRLQP

SEQ ID NO: 701287 - protein, 9 aa, Homo Sapiens
MVSRLFPYS

SEQ ID NO: 701288 - protein, 9 aa, Homo Sapiens
LYPPGFSFA

SEQ ID NO: 701289 - protein, 9 aa, Homo Sapiens
RTFCTMRCP

SEQ ID NO: 701290 - protein, 9 aa, Homo Sapiens
ECTHFGKSF

SEQ ID NO: 701291 - protein, 9 aa, Homo Sapiens
KTVAYHEAC

SEQ ID NO: 701292 - protein, 9 aa, Homo Sapiens
LKKSVCDQG

SEQ ID NO: 701293 - protein, 9 aa, Homo Sapiens
HCVWPCVPG

SEQ ID NO: 701294 - protein, 9 aa, Homo Sapiens
GESIPILLF

SEQ ID NO: 701295 - protein, 9 aa, Homo Sapiens
FGFTNKFSH

SEQ ID NO: 701296 - protein, 9 aa, Homo Sapiens
GRGGCFFGC

SEQ ID NO: 701297 - protein, 9 aa, Homo Sapiens
SVLPFASET

SEQ ID NO: 701298 - protein, 9 aa, Homo Sapiens
WQVTAFQDH

SEQ ID NO: 701299 - protein, 9 aa, Homo Sapiens
MTSGNWLTP

SEQ ID NO: 701300 - protein, 9 aa, Homo Sapiens
IIGLFNLGF

SEQ ID NO: 701301 - protein, 9 aa, Homo Sapiens
GLNDRGIVP

SEQ ID NO: 701302 - protein, 9 aa, Homo Sapiens
HLFGQAVKN

SEQ ID NO: 701303 - protein, 9 aa, Homo Sapiens
RGMKDVESG

SEQ ID NO: 701304 - protein, 9 aa, Homo Sapiens
EACHAVAGW

SEQ ID NO: 701305 - protein, 9 aa, Homo Sapiens
SITTHYFKV

SEQ ID NO: 701306 - protein, 9 aa, Homo Sapiens
VLICKMAAC

SEQ ID NO: 701307 - protein, 9 aa, Homo Sapiens
YIIGIYRIP

SEQ ID NO: 701308 - protein, 9 aa, Homo Sapiens
NQELLGDHQ

SEQ ID NO: 701309 - protein, 9 aa, Homo Sapiens
PHSPFATKQ

SEQ ID NO: 701310 - protein, 9 aa, Homo Sapiens
GTITSSSPS

SEQ ID NO: 701311 - protein, 9 aa, Homo Sapiens
RVKKKITER

SEQ ID NO: 701312 - protein, 9 aa, Homo Sapiens
TAFQDHNIV

SEQ ID NO: 701313 - protein, 9 aa, Homo Sapiens
QNMAQEKVA

SEQ ID NO: 701314 - protein, 9 aa, Homo Sapiens
GTFSRSSSS

SEQ ID NO: 701315 - protein, 9 aa, Homo Sapiens
MGNYSHAAD

SEQ ID NO: 701316 - protein, 9 aa, Homo Sapiens
FKNSSYVDI

SEQ ID NO: 701317 - protein, 9 aa, Homo Sapiens
AETRSRNEF

SEQ ID NO: 701318 - protein, 9 aa, Homo Sapiens
RVPEIEPRG

SEQ ID NO: 701319 - protein, 9 aa, Homo Sapiens
KITERSVTV

SEQ ID NO: 701320 - protein, 9 aa, Homo Sapiens
DETGDVFRA

SEQ ID NO: 701321 - protein, 9 aa, Homo Sapiens
FEKQRSEED

SEQ ID NO: 701322 - protein, 9 aa, Homo Sapiens
YRAFEGVSY

SEQ ID NO: 701323 - protein, 9 aa, Homo Sapiens
CLPEFNQDT

SEQ ID NO: 701324 - protein, 9 aa, Homo Sapiens
ATKQETPEV

SEQ ID NO: 701325 - protein, 9 aa, Homo Sapiens
PFDAQPLPA

SEQ ID NO: 701326 - protein, 9 aa, Homo Sapiens
GRLGRGMKD

SEQ ID NO: 701327 - protein, 9 aa, Homo Sapiens
MFGTNRNSI

SEQ ID NO: 701328 - protein, 9 aa, Homo Sapiens
CICLLSHWS

SEQ ID NO: 701329 - protein, 9 aa, Homo Sapiens
NSVEKAVSS

SEQ ID NO: 701330 - protein, 9 aa, Homo Sapiens
EILQAPVTA

SEQ ID NO: 701331 - protein, 9 aa, Homo Sapiens
EENEIVRMG

SEQ ID NO: 701332 - protein, 9 aa, Homo Sapiens
IRFLNVHVP

SEQ ID NO: 701333 - protein, 9 aa, Homo Sapiens
DIGIKPTLI

SEQ ID NO: 701334 - protein, 9 aa, Homo Sapiens
FGSNCMPID

SEQ ID NO: 701335 - protein, 9 aa, Homo Sapiens
FQYLNYFQT

SEQ ID NO: 701336 - protein, 9 aa, Homo Sapiens
EYKINGLSP

SEQ ID NO: 701337 - protein, 9 aa, Homo Sapiens
KNCQVFRNP

SEQ ID NO: 701338 - protein, 9 aa, Homo Sapiens
RALISPSCL

SEQ ID NO: 701339 - protein, 9 aa, Homo Sapiens
GSGGSVSLL

SEQ ID NO: 701340 - protein, 9 aa, Homo Sapiens
RPRQSHAAV

SEQ ID NO: 701341 - protein, 9 aa, Homo Sapiens
NGQEFSVIY

SEQ ID NO: 701342 - protein, 9 aa, Homo Sapiens
MTKGLKKSV

SEQ ID NO: 701343 - protein, 9 aa, Homo Sapiens
CQRYPPSYK

SEQ ID NO: 701344 - protein, 9 aa, Homo Sapiens
CCNDSRWSL

SEQ ID NO: 701345 - protein, 9 aa, Homo Sapiens
QYHGDAADS

SEQ ID NO: 701346 - protein, 9 aa, Homo Sapiens
RQSHAAVLW

SEQ ID NO: 701347 - protein, 9 aa, Homo Sapiens
THSGMKTSG

SEQ ID NO: 701348 - protein, 9 aa, Homo Sapiens
CVYGKPRTT

SEQ ID NO: 701349 - protein, 9 aa, Homo Sapiens
PTVALDLSR

SEQ ID NO: 701350 - protein, 9 aa, Homo Sapiens
CQILRWAIA

SEQ ID NO: 701351 - protein, 9 aa, Homo Sapiens
PFTLPPRFE

SEQ ID NO: 701352 - protein, 9 aa, Homo Sapiens
PALDLSWIL

SEQ ID NO: 701353 - protein, 9 aa, Homo Sapiens
INHSVDKKW

SEQ ID NO: 701354 - protein, 9 aa, Homo Sapiens
PSSTLWDSP

SEQ ID NO: 701355 - protein, 9 aa, Homo Sapiens
FLPWNKGSR

SEQ ID NO: 701356 - protein, 9 aa, Homo Sapiens
SSCMCGMNR

SEQ ID NO: 701357 - protein, 9 aa, Homo Sapiens
RGAQYCPCL

SEQ ID NO: 701358 - protein, 9 aa, Homo Sapiens
GNWLTPNGT

SEQ ID NO: 701359 - protein, 9 aa, Homo Sapiens
KVAPFINNG

SEQ ID NO: 701360 - protein, 9 aa, Homo Sapiens
RCFEGKPWG

SEQ ID NO: 701361 - protein, 9 aa, Homo Sapiens
LLLPEDSMF

SEQ ID NO: 701362 - protein, 9 aa, Homo Sapiens
RRCFEGKPW

SEQ ID NO: 701363 - protein, 9 aa, Homo Sapiens
SLPGAAIPP

SEQ ID NO: 701364 - protein, 9 aa, Homo Sapiens
QYLNYFQTN

SEQ ID NO: 701365 - protein, 9 aa, Homo Sapiens
VASAREVSG

SEQ ID NO: 701366 - protein, 9 aa, Homo Sapiens
SMYYGRTWV

SEQ ID NO: 701367 - protein, 9 aa, Homo Sapiens
GPGAAAGTA

SEQ ID NO: 701368 - protein, 9 aa, Homo Sapiens
KSDIYLNLR

SEQ ID NO: 701369 - protein, 9 aa, Homo Sapiens
GSQAKTFSN

SEQ ID NO: 701370 - protein, 9 aa, Homo Sapiens
VGPSPSWTC

SEQ ID NO: 701371 - protein, 9 aa, Homo Sapiens
KAKYAEMAR

SEQ ID NO: 701372 - protein, 9 aa, Homo Sapiens
FMYVFTWSL

SEQ ID NO: 701373 - protein, 9 aa, Homo Sapiens
SHEASCPVL

SEQ ID NO: 701374 - protein, 9 aa, Homo Sapiens
TSLSELSVQ

SEQ ID NO: 701375 - protein, 9 aa, Homo Sapiens
RGRYKCNGC

SEQ ID NO: 701376 - protein, 9 aa, Homo Sapiens
GRQPQTNVS

SEQ ID NO: 701377 - protein, 9 aa, Homo Sapiens
FDAQPLPAP

SEQ ID NO: 701378 - protein, 9 aa, Homo Sapiens
PFPFPGPPS

SEQ ID NO: 701379 - protein, 9 aa, Homo Sapiens
FPNVPFLWA

SEQ ID NO: 701380 - protein, 9 aa, Homo Sapiens
ELAAHCVWP

SEQ ID NO: 701381 - protein, 9 aa, Homo Sapiens
NNLTANDGY

SEQ ID NO: 701382 - protein, 9 aa, Homo Sapiens
EPFTTPSPA

SEQ ID NO: 701383 - protein, 9 aa, Homo Sapiens
TCGSQLTVV

SEQ ID NO: 701384 - protein, 9 aa, Homo Sapiens
GSFGMVCIV

SEQ ID NO: 701385 - protein, 9 aa, Homo Sapiens
CNFKFESES

SEQ ID NO: 701386 - protein, 9 aa, Homo Sapiens
QCVTRSQEE

SEQ ID NO: 701387 - protein, 9 aa, Homo Sapiens
SSKSATDLL

SEQ ID NO: 701388 - protein, 9 aa, Homo Sapiens
FGEVMEENK

SEQ ID NO: 701389 - protein, 9 aa, Homo Sapiens
LHTKGAEIE

SEQ ID NO: 701390 - protein, 9 aa, Homo Sapiens
MFFPSSTEE

SEQ ID NO: 701391 - protein, 9 aa, Homo Sapiens
LDLSWILPA

SEQ ID NO: 701392 - protein, 9 aa, Homo Sapiens
CDLWLQLFS

SEQ ID NO: 701393 - protein, 9 aa, Homo Sapiens
SQAPVLNAI

SEQ ID NO: 701394 - protein, 9 aa, Homo Sapiens
PMYFFHSHL

SEQ ID NO: 701395 - protein, 9 aa, Homo Sapiens
NTTIETSLK

SEQ ID NO: 701396 - protein, 9 aa, Homo Sapiens
KFRHLFGQA

SEQ ID NO: 701397 - protein, 9 aa, Homo Sapiens
MKDYMLFRK

SEQ ID NO: 701398 - protein, 9 aa, Homo Sapiens
QMQLKQSMC

SEQ ID NO: 701399 - protein, 9 aa, Homo Sapiens
REFNGMINE

SEQ ID NO: 701400 - protein, 9 aa, Homo Sapiens
LVILFENDR

SEQ ID NO: 701401 - protein, 9 aa, Homo Sapiens
PEMLDPAGT

SEQ ID NO: 701402 - protein, 9 aa, Homo Sapiens
SLYCSLAGL

SEQ ID NO: 701403 - protein, 9 aa, Homo Sapiens
RRNSLHRKT

SEQ ID NO: 701404 - protein, 9 aa, Homo Sapiens
KEVQVLLTT

SEQ ID NO: 701405 - protein, 9 aa, Homo Sapiens
KSKSSHMET

SEQ ID NO: 701406 - protein, 9 aa, Homo Sapiens
RINTCQSLL

SEQ ID NO: 701407 - protein, 9 aa, Homo Sapiens
LSHWSFFDA

SEQ ID NO: 701408 - protein, 9 aa, Homo Sapiens
MCNSSCMCG

SEQ ID NO: 701409 - protein, 9 aa, Homo Sapiens
LQEFVLDEN

SEQ ID NO: 701410 - protein, 9 aa, Homo Sapiens
GGHSRLLDL

SEQ ID NO: 701411 - protein, 9 aa, Homo Sapiens
QLSQPAKES

SEQ ID NO: 701412 - protein, 9 aa, Homo Sapiens
VVPLPDPLK

SEQ ID NO: 701413 - protein, 9 aa, Homo Sapiens
DASSAGPSD

SEQ ID NO: 701414 - protein, 9 aa, Homo Sapiens
NRDITMQST

SEQ ID NO: 701415 - protein, 9 aa, Homo Sapiens
EMTKILSKK

SEQ ID NO: 701416 - protein, 9 aa, Homo Sapiens
SWRLQVGPS

SEQ ID NO: 701417 - protein, 9 aa, Homo Sapiens
TANTQYTAA

SEQ ID NO: 701418 - protein, 9 aa, Homo Sapiens
GTMKKLKLI

SEQ ID NO: 701419 - protein, 9 aa, Homo Sapiens
HVRFINQDL

SEQ ID NO: 701420 - protein, 9 aa, Homo Sapiens
GFEPPAYER

SEQ ID NO: 701421 - protein, 9 aa, Homo Sapiens
DCLPEFNQD

SEQ ID NO: 701422 - protein, 9 aa, Homo Sapiens
EFYSFEFGK

SEQ ID NO: 701423 - protein, 9 aa, Homo Sapiens
EMPGAPSTL

SEQ ID NO: 701424 - protein, 9 aa, Homo Sapiens
NVSINMCAI

SEQ ID NO: 701425 - protein, 9 aa, Homo Sapiens
EDAPAPPTE

SEQ ID NO: 701426 - protein, 9 aa, Homo Sapiens
DFWSNAGSP

SEQ ID NO: 701427 - protein, 9 aa, Homo Sapiens
ELRPAPSLG

SEQ ID NO: 701428 - protein, 9 aa, Homo Sapiens
ITEENTEIR

SEQ ID NO: 701429 - protein, 9 aa, Homo Sapiens
DLLLRQIAW

SEQ ID NO: 701430 - protein, 9 aa, Homo Sapiens
HSPFATKQE

SEQ ID NO: 701431 - protein, 9 aa, Homo Sapiens
VAAAAPTFF

SEQ ID NO: 701432 - protein, 9 aa, Homo Sapiens
WQADPTLAE

SEQ ID NO: 701433 - protein, 9 aa, Homo Sapiens
FGFDVVPVC

SEQ ID NO: 701434 - protein, 9 aa, Homo Sapiens
IVKNDDKNS

SEQ ID NO: 701435 - protein, 9 aa, Homo Sapiens
EETQNMAQE

SEQ ID NO: 701436 - protein, 9 aa, Homo Sapiens
CWSQPRSLS

SEQ ID NO: 701437 - protein, 9 aa, Homo Sapiens
SSSSNASAP

SEQ ID NO: 701438 - protein, 9 aa, Homo Sapiens
SGEQRAVGV

SEQ ID NO: 701439 - protein, 9 aa, Homo Sapiens
NSISMIRPL

SEQ ID NO: 701440 - protein, 9 aa, Homo Sapiens
LAIYLITLS

SEQ ID NO: 701441 - protein, 9 aa, Homo Sapiens
MDNPKLEIP

SEQ ID NO: 701442 - protein, 9 aa, Homo Sapiens
VLFSITTHY

SEQ ID NO: 701443 - protein, 9 aa, Homo Sapiens
PAQNSKGKR

SEQ ID NO: 701444 - protein, 9 aa, Homo Sapiens
DTCDSDSRG

SEQ ID NO: 701445 - protein, 9 aa, Homo Sapiens
LCYDLDHRG

SEQ ID NO: 701446 - protein, 9 aa, Homo Sapiens
CPTSFWQQQ

SEQ ID NO: 701447 - protein, 9 aa, Homo Sapiens
PSINDLGSI

SEQ ID NO: 701448 - protein, 9 aa, Homo Sapiens
ALINASMDG

SEQ ID NO: 701449 - protein, 9 aa, Homo Sapiens
CCKAFSRSS

SEQ ID NO: 701450 - protein, 9 aa, Homo Sapiens
MEEKPCKCQ

SEQ ID NO: 701451 - protein, 9 aa, Homo Sapiens
KSVCDQGFY

SEQ ID NO: 701452 - protein, 9 aa, Homo Sapiens
GSFANVSIN

SEQ ID NO: 701453 - protein, 9 aa, Homo Sapiens
SKTKMRNPR

SEQ ID NO: 701454 - protein, 9 aa, Homo Sapiens
LGADLDFVM

SEQ ID NO: 701455 - protein, 9 aa, Homo Sapiens
RANWSSIHN

SEQ ID NO: 701456 - protein, 9 aa, Homo Sapiens
LSLLNTVSG

SEQ ID NO: 701457 - protein, 9 aa, Homo Sapiens
DRNIFDFLV

SEQ ID NO: 701458 - protein, 9 aa, Homo Sapiens
DLLLRGGTD

SEQ ID NO: 701459 - protein, 9 aa, Homo Sapiens
RQESEENVE

SEQ ID NO: 701460 - protein, 9 aa, Homo Sapiens
KWNYHYLVK

SEQ ID NO: 701461 - protein, 9 aa, Homo Sapiens
NLKEHASSL

SEQ ID NO: 701462 - protein, 9 aa, Homo Sapiens
AKRKIRRLP

SEQ ID NO: 701463 - protein, 9 aa, Homo Sapiens
GPLGLNDRG

SEQ ID NO: 701464 - protein, 9 aa, Homo Sapiens
KTFSNCTSH

SEQ ID NO: 701465 - protein, 9 aa, Homo Sapiens
GSTIPPIIK

SEQ ID NO: 701466 - protein, 9 aa, Homo Sapiens
TAAIYRAFE

SEQ ID NO: 701467 - protein, 9 aa, Homo Sapiens
SKSATDLLS

SEQ ID NO: 701468 - protein, 9 aa, Homo Sapiens
VRFINQDLL

SEQ ID NO: 701469 - protein, 9 aa, Homo Sapiens
HAPSVIFMD

SEQ ID NO: 701470 - protein, 9 aa, Homo Sapiens
MYFFFGLFG

SEQ ID NO: 701471 - protein, 9 aa, Homo Sapiens
VPFTLPPRF

SEQ ID NO: 701472 - protein, 9 aa, Homo Sapiens
TTCRLTMGK

SEQ ID NO: 701473 - protein, 9 aa, Homo Sapiens
CMCGMNRRP

SEQ ID NO: 701474 - protein, 9 aa, Homo Sapiens
NFSGRGGCF

SEQ ID NO: 701475 - protein, 9 aa, Homo Sapiens
YESRAFALL

SEQ ID NO: 701476 - protein, 9 aa, Homo Sapiens
RFEKQRSEE

SEQ ID NO: 701477 - protein, 9 aa, Homo Sapiens
TSLAEQCAK

SEQ ID NO: 701478 - protein, 9 aa, Homo Sapiens
TKKQEIPRQ

SEQ ID NO: 701479 - protein, 9 aa, Homo Sapiens
LTANDGYFL

SEQ ID NO: 701480 - protein, 9 aa, Homo Sapiens
EFGFDVVPV

SEQ ID NO: 701481 - protein, 9 aa, Homo Sapiens
CNGCHGAGT

SEQ ID NO: 701482 - protein, 9 aa, Homo Sapiens
MTKILSKKY

SEQ ID NO: 701483 - protein, 9 aa, Homo Sapiens
PDKEKLIKE

SEQ ID NO: 701484 - protein, 9 aa, Homo Sapiens
VGSCCNDSR

SEQ ID NO: 701485 - protein, 9 aa, Homo Sapiens
DVVRYDILL

SEQ ID NO: 701486 - protein, 9 aa, Homo Sapiens
STQPRDLSP

SEQ ID NO: 701487 - protein, 9 aa, Homo Sapiens
SKSSHMETK

SEQ ID NO: 701488 - protein, 9 aa, Homo Sapiens
PQSLHTKGA

SEQ ID NO: 701489 - protein, 9 aa, Homo Sapiens
NQDGGTVAA

SEQ ID NO: 701490 - protein, 9 aa, Homo Sapiens
RKAKKRRRN

SEQ ID NO: 701491 - protein, 9 aa, Homo Sapiens
PAPAPPGTP

SEQ ID NO: 701492 - protein, 9 aa, Homo Sapiens
IQKYWPMYV

SEQ ID NO: 701493 - protein, 9 aa, Homo Sapiens
LSKKNFSGD

SEQ ID NO: 701494 - protein, 9 aa, Homo Sapiens
PGGSKEERK

SEQ ID NO: 701495 - protein, 9 aa, Homo Sapiens
MYQGLKAAN

SEQ ID NO: 701496 - protein, 9 aa, Homo Sapiens
AICKPLHHT

SEQ ID NO: 701497 - protein, 9 aa, Homo Sapiens
ETGLITVWE

SEQ ID NO: 701498 - protein, 9 aa, Homo Sapiens
IEDDEYSCA

SEQ ID NO: 701499 - protein, 9 aa, Homo Sapiens
CVLSLLNTV

SEQ ID NO: 701500 - protein, 9 aa, Homo Sapiens
GKVDVINAR

SEQ ID NO: 701501 - protein, 9 aa, Homo Sapiens
QKLWEGGFS

SEQ ID NO: 701502 - protein, 9 aa, Homo Sapiens
VIDYFEEYF

SEQ ID NO: 701503 - protein, 9 aa, Homo Sapiens
IHIVIAQAH

SEQ ID NO: 701504 - protein, 9 aa, Homo Sapiens
GWILLEDET

SEQ ID NO: 701505 - protein, 9 aa, Homo Sapiens
GLLECVRGV

SEQ ID NO: 701506 - protein, 9 aa, Homo Sapiens
ENHRLTPTI

SEQ ID NO: 701507 - protein, 9 aa, Homo Sapiens
WEGGFSYVD

SEQ ID NO: 701508 - protein, 9 aa, Homo Sapiens
DQYEVIERV

SEQ ID NO: 701509 - protein, 9 aa, Homo Sapiens
LNFRAPPVF

SEQ ID NO: 701510 - protein, 9 aa, Homo Sapiens
KNSMESGRP

SEQ ID NO: 701511 - protein, 9 aa, Homo Sapiens
YRDTCDSDS

SEQ ID NO: 701512 - protein, 9 aa, Homo Sapiens
ADDEEAGPD

SEQ ID NO: 701513 - protein, 9 aa, Homo Sapiens
VSLLFSNFT

SEQ ID NO: 701514 - protein, 9 aa, Homo Sapiens
VALDLSRKE

SEQ ID NO: 701515 - protein, 9 aa, Homo Sapiens
NHEGYGIED

SEQ ID NO: 701516 - protein, 9 aa, Homo Sapiens
PPGFSFASL

SEQ ID NO: 701517 - protein, 9 aa, Homo Sapiens
MLDPAGTRS

SEQ ID NO: 701518 - protein, 9 aa, Homo Sapiens
HHESRKTYV

SEQ ID NO: 701519 - protein, 9 aa, Homo Sapiens
SSIAIQCVT

SEQ ID NO: 701520 - protein, 9 aa, Homo Sapiens
RSSSSNASA

SEQ ID NO: 701521 - protein, 9 aa, Homo Sapiens
CTFIQTANT

SEQ ID NO: 701522 - protein, 9 aa, Homo Sapiens
LLLRGGTDP

SEQ ID NO: 701523 - protein, 9 aa, Homo Sapiens
QNTLSWMQL

SEQ ID NO: 701524 - protein, 9 aa, Homo Sapiens
LHWYHGTEG

SEQ ID NO: 701525 - protein, 9 aa, Homo Sapiens
RFINQDLLV

SEQ ID NO: 701526 - protein, 9 aa, Homo Sapiens
TRVFEVALP

SEQ ID NO: 701527 - protein, 9 aa, Homo Sapiens
QVELEPVNV

SEQ ID NO: 701528 - protein, 9 aa, Homo Sapiens
LLFISICDL

SEQ ID NO: 701529 - protein, 9 aa, Homo Sapiens
FTFNILCVR

SEQ ID NO: 701530 - protein, 9 aa, Homo Sapiens
FEPDENGQE

SEQ ID NO: 701531 - protein, 9 aa, Homo Sapiens
RTPLTLYYS

SEQ ID NO: 701532 - protein, 9 aa, Homo Sapiens
PPHLNISSL

SEQ ID NO: 701533 - protein, 9 aa, Homo Sapiens
VDETGDVFR

SEQ ID NO: 701534 - protein, 9 aa, Homo Sapiens
SPFPFPGPP

SEQ ID NO: 701535 - protein, 9 aa, Homo Sapiens
NDDFENHRL

SEQ ID NO: 701536 - protein, 9 aa, Homo Sapiens
KICPTSFWQ

SEQ ID NO: 701537 - protein, 9 aa, Homo Sapiens
EHSSPLALT

SEQ ID NO: 701538 - protein, 9 aa, Homo Sapiens
RGTSQYPCL

SEQ ID NO: 701539 - protein, 9 aa, Homo Sapiens
AIKVLFSIT

SEQ ID NO: 701540 - protein, 9 aa, Homo Sapiens
AANITKSVI

SEQ ID NO: 701541 - protein, 9 aa, Homo Sapiens
PLKPREVRK

SEQ ID NO: 701542 - protein, 9 aa, Homo Sapiens
NMKSTFDIK

SEQ ID NO: 701543 - protein, 9 aa, Homo Sapiens
NYFWPGSEV

SEQ ID NO: 701544 - protein, 9 aa, Homo Sapiens
AFSYVQKPY

SEQ ID NO: 701545 - protein, 9 aa, Homo Sapiens
QLKQSMCEA

SEQ ID NO: 701546 - protein, 9 aa, Homo Sapiens
PRANWSSIH

SEQ ID NO: 701547 - protein, 9 aa, Homo Sapiens
AIGKGSFGM

SEQ ID NO: 701548 - protein, 9 aa, Homo Sapiens
QVLRVQGAL

SEQ ID NO: 701549 - protein, 9 aa, Homo Sapiens
AHGYAKVIK

SEQ ID NO: 701550 - protein, 9 aa, Homo Sapiens
SNNLTANDG

SEQ ID NO: 701551 - protein, 9 aa, Homo Sapiens
LTMGKWWCF

SEQ ID NO: 701552 - protein, 9 aa, Homo Sapiens
HTKGAEIEV

SEQ ID NO: 701553 - protein, 9 aa, Homo Sapiens
LCYKICPTS

SEQ ID NO: 701554 - protein, 9 aa, Homo Sapiens
VIFMDEIDS

SEQ ID NO: 701555 - protein, 9 aa, Homo Sapiens
FTNCDLLLR

SEQ ID NO: 701556 - protein, 9 aa, Homo Sapiens
ACYEYKING

SEQ ID NO: 701557 - protein, 9 aa, Homo Sapiens
RTAMVASLS

SEQ ID NO: 701558 - protein, 9 aa, Homo Sapiens
RNSLPSDLL

SEQ ID NO: 701559 - protein, 9 aa, Homo Sapiens
LKTENLQQR

SEQ ID NO: 701560 - protein, 9 aa, Homo Sapiens
LSWMQLDAK

SEQ ID NO: 701561 - protein, 9 aa, Homo Sapiens
MINEKPMKI

SEQ ID NO: 701562 - protein, 9 aa, Homo Sapiens
LNFCANLVL

SEQ ID NO: 701563 - protein, 9 aa, Homo Sapiens
RLCRSVLRW

SEQ ID NO: 701564 - protein, 9 aa, Homo Sapiens
STIPPIIKS

SEQ ID NO: 701565 - protein, 9 aa, Homo Sapiens
SPFATKQET

SEQ ID NO: 701566 - protein, 9 aa, Homo Sapiens
REHAPSVIF

SEQ ID NO: 701567 - protein, 9 aa, Homo Sapiens
IVSHEKKLV

SEQ ID NO: 701568 - protein, 9 aa, Homo Sapiens
EKPCKCQEC

SEQ ID NO: 701569 - protein, 9 aa, Homo Sapiens
CFPPSAMTL

SEQ ID NO: 701570 - protein, 9 aa, Homo Sapiens
ALELRAAVI

SEQ ID NO: 701571 - protein, 9 aa, Homo Sapiens
ESRKTYVQS

SEQ ID NO: 701572 - protein, 9 aa, Homo Sapiens
VNLDADDPL

SEQ ID NO: 701573 - protein, 9 aa, Homo Sapiens
SPSCLGTPT

SEQ ID NO: 701574 - protein, 9 aa, Homo Sapiens
KFQYLNYFQ

SEQ ID NO: 701575 - protein, 9 aa, Homo Sapiens
RSQAPVLNA

SEQ ID NO: 701576 - protein, 9 aa, Homo Sapiens
GFTNKFSHN

SEQ ID NO: 701577 - protein, 9 aa, Homo Sapiens
CLESEGRYN

SEQ ID NO: 701578 - protein, 9 aa, Homo Sapiens
NFVTNAHLG

SEQ ID NO: 701579 - protein, 9 aa, Homo Sapiens
REERWQADP

SEQ ID NO: 701580 - protein, 9 aa, Homo Sapiens
EECCKAFSR

SEQ ID NO: 701581 - protein, 9 aa, Homo Sapiens
KTKMRNPRF

SEQ ID NO: 701582 - protein, 9 aa, Homo Sapiens
SRNNSEKLR

SEQ ID NO: 701583 - protein, 9 aa, Homo Sapiens
NASSKSMDC

SEQ ID NO: 701584 - protein, 9 aa, Homo Sapiens
FFGRQPQTN

SEQ ID NO: 701585 - protein, 9 aa, Homo Sapiens
KVDVINARE

SEQ ID NO: 701586 - protein, 9 aa, Homo Sapiens
MVASLSPAD

SEQ ID NO: 701587 - protein, 9 aa, Homo Sapiens
RLTPTISEV

SEQ ID NO: 701588 - protein, 9 aa, Homo Sapiens
KDRWGTMKK

SEQ ID NO: 701589 - protein, 9 aa, Homo Sapiens
DPLNFLPWN

SEQ ID NO: 701590 - protein, 9 aa, Homo Sapiens
TLWDSPLVD

SEQ ID NO: 701591 - protein, 9 aa, Homo Sapiens
RLPQGMGSV

SEQ ID NO: 701592 - protein, 9 aa, Homo Sapiens
DRDCLDGSH

SEQ ID NO: 701593 - protein, 9 aa, Homo Sapiens
LHWLHLVIL

SEQ ID NO: 701594 - protein, 9 aa, Homo Sapiens
SRTAMVASL

SEQ ID NO: 701595 - protein, 9 aa, Homo Sapiens
RMGKRHLLH

SEQ ID NO: 701596 - protein, 9 aa, Homo Sapiens
KTKKQEIPR

SEQ ID NO: 701597 - protein, 9 aa, Homo Sapiens
TPGKREIQV

SEQ ID NO: 701598 - protein, 9 aa, Homo Sapiens
RSRNEFLRV

SEQ ID NO: 701599 - protein, 9 aa, Homo Sapiens
DSFLYYTDD

SEQ ID NO: 701600 - protein, 9 aa, Homo Sapiens
YEYKINGLS

SEQ ID NO: 701601 - protein, 9 aa, Homo Sapiens
HEACHAVAG

SEQ ID NO: 701602 - protein, 9 aa, Homo Sapiens
KSSHMETKS

SEQ ID NO: 701603 - protein, 9 aa, Homo Sapiens
LTKYKRIHT

SEQ ID NO: 701604 - protein, 9 aa, Homo Sapiens
FLYQKYLSS

SEQ ID NO: 701605 - protein, 9 aa, Homo Sapiens
FTNKFSHNW

SEQ ID NO: 701606 - protein, 9 aa, Homo Sapiens
VGKYLMFTT

SEQ ID NO: 701607 - protein, 9 aa, Homo Sapiens
NCMPIDALK

SEQ ID NO: 701608 - protein, 9 aa, Homo Sapiens
QEFVLDEND

SEQ ID NO: 701609 - protein, 9 aa, Homo Sapiens
SLRMNSDKF

SEQ ID NO: 701610 - protein, 9 aa, Homo Sapiens
GLKKSVCDQ

SEQ ID NO: 701611 - protein, 9 aa, Homo Sapiens
IFSDYQRDM

SEQ ID NO: 701612 - protein, 9 aa, Homo Sapiens
FIPRPLRLE

SEQ ID NO: 701613 - protein, 9 aa, Homo Sapiens
SPALELSDL

SEQ ID NO: 701614 - protein, 9 aa, Homo Sapiens
PFLMHYFDL

SEQ ID NO: 701615 - protein, 9 aa, Homo Sapiens
NDSFPAKAS

SEQ ID NO: 701616 - protein, 9 aa, Homo Sapiens
TGISSSCRR

SEQ ID NO: 701617 - protein, 9 aa, Homo Sapiens
TASLLIDFI

SEQ ID NO: 701618 - protein, 9 aa, Homo Sapiens
AFVSINRCL

SEQ ID NO: 701619 - protein, 9 aa, Homo Sapiens
MGGVNKHST

SEQ ID NO: 701620 - protein, 9 aa, Homo Sapiens
PPAKSLSDR

SEQ ID NO: 701621 - protein, 9 aa, Homo Sapiens
ILDVEEAVS

SEQ ID NO: 701622 - protein, 9 aa, Homo Sapiens
GPRGTGKSL

SEQ ID NO: 701623 - protein, 9 aa, Homo Sapiens
CEGTANASF

SEQ ID NO: 701624 - protein, 9 aa, Homo Sapiens
WIKYMAPSN

SEQ ID NO: 701625 - protein, 9 aa, Homo Sapiens
SCGGGFQNR

SEQ ID NO: 701626 - protein, 9 aa, Homo Sapiens
HVPFLMHYF

SEQ ID NO: 701627 - protein, 9 aa, Homo Sapiens
ENKRRYLHN

SEQ ID NO: 701628 - protein, 9 aa, Homo Sapiens
AAFGNCKTM

SEQ ID NO: 701629 - protein, 9 aa, Homo Sapiens
TAPGTGSRA

SEQ ID NO: 701630 - protein, 9 aa, Homo Sapiens
IFDKNNTFG

SEQ ID NO: 701631 - protein, 9 aa, Homo Sapiens
LNAKNLHVN

SEQ ID NO: 701632 - protein, 9 aa, Homo Sapiens
SDRTCARCR

SEQ ID NO: 701633 - protein, 9 aa, Homo Sapiens
TEAKPSECK

SEQ ID NO: 701634 - protein, 9 aa, Homo Sapiens
NFVHNNGML

SEQ ID NO: 701635 - protein, 9 aa, Homo Sapiens
RSWCWPPWY

SEQ ID NO: 701636 - protein, 9 aa, Homo Sapiens
HGCFCCRYC

SEQ ID NO: 701637 - protein, 9 aa, Homo Sapiens
ASHTTNSAT

SEQ ID NO: 701638 - protein, 9 aa, Homo Sapiens
LELVVTAAY

SEQ ID NO: 701639 - protein, 9 aa, Homo Sapiens
RQNRAYLLL

SEQ ID NO: 701640 - protein, 9 aa, Homo Sapiens
AKAKEQDRV

SEQ ID NO: 701641 - protein, 9 aa, Homo Sapiens
LATGAGNTI

SEQ ID NO: 701642 - protein, 9 aa, Homo Sapiens
EVNGSQHLL

SEQ ID NO: 701643 - protein, 9 aa, Homo Sapiens
NKFWPLYYQ

SEQ ID NO: 701644 - protein, 9 aa, Homo Sapiens
RQQTFIFSD

SEQ ID NO: 701645 - protein, 9 aa, Homo Sapiens
RALTVSAML

SEQ ID NO: 701646 - protein, 9 aa, Homo Sapiens
FPPAKSLSD

SEQ ID NO: 701647 - protein, 9 aa, Homo Sapiens
DSLGHPVEE

SEQ ID NO: 701648 - protein, 9 aa, Homo Sapiens
ALVDMVQLL

SEQ ID NO: 701649 - protein, 9 aa, Homo Sapiens
LRLRVCVLC

SEQ ID NO: 701650 - protein, 9 aa, Homo Sapiens
REAAKKQSM

SEQ ID NO: 701651 - protein, 9 aa, Homo Sapiens
RIEITNINT

SEQ ID NO: 701652 - protein, 9 aa, Homo Sapiens
LLYHQPLQV

SEQ ID NO: 701653 - protein, 9 aa, Homo Sapiens
FFHICHTIV

SEQ ID NO: 701654 - protein, 9 aa, Homo Sapiens
ETHKLSVAL

SEQ ID NO: 701655 - protein, 9 aa, Homo Sapiens
LCPLEATNE

SEQ ID NO: 701656 - protein, 9 aa, Homo Sapiens
LNFCSLLFA

SEQ ID NO: 701657 - protein, 9 aa, Homo Sapiens
DSPLGCIHR

SEQ ID NO: 701658 - protein, 9 aa, Homo Sapiens
QSSERSRKK

SEQ ID NO: 701659 - protein, 9 aa, Homo Sapiens
WGILGAIQS

SEQ ID NO: 701660 - protein, 9 aa, Homo Sapiens
PVKAQAQPV

SEQ ID NO: 701661 - protein, 9 aa, Homo Sapiens
KWEMELPGA

SEQ ID NO: 701662 - protein, 9 aa, Homo Sapiens
QSSSSPAPK

SEQ ID NO: 701663 - protein, 9 aa, Homo Sapiens
DDIYADVLQ

SEQ ID NO: 701664 - protein, 9 aa, Homo Sapiens
QQLRMFFLL

SEQ ID NO: 701665 - protein, 9 aa, Homo Sapiens
GETNFGPQL

SEQ ID NO: 701666 - protein, 9 aa, Homo Sapiens
SDETCQRYK

SEQ ID NO: 701667 - protein, 9 aa, Homo Sapiens
KYQASWKEQ

SEQ ID NO: 701668 - protein, 9 aa, Homo Sapiens
LLVTVRKTA

SEQ ID NO: 701669 - protein, 9 aa, Homo Sapiens
TDICFPLQL

SEQ ID NO: 701670 - protein, 9 aa, Homo Sapiens
RAALQYLGS

SEQ ID NO: 701671 - protein, 9 aa, Homo Sapiens
SRVSELEGE

SEQ ID NO: 701672 - protein, 9 aa, Homo Sapiens
PQGTRYGVI

SEQ ID NO: 701673 - protein, 9 aa, Homo Sapiens
AVVIGMELK

SEQ ID NO: 701674 - protein, 9 aa, Homo Sapiens
SDMECKIPT

SEQ ID NO: 701675 - protein, 9 aa, Homo Sapiens
RLRVCVLCE

SEQ ID NO: 701676 - protein, 9 aa, Homo Sapiens
RFPSCCSSS

SEQ ID NO: 701677 - protein, 9 aa, Homo Sapiens
QLRGRPGSS

SEQ ID NO: 701678 - protein, 9 aa, Homo Sapiens
GHADKQSHI

SEQ ID NO: 701679 - protein, 9 aa, Homo Sapiens
VGRLRSWCW

SEQ ID NO: 701680 - protein, 9 aa, Homo Sapiens
SRSTYPWNY

SEQ ID NO: 701681 - protein, 9 aa, Homo Sapiens
MEHYPMTAQ

SEQ ID NO: 701682 - protein, 9 aa, Homo Sapiens
LAAGTIYDL

SEQ ID NO: 701683 - protein, 9 aa, Homo Sapiens
ALRQQVADL

SEQ ID NO: 701684 - protein, 9 aa, Homo Sapiens
VKANALAAF

SEQ ID NO: 701685 - protein, 9 aa, Homo Sapiens
DLLLIIPDN

SEQ ID NO: 701686 - protein, 9 aa, Homo Sapiens
HEVEECRVK

SEQ ID NO: 701687 - protein, 9 aa, Homo Sapiens
RNTILLHSA

SEQ ID NO: 701688 - protein, 9 aa, Homo Sapiens
AMANLHTLS

SEQ ID NO: 701689 - protein, 9 aa, Homo Sapiens
MFDKEIPPS

SEQ ID NO: 701690 - protein, 9 aa, Homo Sapiens
DVMLVSTSV

SEQ ID NO: 701691 - protein, 9 aa, Homo Sapiens
WKGPQVSFA

SEQ ID NO: 701692 - protein, 9 aa, Homo Sapiens
CEYNFVSHS

SEQ ID NO: 701693 - protein, 9 aa, Homo Sapiens
VQLSQIQWL

SEQ ID NO: 701694 - protein, 9 aa, Homo Sapiens
TLKEMTNHQ

SEQ ID NO: 701695 - protein, 9 aa, Homo Sapiens
RGRGRGAFQ

SEQ ID NO: 701696 - protein, 9 aa, Homo Sapiens
LMRLQRHYN

SEQ ID NO: 701697 - protein, 9 aa, Homo Sapiens
ASQGMGNVC

SEQ ID NO: 701698 - protein, 9 aa, Homo Sapiens
SHVPSPGPG

SEQ ID NO: 701699 - protein, 9 aa, Homo Sapiens
ELLQQQQED

SEQ ID NO: 701700 - protein, 9 aa, Homo Sapiens
NLRELEDLM

SEQ ID NO: 701701 - protein, 9 aa, Homo Sapiens
STSFPSATE

SEQ ID NO: 701702 - protein, 9 aa, Homo Sapiens
LRMFFLLLA

SEQ ID NO: 701703 - protein, 9 aa, Homo Sapiens
GEQCSAIPT

SEQ ID NO: 701704 - protein, 9 aa, Homo Sapiens
YIDSKGKQE

SEQ ID NO: 701705 - protein, 9 aa, Homo Sapiens
FKRGGKKRQ

SEQ ID NO: 701706 - protein, 9 aa, Homo Sapiens
DFMCSAFLD

SEQ ID NO: 701707 - protein, 9 aa, Homo Sapiens
RALENADAS

SEQ ID NO: 701708 - protein, 9 aa, Homo Sapiens
LQKYLIESN

SEQ ID NO: 701709 - protein, 9 aa, Homo Sapiens
MPVNVNRSV

SEQ ID NO: 701710 - protein, 9 aa, Homo Sapiens
ARQVGNMTG

SEQ ID NO: 701711 - protein, 9 aa, Homo Sapiens
CFMNCIVHA

SEQ ID NO: 701712 - protein, 9 aa, Homo Sapiens
IILYFDKGK

SEQ ID NO: 701713 - protein, 9 aa, Homo Sapiens
CSSRPGCSQ

SEQ ID NO: 701714 - protein, 9 aa, Homo Sapiens
LLGAIETYQ

SEQ ID NO: 701715 - protein, 9 aa, Homo Sapiens
LQSFPETLM

SEQ ID NO: 701716 - protein, 9 aa, Homo Sapiens
VGSCLCRTL

SEQ ID NO: 701717 - protein, 9 aa, Homo Sapiens
REFFSEIAD

SEQ ID NO: 701718 - protein, 9 aa, Homo Sapiens
LPPAPRNAA

SEQ ID NO: 701719 - protein, 9 aa, Homo Sapiens
HKKIQTGEK

SEQ ID NO: 701720 - protein, 9 aa, Homo Sapiens
LVNQLVAGG

SEQ ID NO: 701721 - protein, 9 aa, Homo Sapiens
IKFLYSVAL

SEQ ID NO: 701722 - protein, 9 aa, Homo Sapiens
GHLAVDGDQ

SEQ ID NO: 701723 - protein, 9 aa, Homo Sapiens
FLAFVSINR

SEQ ID NO: 701724 - protein, 9 aa, Homo Sapiens
ASAVSKCPL

SEQ ID NO: 701725 - protein, 9 aa, Homo Sapiens
KVRASAVSK

SEQ ID NO: 701726 - protein, 9 aa, Homo Sapiens
QFSYRAALQ

SEQ ID NO: 701727 - protein, 9 aa, Homo Sapiens
ASQLRKMES

SEQ ID NO: 701728 - protein, 9 aa, Homo Sapiens
PSSAPLAAA

SEQ ID NO: 701729 - protein, 9 aa, Homo Sapiens
NQDNASGRT

SEQ ID NO: 701730 - protein, 9 aa, Homo Sapiens
PQHLSRVEG

SEQ ID NO: 701731 - protein, 9 aa, Homo Sapiens
MLGVYLLIF

SEQ ID NO: 701732 - protein, 9 aa, Homo Sapiens
AAVVIGMEL

SEQ ID NO: 701733 - protein, 9 aa, Homo Sapiens
KMNRAQFWP

SEQ ID NO: 701734 - protein, 9 aa, Homo Sapiens
IGPMFDKEI

SEQ ID NO: 701735 - protein, 9 aa, Homo Sapiens
LESEQGMRD

SEQ ID NO: 701736 - protein, 9 aa, Homo Sapiens
VVAVGFLGA

SEQ ID NO: 701737 - protein, 9 aa, Homo Sapiens
SYHKKIQTG

SEQ ID NO: 701738 - protein, 9 aa, Homo Sapiens
NGSQHLLTC

SEQ ID NO: 701739 - protein, 9 aa, Homo Sapiens
YSVALTRKC

SEQ ID NO: 701740 - protein, 9 aa, Homo Sapiens
GPHLVTLYN

SEQ ID NO: 701741 - protein, 9 aa, Homo Sapiens
WMELFSSLC

SEQ ID NO: 701742 - protein, 9 aa, Homo Sapiens
DTGVVHEVE

SEQ ID NO: 701743 - protein, 9 aa, Homo Sapiens
AMLLAFVAL

SEQ ID NO: 701744 - protein, 9 aa, Homo Sapiens
YWEKTFNID

SEQ ID NO: 701745 - protein, 9 aa, Homo Sapiens
LQAEAPHII

SEQ ID NO: 701746 - protein, 9 aa, Homo Sapiens
FVSITDFQL

SEQ ID NO: 701747 - protein, 9 aa, Homo Sapiens
NVQKQQCLF

SEQ ID NO: 701748 - protein, 9 aa, Homo Sapiens
EFVWHRYLD

SEQ ID NO: 701749 - protein, 9 aa, Homo Sapiens
PNQDCLEGN

SEQ ID NO: 701750 - protein, 9 aa, Homo Sapiens
SQAVCILQK

SEQ ID NO: 701751 - protein, 9 aa, Homo Sapiens
EQELFLLHQ

SEQ ID NO: 701752 - protein, 9 aa, Homo Sapiens
PHLVTLYNN

SEQ ID NO: 701753 - protein, 9 aa, Homo Sapiens
PQEGRGIAE

SEQ ID NO: 701754 - protein, 9 aa, Homo Sapiens
LLLIIPDNE

SEQ ID NO: 701755 - protein, 9 aa, Homo Sapiens
RWDPNGASP

SEQ ID NO: 701756 - protein, 9 aa, Homo Sapiens
PTRVQGETV

SEQ ID NO: 701757 - protein, 9 aa, Homo Sapiens
QRRGPGLAK

SEQ ID NO: 701758 - protein, 9 aa, Homo Sapiens
LTVSAMLLA

SEQ ID NO: 701759 - protein, 9 aa, Homo Sapiens
ECLRVPALQ

SEQ ID NO: 701760 - protein, 9 aa, Homo Sapiens
FSQREAGGS

SEQ ID NO: 701761 - protein, 9 aa, Homo Sapiens
VCDRNDNAP

SEQ ID NO: 701762 - protein, 9 aa, Homo Sapiens
QKHKLFHPH

SEQ ID NO: 701763 - protein, 9 aa, Homo Sapiens
APPTPIEVV

SEQ ID NO: 701764 - protein, 9 aa, Homo Sapiens
DRLHNDLLK

SEQ ID NO: 701765 - protein, 9 aa, Homo Sapiens
FTRRAFANR

SEQ ID NO: 701766 - protein, 9 aa, Homo Sapiens
QKVTLTAAK

SEQ ID NO: 701767 - protein, 9 aa, Homo Sapiens
VISLPMKEQ

SEQ ID NO: 701768 - protein, 9 aa, Homo Sapiens
REIRRYHKS

SEQ ID NO: 701769 - protein, 9 aa, Homo Sapiens
CFLRLGIQG

SEQ ID NO: 701770 - protein, 9 aa, Homo Sapiens
WCSAYYEAD

SEQ ID NO: 701771 - protein, 9 aa, Homo Sapiens
RQTFRPACP

SEQ ID NO: 701772 - protein, 9 aa, Homo Sapiens
YSPSYPDKR

SEQ ID NO: 701773 - protein, 9 aa, Homo Sapiens
QQIDNLQRV

SEQ ID NO: 701774 - protein, 9 aa, Homo Sapiens
PNHIPLHSF

SEQ ID NO: 701775 - protein, 9 aa, Homo Sapiens
LGLLSCLLA

SEQ ID NO: 701776 - protein, 9 aa, Homo Sapiens
QQRVLSSEH

SEQ ID NO: 701777 - protein, 9 aa, Homo Sapiens
DMDLVNQLV

SEQ ID NO: 701778 - protein, 9 aa, Homo Sapiens
PTAPGTGSR

SEQ ID NO: 701779 - protein, 9 aa, Homo Sapiens
GWGKQFLQS

SEQ ID NO: 701780 - protein, 9 aa, Homo Sapiens
PLLLLLGIV

SEQ ID NO: 701781 - protein, 9 aa, Homo Sapiens
LPDTNLLRL

SEQ ID NO: 701782 - protein, 9 aa, Homo Sapiens
LLGIFWFCA

SEQ ID NO: 701783 - protein, 9 aa, Homo Sapiens
GATSQKCEV

SEQ ID NO: 701784 - protein, 9 aa, Homo Sapiens
CCSCCRLEL

SEQ ID NO: 701785 - protein, 9 aa, Homo Sapiens
EITNINTRM

SEQ ID NO: 701786 - protein, 9 aa, Homo Sapiens
HSAKNNLKN

SEQ ID NO: 701787 - protein, 9 aa, Homo Sapiens
WASSTGPCG

SEQ ID NO: 701788 - protein, 9 aa, Homo Sapiens
EAMKAMSSK

SEQ ID NO: 701789 - protein, 9 aa, Homo Sapiens
EIQNTGHLA

SEQ ID NO: 701790 - protein, 9 aa, Homo Sapiens
GMFVYHNCE

SEQ ID NO: 701791 - protein, 9 aa, Homo Sapiens
CKAFENRQR

SEQ ID NO: 701792 - protein, 9 aa, Homo Sapiens
LQTIMGGVN

SEQ ID NO: 701793 - protein, 9 aa, Homo Sapiens
LNEDDDEDN

SEQ ID NO: 701794 - protein, 9 aa, Homo Sapiens
LASKIPAFI

SEQ ID NO: 701795 - protein, 9 aa, Homo Sapiens
AKRSATSTR

SEQ ID NO: 701796 - protein, 9 aa, Homo Sapiens
RPGCSQRVR

SEQ ID NO: 701797 - protein, 9 aa, Homo Sapiens
VCDMKKPMD

SEQ ID NO: 701798 - protein, 9 aa, Homo Sapiens
LGPTETEPD

SEQ ID NO: 701799 - protein, 9 aa, Homo Sapiens
TARVVFIKA

SEQ ID NO: 701800 - protein, 9 aa, Homo Sapiens
FWFCACDIG

SEQ ID NO: 701801 - protein, 9 aa, Homo Sapiens
LIEMFLITT

SEQ ID NO: 701802 - protein, 9 aa, Homo Sapiens
EDDDEDNDV

SEQ ID NO: 701803 - protein, 9 aa, Homo Sapiens
QYWTSPTGR

SEQ ID NO: 701804 - protein, 9 aa, Homo Sapiens
PCVSYVGAV

SEQ ID NO: 701805 - protein, 9 aa, Homo Sapiens
PGLLNWITE

SEQ ID NO: 701806 - protein, 9 aa, Homo Sapiens
CLQNENAQL

SEQ ID NO: 701807 - protein, 9 aa, Homo Sapiens
GPNTGGFLY

SEQ ID NO: 701808 - protein, 9 aa, Homo Sapiens
PLGRLGDPG

SEQ ID NO: 701809 - protein, 9 aa, Homo Sapiens
FQDQFEMIT

SEQ ID NO: 701810 - protein, 9 aa, Homo Sapiens
SLQQSSGWI

SEQ ID NO: 701811 - protein, 9 aa, Homo Sapiens
LLKENKRRY

SEQ ID NO: 701812 - protein, 9 aa, Homo Sapiens
FSDGDDPEL

SEQ ID NO: 701813 - protein, 9 aa, Homo Sapiens
NTWAGSKET

SEQ ID NO: 701814 - protein, 9 aa, Homo Sapiens
LPLPSVPTP

SEQ ID NO: 701815 - protein, 9 aa, Homo Sapiens
KAKLHAGRL

SEQ ID NO: 701816 - protein, 9 aa, Homo Sapiens
DPTKPPCLA

SEQ ID NO: 701817 - protein, 9 aa, Homo Sapiens
LSVKFDDIR

SEQ ID NO: 701818 - protein, 9 aa, Homo Sapiens
LQSLRRSTC

SEQ ID NO: 701819 - protein, 9 aa, Homo Sapiens
GGFQNRTVQ

SEQ ID NO: 701820 - protein, 9 aa, Homo Sapiens
KPVPESEFY

SEQ ID NO: 701821 - protein, 9 aa, Homo Sapiens
QKHPLCLES

SEQ ID NO: 701822 - protein, 9 aa, Homo Sapiens
NPKRELIQE

SEQ ID NO: 701823 - protein, 9 aa, Homo Sapiens
RKTATLHCT

SEQ ID NO: 701824 - protein, 9 aa, Homo Sapiens
WLSLLLWVS

SEQ ID NO: 701825 - protein, 9 aa, Homo Sapiens
CGGGFQNRT

SEQ ID NO: 701826 - protein, 9 aa, Homo Sapiens
LFNGSGRDS

SEQ ID NO: 701827 - protein, 9 aa, Homo Sapiens
HPRHPGPAA

SEQ ID NO: 701828 - protein, 9 aa, Homo Sapiens
RTASWASST

SEQ ID NO: 701829 - protein, 9 aa, Homo Sapiens
LLTATASFS

SEQ ID NO: 701830 - protein, 9 aa, Homo Sapiens
FCTCGVSEV

SEQ ID NO: 701831 - protein, 9 aa, Homo Sapiens
FAETHKLSV

SEQ ID NO: 701832 - protein, 9 aa, Homo Sapiens
VLKGHADKQ

SEQ ID NO: 701833 - protein, 9 aa, Homo Sapiens
SLLGRCIAS

SEQ ID NO: 701834 - protein, 9 aa, Homo Sapiens
SRTFSTVPL

SEQ ID NO: 701835 - protein, 9 aa, Homo Sapiens
VLQDAVARS

SEQ ID NO: 701836 - protein, 9 aa, Homo Sapiens
FEAERNISG

SEQ ID NO: 701837 - protein, 9 aa, Homo Sapiens
ARQQTFIFS

SEQ ID NO: 701838 - protein, 9 aa, Homo Sapiens
ADLLLIIPD

SEQ ID NO: 701839 - protein, 9 aa, Homo Sapiens
VNNLAAGTI

SEQ ID NO: 701840 - protein, 9 aa, Homo Sapiens
RDEHESPIT

SEQ ID NO: 701841 - protein, 9 aa, Homo Sapiens
TCFMNCIVH

SEQ ID NO: 701842 - protein, 9 aa, Homo Sapiens
NEDDDEDND

SEQ ID NO: 701843 - protein, 9 aa, Homo Sapiens
KSLLGRCIA

SEQ ID NO: 701844 - protein, 9 aa, Homo Sapiens
GNTIREAEA

SEQ ID NO: 701845 - protein, 9 aa, Homo Sapiens
SARDLDGVA

SEQ ID NO: 701846 - protein, 9 aa, Homo Sapiens
AASLRQTLE

SEQ ID NO: 701847 - protein, 9 aa, Homo Sapiens
LDSKQHIEV

SEQ ID NO: 701848 - protein, 9 aa, Homo Sapiens
TENQPKAPY

SEQ ID NO: 701849 - protein, 9 aa, Homo Sapiens
LLSVEFVWH

SEQ ID NO: 701850 - protein, 9 aa, Homo Sapiens
AAEEAWTET

SEQ ID NO: 701851 - protein, 9 aa, Homo Sapiens
SAEVLLPTH

SEQ ID NO: 701852 - protein, 9 aa, Homo Sapiens
AGRQTFRPA

SEQ ID NO: 701853 - protein, 9 aa, Homo Sapiens
CVSYVGAVS

SEQ ID NO: 701854 - protein, 9 aa, Homo Sapiens
LLCHRGFQS

SEQ ID NO: 701855 - protein, 9 aa, Homo Sapiens
FDKNNTFGS

SEQ ID NO: 701856 - protein, 9 aa, Homo Sapiens
PSVIQSYLK

SEQ ID NO: 701857 - protein, 9 aa, Homo Sapiens
LMECLRVPA

SEQ ID NO: 701858 - protein, 9 aa, Homo Sapiens
ESEFYSSPL

SEQ ID NO: 701859 - protein, 9 aa, Homo Sapiens
LGHPVEEKV

SEQ ID NO: 701860 - protein, 9 aa, Homo Sapiens
TRARCLTRT

SEQ ID NO: 701861 - protein, 9 aa, Homo Sapiens
CFSFFVFFF

SEQ ID NO: 701862 - protein, 9 aa, Homo Sapiens
SLSDRLAVL

SEQ ID NO: 701863 - protein, 9 aa, Homo Sapiens
LLSLGSFRS

SEQ ID NO: 701864 - protein, 9 aa, Homo Sapiens
YADQEFNQD

SEQ ID NO: 701865 - protein, 9 aa, Homo Sapiens
TVSAMLLAF

SEQ ID NO: 701866 - protein, 9 aa, Homo Sapiens
RDLGPNTGG

SEQ ID NO: 701867 - protein, 9 aa, Homo Sapiens
ARSISIYEM

SEQ ID NO: 701868 - protein, 9 aa, Homo Sapiens
LLKFLGDAS

SEQ ID NO: 701869 - protein, 9 aa, Homo Sapiens
ITYIAPLLE

SEQ ID NO: 701870 - protein, 9 aa, Homo Sapiens
SQHLLTCAF

SEQ ID NO: 701871 - protein, 9 aa, Homo Sapiens
SSTSTAGSW

SEQ ID NO: 701872 - protein, 9 aa, Homo Sapiens
SCEYNFVSH

SEQ ID NO: 701873 - protein, 9 aa, Homo Sapiens
HFFMGYYWY

SEQ ID NO: 701874 - protein, 9 aa, Homo Sapiens
PVEAGAGSS

SEQ ID NO: 701875 - protein, 9 aa, Homo Sapiens
KKIQTGEKP

SEQ ID NO: 701876 - protein, 9 aa, Homo Sapiens
SLEPEDFSA

SEQ ID NO: 701877 - protein, 9 aa, Homo Sapiens
FANRKLNLT

SEQ ID NO: 701878 - protein, 9 aa, Homo Sapiens
DYRKVSRSS

SEQ ID NO: 701879 - protein, 9 aa, Homo Sapiens
YFFFHICHT

SEQ ID NO: 701880 - protein, 9 aa, Homo Sapiens
FKVELMRLQ

SEQ ID NO: 701881 - protein, 9 aa, Homo Sapiens
AVARSAATP

SEQ ID NO: 701882 - protein, 9 aa, Homo Sapiens
LFRRFLCSR

SEQ ID NO: 701883 - protein, 9 aa, Homo Sapiens
ECDIFHPEQ

SEQ ID NO: 701884 - protein, 9 aa, Homo Sapiens
KYFFFHICH

SEQ ID NO: 701885 - protein, 9 aa, Homo Sapiens
NLSYIIRKD

SEQ ID NO: 701886 - protein, 9 aa, Homo Sapiens
TSLVAPISL

SEQ ID NO: 701887 - protein, 9 aa, Homo Sapiens
RLQHLLKEN

SEQ ID NO: 701888 - protein, 9 aa, Homo Sapiens
EHLASKIPA

SEQ ID NO: 701889 - protein, 9 aa, Homo Sapiens
TIMGGVNKH

SEQ ID NO: 701890 - protein, 9 aa, Homo Sapiens
EKEDEDEYV

SEQ ID NO: 701891 - protein, 9 aa, Homo Sapiens
MLEIPAGAR

SEQ ID NO: 701892 - protein, 9 aa, Homo Sapiens
PELIEMFLI

SEQ ID NO: 701893 - protein, 9 aa, Homo Sapiens
AACCTAEGS

SEQ ID NO: 701894 - protein, 9 aa, Homo Sapiens
SGETMRVAL

SEQ ID NO: 701895 - protein, 9 aa, Homo Sapiens
ELPGASQGL

SEQ ID NO: 701896 - protein, 9 aa, Homo Sapiens
MSFKRPFPL

SEQ ID NO: 701897 - protein, 9 aa, Homo Sapiens
AFLLCHRGF

SEQ ID NO: 701898 - protein, 9 aa, Homo Sapiens
ITKANGKTS

SEQ ID NO: 701899 - protein, 9 aa, Homo Sapiens
SRSSGPKAD

SEQ ID NO: 701900 - protein, 9 aa, Homo Sapiens
PLYQSFYEK

SEQ ID NO: 701901 - protein, 9 aa, Homo Sapiens
NTVTLPETL

SEQ ID NO: 701902 - protein, 9 aa, Homo Sapiens
KLLGIFWFC

SEQ ID NO: 701903 - protein, 9 aa, Homo Sapiens
LERNPSTIS

SEQ ID NO: 701904 - protein, 9 aa, Homo Sapiens
VHEVEECRV

SEQ ID NO: 701905 - protein, 9 aa, Homo Sapiens
HRFKRGGKK

SEQ ID NO: 701906 - protein, 9 aa, Homo Sapiens
LKQLLSFVS

SEQ ID NO: 701907 - protein, 9 aa, Homo Sapiens
AKNLHVNGN

SEQ ID NO: 701908 - protein, 9 aa, Homo Sapiens
NLVVTICLR

SEQ ID NO: 701909 - protein, 9 aa, Homo Sapiens
AMQEDASPG

SEQ ID NO: 701910 - protein, 9 aa, Homo Sapiens
SGVSTTGKG

SEQ ID NO: 701911 - protein, 9 aa, Homo Sapiens
VAYWEKTFN

SEQ ID NO: 701912 - protein, 9 aa, Homo Sapiens
KEQAERFYT

SEQ ID NO: 701913 - protein, 9 aa, Homo Sapiens
GRDSPPSTP

SEQ ID NO: 701914 - protein, 9 aa, Homo Sapiens
PEDFSAVTM

SEQ ID NO: 701915 - protein, 9 aa, Homo Sapiens
QVGTSQTGT

SEQ ID NO: 701916 - protein, 9 aa, Homo Sapiens
HDYMSTVTR

SEQ ID NO: 701917 - protein, 9 aa, Homo Sapiens
KNYKDEYLK

SEQ ID NO: 701918 - protein, 9 aa, Homo Sapiens
KGHADKQSH

SEQ ID NO: 701919 - protein, 9 aa, Homo Sapiens
ENQPKAPYY

SEQ ID NO: 701920 - protein, 9 aa, Homo Sapiens
TAAKALKLF

SEQ ID NO: 701921 - protein, 9 aa, Homo Sapiens
EIILYFDKG

SEQ ID NO: 701922 - protein, 9 aa, Homo Sapiens
SLRNKVTEL

SEQ ID NO: 701923 - protein, 9 aa, Homo Sapiens
TILLHSAKN

SEQ ID NO: 701924 - protein, 9 aa, Homo Sapiens
LKENKRRYL

SEQ ID NO: 701925 - protein, 9 aa, Homo Sapiens
WHRYLDYRP

SEQ ID NO: 701926 - protein, 9 aa, Homo Sapiens
RYCCSCCRL

SEQ ID NO: 701927 - protein, 9 aa, Homo Sapiens
RLPLPSVPT

SEQ ID NO: 701928 - protein, 9 aa, Homo Sapiens
LFSFYLKDF

SEQ ID NO: 701929 - protein, 9 aa, Homo Sapiens
RASSPVPRG

SEQ ID NO: 701930 - protein, 9 aa, Homo Sapiens
MSTAFCSLL

SEQ ID NO: 701931 - protein, 9 aa, Homo Sapiens
SLVAPISLH

SEQ ID NO: 701932 - protein, 9 aa, Homo Sapiens
VSTSVPKMA

SEQ ID NO: 701933 - protein, 9 aa, Homo Sapiens
FDKADKLYR

SEQ ID NO: 701934 - protein, 9 aa, Homo Sapiens
LQNENAQLV

SEQ ID NO: 701935 - protein, 9 aa, Homo Sapiens
EKNGFNLCF

SEQ ID NO: 701936 - protein, 9 aa, Homo Sapiens
GWIDIIHSK

SEQ ID NO: 701937 - protein, 9 aa, Homo Sapiens
FAVISRKIP

SEQ ID NO: 701938 - protein, 9 aa, Homo Sapiens
YSMQKKKRR

SEQ ID NO: 701939 - protein, 9 aa, Homo Sapiens
EHLKESVKC

SEQ ID NO: 701940 - protein, 9 aa, Homo Sapiens
YEAATYSLN

SEQ ID NO: 701941 - protein, 9 aa, Homo Sapiens
LARAVFQRV

SEQ ID NO: 701942 - protein, 9 aa, Homo Sapiens
NNFVHNNGM

SEQ ID NO: 701943 - protein, 9 aa, Homo Sapiens
NHIPLHSFT

SEQ ID NO: 701944 - protein, 9 aa, Homo Sapiens
LLMLLLGLW

SEQ ID NO: 701945 - protein, 9 aa, Homo Sapiens
QAVCILQKH

SEQ ID NO: 701946 - protein, 9 aa, Homo Sapiens
LTGSQSENK

SEQ ID NO: 701947 - protein, 9 aa, Homo Sapiens
LPNRSLQGK

SEQ ID NO: 701948 - protein, 9 aa, Homo Sapiens
GSCLCRTLS

SEQ ID NO: 701949 - protein, 9 aa, Homo Sapiens
FVGRLRSWC

SEQ ID NO: 701950 - protein, 9 aa, Homo Sapiens
TWHSKPRNR

SEQ ID NO: 701951 - protein, 9 aa, Homo Sapiens
FDKEIPPSI

SEQ ID NO: 701952 - protein, 9 aa, Homo Sapiens
SLRRSTCHS

SEQ ID NO: 701953 - protein, 9 aa, Homo Sapiens
EVVVAVGFL

SEQ ID NO: 701954 - protein, 9 aa, Homo Sapiens
LVTVAKEHH

SEQ ID NO: 701955 - protein, 9 aa, Homo Sapiens
TGSQSENKE

SEQ ID NO: 701956 - protein, 9 aa, Homo Sapiens
NLLSLGSFR

SEQ ID NO: 701957 - protein, 9 aa, Homo Sapiens
STAFCSLLA

SEQ ID NO: 701958 - protein, 9 aa, Homo Sapiens
AQTTPPVAT

SEQ ID NO: 701959 - protein, 9 aa, Homo Sapiens
CKIPTSKDQ

SEQ ID NO: 701960 - protein, 9 aa, Homo Sapiens
SPGAHAAVG

SEQ ID NO: 701961 - protein, 9 aa, Homo Sapiens
FMKQMNDAR

SEQ ID NO: 701962 - protein, 9 aa, Homo Sapiens
AMKAMSSKG

SEQ ID NO: 701963 - protein, 9 aa, Homo Sapiens
ELRPHNHLQ

SEQ ID NO: 701964 - protein, 9 aa, Homo Sapiens
SQSENKEDG

SEQ ID NO: 701965 - protein, 9 aa, Homo Sapiens
ALGYGQAFL

SEQ ID NO: 701966 - protein, 9 aa, Homo Sapiens
MIEAVYTDI

SEQ ID NO: 701967 - protein, 9 aa, Homo Sapiens
PTKPPCLAP

SEQ ID NO: 701968 - protein, 9 aa, Homo Sapiens
KRGRGRGAF

SEQ ID NO: 701969 - protein, 9 aa, Homo Sapiens
LLLADMDLV

SEQ ID NO: 701970 - protein, 9 aa, Homo Sapiens
RSYERQQMR

SEQ ID NO: 701971 - protein, 9 aa, Homo Sapiens
NQGPTTRRK

SEQ ID NO: 701972 - protein, 9 aa, Homo Sapiens
WMMKDVFFF

SEQ ID NO: 701973 - protein, 9 aa, Homo Sapiens
LYAKAKEQD

SEQ ID NO: 701974 - protein, 9 aa, Homo Sapiens
FSKYGPISD

SEQ ID NO: 701975 - protein, 9 aa, Homo Sapiens
HYPMTAQFS

SEQ ID NO: 701976 - protein, 9 aa, Homo Sapiens
QSLESEQGM

SEQ ID NO: 701977 - protein, 9 aa, Homo Sapiens
GPKIIIVKW

SEQ ID NO: 701978 - protein, 9 aa, Homo Sapiens
RSSTSTAGS

SEQ ID NO: 701979 - protein, 9 aa, Homo Sapiens
EEKLNFVEI

SEQ ID NO: 701980 - protein, 9 aa, Homo Sapiens
QVSPEAAVQ

SEQ ID NO: 701981 - protein, 9 aa, Homo Sapiens
STAGSWWPP

SEQ ID NO: 701982 - protein, 9 aa, Homo Sapiens
LLSFVSITD

SEQ ID NO: 701983 - protein, 9 aa, Homo Sapiens
PLQLSTLTP

SEQ ID NO: 701984 - protein, 9 aa, Homo Sapiens
TFFRLQKFL

SEQ ID NO: 701985 - protein, 9 aa, Homo Sapiens
PDVENGKHH

SEQ ID NO: 701986 - protein, 9 aa, Homo Sapiens
LHAGRLEGD

SEQ ID NO: 701987 - protein, 9 aa, Homo Sapiens
ELQLFEAER

SEQ ID NO: 701988 - protein, 9 aa, Homo Sapiens
QEQKANGSP

SEQ ID NO: 701989 - protein, 9 aa, Homo Sapiens
VEYIPYEAA

SEQ ID NO: 701990 - protein, 9 aa, Homo Sapiens
RSSGPKADS

SEQ ID NO: 701991 - protein, 9 aa, Homo Sapiens
TRRAFANRK

SEQ ID NO: 701992 - protein, 9 aa, Homo Sapiens
TPIEVVAAD

SEQ ID NO: 701993 - protein, 9 aa, Homo Sapiens
SMAKEWYKR

SEQ ID NO: 701994 - protein, 9 aa, Homo Sapiens
ARVVFIKAG

SEQ ID NO: 701995 - protein, 9 aa, Homo Sapiens
MARSPTGYW

SEQ ID NO: 701996 - protein, 9 aa, Homo Sapiens
CHRGFQSQV

SEQ ID NO: 701997 - protein, 9 aa, Homo Sapiens
MKQTWHSKP

SEQ ID NO: 701998 - protein, 9 aa, Homo Sapiens
VNLVCDMKK

SEQ ID NO: 701999 - protein, 9 aa, Homo Sapiens
LAPPQHLSR

SEQ ID NO: 702000 - protein, 9 aa, Homo Sapiens
KCTRERHPG

SEQ ID NO: 702001 - protein, 9 aa, Homo Sapiens
HNNGMLDLS

SEQ ID NO: 702002 - protein, 9 aa, Homo Sapiens
KHKLFHPHT

SEQ ID NO: 702003 - protein, 9 aa, Homo Sapiens
TSTAGSWWP

SEQ ID NO: 702004 - protein, 9 aa, Homo Sapiens
IVHALTHTP

SEQ ID NO: 702005 - protein, 9 aa, Homo Sapiens
VATKVTAKI

SEQ ID NO: 702006 - protein, 9 aa, Homo Sapiens
PVPPRRQRG

SEQ ID NO: 702007 - protein, 9 aa, Homo Sapiens
QGTRYGVIP

SEQ ID NO: 702008 - protein, 9 aa, Homo Sapiens
RELIQERTK

SEQ ID NO: 702009 - protein, 9 aa, Homo Sapiens
AERRGAGPQ

SEQ ID NO: 702010 - protein, 9 aa, Homo Sapiens
INVNFQDTD

SEQ ID NO: 702011 - protein, 9 aa, Homo Sapiens
KKKSKNLVV

SEQ ID NO: 702012 - protein, 9 aa, Homo Sapiens
CCRAWEPAR

SEQ ID NO: 702013 - protein, 9 aa, Homo Sapiens
TGPNRILIY

SEQ ID NO: 702014 - protein, 9 aa, Homo Sapiens
AYQRSYERQ

SEQ ID NO: 702015 - protein, 9 aa, Homo Sapiens
QTLEGKYIM

SEQ ID NO: 702016 - protein, 9 aa, Homo Sapiens
AVSHGHMDC

SEQ ID NO: 702017 - protein, 9 aa, Homo Sapiens
RRKGPPKFK

SEQ ID NO: 702018 - protein, 9 aa, Homo Sapiens
STLVFPDCG

SEQ ID NO: 702019 - protein, 9 aa, Homo Sapiens
LRVPALQVV

SEQ ID NO: 702020 - protein, 9 aa, Homo Sapiens
KPPCLAPGT

SEQ ID NO: 702021 - protein, 9 aa, Homo Sapiens
NQNAGFPFA

SEQ ID NO: 702022 - protein, 9 aa, Homo Sapiens
DMECKIPTS

SEQ ID NO: 702023 - protein, 9 aa, Homo Sapiens
PPCLAPGTT

SEQ ID NO: 702024 - protein, 9 aa, Homo Sapiens
TGSRARASS

SEQ ID NO: 702025 - protein, 9 aa, Homo Sapiens
PRRQRGGRG

SEQ ID NO: 702026 - protein, 9 aa, Homo Sapiens
QNAGFPFAA

SEQ ID NO: 702027 - protein, 9 aa, Homo Sapiens
QTTPPVATE

SEQ ID NO: 702028 - protein, 9 aa, Homo Sapiens
NGQGQVLPG

SEQ ID NO: 702029 - protein, 9 aa, Homo Sapiens
NDLLKFLGD

SEQ ID NO: 702030 - protein, 9 aa, Homo Sapiens
PHTCSCEDR

SEQ ID NO: 702031 - protein, 9 aa, Homo Sapiens
SERNTILLH

SEQ ID NO: 702032 - protein, 9 aa, Homo Sapiens
AVIDYNGER

SEQ ID NO: 702033 - protein, 9 aa, Homo Sapiens
VLVCDRNDN

SEQ ID NO: 702034 - protein, 9 aa, Homo Sapiens
TMCNATAIC

SEQ ID NO: 702035 - protein, 9 aa, Homo Sapiens
AVRVSILVT

SEQ ID NO: 702036 - protein, 9 aa, Homo Sapiens
QKHHSAAKP

SEQ ID NO: 702037 - protein, 9 aa, Homo Sapiens
ENSMAKEWY

SEQ ID NO: 702038 - protein, 9 aa, Homo Sapiens
FNIETFQTS

SEQ ID NO: 702039 - protein, 9 aa, Homo Sapiens
GRGRGAFQR

SEQ ID NO: 702040 - protein, 9 aa, Homo Sapiens
QFLQSFPET

SEQ ID NO: 702041 - protein, 9 aa, Homo Sapiens
PSSKQNTPH

SEQ ID NO: 702042 - protein, 9 aa, Homo Sapiens
YWPREILFR

SEQ ID NO: 702043 - protein, 9 aa, Homo Sapiens
YLNFRNPDV

SEQ ID NO: 702044 - protein, 9 aa, Homo Sapiens
LGGPGTASR

SEQ ID NO: 702045 - protein, 9 aa, Homo Sapiens
ALTRKCLCR

SEQ ID NO: 702046 - protein, 9 aa, Homo Sapiens
NTGHLAVDG

SEQ ID NO: 702047 - protein, 9 aa, Homo Sapiens
VARSAATPT

SEQ ID NO: 702048 - protein, 9 aa, Homo Sapiens
TCQRYKNLK

SEQ ID NO: 702049 - protein, 9 aa, Homo Sapiens
KNGFNLCFI

SEQ ID NO: 702050 - protein, 9 aa, Homo Sapiens
ESVKCCLLH

SEQ ID NO: 702051 - protein, 9 aa, Homo Sapiens
AMSDCTGCH

SEQ ID NO: 702052 - protein, 9 aa, Homo Sapiens
RLRSWCWPP

SEQ ID NO: 702053 - protein, 9 aa, Homo Sapiens
PPALRPRPP

SEQ ID NO: 702054 - protein, 9 aa, Homo Sapiens
IDAYLQLCQ

SEQ ID NO: 702055 - protein, 9 aa, Homo Sapiens
TSCGGGFQN

SEQ ID NO: 702056 - protein, 9 aa, Homo Sapiens
KLGPTETEP

SEQ ID NO: 702057 - protein, 9 aa, Homo Sapiens
QEREGTPCA

SEQ ID NO: 702058 - protein, 9 aa, Homo Sapiens
PPVATEAQT

SEQ ID NO: 702059 - protein, 9 aa, Homo Sapiens
NTPHYLASP

SEQ ID NO: 702060 - protein, 9 aa, Homo Sapiens
ENDTGVVHE

SEQ ID NO: 702061 - protein, 9 aa, Homo Sapiens
ARHGGWTTK

SEQ ID NO: 702062 - protein, 9 aa, Homo Sapiens
FPSATELSV

SEQ ID NO: 702063 - protein, 9 aa, Homo Sapiens
VTVAKEHHR

SEQ ID NO: 702064 - protein, 9 aa, Homo Sapiens
LVSCPNKEN

SEQ ID NO: 702065 - protein, 9 aa, Homo Sapiens
TLLGLLVNR

SEQ ID NO: 702066 - protein, 9 aa, Homo Sapiens
AAKALKLFK

SEQ ID NO: 702067 - protein, 9 aa, Homo Sapiens
CLAPGTTQP

SEQ ID NO: 702068 - protein, 9 aa, Homo Sapiens
EPIDIDKII

SEQ ID NO: 702069 - protein, 9 aa, Homo Sapiens
PGTGSRARA

SEQ ID NO: 702070 - protein, 9 aa, Homo Sapiens
RVGVLHGQC

SEQ ID NO: 702071 - protein, 9 aa, Homo Sapiens
RFYTALCVL

SEQ ID NO: 702072 - protein, 9 aa, Homo Sapiens
EFYLSPHTS

SEQ ID NO: 702073 - protein, 9 aa, Homo Sapiens
RSSLLLLPP

SEQ ID NO: 702074 - protein, 9 aa, Homo Sapiens
CKQAVNFFS

SEQ ID NO: 702075 - protein, 9 aa, Homo Sapiens
IPEKRQQSL

SEQ ID NO: 702076 - protein, 9 aa, Homo Sapiens
CDRNDNAPR

SEQ ID NO: 702077 - protein, 9 aa, Homo Sapiens
KGTGPNRIL

SEQ ID NO: 702078 - protein, 9 aa, Homo Sapiens
GSTNTVTLP

SEQ ID NO: 702079 - protein, 9 aa, Homo Sapiens
GRIYPNPNV

SEQ ID NO: 702080 - protein, 9 aa, Homo Sapiens
PSCCSSSRR

SEQ ID NO: 702081 - protein, 9 aa, Homo Sapiens
EAPLITESV

SEQ ID NO: 702082 - protein, 9 aa, Homo Sapiens
RVQGETVQG

SEQ ID NO: 702083 - protein, 9 aa, Homo Sapiens
NNLAFNDIK

SEQ ID NO: 702084 - protein, 9 aa, Homo Sapiens
EAQLQGSKL

SEQ ID NO: 702085 - protein, 9 aa, Homo Sapiens
HLGSMLQKK

SEQ ID NO: 702086 - protein, 9 aa, Homo Sapiens
PAERRGAGP

SEQ ID NO: 702087 - protein, 9 aa, Homo Sapiens
WDPNGASPT

SEQ ID NO: 702088 - protein, 9 aa, Homo Sapiens
WHSKPRNRP

SEQ ID NO: 702089 - protein, 9 aa, Homo Sapiens
FKGTGPNRI

SEQ ID NO: 702090 - protein, 9 aa, Homo Sapiens
TRVQGETVQ

SEQ ID NO: 702091 - protein, 9 aa, Homo Sapiens
MLQKKSVLL

SEQ ID NO: 702092 - protein, 9 aa, Homo Sapiens
TANASFVTC

SEQ ID NO: 702093 - protein, 9 aa, Homo Sapiens
NGHVKVVTL

SEQ ID NO: 702094 - protein, 9 aa, Homo Sapiens
GSDLESCSS

SEQ ID NO: 702095 - protein, 9 aa, Homo Sapiens
FLNFCSLLF

SEQ ID NO: 702096 - protein, 9 aa, Homo Sapiens
VILATTTTN

SEQ ID NO: 702097 - protein, 9 aa, Homo Sapiens
LGTFAKYQA

SEQ ID NO: 702098 - protein, 9 aa, Homo Sapiens
VLGDYRELI

SEQ ID NO: 702099 - protein, 9 aa, Homo Sapiens
EVEECRVKG

SEQ ID NO: 702100 - protein, 9 aa, Homo Sapiens
LLLGLWMGL

SEQ ID NO: 702101 - protein, 9 aa, Homo Sapiens
DVMNYFALE

SEQ ID NO: 702102 - protein, 9 aa, Homo Sapiens
ADRAVIDYN

SEQ ID NO: 702103 - protein, 9 aa, Homo Sapiens
DPNISDEYG

SEQ ID NO: 702104 - protein, 9 aa, Homo Sapiens
YQCQECQKT

SEQ ID NO: 702105 - protein, 9 aa, Homo Sapiens
TLVFPDCGN

SEQ ID NO: 702106 - protein, 9 aa, Homo Sapiens
VGAVSYRLL

SEQ ID NO: 702107 - protein, 9 aa, Homo Sapiens
RKMESSINH

SEQ ID NO: 702108 - protein, 9 aa, Homo Sapiens
LRQRWDPNG

SEQ ID NO: 702109 - protein, 9 aa, Homo Sapiens
SEADYLTFH

SEQ ID NO: 702110 - protein, 9 aa, Homo Sapiens
KLVVSHLCI

SEQ ID NO: 702111 - protein, 9 aa, Homo Sapiens
KENKRRYLH

SEQ ID NO: 702112 - protein, 9 aa, Homo Sapiens
LDVEEAVSK

SEQ ID NO: 702113 - protein, 9 aa, Homo Sapiens
AWEVRHRPG

SEQ ID NO: 702114 - protein, 9 aa, Homo Sapiens
LTLAACCTA

SEQ ID NO: 702115 - protein, 9 aa, Homo Sapiens
NNTFGSVEV

SEQ ID NO: 702116 - protein, 9 aa, Homo Sapiens
TEKSCYVLF

SEQ ID NO: 702117 - protein, 9 aa, Homo Sapiens
KILVVKEEK

SEQ ID NO: 702118 - protein, 9 aa, Homo Sapiens
MHYFDLKRT

SEQ ID NO: 702119 - protein, 9 aa, Homo Sapiens
TSTVMKSGS

SEQ ID NO: 702120 - protein, 9 aa, Homo Sapiens
QNLLTATAS

SEQ ID NO: 702121 - protein, 9 aa, Homo Sapiens
KLSVALPAG

SEQ ID NO: 702122 - protein, 9 aa, Homo Sapiens
SFECFEEAD

SEQ ID NO: 702123 - protein, 9 aa, Homo Sapiens
QSYLKKLFA

SEQ ID NO: 702124 - protein, 9 aa, Homo Sapiens
TKANGKTSV

SEQ ID NO: 702125 - protein, 9 aa, Homo Sapiens
SLSGVSTTG

SEQ ID NO: 702126 - protein, 9 aa, Homo Sapiens
IADLFMHQK

SEQ ID NO: 702127 - protein, 9 aa, Homo Sapiens
NAGFPFAAI

SEQ ID NO: 702128 - protein, 9 aa, Homo Sapiens
IPKDAYFTM

SEQ ID NO: 702129 - protein, 9 aa, Homo Sapiens
MCSAFLDLT

SEQ ID NO: 702130 - protein, 9 aa, Homo Sapiens
TLNHCRLSS

SEQ ID NO: 702131 - protein, 9 aa, Homo Sapiens
DFDKADKLY

SEQ ID NO: 702132 - protein, 9 aa, Homo Sapiens
GPMFDKEIP

SEQ ID NO: 702133 - protein, 9 aa, Homo Sapiens
QTFRPACPP

SEQ ID NO: 702134 - protein, 9 aa, Homo Sapiens
SQHNTWAGS

SEQ ID NO: 702135 - protein, 9 aa, Homo Sapiens
DMRIKKKQS

SEQ ID NO: 702136 - protein, 9 aa, Homo Sapiens
TPPVATEAQ

SEQ ID NO: 702137 - protein, 9 aa, Homo Sapiens
KCEVQKKEW

SEQ ID NO: 702138 - protein, 9 aa, Homo Sapiens
VGVLHGQCW

SEQ ID NO: 702139 - protein, 9 aa, Homo Sapiens
LCFIKNIQQ

SEQ ID NO: 702140 - protein, 9 aa, Homo Sapiens
EIRRYHKST

SEQ ID NO: 702141 - protein, 9 aa, Homo Sapiens
SELLGMLSI

SEQ ID NO: 702142 - protein, 9 aa, Homo Sapiens
SKYFFFHIC

SEQ ID NO: 702143 - protein, 9 aa, Homo Sapiens
SVKCCLLHL

SEQ ID NO: 702144 - protein, 9 aa, Homo Sapiens
DTSTVMKSG

SEQ ID NO: 702145 - protein, 9 aa, Homo Sapiens
LQDDFMCSA

SEQ ID NO: 702146 - protein, 9 aa, Homo Sapiens
QLRQLQGCP

SEQ ID NO: 702147 - protein, 9 aa, Homo Sapiens
NPSVIQSYL

SEQ ID NO: 702148 - protein, 9 aa, Homo Sapiens
IPLHSFTPT

SEQ ID NO: 702149 - protein, 9 aa, Homo Sapiens
FCACDIGLD

SEQ ID NO: 702150 - protein, 9 aa, Homo Sapiens
LSSLGYKSY

SEQ ID NO: 702151 - protein, 9 aa, Homo Sapiens
LVCDMKKPM

SEQ ID NO: 702152 - protein, 9 aa, Homo Sapiens
LVVKEEKLN

SEQ ID NO: 702153 - protein, 9 aa, Homo Sapiens
EILKSPILH

SEQ ID NO: 702154 - protein, 9 aa, Homo Sapiens
QLQGSKLLS

SEQ ID NO: 702155 - protein, 9 aa, Homo Sapiens
KRSERIERG

SEQ ID NO: 702156 - protein, 9 aa, Homo Sapiens
ITTKGVCLG

SEQ ID NO: 702157 - protein, 9 aa, Homo Sapiens
HSIFGDNDS

SEQ ID NO: 702158 - protein, 9 aa, Homo Sapiens
GSKLLSRNS

SEQ ID NO: 702159 - protein, 9 aa, Homo Sapiens
RSLPRNVSA

SEQ ID NO: 702160 - protein, 9 aa, Homo Sapiens
KQAVNFFSP

SEQ ID NO: 702161 - protein, 9 aa, Homo Sapiens
SSSSYRRML

SEQ ID NO: 702162 - protein, 9 aa, Homo Sapiens
LADKGTLLP

SEQ ID NO: 702163 - protein, 9 aa, Homo Sapiens
CSLLFAAWL

SEQ ID NO: 702164 - protein, 9 aa, Homo Sapiens
MGLELRPHN

SEQ ID NO: 702165 - protein, 9 aa, Homo Sapiens
KKQSMKQTK

SEQ ID NO: 702166 - protein, 9 aa, Homo Sapiens
SPTPTPTSS

SEQ ID NO: 702167 - protein, 9 aa, Homo Sapiens
EADYLTFHL

SEQ ID NO: 702168 - protein, 9 aa, Homo Sapiens
EGEENLDYY

SEQ ID NO: 702169 - protein, 9 aa, Homo Sapiens
PEAFLLCHR

SEQ ID NO: 702170 - protein, 9 aa, Homo Sapiens
LSWWIKYMA

SEQ ID NO: 702171 - protein, 9 aa, Homo Sapiens
SEGYFSQLQ

SEQ ID NO: 702172 - protein, 9 aa, Homo Sapiens
SKQNTPHYL

SEQ ID NO: 702173 - protein, 9 aa, Homo Sapiens
VATEAQTTQ

SEQ ID NO: 702174 - protein, 9 aa, Homo Sapiens
SCLCRTLSC

SEQ ID NO: 702175 - protein, 9 aa, Homo Sapiens
IQETYFEHE

SEQ ID NO: 702176 - protein, 9 aa, Homo Sapiens
HIPLHSFTP

SEQ ID NO: 702177 - protein, 9 aa, Homo Sapiens
VALTRKCLC

SEQ ID NO: 702178 - protein, 9 aa, Homo Sapiens
YRRMLGGPG

SEQ ID NO: 702179 - protein, 9 aa, Homo Sapiens
PSECKAFEN

SEQ ID NO: 702180 - protein, 9 aa, Homo Sapiens
QIQWLIGSV

SEQ ID NO: 702181 - protein, 9 aa, Homo Sapiens
DSLRNKVTE

SEQ ID NO: 702182 - protein, 9 aa, Homo Sapiens
CFRSSGSLP

SEQ ID NO: 702183 - protein, 9 aa, Homo Sapiens
QLSEVDKSK

SEQ ID NO: 702184 - protein, 9 aa, Homo Sapiens
VYLLIFLAA

SEQ ID NO: 702185 - protein, 9 aa, Homo Sapiens
FLDSKQHIE

SEQ ID NO: 702186 - protein, 9 aa, Homo Sapiens
TGHLAVDGD

SEQ ID NO: 702187 - protein, 9 aa, Homo Sapiens
EPSLYTIRA

SEQ ID NO: 702188 - protein, 9 aa, Homo Sapiens
IVKWMMKDV

SEQ ID NO: 702189 - protein, 9 aa, Homo Sapiens
PEAWLSHVP

SEQ ID NO: 702190 - protein, 9 aa, Homo Sapiens
RHRSLPRNV

SEQ ID NO: 702191 - protein, 9 aa, Homo Sapiens
EDEDEYVKK

SEQ ID NO: 702192 - protein, 9 aa, Homo Sapiens
AMHPSDGIG

SEQ ID NO: 702193 - protein, 9 aa, Homo Sapiens
ILVVKEEKL

SEQ ID NO: 702194 - protein, 9 aa, Homo Sapiens
KEEKLNFVE

SEQ ID NO: 702195 - protein, 9 aa, Homo Sapiens
AGFPFAAIH

SEQ ID NO: 702196 - protein, 9 aa, Homo Sapiens
NLVCDMKKP

SEQ ID NO: 702197 - protein, 9 aa, Homo Sapiens
LRQMEQFPV

SEQ ID NO: 702198 - protein, 9 aa, Homo Sapiens
NSKRHKIRQ

SEQ ID NO: 702199 - protein, 9 aa, Homo Sapiens
TNNFVHNNG

SEQ ID NO: 702200 - protein, 9 aa, Homo Sapiens
SVIQSYLKK

SEQ ID NO: 702201 - protein, 9 aa, Homo Sapiens
GENSMAKEW

SEQ ID NO: 702202 - protein, 9 aa, Homo Sapiens
SNQGPTTRR

SEQ ID NO: 702203 - protein, 9 aa, Homo Sapiens
SSERSRKKR

SEQ ID NO: 702204 - protein, 9 aa, Homo Sapiens
RRAFANRKL

SEQ ID NO: 702205 - protein, 9 aa, Homo Sapiens
ASLPNRSLQ

SEQ ID NO: 702206 - protein, 9 aa, Homo Sapiens
RVSELEGEL

SEQ ID NO: 702207 - protein, 9 aa, Homo Sapiens
SYVGAVSYR

SEQ ID NO: 702208 - protein, 9 aa, Homo Sapiens
TFRPACPPG

SEQ ID NO: 702209 - protein, 9 aa, Homo Sapiens
YLKKLFAGI

SEQ ID NO: 702210 - protein, 9 aa, Homo Sapiens
ARASSPVPR

SEQ ID NO: 702211 - protein, 9 aa, Homo Sapiens
SLPMKEQLS

SEQ ID NO: 702212 - protein, 9 aa, Homo Sapiens
FRSDNCFSF

SEQ ID NO: 702213 - protein, 9 aa, Homo Sapiens
RWQQRVLSS

SEQ ID NO: 702214 - protein, 9 aa, Homo Sapiens
CSQRVRRGH

SEQ ID NO: 702215 - protein, 9 aa, Homo Sapiens
ILIYNFKQG

SEQ ID NO: 702216 - protein, 9 aa, Homo Sapiens
LLMLGVYLL

SEQ ID NO: 702217 - protein, 9 aa, Homo Sapiens
YFTMMDKDV

SEQ ID NO: 702218 - protein, 9 aa, Homo Sapiens
TDSLRNKVT

SEQ ID NO: 702219 - protein, 9 aa, Homo Sapiens
GPTRVQGET

SEQ ID NO: 702220 - protein, 9 aa, Homo Sapiens
GCFCCRYCC

SEQ ID NO: 702221 - protein, 9 aa, Homo Sapiens
PKPLNAKNL

SEQ ID NO: 702222 - protein, 9 aa, Homo Sapiens
SAEIVATKV

SEQ ID NO: 702223 - protein, 9 aa, Homo Sapiens
YSKCLQNEN

SEQ ID NO: 702224 - protein, 9 aa, Homo Sapiens
LVVTAAYSK

SEQ ID NO: 702225 - protein, 9 aa, Homo Sapiens
EAQTTPPVA

SEQ ID NO: 702226 - protein, 9 aa, Homo Sapiens
NSEGFQIVN

SEQ ID NO: 702227 - protein, 9 aa, Homo Sapiens
QKIHDYMST

SEQ ID NO: 702228 - protein, 9 aa, Homo Sapiens
SEGFQIVNV

SEQ ID NO: 702229 - protein, 9 aa, Homo Sapiens
GSLPNNAIK

SEQ ID NO: 702230 - protein, 9 aa, Homo Sapiens
LVNREAAGI

SEQ ID NO: 702231 - protein, 9 aa, Homo Sapiens
RAQFWPGLN

SEQ ID NO: 702232 - protein, 9 aa, Homo Sapiens
PHGSVSGQC

SEQ ID NO: 702233 - protein, 9 aa, Homo Sapiens
RKSAEHALV

SEQ ID NO: 702234 - protein, 9 aa, Homo Sapiens
MRLQRHYNH

SEQ ID NO: 702235 - protein, 9 aa, Homo Sapiens
ERRGAGPQP

SEQ ID NO: 702236 - protein, 9 aa, Homo Sapiens
FQIVNVQKQ

SEQ ID NO: 702237 - protein, 9 aa, Homo Sapiens
QRSLLPRRT

SEQ ID NO: 702238 - protein, 9 aa, Homo Sapiens
LLGLWMGLG

SEQ ID NO: 702239 - protein, 9 aa, Homo Sapiens
TPDHGCFCC

SEQ ID NO: 702240 - protein, 9 aa, Homo Sapiens
ASRSAVPTA

SEQ ID NO: 702241 - protein, 9 aa, Homo Sapiens
MNGQGQVLP

SEQ ID NO: 702242 - protein, 9 aa, Homo Sapiens
DKCTRERHP

SEQ ID NO: 702243 - protein, 9 aa, Homo Sapiens
GAGRQTFRP

SEQ ID NO: 702244 - protein, 9 aa, Homo Sapiens
KEQPYLNFR

SEQ ID NO: 702245 - protein, 9 aa, Homo Sapiens
SPTGRIYPN

SEQ ID NO: 702246 - protein, 9 aa, Homo Sapiens
IPGHDWCFL

SEQ ID NO: 702247 - protein, 9 aa, Homo Sapiens
PRRTSSAGS

SEQ ID NO: 702248 - protein, 9 aa, Homo Sapiens
EQGMRDRWD

SEQ ID NO: 702249 - protein, 9 aa, Homo Sapiens
HQPLQVFTG

SEQ ID NO: 702250 - protein, 9 aa, Homo Sapiens
YMSTVTRAR

SEQ ID NO: 702251 - protein, 9 aa, Homo Sapiens
TDTNDHDLV

SEQ ID NO: 702252 - protein, 9 aa, Homo Sapiens
GHMDCVRVL

SEQ ID NO: 702253 - protein, 9 aa, Homo Sapiens
EFIKNKFSF

SEQ ID NO: 702254 - protein, 9 aa, Homo Sapiens
ASLLIDFIT

SEQ ID NO: 702255 - protein, 9 aa, Homo Sapiens
DENSSVYAD

SEQ ID NO: 702256 - protein, 9 aa, Homo Sapiens
RAKMGRRAE

SEQ ID NO: 702257 - protein, 9 aa, Homo Sapiens
LTLRSPGAH

SEQ ID NO: 702258 - protein, 9 aa, Homo Sapiens
IFWFCACDI

SEQ ID NO: 702259 - protein, 9 aa, Homo Sapiens
ADSVAELGQ

SEQ ID NO: 702260 - protein, 9 aa, Homo Sapiens
QEPSLYTIR

SEQ ID NO: 702261 - protein, 9 aa, Homo Sapiens
PVPESEFYS

SEQ ID NO: 702262 - protein, 9 aa, Homo Sapiens
GTLHLQRRT

SEQ ID NO: 702263 - protein, 9 aa, Homo Sapiens
CETMCNATA

SEQ ID NO: 702264 - protein, 9 aa, Homo Sapiens
LNANISGGS

SEQ ID NO: 702265 - protein, 9 aa, Homo Sapiens
SKIPAFILP

SEQ ID NO: 702266 - protein, 9 aa, Homo Sapiens
TMMDKDVPS

SEQ ID NO: 702267 - protein, 9 aa, Homo Sapiens
SGWIDIIHS

SEQ ID NO: 702268 - protein, 9 aa, Homo Sapiens
EDPEAFLLC

SEQ ID NO: 702269 - protein, 9 aa, Homo Sapiens
QELFLLHQE

SEQ ID NO: 702270 - protein, 9 aa, Homo Sapiens
TVTRARCLT

SEQ ID NO: 702271 - protein, 9 aa, Homo Sapiens
RQQVADLEF

SEQ ID NO: 702272 - protein, 9 aa, Homo Sapiens
DLMIEAVYT

SEQ ID NO: 702273 - protein, 9 aa, Homo Sapiens
TITKANGKT

SEQ ID NO: 702274 - protein, 9 aa, Homo Sapiens
EKSCYVLFA

SEQ ID NO: 702275 - protein, 9 aa, Homo Sapiens
QDRVKEIQE

SEQ ID NO: 702276 - protein, 9 aa, Homo Sapiens
PHRFKRGGK

SEQ ID NO: 702277 - protein, 9 aa, Homo Sapiens
CGHGFYPQY

SEQ ID NO: 702278 - protein, 9 aa, Homo Sapiens
RCYLVSCPN

SEQ ID NO: 702279 - protein, 9 aa, Homo Sapiens
NLGVTTSVP

SEQ ID NO: 702280 - protein, 9 aa, Homo Sapiens
CVLCELQKT

SEQ ID NO: 702281 - protein, 9 aa, Homo Sapiens
SEVDKSKEE

SEQ ID NO: 702282 - protein, 9 aa, Homo Sapiens
MKAMSSKGP

SEQ ID NO: 702283 - protein, 9 aa, Homo Sapiens
RPGWLSLLL

SEQ ID NO: 702284 - protein, 9 aa, Homo Sapiens
IFLNFCSLL

SEQ ID NO: 702285 - protein, 9 aa, Homo Sapiens
AWTETEKVW

SEQ ID NO: 702286 - protein, 9 aa, Homo Sapiens
GLFRRFLCS

SEQ ID NO: 702287 - protein, 9 aa, Homo Sapiens
WIDIIHSKK

SEQ ID NO: 702288 - protein, 9 aa, Homo Sapiens
FITVFGELT

SEQ ID NO: 702289 - protein, 9 aa, Homo Sapiens
ADQLQTNYD

SEQ ID NO: 702290 - protein, 9 aa, Homo Sapiens
AKPSECKAF

SEQ ID NO: 702291 - protein, 9 aa, Homo Sapiens
AIQSINTDV

SEQ ID NO: 702292 - protein, 9 aa, Homo Sapiens
SKRLRPEDS

SEQ ID NO: 702293 - protein, 9 aa, Homo Sapiens
KWCCRCFPF

SEQ ID NO: 702294 - protein, 9 aa, Homo Sapiens
QLQEEEFAQ

SEQ ID NO: 702295 - protein, 9 aa, Homo Sapiens
ADKLYRKPI

SEQ ID NO: 702296 - protein, 9 aa, Homo Sapiens
AEHALVDMV

SEQ ID NO: 702297 - protein, 9 aa, Homo Sapiens
LLADMDLVN

SEQ ID NO: 702298 - protein, 9 aa, Homo Sapiens
GIDAYLQLC

SEQ ID NO: 702299 - protein, 9 aa, Homo Sapiens
SQLQEEEFA

SEQ ID NO: 702300 - protein, 9 aa, Homo Sapiens
VPESEFYSS

SEQ ID NO: 702301 - protein, 9 aa, Homo Sapiens
EEQKSMFQD

SEQ ID NO: 702302 - protein, 9 aa, Homo Sapiens
KLIFRVCSP

SEQ ID NO: 702303 - protein, 9 aa, Homo Sapiens
KAAVVIGME

SEQ ID NO: 702304 - protein, 9 aa, Homo Sapiens
VLLIRGVRL

SEQ ID NO: 702305 - protein, 9 aa, Homo Sapiens
YGNDSFPAK

SEQ ID NO: 702306 - protein, 9 aa, Homo Sapiens
RRSLEAMKA

SEQ ID NO: 702307 - protein, 9 aa, Homo Sapiens
APPVPPRRQ

SEQ ID NO: 702308 - protein, 9 aa, Homo Sapiens
AAKKQSMKQ

SEQ ID NO: 702309 - protein, 9 aa, Homo Sapiens
WSLEPEDFS

SEQ ID NO: 702310 - protein, 9 aa, Homo Sapiens
RITDYPECT

SEQ ID NO: 702311 - protein, 9 aa, Homo Sapiens
ATSQKCEVQ

SEQ ID NO: 702312 - protein, 9 aa, Homo Sapiens
DIKILGTEE

SEQ ID NO: 702313 - protein, 9 aa, Homo Sapiens
ATELSVVSA

SEQ ID NO: 702314 - protein, 9 aa, Homo Sapiens
PQKVKCKEV

SEQ ID NO: 702315 - protein, 9 aa, Homo Sapiens
SQREAGGSH

SEQ ID NO: 702316 - protein, 9 aa, Homo Sapiens
YGVIPRSGV

SEQ ID NO: 702317 - protein, 9 aa, Homo Sapiens
PVNVNRSVS

SEQ ID NO: 702318 - protein, 9 aa, Homo Sapiens
VKAQAQPVQ

SEQ ID NO: 702319 - protein, 9 aa, Homo Sapiens
RVPALQVVS

SEQ ID NO: 702320 - protein, 9 aa, Homo Sapiens
EKLLLVTVR

SEQ ID NO: 702321 - protein, 9 aa, Homo Sapiens
GTYSTRLGE

SEQ ID NO: 702322 - protein, 9 aa, Homo Sapiens
LFHPHTCSC

SEQ ID NO: 702323 - protein, 9 aa, Homo Sapiens
QQQEDRSKL

SEQ ID NO: 702324 - protein, 9 aa, Homo Sapiens
LNEQDWERT

SEQ ID NO: 702325 - protein, 9 aa, Homo Sapiens
KDAYFTMMD

SEQ ID NO: 702326 - protein, 9 aa, Homo Sapiens
ELVVTAAYS

SEQ ID NO: 702327 - protein, 9 aa, Homo Sapiens
NEADFRWQQ

SEQ ID NO: 702328 - protein, 9 aa, Homo Sapiens
EASLPNRSL

SEQ ID NO: 702329 - protein, 9 aa, Homo Sapiens
TVNPKRELI

SEQ ID NO: 702330 - protein, 9 aa, Homo Sapiens
ADLEFQLGD

SEQ ID NO: 702331 - protein, 9 aa, Homo Sapiens
GCCRAWEPA

SEQ ID NO: 702332 - protein, 9 aa, Homo Sapiens
QVEILSCEG

SEQ ID NO: 702333 - protein, 9 aa, Homo Sapiens
SGRTSVVTA

SEQ ID NO: 702334 - protein, 9 aa, Homo Sapiens
TREVRDIFY

SEQ ID NO: 702335 - protein, 9 aa, Homo Sapiens
SRARASSPV

SEQ ID NO: 702336 - protein, 9 aa, Homo Sapiens
LSDRLAVLK

SEQ ID NO: 702337 - protein, 9 aa, Homo Sapiens
MQEDASPGG

SEQ ID NO: 702338 - protein, 9 aa, Homo Sapiens
YWTSPTGRI

SEQ ID NO: 702339 - protein, 9 aa, Homo Sapiens
MAKTFFRLQ

SEQ ID NO: 702340 - protein, 9 aa, Homo Sapiens
VFPDCGNVS

SEQ ID NO: 702341 - protein, 9 aa, Homo Sapiens
LLPRRTSSA

SEQ ID NO: 702342 - protein, 9 aa, Homo Sapiens
KVELMRLQR

SEQ ID NO: 702343 - protein, 9 aa, Homo Sapiens
ATTTTNLGV

SEQ ID NO: 702344 - protein, 9 aa, Homo Sapiens
IREAEALGE

SEQ ID NO: 702345 - protein, 9 aa, Homo Sapiens
MCNATAICS

SEQ ID NO: 702346 - protein, 9 aa, Homo Sapiens
HLASKIPAF

SEQ ID NO: 702347 - protein, 9 aa, Homo Sapiens
CKPLHYPVI

SEQ ID NO: 702348 - protein, 9 aa, Homo Sapiens
PIEVVAADT

SEQ ID NO: 702349 - protein, 9 aa, Homo Sapiens
KVYKKRDKI

SEQ ID NO: 702350 - protein, 9 aa, Homo Sapiens
MHPSDGIGA

SEQ ID NO: 702351 - protein, 9 aa, Homo Sapiens
PGTPAMSIS

SEQ ID NO: 702352 - protein, 9 aa, Homo Sapiens
PWYSWMELF

SEQ ID NO: 702353 - protein, 9 aa, Homo Sapiens
RAAVVECER

SEQ ID NO: 702354 - protein, 9 aa, Homo Sapiens
NLTALQKYL

SEQ ID NO: 702355 - protein, 9 aa, Homo Sapiens
AAVQKVRAW

SEQ ID NO: 702356 - protein, 9 aa, Homo Sapiens
GTREVRDIF

SEQ ID NO: 702357 - protein, 9 aa, Homo Sapiens
EQAERFYTA

SEQ ID NO: 702358 - protein, 9 aa, Homo Sapiens
AVNFFSPAP

SEQ ID NO: 702359 - protein, 9 aa, Homo Sapiens
REAAGIVFT

SEQ ID NO: 702360 - protein, 9 aa, Homo Sapiens
RCFPFCRES

SEQ ID NO: 702361 - protein, 9 aa, Homo Sapiens
YDLQHIEGG

SEQ ID NO: 702362 - protein, 9 aa, Homo Sapiens
IDIDKIIKE

SEQ ID NO: 702363 - protein, 9 aa, Homo Sapiens
LAACCTAEG

SEQ ID NO: 702364 - protein, 9 aa, Homo Sapiens
MSTVTRARC

SEQ ID NO: 702365 - protein, 9 aa, Homo Sapiens
PPAPRNAAA

SEQ ID NO: 702366 - protein, 9 aa, Homo Sapiens
TIYDLCVLA

SEQ ID NO: 702367 - protein, 9 aa, Homo Sapiens
CIVHALTHT

SEQ ID NO: 702368 - protein, 9 aa, Homo Sapiens
QQVADLEFQ

SEQ ID NO: 702369 - protein, 9 aa, Homo Sapiens
KPEAWLSHV

SEQ ID NO: 702370 - protein, 9 aa, Homo Sapiens
SKNSGLPSQ

SEQ ID NO: 702371 - protein, 9 aa, Homo Sapiens
TWAGSKETC

SEQ ID NO: 702372 - protein, 9 aa, Homo Sapiens
PLLIKGGRI

SEQ ID NO: 702373 - protein, 9 aa, Homo Sapiens
DYMSTVTRA

SEQ ID NO: 702374 - protein, 9 aa, Homo Sapiens
NIMHFHQKH

SEQ ID NO: 702375 - protein, 9 aa, Homo Sapiens
TDGFSALHH

SEQ ID NO: 702376 - protein, 9 aa, Homo Sapiens
PQLRGRPGS

SEQ ID NO: 702377 - protein, 9 aa, Homo Sapiens
CSPGWCSAY

SEQ ID NO: 702378 - protein, 9 aa, Homo Sapiens
YTASLLIDF

SEQ ID NO: 702379 - protein, 9 aa, Homo Sapiens
FMCSAFLDL

SEQ ID NO: 702380 - protein, 9 aa, Homo Sapiens
TAQFSSVLS

SEQ ID NO: 702381 - protein, 9 aa, Homo Sapiens
EYMEMCSIK

SEQ ID NO: 702382 - protein, 9 aa, Homo Sapiens
TCARCRESL

SEQ ID NO: 702383 - protein, 9 aa, Homo Sapiens
LMLNGKPII

SEQ ID NO: 702384 - protein, 9 aa, Homo Sapiens
FSQLQEEEF

SEQ ID NO: 702385 - protein, 9 aa, Homo Sapiens
RSATSTRVD

SEQ ID NO: 702386 - protein, 9 aa, Homo Sapiens
VSYVGAVSY

SEQ ID NO: 702387 - protein, 9 aa, Homo Sapiens
VAKEHHRAQ

SEQ ID NO: 702388 - protein, 9 aa, Homo Sapiens
AKALKLFKN

SEQ ID NO: 702389 - protein, 9 aa, Homo Sapiens
PAISKRDEH

SEQ ID NO: 702390 - protein, 9 aa, Homo Sapiens
TPAMSISLL

SEQ ID NO: 702391 - protein, 9 aa, Homo Sapiens
PSVRDACSL

SEQ ID NO: 702392 - protein, 9 aa, Homo Sapiens
NASFHSQAV

SEQ ID NO: 702393 - protein, 9 aa, Homo Sapiens
STIMRESKR

SEQ ID NO: 702394 - protein, 9 aa, Homo Sapiens
INTDVHSPL

SEQ ID NO: 702395 - protein, 9 aa, Homo Sapiens
AEIVATKVT

SEQ ID NO: 702396 - protein, 9 aa, Homo Sapiens
TFLKIVNLL

SEQ ID NO: 702397 - protein, 9 aa, Homo Sapiens
GIEKGAEGA

SEQ ID NO: 702398 - protein, 9 aa, Homo Sapiens
PYTYNGIFT

SEQ ID NO: 702399 - protein, 9 aa, Homo Sapiens
HPHTCSCED

SEQ ID NO: 702400 - protein, 9 aa, Homo Sapiens
LISQAEHTL

SEQ ID NO: 702401 - protein, 9 aa, Homo Sapiens
HSKPRNRPS

SEQ ID NO: 702402 - protein, 9 aa, Homo Sapiens
KEQDRVKEI

SEQ ID NO: 702403 - protein, 9 aa, Homo Sapiens
QQQQEDRSK

SEQ ID NO: 702404 - protein, 9 aa, Homo Sapiens
DLIDIYADQ

SEQ ID NO: 702405 - protein, 9 aa, Homo Sapiens
QAERFYTAL

SEQ ID NO: 702406 - protein, 9 aa, Homo Sapiens
RTDFWGPEE

SEQ ID NO: 702407 - protein, 9 aa, Homo Sapiens
MNNCLRQME

SEQ ID NO: 702408 - protein, 9 aa, Homo Sapiens
ACETMCNAT

SEQ ID NO: 702409 - protein, 9 aa, Homo Sapiens
GRLRSWCWP

SEQ ID NO: 702410 - protein, 9 aa, Homo Sapiens
RELEDLMIE

SEQ ID NO: 702411 - protein, 9 aa, Homo Sapiens
TTPPVATEA

SEQ ID NO: 702412 - protein, 9 aa, Homo Sapiens
TCMITPKSK

SEQ ID NO: 702413 - protein, 9 aa, Homo Sapiens
PNISDEYGN

SEQ ID NO: 702414 - protein, 9 aa, Homo Sapiens
DKLYRKPIL

SEQ ID NO: 702415 - protein, 9 aa, Homo Sapiens
IVRGIKEKL

SEQ ID NO: 702416 - protein, 9 aa, Homo Sapiens
YGATSQKCE

SEQ ID NO: 702417 - protein, 9 aa, Homo Sapiens
SHLTAVSVF

SEQ ID NO: 702418 - protein, 9 aa, Homo Sapiens
PPSVPHPPP

SEQ ID NO: 702419 - protein, 9 aa, Homo Sapiens
CKTMWNRWF

SEQ ID NO: 702420 - protein, 9 aa, Homo Sapiens
ADFRWQQRV

SEQ ID NO: 702421 - protein, 9 aa, Homo Sapiens
FPFAAIHQV

SEQ ID NO: 702422 - protein, 9 aa, Homo Sapiens
GMGLELRPH

SEQ ID NO: 702423 - protein, 9 aa, Homo Sapiens
GPGLAKRSA

SEQ ID NO: 702424 - protein, 9 aa, Homo Sapiens
SDEDDNDDE

SEQ ID NO: 702425 - protein, 9 aa, Homo Sapiens
FDYDKSKNS

SEQ ID NO: 702426 - protein, 9 aa, Homo Sapiens
IIIVKWMMK

SEQ ID NO: 702427 - protein, 9 aa, Homo Sapiens
LGIFWFCAC

SEQ ID NO: 702428 - protein, 9 aa, Homo Sapiens
NLAFNDIKI

SEQ ID NO: 702429 - protein, 9 aa, Homo Sapiens
AIAQQLRQL

SEQ ID NO: 702430 - protein, 9 aa, Homo Sapiens
MSFMTLLFL

SEQ ID NO: 702431 - protein, 9 aa, Homo Sapiens
KLYRKPILS

SEQ ID NO: 702432 - protein, 9 aa, Homo Sapiens
QTIMGGVNK

SEQ ID NO: 702433 - protein, 9 aa, Homo Sapiens
SQGMGNVCG

SEQ ID NO: 702434 - protein, 9 aa, Homo Sapiens
ADLLTGSQS

SEQ ID NO: 702435 - protein, 9 aa, Homo Sapiens
HMDCVRVLL

SEQ ID NO: 702436 - protein, 9 aa, Homo Sapiens
EKLYQEIIL

SEQ ID NO: 702437 - protein, 9 aa, Homo Sapiens
LAADLLLII

SEQ ID NO: 702438 - protein, 9 aa, Homo Sapiens
FNIDLFRPQ

SEQ ID NO: 702439 - protein, 9 aa, Homo Sapiens
LRPRPPQLR

SEQ ID NO: 702440 - protein, 9 aa, Homo Sapiens
SQIQWLIGS

SEQ ID NO: 702441 - protein, 9 aa, Homo Sapiens
QHIEGGSSG

SEQ ID NO: 702442 - protein, 9 aa, Homo Sapiens
PYLNFRNPD

SEQ ID NO: 702443 - protein, 9 aa, Homo Sapiens
GTFAKYQAS

SEQ ID NO: 702444 - protein, 9 aa, Homo Sapiens
PFMMPPPSV

SEQ ID NO: 702445 - protein, 9 aa, Homo Sapiens
MELPGASQG

SEQ ID NO: 702446 - protein, 9 aa, Homo Sapiens
CCRLELCRA

SEQ ID NO: 702447 - protein, 9 aa, Homo Sapiens
DHDLVFEQQ

SEQ ID NO: 702448 - protein, 9 aa, Homo Sapiens
GLWMGLGLG

SEQ ID NO: 702449 - protein, 9 aa, Homo Sapiens
QDSSDEDDN

SEQ ID NO: 702450 - protein, 9 aa, Homo Sapiens
NENAQLVNL

SEQ ID NO: 702451 - protein, 9 aa, Homo Sapiens
SYERQQMRQ

SEQ ID NO: 702452 - protein, 9 aa, Homo Sapiens
WLSHVPSPG

SEQ ID NO: 702453 - protein, 9 aa, Homo Sapiens
SATLLYHQP

SEQ ID NO: 702454 - protein, 9 aa, Homo Sapiens
FHSQAVCIL

SEQ ID NO: 702455 - protein, 9 aa, Homo Sapiens
IAAEEAWTE

SEQ ID NO: 702456 - protein, 9 aa, Homo Sapiens
ISLPMKEQL

SEQ ID NO: 702457 - protein, 9 aa, Homo Sapiens
PKEVVKGPC

SEQ ID NO: 702458 - protein, 9 aa, Homo Sapiens
PVATEAQTT

SEQ ID NO: 702459 - protein, 9 aa, Homo Sapiens
EYVKKRREK

SEQ ID NO: 702460 - protein, 9 aa, Homo Sapiens
CDAGSGSDL

SEQ ID NO: 702461 - protein, 9 aa, Homo Sapiens
KRELIQERT

SEQ ID NO: 702462 - protein, 9 aa, Homo Sapiens
ESEQGMRDR

SEQ ID NO: 702463 - protein, 9 aa, Homo Sapiens
ISDVSIVYD

SEQ ID NO: 702464 - protein, 9 aa, Homo Sapiens
SCCSSSRRT

SEQ ID NO: 702465 - protein, 9 aa, Homo Sapiens
GSGRDSPPS

SEQ ID NO: 702466 - protein, 9 aa, Homo Sapiens
YCGHGFYPQ

SEQ ID NO: 702467 - protein, 9 aa, Homo Sapiens
VLLPTHPST

SEQ ID NO: 702468 - protein, 9 aa, Homo Sapiens
RCRMEGGCC

SEQ ID NO: 702469 - protein, 9 aa, Homo Sapiens
QPPPLLPHG

SEQ ID NO: 702470 - protein, 9 aa, Homo Sapiens
KEEKITIVT

SEQ ID NO: 702471 - protein, 9 aa, Homo Sapiens
VRKTATLHC

SEQ ID NO: 702472 - protein, 9 aa, Homo Sapiens
FAKYQASWK

SEQ ID NO: 702473 - protein, 9 aa, Homo Sapiens
SECDIFHPE

SEQ ID NO: 702474 - protein, 9 aa, Homo Sapiens
MRPTFLKIV

SEQ ID NO: 702475 - protein, 9 aa, Homo Sapiens
VPTPSQEGA

SEQ ID NO: 702476 - protein, 9 aa, Homo Sapiens
DDEDNDVPG

SEQ ID NO: 702477 - protein, 9 aa, Homo Sapiens
NRAYLLLEL

SEQ ID NO: 702478 - protein, 9 aa, Homo Sapiens
LSEVDKSKE

SEQ ID NO: 702479 - protein, 9 aa, Homo Sapiens
ANGHVKVVT

SEQ ID NO: 702480 - protein, 9 aa, Homo Sapiens
VIQSYLKKL

SEQ ID NO: 702481 - protein, 9 aa, Homo Sapiens
DSNLCGAMH

SEQ ID NO: 702482 - protein, 9 aa, Homo Sapiens
SSLGYKSYQ

SEQ ID NO: 702483 - protein, 9 aa, Homo Sapiens
MAPPTPIEV

SEQ ID NO: 702484 - protein, 9 aa, Homo Sapiens
ELWSRLQVN

SEQ ID NO: 702485 - protein, 9 aa, Homo Sapiens
QESAQRTDF

SEQ ID NO: 702486 - protein, 9 aa, Homo Sapiens
EARALENAD

SEQ ID NO: 702487 - protein, 9 aa, Homo Sapiens
VGTSQTGTS

SEQ ID NO: 702488 - protein, 9 aa, Homo Sapiens
IHETARVVF

SEQ ID NO: 702489 - protein, 9 aa, Homo Sapiens
GSRKRKAPP

SEQ ID NO: 702490 - protein, 9 aa, Homo Sapiens
AVSKCPLPL

SEQ ID NO: 702491 - protein, 9 aa, Homo Sapiens
QKGVVKEEK

SEQ ID NO: 702492 - protein, 9 aa, Homo Sapiens
PSPGCQLAE

SEQ ID NO: 702493 - protein, 9 aa, Homo Sapiens
AFSKGEKKD

SEQ ID NO: 702494 - protein, 9 aa, Homo Sapiens
SMFQDQFEM

SEQ ID NO: 702495 - protein, 9 aa, Homo Sapiens
QTGTSQIGM

SEQ ID NO: 702496 - protein, 9 aa, Homo Sapiens
ETYFEHEEQ

SEQ ID NO: 702497 - protein, 9 aa, Homo Sapiens
PDTNLLRLV

SEQ ID NO: 702498 - protein, 9 aa, Homo Sapiens
EALRQQVAD

SEQ ID NO: 702499 - protein, 9 aa, Homo Sapiens
QNGDKLQKI

SEQ ID NO: 702500 - protein, 9 aa, Homo Sapiens
ASAPNAVWR

SEQ ID NO: 702501 - protein, 9 aa, Homo Sapiens
CSCCRLELC

SEQ ID NO: 702502 - protein, 9 aa, Homo Sapiens
MFEEQKSMF

SEQ ID NO: 702503 - protein, 9 aa, Homo Sapiens
VNFQDTDGF

SEQ ID NO: 702504 - protein, 9 aa, Homo Sapiens
SLLFAAWLS

SEQ ID NO: 702505 - protein, 9 aa, Homo Sapiens
SINRCLQLT

SEQ ID NO: 702506 - protein, 9 aa, Homo Sapiens
SADDNLVPQ

SEQ ID NO: 702507 - protein, 9 aa, Homo Sapiens
LRQTLEGKY

SEQ ID NO: 702508 - protein, 9 aa, Homo Sapiens
TLAACCTAE

SEQ ID NO: 702509 - protein, 9 aa, Homo Sapiens
LFFQINVVE

SEQ ID NO: 702510 - protein, 9 aa, Homo Sapiens
ASSTGPCGR

SEQ ID NO: 702511 - protein, 9 aa, Homo Sapiens
KTMWNRWFG

SEQ ID NO: 702512 - protein, 9 aa, Homo Sapiens
GVVKEEKIT

SEQ ID NO: 702513 - protein, 9 aa, Homo Sapiens
SRQRSLLPR

SEQ ID NO: 702514 - protein, 9 aa, Homo Sapiens
QGPTTRRKG

SEQ ID NO: 702515 - protein, 9 aa, Homo Sapiens
ALRRSLEAM

SEQ ID NO: 702516 - protein, 9 aa, Homo Sapiens
LRPGWLSLL

SEQ ID NO: 702517 - protein, 9 aa, Homo Sapiens
FNDIKILGT

SEQ ID NO: 702518 - protein, 9 aa, Homo Sapiens
VNVQKQQCL

SEQ ID NO: 702519 - protein, 9 aa, Homo Sapiens
SLEAMKAMS

SEQ ID NO: 702520 - protein, 9 aa, Homo Sapiens
PLAAAPATA

SEQ ID NO: 702521 - protein, 9 aa, Homo Sapiens
NPPASSFSA

SEQ ID NO: 702522 - protein, 9 aa, Homo Sapiens
APKAKLHAG

SEQ ID NO: 702523 - protein, 9 aa, Homo Sapiens
PPRRQRGGR

SEQ ID NO: 702524 - protein, 9 aa, Homo Sapiens
HEGCIEDLV

SEQ ID NO: 702525 - protein, 9 aa, Homo Sapiens
VTPTAPGTG

SEQ ID NO: 702526 - protein, 9 aa, Homo Sapiens
DAYFTMMDK

SEQ ID NO: 702527 - protein, 9 aa, Homo Sapiens
VSTTGKGWG

SEQ ID NO: 702528 - protein, 9 aa, Homo Sapiens
LSLGSFRSR

SEQ ID NO: 702529 - protein, 9 aa, Homo Sapiens
LVPGQHFGL

SEQ ID NO: 702530 - protein, 9 aa, Homo Sapiens
LFKSTLVFP

SEQ ID NO: 702531 - protein, 9 aa, Homo Sapiens
LVNLLSLGS

SEQ ID NO: 702532 - protein, 9 aa, Homo Sapiens
WERTQQASV

SEQ ID NO: 702533 - protein, 9 aa, Homo Sapiens
CLCRTLSCD

SEQ ID NO: 702534 - protein, 9 aa, Homo Sapiens
HLSELQLFE

SEQ ID NO: 702535 - protein, 9 aa, Homo Sapiens
ASADRAVID

SEQ ID NO: 702536 - protein, 9 aa, Homo Sapiens
APGTGSRAR

SEQ ID NO: 702537 - protein, 9 aa, Homo Sapiens
PAKSLSDRL

SEQ ID NO: 702538 - protein, 9 aa, Homo Sapiens
GGFLYAGLS

SEQ ID NO: 702539 - protein, 9 aa, Homo Sapiens
NGKHHGTRC

SEQ ID NO: 702540 - protein, 9 aa, Homo Sapiens
RCLTRTASW

SEQ ID NO: 702541 - protein, 9 aa, Homo Sapiens
DCLEGNIMH

SEQ ID NO: 702542 - protein, 9 aa, Homo Sapiens
ECFEEADFS

SEQ ID NO: 702543 - protein, 9 aa, Homo Sapiens
EKGAEGAAE

SEQ ID NO: 702544 - protein, 9 aa, Homo Sapiens
KQLLSFVSI

SEQ ID NO: 702545 - protein, 9 aa, Homo Sapiens
SRPGCSQRV

SEQ ID NO: 702546 - protein, 9 aa, Homo Sapiens
VPSPGPGHL

SEQ ID NO: 702547 - protein, 9 aa, Homo Sapiens
SLGYKSYQN

SEQ ID NO: 702548 - protein, 9 aa, Homo Sapiens
SKYGPISDV

SEQ ID NO: 702549 - protein, 9 aa, Homo Sapiens
QWLIGSVEE

SEQ ID NO: 702550 - protein, 9 aa, Homo Sapiens
CGRRSSTST

SEQ ID NO: 702551 - protein, 9 aa, Homo Sapiens
PPPLLPHGK

SEQ ID NO: 702552 - protein, 9 aa, Homo Sapiens
RQVPVPEPY

SEQ ID NO: 702553 - protein, 9 aa, Homo Sapiens
GTCKKTFNV

SEQ ID NO: 702554 - protein, 9 aa, Homo Sapiens
SFHSQAVCI

SEQ ID NO: 702555 - protein, 9 aa, Homo Sapiens
PWPDLPTMA

SEQ ID NO: 702556 - protein, 9 aa, Homo Sapiens
TLSYHKKIQ

SEQ ID NO: 702557 - protein, 9 aa, Homo Sapiens
KAFRSDNCF

SEQ ID NO: 702558 - protein, 9 aa, Homo Sapiens
TYIAPLLEK

SEQ ID NO: 702559 - protein, 9 aa, Homo Sapiens
SFLNEDDDE

SEQ ID NO: 702560 - protein, 9 aa, Homo Sapiens
AETPHKLQF

SEQ ID NO: 702561 - protein, 9 aa, Homo Sapiens
FEIEARALE

SEQ ID NO: 702562 - protein, 9 aa, Homo Sapiens
NLHVNGNSI

SEQ ID NO: 702563 - protein, 9 aa, Homo Sapiens
PSADDNLVP

SEQ ID NO: 702564 - protein, 9 aa, Homo Sapiens
TERKTKLNQ

SEQ ID NO: 702565 - protein, 9 aa, Homo Sapiens
HDLVFEQQE

SEQ ID NO: 702566 - protein, 9 aa, Homo Sapiens
FGLQDDFMC

SEQ ID NO: 702567 - protein, 9 aa, Homo Sapiens
LTATASFSS

SEQ ID NO: 702568 - protein, 9 aa, Homo Sapiens
SISIYEMNV

SEQ ID NO: 702569 - protein, 9 aa, Homo Sapiens
GFEAEFIKN

SEQ ID NO: 702570 - protein, 9 aa, Homo Sapiens
EVQVSPEAA

SEQ ID NO: 702571 - protein, 9 aa, Homo Sapiens
SMSIYDDIY

SEQ ID NO: 702572 - protein, 9 aa, Homo Sapiens
GLAKRSATS

SEQ ID NO: 702573 - protein, 9 aa, Homo Sapiens
SCPNKENCE

SEQ ID NO: 702574 - protein, 9 aa, Homo Sapiens
SKSATLLYH

SEQ ID NO: 702575 - protein, 9 aa, Homo Sapiens
ETLTNQFLD

SEQ ID NO: 702576 - protein, 9 aa, Homo Sapiens
PISDVSIVY

SEQ ID NO: 702577 - protein, 9 aa, Homo Sapiens
HALVDMVQL

SEQ ID NO: 702578 - protein, 9 aa, Homo Sapiens
QDCLEGNIM

SEQ ID NO: 702579 - protein, 9 aa, Homo Sapiens
SFPSATELS

SEQ ID NO: 702580 - protein, 9 aa, Homo Sapiens
VTLYNNSTL

SEQ ID NO: 702581 - protein, 9 aa, Homo Sapiens
ERSSLLLLP

SEQ ID NO: 702582 - protein, 9 aa, Homo Sapiens
MGDQHYSFN

SEQ ID NO: 702583 - protein, 9 aa, Homo Sapiens
KPQVEILSC

SEQ ID NO: 702584 - protein, 9 aa, Homo Sapiens
DGVANGKIS

SEQ ID NO: 702585 - protein, 9 aa, Homo Sapiens
SGLADKGTL

SEQ ID NO: 702586 - protein, 9 aa, Homo Sapiens
HSRWEADLF

SEQ ID NO: 702587 - protein, 9 aa, Homo Sapiens
ATKVTAKIV

SEQ ID NO: 702588 - protein, 9 aa, Homo Sapiens
RPFPLARYN

SEQ ID NO: 702589 - protein, 9 aa, Homo Sapiens
KRDEHESPI

SEQ ID NO: 702590 - protein, 9 aa, Homo Sapiens
REGTPCAET

SEQ ID NO: 702591 - protein, 9 aa, Homo Sapiens
LNVKGLARA

SEQ ID NO: 702592 - protein, 9 aa, Homo Sapiens
FPFCRESGK

SEQ ID NO: 702593 - protein, 9 aa, Homo Sapiens
RQVGTSQTG

SEQ ID NO: 702594 - protein, 9 aa, Homo Sapiens
SDCTGCHKV

SEQ ID NO: 702595 - protein, 9 aa, Homo Sapiens
SAPNAVWRV

SEQ ID NO: 702596 - protein, 9 aa, Homo Sapiens
NVLMDFEDG

SEQ ID NO: 702597 - protein, 9 aa, Homo Sapiens
GLQDDFMCS

SEQ ID NO: 702598 - protein, 9 aa, Homo Sapiens
YLLLELGRG

SEQ ID NO: 702599 - protein, 9 aa, Homo Sapiens
AKYQASWKE

SEQ ID NO: 702600 - protein, 9 aa, Homo Sapiens
LLVNREAAG

SEQ ID NO: 702601 - protein, 9 aa, Homo Sapiens
TKPPCLAPG

SEQ ID NO: 702602 - protein, 9 aa, Homo Sapiens
LSFVSITDF

SEQ ID NO: 702603 - protein, 9 aa, Homo Sapiens
SKRHKIRQT

SEQ ID NO: 702604 - protein, 9 aa, Homo Sapiens
ALFNGSGRD

SEQ ID NO: 702605 - protein, 9 aa, Homo Sapiens
VNGSQHLLT

SEQ ID NO: 702606 - protein, 9 aa, Homo Sapiens
DRLAVLKGL

SEQ ID NO: 702607 - protein, 9 aa, Homo Sapiens
NENSEPKIC

SEQ ID NO: 702608 - protein, 9 aa, Homo Sapiens
KIQTGEKPY

SEQ ID NO: 702609 - protein, 9 aa, Homo Sapiens
LNDYRKVSR

SEQ ID NO: 702610 - protein, 9 aa, Homo Sapiens
MGRRAEQES

SEQ ID NO: 702611 - protein, 9 aa, Homo Sapiens
DLSSFECFE

SEQ ID NO: 702612 - protein, 9 aa, Homo Sapiens
IQKLESRVS

SEQ ID NO: 702613 - protein, 9 aa, Homo Sapiens
TRERHPGYR

SEQ ID NO: 702614 - protein, 9 aa, Homo Sapiens
ERTQQASVL

SEQ ID NO: 702615 - protein, 9 aa, Homo Sapiens
VAQITGEIQ

SEQ ID NO: 702616 - protein, 9 aa, Homo Sapiens
RDPEPLGRL

SEQ ID NO: 702617 - protein, 9 aa, Homo Sapiens
SPSVRDACS

SEQ ID NO: 702618 - protein, 9 aa, Homo Sapiens
SDEYGNTAL

SEQ ID NO: 702619 - protein, 9 aa, Homo Sapiens
VVTICLRII

SEQ ID NO: 702620 - protein, 9 aa, Homo Sapiens
AVFQRVTGS

SEQ ID NO: 702621 - protein, 9 aa, Homo Sapiens
APNAVWRVT

SEQ ID NO: 702622 - protein, 9 aa, Homo Sapiens
AGNTIREAE

SEQ ID NO: 702623 - protein, 9 aa, Homo Sapiens
QNTGHLAVD

SEQ ID NO: 702624 - protein, 9 aa, Homo Sapiens
KAHGRALAP

SEQ ID NO: 702625 - protein, 9 aa, Homo Sapiens
GVRLPGAAQ

SEQ ID NO: 702626 - protein, 9 aa, Homo Sapiens
SSAPLAAAP

SEQ ID NO: 702627 - protein, 9 aa, Homo Sapiens
NGSGRDSPP

SEQ ID NO: 702628 - protein, 9 aa, Homo Sapiens
DELRQRWDP

SEQ ID NO: 702629 - protein, 9 aa, Homo Sapiens
DAKAAVVIG

SEQ ID NO: 702630 - protein, 9 aa, Homo Sapiens
LGPNTGGFL

SEQ ID NO: 702631 - protein, 9 aa, Homo Sapiens
GHPVEEKVD

SEQ ID NO: 702632 - protein, 9 aa, Homo Sapiens
VSHLCIIIC

SEQ ID NO: 702633 - protein, 9 aa, Homo Sapiens
ADGARQVGN

SEQ ID NO: 702634 - protein, 9 aa, Homo Sapiens
VQLTDLYPG

SEQ ID NO: 702635 - protein, 9 aa, Homo Sapiens
RIPGHDWCF

SEQ ID NO: 702636 - protein, 9 aa, Homo Sapiens
EDLDTCMIT

SEQ ID NO: 702637 - protein, 9 aa, Homo Sapiens
LESRVSELE

SEQ ID NO: 702638 - protein, 9 aa, Homo Sapiens
SLYAKAKEQ

SEQ ID NO: 702639 - protein, 9 aa, Homo Sapiens
TGTREVRDI

SEQ ID NO: 702640 - protein, 9 aa, Homo Sapiens
RVTPTAPGT

SEQ ID NO: 702641 - protein, 9 aa, Homo Sapiens
YLFCTCGVS

SEQ ID NO: 702642 - protein, 9 aa, Homo Sapiens
SPTGYWYAG

SEQ ID NO: 702643 - protein, 9 aa, Homo Sapiens
PGWCSAYYE

SEQ ID NO: 702644 - protein, 9 aa, Homo Sapiens
VNPKRELIQ

SEQ ID NO: 702645 - protein, 9 aa, Homo Sapiens
LGTLHLQRR

SEQ ID NO: 702646 - protein, 9 aa, Homo Sapiens
RILIYNFKQ

SEQ ID NO: 702647 - protein, 9 aa, Homo Sapiens
GPQPLTRRG

SEQ ID NO: 702648 - protein, 9 aa, Homo Sapiens
QRYKNLKVD

SEQ ID NO: 702649 - protein, 9 aa, Homo Sapiens
RNAAAPERL

SEQ ID NO: 702650 - protein, 9 aa, Homo Sapiens
DPNNLAFND

SEQ ID NO: 702651 - protein, 9 aa, Homo Sapiens
EIEARALEN

SEQ ID NO: 702652 - protein, 9 aa, Homo Sapiens
VVTAAYSKP

SEQ ID NO: 702653 - protein, 9 aa, Homo Sapiens
LEAMKAMSS

SEQ ID NO: 702654 - protein, 9 aa, Homo Sapiens
CFEEADFSP

SEQ ID NO: 702655 - protein, 9 aa, Homo Sapiens
MKQMNDARH

SEQ ID NO: 702656 - protein, 9 aa, Homo Sapiens
YEKRALYLE

SEQ ID NO: 702657 - protein, 9 aa, Homo Sapiens
AAKPLESDM

SEQ ID NO: 702658 - protein, 9 aa, Homo Sapiens
EMELPGASQ

SEQ ID NO: 702659 - protein, 9 aa, Homo Sapiens
WTETEKVWL

SEQ ID NO: 702660 - protein, 9 aa, Homo Sapiens
GSVITTKGV

SEQ ID NO: 702661 - protein, 9 aa, Homo Sapiens
EILFRDDDK

SEQ ID NO: 702662 - protein, 9 aa, Homo Sapiens
GQGQVLPGG

SEQ ID NO: 702663 - protein, 9 aa, Homo Sapiens
EHEEQDNDW

SEQ ID NO: 702664 - protein, 9 aa, Homo Sapiens
VPEPYTYNG

SEQ ID NO: 702665 - protein, 9 aa, Homo Sapiens
PLLPHGKGR

SEQ ID NO: 702666 - protein, 9 aa, Homo Sapiens
QHLSRVEGN

SEQ ID NO: 702667 - protein, 9 aa, Homo Sapiens
EKGEPGNDG

SEQ ID NO: 702668 - protein, 9 aa, Homo Sapiens
RGAGPQPLT

SEQ ID NO: 702669 - protein, 9 aa, Homo Sapiens
GSWWPPCRC

SEQ ID NO: 702670 - protein, 9 aa, Homo Sapiens
SSDEDDNDD

SEQ ID NO: 702671 - protein, 9 aa, Homo Sapiens
RLNGAWQYE

SEQ ID NO: 702672 - protein, 9 aa, Homo Sapiens
QDQKHHSAA

SEQ ID NO: 702673 - protein, 9 aa, Homo Sapiens
NSMAKEWYK

SEQ ID NO: 702674 - protein, 9 aa, Homo Sapiens
SAMLLAFVA

SEQ ID NO: 702675 - protein, 9 aa, Homo Sapiens
LSCEGAGEP

SEQ ID NO: 702676 - protein, 9 aa, Homo Sapiens
TFDEAMANL

SEQ ID NO: 702677 - protein, 9 aa, Homo Sapiens
AAIHQVHNT

SEQ ID NO: 702678 - protein, 9 aa, Homo Sapiens
GGRSFSQRE

SEQ ID NO: 702679 - protein, 9 aa, Homo Sapiens
LLRSMSTAF

SEQ ID NO: 702680 - protein, 9 aa, Homo Sapiens
RSTYPWNYT

SEQ ID NO: 702681 - protein, 9 aa, Homo Sapiens
IEITNINTR

SEQ ID NO: 702682 - protein, 9 aa, Homo Sapiens
LATVKANAL

SEQ ID NO: 702683 - protein, 9 aa, Homo Sapiens
PGSATTSLV

SEQ ID NO: 702684 - protein, 9 aa, Homo Sapiens
TLTNQFLDS

SEQ ID NO: 702685 - protein, 9 aa, Homo Sapiens
SLRQTLEGK

SEQ ID NO: 702686 - protein, 9 aa, Homo Sapiens
AALRPGWLS

SEQ ID NO: 702687 - protein, 9 aa, Homo Sapiens
NTFGSVEVH

SEQ ID NO: 702688 - protein, 9 aa, Homo Sapiens
LMDFEDGAF

SEQ ID NO: 702689 - protein, 9 aa, Homo Sapiens
FLLTVNKLS

SEQ ID NO: 702690 - protein, 9 aa, Homo Sapiens
LKDFVAANS

SEQ ID NO: 702691 - protein, 9 aa, Homo Sapiens
PRRLGTFAK

SEQ ID NO: 702692 - protein, 9 aa, Homo Sapiens
TVLFSFYLK

SEQ ID NO: 702693 - protein, 9 aa, Homo Sapiens
KESVKCCLL

SEQ ID NO: 702694 - protein, 9 aa, Homo Sapiens
HLDACETMC

SEQ ID NO: 702695 - protein, 9 aa, Homo Sapiens
TTFDEAMAN

SEQ ID NO: 702696 - protein, 9 aa, Homo Sapiens
YYSPQKVKC

SEQ ID NO: 702697 - protein, 9 aa, Homo Sapiens
LTSTIMRES

SEQ ID NO: 702698 - protein, 9 aa, Homo Sapiens
LMLGVYLLI

SEQ ID NO: 702699 - protein, 9 aa, Homo Sapiens
LQDAVARSA

SEQ ID NO: 702700 - protein, 9 aa, Homo Sapiens
DAVARSAAT

SEQ ID NO: 702701 - protein, 9 aa, Homo Sapiens
GLAPPQHLS

SEQ ID NO: 702702 - protein, 9 aa, Homo Sapiens
IVNVQKQQC

SEQ ID NO: 702703 - protein, 9 aa, Homo Sapiens
SEIADLFMH

SEQ ID NO: 702704 - protein, 9 aa, Homo Sapiens
FYSSPLQAP

SEQ ID NO: 702705 - protein, 9 aa, Homo Sapiens
GLADKGTLL

SEQ ID NO: 702706 - protein, 9 aa, Homo Sapiens
EGCIEDLVR

SEQ ID NO: 702707 - protein, 9 aa, Homo Sapiens
HRYLDYRPV

SEQ ID NO: 702708 - protein, 9 aa, Homo Sapiens
SRWEADLFD

SEQ ID NO: 702709 - protein, 9 aa, Homo Sapiens
TNYDSDLRS

SEQ ID NO: 702710 - protein, 9 aa, Homo Sapiens
KPIISAFAG

SEQ ID NO: 702711 - protein, 9 aa, Homo Sapiens
SEFYSSPLQ

SEQ ID NO: 702712 - protein, 9 aa, Homo Sapiens
CGAMHPSDG

SEQ ID NO: 702713 - protein, 9 aa, Homo Sapiens
RHKIRQTGK

SEQ ID NO: 702714 - protein, 9 aa, Homo Sapiens
RQRWDPNGA

SEQ ID NO: 702715 - protein, 9 aa, Homo Sapiens
YAAGGMGLE

SEQ ID NO: 702716 - protein, 9 aa, Homo Sapiens
YIQNLLTAT

SEQ ID NO: 702717 - protein, 9 aa, Homo Sapiens
VPPLGVDGV

SEQ ID NO: 702718 - protein, 9 aa, Homo Sapiens
TRTGLFRRF

SEQ ID NO: 702719 - protein, 9 aa, Homo Sapiens
VADLEFQLG

SEQ ID NO: 702720 - protein, 9 aa, Homo Sapiens
ADQEFNQDP

SEQ ID NO: 702721 - protein, 9 aa, Homo Sapiens
QHFGLQEQA

SEQ ID NO: 702722 - protein, 9 aa, Homo Sapiens
AQLVNLLSL

SEQ ID NO: 702723 - protein, 9 aa, Homo Sapiens
KKRRELMNF

SEQ ID NO: 702724 - protein, 9 aa, Homo Sapiens
IFGSTNTVT

SEQ ID NO: 702725 - protein, 9 aa, Homo Sapiens
KGPQVSFAL

SEQ ID NO: 702726 - protein, 9 aa, Homo Sapiens
DIDKIIKER

SEQ ID NO: 702727 - protein, 9 aa, Homo Sapiens
LVAPISLHV

SEQ ID NO: 702728 - protein, 9 aa, Homo Sapiens
NDGPSGAEG

SEQ ID NO: 702729 - protein, 9 aa, Homo Sapiens
IRAVFILDN

SEQ ID NO: 702730 - protein, 9 aa, Homo Sapiens
ACPQGTRYG

SEQ ID NO: 702731 - protein, 9 aa, Homo Sapiens
IKYMAPSNT

SEQ ID NO: 702732 - protein, 9 aa, Homo Sapiens
GKKLGPTET

SEQ ID NO: 702733 - protein, 9 aa, Homo Sapiens
SGSYASHTT

SEQ ID NO: 702734 - protein, 9 aa, Homo Sapiens
NVTWAIGEI

SEQ ID NO: 702735 - protein, 9 aa, Homo Sapiens
SADRAVIDY

SEQ ID NO: 702736 - protein, 9 aa, Homo Sapiens
KYGPISDVS

SEQ ID NO: 702737 - protein, 9 aa, Homo Sapiens
GETMRVALF

SEQ ID NO: 702738 - protein, 9 aa, Homo Sapiens
ASKIPAFIL

SEQ ID NO: 702739 - protein, 9 aa, Homo Sapiens
DCTGCHKVN

SEQ ID NO: 702740 - protein, 9 aa, Homo Sapiens
QTFIFSDGD

SEQ ID NO: 702741 - protein, 9 aa, Homo Sapiens
DHVPFLMHY

SEQ ID NO: 702742 - protein, 9 aa, Homo Sapiens
ARAVFQRVT

SEQ ID NO: 702743 - protein, 9 aa, Homo Sapiens
AVVECERRK

SEQ ID NO: 702744 - protein, 9 aa, Homo Sapiens
PEFAIQSIN

SEQ ID NO: 702745 - protein, 9 aa, Homo Sapiens
SRVEGNLRV

SEQ ID NO: 702746 - protein, 9 aa, Homo Sapiens
GEKEDEDEY

SEQ ID NO: 702747 - protein, 9 aa, Homo Sapiens
CVQCRAFSK

SEQ ID NO: 702748 - protein, 9 aa, Homo Sapiens
LRLVQFICA

SEQ ID NO: 702749 - protein, 9 aa, Homo Sapiens
MNCIVHALT

SEQ ID NO: 702750 - protein, 9 aa, Homo Sapiens
HAQVQEFLK

SEQ ID NO: 702751 - protein, 9 aa, Homo Sapiens
IRKDTWVEH

SEQ ID NO: 702752 - protein, 9 aa, Homo Sapiens
RPPRGRGAW

SEQ ID NO: 702753 - protein, 9 aa, Homo Sapiens
IYADVLQNY

SEQ ID NO: 702754 - protein, 9 aa, Homo Sapiens
TSQTGTSQI

SEQ ID NO: 702755 - protein, 9 aa, Homo Sapiens
IQWLIGSVE

SEQ ID NO: 702756 - protein, 9 aa, Homo Sapiens
RPGTPAMSI

SEQ ID NO: 702757 - protein, 9 aa, Homo Sapiens
NFVSHSKSF

SEQ ID NO: 702758 - protein, 9 aa, Homo Sapiens
ARALENADA

SEQ ID NO: 702759 - protein, 9 aa, Homo Sapiens
VSFALNLDT

SEQ ID NO: 702760 - protein, 9 aa, Homo Sapiens
TTSLVAPIS

SEQ ID NO: 702761 - protein, 9 aa, Homo Sapiens
SDGDDPELE

SEQ ID NO: 702762 - protein, 9 aa, Homo Sapiens
FGPRGTGKS

SEQ ID NO: 702763 - protein, 9 aa, Homo Sapiens
AVWRVTPTA

SEQ ID NO: 702764 - protein, 9 aa, Homo Sapiens
VKFDDIREL

SEQ ID NO: 702765 - protein, 9 aa, Homo Sapiens
TTDSLRNKV

SEQ ID NO: 702766 - protein, 9 aa, Homo Sapiens
DNDSRRGSL

SEQ ID NO: 702767 - protein, 9 aa, Homo Sapiens
KVTAKIVTL

SEQ ID NO: 702768 - protein, 9 aa, Homo Sapiens
LQRRTVDEM

SEQ ID NO: 702769 - protein, 9 aa, Homo Sapiens
QIAAEEAWT

SEQ ID NO: 702770 - protein, 9 aa, Homo Sapiens
EVLLGAIET

SEQ ID NO: 702771 - protein, 9 aa, Homo Sapiens
NITYIAPLL

SEQ ID NO: 702772 - protein, 9 aa, Homo Sapiens
WFCACDIGL

SEQ ID NO: 702773 - protein, 9 aa, Homo Sapiens
TNDHDLVFE

SEQ ID NO: 702774 - protein, 9 aa, Homo Sapiens
FLNEDDDED

SEQ ID NO: 702775 - protein, 9 aa, Homo Sapiens
AEREIVRGI

SEQ ID NO: 702776 - protein, 9 aa, Homo Sapiens
NMVNLVCDM

SEQ ID NO: 702777 - protein, 9 aa, Homo Sapiens
QVGNMTGTT

SEQ ID NO: 702778 - protein, 9 aa, Homo Sapiens
QGSLDLYKQ

SEQ ID NO: 702779 - protein, 9 aa, Homo Sapiens
NLLTATASF

SEQ ID NO: 702780 - protein, 9 aa, Homo Sapiens
ALHWAAALN

SEQ ID NO: 702781 - protein, 9 aa, Homo Sapiens
MDVMLVSTS

SEQ ID NO: 702782 - protein, 9 aa, Homo Sapiens
HGQCWEDFV

SEQ ID NO: 702783 - protein, 9 aa, Homo Sapiens
LVCDRNDNA

SEQ ID NO: 702784 - protein, 9 aa, Homo Sapiens
TSTRVDKCT

SEQ ID NO: 702785 - protein, 9 aa, Homo Sapiens
QKVKCKEVL

SEQ ID NO: 702786 - protein, 9 aa, Homo Sapiens
MMPPPSVPH

SEQ ID NO: 702787 - protein, 9 aa, Homo Sapiens
GEEEGEEQE

SEQ ID NO: 702788 - protein, 9 aa, Homo Sapiens
HKIRQTGKK

SEQ ID NO: 702789 - protein, 9 aa, Homo Sapiens
VEEKVDFEK

SEQ ID NO: 702790 - protein, 9 aa, Homo Sapiens
SMLQKKSVL

SEQ ID NO: 702791 - protein, 9 aa, Homo Sapiens
TETEPDGGS

SEQ ID NO: 702792 - protein, 9 aa, Homo Sapiens
ALFASGCSS

SEQ ID NO: 702793 - protein, 9 aa, Homo Sapiens
NVNFQDTDG

SEQ ID NO: 702794 - protein, 9 aa, Homo Sapiens
TYGNDSFPA

SEQ ID NO: 702795 - protein, 9 aa, Homo Sapiens
AKKQSMKQT

SEQ ID NO: 702796 - protein, 9 aa, Homo Sapiens
VVIGMELKD

SEQ ID NO: 702797 - protein, 9 aa, Homo Sapiens
VANGKISYT

SEQ ID NO: 702798 - protein, 9 aa, Homo Sapiens
QEKLKWEME

SEQ ID NO: 702799 - protein, 9 aa, Homo Sapiens
CPAPRPPAL

SEQ ID NO: 702800 - protein, 9 aa, Homo Sapiens
SIYEMNVST

SEQ ID NO: 702801 - protein, 9 aa, Homo Sapiens
RLHNDLLKF

SEQ ID NO: 702802 - protein, 9 aa, Homo Sapiens
ITEAALPLT

SEQ ID NO: 702803 - protein, 9 aa, Homo Sapiens
LQHLLKENK

SEQ ID NO: 702804 - protein, 9 aa, Homo Sapiens
RVSILVTSI

SEQ ID NO: 702805 - protein, 9 aa, Homo Sapiens
NWITEAALP

SEQ ID NO: 702806 - protein, 9 aa, Homo Sapiens
RARASSPVP

SEQ ID NO: 702807 - protein, 9 aa, Homo Sapiens
RESKRLRPE

SEQ ID NO: 702808 - protein, 9 aa, Homo Sapiens
QWEIQNTGH

SEQ ID NO: 702809 - protein, 9 aa, Homo Sapiens
LEGNIMHFH

SEQ ID NO: 702810 - protein, 9 aa, Homo Sapiens
ASQSSSSPA

SEQ ID NO: 702811 - protein, 9 aa, Homo Sapiens
LVPQLAELT

SEQ ID NO: 702812 - protein, 9 aa, Homo Sapiens
GYIQNLLTA

SEQ ID NO: 702813 - protein, 9 aa, Homo Sapiens
SALHWAAAL

SEQ ID NO: 702814 - protein, 9 aa, Homo Sapiens
FSKRRKVAQ

SEQ ID NO: 702815 - protein, 9 aa, Homo Sapiens
CNYGHCPAP

SEQ ID NO: 702816 - protein, 9 aa, Homo Sapiens
SQQQEVISP

SEQ ID NO: 702817 - protein, 9 aa, Homo Sapiens
QDTDGFSAL

SEQ ID NO: 702818 - protein, 9 aa, Homo Sapiens
AGPQPLTRR

SEQ ID NO: 702819 - protein, 9 aa, Homo Sapiens
RGVRLPGAA

SEQ ID NO: 702820 - protein, 9 aa, Homo Sapiens
MNITYIAPL

SEQ ID NO: 702821 - protein, 9 aa, Homo Sapiens
QYKMNITYI

SEQ ID NO: 702822 - protein, 9 aa, Homo Sapiens
PLPDTNLLR

SEQ ID NO: 702823 - protein, 9 aa, Homo Sapiens
ACCTAEGSP

SEQ ID NO: 702824 - protein, 9 aa, Homo Sapiens
NQFLDSKQH

SEQ ID NO: 702825 - protein, 9 aa, Homo Sapiens
HYFDLKRTT

SEQ ID NO: 702826 - protein, 9 aa, Homo Sapiens
KGLARAVFQ

SEQ ID NO: 702827 - protein, 9 aa, Homo Sapiens
EKKKSKNLV

SEQ ID NO: 702828 - protein, 9 aa, Homo Sapiens
LLQQQQEDR

SEQ ID NO: 702829 - protein, 9 aa, Homo Sapiens
TKLNQLPSV

SEQ ID NO: 702830 - protein, 9 aa, Homo Sapiens
ILLHSAKNN

SEQ ID NO: 702831 - protein, 9 aa, Homo Sapiens
SGSDLESCS

SEQ ID NO: 702832 - protein, 9 aa, Homo Sapiens
CLTRTGLFR

SEQ ID NO: 702833 - protein, 9 aa, Homo Sapiens
DGTNNFVHN

SEQ ID NO: 702834 - protein, 9 aa, Homo Sapiens
LCRAGRQRR

SEQ ID NO: 702835 - protein, 9 aa, Homo Sapiens
RSRKKRKVS

SEQ ID NO: 702836 - protein, 9 aa, Homo Sapiens
ASSPVPRGG

SEQ ID NO: 702837 - protein, 9 aa, Homo Sapiens
KPNLSYIIR

SEQ ID NO: 702838 - protein, 9 aa, Homo Sapiens
NPNFQIIIA

SEQ ID NO: 702839 - protein, 9 aa, Homo Sapiens
DNASGRTSV

SEQ ID NO: 702840 - protein, 9 aa, Homo Sapiens
LEVYVFLGA

SEQ ID NO: 702841 - protein, 9 aa, Homo Sapiens
FALERNPST

SEQ ID NO: 702842 - protein, 9 aa, Homo Sapiens
HWAAALNNV

SEQ ID NO: 702843 - protein, 9 aa, Homo Sapiens
SSGSLPNNA

SEQ ID NO: 702844 - protein, 9 aa, Homo Sapiens
EGGSSGGEG

SEQ ID NO: 702845 - protein, 9 aa, Homo Sapiens
FMGYYWYSK

SEQ ID NO: 702846 - protein, 9 aa, Homo Sapiens
TYPWNYTVT

SEQ ID NO: 702847 - protein, 9 aa, Homo Sapiens
SNVLMDFED

SEQ ID NO: 702848 - protein, 9 aa, Homo Sapiens
FCSLLFAAW

SEQ ID NO: 702849 - protein, 9 aa, Homo Sapiens
CSQQSSERS

SEQ ID NO: 702850 - protein, 9 aa, Homo Sapiens
RGPGLAKRS

SEQ ID NO: 702851 - protein, 9 aa, Homo Sapiens
PEKNGFNLC

SEQ ID NO: 702852 - protein, 9 aa, Homo Sapiens
LRELEDLMI

SEQ ID NO: 702853 - protein, 9 aa, Homo Sapiens
VTAAYSKPT

SEQ ID NO: 702854 - protein, 9 aa, Homo Sapiens
RAVIDYNGE

SEQ ID NO: 702855 - protein, 9 aa, Homo Sapiens
PTPIEVVAA

SEQ ID NO: 702856 - protein, 9 aa, Homo Sapiens
PSPPKPHRF

SEQ ID NO: 702857 - protein, 9 aa, Homo Sapiens
EPYTYNGIF

SEQ ID NO: 702858 - protein, 9 aa, Homo Sapiens
VYHGIDAYL

SEQ ID NO: 702859 - protein, 9 aa, Homo Sapiens
IHDYMSTVT

SEQ ID NO: 702860 - protein, 9 aa, Homo Sapiens
GEPGNDGPS

SEQ ID NO: 702861 - protein, 9 aa, Homo Sapiens
YQEIILYFD

SEQ ID NO: 702862 - protein, 9 aa, Homo Sapiens
ILGAIQSQQ

SEQ ID NO: 702863 - protein, 9 aa, Homo Sapiens
FEDGAFEGL

SEQ ID NO: 702864 - protein, 9 aa, Homo Sapiens
KLHQSLYQS

SEQ ID NO: 702865 - protein, 9 aa, Homo Sapiens
IRGVRLPGA

SEQ ID NO: 702866 - protein, 9 aa, Homo Sapiens
GQCSGFGHK

SEQ ID NO: 702867 - protein, 9 aa, Homo Sapiens
FLITTNPYD

SEQ ID NO: 702868 - protein, 9 aa, Homo Sapiens
STSTAGSWW

SEQ ID NO: 702869 - protein, 9 aa, Homo Sapiens
DPSADDNLV

SEQ ID NO: 702870 - protein, 9 aa, Homo Sapiens
PEAAVQKVR

SEQ ID NO: 702871 - protein, 9 aa, Homo Sapiens
ERFYTALCV

SEQ ID NO: 702872 - protein, 9 aa, Homo Sapiens
LRRSLEAMK

SEQ ID NO: 702873 - protein, 9 aa, Homo Sapiens
YASHTTNSA

SEQ ID NO: 702874 - protein, 9 aa, Homo Sapiens
IEGGSSGGE

SEQ ID NO: 702875 - protein, 9 aa, Homo Sapiens
LQSSDSRTF

SEQ ID NO: 702876 - protein, 9 aa, Homo Sapiens
TGAGNTIRE

SEQ ID NO: 702877 - protein, 9 aa, Homo Sapiens
AELQTLKEM

SEQ ID NO: 702878 - protein, 9 aa, Homo Sapiens
TDYPECTLQ

SEQ ID NO: 702879 - protein, 9 aa, Homo Sapiens
RKAPPVEAG

SEQ ID NO: 702880 - protein, 9 aa, Homo Sapiens
FKSTLVFPD

SEQ ID NO: 702881 - protein, 9 aa, Homo Sapiens
FNGSGRDSP

SEQ ID NO: 702882 - protein, 9 aa, Homo Sapiens
PHPDVENGK

SEQ ID NO: 702883 - protein, 9 aa, Homo Sapiens
LFLLTVNKL

SEQ ID NO: 702884 - protein, 9 aa, Homo Sapiens
KRLFLLTVN

SEQ ID NO: 702885 - protein, 9 aa, Homo Sapiens
VQGETVQGG

SEQ ID NO: 702886 - protein, 9 aa, Homo Sapiens
AYHGGLYDP

SEQ ID NO: 702887 - protein, 9 aa, Homo Sapiens
TGYWYAGWW

SEQ ID NO: 702888 - protein, 9 aa, Homo Sapiens
GSRARASSP

SEQ ID NO: 702889 - protein, 9 aa, Homo Sapiens
CACDIGLDA

SEQ ID NO: 702890 - protein, 9 aa, Homo Sapiens
SPGCQLAEV

SEQ ID NO: 702891 - protein, 9 aa, Homo Sapiens
ASFHSQAVC

SEQ ID NO: 702892 - protein, 9 aa, Homo Sapiens
LTNQFLDSK

SEQ ID NO: 702893 - protein, 9 aa, Homo Sapiens
SQRVRRGHP

SEQ ID NO: 702894 - protein, 9 aa, Homo Sapiens
EENLDYYAG

SEQ ID NO: 702895 - protein, 9 aa, Homo Sapiens
DACETMCNA

SEQ ID NO: 702896 - protein, 9 aa, Homo Sapiens
DIYADVLQN

SEQ ID NO: 702897 - protein, 9 aa, Homo Sapiens
LAMQEDASP

SEQ ID NO: 702898 - protein, 9 aa, Homo Sapiens
GTANASFVT

SEQ ID NO: 702899 - protein, 9 aa, Homo Sapiens
APPVEAGAG

SEQ ID NO: 702900 - protein, 9 aa, Homo Sapiens
RRVGVLHGQ

SEQ ID NO: 702901 - protein, 9 aa, Homo Sapiens
VCGRSNERS

SEQ ID NO: 702902 - protein, 9 aa, Homo Sapiens
SLCSSRPGC

SEQ ID NO: 702903 - protein, 9 aa, Homo Sapiens
SARITDYPE

SEQ ID NO: 702904 - protein, 9 aa, Homo Sapiens
VVKEEKITI

SEQ ID NO: 702905 - protein, 9 aa, Homo Sapiens
RAFSKGEKK

SEQ ID NO: 702906 - protein, 9 aa, Homo Sapiens
LPQCQQLRM

SEQ ID NO: 702907 - protein, 9 aa, Homo Sapiens
LLTGSQSEN

SEQ ID NO: 702908 - protein, 9 aa, Homo Sapiens
THKLSVALP

SEQ ID NO: 702909 - protein, 9 aa, Homo Sapiens
DLERIEITN

SEQ ID NO: 702910 - protein, 9 aa, Homo Sapiens
ISQAEHTLK

SEQ ID NO: 702911 - protein, 9 aa, Homo Sapiens
EFYSSPLQA

SEQ ID NO: 702912 - protein, 9 aa, Homo Sapiens
MAEAERSSL

SEQ ID NO: 702913 - protein, 9 aa, Homo Sapiens
HKMNNCLRQ

SEQ ID NO: 702914 - protein, 9 aa, Homo Sapiens
KKLGPTETE

SEQ ID NO: 702915 - protein, 9 aa, Homo Sapiens
EFAIQSINT

SEQ ID NO: 702916 - protein, 9 aa, Homo Sapiens
LRSMSTAFC

SEQ ID NO: 702917 - protein, 9 aa, Homo Sapiens
DAYLQLCQD

SEQ ID NO: 702918 - protein, 9 aa, Homo Sapiens
TELSVVSAS

SEQ ID NO: 702919 - protein, 9 aa, Homo Sapiens
ADMDLVNQL

SEQ ID NO: 702920 - protein, 9 aa, Homo Sapiens
QIQETYFEH

SEQ ID NO: 702921 - protein, 9 aa, Homo Sapiens
SLISQAEHT

SEQ ID NO: 702922 - protein, 9 aa, Homo Sapiens
NCLRQMEQF

SEQ ID NO: 702923 - protein, 9 aa, Homo Sapiens
LRKMESSIN

SEQ ID NO: 702924 - protein, 9 aa, Homo Sapiens
RVDKCTRER

SEQ ID NO: 702925 - protein, 9 aa, Homo Sapiens
WCFLRLGIQ

SEQ ID NO: 702926 - protein, 9 aa, Homo Sapiens
PLLRSMSTA

SEQ ID NO: 702927 - protein, 9 aa, Homo Sapiens
LQKHPLCLE

SEQ ID NO: 702928 - protein, 9 aa, Homo Sapiens
NSEPKICRN

SEQ ID NO: 702929 - protein, 9 aa, Homo Sapiens
PLEATNETG

SEQ ID NO: 702930 - protein, 9 aa, Homo Sapiens
EFRLVPGQH

SEQ ID NO: 702931 - protein, 9 aa, Homo Sapiens
NYKDEYLKK

SEQ ID NO: 702932 - protein, 9 aa, Homo Sapiens
SFNIETFQT

SEQ ID NO: 702933 - protein, 9 aa, Homo Sapiens
KANGKTSVG

SEQ ID NO: 702934 - protein, 9 aa, Homo Sapiens
DTNLLRLVQ

SEQ ID NO: 702935 - protein, 9 aa, Homo Sapiens
LHQSLYQSQ

SEQ ID NO: 702936 - protein, 9 aa, Homo Sapiens
HPVEEKVDF

SEQ ID NO: 702937 - protein, 9 aa, Homo Sapiens
PGIEKGAEG

SEQ ID NO: 702938 - protein, 9 aa, Homo Sapiens
CLRQMEQFP

SEQ ID NO: 702939 - protein, 9 aa, Homo Sapiens
ITPKSKRKS

SEQ ID NO: 702940 - protein, 9 aa, Homo Sapiens
SIKRGLDVQ

SEQ ID NO: 702941 - protein, 9 aa, Homo Sapiens
KMLEIPAGA

SEQ ID NO: 702942 - protein, 9 aa, Homo Sapiens
YLQLCQDPR

SEQ ID NO: 702943 - protein, 9 aa, Homo Sapiens
LLGTLHLQR

SEQ ID NO: 702944 - protein, 9 aa, Homo Sapiens
TCGVSEVFL

SEQ ID NO: 702945 - protein, 9 aa, Homo Sapiens
CQLAEVHSV

SEQ ID NO: 702946 - protein, 9 aa, Homo Sapiens
QASQLRKME

SEQ ID NO: 702947 - protein, 9 aa, Homo Sapiens
AVPTAASAP

SEQ ID NO: 702948 - protein, 9 aa, Homo Sapiens
PTPTSSRPC

SEQ ID NO: 702949 - protein, 9 aa, Homo Sapiens
FYTALCVLG

SEQ ID NO: 702950 - protein, 9 aa, Homo Sapiens
ALKTERKTK

SEQ ID NO: 702951 - protein, 9 aa, Homo Sapiens
SKCLQNENA

SEQ ID NO: 702952 - protein, 9 aa, Homo Sapiens
NLCFIKNIQ

SEQ ID NO: 702953 - protein, 9 aa, Homo Sapiens
PLSLPNHIP

SEQ ID NO: 702954 - protein, 9 aa, Homo Sapiens
TVLNANISG

SEQ ID NO: 702955 - protein, 9 aa, Homo Sapiens
SQSSSSPAP

SEQ ID NO: 702956 - protein, 9 aa, Homo Sapiens
ALQKYLIES

SEQ ID NO: 702957 - protein, 9 aa, Homo Sapiens
GVSEVFLLA

SEQ ID NO: 702958 - protein, 9 aa, Homo Sapiens
GHGFYPQYG

SEQ ID NO: 702959 - protein, 9 aa, Homo Sapiens
GRQRRGPGL

SEQ ID NO: 702960 - protein, 9 aa, Homo Sapiens
PPVPPRRQR

SEQ ID NO: 702961 - protein, 9 aa, Homo Sapiens
CANGHVKVV

SEQ ID NO: 702962 - protein, 9 aa, Homo Sapiens
FSAPSPAAS

SEQ ID NO: 702963 - protein, 9 aa, Homo Sapiens
NGKPIISAF

SEQ ID NO: 702964 - protein, 9 aa, Homo Sapiens
IVATKVTAK

SEQ ID NO: 702965 - protein, 9 aa, Homo Sapiens
RPTFLKIVN

SEQ ID NO: 702966 - protein, 9 aa, Homo Sapiens
ASWASSTGP

SEQ ID NO: 702967 - protein, 9 aa, Homo Sapiens
MLNGKPIIS

SEQ ID NO: 702968 - protein, 9 aa, Homo Sapiens
DLDTCMITP

SEQ ID NO: 702969 - protein, 9 aa, Homo Sapiens
PYEAATYSL

SEQ ID NO: 702970 - protein, 9 aa, Homo Sapiens
GAWEVRHRP

SEQ ID NO: 702971 - protein, 9 aa, Homo Sapiens
MLGGPGTAS

SEQ ID NO: 702972 - protein, 9 aa, Homo Sapiens
GGMGLELRP

SEQ ID NO: 702973 - protein, 9 aa, Homo Sapiens
VTRARCLTR

SEQ ID NO: 702974 - protein, 9 aa, Homo Sapiens
DRAVIDYNG

SEQ ID NO: 702975 - protein, 9 aa, Homo Sapiens
PILHKPPGE

SEQ ID NO: 702976 - protein, 9 aa, Homo Sapiens
LSPHTSTGE

SEQ ID NO: 702977 - protein, 9 aa, Homo Sapiens
KHHSAAKPL

SEQ ID NO: 702978 - protein, 9 aa, Homo Sapiens
PAPRNAAAP

SEQ ID NO: 702979 - protein, 9 aa, Homo Sapiens
TPMKASPEG

SEQ ID NO: 702980 - protein, 9 aa, Homo Sapiens
TAVSHGHMD

SEQ ID NO: 702981 - protein, 9 aa, Homo Sapiens
CYVLFAVIS

SEQ ID NO: 702982 - protein, 9 aa, Homo Sapiens
NRTVQCVPS

SEQ ID NO: 702983 - protein, 9 aa, Homo Sapiens
PLPSVPTPS

SEQ ID NO: 702984 - protein, 9 aa, Homo Sapiens
PTETEPDGG

SEQ ID NO: 702985 - protein, 9 aa, Homo Sapiens
SVISLPMKE

SEQ ID NO: 702986 - protein, 9 aa, Homo Sapiens
DYLTFHLGS

SEQ ID NO: 702987 - protein, 9 aa, Homo Sapiens
VFIKAGRDD

SEQ ID NO: 702988 - protein, 9 aa, Homo Sapiens
KPLNAKNLH

SEQ ID NO: 702989 - protein, 9 aa, Homo Sapiens
KRRELMNFK

SEQ ID NO: 702990 - protein, 9 aa, Homo Sapiens
AQRTDFWGP

SEQ ID NO: 702991 - protein, 9 aa, Homo Sapiens
GSGETNFGP

SEQ ID NO: 702992 - protein, 9 aa, Homo Sapiens
PSSVISLPM

SEQ ID NO: 702993 - protein, 9 aa, Homo Sapiens
KAPYYYVNI

SEQ ID NO: 702994 - protein, 9 aa, Homo Sapiens
ALTLSGMFV

SEQ ID NO: 702995 - protein, 9 aa, Homo Sapiens
QGMGNVCGR

SEQ ID NO: 702996 - protein, 9 aa, Homo Sapiens
FPDCGNVSV

SEQ ID NO: 702997 - protein, 9 aa, Homo Sapiens
EVLLPTHPS

SEQ ID NO: 702998 - protein, 9 aa, Homo Sapiens
AQFWPGLNH

SEQ ID NO: 702999 - protein, 9 aa, Homo Sapiens
MNSRLNGAW

SEQ ID NO: 703000 - protein, 9 aa, Homo Sapiens
IAYHGGLYD

SEQ ID NO: 703001 - protein, 9 aa, Homo Sapiens
NCGREAMSD

SEQ ID NO: 703002 - protein, 9 aa, Homo Sapiens
SQLRKMESS

SEQ ID NO: 703003 - protein, 9 aa, Homo Sapiens
LCSSRPGCS

SEQ ID NO: 703004 - protein, 9 aa, Homo Sapiens
PEPLGRLGD

SEQ ID NO: 703005 - protein, 9 aa, Homo Sapiens
FIKNKFSFN

SEQ ID NO: 703006 - protein, 9 aa, Homo Sapiens
NPPPPPPVI

SEQ ID NO: 703007 - protein, 9 aa, Homo Sapiens
NTGGFLYAG

SEQ ID NO: 703008 - protein, 9 aa, Homo Sapiens
HQFMKEQPY

SEQ ID NO: 703009 - protein, 9 aa, Homo Sapiens
TGPCGRRSS

SEQ ID NO: 703010 - protein, 9 aa, Homo Sapiens
HRSLPRNVS

SEQ ID NO: 703011 - protein, 9 aa, Homo Sapiens
PGAHAAVGD

SEQ ID NO: 703012 - protein, 9 aa, Homo Sapiens
KGVVKEEKI

SEQ ID NO: 703013 - protein, 9 aa, Homo Sapiens
DQEFNQDPE

SEQ ID NO: 703014 - protein, 9 aa, Homo Sapiens
SELQLFEAE

SEQ ID NO: 703015 - protein, 9 aa, Homo Sapiens
DIYADQEFN

SEQ ID NO: 703016 - protein, 9 aa, Homo Sapiens
APWPDLPTM

SEQ ID NO: 703017 - protein, 9 aa, Homo Sapiens
TETEKVWLV

SEQ ID NO: 703018 - protein, 9 aa, Homo Sapiens
QFWPGLNHL

SEQ ID NO: 703019 - protein, 9 aa, Homo Sapiens
GSMLQKKSV

SEQ ID NO: 703020 - protein, 9 aa, Homo Sapiens
CQRIGPMFD

SEQ ID NO: 703021 - protein, 9 aa, Homo Sapiens
EAALPLTAS

SEQ ID NO: 703022 - protein, 9 aa, Homo Sapiens
QPRHRSLPR

SEQ ID NO: 703023 - protein, 9 aa, Homo Sapiens
WDYWPREIL

SEQ ID NO: 703024 - protein, 9 aa, Homo Sapiens
ERIEITNIN

SEQ ID NO: 703025 - protein, 9 aa, Homo Sapiens
TAFCSLLAP

SEQ ID NO: 703026 - protein, 9 aa, Homo Sapiens
QAEAQAKVY

SEQ ID NO: 703027 - protein, 9 aa, Homo Sapiens
RDNGQSDPL

SEQ ID NO: 703028 - protein, 9 aa, Homo Sapiens
QKLESRVSE

SEQ ID NO: 703029 - protein, 9 aa, Homo Sapiens
GAMHPSDGI

SEQ ID NO: 703030 - protein, 9 aa, Homo Sapiens
DSRTFSTVP

SEQ ID NO: 703031 - protein, 9 aa, Homo Sapiens
NNCLRQMEQ

SEQ ID NO: 703032 - protein, 9 aa, Homo Sapiens
EELRRHSSE

SEQ ID NO: 703033 - protein, 9 aa, Homo Sapiens
LKLHQSLYQ

SEQ ID NO: 703034 - protein, 9 aa, Homo Sapiens
PGCSQRVRR

SEQ ID NO: 703035 - protein, 9 aa, Homo Sapiens
QNTPHYLAS

SEQ ID NO: 703036 - protein, 9 aa, Homo Sapiens
FFSEIADLF

SEQ ID NO: 703037 - protein, 9 aa, Homo Sapiens
RFAETHKLS

SEQ ID NO: 703038 - protein, 9 aa, Homo Sapiens
YEFVGRLRS

SEQ ID NO: 703039 - protein, 9 aa, Homo Sapiens
RNIESRSTY

SEQ ID NO: 703040 - protein, 9 aa, Homo Sapiens
SAYYEADCF

SEQ ID NO: 703041 - protein, 9 aa, Homo Sapiens
AKSLSDRLA

SEQ ID NO: 703042 - protein, 9 aa, Homo Sapiens
SAVPTAASA

SEQ ID NO: 703043 - protein, 9 aa, Homo Sapiens
CLEGNIMHF

SEQ ID NO: 703044 - protein, 9 aa, Homo Sapiens
VYVFLGAVR

SEQ ID NO: 703045 - protein, 9 aa, Homo Sapiens
SAQRTDFWG

SEQ ID NO: 703046 - protein, 9 aa, Homo Sapiens
QSFYEKRAL

SEQ ID NO: 703047 - protein, 9 aa, Homo Sapiens
SNEVLLGAI

SEQ ID NO: 703048 - protein, 9 aa, Homo Sapiens
QETYFEHEE

SEQ ID NO: 703049 - protein, 9 aa, Homo Sapiens
SWASSTGPC

SEQ ID NO: 703050 - protein, 9 aa, Homo Sapiens
DEAMANLHT

SEQ ID NO: 703051 - protein, 9 aa, Homo Sapiens
MRESKRLRP

SEQ ID NO: 703052 - protein, 9 aa, Homo Sapiens
VQCRAFSKG

SEQ ID NO: 703053 - protein, 9 aa, Homo Sapiens
QLVNLLSLG

SEQ ID NO: 703054 - protein, 9 aa, Homo Sapiens
TPHYLASPL

SEQ ID NO: 703055 - protein, 9 aa, Homo Sapiens
RGREHRKAH

SEQ ID NO: 703056 - protein, 9 aa, Homo Sapiens
AYSYCGHGF

SEQ ID NO: 703057 - protein, 9 aa, Homo Sapiens
CRESLGRLS

SEQ ID NO: 703058 - protein, 9 aa, Homo Sapiens
RARCLTRTA

SEQ ID NO: 703059 - protein, 9 aa, Homo Sapiens
TMRVALFAS

SEQ ID NO: 703060 - protein, 9 aa, Homo Sapiens
RRMLGGPGT

SEQ ID NO: 703061 - protein, 9 aa, Homo Sapiens
WPLYYQTNA

SEQ ID NO: 703062 - protein, 9 aa, Homo Sapiens
LQQQQEDRS

SEQ ID NO: 703063 - protein, 9 aa, Homo Sapiens
ECVQCRAFS

SEQ ID NO: 703064 - protein, 9 aa, Homo Sapiens
ARSPTGYWY

SEQ ID NO: 703065 - protein, 9 aa, Homo Sapiens
LCHRGFQSQ

SEQ ID NO: 703066 - protein, 9 aa, Homo Sapiens
TPTGISSSC

SEQ ID NO: 703067 - protein, 9 aa, Homo Sapiens
IFSDGDDPE

SEQ ID NO: 703068 - protein, 9 aa, Homo Sapiens
DSFPAKASV

SEQ ID NO: 703069 - protein, 9 aa, Homo Sapiens
HTCSCEDRC

SEQ ID NO: 703070 - protein, 9 aa, Homo Sapiens
RDNLTALQK

SEQ ID NO: 703071 - protein, 9 aa, Homo Sapiens
DTNDHDLVF

SEQ ID NO: 703072 - protein, 9 aa, Homo Sapiens
QCSGFGHKS

SEQ ID NO: 703073 - protein, 9 aa, Homo Sapiens
QITGEIQQY

SEQ ID NO: 703074 - protein, 9 aa, Homo Sapiens
KKKQSNASF

SEQ ID NO: 703075 - protein, 9 aa, Homo Sapiens
TSFPSATEL

SEQ ID NO: 703076 - protein, 9 aa, Homo Sapiens
GKQFLQSFP

SEQ ID NO: 703077 - protein, 9 aa, Homo Sapiens
QSARITDYP

SEQ ID NO: 703078 - protein, 9 aa, Homo Sapiens
FEEQKSMFQ

SEQ ID NO: 703079 - protein, 9 aa, Homo Sapiens
HSAAKPLES

SEQ ID NO: 703080 - protein, 9 aa, Homo Sapiens
ICQRIGPMF

SEQ ID NO: 703081 - protein, 9 aa, Homo Sapiens
EIVATKVTA

SEQ ID NO: 703082 - protein, 9 aa, Homo Sapiens
DSDLRSILK

SEQ ID NO: 703083 - protein, 9 aa, Homo Sapiens
ENSSVYADV

SEQ ID NO: 703084 - protein, 9 aa, Homo Sapiens
QQSSGWIDI

SEQ ID NO: 703085 - protein, 9 aa, Homo Sapiens
IKERSMATV

SEQ ID NO: 703086 - protein, 9 aa, Homo Sapiens
AAYSKPTLS

SEQ ID NO: 703087 - protein, 9 aa, Homo Sapiens
DSRRGSLFV

SEQ ID NO: 703088 - protein, 9 aa, Homo Sapiens
WQQRVLSSE

SEQ ID NO: 703089 - protein, 9 aa, Homo Sapiens
QRWDPNGAS

SEQ ID NO: 703090 - protein, 9 aa, Homo Sapiens
FDDIRELPP

SEQ ID NO: 703091 - protein, 9 aa, Homo Sapiens
DNDDEAPKR

SEQ ID NO: 703092 - protein, 9 aa, Homo Sapiens
CDLSSFECF

SEQ ID NO: 703093 - protein, 9 aa, Homo Sapiens
HKPPGELTA

SEQ ID NO: 703094 - protein, 9 aa, Homo Sapiens
AKEQDRVKE

SEQ ID NO: 703095 - protein, 9 aa, Homo Sapiens
WSRLQVNIP

SEQ ID NO: 703096 - protein, 9 aa, Homo Sapiens
FDEAMANLH

SEQ ID NO: 703097 - protein, 9 aa, Homo Sapiens
QEDRSKLRS

SEQ ID NO: 703098 - protein, 9 aa, Homo Sapiens
PTPTPTSSR

SEQ ID NO: 703099 - protein, 9 aa, Homo Sapiens
EDEYVKKRR

SEQ ID NO: 703100 - protein, 9 aa, Homo Sapiens
KRPFPLARY

SEQ ID NO: 703101 - protein, 9 aa, Homo Sapiens
CFPLQLSTL

SEQ ID NO: 703102 - protein, 9 aa, Homo Sapiens
AGLEVYVFL

SEQ ID NO: 703103 - protein, 9 aa, Homo Sapiens
LHWAAALNN

SEQ ID NO: 703104 - protein, 9 aa, Homo Sapiens
YQSFYEKRA

SEQ ID NO: 703105 - protein, 9 aa, Homo Sapiens
LLPQCQQLR

SEQ ID NO: 703106 - protein, 9 aa, Homo Sapiens
KQEQKANGS

SEQ ID NO: 703107 - protein, 9 aa, Homo Sapiens
YKAFRSDNC

SEQ ID NO: 703108 - protein, 9 aa, Homo Sapiens
RSERIERGQ

SEQ ID NO: 703109 - protein, 9 aa, Homo Sapiens
IIVKWMMKD

SEQ ID NO: 703110 - protein, 9 aa, Homo Sapiens
ERNTILLHS

SEQ ID NO: 703111 - protein, 9 aa, Homo Sapiens
NDARHGGWT

SEQ ID NO: 703112 - protein, 9 aa, Homo Sapiens
NTIREAEAL

SEQ ID NO: 703113 - protein, 9 aa, Homo Sapiens
ATLLYHQPL

SEQ ID NO: 703114 - protein, 9 aa, Homo Sapiens
LYEFVGRLR

SEQ ID NO: 703115 - protein, 9 aa, Homo Sapiens
GRGAWEVRH

SEQ ID NO: 703116 - protein, 9 aa, Homo Sapiens
AQITGEIQQ

SEQ ID NO: 703117 - protein, 9 aa, Homo Sapiens
QGAGRQTFR

SEQ ID NO: 703118 - protein, 9 aa, Homo Sapiens
NFQDTDGFS

SEQ ID NO: 703119 - protein, 9 aa, Homo Sapiens
IMRESKRLR

SEQ ID NO: 703120 - protein, 9 aa, Homo Sapiens
AEVLLPTHP

SEQ ID NO: 703121 - protein, 9 aa, Homo Sapiens
LEVNGSQHL

SEQ ID NO: 703122 - protein, 9 aa, Homo Sapiens
RQRGGRGGR

SEQ ID NO: 703123 - protein, 9 aa, Homo Sapiens
ARALTVSAM

SEQ ID NO: 703124 - protein, 9 aa, Homo Sapiens
DKPAISKRD

SEQ ID NO: 703125 - protein, 9 aa, Homo Sapiens
QGQVLPGGG

SEQ ID NO: 703126 - protein, 9 aa, Homo Sapiens
ESRSTYPWN

SEQ ID NO: 703127 - protein, 9 aa, Homo Sapiens
KKQSNASFH

SEQ ID NO: 703128 - protein, 9 aa, Homo Sapiens
VCVLCELQK

SEQ ID NO: 703129 - protein, 9 aa, Homo Sapiens
GYRSPTTPC

SEQ ID NO: 703130 - protein, 9 aa, Homo Sapiens
TLVTVAKEH

SEQ ID NO: 703131 - protein, 9 aa, Homo Sapiens
FQNRTVQCV

SEQ ID NO: 703132 - protein, 9 aa, Homo Sapiens
VPALQVVSG

SEQ ID NO: 703133 - protein, 9 aa, Homo Sapiens
VVALGLLSC

SEQ ID NO: 703134 - protein, 9 aa, Homo Sapiens
LNGKPIISA

SEQ ID NO: 703135 - protein, 9 aa, Homo Sapiens
SVALTRKCL

SEQ ID NO: 703136 - protein, 9 aa, Homo Sapiens
PCLAPGTTQ

SEQ ID NO: 703137 - protein, 9 aa, Homo Sapiens
PGPTRVQGE

SEQ ID NO: 703138 - protein, 9 aa, Homo Sapiens
STGSVITTK

SEQ ID NO: 703139 - protein, 9 aa, Homo Sapiens
RLELCRAGR

SEQ ID NO: 703140 - protein, 9 aa, Homo Sapiens
EIPPGIEKG

SEQ ID NO: 703141 - protein, 9 aa, Homo Sapiens
EFISVCNNV

SEQ ID NO: 703142 - protein, 9 aa, Homo Sapiens
STPTGISSS

SEQ ID NO: 703143 - protein, 9 aa, Homo Sapiens
LNVMAPPTP

SEQ ID NO: 703144 - protein, 9 aa, Homo Sapiens
EQKANGSPS

SEQ ID NO: 703145 - protein, 9 aa, Homo Sapiens
NALAAFLLQ

SEQ ID NO: 703146 - protein, 9 aa, Homo Sapiens
NYFALERNP

SEQ ID NO: 703147 - protein, 9 aa, Homo Sapiens
AAAPATAPA

SEQ ID NO: 703148 - protein, 9 aa, Homo Sapiens
EAERSSLLL

SEQ ID NO: 703149 - protein, 9 aa, Homo Sapiens
DQHYSFNIE

SEQ ID NO: 703150 - protein, 9 aa, Homo Sapiens
SAGLEVYVF

SEQ ID NO: 703151 - protein, 9 aa, Homo Sapiens
GDNDSRRGS

SEQ ID NO: 703152 - protein, 9 aa, Homo Sapiens
HPDVENGKH

SEQ ID NO: 703153 - protein, 9 aa, Homo Sapiens
HGYIKMLEI

SEQ ID NO: 703154 - protein, 9 aa, Homo Sapiens
FLGAGKSTF

SEQ ID NO: 703155 - protein, 9 aa, Homo Sapiens
EVYVFLGAV

SEQ ID NO: 703156 - protein, 9 aa, Homo Sapiens
IEKGAEGAA

SEQ ID NO: 703157 - protein, 9 aa, Homo Sapiens
EHSIFGDND

SEQ ID NO: 703158 - protein, 9 aa, Homo Sapiens
VSEVFLLAV

SEQ ID NO: 703159 - protein, 9 aa, Homo Sapiens
IESRSTYPW

SEQ ID NO: 703160 - protein, 9 aa, Homo Sapiens
YRKVSRSSG

SEQ ID NO: 703161 - protein, 9 aa, Homo Sapiens
YSPQKVKCK

SEQ ID NO: 703162 - protein, 9 aa, Homo Sapiens
KEENENSEP

SEQ ID NO: 703163 - protein, 9 aa, Homo Sapiens
RFKRGGKKR

SEQ ID NO: 703164 - protein, 9 aa, Homo Sapiens
VWSLEPEDF

SEQ ID NO: 703165 - protein, 9 aa, Homo Sapiens
GLARAVFQR

SEQ ID NO: 703166 - protein, 9 aa, Homo Sapiens
SMQKKKRRE

SEQ ID NO: 703167 - protein, 9 aa, Homo Sapiens
VEEAVSKWL

SEQ ID NO: 703168 - protein, 9 aa, Homo Sapiens
TRRKGPPKF

SEQ ID NO: 703169 - protein, 9 aa, Homo Sapiens
FPLQLSTLT

SEQ ID NO: 703170 - protein, 9 aa, Homo Sapiens
CPQGTRYGV

SEQ ID NO: 703171 - protein, 9 aa, Homo Sapiens
ALAAFLLQH

SEQ ID NO: 703172 - protein, 9 aa, Homo Sapiens
WEADLFDSG

SEQ ID NO: 703173 - protein, 9 aa, Homo Sapiens
QLLSFVSIT

SEQ ID NO: 703174 - protein, 9 aa, Homo Sapiens
GNCKTMWNR

SEQ ID NO: 703175 - protein, 9 aa, Homo Sapiens
VCSQQSSER

SEQ ID NO: 703176 - protein, 9 aa, Homo Sapiens
PQVEILSCE

SEQ ID NO: 703177 - protein, 9 aa, Homo Sapiens
PLPGPTRVQ

SEQ ID NO: 703178 - protein, 9 aa, Homo Sapiens
AYLQLCQDP

SEQ ID NO: 703179 - protein, 9 aa, Homo Sapiens
PESEFYSSP

SEQ ID NO: 703180 - protein, 9 aa, Homo Sapiens
MLLAFVALF

SEQ ID NO: 703181 - protein, 9 aa, Homo Sapiens
NLHTLSEDS

SEQ ID NO: 703182 - protein, 9 aa, Homo Sapiens
RVHAQVQEF

SEQ ID NO: 703183 - protein, 9 aa, Homo Sapiens
FIFSDGDDP

SEQ ID NO: 703184 - protein, 9 aa, Homo Sapiens
KINVNFQDT

SEQ ID NO: 703185 - protein, 9 aa, Homo Sapiens
DKLQKIPEK

SEQ ID NO: 703186 - protein, 9 aa, Homo Sapiens
SPQESFKEI

SEQ ID NO: 703187 - protein, 9 aa, Homo Sapiens
ILYFDKGKM

SEQ ID NO: 703188 - protein, 9 aa, Homo Sapiens
GYYWYSKET

SEQ ID NO: 703189 - protein, 9 aa, Homo Sapiens
FQDTDGFSA

SEQ ID NO: 703190 - protein, 9 aa, Homo Sapiens
TPRGREHRK

SEQ ID NO: 703191 - protein, 9 aa, Homo Sapiens
QSENKEDGL

SEQ ID NO: 703192 - protein, 9 aa, Homo Sapiens
REIPPGIEK

SEQ ID NO: 703193 - protein, 9 aa, Homo Sapiens
MSPQESFKE

SEQ ID NO: 703194 - protein, 9 aa, Homo Sapiens
INHLFCDIA

SEQ ID NO: 703195 - protein, 9 aa, Homo Sapiens
YLLIFLAAR

SEQ ID NO: 703196 - protein, 9 aa, Homo Sapiens
LSGVSTTGK

SEQ ID NO: 703197 - protein, 9 aa, Homo Sapiens
LQFTFTSEP

SEQ ID NO: 703198 - protein, 9 aa, Homo Sapiens
MFVYHNCEF

SEQ ID NO: 703199 - protein, 9 aa, Homo Sapiens
ITAYQRSYE

SEQ ID NO: 703200 - protein, 9 aa, Homo Sapiens
FWGPEEGGE

SEQ ID NO: 703201 - protein, 9 aa, Homo Sapiens
LSHVPSPGP

SEQ ID NO: 703202 - protein, 9 aa, Homo Sapiens
RQVGNMTGT

SEQ ID NO: 703203 - protein, 9 aa, Homo Sapiens
CCRYCCSCC

SEQ ID NO: 703204 - protein, 9 aa, Homo Sapiens
ALTVSAMLL

SEQ ID NO: 703205 - protein, 9 aa, Homo Sapiens
WWPPCRCSP

SEQ ID NO: 703206 - protein, 9 aa, Homo Sapiens
IRELPPWMY

SEQ ID NO: 703207 - protein, 9 aa, Homo Sapiens
LKWEMELPG

SEQ ID NO: 703208 - protein, 9 aa, Homo Sapiens
KTFFRLQKF

SEQ ID NO: 703209 - protein, 9 aa, Homo Sapiens
RKLNLTEVE

SEQ ID NO: 703210 - protein, 9 aa, Homo Sapiens
QKKSVLLLL

SEQ ID NO: 703211 - protein, 9 aa, Homo Sapiens
HAGRLEGDL

SEQ ID NO: 703212 - protein, 9 aa, Homo Sapiens
HETARVVFI

SEQ ID NO: 703213 - protein, 9 aa, Homo Sapiens
QAVNFFSPA

SEQ ID NO: 703214 - protein, 9 aa, Homo Sapiens
VPELLQQQQ

SEQ ID NO: 703215 - protein, 9 aa, Homo Sapiens
EMAEQELFL

SEQ ID NO: 703216 - protein, 9 aa, Homo Sapiens
DKSKEELTE

SEQ ID NO: 703217 - protein, 9 aa, Homo Sapiens
SRLQVNIPD

SEQ ID NO: 703218 - protein, 9 aa, Homo Sapiens
NYDSDLRSI

SEQ ID NO: 703219 - protein, 9 aa, Homo Sapiens
TFIFSDGDD

SEQ ID NO: 703220 - protein, 9 aa, Homo Sapiens
RRGPGLAKR

SEQ ID NO: 703221 - protein, 9 aa, Homo Sapiens
GLLNWITEA

SEQ ID NO: 703222 - protein, 9 aa, Homo Sapiens
HYSFNIETF

SEQ ID NO: 703223 - protein, 9 aa, Homo Sapiens
AFNDIKILG

SEQ ID NO: 703224 - protein, 9 aa, Homo Sapiens
PFCRESGKS

SEQ ID NO: 703225 - protein, 9 aa, Homo Sapiens
PGPAAQPSA

SEQ ID NO: 703226 - protein, 9 aa, Homo Sapiens
TYFEHEEQD

SEQ ID NO: 703227 - protein, 9 aa, Homo Sapiens
IDSKGKQEQ

SEQ ID NO: 703228 - protein, 9 aa, Homo Sapiens
GVSTTGKGW

SEQ ID NO: 703229 - protein, 9 aa, Homo Sapiens
CCRCFPFCR

SEQ ID NO: 703230 - protein, 9 aa, Homo Sapiens
QKSMFQDQF

SEQ ID NO: 703231 - protein, 9 aa, Homo Sapiens
AQQLRQLQG

SEQ ID NO: 703232 - protein, 9 aa, Homo Sapiens
SKGEKKDTC

SEQ ID NO: 703233 - protein, 9 aa, Homo Sapiens
TAAYSKPTL

SEQ ID NO: 703234 - protein, 9 aa, Homo Sapiens
YREFEVLKG

SEQ ID NO: 703235 - protein, 9 aa, Homo Sapiens
CNATAICSD

SEQ ID NO: 703236 - protein, 9 aa, Homo Sapiens
KALKLFKNQ

SEQ ID NO: 703237 - protein, 9 aa, Homo Sapiens
LSCDSPAPQ

SEQ ID NO: 703238 - protein, 9 aa, Homo Sapiens
NCIVHALTH

SEQ ID NO: 703239 - protein, 9 aa, Homo Sapiens
TGTYSTRLG

SEQ ID NO: 703240 - protein, 9 aa, Homo Sapiens
PSVPTPSQE

SEQ ID NO: 703241 - protein, 9 aa, Homo Sapiens
SATTNITPM

SEQ ID NO: 703242 - protein, 9 aa, Homo Sapiens
YLVSCPNKE

SEQ ID NO: 703243 - protein, 9 aa, Homo Sapiens
VYHNCEFVA

SEQ ID NO: 703244 - protein, 9 aa, Homo Sapiens
LKIVNLLKD

SEQ ID NO: 703245 - protein, 9 aa, Homo Sapiens
ILKNYKDEY

SEQ ID NO: 703246 - protein, 9 aa, Homo Sapiens
TLLYHQPLQ

SEQ ID NO: 703247 - protein, 9 aa, Homo Sapiens
QRSYERQQM

SEQ ID NO: 703248 - protein, 9 aa, Homo Sapiens
NIILKNYKD

SEQ ID NO: 703249 - protein, 9 aa, Homo Sapiens
ASPGGSEKL

SEQ ID NO: 703250 - protein, 9 aa, Homo Sapiens
GKHHGTRCA

SEQ ID NO: 703251 - protein, 9 aa, Homo Sapiens
DFRWQQRVL

SEQ ID NO: 703252 - protein, 9 aa, Homo Sapiens
QAQPVQLTD

SEQ ID NO: 703253 - protein, 9 aa, Homo Sapiens
GKQEQKANG

SEQ ID NO: 703254 - protein, 9 aa, Homo Sapiens
CRCSPTPTP

SEQ ID NO: 703255 - protein, 9 aa, Homo Sapiens
WLIGSVEEQ

SEQ ID NO: 703256 - protein, 9 aa, Homo Sapiens
SFVSITDFQ

SEQ ID NO: 703257 - protein, 9 aa, Homo Sapiens
ETCQRYKNL

SEQ ID NO: 703258 - protein, 9 aa, Homo Sapiens
AIQSQQQEV

SEQ ID NO: 703259 - protein, 9 aa, Homo Sapiens
VECERRKWA

SEQ ID NO: 703260 - protein, 9 aa, Homo Sapiens
GARQVGNMT

SEQ ID NO: 703261 - protein, 9 aa, Homo Sapiens
RSPTGYWYA

SEQ ID NO: 703262 - protein, 9 aa, Homo Sapiens
MLFLTCISA

SEQ ID NO: 703263 - protein, 9 aa, Homo Sapiens
WWIKYMAPS

SEQ ID NO: 703264 - protein, 9 aa, Homo Sapiens
DYDKSKNSG

SEQ ID NO: 703265 - protein, 9 aa, Homo Sapiens
NIDLFRPQI

SEQ ID NO: 703266 - protein, 9 aa, Homo Sapiens
PRPPQLRGR

SEQ ID NO: 703267 - protein, 9 aa, Homo Sapiens
KSAEHALVD

SEQ ID NO: 703268 - protein, 9 aa, Homo Sapiens
LGDYRELID

SEQ ID NO: 703269 - protein, 9 aa, Homo Sapiens
LGCIHRNWD

SEQ ID NO: 703270 - protein, 9 aa, Homo Sapiens
FSYRAALQY

SEQ ID NO: 703271 - protein, 9 aa, Homo Sapiens
KSMFQDQFE

SEQ ID NO: 703272 - protein, 9 aa, Homo Sapiens
DKGTLLPIT

SEQ ID NO: 703273 - protein, 9 aa, Homo Sapiens
FAASLRQTL

SEQ ID NO: 703274 - protein, 9 aa, Homo Sapiens
SSLRDPEPL

SEQ ID NO: 703275 - protein, 9 aa, Homo Sapiens
HGTDPNISD

SEQ ID NO: 703276 - protein, 9 aa, Homo Sapiens
TEAALPLTA

SEQ ID NO: 703277 - protein, 9 aa, Homo Sapiens
AQAQPVQLT

SEQ ID NO: 703278 - protein, 9 aa, Homo Sapiens
RKEQAERFY

SEQ ID NO: 703279 - protein, 9 aa, Homo Sapiens
HCPAPRPPA

SEQ ID NO: 703280 - protein, 9 aa, Homo Sapiens
LTFHLGSML

SEQ ID NO: 703281 - protein, 9 aa, Homo Sapiens
QSRQRSLLP

SEQ ID NO: 703282 - protein, 9 aa, Homo Sapiens
EAEFIKNKF

SEQ ID NO: 703283 - protein, 9 aa, Homo Sapiens
WEMELPGAS

SEQ ID NO: 703284 - protein, 9 aa, Homo Sapiens
LAAAPATAP

SEQ ID NO: 703285 - protein, 9 aa, Homo Sapiens
QVADLEFQL

SEQ ID NO: 703286 - protein, 9 aa, Homo Sapiens
RHGGWTTKM

SEQ ID NO: 703287 - protein, 9 aa, Homo Sapiens
WITEAALPL

SEQ ID NO: 703288 - protein, 9 aa, Homo Sapiens
SLKQLLSFV

SEQ ID NO: 703289 - protein, 9 aa, Homo Sapiens
NQPKAPYYY

SEQ ID NO: 703290 - protein, 9 aa, Homo Sapiens
AYWEKTFNI

SEQ ID NO: 703291 - protein, 9 aa, Homo Sapiens
KGVCLGMRL

SEQ ID NO: 703292 - protein, 9 aa, Homo Sapiens
RYIDSKGKQ

SEQ ID NO: 703293 - protein, 9 aa, Homo Sapiens
ILSCEGAGE

SEQ ID NO: 703294 - protein, 9 aa, Homo Sapiens
NFGPQLKNL

SEQ ID NO: 703295 - protein, 9 aa, Homo Sapiens
TALQKYLIE

SEQ ID NO: 703296 - protein, 9 aa, Homo Sapiens
NIETFQTSS

SEQ ID NO: 703297 - protein, 9 aa, Homo Sapiens
QCQQLRMFF

SEQ ID NO: 703298 - protein, 9 aa, Homo Sapiens
KQSNASFHS

SEQ ID NO: 703299 - protein, 9 aa, Homo Sapiens
LEGKYIMSD

SEQ ID NO: 703300 - protein, 9 aa, Homo Sapiens
VTVRKTATL

SEQ ID NO: 703301 - protein, 9 aa, Homo Sapiens
KHHGTRCAG

SEQ ID NO: 703302 - protein, 9 aa, Homo Sapiens
PQESFKEIH

SEQ ID NO: 703303 - protein, 9 aa, Homo Sapiens
LQEEEFAQS

SEQ ID NO: 703304 - protein, 9 aa, Homo Sapiens
PELLQQQQE

SEQ ID NO: 703305 - protein, 9 aa, Homo Sapiens
GVYLLIFLA

SEQ ID NO: 703306 - protein, 9 aa, Homo Sapiens
KVAQITGEI

SEQ ID NO: 703307 - protein, 9 aa, Homo Sapiens
LGVYLLIFL

SEQ ID NO: 703308 - protein, 9 aa, Homo Sapiens
HALTHTPIL

SEQ ID NO: 703309 - protein, 9 aa, Homo Sapiens
PKIIIVKWM

SEQ ID NO: 703310 - protein, 9 aa, Homo Sapiens
LTVNKLSYY

SEQ ID NO: 703311 - protein, 9 aa, Homo Sapiens
ISIYEMNVS

SEQ ID NO: 703312 - protein, 9 aa, Homo Sapiens
FRSSGSLPN

SEQ ID NO: 703313 - protein, 9 aa, Homo Sapiens
FLQSFPETL

SEQ ID NO: 703314 - protein, 9 aa, Homo Sapiens
SACPQGTRY

SEQ ID NO: 703315 - protein, 9 aa, Homo Sapiens
SGTLPPAPR

SEQ ID NO: 703316 - protein, 9 aa, Homo Sapiens
RLSSLGYKS

SEQ ID NO: 703317 - protein, 9 aa, Homo Sapiens
RRSNEVLLG

SEQ ID NO: 703318 - protein, 9 aa, Homo Sapiens
CEGAGEPHS

SEQ ID NO: 703319 - protein, 9 aa, Homo Sapiens
QRRTVDEMK

SEQ ID NO: 703320 - protein, 9 aa, Homo Sapiens
ELCRAGRQR

SEQ ID NO: 703321 - protein, 9 aa, Homo Sapiens
GFQIVNVQK

SEQ ID NO: 703322 - protein, 9 aa, Homo Sapiens
ASIDAELQT

SEQ ID NO: 703323 - protein, 9 aa, Homo Sapiens
LKESVKCCL

SEQ ID NO: 703324 - protein, 9 aa, Homo Sapiens
KFWPLYYQT

SEQ ID NO: 703325 - protein, 9 aa, Homo Sapiens
KVKCKEVLC

SEQ ID NO: 703326 - protein, 9 aa, Homo Sapiens
LRKSAEHAL

SEQ ID NO: 703327 - protein, 9 aa, Homo Sapiens
EQDWERTQQ

SEQ ID NO: 703328 - protein, 9 aa, Homo Sapiens
FLMHYFDLK

SEQ ID NO: 703329 - protein, 9 aa, Homo Sapiens
EVSRTLCPL

SEQ ID NO: 703330 - protein, 9 aa, Homo Sapiens
WPPWYSWME

SEQ ID NO: 703331 - protein, 9 aa, Homo Sapiens
PGRTENQPK

SEQ ID NO: 703332 - protein, 9 aa, Homo Sapiens
NGQSDPLLI

SEQ ID NO: 703333 - protein, 9 aa, Homo Sapiens
LQVNIPDLF

SEQ ID NO: 703334 - protein, 9 aa, Homo Sapiens
MNRAQFWPG

SEQ ID NO: 703335 - protein, 9 aa, Homo Sapiens
IKMLEIPAG

SEQ ID NO: 703336 - protein, 9 aa, Homo Sapiens
QEFLKEGYL

SEQ ID NO: 703337 - protein, 9 aa, Homo Sapiens
LAQTLDTST

SEQ ID NO: 703338 - protein, 9 aa, Homo Sapiens
GTLLPITTP

SEQ ID NO: 703339 - protein, 9 aa, Homo Sapiens
KFDDIRELP

SEQ ID NO: 703340 - protein, 9 aa, Homo Sapiens
KTERKTKLN

SEQ ID NO: 703341 - protein, 9 aa, Homo Sapiens
GMGNVCGRS

SEQ ID NO: 703342 - protein, 9 aa, Homo Sapiens
VTWAIGEIC

SEQ ID NO: 703343 - protein, 9 aa, Homo Sapiens
KRALYLEAI

SEQ ID NO: 703344 - protein, 9 aa, Homo Sapiens
GFNLCFIKN

SEQ ID NO: 703345 - protein, 9 aa, Homo Sapiens
QDSPLGCIH

SEQ ID NO: 703346 - protein, 9 aa, Homo Sapiens
GWCSAYYEA

SEQ ID NO: 703347 - protein, 9 aa, Homo Sapiens
PRGREHRKA

SEQ ID NO: 703348 - protein, 9 aa, Homo Sapiens
PSYPDKRSS

SEQ ID NO: 703349 - protein, 9 aa, Homo Sapiens
YPECTLQEN

SEQ ID NO: 703350 - protein, 9 aa, Homo Sapiens
SRYVHEGCI

SEQ ID NO: 703351 - protein, 9 aa, Homo Sapiens
TKVTAKIVT

SEQ ID NO: 703352 - protein, 9 aa, Homo Sapiens
WGKQFLQSF

SEQ ID NO: 703353 - protein, 9 aa, Homo Sapiens
PVPRGGSGG

SEQ ID NO: 703354 - protein, 9 aa, Homo Sapiens
VSKCPLPLK

SEQ ID NO: 703355 - protein, 9 aa, Homo Sapiens
QVSFALNLD

SEQ ID NO: 703356 - protein, 9 aa, Homo Sapiens
VPGQHFGLQ

SEQ ID NO: 703357 - protein, 9 aa, Homo Sapiens
HGSVSGQCS

SEQ ID NO: 703358 - protein, 9 aa, Homo Sapiens
RAVFILDND

SEQ ID NO: 703359 - protein, 9 aa, Homo Sapiens
QEGRGIAEE

SEQ ID NO: 703360 - protein, 9 aa, Homo Sapiens
RSPGAHAAV

SEQ ID NO: 703361 - protein, 9 aa, Homo Sapiens
RVLVCDRND

SEQ ID NO: 703362 - protein, 9 aa, Homo Sapiens
EVRDIFYKP

SEQ ID NO: 703363 - protein, 9 aa, Homo Sapiens
NAVWRVTPT

SEQ ID NO: 703364 - protein, 9 aa, Homo Sapiens
AISKRDEHE

SEQ ID NO: 703365 - protein, 9 aa, Homo Sapiens
VEILSCEGA

SEQ ID NO: 703366 - protein, 9 aa, Homo Sapiens
NLVPQLAEL

SEQ ID NO: 703367 - protein, 9 aa, Homo Sapiens
SKCPLPLKA

SEQ ID NO: 703368 - protein, 9 aa, Homo Sapiens
FCRESGKSN

SEQ ID NO: 703369 - protein, 9 aa, Homo Sapiens
NFQIIIAYH

SEQ ID NO: 703370 - protein, 9 aa, Homo Sapiens
LQKIPEKRQ

SEQ ID NO: 703371 - protein, 9 aa, Homo Sapiens
TLPPAPRNA

SEQ ID NO: 703372 - protein, 9 aa, Homo Sapiens
LTRTASWAS

SEQ ID NO: 703373 - protein, 9 aa, Homo Sapiens
TVAKEHHRA

SEQ ID NO: 703374 - protein, 9 aa, Homo Sapiens
YDDIYADVL

SEQ ID NO: 703375 - protein, 9 aa, Homo Sapiens
DWCFLRLGI

SEQ ID NO: 703376 - protein, 9 aa, Homo Sapiens
SAEHALVDM

SEQ ID NO: 703377 - protein, 9 aa, Homo Sapiens
RDAKAAVVI

SEQ ID NO: 703378 - protein, 9 aa, Homo Sapiens
HGKGRGGQA

SEQ ID NO: 703379 - protein, 9 aa, Homo Sapiens
TSTIMRESK

SEQ ID NO: 703380 - protein, 9 aa, Homo Sapiens
SIYDDIYAD

SEQ ID NO: 703381 - protein, 9 aa, Homo Sapiens
ALENADAST

SEQ ID NO: 703382 - protein, 9 aa, Homo Sapiens
FMNCIVHAL

SEQ ID NO: 703383 - protein, 9 aa, Homo Sapiens
SSKQNTPHY

SEQ ID NO: 703384 - protein, 9 aa, Homo Sapiens
KEHHRAQLV

SEQ ID NO: 703385 - protein, 9 aa, Homo Sapiens
WCDLSSFEC

SEQ ID NO: 703386 - protein, 9 aa, Homo Sapiens
KLKWEMELP

SEQ ID NO: 703387 - protein, 9 aa, Homo Sapiens
TPTAPGTGS

SEQ ID NO: 703388 - protein, 9 aa, Homo Sapiens
SSAGLEVYV

SEQ ID NO: 703389 - protein, 9 aa, Homo Sapiens
LVTLYNNST

SEQ ID NO: 703390 - protein, 9 aa, Homo Sapiens
EWKGPQVSF

SEQ ID NO: 703391 - protein, 9 aa, Homo Sapiens
PRHPGPAAQ

SEQ ID NO: 703392 - protein, 9 aa, Homo Sapiens
PASADRAVI

SEQ ID NO: 703393 - protein, 9 aa, Homo Sapiens
QESFKEIHV

SEQ ID NO: 703394 - protein, 9 aa, Homo Sapiens
TYSTRLGEQ

SEQ ID NO: 703395 - protein, 9 aa, Homo Sapiens
EIADLFMHQ

SEQ ID NO: 703396 - protein, 9 aa, Homo Sapiens
GRTENQPKA

SEQ ID NO: 703397 - protein, 9 aa, Homo Sapiens
GTSTETVLN

SEQ ID NO: 703398 - protein, 9 aa, Homo Sapiens
NGKTSVGTV

SEQ ID NO: 703399 - protein, 9 aa, Homo Sapiens
GVVALGLLS

SEQ ID NO: 703400 - protein, 9 aa, Homo Sapiens
TPSQEGAPL

SEQ ID NO: 703401 - protein, 9 aa, Homo Sapiens
DIQASQLRK

SEQ ID NO: 703402 - protein, 9 aa, Homo Sapiens
NKLSYYEYD

SEQ ID NO: 703403 - protein, 9 aa, Homo Sapiens
FECFEEADF

SEQ ID NO: 703404 - protein, 9 aa, Homo Sapiens
QGRFSYAHN

SEQ ID NO: 703405 - protein, 9 aa, Homo Sapiens
PSKYFFFHI

SEQ ID NO: 703406 - protein, 9 aa, Homo Sapiens
SGQCSGFGH

SEQ ID NO: 703407 - protein, 9 aa, Homo Sapiens
IQLSEVDKS

SEQ ID NO: 703408 - protein, 9 aa, Homo Sapiens
LLRKSAEHA

SEQ ID NO: 703409 - protein, 9 aa, Homo Sapiens
IIAYHGGLY

SEQ ID NO: 703410 - protein, 9 aa, Homo Sapiens
TGGFLYAGL

SEQ ID NO: 703411 - protein, 9 aa, Homo Sapiens
SFYLKDFVA

SEQ ID NO: 703412 - protein, 9 aa, Homo Sapiens
GDQHYSFNI

SEQ ID NO: 703413 - protein, 9 aa, Homo Sapiens
GTGSRARAS

SEQ ID NO: 703414 - protein, 9 aa, Homo Sapiens
ARITDYPEC

SEQ ID NO: 703415 - protein, 9 aa, Homo Sapiens
FEAEFIKNK

SEQ ID NO: 703416 - protein, 9 aa, Homo Sapiens
DETCQRYKN

SEQ ID NO: 703417 - protein, 9 aa, Homo Sapiens
QIVNVQKQQ

SEQ ID NO: 703418 - protein, 9 aa, Homo Sapiens
GSQHLLTCA

SEQ ID NO: 703419 - protein, 9 aa, Homo Sapiens
LQGSKLLSR

SEQ ID NO: 703420 - protein, 9 aa, Homo Sapiens
PGYRSPTTP

SEQ ID NO: 703421 - protein, 9 aa, Homo Sapiens
EKLKWEMEL

SEQ ID NO: 703422 - protein, 9 aa, Homo Sapiens
FMKEQPYLN

SEQ ID NO: 703423 - protein, 9 aa, Homo Sapiens
YTYNGIFTT

SEQ ID NO: 703424 - protein, 9 aa, Homo Sapiens
KCGIRLFFQ

SEQ ID NO: 703425 - protein, 9 aa, Homo Sapiens
KNLHVNGNS

SEQ ID NO: 703426 - protein, 9 aa, Homo Sapiens
RLGTFAKYQ

SEQ ID NO: 703427 - protein, 9 aa, Homo Sapiens
VSARDLDGV

SEQ ID NO: 703428 - protein, 9 aa, Homo Sapiens
NRDLGPNTG

SEQ ID NO: 703429 - protein, 9 aa, Homo Sapiens
SKLLSRNSG

SEQ ID NO: 703430 - protein, 9 aa, Homo Sapiens
GVANGKISY

SEQ ID NO: 703431 - protein, 9 aa, Homo Sapiens
FSAVTMERF

SEQ ID NO: 703432 - protein, 9 aa, Homo Sapiens
SAAKPLESD

SEQ ID NO: 703433 - protein, 9 aa, Homo Sapiens
RLFLLTVNK

SEQ ID NO: 703434 - protein, 9 aa, Homo Sapiens
FLRLGIQGV

SEQ ID NO: 703435 - protein, 9 aa, Homo Sapiens
LSLPNHIPL

SEQ ID NO: 703436 - protein, 9 aa, Homo Sapiens
KKKRRELMN

SEQ ID NO: 703437 - protein, 9 aa, Homo Sapiens
SSLCSSRPG

SEQ ID NO: 703438 - protein, 9 aa, Homo Sapiens
RHMADGARQ

SEQ ID NO: 703439 - protein, 9 aa, Homo Sapiens
EGTPCAETP

SEQ ID NO: 703440 - protein, 9 aa, Homo Sapiens
VAELGQQID

SEQ ID NO: 703441 - protein, 9 aa, Homo Sapiens
MKEQPYLNF

SEQ ID NO: 703442 - protein, 9 aa, Homo Sapiens
MRIKKKQSN

SEQ ID NO: 703443 - protein, 9 aa, Homo Sapiens
DICFPLQLS

SEQ ID NO: 703444 - protein, 9 aa, Homo Sapiens
SLEGAIAQQ

SEQ ID NO: 703445 - protein, 9 aa, Homo Sapiens
LWMGLGLGL

SEQ ID NO: 703446 - protein, 9 aa, Homo Sapiens
GARSISIYE

SEQ ID NO: 703447 - protein, 9 aa, Homo Sapiens
TVNKLSYYE

SEQ ID NO: 703448 - protein, 9 aa, Homo Sapiens
TGRIYPNPN

SEQ ID NO: 703449 - protein, 9 aa, Homo Sapiens
AKVYKKRDK

SEQ ID NO: 703450 - protein, 9 aa, Homo Sapiens
DEDDNDDEA

SEQ ID NO: 703451 - protein, 9 aa, Homo Sapiens
SKGKQEQKA

SEQ ID NO: 703452 - protein, 9 aa, Homo Sapiens
LITESVLEV

SEQ ID NO: 703453 - protein, 9 aa, Homo Sapiens
PPSSAPLAA

SEQ ID NO: 703454 - protein, 9 aa, Homo Sapiens
LGAIETYQE

SEQ ID NO: 703455 - protein, 9 aa, Homo Sapiens
IKQGRFSYA

SEQ ID NO: 703456 - protein, 9 aa, Homo Sapiens
FHLGSMLQK

SEQ ID NO: 703457 - protein, 9 aa, Homo Sapiens
EQKSMFQDQ

SEQ ID NO: 703458 - protein, 9 aa, Homo Sapiens
DLQHIEGGS

SEQ ID NO: 703459 - protein, 9 aa, Homo Sapiens
KLQKIPEKR

SEQ ID NO: 703460 - protein, 9 aa, Homo Sapiens
ALRPRPPQL

SEQ ID NO: 703461 - protein, 9 aa, Homo Sapiens
KRKAPPVEA

SEQ ID NO: 703462 - protein, 9 aa, Homo Sapiens
VCILQKHPL

SEQ ID NO: 703463 - protein, 9 aa, Homo Sapiens
DFWGPEEGG

SEQ ID NO: 703464 - protein, 9 aa, Homo Sapiens
VRDIFYKPF

SEQ ID NO: 703465 - protein, 9 aa, Homo Sapiens
KHGYIKMLE

SEQ ID NO: 703466 - protein, 9 aa, Homo Sapiens
WTSPTGRIY

SEQ ID NO: 703467 - protein, 9 aa, Homo Sapiens
DLDGVANGK

SEQ ID NO: 703468 - protein, 9 aa, Homo Sapiens
GTLPPAPRN

SEQ ID NO: 703469 - protein, 9 aa, Homo Sapiens
GREAMSDCT

SEQ ID NO: 703470 - protein, 9 aa, Homo Sapiens
HLFCDIAPW

SEQ ID NO: 703471 - protein, 9 aa, Homo Sapiens
FHPHTCSCE

SEQ ID NO: 703472 - protein, 9 aa, Homo Sapiens
FVSHSKSFW

SEQ ID NO: 703473 - protein, 9 aa, Homo Sapiens
EAMSDCTGC

SEQ ID NO: 703474 - protein, 9 aa, Homo Sapiens
SQQSSERSR

SEQ ID NO: 703475 - protein, 9 aa, Homo Sapiens
LDTSTVMKS

SEQ ID NO: 703476 - protein, 9 aa, Homo Sapiens
TIRAVFILD

SEQ ID NO: 703477 - protein, 9 aa, Homo Sapiens
DWERTQQAS

SEQ ID NO: 703478 - protein, 9 aa, Homo Sapiens
EKEENENSE

SEQ ID NO: 703479 - protein, 9 aa, Homo Sapiens
RKVAQITGE

SEQ ID NO: 703480 - protein, 9 aa, Homo Sapiens
TLKENDHAR

SEQ ID NO: 703481 - protein, 9 aa, Homo Sapiens
TFAKYQASW

SEQ ID NO: 703482 - protein, 9 aa, Homo Sapiens
DIRELPPWM

SEQ ID NO: 703483 - protein, 9 aa, Homo Sapiens
RGRGAFQRG

SEQ ID NO: 703484 - protein, 9 aa, Homo Sapiens
PHYLASPLD

SEQ ID NO: 703485 - protein, 9 aa, Homo Sapiens
PNNLAFNDI

SEQ ID NO: 703486 - protein, 9 aa, Homo Sapiens
PASSFSAPS

SEQ ID NO: 703487 - protein, 9 aa, Homo Sapiens
GKVRASAVS

SEQ ID NO: 703488 - protein, 9 aa, Homo Sapiens
EAAKKQSMK

SEQ ID NO: 703489 - protein, 9 aa, Homo Sapiens
GKTSVGTVR

SEQ ID NO: 703490 - protein, 9 aa, Homo Sapiens
EGGCCRAWE

SEQ ID NO: 703491 - protein, 9 aa, Homo Sapiens
LSAEVLLPT

SEQ ID NO: 703492 - protein, 9 aa, Homo Sapiens
RSLQGKKMA

SEQ ID NO: 703493 - protein, 9 aa, Homo Sapiens
PSATELSVV

SEQ ID NO: 703494 - protein, 9 aa, Homo Sapiens
YRELIDALT

SEQ ID NO: 703495 - protein, 9 aa, Homo Sapiens
PNTGGFLYA

SEQ ID NO: 703496 - protein, 9 aa, Homo Sapiens
YSYCGHGFY

SEQ ID NO: 703497 - protein, 9 aa, Homo Sapiens
QHNTWAGSK

SEQ ID NO: 703498 - protein, 9 aa, Homo Sapiens
IEEMAEQEL

SEQ ID NO: 703499 - protein, 9 aa, Homo Sapiens
ARSQHNTWA

SEQ ID NO: 703500 - protein, 9 aa, Homo Sapiens
MELFSSLCS

SEQ ID NO: 703501 - protein, 9 aa, Homo Sapiens
EDLMIEAVY

SEQ ID NO: 703502 - protein, 9 aa, Homo Sapiens
QRVLSSEHT

SEQ ID NO: 703503 - protein, 9 aa, Homo Sapiens
GPTTRRKGP

SEQ ID NO: 703504 - protein, 9 aa, Homo Sapiens
YTGTREVRD

SEQ ID NO: 703505 - protein, 9 aa, Homo Sapiens
FPLSLPNHI

SEQ ID NO: 703506 - protein, 9 aa, Homo Sapiens
CGREAMSDC

SEQ ID NO: 703507 - protein, 9 aa, Homo Sapiens
TCKKTFNVY

SEQ ID NO: 703508 - protein, 9 aa, Homo Sapiens
LLAMQEDAS

SEQ ID NO: 703509 - protein, 9 aa, Homo Sapiens
TPHKLQFTF

SEQ ID NO: 703510 - protein, 9 aa, Homo Sapiens
LRQQVADLE

SEQ ID NO: 703511 - protein, 9 aa, Homo Sapiens
FSFYLKDFV

SEQ ID NO: 703512 - protein, 9 aa, Homo Sapiens
GLKLHQSLY

SEQ ID NO: 703513 - protein, 9 aa, Homo Sapiens
AAGGMGLEL

SEQ ID NO: 703514 - protein, 9 aa, Homo Sapiens
TGVVHEVEE

SEQ ID NO: 703515 - protein, 9 aa, Homo Sapiens
SRSAVPTAA

SEQ ID NO: 703516 - protein, 9 aa, Homo Sapiens
VPPRRQRGG

SEQ ID NO: 703517 - protein, 9 aa, Homo Sapiens
HRNWDKFDP

SEQ ID NO: 703518 - protein, 9 aa, Homo Sapiens
REFEVLKGH

SEQ ID NO: 703519 - protein, 9 aa, Homo Sapiens
SVRDACSLP

SEQ ID NO: 703520 - protein, 9 aa, Homo Sapiens
ELIEMFLIT

SEQ ID NO: 703521 - protein, 9 aa, Homo Sapiens
EDIKQGRFS

SEQ ID NO: 703522 - protein, 9 aa, Homo Sapiens
SPQKVKCKE

SEQ ID NO: 703523 - protein, 9 aa, Homo Sapiens
VAVGFLGAG

SEQ ID NO: 703524 - protein, 9 aa, Homo Sapiens
LSCLLAMLL

SEQ ID NO: 703525 - protein, 9 aa, Homo Sapiens
ETPHKLQFT

SEQ ID NO: 703526 - protein, 9 aa, Homo Sapiens
DARHGGWTT

SEQ ID NO: 703527 - protein, 9 aa, Homo Sapiens
LTAAKALKL

SEQ ID NO: 703528 - protein, 9 aa, Homo Sapiens
AGSWWPPCR

SEQ ID NO: 703529 - protein, 9 aa, Homo Sapiens
SGMFVYHNC

SEQ ID NO: 703530 - protein, 9 aa, Homo Sapiens
AGGMGLELR

SEQ ID NO: 703531 - protein, 9 aa, Homo Sapiens
VLLGAIETY

SEQ ID NO: 703532 - protein, 9 aa, Homo Sapiens
SPGWCSAYY

SEQ ID NO: 703533 - protein, 9 aa, Homo Sapiens
EDASPGGSE

SEQ ID NO: 703534 - protein, 9 aa, Homo Sapiens
SAPLAAAPA

SEQ ID NO: 703535 - protein, 9 aa, Homo Sapiens
DSKGKQEQK

SEQ ID NO: 703536 - protein, 9 aa, Homo Sapiens
MPAILDVEE

SEQ ID NO: 703537 - protein, 9 aa, Homo Sapiens
LGRLGDPGP

SEQ ID NO: 703538 - protein, 9 aa, Homo Sapiens
SEHLKESVK

SEQ ID NO: 703539 - protein, 9 aa, Homo Sapiens
SCLLAMLLA

SEQ ID NO: 703540 - protein, 9 aa, Homo Sapiens
VCKPLHYPV

SEQ ID NO: 703541 - protein, 9 aa, Homo Sapiens
TNKFWPLYY

SEQ ID NO: 703542 - protein, 9 aa, Homo Sapiens
VTYGNDSFP

SEQ ID NO: 703543 - protein, 9 aa, Homo Sapiens
HDRYVAVCK

SEQ ID NO: 703544 - protein, 9 aa, Homo Sapiens
SCEGAGEPH

SEQ ID NO: 703545 - protein, 9 aa, Homo Sapiens
EGRGIAEEQ

SEQ ID NO: 703546 - protein, 9 aa, Homo Sapiens
MFQDQFEMI

SEQ ID NO: 703547 - protein, 9 aa, Homo Sapiens
RRSTCHSAN

SEQ ID NO: 703548 - protein, 9 aa, Homo Sapiens
SYLKKLFAG

SEQ ID NO: 703549 - protein, 9 aa, Homo Sapiens
RTFSTVPLT

SEQ ID NO: 703550 - protein, 9 aa, Homo Sapiens
AERSSLLLL

SEQ ID NO: 703551 - protein, 9 aa, Homo Sapiens
KGKQEQKAN

SEQ ID NO: 703552 - protein, 9 aa, Homo Sapiens
TGEFYLSPH

SEQ ID NO: 703553 - protein, 9 aa, Homo Sapiens
YPDKRSSCS

SEQ ID NO: 703554 - protein, 9 aa, Homo Sapiens
WRVTPTAPG

SEQ ID NO: 703555 - protein, 9 aa, Homo Sapiens
ENAQLVNLL

SEQ ID NO: 703556 - protein, 9 aa, Homo Sapiens
GSYASHTTN

SEQ ID NO: 703557 - protein, 9 aa, Homo Sapiens
VLLLLKLVV

SEQ ID NO: 703558 - protein, 9 aa, Homo Sapiens
ITDYPECTL

SEQ ID NO: 703559 - protein, 9 aa, Homo Sapiens
LFLLHQETL

SEQ ID NO: 703560 - protein, 9 aa, Homo Sapiens
DKRSSCSSG

SEQ ID NO: 703561 - protein, 9 aa, Homo Sapiens
ERHPGYRSP

SEQ ID NO: 703562 - protein, 9 aa, Homo Sapiens
QMNDARHGG

SEQ ID NO: 703563 - protein, 9 aa, Homo Sapiens
PKMRPTFLK

SEQ ID NO: 703564 - protein, 9 aa, Homo Sapiens
LSGPHLVTL

SEQ ID NO: 703565 - protein, 9 aa, Homo Sapiens
GRRSSTSTA

SEQ ID NO: 703566 - protein, 9 aa, Homo Sapiens
NVKGLARAV

SEQ ID NO: 703567 - protein, 9 aa, Homo Sapiens
SVLLLLKLV

SEQ ID NO: 703568 - protein, 9 aa, Homo Sapiens
QKKKRRELM

SEQ ID NO: 703569 - protein, 9 aa, Homo Sapiens
AHPRHPGPA

SEQ ID NO: 703570 - protein, 9 aa, Homo Sapiens
LRPGTPAMS

SEQ ID NO: 703571 - protein, 9 aa, Homo Sapiens
LLIRGVRLP

SEQ ID NO: 703572 - protein, 9 aa, Homo Sapiens
ESVLEVVRK

SEQ ID NO: 703573 - protein, 9 aa, Homo Sapiens
KALKTERKT

SEQ ID NO: 703574 - protein, 9 aa, Homo Sapiens
TFHLGSMLQ

SEQ ID NO: 703575 - protein, 9 aa, Homo Sapiens
LRDNLTALQ

SEQ ID NO: 703576 - protein, 9 aa, Homo Sapiens
LWSRLQVNI

SEQ ID NO: 703577 - protein, 9 aa, Homo Sapiens
LEDIKQGRF

SEQ ID NO: 703578 - protein, 9 aa, Homo Sapiens
TQQASVLAN

SEQ ID NO: 703579 - protein, 9 aa, Homo Sapiens
SGARSISIY

SEQ ID NO: 703580 - protein, 9 aa, Homo Sapiens
SVPTPSQEG

SEQ ID NO: 703581 - protein, 9 aa, Homo Sapiens
RSLSGVSTT

SEQ ID NO: 703582 - protein, 9 aa, Homo Sapiens
VELMRLQRH

SEQ ID NO: 703583 - protein, 9 aa, Homo Sapiens
FLYSVALTR

SEQ ID NO: 703584 - protein, 9 aa, Homo Sapiens
GEFYLSPHT

SEQ ID NO: 703585 - protein, 9 aa, Homo Sapiens
LELCRAGRQ

SEQ ID NO: 703586 - protein, 9 aa, Homo Sapiens
CRCFPFCRE

SEQ ID NO: 703587 - protein, 9 aa, Homo Sapiens
RRPLRPGTP

SEQ ID NO: 703588 - protein, 9 aa, Homo Sapiens
IPAFILPKA

SEQ ID NO: 703589 - protein, 9 aa, Homo Sapiens
HCRLSSLGY

SEQ ID NO: 703590 - protein, 9 aa, Homo Sapiens
RKRKAPPVE

SEQ ID NO: 703591 - protein, 9 aa, Homo Sapiens
VNKLSYYEY

SEQ ID NO: 703592 - protein, 9 aa, Homo Sapiens
SYRAALQYL

SEQ ID NO: 703593 - protein, 9 aa, Homo Sapiens
QEEESSDSS

SEQ ID NO: 703594 - protein, 9 aa, Homo Sapiens
PTGISSSCR

SEQ ID NO: 703595 - protein, 9 aa, Homo Sapiens
EQARQEREG

SEQ ID NO: 703596 - protein, 9 aa, Homo Sapiens
AVCILQKHP

SEQ ID NO: 703597 - protein, 9 aa, Homo Sapiens
QDAVARSAA

SEQ ID NO: 703598 - protein, 9 aa, Homo Sapiens
KEHLASKIP

SEQ ID NO: 703599 - protein, 9 aa, Homo Sapiens
PLITESVLE

SEQ ID NO: 703600 - protein, 9 aa, Homo Sapiens
DSSDEDDND

SEQ ID NO: 703601 - protein, 9 aa, Homo Sapiens
RQKAVRVSI

SEQ ID NO: 703602 - protein, 9 aa, Homo Sapiens
RRLGTFAKY

SEQ ID NO: 703603 - protein, 9 aa, Homo Sapiens
SYPDKRSSC

SEQ ID NO: 703604 - protein, 9 aa, Homo Sapiens
YAKAKEQDR

SEQ ID NO: 703605 - protein, 9 aa, Homo Sapiens
PGLAKRSAT

SEQ ID NO: 703606 - protein, 9 aa, Homo Sapiens
AKLHAGRLE

SEQ ID NO: 703607 - protein, 9 aa, Homo Sapiens
TPTPTSSRP

SEQ ID NO: 703608 - protein, 9 aa, Homo Sapiens
KSKNLVVTI

SEQ ID NO: 703609 - protein, 9 aa, Homo Sapiens
CMITPKSKR

SEQ ID NO: 703610 - protein, 9 aa, Homo Sapiens
PPQHLSRVE

SEQ ID NO: 703611 - protein, 9 aa, Homo Sapiens
YVHEGCIED

SEQ ID NO: 703612 - protein, 9 aa, Homo Sapiens
RTCARCRES

SEQ ID NO: 703613 - protein, 9 aa, Homo Sapiens
VSCPNKENC

SEQ ID NO: 703614 - protein, 9 aa, Homo Sapiens
LNHCRLSSL

SEQ ID NO: 703615 - protein, 9 aa, Homo Sapiens
VSELEGELE

SEQ ID NO: 703616 - protein, 9 aa, Homo Sapiens
GAFQRGRGR

SEQ ID NO: 703617 - protein, 9 aa, Homo Sapiens
LLNWITEAA

SEQ ID NO: 703618 - protein, 9 aa, Homo Sapiens
SDVMNYFAL

SEQ ID NO: 703619 - protein, 9 aa, Homo Sapiens
PTGYWYAGW

SEQ ID NO: 703620 - protein, 9 aa, Homo Sapiens
LEDLDTCMI

SEQ ID NO: 703621 - protein, 9 aa, Homo Sapiens
CYLVSCPNK

SEQ ID NO: 703622 - protein, 9 aa, Homo Sapiens
QQMFKVELM

SEQ ID NO: 703623 - protein, 9 aa, Homo Sapiens
EHTLKENDH

SEQ ID NO: 703624 - protein, 9 aa, Homo Sapiens
QEFNQDPEF

SEQ ID NO: 703625 - protein, 9 aa, Homo Sapiens
TLTAAKALK

SEQ ID NO: 703626 - protein, 9 aa, Homo Sapiens
RLQVNIPDL

SEQ ID NO: 703627 - protein, 9 aa, Homo Sapiens
GQQIDNLQR

SEQ ID NO: 703628 - protein, 9 aa, Homo Sapiens
HLKESVKCC

SEQ ID NO: 703629 - protein, 9 aa, Homo Sapiens
HYSMQKKKR

SEQ ID NO: 703630 - protein, 9 aa, Homo Sapiens
RGIKEKLCY

SEQ ID NO: 703631 - protein, 9 aa, Homo Sapiens
ELRRHSSER

SEQ ID NO: 703632 - protein, 9 aa, Homo Sapiens
LHKPPGELT

SEQ ID NO: 703633 - protein, 9 aa, Homo Sapiens
NASGRTSVV

SEQ ID NO: 703634 - protein, 9 aa, Homo Sapiens
RPACPPGGI

SEQ ID NO: 703635 - protein, 9 aa, Homo Sapiens
PCEGTANAS

SEQ ID NO: 703636 - protein, 9 aa, Homo Sapiens
GTGPNRILI

SEQ ID NO: 703637 - protein, 9 aa, Homo Sapiens
WYSWMELFS

SEQ ID NO: 703638 - protein, 9 aa, Homo Sapiens
VHAQVQEFL

SEQ ID NO: 703639 - protein, 9 aa, Homo Sapiens
GCSQRVRRG

SEQ ID NO: 703640 - protein, 9 aa, Homo Sapiens
LQKKSVLLL

SEQ ID NO: 703641 - protein, 9 aa, Homo Sapiens
HKSTELLIR

SEQ ID NO: 703642 - protein, 9 aa, Homo Sapiens
GFLGAGKST

SEQ ID NO: 703643 - protein, 9 aa, Homo Sapiens
KLHAGRLEG

SEQ ID NO: 703644 - protein, 9 aa, Homo Sapiens
DDNLVPQLA

SEQ ID NO: 703645 - protein, 9 aa, Homo Sapiens
NDTGVVHEV

SEQ ID NO: 703646 - protein, 9 aa, Homo Sapiens
PPRGRGAWE

SEQ ID NO: 703647 - protein, 9 aa, Homo Sapiens
LYTIRAVFI

SEQ ID NO: 703648 - protein, 9 aa, Homo Sapiens
MEGGCCRAW

SEQ ID NO: 703649 - protein, 9 aa, Homo Sapiens
VTDTNDHDL

SEQ ID NO: 703650 - protein, 9 aa, Homo Sapiens
GPRAINHLF

SEQ ID NO: 703651 - protein, 9 aa, Homo Sapiens
ALQYLGSFD

SEQ ID NO: 703652 - protein, 9 aa, Homo Sapiens
PRGGSGGKT

SEQ ID NO: 703653 - protein, 9 aa, Homo Sapiens
GSLDLYKQD

SEQ ID NO: 703654 - protein, 9 aa, Homo Sapiens
KIPTSKDQK

SEQ ID NO: 703655 - protein, 9 aa, Homo Sapiens
IQSINTDVH

SEQ ID NO: 703656 - protein, 9 aa, Homo Sapiens
PSPSVRDAC

SEQ ID NO: 703657 - protein, 9 aa, Homo Sapiens
TLHLQRRTV

SEQ ID NO: 703658 - protein, 9 aa, Homo Sapiens
KIRQTGKKL

SEQ ID NO: 703659 - protein, 9 aa, Homo Sapiens
VITTKGVCL

SEQ ID NO: 703660 - protein, 9 aa, Homo Sapiens
SVPKMAADY

SEQ ID NO: 703661 - protein, 9 aa, Homo Sapiens
YFDLKRTTN

SEQ ID NO: 703662 - protein, 9 aa, Homo Sapiens
EQEEESSDS

SEQ ID NO: 703663 - protein, 9 aa, Homo Sapiens
SQAEHTLKE

SEQ ID NO: 703664 - protein, 9 aa, Homo Sapiens
GTRYGVIPR

SEQ ID NO: 703665 - protein, 9 aa, Homo Sapiens
MLGSGETNF

SEQ ID NO: 703666 - protein, 9 aa, Homo Sapiens
MRQVGTSQT

SEQ ID NO: 703667 - protein, 9 aa, Homo Sapiens
KQNIILKNY

SEQ ID NO: 703668 - protein, 9 aa, Homo Sapiens
NAQLVNLLS

SEQ ID NO: 703669 - protein, 9 aa, Homo Sapiens
PYQCQECQK

SEQ ID NO: 703670 - protein, 9 aa, Homo Sapiens
TLSGMFVYH

SEQ ID NO: 703671 - protein, 9 aa, Homo Sapiens
RTGLFRRFL

SEQ ID NO: 703672 - protein, 9 aa, Homo Sapiens
DLLTGSQSE

SEQ ID NO: 703673 - protein, 9 aa, Homo Sapiens
NDSRRGSLF

SEQ ID NO: 703674 - protein, 9 aa, Homo Sapiens
DLRDNLTAL

SEQ ID NO: 703675 - protein, 9 aa, Homo Sapiens
YVLFAVISR

SEQ ID NO: 703676 - protein, 9 aa, Homo Sapiens
LFCTCGVSE

SEQ ID NO: 703677 - protein, 9 aa, Homo Sapiens
NSGSYASHT

SEQ ID NO: 703678 - protein, 9 aa, Homo Sapiens
MECKIPTSK

SEQ ID NO: 703679 - protein, 9 aa, Homo Sapiens
EKTFNIDLF

SEQ ID NO: 703680 - protein, 9 aa, Homo Sapiens
LFSSLCSSR

SEQ ID NO: 703681 - protein, 9 aa, Homo Sapiens
SFSQREAGG

SEQ ID NO: 703682 - protein, 9 aa, Homo Sapiens
EPLGRLGDP

SEQ ID NO: 703683 - protein, 9 aa, Homo Sapiens
DYYAGMSAI

SEQ ID NO: 703684 - protein, 9 aa, Homo Sapiens
AALNNVDAA

SEQ ID NO: 703685 - protein, 9 aa, Homo Sapiens
AKEHHRAQL

SEQ ID NO: 703686 - protein, 9 aa, Homo Sapiens
PPPSVPHPP

SEQ ID NO: 703687 - protein, 9 aa, Homo Sapiens
CARCRESLG

SEQ ID NO: 703688 - protein, 9 aa, Homo Sapiens
QLRMFFLLL

SEQ ID NO: 703689 - protein, 9 aa, Homo Sapiens
KPELIEMFL

SEQ ID NO: 703690 - protein, 9 aa, Homo Sapiens
TAYQRSYER

SEQ ID NO: 703691 - protein, 9 aa, Homo Sapiens
RSAVPTAAS

SEQ ID NO: 703692 - protein, 9 aa, Homo Sapiens
PRGTGKSLL

SEQ ID NO: 703693 - protein, 9 aa, Homo Sapiens
IDFITVFGE

SEQ ID NO: 703694 - protein, 9 aa, Homo Sapiens
RLGEQCSAI

SEQ ID NO: 703695 - protein, 9 aa, Homo Sapiens
MANLHTLSE

SEQ ID NO: 703696 - protein, 9 aa, Homo Sapiens
EIVRGIKEK

SEQ ID NO: 703697 - protein, 9 aa, Homo Sapiens
GYIKMLEIP

SEQ ID NO: 703698 - protein, 9 aa, Homo Sapiens
LSSECDIFH

SEQ ID NO: 703699 - protein, 9 aa, Homo Sapiens
KPYQCQECQ

SEQ ID NO: 703700 - protein, 9 aa, Homo Sapiens
RIYPNPNVP

SEQ ID NO: 703701 - protein, 9 aa, Homo Sapiens
QPKAPYYYV

SEQ ID NO: 703702 - protein, 9 aa, Homo Sapiens
LADMDLVNQ

SEQ ID NO: 703703 - protein, 9 aa, Homo Sapiens
EVLKGHADK

SEQ ID NO: 703704 - protein, 9 aa, Homo Sapiens
SSFSAPSPA

SEQ ID NO: 703705 - protein, 9 aa, Homo Sapiens
IRLFFQINV

SEQ ID NO: 703706 - protein, 9 aa, Homo Sapiens
ISDEYGNTA

SEQ ID NO: 703707 - protein, 9 aa, Homo Sapiens
VYADVSRLL

SEQ ID NO: 703708 - protein, 9 aa, Homo Sapiens
AHAAVGDLL

SEQ ID NO: 703709 - protein, 9 aa, Homo Sapiens
DNLVPQLAE

SEQ ID NO: 703710 - protein, 9 aa, Homo Sapiens
NISDEYGNT

SEQ ID NO: 703711 - protein, 9 aa, Homo Sapiens
FSFLNEDDD

SEQ ID NO: 703712 - protein, 9 aa, Homo Sapiens
AKSLGHSRW

SEQ ID NO: 703713 - protein, 9 aa, Homo Sapiens
VWRVTPTAP

SEQ ID NO: 703714 - protein, 9 aa, Homo Sapiens
YRFAETHKL

SEQ ID NO: 703715 - protein, 9 aa, Homo Sapiens
FLLCHRGFQ

SEQ ID NO: 703716 - protein, 9 aa, Homo Sapiens
ILQKHPLCL

SEQ ID NO: 703717 - protein, 9 aa, Homo Sapiens
ELEDLMIEA

SEQ ID NO: 703718 - protein, 9 aa, Homo Sapiens
ERVHAQVQE

SEQ ID NO: 703719 - protein, 9 aa, Homo Sapiens
DNLTALQKY

SEQ ID NO: 703720 - protein, 9 aa, Homo Sapiens
RAINHLFCD

SEQ ID NO: 703721 - protein, 9 aa, Homo Sapiens
GIFGSTNTV

SEQ ID NO: 703722 - protein, 9 aa, Homo Sapiens
LAGKKLGPT

SEQ ID NO: 703723 - protein, 9 aa, Homo Sapiens
SKNLVVTIC

SEQ ID NO: 703724 - protein, 9 aa, Homo Sapiens
LDYYAGMSA

SEQ ID NO: 703725 - protein, 9 aa, Homo Sapiens
GPSPSVRDA

SEQ ID NO: 703726 - protein, 9 aa, Homo Sapiens
KIPAFILPK

SEQ ID NO: 703727 - protein, 9 aa, Homo Sapiens
YTIRAVFIL

SEQ ID NO: 703728 - protein, 9 aa, Homo Sapiens
TQGSLDLYK

SEQ ID NO: 703729 - protein, 9 aa, Homo Sapiens
NLTTDSLRN

SEQ ID NO: 703730 - protein, 9 aa, Homo Sapiens
STYPWNYTV

SEQ ID NO: 703731 - protein, 9 aa, Homo Sapiens
LSGMFVYHN

SEQ ID NO: 703732 - protein, 9 aa, Homo Sapiens
GSQSENKED

SEQ ID NO: 703733 - protein, 9 aa, Homo Sapiens
LDSLGHPVE

SEQ ID NO: 703734 - protein, 9 aa, Homo Sapiens
PAPRPPALR

SEQ ID NO: 703735 - protein, 9 aa, Homo Sapiens
QQEDRSKLR

SEQ ID NO: 703736 - protein, 9 aa, Homo Sapiens
LPHGKGRGG

SEQ ID NO: 703737 - protein, 9 aa, Homo Sapiens
HNDLLKFLG

SEQ ID NO: 703738 - protein, 9 aa, Homo Sapiens
GCIEDLVRP

SEQ ID NO: 703739 - protein, 9 aa, Homo Sapiens
GRRAEQESA

SEQ ID NO: 703740 - protein, 9 aa, Homo Sapiens
QEIILYFDK

SEQ ID NO: 703741 - protein, 9 aa, Homo Sapiens
ELFLLHQET

SEQ ID NO: 703742 - protein, 9 aa, Homo Sapiens
ENENSEPKI

SEQ ID NO: 703743 - protein, 9 aa, Homo Sapiens
PVEEKVDFE

SEQ ID NO: 703744 - protein, 9 aa, Homo Sapiens
VMLVSTSVP

SEQ ID NO: 703745 - protein, 9 aa, Homo Sapiens
DIKQGRFSY

SEQ ID NO: 703746 - protein, 9 aa, Homo Sapiens
RSTCHSANC

SEQ ID NO: 703747 - protein, 9 aa, Homo Sapiens
DSPPSTPPP

SEQ ID NO: 703748 - protein, 9 aa, Homo Sapiens
GVVHEVEEC

SEQ ID NO: 703749 - protein, 9 aa, Homo Sapiens
EAQAKVYKK

SEQ ID NO: 703750 - protein, 9 aa, Homo Sapiens
RQTLEGKYI

SEQ ID NO: 703751 - protein, 9 aa, Homo Sapiens
VHNNGMLDL

SEQ ID NO: 703752 - protein, 9 aa, Homo Sapiens
IEMFLITTN

SEQ ID NO: 703753 - protein, 9 aa, Homo Sapiens
ETMCNATAI

SEQ ID NO: 703754 - protein, 9 aa, Homo Sapiens
CVPCEGTAN

SEQ ID NO: 703755 - protein, 9 aa, Homo Sapiens
TMAPNTANT

SEQ ID NO: 703756 - protein, 9 aa, Homo Sapiens
IAQQLRQLQ

SEQ ID NO: 703757 - protein, 9 aa, Homo Sapiens
CIEDLVRPL

SEQ ID NO: 703758 - protein, 9 aa, Homo Sapiens
GWLSLLLWV

SEQ ID NO: 703759 - protein, 9 aa, Homo Sapiens
WEIQNTGHL

SEQ ID NO: 703760 - protein, 9 aa, Homo Sapiens
VCNNVTWAI

SEQ ID NO: 703761 - protein, 9 aa, Homo Sapiens
FTMMDKDVP

SEQ ID NO: 703762 - protein, 9 aa, Homo Sapiens
RTLCPLEAT

SEQ ID NO: 703763 - protein, 9 aa, Homo Sapiens
ITITKANGK

SEQ ID NO: 703764 - protein, 9 aa, Homo Sapiens
RSNEVLLGA

SEQ ID NO: 703765 - protein, 9 aa, Homo Sapiens
ASNQGPTTR

SEQ ID NO: 703766 - protein, 9 aa, Homo Sapiens
SSVYADVSR

SEQ ID NO: 703767 - protein, 9 aa, Homo Sapiens
LKTERKTKL

SEQ ID NO: 703768 - protein, 9 aa, Homo Sapiens
PPQLRGRPG

SEQ ID NO: 703769 - protein, 9 aa, Homo Sapiens
PQCQQLRMF

SEQ ID NO: 703770 - protein, 9 aa, Homo Sapiens
CCTAEGSPA

SEQ ID NO: 703771 - protein, 9 aa, Homo Sapiens
NHCRLSSLG

SEQ ID NO: 703772 - protein, 9 aa, Homo Sapiens
ATTPDHGCF

SEQ ID NO: 703773 - protein, 9 aa, Homo Sapiens
PPTVPPLGV

SEQ ID NO: 703774 - protein, 9 aa, Homo Sapiens
TNQFLDSKQ

SEQ ID NO: 703775 - protein, 9 aa, Homo Sapiens
DPEAFLLCH

SEQ ID NO: 703776 - protein, 9 aa, Homo Sapiens
CQQLRMFFL

SEQ ID NO: 703777 - protein, 9 aa, Homo Sapiens
EMFLITTNP

SEQ ID NO: 703778 - protein, 9 aa, Homo Sapiens
GCQLAEVHS

SEQ ID NO: 703779 - protein, 9 aa, Homo Sapiens
DLLKFLGDA

SEQ ID NO: 703780 - protein, 9 aa, Homo Sapiens
SDRLAVLKG

SEQ ID NO: 703781 - protein, 9 aa, Homo Sapiens
AERFYTALC

SEQ ID NO: 703782 - protein, 9 aa, Homo Sapiens
LGAIQSQQQ

SEQ ID NO: 703783 - protein, 9 aa, Homo Sapiens
NFFSPAPDP

SEQ ID NO: 703784 - protein, 9 aa, Homo Sapiens
SERSRKKRK

SEQ ID NO: 703785 - protein, 9 aa, Homo Sapiens
YQSQKQFQC

SEQ ID NO: 703786 - protein, 9 aa, Homo Sapiens
NEQDWERTQ

SEQ ID NO: 703787 - protein, 9 aa, Homo Sapiens
DTDGFSALH

SEQ ID NO: 703788 - protein, 9 aa, Homo Sapiens
TVKANALAA

SEQ ID NO: 703789 - protein, 9 aa, Homo Sapiens
GYSKCLQNE

SEQ ID NO: 703790 - protein, 9 aa, Homo Sapiens
ETGEFYLSP

SEQ ID NO: 703791 - protein, 9 aa, Homo Sapiens
KSATLLYHQ

SEQ ID NO: 703792 - protein, 9 aa, Homo Sapiens
QREAAKKQS

SEQ ID NO: 703793 - protein, 9 aa, Homo Sapiens
GFPFAAIHQ

SEQ ID NO: 703794 - protein, 9 aa, Homo Sapiens
APRNAAAPE

SEQ ID NO: 703795 - protein, 9 aa, Homo Sapiens
FPSCCSSSR

SEQ ID NO: 703796 - protein, 9 aa, Homo Sapiens
RGAFQRGRG

SEQ ID NO: 703797 - protein, 9 aa, Homo Sapiens
FSEIADLFM

SEQ ID NO: 703798 - protein, 9 aa, Homo Sapiens
RIGPMFDKE

SEQ ID NO: 703799 - protein, 9 aa, Homo Sapiens
ETNFGPQLK

SEQ ID NO: 703800 - protein, 9 aa, Homo Sapiens
WAAALNNVD

SEQ ID NO: 703801 - protein, 9 aa, Homo Sapiens
EASQSSSSP

SEQ ID NO: 703802 - protein, 9 aa, Homo Sapiens
KHPLCLESL

SEQ ID NO: 703803 - protein, 9 aa, Homo Sapiens
FPAKASVSV

SEQ ID NO: 703804 - protein, 9 aa, Homo Sapiens
LLLGTLHLQ

SEQ ID NO: 703805 - protein, 9 aa, Homo Sapiens
ENPPPPPPV

SEQ ID NO: 703806 - protein, 9 aa, Homo Sapiens
LFAVISRKI

SEQ ID NO: 703807 - protein, 9 aa, Homo Sapiens
TVPPLGVDG

SEQ ID NO: 703808 - protein, 9 aa, Homo Sapiens
NLLRLVQFI

SEQ ID NO: 703809 - protein, 9 aa, Homo Sapiens
AILDVEEAV

SEQ ID NO: 703810 - protein, 9 aa, Homo Sapiens
HRAHPRHPG

SEQ ID NO: 703811 - protein, 9 aa, Homo Sapiens
MRTNKFWPL

SEQ ID NO: 703812 - protein, 9 aa, Homo Sapiens
LFAAWLSFF

SEQ ID NO: 703813 - protein, 9 aa, Homo Sapiens
PPLGVDGVS

SEQ ID NO: 703814 - protein, 9 aa, Homo Sapiens
LSYIIRKDT

SEQ ID NO: 703815 - protein, 9 aa, Homo Sapiens
PMFDKEIPP

SEQ ID NO: 703816 - protein, 9 aa, Homo Sapiens
VKWMMKDVF

SEQ ID NO: 703817 - protein, 9 aa, Homo Sapiens
HKLQFTFTS

SEQ ID NO: 703818 - protein, 9 aa, Homo Sapiens
LFCDIAPWI

SEQ ID NO: 703819 - protein, 9 aa, Homo Sapiens
YKNLKVDDK

SEQ ID NO: 703820 - protein, 9 aa, Homo Sapiens
KKTFNVYYL

SEQ ID NO: 703821 - protein, 9 aa, Homo Sapiens
KRRSNEVLL

SEQ ID NO: 703822 - protein, 9 aa, Homo Sapiens
PGHDWCFLR

SEQ ID NO: 703823 - protein, 9 aa, Homo Sapiens
LQTLKEMTN

SEQ ID NO: 703824 - protein, 9 aa, Homo Sapiens
LDPTKPPCL

SEQ ID NO: 703825 - protein, 9 aa, Homo Sapiens
PGQHFGLQE

SEQ ID NO: 703826 - protein, 9 aa, Homo Sapiens
LLLVTVRKT

SEQ ID NO: 703827 - protein, 9 aa, Homo Sapiens
SLLLWVSAL

SEQ ID NO: 703828 - protein, 9 aa, Homo Sapiens
PREILFRDD

SEQ ID NO: 703829 - protein, 9 aa, Homo Sapiens
KYMAPSNTA

SEQ ID NO: 703830 - protein, 9 aa, Homo Sapiens
LREASQSSS

SEQ ID NO: 703831 - protein, 9 aa, Homo Sapiens
KAPPVEAGA

SEQ ID NO: 703832 - protein, 9 aa, Homo Sapiens
DLVNQLVAG

SEQ ID NO: 703833 - protein, 9 aa, Homo Sapiens
VSRSSGPKA

SEQ ID NO: 703834 - protein, 9 aa, Homo Sapiens
WLSWWIKYM

SEQ ID NO: 703835 - protein, 9 aa, Homo Sapiens
QYLGSFDHY

SEQ ID NO: 703836 - protein, 9 aa, Homo Sapiens
SVYADVSRL

SEQ ID NO: 703837 - protein, 9 aa, Homo Sapiens
TDFWGPEEG

SEQ ID NO: 703838 - protein, 9 aa, Homo Sapiens
FPLARYNRT

SEQ ID NO: 703839 - protein, 9 aa, Homo Sapiens
SPLGCIHRN

SEQ ID NO: 703840 - protein, 9 aa, Homo Sapiens
EFEVLKGHA

SEQ ID NO: 703841 - protein, 9 aa, Homo Sapiens
GIFWFCACD

SEQ ID NO: 703842 - protein, 9 aa, Homo Sapiens
TDPNISDEY

SEQ ID NO: 703843 - protein, 9 aa, Homo Sapiens
FYEKRALYL

SEQ ID NO: 703844 - protein, 9 aa, Homo Sapiens
FRRFLCSRF

SEQ ID NO: 703845 - protein, 9 aa, Homo Sapiens
LLIFLAARR

SEQ ID NO: 703846 - protein, 9 aa, Homo Sapiens
QGPSPSVRD

SEQ ID NO: 703847 - protein, 9 aa, Homo Sapiens
ESLREASQS

SEQ ID NO: 703848 - protein, 9 aa, Homo Sapiens
GPISDVSIV

SEQ ID NO: 703849 - protein, 9 aa, Homo Sapiens
LRSPGAHAA

SEQ ID NO: 703850 - protein, 9 aa, Homo Sapiens
CELQKTERD

SEQ ID NO: 703851 - protein, 9 aa, Homo Sapiens
AYYEADCFG

SEQ ID NO: 703852 - protein, 9 aa, Homo Sapiens
EYIPYEAAT

SEQ ID NO: 703853 - protein, 9 aa, Homo Sapiens
ILATTTTNL

SEQ ID NO: 703854 - protein, 9 aa, Homo Sapiens
QVNIPDLFC

SEQ ID NO: 703855 - protein, 9 aa, Homo Sapiens
RQRSLLPRR

SEQ ID NO: 703856 - protein, 9 aa, Homo Sapiens
LQTNYDSDL

SEQ ID NO: 703857 - protein, 9 aa, Homo Sapiens
EREIVRGIK

SEQ ID NO: 703858 - protein, 9 aa, Homo Sapiens
DLEFQLGDR

SEQ ID NO: 703859 - protein, 9 aa, Homo Sapiens
LVSTSVPKM

SEQ ID NO: 703860 - protein, 9 aa, Homo Sapiens
PKAKLHAGR

SEQ ID NO: 703861 - protein, 9 aa, Homo Sapiens
GQGLTLAAC

SEQ ID NO: 703862 - protein, 9 aa, Homo Sapiens
LKGHADKQS

SEQ ID NO: 703863 - protein, 9 aa, Homo Sapiens
CRAGRQRRG

SEQ ID NO: 703864 - protein, 9 aa, Homo Sapiens
KQTWHSKPR

SEQ ID NO: 703865 - protein, 9 aa, Homo Sapiens
CYTGTREVR

SEQ ID NO: 703866 - protein, 9 aa, Homo Sapiens
IITKYQAYN

SEQ ID NO: 703867 - protein, 9 aa, Homo Sapiens
TMWNRWFGM

SEQ ID NO: 703868 - protein, 9 aa, Homo Sapiens
PRNAAAPER

SEQ ID NO: 703869 - protein, 9 aa, Homo Sapiens
SSCRRPIKG

SEQ ID NO: 703870 - protein, 9 aa, Homo Sapiens
KSVLLLLKL

SEQ ID NO: 703871 - protein, 9 aa, Homo Sapiens
LLLELGRGV

SEQ ID NO: 703872 - protein, 9 aa, Homo Sapiens
TLRSPGAHA

SEQ ID NO: 703873 - protein, 9 aa, Homo Sapiens
RHPGYRSPT

SEQ ID NO: 703874 - protein, 9 aa, Homo Sapiens
VQAPKAKLH

SEQ ID NO: 703875 - protein, 9 aa, Homo Sapiens
RGRGAWEVR

SEQ ID NO: 703876 - protein, 9 aa, Homo Sapiens
AVQKVRAWG

SEQ ID NO: 703877 - protein, 9 aa, Homo Sapiens
RSISIYEMN

SEQ ID NO: 703878 - protein, 9 aa, Homo Sapiens
SWWIKYMAP

SEQ ID NO: 703879 - protein, 9 aa, Homo Sapiens
LTRTGLFRR

SEQ ID NO: 703880 - protein, 9 aa, Homo Sapiens
ESRVSELEG

SEQ ID NO: 703881 - protein, 9 aa, Homo Sapiens
LRRHSSERA

SEQ ID NO: 703882 - protein, 9 aa, Homo Sapiens
KCKEVLCWE

SEQ ID NO: 703883 - protein, 9 aa, Homo Sapiens
LHGQCWEDF

SEQ ID NO: 703884 - protein, 9 aa, Homo Sapiens
KKPELIEMF

SEQ ID NO: 703885 - protein, 9 aa, Homo Sapiens
PIISAFAGD

SEQ ID NO: 703886 - protein, 9 aa, Homo Sapiens
LSLLLWVSA

SEQ ID NO: 703887 - protein, 9 aa, Homo Sapiens
SLLIDFITV

SEQ ID NO: 703888 - protein, 9 aa, Homo Sapiens
SELEGELEG

SEQ ID NO: 703889 - protein, 9 aa, Homo Sapiens
CRAFSKGEK

SEQ ID NO: 703890 - protein, 9 aa, Homo Sapiens
VSITDFQLP

SEQ ID NO: 703891 - protein, 9 aa, Homo Sapiens
RRELMNFKS

SEQ ID NO: 703892 - protein, 9 aa, Homo Sapiens
RRPPRGRGA

SEQ ID NO: 703893 - protein, 9 aa, Homo Sapiens
HPSDGIGAL

SEQ ID NO: 703894 - protein, 9 aa, Homo Sapiens
SHGHMDCVR

SEQ ID NO: 703895 - protein, 9 aa, Homo Sapiens
VHEGCIEDL

SEQ ID NO: 703896 - protein, 9 aa, Homo Sapiens
SSDSRTFST

SEQ ID NO: 703897 - protein, 9 aa, Homo Sapiens
ARDLDGVAN

SEQ ID NO: 703898 - protein, 9 aa, Homo Sapiens
FHPEQKKVA

SEQ ID NO: 703899 - protein, 9 aa, Homo Sapiens
GSATTSLVA

SEQ ID NO: 703900 - protein, 9 aa, Homo Sapiens
TVRKTATLH

SEQ ID NO: 703901 - protein, 9 aa, Homo Sapiens
NEVLLGAIE

SEQ ID NO: 703902 - protein, 9 aa, Homo Sapiens
AQFSSVLSV

SEQ ID NO: 703903 - protein, 9 aa, Homo Sapiens
QRQKAVRVS

SEQ ID NO: 703904 - protein, 9 aa, Homo Sapiens
GCIHRNWDK

SEQ ID NO: 703905 - protein, 9 aa, Homo Sapiens
LVVSHLCII

SEQ ID NO: 703906 - protein, 9 aa, Homo Sapiens
QVQEFLKEG

SEQ ID NO: 703907 - protein, 9 aa, Homo Sapiens
LESCSSSPS

SEQ ID NO: 703908 - protein, 9 aa, Homo Sapiens
LFASGCSSD

SEQ ID NO: 703909 - protein, 9 aa, Homo Sapiens
FLKIVNLLK

SEQ ID NO: 703910 - protein, 9 aa, Homo Sapiens
TRVDKCTRE

SEQ ID NO: 703911 - protein, 9 aa, Homo Sapiens
PMTAQFSSV

SEQ ID NO: 703912 - protein, 9 aa, Homo Sapiens
VSHGHMDCV

SEQ ID NO: 703913 - protein, 9 aa, Homo Sapiens
VHKMNNCLR

SEQ ID NO: 703914 - protein, 9 aa, Homo Sapiens
ALERNPSTI

SEQ ID NO: 703915 - protein, 9 aa, Homo Sapiens
QSSGWIDII

SEQ ID NO: 703916 - protein, 9 aa, Homo Sapiens
PHCKQAVNF

SEQ ID NO: 703917 - protein, 9 aa, Homo Sapiens
RPPALRPRP

SEQ ID NO: 703918 - protein, 9 aa, Homo Sapiens
PKRELIQER

SEQ ID NO: 703919 - protein, 9 aa, Homo Sapiens
MSYGATSQK

SEQ ID NO: 703920 - protein, 9 aa, Homo Sapiens
STVMKSGSE

SEQ ID NO: 703921 - protein, 9 aa, Homo Sapiens
PKDAYFTMM

SEQ ID NO: 703922 - protein, 9 aa, Homo Sapiens
EAMANLHTL

SEQ ID NO: 703923 - protein, 9 aa, Homo Sapiens
SKRDEHESP

SEQ ID NO: 703924 - protein, 9 aa, Homo Sapiens
FSYAHNGDK

SEQ ID NO: 703925 - protein, 9 aa, Homo Sapiens
NNLAAGTIY

SEQ ID NO: 703926 - protein, 9 aa, Homo Sapiens
LPNHIPLHS

SEQ ID NO: 703927 - protein, 9 aa, Homo Sapiens
GMRDRWDYV

SEQ ID NO: 703928 - protein, 9 aa, Homo Sapiens
SLYQSQKQF

SEQ ID NO: 703929 - protein, 9 aa, Homo Sapiens
IHRNWDKFD

SEQ ID NO: 703930 - protein, 9 aa, Homo Sapiens
RVCVLCELQ

SEQ ID NO: 703931 - protein, 9 aa, Homo Sapiens
GREHRKAHG

SEQ ID NO: 703932 - protein, 9 aa, Homo Sapiens
VWHRYLDYR

SEQ ID NO: 703933 - protein, 9 aa, Homo Sapiens
QGETVQGGA

SEQ ID NO: 703934 - protein, 9 aa, Homo Sapiens
AEEAWTETE

SEQ ID NO: 703935 - protein, 9 aa, Homo Sapiens
SLPNHIPLH

SEQ ID NO: 703936 - protein, 9 aa, Homo Sapiens
TKGVCLGMR

SEQ ID NO: 703937 - protein, 9 aa, Homo Sapiens
CRYCCSCCR

SEQ ID NO: 703938 - protein, 9 aa, Homo Sapiens
MNYFALERN

SEQ ID NO: 703939 - protein, 9 aa, Homo Sapiens
GSGSDLESC

SEQ ID NO: 703940 - protein, 9 aa, Homo Sapiens
MAKEWYKRA

SEQ ID NO: 703941 - protein, 9 aa, Homo Sapiens
QSSDSRTFS

SEQ ID NO: 703942 - protein, 9 aa, Homo Sapiens
MAPNTANTS

SEQ ID NO: 703943 - protein, 9 aa, Homo Sapiens
LYQSFYEKR

SEQ ID NO: 703944 - protein, 9 aa, Homo Sapiens
KVSRSSGPK

SEQ ID NO: 703945 - protein, 9 aa, Homo Sapiens
KKHGYIKML

SEQ ID NO: 703946 - protein, 9 aa, Homo Sapiens
SSPVPRGGS

SEQ ID NO: 703947 - protein, 9 aa, Homo Sapiens
RPPQLRGRP

SEQ ID NO: 703948 - protein, 9 aa, Homo Sapiens
KSPILHKPP

SEQ ID NO: 703949 - protein, 9 aa, Homo Sapiens
QGMRDRWDY

SEQ ID NO: 703950 - protein, 9 aa, Homo Sapiens
EHALVDMVQ

SEQ ID NO: 703951 - protein, 9 aa, Homo Sapiens
CGPRAINHL

SEQ ID NO: 703952 - protein, 9 aa, Homo Sapiens
LTALQKYLI

SEQ ID NO: 703953 - protein, 9 aa, Homo Sapiens
LELRPHNHL

SEQ ID NO: 703954 - protein, 9 aa, Homo Sapiens
LSDMECKIP

SEQ ID NO: 703955 - protein, 9 aa, Homo Sapiens
LEDLMIEAV

SEQ ID NO: 703956 - protein, 9 aa, Homo Sapiens
ELMRLQRHY

SEQ ID NO: 703957 - protein, 9 aa, Homo Sapiens
YFSQLQEEE

SEQ ID NO: 703958 - protein, 9 aa, Homo Sapiens
AKAAVVIGM

SEQ ID NO: 703959 - protein, 9 aa, Homo Sapiens
SQSARITDY

SEQ ID NO: 703960 - protein, 9 aa, Homo Sapiens
HICHTIVFT

SEQ ID NO: 703961 - protein, 9 aa, Homo Sapiens
PFAAIHQVH

SEQ ID NO: 703962 - protein, 9 aa, Homo Sapiens
QPVQLTDLY

SEQ ID NO: 703963 - protein, 9 aa, Homo Sapiens
GHSRWEADL

SEQ ID NO: 703964 - protein, 9 aa, Homo Sapiens
LIFLAARRQ

SEQ ID NO: 703965 - protein, 9 aa, Homo Sapiens
ERKTKLNQL

SEQ ID NO: 703966 - protein, 9 aa, Homo Sapiens
HVNLYGSML

SEQ ID NO: 703967 - protein, 9 aa, Homo Sapiens
PLRPGTPAM

SEQ ID NO: 703968 - protein, 9 aa, Homo Sapiens
LAFNDIKIL

SEQ ID NO: 703969 - protein, 9 aa, Homo Sapiens
NLAAGTIYD

SEQ ID NO: 703970 - protein, 9 aa, Homo Sapiens
LYFDKGKMW

SEQ ID NO: 703971 - protein, 9 aa, Homo Sapiens
RSDNCFSFF

SEQ ID NO: 703972 - protein, 9 aa, Homo Sapiens
YVKKRREKQ

SEQ ID NO: 703973 - protein, 9 aa, Homo Sapiens
LSVEFVWHR

SEQ ID NO: 703974 - protein, 9 aa, Homo Sapiens
LIRGVRLPG

SEQ ID NO: 703975 - protein, 9 aa, Homo Sapiens
YERQQMRQE

SEQ ID NO: 703976 - protein, 9 aa, Homo Sapiens
VLFSFYLKD

SEQ ID NO: 703977 - protein, 9 aa, Homo Sapiens
KIPEKRQQS

SEQ ID NO: 703978 - protein, 9 aa, Homo Sapiens
CSRYVHEGC

SEQ ID NO: 703979 - protein, 9 aa, Homo Sapiens
LVTVRKTAT

SEQ ID NO: 703980 - protein, 9 aa, Homo Sapiens
RSLEAMKAM

SEQ ID NO: 703981 - protein, 9 aa, Homo Sapiens
FISVCNNVT

SEQ ID NO: 703982 - protein, 9 aa, Homo Sapiens
LHLQRRTVD

SEQ ID NO: 703983 - protein, 9 aa, Homo Sapiens
NSGLPSQGL

SEQ ID NO: 703984 - protein, 9 aa, Homo Sapiens
YLSPHTSTG

SEQ ID NO: 703985 - protein, 9 aa, Homo Sapiens
RMPAILDVE

SEQ ID NO: 703986 - protein, 9 aa, Homo Sapiens
RYKNLKVDD

SEQ ID NO: 703987 - protein, 9 aa, Homo Sapiens
FFMGYYWYS

SEQ ID NO: 703988 - protein, 9 aa, Homo Sapiens
ADKGTLLPI

SEQ ID NO: 703989 - protein, 9 aa, Homo Sapiens
FYLKDFVAA

SEQ ID NO: 703990 - protein, 9 aa, Homo Sapiens
HLQRRTVDE

SEQ ID NO: 703991 - protein, 9 aa, Homo Sapiens
NKFSFNLRK

SEQ ID NO: 703992 - protein, 9 aa, Homo Sapiens
VQEFLKEGY

SEQ ID NO: 703993 - protein, 9 aa, Homo Sapiens
MVMAPSPSL

SEQ ID NO: 703994 - protein, 9 aa, Homo Sapiens
QLEQVLGDY

SEQ ID NO: 703995 - protein, 9 aa, Homo Sapiens
KLLSRNSGE

SEQ ID NO: 703996 - protein, 9 aa, Homo Sapiens
LRRSTCHSA

SEQ ID NO: 703997 - protein, 9 aa, Homo Sapiens
SLDLYKQDS

SEQ ID NO: 703998 - protein, 9 aa, Homo Sapiens
IIIAYHGGL

SEQ ID NO: 703999 - protein, 9 aa, Homo Sapiens
LETLTNQFL

SEQ ID NO: 704000 - protein, 9 aa, Homo Sapiens
GSSVMSPQE

SEQ ID NO: 704001 - protein, 9 aa, Homo Sapiens
YIPYEAATY

SEQ ID NO: 704002 - protein, 9 aa, Homo Sapiens
LTAVSVFYG

SEQ ID NO: 704003 - protein, 9 aa, Homo Sapiens
SVPHPPPPP

SEQ ID NO: 704004 - protein, 9 aa, Homo Sapiens
WMGLGLGLH

SEQ ID NO: 704005 - protein, 9 aa, Homo Sapiens
HRKAHGRAL

SEQ ID NO: 704006 - protein, 9 aa, Homo Sapiens
SSSYRRMLG

SEQ ID NO: 704007 - protein, 9 aa, Homo Sapiens
KLQFTFTSE

SEQ ID NO: 704008 - protein, 9 aa, Homo Sapiens
QRTDFWGPE

SEQ ID NO: 704009 - protein, 9 aa, Homo Sapiens
ILAQTLDTS

SEQ ID NO: 704010 - protein, 9 aa, Homo Sapiens
QAEHTLKEN

SEQ ID NO: 704011 - protein, 9 aa, Homo Sapiens
SFPAKASVS

SEQ ID NO: 704012 - protein, 9 aa, Homo Sapiens
NTDVHSPLK

SEQ ID NO: 704013 - protein, 9 aa, Homo Sapiens
KSLSDRLAV

SEQ ID NO: 704014 - protein, 9 aa, Homo Sapiens
DDDEDNDVP

SEQ ID NO: 704015 - protein, 9 aa, Homo Sapiens
SILVTSIFF

SEQ ID NO: 704016 - protein, 9 aa, Homo Sapiens
ARQEREGTP

SEQ ID NO: 704017 - protein, 9 aa, Homo Sapiens
SLGENSMAK

SEQ ID NO: 704018 - protein, 9 aa, Homo Sapiens
IGMELKDMS

SEQ ID NO: 704019 - protein, 9 aa, Homo Sapiens
KQFLQSFPE

SEQ ID NO: 704020 - protein, 9 aa, Homo Sapiens
SLGHSRWEA

SEQ ID NO: 704021 - protein, 9 aa, Homo Sapiens
GRGAFQRGR

SEQ ID NO: 704022 - protein, 9 aa, Homo Sapiens
CVQLSQIQW

SEQ ID NO: 704023 - protein, 9 aa, Homo Sapiens
REIVRGIKE

SEQ ID NO: 704024 - protein, 9 aa, Homo Sapiens
IFHPEQKKV

SEQ ID NO: 704025 - protein, 9 aa, Homo Sapiens
FFFHICHTI

SEQ ID NO: 704026 - protein, 9 aa, Homo Sapiens
VKGLARAVF

SEQ ID NO: 704027 - protein, 9 aa, Homo Sapiens
TGTSQIGMS

SEQ ID NO: 704028 - protein, 9 aa, Homo Sapiens
AQVQEFLKE

SEQ ID NO: 704029 - protein, 9 aa, Homo Sapiens
LHNDLLKFL

SEQ ID NO: 704030 - protein, 9 aa, Homo Sapiens
YNFVSHSKS

SEQ ID NO: 704031 - protein, 9 aa, Homo Sapiens
YPWNYTVTW

SEQ ID NO: 704032 - protein, 9 aa, Homo Sapiens
QHYSFNIET

SEQ ID NO: 704033 - protein, 9 aa, Homo Sapiens
PLNAKNLHV

SEQ ID NO: 704034 - protein, 9 aa, Homo Sapiens
RAHPRHPGP

SEQ ID NO: 704035 - protein, 9 aa, Homo Sapiens
RPLLRSMST

SEQ ID NO: 704036 - protein, 9 aa, Homo Sapiens
PEPYTYNGI

SEQ ID NO: 704037 - protein, 9 aa, Homo Sapiens
NPHCKQAVN

SEQ ID NO: 704038 - protein, 9 aa, Homo Sapiens
LQWEIQNTG

SEQ ID NO: 704039 - protein, 9 aa, Homo Sapiens
IFGDNDSRR

SEQ ID NO: 704040 - protein, 9 aa, Homo Sapiens
ENSEPKICR

SEQ ID NO: 704041 - protein, 9 aa, Homo Sapiens
DKSKNSGLP

SEQ ID NO: 704042 - protein, 9 aa, Homo Sapiens
CWPPWYSWM

SEQ ID NO: 704043 - protein, 9 aa, Homo Sapiens
RQRRGPGLA

SEQ ID NO: 704044 - protein, 9 aa, Homo Sapiens
KNKFSFNLR

SEQ ID NO: 704045 - protein, 9 aa, Homo Sapiens
NPYDLQHIE

SEQ ID NO: 704046 - protein, 9 aa, Homo Sapiens
ELGQQIDNL

SEQ ID NO: 704047 - protein, 9 aa, Homo Sapiens
ESEHLKESV

SEQ ID NO: 704048 - protein, 9 aa, Homo Sapiens
LDACETMCN

SEQ ID NO: 704049 - protein, 9 aa, Homo Sapiens
SATSTRVDK

SEQ ID NO: 704050 - protein, 9 aa, Homo Sapiens
ARQNRAYLL

SEQ ID NO: 704051 - protein, 9 aa, Homo Sapiens
FAIQSINTD

SEQ ID NO: 704052 - protein, 9 aa, Homo Sapiens
NAAFGNCKT

SEQ ID NO: 704053 - protein, 9 aa, Homo Sapiens
KNSGLPSQG

SEQ ID NO: 704054 - protein, 9 aa, Homo Sapiens
EKLNFVEIW

SEQ ID NO: 704055 - protein, 9 aa, Homo Sapiens
YPLLLLLGI

SEQ ID NO: 704056 - protein, 9 aa, Homo Sapiens
LLPHGKGRG

SEQ ID NO: 704057 - protein, 9 aa, Homo Sapiens
AEHTLKEND

SEQ ID NO: 704058 - protein, 9 aa, Homo Sapiens
DNGQSDPLL

SEQ ID NO: 704059 - protein, 9 aa, Homo Sapiens
KPHRFKRGG

SEQ ID NO: 704060 - protein, 9 aa, Homo Sapiens
LLSCLLAML

SEQ ID NO: 704061 - protein, 9 aa, Homo Sapiens
YIPKDAYFT

SEQ ID NO: 704062 - protein, 9 aa, Homo Sapiens
KILMKQTWH

SEQ ID NO: 704063 - protein, 9 aa, Homo Sapiens
IFLAFVSIN

SEQ ID NO: 704064 - protein, 9 aa, Homo Sapiens
NIKFLYSVA

SEQ ID NO: 704065 - protein, 9 aa, Homo Sapiens
LQLCQDPRL

SEQ ID NO: 704066 - protein, 9 aa, Homo Sapiens
RRLMECLRV

SEQ ID NO: 704067 - protein, 9 aa, Homo Sapiens
LVLQDAVAR

SEQ ID NO: 704068 - protein, 9 aa, Homo Sapiens
EVDKSKEEL

SEQ ID NO: 704069 - protein, 9 aa, Homo Sapiens
FMMPPPSVP

SEQ ID NO: 704070 - protein, 9 aa, Homo Sapiens
NITPMKASP

SEQ ID NO: 704071 - protein, 9 aa, Homo Sapiens
KSTLVFPDC

SEQ ID NO: 704072 - protein, 9 aa, Homo Sapiens
SYCGHGFYP

SEQ ID NO: 704073 - protein, 9 aa, Homo Sapiens
EAWTETEKV

SEQ ID NO: 704074 - protein, 9 aa, Homo Sapiens
RTSVVTAAT

SEQ ID NO: 704075 - protein, 9 aa, Homo Sapiens
DLYKQDSSK

SEQ ID NO: 704076 - protein, 9 aa, Homo Sapiens
IQNLLTATA

SEQ ID NO: 704077 - protein, 9 aa, Homo Sapiens
CKKTFNVYY

SEQ ID NO: 704078 - protein, 9 aa, Homo Sapiens
HLVTLYNNS

SEQ ID NO: 704079 - protein, 9 aa, Homo Sapiens
ERSRKKRKV

SEQ ID NO: 704080 - protein, 9 aa, Homo Sapiens
SVEFVWHRY

SEQ ID NO: 704081 - protein, 9 aa, Homo Sapiens
CRLELCRAG

SEQ ID NO: 704082 - protein, 9 aa, Homo Sapiens
ELFSSLCSS

SEQ ID NO: 704083 - protein, 9 aa, Homo Sapiens
PVQLTDLYP

SEQ ID NO: 704084 - protein, 9 aa, Homo Sapiens
NSSVYADVS

SEQ ID NO: 704085 - protein, 9 aa, Homo Sapiens
SQYKMNITY

SEQ ID NO: 704086 - protein, 9 aa, Homo Sapiens
MSPPTVPPL

SEQ ID NO: 704087 - protein, 9 aa, Homo Sapiens
SGNLTTDSL

SEQ ID NO: 704088 - protein, 9 aa, Homo Sapiens
SECKAFENR

SEQ ID NO: 704089 - protein, 9 aa, Homo Sapiens
HSNVLMDFE

SEQ ID NO: 704090 - protein, 9 aa, Homo Sapiens
GTLQTIMGG

SEQ ID NO: 704091 - protein, 9 aa, Homo Sapiens
QSQQQEVIS

SEQ ID NO: 704092 - protein, 9 aa, Homo Sapiens
LVVTICLRI

SEQ ID NO: 704093 - protein, 9 aa, Homo Sapiens
PDLPTMAPN

SEQ ID NO: 704094 - protein, 9 aa, Homo Sapiens
DFITVFGEL

SEQ ID NO: 704095 - protein, 9 aa, Homo Sapiens
DLESCSSSP

SEQ ID NO: 704096 - protein, 9 aa, Homo Sapiens
VLHGQCWED

SEQ ID NO: 704097 - protein, 9 aa, Homo Sapiens
VENGKHHGT

SEQ ID NO: 704098 - protein, 9 aa, Homo Sapiens
EREGTPCAE

SEQ ID NO: 704099 - protein, 9 aa, Homo Sapiens
LYQSQKQFQ

SEQ ID NO: 704100 - protein, 9 aa, Homo Sapiens
ELRQRWDPN

SEQ ID NO: 704101 - protein, 9 aa, Homo Sapiens
EAFLLCHRG

SEQ ID NO: 704102 - protein, 9 aa, Homo Sapiens
ARCLTRTAS

SEQ ID NO: 704103 - protein, 9 aa, Homo Sapiens
SEVFLLAVM

SEQ ID NO: 704104 - protein, 9 aa, Homo Sapiens
KMRPTFLKI

SEQ ID NO: 704105 - protein, 9 aa, Homo Sapiens
GGGRSFSQR

SEQ ID NO: 704106 - protein, 9 aa, Homo Sapiens
ERRKWADLP

SEQ ID NO: 704107 - protein, 9 aa, Homo Sapiens
GPNRILIYN

SEQ ID NO: 704108 - protein, 9 aa, Homo Sapiens
QMFKVELMR

SEQ ID NO: 704109 - protein, 9 aa, Homo Sapiens
KRSSCSSGD

SEQ ID NO: 704110 - protein, 9 aa, Homo Sapiens
VHALTHTPI

SEQ ID NO: 704111 - protein, 9 aa, Homo Sapiens
LSQIQWLIG

SEQ ID NO: 704112 - protein, 9 aa, Homo Sapiens
RDSPPSTPP

SEQ ID NO: 704113 - protein, 9 aa, Homo Sapiens
QNRTVQCVP

SEQ ID NO: 704114 - protein, 9 aa, Homo Sapiens
PTAASAPNA

SEQ ID NO: 704115 - protein, 9 aa, Homo Sapiens
SRLNGAWQY

SEQ ID NO: 704116 - protein, 9 aa, Homo Sapiens
HQPRHRSLP

SEQ ID NO: 704117 - protein, 9 aa, Homo Sapiens
RTQQASVLA

SEQ ID NO: 704118 - protein, 9 aa, Homo Sapiens
FPSPGCQLA

SEQ ID NO: 704119 - protein, 9 aa, Homo Sapiens
EGTANASFV

SEQ ID NO: 704120 - protein, 9 aa, Homo Sapiens
YADVLQNYQ

SEQ ID NO: 704121 - protein, 9 aa, Homo Sapiens
NDDEAPKRQ

SEQ ID NO: 704122 - protein, 9 aa, Homo Sapiens
QDNASGRTS

SEQ ID NO: 704123 - protein, 9 aa, Homo Sapiens
LEIPAGARH

SEQ ID NO: 704124 - protein, 9 aa, Homo Sapiens
RTLSCDSPA

SEQ ID NO: 704125 - protein, 9 aa, Homo Sapiens
WYSKETNIN

SEQ ID NO: 704126 - protein, 9 aa, Homo Sapiens
IYDDIYADV

SEQ ID NO: 704127 - protein, 9 aa, Homo Sapiens
AMEHYPMTA

SEQ ID NO: 704128 - protein, 9 aa, Homo Sapiens
NGDKLQKIP

SEQ ID NO: 704129 - protein, 9 aa, Homo Sapiens
EADFRWQQR

SEQ ID NO: 704130 - protein, 9 aa, Homo Sapiens
VGFLGAGKS

SEQ ID NO: 704131 - protein, 9 aa, Homo Sapiens
VPQLAELTN

SEQ ID NO: 704132 - protein, 9 aa, Homo Sapiens
GPTETEPDG

SEQ ID NO: 704133 - protein, 9 aa, Homo Sapiens
DSSAGLEVY

SEQ ID NO: 704134 - protein, 9 aa, Homo Sapiens
TIREAEALG

SEQ ID NO: 704135 - protein, 9 aa, Homo Sapiens
SLREASQSS

SEQ ID NO: 704136 - protein, 9 aa, Homo Sapiens
KMGRRAEQE

SEQ ID NO: 704137 - protein, 9 aa, Homo Sapiens
TATASFSSC

SEQ ID NO: 704138 - protein, 9 aa, Homo Sapiens
QQSSERSRK

SEQ ID NO: 704139 - protein, 9 aa, Homo Sapiens
YLKDFVAAN

SEQ ID NO: 704140 - protein, 9 aa, Homo Sapiens
QYPLLLLLG

SEQ ID NO: 704141 - protein, 9 aa, Homo Sapiens
APLAAAPAT

SEQ ID NO: 704142 - protein, 9 aa, Homo Sapiens
FGSTNTVTL

SEQ ID NO: 704143 - protein, 9 aa, Homo Sapiens
PNAVWRVTP

SEQ ID NO: 704144 - protein, 9 aa, Homo Sapiens
NQDCLEGNI

SEQ ID NO: 704145 - protein, 9 aa, Homo Sapiens
AYLLLELGR

SEQ ID NO: 704146 - protein, 9 aa, Homo Sapiens
QREAGGSHH

SEQ ID NO: 704147 - protein, 9 aa, Homo Sapiens
GNDSFPAKA

SEQ ID NO: 704148 - protein, 9 aa, Homo Sapiens
PHTSTGETT

SEQ ID NO: 704149 - protein, 9 aa, Homo Sapiens
VDELRQRWD

SEQ ID NO: 704150 - protein, 9 aa, Homo Sapiens
GIAEEQLFQ

SEQ ID NO: 704151 - protein, 9 aa, Homo Sapiens
VKCKEVLCW

SEQ ID NO: 704152 - protein, 9 aa, Homo Sapiens
ASEGYFSQL

SEQ ID NO: 704153 - protein, 9 aa, Homo Sapiens
QSLRRSTCH

SEQ ID NO: 704154 - protein, 9 aa, Homo Sapiens
QTGKKLLKC

SEQ ID NO: 704155 - protein, 9 aa, Homo Sapiens
AKEWYKRAL

SEQ ID NO: 704156 - protein, 9 aa, Homo Sapiens
MLLLADMDL

SEQ ID NO: 704157 - protein, 9 aa, Homo Sapiens
GTDPNISDE

SEQ ID NO: 704158 - protein, 9 aa, Homo Sapiens
RYGVIPRSG

SEQ ID NO: 704159 - protein, 9 aa, Homo Sapiens
GPCGRRSST

SEQ ID NO: 704160 - protein, 9 aa, Homo Sapiens
PFPSPGCQL

SEQ ID NO: 704161 - protein, 9 aa, Homo Sapiens
RRYHKSTEL

SEQ ID NO: 704162 - protein, 9 aa, Homo Sapiens
LVDELRQRW

SEQ ID NO: 704163 - protein, 9 aa, Homo Sapiens
LHSAKNNLK

SEQ ID NO: 704164 - protein, 9 aa, Homo Sapiens
WVVMNSRLN

SEQ ID NO: 704165 - protein, 9 aa, Homo Sapiens
KLFHPHTCS

SEQ ID NO: 704166 - protein, 9 aa, Homo Sapiens
VSHSKSFWT

SEQ ID NO: 704167 - protein, 9 aa, Homo Sapiens
MQKKKRREL

SEQ ID NO: 704168 - protein, 9 aa, Homo Sapiens
REAGGSHHK

SEQ ID NO: 704169 - protein, 9 aa, Homo Sapiens
VVECERRKW

SEQ ID NO: 704170 - protein, 9 aa, Homo Sapiens
MLVSTSVPK

SEQ ID NO: 704171 - protein, 9 aa, Homo Sapiens
RSLLPRRTS

SEQ ID NO: 704172 - protein, 9 aa, Homo Sapiens
FCCRYCCSC

SEQ ID NO: 704173 - protein, 9 aa, Homo Sapiens
GRDNGQSDP

SEQ ID NO: 704174 - protein, 9 aa, Homo Sapiens
KADKLYRKP

SEQ ID NO: 704175 - protein, 9 aa, Homo Sapiens
RQTGKKLLK

SEQ ID NO: 704176 - protein, 9 aa, Homo Sapiens
AEQELFLLH

SEQ ID NO: 704177 - protein, 9 aa, Homo Sapiens
HDWCFLRLG

SEQ ID NO: 704178 - protein, 9 aa, Homo Sapiens
VSLRVLVCD

SEQ ID NO: 704179 - protein, 9 aa, Homo Sapiens
HLLKENKRR

SEQ ID NO: 704180 - protein, 9 aa, Homo Sapiens
REILFRDDD

SEQ ID NO: 704181 - protein, 9 aa, Homo Sapiens
LLHSAKNNL

SEQ ID NO: 704182 - protein, 9 aa, Homo Sapiens
GPQVSFALN

SEQ ID NO: 704183 - protein, 9 aa, Homo Sapiens
PLGCIHRNW

SEQ ID NO: 704184 - protein, 9 aa, Homo Sapiens
RKAHGRALA

SEQ ID NO: 704185 - protein, 9 aa, Homo Sapiens
PNLSYIIRK

SEQ ID NO: 704186 - protein, 9 aa, Homo Sapiens
KMESSINHI

SEQ ID NO: 704187 - protein, 9 aa, Homo Sapiens
KKSVLLLLK

SEQ ID NO: 704188 - protein, 9 aa, Homo Sapiens
EQDRVKEIQ

SEQ ID NO: 704189 - protein, 9 aa, Homo Sapiens
PQVSFALNL

SEQ ID NO: 704190 - protein, 9 aa, Homo Sapiens
FVYHNCEFV

SEQ ID NO: 704191 - protein, 9 aa, Homo Sapiens
RRAEQESAQ

SEQ ID NO: 704192 - protein, 9 aa, Homo Sapiens
QLQTNYDSD

SEQ ID NO: 704193 - protein, 9 aa, Homo Sapiens
QSINTDVHS

SEQ ID NO: 704194 - protein, 9 aa, Homo Sapiens
YKMNITYIA

SEQ ID NO: 704195 - protein, 9 aa, Homo Sapiens
YVASRSAVP

SEQ ID NO: 704196 - protein, 9 aa, Homo Sapiens
RPLRPGTPA

SEQ ID NO: 704197 - protein, 9 aa, Homo Sapiens
SGPHLVTLY

SEQ ID NO: 704198 - protein, 9 aa, Homo Sapiens
LSLSGPHLV

SEQ ID NO: 704199 - protein, 9 aa, Homo Sapiens
CRAWEPARG

SEQ ID NO: 704200 - protein, 9 aa, Homo Sapiens
PGAAGTCKK

SEQ ID NO: 704201 - protein, 9 aa, Homo Sapiens
PPCRCSPTP

SEQ ID NO: 704202 - protein, 9 aa, Homo Sapiens
KSKNSGLPS

SEQ ID NO: 704203 - protein, 9 aa, Homo Sapiens
AQPVQLTDL

SEQ ID NO: 704204 - protein, 9 aa, Homo Sapiens
VLFAVISRK

SEQ ID NO: 704205 - protein, 9 aa, Homo Sapiens
SHTTNSATG

SEQ ID NO: 704206 - protein, 9 aa, Homo Sapiens
PPGIEKGAE

SEQ ID NO: 704207 - protein, 9 aa, Homo Sapiens
PPWYSWMEL

SEQ ID NO: 704208 - protein, 9 aa, Homo Sapiens
EGAIAQQLR

SEQ ID NO: 704209 - protein, 9 aa, Homo Sapiens
FRPACPPGG

SEQ ID NO: 704210 - protein, 9 aa, Homo Sapiens
TGKSLLGRC

SEQ ID NO: 704211 - protein, 9 aa, Homo Sapiens
SLGHPVEEK

SEQ ID NO: 704212 - protein, 9 aa, Homo Sapiens
ISKRDEHES

SEQ ID NO: 704213 - protein, 9 aa, Homo Sapiens
HPEQKKVAQ

SEQ ID NO: 704214 - protein, 9 aa, Homo Sapiens
SLPNNAIKG

SEQ ID NO: 704215 - protein, 9 aa, Homo Sapiens
DHGCFCCRY

SEQ ID NO: 704216 - protein, 9 aa, Homo Sapiens
YWYSKETNI

SEQ ID NO: 704217 - protein, 9 aa, Homo Sapiens
DSLQQSSGW

SEQ ID NO: 704218 - protein, 9 aa, Homo Sapiens
HHSAAKPLE

SEQ ID NO: 704219 - protein, 9 aa, Homo Sapiens
ECKIPTSKD

SEQ ID NO: 704220 - protein, 9 aa, Homo Sapiens
HPPSSVISL

SEQ ID NO: 704221 - protein, 9 aa, Homo Sapiens
LERIEITNI

SEQ ID NO: 704222 - protein, 9 aa, Homo Sapiens
VKEEKLNFV

SEQ ID NO: 704223 - protein, 9 aa, Homo Sapiens
LETLVTVAK

SEQ ID NO: 704224 - protein, 9 aa, Homo Sapiens
LAKRSATST

SEQ ID NO: 704225 - protein, 9 aa, Homo Sapiens
LLIIPDNEL

SEQ ID NO: 704226 - protein, 9 aa, Homo Sapiens
IQSYLKKLF

SEQ ID NO: 704227 - protein, 9 aa, Homo Sapiens
AVGFLGAGK

SEQ ID NO: 704228 - protein, 9 aa, Homo Sapiens
SLGSFRSRN

SEQ ID NO: 704229 - protein, 9 aa, Homo Sapiens
QSFPETLME

SEQ ID NO: 704230 - protein, 9 aa, Homo Sapiens
RIFTVNPKR

SEQ ID NO: 704231 - protein, 9 aa, Homo Sapiens
ESFKEIHVN

SEQ ID NO: 704232 - protein, 9 aa, Homo Sapiens
EHRKAHGRA

SEQ ID NO: 704233 - protein, 9 aa, Homo Sapiens
RSFSQREAG

SEQ ID NO: 704234 - protein, 9 aa, Homo Sapiens
QDWERTQQA

SEQ ID NO: 704235 - protein, 9 aa, Homo Sapiens
LEQVLGDYR

SEQ ID NO: 704236 - protein, 9 aa, Homo Sapiens
YIKMLEIPA

SEQ ID NO: 704237 - protein, 9 aa, Homo Sapiens
PPKPHRFKR

SEQ ID NO: 704238 - protein, 9 aa, Homo Sapiens
NNVTWAIGE

SEQ ID NO: 704239 - protein, 9 aa, Homo Sapiens
VQVSPEAAV

SEQ ID NO: 704240 - protein, 9 aa, Homo Sapiens
SPILHKPPG

SEQ ID NO: 704241 - protein, 9 aa, Homo Sapiens
QQTFIFSDG

SEQ ID NO: 704242 - protein, 9 aa, Homo Sapiens
NDYRKVSRS

SEQ ID NO: 704243 - protein, 9 aa, Homo Sapiens
PPLLPHGKG

SEQ ID NO: 704244 - protein, 9 aa, Homo Sapiens
SFSAPSPAA

SEQ ID NO: 704245 - protein, 9 aa, Homo Sapiens
ETMRVALFA

SEQ ID NO: 704246 - protein, 9 aa, Homo Sapiens
DDFMCSAFL

SEQ ID NO: 704247 - protein, 9 aa, Homo Sapiens
TLDTSTVMK

SEQ ID NO: 704248 - protein, 9 aa, Homo Sapiens
MSIYDDIYA

SEQ ID NO: 704249 - protein, 9 aa, Homo Sapiens
VLMDFEDGA

SEQ ID NO: 704250 - protein, 9 aa, Homo Sapiens
LGHSRWEAD

SEQ ID NO: 704251 - protein, 9 aa, Homo Sapiens
KCLQNENAQ

SEQ ID NO: 704252 - protein, 9 aa, Homo Sapiens
NEASLPNRS

SEQ ID NO: 704253 - protein, 9 aa, Homo Sapiens
CREFFSEIA

SEQ ID NO: 704254 - protein, 9 aa, Homo Sapiens
RTENQPKAP

SEQ ID NO: 704255 - protein, 9 aa, Homo Sapiens
SEQGMRDRW

SEQ ID NO: 704256 - protein, 9 aa, Homo Sapiens
QVPVPEPYT

SEQ ID NO: 704257 - protein, 9 aa, Homo Sapiens
CERRKWADL

SEQ ID NO: 704258 - protein, 9 aa, Homo Sapiens
TGLFRRFLC

SEQ ID NO: 704259 - protein, 9 aa, Homo Sapiens
KVTLTAAKA

SEQ ID NO: 704260 - protein, 9 aa, Homo Sapiens
SATELSVVS

SEQ ID NO: 704261 - protein, 9 aa, Homo Sapiens
LHSNVLMDF

SEQ ID NO: 704262 - protein, 9 aa, Homo Sapiens
SNLCGAMHP

SEQ ID NO: 704263 - protein, 9 aa, Homo Sapiens
AWLSHVPSP

SEQ ID NO: 704264 - protein, 9 aa, Homo Sapiens
AQTLDTSTV

SEQ ID NO: 704265 - protein, 9 aa, Homo Sapiens
LSTCASHLT

SEQ ID NO: 704266 - protein, 9 aa, Homo Sapiens
IDKIIKERS

SEQ ID NO: 704267 - protein, 9 aa, Homo Sapiens
GQSDPLLIK

SEQ ID NO: 704268 - protein, 9 aa, Homo Sapiens
QDDFMCSAF

SEQ ID NO: 704269 - protein, 9 aa, Homo Sapiens
EAKPSECKA

SEQ ID NO: 704270 - protein, 9 aa, Homo Sapiens
FVHNNGMLD

SEQ ID NO: 704271 - protein, 9 aa, Homo Sapiens
LSYHKKIQT

SEQ ID NO: 704272 - protein, 9 aa, Homo Sapiens
SCYVLFAVI

SEQ ID NO: 704273 - protein, 9 aa, Homo Sapiens
AEQESAQAE

SEQ ID NO: 704274 - protein, 9 aa, Homo Sapiens
SIDAELQTL

SEQ ID NO: 704275 - protein, 9 aa, Homo Sapiens
LSRVEGNLR

SEQ ID NO: 704276 - protein, 9 aa, Homo Sapiens
RESLGRLSP

SEQ ID NO: 704277 - protein, 9 aa, Homo Sapiens
GMLGSGETN

SEQ ID NO: 704278 - protein, 9 aa, Homo Sapiens
ALNNVDAAV

SEQ ID NO: 704279 - protein, 9 aa, Homo Sapiens
DEDEYVKKR

SEQ ID NO: 704280 - protein, 9 aa, Homo Sapiens
ISVCNNVTW

SEQ ID NO: 704281 - protein, 9 aa, Homo Sapiens
LLIDFITVF

SEQ ID NO: 704282 - protein, 9 aa, Homo Sapiens
ANLHTLSED

SEQ ID NO: 704283 - protein, 9 aa, Homo Sapiens
RQEREGTPC

SEQ ID NO: 704284 - protein, 9 aa, Homo Sapiens
VSGQCSGFG

SEQ ID NO: 704285 - protein, 9 aa, Homo Sapiens
DLATVKANA

SEQ ID NO: 704286 - protein, 9 aa, Homo Sapiens
GTPCAETPA

SEQ ID NO: 704287 - protein, 9 aa, Homo Sapiens
LMIEAVYTD

SEQ ID NO: 704288 - protein, 9 aa, Homo Sapiens
VSAMLLAFV

SEQ ID NO: 704289 - protein, 9 aa, Homo Sapiens
AAVVECERR

SEQ ID NO: 704290 - protein, 9 aa, Homo Sapiens
QTLDTSTVM

SEQ ID NO: 704291 - protein, 9 aa, Homo Sapiens
VMNYFALER

SEQ ID NO: 704292 - protein, 9 aa, Homo Sapiens
RCSPTPTPT

SEQ ID NO: 704293 - protein, 9 aa, Homo Sapiens
TLDSLGHPV

SEQ ID NO: 704294 - protein, 9 aa, Homo Sapiens
HFGLQEQAT

SEQ ID NO: 704295 - protein, 9 aa, Homo Sapiens
RGAWEVRHR

SEQ ID NO: 704296 - protein, 9 aa, Homo Sapiens
MKASPEGKG

SEQ ID NO: 704297 - protein, 9 aa, Homo Sapiens
DDIRELPPW

SEQ ID NO: 704298 - protein, 9 aa, Homo Sapiens
EAWLSHVPS

SEQ ID NO: 704299 - protein, 9 aa, Homo Sapiens
ARCRESLGR

SEQ ID NO: 704300 - protein, 9 aa, Homo Sapiens
SWCWPPWYS

SEQ ID NO: 704301 - protein, 9 aa, Homo Sapiens
RRGAGPQPL

SEQ ID NO: 704302 - protein, 9 aa, Homo Sapiens
ITPMKASPE

SEQ ID NO: 704303 - protein, 9 aa, Homo Sapiens
ATTSLVAPI

SEQ ID NO: 704304 - protein, 9 aa, Homo Sapiens
MKKPMDVYK

SEQ ID NO: 704305 - protein, 9 aa, Homo Sapiens
MAEQELFLL

SEQ ID NO: 704306 - protein, 9 aa, Homo Sapiens
LAFVSINRC

SEQ ID NO: 704307 - protein, 9 aa, Homo Sapiens
VLCELQKTE

SEQ ID NO: 704308 - protein, 9 aa, Homo Sapiens
LQHIEGGSS

SEQ ID NO: 704309 - protein, 9 aa, Homo Sapiens
GLELRPHNH

SEQ ID NO: 704310 - protein, 9 aa, Homo Sapiens
KQNTPHYLA

SEQ ID NO: 704311 - protein, 9 aa, Homo Sapiens
ECKAFENRQ

SEQ ID NO: 704312 - protein, 9 aa, Homo Sapiens
GRTSVVTAA

SEQ ID NO: 704313 - protein, 9 aa, Homo Sapiens
NAKNLHVNG

SEQ ID NO: 704314 - protein, 9 aa, Homo Sapiens
EAAVQKVRA

SEQ ID NO: 704315 - protein, 9 aa, Homo Sapiens
FQIIIAYHG

SEQ ID NO: 704316 - protein, 9 aa, Homo Sapiens
IKKKQSNAS

SEQ ID NO: 704317 - protein, 9 aa, Homo Sapiens
RMLGGPGTA

SEQ ID NO: 704318 - protein, 9 aa, Homo Sapiens
FRWQQRVLS

SEQ ID NO: 704319 - protein, 9 aa, Homo Sapiens
YYAGMSAIL

SEQ ID NO: 704320 - protein, 9 aa, Homo Sapiens
LPTMAPNTA

SEQ ID NO: 704321 - protein, 9 aa, Homo Sapiens
PAILDVEEA

SEQ ID NO: 704322 - protein, 9 aa, Homo Sapiens
LGIFGSTNT

SEQ ID NO: 704323 - protein, 9 aa, Homo Sapiens
SCPFPSPGC

SEQ ID NO: 704324 - protein, 9 aa, Homo Sapiens
HGFYPQYGA

SEQ ID NO: 704325 - protein, 9 aa, Homo Sapiens
RLPGAAQGI

SEQ ID NO: 704326 - protein, 9 aa, Homo Sapiens
HEYMEMCSI

SEQ ID NO: 704327 - protein, 9 aa, Homo Sapiens
YSWMELFSS

SEQ ID NO: 704328 - protein, 9 aa, Homo Sapiens
RLVPGQHFG

SEQ ID NO: 704329 - protein, 9 aa, Homo Sapiens
DAELQTLKE

SEQ ID NO: 704330 - protein, 9 aa, Homo Sapiens
LPRRTSSAG

SEQ ID NO: 704331 - protein, 9 aa, Homo Sapiens
LIIPDNELH

SEQ ID NO: 704332 - protein, 9 aa, Homo Sapiens
HSQAVCILQ

SEQ ID NO: 704333 - protein, 9 aa, Homo Sapiens
SRTLCPLEA

SEQ ID NO: 704334 - protein, 9 aa, Homo Sapiens
MVNLVCDMK

SEQ ID NO: 704335 - protein, 9 aa, Homo Sapiens
YMAPSNTAC

SEQ ID NO: 704336 - protein, 9 aa, Homo Sapiens
CLTRTASWA

SEQ ID NO: 704337 - protein, 9 aa, Homo Sapiens
NYGHCPAPR

SEQ ID NO: 704338 - protein, 9 aa, Homo Sapiens
EHYPMTAQF

SEQ ID NO: 704339 - protein, 9 aa, Homo Sapiens
ASSFSAPSP

SEQ ID NO: 704340 - protein, 9 aa, Homo Sapiens
PNFQIIIAY

SEQ ID NO: 704341 - protein, 9 aa, Homo Sapiens
TNFGPQLKN

SEQ ID NO: 704342 - protein, 9 aa, Homo Sapiens
QKCEVQKKE

SEQ ID NO: 704343 - protein, 9 aa, Homo Sapiens
GIRLFFQIN

SEQ ID NO: 704344 - protein, 9 aa, Homo Sapiens
NASFVTCPT

SEQ ID NO: 704345 - protein, 9 aa, Homo Sapiens
SKIFDKNNT

SEQ ID NO: 704346 - protein, 9 aa, Homo Sapiens
KRSATSTRV

SEQ ID NO: 704347 - protein, 9 aa, Homo Sapiens
REAMSDCTG

SEQ ID NO: 704348 - protein, 9 aa, Homo Sapiens
WPDLPTMAP

SEQ ID NO: 704349 - protein, 9 aa, Homo Sapiens
CSIKRGLDV

SEQ ID NO: 704350 - protein, 9 aa, Homo Sapiens
QAPKAKLHA

SEQ ID NO: 704351 - protein, 9 aa, Homo Sapiens
KIIIVKWMM

SEQ ID NO: 704352 - protein, 9 aa, Homo Sapiens
SFPETLMEI

SEQ ID NO: 704353 - protein, 9 aa, Homo Sapiens
GEEQEEESS

SEQ ID NO: 704354 - protein, 9 aa, Homo Sapiens
YKDEYLKKT

SEQ ID NO: 704355 - protein, 9 aa, Homo Sapiens
RTDICFPLQ

SEQ ID NO: 704356 - protein, 9 aa, Homo Sapiens
LTLSGMFVY

SEQ ID NO: 704357 - protein, 9 aa, Homo Sapiens
TTTNLGVTT

SEQ ID NO: 704358 - protein, 9 aa, Homo Sapiens
IQSQQQEVI

SEQ ID NO: 704359 - protein, 9 aa, Homo Sapiens
YVGAVSYRL

SEQ ID NO: 704360 - protein, 9 aa, Homo Sapiens
HLACANGHV

SEQ ID NO: 704361 - protein, 9 aa, Homo Sapiens
KEWYKRALQ

SEQ ID NO: 704362 - protein, 9 aa, Homo Sapiens
QRGGRGGRG

SEQ ID NO: 704363 - protein, 9 aa, Homo Sapiens
PPVEAGAGS

SEQ ID NO: 704364 - protein, 9 aa, Homo Sapiens
TLSCDSPAP

SEQ ID NO: 704365 - protein, 9 aa, Homo Sapiens
APCVSYVGA

SEQ ID NO: 704366 - protein, 9 aa, Homo Sapiens
IASQGMGNV

SEQ ID NO: 704367 - protein, 9 aa, Homo Sapiens
MNDARHGGW

SEQ ID NO: 704368 - protein, 9 aa, Homo Sapiens
MTNPPASSF

SEQ ID NO: 704369 - protein, 9 aa, Homo Sapiens
CSPTPTPTS

SEQ ID NO: 704370 - protein, 9 aa, Homo Sapiens
ITNINTRMF

SEQ ID NO: 704371 - protein, 9 aa, Homo Sapiens
SNASFHSQA

SEQ ID NO: 704372 - protein, 9 aa, Homo Sapiens
GLLSCLLAM

SEQ ID NO: 704373 - protein, 9 aa, Homo Sapiens
RSSGSLPNN

SEQ ID NO: 704374 - protein, 9 aa, Homo Sapiens
FVSINRCLQ

SEQ ID NO: 704375 - protein, 9 aa, Homo Sapiens
CNNVTWAIG

SEQ ID NO: 704376 - protein, 9 aa, Homo Sapiens
PFPLARYNR

SEQ ID NO: 704377 - protein, 9 aa, Homo Sapiens
IPYEAATYS

SEQ ID NO: 704378 - protein, 9 aa, Homo Sapiens
NKRRYLHNR

SEQ ID NO: 704379 - protein, 9 aa, Homo Sapiens
PNNAIKGGV

SEQ ID NO: 704380 - protein, 9 aa, Homo Sapiens
ALREIRRYH

SEQ ID NO: 704381 - protein, 9 aa, Homo Sapiens
LQLFEAERN

SEQ ID NO: 704382 - protein, 9 aa, Homo Sapiens
MAEREIVRG

SEQ ID NO: 704383 - protein, 9 aa, Homo Sapiens
FSSLCSSRP

SEQ ID NO: 704384 - protein, 9 aa, Homo Sapiens
ILKSPILHK

SEQ ID NO: 704385 - protein, 9 aa, Homo Sapiens
SDPLLIKGG

SEQ ID NO: 704386 - protein, 9 aa, Homo Sapiens
RLVQFICAD

SEQ ID NO: 704387 - protein, 9 aa, Homo Sapiens
IEARALENA

SEQ ID NO: 704388 - protein, 9 aa, Homo Sapiens
DLVFEQQEY

SEQ ID NO: 704389 - protein, 9 aa, Homo Sapiens
STGPCGRRS

SEQ ID NO: 704390 - protein, 9 aa, Homo Sapiens
TTPDHGCFC

SEQ ID NO: 704391 - protein, 9 aa, Homo Sapiens
YIIRKDTWV

SEQ ID NO: 704392 - protein, 9 aa, Homo Sapiens
IDIYADQEF

SEQ ID NO: 704393 - protein, 9 aa, Homo Sapiens
IDAELQTLK

SEQ ID NO: 704394 - protein, 9 aa, Homo Sapiens
KNSGSYASH

SEQ ID NO: 704395 - protein, 9 aa, Homo Sapiens
DMKKPMDVY

SEQ ID NO: 704396 - protein, 9 aa, Homo Sapiens
DEHESPITF

SEQ ID NO: 704397 - protein, 9 aa, Homo Sapiens
HSKSFWTRI

SEQ ID NO: 704398 - protein, 9 aa, Homo Sapiens
NLDYYAGMS

SEQ ID NO: 704399 - protein, 9 aa, Homo Sapiens
TNLGVTTSV

SEQ ID NO: 704400 - protein, 9 aa, Homo Sapiens
EEMAEQELF

SEQ ID NO: 704401 - protein, 9 aa, Homo Sapiens
WCWPPWYSW

SEQ ID NO: 704402 - protein, 9 aa, Homo Sapiens
LYGSMLFLT

SEQ ID NO: 704403 - protein, 9 aa, Homo Sapiens
KWMMKDVFF

SEQ ID NO: 704404 - protein, 9 aa, Homo Sapiens
SSYRRMLGG

SEQ ID NO: 704405 - protein, 9 aa, Homo Sapiens
QHLLTCAFE

SEQ ID NO: 704406 - protein, 9 aa, Homo Sapiens
QNIILKNYK

SEQ ID NO: 704407 - protein, 9 aa, Homo Sapiens
IAEEQLFQE

SEQ ID NO: 704408 - protein, 9 aa, Homo Sapiens
YHQPLQVFT

SEQ ID NO: 704409 - protein, 9 aa, Homo Sapiens
ASTPTGISS

SEQ ID NO: 704410 - protein, 9 aa, Homo Sapiens
HPPLSAEVL

SEQ ID NO: 704411 - protein, 9 aa, Homo Sapiens
EEQLFQEKK

SEQ ID NO: 704412 - protein, 9 aa, Homo Sapiens
LSSFECFEE

SEQ ID NO: 704413 - protein, 9 aa, Homo Sapiens
HSAYSYCGH

SEQ ID NO: 704414 - protein, 9 aa, Homo Sapiens
ICFPLQLST

SEQ ID NO: 704415 - protein, 9 aa, Homo Sapiens
QNENAQLVN

SEQ ID NO: 704416 - protein, 9 aa, Homo Sapiens
HLTAVSVFY

SEQ ID NO: 704417 - protein, 9 aa, Homo Sapiens
DPLLIKGGR

SEQ ID NO: 704418 - protein, 9 aa, Homo Sapiens
PCRCSPTPT

SEQ ID NO: 704419 - protein, 9 aa, Homo Sapiens
IMGGVNKHS

SEQ ID NO: 704420 - protein, 9 aa, Homo Sapiens
RMEGGCCRA

SEQ ID NO: 704421 - protein, 9 aa, Homo Sapiens
HGIDAYLQL

SEQ ID NO: 704422 - protein, 9 aa, Homo Sapiens
VSILVTSIF

SEQ ID NO: 704423 - protein, 9 aa, Homo Sapiens
CQRYKNLKV

SEQ ID NO: 704424 - protein, 9 aa, Homo Sapiens
CRTLSCDSP

SEQ ID NO: 704425 - protein, 9 aa, Homo Sapiens
SWWPPCRCS

SEQ ID NO: 704426 - protein, 9 aa, Homo Sapiens
YIAPLLEKL

SEQ ID NO: 704427 - protein, 9 aa, Homo Sapiens
YKRSERIER

SEQ ID NO: 704428 - protein, 9 aa, Homo Sapiens
MRVALFASG

SEQ ID NO: 704429 - protein, 9 aa, Homo Sapiens
TAASAPNAV

SEQ ID NO: 704430 - protein, 9 aa, Homo Sapiens
AASAPNAVW

SEQ ID NO: 704431 - protein, 9 aa, Homo Sapiens
YGHCPAPRP

SEQ ID NO: 704432 - protein, 9 aa, Homo Sapiens
HLLTCAFED

SEQ ID NO: 704433 - protein, 9 aa, Homo Sapiens
YVFLGAVRE

SEQ ID NO: 704434 - protein, 9 aa, Homo Sapiens
TLQTIMGGV

SEQ ID NO: 704435 - protein, 9 aa, Homo Sapiens
SQKCEVQKK

SEQ ID NO: 704436 - protein, 9 aa, Homo Sapiens
SPSYPDKRS

SEQ ID NO: 704437 - protein, 9 aa, Homo Sapiens
APLITESVL

SEQ ID NO: 704438 - protein, 9 aa, Homo Sapiens
GNVCGRSNE

SEQ ID NO: 704439 - protein, 9 aa, Homo Sapiens
VMSPQESFK

SEQ ID NO: 704440 - protein, 9 aa, Homo Sapiens
GHDWCFLRL

SEQ ID NO: 704441 - protein, 9 aa, Homo Sapiens
EGEEEGEEQ

SEQ ID NO: 704442 - protein, 9 aa, Homo Sapiens
AADLLLIIP

SEQ ID NO: 704443 - protein, 9 aa, Homo Sapiens
EAATYSLNV

SEQ ID NO: 704444 - protein, 9 aa, Homo Sapiens
DPEPLGRLG

SEQ ID NO: 704445 - protein, 9 aa, Homo Sapiens
GQAFLGGLA

SEQ ID NO: 704446 - protein, 9 aa, Homo Sapiens
VVVAVGFLG

SEQ ID NO: 704447 - protein, 9 aa, Homo Sapiens
FFPASADRA

SEQ ID NO: 704448 - protein, 9 aa, Homo Sapiens
LLGMLSIGS

SEQ ID NO: 704449 - protein, 9 aa, Homo Sapiens
GEENLDYYA

SEQ ID NO: 704450 - protein, 9 aa, Homo Sapiens
YFALERNPS

SEQ ID NO: 704451 - protein, 9 aa, Homo Sapiens
KLYQEIILY

SEQ ID NO: 704452 - protein, 9 aa, Homo Sapiens
PNRILIYNF

SEQ ID NO: 704453 - protein, 9 aa, Homo Sapiens
YPMTAQFSS

SEQ ID NO: 704454 - protein, 9 aa, Homo Sapiens
NFCSLLFAA

SEQ ID NO: 704455 - protein, 9 aa, Homo Sapiens
SYRRMLGGP

SEQ ID NO: 704456 - protein, 9 aa, Homo Sapiens
FSKGEKKDT

SEQ ID NO: 704457 - protein, 9 aa, Homo Sapiens
DEYVKKRRE

SEQ ID NO: 704458 - protein, 9 aa, Homo Sapiens
SLSGPHLVT

SEQ ID NO: 704459 - protein, 9 aa, Homo Sapiens
QSNASFHSQ

SEQ ID NO: 704460 - protein, 9 aa, Homo Sapiens
AFRSDNCFS

SEQ ID NO: 704461 - protein, 9 aa, Homo Sapiens
YDKSKNSGL

SEQ ID NO: 704462 - protein, 9 aa, Homo Sapiens
FGDNDSRRG

SEQ ID NO: 704463 - protein, 9 aa, Homo Sapiens
ITESVLEVV

SEQ ID NO: 704464 - protein, 9 aa, Homo Sapiens
PIDIDKIIK

SEQ ID NO: 704465 - protein, 9 aa, Homo Sapiens
DYRELIDAL

SEQ ID NO: 704466 - protein, 9 aa, Homo Sapiens
TKNSGSYAS

SEQ ID NO: 704467 - protein, 9 aa, Homo Sapiens
YCCSCCRLE

SEQ ID NO: 704468 - protein, 9 aa, Homo Sapiens
HLCIIICLL

SEQ ID NO: 704469 - protein, 9 aa, Homo Sapiens
ILMKQTWHS

SEQ ID NO: 704470 - protein, 9 aa, Homo Sapiens
CGIRLFFQI

SEQ ID NO: 704471 - protein, 9 aa, Homo Sapiens
VNFFSPAPD

SEQ ID NO: 704472 - protein, 9 aa, Homo Sapiens
TNPSVIQSY

SEQ ID NO: 704473 - protein, 9 aa, Homo Sapiens
ILHKPPGEL

SEQ ID NO: 704474 - protein, 9 aa, Homo Sapiens
FYLSPHTST

SEQ ID NO: 704475 - protein, 9 aa, Homo Sapiens
CGVSEVFLL

SEQ ID NO: 704476 - protein, 9 aa, Homo Sapiens
VPCEGTANA

SEQ ID NO: 704477 - protein, 9 aa, Homo Sapiens
AINHLFCDI

SEQ ID NO: 704478 - protein, 9 aa, Homo Sapiens
FNLCFIKNI

SEQ ID NO: 704479 - protein, 9 aa, Homo Sapiens
PVPEPYTYN

SEQ ID NO: 704480 - protein, 9 aa, Homo Sapiens
WPPCRCSPT

SEQ ID NO: 704481 - protein, 9 aa, Homo Sapiens
VRVSILVTS

SEQ ID NO: 704482 - protein, 9 aa, Homo Sapiens
LLLLKLVVS

SEQ ID NO: 704483 - protein, 9 aa, Homo Sapiens
PGCQLAEVH

SEQ ID NO: 704484 - protein, 9 aa, Homo Sapiens
PTVPPLGVD

SEQ ID NO: 704485 - protein, 9 aa, Homo Sapiens
VQKGVVKEE

SEQ ID NO: 704486 - protein, 9 aa, Homo Sapiens
NQSLESEQG

SEQ ID NO: 704487 - protein, 9 aa, Homo Sapiens
ESKRLRPED

SEQ ID NO: 704488 - protein, 9 aa, Homo Sapiens
KFLYSVALT

SEQ ID NO: 704489 - protein, 9 aa, Homo Sapiens
SSSCRRPIK

SEQ ID NO: 704490 - protein, 9 aa, Homo Sapiens
AAGTCKKTF

SEQ ID NO: 704491 - protein, 9 aa, Homo Sapiens
VTLTAAKAL

SEQ ID NO: 704492 - protein, 9 aa, Homo Sapiens
GAAGTCKKT

SEQ ID NO: 704493 - protein, 9 aa, Homo Sapiens
HNTWAGSKE

SEQ ID NO: 704494 - protein, 9 aa, Homo Sapiens
KTKLNQLPS

SEQ ID NO: 704495 - protein, 9 aa, Homo Sapiens
SVLEVVRKY

SEQ ID NO: 704496 - protein, 9 aa, Homo Sapiens
MITPKSKRK

SEQ ID NO: 704497 - protein, 9 aa, Homo Sapiens
HPGYRSPTT

SEQ ID NO: 704498 - protein, 9 aa, Homo Sapiens
VALFASGCS

SEQ ID NO: 704499 - protein, 9 aa, Homo Sapiens
LYSVALTRK

SEQ ID NO: 704500 - protein, 9 aa, Homo Sapiens
ARSAATPTS

SEQ ID NO: 704501 - protein, 9 aa, Homo Sapiens
ECERRKWAD

SEQ ID NO: 704502 - protein, 9 aa, Homo Sapiens
AATYSLNVT

SEQ ID NO: 704503 - protein, 9 aa, Homo Sapiens
LKSPILHKP

SEQ ID NO: 704504 - protein, 9 aa, Homo Sapiens
TSQKCEVQK

SEQ ID NO: 704505 - protein, 9 aa, Homo Sapiens
HWVVMNSRL

SEQ ID NO: 704506 - protein, 9 aa, Homo Sapiens
RAGRQRRGP

SEQ ID NO: 704507 - protein, 9 aa, Homo Sapiens
FTVNPKREL

SEQ ID NO: 704508 - protein, 9 aa, Homo Sapiens
NLMLNGKPI

SEQ ID NO: 704509 - protein, 9 aa, Homo Sapiens
VVSHLCIII

SEQ ID NO: 704510 - protein, 9 aa, Homo Sapiens
QGLTLAACC

SEQ ID NO: 704511 - protein, 9 aa, Homo Sapiens
KEDEDEYVK

SEQ ID NO: 704512 - protein, 9 aa, Homo Sapiens
CLRVPALQV

SEQ ID NO: 704513 - protein, 9 aa, Homo Sapiens
YTALCVLGT

SEQ ID NO: 704514 - protein, 9 aa, Homo Sapiens
EILSCEGAG

SEQ ID NO: 704515 - protein, 9 aa, Homo Sapiens
SPPTVPPLG

SEQ ID NO: 704516 - protein, 9 aa, Homo Sapiens
RGIAEEQLF

SEQ ID NO: 704517 - protein, 9 aa, Homo Sapiens
HSGNLTTDS

SEQ ID NO: 704518 - protein, 9 aa, Homo Sapiens
AEFIKNKFS

SEQ ID NO: 704519 - protein, 9 aa, Homo Sapiens
LIDFITVFG

SEQ ID NO: 704520 - protein, 9 aa, Homo Sapiens
TAGSWWPPC

SEQ ID NO: 704521 - protein, 9 aa, Homo Sapiens
IRRYHKSTE

SEQ ID NO: 704522 - protein, 9 aa, Homo Sapiens
HPGPAAQPS

SEQ ID NO: 704523 - protein, 9 aa, Homo Sapiens
GQHFGLQEQ

SEQ ID NO: 704524 - protein, 9 aa, Homo Sapiens
KQGRFSYAH

SEQ ID NO: 704525 - protein, 9 aa, Homo Sapiens
KTFNVYYLE

SEQ ID NO: 704526 - protein, 9 aa, Homo Sapiens
KQMNDARHG

SEQ ID NO: 704527 - protein, 9 aa, Homo Sapiens
LLGLLVNRE

SEQ ID NO: 704528 - protein, 9 aa, Homo Sapiens
GVLHGQCWE

SEQ ID NO: 704529 - protein, 9 aa, Homo Sapiens
RSQHNTWAG

SEQ ID NO: 704530 - protein, 9 aa, Homo Sapiens
LQQSSGWID

SEQ ID NO: 704531 - protein, 9 aa, Homo Sapiens
RQMEQFPVK

SEQ ID NO: 704532 - protein, 9 aa, Homo Sapiens
MLDPTKPPC

SEQ ID NO: 704533 - protein, 9 aa, Homo Sapiens
GAHAAVGDL

SEQ ID NO: 704534 - protein, 9 aa, Homo Sapiens
SYGATSQKC

SEQ ID NO: 704535 - protein, 9 aa, Homo Sapiens
CHHQPRHRS

SEQ ID NO: 704536 - protein, 9 aa, Homo Sapiens
RTVLFSFYL

SEQ ID NO: 704537 - protein, 9 aa, Homo Sapiens
ETARVVFIK

SEQ ID NO: 704538 - protein, 9 aa, Homo Sapiens
AATTPDHGC

SEQ ID NO: 704539 - protein, 9 aa, Homo Sapiens
RAFANRKLN

SEQ ID NO: 704540 - protein, 9 aa, Homo Sapiens
EEAWTETEK

SEQ ID NO: 704541 - protein, 9 aa, Homo Sapiens
GEKGEPGND

SEQ ID NO: 704542 - protein, 9 aa, Homo Sapiens
GDYRELIDA

SEQ ID NO: 704543 - protein, 9 aa, Homo Sapiens
YGPISDVSI

SEQ ID NO: 704544 - protein, 9 aa, Homo Sapiens
PSVPHPPPP

SEQ ID NO: 704545 - protein, 9 aa, Homo Sapiens
QTLKEMTNH

SEQ ID NO: 704546 - protein, 9 aa, Homo Sapiens
EMCSIKRGL

SEQ ID NO: 704547 - protein, 9 aa, Homo Sapiens
GISSSCRRP

SEQ ID NO: 704548 - protein, 9 aa, Homo Sapiens
LGRRVGVLH

SEQ ID NO: 704549 - protein, 9 aa, Homo Sapiens
NIPDLFCGL

SEQ ID NO: 704550 - protein, 9 aa, Homo Sapiens
TTGKGWGIR

SEQ ID NO: 704551 - protein, 9 aa, Homo Sapiens
WEKTFNIDL

SEQ ID NO: 704552 - protein, 9 aa, Homo Sapiens
LEPEDFSAV

SEQ ID NO: 704553 - protein, 9 aa, Homo Sapiens
MGNVCGRSN

SEQ ID NO: 704554 - protein, 9 aa, Homo Sapiens
SDNCFSFFV

SEQ ID NO: 704555 - protein, 9 aa, Homo Sapiens
VRLPGAAQG

SEQ ID NO: 704556 - protein, 9 aa, Homo Sapiens
PGWLSLLLW

SEQ ID NO: 704557 - protein, 9 aa, Homo Sapiens
IPPGIEKGA

SEQ ID NO: 704558 - protein, 9 aa, Homo Sapiens
LTTDSLRNK

SEQ ID NO: 704559 - protein, 9 aa, Homo Sapiens
GSAEIVATK

SEQ ID NO: 704560 - protein, 9 aa, Homo Sapiens
VIGMELKDM

SEQ ID NO: 704561 - protein, 9 aa, Homo Sapiens
QSMKQTKLE

SEQ ID NO: 704562 - protein, 9 aa, Homo Sapiens
YHGIDAYLQ

SEQ ID NO: 704563 - protein, 9 aa, Homo Sapiens
SRKRKAPPV

SEQ ID NO: 704564 - protein, 9 aa, Homo Sapiens
LGLLVNREA

SEQ ID NO: 704565 - protein, 9 aa, Homo Sapiens
PMKASPEGK

SEQ ID NO: 704566 - protein, 9 aa, Homo Sapiens
LGEQCSAIP

SEQ ID NO: 704567 - protein, 9 aa, Homo Sapiens
CKEVLCWEQ

SEQ ID NO: 704568 - protein, 9 aa, Homo Sapiens
KAQAQPVQL

SEQ ID NO: 704569 - protein, 9 aa, Homo Sapiens
TRYGVIPRS

SEQ ID NO: 704570 - protein, 9 aa, Homo Sapiens
LENADASTN

SEQ ID NO: 704571 - protein, 9 aa, Homo Sapiens
TFSTVPLTP

SEQ ID NO: 704572 - protein, 9 aa, Homo Sapiens
EQESAQAEN

SEQ ID NO: 704573 - protein, 9 aa, Homo Sapiens
RRFLCSRFP

SEQ ID NO: 704574 - protein, 9 aa, Homo Sapiens
CIHRNWDKF

SEQ ID NO: 704575 - protein, 9 aa, Homo Sapiens
LLRLVQFIC

SEQ ID NO: 704576 - protein, 9 aa, Homo Sapiens
TSVVTAATA

SEQ ID NO: 704577 - protein, 9 aa, Homo Sapiens
AAPCVSYVG

SEQ ID NO: 704578 - protein, 9 aa, Homo Sapiens
DHPPSSVIS

SEQ ID NO: 704579 - protein, 9 aa, Homo Sapiens
EDDNDDEAP

SEQ ID NO: 704580 - protein, 9 aa, Homo Sapiens
HRMPAILDV

SEQ ID NO: 704581 - protein, 9 aa, Homo Sapiens
LGQQIDNLQ

SEQ ID NO: 704582 - protein, 9 aa, Homo Sapiens
VLSVKFDDI

SEQ ID NO: 704583 - protein, 9 aa, Homo Sapiens
MAAPCVSYV

SEQ ID NO: 704584 - protein, 9 aa, Homo Sapiens
VKEEKITIV

SEQ ID NO: 704585 - protein, 9 aa, Homo Sapiens
YLTFHLGSM

SEQ ID NO: 704586 - protein, 9 aa, Homo Sapiens
ILFRDDDKW

SEQ ID NO: 704587 - protein, 9 aa, Homo Sapiens
CSSSRRTAA

SEQ ID NO: 704588 - protein, 9 aa, Homo Sapiens
CDIFHPEQK

SEQ ID NO: 704589 - protein, 9 aa, Homo Sapiens
MLLLGLWMG

SEQ ID NO: 704590 - protein, 9 aa, Homo Sapiens
VVLLIRGVR

SEQ ID NO: 704591 - protein, 9 aa, Homo Sapiens
DQKHHSAAK

SEQ ID NO: 704592 - protein, 9 aa, Homo Sapiens
LPGPTRVQG

SEQ ID NO: 704593 - protein, 9 aa, Homo Sapiens
LCRTLSCDS

SEQ ID NO: 704594 - protein, 9 aa, Homo Sapiens
INRCLQLTH

SEQ ID NO: 704595 - protein, 9 aa, Homo Sapiens
VPTAASAPN

SEQ ID NO: 704596 - protein, 9 aa, Homo Sapiens
STRLGEQCS

SEQ ID NO: 704597 - protein, 9 aa, Homo Sapiens
DTQGSLDLY

SEQ ID NO: 704598 - protein, 9 aa, Homo Sapiens
RSTSFPSAT

SEQ ID NO: 704599 - protein, 9 aa, Homo Sapiens
QLRKMESSI

SEQ ID NO: 704600 - protein, 9 aa, Homo Sapiens
KRRKVAQIT

SEQ ID NO: 704601 - protein, 9 aa, Homo Sapiens
GRSFSQREA

SEQ ID NO: 704602 - protein, 9 aa, Homo Sapiens
ANGKTSVGT

SEQ ID NO: 704603 - protein, 9 aa, Homo Sapiens
RVALFASGC

SEQ ID NO: 704604 - protein, 9 aa, Homo Sapiens
REHRKAHGR

SEQ ID NO: 704605 - protein, 9 aa, Homo Sapiens
EGNIMHFHQ

SEQ ID NO: 704606 - protein, 9 aa, Homo Sapiens
ASHLTAVSV

SEQ ID NO: 704607 - protein, 9 aa, Homo Sapiens
SFKRPFPLA

SEQ ID NO: 704608 - protein, 9 aa, Homo Sapiens
DFEDGAFEG

SEQ ID NO: 704609 - protein, 9 aa, Homo Sapiens
SVCNNVTWA

SEQ ID NO: 704610 - protein, 9 aa, Homo Sapiens
LGVDGVSAY

SEQ ID NO: 704611 - protein, 9 aa, Homo Sapiens
SFYEKRALY

SEQ ID NO: 704612 - protein, 9 aa, Homo Sapiens
RAEQESAQA

SEQ ID NO: 704613 - protein, 9 aa, Homo Sapiens
SSSRRTAAR

SEQ ID NO: 704614 - protein, 9 aa, Homo Sapiens
SFMTLLFLT

SEQ ID NO: 704615 - protein, 9 aa, Homo Sapiens
LIDIYADQE

SEQ ID NO: 704616 - protein, 9 aa, Homo Sapiens
SFEIEARAL

SEQ ID NO: 704617 - protein, 9 aa, Homo Sapiens
AYFTMMDKD

SEQ ID NO: 704618 - protein, 9 aa, Homo Sapiens
KPAISKRDE

SEQ ID NO: 704619 - protein, 9 aa, Homo Sapiens
VVMNSRLNG

SEQ ID NO: 704620 - protein, 9 aa, Homo Sapiens
EHPPLSAEV

SEQ ID NO: 704621 - protein, 9 aa, Homo Sapiens
EVQKGVVKE

SEQ ID NO: 704622 - protein, 9 aa, Homo Sapiens
SSTGPCGRR

SEQ ID NO: 704623 - protein, 9 aa, Homo Sapiens
YHKSTELLI

SEQ ID NO: 704624 - protein, 9 aa, Homo Sapiens
IIRKDTWVE

SEQ ID NO: 704625 - protein, 9 aa, Homo Sapiens
PRAINHLFC

SEQ ID NO: 704626 - protein, 9 aa, Homo Sapiens
QIIIAYHGG

SEQ ID NO: 704627 - protein, 9 aa, Homo Sapiens
HMRTNKFWP

SEQ ID NO: 704628 - protein, 9 aa, Homo Sapiens
LQLSTLTPL

SEQ ID NO: 704629 - protein, 9 aa, Homo Sapiens
VNIPDLFCG

SEQ ID NO: 704630 - protein, 9 aa, Homo Sapiens
YADVSRLLL

SEQ ID NO: 704631 - protein, 9 aa, Homo Sapiens
VFSKYGPIS

SEQ ID NO: 704632 - protein, 9 aa, Homo Sapiens
SDLESCSSS

SEQ ID NO: 704633 - protein, 9 aa, Homo Sapiens
LEATNETGP

SEQ ID NO: 704634 - protein, 9 aa, Homo Sapiens
AGSGSDLES

SEQ ID NO: 704635 - protein, 9 aa, Homo Sapiens
LGENSMAKE

SEQ ID NO: 704636 - protein, 9 aa, Homo Sapiens
QKAVRVSIL

SEQ ID NO: 704637 - protein, 9 aa, Homo Sapiens
GTSQTGTSQ

SEQ ID NO: 704638 - protein, 9 aa, Homo Sapiens
RASAVSKCP

SEQ ID NO: 704639 - protein, 9 aa, Homo Sapiens
VPFLMHYFD

SEQ ID NO: 704640 - protein, 9 aa, Homo Sapiens
DVEEAVSKW

SEQ ID NO: 704641 - protein, 9 aa, Homo Sapiens
CSGFGHKSG

SEQ ID NO: 704642 - protein, 9 aa, Homo Sapiens
EKRALYLEA

SEQ ID NO: 704643 - protein, 9 aa, Homo Sapiens
HSSERASSS

SEQ ID NO: 704644 - protein, 9 aa, Homo Sapiens
MFDYDKSKN

SEQ ID NO: 704645 - protein, 9 aa, Homo Sapiens
PAKASVSVT

SEQ ID NO: 704646 - protein, 9 aa, Homo Sapiens
SLPRNVSAW

SEQ ID NO: 704647 - protein, 9 aa, Homo Sapiens
AETHKLSVA

SEQ ID NO: 704648 - protein, 9 aa, Homo Sapiens
PKPHRFKRG

SEQ ID NO: 704649 - protein, 9 aa, Homo Sapiens
AQAKVYKKR

SEQ ID NO: 704650 - protein, 9 aa, Homo Sapiens
GLEVYVFLG

SEQ ID NO: 704651 - protein, 9 aa, Homo Sapiens
QPYLNFRNP

SEQ ID NO: 704652 - protein, 9 aa, Homo Sapiens
RAYLLLELG

SEQ ID NO: 704653 - protein, 9 aa, Homo Sapiens
TASWASSTG

SEQ ID NO: 704654 - protein, 9 aa, Homo Sapiens
IRQTGKKLL

SEQ ID NO: 704655 - protein, 9 aa, Homo Sapiens
RSKIFDKNN

SEQ ID NO: 704656 - protein, 9 aa, Homo Sapiens
PHFFMGYYW

SEQ ID NO: 704657 - protein, 9 aa, Homo Sapiens
FRQKIHDYM

SEQ ID NO: 704658 - protein, 9 aa, Homo Sapiens
RSMSTAFCS

SEQ ID NO: 704659 - protein, 9 aa, Homo Sapiens
PYDLQHIEG

SEQ ID NO: 704660 - protein, 9 aa, Homo Sapiens
ISSSCRRPI

SEQ ID NO: 704661 - protein, 9 aa, Homo Sapiens
CRLSSLGYK

SEQ ID NO: 704662 - protein, 9 aa, Homo Sapiens
LGSGETNFG

SEQ ID NO: 704663 - protein, 9 aa, Homo Sapiens
VYKKRDKIE

SEQ ID NO: 704664 - protein, 9 aa, Homo Sapiens
PTTRRKGPP

SEQ ID NO: 704665 - protein, 9 aa, Homo Sapiens
VMNSRLNGA

SEQ ID NO: 704666 - protein, 9 aa, Homo Sapiens
DQLQTNYDS

SEQ ID NO: 704667 - protein, 9 aa, Homo Sapiens
YRAALQYLG

SEQ ID NO: 704668 - protein, 9 aa, Homo Sapiens
HHQPRHRSL

SEQ ID NO: 704669 - protein, 9 aa, Homo Sapiens
TLCPLEATN

SEQ ID NO: 704670 - protein, 9 aa, Homo Sapiens
PEKEENENS

SEQ ID NO: 704671 - protein, 9 aa, Homo Sapiens
DRTCARCRE

SEQ ID NO: 704672 - protein, 9 aa, Homo Sapiens
NCKTMWNRW

SEQ ID NO: 704673 - protein, 9 aa, Homo Sapiens
ATGAGNTIR

SEQ ID NO: 704674 - protein, 9 aa, Homo Sapiens
KLLLVTVRK

SEQ ID NO: 704675 - protein, 9 aa, Homo Sapiens
GGGFQNRTV

SEQ ID NO: 704676 - protein, 9 aa, Homo Sapiens
IISAFAGDK

SEQ ID NO: 704677 - protein, 9 aa, Homo Sapiens
LMHYFDLKR

SEQ ID NO: 704678 - protein, 9 aa, Homo Sapiens
RKDTWVEHW

SEQ ID NO: 704679 - protein, 9 aa, Homo Sapiens
PRPPALRPR

SEQ ID NO: 704680 - protein, 9 aa, Homo Sapiens
HQSLYQSQK

SEQ ID NO: 704681 - protein, 9 aa, Homo Sapiens
GDKLQKIPE

SEQ ID NO: 704682 - protein, 9 aa, Homo Sapiens
EQVLGDYRE

SEQ ID NO: 704683 - protein, 9 aa, Homo Sapiens
SSRPGCSQR

SEQ ID NO: 704684 - protein, 9 aa, Homo Sapiens
RPRPPQLRG

SEQ ID NO: 704685 - protein, 9 aa, Homo Sapiens
NDHDLVFEQ

SEQ ID NO: 704686 - protein, 9 aa, Homo Sapiens
TLEGKYIMS

SEQ ID NO: 704687 - protein, 9 aa, Homo Sapiens
LSDETCQRY

SEQ ID NO: 704688 - protein, 9 aa, Homo Sapiens
MECLRVPAL

SEQ ID NO: 704689 - protein, 9 aa, Homo Sapiens
MCSIKRGLD

SEQ ID NO: 704690 - protein, 9 aa, Homo Sapiens
FGNCKTMWN

SEQ ID NO: 704691 - protein, 9 aa, Homo Sapiens
SGRDSPPST

SEQ ID NO: 704692 - protein, 9 aa, Homo Sapiens
LFRDDDKWS

SEQ ID NO: 704693 - protein, 9 aa, Homo Sapiens
NVMAPPTPI

SEQ ID NO: 704694 - protein, 9 aa, Homo Sapiens
IPKPLNAKN

SEQ ID NO: 704695 - protein, 9 aa, Homo Sapiens
TNITPMKAS

SEQ ID NO: 704696 - protein, 9 aa, Homo Sapiens
LYHQPLQVF

SEQ ID NO: 704697 - protein, 9 aa, Homo Sapiens
TNTVTLPET

SEQ ID NO: 704698 - protein, 9 aa, Homo Sapiens
LLTVNKLSY

SEQ ID NO: 704699 - protein, 9 aa, Homo Sapiens
LEGAIAQQL

SEQ ID NO: 704700 - protein, 9 aa, Homo Sapiens
QHLLKENKR

SEQ ID NO: 704701 - protein, 9 aa, Homo Sapiens
RGTSTETVL

SEQ ID NO: 704702 - protein, 9 aa, Homo Sapiens
YKKRDKIER

SEQ ID NO: 704703 - protein, 9 aa, Homo Sapiens
RRHSSERAS

SEQ ID NO: 704704 - protein, 9 aa, Homo Sapiens
IKNKFSFNL

SEQ ID NO: 704705 - protein, 9 aa, Homo Sapiens
EYNFVSHSK

SEQ ID NO: 704706 - protein, 9 aa, Homo Sapiens
FEVLKGHAD

SEQ ID NO: 704707 - protein, 9 aa, Homo Sapiens
TFNIDLFRP

SEQ ID NO: 704708 - protein, 9 aa, Homo Sapiens
VLNANISGG

SEQ ID NO: 704709 - protein, 9 aa, Homo Sapiens
ESAQRTDFW

SEQ ID NO: 704710 - protein, 9 aa, Homo Sapiens
STRVDKCTR

SEQ ID NO: 704711 - protein, 9 aa, Homo Sapiens
LYRKPILSP

SEQ ID NO: 704712 - protein, 9 aa, Homo Sapiens
TTKGVCLGM

SEQ ID NO: 704713 - protein, 9 aa, Homo Sapiens
CSAYYEADC

SEQ ID NO: 704714 - protein, 9 aa, Homo Sapiens
TKYQAYNVS

SEQ ID NO: 704715 - protein, 9 aa, Homo Sapiens
CRMEGGCCR

SEQ ID NO: 704716 - protein, 9 aa, Homo Sapiens
NRSLQGKKM

SEQ ID NO: 704717 - protein, 9 aa, Homo Sapiens
GYFSQLQEE

SEQ ID NO: 704718 - protein, 9 aa, Homo Sapiens
DSVAELGQQ

SEQ ID NO: 704719 - protein, 9 aa, Homo Sapiens
MFLITTNPY

SEQ ID NO: 704720 - protein, 9 aa, Homo Sapiens
ANRKLNLTE

SEQ ID NO: 704721 - protein, 9 aa, Homo Sapiens
LKFLGDASE

SEQ ID NO: 704722 - protein, 9 aa, Homo Sapiens
YRRPLRPGT

SEQ ID NO: 704723 - protein, 9 aa, Homo Sapiens
GSVSGQCSG

SEQ ID NO: 704724 - protein, 9 aa, Homo Sapiens
AKMGRRAEQ

SEQ ID NO: 704725 - protein, 9 aa, Homo Sapiens
GAGPQPLTR

SEQ ID NO: 704726 - protein, 9 aa, Homo Sapiens
LREIRRYHK

SEQ ID NO: 704727 - protein, 9 aa, Homo Sapiens
RVVFIKAGR

SEQ ID NO: 704728 - protein, 9 aa, Homo Sapiens
DIFHPEQKK

SEQ ID NO: 704729 - protein, 9 aa, Homo Sapiens
GNDGPSGAE

SEQ ID NO: 704730 - protein, 9 aa, Homo Sapiens
IPSGARSIS

SEQ ID NO: 704731 - protein, 9 aa, Homo Sapiens
ELQTLKEMT

SEQ ID NO: 704732 - protein, 9 aa, Homo Sapiens
STNTVTLPE

SEQ ID NO: 704733 - protein, 9 aa, Homo Sapiens
KNLVVTICL

SEQ ID NO: 704734 - protein, 9 aa, Homo Sapiens
TSVPKMAAD

SEQ ID NO: 704735 - protein, 9 aa, Homo Sapiens
AKRGRGRGA

SEQ ID NO: 704736 - protein, 9 aa, Homo Sapiens
SYASHTTNS

SEQ ID NO: 704737 - protein, 9 aa, Homo Sapiens
SMKQTKLEI

SEQ ID NO: 704738 - protein, 9 aa, Homo Sapiens
GYGQAFLGG

SEQ ID NO: 704739 - protein, 9 aa, Homo Sapiens
ATSTRVDKC

SEQ ID NO: 704740 - protein, 9 aa, Homo Sapiens
AEAQAKVYK

SEQ ID NO: 704741 - protein, 9 aa, Homo Sapiens
DWGTLQTIM

SEQ ID NO: 704742 - protein, 9 aa, Homo Sapiens
SCCRLELCR

SEQ ID NO: 704743 - protein, 9 aa, Homo Sapiens
KANALAAFL

SEQ ID NO: 704744 - protein, 9 aa, Homo Sapiens
AAALNNVDA

SEQ ID NO: 704745 - protein, 9 aa, Homo Sapiens
WPREILFRD

SEQ ID NO: 704746 - protein, 9 aa, Homo Sapiens
LMLLLGLWM

SEQ ID NO: 704747 - protein, 9 aa, Homo Sapiens
LCELQKTER

SEQ ID NO: 704748 - protein, 9 aa, Homo Sapiens
QYSPSYPDK

SEQ ID NO: 704749 - protein, 9 aa, Homo Sapiens
RFSYAHNGD

SEQ ID NO: 704750 - protein, 9 aa, Homo Sapiens
FFQINVVEK

SEQ ID NO: 704751 - protein, 9 aa, Homo Sapiens
PSLYTIRAV

SEQ ID NO: 704752 - protein, 9 aa, Homo Sapiens
KAKEQDRVK

SEQ ID NO: 704753 - protein, 9 aa, Homo Sapiens
RGTGKSLLG

SEQ ID NO: 704754 - protein, 9 aa, Homo Sapiens
DTCMITPKS

SEQ ID NO: 704755 - protein, 9 aa, Homo Sapiens
LRDPEPLGR

SEQ ID NO: 704756 - protein, 9 aa, Homo Sapiens
VEFVWHRYL

SEQ ID NO: 704757 - protein, 9 aa, Homo Sapiens
RKVSRSSGP

SEQ ID NO: 704758 - protein, 9 aa, Homo Sapiens
SKEELTEHI

SEQ ID NO: 704759 - protein, 9 aa, Homo Sapiens
DKADKLYRK

SEQ ID NO: 704760 - protein, 9 aa, Homo Sapiens
SPGGSEKLY

SEQ ID NO: 704761 - protein, 9 aa, Homo Sapiens
ITKYQAYNV

SEQ ID NO: 704762 - protein, 9 aa, Homo Sapiens
GADLLTGSQ

SEQ ID NO: 704763 - protein, 9 aa, Homo Sapiens
TETVLNANI

SEQ ID NO: 704764 - protein, 9 aa, Homo Sapiens
CTRERHPGY

SEQ ID NO: 704765 - protein, 9 aa, Homo Sapiens
QSDPLLIKG

SEQ ID NO: 704766 - protein, 9 aa, Homo Sapiens
TIMRESKRL

SEQ ID NO: 704767 - protein, 9 aa, Homo Sapiens
SLYTIRAVF

SEQ ID NO: 704768 - protein, 9 aa, Homo Sapiens
LVFPDCGNV

SEQ ID NO: 704769 - protein, 9 aa, Homo Sapiens
KPSECKAFE

SEQ ID NO: 704770 - protein, 9 aa, Homo Sapiens
ACYTGTREV

SEQ ID NO: 704771 - protein, 9 aa, Homo Sapiens
VSPEAAVQK

SEQ ID NO: 704772 - protein, 9 aa, Homo Sapiens
YSSPLQAPT

SEQ ID NO: 704773 - protein, 9 aa, Homo Sapiens
APRPPALRP

SEQ ID NO: 704774 - protein, 9 aa, Homo Sapiens
VMAPPTPIE

SEQ ID NO: 704775 - protein, 9 aa, Homo Sapiens
AEAPHIIVG

SEQ ID NO: 704776 - protein, 9 aa, Homo Sapiens
EHGTDPNIS

SEQ ID NO: 704777 - protein, 9 aa, Homo Sapiens
SPVPRGGSG

SEQ ID NO: 704778 - protein, 9 aa, Homo Sapiens
ADDNLVPQL

SEQ ID NO: 704779 - protein, 9 aa, Homo Sapiens
LLLKLVVSH

SEQ ID NO: 704780 - protein, 9 aa, Homo Sapiens
PNKENCEPK

SEQ ID NO: 704781 - protein, 9 aa, Homo Sapiens
QCRAFSKGE

SEQ ID NO: 704782 - protein, 9 aa, Homo Sapiens
AEEQLFQEK

SEQ ID NO: 704783 - protein, 9 aa, Homo Sapiens
LYQEIILYF

SEQ ID NO: 704784 - protein, 9 aa, Homo Sapiens
MFKVELMRL

SEQ ID NO: 704785 - protein, 9 aa, Homo Sapiens
HEEQDNDWS

SEQ ID NO: 704786 - protein, 9 aa, Homo Sapiens
SVKFDDIRE

SEQ ID NO: 704787 - protein, 9 aa, Homo Sapiens
STSVPKMAA

SEQ ID NO: 704788 - protein, 9 aa, Homo Sapiens
SVSGQCSGF

SEQ ID NO: 704789 - protein, 9 aa, Homo Sapiens
DFSAVTMER

SEQ ID NO: 704790 - protein, 9 aa, Homo Sapiens
IYADQEFNQ

SEQ ID NO: 704791 - protein, 9 aa, Homo Sapiens
SSGWIDIIH

SEQ ID NO: 704792 - protein, 9 aa, Homo Sapiens
KIFDKNNTF

SEQ ID NO: 704793 - protein, 9 aa, Homo Sapiens
KLESRVSEL

SEQ ID NO: 704794 - protein, 9 aa, Homo Sapiens
QKANGSPSM

SEQ ID NO: 704795 - protein, 9 aa, Homo Sapiens
QARQEREGT

SEQ ID NO: 704796 - protein, 9 aa, Homo Sapiens
GEAQLQGSK

SEQ ID NO: 704797 - protein, 9 aa, Homo Sapiens
NRILIYNFK

SEQ ID NO: 704798 - protein, 9 aa, Homo Sapiens
AGTIYDLCV

SEQ ID NO: 704799 - protein, 9 aa, Homo Sapiens
RYVHEGCIE

SEQ ID NO: 704800 - protein, 9 aa, Homo Sapiens
EGYFSQLQE

SEQ ID NO: 704801 - protein, 9 aa, Homo Sapiens
EGFQIVNVQ

SEQ ID NO: 704802 - protein, 9 aa, Homo Sapiens
PTPSQEGAP

SEQ ID NO: 704803 - protein, 9 aa, Homo Sapiens
FRLVPGQHF

SEQ ID NO: 704804 - protein, 9 aa, Homo Sapiens
RRSSTSTAG

SEQ ID NO: 704805 - protein, 9 aa, Homo Sapiens
GRQTFRPAC

SEQ ID NO: 704806 - protein, 9 aa, Homo Sapiens
ENEASLPNR

SEQ ID NO: 704807 - protein, 9 aa, Homo Sapiens
PDKRSSCSS

SEQ ID NO: 704808 - protein, 9 aa, Homo Sapiens
APPQHLSRV

SEQ ID NO: 704809 - protein, 9 aa, Homo Sapiens
VVHEVEECR

SEQ ID NO: 704810 - protein, 9 aa, Homo Sapiens
AKPLESDMD

SEQ ID NO: 704811 - protein, 9 aa, Homo Sapiens
MADGARQVG

SEQ ID NO: 704812 - protein, 9 aa, Homo Sapiens
PTSKDQKKV

SEQ ID NO: 704813 - protein, 9 aa, Homo Sapiens
SGSLPNNAI

SEQ ID NO: 704814 - protein, 9 aa, Homo Sapiens
ANASFVTCP

SEQ ID NO: 704815 - protein, 9 aa, Homo Sapiens
NDIKILGTE

SEQ ID NO: 704816 - protein, 9 aa, Homo Sapiens
RLFFQINVV

SEQ ID NO: 704817 - protein, 9 aa, Homo Sapiens
TNINTRMFQ

SEQ ID NO: 704818 - protein, 9 aa, Homo Sapiens
WCCRCFPFC

SEQ ID NO: 704819 - protein, 9 aa, Homo Sapiens
AGTCKKTFN

SEQ ID NO: 704820 - protein, 9 aa, Homo Sapiens
SSERASSSV

SEQ ID NO: 704821 - protein, 9 aa, Homo Sapiens
DQGPSPSVR

SEQ ID NO: 704822 - protein, 9 aa, Homo Sapiens
LKLVVSHLC

SEQ ID NO: 704823 - protein, 9 aa, Homo Sapiens
ADRLHNDLL

SEQ ID NO: 704824 - protein, 9 aa, Homo Sapiens
NCFSFFVFF

SEQ ID NO: 704825 - protein, 9 aa, Homo Sapiens
STVTRARCL

SEQ ID NO: 704826 - protein, 9 aa, Homo Sapiens
VRGIKEKLC

SEQ ID NO: 704827 - protein, 9 aa, Homo Sapiens
LRSWCWPPW

SEQ ID NO: 704828 - protein, 9 aa, Homo Sapiens
PPLSAEVLL

SEQ ID NO: 704829 - protein, 9 aa, Homo Sapiens
LDTCMITPK

SEQ ID NO: 704830 - protein, 9 aa, Homo Sapiens
QTNYDSDLR

SEQ ID NO: 704831 - protein, 9 aa, Homo Sapiens
ADVSRLLLA

SEQ ID NO: 704832 - protein, 9 aa, Homo Sapiens
DNCFSFFVF

SEQ ID NO: 704833 - protein, 9 aa, Homo Sapiens
TSPTGRIYP

SEQ ID NO: 704834 - protein, 9 aa, Homo Sapiens
HYLASPLDQ

SEQ ID NO: 704835 - protein, 9 aa, Homo Sapiens
ASLRQTLEG

SEQ ID NO: 704836 - protein, 9 aa, Homo Sapiens
LPEKEENEN

SEQ ID NO: 704837 - protein, 9 aa, Homo Sapiens
LLKLVVSHL

SEQ ID NO: 704838 - protein, 9 aa, Homo Sapiens
PHGKGRGGQ

SEQ ID NO: 704839 - protein, 9 aa, Homo Sapiens
EFLKEGYLR

SEQ ID NO: 704840 - protein, 9 aa, Homo Sapiens
HKLSVALPA

SEQ ID NO: 704841 - protein, 9 aa, Homo Sapiens
ERQQMRQEA

SEQ ID NO: 704842 - protein, 9 aa, Homo Sapiens
LQPPPLLPH

SEQ ID NO: 704843 - protein, 9 aa, Homo Sapiens
PHKLQFTFT

SEQ ID NO: 704844 - protein, 9 aa, Homo Sapiens
VLYEFVGRL

SEQ ID NO: 704845 - protein, 9 aa, Homo Sapiens
RQKIHDYMS

SEQ ID NO: 704846 - protein, 9 aa, Homo Sapiens
EGEEQEEES

SEQ ID NO: 704847 - protein, 9 aa, Homo Sapiens
MEMCSIKRG

SEQ ID NO: 704848 - protein, 9 aa, Homo Sapiens
QCQECQKTF

SEQ ID NO: 704849 - protein, 9 aa, Homo Sapiens
REVRDIFYK

SEQ ID NO: 704850 - protein, 9 aa, Homo Sapiens
MSDCTGCHK

SEQ ID NO: 704851 - protein, 9 aa, Homo Sapiens
IPTSKDQKK

SEQ ID NO: 704852 - protein, 9 aa, Homo Sapiens
RRKWADLPP

SEQ ID NO: 704853 - protein, 9 aa, Homo Sapiens
AVCKPLHYP

SEQ ID NO: 704854 - protein, 9 aa, Homo Sapiens
PSGARSISI

SEQ ID NO: 704855 - protein, 9 aa, Homo Sapiens
ERIERGQGT

SEQ ID NO: 704856 - protein, 9 aa, Homo Sapiens
IYDLCVLAI

SEQ ID NO: 704857 - protein, 9 aa, Homo Sapiens
DVSRLLLAT

SEQ ID NO: 704858 - protein, 9 aa, Homo Sapiens
DDNDDEAPK

SEQ ID NO: 704859 - protein, 9 aa, Homo Sapiens
QLSQIQWLI

SEQ ID NO: 704860 - protein, 9 aa, Homo Sapiens
FIKAGRDDL

SEQ ID NO: 704861 - protein, 9 aa, Homo Sapiens
ATTNITPMK

SEQ ID NO: 704862 - protein, 9 aa, Homo Sapiens
LACANGHVK

SEQ ID NO: 704863 - protein, 9 aa, Homo Sapiens
SFALNLDTS

SEQ ID NO: 704864 - protein, 9 aa, Homo Sapiens
SVLYEFVGR

SEQ ID NO: 704865 - protein, 9 aa, Homo Sapiens
STTGKGWGI

SEQ ID NO: 704866 - protein, 9 aa, Homo Sapiens
LATTTTNLG

SEQ ID NO: 704867 - protein, 9 aa, Homo Sapiens
CCNYGHCPA

SEQ ID NO: 704868 - protein, 9 aa, Homo Sapiens
TTNLGVTTS

SEQ ID NO: 704869 - protein, 9 aa, Homo Sapiens
LDQGPSPSV

SEQ ID NO: 704870 - protein, 9 aa, Homo Sapiens
NIESRSTYP

SEQ ID NO: 704871 - protein, 9 aa, Homo Sapiens
WGTLQTIMG

SEQ ID NO: 704872 - protein, 9 aa, Homo Sapiens
TTNITPMKA

SEQ ID NO: 704873 - protein, 9 aa, Homo Sapiens
NSRLNGAWQ

SEQ ID NO: 704874 - protein, 9 aa, Homo Sapiens
VALGLLSCL

SEQ ID NO: 704875 - protein, 9 aa, Homo Sapiens
LDGVANGKI

SEQ ID NO: 704876 - protein, 9 aa, Homo Sapiens
AALQYLGSF

SEQ ID NO: 704877 - protein, 9 aa, Homo Sapiens
SAYSYCGHG

SEQ ID NO: 704878 - protein, 9 aa, Homo Sapiens
RKTKLNQLP

SEQ ID NO: 704879 - protein, 9 aa, Homo Sapiens
EPEDFSAVT

SEQ ID NO: 704880 - protein, 9 aa, Homo Sapiens
AFANRKLNL

SEQ ID NO: 704881 - protein, 9 aa, Homo Sapiens
CPNKENCEP

SEQ ID NO: 704882 - protein, 9 aa, Homo Sapiens
LRVLVCDRN

SEQ ID NO: 704883 - protein, 9 aa, Homo Sapiens
TQRYIDSKG

SEQ ID NO: 704884 - protein, 9 aa, Homo Sapiens
HGHMDCVRV

SEQ ID NO: 704885 - protein, 9 aa, Homo Sapiens
YDSDLRSIL

SEQ ID NO: 704886 - protein, 9 aa, Homo Sapiens
ILQSSDSRT

SEQ ID NO: 704887 - protein, 9 aa, Homo Sapiens
RGRPGSSQS

SEQ ID NO: 704888 - protein, 9 aa, Homo Sapiens
GAIQSQQQE

SEQ ID NO: 704889 - protein, 9 aa, Homo Sapiens
KKILVVKEE

SEQ ID NO: 704890 - protein, 9 aa, Homo Sapiens
ATVKANALA

SEQ ID NO: 704891 - protein, 9 aa, Homo Sapiens
RHSSERASS

SEQ ID NO: 704892 - protein, 9 aa, Homo Sapiens
PRHRSLPRN

SEQ ID NO: 704893 - protein, 9 aa, Homo Sapiens
GPAAQPSAR

SEQ ID NO: 704894 - protein, 9 aa, Homo Sapiens
FTAVSHGHM

SEQ ID NO: 704895 - protein, 9 aa, Homo Sapiens
KIVNLLKDD

SEQ ID NO: 704896 - protein, 9 aa, Homo Sapiens
VASRSAVPT

SEQ ID NO: 704897 - protein, 9 aa, Homo Sapiens
QEDASPGGS

SEQ ID NO: 704898 - protein, 9 aa, Homo Sapiens
DLPTMAPNT

SEQ ID NO: 704899 - protein, 9 aa, Homo Sapiens
LQYLGSFDH

SEQ ID NO: 704900 - protein, 9 aa, Homo Sapiens
ENLDYYAGM

SEQ ID NO: 704901 - protein, 9 aa, Homo Sapiens
KQSMKQTKL

SEQ ID NO: 704902 - protein, 9 aa, Homo Sapiens
PPASSFSAP

SEQ ID NO: 704903 - protein, 9 aa, Homo Sapiens
QVLGDYREL

SEQ ID NO: 704904 - protein, 9 aa, Homo Sapiens
ATASFSSCV

SEQ ID NO: 704905 - protein, 9 aa, Homo Sapiens
EEGEEQEEE

SEQ ID NO: 704906 - protein, 9 aa, Homo Sapiens
QSLYQSQKQ

SEQ ID NO: 704907 - protein, 9 aa, Homo Sapiens
RIKKKQSNA

SEQ ID NO: 704908 - protein, 9 aa, Homo Sapiens
KTSVGTVRI

SEQ ID NO: 704909 - protein, 9 aa, Homo Sapiens
QRIGPMFDK

SEQ ID NO: 704910 - protein, 9 aa, Homo Sapiens
YMEMCSIKR

SEQ ID NO: 704911 - protein, 9 aa, Homo Sapiens
SLPNRSLQG

SEQ ID NO: 704912 - protein, 9 aa, Homo Sapiens
PTFLKIVNL

SEQ ID NO: 704913 - protein, 9 aa, Homo Sapiens
RCRESLGRL

SEQ ID NO: 704914 - protein, 9 aa, Homo Sapiens
HVPSPGPGH

SEQ ID NO: 704915 - protein, 9 aa, Homo Sapiens
ENGKHHGTR

SEQ ID NO: 704916 - protein, 9 aa, Homo Sapiens
LSELQLFEA

SEQ ID NO: 704917 - protein, 9 aa, Homo Sapiens
CDMKKPMDV

SEQ ID NO: 704918 - protein, 9 aa, Homo Sapiens
LMKQTWHSK

SEQ ID NO: 704919 - protein, 9 aa, Homo Sapiens
PQPLTRRGS

SEQ ID NO: 704920 - protein, 9 aa, Homo Sapiens
SVMSPQESF

SEQ ID NO: 704921 - protein, 9 aa, Homo Sapiens
HTLKENDHA

SEQ ID NO: 704922 - protein, 9 aa, Homo Sapiens
ELLGMLSIG

SEQ ID NO: 704923 - protein, 9 aa, Homo Sapiens
LRGRPGSSQ

SEQ ID NO: 704924 - protein, 9 aa, Homo Sapiens
IIKERSMAT

SEQ ID NO: 704925 - protein, 9 aa, Homo Sapiens
TRTASWASS

SEQ ID NO: 704926 - protein, 9 aa, Homo Sapiens
KGEPGNDGP

SEQ ID NO: 704927 - protein, 9 aa, Homo Sapiens
NVCGRSNER

SEQ ID NO: 704928 - protein, 9 aa, Homo Sapiens
QTWHSKPRN

SEQ ID NO: 704929 - protein, 9 aa, Homo Sapiens
NEELRRHSS

SEQ ID NO: 704930 - protein, 9 aa, Homo Sapiens
AGRQRRGPG

SEQ ID NO: 704931 - protein, 9 aa, Homo Sapiens
NRCLQLTHS

SEQ ID NO: 704932 - protein, 9 aa, Homo Sapiens
FVWHRYLDY

SEQ ID NO: 704933 - protein, 9 aa, Homo Sapiens
ALRPGWLSL

SEQ ID NO: 704934 - protein, 9 aa, Homo Sapiens
CFIKNIQQV

SEQ ID NO: 704935 - protein, 9 aa, Homo Sapiens
VKCCLLHLF

SEQ ID NO: 704936 - protein, 9 aa, Homo Sapiens
GGCCRAWEP

SEQ ID NO: 704937 - protein, 9 aa, Homo Sapiens
AAGTIYDLC

SEQ ID NO: 704938 - protein, 9 aa, Homo Sapiens
GKPIISAFA

SEQ ID NO: 704939 - protein, 9 aa, Homo Sapiens
PPTPIEVVA

SEQ ID NO: 704940 - protein, 9 aa, Homo Sapiens
PALRPRPPQ

SEQ ID NO: 704941 - protein, 9 aa, Homo Sapiens
EDFSAVTME

SEQ ID NO: 704942 - protein, 9 aa, Homo Sapiens
DEGEENLDY

SEQ ID NO: 704943 - protein, 9 aa, Homo Sapiens
MPPPSVPHP

SEQ ID NO: 704944 - protein, 9 aa, Homo Sapiens
MDFEDGAFE

SEQ ID NO: 704945 - protein, 9 aa, Homo Sapiens
QFMKEQPYL

SEQ ID NO: 704946 - protein, 9 aa, Homo Sapiens
DVENGKHHG

SEQ ID NO: 704947 - protein, 9 aa, Homo Sapiens
QGSKLLSRN

SEQ ID NO: 704948 - protein, 9 aa, Homo Sapiens
KSKEELTEH

SEQ ID NO: 704949 - protein, 9 aa, Homo Sapiens
IILKNYKDE

SEQ ID NO: 704950 - protein, 9 aa, Homo Sapiens
QINVVEKFK

SEQ ID NO: 704951 - protein, 9 aa, Homo Sapiens
GAGNTIREA

SEQ ID NO: 704952 - protein, 9 aa, Homo Sapiens
LGYGQAFLG

SEQ ID NO: 704953 - protein, 9 aa, Homo Sapiens
RAVFQRVTG

SEQ ID NO: 704954 - protein, 9 aa, Homo Sapiens
MGYYWYSKE

SEQ ID NO: 704955 - protein, 9 aa, Homo Sapiens
IIPDNELHL

SEQ ID NO: 704956 - protein, 9 aa, Homo Sapiens
ARTDICFPL

SEQ ID NO: 704957 - protein, 9 aa, Homo Sapiens
VVFIKAGRD

SEQ ID NO: 704958 - protein, 9 aa, Homo Sapiens
SFSFLNEDD

SEQ ID NO: 704959 - protein, 9 aa, Homo Sapiens
AKTFFRLQK

SEQ ID NO: 704960 - protein, 9 aa, Homo Sapiens
RTNKFWPLY

SEQ ID NO: 704961 - protein, 9 aa, Homo Sapiens
TESVLEVVR

SEQ ID NO: 704962 - protein, 9 aa, Homo Sapiens
LYRFAETHK

SEQ ID NO: 704963 - protein, 9 aa, Homo Sapiens
PNRSLQGKK

SEQ ID NO: 704964 - protein, 9 aa, Homo Sapiens
QRYIDSKGK

SEQ ID NO: 704965 - protein, 9 aa, Homo Sapiens
TRLGEQCSA

SEQ ID NO: 704966 - protein, 9 aa, Homo Sapiens
MTAQFSSVL

SEQ ID NO: 704967 - protein, 9 aa, Homo Sapiens
DKNNTFGSV

SEQ ID NO: 704968 - protein, 9 aa, Homo Sapiens
MDLVNQLVA

SEQ ID NO: 704969 - protein, 9 aa, Homo Sapiens
NVSLRVLVC

SEQ ID NO: 704970 - protein, 9 aa, Homo Sapiens
KNNTFGSVE

SEQ ID NO: 704971 - protein, 9 aa, Homo Sapiens
LPNNAIKGG

SEQ ID NO: 704972 - protein, 9 aa, Homo Sapiens
SPHTSTGET

SEQ ID NO: 704973 - protein, 9 aa, Homo Sapiens
PCGRRSSTS

SEQ ID NO: 704974 - protein, 9 aa, Homo Sapiens
VVKEEKLNF

SEQ ID NO: 704975 - protein, 9 aa, Homo Sapiens
SINTDVHSP

SEQ ID NO: 704976 - protein, 9 aa, Homo Sapiens
SLRDPEPLG

SEQ ID NO: 704977 - protein, 9 aa, Homo Sapiens
QAEAPHIIV

SEQ ID NO: 704978 - protein, 9 aa, Homo Sapiens
IFTVNPKRE

SEQ ID NO: 704979 - protein, 9 aa, Homo Sapiens
SDSRTFSTV

SEQ ID NO: 704980 - protein, 9 aa, Homo Sapiens
GLFKSTLVF

SEQ ID NO: 704981 - protein, 9 aa, Homo Sapiens
NKENCEPKK

SEQ ID NO: 704982 - protein, 9 aa, Homo Sapiens
LGLWMGLGL

SEQ ID NO: 704983 - protein, 9 aa, Homo Sapiens
HCKQAVNFF

SEQ ID NO: 704984 - protein, 9 aa, Homo Sapiens
QAKVYKKRD

SEQ ID NO: 704985 - protein, 9 aa, Homo Sapiens
SPEAAVQKV

SEQ ID NO: 704986 - protein, 9 aa, Homo Sapiens
STETVLNAN

SEQ ID NO: 704987 - protein, 9 aa, Homo Sapiens
KGAEGAAEA

SEQ ID NO: 704988 - protein, 9 aa, Homo Sapiens
LRVCVLCEL

SEQ ID NO: 704989 - protein, 9 aa, Homo Sapiens
GLTLAACCT

SEQ ID NO: 704990 - protein, 9 aa, Homo Sapiens
NHLFCDIAP

SEQ ID NO: 704991 - protein, 9 aa, Homo Sapiens
NTILLHSAK

SEQ ID NO: 704992 - protein, 9 aa, Homo Sapiens
VPRGGSGGK

SEQ ID NO: 704993 - protein, 9 aa, Homo Sapiens
GHMRTNKFW

SEQ ID NO: 704994 - protein, 9 aa, Homo Sapiens
SSVISLPMK

SEQ ID NO: 704995 - protein, 9 aa, Homo Sapiens
DGARQVGNM

SEQ ID NO: 704996 - protein, 9 aa, Homo Sapiens
FAAIHQVHN

SEQ ID NO: 704997 - protein, 9 aa, Homo Sapiens
STCHSANCD

SEQ ID NO: 704998 - protein, 9 aa, Homo Sapiens
LVFEQQEYK

SEQ ID NO: 704999 - protein, 9 aa, Homo Sapiens
GRRVGVLHG

SEQ ID NO: 705000 - protein, 9 aa, Homo Sapiens
PTMAPNTAN

SEQ ID NO: 705001 - protein, 9 aa, Homo Sapiens
ADYLTFHLG

SEQ ID NO: 705002 - protein, 9 aa, Homo Sapiens
NRKLNLTEV

SEQ ID NO: 705003 - protein, 9 aa, Homo Sapiens
CTCGVSEVF

SEQ ID NO: 705004 - protein, 9 aa, Homo Sapiens
KTFNIDLFR

SEQ ID NO: 705005 - protein, 9 aa, Homo Sapiens
TGSVITTKG

SEQ ID NO: 705006 - protein, 9 aa, Homo Sapiens
SERASSSVA

SEQ ID NO: 705007 - protein, 9 aa, Homo Sapiens
VPHPPPPPV

SEQ ID NO: 705008 - protein, 9 aa, Homo Sapiens
KGTLLPITT

SEQ ID NO: 705009 - protein, 9 aa, Homo Sapiens
NLCGAMHPS

SEQ ID NO: 705010 - protein, 9 aa, Homo Sapiens
RRKVAQITG

SEQ ID NO: 705011 - protein, 9 aa, Homo Sapiens
GILGAIQSQ

SEQ ID NO: 705012 - protein, 9 aa, Homo Sapiens
DLGPNTGGF

SEQ ID NO: 705013 - protein, 9 aa, Homo Sapiens
EPGNDGPSG

SEQ ID NO: 705014 - protein, 9 aa, Homo Sapiens
LNGAWQYEV

SEQ ID NO: 705015 - protein, 9 aa, Homo Sapiens
SERIERGQG

SEQ ID NO: 705016 - protein, 9 aa, Homo Sapiens
FEHEEQDND

SEQ ID NO: 705017 - protein, 9 aa, Homo Sapiens
PTGRIYPNP

SEQ ID NO: 705018 - protein, 9 aa, Homo Sapiens
RLMECLRVP

SEQ ID NO: 705019 - protein, 9 aa, Homo Sapiens
PKAPYYYVN

SEQ ID NO: 705020 - protein, 9 aa, Homo Sapiens
NLYGSMLFL

SEQ ID NO: 705021 - protein, 9 aa, Homo Sapiens
GLGIFGSTN

SEQ ID NO: 705022 - protein, 9 aa, Homo Sapiens
PPSSVISLP

SEQ ID NO: 705023 - protein, 9 aa, Homo Sapiens
EAERNISGC

SEQ ID NO: 705024 - protein, 9 aa, Homo Sapiens
MCREFFSEI

SEQ ID NO: 705025 - protein, 9 aa, Homo Sapiens
EFFSEIADL

SEQ ID NO: 705026 - protein, 9 aa, Homo Sapiens
VRDACSLPW

SEQ ID NO: 705027 - protein, 9 aa, Homo Sapiens
CSAFLDLTQ

SEQ ID NO: 705028 - protein, 9 aa, Homo Sapiens
GPSKYFFFH

SEQ ID NO: 705029 - protein, 9 aa, Homo Sapiens
YRSPTTPCT

SEQ ID NO: 705030 - protein, 9 aa, Homo Sapiens
GHCPAPRPP

SEQ ID NO: 705031 - protein, 9 aa, Homo Sapiens
TLLPITTPG

SEQ ID NO: 705032 - protein, 9 aa, Homo Sapiens
KSLGHSRWE

SEQ ID NO: 705033 - protein, 9 aa, Homo Sapiens
LARSQHNTW

SEQ ID NO: 705034 - protein, 9 aa, Homo Sapiens
TGKGWGIRG

SEQ ID NO: 705035 - protein, 9 aa, Homo Sapiens
RHPGPAAQP

SEQ ID NO: 705036 - protein, 9 aa, Homo Sapiens
SYIIRKDTW

SEQ ID NO: 705037 - protein, 9 aa, Homo Sapiens
DYPECTLQE

SEQ ID NO: 705038 - protein, 9 aa, Homo Sapiens
PEVQKGVVK

SEQ ID NO: 705039 - protein, 9 aa, Homo Sapiens
SLESEQGMR

SEQ ID NO: 705040 - protein, 9 aa, Homo Sapiens
TTRRKGPPK

SEQ ID NO: 705041 - protein, 9 aa, Homo Sapiens
SKRRKVAQI

SEQ ID NO: 705042 - protein, 9 aa, Homo Sapiens
TNPPASSFS

SEQ ID NO: 705043 - protein, 9 aa, Homo Sapiens
RWEADLFDS

SEQ ID NO: 705044 - protein, 9 aa, Homo Sapiens
IQNTGHLAV

SEQ ID NO: 705045 - protein, 9 aa, Homo Sapiens
AFQRGRGRF

SEQ ID NO: 705046 - protein, 9 aa, Homo Sapiens
VAPISLHVS

SEQ ID NO: 705047 - protein, 9 aa, Homo Sapiens
QLFEAERNI

SEQ ID NO: 705048 - protein, 9 aa, Homo Sapiens
VPPSSAPLA

SEQ ID NO: 705049 - protein, 9 aa, Homo Sapiens
KAVRVSILV

SEQ ID NO: 705050 - protein, 9 aa, Homo Sapiens
QFLDSKQHI

SEQ ID NO: 705051 - protein, 9 aa, Homo Sapiens
SSECDIFHP

SEQ ID NO: 705052 - protein, 9 aa, Homo Sapiens
REASQSSSS

SEQ ID NO: 705053 - protein, 9 aa, Homo Sapiens
VDKCTRERH

SEQ ID NO: 705054 - protein, 9 aa, Homo Sapiens
KMNITYIAP

SEQ ID NO: 705055 - protein, 9 aa, Homo Sapiens
YFEHEEQDN

SEQ ID NO: 705056 - protein, 9 aa, Homo Sapiens
LGAGKSTFL

SEQ ID NO: 705057 - protein, 9 aa, Homo Sapiens
YSTRLGEQC

SEQ ID NO: 705058 - protein, 9 aa, Homo Sapiens
GTNNFVHNN

SEQ ID NO: 705059 - protein, 9 aa, Homo Sapiens
VLEVVRKYC

SEQ ID NO: 705060 - protein, 9 aa, Homo Sapiens
TTTTNLGVT

SEQ ID NO: 705061 - protein, 9 aa, Homo Sapiens
FALNLDTSK

SEQ ID NO: 705062 - protein, 9 aa, Homo Sapiens
TSTETVLNA

SEQ ID NO: 705063 - protein, 9 aa, Homo Sapiens
GNLTTDSLR

SEQ ID NO: 705064 - protein, 9 aa, Homo Sapiens
PLSAEVLLP

SEQ ID NO: 705065 - protein, 9 aa, Homo Sapiens
SPPKPHRFK

SEQ ID NO: 705066 - protein, 9 aa, Homo Sapiens
EEQEEESSD

SEQ ID NO: 705067 - protein, 9 aa, Homo Sapiens
HKLFHPHTC

SEQ ID NO: 705068 - protein, 9 aa, Homo Sapiens
GQVLPGGGH

SEQ ID NO: 705069 - protein, 9 aa, Homo Sapiens
SHLCIIICL

SEQ ID NO: 705070 - protein, 9 aa, Homo Sapiens
ATYSLNVTY

SEQ ID NO: 705071 - protein, 9 aa, Homo Sapiens
VSRTLCPLE

SEQ ID NO: 705072 - protein, 9 aa, Homo Sapiens
AFGNCKTMW

SEQ ID NO: 705073 - protein, 9 aa, Homo Sapiens
AEAERSSLL

SEQ ID NO: 705074 - protein, 9 aa, Homo Sapiens
IQASQLRKM

SEQ ID NO: 705075 - protein, 9 aa, Homo Sapiens
NNGMLDLSV

SEQ ID NO: 705076 - protein, 9 aa, Homo Sapiens
PRGRGAWEV

SEQ ID NO: 705077 - protein, 9 aa, Homo Sapiens
GKSLLGRCI

SEQ ID NO: 705078 - protein, 9 aa, Homo Sapiens
VNREAAGIV

SEQ ID NO: 705079 - protein, 9 aa, Homo Sapiens
ETVLNANIS

SEQ ID NO: 705080 - protein, 9 aa, Homo Sapiens
LCGAMHPSD

SEQ ID NO: 705081 - protein, 9 aa, Homo Sapiens
DAGSGSDLE

SEQ ID NO: 705082 - protein, 9 aa, Homo Sapiens
GRGIAEEQL

SEQ ID NO: 705083 - protein, 9 aa, Homo Sapiens
SLLPRRTSS

SEQ ID NO: 705084 - protein, 9 aa, Homo Sapiens
CCSSSRRTA

SEQ ID NO: 705085 - protein, 9 aa, Homo Sapiens
KMNNCLRQM

SEQ ID NO: 705086 - protein, 9 aa, Homo Sapiens
SSSSPAPKA

SEQ ID NO: 705087 - protein, 9 aa, Homo Sapiens
EFVGRLRSW

SEQ ID NO: 705088 - protein, 9 aa, Homo Sapiens
AQLQGSKLL

SEQ ID NO: 705089 - protein, 9 aa, Homo Sapiens
RRQRGGRGG

SEQ ID NO: 705090 - protein, 9 aa, Homo Sapiens
FKRPFPLAR

SEQ ID NO: 705091 - protein, 9 aa, Homo Sapiens
LWLSWWIKY

SEQ ID NO: 705092 - protein, 9 aa, Homo Sapiens
FPASADRAV

SEQ ID NO: 705093 - protein, 9 aa, Homo Sapiens
QQLRQLQGC

SEQ ID NO: 705094 - protein, 9 aa, Homo Sapiens
GTPAMSISL

SEQ ID NO: 705095 - protein, 9 aa, Homo Sapiens
YRKPILSPK

SEQ ID NO: 705096 - protein, 9 aa, Homo Sapiens
KKSKNLVVT

SEQ ID NO: 705097 - protein, 9 aa, Homo Sapiens
CFPFCRESG

SEQ ID NO: 705098 - protein, 9 aa, Homo Sapiens
VRASAVSKC

SEQ ID NO: 705099 - protein, 9 aa, Homo Sapiens
HLSRVEGNL

SEQ ID NO: 705100 - protein, 9 aa, Homo Sapiens
CHSANCDRL

SEQ ID NO: 705101 - protein, 9 aa, Homo Sapiens
HIEGGSSGG

SEQ ID NO: 705102 - protein, 9 aa, Homo Sapiens
VNLLSLGSF

SEQ ID NO: 705103 - protein, 9 aa, Homo Sapiens
SMSTAFCSL

SEQ ID NO: 705104 - protein, 9 aa, Homo Sapiens
SHSKSFWTR

SEQ ID NO: 705105 - protein, 9 aa, Homo Sapiens
PGNDGPSGA

SEQ ID NO: 705106 - protein, 9 aa, Homo Sapiens
SAVSKCPLP

SEQ ID NO: 705107 - protein, 9 aa, Homo Sapiens
SLRVLVCDR

SEQ ID NO: 705108 - protein, 9 aa, Homo Sapiens
CFCCRYCCS

SEQ ID NO: 705109 - protein, 9 aa, Homo Sapiens
EENENSEPK

SEQ ID NO: 705110 - protein, 9 aa, Homo Sapiens
AELGQQIDN

SEQ ID NO: 705111 - protein, 9 aa, Homo Sapiens
TNLLRLVQF

SEQ ID NO: 705112 - protein, 9 aa, Homo Sapiens
GLARSQHNT

SEQ ID NO: 705113 - protein, 9 aa, Homo Sapiens
LNWITEAAL

SEQ ID NO: 705114 - protein, 9 aa, Homo Sapiens
SWMELFSSL

SEQ ID NO: 705115 - protein, 9 aa, Homo Sapiens
YYEADCFGA

SEQ ID NO: 705116 - protein, 9 aa, Homo Sapiens
QNRAYLLLE

SEQ ID NO: 705117 - protein, 9 aa, Homo Sapiens
ALGLLSCLL

SEQ ID NO: 705118 - protein, 9 aa, Homo Sapiens
LLTCAFEDP

SEQ ID NO: 705119 - protein, 9 aa, Homo Sapiens
PLGVDGVSA

SEQ ID NO: 705120 - protein, 9 aa, Homo Sapiens
GRFSYAHNG

SEQ ID NO: 705121 - protein, 9 aa, Homo Sapiens
LFEAERNIS

SEQ ID NO: 705122 - protein, 9 aa, Homo Sapiens
ACANGHVKV

SEQ ID NO: 705123 - protein, 9 aa, Homo Sapiens
AGKKLGPTE

SEQ ID NO: 705124 - protein, 9 aa, Homo Sapiens
CPLEATNET

SEQ ID NO: 705125 - protein, 9 aa, Homo Sapiens
NREAAGIVF

SEQ ID NO: 705126 - protein, 9 aa, Homo Sapiens
MDCVRVLLE

SEQ ID NO: 705127 - protein, 9 aa, Homo Sapiens
PGEKGEPGN

SEQ ID NO: 705128 - protein, 9 aa, Homo Sapiens
KIIKERSMA

SEQ ID NO: 705129 - protein, 9 aa, Homo Sapiens
SVAELGQQI

SEQ ID NO: 705130 - protein, 9 aa, Homo Sapiens
KPLHYPVIV

SEQ ID NO: 705131 - protein, 9 aa, Homo Sapiens
FHVNLYGSM

SEQ ID NO: 705132 - protein, 9 aa, Homo Sapiens
LLPITTPGL

SEQ ID NO: 705133 - protein, 9 aa, Homo Sapiens
LKNYKDEYL

SEQ ID NO: 705134 - protein, 9 aa, Homo Sapiens
GTIYDLCVL

SEQ ID NO: 705135 - protein, 9 aa, Homo Sapiens
RERHPGYRS

SEQ ID NO: 705136 - protein, 9 aa, Homo Sapiens
SGETNFGPQ

SEQ ID NO: 705137 - protein, 9 aa, Homo Sapiens
NRAQFWPGL

SEQ ID NO: 705138 - protein, 9 aa, Homo Sapiens
KSCYVLFAV

SEQ ID NO: 705139 - protein, 9 aa, Homo Sapiens
TCHSANCDR

SEQ ID NO: 705140 - protein, 9 aa, Homo Sapiens
GAIAQQLRQ

SEQ ID NO: 705141 - protein, 9 aa, Homo Sapiens
YYWYSKETN

SEQ ID NO: 705142 - protein, 9 aa, Homo Sapiens
SIFGDNDSR

SEQ ID NO: 705143 - protein, 9 aa, Homo Sapiens
YHKKIQTGE

SEQ ID NO: 705144 - protein, 9 aa, Homo Sapiens
PDHGCFCCR

SEQ ID NO: 705145 - protein, 9 aa, Homo Sapiens
NGFNLCFIK

SEQ ID NO: 705146 - protein, 9 aa, Homo Sapiens
VNLYGSMLF

SEQ ID NO: 705147 - protein, 9 aa, Homo Sapiens
FQINVVEKF

SEQ ID NO: 705148 - protein, 9 aa, Homo Sapiens
VSINRCLQL

SEQ ID NO: 705149 - protein, 9 aa, Homo Sapiens
NLAADLLLI

SEQ ID NO: 705150 - protein, 9 aa, Homo Sapiens
ETLVTVAKE

SEQ ID NO: 705151 - protein, 9 aa, Homo Sapiens
IKRGLDVQM

SEQ ID NO: 705152 - protein, 9 aa, Homo Sapiens
VPVPEPYTY

SEQ ID NO: 705153 - protein, 9 aa, Homo Sapiens
HMADGARQV

SEQ ID NO: 705154 - protein, 9 aa, Homo Sapiens
ANALAAFLL

SEQ ID NO: 705155 - protein, 9 aa, Homo Sapiens
CPFPSPGCQ

SEQ ID NO: 705156 - protein, 9 aa, Homo Sapiens
CILQKHPLC

SEQ ID NO: 705157 - protein, 9 aa, Homo Sapiens
SSFECFEEA

SEQ ID NO: 705158 - protein, 9 aa, Homo Sapiens
LNNVDAAVV

SEQ ID NO: 705159 - protein, 9 aa, Homo Sapiens
TEAQTTPPV

SEQ ID NO: 705160 - protein, 9 aa, Homo Sapiens
VMAPSPSLV

SEQ ID NO: 705161 - protein, 9 aa, Homo Sapiens
EQPYLNFRN

SEQ ID NO: 705162 - protein, 9 aa, Homo Sapiens
LPSVPTPSQ

SEQ ID NO: 705163 - protein, 9 aa, Homo Sapiens
GNIMHFHQK

SEQ ID NO: 705164 - protein, 9 aa, Homo Sapiens
LDLERIEIT

SEQ ID NO: 705165 - protein, 9 aa, Homo Sapiens
LLFAAWLSF

SEQ ID NO: 705166 - protein, 9 aa, Homo Sapiens
SVITTKGVC

SEQ ID NO: 705167 - protein, 9 aa, Homo Sapiens
SATTSLVAP

SEQ ID NO: 705168 - protein, 9 aa, Homo Sapiens
LDLYKQDSS

SEQ ID NO: 705169 - protein, 9 aa, Homo Sapiens
VDKSKEELT

SEQ ID NO: 705170 - protein, 9 aa, Homo Sapiens
RKLIFRVCS

SEQ ID NO: 705171 - protein, 9 aa, Homo Sapiens
SDVSIVYDQ

SEQ ID NO: 705172 - protein, 9 aa, Homo Sapiens
GTGKSLLGR

SEQ ID NO: 705173 - protein, 9 aa, Homo Sapiens
GFQNRTVQC

SEQ ID NO: 705174 - protein, 9 aa, Homo Sapiens
LGSMLQKKS

SEQ ID NO: 705175 - protein, 9 aa, Homo Sapiens
GLLVNREAA

SEQ ID NO: 705176 - protein, 9 aa, Homo Sapiens
SQTGTSQIG

SEQ ID NO: 705177 - protein, 9 aa, Homo Sapiens
YQRSYERQQ

SEQ ID NO: 705178 - protein, 9 aa, Homo Sapiens
ASGRTSVVT

SEQ ID NO: 705179 - protein, 9 aa, Homo Sapiens
KIHDYMSTV

SEQ ID NO: 705180 - protein, 9 aa, Homo Sapiens
DYWPREILF

SEQ ID NO: 705181 - protein, 9 aa, Homo Sapiens
RYHKSTELL

SEQ ID NO: 705182 - protein, 9 aa, Homo Sapiens
PAFILPKAE

SEQ ID NO: 705183 - protein, 9 aa, Homo Sapiens
RMFFLLLAR

SEQ ID NO: 705184 - protein, 9 aa, Homo Sapiens
GIKEKLCYV

SEQ ID NO: 705185 - protein, 9 aa, Homo Sapiens
RDLDGVANG

SEQ ID NO: 705186 - protein, 9 aa, Homo Sapiens
QKIPEKRQQ

SEQ ID NO: 705187 - protein, 9 aa, Homo Sapiens
FWPLYYQTN

SEQ ID NO: 705188 - protein, 9 aa, Homo Sapiens
YSFNIETFQ

SEQ ID NO: 705189 - protein, 9 aa, Homo Sapiens
DASPGGSEK

SEQ ID NO: 705190 - protein, 9 aa, Homo Sapiens
RSAATPTSS

SEQ ID NO: 705191 - protein, 9 aa, Homo Sapiens
SKMNRAQFW

SEQ ID NO: 705192 - protein, 9 aa, Homo Sapiens
FHICHTIVF

SEQ ID NO: 705193 - protein, 9 aa, Homo Sapiens
KRHKIRQTG

SEQ ID NO: 705194 - protein, 9 aa, Homo Sapiens
DKIIKERSM

SEQ ID NO: 705195 - protein, 9 aa, Homo Sapiens
YGQAFLGGL

SEQ ID NO: 705196 - protein, 9 aa, Homo Sapiens
SSVMSPQES

SEQ ID NO: 705197 - protein, 9 aa, Homo Sapiens
PLELVVTAA

SEQ ID NO: 705198 - protein, 9 aa, Homo Sapiens
LFVRQAPLA

SEQ ID NO: 705199 - protein, 9 aa, Homo Sapiens
PVSSLHLRG

SEQ ID NO: 705200 - protein, 9 aa, Homo Sapiens
KTTACTEFR

SEQ ID NO: 705201 - protein, 9 aa, Homo Sapiens
RDQCHLGQK

SEQ ID NO: 705202 - protein, 9 aa, Homo Sapiens
KVRPFNGGS

SEQ ID NO: 705203 - protein, 9 aa, Homo Sapiens
PSGQRPQVH

SEQ ID NO: 705204 - protein, 9 aa, Homo Sapiens
NLEDFLNDP

SEQ ID NO: 705205 - protein, 9 aa, Homo Sapiens
SVVFRCYNS

SEQ ID NO: 705206 - protein, 9 aa, Homo Sapiens
QEILSKAQF

SEQ ID NO: 705207 - protein, 9 aa, Homo Sapiens
RSPRRGRSS

SEQ ID NO: 705208 - protein, 9 aa, Homo Sapiens
IYKKVRPFN

SEQ ID NO: 705209 - protein, 9 aa, Homo Sapiens
RCYNSTELA

SEQ ID NO: 705210 - protein, 9 aa, Homo Sapiens
IRLLVVIGA

SEQ ID NO: 705211 - protein, 9 aa, Homo Sapiens
IATACRCNP

SEQ ID NO: 705212 - protein, 9 aa, Homo Sapiens
VGIAVSWVL

SEQ ID NO: 705213 - protein, 9 aa, Homo Sapiens
TCKTSLHMC

SEQ ID NO: 705214 - protein, 9 aa, Homo Sapiens
EKEKKIFLE

SEQ ID NO: 705215 - protein, 9 aa, Homo Sapiens
CPLCMNYFT

SEQ ID NO: 705216 - protein, 9 aa, Homo Sapiens
SPSPSQLPE

SEQ ID NO: 705217 - protein, 9 aa, Homo Sapiens
LSLFTTIYA

SEQ ID NO: 705218 - protein, 9 aa, Homo Sapiens
SPCIIEKKD

SEQ ID NO: 705219 - protein, 9 aa, Homo Sapiens
SLMDNKVVK

SEQ ID NO: 705220 - protein, 9 aa, Homo Sapiens
KTSWTEPAD

SEQ ID NO: 705221 - protein, 9 aa, Homo Sapiens
IELLHLSRS

SEQ ID NO: 705222 - protein, 9 aa, Homo Sapiens
MSVFCQKES

SEQ ID NO: 705223 - protein, 9 aa, Homo Sapiens
NECGKTFVR

SEQ ID NO: 705224 - protein, 9 aa, Homo Sapiens
FDVQLGYSV

SEQ ID NO: 705225 - protein, 9 aa, Homo Sapiens
LAQQWFGNL

SEQ ID NO: 705226 - protein, 9 aa, Homo Sapiens
YGFAKAMIH

SEQ ID NO: 705227 - protein, 9 aa, Homo Sapiens
IDITDMNSE

SEQ ID NO: 705228 - protein, 9 aa, Homo Sapiens
QFTDEYLLE

SEQ ID NO: 705229 - protein, 9 aa, Homo Sapiens
LMDNKVVKN

SEQ ID NO: 705230 - protein, 9 aa, Homo Sapiens
PFHIKVTPD

SEQ ID NO: 705231 - protein, 9 aa, Homo Sapiens
LLGVEPGPL

SEQ ID NO: 705232 - protein, 9 aa, Homo Sapiens
AITFRARVK

SEQ ID NO: 705233 - protein, 9 aa, Homo Sapiens
KMDTMYPFI

SEQ ID NO: 705234 - protein, 9 aa, Homo Sapiens
ILNFIGNSN

SEQ ID NO: 705235 - protein, 9 aa, Homo Sapiens
SFWEPGEPN

SEQ ID NO: 705236 - protein, 9 aa, Homo Sapiens
LDIGYVDLS

SEQ ID NO: 705237 - protein, 9 aa, Homo Sapiens
RTEQDFYAR

SEQ ID NO: 705238 - protein, 9 aa, Homo Sapiens
SNQHDGTLH

SEQ ID NO: 705239 - protein, 9 aa, Homo Sapiens
WWSIALWVV

SEQ ID NO: 705240 - protein, 9 aa, Homo Sapiens
LPHPLNPGL

SEQ ID NO: 705241 - protein, 9 aa, Homo Sapiens
HAPQVRYPQ

SEQ ID NO: 705242 - protein, 9 aa, Homo Sapiens
ASGCSMLSP

SEQ ID NO: 705243 - protein, 9 aa, Homo Sapiens
ALEPYPASE

SEQ ID NO: 705244 - protein, 9 aa, Homo Sapiens
CNGQAHGNK

SEQ ID NO: 705245 - protein, 9 aa, Homo Sapiens
YDPNSLPQF

SEQ ID NO: 705246 - protein, 9 aa, Homo Sapiens
KRAAITLHH

SEQ ID NO: 705247 - protein, 9 aa, Homo Sapiens
RPFNGGSFL

SEQ ID NO: 705248 - protein, 9 aa, Homo Sapiens
VKENMTSGS

SEQ ID NO: 705249 - protein, 9 aa, Homo Sapiens
SEITYYFPC

SEQ ID NO: 705250 - protein, 9 aa, Homo Sapiens
SHDVVSLLK

SEQ ID NO: 705251 - protein, 9 aa, Homo Sapiens
KVQGHPAHF

SEQ ID NO: 705252 - protein, 9 aa, Homo Sapiens
RGRSSSRSP

SEQ ID NO: 705253 - protein, 9 aa, Homo Sapiens
PRSHDVVSL

SEQ ID NO: 705254 - protein, 9 aa, Homo Sapiens
EALLLGVEP

SEQ ID NO: 705255 - protein, 9 aa, Homo Sapiens
SYNNCATKL

SEQ ID NO: 705256 - protein, 9 aa, Homo Sapiens
CDVFMQCRL

SEQ ID NO: 705257 - protein, 9 aa, Homo Sapiens
YIGEKEKKI

SEQ ID NO: 705258 - protein, 9 aa, Homo Sapiens
FCQKESFPA

SEQ ID NO: 705259 - protein, 9 aa, Homo Sapiens
SNPSCCCTV

SEQ ID NO: 705260 - protein, 9 aa, Homo Sapiens
YAITFRARV

SEQ ID NO: 705261 - protein, 9 aa, Homo Sapiens
YNNCATKLF

SEQ ID NO: 705262 - protein, 9 aa, Homo Sapiens
AYVGIAVSW

SEQ ID NO: 705263 - protein, 9 aa, Homo Sapiens
RITPFDVQL

SEQ ID NO: 705264 - protein, 9 aa, Homo Sapiens
LPTFFCHIC

SEQ ID NO: 705265 - protein, 9 aa, Homo Sapiens
APFEQESKI

SEQ ID NO: 705266 - protein, 9 aa, Homo Sapiens
GEGGVAALC

SEQ ID NO: 705267 - protein, 9 aa, Homo Sapiens
RCPSKKKVQ

SEQ ID NO: 705268 - protein, 9 aa, Homo Sapiens
CRGAQNMEF

SEQ ID NO: 705269 - protein, 9 aa, Homo Sapiens
RSSSRSPKR

SEQ ID NO: 705270 - protein, 9 aa, Homo Sapiens
PRRGRSSSR

SEQ ID NO: 705271 - protein, 9 aa, Homo Sapiens
YDRYIAVSQ

SEQ ID NO: 705272 - protein, 9 aa, Homo Sapiens
LVLCILVII

SEQ ID NO: 705273 - protein, 9 aa, Homo Sapiens
ISFGGYISQ

SEQ ID NO: 705274 - protein, 9 aa, Homo Sapiens
DEYLLEQRS

SEQ ID NO: 705275 - protein, 9 aa, Homo Sapiens
HLRGPQAVP

SEQ ID NO: 705276 - protein, 9 aa, Homo Sapiens
RKTTACTEF

SEQ ID NO: 705277 - protein, 9 aa, Homo Sapiens
QKRAAITLH

SEQ ID NO: 705278 - protein, 9 aa, Homo Sapiens
NLDENSQEI

SEQ ID NO: 705279 - protein, 9 aa, Homo Sapiens
GLIMYGFAK

SEQ ID NO: 705280 - protein, 9 aa, Homo Sapiens
VFRCYNSTE

SEQ ID NO: 705281 - protein, 9 aa, Homo Sapiens
CSFFHDFLY

SEQ ID NO: 705282 - protein, 9 aa, Homo Sapiens
HSMGFIHTD

SEQ ID NO: 705283 - protein, 9 aa, Homo Sapiens
VPRAHNHKV

SEQ ID NO: 705284 - protein, 9 aa, Homo Sapiens
LNPGLLSSL

SEQ ID NO: 705285 - protein, 9 aa, Homo Sapiens
SVSNQHDGT

SEQ ID NO: 705286 - protein, 9 aa, Homo Sapiens
TTTARSLMD

SEQ ID NO: 705287 - protein, 9 aa, Homo Sapiens
EPGEPNNIH

SEQ ID NO: 705288 - protein, 9 aa, Homo Sapiens
ALGTLAAGF

SEQ ID NO: 705289 - protein, 9 aa, Homo Sapiens
QCHLGQKED

SEQ ID NO: 705290 - protein, 9 aa, Homo Sapiens
KDFGDLEPR

SEQ ID NO: 705291 - protein, 9 aa, Homo Sapiens
ASGTLLRGV

SEQ ID NO: 705292 - protein, 9 aa, Homo Sapiens
CSYIFAKDF

SEQ ID NO: 705293 - protein, 9 aa, Homo Sapiens
CNIEDERYS

SEQ ID NO: 705294 - protein, 9 aa, Homo Sapiens
AREPVVLCI

SEQ ID NO: 705295 - protein, 9 aa, Homo Sapiens
GEPNNIHDE

SEQ ID NO: 705296 - protein, 9 aa, Homo Sapiens
PTIELLHLS

SEQ ID NO: 705297 - protein, 9 aa, Homo Sapiens
HELAQQWFG

SEQ ID NO: 705298 - protein, 9 aa, Homo Sapiens
VIGGYLDPR

SEQ ID NO: 705299 - protein, 9 aa, Homo Sapiens
LLHLSRSPI

SEQ ID NO: 705300 - protein, 9 aa, Homo Sapiens
GLCRCVAFN

SEQ ID NO: 705301 - protein, 9 aa, Homo Sapiens
VQRGATCKT

SEQ ID NO: 705302 - protein, 9 aa, Homo Sapiens
GGLPAVQRQ

SEQ ID NO: 705303 - protein, 9 aa, Homo Sapiens
AAHSLRAAP

SEQ ID NO: 705304 - protein, 9 aa, Homo Sapiens
IEHLSVVFR

SEQ ID NO: 705305 - protein, 9 aa, Homo Sapiens
ASSTCGLST

SEQ ID NO: 705306 - protein, 9 aa, Homo Sapiens
SGPSSLTEA

SEQ ID NO: 705307 - protein, 9 aa, Homo Sapiens
RNLFFYVGF

SEQ ID NO: 705308 - protein, 9 aa, Homo Sapiens
SECANFIRV

SEQ ID NO: 705309 - protein, 9 aa, Homo Sapiens
EPVPRSHDV

SEQ ID NO: 705310 - protein, 9 aa, Homo Sapiens
RGYCDVFMQ

SEQ ID NO: 705311 - protein, 9 aa, Homo Sapiens
NCATKLFFI

SEQ ID NO: 705312 - protein, 9 aa, Homo Sapiens
YIRLLVVIG

SEQ ID NO: 705313 - protein, 9 aa, Homo Sapiens
IVFWKYRCF

SEQ ID NO: 705314 - protein, 9 aa, Homo Sapiens
PHPLNPGLL

SEQ ID NO: 705315 - protein, 9 aa, Homo Sapiens
NGANVQGHL

SEQ ID NO: 705316 - protein, 9 aa, Homo Sapiens
REPVVLCIA

SEQ ID NO: 705317 - protein, 9 aa, Homo Sapiens
PALGTLAAG

SEQ ID NO: 705318 - protein, 9 aa, Homo Sapiens
DILVIGGYL

SEQ ID NO: 705319 - protein, 9 aa, Homo Sapiens
ITFRARVKV

SEQ ID NO: 705320 - protein, 9 aa, Homo Sapiens
GPLIPPCGW

SEQ ID NO: 705321 - protein, 9 aa, Homo Sapiens
ALAQSEQQG

SEQ ID NO: 705322 - protein, 9 aa, Homo Sapiens
EIIAIESGP

SEQ ID NO: 705323 - protein, 9 aa, Homo Sapiens
AKDFGDLEP

SEQ ID NO: 705324 - protein, 9 aa, Homo Sapiens
LLPLQRLHL

SEQ ID NO: 705325 - protein, 9 aa, Homo Sapiens
RQGPLIPPC

SEQ ID NO: 705326 - protein, 9 aa, Homo Sapiens
EQARVLVDD

SEQ ID NO: 705327 - protein, 9 aa, Homo Sapiens
CHICSFFHD

SEQ ID NO: 705328 - protein, 9 aa, Homo Sapiens
LGTKEFPLI

SEQ ID NO: 705329 - protein, 9 aa, Homo Sapiens
EHLSVVFRC

SEQ ID NO: 705330 - protein, 9 aa, Homo Sapiens
SQPFMSLRY

SEQ ID NO: 705331 - protein, 9 aa, Homo Sapiens
IGLIMYGFA

SEQ ID NO: 705332 - protein, 9 aa, Homo Sapiens
SEMQLRWLS

SEQ ID NO: 705333 - protein, 9 aa, Homo Sapiens
GGYLDPRQE

SEQ ID NO: 705334 - protein, 9 aa, Homo Sapiens
SLHLRGPQA

SEQ ID NO: 705335 - protein, 9 aa, Homo Sapiens
HICSSNPSC

SEQ ID NO: 705336 - protein, 9 aa, Homo Sapiens
SLRYAGGPR

SEQ ID NO: 705337 - protein, 9 aa, Homo Sapiens
AQQWFGNLV

SEQ ID NO: 705338 - protein, 9 aa, Homo Sapiens
INGRQVDSP

SEQ ID NO: 705339 - protein, 9 aa, Homo Sapiens
MAHILLFRG

SEQ ID NO: 705340 - protein, 9 aa, Homo Sapiens
REALLLGVE

SEQ ID NO: 705341 - protein, 9 aa, Homo Sapiens
EVECLTESH

SEQ ID NO: 705342 - protein, 9 aa, Homo Sapiens
PSCNGQAHG

SEQ ID NO: 705343 - protein, 9 aa, Homo Sapiens
VLNHLREPF

SEQ ID NO: 705344 - protein, 9 aa, Homo Sapiens
YPASESSKL

SEQ ID NO: 705345 - protein, 9 aa, Homo Sapiens
GDSSHSEKR

SEQ ID NO: 705346 - protein, 9 aa, Homo Sapiens
LSEMQLRWL

SEQ ID NO: 705347 - protein, 9 aa, Homo Sapiens
LSQPGLSQR

SEQ ID NO: 705348 - protein, 9 aa, Homo Sapiens
HLGQKEDVY

SEQ ID NO: 705349 - protein, 9 aa, Homo Sapiens
HIAIWWSIA

SEQ ID NO: 705350 - protein, 9 aa, Homo Sapiens
WEPGEPNNI

SEQ ID NO: 705351 - protein, 9 aa, Homo Sapiens
HTPGQPFHI

SEQ ID NO: 705352 - protein, 9 aa, Homo Sapiens
VPARNLFFY

SEQ ID NO: 705353 - protein, 9 aa, Homo Sapiens
ILHPTPVTP

SEQ ID NO: 705354 - protein, 9 aa, Homo Sapiens
HNHKVCWVK

SEQ ID NO: 705355 - protein, 9 aa, Homo Sapiens
KVYHGGLAE

SEQ ID NO: 705356 - protein, 9 aa, Homo Sapiens
VYHGGLAEE

SEQ ID NO: 705357 - protein, 9 aa, Homo Sapiens
ARVLVDDVT

SEQ ID NO: 705358 - protein, 9 aa, Homo Sapiens
IAQRQCIFC

SEQ ID NO: 705359 - protein, 9 aa, Homo Sapiens
RIAKKNFDK

SEQ ID NO: 705360 - protein, 9 aa, Homo Sapiens
ICRGAQNME

SEQ ID NO: 705361 - protein, 9 aa, Homo Sapiens
LINGRQVDS

SEQ ID NO: 705362 - protein, 9 aa, Homo Sapiens
QHAPQVRYP

SEQ ID NO: 705363 - protein, 9 aa, Homo Sapiens
LFRITPFDV

SEQ ID NO: 705364 - protein, 9 aa, Homo Sapiens
SSAAHLLLP

SEQ ID NO: 705365 - protein, 9 aa, Homo Sapiens
AGNTTVKQS

SEQ ID NO: 705366 - protein, 9 aa, Homo Sapiens
EGQELEVIR

SEQ ID NO: 705367 - protein, 9 aa, Homo Sapiens
GPTSRPPPS

SEQ ID NO: 705368 - protein, 9 aa, Homo Sapiens
LGVEPGPLG

SEQ ID NO: 705369 - protein, 9 aa, Homo Sapiens
LAEVECLTE

SEQ ID NO: 705370 - protein, 9 aa, Homo Sapiens
PPHHYDPNS

SEQ ID NO: 705371 - protein, 9 aa, Homo Sapiens
VFWKYRCFQ

SEQ ID NO: 705372 - protein, 9 aa, Homo Sapiens
RMCQAGNTT

SEQ ID NO: 705373 - protein, 9 aa, Homo Sapiens
ENMTSGSTL

SEQ ID NO: 705374 - protein, 9 aa, Homo Sapiens
HTRALFVRQ

SEQ ID NO: 705375 - protein, 9 aa, Homo Sapiens
PAHFCHHGG

SEQ ID NO: 705376 - protein, 9 aa, Homo Sapiens
RYIAVSQPL

SEQ ID NO: 705377 - protein, 9 aa, Homo Sapiens
SSTPILHPT

SEQ ID NO: 705378 - protein, 9 aa, Homo Sapiens
SEQARVLVD

SEQ ID NO: 705379 - protein, 9 aa, Homo Sapiens
TTARSLMDN

SEQ ID NO: 705380 - protein, 9 aa, Homo Sapiens
FGHICSSNP

SEQ ID NO: 705381 - protein, 9 aa, Homo Sapiens
ELAQQWFGN

SEQ ID NO: 705382 - protein, 9 aa, Homo Sapiens
EPVVLCIAS

SEQ ID NO: 705383 - protein, 9 aa, Homo Sapiens
HKKLGTKEF

SEQ ID NO: 705384 - protein, 9 aa, Homo Sapiens
SFGGYISQM

SEQ ID NO: 705385 - protein, 9 aa, Homo Sapiens
QVDSPMSTS

SEQ ID NO: 705386 - protein, 9 aa, Homo Sapiens
HAYVGIAVS

SEQ ID NO: 705387 - protein, 9 aa, Homo Sapiens
KTDSGLCRC

SEQ ID NO: 705388 - protein, 9 aa, Homo Sapiens
ILAYWIIFT

SEQ ID NO: 705389 - protein, 9 aa, Homo Sapiens
ITDMNSEIT

SEQ ID NO: 705390 - protein, 9 aa, Homo Sapiens
GDVCLLPGH

SEQ ID NO: 705391 - protein, 9 aa, Homo Sapiens
RSHDVVSLL

SEQ ID NO: 705392 - protein, 9 aa, Homo Sapiens
LGQKEDVYH

SEQ ID NO: 705393 - protein, 9 aa, Homo Sapiens
YLLRSLWVP

SEQ ID NO: 705394 - protein, 9 aa, Homo Sapiens
FRGNIQEAE

SEQ ID NO: 705395 - protein, 9 aa, Homo Sapiens
MTGQNNTTN

SEQ ID NO: 705396 - protein, 9 aa, Homo Sapiens
DTSKQKKMD

SEQ ID NO: 705397 - protein, 9 aa, Homo Sapiens
ITTEMTGQN

SEQ ID NO: 705398 - protein, 9 aa, Homo Sapiens
IHETKCHEV

SEQ ID NO: 705399 - protein, 9 aa, Homo Sapiens
TEVKENMTS

SEQ ID NO: 705400 - protein, 9 aa, Homo Sapiens
LEAALAQSE

SEQ ID NO: 705401 - protein, 9 aa, Homo Sapiens
LQGPYLLRS

SEQ ID NO: 705402 - protein, 9 aa, Homo Sapiens
RSLMDNKVV

SEQ ID NO: 705403 - protein, 9 aa, Homo Sapiens
TSWTEPADF

SEQ ID NO: 705404 - protein, 9 aa, Homo Sapiens
LTISSPCII

SEQ ID NO: 705405 - protein, 9 aa, Homo Sapiens
LHLRGPQAV

SEQ ID NO: 705406 - protein, 9 aa, Homo Sapiens
IALFIKIFS

SEQ ID NO: 705407 - protein, 9 aa, Homo Sapiens
DNALGEGGV

SEQ ID NO: 705408 - protein, 9 aa, Homo Sapiens
FWEPGEPNN

SEQ ID NO: 705409 - protein, 9 aa, Homo Sapiens
STPILHPTP

SEQ ID NO: 705410 - protein, 9 aa, Homo Sapiens
IGDVCLLPG

SEQ ID NO: 705411 - protein, 9 aa, Homo Sapiens
SGLCRCVAF

SEQ ID NO: 705412 - protein, 9 aa, Homo Sapiens
QRGATCKTS

SEQ ID NO: 705413 - protein, 9 aa, Homo Sapiens
LSHTPGQPF

SEQ ID NO: 705414 - protein, 9 aa, Homo Sapiens
CSSNPSCCC

SEQ ID NO: 705415 - protein, 9 aa, Homo Sapiens
TGNGANVQG

SEQ ID NO: 705416 - protein, 9 aa, Homo Sapiens
LNFIGNSNH

SEQ ID NO: 705417 - protein, 9 aa, Homo Sapiens
STCGLSTAQ

SEQ ID NO: 705418 - protein, 9 aa, Homo Sapiens
KNIKIMEVP

SEQ ID NO: 705419 - protein, 9 aa, Homo Sapiens
DSGLCRCVA

SEQ ID NO: 705420 - protein, 9 aa, Homo Sapiens
PSKKKVQGH

SEQ ID NO: 705421 - protein, 9 aa, Homo Sapiens
QTQVRIAKK

SEQ ID NO: 705422 - protein, 9 aa, Homo Sapiens
LNVIYEAYL

SEQ ID NO: 705423 - protein, 9 aa, Homo Sapiens
HKVCWVKEA

SEQ ID NO: 705424 - protein, 9 aa, Homo Sapiens
LGERSGVIL

SEQ ID NO: 705425 - protein, 9 aa, Homo Sapiens
CLLPGHPDA

SEQ ID NO: 705426 - protein, 9 aa, Homo Sapiens
PLNPGLLSS

SEQ ID NO: 705427 - protein, 9 aa, Homo Sapiens
PVVLCIASS

SEQ ID NO: 705428 - protein, 9 aa, Homo Sapiens
KEISFGGYI

SEQ ID NO: 705429 - protein, 9 aa, Homo Sapiens
SGCSMLSPL

SEQ ID NO: 705430 - protein, 9 aa, Homo Sapiens
LDENSQEIL

SEQ ID NO: 705431 - protein, 9 aa, Homo Sapiens
LEQRSHLYG

SEQ ID NO: 705432 - protein, 9 aa, Homo Sapiens
SWVLAVASS

SEQ ID NO: 705433 - protein, 9 aa, Homo Sapiens
IAKKNFDKL

SEQ ID NO: 705434 - protein, 9 aa, Homo Sapiens
MQLRWLSVQ

SEQ ID NO: 705435 - protein, 9 aa, Homo Sapiens
VECLTESHQ

SEQ ID NO: 705436 - protein, 9 aa, Homo Sapiens
VLCILVIIH

SEQ ID NO: 705437 - protein, 9 aa, Homo Sapiens
FHFLDTLQC

SEQ ID NO: 705438 - protein, 9 aa, Homo Sapiens
TKEFPLIDQ

SEQ ID NO: 705439 - protein, 9 aa, Homo Sapiens
FYARLIDSM

SEQ ID NO: 705440 - protein, 9 aa, Homo Sapiens
DRYIAVSQP

SEQ ID NO: 705441 - protein, 9 aa, Homo Sapiens
LALVEDLKV

SEQ ID NO: 705442 - protein, 9 aa, Homo Sapiens
SKVYHGGLA

SEQ ID NO: 705443 - protein, 9 aa, Homo Sapiens
SQPGLSQRG

SEQ ID NO: 705444 - protein, 9 aa, Homo Sapiens
TTKTDSGLC

SEQ ID NO: 705445 - protein, 9 aa, Homo Sapiens
PRPGGLPAV

SEQ ID NO: 705446 - protein, 9 aa, Homo Sapiens
IYVSKVYHG

SEQ ID NO: 705447 - protein, 9 aa, Homo Sapiens
LPAATLALV

SEQ ID NO: 705448 - protein, 9 aa, Homo Sapiens
TRNEIIAIE

SEQ ID NO: 705449 - protein, 9 aa, Homo Sapiens
LFLSIHLIW

SEQ ID NO: 705450 - protein, 9 aa, Homo Sapiens
SKMYLDIGY

SEQ ID NO: 705451 - protein, 9 aa, Homo Sapiens
SSNDSLNGV

SEQ ID NO: 705452 - protein, 9 aa, Homo Sapiens
THTRALFVR

SEQ ID NO: 705453 - protein, 9 aa, Homo Sapiens
GLACNIEDE

SEQ ID NO: 705454 - protein, 9 aa, Homo Sapiens
PTFFCHICS

SEQ ID NO: 705455 - protein, 9 aa, Homo Sapiens
MQCRLVDAD

SEQ ID NO: 705456 - protein, 9 aa, Homo Sapiens
AEEYEILNR

SEQ ID NO: 705457 - protein, 9 aa, Homo Sapiens
DFGDLEPRY

SEQ ID NO: 705458 - protein, 9 aa, Homo Sapiens
VVLCIASSR

SEQ ID NO: 705459 - protein, 9 aa, Homo Sapiens
TTVKQSRYR

SEQ ID NO: 705460 - protein, 9 aa, Homo Sapiens
EILNFIGNS

SEQ ID NO: 705461 - protein, 9 aa, Homo Sapiens
SLDRIPDTG

SEQ ID NO: 705462 - protein, 9 aa, Homo Sapiens
AAPFEQESK

SEQ ID NO: 705463 - protein, 9 aa, Homo Sapiens
NDDNFLNVI

SEQ ID NO: 705464 - protein, 9 aa, Homo Sapiens
PLCMNYFTD

SEQ ID NO: 705465 - protein, 9 aa, Homo Sapiens
LCIASSRLP

SEQ ID NO: 705466 - protein, 9 aa, Homo Sapiens
ETKCHEVLT

SEQ ID NO: 705467 - protein, 9 aa, Homo Sapiens
HLGCHRKAG

SEQ ID NO: 705468 - protein, 9 aa, Homo Sapiens
IIEKKDLGP

SEQ ID NO: 705469 - protein, 9 aa, Homo Sapiens
QVHGHLSSA

SEQ ID NO: 705470 - protein, 9 aa, Homo Sapiens
DSLNGVSSS

SEQ ID NO: 705471 - protein, 9 aa, Homo Sapiens
QVRIAKKNF

SEQ ID NO: 705472 - protein, 9 aa, Homo Sapiens
QPFMSLRYA

SEQ ID NO: 705473 - protein, 9 aa, Homo Sapiens
MNSEITYYF

SEQ ID NO: 705474 - protein, 9 aa, Homo Sapiens
IRTEQDFYA

SEQ ID NO: 705475 - protein, 9 aa, Homo Sapiens
MDNKVVKNS

SEQ ID NO: 705476 - protein, 9 aa, Homo Sapiens
TDMNSEITY

SEQ ID NO: 705477 - protein, 9 aa, Homo Sapiens
CRCVAFNEH

SEQ ID NO: 705478 - protein, 9 aa, Homo Sapiens
NQHDGTLHG

SEQ ID NO: 705479 - protein, 9 aa, Homo Sapiens
NHLREPFAK

SEQ ID NO: 705480 - protein, 9 aa, Homo Sapiens
VSNQHDGTL

SEQ ID NO: 705481 - protein, 9 aa, Homo Sapiens
ILLFRGNIQ

SEQ ID NO: 705482 - protein, 9 aa, Homo Sapiens
CPQDSSCVI

SEQ ID NO: 705483 - protein, 9 aa, Homo Sapiens
YFTEILNFI

SEQ ID NO: 705484 - protein, 9 aa, Homo Sapiens
AEVECLTES

SEQ ID NO: 705485 - protein, 9 aa, Homo Sapiens
VQGHPAHFC

SEQ ID NO: 705486 - protein, 9 aa, Homo Sapiens
PCGWPGNTL

SEQ ID NO: 705487 - protein, 9 aa, Homo Sapiens
NSKLEAALA

SEQ ID NO: 705488 - protein, 9 aa, Homo Sapiens
GRQAQGPSG

SEQ ID NO: 705489 - protein, 9 aa, Homo Sapiens
AYFTEILNF

SEQ ID NO: 705490 - protein, 9 aa, Homo Sapiens
GHPAHFCHH

SEQ ID NO: 705491 - protein, 9 aa, Homo Sapiens
AALAQSEQQ

SEQ ID NO: 705492 - protein, 9 aa, Homo Sapiens
AHGNKLLAP

SEQ ID NO: 705493 - protein, 9 aa, Homo Sapiens
VTLSFWEPG

SEQ ID NO: 705494 - protein, 9 aa, Homo Sapiens
RVVRRGKCL

SEQ ID NO: 705495 - protein, 9 aa, Homo Sapiens
EISFGGYIS

SEQ ID NO: 705496 - protein, 9 aa, Homo Sapiens
CSMLSPLQT

SEQ ID NO: 705497 - protein, 9 aa, Homo Sapiens
DGTLHGICF

SEQ ID NO: 705498 - protein, 9 aa, Homo Sapiens
HSEKRTAKR

SEQ ID NO: 705499 - protein, 9 aa, Homo Sapiens
YISQMFFIH

SEQ ID NO: 705500 - protein, 9 aa, Homo Sapiens
QKKMDTMYP

SEQ ID NO: 705501 - protein, 9 aa, Homo Sapiens
EYEILNRSP

SEQ ID NO: 705502 - protein, 9 aa, Homo Sapiens
HSLRAAPFE

SEQ ID NO: 705503 - protein, 9 aa, Homo Sapiens
HPAHFCHHG

SEQ ID NO: 705504 - protein, 9 aa, Homo Sapiens
AHFCHHGGV

SEQ ID NO: 705505 - protein, 9 aa, Homo Sapiens
ATCKTSLHM

SEQ ID NO: 705506 - protein, 9 aa, Homo Sapiens
EFRDKIACN

SEQ ID NO: 705507 - protein, 9 aa, Homo Sapiens
GRSSSRSPK

SEQ ID NO: 705508 - protein, 9 aa, Homo Sapiens
PPPHHYDPN

SEQ ID NO: 705509 - protein, 9 aa, Homo Sapiens
EAYRISLDR

SEQ ID NO: 705510 - protein, 9 aa, Homo Sapiens
MSSTPILHP

SEQ ID NO: 705511 - protein, 9 aa, Homo Sapiens
MYLDIGYVD

SEQ ID NO: 705512 - protein, 9 aa, Homo Sapiens
SCNGQAHGN

SEQ ID NO: 705513 - protein, 9 aa, Homo Sapiens
TFFCHICSF

SEQ ID NO: 705514 - protein, 9 aa, Homo Sapiens
CGYPSLFLS

SEQ ID NO: 705515 - protein, 9 aa, Homo Sapiens
GQPFHIKVT

SEQ ID NO: 705516 - protein, 9 aa, Homo Sapiens
RGKTSWTEP

SEQ ID NO: 705517 - protein, 9 aa, Homo Sapiens
IGEKEKKIF

SEQ ID NO: 705518 - protein, 9 aa, Homo Sapiens
KMAHILLFR

SEQ ID NO: 705519 - protein, 9 aa, Homo Sapiens
TIAQRQCIF

SEQ ID NO: 705520 - protein, 9 aa, Homo Sapiens
GEKEKKIFL

SEQ ID NO: 705521 - protein, 9 aa, Homo Sapiens
FVSFIALFI

SEQ ID NO: 705522 - protein, 9 aa, Homo Sapiens
VWEAYRISL

SEQ ID NO: 705523 - protein, 9 aa, Homo Sapiens
SFIALFIKI

SEQ ID NO: 705524 - protein, 9 aa, Homo Sapiens
QNNTTNFMT

SEQ ID NO: 705525 - protein, 9 aa, Homo Sapiens
CIYKKVRPF

SEQ ID NO: 705526 - protein, 9 aa, Homo Sapiens
RDIKDCLID

SEQ ID NO: 705527 - protein, 9 aa, Homo Sapiens
RTAKRKGSA

SEQ ID NO: 705528 - protein, 9 aa, Homo Sapiens
SPSQLPESK

SEQ ID NO: 705529 - protein, 9 aa, Homo Sapiens
YFTDPVTID

SEQ ID NO: 705530 - protein, 9 aa, Homo Sapiens
EAALAQSEQ

SEQ ID NO: 705531 - protein, 9 aa, Homo Sapiens
VIAHELAQQ

SEQ ID NO: 705532 - protein, 9 aa, Homo Sapiens
SNLVLCILV

SEQ ID NO: 705533 - protein, 9 aa, Homo Sapiens
GVFHFLDTL

SEQ ID NO: 705534 - protein, 9 aa, Homo Sapiens
CGLSTAQKY

SEQ ID NO: 705535 - protein, 9 aa, Homo Sapiens
HASGTLLRG

SEQ ID NO: 705536 - protein, 9 aa, Homo Sapiens
DENSQEILS

SEQ ID NO: 705537 - protein, 9 aa, Homo Sapiens
VVFRCYNST

SEQ ID NO: 705538 - protein, 9 aa, Homo Sapiens
EELIKALKN

SEQ ID NO: 705539 - protein, 9 aa, Homo Sapiens
LLLGVEPGP

SEQ ID NO: 705540 - protein, 9 aa, Homo Sapiens
LHHYFRTWQ

SEQ ID NO: 705541 - protein, 9 aa, Homo Sapiens
TARSLMDNK

SEQ ID NO: 705542 - protein, 9 aa, Homo Sapiens
VCWVKEAGD

SEQ ID NO: 705543 - protein, 9 aa, Homo Sapiens
EVKENMTSG

SEQ ID NO: 705544 - protein, 9 aa, Homo Sapiens
RYPQLQGPY

SEQ ID NO: 705545 - protein, 9 aa, Homo Sapiens
DSSCVIATA

SEQ ID NO: 705546 - protein, 9 aa, Homo Sapiens
RWLSVQVFT

SEQ ID NO: 705547 - protein, 9 aa, Homo Sapiens
LPAVQRQHA

SEQ ID NO: 705548 - protein, 9 aa, Homo Sapiens
ISVQRASEA

SEQ ID NO: 705549 - protein, 9 aa, Homo Sapiens
MLMSVFCQK

SEQ ID NO: 705550 - protein, 9 aa, Homo Sapiens
FWKYRCFQR

SEQ ID NO: 705551 - protein, 9 aa, Homo Sapiens
SSLHLRGPQ

SEQ ID NO: 705552 - protein, 9 aa, Homo Sapiens
SAAHLLLPL

SEQ ID NO: 705553 - protein, 9 aa, Homo Sapiens
GKCLKLTVD

SEQ ID NO: 705554 - protein, 9 aa, Homo Sapiens
EAGDPRPGG

SEQ ID NO: 705555 - protein, 9 aa, Homo Sapiens
SESSKLVSE

SEQ ID NO: 705556 - protein, 9 aa, Homo Sapiens
GPSGQRPQV

SEQ ID NO: 705557 - protein, 9 aa, Homo Sapiens
RARVKVKHC

SEQ ID NO: 705558 - protein, 9 aa, Homo Sapiens
QGGRQAQGP

SEQ ID NO: 705559 - protein, 9 aa, Homo Sapiens
YWIIFTVFQ

SEQ ID NO: 705560 - protein, 9 aa, Homo Sapiens
LNGVSSSDG

SEQ ID NO: 705561 - protein, 9 aa, Homo Sapiens
QPGLSQRGR

SEQ ID NO: 705562 - protein, 9 aa, Homo Sapiens
KPKAEEYEI

SEQ ID NO: 705563 - protein, 9 aa, Homo Sapiens
VSQPLHYTL

SEQ ID NO: 705564 - protein, 9 aa, Homo Sapiens
RQCIFCTLC

SEQ ID NO: 705565 - protein, 9 aa, Homo Sapiens
DTLQCGYPS

SEQ ID NO: 705566 - protein, 9 aa, Homo Sapiens
VKEAGDPRP

SEQ ID NO: 705567 - protein, 9 aa, Homo Sapiens
QIFLLSLFT

SEQ ID NO: 705568 - protein, 9 aa, Homo Sapiens
DDNFLNVIY

SEQ ID NO: 705569 - protein, 9 aa, Homo Sapiens
TEQDFYARL

SEQ ID NO: 705570 - protein, 9 aa, Homo Sapiens
LSRSPITTN

SEQ ID NO: 705571 - protein, 9 aa, Homo Sapiens
KESFPAERT

SEQ ID NO: 705572 - protein, 9 aa, Homo Sapiens
GHLSSAAHL

SEQ ID NO: 705573 - protein, 9 aa, Homo Sapiens
LLFRGNIQE

SEQ ID NO: 705574 - protein, 9 aa, Homo Sapiens
PGLSQRGRS

SEQ ID NO: 705575 - protein, 9 aa, Homo Sapiens
TLLRGVSPC

SEQ ID NO: 705576 - protein, 9 aa, Homo Sapiens
LHLSRSPIT

SEQ ID NO: 705577 - protein, 9 aa, Homo Sapiens
YPQLQGPYL

SEQ ID NO: 705578 - protein, 9 aa, Homo Sapiens
RVKVKHCRI

SEQ ID NO: 705579 - protein, 9 aa, Homo Sapiens
PQVHGHLSS

SEQ ID NO: 705580 - protein, 9 aa, Homo Sapiens
EDCGKAFKW

SEQ ID NO: 705581 - protein, 9 aa, Homo Sapiens
QCRLVDADG

SEQ ID NO: 705582 - protein, 9 aa, Homo Sapiens
ICSFFHDFL

SEQ ID NO: 705583 - protein, 9 aa, Homo Sapiens
VCLLPGHPD

SEQ ID NO: 705584 - protein, 9 aa, Homo Sapiens
YIAVSQPLH

SEQ ID NO: 705585 - protein, 9 aa, Homo Sapiens
QRASEAALQ

SEQ ID NO: 705586 - protein, 9 aa, Homo Sapiens
DANSECANF

SEQ ID NO: 705587 - protein, 9 aa, Homo Sapiens
TKTDSGLCR

SEQ ID NO: 705588 - protein, 9 aa, Homo Sapiens
TSGSTLVTN

SEQ ID NO: 705589 - protein, 9 aa, Homo Sapiens
FHIKVTPDH

SEQ ID NO: 705590 - protein, 9 aa, Homo Sapiens
VILVKQYKQ

SEQ ID NO: 705591 - protein, 9 aa, Homo Sapiens
YVSKVYHGG

SEQ ID NO: 705592 - protein, 9 aa, Homo Sapiens
QRGRSQPSV

SEQ ID NO: 705593 - protein, 9 aa, Homo Sapiens
TISSPCIIE

SEQ ID NO: 705594 - protein, 9 aa, Homo Sapiens
RAHNHKVCW

SEQ ID NO: 705595 - protein, 9 aa, Homo Sapiens
RRGKCLKLT

SEQ ID NO: 705596 - protein, 9 aa, Homo Sapiens
MCVLNHLRE

SEQ ID NO: 705597 - protein, 9 aa, Homo Sapiens
GQRPQVHGH

SEQ ID NO: 705598 - protein, 9 aa, Homo Sapiens
LIPPCGWPG

SEQ ID NO: 705599 - protein, 9 aa, Homo Sapiens
CRDIKDCLI

SEQ ID NO: 705600 - protein, 9 aa, Homo Sapiens
RGNIQEAEI

SEQ ID NO: 705601 - protein, 9 aa, Homo Sapiens
RIDITDMNS

SEQ ID NO: 705602 - protein, 9 aa, Homo Sapiens
ERSGVILVK

SEQ ID NO: 705603 - protein, 9 aa, Homo Sapiens
RAAPFEQES

SEQ ID NO: 705604 - protein, 9 aa, Homo Sapiens
PHHYDPNSL

SEQ ID NO: 705605 - protein, 9 aa, Homo Sapiens
SLINGRQVD

SEQ ID NO: 705606 - protein, 9 aa, Homo Sapiens
LSPSPSQLP

SEQ ID NO: 705607 - protein, 9 aa, Homo Sapiens
RQGGRQAQG

SEQ ID NO: 705608 - protein, 9 aa, Homo Sapiens
QMTTIAQRQ

SEQ ID NO: 705609 - protein, 9 aa, Homo Sapiens
NTTVKQSRY

SEQ ID NO: 705610 - protein, 9 aa, Homo Sapiens
AVSWVLAVA

SEQ ID NO: 705611 - protein, 9 aa, Homo Sapiens
HDGTLHGIC

SEQ ID NO: 705612 - protein, 9 aa, Homo Sapiens
KYYKCEDCG

SEQ ID NO: 705613 - protein, 9 aa, Homo Sapiens
KAEREALLL

SEQ ID NO: 705614 - protein, 9 aa, Homo Sapiens
THASGTLLR

SEQ ID NO: 705615 - protein, 9 aa, Homo Sapiens
RQVDSPMST

SEQ ID NO: 705616 - protein, 9 aa, Homo Sapiens
IKIFSSFTQ

SEQ ID NO: 705617 - protein, 9 aa, Homo Sapiens
HGGVFHFLD

SEQ ID NO: 705618 - protein, 9 aa, Homo Sapiens
KVQTQVRIA

SEQ ID NO: 705619 - protein, 9 aa, Homo Sapiens
GGVFHFLDT

SEQ ID NO: 705620 - protein, 9 aa, Homo Sapiens
KMYLDIGYV

SEQ ID NO: 705621 - protein, 9 aa, Homo Sapiens
TLSFWEPGE

SEQ ID NO: 705622 - protein, 9 aa, Homo Sapiens
GGYISQMFF

SEQ ID NO: 705623 - protein, 9 aa, Homo Sapiens
CVIATACRC

SEQ ID NO: 705624 - protein, 9 aa, Homo Sapiens
LRSLWVPAL

SEQ ID NO: 705625 - protein, 9 aa, Homo Sapiens
FSHIAIWWS

SEQ ID NO: 705626 - protein, 9 aa, Homo Sapiens
FSKMYLDIG

SEQ ID NO: 705627 - protein, 9 aa, Homo Sapiens
TPILHPTPV

SEQ ID NO: 705628 - protein, 9 aa, Homo Sapiens
AYRISLDRI

SEQ ID NO: 705629 - protein, 9 aa, Homo Sapiens
ISLDRIPDT

SEQ ID NO: 705630 - protein, 9 aa, Homo Sapiens
KEKKIFLEK

SEQ ID NO: 705631 - protein, 9 aa, Homo Sapiens
FTEILNFIG

SEQ ID NO: 705632 - protein, 9 aa, Homo Sapiens
GRQVDSPMS

SEQ ID NO: 705633 - protein, 9 aa, Homo Sapiens
KLGTKEFPL

SEQ ID NO: 705634 - protein, 9 aa, Homo Sapiens
SPLQTGAAR

SEQ ID NO: 705635 - protein, 9 aa, Homo Sapiens
CSEQARVLV

SEQ ID NO: 705636 - protein, 9 aa, Homo Sapiens
LSQRGRSQP

SEQ ID NO: 705637 - protein, 9 aa, Homo Sapiens
NNFETGNGA

SEQ ID NO: 705638 - protein, 9 aa, Homo Sapiens
LRYAGGPRP

SEQ ID NO: 705639 - protein, 9 aa, Homo Sapiens
ECLTESHQH

SEQ ID NO: 705640 - protein, 9 aa, Homo Sapiens
PTHASGTLL

SEQ ID NO: 705641 - protein, 9 aa, Homo Sapiens
FGGYISQMF

SEQ ID NO: 705642 - protein, 9 aa, Homo Sapiens
HTDVKPDNM

SEQ ID NO: 705643 - protein, 9 aa, Homo Sapiens
LTDNALGEG

SEQ ID NO: 705644 - protein, 9 aa, Homo Sapiens
PILHPTPVT

SEQ ID NO: 705645 - protein, 9 aa, Homo Sapiens
LEVIRTTLT

SEQ ID NO: 705646 - protein, 9 aa, Homo Sapiens
ISSPCIIEK

SEQ ID NO: 705647 - protein, 9 aa, Homo Sapiens
GYCDVFMQC

SEQ ID NO: 705648 - protein, 9 aa, Homo Sapiens
RPRKRQGGR

SEQ ID NO: 705649 - protein, 9 aa, Homo Sapiens
WFSHIAIWW

SEQ ID NO: 705650 - protein, 9 aa, Homo Sapiens
LMSVFCQKE

SEQ ID NO: 705651 - protein, 9 aa, Homo Sapiens
LCRCVAFNE

SEQ ID NO: 705652 - protein, 9 aa, Homo Sapiens
LHLGCHRKA

SEQ ID NO: 705653 - protein, 9 aa, Homo Sapiens
PKAEEYEIL

SEQ ID NO: 705654 - protein, 9 aa, Homo Sapiens
FCHHGGVFH

SEQ ID NO: 705655 - protein, 9 aa, Homo Sapiens
FLSIHLIWK

SEQ ID NO: 705656 - protein, 9 aa, Homo Sapiens
AHILLFRGN

SEQ ID NO: 705657 - protein, 9 aa, Homo Sapiens
SMGFIHTDV

SEQ ID NO: 705658 - protein, 9 aa, Homo Sapiens
VFHFLDTLQ

SEQ ID NO: 705659 - protein, 9 aa, Homo Sapiens
LPTESTQKN

SEQ ID NO: 705660 - protein, 9 aa, Homo Sapiens
HSGPSSLTE

SEQ ID NO: 705661 - protein, 9 aa, Homo Sapiens
DVVSLLKST

SEQ ID NO: 705662 - protein, 9 aa, Homo Sapiens
YRISLDRIP

SEQ ID NO: 705663 - protein, 9 aa, Homo Sapiens
LTEAPLKPP

SEQ ID NO: 705664 - protein, 9 aa, Homo Sapiens
TEAPLKPPG

SEQ ID NO: 705665 - protein, 9 aa, Homo Sapiens
CIASSRLPQ

SEQ ID NO: 705666 - protein, 9 aa, Homo Sapiens
PAATLALVE

SEQ ID NO: 705667 - protein, 9 aa, Homo Sapiens
ENSQEILSK

SEQ ID NO: 705668 - protein, 9 aa, Homo Sapiens
LVIGGYLDP

SEQ ID NO: 705669 - protein, 9 aa, Homo Sapiens
RSGVILVKQ

SEQ ID NO: 705670 - protein, 9 aa, Homo Sapiens
PQVRYPQLQ

SEQ ID NO: 705671 - protein, 9 aa, Homo Sapiens
SLNGVSSSD

SEQ ID NO: 705672 - protein, 9 aa, Homo Sapiens
FRITPFDVQ

SEQ ID NO: 705673 - protein, 9 aa, Homo Sapiens
ALKNIKIME

SEQ ID NO: 705674 - protein, 9 aa, Homo Sapiens
IIAIESGPV

SEQ ID NO: 705675 - protein, 9 aa, Homo Sapiens
CISVQRASE

SEQ ID NO: 705676 - protein, 9 aa, Homo Sapiens
VRRGKCLKL

SEQ ID NO: 705677 - protein, 9 aa, Homo Sapiens
HHYFRTWQT

SEQ ID NO: 705678 - protein, 9 aa, Homo Sapiens
TFSVSNQHD

SEQ ID NO: 705679 - protein, 9 aa, Homo Sapiens
YLLEQRSHL

SEQ ID NO: 705680 - protein, 9 aa, Homo Sapiens
EQDFYARLI

SEQ ID NO: 705681 - protein, 9 aa, Homo Sapiens
YLDIGYVDL

SEQ ID NO: 705682 - protein, 9 aa, Homo Sapiens
FLDTLQCGY

SEQ ID NO: 705683 - protein, 9 aa, Homo Sapiens
DITDMNSEI

SEQ ID NO: 705684 - protein, 9 aa, Homo Sapiens
NNCATKLFF

SEQ ID NO: 705685 - protein, 9 aa, Homo Sapiens
AVSQPLHYT

SEQ ID NO: 705686 - protein, 9 aa, Homo Sapiens
GLLSSLPIS

SEQ ID NO: 705687 - protein, 9 aa, Homo Sapiens
GPQAVPRAH

SEQ ID NO: 705688 - protein, 9 aa, Homo Sapiens
GLSTAQKYC

SEQ ID NO: 705689 - protein, 9 aa, Homo Sapiens
QGPSGQRPQ

SEQ ID NO: 705690 - protein, 9 aa, Homo Sapiens
RLHLGCHRK

SEQ ID NO: 705691 - protein, 9 aa, Homo Sapiens
KVYIGEKEK

SEQ ID NO: 705692 - protein, 9 aa, Homo Sapiens
SCVIATACR

SEQ ID NO: 705693 - protein, 9 aa, Homo Sapiens
NGVSSSDGY

SEQ ID NO: 705694 - protein, 9 aa, Homo Sapiens
RALFVRQAP

SEQ ID NO: 705695 - protein, 9 aa, Homo Sapiens
TTIAQRQCI

SEQ ID NO: 705696 - protein, 9 aa, Homo Sapiens
TAQKYCILS

SEQ ID NO: 705697 - protein, 9 aa, Homo Sapiens
CHHGGVFHF

SEQ ID NO: 705698 - protein, 9 aa, Homo Sapiens
GVILVKQYK

SEQ ID NO: 705699 - protein, 9 aa, Homo Sapiens
DQIHETKCH

SEQ ID NO: 705700 - protein, 9 aa, Homo Sapiens
HLSVVFRCY

SEQ ID NO: 705701 - protein, 9 aa, Homo Sapiens
MDTMYPFIV

SEQ ID NO: 705702 - protein, 9 aa, Homo Sapiens
QCGYPSLFL

SEQ ID NO: 705703 - protein, 9 aa, Homo Sapiens
ISYNNCATK

SEQ ID NO: 705704 - protein, 9 aa, Homo Sapiens
IAVSWVLAV

SEQ ID NO: 705705 - protein, 9 aa, Homo Sapiens
FIKIFSSFT

SEQ ID NO: 705706 - protein, 9 aa, Homo Sapiens
LLRGVSPCL

SEQ ID NO: 705707 - protein, 9 aa, Homo Sapiens
HGNKLLAPV

SEQ ID NO: 705708 - protein, 9 aa, Homo Sapiens
CILVIIHWN

SEQ ID NO: 705709 - protein, 9 aa, Homo Sapiens
SGLACNIED

SEQ ID NO: 705710 - protein, 9 aa, Homo Sapiens
SNDSLNGVS

SEQ ID NO: 705711 - protein, 9 aa, Homo Sapiens
ITLHHYFRT

SEQ ID NO: 705712 - protein, 9 aa, Homo Sapiens
FFCHICSFF

SEQ ID NO: 705713 - protein, 9 aa, Homo Sapiens
HFLDTLQCG

SEQ ID NO: 705714 - protein, 9 aa, Homo Sapiens
LSVQVFTSS

SEQ ID NO: 705715 - protein, 9 aa, Homo Sapiens
TDEYLLEQR

SEQ ID NO: 705716 - protein, 9 aa, Homo Sapiens
TACTEFRDK

SEQ ID NO: 705717 - protein, 9 aa, Homo Sapiens
IPFVPARNL

SEQ ID NO: 705718 - protein, 9 aa, Homo Sapiens
GTKEFPLID

SEQ ID NO: 705719 - protein, 9 aa, Homo Sapiens
LFIKIFSSF

SEQ ID NO: 705720 - protein, 9 aa, Homo Sapiens
GHICSSNPS

SEQ ID NO: 705721 - protein, 9 aa, Homo Sapiens
NPGLLSSLP

SEQ ID NO: 705722 - protein, 9 aa, Homo Sapiens
CAAHSLRAA

SEQ ID NO: 705723 - protein, 9 aa, Homo Sapiens
LTESHQHLS

SEQ ID NO: 705724 - protein, 9 aa, Homo Sapiens
ARLIDSMTK

SEQ ID NO: 705725 - protein, 9 aa, Homo Sapiens
KKKVQGHPA

SEQ ID NO: 705726 - protein, 9 aa, Homo Sapiens
GGRQAQGPS

SEQ ID NO: 705727 - protein, 9 aa, Homo Sapiens
NFLNVIYEA

SEQ ID NO: 705728 - protein, 9 aa, Homo Sapiens
PGGLPAVQR

SEQ ID NO: 705729 - protein, 9 aa, Homo Sapiens
PQDSSCVIA

SEQ ID NO: 705730 - protein, 9 aa, Homo Sapiens
LVEDLKVFH

SEQ ID NO: 705731 - protein, 9 aa, Homo Sapiens
CDILVIGGY

SEQ ID NO: 705732 - protein, 9 aa, Homo Sapiens
PRKRQGGRQ

SEQ ID NO: 705733 - protein, 9 aa, Homo Sapiens
TPGQPFHIK

SEQ ID NO: 705734 - protein, 9 aa, Homo Sapiens
LSPLQTGAA

SEQ ID NO: 705735 - protein, 9 aa, Homo Sapiens
ACTEFRDKI

SEQ ID NO: 705736 - protein, 9 aa, Homo Sapiens
VIRTTLTGL

SEQ ID NO: 705737 - protein, 9 aa, Homo Sapiens
TFRARVKVK

SEQ ID NO: 705738 - protein, 9 aa, Homo Sapiens
NSQEILSKA

SEQ ID NO: 705739 - protein, 9 aa, Homo Sapiens
WTEPADFAL

SEQ ID NO: 705740 - protein, 9 aa, Homo Sapiens
YIFAKDFGD

SEQ ID NO: 705741 - protein, 9 aa, Homo Sapiens
PLRGKTSWT

SEQ ID NO: 705742 - protein, 9 aa, Homo Sapiens
RPGGLPAVQ

SEQ ID NO: 705743 - protein, 9 aa, Homo Sapiens
PSPSQLPES

SEQ ID NO: 705744 - protein, 9 aa, Homo Sapiens
HPLNPGLLS

SEQ ID NO: 705745 - protein, 9 aa, Homo Sapiens
MAYDRYIAV

SEQ ID NO: 705746 - protein, 9 aa, Homo Sapiens
EWTIQIFLL

SEQ ID NO: 705747 - protein, 9 aa, Homo Sapiens
RVLVDDVTI

SEQ ID NO: 705748 - protein, 9 aa, Homo Sapiens
SGQRPQVHG

SEQ ID NO: 705749 - protein, 9 aa, Homo Sapiens
SQRGRSQPS

SEQ ID NO: 705750 - protein, 9 aa, Homo Sapiens
LDTLQCGYP

SEQ ID NO: 705751 - protein, 9 aa, Homo Sapiens
PFVPARNLF

SEQ ID NO: 705752 - protein, 9 aa, Homo Sapiens
RQAQGPSGQ

SEQ ID NO: 705753 - protein, 9 aa, Homo Sapiens
CLTESHQHL

SEQ ID NO: 705754 - protein, 9 aa, Homo Sapiens
AYWIIFTVF

SEQ ID NO: 705755 - protein, 9 aa, Homo Sapiens
YHGGLAEEN

SEQ ID NO: 705756 - protein, 9 aa, Homo Sapiens
AQGPSGQRP

SEQ ID NO: 705757 - protein, 9 aa, Homo Sapiens
SSLTEAPLK

SEQ ID NO: 705758 - protein, 9 aa, Homo Sapiens
IHSMGFIHT

SEQ ID NO: 705759 - protein, 9 aa, Homo Sapiens
EKRTAKRKG

SEQ ID NO: 705760 - protein, 9 aa, Homo Sapiens
WKYRCFQRN

SEQ ID NO: 705761 - protein, 9 aa, Homo Sapiens
PQAVPRAHN

SEQ ID NO: 705762 - protein, 9 aa, Homo Sapiens
GLPAVQRQH

SEQ ID NO: 705763 - protein, 9 aa, Homo Sapiens
MSATPSLKV

SEQ ID NO: 705764 - protein, 9 aa, Homo Sapiens
GKDANSECA

SEQ ID NO: 705765 - protein, 9 aa, Homo Sapiens
TDNALGEGG

SEQ ID NO: 705766 - protein, 9 aa, Homo Sapiens
AIWWSIALW

SEQ ID NO: 705767 - protein, 9 aa, Homo Sapiens
NFETGNGAN

SEQ ID NO: 705768 - protein, 9 aa, Homo Sapiens
GCSMLSPLQ

SEQ ID NO: 705769 - protein, 9 aa, Homo Sapiens
LRCPSKKKV

SEQ ID NO: 705770 - protein, 9 aa, Homo Sapiens
ANSECANFI

SEQ ID NO: 705771 - protein, 9 aa, Homo Sapiens
WVKEAGDPR

SEQ ID NO: 705772 - protein, 9 aa, Homo Sapiens
LDQIHETKC

SEQ ID NO: 705773 - protein, 9 aa, Homo Sapiens
AQKYYKCED

SEQ ID NO: 705774 - protein, 9 aa, Homo Sapiens
AQRQCIFCT

SEQ ID NO: 705775 - protein, 9 aa, Homo Sapiens
FLNVIYEAY

SEQ ID NO: 705776 - protein, 9 aa, Homo Sapiens
ALFIKIFSS

SEQ ID NO: 705777 - protein, 9 aa, Homo Sapiens
CHRKAGIPV

SEQ ID NO: 705778 - protein, 9 aa, Homo Sapiens
PCLMSSTPI

SEQ ID NO: 705779 - protein, 9 aa, Homo Sapiens
QGPYLLRSL

SEQ ID NO: 705780 - protein, 9 aa, Homo Sapiens
SVFCQKESF

SEQ ID NO: 705781 - protein, 9 aa, Homo Sapiens
NLVLCILVI

SEQ ID NO: 705782 - protein, 9 aa, Homo Sapiens
TTACTEFRD

SEQ ID NO: 705783 - protein, 9 aa, Homo Sapiens
RKPKAEEYE

SEQ ID NO: 705784 - protein, 9 aa, Homo Sapiens
HDVVSLLKS

SEQ ID NO: 705785 - protein, 9 aa, Homo Sapiens
QAVPRAHNH

SEQ ID NO: 705786 - protein, 9 aa, Homo Sapiens
GDPRPGGLP

SEQ ID NO: 705787 - protein, 9 aa, Homo Sapiens
PHSQPFMSL

SEQ ID NO: 705788 - protein, 9 aa, Homo Sapiens
LACNIEDER

SEQ ID NO: 705789 - protein, 9 aa, Homo Sapiens
RGRSQPSVS

SEQ ID NO: 705790 - protein, 9 aa, Homo Sapiens
KQKKMDTMY

SEQ ID NO: 705791 - protein, 9 aa, Homo Sapiens
ASESSKLVS

SEQ ID NO: 705792 - protein, 9 aa, Homo Sapiens
FVPARNLFF

SEQ ID NO: 705793 - protein, 9 aa, Homo Sapiens
AGIPVSSLH

SEQ ID NO: 705794 - protein, 9 aa, Homo Sapiens
DQCHLGQKE

SEQ ID NO: 705795 - protein, 9 aa, Homo Sapiens
GTLAAGFAV

SEQ ID NO: 705796 - protein, 9 aa, Homo Sapiens
LPESKELLE

SEQ ID NO: 705797 - protein, 9 aa, Homo Sapiens
CHEVLTRTA

SEQ ID NO: 705798 - protein, 9 aa, Homo Sapiens
YSCIYKKVR

SEQ ID NO: 705799 - protein, 9 aa, Homo Sapiens
FGDLEPRYT

SEQ ID NO: 705800 - protein, 9 aa, Homo Sapiens
ASEAALQTL

SEQ ID NO: 705801 - protein, 9 aa, Homo Sapiens
WLSVQVFTS

SEQ ID NO: 705802 - protein, 9 aa, Homo Sapiens
AGDPRPGGL

SEQ ID NO: 705803 - protein, 9 aa, Homo Sapiens
NGQAHGNKL

SEQ ID NO: 705804 - protein, 9 aa, Homo Sapiens
HHYDPNSLP

SEQ ID NO: 705805 - protein, 9 aa, Homo Sapiens
KALKNIKIM

SEQ ID NO: 705806 - protein, 9 aa, Homo Sapiens
HILLFRGNI

SEQ ID NO: 705807 - protein, 9 aa, Homo Sapiens
EREALLLGV

SEQ ID NO: 705808 - protein, 9 aa, Homo Sapiens
AEREALLLG

SEQ ID NO: 705809 - protein, 9 aa, Homo Sapiens
QNDDNFLNV

SEQ ID NO: 705810 - protein, 9 aa, Homo Sapiens
EEYEILNRS

SEQ ID NO: 705811 - protein, 9 aa, Homo Sapiens
PRDMCVLNH

SEQ ID NO: 705812 - protein, 9 aa, Homo Sapiens
KEAGDPRPG

SEQ ID NO: 705813 - protein, 9 aa, Homo Sapiens
TSKQKKMDT

SEQ ID NO: 705814 - protein, 9 aa, Homo Sapiens
LLFILAYWI

SEQ ID NO: 705815 - protein, 9 aa, Homo Sapiens
GIAVSWVLA

SEQ ID NO: 705816 - protein, 9 aa, Homo Sapiens
KLEAALAQS

SEQ ID NO: 705817 - protein, 9 aa, Homo Sapiens
CQAGNTTVK

SEQ ID NO: 705818 - protein, 9 aa, Homo Sapiens
ILVIGGYLD

SEQ ID NO: 705819 - protein, 9 aa, Homo Sapiens
GIYVSKVYH

SEQ ID NO: 705820 - protein, 9 aa, Homo Sapiens
AVQRQHAPQ

SEQ ID NO: 705821 - protein, 9 aa, Homo Sapiens
QAGNTTVKQ

SEQ ID NO: 705822 - protein, 9 aa, Homo Sapiens
SATPSLKVV

SEQ ID NO: 705823 - protein, 9 aa, Homo Sapiens
VPALGTLAA

SEQ ID NO: 705824 - protein, 9 aa, Homo Sapiens
SKICRGAQN

SEQ ID NO: 705825 - protein, 9 aa, Homo Sapiens
DSSHSEKRT

SEQ ID NO: 705826 - protein, 9 aa, Homo Sapiens
FSVSNQHDG

SEQ ID NO: 705827 - protein, 9 aa, Homo Sapiens
QPFHIKVTP

SEQ ID NO: 705828 - protein, 9 aa, Homo Sapiens
TCGLSTAQK

SEQ ID NO: 705829 - protein, 9 aa, Homo Sapiens
SLFLSIHLI

SEQ ID NO: 705830 - protein, 9 aa, Homo Sapiens
CFQRNTGEM

SEQ ID NO: 705831 - protein, 9 aa, Homo Sapiens
YCDVFMQCR

SEQ ID NO: 705832 - protein, 9 aa, Homo Sapiens
IFAKDFGDL

SEQ ID NO: 705833 - protein, 9 aa, Homo Sapiens
DVFMQCRLV

SEQ ID NO: 705834 - protein, 9 aa, Homo Sapiens
TVIAHELAQ

SEQ ID NO: 705835 - protein, 9 aa, Homo Sapiens
PASESSKLV

SEQ ID NO: 705836 - protein, 9 aa, Homo Sapiens
EMTGQNNTT

SEQ ID NO: 705837 - protein, 9 aa, Homo Sapiens
HRKAGIPVS

SEQ ID NO: 705838 - protein, 9 aa, Homo Sapiens
AATLALVED

SEQ ID NO: 705839 - protein, 9 aa, Homo Sapiens
LGCHRKAGI

SEQ ID NO: 705840 - protein, 9 aa, Homo Sapiens
SEFEEEGEE

SEQ ID NO: 705841 - protein, 9 aa, Homo Sapiens
ISQMFFIHF

SEQ ID NO: 705842 - protein, 9 aa, Homo Sapiens
SSPCIIEKK

SEQ ID NO: 705843 - protein, 9 aa, Homo Sapiens
GYPSLFLSI

SEQ ID NO: 705844 - protein, 9 aa, Homo Sapiens
LALLFILAY

SEQ ID NO: 705845 - protein, 9 aa, Homo Sapiens
EILSKAQFV

SEQ ID NO: 705846 - protein, 9 aa, Homo Sapiens
FLLSLFTTI

SEQ ID NO: 705847 - protein, 9 aa, Homo Sapiens
PCISVQRAS

SEQ ID NO: 705848 - protein, 9 aa, Homo Sapiens
LRGKTSWTE

SEQ ID NO: 705849 - protein, 9 aa, Homo Sapiens
ALGEGGVAA

SEQ ID NO: 705850 - protein, 9 aa, Homo Sapiens
FETGNGANV

SEQ ID NO: 705851 - protein, 9 aa, Homo Sapiens
AVWEAYRIS

SEQ ID NO: 705852 - protein, 9 aa, Homo Sapiens
FTDPVTIDC

SEQ ID NO: 705853 - protein, 9 aa, Homo Sapiens
CLMSSTPIL

SEQ ID NO: 705854 - protein, 9 aa, Homo Sapiens
TIQIFLLSL

SEQ ID NO: 705855 - protein, 9 aa, Homo Sapiens
EPTHTRALF

SEQ ID NO: 705856 - protein, 9 aa, Homo Sapiens
GVSSSDGYG

SEQ ID NO: 705857 - protein, 9 aa, Homo Sapiens
GQELEVIRT

SEQ ID NO: 705858 - protein, 9 aa, Homo Sapiens
LFILAYWII

SEQ ID NO: 705859 - protein, 9 aa, Homo Sapiens
YKKVRPFNG

SEQ ID NO: 705860 - protein, 9 aa, Homo Sapiens
QAQGPSGQR

SEQ ID NO: 705861 - protein, 9 aa, Homo Sapiens
DTMYPFIVT

SEQ ID NO: 705862 - protein, 9 aa, Homo Sapiens
TDSGLCRCV

SEQ ID NO: 705863 - protein, 9 aa, Homo Sapiens
GQNNTTNFM

SEQ ID NO: 705864 - protein, 9 aa, Homo Sapiens
FMQCRLVDA

SEQ ID NO: 705865 - protein, 9 aa, Homo Sapiens
QDFYARLID

SEQ ID NO: 705866 - protein, 9 aa, Homo Sapiens
AKAMIHAGQ

SEQ ID NO: 705867 - protein, 9 aa, Homo Sapiens
QHDGTLHGI

SEQ ID NO: 705868 - protein, 9 aa, Homo Sapiens
CGWPGNTLV

SEQ ID NO: 705869 - protein, 9 aa, Homo Sapiens
QQWFGNLVT

SEQ ID NO: 705870 - protein, 9 aa, Homo Sapiens
AITLHHYFR

SEQ ID NO: 705871 - protein, 9 aa, Homo Sapiens
ARNLFFYVG

SEQ ID NO: 705872 - protein, 9 aa, Homo Sapiens
PVPRSHDVV

SEQ ID NO: 705873 - protein, 9 aa, Homo Sapiens
FAKAMIHAG

SEQ ID NO: 705874 - protein, 9 aa, Homo Sapiens
MLSPLQTGA

SEQ ID NO: 705875 - protein, 9 aa, Homo Sapiens
SWTEPADFA

SEQ ID NO: 705876 - protein, 9 aa, Homo Sapiens
YYKCEDCGK

SEQ ID NO: 705877 - protein, 9 aa, Homo Sapiens
VRVVRRGKC

SEQ ID NO: 705878 - protein, 9 aa, Homo Sapiens
GNGANVQGH

SEQ ID NO: 705879 - protein, 9 aa, Homo Sapiens
SSRSPKRRS

SEQ ID NO: 705880 - protein, 9 aa, Homo Sapiens
FRARVKVKH

SEQ ID NO: 705881 - protein, 9 aa, Homo Sapiens
TLHHYFRTW

SEQ ID NO: 705882 - protein, 9 aa, Homo Sapiens
CPSKKKVQG

SEQ ID NO: 705883 - protein, 9 aa, Homo Sapiens
KRQGGRQAQ

SEQ ID NO: 705884 - protein, 9 aa, Homo Sapiens
QELEVIRTT

SEQ ID NO: 705885 - protein, 9 aa, Homo Sapiens
FCHICSFFH

SEQ ID NO: 705886 - protein, 9 aa, Homo Sapiens
RISNLVLCI

SEQ ID NO: 705887 - protein, 9 aa, Homo Sapiens
HYDPNSLPQ

SEQ ID NO: 705888 - protein, 9 aa, Homo Sapiens
VFCQKESFP

SEQ ID NO: 705889 - protein, 9 aa, Homo Sapiens
YPSLFLSIH

SEQ ID NO: 705890 - protein, 9 aa, Homo Sapiens
PYLLRSLWV

SEQ ID NO: 705891 - protein, 9 aa, Homo Sapiens
PARNLFFYV

SEQ ID NO: 705892 - protein, 9 aa, Homo Sapiens
CTEFRDKIA

SEQ ID NO: 705893 - protein, 9 aa, Homo Sapiens
RSSNDSLNG

SEQ ID NO: 705894 - protein, 9 aa, Homo Sapiens
TKCHEVLTR

SEQ ID NO: 705895 - protein, 9 aa, Homo Sapiens
ALVEDLKVF

SEQ ID NO: 705896 - protein, 9 aa, Homo Sapiens
RDMCVLNHL

SEQ ID NO: 705897 - protein, 9 aa, Homo Sapiens
ISEFEEEGE

SEQ ID NO: 705898 - protein, 9 aa, Homo Sapiens
SPRRGRSSS

SEQ ID NO: 705899 - protein, 9 aa, Homo Sapiens
NEIIAIESG

SEQ ID NO: 705900 - protein, 9 aa, Homo Sapiens
GNTTVKQSR

SEQ ID NO: 705901 - protein, 9 aa, Homo Sapiens
SSNPSCCCT

SEQ ID NO: 705902 - protein, 9 aa, Homo Sapiens
SLFSKMYLD

SEQ ID NO: 705903 - protein, 9 aa, Homo Sapiens
KEFPLIDQT

SEQ ID NO: 705904 - protein, 9 aa, Homo Sapiens
RNEIIAIES

SEQ ID NO: 705905 - protein, 9 aa, Homo Sapiens
VIYEAYLFS

SEQ ID NO: 705906 - protein, 9 aa, Homo Sapiens
QKVYIGEKE

SEQ ID NO: 705907 - protein, 9 aa, Homo Sapiens
LLSLFTTIY

SEQ ID NO: 705908 - protein, 9 aa, Homo Sapiens
QSQTRNEII

SEQ ID NO: 705909 - protein, 9 aa, Homo Sapiens
RLFRITPFD

SEQ ID NO: 705910 - protein, 9 aa, Homo Sapiens
QLRWLSVQV

SEQ ID NO: 705911 - protein, 9 aa, Homo Sapiens
IKALKNIKI

SEQ ID NO: 705912 - protein, 9 aa, Homo Sapiens
DFYARLIDS

SEQ ID NO: 705913 - protein, 9 aa, Homo Sapiens
LVDDVTIED

SEQ ID NO: 705914 - protein, 9 aa, Homo Sapiens
KDANSECAN

SEQ ID NO: 705915 - protein, 9 aa, Homo Sapiens
GYISQMFFI

SEQ ID NO: 705916 - protein, 9 aa, Homo Sapiens
PPCGWPGNT

SEQ ID NO: 705917 - protein, 9 aa, Homo Sapiens
KCHEVLTRT

SEQ ID NO: 705918 - protein, 9 aa, Homo Sapiens
FILAYWIIF

SEQ ID NO: 705919 - protein, 9 aa, Homo Sapiens
AYDRYIAVS

SEQ ID NO: 705920 - protein, 9 aa, Homo Sapiens
YARLIDSMT

SEQ ID NO: 705921 - protein, 9 aa, Homo Sapiens
KCLKLTVDD

SEQ ID NO: 705922 - protein, 9 aa, Homo Sapiens
KQSQTRNEI

SEQ ID NO: 705923 - protein, 9 aa, Homo Sapiens
SHTPGQPFH

SEQ ID NO: 705924 - protein, 9 aa, Homo Sapiens
TLALVEDLK

SEQ ID NO: 705925 - protein, 9 aa, Homo Sapiens
DAYFTEILN

SEQ ID NO: 705926 - protein, 9 aa, Homo Sapiens
TESTQKNQE

SEQ ID NO: 705927 - protein, 9 aa, Homo Sapiens
HVQRGATCK

SEQ ID NO: 705928 - protein, 9 aa, Homo Sapiens
GCHRKAGIP

SEQ ID NO: 705929 - protein, 9 aa, Homo Sapiens
QLQGPYLLR

SEQ ID NO: 705930 - protein, 9 aa, Homo Sapiens
DFLNDPLKK

SEQ ID NO: 705931 - protein, 9 aa, Homo Sapiens
LLLPLQRLH

SEQ ID NO: 705932 - protein, 9 aa, Homo Sapiens
IKDCLIDKR

SEQ ID NO: 705933 - protein, 9 aa, Homo Sapiens
TGQNNTTNF

SEQ ID NO: 705934 - protein, 9 aa, Homo Sapiens
LRWLSVQVF

SEQ ID NO: 705935 - protein, 9 aa, Homo Sapiens
TLHYAVYNE

SEQ ID NO: 705936 - protein, 9 aa, Homo Sapiens
DCGKAFKWS

SEQ ID NO: 705937 - protein, 9 aa, Homo Sapiens
EGGVAALCE

SEQ ID NO: 705938 - protein, 9 aa, Homo Sapiens
KKVQGHPAH

SEQ ID NO: 705939 - protein, 9 aa, Homo Sapiens
QKESFPAER

SEQ ID NO: 705940 - protein, 9 aa, Homo Sapiens
NHKVCWVKE

SEQ ID NO: 705941 - protein, 9 aa, Homo Sapiens
MCQAGNTTV

SEQ ID NO: 705942 - protein, 9 aa, Homo Sapiens
TESHQHLSK

SEQ ID NO: 705943 - protein, 9 aa, Homo Sapiens
IFLLSLFTT

SEQ ID NO: 705944 - protein, 9 aa, Homo Sapiens
PTHTRALFV

SEQ ID NO: 705945 - protein, 9 aa, Homo Sapiens
NQKVYIGEK

SEQ ID NO: 705946 - protein, 9 aa, Homo Sapiens
HICSFFHDF

SEQ ID NO: 705947 - protein, 9 aa, Homo Sapiens
FIALFIKIF

SEQ ID NO: 705948 - protein, 9 aa, Homo Sapiens
LEDFLNDPL

SEQ ID NO: 705949 - protein, 9 aa, Homo Sapiens
QARVLVDDV

SEQ ID NO: 705950 - protein, 9 aa, Homo Sapiens
HLSSAAHLL

SEQ ID NO: 705951 - protein, 9 aa, Homo Sapiens
LAYWIIFTV

SEQ ID NO: 705952 - protein, 9 aa, Homo Sapiens
LIVFWKYRC

SEQ ID NO: 705953 - protein, 9 aa, Homo Sapiens
DMNSEITYY

SEQ ID NO: 705954 - protein, 9 aa, Homo Sapiens
KICRGAQNM

SEQ ID NO: 705955 - protein, 9 aa, Homo Sapiens
CWVKEAGDP

SEQ ID NO: 705956 - protein, 9 aa, Homo Sapiens
LIMYGFAKA

SEQ ID NO: 705957 - protein, 9 aa, Homo Sapiens
TIELLHLSR

SEQ ID NO: 705958 - protein, 9 aa, Homo Sapiens
IAVSQPLHY

SEQ ID NO: 705959 - protein, 9 aa, Homo Sapiens
EDERYSERV

SEQ ID NO: 705960 - protein, 9 aa, Homo Sapiens
TDVKPDNML

SEQ ID NO: 705961 - protein, 9 aa, Homo Sapiens
TLQCGYPSL

SEQ ID NO: 705962 - protein, 9 aa, Homo Sapiens
VLCIASSRL

SEQ ID NO: 705963 - protein, 9 aa, Homo Sapiens
EYLLEQRSH

SEQ ID NO: 705964 - protein, 9 aa, Homo Sapiens
IAIWWSIAL

SEQ ID NO: 705965 - protein, 9 aa, Homo Sapiens
HLPHPLNPG

SEQ ID NO: 705966 - protein, 9 aa, Homo Sapiens
DEPVPRSHD

SEQ ID NO: 705967 - protein, 9 aa, Homo Sapiens
SHSGPSSLT

SEQ ID NO: 705968 - protein, 9 aa, Homo Sapiens
APPPHHYDP

SEQ ID NO: 705969 - protein, 9 aa, Homo Sapiens
YTCRDIKDC

SEQ ID NO: 705970 - protein, 9 aa, Homo Sapiens
SYKVDNLED

SEQ ID NO: 705971 - protein, 9 aa, Homo Sapiens
SQEILSKAQ

SEQ ID NO: 705972 - protein, 9 aa, Homo Sapiens
VSKVYHGGL

SEQ ID NO: 705973 - protein, 9 aa, Homo Sapiens
LTYTCRDIK

SEQ ID NO: 705974 - protein, 9 aa, Homo Sapiens
MTSGSTLVT

SEQ ID NO: 705975 - protein, 9 aa, Homo Sapiens
GANVQGHLP

SEQ ID NO: 705976 - protein, 9 aa, Homo Sapiens
LAGKDANSE

SEQ ID NO: 705977 - protein, 9 aa, Homo Sapiens
ELLHLSRSP

SEQ ID NO: 705978 - protein, 9 aa, Homo Sapiens
LRGVSPCLT

SEQ ID NO: 705979 - protein, 9 aa, Homo Sapiens
GSLFSKMYL

SEQ ID NO: 705980 - protein, 9 aa, Homo Sapiens
ITPFDVQLG

SEQ ID NO: 705981 - protein, 9 aa, Homo Sapiens
DVCLLPGHP

SEQ ID NO: 705982 - protein, 9 aa, Homo Sapiens
CIIEKKDLG

SEQ ID NO: 705983 - protein, 9 aa, Homo Sapiens
RCFQRNTGE

SEQ ID NO: 705984 - protein, 9 aa, Homo Sapiens
SVQRASEAA

SEQ ID NO: 705985 - protein, 9 aa, Homo Sapiens
TAPPPHHYD

SEQ ID NO: 705986 - protein, 9 aa, Homo Sapiens
NTTLHYAVY

SEQ ID NO: 705987 - protein, 9 aa, Homo Sapiens
VYIGEKEKK

SEQ ID NO: 705988 - protein, 9 aa, Homo Sapiens
PRAHNHKVC

SEQ ID NO: 705989 - protein, 9 aa, Homo Sapiens
IRTTLTGLK

SEQ ID NO: 705990 - protein, 9 aa, Homo Sapiens
IEDERYSER

SEQ ID NO: 705991 - protein, 9 aa, Homo Sapiens
KKVRPFNGG

SEQ ID NO: 705992 - protein, 9 aa, Homo Sapiens
NITTEMTGQ

SEQ ID NO: 705993 - protein, 9 aa, Homo Sapiens
LIKALKNIK

SEQ ID NO: 705994 - protein, 9 aa, Homo Sapiens
LAQSEQQGE

SEQ ID NO: 705995 - protein, 9 aa, Homo Sapiens
LISEFEEEG

SEQ ID NO: 705996 - protein, 9 aa, Homo Sapiens
PSSLTEAPL

SEQ ID NO: 705997 - protein, 9 aa, Homo Sapiens
ACNIEDERY

SEQ ID NO: 705998 - protein, 9 aa, Homo Sapiens
DRKPKAEEY

SEQ ID NO: 705999 - protein, 9 aa, Homo Sapiens
ALFVRQAPL

SEQ ID NO: 706000 - protein, 9 aa, Homo Sapiens
EQMTTIAQR

SEQ ID NO: 706001 - protein, 9 aa, Homo Sapiens
RTTLTGLKQ

SEQ ID NO: 706002 - protein, 9 aa, Homo Sapiens
SGSTLVTNP

SEQ ID NO: 706003 - protein, 9 aa, Homo Sapiens
NMTSGSTLV

SEQ ID NO: 706004 - protein, 9 aa, Homo Sapiens
QTRNEIIAI

SEQ ID NO: 706005 - protein, 9 aa, Homo Sapiens
IIPFVPARN

SEQ ID NO: 706006 - protein, 9 aa, Homo Sapiens
RLHKKLGTK

SEQ ID NO: 706007 - protein, 9 aa, Homo Sapiens
GERSGVILV

SEQ ID NO: 706008 - protein, 9 aa, Homo Sapiens
KVCWVKEAG

SEQ ID NO: 706009 - protein, 9 aa, Homo Sapiens
SEKRTAKRK

SEQ ID NO: 706010 - protein, 9 aa, Homo Sapiens
LRAAPFEQE

SEQ ID NO: 706011 - protein, 9 aa, Homo Sapiens
IQIFLLSLF

SEQ ID NO: 706012 - protein, 9 aa, Homo Sapiens
SSTCGLSTA

SEQ ID NO: 706013 - protein, 9 aa, Homo Sapiens
WEAYRISLD

SEQ ID NO: 706014 - protein, 9 aa, Homo Sapiens
LQRLHLGCH

SEQ ID NO: 706015 - protein, 9 aa, Homo Sapiens
LLEQRSHLY

SEQ ID NO: 706016 - protein, 9 aa, Homo Sapiens
LLPGHPDAI

SEQ ID NO: 706017 - protein, 9 aa, Homo Sapiens
DIKDCLIDK

SEQ ID NO: 706018 - protein, 9 aa, Homo Sapiens
NSEITYYFP

SEQ ID NO: 706019 - protein, 9 aa, Homo Sapiens
LWVPALGTL

SEQ ID NO: 706020 - protein, 9 aa, Homo Sapiens
VQLPTESTQ

SEQ ID NO: 706021 - protein, 9 aa, Homo Sapiens
PFMSLRYAG

SEQ ID NO: 706022 - protein, 9 aa, Homo Sapiens
TDPVTIDCG

SEQ ID NO: 706023 - protein, 9 aa, Homo Sapiens
SHIAIWWSI

SEQ ID NO: 706024 - protein, 9 aa, Homo Sapiens
RFGHICSSN

SEQ ID NO: 706025 - protein, 9 aa, Homo Sapiens
VIATACRCN

SEQ ID NO: 706026 - protein, 9 aa, Homo Sapiens
YEILNRSPR

SEQ ID NO: 706027 - protein, 9 aa, Homo Sapiens
EDAYFTEIL

SEQ ID NO: 706028 - protein, 9 aa, Homo Sapiens
VSFIALFIK

SEQ ID NO: 706029 - protein, 9 aa, Homo Sapiens
PSLFLSIHL

SEQ ID NO: 706030 - protein, 9 aa, Homo Sapiens
RPQVHGHLS

SEQ ID NO: 706031 - protein, 9 aa, Homo Sapiens
ARVKVKHCR

SEQ ID NO: 706032 - protein, 9 aa, Homo Sapiens
SGTLLRGVS

SEQ ID NO: 706033 - protein, 9 aa, Homo Sapiens
ISNLVLCIL

SEQ ID NO: 706034 - protein, 9 aa, Homo Sapiens
IGGYLDPRQ

SEQ ID NO: 706035 - protein, 9 aa, Homo Sapiens
KKMDTMYPF

SEQ ID NO: 706036 - protein, 9 aa, Homo Sapiens
IMYGFAKAM

SEQ ID NO: 706037 - protein, 9 aa, Homo Sapiens
LGTLAAGFA

SEQ ID NO: 706038 - protein, 9 aa, Homo Sapiens
TKLFFILLP

SEQ ID NO: 706039 - protein, 9 aa, Homo Sapiens
TCRDIKDCL

SEQ ID NO: 706040 - protein, 9 aa, Homo Sapiens
HLWYIRLLV

SEQ ID NO: 706041 - protein, 9 aa, Homo Sapiens
SKQKKMDTM

SEQ ID NO: 706042 - protein, 9 aa, Homo Sapiens
SLWVPALGT

SEQ ID NO: 706043 - protein, 9 aa, Homo Sapiens
AAITLHHYF

SEQ ID NO: 706044 - protein, 9 aa, Homo Sapiens
NALGEGGVA

SEQ ID NO: 706045 - protein, 9 aa, Homo Sapiens
QKEDVYHTV

SEQ ID NO: 706046 - protein, 9 aa, Homo Sapiens
RRGRSSSRS

SEQ ID NO: 706047 - protein, 9 aa, Homo Sapiens
EFEEEGEEE

SEQ ID NO: 706048 - protein, 9 aa, Homo Sapiens
RGPQAVPRA

SEQ ID NO: 706049 - protein, 9 aa, Homo Sapiens
IEKKDLGPK

SEQ ID NO: 706050 - protein, 9 aa, Homo Sapiens
PGLLSSLPI

SEQ ID NO: 706051 - protein, 9 aa, Homo Sapiens
HSQPFMSLR

SEQ ID NO: 706052 - protein, 9 aa, Homo Sapiens
NIEDERYSE

SEQ ID NO: 706053 - protein, 9 aa, Homo Sapiens
FIHTDVKPD

SEQ ID NO: 706054 - protein, 9 aa, Homo Sapiens
RGATCKTSL

SEQ ID NO: 706055 - protein, 9 aa, Homo Sapiens
TEILNFIGN

SEQ ID NO: 706056 - protein, 9 aa, Homo Sapiens
VLVDDVTIE

SEQ ID NO: 706057 - protein, 9 aa, Homo Sapiens
GSLINGRQV

SEQ ID NO: 706058 - protein, 9 aa, Homo Sapiens
TQVRIAKKN

SEQ ID NO: 706059 - protein, 9 aa, Homo Sapiens
MSLRYAGGP

SEQ ID NO: 706060 - protein, 9 aa, Homo Sapiens
LFSKMYLDI

SEQ ID NO: 706061 - protein, 9 aa, Homo Sapiens
LMSSTPILH

SEQ ID NO: 706062 - protein, 9 aa, Homo Sapiens
VFMQCRLVD

SEQ ID NO: 706063 - protein, 9 aa, Homo Sapiens
ARSLMDNKV

SEQ ID NO: 706064 - protein, 9 aa, Homo Sapiens
MYGFAKAMI

SEQ ID NO: 706065 - protein, 9 aa, Homo Sapiens
DNFLNVIYE

SEQ ID NO: 706066 - protein, 9 aa, Homo Sapiens
KVDNLEDFL

SEQ ID NO: 706067 - protein, 9 aa, Homo Sapiens
ETGNGANVQ

SEQ ID NO: 706068 - protein, 9 aa, Homo Sapiens
NYFTDPVTI

SEQ ID NO: 706069 - protein, 9 aa, Homo Sapiens
PQLQGPYLL

SEQ ID NO: 706070 - protein, 9 aa, Homo Sapiens
TTEMTGQNN

SEQ ID NO: 706071 - protein, 9 aa, Homo Sapiens
PGQPFHIKV

SEQ ID NO: 706072 - protein, 9 aa, Homo Sapiens
VQRQHAPQV

SEQ ID NO: 706073 - protein, 9 aa, Homo Sapiens
LLRSLWVPA

SEQ ID NO: 706074 - protein, 9 aa, Homo Sapiens
RASEAALQT

SEQ ID NO: 706075 - protein, 9 aa, Homo Sapiens
LGEGGVAAL

SEQ ID NO: 706076 - protein, 9 aa, Homo Sapiens
SSHSEKRTA

SEQ ID NO: 706077 - protein, 9 aa, Homo Sapiens
ALLFILAYW

SEQ ID NO: 706078 - protein, 9 aa, Homo Sapiens
KKLGTKEFP

SEQ ID NO: 706079 - protein, 9 aa, Homo Sapiens
PSQLPESKE

SEQ ID NO: 706080 - protein, 9 aa, Homo Sapiens
HLREPFAKK

SEQ ID NO: 706081 - protein, 9 aa, Homo Sapiens
PYPASESSK

SEQ ID NO: 706082 - protein, 9 aa, Homo Sapiens
VRIAKKNFD

SEQ ID NO: 706083 - protein, 9 aa, Homo Sapiens
CATKLFFIL

SEQ ID NO: 706084 - protein, 9 aa, Homo Sapiens
GKTSWTEPA

SEQ ID NO: 706085 - protein, 9 aa, Homo Sapiens
LCILVIIHW

SEQ ID NO: 706086 - protein, 9 aa, Homo Sapiens
VHIGDVCLL

SEQ ID NO: 706087 - protein, 9 aa, Homo Sapiens
AGKDANSEC

SEQ ID NO: 706088 - protein, 9 aa, Homo Sapiens
SYIFAKDFG

SEQ ID NO: 706089 - protein, 9 aa, Homo Sapiens
LQCGYPSLF

SEQ ID NO: 706090 - protein, 9 aa, Homo Sapiens
FRDKIACNG

SEQ ID NO: 706091 - protein, 9 aa, Homo Sapiens
QRPQVHGHL

SEQ ID NO: 706092 - protein, 9 aa, Homo Sapiens
KAGIPVSSL

SEQ ID NO: 706093 - protein, 9 aa, Homo Sapiens
LSFWEPGEP

SEQ ID NO: 706094 - protein, 9 aa, Homo Sapiens
VDSPMSTSS

SEQ ID NO: 706095 - protein, 9 aa, Homo Sapiens
QIHETKCHE

SEQ ID NO: 706096 - protein, 9 aa, Homo Sapiens
RKRQGGRQA

SEQ ID NO: 706097 - protein, 9 aa, Homo Sapiens
RAAITLHHY

SEQ ID NO: 706098 - protein, 9 aa, Homo Sapiens
LKNIKIMEV

SEQ ID NO: 706099 - protein, 9 aa, Homo Sapiens
HIGDVCLLP

SEQ ID NO: 706100 - protein, 9 aa, Homo Sapiens
HFCHHGGVF

SEQ ID NO: 706101 - protein, 9 aa, Homo Sapiens
QLPTESTQK

SEQ ID NO: 706102 - protein, 9 aa, Homo Sapiens
QRQCIFCTL

SEQ ID NO: 706103 - protein, 9 aa, Homo Sapiens
CKTSLHMCD

SEQ ID NO: 706104 - protein, 9 aa, Homo Sapiens
WYIRLLVVI

SEQ ID NO: 706105 - protein, 9 aa, Homo Sapiens
SEAALQTLL

SEQ ID NO: 706106 - protein, 9 aa, Homo Sapiens
TRLFRITPF

SEQ ID NO: 706107 - protein, 9 aa, Homo Sapiens
GATCKTSLH

SEQ ID NO: 706108 - protein, 9 aa, Homo Sapiens
LPGHPDAIN

SEQ ID NO: 706109 - protein, 9 aa, Homo Sapiens
LVKQYKQSL

SEQ ID NO: 706110 - protein, 9 aa, Homo Sapiens
PRMCQAGNT

SEQ ID NO: 706111 - protein, 9 aa, Homo Sapiens
LSVVFRCYN

SEQ ID NO: 706112 - protein, 9 aa, Homo Sapiens
QRQHAPQVR

SEQ ID NO: 706113 - protein, 9 aa, Homo Sapiens
QNSKLEAAL

SEQ ID NO: 706114 - protein, 9 aa, Homo Sapiens
HLLLPLQRL

SEQ ID NO: 706115 - protein, 9 aa, Homo Sapiens
PPTIELLHL

SEQ ID NO: 706116 - protein, 9 aa, Homo Sapiens
LFRGNIQEA

SEQ ID NO: 706117 - protein, 9 aa, Homo Sapiens
DLTDNALGE

SEQ ID NO: 706118 - protein, 9 aa, Homo Sapiens
SKLEAALAQ

SEQ ID NO: 706119 - protein, 9 aa, Homo Sapiens
KAEEYEILN

SEQ ID NO: 706120 - protein, 9 aa, Homo Sapiens
QGHPAHFCH

SEQ ID NO: 706121 - protein, 9 aa, Homo Sapiens
AHSLRAAPF

SEQ ID NO: 706122 - protein, 9 aa, Homo Sapiens
VSSLHLRGP

SEQ ID NO: 706123 - protein, 9 aa, Homo Sapiens
SKKKVQGHP

SEQ ID NO: 706124 - protein, 9 aa, Homo Sapiens
FTDEYLLEQ

SEQ ID NO: 706125 - protein, 9 aa, Homo Sapiens
MGFIHTDVK

SEQ ID NO: 706126 - protein, 9 aa, Homo Sapiens
DERYSERVY

SEQ ID NO: 706127 - protein, 9 aa, Homo Sapiens
VRPFNGGSF

SEQ ID NO: 706128 - protein, 9 aa, Homo Sapiens
TEMTGQNNT

SEQ ID NO: 706129 - protein, 9 aa, Homo Sapiens
YVGIAVSWV

SEQ ID NO: 706130 - protein, 9 aa, Homo Sapiens
RSLWVPALG

SEQ ID NO: 706131 - protein, 9 aa, Homo Sapiens
RKVQTQVRI

SEQ ID NO: 706132 - protein, 9 aa, Homo Sapiens
MRPRKRQGG

SEQ ID NO: 706133 - protein, 9 aa, Homo Sapiens
GQFTDEYLL

SEQ ID NO: 706134 - protein, 9 aa, Homo Sapiens
WTIQIFLLS

SEQ ID NO: 706135 - protein, 9 aa, Homo Sapiens
QGPLIPPCG

SEQ ID NO: 706136 - protein, 9 aa, Homo Sapiens
LCMNYFTDP

SEQ ID NO: 706137 - protein, 9 aa, Homo Sapiens
QDSSCVIAT

SEQ ID NO: 706138 - protein, 9 aa, Homo Sapiens
NIKIMEVPV

SEQ ID NO: 706139 - protein, 9 aa, Homo Sapiens
RHVQRGATC

SEQ ID NO: 706140 - protein, 9 aa, Homo Sapiens
QLPESKELL

SEQ ID NO: 706141 - protein, 9 aa, Homo Sapiens
IHTDVKPDN

SEQ ID NO: 706142 - protein, 9 aa, Homo Sapiens
PLIPPCGWP

SEQ ID NO: 706143 - protein, 9 aa, Homo Sapiens
ILSKAQFVI

SEQ ID NO: 706144 - protein, 9 aa, Homo Sapiens
AAHLLLPLQ

SEQ ID NO: 706145 - protein, 9 aa, Homo Sapiens
LPLQRLHLG

SEQ ID NO: 706146 - protein, 9 aa, Homo Sapiens
HGHLSSAAH

SEQ ID NO: 706147 - protein, 9 aa, Homo Sapiens
ANVQGHLPL

SEQ ID NO: 706148 - protein, 9 aa, Homo Sapiens
QALEPYPAS

SEQ ID NO: 706149 - protein, 9 aa, Homo Sapiens
IWWSIALWV

SEQ ID NO: 706150 - protein, 9 aa, Homo Sapiens
EMQLRWLSV

SEQ ID NO: 706151 - protein, 9 aa, Homo Sapiens
CPSCNGQAH

SEQ ID NO: 706152 - protein, 9 aa, Homo Sapiens
FAKDFGDLE

SEQ ID NO: 706153 - protein, 9 aa, Homo Sapiens
VSWVLAVAS

SEQ ID NO: 706154 - protein, 9 aa, Homo Sapiens
DASGCSMLS

SEQ ID NO: 706155 - protein, 9 aa, Homo Sapiens
FMSLRYAGG

SEQ ID NO: 706156 - protein, 9 aa, Homo Sapiens
SMLSPLQTG

SEQ ID NO: 706157 - protein, 9 aa, Homo Sapiens
PAVQRQHAP

SEQ ID NO: 706158 - protein, 9 aa, Homo Sapiens
VVRRGKCLK

SEQ ID NO: 706159 - protein, 9 aa, Homo Sapiens
GPLRGKTSW

SEQ ID NO: 706160 - protein, 9 aa, Homo Sapiens
PFDVQLGYS

SEQ ID NO: 706161 - protein, 9 aa, Homo Sapiens
SQTRNEIIA

SEQ ID NO: 706162 - protein, 9 aa, Homo Sapiens
KRTAKRKGS

SEQ ID NO: 706163 - protein, 9 aa, Homo Sapiens
GQAHGNKLL

SEQ ID NO: 706164 - protein, 9 aa, Homo Sapiens
VKVKHCRIN

SEQ ID NO: 706165 - protein, 9 aa, Homo Sapiens
IPPCGWPGN

SEQ ID NO: 706166 - protein, 9 aa, Homo Sapiens
NVIYEAYLF

SEQ ID NO: 706167 - protein, 9 aa, Homo Sapiens
FVRQAPLAA

SEQ ID NO: 706168 - protein, 9 aa, Homo Sapiens
ELEVIRTTL

SEQ ID NO: 706169 - protein, 9 aa, Homo Sapiens
GFIHTDVKP

SEQ ID NO: 706170 - protein, 9 aa, Homo Sapiens
AVPRAHNHK

SEQ ID NO: 706171 - protein, 9 aa, Homo Sapiens
DMCVLNHLR

SEQ ID NO: 706172 - protein, 9 aa, Homo Sapiens
STAQKYCIL

SEQ ID NO: 706173 - protein, 9 aa, Homo Sapiens
SLTEAPLKP

SEQ ID NO: 706174 - protein, 9 aa, Homo Sapiens
LSTAQKYCI

SEQ ID NO: 706175 - protein, 9 aa, Homo Sapiens
RQHAPQVRY

SEQ ID NO: 706176 - protein, 9 aa, Homo Sapiens
GQKEDVYHT

SEQ ID NO: 706177 - protein, 9 aa, Homo Sapiens
LNHLREPFA

SEQ ID NO: 706178 - protein, 9 aa, Homo Sapiens
ESTQKNQED

SEQ ID NO: 706179 - protein, 9 aa, Homo Sapiens
LRGPQAVPR

SEQ ID NO: 706180 - protein, 9 aa, Homo Sapiens
LAREPVVLC

SEQ ID NO: 706181 - protein, 9 aa, Homo Sapiens
HHGGVFHFL

SEQ ID NO: 706182 - protein, 9 aa, Homo Sapiens
QKYYKCEDC

SEQ ID NO: 706183 - protein, 9 aa, Homo Sapiens
LWYIRLLVV

SEQ ID NO: 706184 - protein, 9 aa, Homo Sapiens
VPRSHDVVS

SEQ ID NO: 706185 - protein, 9 aa, Homo Sapiens
ATLALVEDL

SEQ ID NO: 706186 - protein, 9 aa, Homo Sapiens
TPFDVQLGY

SEQ ID NO: 706187 - protein, 9 aa, Homo Sapiens
WVHLWYIRL

SEQ ID NO: 706188 - protein, 9 aa, Homo Sapiens
TQKNQEDKL

SEQ ID NO: 706189 - protein, 9 aa, Homo Sapiens
ALLLGVEPG

SEQ ID NO: 706190 - protein, 9 aa, Homo Sapiens
CHLGQKEDV

SEQ ID NO: 706191 - protein, 9 aa, Homo Sapiens
FRCYNSTEL

SEQ ID NO: 706192 - protein, 9 aa, Homo Sapiens
GTLLRGVSP

SEQ ID NO: 706193 - protein, 9 aa, Homo Sapiens
TYTCRDIKD

SEQ ID NO: 706194 - protein, 9 aa, Homo Sapiens
SGVILVKQY

SEQ ID NO: 706195 - protein, 9 aa, Homo Sapiens
FRISNLVLC

SEQ ID NO: 706196 - protein, 9 aa, Homo Sapiens
KYRCFQRNT

SEQ ID NO: 706197 - protein, 9 aa, Homo Sapiens
NGRQVDSPM

SEQ ID NO: 706198 - protein, 9 aa, Homo Sapiens
KLAGKDANS

SEQ ID NO: 706199 - protein, 9 aa, Homo Sapiens
TRALFVRQA

SEQ ID NO: 706200 - protein, 9 aa, Homo Sapiens
DPNSLPQFT

SEQ ID NO: 706201 - protein, 9 aa, Homo Sapiens
DNLEDFLND

SEQ ID NO: 706202 - protein, 9 aa, Homo Sapiens
EPYPASESS

SEQ ID NO: 706203 - protein, 9 aa, Homo Sapiens
VHLWYIRLL

SEQ ID NO: 706204 - protein, 9 aa, Homo Sapiens
CQKESFPAE

SEQ ID NO: 706205 - protein, 9 aa, Homo Sapiens
CLKLTVDDD

SEQ ID NO: 706206 - protein, 9 aa, Homo Sapiens
HLSRSPITT

SEQ ID NO: 706207 - protein, 9 aa, Homo Sapiens
LIIPFVPAR

SEQ ID NO: 706208 - protein, 9 aa, Homo Sapiens
KLFFILLPG

SEQ ID NO: 706209 - protein, 9 aa, Homo Sapiens
IAHELAQQW

SEQ ID NO: 706210 - protein, 9 aa, Homo Sapiens
LHKKLGTKE

SEQ ID NO: 706211 - protein, 9 aa, Homo Sapiens
SSSRSPKRR

SEQ ID NO: 706212 - protein, 9 aa, Homo Sapiens
VEDLKVFHN

SEQ ID NO: 706213 - protein, 9 aa, Homo Sapiens
QRLHLGCHR

SEQ ID NO: 706214 - protein, 9 aa, Homo Sapiens
SHSEKRTAK

SEQ ID NO: 706215 - protein, 9 aa, Homo Sapiens
KEDVYHTVD

SEQ ID NO: 706216 - protein, 9 aa, Homo Sapiens
SQLPESKEL

SEQ ID NO: 706217 - protein, 9 aa, Homo Sapiens
AHELAQQWF

SEQ ID NO: 706218 - protein, 9 aa, Homo Sapiens
NSECANFIR

SEQ ID NO: 706219 - protein, 9 aa, Homo Sapiens
GLSQRGRSQ

SEQ ID NO: 706220 - protein, 9 aa, Homo Sapiens
RLLVVIGAL

SEQ ID NO: 706221 - protein, 9 aa, Homo Sapiens
IPVSSLHLR

SEQ ID NO: 706222 - protein, 9 aa, Homo Sapiens
ILVKQYKQS

SEQ ID NO: 706223 - protein, 9 aa, Homo Sapiens
KENMTSGST

SEQ ID NO: 706224 - protein, 9 aa, Homo Sapiens
LEPYPASES

SEQ ID NO: 706225 - protein, 9 aa, Homo Sapiens
GFAKAMIHA

SEQ ID NO: 706226 - protein, 9 aa, Homo Sapiens
NDSLNGVSS

SEQ ID NO: 706227 - protein, 9 aa, Homo Sapiens
DLTYTCRDI

SEQ ID NO: 706228 - protein, 9 aa, Homo Sapiens
VQTQVRIAK

SEQ ID NO: 706229 - protein, 9 aa, Homo Sapiens
RGKCLKLTV

SEQ ID NO: 706230 - protein, 9 aa, Homo Sapiens
PLQRLHLGC

SEQ ID NO: 706231 - protein, 9 aa, Homo Sapiens
GIPVSSLHL

SEQ ID NO: 706232 - protein, 9 aa, Homo Sapiens
WSIALWVVF

SEQ ID NO: 706233 - protein, 9 aa, Homo Sapiens
TTLHYAVYN

SEQ ID NO: 706234 - protein, 9 aa, Homo Sapiens
VRYPQLQGP

SEQ ID NO: 706235 - protein, 9 aa, Homo Sapiens
DWVHLWYIR

SEQ ID NO: 706236 - protein, 9 aa, Homo Sapiens
SSCVIATAC

SEQ ID NO: 706237 - protein, 9 aa, Homo Sapiens
ELIKALKNI

SEQ ID NO: 706238 - protein, 9 aa, Homo Sapiens
MNYFTDPVT

SEQ ID NO: 706239 - protein, 9 aa, Homo Sapiens
APQVRYPQL

SEQ ID NO: 706240 - protein, 9 aa, Homo Sapiens
PTESTQKNQ

SEQ ID NO: 706241 - protein, 9 aa, Homo Sapiens
RLAEVECLT

SEQ ID NO: 706242 - protein, 9 aa, Homo Sapiens
QAHGNKLLA

SEQ ID NO: 706243 - protein, 9 aa, Homo Sapiens
ATTTARSLM

SEQ ID NO: 706244 - protein, 9 aa, Homo Sapiens
WVPALGTLA

SEQ ID NO: 706245 - protein, 9 aa, Homo Sapiens
VHGHLSSAA

SEQ ID NO: 706246 - protein, 9 aa, Homo Sapiens
PESKELLEN

SEQ ID NO: 706247 - protein, 9 aa, Homo Sapiens
SCSEQARVL

SEQ ID NO: 706248 - protein, 9 aa, Homo Sapiens
ICSSNPSCC

SEQ ID NO: 706249 - protein, 9 aa, Homo Sapiens
YLDPRQECL

SEQ ID NO: 706250 - protein, 9 aa, Homo Sapiens
GPSSLTEAP

SEQ ID NO: 706251 - protein, 9 aa, Homo Sapiens
CVLNHLREP

SEQ ID NO: 706252 - protein, 9 aa, Homo Sapiens
VDNLEDFLN

SEQ ID NO: 706253 - protein, 9 aa, Homo Sapiens
AHLLLPLQR

SEQ ID NO: 706254 - protein, 9 aa, Homo Sapiens
GYLDPRQEC

SEQ ID NO: 706255 - protein, 9 aa, Homo Sapiens
LGIYVSKVY

SEQ ID NO: 706256 - protein, 9 aa, Homo Sapiens
PGEPNNIHD

SEQ ID NO: 706257 - protein, 9 aa, Homo Sapiens
CMNYFTDPV

SEQ ID NO: 706258 - protein, 9 aa, Homo Sapiens
LSSAAHLLL

SEQ ID NO: 706259 - protein, 9 aa, Homo Sapiens
ATKLFFILL

SEQ ID NO: 706260 - protein, 9 aa, Homo Sapiens
AHNHKVCWV

SEQ ID NO: 706261 - protein, 9 aa, Homo Sapiens
PCIIEKKDL

SEQ ID NO: 706262 - protein, 9 aa, Homo Sapiens
RKAGIPVSS

SEQ ID NO: 706263 - protein, 9 aa, Homo Sapiens
TEFRDKIAC

SEQ ID NO: 706264 - protein, 9 aa, Homo Sapiens
RISLDRIPD

SEQ ID NO: 706265 - protein, 9 aa, Homo Sapiens
MTTIAQRQC

SEQ ID NO: 706266 - protein, 9 aa, Homo Sapiens
RGAQNMEFL

SEQ ID NO: 706267 - protein, 9 aa, Homo Sapiens
VQRASEAAL

SEQ ID NO: 706268 - protein, 9 aa, Homo Sapiens
SLRAAPFEQ

SEQ ID NO: 706269 - protein, 9 aa, Homo Sapiens
TVQLPTEST

SEQ ID NO: 706270 - protein, 9 aa, Homo Sapiens
SCIYKKVRP

SEQ ID NO: 706271 - protein, 9 aa, Homo Sapiens
GPYLLRSLW

SEQ ID NO: 706272 - protein, 9 aa, Homo Sapiens
EVIRTTLTG

SEQ ID NO: 706273 - protein, 9 aa, Homo Sapiens
NPSCCCTVS

SEQ ID NO: 706274 - protein, 9 aa, Homo Sapiens
YRCFQRNTG

SEQ ID NO: 706275 - protein, 9 aa, Homo Sapiens
QVRYPQLQG

SEQ ID NO: 706276 - protein, 9 aa, Homo Sapiens
HETKCHEVL

SEQ ID NO: 706277 - protein, 9 aa, Homo Sapiens
DPRPGGLPA

SEQ ID NO: 706278 - protein, 9 aa, Homo Sapiens
STQKNQEDK

SEQ ID NO: 706279 - protein, 9 aa, Homo Sapiens
EDFLNDPLK

SEQ ID NO: 706280 - protein, 9 aa, Homo Sapiens
YKVDNLEDF

SEQ ID NO: 706281 - protein, 9 aa, Homo Sapiens
FEEEGEEEE

SEQ ID NO: 706282 - protein, 9 aa, Homo Sapiens
KDCEDGEAA

SEQ ID NO: 706283 - protein, 9 aa, Homo Sapiens
NGTSDRPYS

SEQ ID NO: 706284 - protein, 9 aa, Homo Sapiens
KETRGYEGD

SEQ ID NO: 706285 - protein, 9 aa, Homo Sapiens
ERYVPKHER

SEQ ID NO: 706286 - protein, 9 aa, Homo Sapiens
QLPSDFPEE

SEQ ID NO: 706287 - protein, 9 aa, Homo Sapiens
LDNPFVSEP

SEQ ID NO: 706288 - protein, 9 aa, Homo Sapiens
SCPIFQKPF

SEQ ID NO: 706289 - protein, 9 aa, Homo Sapiens
PESSGFARA

SEQ ID NO: 706290 - protein, 9 aa, Homo Sapiens
RLLPIMTEQ

SEQ ID NO: 706291 - protein, 9 aa, Homo Sapiens
QHVVAGTLE

SEQ ID NO: 706292 - protein, 9 aa, Homo Sapiens
QGKLDTPGV

SEQ ID NO: 706293 - protein, 9 aa, Homo Sapiens
IFKNTAISE

SEQ ID NO: 706294 - protein, 9 aa, Homo Sapiens
SYIDEIDKL

SEQ ID NO: 706295 - protein, 9 aa, Homo Sapiens
SVFIKNLSR

SEQ ID NO: 706296 - protein, 9 aa, Homo Sapiens
VILVVGTEN

SEQ ID NO: 706297 - protein, 9 aa, Homo Sapiens
VERYVPKHE

SEQ ID NO: 706298 - protein, 9 aa, Homo Sapiens
YMRALYDRL

SEQ ID NO: 706299 - protein, 9 aa, Homo Sapiens
AAQRREEEG

SEQ ID NO: 706300 - protein, 9 aa, Homo Sapiens
YKANYWQFP

SEQ ID NO: 706301 - protein, 9 aa, Homo Sapiens
VPLDNPFVS

SEQ ID NO: 706302 - protein, 9 aa, Homo Sapiens
QAIQEQLQL

SEQ ID NO: 706303 - protein, 9 aa, Homo Sapiens
PPLIPPRRL

SEQ ID NO: 706304 - protein, 9 aa, Homo Sapiens
LLEQGKLDT

SEQ ID NO: 706305 - protein, 9 aa, Homo Sapiens
EEKRESKRI

SEQ ID NO: 706306 - protein, 9 aa, Homo Sapiens
VVGTENEEL

SEQ ID NO: 706307 - protein, 9 aa, Homo Sapiens
SGGFQVLTF

SEQ ID NO: 706308 - protein, 9 aa, Homo Sapiens
MHRPMHFFL

SEQ ID NO: 706309 - protein, 9 aa, Homo Sapiens
DKACGRQYT

SEQ ID NO: 706310 - protein, 9 aa, Homo Sapiens
ETNSVYKKH

SEQ ID NO: 706311 - protein, 9 aa, Homo Sapiens
MKDSLLPND

SEQ ID NO: 706312 - protein, 9 aa, Homo Sapiens
GKFVEFYGL

SEQ ID NO: 706313 - protein, 9 aa, Homo Sapiens
QDFKTNLRF

SEQ ID NO: 706314 - protein, 9 aa, Homo Sapiens
AAIARPQKV

SEQ ID NO: 706315 - protein, 9 aa, Homo Sapiens
SKPGKFVEF

SEQ ID NO: 706316 - protein, 9 aa, Homo Sapiens
ESIVDEQER

SEQ ID NO: 706317 - protein, 9 aa, Homo Sapiens
ATAGGAGTI

SEQ ID NO: 706318 - protein, 9 aa, Homo Sapiens
GTWYLVTAL

SEQ ID NO: 706319 - protein, 9 aa, Homo Sapiens
DPQESEETR

SEQ ID NO: 706320 - protein, 9 aa, Homo Sapiens
VAAGAGSGP

SEQ ID NO: 706321 - protein, 9 aa, Homo Sapiens
HGQPKPGPQ

SEQ ID NO: 706322 - protein, 9 aa, Homo Sapiens
HVDSVASLG

SEQ ID NO: 706323 - protein, 9 aa, Homo Sapiens
GCGPSRRGD

SEQ ID NO: 706324 - protein, 9 aa, Homo Sapiens
SGVVGLHLQ

SEQ ID NO: 706325 - protein, 9 aa, Homo Sapiens
EDDGAIGPR

SEQ ID NO: 706326 - protein, 9 aa, Homo Sapiens
GGGTNSNNN

SEQ ID NO: 706327 - protein, 9 aa, Homo Sapiens
ELETLWLNG

SEQ ID NO: 706328 - protein, 9 aa, Homo Sapiens
VPKHERCCW

SEQ ID NO: 706329 - protein, 9 aa, Homo Sapiens
SCNEASQRS

SEQ ID NO: 706330 - protein, 9 aa, Homo Sapiens
PVILVVGTE

SEQ ID NO: 706331 - protein, 9 aa, Homo Sapiens
GAPRVGMPA

SEQ ID NO: 706332 - protein, 9 aa, Homo Sapiens
RERLGISHQ

SEQ ID NO: 706333 - protein, 9 aa, Homo Sapiens
IQRQANPIG

SEQ ID NO: 706334 - protein, 9 aa, Homo Sapiens
ASTPFEEVE

SEQ ID NO: 706335 - protein, 9 aa, Homo Sapiens
VEFYGLLQH

SEQ ID NO: 706336 - protein, 9 aa, Homo Sapiens
NTMAYDRYV

SEQ ID NO: 706337 - protein, 9 aa, Homo Sapiens
LITFGNYVL

SEQ ID NO: 706338 - protein, 9 aa, Homo Sapiens
GIVLSPDYP

SEQ ID NO: 706339 - protein, 9 aa, Homo Sapiens
VYSAHRPVV

SEQ ID NO: 706340 - protein, 9 aa, Homo Sapiens
GLPGDSFYM

SEQ ID NO: 706341 - protein, 9 aa, Homo Sapiens
ILSHESVAK

SEQ ID NO: 706342 - protein, 9 aa, Homo Sapiens
FEEVEISII

SEQ ID NO: 706343 - protein, 9 aa, Homo Sapiens
PETIIAVRG

SEQ ID NO: 706344 - protein, 9 aa, Homo Sapiens
YKTCNTQVH

SEQ ID NO: 706345 - protein, 9 aa, Homo Sapiens
GIVRRYLLR

SEQ ID NO: 706346 - protein, 9 aa, Homo Sapiens
LTDMYGGGE

SEQ ID NO: 706347 - protein, 9 aa, Homo Sapiens
IHHIFCDIL

SEQ ID NO: 706348 - protein, 9 aa, Homo Sapiens
SPSGQHVVA

SEQ ID NO: 706349 - protein, 9 aa, Homo Sapiens
HSLDDGEQG

SEQ ID NO: 706350 - protein, 9 aa, Homo Sapiens
AHLLSASLY

SEQ ID NO: 706351 - protein, 9 aa, Homo Sapiens
YVMKIGNSL

SEQ ID NO: 706352 - protein, 9 aa, Homo Sapiens
IVCSILRIC

SEQ ID NO: 706353 - protein, 9 aa, Homo Sapiens
KLEAEQRQG

SEQ ID NO: 706354 - protein, 9 aa, Homo Sapiens
APEPPASTP

SEQ ID NO: 706355 - protein, 9 aa, Homo Sapiens
ITKEPLKAG

SEQ ID NO: 706356 - protein, 9 aa, Homo Sapiens
GPRTLDNVI

SEQ ID NO: 706357 - protein, 9 aa, Homo Sapiens
SGPSSEQMC

SEQ ID NO: 706358 - protein, 9 aa, Homo Sapiens
ACSNPGASG

SEQ ID NO: 706359 - protein, 9 aa, Homo Sapiens
ISQFSGPSS

SEQ ID NO: 706360 - protein, 9 aa, Homo Sapiens
NNSEHNVKK

SEQ ID NO: 706361 - protein, 9 aa, Homo Sapiens
IEQSNLYWR

SEQ ID NO: 706362 - protein, 9 aa, Homo Sapiens
VEAPVAVIS

SEQ ID NO: 706363 - protein, 9 aa, Homo Sapiens
RYVPKHERC

SEQ ID NO: 706364 - protein, 9 aa, Homo Sapiens
TMCMDVDEF

SEQ ID NO: 706365 - protein, 9 aa, Homo Sapiens
CEQAAETNS

SEQ ID NO: 706366 - protein, 9 aa, Homo Sapiens
SFQHLPKLK

SEQ ID NO: 706367 - protein, 9 aa, Homo Sapiens
LVVGTENEE

SEQ ID NO: 706368 - protein, 9 aa, Homo Sapiens
KAFLQEVWK

SEQ ID NO: 706369 - protein, 9 aa, Homo Sapiens
LHLPSAPWP

SEQ ID NO: 706370 - protein, 9 aa, Homo Sapiens
LGRKAFLQE

SEQ ID NO: 706371 - protein, 9 aa, Homo Sapiens
LYWRETLQM

SEQ ID NO: 706372 - protein, 9 aa, Homo Sapiens
WPAPPCPAL

SEQ ID NO: 706373 - protein, 9 aa, Homo Sapiens
DAEDKDCED

SEQ ID NO: 706374 - protein, 9 aa, Homo Sapiens
GLPDLGTQS

SEQ ID NO: 706375 - protein, 9 aa, Homo Sapiens
IMDANYFGH

SEQ ID NO: 706376 - protein, 9 aa, Homo Sapiens
VGLHLQSPS

SEQ ID NO: 706377 - protein, 9 aa, Homo Sapiens
EDSQALSDV

SEQ ID NO: 706378 - protein, 9 aa, Homo Sapiens
YPWWGNALG

SEQ ID NO: 706379 - protein, 9 aa, Homo Sapiens
EQERNKEEN

SEQ ID NO: 706380 - protein, 9 aa, Homo Sapiens
RDFIFKNTA

SEQ ID NO: 706381 - protein, 9 aa, Homo Sapiens
PCARYEAKY

SEQ ID NO: 706382 - protein, 9 aa, Homo Sapiens
EDIPKGVPA

SEQ ID NO: 706383 - protein, 9 aa, Homo Sapiens
LPPLIPSSK

SEQ ID NO: 706384 - protein, 9 aa, Homo Sapiens
AACSNPGAS

SEQ ID NO: 706385 - protein, 9 aa, Homo Sapiens
EEEEEQMET

SEQ ID NO: 706386 - protein, 9 aa, Homo Sapiens
SEEEKQMLL

SEQ ID NO: 706387 - protein, 9 aa, Homo Sapiens
LELSLGQFF

SEQ ID NO: 706388 - protein, 9 aa, Homo Sapiens
TDMYGGGED

SEQ ID NO: 706389 - protein, 9 aa, Homo Sapiens
PYSCPIFQK

SEQ ID NO: 706390 - protein, 9 aa, Homo Sapiens
EEDKACGRQ

SEQ ID NO: 706391 - protein, 9 aa, Homo Sapiens
GGCLQFGLV

SEQ ID NO: 706392 - protein, 9 aa, Homo Sapiens
QHQCPGYYQ

SEQ ID NO: 706393 - protein, 9 aa, Homo Sapiens
PSRRGDLQS

SEQ ID NO: 706394 - protein, 9 aa, Homo Sapiens
LLPNDLYMS

SEQ ID NO: 706395 - protein, 9 aa, Homo Sapiens
QRREEEGGV

SEQ ID NO: 706396 - protein, 9 aa, Homo Sapiens
RQGRSSSMG

SEQ ID NO: 706397 - protein, 9 aa, Homo Sapiens
STGKCGPTP

SEQ ID NO: 706398 - protein, 9 aa, Homo Sapiens
HSPSSYPYP

SEQ ID NO: 706399 - protein, 9 aa, Homo Sapiens
KGWGIITKE

SEQ ID NO: 706400 - protein, 9 aa, Homo Sapiens
MPAAHPGQL

SEQ ID NO: 706401 - protein, 9 aa, Homo Sapiens
KLKNKQKRQ

SEQ ID NO: 706402 - protein, 9 aa, Homo Sapiens
RRHSFFHDN

SEQ ID NO: 706403 - protein, 9 aa, Homo Sapiens
KMAENESEG

SEQ ID NO: 706404 - protein, 9 aa, Homo Sapiens
VKKMTVLYK

SEQ ID NO: 706405 - protein, 9 aa, Homo Sapiens
GVVGPSSVC

SEQ ID NO: 706406 - protein, 9 aa, Homo Sapiens
ARTPQFSNR

SEQ ID NO: 706407 - protein, 9 aa, Homo Sapiens
GNALGWLLA

SEQ ID NO: 706408 - protein, 9 aa, Homo Sapiens
VPQQPSPED

SEQ ID NO: 706409 - protein, 9 aa, Homo Sapiens
SPEDQVVEE

SEQ ID NO: 706410 - protein, 9 aa, Homo Sapiens
ARPQKVVAL

SEQ ID NO: 706411 - protein, 9 aa, Homo Sapiens
TRPNYIRSL

SEQ ID NO: 706412 - protein, 9 aa, Homo Sapiens
VVLMTLPAW

SEQ ID NO: 706413 - protein, 9 aa, Homo Sapiens
RRMQELGLH

SEQ ID NO: 706414 - protein, 9 aa, Homo Sapiens
VVDPGIVRR

SEQ ID NO: 706415 - protein, 9 aa, Homo Sapiens
LNIFLQLRI

SEQ ID NO: 706416 - protein, 9 aa, Homo Sapiens
MEEDKACGR

SEQ ID NO: 706417 - protein, 9 aa, Homo Sapiens
ELGRETGTW

SEQ ID NO: 706418 - protein, 9 aa, Homo Sapiens
FALRRMQEL

SEQ ID NO: 706419 - protein, 9 aa, Homo Sapiens
QVERYVPKH

SEQ ID NO: 706420 - protein, 9 aa, Homo Sapiens
SWVQDGSPK

SEQ ID NO: 706421 - protein, 9 aa, Homo Sapiens
ISHQPEKPL

SEQ ID NO: 706422 - protein, 9 aa, Homo Sapiens
MDERRRLFE

SEQ ID NO: 706423 - protein, 9 aa, Homo Sapiens
RKGPGTPPT

SEQ ID NO: 706424 - protein, 9 aa, Homo Sapiens
EQGQGADAP

SEQ ID NO: 706425 - protein, 9 aa, Homo Sapiens
KEATPWRWQ

SEQ ID NO: 706426 - protein, 9 aa, Homo Sapiens
GDGGEFHRE

SEQ ID NO: 706427 - protein, 9 aa, Homo Sapiens
INRYCNICH

SEQ ID NO: 706428 - protein, 9 aa, Homo Sapiens
VDPGIVRRY

SEQ ID NO: 706429 - protein, 9 aa, Homo Sapiens
LQRLHMLQM

SEQ ID NO: 706430 - protein, 9 aa, Homo Sapiens
ISRTQALLL

SEQ ID NO: 706431 - protein, 9 aa, Homo Sapiens
VSSLAPGQT

SEQ ID NO: 706432 - protein, 9 aa, Homo Sapiens
FQVLTFEWA

SEQ ID NO: 706433 - protein, 9 aa, Homo Sapiens
DKIEVCPEN

SEQ ID NO: 706434 - protein, 9 aa, Homo Sapiens
TMLESLVGW

SEQ ID NO: 706435 - protein, 9 aa, Homo Sapiens
VVAGTLEED

SEQ ID NO: 706436 - protein, 9 aa, Homo Sapiens
KLDQGEYKR

SEQ ID NO: 706437 - protein, 9 aa, Homo Sapiens
ETLLEQGKL

SEQ ID NO: 706438 - protein, 9 aa, Homo Sapiens
GFLEAKTLV

SEQ ID NO: 706439 - protein, 9 aa, Homo Sapiens
MKIGNSLFV

SEQ ID NO: 706440 - protein, 9 aa, Homo Sapiens
TRPTRPLPP

SEQ ID NO: 706441 - protein, 9 aa, Homo Sapiens
RPGMRVAFC

SEQ ID NO: 706442 - protein, 9 aa, Homo Sapiens
GNRFKKLTD

SEQ ID NO: 706443 - protein, 9 aa, Homo Sapiens
QANPIGLQN

SEQ ID NO: 706444 - protein, 9 aa, Homo Sapiens
NSVFIKNLS

SEQ ID NO: 706445 - protein, 9 aa, Homo Sapiens
LVAAPAAAA

SEQ ID NO: 706446 - protein, 9 aa, Homo Sapiens
AGKIKQFYK

SEQ ID NO: 706447 - protein, 9 aa, Homo Sapiens
SDVPSLSDI

SEQ ID NO: 706448 - protein, 9 aa, Homo Sapiens
GRKAFLQEV

SEQ ID NO: 706449 - protein, 9 aa, Homo Sapiens
SLAPGQTVS

SEQ ID NO: 706450 - protein, 9 aa, Homo Sapiens
DDGAIGPRQ

SEQ ID NO: 706451 - protein, 9 aa, Homo Sapiens
PKHERCCWC

SEQ ID NO: 706452 - protein, 9 aa, Homo Sapiens
QMSYFRDPY

SEQ ID NO: 706453 - protein, 9 aa, Homo Sapiens
VLMTLPAWS

SEQ ID NO: 706454 - protein, 9 aa, Homo Sapiens
ESGGFQVLT

SEQ ID NO: 706455 - protein, 9 aa, Homo Sapiens
ECYFERLSP

SEQ ID NO: 706456 - protein, 9 aa, Homo Sapiens
GVVGLHLQS

SEQ ID NO: 706457 - protein, 9 aa, Homo Sapiens
QAPCPAQLW

SEQ ID NO: 706458 - protein, 9 aa, Homo Sapiens
QPCARYEAK

SEQ ID NO: 706459 - protein, 9 aa, Homo Sapiens
DMDERRRLF

SEQ ID NO: 706460 - protein, 9 aa, Homo Sapiens
MLESLVGWG

SEQ ID NO: 706461 - protein, 9 aa, Homo Sapiens
ALRRMQELG

SEQ ID NO: 706462 - protein, 9 aa, Homo Sapiens
YEGDAPFCT

SEQ ID NO: 706463 - protein, 9 aa, Homo Sapiens
ILRRHSFFH

SEQ ID NO: 706464 - protein, 9 aa, Homo Sapiens
AAVHWGCIG

SEQ ID NO: 706465 - protein, 9 aa, Homo Sapiens
GKAFTCLAS

SEQ ID NO: 706466 - protein, 9 aa, Homo Sapiens
LSLGQFFSL

SEQ ID NO: 706467 - protein, 9 aa, Homo Sapiens
DVHVPDWHL

SEQ ID NO: 706468 - protein, 9 aa, Homo Sapiens
PTRPLPPLI

SEQ ID NO: 706469 - protein, 9 aa, Homo Sapiens
AYKEATPWR

SEQ ID NO: 706470 - protein, 9 aa, Homo Sapiens
CIECEGQLF

SEQ ID NO: 706471 - protein, 9 aa, Homo Sapiens
TISNPPDWT

SEQ ID NO: 706472 - protein, 9 aa, Homo Sapiens
KPVIAAVHW

SEQ ID NO: 706473 - protein, 9 aa, Homo Sapiens
TPQFSNRRS

SEQ ID NO: 706474 - protein, 9 aa, Homo Sapiens
LEGGGTNSN

SEQ ID NO: 706475 - protein, 9 aa, Homo Sapiens
PNDLYMSFL

SEQ ID NO: 706476 - protein, 9 aa, Homo Sapiens
ALHLPSAPW

SEQ ID NO: 706477 - protein, 9 aa, Homo Sapiens
EKSETPLSP

SEQ ID NO: 706478 - protein, 9 aa, Homo Sapiens
QSNLYWRET

SEQ ID NO: 706479 - protein, 9 aa, Homo Sapiens
LQMSYFRDP

SEQ ID NO: 706480 - protein, 9 aa, Homo Sapiens
FLQLPSDFP

SEQ ID NO: 706481 - protein, 9 aa, Homo Sapiens
ETIIAVRGM

SEQ ID NO: 706482 - protein, 9 aa, Homo Sapiens
LEAEQRQGR

SEQ ID NO: 706483 - protein, 9 aa, Homo Sapiens
PRTLDNVIN

SEQ ID NO: 706484 - protein, 9 aa, Homo Sapiens
KKKLKNKQK

SEQ ID NO: 706485 - protein, 9 aa, Homo Sapiens
YHVDSVASL

SEQ ID NO: 706486 - protein, 9 aa, Homo Sapiens
AAALALGQA

SEQ ID NO: 706487 - protein, 9 aa, Homo Sapiens
IKLNIFLQL

SEQ ID NO: 706488 - protein, 9 aa, Homo Sapiens
PKMAENESE

SEQ ID NO: 706489 - protein, 9 aa, Homo Sapiens
SSGFARAIA

SEQ ID NO: 706490 - protein, 9 aa, Homo Sapiens
QHTIILTET

SEQ ID NO: 706491 - protein, 9 aa, Homo Sapiens
YYVAFLRDL

SEQ ID NO: 706492 - protein, 9 aa, Homo Sapiens
GRKSFLTTE

SEQ ID NO: 706493 - protein, 9 aa, Homo Sapiens
NTAISEMVA

SEQ ID NO: 706494 - protein, 9 aa, Homo Sapiens
YAQVSLPEM

SEQ ID NO: 706495 - protein, 9 aa, Homo Sapiens
HITLTKALL

SEQ ID NO: 706496 - protein, 9 aa, Homo Sapiens
PFSHIDPQE

SEQ ID NO: 706497 - protein, 9 aa, Homo Sapiens
GDSFYMRAL

SEQ ID NO: 706498 - protein, 9 aa, Homo Sapiens
EELETLWLN

SEQ ID NO: 706499 - protein, 9 aa, Homo Sapiens
GEYNVQHQC

SEQ ID NO: 706500 - protein, 9 aa, Homo Sapiens
KGPGTPPTT

SEQ ID NO: 706501 - protein, 9 aa, Homo Sapiens
SEQMCKTYS

SEQ ID NO: 706502 - protein, 9 aa, Homo Sapiens
RSPRAACSN

SEQ ID NO: 706503 - protein, 9 aa, Homo Sapiens
PRQGAADLL

SEQ ID NO: 706504 - protein, 9 aa, Homo Sapiens
RKEPKSRRS

SEQ ID NO: 706505 - protein, 9 aa, Homo Sapiens
TGTWYLVTA

SEQ ID NO: 706506 - protein, 9 aa, Homo Sapiens
LKFQNNSEH

SEQ ID NO: 706507 - protein, 9 aa, Homo Sapiens
MCKKAPKAG

SEQ ID NO: 706508 - protein, 9 aa, Homo Sapiens
AFNCSSTHK

SEQ ID NO: 706509 - protein, 9 aa, Homo Sapiens
IMEEDKACG

SEQ ID NO: 706510 - protein, 9 aa, Homo Sapiens
GAEMVLFNT

SEQ ID NO: 706511 - protein, 9 aa, Homo Sapiens
FSWELPECT

SEQ ID NO: 706512 - protein, 9 aa, Homo Sapiens
RPNYIRSLR

SEQ ID NO: 706513 - protein, 9 aa, Homo Sapiens
QGAADLLRD

SEQ ID NO: 706514 - protein, 9 aa, Homo Sapiens
PASTPFEEV

SEQ ID NO: 706515 - protein, 9 aa, Homo Sapiens
CSRIHCLEI

SEQ ID NO: 706516 - protein, 9 aa, Homo Sapiens
STISGRLLP

SEQ ID NO: 706517 - protein, 9 aa, Homo Sapiens
NPIGLQNRD

SEQ ID NO: 706518 - protein, 9 aa, Homo Sapiens
PSDFPEEVP

SEQ ID NO: 706519 - protein, 9 aa, Homo Sapiens
GGICQCLAK

SEQ ID NO: 706520 - protein, 9 aa, Homo Sapiens
LPVILVVGT

SEQ ID NO: 706521 - protein, 9 aa, Homo Sapiens
DFKTNLRFQ

SEQ ID NO: 706522 - protein, 9 aa, Homo Sapiens
QECLPVILV

SEQ ID NO: 706523 - protein, 9 aa, Homo Sapiens
MLHDVAYKE

SEQ ID NO: 706524 - protein, 9 aa, Homo Sapiens
QIIRKQAQT

SEQ ID NO: 706525 - protein, 9 aa, Homo Sapiens
VLLDAYSEY

SEQ ID NO: 706526 - protein, 9 aa, Homo Sapiens
VSLPEMVCG

SEQ ID NO: 706527 - protein, 9 aa, Homo Sapiens
TPIQRQANP

SEQ ID NO: 706528 - protein, 9 aa, Homo Sapiens
GAIGPRQGA

SEQ ID NO: 706529 - protein, 9 aa, Homo Sapiens
GPTPPIDNG

SEQ ID NO: 706530 - protein, 9 aa, Homo Sapiens
FYKTCNTQV

SEQ ID NO: 706531 - protein, 9 aa, Homo Sapiens
AGELVDSLK

SEQ ID NO: 706532 - protein, 9 aa, Homo Sapiens
FRDRSGDTL

SEQ ID NO: 706533 - protein, 9 aa, Homo Sapiens
KLFKEANAI

SEQ ID NO: 706534 - protein, 9 aa, Homo Sapiens
CKKAPKAGL

SEQ ID NO: 706535 - protein, 9 aa, Homo Sapiens
PAAAALALG

SEQ ID NO: 706536 - protein, 9 aa, Homo Sapiens
MAAVAAGAG

SEQ ID NO: 706537 - protein, 9 aa, Homo Sapiens
PQESEETRL

SEQ ID NO: 706538 - protein, 9 aa, Homo Sapiens
STEGYVQSC

SEQ ID NO: 706539 - protein, 9 aa, Homo Sapiens
LRRHSFFHD

SEQ ID NO: 706540 - protein, 9 aa, Homo Sapiens
NTLYSTVEI

SEQ ID NO: 706541 - protein, 9 aa, Homo Sapiens
AQDFKTNLR

SEQ ID NO: 706542 - protein, 9 aa, Homo Sapiens
GIMEEDKAC

SEQ ID NO: 706543 - protein, 9 aa, Homo Sapiens
RPLKLSKEY

SEQ ID NO: 706544 - protein, 9 aa, Homo Sapiens
GMRVAFCYQ

SEQ ID NO: 706545 - protein, 9 aa, Homo Sapiens
LFEVTFSLQ

SEQ ID NO: 706546 - protein, 9 aa, Homo Sapiens
DERRRLFEQ

SEQ ID NO: 706547 - protein, 9 aa, Homo Sapiens
AAAVPGAPA

SEQ ID NO: 706548 - protein, 9 aa, Homo Sapiens
FRLFACIEC

SEQ ID NO: 706549 - protein, 9 aa, Homo Sapiens
ADTVPSPAD

SEQ ID NO: 706550 - protein, 9 aa, Homo Sapiens
HPETIIAVR

SEQ ID NO: 706551 - protein, 9 aa, Homo Sapiens
SLDDGEQGQ

SEQ ID NO: 706552 - protein, 9 aa, Homo Sapiens
PSSEQMCKT

SEQ ID NO: 706553 - protein, 9 aa, Homo Sapiens
HDNILLNSS

SEQ ID NO: 706554 - protein, 9 aa, Homo Sapiens
SFQGHQERA

SEQ ID NO: 706555 - protein, 9 aa, Homo Sapiens
EYNVQHQCP

SEQ ID NO: 706556 - protein, 9 aa, Homo Sapiens
WLNGICHNE

SEQ ID NO: 706557 - protein, 9 aa, Homo Sapiens
VSSEPQKMY

SEQ ID NO: 706558 - protein, 9 aa, Homo Sapiens
TLNRHNIIH

SEQ ID NO: 706559 - protein, 9 aa, Homo Sapiens
NKIHHIFCD

SEQ ID NO: 706560 - protein, 9 aa, Homo Sapiens
AIQEQLQLE

SEQ ID NO: 706561 - protein, 9 aa, Homo Sapiens
EMVLFNTMA

SEQ ID NO: 706562 - protein, 9 aa, Homo Sapiens
KKAPKAGLS

SEQ ID NO: 706563 - protein, 9 aa, Homo Sapiens
RPTRPLPPL

SEQ ID NO: 706564 - protein, 9 aa, Homo Sapiens
TLDNVINPP

SEQ ID NO: 706565 - protein, 9 aa, Homo Sapiens
LPSVPLPQN

SEQ ID NO: 706566 - protein, 9 aa, Homo Sapiens
KGVPAPKAH

SEQ ID NO: 706567 - protein, 9 aa, Homo Sapiens
LKNKQKRQA

SEQ ID NO: 706568 - protein, 9 aa, Homo Sapiens
KYTYPWWGN

SEQ ID NO: 706569 - protein, 9 aa, Homo Sapiens
TAGPSGKAG

SEQ ID NO: 706570 - protein, 9 aa, Homo Sapiens
PIFQKPFKH

SEQ ID NO: 706571 - protein, 9 aa, Homo Sapiens
GSTEGYVQS

SEQ ID NO: 706572 - protein, 9 aa, Homo Sapiens
AFEMKQLID

SEQ ID NO: 706573 - protein, 9 aa, Homo Sapiens
AQVERYVPK

SEQ ID NO: 706574 - protein, 9 aa, Homo Sapiens
TLLEQGKLD

SEQ ID NO: 706575 - protein, 9 aa, Homo Sapiens
DVPSLSDIL

SEQ ID NO: 706576 - protein, 9 aa, Homo Sapiens
VAYKEATPW

SEQ ID NO: 706577 - protein, 9 aa, Homo Sapiens
TWYLVTALI

SEQ ID NO: 706578 - protein, 9 aa, Homo Sapiens
RRDLFEVTF

SEQ ID NO: 706579 - protein, 9 aa, Homo Sapiens
PLEGGGTNS

SEQ ID NO: 706580 - protein, 9 aa, Homo Sapiens
KRKRGRPLK

SEQ ID NO: 706581 - protein, 9 aa, Homo Sapiens
PLIPPRRLI

SEQ ID NO: 706582 - protein, 9 aa, Homo Sapiens
APMGIVLSP

SEQ ID NO: 706583 - protein, 9 aa, Homo Sapiens
RPCGVRPHG

SEQ ID NO: 706584 - protein, 9 aa, Homo Sapiens
KQMLLEKTN

SEQ ID NO: 706585 - protein, 9 aa, Homo Sapiens
ILRICTSEG

SEQ ID NO: 706586 - protein, 9 aa, Homo Sapiens
GTLEEDEAA

SEQ ID NO: 706587 - protein, 9 aa, Homo Sapiens
AVRGMNVTL

SEQ ID NO: 706588 - protein, 9 aa, Homo Sapiens
TNGGGWTVF

SEQ ID NO: 706589 - protein, 9 aa, Homo Sapiens
EPPASTPFE

SEQ ID NO: 706590 - protein, 9 aa, Homo Sapiens
TYPWWGNAL

SEQ ID NO: 706591 - protein, 9 aa, Homo Sapiens
ENKQIIRKQ

SEQ ID NO: 706592 - protein, 9 aa, Homo Sapiens
VMPGPRQEV

SEQ ID NO: 706593 - protein, 9 aa, Homo Sapiens
NICHSMAYH

SEQ ID NO: 706594 - protein, 9 aa, Homo Sapiens
PGDSFYMRA

SEQ ID NO: 706595 - protein, 9 aa, Homo Sapiens
CTSEGRHRA

SEQ ID NO: 706596 - protein, 9 aa, Homo Sapiens
RRLFEQKTQ

SEQ ID NO: 706597 - protein, 9 aa, Homo Sapiens
KRESKRILY

SEQ ID NO: 706598 - protein, 9 aa, Homo Sapiens
CSNPGASGR

SEQ ID NO: 706599 - protein, 9 aa, Homo Sapiens
WMSDGNPEL

SEQ ID NO: 706600 - protein, 9 aa, Homo Sapiens
YQRLGIGTK

SEQ ID NO: 706601 - protein, 9 aa, Homo Sapiens
APVAVISEE

SEQ ID NO: 706602 - protein, 9 aa, Homo Sapiens
TEGYVQSCN

SEQ ID NO: 706603 - protein, 9 aa, Homo Sapiens
QALSDVPSL

SEQ ID NO: 706604 - protein, 9 aa, Homo Sapiens
CVRRDLFEV

SEQ ID NO: 706605 - protein, 9 aa, Homo Sapiens
RQANPIGLQ

SEQ ID NO: 706606 - protein, 9 aa, Homo Sapiens
FEQKTQESQ

SEQ ID NO: 706607 - protein, 9 aa, Homo Sapiens
LRDFIFKNT

SEQ ID NO: 706608 - protein, 9 aa, Homo Sapiens
AAAYLAGLI

SEQ ID NO: 706609 - protein, 9 aa, Homo Sapiens
RSKPGKFVE

SEQ ID NO: 706610 - protein, 9 aa, Homo Sapiens
TEEVLSRKP

SEQ ID NO: 706611 - protein, 9 aa, Homo Sapiens
AGGSADTVP

SEQ ID NO: 706612 - protein, 9 aa, Homo Sapiens
GCMNRRPIL

SEQ ID NO: 706613 - protein, 9 aa, Homo Sapiens
PAMHRPMHF

SEQ ID NO: 706614 - protein, 9 aa, Homo Sapiens
EEDSQALSD

SEQ ID NO: 706615 - protein, 9 aa, Homo Sapiens
MLKLIFLLL

SEQ ID NO: 706616 - protein, 9 aa, Homo Sapiens
EQRQGRSSS

SEQ ID NO: 706617 - protein, 9 aa, Homo Sapiens
LVIIKYKNS

SEQ ID NO: 706618 - protein, 9 aa, Homo Sapiens
MCNSSCMGC

SEQ ID NO: 706619 - protein, 9 aa, Homo Sapiens
PQGSKEESH

SEQ ID NO: 706620 - protein, 9 aa, Homo Sapiens
FKTNLRFQS

SEQ ID NO: 706621 - protein, 9 aa, Homo Sapiens
SGFARAIAI

SEQ ID NO: 706622 - protein, 9 aa, Homo Sapiens
EYLAAALCT

SEQ ID NO: 706623 - protein, 9 aa, Homo Sapiens
LIFLLLFSG

SEQ ID NO: 706624 - protein, 9 aa, Homo Sapiens
DVAYKEATP

SEQ ID NO: 706625 - protein, 9 aa, Homo Sapiens
EGGGTNSNN

SEQ ID NO: 706626 - protein, 9 aa, Homo Sapiens
PFEEVEISI

SEQ ID NO: 706627 - protein, 9 aa, Homo Sapiens
IPKGVPAPK

SEQ ID NO: 706628 - protein, 9 aa, Homo Sapiens
PTPIQRQAN

SEQ ID NO: 706629 - protein, 9 aa, Homo Sapiens
QSRKTLLEC

SEQ ID NO: 706630 - protein, 9 aa, Homo Sapiens
SPHPDLQEQ

SEQ ID NO: 706631 - protein, 9 aa, Homo Sapiens
EEKRQLSLH

SEQ ID NO: 706632 - protein, 9 aa, Homo Sapiens
QRPQGSKEE

SEQ ID NO: 706633 - protein, 9 aa, Homo Sapiens
HQCPGYYQS

SEQ ID NO: 706634 - protein, 9 aa, Homo Sapiens
RFRLFACIE

SEQ ID NO: 706635 - protein, 9 aa, Homo Sapiens
VLTFEWAHV

SEQ ID NO: 706636 - protein, 9 aa, Homo Sapiens
GDTLRWRGE

SEQ ID NO: 706637 - protein, 9 aa, Homo Sapiens
DNERSPRDA

SEQ ID NO: 706638 - protein, 9 aa, Homo Sapiens
PGMRVAFCY

SEQ ID NO: 706639 - protein, 9 aa, Homo Sapiens
GAADLLRDA

SEQ ID NO: 706640 - protein, 9 aa, Homo Sapiens
ANYFGHITL

SEQ ID NO: 706641 - protein, 9 aa, Homo Sapiens
GLSRSCNEA

SEQ ID NO: 706642 - protein, 9 aa, Homo Sapiens
SVLCGVIKR

SEQ ID NO: 706643 - protein, 9 aa, Homo Sapiens
HQLGRKAFL

SEQ ID NO: 706644 - protein, 9 aa, Homo Sapiens
DKDCEDGEA

SEQ ID NO: 706645 - protein, 9 aa, Homo Sapiens
IFLLLFSGA

SEQ ID NO: 706646 - protein, 9 aa, Homo Sapiens
DGGDGGEFH

SEQ ID NO: 706647 - protein, 9 aa, Homo Sapiens
EAKYGEKIT

SEQ ID NO: 706648 - protein, 9 aa, Homo Sapiens
KLKRLFLHN

SEQ ID NO: 706649 - protein, 9 aa, Homo Sapiens
RSPRDAAAY

SEQ ID NO: 706650 - protein, 9 aa, Homo Sapiens
PLLTRPNYI

SEQ ID NO: 706651 - protein, 9 aa, Homo Sapiens
GTITSDLSL

SEQ ID NO: 706652 - protein, 9 aa, Homo Sapiens
LGCLAPYQR

SEQ ID NO: 706653 - protein, 9 aa, Homo Sapiens
APWPAPPCP

SEQ ID NO: 706654 - protein, 9 aa, Homo Sapiens
IAQDFKTNL

SEQ ID NO: 706655 - protein, 9 aa, Homo Sapiens
KFVEFYGLL

SEQ ID NO: 706656 - protein, 9 aa, Homo Sapiens
RPQGSKEES

SEQ ID NO: 706657 - protein, 9 aa, Homo Sapiens
ERPLEGGGT

SEQ ID NO: 706658 - protein, 9 aa, Homo Sapiens
MRKHGHLPL

SEQ ID NO: 706659 - protein, 9 aa, Homo Sapiens
GPSQAERKG

SEQ ID NO: 706660 - protein, 9 aa, Homo Sapiens
KGLRKEPKS

SEQ ID NO: 706661 - protein, 9 aa, Homo Sapiens
VVMCKKAPK

SEQ ID NO: 706662 - protein, 9 aa, Homo Sapiens
EEDEAAQRR

SEQ ID NO: 706663 - protein, 9 aa, Homo Sapiens
RKQAQTFVA

SEQ ID NO: 706664 - protein, 9 aa, Homo Sapiens
QAAETNSVY

SEQ ID NO: 706665 - protein, 9 aa, Homo Sapiens
ASYIDEIDK

SEQ ID NO: 706666 - protein, 9 aa, Homo Sapiens
NLYWRETLQ

SEQ ID NO: 706667 - protein, 9 aa, Homo Sapiens
QFYKTCNTQ

SEQ ID NO: 706668 - protein, 9 aa, Homo Sapiens
SFFHDNILL

SEQ ID NO: 706669 - protein, 9 aa, Homo Sapiens
CGKAFTCLA

SEQ ID NO: 706670 - protein, 9 aa, Homo Sapiens
DAEDAEDKD

SEQ ID NO: 706671 - protein, 9 aa, Homo Sapiens
MSLFPATNY

SEQ ID NO: 706672 - protein, 9 aa, Homo Sapiens
YSEYLAAAL

SEQ ID NO: 706673 - protein, 9 aa, Homo Sapiens
SFHSPSSYP

SEQ ID NO: 706674 - protein, 9 aa, Homo Sapiens
KRLFLHNNR

SEQ ID NO: 706675 - protein, 9 aa, Homo Sapiens
KSFLTTEEV

SEQ ID NO: 706676 - protein, 9 aa, Homo Sapiens
KLNEETLPA

SEQ ID NO: 706677 - protein, 9 aa, Homo Sapiens
NERSPRDAA

SEQ ID NO: 706678 - protein, 9 aa, Homo Sapiens
SAYVWMSDG

SEQ ID NO: 706679 - protein, 9 aa, Homo Sapiens
LKDKDLDLF

SEQ ID NO: 706680 - protein, 9 aa, Homo Sapiens
FACIECEGQ

SEQ ID NO: 706681 - protein, 9 aa, Homo Sapiens
DAYSEYLAA

SEQ ID NO: 706682 - protein, 9 aa, Homo Sapiens
GEDTRLSAF

SEQ ID NO: 706683 - protein, 9 aa, Homo Sapiens
MKETRGYEG

SEQ ID NO: 706684 - protein, 9 aa, Homo Sapiens
LQSPSGQHV

SEQ ID NO: 706685 - protein, 9 aa, Homo Sapiens
CMGCMNRRP

SEQ ID NO: 706686 - protein, 9 aa, Homo Sapiens
PPASTPFEE

SEQ ID NO: 706687 - protein, 9 aa, Homo Sapiens
PHPDLQEQK

SEQ ID NO: 706688 - protein, 9 aa, Homo Sapiens
KGYNQRPQG

SEQ ID NO: 706689 - protein, 9 aa, Homo Sapiens
NEASQRSWN

SEQ ID NO: 706690 - protein, 9 aa, Homo Sapiens
KAGGGAGLA

SEQ ID NO: 706691 - protein, 9 aa, Homo Sapiens
FQREPFHKS

SEQ ID NO: 706692 - protein, 9 aa, Homo Sapiens
GKAGGGAGL

SEQ ID NO: 706693 - protein, 9 aa, Homo Sapiens
LFNTMAYDR

SEQ ID NO: 706694 - protein, 9 aa, Homo Sapiens
SPKGSPRGS

SEQ ID NO: 706695 - protein, 9 aa, Homo Sapiens
GGTNSNNNN

SEQ ID NO: 706696 - protein, 9 aa, Homo Sapiens
NSSCMGCMN

SEQ ID NO: 706697 - protein, 9 aa, Homo Sapiens
GDLQSLGYC

SEQ ID NO: 706698 - protein, 9 aa, Homo Sapiens
IIKYKNSLH

SEQ ID NO: 706699 - protein, 9 aa, Homo Sapiens
CYFERLSPR

SEQ ID NO: 706700 - protein, 9 aa, Homo Sapiens
ESMDGHEKE

SEQ ID NO: 706701 - protein, 9 aa, Homo Sapiens
MLQMSYFRD

SEQ ID NO: 706702 - protein, 9 aa, Homo Sapiens
FSLGPLAVW

SEQ ID NO: 706703 - protein, 9 aa, Homo Sapiens
GGVRMAGQA

SEQ ID NO: 706704 - protein, 9 aa, Homo Sapiens
APQAHGVTS

SEQ ID NO: 706705 - protein, 9 aa, Homo Sapiens
EQAAETNSV

SEQ ID NO: 706706 - protein, 9 aa, Homo Sapiens
DEAAQRREE

SEQ ID NO: 706707 - protein, 9 aa, Homo Sapiens
SYKQVSSEP

SEQ ID NO: 706708 - protein, 9 aa, Homo Sapiens
YSCPIFQKP

SEQ ID NO: 706709 - protein, 9 aa, Homo Sapiens
LDAYSEYLA

SEQ ID NO: 706710 - protein, 9 aa, Homo Sapiens
GICQCLAKR

SEQ ID NO: 706711 - protein, 9 aa, Homo Sapiens
EAHSKPSKN

SEQ ID NO: 706712 - protein, 9 aa, Homo Sapiens
QRLHMLQMS

SEQ ID NO: 706713 - protein, 9 aa, Homo Sapiens
PDLQEQKQQ

SEQ ID NO: 706714 - protein, 9 aa, Homo Sapiens
AEDAEDKDC

SEQ ID NO: 706715 - protein, 9 aa, Homo Sapiens
DSTGKCGPT

SEQ ID NO: 706716 - protein, 9 aa, Homo Sapiens
GHEKELESS

SEQ ID NO: 706717 - protein, 9 aa, Homo Sapiens
VINPPLNLQ

SEQ ID NO: 706718 - protein, 9 aa, Homo Sapiens
SSTLNRHNI

SEQ ID NO: 706719 - protein, 9 aa, Homo Sapiens
KTLLECEMS

SEQ ID NO: 706720 - protein, 9 aa, Homo Sapiens
NVQHQCPGY

SEQ ID NO: 706721 - protein, 9 aa, Homo Sapiens
QHLPSLRAI

SEQ ID NO: 706722 - protein, 9 aa, Homo Sapiens
QAQTFVALC

SEQ ID NO: 706723 - protein, 9 aa, Homo Sapiens
TLRWRGENV

SEQ ID NO: 706724 - protein, 9 aa, Homo Sapiens
GSLLIKNPL

SEQ ID NO: 706725 - protein, 9 aa, Homo Sapiens
RVAFCYQIR

SEQ ID NO: 706726 - protein, 9 aa, Homo Sapiens
ASLCHSEET

SEQ ID NO: 706727 - protein, 9 aa, Homo Sapiens
GLAKWHVPA

SEQ ID NO: 706728 - protein, 9 aa, Homo Sapiens
LPKLKRLFL

SEQ ID NO: 706729 - protein, 9 aa, Homo Sapiens
LPNDLYMSF

SEQ ID NO: 706730 - protein, 9 aa, Homo Sapiens
KLIFLLLFS

SEQ ID NO: 706731 - protein, 9 aa, Homo Sapiens
MVLFNTMAY

SEQ ID NO: 706732 - protein, 9 aa, Homo Sapiens
ECFQVNGAG

SEQ ID NO: 706733 - protein, 9 aa, Homo Sapiens
LEQGKLDTP

SEQ ID NO: 706734 - protein, 9 aa, Homo Sapiens
DSLKLMSLC

SEQ ID NO: 706735 - protein, 9 aa, Homo Sapiens
STGSSFQGH

SEQ ID NO: 706736 - protein, 9 aa, Homo Sapiens
EFHREDEDP

SEQ ID NO: 706737 - protein, 9 aa, Homo Sapiens
SPKMAENES

SEQ ID NO: 706738 - protein, 9 aa, Homo Sapiens
CNSSCMGCM

SEQ ID NO: 706739 - protein, 9 aa, Homo Sapiens
VGMPAAHPG

SEQ ID NO: 706740 - protein, 9 aa, Homo Sapiens
NLIEQSNLY

SEQ ID NO: 706741 - protein, 9 aa, Homo Sapiens
VIVKNIDNG

SEQ ID NO: 706742 - protein, 9 aa, Homo Sapiens
VMCKKAPKA

SEQ ID NO: 706743 - protein, 9 aa, Homo Sapiens
QVEPVTREG

SEQ ID NO: 706744 - protein, 9 aa, Homo Sapiens
MKYYIVQLK

SEQ ID NO: 706745 - protein, 9 aa, Homo Sapiens
RYYKANYWQ

SEQ ID NO: 706746 - protein, 9 aa, Homo Sapiens
ESKRILYQN

SEQ ID NO: 706747 - protein, 9 aa, Homo Sapiens
MSPLLTRPN

SEQ ID NO: 706748 - protein, 9 aa, Homo Sapiens
NRFKKLTDM

SEQ ID NO: 706749 - protein, 9 aa, Homo Sapiens
EEEQMETEE

SEQ ID NO: 706750 - protein, 9 aa, Homo Sapiens
LSLHINKLP

SEQ ID NO: 706751 - protein, 9 aa, Homo Sapiens
DETLLEQGK

SEQ ID NO: 706752 - protein, 9 aa, Homo Sapiens
MAGQAPCPA

SEQ ID NO: 706753 - protein, 9 aa, Homo Sapiens
IKQFYKTCN

SEQ ID NO: 706754 - protein, 9 aa, Homo Sapiens
KDLDLFPAS

SEQ ID NO: 706755 - protein, 9 aa, Homo Sapiens
APAAAALAL

SEQ ID NO: 706756 - protein, 9 aa, Homo Sapiens
CMDVDEFER

SEQ ID NO: 706757 - protein, 9 aa, Homo Sapiens
SLLIKNPLP

SEQ ID NO: 706758 - protein, 9 aa, Homo Sapiens
VLFNTMAYD

SEQ ID NO: 706759 - protein, 9 aa, Homo Sapiens
ETEAHSKPS

SEQ ID NO: 706760 - protein, 9 aa, Homo Sapiens
YNVQHQCPG

SEQ ID NO: 706761 - protein, 9 aa, Homo Sapiens
LDDGEQGQG

SEQ ID NO: 706762 - protein, 9 aa, Homo Sapiens
FEEDQNRDV

SEQ ID NO: 706763 - protein, 9 aa, Homo Sapiens
APKAGLSQS

SEQ ID NO: 706764 - protein, 9 aa, Homo Sapiens
LFSQHTIIL

SEQ ID NO: 706765 - protein, 9 aa, Homo Sapiens
QQYQHLPSL

SEQ ID NO: 706766 - protein, 9 aa, Homo Sapiens
MDGHEKELE

SEQ ID NO: 706767 - protein, 9 aa, Homo Sapiens
KYKNSLHIP

SEQ ID NO: 706768 - protein, 9 aa, Homo Sapiens
SHIDPQESE

SEQ ID NO: 706769 - protein, 9 aa, Homo Sapiens
AKLDQGEYK

SEQ ID NO: 706770 - protein, 9 aa, Homo Sapiens
SDFPEEVPF

SEQ ID NO: 706771 - protein, 9 aa, Homo Sapiens
VVGLHLQSP

SEQ ID NO: 706772 - protein, 9 aa, Homo Sapiens
TVPSPADSL

SEQ ID NO: 706773 - protein, 9 aa, Homo Sapiens
APWRPAKGA

SEQ ID NO: 706774 - protein, 9 aa, Homo Sapiens
EELSVLCGV

SEQ ID NO: 706775 - protein, 9 aa, Homo Sapiens
EKGLRKEPK

SEQ ID NO: 706776 - protein, 9 aa, Homo Sapiens
ISEEDDGAI

SEQ ID NO: 706777 - protein, 9 aa, Homo Sapiens
VATAGGAGT

SEQ ID NO: 706778 - protein, 9 aa, Homo Sapiens
AERERLGIS

SEQ ID NO: 706779 - protein, 9 aa, Homo Sapiens
VGLFKDTNL

SEQ ID NO: 706780 - protein, 9 aa, Homo Sapiens
TVLCDMDTN

SEQ ID NO: 706781 - protein, 9 aa, Homo Sapiens
SPRDAAAYL

SEQ ID NO: 706782 - protein, 9 aa, Homo Sapiens
GEYKRAAID

SEQ ID NO: 706783 - protein, 9 aa, Homo Sapiens
QIELLEVLL

SEQ ID NO: 706784 - protein, 9 aa, Homo Sapiens
VMKIGNSLF

SEQ ID NO: 706785 - protein, 9 aa, Homo Sapiens
ADWLGLKDK

SEQ ID NO: 706786 - protein, 9 aa, Homo Sapiens
GKAFSESSS

SEQ ID NO: 706787 - protein, 9 aa, Homo Sapiens
PRVGMPAAH

SEQ ID NO: 706788 - protein, 9 aa, Homo Sapiens
VHVPDWHLK

SEQ ID NO: 706789 - protein, 9 aa, Homo Sapiens
VDSVASLGT

SEQ ID NO: 706790 - protein, 9 aa, Homo Sapiens
TSGVVGLHL

SEQ ID NO: 706791 - protein, 9 aa, Homo Sapiens
PSVPLPQNP

SEQ ID NO: 706792 - protein, 9 aa, Homo Sapiens
LRWRGENVS

SEQ ID NO: 706793 - protein, 9 aa, Homo Sapiens
DAPDVDVHV

SEQ ID NO: 706794 - protein, 9 aa, Homo Sapiens
ADLLRDASP

SEQ ID NO: 706795 - protein, 9 aa, Homo Sapiens
IDKIRFPTK

SEQ ID NO: 706796 - protein, 9 aa, Homo Sapiens
QGRSSSMGL

SEQ ID NO: 706797 - protein, 9 aa, Homo Sapiens
HMLQMSYFR

SEQ ID NO: 706798 - protein, 9 aa, Homo Sapiens
TTEEVLSRK

SEQ ID NO: 706799 - protein, 9 aa, Homo Sapiens
LRDASPVLQ

SEQ ID NO: 706800 - protein, 9 aa, Homo Sapiens
SVASPHPDL

SEQ ID NO: 706801 - protein, 9 aa, Homo Sapiens
KYGEKITCR

SEQ ID NO: 706802 - protein, 9 aa, Homo Sapiens
LRKEPKSRR

SEQ ID NO: 706803 - protein, 9 aa, Homo Sapiens
ELEQEQRRH

SEQ ID NO: 706804 - protein, 9 aa, Homo Sapiens
LFEQKTQES

SEQ ID NO: 706805 - protein, 9 aa, Homo Sapiens
LSLCEGFSK

SEQ ID NO: 706806 - protein, 9 aa, Homo Sapiens
EEEEQMETE

SEQ ID NO: 706807 - protein, 9 aa, Homo Sapiens
DMDTNGGGW

SEQ ID NO: 706808 - protein, 9 aa, Homo Sapiens
LPSLRAIQD

SEQ ID NO: 706809 - protein, 9 aa, Homo Sapiens
LFKDTNLCA

SEQ ID NO: 706810 - protein, 9 aa, Homo Sapiens
SGDTLRWRG

SEQ ID NO: 706811 - protein, 9 aa, Homo Sapiens
STLNRHNII

SEQ ID NO: 706812 - protein, 9 aa, Homo Sapiens
AMLHDVAYK

SEQ ID NO: 706813 - protein, 9 aa, Homo Sapiens
TLGCLAPYQ

SEQ ID NO: 706814 - protein, 9 aa, Homo Sapiens
PSSYPYPAE

SEQ ID NO: 706815 - protein, 9 aa, Homo Sapiens
SQAERKGPG

SEQ ID NO: 706816 - protein, 9 aa, Homo Sapiens
MDTNGGGWT

SEQ ID NO: 706817 - protein, 9 aa, Homo Sapiens
GSYFHTMLE

SEQ ID NO: 706818 - protein, 9 aa, Homo Sapiens
DPANTLYST

SEQ ID NO: 706819 - protein, 9 aa, Homo Sapiens
IRGMLKLIF

SEQ ID NO: 706820 - protein, 9 aa, Homo Sapiens
LCEGFSKAL

SEQ ID NO: 706821 - protein, 9 aa, Homo Sapiens
FGHITLTKA

SEQ ID NO: 706822 - protein, 9 aa, Homo Sapiens
AALYFVALI

SEQ ID NO: 706823 - protein, 9 aa, Homo Sapiens
QHLPKLKRL

SEQ ID NO: 706824 - protein, 9 aa, Homo Sapiens
AHSLDDGEQ

SEQ ID NO: 706825 - protein, 9 aa, Homo Sapiens
CPAQLWETP

SEQ ID NO: 706826 - protein, 9 aa, Homo Sapiens
TPPIDNGDI

SEQ ID NO: 706827 - protein, 9 aa, Homo Sapiens
IRKQAQTFV

SEQ ID NO: 706828 - protein, 9 aa, Homo Sapiens
IKVIDKIRF

SEQ ID NO: 706829 - protein, 9 aa, Homo Sapiens
DMRRMAAAF

SEQ ID NO: 706830 - protein, 9 aa, Homo Sapiens
QEELSVLCG

SEQ ID NO: 706831 - protein, 9 aa, Homo Sapiens
LKLEAEQRQ

SEQ ID NO: 706832 - protein, 9 aa, Homo Sapiens
TVVDPGIVR

SEQ ID NO: 706833 - protein, 9 aa, Homo Sapiens
QNNSEHNVK

SEQ ID NO: 706834 - protein, 9 aa, Homo Sapiens
FEYPESSGF

SEQ ID NO: 706835 - protein, 9 aa, Homo Sapiens
CRSNKIHHI

SEQ ID NO: 706836 - protein, 9 aa, Homo Sapiens
GYRGHQNRT

SEQ ID NO: 706837 - protein, 9 aa, Homo Sapiens
RDHARTPQF

SEQ ID NO: 706838 - protein, 9 aa, Homo Sapiens
EQEELSVLC

SEQ ID NO: 706839 - protein, 9 aa, Homo Sapiens
ASLYYGTLI

SEQ ID NO: 706840 - protein, 9 aa, Homo Sapiens
LDYYVAFLR

SEQ ID NO: 706841 - protein, 9 aa, Homo Sapiens
VRTARTLRA

SEQ ID NO: 706842 - protein, 9 aa, Homo Sapiens
LQLPSDFPE

SEQ ID NO: 706843 - protein, 9 aa, Homo Sapiens
TPQAKALAA

SEQ ID NO: 706844 - protein, 9 aa, Homo Sapiens
MLLEKTNLS

SEQ ID NO: 706845 - protein, 9 aa, Homo Sapiens
LSASLYYGT

SEQ ID NO: 706846 - protein, 9 aa, Homo Sapiens
DFIFKNTAI

SEQ ID NO: 706847 - protein, 9 aa, Homo Sapiens
VNGAGYRGH

SEQ ID NO: 706848 - protein, 9 aa, Homo Sapiens
PEPPASTPF

SEQ ID NO: 706849 - protein, 9 aa, Homo Sapiens
DKVVDKIEV

SEQ ID NO: 706850 - protein, 9 aa, Homo Sapiens
FQGHQERAE

SEQ ID NO: 706851 - protein, 9 aa, Homo Sapiens
TPFEEVEIS

SEQ ID NO: 706852 - protein, 9 aa, Homo Sapiens
PGRPVSSLA

SEQ ID NO: 706853 - protein, 9 aa, Homo Sapiens
SSTGSSFQG

SEQ ID NO: 706854 - protein, 9 aa, Homo Sapiens
LAKWHVPAA

SEQ ID NO: 706855 - protein, 9 aa, Homo Sapiens
QRGRSGSAN

SEQ ID NO: 706856 - protein, 9 aa, Homo Sapiens
GHLPLVAVF

SEQ ID NO: 706857 - protein, 9 aa, Homo Sapiens
LQEAKLELE

SEQ ID NO: 706858 - protein, 9 aa, Homo Sapiens
SNLIEQSNL

SEQ ID NO: 706859 - protein, 9 aa, Homo Sapiens
CPECYFERL

SEQ ID NO: 706860 - protein, 9 aa, Homo Sapiens
YSAHRPVVV

SEQ ID NO: 706861 - protein, 9 aa, Homo Sapiens
HTMLESLVG

SEQ ID NO: 706862 - protein, 9 aa, Homo Sapiens
RPVVVAAGE

SEQ ID NO: 706863 - protein, 9 aa, Homo Sapiens
QVNGAGYRG

SEQ ID NO: 706864 - protein, 9 aa, Homo Sapiens
LEIQNSCSR

SEQ ID NO: 706865 - protein, 9 aa, Homo Sapiens
RLFEQKTQE

SEQ ID NO: 706866 - protein, 9 aa, Homo Sapiens
PVVVAAGEF

SEQ ID NO: 706867 - protein, 9 aa, Homo Sapiens
MCMDVDEFE

SEQ ID NO: 706868 - protein, 9 aa, Homo Sapiens
YPESSGFAR

SEQ ID NO: 706869 - protein, 9 aa, Homo Sapiens
VNQASLCHS

SEQ ID NO: 706870 - protein, 9 aa, Homo Sapiens
SLLPNDLYM

SEQ ID NO: 706871 - protein, 9 aa, Homo Sapiens
RREEEGGVR

SEQ ID NO: 706872 - protein, 9 aa, Homo Sapiens
AHRPVVVAA

SEQ ID NO: 706873 - protein, 9 aa, Homo Sapiens
LPAWSTIWV

SEQ ID NO: 706874 - protein, 9 aa, Homo Sapiens
ETPHWLGAP

SEQ ID NO: 706875 - protein, 9 aa, Homo Sapiens
AKALAAAAQ

SEQ ID NO: 706876 - protein, 9 aa, Homo Sapiens
LNRHNIIHT

SEQ ID NO: 706877 - protein, 9 aa, Homo Sapiens
PKGSPRGSE

SEQ ID NO: 706878 - protein, 9 aa, Homo Sapiens
IRFPTKQES

SEQ ID NO: 706879 - protein, 9 aa, Homo Sapiens
KYYIVQLKR

SEQ ID NO: 706880 - protein, 9 aa, Homo Sapiens
IELLEVLLS

SEQ ID NO: 706881 - protein, 9 aa, Homo Sapiens
IDEIDKLFK

SEQ ID NO: 706882 - protein, 9 aa, Homo Sapiens
LWLNGICHN

SEQ ID NO: 706883 - protein, 9 aa, Homo Sapiens
RKSFLTTEE

SEQ ID NO: 706884 - protein, 9 aa, Homo Sapiens
CVFMTISNP

SEQ ID NO: 706885 - protein, 9 aa, Homo Sapiens
VDEQERNKE

SEQ ID NO: 706886 - protein, 9 aa, Homo Sapiens
SNPGASGRA

SEQ ID NO: 706887 - protein, 9 aa, Homo Sapiens
NALGWLLAL

SEQ ID NO: 706888 - protein, 9 aa, Homo Sapiens
KALKQCKYY

SEQ ID NO: 706889 - protein, 9 aa, Homo Sapiens
SEYLAAALC

SEQ ID NO: 706890 - protein, 9 aa, Homo Sapiens
SGCPGLFSW

SEQ ID NO: 706891 - protein, 9 aa, Homo Sapiens
DKWLTGLAK

SEQ ID NO: 706892 - protein, 9 aa, Homo Sapiens
NRYCNICHS

SEQ ID NO: 706893 - protein, 9 aa, Homo Sapiens
LHAAIARPQ

SEQ ID NO: 706894 - protein, 9 aa, Homo Sapiens
WELPECTQE

SEQ ID NO: 706895 - protein, 9 aa, Homo Sapiens
SSFQGHQER

SEQ ID NO: 706896 - protein, 9 aa, Homo Sapiens
VAFCYQIRR

SEQ ID NO: 706897 - protein, 9 aa, Homo Sapiens
KVIDKIRFP

SEQ ID NO: 706898 - protein, 9 aa, Homo Sapiens
RGYEGDAPF

SEQ ID NO: 706899 - protein, 9 aa, Homo Sapiens
DLFEVTFSL

SEQ ID NO: 706900 - protein, 9 aa, Homo Sapiens
TEMKYYIVQ

SEQ ID NO: 706901 - protein, 9 aa, Homo Sapiens
IDPQESEET

SEQ ID NO: 706902 - protein, 9 aa, Homo Sapiens
QYVMKIGNS

SEQ ID NO: 706903 - protein, 9 aa, Homo Sapiens
ERKGPGTPP

SEQ ID NO: 706904 - protein, 9 aa, Homo Sapiens
ILLCELFSQ

SEQ ID NO: 706905 - protein, 9 aa, Homo Sapiens
LGTQSLFSS

SEQ ID NO: 706906 - protein, 9 aa, Homo Sapiens
IIRKQAQTF

SEQ ID NO: 706907 - protein, 9 aa, Homo Sapiens
VSQVEPVTR

SEQ ID NO: 706908 - protein, 9 aa, Homo Sapiens
QLGRKAFLQ

SEQ ID NO: 706909 - protein, 9 aa, Homo Sapiens
CGPSRRGDL

SEQ ID NO: 706910 - protein, 9 aa, Homo Sapiens
LTFEWAHVQ

SEQ ID NO: 706911 - protein, 9 aa, Homo Sapiens
IITKEPLKA

SEQ ID NO: 706912 - protein, 9 aa, Homo Sapiens
HAAIARPQK

SEQ ID NO: 706913 - protein, 9 aa, Homo Sapiens
DLLRDASPV

SEQ ID NO: 706914 - protein, 9 aa, Homo Sapiens
WGIITKEPL

SEQ ID NO: 706915 - protein, 9 aa, Homo Sapiens
ARPCGVRPH

SEQ ID NO: 706916 - protein, 9 aa, Homo Sapiens
DDGEQGQGA

SEQ ID NO: 706917 - protein, 9 aa, Homo Sapiens
LLLHIDSFI

SEQ ID NO: 706918 - protein, 9 aa, Homo Sapiens
VTREGELWH

SEQ ID NO: 706919 - protein, 9 aa, Homo Sapiens
DRSGDTLRW

SEQ ID NO: 706920 - protein, 9 aa, Homo Sapiens
ERRFRLFAC

SEQ ID NO: 706921 - protein, 9 aa, Homo Sapiens
SNLYWRETL

SEQ ID NO: 706922 - protein, 9 aa, Homo Sapiens
LFSWELPEC

SEQ ID NO: 706923 - protein, 9 aa, Homo Sapiens
IDKSANSVF

SEQ ID NO: 706924 - protein, 9 aa, Homo Sapiens
PAARGGCLQ

SEQ ID NO: 706925 - protein, 9 aa, Homo Sapiens
DEIDKLFKE

SEQ ID NO: 706926 - protein, 9 aa, Homo Sapiens
HEKELESSE

SEQ ID NO: 706927 - protein, 9 aa, Homo Sapiens
KEEQSKLNE

SEQ ID NO: 706928 - protein, 9 aa, Homo Sapiens
AWMKQAIQE

SEQ ID NO: 706929 - protein, 9 aa, Homo Sapiens
YQHLPSLRA

SEQ ID NO: 706930 - protein, 9 aa, Homo Sapiens
QCLAKRYSV

SEQ ID NO: 706931 - protein, 9 aa, Homo Sapiens
SMDGHEKEL

SEQ ID NO: 706932 - protein, 9 aa, Homo Sapiens
AKRYSVILL

SEQ ID NO: 706933 - protein, 9 aa, Homo Sapiens
PEGSLLIKN

SEQ ID NO: 706934 - protein, 9 aa, Homo Sapiens
KSANSVFIK

SEQ ID NO: 706935 - protein, 9 aa, Homo Sapiens
YKVYPYLCR

SEQ ID NO: 706936 - protein, 9 aa, Homo Sapiens
LESCYAQVS

SEQ ID NO: 706937 - protein, 9 aa, Homo Sapiens
SLCEGFSKA

SEQ ID NO: 706938 - protein, 9 aa, Homo Sapiens
ISGRLLPIM

SEQ ID NO: 706939 - protein, 9 aa, Homo Sapiens
VLQLPGGSL

SEQ ID NO: 706940 - protein, 9 aa, Homo Sapiens
PKGVPAPKA

SEQ ID NO: 706941 - protein, 9 aa, Homo Sapiens
RPLNVLQLP

SEQ ID NO: 706942 - protein, 9 aa, Homo Sapiens
EASQRSWNE

SEQ ID NO: 706943 - protein, 9 aa, Homo Sapiens
EQSNLYWRE

SEQ ID NO: 706944 - protein, 9 aa, Homo Sapiens
APDGPESPK

SEQ ID NO: 706945 - protein, 9 aa, Homo Sapiens
LITLYQCFS

SEQ ID NO: 706946 - protein, 9 aa, Homo Sapiens
HDVAYKEAT

SEQ ID NO: 706947 - protein, 9 aa, Homo Sapiens
GIITKEPLK

SEQ ID NO: 706948 - protein, 9 aa, Homo Sapiens
SKEKGLRKE

SEQ ID NO: 706949 - protein, 9 aa, Homo Sapiens
FSKALKQCK

SEQ ID NO: 706950 - protein, 9 aa, Homo Sapiens
LAPGQTVSS

SEQ ID NO: 706951 - protein, 9 aa, Homo Sapiens
VDSLKLMSL

SEQ ID NO: 706952 - protein, 9 aa, Homo Sapiens
FTCLASVRR

SEQ ID NO: 706953 - protein, 9 aa, Homo Sapiens
DVRTARTLR

SEQ ID NO: 706954 - protein, 9 aa, Homo Sapiens
ELSVLCGVI

SEQ ID NO: 706955 - protein, 9 aa, Homo Sapiens
PQFSNRRST

SEQ ID NO: 706956 - protein, 9 aa, Homo Sapiens
KPYSCPIFQ

SEQ ID NO: 706957 - protein, 9 aa, Homo Sapiens
KQIIRKQAQ

SEQ ID NO: 706958 - protein, 9 aa, Homo Sapiens
QVSQVEPVT

SEQ ID NO: 706959 - protein, 9 aa, Homo Sapiens
DNGTSDRPY

SEQ ID NO: 706960 - protein, 9 aa, Homo Sapiens
AFLRDLPEC

SEQ ID NO: 706961 - protein, 9 aa, Homo Sapiens
KNKKKKLKN

SEQ ID NO: 706962 - protein, 9 aa, Homo Sapiens
IKYKNSLHI

SEQ ID NO: 706963 - protein, 9 aa, Homo Sapiens
NGGGWTVFQ

SEQ ID NO: 706964 - protein, 9 aa, Homo Sapiens
EYKRAAIDA

SEQ ID NO: 706965 - protein, 9 aa, Homo Sapiens
SLRAIQDDC

SEQ ID NO: 706966 - protein, 9 aa, Homo Sapiens
DAAAYLAGL

SEQ ID NO: 706967 - protein, 9 aa, Homo Sapiens
GTQSLFSSP

SEQ ID NO: 706968 - protein, 9 aa, Homo Sapiens
AAAALALGQ

SEQ ID NO: 706969 - protein, 9 aa, Homo Sapiens
SCYAQVSLP

SEQ ID NO: 706970 - protein, 9 aa, Homo Sapiens
DGGEFHRED

SEQ ID NO: 706971 - protein, 9 aa, Homo Sapiens
CLAKRYSVI

SEQ ID NO: 706972 - protein, 9 aa, Homo Sapiens
GFSKALKQC

SEQ ID NO: 706973 - protein, 9 aa, Homo Sapiens
NPLPSQTGL

SEQ ID NO: 706974 - protein, 9 aa, Homo Sapiens
RPLPPLIPS

SEQ ID NO: 706975 - protein, 9 aa, Homo Sapiens
WGCIGGGVD

SEQ ID NO: 706976 - protein, 9 aa, Homo Sapiens
PGQLGGPAA

SEQ ID NO: 706977 - protein, 9 aa, Homo Sapiens
PGPRQEVLC

SEQ ID NO: 706978 - protein, 9 aa, Homo Sapiens
EDKACGRQY

SEQ ID NO: 706979 - protein, 9 aa, Homo Sapiens
LGQFFSLGP

SEQ ID NO: 706980 - protein, 9 aa, Homo Sapiens
LEAKTLVKK

SEQ ID NO: 706981 - protein, 9 aa, Homo Sapiens
DGPESPKGS

SEQ ID NO: 706982 - protein, 9 aa, Homo Sapiens
SADMRRMAA

SEQ ID NO: 706983 - protein, 9 aa, Homo Sapiens
WRPAKGADS

SEQ ID NO: 706984 - protein, 9 aa, Homo Sapiens
EAKTLVKKM

SEQ ID NO: 706985 - protein, 9 aa, Homo Sapiens
LTNCVFMTI

SEQ ID NO: 706986 - protein, 9 aa, Homo Sapiens
GGEKSETPL

SEQ ID NO: 706987 - protein, 9 aa, Homo Sapiens
PWPAPPCPA

SEQ ID NO: 706988 - protein, 9 aa, Homo Sapiens
LGVSGEVFD

SEQ ID NO: 706989 - protein, 9 aa, Homo Sapiens
YFVALITFG

SEQ ID NO: 706990 - protein, 9 aa, Homo Sapiens
QSLFSSPEE

SEQ ID NO: 706991 - protein, 9 aa, Homo Sapiens
HKKHKIIHT

SEQ ID NO: 706992 - protein, 9 aa, Homo Sapiens
ALALGQALW

SEQ ID NO: 706993 - protein, 9 aa, Homo Sapiens
KGSPRGSEA

SEQ ID NO: 706994 - protein, 9 aa, Homo Sapiens
NFLDYYVAF

SEQ ID NO: 706995 - protein, 9 aa, Homo Sapiens
RAACSNPGA

SEQ ID NO: 706996 - protein, 9 aa, Homo Sapiens
FKNTAISEM

SEQ ID NO: 706997 - protein, 9 aa, Homo Sapiens
NDLYMSFLL

SEQ ID NO: 706998 - protein, 9 aa, Homo Sapiens
EGFSKALKQ

SEQ ID NO: 706999 - protein, 9 aa, Homo Sapiens
ISNPPDWTK

SEQ ID NO: 707000 - protein, 9 aa, Homo Sapiens
VKQGDDDDS

SEQ ID NO: 707001 - protein, 9 aa, Homo Sapiens
WENGDSGTL

SEQ ID NO: 707002 - protein, 9 aa, Homo Sapiens
VALITFGNY

SEQ ID NO: 707003 - protein, 9 aa, Homo Sapiens
AEMVLFNTM

SEQ ID NO: 707004 - protein, 9 aa, Homo Sapiens
CSSTLNRHN

SEQ ID NO: 707005 - protein, 9 aa, Homo Sapiens
PDVDVHVPD

SEQ ID NO: 707006 - protein, 9 aa, Homo Sapiens
SNFTAPMGI

SEQ ID NO: 707007 - protein, 9 aa, Homo Sapiens
CHSEETSTC

SEQ ID NO: 707008 - protein, 9 aa, Homo Sapiens
PLPPLIPSS

SEQ ID NO: 707009 - protein, 9 aa, Homo Sapiens
EQGKLDTPG

SEQ ID NO: 707010 - protein, 9 aa, Homo Sapiens
PIQRQANPI

SEQ ID NO: 707011 - protein, 9 aa, Homo Sapiens
WETPHWLGA

SEQ ID NO: 707012 - protein, 9 aa, Homo Sapiens
KRGRPLKLS

SEQ ID NO: 707013 - protein, 9 aa, Homo Sapiens
KDSLLPNDL

SEQ ID NO: 707014 - protein, 9 aa, Homo Sapiens
NRHNIIHTG

SEQ ID NO: 707015 - protein, 9 aa, Homo Sapiens
LLEVLLSFE

SEQ ID NO: 707016 - protein, 9 aa, Homo Sapiens
PFHKSHTSR

SEQ ID NO: 707017 - protein, 9 aa, Homo Sapiens
VSGEVFDFS

SEQ ID NO: 707018 - protein, 9 aa, Homo Sapiens
AYLVGLFKD

SEQ ID NO: 707019 - protein, 9 aa, Homo Sapiens
IGNSLFVQN

SEQ ID NO: 707020 - protein, 9 aa, Homo Sapiens
LDNVINPPL

SEQ ID NO: 707021 - protein, 9 aa, Homo Sapiens
PSGQHVVAG

SEQ ID NO: 707022 - protein, 9 aa, Homo Sapiens
EEDQNRDVK

SEQ ID NO: 707023 - protein, 9 aa, Homo Sapiens
FHSPSSYPY

SEQ ID NO: 707024 - protein, 9 aa, Homo Sapiens
LCELFSQHT

SEQ ID NO: 707025 - protein, 9 aa, Homo Sapiens
KEKGLRKEP

SEQ ID NO: 707026 - protein, 9 aa, Homo Sapiens
LNVLQLPGG

SEQ ID NO: 707027 - protein, 9 aa, Homo Sapiens
KTNLRFQSS

SEQ ID NO: 707028 - protein, 9 aa, Homo Sapiens
SYSFHSPSS

SEQ ID NO: 707029 - protein, 9 aa, Homo Sapiens
TAPMGIVLS

SEQ ID NO: 707030 - protein, 9 aa, Homo Sapiens
GAAAVPGAP

SEQ ID NO: 707031 - protein, 9 aa, Homo Sapiens
LKLFPLHIG

SEQ ID NO: 707032 - protein, 9 aa, Homo Sapiens
DGEQGQGAD

SEQ ID NO: 707033 - protein, 9 aa, Homo Sapiens
SVPLPQNPM

SEQ ID NO: 707034 - protein, 9 aa, Homo Sapiens
CTVVDPGIV

SEQ ID NO: 707035 - protein, 9 aa, Homo Sapiens
SAPWPAPPC

SEQ ID NO: 707036 - protein, 9 aa, Homo Sapiens
FQNNSEHNV

SEQ ID NO: 707037 - protein, 9 aa, Homo Sapiens
CARYEAKYG

SEQ ID NO: 707038 - protein, 9 aa, Homo Sapiens
EDQNRDVKQ

SEQ ID NO: 707039 - protein, 9 aa, Homo Sapiens
ASSTGSSFQ

SEQ ID NO: 707040 - protein, 9 aa, Homo Sapiens
IAVRGMNVT

SEQ ID NO: 707041 - protein, 9 aa, Homo Sapiens
WLGAPEPPA

SEQ ID NO: 707042 - protein, 9 aa, Homo Sapiens
EQSKLNEET

SEQ ID NO: 707043 - protein, 9 aa, Homo Sapiens
PRAACSNPG

SEQ ID NO: 707044 - protein, 9 aa, Homo Sapiens
SEETSTCIG

SEQ ID NO: 707045 - protein, 9 aa, Homo Sapiens
KACGRQYTL

SEQ ID NO: 707046 - protein, 9 aa, Homo Sapiens
EEVEISIIQ

SEQ ID NO: 707047 - protein, 9 aa, Homo Sapiens
FQVNGAGYR

SEQ ID NO: 707048 - protein, 9 aa, Homo Sapiens
MDVDEFERH

SEQ ID NO: 707049 - protein, 9 aa, Homo Sapiens
VCSILRICT

SEQ ID NO: 707050 - protein, 9 aa, Homo Sapiens
AFTCLASVR

SEQ ID NO: 707051 - protein, 9 aa, Homo Sapiens
LLCELFSQH

SEQ ID NO: 707052 - protein, 9 aa, Homo Sapiens
CGVIKRSSS

SEQ ID NO: 707053 - protein, 9 aa, Homo Sapiens
FSHIDPQES

SEQ ID NO: 707054 - protein, 9 aa, Homo Sapiens
DTNGGGWTV

SEQ ID NO: 707055 - protein, 9 aa, Homo Sapiens
LRAIQDDCQ

SEQ ID NO: 707056 - protein, 9 aa, Homo Sapiens
YFHTMLESL

SEQ ID NO: 707057 - protein, 9 aa, Homo Sapiens
SIVDEQERN

SEQ ID NO: 707058 - protein, 9 aa, Homo Sapiens
MCTVVDPGI

SEQ ID NO: 707059 - protein, 9 aa, Homo Sapiens
NVLQLPGGS

SEQ ID NO: 707060 - protein, 9 aa, Homo Sapiens
GVSGEVFDF

SEQ ID NO: 707061 - protein, 9 aa, Homo Sapiens
SWELPECTQ

SEQ ID NO: 707062 - protein, 9 aa, Homo Sapiens
IVDEQERNK

SEQ ID NO: 707063 - protein, 9 aa, Homo Sapiens
PAQLWETPH

SEQ ID NO: 707064 - protein, 9 aa, Homo Sapiens
QPSPEDQVV

SEQ ID NO: 707065 - protein, 9 aa, Homo Sapiens
AAPAAAALA

SEQ ID NO: 707066 - protein, 9 aa, Homo Sapiens
IFCDILPLY

SEQ ID NO: 707067 - protein, 9 aa, Homo Sapiens
AEQRQGRSS

SEQ ID NO: 707068 - protein, 9 aa, Homo Sapiens
EEQMETEEK

SEQ ID NO: 707069 - protein, 9 aa, Homo Sapiens
GGEFHREDE

SEQ ID NO: 707070 - protein, 9 aa, Homo Sapiens
ESQYVMKIG

SEQ ID NO: 707071 - protein, 9 aa, Homo Sapiens
HRPVVVAAG

SEQ ID NO: 707072 - protein, 9 aa, Homo Sapiens
SRRGDLQSL

SEQ ID NO: 707073 - protein, 9 aa, Homo Sapiens
EDAEDKDCE

SEQ ID NO: 707074 - protein, 9 aa, Homo Sapiens
LALGQALWP

SEQ ID NO: 707075 - protein, 9 aa, Homo Sapiens
ETLWLNGIC

SEQ ID NO: 707076 - protein, 9 aa, Homo Sapiens
VKNIDNGTS

SEQ ID NO: 707077 - protein, 9 aa, Homo Sapiens
YTYPWWGNA

SEQ ID NO: 707078 - protein, 9 aa, Homo Sapiens
IQEEFYKVY

SEQ ID NO: 707079 - protein, 9 aa, Homo Sapiens
DMKDSLLPN

SEQ ID NO: 707080 - protein, 9 aa, Homo Sapiens
AKLELEQEQ

SEQ ID NO: 707081 - protein, 9 aa, Homo Sapiens
SLQESMDGH

SEQ ID NO: 707082 - protein, 9 aa, Homo Sapiens
STPFEEVEI

SEQ ID NO: 707083 - protein, 9 aa, Homo Sapiens
AGTLEEDEA

SEQ ID NO: 707084 - protein, 9 aa, Homo Sapiens
GKIKQFYKT

SEQ ID NO: 707085 - protein, 9 aa, Homo Sapiens
DSLLPNDLY

SEQ ID NO: 707086 - protein, 9 aa, Homo Sapiens
MRALYDRLA

SEQ ID NO: 707087 - protein, 9 aa, Homo Sapiens
QFSNRRSTP

SEQ ID NO: 707088 - protein, 9 aa, Homo Sapiens
SLHINKLPG

SEQ ID NO: 707089 - protein, 9 aa, Homo Sapiens
RLQEAKLEL

SEQ ID NO: 707090 - protein, 9 aa, Homo Sapiens
QESEETRLL

SEQ ID NO: 707091 - protein, 9 aa, Homo Sapiens
IVNETEAHS

SEQ ID NO: 707092 - protein, 9 aa, Homo Sapiens
QEVLCAFWK

SEQ ID NO: 707093 - protein, 9 aa, Homo Sapiens
ELLEVLLSF

SEQ ID NO: 707094 - protein, 9 aa, Homo Sapiens
GDTPQAKAL

SEQ ID NO: 707095 - protein, 9 aa, Homo Sapiens
RGGCLQFGL

SEQ ID NO: 707096 - protein, 9 aa, Homo Sapiens
SASSTGSSF

SEQ ID NO: 707097 - protein, 9 aa, Homo Sapiens
YVAFLRDLP

SEQ ID NO: 707098 - protein, 9 aa, Homo Sapiens
PQAHGVTSA

SEQ ID NO: 707099 - protein, 9 aa, Homo Sapiens
PSPEDQVVE

SEQ ID NO: 707100 - protein, 9 aa, Homo Sapiens
DANYFGHIT

SEQ ID NO: 707101 - protein, 9 aa, Homo Sapiens
QEEFYKVYP

SEQ ID NO: 707102 - protein, 9 aa, Homo Sapiens
GYEGDAPFC

SEQ ID NO: 707103 - protein, 9 aa, Homo Sapiens
DGSPKMAEN

SEQ ID NO: 707104 - protein, 9 aa, Homo Sapiens
SAFEMKQLI

SEQ ID NO: 707105 - protein, 9 aa, Homo Sapiens
FEMKQLIDN

SEQ ID NO: 707106 - protein, 9 aa, Homo Sapiens
PEEEEEEQM

SEQ ID NO: 707107 - protein, 9 aa, Homo Sapiens
KGCGPSRRG

SEQ ID NO: 707108 - protein, 9 aa, Homo Sapiens
STHKKHKII

SEQ ID NO: 707109 - protein, 9 aa, Homo Sapiens
ARLAWCCYR

SEQ ID NO: 707110 - protein, 9 aa, Homo Sapiens
SQRGRSGSA

SEQ ID NO: 707111 - protein, 9 aa, Homo Sapiens
PNYIRSLRK

SEQ ID NO: 707112 - protein, 9 aa, Homo Sapiens
VFIIIFWEN

SEQ ID NO: 707113 - protein, 9 aa, Homo Sapiens
LESLVGWGY

SEQ ID NO: 707114 - protein, 9 aa, Homo Sapiens
RKAFLQEVW

SEQ ID NO: 707115 - protein, 9 aa, Homo Sapiens
GGSADTVPS

SEQ ID NO: 707116 - protein, 9 aa, Homo Sapiens
YVWMSDGNP

SEQ ID NO: 707117 - protein, 9 aa, Homo Sapiens
AKYGEKITC

SEQ ID NO: 707118 - protein, 9 aa, Homo Sapiens
YEAKYGEKI

SEQ ID NO: 707119 - protein, 9 aa, Homo Sapiens
QRQGRSSSM

SEQ ID NO: 707120 - protein, 9 aa, Homo Sapiens
QAKALAAAA

SEQ ID NO: 707121 - protein, 9 aa, Homo Sapiens
CLQFGLVEA

SEQ ID NO: 707122 - protein, 9 aa, Homo Sapiens
DTRLSAFEM

SEQ ID NO: 707123 - protein, 9 aa, Homo Sapiens
FDGDSAYVW

SEQ ID NO: 707124 - protein, 9 aa, Homo Sapiens
FHTMLESLV

SEQ ID NO: 707125 - protein, 9 aa, Homo Sapiens
YFERLSPRC

SEQ ID NO: 707126 - protein, 9 aa, Homo Sapiens
EEEKQMLLE

SEQ ID NO: 707127 - protein, 9 aa, Homo Sapiens
LSFESSNMY

SEQ ID NO: 707128 - protein, 9 aa, Homo Sapiens
QNRDVKQGD

SEQ ID NO: 707129 - protein, 9 aa, Homo Sapiens
HGHLPLVAV

SEQ ID NO: 707130 - protein, 9 aa, Homo Sapiens
PCGVRPHGQ

SEQ ID NO: 707131 - protein, 9 aa, Homo Sapiens
NSEHNVKKL

SEQ ID NO: 707132 - protein, 9 aa, Homo Sapiens
APYQRLGIG

SEQ ID NO: 707133 - protein, 9 aa, Homo Sapiens
REEKRESKR

SEQ ID NO: 707134 - protein, 9 aa, Homo Sapiens
GRPLKLSKE

SEQ ID NO: 707135 - protein, 9 aa, Homo Sapiens
PHWLGAPEP

SEQ ID NO: 707136 - protein, 9 aa, Homo Sapiens
SRHQLGRKA

SEQ ID NO: 707137 - protein, 9 aa, Homo Sapiens
HVPDWHLKM

SEQ ID NO: 707138 - protein, 9 aa, Homo Sapiens
LGLKDKDLD

SEQ ID NO: 707139 - protein, 9 aa, Homo Sapiens
LYFVALITF

SEQ ID NO: 707140 - protein, 9 aa, Homo Sapiens
VAIKVIDKI

SEQ ID NO: 707141 - protein, 9 aa, Homo Sapiens
GQFFSLGPL

SEQ ID NO: 707142 - protein, 9 aa, Homo Sapiens
FTAPMGIVL

SEQ ID NO: 707143 - protein, 9 aa, Homo Sapiens
VFMTISNPP

SEQ ID NO: 707144 - protein, 9 aa, Homo Sapiens
TNLRFQSSA

SEQ ID NO: 707145 - protein, 9 aa, Homo Sapiens
ELFSQHTII

SEQ ID NO: 707146 - protein, 9 aa, Homo Sapiens
LQFGLVEAP

SEQ ID NO: 707147 - protein, 9 aa, Homo Sapiens
ERERLGISH

SEQ ID NO: 707148 - protein, 9 aa, Homo Sapiens
SSCMGCMNR

SEQ ID NO: 707149 - protein, 9 aa, Homo Sapiens
QVLTFEWAH

SEQ ID NO: 707150 - protein, 9 aa, Homo Sapiens
SAHRPVVVA

SEQ ID NO: 707151 - protein, 9 aa, Homo Sapiens
KKLTDMYGG

SEQ ID NO: 707152 - protein, 9 aa, Homo Sapiens
QTSGVVGLH

SEQ ID NO: 707153 - protein, 9 aa, Homo Sapiens
VCGKAFSES

SEQ ID NO: 707154 - protein, 9 aa, Homo Sapiens
LPQNPMRPR

SEQ ID NO: 707155 - protein, 9 aa, Homo Sapiens
DKSANSVFI

SEQ ID NO: 707156 - protein, 9 aa, Homo Sapiens
KDTNLCAIH

SEQ ID NO: 707157 - protein, 9 aa, Homo Sapiens
ARYEAKYGE

SEQ ID NO: 707158 - protein, 9 aa, Homo Sapiens
ICQCLAKRY

SEQ ID NO: 707159 - protein, 9 aa, Homo Sapiens
YKEATPWRW

SEQ ID NO: 707160 - protein, 9 aa, Homo Sapiens
DEFERHPCG

SEQ ID NO: 707161 - protein, 9 aa, Homo Sapiens
QMLLEKTNL

SEQ ID NO: 707162 - protein, 9 aa, Homo Sapiens
WIIALQPAM

SEQ ID NO: 707163 - protein, 9 aa, Homo Sapiens
LQPAMHRPM

SEQ ID NO: 707164 - protein, 9 aa, Homo Sapiens
GGAGTITSD

SEQ ID NO: 707165 - protein, 9 aa, Homo Sapiens
SAGKIKQFY

SEQ ID NO: 707166 - protein, 9 aa, Homo Sapiens
AVISEEDDG

SEQ ID NO: 707167 - protein, 9 aa, Homo Sapiens
AEEKGWGII

SEQ ID NO: 707168 - protein, 9 aa, Homo Sapiens
RTARTLRAQ

SEQ ID NO: 707169 - protein, 9 aa, Homo Sapiens
GAGYRGHQN

SEQ ID NO: 707170 - protein, 9 aa, Homo Sapiens
GLFSWELPE

SEQ ID NO: 707171 - protein, 9 aa, Homo Sapiens
PKAGLSQSL

SEQ ID NO: 707172 - protein, 9 aa, Homo Sapiens
EAPVAVISE

SEQ ID NO: 707173 - protein, 9 aa, Homo Sapiens
PKLKRLFLH

SEQ ID NO: 707174 - protein, 9 aa, Homo Sapiens
ERRRLFEQK

SEQ ID NO: 707175 - protein, 9 aa, Homo Sapiens
RETGTWYLV

SEQ ID NO: 707176 - protein, 9 aa, Homo Sapiens
ERLGISHQP

SEQ ID NO: 707177 - protein, 9 aa, Homo Sapiens
RRRLFEQKT

SEQ ID NO: 707178 - protein, 9 aa, Homo Sapiens
HLPSAPWPA

SEQ ID NO: 707179 - protein, 9 aa, Homo Sapiens
SEEDDGAIG

SEQ ID NO: 707180 - protein, 9 aa, Homo Sapiens
GESGGFQVL

SEQ ID NO: 707181 - protein, 9 aa, Homo Sapiens
APDVDVHVP

SEQ ID NO: 707182 - protein, 9 aa, Homo Sapiens
TGLAKWHVP

SEQ ID NO: 707183 - protein, 9 aa, Homo Sapiens
NYFGHITLT

SEQ ID NO: 707184 - protein, 9 aa, Homo Sapiens
TCGAHLLSA

SEQ ID NO: 707185 - protein, 9 aa, Homo Sapiens
GKRYRVPLD

SEQ ID NO: 707186 - protein, 9 aa, Homo Sapiens
EEDDGAIGP

SEQ ID NO: 707187 - protein, 9 aa, Homo Sapiens
VVDKIEVCP

SEQ ID NO: 707188 - protein, 9 aa, Homo Sapiens
GNRYYKANY

SEQ ID NO: 707189 - protein, 9 aa, Homo Sapiens
QVSSEPQKM

SEQ ID NO: 707190 - protein, 9 aa, Homo Sapiens
VAVISEEDD

SEQ ID NO: 707191 - protein, 9 aa, Homo Sapiens
GYNQRPQGS

SEQ ID NO: 707192 - protein, 9 aa, Homo Sapiens
KRYRVPLDN

SEQ ID NO: 707193 - protein, 9 aa, Homo Sapiens
CLAPYQRLG

SEQ ID NO: 707194 - protein, 9 aa, Homo Sapiens
GCPGLFSWE

SEQ ID NO: 707195 - protein, 9 aa, Homo Sapiens
SESSSLTVH

SEQ ID NO: 707196 - protein, 9 aa, Homo Sapiens
IIAVRGMNV

SEQ ID NO: 707197 - protein, 9 aa, Homo Sapiens
DPGIVRRYL

SEQ ID NO: 707198 - protein, 9 aa, Homo Sapiens
FYMRALYDR

SEQ ID NO: 707199 - protein, 9 aa, Homo Sapiens
KFQNNSEHN

SEQ ID NO: 707200 - protein, 9 aa, Homo Sapiens
TEAHSKPSK

SEQ ID NO: 707201 - protein, 9 aa, Homo Sapiens
RRLITLYQC

SEQ ID NO: 707202 - protein, 9 aa, Homo Sapiens
RDVKQGDDD

SEQ ID NO: 707203 - protein, 9 aa, Homo Sapiens
HLPKLKRLF

SEQ ID NO: 707204 - protein, 9 aa, Homo Sapiens
YKRAAIDAV

SEQ ID NO: 707205 - protein, 9 aa, Homo Sapiens
ANFGGGRGG

SEQ ID NO: 707206 - protein, 9 aa, Homo Sapiens
VRMAGQAPC

SEQ ID NO: 707207 - protein, 9 aa, Homo Sapiens
QSKLNEETL

SEQ ID NO: 707208 - protein, 9 aa, Homo Sapiens
SGRLLPIMT

SEQ ID NO: 707209 - protein, 9 aa, Homo Sapiens
SKRILYQNL

SEQ ID NO: 707210 - protein, 9 aa, Homo Sapiens
EDEAAQRRE

SEQ ID NO: 707211 - protein, 9 aa, Homo Sapiens
KDKDLDLFP

SEQ ID NO: 707212 - protein, 9 aa, Homo Sapiens
PVAVISEED

SEQ ID NO: 707213 - protein, 9 aa, Homo Sapiens
EGYVQSCNG

SEQ ID NO: 707214 - protein, 9 aa, Homo Sapiens
KLNIFLQLR

SEQ ID NO: 707215 - protein, 9 aa, Homo Sapiens
EDAEDAEDK

SEQ ID NO: 707216 - protein, 9 aa, Homo Sapiens
NFTAPMGIV

SEQ ID NO: 707217 - protein, 9 aa, Homo Sapiens
GAHLLSASL

SEQ ID NO: 707218 - protein, 9 aa, Homo Sapiens
QERNKEENI

SEQ ID NO: 707219 - protein, 9 aa, Homo Sapiens
EEKQMLLEK

SEQ ID NO: 707220 - protein, 9 aa, Homo Sapiens
NCSSTHKKH

SEQ ID NO: 707221 - protein, 9 aa, Homo Sapiens
EAYLVGLFK

SEQ ID NO: 707222 - protein, 9 aa, Homo Sapiens
MDANYFGHI

SEQ ID NO: 707223 - protein, 9 aa, Homo Sapiens
KAFSESSSL

SEQ ID NO: 707224 - protein, 9 aa, Homo Sapiens
LKRLFLHNN

SEQ ID NO: 707225 - protein, 9 aa, Homo Sapiens
KNTAISEMV

SEQ ID NO: 707226 - protein, 9 aa, Homo Sapiens
PDGPESPKG

SEQ ID NO: 707227 - protein, 9 aa, Homo Sapiens
SLGQFFSLG

SEQ ID NO: 707228 - protein, 9 aa, Homo Sapiens
IALQPAMHR

SEQ ID NO: 707229 - protein, 9 aa, Homo Sapiens
NGICHNEKN

SEQ ID NO: 707230 - protein, 9 aa, Homo Sapiens
LPIMTEQDD

SEQ ID NO: 707231 - protein, 9 aa, Homo Sapiens
QASLCHSEE

SEQ ID NO: 707232 - protein, 9 aa, Homo Sapiens
LLIKNPLPS

SEQ ID NO: 707233 - protein, 9 aa, Homo Sapiens
MSYFRDPYH

SEQ ID NO: 707234 - protein, 9 aa, Homo Sapiens
KVYPYLCRA

SEQ ID NO: 707235 - protein, 9 aa, Homo Sapiens
HREDEDPEY

SEQ ID NO: 707236 - protein, 9 aa, Homo Sapiens
YYIVQLKRH

SEQ ID NO: 707237 - protein, 9 aa, Homo Sapiens
KTLVKKMTV

SEQ ID NO: 707238 - protein, 9 aa, Homo Sapiens
PSLRAIQDD

SEQ ID NO: 707239 - protein, 9 aa, Homo Sapiens
QVSLPEMVC

SEQ ID NO: 707240 - protein, 9 aa, Homo Sapiens
SKGIMEEDK

SEQ ID NO: 707241 - protein, 9 aa, Homo Sapiens
GARLAWCCY

SEQ ID NO: 707242 - protein, 9 aa, Homo Sapiens
AQLWETPHW

SEQ ID NO: 707243 - protein, 9 aa, Homo Sapiens
LWETPHWLG

SEQ ID NO: 707244 - protein, 9 aa, Homo Sapiens
EDTRLSAFE

SEQ ID NO: 707245 - protein, 9 aa, Homo Sapiens
NETEAHSKP

SEQ ID NO: 707246 - protein, 9 aa, Homo Sapiens
IVQLKRHFM

SEQ ID NO: 707247 - protein, 9 aa, Homo Sapiens
RLAWCCYRL

SEQ ID NO: 707248 - protein, 9 aa, Homo Sapiens
FYKVYPYLC

SEQ ID NO: 707249 - protein, 9 aa, Homo Sapiens
LPLLPGARL

SEQ ID NO: 707250 - protein, 9 aa, Homo Sapiens
IARPQKVVA

SEQ ID NO: 707251 - protein, 9 aa, Homo Sapiens
FKDTNLCAI

SEQ ID NO: 707252 - protein, 9 aa, Homo Sapiens
LSAFEMKQL

SEQ ID NO: 707253 - protein, 9 aa, Homo Sapiens
LVDSLKLMS

SEQ ID NO: 707254 - protein, 9 aa, Homo Sapiens
LCGVIKRSS

SEQ ID NO: 707255 - protein, 9 aa, Homo Sapiens
QESMDGHEK

SEQ ID NO: 707256 - protein, 9 aa, Homo Sapiens
LVKKMTVLY

SEQ ID NO: 707257 - protein, 9 aa, Homo Sapiens
PLHIGELHI

SEQ ID NO: 707258 - protein, 9 aa, Homo Sapiens
KCGPTPPID

SEQ ID NO: 707259 - protein, 9 aa, Homo Sapiens
GELVDSLKL

SEQ ID NO: 707260 - protein, 9 aa, Homo Sapiens
ELSLGQFFS

SEQ ID NO: 707261 - protein, 9 aa, Homo Sapiens
ETGTWYLVT

SEQ ID NO: 707262 - protein, 9 aa, Homo Sapiens
KVVDKIEVC

SEQ ID NO: 707263 - protein, 9 aa, Homo Sapiens
SSAPWRPAK

SEQ ID NO: 707264 - protein, 9 aa, Homo Sapiens
KWLTGLAKW

SEQ ID NO: 707265 - protein, 9 aa, Homo Sapiens
SQYVMKIGN

SEQ ID NO: 707266 - protein, 9 aa, Homo Sapiens
GEKSETPLS

SEQ ID NO: 707267 - protein, 9 aa, Homo Sapiens
DQNRDVKQG

SEQ ID NO: 707268 - protein, 9 aa, Homo Sapiens
QGSKEESHM

SEQ ID NO: 707269 - protein, 9 aa, Homo Sapiens
AAVAAGAGS

SEQ ID NO: 707270 - protein, 9 aa, Homo Sapiens
LILVIIKYK

SEQ ID NO: 707271 - protein, 9 aa, Homo Sapiens
SEPQKMYPG

SEQ ID NO: 707272 - protein, 9 aa, Homo Sapiens
DSQALSDVP

SEQ ID NO: 707273 - protein, 9 aa, Homo Sapiens
HIFCDILPL

SEQ ID NO: 707274 - protein, 9 aa, Homo Sapiens
TRPLPPLIP

SEQ ID NO: 707275 - protein, 9 aa, Homo Sapiens
RPHGQPKPG

SEQ ID NO: 707276 - protein, 9 aa, Homo Sapiens
FLTTEEVLS

SEQ ID NO: 707277 - protein, 9 aa, Homo Sapiens
LGAEMVLFN

SEQ ID NO: 707278 - protein, 9 aa, Homo Sapiens
HSEETSTCI

SEQ ID NO: 707279 - protein, 9 aa, Homo Sapiens
ARGGCLQFG

SEQ ID NO: 707280 - protein, 9 aa, Homo Sapiens
EVLLSFESS

SEQ ID NO: 707281 - protein, 9 aa, Homo Sapiens
HGPRTLDNV

SEQ ID NO: 707282 - protein, 9 aa, Homo Sapiens
ANSVFIKNL

SEQ ID NO: 707283 - protein, 9 aa, Homo Sapiens
DIDLGVSGE

SEQ ID NO: 707284 - protein, 9 aa, Homo Sapiens
GCLAPYQRL

SEQ ID NO: 707285 - protein, 9 aa, Homo Sapiens
DFINILSHE

SEQ ID NO: 707286 - protein, 9 aa, Homo Sapiens
ARTLRAQFL

SEQ ID NO: 707287 - protein, 9 aa, Homo Sapiens
HNVKKLQEE

SEQ ID NO: 707288 - protein, 9 aa, Homo Sapiens
PRAYHVDSV

SEQ ID NO: 707289 - protein, 9 aa, Homo Sapiens
CYAQVSLPE

SEQ ID NO: 707290 - protein, 9 aa, Homo Sapiens
GSANFGGGR

SEQ ID NO: 707291 - protein, 9 aa, Homo Sapiens
KIKQFYKTC

SEQ ID NO: 707292 - protein, 9 aa, Homo Sapiens
TTIQEEFYK

SEQ ID NO: 707293 - protein, 9 aa, Homo Sapiens
LRDVRTART

SEQ ID NO: 707294 - protein, 9 aa, Homo Sapiens
EGEYNVQHQ

SEQ ID NO: 707295 - protein, 9 aa, Homo Sapiens
EHNVKKLQE

SEQ ID NO: 707296 - protein, 9 aa, Homo Sapiens
FHERKIKLN

SEQ ID NO: 707297 - protein, 9 aa, Homo Sapiens
VAWMKQAIQ

SEQ ID NO: 707298 - protein, 9 aa, Homo Sapiens
VFQREPFHK

SEQ ID NO: 707299 - protein, 9 aa, Homo Sapiens
VNETEAHSK

SEQ ID NO: 707300 - protein, 9 aa, Homo Sapiens
LVEAPVAVI

SEQ ID NO: 707301 - protein, 9 aa, Homo Sapiens
LFACIECEG

SEQ ID NO: 707302 - protein, 9 aa, Homo Sapiens
HSKPSKNVA

SEQ ID NO: 707303 - protein, 9 aa, Homo Sapiens
SGSANFGGG

SEQ ID NO: 707304 - protein, 9 aa, Homo Sapiens
EKRQLSLHI

SEQ ID NO: 707305 - protein, 9 aa, Homo Sapiens
QLSLHINKL

SEQ ID NO: 707306 - protein, 9 aa, Homo Sapiens
ILVVGTENE

SEQ ID NO: 707307 - protein, 9 aa, Homo Sapiens
ADMRRMAAA

SEQ ID NO: 707308 - protein, 9 aa, Homo Sapiens
FERLSPRCG

SEQ ID NO: 707309 - protein, 9 aa, Homo Sapiens
HSFFHDNIL

SEQ ID NO: 707310 - protein, 9 aa, Homo Sapiens
YFGHITLTK

SEQ ID NO: 707311 - protein, 9 aa, Homo Sapiens
IISRTQALL

SEQ ID NO: 707312 - protein, 9 aa, Homo Sapiens
VRGMNVTLT

SEQ ID NO: 707313 - protein, 9 aa, Homo Sapiens
TLVKKMTVL

SEQ ID NO: 707314 - protein, 9 aa, Homo Sapiens
EEKGWGIIT

SEQ ID NO: 707315 - protein, 9 aa, Homo Sapiens
REPFHKSHT

SEQ ID NO: 707316 - protein, 9 aa, Homo Sapiens
NGAGYRGHQ

SEQ ID NO: 707317 - protein, 9 aa, Homo Sapiens
WGNALGWLL

SEQ ID NO: 707318 - protein, 9 aa, Homo Sapiens
GEVFDFSQR

SEQ ID NO: 707319 - protein, 9 aa, Homo Sapiens
QLKRHFMFR

SEQ ID NO: 707320 - protein, 9 aa, Homo Sapiens
KHERCCWCL

SEQ ID NO: 707321 - protein, 9 aa, Homo Sapiens
ESVAKRFLE

SEQ ID NO: 707322 - protein, 9 aa, Homo Sapiens
RLFACIECE

SEQ ID NO: 707323 - protein, 9 aa, Homo Sapiens
ITFGNYVLF

SEQ ID NO: 707324 - protein, 9 aa, Homo Sapiens
VKEEQSKLN

SEQ ID NO: 707325 - protein, 9 aa, Homo Sapiens
ALGQALWPC

SEQ ID NO: 707326 - protein, 9 aa, Homo Sapiens
PGKFVEFYG

SEQ ID NO: 707327 - protein, 9 aa, Homo Sapiens
GPSRRGDLQ

SEQ ID NO: 707328 - protein, 9 aa, Homo Sapiens
SPVLQTSGV

SEQ ID NO: 707329 - protein, 9 aa, Homo Sapiens
HWLGAPEPP

SEQ ID NO: 707330 - protein, 9 aa, Homo Sapiens
IEVCPENAE

SEQ ID NO: 707331 - protein, 9 aa, Homo Sapiens
GNSLFVQNG

SEQ ID NO: 707332 - protein, 9 aa, Homo Sapiens
NPMRPRQPQ

SEQ ID NO: 707333 - protein, 9 aa, Homo Sapiens
RGSTEGYVQ

SEQ ID NO: 707334 - protein, 9 aa, Homo Sapiens
LYSTVEIPK

SEQ ID NO: 707335 - protein, 9 aa, Homo Sapiens
DKIRFPTKQ

SEQ ID NO: 707336 - protein, 9 aa, Homo Sapiens
IDKLFKEAN

SEQ ID NO: 707337 - protein, 9 aa, Homo Sapiens
YVQSCNGLF

SEQ ID NO: 707338 - protein, 9 aa, Homo Sapiens
LLSASLYYG

SEQ ID NO: 707339 - protein, 9 aa, Homo Sapiens
RTLDNVINP

SEQ ID NO: 707340 - protein, 9 aa, Homo Sapiens
ALYFVALIT

SEQ ID NO: 707341 - protein, 9 aa, Homo Sapiens
YIDEIDKLF

SEQ ID NO: 707342 - protein, 9 aa, Homo Sapiens
SQFSGPSSE

SEQ ID NO: 707343 - protein, 9 aa, Homo Sapiens
EDPANTLYS

SEQ ID NO: 707344 - protein, 9 aa, Homo Sapiens
LSRSCNEAS

SEQ ID NO: 707345 - protein, 9 aa, Homo Sapiens
KKKKLKNKQ

SEQ ID NO: 707346 - protein, 9 aa, Homo Sapiens
FHKSHTSRS

SEQ ID NO: 707347 - protein, 9 aa, Homo Sapiens
GWGIITKEP

SEQ ID NO: 707348 - protein, 9 aa, Homo Sapiens
LTGLAKWHV

SEQ ID NO: 707349 - protein, 9 aa, Homo Sapiens
IDNGTSDRP

SEQ ID NO: 707350 - protein, 9 aa, Homo Sapiens
AIARPQKVV

SEQ ID NO: 707351 - protein, 9 aa, Homo Sapiens
CQCLAKRYS

SEQ ID NO: 707352 - protein, 9 aa, Homo Sapiens
KLTDMYGGG

SEQ ID NO: 707353 - protein, 9 aa, Homo Sapiens
AVIVKNIDN

SEQ ID NO: 707354 - protein, 9 aa, Homo Sapiens
LPGARLAWC

SEQ ID NO: 707355 - protein, 9 aa, Homo Sapiens
VPLPQNPMR

SEQ ID NO: 707356 - protein, 9 aa, Homo Sapiens
FHREDEDPE

SEQ ID NO: 707357 - protein, 9 aa, Homo Sapiens
FSQHTIILT

SEQ ID NO: 707358 - protein, 9 aa, Homo Sapiens
PAAGGGAAA

SEQ ID NO: 707359 - protein, 9 aa, Homo Sapiens
ASTISGRLL

SEQ ID NO: 707360 - protein, 9 aa, Homo Sapiens
LKLSKEYWD

SEQ ID NO: 707361 - protein, 9 aa, Homo Sapiens
SRTQALLLH

SEQ ID NO: 707362 - protein, 9 aa, Homo Sapiens
AGPRAYHVD

SEQ ID NO: 707363 - protein, 9 aa, Homo Sapiens
FQKPFKHLS

SEQ ID NO: 707364 - protein, 9 aa, Homo Sapiens
RDLFEVTFS

SEQ ID NO: 707365 - protein, 9 aa, Homo Sapiens
RGMLKLIFL

SEQ ID NO: 707366 - protein, 9 aa, Homo Sapiens
VPAAGGGAA

SEQ ID NO: 707367 - protein, 9 aa, Homo Sapiens
LEVLLSFES

SEQ ID NO: 707368 - protein, 9 aa, Homo Sapiens
LSHESVAKR

SEQ ID NO: 707369 - protein, 9 aa, Homo Sapiens
QMETEEKEA

SEQ ID NO: 707370 - protein, 9 aa, Homo Sapiens
VLQTSGVVG

SEQ ID NO: 707371 - protein, 9 aa, Homo Sapiens
LQESMDGHE

SEQ ID NO: 707372 - protein, 9 aa, Homo Sapiens
QQPSPEDQV

SEQ ID NO: 707373 - protein, 9 aa, Homo Sapiens
GDSAYVWMS

SEQ ID NO: 707374 - protein, 9 aa, Homo Sapiens
HLPSLRAIQ

SEQ ID NO: 707375 - protein, 9 aa, Homo Sapiens
DGHEKELES

SEQ ID NO: 707376 - protein, 9 aa, Homo Sapiens
CDMDTNGGG

SEQ ID NO: 707377 - protein, 9 aa, Homo Sapiens
ASPVLQTSG

SEQ ID NO: 707378 - protein, 9 aa, Homo Sapiens
FPATNYIYT

SEQ ID NO: 707379 - protein, 9 aa, Homo Sapiens
YLVGLFKDT

SEQ ID NO: 707380 - protein, 9 aa, Homo Sapiens
VWMSDGNPE

SEQ ID NO: 707381 - protein, 9 aa, Homo Sapiens
IFQKPFKHL

SEQ ID NO: 707382 - protein, 9 aa, Homo Sapiens
GVRPHGQPK

SEQ ID NO: 707383 - protein, 9 aa, Homo Sapiens
VRRDLFEVT

SEQ ID NO: 707384 - protein, 9 aa, Homo Sapiens
NKQKRQAEL

SEQ ID NO: 707385 - protein, 9 aa, Homo Sapiens
AGTITSDLS

SEQ ID NO: 707386 - protein, 9 aa, Homo Sapiens
CPGLFSWEL

SEQ ID NO: 707387 - protein, 9 aa, Homo Sapiens
RSGSANFGG

SEQ ID NO: 707388 - protein, 9 aa, Homo Sapiens
GEQGQGADA

SEQ ID NO: 707389 - protein, 9 aa, Homo Sapiens
YNQRPQGSK

SEQ ID NO: 707390 - protein, 9 aa, Homo Sapiens
EEEEEEQME

SEQ ID NO: 707391 - protein, 9 aa, Homo Sapiens
PECYFERLS

SEQ ID NO: 707392 - protein, 9 aa, Homo Sapiens
AIKVIDKIR

SEQ ID NO: 707393 - protein, 9 aa, Homo Sapiens
GSADTVPSP

SEQ ID NO: 707394 - protein, 9 aa, Homo Sapiens
SEHNVKKLQ

SEQ ID NO: 707395 - protein, 9 aa, Homo Sapiens
TQSLFSSPE

SEQ ID NO: 707396 - protein, 9 aa, Homo Sapiens
DLGVSGEVF

SEQ ID NO: 707397 - protein, 9 aa, Homo Sapiens
FEVTFSLQV

SEQ ID NO: 707398 - protein, 9 aa, Homo Sapiens
PQAKALAAA

SEQ ID NO: 707399 - protein, 9 aa, Homo Sapiens
PSPADSLST

SEQ ID NO: 707400 - protein, 9 aa, Homo Sapiens
PHGQPKPGP

SEQ ID NO: 707401 - protein, 9 aa, Homo Sapiens
PVVMCKKAP

SEQ ID NO: 707402 - protein, 9 aa, Homo Sapiens
FARAIAIVS

SEQ ID NO: 707403 - protein, 9 aa, Homo Sapiens
GYVQSCNGL

SEQ ID NO: 707404 - protein, 9 aa, Homo Sapiens
RGDTPQAKA

SEQ ID NO: 707405 - protein, 9 aa, Homo Sapiens
TIIAVRGMN

SEQ ID NO: 707406 - protein, 9 aa, Homo Sapiens
KAPKAGLSQ

SEQ ID NO: 707407 - protein, 9 aa, Homo Sapiens
TGSSFQGHQ

SEQ ID NO: 707408 - protein, 9 aa, Homo Sapiens
RVFQREPFH

SEQ ID NO: 707409 - protein, 9 aa, Homo Sapiens
VARLKLFPL

SEQ ID NO: 707410 - protein, 9 aa, Homo Sapiens
NAERERLGI

SEQ ID NO: 707411 - protein, 9 aa, Homo Sapiens
SLPEMVCGT

SEQ ID NO: 707412 - protein, 9 aa, Homo Sapiens
GFQVLTFEW

SEQ ID NO: 707413 - protein, 9 aa, Homo Sapiens
RFKKLTDMY

SEQ ID NO: 707414 - protein, 9 aa, Homo Sapiens
GLVEAPVAV

SEQ ID NO: 707415 - protein, 9 aa, Homo Sapiens
DKPYSCPIF

SEQ ID NO: 707416 - protein, 9 aa, Homo Sapiens
EIQNSCSRI

SEQ ID NO: 707417 - protein, 9 aa, Homo Sapiens
FLDYYVAFL

SEQ ID NO: 707418 - protein, 9 aa, Homo Sapiens
QFSGPSSEQ

SEQ ID NO: 707419 - protein, 9 aa, Homo Sapiens
QRQANPIGL

SEQ ID NO: 707420 - protein, 9 aa, Homo Sapiens
AEGNRYYKA

SEQ ID NO: 707421 - protein, 9 aa, Homo Sapiens
IKNPLPSQT

SEQ ID NO: 707422 - protein, 9 aa, Homo Sapiens
AETNSVYKK

SEQ ID NO: 707423 - protein, 9 aa, Homo Sapiens
HPDLQEQKQ

SEQ ID NO: 707424 - protein, 9 aa, Homo Sapiens
SLCHSEETS

SEQ ID NO: 707425 - protein, 9 aa, Homo Sapiens
AKWHVPAAG

SEQ ID NO: 707426 - protein, 9 aa, Homo Sapiens
NKQIIRKQA

SEQ ID NO: 707427 - protein, 9 aa, Homo Sapiens
KRILYQNLN

SEQ ID NO: 707428 - protein, 9 aa, Homo Sapiens
HGKRYRVPL

SEQ ID NO: 707429 - protein, 9 aa, Homo Sapiens
LQTSGVVGL

SEQ ID NO: 707430 - protein, 9 aa, Homo Sapiens
IIFWENGDS

SEQ ID NO: 707431 - protein, 9 aa, Homo Sapiens
NILSHESVA

SEQ ID NO: 707432 - protein, 9 aa, Homo Sapiens
EPFHKSHTS

SEQ ID NO: 707433 - protein, 9 aa, Homo Sapiens
NIIHTGEKP

SEQ ID NO: 707434 - protein, 9 aa, Homo Sapiens
GLHLQSPSG

SEQ ID NO: 707435 - protein, 9 aa, Homo Sapiens
SANFGGGRG

SEQ ID NO: 707436 - protein, 9 aa, Homo Sapiens
RHNIIHTGE

SEQ ID NO: 707437 - protein, 9 aa, Homo Sapiens
QSPSGQHVV

SEQ ID NO: 707438 - protein, 9 aa, Homo Sapiens
KRYSVILLD

SEQ ID NO: 707439 - protein, 9 aa, Homo Sapiens
EKGWGIITK

SEQ ID NO: 707440 - protein, 9 aa, Homo Sapiens
PSAPWPAPP

SEQ ID NO: 707441 - protein, 9 aa, Homo Sapiens
SAGELVDSL

SEQ ID NO: 707442 - protein, 9 aa, Homo Sapiens
EPVTREGEL

SEQ ID NO: 707443 - protein, 9 aa, Homo Sapiens
DSAYVWMSD

SEQ ID NO: 707444 - protein, 9 aa, Homo Sapiens
ESPKGSPRG

SEQ ID NO: 707445 - protein, 9 aa, Homo Sapiens
GLFKDTNLC

SEQ ID NO: 707446 - protein, 9 aa, Homo Sapiens
AHPGQLGGP

SEQ ID NO: 707447 - protein, 9 aa, Homo Sapiens
LPSAPWPAP

SEQ ID NO: 707448 - protein, 9 aa, Homo Sapiens
RLGISHQPE

SEQ ID NO: 707449 - protein, 9 aa, Homo Sapiens
GPRQEVLCA

SEQ ID NO: 707450 - protein, 9 aa, Homo Sapiens
LPSDFPEEV

SEQ ID NO: 707451 - protein, 9 aa, Homo Sapiens
ALQPAMHRP

SEQ ID NO: 707452 - protein, 9 aa, Homo Sapiens
NNLVVLMTL

SEQ ID NO: 707453 - protein, 9 aa, Homo Sapiens
RFALRRMQE

SEQ ID NO: 707454 - protein, 9 aa, Homo Sapiens
LRPLNVLQL

SEQ ID NO: 707455 - protein, 9 aa, Homo Sapiens
FSGPSSEQM

SEQ ID NO: 707456 - protein, 9 aa, Homo Sapiens
SCMGCMNRR

SEQ ID NO: 707457 - protein, 9 aa, Homo Sapiens
GRSGSANFG

SEQ ID NO: 707458 - protein, 9 aa, Homo Sapiens
MPGPRQEVL

SEQ ID NO: 707459 - protein, 9 aa, Homo Sapiens
SGQHVVAGT

SEQ ID NO: 707460 - protein, 9 aa, Homo Sapiens
DVKQGDDDD

SEQ ID NO: 707461 - protein, 9 aa, Homo Sapiens
DHARTPQFS

SEQ ID NO: 707462 - protein, 9 aa, Homo Sapiens
FVEFYGLLQ

SEQ ID NO: 707463 - protein, 9 aa, Homo Sapiens
VLRDVRTAR

SEQ ID NO: 707464 - protein, 9 aa, Homo Sapiens
NKKKKLKNK

SEQ ID NO: 707465 - protein, 9 aa, Homo Sapiens
DGLPDLGTQ

SEQ ID NO: 707466 - protein, 9 aa, Homo Sapiens
KNPLPSQTG

SEQ ID NO: 707467 - protein, 9 aa, Homo Sapiens
LGQALWPCW

SEQ ID NO: 707468 - protein, 9 aa, Homo Sapiens
FQHLPKLKR

SEQ ID NO: 707469 - protein, 9 aa, Homo Sapiens
SRSCNEASQ

SEQ ID NO: 707470 - protein, 9 aa, Homo Sapiens
KRQLSLHIN

SEQ ID NO: 707471 - protein, 9 aa, Homo Sapiens
LLPLLPGAR

SEQ ID NO: 707472 - protein, 9 aa, Homo Sapiens
LEEDEAAQR

SEQ ID NO: 707473 - protein, 9 aa, Homo Sapiens
KQAIQEQLQ

SEQ ID NO: 707474 - protein, 9 aa, Homo Sapiens
FKKLTDMYG

SEQ ID NO: 707475 - protein, 9 aa, Homo Sapiens
RRGDLQSLG

SEQ ID NO: 707476 - protein, 9 aa, Homo Sapiens
RESKRILYQ

SEQ ID NO: 707477 - protein, 9 aa, Homo Sapiens
SSLAPGQTV

SEQ ID NO: 707478 - protein, 9 aa, Homo Sapiens
YRVPLDNPF

SEQ ID NO: 707479 - protein, 9 aa, Homo Sapiens
LHINKLPGE

SEQ ID NO: 707480 - protein, 9 aa, Homo Sapiens
GLKDKDLDL

SEQ ID NO: 707481 - protein, 9 aa, Homo Sapiens
ARLKLFPLH

SEQ ID NO: 707482 - protein, 9 aa, Homo Sapiens
PPRRLITLY

SEQ ID NO: 707483 - protein, 9 aa, Homo Sapiens
RGRSGSANF

SEQ ID NO: 707484 - protein, 9 aa, Homo Sapiens
RICTSEGRH

SEQ ID NO: 707485 - protein, 9 aa, Homo Sapiens
LGLSRSCNE

SEQ ID NO: 707486 - protein, 9 aa, Homo Sapiens
HLLSASLYY

SEQ ID NO: 707487 - protein, 9 aa, Homo Sapiens
RHQLGRKAF

SEQ ID NO: 707488 - protein, 9 aa, Homo Sapiens
ERSPRDAAA

SEQ ID NO: 707489 - protein, 9 aa, Homo Sapiens
CLPVILVVG

SEQ ID NO: 707490 - protein, 9 aa, Homo Sapiens
AGQAPCPAQ

SEQ ID NO: 707491 - protein, 9 aa, Homo Sapiens
KNKQKRQAE

SEQ ID NO: 707492 - protein, 9 aa, Homo Sapiens
IIIFWENGD

SEQ ID NO: 707493 - protein, 9 aa, Homo Sapiens
DTLRWRGEN

SEQ ID NO: 707494 - protein, 9 aa, Homo Sapiens
DTVPSPADS

SEQ ID NO: 707495 - protein, 9 aa, Homo Sapiens
ANPIGLQNR

SEQ ID NO: 707496 - protein, 9 aa, Homo Sapiens
VISEEDDGA

SEQ ID NO: 707497 - protein, 9 aa, Homo Sapiens
LSRHQLGRK

SEQ ID NO: 707498 - protein, 9 aa, Homo Sapiens
GGAAAVPGA

SEQ ID NO: 707499 - protein, 9 aa, Homo Sapiens
CEGFSKALK

SEQ ID NO: 707500 - protein, 9 aa, Homo Sapiens
RDRSGDTLR

SEQ ID NO: 707501 - protein, 9 aa, Homo Sapiens
ANTLYSTVE

SEQ ID NO: 707502 - protein, 9 aa, Homo Sapiens
DLGTQSLFS

SEQ ID NO: 707503 - protein, 9 aa, Homo Sapiens
RTPQFSNRR

SEQ ID NO: 707504 - protein, 9 aa, Homo Sapiens
GMPAAHPGQ

SEQ ID NO: 707505 - protein, 9 aa, Homo Sapiens
ECGKAFTCL

SEQ ID NO: 707506 - protein, 9 aa, Homo Sapiens
LIPPRRLIT

SEQ ID NO: 707507 - protein, 9 aa, Homo Sapiens
LRPGMRVAF

SEQ ID NO: 707508 - protein, 9 aa, Homo Sapiens
LLPGARLAW

SEQ ID NO: 707509 - protein, 9 aa, Homo Sapiens
VIVNETEAH

SEQ ID NO: 707510 - protein, 9 aa, Homo Sapiens
YVSADMRRM

SEQ ID NO: 707511 - protein, 9 aa, Homo Sapiens
TDEDIPKGV

SEQ ID NO: 707512 - protein, 9 aa, Homo Sapiens
ANVFIIIFW

SEQ ID NO: 707513 - protein, 9 aa, Homo Sapiens
SSLRPLNVL

SEQ ID NO: 707514 - protein, 9 aa, Homo Sapiens
AIGPRQGAA

SEQ ID NO: 707515 - protein, 9 aa, Homo Sapiens
LTTEEVLSR

SEQ ID NO: 707516 - protein, 9 aa, Homo Sapiens
LCDMDTNGG

SEQ ID NO: 707517 - protein, 9 aa, Homo Sapiens
LSDVPSLSD

SEQ ID NO: 707518 - protein, 9 aa, Homo Sapiens
VQLKRHFMF

SEQ ID NO: 707519 - protein, 9 aa, Homo Sapiens
GAPEPPAST

SEQ ID NO: 707520 - protein, 9 aa, Homo Sapiens
LIEQSNLYW

SEQ ID NO: 707521 - protein, 9 aa, Homo Sapiens
AADLLRDAS

SEQ ID NO: 707522 - protein, 9 aa, Homo Sapiens
LSYKQVSSE

SEQ ID NO: 707523 - protein, 9 aa, Homo Sapiens
VSEGGEKSE

SEQ ID NO: 707524 - protein, 9 aa, Homo Sapiens
RMAGQAPCP

SEQ ID NO: 707525 - protein, 9 aa, Homo Sapiens
FGLVEAPVA

SEQ ID NO: 707526 - protein, 9 aa, Homo Sapiens
HLQSPSGQH

SEQ ID NO: 707527 - protein, 9 aa, Homo Sapiens
GQHVVAGTL

SEQ ID NO: 707528 - protein, 9 aa, Homo Sapiens
SSTHKKHKI

SEQ ID NO: 707529 - protein, 9 aa, Homo Sapiens
GQALWPCWA

SEQ ID NO: 707530 - protein, 9 aa, Homo Sapiens
LHDVAYKEA

SEQ ID NO: 707531 - protein, 9 aa, Homo Sapiens
GTTAGPSGK

SEQ ID NO: 707532 - protein, 9 aa, Homo Sapiens
VLCGVIKRS

SEQ ID NO: 707533 - protein, 9 aa, Homo Sapiens
RIHCLEILE

SEQ ID NO: 707534 - protein, 9 aa, Homo Sapiens
KLFPLHIGE

SEQ ID NO: 707535 - protein, 9 aa, Homo Sapiens
LEKTNLSLL

SEQ ID NO: 707536 - protein, 9 aa, Homo Sapiens
TGKCGPTPP

SEQ ID NO: 707537 - protein, 9 aa, Homo Sapiens
EVLCAFWKS

SEQ ID NO: 707538 - protein, 9 aa, Homo Sapiens
RVPLDNPFV

SEQ ID NO: 707539 - protein, 9 aa, Homo Sapiens
HARTPQFSN

SEQ ID NO: 707540 - protein, 9 aa, Homo Sapiens
PVLQTSGVV

SEQ ID NO: 707541 - protein, 9 aa, Homo Sapiens
GMLKLIFLL

SEQ ID NO: 707542 - protein, 9 aa, Homo Sapiens
LKEDPANTL

SEQ ID NO: 707543 - protein, 9 aa, Homo Sapiens
DGAIGPRQG

SEQ ID NO: 707544 - protein, 9 aa, Homo Sapiens
SKALKQCKY

SEQ ID NO: 707545 - protein, 9 aa, Homo Sapiens
VGSYFHTML

SEQ ID NO: 707546 - protein, 9 aa, Homo Sapiens
ERLSPRCGF

SEQ ID NO: 707547 - protein, 9 aa, Homo Sapiens
KIEVCPENA

SEQ ID NO: 707548 - protein, 9 aa, Homo Sapiens
KIKLNIFLQ

SEQ ID NO: 707549 - protein, 9 aa, Homo Sapiens
GVRMAGQAP

SEQ ID NO: 707550 - protein, 9 aa, Homo Sapiens
VAFLRDLPE

SEQ ID NO: 707551 - protein, 9 aa, Homo Sapiens
TNCVFMTIS

SEQ ID NO: 707552 - protein, 9 aa, Homo Sapiens
ATRGSTEGY

SEQ ID NO: 707553 - protein, 9 aa, Homo Sapiens
HPGQLGGPA

SEQ ID NO: 707554 - protein, 9 aa, Homo Sapiens
VYCVRRDLF

SEQ ID NO: 707555 - protein, 9 aa, Homo Sapiens
GEFHREDED

SEQ ID NO: 707556 - protein, 9 aa, Homo Sapiens
SQALSDVPS

SEQ ID NO: 707557 - protein, 9 aa, Homo Sapiens
LNEETLPAE

SEQ ID NO: 707558 - protein, 9 aa, Homo Sapiens
IAINRYCNI

SEQ ID NO: 707559 - protein, 9 aa, Homo Sapiens
CNICHSMAY

SEQ ID NO: 707560 - protein, 9 aa, Homo Sapiens
TPHWLGAPE

SEQ ID NO: 707561 - protein, 9 aa, Homo Sapiens
AMHRPMHFF

SEQ ID NO: 707562 - protein, 9 aa, Homo Sapiens
DQGEYKRAA

SEQ ID NO: 707563 - protein, 9 aa, Homo Sapiens
PCPAQLWET

SEQ ID NO: 707564 - protein, 9 aa, Homo Sapiens
LHLQSPSGQ

SEQ ID NO: 707565 - protein, 9 aa, Homo Sapiens
IPPRRLITL

SEQ ID NO: 707566 - protein, 9 aa, Homo Sapiens
GAEGNRYYK

SEQ ID NO: 707567 - protein, 9 aa, Homo Sapiens
VVVAAGEFL

SEQ ID NO: 707568 - protein, 9 aa, Homo Sapiens
LLHIDSFIE

SEQ ID NO: 707569 - protein, 9 aa, Homo Sapiens
NLVVLMTLP

SEQ ID NO: 707570 - protein, 9 aa, Homo Sapiens
LGGPAARGG

SEQ ID NO: 707571 - protein, 9 aa, Homo Sapiens
TLYSTVEIP

SEQ ID NO: 707572 - protein, 9 aa, Homo Sapiens
EGDAPFCTR

SEQ ID NO: 707573 - protein, 9 aa, Homo Sapiens
TLLECEMSH

SEQ ID NO: 707574 - protein, 9 aa, Homo Sapiens
AHSKPSKNV

SEQ ID NO: 707575 - protein, 9 aa, Homo Sapiens
CGAHLLSAS

SEQ ID NO: 707576 - protein, 9 aa, Homo Sapiens
LLTRPNYIR

SEQ ID NO: 707577 - protein, 9 aa, Homo Sapiens
IQNSCSRIH

SEQ ID NO: 707578 - protein, 9 aa, Homo Sapiens
LECEMSHPR

SEQ ID NO: 707579 - protein, 9 aa, Homo Sapiens
AAHPGQLGG

SEQ ID NO: 707580 - protein, 9 aa, Homo Sapiens
EAEQRQGRS

SEQ ID NO: 707581 - protein, 9 aa, Homo Sapiens
LGRETGTWY

SEQ ID NO: 707582 - protein, 9 aa, Homo Sapiens
EEQSKLNEE

SEQ ID NO: 707583 - protein, 9 aa, Homo Sapiens
EYPESSGFA

SEQ ID NO: 707584 - protein, 9 aa, Homo Sapiens
EVCPENAEV

SEQ ID NO: 707585 - protein, 9 aa, Homo Sapiens
LTDEDIPKG

SEQ ID NO: 707586 - protein, 9 aa, Homo Sapiens
HKSHTSRSV

SEQ ID NO: 707587 - protein, 9 aa, Homo Sapiens
RDASPVLQT

SEQ ID NO: 707588 - protein, 9 aa, Homo Sapiens
SKLNEETLP

SEQ ID NO: 707589 - protein, 9 aa, Homo Sapiens
LVVLMTLPA

SEQ ID NO: 707590 - protein, 9 aa, Homo Sapiens
IVKNIDNGT

SEQ ID NO: 707591 - protein, 9 aa, Homo Sapiens
RNKEENIHL

SEQ ID NO: 707592 - protein, 9 aa, Homo Sapiens
AEDKDCEDG

SEQ ID NO: 707593 - protein, 9 aa, Homo Sapiens
TLEEDEAAQ

SEQ ID NO: 707594 - protein, 9 aa, Homo Sapiens
RQEVLCAFW

SEQ ID NO: 707595 - protein, 9 aa, Homo Sapiens
AARGGCLQF

SEQ ID NO: 707596 - protein, 9 aa, Homo Sapiens
VLLSFESSN

SEQ ID NO: 707597 - protein, 9 aa, Homo Sapiens
LLDAYSEYL

SEQ ID NO: 707598 - protein, 9 aa, Homo Sapiens
PGLFSWELP

SEQ ID NO: 707599 - protein, 9 aa, Homo Sapiens
QALLLHIDS

SEQ ID NO: 707600 - protein, 9 aa, Homo Sapiens
WLTGLAKWH

SEQ ID NO: 707601 - protein, 9 aa, Homo Sapiens
DVDVHVPDW

SEQ ID NO: 707602 - protein, 9 aa, Homo Sapiens
FLEAKTLVK

SEQ ID NO: 707603 - protein, 9 aa, Homo Sapiens
SFLTTEEVL

SEQ ID NO: 707604 - protein, 9 aa, Homo Sapiens
REEEGGVRM

SEQ ID NO: 707605 - protein, 9 aa, Homo Sapiens
SAPWRPAKG

SEQ ID NO: 707606 - protein, 9 aa, Homo Sapiens
FFHDNILLN

SEQ ID NO: 707607 - protein, 9 aa, Homo Sapiens
VIAAVHWGC

SEQ ID NO: 707608 - protein, 9 aa, Homo Sapiens
GRPVSSLAP

SEQ ID NO: 707609 - protein, 9 aa, Homo Sapiens
GGPAARGGC

SEQ ID NO: 707610 - protein, 9 aa, Homo Sapiens
PANTLYSTV

SEQ ID NO: 707611 - protein, 9 aa, Homo Sapiens
YVPKHERCC

SEQ ID NO: 707612 - protein, 9 aa, Homo Sapiens
DYYVAFLRD

SEQ ID NO: 707613 - protein, 9 aa, Homo Sapiens
AERKGPGTP

SEQ ID NO: 707614 - protein, 9 aa, Homo Sapiens
VRFALRRMQ

SEQ ID NO: 707615 - protein, 9 aa, Homo Sapiens
TSSLRPLNV

SEQ ID NO: 707616 - protein, 9 aa, Homo Sapiens
VFIKNLSRT

SEQ ID NO: 707617 - protein, 9 aa, Homo Sapiens
LHMLQMSYF

SEQ ID NO: 707618 - protein, 9 aa, Homo Sapiens
PVSSLAPGQ

SEQ ID NO: 707619 - protein, 9 aa, Homo Sapiens
LRRMQELGL

SEQ ID NO: 707620 - protein, 9 aa, Homo Sapiens
EGNRYYKAN

SEQ ID NO: 707621 - protein, 9 aa, Homo Sapiens
ALTDEDIPK

SEQ ID NO: 707622 - protein, 9 aa, Homo Sapiens
TLPAWSTIW

SEQ ID NO: 707623 - protein, 9 aa, Homo Sapiens
EMKYYIVQL

SEQ ID NO: 707624 - protein, 9 aa, Homo Sapiens
QREPFHKSH

SEQ ID NO: 707625 - protein, 9 aa, Homo Sapiens
SPSSYPYPA

SEQ ID NO: 707626 - protein, 9 aa, Homo Sapiens
RKTLLECEM

SEQ ID NO: 707627 - protein, 9 aa, Homo Sapiens
TREGELWHI

SEQ ID NO: 707628 - protein, 9 aa, Homo Sapiens
SVKEEQSKL

SEQ ID NO: 707629 - protein, 9 aa, Homo Sapiens
EEEGGVRMA

SEQ ID NO: 707630 - protein, 9 aa, Homo Sapiens
MRVAFCYQI

SEQ ID NO: 707631 - protein, 9 aa, Homo Sapiens
LFPATNYIY

SEQ ID NO: 707632 - protein, 9 aa, Homo Sapiens
MTLPAWSTI

SEQ ID NO: 707633 - protein, 9 aa, Homo Sapiens
RGPSQAERK

SEQ ID NO: 707634 - protein, 9 aa, Homo Sapiens
LTRPNYIRS

SEQ ID NO: 707635 - protein, 9 aa, Homo Sapiens
VLCDMDTNG

SEQ ID NO: 707636 - protein, 9 aa, Homo Sapiens
THPETIIAV

SEQ ID NO: 707637 - protein, 9 aa, Homo Sapiens
KIRFPTKQE

SEQ ID NO: 707638 - protein, 9 aa, Homo Sapiens
WGNRFKKLT

SEQ ID NO: 707639 - protein, 9 aa, Homo Sapiens
RYEAKYGEK

SEQ ID NO: 707640 - protein, 9 aa, Homo Sapiens
CFQVNGAGY

SEQ ID NO: 707641 - protein, 9 aa, Homo Sapiens
NPGASGRAQ

SEQ ID NO: 707642 - protein, 9 aa, Homo Sapiens
SPYVSADMR

SEQ ID NO: 707643 - protein, 9 aa, Homo Sapiens
DKDLDLFPA

SEQ ID NO: 707644 - protein, 9 aa, Homo Sapiens
PDLGTQSLF

SEQ ID NO: 707645 - protein, 9 aa, Homo Sapiens
PLDNPFVSE

SEQ ID NO: 707646 - protein, 9 aa, Homo Sapiens
LNGICHNEK

SEQ ID NO: 707647 - protein, 9 aa, Homo Sapiens
DEDIPKGVP

SEQ ID NO: 707648 - protein, 9 aa, Homo Sapiens
GLRKEPKSR

SEQ ID NO: 707649 - protein, 9 aa, Homo Sapiens
DFLQLPSDF

SEQ ID NO: 707650 - protein, 9 aa, Homo Sapiens
YSFHSPSSY

SEQ ID NO: 707651 - protein, 9 aa, Homo Sapiens
FLRDLPECI

SEQ ID NO: 707652 - protein, 9 aa, Homo Sapiens
VVAAGEFLH

SEQ ID NO: 707653 - protein, 9 aa, Homo Sapiens
IFWENGDSG

SEQ ID NO: 707654 - protein, 9 aa, Homo Sapiens
ETRGYEGDA

SEQ ID NO: 707655 - protein, 9 aa, Homo Sapiens
SGEVFDFSQ

SEQ ID NO: 707656 - protein, 9 aa, Homo Sapiens
DASPVLQTS

SEQ ID NO: 707657 - protein, 9 aa, Homo Sapiens
FIFKNTAIS

SEQ ID NO: 707658 - protein, 9 aa, Homo Sapiens
QEAKLELEQ

SEQ ID NO: 707659 - protein, 9 aa, Homo Sapiens
EDKDCEDGE

SEQ ID NO: 707660 - protein, 9 aa, Homo Sapiens
GRLLPIMTE

SEQ ID NO: 707661 - protein, 9 aa, Homo Sapiens
NRDVKQGDD

SEQ ID NO: 707662 - protein, 9 aa, Homo Sapiens
QGEYKRAAI

SEQ ID NO: 707663 - protein, 9 aa, Homo Sapiens
ERSKPGKFV

SEQ ID NO: 707664 - protein, 9 aa, Homo Sapiens
SRSAGELVD

SEQ ID NO: 707665 - protein, 9 aa, Homo Sapiens
MQELGLHPA

SEQ ID NO: 707666 - protein, 9 aa, Homo Sapiens
ERNKEENIH

SEQ ID NO: 707667 - protein, 9 aa, Homo Sapiens
RRFRLFACI

SEQ ID NO: 707668 - protein, 9 aa, Homo Sapiens
LVGLFKDTN

SEQ ID NO: 707669 - protein, 9 aa, Homo Sapiens
TAGGAGTIT

SEQ ID NO: 707670 - protein, 9 aa, Homo Sapiens
SRKTLLECE

SEQ ID NO: 707671 - protein, 9 aa, Homo Sapiens
RLITLYQCF

SEQ ID NO: 707672 - protein, 9 aa, Homo Sapiens
VLCAFWKSD

SEQ ID NO: 707673 - protein, 9 aa, Homo Sapiens
RTLRAQFLQ

SEQ ID NO: 707674 - protein, 9 aa, Homo Sapiens
RKRGRPLKL

SEQ ID NO: 707675 - protein, 9 aa, Homo Sapiens
APGQTVSSS

SEQ ID NO: 707676 - protein, 9 aa, Homo Sapiens
SLRPLNVLQ

SEQ ID NO: 707677 - protein, 9 aa, Homo Sapiens
KHGHLPLVA

SEQ ID NO: 707678 - protein, 9 aa, Homo Sapiens
RVGMPAAHP

SEQ ID NO: 707679 - protein, 9 aa, Homo Sapiens
AINRYCNIC

SEQ ID NO: 707680 - protein, 9 aa, Homo Sapiens
EEFYKVYPY

SEQ ID NO: 707681 - protein, 9 aa, Homo Sapiens
SHESVAKRF

SEQ ID NO: 707682 - protein, 9 aa, Homo Sapiens
FFSLGPLAV

SEQ ID NO: 707683 - protein, 9 aa, Homo Sapiens
NQASLCHSE

SEQ ID NO: 707684 - protein, 9 aa, Homo Sapiens
VAAPAAAAL

SEQ ID NO: 707685 - protein, 9 aa, Homo Sapiens
GQLGGPAAR

SEQ ID NO: 707686 - protein, 9 aa, Homo Sapiens
GSKEKGLRK

SEQ ID NO: 707687 - protein, 9 aa, Homo Sapiens
QFFSLGPLA

SEQ ID NO: 707688 - protein, 9 aa, Homo Sapiens
CMNRRPILT

SEQ ID NO: 707689 - protein, 9 aa, Homo Sapiens
EFYKVYPYL

SEQ ID NO: 707690 - protein, 9 aa, Homo Sapiens
VDVHVPDWH

SEQ ID NO: 707691 - protein, 9 aa, Homo Sapiens
RPLEGGGTN

SEQ ID NO: 707692 - protein, 9 aa, Homo Sapiens
DTPQAKALA

SEQ ID NO: 707693 - protein, 9 aa, Homo Sapiens
PLPQNPMRP

SEQ ID NO: 707694 - protein, 9 aa, Homo Sapiens
KKLKNKQKR

SEQ ID NO: 707695 - protein, 9 aa, Homo Sapiens
YCVRRDLFE

SEQ ID NO: 707696 - protein, 9 aa, Homo Sapiens
LLEKTNLSL

SEQ ID NO: 707697 - protein, 9 aa, Homo Sapiens
PRGDTPQAK

SEQ ID NO: 707698 - protein, 9 aa, Homo Sapiens
QKVVALIGV

SEQ ID NO: 707699 - protein, 9 aa, Homo Sapiens
CSILRICTS

SEQ ID NO: 707700 - protein, 9 aa, Homo Sapiens
GLDAPLFGV

SEQ ID NO: 707701 - protein, 9 aa, Homo Sapiens
LLRDASPVL

SEQ ID NO: 707702 - protein, 9 aa, Homo Sapiens
SYFHTMLES

SEQ ID NO: 707703 - protein, 9 aa, Homo Sapiens
GSSFQGHQE

SEQ ID NO: 707704 - protein, 9 aa, Homo Sapiens
SYPYPAERR

SEQ ID NO: 707705 - protein, 9 aa, Homo Sapiens
LPDLGTQSL

SEQ ID NO: 707706 - protein, 9 aa, Homo Sapiens
MTISNPPDW

SEQ ID NO: 707707 - protein, 9 aa, Homo Sapiens
FPLHIGELH

SEQ ID NO: 707708 - protein, 9 aa, Homo Sapiens
PSQAERKGP

SEQ ID NO: 707709 - protein, 9 aa, Homo Sapiens
GPESPKGSP

SEQ ID NO: 707710 - protein, 9 aa, Homo Sapiens
PRQEVLCAF

SEQ ID NO: 707711 - protein, 9 aa, Homo Sapiens
PTTRPTRPL

SEQ ID NO: 707712 - protein, 9 aa, Homo Sapiens
GKCGPTPPI

SEQ ID NO: 707713 - protein, 9 aa, Homo Sapiens
VASPHPDLQ

SEQ ID NO: 707714 - protein, 9 aa, Homo Sapiens
GPSSEQMCK

SEQ ID NO: 707715 - protein, 9 aa, Homo Sapiens
FVALITFGN

SEQ ID NO: 707716 - protein, 9 aa, Homo Sapiens
NIDNGTSDR

SEQ ID NO: 707717 - protein, 9 aa, Homo Sapiens
FSESSSLTV

SEQ ID NO: 707718 - protein, 9 aa, Homo Sapiens
SKGYNQRPQ

SEQ ID NO: 707719 - protein, 9 aa, Homo Sapiens
FIIIFWENG

SEQ ID NO: 707720 - protein, 9 aa, Homo Sapiens
AYHVDSVAS

SEQ ID NO: 707721 - protein, 9 aa, Homo Sapiens
TRLSAFEMK

SEQ ID NO: 707722 - protein, 9 aa, Homo Sapiens
EGGEKSETP

SEQ ID NO: 707723 - protein, 9 aa, Homo Sapiens
EKRESKRIL

SEQ ID NO: 707724 - protein, 9 aa, Homo Sapiens
VPSPADSLS

SEQ ID NO: 707725 - protein, 9 aa, Homo Sapiens
QPAMHRPMH

SEQ ID NO: 707726 - protein, 9 aa, Homo Sapiens
LLPIMTEQD

SEQ ID NO: 707727 - protein, 9 aa, Homo Sapiens
KPGKFVEFY

SEQ ID NO: 707728 - protein, 9 aa, Homo Sapiens
ERKIKLNIF

SEQ ID NO: 707729 - protein, 9 aa, Homo Sapiens
SQHTIILTE

SEQ ID NO: 707730 - protein, 9 aa, Homo Sapiens
PGIVRRYLL

SEQ ID NO: 707731 - protein, 9 aa, Homo Sapiens
AFSESSSLT

SEQ ID NO: 707732 - protein, 9 aa, Homo Sapiens
PYQRLGIGT

SEQ ID NO: 707733 - protein, 9 aa, Homo Sapiens
RERPLEGGG

SEQ ID NO: 707734 - protein, 9 aa, Homo Sapiens
GHITLTKAL

SEQ ID NO: 707735 - protein, 9 aa, Homo Sapiens
EGSLLIKNP

SEQ ID NO: 707736 - protein, 9 aa, Homo Sapiens
LELEQEQRR

SEQ ID NO: 707737 - protein, 9 aa, Homo Sapiens
QDIDLGVSG

SEQ ID NO: 707738 - protein, 9 aa, Homo Sapiens
IGPRQGAAD

SEQ ID NO: 707739 - protein, 9 aa, Homo Sapiens
PWWGNALGW

SEQ ID NO: 707740 - protein, 9 aa, Homo Sapiens
TLWLNGICH

SEQ ID NO: 707741 - protein, 9 aa, Homo Sapiens
YIVQLKRHF

SEQ ID NO: 707742 - protein, 9 aa, Homo Sapiens
VIIKYKNSL

SEQ ID NO: 707743 - protein, 9 aa, Homo Sapiens
IDLGVSGEV

SEQ ID NO: 707744 - protein, 9 aa, Homo Sapiens
CELFSQHTI

SEQ ID NO: 707745 - protein, 9 aa, Homo Sapiens
HVVAGTLEE

SEQ ID NO: 707746 - protein, 9 aa, Homo Sapiens
SCSRIHCLE

SEQ ID NO: 707747 - protein, 9 aa, Homo Sapiens
GGFQVLTFE

SEQ ID NO: 707748 - protein, 9 aa, Homo Sapiens
PQNPMRPRQ

SEQ ID NO: 707749 - protein, 9 aa, Homo Sapiens
EEGGVRMAG

SEQ ID NO: 707750 - protein, 9 aa, Homo Sapiens
KAFNCSSTH

SEQ ID NO: 707751 - protein, 9 aa, Homo Sapiens
TIQEEFYKV

SEQ ID NO: 707752 - protein, 9 aa, Homo Sapiens
AKTLVKKMT

SEQ ID NO: 707753 - protein, 9 aa, Homo Sapiens
RLSAFEMKQ

SEQ ID NO: 707754 - protein, 9 aa, Homo Sapiens
YLAAALCTN

SEQ ID NO: 707755 - protein, 9 aa, Homo Sapiens
QGAPRVGMP

SEQ ID NO: 707756 - protein, 9 aa, Homo Sapiens
PVTREGELW

SEQ ID NO: 707757 - protein, 9 aa, Homo Sapiens
RPVSSLAPG

SEQ ID NO: 707758 - protein, 9 aa, Homo Sapiens
KQVSSEPQK

SEQ ID NO: 707759 - protein, 9 aa, Homo Sapiens
PQKVVALIG

SEQ ID NO: 707760 - protein, 9 aa, Homo Sapiens
NVINPPLNL

SEQ ID NO: 707761 - protein, 9 aa, Homo Sapiens
NRYYKANYW

SEQ ID NO: 707762 - protein, 9 aa, Homo Sapiens
VDKIEVCPE

SEQ ID NO: 707763 - protein, 9 aa, Homo Sapiens
NCVFMTISN

SEQ ID NO: 707764 - protein, 9 aa, Homo Sapiens
ICTSEGRHR

SEQ ID NO: 707765 - protein, 9 aa, Homo Sapiens
AYSEYLAAA

SEQ ID NO: 707766 - protein, 9 aa, Homo Sapiens
RQLSLHINK

SEQ ID NO: 707767 - protein, 9 aa, Homo Sapiens
VQDGSPKMA

SEQ ID NO: 707768 - protein, 9 aa, Homo Sapiens
LRICTSEGR

SEQ ID NO: 707769 - protein, 9 aa, Homo Sapiens
PTPPIDNGD

SEQ ID NO: 707770 - protein, 9 aa, Homo Sapiens
KRAAIDAVD

SEQ ID NO: 707771 - protein, 9 aa, Homo Sapiens
SPRAACSNP

SEQ ID NO: 707772 - protein, 9 aa, Homo Sapiens
QLGGPAARG

SEQ ID NO: 707773 - protein, 9 aa, Homo Sapiens
APRVGMPAA

SEQ ID NO: 707774 - protein, 9 aa, Homo Sapiens
KIGNSLFVQ

SEQ ID NO: 707775 - protein, 9 aa, Homo Sapiens
DGDSAYVWM

SEQ ID NO: 707776 - protein, 9 aa, Homo Sapiens
NSCSRIHCL

SEQ ID NO: 707777 - protein, 9 aa, Homo Sapiens
QEQLQLERA

SEQ ID NO: 707778 - protein, 9 aa, Homo Sapiens
ECLPVILVV

SEQ ID NO: 707779 - protein, 9 aa, Homo Sapiens
NYIRSLRKA

SEQ ID NO: 707780 - protein, 9 aa, Homo Sapiens
KQAQTFVAL

SEQ ID NO: 707781 - protein, 9 aa, Homo Sapiens
TRGSTEGYV

SEQ ID NO: 707782 - protein, 9 aa, Homo Sapiens
TTRPTRPLP

SEQ ID NO: 707783 - protein, 9 aa, Homo Sapiens
LPGDSFYMR

SEQ ID NO: 707784 - protein, 9 aa, Homo Sapiens
KWHVPAAGM

SEQ ID NO: 707785 - protein, 9 aa, Homo Sapiens
HESVAKRFL

SEQ ID NO: 707786 - protein, 9 aa, Homo Sapiens
YKNSLHIPM

SEQ ID NO: 707787 - protein, 9 aa, Homo Sapiens
FERHPCGNG

SEQ ID NO: 707788 - protein, 9 aa, Homo Sapiens
AQRREEEGG

SEQ ID NO: 707789 - protein, 9 aa, Homo Sapiens
FWENGDSGT

SEQ ID NO: 707790 - protein, 9 aa, Homo Sapiens
AGPSGKAGG

SEQ ID NO: 707791 - protein, 9 aa, Homo Sapiens
GPRAYHVDS

SEQ ID NO: 707792 - protein, 9 aa, Homo Sapiens
TRGYEGDAP

SEQ ID NO: 707793 - protein, 9 aa, Homo Sapiens
AVHWGCIGG

SEQ ID NO: 707794 - protein, 9 aa, Homo Sapiens
QELGLHPAD

SEQ ID NO: 707795 - protein, 9 aa, Homo Sapiens
VAGTLEEDE

SEQ ID NO: 707796 - protein, 9 aa, Homo Sapiens
KANYWQFPD

SEQ ID NO: 707797 - protein, 9 aa, Homo Sapiens
TTAGPSGKA

SEQ ID NO: 707798 - protein, 9 aa, Homo Sapiens
LLECEMSHP

SEQ ID NO: 707799 - protein, 9 aa, Homo Sapiens
TQALLLHID

SEQ ID NO: 707800 - protein, 9 aa, Homo Sapiens
KGIMEEDKA

SEQ ID NO: 707801 - protein, 9 aa, Homo Sapiens
LSPRCGFCN

SEQ ID NO: 707802 - protein, 9 aa, Homo Sapiens
LAPYQRLGI

SEQ ID NO: 707803 - protein, 9 aa, Homo Sapiens
PESPKGSPR

SEQ ID NO: 707804 - protein, 9 aa, Homo Sapiens
YCNICHSMA

SEQ ID NO: 707805 - protein, 9 aa, Homo Sapiens
IQEQLQLER

SEQ ID NO: 707806 - protein, 9 aa, Homo Sapiens
AGYRGHQNR

SEQ ID NO: 707807 - protein, 9 aa, Homo Sapiens
ESSGFARAI

SEQ ID NO: 707808 - protein, 9 aa, Homo Sapiens
KEDPANTLY

SEQ ID NO: 707809 - protein, 9 aa, Homo Sapiens
SGKAGGGAG

SEQ ID NO: 707810 - protein, 9 aa, Homo Sapiens
TLRPGMRVA

SEQ ID NO: 707811 - protein, 9 aa, Homo Sapiens
RGDLQSLGY

SEQ ID NO: 707812 - protein, 9 aa, Homo Sapiens
AVSEGGEKS

SEQ ID NO: 707813 - protein, 9 aa, Homo Sapiens
EGGVRMAGQ

SEQ ID NO: 707814 - protein, 9 aa, Homo Sapiens
EFERHPCGN

SEQ ID NO: 707815 - protein, 9 aa, Homo Sapiens
CNEASQRSW

SEQ ID NO: 707816 - protein, 9 aa, Homo Sapiens
SSEPQKMYP

SEQ ID NO: 707817 - protein, 9 aa, Homo Sapiens
KIHHIFCDI

SEQ ID NO: 707818 - protein, 9 aa, Homo Sapiens
SQVEPVTRE

SEQ ID NO: 707819 - protein, 9 aa, Homo Sapiens
MGCMNRRPI

SEQ ID NO: 707820 - protein, 9 aa, Homo Sapiens
TNSVYKKHR

SEQ ID NO: 707821 - protein, 9 aa, Homo Sapiens
LFPLHIGEL

SEQ ID NO: 707822 - protein, 9 aa, Homo Sapiens
QAHGVTSAP

SEQ ID NO: 707823 - protein, 9 aa, Homo Sapiens
KEPKSRRSH

SEQ ID NO: 707824 - protein, 9 aa, Homo Sapiens
GPAARGGCL

SEQ ID NO: 707825 - protein, 9 aa, Homo Sapiens
HINKLPGEK

SEQ ID NO: 707826 - protein, 9 aa, Homo Sapiens
SRIHCLEIL

SEQ ID NO: 707827 - protein, 9 aa, Homo Sapiens
DVDEFERHP

SEQ ID NO: 707828 - protein, 9 aa, Homo Sapiens
PRRLITLYQ

SEQ ID NO: 707829 - protein, 9 aa, Homo Sapiens
KQFYKTCNT

SEQ ID NO: 707830 - protein, 9 aa, Homo Sapiens
WVQDGSPKM

SEQ ID NO: 707831 - protein, 9 aa, Homo Sapiens
QRLGIGTKM

SEQ ID NO: 707832 - protein, 9 aa, Homo Sapiens
LEQEQRRHT

SEQ ID NO: 707833 - protein, 9 aa, Homo Sapiens
PRDAAAYLA

SEQ ID NO: 707834 - protein, 9 aa, Homo Sapiens
GKLDTPGVH

SEQ ID NO: 707835 - protein, 9 aa, Homo Sapiens
NVCGKAFSE

SEQ ID NO: 707836 - protein, 9 aa, Homo Sapiens
RSNKIHHIF

SEQ ID NO: 707837 - protein, 9 aa, Homo Sapiens
ELVDSLKLM

SEQ ID NO: 707838 - protein, 9 aa, Homo Sapiens
SILRICTSE

SEQ ID NO: 707839 - protein, 9 aa, Homo Sapiens
NQRPQGSKE

SEQ ID NO: 707840 - protein, 9 aa, Homo Sapiens
LMTLPAWST

SEQ ID NO: 707841 - protein, 9 aa, Homo Sapiens
NVFIIIFWE

SEQ ID NO: 707842 - protein, 9 aa, Homo Sapiens
EPFSHIDPQ

SEQ ID NO: 707843 - protein, 9 aa, Homo Sapiens
TISGRLLPI

SEQ ID NO: 707844 - protein, 9 aa, Homo Sapiens
PAAHPGQLG

SEQ ID NO: 707845 - protein, 9 aa, Homo Sapiens
ESSSLTVHV

SEQ ID NO: 707846 - protein, 9 aa, Homo Sapiens
LSVLCGVIK

SEQ ID NO: 707847 - protein, 9 aa, Homo Sapiens
SNKIHHIFC

SEQ ID NO: 707848 - protein, 9 aa, Homo Sapiens
KLDTPGVHN

SEQ ID NO: 707849 - protein, 9 aa, Homo Sapiens
GGGAAAVPG

SEQ ID NO: 707850 - protein, 9 aa, Homo Sapiens
GKRKRGRPL

SEQ ID NO: 707851 - protein, 9 aa, Homo Sapiens
ADKVVDKIE

SEQ ID NO: 707852 - protein, 9 aa, Homo Sapiens
VSADMRRMA

SEQ ID NO: 707853 - protein, 9 aa, Homo Sapiens
VPAVSEGGE

SEQ ID NO: 707854 - protein, 9 aa, Homo Sapiens
FLLLFSGAT

SEQ ID NO: 707855 - protein, 9 aa, Homo Sapiens
GPSGKAGGG

SEQ ID NO: 707856 - protein, 9 aa, Homo Sapiens
MGIVLSPDY

SEQ ID NO: 707857 - protein, 9 aa, Homo Sapiens
RAYHVDSVA

SEQ ID NO: 707858 - protein, 9 aa, Homo Sapiens
PGARLAWCC

SEQ ID NO: 707859 - protein, 9 aa, Homo Sapiens
CGPTPPIDN

SEQ ID NO: 707860 - protein, 9 aa, Homo Sapiens
RDVRTARTL

SEQ ID NO: 707861 - protein, 9 aa, Homo Sapiens
LKLIFLLLF

SEQ ID NO: 707862 - protein, 9 aa, Homo Sapiens
DWLGLKDKD

SEQ ID NO: 707863 - protein, 9 aa, Homo Sapiens
IVLSPDYPE

SEQ ID NO: 707864 - protein, 9 aa, Homo Sapiens
WWGNALGWL

SEQ ID NO: 707865 - protein, 9 aa, Homo Sapiens
PAGPRAYHV

SEQ ID NO: 707866 - protein, 9 aa, Homo Sapiens
VRPHGQPKP

SEQ ID NO: 707867 - protein, 9 aa, Homo Sapiens
KALAAAAQD

SEQ ID NO: 707868 - protein, 9 aa, Homo Sapiens
APCPAQLWE

SEQ ID NO: 707869 - protein, 9 aa, Homo Sapiens
RKIKLNIFL

SEQ ID NO: 707870 - protein, 9 aa, Homo Sapiens
TAISEMVAH

SEQ ID NO: 707871 - protein, 9 aa, Homo Sapiens
GFARAIAIV

SEQ ID NO: 707872 - protein, 9 aa, Homo Sapiens
GISHQPEKP

SEQ ID NO: 707873 - protein, 9 aa, Homo Sapiens
DKLFKEANA

SEQ ID NO: 707874 - protein, 9 aa, Homo Sapiens
HHIFCDILP

SEQ ID NO: 707875 - protein, 9 aa, Homo Sapiens
PVIAAVHWG

SEQ ID NO: 707876 - protein, 9 aa, Homo Sapiens
MSSAPWRPA

SEQ ID NO: 707877 - protein, 9 aa, Homo Sapiens
ALLLHIDSF

SEQ ID NO: 707878 - protein, 9 aa, Homo Sapiens
PAVSEGGEK

SEQ ID NO: 707879 - protein, 9 aa, Homo Sapiens
VDEFERHPC

SEQ ID NO: 707880 - protein, 9 aa, Homo Sapiens
KAFTCLASV

SEQ ID NO: 707881 - protein, 9 aa, Homo Sapiens
IAAVHWGCI

SEQ ID NO: 707882 - protein, 9 aa, Homo Sapiens
GVDFLQLPS

SEQ ID NO: 707883 - protein, 9 aa, Homo Sapiens
EKQMLLEKT

SEQ ID NO: 707884 - protein, 9 aa, Homo Sapiens
VQHQCPGYY

SEQ ID NO: 707885 - protein, 9 aa, Homo Sapiens
RMQELGLHP

SEQ ID NO: 707886 - protein, 9 aa, Homo Sapiens
TARTLRAQF

SEQ ID NO: 707887 - protein, 9 aa, Homo Sapiens
IIALQPAMH

SEQ ID NO: 707888 - protein, 9 aa, Homo Sapiens
QNPMRPRQP

SEQ ID NO: 707889 - protein, 9 aa, Homo Sapiens
LAKRYSVIL

SEQ ID NO: 707890 - protein, 9 aa, Homo Sapiens
RDAAAYLAG

SEQ ID NO: 707891 - protein, 9 aa, Homo Sapiens
SFYMRALYD

SEQ ID NO: 707892 - protein, 9 aa, Homo Sapiens
PSGKAGGGA

SEQ ID NO: 707893 - protein, 9 aa, Homo Sapiens
GCLQFGLVE

SEQ ID NO: 707894 - protein, 9 aa, Homo Sapiens
LHIGELHIL

SEQ ID NO: 707895 - protein, 9 aa, Homo Sapiens
SLFPATNYI

SEQ ID NO: 707896 - protein, 9 aa, Homo Sapiens
GSPKMAENE

SEQ ID NO: 707897 - protein, 9 aa, Homo Sapiens
RLHMLQMSY

SEQ ID NO: 707898 - protein, 9 aa, Homo Sapiens
AYVWMSDGN

SEQ ID NO: 707899 - protein, 9 aa, Homo Sapiens
FINILSHES

SEQ ID NO: 707900 - protein, 9 aa, Homo Sapiens
LGISHQPEK

SEQ ID NO: 707901 - protein, 9 aa, Homo Sapiens
EQMETEEKE

SEQ ID NO: 707902 - protein, 9 aa, Homo Sapiens
ESCYAQVSL

SEQ ID NO: 707903 - protein, 9 aa, Homo Sapiens
QLWETPHWL

SEQ ID NO: 707904 - protein, 9 aa, Homo Sapiens
QYQHLPSLR

SEQ ID NO: 707905 - protein, 9 aa, Homo Sapiens
SSYPYPAER

SEQ ID NO: 707906 - protein, 9 aa, Homo Sapiens
RPQKVVALI

SEQ ID NO: 707907 - protein, 9 aa, Homo Sapiens
VPDWHLKMP

SEQ ID NO: 707908 - protein, 9 aa, Homo Sapiens
RSGDTLRWR

SEQ ID NO: 707909 - protein, 9 aa, Homo Sapiens
AQVSLPEMV

SEQ ID NO: 707910 - protein, 9 aa, Homo Sapiens
GRETGTWYL

SEQ ID NO: 707911 - protein, 9 aa, Homo Sapiens
HERKIKLNI

SEQ ID NO: 707912 - protein, 9 aa, Homo Sapiens
RSAGELVDS

SEQ ID NO: 707913 - protein, 9 aa, Homo Sapiens
RSCNEASQR

SEQ ID NO: 707914 - protein, 9 aa, Homo Sapiens
AALALGQAL

SEQ ID NO: 707915 - protein, 9 aa, Homo Sapiens
WMKQAIQEQ

SEQ ID NO: 707916 - protein, 9 aa, Homo Sapiens
VIDKIRFPT

SEQ ID NO: 707917 - protein, 9 aa, Homo Sapiens
GVATAGGAG

SEQ ID NO: 707918 - protein, 9 aa, Homo Sapiens
GRDHARTPQ

SEQ ID NO: 707919 - protein, 9 aa, Homo Sapiens
ASPHPDLQE

SEQ ID NO: 707920 - protein, 9 aa, Homo Sapiens
PLKLSKEYW

SEQ ID NO: 707921 - protein, 9 aa, Homo Sapiens
ACIECEGQL

SEQ ID NO: 707922 - protein, 9 aa, Homo Sapiens
RGRPLKLSK

SEQ ID NO: 707923 - protein, 9 aa, Homo Sapiens
EPQKMYPGE

SEQ ID NO: 707924 - protein, 9 aa, Homo Sapiens
PYVSADMRR

SEQ ID NO: 707925 - protein, 9 aa, Homo Sapiens
RRMAAAFNT

SEQ ID NO: 707926 - protein, 9 aa, Homo Sapiens
SADTVPSPA

SEQ ID NO: 707927 - protein, 9 aa, Homo Sapiens
DLQEQKQQI

SEQ ID NO: 707928 - protein, 9 aa, Homo Sapiens
KLELEQEQR

SEQ ID NO: 707929 - protein, 9 aa, Homo Sapiens
LVPAAGGGA

SEQ ID NO: 707930 - protein, 8 aa, Homo Sapiens
ITRAGLPC

SEQ ID NO: 707931 - protein, 9 aa, Homo Sapiens
RQGAADLLR

SEQ ID NO: 707932 - protein, 9 aa, Homo Sapiens
QFGLVEAPV

SEQ ID NO: 707933 - protein, 9 aa, Homo Sapiens
NIFLQLRIF

SEQ ID NO: 707934 - protein, 9 aa, Homo Sapiens
RYRVPLDNP

SEQ ID NO: 707935 - protein, 9 aa, Homo Sapiens
AIAINRYCN

SEQ ID NO: 707936 - protein, 9 aa, Homo Sapiens
FNCSSTHKK

SEQ ID NO: 707937 - protein, 9 aa, Homo Sapiens
CGVRPHGQP

SEQ ID NO: 707938 - protein, 9 aa, Homo Sapiens
CEMSHPRGI

SEQ ID NO: 707939 - protein, 9 aa, Homo Sapiens
KNSLHIPMY

SEQ ID NO: 707940 - protein, 9 aa, Homo Sapiens
AAETNSVYK

SEQ ID NO: 707941 - protein, 9 aa, Homo Sapiens
LGAPEPPAS

SEQ ID NO: 707942 - protein, 9 aa, Homo Sapiens
YKQVSSEPQ

SEQ ID NO: 707943 - protein, 9 aa, Homo Sapiens
GPRQGAADL

SEQ ID NO: 707944 - protein, 9 aa, Homo Sapiens
KEGEYNVQH

SEQ ID NO: 707945 - protein, 9 aa, Homo Sapiens
EAKLELEQE

SEQ ID NO: 707946 - protein, 9 aa, Homo Sapiens
AGGAGTITS

SEQ ID NO: 707947 - protein, 9 aa, Homo Sapiens
EAAQRREEE

SEQ ID NO: 707948 - protein, 9 aa, Homo Sapiens
DIPKGVPAP

SEQ ID NO: 707949 - protein, 9 aa, Homo Sapiens
LDQGEYKRA

SEQ ID NO: 707950 - protein, 9 aa, Homo Sapiens
RHSFFHDNI

SEQ ID NO: 707951 - protein, 9 aa, Homo Sapiens
DGRKSFLTT

SEQ ID NO: 707952 - protein, 9 aa, Homo Sapiens
GGDGGEFHR

SEQ ID NO: 707953 - protein, 9 aa, Homo Sapiens
PMGIVLSPD

SEQ ID NO: 707954 - protein, 9 aa, Homo Sapiens
QAERKGPGT

SEQ ID NO: 707955 - protein, 9 aa, Homo Sapiens
LAHSLDDGE

SEQ ID NO: 707956 - protein, 9 aa, Homo Sapiens
LLSFESSNM

SEQ ID NO: 707957 - protein, 9 aa, Homo Sapiens
RTQALLLHI

SEQ ID NO: 707958 - protein, 9 aa, Homo Sapiens
VEPVTREGE

SEQ ID NO: 707959 - protein, 9 aa, Homo Sapiens
FTLRPGMRV

SEQ ID NO: 707960 - protein, 9 aa, Homo Sapiens
YYKANYWQF

SEQ ID NO: 707961 - protein, 9 aa, Homo Sapiens
EIDKLFKEA

SEQ ID NO: 707962 - protein, 9 aa, Homo Sapiens
PEDQVVEEG

SEQ ID NO: 707963 - protein, 9 aa, Homo Sapiens
DSFYMRALY

SEQ ID NO: 707964 - protein, 9 aa, Homo Sapiens
RLKLFPLHI

SEQ ID NO: 707965 - protein, 9 aa, Homo Sapiens
SSEQMCKTY

SEQ ID NO: 707966 - protein, 9 aa, Homo Sapiens
WLGLKDKDL

SEQ ID NO: 707967 - protein, 9 aa, Homo Sapiens
RLSPRCGFC

SEQ ID NO: 707968 - protein, 9 aa, Homo Sapiens
ILVIIKYKN

SEQ ID NO: 707969 - protein, 9 aa, Homo Sapiens
PQQPSPEDQ

SEQ ID NO: 707970 - protein, 9 aa, Homo Sapiens
KNIDNGTSD

SEQ ID NO: 707971 - protein, 9 aa, Homo Sapiens
EIAQDFKTN

SEQ ID NO: 707972 - protein, 9 aa, Homo Sapiens
DEQERNKEE

SEQ ID NO: 707973 - protein, 9 aa, Homo Sapiens
LCHSEETST

SEQ ID NO: 707974 - protein, 9 aa, Homo Sapiens
SVYKKHRIL

SEQ ID NO: 707975 - protein, 9 aa, Homo Sapiens
LLVAAPAAA

SEQ ID NO: 707976 - protein, 9 aa, Homo Sapiens
SANSVFIKN

SEQ ID NO: 707977 - protein, 9 aa, Homo Sapiens
QNSCSRIHC

SEQ ID NO: 707978 - protein, 9 aa, Homo Sapiens
NSVYKKHRI

SEQ ID NO: 707979 - protein, 9 aa, Homo Sapiens
HIDPQESEE

SEQ ID NO: 707980 - protein, 9 aa, Homo Sapiens
THKKHKIIH

SEQ ID NO: 707981 - protein, 9 aa, Homo Sapiens
PWRPAKGAD

SEQ ID NO: 707982 - protein, 9 aa, Homo Sapiens
GAGTITSDL

SEQ ID NO: 707983 - protein, 9 aa, Homo Sapiens
NLRFQSSAV

SEQ ID NO: 707984 - protein, 9 aa, Homo Sapiens
PLLPGARLA

SEQ ID NO: 707985 - protein, 9 aa, Homo Sapiens
SPLLTRPNY

SEQ ID NO: 707986 - protein, 9 aa, Homo Sapiens
VHWGCIGGG

SEQ ID NO: 707987 - protein, 9 aa, Homo Sapiens
AVAAGAGSG

SEQ ID NO: 707988 - protein, 9 aa, Homo Sapiens
FNTMAYDRY

SEQ ID NO: 707989 - protein, 9 aa, Homo Sapiens
WYLVTALIK

SEQ ID NO: 707990 - protein, 9 aa, Homo Sapiens
LETLWLNGI

SEQ ID NO: 707991 - protein, 9 aa, Homo Sapiens
FMTISNPPD

SEQ ID NO: 707992 - protein, 9 aa, Homo Sapiens
MKQAIQEQL

SEQ ID NO: 707993 - protein, 9 aa, Homo Sapiens
VDFLQLPSD

SEQ ID NO: 707994 - protein, 9 aa, Homo Sapiens
LIKNPLPSQ

SEQ ID NO: 707995 - protein, 9 aa, Homo Sapiens
PLNVLQLPG

SEQ ID NO: 707996 - protein, 9 aa, Homo Sapiens
FHDNILLNS

SEQ ID NO: 707997 - protein, 9 aa, Homo Sapiens
RKHGHLPLV

SEQ ID NO: 707998 - protein, 9 aa, Homo Sapiens
QDGSPKMAE

SEQ ID NO: 707999 - protein, 9 aa, Homo Sapiens
ALITFGNYV

SEQ ID NO: 708000 - protein, 9 aa, Homo Sapiens
SEGGEKSET

SEQ ID NO: 708001 - protein, 9 aa, Homo Sapiens
ECEMSHPRG

SEQ ID NO: 708002 - protein, 9 aa, Homo Sapiens
RYCNICHSM

SEQ ID NO: 708003 - protein, 9 aa, Homo Sapiens
CPIFQKPFK

SEQ ID NO: 708004 - protein, 9 aa, Homo Sapiens
FIKNLSRTP

SEQ ID NO: 708005 - protein, 9 aa, Homo Sapiens
MRRMAAAFN

SEQ ID NO: 708006 - protein, 9 aa, Homo Sapiens
SASLYYGTL

SEQ ID NO: 708007 - protein, 9 aa, Homo Sapiens
LQEQKQQIT

SEQ ID NO: 708008 - protein, 9 aa, Homo Sapiens
ALSDVPSLS

SEQ ID NO: 708009 - protein, 9 aa, Homo Sapiens
HWGCIGGGV

SEQ ID NO: 708010 - protein, 9 aa, Homo Sapiens
INILSHESV

SEQ ID NO: 708011 - protein, 9 aa, Homo Sapiens
DNVINPPLN

SEQ ID NO: 708012 - protein, 9 aa, Homo Sapiens
CSSTHKKHK

SEQ ID NO: 708013 - protein, 9 aa, Homo Sapiens
GQAPCPAQL

SEQ ID NO: 708014 - protein, 9 aa, Homo Sapiens
GTNSNNNNS

SEQ ID NO: 708015 - protein, 9 aa, Homo Sapiens
EREEKRESK

SEQ ID NO: 708016 - protein, 9 aa, Homo Sapiens
KISALKLCL

SEQ ID NO: 708017 - protein, 9 aa, Homo Sapiens
KEDKILKIS

SEQ ID NO: 708018 - protein, 9 aa, Homo Sapiens
YRGSEPESE

SEQ ID NO: 708019 - protein, 9 aa, Homo Sapiens
CVKLNEERV

SEQ ID NO: 708020 - protein, 9 aa, Homo Sapiens
TQRLDRLPH

SEQ ID NO: 708021 - protein, 9 aa, Homo Sapiens
PPARVKTLR

SEQ ID NO: 708022 - protein, 9 aa, Homo Sapiens
NYAVWFRLY

SEQ ID NO: 708023 - protein, 9 aa, Homo Sapiens
TSDDFHHTP

SEQ ID NO: 708024 - protein, 9 aa, Homo Sapiens
TTPLFNALI

SEQ ID NO: 708025 - protein, 9 aa, Homo Sapiens
GTNGGPDKG

SEQ ID NO: 708026 - protein, 9 aa, Homo Sapiens
KGTPTSSQP

SEQ ID NO: 708027 - protein, 9 aa, Homo Sapiens
STTSPPFGK

SEQ ID NO: 708028 - protein, 9 aa, Homo Sapiens
EIVSMFQED

SEQ ID NO: 708029 - protein, 9 aa, Homo Sapiens
YVIGFLLFR

SEQ ID NO: 708030 - protein, 9 aa, Homo Sapiens
RRRRLLQPV

SEQ ID NO: 708031 - protein, 9 aa, Homo Sapiens
PQKVCRTEY

SEQ ID NO: 708032 - protein, 9 aa, Homo Sapiens
QQIHSGDRL

SEQ ID NO: 708033 - protein, 9 aa, Homo Sapiens
MIGNYAVWF

SEQ ID NO: 708034 - protein, 9 aa, Homo Sapiens
LWRPPEAPL

SEQ ID NO: 708035 - protein, 9 aa, Homo Sapiens
YYPVQGQVL

SEQ ID NO: 708036 - protein, 9 aa, Homo Sapiens
EDWDRFTRR

SEQ ID NO: 708037 - protein, 9 aa, Homo Sapiens
FRHSVVVPC

SEQ ID NO: 708038 - protein, 9 aa, Homo Sapiens
HKICSSHSL

SEQ ID NO: 708039 - protein, 9 aa, Homo Sapiens
ALVVGVFLR

SEQ ID NO: 708040 - protein, 9 aa, Homo Sapiens
EIETAIVTS

SEQ ID NO: 708041 - protein, 9 aa, Homo Sapiens
PKTFPVVLP

SEQ ID NO: 708042 - protein, 9 aa, Homo Sapiens
FRNRSCRIL

SEQ ID NO: 708043 - protein, 9 aa, Homo Sapiens
NYGIQQDLK

SEQ ID NO: 708044 - protein, 9 aa, Homo Sapiens
IGKVSFGKV

SEQ ID NO: 708045 - protein, 9 aa, Homo Sapiens
DNPLSIHPQ

SEQ ID NO: 708046 - protein, 9 aa, Homo Sapiens
KECYGTKGP

SEQ ID NO: 708047 - protein, 9 aa, Homo Sapiens
GVVEPLPHD

SEQ ID NO: 708048 - protein, 9 aa, Homo Sapiens
EPLPHDETY

SEQ ID NO: 708049 - protein, 9 aa, Homo Sapiens
FGLALQADE

SEQ ID NO: 708050 - protein, 9 aa, Homo Sapiens
SLSSPTDAS

SEQ ID NO: 708051 - protein, 9 aa, Homo Sapiens
SVWLRTPRS

SEQ ID NO: 708052 - protein, 9 aa, Homo Sapiens
SDCDLYFTQ

SEQ ID NO: 708053 - protein, 9 aa, Homo Sapiens
SVWGREESE

SEQ ID NO: 708054 - protein, 9 aa, Homo Sapiens
FKNKADNPL

SEQ ID NO: 708055 - protein, 9 aa, Homo Sapiens
RMKEKEAQA

SEQ ID NO: 708056 - protein, 9 aa, Homo Sapiens
IFTVGTSGT

SEQ ID NO: 708057 - protein, 9 aa, Homo Sapiens
ECYGTKGPK

SEQ ID NO: 708058 - protein, 9 aa, Homo Sapiens
QLMFIPRSL

SEQ ID NO: 708059 - protein, 9 aa, Homo Sapiens
WKMLSEICH

SEQ ID NO: 708060 - protein, 9 aa, Homo Sapiens
KDRIKQGWN

SEQ ID NO: 708061 - protein, 9 aa, Homo Sapiens
TAPVCKAVQ

SEQ ID NO: 708062 - protein, 9 aa, Homo Sapiens
AVLQRWLQK

SEQ ID NO: 708063 - protein, 9 aa, Homo Sapiens
ISTGRNATV

SEQ ID NO: 708064 - protein, 9 aa, Homo Sapiens
CADPQISES

SEQ ID NO: 708065 - protein, 9 aa, Homo Sapiens
LQSCEGCRM

SEQ ID NO: 708066 - protein, 9 aa, Homo Sapiens
PCLARLHLP

SEQ ID NO: 708067 - protein, 9 aa, Homo Sapiens
LRAIGKVSF

SEQ ID NO: 708068 - protein, 9 aa, Homo Sapiens
GFLLFRNRS

SEQ ID NO: 708069 - protein, 9 aa, Homo Sapiens
LAGPTENRE

SEQ ID NO: 708070 - protein, 9 aa, Homo Sapiens
ETVNLLLKK

SEQ ID NO: 708071 - protein, 9 aa, Homo Sapiens
YPSYLALGE

SEQ ID NO: 708072 - protein, 9 aa, Homo Sapiens
NRHVLVRDP

SEQ ID NO: 708073 - protein, 9 aa, Homo Sapiens
VEWHHDGKP

SEQ ID NO: 708074 - protein, 9 aa, Homo Sapiens
SETRHSKID

SEQ ID NO: 708075 - protein, 9 aa, Homo Sapiens
LQAWVASTR

SEQ ID NO: 708076 - protein, 9 aa, Homo Sapiens
ELEESIPEG

SEQ ID NO: 708077 - protein, 9 aa, Homo Sapiens
LALTLAAVT

SEQ ID NO: 708078 - protein, 9 aa, Homo Sapiens
TSMPHAVTC

SEQ ID NO: 708079 - protein, 9 aa, Homo Sapiens
LKDNIATLL

SEQ ID NO: 708080 - protein, 9 aa, Homo Sapiens
EPRPPARVK

SEQ ID NO: 708081 - protein, 9 aa, Homo Sapiens
QLDESKARM

SEQ ID NO: 708082 - protein, 9 aa, Homo Sapiens
LSIFVLDQN

SEQ ID NO: 708083 - protein, 9 aa, Homo Sapiens
SQKDLYRDA

SEQ ID NO: 708084 - protein, 9 aa, Homo Sapiens
PPSAKDVSF

SEQ ID NO: 708085 - protein, 9 aa, Homo Sapiens
PIERAHVHV

SEQ ID NO: 708086 - protein, 9 aa, Homo Sapiens
GHCYCYFAH

SEQ ID NO: 708087 - protein, 9 aa, Homo Sapiens
LETVNLLLK

SEQ ID NO: 708088 - protein, 9 aa, Homo Sapiens
ETGPYQCET

SEQ ID NO: 708089 - protein, 9 aa, Homo Sapiens
LDPLLPWQL

SEQ ID NO: 708090 - protein, 9 aa, Homo Sapiens
FSFDTRFKV

SEQ ID NO: 708091 - protein, 9 aa, Homo Sapiens
LSSSPIHSC

SEQ ID NO: 708092 - protein, 9 aa, Homo Sapiens
DLCGDFRYV

SEQ ID NO: 708093 - protein, 9 aa, Homo Sapiens
SGTTGETDT

SEQ ID NO: 708094 - protein, 9 aa, Homo Sapiens
KTFPVVLPP

SEQ ID NO: 708095 - protein, 9 aa, Homo Sapiens
MTKTIEYIQ

SEQ ID NO: 708096 - protein, 9 aa, Homo Sapiens
LLLIKTTQQ

SEQ ID NO: 708097 - protein, 9 aa, Homo Sapiens
RDAKAALVT

SEQ ID NO: 708098 - protein, 9 aa, Homo Sapiens
KQVEVVTAY

SEQ ID NO: 708099 - protein, 9 aa, Homo Sapiens
TGQCNNPMP

SEQ ID NO: 708100 - protein, 9 aa, Homo Sapiens
EKKPINVCS

SEQ ID NO: 708101 - protein, 9 aa, Homo Sapiens
SMDYRVARI

SEQ ID NO: 708102 - protein, 9 aa, Homo Sapiens
ARAASMETR

SEQ ID NO: 708103 - protein, 9 aa, Homo Sapiens
YLLLDMGSD

SEQ ID NO: 708104 - protein, 9 aa, Homo Sapiens
GQCNNPMPI

SEQ ID NO: 708105 - protein, 9 aa, Homo Sapiens
LSMANAGPK

SEQ ID NO: 708106 - protein, 9 aa, Homo Sapiens
NKADNPLSI

SEQ ID NO: 708107 - protein, 9 aa, Homo Sapiens
FPVVLPPET

SEQ ID NO: 708108 - protein, 9 aa, Homo Sapiens
DAMLENYRN

SEQ ID NO: 708109 - protein, 9 aa, Homo Sapiens
EVTVPGVCG

SEQ ID NO: 708110 - protein, 9 aa, Homo Sapiens
SLFRDSQTI

SEQ ID NO: 708111 - protein, 9 aa, Homo Sapiens
LYYPVQGQV

SEQ ID NO: 708112 - protein, 9 aa, Homo Sapiens
GYKGTFPHH

SEQ ID NO: 708113 - protein, 9 aa, Homo Sapiens
LLSESKTFF

SEQ ID NO: 708114 - protein, 9 aa, Homo Sapiens
DVNGAIHFE

SEQ ID NO: 708115 - protein, 9 aa, Homo Sapiens
LYRDAMLEN

SEQ ID NO: 708116 - protein, 9 aa, Homo Sapiens
LYLIIAICA

SEQ ID NO: 708117 - protein, 9 aa, Homo Sapiens
ESSFPSKSF

SEQ ID NO: 708118 - protein, 9 aa, Homo Sapiens
IDRSDLSPR

SEQ ID NO: 708119 - protein, 9 aa, Homo Sapiens
LTLLHDRSF

SEQ ID NO: 708120 - protein, 9 aa, Homo Sapiens
ALDVYRRAI

SEQ ID NO: 708121 - protein, 9 aa, Homo Sapiens
PEKLTPTTP

SEQ ID NO: 708122 - protein, 9 aa, Homo Sapiens
VWTATAPVC

SEQ ID NO: 708123 - protein, 9 aa, Homo Sapiens
QMVVQNVVG

SEQ ID NO: 708124 - protein, 9 aa, Homo Sapiens
FAFLGFTDY

SEQ ID NO: 708125 - protein, 9 aa, Homo Sapiens
FTECGKAFK

SEQ ID NO: 708126 - protein, 9 aa, Homo Sapiens
LASEGEQKR

SEQ ID NO: 708127 - protein, 9 aa, Homo Sapiens
AKACSRVNV

SEQ ID NO: 708128 - protein, 9 aa, Homo Sapiens
AREDQRFAL

SEQ ID NO: 708129 - protein, 9 aa, Homo Sapiens
NSPTFCQTI

SEQ ID NO: 708130 - protein, 9 aa, Homo Sapiens
NFRAKVQLG

SEQ ID NO: 708131 - protein, 9 aa, Homo Sapiens
GEQGTKECY

SEQ ID NO: 708132 - protein, 9 aa, Homo Sapiens
KTLREEAPT

SEQ ID NO: 708133 - protein, 9 aa, Homo Sapiens
LPFPDVECE

SEQ ID NO: 708134 - protein, 9 aa, Homo Sapiens
NFTDIRCIL

SEQ ID NO: 708135 - protein, 9 aa, Homo Sapiens
PHLHISMYL

SEQ ID NO: 708136 - protein, 9 aa, Homo Sapiens
FGYKGTFPH

SEQ ID NO: 708137 - protein, 9 aa, Homo Sapiens
RILDFGLAL

SEQ ID NO: 708138 - protein, 9 aa, Homo Sapiens
KSVLSQGGV

SEQ ID NO: 708139 - protein, 9 aa, Homo Sapiens
ACISHNHLY

SEQ ID NO: 708140 - protein, 9 aa, Homo Sapiens
MHTVEKSHE

SEQ ID NO: 708141 - protein, 9 aa, Homo Sapiens
LRSSFRPQK

SEQ ID NO: 708142 - protein, 9 aa, Homo Sapiens
DNDIPLHLA

SEQ ID NO: 708143 - protein, 9 aa, Homo Sapiens
LYTNVMLEN

SEQ ID NO: 708144 - protein, 9 aa, Homo Sapiens
LLKKGASLN

SEQ ID NO: 708145 - protein, 9 aa, Homo Sapiens
ICKFIFSIL

SEQ ID NO: 708146 - protein, 9 aa, Homo Sapiens
LQSGIGLLI

SEQ ID NO: 708147 - protein, 9 aa, Homo Sapiens
LFYNSPTFC

SEQ ID NO: 708148 - protein, 9 aa, Homo Sapiens
SESLLTTNI

SEQ ID NO: 708149 - protein, 9 aa, Homo Sapiens
MEARTLQPG

SEQ ID NO: 708150 - protein, 9 aa, Homo Sapiens
SFRSFTRES

SEQ ID NO: 708151 - protein, 9 aa, Homo Sapiens
DLYRDAMLE

SEQ ID NO: 708152 - protein, 9 aa, Homo Sapiens
DRSDLSPRA

SEQ ID NO: 708153 - protein, 9 aa, Homo Sapiens
SEHLRSFRS

SEQ ID NO: 708154 - protein, 9 aa, Homo Sapiens
GVTMCEIMT

SEQ ID NO: 708155 - protein, 9 aa, Homo Sapiens
ADTAQRAEL

SEQ ID NO: 708156 - protein, 9 aa, Homo Sapiens
RSFTRESLA

SEQ ID NO: 708157 - protein, 9 aa, Homo Sapiens
PTPMALLVQ

SEQ ID NO: 708158 - protein, 9 aa, Homo Sapiens
APWGIPFAS

SEQ ID NO: 708159 - protein, 9 aa, Homo Sapiens
RFVTLYTEN

SEQ ID NO: 708160 - protein, 9 aa, Homo Sapiens
LLLDMGSDT

SEQ ID NO: 708161 - protein, 9 aa, Homo Sapiens
FVGSLIGIA

SEQ ID NO: 708162 - protein, 9 aa, Homo Sapiens
CETRDRYGG

SEQ ID NO: 708163 - protein, 9 aa, Homo Sapiens
TNLSHPFAF

SEQ ID NO: 708164 - protein, 9 aa, Homo Sapiens
MQLAREDQR

SEQ ID NO: 708165 - protein, 9 aa, Homo Sapiens
YRDAMLENY

SEQ ID NO: 708166 - protein, 9 aa, Homo Sapiens
AFDADVNGA

SEQ ID NO: 708167 - protein, 9 aa, Homo Sapiens
QTSATKDLS

SEQ ID NO: 708168 - protein, 9 aa, Homo Sapiens
QLRYLQTLR

SEQ ID NO: 708169 - protein, 9 aa, Homo Sapiens
RKHSDSDLI

SEQ ID NO: 708170 - protein, 9 aa, Homo Sapiens
VGEQGTKEC

SEQ ID NO: 708171 - protein, 9 aa, Homo Sapiens
NITIIVTDL

SEQ ID NO: 708172 - protein, 9 aa, Homo Sapiens
MRLSRTFSQ

SEQ ID NO: 708173 - protein, 9 aa, Homo Sapiens
LSLVIADHS

SEQ ID NO: 708174 - protein, 9 aa, Homo Sapiens
FDADVNGAI

SEQ ID NO: 708175 - protein, 9 aa, Homo Sapiens
PAPIPNNYP

SEQ ID NO: 708176 - protein, 9 aa, Homo Sapiens
CYFAHRRAW

SEQ ID NO: 708177 - protein, 9 aa, Homo Sapiens
EQGTKECYG

SEQ ID NO: 708178 - protein, 9 aa, Homo Sapiens
DYEFKYKPG

SEQ ID NO: 708179 - protein, 9 aa, Homo Sapiens
PLDRSVFWI

SEQ ID NO: 708180 - protein, 9 aa, Homo Sapiens
SMNLQMTAL

SEQ ID NO: 708181 - protein, 9 aa, Homo Sapiens
DLSASLAAE

SEQ ID NO: 708182 - protein, 9 aa, Homo Sapiens
QEVCGAYLS

SEQ ID NO: 708183 - protein, 9 aa, Homo Sapiens
MKNMDPLKD

SEQ ID NO: 708184 - protein, 9 aa, Homo Sapiens
LPMMMQMVV

SEQ ID NO: 708185 - protein, 9 aa, Homo Sapiens
GGDWFTSHT

SEQ ID NO: 708186 - protein, 9 aa, Homo Sapiens
RQKTHSGAK

SEQ ID NO: 708187 - protein, 9 aa, Homo Sapiens
RSVFWIEFV

SEQ ID NO: 708188 - protein, 9 aa, Homo Sapiens
CGDVSLPEI

SEQ ID NO: 708189 - protein, 9 aa, Homo Sapiens
VRFRTGQCN

SEQ ID NO: 708190 - protein, 9 aa, Homo Sapiens
KACSRVNVC

SEQ ID NO: 708191 - protein, 9 aa, Homo Sapiens
VSMFQEDEK

SEQ ID NO: 708192 - protein, 9 aa, Homo Sapiens
ARDTLPQSQ

SEQ ID NO: 708193 - protein, 9 aa, Homo Sapiens
WHHDGKPLE

SEQ ID NO: 708194 - protein, 9 aa, Homo Sapiens
PHAKACSRV

SEQ ID NO: 708195 - protein, 9 aa, Homo Sapiens
MVLSEKVII

SEQ ID NO: 708196 - protein, 9 aa, Homo Sapiens
EEDEQDGEE

SEQ ID NO: 708197 - protein, 9 aa, Homo Sapiens
YLAESHQHL

SEQ ID NO: 708198 - protein, 9 aa, Homo Sapiens
EDIFQQLDE

SEQ ID NO: 708199 - protein, 9 aa, Homo Sapiens
HVHVCSSKM

SEQ ID NO: 708200 - protein, 9 aa, Homo Sapiens
ASMETREKL

SEQ ID NO: 708201 - protein, 9 aa, Homo Sapiens
KGRQSIWNP

SEQ ID NO: 708202 - protein, 9 aa, Homo Sapiens
HFPFLDISD

SEQ ID NO: 708203 - protein, 9 aa, Homo Sapiens
GMVKAVRLI

SEQ ID NO: 708204 - protein, 9 aa, Homo Sapiens
HVEAQDLCG

SEQ ID NO: 708205 - protein, 9 aa, Homo Sapiens
PINVCSQLD

SEQ ID NO: 708206 - protein, 9 aa, Homo Sapiens
TTQLALWRP

SEQ ID NO: 708207 - protein, 9 aa, Homo Sapiens
EMQLAREDQ

SEQ ID NO: 708208 - protein, 9 aa, Homo Sapiens
EHLRSFRSG

SEQ ID NO: 708209 - protein, 9 aa, Homo Sapiens
QRTPWSTRE

SEQ ID NO: 708210 - protein, 9 aa, Homo Sapiens
RDKPFVEPV

SEQ ID NO: 708211 - protein, 9 aa, Homo Sapiens
DADVNGAIH

SEQ ID NO: 708212 - protein, 9 aa, Homo Sapiens
VHGESHTEQ

SEQ ID NO: 708213 - protein, 9 aa, Homo Sapiens
VLWLPMMMQ

SEQ ID NO: 708214 - protein, 9 aa, Homo Sapiens
QRVHITGDY

SEQ ID NO: 708215 - protein, 9 aa, Homo Sapiens
QAPSGLAGP

SEQ ID NO: 708216 - protein, 9 aa, Homo Sapiens
DPTMVVEWH

SEQ ID NO: 708217 - protein, 9 aa, Homo Sapiens
RRPVHGESH

SEQ ID NO: 708218 - protein, 9 aa, Homo Sapiens
DVVQLVYRK

SEQ ID NO: 708219 - protein, 9 aa, Homo Sapiens
LNVLHHLIH

SEQ ID NO: 708220 - protein, 9 aa, Homo Sapiens
GLALQADEE

SEQ ID NO: 708221 - protein, 9 aa, Homo Sapiens
KRKGRQSIW

SEQ ID NO: 708222 - protein, 9 aa, Homo Sapiens
GPSDDDKGT

SEQ ID NO: 708223 - protein, 9 aa, Homo Sapiens
EEETEEALD

SEQ ID NO: 708224 - protein, 9 aa, Homo Sapiens
IQWINEKEP

SEQ ID NO: 708225 - protein, 9 aa, Homo Sapiens
RLMISDSLI

SEQ ID NO: 708226 - protein, 9 aa, Homo Sapiens
NSATSKTIA

SEQ ID NO: 708227 - protein, 9 aa, Homo Sapiens
SDNDIPLHL

SEQ ID NO: 708228 - protein, 9 aa, Homo Sapiens
DCDLYFTQG

SEQ ID NO: 708229 - protein, 9 aa, Homo Sapiens
LDPEPQIQW

SEQ ID NO: 708230 - protein, 9 aa, Homo Sapiens
PQKQQLSSP

SEQ ID NO: 708231 - protein, 9 aa, Homo Sapiens
HGESHTEQL

SEQ ID NO: 708232 - protein, 9 aa, Homo Sapiens
PFVEPVEEY

SEQ ID NO: 708233 - protein, 9 aa, Homo Sapiens
VAGMGQDCI

SEQ ID NO: 708234 - protein, 9 aa, Homo Sapiens
MDGPEVMIK

SEQ ID NO: 708235 - protein, 9 aa, Homo Sapiens
ESAEEFFML

SEQ ID NO: 708236 - protein, 9 aa, Homo Sapiens
LPWQLSLWR

SEQ ID NO: 708237 - protein, 9 aa, Homo Sapiens
LLGHFPGPE

SEQ ID NO: 708238 - protein, 9 aa, Homo Sapiens
DAYSHLQGL

SEQ ID NO: 708239 - protein, 9 aa, Homo Sapiens
CSLSCLNLP

SEQ ID NO: 708240 - protein, 9 aa, Homo Sapiens
IFMAALPMS

SEQ ID NO: 708241 - protein, 9 aa, Homo Sapiens
GEIQECTVN

SEQ ID NO: 708242 - protein, 9 aa, Homo Sapiens
GSLIGIAGI

SEQ ID NO: 708243 - protein, 9 aa, Homo Sapiens
KANTKTRRS

SEQ ID NO: 708244 - protein, 9 aa, Homo Sapiens
GDWFTSHTS

SEQ ID NO: 708245 - protein, 9 aa, Homo Sapiens
YIDLIPTSM

SEQ ID NO: 708246 - protein, 9 aa, Homo Sapiens
VDSLKDKAQ

SEQ ID NO: 708247 - protein, 9 aa, Homo Sapiens
EIVTNIQIG

SEQ ID NO: 708248 - protein, 9 aa, Homo Sapiens
SSGIYSESL

SEQ ID NO: 708249 - protein, 9 aa, Homo Sapiens
VASTRVSLP

SEQ ID NO: 708250 - protein, 9 aa, Homo Sapiens
VLQRWLQKT

SEQ ID NO: 708251 - protein, 9 aa, Homo Sapiens
GTVKEMQLA

SEQ ID NO: 708252 - protein, 9 aa, Homo Sapiens
IWNPQHLLI

SEQ ID NO: 708253 - protein, 9 aa, Homo Sapiens
KIADPICKF

SEQ ID NO: 708254 - protein, 9 aa, Homo Sapiens
VDCWPLPFP

SEQ ID NO: 708255 - protein, 9 aa, Homo Sapiens
KALQERFKD

SEQ ID NO: 708256 - protein, 9 aa, Homo Sapiens
EEVLIQPLN

SEQ ID NO: 708257 - protein, 9 aa, Homo Sapiens
PCRLDDCLM

SEQ ID NO: 708258 - protein, 9 aa, Homo Sapiens
DSTARAWYL

SEQ ID NO: 708259 - protein, 9 aa, Homo Sapiens
ISHNHLYMM

SEQ ID NO: 708260 - protein, 9 aa, Homo Sapiens
AKDVSFHKE

SEQ ID NO: 708261 - protein, 9 aa, Homo Sapiens
LTPTTPEKP

SEQ ID NO: 708262 - protein, 9 aa, Homo Sapiens
ILKISPRAM

SEQ ID NO: 708263 - protein, 9 aa, Homo Sapiens
NLPLNPKET

SEQ ID NO: 708264 - protein, 9 aa, Homo Sapiens
LCQLHHMEK

SEQ ID NO: 708265 - protein, 9 aa, Homo Sapiens
GGHPLKKRR

SEQ ID NO: 708266 - protein, 9 aa, Homo Sapiens
QASGSGSCS

SEQ ID NO: 708267 - protein, 9 aa, Homo Sapiens
RDTLPQSQS

SEQ ID NO: 708268 - protein, 9 aa, Homo Sapiens
AFFGLITEI

SEQ ID NO: 708269 - protein, 9 aa, Homo Sapiens
HKFQGHCYC

SEQ ID NO: 708270 - protein, 9 aa, Homo Sapiens
QLAREDQRF

SEQ ID NO: 708271 - protein, 9 aa, Homo Sapiens
GALADNLLM

SEQ ID NO: 708272 - protein, 9 aa, Homo Sapiens
TTPPQVYST

SEQ ID NO: 708273 - protein, 9 aa, Homo Sapiens
QVEVVTAYV

SEQ ID NO: 708274 - protein, 9 aa, Homo Sapiens
ERAHVHVCS

SEQ ID NO: 708275 - protein, 9 aa, Homo Sapiens
GSDCDLYFT

SEQ ID NO: 708276 - protein, 9 aa, Homo Sapiens
AQHVLSMDY

SEQ ID NO: 708277 - protein, 9 aa, Homo Sapiens
ESCPSLQSC

SEQ ID NO: 708278 - protein, 9 aa, Homo Sapiens
HAVLESRGS

SEQ ID NO: 708279 - protein, 9 aa, Homo Sapiens
FEVFGEIQE

SEQ ID NO: 708280 - protein, 9 aa, Homo Sapiens
VHGRGSESK

SEQ ID NO: 708281 - protein, 9 aa, Homo Sapiens
GKLYVNVKM

SEQ ID NO: 708282 - protein, 9 aa, Homo Sapiens
PNSATSKTI

SEQ ID NO: 708283 - protein, 9 aa, Homo Sapiens
ETAIVTSIG

SEQ ID NO: 708284 - protein, 9 aa, Homo Sapiens
ESAPLMGKH

SEQ ID NO: 708285 - protein, 9 aa, Homo Sapiens
PPLGPLDPL

SEQ ID NO: 708286 - protein, 9 aa, Homo Sapiens
LDESKARME

SEQ ID NO: 708287 - protein, 9 aa, Homo Sapiens
PYQCETRDR

SEQ ID NO: 708288 - protein, 9 aa, Homo Sapiens
SPRFLACPF

SEQ ID NO: 708289 - protein, 9 aa, Homo Sapiens
WFTSHTSAC

SEQ ID NO: 708290 - protein, 9 aa, Homo Sapiens
MPHPRWYHS

SEQ ID NO: 708291 - protein, 9 aa, Homo Sapiens
KHKKEKLNV

SEQ ID NO: 708292 - protein, 9 aa, Homo Sapiens
ESKPCGELK

SEQ ID NO: 708293 - protein, 9 aa, Homo Sapiens
NTVALSHPL

SEQ ID NO: 708294 - protein, 9 aa, Homo Sapiens
LLPWQLTLW

SEQ ID NO: 708295 - protein, 9 aa, Homo Sapiens
PARVKTLRE

SEQ ID NO: 708296 - protein, 9 aa, Homo Sapiens
MFIPRSLSR

SEQ ID NO: 708297 - protein, 9 aa, Homo Sapiens
EQDGEEEKE

SEQ ID NO: 708298 - protein, 9 aa, Homo Sapiens
FTDIRCILP

SEQ ID NO: 708299 - protein, 9 aa, Homo Sapiens
RPPARVKTL

SEQ ID NO: 708300 - protein, 9 aa, Homo Sapiens
APSGLAGPV

SEQ ID NO: 708301 - protein, 9 aa, Homo Sapiens
IRMDRGGMV

SEQ ID NO: 708302 - protein, 9 aa, Homo Sapiens
EEDTLSLVI

SEQ ID NO: 708303 - protein, 9 aa, Homo Sapiens
IYSRRDKPF

SEQ ID NO: 708304 - protein, 9 aa, Homo Sapiens
VPEEIVPEK

SEQ ID NO: 708305 - protein, 9 aa, Homo Sapiens
TLCYRKYNN

SEQ ID NO: 708306 - protein, 9 aa, Homo Sapiens
KNSLITHHQ

SEQ ID NO: 708307 - protein, 9 aa, Homo Sapiens
IGLLILKEE

SEQ ID NO: 708308 - protein, 9 aa, Homo Sapiens
PVEPLSPRF

SEQ ID NO: 708309 - protein, 9 aa, Homo Sapiens
TRGEDWDRF

SEQ ID NO: 708310 - protein, 9 aa, Homo Sapiens
RTEYRWSQW

SEQ ID NO: 708311 - protein, 9 aa, Homo Sapiens
GSPGAATAA

SEQ ID NO: 708312 - protein, 9 aa, Homo Sapiens
GMGQDCIVQ

SEQ ID NO: 708313 - protein, 9 aa, Homo Sapiens
WYLLWKNVR

SEQ ID NO: 708314 - protein, 9 aa, Homo Sapiens
ATNRYKLFT

SEQ ID NO: 708315 - protein, 9 aa, Homo Sapiens
LGPGWSSST

SEQ ID NO: 708316 - protein, 9 aa, Homo Sapiens
YNSPTFCQT

SEQ ID NO: 708317 - protein, 9 aa, Homo Sapiens
QIGFIESGK

SEQ ID NO: 708318 - protein, 9 aa, Homo Sapiens
GEVTVPGVC

SEQ ID NO: 708319 - protein, 9 aa, Homo Sapiens
PEAFLEDIF

SEQ ID NO: 708320 - protein, 9 aa, Homo Sapiens
DRGETGALG

SEQ ID NO: 708321 - protein, 9 aa, Homo Sapiens
IERAHVHVC

SEQ ID NO: 708322 - protein, 9 aa, Homo Sapiens
SAPWGIPFA

SEQ ID NO: 708323 - protein, 9 aa, Homo Sapiens
LSMDYRVAR

SEQ ID NO: 708324 - protein, 9 aa, Homo Sapiens
AVASQGRVI

SEQ ID NO: 708325 - protein, 9 aa, Homo Sapiens
MGSDTIKIK

SEQ ID NO: 708326 - protein, 9 aa, Homo Sapiens
YGSSTPHHC

SEQ ID NO: 708327 - protein, 9 aa, Homo Sapiens
IQEQMLGGK

SEQ ID NO: 708328 - protein, 9 aa, Homo Sapiens
LFSEKILQV

SEQ ID NO: 708329 - protein, 9 aa, Homo Sapiens
LFTRGEDWD

SEQ ID NO: 708330 - protein, 9 aa, Homo Sapiens
LLALNPIKR

SEQ ID NO: 708331 - protein, 9 aa, Homo Sapiens
GLLGLCYLN

SEQ ID NO: 708332 - protein, 9 aa, Homo Sapiens
SGIAYVALL

SEQ ID NO: 708333 - protein, 9 aa, Homo Sapiens
EIEPCLEGE

SEQ ID NO: 708334 - protein, 9 aa, Homo Sapiens
RVYVVAPST

SEQ ID NO: 708335 - protein, 9 aa, Homo Sapiens
EEQDLELAS

SEQ ID NO: 708336 - protein, 9 aa, Homo Sapiens
IALVVGVFL

SEQ ID NO: 708337 - protein, 9 aa, Homo Sapiens
RLHLPLSPG

SEQ ID NO: 708338 - protein, 9 aa, Homo Sapiens
AQAKFRQIV

SEQ ID NO: 708339 - protein, 9 aa, Homo Sapiens
LCLYLAERW

SEQ ID NO: 708340 - protein, 9 aa, Homo Sapiens
RAVVTRWLC

SEQ ID NO: 708341 - protein, 9 aa, Homo Sapiens
SIWNPQHLL

SEQ ID NO: 708342 - protein, 9 aa, Homo Sapiens
EAMRAMIDE

SEQ ID NO: 708343 - protein, 9 aa, Homo Sapiens
TEAIQWINE

SEQ ID NO: 708344 - protein, 9 aa, Homo Sapiens
MQMVVQNVV

SEQ ID NO: 708345 - protein, 9 aa, Homo Sapiens
TTPSLAGPT

SEQ ID NO: 708346 - protein, 9 aa, Homo Sapiens
VNLLLKKGA

SEQ ID NO: 708347 - protein, 9 aa, Homo Sapiens
VLSMDYRVA

SEQ ID NO: 708348 - protein, 9 aa, Homo Sapiens
REESRINLP

SEQ ID NO: 708349 - protein, 9 aa, Homo Sapiens
SEHFPFLDI

SEQ ID NO: 708350 - protein, 9 aa, Homo Sapiens
LCLHPMDTV

SEQ ID NO: 708351 - protein, 9 aa, Homo Sapiens
KDSSLPSHI

SEQ ID NO: 708352 - protein, 9 aa, Homo Sapiens
SLAGPTENR

SEQ ID NO: 708353 - protein, 9 aa, Homo Sapiens
FANGGVEMP

SEQ ID NO: 708354 - protein, 9 aa, Homo Sapiens
PCGSRICGS

SEQ ID NO: 708355 - protein, 9 aa, Homo Sapiens
NPTTPEAAE

SEQ ID NO: 708356 - protein, 9 aa, Homo Sapiens
VYRRAIEIV

SEQ ID NO: 708357 - protein, 9 aa, Homo Sapiens
KAQKLYTIM

SEQ ID NO: 708358 - protein, 9 aa, Homo Sapiens
PMDTVPTPA

SEQ ID NO: 708359 - protein, 9 aa, Homo Sapiens
GHLYAVGGL

SEQ ID NO: 708360 - protein, 9 aa, Homo Sapiens
HKKRCQGRM

SEQ ID NO: 708361 - protein, 9 aa, Homo Sapiens
IHTAEKPWK

SEQ ID NO: 708362 - protein, 9 aa, Homo Sapiens
LVTVKLKWW

SEQ ID NO: 708363 - protein, 9 aa, Homo Sapiens
AQKLYTIMN

SEQ ID NO: 708364 - protein, 9 aa, Homo Sapiens
KTAENFRAV

SEQ ID NO: 708365 - protein, 9 aa, Homo Sapiens
MQNGGLSTP

SEQ ID NO: 708366 - protein, 9 aa, Homo Sapiens
QLGQEEVLI

SEQ ID NO: 708367 - protein, 9 aa, Homo Sapiens
HQIWTPLTL

SEQ ID NO: 708368 - protein, 9 aa, Homo Sapiens
GLRFVTLYT

SEQ ID NO: 708369 - protein, 9 aa, Homo Sapiens
VNVKMGCEK

SEQ ID NO: 708370 - protein, 9 aa, Homo Sapiens
VEYLAESHQ

SEQ ID NO: 708371 - protein, 9 aa, Homo Sapiens
TTHLLVHYV

SEQ ID NO: 708372 - protein, 9 aa, Homo Sapiens
LGAPGAPGP

SEQ ID NO: 708373 - protein, 9 aa, Homo Sapiens
TPEKLTPTT

SEQ ID NO: 708374 - protein, 9 aa, Homo Sapiens
TQKDHPRRW

SEQ ID NO: 708375 - protein, 9 aa, Homo Sapiens
VWFRLYGVH

SEQ ID NO: 708376 - protein, 9 aa, Homo Sapiens
PGWSSSTKL

SEQ ID NO: 708377 - protein, 9 aa, Homo Sapiens
GQEEVLIQP

SEQ ID NO: 708378 - protein, 9 aa, Homo Sapiens
KFTECGKAF

SEQ ID NO: 708379 - protein, 9 aa, Homo Sapiens
SHQSHLYGL

SEQ ID NO: 708380 - protein, 9 aa, Homo Sapiens
TEYRWSQWT

SEQ ID NO: 708381 - protein, 9 aa, Homo Sapiens
KRCPKFKVY

SEQ ID NO: 708382 - protein, 9 aa, Homo Sapiens
GHPLKKRRG

SEQ ID NO: 708383 - protein, 9 aa, Homo Sapiens
EAFLEDIFT

SEQ ID NO: 708384 - protein, 9 aa, Homo Sapiens
LPSRPVKQV

SEQ ID NO: 708385 - protein, 9 aa, Homo Sapiens
YLQTLRTVA

SEQ ID NO: 708386 - protein, 9 aa, Homo Sapiens
TSMKSETRH

SEQ ID NO: 708387 - protein, 9 aa, Homo Sapiens
KMLSEICHR

SEQ ID NO: 708388 - protein, 9 aa, Homo Sapiens
HPLKKRRGS

SEQ ID NO: 708389 - protein, 9 aa, Homo Sapiens
GRMKEKEAQ

SEQ ID NO: 708390 - protein, 9 aa, Homo Sapiens
MTALFSEKI

SEQ ID NO: 708391 - protein, 9 aa, Homo Sapiens
VPSDGTDAK

SEQ ID NO: 708392 - protein, 9 aa, Homo Sapiens
MANAGPKTN

SEQ ID NO: 708393 - protein, 9 aa, Homo Sapiens
ELEKTQEPN

SEQ ID NO: 708394 - protein, 9 aa, Homo Sapiens
GGKCRKECL

SEQ ID NO: 708395 - protein, 9 aa, Homo Sapiens
GRNATVGNA

SEQ ID NO: 708396 - protein, 9 aa, Homo Sapiens
DICCRNLDI

SEQ ID NO: 708397 - protein, 9 aa, Homo Sapiens
CFPSFQSLQ

SEQ ID NO: 708398 - protein, 9 aa, Homo Sapiens
QIPMPFSSC

SEQ ID NO: 708399 - protein, 9 aa, Homo Sapiens
PQLALVLRV

SEQ ID NO: 708400 - protein, 9 aa, Homo Sapiens
PLPPPLALT

SEQ ID NO: 708401 - protein, 9 aa, Homo Sapiens
DKAQKLYTI

SEQ ID NO: 708402 - protein, 9 aa, Homo Sapiens
LGKLYVNVK

SEQ ID NO: 708403 - protein, 9 aa, Homo Sapiens
SGIYSESLL

SEQ ID NO: 708404 - protein, 9 aa, Homo Sapiens
SIKNRPKIQ

SEQ ID NO: 708405 - protein, 9 aa, Homo Sapiens
IKAIREVAM

SEQ ID NO: 708406 - protein, 9 aa, Homo Sapiens
SAQMQNGGL

SEQ ID NO: 708407 - protein, 9 aa, Homo Sapiens
LNSVWGREE

SEQ ID NO: 708408 - protein, 9 aa, Homo Sapiens
PTFCQTIVE

SEQ ID NO: 708409 - protein, 9 aa, Homo Sapiens
EFYTAFSNS

SEQ ID NO: 708410 - protein, 9 aa, Homo Sapiens
KPFVEPVEE

SEQ ID NO: 708411 - protein, 9 aa, Homo Sapiens
ILPKLSPGK

SEQ ID NO: 708412 - protein, 9 aa, Homo Sapiens
PSHILEVID

SEQ ID NO: 708413 - protein, 9 aa, Homo Sapiens
HITGDYASG

SEQ ID NO: 708414 - protein, 9 aa, Homo Sapiens
HQYLRLRDK

SEQ ID NO: 708415 - protein, 9 aa, Homo Sapiens
TGEKPHIFE

SEQ ID NO: 708416 - protein, 9 aa, Homo Sapiens
FLVCFGPYK

SEQ ID NO: 708417 - protein, 9 aa, Homo Sapiens
KNKADNPLS

SEQ ID NO: 708418 - protein, 9 aa, Homo Sapiens
LIGISEMFA

SEQ ID NO: 708419 - protein, 9 aa, Homo Sapiens
TPTTPEKLT

SEQ ID NO: 708420 - protein, 9 aa, Homo Sapiens
TRDDRRESI

SEQ ID NO: 708421 - protein, 9 aa, Homo Sapiens
STLTLLHDR

SEQ ID NO: 708422 - protein, 9 aa, Homo Sapiens
GHLDFFANG

SEQ ID NO: 708423 - protein, 9 aa, Homo Sapiens
ERLWVQESD

SEQ ID NO: 708424 - protein, 9 aa, Homo Sapiens
EICHRFLSK

SEQ ID NO: 708425 - protein, 9 aa, Homo Sapiens
LGSSVELEE

SEQ ID NO: 708426 - protein, 9 aa, Homo Sapiens
LNTVALSHP

SEQ ID NO: 708427 - protein, 9 aa, Homo Sapiens
CISHNHLYM

SEQ ID NO: 708428 - protein, 9 aa, Homo Sapiens
SRHHKKRCQ

SEQ ID NO: 708429 - protein, 9 aa, Homo Sapiens
NMDPLKDNI

SEQ ID NO: 708430 - protein, 9 aa, Homo Sapiens
KGIVIPLQY

SEQ ID NO: 708431 - protein, 9 aa, Homo Sapiens
DRSVFWIEF

SEQ ID NO: 708432 - protein, 9 aa, Homo Sapiens
PFPDVECEF

SEQ ID NO: 708433 - protein, 9 aa, Homo Sapiens
AELELEKTQ

SEQ ID NO: 708434 - protein, 9 aa, Homo Sapiens
SRSRRKKKV

SEQ ID NO: 708435 - protein, 9 aa, Homo Sapiens
VLAGPRCAD

SEQ ID NO: 708436 - protein, 9 aa, Homo Sapiens
GLLGHFPGP

SEQ ID NO: 708437 - protein, 9 aa, Homo Sapiens
NSSGIYSES

SEQ ID NO: 708438 - protein, 9 aa, Homo Sapiens
LEFYTAFSN

SEQ ID NO: 708439 - protein, 9 aa, Homo Sapiens
LPPPLALTL

SEQ ID NO: 708440 - protein, 9 aa, Homo Sapiens
CTNENSLLK

SEQ ID NO: 708441 - protein, 9 aa, Homo Sapiens
RRNHAVLES

SEQ ID NO: 708442 - protein, 9 aa, Homo Sapiens
ECTMRKAAY

SEQ ID NO: 708443 - protein, 9 aa, Homo Sapiens
LFGLFGAVA

SEQ ID NO: 708444 - protein, 9 aa, Homo Sapiens
DAKAALVTG

SEQ ID NO: 708445 - protein, 9 aa, Homo Sapiens
RQKFPFVPV

SEQ ID NO: 708446 - protein, 9 aa, Homo Sapiens
KDHPRRWKL

SEQ ID NO: 708447 - protein, 9 aa, Homo Sapiens
RNATVGNAH

SEQ ID NO: 708448 - protein, 9 aa, Homo Sapiens
LGQEEVLIQ

SEQ ID NO: 708449 - protein, 9 aa, Homo Sapiens
TIHTGEKPL

SEQ ID NO: 708450 - protein, 9 aa, Homo Sapiens
EPQIVHITF

SEQ ID NO: 708451 - protein, 9 aa, Homo Sapiens
SLPSHILEV

SEQ ID NO: 708452 - protein, 9 aa, Homo Sapiens
IFQQLDESK

SEQ ID NO: 708453 - protein, 9 aa, Homo Sapiens
LHLAIKHSR

SEQ ID NO: 708454 - protein, 9 aa, Homo Sapiens
ADPICKFIF

SEQ ID NO: 708455 - protein, 9 aa, Homo Sapiens
AWHGGQGTD

SEQ ID NO: 708456 - protein, 9 aa, Homo Sapiens
SALKLCLYL

SEQ ID NO: 708457 - protein, 9 aa, Homo Sapiens
AHVHVCSSK

SEQ ID NO: 708458 - protein, 9 aa, Homo Sapiens
SLFLSKAVA

SEQ ID NO: 708459 - protein, 9 aa, Homo Sapiens
TMVVEWHHD

SEQ ID NO: 708460 - protein, 9 aa, Homo Sapiens
SLKDKAQKL

SEQ ID NO: 708461 - protein, 9 aa, Homo Sapiens
SRTFSQAQR

SEQ ID NO: 708462 - protein, 9 aa, Homo Sapiens
GTSSFRSFT

SEQ ID NO: 708463 - protein, 9 aa, Homo Sapiens
ILNRLYLHE

SEQ ID NO: 708464 - protein, 9 aa, Homo Sapiens
WYHSSERGS

SEQ ID NO: 708465 - protein, 9 aa, Homo Sapiens
EAIYDICCR

SEQ ID NO: 708466 - protein, 9 aa, Homo Sapiens
EVLIQPLNN

SEQ ID NO: 708467 - protein, 9 aa, Homo Sapiens
AMIDEFRPR

SEQ ID NO: 708468 - protein, 9 aa, Homo Sapiens
QMRLSRTFS

SEQ ID NO: 708469 - protein, 9 aa, Homo Sapiens
EMFASIAGL

SEQ ID NO: 708470 - protein, 9 aa, Homo Sapiens
LCYRKYNNV

SEQ ID NO: 708471 - protein, 9 aa, Homo Sapiens
FVPVMALTA

SEQ ID NO: 708472 - protein, 9 aa, Homo Sapiens
NFRAVSTGE

SEQ ID NO: 708473 - protein, 9 aa, Homo Sapiens
YGLARGENQ

SEQ ID NO: 708474 - protein, 9 aa, Homo Sapiens
KFKVYIERD

SEQ ID NO: 708475 - protein, 9 aa, Homo Sapiens
VVEPLPHDE

SEQ ID NO: 708476 - protein, 9 aa, Homo Sapiens
PQSQSHQEE

SEQ ID NO: 708477 - protein, 9 aa, Homo Sapiens
FLEDIFTSK

SEQ ID NO: 708478 - protein, 9 aa, Homo Sapiens
KEIVTNIQI

SEQ ID NO: 708479 - protein, 9 aa, Homo Sapiens
SKTIAVYWS

SEQ ID NO: 708480 - protein, 9 aa, Homo Sapiens
EVLVREGAE

SEQ ID NO: 708481 - protein, 9 aa, Homo Sapiens
NGGPDKGSV

SEQ ID NO: 708482 - protein, 9 aa, Homo Sapiens
TAYFSFDTR

SEQ ID NO: 708483 - protein, 9 aa, Homo Sapiens
RWLCAGSLA

SEQ ID NO: 708484 - protein, 9 aa, Homo Sapiens
TAFSNSFSR

SEQ ID NO: 708485 - protein, 9 aa, Homo Sapiens
RAVSTGEKG

SEQ ID NO: 708486 - protein, 9 aa, Homo Sapiens
KRNKALQER

SEQ ID NO: 708487 - protein, 9 aa, Homo Sapiens
FPFLDISDN

SEQ ID NO: 708488 - protein, 9 aa, Homo Sapiens
PSYGLARGE

SEQ ID NO: 708489 - protein, 9 aa, Homo Sapiens
VNLYLIIAI

SEQ ID NO: 708490 - protein, 9 aa, Homo Sapiens
MFASIAGLE

SEQ ID NO: 708491 - protein, 9 aa, Homo Sapiens
KQGWNYGIQ

SEQ ID NO: 708492 - protein, 9 aa, Homo Sapiens
LQRWLQKTI

SEQ ID NO: 708493 - protein, 9 aa, Homo Sapiens
QECTVNLRD

SEQ ID NO: 708494 - protein, 9 aa, Homo Sapiens
LSESRSRRK

SEQ ID NO: 708495 - protein, 9 aa, Homo Sapiens
SSKYWAWRG

SEQ ID NO: 708496 - protein, 9 aa, Homo Sapiens
SEICHRFLS

SEQ ID NO: 708497 - protein, 9 aa, Homo Sapiens
LALNPIKRG

SEQ ID NO: 708498 - protein, 9 aa, Homo Sapiens
FRTGQCNNP

SEQ ID NO: 708499 - protein, 9 aa, Homo Sapiens
ESHTEQLQD

SEQ ID NO: 708500 - protein, 9 aa, Homo Sapiens
LSTPPASPP

SEQ ID NO: 708501 - protein, 9 aa, Homo Sapiens
CLMSLTRFA

SEQ ID NO: 708502 - protein, 9 aa, Homo Sapiens
RQSIWNPQH

SEQ ID NO: 708503 - protein, 9 aa, Homo Sapiens
KDKAQKLYT

SEQ ID NO: 708504 - protein, 9 aa, Homo Sapiens
THIIKNPFE

SEQ ID NO: 708505 - protein, 9 aa, Homo Sapiens
FFCMLAAID

SEQ ID NO: 708506 - protein, 9 aa, Homo Sapiens
AWNFRAKVQ

SEQ ID NO: 708507 - protein, 9 aa, Homo Sapiens
ICFPSFQSL

SEQ ID NO: 708508 - protein, 9 aa, Homo Sapiens
ETHIIKNPF

SEQ ID NO: 708509 - protein, 9 aa, Homo Sapiens
ATSMKSETR

SEQ ID NO: 708510 - protein, 9 aa, Homo Sapiens
DGQCGPERL

SEQ ID NO: 708511 - protein, 9 aa, Homo Sapiens
QMQNGGLST

SEQ ID NO: 708512 - protein, 9 aa, Homo Sapiens
TTPEKLTPT

SEQ ID NO: 708513 - protein, 9 aa, Homo Sapiens
CKLGGGKCR

SEQ ID NO: 708514 - protein, 9 aa, Homo Sapiens
PICKFIFSI

SEQ ID NO: 708515 - protein, 9 aa, Homo Sapiens
QRSNSCDRS

SEQ ID NO: 708516 - protein, 9 aa, Homo Sapiens
FGMSGLRFV

SEQ ID NO: 708517 - protein, 9 aa, Homo Sapiens
DCLMSLTRF

SEQ ID NO: 708518 - protein, 9 aa, Homo Sapiens
RCVSDGQCG

SEQ ID NO: 708519 - protein, 9 aa, Homo Sapiens
RGEDWDRFT

SEQ ID NO: 708520 - protein, 9 aa, Homo Sapiens
SSCSLSCLN

SEQ ID NO: 708521 - protein, 9 aa, Homo Sapiens
VTTPLFNAL

SEQ ID NO: 708522 - protein, 9 aa, Homo Sapiens
CVDFSNMAS

SEQ ID NO: 708523 - protein, 9 aa, Homo Sapiens
IPQAPSGLA

SEQ ID NO: 708524 - protein, 9 aa, Homo Sapiens
CRFHCTEDP

SEQ ID NO: 708525 - protein, 9 aa, Homo Sapiens
MVKAVRLIA

SEQ ID NO: 708526 - protein, 9 aa, Homo Sapiens
EVMIKQPIP

SEQ ID NO: 708527 - protein, 9 aa, Homo Sapiens
LARGENQDT

SEQ ID NO: 708528 - protein, 9 aa, Homo Sapiens
TKLGKLYVN

SEQ ID NO: 708529 - protein, 9 aa, Homo Sapiens
YSESLLTTN

SEQ ID NO: 708530 - protein, 9 aa, Homo Sapiens
NEAIYDICC

SEQ ID NO: 708531 - protein, 9 aa, Homo Sapiens
NKVEIVSMF

SEQ ID NO: 708532 - protein, 9 aa, Homo Sapiens
CSEPQIVHI

SEQ ID NO: 708533 - protein, 9 aa, Homo Sapiens
RNHAVLESR

SEQ ID NO: 708534 - protein, 9 aa, Homo Sapiens
GNRKFKFTE

SEQ ID NO: 708535 - protein, 9 aa, Homo Sapiens
KAALVTGME

SEQ ID NO: 708536 - protein, 9 aa, Homo Sapiens
LVIADHSHV

SEQ ID NO: 708537 - protein, 9 aa, Homo Sapiens
HTVEKSHEC

SEQ ID NO: 708538 - protein, 9 aa, Homo Sapiens
LLIVLGNRH

SEQ ID NO: 708539 - protein, 9 aa, Homo Sapiens
GTDAKVDEA

SEQ ID NO: 708540 - protein, 9 aa, Homo Sapiens
DGAIDMVLS

SEQ ID NO: 708541 - protein, 9 aa, Homo Sapiens
NAFDADVNG

SEQ ID NO: 708542 - protein, 9 aa, Homo Sapiens
ALLIVLGNR

SEQ ID NO: 708543 - protein, 9 aa, Homo Sapiens
KFIFSILVL

SEQ ID NO: 708544 - protein, 9 aa, Homo Sapiens
EVFGEIQEC

SEQ ID NO: 708545 - protein, 9 aa, Homo Sapiens
VGTSGTTGE

SEQ ID NO: 708546 - protein, 9 aa, Homo Sapiens
AVVTRWLCA

SEQ ID NO: 708547 - protein, 9 aa, Homo Sapiens
LSSPTDASA

SEQ ID NO: 708548 - protein, 9 aa, Homo Sapiens
SADPQLALV

SEQ ID NO: 708549 - protein, 9 aa, Homo Sapiens
LVVGVFLRG

SEQ ID NO: 708550 - protein, 9 aa, Homo Sapiens
YRVNLLFGL

SEQ ID NO: 708551 - protein, 9 aa, Homo Sapiens
GVWTATAPV

SEQ ID NO: 708552 - protein, 9 aa, Homo Sapiens
HHTKELLEL

SEQ ID NO: 708553 - protein, 9 aa, Homo Sapiens
VGSLIGIAG

SEQ ID NO: 708554 - protein, 9 aa, Homo Sapiens
KRDAKAALV

SEQ ID NO: 708555 - protein, 9 aa, Homo Sapiens
PGKTTPSSH

SEQ ID NO: 708556 - protein, 9 aa, Homo Sapiens
RYLQTLRTV

SEQ ID NO: 708557 - protein, 9 aa, Homo Sapiens
EDYEFKYKP

SEQ ID NO: 708558 - protein, 9 aa, Homo Sapiens
LHHLIHPAL

SEQ ID NO: 708559 - protein, 9 aa, Homo Sapiens
ALVDVNLYL

SEQ ID NO: 708560 - protein, 9 aa, Homo Sapiens
IGKWWCEIE

SEQ ID NO: 708561 - protein, 9 aa, Homo Sapiens
TAKKLKSVR

SEQ ID NO: 708562 - protein, 9 aa, Homo Sapiens
VWLQAWVAS

SEQ ID NO: 708563 - protein, 9 aa, Homo Sapiens
QKPDKGIVI

SEQ ID NO: 708564 - protein, 9 aa, Homo Sapiens
TTPEAAENL

SEQ ID NO: 708565 - protein, 9 aa, Homo Sapiens
LPVRTPTQS

SEQ ID NO: 708566 - protein, 9 aa, Homo Sapiens
VPCEPPEVG

SEQ ID NO: 708567 - protein, 9 aa, Homo Sapiens
DRINRYQGA

SEQ ID NO: 708568 - protein, 9 aa, Homo Sapiens
LLPWQLSLW

SEQ ID NO: 708569 - protein, 9 aa, Homo Sapiens
LQERFKDIC

SEQ ID NO: 708570 - protein, 9 aa, Homo Sapiens
FEDGVTNLS

SEQ ID NO: 708571 - protein, 9 aa, Homo Sapiens
SATSKTIAV

SEQ ID NO: 708572 - protein, 9 aa, Homo Sapiens
VDPSADPQL

SEQ ID NO: 708573 - protein, 9 aa, Homo Sapiens
ERPSAPWGI

SEQ ID NO: 708574 - protein, 9 aa, Homo Sapiens
WRGFSLDSA

SEQ ID NO: 708575 - protein, 9 aa, Homo Sapiens
MIKQPIPMS

SEQ ID NO: 708576 - protein, 9 aa, Homo Sapiens
TQRQKTHSG

SEQ ID NO: 708577 - protein, 9 aa, Homo Sapiens
DLRVSKIRQ

SEQ ID NO: 708578 - protein, 9 aa, Homo Sapiens
PATVPEVPE

SEQ ID NO: 708579 - protein, 9 aa, Homo Sapiens
NHQQIHSGD

SEQ ID NO: 708580 - protein, 9 aa, Homo Sapiens
CRVYVVAPS

SEQ ID NO: 708581 - protein, 9 aa, Homo Sapiens
QGHCYCYFA

SEQ ID NO: 708582 - protein, 9 aa, Homo Sapiens
VHKEVLNSG

SEQ ID NO: 708583 - protein, 9 aa, Homo Sapiens
VHPKTFPVV

SEQ ID NO: 708584 - protein, 9 aa, Homo Sapiens
TIEYIQPNP

SEQ ID NO: 708585 - protein, 9 aa, Homo Sapiens
NVSDLCKLE

SEQ ID NO: 708586 - protein, 9 aa, Homo Sapiens
NTKEEFSGV

SEQ ID NO: 708587 - protein, 9 aa, Homo Sapiens
IGFIESGKK

SEQ ID NO: 708588 - protein, 9 aa, Homo Sapiens
IFVLDQNDN

SEQ ID NO: 708589 - protein, 9 aa, Homo Sapiens
RTLQPGMAA

SEQ ID NO: 708590 - protein, 9 aa, Homo Sapiens
TLPQSQSHQ

SEQ ID NO: 708591 - protein, 9 aa, Homo Sapiens
DGGVKLTSD

SEQ ID NO: 708592 - protein, 9 aa, Homo Sapiens
PVHGRGSES

SEQ ID NO: 708593 - protein, 9 aa, Homo Sapiens
IDMVLSEKV

SEQ ID NO: 708594 - protein, 9 aa, Homo Sapiens
GKWWCEIEP

SEQ ID NO: 708595 - protein, 9 aa, Homo Sapiens
CQLHHMEKT

SEQ ID NO: 708596 - protein, 9 aa, Homo Sapiens
LEALKACLK

SEQ ID NO: 708597 - protein, 9 aa, Homo Sapiens
RPSAPWGIP

SEQ ID NO: 708598 - protein, 9 aa, Homo Sapiens
TGALGAPGA

SEQ ID NO: 708599 - protein, 9 aa, Homo Sapiens
TPPQVYSTT

SEQ ID NO: 708600 - protein, 9 aa, Homo Sapiens
PLMGKHKIC

SEQ ID NO: 708601 - protein, 9 aa, Homo Sapiens
LNASGSDCD

SEQ ID NO: 708602 - protein, 9 aa, Homo Sapiens
AIDMVLSEK

SEQ ID NO: 708603 - protein, 9 aa, Homo Sapiens
KSFNCVKLN

SEQ ID NO: 708604 - protein, 9 aa, Homo Sapiens
VTVKLKWWG

SEQ ID NO: 708605 - protein, 9 aa, Homo Sapiens
PQMEARTLQ

SEQ ID NO: 708606 - protein, 9 aa, Homo Sapiens
SLVSDIERV

SEQ ID NO: 708607 - protein, 9 aa, Homo Sapiens
PSTTRSLEA

SEQ ID NO: 708608 - protein, 9 aa, Homo Sapiens
ISMYLFLGS

SEQ ID NO: 708609 - protein, 9 aa, Homo Sapiens
VEPLSPRFL

SEQ ID NO: 708610 - protein, 9 aa, Homo Sapiens
WNFRAKVQL

SEQ ID NO: 708611 - protein, 9 aa, Homo Sapiens
AMLENYRNL

SEQ ID NO: 708612 - protein, 9 aa, Homo Sapiens
HLDPEPQIQ

SEQ ID NO: 708613 - protein, 9 aa, Homo Sapiens
HHKKRCQGR

SEQ ID NO: 708614 - protein, 9 aa, Homo Sapiens
NLLFGLFGA

SEQ ID NO: 708615 - protein, 9 aa, Homo Sapiens
DPQLALVLR

SEQ ID NO: 708616 - protein, 9 aa, Homo Sapiens
DTLPQSQSH

SEQ ID NO: 708617 - protein, 9 aa, Homo Sapiens
APSTTRSLE

SEQ ID NO: 708618 - protein, 9 aa, Homo Sapiens
PGQTQRLDR

SEQ ID NO: 708619 - protein, 9 aa, Homo Sapiens
AYFSFDTRF

SEQ ID NO: 708620 - protein, 9 aa, Homo Sapiens
NPKETGKRD

SEQ ID NO: 708621 - protein, 9 aa, Homo Sapiens
VYRKSWKVG

SEQ ID NO: 708622 - protein, 9 aa, Homo Sapiens
LCAGSLAQE

SEQ ID NO: 708623 - protein, 9 aa, Homo Sapiens
KETGKRDGE

SEQ ID NO: 708624 - protein, 9 aa, Homo Sapiens
RKKLCQLHH

SEQ ID NO: 708625 - protein, 9 aa, Homo Sapiens
ERLLLTVGV

SEQ ID NO: 708626 - protein, 9 aa, Homo Sapiens
AGNRKFKFT

SEQ ID NO: 708627 - protein, 9 aa, Homo Sapiens
PSRPVKQVE

SEQ ID NO: 708628 - protein, 9 aa, Homo Sapiens
KHKICSSHS

SEQ ID NO: 708629 - protein, 9 aa, Homo Sapiens
KTDTAELTL

SEQ ID NO: 708630 - protein, 9 aa, Homo Sapiens
WEDYEFKYK

SEQ ID NO: 708631 - protein, 9 aa, Homo Sapiens
RRESIVAEC

SEQ ID NO: 708632 - protein, 9 aa, Homo Sapiens
LSKAVASQG

SEQ ID NO: 708633 - protein, 9 aa, Homo Sapiens
SCEGCRMHA

SEQ ID NO: 708634 - protein, 9 aa, Homo Sapiens
RGGHPLKKR

SEQ ID NO: 708635 - protein, 9 aa, Homo Sapiens
QWINEKEPV

SEQ ID NO: 708636 - protein, 9 aa, Homo Sapiens
KPPPSAKDV

SEQ ID NO: 708637 - protein, 9 aa, Homo Sapiens
GISEMFASI

SEQ ID NO: 708638 - protein, 9 aa, Homo Sapiens
QMTALFSEK

SEQ ID NO: 708639 - protein, 9 aa, Homo Sapiens
RCPKFKVYI

SEQ ID NO: 708640 - protein, 9 aa, Homo Sapiens
FPSFQSLQH

SEQ ID NO: 708641 - protein, 9 aa, Homo Sapiens
LSRTFSQAQ

SEQ ID NO: 708642 - protein, 9 aa, Homo Sapiens
LYAVGGLSA

SEQ ID NO: 708643 - protein, 9 aa, Homo Sapiens
VQHIDRSDL

SEQ ID NO: 708644 - protein, 9 aa, Homo Sapiens
GHQLTQRQK

SEQ ID NO: 708645 - protein, 9 aa, Homo Sapiens
GIYSESLLT

SEQ ID NO: 708646 - protein, 9 aa, Homo Sapiens
FECKECGKD

SEQ ID NO: 708647 - protein, 9 aa, Homo Sapiens
VMIKQPIPM

SEQ ID NO: 708648 - protein, 9 aa, Homo Sapiens
MKRVAKLVG

SEQ ID NO: 708649 - protein, 9 aa, Homo Sapiens
CESCKLGGG

SEQ ID NO: 708650 - protein, 9 aa, Homo Sapiens
LTQKDHPRR

SEQ ID NO: 708651 - protein, 9 aa, Homo Sapiens
PRPRGLLGL

SEQ ID NO: 708652 - protein, 9 aa, Homo Sapiens
STRETELLL

SEQ ID NO: 708653 - protein, 9 aa, Homo Sapiens
NKRDAKAAL

SEQ ID NO: 708654 - protein, 9 aa, Homo Sapiens
ASIKNRPKI

SEQ ID NO: 708655 - protein, 9 aa, Homo Sapiens
GPITVLRDR

SEQ ID NO: 708656 - protein, 9 aa, Homo Sapiens
VLVREGAEW

SEQ ID NO: 708657 - protein, 9 aa, Homo Sapiens
LPGLVVLAY

SEQ ID NO: 708658 - protein, 9 aa, Homo Sapiens
VTVPGVCGD

SEQ ID NO: 708659 - protein, 9 aa, Homo Sapiens
SVFWIEFVM

SEQ ID NO: 708660 - protein, 9 aa, Homo Sapiens
GAATAATLG

SEQ ID NO: 708661 - protein, 9 aa, Homo Sapiens
CTMRKAAYY

SEQ ID NO: 708662 - protein, 9 aa, Homo Sapiens
QWRLGAELQ

SEQ ID NO: 708663 - protein, 9 aa, Homo Sapiens
LQRLYYPVQ

SEQ ID NO: 708664 - protein, 9 aa, Homo Sapiens
VIALVVGVF

SEQ ID NO: 708665 - protein, 9 aa, Homo Sapiens
LSESKTFFS

SEQ ID NO: 708666 - protein, 9 aa, Homo Sapiens
VGTEIETAI

SEQ ID NO: 708667 - protein, 9 aa, Homo Sapiens
DVDTLNTVA

SEQ ID NO: 708668 - protein, 9 aa, Homo Sapiens
SSTKLQIAA

SEQ ID NO: 708669 - protein, 9 aa, Homo Sapiens
YPITVQTVY

SEQ ID NO: 708670 - protein, 9 aa, Homo Sapiens
PHPRWYHSS

SEQ ID NO: 708671 - protein, 9 aa, Homo Sapiens
LLLKKGASL

SEQ ID NO: 708672 - protein, 9 aa, Homo Sapiens
AIQWINEKE

SEQ ID NO: 708673 - protein, 9 aa, Homo Sapiens
RRDKPFVEP

SEQ ID NO: 708674 - protein, 9 aa, Homo Sapiens
SEPESEKET

SEQ ID NO: 708675 - protein, 9 aa, Homo Sapiens
NRPKIQKLV

SEQ ID NO: 708676 - protein, 9 aa, Homo Sapiens
WKDSSLPSH

SEQ ID NO: 708677 - protein, 9 aa, Homo Sapiens
QRPSSFGYK

SEQ ID NO: 708678 - protein, 9 aa, Homo Sapiens
PLKCNECGK

SEQ ID NO: 708679 - protein, 9 aa, Homo Sapiens
GGGGDRHHG

SEQ ID NO: 708680 - protein, 9 aa, Homo Sapiens
KAVRLIAEG

SEQ ID NO: 708681 - protein, 9 aa, Homo Sapiens
APGKTTPSS

SEQ ID NO: 708682 - protein, 9 aa, Homo Sapiens
EARTLQPGM

SEQ ID NO: 708683 - protein, 9 aa, Homo Sapiens
TNIQIGFIE

SEQ ID NO: 708684 - protein, 9 aa, Homo Sapiens
TFPVVLPPE

SEQ ID NO: 708685 - protein, 9 aa, Homo Sapiens
SAGPITVLR

SEQ ID NO: 708686 - protein, 9 aa, Homo Sapiens
KYPMEHCII

SEQ ID NO: 708687 - protein, 9 aa, Homo Sapiens
HQTHTGEKL

SEQ ID NO: 708688 - protein, 9 aa, Homo Sapiens
KLFTAKKLK

SEQ ID NO: 708689 - protein, 9 aa, Homo Sapiens
GGGKCRKEC

SEQ ID NO: 708690 - protein, 9 aa, Homo Sapiens
VHVRRKHSD

SEQ ID NO: 708691 - protein, 9 aa, Homo Sapiens
LEREESRIN

SEQ ID NO: 708692 - protein, 9 aa, Homo Sapiens
VAMCEEDFI

SEQ ID NO: 708693 - protein, 9 aa, Homo Sapiens
PTFAFLGFT

SEQ ID NO: 708694 - protein, 9 aa, Homo Sapiens
SFTRESLAA

SEQ ID NO: 708695 - protein, 9 aa, Homo Sapiens
LVREGAEWG

SEQ ID NO: 708696 - protein, 9 aa, Homo Sapiens
LLLTVGVSA

SEQ ID NO: 708697 - protein, 9 aa, Homo Sapiens
KLQSGIGLL

SEQ ID NO: 708698 - protein, 9 aa, Homo Sapiens
SLLTTNIVP

SEQ ID NO: 708699 - protein, 9 aa, Homo Sapiens
YLFQASQMK

SEQ ID NO: 708700 - protein, 9 aa, Homo Sapiens
MTIYDWELL

SEQ ID NO: 708701 - protein, 9 aa, Homo Sapiens
AKTDTAELT

SEQ ID NO: 708702 - protein, 9 aa, Homo Sapiens
TSLSSLSSE

SEQ ID NO: 708703 - protein, 9 aa, Homo Sapiens
ARLHLPLSP

SEQ ID NO: 708704 - protein, 9 aa, Homo Sapiens
ISALKLCLY

SEQ ID NO: 708705 - protein, 9 aa, Homo Sapiens
VLIREVRRT

SEQ ID NO: 708706 - protein, 9 aa, Homo Sapiens
GGLVSYPSM

SEQ ID NO: 708707 - protein, 9 aa, Homo Sapiens
SCPSLQSCE

SEQ ID NO: 708708 - protein, 9 aa, Homo Sapiens
PPEAPLDPL

SEQ ID NO: 708709 - protein, 9 aa, Homo Sapiens
YKPGDPSRR

SEQ ID NO: 708710 - protein, 9 aa, Homo Sapiens
TKTRRSQTQ

SEQ ID NO: 708711 - protein, 9 aa, Homo Sapiens
NMLRQKFPF

SEQ ID NO: 708712 - protein, 9 aa, Homo Sapiens
HRCWLLGLL

SEQ ID NO: 708713 - protein, 9 aa, Homo Sapiens
GLSTPPASP

SEQ ID NO: 708714 - protein, 9 aa, Homo Sapiens
KEKLNVPEK

SEQ ID NO: 708715 - protein, 9 aa, Homo Sapiens
QIVHITFVN

SEQ ID NO: 708716 - protein, 9 aa, Homo Sapiens
LESRGSGAF

SEQ ID NO: 708717 - protein, 9 aa, Homo Sapiens
QQNLYTNVM

SEQ ID NO: 708718 - protein, 9 aa, Homo Sapiens
ATVPEVPEE

SEQ ID NO: 708719 - protein, 9 aa, Homo Sapiens
QPQKQQLSS

SEQ ID NO: 708720 - protein, 9 aa, Homo Sapiens
AWYLLWKNV

SEQ ID NO: 708721 - protein, 9 aa, Homo Sapiens
LVDVNLYLI

SEQ ID NO: 708722 - protein, 9 aa, Homo Sapiens
FVAGMGQDC

SEQ ID NO: 708723 - protein, 9 aa, Homo Sapiens
ICCRNLDIE

SEQ ID NO: 708724 - protein, 9 aa, Homo Sapiens
PLEALKACL

SEQ ID NO: 708725 - protein, 9 aa, Homo Sapiens
MAKRSQRKQ

SEQ ID NO: 708726 - protein, 9 aa, Homo Sapiens
NAKTDTAEL

SEQ ID NO: 708727 - protein, 9 aa, Homo Sapiens
SGLAGPVRG

SEQ ID NO: 708728 - protein, 9 aa, Homo Sapiens
MRAMIDEFR

SEQ ID NO: 708729 - protein, 9 aa, Homo Sapiens
PGPCLARLH

SEQ ID NO: 708730 - protein, 9 aa, Homo Sapiens
WQLSEKKPI

SEQ ID NO: 708731 - protein, 9 aa, Homo Sapiens
HGHQLTQRQ

SEQ ID NO: 708732 - protein, 9 aa, Homo Sapiens
SFNCVKLNE

SEQ ID NO: 708733 - protein, 9 aa, Homo Sapiens
WTKLGKLYV

SEQ ID NO: 708734 - protein, 9 aa, Homo Sapiens
DGPEVMIKQ

SEQ ID NO: 708735 - protein, 9 aa, Homo Sapiens
HLRSFRSGD

SEQ ID NO: 708736 - protein, 9 aa, Homo Sapiens
EKLNVPEKG

SEQ ID NO: 708737 - protein, 9 aa, Homo Sapiens
KNTKEEFSG

SEQ ID NO: 708738 - protein, 9 aa, Homo Sapiens
IKNRPKIQK

SEQ ID NO: 708739 - protein, 9 aa, Homo Sapiens
VLPTPMALL

SEQ ID NO: 708740 - protein, 9 aa, Homo Sapiens
IKGMVKAVR

SEQ ID NO: 708741 - protein, 9 aa, Homo Sapiens
PTDASAASS

SEQ ID NO: 708742 - protein, 9 aa, Homo Sapiens
LFNAFDADV

SEQ ID NO: 708743 - protein, 9 aa, Homo Sapiens
TAQQNLYTN

SEQ ID NO: 708744 - protein, 9 aa, Homo Sapiens
HAKACSRVN

SEQ ID NO: 708745 - protein, 9 aa, Homo Sapiens
SMKPNKYGS

SEQ ID NO: 708746 - protein, 9 aa, Homo Sapiens
MIDEFRPRS

SEQ ID NO: 708747 - protein, 9 aa, Homo Sapiens
PSSFGYKGT

SEQ ID NO: 708748 - protein, 9 aa, Homo Sapiens
LSAGPITVL

SEQ ID NO: 708749 - protein, 9 aa, Homo Sapiens
PVGEQGTKE

SEQ ID NO: 708750 - protein, 9 aa, Homo Sapiens
TRWLCAGSL

SEQ ID NO: 708751 - protein, 9 aa, Homo Sapiens
AENLKSCLS

SEQ ID NO: 708752 - protein, 9 aa, Homo Sapiens
GEDIFQQLD

SEQ ID NO: 708753 - protein, 9 aa, Homo Sapiens
RLLQPVGTV

SEQ ID NO: 708754 - protein, 9 aa, Homo Sapiens
TSDALQHAQ

SEQ ID NO: 708755 - protein, 9 aa, Homo Sapiens
LLTQKDHPR

SEQ ID NO: 708756 - protein, 9 aa, Homo Sapiens
ANGGVEMPG

SEQ ID NO: 708757 - protein, 9 aa, Homo Sapiens
GRYGQDCAE

SEQ ID NO: 708758 - protein, 9 aa, Homo Sapiens
FLSKAVASQ

SEQ ID NO: 708759 - protein, 9 aa, Homo Sapiens
IIPGMDKGL

SEQ ID NO: 708760 - protein, 9 aa, Homo Sapiens
KKMHTVEKS

SEQ ID NO: 708761 - protein, 9 aa, Homo Sapiens
TPPCGSRIC

SEQ ID NO: 708762 - protein, 9 aa, Homo Sapiens
SQTIGLGWS

SEQ ID NO: 708763 - protein, 9 aa, Homo Sapiens
HCTEDPETV

SEQ ID NO: 708764 - protein, 9 aa, Homo Sapiens
LFTAKKLKS

SEQ ID NO: 708765 - protein, 9 aa, Homo Sapiens
LNCVHELEL

SEQ ID NO: 708766 - protein, 9 aa, Homo Sapiens
EVEYLAESH

SEQ ID NO: 708767 - protein, 9 aa, Homo Sapiens
GIGLLILKE

SEQ ID NO: 708768 - protein, 9 aa, Homo Sapiens
DWELLNCVH

SEQ ID NO: 708769 - protein, 9 aa, Homo Sapiens
SMANAGPKT

SEQ ID NO: 708770 - protein, 9 aa, Homo Sapiens
DEGGLVSYP

SEQ ID NO: 708771 - protein, 9 aa, Homo Sapiens
HTEQLQDDD

SEQ ID NO: 708772 - protein, 9 aa, Homo Sapiens
YLWTCIQEY

SEQ ID NO: 708773 - protein, 9 aa, Homo Sapiens
FKYKPGDPS

SEQ ID NO: 708774 - protein, 9 aa, Homo Sapiens
VKLKWWGLQ

SEQ ID NO: 708775 - protein, 9 aa, Homo Sapiens
GVPIPQAPS

SEQ ID NO: 708776 - protein, 9 aa, Homo Sapiens
TEIIGDCCY

SEQ ID NO: 708777 - protein, 9 aa, Homo Sapiens
LSMEPTFAF

SEQ ID NO: 708778 - protein, 9 aa, Homo Sapiens
QYLWTCIQE

SEQ ID NO: 708779 - protein, 9 aa, Homo Sapiens
SLSSLSSEH

SEQ ID NO: 708780 - protein, 9 aa, Homo Sapiens
DYQYQKPKT

SEQ ID NO: 708781 - protein, 9 aa, Homo Sapiens
LNVPEKGSG

SEQ ID NO: 708782 - protein, 9 aa, Homo Sapiens
ENLLKKLLA

SEQ ID NO: 708783 - protein, 9 aa, Homo Sapiens
RNKALQERF

SEQ ID NO: 708784 - protein, 9 aa, Homo Sapiens
PLPFPDVEC

SEQ ID NO: 708785 - protein, 9 aa, Homo Sapiens
LIKTTQQEV

SEQ ID NO: 708786 - protein, 9 aa, Homo Sapiens
LWVQESDLR

SEQ ID NO: 708787 - protein, 9 aa, Homo Sapiens
NNYPITVQT

SEQ ID NO: 708788 - protein, 9 aa, Homo Sapiens
RPVHGESHT

SEQ ID NO: 708789 - protein, 9 aa, Homo Sapiens
VEAQDLCGD

SEQ ID NO: 708790 - protein, 9 aa, Homo Sapiens
LAGPRCADP

SEQ ID NO: 708791 - protein, 9 aa, Homo Sapiens
APIPNNYPI

SEQ ID NO: 708792 - protein, 9 aa, Homo Sapiens
LIREVRRTG

SEQ ID NO: 708793 - protein, 9 aa, Homo Sapiens
LNSGIAYVA

SEQ ID NO: 708794 - protein, 9 aa, Homo Sapiens
LRNHQQIHS

SEQ ID NO: 708795 - protein, 9 aa, Homo Sapiens
KSSVAIQEQ

SEQ ID NO: 708796 - protein, 9 aa, Homo Sapiens
YWNLVSLGI

SEQ ID NO: 708797 - protein, 9 aa, Homo Sapiens
FYNSPTFCQ

SEQ ID NO: 708798 - protein, 9 aa, Homo Sapiens
QYQKPKTMI

SEQ ID NO: 708799 - protein, 9 aa, Homo Sapiens
LSIVCQIRM

SEQ ID NO: 708800 - protein, 9 aa, Homo Sapiens
KTIAVYWSM

SEQ ID NO: 708801 - protein, 9 aa, Homo Sapiens
SYECTNENS

SEQ ID NO: 708802 - protein, 9 aa, Homo Sapiens
PSCVDFSNM

SEQ ID NO: 708803 - protein, 9 aa, Homo Sapiens
IVCQIRMDR

SEQ ID NO: 708804 - protein, 9 aa, Homo Sapiens
ECPVGRYGQ

SEQ ID NO: 708805 - protein, 9 aa, Homo Sapiens
IMPGSLKME

SEQ ID NO: 708806 - protein, 9 aa, Homo Sapiens
FRAVSTGEK

SEQ ID NO: 708807 - protein, 9 aa, Homo Sapiens
SPTDASAAS

SEQ ID NO: 708808 - protein, 9 aa, Homo Sapiens
GEDWDRFTR

SEQ ID NO: 708809 - protein, 9 aa, Homo Sapiens
PTSMKRVAK

SEQ ID NO: 708810 - protein, 9 aa, Homo Sapiens
ELELEKTQE

SEQ ID NO: 708811 - protein, 9 aa, Homo Sapiens
KGTSHQSHL

SEQ ID NO: 708812 - protein, 9 aa, Homo Sapiens
EFKYKPGDP

SEQ ID NO: 708813 - protein, 9 aa, Homo Sapiens
PDKGIVIPL

SEQ ID NO: 708814 - protein, 9 aa, Homo Sapiens
GSPGPCLAR

SEQ ID NO: 708815 - protein, 9 aa, Homo Sapiens
DTDSRHHKK

SEQ ID NO: 708816 - protein, 9 aa, Homo Sapiens
VSVLAGPRC

SEQ ID NO: 708817 - protein, 9 aa, Homo Sapiens
EAQAKFRQI

SEQ ID NO: 708818 - protein, 9 aa, Homo Sapiens
ETREKLERI

SEQ ID NO: 708819 - protein, 9 aa, Homo Sapiens
KKLLALNPI

SEQ ID NO: 708820 - protein, 9 aa, Homo Sapiens
LDVYRRAIE

SEQ ID NO: 708821 - protein, 9 aa, Homo Sapiens
FTSHTSACG

SEQ ID NO: 708822 - protein, 9 aa, Homo Sapiens
HSVVVPCEP

SEQ ID NO: 708823 - protein, 9 aa, Homo Sapiens
WNFTDIRCI

SEQ ID NO: 708824 - protein, 9 aa, Homo Sapiens
ISEHLRSFR

SEQ ID NO: 708825 - protein, 9 aa, Homo Sapiens
EQVNRICGL

SEQ ID NO: 708826 - protein, 9 aa, Homo Sapiens
ESCKLGGGK

SEQ ID NO: 708827 - protein, 9 aa, Homo Sapiens
IYDWELLNC

SEQ ID NO: 708828 - protein, 9 aa, Homo Sapiens
TFAFLGFTD

SEQ ID NO: 708829 - protein, 9 aa, Homo Sapiens
SYLALGEAH

SEQ ID NO: 708830 - protein, 9 aa, Homo Sapiens
VVTRWLCAG

SEQ ID NO: 708831 - protein, 9 aa, Homo Sapiens
GGSTLTLLH

SEQ ID NO: 708832 - protein, 9 aa, Homo Sapiens
GAGNRKFKF

SEQ ID NO: 708833 - protein, 9 aa, Homo Sapiens
NHLYMMVLR

SEQ ID NO: 708834 - protein, 9 aa, Homo Sapiens
TYRKLLERE

SEQ ID NO: 708835 - protein, 9 aa, Homo Sapiens
CQEGRCFRR

SEQ ID NO: 708836 - protein, 9 aa, Homo Sapiens
SLKMEFKGN

SEQ ID NO: 708837 - protein, 9 aa, Homo Sapiens
TPEEQDLEL

SEQ ID NO: 708838 - protein, 9 aa, Homo Sapiens
LNPVLIREV

SEQ ID NO: 708839 - protein, 9 aa, Homo Sapiens
TLCQEGRCF

SEQ ID NO: 708840 - protein, 9 aa, Homo Sapiens
DVRKALDVY

SEQ ID NO: 708841 - protein, 9 aa, Homo Sapiens
SSVELEESI

SEQ ID NO: 708842 - protein, 9 aa, Homo Sapiens
GMSGLRFVT

SEQ ID NO: 708843 - protein, 9 aa, Homo Sapiens
LGNRHVLVR

SEQ ID NO: 708844 - protein, 9 aa, Homo Sapiens
NNKDVLFGN

SEQ ID NO: 708845 - protein, 9 aa, Homo Sapiens
CYRKYNNVS

SEQ ID NO: 708846 - protein, 9 aa, Homo Sapiens
FRDSQTIGL

SEQ ID NO: 708847 - protein, 9 aa, Homo Sapiens
YLLIGISEM

SEQ ID NO: 708848 - protein, 9 aa, Homo Sapiens
AQDLCGDFR

SEQ ID NO: 708849 - protein, 9 aa, Homo Sapiens
CGDFRYVTC

SEQ ID NO: 708850 - protein, 9 aa, Homo Sapiens
FKISALKLC

SEQ ID NO: 708851 - protein, 9 aa, Homo Sapiens
LQMTALFSE

SEQ ID NO: 708852 - protein, 9 aa, Homo Sapiens
KTIEYIQPN

SEQ ID NO: 708853 - protein, 9 aa, Homo Sapiens
TRDRYGGIR

SEQ ID NO: 708854 - protein, 9 aa, Homo Sapiens
RTPPCGSRI

SEQ ID NO: 708855 - protein, 9 aa, Homo Sapiens
AQRPSSFGY

SEQ ID NO: 708856 - protein, 9 aa, Homo Sapiens
WLPMMMQMV

SEQ ID NO: 708857 - protein, 9 aa, Homo Sapiens
SNSFSRNLI

SEQ ID NO: 708858 - protein, 9 aa, Homo Sapiens
LMSLTRFAA

SEQ ID NO: 708859 - protein, 9 aa, Homo Sapiens
SSSPLEALK

SEQ ID NO: 708860 - protein, 9 aa, Homo Sapiens
PNKYGSSTP

SEQ ID NO: 708861 - protein, 9 aa, Homo Sapiens
SSPIHSCFL

SEQ ID NO: 708862 - protein, 9 aa, Homo Sapiens
VKPHTAKKA

SEQ ID NO: 708863 - protein, 9 aa, Homo Sapiens
NTRVIALVV

SEQ ID NO: 708864 - protein, 9 aa, Homo Sapiens
LLVQLAMSP

SEQ ID NO: 708865 - protein, 9 aa, Homo Sapiens
YRKSWKVGD

SEQ ID NO: 708866 - protein, 9 aa, Homo Sapiens
NRLYLHENK

SEQ ID NO: 708867 - protein, 9 aa, Homo Sapiens
ETEEALDSN

SEQ ID NO: 708868 - protein, 9 aa, Homo Sapiens
SPIHSCFLV

SEQ ID NO: 708869 - protein, 9 aa, Homo Sapiens
HHDGKPLEA

SEQ ID NO: 708870 - protein, 9 aa, Homo Sapiens
LELASEGEQ

SEQ ID NO: 708871 - protein, 9 aa, Homo Sapiens
SAQRTPWST

SEQ ID NO: 708872 - protein, 9 aa, Homo Sapiens
ATVGNAHRQ

SEQ ID NO: 708873 - protein, 9 aa, Homo Sapiens
RVSKIRQVF

SEQ ID NO: 708874 - protein, 9 aa, Homo Sapiens
WQLSLWRLP

SEQ ID NO: 708875 - protein, 9 aa, Homo Sapiens
SAFQKPDKG

SEQ ID NO: 708876 - protein, 9 aa, Homo Sapiens
HVLSMDYRV

SEQ ID NO: 708877 - protein, 9 aa, Homo Sapiens
KAPLDPLLP

SEQ ID NO: 708878 - protein, 9 aa, Homo Sapiens
YFFFCMLAA

SEQ ID NO: 708879 - protein, 9 aa, Homo Sapiens
SHKKSVLSQ

SEQ ID NO: 708880 - protein, 9 aa, Homo Sapiens
ISEMFASIA

SEQ ID NO: 708881 - protein, 9 aa, Homo Sapiens
RTSLSSLSS

SEQ ID NO: 708882 - protein, 9 aa, Homo Sapiens
TGKRDGEGQ

SEQ ID NO: 708883 - protein, 9 aa, Homo Sapiens
GPDKGSVKK

SEQ ID NO: 708884 - protein, 9 aa, Homo Sapiens
REGAEWGLG

SEQ ID NO: 708885 - protein, 9 aa, Homo Sapiens
ILRAIGKVS

SEQ ID NO: 708886 - protein, 9 aa, Homo Sapiens
QKQQLSSPL

SEQ ID NO: 708887 - protein, 9 aa, Homo Sapiens
LQPVGTVAQ

SEQ ID NO: 708888 - protein, 9 aa, Homo Sapiens
ANENTTPSL

SEQ ID NO: 708889 - protein, 9 aa, Homo Sapiens
QNLYTNVML

SEQ ID NO: 708890 - protein, 9 aa, Homo Sapiens
ETGALGAPG

SEQ ID NO: 708891 - protein, 9 aa, Homo Sapiens
PMYFFFCML

SEQ ID NO: 708892 - protein, 9 aa, Homo Sapiens
MKEKEAQAK

SEQ ID NO: 708893 - protein, 9 aa, Homo Sapiens
SMKSETRHS

SEQ ID NO: 708894 - protein, 9 aa, Homo Sapiens
PMEHCIITN

SEQ ID NO: 708895 - protein, 9 aa, Homo Sapiens
TDIRCILPK

SEQ ID NO: 708896 - protein, 9 aa, Homo Sapiens
LTSDALQHA

SEQ ID NO: 708897 - protein, 9 aa, Homo Sapiens
KKPINVCSQ

SEQ ID NO: 708898 - protein, 9 aa, Homo Sapiens
DIPLHLAIK

SEQ ID NO: 708899 - protein, 9 aa, Homo Sapiens
VSTGEKGFR

SEQ ID NO: 708900 - protein, 9 aa, Homo Sapiens
VHYVALEDA

SEQ ID NO: 708901 - protein, 9 aa, Homo Sapiens
AEVEYLAES

SEQ ID NO: 708902 - protein, 9 aa, Homo Sapiens
FGLITEIIG

SEQ ID NO: 708903 - protein, 9 aa, Homo Sapiens
LVTGMELKD

SEQ ID NO: 708904 - protein, 9 aa, Homo Sapiens
YIIPGMDKG

SEQ ID NO: 708905 - protein, 9 aa, Homo Sapiens
NSCDRSSGQ

SEQ ID NO: 708906 - protein, 9 aa, Homo Sapiens
QHIDRSDLS

SEQ ID NO: 708907 - protein, 9 aa, Homo Sapiens
MDKGLQGAC

SEQ ID NO: 708908 - protein, 9 aa, Homo Sapiens
HQQIHSGDR

SEQ ID NO: 708909 - protein, 9 aa, Homo Sapiens
CPKFKVYIE

SEQ ID NO: 708910 - protein, 9 aa, Homo Sapiens
QKDLYRDAM

SEQ ID NO: 708911 - protein, 9 aa, Homo Sapiens
QLSSPLPPA

SEQ ID NO: 708912 - protein, 9 aa, Homo Sapiens
YTPSYGLAR

SEQ ID NO: 708913 - protein, 9 aa, Homo Sapiens
FHCTEDPET

SEQ ID NO: 708914 - protein, 9 aa, Homo Sapiens
SMETREKLE

SEQ ID NO: 708915 - protein, 9 aa, Homo Sapiens
ELPECTMRK

SEQ ID NO: 708916 - protein, 9 aa, Homo Sapiens
CVSDGQCGP

SEQ ID NO: 708917 - protein, 9 aa, Homo Sapiens
PKFKVYIER

SEQ ID NO: 708918 - protein, 9 aa, Homo Sapiens
NNVSDLCKL

SEQ ID NO: 708919 - protein, 9 aa, Homo Sapiens
QQLDESKAR

SEQ ID NO: 708920 - protein, 9 aa, Homo Sapiens
LELPECTMR

SEQ ID NO: 708921 - protein, 9 aa, Homo Sapiens
VQLLQRLYY

SEQ ID NO: 708922 - protein, 9 aa, Homo Sapiens
VLQNNKDVL

SEQ ID NO: 708923 - protein, 9 aa, Homo Sapiens
HKKSVLSQG

SEQ ID NO: 708924 - protein, 9 aa, Homo Sapiens
FTAKKLKSV

SEQ ID NO: 708925 - protein, 9 aa, Homo Sapiens
GQCGPERLP

SEQ ID NO: 708926 - protein, 9 aa, Homo Sapiens
TLRTVATEK

SEQ ID NO: 708927 - protein, 9 aa, Homo Sapiens
VLESRGSGA

SEQ ID NO: 708928 - protein, 9 aa, Homo Sapiens
RTAYFSFDT

SEQ ID NO: 708929 - protein, 9 aa, Homo Sapiens
QSHQEESWL

SEQ ID NO: 708930 - protein, 9 aa, Homo Sapiens
SHNHLYMMV

SEQ ID NO: 708931 - protein, 9 aa, Homo Sapiens
WAWRGFSLD

SEQ ID NO: 708932 - protein, 9 aa, Homo Sapiens
HQLTQRQKT

SEQ ID NO: 708933 - protein, 9 aa, Homo Sapiens
SPGAATAAT

SEQ ID NO: 708934 - protein, 9 aa, Homo Sapiens
DSNLYSAPT

SEQ ID NO: 708935 - protein, 9 aa, Homo Sapiens
EALKACLKG

SEQ ID NO: 708936 - protein, 9 aa, Homo Sapiens
ILEAMRAMI

SEQ ID NO: 708937 - protein, 9 aa, Homo Sapiens
TDAKVDEAQ

SEQ ID NO: 708938 - protein, 9 aa, Homo Sapiens
QPMKPLDRS

SEQ ID NO: 708939 - protein, 9 aa, Homo Sapiens
TDASAASSS

SEQ ID NO: 708940 - protein, 9 aa, Homo Sapiens
AFSNSFSRN

SEQ ID NO: 708941 - protein, 9 aa, Homo Sapiens
ETGKRDGEG

SEQ ID NO: 708942 - protein, 9 aa, Homo Sapiens
YSRRDKPFV

SEQ ID NO: 708943 - protein, 9 aa, Homo Sapiens
YKGTFPHHD

SEQ ID NO: 708944 - protein, 9 aa, Homo Sapiens
PVKQVEVVT

SEQ ID NO: 708945 - protein, 9 aa, Homo Sapiens
SSTPHHCLR

SEQ ID NO: 708946 - protein, 9 aa, Homo Sapiens
MFQEDEKFL

SEQ ID NO: 708947 - protein, 9 aa, Homo Sapiens
EPVEPLSPR

SEQ ID NO: 708948 - protein, 9 aa, Homo Sapiens
KDGSHKKSV

SEQ ID NO: 708949 - protein, 9 aa, Homo Sapiens
RKLLEREES

SEQ ID NO: 708950 - protein, 9 aa, Homo Sapiens
EALDSNLYS

SEQ ID NO: 708951 - protein, 9 aa, Homo Sapiens
NLLMVFEAV

SEQ ID NO: 708952 - protein, 9 aa, Homo Sapiens
DYRVARILG

SEQ ID NO: 708953 - protein, 9 aa, Homo Sapiens
YKHKKEKLN

SEQ ID NO: 708954 - protein, 9 aa, Homo Sapiens
VIGFLLFRN

SEQ ID NO: 708955 - protein, 9 aa, Homo Sapiens
PPQAKDTWV

SEQ ID NO: 708956 - protein, 9 aa, Homo Sapiens
HCYCYFAHR

SEQ ID NO: 708957 - protein, 9 aa, Homo Sapiens
DLSPRASPE

SEQ ID NO: 708958 - protein, 9 aa, Homo Sapiens
GFVGSLIGI

SEQ ID NO: 708959 - protein, 9 aa, Homo Sapiens
AGPKTNGSQ

SEQ ID NO: 708960 - protein, 9 aa, Homo Sapiens
IAYRVNLLF

SEQ ID NO: 708961 - protein, 9 aa, Homo Sapiens
STARAWYLL

SEQ ID NO: 708962 - protein, 9 aa, Homo Sapiens
DPHLHISMY

SEQ ID NO: 708963 - protein, 9 aa, Homo Sapiens
KYQTSATKD

SEQ ID NO: 708964 - protein, 9 aa, Homo Sapiens
IDEFRPRSK

SEQ ID NO: 708965 - protein, 9 aa, Homo Sapiens
RDSTARAWY

SEQ ID NO: 708966 - protein, 9 aa, Homo Sapiens
VHVEAQDLC

SEQ ID NO: 708967 - protein, 9 aa, Homo Sapiens
VTEAIQWIN

SEQ ID NO: 708968 - protein, 9 aa, Homo Sapiens
SVSLSSPTD

SEQ ID NO: 708969 - protein, 9 aa, Homo Sapiens
GWVDLTSVK

SEQ ID NO: 708970 - protein, 9 aa, Homo Sapiens
LRTVATEKN

SEQ ID NO: 708971 - protein, 9 aa, Homo Sapiens
PLNASGSDC

SEQ ID NO: 708972 - protein, 9 aa, Homo Sapiens
NGSPGAATA

SEQ ID NO: 708973 - protein, 9 aa, Homo Sapiens
EKPWKCEEC

SEQ ID NO: 708974 - protein, 9 aa, Homo Sapiens
QLALVLRVF

SEQ ID NO: 708975 - protein, 9 aa, Homo Sapiens
NSLITHHQT

SEQ ID NO: 708976 - protein, 9 aa, Homo Sapiens
QQQPQKQQL

SEQ ID NO: 708977 - protein, 9 aa, Homo Sapiens
HPRWYHSSE

SEQ ID NO: 708978 - protein, 9 aa, Homo Sapiens
LKDKAQKLY

SEQ ID NO: 708979 - protein, 9 aa, Homo Sapiens
DDEGGLVSY

SEQ ID NO: 708980 - protein, 9 aa, Homo Sapiens
PEGIKGMVK

SEQ ID NO: 708981 - protein, 9 aa, Homo Sapiens
SKYWAWRGF

SEQ ID NO: 708982 - protein, 9 aa, Homo Sapiens
FNGLKILNR

SEQ ID NO: 708983 - protein, 9 aa, Homo Sapiens
LRLRDKSEA

SEQ ID NO: 708984 - protein, 9 aa, Homo Sapiens
QNGGLSTPP

SEQ ID NO: 708985 - protein, 9 aa, Homo Sapiens
PKTNGSQFF

SEQ ID NO: 708986 - protein, 9 aa, Homo Sapiens
VNGAIHFED

SEQ ID NO: 708987 - protein, 9 aa, Homo Sapiens
QDLELASEG

SEQ ID NO: 708988 - protein, 9 aa, Homo Sapiens
LITEIIGDC

SEQ ID NO: 708989 - protein, 9 aa, Homo Sapiens
TSATKDLSA

SEQ ID NO: 708990 - protein, 9 aa, Homo Sapiens
MKPLDRSVF

SEQ ID NO: 708991 - protein, 9 aa, Homo Sapiens
VWQLSEKKP

SEQ ID NO: 708992 - protein, 9 aa, Homo Sapiens
QKRKGRQSI

SEQ ID NO: 708993 - protein, 9 aa, Homo Sapiens
VTRWLCAGS

SEQ ID NO: 708994 - protein, 9 aa, Homo Sapiens
LQADEEMTG

SEQ ID NO: 708995 - protein, 9 aa, Homo Sapiens
KLCLYLAER

SEQ ID NO: 708996 - protein, 9 aa, Homo Sapiens
LDMGSDTIK

SEQ ID NO: 708997 - protein, 9 aa, Homo Sapiens
KTTQQEVCG

SEQ ID NO: 708998 - protein, 9 aa, Homo Sapiens
PWKCEECGK

SEQ ID NO: 708999 - protein, 9 aa, Homo Sapiens
TKECYGTKG

SEQ ID NO: 709000 - protein, 9 aa, Homo Sapiens
LKNSLITHH

SEQ ID NO: 709001 - protein, 9 aa, Homo Sapiens
LLTVGVSAG

SEQ ID NO: 709002 - protein, 9 aa, Homo Sapiens
PEPQIQWRL

SEQ ID NO: 709003 - protein, 9 aa, Homo Sapiens
SPEEAAWCG

SEQ ID NO: 709004 - protein, 9 aa, Homo Sapiens
PQAPSGLAG

SEQ ID NO: 709005 - protein, 9 aa, Homo Sapiens
NETVCTLCQ

SEQ ID NO: 709006 - protein, 9 aa, Homo Sapiens
TPWSTRETE

SEQ ID NO: 709007 - protein, 9 aa, Homo Sapiens
RRKHSDSDL

SEQ ID NO: 709008 - protein, 9 aa, Homo Sapiens
VGVSAGRQM

SEQ ID NO: 709009 - protein, 9 aa, Homo Sapiens
GLVWLQAWV

SEQ ID NO: 709010 - protein, 9 aa, Homo Sapiens
KPWKCEECG

SEQ ID NO: 709011 - protein, 9 aa, Homo Sapiens
SKPCGELKK

SEQ ID NO: 709012 - protein, 9 aa, Homo Sapiens
AGGDWFTSH

SEQ ID NO: 709013 - protein, 9 aa, Homo Sapiens
GLVSYPSMQ

SEQ ID NO: 709014 - protein, 9 aa, Homo Sapiens
TFCQTIVEK

SEQ ID NO: 709015 - protein, 9 aa, Homo Sapiens
ARTLQPGMA

SEQ ID NO: 709016 - protein, 9 aa, Homo Sapiens
IKRCPKFKV

SEQ ID NO: 709017 - protein, 9 aa, Homo Sapiens
SLWRLPKAP

SEQ ID NO: 709018 - protein, 9 aa, Homo Sapiens
LLKKLLALN

SEQ ID NO: 709019 - protein, 9 aa, Homo Sapiens
ILFYNSPTF

SEQ ID NO: 709020 - protein, 9 aa, Homo Sapiens
QERFKDICE

SEQ ID NO: 709021 - protein, 9 aa, Homo Sapiens
CEIEPCLEG

SEQ ID NO: 709022 - protein, 9 aa, Homo Sapiens
SAVPSDGTD

SEQ ID NO: 709023 - protein, 9 aa, Homo Sapiens
MPFSSCSLS

SEQ ID NO: 709024 - protein, 9 aa, Homo Sapiens
TVPGVCGDV

SEQ ID NO: 709025 - protein, 9 aa, Homo Sapiens
AENFRAVST

SEQ ID NO: 709026 - protein, 9 aa, Homo Sapiens
KLVGVEEGF

SEQ ID NO: 709027 - protein, 9 aa, Homo Sapiens
SCDRSSGQQ

SEQ ID NO: 709028 - protein, 9 aa, Homo Sapiens
LGDGGVKLT

SEQ ID NO: 709029 - protein, 9 aa, Homo Sapiens
AASMETREK

SEQ ID NO: 709030 - protein, 9 aa, Homo Sapiens
PDKGSVKKS

SEQ ID NO: 709031 - protein, 9 aa, Homo Sapiens
WGIPFASAS

SEQ ID NO: 709032 - protein, 9 aa, Homo Sapiens
TEIETAIVT

SEQ ID NO: 709033 - protein, 9 aa, Homo Sapiens
LHHMEKTKE

SEQ ID NO: 709034 - protein, 9 aa, Homo Sapiens
ARAWYLLWK

SEQ ID NO: 709035 - protein, 9 aa, Homo Sapiens
CEPPEVGSD

SEQ ID NO: 709036 - protein, 9 aa, Homo Sapiens
QVNRICGLP

SEQ ID NO: 709037 - protein, 9 aa, Homo Sapiens
HHRCWLLGL

SEQ ID NO: 709038 - protein, 9 aa, Homo Sapiens
IREVAMCEE

SEQ ID NO: 709039 - protein, 9 aa, Homo Sapiens
DGVTNLSHP

SEQ ID NO: 709040 - protein, 9 aa, Homo Sapiens
YKPPPSAKD

SEQ ID NO: 709041 - protein, 9 aa, Homo Sapiens
HVRRKHSDS

SEQ ID NO: 709042 - protein, 9 aa, Homo Sapiens
ELASEGEQK

SEQ ID NO: 709043 - protein, 9 aa, Homo Sapiens
DIFQQLDES

SEQ ID NO: 709044 - protein, 9 aa, Homo Sapiens
ETRHSKIDK

SEQ ID NO: 709045 - protein, 9 aa, Homo Sapiens
ESKTFFSQV

SEQ ID NO: 709046 - protein, 9 aa, Homo Sapiens
IPLHLAIKH

SEQ ID NO: 709047 - protein, 9 aa, Homo Sapiens
PRFLACPFP

SEQ ID NO: 709048 - protein, 9 aa, Homo Sapiens
WRPPEAPLD

SEQ ID NO: 709049 - protein, 9 aa, Homo Sapiens
DFFANGGVE

SEQ ID NO: 709050 - protein, 9 aa, Homo Sapiens
KPHIFEECG

SEQ ID NO: 709051 - protein, 9 aa, Homo Sapiens
FPLPEPQYL

SEQ ID NO: 709052 - protein, 9 aa, Homo Sapiens
AGPRCADPQ

SEQ ID NO: 709053 - protein, 9 aa, Homo Sapiens
KEEFSGVNG

SEQ ID NO: 709054 - protein, 9 aa, Homo Sapiens
KTNGSQFFI

SEQ ID NO: 709055 - protein, 9 aa, Homo Sapiens
RCILPKLSP

SEQ ID NO: 709056 - protein, 9 aa, Homo Sapiens
NIQIGFIES

SEQ ID NO: 709057 - protein, 9 aa, Homo Sapiens
RWLQKTIKE

SEQ ID NO: 709058 - protein, 9 aa, Homo Sapiens
MLRQKFPFV

SEQ ID NO: 709059 - protein, 9 aa, Homo Sapiens
VAPSTTRSL

SEQ ID NO: 709060 - protein, 9 aa, Homo Sapiens
KNRPKIQKL

SEQ ID NO: 709061 - protein, 9 aa, Homo Sapiens
RDKSEATQV

SEQ ID NO: 709062 - protein, 9 aa, Homo Sapiens
MVFEAVEQA

SEQ ID NO: 709063 - protein, 9 aa, Homo Sapiens
LPTPMALLV

SEQ ID NO: 709064 - protein, 9 aa, Homo Sapiens
ASQGRVISF

SEQ ID NO: 709065 - protein, 9 aa, Homo Sapiens
LLMVFEAVE

SEQ ID NO: 709066 - protein, 9 aa, Homo Sapiens
TLQPGMAAV

SEQ ID NO: 709067 - protein, 9 aa, Homo Sapiens
HSDSDLIPE

SEQ ID NO: 709068 - protein, 9 aa, Homo Sapiens
SSPTDASAA

SEQ ID NO: 709069 - protein, 9 aa, Homo Sapiens
GMDKGLQGA

SEQ ID NO: 709070 - protein, 9 aa, Homo Sapiens
ELAFFGLIT

SEQ ID NO: 709071 - protein, 9 aa, Homo Sapiens
GSGSCSRLL

SEQ ID NO: 709072 - protein, 9 aa, Homo Sapiens
GGLADTAQR

SEQ ID NO: 709073 - protein, 9 aa, Homo Sapiens
GSDNDIPLH

SEQ ID NO: 709074 - protein, 9 aa, Homo Sapiens
MLSEICHRF

SEQ ID NO: 709075 - protein, 9 aa, Homo Sapiens
TVGVSAGRQ

SEQ ID NO: 709076 - protein, 9 aa, Homo Sapiens
MLGYRVHYY

SEQ ID NO: 709077 - protein, 9 aa, Homo Sapiens
PTTPEAAEN

SEQ ID NO: 709078 - protein, 9 aa, Homo Sapiens
LSEICHRFL

SEQ ID NO: 709079 - protein, 9 aa, Homo Sapiens
VLNPVLIRE

SEQ ID NO: 709080 - protein, 9 aa, Homo Sapiens
HYVALEDAG

SEQ ID NO: 709081 - protein, 9 aa, Homo Sapiens
QAKFRQIVS

SEQ ID NO: 709082 - protein, 9 aa, Homo Sapiens
KYGSSTPHH

SEQ ID NO: 709083 - protein, 9 aa, Homo Sapiens
IQLGQEEVL

SEQ ID NO: 709084 - protein, 9 aa, Homo Sapiens
CPSLQSCEG

SEQ ID NO: 709085 - protein, 9 aa, Homo Sapiens
VVEWHHDGK

SEQ ID NO: 709086 - protein, 9 aa, Homo Sapiens
NKALQERFK

SEQ ID NO: 709087 - protein, 9 aa, Homo Sapiens
CWPLPFPDV

SEQ ID NO: 709088 - protein, 9 aa, Homo Sapiens
DKSEATQVM

SEQ ID NO: 709089 - protein, 9 aa, Homo Sapiens
LIHPALNPI

SEQ ID NO: 709090 - protein, 9 aa, Homo Sapiens
QLTQRQKTH

SEQ ID NO: 709091 - protein, 9 aa, Homo Sapiens
ELLKSSVAI

SEQ ID NO: 709092 - protein, 9 aa, Homo Sapiens
VAKLVGVEE

SEQ ID NO: 709093 - protein, 9 aa, Homo Sapiens
QVHKEVLNS

SEQ ID NO: 709094 - protein, 9 aa, Homo Sapiens
VVVPCEPPE

SEQ ID NO: 709095 - protein, 9 aa, Homo Sapiens
ALIYTLRNK

SEQ ID NO: 709096 - protein, 9 aa, Homo Sapiens
TVKEMQLAR

SEQ ID NO: 709097 - protein, 9 aa, Homo Sapiens
LYVNVKMGC

SEQ ID NO: 709098 - protein, 9 aa, Homo Sapiens
SMFQEDEKF

SEQ ID NO: 709099 - protein, 9 aa, Homo Sapiens
TATAPVCKA

SEQ ID NO: 709100 - protein, 9 aa, Homo Sapiens
NSLVSDIER

SEQ ID NO: 709101 - protein, 9 aa, Homo Sapiens
VKGTSHQSH

SEQ ID NO: 709102 - protein, 9 aa, Homo Sapiens
AEYNITIIV

SEQ ID NO: 709103 - protein, 9 aa, Homo Sapiens
AVWFRLYGV

SEQ ID NO: 709104 - protein, 9 aa, Homo Sapiens
LLVHYVALE

SEQ ID NO: 709105 - protein, 9 aa, Homo Sapiens
FQPPQAKDT

SEQ ID NO: 709106 - protein, 9 aa, Homo Sapiens
PSLQSCEGC

SEQ ID NO: 709107 - protein, 9 aa, Homo Sapiens
LQKTIKERA

SEQ ID NO: 709108 - protein, 9 aa, Homo Sapiens
YSHLQGLLG

SEQ ID NO: 709109 - protein, 9 aa, Homo Sapiens
SSLPSHILE

SEQ ID NO: 709110 - protein, 9 aa, Homo Sapiens
PWGIPFASA

SEQ ID NO: 709111 - protein, 9 aa, Homo Sapiens
SRGSGAFPL

SEQ ID NO: 709112 - protein, 9 aa, Homo Sapiens
SVELEESIP

SEQ ID NO: 709113 - protein, 9 aa, Homo Sapiens
WPLPFPDVE

SEQ ID NO: 709114 - protein, 9 aa, Homo Sapiens
SGSGSCSRL

SEQ ID NO: 709115 - protein, 9 aa, Homo Sapiens
TSMKRVAKL

SEQ ID NO: 709116 - protein, 9 aa, Homo Sapiens
ARGENQDTS

SEQ ID NO: 709117 - protein, 9 aa, Homo Sapiens
GLDTDSRHH

SEQ ID NO: 709118 - protein, 9 aa, Homo Sapiens
QVYSTTSPP

SEQ ID NO: 709119 - protein, 9 aa, Homo Sapiens
EDGVTNLSH

SEQ ID NO: 709120 - protein, 9 aa, Homo Sapiens
IGNYAVWFR

SEQ ID NO: 709121 - protein, 9 aa, Homo Sapiens
FSSCSLSCL

SEQ ID NO: 709122 - protein, 9 aa, Homo Sapiens
QAWVASTRV

SEQ ID NO: 709123 - protein, 9 aa, Homo Sapiens
DESKARMEH

SEQ ID NO: 709124 - protein, 9 aa, Homo Sapiens
EVPEEIVPE

SEQ ID NO: 709125 - protein, 9 aa, Homo Sapiens
IHPALNPIV

SEQ ID NO: 709126 - protein, 9 aa, Homo Sapiens
VCESCKLGG

SEQ ID NO: 709127 - protein, 9 aa, Homo Sapiens
SHPLKSFNC

SEQ ID NO: 709128 - protein, 9 aa, Homo Sapiens
GDGGVKLTS

SEQ ID NO: 709129 - protein, 9 aa, Homo Sapiens
VTNIQIGFI

SEQ ID NO: 709130 - protein, 9 aa, Homo Sapiens
RHHGGASYV

SEQ ID NO: 709131 - protein, 9 aa, Homo Sapiens
DMGSDTIKI

SEQ ID NO: 709132 - protein, 9 aa, Homo Sapiens
CLGGSTLTL

SEQ ID NO: 709133 - protein, 9 aa, Homo Sapiens
GVRFRTGQC

SEQ ID NO: 709134 - protein, 9 aa, Homo Sapiens
EPQIQWRLG

SEQ ID NO: 709135 - protein, 9 aa, Homo Sapiens
VCFGPYKVS

SEQ ID NO: 709136 - protein, 9 aa, Homo Sapiens
PFSSCSLSC

SEQ ID NO: 709137 - protein, 9 aa, Homo Sapiens
ADNYRGSEP

SEQ ID NO: 709138 - protein, 9 aa, Homo Sapiens
TNTRVIALV

SEQ ID NO: 709139 - protein, 9 aa, Homo Sapiens
EKMEEEDEQ

SEQ ID NO: 709140 - protein, 9 aa, Homo Sapiens
LAFFGLITE

SEQ ID NO: 709141 - protein, 9 aa, Homo Sapiens
IIVTDLGTP

SEQ ID NO: 709142 - protein, 9 aa, Homo Sapiens
SSFPSKSFP

SEQ ID NO: 709143 - protein, 9 aa, Homo Sapiens
LQTLRTVAT

SEQ ID NO: 709144 - protein, 9 aa, Homo Sapiens
SKAVASQGR

SEQ ID NO: 709145 - protein, 9 aa, Homo Sapiens
VNPTTPEAA

SEQ ID NO: 709146 - protein, 9 aa, Homo Sapiens
GTTGETDTV

SEQ ID NO: 709147 - protein, 9 aa, Homo Sapiens
DLERLWVQE

SEQ ID NO: 709148 - protein, 9 aa, Homo Sapiens
FGPYKVSHV

SEQ ID NO: 709149 - protein, 9 aa, Homo Sapiens
KDHQIWTPL

SEQ ID NO: 709150 - protein, 9 aa, Homo Sapiens
IRCILPKLS

SEQ ID NO: 709151 - protein, 9 aa, Homo Sapiens
GSHKKSVLS

SEQ ID NO: 709152 - protein, 9 aa, Homo Sapiens
MPHAVTCDV

SEQ ID NO: 709153 - protein, 9 aa, Homo Sapiens
TAPLPPPLA

SEQ ID NO: 709154 - protein, 9 aa, Homo Sapiens
RGSEPESEK

SEQ ID NO: 709155 - protein, 9 aa, Homo Sapiens
WGQASGSGS

SEQ ID NO: 709156 - protein, 9 aa, Homo Sapiens
PRPPARVKT

SEQ ID NO: 709157 - protein, 9 aa, Homo Sapiens
AYRVNLLFG

SEQ ID NO: 709158 - protein, 9 aa, Homo Sapiens
EALLSESKT

SEQ ID NO: 709159 - protein, 9 aa, Homo Sapiens
TKTIEYIQP

SEQ ID NO: 709160 - protein, 9 aa, Homo Sapiens
FSNMASLRS

SEQ ID NO: 709161 - protein, 9 aa, Homo Sapiens
HLIHPALNP

SEQ ID NO: 709162 - protein, 9 aa, Homo Sapiens
SKIRQVFRA

SEQ ID NO: 709163 - protein, 9 aa, Homo Sapiens
PMKPLDRSV

SEQ ID NO: 709164 - protein, 9 aa, Homo Sapiens
RFHCTEDPE

SEQ ID NO: 709165 - protein, 9 aa, Homo Sapiens
LLNCVHELE

SEQ ID NO: 709166 - protein, 9 aa, Homo Sapiens
NVLHHLIHP

SEQ ID NO: 709167 - protein, 9 aa, Homo Sapiens
FCQTIVEKV

SEQ ID NO: 709168 - protein, 9 aa, Homo Sapiens
KLLALNPIK

SEQ ID NO: 709169 - protein, 9 aa, Homo Sapiens
ALNPIKRGS

SEQ ID NO: 709170 - protein, 9 aa, Homo Sapiens
TKLQIAAMW

SEQ ID NO: 709171 - protein, 9 aa, Homo Sapiens
AATAATLGL

SEQ ID NO: 709172 - protein, 9 aa, Homo Sapiens
FLSESRSRR

SEQ ID NO: 709173 - protein, 9 aa, Homo Sapiens
WLCAGSLAQ

SEQ ID NO: 709174 - protein, 9 aa, Homo Sapiens
VNLLFGLFG

SEQ ID NO: 709175 - protein, 9 aa, Homo Sapiens
DMVLSEKVI

SEQ ID NO: 709176 - protein, 9 aa, Homo Sapiens
FSYPSYLAL

SEQ ID NO: 709177 - protein, 9 aa, Homo Sapiens
KEVLNSGIA

SEQ ID NO: 709178 - protein, 9 aa, Homo Sapiens
LTVGVSAGR

SEQ ID NO: 709179 - protein, 9 aa, Homo Sapiens
PLKDNIATL

SEQ ID NO: 709180 - protein, 9 aa, Homo Sapiens
SYGLARGEN

SEQ ID NO: 709181 - protein, 9 aa, Homo Sapiens
LLQPVGTVA

SEQ ID NO: 709182 - protein, 9 aa, Homo Sapiens
FTVGTSGTT

SEQ ID NO: 709183 - protein, 9 aa, Homo Sapiens
SFPSKSFPS

SEQ ID NO: 709184 - protein, 9 aa, Homo Sapiens
LISAVAPGT

SEQ ID NO: 709185 - protein, 9 aa, Homo Sapiens
PKPPKTQCH

SEQ ID NO: 709186 - protein, 9 aa, Homo Sapiens
SWGQASGSG

SEQ ID NO: 709187 - protein, 9 aa, Homo Sapiens
PQYLFQASQ

SEQ ID NO: 709188 - protein, 9 aa, Homo Sapiens
LQPGMAAVT

SEQ ID NO: 709189 - protein, 9 aa, Homo Sapiens
PPCGSRICG

SEQ ID NO: 709190 - protein, 9 aa, Homo Sapiens
SCSEPQIVH

SEQ ID NO: 709191 - protein, 9 aa, Homo Sapiens
TREKLERIL

SEQ ID NO: 709192 - protein, 9 aa, Homo Sapiens
VSFYGGLAD

SEQ ID NO: 709193 - protein, 9 aa, Homo Sapiens
PTMVVEWHH

SEQ ID NO: 709194 - protein, 9 aa, Homo Sapiens
SLSIFVLDQ

SEQ ID NO: 709195 - protein, 9 aa, Homo Sapiens
CFGPYKVSH

SEQ ID NO: 709196 - protein, 9 aa, Homo Sapiens
TPHHCLRSS

SEQ ID NO: 709197 - protein, 9 aa, Homo Sapiens
PVLNPVLIR

SEQ ID NO: 709198 - protein, 9 aa, Homo Sapiens
LGGGKCRKE

SEQ ID NO: 709199 - protein, 9 aa, Homo Sapiens
RLAEVEYLA

SEQ ID NO: 709200 - protein, 9 aa, Homo Sapiens
NLSHPFAFG

SEQ ID NO: 709201 - protein, 9 aa, Homo Sapiens
RCWLLGLLP

SEQ ID NO: 709202 - protein, 9 aa, Homo Sapiens
AVLESRGSG

SEQ ID NO: 709203 - protein, 9 aa, Homo Sapiens
PKNTKEEFS

SEQ ID NO: 709204 - protein, 9 aa, Homo Sapiens
LCQEGRCFR

SEQ ID NO: 709205 - protein, 9 aa, Homo Sapiens
STVQLMFIP

SEQ ID NO: 709206 - protein, 9 aa, Homo Sapiens
EDLERLWVQ

SEQ ID NO: 709207 - protein, 9 aa, Homo Sapiens
AAENLKSCL

SEQ ID NO: 709208 - protein, 9 aa, Homo Sapiens
KYKPGDPSR

SEQ ID NO: 709209 - protein, 9 aa, Homo Sapiens
TSVKPHTAK

SEQ ID NO: 709210 - protein, 9 aa, Homo Sapiens
THHQTHTGE

SEQ ID NO: 709211 - protein, 9 aa, Homo Sapiens
MKSETRHSK

SEQ ID NO: 709212 - protein, 9 aa, Homo Sapiens
HCIITNWDD

SEQ ID NO: 709213 - protein, 9 aa, Homo Sapiens
MEHCIITNW

SEQ ID NO: 709214 - protein, 9 aa, Homo Sapiens
RAIGKVSFG

SEQ ID NO: 709215 - protein, 9 aa, Homo Sapiens
RSQRKQRDC

SEQ ID NO: 709216 - protein, 9 aa, Homo Sapiens
LNPKETGKR

SEQ ID NO: 709217 - protein, 9 aa, Homo Sapiens
AYSHLQGLL

SEQ ID NO: 709218 - protein, 9 aa, Homo Sapiens
MGQDCIVQL

SEQ ID NO: 709219 - protein, 9 aa, Homo Sapiens
NLYTNVMLE

SEQ ID NO: 709220 - protein, 9 aa, Homo Sapiens
MEEEDEQDG

SEQ ID NO: 709221 - protein, 9 aa, Homo Sapiens
YQTSATKDL

SEQ ID NO: 709222 - protein, 9 aa, Homo Sapiens
FIPRSLSRW

SEQ ID NO: 709223 - protein, 9 aa, Homo Sapiens
AQMQNGGLS

SEQ ID NO: 709224 - protein, 9 aa, Homo Sapiens
PEAPLDPLL

SEQ ID NO: 709225 - protein, 9 aa, Homo Sapiens
AFGVTMCEI

SEQ ID NO: 709226 - protein, 9 aa, Homo Sapiens
TMRKAAYYE

SEQ ID NO: 709227 - protein, 9 aa, Homo Sapiens
AFQKPDKGI

SEQ ID NO: 709228 - protein, 9 aa, Homo Sapiens
HPALNPIVY

SEQ ID NO: 709229 - protein, 9 aa, Homo Sapiens
CCRNLDIER

SEQ ID NO: 709230 - protein, 9 aa, Homo Sapiens
VYSTTSPPF

SEQ ID NO: 709231 - protein, 9 aa, Homo Sapiens
QQPQKQQLS

SEQ ID NO: 709232 - protein, 9 aa, Homo Sapiens
KSETRHSKI

SEQ ID NO: 709233 - protein, 9 aa, Homo Sapiens
QDRINRYQG

SEQ ID NO: 709234 - protein, 9 aa, Homo Sapiens
LPGPHAKAC

SEQ ID NO: 709235 - protein, 9 aa, Homo Sapiens
IKQGWNYGI

SEQ ID NO: 709236 - protein, 9 aa, Homo Sapiens
NLLKKLLAL

SEQ ID NO: 709237 - protein, 9 aa, Homo Sapiens
RTVATEKNS

SEQ ID NO: 709238 - protein, 9 aa, Homo Sapiens
SCKLGGGKC

SEQ ID NO: 709239 - protein, 9 aa, Homo Sapiens
YLLWKNVRE

SEQ ID NO: 709240 - protein, 9 aa, Homo Sapiens
ECTNENSLL

SEQ ID NO: 709241 - protein, 9 aa, Homo Sapiens
NATVGNAHR

SEQ ID NO: 709242 - protein, 9 aa, Homo Sapiens
LFPLPEPQY

SEQ ID NO: 709243 - protein, 9 aa, Homo Sapiens
EWHHDGKPL

SEQ ID NO: 709244 - protein, 9 aa, Homo Sapiens
LPKAPLDPL

SEQ ID NO: 709245 - protein, 9 aa, Homo Sapiens
NPVLIREVR

SEQ ID NO: 709246 - protein, 9 aa, Homo Sapiens
GSSVELEES

SEQ ID NO: 709247 - protein, 9 aa, Homo Sapiens
TRHSKIDKA

SEQ ID NO: 709248 - protein, 9 aa, Homo Sapiens
ASGVWTATA

SEQ ID NO: 709249 - protein, 9 aa, Homo Sapiens
HQSHLYGLE

SEQ ID NO: 709250 - protein, 9 aa, Homo Sapiens
PVLIREVRR

SEQ ID NO: 709251 - protein, 9 aa, Homo Sapiens
ALADNLLMV

SEQ ID NO: 709252 - protein, 9 aa, Homo Sapiens
LLDMGSDTI

SEQ ID NO: 709253 - protein, 9 aa, Homo Sapiens
ALQERFKDI

SEQ ID NO: 709254 - protein, 9 aa, Homo Sapiens
SAKDVSFHK

SEQ ID NO: 709255 - protein, 9 aa, Homo Sapiens
DWFTSHTSA

SEQ ID NO: 709256 - protein, 9 aa, Homo Sapiens
VPTPAPTRP

SEQ ID NO: 709257 - protein, 9 aa, Homo Sapiens
RPSSFGYKG

SEQ ID NO: 709258 - protein, 9 aa, Homo Sapiens
QDLCGDFRY

SEQ ID NO: 709259 - protein, 9 aa, Homo Sapiens
YFSFDTRFK

SEQ ID NO: 709260 - protein, 9 aa, Homo Sapiens
MCEIMTRGQ

SEQ ID NO: 709261 - protein, 9 aa, Homo Sapiens
GALGAPGAP

SEQ ID NO: 709262 - protein, 9 aa, Homo Sapiens
IPGMDKGLQ

SEQ ID NO: 709263 - protein, 9 aa, Homo Sapiens
RSRRKKKVS

SEQ ID NO: 709264 - protein, 9 aa, Homo Sapiens
VQLVYRKSW

SEQ ID NO: 709265 - protein, 9 aa, Homo Sapiens
LMVFEAVEQ

SEQ ID NO: 709266 - protein, 9 aa, Homo Sapiens
TKELLELSL

SEQ ID NO: 709267 - protein, 9 aa, Homo Sapiens
HLYMMVLRV

SEQ ID NO: 709268 - protein, 9 aa, Homo Sapiens
APLDPLLPW

SEQ ID NO: 709269 - protein, 9 aa, Homo Sapiens
ELSAGPITV

SEQ ID NO: 709270 - protein, 9 aa, Homo Sapiens
PLNPKETGK

SEQ ID NO: 709271 - protein, 9 aa, Homo Sapiens
TRRRRLLQP

SEQ ID NO: 709272 - protein, 9 aa, Homo Sapiens
EGLAPGKTT

SEQ ID NO: 709273 - protein, 9 aa, Homo Sapiens
RSSFRPQKV

SEQ ID NO: 709274 - protein, 9 aa, Homo Sapiens
PYKVSHVVG

SEQ ID NO: 709275 - protein, 9 aa, Homo Sapiens
HMLLTQKDH

SEQ ID NO: 709276 - protein, 9 aa, Homo Sapiens
VVPCEPPEV

SEQ ID NO: 709277 - protein, 9 aa, Homo Sapiens
PGSLKMEFK

SEQ ID NO: 709278 - protein, 9 aa, Homo Sapiens
GLCYLNTVN

SEQ ID NO: 709279 - protein, 9 aa, Homo Sapiens
LSLWRLPKA

SEQ ID NO: 709280 - protein, 9 aa, Homo Sapiens
KMHTVEKSH

SEQ ID NO: 709281 - protein, 9 aa, Homo Sapiens
ICRFHCTED

SEQ ID NO: 709282 - protein, 9 aa, Homo Sapiens
ACQGLGFVG

SEQ ID NO: 709283 - protein, 9 aa, Homo Sapiens
EKLTPTTPE

SEQ ID NO: 709284 - protein, 9 aa, Homo Sapiens
YWAWRGFSL

SEQ ID NO: 709285 - protein, 9 aa, Homo Sapiens
NTTPSLAGP

SEQ ID NO: 709286 - protein, 9 aa, Homo Sapiens
VTNLSHPFA

SEQ ID NO: 709287 - protein, 9 aa, Homo Sapiens
SCFLVSFMV

SEQ ID NO: 709288 - protein, 9 aa, Homo Sapiens
VYVVAPSTT

SEQ ID NO: 709289 - protein, 9 aa, Homo Sapiens
FRPQKVCRT

SEQ ID NO: 709290 - protein, 9 aa, Homo Sapiens
WNYGIQQDL

SEQ ID NO: 709291 - protein, 9 aa, Homo Sapiens
RTIMPGSLK

SEQ ID NO: 709292 - protein, 9 aa, Homo Sapiens
SNVSLSIFV

SEQ ID NO: 709293 - protein, 9 aa, Homo Sapiens
GVTNLSHPF

SEQ ID NO: 709294 - protein, 9 aa, Homo Sapiens
LLELSLALL

SEQ ID NO: 709295 - protein, 9 aa, Homo Sapiens
EVAMCEEDF

SEQ ID NO: 709296 - protein, 9 aa, Homo Sapiens
DPEPQIQWR

SEQ ID NO: 709297 - protein, 9 aa, Homo Sapiens
YCYFAHRRA

SEQ ID NO: 709298 - protein, 9 aa, Homo Sapiens
PEPQYLFQA

SEQ ID NO: 709299 - protein, 9 aa, Homo Sapiens
LLKSSVAIQ

SEQ ID NO: 709300 - protein, 9 aa, Homo Sapiens
NNYLIISEH

SEQ ID NO: 709301 - protein, 9 aa, Homo Sapiens
RAEYNITII

SEQ ID NO: 709302 - protein, 9 aa, Homo Sapiens
LVVLAYAVY

SEQ ID NO: 709303 - protein, 9 aa, Homo Sapiens
PVGTVAQLW

SEQ ID NO: 709304 - protein, 9 aa, Homo Sapiens
GKHKICSSH

SEQ ID NO: 709305 - protein, 9 aa, Homo Sapiens
SRRDKPFVE

SEQ ID NO: 709306 - protein, 9 aa, Homo Sapiens
LRFVTLYTE

SEQ ID NO: 709307 - protein, 9 aa, Homo Sapiens
YKIADPICK

SEQ ID NO: 709308 - protein, 9 aa, Homo Sapiens
KNPFECKEC

SEQ ID NO: 709309 - protein, 9 aa, Homo Sapiens
KEKEAQAKF

SEQ ID NO: 709310 - protein, 9 aa, Homo Sapiens
QLHHMEKTK

SEQ ID NO: 709311 - protein, 9 aa, Homo Sapiens
RGTSSFRSF

SEQ ID NO: 709312 - protein, 9 aa, Homo Sapiens
MMQMVVQNV

SEQ ID NO: 709313 - protein, 9 aa, Homo Sapiens
YRVARILGV

SEQ ID NO: 709314 - protein, 9 aa, Homo Sapiens
ISAFQKPDK

SEQ ID NO: 709315 - protein, 9 aa, Homo Sapiens
LDVVQLVYR

SEQ ID NO: 709316 - protein, 9 aa, Homo Sapiens
KVSFGKVCI

SEQ ID NO: 709317 - protein, 9 aa, Homo Sapiens
KDYPKNTKE

SEQ ID NO: 709318 - protein, 9 aa, Homo Sapiens
AFLGFTDYP

SEQ ID NO: 709319 - protein, 9 aa, Homo Sapiens
GDRGETGAL

SEQ ID NO: 709320 - protein, 9 aa, Homo Sapiens
NRYQGANVC

SEQ ID NO: 709321 - protein, 9 aa, Homo Sapiens
WINEKEPVL

SEQ ID NO: 709322 - protein, 9 aa, Homo Sapiens
FMAALPMSV

SEQ ID NO: 709323 - protein, 9 aa, Homo Sapiens
CRLDDCLMS

SEQ ID NO: 709324 - protein, 9 aa, Homo Sapiens
PSAPWGIPF

SEQ ID NO: 709325 - protein, 9 aa, Homo Sapiens
SPGPCLARL

SEQ ID NO: 709326 - protein, 9 aa, Homo Sapiens
SHGHQLTQR

SEQ ID NO: 709327 - protein, 9 aa, Homo Sapiens
PGVCGDVSL

SEQ ID NO: 709328 - protein, 9 aa, Homo Sapiens
NLLLKKGAS

SEQ ID NO: 709329 - protein, 9 aa, Homo Sapiens
IKNPFECKE

SEQ ID NO: 709330 - protein, 9 aa, Homo Sapiens
WTCIQEYVQ

SEQ ID NO: 709331 - protein, 9 aa, Homo Sapiens
EAIQWINEK

SEQ ID NO: 709332 - protein, 9 aa, Homo Sapiens
LLGLCYLNT

SEQ ID NO: 709333 - protein, 9 aa, Homo Sapiens
TVPEVPEEI

SEQ ID NO: 709334 - protein, 9 aa, Homo Sapiens
KPINVCSQL

SEQ ID NO: 709335 - protein, 9 aa, Homo Sapiens
NSSYECTNE

SEQ ID NO: 709336 - protein, 9 aa, Homo Sapiens
HKKMHTVEK

SEQ ID NO: 709337 - protein, 9 aa, Homo Sapiens
QTQRLDRLP

SEQ ID NO: 709338 - protein, 9 aa, Homo Sapiens
LVCFGPYKV

SEQ ID NO: 709339 - protein, 9 aa, Homo Sapiens
MDPLKDNIA

SEQ ID NO: 709340 - protein, 9 aa, Homo Sapiens
VSKIRQVFR

SEQ ID NO: 709341 - protein, 9 aa, Homo Sapiens
QSCEGCRMH

SEQ ID NO: 709342 - protein, 9 aa, Homo Sapiens
DALSIVCQI

SEQ ID NO: 709343 - protein, 9 aa, Homo Sapiens
VQALNAKTD

SEQ ID NO: 709344 - protein, 9 aa, Homo Sapiens
CIVQLGASY

SEQ ID NO: 709345 - protein, 9 aa, Homo Sapiens
FQEDEKFLS

SEQ ID NO: 709346 - protein, 9 aa, Homo Sapiens
VWGREESER

SEQ ID NO: 709347 - protein, 9 aa, Homo Sapiens
YTAFSNSFS

SEQ ID NO: 709348 - protein, 9 aa, Homo Sapiens
LKWWGLQNK

SEQ ID NO: 709349 - protein, 9 aa, Homo Sapiens
AQQNLYTNV

SEQ ID NO: 709350 - protein, 9 aa, Homo Sapiens
PLLPWQLSL

SEQ ID NO: 709351 - protein, 9 aa, Homo Sapiens
HLAIKHSRP

SEQ ID NO: 709352 - protein, 9 aa, Homo Sapiens
RYGQDCAET

SEQ ID NO: 709353 - protein, 9 aa, Homo Sapiens
LSPRFLACP

SEQ ID NO: 709354 - protein, 9 aa, Homo Sapiens
NVSLSIFVL

SEQ ID NO: 709355 - protein, 9 aa, Homo Sapiens
NDIPLHLAI

SEQ ID NO: 709356 - protein, 9 aa, Homo Sapiens
LYKPPPSAK

SEQ ID NO: 709357 - protein, 9 aa, Homo Sapiens
YDICCRNLD

SEQ ID NO: 709358 - protein, 9 aa, Homo Sapiens
ATAPVCKAV

SEQ ID NO: 709359 - protein, 9 aa, Homo Sapiens
VVAPSTTRS

SEQ ID NO: 709360 - protein, 9 aa, Homo Sapiens
LERLWVQES

SEQ ID NO: 709361 - protein, 9 aa, Homo Sapiens
ESRGSGAFP

SEQ ID NO: 709362 - protein, 9 aa, Homo Sapiens
LGLCYLNTV

SEQ ID NO: 709363 - protein, 9 aa, Homo Sapiens
NPFECKECG

SEQ ID NO: 709364 - protein, 9 aa, Homo Sapiens
RINRYQGAN

SEQ ID NO: 709365 - protein, 9 aa, Homo Sapiens
QRLMISDSL

SEQ ID NO: 709366 - protein, 9 aa, Homo Sapiens
HTGEKPHIF

SEQ ID NO: 709367 - protein, 9 aa, Homo Sapiens
RTPWSTRET

SEQ ID NO: 709368 - protein, 9 aa, Homo Sapiens
LLEREESRI

SEQ ID NO: 709369 - protein, 9 aa, Homo Sapiens
PTTPEKLTP

SEQ ID NO: 709370 - protein, 9 aa, Homo Sapiens
AIREVAMCE

SEQ ID NO: 709371 - protein, 9 aa, Homo Sapiens
PLKSFNCVK

SEQ ID NO: 709372 - protein, 9 aa, Homo Sapiens
RCADPQISE

SEQ ID NO: 709373 - protein, 9 aa, Homo Sapiens
VSLSSPTDA

SEQ ID NO: 709374 - protein, 9 aa, Homo Sapiens
LKACLKGIP

SEQ ID NO: 709375 - protein, 9 aa, Homo Sapiens
KEAQAKFRQ

SEQ ID NO: 709376 - protein, 9 aa, Homo Sapiens
SSSPIHSCF

SEQ ID NO: 709377 - protein, 9 aa, Homo Sapiens
GNRHVLVRD

SEQ ID NO: 709378 - protein, 9 aa, Homo Sapiens
TVKLKWWGL

SEQ ID NO: 709379 - protein, 9 aa, Homo Sapiens
RLWVQESDL

SEQ ID NO: 709380 - protein, 9 aa, Homo Sapiens
PPQVYSTTS

SEQ ID NO: 709381 - protein, 9 aa, Homo Sapiens
RGWVDLTSV

SEQ ID NO: 709382 - protein, 9 aa, Homo Sapiens
WLQAWVAST

SEQ ID NO: 709383 - protein, 9 aa, Homo Sapiens
MALLVQLAM

SEQ ID NO: 709384 - protein, 9 aa, Homo Sapiens
LDFFANGGV

SEQ ID NO: 709385 - protein, 9 aa, Homo Sapiens
LVYRKSWKV

SEQ ID NO: 709386 - protein, 9 aa, Homo Sapiens
SVHPKTFPV

SEQ ID NO: 709387 - protein, 9 aa, Homo Sapiens
ITHHQTHTG

SEQ ID NO: 709388 - protein, 9 aa, Homo Sapiens
LMGKHKICS

SEQ ID NO: 709389 - protein, 9 aa, Homo Sapiens
LPECTMRKA

SEQ ID NO: 709390 - protein, 9 aa, Homo Sapiens
PEVPEEIVP

SEQ ID NO: 709391 - protein, 9 aa, Homo Sapiens
RYKLFTAKK

SEQ ID NO: 709392 - protein, 9 aa, Homo Sapiens
RVAKLVGVE

SEQ ID NO: 709393 - protein, 9 aa, Homo Sapiens
YAVWFRLYG

SEQ ID NO: 709394 - protein, 9 aa, Homo Sapiens
ISRVPPADF

SEQ ID NO: 709395 - protein, 9 aa, Homo Sapiens
EFSYPSYLA

SEQ ID NO: 709396 - protein, 9 aa, Homo Sapiens
ISISRVPPA

SEQ ID NO: 709397 - protein, 9 aa, Homo Sapiens
GLMDVDTLN

SEQ ID NO: 709398 - protein, 9 aa, Homo Sapiens
QKDHPRRWK

SEQ ID NO: 709399 - protein, 9 aa, Homo Sapiens
GAPVTTQLA

SEQ ID NO: 709400 - protein, 9 aa, Homo Sapiens
LSAAGELAT

SEQ ID NO: 709401 - protein, 9 aa, Homo Sapiens
QIHSGDRLY

SEQ ID NO: 709402 - protein, 9 aa, Homo Sapiens
HTSACGLFS

SEQ ID NO: 709403 - protein, 9 aa, Homo Sapiens
KDLYRDAML

SEQ ID NO: 709404 - protein, 9 aa, Homo Sapiens
PTTPPQVYS

SEQ ID NO: 709405 - protein, 9 aa, Homo Sapiens
SPTFCQTIV

SEQ ID NO: 709406 - protein, 9 aa, Homo Sapiens
WVASTRVSL

SEQ ID NO: 709407 - protein, 9 aa, Homo Sapiens
LKILNRLYL

SEQ ID NO: 709408 - protein, 9 aa, Homo Sapiens
GSTLTLLHD

SEQ ID NO: 709409 - protein, 9 aa, Homo Sapiens
NYPITVQTV

SEQ ID NO: 709410 - protein, 9 aa, Homo Sapiens
CDLYFTQGD

SEQ ID NO: 709411 - protein, 9 aa, Homo Sapiens
PLLGSSVEL

SEQ ID NO: 709412 - protein, 9 aa, Homo Sapiens
CTRDDRRES

SEQ ID NO: 709413 - protein, 9 aa, Homo Sapiens
HTAEKPWKC

SEQ ID NO: 709414 - protein, 9 aa, Homo Sapiens
TTQQEVCGA

SEQ ID NO: 709415 - protein, 9 aa, Homo Sapiens
GLGFVGSLI

SEQ ID NO: 709416 - protein, 9 aa, Homo Sapiens
EPLSPRFLA

SEQ ID NO: 709417 - protein, 9 aa, Homo Sapiens
RNRSCRILH

SEQ ID NO: 709418 - protein, 9 aa, Homo Sapiens
IYSESLLTT

SEQ ID NO: 709419 - protein, 9 aa, Homo Sapiens
PIPNNYPIT

SEQ ID NO: 709420 - protein, 9 aa, Homo Sapiens
ASGSGSCSR

SEQ ID NO: 709421 - protein, 9 aa, Homo Sapiens
RNHQQIHSG

SEQ ID NO: 709422 - protein, 9 aa, Homo Sapiens
FGPSDDDKG

SEQ ID NO: 709423 - protein, 9 aa, Homo Sapiens
SGSDCDLYF

SEQ ID NO: 709424 - protein, 9 aa, Homo Sapiens
GKVSFGKVC

SEQ ID NO: 709425 - protein, 9 aa, Homo Sapiens
KFQGHCYCY

SEQ ID NO: 709426 - protein, 9 aa, Homo Sapiens
LTQRQKTHS

SEQ ID NO: 709427 - protein, 9 aa, Homo Sapiens
DFGLALQAD

SEQ ID NO: 709428 - protein, 9 aa, Homo Sapiens
PITVLRDRL

SEQ ID NO: 709429 - protein, 9 aa, Homo Sapiens
HIDRSDLSP

SEQ ID NO: 709430 - protein, 9 aa, Homo Sapiens
LMISDSLIS

SEQ ID NO: 709431 - protein, 9 aa, Homo Sapiens
TTAPLPPPL

SEQ ID NO: 709432 - protein, 9 aa, Homo Sapiens
GTSHQSHLY

SEQ ID NO: 709433 - protein, 9 aa, Homo Sapiens
PEVMIKQPI

SEQ ID NO: 709434 - protein, 9 aa, Homo Sapiens
TARAWYLLW

SEQ ID NO: 709435 - protein, 9 aa, Homo Sapiens
PREALLSES

SEQ ID NO: 709436 - protein, 9 aa, Homo Sapiens
GLPVRTPTQ

SEQ ID NO: 709437 - protein, 9 aa, Homo Sapiens
KNMDPLKDN

SEQ ID NO: 709438 - protein, 9 aa, Homo Sapiens
VEPLPHDET

SEQ ID NO: 709439 - protein, 9 aa, Homo Sapiens
IEYIQPNPA

SEQ ID NO: 709440 - protein, 9 aa, Homo Sapiens
KLGGGKCRK

SEQ ID NO: 709441 - protein, 9 aa, Homo Sapiens
LLPEPNWTR

SEQ ID NO: 709442 - protein, 9 aa, Homo Sapiens
DCWPLPFPD

SEQ ID NO: 709443 - protein, 9 aa, Homo Sapiens
IREVRRTGG

SEQ ID NO: 709444 - protein, 9 aa, Homo Sapiens
MAALPMSVW

SEQ ID NO: 709445 - protein, 9 aa, Homo Sapiens
VSLPGPHAK

SEQ ID NO: 709446 - protein, 9 aa, Homo Sapiens
SESKPCGEL

SEQ ID NO: 709447 - protein, 9 aa, Homo Sapiens
ITIIVTDLG

SEQ ID NO: 709448 - protein, 9 aa, Homo Sapiens
EHKKMHTVE

SEQ ID NO: 709449 - protein, 9 aa, Homo Sapiens
LALWRPPEA

SEQ ID NO: 709450 - protein, 9 aa, Homo Sapiens
KLCQLHHME

SEQ ID NO: 709451 - protein, 9 aa, Homo Sapiens
APLLGSSVE

SEQ ID NO: 709452 - protein, 9 aa, Homo Sapiens
RFEDGVTNL

SEQ ID NO: 709453 - protein, 9 aa, Homo Sapiens
EIVGVVEPL

SEQ ID NO: 709454 - protein, 9 aa, Homo Sapiens
GLSAAGELA

SEQ ID NO: 709455 - protein, 9 aa, Homo Sapiens
DPLLPWQLT

SEQ ID NO: 709456 - protein, 9 aa, Homo Sapiens
NTKTRRSQT

SEQ ID NO: 709457 - protein, 9 aa, Homo Sapiens
AGPITVLRD

SEQ ID NO: 709458 - protein, 9 aa, Homo Sapiens
DPLLPWQLS

SEQ ID NO: 709459 - protein, 9 aa, Homo Sapiens
SMPHAVTCD

SEQ ID NO: 709460 - protein, 9 aa, Homo Sapiens
LIACISHNH

SEQ ID NO: 709461 - protein, 9 aa, Homo Sapiens
EDYQYQKPK

SEQ ID NO: 709462 - protein, 9 aa, Homo Sapiens
YKVSHVVGY

SEQ ID NO: 709463 - protein, 9 aa, Homo Sapiens
TGPYQCETR

SEQ ID NO: 709464 - protein, 9 aa, Homo Sapiens
LPHDETYCD

SEQ ID NO: 709465 - protein, 9 aa, Homo Sapiens
LDISDNHSL

SEQ ID NO: 709466 - protein, 9 aa, Homo Sapiens
HPLKSFNCV

SEQ ID NO: 709467 - protein, 9 aa, Homo Sapiens
QSHLYGLEP

SEQ ID NO: 709468 - protein, 9 aa, Homo Sapiens
KILNRLYLH

SEQ ID NO: 709469 - protein, 9 aa, Homo Sapiens
MNLQMTALF

SEQ ID NO: 709470 - protein, 9 aa, Homo Sapiens
TPTTPEKPA

SEQ ID NO: 709471 - protein, 9 aa, Homo Sapiens
QQLSSPLPP

SEQ ID NO: 709472 - protein, 9 aa, Homo Sapiens
TVPTPAPTR

SEQ ID NO: 709473 - protein, 9 aa, Homo Sapiens
EYLAESHQH

SEQ ID NO: 709474 - protein, 9 aa, Homo Sapiens
YAVYDDLQF

SEQ ID NO: 709475 - protein, 9 aa, Homo Sapiens
TRETELLLG

SEQ ID NO: 709476 - protein, 9 aa, Homo Sapiens
VIADHSHVF

SEQ ID NO: 709477 - protein, 9 aa, Homo Sapiens
PQIVHITFV

SEQ ID NO: 709478 - protein, 9 aa, Homo Sapiens
GIKGMVKAV

SEQ ID NO: 709479 - protein, 9 aa, Homo Sapiens
PRGLLGLCY

SEQ ID NO: 709480 - protein, 9 aa, Homo Sapiens
KDVSFHKEN

SEQ ID NO: 709481 - protein, 9 aa, Homo Sapiens
NGLKILNRL

SEQ ID NO: 709482 - protein, 9 aa, Homo Sapiens
LDSNLYSAP

SEQ ID NO: 709483 - protein, 9 aa, Homo Sapiens
GVCGDVSLP

SEQ ID NO: 709484 - protein, 9 aa, Homo Sapiens
CGLPVRTPT

SEQ ID NO: 709485 - protein, 9 aa, Homo Sapiens
VIGKWWCEI

SEQ ID NO: 709486 - protein, 9 aa, Homo Sapiens
GWSSSTKLQ

SEQ ID NO: 709487 - protein, 9 aa, Homo Sapiens
HPMDTVPTP

SEQ ID NO: 709488 - protein, 9 aa, Homo Sapiens
LFRNRSCRI

SEQ ID NO: 709489 - protein, 9 aa, Homo Sapiens
LEAMRAMID

SEQ ID NO: 709490 - protein, 9 aa, Homo Sapiens
IQPNPASRA

SEQ ID NO: 709491 - protein, 9 aa, Homo Sapiens
KDVLFGNIR

SEQ ID NO: 709492 - protein, 9 aa, Homo Sapiens
LLFRNRSCR

SEQ ID NO: 709493 - protein, 9 aa, Homo Sapiens
CFLVSFMVD

SEQ ID NO: 709494 - protein, 9 aa, Homo Sapiens
YVALEDAGY

SEQ ID NO: 709495 - protein, 9 aa, Homo Sapiens
SGLRFVTLY

SEQ ID NO: 709496 - protein, 9 aa, Homo Sapiens
EVLNSGIAY

SEQ ID NO: 709497 - protein, 9 aa, Homo Sapiens
PGLVVLAYA

SEQ ID NO: 709498 - protein, 9 aa, Homo Sapiens
LMDVDTLNT

SEQ ID NO: 709499 - protein, 9 aa, Homo Sapiens
AEEFFMLGY

SEQ ID NO: 709500 - protein, 9 aa, Homo Sapiens
GSEPESEKE

SEQ ID NO: 709501 - protein, 9 aa, Homo Sapiens
NSFSRNLIL

SEQ ID NO: 709502 - protein, 9 aa, Homo Sapiens
ALKACLKGI

SEQ ID NO: 709503 - protein, 9 aa, Homo Sapiens
PLLPWQLTL

SEQ ID NO: 709504 - protein, 9 aa, Homo Sapiens
KHSDSDLIP

SEQ ID NO: 709505 - protein, 9 aa, Homo Sapiens
LVSDIERVD

SEQ ID NO: 709506 - protein, 9 aa, Homo Sapiens
VNRICGLPV

SEQ ID NO: 709507 - protein, 9 aa, Homo Sapiens
HHLIHPALN

SEQ ID NO: 709508 - protein, 9 aa, Homo Sapiens
LLILKEEMK

SEQ ID NO: 709509 - protein, 9 aa, Homo Sapiens
IPRSLSRWT

SEQ ID NO: 709510 - protein, 9 aa, Homo Sapiens
DTAQQNLYT

SEQ ID NO: 709511 - protein, 9 aa, Homo Sapiens
LPQSQSHQE

SEQ ID NO: 709512 - protein, 9 aa, Homo Sapiens
MMMQMVVQN

SEQ ID NO: 709513 - protein, 9 aa, Homo Sapiens
TNVMLENYR

SEQ ID NO: 709514 - protein, 9 aa, Homo Sapiens
VSDGQCGPE

SEQ ID NO: 709515 - protein, 9 aa, Homo Sapiens
EEEDEQDGE

SEQ ID NO: 709516 - protein, 9 aa, Homo Sapiens
QILRAIGKV

SEQ ID NO: 709517 - protein, 9 aa, Homo Sapiens
DSLISAVAP

SEQ ID NO: 709518 - protein, 9 aa, Homo Sapiens
EDTLSLVIA

SEQ ID NO: 709519 - protein, 9 aa, Homo Sapiens
CHRFLSKCK

SEQ ID NO: 709520 - protein, 9 aa, Homo Sapiens
DRIKQGWNY

SEQ ID NO: 709521 - protein, 9 aa, Homo Sapiens
MYFFFCMLA

SEQ ID NO: 709522 - protein, 9 aa, Homo Sapiens
QKPKTMIAN

SEQ ID NO: 709523 - protein, 9 aa, Homo Sapiens
WSSSTKLQI

SEQ ID NO: 709524 - protein, 9 aa, Homo Sapiens
LKYPMEHCI

SEQ ID NO: 709525 - protein, 9 aa, Homo Sapiens
DTIKIKALL

SEQ ID NO: 709526 - protein, 9 aa, Homo Sapiens
ICGLPVRTP

SEQ ID NO: 709527 - protein, 9 aa, Homo Sapiens
ISDSLISAV

SEQ ID NO: 709528 - protein, 9 aa, Homo Sapiens
IQEYVQSQD

SEQ ID NO: 709529 - protein, 9 aa, Homo Sapiens
PFVPVMALT

SEQ ID NO: 709530 - protein, 9 aa, Homo Sapiens
KLLEREESR

SEQ ID NO: 709531 - protein, 9 aa, Homo Sapiens
IPQYLWTCI

SEQ ID NO: 709532 - protein, 9 aa, Homo Sapiens
DDDKGTPTS

SEQ ID NO: 709533 - protein, 9 aa, Homo Sapiens
PEEAAWCGG

SEQ ID NO: 709534 - protein, 9 aa, Homo Sapiens
SLISAVAPG

SEQ ID NO: 709535 - protein, 9 aa, Homo Sapiens
HLQGLLGHF

SEQ ID NO: 709536 - protein, 9 aa, Homo Sapiens
SDLSPRASP

SEQ ID NO: 709537 - protein, 9 aa, Homo Sapiens
GVKLTSDAL

SEQ ID NO: 709538 - protein, 9 aa, Homo Sapiens
HIIKNPFEC

SEQ ID NO: 709539 - protein, 9 aa, Homo Sapiens
THLLVHYVA

SEQ ID NO: 709540 - protein, 9 aa, Homo Sapiens
LKCNECGKS

SEQ ID NO: 709541 - protein, 9 aa, Homo Sapiens
LELEKTQEP

SEQ ID NO: 709542 - protein, 9 aa, Homo Sapiens
DDKGTPTSS

SEQ ID NO: 709543 - protein, 9 aa, Homo Sapiens
ADPQLALVL

SEQ ID NO: 709544 - protein, 9 aa, Homo Sapiens
SSFGYKGTF

SEQ ID NO: 709545 - protein, 9 aa, Homo Sapiens
WTATAPVCK

SEQ ID NO: 709546 - protein, 9 aa, Homo Sapiens
QPPQAKDTW

SEQ ID NO: 709547 - protein, 9 aa, Homo Sapiens
ITVLRDRLI

SEQ ID NO: 709548 - protein, 9 aa, Homo Sapiens
YPKNTKEEF

SEQ ID NO: 709549 - protein, 9 aa, Homo Sapiens
YPMEHCIIT

SEQ ID NO: 709550 - protein, 9 aa, Homo Sapiens
GGVKLTSDA

SEQ ID NO: 709551 - protein, 9 aa, Homo Sapiens
KQPIPMSKE

SEQ ID NO: 709552 - protein, 9 aa, Homo Sapiens
PLFNALIYT

SEQ ID NO: 709553 - protein, 9 aa, Homo Sapiens
SEKKPINVC

SEQ ID NO: 709554 - protein, 9 aa, Homo Sapiens
GYIIPGMDK

SEQ ID NO: 709555 - protein, 9 aa, Homo Sapiens
PHIFEECGK

SEQ ID NO: 709556 - protein, 9 aa, Homo Sapiens
YRKLLEREE

SEQ ID NO: 709557 - protein, 9 aa, Homo Sapiens
QQEVCGAYL

SEQ ID NO: 709558 - protein, 9 aa, Homo Sapiens
LRVSKIRQV

SEQ ID NO: 709559 - protein, 9 aa, Homo Sapiens
TPLFNALIY

SEQ ID NO: 709560 - protein, 9 aa, Homo Sapiens
YFASIAAID

SEQ ID NO: 709561 - protein, 9 aa, Homo Sapiens
QQQQPQKQQ

SEQ ID NO: 709562 - protein, 9 aa, Homo Sapiens
DLIPTSMPH

SEQ ID NO: 709563 - protein, 9 aa, Homo Sapiens
HQPMYFFFC

SEQ ID NO: 709564 - protein, 9 aa, Homo Sapiens
QKTIKERAL

SEQ ID NO: 709565 - protein, 9 aa, Homo Sapiens
EETEEALDS

SEQ ID NO: 709566 - protein, 9 aa, Homo Sapiens
DKGIVIPLQ

SEQ ID NO: 709567 - protein, 9 aa, Homo Sapiens
EMIGNYAVW

SEQ ID NO: 709568 - protein, 9 aa, Homo Sapiens
VTTQLALWR

SEQ ID NO: 709569 - protein, 9 aa, Homo Sapiens
SHTEQLQDD

SEQ ID NO: 709570 - protein, 9 aa, Homo Sapiens
FGEIQECTV

SEQ ID NO: 709571 - protein, 9 aa, Homo Sapiens
NKDVLFGNI

SEQ ID NO: 709572 - protein, 9 aa, Homo Sapiens
MRKAAYYEN

SEQ ID NO: 709573 - protein, 9 aa, Homo Sapiens
VVQLVYRKS

SEQ ID NO: 709574 - protein, 9 aa, Homo Sapiens
RHVLVRDPC

SEQ ID NO: 709575 - protein, 9 aa, Homo Sapiens
VASQGRVIS

SEQ ID NO: 709576 - protein, 9 aa, Homo Sapiens
FLLFRNRSC

SEQ ID NO: 709577 - protein, 9 aa, Homo Sapiens
ASWGQASGS

SEQ ID NO: 709578 - protein, 9 aa, Homo Sapiens
RGLLGLCYL

SEQ ID NO: 709579 - protein, 9 aa, Homo Sapiens
KRKKLCQLH

SEQ ID NO: 709580 - protein, 9 aa, Homo Sapiens
PPSCVDFSN

SEQ ID NO: 709581 - protein, 9 aa, Homo Sapiens
QSLQHWLSL

SEQ ID NO: 709582 - protein, 9 aa, Homo Sapiens
TPSLAGPTE

SEQ ID NO: 709583 - protein, 9 aa, Homo Sapiens
LSSNVSLSI

SEQ ID NO: 709584 - protein, 9 aa, Homo Sapiens
FQKPDKGIV

SEQ ID NO: 709585 - protein, 9 aa, Homo Sapiens
TSKTIAVYW

SEQ ID NO: 709586 - protein, 9 aa, Homo Sapiens
DKILKISPR

SEQ ID NO: 709587 - protein, 9 aa, Homo Sapiens
PSAKDVSFH

SEQ ID NO: 709588 - protein, 9 aa, Homo Sapiens
RKALDVYRR

SEQ ID NO: 709589 - protein, 9 aa, Homo Sapiens
LDDCLMSLT

SEQ ID NO: 709590 - protein, 9 aa, Homo Sapiens
LVHYVALED

SEQ ID NO: 709591 - protein, 9 aa, Homo Sapiens
TVGNAHRQI

SEQ ID NO: 709592 - protein, 9 aa, Homo Sapiens
GLKILNRLY

SEQ ID NO: 709593 - protein, 9 aa, Homo Sapiens
RRRLLQPVG

SEQ ID NO: 709594 - protein, 9 aa, Homo Sapiens
IWTPLTLAD

SEQ ID NO: 709595 - protein, 9 aa, Homo Sapiens
SSSTKLQIA

SEQ ID NO: 709596 - protein, 9 aa, Homo Sapiens
EPESEKETK

SEQ ID NO: 709597 - protein, 9 aa, Homo Sapiens
FYTAFSNSF

SEQ ID NO: 709598 - protein, 9 aa, Homo Sapiens
NKYGSSTPH

SEQ ID NO: 709599 - protein, 9 aa, Homo Sapiens
QKFPFVPVM

SEQ ID NO: 709600 - protein, 9 aa, Homo Sapiens
NRYKLFTAK

SEQ ID NO: 709601 - protein, 9 aa, Homo Sapiens
IVTNIQIGF

SEQ ID NO: 709602 - protein, 9 aa, Homo Sapiens
LALQADEEM

SEQ ID NO: 709603 - protein, 9 aa, Homo Sapiens
KMEEEDEQD

SEQ ID NO: 709604 - protein, 9 aa, Homo Sapiens
WELLNCVHE

SEQ ID NO: 709605 - protein, 9 aa, Homo Sapiens
LVSYPSMQK

SEQ ID NO: 709606 - protein, 9 aa, Homo Sapiens
TLLHDRSFS

SEQ ID NO: 709607 - protein, 9 aa, Homo Sapiens
PNNYPITVQ

SEQ ID NO: 709608 - protein, 9 aa, Homo Sapiens
GLAPGKTTP

SEQ ID NO: 709609 - protein, 9 aa, Homo Sapiens
KYKHKKEKL

SEQ ID NO: 709610 - protein, 9 aa, Homo Sapiens
PPEAFLEDI

SEQ ID NO: 709611 - protein, 9 aa, Homo Sapiens
GETGALGAP

SEQ ID NO: 709612 - protein, 9 aa, Homo Sapiens
WSTRETELL

SEQ ID NO: 709613 - protein, 9 aa, Homo Sapiens
AMRAMIDEF

SEQ ID NO: 709614 - protein, 9 aa, Homo Sapiens
DPICKFIFS

SEQ ID NO: 709615 - protein, 9 aa, Homo Sapiens
LRTSLSSLS

SEQ ID NO: 709616 - protein, 9 aa, Homo Sapiens
KTISISRVP

SEQ ID NO: 709617 - protein, 9 aa, Homo Sapiens
ENTTPSLAG

SEQ ID NO: 709618 - protein, 9 aa, Homo Sapiens
SRVPPADFD

SEQ ID NO: 709619 - protein, 9 aa, Homo Sapiens
LPLNPKETG

SEQ ID NO: 709620 - protein, 9 aa, Homo Sapiens
RDDRRESIV

SEQ ID NO: 709621 - protein, 9 aa, Homo Sapiens
TNGGPDKGS

SEQ ID NO: 709622 - protein, 9 aa, Homo Sapiens
KEMQLARED

SEQ ID NO: 709623 - protein, 9 aa, Homo Sapiens
SDGTDAKVD

SEQ ID NO: 709624 - protein, 9 aa, Homo Sapiens
ELSLALLNK

SEQ ID NO: 709625 - protein, 9 aa, Homo Sapiens
INEKEPVLT

SEQ ID NO: 709626 - protein, 9 aa, Homo Sapiens
SISRVPPAD

SEQ ID NO: 709627 - protein, 9 aa, Homo Sapiens
AFIAQMRLS

SEQ ID NO: 709628 - protein, 9 aa, Homo Sapiens
GPRCADPQI

SEQ ID NO: 709629 - protein, 9 aa, Homo Sapiens
VEKSHECTE

SEQ ID NO: 709630 - protein, 9 aa, Homo Sapiens
SFRPQKVCR

SEQ ID NO: 709631 - protein, 9 aa, Homo Sapiens
TNRYKLFTA

SEQ ID NO: 709632 - protein, 9 aa, Homo Sapiens
VIDLRVSKI

SEQ ID NO: 709633 - protein, 9 aa, Homo Sapiens
VDLTSVKPH

SEQ ID NO: 709634 - protein, 9 aa, Homo Sapiens
QEEVLIQPL

SEQ ID NO: 709635 - protein, 9 aa, Homo Sapiens
LARLHLPLS

SEQ ID NO: 709636 - protein, 9 aa, Homo Sapiens
GPPSCVDFS

SEQ ID NO: 709637 - protein, 9 aa, Homo Sapiens
FFMLGYRVH

SEQ ID NO: 709638 - protein, 9 aa, Homo Sapiens
RDAMLENYR

SEQ ID NO: 709639 - protein, 9 aa, Homo Sapiens
GQASGSGSC

SEQ ID NO: 709640 - protein, 9 aa, Homo Sapiens
ALFTRGEDW

SEQ ID NO: 709641 - protein, 9 aa, Homo Sapiens
QLSLWRLPK

SEQ ID NO: 709642 - protein, 9 aa, Homo Sapiens
KERLLLTVG

SEQ ID NO: 709643 - protein, 9 aa, Homo Sapiens
NGGLSTPPA

SEQ ID NO: 709644 - protein, 9 aa, Homo Sapiens
PSLAGPTEN

SEQ ID NO: 709645 - protein, 9 aa, Homo Sapiens
RPKIQKLVL

SEQ ID NO: 709646 - protein, 9 aa, Homo Sapiens
IADPICKFI

SEQ ID NO: 709647 - protein, 9 aa, Homo Sapiens
ALKLCLYLA

SEQ ID NO: 709648 - protein, 9 aa, Homo Sapiens
MSLTRFAAA

SEQ ID NO: 709649 - protein, 9 aa, Homo Sapiens
LSSLSSEHS

SEQ ID NO: 709650 - protein, 9 aa, Homo Sapiens
IHSCFLVSF

SEQ ID NO: 709651 - protein, 9 aa, Homo Sapiens
LLGLLPEPN

SEQ ID NO: 709652 - protein, 9 aa, Homo Sapiens
ISLNSVWGR

SEQ ID NO: 709653 - protein, 9 aa, Homo Sapiens
VKTLREEAP

SEQ ID NO: 709654 - protein, 9 aa, Homo Sapiens
GLVVLAYAV

SEQ ID NO: 709655 - protein, 9 aa, Homo Sapiens
TVGTSGTTG

SEQ ID NO: 709656 - protein, 9 aa, Homo Sapiens
MPPEAFLED

SEQ ID NO: 709657 - protein, 9 aa, Homo Sapiens
WDRFTRRCG

SEQ ID NO: 709658 - protein, 9 aa, Homo Sapiens
FGVTMCEIM

SEQ ID NO: 709659 - protein, 9 aa, Homo Sapiens
DISDNHSLS

SEQ ID NO: 709660 - protein, 9 aa, Homo Sapiens
FTRGEDWDR

SEQ ID NO: 709661 - protein, 9 aa, Homo Sapiens
KLTSDALQH

SEQ ID NO: 709662 - protein, 9 aa, Homo Sapiens
LSSEHSNGT

SEQ ID NO: 709663 - protein, 9 aa, Homo Sapiens
PEAAENLKS

SEQ ID NO: 709664 - protein, 9 aa, Homo Sapiens
GTKECYGTK

SEQ ID NO: 709665 - protein, 9 aa, Homo Sapiens
RAWYLLWKN

SEQ ID NO: 709666 - protein, 9 aa, Homo Sapiens
KISPRAMFV

SEQ ID NO: 709667 - protein, 9 aa, Homo Sapiens
VVGVFLRGF

SEQ ID NO: 709668 - protein, 9 aa, Homo Sapiens
DTAQRAELL

SEQ ID NO: 709669 - protein, 9 aa, Homo Sapiens
YDWELLNCV

SEQ ID NO: 709670 - protein, 9 aa, Homo Sapiens
LECKECGKA

SEQ ID NO: 709671 - protein, 9 aa, Homo Sapiens
FGLFGAVAA

SEQ ID NO: 709672 - protein, 9 aa, Homo Sapiens
DPSADPQLA

SEQ ID NO: 709673 - protein, 9 aa, Homo Sapiens
PMMMQMVVQ

SEQ ID NO: 709674 - protein, 9 aa, Homo Sapiens
VCTLCQEGR

SEQ ID NO: 709675 - protein, 9 aa, Homo Sapiens
VHITFVNSS

SEQ ID NO: 709676 - protein, 9 aa, Homo Sapiens
RLRDKSEAT

SEQ ID NO: 709677 - protein, 9 aa, Homo Sapiens
KPNKYGSST

SEQ ID NO: 709678 - protein, 9 aa, Homo Sapiens
TRVIALVVG

SEQ ID NO: 709679 - protein, 9 aa, Homo Sapiens
TCIQEYVQS

SEQ ID NO: 709680 - protein, 9 aa, Homo Sapiens
EPLEFSYPS

SEQ ID NO: 709681 - protein, 9 aa, Homo Sapiens
LIPTSMPHA

SEQ ID NO: 709682 - protein, 9 aa, Homo Sapiens
EDIFTSKTD

SEQ ID NO: 709683 - protein, 9 aa, Homo Sapiens
QSGIGLLIL

SEQ ID NO: 709684 - protein, 9 aa, Homo Sapiens
PLALTLAAV

SEQ ID NO: 709685 - protein, 9 aa, Homo Sapiens
QYLFQASQM

SEQ ID NO: 709686 - protein, 9 aa, Homo Sapiens
LICRFHCTE

SEQ ID NO: 709687 - protein, 9 aa, Homo Sapiens
KFKFTECGK

SEQ ID NO: 709688 - protein, 9 aa, Homo Sapiens
LKISPRAMF

SEQ ID NO: 709689 - protein, 9 aa, Homo Sapiens
ARLAEVEYL

SEQ ID NO: 709690 - protein, 9 aa, Homo Sapiens
REKLERILL

SEQ ID NO: 709691 - protein, 9 aa, Homo Sapiens
PKETGKRDG

SEQ ID NO: 709692 - protein, 9 aa, Homo Sapiens
HRGGHPLKK

SEQ ID NO: 709693 - protein, 9 aa, Homo Sapiens
SSVAIQEQM

SEQ ID NO: 709694 - protein, 9 aa, Homo Sapiens
EECPVGRYG

SEQ ID NO: 709695 - protein, 9 aa, Homo Sapiens
ALWRPPEAP

SEQ ID NO: 709696 - protein, 9 aa, Homo Sapiens
GPCLARLHL

SEQ ID NO: 709697 - protein, 9 aa, Homo Sapiens
RVKTLREEA

SEQ ID NO: 709698 - protein, 9 aa, Homo Sapiens
VHFKNKADN

SEQ ID NO: 709699 - protein, 9 aa, Homo Sapiens
QALNAKTDT

SEQ ID NO: 709700 - protein, 9 aa, Homo Sapiens
VGVVEPLPH

SEQ ID NO: 709701 - protein, 9 aa, Homo Sapiens
RPPLGPLDP

SEQ ID NO: 709702 - protein, 9 aa, Homo Sapiens
TKERLLLTV

SEQ ID NO: 709703 - protein, 9 aa, Homo Sapiens
IQEDYQYQK

SEQ ID NO: 709704 - protein, 9 aa, Homo Sapiens
RAHVHVCSS

SEQ ID NO: 709705 - protein, 9 aa, Homo Sapiens
WNLVSLGIC

SEQ ID NO: 709706 - protein, 9 aa, Homo Sapiens
ICHRFLSKC

SEQ ID NO: 709707 - protein, 9 aa, Homo Sapiens
PFLDISDNH

SEQ ID NO: 709708 - protein, 9 aa, Homo Sapiens
TIGLGWSRS

SEQ ID NO: 709709 - protein, 9 aa, Homo Sapiens
AFNGLKILN

SEQ ID NO: 709710 - protein, 9 aa, Homo Sapiens
WVDLTSVKP

SEQ ID NO: 709711 - protein, 9 aa, Homo Sapiens
AIKAIREVA

SEQ ID NO: 709712 - protein, 9 aa, Homo Sapiens
YNITIIVTD

SEQ ID NO: 709713 - protein, 9 aa, Homo Sapiens
MSGLRFVTL

SEQ ID NO: 709714 - protein, 9 aa, Homo Sapiens
DDRGKKDNA

SEQ ID NO: 709715 - protein, 9 aa, Homo Sapiens
PHHCLRSSF

SEQ ID NO: 709716 - protein, 9 aa, Homo Sapiens
QNNKDVLFG

SEQ ID NO: 709717 - protein, 9 aa, Homo Sapiens
EAQDLCGDF

SEQ ID NO: 709718 - protein, 9 aa, Homo Sapiens
PRWYHSSER

SEQ ID NO: 709719 - protein, 9 aa, Homo Sapiens
AKLVGVEEG

SEQ ID NO: 709720 - protein, 9 aa, Homo Sapiens
MFSSKYWAW

SEQ ID NO: 709721 - protein, 9 aa, Homo Sapiens
KDPHLHISM

SEQ ID NO: 709722 - protein, 9 aa, Homo Sapiens
PSADPQLAL

SEQ ID NO: 709723 - protein, 9 aa, Homo Sapiens
QIQWRLGAE

SEQ ID NO: 709724 - protein, 9 aa, Homo Sapiens
IQECTVNLR

SEQ ID NO: 709725 - protein, 9 aa, Homo Sapiens
LKKLLALNP

SEQ ID NO: 709726 - protein, 9 aa, Homo Sapiens
RLLLTVGVS

SEQ ID NO: 709727 - protein, 9 aa, Homo Sapiens
RDSQTIGLG

SEQ ID NO: 709728 - protein, 9 aa, Homo Sapiens
KPLKCNECG

SEQ ID NO: 709729 - protein, 9 aa, Homo Sapiens
SIAAIDDRG

SEQ ID NO: 709730 - protein, 9 aa, Homo Sapiens
LAEVEYLAE

SEQ ID NO: 709731 - protein, 9 aa, Homo Sapiens
SFDTRFKVG

SEQ ID NO: 709732 - protein, 9 aa, Homo Sapiens
LNRLYLHEN

SEQ ID NO: 709733 - protein, 9 aa, Homo Sapiens
DVLQNNKDV

SEQ ID NO: 709734 - protein, 9 aa, Homo Sapiens
QRLYYPVQG

SEQ ID NO: 709735 - protein, 9 aa, Homo Sapiens
SVVVPCEPP

SEQ ID NO: 709736 - protein, 9 aa, Homo Sapiens
LPWQLTLWR

SEQ ID NO: 709737 - protein, 9 aa, Homo Sapiens
TKEEFSGVN

SEQ ID NO: 709738 - protein, 9 aa, Homo Sapiens
PDGAIDMVL

SEQ ID NO: 709739 - protein, 9 aa, Homo Sapiens
QKVCRTEYR

SEQ ID NO: 709740 - protein, 9 aa, Homo Sapiens
DLELASEGE

SEQ ID NO: 709741 - protein, 9 aa, Homo Sapiens
ITEIIGDCC

SEQ ID NO: 709742 - protein, 9 aa, Homo Sapiens
CLRSSFRPQ

SEQ ID NO: 709743 - protein, 9 aa, Homo Sapiens
DTLNTVALS

SEQ ID NO: 709744 - protein, 9 aa, Homo Sapiens
FNAFDADVN

SEQ ID NO: 709745 - protein, 9 aa, Homo Sapiens
YRCVSDGQC

SEQ ID NO: 709746 - protein, 9 aa, Homo Sapiens
DLTSVKPHT

SEQ ID NO: 709747 - protein, 9 aa, Homo Sapiens
SVKPHTAKK

SEQ ID NO: 709748 - protein, 9 aa, Homo Sapiens
SNSCDRSSG

SEQ ID NO: 709749 - protein, 9 aa, Homo Sapiens
MSVWLRTPR

SEQ ID NO: 709750 - protein, 9 aa, Homo Sapiens
PMPFSSCSL

SEQ ID NO: 709751 - protein, 9 aa, Homo Sapiens
RVHITGDYA

SEQ ID NO: 709752 - protein, 9 aa, Homo Sapiens
ANAGPKTNG

SEQ ID NO: 709753 - protein, 9 aa, Homo Sapiens
APLPPPLAL

SEQ ID NO: 709754 - protein, 9 aa, Homo Sapiens
WLLGLLPEP

SEQ ID NO: 709755 - protein, 9 aa, Homo Sapiens
GPYQCETRD

SEQ ID NO: 709756 - protein, 9 aa, Homo Sapiens
VCRTEYRWS

SEQ ID NO: 709757 - protein, 9 aa, Homo Sapiens
GTTHLLVHY

SEQ ID NO: 709758 - protein, 9 aa, Homo Sapiens
GESHTEQLQ

SEQ ID NO: 709759 - protein, 9 aa, Homo Sapiens
KIRQVFRAD

SEQ ID NO: 709760 - protein, 9 aa, Homo Sapiens
MVVEWHHDG

SEQ ID NO: 709761 - protein, 9 aa, Homo Sapiens
DDCLMSLTR

SEQ ID NO: 709762 - protein, 9 aa, Homo Sapiens
EPKPPKTQC

SEQ ID NO: 709763 - protein, 9 aa, Homo Sapiens
SIFVLDQND

SEQ ID NO: 709764 - protein, 9 aa, Homo Sapiens
LSHPFAFGI

SEQ ID NO: 709765 - protein, 9 aa, Homo Sapiens
KPLECKECG

SEQ ID NO: 709766 - protein, 9 aa, Homo Sapiens
QDGEEEKED

SEQ ID NO: 709767 - protein, 9 aa, Homo Sapiens
SFGPSDDDK

SEQ ID NO: 709768 - protein, 9 aa, Homo Sapiens
LKKGASLNV

SEQ ID NO: 709769 - protein, 9 aa, Homo Sapiens
RRLHKDHQI

SEQ ID NO: 709770 - protein, 9 aa, Homo Sapiens
KVEIVSMFQ

SEQ ID NO: 709771 - protein, 9 aa, Homo Sapiens
HLLVHYVAL

SEQ ID NO: 709772 - protein, 9 aa, Homo Sapiens
QSIWNPQHL

SEQ ID NO: 709773 - protein, 9 aa, Homo Sapiens
STPHHCLRS

SEQ ID NO: 709774 - protein, 9 aa, Homo Sapiens
GNYAVWFRL

SEQ ID NO: 709775 - protein, 9 aa, Homo Sapiens
AYKLVTVKL

SEQ ID NO: 709776 - protein, 9 aa, Homo Sapiens
STKLQIAAM

SEQ ID NO: 709777 - protein, 9 aa, Homo Sapiens
VKQVEVVTA

SEQ ID NO: 709778 - protein, 9 aa, Homo Sapiens
AIGKVSFGK

SEQ ID NO: 709779 - protein, 9 aa, Homo Sapiens
CTLCQEGRC

SEQ ID NO: 709780 - protein, 9 aa, Homo Sapiens
MKQDRINRY

SEQ ID NO: 709781 - protein, 9 aa, Homo Sapiens
CYCYFAHRR

SEQ ID NO: 709782 - protein, 9 aa, Homo Sapiens
MGKHKICSS

SEQ ID NO: 709783 - protein, 9 aa, Homo Sapiens
LLIGISEMF

SEQ ID NO: 709784 - protein, 9 aa, Homo Sapiens
AVSTGEKGF

SEQ ID NO: 709785 - protein, 9 aa, Homo Sapiens
RRKKKVSII

SEQ ID NO: 709786 - protein, 9 aa, Homo Sapiens
HGRGSESKP

SEQ ID NO: 709787 - protein, 9 aa, Homo Sapiens
IVTDLGTPR

SEQ ID NO: 709788 - protein, 9 aa, Homo Sapiens
RVPPADFDP

SEQ ID NO: 709789 - protein, 9 aa, Homo Sapiens
FDTRFKVGT

SEQ ID NO: 709790 - protein, 9 aa, Homo Sapiens
ETVCTLCQE

SEQ ID NO: 709791 - protein, 9 aa, Homo Sapiens
SYPSYLALG

SEQ ID NO: 709792 - protein, 9 aa, Homo Sapiens
GTEIETAIV

SEQ ID NO: 709793 - protein, 9 aa, Homo Sapiens
TVQLMFIPR

SEQ ID NO: 709794 - protein, 9 aa, Homo Sapiens
HVVNSLVSD

SEQ ID NO: 709795 - protein, 9 aa, Homo Sapiens
KLVTVKLKW

SEQ ID NO: 709796 - protein, 9 aa, Homo Sapiens
VPDFQRVHI

SEQ ID NO: 709797 - protein, 9 aa, Homo Sapiens
ALSIVCQIR

SEQ ID NO: 709798 - protein, 9 aa, Homo Sapiens
PRCADPQIS

SEQ ID NO: 709799 - protein, 9 aa, Homo Sapiens
VKAVRLIAE

SEQ ID NO: 709800 - protein, 9 aa, Homo Sapiens
DPVLNPVLI

SEQ ID NO: 709801 - protein, 9 aa, Homo Sapiens
QTIGLGWSR

SEQ ID NO: 709802 - protein, 9 aa, Homo Sapiens
SCVDFSNMA

SEQ ID NO: 709803 - protein, 9 aa, Homo Sapiens
IVSMFQEDE

SEQ ID NO: 709804 - protein, 9 aa, Homo Sapiens
QPMYFFFCM

SEQ ID NO: 709805 - protein, 9 aa, Homo Sapiens
SMEPTFAFL

SEQ ID NO: 709806 - protein, 9 aa, Homo Sapiens
DVYRRAIEI

SEQ ID NO: 709807 - protein, 9 aa, Homo Sapiens
DDRRESIVA

SEQ ID NO: 709808 - protein, 9 aa, Homo Sapiens
EAALVDVNL

SEQ ID NO: 709809 - protein, 9 aa, Homo Sapiens
QGPIERAHV

SEQ ID NO: 709810 - protein, 9 aa, Homo Sapiens
LADTAQRAE

SEQ ID NO: 709811 - protein, 9 aa, Homo Sapiens
GPEVMIKQP

SEQ ID NO: 709812 - protein, 9 aa, Homo Sapiens
TDTAELTLL

SEQ ID NO: 709813 - protein, 9 aa, Homo Sapiens
LLICRFHCT

SEQ ID NO: 709814 - protein, 9 aa, Homo Sapiens
SWKDSSLPS

SEQ ID NO: 709815 - protein, 9 aa, Homo Sapiens
ERFKDICEA

SEQ ID NO: 709816 - protein, 9 aa, Homo Sapiens
FRSFTRESL

SEQ ID NO: 709817 - protein, 9 aa, Homo Sapiens
CRNLDIERP

SEQ ID NO: 709818 - protein, 9 aa, Homo Sapiens
KDNIATLLH

SEQ ID NO: 709819 - protein, 9 aa, Homo Sapiens
LLFGLFGAV

SEQ ID NO: 709820 - protein, 9 aa, Homo Sapiens
LQGPIERAH

SEQ ID NO: 709821 - protein, 9 aa, Homo Sapiens
RERPSAPWG

SEQ ID NO: 709822 - protein, 9 aa, Homo Sapiens
TSSFRSFTR

SEQ ID NO: 709823 - protein, 9 aa, Homo Sapiens
KTTPSSHKT

SEQ ID NO: 709824 - protein, 9 aa, Homo Sapiens
EKDYPKNTK

SEQ ID NO: 709825 - protein, 9 aa, Homo Sapiens
KALDVYRRA

SEQ ID NO: 709826 - protein, 9 aa, Homo Sapiens
PRGTSSFRS

SEQ ID NO: 709827 - protein, 9 aa, Homo Sapiens
TEEALDSNL

SEQ ID NO: 709828 - protein, 9 aa, Homo Sapiens
GSLKMEFKG

SEQ ID NO: 709829 - protein, 9 aa, Homo Sapiens
RGSESKPCG

SEQ ID NO: 709830 - protein, 9 aa, Homo Sapiens
LFLSKAVAS

SEQ ID NO: 709831 - protein, 9 aa, Homo Sapiens
WQLTLWRPP

SEQ ID NO: 709832 - protein, 9 aa, Homo Sapiens
ILDFGLALQ

SEQ ID NO: 709833 - protein, 9 aa, Homo Sapiens
SLQHWLSLP

SEQ ID NO: 709834 - protein, 9 aa, Homo Sapiens
IISEHLRSF

SEQ ID NO: 709835 - protein, 9 aa, Homo Sapiens
VLAYAVYDD

SEQ ID NO: 709836 - protein, 9 aa, Homo Sapiens
PQYLWTCIQ

SEQ ID NO: 709837 - protein, 9 aa, Homo Sapiens
HHCLRSSFR

SEQ ID NO: 709838 - protein, 9 aa, Homo Sapiens
LEKTQEPNP

SEQ ID NO: 709839 - protein, 9 aa, Homo Sapiens
DRSSGQQGG

SEQ ID NO: 709840 - protein, 9 aa, Homo Sapiens
APLMGKHKI

SEQ ID NO: 709841 - protein, 9 aa, Homo Sapiens
QLTLWRPPL

SEQ ID NO: 709842 - protein, 9 aa, Homo Sapiens
LELSLALLN

SEQ ID NO: 709843 - protein, 9 aa, Homo Sapiens
AIVTSIGMH

SEQ ID NO: 709844 - protein, 9 aa, Homo Sapiens
LAREDQRFA

SEQ ID NO: 709845 - protein, 9 aa, Homo Sapiens
DTLSLVIAD

SEQ ID NO: 709846 - protein, 9 aa, Homo Sapiens
PSYLALGEA

SEQ ID NO: 709847 - protein, 9 aa, Homo Sapiens
MSPEEAAWC

SEQ ID NO: 709848 - protein, 9 aa, Homo Sapiens
PWSTRETEL

SEQ ID NO: 709849 - protein, 9 aa, Homo Sapiens
SEPQIVHIT

SEQ ID NO: 709850 - protein, 9 aa, Homo Sapiens
RLDRLPHLH

SEQ ID NO: 709851 - protein, 9 aa, Homo Sapiens
LGLLPEPNW

SEQ ID NO: 709852 - protein, 9 aa, Homo Sapiens
GPYKVSHVV

SEQ ID NO: 709853 - protein, 9 aa, Homo Sapiens
WLQKTIKER

SEQ ID NO: 709854 - protein, 9 aa, Homo Sapiens
CADNYRGSE

SEQ ID NO: 709855 - protein, 9 aa, Homo Sapiens
SRICGSVLT

SEQ ID NO: 709856 - protein, 9 aa, Homo Sapiens
GDRHHGGAS

SEQ ID NO: 709857 - protein, 9 aa, Homo Sapiens
VWAFGVTMC

SEQ ID NO: 709858 - protein, 9 aa, Homo Sapiens
KWWCEIEPC

SEQ ID NO: 709859 - protein, 9 aa, Homo Sapiens
FLDVVQLVY

SEQ ID NO: 709860 - protein, 9 aa, Homo Sapiens
RWYHSSERG

SEQ ID NO: 709861 - protein, 9 aa, Homo Sapiens
VLDDEGGLV

SEQ ID NO: 709862 - protein, 9 aa, Homo Sapiens
LRQKFPFVP

SEQ ID NO: 709863 - protein, 9 aa, Homo Sapiens
LPMSVWLRT

SEQ ID NO: 709864 - protein, 9 aa, Homo Sapiens
RRLLQPVGT

SEQ ID NO: 709865 - protein, 9 aa, Homo Sapiens
SCSLSCLNL

SEQ ID NO: 709866 - protein, 9 aa, Homo Sapiens
PKIQKLVLE

SEQ ID NO: 709867 - protein, 9 aa, Homo Sapiens
RKGRQSIWN

SEQ ID NO: 709868 - protein, 9 aa, Homo Sapiens
LWRPPLGPL

SEQ ID NO: 709869 - protein, 9 aa, Homo Sapiens
QIWTPLTLA

SEQ ID NO: 709870 - protein, 9 aa, Homo Sapiens
CQIRMDRGG

SEQ ID NO: 709871 - protein, 9 aa, Homo Sapiens
NLYLIIAIC

SEQ ID NO: 709872 - protein, 9 aa, Homo Sapiens
TPSSHKTSE

SEQ ID NO: 709873 - protein, 9 aa, Homo Sapiens
SAEEFFMLG

SEQ ID NO: 709874 - protein, 9 aa, Homo Sapiens
SRRKKKVSI

SEQ ID NO: 709875 - protein, 9 aa, Homo Sapiens
PLHLAIKHS

SEQ ID NO: 709876 - protein, 9 aa, Homo Sapiens
VLNSGIAYV

SEQ ID NO: 709877 - protein, 9 aa, Homo Sapiens
VQLMFIPRS

SEQ ID NO: 709878 - protein, 9 aa, Homo Sapiens
EKANTKTRR

SEQ ID NO: 709879 - protein, 9 aa, Homo Sapiens
SDDDKGTPT

SEQ ID NO: 709880 - protein, 9 aa, Homo Sapiens
SSFRSFTRE

SEQ ID NO: 709881 - protein, 9 aa, Homo Sapiens
TSHQSHLYG

SEQ ID NO: 709882 - protein, 9 aa, Homo Sapiens
GKTTPSSHK

SEQ ID NO: 709883 - protein, 9 aa, Homo Sapiens
GGSGGGGDR

SEQ ID NO: 709884 - protein, 9 aa, Homo Sapiens
KGLQGACMG

SEQ ID NO: 709885 - protein, 9 aa, Homo Sapiens
WFRLYGVHR

SEQ ID NO: 709886 - protein, 9 aa, Homo Sapiens
AALVDVNLY

SEQ ID NO: 709887 - protein, 9 aa, Homo Sapiens
ELLELSLAL

SEQ ID NO: 709888 - protein, 9 aa, Homo Sapiens
CASVHPKTF

SEQ ID NO: 709889 - protein, 9 aa, Homo Sapiens
HLYAVGGLS

SEQ ID NO: 709890 - protein, 9 aa, Homo Sapiens
PQVYSTTSP

SEQ ID NO: 709891 - protein, 9 aa, Homo Sapiens
SATKDLSAS

SEQ ID NO: 709892 - protein, 9 aa, Homo Sapiens
PNGSPGAAT

SEQ ID NO: 709893 - protein, 9 aa, Homo Sapiens
PVTTQLALW

SEQ ID NO: 709894 - protein, 9 aa, Homo Sapiens
YQCETRDRY

SEQ ID NO: 709895 - protein, 9 aa, Homo Sapiens
RPPEAPLDP

SEQ ID NO: 709896 - protein, 9 aa, Homo Sapiens
GSGGGGDRH

SEQ ID NO: 709897 - protein, 9 aa, Homo Sapiens
VLHHLIHPA

SEQ ID NO: 709898 - protein, 9 aa, Homo Sapiens
RAMIDEFRP

SEQ ID NO: 709899 - protein, 9 aa, Homo Sapiens
INRYQGANV

SEQ ID NO: 709900 - protein, 9 aa, Homo Sapiens
ENFRAVSTG

SEQ ID NO: 709901 - protein, 9 aa, Homo Sapiens
DYPKNTKEE

SEQ ID NO: 709902 - protein, 9 aa, Homo Sapiens
TDSRHHKKR

SEQ ID NO: 709903 - protein, 9 aa, Homo Sapiens
ALLVQLAMS

SEQ ID NO: 709904 - protein, 9 aa, Homo Sapiens
CRTEYRWSQ

SEQ ID NO: 709905 - protein, 9 aa, Homo Sapiens
AWRGFSLDS

SEQ ID NO: 709906 - protein, 9 aa, Homo Sapiens
PVHGESHTE

SEQ ID NO: 709907 - protein, 9 aa, Homo Sapiens
HSGDRLYEC

SEQ ID NO: 709908 - protein, 9 aa, Homo Sapiens
KILKISPRA

SEQ ID NO: 709909 - protein, 9 aa, Homo Sapiens
IHSGDRLYE

SEQ ID NO: 709910 - protein, 9 aa, Homo Sapiens
AFLEDIFTS

SEQ ID NO: 709911 - protein, 9 aa, Homo Sapiens
PPLALTLAA

SEQ ID NO: 709912 - protein, 9 aa, Homo Sapiens
LATSMKSET

SEQ ID NO: 709913 - protein, 9 aa, Homo Sapiens
GSDTIKIKA

SEQ ID NO: 709914 - protein, 9 aa, Homo Sapiens
HFKNKADNP

SEQ ID NO: 709915 - protein, 9 aa, Homo Sapiens
SVAIQEQML

SEQ ID NO: 709916 - protein, 9 aa, Homo Sapiens
NEKEPVLTS

SEQ ID NO: 709917 - protein, 9 aa, Homo Sapiens
EFFMLGYRV

SEQ ID NO: 709918 - protein, 9 aa, Homo Sapiens
KTRRSQTQT

SEQ ID NO: 709919 - protein, 9 aa, Homo Sapiens
LQGLLGHFP

SEQ ID NO: 709920 - protein, 9 aa, Homo Sapiens
CDRSSGQQG

SEQ ID NO: 709921 - protein, 9 aa, Homo Sapiens
GRGSESKPC

SEQ ID NO: 709922 - protein, 9 aa, Homo Sapiens
KRVAKLVGV

SEQ ID NO: 709923 - protein, 9 aa, Homo Sapiens
LKLCLYLAE

SEQ ID NO: 709924 - protein, 9 aa, Homo Sapiens
FLDISDNHS

SEQ ID NO: 709925 - protein, 9 aa, Homo Sapiens
VEVVTAYVT

SEQ ID NO: 709926 - protein, 9 aa, Homo Sapiens
NSVWGREES

SEQ ID NO: 709927 - protein, 9 aa, Homo Sapiens
MKPNKYGSS

SEQ ID NO: 709928 - protein, 9 aa, Homo Sapiens
AAELELEKT

SEQ ID NO: 709929 - protein, 9 aa, Homo Sapiens
PWQLTLWRP

SEQ ID NO: 709930 - protein, 9 aa, Homo Sapiens
EISLNSVWG

SEQ ID NO: 709931 - protein, 9 aa, Homo Sapiens
VTLYTENQD

SEQ ID NO: 709932 - protein, 9 aa, Homo Sapiens
VGHLDFFAN

SEQ ID NO: 709933 - protein, 9 aa, Homo Sapiens
NARLAEVEY

SEQ ID NO: 709934 - protein, 9 aa, Homo Sapiens
DFSNMASLR

SEQ ID NO: 709935 - protein, 9 aa, Homo Sapiens
LIISEHLRS

SEQ ID NO: 709936 - protein, 9 aa, Homo Sapiens
NPLSIHPQG

SEQ ID NO: 709937 - protein, 9 aa, Homo Sapiens
LITHHQTHT

SEQ ID NO: 709938 - protein, 9 aa, Homo Sapiens
FSSKYWAWR

SEQ ID NO: 709939 - protein, 9 aa, Homo Sapiens
RFRTGQCNN

SEQ ID NO: 709940 - protein, 9 aa, Homo Sapiens
RVNLLFGLF

SEQ ID NO: 709941 - protein, 9 aa, Homo Sapiens
EGIKGMVKA

SEQ ID NO: 709942 - protein, 9 aa, Homo Sapiens
TKDLSASLA

SEQ ID NO: 709943 - protein, 9 aa, Homo Sapiens
PLGPLDPLL

SEQ ID NO: 709944 - protein, 9 aa, Homo Sapiens
TSGAPVTTQ

SEQ ID NO: 709945 - protein, 9 aa, Homo Sapiens
FVTLYTENQ

SEQ ID NO: 709946 - protein, 9 aa, Homo Sapiens
KKGASLNVC

SEQ ID NO: 709947 - protein, 9 aa, Homo Sapiens
LRYLQTLRT

SEQ ID NO: 709948 - protein, 9 aa, Homo Sapiens
GTGVRFRTG

SEQ ID NO: 709949 - protein, 9 aa, Homo Sapiens
ETRDRYGGI

SEQ ID NO: 709950 - protein, 9 aa, Homo Sapiens
VTSDDFHHT

SEQ ID NO: 709951 - protein, 9 aa, Homo Sapiens
LKSSVAIQE

SEQ ID NO: 709952 - protein, 9 aa, Homo Sapiens
NRICGLPVR

SEQ ID NO: 709953 - protein, 9 aa, Homo Sapiens
KVSHVVGYI

SEQ ID NO: 709954 - protein, 9 aa, Homo Sapiens
DSLKDKAQK

SEQ ID NO: 709955 - protein, 9 aa, Homo Sapiens
MISDSLISA

SEQ ID NO: 709956 - protein, 9 aa, Homo Sapiens
HSCFLVSFM

SEQ ID NO: 709957 - protein, 9 aa, Homo Sapiens
LHPMDTVPT

SEQ ID NO: 709958 - protein, 9 aa, Homo Sapiens
LTSVKPHTA

SEQ ID NO: 709959 - protein, 9 aa, Homo Sapiens
RICGSVLTT

SEQ ID NO: 709960 - protein, 9 aa, Homo Sapiens
LTPDGAIDM

SEQ ID NO: 709961 - protein, 9 aa, Homo Sapiens
VPIPQAPSG

SEQ ID NO: 709962 - protein, 9 aa, Homo Sapiens
KADNPLSIH

SEQ ID NO: 709963 - protein, 9 aa, Homo Sapiens
FFANGGVEM

SEQ ID NO: 709964 - protein, 9 aa, Homo Sapiens
IVLGNRHVL

SEQ ID NO: 709965 - protein, 9 aa, Homo Sapiens
PSGLAGPVR

SEQ ID NO: 709966 - protein, 9 aa, Homo Sapiens
SFKISALKL

SEQ ID NO: 709967 - protein, 9 aa, Homo Sapiens
RVQHIDRSD

SEQ ID NO: 709968 - protein, 9 aa, Homo Sapiens
QRLDRLPHL

SEQ ID NO: 709969 - protein, 9 aa, Homo Sapiens
WAFGVTMCE

SEQ ID NO: 709970 - protein, 9 aa, Homo Sapiens
TQLALWRPP

SEQ ID NO: 709971 - protein, 9 aa, Homo Sapiens
DKGSVKKSS

SEQ ID NO: 709972 - protein, 9 aa, Homo Sapiens
LGGSTLTLL

SEQ ID NO: 709973 - protein, 9 aa, Homo Sapiens
CPVGRYGQD

SEQ ID NO: 709974 - protein, 9 aa, Homo Sapiens
WGREESERI

SEQ ID NO: 709975 - protein, 9 aa, Homo Sapiens
ECLGGSTLT

SEQ ID NO: 709976 - protein, 9 aa, Homo Sapiens
VTMCEIMTR

SEQ ID NO: 709977 - protein, 9 aa, Homo Sapiens
KQQLSSPLP

SEQ ID NO: 709978 - protein, 9 aa, Homo Sapiens
SLNSVWGRE

SEQ ID NO: 709979 - protein, 9 aa, Homo Sapiens
SFGYKGTFP

SEQ ID NO: 709980 - protein, 9 aa, Homo Sapiens
IDDRGKKDN

SEQ ID NO: 709981 - protein, 9 aa, Homo Sapiens
SLITHHQTH

SEQ ID NO: 709982 - protein, 9 aa, Homo Sapiens
VVNSLVSDI

SEQ ID NO: 709983 - protein, 9 aa, Homo Sapiens
VPEVPEEIV

SEQ ID NO: 709984 - protein, 9 aa, Homo Sapiens
APVTTQLAL

SEQ ID NO: 709985 - protein, 9 aa, Homo Sapiens
QMEARTLQP

SEQ ID NO: 709986 - protein, 9 aa, Homo Sapiens
VNSLVSDIE

SEQ ID NO: 709987 - protein, 9 aa, Homo Sapiens
TAENFRAVS

SEQ ID NO: 709988 - protein, 9 aa, Homo Sapiens
LPNGSPGAA

SEQ ID NO: 709989 - protein, 9 aa, Homo Sapiens
RIKQGWNYG

SEQ ID NO: 709990 - protein, 9 aa, Homo Sapiens
YGGLADTAQ

SEQ ID NO: 709991 - protein, 9 aa, Homo Sapiens
PGMDKGLQG

SEQ ID NO: 709992 - protein, 9 aa, Homo Sapiens
APIKRCPKF

SEQ ID NO: 709993 - protein, 9 aa, Homo Sapiens
ANTKTRRSQ

SEQ ID NO: 709994 - protein, 9 aa, Homo Sapiens
NALIYTLRN

SEQ ID NO: 709995 - protein, 9 aa, Homo Sapiens
SLVIADHSH

SEQ ID NO: 709996 - protein, 9 aa, Homo Sapiens
LCGDFRYVT

SEQ ID NO: 709997 - protein, 9 aa, Homo Sapiens
LHISMYLFL

SEQ ID NO: 709998 - protein, 9 aa, Homo Sapiens
KKEKLNVPE

SEQ ID NO: 709999 - protein, 9 aa, Homo Sapiens
VVLAYAVYD

SEQ ID NO: 710000 - protein, 9 aa, Homo Sapiens
TNENSLLKQ

SEQ ID NO: 710001 - protein, 9 aa, Homo Sapiens
HNHLYMMVL

SEQ ID NO: 710002 - protein, 9 aa, Homo Sapiens
VDFSNMASL

SEQ ID NO: 710003 - protein, 9 aa, Homo Sapiens
SSYECTNEN

SEQ ID NO: 710004 - protein, 9 aa, Homo Sapiens
AVHVRRKHS

SEQ ID NO: 710005 - protein, 9 aa, Homo Sapiens
LPEPQYLFQ

SEQ ID NO: 710006 - protein, 9 aa, Homo Sapiens
ADNPLSIHP

SEQ ID NO: 710007 - protein, 9 aa, Homo Sapiens
ALPMSVWLR

SEQ ID NO: 710008 - protein, 9 aa, Homo Sapiens
QRQKTHSGA

SEQ ID NO: 710009 - protein, 9 aa, Homo Sapiens
IWKMLSEIC

SEQ ID NO: 710010 - protein, 9 aa, Homo Sapiens
SGSCSRLLR

SEQ ID NO: 710011 - protein, 9 aa, Homo Sapiens
KYWAWRGFS

SEQ ID NO: 710012 - protein, 9 aa, Homo Sapiens
QPGMAAVTV

SEQ ID NO: 710013 - protein, 9 aa, Homo Sapiens
PIKRCPKFK

SEQ ID NO: 710014 - protein, 9 aa, Homo Sapiens
GPHAKACSR

SEQ ID NO: 710015 - protein, 9 aa, Homo Sapiens
GGPDKGSVK

SEQ ID NO: 710016 - protein, 9 aa, Homo Sapiens
GQDCIVQLG

SEQ ID NO: 710017 - protein, 9 aa, Homo Sapiens
VPGVCGDVS

SEQ ID NO: 710018 - protein, 9 aa, Homo Sapiens
HPKTFPVVL

SEQ ID NO: 710019 - protein, 9 aa, Homo Sapiens
CLARLHLPL

SEQ ID NO: 710020 - protein, 9 aa, Homo Sapiens
QLALWRPPE

SEQ ID NO: 710021 - protein, 9 aa, Homo Sapiens
MWEDYEFKY

SEQ ID NO: 710022 - protein, 9 aa, Homo Sapiens
PMALLVQLA

SEQ ID NO: 710023 - protein, 9 aa, Homo Sapiens
YSTTSPPFG

SEQ ID NO: 710024 - protein, 9 aa, Homo Sapiens
AIYDICCRN

SEQ ID NO: 710025 - protein, 9 aa, Homo Sapiens
TPMALLVQL

SEQ ID NO: 710026 - protein, 9 aa, Homo Sapiens
HLDFFANGG

SEQ ID NO: 710027 - protein, 9 aa, Homo Sapiens
WKDPHLHIS

SEQ ID NO: 710028 - protein, 9 aa, Homo Sapiens
FLGFTDYPK

SEQ ID NO: 710029 - protein, 9 aa, Homo Sapiens
SGAPVTTQL

SEQ ID NO: 710030 - protein, 9 aa, Homo Sapiens
NLQMTALFS

SEQ ID NO: 710031 - protein, 9 aa, Homo Sapiens
EVDCWPLPF

SEQ ID NO: 710032 - protein, 9 aa, Homo Sapiens
RHSVVVPCE

SEQ ID NO: 710033 - protein, 9 aa, Homo Sapiens
TRRSQTQTI

SEQ ID NO: 710034 - protein, 9 aa, Homo Sapiens
AIDDRGKKD

SEQ ID NO: 710035 - protein, 9 aa, Homo Sapiens
SNMASLRSL

SEQ ID NO: 710036 - protein, 9 aa, Homo Sapiens
TKTISISRV

SEQ ID NO: 710037 - protein, 9 aa, Homo Sapiens
FPDVECEFS

SEQ ID NO: 710038 - protein, 9 aa, Homo Sapiens
QTKTISISR

SEQ ID NO: 710039 - protein, 9 aa, Homo Sapiens
VHITGDYAS

SEQ ID NO: 710040 - protein, 9 aa, Homo Sapiens
RLSRTFSQA

SEQ ID NO: 710041 - protein, 9 aa, Homo Sapiens
KKRNKALQE

SEQ ID NO: 710042 - protein, 9 aa, Homo Sapiens
DSQTIGLGW

SEQ ID NO: 710043 - protein, 9 aa, Homo Sapiens
YQKPKTMIA

SEQ ID NO: 710044 - protein, 9 aa, Homo Sapiens
TMCEIMTRG

SEQ ID NO: 710045 - protein, 9 aa, Homo Sapiens
RTGQCNNPM

SEQ ID NO: 710046 - protein, 9 aa, Homo Sapiens
VLGNRHVLV

SEQ ID NO: 710047 - protein, 9 aa, Homo Sapiens
SIVCQIRMD

SEQ ID NO: 710048 - protein, 9 aa, Homo Sapiens
SMKRVAKLV

SEQ ID NO: 710049 - protein, 9 aa, Homo Sapiens
TLSLVIADH

SEQ ID NO: 710050 - protein, 9 aa, Homo Sapiens
AALPMSVWL

SEQ ID NO: 710051 - protein, 9 aa, Homo Sapiens
TSVSLSSPT

SEQ ID NO: 710052 - protein, 9 aa, Homo Sapiens
AALVTGMEL

SEQ ID NO: 710053 - protein, 9 aa, Homo Sapiens
IQIGFIESG

SEQ ID NO: 710054 - protein, 9 aa, Homo Sapiens
HTKELLELS

SEQ ID NO: 710055 - protein, 9 aa, Homo Sapiens
ESWLRRKLR

SEQ ID NO: 710056 - protein, 9 aa, Homo Sapiens
SDGQCGPER

SEQ ID NO: 710057 - protein, 9 aa, Homo Sapiens
YRKYNNVSD

SEQ ID NO: 710058 - protein, 9 aa, Homo Sapiens
ESLLTTNIV

SEQ ID NO: 710059 - protein, 9 aa, Homo Sapiens
ELLNCVHEL

SEQ ID NO: 710060 - protein, 9 aa, Homo Sapiens
SVTTPLFNA

SEQ ID NO: 710061 - protein, 9 aa, Homo Sapiens
RVIALVVGV

SEQ ID NO: 710062 - protein, 9 aa, Homo Sapiens
MLLTQKDHP

SEQ ID NO: 710063 - protein, 9 aa, Homo Sapiens
CQGLGFVGS

SEQ ID NO: 710064 - protein, 9 aa, Homo Sapiens
DFQRVHITG

SEQ ID NO: 710065 - protein, 9 aa, Homo Sapiens
SSPLEALKA

SEQ ID NO: 710066 - protein, 9 aa, Homo Sapiens
PLPEPQYLF

SEQ ID NO: 710067 - protein, 9 aa, Homo Sapiens
GLLPEPNWT

SEQ ID NO: 710068 - protein, 9 aa, Homo Sapiens
LIQLGQEEV

SEQ ID NO: 710069 - protein, 9 aa, Homo Sapiens
RPQKVCRTE

SEQ ID NO: 710070 - protein, 9 aa, Homo Sapiens
NASGSDCDL

SEQ ID NO: 710071 - protein, 9 aa, Homo Sapiens
VLFGNIREL

SEQ ID NO: 710072 - protein, 9 aa, Homo Sapiens
METREKLER

SEQ ID NO: 710073 - protein, 9 aa, Homo Sapiens
LWLPMMMQM

SEQ ID NO: 710074 - protein, 9 aa, Homo Sapiens
EKEAQAKFR

SEQ ID NO: 710075 - protein, 9 aa, Homo Sapiens
ALFSEKILQ

SEQ ID NO: 710076 - protein, 9 aa, Homo Sapiens
PIPQAPSGL

SEQ ID NO: 710077 - protein, 9 aa, Homo Sapiens
VFGEIQECT

SEQ ID NO: 710078 - protein, 9 aa, Homo Sapiens
TPSYGLARG

SEQ ID NO: 710079 - protein, 9 aa, Homo Sapiens
LCYLNTVNG

SEQ ID NO: 710080 - protein, 9 aa, Homo Sapiens
KLGKLYVNV

SEQ ID NO: 710081 - protein, 9 aa, Homo Sapiens
RSNSCDRSS

SEQ ID NO: 710082 - protein, 9 aa, Homo Sapiens
YEFKYKPGD

SEQ ID NO: 710083 - protein, 9 aa, Homo Sapiens
PGPHAKACS

SEQ ID NO: 710084 - protein, 9 aa, Homo Sapiens
KPDKGIVIP

SEQ ID NO: 710085 - protein, 9 aa, Homo Sapiens
KQDRINRYQ

SEQ ID NO: 710086 - protein, 9 aa, Homo Sapiens
GEKANTKTR

SEQ ID NO: 710087 - protein, 9 aa, Homo Sapiens
DIRCILPKL

SEQ ID NO: 710088 - protein, 9 aa, Homo Sapiens
FCMLAAIDL

SEQ ID NO: 710089 - protein, 9 aa, Homo Sapiens
QEDYQYQKP

SEQ ID NO: 710090 - protein, 9 aa, Homo Sapiens
EEFFMLGYR

SEQ ID NO: 710091 - protein, 9 aa, Homo Sapiens
QRWLQKTIK

SEQ ID NO: 710092 - protein, 9 aa, Homo Sapiens
HISMYLFLG

SEQ ID NO: 710093 - protein, 9 aa, Homo Sapiens
ICGSVLTTV

SEQ ID NO: 710094 - protein, 9 aa, Homo Sapiens
DKPFVEPVE

SEQ ID NO: 710095 - protein, 9 aa, Homo Sapiens
VRKALDVYR

SEQ ID NO: 710096 - protein, 9 aa, Homo Sapiens
VEIVSMFQE

SEQ ID NO: 710097 - protein, 9 aa, Homo Sapiens
EGGLVSYPS

SEQ ID NO: 710098 - protein, 9 aa, Homo Sapiens
RKAAYYENP

SEQ ID NO: 710099 - protein, 9 aa, Homo Sapiens
QRTAYFSFD

SEQ ID NO: 710100 - protein, 9 aa, Homo Sapiens
LSEKKPINV

SEQ ID NO: 710101 - protein, 9 aa, Homo Sapiens
KKRKKLCQL

SEQ ID NO: 710102 - protein, 9 aa, Homo Sapiens
IGLGWSRSP

SEQ ID NO: 710103 - protein, 9 aa, Homo Sapiens
GRQSIWNPQ

SEQ ID NO: 710104 - protein, 9 aa, Homo Sapiens
QGWNYGIQQ

SEQ ID NO: 710105 - protein, 9 aa, Homo Sapiens
ALDSNLYSA

SEQ ID NO: 710106 - protein, 9 aa, Homo Sapiens
TSGTTGETD

SEQ ID NO: 710107 - protein, 9 aa, Homo Sapiens
GLADTAQRA

SEQ ID NO: 710108 - protein, 9 aa, Homo Sapiens
CAGSLAQEA

SEQ ID NO: 710109 - protein, 9 aa, Homo Sapiens
LFNALIYTL

SEQ ID NO: 710110 - protein, 9 aa, Homo Sapiens
IGISEMFAS

SEQ ID NO: 710111 - protein, 9 aa, Homo Sapiens
PECTMRKAA

SEQ ID NO: 710112 - protein, 9 aa, Homo Sapiens
RKYNNVSDL

SEQ ID NO: 710113 - protein, 9 aa, Homo Sapiens
NENTTPSLA

SEQ ID NO: 710114 - protein, 9 aa, Homo Sapiens
EYNITIIVT

SEQ ID NO: 710115 - protein, 9 aa, Homo Sapiens
NCVKLNEER

SEQ ID NO: 710116 - protein, 9 aa, Homo Sapiens
SLPGPHAKA

SEQ ID NO: 710117 - protein, 9 aa, Homo Sapiens
KGKEDKILK

SEQ ID NO: 710118 - protein, 9 aa, Homo Sapiens
EEIVPEKKT

SEQ ID NO: 710119 - protein, 9 aa, Homo Sapiens
NENSLLKQT

SEQ ID NO: 710120 - protein, 9 aa, Homo Sapiens
WPREALLSE

SEQ ID NO: 710121 - protein, 9 aa, Homo Sapiens
PEEIVPEKK

SEQ ID NO: 710122 - protein, 9 aa, Homo Sapiens
SFYGGLADT

SEQ ID NO: 710123 - protein, 9 aa, Homo Sapiens
VVGHLDFFA

SEQ ID NO: 710124 - protein, 9 aa, Homo Sapiens
WKCEECGKA

SEQ ID NO: 710125 - protein, 9 aa, Homo Sapiens
SHILEVIDK

SEQ ID NO: 710126 - protein, 9 aa, Homo Sapiens
GLLILKEEM

SEQ ID NO: 710127 - protein, 9 aa, Homo Sapiens
WWCEIEPCL

SEQ ID NO: 710128 - protein, 9 aa, Homo Sapiens
FVEPVEEYD

SEQ ID NO: 710129 - protein, 9 aa, Homo Sapiens
NHAVLESRG

SEQ ID NO: 710130 - protein, 9 aa, Homo Sapiens
PPPSAKDVS

SEQ ID NO: 710131 - protein, 9 aa, Homo Sapiens
CEIMTRGQT

SEQ ID NO: 710132 - protein, 9 aa, Homo Sapiens
EKPHIFEEC

SEQ ID NO: 710133 - protein, 9 aa, Homo Sapiens
RLDDCLMSL

SEQ ID NO: 710134 - protein, 9 aa, Homo Sapiens
KPLDRSVFW

SEQ ID NO: 710135 - protein, 9 aa, Homo Sapiens
EAPLDPLLP

SEQ ID NO: 710136 - protein, 9 aa, Homo Sapiens
PLEFSYPSY

SEQ ID NO: 710137 - protein, 9 aa, Homo Sapiens
LKMEFKGNY

SEQ ID NO: 710138 - protein, 9 aa, Homo Sapiens
IACISHNHL

SEQ ID NO: 710139 - protein, 9 aa, Homo Sapiens
QHVLSMDYR

SEQ ID NO: 710140 - protein, 9 aa, Homo Sapiens
SSNVSLSIF

SEQ ID NO: 710141 - protein, 9 aa, Homo Sapiens
YTNVMLENY

SEQ ID NO: 710142 - protein, 9 aa, Homo Sapiens
FNALIYTLR

SEQ ID NO: 710143 - protein, 9 aa, Homo Sapiens
LVLDDEGGL

SEQ ID NO: 710144 - protein, 9 aa, Homo Sapiens
MDYRVARIL

SEQ ID NO: 710145 - protein, 9 aa, Homo Sapiens
DNLLMVFEA

SEQ ID NO: 710146 - protein, 9 aa, Homo Sapiens
MAWNFRAKV

SEQ ID NO: 710147 - protein, 9 aa, Homo Sapiens
SPVTSDDFH

SEQ ID NO: 710148 - protein, 9 aa, Homo Sapiens
ADVNGAIHF

SEQ ID NO: 710149 - protein, 9 aa, Homo Sapiens
TVKGTSHQS

SEQ ID NO: 710150 - protein, 9 aa, Homo Sapiens
SPLEALKAC

SEQ ID NO: 710151 - protein, 9 aa, Homo Sapiens
TLWRPPLGP

SEQ ID NO: 710152 - protein, 9 aa, Homo Sapiens
ALGAPGAPG

SEQ ID NO: 710153 - protein, 9 aa, Homo Sapiens
AVGGLSAAG

SEQ ID NO: 710154 - protein, 9 aa, Homo Sapiens
CLHPMDTVP

SEQ ID NO: 710155 - protein, 9 aa, Homo Sapiens
RICGLPVRT

SEQ ID NO: 710156 - protein, 9 aa, Homo Sapiens
DVLFGNIRE

SEQ ID NO: 710157 - protein, 9 aa, Homo Sapiens
RPRGLLGLC

SEQ ID NO: 710158 - protein, 9 aa, Homo Sapiens
REDLERLWV

SEQ ID NO: 710159 - protein, 9 aa, Homo Sapiens
IMTKTIEYI

SEQ ID NO: 710160 - protein, 9 aa, Homo Sapiens
KKLCQLHHM

SEQ ID NO: 710161 - protein, 9 aa, Homo Sapiens
RFLACPFPT

SEQ ID NO: 710162 - protein, 9 aa, Homo Sapiens
DHQIWTPLT

SEQ ID NO: 710163 - protein, 9 aa, Homo Sapiens
KYNNVSDLC

SEQ ID NO: 710164 - protein, 9 aa, Homo Sapiens
SIVAECNAV

SEQ ID NO: 710165 - protein, 9 aa, Homo Sapiens
SGVWTATAP

SEQ ID NO: 710166 - protein, 9 aa, Homo Sapiens
LLGSSVELE

SEQ ID NO: 710167 - protein, 9 aa, Homo Sapiens
GQTQRLDRL

SEQ ID NO: 710168 - protein, 9 aa, Homo Sapiens
DHPRRWKLQ

SEQ ID NO: 710169 - protein, 9 aa, Homo Sapiens
DTVPTPAPT

SEQ ID NO: 710170 - protein, 9 aa, Homo Sapiens
DRHHGGASY

SEQ ID NO: 710171 - protein, 9 aa, Homo Sapiens
VGGLSAAGE

SEQ ID NO: 710172 - protein, 9 aa, Homo Sapiens
MDTVPTPAP

SEQ ID NO: 710173 - protein, 9 aa, Homo Sapiens
ASIAAIDDR

SEQ ID NO: 710174 - protein, 9 aa, Homo Sapiens
AQMRLSRTF

SEQ ID NO: 710175 - protein, 9 aa, Homo Sapiens
PLDPLLPWQ

SEQ ID NO: 710176 - protein, 9 aa, Homo Sapiens
GPIERAHVH

SEQ ID NO: 710177 - protein, 9 aa, Homo Sapiens
TISISRVPP

SEQ ID NO: 710178 - protein, 9 aa, Homo Sapiens
FKFTECGKA

SEQ ID NO: 710179 - protein, 9 aa, Homo Sapiens
IFEECGKAF

SEQ ID NO: 710180 - protein, 9 aa, Homo Sapiens
LLQRLYYPV

SEQ ID NO: 710181 - protein, 9 aa, Homo Sapiens
PLSPRFLAC

SEQ ID NO: 710182 - protein, 9 aa, Homo Sapiens
STGRNATVG

SEQ ID NO: 710183 - protein, 9 aa, Homo Sapiens
ASVHPKTFP

SEQ ID NO: 710184 - protein, 9 aa, Homo Sapiens
ATSKTIAVY

SEQ ID NO: 710185 - protein, 9 aa, Homo Sapiens
QGLGFVGSL

SEQ ID NO: 710186 - protein, 9 aa, Homo Sapiens
ARVKTLREE

SEQ ID NO: 710187 - protein, 9 aa, Homo Sapiens
PPPLALTLA

SEQ ID NO: 710188 - protein, 9 aa, Homo Sapiens
SFQSLQHWL

SEQ ID NO: 710189 - protein, 9 aa, Homo Sapiens
EPNSATSKT

SEQ ID NO: 710190 - protein, 9 aa, Homo Sapiens
FNCVKLNEE

SEQ ID NO: 710191 - protein, 9 aa, Homo Sapiens
TQQEVCGAY

SEQ ID NO: 710192 - protein, 9 aa, Homo Sapiens
GGGDRHHGG

SEQ ID NO: 710193 - protein, 9 aa, Homo Sapiens
ESIVAECNA

SEQ ID NO: 710194 - protein, 9 aa, Homo Sapiens
CKFIFSILV

SEQ ID NO: 710195 - protein, 9 aa, Homo Sapiens
YRWSQWTSR

SEQ ID NO: 710196 - protein, 9 aa, Homo Sapiens
EREESRINL

SEQ ID NO: 710197 - protein, 9 aa, Homo Sapiens
FQGHCYCYF

SEQ ID NO: 710198 - protein, 9 aa, Homo Sapiens
YKLFTAKKL

SEQ ID NO: 710199 - protein, 9 aa, Homo Sapiens
MHRGGHPLK

SEQ ID NO: 710200 - protein, 9 aa, Homo Sapiens
QMKQDRINR

SEQ ID NO: 710201 - protein, 9 aa, Homo Sapiens
MESCPSLQS

SEQ ID NO: 710202 - protein, 9 aa, Homo Sapiens
LLIKTTQQE

SEQ ID NO: 710203 - protein, 9 aa, Homo Sapiens
GAIDMVLSE

SEQ ID NO: 710204 - protein, 9 aa, Homo Sapiens
SAVHVRRKH

SEQ ID NO: 710205 - protein, 9 aa, Homo Sapiens
YKLVTVKLK

SEQ ID NO: 710206 - protein, 9 aa, Homo Sapiens
SRERPSAPW

SEQ ID NO: 710207 - protein, 9 aa, Homo Sapiens
YPGQTQRLD

SEQ ID NO: 710208 - protein, 9 aa, Homo Sapiens
TLNTVALSH

SEQ ID NO: 710209 - protein, 9 aa, Homo Sapiens
QDCIVQLGA

SEQ ID NO: 710210 - protein, 9 aa, Homo Sapiens
AKAALVTGM

SEQ ID NO: 710211 - protein, 9 aa, Homo Sapiens
EQASIKNRP

SEQ ID NO: 710212 - protein, 9 aa, Homo Sapiens
LIFTVGTSG

SEQ ID NO: 710213 - protein, 9 aa, Homo Sapiens
SESKTFFSQ

SEQ ID NO: 710214 - protein, 9 aa, Homo Sapiens
RESIVAECN

SEQ ID NO: 710215 - protein, 9 aa, Homo Sapiens
DWDRFTRRC

SEQ ID NO: 710216 - protein, 9 aa, Homo Sapiens
YPVQGQVLF

SEQ ID NO: 710217 - protein, 9 aa, Homo Sapiens
IPMPFSSCS

SEQ ID NO: 710218 - protein, 9 aa, Homo Sapiens
GSESKPCGE

SEQ ID NO: 710219 - protein, 9 aa, Homo Sapiens
TIMPGSLKM

SEQ ID NO: 710220 - protein, 9 aa, Homo Sapiens
QHVVNSLVS

SEQ ID NO: 710221 - protein, 9 aa, Homo Sapiens
VREGAEWGL

SEQ ID NO: 710222 - protein, 9 aa, Homo Sapiens
QKLYTIMNS

SEQ ID NO: 710223 - protein, 9 aa, Homo Sapiens
KELLELSLA

SEQ ID NO: 710224 - protein, 9 aa, Homo Sapiens
VEHKKMHTV

SEQ ID NO: 710225 - protein, 9 aa, Homo Sapiens
AVPSDGTDA

SEQ ID NO: 710226 - protein, 9 aa, Homo Sapiens
MPGSLKMEF

SEQ ID NO: 710227 - protein, 9 aa, Homo Sapiens
GSSTPHHCL

SEQ ID NO: 710228 - protein, 9 aa, Homo Sapiens
VGRYGQDCA

SEQ ID NO: 710229 - protein, 9 aa, Homo Sapiens
EPQYLFQAS

SEQ ID NO: 710230 - protein, 9 aa, Homo Sapiens
EQMKQDRIN

SEQ ID NO: 710231 - protein, 9 aa, Homo Sapiens
KTIKERALL

SEQ ID NO: 710232 - protein, 9 aa, Homo Sapiens
LGFVGSLIG

SEQ ID NO: 710233 - protein, 9 aa, Homo Sapiens
LEFSYPSYL

SEQ ID NO: 710234 - protein, 9 aa, Homo Sapiens
LQNNKDVLF

SEQ ID NO: 710235 - protein, 9 aa, Homo Sapiens
MDVDTLNTV

SEQ ID NO: 710236 - protein, 9 aa, Homo Sapiens
TAEKPWKCE

SEQ ID NO: 710237 - protein, 9 aa, Homo Sapiens
LVQLAMSPS

SEQ ID NO: 710238 - protein, 9 aa, Homo Sapiens
REECPVGRY

SEQ ID NO: 710239 - protein, 9 aa, Homo Sapiens
FEECGKAFS

SEQ ID NO: 710240 - protein, 9 aa, Homo Sapiens
GSPVTSDDF

SEQ ID NO: 710241 - protein, 9 aa, Homo Sapiens
RLHKDHQIW

SEQ ID NO: 710242 - protein, 9 aa, Homo Sapiens
GNETVCTLC

SEQ ID NO: 710243 - protein, 9 aa, Homo Sapiens
EQDLELASE

SEQ ID NO: 710244 - protein, 9 aa, Homo Sapiens
EDKILKISP

SEQ ID NO: 710245 - protein, 9 aa, Homo Sapiens
FKVYIERDE

SEQ ID NO: 710246 - protein, 9 aa, Homo Sapiens
VKEMQLARE

SEQ ID NO: 710247 - protein, 9 aa, Homo Sapiens
KLYVNVKMG

SEQ ID NO: 710248 - protein, 9 aa, Homo Sapiens
SAPLMGKHK

SEQ ID NO: 710249 - protein, 9 aa, Homo Sapiens
DIFTSKTDS

SEQ ID NO: 710250 - protein, 9 aa, Homo Sapiens
HITFVNSSG

SEQ ID NO: 710251 - protein, 9 aa, Homo Sapiens
SDSLISAVA

SEQ ID NO: 710252 - protein, 9 aa, Homo Sapiens
WRPPLGPLD

SEQ ID NO: 710253 - protein, 9 aa, Homo Sapiens
FASIAAIDD

SEQ ID NO: 710254 - protein, 9 aa, Homo Sapiens
KLNVPEKGS

SEQ ID NO: 710255 - protein, 9 aa, Homo Sapiens
TSHTSACGL

SEQ ID NO: 710256 - protein, 9 aa, Homo Sapiens
LSLALLNKS

SEQ ID NO: 710257 - protein, 9 aa, Homo Sapiens
YECTNENSL

SEQ ID NO: 710258 - protein, 9 aa, Homo Sapiens
PKAPLDPLL

SEQ ID NO: 710259 - protein, 9 aa, Homo Sapiens
QGTKECYGT

SEQ ID NO: 710260 - protein, 9 aa, Homo Sapiens
LGYRVHYYI

SEQ ID NO: 710261 - protein, 9 aa, Homo Sapiens
SSLSSEHSN

SEQ ID NO: 710262 - protein, 9 aa, Homo Sapiens
SLSSEHSNG

SEQ ID NO: 710263 - protein, 9 aa, Homo Sapiens
RHHKKRCQG

SEQ ID NO: 710264 - protein, 9 aa, Homo Sapiens
DVNLYLIIA

SEQ ID NO: 710265 - protein, 9 aa, Homo Sapiens
GWNYGIQQD

SEQ ID NO: 710266 - protein, 9 aa, Homo Sapiens
DCIVQLGAS

SEQ ID NO: 710267 - protein, 9 aa, Homo Sapiens
SRPVKQVEV

SEQ ID NO: 710268 - protein, 9 aa, Homo Sapiens
VELEESIPE

SEQ ID NO: 710269 - protein, 9 aa, Homo Sapiens
TIYDWELLN

SEQ ID NO: 710270 - protein, 9 aa, Homo Sapiens
AAIDDRGKK

SEQ ID NO: 710271 - protein, 9 aa, Homo Sapiens
AQRTPWSTR

SEQ ID NO: 710272 - protein, 9 aa, Homo Sapiens
QLVYRKSWK

SEQ ID NO: 710273 - protein, 9 aa, Homo Sapiens
ALVTGMELK

SEQ ID NO: 710274 - protein, 9 aa, Homo Sapiens
CWLLGLLPE

SEQ ID NO: 710275 - protein, 9 aa, Homo Sapiens
PSKDGSHKK

SEQ ID NO: 710276 - protein, 9 aa, Homo Sapiens
SEMFASIAG

SEQ ID NO: 710277 - protein, 9 aa, Homo Sapiens
SFLSESRSR

SEQ ID NO: 710278 - protein, 9 aa, Homo Sapiens
YIQPNPASR

SEQ ID NO: 710279 - protein, 9 aa, Homo Sapiens
DGTDAKVDE

SEQ ID NO: 710280 - protein, 9 aa, Homo Sapiens
LDDEGGLVS

SEQ ID NO: 710281 - protein, 9 aa, Homo Sapiens
SLQSCEGCR

SEQ ID NO: 710282 - protein, 9 aa, Homo Sapiens
MEPTFAFLG

SEQ ID NO: 710283 - protein, 9 aa, Homo Sapiens
KRTIMPGSL

SEQ ID NO: 710284 - protein, 9 aa, Homo Sapiens
HKEVLNSGI

SEQ ID NO: 710285 - protein, 9 aa, Homo Sapiens
IIKNPFECK

SEQ ID NO: 710286 - protein, 9 aa, Homo Sapiens
IPNNYPITV

SEQ ID NO: 710287 - protein, 9 aa, Homo Sapiens
GGLSAAGEL

SEQ ID NO: 710288 - protein, 9 aa, Homo Sapiens
YCRVYVVAP

SEQ ID NO: 710289 - protein, 9 aa, Homo Sapiens
SMYLFLGSL

SEQ ID NO: 710290 - protein, 9 aa, Homo Sapiens
ALNAKTDTA

SEQ ID NO: 710291 - protein, 9 aa, Homo Sapiens
GKEDKILKI

SEQ ID NO: 710292 - protein, 9 aa, Homo Sapiens
QEPNSATSK

SEQ ID NO: 710293 - protein, 9 aa, Homo Sapiens
FIAQMRLSR

SEQ ID NO: 710294 - protein, 9 aa, Homo Sapiens
GLITEIIGD

SEQ ID NO: 710295 - protein, 9 aa, Homo Sapiens
SKDGSHKKS

SEQ ID NO: 710296 - protein, 9 aa, Homo Sapiens
EAAENLKSC

SEQ ID NO: 710297 - protein, 9 aa, Homo Sapiens
PSDGTDAKV

SEQ ID NO: 710298 - protein, 9 aa, Homo Sapiens
IEPCLEGEE

SEQ ID NO: 710299 - protein, 9 aa, Homo Sapiens
SESRSRRKK

SEQ ID NO: 710300 - protein, 9 aa, Homo Sapiens
SGDRLYECG

SEQ ID NO: 710301 - protein, 9 aa, Homo Sapiens
AEKPWKCEE

SEQ ID NO: 710302 - protein, 9 aa, Homo Sapiens
GVDPSADPQ

SEQ ID NO: 710303 - protein, 9 aa, Homo Sapiens
QIRMDRGGM

SEQ ID NO: 710304 - protein, 9 aa, Homo Sapiens
DQHVVNSLV

SEQ ID NO: 710305 - protein, 9 aa, Homo Sapiens
IYDICCRNL

SEQ ID NO: 710306 - protein, 9 aa, Homo Sapiens
KVCRTEYRW

SEQ ID NO: 710307 - protein, 9 aa, Homo Sapiens
NYRGSEPES

SEQ ID NO: 710308 - protein, 9 aa, Homo Sapiens
NYLIISEHL

SEQ ID NO: 710309 - protein, 9 aa, Homo Sapiens
YNNVSDLCK

SEQ ID NO: 710310 - protein, 9 aa, Homo Sapiens
YVNVKMGCE

SEQ ID NO: 710311 - protein, 9 aa, Homo Sapiens
GGDRHHGGA

SEQ ID NO: 710312 - protein, 9 aa, Homo Sapiens
IETAIVTSI

SEQ ID NO: 710313 - protein, 9 aa, Homo Sapiens
TGRNATVGN

SEQ ID NO: 710314 - protein, 9 aa, Homo Sapiens
LPSHILEVI

SEQ ID NO: 710315 - protein, 9 aa, Homo Sapiens
GTSGTTGET

SEQ ID NO: 710316 - protein, 9 aa, Homo Sapiens
RHYWEVLVR

SEQ ID NO: 710317 - protein, 9 aa, Homo Sapiens
ALQADEEMT

SEQ ID NO: 710318 - protein, 9 aa, Homo Sapiens
PTSMPHAVT

SEQ ID NO: 710319 - protein, 9 aa, Homo Sapiens
PSFQSLQHW

SEQ ID NO: 710320 - protein, 9 aa, Homo Sapiens
DNYRGSEPE

SEQ ID NO: 710321 - protein, 9 aa, Homo Sapiens
HKDHQIWTP

SEQ ID NO: 710322 - protein, 9 aa, Homo Sapiens
CILPKLSPG

SEQ ID NO: 710323 - protein, 9 aa, Homo Sapiens
EPTFAFLGF

SEQ ID NO: 710324 - protein, 9 aa, Homo Sapiens
ESRSRRKKK

SEQ ID NO: 710325 - protein, 9 aa, Homo Sapiens
CGSRICGSV

SEQ ID NO: 710326 - protein, 9 aa, Homo Sapiens
RQRTAYFSF

SEQ ID NO: 710327 - protein, 9 aa, Homo Sapiens
YRRAIEIVE

SEQ ID NO: 710328 - protein, 9 aa, Homo Sapiens
WEVLVREGA

SEQ ID NO: 710329 - protein, 9 aa, Homo Sapiens
AWVASTRVS

SEQ ID NO: 710330 - protein, 9 aa, Homo Sapiens
FMLGYRVHY

SEQ ID NO: 710331 - protein, 9 aa, Homo Sapiens
YAVGGLSAA

SEQ ID NO: 710332 - protein, 9 aa, Homo Sapiens
RSDLSPRAS

SEQ ID NO: 710333 - protein, 9 aa, Homo Sapiens
GLPNGSPGA

SEQ ID NO: 710334 - protein, 9 aa, Homo Sapiens
HYWEVLVRE

SEQ ID NO: 710335 - protein, 9 aa, Homo Sapiens
PWQLSLWRL

SEQ ID NO: 710336 - protein, 9 aa, Homo Sapiens
LMFIPRSLS

SEQ ID NO: 710337 - protein, 9 aa, Homo Sapiens
QSQSHQEES

SEQ ID NO: 710338 - protein, 9 aa, Homo Sapiens
ASGSDCDLY

SEQ ID NO: 710339 - protein, 9 aa, Homo Sapiens
SQSHQEESW

SEQ ID NO: 710340 - protein, 9 aa, Homo Sapiens
DKGTPTSSQ

SEQ ID NO: 710341 - protein, 9 aa, Homo Sapiens
FQQLDESKA

SEQ ID NO: 710342 - protein, 9 aa, Homo Sapiens
LDTDSRHHK

SEQ ID NO: 710343 - protein, 9 aa, Homo Sapiens
LQHWLSLPL

SEQ ID NO: 710344 - protein, 9 aa, Homo Sapiens
FFFCMLAAI

SEQ ID NO: 710345 - protein, 9 aa, Homo Sapiens
QTLRTVATE

SEQ ID NO: 710346 - protein, 9 aa, Homo Sapiens
ATYRKLLER

SEQ ID NO: 710347 - protein, 9 aa, Homo Sapiens
LWTCIQEYV

SEQ ID NO: 710348 - protein, 9 aa, Homo Sapiens
NSGIAYVAL

SEQ ID NO: 710349 - protein, 9 aa, Homo Sapiens
YVVAPSTTR

SEQ ID NO: 710350 - protein, 9 aa, Homo Sapiens
QPVGTVAQL

SEQ ID NO: 710351 - protein, 9 aa, Homo Sapiens
NRKFKFTEC

SEQ ID NO: 710352 - protein, 9 aa, Homo Sapiens
KACLKGIPP

SEQ ID NO: 710353 - protein, 9 aa, Homo Sapiens
IADHSHVFS

SEQ ID NO: 710354 - protein, 9 aa, Homo Sapiens
EIQECTVNL

SEQ ID NO: 710355 - protein, 9 aa, Homo Sapiens
KKSVLSQGG

SEQ ID NO: 710356 - protein, 9 aa, Homo Sapiens
SHLQGLLGH

SEQ ID NO: 710357 - protein, 9 aa, Homo Sapiens
FQSLQHWLS

SEQ ID NO: 710358 - protein, 9 aa, Homo Sapiens
IKTTQQEVC

SEQ ID NO: 710359 - protein, 9 aa, Homo Sapiens
GLIQLGQEE

SEQ ID NO: 710360 - protein, 9 aa, Homo Sapiens
YWEVLVREG

SEQ ID NO: 710361 - protein, 9 aa, Homo Sapiens
QASIKNRPK

SEQ ID NO: 710362 - protein, 9 aa, Homo Sapiens
KYRCVSDGQ

SEQ ID NO: 710363 - protein, 9 aa, Homo Sapiens
TALFSEKIL

SEQ ID NO: 710364 - protein, 9 aa, Homo Sapiens
LMKNMDPLK

SEQ ID NO: 710365 - protein, 9 aa, Homo Sapiens
QLLQRLYYP

SEQ ID NO: 710366 - protein, 9 aa, Homo Sapiens
LIQEDYQYQ

SEQ ID NO: 710367 - protein, 9 aa, Homo Sapiens
VAIKAIREV

SEQ ID NO: 710368 - protein, 9 aa, Homo Sapiens
DGSHKKSVL

SEQ ID NO: 710369 - protein, 9 aa, Homo Sapiens
IVHITFVNS

SEQ ID NO: 710370 - protein, 9 aa, Homo Sapiens
IVTSIGMHL

SEQ ID NO: 710371 - protein, 9 aa, Homo Sapiens
FYGGLADTA

SEQ ID NO: 710372 - protein, 9 aa, Homo Sapiens
KDLSASLAA

SEQ ID NO: 710373 - protein, 9 aa, Homo Sapiens
YLIISEHLR

SEQ ID NO: 710374 - protein, 9 aa, Homo Sapiens
AGTNGGPDK

SEQ ID NO: 710375 - protein, 9 aa, Homo Sapiens
LDRSVFWIE

SEQ ID NO: 710376 - protein, 9 aa, Homo Sapiens
EEALDSNLY

SEQ ID NO: 710377 - protein, 9 aa, Homo Sapiens
DSRHHKKRC

SEQ ID NO: 710378 - protein, 9 aa, Homo Sapiens
TPDGAIDMV

SEQ ID NO: 710379 - protein, 9 aa, Homo Sapiens
LKSFNCVKL

SEQ ID NO: 710380 - protein, 9 aa, Homo Sapiens
LGPLDPLLP

SEQ ID NO: 710381 - protein, 9 aa, Homo Sapiens
LTLWRPPLG

SEQ ID NO: 710382 - protein, 9 aa, Homo Sapiens
KFPFVPVMA

SEQ ID NO: 710383 - protein, 9 aa, Homo Sapiens
YGQDCAETC

SEQ ID NO: 710384 - protein, 9 aa, Homo Sapiens
KGSVKKSSG

SEQ ID NO: 710385 - protein, 9 aa, Homo Sapiens
FSNSFSRNL

SEQ ID NO: 710386 - protein, 9 aa, Homo Sapiens
VSFGKVCIV

SEQ ID NO: 710387 - protein, 9 aa, Homo Sapiens
KAVASQGRV

SEQ ID NO: 710388 - protein, 9 aa, Homo Sapiens
KVIDLRVSK

SEQ ID NO: 710389 - protein, 9 aa, Homo Sapiens
GPKTNGSQF

SEQ ID NO: 710390 - protein, 9 aa, Homo Sapiens
PGAATAATL

SEQ ID NO: 710391 - protein, 9 aa, Homo Sapiens
EKYPGQTQR

SEQ ID NO: 710392 - protein, 9 aa, Homo Sapiens
LRDKSEATQ

SEQ ID NO: 710393 - protein, 9 aa, Homo Sapiens
PQAKDTWVH

SEQ ID NO: 710394 - protein, 9 aa, Homo Sapiens
VDVNLYLII

SEQ ID NO: 710395 - protein, 9 aa, Homo Sapiens
SVQALNAKT

SEQ ID NO: 710396 - protein, 9 aa, Homo Sapiens
WCEIEPCLE

SEQ ID NO: 710397 - protein, 9 aa, Homo Sapiens
IDLIPTSMP

SEQ ID NO: 710398 - protein, 9 aa, Homo Sapiens
AYAVYDDLQ

SEQ ID NO: 710399 - protein, 9 aa, Homo Sapiens
LADNLLMVF

SEQ ID NO: 710400 - protein, 9 aa, Homo Sapiens
KSTVQLMFI

SEQ ID NO: 710401 - protein, 9 aa, Homo Sapiens
DPLKDNIAT

SEQ ID NO: 710402 - protein, 9 aa, Homo Sapiens
HKKEKLNVP

SEQ ID NO: 710403 - protein, 9 aa, Homo Sapiens
KGMVKAVRL

SEQ ID NO: 710404 - protein, 9 aa, Homo Sapiens
TPEAAENLK

SEQ ID NO: 710405 - protein, 9 aa, Homo Sapiens
SNSSYECTN

SEQ ID NO: 710406 - protein, 9 aa, Homo Sapiens
LFRDSQTIG

SEQ ID NO: 710407 - protein, 9 aa, Homo Sapiens
AIQEQMLGG

SEQ ID NO: 710408 - protein, 9 aa, Homo Sapiens
SVLAGPRCA

SEQ ID NO: 710409 - protein, 9 aa, Homo Sapiens
TVPDFQRVH

SEQ ID NO: 710410 - protein, 9 aa, Homo Sapiens
RKFKFTECG

SEQ ID NO: 710411 - protein, 9 aa, Homo Sapiens
RAASMETRE

SEQ ID NO: 710412 - protein, 9 aa, Homo Sapiens
TGVRFRTGQ

SEQ ID NO: 710413 - protein, 9 aa, Homo Sapiens
QPAPIPNNY

SEQ ID NO: 710414 - protein, 9 aa, Homo Sapiens
MLLICRFHC

SEQ ID NO: 710415 - protein, 9 aa, Homo Sapiens
PLECKECGK

SEQ ID NO: 710416 - protein, 9 aa, Homo Sapiens
SHLYGLEPF

SEQ ID NO: 710417 - protein, 9 aa, Homo Sapiens
IVGVVEPLP

SEQ ID NO: 710418 - protein, 9 aa, Homo Sapiens
EHFPFLDIS

SEQ ID NO: 710419 - protein, 9 aa, Homo Sapiens
VCQIRMDRG

SEQ ID NO: 710420 - protein, 9 aa, Homo Sapiens
SSGQQGGGS

SEQ ID NO: 710421 - protein, 9 aa, Homo Sapiens
FPFVPVMAL

SEQ ID NO: 710422 - protein, 9 aa, Homo Sapiens
HCLRSSFRP

SEQ ID NO: 710423 - protein, 9 aa, Homo Sapiens
NAGPKTNGS

SEQ ID NO: 710424 - protein, 9 aa, Homo Sapiens
IAAIDDRGK

SEQ ID NO: 710425 - protein, 9 aa, Homo Sapiens
DSSLPSHIL

SEQ ID NO: 710426 - protein, 9 aa, Homo Sapiens
LVWLQAWVA

SEQ ID NO: 710427 - protein, 9 aa, Homo Sapiens
VCGDVSLPE

SEQ ID NO: 710428 - protein, 9 aa, Homo Sapiens
PIHSCFLVS

SEQ ID NO: 710429 - protein, 9 aa, Homo Sapiens
SDTIKIKAL

SEQ ID NO: 710430 - protein, 9 aa, Homo Sapiens
LAYAVYDDL

SEQ ID NO: 710431 - protein, 9 aa, Homo Sapiens
RLYYPVQGQ

SEQ ID NO: 710432 - protein, 9 aa, Homo Sapiens
EKYRCVSDG

SEQ ID NO: 710433 - protein, 9 aa, Homo Sapiens
TSEHFPFLD

SEQ ID NO: 710434 - protein, 9 aa, Homo Sapiens
VSLSIFVLD

SEQ ID NO: 710435 - protein, 9 aa, Homo Sapiens
LHQPMYFFF

SEQ ID NO: 710436 - protein, 9 aa, Homo Sapiens
HREDLERLW

SEQ ID NO: 710437 - protein, 9 aa, Homo Sapiens
PSDDDKGTP

SEQ ID NO: 710438 - protein, 9 aa, Homo Sapiens
HLHISMYLF

SEQ ID NO: 710439 - protein, 9 aa, Homo Sapiens
DRRESIVAE

SEQ ID NO: 710440 - protein, 9 aa, Homo Sapiens
TLKYPMEHC

SEQ ID NO: 710441 - protein, 9 aa, Homo Sapiens
EHCIITNWD

SEQ ID NO: 710442 - protein, 9 aa, Homo Sapiens
KRSQRKQRD

SEQ ID NO: 710443 - protein, 9 aa, Homo Sapiens
VAIQEQMLG

SEQ ID NO: 710444 - protein, 9 aa, Homo Sapiens
CTEDPETVD

SEQ ID NO: 710445 - protein, 9 aa, Homo Sapiens
RLPKAPLDP

SEQ ID NO: 710446 - protein, 9 aa, Homo Sapiens
TASGVWTAT

SEQ ID NO: 710447 - protein, 9 aa, Homo Sapiens
YQYQKPKTM

SEQ ID NO: 710448 - protein, 9 aa, Homo Sapiens
REVAMCEED

SEQ ID NO: 710449 - protein, 9 aa, Homo Sapiens
YLRLRDKSE

SEQ ID NO: 710450 - protein, 9 aa, Homo Sapiens
LHKDHQIWT

SEQ ID NO: 710451 - protein, 9 aa, Homo Sapiens
VRRKHSDSD

SEQ ID NO: 710452 - protein, 9 aa, Homo Sapiens
AGMGQDCIV

SEQ ID NO: 710453 - protein, 9 aa, Homo Sapiens
HHQTHTGEK

SEQ ID NO: 710454 - protein, 9 aa, Homo Sapiens
LEDIFTSKT

SEQ ID NO: 710455 - protein, 9 aa, Homo Sapiens
EYIQPNPAS

SEQ ID NO: 710456 - protein, 9 aa, Homo Sapiens
MESWLRRKL

SEQ ID NO: 710457 - protein, 9 aa, Homo Sapiens
RGENQDTSP

SEQ ID NO: 710458 - protein, 9 aa, Homo Sapiens
EYRWSQWTS

SEQ ID NO: 710459 - protein, 9 aa, Homo Sapiens
SSFRPQKVC

SEQ ID NO: 710460 - protein, 9 aa, Homo Sapiens
TVNLLLKKG

SEQ ID NO: 710461 - protein, 9 aa, Homo Sapiens
DKGLQGACM

SEQ ID NO: 710462 - protein, 9 aa, Homo Sapiens
DAKVDEAQA

SEQ ID NO: 710463 - protein, 9 aa, Homo Sapiens
PVTSDDFHH

SEQ ID NO: 710464 - protein, 9 aa, Homo Sapiens
CIQEYVQSQ

SEQ ID NO: 710465 - protein, 9 aa, Homo Sapiens
VIHTAEKPW

SEQ ID NO: 710466 - protein, 9 aa, Homo Sapiens
LAPGKTTPS

SEQ ID NO: 710467 - protein, 9 aa, Homo Sapiens
PVGRYGQDC

SEQ ID NO: 710468 - protein, 9 aa, Homo Sapiens
TTPSSHKTS

SEQ ID NO: 710469 - protein, 9 aa, Homo Sapiens
SGGGGDRHH

SEQ ID NO: 710470 - protein, 9 aa, Homo Sapiens
REALLSESK

SEQ ID NO: 710471 - protein, 9 aa, Homo Sapiens
VKLTSDALQ

SEQ ID NO: 710472 - protein, 9 aa, Homo Sapiens
RFEVFGEIQ

SEQ ID NO: 710473 - protein, 9 aa, Homo Sapiens
LIVLGNRHV

SEQ ID NO: 710474 - protein, 9 aa, Homo Sapiens
DEQDGEEEK

SEQ ID NO: 710475 - protein, 9 aa, Homo Sapiens
CIITNWDDM

SEQ ID NO: 710476 - protein, 9 aa, Homo Sapiens
SGIGLLILK

SEQ ID NO: 710477 - protein, 9 aa, Homo Sapiens
NISTGRNAT

SEQ ID NO: 710478 - protein, 9 aa, Homo Sapiens
ADNLLMVFE

SEQ ID NO: 710479 - protein, 9 aa, Homo Sapiens
GGLSTPPAS

SEQ ID NO: 710480 - protein, 9 aa, Homo Sapiens
TIIVTDLGT

SEQ ID NO: 710481 - protein, 9 aa, Homo Sapiens
GEKPHIFEE

SEQ ID NO: 710482 - protein, 9 aa, Homo Sapiens
RGETGALGA

SEQ ID NO: 710483 - protein, 9 aa, Homo Sapiens
RPVKQVEVV

SEQ ID NO: 710484 - protein, 9 aa, Homo Sapiens
AKRSQRKQR

SEQ ID NO: 710485 - protein, 9 aa, Homo Sapiens
PMSVWLRTP

SEQ ID NO: 710486 - protein, 9 aa, Homo Sapiens
PQIQWRLGA

SEQ ID NO: 710487 - protein, 9 aa, Homo Sapiens
IAQMRLSRT

SEQ ID NO: 710488 - protein, 9 aa, Homo Sapiens
PEEQDLELA

SEQ ID NO: 710489 - protein, 9 aa, Homo Sapiens
WRLPKAPLD

SEQ ID NO: 710490 - protein, 9 aa, Homo Sapiens
QLSEKKPIN

SEQ ID NO: 710491 - protein, 9 aa, Homo Sapiens
HIFEECGKA

SEQ ID NO: 710492 - protein, 9 aa, Homo Sapiens
IGFLLFRNR

SEQ ID NO: 710493 - protein, 9 aa, Homo Sapiens
IQWRLGAEL

SEQ ID NO: 710494 - protein, 9 aa, Homo Sapiens
RSSGQQGGG

SEQ ID NO: 710495 - protein, 9 aa, Homo Sapiens
KSEATQVMA

SEQ ID NO: 710496 - protein, 9 aa, Homo Sapiens
LDFGLALQA

SEQ ID NO: 710497 - protein, 9 aa, Homo Sapiens
RRSQTQTIL

SEQ ID NO: 710498 - protein, 9 aa, Homo Sapiens
EDEQDGEEE

SEQ ID NO: 710499 - protein, 9 aa, Homo Sapiens
FDQHVVNSL

SEQ ID NO: 710500 - protein, 9 aa, Homo Sapiens
TLTLLHDRS

SEQ ID NO: 710501 - protein, 9 aa, Homo Sapiens
KAIREVAMC

SEQ ID NO: 710502 - protein, 9 aa, Homo Sapiens
LNAKTDTAE

SEQ ID NO: 710503 - protein, 9 aa, Homo Sapiens
KLKWWGLQN

SEQ ID NO: 710504 - protein, 9 aa, Homo Sapiens
YEISLNSVW

SEQ ID NO: 710505 - protein, 9 aa, Homo Sapiens
TVEKSHECT

SEQ ID NO: 710506 - protein, 9 aa, Homo Sapiens
TVCTLCQEG

SEQ ID NO: 710507 - protein, 9 aa, Homo Sapiens
PCEPPEVGS

SEQ ID NO: 710508 - protein, 9 aa, Homo Sapiens
QGLLGHFPG

SEQ ID NO: 710509 - protein, 9 aa, Homo Sapiens
ALLSESKTF

SEQ ID NO: 710510 - protein, 9 aa, Homo Sapiens
HKLQSGIGL

SEQ ID NO: 710511 - protein, 9 aa, Homo Sapiens
SHTSACGLF

SEQ ID NO: 710512 - protein, 9 aa, Homo Sapiens
QCETRDRYG

SEQ ID NO: 710513 - protein, 9 aa, Homo Sapiens
WVQESDLRL

SEQ ID NO: 710514 - protein, 9 aa, Homo Sapiens
LWRLPKAPL

SEQ ID NO: 710515 - protein, 9 aa, Homo Sapiens
ATKDLSASL

SEQ ID NO: 710516 - protein, 9 aa, Homo Sapiens
PDFQRVHIT

SEQ ID NO: 710517 - protein, 9 aa, Homo Sapiens
SSEHSNGTV

SEQ ID NO: 710518 - protein, 9 aa, Homo Sapiens
GSRICGSVL

SEQ ID NO: 710519 - protein, 9 aa, Homo Sapiens
GPGWSSSTK

SEQ ID NO: 710520 - protein, 9 aa, Homo Sapiens
FQRVHITGD

SEQ ID NO: 710521 - protein, 9 aa, Homo Sapiens
QYLRLRDKS

SEQ ID NO: 710522 - protein, 9 aa, Homo Sapiens
IDLRVSKIR

SEQ ID NO: 710523 - protein, 9 aa, Homo Sapiens
PLPHDETYC

SEQ ID NO: 710524 - protein, 9 aa, Homo Sapiens
VDTLNTVAL

SEQ ID NO: 710525 - protein, 9 aa, Homo Sapiens
KYPGQTQRL

SEQ ID NO: 710526 - protein, 9 aa, Homo Sapiens
IPTSMPHAV

SEQ ID NO: 710527 - protein, 9 aa, Homo Sapiens
FFGLITEII

SEQ ID NO: 710528 - protein, 9 aa, Homo Sapiens
TAIVTSIGM

SEQ ID NO: 710529 - protein, 9 aa, Homo Sapiens
IKQPIPMSK

SEQ ID NO: 710530 - protein, 9 aa, Homo Sapiens
HCTEDTMLE

SEQ ID NO: 710531 - protein, 9 aa, Homo Sapiens
LFLQPEPGP

SEQ ID NO: 710532 - protein, 9 aa, Homo Sapiens
QTEVLVIPK

SEQ ID NO: 710533 - protein, 9 aa, Homo Sapiens
QHDTDMKYY

SEQ ID NO: 710534 - protein, 9 aa, Homo Sapiens
KKYLQFYLG

SEQ ID NO: 710535 - protein, 9 aa, Homo Sapiens
ARLCWMGNK

SEQ ID NO: 710536 - protein, 9 aa, Homo Sapiens
MDNSKGPLV

SEQ ID NO: 710537 - protein, 9 aa, Homo Sapiens
LQFYLGLPG

SEQ ID NO: 710538 - protein, 9 aa, Homo Sapiens
VPRAPHGPK

SEQ ID NO: 710539 - protein, 9 aa, Homo Sapiens
GFSLTPDQT

SEQ ID NO: 710540 - protein, 9 aa, Homo Sapiens
KYLQFYLGL

SEQ ID NO: 710541 - protein, 9 aa, Homo Sapiens
CASKRHCTE

SEQ ID NO: 710542 - protein, 9 aa, Homo Sapiens
FPGHSKTRE

SEQ ID NO: 710543 - protein, 9 aa, Homo Sapiens
AGRARCGPG

SEQ ID NO: 710544 - protein, 9 aa, Homo Sapiens
VGKGRGTPG

SEQ ID NO: 710545 - protein, 9 aa, Homo Sapiens
CYNSIYEQS

SEQ ID NO: 710546 - protein, 9 aa, Homo Sapiens
QRRGLQLTG

SEQ ID NO: 710547 - protein, 9 aa, Homo Sapiens
APTHSPVGR

SEQ ID NO: 710548 - protein, 9 aa, Homo Sapiens
NSCNVFPKK

SEQ ID NO: 710549 - protein, 9 aa, Homo Sapiens
IEAQGPGRK

SEQ ID NO: 710550 - protein, 9 aa, Homo Sapiens
RKASLEGVS

SEQ ID NO: 710551 - protein, 9 aa, Homo Sapiens
EALRLESKI

SEQ ID NO: 710552 - protein, 9 aa, Homo Sapiens
PENARLVLQ

SEQ ID NO: 710553 - protein, 9 aa, Homo Sapiens
YLIEVELED

SEQ ID NO: 710554 - protein, 9 aa, Homo Sapiens
VPPPPSARP

SEQ ID NO: 710555 - protein, 9 aa, Homo Sapiens
DAHLFALLE

SEQ ID NO: 710556 - protein, 9 aa, Homo Sapiens
LILFVLDQN

SEQ ID NO: 710557 - protein, 9 aa, Homo Sapiens
PWLLRVSGK

SEQ ID NO: 710558 - protein, 9 aa, Homo Sapiens
WLLRVSGKS

SEQ ID NO: 710559 - protein, 9 aa, Homo Sapiens
MPRASTPCP

SEQ ID NO: 710560 - protein, 9 aa, Homo Sapiens
GKVALEMLF

SEQ ID NO: 710561 - protein, 9 aa, Homo Sapiens
RRKASLEGV

SEQ ID NO: 710562 - protein, 9 aa, Homo Sapiens
RRVHSHERP

SEQ ID NO: 710563 - protein, 9 aa, Homo Sapiens
SYFDTDSSS

SEQ ID NO: 710564 - protein, 9 aa, Homo Sapiens
LESKIKVYN

SEQ ID NO: 710565 - protein, 9 aa, Homo Sapiens
GKIEDCIKV

SEQ ID NO: 710566 - protein, 9 aa, Homo Sapiens
PGIACLRPL

SEQ ID NO: 710567 - protein, 9 aa, Homo Sapiens
DAEAKNILA

SEQ ID NO: 710568 - protein, 9 aa, Homo Sapiens
TRGTRPEGT

SEQ ID NO: 710569 - protein, 9 aa, Homo Sapiens
TAEVEEVEM

SEQ ID NO: 710570 - protein, 9 aa, Homo Sapiens
PIPSSAGKK

SEQ ID NO: 710571 - protein, 9 aa, Homo Sapiens
SDITDNAVC

SEQ ID NO: 710572 - protein, 9 aa, Homo Sapiens
KTNSVNKFV

SEQ ID NO: 710573 - protein, 9 aa, Homo Sapiens
VVQAGVQRR

SEQ ID NO: 710574 - protein, 9 aa, Homo Sapiens
TAPTHSPVG

SEQ ID NO: 710575 - protein, 9 aa, Homo Sapiens
KECWEELHR

SEQ ID NO: 710576 - protein, 9 aa, Homo Sapiens
SQQRCSRCS

SEQ ID NO: 710577 - protein, 9 aa, Homo Sapiens
PSRISEMSL

SEQ ID NO: 710578 - protein, 9 aa, Homo Sapiens
DSPLGHDMV

SEQ ID NO: 710579 - protein, 9 aa, Homo Sapiens
LVWSPVPLV

SEQ ID NO: 710580 - protein, 9 aa, Homo Sapiens
TVLGFLLPL

SEQ ID NO: 710581 - protein, 9 aa, Homo Sapiens
EKKRSEQKF

SEQ ID NO: 710582 - protein, 9 aa, Homo Sapiens
DNIVKSKTE

SEQ ID NO: 710583 - protein, 9 aa, Homo Sapiens
QDKNSQQRC

SEQ ID NO: 710584 - protein, 9 aa, Homo Sapiens
SQKTYQCSY

SEQ ID NO: 710585 - protein, 9 aa, Homo Sapiens
SLTRPAGTT

SEQ ID NO: 710586 - protein, 9 aa, Homo Sapiens
ESKIKVYNR

SEQ ID NO: 710587 - protein, 9 aa, Homo Sapiens
DTAKFFLSC

SEQ ID NO: 710588 - protein, 9 aa, Homo Sapiens
PSLACEWCQ

SEQ ID NO: 710589 - protein, 9 aa, Homo Sapiens
GEVFDFSQR

SEQ ID NO: 710590 - protein, 9 aa, Homo Sapiens
GFGYRGRAS

SEQ ID NO: 710591 - protein, 9 aa, Homo Sapiens
LLVKIKKQT

SEQ ID NO: 710592 - protein, 9 aa, Homo Sapiens
DRPVHCRKL

SEQ ID NO: 710593 - protein, 9 aa, Homo Sapiens
TNSCNVFPK

SEQ ID NO: 710594 - protein, 9 aa, Homo Sapiens
KKVTKEKIS

SEQ ID NO: 710595 - protein, 9 aa, Homo Sapiens
LGVTVTRSA

SEQ ID NO: 710596 - protein, 9 aa, Homo Sapiens
HPLHYGAIM

SEQ ID NO: 710597 - protein, 9 aa, Homo Sapiens
HVYIFATFL

SEQ ID NO: 710598 - protein, 9 aa, Homo Sapiens
TRVQPEPRA

SEQ ID NO: 710599 - protein, 9 aa, Homo Sapiens
AQVKKVTKE

SEQ ID NO: 710600 - protein, 9 aa, Homo Sapiens
PGFGYRGRA

SEQ ID NO: 710601 - protein, 9 aa, Homo Sapiens
LSEKPEMKQ

SEQ ID NO: 710602 - protein, 9 aa, Homo Sapiens
LTKPENARL

SEQ ID NO: 710603 - protein, 9 aa, Homo Sapiens
RITAEVEEV

SEQ ID NO: 710604 - protein, 9 aa, Homo Sapiens
QLLNQTKTE

SEQ ID NO: 710605 - protein, 9 aa, Homo Sapiens
YKARSRLLA

SEQ ID NO: 710606 - protein, 9 aa, Homo Sapiens
KFFLSCLLP

SEQ ID NO: 710607 - protein, 9 aa, Homo Sapiens
ALSVIINMN

SEQ ID NO: 710608 - protein, 9 aa, Homo Sapiens
SKIKVYNRA

SEQ ID NO: 710609 - protein, 9 aa, Homo Sapiens
YNSIYEQSC

SEQ ID NO: 710610 - protein, 9 aa, Homo Sapiens
PFVADKYIE

SEQ ID NO: 710611 - protein, 9 aa, Homo Sapiens
CDWTSFVAV

SEQ ID NO: 710612 - protein, 9 aa, Homo Sapiens
PGVPPPPSA

SEQ ID NO: 710613 - protein, 9 aa, Homo Sapiens
SSITLQATR

SEQ ID NO: 710614 - protein, 9 aa, Homo Sapiens
IWSMFTDIL

SEQ ID NO: 710615 - protein, 9 aa, Homo Sapiens
KESFKYAWV

SEQ ID NO: 710616 - protein, 9 aa, Homo Sapiens
SSMVIFCAD

SEQ ID NO: 710617 - protein, 9 aa, Homo Sapiens
FTDILRKSV

SEQ ID NO: 710618 - protein, 9 aa, Homo Sapiens
YLSDMGLGI

SEQ ID NO: 710619 - protein, 9 aa, Homo Sapiens
KCEREKLTQ

SEQ ID NO: 710620 - protein, 9 aa, Homo Sapiens
VRDSDLSAV

SEQ ID NO: 710621 - protein, 9 aa, Homo Sapiens
SPSQPASNT

SEQ ID NO: 710622 - protein, 9 aa, Homo Sapiens
QKVMLKEIR

SEQ ID NO: 710623 - protein, 9 aa, Homo Sapiens
PTPQNDGIT

SEQ ID NO: 710624 - protein, 9 aa, Homo Sapiens
EWDCVTLST

SEQ ID NO: 710625 - protein, 9 aa, Homo Sapiens
MAGFKGEGP

SEQ ID NO: 710626 - protein, 9 aa, Homo Sapiens
RCLAICHPL

SEQ ID NO: 710627 - protein, 9 aa, Homo Sapiens
NNRLMDGYP

SEQ ID NO: 710628 - protein, 9 aa, Homo Sapiens
GTRPEGTSE

SEQ ID NO: 710629 - protein, 9 aa, Homo Sapiens
DKNSQQRCS

SEQ ID NO: 710630 - protein, 9 aa, Homo Sapiens
LSEEEQTKK

SEQ ID NO: 710631 - protein, 9 aa, Homo Sapiens
VKKVTKEKI

SEQ ID NO: 710632 - protein, 9 aa, Homo Sapiens
EKKVCLNEI

SEQ ID NO: 710633 - protein, 9 aa, Homo Sapiens
VCLNEIYTK

SEQ ID NO: 710634 - protein, 9 aa, Homo Sapiens
KEEGEEDEE

SEQ ID NO: 710635 - protein, 9 aa, Homo Sapiens
IQPQPLPSA

SEQ ID NO: 710636 - protein, 9 aa, Homo Sapiens
SALLTHCQA

SEQ ID NO: 710637 - protein, 9 aa, Homo Sapiens
LSNKNKFKS

SEQ ID NO: 710638 - protein, 9 aa, Homo Sapiens
LLKWSFYSC

SEQ ID NO: 710639 - protein, 9 aa, Homo Sapiens
DSDLSAVSA

SEQ ID NO: 710640 - protein, 9 aa, Homo Sapiens
ELFPGHSKT

SEQ ID NO: 710641 - protein, 9 aa, Homo Sapiens
RVFALTVLG

SEQ ID NO: 710642 - protein, 9 aa, Homo Sapiens
KGRGTPGDD

SEQ ID NO: 710643 - protein, 9 aa, Homo Sapiens
TSEPRSSKT

SEQ ID NO: 710644 - protein, 9 aa, Homo Sapiens
NVRPYAPVT

SEQ ID NO: 710645 - protein, 9 aa, Homo Sapiens
DQTEVLVIP

SEQ ID NO: 710646 - protein, 9 aa, Homo Sapiens
KIPDRWIYG

SEQ ID NO: 710647 - protein, 9 aa, Homo Sapiens
AIDMEERNC

SEQ ID NO: 710648 - protein, 9 aa, Homo Sapiens
CNVFPKKEA

SEQ ID NO: 710649 - protein, 9 aa, Homo Sapiens
GCRLRNLLD

SEQ ID NO: 710650 - protein, 9 aa, Homo Sapiens
PLQDAEAKN

SEQ ID NO: 710651 - protein, 9 aa, Homo Sapiens
LPSAGVNQV

SEQ ID NO: 710652 - protein, 9 aa, Homo Sapiens
YNRNGKYFN

SEQ ID NO: 710653 - protein, 9 aa, Homo Sapiens
EAAEMGKES

SEQ ID NO: 710654 - protein, 9 aa, Homo Sapiens
ESNDDGTQV

SEQ ID NO: 710655 - protein, 9 aa, Homo Sapiens
KTEMVLSEK

SEQ ID NO: 710656 - protein, 9 aa, Homo Sapiens
HWISDNIVK

SEQ ID NO: 710657 - protein, 9 aa, Homo Sapiens
DTDMKYYIV

SEQ ID NO: 710658 - protein, 9 aa, Homo Sapiens
PLPSAGVNQ

SEQ ID NO: 710659 - protein, 9 aa, Homo Sapiens
LFTPISDGY

SEQ ID NO: 710660 - protein, 9 aa, Homo Sapiens
EANRQELQD

SEQ ID NO: 710661 - protein, 9 aa, Homo Sapiens
LPVVVRELP

SEQ ID NO: 710662 - protein, 9 aa, Homo Sapiens
LARAVPGKV

SEQ ID NO: 710663 - protein, 9 aa, Homo Sapiens
AALVDGQIF

SEQ ID NO: 710664 - protein, 9 aa, Homo Sapiens
SGEVFDFSQ

SEQ ID NO: 710665 - protein, 9 aa, Homo Sapiens
LEAQVKKVT

SEQ ID NO: 710666 - protein, 9 aa, Homo Sapiens
TPGDDSSMG

SEQ ID NO: 710667 - protein, 9 aa, Homo Sapiens
DSSSSDEFF

SEQ ID NO: 710668 - protein, 9 aa, Homo Sapiens
NKNKFKSFL

SEQ ID NO: 710669 - protein, 9 aa, Homo Sapiens
TDNAVCRRC

SEQ ID NO: 710670 - protein, 9 aa, Homo Sapiens
VGQATSRPI

SEQ ID NO: 710671 - protein, 9 aa, Homo Sapiens
GFSAPLILR

SEQ ID NO: 710672 - protein, 9 aa, Homo Sapiens
LKWSFYSCM

SEQ ID NO: 710673 - protein, 9 aa, Homo Sapiens
LDESIDDQR

SEQ ID NO: 710674 - protein, 9 aa, Homo Sapiens
GITVHFKPI

SEQ ID NO: 710675 - protein, 9 aa, Homo Sapiens
PEGTSEPRS

SEQ ID NO: 710676 - protein, 9 aa, Homo Sapiens
VESLLVQCV

SEQ ID NO: 710677 - protein, 9 aa, Homo Sapiens
EEDEKEEGE

SEQ ID NO: 710678 - protein, 9 aa, Homo Sapiens
QHSYFDTDS

SEQ ID NO: 710679 - protein, 9 aa, Homo Sapiens
LQPEPGPFP

SEQ ID NO: 710680 - protein, 9 aa, Homo Sapiens
IRNCQYVAC

SEQ ID NO: 710681 - protein, 9 aa, Homo Sapiens
KIKKQTYKF

SEQ ID NO: 710682 - protein, 9 aa, Homo Sapiens
ASQTVLDKF

SEQ ID NO: 710683 - protein, 9 aa, Homo Sapiens
LKCEREKLT

SEQ ID NO: 710684 - protein, 9 aa, Homo Sapiens
CSGPNDTSP

SEQ ID NO: 710685 - protein, 9 aa, Homo Sapiens
TLQATRVQP

SEQ ID NO: 710686 - protein, 9 aa, Homo Sapiens
LLRVSGKSG

SEQ ID NO: 710687 - protein, 9 aa, Homo Sapiens
TGYRGATCY

SEQ ID NO: 710688 - protein, 9 aa, Homo Sapiens
YDRCLAICH

SEQ ID NO: 710689 - protein, 9 aa, Homo Sapiens
VLDNTIHGR

SEQ ID NO: 710690 - protein, 9 aa, Homo Sapiens
ICSGPNDTS

SEQ ID NO: 710691 - protein, 9 aa, Homo Sapiens
RGTLFLQPE

SEQ ID NO: 710692 - protein, 9 aa, Homo Sapiens
QGEYLSDMG

SEQ ID NO: 710693 - protein, 9 aa, Homo Sapiens
QAGVQRRGL

SEQ ID NO: 710694 - protein, 9 aa, Homo Sapiens
GKLNLPEST

SEQ ID NO: 710695 - protein, 9 aa, Homo Sapiens
RHCTEDTML

SEQ ID NO: 710696 - protein, 9 aa, Homo Sapiens
NRLMDGYPM

SEQ ID NO: 710697 - protein, 9 aa, Homo Sapiens
AEEPLIEPP

SEQ ID NO: 710698 - protein, 9 aa, Homo Sapiens
LRPSRISEM

SEQ ID NO: 710699 - protein, 9 aa, Homo Sapiens
FTPISDGYR

SEQ ID NO: 710700 - protein, 9 aa, Homo Sapiens
SKGCLIWNT

SEQ ID NO: 710701 - protein, 9 aa, Homo Sapiens
NQFGEVFVD

SEQ ID NO: 710702 - protein, 9 aa, Homo Sapiens
EYKNQTFEG

SEQ ID NO: 710703 - protein, 9 aa, Homo Sapiens
YRCVYKARS

SEQ ID NO: 710704 - protein, 9 aa, Homo Sapiens
SQLLNQTKT

SEQ ID NO: 710705 - protein, 9 aa, Homo Sapiens
SEHWISDNI

SEQ ID NO: 710706 - protein, 9 aa, Homo Sapiens
LQQYEMHVP

SEQ ID NO: 710707 - protein, 9 aa, Homo Sapiens
STPCPLTVT

SEQ ID NO: 710708 - protein, 9 aa, Homo Sapiens
HAEANRQEL

SEQ ID NO: 710709 - protein, 9 aa, Homo Sapiens
CASRKDHVL

SEQ ID NO: 710710 - protein, 9 aa, Homo Sapiens
GMQELFPGH

SEQ ID NO: 710711 - protein, 9 aa, Homo Sapiens
YLRPSRISE

SEQ ID NO: 710712 - protein, 9 aa, Homo Sapiens
INSASLTRP

SEQ ID NO: 710713 - protein, 9 aa, Homo Sapiens
PMIGNILQI

SEQ ID NO: 710714 - protein, 9 aa, Homo Sapiens
SEEEQTKKK

SEQ ID NO: 710715 - protein, 9 aa, Homo Sapiens
LEECDWTSF

SEQ ID NO: 710716 - protein, 9 aa, Homo Sapiens
SYEKKVCLN

SEQ ID NO: 710717 - protein, 9 aa, Homo Sapiens
SITLQATRV

SEQ ID NO: 710718 - protein, 9 aa, Homo Sapiens
APDLYNRNG

SEQ ID NO: 710719 - protein, 9 aa, Homo Sapiens
VPSQKTYQC

SEQ ID NO: 710720 - protein, 9 aa, Homo Sapiens
SCHKLVDLQ

SEQ ID NO: 710721 - protein, 9 aa, Homo Sapiens
PCPLTVTAA

SEQ ID NO: 710722 - protein, 9 aa, Homo Sapiens
PPQGEYLSD

SEQ ID NO: 710723 - protein, 9 aa, Homo Sapiens
TAVGNISLV

SEQ ID NO: 710724 - protein, 9 aa, Homo Sapiens
AQLEAQVKK

SEQ ID NO: 710725 - protein, 9 aa, Homo Sapiens
HSPVGRHVV

SEQ ID NO: 710726 - protein, 9 aa, Homo Sapiens
RLLSNKNKF

SEQ ID NO: 710727 - protein, 9 aa, Homo Sapiens
LFPGHSKTR

SEQ ID NO: 710728 - protein, 9 aa, Homo Sapiens
TLFLQPEPG

SEQ ID NO: 710729 - protein, 9 aa, Homo Sapiens
SNDESNDDG

SEQ ID NO: 710730 - protein, 9 aa, Homo Sapiens
FSMAGFKGE

SEQ ID NO: 710731 - protein, 9 aa, Homo Sapiens
NTTEKLVVS

SEQ ID NO: 710732 - protein, 9 aa, Homo Sapiens
HDMVRALMY

SEQ ID NO: 710733 - protein, 9 aa, Homo Sapiens
VPGKVALEM

SEQ ID NO: 710734 - protein, 9 aa, Homo Sapiens
EMHVPEGLR

SEQ ID NO: 710735 - protein, 9 aa, Homo Sapiens
DQPWLLRVS

SEQ ID NO: 710736 - protein, 9 aa, Homo Sapiens
RVRNNRLMD

SEQ ID NO: 710737 - protein, 9 aa, Homo Sapiens
HGPKSSLPP

SEQ ID NO: 710738 - protein, 9 aa, Homo Sapiens
RKTEMVLSE

SEQ ID NO: 710739 - protein, 9 aa, Homo Sapiens
NSGFAIDME

SEQ ID NO: 710740 - protein, 9 aa, Homo Sapiens
AKSSMVIFC

SEQ ID NO: 710741 - protein, 9 aa, Homo Sapiens
TALPQSYLI

SEQ ID NO: 710742 - protein, 9 aa, Homo Sapiens
RDEEEEEEG

SEQ ID NO: 710743 - protein, 9 aa, Homo Sapiens
PLGHDMVRA

SEQ ID NO: 710744 - protein, 9 aa, Homo Sapiens
ISAMSEDTK

SEQ ID NO: 710745 - protein, 9 aa, Homo Sapiens
EEEQTKKKH

SEQ ID NO: 710746 - protein, 9 aa, Homo Sapiens
SSICASKRH

SEQ ID NO: 710747 - protein, 9 aa, Homo Sapiens
CGTFRPRAL

SEQ ID NO: 710748 - protein, 9 aa, Homo Sapiens
KKVICSGPN

SEQ ID NO: 710749 - protein, 9 aa, Homo Sapiens
MPKFSMAGF

SEQ ID NO: 710750 - protein, 9 aa, Homo Sapiens
SGDAHLFAL

SEQ ID NO: 710751 - protein, 9 aa, Homo Sapiens
QQYEMHVPE

SEQ ID NO: 710752 - protein, 9 aa, Homo Sapiens
HRVLQGSLF

SEQ ID NO: 710753 - protein, 9 aa, Homo Sapiens
PPSARPPAL

SEQ ID NO: 710754 - protein, 9 aa, Homo Sapiens
CLVWSPVPL

SEQ ID NO: 710755 - protein, 9 aa, Homo Sapiens
FVHRVLQGS

SEQ ID NO: 710756 - protein, 9 aa, Homo Sapiens
LTPLILILM

SEQ ID NO: 710757 - protein, 9 aa, Homo Sapiens
KKQTYKFRN

SEQ ID NO: 710758 - protein, 9 aa, Homo Sapiens
WSFYSCMVI

SEQ ID NO: 710759 - protein, 9 aa, Homo Sapiens
FICPQFHMS

SEQ ID NO: 710760 - protein, 9 aa, Homo Sapiens
YLQFYLGLP

SEQ ID NO: 710761 - protein, 9 aa, Homo Sapiens
RYDQFLWEV

SEQ ID NO: 710762 - protein, 9 aa, Homo Sapiens
DGITVHFKP

SEQ ID NO: 710763 - protein, 9 aa, Homo Sapiens
YGRYDQFLW

SEQ ID NO: 710764 - protein, 9 aa, Homo Sapiens
DEEEEEEGM

SEQ ID NO: 710765 - protein, 9 aa, Homo Sapiens
QLEAQVKKV

SEQ ID NO: 710766 - protein, 9 aa, Homo Sapiens
FSAPLILRS

SEQ ID NO: 710767 - protein, 9 aa, Homo Sapiens
NSKGPLVAS

SEQ ID NO: 710768 - protein, 9 aa, Homo Sapiens
NVFPKKEAL

SEQ ID NO: 710769 - protein, 9 aa, Homo Sapiens
YITFEGQRR

SEQ ID NO: 710770 - protein, 9 aa, Homo Sapiens
KVMCCLLHR

SEQ ID NO: 710771 - protein, 9 aa, Homo Sapiens
LRVSGKSGR

SEQ ID NO: 710772 - protein, 9 aa, Homo Sapiens
QPEPGPFPG

SEQ ID NO: 710773 - protein, 9 aa, Homo Sapiens
TDILRKSVR

SEQ ID NO: 710774 - protein, 9 aa, Homo Sapiens
APHGPKSSL

SEQ ID NO: 710775 - protein, 9 aa, Homo Sapiens
KYIERLVWR

SEQ ID NO: 710776 - protein, 9 aa, Homo Sapiens
DLYKSFFVE

SEQ ID NO: 710777 - protein, 9 aa, Homo Sapiens
QQRCSRCSD

SEQ ID NO: 710778 - protein, 9 aa, Homo Sapiens
ASTDTVKQG

SEQ ID NO: 710779 - protein, 9 aa, Homo Sapiens
QEKKRSEQK

SEQ ID NO: 710780 - protein, 9 aa, Homo Sapiens
SDTPSSLDP

SEQ ID NO: 710781 - protein, 9 aa, Homo Sapiens
CEREKLTQQ

SEQ ID NO: 710782 - protein, 9 aa, Homo Sapiens
LVQCVLDNT

SEQ ID NO: 710783 - protein, 9 aa, Homo Sapiens
NHYLRPSRI

SEQ ID NO: 710784 - protein, 9 aa, Homo Sapiens
CPLTVTAAL

SEQ ID NO: 710785 - protein, 9 aa, Homo Sapiens
HMELKCERE

SEQ ID NO: 710786 - protein, 9 aa, Homo Sapiens
LNVRPYAPV

SEQ ID NO: 710787 - protein, 9 aa, Homo Sapiens
AQTPEGHLG

SEQ ID NO: 710788 - protein, 9 aa, Homo Sapiens
TTEKLVVSA

SEQ ID NO: 710789 - protein, 9 aa, Homo Sapiens
CLAICHPLH

SEQ ID NO: 710790 - protein, 9 aa, Homo Sapiens
LPQSYLIEV

SEQ ID NO: 710791 - protein, 9 aa, Homo Sapiens
IHMDYRLHT

SEQ ID NO: 710792 - protein, 9 aa, Homo Sapiens
HSHERPYPC

SEQ ID NO: 710793 - protein, 9 aa, Homo Sapiens
TNSVNKFVD

SEQ ID NO: 710794 - protein, 9 aa, Homo Sapiens
QFYLGLPGS

SEQ ID NO: 710795 - protein, 9 aa, Homo Sapiens
KILLTKPEN

SEQ ID NO: 710796 - protein, 9 aa, Homo Sapiens
LAAVHGELE

SEQ ID NO: 710797 - protein, 9 aa, Homo Sapiens
ESIDDQRLQ

SEQ ID NO: 710798 - protein, 9 aa, Homo Sapiens
IDMEERNCT

SEQ ID NO: 710799 - protein, 9 aa, Homo Sapiens
RASTPCPLT

SEQ ID NO: 710800 - protein, 9 aa, Homo Sapiens
EALAAVHGE

SEQ ID NO: 710801 - protein, 9 aa, Homo Sapiens
DTPSSLDPC

SEQ ID NO: 710802 - protein, 9 aa, Homo Sapiens
KASSTFQGI

SEQ ID NO: 710803 - protein, 9 aa, Homo Sapiens
PSASAQRKT

SEQ ID NO: 710804 - protein, 9 aa, Homo Sapiens
GVPPPPSAR

SEQ ID NO: 710805 - protein, 9 aa, Homo Sapiens
RISAMSEDT

SEQ ID NO: 710806 - protein, 9 aa, Homo Sapiens
SFYSCMVIR

SEQ ID NO: 710807 - protein, 9 aa, Homo Sapiens
SSNVSLILF

SEQ ID NO: 710808 - protein, 9 aa, Homo Sapiens
CSYGFRLGF

SEQ ID NO: 710809 - protein, 9 aa, Homo Sapiens
CRLRNLLDI

SEQ ID NO: 710810 - protein, 9 aa, Homo Sapiens
SLTIDTAKF

SEQ ID NO: 710811 - protein, 9 aa, Homo Sapiens
SQPASNTDR

SEQ ID NO: 710812 - protein, 9 aa, Homo Sapiens
QTPEGHLGN

SEQ ID NO: 710813 - protein, 9 aa, Homo Sapiens
SDGYRTVLQ

SEQ ID NO: 710814 - protein, 9 aa, Homo Sapiens
QNDGITVHF

SEQ ID NO: 710815 - protein, 9 aa, Homo Sapiens
LAICHPLHY

SEQ ID NO: 710816 - protein, 9 aa, Homo Sapiens
DTDSSSSDE

SEQ ID NO: 710817 - protein, 9 aa, Homo Sapiens
VPTPCLIED

SEQ ID NO: 710818 - protein, 9 aa, Homo Sapiens
SDLSAVSAL

SEQ ID NO: 710819 - protein, 9 aa, Homo Sapiens
TLGKIEDCI

SEQ ID NO: 710820 - protein, 9 aa, Homo Sapiens
QKNTTEKLV

SEQ ID NO: 710821 - protein, 9 aa, Homo Sapiens
DIDLGVSGE

SEQ ID NO: 710822 - protein, 9 aa, Homo Sapiens
TGGIVDKAS

SEQ ID NO: 710823 - protein, 9 aa, Homo Sapiens
AALSVIINM

SEQ ID NO: 710824 - protein, 9 aa, Homo Sapiens
KDMVALRKL

SEQ ID NO: 710825 - protein, 9 aa, Homo Sapiens
VFDGLQLSV

SEQ ID NO: 710826 - protein, 9 aa, Homo Sapiens
SNDDGTQVQ

SEQ ID NO: 710827 - protein, 9 aa, Homo Sapiens
QRRKASLEG

SEQ ID NO: 710828 - protein, 9 aa, Homo Sapiens
SPLGHDMVR

SEQ ID NO: 710829 - protein, 9 aa, Homo Sapiens
TSHNLLKNL

SEQ ID NO: 710830 - protein, 9 aa, Homo Sapiens
CHKLVDLQG

SEQ ID NO: 710831 - protein, 9 aa, Homo Sapiens
LACASRKDH

SEQ ID NO: 710832 - protein, 9 aa, Homo Sapiens
YEKKVCLNE

SEQ ID NO: 710833 - protein, 9 aa, Homo Sapiens
AVGNISLVA

SEQ ID NO: 710834 - protein, 9 aa, Homo Sapiens
MDYRLHTPM

SEQ ID NO: 710835 - protein, 9 aa, Homo Sapiens
HMDYRLHTP

SEQ ID NO: 710836 - protein, 9 aa, Homo Sapiens
ILLIHMDYR

SEQ ID NO: 710837 - protein, 9 aa, Homo Sapiens
SNINSASLT

SEQ ID NO: 710838 - protein, 9 aa, Homo Sapiens
TPISDGYRT

SEQ ID NO: 710839 - protein, 9 aa, Homo Sapiens
TRSALLTHC

SEQ ID NO: 710840 - protein, 9 aa, Homo Sapiens
FEEPFVADK

SEQ ID NO: 710841 - protein, 9 aa, Homo Sapiens
RSDITDNAV

SEQ ID NO: 710842 - protein, 9 aa, Homo Sapiens
GCLIWNTRG

SEQ ID NO: 710843 - protein, 9 aa, Homo Sapiens
CQLTLSGLN

SEQ ID NO: 710844 - protein, 9 aa, Homo Sapiens
DLFDYLPLA

SEQ ID NO: 710845 - protein, 9 aa, Homo Sapiens
LACEWCQLT

SEQ ID NO: 710846 - protein, 9 aa, Homo Sapiens
QPASNTDRR

SEQ ID NO: 710847 - protein, 9 aa, Homo Sapiens
KAKSGDAHL

SEQ ID NO: 710848 - protein, 9 aa, Homo Sapiens
VIINMNNSP

SEQ ID NO: 710849 - protein, 9 aa, Homo Sapiens
DKYIERLVW

SEQ ID NO: 710850 - protein, 9 aa, Homo Sapiens
NSVNKFVDI

SEQ ID NO: 710851 - protein, 9 aa, Homo Sapiens
VFPKKEALK

SEQ ID NO: 710852 - protein, 9 aa, Homo Sapiens
RPGFGYRGR

SEQ ID NO: 710853 - protein, 9 aa, Homo Sapiens
REGKGHEYK

SEQ ID NO: 710854 - protein, 9 aa, Homo Sapiens
QPWLLRVSG

SEQ ID NO: 710855 - protein, 9 aa, Homo Sapiens
GIACLRPLR

SEQ ID NO: 710856 - protein, 9 aa, Homo Sapiens
ASTPCPLTV

SEQ ID NO: 710857 - protein, 9 aa, Homo Sapiens
TPLLVKIKK

SEQ ID NO: 710858 - protein, 9 aa, Homo Sapiens
EDTKLIVVV

SEQ ID NO: 710859 - protein, 9 aa, Homo Sapiens
DLYNRNGKY

SEQ ID NO: 710860 - protein, 9 aa, Homo Sapiens
TLRNKDMVA

SEQ ID NO: 710861 - protein, 9 aa, Homo Sapiens
RELPEGWSL

SEQ ID NO: 710862 - protein, 9 aa, Homo Sapiens
SAPLILRSL

SEQ ID NO: 710863 - protein, 9 aa, Homo Sapiens
FVADKYIER

SEQ ID NO: 710864 - protein, 9 aa, Homo Sapiens
LGFLLPLLV

SEQ ID NO: 710865 - protein, 9 aa, Homo Sapiens
PSAGVNQVS

SEQ ID NO: 710866 - protein, 9 aa, Homo Sapiens
TVKQGLVEN

SEQ ID NO: 710867 - protein, 9 aa, Homo Sapiens
LKPVISDIE

SEQ ID NO: 710868 - protein, 9 aa, Homo Sapiens
NKDMVALRK

SEQ ID NO: 710869 - protein, 9 aa, Homo Sapiens
SIDDQRLQK

SEQ ID NO: 710870 - protein, 9 aa, Homo Sapiens
VSSLACASR

SEQ ID NO: 710871 - protein, 9 aa, Homo Sapiens
RPRALVSSG

SEQ ID NO: 710872 - protein, 9 aa, Homo Sapiens
LLSNKNKFK

SEQ ID NO: 710873 - protein, 9 aa, Homo Sapiens
VFDRPVHCR

SEQ ID NO: 710874 - protein, 9 aa, Homo Sapiens
SASAQRKTE

SEQ ID NO: 710875 - protein, 9 aa, Homo Sapiens
GLFLVPTPC

SEQ ID NO: 710876 - protein, 9 aa, Homo Sapiens
DNAVCRRCP

SEQ ID NO: 710877 - protein, 9 aa, Homo Sapiens
DFYTSHNLL

SEQ ID NO: 710878 - protein, 9 aa, Homo Sapiens
YEMHVPEGL

SEQ ID NO: 710879 - protein, 9 aa, Homo Sapiens
QSKVSSLAC

SEQ ID NO: 710880 - protein, 9 aa, Homo Sapiens
GYRGRASDY

SEQ ID NO: 710881 - protein, 9 aa, Homo Sapiens
WPGVPPPPS

SEQ ID NO: 710882 - protein, 9 aa, Homo Sapiens
QDIDLGVSG

SEQ ID NO: 710883 - protein, 9 aa, Homo Sapiens
GHRRVHSHE

SEQ ID NO: 710884 - protein, 9 aa, Homo Sapiens
PARISAMSE

SEQ ID NO: 710885 - protein, 9 aa, Homo Sapiens
GAGGCLVWS

SEQ ID NO: 710886 - protein, 9 aa, Homo Sapiens
LPLAALVDG

SEQ ID NO: 710887 - protein, 9 aa, Homo Sapiens
VSKKYLQFY

SEQ ID NO: 710888 - protein, 9 aa, Homo Sapiens
RCVYKARSR

SEQ ID NO: 710889 - protein, 9 aa, Homo Sapiens
PGKVALEML

SEQ ID NO: 710890 - protein, 9 aa, Homo Sapiens
ARISAMSED

SEQ ID NO: 710891 - protein, 9 aa, Homo Sapiens
LRNKDMVAL

SEQ ID NO: 710892 - protein, 9 aa, Homo Sapiens
STNVNSSSF

SEQ ID NO: 710893 - protein, 9 aa, Homo Sapiens
NPHGLAGHR

SEQ ID NO: 710894 - protein, 9 aa, Homo Sapiens
LILRSLFVC

SEQ ID NO: 710895 - protein, 9 aa, Homo Sapiens
NDGITVHFK

SEQ ID NO: 710896 - protein, 9 aa, Homo Sapiens
LSDMGLGID

SEQ ID NO: 710897 - protein, 9 aa, Homo Sapiens
YIFATFLGL

SEQ ID NO: 710898 - protein, 9 aa, Homo Sapiens
ITAVGNISL

SEQ ID NO: 710899 - protein, 9 aa, Homo Sapiens
VICSGPNDT

SEQ ID NO: 710900 - protein, 9 aa, Homo Sapiens
LVDLQGPLK

SEQ ID NO: 710901 - protein, 9 aa, Homo Sapiens
INMNNSPFD

SEQ ID NO: 710902 - protein, 9 aa, Homo Sapiens
PFICPQFHM

SEQ ID NO: 710903 - protein, 9 aa, Homo Sapiens
FLQPEPGPF

SEQ ID NO: 710904 - protein, 9 aa, Homo Sapiens
DKASSTFQG

SEQ ID NO: 710905 - protein, 9 aa, Homo Sapiens
EEPFVADKY

SEQ ID NO: 710906 - protein, 9 aa, Homo Sapiens
DQFLWEVLK

SEQ ID NO: 710907 - protein, 9 aa, Homo Sapiens
VRPTPQNDG

SEQ ID NO: 710908 - protein, 9 aa, Homo Sapiens
RPTGGIVDK

SEQ ID NO: 710909 - protein, 9 aa, Homo Sapiens
DCIKVWIKQ

SEQ ID NO: 710910 - protein, 9 aa, Homo Sapiens
PVKKVICSG

SEQ ID NO: 710911 - protein, 9 aa, Homo Sapiens
VTLSTNVNS

SEQ ID NO: 710912 - protein, 9 aa, Homo Sapiens
HRVSCGKTS

SEQ ID NO: 710913 - protein, 9 aa, Homo Sapiens
RAVPGKVAL

SEQ ID NO: 710914 - protein, 9 aa, Homo Sapiens
LFLVPTPCL

SEQ ID NO: 710915 - protein, 9 aa, Homo Sapiens
IWNTRGFLS

SEQ ID NO: 710916 - protein, 9 aa, Homo Sapiens
VASSLGTPE

SEQ ID NO: 710917 - protein, 9 aa, Homo Sapiens
VYIFATFLG

SEQ ID NO: 710918 - protein, 9 aa, Homo Sapiens
EEEEEDEKE

SEQ ID NO: 710919 - protein, 9 aa, Homo Sapiens
TNVNSSSFL

SEQ ID NO: 710920 - protein, 9 aa, Homo Sapiens
VIFEVLEEC

SEQ ID NO: 710921 - protein, 9 aa, Homo Sapiens
QYCRVKKCL

SEQ ID NO: 710922 - protein, 9 aa, Homo Sapiens
SVVQAGVQR

SEQ ID NO: 710923 - protein, 9 aa, Homo Sapiens
LLVQCVLDN

SEQ ID NO: 710924 - protein, 9 aa, Homo Sapiens
KARSRLLAC

SEQ ID NO: 710925 - protein, 9 aa, Homo Sapiens
LTVLGFLLP

SEQ ID NO: 710926 - protein, 9 aa, Homo Sapiens
INGYVFDGL

SEQ ID NO: 710927 - protein, 9 aa, Homo Sapiens
EEGKTNSVN

SEQ ID NO: 710928 - protein, 9 aa, Homo Sapiens
SHNLLKNLA

SEQ ID NO: 710929 - protein, 9 aa, Homo Sapiens
MFTDILRKS

SEQ ID NO: 710930 - protein, 9 aa, Homo Sapiens
VPEGLRVGF

SEQ ID NO: 710931 - protein, 9 aa, Homo Sapiens
SQTVLDKFS

SEQ ID NO: 710932 - protein, 9 aa, Homo Sapiens
LRPLRPFAG

SEQ ID NO: 710933 - protein, 9 aa, Homo Sapiens
PDLYNRNGK

SEQ ID NO: 710934 - protein, 9 aa, Homo Sapiens
FCGTFRPRA

SEQ ID NO: 710935 - protein, 9 aa, Homo Sapiens
QRPGFGYRG

SEQ ID NO: 710936 - protein, 9 aa, Homo Sapiens
ESFKYAWVL

SEQ ID NO: 710937 - protein, 9 aa, Homo Sapiens
YQCSYGFRL

SEQ ID NO: 710938 - protein, 9 aa, Homo Sapiens
RNNRLMDGY

SEQ ID NO: 710939 - protein, 9 aa, Homo Sapiens
EVEMHESDI

SEQ ID NO: 710940 - protein, 9 aa, Homo Sapiens
MVRALMYYA

SEQ ID NO: 710941 - protein, 9 aa, Homo Sapiens
HVPEGLRVG

SEQ ID NO: 710942 - protein, 9 aa, Homo Sapiens
VRNNRLMDG

SEQ ID NO: 710943 - protein, 9 aa, Homo Sapiens
DLTCSWPAS

SEQ ID NO: 710944 - protein, 9 aa, Homo Sapiens
LYKSFFVEL

SEQ ID NO: 710945 - protein, 9 aa, Homo Sapiens
WISDNIVKS

SEQ ID NO: 710946 - protein, 9 aa, Homo Sapiens
RCSRCSDGV

SEQ ID NO: 710947 - protein, 9 aa, Homo Sapiens
KGCLIWNTR

SEQ ID NO: 710948 - protein, 9 aa, Homo Sapiens
ANTEEGKTN

SEQ ID NO: 710949 - protein, 9 aa, Homo Sapiens
TIDTAKFFL

SEQ ID NO: 710950 - protein, 9 aa, Homo Sapiens
VIAIHPIRR

SEQ ID NO: 710951 - protein, 9 aa, Homo Sapiens
RPIYITFEG

SEQ ID NO: 710952 - protein, 9 aa, Homo Sapiens
QDAEAKNIL

SEQ ID NO: 710953 - protein, 9 aa, Homo Sapiens
SVIINMNNS

SEQ ID NO: 710954 - protein, 9 aa, Homo Sapiens
AIISQLLNQ

SEQ ID NO: 710955 - protein, 9 aa, Homo Sapiens
PFSASTDTV

SEQ ID NO: 710956 - protein, 9 aa, Homo Sapiens
VKKVICSGP

SEQ ID NO: 710957 - protein, 9 aa, Homo Sapiens
SSLLGARLC

SEQ ID NO: 710958 - protein, 9 aa, Homo Sapiens
QPLPSAGVN

SEQ ID NO: 710959 - protein, 9 aa, Homo Sapiens
PPPQGEYLS

SEQ ID NO: 710960 - protein, 9 aa, Homo Sapiens
EYLSDMGLG

SEQ ID NO: 710961 - protein, 9 aa, Homo Sapiens
RALVSSGNK

SEQ ID NO: 710962 - protein, 9 aa, Homo Sapiens
ALAAVHGEL

SEQ ID NO: 710963 - protein, 9 aa, Homo Sapiens
PISDGYRTV

SEQ ID NO: 710964 - protein, 9 aa, Homo Sapiens
GVTVTRSAL

SEQ ID NO: 710965 - protein, 9 aa, Homo Sapiens
DTSSASTSH

SEQ ID NO: 710966 - protein, 9 aa, Homo Sapiens
EMPRASTPC

SEQ ID NO: 710967 - protein, 9 aa, Homo Sapiens
GTFRPRALV

SEQ ID NO: 710968 - protein, 9 aa, Homo Sapiens
LRITAEVEE

SEQ ID NO: 710969 - protein, 9 aa, Homo Sapiens
PPMEPEGES

SEQ ID NO: 710970 - protein, 9 aa, Homo Sapiens
QRLDHAEAN

SEQ ID NO: 710971 - protein, 9 aa, Homo Sapiens
TDTVKQGLV

SEQ ID NO: 710972 - protein, 9 aa, Homo Sapiens
EIWSMFTDI

SEQ ID NO: 710973 - protein, 9 aa, Homo Sapiens
SMFTDILRK

SEQ ID NO: 710974 - protein, 9 aa, Homo Sapiens
SKGPLVASS

SEQ ID NO: 710975 - protein, 9 aa, Homo Sapiens
DPVKKVICS

SEQ ID NO: 710976 - protein, 9 aa, Homo Sapiens
KPENARLVL

SEQ ID NO: 710977 - protein, 9 aa, Homo Sapiens
KLSEEEQTK

SEQ ID NO: 710978 - protein, 9 aa, Homo Sapiens
QATSRPIPS

SEQ ID NO: 710979 - protein, 9 aa, Homo Sapiens
IPGCTAPTH

SEQ ID NO: 710980 - protein, 9 aa, Homo Sapiens
SASLTRPAG

SEQ ID NO: 710981 - protein, 9 aa, Homo Sapiens
ACASRKDHV

SEQ ID NO: 710982 - protein, 9 aa, Homo Sapiens
GKGHEYKNQ

SEQ ID NO: 710983 - protein, 9 aa, Homo Sapiens
RLRNLLDIA

SEQ ID NO: 710984 - protein, 9 aa, Homo Sapiens
MQELFPGHS

SEQ ID NO: 710985 - protein, 9 aa, Homo Sapiens
ICHPLHYGA

SEQ ID NO: 710986 - protein, 9 aa, Homo Sapiens
QKVMCCLLH

SEQ ID NO: 710987 - protein, 9 aa, Homo Sapiens
EPAALSVII

SEQ ID NO: 710988 - protein, 9 aa, Homo Sapiens
VLEECDWTS

SEQ ID NO: 710989 - protein, 9 aa, Homo Sapiens
MREKSYECQ

SEQ ID NO: 710990 - protein, 9 aa, Homo Sapiens
RVRGTLFLQ

SEQ ID NO: 710991 - protein, 9 aa, Homo Sapiens
FFAIYLITA

SEQ ID NO: 710992 - protein, 9 aa, Homo Sapiens
KPVISDIEA

SEQ ID NO: 710993 - protein, 9 aa, Homo Sapiens
RPLRPFAGA

SEQ ID NO: 710994 - protein, 9 aa, Homo Sapiens
DSLLKIPDR

SEQ ID NO: 710995 - protein, 9 aa, Homo Sapiens
LMDGYPMQI

SEQ ID NO: 710996 - protein, 9 aa, Homo Sapiens
LAALVDGQI

SEQ ID NO: 710997 - protein, 9 aa, Homo Sapiens
SRISEMSLV

SEQ ID NO: 710998 - protein, 9 aa, Homo Sapiens
LIWNTRGFL

SEQ ID NO: 710999 - protein, 9 aa, Homo Sapiens
RGTRPEGTS

SEQ ID NO: 711000 - protein, 9 aa, Homo Sapiens
ASMAYALRS

SEQ ID NO: 711001 - protein, 9 aa, Homo Sapiens
VDVEDDLTC

SEQ ID NO: 711002 - protein, 9 aa, Homo Sapiens
MILLIHMDY

SEQ ID NO: 711003 - protein, 9 aa, Homo Sapiens
SCMVIRDLT

SEQ ID NO: 711004 - protein, 9 aa, Homo Sapiens
KGHEYKNQT

SEQ ID NO: 711005 - protein, 9 aa, Homo Sapiens
LHRYLTSMR

SEQ ID NO: 711006 - protein, 9 aa, Homo Sapiens
SYLIEVELE

SEQ ID NO: 711007 - protein, 9 aa, Homo Sapiens
PSNINSASL

SEQ ID NO: 711008 - protein, 9 aa, Homo Sapiens
TFRPRALVS

SEQ ID NO: 711009 - protein, 9 aa, Homo Sapiens
SHATSLPVT

SEQ ID NO: 711010 - protein, 9 aa, Homo Sapiens
TPCLIEDVA

SEQ ID NO: 711011 - protein, 9 aa, Homo Sapiens
SMAGFKGEG

SEQ ID NO: 711012 - protein, 9 aa, Homo Sapiens
EGTSEPRSS

SEQ ID NO: 711013 - protein, 9 aa, Homo Sapiens
LLVQLLDAS

SEQ ID NO: 711014 - protein, 9 aa, Homo Sapiens
WRVRNNRLM

SEQ ID NO: 711015 - protein, 9 aa, Homo Sapiens
ELHRVSCGK

SEQ ID NO: 711016 - protein, 9 aa, Homo Sapiens
CNSGFAIDM

SEQ ID NO: 711017 - protein, 9 aa, Homo Sapiens
PTPCLIEDV

SEQ ID NO: 711018 - protein, 9 aa, Homo Sapiens
SSLDPCPDE

SEQ ID NO: 711019 - protein, 9 aa, Homo Sapiens
MRLFTPISD

SEQ ID NO: 711020 - protein, 9 aa, Homo Sapiens
LVKIKKQTY

SEQ ID NO: 711021 - protein, 9 aa, Homo Sapiens
VKMPKFSMA

SEQ ID NO: 711022 - protein, 9 aa, Homo Sapiens
DITDNAVCR

SEQ ID NO: 711023 - protein, 9 aa, Homo Sapiens
QKTYQCSYG

SEQ ID NO: 711024 - protein, 9 aa, Homo Sapiens
VLDLANPHG

SEQ ID NO: 711025 - protein, 9 aa, Homo Sapiens
KQDKNSQQR

SEQ ID NO: 711026 - protein, 9 aa, Homo Sapiens
TVTRSALLT

SEQ ID NO: 711027 - protein, 9 aa, Homo Sapiens
ILFVLDQND

SEQ ID NO: 711028 - protein, 9 aa, Homo Sapiens
WEELHRVSC

SEQ ID NO: 711029 - protein, 9 aa, Homo Sapiens
SEKPEMKQK

SEQ ID NO: 711030 - protein, 9 aa, Homo Sapiens
ILILMSYGY

SEQ ID NO: 711031 - protein, 9 aa, Homo Sapiens
CRVKKCLKV

SEQ ID NO: 711032 - protein, 9 aa, Homo Sapiens
EDSLLKIPD

SEQ ID NO: 711033 - protein, 9 aa, Homo Sapiens
ASKRHCTED

SEQ ID NO: 711034 - protein, 9 aa, Homo Sapiens
REKSYECQQ

SEQ ID NO: 711035 - protein, 9 aa, Homo Sapiens
ITAEVEEVE

SEQ ID NO: 711036 - protein, 9 aa, Homo Sapiens
EDEKEEGEE

SEQ ID NO: 711037 - protein, 9 aa, Homo Sapiens
IVNHYLRPS

SEQ ID NO: 711038 - protein, 9 aa, Homo Sapiens
MNQHDTDMK

SEQ ID NO: 711039 - protein, 9 aa, Homo Sapiens
GKESFKYAW

SEQ ID NO: 711040 - protein, 9 aa, Homo Sapiens
ISDGYRTVL

SEQ ID NO: 711041 - protein, 9 aa, Homo Sapiens
LLPRFVHRV

SEQ ID NO: 711042 - protein, 9 aa, Homo Sapiens
SSSITLQAT

SEQ ID NO: 711043 - protein, 9 aa, Homo Sapiens
KRLQYLGKL

SEQ ID NO: 711044 - protein, 9 aa, Homo Sapiens
PTPLPMIGN

SEQ ID NO: 711045 - protein, 9 aa, Homo Sapiens
DTVKQGLVE

SEQ ID NO: 711046 - protein, 9 aa, Homo Sapiens
DYRLHTPMY

SEQ ID NO: 711047 - protein, 9 aa, Homo Sapiens
YLGKLNLPE

SEQ ID NO: 711048 - protein, 9 aa, Homo Sapiens
VPGFSAPLI

SEQ ID NO: 711049 - protein, 9 aa, Homo Sapiens
QKILLTKPE

SEQ ID NO: 711050 - protein, 9 aa, Homo Sapiens
KLHMELKCE

SEQ ID NO: 711051 - protein, 9 aa, Homo Sapiens
FFLSCLLPW

SEQ ID NO: 711052 - protein, 9 aa, Homo Sapiens
ALTVLGFLL

SEQ ID NO: 711053 - protein, 9 aa, Homo Sapiens
ASLTRPAGT

SEQ ID NO: 711054 - protein, 9 aa, Homo Sapiens
FGEVFVDGD

SEQ ID NO: 711055 - protein, 9 aa, Homo Sapiens
WVELPVVVR

SEQ ID NO: 711056 - protein, 9 aa, Homo Sapiens
EMGKESFKY

SEQ ID NO: 711057 - protein, 9 aa, Homo Sapiens
MELKCEREK

SEQ ID NO: 711058 - protein, 9 aa, Homo Sapiens
AAVHGELES

SEQ ID NO: 711059 - protein, 9 aa, Homo Sapiens
VFVDGDVVH

SEQ ID NO: 711060 - protein, 9 aa, Homo Sapiens
SDIEAQGPG

SEQ ID NO: 711061 - protein, 9 aa, Homo Sapiens
EQTKKKHRR

SEQ ID NO: 711062 - protein, 9 aa, Homo Sapiens
LDLANPHGL

SEQ ID NO: 711063 - protein, 9 aa, Homo Sapiens
VQEVRDSDL

SEQ ID NO: 711064 - protein, 9 aa, Homo Sapiens
KNKFKSFLR

SEQ ID NO: 711065 - protein, 9 aa, Homo Sapiens
IACLRPLRP

SEQ ID NO: 711066 - protein, 9 aa, Homo Sapiens
MSYGYIAKA

SEQ ID NO: 711067 - protein, 9 aa, Homo Sapiens
VEYLNVRPY

SEQ ID NO: 711068 - protein, 9 aa, Homo Sapiens
PIYITFEGQ

SEQ ID NO: 711069 - protein, 9 aa, Homo Sapiens
NTNSCNVFP

SEQ ID NO: 711070 - protein, 9 aa, Homo Sapiens
EKSYECQQC

SEQ ID NO: 711071 - protein, 9 aa, Homo Sapiens
TPDQTEVLV

SEQ ID NO: 711072 - protein, 9 aa, Homo Sapiens
EMSLQEKKR

SEQ ID NO: 711073 - protein, 9 aa, Homo Sapiens
GFLLPLLVI

SEQ ID NO: 711074 - protein, 9 aa, Homo Sapiens
GGCLVWSPV

SEQ ID NO: 711075 - protein, 9 aa, Homo Sapiens
DKSPSQPAS

SEQ ID NO: 711076 - protein, 9 aa, Homo Sapiens
TRRPIYITF

SEQ ID NO: 711077 - protein, 9 aa, Homo Sapiens
CRKLAQLEK

SEQ ID NO: 711078 - protein, 9 aa, Homo Sapiens
KEAAEMGKE

SEQ ID NO: 711079 - protein, 9 aa, Homo Sapiens
QLQQYEMHV

SEQ ID NO: 711080 - protein, 9 aa, Homo Sapiens
CLNEIYTKT

SEQ ID NO: 711081 - protein, 9 aa, Homo Sapiens
QVKKVTKEK

SEQ ID NO: 711082 - protein, 9 aa, Homo Sapiens
TLSTNVNSS

SEQ ID NO: 711083 - protein, 9 aa, Homo Sapiens
NPEALAAVH

SEQ ID NO: 711084 - protein, 9 aa, Homo Sapiens
EELHRVSCG

SEQ ID NO: 711085 - protein, 9 aa, Homo Sapiens
LVQLLDASQ

SEQ ID NO: 711086 - protein, 9 aa, Homo Sapiens
FDYLPLAAL

SEQ ID NO: 711087 - protein, 9 aa, Homo Sapiens
KNQTFEGRQ

SEQ ID NO: 711088 - protein, 9 aa, Homo Sapiens
LGARLCWMG

SEQ ID NO: 711089 - protein, 9 aa, Homo Sapiens
HTSTIDLYK

SEQ ID NO: 711090 - protein, 9 aa, Homo Sapiens
ARAVPGKVA

SEQ ID NO: 711091 - protein, 9 aa, Homo Sapiens
RPYAPVTFH

SEQ ID NO: 711092 - protein, 9 aa, Homo Sapiens
VTVTRSALL

SEQ ID NO: 711093 - protein, 9 aa, Homo Sapiens
GTLFLQPEP

SEQ ID NO: 711094 - protein, 9 aa, Homo Sapiens
PAALSVIIN

SEQ ID NO: 711095 - protein, 9 aa, Homo Sapiens
HNLLKNLAL

SEQ ID NO: 711096 - protein, 9 aa, Homo Sapiens
IVKSKTELK

SEQ ID NO: 711097 - protein, 9 aa, Homo Sapiens
CHPLHYGAI

SEQ ID NO: 711098 - protein, 9 aa, Homo Sapiens
ASLEGVSKD

SEQ ID NO: 711099 - protein, 9 aa, Homo Sapiens
QTKKKHRRN

SEQ ID NO: 711100 - protein, 9 aa, Homo Sapiens
DLANPHGLA

SEQ ID NO: 711101 - protein, 9 aa, Homo Sapiens
FDRPVHCRK

SEQ ID NO: 711102 - protein, 9 aa, Homo Sapiens
RPEGTSEPR

SEQ ID NO: 711103 - protein, 9 aa, Homo Sapiens
YDQFLWEVL

SEQ ID NO: 711104 - protein, 9 aa, Homo Sapiens
PVISDIEAQ

SEQ ID NO: 711105 - protein, 9 aa, Homo Sapiens
KFKSFLRTI

SEQ ID NO: 711106 - protein, 9 aa, Homo Sapiens
ALLPRFVHR

SEQ ID NO: 711107 - protein, 9 aa, Homo Sapiens
TEEGKTNSV

SEQ ID NO: 711108 - protein, 9 aa, Homo Sapiens
FATFLGLSY

SEQ ID NO: 711109 - protein, 9 aa, Homo Sapiens
PLILRSLFV

SEQ ID NO: 711110 - protein, 9 aa, Homo Sapiens
TSSASTSHA

SEQ ID NO: 711111 - protein, 9 aa, Homo Sapiens
PGPTPLPMI

SEQ ID NO: 711112 - protein, 9 aa, Homo Sapiens
RRPIYITFE

SEQ ID NO: 711113 - protein, 9 aa, Homo Sapiens
RNGKYFNVE

SEQ ID NO: 711114 - protein, 9 aa, Homo Sapiens
IEPPMEPEG

SEQ ID NO: 711115 - protein, 9 aa, Homo Sapiens
SKVSSLACA

SEQ ID NO: 711116 - protein, 9 aa, Homo Sapiens
YTSHNLLKN

SEQ ID NO: 711117 - protein, 9 aa, Homo Sapiens
AQRKTEMVL

SEQ ID NO: 711118 - protein, 9 aa, Homo Sapiens
VASMAYALR

SEQ ID NO: 711119 - protein, 9 aa, Homo Sapiens
IEDCIKVWI

SEQ ID NO: 711120 - protein, 9 aa, Homo Sapiens
DLQGPLKDC

SEQ ID NO: 711121 - protein, 9 aa, Homo Sapiens
EEEDEKEEG

SEQ ID NO: 711122 - protein, 9 aa, Homo Sapiens
IISQLLNQT

SEQ ID NO: 711123 - protein, 9 aa, Homo Sapiens
SLDPCPDEI

SEQ ID NO: 711124 - protein, 9 aa, Homo Sapiens
DRCLAICHP

SEQ ID NO: 711125 - protein, 9 aa, Homo Sapiens
QLLDASQTV

SEQ ID NO: 711126 - protein, 9 aa, Homo Sapiens
VHRVLQGSL

SEQ ID NO: 711127 - protein, 9 aa, Homo Sapiens
VNHYLRPSR

SEQ ID NO: 711128 - protein, 9 aa, Homo Sapiens
GRGTPGDDS

SEQ ID NO: 711129 - protein, 9 aa, Homo Sapiens
GPFICPQFH

SEQ ID NO: 711130 - protein, 9 aa, Homo Sapiens
PDQTEVLVI

SEQ ID NO: 711131 - protein, 9 aa, Homo Sapiens
KKRSEQKFY

SEQ ID NO: 711132 - protein, 9 aa, Homo Sapiens
EVRDSDLSA

SEQ ID NO: 711133 - protein, 9 aa, Homo Sapiens
AEVEEVEMH

SEQ ID NO: 711134 - protein, 9 aa, Homo Sapiens
NVSLILFVL

SEQ ID NO: 711135 - protein, 9 aa, Homo Sapiens
DYLPLAALV

SEQ ID NO: 711136 - protein, 9 aa, Homo Sapiens
HSYFDTDSS

SEQ ID NO: 711137 - protein, 9 aa, Homo Sapiens
LNQTKTEQD

SEQ ID NO: 711138 - protein, 9 aa, Homo Sapiens
LWEVLKLPT

SEQ ID NO: 711139 - protein, 9 aa, Homo Sapiens
VVRELPEGW

SEQ ID NO: 711140 - protein, 9 aa, Homo Sapiens
VADKYIERL

SEQ ID NO: 711141 - protein, 9 aa, Homo Sapiens
DLGVSGEVF

SEQ ID NO: 711142 - protein, 9 aa, Homo Sapiens
SAMSEDTKL

SEQ ID NO: 711143 - protein, 9 aa, Homo Sapiens
RLFTPISDG

SEQ ID NO: 711144 - protein, 9 aa, Homo Sapiens
GWAEDVASM

SEQ ID NO: 711145 - protein, 9 aa, Homo Sapiens
GGRSDITDN

SEQ ID NO: 711146 - protein, 9 aa, Homo Sapiens
MIGNILQIG

SEQ ID NO: 711147 - protein, 9 aa, Homo Sapiens
WSPVPLVTL

SEQ ID NO: 711148 - protein, 9 aa, Homo Sapiens
KGPLVASSL

SEQ ID NO: 711149 - protein, 9 aa, Homo Sapiens
NIVKSKTEL

SEQ ID NO: 711150 - protein, 9 aa, Homo Sapiens
LSTNVNSSS

SEQ ID NO: 711151 - protein, 9 aa, Homo Sapiens
QCVLDNTIH

SEQ ID NO: 711152 - protein, 9 aa, Homo Sapiens
FPKKEALKM

SEQ ID NO: 711153 - protein, 9 aa, Homo Sapiens
EDCIKVWIK

SEQ ID NO: 711154 - protein, 9 aa, Homo Sapiens
TPCPLTVTA

SEQ ID NO: 711155 - protein, 9 aa, Homo Sapiens
SQHSYFDTD

SEQ ID NO: 711156 - protein, 9 aa, Homo Sapiens
VHSHERPYP

SEQ ID NO: 711157 - protein, 9 aa, Homo Sapiens
AKSGDAHLF

SEQ ID NO: 711158 - protein, 9 aa, Homo Sapiens
TDTSSASTS

SEQ ID NO: 711159 - protein, 9 aa, Homo Sapiens
RVKKCLKVG

SEQ ID NO: 711160 - protein, 9 aa, Homo Sapiens
AIHPIRRIT

SEQ ID NO: 711161 - protein, 9 aa, Homo Sapiens
CLIWNTRGF

SEQ ID NO: 711162 - protein, 9 aa, Homo Sapiens
PVHCRKLAQ

SEQ ID NO: 711163 - protein, 9 aa, Homo Sapiens
PGFSAPLIL

SEQ ID NO: 711164 - protein, 9 aa, Homo Sapiens
ALARAVPGK

SEQ ID NO: 711165 - protein, 9 aa, Homo Sapiens
PDRWIYGVS

SEQ ID NO: 711166 - protein, 9 aa, Homo Sapiens
EMKQKWASR

SEQ ID NO: 711167 - protein, 9 aa, Homo Sapiens
YLNVRPYAP

SEQ ID NO: 711168 - protein, 9 aa, Homo Sapiens
VLGPFICPQ

SEQ ID NO: 711169 - protein, 9 aa, Homo Sapiens
YVFDGLQLS

SEQ ID NO: 711170 - protein, 9 aa, Homo Sapiens
SLLGARLCW

SEQ ID NO: 711171 - protein, 9 aa, Homo Sapiens
LPRFVHRVL

SEQ ID NO: 711172 - protein, 9 aa, Homo Sapiens
PRALVSSGN

SEQ ID NO: 711173 - protein, 9 aa, Homo Sapiens
NRQELQDEL

SEQ ID NO: 711174 - protein, 9 aa, Homo Sapiens
CQYCRVKKC

SEQ ID NO: 711175 - protein, 9 aa, Homo Sapiens
SLILFVLDQ

SEQ ID NO: 711176 - protein, 9 aa, Homo Sapiens
PLVASSLGT

SEQ ID NO: 711177 - protein, 9 aa, Homo Sapiens
VFALTVLGF

SEQ ID NO: 711178 - protein, 9 aa, Homo Sapiens
GARLCWMGN

SEQ ID NO: 711179 - protein, 9 aa, Homo Sapiens
RDSPLGHDM

SEQ ID NO: 711180 - protein, 9 aa, Homo Sapiens
LLSEKPEMK

SEQ ID NO: 711181 - protein, 9 aa, Homo Sapiens
LGHDMVRAL

SEQ ID NO: 711182 - protein, 9 aa, Homo Sapiens
SEDTKLIVV

SEQ ID NO: 711183 - protein, 9 aa, Homo Sapiens
IDLGVSGEV

SEQ ID NO: 711184 - protein, 9 aa, Homo Sapiens
ATFLGLSYD

SEQ ID NO: 711185 - protein, 9 aa, Homo Sapiens
LKNLALFLK

SEQ ID NO: 711186 - protein, 9 aa, Homo Sapiens
PRASTPCPL

SEQ ID NO: 711187 - protein, 9 aa, Homo Sapiens
PCLIEDVAW

SEQ ID NO: 711188 - protein, 9 aa, Homo Sapiens
VEDDLTCSW

SEQ ID NO: 711189 - protein, 9 aa, Homo Sapiens
FRPRALVSS

SEQ ID NO: 711190 - protein, 9 aa, Homo Sapiens
FEVLEECDW

SEQ ID NO: 711191 - protein, 9 aa, Homo Sapiens
QGAVLGPFI

SEQ ID NO: 711192 - protein, 9 aa, Homo Sapiens
MVIFCADQP

SEQ ID NO: 711193 - protein, 9 aa, Homo Sapiens
LQATRVQPE

SEQ ID NO: 711194 - protein, 9 aa, Homo Sapiens
EKIAFQYGV

SEQ ID NO: 711195 - protein, 9 aa, Homo Sapiens
DDLTCSWPA

SEQ ID NO: 711196 - protein, 9 aa, Homo Sapiens
YAPVTFHAG

SEQ ID NO: 711197 - protein, 9 aa, Homo Sapiens
DMVRALMYY

SEQ ID NO: 711198 - protein, 9 aa, Homo Sapiens
ACEWCQLTL

SEQ ID NO: 711199 - protein, 9 aa, Homo Sapiens
LQRRKASLE

SEQ ID NO: 711200 - protein, 9 aa, Homo Sapiens
IDTAKFFLS

SEQ ID NO: 711201 - protein, 9 aa, Homo Sapiens
AEAKNILAA

SEQ ID NO: 711202 - protein, 9 aa, Homo Sapiens
RFCGTFRPR

SEQ ID NO: 711203 - protein, 9 aa, Homo Sapiens
LVASSLGTP

SEQ ID NO: 711204 - protein, 9 aa, Homo Sapiens
VYRCVYKAR

SEQ ID NO: 711205 - protein, 9 aa, Homo Sapiens
FVFDRPVHC

SEQ ID NO: 711206 - protein, 9 aa, Homo Sapiens
SLLVQCVLD

SEQ ID NO: 711207 - protein, 9 aa, Homo Sapiens
IALLPRFVH

SEQ ID NO: 711208 - protein, 9 aa, Homo Sapiens
IAIHPIRRI

SEQ ID NO: 711209 - protein, 9 aa, Homo Sapiens
FSASTDTVK

SEQ ID NO: 711210 - protein, 9 aa, Homo Sapiens
KKVCLNEIY

SEQ ID NO: 711211 - protein, 9 aa, Homo Sapiens
DDQRLQKEF

SEQ ID NO: 711212 - protein, 9 aa, Homo Sapiens
PGHSKTREF

SEQ ID NO: 711213 - protein, 9 aa, Homo Sapiens
DGTQVQEIY

SEQ ID NO: 711214 - protein, 9 aa, Homo Sapiens
YCAYGFAPW

SEQ ID NO: 711215 - protein, 9 aa, Homo Sapiens
NSQQRCSRC

SEQ ID NO: 711216 - protein, 9 aa, Homo Sapiens
PQNDGITVH

SEQ ID NO: 711217 - protein, 9 aa, Homo Sapiens
FDTDSSSSD

SEQ ID NO: 711218 - protein, 9 aa, Homo Sapiens
TCYNSIYEQ

SEQ ID NO: 711219 - protein, 9 aa, Homo Sapiens
NQTKTEQDH

SEQ ID NO: 711220 - protein, 9 aa, Homo Sapiens
PEEEEEDEK

SEQ ID NO: 711221 - protein, 9 aa, Homo Sapiens
KTYQCSYGF

SEQ ID NO: 711222 - protein, 9 aa, Homo Sapiens
PSQKTYQCS

SEQ ID NO: 711223 - protein, 9 aa, Homo Sapiens
YLITAVGNI

SEQ ID NO: 711224 - protein, 9 aa, Homo Sapiens
GYVFDGLQL

SEQ ID NO: 711225 - protein, 9 aa, Homo Sapiens
EDVASMAYA

SEQ ID NO: 711226 - protein, 9 aa, Homo Sapiens
DESNDDGTQ

SEQ ID NO: 711227 - protein, 9 aa, Homo Sapiens
ANPHGLAGH

SEQ ID NO: 711228 - protein, 9 aa, Homo Sapiens
VRELPEGWS

SEQ ID NO: 711229 - protein, 9 aa, Homo Sapiens
TPSSLDPCP

SEQ ID NO: 711230 - protein, 9 aa, Homo Sapiens
PHGPKSSLP

SEQ ID NO: 711231 - protein, 9 aa, Homo Sapiens
GDAHLFALL

SEQ ID NO: 711232 - protein, 9 aa, Homo Sapiens
EDSDTPSSL

SEQ ID NO: 711233 - protein, 9 aa, Homo Sapiens
YFDTDSSSS

SEQ ID NO: 711234 - protein, 9 aa, Homo Sapiens
ITLQATRVQ

SEQ ID NO: 711235 - protein, 9 aa, Homo Sapiens
EVEEVEMHE

SEQ ID NO: 711236 - protein, 9 aa, Homo Sapiens
ESLLVQCVL

SEQ ID NO: 711237 - protein, 9 aa, Homo Sapiens
PLPMIGNIL

SEQ ID NO: 711238 - protein, 9 aa, Homo Sapiens
MSLQEKKRS

SEQ ID NO: 711239 - protein, 9 aa, Homo Sapiens
TIDLYKSFF

SEQ ID NO: 711240 - protein, 9 aa, Homo Sapiens
RNKDMVALR

SEQ ID NO: 711241 - protein, 9 aa, Homo Sapiens
LGVSGEVFD

SEQ ID NO: 711242 - protein, 9 aa, Homo Sapiens
WAEDVASMA

SEQ ID NO: 711243 - protein, 9 aa, Homo Sapiens
HPIRRITHI

SEQ ID NO: 711244 - protein, 9 aa, Homo Sapiens
EAQVKKVTK

SEQ ID NO: 711245 - protein, 9 aa, Homo Sapiens
HDTDMKYYI

SEQ ID NO: 711246 - protein, 9 aa, Homo Sapiens
KVSSLACAS

SEQ ID NO: 711247 - protein, 9 aa, Homo Sapiens
KEIRNCQYV

SEQ ID NO: 711248 - protein, 9 aa, Homo Sapiens
RPTPQNDGI

SEQ ID NO: 711249 - protein, 9 aa, Homo Sapiens
EKEEGEEDE

SEQ ID NO: 711250 - protein, 9 aa, Homo Sapiens
RRGCRLRNL

SEQ ID NO: 711251 - protein, 9 aa, Homo Sapiens
IFATFLGLS

SEQ ID NO: 711252 - protein, 9 aa, Homo Sapiens
DVASMAYAL

SEQ ID NO: 711253 - protein, 9 aa, Homo Sapiens
AAIISQLLN

SEQ ID NO: 711254 - protein, 9 aa, Homo Sapiens
RNQCQYCRV

SEQ ID NO: 711255 - protein, 9 aa, Homo Sapiens
GTPGDDSSM

SEQ ID NO: 711256 - protein, 9 aa, Homo Sapiens
NQCQYCRVK

SEQ ID NO: 711257 - protein, 9 aa, Homo Sapiens
VTRSALLTH

SEQ ID NO: 711258 - protein, 9 aa, Homo Sapiens
ITDNAVCRR

SEQ ID NO: 711259 - protein, 9 aa, Homo Sapiens
FVDGDVVHG

SEQ ID NO: 711260 - protein, 9 aa, Homo Sapiens
PPSNINSAS

SEQ ID NO: 711261 - protein, 9 aa, Homo Sapiens
VMLKEIRNC

SEQ ID NO: 711262 - protein, 9 aa, Homo Sapiens
RGTPGDDSS

SEQ ID NO: 711263 - protein, 9 aa, Homo Sapiens
LGLFLVPTP

SEQ ID NO: 711264 - protein, 9 aa, Homo Sapiens
SSASTSHAT

SEQ ID NO: 711265 - protein, 9 aa, Homo Sapiens
SINGYVFDG

SEQ ID NO: 711266 - protein, 9 aa, Homo Sapiens
RDSDLSAVS

SEQ ID NO: 711267 - protein, 9 aa, Homo Sapiens
PPPPSARPP

SEQ ID NO: 711268 - protein, 9 aa, Homo Sapiens
SMAYALRSL

SEQ ID NO: 711269 - protein, 9 aa, Homo Sapiens
LIHMDYRLH

SEQ ID NO: 711270 - protein, 9 aa, Homo Sapiens
SKAKSGDAH

SEQ ID NO: 711271 - protein, 9 aa, Homo Sapiens
ELPVVVREL

SEQ ID NO: 711272 - protein, 9 aa, Homo Sapiens
STIDLYKSF

SEQ ID NO: 711273 - protein, 9 aa, Homo Sapiens
VQLLDASQT

SEQ ID NO: 711274 - protein, 9 aa, Homo Sapiens
GAAGRARCG

SEQ ID NO: 711275 - protein, 9 aa, Homo Sapiens
RGHRRVHSH

SEQ ID NO: 711276 - protein, 9 aa, Homo Sapiens
TPLILILMS

SEQ ID NO: 711277 - protein, 9 aa, Homo Sapiens
FHTSTIDLY

SEQ ID NO: 711278 - protein, 9 aa, Homo Sapiens
PRAPHGPKS

SEQ ID NO: 711279 - protein, 9 aa, Homo Sapiens
AAGRARCGP

SEQ ID NO: 711280 - protein, 9 aa, Homo Sapiens
NGYVFDGLQ

SEQ ID NO: 711281 - protein, 9 aa, Homo Sapiens
ANRQELQDE

SEQ ID NO: 711282 - protein, 9 aa, Homo Sapiens
GKGRGTPGD

SEQ ID NO: 711283 - protein, 9 aa, Homo Sapiens
AMSEDTKLI

SEQ ID NO: 711284 - protein, 9 aa, Homo Sapiens
LRNLLDIAN

SEQ ID NO: 711285 - protein, 9 aa, Homo Sapiens
SRPIPSSAG

SEQ ID NO: 711286 - protein, 9 aa, Homo Sapiens
LGKIEDCIK

SEQ ID NO: 711287 - protein, 9 aa, Homo Sapiens
IVDKASSTF

SEQ ID NO: 711288 - protein, 9 aa, Homo Sapiens
GVQRRGLQL

SEQ ID NO: 711289 - protein, 9 aa, Homo Sapiens
LVQEVRDSD

SEQ ID NO: 711290 - protein, 9 aa, Homo Sapiens
CEWCQLTLS

SEQ ID NO: 711291 - protein, 9 aa, Homo Sapiens
ESPLQDAEA

SEQ ID NO: 711292 - protein, 9 aa, Homo Sapiens
SSCHKLVDL

SEQ ID NO: 711293 - protein, 9 aa, Homo Sapiens
LLHRYLTSM

SEQ ID NO: 711294 - protein, 9 aa, Homo Sapiens
WCQLTLSGL

SEQ ID NO: 711295 - protein, 9 aa, Homo Sapiens
AVPRAPHGP

SEQ ID NO: 711296 - protein, 9 aa, Homo Sapiens
LDPCPDEIS

SEQ ID NO: 711297 - protein, 9 aa, Homo Sapiens
HKLVDLQGP

SEQ ID NO: 711298 - protein, 9 aa, Homo Sapiens
LITAVGNIS

SEQ ID NO: 711299 - protein, 9 aa, Homo Sapiens
ILLTKPENA

SEQ ID NO: 711300 - protein, 9 aa, Homo Sapiens
PLIEPPMEP

SEQ ID NO: 711301 - protein, 9 aa, Homo Sapiens
ASNTDRRAE

SEQ ID NO: 711302 - protein, 9 aa, Homo Sapiens
SGFAIDMEE

SEQ ID NO: 711303 - protein, 9 aa, Homo Sapiens
LLKNLALFL

SEQ ID NO: 711304 - protein, 9 aa, Homo Sapiens
AICHPLHYG

SEQ ID NO: 711305 - protein, 9 aa, Homo Sapiens
TRPEGTSEP

SEQ ID NO: 711306 - protein, 9 aa, Homo Sapiens
CWMGNKPPS

SEQ ID NO: 711307 - protein, 9 aa, Homo Sapiens
SKRHCTEDT

SEQ ID NO: 711308 - protein, 9 aa, Homo Sapiens
KAQTPEGHL

SEQ ID NO: 711309 - protein, 9 aa, Homo Sapiens
MGKESFKYA

SEQ ID NO: 711310 - protein, 9 aa, Homo Sapiens
CVYKARSRL

SEQ ID NO: 711311 - protein, 9 aa, Homo Sapiens
PKFSMAGFK

SEQ ID NO: 711312 - protein, 9 aa, Homo Sapiens
STDTVKQGL

SEQ ID NO: 711313 - protein, 9 aa, Homo Sapiens
SASTSHATS

SEQ ID NO: 711314 - protein, 9 aa, Homo Sapiens
EPPMEPEGE

SEQ ID NO: 711315 - protein, 9 aa, Homo Sapiens
RVSGKSGRK

SEQ ID NO: 711316 - protein, 9 aa, Homo Sapiens
SLACASRKD

SEQ ID NO: 711317 - protein, 9 aa, Homo Sapiens
RNLLDIANG

SEQ ID NO: 711318 - protein, 9 aa, Homo Sapiens
PGCTAPTHS

SEQ ID NO: 711319 - protein, 9 aa, Homo Sapiens
YCRVKKCLK

SEQ ID NO: 711320 - protein, 9 aa, Homo Sapiens
DCVTLSTNV

SEQ ID NO: 711321 - protein, 9 aa, Homo Sapiens
DIEAQGPGR

SEQ ID NO: 711322 - protein, 9 aa, Homo Sapiens
TDSSSSDEF

SEQ ID NO: 711323 - protein, 9 aa, Homo Sapiens
VQRRGLQLT

SEQ ID NO: 711324 - protein, 9 aa, Homo Sapiens
LPMIGNILQ

SEQ ID NO: 711325 - protein, 9 aa, Homo Sapiens
GEYLSDMGL

SEQ ID NO: 711326 - protein, 9 aa, Homo Sapiens
FAIDMEERN

SEQ ID NO: 711327 - protein, 9 aa, Homo Sapiens
LVVSAPTIP

SEQ ID NO: 711328 - protein, 9 aa, Homo Sapiens
VSLILFVLD

SEQ ID NO: 711329 - protein, 9 aa, Homo Sapiens
LLGARLCWM

SEQ ID NO: 711330 - protein, 9 aa, Homo Sapiens
VSGEVFDFS

SEQ ID NO: 711331 - protein, 9 aa, Homo Sapiens
SICASKRHC

SEQ ID NO: 711332 - protein, 9 aa, Homo Sapiens
EAPDLYNRN

SEQ ID NO: 711333 - protein, 9 aa, Homo Sapiens
SRLLSNKNK

SEQ ID NO: 711334 - protein, 9 aa, Homo Sapiens
APLILRSLF

SEQ ID NO: 711335 - protein, 9 aa, Homo Sapiens
PLSSNVSLI

SEQ ID NO: 711336 - protein, 9 aa, Homo Sapiens
ISDNIVKSK

SEQ ID NO: 711337 - protein, 9 aa, Homo Sapiens
MHVPEGLRV

SEQ ID NO: 711338 - protein, 9 aa, Homo Sapiens
ICASKRHCT

SEQ ID NO: 711339 - protein, 9 aa, Homo Sapiens
TSTIDLYKS

SEQ ID NO: 711340 - protein, 9 aa, Homo Sapiens
PHGLAGHRQ

SEQ ID NO: 711341 - protein, 9 aa, Homo Sapiens
VPSLACEWC

SEQ ID NO: 711342 - protein, 9 aa, Homo Sapiens
PEMKQKWAS

SEQ ID NO: 711343 - protein, 9 aa, Homo Sapiens
EGKGHEYKN

SEQ ID NO: 711344 - protein, 9 aa, Homo Sapiens
THSPVGRHV

SEQ ID NO: 711345 - protein, 9 aa, Homo Sapiens
VRGTLFLQP

SEQ ID NO: 711346 - protein, 9 aa, Homo Sapiens
NTEEGKTNS

SEQ ID NO: 711347 - protein, 9 aa, Homo Sapiens
VRPYAPVTF

SEQ ID NO: 711348 - protein, 9 aa, Homo Sapiens
LQGPLKDCI

SEQ ID NO: 711349 - protein, 9 aa, Homo Sapiens
VDLQGPLKD

SEQ ID NO: 711350 - protein, 9 aa, Homo Sapiens
HYLRPSRIS

SEQ ID NO: 711351 - protein, 9 aa, Homo Sapiens
PLLVKIKKQ

SEQ ID NO: 711352 - protein, 9 aa, Homo Sapiens
DSDTPSSLD

SEQ ID NO: 711353 - protein, 9 aa, Homo Sapiens
VVVRELPEG

SEQ ID NO: 711354 - protein, 9 aa, Homo Sapiens
KLVVSAPTI

SEQ ID NO: 711355 - protein, 9 aa, Homo Sapiens
DDGTQVQEI

SEQ ID NO: 711356 - protein, 9 aa, Homo Sapiens
QSYLIEVEL

SEQ ID NO: 711357 - protein, 9 aa, Homo Sapiens
KVMLKEIRN

SEQ ID NO: 711358 - protein, 9 aa, Homo Sapiens
NDDGTQVQE

SEQ ID NO: 711359 - protein, 9 aa, Homo Sapiens
LKIPDRWIY

SEQ ID NO: 711360 - protein, 9 aa, Homo Sapiens
GFAIDMEER

SEQ ID NO: 711361 - protein, 9 aa, Homo Sapiens
CIKVWIKQT

SEQ ID NO: 711362 - protein, 9 aa, Homo Sapiens
FLGLSYDGL

SEQ ID NO: 711363 - protein, 9 aa, Homo Sapiens
DHAEANRQE

SEQ ID NO: 711364 - protein, 9 aa, Homo Sapiens
SLEGVSKDL

SEQ ID NO: 711365 - protein, 9 aa, Homo Sapiens
MSEDTKLIV

SEQ ID NO: 711366 - protein, 9 aa, Homo Sapiens
FAIYLITAV

SEQ ID NO: 711367 - protein, 9 aa, Homo Sapiens
IYITFEGQR

SEQ ID NO: 711368 - protein, 9 aa, Homo Sapiens
PSQPASNTD

SEQ ID NO: 711369 - protein, 9 aa, Homo Sapiens
KGWAEDVAS

SEQ ID NO: 711370 - protein, 9 aa, Homo Sapiens
QFGEVFVDG

SEQ ID NO: 711371 - protein, 9 aa, Homo Sapiens
KLVDLQGPL

SEQ ID NO: 711372 - protein, 9 aa, Homo Sapiens
NGKYFNVER

SEQ ID NO: 711373 - protein, 9 aa, Homo Sapiens
LHRVSCGKT

SEQ ID NO: 711374 - protein, 9 aa, Homo Sapiens
ELSYCAYGF

SEQ ID NO: 711375 - protein, 9 aa, Homo Sapiens
LSVIINMNN

SEQ ID NO: 711376 - protein, 9 aa, Homo Sapiens
LGKLNLPES

SEQ ID NO: 711377 - protein, 9 aa, Homo Sapiens
LQEKKRSEQ

SEQ ID NO: 711378 - protein, 9 aa, Homo Sapiens
VHGELESIL

SEQ ID NO: 711379 - protein, 9 aa, Homo Sapiens
RGATCYNSI

SEQ ID NO: 711380 - protein, 9 aa, Homo Sapiens
GAVLGPFIC

SEQ ID NO: 711381 - protein, 9 aa, Homo Sapiens
RRGLQLTGV

SEQ ID NO: 711382 - protein, 9 aa, Homo Sapiens
YKSFFVELQ

SEQ ID NO: 711383 - protein, 9 aa, Homo Sapiens
PLRPFAGAQ

SEQ ID NO: 711384 - protein, 9 aa, Homo Sapiens
GIVDKASST

SEQ ID NO: 711385 - protein, 9 aa, Homo Sapiens
ASYEKKVCL

SEQ ID NO: 711386 - protein, 9 aa, Homo Sapiens
KIKVYNRAA

SEQ ID NO: 711387 - protein, 9 aa, Homo Sapiens
DVEDDLTCS

SEQ ID NO: 711388 - protein, 9 aa, Homo Sapiens
TKKKHRRNR

SEQ ID NO: 711389 - protein, 9 aa, Homo Sapiens
LQYLGKLNL

SEQ ID NO: 711390 - protein, 9 aa, Homo Sapiens
LELTRRPIY

SEQ ID NO: 711391 - protein, 9 aa, Homo Sapiens
CLRPLRPFA

SEQ ID NO: 711392 - protein, 9 aa, Homo Sapiens
GHEYKNQTF

SEQ ID NO: 711393 - protein, 9 aa, Homo Sapiens
EHWISDNIV

SEQ ID NO: 711394 - protein, 9 aa, Homo Sapiens
KIAFQYGVT

SEQ ID NO: 711395 - protein, 9 aa, Homo Sapiens
KRVIAIHPI

SEQ ID NO: 711396 - protein, 9 aa, Homo Sapiens
GEVFVDGDV

SEQ ID NO: 711397 - protein, 9 aa, Homo Sapiens
LILILMSYG

SEQ ID NO: 711398 - protein, 9 aa, Homo Sapiens
VMCCLLHRY

SEQ ID NO: 711399 - protein, 9 aa, Homo Sapiens
SLTPDQTEV

SEQ ID NO: 711400 - protein, 9 aa, Homo Sapiens
AASKGCLIW

SEQ ID NO: 711401 - protein, 9 aa, Homo Sapiens
FYTSHNLLK

SEQ ID NO: 711402 - protein, 9 aa, Homo Sapiens
LDASQTVLD

SEQ ID NO: 711403 - protein, 9 aa, Homo Sapiens
SSELSYCAY

SEQ ID NO: 711404 - protein, 9 aa, Homo Sapiens
GYRGATCYN

SEQ ID NO: 711405 - protein, 9 aa, Homo Sapiens
FALTVLGFL

SEQ ID NO: 711406 - protein, 9 aa, Homo Sapiens
EAQGPGRKG

SEQ ID NO: 711407 - protein, 9 aa, Homo Sapiens
DASQTVLDK

SEQ ID NO: 711408 - protein, 9 aa, Homo Sapiens
QEVRDSDLS

SEQ ID NO: 711409 - protein, 9 aa, Homo Sapiens
SPVPLVTLL

SEQ ID NO: 711410 - protein, 9 aa, Homo Sapiens
ASAQRKTEM

SEQ ID NO: 711411 - protein, 9 aa, Homo Sapiens
YNQFGEVFV

SEQ ID NO: 711412 - protein, 9 aa, Homo Sapiens
NRNGKYFNV

SEQ ID NO: 711413 - protein, 9 aa, Homo Sapiens
PLILILMSY

SEQ ID NO: 711414 - protein, 9 aa, Homo Sapiens
EWCQLTLSG

SEQ ID NO: 711415 - protein, 9 aa, Homo Sapiens
GGIVDKASS

SEQ ID NO: 711416 - protein, 9 aa, Homo Sapiens
EKLVVSAPT

SEQ ID NO: 711417 - protein, 9 aa, Homo Sapiens
DESIDDQRL

SEQ ID NO: 711418 - protein, 9 aa, Homo Sapiens
YSKAKSGDA

SEQ ID NO: 711419 - protein, 9 aa, Homo Sapiens
DGVDVEDDL

SEQ ID NO: 711420 - protein, 9 aa, Homo Sapiens
PQGEYLSDM

SEQ ID NO: 711421 - protein, 9 aa, Homo Sapiens
CTAPTHSPV

SEQ ID NO: 711422 - protein, 9 aa, Homo Sapiens
LYNRNGKYF

SEQ ID NO: 711423 - protein, 9 aa, Homo Sapiens
ETPLLVKIK

SEQ ID NO: 711424 - protein, 9 aa, Homo Sapiens
MLKEIRNCQ

SEQ ID NO: 711425 - protein, 9 aa, Homo Sapiens
AGGCLVWSP

SEQ ID NO: 711426 - protein, 9 aa, Homo Sapiens
TDMKYYIVH

SEQ ID NO: 711427 - protein, 9 aa, Homo Sapiens
HLGNVYSTP

SEQ ID NO: 711428 - protein, 9 aa, Homo Sapiens
KSPSQPASN

SEQ ID NO: 711429 - protein, 9 aa, Homo Sapiens
RLDHAEANR

SEQ ID NO: 711430 - protein, 9 aa, Homo Sapiens
GTQVQEIYE

SEQ ID NO: 711431 - protein, 9 aa, Homo Sapiens
RKLHMELKC

SEQ ID NO: 711432 - protein, 9 aa, Homo Sapiens
VSGKSGRKF

SEQ ID NO: 711433 - protein, 9 aa, Homo Sapiens
SLACEWCQL

SEQ ID NO: 711434 - protein, 9 aa, Homo Sapiens
QRLQKEFSP

SEQ ID NO: 711435 - protein, 9 aa, Homo Sapiens
IHPIRRITH

SEQ ID NO: 711436 - protein, 9 aa, Homo Sapiens
LMNQHDTDM

SEQ ID NO: 711437 - protein, 9 aa, Homo Sapiens
LIEPPMEPE

SEQ ID NO: 711438 - protein, 9 aa, Homo Sapiens
GVSGEVFDF

SEQ ID NO: 711439 - protein, 9 aa, Homo Sapiens
LLDASQTVL

SEQ ID NO: 711440 - protein, 9 aa, Homo Sapiens
RCNSGFAID

SEQ ID NO: 711441 - protein, 9 aa, Homo Sapiens
EGKTNSVNK

SEQ ID NO: 711442 - protein, 9 aa, Homo Sapiens
QATRVQPEP

SEQ ID NO: 711443 - protein, 9 aa, Homo Sapiens
RVHSHERPY

SEQ ID NO: 711444 - protein, 9 aa, Homo Sapiens
YRGRASDYK

SEQ ID NO: 711445 - protein, 9 aa, Homo Sapiens
QCSYGFRLG

SEQ ID NO: 711446 - protein, 9 aa, Homo Sapiens
KSGDAHLFA

SEQ ID NO: 711447 - protein, 9 aa, Homo Sapiens
GPTPLPMIG

SEQ ID NO: 711448 - protein, 9 aa, Homo Sapiens
NINSASLTR

SEQ ID NO: 711449 - protein, 9 aa, Homo Sapiens
LLIHMDYRL

SEQ ID NO: 711450 - protein, 9 aa, Homo Sapiens
ARSRLLACK

SEQ ID NO: 711451 - protein, 9 aa, Homo Sapiens
FGYRGRASD

SEQ ID NO: 711452 - protein, 9 aa, Homo Sapiens
NSSELSYCA

SEQ ID NO: 711453 - protein, 9 aa, Homo Sapiens
RGRASDYKS

SEQ ID NO: 711454 - protein, 9 aa, Homo Sapiens
LTRRPIYIT

SEQ ID NO: 711455 - protein, 9 aa, Homo Sapiens
PRFVHRVLQ

SEQ ID NO: 711456 - protein, 9 aa, Homo Sapiens
DMKYYIVHL

SEQ ID NO: 711457 - protein, 9 aa, Homo Sapiens
AVHGELESI

SEQ ID NO: 711458 - protein, 9 aa, Homo Sapiens
SASTDTVKQ

SEQ ID NO: 711459 - protein, 9 aa, Homo Sapiens
LCWMGNKPP

SEQ ID NO: 711460 - protein, 9 aa, Homo Sapiens
IDDQRLQKE

SEQ ID NO: 711461 - protein, 9 aa, Homo Sapiens
VQAGVQRRG

SEQ ID NO: 711462 - protein, 9 aa, Homo Sapiens
VKKCLKVGM

SEQ ID NO: 711463 - protein, 9 aa, Homo Sapiens
YQKVMCCLL

SEQ ID NO: 711464 - protein, 9 aa, Homo Sapiens
AKFFLSCLL

SEQ ID NO: 711465 - protein, 9 aa, Homo Sapiens
RLQYLGKLN

SEQ ID NO: 711466 - protein, 9 aa, Homo Sapiens
LGPFICPQF

SEQ ID NO: 711467 - protein, 9 aa, Homo Sapiens
ASKGCLIWN

SEQ ID NO: 711468 - protein, 9 aa, Homo Sapiens
EKPEMKQKW

SEQ ID NO: 711469 - protein, 9 aa, Homo Sapiens
TPQNDGITV

SEQ ID NO: 711470 - protein, 9 aa, Homo Sapiens
CLLHRYLTS

SEQ ID NO: 711471 - protein, 9 aa, Homo Sapiens
KIEDCIKVW

SEQ ID NO: 711472 - protein, 9 aa, Homo Sapiens
QRCSRCSDG

SEQ ID NO: 711473 - protein, 9 aa, Homo Sapiens
SNVSLILFV

SEQ ID NO: 711474 - protein, 9 aa, Homo Sapiens
HGELESILW

SEQ ID NO: 711475 - protein, 9 aa, Homo Sapiens
LSSNVSLIL

SEQ ID NO: 711476 - protein, 9 aa, Homo Sapiens
GRYDQFLWE

SEQ ID NO: 711477 - protein, 9 aa, Homo Sapiens
DAKSSMVIF

SEQ ID NO: 711478 - protein, 9 aa, Homo Sapiens
IPDRWIYGV

SEQ ID NO: 711479 - protein, 9 aa, Homo Sapiens
QYLGKLNLP

SEQ ID NO: 711480 - protein, 9 aa, Homo Sapiens
ASTSHATSL

SEQ ID NO: 711481 - protein, 9 aa, Homo Sapiens
EEEEDEKEE

SEQ ID NO: 711482 - protein, 9 aa, Homo Sapiens
GVDVEDDLT

SEQ ID NO: 711483 - protein, 9 aa, Homo Sapiens
EVLEECDWT

SEQ ID NO: 711484 - protein, 9 aa, Homo Sapiens
VASYEKKVC

SEQ ID NO: 711485 - protein, 9 aa, Homo Sapiens
YRGATCYNS

SEQ ID NO: 711486 - protein, 9 aa, Homo Sapiens
NDESNDDGT

SEQ ID NO: 711487 - protein, 9 aa, Homo Sapiens
ICPQFHMSG

SEQ ID NO: 711488 - protein, 9 aa, Homo Sapiens
ELMNQHDTD

SEQ ID NO: 711489 - protein, 9 aa, Homo Sapiens
HEYKNQTFE

SEQ ID NO: 711490 - protein, 9 aa, Homo Sapiens
WEVLKLPTA

SEQ ID NO: 711491 - protein, 9 aa, Homo Sapiens
VDKASSTFQ

SEQ ID NO: 711492 - protein, 9 aa, Homo Sapiens
ACLRPLRPF

SEQ ID NO: 711493 - protein, 9 aa, Homo Sapiens
TSRPIPSSA

SEQ ID NO: 711494 - protein, 9 aa, Homo Sapiens
VKIKKQTYK

SEQ ID NO: 711495 - protein, 9 aa, Homo Sapiens
ISDIEAQGP

SEQ ID NO: 711496 - protein, 9 aa, Homo Sapiens
ATCYNSIYE

SEQ ID NO: 711497 - protein, 9 aa, Homo Sapiens
CAYGFAPWS

SEQ ID NO: 711498 - protein, 9 aa, Homo Sapiens
LMSYGYIAK

SEQ ID NO: 711499 - protein, 9 aa, Homo Sapiens
RKRLQYLGK

SEQ ID NO: 711500 - protein, 9 aa, Homo Sapiens
KIEVETRCL

SEQ ID NO: 711501 - protein, 9 aa, Homo Sapiens
ADKYIERLV

SEQ ID NO: 711502 - protein, 9 aa, Homo Sapiens
GHDMVRALM

SEQ ID NO: 711503 - protein, 9 aa, Homo Sapiens
ELQRRKASL

SEQ ID NO: 711504 - protein, 9 aa, Homo Sapiens
VWSPVPLVT

SEQ ID NO: 711505 - protein, 9 aa, Homo Sapiens
GCLVWSPVP

SEQ ID NO: 711506 - protein, 9 aa, Homo Sapiens
SPLQDAEAK

SEQ ID NO: 711507 - protein, 9 aa, Homo Sapiens
GRSDITDNA

SEQ ID NO: 711508 - protein, 9 aa, Homo Sapiens
IKVYNRAAV

SEQ ID NO: 711509 - protein, 9 aa, Homo Sapiens
EYLNVRPYA

SEQ ID NO: 711510 - protein, 9 aa, Homo Sapiens
EEPLIEPPM

SEQ ID NO: 711511 - protein, 9 aa, Homo Sapiens
KSSMVIFCA

SEQ ID NO: 711512 - protein, 9 aa, Homo Sapiens
FGFSLTPDQ

SEQ ID NO: 711513 - protein, 9 aa, Homo Sapiens
YSCMVIRDL

SEQ ID NO: 711514 - protein, 9 aa, Homo Sapiens
PEGHLGNVY

SEQ ID NO: 711515 - protein, 9 aa, Homo Sapiens
WNTRGFLSS

SEQ ID NO: 711516 - protein, 9 aa, Homo Sapiens
VISDIEAQG

SEQ ID NO: 711517 - protein, 9 aa, Homo Sapiens
AEDVASMAY

SEQ ID NO: 711518 - protein, 9 aa, Homo Sapiens
CMVIRDLTL

SEQ ID NO: 711519 - protein, 9 aa, Homo Sapiens
CVPGFSAPL

SEQ ID NO: 711520 - protein, 9 aa, Homo Sapiens
IFEVLEECD

SEQ ID NO: 711521 - protein, 9 aa, Homo Sapiens
DGYRTVLQT

SEQ ID NO: 711522 - protein, 9 aa, Homo Sapiens
PTHSPVGRH

SEQ ID NO: 711523 - protein, 9 aa, Homo Sapiens
IPSSAGKKM

SEQ ID NO: 711524 - protein, 9 aa, Homo Sapiens
NSASLTRPA

SEQ ID NO: 711525 - protein, 9 aa, Homo Sapiens
ATRVQPEPR

SEQ ID NO: 711526 - protein, 9 aa, Homo Sapiens
HRRVHSHER

SEQ ID NO: 711527 - protein, 9 aa, Homo Sapiens
EVFVDGDVV

SEQ ID NO: 711528 - protein, 9 aa, Homo Sapiens
SNTNSCNVF

SEQ ID NO: 711529 - protein, 9 aa, Homo Sapiens
VHCRKLAQL

SEQ ID NO: 711530 - protein, 9 aa, Homo Sapiens
DILRKSVRN

SEQ ID NO: 711531 - protein, 9 aa, Homo Sapiens
PYAPVTFHA

SEQ ID NO: 711532 - protein, 9 aa, Homo Sapiens
ECWEELHRV

SEQ ID NO: 711533 - protein, 9 aa, Homo Sapiens
HCRKLAQLE

SEQ ID NO: 711534 - protein, 9 aa, Homo Sapiens
AGFKGEGPE

SEQ ID NO: 711535 - protein, 9 aa, Homo Sapiens
GKTNSVNKF

SEQ ID NO: 711536 - protein, 9 aa, Homo Sapiens
SAQRKTEMV

SEQ ID NO: 711537 - protein, 9 aa, Homo Sapiens
VLGVTVTRS

SEQ ID NO: 711538 - protein, 9 aa, Homo Sapiens
TSHATSLPV

SEQ ID NO: 711539 - protein, 9 aa, Homo Sapiens
ALPQSYLIE

SEQ ID NO: 711540 - protein, 9 aa, Homo Sapiens
TEMVLSEKV

SEQ ID NO: 711541 - protein, 9 aa, Homo Sapiens
KVICSGPND

SEQ ID NO: 711542 - protein, 9 aa, Homo Sapiens
SSLACASRK

SEQ ID NO: 711543 - protein, 9 aa, Homo Sapiens
CRCNSGFAI

SEQ ID NO: 711544 - protein, 9 aa, Homo Sapiens
LANPHGLAG

SEQ ID NO: 711545 - protein, 9 aa, Homo Sapiens
LVPTPCLIE

SEQ ID NO: 711546 - protein, 9 aa, Homo Sapiens
KNSQQRCSR

SEQ ID NO: 711547 - protein, 9 aa, Homo Sapiens
LGNVYSTPL

SEQ ID NO: 711548 - protein, 9 aa, Homo Sapiens
NQHDTDMKY

SEQ ID NO: 711549 - protein, 9 aa, Homo Sapiens
PQSYLIEVE

SEQ ID NO: 711550 - protein, 9 aa, Homo Sapiens
GPLVASSLG

SEQ ID NO: 711551 - protein, 9 aa, Homo Sapiens
PLAALVDGQ

SEQ ID NO: 711552 - protein, 9 aa, Homo Sapiens
SGKSGRKFK

SEQ ID NO: 711553 - protein, 9 aa, Homo Sapiens
FSLTPDQTE

SEQ ID NO: 711554 - protein, 9 aa, Homo Sapiens
KWSFYSCMV

SEQ ID NO: 711555 - protein, 9 aa, Homo Sapiens
EEQTKKKHR

SEQ ID NO: 711556 - protein, 9 aa, Homo Sapiens
DRKRLQYLG

SEQ ID NO: 711557 - protein, 9 aa, Homo Sapiens
KPEMKQKWA

SEQ ID NO: 711558 - protein, 9 aa, Homo Sapiens
VLGFLLPLL

SEQ ID NO: 711559 - protein, 9 aa, Homo Sapiens
GATCYNSIY

SEQ ID NO: 711560 - protein, 9 aa, Homo Sapiens
LRLESKIKV

SEQ ID NO: 711561 - protein, 9 aa, Homo Sapiens
TKPENARLV

SEQ ID NO: 711562 - protein, 9 aa, Homo Sapiens
LTCSWPASS

SEQ ID NO: 711563 - protein, 9 aa, Homo Sapiens
PSARPPALR

SEQ ID NO: 711564 - protein, 9 aa, Homo Sapiens
RLCWMGNKP

SEQ ID NO: 711565 - protein, 9 aa, Homo Sapiens
RPSRISEMS

SEQ ID NO: 711566 - protein, 9 aa, Homo Sapiens
VLGMQELFP

SEQ ID NO: 711567 - protein, 9 aa, Homo Sapiens
VIFCADQPR

SEQ ID NO: 711568 - protein, 9 aa, Homo Sapiens
SCNVFPKKE

SEQ ID NO: 711569 - protein, 9 aa, Homo Sapiens
RVIAIHPIR

SEQ ID NO: 711570 - protein, 9 aa, Homo Sapiens
QCQYCRVKK

SEQ ID NO: 711571 - protein, 9 aa, Homo Sapiens
AVLGPFICP

SEQ ID NO: 711572 - protein, 9 aa, Homo Sapiens
QPQPLPSAG

SEQ ID NO: 711573 - protein, 9 aa, Homo Sapiens
TYQCSYGFR

SEQ ID NO: 711574 - protein, 9 aa, Homo Sapiens
WSMFTDILR

SEQ ID NO: 711575 - protein, 9 aa, Homo Sapiens
RVSCGKTSM

SEQ ID NO: 711576 - protein, 9 aa, Homo Sapiens
EGHLGNVYS

SEQ ID NO: 711577 - protein, 9 aa, Homo Sapiens
KASLEGVSK

SEQ ID NO: 711578 - protein, 9 aa, Homo Sapiens
FLWEVLKLP

SEQ ID NO: 711579 - protein, 9 aa, Homo Sapiens
TSTALPQSY

SEQ ID NO: 711580 - protein, 9 aa, Homo Sapiens
IDLYKSFFV

SEQ ID NO: 711581 - protein, 9 aa, Homo Sapiens
SNKNKFKSF

SEQ ID NO: 711582 - protein, 9 aa, Homo Sapiens
LLTKPENAR

SEQ ID NO: 711583 - protein, 9 aa, Homo Sapiens
SGPNDTSPG

SEQ ID NO: 711584 - protein, 9 aa, Homo Sapiens
LKEIRNCQY

SEQ ID NO: 711585 - protein, 9 aa, Homo Sapiens
NLLKNLALF

SEQ ID NO: 711586 - protein, 9 aa, Homo Sapiens
LRPFAGAQV

SEQ ID NO: 711587 - protein, 9 aa, Homo Sapiens
VYKARSRLL

SEQ ID NO: 711588 - protein, 9 aa, Homo Sapiens
PSSLDPCPD

SEQ ID NO: 711589 - protein, 9 aa, Homo Sapiens
SAGVNQVSS

SEQ ID NO: 711590 - protein, 9 aa, Homo Sapiens
DPFSASTDT

SEQ ID NO: 711591 - protein, 9 aa, Homo Sapiens
FLVPTPCLI

SEQ ID NO: 711592 - protein, 9 aa, Homo Sapiens
ISQLLNQTK

SEQ ID NO: 711593 - protein, 9 aa, Homo Sapiens
HRRGCRLRN

SEQ ID NO: 711594 - protein, 9 aa, Homo Sapiens
DEKEEGEED

SEQ ID NO: 711595 - protein, 9 aa, Homo Sapiens
DNSKGPLVA

SEQ ID NO: 711596 - protein, 9 aa, Homo Sapiens
EKIEVETRC

SEQ ID NO: 711597 - protein, 9 aa, Homo Sapiens
STALPQSYL

SEQ ID NO: 711598 - protein, 9 aa, Homo Sapiens
PMEPEGESY

SEQ ID NO: 711599 - protein, 9 aa, Homo Sapiens
RPIPSSAGK

SEQ ID NO: 711600 - protein, 9 aa, Homo Sapiens
LILMSYGYI

SEQ ID NO: 711601 - protein, 9 aa, Homo Sapiens
VELPVVVRE

SEQ ID NO: 711602 - protein, 9 aa, Homo Sapiens
RPVHCRKLA

SEQ ID NO: 711603 - protein, 9 aa, Homo Sapiens
RFVHRVLQG

SEQ ID NO: 711604 - protein, 9 aa, Homo Sapiens
HGLAGHRQE

SEQ ID NO: 711605 - protein, 9 aa, Homo Sapiens
NLDESIDDQ

SEQ ID NO: 711606 - protein, 9 aa, Homo Sapiens
GHLGNVYST

SEQ ID NO: 711607 - protein, 9 aa, Homo Sapiens
PEALAAVHG

SEQ ID NO: 711608 - protein, 9 aa, Homo Sapiens
TFLGLSYDG

SEQ ID NO: 711609 - protein, 9 aa, Homo Sapiens
AVPGKVALE

SEQ ID NO: 711610 - protein, 9 aa, Homo Sapiens
FDGLQLSVC

SEQ ID NO: 711611 - protein, 9 aa, Homo Sapiens
YRLHTPMYF

SEQ ID NO: 711612 - protein, 9 aa, Homo Sapiens
SLLKIPDRW

SEQ ID NO: 711613 - protein, 9 aa, Homo Sapiens
GQRPGFGYR

SEQ ID NO: 711614 - protein, 9 aa, Homo Sapiens
RGCRLRNLL

SEQ ID NO: 711615 - protein, 9 aa, Homo Sapiens
KMPKFSMAG

SEQ ID NO: 711616 - protein, 9 aa, Homo Sapiens
RNCQYVACM

SEQ ID NO: 711617 - protein, 9 aa, Homo Sapiens
IAQLEAQVK

SEQ ID NO: 711618 - protein, 9 aa, Homo Sapiens
SKKYLQFYL

SEQ ID NO: 711619 - protein, 9 aa, Homo Sapiens
QPRFYRSTV

SEQ ID NO: 711620 - protein, 9 aa, Homo Sapiens
GHVYIFATF

SEQ ID NO: 711621 - protein, 9 aa, Homo Sapiens
DQRLQKEFS

SEQ ID NO: 711622 - protein, 9 aa, Homo Sapiens
HERPYPCPK

SEQ ID NO: 711623 - protein, 9 aa, Homo Sapiens
AGVQRRGLQ

SEQ ID NO: 711624 - protein, 9 aa, Homo Sapiens
SDNIVKSKT

SEQ ID NO: 711625 - protein, 9 aa, Homo Sapiens
PTGGIVDKA

SEQ ID NO: 711626 - protein, 9 aa, Homo Sapiens
RAPHGPKSS

SEQ ID NO: 711627 - protein, 9 aa, Homo Sapiens
ELKCEREKL

SEQ ID NO: 711628 - protein, 9 aa, Homo Sapiens
PASNTDRRA

SEQ ID NO: 711629 - protein, 9 aa, Homo Sapiens
LLNQTKTEQ

SEQ ID NO: 711630 - protein, 9 aa, Homo Sapiens
QELFPGHSK

SEQ ID NO: 711631 - protein, 9 aa, Homo Sapiens
IINMNNSPF

SEQ ID NO: 711632 - protein, 9 aa, Homo Sapiens
ECDWTSFVA

SEQ ID NO: 711633 - protein, 9 aa, Homo Sapiens
IKVWIKQTE

SEQ ID NO: 711634 - protein, 9 aa, Homo Sapiens
SHERPYPCP

SEQ ID NO: 711635 - protein, 9 aa, Homo Sapiens
CVTLSTNVN

SEQ ID NO: 711636 - protein, 9 aa, Homo Sapiens
SMVIFCADQ

SEQ ID NO: 711637 - protein, 9 aa, Homo Sapiens
SDMGLGIDG

SEQ ID NO: 711638 - protein, 9 aa, Homo Sapiens
FYSCMVIRD

SEQ ID NO: 711639 - protein, 9 aa, Homo Sapiens
AIYLITAVG

SEQ ID NO: 711640 - protein, 9 aa, Homo Sapiens
MKQKWASRL

SEQ ID NO: 711641 - protein, 9 aa, Homo Sapiens
EEVEMHESD

SEQ ID NO: 711642 - protein, 9 aa, Homo Sapiens
LDHAEANRQ

SEQ ID NO: 711643 - protein, 9 aa, Homo Sapiens
RLESKIKVY

SEQ ID NO: 711644 - protein, 9 aa, Homo Sapiens
EIRNCQYVA

SEQ ID NO: 711645 - protein, 9 aa, Homo Sapiens
LFDYLPLAA

SEQ ID NO: 711646 - protein, 9 aa, Homo Sapiens
EDDLTCSWP

SEQ ID NO: 711647 - protein, 9 aa, Homo Sapiens
LTIDTAKFF

SEQ ID NO: 711648 - protein, 9 aa, Homo Sapiens
GQATSRPIP

SEQ ID NO: 711649 - protein, 9 aa, Homo Sapiens
EVYRCVYKA

SEQ ID NO: 711650 - protein, 9 aa, Homo Sapiens
AKLSEEEQT

SEQ ID NO: 711651 - protein, 9 aa, Homo Sapiens
ATSRPIPSS

SEQ ID NO: 711652 - protein, 9 aa, Homo Sapiens
PGGRSDITD

SEQ ID NO: 711653 - protein, 9 aa, Homo Sapiens
FWRVRNNRL

SEQ ID NO: 711654 - protein, 9 aa, Homo Sapiens
HNSSELSYC

SEQ ID NO: 711655 - protein, 9 aa, Homo Sapiens
CVLDNTIHG

SEQ ID NO: 711656 - protein, 9 aa, Homo Sapiens
LTPDQTEVL

SEQ ID NO: 711657 - protein, 9 aa, Homo Sapiens
VVVGKGRGT

SEQ ID NO: 711658 - protein, 9 aa, Homo Sapiens
RSALLTHCQ

SEQ ID NO: 711659 - protein, 9 aa, Homo Sapiens
KNTTEKLVV

SEQ ID NO: 711660 - protein, 9 aa, Homo Sapiens
LHMELKCER

SEQ ID NO: 711661 - protein, 9 aa, Homo Sapiens
AEIWSMFTD

SEQ ID NO: 711662 - protein, 9 aa, Homo Sapiens
CWEELHRVS

SEQ ID NO: 711663 - protein, 9 aa, Homo Sapiens
SELSYCAYG

SEQ ID NO: 711664 - protein, 9 aa, Homo Sapiens
KVCLNEIYT

SEQ ID NO: 711665 - protein, 9 aa, Homo Sapiens
CCLLHRYLT

SEQ ID NO: 711666 - protein, 9 aa, Homo Sapiens
PVVVRELPE

SEQ ID NO: 711667 - protein, 9 aa, Homo Sapiens
YLPLAALVD

SEQ ID NO: 711668 - protein, 9 aa, Homo Sapiens
LLKIPDRWI

SEQ ID NO: 711669 - protein, 9 aa, Homo Sapiens
GTSEPRSSK

SEQ ID NO: 711670 - protein, 9 aa, Homo Sapiens
NLLDIANGH

SEQ ID NO: 711671 - protein, 9 aa, Homo Sapiens
KFSMAGFKG

SEQ ID NO: 711672 - protein, 9 aa, Homo Sapiens
LEDSLLKIP

SEQ ID NO: 711673 - protein, 9 aa, Homo Sapiens
PAVPRAPHG

SEQ ID NO: 711674 - protein, 9 aa, Homo Sapiens
ELLSEKPEM

SEQ ID NO: 711675 - protein, 9 aa, Homo Sapiens
LGMQELFPG

SEQ ID NO: 711676 - protein, 9 aa, Homo Sapiens
DGLQLSVCL

SEQ ID NO: 711677 - protein, 9 aa, Homo Sapiens
ILMSYGYIA

SEQ ID NO: 711678 - protein, 9 aa, Homo Sapiens
QQKILLTKP

SEQ ID NO: 711679 - protein, 9 aa, Homo Sapiens
PQPLPSAGV

SEQ ID NO: 711680 - protein, 9 aa, Homo Sapiens
IFCADQPRI

SEQ ID NO: 711681 - protein, 9 aa, Homo Sapiens
EPLIEPPME

SEQ ID NO: 711682 - protein, 9 aa, Homo Sapiens
LSYCAYGFA

SEQ ID NO: 711683 - protein, 9 aa, Homo Sapiens
TPLPMIGNI

SEQ ID NO: 711684 - protein, 9 aa, Homo Sapiens
LQDAEAKNI

SEQ ID NO: 711685 - protein, 9 aa, Homo Sapiens
QRKTEMVLS

SEQ ID NO: 711686 - protein, 9 aa, Homo Sapiens
AGVNQVSST

SEQ ID NO: 711687 - protein, 9 aa, Homo Sapiens
SVSKKYLQF

SEQ ID NO: 711688 - protein, 9 aa, Homo Sapiens
AEANRQELQ

SEQ ID NO: 711689 - protein, 9 aa, Homo Sapiens
GCTAPTHSP

SEQ ID NO: 711690 - protein, 9 aa, Homo Sapiens
EECDWTSFV

SEQ ID NO: 711691 - protein, 9 aa, Homo Sapiens
ELTRRPIYI

SEQ ID NO: 711692 - protein, 9 aa, Homo Sapiens
DDKRVIAIH

SEQ ID NO: 711693 - protein, 9 aa, Homo Sapiens
VVSAPTIPV

SEQ ID NO: 711694 - protein, 9 aa, Homo Sapiens
VVGKGRGTP

SEQ ID NO: 711695 - protein, 9 aa, Homo Sapiens
KRHCTEDTM

SEQ ID NO: 711696 - protein, 9 aa, Homo Sapiens
VALARAVPG

SEQ ID NO: 711697 - protein, 9 aa, Homo Sapiens
SLQEKKRSE

SEQ ID NO: 711698 - protein, 9 aa, Homo Sapiens
IKKQTYKFR

SEQ ID NO: 711699 - protein, 9 aa, Homo Sapiens
GYNQFGEVF

SEQ ID NO: 711700 - protein, 9 aa, Homo Sapiens
SVLDLANPH

SEQ ID NO: 711701 - protein, 9 aa, Homo Sapiens
RLMDGYPMQ

SEQ ID NO: 711702 - protein, 9 aa, Homo Sapiens
TPEGHLGNV

SEQ ID NO: 711703 - protein, 9 aa, Homo Sapiens
MCCLLHRYL

SEQ ID NO: 711704 - protein, 9 aa, Homo Sapiens
EPFVADKYI

SEQ ID NO: 711705 - protein, 9 aa, Homo Sapiens
DMVALRKLL

SEQ ID NO: 711706 - protein, 9 aa, Homo Sapiens
IYLITAVGN

SEQ ID NO: 711707 - protein, 9 aa, Homo Sapiens
SNTDRRAEG

SEQ ID NO: 711708 - protein, 9 aa, Homo Sapiens
AEMGKESFK

SEQ ID NO: 711709 - protein, 9 aa, Homo Sapiens
YTLRNKDMV

SEQ ID NO: 711710 - protein, 9 aa, Homo Sapiens
GELQRRKAS

SEQ ID NO: 711711 - protein, 9 aa, Homo Sapiens
STSHATSLP

SEQ ID NO: 711712 - protein, 9 aa, Homo Sapiens
ALRLESKIK

SEQ ID NO: 711713 - protein, 9 aa, Homo Sapiens
VQCVLDNTI

SEQ ID NO: 711714 - protein, 9 aa, Homo Sapiens
GPKSSLPPP

SEQ ID NO: 711715 - protein, 9 aa, Homo Sapiens
SYCAYGFAP

SEQ ID NO: 711716 - protein, 9 aa, Homo Sapiens
VEEVEMHES

SEQ ID NO: 711717 - protein, 9 aa, Homo Sapiens
PPPSARPPA

SEQ ID NO: 711718 - protein, 9 aa, Homo Sapiens
EYSKAKSGD

SEQ ID NO: 711719 - protein, 9 aa, Homo Sapiens
TEKLVVSAP

SEQ ID NO: 711720 - protein, 9 aa, Homo Sapiens
AAEMGKESF

SEQ ID NO: 711721 - protein, 9 aa, Homo Sapiens
TAKFFLSCL

SEQ ID NO: 711722 - protein, 9 aa, Homo Sapiens
YKNQTFEGR

SEQ ID NO: 711723 - protein, 9 aa, Homo Sapiens
GLQLSVCLH

SEQ ID NO: 711724 - protein, 9 aa, Homo Sapiens
WDCVTLSTN

SEQ ID NO: 711725 - protein, 9 aa, Homo Sapiens
PPGPTPLPM

SEQ ID NO: 711726 - protein, 9 aa, Homo Sapiens
QFLWEVLKL

SEQ ID NO: 711727 - protein, 9 aa, Homo Sapiens
NKFKSFLRT

SEQ ID NO: 711728 - protein, 9 aa, Homo Sapiens
DKRVIAIHP

SEQ ID NO: 711729 - protein, 9 aa, Homo Sapiens
QYEMHVPEG

SEQ ID NO: 711730 - protein, 9 aa, Homo Sapiens
ASVSKKYLQ

SEQ ID NO: 711731 - protein, 9 aa, Homo Sapiens
EQHAVTLHR

SEQ ID NO: 711732 - protein, 9 aa, Homo Sapiens
KGHGDSSCR

SEQ ID NO: 711733 - protein, 9 aa, Homo Sapiens
SRPASRCQG

SEQ ID NO: 711734 - protein, 9 aa, Homo Sapiens
GGMRIRARF

SEQ ID NO: 711735 - protein, 9 aa, Homo Sapiens
GSSSICEGT

SEQ ID NO: 711736 - protein, 9 aa, Homo Sapiens
SFQIVSEKW

SEQ ID NO: 711737 - protein, 9 aa, Homo Sapiens
PFRQLRSHW

SEQ ID NO: 711738 - protein, 9 aa, Homo Sapiens
VASAEYHHK

SEQ ID NO: 711739 - protein, 9 aa, Homo Sapiens
SEGVPLSSL

SEQ ID NO: 711740 - protein, 9 aa, Homo Sapiens
LLLPVMPVW

SEQ ID NO: 711741 - protein, 9 aa, Homo Sapiens
FYVAVIFTL

SEQ ID NO: 711742 - protein, 9 aa, Homo Sapiens
RVNTIPQTR

SEQ ID NO: 711743 - protein, 9 aa, Homo Sapiens
PIVSVLALE

SEQ ID NO: 711744 - protein, 9 aa, Homo Sapiens
SGHFNLQVL

SEQ ID NO: 711745 - protein, 9 aa, Homo Sapiens
FSAFQEGTK

SEQ ID NO: 711746 - protein, 9 aa, Homo Sapiens
VIFTLNGLM

SEQ ID NO: 711747 - protein, 9 aa, Homo Sapiens
RAHPCACRA

SEQ ID NO: 711748 - protein, 9 aa, Homo Sapiens
LRSHWQAPR

SEQ ID NO: 711749 - protein, 9 aa, Homo Sapiens
TLDWAEDNL

SEQ ID NO: 711750 - protein, 9 aa, Homo Sapiens
FMWLHKLGL

SEQ ID NO: 711751 - protein, 9 aa, Homo Sapiens
VYANQVASE

SEQ ID NO: 711752 - protein, 9 aa, Homo Sapiens
VASEQNLFQ

SEQ ID NO: 711753 - protein, 9 aa, Homo Sapiens
SESLGGTPI

SEQ ID NO: 711754 - protein, 9 aa, Homo Sapiens
HLHPEIPKP

SEQ ID NO: 711755 - protein, 9 aa, Homo Sapiens
MIRCHNLVY

SEQ ID NO: 711756 - protein, 9 aa, Homo Sapiens
QVPLRFCLS

SEQ ID NO: 711757 - protein, 9 aa, Homo Sapiens
TLVRSAGCG

SEQ ID NO: 711758 - protein, 9 aa, Homo Sapiens
GHKSEVAHR

SEQ ID NO: 711759 - protein, 9 aa, Homo Sapiens
DIKQYNGPP

SEQ ID NO: 711760 - protein, 9 aa, Homo Sapiens
SSTTETTHT

SEQ ID NO: 711761 - protein, 9 aa, Homo Sapiens
LGHTDDKPF

SEQ ID NO: 711762 - protein, 9 aa, Homo Sapiens
SAEYHHKAL

SEQ ID NO: 711763 - protein, 9 aa, Homo Sapiens
TFTHPHETT

SEQ ID NO: 711764 - protein, 9 aa, Homo Sapiens
KAWDTGILI

SEQ ID NO: 711765 - protein, 9 aa, Homo Sapiens
PFQQKNISK

SEQ ID NO: 711766 - protein, 9 aa, Homo Sapiens
DPAPLNLYM

SEQ ID NO: 711767 - protein, 9 aa, Homo Sapiens
PPHPCEGQK

SEQ ID NO: 711768 - protein, 9 aa, Homo Sapiens
ELINQTDFS

SEQ ID NO: 711769 - protein, 9 aa, Homo Sapiens
YHILGHTDD

SEQ ID NO: 711770 - protein, 9 aa, Homo Sapiens
TNRTPEAAL

SEQ ID NO: 711771 - protein, 9 aa, Homo Sapiens
AQTVLLLPG

SEQ ID NO: 711772 - protein, 9 aa, Homo Sapiens
LEVKVLSID

SEQ ID NO: 711773 - protein, 9 aa, Homo Sapiens
LQSLNALGC

SEQ ID NO: 711774 - protein, 9 aa, Homo Sapiens
DMAVKYENT

SEQ ID NO: 711775 - protein, 9 aa, Homo Sapiens
ALYTCSGWM

SEQ ID NO: 711776 - protein, 9 aa, Homo Sapiens
QIVSEKWVP

SEQ ID NO: 711777 - protein, 9 aa, Homo Sapiens
KLHRTAWWG

SEQ ID NO: 711778 - protein, 9 aa, Homo Sapiens
QMMEVSLDA

SEQ ID NO: 711779 - protein, 9 aa, Homo Sapiens
FLQIQYFEG

SEQ ID NO: 711780 - protein, 9 aa, Homo Sapiens
LQGLAEVTI

SEQ ID NO: 711781 - protein, 9 aa, Homo Sapiens
NISENRYRD

SEQ ID NO: 711782 - protein, 9 aa, Homo Sapiens
VRHQGRIMY

SEQ ID NO: 711783 - protein, 9 aa, Homo Sapiens
HWARWLTPV

SEQ ID NO: 711784 - protein, 9 aa, Homo Sapiens
HAVTLHRAP

SEQ ID NO: 711785 - protein, 9 aa, Homo Sapiens
WVSIWPPSP

SEQ ID NO: 711786 - protein, 9 aa, Homo Sapiens
KKTYKCEEC

SEQ ID NO: 711787 - protein, 9 aa, Homo Sapiens
AGATEADEG

SEQ ID NO: 711788 - protein, 9 aa, Homo Sapiens
SSGPDNHQG

SEQ ID NO: 711789 - protein, 9 aa, Homo Sapiens
ISRRGRHTL

SEQ ID NO: 711790 - protein, 9 aa, Homo Sapiens
LARIGRIRR

SEQ ID NO: 711791 - protein, 9 aa, Homo Sapiens
SPRAHPCAC

SEQ ID NO: 711792 - protein, 9 aa, Homo Sapiens
HKLLLPSNT

SEQ ID NO: 711793 - protein, 9 aa, Homo Sapiens
TGKKTYKCE

SEQ ID NO: 711794 - protein, 9 aa, Homo Sapiens
EGSRAASGP

SEQ ID NO: 711795 - protein, 9 aa, Homo Sapiens
GGQGEKKQL

SEQ ID NO: 711796 - protein, 9 aa, Homo Sapiens
DKAWAVPDS

SEQ ID NO: 711797 - protein, 9 aa, Homo Sapiens
VAPGSSAGS

SEQ ID NO: 711798 - protein, 9 aa, Homo Sapiens
ESSGFCPHA

SEQ ID NO: 711799 - protein, 9 aa, Homo Sapiens
HELARKRQQ

SEQ ID NO: 711800 - protein, 9 aa, Homo Sapiens
VSPHAGRES

SEQ ID NO: 711801 - protein, 9 aa, Homo Sapiens
PQVDESPVS

SEQ ID NO: 711802 - protein, 9 aa, Homo Sapiens
DCGVPYPSL

SEQ ID NO: 711803 - protein, 9 aa, Homo Sapiens
VIEDRILNH

SEQ ID NO: 711804 - protein, 9 aa, Homo Sapiens
DFTVQVPLR

SEQ ID NO: 711805 - protein, 9 aa, Homo Sapiens
APDKYEYHR

SEQ ID NO: 711806 - protein, 9 aa, Homo Sapiens
VSDSHGRAP

SEQ ID NO: 711807 - protein, 9 aa, Homo Sapiens
KKRLEPLGE

SEQ ID NO: 711808 - protein, 9 aa, Homo Sapiens
YSPREYVCR

SEQ ID NO: 711809 - protein, 9 aa, Homo Sapiens
GSDQKDLVP

SEQ ID NO: 711810 - protein, 9 aa, Homo Sapiens
RIRTWNIAG

SEQ ID NO: 711811 - protein, 9 aa, Homo Sapiens
EDRILNHIL

SEQ ID NO: 711812 - protein, 9 aa, Homo Sapiens
PKKLKGKRY

SEQ ID NO: 711813 - protein, 9 aa, Homo Sapiens
SPWAPTVGR

SEQ ID NO: 711814 - protein, 9 aa, Homo Sapiens
FMITAVVLF

SEQ ID NO: 711815 - protein, 9 aa, Homo Sapiens
FFSPWTVLR

SEQ ID NO: 711816 - protein, 9 aa, Homo Sapiens
LERHVVPHV

SEQ ID NO: 711817 - protein, 9 aa, Homo Sapiens
LGSAQSKRN

SEQ ID NO: 711818 - protein, 9 aa, Homo Sapiens
RTPETGSDE

SEQ ID NO: 711819 - protein, 9 aa, Homo Sapiens
SKACKITKT

SEQ ID NO: 711820 - protein, 9 aa, Homo Sapiens
LESQQEWVV

SEQ ID NO: 711821 - protein, 9 aa, Homo Sapiens
RMDPQKSWV

SEQ ID NO: 711822 - protein, 9 aa, Homo Sapiens
KYENTLIAA

SEQ ID NO: 711823 - protein, 9 aa, Homo Sapiens
FLKEEESDP

SEQ ID NO: 711824 - protein, 9 aa, Homo Sapiens
AGEKAGKDA

SEQ ID NO: 711825 - protein, 9 aa, Homo Sapiens
DIFQYHATN

SEQ ID NO: 711826 - protein, 9 aa, Homo Sapiens
NFLQIQYFE

SEQ ID NO: 711827 - protein, 9 aa, Homo Sapiens
PITVLEGQT

SEQ ID NO: 711828 - protein, 9 aa, Homo Sapiens
AVTLHRAPG

SEQ ID NO: 711829 - protein, 9 aa, Homo Sapiens
TSSCHRVRK

SEQ ID NO: 711830 - protein, 9 aa, Homo Sapiens
ALTDMGLTL

SEQ ID NO: 711831 - protein, 9 aa, Homo Sapiens
LSPCYDDAA

SEQ ID NO: 711832 - protein, 9 aa, Homo Sapiens
QHQLPQPPV

SEQ ID NO: 711833 - protein, 9 aa, Homo Sapiens
TFSYYDSLK

SEQ ID NO: 711834 - protein, 9 aa, Homo Sapiens
DNFQQLRTP

SEQ ID NO: 711835 - protein, 9 aa, Homo Sapiens
DQGPRAHAQ

SEQ ID NO: 711836 - protein, 9 aa, Homo Sapiens
EDLDKLHRT

SEQ ID NO: 711837 - protein, 9 aa, Homo Sapiens
ASYPPYPGA

SEQ ID NO: 711838 - protein, 9 aa, Homo Sapiens
QHAVTLHRA

SEQ ID NO: 711839 - protein, 9 aa, Homo Sapiens
PVGNWVPPE

SEQ ID NO: 711840 - protein, 9 aa, Homo Sapiens
QSLQDISKQ

SEQ ID NO: 711841 - protein, 9 aa, Homo Sapiens
GRIRRLIRA

SEQ ID NO: 711842 - protein, 9 aa, Homo Sapiens
LMHLPRMYN

SEQ ID NO: 711843 - protein, 9 aa, Homo Sapiens
PVDLEKLQH

SEQ ID NO: 711844 - protein, 9 aa, Homo Sapiens
AKASANNES

SEQ ID NO: 711845 - protein, 9 aa, Homo Sapiens
RLVLHMLQD

SEQ ID NO: 711846 - protein, 9 aa, Homo Sapiens
QRFLFLLCL

SEQ ID NO: 711847 - protein, 9 aa, Homo Sapiens
VLDTGCALR

SEQ ID NO: 711848 - protein, 9 aa, Homo Sapiens
AQGGMRIRA

SEQ ID NO: 711849 - protein, 9 aa, Homo Sapiens
LHSQEAAAT

SEQ ID NO: 711850 - protein, 9 aa, Homo Sapiens
KIHINKEIE

SEQ ID NO: 711851 - protein, 9 aa, Homo Sapiens
IIHTGKKTY

SEQ ID NO: 711852 - protein, 9 aa, Homo Sapiens
RFPLRPGDS

SEQ ID NO: 711853 - protein, 9 aa, Homo Sapiens
GTLGEAVRI

SEQ ID NO: 711854 - protein, 9 aa, Homo Sapiens
GQEFLFAIF

SEQ ID NO: 711855 - protein, 9 aa, Homo Sapiens
IPRERRNEF

SEQ ID NO: 711856 - protein, 9 aa, Homo Sapiens
IHINKEIEQ

SEQ ID NO: 711857 - protein, 9 aa, Homo Sapiens
QLRTPHQKP

SEQ ID NO: 711858 - protein, 9 aa, Homo Sapiens
GCECSHLGN

SEQ ID NO: 711859 - protein, 9 aa, Homo Sapiens
LRMDPQKSW

SEQ ID NO: 711860 - protein, 9 aa, Homo Sapiens
RYLTDYLMK

SEQ ID NO: 711861 - protein, 9 aa, Homo Sapiens
VDECEHYER

SEQ ID NO: 711862 - protein, 9 aa, Homo Sapiens
IKQYNGPPS

SEQ ID NO: 711863 - protein, 9 aa, Homo Sapiens
ACRALAPAP

SEQ ID NO: 711864 - protein, 9 aa, Homo Sapiens
GSFFQTQYP

SEQ ID NO: 711865 - protein, 9 aa, Homo Sapiens
FSPWTVLRG

SEQ ID NO: 711866 - protein, 9 aa, Homo Sapiens
EKQLLRSSG

SEQ ID NO: 711867 - protein, 9 aa, Homo Sapiens
SITNPKTIS

SEQ ID NO: 711868 - protein, 9 aa, Homo Sapiens
HVEAEAGAV

SEQ ID NO: 711869 - protein, 9 aa, Homo Sapiens
LVPELQEEK

SEQ ID NO: 711870 - protein, 9 aa, Homo Sapiens
TWTAAATVF

SEQ ID NO: 711871 - protein, 9 aa, Homo Sapiens
SIMQVREDF

SEQ ID NO: 711872 - protein, 9 aa, Homo Sapiens
SDMAVKYEN

SEQ ID NO: 711873 - protein, 9 aa, Homo Sapiens
QLRSESLGG

SEQ ID NO: 711874 - protein, 9 aa, Homo Sapiens
ISFEYHRYT

SEQ ID NO: 711875 - protein, 9 aa, Homo Sapiens
IPDKAWAVP

SEQ ID NO: 711876 - protein, 9 aa, Homo Sapiens
QSNRKTLWG

SEQ ID NO: 711877 - protein, 9 aa, Homo Sapiens
RGSSGPDNH

SEQ ID NO: 711878 - protein, 9 aa, Homo Sapiens
ADFTVQDNR

SEQ ID NO: 711879 - protein, 9 aa, Homo Sapiens
PPSPWAPTV

SEQ ID NO: 711880 - protein, 9 aa, Homo Sapiens
CQGQSPRIT

SEQ ID NO: 711881 - protein, 9 aa, Homo Sapiens
LSKYKENFP

SEQ ID NO: 711882 - protein, 9 aa, Homo Sapiens
DTVPLMTKT

SEQ ID NO: 711883 - protein, 9 aa, Homo Sapiens
SPGKNIFFS

SEQ ID NO: 711884 - protein, 9 aa, Homo Sapiens
FRHQILQTK

SEQ ID NO: 711885 - protein, 9 aa, Homo Sapiens
RQRCQLSVC

SEQ ID NO: 711886 - protein, 9 aa, Homo Sapiens
PLLGSLSTA

SEQ ID NO: 711887 - protein, 9 aa, Homo Sapiens
TSYNNRSWI

SEQ ID NO: 711888 - protein, 9 aa, Homo Sapiens
PGMTGMVGS

SEQ ID NO: 711889 - protein, 9 aa, Homo Sapiens
VQYSSTSSV

SEQ ID NO: 711890 - protein, 9 aa, Homo Sapiens
AAGKCLADN

SEQ ID NO: 711891 - protein, 9 aa, Homo Sapiens
EMMVSLMKT

SEQ ID NO: 711892 - protein, 9 aa, Homo Sapiens
SKKGWGLGA

SEQ ID NO: 711893 - protein, 9 aa, Homo Sapiens
HTISYIADI

SEQ ID NO: 711894 - protein, 9 aa, Homo Sapiens
AVKYENTLI

SEQ ID NO: 711895 - protein, 9 aa, Homo Sapiens
KTGFVRSKR

SEQ ID NO: 711896 - protein, 9 aa, Homo Sapiens
TLAGATGSG

SEQ ID NO: 711897 - protein, 9 aa, Homo Sapiens
TGPGTCQSK

SEQ ID NO: 711898 - protein, 9 aa, Homo Sapiens
AFSTISLGK

SEQ ID NO: 711899 - protein, 9 aa, Homo Sapiens
PREYVCRKG

SEQ ID NO: 711900 - protein, 9 aa, Homo Sapiens
KLKELKNEE

SEQ ID NO: 711901 - protein, 9 aa, Homo Sapiens
FHHQTGWAS

SEQ ID NO: 711902 - protein, 9 aa, Homo Sapiens
ILGHTDDKP

SEQ ID NO: 711903 - protein, 9 aa, Homo Sapiens
RTSYNNRSW

SEQ ID NO: 711904 - protein, 9 aa, Homo Sapiens
PGAPGTRGP

SEQ ID NO: 711905 - protein, 9 aa, Homo Sapiens
NDNFQQLRT

SEQ ID NO: 711906 - protein, 9 aa, Homo Sapiens
IIGKGRSCK

SEQ ID NO: 711907 - protein, 9 aa, Homo Sapiens
AWRGHVECV

SEQ ID NO: 711908 - protein, 9 aa, Homo Sapiens
SDSHGRAPE

SEQ ID NO: 711909 - protein, 9 aa, Homo Sapiens
RVSSQKKPA

SEQ ID NO: 711910 - protein, 9 aa, Homo Sapiens
SGHCRPWKV

SEQ ID NO: 711911 - protein, 9 aa, Homo Sapiens
VGNWVPPED

SEQ ID NO: 711912 - protein, 9 aa, Homo Sapiens
GEQAKKSSE

SEQ ID NO: 711913 - protein, 9 aa, Homo Sapiens
EEEQMMEVS

SEQ ID NO: 711914 - protein, 9 aa, Homo Sapiens
FPTTLCPHF

SEQ ID NO: 711915 - protein, 9 aa, Homo Sapiens
GEAVRIRTW

SEQ ID NO: 711916 - protein, 9 aa, Homo Sapiens
TVQVPLRFC

SEQ ID NO: 711917 - protein, 9 aa, Homo Sapiens
QDISKQTEI

SEQ ID NO: 711918 - protein, 9 aa, Homo Sapiens
WKPAQCPKR

SEQ ID NO: 711919 - protein, 9 aa, Homo Sapiens
QGQCVKFWE

SEQ ID NO: 711920 - protein, 9 aa, Homo Sapiens
ELLHISPEG

SEQ ID NO: 711921 - protein, 9 aa, Homo Sapiens
RPASRCQGQ

SEQ ID NO: 711922 - protein, 9 aa, Homo Sapiens
QYNGPPSAA

SEQ ID NO: 711923 - protein, 9 aa, Homo Sapiens
DFQVGPTEE

SEQ ID NO: 711924 - protein, 9 aa, Homo Sapiens
EEAGATEAD

SEQ ID NO: 711925 - protein, 9 aa, Homo Sapiens
NKELINQTD

SEQ ID NO: 711926 - protein, 9 aa, Homo Sapiens
DVASEQNLF

SEQ ID NO: 711927 - protein, 9 aa, Homo Sapiens
PLGPDADFT

SEQ ID NO: 711928 - protein, 9 aa, Homo Sapiens
RPPNATLIL

SEQ ID NO: 711929 - protein, 9 aa, Homo Sapiens
ACPPNFGGG

SEQ ID NO: 711930 - protein, 9 aa, Homo Sapiens
DSLYLSPCY

SEQ ID NO: 711931 - protein, 9 aa, Homo Sapiens
APQAHGVTS

SEQ ID NO: 711932 - protein, 9 aa, Homo Sapiens
IHPSSTTET

SEQ ID NO: 711933 - protein, 9 aa, Homo Sapiens
ESVAWVCFN

SEQ ID NO: 711934 - protein, 9 aa, Homo Sapiens
EEEGQSTSP

SEQ ID NO: 711935 - protein, 9 aa, Homo Sapiens
IPLKTSPLL

SEQ ID NO: 711936 - protein, 9 aa, Homo Sapiens
AMPGSVGPK

SEQ ID NO: 711937 - protein, 9 aa, Homo Sapiens
GQGKGHGDS

SEQ ID NO: 711938 - protein, 9 aa, Homo Sapiens
ARGPQSVGR

SEQ ID NO: 711939 - protein, 9 aa, Homo Sapiens
LFMITAVVL

SEQ ID NO: 711940 - protein, 9 aa, Homo Sapiens
FASAIHHVD

SEQ ID NO: 711941 - protein, 9 aa, Homo Sapiens
YHTNKYASS

SEQ ID NO: 711942 - protein, 9 aa, Homo Sapiens
YEYIKEVHK

SEQ ID NO: 711943 - protein, 9 aa, Homo Sapiens
HTLRAQALD

SEQ ID NO: 711944 - protein, 9 aa, Homo Sapiens
EPKHSQSPF

SEQ ID NO: 711945 - protein, 9 aa, Homo Sapiens
SHRIFQAHC

SEQ ID NO: 711946 - protein, 9 aa, Homo Sapiens
KLLLPSNTP

SEQ ID NO: 711947 - protein, 9 aa, Homo Sapiens
LSQYPELQR

SEQ ID NO: 711948 - protein, 9 aa, Homo Sapiens
AFVFFSLSS

SEQ ID NO: 711949 - protein, 9 aa, Homo Sapiens
LSTAQTQLS

SEQ ID NO: 711950 - protein, 9 aa, Homo Sapiens
FTHPHETTG

SEQ ID NO: 711951 - protein, 9 aa, Homo Sapiens
FAAGFMWLH

SEQ ID NO: 711952 - protein, 9 aa, Homo Sapiens
LLPSNTPNV

SEQ ID NO: 711953 - protein, 9 aa, Homo Sapiens
DPRAKGHSL

SEQ ID NO: 711954 - protein, 9 aa, Homo Sapiens
AAKAWDTGI

SEQ ID NO: 711955 - protein, 9 aa, Homo Sapiens
KATKADDRG

SEQ ID NO: 711956 - protein, 9 aa, Homo Sapiens
LGPDADFTV

SEQ ID NO: 711957 - protein, 9 aa, Homo Sapiens
SEQNLFQTF

SEQ ID NO: 711958 - protein, 9 aa, Homo Sapiens
DRLYNIPVR

SEQ ID NO: 711959 - protein, 9 aa, Homo Sapiens
VEAEAGAVI

SEQ ID NO: 711960 - protein, 9 aa, Homo Sapiens
GADLEHYVL

SEQ ID NO: 711961 - protein, 9 aa, Homo Sapiens
RASLSPVSR

SEQ ID NO: 711962 - protein, 9 aa, Homo Sapiens
MKQAKMRRD

SEQ ID NO: 711963 - protein, 9 aa, Homo Sapiens
SRLVLHMLQ

SEQ ID NO: 711964 - protein, 9 aa, Homo Sapiens
PVEIKSFYV

SEQ ID NO: 711965 - protein, 9 aa, Homo Sapiens
SSQEEEGQS

SEQ ID NO: 711966 - protein, 9 aa, Homo Sapiens
QAVAELLHI

SEQ ID NO: 711967 - protein, 9 aa, Homo Sapiens
GPRAHAQSK

SEQ ID NO: 711968 - protein, 9 aa, Homo Sapiens
TGERPYLCQ

SEQ ID NO: 711969 - protein, 9 aa, Homo Sapiens
ESLITNSGK

SEQ ID NO: 711970 - protein, 9 aa, Homo Sapiens
AFFSPWTVL

SEQ ID NO: 711971 - protein, 9 aa, Homo Sapiens
TIPTRFLFI

SEQ ID NO: 711972 - protein, 9 aa, Homo Sapiens
IISDKRNVI

SEQ ID NO: 711973 - protein, 9 aa, Homo Sapiens
HRPPNATLI

SEQ ID NO: 711974 - protein, 9 aa, Homo Sapiens
PPSRMASYP

SEQ ID NO: 711975 - protein, 9 aa, Homo Sapiens
LHTTMYFFL

SEQ ID NO: 711976 - protein, 9 aa, Homo Sapiens
RSCKGTVSI

SEQ ID NO: 711977 - protein, 9 aa, Homo Sapiens
ALCDEKNLE

SEQ ID NO: 711978 - protein, 9 aa, Homo Sapiens
VSRPASRCQ

SEQ ID NO: 711979 - protein, 9 aa, Homo Sapiens
DRCMVTHEL

SEQ ID NO: 711980 - protein, 9 aa, Homo Sapiens
GRIMYVGDV

SEQ ID NO: 711981 - protein, 9 aa, Homo Sapiens
IEDGAFSGH

SEQ ID NO: 711982 - protein, 9 aa, Homo Sapiens
LNALGCNFE

SEQ ID NO: 711983 - protein, 9 aa, Homo Sapiens
PQLIGIIPR

SEQ ID NO: 711984 - protein, 9 aa, Homo Sapiens
VGRETRPVG

SEQ ID NO: 711985 - protein, 9 aa, Homo Sapiens
QGEKQLLRS

SEQ ID NO: 711986 - protein, 9 aa, Homo Sapiens
NFQEGGCTG

SEQ ID NO: 711987 - protein, 9 aa, Homo Sapiens
GFCPHANHS

SEQ ID NO: 711988 - protein, 9 aa, Homo Sapiens
ERPYLCQAC

SEQ ID NO: 711989 - protein, 9 aa, Homo Sapiens
LDEGLFLHS

SEQ ID NO: 711990 - protein, 9 aa, Homo Sapiens
CHSVQSQDT

SEQ ID NO: 711991 - protein, 9 aa, Homo Sapiens
TQARARTTR

SEQ ID NO: 711992 - protein, 9 aa, Homo Sapiens
RLARIGRIR

SEQ ID NO: 711993 - protein, 9 aa, Homo Sapiens
FFLGNLSFM

SEQ ID NO: 711994 - protein, 9 aa, Homo Sapiens
DKYEYHRQR

SEQ ID NO: 711995 - protein, 9 aa, Homo Sapiens
YSTPTTNRT

SEQ ID NO: 711996 - protein, 9 aa, Homo Sapiens
QGEKKQLWK

SEQ ID NO: 711997 - protein, 9 aa, Homo Sapiens
TENLVLDSE

SEQ ID NO: 711998 - protein, 9 aa, Homo Sapiens
VTIPTRFLF

SEQ ID NO: 711999 - protein, 9 aa, Homo Sapiens
KIKISVTKK

SEQ ID NO: 712000 - protein, 9 aa, Homo Sapiens
RAGPPSPTD

SEQ ID NO: 712001 - protein, 9 aa, Homo Sapiens
LQEKPKNEK

SEQ ID NO: 712002 - protein, 9 aa, Homo Sapiens
AEDDRLYNI

SEQ ID NO: 712003 - protein, 9 aa, Homo Sapiens
CKITKTPGM

SEQ ID NO: 712004 - protein, 9 aa, Homo Sapiens
ALLGSAQSK

SEQ ID NO: 712005 - protein, 9 aa, Homo Sapiens
DRNQAAPFC

SEQ ID NO: 712006 - protein, 9 aa, Homo Sapiens
KELKNEELF

SEQ ID NO: 712007 - protein, 9 aa, Homo Sapiens
PLEVKVLSI

SEQ ID NO: 712008 - protein, 9 aa, Homo Sapiens
GHCRPWKVK

SEQ ID NO: 712009 - protein, 9 aa, Homo Sapiens
QTYSPREYV

SEQ ID NO: 712010 - protein, 9 aa, Homo Sapiens
PPLAMPGSV

SEQ ID NO: 712011 - protein, 9 aa, Homo Sapiens
PGKYPMPNL

SEQ ID NO: 712012 - protein, 9 aa, Homo Sapiens
VTKKVKLEV

SEQ ID NO: 712013 - protein, 9 aa, Homo Sapiens
QRGNQIISD

SEQ ID NO: 712014 - protein, 9 aa, Homo Sapiens
LHKLGLSAR

SEQ ID NO: 712015 - protein, 9 aa, Homo Sapiens
SCWTTGAES

SEQ ID NO: 712016 - protein, 9 aa, Homo Sapiens
HCSFPECHE

SEQ ID NO: 712017 - protein, 9 aa, Homo Sapiens
LLQGLAEVT

SEQ ID NO: 712018 - protein, 9 aa, Homo Sapiens
ETPLHSKHH

SEQ ID NO: 712019 - protein, 9 aa, Homo Sapiens
HFNPCNCVI

SEQ ID NO: 712020 - protein, 9 aa, Homo Sapiens
GQSNRKTLW

SEQ ID NO: 712021 - protein, 9 aa, Homo Sapiens
IIDVASEQN

SEQ ID NO: 712022 - protein, 9 aa, Homo Sapiens
LYNEIPRER

SEQ ID NO: 712023 - protein, 9 aa, Homo Sapiens
ERHVVPHVG

SEQ ID NO: 712024 - protein, 9 aa, Homo Sapiens
QEKPKNEKL

SEQ ID NO: 712025 - protein, 9 aa, Homo Sapiens
RGRHTLLNF

SEQ ID NO: 712026 - protein, 9 aa, Homo Sapiens
VVSPSSFQI

SEQ ID NO: 712027 - protein, 9 aa, Homo Sapiens
KDPAPLNLY

SEQ ID NO: 712028 - protein, 9 aa, Homo Sapiens
KQAKMRRDL

SEQ ID NO: 712029 - protein, 9 aa, Homo Sapiens
PGEQGFQSL

SEQ ID NO: 712030 - protein, 9 aa, Homo Sapiens
GVPYPSLVN

SEQ ID NO: 712031 - protein, 9 aa, Homo Sapiens
SPCYDDAAK

SEQ ID NO: 712032 - protein, 9 aa, Homo Sapiens
LSPVSRPAS

SEQ ID NO: 712033 - protein, 9 aa, Homo Sapiens
GPDADFTVQ

SEQ ID NO: 712034 - protein, 9 aa, Homo Sapiens
DDKPFQQKN

SEQ ID NO: 712035 - protein, 9 aa, Homo Sapiens
LDTGCALRV

SEQ ID NO: 712036 - protein, 9 aa, Homo Sapiens
EKKQLWKKA

SEQ ID NO: 712037 - protein, 9 aa, Homo Sapiens
SSGEEPSKR

SEQ ID NO: 712038 - protein, 9 aa, Homo Sapiens
QEIVTFKDV

SEQ ID NO: 712039 - protein, 9 aa, Homo Sapiens
FNIPADQQL

SEQ ID NO: 712040 - protein, 9 aa, Homo Sapiens
GAPGTRGPE

SEQ ID NO: 712041 - protein, 9 aa, Homo Sapiens
YFPTTLCPH

SEQ ID NO: 712042 - protein, 9 aa, Homo Sapiens
LWTNKQGQE

SEQ ID NO: 712043 - protein, 9 aa, Homo Sapiens
SYNNRSWIS

SEQ ID NO: 712044 - protein, 9 aa, Homo Sapiens
PRASLSPVS

SEQ ID NO: 712045 - protein, 9 aa, Homo Sapiens
VCGSFFQTQ

SEQ ID NO: 712046 - protein, 9 aa, Homo Sapiens
LQIQYFEGL

SEQ ID NO: 712047 - protein, 9 aa, Homo Sapiens
KRVSSQKKP

SEQ ID NO: 712048 - protein, 9 aa, Homo Sapiens
GKYPMPNLS

SEQ ID NO: 712049 - protein, 9 aa, Homo Sapiens
YNEIPRERR

SEQ ID NO: 712050 - protein, 9 aa, Homo Sapiens
VQFISKEEE

SEQ ID NO: 712051 - protein, 9 aa, Homo Sapiens
FGLISAKRE

SEQ ID NO: 712052 - protein, 9 aa, Homo Sapiens
IFQYHATNG

SEQ ID NO: 712053 - protein, 9 aa, Homo Sapiens
ATSNDSPKI

SEQ ID NO: 712054 - protein, 9 aa, Homo Sapiens
PPRPPPMLS

SEQ ID NO: 712055 - protein, 9 aa, Homo Sapiens
LAGRYLTDY

SEQ ID NO: 712056 - protein, 9 aa, Homo Sapiens
LRIDLSKYK

SEQ ID NO: 712057 - protein, 9 aa, Homo Sapiens
HNLVYVFFA

SEQ ID NO: 712058 - protein, 9 aa, Homo Sapiens
WRLYNEIPR

SEQ ID NO: 712059 - protein, 9 aa, Homo Sapiens
HAGMKPYKC

SEQ ID NO: 712060 - protein, 9 aa, Homo Sapiens
AWDTGILIF

SEQ ID NO: 712061 - protein, 9 aa, Homo Sapiens
AGPPSPTDD

SEQ ID NO: 712062 - protein, 9 aa, Homo Sapiens
QLRSHWQAP

SEQ ID NO: 712063 - protein, 9 aa, Homo Sapiens
GPVQSIMQV

SEQ ID NO: 712064 - protein, 9 aa, Homo Sapiens
TVLEGQTIC

SEQ ID NO: 712065 - protein, 9 aa, Homo Sapiens
FPDRNQAAP

SEQ ID NO: 712066 - protein, 9 aa, Homo Sapiens
KRLEPLGED

SEQ ID NO: 712067 - protein, 9 aa, Homo Sapiens
RQRQEERQH

SEQ ID NO: 712068 - protein, 9 aa, Homo Sapiens
KVAAPDVIV

SEQ ID NO: 712069 - protein, 9 aa, Homo Sapiens
LLTLAGATG

SEQ ID NO: 712070 - protein, 9 aa, Homo Sapiens
PSPTDDFSV

SEQ ID NO: 712071 - protein, 9 aa, Homo Sapiens
GDRSGADDP

SEQ ID NO: 712072 - protein, 9 aa, Homo Sapiens
QYNCYYHGY

SEQ ID NO: 712073 - protein, 9 aa, Homo Sapiens
ALMHLPRMY

SEQ ID NO: 712074 - protein, 9 aa, Homo Sapiens
AGPFSQFTK

SEQ ID NO: 712075 - protein, 9 aa, Homo Sapiens
TKADDRGSN

SEQ ID NO: 712076 - protein, 9 aa, Homo Sapiens
CPGPFLRTT

SEQ ID NO: 712077 - protein, 9 aa, Homo Sapiens
SAGCGTGSC

SEQ ID NO: 712078 - protein, 9 aa, Homo Sapiens
SQEEEGQST

SEQ ID NO: 712079 - protein, 9 aa, Homo Sapiens
VLASDIPNF

SEQ ID NO: 712080 - protein, 9 aa, Homo Sapiens
CTKNTGRTQ

SEQ ID NO: 712081 - protein, 9 aa, Homo Sapiens
GFMWLHKLG

SEQ ID NO: 712082 - protein, 9 aa, Homo Sapiens
RPVDLEKLQ

SEQ ID NO: 712083 - protein, 9 aa, Homo Sapiens
LDSEANAEP

SEQ ID NO: 712084 - protein, 9 aa, Homo Sapiens
SDQKDLVPE

SEQ ID NO: 712085 - protein, 9 aa, Homo Sapiens
GWLKMREEW

SEQ ID NO: 712086 - protein, 9 aa, Homo Sapiens
VGVAPGSSA

SEQ ID NO: 712087 - protein, 9 aa, Homo Sapiens
SQDTSSCHR

SEQ ID NO: 712088 - protein, 9 aa, Homo Sapiens
AGRTIQCFP

SEQ ID NO: 712089 - protein, 9 aa, Homo Sapiens
ILQTKGALS

SEQ ID NO: 712090 - protein, 9 aa, Homo Sapiens
SASGAPAPR

SEQ ID NO: 712091 - protein, 9 aa, Homo Sapiens
YYDSLKAVY

SEQ ID NO: 712092 - protein, 9 aa, Homo Sapiens
MDDDKPFQQ

SEQ ID NO: 712093 - protein, 9 aa, Homo Sapiens
YWCKQEPGA

SEQ ID NO: 712094 - protein, 9 aa, Homo Sapiens
GPLGPDADF

SEQ ID NO: 712095 - protein, 9 aa, Homo Sapiens
ASGAPAPRR

SEQ ID NO: 712096 - protein, 9 aa, Homo Sapiens
RTGWQYFLF

SEQ ID NO: 712097 - protein, 9 aa, Homo Sapiens
RSHWQAPRQ

SEQ ID NO: 712098 - protein, 9 aa, Homo Sapiens
SSTMSCLAS

SEQ ID NO: 712099 - protein, 9 aa, Homo Sapiens
PAPLNLYMF

SEQ ID NO: 712100 - protein, 9 aa, Homo Sapiens
AQHQLPQPP

SEQ ID NO: 712101 - protein, 9 aa, Homo Sapiens
VDQRGNQII

SEQ ID NO: 712102 - protein, 9 aa, Homo Sapiens
VESSRKHRY

SEQ ID NO: 712103 - protein, 9 aa, Homo Sapiens
SEASKKKRL

SEQ ID NO: 712104 - protein, 9 aa, Homo Sapiens
TGFVRSKRT

SEQ ID NO: 712105 - protein, 9 aa, Homo Sapiens
YYLIASESP

SEQ ID NO: 712106 - protein, 9 aa, Homo Sapiens
TGWQYFLFT

SEQ ID NO: 712107 - protein, 9 aa, Homo Sapiens
IHAGMKPYK

SEQ ID NO: 712108 - protein, 9 aa, Homo Sapiens
VQQGEKQLL

SEQ ID NO: 712109 - protein, 9 aa, Homo Sapiens
GKLHDPQLI

SEQ ID NO: 712110 - protein, 9 aa, Homo Sapiens
VDLEKLQHL

SEQ ID NO: 712111 - protein, 9 aa, Homo Sapiens
NHKLLSLEY

SEQ ID NO: 712112 - protein, 9 aa, Homo Sapiens
WTNKQGQEF

SEQ ID NO: 712113 - protein, 9 aa, Homo Sapiens
AVAELLHIS

SEQ ID NO: 712114 - protein, 9 aa, Homo Sapiens
FIPLEVKVL

SEQ ID NO: 712115 - protein, 9 aa, Homo Sapiens
FRRDGHKSE

SEQ ID NO: 712116 - protein, 9 aa, Homo Sapiens
VRTGEVGAV

SEQ ID NO: 712117 - protein, 9 aa, Homo Sapiens
QQSIARSAD

SEQ ID NO: 712118 - protein, 9 aa, Homo Sapiens
IIPDKAWAV

SEQ ID NO: 712119 - protein, 9 aa, Homo Sapiens
LEGQTICVR

SEQ ID NO: 712120 - protein, 9 aa, Homo Sapiens
VRSAGCGTG

SEQ ID NO: 712121 - protein, 9 aa, Homo Sapiens
ISKQTEIPY

SEQ ID NO: 712122 - protein, 9 aa, Homo Sapiens
MKYLRHRPP

SEQ ID NO: 712123 - protein, 9 aa, Homo Sapiens
APLNLYMFR

SEQ ID NO: 712124 - protein, 9 aa, Homo Sapiens
QAKKSSEIS

SEQ ID NO: 712125 - protein, 9 aa, Homo Sapiens
KYLTLRTGW

SEQ ID NO: 712126 - protein, 9 aa, Homo Sapiens
VVSVENIMC

SEQ ID NO: 712127 - protein, 9 aa, Homo Sapiens
GPQSVGRSS

SEQ ID NO: 712128 - protein, 9 aa, Homo Sapiens
LTLAGATGS

SEQ ID NO: 712129 - protein, 9 aa, Homo Sapiens
NALGCNFET

SEQ ID NO: 712130 - protein, 9 aa, Homo Sapiens
GADMQEEEE

SEQ ID NO: 712131 - protein, 9 aa, Homo Sapiens
MPGSVGPKL

SEQ ID NO: 712132 - protein, 9 aa, Homo Sapiens
IWPPSPWAP

SEQ ID NO: 712133 - protein, 9 aa, Homo Sapiens
GKDAPVKGL

SEQ ID NO: 712134 - protein, 9 aa, Homo Sapiens
MRLDLAGRY

SEQ ID NO: 712135 - protein, 9 aa, Homo Sapiens
QQVAVGNVQ

SEQ ID NO: 712136 - protein, 9 aa, Homo Sapiens
GQCVKFWEL

SEQ ID NO: 712137 - protein, 9 aa, Homo Sapiens
SFEYHRYTE

SEQ ID NO: 712138 - protein, 9 aa, Homo Sapiens
EYLADEFSC

SEQ ID NO: 712139 - protein, 9 aa, Homo Sapiens
WAPTVGRET

SEQ ID NO: 712140 - protein, 9 aa, Homo Sapiens
SVGPKLMRS

SEQ ID NO: 712141 - protein, 9 aa, Homo Sapiens
TALCDEKNL

SEQ ID NO: 712142 - protein, 9 aa, Homo Sapiens
VQSQDTSSC

SEQ ID NO: 712143 - protein, 9 aa, Homo Sapiens
PLRFCLSET

SEQ ID NO: 712144 - protein, 9 aa, Homo Sapiens
NLVYVFFAA

SEQ ID NO: 712145 - protein, 9 aa, Homo Sapiens
TSMVVLDTG

SEQ ID NO: 712146 - protein, 9 aa, Homo Sapiens
CGSFFQTQY

SEQ ID NO: 712147 - protein, 9 aa, Homo Sapiens
AEISDMAVK

SEQ ID NO: 712148 - protein, 9 aa, Homo Sapiens
ISKEEELFK

SEQ ID NO: 712149 - protein, 9 aa, Homo Sapiens
CSGWMIASG

SEQ ID NO: 712150 - protein, 9 aa, Homo Sapiens
KLGHSELKE

SEQ ID NO: 712151 - protein, 9 aa, Homo Sapiens
TTRPVDLEK

SEQ ID NO: 712152 - protein, 9 aa, Homo Sapiens
MLERHVVPH

SEQ ID NO: 712153 - protein, 9 aa, Homo Sapiens
RPRAGPPSP

SEQ ID NO: 712154 - protein, 9 aa, Homo Sapiens
SKKKRLEPL

SEQ ID NO: 712155 - protein, 9 aa, Homo Sapiens
LRSESLGGT

SEQ ID NO: 712156 - protein, 9 aa, Homo Sapiens
CTWTAAATV

SEQ ID NO: 712157 - protein, 9 aa, Homo Sapiens
PRAHAQSKA

SEQ ID NO: 712158 - protein, 9 aa, Homo Sapiens
HILYYLPQL

SEQ ID NO: 712159 - protein, 9 aa, Homo Sapiens
RTAWWGKVP

SEQ ID NO: 712160 - protein, 9 aa, Homo Sapiens
ENFLQIQYF

SEQ ID NO: 712161 - protein, 9 aa, Homo Sapiens
PDKYEYHRQ

SEQ ID NO: 712162 - protein, 9 aa, Homo Sapiens
KIIHTGKKT

SEQ ID NO: 712163 - protein, 9 aa, Homo Sapiens
KLDSEANAE

SEQ ID NO: 712164 - protein, 9 aa, Homo Sapiens
SSSQEEEGQ

SEQ ID NO: 712165 - protein, 9 aa, Homo Sapiens
ILALYTCSG

SEQ ID NO: 712166 - protein, 9 aa, Homo Sapiens
NELGKYRVM

SEQ ID NO: 712167 - protein, 9 aa, Homo Sapiens
ELQRFLFLL

SEQ ID NO: 712168 - protein, 9 aa, Homo Sapiens
VDQSYESST

SEQ ID NO: 712169 - protein, 9 aa, Homo Sapiens
TLRTGWQYF

SEQ ID NO: 712170 - protein, 9 aa, Homo Sapiens
CVKFWELGP

SEQ ID NO: 712171 - protein, 9 aa, Homo Sapiens
KNEELFTMK

SEQ ID NO: 712172 - protein, 9 aa, Homo Sapiens
NLSVPITWM

SEQ ID NO: 712173 - protein, 9 aa, Homo Sapiens
FNVECCVSG

SEQ ID NO: 712174 - protein, 9 aa, Homo Sapiens
KDQLEYHIL

SEQ ID NO: 712175 - protein, 9 aa, Homo Sapiens
VLHMLQDCY

SEQ ID NO: 712176 - protein, 9 aa, Homo Sapiens
PDYSKNFSI

SEQ ID NO: 712177 - protein, 9 aa, Homo Sapiens
QAHCSFPEC

SEQ ID NO: 712178 - protein, 9 aa, Homo Sapiens
CQLSVCYLW

SEQ ID NO: 712179 - protein, 9 aa, Homo Sapiens
LWGQSNRKT

SEQ ID NO: 712180 - protein, 9 aa, Homo Sapiens
NKLLTFSYY

SEQ ID NO: 712181 - protein, 9 aa, Homo Sapiens
KSWVSIWPP

SEQ ID NO: 712182 - protein, 9 aa, Homo Sapiens
MVRHQGRIM

SEQ ID NO: 712183 - protein, 9 aa, Homo Sapiens
EDEEDYEEH

SEQ ID NO: 712184 - protein, 9 aa, Homo Sapiens
QQGEKQLLR

SEQ ID NO: 712185 - protein, 9 aa, Homo Sapiens
PKRECQGKQ

SEQ ID NO: 712186 - protein, 9 aa, Homo Sapiens
NVRFDATLA

SEQ ID NO: 712187 - protein, 9 aa, Homo Sapiens
KKLKELKNE

SEQ ID NO: 712188 - protein, 9 aa, Homo Sapiens
FGLYYSLYE

SEQ ID NO: 712189 - protein, 9 aa, Homo Sapiens
VVLDTGCAL

SEQ ID NO: 712190 - protein, 9 aa, Homo Sapiens
DSSAPDKYE

SEQ ID NO: 712191 - protein, 9 aa, Homo Sapiens
SAPDKYEYH

SEQ ID NO: 712192 - protein, 9 aa, Homo Sapiens
QYGGIRSDP

SEQ ID NO: 712193 - protein, 9 aa, Homo Sapiens
PCACRALAP

SEQ ID NO: 712194 - protein, 9 aa, Homo Sapiens
TRTATVETL

SEQ ID NO: 712195 - protein, 9 aa, Homo Sapiens
YLYWCKQEP

SEQ ID NO: 712196 - protein, 9 aa, Homo Sapiens
DADFTVQDN

SEQ ID NO: 712197 - protein, 9 aa, Homo Sapiens
EVAAKAWDT

SEQ ID NO: 712198 - protein, 9 aa, Homo Sapiens
PDVIVPTLD

SEQ ID NO: 712199 - protein, 9 aa, Homo Sapiens
FQEGTKKSQ

SEQ ID NO: 712200 - protein, 9 aa, Homo Sapiens
FKYLTLRTG

SEQ ID NO: 712201 - protein, 9 aa, Homo Sapiens
QKIHINKEI

SEQ ID NO: 712202 - protein, 9 aa, Homo Sapiens
IRYHTNKYA

SEQ ID NO: 712203 - protein, 9 aa, Homo Sapiens
QRQEERQHA

SEQ ID NO: 712204 - protein, 9 aa, Homo Sapiens
KHSQSPFWQ

SEQ ID NO: 712205 - protein, 9 aa, Homo Sapiens
TYSPREYVC

SEQ ID NO: 712206 - protein, 9 aa, Homo Sapiens
AQCPKRECQ

SEQ ID NO: 712207 - protein, 9 aa, Homo Sapiens
GERPYLCQA

SEQ ID NO: 712208 - protein, 9 aa, Homo Sapiens
STYLYWCKQ

SEQ ID NO: 712209 - protein, 9 aa, Homo Sapiens
FFNVECCVS

SEQ ID NO: 712210 - protein, 9 aa, Homo Sapiens
YPSLVNYAN

SEQ ID NO: 712211 - protein, 9 aa, Homo Sapiens
TIHPSSTTE

SEQ ID NO: 712212 - protein, 9 aa, Homo Sapiens
SVQSQDTSS

SEQ ID NO: 712213 - protein, 9 aa, Homo Sapiens
LKATKADDR

SEQ ID NO: 712214 - protein, 9 aa, Homo Sapiens
EISDMAVKY

SEQ ID NO: 712215 - protein, 9 aa, Homo Sapiens
RIMYVGDVR

SEQ ID NO: 712216 - protein, 9 aa, Homo Sapiens
SIARSADSK

SEQ ID NO: 712217 - protein, 9 aa, Homo Sapiens
QGQSPRITP

SEQ ID NO: 712218 - protein, 9 aa, Homo Sapiens
SPRASPALS

SEQ ID NO: 712219 - protein, 9 aa, Homo Sapiens
GVPLSSLPR

SEQ ID NO: 712220 - protein, 9 aa, Homo Sapiens
PLRPGDSEA

SEQ ID NO: 712221 - protein, 9 aa, Homo Sapiens
SFFQTQYPG

SEQ ID NO: 712222 - protein, 9 aa, Homo Sapiens
YPELQRFLF

SEQ ID NO: 712223 - protein, 9 aa, Homo Sapiens
GCGTGSCCN

SEQ ID NO: 712224 - protein, 9 aa, Homo Sapiens
QSQDTSSCH

SEQ ID NO: 712225 - protein, 9 aa, Homo Sapiens
DQRGNQIIS

SEQ ID NO: 712226 - protein, 9 aa, Homo Sapiens
NRKTLWGIQ

SEQ ID NO: 712227 - protein, 9 aa, Homo Sapiens
DEGLFLHSQ

SEQ ID NO: 712228 - protein, 9 aa, Homo Sapiens
PFVQYNCYY

SEQ ID NO: 712229 - protein, 9 aa, Homo Sapiens
AGCRGSASG

SEQ ID NO: 712230 - protein, 9 aa, Homo Sapiens
HRYTELREA

SEQ ID NO: 712231 - protein, 9 aa, Homo Sapiens
DDSLYLSPC

SEQ ID NO: 712232 - protein, 9 aa, Homo Sapiens
LLHISPEGL

SEQ ID NO: 712233 - protein, 9 aa, Homo Sapiens
LVYVFFAAK

SEQ ID NO: 712234 - protein, 9 aa, Homo Sapiens
LVQRYNRVN

SEQ ID NO: 712235 - protein, 9 aa, Homo Sapiens
PDTFTHPHE

SEQ ID NO: 712236 - protein, 9 aa, Homo Sapiens
DVIVPTLDT

SEQ ID NO: 712237 - protein, 9 aa, Homo Sapiens
RCMVTHELA

SEQ ID NO: 712238 - protein, 9 aa, Homo Sapiens
EWGVSPDPP

SEQ ID NO: 712239 - protein, 9 aa, Homo Sapiens
FQQLRTPHQ

SEQ ID NO: 712240 - protein, 9 aa, Homo Sapiens
RREGADMQE

SEQ ID NO: 712241 - protein, 9 aa, Homo Sapiens
LYEWFHPLF

SEQ ID NO: 712242 - protein, 9 aa, Homo Sapiens
TSNDSPKIL

SEQ ID NO: 712243 - protein, 9 aa, Homo Sapiens
QTQYPGQPS

SEQ ID NO: 712244 - protein, 9 aa, Homo Sapiens
ASAEYHHKA

SEQ ID NO: 712245 - protein, 9 aa, Homo Sapiens
DPPHPCEGQ

SEQ ID NO: 712246 - protein, 9 aa, Homo Sapiens
EKKVESSRK

SEQ ID NO: 712247 - protein, 9 aa, Homo Sapiens
EESDPYKFK

SEQ ID NO: 712248 - protein, 9 aa, Homo Sapiens
LHRTAWWGK

SEQ ID NO: 712249 - protein, 9 aa, Homo Sapiens
MPGMTGMVG

SEQ ID NO: 712250 - protein, 9 aa, Homo Sapiens
CDFTVQVPL

SEQ ID NO: 712251 - protein, 9 aa, Homo Sapiens
QGPVVRTGE

SEQ ID NO: 712252 - protein, 9 aa, Homo Sapiens
VRPVVKWQL

SEQ ID NO: 712253 - protein, 9 aa, Homo Sapiens
TGAESKLGW

SEQ ID NO: 712254 - protein, 9 aa, Homo Sapiens
LIGIIPRIA

SEQ ID NO: 712255 - protein, 9 aa, Homo Sapiens
TAAATVFSI

SEQ ID NO: 712256 - protein, 9 aa, Homo Sapiens
YYSLYEWFH

SEQ ID NO: 712257 - protein, 9 aa, Homo Sapiens
HQLPQPPVG

SEQ ID NO: 712258 - protein, 9 aa, Homo Sapiens
ESSTSETNF

SEQ ID NO: 712259 - protein, 9 aa, Homo Sapiens
LQRFLFLLC

SEQ ID NO: 712260 - protein, 9 aa, Homo Sapiens
VFSICSLWA

SEQ ID NO: 712261 - protein, 9 aa, Homo Sapiens
SDSSAPDKY

SEQ ID NO: 712262 - protein, 9 aa, Homo Sapiens
RILNHILYY

SEQ ID NO: 712263 - protein, 9 aa, Homo Sapiens
KRVTLLTLA

SEQ ID NO: 712264 - protein, 9 aa, Homo Sapiens
SLQSLNALG

SEQ ID NO: 712265 - protein, 9 aa, Homo Sapiens
LISAKREPI

SEQ ID NO: 712266 - protein, 9 aa, Homo Sapiens
EEQEKKKAG

SEQ ID NO: 712267 - protein, 9 aa, Homo Sapiens
WNEERQSEG

SEQ ID NO: 712268 - protein, 9 aa, Homo Sapiens
IPADQQLEF

SEQ ID NO: 712269 - protein, 9 aa, Homo Sapiens
VPYPSLVNY

SEQ ID NO: 712270 - protein, 9 aa, Homo Sapiens
GQGEKKQLW

SEQ ID NO: 712271 - protein, 9 aa, Homo Sapiens
RGNQIISDK

SEQ ID NO: 712272 - protein, 9 aa, Homo Sapiens
NLEEPIPAF

SEQ ID NO: 712273 - protein, 9 aa, Homo Sapiens
PQTYSPREY

SEQ ID NO: 712274 - protein, 9 aa, Homo Sapiens
SLLAFVFFS

SEQ ID NO: 712275 - protein, 9 aa, Homo Sapiens
QVDESPVSD

SEQ ID NO: 712276 - protein, 9 aa, Homo Sapiens
KTIDQIHRE

SEQ ID NO: 712277 - protein, 9 aa, Homo Sapiens
QCVKFWELG

SEQ ID NO: 712278 - protein, 9 aa, Homo Sapiens
DESPVSDSH

SEQ ID NO: 712279 - protein, 9 aa, Homo Sapiens
ARREGADMQ

SEQ ID NO: 712280 - protein, 9 aa, Homo Sapiens
GRSSPRASP

SEQ ID NO: 712281 - protein, 9 aa, Homo Sapiens
CKGTVSITK

SEQ ID NO: 712282 - protein, 9 aa, Homo Sapiens
LRLRPDYSK

SEQ ID NO: 712283 - protein, 9 aa, Homo Sapiens
SRMASYPPY

SEQ ID NO: 712284 - protein, 9 aa, Homo Sapiens
PCSHSCGPE

SEQ ID NO: 712285 - protein, 9 aa, Homo Sapiens
RSESLGGTP

SEQ ID NO: 712286 - protein, 9 aa, Homo Sapiens
PLHSKHHII

SEQ ID NO: 712287 - protein, 9 aa, Homo Sapiens
REGADMQEE

SEQ ID NO: 712288 - protein, 9 aa, Homo Sapiens
QQKNISKMA

SEQ ID NO: 712289 - protein, 9 aa, Homo Sapiens
TVLASDIPN

SEQ ID NO: 712290 - protein, 9 aa, Homo Sapiens
SQLRMDPQK

SEQ ID NO: 712291 - protein, 9 aa, Homo Sapiens
SACPPNFGG

SEQ ID NO: 712292 - protein, 9 aa, Homo Sapiens
HWQAPRQGW

SEQ ID NO: 712293 - protein, 9 aa, Homo Sapiens
ASGHCRPWK

SEQ ID NO: 712294 - protein, 9 aa, Homo Sapiens
EKTKRVSSQ

SEQ ID NO: 712295 - protein, 9 aa, Homo Sapiens
WMIAQTVLL

SEQ ID NO: 712296 - protein, 9 aa, Homo Sapiens
PRAHPCACR

SEQ ID NO: 712297 - protein, 9 aa, Homo Sapiens
TLCPHFNPC

SEQ ID NO: 712298 - protein, 9 aa, Homo Sapiens
PKTIDQIHR

SEQ ID NO: 712299 - protein, 9 aa, Homo Sapiens
SADEFFIPL

SEQ ID NO: 712300 - protein, 9 aa, Homo Sapiens
GKRYLIVPK

SEQ ID NO: 712301 - protein, 9 aa, Homo Sapiens
KVQSRLVGS

SEQ ID NO: 712302 - protein, 9 aa, Homo Sapiens
YSKNFSIQV

SEQ ID NO: 712303 - protein, 9 aa, Homo Sapiens
TVGRETRPV

SEQ ID NO: 712304 - protein, 9 aa, Homo Sapiens
LAQGGMRIR

SEQ ID NO: 712305 - protein, 9 aa, Homo Sapiens
VESKKMSIT

SEQ ID NO: 712306 - protein, 9 aa, Homo Sapiens
WTAAATVFS

SEQ ID NO: 712307 - protein, 9 aa, Homo Sapiens
PASRCQGQS

SEQ ID NO: 712308 - protein, 9 aa, Homo Sapiens
GPGTCQSKK

SEQ ID NO: 712309 - protein, 9 aa, Homo Sapiens
RFGLYYSLY

SEQ ID NO: 712310 - protein, 9 aa, Homo Sapiens
RISRRGRHT

SEQ ID NO: 712311 - protein, 9 aa, Homo Sapiens
EGTKKSQTD

SEQ ID NO: 712312 - protein, 9 aa, Homo Sapiens
KFQEIVTFK

SEQ ID NO: 712313 - protein, 9 aa, Homo Sapiens
FGNVRFDAT

SEQ ID NO: 712314 - protein, 9 aa, Homo Sapiens
MQNGPVQSI

SEQ ID NO: 712315 - protein, 9 aa, Homo Sapiens
AENFLQIQY

SEQ ID NO: 712316 - protein, 9 aa, Homo Sapiens
KQYNGPPSA

SEQ ID NO: 712317 - protein, 9 aa, Homo Sapiens
PMPNLSVPI

SEQ ID NO: 712318 - protein, 9 aa, Homo Sapiens
EEDYEEHEG

SEQ ID NO: 712319 - protein, 9 aa, Homo Sapiens
PGTCQSKKG

SEQ ID NO: 712320 - protein, 9 aa, Homo Sapiens
DQIHREAEM

SEQ ID NO: 712321 - protein, 9 aa, Homo Sapiens
RPDPPHPCE

SEQ ID NO: 712322 - protein, 9 aa, Homo Sapiens
RDGHKSEVA

SEQ ID NO: 712323 - protein, 9 aa, Homo Sapiens
FVRSKRTPR

SEQ ID NO: 712324 - protein, 9 aa, Homo Sapiens
QGLAEVTIP

SEQ ID NO: 712325 - protein, 9 aa, Homo Sapiens
LNLYMFRNN

SEQ ID NO: 712326 - protein, 9 aa, Homo Sapiens
QSIARSADS

SEQ ID NO: 712327 - protein, 9 aa, Homo Sapiens
KFNIPADQQ

SEQ ID NO: 712328 - protein, 9 aa, Homo Sapiens
QIEMEKKVA

SEQ ID NO: 712329 - protein, 9 aa, Homo Sapiens
LEKLSASTR

SEQ ID NO: 712330 - protein, 9 aa, Homo Sapiens
PTTNRTPEA

SEQ ID NO: 712331 - protein, 9 aa, Homo Sapiens
RGPQSVGRS

SEQ ID NO: 712332 - protein, 9 aa, Homo Sapiens
ATVETLVNV

SEQ ID NO: 712333 - protein, 9 aa, Homo Sapiens
SVTKKVKLE

SEQ ID NO: 712334 - protein, 9 aa, Homo Sapiens
WLKMREEWG

SEQ ID NO: 712335 - protein, 9 aa, Homo Sapiens
SKKMSITNP

SEQ ID NO: 712336 - protein, 9 aa, Homo Sapiens
KYKENFPAS

SEQ ID NO: 712337 - protein, 9 aa, Homo Sapiens
QPITVLEGQ

SEQ ID NO: 712338 - protein, 9 aa, Homo Sapiens
SFMDICYTT

SEQ ID NO: 712339 - protein, 9 aa, Homo Sapiens
RKIKISVTK

SEQ ID NO: 712340 - protein, 9 aa, Homo Sapiens
EVINILAYD

SEQ ID NO: 712341 - protein, 9 aa, Homo Sapiens
FCPHANHSL

SEQ ID NO: 712342 - protein, 9 aa, Homo Sapiens
SPKILPDVN

SEQ ID NO: 712343 - protein, 9 aa, Homo Sapiens
KENFPASNT

SEQ ID NO: 712344 - protein, 9 aa, Homo Sapiens
PALSPRAHP

SEQ ID NO: 712345 - protein, 9 aa, Homo Sapiens
FFIPLEVKV

SEQ ID NO: 712346 - protein, 9 aa, Homo Sapiens
ERQHAELRR

SEQ ID NO: 712347 - protein, 9 aa, Homo Sapiens
PGKESLITN

SEQ ID NO: 712348 - protein, 9 aa, Homo Sapiens
VAVGNVQDG

SEQ ID NO: 712349 - protein, 9 aa, Homo Sapiens
SAIHHVDHP

SEQ ID NO: 712350 - protein, 9 aa, Homo Sapiens
DRILNHILY

SEQ ID NO: 712351 - protein, 9 aa, Homo Sapiens
VRFDATLAI

SEQ ID NO: 712352 - protein, 9 aa, Homo Sapiens
TLHDEEANN

SEQ ID NO: 712353 - protein, 9 aa, Homo Sapiens
VGDRSGADD

SEQ ID NO: 712354 - protein, 9 aa, Homo Sapiens
YSSTSSVRP

SEQ ID NO: 712355 - protein, 9 aa, Homo Sapiens
TVCGSFFQT

SEQ ID NO: 712356 - protein, 9 aa, Homo Sapiens
PKHSQSPFW

SEQ ID NO: 712357 - protein, 9 aa, Homo Sapiens
CMVTHELAR

SEQ ID NO: 712358 - protein, 9 aa, Homo Sapiens
SAIRISRRG

SEQ ID NO: 712359 - protein, 9 aa, Homo Sapiens
EERQHAELR

SEQ ID NO: 712360 - protein, 9 aa, Homo Sapiens
AVGNVQDGL

SEQ ID NO: 712361 - protein, 9 aa, Homo Sapiens
YPTDPSQLT

SEQ ID NO: 712362 - protein, 9 aa, Homo Sapiens
RQSEGSKTS

SEQ ID NO: 712363 - protein, 9 aa, Homo Sapiens
GNFNTLALM

SEQ ID NO: 712364 - protein, 9 aa, Homo Sapiens
GMVGSLLED

SEQ ID NO: 712365 - protein, 9 aa, Homo Sapiens
SCKGTVSIT

SEQ ID NO: 712366 - protein, 9 aa, Homo Sapiens
GLAEVTIPT

SEQ ID NO: 712367 - protein, 9 aa, Homo Sapiens
QQEMPGEQG

SEQ ID NO: 712368 - protein, 9 aa, Homo Sapiens
LMATEAVAR

SEQ ID NO: 712369 - protein, 9 aa, Homo Sapiens
LTFSYYDSL

SEQ ID NO: 712370 - protein, 9 aa, Homo Sapiens
IHHKLLLPS

SEQ ID NO: 712371 - protein, 9 aa, Homo Sapiens
TEADEGRGQ

SEQ ID NO: 712372 - protein, 9 aa, Homo Sapiens
KMLPDTFTH

SEQ ID NO: 712373 - protein, 9 aa, Homo Sapiens
KVESSRKHR

SEQ ID NO: 712374 - protein, 9 aa, Homo Sapiens
IAEDDRLYN

SEQ ID NO: 712375 - protein, 9 aa, Homo Sapiens
LPGAPGTRG

SEQ ID NO: 712376 - protein, 9 aa, Homo Sapiens
KLKAQQEMP

SEQ ID NO: 712377 - protein, 9 aa, Homo Sapiens
AKAWDTGIL

SEQ ID NO: 712378 - protein, 9 aa, Homo Sapiens
VLALEKLSA

SEQ ID NO: 712379 - protein, 9 aa, Homo Sapiens
ANHSLLVPE

SEQ ID NO: 712380 - protein, 9 aa, Homo Sapiens
SPVSRPASR

SEQ ID NO: 712381 - protein, 9 aa, Homo Sapiens
ANNESSNHS

SEQ ID NO: 712382 - protein, 9 aa, Homo Sapiens
VQSRLVGSS

SEQ ID NO: 712383 - protein, 9 aa, Homo Sapiens
ASDIPNFPP

SEQ ID NO: 712384 - protein, 9 aa, Homo Sapiens
ITNSGKLYA

SEQ ID NO: 712385 - protein, 9 aa, Homo Sapiens
VKFWELGPR

SEQ ID NO: 712386 - protein, 9 aa, Homo Sapiens
AKKLKELKN

SEQ ID NO: 712387 - protein, 9 aa, Homo Sapiens
ACKITKTPG

SEQ ID NO: 712388 - protein, 9 aa, Homo Sapiens
KKKRLEPLG

SEQ ID NO: 712389 - protein, 9 aa, Homo Sapiens
MVHAWAQKG

SEQ ID NO: 712390 - protein, 9 aa, Homo Sapiens
SWVSIWPPS

SEQ ID NO: 712391 - protein, 9 aa, Homo Sapiens
HQIIHAGMK

SEQ ID NO: 712392 - protein, 9 aa, Homo Sapiens
GPFSQFTKA

SEQ ID NO: 712393 - protein, 9 aa, Homo Sapiens
QLELQEKPK

SEQ ID NO: 712394 - protein, 9 aa, Homo Sapiens
SGAPAPRRV

SEQ ID NO: 712395 - protein, 9 aa, Homo Sapiens
GVAPGSSAG

SEQ ID NO: 712396 - protein, 9 aa, Homo Sapiens
KMSITNPKT

SEQ ID NO: 712397 - protein, 9 aa, Homo Sapiens
SSTSSVRPV

SEQ ID NO: 712398 - protein, 9 aa, Homo Sapiens
PRPPPMLSA

SEQ ID NO: 712399 - protein, 9 aa, Homo Sapiens
LITNSGKLY

SEQ ID NO: 712400 - protein, 9 aa, Homo Sapiens
NLVLDSEVA

SEQ ID NO: 712401 - protein, 9 aa, Homo Sapiens
IRCHNLVYV

SEQ ID NO: 712402 - protein, 9 aa, Homo Sapiens
GPPRRARGP

SEQ ID NO: 712403 - protein, 9 aa, Homo Sapiens
HGADLEHYV

SEQ ID NO: 712404 - protein, 9 aa, Homo Sapiens
SIFAYEYIK

SEQ ID NO: 712405 - protein, 9 aa, Homo Sapiens
FISKEEELF

SEQ ID NO: 712406 - protein, 9 aa, Homo Sapiens
NTGRTQARA

SEQ ID NO: 712407 - protein, 9 aa, Homo Sapiens
QSIMQVRED

SEQ ID NO: 712408 - protein, 9 aa, Homo Sapiens
VRSKRTPRG

SEQ ID NO: 712409 - protein, 9 aa, Homo Sapiens
RPVGNWVPP

SEQ ID NO: 712410 - protein, 9 aa, Homo Sapiens
DECEHYERV

SEQ ID NO: 712411 - protein, 9 aa, Homo Sapiens
KELINQTDF

SEQ ID NO: 712412 - protein, 9 aa, Homo Sapiens
KTPGMNSVH

SEQ ID NO: 712413 - protein, 9 aa, Homo Sapiens
DATLAIVGI

SEQ ID NO: 712414 - protein, 9 aa, Homo Sapiens
STAQTQLSR

SEQ ID NO: 712415 - protein, 9 aa, Homo Sapiens
PGLEHALRS

SEQ ID NO: 712416 - protein, 9 aa, Homo Sapiens
GREQSQTAG

SEQ ID NO: 712417 - protein, 9 aa, Homo Sapiens
GHFNLQVLQ

SEQ ID NO: 712418 - protein, 9 aa, Homo Sapiens
LELQEKPKN

SEQ ID NO: 712419 - protein, 9 aa, Homo Sapiens
RIGKDPAPL

SEQ ID NO: 712420 - protein, 9 aa, Homo Sapiens
SWMIAQTVL

SEQ ID NO: 712421 - protein, 9 aa, Homo Sapiens
PPEDTVPLM

SEQ ID NO: 712422 - protein, 9 aa, Homo Sapiens
PGLPGAPGT

SEQ ID NO: 712423 - protein, 9 aa, Homo Sapiens
PVWLRRSHK

SEQ ID NO: 712424 - protein, 9 aa, Homo Sapiens
DRSGADDPR

SEQ ID NO: 712425 - protein, 9 aa, Homo Sapiens
GEKAGKDAP

SEQ ID NO: 712426 - protein, 9 aa, Homo Sapiens
TKTPGMNSV

SEQ ID NO: 712427 - protein, 9 aa, Homo Sapiens
WTVLRGGGL

SEQ ID NO: 712428 - protein, 9 aa, Homo Sapiens
AKMRRDLEQ

SEQ ID NO: 712429 - protein, 9 aa, Homo Sapiens
RGVFRRDGH

SEQ ID NO: 712430 - protein, 9 aa, Homo Sapiens
GKKPAVSPH

SEQ ID NO: 712431 - protein, 9 aa, Homo Sapiens
LYYSLYEWF

SEQ ID NO: 712432 - protein, 9 aa, Homo Sapiens
SFFNVECCV

SEQ ID NO: 712433 - protein, 9 aa, Homo Sapiens
HFNLQVLQL

SEQ ID NO: 712434 - protein, 9 aa, Homo Sapiens
GAGPFSQFT

SEQ ID NO: 712435 - protein, 9 aa, Homo Sapiens
ISDMAVKYE

SEQ ID NO: 712436 - protein, 9 aa, Homo Sapiens
RRDLEQLME

SEQ ID NO: 712437 - protein, 9 aa, Homo Sapiens
PRNRKDALL

SEQ ID NO: 712438 - protein, 9 aa, Homo Sapiens
RSKRTPRGD

SEQ ID NO: 712439 - protein, 9 aa, Homo Sapiens
HCRPWKVKA

SEQ ID NO: 712440 - protein, 9 aa, Homo Sapiens
RYRYQQVAV

SEQ ID NO: 712441 - protein, 9 aa, Homo Sapiens
HKLLSLEYP

SEQ ID NO: 712442 - protein, 9 aa, Homo Sapiens
CQSKKGWGL

SEQ ID NO: 712443 - protein, 9 aa, Homo Sapiens
AASGHCRPW

SEQ ID NO: 712444 - protein, 9 aa, Homo Sapiens
QVAVGNVQD

SEQ ID NO: 712445 - protein, 9 aa, Homo Sapiens
PSSTTETTH

SEQ ID NO: 712446 - protein, 9 aa, Homo Sapiens
IHREAEMEE

SEQ ID NO: 712447 - protein, 9 aa, Homo Sapiens
SQFTKAKTR

SEQ ID NO: 712448 - protein, 9 aa, Homo Sapiens
QGGMRIRAR

SEQ ID NO: 712449 - protein, 9 aa, Homo Sapiens
IDVASEQNL

SEQ ID NO: 712450 - protein, 9 aa, Homo Sapiens
PDNHQGTPE

SEQ ID NO: 712451 - protein, 9 aa, Homo Sapiens
PWKVKADIP

SEQ ID NO: 712452 - protein, 9 aa, Homo Sapiens
DPQLIGIIP

SEQ ID NO: 712453 - protein, 9 aa, Homo Sapiens
INQTDFSMN

SEQ ID NO: 712454 - protein, 9 aa, Homo Sapiens
EAVARGWLR

SEQ ID NO: 712455 - protein, 9 aa, Homo Sapiens
TSETNFDCD

SEQ ID NO: 712456 - protein, 9 aa, Homo Sapiens
ASGPPRRAR

SEQ ID NO: 712457 - protein, 9 aa, Homo Sapiens
MIAQTVLLL

SEQ ID NO: 712458 - protein, 9 aa, Homo Sapiens
EEPSKRWPP

SEQ ID NO: 712459 - protein, 9 aa, Homo Sapiens
VYVFFAAKT

SEQ ID NO: 712460 - protein, 9 aa, Homo Sapiens
NQIISDKRN

SEQ ID NO: 712461 - protein, 9 aa, Homo Sapiens
FNTLALMHL

SEQ ID NO: 712462 - protein, 9 aa, Homo Sapiens
RSSPRASPA

SEQ ID NO: 712463 - protein, 9 aa, Homo Sapiens
EQSLSPQSP

SEQ ID NO: 712464 - protein, 9 aa, Homo Sapiens
ESPVSDSHG

SEQ ID NO: 712465 - protein, 9 aa, Homo Sapiens
SRCQGQSPR

SEQ ID NO: 712466 - protein, 9 aa, Homo Sapiens
FQYHATNGS

SEQ ID NO: 712467 - protein, 9 aa, Homo Sapiens
KAGREQSQT

SEQ ID NO: 712468 - protein, 9 aa, Homo Sapiens
LSVPITWMP

SEQ ID NO: 712469 - protein, 9 aa, Homo Sapiens
TETTHTSTV

SEQ ID NO: 712470 - protein, 9 aa, Homo Sapiens
WGQSNRKTL

SEQ ID NO: 712471 - protein, 9 aa, Homo Sapiens
RADIKQYNG

SEQ ID NO: 712472 - protein, 9 aa, Homo Sapiens
LFLHSQEAA

SEQ ID NO: 712473 - protein, 9 aa, Homo Sapiens
VFRRDGHKS

SEQ ID NO: 712474 - protein, 9 aa, Homo Sapiens
AWAQKGAQE

SEQ ID NO: 712475 - protein, 9 aa, Homo Sapiens
RIRRLIRAA

SEQ ID NO: 712476 - protein, 9 aa, Homo Sapiens
NVKFYPTDP

SEQ ID NO: 712477 - protein, 9 aa, Homo Sapiens
QSVGRSSPR

SEQ ID NO: 712478 - protein, 9 aa, Homo Sapiens
LAMPGSVGP

SEQ ID NO: 712479 - protein, 9 aa, Homo Sapiens
RAASGPPRR

SEQ ID NO: 712480 - protein, 9 aa, Homo Sapiens
KDLVPELQE

SEQ ID NO: 712481 - protein, 9 aa, Homo Sapiens
RQHAELRRA

SEQ ID NO: 712482 - protein, 9 aa, Homo Sapiens
GRKIKISVT

SEQ ID NO: 712483 - protein, 9 aa, Homo Sapiens
KFWELGPRP

SEQ ID NO: 712484 - protein, 9 aa, Homo Sapiens
AQKLTLDWA

SEQ ID NO: 712485 - protein, 9 aa, Homo Sapiens
DGAFSGHFN

SEQ ID NO: 712486 - protein, 9 aa, Homo Sapiens
FLSRLVLHM

SEQ ID NO: 712487 - protein, 9 aa, Homo Sapiens
QLPQPPVGK

SEQ ID NO: 712488 - protein, 9 aa, Homo Sapiens
TTGAESKLG

SEQ ID NO: 712489 - protein, 9 aa, Homo Sapiens
GLPGAPGTR

SEQ ID NO: 712490 - protein, 9 aa, Homo Sapiens
HPEIPKPRV

SEQ ID NO: 712491 - protein, 9 aa, Homo Sapiens
GWQYFLFTC

SEQ ID NO: 712492 - protein, 9 aa, Homo Sapiens
DDPRAKGHS

SEQ ID NO: 712493 - protein, 9 aa, Homo Sapiens
APTVGRETR

SEQ ID NO: 712494 - protein, 9 aa, Homo Sapiens
ENIMCPVYD

SEQ ID NO: 712495 - protein, 9 aa, Homo Sapiens
CSACPPNFG

SEQ ID NO: 712496 - protein, 9 aa, Homo Sapiens
STTETTHTS

SEQ ID NO: 712497 - protein, 9 aa, Homo Sapiens
KRWPPPVPR

SEQ ID NO: 712498 - protein, 9 aa, Homo Sapiens
VDWNEERQS

SEQ ID NO: 712499 - protein, 9 aa, Homo Sapiens
ATEADEGRG

SEQ ID NO: 712500 - protein, 9 aa, Homo Sapiens
EAGEKAGKD

SEQ ID NO: 712501 - protein, 9 aa, Homo Sapiens
DQSYESSTS

SEQ ID NO: 712502 - protein, 9 aa, Homo Sapiens
HKVAAPDVI

SEQ ID NO: 712503 - protein, 9 aa, Homo Sapiens
GPVVRTGEV

SEQ ID NO: 712504 - protein, 9 aa, Homo Sapiens
NKYASSSTS

SEQ ID NO: 712505 - protein, 9 aa, Homo Sapiens
SSTSETNFD

SEQ ID NO: 712506 - protein, 9 aa, Homo Sapiens
NRKDALLGS

SEQ ID NO: 712507 - protein, 9 aa, Homo Sapiens
ETFDVDECE

SEQ ID NO: 712508 - protein, 9 aa, Homo Sapiens
LQDISKQTE

SEQ ID NO: 712509 - protein, 9 aa, Homo Sapiens
MSCLASYLA

SEQ ID NO: 712510 - protein, 9 aa, Homo Sapiens
KFYPTDPSQ

SEQ ID NO: 712511 - protein, 9 aa, Homo Sapiens
CFYVAVIFT

SEQ ID NO: 712512 - protein, 9 aa, Homo Sapiens
CACRALAPA

SEQ ID NO: 712513 - protein, 9 aa, Homo Sapiens
CWTTGAESK

SEQ ID NO: 712514 - protein, 9 aa, Homo Sapiens
PRDEEEQMM

SEQ ID NO: 712515 - protein, 9 aa, Homo Sapiens
LRSSGEEPS

SEQ ID NO: 712516 - protein, 9 aa, Homo Sapiens
KKVAFSTIS

SEQ ID NO: 712517 - protein, 9 aa, Homo Sapiens
KEFLKEEES

SEQ ID NO: 712518 - protein, 9 aa, Homo Sapiens
TNPKTISRL

SEQ ID NO: 712519 - protein, 9 aa, Homo Sapiens
HLLLPVMPV

SEQ ID NO: 712520 - protein, 9 aa, Homo Sapiens
KYASSSTSL

SEQ ID NO: 712521 - protein, 9 aa, Homo Sapiens
SKRTPRGDK

SEQ ID NO: 712522 - protein, 9 aa, Homo Sapiens
ATLAIVGIA

SEQ ID NO: 712523 - protein, 9 aa, Homo Sapiens
VIMNANENN

SEQ ID NO: 712524 - protein, 9 aa, Homo Sapiens
GPFLRTTLM

SEQ ID NO: 712525 - protein, 9 aa, Homo Sapiens
GADDPRAKG

SEQ ID NO: 712526 - protein, 9 aa, Homo Sapiens
MREEWGVSP

SEQ ID NO: 712527 - protein, 9 aa, Homo Sapiens
WNKELINQT

SEQ ID NO: 712528 - protein, 9 aa, Homo Sapiens
KKSSEISLK

SEQ ID NO: 712529 - protein, 9 aa, Homo Sapiens
GLEHALRST

SEQ ID NO: 712530 - protein, 9 aa, Homo Sapiens
LLNHKLLSL

SEQ ID NO: 712531 - protein, 9 aa, Homo Sapiens
IHHVDHPGV

SEQ ID NO: 712532 - protein, 9 aa, Homo Sapiens
QEEEGQSTS

SEQ ID NO: 712533 - protein, 9 aa, Homo Sapiens
CSIFAYEYI

SEQ ID NO: 712534 - protein, 9 aa, Homo Sapiens
QGKGHGDSS

SEQ ID NO: 712535 - protein, 9 aa, Homo Sapiens
FQIVSEKWV

SEQ ID NO: 712536 - protein, 9 aa, Homo Sapiens
EGADMQEEE

SEQ ID NO: 712537 - protein, 9 aa, Homo Sapiens
CTGCECSHL

SEQ ID NO: 712538 - protein, 9 aa, Homo Sapiens
TSRTSYNNR

SEQ ID NO: 712539 - protein, 9 aa, Homo Sapiens
LHDEEANND

SEQ ID NO: 712540 - protein, 9 aa, Homo Sapiens
LQDDSLYLS

SEQ ID NO: 712541 - protein, 9 aa, Homo Sapiens
IRRLIRAAK

SEQ ID NO: 712542 - protein, 9 aa, Homo Sapiens
NPPSRMASY

SEQ ID NO: 712543 - protein, 9 aa, Homo Sapiens
HAWAQKGAQ

SEQ ID NO: 712544 - protein, 9 aa, Homo Sapiens
LALMHLPRM

SEQ ID NO: 712545 - protein, 9 aa, Homo Sapiens
ADDPRAKGH

SEQ ID NO: 712546 - protein, 9 aa, Homo Sapiens
MGTLGEAVR

SEQ ID NO: 712547 - protein, 9 aa, Homo Sapiens
LAEVTIPTR

SEQ ID NO: 712548 - protein, 9 aa, Homo Sapiens
YPMPNLSVP

SEQ ID NO: 712549 - protein, 9 aa, Homo Sapiens
HREAEMEEH

SEQ ID NO: 712550 - protein, 9 aa, Homo Sapiens
TCSIFAYEY

SEQ ID NO: 712551 - protein, 9 aa, Homo Sapiens
EQEKKKAGR

SEQ ID NO: 712552 - protein, 9 aa, Homo Sapiens
RLDLAGRYL

SEQ ID NO: 712553 - protein, 9 aa, Homo Sapiens
KMRRDLEQL

SEQ ID NO: 712554 - protein, 9 aa, Homo Sapiens
SSGFCPHAN

SEQ ID NO: 712555 - protein, 9 aa, Homo Sapiens
AIHHVDHPG

SEQ ID NO: 712556 - protein, 9 aa, Homo Sapiens
FLEKKVESS

SEQ ID NO: 712557 - protein, 9 aa, Homo Sapiens
LASDIPNFP

SEQ ID NO: 712558 - protein, 9 aa, Homo Sapiens
QFISKEEEL

SEQ ID NO: 712559 - protein, 9 aa, Homo Sapiens
SRTSYNNRS

SEQ ID NO: 712560 - protein, 9 aa, Homo Sapiens
MDICYTTTS

SEQ ID NO: 712561 - protein, 9 aa, Homo Sapiens
KYPMPNLSV

SEQ ID NO: 712562 - protein, 9 aa, Homo Sapiens
QTDFSMNLM

SEQ ID NO: 712563 - protein, 9 aa, Homo Sapiens
PYLCQACGK

SEQ ID NO: 712564 - protein, 9 aa, Homo Sapiens
LHDPQLIGI

SEQ ID NO: 712565 - protein, 9 aa, Homo Sapiens
SVVSVENIM

SEQ ID NO: 712566 - protein, 9 aa, Homo Sapiens
QTAGRTIQC

SEQ ID NO: 712567 - protein, 9 aa, Homo Sapiens
ADLEHYVLT

SEQ ID NO: 712568 - protein, 9 aa, Homo Sapiens
QSAIRISRR

SEQ ID NO: 712569 - protein, 9 aa, Homo Sapiens
SENRYRDIS

SEQ ID NO: 712570 - protein, 9 aa, Homo Sapiens
RNRKDALLG

SEQ ID NO: 712571 - protein, 9 aa, Homo Sapiens
RRARGPQSV

SEQ ID NO: 712572 - protein, 9 aa, Homo Sapiens
FDATLAIVG

SEQ ID NO: 712573 - protein, 9 aa, Homo Sapiens
GMVRHQGRI

SEQ ID NO: 712574 - protein, 9 aa, Homo Sapiens
PIRLFGLIS

SEQ ID NO: 712575 - protein, 9 aa, Homo Sapiens
ASEMMVSLM

SEQ ID NO: 712576 - protein, 9 aa, Homo Sapiens
RVTLLTLAG

SEQ ID NO: 712577 - protein, 9 aa, Homo Sapiens
QLRMDPQKS

SEQ ID NO: 712578 - protein, 9 aa, Homo Sapiens
TPLHSKHHI

SEQ ID NO: 712579 - protein, 9 aa, Homo Sapiens
EKRVTLLTL

SEQ ID NO: 712580 - protein, 9 aa, Homo Sapiens
EALAQGGMR

SEQ ID NO: 712581 - protein, 9 aa, Homo Sapiens
TPGMNSVHK

SEQ ID NO: 712582 - protein, 9 aa, Homo Sapiens
ADIKQYNGP

SEQ ID NO: 712583 - protein, 9 aa, Homo Sapiens
LSTNTTVLF

SEQ ID NO: 712584 - protein, 9 aa, Homo Sapiens
PDRNQAAPF

SEQ ID NO: 712585 - protein, 9 aa, Homo Sapiens
PPPVPRASL

SEQ ID NO: 712586 - protein, 9 aa, Homo Sapiens
RTQARARTT

SEQ ID NO: 712587 - protein, 9 aa, Homo Sapiens
YNGPPSAAA

SEQ ID NO: 712588 - protein, 9 aa, Homo Sapiens
HISPEGLQK

SEQ ID NO: 712589 - protein, 9 aa, Homo Sapiens
QQLRTPHQK

SEQ ID NO: 712590 - protein, 9 aa, Homo Sapiens
SPREYVCRK

SEQ ID NO: 712591 - protein, 9 aa, Homo Sapiens
SSLPRVPQG

SEQ ID NO: 712592 - protein, 9 aa, Homo Sapiens
QSTSPDAES

SEQ ID NO: 712593 - protein, 9 aa, Homo Sapiens
PWAPTVGRE

SEQ ID NO: 712594 - protein, 9 aa, Homo Sapiens
PMLSASDPS

SEQ ID NO: 712595 - protein, 9 aa, Homo Sapiens
ENLVLDSEV

SEQ ID NO: 712596 - protein, 9 aa, Homo Sapiens
IFQAHCSFP

SEQ ID NO: 712597 - protein, 9 aa, Homo Sapiens
CIAHTYKIY

SEQ ID NO: 712598 - protein, 9 aa, Homo Sapiens
WCKQEPGAG

SEQ ID NO: 712599 - protein, 9 aa, Homo Sapiens
LSSLPRVPQ

SEQ ID NO: 712600 - protein, 9 aa, Homo Sapiens
GRTQARART

SEQ ID NO: 712601 - protein, 9 aa, Homo Sapiens
RFAAGKCLA

SEQ ID NO: 712602 - protein, 9 aa, Homo Sapiens
PGDSEARAS

SEQ ID NO: 712603 - protein, 9 aa, Homo Sapiens
QRCQLSVCY

SEQ ID NO: 712604 - protein, 9 aa, Homo Sapiens
VAVIFTLNG

SEQ ID NO: 712605 - protein, 9 aa, Homo Sapiens
GSASGAPAP

SEQ ID NO: 712606 - protein, 9 aa, Homo Sapiens
TATVETLVN

SEQ ID NO: 712607 - protein, 9 aa, Homo Sapiens
QDTSSCHRV

SEQ ID NO: 712608 - protein, 9 aa, Homo Sapiens
EADEGRGQA

SEQ ID NO: 712609 - protein, 9 aa, Homo Sapiens
EYHRYTELR

SEQ ID NO: 712610 - protein, 9 aa, Homo Sapiens
CEHYERVEN

SEQ ID NO: 712611 - protein, 9 aa, Homo Sapiens
TCSGWMIAS

SEQ ID NO: 712612 - protein, 9 aa, Homo Sapiens
TDFSMNLMD

SEQ ID NO: 712613 - protein, 9 aa, Homo Sapiens
AGREQSQTA

SEQ ID NO: 712614 - protein, 9 aa, Homo Sapiens
ETRPVGNWV

SEQ ID NO: 712615 - protein, 9 aa, Homo Sapiens
SYESSTSET

SEQ ID NO: 712616 - protein, 9 aa, Homo Sapiens
PPNATLILA

SEQ ID NO: 712617 - protein, 9 aa, Homo Sapiens
MTGMVGSLL

SEQ ID NO: 712618 - protein, 9 aa, Homo Sapiens
RAHAQSKAH

SEQ ID NO: 712619 - protein, 9 aa, Homo Sapiens
MHLPRMYNQ

SEQ ID NO: 712620 - protein, 9 aa, Homo Sapiens
RQGQCVKFW

SEQ ID NO: 712621 - protein, 9 aa, Homo Sapiens
SDIPNFPPE

SEQ ID NO: 712622 - protein, 9 aa, Homo Sapiens
RGDQGPVVR

SEQ ID NO: 712623 - protein, 9 aa, Homo Sapiens
SSDSSAPDK

SEQ ID NO: 712624 - protein, 9 aa, Homo Sapiens
APAPWGTAG

SEQ ID NO: 712625 - protein, 9 aa, Homo Sapiens
IQSLQDISK

SEQ ID NO: 712626 - protein, 9 aa, Homo Sapiens
YIKEVHKRR

SEQ ID NO: 712627 - protein, 9 aa, Homo Sapiens
CPKRECQGK

SEQ ID NO: 712628 - protein, 9 aa, Homo Sapiens
ILNHILYYL

SEQ ID NO: 712629 - protein, 9 aa, Homo Sapiens
KYEYHRQRC

SEQ ID NO: 712630 - protein, 9 aa, Homo Sapiens
ECEHYERVE

SEQ ID NO: 712631 - protein, 9 aa, Homo Sapiens
EGQSTSPDA

SEQ ID NO: 712632 - protein, 9 aa, Homo Sapiens
NILAYDETT

SEQ ID NO: 712633 - protein, 9 aa, Homo Sapiens
MAVKYENTL

SEQ ID NO: 712634 - protein, 9 aa, Homo Sapiens
KAGKDAPVK

SEQ ID NO: 712635 - protein, 9 aa, Homo Sapiens
HEAAWRGHV

SEQ ID NO: 712636 - protein, 9 aa, Homo Sapiens
HPCEGQKLL

SEQ ID NO: 712637 - protein, 9 aa, Homo Sapiens
SIWPPSPWA

SEQ ID NO: 712638 - protein, 9 aa, Homo Sapiens
QAKMRRDLE

SEQ ID NO: 712639 - protein, 9 aa, Homo Sapiens
KCDFTVQVP

SEQ ID NO: 712640 - protein, 9 aa, Homo Sapiens
RVHITLHDE

SEQ ID NO: 712641 - protein, 9 aa, Homo Sapiens
EKKVAFSTI

SEQ ID NO: 712642 - protein, 9 aa, Homo Sapiens
HRALQLLEE

SEQ ID NO: 712643 - protein, 9 aa, Homo Sapiens
ASLSPVSRP

SEQ ID NO: 712644 - protein, 9 aa, Homo Sapiens
ASRCQGQSP

SEQ ID NO: 712645 - protein, 9 aa, Homo Sapiens
GATEADEGR

SEQ ID NO: 712646 - protein, 9 aa, Homo Sapiens
FPLRPGDSE

SEQ ID NO: 712647 - protein, 9 aa, Homo Sapiens
MNKLGHSEL

SEQ ID NO: 712648 - protein, 9 aa, Homo Sapiens
FEYHRYTEL

SEQ ID NO: 712649 - protein, 9 aa, Homo Sapiens
GSAPAAQHQ

SEQ ID NO: 712650 - protein, 9 aa, Homo Sapiens
CSVGAKASA

SEQ ID NO: 712651 - protein, 9 aa, Homo Sapiens
LVCTWTAAA

SEQ ID NO: 712652 - protein, 9 aa, Homo Sapiens
FFLEKKVES

SEQ ID NO: 712653 - protein, 9 aa, Homo Sapiens
LYWCKQEPG

SEQ ID NO: 712654 - protein, 9 aa, Homo Sapiens
AYEYIKEVH

SEQ ID NO: 712655 - protein, 9 aa, Homo Sapiens
RIRARFPPT

SEQ ID NO: 712656 - protein, 9 aa, Homo Sapiens
RYHTNKYAS

SEQ ID NO: 712657 - protein, 9 aa, Homo Sapiens
KSSEISLKE

SEQ ID NO: 712658 - protein, 9 aa, Homo Sapiens
IPLEVKVLS

SEQ ID NO: 712659 - protein, 9 aa, Homo Sapiens
YSLYEWFHP

SEQ ID NO: 712660 - protein, 9 aa, Homo Sapiens
RDQGPRAHA

SEQ ID NO: 712661 - protein, 9 aa, Homo Sapiens
AHAQSKAHK

SEQ ID NO: 712662 - protein, 9 aa, Homo Sapiens
VGSCWTTGA

SEQ ID NO: 712663 - protein, 9 aa, Homo Sapiens
SMLALTDMG

SEQ ID NO: 712664 - protein, 9 aa, Homo Sapiens
MRIRARFPP

SEQ ID NO: 712665 - protein, 9 aa, Homo Sapiens
GMPGMTGMV

SEQ ID NO: 712666 - protein, 9 aa, Homo Sapiens
VAEVAAKAW

SEQ ID NO: 712667 - protein, 9 aa, Homo Sapiens
GSLSTAQTQ

SEQ ID NO: 712668 - protein, 9 aa, Homo Sapiens
PQAHGVTSA

SEQ ID NO: 712669 - protein, 9 aa, Homo Sapiens
PVVRTGEVG

SEQ ID NO: 712670 - protein, 9 aa, Homo Sapiens
FDVDECEHY

SEQ ID NO: 712671 - protein, 9 aa, Homo Sapiens
AEVTIPTRF

SEQ ID NO: 712672 - protein, 9 aa, Homo Sapiens
DGEQAKKSS

SEQ ID NO: 712673 - protein, 9 aa, Homo Sapiens
GHGDSSCRV

SEQ ID NO: 712674 - protein, 9 aa, Homo Sapiens
GNWVPPEDT

SEQ ID NO: 712675 - protein, 9 aa, Homo Sapiens
CYLWGQSNR

SEQ ID NO: 712676 - protein, 9 aa, Homo Sapiens
YEWFHPLFL

SEQ ID NO: 712677 - protein, 9 aa, Homo Sapiens
ALQLLEEVL

SEQ ID NO: 712678 - protein, 9 aa, Homo Sapiens
RPPPMLSAS

SEQ ID NO: 712679 - protein, 9 aa, Homo Sapiens
GKGRSCKGT

SEQ ID NO: 712680 - protein, 9 aa, Homo Sapiens
TFNVKFYPT

SEQ ID NO: 712681 - protein, 9 aa, Homo Sapiens
GEKKQLWKK

SEQ ID NO: 712682 - protein, 9 aa, Homo Sapiens
KEEESDPYK

SEQ ID NO: 712683 - protein, 9 aa, Homo Sapiens
VLFHLQDEN

SEQ ID NO: 712684 - protein, 9 aa, Homo Sapiens
PIHEAAWRG

SEQ ID NO: 712685 - protein, 9 aa, Homo Sapiens
IQAVAELLH

SEQ ID NO: 712686 - protein, 9 aa, Homo Sapiens
SENGGQGEK

SEQ ID NO: 712687 - protein, 9 aa, Homo Sapiens
TLLTLAGAT

SEQ ID NO: 712688 - protein, 9 aa, Homo Sapiens
MFSAFQEGT

SEQ ID NO: 712689 - protein, 9 aa, Homo Sapiens
MSITNPKTI

SEQ ID NO: 712690 - protein, 9 aa, Homo Sapiens
ICIAHTYKI

SEQ ID NO: 712691 - protein, 9 aa, Homo Sapiens
ASPALSPRA

SEQ ID NO: 712692 - protein, 9 aa, Homo Sapiens
ERQSEGSKT

SEQ ID NO: 712693 - protein, 9 aa, Homo Sapiens
RLHTTMYFF

SEQ ID NO: 712694 - protein, 9 aa, Homo Sapiens
DSRLHTTMY

SEQ ID NO: 712695 - protein, 9 aa, Homo Sapiens
VFFSLSSSC

SEQ ID NO: 712696 - protein, 9 aa, Homo Sapiens
TKRVSSQKK

SEQ ID NO: 712697 - protein, 9 aa, Homo Sapiens
SVAWVCFNH

SEQ ID NO: 712698 - protein, 9 aa, Homo Sapiens
LKGKRYLIV

SEQ ID NO: 712699 - protein, 9 aa, Homo Sapiens
FSICSLWAF

SEQ ID NO: 712700 - protein, 9 aa, Homo Sapiens
SQYPELQRF

SEQ ID NO: 712701 - protein, 9 aa, Homo Sapiens
IIHAGMKPY

SEQ ID NO: 712702 - protein, 9 aa, Homo Sapiens
GFVRSKRTP

SEQ ID NO: 712703 - protein, 9 aa, Homo Sapiens
QTKGALSLQ

SEQ ID NO: 712704 - protein, 9 aa, Homo Sapiens
SPSSFQIVS

SEQ ID NO: 712705 - protein, 9 aa, Homo Sapiens
PVSRPASRC

SEQ ID NO: 712706 - protein, 9 aa, Homo Sapiens
LCDRCMVTH

SEQ ID NO: 712707 - protein, 9 aa, Homo Sapiens
LTDMGLTLT

SEQ ID NO: 712708 - protein, 9 aa, Homo Sapiens
IWEQHAVTL

SEQ ID NO: 712709 - protein, 9 aa, Homo Sapiens
TLAIVGIAF

SEQ ID NO: 712710 - protein, 9 aa, Homo Sapiens
ESDPYKFKI

SEQ ID NO: 712711 - protein, 9 aa, Homo Sapiens
SEANAEPQD

SEQ ID NO: 712712 - protein, 9 aa, Homo Sapiens
SPALSPRAH

SEQ ID NO: 712713 - protein, 9 aa, Homo Sapiens
FHLQDENDN

SEQ ID NO: 712714 - protein, 9 aa, Homo Sapiens
FSQFTKAKT

SEQ ID NO: 712715 - protein, 9 aa, Homo Sapiens
SPTDDFSVE

SEQ ID NO: 712716 - protein, 9 aa, Homo Sapiens
FTKAKTRPL

SEQ ID NO: 712717 - protein, 9 aa, Homo Sapiens
PSSFQIVSE

SEQ ID NO: 712718 - protein, 9 aa, Homo Sapiens
HRQRCQLSV

SEQ ID NO: 712719 - protein, 9 aa, Homo Sapiens
FQAHCSFPE

SEQ ID NO: 712720 - protein, 9 aa, Homo Sapiens
NNRSWISTT

SEQ ID NO: 712721 - protein, 9 aa, Homo Sapiens
SEQSLSPQS

SEQ ID NO: 712722 - protein, 9 aa, Homo Sapiens
TISSTMSCL

SEQ ID NO: 712723 - protein, 9 aa, Homo Sapiens
IFTLNGLMM

SEQ ID NO: 712724 - protein, 9 aa, Homo Sapiens
RIGRIRRLI

SEQ ID NO: 712725 - protein, 9 aa, Homo Sapiens
HDEEANNDI

SEQ ID NO: 712726 - protein, 9 aa, Homo Sapiens
LALYTCSGW

SEQ ID NO: 712727 - protein, 9 aa, Homo Sapiens
LTLDWAEDN

SEQ ID NO: 712728 - protein, 9 aa, Homo Sapiens
AAQRAVGVA

SEQ ID NO: 712729 - protein, 9 aa, Homo Sapiens
CTLVRSAGC

SEQ ID NO: 712730 - protein, 9 aa, Homo Sapiens
DLEKLQHLL

SEQ ID NO: 712731 - protein, 9 aa, Homo Sapiens
TLAQKLTLD

SEQ ID NO: 712732 - protein, 9 aa, Homo Sapiens
FSYYDSLKA

SEQ ID NO: 712733 - protein, 9 aa, Homo Sapiens
SSIQSLQDI

SEQ ID NO: 712734 - protein, 9 aa, Homo Sapiens
GAVIMNANE

SEQ ID NO: 712735 - protein, 9 aa, Homo Sapiens
IGKDPAPLN

SEQ ID NO: 712736 - protein, 9 aa, Homo Sapiens
CPHANHSLL

SEQ ID NO: 712737 - protein, 9 aa, Homo Sapiens
DREEQAYHT

SEQ ID NO: 712738 - protein, 9 aa, Homo Sapiens
KVAFSTISL

SEQ ID NO: 712739 - protein, 9 aa, Homo Sapiens
GMTGMVGSL

SEQ ID NO: 712740 - protein, 9 aa, Homo Sapiens
RHQGRIMYV

SEQ ID NO: 712741 - protein, 9 aa, Homo Sapiens
PHANHSLLV

SEQ ID NO: 712742 - protein, 9 aa, Homo Sapiens
TTLCPHFNP

SEQ ID NO: 712743 - protein, 9 aa, Homo Sapiens
DQYGGIRSD

SEQ ID NO: 712744 - protein, 9 aa, Homo Sapiens
QYPELQRFL

SEQ ID NO: 712745 - protein, 9 aa, Homo Sapiens
TKKVKLEVK

SEQ ID NO: 712746 - protein, 9 aa, Homo Sapiens
LGEAVRIRT

SEQ ID NO: 712747 - protein, 9 aa, Homo Sapiens
AMCDLFHHQ

SEQ ID NO: 712748 - protein, 9 aa, Homo Sapiens
PLSQLRMDP

SEQ ID NO: 712749 - protein, 9 aa, Homo Sapiens
VAAPDVIVP

SEQ ID NO: 712750 - protein, 9 aa, Homo Sapiens
PSRMASYPP

SEQ ID NO: 712751 - protein, 9 aa, Homo Sapiens
SLNALGCNF

SEQ ID NO: 712752 - protein, 9 aa, Homo Sapiens
PQKLDSEAN

SEQ ID NO: 712753 - protein, 9 aa, Homo Sapiens
DRADIKQYN

SEQ ID NO: 712754 - protein, 9 aa, Homo Sapiens
CLASYLADA

SEQ ID NO: 712755 - protein, 9 aa, Homo Sapiens
VSHLHPEIP

SEQ ID NO: 712756 - protein, 9 aa, Homo Sapiens
NRVNTIPQT

SEQ ID NO: 712757 - protein, 9 aa, Homo Sapiens
SEEAVQFIS

SEQ ID NO: 712758 - protein, 9 aa, Homo Sapiens
TKGALSLQG

SEQ ID NO: 712759 - protein, 9 aa, Homo Sapiens
AKKSSEISL

SEQ ID NO: 712760 - protein, 9 aa, Homo Sapiens
PSVGSCWTT

SEQ ID NO: 712761 - protein, 9 aa, Homo Sapiens
HTTMYFFLT

SEQ ID NO: 712762 - protein, 9 aa, Homo Sapiens
VNSIHVESV

SEQ ID NO: 712763 - protein, 9 aa, Homo Sapiens
PPMLSASDP

SEQ ID NO: 712764 - protein, 9 aa, Homo Sapiens
WVPPEDTVP

SEQ ID NO: 712765 - protein, 9 aa, Homo Sapiens
CSGAAPAVE

SEQ ID NO: 712766 - protein, 9 aa, Homo Sapiens
LEYHILGHT

SEQ ID NO: 712767 - protein, 9 aa, Homo Sapiens
GVFRRDGHK

SEQ ID NO: 712768 - protein, 9 aa, Homo Sapiens
IKSFYVQRC

SEQ ID NO: 712769 - protein, 9 aa, Homo Sapiens
MLSASDPSL

SEQ ID NO: 712770 - protein, 9 aa, Homo Sapiens
ALHTISYIA

SEQ ID NO: 712771 - protein, 9 aa, Homo Sapiens
DLAGRYLTD

SEQ ID NO: 712772 - protein, 9 aa, Homo Sapiens
LAGATGSGG

SEQ ID NO: 712773 - protein, 9 aa, Homo Sapiens
TDMGLTLTT

SEQ ID NO: 712774 - protein, 9 aa, Homo Sapiens
QKNISKMAE

SEQ ID NO: 712775 - protein, 9 aa, Homo Sapiens
QRMPLLLNH

SEQ ID NO: 712776 - protein, 9 aa, Homo Sapiens
VSVENIMCP

SEQ ID NO: 712777 - protein, 9 aa, Homo Sapiens
QVGPTEESY

SEQ ID NO: 712778 - protein, 9 aa, Homo Sapiens
QRYNRVNTI

SEQ ID NO: 712779 - protein, 9 aa, Homo Sapiens
FQEIVTFKD

SEQ ID NO: 712780 - protein, 9 aa, Homo Sapiens
KQGQEFLFA

SEQ ID NO: 712781 - protein, 9 aa, Homo Sapiens
ENRYRDISP

SEQ ID NO: 712782 - protein, 9 aa, Homo Sapiens
GRFPLRPGD

SEQ ID NO: 712783 - protein, 9 aa, Homo Sapiens
YVFFAAKTL

SEQ ID NO: 712784 - protein, 9 aa, Homo Sapiens
PPRRARGPQ

SEQ ID NO: 712785 - protein, 9 aa, Homo Sapiens
ETLVNVKLW

SEQ ID NO: 712786 - protein, 9 aa, Homo Sapiens
PEDTVPLMT

SEQ ID NO: 712787 - protein, 9 aa, Homo Sapiens
DDDKPFQQK

SEQ ID NO: 712788 - protein, 9 aa, Homo Sapiens
ARIGRIRRL

SEQ ID NO: 712789 - protein, 9 aa, Homo Sapiens
GGNPPSRMA

SEQ ID NO: 712790 - protein, 9 aa, Homo Sapiens
VGSLLEDLK

SEQ ID NO: 712791 - protein, 9 aa, Homo Sapiens
ESPGKNIFF

SEQ ID NO: 712792 - protein, 9 aa, Homo Sapiens
RALQLLEEV

SEQ ID NO: 712793 - protein, 9 aa, Homo Sapiens
DQGPVVRTG

SEQ ID NO: 712794 - protein, 9 aa, Homo Sapiens
DTFTHPHET

SEQ ID NO: 712795 - protein, 9 aa, Homo Sapiens
QTGWASAKQ

SEQ ID NO: 712796 - protein, 9 aa, Homo Sapiens
GQKIHINKE

SEQ ID NO: 712797 - protein, 9 aa, Homo Sapiens
EAEAGAVIM

SEQ ID NO: 712798 - protein, 9 aa, Homo Sapiens
CDRCMVTHE

SEQ ID NO: 712799 - protein, 9 aa, Homo Sapiens
HAQSKAHKR

SEQ ID NO: 712800 - protein, 9 aa, Homo Sapiens
LEEPIPAFS

SEQ ID NO: 712801 - protein, 9 aa, Homo Sapiens
YTELREALV

SEQ ID NO: 712802 - protein, 9 aa, Homo Sapiens
VASEMMVSL

SEQ ID NO: 712803 - protein, 9 aa, Homo Sapiens
RIDLSKYKE

SEQ ID NO: 712804 - protein, 9 aa, Homo Sapiens
YRYQQVAVG

SEQ ID NO: 712805 - protein, 9 aa, Homo Sapiens
IDLSKYKEN

SEQ ID NO: 712806 - protein, 9 aa, Homo Sapiens
LNSFFNVEC

SEQ ID NO: 712807 - protein, 9 aa, Homo Sapiens
LSMLALTDM

SEQ ID NO: 712808 - protein, 9 aa, Homo Sapiens
FETFDVDEC

SEQ ID NO: 712809 - protein, 9 aa, Homo Sapiens
NVECCVSGT

SEQ ID NO: 712810 - protein, 9 aa, Homo Sapiens
EDQPFVQYN

SEQ ID NO: 712811 - protein, 9 aa, Homo Sapiens
MPLLLNHKL

SEQ ID NO: 712812 - protein, 9 aa, Homo Sapiens
TRPVDLEKL

SEQ ID NO: 712813 - protein, 9 aa, Homo Sapiens
LLEEVLHTM

SEQ ID NO: 712814 - protein, 9 aa, Homo Sapiens
ALAQGGMRI

SEQ ID NO: 712815 - protein, 9 aa, Homo Sapiens
YLIVPKSFQ

SEQ ID NO: 712816 - protein, 9 aa, Homo Sapiens
TEPKHSQSP

SEQ ID NO: 712817 - protein, 9 aa, Homo Sapiens
SKYKENFPA

SEQ ID NO: 712818 - protein, 9 aa, Homo Sapiens
PQNISENRY

SEQ ID NO: 712819 - protein, 9 aa, Homo Sapiens
MKPYKCDEC

SEQ ID NO: 712820 - protein, 9 aa, Homo Sapiens
VINILAYDE

SEQ ID NO: 712821 - protein, 9 aa, Homo Sapiens
TPETGSDEA

SEQ ID NO: 712822 - protein, 9 aa, Homo Sapiens
QGPLGPDAD

SEQ ID NO: 712823 - protein, 9 aa, Homo Sapiens
RYQQVAVGN

SEQ ID NO: 712824 - protein, 9 aa, Homo Sapiens
AGMKPYKCD

SEQ ID NO: 712825 - protein, 9 aa, Homo Sapiens
TTNRTPEAA

SEQ ID NO: 712826 - protein, 9 aa, Homo Sapiens
ADEFFIPLE

SEQ ID NO: 712827 - protein, 9 aa, Homo Sapiens
PVPRASLSP

SEQ ID NO: 712828 - protein, 9 aa, Homo Sapiens
DTGCALRVP

SEQ ID NO: 712829 - protein, 9 aa, Homo Sapiens
EKAGKDAPV

SEQ ID NO: 712830 - protein, 9 aa, Homo Sapiens
KPKNEKLIS

SEQ ID NO: 712831 - protein, 9 aa, Homo Sapiens
RPYLCQACG

SEQ ID NO: 712832 - protein, 9 aa, Homo Sapiens
SLYLSPCYD

SEQ ID NO: 712833 - protein, 9 aa, Homo Sapiens
DQPFVQYNC

SEQ ID NO: 712834 - protein, 9 aa, Homo Sapiens
NEERQSEGS

SEQ ID NO: 712835 - protein, 9 aa, Homo Sapiens
WWKPAQCPK

SEQ ID NO: 712836 - protein, 9 aa, Homo Sapiens
IARSADSKP

SEQ ID NO: 712837 - protein, 9 aa, Homo Sapiens
DALLGSAQS

SEQ ID NO: 712838 - protein, 9 aa, Homo Sapiens
LGGTPIRGA

SEQ ID NO: 712839 - protein, 9 aa, Homo Sapiens
RFDATLAIV

SEQ ID NO: 712840 - protein, 9 aa, Homo Sapiens
SLSPQSPQN

SEQ ID NO: 712841 - protein, 9 aa, Homo Sapiens
AGKDAPVKG

SEQ ID NO: 712842 - protein, 9 aa, Homo Sapiens
KASANNESS

SEQ ID NO: 712843 - protein, 9 aa, Homo Sapiens
CGPEGSRAA

SEQ ID NO: 712844 - protein, 9 aa, Homo Sapiens
KPAVSPHAG

SEQ ID NO: 712845 - protein, 9 aa, Homo Sapiens
IFAYEYIKE

SEQ ID NO: 712846 - protein, 9 aa, Homo Sapiens
LPQNISENR

SEQ ID NO: 712847 - protein, 9 aa, Homo Sapiens
SGNWEVINI

SEQ ID NO: 712848 - protein, 9 aa, Homo Sapiens
VTHELARKR

SEQ ID NO: 712849 - protein, 9 aa, Homo Sapiens
TSSVRPVVK

SEQ ID NO: 712850 - protein, 9 aa, Homo Sapiens
FVFFSLSSS

SEQ ID NO: 712851 - protein, 9 aa, Homo Sapiens
HTGKKTYKC

SEQ ID NO: 712852 - protein, 9 aa, Homo Sapiens
DLSKYKENF

SEQ ID NO: 712853 - protein, 9 aa, Homo Sapiens
VQVPLRFCL

SEQ ID NO: 712854 - protein, 9 aa, Homo Sapiens
LNHKLLSLE

SEQ ID NO: 712855 - protein, 9 aa, Homo Sapiens
EPSKRWPPP

SEQ ID NO: 712856 - protein, 9 aa, Homo Sapiens
RPGDSEARA

SEQ ID NO: 712857 - protein, 9 aa, Homo Sapiens
WPPPVPRAS

SEQ ID NO: 712858 - protein, 9 aa, Homo Sapiens
RWPPPVPRA

SEQ ID NO: 712859 - protein, 9 aa, Homo Sapiens
FQQKNISKM

SEQ ID NO: 712860 - protein, 9 aa, Homo Sapiens
KKGWGLGAS

SEQ ID NO: 712861 - protein, 9 aa, Homo Sapiens
SLSPVSRPA

SEQ ID NO: 712862 - protein, 9 aa, Homo Sapiens
AVGVAPGSS

SEQ ID NO: 712863 - protein, 9 aa, Homo Sapiens
IASESPGKN

SEQ ID NO: 712864 - protein, 9 aa, Homo Sapiens
LTLRTGWQY

SEQ ID NO: 712865 - protein, 9 aa, Homo Sapiens
AATVFSICS

SEQ ID NO: 712866 - protein, 9 aa, Homo Sapiens
SAFQEGTKK

SEQ ID NO: 712867 - protein, 9 aa, Homo Sapiens
TVFSICSLW

SEQ ID NO: 712868 - protein, 9 aa, Homo Sapiens
PEIPKPRVS

SEQ ID NO: 712869 - protein, 9 aa, Homo Sapiens
LALMATEAV

SEQ ID NO: 712870 - protein, 9 aa, Homo Sapiens
CKQEPGAGL

SEQ ID NO: 712871 - protein, 9 aa, Homo Sapiens
DDRISCLFM

SEQ ID NO: 712872 - protein, 9 aa, Homo Sapiens
MRRDLEQLM

SEQ ID NO: 712873 - protein, 9 aa, Homo Sapiens
EDYEEHEGG

SEQ ID NO: 712874 - protein, 9 aa, Homo Sapiens
YNCYYHGYV

SEQ ID NO: 712875 - protein, 9 aa, Homo Sapiens
LHSKHHIIQ

SEQ ID NO: 712876 - protein, 9 aa, Homo Sapiens
KKQQSIARS

SEQ ID NO: 712877 - protein, 9 aa, Homo Sapiens
SKRWPPPVP

SEQ ID NO: 712878 - protein, 9 aa, Homo Sapiens
VSGRFPLRP

SEQ ID NO: 712879 - protein, 9 aa, Homo Sapiens
LNKLLTFSY

SEQ ID NO: 712880 - protein, 9 aa, Homo Sapiens
NQVASEMMV

SEQ ID NO: 712881 - protein, 9 aa, Homo Sapiens
EQLELQEKP

SEQ ID NO: 712882 - protein, 9 aa, Homo Sapiens
EQAKKSSEI

SEQ ID NO: 712883 - protein, 9 aa, Homo Sapiens
PRASPALSP

SEQ ID NO: 712884 - protein, 9 aa, Homo Sapiens
KAQQEMPGE

SEQ ID NO: 712885 - protein, 9 aa, Homo Sapiens
AELLHISPE

SEQ ID NO: 712886 - protein, 9 aa, Homo Sapiens
SIIDVASEQ

SEQ ID NO: 712887 - protein, 9 aa, Homo Sapiens
LAPAPWGTA

SEQ ID NO: 712888 - protein, 9 aa, Homo Sapiens
LRHRPPNAT

SEQ ID NO: 712889 - protein, 9 aa, Homo Sapiens
PRRARGPQS

SEQ ID NO: 712890 - protein, 9 aa, Homo Sapiens
AQANELGKY

SEQ ID NO: 712891 - protein, 9 aa, Homo Sapiens
KYLRHRPPN

SEQ ID NO: 712892 - protein, 9 aa, Homo Sapiens
CSHSCGPEG

SEQ ID NO: 712893 - protein, 9 aa, Homo Sapiens
TTMYFFLTN

SEQ ID NO: 712894 - protein, 9 aa, Homo Sapiens
SEMMVSLMK

SEQ ID NO: 712895 - protein, 9 aa, Homo Sapiens
GAAPAVEMD

SEQ ID NO: 712896 - protein, 9 aa, Homo Sapiens
SQTAGRTIQ

SEQ ID NO: 712897 - protein, 9 aa, Homo Sapiens
EEQAYHTLR

SEQ ID NO: 712898 - protein, 9 aa, Homo Sapiens
TGCALRVPL

SEQ ID NO: 712899 - protein, 9 aa, Homo Sapiens
VTENLVLDS

SEQ ID NO: 712900 - protein, 9 aa, Homo Sapiens
YHRQRCQLS

SEQ ID NO: 712901 - protein, 9 aa, Homo Sapiens
ASANNESSN

SEQ ID NO: 712902 - protein, 9 aa, Homo Sapiens
AEVAAKAWD

SEQ ID NO: 712903 - protein, 9 aa, Homo Sapiens
SPRITPLSQ

SEQ ID NO: 712904 - protein, 9 aa, Homo Sapiens
SLQDISKQT

SEQ ID NO: 712905 - protein, 9 aa, Homo Sapiens
CRGSASGAP

SEQ ID NO: 712906 - protein, 9 aa, Homo Sapiens
MATEAVARG

SEQ ID NO: 712907 - protein, 9 aa, Homo Sapiens
LRPRAGPPS

SEQ ID NO: 712908 - protein, 9 aa, Homo Sapiens
SSEISLKEF

SEQ ID NO: 712909 - protein, 9 aa, Homo Sapiens
IRLFGLISA

SEQ ID NO: 712910 - protein, 9 aa, Homo Sapiens
MPNLSVPIT

SEQ ID NO: 712911 - protein, 9 aa, Homo Sapiens
HYVLTLLAT

SEQ ID NO: 712912 - protein, 9 aa, Homo Sapiens
ALAPAPWGT

SEQ ID NO: 712913 - protein, 9 aa, Homo Sapiens
EKTGFVRSK

SEQ ID NO: 712914 - protein, 9 aa, Homo Sapiens
GMKPYKCDE

SEQ ID NO: 712915 - protein, 9 aa, Homo Sapiens
LHMLQDCYG

SEQ ID NO: 712916 - protein, 9 aa, Homo Sapiens
SMLERHVVP

SEQ ID NO: 712917 - protein, 9 aa, Homo Sapiens
FAYEYIKEV

SEQ ID NO: 712918 - protein, 9 aa, Homo Sapiens
FDLWTNKQG

SEQ ID NO: 712919 - protein, 9 aa, Homo Sapiens
SGADDPRAK

SEQ ID NO: 712920 - protein, 9 aa, Homo Sapiens
STPSWSSLG

SEQ ID NO: 712921 - protein, 9 aa, Homo Sapiens
PTTLCPHFN

SEQ ID NO: 712922 - protein, 9 aa, Homo Sapiens
VETLVNVKL

SEQ ID NO: 712923 - protein, 9 aa, Homo Sapiens
TGCECSHLG

SEQ ID NO: 712924 - protein, 9 aa, Homo Sapiens
SATSNDSPK

SEQ ID NO: 712925 - protein, 9 aa, Homo Sapiens
QVASEMMVS

SEQ ID NO: 712926 - protein, 9 aa, Homo Sapiens
QLLRSSGEE

SEQ ID NO: 712927 - protein, 9 aa, Homo Sapiens
ATEAVARGW

SEQ ID NO: 712928 - protein, 9 aa, Homo Sapiens
TNKYASSST

SEQ ID NO: 712929 - protein, 9 aa, Homo Sapiens
TAWWGKVPR

SEQ ID NO: 712930 - protein, 9 aa, Homo Sapiens
SCLFMITAV

SEQ ID NO: 712931 - protein, 9 aa, Homo Sapiens
TVETLVNVK

SEQ ID NO: 712932 - protein, 9 aa, Homo Sapiens
PLNLYMFRN

SEQ ID NO: 712933 - protein, 9 aa, Homo Sapiens
ANELGKYRV

SEQ ID NO: 712934 - protein, 9 aa, Homo Sapiens
CLFMITAVV

SEQ ID NO: 712935 - protein, 9 aa, Homo Sapiens
EQNLFQTFI

SEQ ID NO: 712936 - protein, 9 aa, Homo Sapiens
AQRAVGVAP

SEQ ID NO: 712937 - protein, 9 aa, Homo Sapiens
HHVDHPGVS

SEQ ID NO: 712938 - protein, 9 aa, Homo Sapiens
RQLRSHWQA

SEQ ID NO: 712939 - protein, 9 aa, Homo Sapiens
VHAWAQKGA

SEQ ID NO: 712940 - protein, 9 aa, Homo Sapiens
RYDIFQYHA

SEQ ID NO: 712941 - protein, 9 aa, Homo Sapiens
QIIHAGMKP

SEQ ID NO: 712942 - protein, 9 aa, Homo Sapiens
HALHTISYI

SEQ ID NO: 712943 - protein, 9 aa, Homo Sapiens
EIVTFKDVA

SEQ ID NO: 712944 - protein, 9 aa, Homo Sapiens
TGRTQARAR

SEQ ID NO: 712945 - protein, 9 aa, Homo Sapiens
LVRSAGCGT

SEQ ID NO: 712946 - protein, 9 aa, Homo Sapiens
FTVQVPLRF

SEQ ID NO: 712947 - protein, 9 aa, Homo Sapiens
GAFSGHFNL

SEQ ID NO: 712948 - protein, 9 aa, Homo Sapiens
LALTDMGLT

SEQ ID NO: 712949 - protein, 9 aa, Homo Sapiens
LPVMPVWLR

SEQ ID NO: 712950 - protein, 9 aa, Homo Sapiens
LSVCYLWGQ

SEQ ID NO: 712951 - protein, 9 aa, Homo Sapiens
GRETRPVGN

SEQ ID NO: 712952 - protein, 9 aa, Homo Sapiens
DCTLVRSAG

SEQ ID NO: 712953 - protein, 9 aa, Homo Sapiens
EFLKEEESD

SEQ ID NO: 712954 - protein, 9 aa, Homo Sapiens
WLHKLGLSA

SEQ ID NO: 712955 - protein, 9 aa, Homo Sapiens
EKPKNEKLI

SEQ ID NO: 712956 - protein, 9 aa, Homo Sapiens
KKLKGKRYL

SEQ ID NO: 712957 - protein, 9 aa, Homo Sapiens
EEGQSTSPD

SEQ ID NO: 712958 - protein, 9 aa, Homo Sapiens
SIDFQVGPT

SEQ ID NO: 712959 - protein, 9 aa, Homo Sapiens
TRPVGNWVP

SEQ ID NO: 712960 - protein, 9 aa, Homo Sapiens
SSCSGAAPA

SEQ ID NO: 712961 - protein, 9 aa, Homo Sapiens
ASEQNLFQT

SEQ ID NO: 712962 - protein, 9 aa, Homo Sapiens
AVRIRTWNI

SEQ ID NO: 712963 - protein, 9 aa, Homo Sapiens
LFHLQDEND

SEQ ID NO: 712964 - protein, 9 aa, Homo Sapiens
LSQLRMDPQ

SEQ ID NO: 712965 - protein, 9 aa, Homo Sapiens
LQTKGALSL

SEQ ID NO: 712966 - protein, 9 aa, Homo Sapiens
THPHETTGD

SEQ ID NO: 712967 - protein, 9 aa, Homo Sapiens
TMSCLASYL

SEQ ID NO: 712968 - protein, 9 aa, Homo Sapiens
TLNGLMMAL

SEQ ID NO: 712969 - protein, 9 aa, Homo Sapiens
LKELKNEEL

SEQ ID NO: 712970 - protein, 9 aa, Homo Sapiens
GLYYSLYEW

SEQ ID NO: 712971 - protein, 9 aa, Homo Sapiens
RPWKVKADI

SEQ ID NO: 712972 - protein, 9 aa, Homo Sapiens
PDKAWAVPD

SEQ ID NO: 712973 - protein, 9 aa, Homo Sapiens
HDPQLIGII

SEQ ID NO: 712974 - protein, 9 aa, Homo Sapiens
QANELGKYR

SEQ ID NO: 712975 - protein, 9 aa, Homo Sapiens
AKEEAGATE

SEQ ID NO: 712976 - protein, 9 aa, Homo Sapiens
AQQEMPGEQ

SEQ ID NO: 712977 - protein, 9 aa, Homo Sapiens
IQYFEGLQN

SEQ ID NO: 712978 - protein, 9 aa, Homo Sapiens
TKAKTRPLP

SEQ ID NO: 712979 - protein, 9 aa, Homo Sapiens
IAQTVLLLP

SEQ ID NO: 712980 - protein, 9 aa, Homo Sapiens
RITPLSQLR

SEQ ID NO: 712981 - protein, 9 aa, Homo Sapiens
SRLVGSSSI

SEQ ID NO: 712982 - protein, 9 aa, Homo Sapiens
SNDSPKILP

SEQ ID NO: 712983 - protein, 9 aa, Homo Sapiens
MLQDCYGDG

SEQ ID NO: 712984 - protein, 9 aa, Homo Sapiens
TTETTHTST

SEQ ID NO: 712985 - protein, 9 aa, Homo Sapiens
MGLTLTTLP

SEQ ID NO: 712986 - protein, 9 aa, Homo Sapiens
ALESQQEWV

SEQ ID NO: 712987 - protein, 9 aa, Homo Sapiens
EKKQQSIAR

SEQ ID NO: 712988 - protein, 9 aa, Homo Sapiens
YVAVIFTLN

SEQ ID NO: 712989 - protein, 9 aa, Homo Sapiens
EWVVREVND

SEQ ID NO: 712990 - protein, 9 aa, Homo Sapiens
LDSRLHTTM

SEQ ID NO: 712991 - protein, 9 aa, Homo Sapiens
QEGGCTGCE

SEQ ID NO: 712992 - protein, 9 aa, Homo Sapiens
VDCGVPYPS

SEQ ID NO: 712993 - protein, 9 aa, Homo Sapiens
KVASAEYHH

SEQ ID NO: 712994 - protein, 9 aa, Homo Sapiens
GRSCKGTVS

SEQ ID NO: 712995 - protein, 9 aa, Homo Sapiens
RALAPAPWG

SEQ ID NO: 712996 - protein, 9 aa, Homo Sapiens
VPPEDTVPL

SEQ ID NO: 712997 - protein, 9 aa, Homo Sapiens
TGQGKGHGD

SEQ ID NO: 712998 - protein, 9 aa, Homo Sapiens
HANHSLLVP

SEQ ID NO: 712999 - protein, 9 aa, Homo Sapiens
VMPVWLRRS

SEQ ID NO: 713000 - protein, 9 aa, Homo Sapiens
PRGDQGPVV

SEQ ID NO: 713001 - protein, 9 aa, Homo Sapiens
QCPKRECQG

SEQ ID NO: 713002 - protein, 9 aa, Homo Sapiens
SYYDSLKAV

SEQ ID NO: 713003 - protein, 9 aa, Homo Sapiens
IHTGKKTYK

SEQ ID NO: 713004 - protein, 9 aa, Homo Sapiens
GNWEVINIL

SEQ ID NO: 713005 - protein, 9 aa, Homo Sapiens
EAAWRGHVE

SEQ ID NO: 713006 - protein, 9 aa, Homo Sapiens
PGPFLRTTL

SEQ ID NO: 713007 - protein, 9 aa, Homo Sapiens
EIPKPRVSS

SEQ ID NO: 713008 - protein, 9 aa, Homo Sapiens
YTCSGWMIA

SEQ ID NO: 713009 - protein, 9 aa, Homo Sapiens
NSFFNVECC

SEQ ID NO: 713010 - protein, 9 aa, Homo Sapiens
EDSEGVPLS

SEQ ID NO: 713011 - protein, 9 aa, Homo Sapiens
WKVKADIPS

SEQ ID NO: 713012 - protein, 9 aa, Homo Sapiens
NFPPEEEEE

SEQ ID NO: 713013 - protein, 9 aa, Homo Sapiens
FTEPKHSQS

SEQ ID NO: 713014 - protein, 9 aa, Homo Sapiens
PRAGPPSPT

SEQ ID NO: 713015 - protein, 9 aa, Homo Sapiens
LLPVMPVWL

SEQ ID NO: 713016 - protein, 9 aa, Homo Sapiens
DEFSCMDCG

SEQ ID NO: 713017 - protein, 9 aa, Homo Sapiens
PDPPHPCEG

SEQ ID NO: 713018 - protein, 9 aa, Homo Sapiens
FTWRLYNEI

SEQ ID NO: 713019 - protein, 9 aa, Homo Sapiens
QGRIMYVGD

SEQ ID NO: 713020 - protein, 9 aa, Homo Sapiens
DLWTNKQGQ

SEQ ID NO: 713021 - protein, 9 aa, Homo Sapiens
MASYPPYPG

SEQ ID NO: 713022 - protein, 9 aa, Homo Sapiens
EHALRSTPS

SEQ ID NO: 713023 - protein, 9 aa, Homo Sapiens
AVQFISKEE

SEQ ID NO: 713024 - protein, 9 aa, Homo Sapiens
AHTYKIYSN

SEQ ID NO: 713025 - protein, 9 aa, Homo Sapiens
SAPAAQHQL

SEQ ID NO: 713026 - protein, 9 aa, Homo Sapiens
FSGHFNLQV

SEQ ID NO: 713027 - protein, 9 aa, Homo Sapiens
IEDRILNHI

SEQ ID NO: 713028 - protein, 9 aa, Homo Sapiens
VSIWPPSPW

SEQ ID NO: 713029 - protein, 9 aa, Homo Sapiens
FYPTDPSQL

SEQ ID NO: 713030 - protein, 9 aa, Homo Sapiens
MLALTDMGL

SEQ ID NO: 713031 - protein, 9 aa, Homo Sapiens
IRISRRGRH

SEQ ID NO: 713032 - protein, 9 aa, Homo Sapiens
RMASYPPYP

SEQ ID NO: 713033 - protein, 9 aa, Homo Sapiens
RASPALSPR

SEQ ID NO: 713034 - protein, 9 aa, Homo Sapiens
TIDQIHREA

SEQ ID NO: 713035 - protein, 9 aa, Homo Sapiens
QLLEEVLHT

SEQ ID NO: 713036 - protein, 9 aa, Homo Sapiens
DIPNFPPEE

SEQ ID NO: 713037 - protein, 9 aa, Homo Sapiens
ELQEKPKNE

SEQ ID NO: 713038 - protein, 9 aa, Homo Sapiens
VENIMCPVY

SEQ ID NO: 713039 - protein, 9 aa, Homo Sapiens
APWGTAGCR

SEQ ID NO: 713040 - protein, 9 aa, Homo Sapiens
VVPHVGGKP

SEQ ID NO: 713041 - protein, 9 aa, Homo Sapiens
KEGICIAHT

SEQ ID NO: 713042 - protein, 9 aa, Homo Sapiens
ISCLFMITA

SEQ ID NO: 713043 - protein, 9 aa, Homo Sapiens
RYLIVPKSF

SEQ ID NO: 713044 - protein, 9 aa, Homo Sapiens
DVDECEHYE

SEQ ID NO: 713045 - protein, 9 aa, Homo Sapiens
YEEHEGGGS

SEQ ID NO: 713046 - protein, 9 aa, Homo Sapiens
IMQNGPVQS

SEQ ID NO: 713047 - protein, 9 aa, Homo Sapiens
AWAVPDSLK

SEQ ID NO: 713048 - protein, 9 aa, Homo Sapiens
ITKTPGMNS

SEQ ID NO: 713049 - protein, 9 aa, Homo Sapiens
RSTPSWSSL

SEQ ID NO: 713050 - protein, 9 aa, Homo Sapiens
IGRIRRLIR

SEQ ID NO: 713051 - protein, 9 aa, Homo Sapiens
LSPQSPQNN

SEQ ID NO: 713052 - protein, 9 aa, Homo Sapiens
GPDNHQGTP

SEQ ID NO: 713053 - protein, 9 aa, Homo Sapiens
KKPAVSPHA

SEQ ID NO: 713054 - protein, 9 aa, Homo Sapiens
VPHVGGKPF

SEQ ID NO: 713055 - protein, 9 aa, Homo Sapiens
NFGGGCREN

SEQ ID NO: 713056 - protein, 9 aa, Homo Sapiens
ANAEPQDLE

SEQ ID NO: 713057 - protein, 9 aa, Homo Sapiens
FTLNGLMMA

SEQ ID NO: 713058 - protein, 9 aa, Homo Sapiens
YPCSVVSVE

SEQ ID NO: 713059 - protein, 9 aa, Homo Sapiens
WELGPRPIH

SEQ ID NO: 713060 - protein, 9 aa, Homo Sapiens
RCQGQSPRI

SEQ ID NO: 713061 - protein, 9 aa, Homo Sapiens
GRYDIFQYH

SEQ ID NO: 713062 - protein, 9 aa, Homo Sapiens
FQVGPTEES

SEQ ID NO: 713063 - protein, 9 aa, Homo Sapiens
KGALSLQGS

SEQ ID NO: 713064 - protein, 9 aa, Homo Sapiens
VECCVSGTH

SEQ ID NO: 713065 - protein, 9 aa, Homo Sapiens
PAPWGTAGC

SEQ ID NO: 713066 - protein, 9 aa, Homo Sapiens
ISDKRNVIL

SEQ ID NO: 713067 - protein, 9 aa, Homo Sapiens
AKLPQNISE

SEQ ID NO: 713068 - protein, 9 aa, Homo Sapiens
CTRTATVET

SEQ ID NO: 713069 - protein, 9 aa, Homo Sapiens
YANQVASEM

SEQ ID NO: 713070 - protein, 9 aa, Homo Sapiens
QAYHTLRAQ

SEQ ID NO: 713071 - protein, 9 aa, Homo Sapiens
ALGCNFETQ

SEQ ID NO: 713072 - protein, 9 aa, Homo Sapiens
CGVPYPSLV

SEQ ID NO: 713073 - protein, 9 aa, Homo Sapiens
MVGSLLEDL

SEQ ID NO: 713074 - protein, 9 aa, Homo Sapiens
YSPRDEEEQ

SEQ ID NO: 713075 - protein, 9 aa, Homo Sapiens
CFPDRNQAA

SEQ ID NO: 713076 - protein, 9 aa, Homo Sapiens
QYSSTSSVR

SEQ ID NO: 713077 - protein, 9 aa, Homo Sapiens
TEAVARGWL

SEQ ID NO: 713078 - protein, 9 aa, Homo Sapiens
DEKNLEEPI

SEQ ID NO: 713079 - protein, 9 aa, Homo Sapiens
QNISENRYR

SEQ ID NO: 713080 - protein, 9 aa, Homo Sapiens
TLDEGLFLH

SEQ ID NO: 713081 - protein, 9 aa, Homo Sapiens
TTLAQKLTL

SEQ ID NO: 713082 - protein, 9 aa, Homo Sapiens
VIVPTLDTV

SEQ ID NO: 713083 - protein, 9 aa, Homo Sapiens
HINKEIEQR

SEQ ID NO: 713084 - protein, 9 aa, Homo Sapiens
TYKIYSNAG

SEQ ID NO: 713085 - protein, 9 aa, Homo Sapiens
KKMSITNPK

SEQ ID NO: 713086 - protein, 9 aa, Homo Sapiens
LLALMATEA

SEQ ID NO: 713087 - protein, 9 aa, Homo Sapiens
LYTCSGWMI

SEQ ID NO: 713088 - protein, 9 aa, Homo Sapiens
LKNEELFTM

SEQ ID NO: 713089 - protein, 9 aa, Homo Sapiens
RCQLSVCYL

SEQ ID NO: 713090 - protein, 9 aa, Homo Sapiens
YMVHAWAQK

SEQ ID NO: 713091 - protein, 9 aa, Homo Sapiens
LLLNHKLLS

SEQ ID NO: 713092 - protein, 9 aa, Homo Sapiens
AVSPHAGRE

SEQ ID NO: 713093 - protein, 9 aa, Homo Sapiens
QSEGSKTSE

SEQ ID NO: 713094 - protein, 9 aa, Homo Sapiens
YLADEFSCM

SEQ ID NO: 713095 - protein, 9 aa, Homo Sapiens
REEQAYHTL

SEQ ID NO: 713096 - protein, 9 aa, Homo Sapiens
TLGEAVRIR

SEQ ID NO: 713097 - protein, 9 aa, Homo Sapiens
SQQEWVVRE

SEQ ID NO: 713098 - protein, 9 aa, Homo Sapiens
SRGVFRRDG

SEQ ID NO: 713099 - protein, 9 aa, Homo Sapiens
EEWGVSPDP

SEQ ID NO: 713100 - protein, 9 aa, Homo Sapiens
KITKTPGMN

SEQ ID NO: 713101 - protein, 9 aa, Homo Sapiens
QCFPDRNQA

SEQ ID NO: 713102 - protein, 9 aa, Homo Sapiens
RPDYSKNFS

SEQ ID NO: 713103 - protein, 9 aa, Homo Sapiens
GRTIQCFPD

SEQ ID NO: 713104 - protein, 9 aa, Homo Sapiens
RKTLWGIQL

SEQ ID NO: 713105 - protein, 9 aa, Homo Sapiens
EEAVQFISK

SEQ ID NO: 713106 - protein, 9 aa, Homo Sapiens
FMDICYTTT

SEQ ID NO: 713107 - protein, 9 aa, Homo Sapiens
RFLFLLCLI

SEQ ID NO: 713108 - protein, 9 aa, Homo Sapiens
SVGAKASAN

SEQ ID NO: 713109 - protein, 9 aa, Homo Sapiens
SCMDCGSGQ

SEQ ID NO: 713110 - protein, 9 aa, Homo Sapiens
DLFHHQTGW

SEQ ID NO: 713111 - protein, 9 aa, Homo Sapiens
RHRPPNATL

SEQ ID NO: 713112 - protein, 9 aa, Homo Sapiens
SRLHTTMYF

SEQ ID NO: 713113 - protein, 9 aa, Homo Sapiens
ITLHDEEAN

SEQ ID NO: 713114 - protein, 9 aa, Homo Sapiens
LIASESPGK

SEQ ID NO: 713115 - protein, 9 aa, Homo Sapiens
LITTRPVDL

SEQ ID NO: 713116 - protein, 9 aa, Homo Sapiens
SSTYLYWCK

SEQ ID NO: 713117 - protein, 9 aa, Homo Sapiens
EKKKAGREQ

SEQ ID NO: 713118 - protein, 9 aa, Homo Sapiens
QFTKAKTRP

SEQ ID NO: 713119 - protein, 9 aa, Homo Sapiens
PCASEQSLS

SEQ ID NO: 713120 - protein, 9 aa, Homo Sapiens
VCLGQKIHI

SEQ ID NO: 713121 - protein, 9 aa, Homo Sapiens
PELQEEKPS

SEQ ID NO: 713122 - protein, 9 aa, Homo Sapiens
VNTIPQTRS

SEQ ID NO: 713123 - protein, 9 aa, Homo Sapiens
QLSVCYLWG

SEQ ID NO: 713124 - protein, 9 aa, Homo Sapiens
KVTENLVLD

SEQ ID NO: 713125 - protein, 9 aa, Homo Sapiens
HSELKECLK

SEQ ID NO: 713126 - protein, 9 aa, Homo Sapiens
ANQVASEMM

SEQ ID NO: 713127 - protein, 9 aa, Homo Sapiens
CRPWKVKAD

SEQ ID NO: 713128 - protein, 9 aa, Homo Sapiens
VTLLTLAGA

SEQ ID NO: 713129 - protein, 9 aa, Homo Sapiens
PVQSIMQVR

SEQ ID NO: 713130 - protein, 9 aa, Homo Sapiens
WSNDNFQQL

SEQ ID NO: 713131 - protein, 9 aa, Homo Sapiens
ATKADDRGS

SEQ ID NO: 713132 - protein, 9 aa, Homo Sapiens
PEGSRAASG

SEQ ID NO: 713133 - protein, 9 aa, Homo Sapiens
LRPDYSKNF

SEQ ID NO: 713134 - protein, 9 aa, Homo Sapiens
LEKKVESSR

SEQ ID NO: 713135 - protein, 9 aa, Homo Sapiens
REYVCRKGD

SEQ ID NO: 713136 - protein, 9 aa, Homo Sapiens
VEIKSFYVQ

SEQ ID NO: 713137 - protein, 9 aa, Homo Sapiens
FQTQYPGQP

SEQ ID NO: 713138 - protein, 9 aa, Homo Sapiens
MVTHELARK

SEQ ID NO: 713139 - protein, 9 aa, Homo Sapiens
NEELFTMKL

SEQ ID NO: 713140 - protein, 9 aa, Homo Sapiens
GRYLTDYLM

SEQ ID NO: 713141 - protein, 9 aa, Homo Sapiens
GKDPAPLNL

SEQ ID NO: 713142 - protein, 9 aa, Homo Sapiens
MWLHKLGLS

SEQ ID NO: 713143 - protein, 9 aa, Homo Sapiens
VHITLHDEE

SEQ ID NO: 713144 - protein, 9 aa, Homo Sapiens
LCPHFNPCN

SEQ ID NO: 713145 - protein, 9 aa, Homo Sapiens
SRAASGPPR

SEQ ID NO: 713146 - protein, 9 aa, Homo Sapiens
AGRYLTDYL

SEQ ID NO: 713147 - protein, 9 aa, Homo Sapiens
NHILYYLPQ

SEQ ID NO: 713148 - protein, 9 aa, Homo Sapiens
RSLLAFVFF

SEQ ID NO: 713149 - protein, 9 aa, Homo Sapiens
ITPLSQLRM

SEQ ID NO: 713150 - protein, 9 aa, Homo Sapiens
VGRSSPRAS

SEQ ID NO: 713151 - protein, 9 aa, Homo Sapiens
AAQHQLPQP

SEQ ID NO: 713152 - protein, 9 aa, Homo Sapiens
GNQIISDKR

SEQ ID NO: 713153 - protein, 9 aa, Homo Sapiens
RRDGHKSEV

SEQ ID NO: 713154 - protein, 9 aa, Homo Sapiens
VPIVSVLAL

SEQ ID NO: 713155 - protein, 9 aa, Homo Sapiens
ALRLRPDYS

SEQ ID NO: 713156 - protein, 9 aa, Homo Sapiens
TNKQGQEFL

SEQ ID NO: 713157 - protein, 9 aa, Homo Sapiens
EERQSEGSK

SEQ ID NO: 713158 - protein, 9 aa, Homo Sapiens
RKDALLGSA

SEQ ID NO: 713159 - protein, 9 aa, Homo Sapiens
FKMLPDTFT

SEQ ID NO: 713160 - protein, 9 aa, Homo Sapiens
GKKTYKCEE

SEQ ID NO: 713161 - protein, 9 aa, Homo Sapiens
ATVFSICSL

SEQ ID NO: 713162 - protein, 9 aa, Homo Sapiens
QQEWVVREV

SEQ ID NO: 713163 - protein, 9 aa, Homo Sapiens
THELARKRQ

SEQ ID NO: 713164 - protein, 9 aa, Homo Sapiens
QIHREAEME

SEQ ID NO: 713165 - protein, 9 aa, Homo Sapiens
IVSEKWVPE

SEQ ID NO: 713166 - protein, 9 aa, Homo Sapiens
VQRYNRVNT

SEQ ID NO: 713167 - protein, 9 aa, Homo Sapiens
DISKQTEIP

SEQ ID NO: 713168 - protein, 9 aa, Homo Sapiens
VCTWTAAAT

SEQ ID NO: 713169 - protein, 9 aa, Homo Sapiens
LHTISYIAD

SEQ ID NO: 713170 - protein, 9 aa, Homo Sapiens
QIQYFEGLQ

SEQ ID NO: 713171 - protein, 9 aa, Homo Sapiens
ELGKYRVML

SEQ ID NO: 713172 - protein, 9 aa, Homo Sapiens
VPLLGSLST

SEQ ID NO: 713173 - protein, 9 aa, Homo Sapiens
RYNRVNTIP

SEQ ID NO: 713174 - protein, 9 aa, Homo Sapiens
LPDTFTHPH

SEQ ID NO: 713175 - protein, 9 aa, Homo Sapiens
CCSEDEEDY

SEQ ID NO: 713176 - protein, 9 aa, Homo Sapiens
LGHSELKEC

SEQ ID NO: 713177 - protein, 9 aa, Homo Sapiens
EAGATEADE

SEQ ID NO: 713178 - protein, 9 aa, Homo Sapiens
KQLRSESLG

SEQ ID NO: 713179 - protein, 9 aa, Homo Sapiens
EDTVPLMTK

SEQ ID NO: 713180 - protein, 9 aa, Homo Sapiens
HQTGWASAK

SEQ ID NO: 713181 - protein, 9 aa, Homo Sapiens
TLIAEDDRL

SEQ ID NO: 713182 - protein, 9 aa, Homo Sapiens
IRPDPPHPC

SEQ ID NO: 713183 - protein, 9 aa, Homo Sapiens
FTGQGKGHG

SEQ ID NO: 713184 - protein, 9 aa, Homo Sapiens
RLYNIPVRV

SEQ ID NO: 713185 - protein, 9 aa, Homo Sapiens
PGTRGPEGA

SEQ ID NO: 713186 - protein, 9 aa, Homo Sapiens
PELQRFLFL

SEQ ID NO: 713187 - protein, 9 aa, Homo Sapiens
ASESPGKNI

SEQ ID NO: 713188 - protein, 9 aa, Homo Sapiens
STSETNFDC

SEQ ID NO: 713189 - protein, 9 aa, Homo Sapiens
VFEFTEPKH

SEQ ID NO: 713190 - protein, 9 aa, Homo Sapiens
GHILALYTC

SEQ ID NO: 713191 - protein, 9 aa, Homo Sapiens
KLPQNISEN

SEQ ID NO: 713192 - protein, 9 aa, Homo Sapiens
IQCFPDRNQ

SEQ ID NO: 713193 - protein, 9 aa, Homo Sapiens
TAIWEQHAV

SEQ ID NO: 713194 - protein, 9 aa, Homo Sapiens
YLWGQSNRK

SEQ ID NO: 713195 - protein, 9 aa, Homo Sapiens
LLTFSYYDS

SEQ ID NO: 713196 - protein, 9 aa, Homo Sapiens
SEDEEDYEE

SEQ ID NO: 713197 - protein, 9 aa, Homo Sapiens
CLGQKIHIN

SEQ ID NO: 713198 - protein, 9 aa, Homo Sapiens
GAKASANNE

SEQ ID NO: 713199 - protein, 9 aa, Homo Sapiens
VLEGQTICV

SEQ ID NO: 713200 - protein, 9 aa, Homo Sapiens
YLRHRPPNA

SEQ ID NO: 713201 - protein, 9 aa, Homo Sapiens
LNHILYYLP

SEQ ID NO: 713202 - protein, 9 aa, Homo Sapiens
PPNFGGGCR

SEQ ID NO: 713203 - protein, 9 aa, Homo Sapiens
LYNIPVRVC

SEQ ID NO: 713204 - protein, 9 aa, Homo Sapiens
FWELGPRPI

SEQ ID NO: 713205 - protein, 9 aa, Homo Sapiens
AYHTLRAQA

SEQ ID NO: 713206 - protein, 9 aa, Homo Sapiens
QEMPGEQGF

SEQ ID NO: 713207 - protein, 9 aa, Homo Sapiens
REEQEKKKA

SEQ ID NO: 713208 - protein, 9 aa, Homo Sapiens
NSGKLYALD

SEQ ID NO: 713209 - protein, 9 aa, Homo Sapiens
AGKKPAVSP

SEQ ID NO: 713210 - protein, 9 aa, Homo Sapiens
RSGADDPRA

SEQ ID NO: 713211 - protein, 9 aa, Homo Sapiens
WEVINILAY

SEQ ID NO: 713212 - protein, 9 aa, Homo Sapiens
AFQEGTKKS

SEQ ID NO: 713213 - protein, 9 aa, Homo Sapiens
RTATVETLV

SEQ ID NO: 713214 - protein, 9 aa, Homo Sapiens
PYPSLVNYA

SEQ ID NO: 713215 - protein, 9 aa, Homo Sapiens
SGAAPAVEM

SEQ ID NO: 713216 - protein, 9 aa, Homo Sapiens
GNVRFDATL

SEQ ID NO: 713217 - protein, 9 aa, Homo Sapiens
HATNGSASS

SEQ ID NO: 713218 - protein, 9 aa, Homo Sapiens
FVQYNCYYH

SEQ ID NO: 713219 - protein, 9 aa, Homo Sapiens
GEKQLLRSS

SEQ ID NO: 713220 - protein, 9 aa, Homo Sapiens
PVDCGVPYP

SEQ ID NO: 713221 - protein, 9 aa, Homo Sapiens
HRIFQAHCS

SEQ ID NO: 713222 - protein, 9 aa, Homo Sapiens
QAFFSPWTV

SEQ ID NO: 713223 - protein, 9 aa, Homo Sapiens
EKNLEEPIP

SEQ ID NO: 713224 - protein, 9 aa, Homo Sapiens
SLITNSGKL

SEQ ID NO: 713225 - protein, 9 aa, Homo Sapiens
DLDKLHRTA

SEQ ID NO: 713226 - protein, 9 aa, Homo Sapiens
HSQEAAATV

SEQ ID NO: 713227 - protein, 9 aa, Homo Sapiens
DYSTPTTNR

SEQ ID NO: 713228 - protein, 9 aa, Homo Sapiens
RETRPVGNW

SEQ ID NO: 713229 - protein, 9 aa, Homo Sapiens
HQGRIMYVG

SEQ ID NO: 713230 - protein, 9 aa, Homo Sapiens
QSRLVGSSS

SEQ ID NO: 713231 - protein, 9 aa, Homo Sapiens
GKVTENLVL

SEQ ID NO: 713232 - protein, 9 aa, Homo Sapiens
SGEEPSKRW

SEQ ID NO: 713233 - protein, 9 aa, Homo Sapiens
YLIASESPG

SEQ ID NO: 713234 - protein, 9 aa, Homo Sapiens
YVLTLLATA

SEQ ID NO: 713235 - protein, 9 aa, Homo Sapiens
IVSVLALEK

SEQ ID NO: 713236 - protein, 9 aa, Homo Sapiens
KLTLDWAED

SEQ ID NO: 713237 - protein, 9 aa, Homo Sapiens
ALRSTPSWS

SEQ ID NO: 713238 - protein, 9 aa, Homo Sapiens
EAVQFISKE

SEQ ID NO: 713239 - protein, 9 aa, Homo Sapiens
SRRGRHTLL

SEQ ID NO: 713240 - protein, 9 aa, Homo Sapiens
VKYENTLIA

SEQ ID NO: 713241 - protein, 9 aa, Homo Sapiens
STSSVRPVV

SEQ ID NO: 713242 - protein, 9 aa, Homo Sapiens
DALESQQEW

SEQ ID NO: 713243 - protein, 9 aa, Homo Sapiens
PQKSWVSIW

SEQ ID NO: 713244 - protein, 9 aa, Homo Sapiens
PAQCPKREC

SEQ ID NO: 713245 - protein, 9 aa, Homo Sapiens
EHYVLTLLA

SEQ ID NO: 713246 - protein, 9 aa, Homo Sapiens
TELREALVS

SEQ ID NO: 713247 - protein, 9 aa, Homo Sapiens
NTTVLFHLQ

SEQ ID NO: 713248 - protein, 9 aa, Homo Sapiens
LVLDSEVAK

SEQ ID NO: 713249 - protein, 9 aa, Homo Sapiens
GDQGPVVRT

SEQ ID NO: 713250 - protein, 9 aa, Homo Sapiens
NWEVINILA

SEQ ID NO: 713251 - protein, 9 aa, Homo Sapiens
RTPEAALSE

SEQ ID NO: 713252 - protein, 9 aa, Homo Sapiens
AAWRGHVEC

SEQ ID NO: 713253 - protein, 9 aa, Homo Sapiens
QEWVVREVN

SEQ ID NO: 713254 - protein, 9 aa, Homo Sapiens
VKFYPTDPS

SEQ ID NO: 713255 - protein, 9 aa, Homo Sapiens
LEPLGEDSV

SEQ ID NO: 713256 - protein, 9 aa, Homo Sapiens
TSGNWEVIN

SEQ ID NO: 713257 - protein, 9 aa, Homo Sapiens
PKNEKLISL

SEQ ID NO: 713258 - protein, 9 aa, Homo Sapiens
IQPETPLHS

SEQ ID NO: 713259 - protein, 9 aa, Homo Sapiens
RSAGCGTGS

SEQ ID NO: 713260 - protein, 9 aa, Homo Sapiens
TWRLYNEIP

SEQ ID NO: 713261 - protein, 9 aa, Homo Sapiens
DWWKPAQCP

SEQ ID NO: 713262 - protein, 9 aa, Homo Sapiens
IFASAIHHV

SEQ ID NO: 713263 - protein, 9 aa, Homo Sapiens
GLIIPDKAW

SEQ ID NO: 713264 - protein, 9 aa, Homo Sapiens
PAVEMDEEL

SEQ ID NO: 713265 - protein, 9 aa, Homo Sapiens
VAWVCFNHP

SEQ ID NO: 713266 - protein, 9 aa, Homo Sapiens
APDVIVPTL

SEQ ID NO: 713267 - protein, 9 aa, Homo Sapiens
YHTLRAQAL

SEQ ID NO: 713268 - protein, 9 aa, Homo Sapiens
RSADSKPID

SEQ ID NO: 713269 - protein, 9 aa, Homo Sapiens
MTKFQEIVT

SEQ ID NO: 713270 - protein, 9 aa, Homo Sapiens
VLNSFFNVE

SEQ ID NO: 713271 - protein, 9 aa, Homo Sapiens
YLSPCYDDA

SEQ ID NO: 713272 - protein, 9 aa, Homo Sapiens
LLAFVFFSL

SEQ ID NO: 713273 - protein, 9 aa, Homo Sapiens
SMVVLDTGC

SEQ ID NO: 713274 - protein, 9 aa, Homo Sapiens
EDDRLYNIP

SEQ ID NO: 713275 - protein, 9 aa, Homo Sapiens
CSEDEEDYE

SEQ ID NO: 713276 - protein, 9 aa, Homo Sapiens
REQSQTAGR

SEQ ID NO: 713277 - protein, 9 aa, Homo Sapiens
DWNEERQSE

SEQ ID NO: 713278 - protein, 9 aa, Homo Sapiens
IPNFPPEEE

SEQ ID NO: 713279 - protein, 9 aa, Homo Sapiens
HVESVAWVC

SEQ ID NO: 713280 - protein, 9 aa, Homo Sapiens
PPVPRASLS

SEQ ID NO: 713281 - protein, 9 aa, Homo Sapiens
SSSICEGTV

SEQ ID NO: 713282 - protein, 9 aa, Homo Sapiens
QSQTAGRTI

SEQ ID NO: 713283 - protein, 9 aa, Homo Sapiens
SVGRSSPRA

SEQ ID NO: 713284 - protein, 9 aa, Homo Sapiens
LTSMVVLDT

SEQ ID NO: 713285 - protein, 9 aa, Homo Sapiens
LPVDCGVPY

SEQ ID NO: 713286 - protein, 9 aa, Homo Sapiens
LEHALRSTP

SEQ ID NO: 713287 - protein, 9 aa, Homo Sapiens
EEVLHTMPI

SEQ ID NO: 713288 - protein, 9 aa, Homo Sapiens
RQEERQHAE

SEQ ID NO: 713289 - protein, 9 aa, Homo Sapiens
ETMMDHALH

SEQ ID NO: 713290 - protein, 9 aa, Homo Sapiens
GTCQSKKGW

SEQ ID NO: 713291 - protein, 9 aa, Homo Sapiens
HSVQSQDTS

SEQ ID NO: 713292 - protein, 9 aa, Homo Sapiens
RHQILQTKG

SEQ ID NO: 713293 - protein, 9 aa, Homo Sapiens
ASPIHEAAW

SEQ ID NO: 713294 - protein, 9 aa, Homo Sapiens
AVIFTLNGL

SEQ ID NO: 713295 - protein, 9 aa, Homo Sapiens
ISAKREPIN

SEQ ID NO: 713296 - protein, 9 aa, Homo Sapiens
AAATVFSIC

SEQ ID NO: 713297 - protein, 9 aa, Homo Sapiens
GHSELKECL

SEQ ID NO: 713298 - protein, 9 aa, Homo Sapiens
PADQQLEFC

SEQ ID NO: 713299 - protein, 9 aa, Homo Sapiens
PSPWAPTVG

SEQ ID NO: 713300 - protein, 9 aa, Homo Sapiens
HPSSTTETT

SEQ ID NO: 713301 - protein, 9 aa, Homo Sapiens
MEYMVHAWA

SEQ ID NO: 713302 - protein, 9 aa, Homo Sapiens
HITLHDEEA

SEQ ID NO: 713303 - protein, 9 aa, Homo Sapiens
WPPSPWAPT

SEQ ID NO: 713304 - protein, 9 aa, Homo Sapiens
EGICIAHTY

SEQ ID NO: 713305 - protein, 9 aa, Homo Sapiens
NDSPKILPD

SEQ ID NO: 713306 - protein, 9 aa, Homo Sapiens
IKQLRSESL

SEQ ID NO: 713307 - protein, 9 aa, Homo Sapiens
RIHHKLLLP

SEQ ID NO: 713308 - protein, 9 aa, Homo Sapiens
FSCMDCGSG

SEQ ID NO: 713309 - protein, 9 aa, Homo Sapiens
PLLLNHKLL

SEQ ID NO: 713310 - protein, 9 aa, Homo Sapiens
DEFFIPLEV

SEQ ID NO: 713311 - protein, 9 aa, Homo Sapiens
NRIHHKLLL

SEQ ID NO: 713312 - protein, 9 aa, Homo Sapiens
DDRLYNIPV

SEQ ID NO: 713313 - protein, 9 aa, Homo Sapiens
AIWEQHAVT

SEQ ID NO: 713314 - protein, 9 aa, Homo Sapiens
PGSVGPKLM

SEQ ID NO: 713315 - protein, 9 aa, Homo Sapiens
MQEEEEEEE

SEQ ID NO: 713316 - protein, 9 aa, Homo Sapiens
LFGLISAKR

SEQ ID NO: 713317 - protein, 9 aa, Homo Sapiens
HTYKIYSNA

SEQ ID NO: 713318 - protein, 9 aa, Homo Sapiens
NKLGHSELK

SEQ ID NO: 713319 - protein, 9 aa, Homo Sapiens
LVLHMLQDC

SEQ ID NO: 713320 - protein, 9 aa, Homo Sapiens
CHTGERPYL

SEQ ID NO: 713321 - protein, 9 aa, Homo Sapiens
LAFVFFSLS

SEQ ID NO: 713322 - protein, 9 aa, Homo Sapiens
RLEPLGEDS

SEQ ID NO: 713323 - protein, 9 aa, Homo Sapiens
PCSACPPNF

SEQ ID NO: 713324 - protein, 9 aa, Homo Sapiens
EVTIPTRFL

SEQ ID NO: 713325 - protein, 9 aa, Homo Sapiens
QYFEGLQNR

SEQ ID NO: 713326 - protein, 9 aa, Homo Sapiens
DKPFQQKNI

SEQ ID NO: 713327 - protein, 9 aa, Homo Sapiens
IVTFKDVAV

SEQ ID NO: 713328 - protein, 9 aa, Homo Sapiens
KLHDPQLIG

SEQ ID NO: 713329 - protein, 9 aa, Homo Sapiens
DSPKILPDV

SEQ ID NO: 713330 - protein, 9 aa, Homo Sapiens
VVRTGEVGA

SEQ ID NO: 713331 - protein, 9 aa, Homo Sapiens
KDALLGSAQ

SEQ ID NO: 713332 - protein, 9 aa, Homo Sapiens
QLEYHILGH

SEQ ID NO: 713333 - protein, 9 aa, Homo Sapiens
DGHKSEVAH

SEQ ID NO: 713334 - protein, 9 aa, Homo Sapiens
DYSKNFSIQ

SEQ ID NO: 713335 - protein, 9 aa, Homo Sapiens
GTAGCRGSA

SEQ ID NO: 713336 - protein, 9 aa, Homo Sapiens
DLEHYVLTL

SEQ ID NO: 713337 - protein, 9 aa, Homo Sapiens
PRITPLSQL

SEQ ID NO: 713338 - protein, 9 aa, Homo Sapiens
SGRFPLRPG

SEQ ID NO: 713339 - protein, 9 aa, Homo Sapiens
IPKPRVSSL

SEQ ID NO: 713340 - protein, 9 aa, Homo Sapiens
LPFFLEKKV

SEQ ID NO: 713341 - protein, 9 aa, Homo Sapiens
CIIGKGRSC

SEQ ID NO: 713342 - protein, 9 aa, Homo Sapiens
TCTKNTGRT

SEQ ID NO: 713343 - protein, 9 aa, Homo Sapiens
LEDQPFVQY

SEQ ID NO: 713344 - protein, 9 aa, Homo Sapiens
YEYLADEFS

SEQ ID NO: 713345 - protein, 9 aa, Homo Sapiens
GICIAHTYK

SEQ ID NO: 713346 - protein, 9 aa, Homo Sapiens
QSPRITPLS

SEQ ID NO: 713347 - protein, 9 aa, Homo Sapiens
EYIKEVHKR

SEQ ID NO: 713348 - protein, 9 aa, Homo Sapiens
PETGSDEAI

SEQ ID NO: 713349 - protein, 9 aa, Homo Sapiens
RAVGVAPGS

SEQ ID NO: 713350 - protein, 9 aa, Homo Sapiens
DEEANNDIF

SEQ ID NO: 713351 - protein, 9 aa, Homo Sapiens
HVVPHVGGK

SEQ ID NO: 713352 - protein, 9 aa, Homo Sapiens
TRGPEGAMG

SEQ ID NO: 713353 - protein, 9 aa, Homo Sapiens
SVGSCWTTG

SEQ ID NO: 713354 - protein, 9 aa, Homo Sapiens
FYVQRCPED

SEQ ID NO: 713355 - protein, 9 aa, Homo Sapiens
MVVLDTGCA

SEQ ID NO: 713356 - protein, 9 aa, Homo Sapiens
NFQQLRTPH

SEQ ID NO: 713357 - protein, 9 aa, Homo Sapiens
CQIRYHTNK

SEQ ID NO: 713358 - protein, 9 aa, Homo Sapiens
WGTAGCRGS

SEQ ID NO: 713359 - protein, 9 aa, Homo Sapiens
RYTELREAL

SEQ ID NO: 713360 - protein, 9 aa, Homo Sapiens
SLSTAQTQL

SEQ ID NO: 713361 - protein, 9 aa, Homo Sapiens
ESLGGTPIR

SEQ ID NO: 713362 - protein, 9 aa, Homo Sapiens
ADEFSCMDC

SEQ ID NO: 713363 - protein, 9 aa, Homo Sapiens
LRTPHQKPT

SEQ ID NO: 713364 - protein, 9 aa, Homo Sapiens
AFSGHFNLQ

SEQ ID NO: 713365 - protein, 9 aa, Homo Sapiens
YLCQACGKR

SEQ ID NO: 713366 - protein, 9 aa, Homo Sapiens
YHATNGSAS

SEQ ID NO: 713367 - protein, 9 aa, Homo Sapiens
KKAGREQSQ

SEQ ID NO: 713368 - protein, 9 aa, Homo Sapiens
IHVESVAWV

SEQ ID NO: 713369 - protein, 9 aa, Homo Sapiens
IVPTLDTVR

SEQ ID NO: 713370 - protein, 9 aa, Homo Sapiens
QIRYHTNKY

SEQ ID NO: 713371 - protein, 9 aa, Homo Sapiens
VPELQEEKP

SEQ ID NO: 713372 - protein, 9 aa, Homo Sapiens
QLIGIIPRI

SEQ ID NO: 713373 - protein, 9 aa, Homo Sapiens
HRTAWWGKV

SEQ ID NO: 713374 - protein, 9 aa, Homo Sapiens
LGKVTENLV

SEQ ID NO: 713375 - protein, 9 aa, Homo Sapiens
SHSCGPEGS

SEQ ID NO: 713376 - protein, 9 aa, Homo Sapiens
LCQACGKRF

SEQ ID NO: 713377 - protein, 9 aa, Homo Sapiens
YFEGLQNRP

SEQ ID NO: 713378 - protein, 9 aa, Homo Sapiens
NSIHVESVA

SEQ ID NO: 713379 - protein, 9 aa, Homo Sapiens
ITTRPVDLE

SEQ ID NO: 713380 - protein, 9 aa, Homo Sapiens
IDFQVGPTE

SEQ ID NO: 713381 - protein, 9 aa, Homo Sapiens
SVLALEKLS

SEQ ID NO: 713382 - protein, 9 aa, Homo Sapiens
INILAYDET

SEQ ID NO: 713383 - protein, 9 aa, Homo Sapiens
PPPMLSASD

SEQ ID NO: 713384 - protein, 9 aa, Homo Sapiens
IEMEKKVAF

SEQ ID NO: 713385 - protein, 9 aa, Homo Sapiens
AAPAVEMDE

SEQ ID NO: 713386 - protein, 9 aa, Homo Sapiens
EIKSFYVQR

SEQ ID NO: 713387 - protein, 9 aa, Homo Sapiens
TMYFFLTNL

SEQ ID NO: 713388 - protein, 9 aa, Homo Sapiens
EANAEPQDL

SEQ ID NO: 713389 - protein, 9 aa, Homo Sapiens
PQSVGRSSP

SEQ ID NO: 713390 - protein, 9 aa, Homo Sapiens
EEESDPYKF

SEQ ID NO: 713391 - protein, 9 aa, Homo Sapiens
KTTLAQKLT

SEQ ID NO: 713392 - protein, 9 aa, Homo Sapiens
SVRPVVKWQ

SEQ ID NO: 713393 - protein, 9 aa, Homo Sapiens
SSSTYLYWC

SEQ ID NO: 713394 - protein, 9 aa, Homo Sapiens
HVDHPGVSN

SEQ ID NO: 713395 - protein, 9 aa, Homo Sapiens
CPPNFGGGC

SEQ ID NO: 713396 - protein, 9 aa, Homo Sapiens
NIPADQQLE

SEQ ID NO: 713397 - protein, 9 aa, Homo Sapiens
NRTPEAALS

SEQ ID NO: 713398 - protein, 9 aa, Homo Sapiens
TGMVGSLLE

SEQ ID NO: 713399 - protein, 9 aa, Homo Sapiens
DPQKSWVSI

SEQ ID NO: 713400 - protein, 9 aa, Homo Sapiens
SFYVQRCPE

SEQ ID NO: 713401 - protein, 9 aa, Homo Sapiens
MDPQKSWVS

SEQ ID NO: 713402 - protein, 9 aa, Homo Sapiens
PTDPSQLTE

SEQ ID NO: 713403 - protein, 9 aa, Homo Sapiens
PTEESYALL

SEQ ID NO: 713404 - protein, 9 aa, Homo Sapiens
RLRPDYSKN

SEQ ID NO: 713405 - protein, 9 aa, Homo Sapiens
GSRAASGPP

SEQ ID NO: 713406 - protein, 9 aa, Homo Sapiens
SSLQSLNAL

SEQ ID NO: 713407 - protein, 9 aa, Homo Sapiens
TVLRGGGLD

SEQ ID NO: 713408 - protein, 9 aa, Homo Sapiens
KESLITNSG

SEQ ID NO: 713409 - protein, 9 aa, Homo Sapiens
YQQVAVGNV

SEQ ID NO: 713410 - protein, 9 aa, Homo Sapiens
QGPRAHAQS

SEQ ID NO: 713411 - protein, 9 aa, Homo Sapiens
KSFYVQRCP

SEQ ID NO: 713412 - protein, 9 aa, Homo Sapiens
SGWLKMREE

SEQ ID NO: 713413 - protein, 9 aa, Homo Sapiens
NEIPRERRN

SEQ ID NO: 713414 - protein, 9 aa, Homo Sapiens
QYHATNGSA

SEQ ID NO: 713415 - protein, 9 aa, Homo Sapiens
SVENIMCPV

SEQ ID NO: 713416 - protein, 9 aa, Homo Sapiens
PTVGRETRP

SEQ ID NO: 713417 - protein, 9 aa, Homo Sapiens
RRGRHTLLN

SEQ ID NO: 713418 - protein, 9 aa, Homo Sapiens
SSPRASPAL

SEQ ID NO: 713419 - protein, 9 aa, Homo Sapiens
QSYESSTSE

SEQ ID NO: 713420 - protein, 9 aa, Homo Sapiens
DLVPELQEE

SEQ ID NO: 713421 - protein, 9 aa, Homo Sapiens
EDGAFSGHF

SEQ ID NO: 713422 - protein, 9 aa, Homo Sapiens
DEEEQMMEV

SEQ ID NO: 713423 - protein, 9 aa, Homo Sapiens
RISCLFMIT

SEQ ID NO: 713424 - protein, 9 aa, Homo Sapiens
KKKAGREQS

SEQ ID NO: 713425 - protein, 9 aa, Homo Sapiens
ADDRGSNKG

SEQ ID NO: 713426 - protein, 9 aa, Homo Sapiens
EFSCMDCGS

SEQ ID NO: 713427 - protein, 9 aa, Homo Sapiens
STMSCLASY

SEQ ID NO: 713428 - protein, 9 aa, Homo Sapiens
VRIRTWNIA

SEQ ID NO: 713429 - protein, 9 aa, Homo Sapiens
IKISVTKKV

SEQ ID NO: 713430 - protein, 9 aa, Homo Sapiens
ALEKLSAST

SEQ ID NO: 713431 - protein, 9 aa, Homo Sapiens
NTLALMHLP

SEQ ID NO: 713432 - protein, 9 aa, Homo Sapiens
DFTVQDNRD

SEQ ID NO: 713433 - protein, 9 aa, Homo Sapiens
DTSSCHRVR

SEQ ID NO: 713434 - protein, 9 aa, Homo Sapiens
LGQKIHINK

SEQ ID NO: 713435 - protein, 9 aa, Homo Sapiens
PLAMPGSVG

SEQ ID NO: 713436 - protein, 9 aa, Homo Sapiens
SKEEELFKW

SEQ ID NO: 713437 - protein, 9 aa, Homo Sapiens
HILGHTDDK

SEQ ID NO: 713438 - protein, 9 aa, Homo Sapiens
HHQTGWASA

SEQ ID NO: 713439 - protein, 9 aa, Homo Sapiens
KLLTFSYYD

SEQ ID NO: 713440 - protein, 9 aa, Homo Sapiens
HMLQDCYGD

SEQ ID NO: 713441 - protein, 9 aa, Homo Sapiens
NGPPSAAAI

SEQ ID NO: 713442 - protein, 9 aa, Homo Sapiens
LRPGDSEAR

SEQ ID NO: 713443 - protein, 9 aa, Homo Sapiens
DMGLTLTTL

SEQ ID NO: 713444 - protein, 9 aa, Homo Sapiens
MPVWLRRSH

SEQ ID NO: 713445 - protein, 9 aa, Homo Sapiens
EGGCTGCEC

SEQ ID NO: 713446 - protein, 9 aa, Homo Sapiens
FRVHITLHD

SEQ ID NO: 713447 - protein, 9 aa, Homo Sapiens
EQAYHTLRA

SEQ ID NO: 713448 - protein, 9 aa, Homo Sapiens
RLYNEIPRE

SEQ ID NO: 713449 - protein, 9 aa, Homo Sapiens
HSCGPEGSR

SEQ ID NO: 713450 - protein, 9 aa, Homo Sapiens
SCSGAAPAV

SEQ ID NO: 713451 - protein, 9 aa, Homo Sapiens
SGPPRRARG

SEQ ID NO: 713452 - protein, 9 aa, Homo Sapiens
FQEGGCTGC

SEQ ID NO: 713453 - protein, 9 aa, Homo Sapiens
VTSRTSYNN

SEQ ID NO: 713454 - protein, 9 aa, Homo Sapiens
DYEEHEGGG

SEQ ID NO: 713455 - protein, 9 aa, Homo Sapiens
PCPGPFLRT

SEQ ID NO: 713456 - protein, 9 aa, Homo Sapiens
DSEGVPLSS

SEQ ID NO: 713457 - protein, 9 aa, Homo Sapiens
WEAGKKPAV

SEQ ID NO: 713458 - protein, 9 aa, Homo Sapiens
GTRGPEGAM

SEQ ID NO: 713459 - protein, 9 aa, Homo Sapiens
EQSQTAGRT

SEQ ID NO: 713460 - protein, 9 aa, Homo Sapiens
LLLPSNTPN

SEQ ID NO: 713461 - protein, 9 aa, Homo Sapiens
EYHILGHTD

SEQ ID NO: 713462 - protein, 9 aa, Homo Sapiens
YVQRCPEDS

SEQ ID NO: 713463 - protein, 9 aa, Homo Sapiens
YKENFPASN

SEQ ID NO: 713464 - protein, 9 aa, Homo Sapiens
SEGSKTSEE

SEQ ID NO: 713465 - protein, 9 aa, Homo Sapiens
FLHSQEAAA

SEQ ID NO: 713466 - protein, 9 aa, Homo Sapiens
GSVGPKLMR

SEQ ID NO: 713467 - protein, 9 aa, Homo Sapiens
HSQSPFWQN

SEQ ID NO: 713468 - protein, 9 aa, Homo Sapiens
TAGRTIQCF

SEQ ID NO: 713469 - protein, 9 aa, Homo Sapiens
VCYLWGQSN

SEQ ID NO: 713470 - protein, 9 aa, Homo Sapiens
LAQKLTLDW

SEQ ID NO: 713471 - protein, 9 aa, Homo Sapiens
GPPSPTDDF

SEQ ID NO: 713472 - protein, 9 aa, Homo Sapiens
ETAIWEQHA

SEQ ID NO: 713473 - protein, 9 aa, Homo Sapiens
PPPPRPPPM

SEQ ID NO: 713474 - protein, 9 aa, Homo Sapiens
EAVRIRTWN

SEQ ID NO: 713475 - protein, 9 aa, Homo Sapiens
TKFQEIVTF

SEQ ID NO: 713476 - protein, 9 aa, Homo Sapiens
LQPQTYSPR

SEQ ID NO: 713477 - protein, 9 aa, Homo Sapiens
LDREEQAYH

SEQ ID NO: 713478 - protein, 9 aa, Homo Sapiens
PRGSSGPDN

SEQ ID NO: 713479 - protein, 9 aa, Homo Sapiens
LKAQQEMPG

SEQ ID NO: 713480 - protein, 9 aa, Homo Sapiens
APGSSAGSN

SEQ ID NO: 713481 - protein, 9 aa, Homo Sapiens
HEKTGFVRS

SEQ ID NO: 713482 - protein, 9 aa, Homo Sapiens
NKQGQEFLF

SEQ ID NO: 713483 - protein, 9 aa, Homo Sapiens
GLFLHSQEA

SEQ ID NO: 713484 - protein, 9 aa, Homo Sapiens
KNTGRTQAR

SEQ ID NO: 713485 - protein, 9 aa, Homo Sapiens
HKLGLSARM

SEQ ID NO: 713486 - protein, 9 aa, Homo Sapiens
SSAPDKYEY

SEQ ID NO: 713487 - protein, 9 aa, Homo Sapiens
ELKNEELFT

SEQ ID NO: 713488 - protein, 9 aa, Homo Sapiens
QNGPVQSIM

SEQ ID NO: 713489 - protein, 9 aa, Homo Sapiens
GTKKSQTDC

SEQ ID NO: 713490 - protein, 9 aa, Homo Sapiens
PPSPTDDFS

SEQ ID NO: 713491 - protein, 9 aa, Homo Sapiens
AEAGAVIMN

SEQ ID NO: 713492 - protein, 9 aa, Homo Sapiens
YVPLLGSLS

SEQ ID NO: 713493 - protein, 9 aa, Homo Sapiens
IDQIHREAE

SEQ ID NO: 713494 - protein, 9 aa, Homo Sapiens
RGSNKGFEA

SEQ ID NO: 713495 - protein, 9 aa, Homo Sapiens
VESVAWVCF

SEQ ID NO: 713496 - protein, 9 aa, Homo Sapiens
TVLFHLQDE

SEQ ID NO: 713497 - protein, 9 aa, Homo Sapiens
MCDLFHHQT

SEQ ID NO: 713498 - protein, 9 aa, Homo Sapiens
NSSDSSAPD

SEQ ID NO: 713499 - protein, 9 aa, Homo Sapiens
QSLSPQSPQ

SEQ ID NO: 713500 - protein, 9 aa, Homo Sapiens
KTKRVSSQK

SEQ ID NO: 713501 - protein, 9 aa, Homo Sapiens
GSSGPDNHQ

SEQ ID NO: 713502 - protein, 9 aa, Homo Sapiens
STPTTNRTP

SEQ ID NO: 713503 - protein, 9 aa, Homo Sapiens
NAEPQDLES

SEQ ID NO: 713504 - protein, 9 aa, Homo Sapiens
HTNKYASSS

SEQ ID NO: 713505 - protein, 8 aa, Homo Sapiens
QRLGATLL

SEQ ID NO: 713506 - protein, 9 aa, Homo Sapiens
REEWGVSPD

SEQ ID NO: 713507 - protein, 9 aa, Homo Sapiens
LHRALQLLE

SEQ ID NO: 713508 - protein, 9 aa, Homo Sapiens
CPHFNPCNC

SEQ ID NO: 713509 - protein, 9 aa, Homo Sapiens
SNDNFQQLR

SEQ ID NO: 713510 - protein, 9 aa, Homo Sapiens
NWVPPEDTV

SEQ ID NO: 713511 - protein, 9 aa, Homo Sapiens
PIKQPITVL

SEQ ID NO: 713512 - protein, 9 aa, Homo Sapiens
KRYLIVPKS

SEQ ID NO: 713513 - protein, 9 aa, Homo Sapiens
ASEQSLSPQ

SEQ ID NO: 713514 - protein, 9 aa, Homo Sapiens
ASKKKRLEP

SEQ ID NO: 713515 - protein, 9 aa, Homo Sapiens
IGIIPRIAR

SEQ ID NO: 713516 - protein, 9 aa, Homo Sapiens
PGMEYMVHA

SEQ ID NO: 713517 - protein, 9 aa, Homo Sapiens
GLLALMATE

SEQ ID NO: 713518 - protein, 9 aa, Homo Sapiens
LLRSSGEEP

SEQ ID NO: 713519 - protein, 9 aa, Homo Sapiens
PSKRWPPPV

SEQ ID NO: 713520 - protein, 9 aa, Homo Sapiens
ALMATEAVA

SEQ ID NO: 713521 - protein, 9 aa, Homo Sapiens
WVVREVNDA

SEQ ID NO: 713522 - protein, 9 aa, Homo Sapiens
LSRLVLHML

SEQ ID NO: 713523 - protein, 9 aa, Homo Sapiens
PNMKQAKMR

SEQ ID NO: 713524 - protein, 9 aa, Homo Sapiens
LYLSPCYDD

SEQ ID NO: 713525 - protein, 9 aa, Homo Sapiens
NHQGTPEPC

SEQ ID NO: 713526 - protein, 9 aa, Homo Sapiens
IKQPITVLE

SEQ ID NO: 713527 - protein, 9 aa, Homo Sapiens
EGLFLHSQE

SEQ ID NO: 713528 - protein, 9 aa, Homo Sapiens
SCGPEGSRA

SEQ ID NO: 713529 - protein, 9 aa, Homo Sapiens
IHEAAWRGH

SEQ ID NO: 713530 - protein, 9 aa, Homo Sapiens
SEISLKEFG

SEQ ID NO: 713531 - protein, 9 aa, Homo Sapiens
PCSVVSVEN

SEQ ID NO: 713532 - protein, 9 aa, Homo Sapiens
TDPSQLTED

SEQ ID NO: 713533 - protein, 9 aa, Homo Sapiens
IGKGRSCKG

SEQ ID NO: 713534 - protein, 9 aa, Homo Sapiens
VFAQANELG

SEQ ID NO: 713535 - protein, 9 aa, Homo Sapiens
LHPEIPKPR

SEQ ID NO: 713536 - protein, 9 aa, Homo Sapiens
WDTGILIFA

SEQ ID NO: 713537 - protein, 9 aa, Homo Sapiens
LFHHQTGWA

SEQ ID NO: 713538 - protein, 9 aa, Homo Sapiens
LEHYVLTLL

SEQ ID NO: 713539 - protein, 9 aa, Homo Sapiens
FEFTEPKHS

SEQ ID NO: 713540 - protein, 9 aa, Homo Sapiens
PAVSPHAGR

SEQ ID NO: 713541 - protein, 9 aa, Homo Sapiens
MITAVVLFQ

SEQ ID NO: 713542 - protein, 9 aa, Homo Sapiens
TIQCFPDRN

SEQ ID NO: 713543 - protein, 9 aa, Homo Sapiens
TPLSQLRMD

SEQ ID NO: 713544 - protein, 9 aa, Homo Sapiens
GNPPSRMAS

SEQ ID NO: 713545 - protein, 9 aa, Homo Sapiens
RARGPQSVG

SEQ ID NO: 713546 - protein, 9 aa, Homo Sapiens
FAAGKCLAD

SEQ ID NO: 713547 - protein, 9 aa, Homo Sapiens
VPLSSLPRV

SEQ ID NO: 713548 - protein, 9 aa, Homo Sapiens
ADMQEEEEE

SEQ ID NO: 713549 - protein, 9 aa, Homo Sapiens
EIPRERRNE

SEQ ID NO: 713550 - protein, 9 aa, Homo Sapiens
PAAQHQLPQ

SEQ ID NO: 713551 - protein, 9 aa, Homo Sapiens
DKLHRTAWW

SEQ ID NO: 713552 - protein, 9 aa, Homo Sapiens
FYYLIASES

SEQ ID NO: 713553 - protein, 9 aa, Homo Sapiens
VLDSEVAKA

SEQ ID NO: 713554 - protein, 9 aa, Homo Sapiens
WRGHVECVN

SEQ ID NO: 713555 - protein, 9 aa, Homo Sapiens
PPPRPPPML

SEQ ID NO: 713556 - protein, 9 aa, Homo Sapiens
LQLLEEVLH

SEQ ID NO: 713557 - protein, 9 aa, Homo Sapiens
RGSASGAPA

SEQ ID NO: 713558 - protein, 9 aa, Homo Sapiens
AAPDVIVPT

SEQ ID NO: 713559 - protein, 9 aa, Homo Sapiens
SIQSLQDIS

SEQ ID NO: 713560 - protein, 9 aa, Homo Sapiens
LGSLSTAQT

SEQ ID NO: 713561 - protein, 9 aa, Homo Sapiens
KKVESSRKH

SEQ ID NO: 713562 - protein, 9 aa, Homo Sapiens
APGTRGPEG

SEQ ID NO: 713563 - protein, 9 aa, Homo Sapiens
FAQANELGK

SEQ ID NO: 713564 - protein, 9 aa, Homo Sapiens
VHLLLPVMP

SEQ ID NO: 713565 - protein, 9 aa, Homo Sapiens
AIFASAIHH

SEQ ID NO: 713566 - protein, 9 aa, Homo Sapiens
RSSGEEPSK

SEQ ID NO: 713567 - protein, 9 aa, Homo Sapiens
RDEEEQMME

SEQ ID NO: 713568 - protein, 9 aa, Homo Sapiens
HSKHHIIQE

SEQ ID NO: 713569 - protein, 9 aa, Homo Sapiens
ISVTKKVKL

SEQ ID NO: 713570 - protein, 9 aa, Homo Sapiens
ISENRYRDI

SEQ ID NO: 713571 - protein, 9 aa, Homo Sapiens
KRFAAGKCL

SEQ ID NO: 713572 - protein, 9 aa, Homo Sapiens
ESKKMSITN

SEQ ID NO: 713573 - protein, 9 aa, Homo Sapiens
RHVVPHVGG

SEQ ID NO: 713574 - protein, 9 aa, Homo Sapiens
KQQSIARSA

SEQ ID NO: 713575 - protein, 9 aa, Homo Sapiens
PDADFTVQD

SEQ ID NO: 713576 - protein, 9 aa, Homo Sapiens
ATISSTMSC

SEQ ID NO: 713577 - protein, 9 aa, Homo Sapiens
GGLIIPDKA

SEQ ID NO: 713578 - protein, 9 aa, Homo Sapiens
ENGGQGEKK

SEQ ID NO: 713579 - protein, 9 aa, Homo Sapiens
ARYRYQQVA

SEQ ID NO: 713580 - protein, 9 aa, Homo Sapiens
HAELRRART

SEQ ID NO: 713581 - protein, 9 aa, Homo Sapiens
EVCLGQKIH

SEQ ID NO: 713582 - protein, 9 aa, Homo Sapiens
SELKECLKT

SEQ ID NO: 713583 - protein, 9 aa, Homo Sapiens
SPCASEQSL

SEQ ID NO: 713584 - protein, 9 aa, Homo Sapiens
DQLEYHILG

SEQ ID NO: 713585 - protein, 9 aa, Homo Sapiens
ELVQRYNRV

SEQ ID NO: 713586 - protein, 9 aa, Homo Sapiens
DQKDLVPEL

SEQ ID NO: 713587 - protein, 9 aa, Homo Sapiens
VAAKAWDTG

SEQ ID NO: 713588 - protein, 9 aa, Homo Sapiens
VAELLHISP

SEQ ID NO: 713589 - protein, 9 aa, Homo Sapiens
CASEQSLSP

SEQ ID NO: 713590 - protein, 9 aa, Homo Sapiens
QPQTYSPRE

SEQ ID NO: 713591 - protein, 9 aa, Homo Sapiens
CHNLVYVFF

SEQ ID NO: 713592 - protein, 9 aa, Homo Sapiens
QAHGVTSAP

SEQ ID NO: 713593 - protein, 9 aa, Homo Sapiens
VPLRFCLSE

SEQ ID NO: 713594 - protein, 9 aa, Homo Sapiens
LGKYRVMLT

SEQ ID NO: 713595 - protein, 9 aa, Homo Sapiens
RRLIRAAKG

SEQ ID NO: 713596 - protein, 9 aa, Homo Sapiens
LVGSSSICE

SEQ ID NO: 713597 - protein, 9 aa, Homo Sapiens
CRALAPAPW

SEQ ID NO: 713598 - protein, 9 aa, Homo Sapiens
SANNESSNH

SEQ ID NO: 713599 - protein, 9 aa, Homo Sapiens
APAAQHQLP

SEQ ID NO: 713600 - protein, 9 aa, Homo Sapiens
PWTVLRGGG

SEQ ID NO: 713601 - protein, 9 aa, Homo Sapiens
QKLTLDWAE

SEQ ID NO: 713602 - protein, 9 aa, Homo Sapiens
PWGTAGCRG

SEQ ID NO: 713603 - protein, 9 aa, Homo Sapiens
PETPLHSKH

SEQ ID NO: 713604 - protein, 9 aa, Homo Sapiens
CEGQKLLLH

SEQ ID NO: 713605 - protein, 9 aa, Homo Sapiens
YLTLRTGWQ

SEQ ID NO: 713606 - protein, 9 aa, Homo Sapiens
VSPSSFQIV

SEQ ID NO: 713607 - protein, 9 aa, Homo Sapiens
LSIIDVASE

SEQ ID NO: 713608 - protein, 9 aa, Homo Sapiens
YLTDYLMKI

SEQ ID NO: 713609 - protein, 9 aa, Homo Sapiens
GMRIRARFP

SEQ ID NO: 713610 - protein, 9 aa, Homo Sapiens
QKDLVPELQ

SEQ ID NO: 713611 - protein, 9 aa, Homo Sapiens
AGFMWLHKL

SEQ ID NO: 713612 - protein, 9 aa, Homo Sapiens
AGCGTGSCC

SEQ ID NO: 713613 - protein, 9 aa, Homo Sapiens
YHRYTELRE

SEQ ID NO: 713614 - protein, 9 aa, Homo Sapiens
WTTGAESKL

SEQ ID NO: 713615 - protein, 9 aa, Homo Sapiens
ITVLEGQTI

SEQ ID NO: 713616 - protein, 9 aa, Homo Sapiens
LCDEKNLEE

SEQ ID NO: 713617 - protein, 9 aa, Homo Sapiens
PNFPPEEEE

SEQ ID NO: 713618 - protein, 9 aa, Homo Sapiens
SPVSDSHGR

SEQ ID NO: 713619 - protein, 9 aa, Homo Sapiens
NRSLLAFVF

SEQ ID NO: 713620 - protein, 9 aa, Homo Sapiens
DMQEEEEEE

SEQ ID NO: 713621 - protein, 9 aa, Homo Sapiens
QIQPETPLH

SEQ ID NO: 713622 - protein, 9 aa, Homo Sapiens
AASGPPRRA

SEQ ID NO: 713623 - protein, 9 aa, Homo Sapiens
SLYEWFHPL

SEQ ID NO: 713624 - protein, 9 aa, Homo Sapiens
TQYPGQPSS

SEQ ID NO: 713625 - protein, 9 aa, Homo Sapiens
IALRLRPDY

SEQ ID NO: 713626 - protein, 9 aa, Homo Sapiens
NCTRTATVE

SEQ ID NO: 713627 - protein, 9 aa, Homo Sapiens
SGFCPHANH

SEQ ID NO: 713628 - protein, 9 aa, Homo Sapiens
EAGAVIMNA

SEQ ID NO: 713629 - protein, 9 aa, Homo Sapiens
TMMDHALHT

SEQ ID NO: 713630 - protein, 9 aa, Homo Sapiens
KMREEWGVS

SEQ ID NO: 713631 - protein, 9 aa, Homo Sapiens
PCEGQKLLL

SEQ ID NO: 713632 - protein, 9 aa, Homo Sapiens
CSVVSVENI

SEQ ID NO: 713633 - protein, 9 aa, Homo Sapiens
SNRSLLAFV

SEQ ID NO: 713634 - protein, 9 aa, Homo Sapiens
SPIHEAAWR

SEQ ID NO: 713635 - protein, 9 aa, Homo Sapiens
NRSWISTTS

SEQ ID NO: 713636 - protein, 9 aa, Homo Sapiens
VQSIMQVRE

SEQ ID NO: 713637 - protein, 9 aa, Homo Sapiens
PHFNPCNCV

SEQ ID NO: 713638 - protein, 9 aa, Homo Sapiens
SSFQIVSEK

SEQ ID NO: 713639 - protein, 9 aa, Homo Sapiens
LLGSAQSKR

SEQ ID NO: 713640 - protein, 9 aa, Homo Sapiens
TCQSKKGWG

SEQ ID NO: 713641 - protein, 9 aa, Homo Sapiens
QILQTKGAL

SEQ ID NO: 713642 - protein, 9 aa, Homo Sapiens
EMPGEQGFQ

SEQ ID NO: 713643 - protein, 9 aa, Homo Sapiens
ALSPRAHPC

SEQ ID NO: 713644 - protein, 9 aa, Homo Sapiens
PNFGGGCRE

SEQ ID NO: 713645 - protein, 9 aa, Homo Sapiens
SDPYKFKIK

SEQ ID NO: 713646 - protein, 9 aa, Homo Sapiens
TPTTNRTPE

SEQ ID NO: 713647 - protein, 9 aa, Homo Sapiens
HGDSSCRVC

SEQ ID NO: 713648 - protein, 9 aa, Homo Sapiens
EGVPLSSLP

SEQ ID NO: 713649 - protein, 9 aa, Homo Sapiens
STNTTVLFH

SEQ ID NO: 713650 - protein, 9 aa, Homo Sapiens
VGPTEESYA

SEQ ID NO: 713651 - protein, 9 aa, Homo Sapiens
LALEKLSAS

SEQ ID NO: 713652 - protein, 9 aa, Homo Sapiens
VLRGGGLDP

SEQ ID NO: 713653 - protein, 9 aa, Homo Sapiens
ESQQEWVVR

SEQ ID NO: 713654 - protein, 9 aa, Homo Sapiens
GPTEESYAL

SEQ ID NO: 713655 - protein, 9 aa, Homo Sapiens
EEQMMEVSL

SEQ ID NO: 713656 - protein, 9 aa, Homo Sapiens
AIRISRRGR

SEQ ID NO: 713657 - protein, 9 aa, Homo Sapiens
QKSWVSIWP

SEQ ID NO: 713658 - protein, 9 aa, Homo Sapiens
TNSGKLYAL

SEQ ID NO: 713659 - protein, 9 aa, Homo Sapiens
DRGSNKGFE

SEQ ID NO: 713660 - protein, 9 aa, Homo Sapiens
KSHRIFQAH

SEQ ID NO: 713661 - protein, 9 aa, Homo Sapiens
YESSTSETN

SEQ ID NO: 713662 - protein, 9 aa, Homo Sapiens
PKILPDVNS

SEQ ID NO: 713663 - protein, 9 aa, Homo Sapiens
KGKRYLIVP

SEQ ID NO: 713664 - protein, 9 aa, Homo Sapiens
KQPITVLEG

SEQ ID NO: 713665 - protein, 9 aa, Homo Sapiens
GGCTGCECS

SEQ ID NO: 713666 - protein, 9 aa, Homo Sapiens
TEESYALLN

SEQ ID NO: 713667 - protein, 9 aa, Homo Sapiens
LSPRAHPCA

SEQ ID NO: 713668 - protein, 9 aa, Homo Sapiens
ASAIHHVDH

SEQ ID NO: 713669 - protein, 9 aa, Homo Sapiens
ARSADSKPI

SEQ ID NO: 713670 - protein, 9 aa, Homo Sapiens
SHLHPEIPK

SEQ ID NO: 713671 - protein, 9 aa, Homo Sapiens
PFSQFTKAK

SEQ ID NO: 713672 - protein, 9 aa, Homo Sapiens
KADDRGSNK

SEQ ID NO: 713673 - protein, 9 aa, Homo Sapiens
QKLDSEANA

SEQ ID NO: 713674 - protein, 9 aa, Homo Sapiens
SHWQAPRQG

SEQ ID NO: 713675 - protein, 9 aa, Homo Sapiens
NPPLAMPGS

SEQ ID NO: 713676 - protein, 9 aa, Homo Sapiens
EMEKKVAFS

SEQ ID NO: 713677 - protein, 9 aa, Homo Sapiens
AVIMNANEN

SEQ ID NO: 713678 - protein, 9 aa, Homo Sapiens
EAGKKPAVS

SEQ ID NO: 713679 - protein, 9 aa, Homo Sapiens
LINQTDFSM

SEQ ID NO: 713680 - protein, 9 aa, Homo Sapiens
SVCYLWGQS

SEQ ID NO: 713681 - protein, 9 aa, Homo Sapiens
SLGGTPIRG

SEQ ID NO: 713682 - protein, 9 aa, Homo Sapiens
APAVEMDEE

SEQ ID NO: 713683 - protein, 9 aa, Homo Sapiens
LGCNFETQS

SEQ ID NO: 713684 - protein, 9 aa, Homo Sapiens
AVLNSFFNV

SEQ ID NO: 713685 - protein, 9 aa, Homo Sapiens
LLITTRPVD

SEQ ID NO: 713686 - protein, 9 aa, Homo Sapiens
EYMVHAWAQ

SEQ ID NO: 713687 - protein, 9 aa, Homo Sapiens
SESPGKNIF

SEQ ID NO: 713688 - protein, 9 aa, Homo Sapiens
SPRDEEEQM

SEQ ID NO: 713689 - protein, 9 aa, Homo Sapiens
VDESPVSDS

SEQ ID NO: 713690 - protein, 9 aa, Homo Sapiens
KPAQCPKRE

SEQ ID NO: 713691 - protein, 9 aa, Homo Sapiens
LLGSLSTAQ

SEQ ID NO: 713692 - protein, 9 aa, Homo Sapiens
QGQEFLFAI

SEQ ID NO: 713693 - protein, 9 aa, Homo Sapiens
AHQIIHAGM

SEQ ID NO: 713694 - protein, 9 aa, Homo Sapiens
VGSSSICEG

SEQ ID NO: 713695 - protein, 9 aa, Homo Sapiens
QRAVGVAPG

SEQ ID NO: 713696 - protein, 9 aa, Homo Sapiens
LADEFSCMD

SEQ ID NO: 713697 - protein, 9 aa, Homo Sapiens
QDDSLYLSP

SEQ ID NO: 713698 - protein, 9 aa, Homo Sapiens
NGGQGEKKQ

SEQ ID NO: 713699 - protein, 9 aa, Homo Sapiens
STIHPSSTT

SEQ ID NO: 713700 - protein, 9 aa, Homo Sapiens
YDIFQYHAT

SEQ ID NO: 713701 - protein, 9 aa, Homo Sapiens
GLISAKREP

SEQ ID NO: 713702 - protein, 9 aa, Homo Sapiens
HQILQTKGA

SEQ ID NO: 713703 - protein, 9 aa, Homo Sapiens
DEEDYEEHE

SEQ ID NO: 713704 - protein, 9 aa, Homo Sapiens
DRISCLFMI

SEQ ID NO: 713705 - protein, 9 aa, Homo Sapiens
VPRASLSPV

SEQ ID NO: 713706 - protein, 9 aa, Homo Sapiens
LDKLHRTAW

SEQ ID NO: 713707 - protein, 9 aa, Homo Sapiens
GCTGCECSH

SEQ ID NO: 713708 - protein, 9 aa, Homo Sapiens
VGMVRHQGR

SEQ ID NO: 713709 - protein, 9 aa, Homo Sapiens
PLSSLPRVP

SEQ ID NO: 713710 - protein, 9 aa, Homo Sapiens
TFDVDECEH

SEQ ID NO: 713711 - protein, 9 aa, Homo Sapiens
IAHTYKIYS

SEQ ID NO: 713712 - protein, 9 aa, Homo Sapiens
RMPLLLNHK

SEQ ID NO: 713713 - protein, 9 aa, Homo Sapiens
KKRFAAGKC

SEQ ID NO: 713714 - protein, 9 aa, Homo Sapiens
KACKITKTP

SEQ ID NO: 713715 - protein, 9 aa, Homo Sapiens
EYHRQRCQL

SEQ ID NO: 713716 - protein, 9 aa, Homo Sapiens
PVSDSHGRA

SEQ ID NO: 713717 - protein, 9 aa, Homo Sapiens
KNRIHHKLL

SEQ ID NO: 713718 - protein, 9 aa, Homo Sapiens
EFTEPKHSQ

SEQ ID NO: 713719 - protein, 9 aa, Homo Sapiens
FRQLRSHWQ

SEQ ID NO: 713720 - protein, 9 aa, Homo Sapiens
MPGEQGFQS

SEQ ID NO: 713721 - protein, 9 aa, Homo Sapiens
HPCACRALA

SEQ ID NO: 713722 - protein, 9 aa, Homo Sapiens
HILALYTCS

SEQ ID NO: 713723 - protein, 9 aa, Homo Sapiens
NMKQAKMRR

SEQ ID NO: 713724 - protein, 9 aa, Homo Sapiens
QSLNALGCN

SEQ ID NO: 713725 - protein, 9 aa, Homo Sapiens
DSEANAEPQ

SEQ ID NO: 713726 - protein, 9 aa, Homo Sapiens
WEQHAVTLH

SEQ ID NO: 713727 - protein, 9 aa, Homo Sapiens
GEEPSKRWP

SEQ ID NO: 713728 - protein, 9 aa, Homo Sapiens
TTVLFHLQD

SEQ ID NO: 713729 - protein, 9 aa, Homo Sapiens
LIIPDKAWA

SEQ ID NO: 713730 - protein, 9 aa, Homo Sapiens
RIFQAHCSF

SEQ ID NO: 713731 - protein, 9 aa, Homo Sapiens
VQYNCYYHG

SEQ ID NO: 713732 - protein, 9 aa, Homo Sapiens
GQSTSPDAE

SEQ ID NO: 713733 - protein, 9 aa, Homo Sapiens
QPFVQYNCY

SEQ ID NO: 713734 - protein, 9 aa, Homo Sapiens
LRTGWQYFL

SEQ ID NO: 713735 - protein, 9 aa, Homo Sapiens
KDAPVKGLL

SEQ ID NO: 713736 - protein, 9 aa, Homo Sapiens
YNRVNTIPQ

SEQ ID NO: 713737 - protein, 9 aa, Homo Sapiens
LFTGQGKGH

SEQ ID NO: 713738 - protein, 9 aa, Homo Sapiens
SIHVESVAW

SEQ ID NO: 713739 - protein, 9 aa, Homo Sapiens
QEERQHAEL

SEQ ID NO: 713740 - protein, 9 aa, Homo Sapiens
PVMPVWLRR

SEQ ID NO: 713741 - protein, 9 aa, Homo Sapiens
VLTLLATAA

SEQ ID NO: 713742 - protein, 9 aa, Homo Sapiens
LKEEESDPY

SEQ ID NO: 713743 - protein, 9 aa, Homo Sapiens
PHPCEGQKL

SEQ ID NO: 713744 - protein, 9 aa, Homo Sapiens
GKGHGDSSC

SEQ ID NO: 713745 - protein, 9 aa, Homo Sapiens
AAGFMWLHK

SEQ ID NO: 713746 - protein, 9 aa, Homo Sapiens
CDLFHHQTG

SEQ ID NO: 713747 - protein, 9 aa, Homo Sapiens
PNLSVPITW

SEQ ID NO: 713748 - protein, 9 aa, Homo Sapiens
SGPDNHQGT

SEQ ID NO: 713749 - protein, 9 aa, Homo Sapiens
LKMREEWGV

SEQ ID NO: 713750 - protein, 9 aa, Homo Sapiens
SCLASYLAD

SEQ ID NO: 713751 - protein, 9 aa, Homo Sapiens
QIISDKRNV

SEQ ID NO: 713752 - protein, 9 aa, Homo Sapiens
RLFGLISAK

SEQ ID NO: 713753 - protein, 9 aa, Homo Sapiens
DAPVKGLLQ

SEQ ID NO: 713754 - protein, 9 aa, Homo Sapiens
VAFSTISLG

SEQ ID NO: 713755 - protein, 9 aa, Homo Sapiens
KLKGKRYLI

SEQ ID NO: 713756 - protein, 9 aa, Homo Sapiens
LEEVLHTMP

SEQ ID NO: 713757 - protein, 9 aa, Homo Sapiens
AVEMDEELH

SEQ ID NO: 713758 - protein, 9 aa, Homo Sapiens
TYLYWCKQE

SEQ ID NO: 713759 - protein, 9 aa, Homo Sapiens
QHAELRRAR

SEQ ID NO: 713760 - protein, 9 aa, Homo Sapiens
PHVGGKPFS

SEQ ID NO: 713761 - protein, 9 aa, Homo Sapiens
TKKSQTDCI

SEQ ID NO: 713762 - protein, 9 aa, Homo Sapiens
EFFIPLEVK

SEQ ID NO: 713763 - protein, 9 aa, Homo Sapiens
NFNTLALMH

SEQ ID NO: 713764 - protein, 9 aa, Homo Sapiens
PFFLEKKVE

SEQ ID NO: 713765 - protein, 9 aa, Homo Sapiens
QPETPLHSK

SEQ ID NO: 713766 - protein, 9 aa, Homo Sapiens
QEKKKAGRE

SEQ ID NO: 713767 - protein, 9 aa, Homo Sapiens
KQLLRSSGE

SEQ ID NO: 713768 - protein, 9 aa, Homo Sapiens
EASKKKRLE

SEQ ID NO: 713769 - protein, 9 aa, Homo Sapiens
YEYHRQRCQ

SEQ ID NO: 713770 - protein, 9 aa, Homo Sapiens
KEEAGATEA

SEQ ID NO: 713771 - protein, 9 aa, Homo Sapiens
LHISPEGLQ

SEQ ID NO: 713772 - protein, 9 aa, Homo Sapiens
SSATSNDSP

SEQ ID NO: 713773 - protein, 9 aa, Homo Sapiens
VGAKASANN

SEQ ID NO: 713774 - protein, 9 aa, Homo Sapiens
DDRGSNKGF

SEQ ID NO: 713775 - protein, 9 aa, Homo Sapiens
MLPDTFTHP

SEQ ID NO: 713776 - protein, 9 aa, Homo Sapiens
GKYRVMLTG

SEQ ID NO: 713777 - protein, 9 aa, Homo Sapiens
FNVKFYPTD

SEQ ID NO: 713778 - protein, 9 aa, Homo Sapiens
TLALMHLPR

SEQ ID NO: 713779 - protein, 9 aa, Homo Sapiens
MHWARWLTP

SEQ ID NO: 713780 - protein, 9 aa, Homo Sapiens
DNHQGTPEP

SEQ ID NO: 713781 - protein, 9 aa, Homo Sapiens
ISSTMSCLA

SEQ ID NO: 713782 - protein, 9 aa, Homo Sapiens
VQRCPEDSR

SEQ ID NO: 713783 - protein, 9 aa, Homo Sapiens
SNRKTLWGI

SEQ ID NO: 713784 - protein, 9 aa, Homo Sapiens
QEGTKKSQT

SEQ ID NO: 713785 - protein, 9 aa, Homo Sapiens
RCHNLVYVF

SEQ ID NO: 713786 - protein, 9 aa, Homo Sapiens
SSVRPVVKW

SEQ ID NO: 713787 - protein, 9 aa, Homo Sapiens
AGAVIMNAN

SEQ ID NO: 713788 - protein, 9 aa, Homo Sapiens
FFQTQYPGQ

SEQ ID NO: 713789 - protein, 9 aa, Homo Sapiens
GSCWTTGAE

SEQ ID NO: 713790 - protein, 9 aa, Homo Sapiens
VSVLALEKL

SEQ ID NO: 713791 - protein, 9 aa, Homo Sapiens
QPFRQLRSH

SEQ ID NO: 713792 - protein, 9 aa, Homo Sapiens
RPCSACPPN

SEQ ID NO: 713793 - protein, 9 aa, Homo Sapiens
YNNRSWIST

SEQ ID NO: 713794 - protein, 9 aa, Homo Sapiens
MEKKVAFST

SEQ ID NO: 713795 - protein, 9 aa, Homo Sapiens
LDLAGRYLT

SEQ ID NO: 713796 - protein, 9 aa, Homo Sapiens
ITNPKTISR

SEQ ID NO: 713797 - protein, 9 aa, Homo Sapiens
HALRSTPSW

SEQ ID NO: 713798 - protein, 9 aa, Homo Sapiens
NGPVQSIMQ

SEQ ID NO: 713799 - protein, 9 aa, Homo Sapiens
RLDSRLHTT

SEQ ID NO: 713800 - protein, 9 aa, Homo Sapiens
TNTTVLFHL

SEQ ID NO: 713801 - protein, 9 aa, Homo Sapiens
AHPCACRAL

SEQ ID NO: 713802 - protein, 9 aa, Homo Sapiens
GCRGSASGA

SEQ ID NO: 713803 - protein, 9 aa, Homo Sapiens
HHKLLLPSN

SEQ ID NO: 713804 - protein, 9 aa, Homo Sapiens
RTIQCFPDR

SEQ ID NO: 713805 - protein, 9 aa, Homo Sapiens
EQMMEVSLD

SEQ ID NO: 713806 - protein, 9 aa, Homo Sapiens
AHCSFPECH

SEQ ID NO: 713807 - protein, 9 aa, Homo Sapiens
KISVTKKVK

SEQ ID NO: 713808 - protein, 9 aa, Homo Sapiens
GMEYMVHAW

SEQ ID NO: 713809 - protein, 9 aa, Homo Sapiens
GQSPRITPL

SEQ ID NO: 713810 - protein, 9 aa, Homo Sapiens
LRSTPSWSS

SEQ ID NO: 713811 - protein, 9 aa, Homo Sapiens
CDEKNLEEP

SEQ ID NO: 713812 - protein, 9 aa, Homo Sapiens
GKESLITNS

SEQ ID NO: 713813 - protein, 9 aa, Homo Sapiens
LIAEDDRLY

SEQ ID NO: 713814 - protein, 9 aa, Homo Sapiens
TAGCRGSAS

SEQ ID NO: 713815 - protein, 9 aa, Homo Sapiens
KNLEEPIPA

SEQ ID NO: 713816 - protein, 9 aa, Homo Sapiens
GVSHLHPEI

SEQ ID NO: 713817 - protein, 9 aa, Homo Sapiens
QSKKGWGLG

SEQ ID NO: 713818 - protein, 9 aa, Homo Sapiens
REAEMEEHR

SEQ ID NO: 713819 - protein, 9 aa, Homo Sapiens
KPFQQKNIS

SEQ ID NO: 713820 - protein, 9 aa, Homo Sapiens
SPWTVLRGG

SEQ ID NO: 713821 - protein, 9 aa, Homo Sapiens
TKNTGRTQA

SEQ ID NO: 713822 - protein, 9 aa, Homo Sapiens
RLVGSSSIC

SEQ ID NO: 713823 - protein, 9 aa, Homo Sapiens
KGRSCKGTV

SEQ ID NO: 713824 - protein, 9 aa, Homo Sapiens
NQTDFSMNL

SEQ ID NO: 713825 - protein, 9 aa, Homo Sapiens
KAWAVPDSL

SEQ ID NO: 713826 - protein, 9 aa, Homo Sapiens
IEEANRISE

SEQ ID NO: 713827 - protein, 9 aa, Homo Sapiens
TLNEEVSER

SEQ ID NO: 713828 - protein, 9 aa, Homo Sapiens
PEGLYKFTL

SEQ ID NO: 713829 - protein, 9 aa, Homo Sapiens
AKEMSVPLY

SEQ ID NO: 713830 - protein, 9 aa, Homo Sapiens
LSALPEGGS

SEQ ID NO: 713831 - protein, 9 aa, Homo Sapiens
FHGRDIMTD

SEQ ID NO: 713832 - protein, 9 aa, Homo Sapiens
PEEDGRSHR

SEQ ID NO: 713833 - protein, 9 aa, Homo Sapiens
CFWGGTAFG

SEQ ID NO: 713834 - protein, 9 aa, Homo Sapiens
FSVQNGLLK

SEQ ID NO: 713835 - protein, 9 aa, Homo Sapiens
FSPVMPTSP

SEQ ID NO: 713836 - protein, 9 aa, Homo Sapiens
SHAVLLVKL

SEQ ID NO: 713837 - protein, 9 aa, Homo Sapiens
LDLCILAIN

SEQ ID NO: 713838 - protein, 9 aa, Homo Sapiens
SEIPDFGLL

SEQ ID NO: 713839 - protein, 9 aa, Homo Sapiens
SSADNLTPS

SEQ ID NO: 713840 - protein, 9 aa, Homo Sapiens
QCSILYSDI

SEQ ID NO: 713841 - protein, 9 aa, Homo Sapiens
VGYLSILTL

SEQ ID NO: 713842 - protein, 9 aa, Homo Sapiens
GLRRLDGPQ

SEQ ID NO: 713843 - protein, 9 aa, Homo Sapiens
THLFFLHFL

SEQ ID NO: 713844 - protein, 9 aa, Homo Sapiens
RGIKVRKRI

SEQ ID NO: 713845 - protein, 9 aa, Homo Sapiens
AQENLAPAP

SEQ ID NO: 713846 - protein, 9 aa, Homo Sapiens
NAAIRKMEQ

SEQ ID NO: 713847 - protein, 9 aa, Homo Sapiens
YNFVRYYNK

SEQ ID NO: 713848 - protein, 9 aa, Homo Sapiens
EKPLHEVPI

SEQ ID NO: 713849 - protein, 9 aa, Homo Sapiens
TQMHEIHSN

SEQ ID NO: 713850 - protein, 9 aa, Homo Sapiens
PGYANSLRD

SEQ ID NO: 713851 - protein, 9 aa, Homo Sapiens
YAIAPGYSM

SEQ ID NO: 713852 - protein, 9 aa, Homo Sapiens
ALKIPFGKN

SEQ ID NO: 713853 - protein, 9 aa, Homo Sapiens
LQPSEMFVT

SEQ ID NO: 713854 - protein, 9 aa, Homo Sapiens
PGSWGRVGF

SEQ ID NO: 713855 - protein, 9 aa, Homo Sapiens
EVPIGNSLL

SEQ ID NO: 713856 - protein, 9 aa, Homo Sapiens
KEAQTQRLK

SEQ ID NO: 713857 - protein, 9 aa, Homo Sapiens
HRVNAVTLA

SEQ ID NO: 713858 - protein, 9 aa, Homo Sapiens
PSLELVPIP

SEQ ID NO: 713859 - protein, 9 aa, Homo Sapiens
KAVSGANPL

SEQ ID NO: 713860 - protein, 9 aa, Homo Sapiens
ISYRGCITH

SEQ ID NO: 713861 - protein, 9 aa, Homo Sapiens
MMNTLIYSL

SEQ ID NO: 713862 - protein, 9 aa, Homo Sapiens
LLLLGAHGM

SEQ ID NO: 713863 - protein, 9 aa, Homo Sapiens
QGVPPGWAE

SEQ ID NO: 713864 - protein, 9 aa, Homo Sapiens
TATANAYLV

SEQ ID NO: 713865 - protein, 9 aa, Homo Sapiens
LVRNSFEVR

SEQ ID NO: 713866 - protein, 9 aa, Homo Sapiens
VNGDCSPIS

SEQ ID NO: 713867 - protein, 9 aa, Homo Sapiens
ASADLLLAS

SEQ ID NO: 713868 - protein, 9 aa, Homo Sapiens
DCPRMKGRQ

SEQ ID NO: 713869 - protein, 9 aa, Homo Sapiens
PECQHTEMI

SEQ ID NO: 713870 - protein, 9 aa, Homo Sapiens
FAPSKGAGT

SEQ ID NO: 713871 - protein, 9 aa, Homo Sapiens
ASRAPGSTW

SEQ ID NO: 713872 - protein, 9 aa, Homo Sapiens
KKFDCKEKP

SEQ ID NO: 713873 - protein, 9 aa, Homo Sapiens
STHVAVVGL

SEQ ID NO: 713874 - protein, 9 aa, Homo Sapiens
GVPDSGSPP

SEQ ID NO: 713875 - protein, 9 aa, Homo Sapiens
RNEADLQVH

SEQ ID NO: 713876 - protein, 9 aa, Homo Sapiens
PEGQRHRAL

SEQ ID NO: 713877 - protein, 9 aa, Homo Sapiens
KKTKDVTVL

SEQ ID NO: 713878 - protein, 9 aa, Homo Sapiens
WEGRLIAAN

SEQ ID NO: 713879 - protein, 9 aa, Homo Sapiens
QPSKCEECG

SEQ ID NO: 713880 - protein, 9 aa, Homo Sapiens
DPKREIETI

SEQ ID NO: 713881 - protein, 9 aa, Homo Sapiens
NFSDNLGWC

SEQ ID NO: 713882 - protein, 9 aa, Homo Sapiens
IPFFAVRNC

SEQ ID NO: 713883 - protein, 9 aa, Homo Sapiens
WKVDCRDSL

SEQ ID NO: 713884 - protein, 9 aa, Homo Sapiens
KSHSFQAMC

SEQ ID NO: 713885 - protein, 9 aa, Homo Sapiens
RLDAQQESD

SEQ ID NO: 713886 - protein, 9 aa, Homo Sapiens
DCKEKPMLV

SEQ ID NO: 713887 - protein, 9 aa, Homo Sapiens
DVQTNAEKH

SEQ ID NO: 713888 - protein, 9 aa, Homo Sapiens
TTVSTLMSV

SEQ ID NO: 713889 - protein, 9 aa, Homo Sapiens
PLYTSRIDE

SEQ ID NO: 713890 - protein, 9 aa, Homo Sapiens
VSRSRSGSQ

SEQ ID NO: 713891 - protein, 9 aa, Homo Sapiens
GIRCLGDIA

SEQ ID NO: 713892 - protein, 9 aa, Homo Sapiens
SKVQDPPVV

SEQ ID NO: 713893 - protein, 9 aa, Homo Sapiens
VGIDNGDIP

SEQ ID NO: 713894 - protein, 9 aa, Homo Sapiens
FSSVQDLDQ

SEQ ID NO: 713895 - protein, 9 aa, Homo Sapiens
LVRLYTVVT

SEQ ID NO: 713896 - protein, 9 aa, Homo Sapiens
TAEYYRYRV

SEQ ID NO: 713897 - protein, 9 aa, Homo Sapiens
SLLHVIFGG

SEQ ID NO: 713898 - protein, 9 aa, Homo Sapiens
SCRLSALPE

SEQ ID NO: 713899 - protein, 9 aa, Homo Sapiens
RKTLLALFA

SEQ ID NO: 713900 - protein, 9 aa, Homo Sapiens
KEEYSAMRD

SEQ ID NO: 713901 - protein, 9 aa, Homo Sapiens
GHLIQKAAD

SEQ ID NO: 713902 - protein, 9 aa, Homo Sapiens
LDSSPNPFS

SEQ ID NO: 713903 - protein, 9 aa, Homo Sapiens
RPAVPVLGF

SEQ ID NO: 713904 - protein, 9 aa, Homo Sapiens
YGQHGSGCR

SEQ ID NO: 713905 - protein, 9 aa, Homo Sapiens
HEIHSNGGT

SEQ ID NO: 713906 - protein, 9 aa, Homo Sapiens
SGANPLLRV

SEQ ID NO: 713907 - protein, 9 aa, Homo Sapiens
KRGRVARPP

SEQ ID NO: 713908 - protein, 9 aa, Homo Sapiens
GWAELALSS

SEQ ID NO: 713909 - protein, 9 aa, Homo Sapiens
VSDTRTKRG

SEQ ID NO: 713910 - protein, 9 aa, Homo Sapiens
FRIGTVIKD

SEQ ID NO: 713911 - protein, 9 aa, Homo Sapiens
KEGDNSLQL

SEQ ID NO: 713912 - protein, 9 aa, Homo Sapiens
GEIRSLSAQ

SEQ ID NO: 713913 - protein, 9 aa, Homo Sapiens
STEITLDTA

SEQ ID NO: 713914 - protein, 9 aa, Homo Sapiens
QLEELYMTH

SEQ ID NO: 713915 - protein, 9 aa, Homo Sapiens
GGGLSQTWS

SEQ ID NO: 713916 - protein, 9 aa, Homo Sapiens
AIEEANRIS

SEQ ID NO: 713917 - protein, 9 aa, Homo Sapiens
QTQPGYANS

SEQ ID NO: 713918 - protein, 9 aa, Homo Sapiens
GAFCNMNDV

SEQ ID NO: 713919 - protein, 9 aa, Homo Sapiens
EKPMLVDKA

SEQ ID NO: 713920 - protein, 9 aa, Homo Sapiens
WDFRNEADL

SEQ ID NO: 713921 - protein, 9 aa, Homo Sapiens
EEEEEIPKE

SEQ ID NO: 713922 - protein, 9 aa, Homo Sapiens
CELADALSQ

SEQ ID NO: 713923 - protein, 9 aa, Homo Sapiens
QARLSAIAE

SEQ ID NO: 713924 - protein, 9 aa, Homo Sapiens
SHRLPQEAE

SEQ ID NO: 713925 - protein, 9 aa, Homo Sapiens
CQFKSSFLK

SEQ ID NO: 713926 - protein, 9 aa, Homo Sapiens
HPHFPAPIP

SEQ ID NO: 713927 - protein, 9 aa, Homo Sapiens
SQNVNHEYM

SEQ ID NO: 713928 - protein, 9 aa, Homo Sapiens
SVQNGLLKP

SEQ ID NO: 713929 - protein, 9 aa, Homo Sapiens
TRAVSRVLA

SEQ ID NO: 713930 - protein, 9 aa, Homo Sapiens
QPLQPSEMF

SEQ ID NO: 713931 - protein, 9 aa, Homo Sapiens
EEIPKEIRE

SEQ ID NO: 713932 - protein, 9 aa, Homo Sapiens
SKWTAILGQ

SEQ ID NO: 713933 - protein, 9 aa, Homo Sapiens
RVMTPMMNT

SEQ ID NO: 713934 - protein, 9 aa, Homo Sapiens
VPVLGFCRA

SEQ ID NO: 713935 - protein, 9 aa, Homo Sapiens
CRQSLGHGQ

SEQ ID NO: 713936 - protein, 9 aa, Homo Sapiens
SKKKNNGPI

SEQ ID NO: 713937 - protein, 9 aa, Homo Sapiens
HCGKLFQRS

SEQ ID NO: 713938 - protein, 9 aa, Homo Sapiens
LWEIKMTSP

SEQ ID NO: 713939 - protein, 9 aa, Homo Sapiens
ELEDISERL

SEQ ID NO: 713940 - protein, 9 aa, Homo Sapiens
DKKACQFKS

SEQ ID NO: 713941 - protein, 9 aa, Homo Sapiens
QHLWEIKMT

SEQ ID NO: 713942 - protein, 9 aa, Homo Sapiens
QISHLVAVK

SEQ ID NO: 713943 - protein, 9 aa, Homo Sapiens
RRRTHSDGS

SEQ ID NO: 713944 - protein, 9 aa, Homo Sapiens
WGHTEVCVM

SEQ ID NO: 713945 - protein, 9 aa, Homo Sapiens
EMATAASYS

SEQ ID NO: 713946 - protein, 9 aa, Homo Sapiens
LWDILPNAN

SEQ ID NO: 713947 - protein, 9 aa, Homo Sapiens
AQTQRLKTA

SEQ ID NO: 713948 - protein, 9 aa, Homo Sapiens
SQMLQHMRL

SEQ ID NO: 713949 - protein, 9 aa, Homo Sapiens
GNRTLDHIF

SEQ ID NO: 713950 - protein, 9 aa, Homo Sapiens
CSSTPCSSM

SEQ ID NO: 713951 - protein, 9 aa, Homo Sapiens
MNGPSSLLG

SEQ ID NO: 713952 - protein, 9 aa, Homo Sapiens
ECQHTEMIK

SEQ ID NO: 713953 - protein, 9 aa, Homo Sapiens
LLGFPQNSN

SEQ ID NO: 713954 - protein, 9 aa, Homo Sapiens
PFFAVRNCY

SEQ ID NO: 713955 - protein, 9 aa, Homo Sapiens
LSAQKAPIE

SEQ ID NO: 713956 - protein, 9 aa, Homo Sapiens
LKLAVLLII

SEQ ID NO: 713957 - protein, 9 aa, Homo Sapiens
EAMSVIEHM

SEQ ID NO: 713958 - protein, 9 aa, Homo Sapiens
ACQFKSSFL

SEQ ID NO: 713959 - protein, 9 aa, Homo Sapiens
LLPEGQRHR

SEQ ID NO: 713960 - protein, 9 aa, Homo Sapiens
SRLDAQQES

SEQ ID NO: 713961 - protein, 9 aa, Homo Sapiens
VPPGWAELA

SEQ ID NO: 713962 - protein, 9 aa, Homo Sapiens
IYNFVRYYN

SEQ ID NO: 713963 - protein, 9 aa, Homo Sapiens
NLDVQTNAE

SEQ ID NO: 713964 - protein, 9 aa, Homo Sapiens
KMEQMHKLL

SEQ ID NO: 713965 - protein, 9 aa, Homo Sapiens
YLDSSPNPF

SEQ ID NO: 713966 - protein, 9 aa, Homo Sapiens
EMGPFKLTV

SEQ ID NO: 713967 - protein, 9 aa, Homo Sapiens
TCSSEIPDF

SEQ ID NO: 713968 - protein, 9 aa, Homo Sapiens
IGDPSLCFQ

SEQ ID NO: 713969 - protein, 9 aa, Homo Sapiens
FAFPVTYAI

SEQ ID NO: 713970 - protein, 9 aa, Homo Sapiens
DGFVSPQDP

SEQ ID NO: 713971 - protein, 9 aa, Homo Sapiens
FCKAVSGAN

SEQ ID NO: 713972 - protein, 9 aa, Homo Sapiens
NQRAQAFLQ

SEQ ID NO: 713973 - protein, 9 aa, Homo Sapiens
AESSGNKHP

SEQ ID NO: 713974 - protein, 9 aa, Homo Sapiens
SKTYNSGTQ

SEQ ID NO: 713975 - protein, 9 aa, Homo Sapiens
NAVTLAVLQ

SEQ ID NO: 713976 - protein, 9 aa, Homo Sapiens
QADSLLHVI

SEQ ID NO: 713977 - protein, 9 aa, Homo Sapiens
MKALKIPFG

SEQ ID NO: 713978 - protein, 9 aa, Homo Sapiens
SPVNTLLYA

SEQ ID NO: 713979 - protein, 9 aa, Homo Sapiens
AANFSLIGV

SEQ ID NO: 713980 - protein, 9 aa, Homo Sapiens
TWKDFEVWH

SEQ ID NO: 713981 - protein, 9 aa, Homo Sapiens
FLSCDKEPQ

SEQ ID NO: 713982 - protein, 9 aa, Homo Sapiens
KREIETILK

SEQ ID NO: 713983 - protein, 9 aa, Homo Sapiens
PRTGTRAVS

SEQ ID NO: 713984 - protein, 9 aa, Homo Sapiens
VSRSNQSPS

SEQ ID NO: 713985 - protein, 9 aa, Homo Sapiens
ETILKFLEK

SEQ ID NO: 713986 - protein, 9 aa, Homo Sapiens
KQNVRKIIL

SEQ ID NO: 713987 - protein, 9 aa, Homo Sapiens
MHLEDHLFC

SEQ ID NO: 713988 - protein, 9 aa, Homo Sapiens
LGDSNSQSL

SEQ ID NO: 713989 - protein, 9 aa, Homo Sapiens
ALDRKQSEI

SEQ ID NO: 713990 - protein, 9 aa, Homo Sapiens
DHSAVFLDK

SEQ ID NO: 713991 - protein, 9 aa, Homo Sapiens
EDGEGEVEE

SEQ ID NO: 713992 - protein, 9 aa, Homo Sapiens
SKRYKQAQK

SEQ ID NO: 713993 - protein, 9 aa, Homo Sapiens
KGAGTQDAA

SEQ ID NO: 713994 - protein, 9 aa, Homo Sapiens
KIYKSDGIN

SEQ ID NO: 713995 - protein, 9 aa, Homo Sapiens
WNHIMHLED

SEQ ID NO: 713996 - protein, 9 aa, Homo Sapiens
LYMISIVGY

SEQ ID NO: 713997 - protein, 9 aa, Homo Sapiens
VIFKCLEPE

SEQ ID NO: 713998 - protein, 9 aa, Homo Sapiens
TQSSADNLT

SEQ ID NO: 713999 - protein, 9 aa, Homo Sapiens
YSSLEKSYE

SEQ ID NO: 714000 - protein, 9 aa, Homo Sapiens
CEVIDHPHV

SEQ ID NO: 714001 - protein, 9 aa, Homo Sapiens
CIIPFLETH

SEQ ID NO: 714002 - protein, 9 aa, Homo Sapiens
GYNFGNELR

SEQ ID NO: 714003 - protein, 9 aa, Homo Sapiens
SSVQDLDQP

SEQ ID NO: 714004 - protein, 9 aa, Homo Sapiens
AVLLVKLDQ

SEQ ID NO: 714005 - protein, 9 aa, Homo Sapiens
KCLEPEGLY

SEQ ID NO: 714006 - protein, 9 aa, Homo Sapiens
ETQSSADNL

SEQ ID NO: 714007 - protein, 9 aa, Homo Sapiens
GCGGFGGGG

SEQ ID NO: 714008 - protein, 9 aa, Homo Sapiens
QTQRLKTAA

SEQ ID NO: 714009 - protein, 9 aa, Homo Sapiens
VMPETFRNL

SEQ ID NO: 714010 - protein, 9 aa, Homo Sapiens
DRTIVFCFW

SEQ ID NO: 714011 - protein, 9 aa, Homo Sapiens
DVTVLRKPS

SEQ ID NO: 714012 - protein, 9 aa, Homo Sapiens
PGQGFRSSG

SEQ ID NO: 714013 - protein, 9 aa, Homo Sapiens
PEQQQHSHP

SEQ ID NO: 714014 - protein, 9 aa, Homo Sapiens
TCSQNVNHE

SEQ ID NO: 714015 - protein, 9 aa, Homo Sapiens
SGRLWANSG

SEQ ID NO: 714016 - protein, 9 aa, Homo Sapiens
TLMSVSSET

SEQ ID NO: 714017 - protein, 9 aa, Homo Sapiens
TTKPENSSY

SEQ ID NO: 714018 - protein, 9 aa, Homo Sapiens
THPHFPAPI

SEQ ID NO: 714019 - protein, 9 aa, Homo Sapiens
YITDAHTFA

SEQ ID NO: 714020 - protein, 9 aa, Homo Sapiens
DNSLQLRLE

SEQ ID NO: 714021 - protein, 9 aa, Homo Sapiens
QGTEKADKE

SEQ ID NO: 714022 - protein, 9 aa, Homo Sapiens
SGIKVNGDC

SEQ ID NO: 714023 - protein, 9 aa, Homo Sapiens
YEAGYDQCD

SEQ ID NO: 714024 - protein, 9 aa, Homo Sapiens
APLPTHPHF

SEQ ID NO: 714025 - protein, 9 aa, Homo Sapiens
RQVEVRRGP

SEQ ID NO: 714026 - protein, 9 aa, Homo Sapiens
CPQGLYKSS

SEQ ID NO: 714027 - protein, 9 aa, Homo Sapiens
TLLALFADH

SEQ ID NO: 714028 - protein, 9 aa, Homo Sapiens
LPVALKSPQ

SEQ ID NO: 714029 - protein, 9 aa, Homo Sapiens
KFLEYPEDY

SEQ ID NO: 714030 - protein, 9 aa, Homo Sapiens
MNSFSPVMP

SEQ ID NO: 714031 - protein, 9 aa, Homo Sapiens
TIYTTIFRI

SEQ ID NO: 714032 - protein, 9 aa, Homo Sapiens
DTATANAYL

SEQ ID NO: 714033 - protein, 9 aa, Homo Sapiens
QIVVGVPDS

SEQ ID NO: 714034 - protein, 9 aa, Homo Sapiens
ARLGLPGRS

SEQ ID NO: 714035 - protein, 9 aa, Homo Sapiens
PAMLDNEAN

SEQ ID NO: 714036 - protein, 9 aa, Homo Sapiens
GIHRVNAVT

SEQ ID NO: 714037 - protein, 9 aa, Homo Sapiens
DGIHRVNAV

SEQ ID NO: 714038 - protein, 9 aa, Homo Sapiens
AYRGIKVRK

SEQ ID NO: 714039 - protein, 9 aa, Homo Sapiens
LHEVPIGNS

SEQ ID NO: 714040 - protein, 9 aa, Homo Sapiens
ELYMTHSRK

SEQ ID NO: 714041 - protein, 9 aa, Homo Sapiens
GQHGSGCRQ

SEQ ID NO: 714042 - protein, 9 aa, Homo Sapiens
LPLCGNRTL

SEQ ID NO: 714043 - protein, 9 aa, Homo Sapiens
ADHQWVAPA

SEQ ID NO: 714044 - protein, 9 aa, Homo Sapiens
YIVQASNVH

SEQ ID NO: 714045 - protein, 9 aa, Homo Sapiens
ADKEEMMRE

SEQ ID NO: 714046 - protein, 9 aa, Homo Sapiens
QAAYEAGYD

SEQ ID NO: 714047 - protein, 9 aa, Homo Sapiens
DAQQESDVR

SEQ ID NO: 714048 - protein, 9 aa, Homo Sapiens
QKTSRYRSL

SEQ ID NO: 714049 - protein, 9 aa, Homo Sapiens
RTVYSPIPY

SEQ ID NO: 714050 - protein, 9 aa, Homo Sapiens
LEELYMTHS

SEQ ID NO: 714051 - protein, 9 aa, Homo Sapiens
VNTLLYARE

SEQ ID NO: 714052 - protein, 9 aa, Homo Sapiens
SQSLKKDPM

SEQ ID NO: 714053 - protein, 9 aa, Homo Sapiens
VVGVPDSGS

SEQ ID NO: 714054 - protein, 9 aa, Homo Sapiens
RDSPVNTLL

SEQ ID NO: 714055 - protein, 9 aa, Homo Sapiens
HRLPQEAEE

SEQ ID NO: 714056 - protein, 9 aa, Homo Sapiens
CSSEIPDFG

SEQ ID NO: 714057 - protein, 9 aa, Homo Sapiens
NAEKHSQVE

SEQ ID NO: 714058 - protein, 9 aa, Homo Sapiens
TVMGNTLYV

SEQ ID NO: 714059 - protein, 9 aa, Homo Sapiens
SHSFQAMCQ

SEQ ID NO: 714060 - protein, 9 aa, Homo Sapiens
CNMNDVEVP

SEQ ID NO: 714061 - protein, 9 aa, Homo Sapiens
VPLYTSRID

SEQ ID NO: 714062 - protein, 9 aa, Homo Sapiens
TKLELSPFS

SEQ ID NO: 714063 - protein, 9 aa, Homo Sapiens
EAKEKFLEY

SEQ ID NO: 714064 - protein, 9 aa, Homo Sapiens
HCRYGGKNG

SEQ ID NO: 714065 - protein, 9 aa, Homo Sapiens
CSVYYRNTS

SEQ ID NO: 714066 - protein, 9 aa, Homo Sapiens
PRSPLITRK

SEQ ID NO: 714067 - protein, 9 aa, Homo Sapiens
VTILPPKKK

SEQ ID NO: 714068 - protein, 9 aa, Homo Sapiens
TIVFCFWGG

SEQ ID NO: 714069 - protein, 9 aa, Homo Sapiens
QFKSSFLKN

SEQ ID NO: 714070 - protein, 9 aa, Homo Sapiens
EHVEERLAR

SEQ ID NO: 714071 - protein, 9 aa, Homo Sapiens
LALAKHLRT

SEQ ID NO: 714072 - protein, 9 aa, Homo Sapiens
IGNSLLSSE

SEQ ID NO: 714073 - protein, 9 aa, Homo Sapiens
EKFLEYPED

SEQ ID NO: 714074 - protein, 9 aa, Homo Sapiens
EDGRSHRLP

SEQ ID NO: 714075 - protein, 9 aa, Homo Sapiens
APSKGAGTQ

SEQ ID NO: 714076 - protein, 9 aa, Homo Sapiens
KNFTQSLAL

SEQ ID NO: 714077 - protein, 9 aa, Homo Sapiens
PWLQKLFLP

SEQ ID NO: 714078 - protein, 9 aa, Homo Sapiens
TVSASPETL

SEQ ID NO: 714079 - protein, 9 aa, Homo Sapiens
KKAFATCST

SEQ ID NO: 714080 - protein, 9 aa, Homo Sapiens
GIKVRKRIK

SEQ ID NO: 714081 - protein, 9 aa, Homo Sapiens
EGVQNLFAE

SEQ ID NO: 714082 - protein, 9 aa, Homo Sapiens
AGQTNSNAA

SEQ ID NO: 714083 - protein, 9 aa, Homo Sapiens
SPDLSQMPL

SEQ ID NO: 714084 - protein, 9 aa, Homo Sapiens
TKDYKEGDN

SEQ ID NO: 714085 - protein, 9 aa, Homo Sapiens
RDPECQHTE

SEQ ID NO: 714086 - protein, 9 aa, Homo Sapiens
KADKEEMMR

SEQ ID NO: 714087 - protein, 9 aa, Homo Sapiens
IALAVKMGL

SEQ ID NO: 714088 - protein, 9 aa, Homo Sapiens
NHIMHLEDH

SEQ ID NO: 714089 - protein, 9 aa, Homo Sapiens
LSRELEDIS

SEQ ID NO: 714090 - protein, 9 aa, Homo Sapiens
LSCDKEPQT

SEQ ID NO: 714091 - protein, 9 aa, Homo Sapiens
EMKALKIPF

SEQ ID NO: 714092 - protein, 9 aa, Homo Sapiens
PMLVDKARE

SEQ ID NO: 714093 - protein, 9 aa, Homo Sapiens
LDTATANAY

SEQ ID NO: 714094 - protein, 9 aa, Homo Sapiens
RPRTGTRAV

SEQ ID NO: 714095 - protein, 9 aa, Homo Sapiens
QNNTVQIKL

SEQ ID NO: 714096 - protein, 9 aa, Homo Sapiens
LQPYCRGNI

SEQ ID NO: 714097 - protein, 9 aa, Homo Sapiens
LAINSLEFQ

SEQ ID NO: 714098 - protein, 9 aa, Homo Sapiens
PSKCEECGK

SEQ ID NO: 714099 - protein, 9 aa, Homo Sapiens
DRDVPANVQ

SEQ ID NO: 714100 - protein, 9 aa, Homo Sapiens
VGCVLYDKD

SEQ ID NO: 714101 - protein, 9 aa, Homo Sapiens
KEMKALKIP

SEQ ID NO: 714102 - protein, 9 aa, Homo Sapiens
EVEEEEGEW

SEQ ID NO: 714103 - protein, 9 aa, Homo Sapiens
TPQAAAWGT

SEQ ID NO: 714104 - protein, 9 aa, Homo Sapiens
DSLDEINCT

SEQ ID NO: 714105 - protein, 9 aa, Homo Sapiens
LLGNVQENS

SEQ ID NO: 714106 - protein, 9 aa, Homo Sapiens
YFLALVEKF

SEQ ID NO: 714107 - protein, 9 aa, Homo Sapiens
KQRRKRTTF

SEQ ID NO: 714108 - protein, 9 aa, Homo Sapiens
VLLIIIAIY

SEQ ID NO: 714109 - protein, 9 aa, Homo Sapiens
SSTPCSSMR

SEQ ID NO: 714110 - protein, 9 aa, Homo Sapiens
QGDINASYF

SEQ ID NO: 714111 - protein, 9 aa, Homo Sapiens
KPMLVDKAR

SEQ ID NO: 714112 - protein, 9 aa, Homo Sapiens
HPFYVYSRL

SEQ ID NO: 714113 - protein, 9 aa, Homo Sapiens
ANENGKINH

SEQ ID NO: 714114 - protein, 9 aa, Homo Sapiens
EEDDLALCL

SEQ ID NO: 714115 - protein, 9 aa, Homo Sapiens
GFTVKHTLV

SEQ ID NO: 714116 - protein, 9 aa, Homo Sapiens
KPHSQEQTH

SEQ ID NO: 714117 - protein, 9 aa, Homo Sapiens
IPFLETHTR

SEQ ID NO: 714118 - protein, 9 aa, Homo Sapiens
CPHCGKLFQ

SEQ ID NO: 714119 - protein, 9 aa, Homo Sapiens
KQAQKISDD

SEQ ID NO: 714120 - protein, 9 aa, Homo Sapiens
PVTLFPLLI

SEQ ID NO: 714121 - protein, 9 aa, Homo Sapiens
AVKQLGTEK

SEQ ID NO: 714122 - protein, 9 aa, Homo Sapiens
WTAILGQHM

SEQ ID NO: 714123 - protein, 9 aa, Homo Sapiens
TVKKFFSAF

SEQ ID NO: 714124 - protein, 9 aa, Homo Sapiens
PVDPQISHL

SEQ ID NO: 714125 - protein, 9 aa, Homo Sapiens
KQLGTEKVI

SEQ ID NO: 714126 - protein, 9 aa, Homo Sapiens
YSMIKGVTS

SEQ ID NO: 714127 - protein, 9 aa, Homo Sapiens
IEDVIEGVQ

SEQ ID NO: 714128 - protein, 9 aa, Homo Sapiens
TLQSAYRGI

SEQ ID NO: 714129 - protein, 9 aa, Homo Sapiens
SVMTEGSTP

SEQ ID NO: 714130 - protein, 9 aa, Homo Sapiens
GWGISDEKV

SEQ ID NO: 714131 - protein, 9 aa, Homo Sapiens
KNNGPIAGK

SEQ ID NO: 714132 - protein, 9 aa, Homo Sapiens
AKKHIRDVG

SEQ ID NO: 714133 - protein, 9 aa, Homo Sapiens
GQRHRALGF

SEQ ID NO: 714134 - protein, 9 aa, Homo Sapiens
SRSRSGSQE

SEQ ID NO: 714135 - protein, 9 aa, Homo Sapiens
KITEVALMD

SEQ ID NO: 714136 - protein, 9 aa, Homo Sapiens
TDGVAALEF

SEQ ID NO: 714137 - protein, 9 aa, Homo Sapiens
GKHAHFETS

SEQ ID NO: 714138 - protein, 9 aa, Homo Sapiens
KLQPYCRGN

SEQ ID NO: 714139 - protein, 9 aa, Homo Sapiens
HFPAPIPSS

SEQ ID NO: 714140 - protein, 9 aa, Homo Sapiens
KASKSPWLQ

SEQ ID NO: 714141 - protein, 9 aa, Homo Sapiens
LGRCQLSSI

SEQ ID NO: 714142 - protein, 9 aa, Homo Sapiens
AVFLDKQML

SEQ ID NO: 714143 - protein, 9 aa, Homo Sapiens
GQLEELYMT

SEQ ID NO: 714144 - protein, 9 aa, Homo Sapiens
NGKVKQATP

SEQ ID NO: 714145 - protein, 9 aa, Homo Sapiens
ACWTSVFSV

SEQ ID NO: 714146 - protein, 9 aa, Homo Sapiens
DLLLASGPE

SEQ ID NO: 714147 - protein, 9 aa, Homo Sapiens
LQEYLQPMP

SEQ ID NO: 714148 - protein, 9 aa, Homo Sapiens
GIYSFTFHV

SEQ ID NO: 714149 - protein, 9 aa, Homo Sapiens
FLDGYPLPS

SEQ ID NO: 714150 - protein, 9 aa, Homo Sapiens
CRDVMLENY

SEQ ID NO: 714151 - protein, 9 aa, Homo Sapiens
QYCSVYYRN

SEQ ID NO: 714152 - protein, 9 aa, Homo Sapiens
GNELRQNMA

SEQ ID NO: 714153 - protein, 9 aa, Homo Sapiens
VLDLQADSL

SEQ ID NO: 714154 - protein, 9 aa, Homo Sapiens
LEDLDFLEA

SEQ ID NO: 714155 - protein, 9 aa, Homo Sapiens
FRAKFYPEH

SEQ ID NO: 714156 - protein, 9 aa, Homo Sapiens
IRCLGDIAK

SEQ ID NO: 714157 - protein, 9 aa, Homo Sapiens
KLDSLMTDE

SEQ ID NO: 714158 - protein, 9 aa, Homo Sapiens
EGEDGEGEV

SEQ ID NO: 714159 - protein, 9 aa, Homo Sapiens
LQADSLLHV

SEQ ID NO: 714160 - protein, 9 aa, Homo Sapiens
DLSQMPLFA

SEQ ID NO: 714161 - protein, 9 aa, Homo Sapiens
VLPTNLTHI

SEQ ID NO: 714162 - protein, 9 aa, Homo Sapiens
FLEYPEDYV

SEQ ID NO: 714163 - protein, 9 aa, Homo Sapiens
SSASTGLAT

SEQ ID NO: 714164 - protein, 9 aa, Homo Sapiens
THVAVVGLF

SEQ ID NO: 714165 - protein, 9 aa, Homo Sapiens
ENSSYDALN

SEQ ID NO: 714166 - protein, 9 aa, Homo Sapiens
GAHGMGFAG

SEQ ID NO: 714167 - protein, 9 aa, Homo Sapiens
SNVHVKMTW

SEQ ID NO: 714168 - protein, 9 aa, Homo Sapiens
SALVLPTNL

SEQ ID NO: 714169 - protein, 9 aa, Homo Sapiens
PMMNTLIYS

SEQ ID NO: 714170 - protein, 9 aa, Homo Sapiens
SPACWTSVF

SEQ ID NO: 714171 - protein, 9 aa, Homo Sapiens
PVINRRTFQ

SEQ ID NO: 714172 - protein, 9 aa, Homo Sapiens
LGWCVVMVG

SEQ ID NO: 714173 - protein, 9 aa, Homo Sapiens
IRTALLNMD

SEQ ID NO: 714174 - protein, 9 aa, Homo Sapiens
NVHVKMTWL

SEQ ID NO: 714175 - protein, 9 aa, Homo Sapiens
QRQDNRVAT

SEQ ID NO: 714176 - protein, 9 aa, Homo Sapiens
PQAVTGFSW

SEQ ID NO: 714177 - protein, 9 aa, Homo Sapiens
PPTLPNFSA

SEQ ID NO: 714178 - protein, 9 aa, Homo Sapiens
FQAMCQNGK

SEQ ID NO: 714179 - protein, 9 aa, Homo Sapiens
GEGQHLWEI

SEQ ID NO: 714180 - protein, 9 aa, Homo Sapiens
FRVGAQENL

SEQ ID NO: 714181 - protein, 9 aa, Homo Sapiens
YMISIVGYL

SEQ ID NO: 714182 - protein, 9 aa, Homo Sapiens
TIFRIGTVI

SEQ ID NO: 714183 - protein, 9 aa, Homo Sapiens
IPNQTAVYF

SEQ ID NO: 714184 - protein, 9 aa, Homo Sapiens
VSLTTPPCN

SEQ ID NO: 714185 - protein, 9 aa, Homo Sapiens
FETSKLAGP

SEQ ID NO: 714186 - protein, 9 aa, Homo Sapiens
RMKGRQPLT

SEQ ID NO: 714187 - protein, 9 aa, Homo Sapiens
LCLATIGSD

SEQ ID NO: 714188 - protein, 9 aa, Homo Sapiens
KTKDVTVLR

SEQ ID NO: 714189 - protein, 9 aa, Homo Sapiens
PAVPVLGFC

SEQ ID NO: 714190 - protein, 9 aa, Homo Sapiens
KLYRDVMPE

SEQ ID NO: 714191 - protein, 9 aa, Homo Sapiens
LNMDREARE

SEQ ID NO: 714192 - protein, 9 aa, Homo Sapiens
LYLITEATK

SEQ ID NO: 714193 - protein, 9 aa, Homo Sapiens
AMRKLWSKN

SEQ ID NO: 714194 - protein, 9 aa, Homo Sapiens
PQAAAWGTT

SEQ ID NO: 714195 - protein, 9 aa, Homo Sapiens
YETTLFVEK

SEQ ID NO: 714196 - protein, 9 aa, Homo Sapiens
YLREIQQTE

SEQ ID NO: 714197 - protein, 9 aa, Homo Sapiens
SEMFVTNNL

SEQ ID NO: 714198 - protein, 9 aa, Homo Sapiens
PPGWAELAL

SEQ ID NO: 714199 - protein, 9 aa, Homo Sapiens
KEEMMREAQ

SEQ ID NO: 714200 - protein, 9 aa, Homo Sapiens
PQISHLVAV

SEQ ID NO: 714201 - protein, 9 aa, Homo Sapiens
GSEDFDDFN

SEQ ID NO: 714202 - protein, 9 aa, Homo Sapiens
RFCHLLAAA

SEQ ID NO: 714203 - protein, 9 aa, Homo Sapiens
AVKMGLDGL

SEQ ID NO: 714204 - protein, 9 aa, Homo Sapiens
QSAYRGIKV

SEQ ID NO: 714205 - protein, 9 aa, Homo Sapiens
HGTVSASPE

SEQ ID NO: 714206 - protein, 9 aa, Homo Sapiens
WSQKTGITK

SEQ ID NO: 714207 - protein, 9 aa, Homo Sapiens
DGASRAPGS

SEQ ID NO: 714208 - protein, 9 aa, Homo Sapiens
TKSHSFQAM

SEQ ID NO: 714209 - protein, 9 aa, Homo Sapiens
QKQTSNPER

SEQ ID NO: 714210 - protein, 9 aa, Homo Sapiens
KPLHEVPIG

SEQ ID NO: 714211 - protein, 9 aa, Homo Sapiens
NGKINHQDS

SEQ ID NO: 714212 - protein, 9 aa, Homo Sapiens
HHRIHSGER

SEQ ID NO: 714213 - protein, 9 aa, Homo Sapiens
TEVALMDHL

SEQ ID NO: 714214 - protein, 9 aa, Homo Sapiens
QLPEQQQHS

SEQ ID NO: 714215 - protein, 9 aa, Homo Sapiens
PPKKKYPEY

SEQ ID NO: 714216 - protein, 9 aa, Homo Sapiens
HLWEIKMTS

SEQ ID NO: 714217 - protein, 9 aa, Homo Sapiens
GMNGPSSLL

SEQ ID NO: 714218 - protein, 9 aa, Homo Sapiens
NEADLQVHV

SEQ ID NO: 714219 - protein, 9 aa, Homo Sapiens
VYSPIPYTP

SEQ ID NO: 714220 - protein, 9 aa, Homo Sapiens
NEYTTKLEL

SEQ ID NO: 714221 - protein, 9 aa, Homo Sapiens
LFVEKNNDA

SEQ ID NO: 714222 - protein, 9 aa, Homo Sapiens
DTKQFDSSS

SEQ ID NO: 714223 - protein, 9 aa, Homo Sapiens
MGDLVDAQE

SEQ ID NO: 714224 - protein, 9 aa, Homo Sapiens
PIHPIIYNF

SEQ ID NO: 714225 - protein, 9 aa, Homo Sapiens
VCQKTSRYR

SEQ ID NO: 714226 - protein, 9 aa, Homo Sapiens
EEEEIPKEI

SEQ ID NO: 714227 - protein, 9 aa, Homo Sapiens
IWSQKTGIT

SEQ ID NO: 714228 - protein, 9 aa, Homo Sapiens
ECFNCALGS

SEQ ID NO: 714229 - protein, 9 aa, Homo Sapiens
QNRISEHVE

SEQ ID NO: 714230 - protein, 9 aa, Homo Sapiens
DSVVEADLE

SEQ ID NO: 714231 - protein, 9 aa, Homo Sapiens
SLRDAAPKM

SEQ ID NO: 714232 - protein, 9 aa, Homo Sapiens
FGNELRQNM

SEQ ID NO: 714233 - protein, 9 aa, Homo Sapiens
SAVFLDKQM

SEQ ID NO: 714234 - protein, 9 aa, Homo Sapiens
QNLFAEEGI

SEQ ID NO: 714235 - protein, 9 aa, Homo Sapiens
YYRYRVSLT

SEQ ID NO: 714236 - protein, 9 aa, Homo Sapiens
MATAASYSS

SEQ ID NO: 714237 - protein, 9 aa, Homo Sapiens
TQSLALAKH

SEQ ID NO: 714238 - protein, 9 aa, Homo Sapiens
GLLKPTLKA

SEQ ID NO: 714239 - protein, 9 aa, Homo Sapiens
GNVQENSEH

SEQ ID NO: 714240 - protein, 9 aa, Homo Sapiens
PPVINRRTF

SEQ ID NO: 714241 - protein, 9 aa, Homo Sapiens
PNDIPFFAV

SEQ ID NO: 714242 - protein, 9 aa, Homo Sapiens
CQKTSRYRS

SEQ ID NO: 714243 - protein, 9 aa, Homo Sapiens
LGFPQNSNT

SEQ ID NO: 714244 - protein, 9 aa, Homo Sapiens
QNVNHEYMS

SEQ ID NO: 714245 - protein, 9 aa, Homo Sapiens
CKLFTDGVA

SEQ ID NO: 714246 - protein, 9 aa, Homo Sapiens
KEQLQEYLQ

SEQ ID NO: 714247 - protein, 9 aa, Homo Sapiens
TTLFVEKNN

SEQ ID NO: 714248 - protein, 9 aa, Homo Sapiens
NTVQIKLVI

SEQ ID NO: 714249 - protein, 9 aa, Homo Sapiens
PLCGNRTLD

SEQ ID NO: 714250 - protein, 9 aa, Homo Sapiens
AKEPRSPLI

SEQ ID NO: 714251 - protein, 9 aa, Homo Sapiens
SNQSPSHSP

SEQ ID NO: 714252 - protein, 9 aa, Homo Sapiens
KACQACPQG

SEQ ID NO: 714253 - protein, 9 aa, Homo Sapiens
TVSTLMSVS

SEQ ID NO: 714254 - protein, 9 aa, Homo Sapiens
SAFSRVGSK

SEQ ID NO: 714255 - protein, 9 aa, Homo Sapiens
TLWGMLCPA

SEQ ID NO: 714256 - protein, 9 aa, Homo Sapiens
HIMHLEDHL

SEQ ID NO: 714257 - protein, 9 aa, Homo Sapiens
RSSGYADGA

SEQ ID NO: 714258 - protein, 9 aa, Homo Sapiens
SSSSSRPRT

SEQ ID NO: 714259 - protein, 9 aa, Homo Sapiens
DVPANVQLT

SEQ ID NO: 714260 - protein, 9 aa, Homo Sapiens
NGAVQLPEQ

SEQ ID NO: 714261 - protein, 9 aa, Homo Sapiens
NVRFSDKGG

SEQ ID NO: 714262 - protein, 9 aa, Homo Sapiens
PSLSPACWT

SEQ ID NO: 714263 - protein, 9 aa, Homo Sapiens
DLVDAQEYL

SEQ ID NO: 714264 - protein, 9 aa, Homo Sapiens
CGGFGGGGG

SEQ ID NO: 714265 - protein, 9 aa, Homo Sapiens
NRISEHVEE

SEQ ID NO: 714266 - protein, 9 aa, Homo Sapiens
AADDSNLKR

SEQ ID NO: 714267 - protein, 9 aa, Homo Sapiens
PFTCDDPRF

SEQ ID NO: 714268 - protein, 9 aa, Homo Sapiens
PPKRIRISQ

SEQ ID NO: 714269 - protein, 9 aa, Homo Sapiens
CQACPQGLY

SEQ ID NO: 714270 - protein, 9 aa, Homo Sapiens
SLRRRTHSD

SEQ ID NO: 714271 - protein, 9 aa, Homo Sapiens
ELVPIPAGE

SEQ ID NO: 714272 - protein, 9 aa, Homo Sapiens
VTCSQNVNH

SEQ ID NO: 714273 - protein, 9 aa, Homo Sapiens
FSDNLGWCV

SEQ ID NO: 714274 - protein, 9 aa, Homo Sapiens
QAMCQNGKL

SEQ ID NO: 714275 - protein, 9 aa, Homo Sapiens
ILGAFCNMN

SEQ ID NO: 714276 - protein, 9 aa, Homo Sapiens
SKEKLDSLM

SEQ ID NO: 714277 - protein, 9 aa, Homo Sapiens
WRKEMKALK

SEQ ID NO: 714278 - protein, 9 aa, Homo Sapiens
PVNTLLYAR

SEQ ID NO: 714279 - protein, 9 aa, Homo Sapiens
DNEANGNKT

SEQ ID NO: 714280 - protein, 9 aa, Homo Sapiens
IRDVGITFP

SEQ ID NO: 714281 - protein, 9 aa, Homo Sapiens
FDCKEKPML

SEQ ID NO: 714282 - protein, 9 aa, Homo Sapiens
KECFNCALG

SEQ ID NO: 714283 - protein, 9 aa, Homo Sapiens
PFLETHTRL

SEQ ID NO: 714284 - protein, 9 aa, Homo Sapiens
IPDFGLLVK

SEQ ID NO: 714285 - protein, 9 aa, Homo Sapiens
LAHPQAVTG

SEQ ID NO: 714286 - protein, 9 aa, Homo Sapiens
PKKKYPEYG

SEQ ID NO: 714287 - protein, 9 aa, Homo Sapiens
KIHTGEQPS

SEQ ID NO: 714288 - protein, 9 aa, Homo Sapiens
SGCEQPLGF

SEQ ID NO: 714289 - protein, 9 aa, Homo Sapiens
PGWAELALS

SEQ ID NO: 714290 - protein, 9 aa, Homo Sapiens
QGLRPRTVY

SEQ ID NO: 714291 - protein, 9 aa, Homo Sapiens
ANCMSSQTT

SEQ ID NO: 714292 - protein, 9 aa, Homo Sapiens
DWRKEMKAL

SEQ ID NO: 714293 - protein, 9 aa, Homo Sapiens
LEAMSVIEH

SEQ ID NO: 714294 - protein, 9 aa, Homo Sapiens
GGDDGASRA

SEQ ID NO: 714295 - protein, 9 aa, Homo Sapiens
VCMLWGHTE

SEQ ID NO: 714296 - protein, 9 aa, Homo Sapiens
RDSLDEINC

SEQ ID NO: 714297 - protein, 9 aa, Homo Sapiens
KRYKQAQKI

SEQ ID NO: 714298 - protein, 9 aa, Homo Sapiens
KLTVDDGLD

SEQ ID NO: 714299 - protein, 9 aa, Homo Sapiens
GDLVDAQEY

SEQ ID NO: 714300 - protein, 9 aa, Homo Sapiens
INFSDNLGW

SEQ ID NO: 714301 - protein, 9 aa, Homo Sapiens
PRFCHLLAA

SEQ ID NO: 714302 - protein, 9 aa, Homo Sapiens
SQPVTLFPL

SEQ ID NO: 714303 - protein, 9 aa, Homo Sapiens
QTNAEKHSQ

SEQ ID NO: 714304 - protein, 9 aa, Homo Sapiens
NSLEFQYRI

SEQ ID NO: 714305 - protein, 9 aa, Homo Sapiens
SNILGAFCN

SEQ ID NO: 714306 - protein, 9 aa, Homo Sapiens
GKLFQRSSE

SEQ ID NO: 714307 - protein, 9 aa, Homo Sapiens
ALVLPTNLT

SEQ ID NO: 714308 - protein, 9 aa, Homo Sapiens
SKSPWLQKL

SEQ ID NO: 714309 - protein, 9 aa, Homo Sapiens
EQRSQMLQH

SEQ ID NO: 714310 - protein, 9 aa, Homo Sapiens
YADLLTKTN

SEQ ID NO: 714311 - protein, 9 aa, Homo Sapiens
LTVTCSQNV

SEQ ID NO: 714312 - protein, 9 aa, Homo Sapiens
GQTNSNAAG

SEQ ID NO: 714313 - protein, 9 aa, Homo Sapiens
SPETLQQSL

SEQ ID NO: 714314 - protein, 9 aa, Homo Sapiens
VRLYTVVTQ

SEQ ID NO: 714315 - protein, 9 aa, Homo Sapiens
VNHEYMSWY

SEQ ID NO: 714316 - protein, 9 aa, Homo Sapiens
FFSAFSRVG

SEQ ID NO: 714317 - protein, 9 aa, Homo Sapiens
MGHTTVSTL

SEQ ID NO: 714318 - protein, 9 aa, Homo Sapiens
EDCPRMKGR

SEQ ID NO: 714319 - protein, 9 aa, Homo Sapiens
PACWTSVFS

SEQ ID NO: 714320 - protein, 9 aa, Homo Sapiens
YKQAQKISD

SEQ ID NO: 714321 - protein, 9 aa, Homo Sapiens
SASQASCFL

SEQ ID NO: 714322 - protein, 9 aa, Homo Sapiens
FTDGVAALE

SEQ ID NO: 714323 - protein, 9 aa, Homo Sapiens
KGVTSGDYK

SEQ ID NO: 714324 - protein, 9 aa, Homo Sapiens
MSVIEHMQE

SEQ ID NO: 714325 - protein, 9 aa, Homo Sapiens
VNAVTLAVL

SEQ ID NO: 714326 - protein, 9 aa, Homo Sapiens
ECRKAFSYL

SEQ ID NO: 714327 - protein, 9 aa, Homo Sapiens
YRGIKVRKR

SEQ ID NO: 714328 - protein, 9 aa, Homo Sapiens
RVGAQENLA

SEQ ID NO: 714329 - protein, 9 aa, Homo Sapiens
SSHLSRHHR

SEQ ID NO: 714330 - protein, 9 aa, Homo Sapiens
NMNDVEVPL

SEQ ID NO: 714331 - protein, 9 aa, Homo Sapiens
GCVLYDKDA

SEQ ID NO: 714332 - protein, 9 aa, Homo Sapiens
QASCFLDGY

SEQ ID NO: 714333 - protein, 9 aa, Homo Sapiens
SSYDALNES

SEQ ID NO: 714334 - protein, 9 aa, Homo Sapiens
PLITRKHVL

SEQ ID NO: 714335 - protein, 9 aa, Homo Sapiens
DKEPQTTVI

SEQ ID NO: 714336 - protein, 9 aa, Homo Sapiens
EEPQLRLEH

SEQ ID NO: 714337 - protein, 9 aa, Homo Sapiens
LCGNRTLDH

SEQ ID NO: 714338 - protein, 9 aa, Homo Sapiens
KEMSVPLYT

SEQ ID NO: 714339 - protein, 9 aa, Homo Sapiens
PIFSSVQDL

SEQ ID NO: 714340 - protein, 9 aa, Homo Sapiens
FCHLLAAAS

SEQ ID NO: 714341 - protein, 9 aa, Homo Sapiens
VDKAVKQLG

SEQ ID NO: 714342 - protein, 9 aa, Homo Sapiens
NDHSAVFLD

SEQ ID NO: 714343 - protein, 9 aa, Homo Sapiens
MCFSYADLL

SEQ ID NO: 714344 - protein, 9 aa, Homo Sapiens
DPSLCFQKT

SEQ ID NO: 714345 - protein, 9 aa, Homo Sapiens
DLQADSLLH

SEQ ID NO: 714346 - protein, 9 aa, Homo Sapiens
HVKCQTKKK

SEQ ID NO: 714347 - protein, 9 aa, Homo Sapiens
PLPTHPHFP

SEQ ID NO: 714348 - protein, 9 aa, Homo Sapiens
GAECCSPKF

SEQ ID NO: 714349 - protein, 9 aa, Homo Sapiens
LPTHPHFPA

SEQ ID NO: 714350 - protein, 9 aa, Homo Sapiens
LGEIRSLSA

SEQ ID NO: 714351 - protein, 9 aa, Homo Sapiens
YLAHPQAVT

SEQ ID NO: 714352 - protein, 9 aa, Homo Sapiens
RGSEDFDDF

SEQ ID NO: 714353 - protein, 9 aa, Homo Sapiens
ALPEGGSGR

SEQ ID NO: 714354 - protein, 9 aa, Homo Sapiens
INNSLLGRC

SEQ ID NO: 714355 - protein, 9 aa, Homo Sapiens
DPECQHTEM

SEQ ID NO: 714356 - protein, 9 aa, Homo Sapiens
PETLQQSLP

SEQ ID NO: 714357 - protein, 9 aa, Homo Sapiens
GDINASYFL

SEQ ID NO: 714358 - protein, 9 aa, Homo Sapiens
VDAQEYLVP

SEQ ID NO: 714359 - protein, 9 aa, Homo Sapiens
LRPRTVYSP

SEQ ID NO: 714360 - protein, 9 aa, Homo Sapiens
RISALVLPT

SEQ ID NO: 714361 - protein, 9 aa, Homo Sapiens
NQTAVYFCA

SEQ ID NO: 714362 - protein, 9 aa, Homo Sapiens
SSPAKPHTT

SEQ ID NO: 714363 - protein, 9 aa, Homo Sapiens
KKHIRDVGI

SEQ ID NO: 714364 - protein, 9 aa, Homo Sapiens
RDVPANVQL

SEQ ID NO: 714365 - protein, 9 aa, Homo Sapiens
RKEMKALKI

SEQ ID NO: 714366 - protein, 9 aa, Homo Sapiens
TSKLAGPKG

SEQ ID NO: 714367 - protein, 9 aa, Homo Sapiens
EQMHKLLKV

SEQ ID NO: 714368 - protein, 9 aa, Homo Sapiens
IVGYLSILT

SEQ ID NO: 714369 - protein, 9 aa, Homo Sapiens
EVRRGPVSP

SEQ ID NO: 714370 - protein, 9 aa, Homo Sapiens
PDPYEKILH

SEQ ID NO: 714371 - protein, 9 aa, Homo Sapiens
FATCSTHVA

SEQ ID NO: 714372 - protein, 9 aa, Homo Sapiens
RKRTTFTRS

SEQ ID NO: 714373 - protein, 9 aa, Homo Sapiens
SSVSSPDNA

SEQ ID NO: 714374 - protein, 9 aa, Homo Sapiens
GIDNGDIPD

SEQ ID NO: 714375 - protein, 9 aa, Homo Sapiens
QMHEIHSNG

SEQ ID NO: 714376 - protein, 9 aa, Homo Sapiens
GTQLWDILP

SEQ ID NO: 714377 - protein, 9 aa, Homo Sapiens
TGITKLKEA

SEQ ID NO: 714378 - protein, 9 aa, Homo Sapiens
FNCALGSSW

SEQ ID NO: 714379 - protein, 9 aa, Homo Sapiens
YTTIFRIGT

SEQ ID NO: 714380 - protein, 9 aa, Homo Sapiens
AVCYETTLF

SEQ ID NO: 714381 - protein, 9 aa, Homo Sapiens
RRKRTTFTR

SEQ ID NO: 714382 - protein, 9 aa, Homo Sapiens
PYAKKQCSI

SEQ ID NO: 714383 - protein, 9 aa, Homo Sapiens
HGRDIMTDP

SEQ ID NO: 714384 - protein, 9 aa, Homo Sapiens
KLVIQTLSQ

SEQ ID NO: 714385 - protein, 9 aa, Homo Sapiens
EANGNKTMI

SEQ ID NO: 714386 - protein, 9 aa, Homo Sapiens
TCSTHVAVV

SEQ ID NO: 714387 - protein, 9 aa, Homo Sapiens
PVSDTRTKR

SEQ ID NO: 714388 - protein, 9 aa, Homo Sapiens
PSEMFVTNN

SEQ ID NO: 714389 - protein, 9 aa, Homo Sapiens
AHGMGFAGA

SEQ ID NO: 714390 - protein, 9 aa, Homo Sapiens
KGIYSFTFH

SEQ ID NO: 714391 - protein, 9 aa, Homo Sapiens
VVSLEEPQL

SEQ ID NO: 714392 - protein, 9 aa, Homo Sapiens
MRKLWSKNV

SEQ ID NO: 714393 - protein, 9 aa, Homo Sapiens
PDNAMVSPL

SEQ ID NO: 714394 - protein, 9 aa, Homo Sapiens
KPENSSYDA

SEQ ID NO: 714395 - protein, 9 aa, Homo Sapiens
PSSLLGFPQ

SEQ ID NO: 714396 - protein, 9 aa, Homo Sapiens
KEGECHVKK

SEQ ID NO: 714397 - protein, 9 aa, Homo Sapiens
LSQMPLFAD

SEQ ID NO: 714398 - protein, 9 aa, Homo Sapiens
KDVTVLRKP

SEQ ID NO: 714399 - protein, 9 aa, Homo Sapiens
RNMSWSRLI

SEQ ID NO: 714400 - protein, 9 aa, Homo Sapiens
RELEDISER

SEQ ID NO: 714401 - protein, 9 aa, Homo Sapiens
SPVSDTRTK

SEQ ID NO: 714402 - protein, 9 aa, Homo Sapiens
KLFQRSSEL

SEQ ID NO: 714403 - protein, 9 aa, Homo Sapiens
GVIRTALLN

SEQ ID NO: 714404 - protein, 9 aa, Homo Sapiens
QFDSSSSPA

SEQ ID NO: 714405 - protein, 9 aa, Homo Sapiens
CPRMKGRQP

SEQ ID NO: 714406 - protein, 9 aa, Homo Sapiens
IKQNNTAMV

SEQ ID NO: 714407 - protein, 9 aa, Homo Sapiens
GLILHHRIH

SEQ ID NO: 714408 - protein, 9 aa, Homo Sapiens
GWGIRCLGD

SEQ ID NO: 714409 - protein, 9 aa, Homo Sapiens
QRGSEDFDD

SEQ ID NO: 714410 - protein, 9 aa, Homo Sapiens
HVKMTWLKE

SEQ ID NO: 714411 - protein, 9 aa, Homo Sapiens
QEYLVPQQG

SEQ ID NO: 714412 - protein, 9 aa, Homo Sapiens
YDQCDAGWL

SEQ ID NO: 714413 - protein, 9 aa, Homo Sapiens
FCFWGGTAF

SEQ ID NO: 714414 - protein, 9 aa, Homo Sapiens
NLLVRNSFE

SEQ ID NO: 714415 - protein, 9 aa, Homo Sapiens
QNACKKTQL

SEQ ID NO: 714416 - protein, 9 aa, Homo Sapiens
EIHSNGGTV

SEQ ID NO: 714417 - protein, 9 aa, Homo Sapiens
AFATCSTHV

SEQ ID NO: 714418 - protein, 9 aa, Homo Sapiens
VEVRRGPVS

SEQ ID NO: 714419 - protein, 9 aa, Homo Sapiens
VKQLGTEKV

SEQ ID NO: 714420 - protein, 9 aa, Homo Sapiens
KALKIPFGK

SEQ ID NO: 714421 - protein, 9 aa, Homo Sapiens
TKLQPYCRG

SEQ ID NO: 714422 - protein, 9 aa, Homo Sapiens
RTCGRPAVP

SEQ ID NO: 714423 - protein, 9 aa, Homo Sapiens
PLGFRSFVP

SEQ ID NO: 714424 - protein, 9 aa, Homo Sapiens
HVSEELIQD

SEQ ID NO: 714425 - protein, 9 aa, Homo Sapiens
DVARISALV

SEQ ID NO: 714426 - protein, 9 aa, Homo Sapiens
CGKNFTQSL

SEQ ID NO: 714427 - protein, 9 aa, Homo Sapiens
LHFMDMQNA

SEQ ID NO: 714428 - protein, 9 aa, Homo Sapiens
IRNMSWSRL

SEQ ID NO: 714429 - protein, 9 aa, Homo Sapiens
WHGNEDTIK

SEQ ID NO: 714430 - protein, 9 aa, Homo Sapiens
SSRPRTGTR

SEQ ID NO: 714431 - protein, 9 aa, Homo Sapiens
PDLSQMPLF

SEQ ID NO: 714432 - protein, 9 aa, Homo Sapiens
FCPLTVNSL

SEQ ID NO: 714433 - protein, 9 aa, Homo Sapiens
LPEEDGRSH

SEQ ID NO: 714434 - protein, 9 aa, Homo Sapiens
FHCRYGGKN

SEQ ID NO: 714435 - protein, 9 aa, Homo Sapiens
CCYLREIQQ

SEQ ID NO: 714436 - protein, 9 aa, Homo Sapiens
GDNSLQLRL

SEQ ID NO: 714437 - protein, 9 aa, Homo Sapiens
KHIRDVGIT

SEQ ID NO: 714438 - protein, 9 aa, Homo Sapiens
GAVCYETTL

SEQ ID NO: 714439 - protein, 9 aa, Homo Sapiens
TEGLRRLDG

SEQ ID NO: 714440 - protein, 9 aa, Homo Sapiens
DLGSGIKVN

SEQ ID NO: 714441 - protein, 9 aa, Homo Sapiens
AKSAAQAAG

SEQ ID NO: 714442 - protein, 9 aa, Homo Sapiens
QDREEKSLY

SEQ ID NO: 714443 - protein, 9 aa, Homo Sapiens
KHTLVIHQR

SEQ ID NO: 714444 - protein, 9 aa, Homo Sapiens
FLETHTRLI

SEQ ID NO: 714445 - protein, 9 aa, Homo Sapiens
RLVRLYTVV

SEQ ID NO: 714446 - protein, 9 aa, Homo Sapiens
PPPVINRRT

SEQ ID NO: 714447 - protein, 9 aa, Homo Sapiens
AQAFLQAVT

SEQ ID NO: 714448 - protein, 9 aa, Homo Sapiens
SKCQHSCLK

SEQ ID NO: 714449 - protein, 9 aa, Homo Sapiens
RKNLDVQTN

SEQ ID NO: 714450 - protein, 9 aa, Homo Sapiens
GYDQCDAGW

SEQ ID NO: 714451 - protein, 9 aa, Homo Sapiens
YDKRCCYLR

SEQ ID NO: 714452 - protein, 9 aa, Homo Sapiens
EVWHGNEDT

SEQ ID NO: 714453 - protein, 9 aa, Homo Sapiens
ERLLESKEK

SEQ ID NO: 714454 - protein, 9 aa, Homo Sapiens
AGRDPECQH

SEQ ID NO: 714455 - protein, 9 aa, Homo Sapiens
TSSGALLPV

SEQ ID NO: 714456 - protein, 9 aa, Homo Sapiens
VMGNTLYVT

SEQ ID NO: 714457 - protein, 9 aa, Homo Sapiens
VNGAKKHIR

SEQ ID NO: 714458 - protein, 9 aa, Homo Sapiens
DNAMVSPLK

SEQ ID NO: 714459 - protein, 9 aa, Homo Sapiens
QLRLEHCIE

SEQ ID NO: 714460 - protein, 9 aa, Homo Sapiens
EKLDSLMTD

SEQ ID NO: 714461 - protein, 9 aa, Homo Sapiens
PIIYNFVRY

SEQ ID NO: 714462 - protein, 9 aa, Homo Sapiens
AARQSHPHG

SEQ ID NO: 714463 - protein, 9 aa, Homo Sapiens
NRRTFQGEQ

SEQ ID NO: 714464 - protein, 9 aa, Homo Sapiens
LFHCRYGGK

SEQ ID NO: 714465 - protein, 9 aa, Homo Sapiens
QTWKDFEVW

SEQ ID NO: 714466 - protein, 9 aa, Homo Sapiens
VMPTSPLSM

SEQ ID NO: 714467 - protein, 9 aa, Homo Sapiens
QAAAWGTTP

SEQ ID NO: 714468 - protein, 9 aa, Homo Sapiens
IFKCLEPEG

SEQ ID NO: 714469 - protein, 9 aa, Homo Sapiens
SWGRVGFPS

SEQ ID NO: 714470 - protein, 9 aa, Homo Sapiens
YGGKNGFMV

SEQ ID NO: 714471 - protein, 9 aa, Homo Sapiens
FNGKVKQAT

SEQ ID NO: 714472 - protein, 9 aa, Homo Sapiens
HRALGFGTV

SEQ ID NO: 714473 - protein, 9 aa, Homo Sapiens
WDTSSGALL

SEQ ID NO: 714474 - protein, 9 aa, Homo Sapiens
KFDCKEKPM

SEQ ID NO: 714475 - protein, 9 aa, Homo Sapiens
LGDIAKGSF

SEQ ID NO: 714476 - protein, 9 aa, Homo Sapiens
GPSSLLGFP

SEQ ID NO: 714477 - protein, 9 aa, Homo Sapiens
MQNACKKTQ

SEQ ID NO: 714478 - protein, 9 aa, Homo Sapiens
LLAAIEEAN

SEQ ID NO: 714479 - protein, 9 aa, Homo Sapiens
FTQSLALAK

SEQ ID NO: 714480 - protein, 9 aa, Homo Sapiens
FWGGTAFGN

SEQ ID NO: 714481 - protein, 9 aa, Homo Sapiens
LASADLLLA

SEQ ID NO: 714482 - protein, 9 aa, Homo Sapiens
DNGDIPDLT

SEQ ID NO: 714483 - protein, 9 aa, Homo Sapiens
PENSSYDAL

SEQ ID NO: 714484 - protein, 9 aa, Homo Sapiens
RVATGLKKQ

SEQ ID NO: 714485 - protein, 9 aa, Homo Sapiens
TKEQLQEYL

SEQ ID NO: 714486 - protein, 9 aa, Homo Sapiens
SFQAMCQNG

SEQ ID NO: 714487 - protein, 9 aa, Homo Sapiens
CHLLAAASW

SEQ ID NO: 714488 - protein, 9 aa, Homo Sapiens
SFTFHVVKV

SEQ ID NO: 714489 - protein, 9 aa, Homo Sapiens
SDGSLLQEP

SEQ ID NO: 714490 - protein, 9 aa, Homo Sapiens
KSKKKNNGP

SEQ ID NO: 714491 - protein, 9 aa, Homo Sapiens
TGLATPLPV

SEQ ID NO: 714492 - protein, 9 aa, Homo Sapiens
SDKGGFTCF

SEQ ID NO: 714493 - protein, 9 aa, Homo Sapiens
GSACIEIKC

SEQ ID NO: 714494 - protein, 9 aa, Homo Sapiens
PSLPKDLHS

SEQ ID NO: 714495 - protein, 9 aa, Homo Sapiens
ILHVVGEHG

SEQ ID NO: 714496 - protein, 9 aa, Homo Sapiens
GLRPRTVYS

SEQ ID NO: 714497 - protein, 9 aa, Homo Sapiens
RLDGPQASL

SEQ ID NO: 714498 - protein, 9 aa, Homo Sapiens
VYFFSRLVE

SEQ ID NO: 714499 - protein, 9 aa, Homo Sapiens
IAESSGNKH

SEQ ID NO: 714500 - protein, 9 aa, Homo Sapiens
KSDGINGLY

SEQ ID NO: 714501 - protein, 9 aa, Homo Sapiens
YMTHSRKDM

SEQ ID NO: 714502 - protein, 9 aa, Homo Sapiens
AEMTRALDR

SEQ ID NO: 714503 - protein, 9 aa, Homo Sapiens
SGPSLPKDL

SEQ ID NO: 714504 - protein, 9 aa, Homo Sapiens
DNEYTTKLE

SEQ ID NO: 714505 - protein, 9 aa, Homo Sapiens
PHFPAPIPS

SEQ ID NO: 714506 - protein, 9 aa, Homo Sapiens
RKMEQMHKL

SEQ ID NO: 714507 - protein, 9 aa, Homo Sapiens
QAAGQTNSN

SEQ ID NO: 714508 - protein, 9 aa, Homo Sapiens
KPGAECCSP

SEQ ID NO: 714509 - protein, 9 aa, Homo Sapiens
SLSAQKAPI

SEQ ID NO: 714510 - protein, 9 aa, Homo Sapiens
KQNNTAMVS

SEQ ID NO: 714511 - protein, 9 aa, Homo Sapiens
SLYSMIKGV

SEQ ID NO: 714512 - protein, 9 aa, Homo Sapiens
AEYYRYRVS

SEQ ID NO: 714513 - protein, 9 aa, Homo Sapiens
GKINHQDSM

SEQ ID NO: 714514 - protein, 9 aa, Homo Sapiens
SSFCIIPFL

SEQ ID NO: 714515 - protein, 9 aa, Homo Sapiens
AKKQCSILY

SEQ ID NO: 714516 - protein, 9 aa, Homo Sapiens
AQQNLCRDV

SEQ ID NO: 714517 - protein, 9 aa, Homo Sapiens
GKVKQATPY

SEQ ID NO: 714518 - protein, 9 aa, Homo Sapiens
RLYTVVTQE

SEQ ID NO: 714519 - protein, 9 aa, Homo Sapiens
EGQRHRALG

SEQ ID NO: 714520 - protein, 9 aa, Homo Sapiens
LLKELSGPS

SEQ ID NO: 714521 - protein, 9 aa, Homo Sapiens
EIKTIPYER

SEQ ID NO: 714522 - protein, 9 aa, Homo Sapiens
VVDLVSRSN

SEQ ID NO: 714523 - protein, 9 aa, Homo Sapiens
PSSVSSPDN

SEQ ID NO: 714524 - protein, 9 aa, Homo Sapiens
LFQRSSELT

SEQ ID NO: 714525 - protein, 9 aa, Homo Sapiens
GPKDHPFTC

SEQ ID NO: 714526 - protein, 9 aa, Homo Sapiens
KETCSSEIP

SEQ ID NO: 714527 - protein, 9 aa, Homo Sapiens
LAVLLIIIA

SEQ ID NO: 714528 - protein, 9 aa, Homo Sapiens
FRSSGYADG

SEQ ID NO: 714529 - protein, 9 aa, Homo Sapiens
VQTNAEKHS

SEQ ID NO: 714530 - protein, 9 aa, Homo Sapiens
PRTVYSPIP

SEQ ID NO: 714531 - protein, 9 aa, Homo Sapiens
KALVSFKPT

SEQ ID NO: 714532 - protein, 9 aa, Homo Sapiens
PRMKGRQPL

SEQ ID NO: 714533 - protein, 9 aa, Homo Sapiens
HFNGKVKQA

SEQ ID NO: 714534 - protein, 9 aa, Homo Sapiens
LITEATKTV

SEQ ID NO: 714535 - protein, 9 aa, Homo Sapiens
SVSSPDNAM

SEQ ID NO: 714536 - protein, 9 aa, Homo Sapiens
VARISALVL

SEQ ID NO: 714537 - protein, 9 aa, Homo Sapiens
DGSLLQEPR

SEQ ID NO: 714538 - protein, 9 aa, Homo Sapiens
QKAADDSNL

SEQ ID NO: 714539 - protein, 9 aa, Homo Sapiens
LENYTCHVE

SEQ ID NO: 714540 - protein, 9 aa, Homo Sapiens
DKEDYTAQS

SEQ ID NO: 714541 - protein, 9 aa, Homo Sapiens
LYPRSKVQD

SEQ ID NO: 714542 - protein, 9 aa, Homo Sapiens
GGLSQTWSA

SEQ ID NO: 714543 - protein, 9 aa, Homo Sapiens
LDEINCTEI

SEQ ID NO: 714544 - protein, 9 aa, Homo Sapiens
GAKKHIRDV

SEQ ID NO: 714545 - protein, 9 aa, Homo Sapiens
TPSLELVPI

SEQ ID NO: 714546 - protein, 9 aa, Homo Sapiens
KDHPFTCDD

SEQ ID NO: 714547 - protein, 9 aa, Homo Sapiens
GRSESLEHQ

SEQ ID NO: 714548 - protein, 9 aa, Homo Sapiens
CYETTLFVE

SEQ ID NO: 714549 - protein, 9 aa, Homo Sapiens
AQQESDVRE

SEQ ID NO: 714550 - protein, 9 aa, Homo Sapiens
NFTQSLALA

SEQ ID NO: 714551 - protein, 9 aa, Homo Sapiens
TQDQLQKQT

SEQ ID NO: 714552 - protein, 9 aa, Homo Sapiens
PEPLYPRSK

SEQ ID NO: 714553 - protein, 9 aa, Homo Sapiens
RLIAANFSL

SEQ ID NO: 714554 - protein, 9 aa, Homo Sapiens
PTHPHFPAP

SEQ ID NO: 714555 - protein, 9 aa, Homo Sapiens
SLLGFPQNS

SEQ ID NO: 714556 - protein, 9 aa, Homo Sapiens
EVIDHPHVK

SEQ ID NO: 714557 - protein, 9 aa, Homo Sapiens
APDLSPEIL

SEQ ID NO: 714558 - protein, 9 aa, Homo Sapiens
YLPPIFSSV

SEQ ID NO: 714559 - protein, 9 aa, Homo Sapiens
SVQDLDQPE

SEQ ID NO: 714560 - protein, 9 aa, Homo Sapiens
GVPPGWAEL

SEQ ID NO: 714561 - protein, 9 aa, Homo Sapiens
DNEESEKRK

SEQ ID NO: 714562 - protein, 9 aa, Homo Sapiens
CSTHVAVVG

SEQ ID NO: 714563 - protein, 9 aa, Homo Sapiens
RFDKECFNC

SEQ ID NO: 714564 - protein, 9 aa, Homo Sapiens
SALSVPPAG

SEQ ID NO: 714565 - protein, 9 aa, Homo Sapiens
YPRSKVQDP

SEQ ID NO: 714566 - protein, 9 aa, Homo Sapiens
TILPPKKKY

SEQ ID NO: 714567 - protein, 9 aa, Homo Sapiens
DFEVWHGNE

SEQ ID NO: 714568 - protein, 9 aa, Homo Sapiens
ITEVALMDH

SEQ ID NO: 714569 - protein, 9 aa, Homo Sapiens
QACPQGLYK

SEQ ID NO: 714570 - protein, 9 aa, Homo Sapiens
ITDAHTFAL

SEQ ID NO: 714571 - protein, 9 aa, Homo Sapiens
GDSNSQSLK

SEQ ID NO: 714572 - protein, 9 aa, Homo Sapiens
QHGSGCRQS

SEQ ID NO: 714573 - protein, 9 aa, Homo Sapiens
FTFLTKLQP

SEQ ID NO: 714574 - protein, 9 aa, Homo Sapiens
YEKILHVVG

SEQ ID NO: 714575 - protein, 9 aa, Homo Sapiens
YRVSLTTPP

SEQ ID NO: 714576 - protein, 9 aa, Homo Sapiens
HPQAVTGFS

SEQ ID NO: 714577 - protein, 9 aa, Homo Sapiens
CRLSALPEG

SEQ ID NO: 714578 - protein, 9 aa, Homo Sapiens
LFLSCDKEP

SEQ ID NO: 714579 - protein, 9 aa, Homo Sapiens
DLCILAINS

SEQ ID NO: 714580 - protein, 9 aa, Homo Sapiens
VKLDQRERL

SEQ ID NO: 714581 - protein, 9 aa, Homo Sapiens
FKCLEPEGL

SEQ ID NO: 714582 - protein, 9 aa, Homo Sapiens
TLIYSLRNK

SEQ ID NO: 714583 - protein, 9 aa, Homo Sapiens
TVQFKPGSW

SEQ ID NO: 714584 - protein, 9 aa, Homo Sapiens
YLSILTLVF

SEQ ID NO: 714585 - protein, 9 aa, Homo Sapiens
QVHPFYVYS

SEQ ID NO: 714586 - protein, 9 aa, Homo Sapiens
GMCFSYADL

SEQ ID NO: 714587 - protein, 9 aa, Homo Sapiens
INASYFLAL

SEQ ID NO: 714588 - protein, 9 aa, Homo Sapiens
QPSEMFVTN

SEQ ID NO: 714589 - protein, 9 aa, Homo Sapiens
CHVKKVNKM

SEQ ID NO: 714590 - protein, 9 aa, Homo Sapiens
LPEGQRHRA

SEQ ID NO: 714591 - protein, 9 aa, Homo Sapiens
RAKFYPEHV

SEQ ID NO: 714592 - protein, 9 aa, Homo Sapiens
RSRSGSQEA

SEQ ID NO: 714593 - protein, 9 aa, Homo Sapiens
KGQQKALVS

SEQ ID NO: 714594 - protein, 9 aa, Homo Sapiens
ISALVLPTN

SEQ ID NO: 714595 - protein, 9 aa, Homo Sapiens
TLDTATANA

SEQ ID NO: 714596 - protein, 9 aa, Homo Sapiens
FSTEITLDT

SEQ ID NO: 714597 - protein, 9 aa, Homo Sapiens
TLLYAREIP

SEQ ID NO: 714598 - protein, 9 aa, Homo Sapiens
PLLALAREY

SEQ ID NO: 714599 - protein, 9 aa, Homo Sapiens
IEGVQNLFA

SEQ ID NO: 714600 - protein, 9 aa, Homo Sapiens
YKEGDNSLQ

SEQ ID NO: 714601 - protein, 9 aa, Homo Sapiens
DILDTAGKE

SEQ ID NO: 714602 - protein, 9 aa, Homo Sapiens
LYMTHSRKD

SEQ ID NO: 714603 - protein, 9 aa, Homo Sapiens
IKASKSPWL

SEQ ID NO: 714604 - protein, 9 aa, Homo Sapiens
VGGGLSQTW

SEQ ID NO: 714605 - protein, 9 aa, Homo Sapiens
RAQAFLQAV

SEQ ID NO: 714606 - protein, 9 aa, Homo Sapiens
SMRRTVSGY

SEQ ID NO: 714607 - protein, 9 aa, Homo Sapiens
IFSSVQDLD

SEQ ID NO: 714608 - protein, 9 aa, Homo Sapiens
SVIEHMQEK

SEQ ID NO: 714609 - protein, 9 aa, Homo Sapiens
NGAKKHIRD

SEQ ID NO: 714610 - protein, 9 aa, Homo Sapiens
NSLLGRCQL

SEQ ID NO: 714611 - protein, 9 aa, Homo Sapiens
DEDGFVSPQ

SEQ ID NO: 714612 - protein, 9 aa, Homo Sapiens
DKGKNKHEG

SEQ ID NO: 714613 - protein, 9 aa, Homo Sapiens
EGDNSLQLR

SEQ ID NO: 714614 - protein, 9 aa, Homo Sapiens
AQAAGQTNS

SEQ ID NO: 714615 - protein, 9 aa, Homo Sapiens
MSSQTTNVV

SEQ ID NO: 714616 - protein, 9 aa, Homo Sapiens
WGIRCLGDI

SEQ ID NO: 714617 - protein, 9 aa, Homo Sapiens
GRPPKRIRI

SEQ ID NO: 714618 - protein, 9 aa, Homo Sapiens
DVIEGVQNL

SEQ ID NO: 714619 - protein, 9 aa, Homo Sapiens
RYRVSLTTP

SEQ ID NO: 714620 - protein, 9 aa, Homo Sapiens
VRFSDKGGF

SEQ ID NO: 714621 - protein, 9 aa, Homo Sapiens
IDHPHVKCQ

SEQ ID NO: 714622 - protein, 9 aa, Homo Sapiens
FQRSSELTK

SEQ ID NO: 714623 - protein, 9 aa, Homo Sapiens
VKQNVRKII

SEQ ID NO: 714624 - protein, 9 aa, Homo Sapiens
DQLQKQTSN

SEQ ID NO: 714625 - protein, 9 aa, Homo Sapiens
KGRQPLTVF

SEQ ID NO: 714626 - protein, 9 aa, Homo Sapiens
GQHMKSNLT

SEQ ID NO: 714627 - protein, 9 aa, Homo Sapiens
DPTVGVYFF

SEQ ID NO: 714628 - protein, 9 aa, Homo Sapiens
VHVKMTWLK

SEQ ID NO: 714629 - protein, 9 aa, Homo Sapiens
LQSAYRGIK

SEQ ID NO: 714630 - protein, 9 aa, Homo Sapiens
TRALDRKQS

SEQ ID NO: 714631 - protein, 9 aa, Homo Sapiens
NAMVSPLKP

SEQ ID NO: 714632 - protein, 9 aa, Homo Sapiens
NVNHEYMSW

SEQ ID NO: 714633 - protein, 9 aa, Homo Sapiens
EETQSSADN

SEQ ID NO: 714634 - protein, 9 aa, Homo Sapiens
ISHLVAVKS

SEQ ID NO: 714635 - protein, 9 aa, Homo Sapiens
LYRDVMPET

SEQ ID NO: 714636 - protein, 9 aa, Homo Sapiens
QEYLQPMPE

SEQ ID NO: 714637 - protein, 9 aa, Homo Sapiens
NEEVSERMF

SEQ ID NO: 714638 - protein, 9 aa, Homo Sapiens
TVQIKLVIQ

SEQ ID NO: 714639 - protein, 9 aa, Homo Sapiens
ANSLRDAAP

SEQ ID NO: 714640 - protein, 9 aa, Homo Sapiens
SSEIPDFGL

SEQ ID NO: 714641 - protein, 9 aa, Homo Sapiens
CSQNVNHEY

SEQ ID NO: 714642 - protein, 9 aa, Homo Sapiens
QFVLYLITE

SEQ ID NO: 714643 - protein, 9 aa, Homo Sapiens
ASYFLALVE

SEQ ID NO: 714644 - protein, 9 aa, Homo Sapiens
YTVVTQEPI

SEQ ID NO: 714645 - protein, 9 aa, Homo Sapiens
SKCEECGKA

SEQ ID NO: 714646 - protein, 9 aa, Homo Sapiens
DHPFTCDDP

SEQ ID NO: 714647 - protein, 9 aa, Homo Sapiens
SQKTGITKL

SEQ ID NO: 714648 - protein, 9 aa, Homo Sapiens
SYGQHGSGC

SEQ ID NO: 714649 - protein, 9 aa, Homo Sapiens
YVYSRLPCP

SEQ ID NO: 714650 - protein, 9 aa, Homo Sapiens
IHPIIYNFV

SEQ ID NO: 714651 - protein, 9 aa, Homo Sapiens
FFAVRNCYF

SEQ ID NO: 714652 - protein, 9 aa, Homo Sapiens
ASCFLDGYP

SEQ ID NO: 714653 - protein, 9 aa, Homo Sapiens
SVPLYTSRI

SEQ ID NO: 714654 - protein, 9 aa, Homo Sapiens
LGSGIKVNG

SEQ ID NO: 714655 - protein, 9 aa, Homo Sapiens
SQMPLFADL

SEQ ID NO: 714656 - protein, 9 aa, Homo Sapiens
KCMPPEKPN

SEQ ID NO: 714657 - protein, 9 aa, Homo Sapiens
QQESDVREL

SEQ ID NO: 714658 - protein, 9 aa, Homo Sapiens
PRSKVQDPP

SEQ ID NO: 714659 - protein, 9 aa, Homo Sapiens
VGAQENLAP

SEQ ID NO: 714660 - protein, 9 aa, Homo Sapiens
GMLCPAETP

SEQ ID NO: 714661 - protein, 9 aa, Homo Sapiens
LDILDTAGK

SEQ ID NO: 714662 - protein, 9 aa, Homo Sapiens
TYNSGTQSR

SEQ ID NO: 714663 - protein, 9 aa, Homo Sapiens
QWSQDLRRV

SEQ ID NO: 714664 - protein, 9 aa, Homo Sapiens
RFSDKGGFT

SEQ ID NO: 714665 - protein, 9 aa, Homo Sapiens
GTVCMLWGH

SEQ ID NO: 714666 - protein, 9 aa, Homo Sapiens
EPEGLYKFT

SEQ ID NO: 714667 - protein, 9 aa, Homo Sapiens
SALPEGGSG

SEQ ID NO: 714668 - protein, 9 aa, Homo Sapiens
RCLGDIAKG

SEQ ID NO: 714669 - protein, 9 aa, Homo Sapiens
REIKTIPYE

SEQ ID NO: 714670 - protein, 9 aa, Homo Sapiens
AYEAGYDQC

SEQ ID NO: 714671 - protein, 9 aa, Homo Sapiens
RKGIYSFTF

SEQ ID NO: 714672 - protein, 9 aa, Homo Sapiens
AVLLIIIAI

SEQ ID NO: 714673 - protein, 9 aa, Homo Sapiens
INDHSAVFL

SEQ ID NO: 714674 - protein, 9 aa, Homo Sapiens
KVKQATPYI

SEQ ID NO: 714675 - protein, 9 aa, Homo Sapiens
QGHMRGGSQ

SEQ ID NO: 714676 - protein, 9 aa, Homo Sapiens
DKGGFTCFF

SEQ ID NO: 714677 - protein, 9 aa, Homo Sapiens
WCVVMVGMP

SEQ ID NO: 714678 - protein, 9 aa, Homo Sapiens
YGTVCMLWG

SEQ ID NO: 714679 - protein, 9 aa, Homo Sapiens
HCKLFTDGV

SEQ ID NO: 714680 - protein, 9 aa, Homo Sapiens
HIRDVGITF

SEQ ID NO: 714681 - protein, 9 aa, Homo Sapiens
GVYFFSRLV

SEQ ID NO: 714682 - protein, 9 aa, Homo Sapiens
SQASCFLDG

SEQ ID NO: 714683 - protein, 9 aa, Homo Sapiens
SLALAKHLR

SEQ ID NO: 714684 - protein, 9 aa, Homo Sapiens
KKNNGPIAG

SEQ ID NO: 714685 - protein, 9 aa, Homo Sapiens
SAPRKQRRK

SEQ ID NO: 714686 - protein, 9 aa, Homo Sapiens
LQNRISEHV

SEQ ID NO: 714687 - protein, 9 aa, Homo Sapiens
NGIIQYCSV

SEQ ID NO: 714688 - protein, 9 aa, Homo Sapiens
EDDLALCLA

SEQ ID NO: 714689 - protein, 9 aa, Homo Sapiens
VQLPLCGNR

SEQ ID NO: 714690 - protein, 9 aa, Homo Sapiens
LTKLQPYCR

SEQ ID NO: 714691 - protein, 9 aa, Homo Sapiens
TYAIAPGYS

SEQ ID NO: 714692 - protein, 9 aa, Homo Sapiens
TPMMNTLIY

SEQ ID NO: 714693 - protein, 9 aa, Homo Sapiens
PDRTIVFCF

SEQ ID NO: 714694 - protein, 9 aa, Homo Sapiens
RVNAVTLAV

SEQ ID NO: 714695 - protein, 9 aa, Homo Sapiens
NLCRDVMLE

SEQ ID NO: 714696 - protein, 9 aa, Homo Sapiens
SRSEVSNYH

SEQ ID NO: 714697 - protein, 9 aa, Homo Sapiens
ACIEIKCMP

SEQ ID NO: 714698 - protein, 9 aa, Homo Sapiens
AQEYLVPQQ

SEQ ID NO: 714699 - protein, 9 aa, Homo Sapiens
AQKYLEAMS

SEQ ID NO: 714700 - protein, 9 aa, Homo Sapiens
NTLYVTGGR

SEQ ID NO: 714701 - protein, 9 aa, Homo Sapiens
VKMGLDGLQ

SEQ ID NO: 714702 - protein, 9 aa, Homo Sapiens
NNSLLGRCQ

SEQ ID NO: 714703 - protein, 9 aa, Homo Sapiens
SQVEVPEDK

SEQ ID NO: 714704 - protein, 9 aa, Homo Sapiens
RSHRLPQEA

SEQ ID NO: 714705 - protein, 9 aa, Homo Sapiens
PEDKEDYTA

SEQ ID NO: 714706 - protein, 9 aa, Homo Sapiens
SDTRTKRGR

SEQ ID NO: 714707 - protein, 9 aa, Homo Sapiens
STPCSSMRR

SEQ ID NO: 714708 - protein, 9 aa, Homo Sapiens
FPYAKKQCS

SEQ ID NO: 714709 - protein, 9 aa, Homo Sapiens
RHRALGFGT

SEQ ID NO: 714710 - protein, 9 aa, Homo Sapiens
TAASYSSLE

SEQ ID NO: 714711 - protein, 9 aa, Homo Sapiens
ILDTAGKEE

SEQ ID NO: 714712 - protein, 9 aa, Homo Sapiens
NSFSPVMPT

SEQ ID NO: 714713 - protein, 9 aa, Homo Sapiens
LWSKNVSLA

SEQ ID NO: 714714 - protein, 9 aa, Homo Sapiens
EVALMDHLS

SEQ ID NO: 714715 - protein, 9 aa, Homo Sapiens
LEYPEDYVA

SEQ ID NO: 714716 - protein, 9 aa, Homo Sapiens
LPNFSALSV

SEQ ID NO: 714717 - protein, 9 aa, Homo Sapiens
LGNVQENSE

SEQ ID NO: 714718 - protein, 9 aa, Homo Sapiens
SYLDSSPNP

SEQ ID NO: 714719 - protein, 9 aa, Homo Sapiens
EQQQHSHPN

SEQ ID NO: 714720 - protein, 9 aa, Homo Sapiens
PAQQNLCRD

SEQ ID NO: 714721 - protein, 9 aa, Homo Sapiens
WSKNVSLAG

SEQ ID NO: 714722 - protein, 9 aa, Homo Sapiens
TDAHTFALS

SEQ ID NO: 714723 - protein, 9 aa, Homo Sapiens
EANRISEDP

SEQ ID NO: 714724 - protein, 9 aa, Homo Sapiens
GEVEEEEGE

SEQ ID NO: 714725 - protein, 9 aa, Homo Sapiens
DTSSGALLP

SEQ ID NO: 714726 - protein, 9 aa, Homo Sapiens
IRISQEDNV

SEQ ID NO: 714727 - protein, 9 aa, Homo Sapiens
GEGEVEEEE

SEQ ID NO: 714728 - protein, 9 aa, Homo Sapiens
WSRLIRKLR

SEQ ID NO: 714729 - protein, 9 aa, Homo Sapiens
HFMDMQNAC

SEQ ID NO: 714730 - protein, 9 aa, Homo Sapiens
PLYPRSKVQ

SEQ ID NO: 714731 - protein, 9 aa, Homo Sapiens
SSSSSSSRP

SEQ ID NO: 714732 - protein, 9 aa, Homo Sapiens
DGPQASLST

SEQ ID NO: 714733 - protein, 9 aa, Homo Sapiens
CYLREIQQT

SEQ ID NO: 714734 - protein, 9 aa, Homo Sapiens
HSSTLNEEV

SEQ ID NO: 714735 - protein, 9 aa, Homo Sapiens
ALFADHQWV

SEQ ID NO: 714736 - protein, 9 aa, Homo Sapiens
RRTHSDGSL

SEQ ID NO: 714737 - protein, 9 aa, Homo Sapiens
SADLLLASG

SEQ ID NO: 714738 - protein, 9 aa, Homo Sapiens
LFADHQWVA

SEQ ID NO: 714739 - protein, 9 aa, Homo Sapiens
AVYFCATSD

SEQ ID NO: 714740 - protein, 9 aa, Homo Sapiens
LMSVSSETT

SEQ ID NO: 714741 - protein, 9 aa, Homo Sapiens
VTEAELKTE

SEQ ID NO: 714742 - protein, 9 aa, Homo Sapiens
PTKSHSFQA

SEQ ID NO: 714743 - protein, 9 aa, Homo Sapiens
LHHRIHSGE

SEQ ID NO: 714744 - protein, 9 aa, Homo Sapiens
IKVNGDCSP

SEQ ID NO: 714745 - protein, 9 aa, Homo Sapiens
DKFCPLTVN

SEQ ID NO: 714746 - protein, 9 aa, Homo Sapiens
CGKLFQRSS

SEQ ID NO: 714747 - protein, 9 aa, Homo Sapiens
PRKQRRKRT

SEQ ID NO: 714748 - protein, 9 aa, Homo Sapiens
SPDPYEKIL

SEQ ID NO: 714749 - protein, 9 aa, Homo Sapiens
KLFTDGVAA

SEQ ID NO: 714750 - protein, 9 aa, Homo Sapiens
RNVRFSDKG

SEQ ID NO: 714751 - protein, 9 aa, Homo Sapiens
DEGVERYIT

SEQ ID NO: 714752 - protein, 9 aa, Homo Sapiens
YAPLSGVGC

SEQ ID NO: 714753 - protein, 9 aa, Homo Sapiens
SIVGYLSIL

SEQ ID NO: 714754 - protein, 9 aa, Homo Sapiens
EIRLHTRCR

SEQ ID NO: 714755 - protein, 9 aa, Homo Sapiens
LLGEIRSLS

SEQ ID NO: 714756 - protein, 9 aa, Homo Sapiens
QVEVPEDKE

SEQ ID NO: 714757 - protein, 9 aa, Homo Sapiens
DPQISHLVA

SEQ ID NO: 714758 - protein, 9 aa, Homo Sapiens
DITQDQLQK

SEQ ID NO: 714759 - protein, 9 aa, Homo Sapiens
DDSNLKRVT

SEQ ID NO: 714760 - protein, 9 aa, Homo Sapiens
DLFLSCDKE

SEQ ID NO: 714761 - protein, 9 aa, Homo Sapiens
FSYADLLTK

SEQ ID NO: 714762 - protein, 9 aa, Homo Sapiens
TLYVTGGRR

SEQ ID NO: 714763 - protein, 9 aa, Homo Sapiens
SAYRGIKVR

SEQ ID NO: 714764 - protein, 9 aa, Homo Sapiens
KKKNNGPIA

SEQ ID NO: 714765 - protein, 9 aa, Homo Sapiens
KELGEGQHL

SEQ ID NO: 714766 - protein, 9 aa, Homo Sapiens
EGVERYITD

SEQ ID NO: 714767 - protein, 9 aa, Homo Sapiens
SHLVAVKSQ

SEQ ID NO: 714768 - protein, 9 aa, Homo Sapiens
AARRQVEVR

SEQ ID NO: 714769 - protein, 9 aa, Homo Sapiens
SDNLGWCVV

SEQ ID NO: 714770 - protein, 9 aa, Homo Sapiens
SLELVPIPA

SEQ ID NO: 714771 - protein, 9 aa, Homo Sapiens
LQIVVGVPD

SEQ ID NO: 714772 - protein, 9 aa, Homo Sapiens
TGVIRTALL

SEQ ID NO: 714773 - protein, 9 aa, Homo Sapiens
PQGVPPGWA

SEQ ID NO: 714774 - protein, 9 aa, Homo Sapiens
VSGANPLLR

SEQ ID NO: 714775 - protein, 9 aa, Homo Sapiens
GPNDIPFFA

SEQ ID NO: 714776 - protein, 9 aa, Homo Sapiens
VQNGLLKPT

SEQ ID NO: 714777 - protein, 9 aa, Homo Sapiens
QSAPDLSPE

SEQ ID NO: 714778 - protein, 9 aa, Homo Sapiens
GKGFTVKHT

SEQ ID NO: 714779 - protein, 9 aa, Homo Sapiens
NSLRDAAPK

SEQ ID NO: 714780 - protein, 9 aa, Homo Sapiens
LALCLATIG

SEQ ID NO: 714781 - protein, 9 aa, Homo Sapiens
SQTTNVVSG

SEQ ID NO: 714782 - protein, 9 aa, Homo Sapiens
CMLWGHTEV

SEQ ID NO: 714783 - protein, 9 aa, Homo Sapiens
HKSKKKNNG

SEQ ID NO: 714784 - protein, 9 aa, Homo Sapiens
QRSPTVSRS

SEQ ID NO: 714785 - protein, 9 aa, Homo Sapiens
TAMVSVILK

SEQ ID NO: 714786 - protein, 9 aa, Homo Sapiens
PCPVCQKTS

SEQ ID NO: 714787 - protein, 9 aa, Homo Sapiens
PGRSESLEH

SEQ ID NO: 714788 - protein, 9 aa, Homo Sapiens
LGFRSFVPD

SEQ ID NO: 714789 - protein, 9 aa, Homo Sapiens
VSDPTVGVY

SEQ ID NO: 714790 - protein, 9 aa, Homo Sapiens
AAIEEANRI

SEQ ID NO: 714791 - protein, 9 aa, Homo Sapiens
SRPRTGTRA

SEQ ID NO: 714792 - protein, 9 aa, Homo Sapiens
QSLALAKHL

SEQ ID NO: 714793 - protein, 9 aa, Homo Sapiens
EIETILKFL

SEQ ID NO: 714794 - protein, 9 aa, Homo Sapiens
GQEEDDLAL

SEQ ID NO: 714795 - protein, 9 aa, Homo Sapiens
KILENSQPV

SEQ ID NO: 714796 - protein, 9 aa, Homo Sapiens
HFWVTILPP

SEQ ID NO: 714797 - protein, 9 aa, Homo Sapiens
ATVMGNTLY

SEQ ID NO: 714798 - protein, 9 aa, Homo Sapiens
HTTVSTLMS

SEQ ID NO: 714799 - protein, 9 aa, Homo Sapiens
ISIVGYLSI

SEQ ID NO: 714800 - protein, 9 aa, Homo Sapiens
MTHSRKDMN

SEQ ID NO: 714801 - protein, 9 aa, Homo Sapiens
LHNTLWGML

SEQ ID NO: 714802 - protein, 9 aa, Homo Sapiens
VPEDKEDYT

SEQ ID NO: 714803 - protein, 9 aa, Homo Sapiens
GNGAVQLPE

SEQ ID NO: 714804 - protein, 9 aa, Homo Sapiens
TPRSYLDSS

SEQ ID NO: 714805 - protein, 9 aa, Homo Sapiens
GAVQLPEQQ

SEQ ID NO: 714806 - protein, 9 aa, Homo Sapiens
QSSHLSRHH

SEQ ID NO: 714807 - protein, 9 aa, Homo Sapiens
QEEDDLALC

SEQ ID NO: 714808 - protein, 9 aa, Homo Sapiens
AWGTTPQER

SEQ ID NO: 714809 - protein, 9 aa, Homo Sapiens
KSMEFAPSK

SEQ ID NO: 714810 - protein, 9 aa, Homo Sapiens
NKFPYAKKQ

SEQ ID NO: 714811 - protein, 9 aa, Homo Sapiens
PTLPNFSAL

SEQ ID NO: 714812 - protein, 9 aa, Homo Sapiens
LVSRSNQSP

SEQ ID NO: 714813 - protein, 9 aa, Homo Sapiens
LLHVIFGGT

SEQ ID NO: 714814 - protein, 9 aa, Homo Sapiens
KINHQDSMS

SEQ ID NO: 714815 - protein, 9 aa, Homo Sapiens
CMSSQTTNV

SEQ ID NO: 714816 - protein, 9 aa, Homo Sapiens
SEKRKKKKK

SEQ ID NO: 714817 - protein, 9 aa, Homo Sapiens
AAGQTNSNA

SEQ ID NO: 714818 - protein, 9 aa, Homo Sapiens
ADLENYTCH

SEQ ID NO: 714819 - protein, 9 aa, Homo Sapiens
FEVWHGNED

SEQ ID NO: 714820 - protein, 9 aa, Homo Sapiens
VLEVSKADG

SEQ ID NO: 714821 - protein, 9 aa, Homo Sapiens
VQIKLVIQT

SEQ ID NO: 714822 - protein, 9 aa, Homo Sapiens
KPNGIIQYC

SEQ ID NO: 714823 - protein, 9 aa, Homo Sapiens
ECHVKKVNK

SEQ ID NO: 714824 - protein, 9 aa, Homo Sapiens
RQGDINASY

SEQ ID NO: 714825 - protein, 9 aa, Homo Sapiens
VSSPDNAMV

SEQ ID NO: 714826 - protein, 9 aa, Homo Sapiens
RWAEMTRAL

SEQ ID NO: 714827 - protein, 9 aa, Homo Sapiens
YPEHVSEEL

SEQ ID NO: 714828 - protein, 9 aa, Homo Sapiens
CKEKPMLVD

SEQ ID NO: 714829 - protein, 9 aa, Homo Sapiens
GTVSASPET

SEQ ID NO: 714830 - protein, 9 aa, Homo Sapiens
SSCRLSALP

SEQ ID NO: 714831 - protein, 9 aa, Homo Sapiens
CEQPLGFRS

SEQ ID NO: 714832 - protein, 9 aa, Homo Sapiens
SVVEADLEN

SEQ ID NO: 714833 - protein, 9 aa, Homo Sapiens
HTEMIKKEE

SEQ ID NO: 714834 - protein, 9 aa, Homo Sapiens
LPIHPIIYN

SEQ ID NO: 714835 - protein, 9 aa, Homo Sapiens
LRWAEMTRA

SEQ ID NO: 714836 - protein, 9 aa, Homo Sapiens
LASGPEACK

SEQ ID NO: 714837 - protein, 9 aa, Homo Sapiens
SPEILTPPV

SEQ ID NO: 714838 - protein, 9 aa, Homo Sapiens
SDGINGLYQ

SEQ ID NO: 714839 - protein, 9 aa, Homo Sapiens
IRSLSAQKA

SEQ ID NO: 714840 - protein, 9 aa, Homo Sapiens
LNQRAQAFL

SEQ ID NO: 714841 - protein, 9 aa, Homo Sapiens
GRSHRLPQE

SEQ ID NO: 714842 - protein, 9 aa, Homo Sapiens
KFCPLTVNS

SEQ ID NO: 714843 - protein, 9 aa, Homo Sapiens
EQLQEYLQP

SEQ ID NO: 714844 - protein, 9 aa, Homo Sapiens
TAGKEEYSA

SEQ ID NO: 714845 - protein, 9 aa, Homo Sapiens
TLNQRAQAF

SEQ ID NO: 714846 - protein, 9 aa, Homo Sapiens
VLAASLTPL

SEQ ID NO: 714847 - protein, 9 aa, Homo Sapiens
MKEAQTQRL

SEQ ID NO: 714848 - protein, 9 aa, Homo Sapiens
SCFLDGYPL

SEQ ID NO: 714849 - protein, 9 aa, Homo Sapiens
NCMSSQTTN

SEQ ID NO: 714850 - protein, 9 aa, Homo Sapiens
LEEPQLRLE

SEQ ID NO: 714851 - protein, 9 aa, Homo Sapiens
SAIPNQTAV

SEQ ID NO: 714852 - protein, 9 aa, Homo Sapiens
SSSFCIIPF

SEQ ID NO: 714853 - protein, 9 aa, Homo Sapiens
QSSADNLTP

SEQ ID NO: 714854 - protein, 9 aa, Homo Sapiens
DPAQQNLCR

SEQ ID NO: 714855 - protein, 9 aa, Homo Sapiens
ASRSEVSNY

SEQ ID NO: 714856 - protein, 9 aa, Homo Sapiens
LELVPIPAG

SEQ ID NO: 714857 - protein, 9 aa, Homo Sapiens
TFHVVKVYN

SEQ ID NO: 714858 - protein, 9 aa, Homo Sapiens
AAQAAGQTN

SEQ ID NO: 714859 - protein, 9 aa, Homo Sapiens
EYLQPMPEH

SEQ ID NO: 714860 - protein, 9 aa, Homo Sapiens
ALLPVALKS

SEQ ID NO: 714861 - protein, 9 aa, Homo Sapiens
NNGPIAGKS

SEQ ID NO: 714862 - protein, 9 aa, Homo Sapiens
EKLHFMDMQ

SEQ ID NO: 714863 - protein, 9 aa, Homo Sapiens
LSAIAESSG

SEQ ID NO: 714864 - protein, 9 aa, Homo Sapiens
DTRTKRGRV

SEQ ID NO: 714865 - protein, 9 aa, Homo Sapiens
ISEHVEERL

SEQ ID NO: 714866 - protein, 9 aa, Homo Sapiens
MNTLIYSLR

SEQ ID NO: 714867 - protein, 9 aa, Homo Sapiens
SAAQAAGQT

SEQ ID NO: 714868 - protein, 9 aa, Homo Sapiens
EGLYKFTLY

SEQ ID NO: 714869 - protein, 9 aa, Homo Sapiens
DNDNEYTTK

SEQ ID NO: 714870 - protein, 9 aa, Homo Sapiens
REIETILKF

SEQ ID NO: 714871 - protein, 9 aa, Homo Sapiens
AVSRVLAAS

SEQ ID NO: 714872 - protein, 9 aa, Homo Sapiens
VEADLENYT

SEQ ID NO: 714873 - protein, 9 aa, Homo Sapiens
DHLSCDTKE

SEQ ID NO: 714874 - protein, 9 aa, Homo Sapiens
QRHRALGFG

SEQ ID NO: 714875 - protein, 9 aa, Homo Sapiens
VVEADLENY

SEQ ID NO: 714876 - protein, 9 aa, Homo Sapiens
FQVHPFYVY

SEQ ID NO: 714877 - protein, 9 aa, Homo Sapiens
RLAANENGK

SEQ ID NO: 714878 - protein, 9 aa, Homo Sapiens
KKQCSILYS

SEQ ID NO: 714879 - protein, 9 aa, Homo Sapiens
VHSGVSHKP

SEQ ID NO: 714880 - protein, 9 aa, Homo Sapiens
PETFRNLAC

SEQ ID NO: 714881 - protein, 9 aa, Homo Sapiens
WGMLCPAET

SEQ ID NO: 714882 - protein, 9 aa, Homo Sapiens
TKRGRVARP

SEQ ID NO: 714883 - protein, 9 aa, Homo Sapiens
TCGRPAVPV

SEQ ID NO: 714884 - protein, 9 aa, Homo Sapiens
DSSGNLLVR

SEQ ID NO: 714885 - protein, 9 aa, Homo Sapiens
QFKPGSWGR

SEQ ID NO: 714886 - protein, 9 aa, Homo Sapiens
VIEGVQNLF

SEQ ID NO: 714887 - protein, 9 aa, Homo Sapiens
KFYPEHVSE

SEQ ID NO: 714888 - protein, 9 aa, Homo Sapiens
LGLPGRSES

SEQ ID NO: 714889 - protein, 9 aa, Homo Sapiens
YFFSRLVEI

SEQ ID NO: 714890 - protein, 9 aa, Homo Sapiens
DKEEMMREA

SEQ ID NO: 714891 - protein, 9 aa, Homo Sapiens
SSSSRPRTG

SEQ ID NO: 714892 - protein, 9 aa, Homo Sapiens
LSPDLSQMP

SEQ ID NO: 714893 - protein, 9 aa, Homo Sapiens
LGQHMKSNL

SEQ ID NO: 714894 - protein, 9 aa, Homo Sapiens
LLIIIAIYA

SEQ ID NO: 714895 - protein, 9 aa, Homo Sapiens
AGYDQCDAG

SEQ ID NO: 714896 - protein, 9 aa, Homo Sapiens
LRPVDPQIS

SEQ ID NO: 714897 - protein, 9 aa, Homo Sapiens
SFCIIPFLE

SEQ ID NO: 714898 - protein, 9 aa, Homo Sapiens
YTPQAAAWG

SEQ ID NO: 714899 - protein, 9 aa, Homo Sapiens
RCSSTPCSS

SEQ ID NO: 714900 - protein, 9 aa, Homo Sapiens
GPSLPKDLH

SEQ ID NO: 714901 - protein, 9 aa, Homo Sapiens
LPGRSESLE

SEQ ID NO: 714902 - protein, 9 aa, Homo Sapiens
QSAGLILHH

SEQ ID NO: 714903 - protein, 9 aa, Homo Sapiens
HGGDDGASR

SEQ ID NO: 714904 - protein, 9 aa, Homo Sapiens
SQTWSAQED

SEQ ID NO: 714905 - protein, 9 aa, Homo Sapiens
RQDNRVATG

SEQ ID NO: 714906 - protein, 9 aa, Homo Sapiens
ADDSNLKRV

SEQ ID NO: 714907 - protein, 9 aa, Homo Sapiens
ETCSSEIPD

SEQ ID NO: 714908 - protein, 9 aa, Homo Sapiens
GFFAFPVTY

SEQ ID NO: 714909 - protein, 9 aa, Homo Sapiens
LDTAGKEEY

SEQ ID NO: 714910 - protein, 9 aa, Homo Sapiens
IVFCFWGGT

SEQ ID NO: 714911 - protein, 9 aa, Homo Sapiens
NGPIAGKSK

SEQ ID NO: 714912 - protein, 9 aa, Homo Sapiens
VERYITDAH

SEQ ID NO: 714913 - protein, 9 aa, Homo Sapiens
NVQLTNPQL

SEQ ID NO: 714914 - protein, 9 aa, Homo Sapiens
YLQPMPEHD

SEQ ID NO: 714915 - protein, 9 aa, Homo Sapiens
TQAEAVTEA

SEQ ID NO: 714916 - protein, 9 aa, Homo Sapiens
QKYLEAMSV

SEQ ID NO: 714917 - protein, 9 aa, Homo Sapiens
SRSNQSPSH

SEQ ID NO: 714918 - protein, 9 aa, Homo Sapiens
GGCGGFGGG

SEQ ID NO: 714919 - protein, 9 aa, Homo Sapiens
VDPQISHLV

SEQ ID NO: 714920 - protein, 9 aa, Homo Sapiens
ESEKRKKKK

SEQ ID NO: 714921 - protein, 9 aa, Homo Sapiens
ANVQLTNPQ

SEQ ID NO: 714922 - protein, 9 aa, Homo Sapiens
WVTILPPKK

SEQ ID NO: 714923 - protein, 9 aa, Homo Sapiens
IRNVRFSDK

SEQ ID NO: 714924 - protein, 9 aa, Homo Sapiens
GRLIAANFS

SEQ ID NO: 714925 - protein, 9 aa, Homo Sapiens
YANSLRDAA

SEQ ID NO: 714926 - protein, 9 aa, Homo Sapiens
RLAPPPVIN

SEQ ID NO: 714927 - protein, 9 aa, Homo Sapiens
LPEQQQHSH

SEQ ID NO: 714928 - protein, 9 aa, Homo Sapiens
HIPIYSFHG

SEQ ID NO: 714929 - protein, 9 aa, Homo Sapiens
VLRKPSEEF

SEQ ID NO: 714930 - protein, 9 aa, Homo Sapiens
EDSSGNLLV

SEQ ID NO: 714931 - protein, 9 aa, Homo Sapiens
EDISERLEE

SEQ ID NO: 714932 - protein, 9 aa, Homo Sapiens
LVQRGSEDF

SEQ ID NO: 714933 - protein, 9 aa, Homo Sapiens
QTWSAQEDS

SEQ ID NO: 714934 - protein, 9 aa, Homo Sapiens
RTGTRAVSR

SEQ ID NO: 714935 - protein, 9 aa, Homo Sapiens
QNNTAMVSV

SEQ ID NO: 714936 - protein, 9 aa, Homo Sapiens
PLHEVPIGN

SEQ ID NO: 714937 - protein, 9 aa, Homo Sapiens
PKDHPFTCD

SEQ ID NO: 714938 - protein, 9 aa, Homo Sapiens
PKRIRISQE

SEQ ID NO: 714939 - protein, 9 aa, Homo Sapiens
NGLLKPTLK

SEQ ID NO: 714940 - protein, 9 aa, Homo Sapiens
CQHSCLKKL

SEQ ID NO: 714941 - protein, 9 aa, Homo Sapiens
LFTDGVAAL

SEQ ID NO: 714942 - protein, 9 aa, Homo Sapiens
IVQASNVHV

SEQ ID NO: 714943 - protein, 9 aa, Homo Sapiens
DLSPEILTP

SEQ ID NO: 714944 - protein, 9 aa, Homo Sapiens
GKTQAEAVT

SEQ ID NO: 714945 - protein, 9 aa, Homo Sapiens
DGEGEVEEE

SEQ ID NO: 714946 - protein, 9 aa, Homo Sapiens
AGAGGGCGG

SEQ ID NO: 714947 - protein, 9 aa, Homo Sapiens
EERKDPLLA

SEQ ID NO: 714948 - protein, 9 aa, Homo Sapiens
MISIVGYLS

SEQ ID NO: 714949 - protein, 9 aa, Homo Sapiens
EEIKEGECH

SEQ ID NO: 714950 - protein, 9 aa, Homo Sapiens
KAVKQLGTE

SEQ ID NO: 714951 - protein, 9 aa, Homo Sapiens
VQRGSEDFD

SEQ ID NO: 714952 - protein, 9 aa, Homo Sapiens
GFRSFVPDK

SEQ ID NO: 714953 - protein, 9 aa, Homo Sapiens
NELRQNMAV

SEQ ID NO: 714954 - protein, 9 aa, Homo Sapiens
SSQTTNVVS

SEQ ID NO: 714955 - protein, 9 aa, Homo Sapiens
EPLYPRSKV

SEQ ID NO: 714956 - protein, 9 aa, Homo Sapiens
YDALNESKP

SEQ ID NO: 714957 - protein, 9 aa, Homo Sapiens
DQSSGRLWA

SEQ ID NO: 714958 - protein, 9 aa, Homo Sapiens
PKREIETIL

SEQ ID NO: 714959 - protein, 9 aa, Homo Sapiens
GSGIKVNGD

SEQ ID NO: 714960 - protein, 9 aa, Homo Sapiens
QQLLGNVQE

SEQ ID NO: 714961 - protein, 9 aa, Homo Sapiens
HLLAAASWV

SEQ ID NO: 714962 - protein, 9 aa, Homo Sapiens
LTVNSLNCL

SEQ ID NO: 714963 - protein, 9 aa, Homo Sapiens
SEHVEERLA

SEQ ID NO: 714964 - protein, 9 aa, Homo Sapiens
LALFADHQW

SEQ ID NO: 714965 - protein, 9 aa, Homo Sapiens
AAAWGTTPQ

SEQ ID NO: 714966 - protein, 9 aa, Homo Sapiens
FSDKGGFTC

SEQ ID NO: 714967 - protein, 9 aa, Homo Sapiens
FVYLAHPQA

SEQ ID NO: 714968 - protein, 9 aa, Homo Sapiens
AVTLAVLQR

SEQ ID NO: 714969 - protein, 9 aa, Homo Sapiens
SMEFAPSKG

SEQ ID NO: 714970 - protein, 9 aa, Homo Sapiens
NNQFVLYLI

SEQ ID NO: 714971 - protein, 9 aa, Homo Sapiens
PPAVKQNVR

SEQ ID NO: 714972 - protein, 9 aa, Homo Sapiens
RQNMAVYVG

SEQ ID NO: 714973 - protein, 9 aa, Homo Sapiens
QMPLFADLS

SEQ ID NO: 714974 - protein, 9 aa, Homo Sapiens
IPKEIREDD

SEQ ID NO: 714975 - protein, 9 aa, Homo Sapiens
GSWGRVGFP

SEQ ID NO: 714976 - protein, 9 aa, Homo Sapiens
YLITEATKT

SEQ ID NO: 714977 - protein, 9 aa, Homo Sapiens
RIVDKAVKQ

SEQ ID NO: 714978 - protein, 9 aa, Homo Sapiens
PVTYAIAPG

SEQ ID NO: 714979 - protein, 9 aa, Homo Sapiens
ISKGQQKAL

SEQ ID NO: 714980 - protein, 9 aa, Homo Sapiens
CSSMRRTVS

SEQ ID NO: 714981 - protein, 9 aa, Homo Sapiens
PNFSALSVP

SEQ ID NO: 714982 - protein, 9 aa, Homo Sapiens
VQNLFAEEG

SEQ ID NO: 714983 - protein, 9 aa, Homo Sapiens
EVEMGPFKL

SEQ ID NO: 714984 - protein, 9 aa, Homo Sapiens
SGVGCVLYD

SEQ ID NO: 714985 - protein, 9 aa, Homo Sapiens
VSVMTEGST

SEQ ID NO: 714986 - protein, 9 aa, Homo Sapiens
CRDSLDEIN

SEQ ID NO: 714987 - protein, 9 aa, Homo Sapiens
CFSYADLLT

SEQ ID NO: 714988 - protein, 9 aa, Homo Sapiens
KKLYRDVMP

SEQ ID NO: 714989 - protein, 9 aa, Homo Sapiens
ACQACPQGL

SEQ ID NO: 714990 - protein, 9 aa, Homo Sapiens
NILGAFCNM

SEQ ID NO: 714991 - protein, 9 aa, Homo Sapiens
FRSFVPDKG

SEQ ID NO: 714992 - protein, 9 aa, Homo Sapiens
TRTKRGRVA

SEQ ID NO: 714993 - protein, 9 aa, Homo Sapiens
YCSVYYRNT

SEQ ID NO: 714994 - protein, 9 aa, Homo Sapiens
EEEIPKEIR

SEQ ID NO: 714995 - protein, 9 aa, Homo Sapiens
FCNMNDVEV

SEQ ID NO: 714996 - protein, 9 aa, Homo Sapiens
NSKRYKQAQ

SEQ ID NO: 714997 - protein, 9 aa, Homo Sapiens
MEQRSQMLQ

SEQ ID NO: 714998 - protein, 9 aa, Homo Sapiens
DSLLHVIFG

SEQ ID NO: 714999 - protein, 9 aa, Homo Sapiens
EIRSLSAQK

SEQ ID NO: 715000 - protein, 9 aa, Homo Sapiens
WGISDEKVL

SEQ ID NO: 715001 - protein, 9 aa, Homo Sapiens
KDFEVWHGN

SEQ ID NO: 715002 - protein, 9 aa, Homo Sapiens
KGTPRSYLD

SEQ ID NO: 715003 - protein, 9 aa, Homo Sapiens
DNFCKAVSG

SEQ ID NO: 715004 - protein, 9 aa, Homo Sapiens
APRKQRRKR

SEQ ID NO: 715005 - protein, 9 aa, Homo Sapiens
AAASWVIGF

SEQ ID NO: 715006 - protein, 9 aa, Homo Sapiens
KDKFCPLTV

SEQ ID NO: 715007 - protein, 9 aa, Homo Sapiens
RPPKRIRIS

SEQ ID NO: 715008 - protein, 9 aa, Homo Sapiens
KGAGAGGGC

SEQ ID NO: 715009 - protein, 9 aa, Homo Sapiens
REQVRAKLN

SEQ ID NO: 715010 - protein, 9 aa, Homo Sapiens
CFNCALGSS

SEQ ID NO: 715011 - protein, 9 aa, Homo Sapiens
RSPTVSRSR

SEQ ID NO: 715012 - protein, 9 aa, Homo Sapiens
HPSLSPACW

SEQ ID NO: 715013 - protein, 9 aa, Homo Sapiens
TNAEKHSQV

SEQ ID NO: 715014 - protein, 9 aa, Homo Sapiens
LLKPTLKAK

SEQ ID NO: 715015 - protein, 9 aa, Homo Sapiens
KTIPYERSS

SEQ ID NO: 715016 - protein, 9 aa, Homo Sapiens
RGCITHLFF

SEQ ID NO: 715017 - protein, 9 aa, Homo Sapiens
PVCQKTSRY

SEQ ID NO: 715018 - protein, 9 aa, Homo Sapiens
LPEGGSGRG

SEQ ID NO: 715019 - protein, 9 aa, Homo Sapiens
GANPLLRVF

SEQ ID NO: 715020 - protein, 9 aa, Homo Sapiens
IIYNFVRYY

SEQ ID NO: 715021 - protein, 9 aa, Homo Sapiens
SCDKEPQTT

SEQ ID NO: 715022 - protein, 9 aa, Homo Sapiens
IVNGAKKHI

SEQ ID NO: 715023 - protein, 9 aa, Homo Sapiens
NTLIYSLRN

SEQ ID NO: 715024 - protein, 9 aa, Homo Sapiens
KKFFSAFSR

SEQ ID NO: 715025 - protein, 9 aa, Homo Sapiens
PAVKQNVRK

SEQ ID NO: 715026 - protein, 9 aa, Homo Sapiens
LCILAINSL

SEQ ID NO: 715027 - protein, 9 aa, Homo Sapiens
RKSSVKYSA

SEQ ID NO: 715028 - protein, 9 aa, Homo Sapiens
SGCRQSLGH

SEQ ID NO: 715029 - protein, 9 aa, Homo Sapiens
LTKEQLQEY

SEQ ID NO: 715030 - protein, 9 aa, Homo Sapiens
DKRCCYLRE

SEQ ID NO: 715031 - protein, 9 aa, Homo Sapiens
KEDYTAQST

SEQ ID NO: 715032 - protein, 9 aa, Homo Sapiens
KSAAQAAGQ

SEQ ID NO: 715033 - protein, 9 aa, Homo Sapiens
FSRVGSKKE

SEQ ID NO: 715034 - protein, 9 aa, Homo Sapiens
QVRAKLNRE

SEQ ID NO: 715035 - protein, 9 aa, Homo Sapiens
AHPQAVTGF

SEQ ID NO: 715036 - protein, 9 aa, Homo Sapiens
SLDEINCTE

SEQ ID NO: 715037 - protein, 9 aa, Homo Sapiens
RTKRGRVAR

SEQ ID NO: 715038 - protein, 9 aa, Homo Sapiens
GYLSILTLV

SEQ ID NO: 715039 - protein, 9 aa, Homo Sapiens
MLCPAETPE

SEQ ID NO: 715040 - protein, 9 aa, Homo Sapiens
KLWSKNVSL

SEQ ID NO: 715041 - protein, 9 aa, Homo Sapiens
GRDPECQHT

SEQ ID NO: 715042 - protein, 9 aa, Homo Sapiens
KQCSILYSD

SEQ ID NO: 715043 - protein, 9 aa, Homo Sapiens
ASNVHVKMT

SEQ ID NO: 715044 - protein, 9 aa, Homo Sapiens
QIKLVIQTL

SEQ ID NO: 715045 - protein, 9 aa, Homo Sapiens
RKAFSYLSN

SEQ ID NO: 715046 - protein, 9 aa, Homo Sapiens
KVNGDCSPI

SEQ ID NO: 715047 - protein, 9 aa, Homo Sapiens
ARLSAIAES

SEQ ID NO: 715048 - protein, 9 aa, Homo Sapiens
HPTKSHSFQ

SEQ ID NO: 715049 - protein, 9 aa, Homo Sapiens
VRNSFEVRV

SEQ ID NO: 715050 - protein, 9 aa, Homo Sapiens
PYEKILHVV

SEQ ID NO: 715051 - protein, 9 aa, Homo Sapiens
QASNVHVKM

SEQ ID NO: 715052 - protein, 9 aa, Homo Sapiens
GQHLWEIKM

SEQ ID NO: 715053 - protein, 9 aa, Homo Sapiens
KKACQFKSS

SEQ ID NO: 715054 - protein, 9 aa, Homo Sapiens
VKIKASKSP

SEQ ID NO: 715055 - protein, 9 aa, Homo Sapiens
SSLLGFPQN

SEQ ID NO: 715056 - protein, 9 aa, Homo Sapiens
KVLEVSKAD

SEQ ID NO: 715057 - protein, 9 aa, Homo Sapiens
HFETSKLAG

SEQ ID NO: 715058 - protein, 9 aa, Homo Sapiens
PDSGSPPLH

SEQ ID NO: 715059 - protein, 9 aa, Homo Sapiens
IKVRKRIKD

SEQ ID NO: 715060 - protein, 9 aa, Homo Sapiens
NASYFLALV

SEQ ID NO: 715061 - protein, 9 aa, Homo Sapiens
FRNEADLQV

SEQ ID NO: 715062 - protein, 9 aa, Homo Sapiens
TNVVSGVLF

SEQ ID NO: 715063 - protein, 9 aa, Homo Sapiens
INSLEFQYR

SEQ ID NO: 715064 - protein, 9 aa, Homo Sapiens
KTLLALFAD

SEQ ID NO: 715065 - protein, 9 aa, Homo Sapiens
LRRRTHSDG

SEQ ID NO: 715066 - protein, 9 aa, Homo Sapiens
EIKCMPPEK

SEQ ID NO: 715067 - protein, 9 aa, Homo Sapiens
GQQKALVSF

SEQ ID NO: 715068 - protein, 9 aa, Homo Sapiens
FDLGSGIKV

SEQ ID NO: 715069 - protein, 9 aa, Homo Sapiens
EITLDTATA

SEQ ID NO: 715070 - protein, 9 aa, Homo Sapiens
SQGHMRGGS

SEQ ID NO: 715071 - protein, 9 aa, Homo Sapiens
FCIIPFLET

SEQ ID NO: 715072 - protein, 9 aa, Homo Sapiens
YSPIPYTPS

SEQ ID NO: 715073 - protein, 9 aa, Homo Sapiens
SFSPVMPTS

SEQ ID NO: 715074 - protein, 9 aa, Homo Sapiens
EGECHVKKV

SEQ ID NO: 715075 - protein, 9 aa, Homo Sapiens
EGLRRLDGP

SEQ ID NO: 715076 - protein, 9 aa, Homo Sapiens
QMLQHMRLS

SEQ ID NO: 715077 - protein, 9 aa, Homo Sapiens
IRKSSVKYS

SEQ ID NO: 715078 - protein, 9 aa, Homo Sapiens
RLSAIAESS

SEQ ID NO: 715079 - protein, 9 aa, Homo Sapiens
VMTEGSTPG

SEQ ID NO: 715080 - protein, 9 aa, Homo Sapiens
LWGMLCPAE

SEQ ID NO: 715081 - protein, 9 aa, Homo Sapiens
VIDINDHSA

SEQ ID NO: 715082 - protein, 9 aa, Homo Sapiens
LVPIPAGEE

SEQ ID NO: 715083 - protein, 9 aa, Homo Sapiens
ACNWDFRNE

SEQ ID NO: 715084 - protein, 9 aa, Homo Sapiens
HPFTCDDPR

SEQ ID NO: 715085 - protein, 9 aa, Homo Sapiens
LIQKAADDS

SEQ ID NO: 715086 - protein, 9 aa, Homo Sapiens
PTVGVYFFS

SEQ ID NO: 715087 - protein, 9 aa, Homo Sapiens
FPVTYAIAP

SEQ ID NO: 715088 - protein, 9 aa, Homo Sapiens
ELGEGQHLW

SEQ ID NO: 715089 - protein, 9 aa, Homo Sapiens
PLSGVGCVL

SEQ ID NO: 715090 - protein, 9 aa, Homo Sapiens
TITPPAVKQ

SEQ ID NO: 715091 - protein, 9 aa, Homo Sapiens
RSNQSPSHS

SEQ ID NO: 715092 - protein, 9 aa, Homo Sapiens
EPRSPLITR

SEQ ID NO: 715093 - protein, 9 aa, Homo Sapiens
SEDFDDFNL

SEQ ID NO: 715094 - protein, 9 aa, Homo Sapiens
LLNMDREAR

SEQ ID NO: 715095 - protein, 9 aa, Homo Sapiens
GGPKDHPFT

SEQ ID NO: 715096 - protein, 9 aa, Homo Sapiens
DMNSFSPVM

SEQ ID NO: 715097 - protein, 9 aa, Homo Sapiens
RPVDPQISH

SEQ ID NO: 715098 - protein, 9 aa, Homo Sapiens
ILPPKKKYP

SEQ ID NO: 715099 - protein, 9 aa, Homo Sapiens
VGVPDSGSP

SEQ ID NO: 715100 - protein, 9 aa, Homo Sapiens
LIIIAIYAL

SEQ ID NO: 715101 - protein, 9 aa, Homo Sapiens
DINDHSAVF

SEQ ID NO: 715102 - protein, 9 aa, Homo Sapiens
IVDKAVKQL

SEQ ID NO: 715103 - protein, 9 aa, Homo Sapiens
ESDVRELVR

SEQ ID NO: 715104 - protein, 9 aa, Homo Sapiens
KLAVLLIII

SEQ ID NO: 715105 - protein, 9 aa, Homo Sapiens
ACPQGLYKS

SEQ ID NO: 715106 - protein, 9 aa, Homo Sapiens
KNLDVQTNA

SEQ ID NO: 715107 - protein, 9 aa, Homo Sapiens
SSSPAKPHT

SEQ ID NO: 715108 - protein, 9 aa, Homo Sapiens
SPDNAMVSP

SEQ ID NO: 715109 - protein, 9 aa, Homo Sapiens
TNLSPDLSQ

SEQ ID NO: 715110 - protein, 9 aa, Homo Sapiens
CIFHFNGKV

SEQ ID NO: 715111 - protein, 9 aa, Homo Sapiens
LCIFHFNGK

SEQ ID NO: 715112 - protein, 9 aa, Homo Sapiens
AILGQHMKS

SEQ ID NO: 715113 - protein, 9 aa, Homo Sapiens
ITHLFFLHF

SEQ ID NO: 715114 - protein, 9 aa, Homo Sapiens
LDPAQQNLC

SEQ ID NO: 715115 - protein, 9 aa, Homo Sapiens
DNLTPSVTS

SEQ ID NO: 715116 - protein, 9 aa, Homo Sapiens
RSEVSNYHI

SEQ ID NO: 715117 - protein, 9 aa, Homo Sapiens
RPRTVYSPI

SEQ ID NO: 715118 - protein, 9 aa, Homo Sapiens
NGLYQGFNV

SEQ ID NO: 715119 - protein, 9 aa, Homo Sapiens
EIPDFGLLV

SEQ ID NO: 715120 - protein, 9 aa, Homo Sapiens
VAALEFADF

SEQ ID NO: 715121 - protein, 9 aa, Homo Sapiens
ARISALVLP

SEQ ID NO: 715122 - protein, 9 aa, Homo Sapiens
AMLDNEANG

SEQ ID NO: 715123 - protein, 9 aa, Homo Sapiens
APLSGVGCV

SEQ ID NO: 715124 - protein, 9 aa, Homo Sapiens
KAARRQVEV

SEQ ID NO: 715125 - protein, 9 aa, Homo Sapiens
SKNVSLAGK

SEQ ID NO: 715126 - protein, 9 aa, Homo Sapiens
MDHLSCDTK

SEQ ID NO: 715127 - protein, 9 aa, Homo Sapiens
LVDAQEYLV

SEQ ID NO: 715128 - protein, 9 aa, Homo Sapiens
PIYSFHGRD

SEQ ID NO: 715129 - protein, 9 aa, Homo Sapiens
AVPVLGFCR

SEQ ID NO: 715130 - protein, 9 aa, Homo Sapiens
CESKCQHSC

SEQ ID NO: 715131 - protein, 9 aa, Homo Sapiens
KQTSNPERN

SEQ ID NO: 715132 - protein, 9 aa, Homo Sapiens
GLPGRSESL

SEQ ID NO: 715133 - protein, 9 aa, Homo Sapiens
PHVKCQTKK

SEQ ID NO: 715134 - protein, 9 aa, Homo Sapiens
VINRRTFQG

SEQ ID NO: 715135 - protein, 9 aa, Homo Sapiens
DYKEGDNSL

SEQ ID NO: 715136 - protein, 9 aa, Homo Sapiens
EKILHVVGE

SEQ ID NO: 715137 - protein, 9 aa, Homo Sapiens
YRGCITHLF

SEQ ID NO: 715138 - protein, 9 aa, Homo Sapiens
KEIREDDLP

SEQ ID NO: 715139 - protein, 9 aa, Homo Sapiens
LQWSQDLRR

SEQ ID NO: 715140 - protein, 9 aa, Homo Sapiens
VEVPEDKED

SEQ ID NO: 715141 - protein, 9 aa, Homo Sapiens
IHSNGGTVI

SEQ ID NO: 715142 - protein, 9 aa, Homo Sapiens
WDILPNANW

SEQ ID NO: 715143 - protein, 9 aa, Homo Sapiens
PEHVSEELI

SEQ ID NO: 715144 - protein, 9 aa, Homo Sapiens
RSESLEHQV

SEQ ID NO: 715145 - protein, 9 aa, Homo Sapiens
TPCSSMRRT

SEQ ID NO: 715146 - protein, 9 aa, Homo Sapiens
NFCKAVSGA

SEQ ID NO: 715147 - protein, 9 aa, Homo Sapiens
SYRGCITHL

SEQ ID NO: 715148 - protein, 9 aa, Homo Sapiens
FYVYSRLPC

SEQ ID NO: 715149 - protein, 9 aa, Homo Sapiens
ALIALAVKM

SEQ ID NO: 715150 - protein, 9 aa, Homo Sapiens
GRDSPVNTL

SEQ ID NO: 715151 - protein, 9 aa, Homo Sapiens
LLLLLGAHG

SEQ ID NO: 715152 - protein, 9 aa, Homo Sapiens
TQPGYANSL

SEQ ID NO: 715153 - protein, 9 aa, Homo Sapiens
NSLFHCRYG

SEQ ID NO: 715154 - protein, 9 aa, Homo Sapiens
CFQKTFPDL

SEQ ID NO: 715155 - protein, 9 aa, Homo Sapiens
SKLAGPKGR

SEQ ID NO: 715156 - protein, 9 aa, Homo Sapiens
HNTLWGMLC

SEQ ID NO: 715157 - protein, 9 aa, Homo Sapiens
AVKQNVRKI

SEQ ID NO: 715158 - protein, 9 aa, Homo Sapiens
CGNRTLDHI

SEQ ID NO: 715159 - protein, 9 aa, Homo Sapiens
CPLTVNSLN

SEQ ID NO: 715160 - protein, 9 aa, Homo Sapiens
VRRGPVSPS

SEQ ID NO: 715161 - protein, 9 aa, Homo Sapiens
EQQGTQLWD

SEQ ID NO: 715162 - protein, 9 aa, Homo Sapiens
TTNVVSGVL

SEQ ID NO: 715163 - protein, 9 aa, Homo Sapiens
NFGNELRQN

SEQ ID NO: 715164 - protein, 9 aa, Homo Sapiens
NGDIPDLTQ

SEQ ID NO: 715165 - protein, 9 aa, Homo Sapiens
SAARQSHPH

SEQ ID NO: 715166 - protein, 9 aa, Homo Sapiens
ARQSHPHGV

SEQ ID NO: 715167 - protein, 9 aa, Homo Sapiens
TVQLPLCGN

SEQ ID NO: 715168 - protein, 9 aa, Homo Sapiens
ANGNKTMIE

SEQ ID NO: 715169 - protein, 9 aa, Homo Sapiens
NRTLDHIFC

SEQ ID NO: 715170 - protein, 9 aa, Homo Sapiens
GKNKHEGDV

SEQ ID NO: 715171 - protein, 9 aa, Homo Sapiens
ITPPAVKQN

SEQ ID NO: 715172 - protein, 9 aa, Homo Sapiens
IPIYSFHGR

SEQ ID NO: 715173 - protein, 9 aa, Homo Sapiens
GNTLYVTGG

SEQ ID NO: 715174 - protein, 9 aa, Homo Sapiens
LEDISERLE

SEQ ID NO: 715175 - protein, 9 aa, Homo Sapiens
NLGWCVVMV

SEQ ID NO: 715176 - protein, 9 aa, Homo Sapiens
CGKGFTVKH

SEQ ID NO: 715177 - protein, 9 aa, Homo Sapiens
ASQASCFLD

SEQ ID NO: 715178 - protein, 9 aa, Homo Sapiens
VASRSEVSN

SEQ ID NO: 715179 - protein, 9 aa, Homo Sapiens
YSRLPCPHK

SEQ ID NO: 715180 - protein, 9 aa, Homo Sapiens
SYTPQAAAW

SEQ ID NO: 715181 - protein, 9 aa, Homo Sapiens
EGEVEEEEG

SEQ ID NO: 715182 - protein, 9 aa, Homo Sapiens
QQNLCRDVM

SEQ ID NO: 715183 - protein, 9 aa, Homo Sapiens
LSSCRLSAL

SEQ ID NO: 715184 - protein, 9 aa, Homo Sapiens
WGTTPQERR

SEQ ID NO: 715185 - protein, 9 aa, Homo Sapiens
DDGASRAPG

SEQ ID NO: 715186 - protein, 9 aa, Homo Sapiens
GINGLYQGF

SEQ ID NO: 715187 - protein, 9 aa, Homo Sapiens
DKAVKQLGT

SEQ ID NO: 715188 - protein, 9 aa, Homo Sapiens
GKEEYSAMR

SEQ ID NO: 715189 - protein, 9 aa, Homo Sapiens
QWTSCSKTY

SEQ ID NO: 715190 - protein, 9 aa, Homo Sapiens
DKACQACPQ

SEQ ID NO: 715191 - protein, 9 aa, Homo Sapiens
LEIRNMSWS

SEQ ID NO: 715192 - protein, 9 aa, Homo Sapiens
EFAPSKGAG

SEQ ID NO: 715193 - protein, 9 aa, Homo Sapiens
GRPAVPVLG

SEQ ID NO: 715194 - protein, 9 aa, Homo Sapiens
NSLQLRLED

SEQ ID NO: 715195 - protein, 9 aa, Homo Sapiens
RSYLDSSPN

SEQ ID NO: 715196 - protein, 9 aa, Homo Sapiens
LDQRERLAP

SEQ ID NO: 715197 - protein, 9 aa, Homo Sapiens
PANVQLTNP

SEQ ID NO: 715198 - protein, 9 aa, Homo Sapiens
RVVSLEEPQ

SEQ ID NO: 715199 - protein, 9 aa, Homo Sapiens
YRDVMPETF

SEQ ID NO: 715200 - protein, 9 aa, Homo Sapiens
PIGNSLLSS

SEQ ID NO: 715201 - protein, 9 aa, Homo Sapiens
DKECFNCAL

SEQ ID NO: 715202 - protein, 9 aa, Homo Sapiens
VHPFYVYSR

SEQ ID NO: 715203 - protein, 9 aa, Homo Sapiens
CLLLLLGAH

SEQ ID NO: 715204 - protein, 9 aa, Homo Sapiens
DFPCPVCQK

SEQ ID NO: 715205 - protein, 9 aa, Homo Sapiens
HGATVMGNT

SEQ ID NO: 715206 - protein, 9 aa, Homo Sapiens
QLLREIKTI

SEQ ID NO: 715207 - protein, 9 aa, Homo Sapiens
LCRDVMLEN

SEQ ID NO: 715208 - protein, 9 aa, Homo Sapiens
IHAAKKQDR

SEQ ID NO: 715209 - protein, 9 aa, Homo Sapiens
ALPIHPIIY

SEQ ID NO: 715210 - protein, 9 aa, Homo Sapiens
RTIVFCFWG

SEQ ID NO: 715211 - protein, 9 aa, Homo Sapiens
EYDKRCCYL

SEQ ID NO: 715212 - protein, 9 aa, Homo Sapiens
GVQNLFAEE

SEQ ID NO: 715213 - protein, 9 aa, Homo Sapiens
LDGYPLPSW

SEQ ID NO: 715214 - protein, 9 aa, Homo Sapiens
QRSSELTKH

SEQ ID NO: 715215 - protein, 9 aa, Homo Sapiens
RQSHPHGVK

SEQ ID NO: 715216 - protein, 9 aa, Homo Sapiens
HTGEQPSKC

SEQ ID NO: 715217 - protein, 9 aa, Homo Sapiens
KGFTVKHTL

SEQ ID NO: 715218 - protein, 9 aa, Homo Sapiens
DMQNACKKT

SEQ ID NO: 715219 - protein, 9 aa, Homo Sapiens
LLGAHGMGF

SEQ ID NO: 715220 - protein, 9 aa, Homo Sapiens
SNGGTVIRP

SEQ ID NO: 715221 - protein, 9 aa, Homo Sapiens
LLAAASWVI

SEQ ID NO: 715222 - protein, 9 aa, Homo Sapiens
TVGVYFFSR

SEQ ID NO: 715223 - protein, 9 aa, Homo Sapiens
TVSRSRSGS

SEQ ID NO: 715224 - protein, 9 aa, Homo Sapiens
KEPQTTVIE

SEQ ID NO: 715225 - protein, 9 aa, Homo Sapiens
IFHFNGKVK

SEQ ID NO: 715226 - protein, 9 aa, Homo Sapiens
ATPSLELVP

SEQ ID NO: 715227 - protein, 9 aa, Homo Sapiens
ERKDPLLAL

SEQ ID NO: 715228 - protein, 9 aa, Homo Sapiens
HGSGCRQSL

SEQ ID NO: 715229 - protein, 9 aa, Homo Sapiens
THSRKDMND

SEQ ID NO: 715230 - protein, 9 aa, Homo Sapiens
TSSASTGLA

SEQ ID NO: 715231 - protein, 9 aa, Homo Sapiens
EDLDFLEAI

SEQ ID NO: 715232 - protein, 9 aa, Homo Sapiens
ATGLKKQRR

SEQ ID NO: 715233 - protein, 9 aa, Homo Sapiens
EHVSEELIQ

SEQ ID NO: 715234 - protein, 9 aa, Homo Sapiens
ISDEKVLEV

SEQ ID NO: 715235 - protein, 9 aa, Homo Sapiens
AAWGTTPQE

SEQ ID NO: 715236 - protein, 9 aa, Homo Sapiens
VFCFWGGTA

SEQ ID NO: 715237 - protein, 9 aa, Homo Sapiens
PEDQSSGRL

SEQ ID NO: 715238 - protein, 9 aa, Homo Sapiens
YRFDKECFN

SEQ ID NO: 715239 - protein, 9 aa, Homo Sapiens
YTTKLELSP

SEQ ID NO: 715240 - protein, 9 aa, Homo Sapiens
PLTVNSLNC

SEQ ID NO: 715241 - protein, 9 aa, Homo Sapiens
LYSMIKGVT

SEQ ID NO: 715242 - protein, 9 aa, Homo Sapiens
GGGCGGFGG

SEQ ID NO: 715243 - protein, 9 aa, Homo Sapiens
SLCFQKTFP

SEQ ID NO: 715244 - protein, 9 aa, Homo Sapiens
LDVQTNAEK

SEQ ID NO: 715245 - protein, 9 aa, Homo Sapiens
SKNRNFNVI

SEQ ID NO: 715246 - protein, 9 aa, Homo Sapiens
NKSKNRNFN

SEQ ID NO: 715247 - protein, 9 aa, Homo Sapiens
HPHVKCQTK

SEQ ID NO: 715248 - protein, 9 aa, Homo Sapiens
LNEEVSERM

SEQ ID NO: 715249 - protein, 9 aa, Homo Sapiens
DSNSQSLKK

SEQ ID NO: 715250 - protein, 9 aa, Homo Sapiens
LWANSGDQI

SEQ ID NO: 715251 - protein, 9 aa, Homo Sapiens
GHGGDDGAS

SEQ ID NO: 715252 - protein, 9 aa, Homo Sapiens
KSKNRNFNV

SEQ ID NO: 715253 - protein, 9 aa, Homo Sapiens
ILHHRIHSG

SEQ ID NO: 715254 - protein, 9 aa, Homo Sapiens
SYADLLTKT

SEQ ID NO: 715255 - protein, 9 aa, Homo Sapiens
HKPHSQEQT

SEQ ID NO: 715256 - protein, 9 aa, Homo Sapiens
ADEDGFVSP

SEQ ID NO: 715257 - protein, 9 aa, Homo Sapiens
GTEKADKEE

SEQ ID NO: 715258 - protein, 9 aa, Homo Sapiens
FKSSFLKNC

SEQ ID NO: 715259 - protein, 9 aa, Homo Sapiens
NTAMVSVIL

SEQ ID NO: 715260 - protein, 9 aa, Homo Sapiens
PQLRLEHCI

SEQ ID NO: 715261 - protein, 9 aa, Homo Sapiens
DINASYFLA

SEQ ID NO: 715262 - protein, 9 aa, Homo Sapiens
KAKEPRSPL

SEQ ID NO: 715263 - protein, 9 aa, Homo Sapiens
EDGFVSPQD

SEQ ID NO: 715264 - protein, 9 aa, Homo Sapiens
DMGDLVDAQ

SEQ ID NO: 715265 - protein, 9 aa, Homo Sapiens
YAKKQCSIL

SEQ ID NO: 715266 - protein, 9 aa, Homo Sapiens
SHKPHSQEQ

SEQ ID NO: 715267 - protein, 9 aa, Homo Sapiens
SQLLREIKT

SEQ ID NO: 715268 - protein, 9 aa, Homo Sapiens
FYPEHVSEE

SEQ ID NO: 715269 - protein, 9 aa, Homo Sapiens
RKKKKKGTK

SEQ ID NO: 715270 - protein, 9 aa, Homo Sapiens
MHIPIYSFH

SEQ ID NO: 715271 - protein, 9 aa, Homo Sapiens
VEEEEGEWE

SEQ ID NO: 715272 - protein, 9 aa, Homo Sapiens
CQHTEMIKK

SEQ ID NO: 715273 - protein, 9 aa, Homo Sapiens
ANRISEDPA

SEQ ID NO: 715274 - protein, 9 aa, Homo Sapiens
LRKPSEEFN

SEQ ID NO: 715275 - protein, 9 aa, Homo Sapiens
TQLWDILPN

SEQ ID NO: 715276 - protein, 9 aa, Homo Sapiens
NGPSSLLGF

SEQ ID NO: 715277 - protein, 9 aa, Homo Sapiens
QNVRKIILH

SEQ ID NO: 715278 - protein, 9 aa, Homo Sapiens
ADLLLASGP

SEQ ID NO: 715279 - protein, 9 aa, Homo Sapiens
ADSLLHVIF

SEQ ID NO: 715280 - protein, 9 aa, Homo Sapiens
QHKSKKKNN

SEQ ID NO: 715281 - protein, 9 aa, Homo Sapiens
VSPQDPLRG

SEQ ID NO: 715282 - protein, 9 aa, Homo Sapiens
VSLEEPQLR

SEQ ID NO: 715283 - protein, 9 aa, Homo Sapiens
PEILTPPVI

SEQ ID NO: 715284 - protein, 9 aa, Homo Sapiens
DLDFLEAID

SEQ ID NO: 715285 - protein, 9 aa, Homo Sapiens
QDQLQKQTS

SEQ ID NO: 715286 - protein, 9 aa, Homo Sapiens
CRKAFSYLS

SEQ ID NO: 715287 - protein, 9 aa, Homo Sapiens
EADEDGFVS

SEQ ID NO: 715288 - protein, 9 aa, Homo Sapiens
VCYETTLFV

SEQ ID NO: 715289 - protein, 9 aa, Homo Sapiens
QRLVRLYTV

SEQ ID NO: 715290 - protein, 9 aa, Homo Sapiens
SLLGRCQLS

SEQ ID NO: 715291 - protein, 9 aa, Homo Sapiens
ALCLATIGS

SEQ ID NO: 715292 - protein, 9 aa, Homo Sapiens
VTLAVLQRL

SEQ ID NO: 715293 - protein, 9 aa, Homo Sapiens
QLLGNVQEN

SEQ ID NO: 715294 - protein, 9 aa, Homo Sapiens
GVGCVLYDK

SEQ ID NO: 715295 - protein, 9 aa, Homo Sapiens
QLGTEKVIT

SEQ ID NO: 715296 - protein, 9 aa, Homo Sapiens
QKCESKCQH

SEQ ID NO: 715297 - protein, 9 aa, Homo Sapiens
GDDGASRAP

SEQ ID NO: 715298 - protein, 9 aa, Homo Sapiens
MLLPEGQRH

SEQ ID NO: 715299 - protein, 9 aa, Homo Sapiens
GIKVNGDCS

SEQ ID NO: 715300 - protein, 9 aa, Homo Sapiens
VAEQVGIDN

SEQ ID NO: 715301 - protein, 9 aa, Homo Sapiens
SSSSSSRPR

SEQ ID NO: 715302 - protein, 9 aa, Homo Sapiens
KNKHEGDVC

SEQ ID NO: 715303 - protein, 9 aa, Homo Sapiens
QPLGFRSFV

SEQ ID NO: 715304 - protein, 9 aa, Homo Sapiens
QVQQLLGNV

SEQ ID NO: 715305 - protein, 9 aa, Homo Sapiens
HSCLKKLLQ

SEQ ID NO: 715306 - protein, 9 aa, Homo Sapiens
LKIGDPSLC

SEQ ID NO: 715307 - protein, 9 aa, Homo Sapiens
LCPAETPEG

SEQ ID NO: 715308 - protein, 9 aa, Homo Sapiens
SSSSPAKPH

SEQ ID NO: 715309 - protein, 9 aa, Homo Sapiens
RSQMLQHMR

SEQ ID NO: 715310 - protein, 9 aa, Homo Sapiens
VTLFPLLIA

SEQ ID NO: 715311 - protein, 9 aa, Homo Sapiens
KSQLLREIK

SEQ ID NO: 715312 - protein, 9 aa, Homo Sapiens
IAANFSLIG

SEQ ID NO: 715313 - protein, 9 aa, Homo Sapiens
DTSSASTGL

SEQ ID NO: 715314 - protein, 9 aa, Homo Sapiens
LAPPPVINR

SEQ ID NO: 715315 - protein, 9 aa, Homo Sapiens
VPIGNSLLS

SEQ ID NO: 715316 - protein, 9 aa, Homo Sapiens
YTQMHEIHS

SEQ ID NO: 715317 - protein, 9 aa, Homo Sapiens
IEIKCMPPE

SEQ ID NO: 715318 - protein, 9 aa, Homo Sapiens
GASRAPGST

SEQ ID NO: 715319 - protein, 9 aa, Homo Sapiens
CWTSVFSVF

SEQ ID NO: 715320 - protein, 9 aa, Homo Sapiens
SRELEDISE

SEQ ID NO: 715321 - protein, 9 aa, Homo Sapiens
AVQLPEQQQ

SEQ ID NO: 715322 - protein, 9 aa, Homo Sapiens
STGLATPLP

SEQ ID NO: 715323 - protein, 9 aa, Homo Sapiens
RDVMPETFR

SEQ ID NO: 715324 - protein, 9 aa, Homo Sapiens
ETLQQSLPR

SEQ ID NO: 715325 - protein, 9 aa, Homo Sapiens
IETILKFLE

SEQ ID NO: 715326 - protein, 9 aa, Homo Sapiens
TISVSVMTE

SEQ ID NO: 715327 - protein, 9 aa, Homo Sapiens
KFFSAFSRV

SEQ ID NO: 715328 - protein, 9 aa, Homo Sapiens
IYSFHGRDI

SEQ ID NO: 715329 - protein, 9 aa, Homo Sapiens
LAANENGKI

SEQ ID NO: 715330 - protein, 9 aa, Homo Sapiens
QRSQMLQHM

SEQ ID NO: 715331 - protein, 9 aa, Homo Sapiens
NEANGNKTM

SEQ ID NO: 715332 - protein, 9 aa, Homo Sapiens
APEPLYPRS

SEQ ID NO: 715333 - protein, 9 aa, Homo Sapiens
QGFRSSGYA

SEQ ID NO: 715334 - protein, 9 aa, Homo Sapiens
DLVSRSNQS

SEQ ID NO: 715335 - protein, 9 aa, Homo Sapiens
RLSALPEGG

SEQ ID NO: 715336 - protein, 9 aa, Homo Sapiens
IGDKGKNKH

SEQ ID NO: 715337 - protein, 9 aa, Homo Sapiens
VIRTALLNM

SEQ ID NO: 715338 - protein, 9 aa, Homo Sapiens
EIPKEIRED

SEQ ID NO: 715339 - protein, 9 aa, Homo Sapiens
GLATPLPVT

SEQ ID NO: 715340 - protein, 9 aa, Homo Sapiens
HSAVFLDKQ

SEQ ID NO: 715341 - protein, 9 aa, Homo Sapiens
TAILGQHMK

SEQ ID NO: 715342 - protein, 9 aa, Homo Sapiens
EQPSKCEEC

SEQ ID NO: 715343 - protein, 9 aa, Homo Sapiens
LLESKEKLD

SEQ ID NO: 715344 - protein, 9 aa, Homo Sapiens
CITHLFFLH

SEQ ID NO: 715345 - protein, 9 aa, Homo Sapiens
LQRQDNRVA

SEQ ID NO: 715346 - protein, 9 aa, Homo Sapiens
CFLDGYPLP

SEQ ID NO: 715347 - protein, 9 aa, Homo Sapiens
GDIHAAKKQ

SEQ ID NO: 715348 - protein, 9 aa, Homo Sapiens
MLQIVVGVP

SEQ ID NO: 715349 - protein, 9 aa, Homo Sapiens
KQGTEKADK

SEQ ID NO: 715350 - protein, 9 aa, Homo Sapiens
HAAKKQDRE

SEQ ID NO: 715351 - protein, 9 aa, Homo Sapiens
WAELALSSH

SEQ ID NO: 715352 - protein, 9 aa, Homo Sapiens
SAPDLSPEI

SEQ ID NO: 715353 - protein, 9 aa, Homo Sapiens
ENGKINHQD

SEQ ID NO: 715354 - protein, 9 aa, Homo Sapiens
IKTIPYERS

SEQ ID NO: 715355 - protein, 9 aa, Homo Sapiens
DIHAAKKQD

SEQ ID NO: 715356 - protein, 9 aa, Homo Sapiens
SPWLQKLFL

SEQ ID NO: 715357 - protein, 9 aa, Homo Sapiens
SKGQQKALV

SEQ ID NO: 715358 - protein, 9 aa, Homo Sapiens
GEQPSKCEE

SEQ ID NO: 715359 - protein, 9 aa, Homo Sapiens
RAVSRVLAA

SEQ ID NO: 715360 - protein, 9 aa, Homo Sapiens
KYLEAMSVI

SEQ ID NO: 715361 - protein, 9 aa, Homo Sapiens
MMNSKRYKQ

SEQ ID NO: 715362 - protein, 9 aa, Homo Sapiens
QLWDILPNA

SEQ ID NO: 715363 - protein, 9 aa, Homo Sapiens
LVSFKPTVA

SEQ ID NO: 715364 - protein, 9 aa, Homo Sapiens
RPGQGFRSS

SEQ ID NO: 715365 - protein, 9 aa, Homo Sapiens
LREIKTIPY

SEQ ID NO: 715366 - protein, 9 aa, Homo Sapiens
TEYDKRCCY

SEQ ID NO: 715367 - protein, 9 aa, Homo Sapiens
EESEKRKKK

SEQ ID NO: 715368 - protein, 9 aa, Homo Sapiens
DNLGWCVVM

SEQ ID NO: 715369 - protein, 9 aa, Homo Sapiens
SAIAESSGN

SEQ ID NO: 715370 - protein, 9 aa, Homo Sapiens
ITKLKEALI

SEQ ID NO: 715371 - protein, 9 aa, Homo Sapiens
ARRQVEVRR

SEQ ID NO: 715372 - protein, 9 aa, Homo Sapiens
EAQTQRLKT

SEQ ID NO: 715373 - protein, 9 aa, Homo Sapiens
GKNFTQSLA

SEQ ID NO: 715374 - protein, 9 aa, Homo Sapiens
AAIRKMEQM

SEQ ID NO: 715375 - protein, 9 aa, Homo Sapiens
ELLGEIRSL

SEQ ID NO: 715376 - protein, 9 aa, Homo Sapiens
GWCVVMVGM

SEQ ID NO: 715377 - protein, 9 aa, Homo Sapiens
KGWGIRCLG

SEQ ID NO: 715378 - protein, 9 aa, Homo Sapiens
RTHSDGSLL

SEQ ID NO: 715379 - protein, 9 aa, Homo Sapiens
EMTRALDRK

SEQ ID NO: 715380 - protein, 9 aa, Homo Sapiens
VDCRDSLDE

SEQ ID NO: 715381 - protein, 9 aa, Homo Sapiens
AEAVTEAEL

SEQ ID NO: 715382 - protein, 9 aa, Homo Sapiens
MLWGHTEVC

SEQ ID NO: 715383 - protein, 9 aa, Homo Sapiens
NFSALSVPP

SEQ ID NO: 715384 - protein, 9 aa, Homo Sapiens
QIWSQKTGI

SEQ ID NO: 715385 - protein, 9 aa, Homo Sapiens
QPGYANSLR

SEQ ID NO: 715386 - protein, 9 aa, Homo Sapiens
ILENSQPVT

SEQ ID NO: 715387 - protein, 9 aa, Homo Sapiens
SRLIRKLRC

SEQ ID NO: 715388 - protein, 9 aa, Homo Sapiens
EKADKEEMM

SEQ ID NO: 715389 - protein, 9 aa, Homo Sapiens
LADALSQGH

SEQ ID NO: 715390 - protein, 9 aa, Homo Sapiens
LDGPQASLS

SEQ ID NO: 715391 - protein, 9 aa, Homo Sapiens
AIAESSGNK

SEQ ID NO: 715392 - protein, 9 aa, Homo Sapiens
FAVRNCYFG

SEQ ID NO: 715393 - protein, 9 aa, Homo Sapiens
IIRKSSVKY

SEQ ID NO: 715394 - protein, 9 aa, Homo Sapiens
TSRPGQGFR

SEQ ID NO: 715395 - protein, 9 aa, Homo Sapiens
IDINDHSAV

SEQ ID NO: 715396 - protein, 9 aa, Homo Sapiens
DPLLALARE

SEQ ID NO: 715397 - protein, 9 aa, Homo Sapiens
TLFVEKNND

SEQ ID NO: 715398 - protein, 9 aa, Homo Sapiens
ETTLFVEKN

SEQ ID NO: 715399 - protein, 9 aa, Homo Sapiens
PFTFLTKLQ

SEQ ID NO: 715400 - protein, 9 aa, Homo Sapiens
VPANVQLTN

SEQ ID NO: 715401 - protein, 9 aa, Homo Sapiens
DGINGLYQG

SEQ ID NO: 715402 - protein, 9 aa, Homo Sapiens
EVPEDKEDY

SEQ ID NO: 715403 - protein, 9 aa, Homo Sapiens
HSFQAMCQN

SEQ ID NO: 715404 - protein, 9 aa, Homo Sapiens
LTVDDGLDI

SEQ ID NO: 715405 - protein, 9 aa, Homo Sapiens
KKQDREEKS

SEQ ID NO: 715406 - protein, 9 aa, Homo Sapiens
DTAGKEEYS

SEQ ID NO: 715407 - protein, 9 aa, Homo Sapiens
QNLCRDVML

SEQ ID NO: 715408 - protein, 9 aa, Homo Sapiens
HVEERLARH

SEQ ID NO: 715409 - protein, 9 aa, Homo Sapiens
TEKADKEEM

SEQ ID NO: 715410 - protein, 9 aa, Homo Sapiens
EILTPPVIC

SEQ ID NO: 715411 - protein, 9 aa, Homo Sapiens
LALAREYGG

SEQ ID NO: 715412 - protein, 9 aa, Homo Sapiens
GAQENLAPA

SEQ ID NO: 715413 - protein, 9 aa, Homo Sapiens
KRCCYLREI

SEQ ID NO: 715414 - protein, 9 aa, Homo Sapiens
KSPWLQKLF

SEQ ID NO: 715415 - protein, 9 aa, Homo Sapiens
NWDFRNEAD

SEQ ID NO: 715416 - protein, 9 aa, Homo Sapiens
DAQEYLVPQ

SEQ ID NO: 715417 - protein, 9 aa, Homo Sapiens
NTLWGMLCP

SEQ ID NO: 715418 - protein, 9 aa, Homo Sapiens
KFPYAKKQC

SEQ ID NO: 715419 - protein, 9 aa, Homo Sapiens
VQLTNPQLY

SEQ ID NO: 715420 - protein, 9 aa, Homo Sapiens
RKQRRKRTT

SEQ ID NO: 715421 - protein, 9 aa, Homo Sapiens
EGALIALAV

SEQ ID NO: 715422 - protein, 9 aa, Homo Sapiens
AIPNQTAVY

SEQ ID NO: 715423 - protein, 9 aa, Homo Sapiens
LVLPTNLTH

SEQ ID NO: 715424 - protein, 9 aa, Homo Sapiens
KHAHFETSK

SEQ ID NO: 715425 - protein, 9 aa, Homo Sapiens
DNRVATGLK

SEQ ID NO: 715426 - protein, 9 aa, Homo Sapiens
SGNLLVRNS

SEQ ID NO: 715427 - protein, 9 aa, Homo Sapiens
PPIFSSVQD

SEQ ID NO: 715428 - protein, 9 aa, Homo Sapiens
KIGDPSLCF

SEQ ID NO: 715429 - protein, 9 aa, Homo Sapiens
ENYTCHVEN

SEQ ID NO: 715430 - protein, 9 aa, Homo Sapiens
SYSSLEKSY

SEQ ID NO: 715431 - protein, 9 aa, Homo Sapiens
CSKTYNSGT

SEQ ID NO: 715432 - protein, 9 aa, Homo Sapiens
NDIPFFAVR

SEQ ID NO: 715433 - protein, 9 aa, Homo Sapiens
LDNEANGNK

SEQ ID NO: 715434 - protein, 9 aa, Homo Sapiens
EGQHLWEIK

SEQ ID NO: 715435 - protein, 9 aa, Homo Sapiens
ELSGPSLPK

SEQ ID NO: 715436 - protein, 9 aa, Homo Sapiens
LGAHGMGFA

SEQ ID NO: 715437 - protein, 9 aa, Homo Sapiens
YKSDGINGL

SEQ ID NO: 715438 - protein, 9 aa, Homo Sapiens
DALSQGHMR

SEQ ID NO: 715439 - protein, 9 aa, Homo Sapiens
ALSQGHMRG

SEQ ID NO: 715440 - protein, 9 aa, Homo Sapiens
EQPLGFRSF

SEQ ID NO: 715441 - protein, 9 aa, Homo Sapiens
AANENGKIN

SEQ ID NO: 715442 - protein, 9 aa, Homo Sapiens
CDKEPQTTV

SEQ ID NO: 715443 - protein, 9 aa, Homo Sapiens
SRPGQGFRS

SEQ ID NO: 715444 - protein, 9 aa, Homo Sapiens
IYTTIFRIG

SEQ ID NO: 715445 - protein, 9 aa, Homo Sapiens
NQFVLYLIT

SEQ ID NO: 715446 - protein, 9 aa, Homo Sapiens
SNSLFHCRY

SEQ ID NO: 715447 - protein, 9 aa, Homo Sapiens
SSTLNEEVS

SEQ ID NO: 715448 - protein, 9 aa, Homo Sapiens
SASTGLATP

SEQ ID NO: 715449 - protein, 9 aa, Homo Sapiens
KQDREEKSL

SEQ ID NO: 715450 - protein, 9 aa, Homo Sapiens
FKETCSSEI

SEQ ID NO: 715451 - protein, 9 aa, Homo Sapiens
AGLILHHRI

SEQ ID NO: 715452 - protein, 9 aa, Homo Sapiens
SGALLPVAL

SEQ ID NO: 715453 - protein, 9 aa, Homo Sapiens
AKKQDREEK

SEQ ID NO: 715454 - protein, 9 aa, Homo Sapiens
WRTCGRPAV

SEQ ID NO: 715455 - protein, 9 aa, Homo Sapiens
IFRIGTVIK

SEQ ID NO: 715456 - protein, 9 aa, Homo Sapiens
AVSGANPLL

SEQ ID NO: 715457 - protein, 9 aa, Homo Sapiens
IKEGECHVK

SEQ ID NO: 715458 - protein, 9 aa, Homo Sapiens
SHPSLSPAC

SEQ ID NO: 715459 - protein, 9 aa, Homo Sapiens
DDLALCLAT

SEQ ID NO: 715460 - protein, 9 aa, Homo Sapiens
RGRPPKRIR

SEQ ID NO: 715461 - protein, 9 aa, Homo Sapiens
WSAQEDSPH

SEQ ID NO: 715462 - protein, 9 aa, Homo Sapiens
EADLENYTC

SEQ ID NO: 715463 - protein, 9 aa, Homo Sapiens
NKHEGDVCN

SEQ ID NO: 715464 - protein, 9 aa, Homo Sapiens
GVSHKPHSQ

SEQ ID NO: 715465 - protein, 9 aa, Homo Sapiens
FVLYLITEA

SEQ ID NO: 715466 - protein, 9 aa, Homo Sapiens
SAGLILHHR

SEQ ID NO: 715467 - protein, 9 aa, Homo Sapiens
HVKKVNKMT

SEQ ID NO: 715468 - protein, 9 aa, Homo Sapiens
EPQLRLEHC

SEQ ID NO: 715469 - protein, 9 aa, Homo Sapiens
TEAELKTES

SEQ ID NO: 715470 - protein, 9 aa, Homo Sapiens
MGPFKLTVD

SEQ ID NO: 715471 - protein, 9 aa, Homo Sapiens
TGEQPSKCE

SEQ ID NO: 715472 - protein, 9 aa, Homo Sapiens
LSPACWTSV

SEQ ID NO: 715473 - protein, 9 aa, Homo Sapiens
QEQQGTQLW

SEQ ID NO: 715474 - protein, 9 aa, Homo Sapiens
DHPHVKCQT

SEQ ID NO: 715475 - protein, 9 aa, Homo Sapiens
YRYRVSLTT

SEQ ID NO: 715476 - protein, 9 aa, Homo Sapiens
DPYEKILHV

SEQ ID NO: 715477 - protein, 9 aa, Homo Sapiens
LLALAREYG

SEQ ID NO: 715478 - protein, 9 aa, Homo Sapiens
NGNKTMIEL

SEQ ID NO: 715479 - protein, 9 aa, Homo Sapiens
ENIIRKSSV

SEQ ID NO: 715480 - protein, 9 aa, Homo Sapiens
LVKLDQRER

SEQ ID NO: 715481 - protein, 9 aa, Homo Sapiens
GPFKLTVDD

SEQ ID NO: 715482 - protein, 9 aa, Homo Sapiens
NLSPDLSQM

SEQ ID NO: 715483 - protein, 9 aa, Homo Sapiens
VPLGDSNSQ

SEQ ID NO: 715484 - protein, 9 aa, Homo Sapiens
KPTLKAKRP

SEQ ID NO: 715485 - protein, 9 aa, Homo Sapiens
QAFLQAVTA

SEQ ID NO: 715486 - protein, 9 aa, Homo Sapiens
ELRQNMAVY

SEQ ID NO: 715487 - protein, 9 aa, Homo Sapiens
PLGDSNSQS

SEQ ID NO: 715488 - protein, 9 aa, Homo Sapiens
MEQMHKLLK

SEQ ID NO: 715489 - protein, 9 aa, Homo Sapiens
FPCPVCQKT

SEQ ID NO: 715490 - protein, 9 aa, Homo Sapiens
QGTQLWDIL

SEQ ID NO: 715491 - protein, 9 aa, Homo Sapiens
CKAVSGANP

SEQ ID NO: 715492 - protein, 9 aa, Homo Sapiens
TGTRAVSRV

SEQ ID NO: 715493 - protein, 9 aa, Homo Sapiens
NSSYDALNE

SEQ ID NO: 715494 - protein, 9 aa, Homo Sapiens
LESKEKLDS

SEQ ID NO: 715495 - protein, 9 aa, Homo Sapiens
QIKQNNTAM

SEQ ID NO: 715496 - protein, 9 aa, Homo Sapiens
DEKVLEVSK

SEQ ID NO: 715497 - protein, 9 aa, Homo Sapiens
MKPGAECCS

SEQ ID NO: 715498 - protein, 9 aa, Homo Sapiens
YLEAMSVIE

SEQ ID NO: 715499 - protein, 9 aa, Homo Sapiens
VKYSAPSAS

SEQ ID NO: 715500 - protein, 9 aa, Homo Sapiens
SSSRPRTGT

SEQ ID NO: 715501 - protein, 9 aa, Homo Sapiens
PNKDKFCPL

SEQ ID NO: 715502 - protein, 9 aa, Homo Sapiens
SADNLTPSV

SEQ ID NO: 715503 - protein, 9 aa, Homo Sapiens
SDEKVLEVS

SEQ ID NO: 715504 - protein, 9 aa, Homo Sapiens
LDAQQESDV

SEQ ID NO: 715505 - protein, 9 aa, Homo Sapiens
SASPETLQQ

SEQ ID NO: 715506 - protein, 9 aa, Homo Sapiens
NLRLPGSSN

SEQ ID NO: 715507 - protein, 9 aa, Homo Sapiens
FSAFSRVGS

SEQ ID NO: 715508 - protein, 9 aa, Homo Sapiens
EDVIEGVQN

SEQ ID NO: 715509 - protein, 9 aa, Homo Sapiens
MLQHMRLSK

SEQ ID NO: 715510 - protein, 9 aa, Homo Sapiens
LPPIFSSVQ

SEQ ID NO: 715511 - protein, 9 aa, Homo Sapiens
TLVQRGSED

SEQ ID NO: 715512 - protein, 9 aa, Homo Sapiens
KEKLDSLMT

SEQ ID NO: 715513 - protein, 9 aa, Homo Sapiens
LGMCFSYAD

SEQ ID NO: 715514 - protein, 9 aa, Homo Sapiens
PNQTAVYFC

SEQ ID NO: 715515 - protein, 9 aa, Homo Sapiens
NRISEDPAR

SEQ ID NO: 715516 - protein, 9 aa, Homo Sapiens
AGKEEYSAM

SEQ ID NO: 715517 - protein, 9 aa, Homo Sapiens
LEPEGLYKF

SEQ ID NO: 715518 - protein, 9 aa, Homo Sapiens
AHFETSKLA

SEQ ID NO: 715519 - protein, 9 aa, Homo Sapiens
AKEKFLEYP

SEQ ID NO: 715520 - protein, 9 aa, Homo Sapiens
DLENYTCHV

SEQ ID NO: 715521 - protein, 9 aa, Homo Sapiens
SYDALNESK

SEQ ID NO: 715522 - protein, 9 aa, Homo Sapiens
GDIAKGSFV

SEQ ID NO: 715523 - protein, 9 aa, Homo Sapiens
TLPNFSALS

SEQ ID NO: 715524 - protein, 9 aa, Homo Sapiens
MNSKRYKQA

SEQ ID NO: 715525 - protein, 9 aa, Homo Sapiens
PVEDCPRMK

SEQ ID NO: 715526 - protein, 9 aa, Homo Sapiens
SLSPACWTS

SEQ ID NO: 715527 - protein, 9 aa, Homo Sapiens
SSGRLWANS

SEQ ID NO: 715528 - protein, 9 aa, Homo Sapiens
GECHVKKVN

SEQ ID NO: 715529 - protein, 9 aa, Homo Sapiens
LLGRCQLSS

SEQ ID NO: 715530 - protein, 9 aa, Homo Sapiens
TVYSPIPYT

SEQ ID NO: 715531 - protein, 9 aa, Homo Sapiens
TPPAVKQNV

SEQ ID NO: 715532 - protein, 9 aa, Homo Sapiens
VATPSLELV

SEQ ID NO: 715533 - protein, 9 aa, Homo Sapiens
RKDPLLALA

SEQ ID NO: 715534 - protein, 9 aa, Homo Sapiens
PSKGAGTQD

SEQ ID NO: 715535 - protein, 9 aa, Homo Sapiens
DIPFFAVRN

SEQ ID NO: 715536 - protein, 9 aa, Homo Sapiens
KTQAEAVTE

SEQ ID NO: 715537 - protein, 9 aa, Homo Sapiens
RLLESKEKL

SEQ ID NO: 715538 - protein, 9 aa, Homo Sapiens
IKGVTSGDY

SEQ ID NO: 715539 - protein, 9 aa, Homo Sapiens
VTSGDYKKA

SEQ ID NO: 715540 - protein, 9 aa, Homo Sapiens
IQMKEAQTQ

SEQ ID NO: 715541 - protein, 9 aa, Homo Sapiens
IYSFTFHVV

SEQ ID NO: 715542 - protein, 9 aa, Homo Sapiens
ADALSQGHM

SEQ ID NO: 715543 - protein, 9 aa, Homo Sapiens
IIQYCSVYY

SEQ ID NO: 715544 - protein, 9 aa, Homo Sapiens
AAYEAGYDQ

SEQ ID NO: 715545 - protein, 9 aa, Homo Sapiens
DLLTKTNRI

SEQ ID NO: 715546 - protein, 9 aa, Homo Sapiens
KEKPMLVDK

SEQ ID NO: 715547 - protein, 9 aa, Homo Sapiens
THSSTLNEE

SEQ ID NO: 715548 - protein, 9 aa, Homo Sapiens
NTLLYAREI

SEQ ID NO: 715549 - protein, 9 aa, Homo Sapiens
TILKFLEKD

SEQ ID NO: 715550 - protein, 9 aa, Homo Sapiens
SVSVMTEGS

SEQ ID NO: 715551 - protein, 9 aa, Homo Sapiens
DLRRVQVFR

SEQ ID NO: 715552 - protein, 9 aa, Homo Sapiens
ISVSVMTEG

SEQ ID NO: 715553 - protein, 9 aa, Homo Sapiens
GALLPVALK

SEQ ID NO: 715554 - protein, 9 aa, Homo Sapiens
IDNGDIPDL

SEQ ID NO: 715555 - protein, 9 aa, Homo Sapiens
ERYITDAHT

SEQ ID NO: 715556 - protein, 9 aa, Homo Sapiens
SLFHCRYGG

SEQ ID NO: 715557 - protein, 9 aa, Homo Sapiens
FDKECFNCA

SEQ ID NO: 715558 - protein, 9 aa, Homo Sapiens
DLSRELEDI

SEQ ID NO: 715559 - protein, 9 aa, Homo Sapiens
HSNGGTVIR

SEQ ID NO: 715560 - protein, 9 aa, Homo Sapiens
ATCSTHVAV

SEQ ID NO: 715561 - protein, 9 aa, Homo Sapiens
THSDGSLLQ

SEQ ID NO: 715562 - protein, 9 aa, Homo Sapiens
HTLVIHQRT

SEQ ID NO: 715563 - protein, 9 aa, Homo Sapiens
QDLRRVQVF

SEQ ID NO: 715564 - protein, 9 aa, Homo Sapiens
KLDQRERLA

SEQ ID NO: 715565 - protein, 9 aa, Homo Sapiens
MIKGVTSGD

SEQ ID NO: 715566 - protein, 9 aa, Homo Sapiens
PRSYLDSSP

SEQ ID NO: 715567 - protein, 9 aa, Homo Sapiens
FTVKHTLVI

SEQ ID NO: 715568 - protein, 9 aa, Homo Sapiens
KSSVKYSAP

SEQ ID NO: 715569 - protein, 9 aa, Homo Sapiens
QMKEAQTQR

SEQ ID NO: 715570 - protein, 9 aa, Homo Sapiens
LGEGQHLWE

SEQ ID NO: 715571 - protein, 9 aa, Homo Sapiens
LDFLEAIDL

SEQ ID NO: 715572 - protein, 9 aa, Homo Sapiens
QLPLCGNRT

SEQ ID NO: 715573 - protein, 9 aa, Homo Sapiens
AELALSSHS

SEQ ID NO: 715574 - protein, 9 aa, Homo Sapiens
IQYCSVYYR

SEQ ID NO: 715575 - protein, 9 aa, Homo Sapiens
QQKALVSFK

SEQ ID NO: 715576 - protein, 9 aa, Homo Sapiens
KGGFTCFFR

SEQ ID NO: 715577 - protein, 9 aa, Homo Sapiens
GATVMGNTL

SEQ ID NO: 715578 - protein, 9 aa, Homo Sapiens
GTEGLRRLD

SEQ ID NO: 715579 - protein, 9 aa, Homo Sapiens
MHEIHSNGG

SEQ ID NO: 715580 - protein, 9 aa, Homo Sapiens
MTEGSTPGT

SEQ ID NO: 715581 - protein, 9 aa, Homo Sapiens
EVHSGVSHK

SEQ ID NO: 715582 - protein, 9 aa, Homo Sapiens
KDPLLALAR

SEQ ID NO: 715583 - protein, 9 aa, Homo Sapiens
LENSQPVTL

SEQ ID NO: 715584 - protein, 9 aa, Homo Sapiens
GIIQYCSVY

SEQ ID NO: 715585 - protein, 9 aa, Homo Sapiens
EAVTEAELK

SEQ ID NO: 715586 - protein, 9 aa, Homo Sapiens
AKFYPEHVS

SEQ ID NO: 715587 - protein, 9 aa, Homo Sapiens
QHTEMIKKE

SEQ ID NO: 715588 - protein, 9 aa, Homo Sapiens
LLLGAHGMG

SEQ ID NO: 715589 - protein, 9 aa, Homo Sapiens
SFVYLAHPQ

SEQ ID NO: 715590 - protein, 9 aa, Homo Sapiens
QESDVRELV

SEQ ID NO: 715591 - protein, 9 aa, Homo Sapiens
YNSGTQSRH

SEQ ID NO: 715592 - protein, 9 aa, Homo Sapiens
GISDEKVLE

SEQ ID NO: 715593 - protein, 9 aa, Homo Sapiens
KLELSPFST

SEQ ID NO: 715594 - protein, 9 aa, Homo Sapiens
MDMQNACKK

SEQ ID NO: 715595 - protein, 9 aa, Homo Sapiens
IKCMPPEKP

SEQ ID NO: 715596 - protein, 9 aa, Homo Sapiens
QHMRLSKTE

SEQ ID NO: 715597 - protein, 9 aa, Homo Sapiens
SSFLKNCSG

SEQ ID NO: 715598 - protein, 9 aa, Homo Sapiens
NMSWSRLIR

SEQ ID NO: 715599 - protein, 9 aa, Homo Sapiens
GYANSLRDA

SEQ ID NO: 715600 - protein, 9 aa, Homo Sapiens
GTPRSYLDS

SEQ ID NO: 715601 - protein, 9 aa, Homo Sapiens
ATTISVSVM

SEQ ID NO: 715602 - protein, 9 aa, Homo Sapiens
GCEQPLGFR

SEQ ID NO: 715603 - protein, 9 aa, Homo Sapiens
SLEEPQLRL

SEQ ID NO: 715604 - protein, 9 aa, Homo Sapiens
VQASNVHVK

SEQ ID NO: 715605 - protein, 9 aa, Homo Sapiens
FKPGSWGRV

SEQ ID NO: 715606 - protein, 9 aa, Homo Sapiens
DSSPNPFSR

SEQ ID NO: 715607 - protein, 9 aa, Homo Sapiens
QSSGRLWAN

SEQ ID NO: 715608 - protein, 9 aa, Homo Sapiens
SSGNLLVRN

SEQ ID NO: 715609 - protein, 9 aa, Homo Sapiens
QRAQAFLQA

SEQ ID NO: 715610 - protein, 9 aa, Homo Sapiens
SKGAGTQDA

SEQ ID NO: 715611 - protein, 9 aa, Homo Sapiens
SSVKYSAPS

SEQ ID NO: 715612 - protein, 9 aa, Homo Sapiens
ASPETLQQS

SEQ ID NO: 715613 - protein, 9 aa, Homo Sapiens
KQFDSSSSP

SEQ ID NO: 715614 - protein, 9 aa, Homo Sapiens
GVTSGDYKK

SEQ ID NO: 715615 - protein, 9 aa, Homo Sapiens
LLPVALKSP

SEQ ID NO: 715616 - protein, 9 aa, Homo Sapiens
TVLRKPSEE

SEQ ID NO: 715617 - protein, 9 aa, Homo Sapiens
VATGLKKQR

SEQ ID NO: 715618 - protein, 9 aa, Homo Sapiens
CSFRVGAQE

SEQ ID NO: 715619 - protein, 9 aa, Homo Sapiens
CMPPEKPNG

SEQ ID NO: 715620 - protein, 9 aa, Homo Sapiens
DLALCLATI

SEQ ID NO: 715621 - protein, 9 aa, Homo Sapiens
AAKKQDREE

SEQ ID NO: 715622 - protein, 9 aa, Homo Sapiens
KWTAILGQH

SEQ ID NO: 715623 - protein, 9 aa, Homo Sapiens
MPETFRNLA

SEQ ID NO: 715624 - protein, 9 aa, Homo Sapiens
NENGKINHQ

SEQ ID NO: 715625 - protein, 9 aa, Homo Sapiens
ESKEKLDSL

SEQ ID NO: 715626 - protein, 9 aa, Homo Sapiens
CIEIKCMPP

SEQ ID NO: 715627 - protein, 9 aa, Homo Sapiens
VQDLDQPES

SEQ ID NO: 715628 - protein, 9 aa, Homo Sapiens
FLQAVTAVQ

SEQ ID NO: 715629 - protein, 9 aa, Homo Sapiens
VSTHSSTLN

SEQ ID NO: 715630 - protein, 9 aa, Homo Sapiens
ILGQHMKSN

SEQ ID NO: 715631 - protein, 9 aa, Homo Sapiens
VKKFFSAFS

SEQ ID NO: 715632 - protein, 9 aa, Homo Sapiens
ICSFRVGAQ

SEQ ID NO: 715633 - protein, 9 aa, Homo Sapiens
VTVLRKPSE

SEQ ID NO: 715634 - protein, 9 aa, Homo Sapiens
RYITDAHTF

SEQ ID NO: 715635 - protein, 9 aa, Homo Sapiens
QSHPHGVKR

SEQ ID NO: 715636 - protein, 9 aa, Homo Sapiens
KELSGPSLP

SEQ ID NO: 715637 - protein, 9 aa, Homo Sapiens
GCRQSLGHG

SEQ ID NO: 715638 - protein, 9 aa, Homo Sapiens
SFRVGAQEN

SEQ ID NO: 715639 - protein, 9 aa, Homo Sapiens
SESLEHQVQ

SEQ ID NO: 715640 - protein, 9 aa, Homo Sapiens
ADLLTKTNR

SEQ ID NO: 715641 - protein, 9 aa, Homo Sapiens
HQRLVRLYT

SEQ ID NO: 715642 - protein, 9 aa, Homo Sapiens
NRVATGLKK

SEQ ID NO: 715643 - protein, 9 aa, Homo Sapiens
LAAASWVIG

SEQ ID NO: 715644 - protein, 9 aa, Homo Sapiens
ATIYTTIFR

SEQ ID NO: 715645 - protein, 9 aa, Homo Sapiens
HAVLLVKLD

SEQ ID NO: 715646 - protein, 9 aa, Homo Sapiens
DVMPETFRN

SEQ ID NO: 715647 - protein, 9 aa, Homo Sapiens
DGVAALEFA

SEQ ID NO: 715648 - protein, 9 aa, Homo Sapiens
SDVRELVRG

SEQ ID NO: 715649 - protein, 9 aa, Homo Sapiens
KEPRSPLIT

SEQ ID NO: 715650 - protein, 9 aa, Homo Sapiens
TVCMLWGHT

SEQ ID NO: 715651 - protein, 9 aa, Homo Sapiens
CRYGGKNGF

SEQ ID NO: 715652 - protein, 9 aa, Homo Sapiens
LRRVQVFRE

SEQ ID NO: 715653 - protein, 9 aa, Homo Sapiens
LQKQTSNPE

SEQ ID NO: 715654 - protein, 9 aa, Homo Sapiens
FKLTVDDGL

SEQ ID NO: 715655 - protein, 9 aa, Homo Sapiens
KHEGDVCNH

SEQ ID NO: 715656 - protein, 9 aa, Homo Sapiens
KNVSLAGKW

SEQ ID NO: 715657 - protein, 9 aa, Homo Sapiens
EMFVTNNLL

SEQ ID NO: 715658 - protein, 9 aa, Homo Sapiens
LKIPFGKNL

SEQ ID NO: 715659 - protein, 9 aa, Homo Sapiens
MSWSRLIRK

SEQ ID NO: 715660 - protein, 9 aa, Homo Sapiens
SQDLRRVQV

SEQ ID NO: 715661 - protein, 9 aa, Homo Sapiens
LKPTLKAKR

SEQ ID NO: 715662 - protein, 9 aa, Homo Sapiens
VWHGNEDTI

SEQ ID NO: 715663 - protein, 9 aa, Homo Sapiens
ANFSLIGVS

SEQ ID NO: 715664 - protein, 9 aa, Homo Sapiens
AGGGCGGFG

SEQ ID NO: 715665 - protein, 9 aa, Homo Sapiens
LAAIEEANR

SEQ ID NO: 715666 - protein, 9 aa, Homo Sapiens
TPPTLPNFS

SEQ ID NO: 715667 - protein, 9 aa, Homo Sapiens
QQGTQLWDI

SEQ ID NO: 715668 - protein, 9 aa, Homo Sapiens
VMTPMMNTL

SEQ ID NO: 715669 - protein, 9 aa, Homo Sapiens
TEREQVRAK

SEQ ID NO: 715670 - protein, 9 aa, Homo Sapiens
SCSKTYNSG

SEQ ID NO: 715671 - protein, 9 aa, Homo Sapiens
NLTPSVTSH

SEQ ID NO: 715672 - protein, 9 aa, Homo Sapiens
NDNEYTTKL

SEQ ID NO: 715673 - protein, 9 aa, Homo Sapiens
VALMDHLSC

SEQ ID NO: 715674 - protein, 9 aa, Homo Sapiens
SPVMPTSPL

SEQ ID NO: 715675 - protein, 9 aa, Homo Sapiens
EDFDDFNLE

SEQ ID NO: 715676 - protein, 9 aa, Homo Sapiens
PDLSPEILT

SEQ ID NO: 715677 - protein, 9 aa, Homo Sapiens
HLIQKAADD

SEQ ID NO: 715678 - protein, 9 aa, Homo Sapiens
KDYKEGDNS

SEQ ID NO: 715679 - protein, 9 aa, Homo Sapiens
LRRLDGPQA

SEQ ID NO: 715680 - protein, 9 aa, Homo Sapiens
TACNWDFRN

SEQ ID NO: 715681 - protein, 9 aa, Homo Sapiens
ALVSFKPTV

SEQ ID NO: 715682 - protein, 9 aa, Homo Sapiens
AMSVIEHMQ

SEQ ID NO: 715683 - protein, 9 aa, Homo Sapiens
LYTVVTQEP

SEQ ID NO: 715684 - protein, 9 aa, Homo Sapiens
TTISVSVMT

SEQ ID NO: 715685 - protein, 9 aa, Homo Sapiens
VSRVLAASL

SEQ ID NO: 715686 - protein, 9 aa, Homo Sapiens
WKDFEVWHG

SEQ ID NO: 715687 - protein, 9 aa, Homo Sapiens
GQRSPTVSR

SEQ ID NO: 715688 - protein, 9 aa, Homo Sapiens
QAVTGFSWR

SEQ ID NO: 715689 - protein, 9 aa, Homo Sapiens
VYSRLPCPH

SEQ ID NO: 715690 - protein, 9 aa, Homo Sapiens
GVVDLVSRS

SEQ ID NO: 715691 - protein, 9 aa, Homo Sapiens
ETSKLAGPK

SEQ ID NO: 715692 - protein, 9 aa, Homo Sapiens
VSASPETLQ

SEQ ID NO: 715693 - protein, 9 aa, Homo Sapiens
SACIEIKCM

SEQ ID NO: 715694 - protein, 9 aa, Homo Sapiens
AFSRVGSKK

SEQ ID NO: 715695 - protein, 9 aa, Homo Sapiens
NSQSLKKDP

SEQ ID NO: 715696 - protein, 9 aa, Homo Sapiens
NFSLIGVSF

SEQ ID NO: 715697 - protein, 9 aa, Homo Sapiens
TTKLELSPF

SEQ ID NO: 715698 - protein, 9 aa, Homo Sapiens
ALAVKMGLD

SEQ ID NO: 715699 - protein, 9 aa, Homo Sapiens
PGAECCSPK

SEQ ID NO: 715700 - protein, 9 aa, Homo Sapiens
EYTTKLELS

SEQ ID NO: 715701 - protein, 9 aa, Homo Sapiens
KTYNSGTQS

SEQ ID NO: 715702 - protein, 9 aa, Homo Sapiens
GTRAVSRVL

SEQ ID NO: 715703 - protein, 9 aa, Homo Sapiens
RALDRKQSE

SEQ ID NO: 715704 - protein, 9 aa, Homo Sapiens
FDTEREQVR

SEQ ID NO: 715705 - protein, 9 aa, Homo Sapiens
VQLPEQQQH

SEQ ID NO: 715706 - protein, 9 aa, Homo Sapiens
CNWDFRNEA

SEQ ID NO: 715707 - protein, 9 aa, Homo Sapiens
QKALVSFKP

SEQ ID NO: 715708 - protein, 9 aa, Homo Sapiens
QLTNPQLYK

SEQ ID NO: 715709 - protein, 9 aa, Homo Sapiens
PQGLYKSSA

SEQ ID NO: 715710 - protein, 9 aa, Homo Sapiens
INGLYQGFN

SEQ ID NO: 715711 - protein, 9 aa, Homo Sapiens
EEANRISED

SEQ ID NO: 715712 - protein, 9 aa, Homo Sapiens
LDLQADSLL

SEQ ID NO: 715713 - protein, 9 aa, Homo Sapiens
GHTTVSTLM

SEQ ID NO: 715714 - protein, 9 aa, Homo Sapiens
SDPTVGVYF

SEQ ID NO: 715715 - protein, 9 aa, Homo Sapiens
LHVVGEHGL

SEQ ID NO: 715716 - protein, 9 aa, Homo Sapiens
EKVLEVSKA

SEQ ID NO: 715717 - protein, 9 aa, Homo Sapiens
LYTSRIDEV

SEQ ID NO: 715718 - protein, 9 aa, Homo Sapiens
MTPMMNTLI

SEQ ID NO: 715719 - protein, 9 aa, Homo Sapiens
SPLITRKHV

SEQ ID NO: 715720 - protein, 9 aa, Homo Sapiens
STLNEEVSE

SEQ ID NO: 715721 - protein, 9 aa, Homo Sapiens
MKGRQPLTV

SEQ ID NO: 715722 - protein, 9 aa, Homo Sapiens
KIKASKSPW

SEQ ID NO: 715723 - protein, 9 aa, Homo Sapiens
RISEHVEER

SEQ ID NO: 715724 - protein, 9 aa, Homo Sapiens
RKLWSKNVS

SEQ ID NO: 715725 - protein, 9 aa, Homo Sapiens
LSGPSLPKD

SEQ ID NO: 715726 - protein, 9 aa, Homo Sapiens
EQVRAKLNR

SEQ ID NO: 715727 - protein, 9 aa, Homo Sapiens
EMSVPLYTS

SEQ ID NO: 715728 - protein, 9 aa, Homo Sapiens
ASTGLATPL

SEQ ID NO: 715729 - protein, 9 aa, Homo Sapiens
MDMNSFSPV

SEQ ID NO: 715730 - protein, 9 aa, Homo Sapiens
ILAINSLEF

SEQ ID NO: 715731 - protein, 9 aa, Homo Sapiens
ELADALSQG

SEQ ID NO: 715732 - protein, 9 aa, Homo Sapiens
LAVKMGLDG

SEQ ID NO: 715733 - protein, 9 aa, Homo Sapiens
KEKFLEYPE

SEQ ID NO: 715734 - protein, 9 aa, Homo Sapiens
DCRDSLDEI

SEQ ID NO: 715735 - protein, 9 aa, Homo Sapiens
VCEVIDHPH

SEQ ID NO: 715736 - protein, 9 aa, Homo Sapiens
HEGDVCNHE

SEQ ID NO: 715737 - protein, 9 aa, Homo Sapiens
EEEEEEIPK

SEQ ID NO: 715738 - protein, 9 aa, Homo Sapiens
KCQHSCLKK

SEQ ID NO: 715739 - protein, 9 aa, Homo Sapiens
EYYRYRVSL

SEQ ID NO: 715740 - protein, 9 aa, Homo Sapiens
CGGPKDHPF

SEQ ID NO: 715741 - protein, 9 aa, Homo Sapiens
HPIIYNFVR

SEQ ID NO: 715742 - protein, 9 aa, Homo Sapiens
TVKHTLVIH

SEQ ID NO: 715743 - protein, 9 aa, Homo Sapiens
NCALGSSWI

SEQ ID NO: 715744 - protein, 9 aa, Homo Sapiens
ADNLTPSVT

SEQ ID NO: 715745 - protein, 9 aa, Homo Sapiens
PTVSRSRSG

SEQ ID NO: 715746 - protein, 9 aa, Homo Sapiens
HGMGFAGAM

SEQ ID NO: 715747 - protein, 9 aa, Homo Sapiens
NNTAMVSVI

SEQ ID NO: 715748 - protein, 9 aa, Homo Sapiens
PRKGIYSFT

SEQ ID NO: 715749 - protein, 9 aa, Homo Sapiens
RVLAASLTP

SEQ ID NO: 715750 - protein, 9 aa, Homo Sapiens
QLQEYLQPM

SEQ ID NO: 715751 - protein, 9 aa, Homo Sapiens
KNRNFNVIP

SEQ ID NO: 715752 - protein, 9 aa, Homo Sapiens
LMDHLSCDT

SEQ ID NO: 715753 - protein, 9 aa, Homo Sapiens
EFDTEREQV

SEQ ID NO: 715754 - protein, 9 aa, Homo Sapiens
CLEPEGLYK

SEQ ID NO: 715755 - protein, 9 aa, Homo Sapiens
WAEMTRALD

SEQ ID NO: 715756 - protein, 9 aa, Homo Sapiens
GEDGEGEVE

SEQ ID NO: 715757 - protein, 9 aa, Homo Sapiens
VGRDSPVNT

SEQ ID NO: 715758 - protein, 9 aa, Homo Sapiens
AFLQAVTAV

SEQ ID NO: 715759 - protein, 9 aa, Homo Sapiens
DISERLEEA

SEQ ID NO: 715760 - protein, 9 aa, Homo Sapiens
LIAANFSLI

SEQ ID NO: 715761 - protein, 9 aa, Homo Sapiens
GSGCRQSLG

SEQ ID NO: 715762 - protein, 9 aa, Homo Sapiens
QKTGITKLK

SEQ ID NO: 715763 - protein, 9 aa, Homo Sapiens
FTCDDPRFQ

SEQ ID NO: 715764 - protein, 9 aa, Homo Sapiens
LLASGPEAC

SEQ ID NO: 715765 - protein, 9 aa, Homo Sapiens
IIIAIYALL

SEQ ID NO: 715766 - protein, 9 aa, Homo Sapiens
HRIHSGERP

SEQ ID NO: 715767 - protein, 9 aa, Homo Sapiens
FLTKLQPYC

SEQ ID NO: 715768 - protein, 9 aa, Homo Sapiens
LPPKKKYPE

SEQ ID NO: 715769 - protein, 9 aa, Homo Sapiens
WTSCSKTYN

SEQ ID NO: 715770 - protein, 9 aa, Homo Sapiens
AVTEAELKT

SEQ ID NO: 715771 - protein, 9 aa, Homo Sapiens
RDFPCPVCQ

SEQ ID NO: 715772 - protein, 9 aa, Homo Sapiens
LSQTWSAQE

SEQ ID NO: 715773 - protein, 9 aa, Homo Sapiens
NEMATAASY

SEQ ID NO: 715774 - protein, 9 aa, Homo Sapiens
VYLAHPQAV

SEQ ID NO: 715775 - protein, 9 aa, Homo Sapiens
ESSGNKHPS

SEQ ID NO: 715776 - protein, 9 aa, Homo Sapiens
KSSFLKNCS

SEQ ID NO: 715777 - protein, 9 aa, Homo Sapiens
GVERYITDA

SEQ ID NO: 715778 - protein, 9 aa, Homo Sapiens
TWSAQEDSP

SEQ ID NO: 715779 - protein, 9 aa, Homo Sapiens
GAGGGCGGF

SEQ ID NO: 715780 - protein, 9 aa, Homo Sapiens
IHRVNAVTL

SEQ ID NO: 715781 - protein, 9 aa, Homo Sapiens
KILHVVGEH

SEQ ID NO: 715782 - protein, 9 aa, Homo Sapiens
SLASADLLL

SEQ ID NO: 715783 - protein, 9 aa, Homo Sapiens
EAGYDQCDA

SEQ ID NO: 715784 - protein, 9 aa, Homo Sapiens
LCFQKTFPD

SEQ ID NO: 715785 - protein, 9 aa, Homo Sapiens
EPQTTVIEN

SEQ ID NO: 715786 - protein, 9 aa, Homo Sapiens
AINSLEFQY

SEQ ID NO: 715787 - protein, 9 aa, Homo Sapiens
KRTTFTRSQ

SEQ ID NO: 715788 - protein, 9 aa, Homo Sapiens
ALMDHLSCD

SEQ ID NO: 715789 - protein, 9 aa, Homo Sapiens
AIRKMEQMH

SEQ ID NO: 715790 - protein, 9 aa, Homo Sapiens
QTTNVVSGV

SEQ ID NO: 715791 - protein, 9 aa, Homo Sapiens
EIKEGECHV

SEQ ID NO: 715792 - protein, 9 aa, Homo Sapiens
SVKYSAPSA

SEQ ID NO: 715793 - protein, 9 aa, Homo Sapiens
FFAFPVTYA

SEQ ID NO: 715794 - protein, 9 aa, Homo Sapiens
VLLVKLDQR

SEQ ID NO: 715795 - protein, 9 aa, Homo Sapiens
IRLHTRCRG

SEQ ID NO: 715796 - protein, 9 aa, Homo Sapiens
RNFNVIPYD

SEQ ID NO: 715797 - protein, 9 aa, Homo Sapiens
APPPVINRR

SEQ ID NO: 715798 - protein, 9 aa, Homo Sapiens
QHSCLKKLL

SEQ ID NO: 715799 - protein, 9 aa, Homo Sapiens
LWGHTEVCV

SEQ ID NO: 715800 - protein, 9 aa, Homo Sapiens
RSKVQDPPV

SEQ ID NO: 715801 - protein, 9 aa, Homo Sapiens
QPVTLFPLL

SEQ ID NO: 715802 - protein, 9 aa, Homo Sapiens
GCITHLFFL

SEQ ID NO: 715803 - protein, 9 aa, Homo Sapiens
AEQVGIDNG

SEQ ID NO: 715804 - protein, 9 aa, Homo Sapiens
EGRLIAANF

SEQ ID NO: 715805 - protein, 9 aa, Homo Sapiens
KCESKCQHS

SEQ ID NO: 715806 - protein, 9 aa, Homo Sapiens
TEITLDTAT

SEQ ID NO: 715807 - protein, 9 aa, Homo Sapiens
ITLDTATAN

SEQ ID NO: 715808 - protein, 9 aa, Homo Sapiens
VPIPAGEEK

SEQ ID NO: 715809 - protein, 9 aa, Homo Sapiens
KKKKKGTKR

SEQ ID NO: 715810 - protein, 9 aa, Homo Sapiens
RLQNRISEH

SEQ ID NO: 715811 - protein, 9 aa, Homo Sapiens
TAVYFCATS

SEQ ID NO: 715812 - protein, 9 aa, Homo Sapiens
KVDCRDSLD

SEQ ID NO: 715813 - protein, 9 aa, Homo Sapiens
ITQDQLQKQ

SEQ ID NO: 715814 - protein, 9 aa, Homo Sapiens
VIDHPHVKC

SEQ ID NO: 715815 - protein, 9 aa, Homo Sapiens
FNVIPYDYN

SEQ ID NO: 715816 - protein, 9 aa, Homo Sapiens
EELYMTHSR

SEQ ID NO: 715817 - protein, 9 aa, Homo Sapiens
LSPEILTPP

SEQ ID NO: 715818 - protein, 9 aa, Homo Sapiens
LLVRNSFEV

SEQ ID NO: 715819 - protein, 9 aa, Homo Sapiens
RQVQQLLGN

SEQ ID NO: 715820 - protein, 9 aa, Homo Sapiens
SPQDPLRGH

SEQ ID NO: 715821 - protein, 9 aa, Homo Sapiens
LLVKLDQRE

SEQ ID NO: 715822 - protein, 9 aa, Homo Sapiens
VTYAIAPGY

SEQ ID NO: 715823 - protein, 9 aa, Homo Sapiens
DTEREQVRA

SEQ ID NO: 715824 - protein, 9 aa, Homo Sapiens
QSLKKDPMM

SEQ ID NO: 715825 - protein, 9 aa, Homo Sapiens
LLALFADHQ

SEQ ID NO: 715826 - protein, 9 aa, Homo Sapiens
MSVPLYTSR

SEQ ID NO: 715827 - protein, 9 aa, Homo Sapiens
EDKEDYTAQ

SEQ ID NO: 715828 - protein, 9 aa, Homo Sapiens
FVSPQDPLR

SEQ ID NO: 715829 - protein, 9 aa, Homo Sapiens
VGVYFFSRL

SEQ ID NO: 715830 - protein, 9 aa, Homo Sapiens
MSAARQSHP

SEQ ID NO: 715831 - protein, 9 aa, Homo Sapiens
IYKSDGING

SEQ ID NO: 715832 - protein, 9 aa, Homo Sapiens
STHSSTLNE

SEQ ID NO: 715833 - protein, 9 aa, Homo Sapiens
IHTGEQPSK

SEQ ID NO: 715834 - protein, 9 aa, Homo Sapiens
RYKQAQKIS

SEQ ID NO: 715835 - protein, 9 aa, Homo Sapiens
IRKMEQMHK

SEQ ID NO: 715836 - protein, 9 aa, Homo Sapiens
KLHFMDMQN

SEQ ID NO: 715837 - protein, 9 aa, Homo Sapiens
VIQMKEAQT

SEQ ID NO: 715838 - protein, 9 aa, Homo Sapiens
GNLLVRNSF

SEQ ID NO: 715839 - protein, 9 aa, Homo Sapiens
ATAASYSSL

SEQ ID NO: 715840 - protein, 9 aa, Homo Sapiens
RLWANSGDQ

SEQ ID NO: 715841 - protein, 9 aa, Homo Sapiens
YSFHGRDIM

SEQ ID NO: 715842 - protein, 9 aa, Homo Sapiens
QHMKSNLTS

SEQ ID NO: 715843 - protein, 9 aa, Homo Sapiens
KDPKREIET

SEQ ID NO: 715844 - protein, 9 aa, Homo Sapiens
GFRSSGYAD

SEQ ID NO: 715845 - protein, 9 aa, Homo Sapiens
TVTCSQNVN

SEQ ID NO: 715846 - protein, 9 aa, Homo Sapiens
AASYSSLEK

SEQ ID NO: 715847 - protein, 9 aa, Homo Sapiens
REERKDPLL

SEQ ID NO: 715848 - protein, 9 aa, Homo Sapiens
NEESEKRKK

SEQ ID NO: 715849 - protein, 9 aa, Homo Sapiens
KGKNKHEGD

SEQ ID NO: 715850 - protein, 9 aa, Homo Sapiens
CGRPAVPVL

SEQ ID NO: 715851 - protein, 9 aa, Homo Sapiens
SDLSRELED

SEQ ID NO: 715852 - protein, 9 aa, Homo Sapiens
VSTLMSVSS

SEQ ID NO: 715853 - protein, 9 aa, Homo Sapiens
LVIQTLSQE

SEQ ID NO: 715854 - protein, 9 aa, Homo Sapiens
LITRKHVLP

SEQ ID NO: 715855 - protein, 9 aa, Homo Sapiens
LIALAVKMG

SEQ ID NO: 715856 - protein, 9 aa, Homo Sapiens
MGNTLYVTG

SEQ ID NO: 715857 - protein, 9 aa, Homo Sapiens
ATLVQRGSE

SEQ ID NO: 715858 - protein, 9 aa, Homo Sapiens
QMHKLLKVY

SEQ ID NO: 715859 - protein, 9 aa, Homo Sapiens
QPYCRGNIL

SEQ ID NO: 715860 - protein, 9 aa, Homo Sapiens
TATIYTTIF

SEQ ID NO: 715861 - protein, 9 aa, Homo Sapiens
RLGLPGRSE

SEQ ID NO: 715862 - protein, 9 aa, Homo Sapiens
QLQWSQDLR

SEQ ID NO: 715863 - protein, 9 aa, Homo Sapiens
QAQKISDDL

SEQ ID NO: 715864 - protein, 9 aa, Homo Sapiens
HLFFLHFLG

SEQ ID NO: 715865 - protein, 9 aa, Homo Sapiens
VQFKPGSWG

SEQ ID NO: 715866 - protein, 9 aa, Homo Sapiens
IIAIYALLT

SEQ ID NO: 715867 - protein, 9 aa, Homo Sapiens
AFCNMNDVE

SEQ ID NO: 715868 - protein, 9 aa, Homo Sapiens
LGAFCNMND

SEQ ID NO: 715869 - protein, 9 aa, Homo Sapiens
ALLNMDREA

SEQ ID NO: 715870 - protein, 9 aa, Homo Sapiens
SMIKGVTSG

SEQ ID NO: 715871 - protein, 9 aa, Homo Sapiens
PKEIREDDL

SEQ ID NO: 715872 - protein, 9 aa, Homo Sapiens
WSQDLRRVQ

SEQ ID NO: 715873 - protein, 9 aa, Homo Sapiens
HSGVSHKPH

SEQ ID NO: 715874 - protein, 9 aa, Homo Sapiens
DSSSSPAKP

SEQ ID NO: 715875 - protein, 9 aa, Homo Sapiens
RTALLNMDR

SEQ ID NO: 715876 - protein, 9 aa, Homo Sapiens
NSQPVTLFP

SEQ ID NO: 715877 - protein, 9 aa, Homo Sapiens
VEMGPFKLT

SEQ ID NO: 715878 - protein, 9 aa, Homo Sapiens
FHFNGKVKQ

SEQ ID NO: 715879 - protein, 9 aa, Homo Sapiens
AFPVTYAIA

SEQ ID NO: 715880 - protein, 9 aa, Homo Sapiens
DSPVNTLLY

SEQ ID NO: 715881 - protein, 9 aa, Homo Sapiens
PNGIIQYCS

SEQ ID NO: 715882 - protein, 9 aa, Homo Sapiens
MTRALDRKQ

SEQ ID NO: 715883 - protein, 9 aa, Homo Sapiens
LATPLPVTS

SEQ ID NO: 715884 - protein, 9 aa, Homo Sapiens
TFLTKLQPY

SEQ ID NO: 715885 - protein, 9 aa, Homo Sapiens
EEDGRSHRL

SEQ ID NO: 715886 - protein, 9 aa, Homo Sapiens
NKDKFCPLT

SEQ ID NO: 715887 - protein, 9 aa, Homo Sapiens
YNFGNELRQ

SEQ ID NO: 715888 - protein, 9 aa, Homo Sapiens
EQVGIDNGD

SEQ ID NO: 715889 - protein, 9 aa, Homo Sapiens
HAHFETSKL

SEQ ID NO: 715890 - protein, 9 aa, Homo Sapiens
TKPENSSYD

SEQ ID NO: 715891 - protein, 9 aa, Homo Sapiens
ENSQPVTLF

SEQ ID NO: 715892 - protein, 9 aa, Homo Sapiens
CVLYDKDAV

SEQ ID NO: 715893 - protein, 9 aa, Homo Sapiens
SRVLAASLT

SEQ ID NO: 715894 - protein, 9 aa, Homo Sapiens
NNTVQIKLV

SEQ ID NO: 715895 - protein, 9 aa, Homo Sapiens
PFYVYSRLP

SEQ ID NO: 715896 - protein, 9 aa, Homo Sapiens
NVQENSEHI

SEQ ID NO: 715897 - protein, 9 aa, Homo Sapiens
TVVTQEPIY

SEQ ID NO: 715898 - protein, 9 aa, Homo Sapiens
KACQFKSSF

SEQ ID NO: 715899 - protein, 9 aa, Homo Sapiens
LSGVGCVLY

SEQ ID NO: 715900 - protein, 9 aa, Homo Sapiens
YSFTFHVVK

SEQ ID NO: 715901 - protein, 9 aa, Homo Sapiens
NIIRKSSVK

SEQ ID NO: 715902 - protein, 9 aa, Homo Sapiens
SSMRRTVSG

SEQ ID NO: 715903 - protein, 9 aa, Homo Sapiens
EDQSSGRLW

SEQ ID NO: 715904 - protein, 9 aa, Homo Sapiens
VEDCPRMKG

SEQ ID NO: 715905 - protein, 9 aa, Homo Sapiens
PFKLTVDDG

SEQ ID NO: 715906 - protein, 9 aa, Homo Sapiens
TTIFRIGTV

SEQ ID NO: 715907 - protein, 9 aa, Homo Sapiens
GLSQTWSAQ

SEQ ID NO: 715908 - protein, 9 aa, Homo Sapiens
QENLAPAPG

SEQ ID NO: 715909 - protein, 9 aa, Homo Sapiens
RCCYLREIQ

SEQ ID NO: 715910 - protein, 9 aa, Homo Sapiens
KRKKKKKGT

SEQ ID NO: 715911 - protein, 9 aa, Homo Sapiens
GDPSLCFQK

SEQ ID NO: 715912 - protein, 9 aa, Homo Sapiens
SFHGRDIMT

SEQ ID NO: 715913 - protein, 9 aa, Homo Sapiens
SPTVSRSRS

SEQ ID NO: 715914 - protein, 9 aa, Homo Sapiens
PVMPTSPLS

SEQ ID NO: 715915 - protein, 9 aa, Homo Sapiens
VPDSGSPPL

SEQ ID NO: 715916 - protein, 9 aa, Homo Sapiens
QVEVRRGPV

SEQ ID NO: 715917 - protein, 9 aa, Homo Sapiens
RSPLITRKH

SEQ ID NO: 715918 - protein, 9 aa, Homo Sapiens
VQQLLGNVQ

SEQ ID NO: 715919 - protein, 9 aa, Homo Sapiens
QVGIDNGDI

SEQ ID NO: 715920 - protein, 9 aa, Homo Sapiens
IVVGVPDSG

SEQ ID NO: 715921 - protein, 9 aa, Homo Sapiens
DFLEDLDFL

SEQ ID NO: 715922 - protein, 9 aa, Homo Sapiens
FWVTILPPK

SEQ ID NO: 715923 - protein, 9 aa, Homo Sapiens
LRQNMAVYV

SEQ ID NO: 715924 - protein, 9 aa, Homo Sapiens
FADHQWVAP

SEQ ID NO: 715925 - protein, 9 aa, Homo Sapiens
QRRKRTTFT

SEQ ID NO: 715926 - protein, 9 aa, Homo Sapiens
VTVQFKPGS

SEQ ID NO: 715927 - protein, 9 aa, Homo Sapiens
DFRNEADLQ

SEQ ID NO: 715928 - protein, 9 aa, Homo Sapiens
LLLASGPEA

SEQ ID NO: 715929 - protein, 9 aa, Homo Sapiens
STLMSVSSE

SEQ ID NO: 715930 - protein, 9 aa, Homo Sapiens
HSDGSLLQE

SEQ ID NO: 715931 - protein, 9 aa, Homo Sapiens
SWSRLIRKL

SEQ ID NO: 715932 - protein, 9 aa, Homo Sapiens
EREQVRAKL

SEQ ID NO: 715933 - protein, 9 aa, Homo Sapiens
SRAPGSTWA

SEQ ID NO: 715934 - protein, 9 aa, Homo Sapiens
GRLWANSGD

SEQ ID NO: 715935 - protein, 9 aa, Homo Sapiens
LSQGHMRGG

SEQ ID NO: 715936 - protein, 9 aa, Homo Sapiens
ASYSSLEKS

SEQ ID NO: 715937 - protein, 9 aa, Homo Sapiens
LLREIKTIP

SEQ ID NO: 715938 - protein, 9 aa, Homo Sapiens
IIPFLETHT

SEQ ID NO: 715939 - protein, 9 aa, Homo Sapiens
RRLDGPQAS

SEQ ID NO: 715940 - protein, 9 aa, Homo Sapiens
SYFLALVEK

SEQ ID NO: 715941 - protein, 9 aa, Homo Sapiens
RIRISQEDN

SEQ ID NO: 715942 - protein, 9 aa, Homo Sapiens
ASKSPWLQK

SEQ ID NO: 715943 - protein, 9 aa, Homo Sapiens
IKLVIQTLS

SEQ ID NO: 715944 - protein, 9 aa, Homo Sapiens
VLYLITEAT

SEQ ID NO: 715945 - protein, 9 aa, Homo Sapiens
FDSSSSPAK

SEQ ID NO: 715946 - protein, 9 aa, Homo Sapiens
RYGGKNGFM

SEQ ID NO: 715947 - protein, 9 aa, Homo Sapiens
QAEAVTEAE

SEQ ID NO: 715948 - protein, 9 aa, Homo Sapiens
CPVCQKTSR

SEQ ID NO: 715949 - protein, 9 aa, Homo Sapiens
VSHKPHSQE

SEQ ID NO: 715950 - protein, 9 aa, Homo Sapiens
LAKEMSVPL

SEQ ID NO: 715951 - protein, 9 aa, Homo Sapiens
QLQKQTSNP

SEQ ID NO: 715952 - protein, 9 aa, Homo Sapiens
KRIRISQED

SEQ ID NO: 715953 - protein, 9 aa, Homo Sapiens
SLPKDLHST

SEQ ID NO: 715954 - protein, 9 aa, Homo Sapiens
GITKLKEAL

SEQ ID NO: 715955 - protein, 9 aa, Homo Sapiens
GVAALEFAD

SEQ ID NO: 715956 - protein, 9 aa, Homo Sapiens
NFNVIPYDY

SEQ ID NO: 715957 - protein, 9 aa, Homo Sapiens
LKELSGPSL

SEQ ID NO: 715958 - protein, 9 aa, Homo Sapiens
GDKGKNKHE

SEQ ID NO: 715959 - protein, 9 aa, Homo Sapiens
FLEDLDFLE

SEQ ID NO: 715960 - protein, 9 aa, Homo Sapiens
RRQVEVRRG

SEQ ID NO: 715961 - protein, 9 aa, Homo Sapiens
TSCSKTYNS

SEQ ID NO: 715962 - protein, 9 aa, Homo Sapiens
FMDMQNACK

SEQ ID NO: 715963 - protein, 9 aa, Homo Sapiens
SSPDNAMVS

SEQ ID NO: 715964 - protein, 9 aa, Homo Sapiens
FSALSVPPA

SEQ ID NO: 715965 - protein, 9 aa, Homo Sapiens
GFVSPQDPL

SEQ ID NO: 715966 - protein, 9 aa, Homo Sapiens
SGVSHKPHS

SEQ ID NO: 715967 - protein, 9 aa, Homo Sapiens
RISQEDNVA

SEQ ID NO: 715968 - protein, 9 aa, Homo Sapiens
AMVSVILKS

SEQ ID NO: 715969 - protein, 9 aa, Homo Sapiens
RSLSAQKAP

SEQ ID NO: 715970 - protein, 9 aa, Homo Sapiens
PHCGKLFQR

SEQ ID NO: 715971 - protein, 9 aa, Homo Sapiens
VDLVSRSNQ

SEQ ID NO: 715972 - protein, 9 aa, Homo Sapiens
FTFHVVKVY

SEQ ID NO: 715973 - protein, 9 aa, Homo Sapiens
IQKAADDSN

SEQ ID NO: 715974 - protein, 9 aa, Homo Sapiens
VRAKLNREE

SEQ ID NO: 715975 - protein, 9 aa, Homo Sapiens
SSGALLPVA

SEQ ID NO: 715976 - protein, 9 aa, Homo Sapiens
PLQPSEMFV

SEQ ID NO: 715977 - protein, 9 aa, Homo Sapiens
KAADDSNLK

SEQ ID NO: 715978 - protein, 9 aa, Homo Sapiens
HEVPIGNSL

SEQ ID NO: 715979 - protein, 9 aa, Homo Sapiens
DGRSHRLPQ

SEQ ID NO: 715980 - protein, 9 aa, Homo Sapiens
PSLCFQKTF

SEQ ID NO: 715981 - protein, 9 aa, Homo Sapiens
SNSQSLKKD

SEQ ID NO: 715982 - protein, 9 aa, Homo Sapiens
VKHTLVIHQ

SEQ ID NO: 715983 - protein, 9 aa, Homo Sapiens
QDNRVATGL

SEQ ID NO: 715984 - protein, 9 aa, Homo Sapiens
MVSVILKSD

SEQ ID NO: 715985 - protein, 9 aa, Homo Sapiens
MFVTNNLLD

SEQ ID NO: 715986 - protein, 9 aa, Homo Sapiens
EKRKKKKKG

SEQ ID NO: 715987 - protein, 9 aa, Homo Sapiens
LILHHRIHS

SEQ ID NO: 715988 - protein, 9 aa, Homo Sapiens
NRNFNVIPY

SEQ ID NO: 715989 - protein, 9 aa, Homo Sapiens
QNGLLKPTL

SEQ ID NO: 715990 - protein, 9 aa, Homo Sapiens
GALIALAVK

SEQ ID NO: 715991 - protein, 9 aa, Homo Sapiens
FPAPIPSSQ

SEQ ID NO: 715992 - protein, 9 aa, Homo Sapiens
FVTNNLLDL

SEQ ID NO: 715993 - protein, 9 aa, Homo Sapiens
MEFAPSKGA

SEQ ID NO: 715994 - protein, 9 aa, Homo Sapiens
MLDNEANGN

SEQ ID NO: 715995 - protein, 9 aa, Homo Sapiens
SECRKAFSY

SEQ ID NO: 715996 - protein, 9 aa, Homo Sapiens
RRVQVFREQ

SEQ ID NO: 715997 - protein, 9 aa, Homo Sapiens
KPGSWGRVG

SEQ ID NO: 715998 - protein, 9 aa, Homo Sapiens
YPEDYVAHE

SEQ ID NO: 715999 - protein, 9 aa, Homo Sapiens
INRRTFQGE

SEQ ID NO: 716000 - protein, 9 aa, Homo Sapiens
PCSSMRRTV

SEQ ID NO: 716001 - protein, 9 aa, Homo Sapiens
DQCDAGWLR

SEQ ID NO: 716002 - protein, 9 aa, Homo Sapiens
KAFATCSTH

SEQ ID NO: 716003 - protein, 9 aa, Homo Sapiens
SNNQFVLYL

SEQ ID NO: 716004 - protein, 9 aa, Homo Sapiens
NVSLAGKWL

SEQ ID NO: 716005 - protein, 9 aa, Homo Sapiens
AVRNCYFGI

SEQ ID NO: 716006 - protein, 9 aa, Homo Sapiens
CLGDIAKGS

SEQ ID NO: 716007 - protein, 9 aa, Homo Sapiens
MVIQMKEAQ

SEQ ID NO: 716008 - protein, 9 aa, Homo Sapiens
QTAVYFCAT

SEQ ID NO: 716009 - protein, 9 aa, Homo Sapiens
ENKSKNRNF

SEQ ID NO: 716010 - protein, 9 aa, Homo Sapiens
RVSLTTPPC

SEQ ID NO: 716011 - protein, 9 aa, Homo Sapiens
EYPEDYVAH

SEQ ID NO: 716012 - protein, 9 aa, Homo Sapiens
QGLYKSSAG

SEQ ID NO: 716013 - protein, 9 aa, Homo Sapiens
KTGITKLKE

SEQ ID NO: 716014 - protein, 9 aa, Homo Sapiens
IMHLEDHLF

SEQ ID NO: 716015 - protein, 9 aa, Homo Sapiens
CILAINSLE

SEQ ID NO: 716016 - protein, 9 aa, Homo Sapiens
EIRNMSWSR

SEQ ID NO: 716017 - protein, 9 aa, Homo Sapiens
LQHMRLSKT

SEQ ID NO: 716018 - protein, 9 aa, Homo Sapiens
ESKCQHSCL

SEQ ID NO: 716019 - protein, 9 aa, Homo Sapiens
TKQFDSSSS

SEQ ID NO: 716020 - protein, 9 aa, Homo Sapiens
TKDVTVLRK

SEQ ID NO: 716021 - protein, 9 aa, Homo Sapiens
GQGFRSSGY

SEQ ID NO: 716022 - protein, 9 aa, Homo Sapiens
SWITARRID

SEQ ID NO: 716023 - protein, 9 aa, Homo Sapiens
HKLLNGTRG

SEQ ID NO: 716024 - protein, 9 aa, Homo Sapiens
NERAQEAMR

SEQ ID NO: 716025 - protein, 9 aa, Homo Sapiens
KERKKMTSK

SEQ ID NO: 716026 - protein, 9 aa, Homo Sapiens
SILTKLGCG

SEQ ID NO: 716027 - protein, 9 aa, Homo Sapiens
IQSITVESR

SEQ ID NO: 716028 - protein, 9 aa, Homo Sapiens
LRLELTGTS

SEQ ID NO: 716029 - protein, 9 aa, Homo Sapiens
WKAQVRRIY

SEQ ID NO: 716030 - protein, 9 aa, Homo Sapiens
DSYQKGILR

SEQ ID NO: 716031 - protein, 9 aa, Homo Sapiens
AILLVLLPI

SEQ ID NO: 716032 - protein, 9 aa, Homo Sapiens
GSCGKVLVC

SEQ ID NO: 716033 - protein, 9 aa, Homo Sapiens
EVNGYPVGE

SEQ ID NO: 716034 - protein, 9 aa, Homo Sapiens
NSFTTSSTQ

SEQ ID NO: 716035 - protein, 9 aa, Homo Sapiens
YTASLGEAA

SEQ ID NO: 716036 - protein, 9 aa, Homo Sapiens
KESQIQLEL

SEQ ID NO: 716037 - protein, 9 aa, Homo Sapiens
FSQRLFVIL

SEQ ID NO: 716038 - protein, 9 aa, Homo Sapiens
CPEVKLKMA

SEQ ID NO: 716039 - protein, 9 aa, Homo Sapiens
KILTDTQNS

SEQ ID NO: 716040 - protein, 9 aa, Homo Sapiens
LSIVVLFIT

SEQ ID NO: 716041 - protein, 9 aa, Homo Sapiens
MGLSMGTII

SEQ ID NO: 716042 - protein, 9 aa, Homo Sapiens
PYQSPQSIL

SEQ ID NO: 716043 - protein, 9 aa, Homo Sapiens
ASDSHCPEV

SEQ ID NO: 716044 - protein, 9 aa, Homo Sapiens
YSAFYLGHL

SEQ ID NO: 716045 - protein, 9 aa, Homo Sapiens
ITDTINEPI

SEQ ID NO: 716046 - protein, 9 aa, Homo Sapiens
HVTRNLTCL

SEQ ID NO: 716047 - protein, 9 aa, Homo Sapiens
REMKTFIPP

SEQ ID NO: 716048 - protein, 9 aa, Homo Sapiens
GSARMAELL

SEQ ID NO: 716049 - protein, 9 aa, Homo Sapiens
TQERDHSGE

SEQ ID NO: 716050 - protein, 9 aa, Homo Sapiens
KLVAAAQKE

SEQ ID NO: 716051 - protein, 9 aa, Homo Sapiens
VANELRRKR

SEQ ID NO: 716052 - protein, 9 aa, Homo Sapiens
LAQYFQYRK

SEQ ID NO: 716053 - protein, 9 aa, Homo Sapiens
QIVVGWQLK

SEQ ID NO: 716054 - protein, 9 aa, Homo Sapiens
SHWSESTAA

SEQ ID NO: 716055 - protein, 9 aa, Homo Sapiens
CHQRNCIPI

SEQ ID NO: 716056 - protein, 9 aa, Homo Sapiens
SQGPPPQGD

SEQ ID NO: 716057 - protein, 9 aa, Homo Sapiens
RDPLSKITE

SEQ ID NO: 716058 - protein, 9 aa, Homo Sapiens
LPPRNIPLN

SEQ ID NO: 716059 - protein, 9 aa, Homo Sapiens
DDGLRPNSK

SEQ ID NO: 716060 - protein, 9 aa, Homo Sapiens
IIGVSLLSV

SEQ ID NO: 716061 - protein, 9 aa, Homo Sapiens
ETDRKEASS

SEQ ID NO: 716062 - protein, 9 aa, Homo Sapiens
AFLVPRARP

SEQ ID NO: 716063 - protein, 9 aa, Homo Sapiens
DRKEASSES

SEQ ID NO: 716064 - protein, 9 aa, Homo Sapiens
LLSSRYARA

SEQ ID NO: 716065 - protein, 9 aa, Homo Sapiens
SSHRNIYSS

SEQ ID NO: 716066 - protein, 9 aa, Homo Sapiens
MMGSARMAE

SEQ ID NO: 716067 - protein, 9 aa, Homo Sapiens
STDPAIHEF

SEQ ID NO: 716068 - protein, 9 aa, Homo Sapiens
GNSFTTSST

SEQ ID NO: 716069 - protein, 9 aa, Homo Sapiens
VWYQHGQRK

SEQ ID NO: 716070 - protein, 9 aa, Homo Sapiens
MSVKALYTV

SEQ ID NO: 716071 - protein, 9 aa, Homo Sapiens
HWSESTAAK

SEQ ID NO: 716072 - protein, 9 aa, Homo Sapiens
IDVNDHATE

SEQ ID NO: 716073 - protein, 9 aa, Homo Sapiens
LSPGAILLV

SEQ ID NO: 716074 - protein, 9 aa, Homo Sapiens
AQIESSKSK

SEQ ID NO: 716075 - protein, 9 aa, Homo Sapiens
PSYDVYMYQ

SEQ ID NO: 716076 - protein, 9 aa, Homo Sapiens
PGYQDSTSQ

SEQ ID NO: 716077 - protein, 9 aa, Homo Sapiens
ITVESRGSI

SEQ ID NO: 716078 - protein, 9 aa, Homo Sapiens
AVMSYDSYV

SEQ ID NO: 716079 - protein, 9 aa, Homo Sapiens
HACISIPFC

SEQ ID NO: 716080 - protein, 9 aa, Homo Sapiens
QNYESLLGL

SEQ ID NO: 716081 - protein, 9 aa, Homo Sapiens
EPPGKPSAL

SEQ ID NO: 716082 - protein, 9 aa, Homo Sapiens
EGCMLAVAT

SEQ ID NO: 716083 - protein, 9 aa, Homo Sapiens
VSRSRSGSQ

SEQ ID NO: 716084 - protein, 9 aa, Homo Sapiens
DDGQRLSGG

SEQ ID NO: 716085 - protein, 9 aa, Homo Sapiens
GGFFGGNPR

SEQ ID NO: 716086 - protein, 9 aa, Homo Sapiens
QARLISVPH

SEQ ID NO: 716087 - protein, 9 aa, Homo Sapiens
AILISRKGR

SEQ ID NO: 716088 - protein, 9 aa, Homo Sapiens
YQKHYGPQT

SEQ ID NO: 716089 - protein, 9 aa, Homo Sapiens
HMSVVVLFY

SEQ ID NO: 716090 - protein, 9 aa, Homo Sapiens
SVANELRRK

SEQ ID NO: 716091 - protein, 9 aa, Homo Sapiens
ASGCFVLIL

SEQ ID NO: 716092 - protein, 9 aa, Homo Sapiens
CSADAYSEG

SEQ ID NO: 716093 - protein, 9 aa, Homo Sapiens
EQNDLERLQ

SEQ ID NO: 716094 - protein, 9 aa, Homo Sapiens
RMAELLLLH

SEQ ID NO: 716095 - protein, 9 aa, Homo Sapiens
LVCAAEYSH

SEQ ID NO: 716096 - protein, 9 aa, Homo Sapiens
PGHDDGQRL

SEQ ID NO: 716097 - protein, 9 aa, Homo Sapiens
ERAYHCGKC

SEQ ID NO: 716098 - protein, 9 aa, Homo Sapiens
KLQFYKQKA

SEQ ID NO: 716099 - protein, 9 aa, Homo Sapiens
IGIITRFLY

SEQ ID NO: 716100 - protein, 9 aa, Homo Sapiens
LLCVWVSSI

SEQ ID NO: 716101 - protein, 9 aa, Homo Sapiens
SGSFIDQSR

SEQ ID NO: 716102 - protein, 9 aa, Homo Sapiens
RNSSSDWVT

SEQ ID NO: 716103 - protein, 9 aa, Homo Sapiens
HRNIYSSIL

SEQ ID NO: 716104 - protein, 9 aa, Homo Sapiens
DSRIPCLIL

SEQ ID NO: 716105 - protein, 9 aa, Homo Sapiens
TVTPGYQDS

SEQ ID NO: 716106 - protein, 9 aa, Homo Sapiens
FIDQSRVLN

SEQ ID NO: 716107 - protein, 9 aa, Homo Sapiens
KSQGPPPQG

SEQ ID NO: 716108 - protein, 9 aa, Homo Sapiens
PENQTNGAT

SEQ ID NO: 716109 - protein, 9 aa, Homo Sapiens
ISPEGPLIL

SEQ ID NO: 716110 - protein, 9 aa, Homo Sapiens
QGILWTIRL

SEQ ID NO: 716111 - protein, 9 aa, Homo Sapiens
RRKQSSKHA

SEQ ID NO: 716112 - protein, 9 aa, Homo Sapiens
NLLKTVPIR

SEQ ID NO: 716113 - protein, 9 aa, Homo Sapiens
SLCHATNQL

SEQ ID NO: 716114 - protein, 9 aa, Homo Sapiens
ENIRAVATA

SEQ ID NO: 716115 - protein, 9 aa, Homo Sapiens
LSGLSLLRN

SEQ ID NO: 716116 - protein, 9 aa, Homo Sapiens
LAVLALLSF

SEQ ID NO: 716117 - protein, 9 aa, Homo Sapiens
PAPVRIQVV

SEQ ID NO: 716118 - protein, 9 aa, Homo Sapiens
QKHYGPQTL

SEQ ID NO: 716119 - protein, 9 aa, Homo Sapiens
FDGSKPDAL

SEQ ID NO: 716120 - protein, 9 aa, Homo Sapiens
LKSGQVYSF

SEQ ID NO: 716121 - protein, 9 aa, Homo Sapiens
LRNSAAIEE

SEQ ID NO: 716122 - protein, 9 aa, Homo Sapiens
IKDSYQKGI

SEQ ID NO: 716123 - protein, 9 aa, Homo Sapiens
PKVSQGKDV

SEQ ID NO: 716124 - protein, 9 aa, Homo Sapiens
TWATASTGR

SEQ ID NO: 716125 - protein, 9 aa, Homo Sapiens
KKYLMAALY

SEQ ID NO: 716126 - protein, 9 aa, Homo Sapiens
VPLFCSILT

SEQ ID NO: 716127 - protein, 9 aa, Homo Sapiens
LRSNLLKTV

SEQ ID NO: 716128 - protein, 9 aa, Homo Sapiens
GVTEIPTNL

SEQ ID NO: 716129 - protein, 9 aa, Homo Sapiens
MSYDSYVAI

SEQ ID NO: 716130 - protein, 9 aa, Homo Sapiens
VFLDTIISL

SEQ ID NO: 716131 - protein, 9 aa, Homo Sapiens
ANKTADRNL

SEQ ID NO: 716132 - protein, 9 aa, Homo Sapiens
SQRLFVILW

SEQ ID NO: 716133 - protein, 9 aa, Homo Sapiens
GGYPAYSKD

SEQ ID NO: 716134 - protein, 9 aa, Homo Sapiens
ERLITDTIN

SEQ ID NO: 716135 - protein, 9 aa, Homo Sapiens
DKKNRYNYG

SEQ ID NO: 716136 - protein, 9 aa, Homo Sapiens
VPGTSANGS

SEQ ID NO: 716137 - protein, 9 aa, Homo Sapiens
QDEEPMHYG

SEQ ID NO: 716138 - protein, 9 aa, Homo Sapiens
FLDHKVYAE

SEQ ID NO: 716139 - protein, 9 aa, Homo Sapiens
PQRVTSPLH

SEQ ID NO: 716140 - protein, 9 aa, Homo Sapiens
TPYLFWYVR

SEQ ID NO: 716141 - protein, 9 aa, Homo Sapiens
CSICEKSFS

SEQ ID NO: 716142 - protein, 9 aa, Homo Sapiens
KNSTDPAIH

SEQ ID NO: 716143 - protein, 9 aa, Homo Sapiens
TAESLKPAS

SEQ ID NO: 716144 - protein, 9 aa, Homo Sapiens
WCPCWEEKR

SEQ ID NO: 716145 - protein, 9 aa, Homo Sapiens
AQPPKVSQG

SEQ ID NO: 716146 - protein, 9 aa, Homo Sapiens
VRCHQRNCI

SEQ ID NO: 716147 - protein, 9 aa, Homo Sapiens
TRFRSGSFI

SEQ ID NO: 716148 - protein, 9 aa, Homo Sapiens
KHQLLVLAL

SEQ ID NO: 716149 - protein, 9 aa, Homo Sapiens
IITRFLYQH

SEQ ID NO: 716150 - protein, 9 aa, Homo Sapiens
ITAAAQLTH

SEQ ID NO: 716151 - protein, 9 aa, Homo Sapiens
KKRREQLSY

SEQ ID NO: 716152 - protein, 9 aa, Homo Sapiens
STSKGILRQ

SEQ ID NO: 716153 - protein, 9 aa, Homo Sapiens
GYPVGEQND

SEQ ID NO: 716154 - protein, 9 aa, Homo Sapiens
NIEVYHEKD

SEQ ID NO: 716155 - protein, 9 aa, Homo Sapiens
RNIPLNASS

SEQ ID NO: 716156 - protein, 9 aa, Homo Sapiens
NIRLVHLGR

SEQ ID NO: 716157 - protein, 9 aa, Homo Sapiens
LAQSPPKNE

SEQ ID NO: 716158 - protein, 9 aa, Homo Sapiens
GKHTTSCDV

SEQ ID NO: 716159 - protein, 9 aa, Homo Sapiens
AIYKCRPVY

SEQ ID NO: 716160 - protein, 9 aa, Homo Sapiens
QTGEGGMKG

SEQ ID NO: 716161 - protein, 9 aa, Homo Sapiens
FEVSSSRIL

SEQ ID NO: 716162 - protein, 9 aa, Homo Sapiens
KKCGTLRLE

SEQ ID NO: 716163 - protein, 9 aa, Homo Sapiens
YPTVHTATD

SEQ ID NO: 716164 - protein, 9 aa, Homo Sapiens
VFGLAISKV

SEQ ID NO: 716165 - protein, 9 aa, Homo Sapiens
SISLCHATN

SEQ ID NO: 716166 - protein, 9 aa, Homo Sapiens
HQSAILISR

SEQ ID NO: 716167 - protein, 9 aa, Homo Sapiens
GFSETDRKE

SEQ ID NO: 716168 - protein, 9 aa, Homo Sapiens
PTYYRTGGN

SEQ ID NO: 716169 - protein, 9 aa, Homo Sapiens
LILLSIVVL

SEQ ID NO: 716170 - protein, 9 aa, Homo Sapiens
MIASDSHCP

SEQ ID NO: 716171 - protein, 9 aa, Homo Sapiens
LGTGECYLL

SEQ ID NO: 716172 - protein, 9 aa, Homo Sapiens
NRYNYGWSF

SEQ ID NO: 716173 - protein, 9 aa, Homo Sapiens
ENQTNGATA

SEQ ID NO: 716174 - protein, 9 aa, Homo Sapiens
HQQSADRSR

SEQ ID NO: 716175 - protein, 9 aa, Homo Sapiens
SFTTSSTQN

SEQ ID NO: 716176 - protein, 9 aa, Homo Sapiens
DFLGPEDYW

SEQ ID NO: 716177 - protein, 9 aa, Homo Sapiens
NKNMKKKKT

SEQ ID NO: 716178 - protein, 9 aa, Homo Sapiens
FGFKVGSVV

SEQ ID NO: 716179 - protein, 9 aa, Homo Sapiens
AQVANKTAD

SEQ ID NO: 716180 - protein, 9 aa, Homo Sapiens
QKGQSKQAQ

SEQ ID NO: 716181 - protein, 9 aa, Homo Sapiens
CPQDFFGDD

SEQ ID NO: 716182 - protein, 9 aa, Homo Sapiens
KQDRRRKKS

SEQ ID NO: 716183 - protein, 9 aa, Homo Sapiens
QLPAEIVAF

SEQ ID NO: 716184 - protein, 9 aa, Homo Sapiens
ALLSFWPGG

SEQ ID NO: 716185 - protein, 9 aa, Homo Sapiens
MCRCREGWK

SEQ ID NO: 716186 - protein, 9 aa, Homo Sapiens
IASDSHCPE

SEQ ID NO: 716187 - protein, 9 aa, Homo Sapiens
LSRQHEAKL

SEQ ID NO: 716188 - protein, 9 aa, Homo Sapiens
ALYSSLVTL

SEQ ID NO: 716189 - protein, 9 aa, Homo Sapiens
NSAAIEEKK

SEQ ID NO: 716190 - protein, 9 aa, Homo Sapiens
DRSRHSGIG

SEQ ID NO: 716191 - protein, 9 aa, Homo Sapiens
QSAILISRK

SEQ ID NO: 716192 - protein, 9 aa, Homo Sapiens
YFGGCLDNI

SEQ ID NO: 716193 - protein, 9 aa, Homo Sapiens
IYRADLEWL

SEQ ID NO: 716194 - protein, 9 aa, Homo Sapiens
YLMAALYVG

SEQ ID NO: 716195 - protein, 9 aa, Homo Sapiens
YQDSTSQEA

SEQ ID NO: 716196 - protein, 9 aa, Homo Sapiens
CRPVYRSLG

SEQ ID NO: 716197 - protein, 9 aa, Homo Sapiens
RNTQHIQKQ

SEQ ID NO: 716198 - protein, 9 aa, Homo Sapiens
EAGPWEEAA

SEQ ID NO: 716199 - protein, 9 aa, Homo Sapiens
GLLTSSSRE

SEQ ID NO: 716200 - protein, 9 aa, Homo Sapiens
ATEVTMSAF

SEQ ID NO: 716201 - protein, 9 aa, Homo Sapiens
YGGYPTVHT

SEQ ID NO: 716202 - protein, 9 aa, Homo Sapiens
SSTQNKGAM

SEQ ID NO: 716203 - protein, 9 aa, Homo Sapiens
ACERLSPGA

SEQ ID NO: 716204 - protein, 9 aa, Homo Sapiens
EDKLTWKDC

SEQ ID NO: 716205 - protein, 9 aa, Homo Sapiens
IPCLILAAK

SEQ ID NO: 716206 - protein, 9 aa, Homo Sapiens
RITGMYVYY

SEQ ID NO: 716207 - protein, 9 aa, Homo Sapiens
SPTSPLHIN

SEQ ID NO: 716208 - protein, 9 aa, Homo Sapiens
QTAKNSTDP

SEQ ID NO: 716209 - protein, 9 aa, Homo Sapiens
YPDVYGVRL

SEQ ID NO: 716210 - protein, 9 aa, Homo Sapiens
KSLKEAHIL

SEQ ID NO: 716211 - protein, 9 aa, Homo Sapiens
VTDIPTYYR

SEQ ID NO: 716212 - protein, 9 aa, Homo Sapiens
EDKKNRYNY

SEQ ID NO: 716213 - protein, 9 aa, Homo Sapiens
NQRLWGELD

SEQ ID NO: 716214 - protein, 9 aa, Homo Sapiens
NINGATLKY

SEQ ID NO: 716215 - protein, 9 aa, Homo Sapiens
LELTGTSGT

SEQ ID NO: 716216 - protein, 9 aa, Homo Sapiens
TIRLPRKEE

SEQ ID NO: 716217 - protein, 9 aa, Homo Sapiens
EKYSAVKSL

SEQ ID NO: 716218 - protein, 9 aa, Homo Sapiens
GSQVRLPGR

SEQ ID NO: 716219 - protein, 9 aa, Homo Sapiens
SVMLQSPTS

SEQ ID NO: 716220 - protein, 9 aa, Homo Sapiens
RMPETDPVL

SEQ ID NO: 716221 - protein, 9 aa, Homo Sapiens
SPGSSYWTG

SEQ ID NO: 716222 - protein, 9 aa, Homo Sapiens
SVLNSKAIK

SEQ ID NO: 716223 - protein, 9 aa, Homo Sapiens
RLHKNEPLI

SEQ ID NO: 716224 - protein, 9 aa, Homo Sapiens
CDVIVMTPY

SEQ ID NO: 716225 - protein, 9 aa, Homo Sapiens
DAQAAMRLS

SEQ ID NO: 716226 - protein, 9 aa, Homo Sapiens
EIPKGSALY

SEQ ID NO: 716227 - protein, 9 aa, Homo Sapiens
RSLATYLSQ

SEQ ID NO: 716228 - protein, 9 aa, Homo Sapiens
LYSSLVTLA

SEQ ID NO: 716229 - protein, 9 aa, Homo Sapiens
LVAAAQKER

SEQ ID NO: 716230 - protein, 9 aa, Homo Sapiens
GGTDALLLG

SEQ ID NO: 716231 - protein, 9 aa, Homo Sapiens
KIHQVKLMY

SEQ ID NO: 716232 - protein, 9 aa, Homo Sapiens
ERDHSGEKP

SEQ ID NO: 716233 - protein, 9 aa, Homo Sapiens
KTWLEQDEQ

SEQ ID NO: 716234 - protein, 9 aa, Homo Sapiens
VEVKNAARA

SEQ ID NO: 716235 - protein, 9 aa, Homo Sapiens
ANKERKKMT

SEQ ID NO: 716236 - protein, 9 aa, Homo Sapiens
KKKKDTLMT

SEQ ID NO: 716237 - protein, 9 aa, Homo Sapiens
AEGRSDNVV

SEQ ID NO: 716238 - protein, 9 aa, Homo Sapiens
PELLCVWVS

SEQ ID NO: 716239 - protein, 9 aa, Homo Sapiens
MCIEAIHLY

SEQ ID NO: 716240 - protein, 9 aa, Homo Sapiens
KAIVSNGGQ

SEQ ID NO: 716241 - protein, 9 aa, Homo Sapiens
PVDTCTPVT

SEQ ID NO: 716242 - protein, 9 aa, Homo Sapiens
SATAGDTSH

SEQ ID NO: 716243 - protein, 9 aa, Homo Sapiens
TVCQSESSS

SEQ ID NO: 716244 - protein, 9 aa, Homo Sapiens
CSCHMSVVV

SEQ ID NO: 716245 - protein, 9 aa, Homo Sapiens
LGHLQAEAK

SEQ ID NO: 716246 - protein, 9 aa, Homo Sapiens
LYTLATGLH

SEQ ID NO: 716247 - protein, 9 aa, Homo Sapiens
PETDPVLVH

SEQ ID NO: 716248 - protein, 9 aa, Homo Sapiens
EKNEIKQYF

SEQ ID NO: 716249 - protein, 9 aa, Homo Sapiens
TCLPNGING

SEQ ID NO: 716250 - protein, 9 aa, Homo Sapiens
PPVSSWEYY

SEQ ID NO: 716251 - protein, 9 aa, Homo Sapiens
KTFIPPKGE

SEQ ID NO: 716252 - protein, 9 aa, Homo Sapiens
ADDGLRPNS

SEQ ID NO: 716253 - protein, 9 aa, Homo Sapiens
TSSTQNKGA

SEQ ID NO: 716254 - protein, 9 aa, Homo Sapiens
WNSTFLEKY

SEQ ID NO: 716255 - protein, 9 aa, Homo Sapiens
YYYMSVKAL

SEQ ID NO: 716256 - protein, 9 aa, Homo Sapiens
VETVPTARE

SEQ ID NO: 716257 - protein, 9 aa, Homo Sapiens
QGRNSSSDW

SEQ ID NO: 716258 - protein, 9 aa, Homo Sapiens
AQAAMRLSV

SEQ ID NO: 716259 - protein, 9 aa, Homo Sapiens
YSGEVNQDI

SEQ ID NO: 716260 - protein, 9 aa, Homo Sapiens
KQGRALNQE

SEQ ID NO: 716261 - protein, 9 aa, Homo Sapiens
SIGQFQEGD

SEQ ID NO: 716262 - protein, 9 aa, Homo Sapiens
DGGGGVSAD

SEQ ID NO: 716263 - protein, 9 aa, Homo Sapiens
IQCLRRKQS

SEQ ID NO: 716264 - protein, 9 aa, Homo Sapiens
CFPGYLMNF

SEQ ID NO: 716265 - protein, 9 aa, Homo Sapiens
LSYLESEEF

SEQ ID NO: 716266 - protein, 9 aa, Homo Sapiens
ILTDTQNSK

SEQ ID NO: 716267 - protein, 9 aa, Homo Sapiens
TSQVETVPT

SEQ ID NO: 716268 - protein, 9 aa, Homo Sapiens
AARMPETDP

SEQ ID NO: 716269 - protein, 9 aa, Homo Sapiens
TPGYQDSTS

SEQ ID NO: 716270 - protein, 9 aa, Homo Sapiens
KLCESVGLC

SEQ ID NO: 716271 - protein, 9 aa, Homo Sapiens
HCGKCGKSF

SEQ ID NO: 716272 - protein, 9 aa, Homo Sapiens
AFLGTGECY

SEQ ID NO: 716273 - protein, 9 aa, Homo Sapiens
PGAILLVLL

SEQ ID NO: 716274 - protein, 9 aa, Homo Sapiens
GKGQTGEGG

SEQ ID NO: 716275 - protein, 9 aa, Homo Sapiens
SCHSDIVCP

SEQ ID NO: 716276 - protein, 9 aa, Homo Sapiens
QNPDTLLAM

SEQ ID NO: 716277 - protein, 9 aa, Homo Sapiens
VYMYQHISP

SEQ ID NO: 716278 - protein, 9 aa, Homo Sapiens
LALEPGSNL

SEQ ID NO: 716279 - protein, 9 aa, Homo Sapiens
WKVKFPELL

SEQ ID NO: 716280 - protein, 9 aa, Homo Sapiens
PFPEAGPWE

SEQ ID NO: 716281 - protein, 9 aa, Homo Sapiens
GDCRNQIGI

SEQ ID NO: 716282 - protein, 9 aa, Homo Sapiens
AVHVAGLQG

SEQ ID NO: 716283 - protein, 9 aa, Homo Sapiens
DRRRKKSFQ

SEQ ID NO: 716284 - protein, 9 aa, Homo Sapiens
IKPEDWDES

SEQ ID NO: 716285 - protein, 9 aa, Homo Sapiens
CGTLRLELT

SEQ ID NO: 716286 - protein, 9 aa, Homo Sapiens
KSKLGFRIS

SEQ ID NO: 716287 - protein, 9 aa, Homo Sapiens
KEENQAVKG

SEQ ID NO: 716288 - protein, 9 aa, Homo Sapiens
FDVSFQQWS

SEQ ID NO: 716289 - protein, 9 aa, Homo Sapiens
AIKPEDWDE

SEQ ID NO: 716290 - protein, 9 aa, Homo Sapiens
VCPQTDKCC

SEQ ID NO: 716291 - protein, 9 aa, Homo Sapiens
AQGILWTIR

SEQ ID NO: 716292 - protein, 9 aa, Homo Sapiens
QLMDMVRCH

SEQ ID NO: 716293 - protein, 9 aa, Homo Sapiens
VHRFGNSVH

SEQ ID NO: 716294 - protein, 9 aa, Homo Sapiens
KVKFPELLC

SEQ ID NO: 716295 - protein, 9 aa, Homo Sapiens
LIRTNSRLQ

SEQ ID NO: 716296 - protein, 9 aa, Homo Sapiens
KDSGLLTSS

SEQ ID NO: 716297 - protein, 9 aa, Homo Sapiens
HSGEKPNAC

SEQ ID NO: 716298 - protein, 9 aa, Homo Sapiens
LLCVLILLS

SEQ ID NO: 716299 - protein, 9 aa, Homo Sapiens
QHEAKLHEH

SEQ ID NO: 716300 - protein, 9 aa, Homo Sapiens
INGATLKYE

SEQ ID NO: 716301 - protein, 9 aa, Homo Sapiens
HLRSNLLKT

SEQ ID NO: 716302 - protein, 9 aa, Homo Sapiens
ALGGTDALL

SEQ ID NO: 716303 - protein, 9 aa, Homo Sapiens
QHGQRKLRR

SEQ ID NO: 716304 - protein, 9 aa, Homo Sapiens
QLNADLQKL

SEQ ID NO: 716305 - protein, 9 aa, Homo Sapiens
EKQDRRRKK

SEQ ID NO: 716306 - protein, 9 aa, Homo Sapiens
FRRPRDGHL

SEQ ID NO: 716307 - protein, 9 aa, Homo Sapiens
VLYHRFIRH

SEQ ID NO: 716308 - protein, 9 aa, Homo Sapiens
TQHIQKQGR

SEQ ID NO: 716309 - protein, 9 aa, Homo Sapiens
GKEESFTSL

SEQ ID NO: 716310 - protein, 9 aa, Homo Sapiens
RMDDIQARD

SEQ ID NO: 716311 - protein, 9 aa, Homo Sapiens
VPTAREEIA

SEQ ID NO: 716312 - protein, 9 aa, Homo Sapiens
IPFMIMTLL

SEQ ID NO: 716313 - protein, 9 aa, Homo Sapiens
HDDGQRLSG

SEQ ID NO: 716314 - protein, 9 aa, Homo Sapiens
PSASSAFLV

SEQ ID NO: 716315 - protein, 9 aa, Homo Sapiens
SVMTSRLNL

SEQ ID NO: 716316 - protein, 9 aa, Homo Sapiens
KGHVTRNLT

SEQ ID NO: 716317 - protein, 9 aa, Homo Sapiens
DDSFMKMLS

SEQ ID NO: 716318 - protein, 9 aa, Homo Sapiens
GDRNYITLS

SEQ ID NO: 716319 - protein, 9 aa, Homo Sapiens
ERMAHDGAL

SEQ ID NO: 716320 - protein, 9 aa, Homo Sapiens
QGKDVLLLV

SEQ ID NO: 716321 - protein, 9 aa, Homo Sapiens
SFDVSFQQW

SEQ ID NO: 716322 - protein, 9 aa, Homo Sapiens
KCGKSFRQK

SEQ ID NO: 716323 - protein, 9 aa, Homo Sapiens
EAPERLITD

SEQ ID NO: 716324 - protein, 9 aa, Homo Sapiens
QKERLDKHL

SEQ ID NO: 716325 - protein, 9 aa, Homo Sapiens
CNPRQYHIM

SEQ ID NO: 716326 - protein, 9 aa, Homo Sapiens
ISVGYLGLS

SEQ ID NO: 716327 - protein, 9 aa, Homo Sapiens
ITASSHWSE

SEQ ID NO: 716328 - protein, 9 aa, Homo Sapiens
DCRGKGVTE

SEQ ID NO: 716329 - protein, 9 aa, Homo Sapiens
NQDIADLIK

SEQ ID NO: 716330 - protein, 9 aa, Homo Sapiens
KDGKRLPSP

SEQ ID NO: 716331 - protein, 9 aa, Homo Sapiens
HTGPSAWET

SEQ ID NO: 716332 - protein, 9 aa, Homo Sapiens
HQKGQSKQA

SEQ ID NO: 716333 - protein, 9 aa, Homo Sapiens
FRSGSFIDQ

SEQ ID NO: 716334 - protein, 9 aa, Homo Sapiens
ASTVPGTSA

SEQ ID NO: 716335 - protein, 9 aa, Homo Sapiens
VMCPQDFFG

SEQ ID NO: 716336 - protein, 9 aa, Homo Sapiens
VHQSAILIS

SEQ ID NO: 716337 - protein, 9 aa, Homo Sapiens
RMAHDGALT

SEQ ID NO: 716338 - protein, 9 aa, Homo Sapiens
KTFDFIDVL

SEQ ID NO: 716339 - protein, 9 aa, Homo Sapiens
LADLGVTLD

SEQ ID NO: 716340 - protein, 9 aa, Homo Sapiens
SPCLPGWSR

SEQ ID NO: 716341 - protein, 9 aa, Homo Sapiens
GTGECYLLS

SEQ ID NO: 716342 - protein, 9 aa, Homo Sapiens
TWKDCFPGY

SEQ ID NO: 716343 - protein, 9 aa, Homo Sapiens
CFSNWSAAI

SEQ ID NO: 716344 - protein, 9 aa, Homo Sapiens
LNLCGSNRI

SEQ ID NO: 716345 - protein, 9 aa, Homo Sapiens
RNSAAIEEK

SEQ ID NO: 716346 - protein, 9 aa, Homo Sapiens
LTSQQVGEY

SEQ ID NO: 716347 - protein, 9 aa, Homo Sapiens
FEEVFGLAI

SEQ ID NO: 716348 - protein, 9 aa, Homo Sapiens
LKFAPLLLP

SEQ ID NO: 716349 - protein, 9 aa, Homo Sapiens
PYLFWYVRS

SEQ ID NO: 716350 - protein, 9 aa, Homo Sapiens
KVSQGKDVL

SEQ ID NO: 716351 - protein, 9 aa, Homo Sapiens
RPVYRSLGN

SEQ ID NO: 716352 - protein, 9 aa, Homo Sapiens
GKTWLEQDE

SEQ ID NO: 716353 - protein, 9 aa, Homo Sapiens
EQLSYLESE

SEQ ID NO: 716354 - protein, 9 aa, Homo Sapiens
GTPHNFLYK

SEQ ID NO: 716355 - protein, 9 aa, Homo Sapiens
EGKKPPSGS

SEQ ID NO: 716356 - protein, 9 aa, Homo Sapiens
NDNPPHPGC

SEQ ID NO: 716357 - protein, 9 aa, Homo Sapiens
IRLPRKEEN

SEQ ID NO: 716358 - protein, 9 aa, Homo Sapiens
SKDSGLLTS

SEQ ID NO: 716359 - protein, 9 aa, Homo Sapiens
AWMCIEAIH

SEQ ID NO: 716360 - protein, 9 aa, Homo Sapiens
GKKKKYLMA

SEQ ID NO: 716361 - protein, 9 aa, Homo Sapiens
DNISGSGCK

SEQ ID NO: 716362 - protein, 9 aa, Homo Sapiens
GVSPCLPGW

SEQ ID NO: 716363 - protein, 9 aa, Homo Sapiens
DMVRCHQRN

SEQ ID NO: 716364 - protein, 9 aa, Homo Sapiens
KQLEGGRTL

SEQ ID NO: 716365 - protein, 9 aa, Homo Sapiens
SRLNLCGSN

SEQ ID NO: 716366 - protein, 9 aa, Homo Sapiens
TDSNPGTSP

SEQ ID NO: 716367 - protein, 9 aa, Homo Sapiens
TSEVYGDPA

SEQ ID NO: 716368 - protein, 9 aa, Homo Sapiens
CISIPFCFA

SEQ ID NO: 716369 - protein, 9 aa, Homo Sapiens
YRTGGNSWQ

SEQ ID NO: 716370 - protein, 9 aa, Homo Sapiens
LEVSLTSQQ

SEQ ID NO: 716371 - protein, 9 aa, Homo Sapiens
VEYYWGQLN

SEQ ID NO: 716372 - protein, 9 aa, Homo Sapiens
CERTVCQSE

SEQ ID NO: 716373 - protein, 9 aa, Homo Sapiens
QNNTFGFKV

SEQ ID NO: 716374 - protein, 9 aa, Homo Sapiens
KLLNGTRGL

SEQ ID NO: 716375 - protein, 9 aa, Homo Sapiens
QLSRQHEAK

SEQ ID NO: 716376 - protein, 9 aa, Homo Sapiens
VRSPGQGLQ

SEQ ID NO: 716377 - protein, 9 aa, Homo Sapiens
SCHMSVVVL

SEQ ID NO: 716378 - protein, 9 aa, Homo Sapiens
SGLLTSSSR

SEQ ID NO: 716379 - protein, 9 aa, Homo Sapiens
SLTPGHPCG

SEQ ID NO: 716380 - protein, 9 aa, Homo Sapiens
TSANGSPSS

SEQ ID NO: 716381 - protein, 9 aa, Homo Sapiens
SRSRSGSQE

SEQ ID NO: 716382 - protein, 9 aa, Homo Sapiens
RIPCLILAA

SEQ ID NO: 716383 - protein, 9 aa, Homo Sapiens
GMGLSMGTI

SEQ ID NO: 716384 - protein, 9 aa, Homo Sapiens
KLMYQVRIQ

SEQ ID NO: 716385 - protein, 9 aa, Homo Sapiens
LEPGSNLDM

SEQ ID NO: 716386 - protein, 9 aa, Homo Sapiens
EPQRVTSPL

SEQ ID NO: 716387 - protein, 9 aa, Homo Sapiens
SFSQKSNVI

SEQ ID NO: 716388 - protein, 9 aa, Homo Sapiens
RFGNSVHPI

SEQ ID NO: 716389 - protein, 9 aa, Homo Sapiens
TDTQNSKPS

SEQ ID NO: 716390 - protein, 9 aa, Homo Sapiens
VPRQQIPQC

SEQ ID NO: 716391 - protein, 9 aa, Homo Sapiens
TVPTAREEI

SEQ ID NO: 716392 - protein, 9 aa, Homo Sapiens
DLQNQIKDS

SEQ ID NO: 716393 - protein, 9 aa, Homo Sapiens
TMDMPKMSC

SEQ ID NO: 716394 - protein, 9 aa, Homo Sapiens
QRLFVILWL

SEQ ID NO: 716395 - protein, 9 aa, Homo Sapiens
LDKNMSSLS

SEQ ID NO: 716396 - protein, 9 aa, Homo Sapiens
IEAIHLYLI

SEQ ID NO: 716397 - protein, 9 aa, Homo Sapiens
QLCLICKAC

SEQ ID NO: 716398 - protein, 9 aa, Homo Sapiens
QGRALNQEA

SEQ ID NO: 716399 - protein, 9 aa, Homo Sapiens
KRQIYNPKS

SEQ ID NO: 716400 - protein, 9 aa, Homo Sapiens
YKCSICEKS

SEQ ID NO: 716401 - protein, 9 aa, Homo Sapiens
YDVYMYQHI

SEQ ID NO: 716402 - protein, 9 aa, Homo Sapiens
DNIYRADLE

SEQ ID NO: 716403 - protein, 9 aa, Homo Sapiens
STTPVDTCT

SEQ ID NO: 716404 - protein, 9 aa, Homo Sapiens
CTPSWSQLL

SEQ ID NO: 716405 - protein, 9 aa, Homo Sapiens
LGVTLDKIT

SEQ ID NO: 716406 - protein, 9 aa, Homo Sapiens
CRPSDLFRH

SEQ ID NO: 716407 - protein, 9 aa, Homo Sapiens
MGSARMAEL

SEQ ID NO: 716408 - protein, 9 aa, Homo Sapiens
GGQYETVVP

SEQ ID NO: 716409 - protein, 9 aa, Homo Sapiens
TSCDVWSFG

SEQ ID NO: 716410 - protein, 9 aa, Homo Sapiens
ATGQNKISR

SEQ ID NO: 716411 - protein, 9 aa, Homo Sapiens
KLGFSETDR

SEQ ID NO: 716412 - protein, 9 aa, Homo Sapiens
VMTPYSLLR

SEQ ID NO: 716413 - protein, 9 aa, Homo Sapiens
SYVAICHPL

SEQ ID NO: 716414 - protein, 9 aa, Homo Sapiens
PSALEPATE

SEQ ID NO: 716415 - protein, 9 aa, Homo Sapiens
CPFSQRLFV

SEQ ID NO: 716416 - protein, 9 aa, Homo Sapiens
ILHLRSNLL

SEQ ID NO: 716417 - protein, 9 aa, Homo Sapiens
QRVTSPLHS

SEQ ID NO: 716418 - protein, 9 aa, Homo Sapiens
CHATNQLLL

SEQ ID NO: 716419 - protein, 9 aa, Homo Sapiens
IQVNHQIVV

SEQ ID NO: 716420 - protein, 9 aa, Homo Sapiens
PPRNIPLNA

SEQ ID NO: 716421 - protein, 9 aa, Homo Sapiens
LLFPLFNSL

SEQ ID NO: 716422 - protein, 9 aa, Homo Sapiens
EAQPPKVSQ

SEQ ID NO: 716423 - protein, 9 aa, Homo Sapiens
KAIKNLPPP

SEQ ID NO: 716424 - protein, 9 aa, Homo Sapiens
EDDHGDESS

SEQ ID NO: 716425 - protein, 9 aa, Homo Sapiens
LREAFSKLD

SEQ ID NO: 716426 - protein, 9 aa, Homo Sapiens
AFSLKSHLT

SEQ ID NO: 716427 - protein, 9 aa, Homo Sapiens
SWSRLIRKL

SEQ ID NO: 716428 - protein, 9 aa, Homo Sapiens
SYDLSSDIS

SEQ ID NO: 716429 - protein, 9 aa, Homo Sapiens
GHLQAEAKK

SEQ ID NO: 716430 - protein, 9 aa, Homo Sapiens
IVSNGGQYE

SEQ ID NO: 716431 - protein, 9 aa, Homo Sapiens
LKLFIHNIE

SEQ ID NO: 716432 - protein, 9 aa, Homo Sapiens
RQIYNPKSV

SEQ ID NO: 716433 - protein, 9 aa, Homo Sapiens
YRGDCRNQI

SEQ ID NO: 716434 - protein, 9 aa, Homo Sapiens
TRQQVEDFL

SEQ ID NO: 716435 - protein, 9 aa, Homo Sapiens
DIAITEVSP

SEQ ID NO: 716436 - protein, 9 aa, Homo Sapiens
NFEFELQLC

SEQ ID NO: 716437 - protein, 9 aa, Homo Sapiens
NHQYTTLHH

SEQ ID NO: 716438 - protein, 9 aa, Homo Sapiens
VVWYQHGQR

SEQ ID NO: 716439 - protein, 9 aa, Homo Sapiens
TPTNTKQQP

SEQ ID NO: 716440 - protein, 9 aa, Homo Sapiens
FGGCLDNIS

SEQ ID NO: 716441 - protein, 9 aa, Homo Sapiens
GEVKYPSCT

SEQ ID NO: 716442 - protein, 9 aa, Homo Sapiens
SCDVWSFGI

SEQ ID NO: 716443 - protein, 9 aa, Homo Sapiens
LPFEAMPRH

SEQ ID NO: 716444 - protein, 9 aa, Homo Sapiens
STVPGTSAN

SEQ ID NO: 716445 - protein, 9 aa, Homo Sapiens
QCLRRKQSS

SEQ ID NO: 716446 - protein, 9 aa, Homo Sapiens
KRDEDKKNR

SEQ ID NO: 716447 - protein, 9 aa, Homo Sapiens
IFGGYAFLK

SEQ ID NO: 716448 - protein, 9 aa, Homo Sapiens
AYSEGHDSS

SEQ ID NO: 716449 - protein, 9 aa, Homo Sapiens
KNFEDLQNQ

SEQ ID NO: 716450 - protein, 9 aa, Homo Sapiens
HILAFQTME

SEQ ID NO: 716451 - protein, 9 aa, Homo Sapiens
TKLALAEDR

SEQ ID NO: 716452 - protein, 9 aa, Homo Sapiens
GKEEAQEAQ

SEQ ID NO: 716453 - protein, 9 aa, Homo Sapiens
VLCEAESKV

SEQ ID NO: 716454 - protein, 9 aa, Homo Sapiens
FAPLLLPGR

SEQ ID NO: 716455 - protein, 9 aa, Homo Sapiens
YYWGQLNET

SEQ ID NO: 716456 - protein, 9 aa, Homo Sapiens
VHVAGLQGK

SEQ ID NO: 716457 - protein, 9 aa, Homo Sapiens
FEFELQLCL

SEQ ID NO: 716458 - protein, 9 aa, Homo Sapiens
PNLPEIPSH

SEQ ID NO: 716459 - protein, 9 aa, Homo Sapiens
ISVRNPRGL

SEQ ID NO: 716460 - protein, 9 aa, Homo Sapiens
KQYFESKLS

SEQ ID NO: 716461 - protein, 9 aa, Homo Sapiens
AGPWEEAAG

SEQ ID NO: 716462 - protein, 9 aa, Homo Sapiens
MCGTICDIW

SEQ ID NO: 716463 - protein, 9 aa, Homo Sapiens
QDRRRKKSF

SEQ ID NO: 716464 - protein, 9 aa, Homo Sapiens
EVNQDIADL

SEQ ID NO: 716465 - protein, 9 aa, Homo Sapiens
DVKKFTISI

SEQ ID NO: 716466 - protein, 9 aa, Homo Sapiens
AFAWMCIEA

SEQ ID NO: 716467 - protein, 9 aa, Homo Sapiens
QVYKEERSR

SEQ ID NO: 716468 - protein, 9 aa, Homo Sapiens
QAKAKSKTF

SEQ ID NO: 716469 - protein, 9 aa, Homo Sapiens
LHKNEPLII

SEQ ID NO: 716470 - protein, 9 aa, Homo Sapiens
ADLGVTLDK

SEQ ID NO: 716471 - protein, 9 aa, Homo Sapiens
RFCHLLAAA

SEQ ID NO: 716472 - protein, 9 aa, Homo Sapiens
LATGLHPES

SEQ ID NO: 716473 - protein, 9 aa, Homo Sapiens
SEKLQFYKQ

SEQ ID NO: 716474 - protein, 9 aa, Homo Sapiens
AQKERLDKH

SEQ ID NO: 716475 - protein, 9 aa, Homo Sapiens
LLITAAAQL

SEQ ID NO: 716476 - protein, 9 aa, Homo Sapiens
VAKGGTAWL

SEQ ID NO: 716477 - protein, 9 aa, Homo Sapiens
FTISIGIIV

SEQ ID NO: 716478 - protein, 9 aa, Homo Sapiens
FLVPRARPV

SEQ ID NO: 716479 - protein, 9 aa, Homo Sapiens
LEDTKLLSE

SEQ ID NO: 716480 - protein, 9 aa, Homo Sapiens
VIVMTPYSL

SEQ ID NO: 716481 - protein, 9 aa, Homo Sapiens
NDDHDDDDG

SEQ ID NO: 716482 - protein, 9 aa, Homo Sapiens
KVPVEEIQI

SEQ ID NO: 716483 - protein, 9 aa, Homo Sapiens
TNTCQVVAF

SEQ ID NO: 716484 - protein, 9 aa, Homo Sapiens
IHRMDDIQA

SEQ ID NO: 716485 - protein, 9 aa, Homo Sapiens
YLGLSLDTP

SEQ ID NO: 716486 - protein, 9 aa, Homo Sapiens
PPSASSAFL

SEQ ID NO: 716487 - protein, 9 aa, Homo Sapiens
LFGSDAEGD

SEQ ID NO: 716488 - protein, 9 aa, Homo Sapiens
QTNGATADN

SEQ ID NO: 716489 - protein, 9 aa, Homo Sapiens
DDHGDESSY

SEQ ID NO: 716490 - protein, 9 aa, Homo Sapiens
FLGPEDYWC

SEQ ID NO: 716491 - protein, 9 aa, Homo Sapiens
ALNPRSGSW

SEQ ID NO: 716492 - protein, 9 aa, Homo Sapiens
IAGYPNGEG

SEQ ID NO: 716493 - protein, 9 aa, Homo Sapiens
RQQVEDFLG

SEQ ID NO: 716494 - protein, 9 aa, Homo Sapiens
ILLVLLPIA

SEQ ID NO: 716495 - protein, 9 aa, Homo Sapiens
CSFMVAAPS

SEQ ID NO: 716496 - protein, 9 aa, Homo Sapiens
DPSAIKPED

SEQ ID NO: 716497 - protein, 9 aa, Homo Sapiens
SGRSTATSS

SEQ ID NO: 716498 - protein, 9 aa, Homo Sapiens
DSNSDGKTW

SEQ ID NO: 716499 - protein, 9 aa, Homo Sapiens
GLGDYLELN

SEQ ID NO: 716500 - protein, 9 aa, Homo Sapiens
GSWWAQELE

SEQ ID NO: 716501 - protein, 9 aa, Homo Sapiens
AYSKDSGLL

SEQ ID NO: 716502 - protein, 9 aa, Homo Sapiens
HQRNCIPIG

SEQ ID NO: 716503 - protein, 9 aa, Homo Sapiens
LDTIISLCL

SEQ ID NO: 716504 - protein, 9 aa, Homo Sapiens
PPGKSQGPP

SEQ ID NO: 716505 - protein, 9 aa, Homo Sapiens
MAGSGQEWR

SEQ ID NO: 716506 - protein, 9 aa, Homo Sapiens
RLSPGAILL

SEQ ID NO: 716507 - protein, 9 aa, Homo Sapiens
AICNPRQYH

SEQ ID NO: 716508 - protein, 9 aa, Homo Sapiens
LHLRSNLLK

SEQ ID NO: 716509 - protein, 9 aa, Homo Sapiens
FQEGDAYVV

SEQ ID NO: 716510 - protein, 9 aa, Homo Sapiens
ATWATASTG

SEQ ID NO: 716511 - protein, 9 aa, Homo Sapiens
RFIRHPSKH

SEQ ID NO: 716512 - protein, 9 aa, Homo Sapiens
LRELTMDMP

SEQ ID NO: 716513 - protein, 9 aa, Homo Sapiens
LLNTDSNPG

SEQ ID NO: 716514 - protein, 9 aa, Homo Sapiens
GPWEEAAGA

SEQ ID NO: 716515 - protein, 9 aa, Homo Sapiens
REVIEKKLE

SEQ ID NO: 716516 - protein, 9 aa, Homo Sapiens
IKIPVRAGD

SEQ ID NO: 716517 - protein, 9 aa, Homo Sapiens
LMYQVRIQP

SEQ ID NO: 716518 - protein, 9 aa, Homo Sapiens
SDNIYRADL

SEQ ID NO: 716519 - protein, 9 aa, Homo Sapiens
TSQFYTTSE

SEQ ID NO: 716520 - protein, 9 aa, Homo Sapiens
LAMLATIDV

SEQ ID NO: 716521 - protein, 9 aa, Homo Sapiens
QYRKLNLDM

SEQ ID NO: 716522 - protein, 9 aa, Homo Sapiens
ADLQKLAVN

SEQ ID NO: 716523 - protein, 9 aa, Homo Sapiens
VWSECSVKS

SEQ ID NO: 716524 - protein, 9 aa, Homo Sapiens
LGYIKIPVR

SEQ ID NO: 716525 - protein, 9 aa, Homo Sapiens
LIHSEPRLQ

SEQ ID NO: 716526 - protein, 9 aa, Homo Sapiens
PCLPGWSRT

SEQ ID NO: 716527 - protein, 9 aa, Homo Sapiens
KCSICEKSF

SEQ ID NO: 716528 - protein, 9 aa, Homo Sapiens
MAELLLLHG

SEQ ID NO: 716529 - protein, 9 aa, Homo Sapiens
LTCFSNWSA

SEQ ID NO: 716530 - protein, 9 aa, Homo Sapiens
GSGIPFLDH

SEQ ID NO: 716531 - protein, 9 aa, Homo Sapiens
ATAGDTSHP

SEQ ID NO: 716532 - protein, 9 aa, Homo Sapiens
VQLRELTMD

SEQ ID NO: 716533 - protein, 9 aa, Homo Sapiens
LELNIHQGK

SEQ ID NO: 716534 - protein, 9 aa, Homo Sapiens
EITSGGFFG

SEQ ID NO: 716535 - protein, 9 aa, Homo Sapiens
LSTTPVDTC

SEQ ID NO: 716536 - protein, 9 aa, Homo Sapiens
ILGYIKIPV

SEQ ID NO: 716537 - protein, 9 aa, Homo Sapiens
KVLEDTKLL

SEQ ID NO: 716538 - protein, 9 aa, Homo Sapiens
HDPQGPWCP

SEQ ID NO: 716539 - protein, 9 aa, Homo Sapiens
RFEVSSSRI

SEQ ID NO: 716540 - protein, 9 aa, Homo Sapiens
SADAYSEGH

SEQ ID NO: 716541 - protein, 9 aa, Homo Sapiens
LDMPLTHSR

SEQ ID NO: 716542 - protein, 9 aa, Homo Sapiens
SPLVVAKGG

SEQ ID NO: 716543 - protein, 9 aa, Homo Sapiens
VKKFTISIG

SEQ ID NO: 716544 - protein, 9 aa, Homo Sapiens
RGKGVTEIP

SEQ ID NO: 716545 - protein, 9 aa, Homo Sapiens
TLHHQSFHY

SEQ ID NO: 716546 - protein, 9 aa, Homo Sapiens
RGSFPGLAL

SEQ ID NO: 716547 - protein, 9 aa, Homo Sapiens
TRDPLSKIT

SEQ ID NO: 716548 - protein, 9 aa, Homo Sapiens
DVYMYQHIS

SEQ ID NO: 716549 - protein, 9 aa, Homo Sapiens
ALAEDRVQE

SEQ ID NO: 716550 - protein, 9 aa, Homo Sapiens
GVRLSNRSR

SEQ ID NO: 716551 - protein, 9 aa, Homo Sapiens
DPLSKITEQ

SEQ ID NO: 716552 - protein, 9 aa, Homo Sapiens
THTGPSAWE

SEQ ID NO: 716553 - protein, 9 aa, Homo Sapiens
LSFWPGGYP

SEQ ID NO: 716554 - protein, 9 aa, Homo Sapiens
HPESHGIVG

SEQ ID NO: 716555 - protein, 9 aa, Homo Sapiens
EDFLGPEDY

SEQ ID NO: 716556 - protein, 9 aa, Homo Sapiens
GTQTAKNST

SEQ ID NO: 716557 - protein, 9 aa, Homo Sapiens
AHMETPPAI

SEQ ID NO: 716558 - protein, 9 aa, Homo Sapiens
WSQLLTGRY

SEQ ID NO: 716559 - protein, 9 aa, Homo Sapiens
HIQKQGRAL

SEQ ID NO: 716560 - protein, 9 aa, Homo Sapiens
ARMAELLLL

SEQ ID NO: 716561 - protein, 9 aa, Homo Sapiens
ETQDFRSLA

SEQ ID NO: 716562 - protein, 9 aa, Homo Sapiens
AVHPQSEDY

SEQ ID NO: 716563 - protein, 9 aa, Homo Sapiens
SQGKDVLLL

SEQ ID NO: 716564 - protein, 9 aa, Homo Sapiens
AIHLYLIVV

SEQ ID NO: 716565 - protein, 9 aa, Homo Sapiens
ISLCLLDSD

SEQ ID NO: 716566 - protein, 9 aa, Homo Sapiens
PRSGSWITA

SEQ ID NO: 716567 - protein, 9 aa, Homo Sapiens
GERGGKGQT

SEQ ID NO: 716568 - protein, 9 aa, Homo Sapiens
GFPENQTNG

SEQ ID NO: 716569 - protein, 9 aa, Homo Sapiens
PRFCHLLAA

SEQ ID NO: 716570 - protein, 9 aa, Homo Sapiens
SNGPEGCML

SEQ ID NO: 716571 - protein, 9 aa, Homo Sapiens
GTLRNSAAI

SEQ ID NO: 716572 - protein, 9 aa, Homo Sapiens
TIIGVSLLS

SEQ ID NO: 716573 - protein, 9 aa, Homo Sapiens
GSFIDQSRV

SEQ ID NO: 716574 - protein, 9 aa, Homo Sapiens
DNPPHPGCS

SEQ ID NO: 716575 - protein, 9 aa, Homo Sapiens
GPPPPGKSQ

SEQ ID NO: 716576 - protein, 9 aa, Homo Sapiens
DDDLQLPAE

SEQ ID NO: 716577 - protein, 9 aa, Homo Sapiens
GRSDNVVIC

SEQ ID NO: 716578 - protein, 9 aa, Homo Sapiens
KATVPICED

SEQ ID NO: 716579 - protein, 9 aa, Homo Sapiens
SLTCFSNWS

SEQ ID NO: 716580 - protein, 9 aa, Homo Sapiens
GTSANGSPS

SEQ ID NO: 716581 - protein, 9 aa, Homo Sapiens
NFEDLQNQI

SEQ ID NO: 716582 - protein, 9 aa, Homo Sapiens
SKPDALGLN

SEQ ID NO: 716583 - protein, 9 aa, Homo Sapiens
SICEKSFSQ

SEQ ID NO: 716584 - protein, 9 aa, Homo Sapiens
SGLFVQGLQ

SEQ ID NO: 716585 - protein, 9 aa, Homo Sapiens
GLRPNSKTS

SEQ ID NO: 716586 - protein, 9 aa, Homo Sapiens
WNLLAARSI

SEQ ID NO: 716587 - protein, 9 aa, Homo Sapiens
MYVYYQRDM

SEQ ID NO: 716588 - protein, 9 aa, Homo Sapiens
NISGSGCKS

SEQ ID NO: 716589 - protein, 9 aa, Homo Sapiens
GLHPESHGI

SEQ ID NO: 716590 - protein, 9 aa, Homo Sapiens
YSKDSGLLT

SEQ ID NO: 716591 - protein, 9 aa, Homo Sapiens
LVFKNSCFP

SEQ ID NO: 716592 - protein, 9 aa, Homo Sapiens
GLALEPGSN

SEQ ID NO: 716593 - protein, 9 aa, Homo Sapiens
FFQTKYDWN

SEQ ID NO: 716594 - protein, 9 aa, Homo Sapiens
IPTYYRTGG

SEQ ID NO: 716595 - protein, 9 aa, Homo Sapiens
AKKLEQHTR

SEQ ID NO: 716596 - protein, 9 aa, Homo Sapiens
DSHCPEVKL

SEQ ID NO: 716597 - protein, 9 aa, Homo Sapiens
TLLAMSNPR

SEQ ID NO: 716598 - protein, 9 aa, Homo Sapiens
NSKPSPTQH

SEQ ID NO: 716599 - protein, 9 aa, Homo Sapiens
SNLLKTVPI

SEQ ID NO: 716600 - protein, 9 aa, Homo Sapiens
LNPRSGSWI

SEQ ID NO: 716601 - protein, 9 aa, Homo Sapiens
DCRNQIGIF

SEQ ID NO: 716602 - protein, 9 aa, Homo Sapiens
STRDPLSKI

SEQ ID NO: 716603 - protein, 9 aa, Homo Sapiens
DHWADMEKD

SEQ ID NO: 716604 - protein, 9 aa, Homo Sapiens
PTVHTATDY

SEQ ID NO: 716605 - protein, 9 aa, Homo Sapiens
QFQMHPAPV

SEQ ID NO: 716606 - protein, 9 aa, Homo Sapiens
LNTDSNPGT

SEQ ID NO: 716607 - protein, 9 aa, Homo Sapiens
PGTSANGSP

SEQ ID NO: 716608 - protein, 9 aa, Homo Sapiens
QYPSERELH

SEQ ID NO: 716609 - protein, 9 aa, Homo Sapiens
LPRCCPLCG

SEQ ID NO: 716610 - protein, 9 aa, Homo Sapiens
RKEASSESS

SEQ ID NO: 716611 - protein, 9 aa, Homo Sapiens
SWWAQELED

SEQ ID NO: 716612 - protein, 9 aa, Homo Sapiens
QYFQYRKLN

SEQ ID NO: 716613 - protein, 9 aa, Homo Sapiens
SQIQLELKS

SEQ ID NO: 716614 - protein, 9 aa, Homo Sapiens
GYPTVHTAT

SEQ ID NO: 716615 - protein, 9 aa, Homo Sapiens
LSNRSRQEP

SEQ ID NO: 716616 - protein, 9 aa, Homo Sapiens
ALYGCIYVE

SEQ ID NO: 716617 - protein, 9 aa, Homo Sapiens
RREQLSYLE

SEQ ID NO: 716618 - protein, 9 aa, Homo Sapiens
GPHEMGALR

SEQ ID NO: 716619 - protein, 9 aa, Homo Sapiens
ETRVQGLLI

SEQ ID NO: 716620 - protein, 9 aa, Homo Sapiens
RHSYDLSSD

SEQ ID NO: 716621 - protein, 9 aa, Homo Sapiens
DHDDDDGDD

SEQ ID NO: 716622 - protein, 9 aa, Homo Sapiens
TISVGYLGL

SEQ ID NO: 716623 - protein, 9 aa, Homo Sapiens
ERKKMTSKS

SEQ ID NO: 716624 - protein, 9 aa, Homo Sapiens
LYHRFIRHP

SEQ ID NO: 716625 - protein, 9 aa, Homo Sapiens
LISVPHKAE

SEQ ID NO: 716626 - protein, 9 aa, Homo Sapiens
KSFSQKSNV

SEQ ID NO: 716627 - protein, 9 aa, Homo Sapiens
SYLESEEFQ

SEQ ID NO: 716628 - protein, 9 aa, Homo Sapiens
WAGHWASKS

SEQ ID NO: 716629 - protein, 9 aa, Homo Sapiens
MLQSPTSPL

SEQ ID NO: 716630 - protein, 9 aa, Homo Sapiens
FCHLLAAAS

SEQ ID NO: 716631 - protein, 9 aa, Homo Sapiens
FLALGGTDA

SEQ ID NO: 716632 - protein, 9 aa, Homo Sapiens
SVSSYENIR

SEQ ID NO: 716633 - protein, 9 aa, Homo Sapiens
IDGGGGVSA

SEQ ID NO: 716634 - protein, 9 aa, Homo Sapiens
MPDAIRRAV

SEQ ID NO: 716635 - protein, 9 aa, Homo Sapiens
PPKVSQGKD

SEQ ID NO: 716636 - protein, 9 aa, Homo Sapiens
EKLCESVGL

SEQ ID NO: 716637 - protein, 9 aa, Homo Sapiens
VAGLQGKPR

SEQ ID NO: 716638 - protein, 9 aa, Homo Sapiens
GQSKQAQAR

SEQ ID NO: 716639 - protein, 9 aa, Homo Sapiens
NSDGKTWLE

SEQ ID NO: 716640 - protein, 9 aa, Homo Sapiens
FSKLDMTSE

SEQ ID NO: 716641 - protein, 9 aa, Homo Sapiens
QTPVQGGIP

SEQ ID NO: 716642 - protein, 9 aa, Homo Sapiens
VIEKKLEKF

SEQ ID NO: 716643 - protein, 9 aa, Homo Sapiens
AEARESARR

SEQ ID NO: 716644 - protein, 9 aa, Homo Sapiens
MDMPKMSCW

SEQ ID NO: 716645 - protein, 9 aa, Homo Sapiens
RGCDVIVMT

SEQ ID NO: 716646 - protein, 9 aa, Homo Sapiens
PYCGKAFCR

SEQ ID NO: 716647 - protein, 9 aa, Homo Sapiens
KLTKITHTG

SEQ ID NO: 716648 - protein, 9 aa, Homo Sapiens
TVPGTSANG

SEQ ID NO: 716649 - protein, 9 aa, Homo Sapiens
LWTIRLPRK

SEQ ID NO: 716650 - protein, 9 aa, Homo Sapiens
KKAIVSNGG

SEQ ID NO: 716651 - protein, 9 aa, Homo Sapiens
AVLALLSFW

SEQ ID NO: 716652 - protein, 9 aa, Homo Sapiens
LEFLHITFE

SEQ ID NO: 716653 - protein, 9 aa, Homo Sapiens
TLIPKSNDT

SEQ ID NO: 716654 - protein, 9 aa, Homo Sapiens
EERSRFKEQ

SEQ ID NO: 716655 - protein, 9 aa, Homo Sapiens
GCSADAYSE

SEQ ID NO: 716656 - protein, 9 aa, Homo Sapiens
VAICNPRQY

SEQ ID NO: 716657 - protein, 9 aa, Homo Sapiens
PHGINTAVY

SEQ ID NO: 716658 - protein, 9 aa, Homo Sapiens
SGEKPNACK

SEQ ID NO: 716659 - protein, 9 aa, Homo Sapiens
VVHRFGNSV

SEQ ID NO: 716660 - protein, 9 aa, Homo Sapiens
MHRPARKFR

SEQ ID NO: 716661 - protein, 9 aa, Homo Sapiens
LRPNSKTSQ

SEQ ID NO: 716662 - protein, 9 aa, Homo Sapiens
WLEQDEQPL

SEQ ID NO: 716663 - protein, 9 aa, Homo Sapiens
VMTSRLNLC

SEQ ID NO: 716664 - protein, 9 aa, Homo Sapiens
NSGVEYYWG

SEQ ID NO: 716665 - protein, 9 aa, Homo Sapiens
FEAMPRHPG

SEQ ID NO: 716666 - protein, 9 aa, Homo Sapiens
CPWMKWCWC

SEQ ID NO: 716667 - protein, 9 aa, Homo Sapiens
FDFIDVLLL

SEQ ID NO: 716668 - protein, 9 aa, Homo Sapiens
FAFLGTGEC

SEQ ID NO: 716669 - protein, 9 aa, Homo Sapiens
SPLSGLSLL

SEQ ID NO: 716670 - protein, 9 aa, Homo Sapiens
CSVKSGKGI

SEQ ID NO: 716671 - protein, 9 aa, Homo Sapiens
HREVIEKKL

SEQ ID NO: 716672 - protein, 9 aa, Homo Sapiens
LEDIIMKYE

SEQ ID NO: 716673 - protein, 9 aa, Homo Sapiens
SVRNPRGLS

SEQ ID NO: 716674 - protein, 9 aa, Homo Sapiens
DRNYITLSG

SEQ ID NO: 716675 - protein, 9 aa, Homo Sapiens
FIHNIEVYH

SEQ ID NO: 716676 - protein, 9 aa, Homo Sapiens
QLSYLESEE

SEQ ID NO: 716677 - protein, 9 aa, Homo Sapiens
PGSQVRLPG

SEQ ID NO: 716678 - protein, 9 aa, Homo Sapiens
LLSIVVLFI

SEQ ID NO: 716679 - protein, 9 aa, Homo Sapiens
MRLSVMVKK

SEQ ID NO: 716680 - protein, 9 aa, Homo Sapiens
RKRPVPAKR

SEQ ID NO: 716681 - protein, 9 aa, Homo Sapiens
SFIDQSRVL

SEQ ID NO: 716682 - protein, 9 aa, Homo Sapiens
RKLNLDMFK

SEQ ID NO: 716683 - protein, 9 aa, Homo Sapiens
PVLENSATA

SEQ ID NO: 716684 - protein, 9 aa, Homo Sapiens
PNKNMKKKK

SEQ ID NO: 716685 - protein, 9 aa, Homo Sapiens
SDISVLVPL

SEQ ID NO: 716686 - protein, 9 aa, Homo Sapiens
HATEVTMSA

SEQ ID NO: 716687 - protein, 9 aa, Homo Sapiens
EEPQRVTSP

SEQ ID NO: 716688 - protein, 9 aa, Homo Sapiens
SQRLFIMEK

SEQ ID NO: 716689 - protein, 9 aa, Homo Sapiens
RNMSWSRLI

SEQ ID NO: 716690 - protein, 9 aa, Homo Sapiens
PPLMQTPVQ

SEQ ID NO: 716691 - protein, 9 aa, Homo Sapiens
GPSYDVYMY

SEQ ID NO: 716692 - protein, 9 aa, Homo Sapiens
VIFGGYAFL

SEQ ID NO: 716693 - protein, 9 aa, Homo Sapiens
QNHDPNVEQ

SEQ ID NO: 716694 - protein, 9 aa, Homo Sapiens
EPRLQTPMY

SEQ ID NO: 716695 - protein, 9 aa, Homo Sapiens
RSDNVVICS

SEQ ID NO: 716696 - protein, 9 aa, Homo Sapiens
KYSAVKSLE

SEQ ID NO: 716697 - protein, 9 aa, Homo Sapiens
LIALYGCIY

SEQ ID NO: 716698 - protein, 9 aa, Homo Sapiens
VIQVNHQIV

SEQ ID NO: 716699 - protein, 9 aa, Homo Sapiens
RLSVMVKKE

SEQ ID NO: 716700 - protein, 9 aa, Homo Sapiens
VSQSIPFMI

SEQ ID NO: 716701 - protein, 9 aa, Homo Sapiens
AVSTCSCHM

SEQ ID NO: 716702 - protein, 9 aa, Homo Sapiens
VSPCLPGWS

SEQ ID NO: 716703 - protein, 9 aa, Homo Sapiens
LQFYKQKAP

SEQ ID NO: 716704 - protein, 9 aa, Homo Sapiens
FPLFNSLLC

SEQ ID NO: 716705 - protein, 9 aa, Homo Sapiens
TDRKEASSE

SEQ ID NO: 716706 - protein, 9 aa, Homo Sapiens
ALGHARQGR

SEQ ID NO: 716707 - protein, 9 aa, Homo Sapiens
GCMLAVATS

SEQ ID NO: 716708 - protein, 9 aa, Homo Sapiens
LAVIHMGSV

SEQ ID NO: 716709 - protein, 9 aa, Homo Sapiens
FLVALLVAF

SEQ ID NO: 716710 - protein, 9 aa, Homo Sapiens
RQQIPQCAG

SEQ ID NO: 716711 - protein, 9 aa, Homo Sapiens
MGTIICGWD

SEQ ID NO: 716712 - protein, 9 aa, Homo Sapiens
QDYYYMSVK

SEQ ID NO: 716713 - protein, 9 aa, Homo Sapiens
SLLSSRYAR

SEQ ID NO: 716714 - protein, 9 aa, Homo Sapiens
EEVEETLKR

SEQ ID NO: 716715 - protein, 9 aa, Homo Sapiens
QPTSATGQN

SEQ ID NO: 716716 - protein, 9 aa, Homo Sapiens
SRIPCLILA

SEQ ID NO: 716717 - protein, 9 aa, Homo Sapiens
IRNMSWSRL

SEQ ID NO: 716718 - protein, 9 aa, Homo Sapiens
AAYTASLGE

SEQ ID NO: 716719 - protein, 9 aa, Homo Sapiens
SLTSQQVGE

SEQ ID NO: 716720 - protein, 9 aa, Homo Sapiens
LCAEARESA

SEQ ID NO: 716721 - protein, 9 aa, Homo Sapiens
PSCHSDIVC

SEQ ID NO: 716722 - protein, 9 aa, Homo Sapiens
VKFPELLCV

SEQ ID NO: 716723 - protein, 9 aa, Homo Sapiens
DSNPGTSPM

SEQ ID NO: 716724 - protein, 9 aa, Homo Sapiens
RSPGQGLQL

SEQ ID NO: 716725 - protein, 9 aa, Homo Sapiens
YESLLGLTN

SEQ ID NO: 716726 - protein, 9 aa, Homo Sapiens
PVYRSLGNV

SEQ ID NO: 716727 - protein, 9 aa, Homo Sapiens
LLSYVSIVC

SEQ ID NO: 716728 - protein, 9 aa, Homo Sapiens
LFVTLRLHK

SEQ ID NO: 716729 - protein, 9 aa, Homo Sapiens
AMPRHPGNR

SEQ ID NO: 716730 - protein, 9 aa, Homo Sapiens
DLPGSQVRL

SEQ ID NO: 716731 - protein, 9 aa, Homo Sapiens
FRTQERDHS

SEQ ID NO: 716732 - protein, 9 aa, Homo Sapiens
IDTDWYRGD

SEQ ID NO: 716733 - protein, 9 aa, Homo Sapiens
NQIKDSEIR

SEQ ID NO: 716734 - protein, 9 aa, Homo Sapiens
CGIAVPPVS

SEQ ID NO: 716735 - protein, 9 aa, Homo Sapiens
LQNQIKDSE

SEQ ID NO: 716736 - protein, 9 aa, Homo Sapiens
NNTFGFKVG

SEQ ID NO: 716737 - protein, 9 aa, Homo Sapiens
PLSGLSLLR

SEQ ID NO: 716738 - protein, 9 aa, Homo Sapiens
PLLQSSSHR

SEQ ID NO: 716739 - protein, 9 aa, Homo Sapiens
HAITATHKT

SEQ ID NO: 716740 - protein, 9 aa, Homo Sapiens
MNSICNPVP

SEQ ID NO: 716741 - protein, 9 aa, Homo Sapiens
KLHEHIKQQ

SEQ ID NO: 716742 - protein, 9 aa, Homo Sapiens
DHGDESSYT

SEQ ID NO: 716743 - protein, 9 aa, Homo Sapiens
VPICEDIPE

SEQ ID NO: 716744 - protein, 9 aa, Homo Sapiens
RRPRDGHLP

SEQ ID NO: 716745 - protein, 9 aa, Homo Sapiens
AAAQKERLD

SEQ ID NO: 716746 - protein, 9 aa, Homo Sapiens
KPSALEPAT

SEQ ID NO: 716747 - protein, 9 aa, Homo Sapiens
GMHTVCLKS

SEQ ID NO: 716748 - protein, 9 aa, Homo Sapiens
DTQNSKPSP

SEQ ID NO: 716749 - protein, 9 aa, Homo Sapiens
ESSYTDLLP

SEQ ID NO: 716750 - protein, 9 aa, Homo Sapiens
WADMEKDGK

SEQ ID NO: 716751 - protein, 9 aa, Homo Sapiens
ASSHWSEST

SEQ ID NO: 716752 - protein, 9 aa, Homo Sapiens
LFPLFNSLL

SEQ ID NO: 716753 - protein, 9 aa, Homo Sapiens
GSKPDALGL

SEQ ID NO: 716754 - protein, 9 aa, Homo Sapiens
SDAEGDPEK

SEQ ID NO: 716755 - protein, 9 aa, Homo Sapiens
QVNHQIVVG

SEQ ID NO: 716756 - protein, 9 aa, Homo Sapiens
GHLELEEVQ

SEQ ID NO: 716757 - protein, 9 aa, Homo Sapiens
RDNQHHDEA

SEQ ID NO: 716758 - protein, 9 aa, Homo Sapiens
RILRNHNEP

SEQ ID NO: 716759 - protein, 9 aa, Homo Sapiens
FKVGSVVQF

SEQ ID NO: 716760 - protein, 9 aa, Homo Sapiens
HTKLALAED

SEQ ID NO: 716761 - protein, 9 aa, Homo Sapiens
PIPLETRPK

SEQ ID NO: 716762 - protein, 9 aa, Homo Sapiens
LKAQEKHQL

SEQ ID NO: 716763 - protein, 9 aa, Homo Sapiens
QHHDEAEGD

SEQ ID NO: 716764 - protein, 9 aa, Homo Sapiens
TAKNSTDPA

SEQ ID NO: 716765 - protein, 9 aa, Homo Sapiens
DVSFQQWST

SEQ ID NO: 716766 - protein, 9 aa, Homo Sapiens
LLFSPLSGL

SEQ ID NO: 716767 - protein, 9 aa, Homo Sapiens
IIGIITRFL

SEQ ID NO: 716768 - protein, 9 aa, Homo Sapiens
LMDMVRCHQ

SEQ ID NO: 716769 - protein, 9 aa, Homo Sapiens
RCNGVPEGI

SEQ ID NO: 716770 - protein, 9 aa, Homo Sapiens
HTVCLKSGQ

SEQ ID NO: 716771 - protein, 9 aa, Homo Sapiens
QSADRSRHS

SEQ ID NO: 716772 - protein, 9 aa, Homo Sapiens
AMQRNIRLV

SEQ ID NO: 716773 - protein, 9 aa, Homo Sapiens
TDPVLVHCS

SEQ ID NO: 716774 - protein, 9 aa, Homo Sapiens
CRCREGWKG

SEQ ID NO: 716775 - protein, 9 aa, Homo Sapiens
CIIAGYPNG

SEQ ID NO: 716776 - protein, 9 aa, Homo Sapiens
ERGGKGQTG

SEQ ID NO: 716777 - protein, 9 aa, Homo Sapiens
PICEDIPEK

SEQ ID NO: 716778 - protein, 9 aa, Homo Sapiens
ISPLVVAKG

SEQ ID NO: 716779 - protein, 9 aa, Homo Sapiens
TLGPHEMGA

SEQ ID NO: 716780 - protein, 9 aa, Homo Sapiens
CHLLAAASW

SEQ ID NO: 716781 - protein, 9 aa, Homo Sapiens
SLCLLDSDS

SEQ ID NO: 716782 - protein, 9 aa, Homo Sapiens
KLSVLYHRF

SEQ ID NO: 716783 - protein, 9 aa, Homo Sapiens
IHSEPRLQT

SEQ ID NO: 716784 - protein, 9 aa, Homo Sapiens
KLDMTSEVL

SEQ ID NO: 716785 - protein, 9 aa, Homo Sapiens
RQYHIMMSK

SEQ ID NO: 716786 - protein, 9 aa, Homo Sapiens
LALAEDRVQ

SEQ ID NO: 716787 - protein, 9 aa, Homo Sapiens
GYQDSTSQE

SEQ ID NO: 716788 - protein, 9 aa, Homo Sapiens
RKKSFQGDD

SEQ ID NO: 716789 - protein, 9 aa, Homo Sapiens
SATWATAST

SEQ ID NO: 716790 - protein, 9 aa, Homo Sapiens
VCAAEYSHW

SEQ ID NO: 716791 - protein, 9 aa, Homo Sapiens
HSDIVCPQT

SEQ ID NO: 716792 - protein, 9 aa, Homo Sapiens
YHRFIRHPS

SEQ ID NO: 716793 - protein, 9 aa, Homo Sapiens
MQTPVQGGI

SEQ ID NO: 716794 - protein, 9 aa, Homo Sapiens
VIDVNDHAT

SEQ ID NO: 716795 - protein, 9 aa, Homo Sapiens
DGSQRLFIM

SEQ ID NO: 716796 - protein, 9 aa, Homo Sapiens
QKDSTGSFV

SEQ ID NO: 716797 - protein, 9 aa, Homo Sapiens
SANGSPSSP

SEQ ID NO: 716798 - protein, 9 aa, Homo Sapiens
KGGTAWLEW

SEQ ID NO: 716799 - protein, 9 aa, Homo Sapiens
VERVTAPKV

SEQ ID NO: 716800 - protein, 9 aa, Homo Sapiens
VNDHATEVT

SEQ ID NO: 716801 - protein, 9 aa, Homo Sapiens
VSFPLQPKP

SEQ ID NO: 716802 - protein, 9 aa, Homo Sapiens
LGQYNDDHD

SEQ ID NO: 716803 - protein, 9 aa, Homo Sapiens
YGCIYVEAR

SEQ ID NO: 716804 - protein, 9 aa, Homo Sapiens
ATIDVGLST

SEQ ID NO: 716805 - protein, 9 aa, Homo Sapiens
TSRLNLCGS

SEQ ID NO: 716806 - protein, 9 aa, Homo Sapiens
GQRLSGGAA

SEQ ID NO: 716807 - protein, 9 aa, Homo Sapiens
CNKVENHGL

SEQ ID NO: 716808 - protein, 9 aa, Homo Sapiens
PEGIRICRK

SEQ ID NO: 716809 - protein, 9 aa, Homo Sapiens
NQHHDEAEG

SEQ ID NO: 716810 - protein, 9 aa, Homo Sapiens
IYSGEVNQD

SEQ ID NO: 716811 - protein, 9 aa, Homo Sapiens
DTKLLSETV

SEQ ID NO: 716812 - protein, 9 aa, Homo Sapiens
TKITHTGPS

SEQ ID NO: 716813 - protein, 9 aa, Homo Sapiens
KKLEQHTRQ

SEQ ID NO: 716814 - protein, 9 aa, Homo Sapiens
IIFCIIGII

SEQ ID NO: 716815 - protein, 9 aa, Homo Sapiens
NLCGSNRIH

SEQ ID NO: 716816 - protein, 9 aa, Homo Sapiens
GGGGVSADA

SEQ ID NO: 716817 - protein, 9 aa, Homo Sapiens
ALEPGSNLD

SEQ ID NO: 716818 - protein, 9 aa, Homo Sapiens
FVEVKNAAR

SEQ ID NO: 716819 - protein, 9 aa, Homo Sapiens
PSCTRKESK

SEQ ID NO: 716820 - protein, 9 aa, Homo Sapiens
GQEWRQQAV

SEQ ID NO: 716821 - protein, 9 aa, Homo Sapiens
LYVALRRKK

SEQ ID NO: 716822 - protein, 9 aa, Homo Sapiens
AGYPNGEGM

SEQ ID NO: 716823 - protein, 9 aa, Homo Sapiens
NKERKKMTS

SEQ ID NO: 716824 - protein, 9 aa, Homo Sapiens
ICEKSFSQK

SEQ ID NO: 716825 - protein, 9 aa, Homo Sapiens
SARRLLTHY

SEQ ID NO: 716826 - protein, 9 aa, Homo Sapiens
SHCPEVKLK

SEQ ID NO: 716827 - protein, 9 aa, Homo Sapiens
ALEVSLTSQ

SEQ ID NO: 716828 - protein, 9 aa, Homo Sapiens
YAFLKLTLS

SEQ ID NO: 716829 - protein, 9 aa, Homo Sapiens
MIAQIESSK

SEQ ID NO: 716830 - protein, 9 aa, Homo Sapiens
ASKWEWGTP

SEQ ID NO: 716831 - protein, 9 aa, Homo Sapiens
CVLILLSIV

SEQ ID NO: 716832 - protein, 9 aa, Homo Sapiens
RGEVKYPSC

SEQ ID NO: 716833 - protein, 9 aa, Homo Sapiens
ASAMQRNIR

SEQ ID NO: 716834 - protein, 9 aa, Homo Sapiens
QWFVKEALV

SEQ ID NO: 716835 - protein, 9 aa, Homo Sapiens
LATIDVGLS

SEQ ID NO: 716836 - protein, 9 aa, Homo Sapiens
ERSRFKEQL

SEQ ID NO: 716837 - protein, 9 aa, Homo Sapiens
CEDIPEKNI

SEQ ID NO: 716838 - protein, 9 aa, Homo Sapiens
VYRSLGNVI

SEQ ID NO: 716839 - protein, 9 aa, Homo Sapiens
DKVSFPLQP

SEQ ID NO: 716840 - protein, 9 aa, Homo Sapiens
NQTNGATAD

SEQ ID NO: 716841 - protein, 9 aa, Homo Sapiens
DHATEVTMS

SEQ ID NO: 716842 - protein, 9 aa, Homo Sapiens
PEAGPWEEA

SEQ ID NO: 716843 - protein, 9 aa, Homo Sapiens
NTKQQPKRS

SEQ ID NO: 716844 - protein, 9 aa, Homo Sapiens
SATSQFYTT

SEQ ID NO: 716845 - protein, 9 aa, Homo Sapiens
LERMAHDGA

SEQ ID NO: 716846 - protein, 9 aa, Homo Sapiens
TAPKVERLL

SEQ ID NO: 716847 - protein, 9 aa, Homo Sapiens
GKLQGLLKF

SEQ ID NO: 716848 - protein, 9 aa, Homo Sapiens
GLREAFSKL

SEQ ID NO: 716849 - protein, 9 aa, Homo Sapiens
LDCQIHRMD

SEQ ID NO: 716850 - protein, 9 aa, Homo Sapiens
RDGQELEPQ

SEQ ID NO: 716851 - protein, 9 aa, Homo Sapiens
QGPWCPCWE

SEQ ID NO: 716852 - protein, 9 aa, Homo Sapiens
FPGLALEPG

SEQ ID NO: 716853 - protein, 9 aa, Homo Sapiens
QVMCPQDFF

SEQ ID NO: 716854 - protein, 9 aa, Homo Sapiens
CLRRKQSSK

SEQ ID NO: 716855 - protein, 9 aa, Homo Sapiens
LLKFAPLLL

SEQ ID NO: 716856 - protein, 9 aa, Homo Sapiens
SVKSGKGIR

SEQ ID NO: 716857 - protein, 9 aa, Homo Sapiens
DLQSDNIYR

SEQ ID NO: 716858 - protein, 9 aa, Homo Sapiens
YITLSGLES

SEQ ID NO: 716859 - protein, 9 aa, Homo Sapiens
SAFVEVKNA

SEQ ID NO: 716860 - protein, 9 aa, Homo Sapiens
DLQKLAVNM

SEQ ID NO: 716861 - protein, 9 aa, Homo Sapiens
NGGQYETVV

SEQ ID NO: 716862 - protein, 9 aa, Homo Sapiens
EGRSDNVVI

SEQ ID NO: 716863 - protein, 9 aa, Homo Sapiens
HDPNVEQFL

SEQ ID NO: 716864 - protein, 9 aa, Homo Sapiens
IGTLRNSAA

SEQ ID NO: 716865 - protein, 9 aa, Homo Sapiens
TASSHWSES

SEQ ID NO: 716866 - protein, 9 aa, Homo Sapiens
FSLKSHLTV

SEQ ID NO: 716867 - protein, 9 aa, Homo Sapiens
DGQELEPQV

SEQ ID NO: 716868 - protein, 9 aa, Homo Sapiens
VQGLLITAA

SEQ ID NO: 716869 - protein, 9 aa, Homo Sapiens
NGEGMFASQ

SEQ ID NO: 716870 - protein, 9 aa, Homo Sapiens
SSLSTWLAH

SEQ ID NO: 716871 - protein, 9 aa, Homo Sapiens
SETDRKEAS

SEQ ID NO: 716872 - protein, 9 aa, Homo Sapiens
LQKLAVNMV

SEQ ID NO: 716873 - protein, 9 aa, Homo Sapiens
IPKSNDTDM

SEQ ID NO: 716874 - protein, 9 aa, Homo Sapiens
LCVWVSSIR

SEQ ID NO: 716875 - protein, 9 aa, Homo Sapiens
HWASKSGQS

SEQ ID NO: 716876 - protein, 9 aa, Homo Sapiens
VDTCTPVTT

SEQ ID NO: 716877 - protein, 9 aa, Homo Sapiens
VAAAQKERL

SEQ ID NO: 716878 - protein, 9 aa, Homo Sapiens
HNSRITGMY

SEQ ID NO: 716879 - protein, 9 aa, Homo Sapiens
ETVPTAREE

SEQ ID NO: 716880 - protein, 9 aa, Homo Sapiens
LHPESHGIV

SEQ ID NO: 716881 - protein, 9 aa, Homo Sapiens
ERVTAPKVE

SEQ ID NO: 716882 - protein, 9 aa, Homo Sapiens
NADLQKLAV

SEQ ID NO: 716883 - protein, 9 aa, Homo Sapiens
GEAEHLSKR

SEQ ID NO: 716884 - protein, 9 aa, Homo Sapiens
DLISLHCNK

SEQ ID NO: 716885 - protein, 9 aa, Homo Sapiens
KSGQSTGLR

SEQ ID NO: 716886 - protein, 9 aa, Homo Sapiens
RIQCLRRKQ

SEQ ID NO: 716887 - protein, 9 aa, Homo Sapiens
ARKFRRPRD

SEQ ID NO: 716888 - protein, 9 aa, Homo Sapiens
RSRSGSQEA

SEQ ID NO: 716889 - protein, 9 aa, Homo Sapiens
QVANKTADR

SEQ ID NO: 716890 - protein, 9 aa, Homo Sapiens
WYRGDCRNQ

SEQ ID NO: 716891 - protein, 9 aa, Homo Sapiens
SQNNTFGFK

SEQ ID NO: 716892 - protein, 9 aa, Homo Sapiens
GSQRLFIME

SEQ ID NO: 716893 - protein, 9 aa, Homo Sapiens
LLVFKNSCF

SEQ ID NO: 716894 - protein, 9 aa, Homo Sapiens
VTLDKITNS

SEQ ID NO: 716895 - protein, 9 aa, Homo Sapiens
KVEKKGHGR

SEQ ID NO: 716896 - protein, 9 aa, Homo Sapiens
HVAGLQGKP

SEQ ID NO: 716897 - protein, 9 aa, Homo Sapiens
VNQDIADLI

SEQ ID NO: 716898 - protein, 9 aa, Homo Sapiens
RRIYSLLMG

SEQ ID NO: 716899 - protein, 9 aa, Homo Sapiens
LGHCIFLVA

SEQ ID NO: 716900 - protein, 9 aa, Homo Sapiens
PWAGHWASK

SEQ ID NO: 716901 - protein, 9 aa, Homo Sapiens
RSPTVSRSR

SEQ ID NO: 716902 - protein, 9 aa, Homo Sapiens
INYLGHCIF

SEQ ID NO: 716903 - protein, 9 aa, Homo Sapiens
DNQHHDEAE

SEQ ID NO: 716904 - protein, 9 aa, Homo Sapiens
VLGETQDFR

SEQ ID NO: 716905 - protein, 9 aa, Homo Sapiens
ENSATAGDT

SEQ ID NO: 716906 - protein, 9 aa, Homo Sapiens
KGTNQKDET

SEQ ID NO: 716907 - protein, 9 aa, Homo Sapiens
ENQRLWGEL

SEQ ID NO: 716908 - protein, 9 aa, Homo Sapiens
TYYRTGGNS

SEQ ID NO: 716909 - protein, 9 aa, Homo Sapiens
NTVKESQIQ

SEQ ID NO: 716910 - protein, 9 aa, Homo Sapiens
ICNPRQYHI

SEQ ID NO: 716911 - protein, 9 aa, Homo Sapiens
LRLHKNEPL

SEQ ID NO: 716912 - protein, 9 aa, Homo Sapiens
GSALYSSLV

SEQ ID NO: 716913 - protein, 9 aa, Homo Sapiens
GYIKIPVRA

SEQ ID NO: 716914 - protein, 9 aa, Homo Sapiens
NGLLVFKNS

SEQ ID NO: 716915 - protein, 9 aa, Homo Sapiens
TGEGGMKGE

SEQ ID NO: 716916 - protein, 9 aa, Homo Sapiens
RYEREMKTF

SEQ ID NO: 716917 - protein, 9 aa, Homo Sapiens
FWYVRSPGQ

SEQ ID NO: 716918 - protein, 9 aa, Homo Sapiens
DRNLLLNTD

SEQ ID NO: 716919 - protein, 9 aa, Homo Sapiens
QGKPRPGRV

SEQ ID NO: 716920 - protein, 9 aa, Homo Sapiens
SGIPFLDHK

SEQ ID NO: 716921 - protein, 9 aa, Homo Sapiens
LLKTVPIRV

SEQ ID NO: 716922 - protein, 9 aa, Homo Sapiens
PSERELHGI

SEQ ID NO: 716923 - protein, 9 aa, Homo Sapiens
CLILAAKSD

SEQ ID NO: 716924 - protein, 9 aa, Homo Sapiens
EKKLEKFKI

SEQ ID NO: 716925 - protein, 9 aa, Homo Sapiens
YDSYVAICH

SEQ ID NO: 716926 - protein, 9 aa, Homo Sapiens
RDEDKKNRY

SEQ ID NO: 716927 - protein, 9 aa, Homo Sapiens
PRQYHIMMS

SEQ ID NO: 716928 - protein, 9 aa, Homo Sapiens
KHTTSCDVW

SEQ ID NO: 716929 - protein, 9 aa, Homo Sapiens
PKGSALYSS

SEQ ID NO: 716930 - protein, 9 aa, Homo Sapiens
IVHQSAILI

SEQ ID NO: 716931 - protein, 9 aa, Homo Sapiens
VNDNPPHPG

SEQ ID NO: 716932 - protein, 9 aa, Homo Sapiens
TPHNFLYKH

SEQ ID NO: 716933 - protein, 9 aa, Homo Sapiens
SVLYHRFIR

SEQ ID NO: 716934 - protein, 9 aa, Homo Sapiens
PEAPERLIT

SEQ ID NO: 716935 - protein, 9 aa, Homo Sapiens
ESSKSKLGF

SEQ ID NO: 716936 - protein, 9 aa, Homo Sapiens
YLGHCIFLV

SEQ ID NO: 716937 - protein, 9 aa, Homo Sapiens
NGTQTAKNS

SEQ ID NO: 716938 - protein, 9 aa, Homo Sapiens
YAAAAALVH

SEQ ID NO: 716939 - protein, 9 aa, Homo Sapiens
SADAVNLTA

SEQ ID NO: 716940 - protein, 9 aa, Homo Sapiens
RPRDGHLPR

SEQ ID NO: 716941 - protein, 9 aa, Homo Sapiens
HQYTTLHHQ

SEQ ID NO: 716942 - protein, 9 aa, Homo Sapiens
MKTFIPPKG

SEQ ID NO: 716943 - protein, 9 aa, Homo Sapiens
QNTVKESQI

SEQ ID NO: 716944 - protein, 9 aa, Homo Sapiens
QNSKPSPTQ

SEQ ID NO: 716945 - protein, 9 aa, Homo Sapiens
LCGSNRIHH

SEQ ID NO: 716946 - protein, 9 aa, Homo Sapiens
HRPARKFRR

SEQ ID NO: 716947 - protein, 9 aa, Homo Sapiens
VLRIQCLRR

SEQ ID NO: 716948 - protein, 9 aa, Homo Sapiens
GHWASKSGQ

SEQ ID NO: 716949 - protein, 9 aa, Homo Sapiens
EWGTPHNFL

SEQ ID NO: 716950 - protein, 9 aa, Homo Sapiens
EANKERKKM

SEQ ID NO: 716951 - protein, 9 aa, Homo Sapiens
QHIQKQGRA

SEQ ID NO: 716952 - protein, 9 aa, Homo Sapiens
KNAARAASL

SEQ ID NO: 716953 - protein, 9 aa, Homo Sapiens
TVKESQIQL

SEQ ID NO: 716954 - protein, 9 aa, Homo Sapiens
LALGGTDAL

SEQ ID NO: 716955 - protein, 9 aa, Homo Sapiens
YVYYQRDMI

SEQ ID NO: 716956 - protein, 9 aa, Homo Sapiens
GGVVWYQHG

SEQ ID NO: 716957 - protein, 9 aa, Homo Sapiens
TEVSPAEHT

SEQ ID NO: 716958 - protein, 9 aa, Homo Sapiens
EEKLTKITH

SEQ ID NO: 716959 - protein, 9 aa, Homo Sapiens
AAAALVHHH

SEQ ID NO: 716960 - protein, 9 aa, Homo Sapiens
ELDMPLTHS

SEQ ID NO: 716961 - protein, 9 aa, Homo Sapiens
NHDPNVEQF

SEQ ID NO: 716962 - protein, 9 aa, Homo Sapiens
LGHARQGRA

SEQ ID NO: 716963 - protein, 9 aa, Homo Sapiens
SSYENIRAV

SEQ ID NO: 716964 - protein, 9 aa, Homo Sapiens
VQGLQKDST

SEQ ID NO: 716965 - protein, 9 aa, Homo Sapiens
QQHQKGQSK

SEQ ID NO: 716966 - protein, 9 aa, Homo Sapiens
QVRLPGRAQ

SEQ ID NO: 716967 - protein, 9 aa, Homo Sapiens
IAITEVSPA

SEQ ID NO: 716968 - protein, 9 aa, Homo Sapiens
GNQARLISV

SEQ ID NO: 716969 - protein, 9 aa, Homo Sapiens
LKSHLTVHQ

SEQ ID NO: 716970 - protein, 9 aa, Homo Sapiens
KCGKAFTYS

SEQ ID NO: 716971 - protein, 9 aa, Homo Sapiens
VFKNSCFPT

SEQ ID NO: 716972 - protein, 9 aa, Homo Sapiens
PPKNERAQE

SEQ ID NO: 716973 - protein, 9 aa, Homo Sapiens
MGENQRLWG

SEQ ID NO: 716974 - protein, 9 aa, Homo Sapiens
LTKITHTGP

SEQ ID NO: 716975 - protein, 9 aa, Homo Sapiens
SDSHCPEVK

SEQ ID NO: 716976 - protein, 9 aa, Homo Sapiens
RPNSKTSQI

SEQ ID NO: 716977 - protein, 9 aa, Homo Sapiens
RSNLLKTVP

SEQ ID NO: 716978 - protein, 9 aa, Homo Sapiens
PPPPGKSQG

SEQ ID NO: 716979 - protein, 9 aa, Homo Sapiens
YWGQLNETV

SEQ ID NO: 716980 - protein, 9 aa, Homo Sapiens
IDDDLQLPA

SEQ ID NO: 716981 - protein, 9 aa, Homo Sapiens
WPGGYPAYS

SEQ ID NO: 716982 - protein, 9 aa, Homo Sapiens
GATLKYECC

SEQ ID NO: 716983 - protein, 9 aa, Homo Sapiens
KEERSRFKE

SEQ ID NO: 716984 - protein, 9 aa, Homo Sapiens
NVVICSVTG

SEQ ID NO: 716985 - protein, 9 aa, Homo Sapiens
FSDALGHAR

SEQ ID NO: 716986 - protein, 9 aa, Homo Sapiens
WGQLNETVF

SEQ ID NO: 716987 - protein, 9 aa, Homo Sapiens
CESVGLCVA

SEQ ID NO: 716988 - protein, 9 aa, Homo Sapiens
RDHSGEKPN

SEQ ID NO: 716989 - protein, 9 aa, Homo Sapiens
EIQSITVES

SEQ ID NO: 716990 - protein, 9 aa, Homo Sapiens
CGKAFCRPS

SEQ ID NO: 716991 - protein, 9 aa, Homo Sapiens
LHCNKVENH

SEQ ID NO: 716992 - protein, 9 aa, Homo Sapiens
TGECYLLSS

SEQ ID NO: 716993 - protein, 9 aa, Homo Sapiens
PDVYGVRLS

SEQ ID NO: 716994 - protein, 9 aa, Homo Sapiens
MEKEGYVKI

SEQ ID NO: 716995 - protein, 9 aa, Homo Sapiens
NAARAASLQ

SEQ ID NO: 716996 - protein, 9 aa, Homo Sapiens
YFEEVFGLA

SEQ ID NO: 716997 - protein, 9 aa, Homo Sapiens
QPKRSLKKA

SEQ ID NO: 716998 - protein, 9 aa, Homo Sapiens
IQPICTPSW

SEQ ID NO: 716999 - protein, 9 aa, Homo Sapiens
ECSVKSGKG

SEQ ID NO: 717000 - protein, 9 aa, Homo Sapiens
RLITDTINE

SEQ ID NO: 717001 - protein, 9 aa, Homo Sapiens
GRNSSSDWV

SEQ ID NO: 717002 - protein, 9 aa, Homo Sapiens
VSSYENIRA

SEQ ID NO: 717003 - protein, 9 aa, Homo Sapiens
TTKQPTSAT

SEQ ID NO: 717004 - protein, 9 aa, Homo Sapiens
RDGHLPRCC

SEQ ID NO: 717005 - protein, 9 aa, Homo Sapiens
NSICNPVPW

SEQ ID NO: 717006 - protein, 9 aa, Homo Sapiens
AQSPPKNER

SEQ ID NO: 717007 - protein, 9 aa, Homo Sapiens
LTWKDCFPG

SEQ ID NO: 717008 - protein, 9 aa, Homo Sapiens
WMCIEAIHL

SEQ ID NO: 717009 - protein, 9 aa, Homo Sapiens
PKVERLLNP

SEQ ID NO: 717010 - protein, 9 aa, Homo Sapiens
PRHPGNRWL

SEQ ID NO: 717011 - protein, 9 aa, Homo Sapiens
TLRLHKNEP

SEQ ID NO: 717012 - protein, 9 aa, Homo Sapiens
KKFTISIGI

SEQ ID NO: 717013 - protein, 9 aa, Homo Sapiens
LWRFDGSKP

SEQ ID NO: 717014 - protein, 9 aa, Homo Sapiens
AGSWWAQEL

SEQ ID NO: 717015 - protein, 9 aa, Homo Sapiens
FVKEALVTY

SEQ ID NO: 717016 - protein, 9 aa, Homo Sapiens
LSKITEQEK

SEQ ID NO: 717017 - protein, 9 aa, Homo Sapiens
LTSSSREWK

SEQ ID NO: 717018 - protein, 9 aa, Homo Sapiens
LSYMCGTIC

SEQ ID NO: 717019 - protein, 9 aa, Homo Sapiens
GIITRFLYQ

SEQ ID NO: 717020 - protein, 9 aa, Homo Sapiens
VMSYDSYVA

SEQ ID NO: 717021 - protein, 9 aa, Homo Sapiens
RSRHSGIGH

SEQ ID NO: 717022 - protein, 9 aa, Homo Sapiens
GFFGGNPRS

SEQ ID NO: 717023 - protein, 9 aa, Homo Sapiens
QIHRMDDIQ

SEQ ID NO: 717024 - protein, 9 aa, Homo Sapiens
SALEPATEM

SEQ ID NO: 717025 - protein, 9 aa, Homo Sapiens
EVSPAEHTQ

SEQ ID NO: 717026 - protein, 9 aa, Homo Sapiens
KEAHILAFQ

SEQ ID NO: 717027 - protein, 9 aa, Homo Sapiens
AMLATIDVG

SEQ ID NO: 717028 - protein, 9 aa, Homo Sapiens
WSRLIRKLR

SEQ ID NO: 717029 - protein, 9 aa, Homo Sapiens
YEREMKTFI

SEQ ID NO: 717030 - protein, 9 aa, Homo Sapiens
QHQNTVKES

SEQ ID NO: 717031 - protein, 9 aa, Homo Sapiens
NTFGFKVGS

SEQ ID NO: 717032 - protein, 9 aa, Homo Sapiens
RFRSGSFID

SEQ ID NO: 717033 - protein, 9 aa, Homo Sapiens
SAARMPETD

SEQ ID NO: 717034 - protein, 9 aa, Homo Sapiens
AITKAQVAN

SEQ ID NO: 717035 - protein, 9 aa, Homo Sapiens
EAKKLEQHT

SEQ ID NO: 717036 - protein, 9 aa, Homo Sapiens
SVMVKKEWE

SEQ ID NO: 717037 - protein, 9 aa, Homo Sapiens
LQGKPRPGR

SEQ ID NO: 717038 - protein, 9 aa, Homo Sapiens
MDMVRCHQR

SEQ ID NO: 717039 - protein, 9 aa, Homo Sapiens
QYTTLHHQS

SEQ ID NO: 717040 - protein, 9 aa, Homo Sapiens
ILISRKGRH

SEQ ID NO: 717041 - protein, 9 aa, Homo Sapiens
HGQRKLRRN

SEQ ID NO: 717042 - protein, 9 aa, Homo Sapiens
ERTVCQSES

SEQ ID NO: 717043 - protein, 9 aa, Homo Sapiens
LGLSLDTPN

SEQ ID NO: 717044 - protein, 9 aa, Homo Sapiens
TNTKQQPKR

SEQ ID NO: 717045 - protein, 8 aa, Homo Sapiens
KASQCCCC

SEQ ID NO: 717046 - protein, 9 aa, Homo Sapiens
GHVTRNLTC

SEQ ID NO: 717047 - protein, 9 aa, Homo Sapiens
GVSADAVNL

SEQ ID NO: 717048 - protein, 9 aa, Homo Sapiens
ILLSYVSIV

SEQ ID NO: 717049 - protein, 9 aa, Homo Sapiens
MSSLSTWLA

SEQ ID NO: 717050 - protein, 9 aa, Homo Sapiens
YGVRLSNRS

SEQ ID NO: 717051 - protein, 9 aa, Homo Sapiens
PTAREEIAA

SEQ ID NO: 717052 - protein, 9 aa, Homo Sapiens
TKAQVANKT

SEQ ID NO: 717053 - protein, 9 aa, Homo Sapiens
SQVRLPGRA

SEQ ID NO: 717054 - protein, 9 aa, Homo Sapiens
FLKLTLSRS

SEQ ID NO: 717055 - protein, 9 aa, Homo Sapiens
RGSCNVNCG

SEQ ID NO: 717056 - protein, 9 aa, Homo Sapiens
EREIQSITV

SEQ ID NO: 717057 - protein, 9 aa, Homo Sapiens
YERDNQHHD

SEQ ID NO: 717058 - protein, 9 aa, Homo Sapiens
VESRGSIRR

SEQ ID NO: 717059 - protein, 9 aa, Homo Sapiens
LAMSNPRAM

SEQ ID NO: 717060 - protein, 9 aa, Homo Sapiens
LSVLYHRFI

SEQ ID NO: 717061 - protein, 9 aa, Homo Sapiens
KKLEKFKIE

SEQ ID NO: 717062 - protein, 9 aa, Homo Sapiens
YLNRIHKLL

SEQ ID NO: 717063 - protein, 9 aa, Homo Sapiens
DGALTGVTT

SEQ ID NO: 717064 - protein, 9 aa, Homo Sapiens
IQSYQKHYG

SEQ ID NO: 717065 - protein, 9 aa, Homo Sapiens
EGWKGNRCH

SEQ ID NO: 717066 - protein, 9 aa, Homo Sapiens
NTDSNPGTS

SEQ ID NO: 717067 - protein, 9 aa, Homo Sapiens
FYTTSERLH

SEQ ID NO: 717068 - protein, 9 aa, Homo Sapiens
LFKCGIAVP

SEQ ID NO: 717069 - protein, 9 aa, Homo Sapiens
YTEKVLEDT

SEQ ID NO: 717070 - protein, 9 aa, Homo Sapiens
TTSERLHPS

SEQ ID NO: 717071 - protein, 9 aa, Homo Sapiens
ESVGLCVAD

SEQ ID NO: 717072 - protein, 9 aa, Homo Sapiens
SREWKVKFP

SEQ ID NO: 717073 - protein, 9 aa, Homo Sapiens
DYYYMSVKA

SEQ ID NO: 717074 - protein, 9 aa, Homo Sapiens
ALEPATEMQ

SEQ ID NO: 717075 - protein, 9 aa, Homo Sapiens
HLPRCCPLC

SEQ ID NO: 717076 - protein, 9 aa, Homo Sapiens
GVSLLSVLV

SEQ ID NO: 717077 - protein, 9 aa, Homo Sapiens
PQDFFGDDD

SEQ ID NO: 717078 - protein, 9 aa, Homo Sapiens
MEKDGKRLP

SEQ ID NO: 717079 - protein, 9 aa, Homo Sapiens
VCQSESSSA

SEQ ID NO: 717080 - protein, 9 aa, Homo Sapiens
GSPGSSYWT

SEQ ID NO: 717081 - protein, 9 aa, Homo Sapiens
SRITGMYVY

SEQ ID NO: 717082 - protein, 9 aa, Homo Sapiens
QLRELTMDM

SEQ ID NO: 717083 - protein, 9 aa, Homo Sapiens
RTAPHKSKT

SEQ ID NO: 717084 - protein, 9 aa, Homo Sapiens
NTQHIQKQG

SEQ ID NO: 717085 - protein, 9 aa, Homo Sapiens
AYERDNQHH

SEQ ID NO: 717086 - protein, 9 aa, Homo Sapiens
RNLLLNTDS

SEQ ID NO: 717087 - protein, 9 aa, Homo Sapiens
DGVSPCLPG

SEQ ID NO: 717088 - protein, 9 aa, Homo Sapiens
LEWKQKVEK

SEQ ID NO: 717089 - protein, 9 aa, Homo Sapiens
LRCNGVPEG

SEQ ID NO: 717090 - protein, 9 aa, Homo Sapiens
SKWEWGTPH

SEQ ID NO: 717091 - protein, 9 aa, Homo Sapiens
LMAALYVGD

SEQ ID NO: 717092 - protein, 9 aa, Homo Sapiens
AHGKHTTSC

SEQ ID NO: 717093 - protein, 9 aa, Homo Sapiens
PHLLFSPLS

SEQ ID NO: 717094 - protein, 9 aa, Homo Sapiens
QAEAKKLEQ

SEQ ID NO: 717095 - protein, 9 aa, Homo Sapiens
DSFMKMLSS

SEQ ID NO: 717096 - protein, 9 aa, Homo Sapiens
QKLAVNMVP

SEQ ID NO: 717097 - protein, 9 aa, Homo Sapiens
FGLAISKVG

SEQ ID NO: 717098 - protein, 9 aa, Homo Sapiens
GYLGLSLDT

SEQ ID NO: 717099 - protein, 9 aa, Homo Sapiens
GGKEEAQEA

SEQ ID NO: 717100 - protein, 9 aa, Homo Sapiens
SYDSYVAIC

SEQ ID NO: 717101 - protein, 9 aa, Homo Sapiens
VLVCAAEYS

SEQ ID NO: 717102 - protein, 9 aa, Homo Sapiens
HEAKLHEHI

SEQ ID NO: 717103 - protein, 9 aa, Homo Sapiens
LGVPRQQIP

SEQ ID NO: 717104 - protein, 9 aa, Homo Sapiens
QEAQGILWT

SEQ ID NO: 717105 - protein, 9 aa, Homo Sapiens
GHCIFLVAL

SEQ ID NO: 717106 - protein, 9 aa, Homo Sapiens
QKGILRKFE

SEQ ID NO: 717107 - protein, 9 aa, Homo Sapiens
DVNDNPPHP

SEQ ID NO: 717108 - protein, 9 aa, Homo Sapiens
QRSPTVSRS

SEQ ID NO: 717109 - protein, 9 aa, Homo Sapiens
LFCSILTKL

SEQ ID NO: 717110 - protein, 9 aa, Homo Sapiens
SFMVAAPSS

SEQ ID NO: 717111 - protein, 9 aa, Homo Sapiens
RIGGDRNYI

SEQ ID NO: 717112 - protein, 9 aa, Homo Sapiens
PEIPSHCEI

SEQ ID NO: 717113 - protein, 9 aa, Homo Sapiens
NMKKKKTDF

SEQ ID NO: 717114 - protein, 9 aa, Homo Sapiens
QSIPFMIMT

SEQ ID NO: 717115 - protein, 9 aa, Homo Sapiens
RLNLCGSNR

SEQ ID NO: 717116 - protein, 9 aa, Homo Sapiens
NQLLLFPLF

SEQ ID NO: 717117 - protein, 9 aa, Homo Sapiens
EVYGDPAVH

SEQ ID NO: 717118 - protein, 9 aa, Homo Sapiens
ITRFLYQHK

SEQ ID NO: 717119 - protein, 9 aa, Homo Sapiens
EDRVQEEEQ

SEQ ID NO: 717120 - protein, 9 aa, Homo Sapiens
TGQNKISRF

SEQ ID NO: 717121 - protein, 9 aa, Homo Sapiens
LLVLALERN

SEQ ID NO: 717122 - protein, 9 aa, Homo Sapiens
APHKSKTGF

SEQ ID NO: 717123 - protein, 9 aa, Homo Sapiens
AITATHKTV

SEQ ID NO: 717124 - protein, 9 aa, Homo Sapiens
FCRPSDLFR

SEQ ID NO: 717125 - protein, 9 aa, Homo Sapiens
VPQISVRNP

SEQ ID NO: 717126 - protein, 9 aa, Homo Sapiens
LFVQGLQKD

SEQ ID NO: 717127 - protein, 9 aa, Homo Sapiens
EKGEAEHLS

SEQ ID NO: 717128 - protein, 9 aa, Homo Sapiens
LEKSLSLLS

SEQ ID NO: 717129 - protein, 9 aa, Homo Sapiens
LELDMPLTH

SEQ ID NO: 717130 - protein, 9 aa, Homo Sapiens
RVTSPLHSP

SEQ ID NO: 717131 - protein, 9 aa, Homo Sapiens
AFLKLTLSR

SEQ ID NO: 717132 - protein, 9 aa, Homo Sapiens
GAEGRSDNV

SEQ ID NO: 717133 - protein, 9 aa, Homo Sapiens
FGNSVHPIV

SEQ ID NO: 717134 - protein, 9 aa, Homo Sapiens
FYKQKAPDC

SEQ ID NO: 717135 - protein, 9 aa, Homo Sapiens
STCSCHMSV

SEQ ID NO: 717136 - protein, 9 aa, Homo Sapiens
VAEKNEIKQ

SEQ ID NO: 717137 - protein, 9 aa, Homo Sapiens
AYTASLGEA

SEQ ID NO: 717138 - protein, 9 aa, Homo Sapiens
PKIHQVKLM

SEQ ID NO: 717139 - protein, 9 aa, Homo Sapiens
EDITASSHW

SEQ ID NO: 717140 - protein, 9 aa, Homo Sapiens
RFDGSKPDA

SEQ ID NO: 717141 - protein, 9 aa, Homo Sapiens
ISLHCNKVE

SEQ ID NO: 717142 - protein, 9 aa, Homo Sapiens
PGKPSALEP

SEQ ID NO: 717143 - protein, 9 aa, Homo Sapiens
VFSDALGHA

SEQ ID NO: 717144 - protein, 9 aa, Homo Sapiens
DEDKKNRYN

SEQ ID NO: 717145 - protein, 9 aa, Homo Sapiens
NQARLISVP

SEQ ID NO: 717146 - protein, 9 aa, Homo Sapiens
IPSHCEIPE

SEQ ID NO: 717147 - protein, 9 aa, Homo Sapiens
KKNRYNYGW

SEQ ID NO: 717148 - protein, 9 aa, Homo Sapiens
LAEDRVQEE

SEQ ID NO: 717149 - protein, 9 aa, Homo Sapiens
IPEAPERLI

SEQ ID NO: 717150 - protein, 9 aa, Homo Sapiens
DEDITASSH

SEQ ID NO: 717151 - protein, 9 aa, Homo Sapiens
QVPIPLETR

SEQ ID NO: 717152 - protein, 9 aa, Homo Sapiens
NSKTSQITT

SEQ ID NO: 717153 - protein, 9 aa, Homo Sapiens
EKLTKITHT

SEQ ID NO: 717154 - protein, 9 aa, Homo Sapiens
VRRIYSLLM

SEQ ID NO: 717155 - protein, 9 aa, Homo Sapiens
PGGYPAYSK

SEQ ID NO: 717156 - protein, 9 aa, Homo Sapiens
IIAGYPNGE

SEQ ID NO: 717157 - protein, 9 aa, Homo Sapiens
LGETQDFRS

SEQ ID NO: 717158 - protein, 9 aa, Homo Sapiens
EWQVYKEER

SEQ ID NO: 717159 - protein, 9 aa, Homo Sapiens
FCSILTKLG

SEQ ID NO: 717160 - protein, 9 aa, Homo Sapiens
GYLNRIHKL

SEQ ID NO: 717161 - protein, 9 aa, Homo Sapiens
TSKGILRQF

SEQ ID NO: 717162 - protein, 9 aa, Homo Sapiens
LNRIHKLLN

SEQ ID NO: 717163 - protein, 9 aa, Homo Sapiens
RLRSVSSYE

SEQ ID NO: 717164 - protein, 9 aa, Homo Sapiens
HWADMEKDG

SEQ ID NO: 717165 - protein, 9 aa, Homo Sapiens
GKAFSLKSH

SEQ ID NO: 717166 - protein, 9 aa, Homo Sapiens
LDHKVYAER

SEQ ID NO: 717167 - protein, 9 aa, Homo Sapiens
WMTISVGYL

SEQ ID NO: 717168 - protein, 9 aa, Homo Sapiens
FIMEKEGYV

SEQ ID NO: 717169 - protein, 9 aa, Homo Sapiens
KSKTGFPKL

SEQ ID NO: 717170 - protein, 9 aa, Homo Sapiens
SLSLLSSRY

SEQ ID NO: 717171 - protein, 9 aa, Homo Sapiens
VYTEKVLED

SEQ ID NO: 717172 - protein, 9 aa, Homo Sapiens
KFAPLLLPG

SEQ ID NO: 717173 - protein, 9 aa, Homo Sapiens
NPPHPGCSL

SEQ ID NO: 717174 - protein, 9 aa, Homo Sapiens
LFVILWLKG

SEQ ID NO: 717175 - protein, 9 aa, Homo Sapiens
SARMAELLL

SEQ ID NO: 717176 - protein, 9 aa, Homo Sapiens
ISVPHKAEL

SEQ ID NO: 717177 - protein, 9 aa, Homo Sapiens
CSLTPGHPC

SEQ ID NO: 717178 - protein, 9 aa, Homo Sapiens
TQQDEEPMH

SEQ ID NO: 717179 - protein, 9 aa, Homo Sapiens
APSSATWAT

SEQ ID NO: 717180 - protein, 9 aa, Homo Sapiens
IPDPSAIKP

SEQ ID NO: 717181 - protein, 9 aa, Homo Sapiens
YGDPAVHPQ

SEQ ID NO: 717182 - protein, 9 aa, Homo Sapiens
AKAKSKTFD

SEQ ID NO: 717183 - protein, 9 aa, Homo Sapiens
LITAAAQLT

SEQ ID NO: 717184 - protein, 9 aa, Homo Sapiens
SGGFFGGNP

SEQ ID NO: 717185 - protein, 9 aa, Homo Sapiens
TFGFKVGSV

SEQ ID NO: 717186 - protein, 9 aa, Homo Sapiens
ELEEVQSGS

SEQ ID NO: 717187 - protein, 9 aa, Homo Sapiens
HCNKVENHG

SEQ ID NO: 717188 - protein, 9 aa, Homo Sapiens
DIPTYYRTG

SEQ ID NO: 717189 - protein, 9 aa, Homo Sapiens
KGILRQFLI

SEQ ID NO: 717190 - protein, 9 aa, Homo Sapiens
RDSLTQQDE

SEQ ID NO: 717191 - protein, 9 aa, Homo Sapiens
HISPEGPLI

SEQ ID NO: 717192 - protein, 9 aa, Homo Sapiens
TPNRPKKRQ

SEQ ID NO: 717193 - protein, 9 aa, Homo Sapiens
VCLKSGQVY

SEQ ID NO: 717194 - protein, 9 aa, Homo Sapiens
TVESRGSIR

SEQ ID NO: 717195 - protein, 9 aa, Homo Sapiens
IMEKEGYVK

SEQ ID NO: 717196 - protein, 9 aa, Homo Sapiens
SAFYLGHLR

SEQ ID NO: 717197 - protein, 9 aa, Homo Sapiens
SGKGIRHRT

SEQ ID NO: 717198 - protein, 9 aa, Homo Sapiens
MTPYSLLRL

SEQ ID NO: 717199 - protein, 9 aa, Homo Sapiens
PLVVAKGGT

SEQ ID NO: 717200 - protein, 9 aa, Homo Sapiens
YSYSMPDAI

SEQ ID NO: 717201 - protein, 9 aa, Homo Sapiens
SRPCERTVC

SEQ ID NO: 717202 - protein, 9 aa, Homo Sapiens
WKDCFPGYL

SEQ ID NO: 717203 - protein, 9 aa, Homo Sapiens
CERLSPGAI

SEQ ID NO: 717204 - protein, 9 aa, Homo Sapiens
NKTADRNLQ

SEQ ID NO: 717205 - protein, 9 aa, Homo Sapiens
SRDGVSPCL

SEQ ID NO: 717206 - protein, 9 aa, Homo Sapiens
LPVLENSAT

SEQ ID NO: 717207 - protein, 9 aa, Homo Sapiens
DNVVICSVT

SEQ ID NO: 717208 - protein, 9 aa, Homo Sapiens
SEGHDSSSQ

SEQ ID NO: 717209 - protein, 9 aa, Homo Sapiens
TVCLKSGQV

SEQ ID NO: 717210 - protein, 9 aa, Homo Sapiens
PQSILSKCL

SEQ ID NO: 717211 - protein, 9 aa, Homo Sapiens
CREKLCESV

SEQ ID NO: 717212 - protein, 9 aa, Homo Sapiens
AMAGSGQEW

SEQ ID NO: 717213 - protein, 9 aa, Homo Sapiens
KYPSCTRKE

SEQ ID NO: 717214 - protein, 9 aa, Homo Sapiens
SQVETVPTA

SEQ ID NO: 717215 - protein, 9 aa, Homo Sapiens
TLRNSAAIE

SEQ ID NO: 717216 - protein, 9 aa, Homo Sapiens
MGFPENQTN

SEQ ID NO: 717217 - protein, 9 aa, Homo Sapiens
FQQWSTAKS

SEQ ID NO: 717218 - protein, 9 aa, Homo Sapiens
NGVPEGIRI

SEQ ID NO: 717219 - protein, 9 aa, Homo Sapiens
EKLSYMCGT

SEQ ID NO: 717220 - protein, 9 aa, Homo Sapiens
QVKLMYQVR

SEQ ID NO: 717221 - protein, 9 aa, Homo Sapiens
GLLVFKNSC

SEQ ID NO: 717222 - protein, 9 aa, Homo Sapiens
DGSKPDALG

SEQ ID NO: 717223 - protein, 9 aa, Homo Sapiens
LNIHQGKIG

SEQ ID NO: 717224 - protein, 9 aa, Homo Sapiens
YIDVKKFTI

SEQ ID NO: 717225 - protein, 9 aa, Homo Sapiens
IQKQGRALN

SEQ ID NO: 717226 - protein, 9 aa, Homo Sapiens
DSGLLTSSS

SEQ ID NO: 717227 - protein, 9 aa, Homo Sapiens
LGPEDYWCQ

SEQ ID NO: 717228 - protein, 9 aa, Homo Sapiens
KYECCATLG

SEQ ID NO: 717229 - protein, 9 aa, Homo Sapiens
AFYLGHLRE

SEQ ID NO: 717230 - protein, 9 aa, Homo Sapiens
CTPVTTSAE

SEQ ID NO: 717231 - protein, 9 aa, Homo Sapiens
YGPQTLYLP

SEQ ID NO: 717232 - protein, 9 aa, Homo Sapiens
NSKAIKNLP

SEQ ID NO: 717233 - protein, 9 aa, Homo Sapiens
YVAICNPRQ

SEQ ID NO: 717234 - protein, 9 aa, Homo Sapiens
RKKMTSKSS

SEQ ID NO: 717235 - protein, 9 aa, Homo Sapiens
PHPGCSLTP

SEQ ID NO: 717236 - protein, 9 aa, Homo Sapiens
KNEIKQYFE

SEQ ID NO: 717237 - protein, 9 aa, Homo Sapiens
LEPATEMQK

SEQ ID NO: 717238 - protein, 9 aa, Homo Sapiens
QFYTTSERL

SEQ ID NO: 717239 - protein, 9 aa, Homo Sapiens
FKNSCFPTS

SEQ ID NO: 717240 - protein, 9 aa, Homo Sapiens
HSRRPRPRG

SEQ ID NO: 717241 - protein, 9 aa, Homo Sapiens
GASDAAYTA

SEQ ID NO: 717242 - protein, 9 aa, Homo Sapiens
DSLTQQDEE

SEQ ID NO: 717243 - protein, 9 aa, Homo Sapiens
EQFLQQQDT

SEQ ID NO: 717244 - protein, 9 aa, Homo Sapiens
YTTLHHQSF

SEQ ID NO: 717245 - protein, 9 aa, Homo Sapiens
ILRQFLIVC

SEQ ID NO: 717246 - protein, 9 aa, Homo Sapiens
DPVLVHCSA

SEQ ID NO: 717247 - protein, 9 aa, Homo Sapiens
PGLALEPGS

SEQ ID NO: 717248 - protein, 9 aa, Homo Sapiens
SYSMPDAIR

SEQ ID NO: 717249 - protein, 9 aa, Homo Sapiens
WEKLSYMCG

SEQ ID NO: 717250 - protein, 9 aa, Homo Sapiens
SAFLVPRAR

SEQ ID NO: 717251 - protein, 9 aa, Homo Sapiens
RTNSRLQTP

SEQ ID NO: 717252 - protein, 9 aa, Homo Sapiens
RLWGELDRV

SEQ ID NO: 717253 - protein, 9 aa, Homo Sapiens
YKQKAPDCH

SEQ ID NO: 717254 - protein, 9 aa, Homo Sapiens
EKQVPIPLE

SEQ ID NO: 717255 - protein, 9 aa, Homo Sapiens
GPWCPCWEE

SEQ ID NO: 717256 - protein, 9 aa, Homo Sapiens
VMMMGSARM

SEQ ID NO: 717257 - protein, 9 aa, Homo Sapiens
SLHCNKVEN

SEQ ID NO: 717258 - protein, 9 aa, Homo Sapiens
PARKFRRPR

SEQ ID NO: 717259 - protein, 9 aa, Homo Sapiens
SGCFVLILL

SEQ ID NO: 717260 - protein, 9 aa, Homo Sapiens
NYLGHCIFL

SEQ ID NO: 717261 - protein, 9 aa, Homo Sapiens
YLELNIHQG

SEQ ID NO: 717262 - protein, 9 aa, Homo Sapiens
SKAIKNLPP

SEQ ID NO: 717263 - protein, 9 aa, Homo Sapiens
YDWNLLAAR

SEQ ID NO: 717264 - protein, 9 aa, Homo Sapiens
LCLLDSDSR

SEQ ID NO: 717265 - protein, 9 aa, Homo Sapiens
FAWMCIEAI

SEQ ID NO: 717266 - protein, 9 aa, Homo Sapiens
EVKYPSCTR

SEQ ID NO: 717267 - protein, 9 aa, Homo Sapiens
YNDDHDDDD

SEQ ID NO: 717268 - protein, 9 aa, Homo Sapiens
KCRPVYRSL

SEQ ID NO: 717269 - protein, 9 aa, Homo Sapiens
RRKKSFQGD

SEQ ID NO: 717270 - protein, 9 aa, Homo Sapiens
TKQQPKRSL

SEQ ID NO: 717271 - protein, 9 aa, Homo Sapiens
TPSWSQLLT

SEQ ID NO: 717272 - protein, 9 aa, Homo Sapiens
PEMLGVPRQ

SEQ ID NO: 717273 - protein, 9 aa, Homo Sapiens
HLHACISIP

SEQ ID NO: 717274 - protein, 9 aa, Homo Sapiens
THMGFPENQ

SEQ ID NO: 717275 - protein, 9 aa, Homo Sapiens
IHNIEVYHE

SEQ ID NO: 717276 - protein, 9 aa, Homo Sapiens
AAALVHHHH

SEQ ID NO: 717277 - protein, 9 aa, Homo Sapiens
TPTTVTPGY

SEQ ID NO: 717278 - protein, 9 aa, Homo Sapiens
SSATWATAS

SEQ ID NO: 717279 - protein, 9 aa, Homo Sapiens
VIHMGSVEG

SEQ ID NO: 717280 - protein, 9 aa, Homo Sapiens
VSSSRILRN

SEQ ID NO: 717281 - protein, 9 aa, Homo Sapiens
VFLALGGTD

SEQ ID NO: 717282 - protein, 9 aa, Homo Sapiens
QERDHSGEK

SEQ ID NO: 717283 - protein, 9 aa, Homo Sapiens
CNGVPEGIR

SEQ ID NO: 717284 - protein, 9 aa, Homo Sapiens
QMHPAPVRI

SEQ ID NO: 717285 - protein, 9 aa, Homo Sapiens
TNSRLQTPM

SEQ ID NO: 717286 - protein, 9 aa, Homo Sapiens
LRQFLIVCI

SEQ ID NO: 717287 - protein, 9 aa, Homo Sapiens
VLNSKAIKN

SEQ ID NO: 717288 - protein, 9 aa, Homo Sapiens
PLETRPKTF

SEQ ID NO: 717289 - protein, 9 aa, Homo Sapiens
PTNTKQQPK

SEQ ID NO: 717290 - protein, 9 aa, Homo Sapiens
FMKMLSSKM

SEQ ID NO: 717291 - protein, 9 aa, Homo Sapiens
AKNSTDPAI

SEQ ID NO: 717292 - protein, 9 aa, Homo Sapiens
GGMHTVCLK

SEQ ID NO: 717293 - protein, 9 aa, Homo Sapiens
NRPKKRQIY

SEQ ID NO: 717294 - protein, 9 aa, Homo Sapiens
IPLETRPKT

SEQ ID NO: 717295 - protein, 9 aa, Homo Sapiens
LVPRARPVP

SEQ ID NO: 717296 - protein, 9 aa, Homo Sapiens
TSSASSLTC

SEQ ID NO: 717297 - protein, 9 aa, Homo Sapiens
WDLISLHCN

SEQ ID NO: 717298 - protein, 9 aa, Homo Sapiens
FPEAGPWEE

SEQ ID NO: 717299 - protein, 9 aa, Homo Sapiens
REKLCESVG

SEQ ID NO: 717300 - protein, 9 aa, Homo Sapiens
SSDISVLVP

SEQ ID NO: 717301 - protein, 9 aa, Homo Sapiens
GETQDFRSL

SEQ ID NO: 717302 - protein, 9 aa, Homo Sapiens
ESARRLLTH

SEQ ID NO: 717303 - protein, 9 aa, Homo Sapiens
KVERLLNPP

SEQ ID NO: 717304 - protein, 9 aa, Homo Sapiens
ATHKTVDGP

SEQ ID NO: 717305 - protein, 9 aa, Homo Sapiens
YPSERELHG

SEQ ID NO: 717306 - protein, 9 aa, Homo Sapiens
SAIATQGRN

SEQ ID NO: 717307 - protein, 9 aa, Homo Sapiens
LLVLLPIAL

SEQ ID NO: 717308 - protein, 9 aa, Homo Sapiens
FQYRKLNLD

SEQ ID NO: 717309 - protein, 9 aa, Homo Sapiens
LPPGGKEEA

SEQ ID NO: 717310 - protein, 9 aa, Homo Sapiens
EHLHACISI

SEQ ID NO: 717311 - protein, 9 aa, Homo Sapiens
MQRNIRLVH

SEQ ID NO: 717312 - protein, 9 aa, Homo Sapiens
LSGGAAAAP

SEQ ID NO: 717313 - protein, 9 aa, Homo Sapiens
QSPPKNERA

SEQ ID NO: 717314 - protein, 9 aa, Homo Sapiens
WRQQAVCAT

SEQ ID NO: 717315 - protein, 9 aa, Homo Sapiens
RGDCRNQIG

SEQ ID NO: 717316 - protein, 9 aa, Homo Sapiens
TMPHRNLRG

SEQ ID NO: 717317 - protein, 9 aa, Homo Sapiens
LFWYVRSPG

SEQ ID NO: 717318 - protein, 9 aa, Homo Sapiens
PWEEAAGAP

SEQ ID NO: 717319 - protein, 9 aa, Homo Sapiens
KQQPKRSLK

SEQ ID NO: 717320 - protein, 9 aa, Homo Sapiens
FPELLCVWV

SEQ ID NO: 717321 - protein, 9 aa, Homo Sapiens
WSECSVKSG

SEQ ID NO: 717322 - protein, 9 aa, Homo Sapiens
ITHTGPSAW

SEQ ID NO: 717323 - protein, 9 aa, Homo Sapiens
FSETDRKEA

SEQ ID NO: 717324 - protein, 9 aa, Homo Sapiens
AIATQGRNS

SEQ ID NO: 717325 - protein, 9 aa, Homo Sapiens
LIVMGSPGS

SEQ ID NO: 717326 - protein, 9 aa, Homo Sapiens
SSHWSESTA

SEQ ID NO: 717327 - protein, 9 aa, Homo Sapiens
WDLPGSQVR

SEQ ID NO: 717328 - protein, 9 aa, Homo Sapiens
TSERLHPSD

SEQ ID NO: 717329 - protein, 9 aa, Homo Sapiens
FAGKQLEGG

SEQ ID NO: 717330 - protein, 9 aa, Homo Sapiens
TWDLISLHC

SEQ ID NO: 717331 - protein, 9 aa, Homo Sapiens
SSSRILRNH

SEQ ID NO: 717332 - protein, 9 aa, Homo Sapiens
NELRRKRPV

SEQ ID NO: 717333 - protein, 9 aa, Homo Sapiens
GCFVLILLS

SEQ ID NO: 717334 - protein, 9 aa, Homo Sapiens
KAQEKHQLL

SEQ ID NO: 717335 - protein, 9 aa, Homo Sapiens
SETCLPNGI

SEQ ID NO: 717336 - protein, 9 aa, Homo Sapiens
EYMNSICNP

SEQ ID NO: 717337 - protein, 9 aa, Homo Sapiens
FEDLQNQIK

SEQ ID NO: 717338 - protein, 9 aa, Homo Sapiens
HLLAAASWV

SEQ ID NO: 717339 - protein, 9 aa, Homo Sapiens
DHKVYAERI

SEQ ID NO: 717340 - protein, 9 aa, Homo Sapiens
VNAHMETPP

SEQ ID NO: 717341 - protein, 9 aa, Homo Sapiens
HLELEEVQS

SEQ ID NO: 717342 - protein, 9 aa, Homo Sapiens
HSEPRLQTP

SEQ ID NO: 717343 - protein, 9 aa, Homo Sapiens
ILAFQTMEE

SEQ ID NO: 717344 - protein, 9 aa, Homo Sapiens
GIAVPPVSS

SEQ ID NO: 717345 - protein, 9 aa, Homo Sapiens
SGPNKNMKK

SEQ ID NO: 717346 - protein, 9 aa, Homo Sapiens
SKLDMTSEV

SEQ ID NO: 717347 - protein, 9 aa, Homo Sapiens
LEKYSAVKS

SEQ ID NO: 717348 - protein, 9 aa, Homo Sapiens
GSGQEWRQQ

SEQ ID NO: 717349 - protein, 9 aa, Homo Sapiens
LLEWKQKVE

SEQ ID NO: 717350 - protein, 9 aa, Homo Sapiens
QPICTPSWS

SEQ ID NO: 717351 - protein, 9 aa, Homo Sapiens
DVYGVRLSN

SEQ ID NO: 717352 - protein, 9 aa, Homo Sapiens
QQDEEPMHY

SEQ ID NO: 717353 - protein, 9 aa, Homo Sapiens
LAISKVGLL

SEQ ID NO: 717354 - protein, 9 aa, Homo Sapiens
SNSDGKTWL

SEQ ID NO: 717355 - protein, 9 aa, Homo Sapiens
IATQGRNSS

SEQ ID NO: 717356 - protein, 9 aa, Homo Sapiens
HHQQSADRS

SEQ ID NO: 717357 - protein, 9 aa, Homo Sapiens
SRQHEAKLH

SEQ ID NO: 717358 - protein, 9 aa, Homo Sapiens
KLQGLLKFA

SEQ ID NO: 717359 - protein, 9 aa, Homo Sapiens
LVTYKSDPA

SEQ ID NO: 717360 - protein, 9 aa, Homo Sapiens
RDGVSPCLP

SEQ ID NO: 717361 - protein, 9 aa, Homo Sapiens
QKQGRALNQ

SEQ ID NO: 717362 - protein, 9 aa, Homo Sapiens
MEEVEETLK

SEQ ID NO: 717363 - protein, 9 aa, Homo Sapiens
EIKQYFESK

SEQ ID NO: 717364 - protein, 9 aa, Homo Sapiens
LQLCLICKA

SEQ ID NO: 717365 - protein, 9 aa, Homo Sapiens
ASSLTCFSN

SEQ ID NO: 717366 - protein, 9 aa, Homo Sapiens
QFLIVCIIL

SEQ ID NO: 717367 - protein, 9 aa, Homo Sapiens
ILWTIRLPR

SEQ ID NO: 717368 - protein, 9 aa, Homo Sapiens
VYKEERSRF

SEQ ID NO: 717369 - protein, 9 aa, Homo Sapiens
STQNKGAML

SEQ ID NO: 717370 - protein, 9 aa, Homo Sapiens
REWKVKFPE

SEQ ID NO: 717371 - protein, 9 aa, Homo Sapiens
KPPSGSGRS

SEQ ID NO: 717372 - protein, 9 aa, Homo Sapiens
AMRLSVMVK

SEQ ID NO: 717373 - protein, 9 aa, Homo Sapiens
EPQVGEQLL

SEQ ID NO: 717374 - protein, 9 aa, Homo Sapiens
VSQGKDVLL

SEQ ID NO: 717375 - protein, 9 aa, Homo Sapiens
RVNETLVRE

SEQ ID NO: 717376 - protein, 9 aa, Homo Sapiens
GSFPGLALE

SEQ ID NO: 717377 - protein, 9 aa, Homo Sapiens
WEEPQRVTS

SEQ ID NO: 717378 - protein, 9 aa, Homo Sapiens
MMMGSARMA

SEQ ID NO: 717379 - protein, 9 aa, Homo Sapiens
TPPAIAAYW

SEQ ID NO: 717380 - protein, 9 aa, Homo Sapiens
MAHDGALTG

SEQ ID NO: 717381 - protein, 9 aa, Homo Sapiens
SPLPPGGKE

SEQ ID NO: 717382 - protein, 9 aa, Homo Sapiens
GYAFLKLTL

SEQ ID NO: 717383 - protein, 9 aa, Homo Sapiens
NSWDLPGSQ

SEQ ID NO: 717384 - protein, 9 aa, Homo Sapiens
EAFSKLDMT

SEQ ID NO: 717385 - protein, 9 aa, Homo Sapiens
RNLRGSCNV

SEQ ID NO: 717386 - protein, 9 aa, Homo Sapiens
HEVPQISVR

SEQ ID NO: 717387 - protein, 9 aa, Homo Sapiens
AAPSSATWA

SEQ ID NO: 717388 - protein, 9 aa, Homo Sapiens
WWAQELEDI

SEQ ID NO: 717389 - protein, 9 aa, Homo Sapiens
DAAYTASLG

SEQ ID NO: 717390 - protein, 9 aa, Homo Sapiens
PCWEEKRPT

SEQ ID NO: 717391 - protein, 9 aa, Homo Sapiens
TPVQGGIPA

SEQ ID NO: 717392 - protein, 9 aa, Homo Sapiens
LEEVQSGSL

SEQ ID NO: 717393 - protein, 9 aa, Homo Sapiens
AKLHEHIKQ

SEQ ID NO: 717394 - protein, 9 aa, Homo Sapiens
TVPICEDIP

SEQ ID NO: 717395 - protein, 9 aa, Homo Sapiens
SGQEWRQQA

SEQ ID NO: 717396 - protein, 9 aa, Homo Sapiens
MHPAPVRIQ

SEQ ID NO: 717397 - protein, 9 aa, Homo Sapiens
KYLMAALYV

SEQ ID NO: 717398 - protein, 9 aa, Homo Sapiens
SRILRNHNE

SEQ ID NO: 717399 - protein, 9 aa, Homo Sapiens
SGVEYYWGQ

SEQ ID NO: 717400 - protein, 9 aa, Homo Sapiens
AAASWVIGF

SEQ ID NO: 717401 - protein, 9 aa, Homo Sapiens
QLEGGRTLS

SEQ ID NO: 717402 - protein, 9 aa, Homo Sapiens
DWYRGDCRN

SEQ ID NO: 717403 - protein, 9 aa, Homo Sapiens
HCEIPEGSR

SEQ ID NO: 717404 - protein, 9 aa, Homo Sapiens
VLALEVSLT

SEQ ID NO: 717405 - protein, 9 aa, Homo Sapiens
IVMTPYSLL

SEQ ID NO: 717406 - protein, 9 aa, Homo Sapiens
LDNISGSGC

SEQ ID NO: 717407 - protein, 9 aa, Homo Sapiens
LGDYLELNI

SEQ ID NO: 717408 - protein, 9 aa, Homo Sapiens
KSNDTDMRW

SEQ ID NO: 717409 - protein, 9 aa, Homo Sapiens
LWGELDRVN

SEQ ID NO: 717410 - protein, 9 aa, Homo Sapiens
LNSKAIKNL

SEQ ID NO: 717411 - protein, 9 aa, Homo Sapiens
SGASDAAYT

SEQ ID NO: 717412 - protein, 9 aa, Homo Sapiens
YVALRRKKK

SEQ ID NO: 717413 - protein, 9 aa, Homo Sapiens
VNETLVREV

SEQ ID NO: 717414 - protein, 9 aa, Homo Sapiens
SITVESRGS

SEQ ID NO: 717415 - protein, 9 aa, Homo Sapiens
YRKLNLDMF

SEQ ID NO: 717416 - protein, 9 aa, Homo Sapiens
IPPLMQTPV

SEQ ID NO: 717417 - protein, 9 aa, Homo Sapiens
SKRDKLWGV

SEQ ID NO: 717418 - protein, 9 aa, Homo Sapiens
NLRGSCNVN

SEQ ID NO: 717419 - protein, 9 aa, Homo Sapiens
IEVYHEKDI

SEQ ID NO: 717420 - protein, 9 aa, Homo Sapiens
AEHLSKRDK

SEQ ID NO: 717421 - protein, 9 aa, Homo Sapiens
LCESVGLCV

SEQ ID NO: 717422 - protein, 9 aa, Homo Sapiens
ILSEGPSVG

SEQ ID NO: 717423 - protein, 9 aa, Homo Sapiens
DGALFGSDA

SEQ ID NO: 717424 - protein, 9 aa, Homo Sapiens
EDLQNQIKD

SEQ ID NO: 717425 - protein, 9 aa, Homo Sapiens
FQTKYDWNL

SEQ ID NO: 717426 - protein, 9 aa, Homo Sapiens
SSLTCFSNW

SEQ ID NO: 717427 - protein, 9 aa, Homo Sapiens
VDIAITEVS

SEQ ID NO: 717428 - protein, 9 aa, Homo Sapiens
GCLDNISGS

SEQ ID NO: 717429 - protein, 9 aa, Homo Sapiens
IALYGCIYV

SEQ ID NO: 717430 - protein, 9 aa, Homo Sapiens
SDIVCPQTD

SEQ ID NO: 717431 - protein, 9 aa, Homo Sapiens
SSAFLVPRA

SEQ ID NO: 717432 - protein, 9 aa, Homo Sapiens
VSLLSVLVV

SEQ ID NO: 717433 - protein, 9 aa, Homo Sapiens
SKSGQSTGL

SEQ ID NO: 717434 - protein, 9 aa, Homo Sapiens
NSVHPIVRV

SEQ ID NO: 717435 - protein, 9 aa, Homo Sapiens
PCERTVCQS

SEQ ID NO: 717436 - protein, 9 aa, Homo Sapiens
IHQVKLMYQ

SEQ ID NO: 717437 - protein, 9 aa, Homo Sapiens
VSTCSCHMS

SEQ ID NO: 717438 - protein, 9 aa, Homo Sapiens
VVICSVTGA

SEQ ID NO: 717439 - protein, 9 aa, Homo Sapiens
YPNGEGMFA

SEQ ID NO: 717440 - protein, 9 aa, Homo Sapiens
NPDTLLAMS

SEQ ID NO: 717441 - protein, 9 aa, Homo Sapiens
ILANTLGPH

SEQ ID NO: 717442 - protein, 9 aa, Homo Sapiens
YECCATLGA

SEQ ID NO: 717443 - protein, 9 aa, Homo Sapiens
TLATGLHPE

SEQ ID NO: 717444 - protein, 9 aa, Homo Sapiens
WAQELEDII

SEQ ID NO: 717445 - protein, 9 aa, Homo Sapiens
RLFVILWLK

SEQ ID NO: 717446 - protein, 9 aa, Homo Sapiens
TATHKTVDG

SEQ ID NO: 717447 - protein, 9 aa, Homo Sapiens
REQLSYLES

SEQ ID NO: 717448 - protein, 9 aa, Homo Sapiens
AAQKERLDK

SEQ ID NO: 717449 - protein, 9 aa, Homo Sapiens
QDFRSLATY

SEQ ID NO: 717450 - protein, 9 aa, Homo Sapiens
RNYITLSGL

SEQ ID NO: 717451 - protein, 9 aa, Homo Sapiens
TISIGIIVF

SEQ ID NO: 717452 - protein, 9 aa, Homo Sapiens
RLSNRSRQE

SEQ ID NO: 717453 - protein, 9 aa, Homo Sapiens
TLKYECCAT

SEQ ID NO: 717454 - protein, 9 aa, Homo Sapiens
RLLEWKQKV

SEQ ID NO: 717455 - protein, 9 aa, Homo Sapiens
ITGMYVYYQ

SEQ ID NO: 717456 - protein, 9 aa, Homo Sapiens
EVFGLAISK

SEQ ID NO: 717457 - protein, 9 aa, Homo Sapiens
ANELRRKRP

SEQ ID NO: 717458 - protein, 9 aa, Homo Sapiens
CPCWEEKRP

SEQ ID NO: 717459 - protein, 9 aa, Homo Sapiens
AEAKKLEQH

SEQ ID NO: 717460 - protein, 9 aa, Homo Sapiens
QQPKRSLKK

SEQ ID NO: 717461 - protein, 9 aa, Homo Sapiens
SNGGQYETV

SEQ ID NO: 717462 - protein, 9 aa, Homo Sapiens
NSSSDWVTQ

SEQ ID NO: 717463 - protein, 9 aa, Homo Sapiens
RLELTGTSG

SEQ ID NO: 717464 - protein, 9 aa, Homo Sapiens
EAQEAQGIL

SEQ ID NO: 717465 - protein, 9 aa, Homo Sapiens
DIGTLRNSA

SEQ ID NO: 717466 - protein, 9 aa, Homo Sapiens
QIYNPKSVV

SEQ ID NO: 717467 - protein, 9 aa, Homo Sapiens
DPAVHPQSE

SEQ ID NO: 717468 - protein, 9 aa, Homo Sapiens
TTITAESLK

SEQ ID NO: 717469 - protein, 9 aa, Homo Sapiens
TGDQDYYYM

SEQ ID NO: 717470 - protein, 9 aa, Homo Sapiens
VLENSATAG

SEQ ID NO: 717471 - protein, 9 aa, Homo Sapiens
AHDGALTGV

SEQ ID NO: 717472 - protein, 9 aa, Homo Sapiens
DTLLAMSNP

SEQ ID NO: 717473 - protein, 9 aa, Homo Sapiens
PDPSAIKPE

SEQ ID NO: 717474 - protein, 9 aa, Homo Sapiens
YKCRPVYRS

SEQ ID NO: 717475 - protein, 9 aa, Homo Sapiens
NGATLKYEC

SEQ ID NO: 717476 - protein, 9 aa, Homo Sapiens
YDIAAHKCQ

SEQ ID NO: 717477 - protein, 9 aa, Homo Sapiens
SKTSQITTA

SEQ ID NO: 717478 - protein, 9 aa, Homo Sapiens
GAILLVLLP

SEQ ID NO: 717479 - protein, 9 aa, Homo Sapiens
SFMKMLSSK

SEQ ID NO: 717480 - protein, 9 aa, Homo Sapiens
GSDAEGDPE

SEQ ID NO: 717481 - protein, 9 aa, Homo Sapiens
IPVRAGDSW

SEQ ID NO: 717482 - protein, 9 aa, Homo Sapiens
NVLRIQCLR

SEQ ID NO: 717483 - protein, 9 aa, Homo Sapiens
ETCLPNGIN

SEQ ID NO: 717484 - protein, 9 aa, Homo Sapiens
HKVYAERIF

SEQ ID NO: 717485 - protein, 9 aa, Homo Sapiens
DGHLPRCCP

SEQ ID NO: 717486 - protein, 9 aa, Homo Sapiens
KMLSSKMGK

SEQ ID NO: 717487 - protein, 9 aa, Homo Sapiens
PSGSGRSTA

SEQ ID NO: 717488 - protein, 9 aa, Homo Sapiens
SKVPVEEIQ

SEQ ID NO: 717489 - protein, 9 aa, Homo Sapiens
ERTAPHKSK

SEQ ID NO: 717490 - protein, 9 aa, Homo Sapiens
DSGPNKNMK

SEQ ID NO: 717491 - protein, 9 aa, Homo Sapiens
TKQPTSATG

SEQ ID NO: 717492 - protein, 9 aa, Homo Sapiens
NGPEGCMLA

SEQ ID NO: 717493 - protein, 9 aa, Homo Sapiens
VSFQQWSTA

SEQ ID NO: 717494 - protein, 9 aa, Homo Sapiens
ECFFAAFYL

SEQ ID NO: 717495 - protein, 9 aa, Homo Sapiens
LLIALYGCI

SEQ ID NO: 717496 - protein, 9 aa, Homo Sapiens
QDEKQDRRR

SEQ ID NO: 717497 - protein, 9 aa, Homo Sapiens
LNSVLNSKA

SEQ ID NO: 717498 - protein, 9 aa, Homo Sapiens
PPAIAAYWA

SEQ ID NO: 717499 - protein, 9 aa, Homo Sapiens
LTHSRRPRP

SEQ ID NO: 717500 - protein, 9 aa, Homo Sapiens
LVHHHHPGH

SEQ ID NO: 717501 - protein, 9 aa, Homo Sapiens
FEDKVSFPL

SEQ ID NO: 717502 - protein, 9 aa, Homo Sapiens
LQTPMYFFI

SEQ ID NO: 717503 - protein, 9 aa, Homo Sapiens
GVTLDKITN

SEQ ID NO: 717504 - protein, 9 aa, Homo Sapiens
HTTSCDVWS

SEQ ID NO: 717505 - protein, 9 aa, Homo Sapiens
RYVAICNPR

SEQ ID NO: 717506 - protein, 9 aa, Homo Sapiens
ADAYSEGHD

SEQ ID NO: 717507 - protein, 9 aa, Homo Sapiens
QQSADRSRH

SEQ ID NO: 717508 - protein, 9 aa, Homo Sapiens
IVDCRGKGV

SEQ ID NO: 717509 - protein, 9 aa, Homo Sapiens
RPCERTVCQ

SEQ ID NO: 717510 - protein, 9 aa, Homo Sapiens
LANTLGPHE

SEQ ID NO: 717511 - protein, 9 aa, Homo Sapiens
WCWCFFTPL

SEQ ID NO: 717512 - protein, 9 aa, Homo Sapiens
YYRTGGNSW

SEQ ID NO: 717513 - protein, 9 aa, Homo Sapiens
GLFVQGLQK

SEQ ID NO: 717514 - protein, 9 aa, Homo Sapiens
VPIPLETRP

SEQ ID NO: 717515 - protein, 9 aa, Homo Sapiens
PPHPGCSLT

SEQ ID NO: 717516 - protein, 9 aa, Homo Sapiens
PKNERAQEA

SEQ ID NO: 717517 - protein, 9 aa, Homo Sapiens
HRNLRGSCN

SEQ ID NO: 717518 - protein, 9 aa, Homo Sapiens
FKCGIAVPP

SEQ ID NO: 717519 - protein, 9 aa, Homo Sapiens
LFSPLSGLS

SEQ ID NO: 717520 - protein, 9 aa, Homo Sapiens
RIHKLLNGT

SEQ ID NO: 717521 - protein, 9 aa, Homo Sapiens
NIPLNASSC

SEQ ID NO: 717522 - protein, 9 aa, Homo Sapiens
EWKVKFPEL

SEQ ID NO: 717523 - protein, 9 aa, Homo Sapiens
HKSLKEAHI

SEQ ID NO: 717524 - protein, 9 aa, Homo Sapiens
EFELQLCLI

SEQ ID NO: 717525 - protein, 9 aa, Homo Sapiens
QELEPQVGE

SEQ ID NO: 717526 - protein, 9 aa, Homo Sapiens
HRFIRHPSK

SEQ ID NO: 717527 - protein, 9 aa, Homo Sapiens
GKKPPSGSG

SEQ ID NO: 717528 - protein, 9 aa, Homo Sapiens
IDVGLSTAT

SEQ ID NO: 717529 - protein, 9 aa, Homo Sapiens
KQSIGQFQE

SEQ ID NO: 717530 - protein, 9 aa, Homo Sapiens
PPPGKSQGP

SEQ ID NO: 717531 - protein, 9 aa, Homo Sapiens
FLHITFECF

SEQ ID NO: 717532 - protein, 9 aa, Homo Sapiens
KQVMCPQDF

SEQ ID NO: 717533 - protein, 9 aa, Homo Sapiens
QRLSGGAAA

SEQ ID NO: 717534 - protein, 9 aa, Homo Sapiens
QAVEEPSIW

SEQ ID NO: 717535 - protein, 9 aa, Homo Sapiens
EFLHITFEC

SEQ ID NO: 717536 - protein, 9 aa, Homo Sapiens
SAMQRNIRL

SEQ ID NO: 717537 - protein, 9 aa, Homo Sapiens
RKKKKDTLM

SEQ ID NO: 717538 - protein, 9 aa, Homo Sapiens
AQELEDIIM

SEQ ID NO: 717539 - protein, 9 aa, Homo Sapiens
ANTLGPHEM

SEQ ID NO: 717540 - protein, 9 aa, Homo Sapiens
DKNMSSLST

SEQ ID NO: 717541 - protein, 9 aa, Homo Sapiens
CVWVSSIRH

SEQ ID NO: 717542 - protein, 9 aa, Homo Sapiens
YMNSICNPV

SEQ ID NO: 717543 - protein, 9 aa, Homo Sapiens
ESKVPVEEI

SEQ ID NO: 717544 - protein, 9 aa, Homo Sapiens
GLQKDSTGS

SEQ ID NO: 717545 - protein, 9 aa, Homo Sapiens
QSPTSPLHI

SEQ ID NO: 717546 - protein, 9 aa, Homo Sapiens
GVPRQQIPQ

SEQ ID NO: 717547 - protein, 9 aa, Homo Sapiens
VLYVALRRK

SEQ ID NO: 717548 - protein, 9 aa, Homo Sapiens
ERLSPGAIL

SEQ ID NO: 717549 - protein, 9 aa, Homo Sapiens
PLNASSCEA

SEQ ID NO: 717550 - protein, 9 aa, Homo Sapiens
FSPLSGLSL

SEQ ID NO: 717551 - protein, 9 aa, Homo Sapiens
EKDGKRLPS

SEQ ID NO: 717552 - protein, 9 aa, Homo Sapiens
NLPEIPSHC

SEQ ID NO: 717553 - protein, 9 aa, Homo Sapiens
CIYVEARSR

SEQ ID NO: 717554 - protein, 9 aa, Homo Sapiens
SLSTWLAHI

SEQ ID NO: 717555 - protein, 9 aa, Homo Sapiens
SIKDSYQKG

SEQ ID NO: 717556 - protein, 9 aa, Homo Sapiens
PHNFLYKHG

SEQ ID NO: 717557 - protein, 9 aa, Homo Sapiens
SIVVLFITL

SEQ ID NO: 717558 - protein, 9 aa, Homo Sapiens
EKCGKAFTY

SEQ ID NO: 717559 - protein, 9 aa, Homo Sapiens
QDIADLIKR

SEQ ID NO: 717560 - protein, 9 aa, Homo Sapiens
QVETVPTAR

SEQ ID NO: 717561 - protein, 9 aa, Homo Sapiens
GKQVMCPQD

SEQ ID NO: 717562 - protein, 9 aa, Homo Sapiens
FLGTGECYL

SEQ ID NO: 717563 - protein, 9 aa, Homo Sapiens
GTDALLLGF

SEQ ID NO: 717564 - protein, 9 aa, Homo Sapiens
ACISIPFCF

SEQ ID NO: 717565 - protein, 9 aa, Homo Sapiens
QIKDSEIRQ

SEQ ID NO: 717566 - protein, 9 aa, Homo Sapiens
GDYLELNIH

SEQ ID NO: 717567 - protein, 9 aa, Homo Sapiens
TKDLIVMGS

SEQ ID NO: 717568 - protein, 9 aa, Homo Sapiens
KNMKKKKTD

SEQ ID NO: 717569 - protein, 9 aa, Homo Sapiens
PLFCSILTK

SEQ ID NO: 717570 - protein, 9 aa, Homo Sapiens
QEGDAYVVK

SEQ ID NO: 717571 - protein, 9 aa, Homo Sapiens
WKQKVEKKG

SEQ ID NO: 717572 - protein, 9 aa, Homo Sapiens
QHQKGQSKQ

SEQ ID NO: 717573 - protein, 9 aa, Homo Sapiens
PAEIVAFQI

SEQ ID NO: 717574 - protein, 9 aa, Homo Sapiens
PFMIMTLLT

SEQ ID NO: 717575 - protein, 9 aa, Homo Sapiens
EHLSKRDKL

SEQ ID NO: 717576 - protein, 9 aa, Homo Sapiens
ICEDIPEKN

SEQ ID NO: 717577 - protein, 9 aa, Homo Sapiens
LQSPTSPLH

SEQ ID NO: 717578 - protein, 9 aa, Homo Sapiens
EIPSHCEIP

SEQ ID NO: 717579 - protein, 9 aa, Homo Sapiens
GDPAVHPQS

SEQ ID NO: 717580 - protein, 9 aa, Homo Sapiens
VTPGYQDST

SEQ ID NO: 717581 - protein, 9 aa, Homo Sapiens
ETDPVLVHC

SEQ ID NO: 717582 - protein, 9 aa, Homo Sapiens
TCSCHMSVV

SEQ ID NO: 717583 - protein, 9 aa, Homo Sapiens
FYLGHLREV

SEQ ID NO: 717584 - protein, 9 aa, Homo Sapiens
FDIGTLRNS

SEQ ID NO: 717585 - protein, 9 aa, Homo Sapiens
DITASSHWS

SEQ ID NO: 717586 - protein, 9 aa, Homo Sapiens
YPAYSKDSG

SEQ ID NO: 717587 - protein, 9 aa, Homo Sapiens
AKSKTFDFI

SEQ ID NO: 717588 - protein, 9 aa, Homo Sapiens
FMIMTLLTM

SEQ ID NO: 717589 - protein, 9 aa, Homo Sapiens
SMPDAIRRA

SEQ ID NO: 717590 - protein, 9 aa, Homo Sapiens
DVNDHATEV

SEQ ID NO: 717591 - protein, 9 aa, Homo Sapiens
GQYNDDHDD

SEQ ID NO: 717592 - protein, 9 aa, Homo Sapiens
VHHHHPGHV

SEQ ID NO: 717593 - protein, 9 aa, Homo Sapiens
NEIKQYFES

SEQ ID NO: 717594 - protein, 9 aa, Homo Sapiens
TQGRNSSSD

SEQ ID NO: 717595 - protein, 9 aa, Homo Sapiens
CLPGWSRTP

SEQ ID NO: 717596 - protein, 9 aa, Homo Sapiens
TCFSNWSAA

SEQ ID NO: 717597 - protein, 9 aa, Homo Sapiens
KFRRPRDGH

SEQ ID NO: 717598 - protein, 9 aa, Homo Sapiens
PRNIPLNAS

SEQ ID NO: 717599 - protein, 9 aa, Homo Sapiens
IPFLDHKVY

SEQ ID NO: 717600 - protein, 9 aa, Homo Sapiens
MIMTLLTMQ

SEQ ID NO: 717601 - protein, 9 aa, Homo Sapiens
TNQKDETFN

SEQ ID NO: 717602 - protein, 9 aa, Homo Sapiens
GIPFLDHKV

SEQ ID NO: 717603 - protein, 9 aa, Homo Sapiens
AESLKPASV

SEQ ID NO: 717604 - protein, 9 aa, Homo Sapiens
NIHQGKIGV

SEQ ID NO: 717605 - protein, 9 aa, Homo Sapiens
LKLTLSRSP

SEQ ID NO: 717606 - protein, 9 aa, Homo Sapiens
ASSAFLVPR

SEQ ID NO: 717607 - protein, 9 aa, Homo Sapiens
SKSKLGFRI

SEQ ID NO: 717608 - protein, 9 aa, Homo Sapiens
DTPTNTKQQ

SEQ ID NO: 717609 - protein, 9 aa, Homo Sapiens
KAQVANKTA

SEQ ID NO: 717610 - protein, 9 aa, Homo Sapiens
PNGEGMFAS

SEQ ID NO: 717611 - protein, 9 aa, Homo Sapiens
GGCLDNISG

SEQ ID NO: 717612 - protein, 9 aa, Homo Sapiens
RYRDSLTQQ

SEQ ID NO: 717613 - protein, 9 aa, Homo Sapiens
ATSQFYTTS

SEQ ID NO: 717614 - protein, 9 aa, Homo Sapiens
GWNGLLVFK

SEQ ID NO: 717615 - protein, 9 aa, Homo Sapiens
SFPGLALEP

SEQ ID NO: 717616 - protein, 9 aa, Homo Sapiens
LEIRNMSWS

SEQ ID NO: 717617 - protein, 9 aa, Homo Sapiens
HKSKTGFPK

SEQ ID NO: 717618 - protein, 9 aa, Homo Sapiens
SPGAILLVL

SEQ ID NO: 717619 - protein, 9 aa, Homo Sapiens
GQLNETVFT

SEQ ID NO: 717620 - protein, 9 aa, Homo Sapiens
RLPRKEENQ

SEQ ID NO: 717621 - protein, 9 aa, Homo Sapiens
GLQNYESLL

SEQ ID NO: 717622 - protein, 9 aa, Homo Sapiens
LITDTINEP

SEQ ID NO: 717623 - protein, 9 aa, Homo Sapiens
AQYFQYRKL

SEQ ID NO: 717624 - protein, 9 aa, Homo Sapiens
RIYSLLMGS

SEQ ID NO: 717625 - protein, 9 aa, Homo Sapiens
ADMEKDGKR

SEQ ID NO: 717626 - protein, 9 aa, Homo Sapiens
PGCSLTPGH

SEQ ID NO: 717627 - protein, 9 aa, Homo Sapiens
YENIRAVAT

SEQ ID NO: 717628 - protein, 9 aa, Homo Sapiens
QEWRQQAVC

SEQ ID NO: 717629 - protein, 9 aa, Homo Sapiens
PPGKPSALE

SEQ ID NO: 717630 - protein, 9 aa, Homo Sapiens
DDLQLPAEI

SEQ ID NO: 717631 - protein, 9 aa, Homo Sapiens
KKLSVLYHR

SEQ ID NO: 717632 - protein, 9 aa, Homo Sapiens
TNQLLLFPL

SEQ ID NO: 717633 - protein, 9 aa, Homo Sapiens
LQAEAKKLE

SEQ ID NO: 717634 - protein, 9 aa, Homo Sapiens
RNLTCLCIA

SEQ ID NO: 717635 - protein, 9 aa, Homo Sapiens
NRIHKLLNG

SEQ ID NO: 717636 - protein, 9 aa, Homo Sapiens
NAHMETPPA

SEQ ID NO: 717637 - protein, 9 aa, Homo Sapiens
SEDDHGDES

SEQ ID NO: 717638 - protein, 9 aa, Homo Sapiens
DRVQEEEQK

SEQ ID NO: 717639 - protein, 9 aa, Homo Sapiens
PWCPCWEEK

SEQ ID NO: 717640 - protein, 9 aa, Homo Sapiens
PAYSKDSGL

SEQ ID NO: 717641 - protein, 9 aa, Homo Sapiens
LLAAASWVI

SEQ ID NO: 717642 - protein, 9 aa, Homo Sapiens
WITARRIDR

SEQ ID NO: 717643 - protein, 9 aa, Homo Sapiens
TVSRSRSGS

SEQ ID NO: 717644 - protein, 9 aa, Homo Sapiens
RVQGLLITA

SEQ ID NO: 717645 - protein, 9 aa, Homo Sapiens
DYSAFYLGH

SEQ ID NO: 717646 - protein, 9 aa, Homo Sapiens
FPFPEAGPW

SEQ ID NO: 717647 - protein, 9 aa, Homo Sapiens
ITAESLKPA

SEQ ID NO: 717648 - protein, 9 aa, Homo Sapiens
SIPFMIMTL

SEQ ID NO: 717649 - protein, 9 aa, Homo Sapiens
VKEALVTYK

SEQ ID NO: 717650 - protein, 9 aa, Homo Sapiens
VKYPSCTRK

SEQ ID NO: 717651 - protein, 9 aa, Homo Sapiens
LGWNGLLVF

SEQ ID NO: 717652 - protein, 9 aa, Homo Sapiens
LCHATNQLL

SEQ ID NO: 717653 - protein, 9 aa, Homo Sapiens
GKPRPGRVI

SEQ ID NO: 717654 - protein, 9 aa, Homo Sapiens
ESLLGLTNL

SEQ ID NO: 717655 - protein, 9 aa, Homo Sapiens
SPEGPLILS

SEQ ID NO: 717656 - protein, 9 aa, Homo Sapiens
GLAISKVGL

SEQ ID NO: 717657 - protein, 9 aa, Homo Sapiens
GGKGQTGEG

SEQ ID NO: 717658 - protein, 9 aa, Homo Sapiens
KVGSVVQFH

SEQ ID NO: 717659 - protein, 9 aa, Homo Sapiens
CHSDIVCPQ

SEQ ID NO: 717660 - protein, 9 aa, Homo Sapiens
LDGKQVMCP

SEQ ID NO: 717661 - protein, 9 aa, Homo Sapiens
LRIQCLRRK

SEQ ID NO: 717662 - protein, 9 aa, Homo Sapiens
EEITSGGFF

SEQ ID NO: 717663 - protein, 9 aa, Homo Sapiens
SLKPASVYV

SEQ ID NO: 717664 - protein, 9 aa, Homo Sapiens
QNQIKDSEI

SEQ ID NO: 717665 - protein, 9 aa, Homo Sapiens
PSSATWATA

SEQ ID NO: 717666 - protein, 9 aa, Homo Sapiens
IFCIIGIIT

SEQ ID NO: 717667 - protein, 9 aa, Homo Sapiens
TEKVLEDTK

SEQ ID NO: 717668 - protein, 9 aa, Homo Sapiens
RKFRRPRDG

SEQ ID NO: 717669 - protein, 9 aa, Homo Sapiens
ERVNETLVR

SEQ ID NO: 717670 - protein, 9 aa, Homo Sapiens
RSAFVEVKN

SEQ ID NO: 717671 - protein, 9 aa, Homo Sapiens
DIAAHKCQK

SEQ ID NO: 717672 - protein, 9 aa, Homo Sapiens
YSMPDAIRR

SEQ ID NO: 717673 - protein, 9 aa, Homo Sapiens
LELEEVQSG

SEQ ID NO: 717674 - protein, 9 aa, Homo Sapiens
HDDDDGDDP

SEQ ID NO: 717675 - protein, 9 aa, Homo Sapiens
TFECFFAAF

SEQ ID NO: 717676 - protein, 9 aa, Homo Sapiens
MKWCWCFFT

SEQ ID NO: 717677 - protein, 9 aa, Homo Sapiens
DKDYSAFYL

SEQ ID NO: 717678 - protein, 9 aa, Homo Sapiens
PVGEQNDLE

SEQ ID NO: 717679 - protein, 9 aa, Homo Sapiens
EARESARRL

SEQ ID NO: 717680 - protein, 9 aa, Homo Sapiens
MVRCHQRNC

SEQ ID NO: 717681 - protein, 9 aa, Homo Sapiens
SKLVAAAQK

SEQ ID NO: 717682 - protein, 9 aa, Homo Sapiens
RRRKKSFQG

SEQ ID NO: 717683 - protein, 9 aa, Homo Sapiens
PFSQRLFVI

SEQ ID NO: 717684 - protein, 9 aa, Homo Sapiens
QQWSTAKSA

SEQ ID NO: 717685 - protein, 9 aa, Homo Sapiens
QAIYKCRPV

SEQ ID NO: 717686 - protein, 9 aa, Homo Sapiens
MSVVVLFYG

SEQ ID NO: 717687 - protein, 9 aa, Homo Sapiens
ANGSPSSPS

SEQ ID NO: 717688 - protein, 9 aa, Homo Sapiens
GQLNADLQK

SEQ ID NO: 717689 - protein, 9 aa, Homo Sapiens
AGHWASKSG

SEQ ID NO: 717690 - protein, 9 aa, Homo Sapiens
EMLGVPRQQ

SEQ ID NO: 717691 - protein, 9 aa, Homo Sapiens
TSATGQNKI

SEQ ID NO: 717692 - protein, 9 aa, Homo Sapiens
EELERMAHD

SEQ ID NO: 717693 - protein, 9 aa, Homo Sapiens
IGQFQEGDA

SEQ ID NO: 717694 - protein, 9 aa, Homo Sapiens
VDCRGKGVT

SEQ ID NO: 717695 - protein, 9 aa, Homo Sapiens
HPGCSLTPG

SEQ ID NO: 717696 - protein, 9 aa, Homo Sapiens
KWEKLSYMC

SEQ ID NO: 717697 - protein, 9 aa, Homo Sapiens
SKITEQEKD

SEQ ID NO: 717698 - protein, 9 aa, Homo Sapiens
DIVCPQTDK

SEQ ID NO: 717699 - protein, 9 aa, Homo Sapiens
QSGSGHLEL

SEQ ID NO: 717700 - protein, 9 aa, Homo Sapiens
SLKSHLTVH

SEQ ID NO: 717701 - protein, 9 aa, Homo Sapiens
WIDGGGGVS

SEQ ID NO: 717702 - protein, 9 aa, Homo Sapiens
CREGWKGNR

SEQ ID NO: 717703 - protein, 9 aa, Homo Sapiens
RTVCQSESS

SEQ ID NO: 717704 - protein, 9 aa, Homo Sapiens
TDKDYSAFY

SEQ ID NO: 717705 - protein, 9 aa, Homo Sapiens
FLEKYSAVK

SEQ ID NO: 717706 - protein, 9 aa, Homo Sapiens
NYITLSGLE

SEQ ID NO: 717707 - protein, 9 aa, Homo Sapiens
VHPIVRVVM

SEQ ID NO: 717708 - protein, 9 aa, Homo Sapiens
QSITVESRG

SEQ ID NO: 717709 - protein, 9 aa, Homo Sapiens
QGPPPPGKS

SEQ ID NO: 717710 - protein, 9 aa, Homo Sapiens
EYYWGQLNE

SEQ ID NO: 717711 - protein, 9 aa, Homo Sapiens
EAEHLSKRD

SEQ ID NO: 717712 - protein, 9 aa, Homo Sapiens
LHACISIPF

SEQ ID NO: 717713 - protein, 9 aa, Homo Sapiens
LPHLLFSPL

SEQ ID NO: 717714 - protein, 9 aa, Homo Sapiens
CWCFFTPLV

SEQ ID NO: 717715 - protein, 9 aa, Homo Sapiens
PLSKITEQE

SEQ ID NO: 717716 - protein, 9 aa, Homo Sapiens
HQLLVLALE

SEQ ID NO: 717717 - protein, 9 aa, Homo Sapiens
EVSLTSQQV

SEQ ID NO: 717718 - protein, 9 aa, Homo Sapiens
RNIYSSILP

SEQ ID NO: 717719 - protein, 9 aa, Homo Sapiens
SGSGRSTAT

SEQ ID NO: 717720 - protein, 9 aa, Homo Sapiens
FECFFAAFY

SEQ ID NO: 717721 - protein, 9 aa, Homo Sapiens
VGEQNDLER

SEQ ID NO: 717722 - protein, 9 aa, Homo Sapiens
CQIHRMDDI

SEQ ID NO: 717723 - protein, 9 aa, Homo Sapiens
SSKSKLGFR

SEQ ID NO: 717724 - protein, 9 aa, Homo Sapiens
LSLLSSRYA

SEQ ID NO: 717725 - protein, 9 aa, Homo Sapiens
GINTAVYHP

SEQ ID NO: 717726 - protein, 9 aa, Homo Sapiens
NDHATEVTM

SEQ ID NO: 717727 - protein, 9 aa, Homo Sapiens
CPYCGKAFC

SEQ ID NO: 717728 - protein, 9 aa, Homo Sapiens
HMETPPAIA

SEQ ID NO: 717729 - protein, 9 aa, Homo Sapiens
FFGGNPRSY

SEQ ID NO: 717730 - protein, 9 aa, Homo Sapiens
LLSVLVVSV

SEQ ID NO: 717731 - protein, 9 aa, Homo Sapiens
SCTRKESKG

SEQ ID NO: 717732 - protein, 9 aa, Homo Sapiens
KLKKGTNQK

SEQ ID NO: 717733 - protein, 9 aa, Homo Sapiens
LQLPAEIVA

SEQ ID NO: 717734 - protein, 9 aa, Homo Sapiens
CDVWSFGIL

SEQ ID NO: 717735 - protein, 9 aa, Homo Sapiens
VLADLGVTL

SEQ ID NO: 717736 - protein, 9 aa, Homo Sapiens
LYGCIYVEA

SEQ ID NO: 717737 - protein, 9 aa, Homo Sapiens
KGILRKFEK

SEQ ID NO: 717738 - protein, 9 aa, Homo Sapiens
LVREVIFLG

SEQ ID NO: 717739 - protein, 9 aa, Homo Sapiens
VRAGDSWTL

SEQ ID NO: 717740 - protein, 9 aa, Homo Sapiens
TLNSVLNSK

SEQ ID NO: 717741 - protein, 9 aa, Homo Sapiens
SSREWKVKF

SEQ ID NO: 717742 - protein, 9 aa, Homo Sapiens
MSTNTCQVV

SEQ ID NO: 717743 - protein, 9 aa, Homo Sapiens
EAESKVPVE

SEQ ID NO: 717744 - protein, 9 aa, Homo Sapiens
KLTWKDCFP

SEQ ID NO: 717745 - protein, 9 aa, Homo Sapiens
SSGASDAAY

SEQ ID NO: 717746 - protein, 9 aa, Homo Sapiens
DKLSGKEES

SEQ ID NO: 717747 - protein, 9 aa, Homo Sapiens
SQSIPFMIM

SEQ ID NO: 717748 - protein, 9 aa, Homo Sapiens
PLTHSRRPR

SEQ ID NO: 717749 - protein, 9 aa, Homo Sapiens
GSVEGRRKA

SEQ ID NO: 717750 - protein, 9 aa, Homo Sapiens
SICNPVPWE

SEQ ID NO: 717751 - protein, 9 aa, Homo Sapiens
DAYSEGHDS

SEQ ID NO: 717752 - protein, 9 aa, Homo Sapiens
GECYLLSSM

SEQ ID NO: 717753 - protein, 9 aa, Homo Sapiens
HQLRCNGVP

SEQ ID NO: 717754 - protein, 9 aa, Homo Sapiens
AFVEVKNAA

SEQ ID NO: 717755 - protein, 9 aa, Homo Sapiens
QPPKVSQGK

SEQ ID NO: 717756 - protein, 9 aa, Homo Sapiens
KVLWRFDGS

SEQ ID NO: 717757 - protein, 9 aa, Homo Sapiens
GKCGKSFRQ

SEQ ID NO: 717758 - protein, 9 aa, Homo Sapiens
PYVPLFCSI

SEQ ID NO: 717759 - protein, 9 aa, Homo Sapiens
KKKKYLMAA

SEQ ID NO: 717760 - protein, 9 aa, Homo Sapiens
VLILLSYVS

SEQ ID NO: 717761 - protein, 9 aa, Homo Sapiens
VMGSPGSSY

SEQ ID NO: 717762 - protein, 9 aa, Homo Sapiens
DSYVAICHP

SEQ ID NO: 717763 - protein, 9 aa, Homo Sapiens
PNVEQFLQQ

SEQ ID NO: 717764 - protein, 9 aa, Homo Sapiens
NRGEVKYPS

SEQ ID NO: 717765 - protein, 9 aa, Homo Sapiens
GKSQGPPPQ

SEQ ID NO: 717766 - protein, 9 aa, Homo Sapiens
YIKIPVRAG

SEQ ID NO: 717767 - protein, 9 aa, Homo Sapiens
EGHDSSSQS

SEQ ID NO: 717768 - protein, 9 aa, Homo Sapiens
KLNLDMFKN

SEQ ID NO: 717769 - protein, 9 aa, Homo Sapiens
RELTMDMPK

SEQ ID NO: 717770 - protein, 9 aa, Homo Sapiens
KETTITAES

SEQ ID NO: 717771 - protein, 9 aa, Homo Sapiens
EEVFGLAIS

SEQ ID NO: 717772 - protein, 9 aa, Homo Sapiens
FSVMLQSPT

SEQ ID NO: 717773 - protein, 9 aa, Homo Sapiens
IICGWDKRG

SEQ ID NO: 717774 - protein, 9 aa, Homo Sapiens
VEDFLGPED

SEQ ID NO: 717775 - protein, 9 aa, Homo Sapiens
TTSCDVWSF

SEQ ID NO: 717776 - protein, 9 aa, Homo Sapiens
EMKTFIPPK

SEQ ID NO: 717777 - protein, 9 aa, Homo Sapiens
KQVPIPLET

SEQ ID NO: 717778 - protein, 9 aa, Homo Sapiens
HCPEVKLKM

SEQ ID NO: 717779 - protein, 9 aa, Homo Sapiens
QLLLFPLFN

SEQ ID NO: 717780 - protein, 9 aa, Homo Sapiens
PPSCHSDIV

SEQ ID NO: 717781 - protein, 9 aa, Homo Sapiens
CLICKACGH

SEQ ID NO: 717782 - protein, 9 aa, Homo Sapiens
VYGDPAVHP

SEQ ID NO: 717783 - protein, 9 aa, Homo Sapiens
EAIHLYLIV

SEQ ID NO: 717784 - protein, 9 aa, Homo Sapiens
MTSRLNLCG

SEQ ID NO: 717785 - protein, 9 aa, Homo Sapiens
IMTLLTMQT

SEQ ID NO: 717786 - protein, 9 aa, Homo Sapiens
YTTSERLHP

SEQ ID NO: 717787 - protein, 9 aa, Homo Sapiens
IVVGWQLKN

SEQ ID NO: 717788 - protein, 9 aa, Homo Sapiens
AIVSNGGQY

SEQ ID NO: 717789 - protein, 9 aa, Homo Sapiens
KKGTNQKDE

SEQ ID NO: 717790 - protein, 9 aa, Homo Sapiens
NKVFSDALG

SEQ ID NO: 717791 - protein, 9 aa, Homo Sapiens
NDTDMRWNK

SEQ ID NO: 717792 - protein, 9 aa, Homo Sapiens
CIIGIITRF

SEQ ID NO: 717793 - protein, 9 aa, Homo Sapiens
SHHQQSADR

SEQ ID NO: 717794 - protein, 9 aa, Homo Sapiens
KEEAQEAQG

SEQ ID NO: 717795 - protein, 9 aa, Homo Sapiens
EGGRTLSDY

SEQ ID NO: 717796 - protein, 9 aa, Homo Sapiens
KCGIAVPPV

SEQ ID NO: 717797 - protein, 9 aa, Homo Sapiens
KGVTEIPTN

SEQ ID NO: 717798 - protein, 9 aa, Homo Sapiens
SLLSVLVVS

SEQ ID NO: 717799 - protein, 9 aa, Homo Sapiens
SVGYLGLSL

SEQ ID NO: 717800 - protein, 9 aa, Homo Sapiens
GILRQFLIV

SEQ ID NO: 717801 - protein, 9 aa, Homo Sapiens
ILTKLGCGL

SEQ ID NO: 717802 - protein, 9 aa, Homo Sapiens
LSSKMGKCC

SEQ ID NO: 717803 - protein, 9 aa, Homo Sapiens
LLTSSSREW

SEQ ID NO: 717804 - protein, 9 aa, Homo Sapiens
DTDWYRGDC

SEQ ID NO: 717805 - protein, 9 aa, Homo Sapiens
TDWYRGDCR

SEQ ID NO: 717806 - protein, 9 aa, Homo Sapiens
PCLILAAKS

SEQ ID NO: 717807 - protein, 9 aa, Homo Sapiens
AGKQLEGGR

SEQ ID NO: 717808 - protein, 9 aa, Homo Sapiens
LLAVMSYDS

SEQ ID NO: 717809 - protein, 9 aa, Homo Sapiens
LPEMLGVPR

SEQ ID NO: 717810 - protein, 9 aa, Homo Sapiens
WTIRLPRKE

SEQ ID NO: 717811 - protein, 9 aa, Homo Sapiens
KEALVTYKS

SEQ ID NO: 717812 - protein, 9 aa, Homo Sapiens
LTQQDEEPM

SEQ ID NO: 717813 - protein, 9 aa, Homo Sapiens
GPNKNMKKK

SEQ ID NO: 717814 - protein, 9 aa, Homo Sapiens
IPKGSALYS

SEQ ID NO: 717815 - protein, 9 aa, Homo Sapiens
HYGPQTLYL

SEQ ID NO: 717816 - protein, 9 aa, Homo Sapiens
KDVNDNPPH

SEQ ID NO: 717817 - protein, 9 aa, Homo Sapiens
SFWPGGYPA

SEQ ID NO: 717818 - protein, 9 aa, Homo Sapiens
EWKQKVEKK

SEQ ID NO: 717819 - protein, 9 aa, Homo Sapiens
DGQRLSGGA

SEQ ID NO: 717820 - protein, 9 aa, Homo Sapiens
MGSPGSSYW

SEQ ID NO: 717821 - protein, 9 aa, Homo Sapiens
QWSTAKSAT

SEQ ID NO: 717822 - protein, 9 aa, Homo Sapiens
ERDNQHHDE

SEQ ID NO: 717823 - protein, 9 aa, Homo Sapiens
TSGGFFGGN

SEQ ID NO: 717824 - protein, 9 aa, Homo Sapiens
EAMPRHPGN

SEQ ID NO: 717825 - protein, 9 aa, Homo Sapiens
LPAEIVAFQ

SEQ ID NO: 717826 - protein, 9 aa, Homo Sapiens
FVILWLKGV

SEQ ID NO: 717827 - protein, 9 aa, Homo Sapiens
GKPSALEPA

SEQ ID NO: 717828 - protein, 9 aa, Homo Sapiens
KLSGKEESF

SEQ ID NO: 717829 - protein, 9 aa, Homo Sapiens
KAKSKTFDF

SEQ ID NO: 717830 - protein, 9 aa, Homo Sapiens
LMQTPVQGG

SEQ ID NO: 717831 - protein, 9 aa, Homo Sapiens
GILRKFEKC

SEQ ID NO: 717832 - protein, 9 aa, Homo Sapiens
KEESFTSLE

SEQ ID NO: 717833 - protein, 9 aa, Homo Sapiens
NQKDETFNL

SEQ ID NO: 717834 - protein, 9 aa, Homo Sapiens
THKTVDGPS

SEQ ID NO: 717835 - protein, 9 aa, Homo Sapiens
SRLIRKLRC

SEQ ID NO: 717836 - protein, 9 aa, Homo Sapiens
RPKKRQIYN

SEQ ID NO: 717837 - protein, 9 aa, Homo Sapiens
SWSQLLTGR

SEQ ID NO: 717838 - protein, 9 aa, Homo Sapiens
RQHEAKLHE

SEQ ID NO: 717839 - protein, 9 aa, Homo Sapiens
IDVKKFTIS

SEQ ID NO: 717840 - protein, 9 aa, Homo Sapiens
ARESARRLL

SEQ ID NO: 717841 - protein, 9 aa, Homo Sapiens
YMCGTICDI

SEQ ID NO: 717842 - protein, 9 aa, Homo Sapiens
CIFLVALLV

SEQ ID NO: 717843 - protein, 9 aa, Homo Sapiens
IKQYFESKL

SEQ ID NO: 717844 - protein, 9 aa, Homo Sapiens
CLKSGQVYS

SEQ ID NO: 717845 - protein, 9 aa, Homo Sapiens
PHKSKTGFP

SEQ ID NO: 717846 - protein, 9 aa, Homo Sapiens
LTMPHRNLR

SEQ ID NO: 717847 - protein, 9 aa, Homo Sapiens
EVLALEVSL

SEQ ID NO: 717848 - protein, 9 aa, Homo Sapiens
TFLEKYSAV

SEQ ID NO: 717849 - protein, 9 aa, Homo Sapiens
HQNTVKESQ

SEQ ID NO: 717850 - protein, 9 aa, Homo Sapiens
DHSGEKPNA

SEQ ID NO: 717851 - protein, 9 aa, Homo Sapiens
IAVPPVSSW

SEQ ID NO: 717852 - protein, 9 aa, Homo Sapiens
PQVGEQLLQ

SEQ ID NO: 717853 - protein, 9 aa, Homo Sapiens
NGYPVGEQN

SEQ ID NO: 717854 - protein, 9 aa, Homo Sapiens
CSILTKLGC

SEQ ID NO: 717855 - protein, 9 aa, Homo Sapiens
ELERMAHDG

SEQ ID NO: 717856 - protein, 9 aa, Homo Sapiens
KKPPSGSGR

SEQ ID NO: 717857 - protein, 9 aa, Homo Sapiens
SSKLVAAAQ

SEQ ID NO: 717858 - protein, 9 aa, Homo Sapiens
VHAITATHK

SEQ ID NO: 717859 - protein, 9 aa, Homo Sapiens
TITAESLKP

SEQ ID NO: 717860 - protein, 9 aa, Homo Sapiens
DGKRLPSPA

SEQ ID NO: 717861 - protein, 9 aa, Homo Sapiens
HITFECFFA

SEQ ID NO: 717862 - protein, 9 aa, Homo Sapiens
SPQSILSKC

SEQ ID NO: 717863 - protein, 9 aa, Homo Sapiens
FLDTIISLC

SEQ ID NO: 717864 - protein, 9 aa, Homo Sapiens
VLEDTKLLS

SEQ ID NO: 717865 - protein, 9 aa, Homo Sapiens
FSTNHQYTT

SEQ ID NO: 717866 - protein, 9 aa, Homo Sapiens
ESLKPASVY

SEQ ID NO: 717867 - protein, 9 aa, Homo Sapiens
SLTQQDEEP

SEQ ID NO: 717868 - protein, 9 aa, Homo Sapiens
KLEKFKIEC

SEQ ID NO: 717869 - protein, 9 aa, Homo Sapiens
LWNSTFLEK

SEQ ID NO: 717870 - protein, 9 aa, Homo Sapiens
PICTPSWSQ

SEQ ID NO: 717871 - protein, 9 aa, Homo Sapiens
GENQRLWGE

SEQ ID NO: 717872 - protein, 9 aa, Homo Sapiens
RSRFKEQLT

SEQ ID NO: 717873 - protein, 9 aa, Homo Sapiens
LDKITNSGQ

SEQ ID NO: 717874 - protein, 9 aa, Homo Sapiens
RHPGNRWLR

SEQ ID NO: 717875 - protein, 9 aa, Homo Sapiens
GGYAFLKLT

SEQ ID NO: 717876 - protein, 9 aa, Homo Sapiens
DLIVMGSPG

SEQ ID NO: 717877 - protein, 9 aa, Homo Sapiens
ICTPSWSQL

SEQ ID NO: 717878 - protein, 9 aa, Homo Sapiens
SGSGHLELE

SEQ ID NO: 717879 - protein, 9 aa, Homo Sapiens
PWMKWCWCF

SEQ ID NO: 717880 - protein, 9 aa, Homo Sapiens
QSDNIYRAD

SEQ ID NO: 717881 - protein, 9 aa, Homo Sapiens
GYPAYSKDS

SEQ ID NO: 717882 - protein, 9 aa, Homo Sapiens
QRNIRLVHL

SEQ ID NO: 717883 - protein, 9 aa, Homo Sapiens
LGPHEMGAL

SEQ ID NO: 717884 - protein, 9 aa, Homo Sapiens
HHDEAEGDP

SEQ ID NO: 717885 - protein, 9 aa, Homo Sapiens
ATVPICEDI

SEQ ID NO: 717886 - protein, 9 aa, Homo Sapiens
AESKVPVEE

SEQ ID NO: 717887 - protein, 9 aa, Homo Sapiens
RCREGWKGN

SEQ ID NO: 717888 - protein, 9 aa, Homo Sapiens
VNGYPVGEQ

SEQ ID NO: 717889 - protein, 9 aa, Homo Sapiens
HMGFPENQT

SEQ ID NO: 717890 - protein, 9 aa, Homo Sapiens
NTAVYHPGH

SEQ ID NO: 717891 - protein, 9 aa, Homo Sapiens
GQELEPQVG

SEQ ID NO: 717892 - protein, 9 aa, Homo Sapiens
LPEIPSHCE

SEQ ID NO: 717893 - protein, 9 aa, Homo Sapiens
QISVRNPRG

SEQ ID NO: 717894 - protein, 9 aa, Homo Sapiens
MPETDPVLV

SEQ ID NO: 717895 - protein, 9 aa, Homo Sapiens
VVAKGGTAW

SEQ ID NO: 717896 - protein, 9 aa, Homo Sapiens
ICNPVPWEK

SEQ ID NO: 717897 - protein, 9 aa, Homo Sapiens
VPYQSPQSI

SEQ ID NO: 717898 - protein, 9 aa, Homo Sapiens
TQDFRSLAT

SEQ ID NO: 717899 - protein, 9 aa, Homo Sapiens
RDGLQNYES

SEQ ID NO: 717900 - protein, 9 aa, Homo Sapiens
KAFCRPSDL

SEQ ID NO: 717901 - protein, 9 aa, Homo Sapiens
EDTKLLSET

SEQ ID NO: 717902 - protein, 9 aa, Homo Sapiens
CFFTPLVCM

SEQ ID NO: 717903 - protein, 9 aa, Homo Sapiens
IFAGKQLEG

SEQ ID NO: 717904 - protein, 9 aa, Homo Sapiens
AAAAALVHH

SEQ ID NO: 717905 - protein, 9 aa, Homo Sapiens
DLQLPAEIV

SEQ ID NO: 717906 - protein, 9 aa, Homo Sapiens
EGLREAFSK

SEQ ID NO: 717907 - protein, 9 aa, Homo Sapiens
KVLCEAESK

SEQ ID NO: 717908 - protein, 9 aa, Homo Sapiens
DCQIHRMDD

SEQ ID NO: 717909 - protein, 9 aa, Homo Sapiens
VGYLGLSLD

SEQ ID NO: 717910 - protein, 9 aa, Homo Sapiens
LLAMSNPRA

SEQ ID NO: 717911 - protein, 9 aa, Homo Sapiens
TASAMQRNI

SEQ ID NO: 717912 - protein, 9 aa, Homo Sapiens
CFVLILLSY

SEQ ID NO: 717913 - protein, 9 aa, Homo Sapiens
LLLFPLFNS

SEQ ID NO: 717914 - protein, 9 aa, Homo Sapiens
PHRNLRGSC

SEQ ID NO: 717915 - protein, 9 aa, Homo Sapiens
VERLLNPPP

SEQ ID NO: 717916 - protein, 9 aa, Homo Sapiens
SSSHRNIYS

SEQ ID NO: 717917 - protein, 9 aa, Homo Sapiens
GQRKLRRNR

SEQ ID NO: 717918 - protein, 9 aa, Homo Sapiens
VPPVSSWEY

SEQ ID NO: 717919 - protein, 9 aa, Homo Sapiens
CILANTLGP

SEQ ID NO: 717920 - protein, 9 aa, Homo Sapiens
GQFQEGDAY

SEQ ID NO: 717921 - protein, 9 aa, Homo Sapiens
MDSGPNKNM

SEQ ID NO: 717922 - protein, 9 aa, Homo Sapiens
ITFECFFAA

SEQ ID NO: 717923 - protein, 9 aa, Homo Sapiens
NETLVREVI

SEQ ID NO: 717924 - protein, 9 aa, Homo Sapiens
VEQFLQQQD

SEQ ID NO: 717925 - protein, 9 aa, Homo Sapiens
KAQVRRIYS

SEQ ID NO: 717926 - protein, 9 aa, Homo Sapiens
AYHCGKCGK

SEQ ID NO: 717927 - protein, 9 aa, Homo Sapiens
TQNKGAMLE

SEQ ID NO: 717928 - protein, 9 aa, Homo Sapiens
EVIQVNHQI

SEQ ID NO: 717929 - protein, 9 aa, Homo Sapiens
KISISLCHA

SEQ ID NO: 717930 - protein, 9 aa, Homo Sapiens
TLVREVIFL

SEQ ID NO: 717931 - protein, 9 aa, Homo Sapiens
SEANKERKK

SEQ ID NO: 717932 - protein, 9 aa, Homo Sapiens
IFLVALLVA

SEQ ID NO: 717933 - protein, 9 aa, Homo Sapiens
QQVEDFLGP

SEQ ID NO: 717934 - protein, 9 aa, Homo Sapiens
QRLFIMEKE

SEQ ID NO: 717935 - protein, 9 aa, Homo Sapiens
YDLSSDISV

SEQ ID NO: 717936 - protein, 9 aa, Homo Sapiens
HQIVVGWQL

SEQ ID NO: 717937 - protein, 9 aa, Homo Sapiens
SDAAYTASL

SEQ ID NO: 717938 - protein, 9 aa, Homo Sapiens
PEGCMLAVA

SEQ ID NO: 717939 - protein, 9 aa, Homo Sapiens
KKKYLMAAL

SEQ ID NO: 717940 - protein, 9 aa, Homo Sapiens
TSSSREWKV

SEQ ID NO: 717941 - protein, 9 aa, Homo Sapiens
HCIFLVALL

SEQ ID NO: 717942 - protein, 9 aa, Homo Sapiens
SAIKPEDWD

SEQ ID NO: 717943 - protein, 9 aa, Homo Sapiens
YKEERSRFK

SEQ ID NO: 717944 - protein, 9 aa, Homo Sapiens
PGLEHLHAC

SEQ ID NO: 717945 - protein, 9 aa, Homo Sapiens
ISLCHATNQ

SEQ ID NO: 717946 - protein, 9 aa, Homo Sapiens
QYNDDHDDD

SEQ ID NO: 717947 - protein, 9 aa, Homo Sapiens
NIYRADLEW

SEQ ID NO: 717948 - protein, 9 aa, Homo Sapiens
VTLRLHKNE

SEQ ID NO: 717949 - protein, 9 aa, Homo Sapiens
MPRHPGNRW

SEQ ID NO: 717950 - protein, 9 aa, Homo Sapiens
VTEIPTNLP

SEQ ID NO: 717951 - protein, 9 aa, Homo Sapiens
REAFSKLDM

SEQ ID NO: 717952 - protein, 9 aa, Homo Sapiens
TISPLVVAK

SEQ ID NO: 717953 - protein, 9 aa, Homo Sapiens
RRKKKKDTL

SEQ ID NO: 717954 - protein, 9 aa, Homo Sapiens
KTFEDKVSF

SEQ ID NO: 717955 - protein, 9 aa, Homo Sapiens
LISLHCNKV

SEQ ID NO: 717956 - protein, 9 aa, Homo Sapiens
KFPELLCVW

SEQ ID NO: 717957 - protein, 9 aa, Homo Sapiens
LCVLILLSI

SEQ ID NO: 717958 - protein, 9 aa, Homo Sapiens
HLSKRDKLW

SEQ ID NO: 717959 - protein, 9 aa, Homo Sapiens
ELNIHQGKI

SEQ ID NO: 717960 - protein, 9 aa, Homo Sapiens
YVPLFCSIL

SEQ ID NO: 717961 - protein, 9 aa, Homo Sapiens
PERLITDTI

SEQ ID NO: 717962 - protein, 9 aa, Homo Sapiens
ITEVSPAEH

SEQ ID NO: 717963 - protein, 9 aa, Homo Sapiens
TFIPPKGET

SEQ ID NO: 717964 - protein, 9 aa, Homo Sapiens
TDALLLGFM

SEQ ID NO: 717965 - protein, 9 aa, Homo Sapiens
KGQSKQAQA

SEQ ID NO: 717966 - protein, 9 aa, Homo Sapiens
DVIVMTPYS

SEQ ID NO: 717967 - protein, 9 aa, Homo Sapiens
VTYKSDPAM

SEQ ID NO: 717968 - protein, 9 aa, Homo Sapiens
AGGYSYSMP

SEQ ID NO: 717969 - protein, 9 aa, Homo Sapiens
YLFWYVRSP

SEQ ID NO: 717970 - protein, 9 aa, Homo Sapiens
HQVKLMYQV

SEQ ID NO: 717971 - protein, 9 aa, Homo Sapiens
DDHDDDDGD

SEQ ID NO: 717972 - protein, 9 aa, Homo Sapiens
ESFTSLEVR

SEQ ID NO: 717973 - protein, 9 aa, Homo Sapiens
PRCCPLCGM

SEQ ID NO: 717974 - protein, 9 aa, Homo Sapiens
TVHAITATH

SEQ ID NO: 717975 - protein, 9 aa, Homo Sapiens
LCILANTLG

SEQ ID NO: 717976 - protein, 9 aa, Homo Sapiens
ISISLCHAT

SEQ ID NO: 717977 - protein, 9 aa, Homo Sapiens
CEAESKVPV

SEQ ID NO: 717978 - protein, 9 aa, Homo Sapiens
SYMCGTICD

SEQ ID NO: 717979 - protein, 9 aa, Homo Sapiens
DESSYTDLL

SEQ ID NO: 717980 - protein, 9 aa, Homo Sapiens
AHILAFQTM

SEQ ID NO: 717981 - protein, 9 aa, Homo Sapiens
YPVGEQNDL

SEQ ID NO: 717982 - protein, 9 aa, Homo Sapiens
GMYVYYQRD

SEQ ID NO: 717983 - protein, 9 aa, Homo Sapiens
DLGVTLDKI

SEQ ID NO: 717984 - protein, 9 aa, Homo Sapiens
ELLCVWVSS

SEQ ID NO: 717985 - protein, 9 aa, Homo Sapiens
TRNLTCLCI

SEQ ID NO: 717986 - protein, 9 aa, Homo Sapiens
DMEKDGKRL

SEQ ID NO: 717987 - protein, 9 aa, Homo Sapiens
LEKFKIECL

SEQ ID NO: 717988 - protein, 9 aa, Homo Sapiens
LAAKSDLHE

SEQ ID NO: 717989 - protein, 9 aa, Homo Sapiens
KTGFPKLLC

SEQ ID NO: 717990 - protein, 9 aa, Homo Sapiens
GVEYYWGQL

SEQ ID NO: 717991 - protein, 9 aa, Homo Sapiens
PLMQTPVQG

SEQ ID NO: 717992 - protein, 9 aa, Homo Sapiens
PRLQTPMYF

SEQ ID NO: 717993 - protein, 9 aa, Homo Sapiens
FVLILLSYV

SEQ ID NO: 717994 - protein, 9 aa, Homo Sapiens
QGNQARLIS

SEQ ID NO: 717995 - protein, 9 aa, Homo Sapiens
PLFNSLLCS

SEQ ID NO: 717996 - protein, 9 aa, Homo Sapiens
AAMRLSVMV

SEQ ID NO: 717997 - protein, 9 aa, Homo Sapiens
KLALAEDRV

SEQ ID NO: 717998 - protein, 9 aa, Homo Sapiens
SSYTDLLPQ

SEQ ID NO: 717999 - protein, 9 aa, Homo Sapiens
AQEAQGILW

SEQ ID NO: 718000 - protein, 9 aa, Homo Sapiens
VKSGKGIRH

SEQ ID NO: 718001 - protein, 9 aa, Homo Sapiens
LCEAESKVP

SEQ ID NO: 718002 - protein, 9 aa, Homo Sapiens
FGGNPRSYQ

SEQ ID NO: 718003 - protein, 9 aa, Homo Sapiens
PAIAAYWAL

SEQ ID NO: 718004 - protein, 9 aa, Homo Sapiens
AEKNEIKQY

SEQ ID NO: 718005 - protein, 9 aa, Homo Sapiens
SSRYARAHP

SEQ ID NO: 718006 - protein, 9 aa, Homo Sapiens
TEVTMSAFT

SEQ ID NO: 718007 - protein, 9 aa, Homo Sapiens
EKLQFYKQK

SEQ ID NO: 718008 - protein, 9 aa, Homo Sapiens
APVRIQVVD

SEQ ID NO: 718009 - protein, 9 aa, Homo Sapiens
YRDSLTQQD

SEQ ID NO: 718010 - protein, 9 aa, Homo Sapiens
WCFFTPLVC

SEQ ID NO: 718011 - protein, 9 aa, Homo Sapiens
LQNYESLLG

SEQ ID NO: 718012 - protein, 9 aa, Homo Sapiens
INTAVYHPG

SEQ ID NO: 718013 - protein, 9 aa, Homo Sapiens
NSRPCERTV

SEQ ID NO: 718014 - protein, 9 aa, Homo Sapiens
IPLNASSCE

SEQ ID NO: 718015 - protein, 9 aa, Homo Sapiens
KSGKGIRHR

SEQ ID NO: 718016 - protein, 9 aa, Homo Sapiens
EVPQISVRN

SEQ ID NO: 718017 - protein, 9 aa, Homo Sapiens
ETLVREVIF

SEQ ID NO: 718018 - protein, 9 aa, Homo Sapiens
GVPEGIRIC

SEQ ID NO: 718019 - protein, 9 aa, Homo Sapiens
EKSLSLLSS

SEQ ID NO: 718020 - protein, 9 aa, Homo Sapiens
HRMDDIQAR

SEQ ID NO: 718021 - protein, 9 aa, Homo Sapiens
YVRSPGQGL

SEQ ID NO: 718022 - protein, 9 aa, Homo Sapiens
SDGKTWLEQ

SEQ ID NO: 718023 - protein, 9 aa, Homo Sapiens
PDAIRRAVM

SEQ ID NO: 718024 - protein, 9 aa, Homo Sapiens
RYNYGWSFY

SEQ ID NO: 718025 - protein, 9 aa, Homo Sapiens
GDESSYTDL

SEQ ID NO: 718026 - protein, 9 aa, Homo Sapiens
CMLAVATSR

SEQ ID NO: 718027 - protein, 9 aa, Homo Sapiens
KNRYNYGWS

SEQ ID NO: 718028 - protein, 9 aa, Homo Sapiens
PGGKEEAQE

SEQ ID NO: 718029 - protein, 9 aa, Homo Sapiens
VLFVTLRLH

SEQ ID NO: 718030 - protein, 9 aa, Homo Sapiens
QTPMYFFIS

SEQ ID NO: 718031 - protein, 9 aa, Homo Sapiens
NASSCEAKE

SEQ ID NO: 718032 - protein, 9 aa, Homo Sapiens
EAHILAFQT

SEQ ID NO: 718033 - protein, 9 aa, Homo Sapiens
QSPQSILSK

SEQ ID NO: 718034 - protein, 9 aa, Homo Sapiens
APERLITDT

SEQ ID NO: 718035 - protein, 9 aa, Homo Sapiens
TLRLELTGT

SEQ ID NO: 718036 - protein, 9 aa, Homo Sapiens
ATQGRNSSS

SEQ ID NO: 718037 - protein, 9 aa, Homo Sapiens
PDTLLAMSN

SEQ ID NO: 718038 - protein, 9 aa, Homo Sapiens
SHCEIPEGS

SEQ ID NO: 718039 - protein, 9 aa, Homo Sapiens
YLGHLREVR

SEQ ID NO: 718040 - protein, 9 aa, Homo Sapiens
LCLICKACG

SEQ ID NO: 718041 - protein, 9 aa, Homo Sapiens
KDYSAFYLG

SEQ ID NO: 718042 - protein, 9 aa, Homo Sapiens
FQMHPAPVR

SEQ ID NO: 718043 - protein, 9 aa, Homo Sapiens
PHEVPQISV

SEQ ID NO: 718044 - protein, 9 aa, Homo Sapiens
VNHQIVVGW

SEQ ID NO: 718045 - protein, 9 aa, Homo Sapiens
NSATAGDTS

SEQ ID NO: 718046 - protein, 9 aa, Homo Sapiens
PGYLNRIHK

SEQ ID NO: 718047 - protein, 9 aa, Homo Sapiens
CKATVPICE

SEQ ID NO: 718048 - protein, 9 aa, Homo Sapiens
MQNPDTLLA

SEQ ID NO: 718049 - protein, 9 aa, Homo Sapiens
ARMPETDPV

SEQ ID NO: 718050 - protein, 9 aa, Homo Sapiens
QGLQKDSTG

SEQ ID NO: 718051 - protein, 9 aa, Homo Sapiens
HGINTAVYH

SEQ ID NO: 718052 - protein, 9 aa, Homo Sapiens
LIPKSNDTD

SEQ ID NO: 718053 - protein, 9 aa, Homo Sapiens
PKKRQIYNP

SEQ ID NO: 718054 - protein, 9 aa, Homo Sapiens
SAILISRKG

SEQ ID NO: 718055 - protein, 9 aa, Homo Sapiens
LLQSSSHRN

SEQ ID NO: 718056 - protein, 9 aa, Homo Sapiens
LNASSCEAK

SEQ ID NO: 718057 - protein, 9 aa, Homo Sapiens
QFQEGDAYV

SEQ ID NO: 718058 - protein, 9 aa, Homo Sapiens
IISLCLLDS

SEQ ID NO: 718059 - protein, 9 aa, Homo Sapiens
LSGKEESFT

SEQ ID NO: 718060 - protein, 9 aa, Homo Sapiens
STASAMQRN

SEQ ID NO: 718061 - protein, 9 aa, Homo Sapiens
CGKVLVCAA

SEQ ID NO: 718062 - protein, 9 aa, Homo Sapiens
FLDCQIHRM

SEQ ID NO: 718063 - protein, 9 aa, Homo Sapiens
TTLHHQSFH

SEQ ID NO: 718064 - protein, 9 aa, Homo Sapiens
FVPYQSPQS

SEQ ID NO: 718065 - protein, 9 aa, Homo Sapiens
YQHGQRKLR

SEQ ID NO: 718066 - protein, 9 aa, Homo Sapiens
DQDYYYMSV

SEQ ID NO: 718067 - protein, 9 aa, Homo Sapiens
KKGHVTRNL

SEQ ID NO: 718068 - protein, 9 aa, Homo Sapiens
RLFIMEKEG

SEQ ID NO: 718069 - protein, 9 aa, Homo Sapiens
LQSSSHRNI

SEQ ID NO: 718070 - protein, 9 aa, Homo Sapiens
HLQAEAKKL

SEQ ID NO: 718071 - protein, 9 aa, Homo Sapiens
HGPSYDVYM

SEQ ID NO: 718072 - protein, 9 aa, Homo Sapiens
HKCQKILGK

SEQ ID NO: 718073 - protein, 9 aa, Homo Sapiens
CNPVPWEKE

SEQ ID NO: 718074 - protein, 9 aa, Homo Sapiens
MVAAPSSAT

SEQ ID NO: 718075 - protein, 9 aa, Homo Sapiens
AGLQGKPRP

SEQ ID NO: 718076 - protein, 9 aa, Homo Sapiens
ALRRKKKKD

SEQ ID NO: 718077 - protein, 9 aa, Homo Sapiens
AVYHPGHRL

SEQ ID NO: 718078 - protein, 9 aa, Homo Sapiens
QLRCNGVPE

SEQ ID NO: 718079 - protein, 9 aa, Homo Sapiens
QYFESKLSE

SEQ ID NO: 718080 - protein, 9 aa, Homo Sapiens
VLILLSIVV

SEQ ID NO: 718081 - protein, 9 aa, Homo Sapiens
NLTCLCIAY

SEQ ID NO: 718082 - protein, 9 aa, Homo Sapiens
GALFGSDAE

SEQ ID NO: 718083 - protein, 9 aa, Homo Sapiens
LILAAKSDL

SEQ ID NO: 718084 - protein, 9 aa, Homo Sapiens
VMLQSPTSP

SEQ ID NO: 718085 - protein, 9 aa, Homo Sapiens
LVLLPIALN

SEQ ID NO: 718086 - protein, 9 aa, Homo Sapiens
KLSYMCGTI

SEQ ID NO: 718087 - protein, 9 aa, Homo Sapiens
IRTNSRLQT

SEQ ID NO: 718088 - protein, 9 aa, Homo Sapiens
AEDRVQEEE

SEQ ID NO: 718089 - protein, 9 aa, Homo Sapiens
VANKTADRN

SEQ ID NO: 718090 - protein, 9 aa, Homo Sapiens
IKILTDTQN

SEQ ID NO: 718091 - protein, 9 aa, Homo Sapiens
TSEANKERK

SEQ ID NO: 718092 - protein, 9 aa, Homo Sapiens
TAVYHPGHR

SEQ ID NO: 718093 - protein, 9 aa, Homo Sapiens
PQISVRNPR

SEQ ID NO: 718094 - protein, 9 aa, Homo Sapiens
PGQLNADLQ

SEQ ID NO: 718095 - protein, 9 aa, Homo Sapiens
SKGILRQFL

SEQ ID NO: 718096 - protein, 9 aa, Homo Sapiens
ILAAKSDLH

SEQ ID NO: 718097 - protein, 9 aa, Homo Sapiens
QLLVLALER

SEQ ID NO: 718098 - protein, 9 aa, Homo Sapiens
NVEQFLQQQ

SEQ ID NO: 718099 - protein, 9 aa, Homo Sapiens
FPENQTNGA

SEQ ID NO: 718100 - protein, 9 aa, Homo Sapiens
ILLIRTNSR

SEQ ID NO: 718101 - protein, 9 aa, Homo Sapiens
HLLFSPLSG

SEQ ID NO: 718102 - protein, 9 aa, Homo Sapiens
TQTAKNSTD

SEQ ID NO: 718103 - protein, 9 aa, Homo Sapiens
FFAFLGTGE

SEQ ID NO: 718104 - protein, 9 aa, Homo Sapiens
NMSWSRLIR

SEQ ID NO: 718105 - protein, 9 aa, Homo Sapiens
TNHQYTTLH

SEQ ID NO: 718106 - protein, 9 aa, Homo Sapiens
MLGVPRQQI

SEQ ID NO: 718107 - protein, 9 aa, Homo Sapiens
CGKCGKSFR

SEQ ID NO: 718108 - protein, 9 aa, Homo Sapiens
DALGHARQG

SEQ ID NO: 718109 - protein, 9 aa, Homo Sapiens
ALGQYNDDH

SEQ ID NO: 718110 - protein, 9 aa, Homo Sapiens
KITHTGPSA

SEQ ID NO: 718111 - protein, 9 aa, Homo Sapiens
KNMSSLSTW

SEQ ID NO: 718112 - protein, 9 aa, Homo Sapiens
ITATHKTVD

SEQ ID NO: 718113 - protein, 9 aa, Homo Sapiens
PKSLSETCL

SEQ ID NO: 718114 - protein, 9 aa, Homo Sapiens
GDYDIAAHK

SEQ ID NO: 718115 - protein, 9 aa, Homo Sapiens
KNERAQEAM

SEQ ID NO: 718116 - protein, 9 aa, Homo Sapiens
KCGTLRLEL

SEQ ID NO: 718117 - protein, 9 aa, Homo Sapiens
VDKLSGKEE

SEQ ID NO: 718118 - protein, 9 aa, Homo Sapiens
EDIPEKNIQ

SEQ ID NO: 718119 - protein, 9 aa, Homo Sapiens
RGGKGQTGE

SEQ ID NO: 718120 - protein, 9 aa, Homo Sapiens
STFLEKYSA

SEQ ID NO: 718121 - protein, 9 aa, Homo Sapiens
SDNVVICSV

SEQ ID NO: 718122 - protein, 9 aa, Homo Sapiens
DALLLGFMS

SEQ ID NO: 718123 - protein, 9 aa, Homo Sapiens
SLSETCLPN

SEQ ID NO: 718124 - protein, 9 aa, Homo Sapiens
KQKVEKKGH

SEQ ID NO: 718125 - protein, 9 aa, Homo Sapiens
LSPLPPGGK

SEQ ID NO: 718126 - protein, 9 aa, Homo Sapiens
WYQHGQRKL

SEQ ID NO: 718127 - protein, 9 aa, Homo Sapiens
IHKLLNGTR

SEQ ID NO: 718128 - protein, 9 aa, Homo Sapiens
LETRPKTFS

SEQ ID NO: 718129 - protein, 9 aa, Homo Sapiens
SGEVNQDIA

SEQ ID NO: 718130 - protein, 9 aa, Homo Sapiens
GNSVHPIVR

SEQ ID NO: 718131 - protein, 9 aa, Homo Sapiens
CGTICDIWI

SEQ ID NO: 718132 - protein, 9 aa, Homo Sapiens
LKYECCATL

SEQ ID NO: 718133 - protein, 9 aa, Homo Sapiens
QVEDFLGPE

SEQ ID NO: 718134 - protein, 9 aa, Homo Sapiens
PLILSEGPS

SEQ ID NO: 718135 - protein, 9 aa, Homo Sapiens
FFSVMLQSP

SEQ ID NO: 718136 - protein, 9 aa, Homo Sapiens
DYLELNIHQ

SEQ ID NO: 718137 - protein, 9 aa, Homo Sapiens
ELTMDMPKM

SEQ ID NO: 718138 - protein, 9 aa, Homo Sapiens
TPVDTCTPV

SEQ ID NO: 718139 - protein, 9 aa, Homo Sapiens
DYDIAAHKC

SEQ ID NO: 718140 - protein, 9 aa, Homo Sapiens
FCIIGIITR

SEQ ID NO: 718141 - protein, 9 aa, Homo Sapiens
TFEDKVSFP

SEQ ID NO: 718142 - protein, 9 aa, Homo Sapiens
QVRRIYSLL

SEQ ID NO: 718143 - protein, 9 aa, Homo Sapiens
SATGQNKIS

SEQ ID NO: 718144 - protein, 9 aa, Homo Sapiens
ITKAQVANK

SEQ ID NO: 718145 - protein, 9 aa, Homo Sapiens
NMSSLSTWL

SEQ ID NO: 718146 - protein, 9 aa, Homo Sapiens
AVPPVSSWE

SEQ ID NO: 718147 - protein, 9 aa, Homo Sapiens
CAAEYSHWM

SEQ ID NO: 718148 - protein, 9 aa, Homo Sapiens
DWNLLAARS

SEQ ID NO: 718149 - protein, 9 aa, Homo Sapiens
GHLPRCCPL

SEQ ID NO: 718150 - protein, 9 aa, Homo Sapiens
MLSSKMGKC

SEQ ID NO: 718151 - protein, 9 aa, Homo Sapiens
SSRILRNHN

SEQ ID NO: 718152 - protein, 9 aa, Homo Sapiens
LFIHNIEVY

SEQ ID NO: 718153 - protein, 9 aa, Homo Sapiens
SHRNIYSSI

SEQ ID NO: 718154 - protein, 9 aa, Homo Sapiens
SASSLTCFS

SEQ ID NO: 718155 - protein, 9 aa, Homo Sapiens
PTSPLHINK

SEQ ID NO: 718156 - protein, 9 aa, Homo Sapiens
LSSDISVLV

SEQ ID NO: 718157 - protein, 9 aa, Homo Sapiens
VLALLSFWP

SEQ ID NO: 718158 - protein, 9 aa, Homo Sapiens
DIQSYQKHY

SEQ ID NO: 718159 - protein, 9 aa, Homo Sapiens
FGGYAFLKL

SEQ ID NO: 718160 - protein, 9 aa, Homo Sapiens
RRKRPVPAK

SEQ ID NO: 718161 - protein, 9 aa, Homo Sapiens
AEIVAFQIA

SEQ ID NO: 718162 - protein, 9 aa, Homo Sapiens
KDCFPGYLM

SEQ ID NO: 718163 - protein, 9 aa, Homo Sapiens
SGHLELEEV

SEQ ID NO: 718164 - protein, 9 aa, Homo Sapiens
HGDESSYTD

SEQ ID NO: 718165 - protein, 9 aa, Homo Sapiens
FWPGGYPAY

SEQ ID NO: 718166 - protein, 9 aa, Homo Sapiens
EALVTYKSD

SEQ ID NO: 718167 - protein, 9 aa, Homo Sapiens
HGKHTTSCD

SEQ ID NO: 718168 - protein, 9 aa, Homo Sapiens
WNGLLVFKN

SEQ ID NO: 718169 - protein, 9 aa, Homo Sapiens
WGELDRVNF

SEQ ID NO: 718170 - protein, 9 aa, Homo Sapiens
PSHCEIPEG

SEQ ID NO: 718171 - protein, 9 aa, Homo Sapiens
GCIYVEARS

SEQ ID NO: 718172 - protein, 9 aa, Homo Sapiens
AKGGTAWLE

SEQ ID NO: 718173 - protein, 9 aa, Homo Sapiens
RNIRLVHLG

SEQ ID NO: 718174 - protein, 9 aa, Homo Sapiens
LAAASWVIG

SEQ ID NO: 718175 - protein, 9 aa, Homo Sapiens
AAYGGYPTV

SEQ ID NO: 718176 - protein, 9 aa, Homo Sapiens
PFEAMPRHP

SEQ ID NO: 718177 - protein, 9 aa, Homo Sapiens
EKVLEDTKL

SEQ ID NO: 718178 - protein, 9 aa, Homo Sapiens
SKQAQARRK

SEQ ID NO: 718179 - protein, 9 aa, Homo Sapiens
LSVMVKKEW

SEQ ID NO: 718180 - protein, 9 aa, Homo Sapiens
AQVRRIYSL

SEQ ID NO: 718181 - protein, 9 aa, Homo Sapiens
PKSNDTDMR

SEQ ID NO: 718182 - protein, 9 aa, Homo Sapiens
GSWITARRI

SEQ ID NO: 718183 - protein, 9 aa, Homo Sapiens
NLLAARSIW

SEQ ID NO: 718184 - protein, 9 aa, Homo Sapiens
GKTFEDKVS

SEQ ID NO: 718185 - protein, 9 aa, Homo Sapiens
KVLVCAAEY

SEQ ID NO: 718186 - protein, 9 aa, Homo Sapiens
STNTCQVVA

SEQ ID NO: 718187 - protein, 9 aa, Homo Sapiens
SYENIRAVA

SEQ ID NO: 718188 - protein, 9 aa, Homo Sapiens
SECSVKSGK

SEQ ID NO: 718189 - protein, 9 aa, Homo Sapiens
AYGGYPTVH

SEQ ID NO: 718190 - protein, 9 aa, Homo Sapiens
QKAPDCHGP

SEQ ID NO: 718191 - protein, 9 aa, Homo Sapiens
GYAAAAALV

SEQ ID NO: 718192 - protein, 9 aa, Homo Sapiens
EVIEKKLEK

SEQ ID NO: 718193 - protein, 9 aa, Homo Sapiens
EAQGILWTI

SEQ ID NO: 718194 - protein, 9 aa, Homo Sapiens
MSWSRLIRK

SEQ ID NO: 718195 - protein, 9 aa, Homo Sapiens
DTIISLCLL

SEQ ID NO: 718196 - protein, 9 aa, Homo Sapiens
VGLCVADLP

SEQ ID NO: 718197 - protein, 9 aa, Homo Sapiens
TKKGHVTRN

SEQ ID NO: 718198 - protein, 9 aa, Homo Sapiens
QGLLITAAA

SEQ ID NO: 718199 - protein, 9 aa, Homo Sapiens
KAFSLKSHL

SEQ ID NO: 718200 - protein, 9 aa, Homo Sapiens
QIESSKSKL

SEQ ID NO: 718201 - protein, 9 aa, Homo Sapiens
FGSDAEGDP

SEQ ID NO: 718202 - protein, 9 aa, Homo Sapiens
VAAPSSATW

SEQ ID NO: 718203 - protein, 9 aa, Homo Sapiens
GTIICGWDK

SEQ ID NO: 718204 - protein, 9 aa, Homo Sapiens
SADRSRHSG

SEQ ID NO: 718205 - protein, 9 aa, Homo Sapiens
SDALGHARQ

SEQ ID NO: 718206 - protein, 9 aa, Homo Sapiens
ALVHHHHPG

SEQ ID NO: 718207 - protein, 9 aa, Homo Sapiens
GLEHLHACI

SEQ ID NO: 718208 - protein, 9 aa, Homo Sapiens
LISRKGRHT

SEQ ID NO: 718209 - protein, 9 aa, Homo Sapiens
NSVLNSKAI

SEQ ID NO: 718210 - protein, 9 aa, Homo Sapiens
PRQQIPQCA

SEQ ID NO: 718211 - protein, 9 aa, Homo Sapiens
LKLKKGTNQ

SEQ ID NO: 718212 - protein, 9 aa, Homo Sapiens
GPEGCMLAV

SEQ ID NO: 718213 - protein, 9 aa, Homo Sapiens
ITSGGFFGG

SEQ ID NO: 718214 - protein, 9 aa, Homo Sapiens
PTSATGQNK

SEQ ID NO: 718215 - protein, 9 aa, Homo Sapiens
LLLIALYGC

SEQ ID NO: 718216 - protein, 9 aa, Homo Sapiens
SPPKNERAQ

SEQ ID NO: 718217 - protein, 9 aa, Homo Sapiens
FFFAFLGTG

SEQ ID NO: 718218 - protein, 9 aa, Homo Sapiens
ETTITAESL

SEQ ID NO: 718219 - protein, 9 aa, Homo Sapiens
PNRPKKRQI

SEQ ID NO: 718220 - protein, 9 aa, Homo Sapiens
FYIDVKKFT

SEQ ID NO: 718221 - protein, 9 aa, Homo Sapiens
RESARRLLT

SEQ ID NO: 718222 - protein, 9 aa, Homo Sapiens
GQRSPTVSR

SEQ ID NO: 718223 - protein, 9 aa, Homo Sapiens
PSVANELRR

SEQ ID NO: 718224 - protein, 9 aa, Homo Sapiens
CLPNGINGI

SEQ ID NO: 718225 - protein, 9 aa, Homo Sapiens
ATNQLLLFP

SEQ ID NO: 718226 - protein, 9 aa, Homo Sapiens
VTAPKVERL

SEQ ID NO: 718227 - protein, 9 aa, Homo Sapiens
LGGTDALLL

SEQ ID NO: 718228 - protein, 9 aa, Homo Sapiens
NKTIIGVSL

SEQ ID NO: 718229 - protein, 9 aa, Homo Sapiens
ALKLFIHNI

SEQ ID NO: 718230 - protein, 9 aa, Homo Sapiens
ELEDIIMKY

SEQ ID NO: 718231 - protein, 9 aa, Homo Sapiens
QFYKQKAPD

SEQ ID NO: 718232 - protein, 9 aa, Homo Sapiens
EEAQEAQGI

SEQ ID NO: 718233 - protein, 9 aa, Homo Sapiens
SQFQMHPAP

SEQ ID NO: 718234 - protein, 9 aa, Homo Sapiens
TVEYMNSIC

SEQ ID NO: 718235 - protein, 9 aa, Homo Sapiens
QSILSKCLQ

SEQ ID NO: 718236 - protein, 9 aa, Homo Sapiens
MTISVGYLG

SEQ ID NO: 718237 - protein, 9 aa, Homo Sapiens
DPNVEQFLQ

SEQ ID NO: 718238 - protein, 9 aa, Homo Sapiens
GILWTIRLP

SEQ ID NO: 718239 - protein, 9 aa, Homo Sapiens
EGPLILSEG

SEQ ID NO: 718240 - protein, 9 aa, Homo Sapiens
YFLAMLATI

SEQ ID NO: 718241 - protein, 9 aa, Homo Sapiens
KKMTSKSSE

SEQ ID NO: 718242 - protein, 9 aa, Homo Sapiens
KQKAPDCHG

SEQ ID NO: 718243 - protein, 9 aa, Homo Sapiens
LFIMEKEGY

SEQ ID NO: 718244 - protein, 9 aa, Homo Sapiens
LLSFWPGGY

SEQ ID NO: 718245 - protein, 9 aa, Homo Sapiens
GGYPTVHTA

SEQ ID NO: 718246 - protein, 9 aa, Homo Sapiens
PAVHPQSED

SEQ ID NO: 718247 - protein, 9 aa, Homo Sapiens
WYVRSPGQG

SEQ ID NO: 718248 - protein, 9 aa, Homo Sapiens
PPGGKEEAQ

SEQ ID NO: 718249 - protein, 9 aa, Homo Sapiens
EPWEEPQRV

SEQ ID NO: 718250 - protein, 9 aa, Homo Sapiens
YIVHQSAIL

SEQ ID NO: 718251 - protein, 9 aa, Homo Sapiens
SYQKGILRK

SEQ ID NO: 718252 - protein, 9 aa, Homo Sapiens
SGSWITARR

SEQ ID NO: 718253 - protein, 9 aa, Homo Sapiens
CRGKGVTEI

SEQ ID NO: 718254 - protein, 9 aa, Homo Sapiens
MERVNETLV

SEQ ID NO: 718255 - protein, 9 aa, Homo Sapiens
AGKKKKYLM

SEQ ID NO: 718256 - protein, 9 aa, Homo Sapiens
YPHGINTAV

SEQ ID NO: 718257 - protein, 9 aa, Homo Sapiens
FIPPKGETK

SEQ ID NO: 718258 - protein, 9 aa, Homo Sapiens
SEPRLQTPM

SEQ ID NO: 718259 - protein, 9 aa, Homo Sapiens
LEHLHACIS

SEQ ID NO: 718260 - protein, 9 aa, Homo Sapiens
LPRKEENQA

SEQ ID NO: 718261 - protein, 9 aa, Homo Sapiens
CIEAIHLYL

SEQ ID NO: 718262 - protein, 9 aa, Homo Sapiens
RLSGGAAAA

SEQ ID NO: 718263 - protein, 9 aa, Homo Sapiens
ARLISVPHK

SEQ ID NO: 718264 - protein, 9 aa, Homo Sapiens
SYQKHYGPQ

SEQ ID NO: 718265 - protein, 9 aa, Homo Sapiens
TIICGWDKR

SEQ ID NO: 718266 - protein, 9 aa, Homo Sapiens
GYPNGEGMF

SEQ ID NO: 718267 - protein, 9 aa, Homo Sapiens
PVQLRELTM

SEQ ID NO: 718268 - protein, 9 aa, Homo Sapiens
GYSYSMPDA

SEQ ID NO: 718269 - protein, 9 aa, Homo Sapiens
LQKDSTGSF

SEQ ID NO: 718270 - protein, 9 aa, Homo Sapiens
YCGKAFCRP

SEQ ID NO: 718271 - protein, 9 aa, Homo Sapiens
WSTAKSATW

SEQ ID NO: 718272 - protein, 9 aa, Homo Sapiens
QEKHQLLVL

SEQ ID NO: 718273 - protein, 9 aa, Homo Sapiens
LTMDMPKMS

SEQ ID NO: 718274 - protein, 9 aa, Homo Sapiens
GLQGKPRPG

SEQ ID NO: 718275 - protein, 9 aa, Homo Sapiens
GLSMGTIIC

SEQ ID NO: 718276 - protein, 9 aa, Homo Sapiens
GKAFCRPSD

SEQ ID NO: 718277 - protein, 9 aa, Homo Sapiens
ELTGTSGTA

SEQ ID NO: 718278 - protein, 9 aa, Homo Sapiens
GHDDGQRLS

SEQ ID NO: 718279 - protein, 9 aa, Homo Sapiens
KWCWCFFTP

SEQ ID NO: 718280 - protein, 9 aa, Homo Sapiens
DTCTPVTTS

SEQ ID NO: 718281 - protein, 9 aa, Homo Sapiens
SKTGFPKLL

SEQ ID NO: 718282 - protein, 9 aa, Homo Sapiens
DTDMRWNKG

SEQ ID NO: 718283 - protein, 9 aa, Homo Sapiens
KSKTFDFID

SEQ ID NO: 718284 - protein, 9 aa, Homo Sapiens
GGDRNYITL

SEQ ID NO: 718285 - protein, 9 aa, Homo Sapiens
PLAQSPPKN

SEQ ID NO: 718286 - protein, 9 aa, Homo Sapiens
PQGPWCPCW

SEQ ID NO: 718287 - protein, 9 aa, Homo Sapiens
KGQTGEGGM

SEQ ID NO: 718288 - protein, 9 aa, Homo Sapiens
DGLQNYESL

SEQ ID NO: 718289 - protein, 9 aa, Homo Sapiens
VEPWEEPQR

SEQ ID NO: 718290 - protein, 9 aa, Homo Sapiens
LALEVSLTS

SEQ ID NO: 718291 - protein, 9 aa, Homo Sapiens
AVTDIPTYY

SEQ ID NO: 718292 - protein, 9 aa, Homo Sapiens
NTCQVVAFL

SEQ ID NO: 718293 - protein, 9 aa, Homo Sapiens
WEEAAGAPV

SEQ ID NO: 718294 - protein, 9 aa, Homo Sapiens
DGKQVMCPQ

SEQ ID NO: 718295 - protein, 9 aa, Homo Sapiens
TFDFIDVLL

SEQ ID NO: 718296 - protein, 9 aa, Homo Sapiens
PTVSRSRSG

SEQ ID NO: 718297 - protein, 9 aa, Homo Sapiens
EWRQQAVCA

SEQ ID NO: 718298 - protein, 9 aa, Homo Sapiens
ADRSRHSGI

SEQ ID NO: 718299 - protein, 9 aa, Homo Sapiens
TAREEIAAT

SEQ ID NO: 718300 - protein, 9 aa, Homo Sapiens
LSTWLAHIE

SEQ ID NO: 718301 - protein, 9 aa, Homo Sapiens
IVCPQTDKC

SEQ ID NO: 718302 - protein, 9 aa, Homo Sapiens
HRFGNSVHP

SEQ ID NO: 718303 - protein, 9 aa, Homo Sapiens
PVRAGDSWT

SEQ ID NO: 718304 - protein, 9 aa, Homo Sapiens
RGDYDIAAH

SEQ ID NO: 718305 - protein, 9 aa, Homo Sapiens
VPEGIRICR

SEQ ID NO: 718306 - protein, 9 aa, Homo Sapiens
WRFDGSKPD

SEQ ID NO: 718307 - protein, 9 aa, Homo Sapiens
SSSREWKVK

SEQ ID NO: 718308 - protein, 9 aa, Homo Sapiens
ISGSGCKSP

SEQ ID NO: 718309 - protein, 9 aa, Homo Sapiens
KSLSLLSSR

SEQ ID NO: 718310 - protein, 9 aa, Homo Sapiens
GKQLEGGRT

SEQ ID NO: 718311 - protein, 9 aa, Homo Sapiens
VEGRRKAFT

SEQ ID NO: 718312 - protein, 9 aa, Homo Sapiens
QSKQAQARR

SEQ ID NO: 718313 - protein, 9 aa, Homo Sapiens
TTPVDTCTP

SEQ ID NO: 718314 - protein, 9 aa, Homo Sapiens
GPLILSEGP

SEQ ID NO: 718315 - protein, 9 aa, Homo Sapiens
VKLMYQVRI

SEQ ID NO: 718316 - protein, 9 aa, Homo Sapiens
LAVMSYDSY

SEQ ID NO: 718317 - protein, 9 aa, Homo Sapiens
EEKQVPIPL

SEQ ID NO: 718318 - protein, 9 aa, Homo Sapiens
PQGNQARLI

SEQ ID NO: 718319 - protein, 9 aa, Homo Sapiens
LILLSYVSI

SEQ ID NO: 718320 - protein, 9 aa, Homo Sapiens
KFTISIGII

SEQ ID NO: 718321 - protein, 9 aa, Homo Sapiens
TGLHPESHG

SEQ ID NO: 718322 - protein, 9 aa, Homo Sapiens
VRLSNRSRQ

SEQ ID NO: 718323 - protein, 9 aa, Homo Sapiens
VYHPGHRLL

SEQ ID NO: 718324 - protein, 9 aa, Homo Sapiens
HDEAEGDPG

SEQ ID NO: 718325 - protein, 9 aa, Homo Sapiens
EESFTSLEV

SEQ ID NO: 718326 - protein, 9 aa, Homo Sapiens
MLATIDVGL

SEQ ID NO: 718327 - protein, 9 aa, Homo Sapiens
HSYDLSSDI

SEQ ID NO: 718328 - protein, 9 aa, Homo Sapiens
QKVEKKGHG

SEQ ID NO: 718329 - protein, 9 aa, Homo Sapiens
PSWSQLLTG

SEQ ID NO: 718330 - protein, 9 aa, Homo Sapiens
ISTRDPLSK

SEQ ID NO: 718331 - protein, 9 aa, Homo Sapiens
GEVNQDIAD

SEQ ID NO: 718332 - protein, 9 aa, Homo Sapiens
GTRFRSGSF

SEQ ID NO: 718333 - protein, 9 aa, Homo Sapiens
SMGTIICGW

SEQ ID NO: 718334 - protein, 9 aa, Homo Sapiens
KDSYQKGIL

SEQ ID NO: 718335 - protein, 9 aa, Homo Sapiens
WMKWCWCFF

SEQ ID NO: 718336 - protein, 9 aa, Homo Sapiens
SYDVYMYQH

SEQ ID NO: 718337 - protein, 9 aa, Homo Sapiens
MPLTHSRRP

SEQ ID NO: 718338 - protein, 9 aa, Homo Sapiens
MGSVEGRRK

SEQ ID NO: 718339 - protein, 9 aa, Homo Sapiens
GGYSYSMPD

SEQ ID NO: 718340 - protein, 9 aa, Homo Sapiens
SSKMGKCCH

SEQ ID NO: 718341 - protein, 9 aa, Homo Sapiens
LSKRDKLWG

SEQ ID NO: 718342 - protein, 9 aa, Homo Sapiens
ELRRKRPVP

SEQ ID NO: 718343 - protein, 9 aa, Homo Sapiens
TWLEQDEQP

SEQ ID NO: 718344 - protein, 9 aa, Homo Sapiens
VHTATDYGY

SEQ ID NO: 718345 - protein, 9 aa, Homo Sapiens
ESQIQLELK

SEQ ID NO: 718346 - protein, 9 aa, Homo Sapiens
RLISVPHKA

SEQ ID NO: 718347 - protein, 9 aa, Homo Sapiens
MCPQDFFGD

SEQ ID NO: 718348 - protein, 9 aa, Homo Sapiens
STWLAHIES

SEQ ID NO: 718349 - protein, 9 aa, Homo Sapiens
SPAEHTQCS

SEQ ID NO: 718350 - protein, 9 aa, Homo Sapiens
KWEWGTPHN

SEQ ID NO: 718351 - protein, 9 aa, Homo Sapiens
REIPKGSAL

SEQ ID NO: 718352 - protein, 9 aa, Homo Sapiens
THSRRPRPR

SEQ ID NO: 718353 - protein, 9 aa, Homo Sapiens
HDGALTGVT

SEQ ID NO: 718354 - protein, 9 aa, Homo Sapiens
QSYQKHYGP

SEQ ID NO: 718355 - protein, 9 aa, Homo Sapiens
YFQYRKLNL

SEQ ID NO: 718356 - protein, 9 aa, Homo Sapiens
KTIIGVSLL

SEQ ID NO: 718357 - protein, 9 aa, Homo Sapiens
SQFYTTSER

SEQ ID NO: 718358 - protein, 9 aa, Homo Sapiens
SWDLPGSQV

SEQ ID NO: 718359 - protein, 9 aa, Homo Sapiens
AFSKLDMTS

SEQ ID NO: 718360 - protein, 9 aa, Homo Sapiens
REGWKGNRC

SEQ ID NO: 718361 - protein, 9 aa, Homo Sapiens
EVSSSRILR

SEQ ID NO: 718362 - protein, 9 aa, Homo Sapiens
ATGLHPESH

SEQ ID NO: 718363 - protein, 9 aa, Homo Sapiens
SVEGRRKAF

SEQ ID NO: 718364 - protein, 9 aa, Homo Sapiens
KHYGPQTLY

SEQ ID NO: 718365 - protein, 9 aa, Homo Sapiens
DLSSDISVL

SEQ ID NO: 718366 - protein, 9 aa, Homo Sapiens
WEWGTPHNF

SEQ ID NO: 718367 - protein, 9 aa, Homo Sapiens
AEGDPEKAE

SEQ ID NO: 718368 - protein, 9 aa, Homo Sapiens
NYESLLGLT

SEQ ID NO: 718369 - protein, 9 aa, Homo Sapiens
PVQGGIPAP

SEQ ID NO: 718370 - protein, 9 aa, Homo Sapiens
VILWLKGVV

SEQ ID NO: 718371 - protein, 9 aa, Homo Sapiens
KRREQLSYL

SEQ ID NO: 718372 - protein, 9 aa, Homo Sapiens
SCGKVLVCA

SEQ ID NO: 718373 - protein, 9 aa, Homo Sapiens
IEKKLEKFK

SEQ ID NO: 718374 - protein, 9 aa, Homo Sapiens
AVIHMGSVE

SEQ ID NO: 718375 - protein, 9 aa, Homo Sapiens
NSTDPAIHE

SEQ ID NO: 718376 - protein, 9 aa, Homo Sapiens
VSADAVNLT

SEQ ID NO: 718377 - protein, 9 aa, Homo Sapiens
VTRNLTCLC

SEQ ID NO: 718378 - protein, 9 aa, Homo Sapiens
LAVATSRSE

SEQ ID NO: 718379 - protein, 9 aa, Homo Sapiens
GCDVIVMTP

SEQ ID NO: 718380 - protein, 9 aa, Homo Sapiens
TDMRWNKGT

SEQ ID NO: 718381 - protein, 9 aa, Homo Sapiens
TKYDWNLLA

SEQ ID NO: 718382 - protein, 9 aa, Homo Sapiens
AITEVSPAE

SEQ ID NO: 718383 - protein, 9 aa, Homo Sapiens
QVGEQLLQL

SEQ ID NO: 718384 - protein, 9 aa, Homo Sapiens
LVVAKGGTA

SEQ ID NO: 718385 - protein, 9 aa, Homo Sapiens
IILHLRSNL

SEQ ID NO: 718386 - protein, 9 aa, Homo Sapiens
SLKLKKGTN

SEQ ID NO: 718387 - protein, 9 aa, Homo Sapiens
VVLFVTLRL

SEQ ID NO: 718388 - protein, 9 aa, Homo Sapiens
KSLSETCLP

SEQ ID NO: 718389 - protein, 9 aa, Homo Sapiens
PPSGSGRST

SEQ ID NO: 718390 - protein, 9 aa, Homo Sapiens
YTLATGLHP

SEQ ID NO: 718391 - protein, 9 aa, Homo Sapiens
DIADLIKRI

SEQ ID NO: 718392 - protein, 9 aa, Homo Sapiens
LSETCLPNG

SEQ ID NO: 718393 - protein, 9 aa, Homo Sapiens
KVFSDALGH

SEQ ID NO: 718394 - protein, 9 aa, Homo Sapiens
SEVYGDPAV

SEQ ID NO: 718395 - protein, 9 aa, Homo Sapiens
DPQGPWCPC

SEQ ID NO: 718396 - protein, 9 aa, Homo Sapiens
YMSVKALYT

SEQ ID NO: 718397 - protein, 9 aa, Homo Sapiens
MKMLSSKMG

SEQ ID NO: 718398 - protein, 9 aa, Homo Sapiens
SNDTDMRWN

SEQ ID NO: 718399 - protein, 9 aa, Homo Sapiens
SSASSLTCF

SEQ ID NO: 718400 - protein, 9 aa, Homo Sapiens
GEQNDLERL

SEQ ID NO: 718401 - protein, 9 aa, Homo Sapiens
LPGWSRTPD

SEQ ID NO: 718402 - protein, 9 aa, Homo Sapiens
KMIASDSHC

SEQ ID NO: 718403 - protein, 9 aa, Homo Sapiens
FMVAAPSSA

SEQ ID NO: 718404 - protein, 9 aa, Homo Sapiens
RPARKFRRP

SEQ ID NO: 718405 - protein, 9 aa, Homo Sapiens
LGFSETDRK

SEQ ID NO: 718406 - protein, 9 aa, Homo Sapiens
QWKAQVRRI

SEQ ID NO: 718407 - protein, 9 aa, Homo Sapiens
VLWRFDGSK

SEQ ID NO: 718408 - protein, 9 aa, Homo Sapiens
SFQQWSTAK

SEQ ID NO: 718409 - protein, 9 aa, Homo Sapiens
GVVWYQHGQ

SEQ ID NO: 718410 - protein, 9 aa, Homo Sapiens
LHITFECFF

SEQ ID NO: 718411 - protein, 9 aa, Homo Sapiens
KIPVRAGDS

SEQ ID NO: 718412 - protein, 9 aa, Homo Sapiens
WASKSGQST

SEQ ID NO: 718413 - protein, 9 aa, Homo Sapiens
QRLWGELDR

SEQ ID NO: 718414 - protein, 9 aa, Homo Sapiens
QGLLKFAPL

SEQ ID NO: 718415 - protein, 9 aa, Homo Sapiens
AFCRPSDLF

SEQ ID NO: 718416 - protein, 9 aa, Homo Sapiens
DCFPGYLMN

SEQ ID NO: 718417 - protein, 9 aa, Homo Sapiens
TVHTATDYG

SEQ ID NO: 718418 - protein, 9 aa, Homo Sapiens
WFVKEALVT

SEQ ID NO: 718419 - protein, 9 aa, Homo Sapiens
APKVERLLN

SEQ ID NO: 718420 - protein, 9 aa, Homo Sapiens
GGRTLSDYN

SEQ ID NO: 718421 - protein, 9 aa, Homo Sapiens
DGLRPNSKT

SEQ ID NO: 718422 - protein, 9 aa, Homo Sapiens
CLDNISGSG

SEQ ID NO: 718423 - protein, 9 aa, Homo Sapiens
PFLDHKVYA

SEQ ID NO: 718424 - protein, 9 aa, Homo Sapiens
LRRKQSSKH

SEQ ID NO: 718425 - protein, 9 aa, Homo Sapiens
SVGLCVADL

SEQ ID NO: 718426 - protein, 9 aa, Homo Sapiens
TQNSKPSPT

SEQ ID NO: 718427 - protein, 9 aa, Homo Sapiens
GQTGEGGMK

SEQ ID NO: 718428 - protein, 9 aa, Homo Sapiens
GGVSADAVN

SEQ ID NO: 718429 - protein, 9 aa, Homo Sapiens
LNADLQKLA

SEQ ID NO: 718430 - protein, 9 aa, Homo Sapiens
LKKGTNQKD

SEQ ID NO: 718431 - protein, 9 aa, Homo Sapiens
ELEPQVGEQ

SEQ ID NO: 718432 - protein, 9 aa, Homo Sapiens
AQEKHQLLV

SEQ ID NO: 718433 - protein, 9 aa, Homo Sapiens
IESSKSKLG

SEQ ID NO: 718434 - protein, 9 aa, Homo Sapiens
GGGVSADAV

SEQ ID NO: 718435 - protein, 9 aa, Homo Sapiens
GKGVTEIPT

SEQ ID NO: 718436 - protein, 9 aa, Homo Sapiens
LEPQVGEQL

SEQ ID NO: 718437 - protein, 9 aa, Homo Sapiens
GPKIHQVKL

SEQ ID NO: 718438 - protein, 9 aa, Homo Sapiens
GLLITAAAQ

SEQ ID NO: 718439 - protein, 9 aa, Homo Sapiens
ASKSGQSTG

SEQ ID NO: 718440 - protein, 9 aa, Homo Sapiens
LRGSCNVNC

SEQ ID NO: 718441 - protein, 9 aa, Homo Sapiens
GTNQKDETF

SEQ ID NO: 718442 - protein, 9 aa, Homo Sapiens
YYMSVKALY

SEQ ID NO: 718443 - protein, 9 aa, Homo Sapiens
ETPPAIAAY

SEQ ID NO: 718444 - protein, 9 aa, Homo Sapiens
ATLKYECCA

SEQ ID NO: 718445 - protein, 9 aa, Homo Sapiens
ELQLCLICK

SEQ ID NO: 718446 - protein, 9 aa, Homo Sapiens
VSLTSQQVG

SEQ ID NO: 718447 - protein, 9 aa, Homo Sapiens
TTVTPGYQD

SEQ ID NO: 718448 - protein, 9 aa, Homo Sapiens
YHCGKCGKS

SEQ ID NO: 718449 - protein, 9 aa, Homo Sapiens
ILLSIVVLF

SEQ ID NO: 718450 - protein, 9 aa, Homo Sapiens
INKVFSDAL

SEQ ID NO: 718451 - protein, 9 aa, Homo Sapiens
VYGVRLSNR

SEQ ID NO: 718452 - protein, 9 aa, Homo Sapiens
NHQIVVGWQ

SEQ ID NO: 718453 - protein, 9 aa, Homo Sapiens
HNIEVYHEK

SEQ ID NO: 718454 - protein, 9 aa, Homo Sapiens
MKKKKTDFI

SEQ ID NO: 718455 - protein, 9 aa, Homo Sapiens
PGKSQGPPP

SEQ ID NO: 718456 - protein, 9 aa, Homo Sapiens
LTDTQNSKP

SEQ ID NO: 718457 - protein, 9 aa, Homo Sapiens
AYFEEVFGL

SEQ ID NO: 718458 - protein, 9 aa, Homo Sapiens
LEGGRTLSD

SEQ ID NO: 718459 - protein, 9 aa, Homo Sapiens
PTTVTPGYQ

SEQ ID NO: 718460 - protein, 9 aa, Homo Sapiens
EAKLHEHIK

SEQ ID NO: 718461 - protein, 9 aa, Homo Sapiens
MPHRNLRGS

SEQ ID NO: 718462 - protein, 9 aa, Homo Sapiens
YSEGHDSSS

SEQ ID NO: 718463 - protein, 9 aa, Homo Sapiens
VKESQIQLE

SEQ ID NO: 718464 - protein, 9 aa, Homo Sapiens
IGVSLLSVL

SEQ ID NO: 718465 - protein, 9 aa, Homo Sapiens
RCHQRNCIP

SEQ ID NO: 718466 - protein, 9 aa, Homo Sapiens
AKIPDPSAI

SEQ ID NO: 718467 - protein, 9 aa, Homo Sapiens
RKKRREQLS

SEQ ID NO: 718468 - protein, 9 aa, Homo Sapiens
LSSRYARAH

SEQ ID NO: 718469 - protein, 9 aa, Homo Sapiens
RTQERDHSG

SEQ ID NO: 718470 - protein, 9 aa, Homo Sapiens
PEGPLILSE

SEQ ID NO: 718471 - protein, 9 aa, Homo Sapiens
TIISLCLLD

SEQ ID NO: 718472 - protein, 9 aa, Homo Sapiens
VQGGIPAPG

SEQ ID NO: 718473 - protein, 9 aa, Homo Sapiens
TGMYVYYQR

SEQ ID NO: 718474 - protein, 9 aa, Homo Sapiens
LSMGTIICG

SEQ ID NO: 718475 - protein, 9 aa, Homo Sapiens
GFKVGSVVQ

SEQ ID NO: 718476 - protein, 9 aa, Homo Sapiens
VALRRKKKK

SEQ ID NO: 718477 - protein, 9 aa, Homo Sapiens
SFPLQPKPD

SEQ ID NO: 718478 - protein, 9 aa, Homo Sapiens
DGKTWLEQD

SEQ ID NO: 718479 - protein, 9 aa, Homo Sapiens
GEGMFASQH

SEQ ID NO: 718480 - protein, 9 aa, Homo Sapiens
DMPLTHSRR

SEQ ID NO: 718481 - protein, 9 aa, Homo Sapiens
GSGRSTATS

SEQ ID NO: 718482 - protein, 9 aa, Homo Sapiens
LKKAIVSNG

SEQ ID NO: 718483 - protein, 9 aa, Homo Sapiens
REIQSITVE

SEQ ID NO: 718484 - protein, 9 aa, Homo Sapiens
SLKEAHILA

SEQ ID NO: 718485 - protein, 9 aa, Homo Sapiens
AHKCQKILG

SEQ ID NO: 718486 - protein, 9 aa, Homo Sapiens
IAQIESSKS

SEQ ID NO: 718487 - protein, 9 aa, Homo Sapiens
NSRITGMYV

SEQ ID NO: 718488 - protein, 9 aa, Homo Sapiens
RSGSFIDQS

SEQ ID NO: 718489 - protein, 9 aa, Homo Sapiens
TCTPVTTSA

SEQ ID NO: 718490 - protein, 9 aa, Homo Sapiens
VRIGGDRNY

SEQ ID NO: 718491 - protein, 9 aa, Homo Sapiens
WQVYKEERS

SEQ ID NO: 718492 - protein, 9 aa, Homo Sapiens
SPTVSRSRS

SEQ ID NO: 718493 - protein, 9 aa, Homo Sapiens
EDKVSFPLQ

SEQ ID NO: 718494 - protein, 9 aa, Homo Sapiens
FVQGLQKDS

SEQ ID NO: 718495 - protein, 9 aa, Homo Sapiens
TTSSTQNKG

SEQ ID NO: 718496 - protein, 9 aa, Homo Sapiens
PWEEPQRVT

SEQ ID NO: 718497 - protein, 9 aa, Homo Sapiens
STNHQYTTL

SEQ ID NO: 718498 - protein, 9 aa, Homo Sapiens
DKLTWKDCF

SEQ ID NO: 718499 - protein, 9 aa, Homo Sapiens
FELQLCLIC

SEQ ID NO: 718500 - protein, 9 aa, Homo Sapiens
PRDGHLPRC

SEQ ID NO: 718501 - protein, 9 aa, Homo Sapiens
TAGDTSHPH

SEQ ID NO: 718502 - protein, 9 aa, Homo Sapiens
SASSAFLVP

SEQ ID NO: 718503 - protein, 9 aa, Homo Sapiens
EKHQLLVLA

SEQ ID NO: 718504 - protein, 9 aa, Homo Sapiens
QFLQQQDTA

SEQ ID NO: 718505 - protein, 9 aa, Homo Sapiens
NTLGPHEMG

SEQ ID NO: 718506 - protein, 9 aa, Homo Sapiens
GDQDYYYMS

SEQ ID NO: 718507 - protein, 9 aa, Homo Sapiens
EVKNAARAA

SEQ ID NO: 718508 - protein, 9 aa, Homo Sapiens
YQKGILRKF

SEQ ID NO: 718509 - protein, 9 aa, Homo Sapiens
KVSFPLQPK

SEQ ID NO: 718510 - protein, 9 aa, Homo Sapiens
CAEARESAR

SEQ ID NO: 718511 - protein, 9 aa, Homo Sapiens
PSAIKPEDW

SEQ ID NO: 718512 - protein, 9 aa, Homo Sapiens
RVTAPKVER

SEQ ID NO: 718513 - protein, 9 aa, Homo Sapiens
AALVHHHHP

SEQ ID NO: 718514 - protein, 9 aa, Homo Sapiens
YQSPQSILS

SEQ ID NO: 718515 - protein, 9 aa, Homo Sapiens
SPKSLSETC

SEQ ID NO: 718516 - protein, 9 aa, Homo Sapiens
RKEENQAVK

SEQ ID NO: 718517 - protein, 9 aa, Homo Sapiens
RAYHCGKCG

SEQ ID NO: 718518 - protein, 9 aa, Homo Sapiens
VEYMNSICN

SEQ ID NO: 718519 - protein, 9 aa, Homo Sapiens
FVTLRLHKN

SEQ ID NO: 718520 - protein, 9 aa, Homo Sapiens
IHMGSVEGR

SEQ ID NO: 718521 - protein, 9 aa, Homo Sapiens
TRVQGLLIT

SEQ ID NO: 718522 - protein, 9 aa, Homo Sapiens
GCSLTPGHP

SEQ ID NO: 718523 - protein, 9 aa, Homo Sapiens
HKTVDGPSG

SEQ ID NO: 718524 - protein, 9 aa, Homo Sapiens
RRLLEWKQK

SEQ ID NO: 718525 - protein, 9 aa, Homo Sapiens
DFRSLATYL

SEQ ID NO: 718526 - protein, 9 aa, Homo Sapiens
LRSVSSYEN

SEQ ID NO: 718527 - protein, 9 aa, Homo Sapiens
QTKYDWNLL

SEQ ID NO: 718528 - protein, 9 aa, Homo Sapiens
IGGDRNYIT

SEQ ID NO: 718529 - protein, 9 aa, Homo Sapiens
DEKQDRRRK

SEQ ID NO: 718530 - protein, 9 aa, Homo Sapiens
VKNAARAAS

SEQ ID NO: 718531 - protein, 9 aa, Homo Sapiens
DISVLVPLG

SEQ ID NO: 718532 - protein, 9 aa, Homo Sapiens
GTLRLELTG

SEQ ID NO: 718533 - protein, 9 aa, Homo Sapiens
KDLIVMGSP

SEQ ID NO: 718534 - protein, 9 aa, Homo Sapiens
CHMSVVVLF

SEQ ID NO: 718535 - protein, 9 aa, Homo Sapiens
GERAYHCGK

SEQ ID NO: 718536 - protein, 9 aa, Homo Sapiens
LILSEGPSV

SEQ ID NO: 718537 - protein, 9 aa, Homo Sapiens
HATNQLLLF

SEQ ID NO: 718538 - protein, 9 aa, Homo Sapiens
SLLGLTNLS

SEQ ID NO: 718539 - protein, 9 aa, Homo Sapiens
QMQNPDTLL

SEQ ID NO: 718540 - protein, 9 aa, Homo Sapiens
LQGLLKFAP

SEQ ID NO: 718541 - protein, 9 aa, Homo Sapiens
GLLKFAPLL

SEQ ID NO: 718542 - protein, 9 aa, Homo Sapiens
DAEGDPEKA

SEQ ID NO: 718543 - protein, 9 aa, Homo Sapiens
TLCAEARES

SEQ ID NO: 718544 - protein, 9 aa, Homo Sapiens
PKQSIGQFQ

SEQ ID NO: 718545 - protein, 9 aa, Homo Sapiens
VRNPRGLSD

SEQ ID NO: 718546 - protein, 9 aa, Homo Sapiens
SALYSSLVT

SEQ ID NO: 718547 - protein, 9 aa, Homo Sapiens
SGKEESFTS

SEQ ID NO: 718548 - protein, 9 aa, Homo Sapiens
KYDWNLLAA

SEQ ID NO: 718549 - protein, 9 aa, Homo Sapiens
AQWKAQVRR

SEQ ID NO: 718550 - protein, 9 aa, Homo Sapiens
KGSALYSSL

SEQ ID NO: 718551 - protein, 9 aa, Homo Sapiens
EHGTFVGRV

SEQ ID NO: 718552 - protein, 9 aa, Homo Sapiens
WGTPHNFLY

SEQ ID NO: 718553 - protein, 9 aa, Homo Sapiens
RSVSSYENI

SEQ ID NO: 718554 - protein, 9 aa, Homo Sapiens
IAAHKCQKI

SEQ ID NO: 718555 - protein, 9 aa, Homo Sapiens
ASDAAYTAS

SEQ ID NO: 718556 - protein, 9 aa, Homo Sapiens
VLWEIVTLG

SEQ ID NO: 718557 - protein, 9 aa, Homo Sapiens
MDDIQARDE

SEQ ID NO: 718558 - protein, 9 aa, Homo Sapiens
LPGSQVRLP

SEQ ID NO: 718559 - protein, 9 aa, Homo Sapiens
KKRQIYNPK

SEQ ID NO: 718560 - protein, 9 aa, Homo Sapiens
KGEAEHLSK

SEQ ID NO: 718561 - protein, 9 aa, Homo Sapiens
MHTVCLKSG

SEQ ID NO: 718562 - protein, 9 aa, Homo Sapiens
LLIRTNSRL

SEQ ID NO: 718563 - protein, 9 aa, Homo Sapiens
EREMKTFIP

SEQ ID NO: 718564 - protein, 9 aa, Homo Sapiens
IYKCRPVYR

SEQ ID NO: 718565 - protein, 9 aa, Homo Sapiens
ESDKDEIHL

SEQ ID NO: 718566 - protein, 9 aa, Homo Sapiens
AMGENQRLW

SEQ ID NO: 718567 - protein, 9 aa, Homo Sapiens
LRRKRPVPA

SEQ ID NO: 718568 - protein, 9 aa, Homo Sapiens
LKEAHILAF

SEQ ID NO: 718569 - protein, 9 aa, Homo Sapiens
GKVLVCAAE

SEQ ID NO: 718570 - protein, 9 aa, Homo Sapiens
ALFGSDAEG

SEQ ID NO: 718571 - protein, 9 aa, Homo Sapiens
NLLLNTDSN

SEQ ID NO: 718572 - protein, 9 aa, Homo Sapiens
SILSKCLQW

SEQ ID NO: 718573 - protein, 9 aa, Homo Sapiens
QAAMRLSVM

SEQ ID NO: 718574 - protein, 9 aa, Homo Sapiens
QELEDIIMK

SEQ ID NO: 718575 - protein, 9 aa, Homo Sapiens
KIPDPSAIK

SEQ ID NO: 718576 - protein, 9 aa, Homo Sapiens
FTTSSTQNK

SEQ ID NO: 718577 - protein, 9 aa, Homo Sapiens
QSIGQFQEG

SEQ ID NO: 718578 - protein, 9 aa, Homo Sapiens
MLAVATSRS

SEQ ID NO: 718579 - protein, 9 aa, Homo Sapiens
AAHKCQKIL

SEQ ID NO: 718580 - protein, 9 aa, Homo Sapiens
QSSSHRNIY

SEQ ID NO: 718581 - protein, 9 aa, Homo Sapiens
ASQFQMHPA

SEQ ID NO: 718582 - protein, 9 aa, Homo Sapiens
YPSCTRKES

SEQ ID NO: 718583 - protein, 9 aa, Homo Sapiens
PLPPGGKEE

SEQ ID NO: 718584 - protein, 9 aa, Homo Sapiens
KLFIHNIEV

SEQ ID NO: 718585 - protein, 9 aa, Homo Sapiens
PNSKTSQIT

SEQ ID NO: 718586 - protein, 9 aa, Homo Sapiens
NPRSGSWIT

SEQ ID NO: 718587 - protein, 9 aa, Homo Sapiens
LENSATAGD

SEQ ID NO: 718588 - protein, 9 aa, Homo Sapiens
FRSLATYLS

SEQ ID NO: 718589 - protein, 9 aa, Homo Sapiens
SAAIEEKKL

SEQ ID NO: 718590 - protein, 9 aa, Homo Sapiens
TDIPTYYRT

SEQ ID NO: 718591 - protein, 9 aa, Homo Sapiens
PRGCDVIVM

SEQ ID NO: 718592 - protein, 9 aa, Homo Sapiens
TLDKITNSG

SEQ ID NO: 718593 - protein, 9 aa, Homo Sapiens
METPPAIAA

SEQ ID NO: 718594 - protein, 9 aa, Homo Sapiens
PRKEENQAV

SEQ ID NO: 718595 - protein, 9 aa, Homo Sapiens
GSGHLELEE

SEQ ID NO: 718596 - protein, 9 aa, Homo Sapiens
NPRQYHIMM

SEQ ID NO: 718597 - protein, 9 aa, Homo Sapiens
NSRLQTPMY

SEQ ID NO: 718598 - protein, 9 aa, Homo Sapiens
IVMGSPGSS

SEQ ID NO: 718599 - protein, 9 aa, Homo Sapiens
RSGSWITAR

SEQ ID NO: 718600 - protein, 9 aa, Homo Sapiens
LRRKKKKDT

SEQ ID NO: 718601 - protein, 9 aa, Homo Sapiens
TIDVGLSTA

SEQ ID NO: 718602 - protein, 9 aa, Homo Sapiens
MAALYVGDL

SEQ ID NO: 718603 - protein, 9 aa, Homo Sapiens
RRFEVSSSR

SEQ ID NO: 718604 - protein, 9 aa, Homo Sapiens
HPAPVRIQV

SEQ ID NO: 718605 - protein, 9 aa, Homo Sapiens
KITEQEKDF

SEQ ID NO: 718606 - protein, 9 aa, Homo Sapiens
SKTFDFIDV

SEQ ID NO: 718607 - protein, 9 aa, Homo Sapiens
KQPTSATGQ

SEQ ID NO: 718608 - protein, 9 aa, Homo Sapiens
HMGSVEGRR

SEQ ID NO: 718609 - protein, 9 aa, Homo Sapiens
VSNGGQYET

SEQ ID NO: 718610 - protein, 9 aa, Homo Sapiens
SVHPIVRVV

SEQ ID NO: 718611 - protein, 9 aa, Homo Sapiens
ALVTYKSDP

SEQ ID NO: 718612 - protein, 9 aa, Homo Sapiens
LQSDNIYRA

SEQ ID NO: 718613 - protein, 9 aa, Homo Sapiens
EIRNMSWSR

SEQ ID NO: 718614 - protein, 9 aa, Homo Sapiens
NSTFLEKYS

SEQ ID NO: 718615 - protein, 9 aa, Homo Sapiens
VSPAEHTQC

SEQ ID NO: 718616 - protein, 9 aa, Homo Sapiens
AGSGQEWRQ

SEQ ID NO: 718617 - protein, 9 aa, Homo Sapiens
LALLSFWPG

SEQ ID NO: 718618 - protein, 9 aa, Homo Sapiens
RQFLIVCII

SEQ ID NO: 718619 - protein, 9 aa, Homo Sapiens
LLLNTDSNP

SEQ ID NO: 718620 - protein, 9 aa, Homo Sapiens
TAPHKSKTG

SEQ ID NO: 718621 - protein, 9 aa, Homo Sapiens
NSNPPSQYS

SEQ ID NO: 718622 - protein, 9 aa, Homo Sapiens
FHSFLPGAI

SEQ ID NO: 718623 - protein, 9 aa, Homo Sapiens
TEKLPTSHT

SEQ ID NO: 718624 - protein, 9 aa, Homo Sapiens
NPESLGYKI

SEQ ID NO: 718625 - protein, 9 aa, Homo Sapiens
DVFKCPPPK

SEQ ID NO: 718626 - protein, 9 aa, Homo Sapiens
MPTAGATTV

SEQ ID NO: 718627 - protein, 9 aa, Homo Sapiens
GPTNTAYSF

SEQ ID NO: 718628 - protein, 9 aa, Homo Sapiens
FMLFGDLES

SEQ ID NO: 718629 - protein, 9 aa, Homo Sapiens
EQLEGVNSS

SEQ ID NO: 718630 - protein, 9 aa, Homo Sapiens
FFMLFGDLE

SEQ ID NO: 718631 - protein, 9 aa, Homo Sapiens
GSCAEGIEG

SEQ ID NO: 718632 - protein, 9 aa, Homo Sapiens
DDQRPPPPY

SEQ ID NO: 718633 - protein, 9 aa, Homo Sapiens
LEAEDNMKL

SEQ ID NO: 718634 - protein, 9 aa, Homo Sapiens
SDTNKTTCE

SEQ ID NO: 718635 - protein, 9 aa, Homo Sapiens
IDLQILLHI

SEQ ID NO: 718636 - protein, 9 aa, Homo Sapiens
VRVVGAQVS

SEQ ID NO: 718637 - protein, 9 aa, Homo Sapiens
LMGRTSGYV

SEQ ID NO: 718638 - protein, 9 aa, Homo Sapiens
VPQEYQDPV

SEQ ID NO: 718639 - protein, 9 aa, Homo Sapiens
DIYLVARIE

SEQ ID NO: 718640 - protein, 9 aa, Homo Sapiens
NRGGQRQGG

SEQ ID NO: 718641 - protein, 9 aa, Homo Sapiens
PRVQAENSR

SEQ ID NO: 718642 - protein, 9 aa, Homo Sapiens
VSATAMAGV

SEQ ID NO: 718643 - protein, 9 aa, Homo Sapiens
PDTEKLPTS

SEQ ID NO: 718644 - protein, 9 aa, Homo Sapiens
SKLPSRLED

SEQ ID NO: 718645 - protein, 9 aa, Homo Sapiens
KVPEDLKDA

SEQ ID NO: 718646 - protein, 9 aa, Homo Sapiens
PGVRRPEGG

SEQ ID NO: 718647 - protein, 9 aa, Homo Sapiens
CDTVRLFLK

SEQ ID NO: 718648 - protein, 9 aa, Homo Sapiens
GHAKDELLT

SEQ ID NO: 718649 - protein, 9 aa, Homo Sapiens
LEIPHGKGK

SEQ ID NO: 718650 - protein, 9 aa, Homo Sapiens
TQPQAKGVG

SEQ ID NO: 718651 - protein, 9 aa, Homo Sapiens
FRAVGPSLR

SEQ ID NO: 718652 - protein, 9 aa, Homo Sapiens
DTNKTTCEA

SEQ ID NO: 718653 - protein, 9 aa, Homo Sapiens
LRPHNVAFL

SEQ ID NO: 718654 - protein, 9 aa, Homo Sapiens
GTTTTKFIK

SEQ ID NO: 718655 - protein, 9 aa, Homo Sapiens
VTLVKEKPK

SEQ ID NO: 718656 - protein, 9 aa, Homo Sapiens
SADVTTFQP

SEQ ID NO: 718657 - protein, 9 aa, Homo Sapiens
DLQNAQSKM

SEQ ID NO: 718658 - protein, 9 aa, Homo Sapiens
FLDRTGLSA

SEQ ID NO: 718659 - protein, 9 aa, Homo Sapiens
YSIIVNNLL

SEQ ID NO: 718660 - protein, 9 aa, Homo Sapiens
VSAVEEPLE

SEQ ID NO: 718661 - protein, 9 aa, Homo Sapiens
GAMHSAFGL

SEQ ID NO: 718662 - protein, 9 aa, Homo Sapiens
VLAPHFPIK

SEQ ID NO: 718663 - protein, 9 aa, Homo Sapiens
LLPQAILEA

SEQ ID NO: 718664 - protein, 9 aa, Homo Sapiens
MLAKSDLHP

SEQ ID NO: 718665 - protein, 9 aa, Homo Sapiens
QHNQQQCQP

SEQ ID NO: 718666 - protein, 9 aa, Homo Sapiens
LTQMYFFML

SEQ ID NO: 718667 - protein, 9 aa, Homo Sapiens
EYQDPVPEQ

SEQ ID NO: 718668 - protein, 9 aa, Homo Sapiens
SGATMARGF

SEQ ID NO: 718669 - protein, 9 aa, Homo Sapiens
GKVLRSKVD

SEQ ID NO: 718670 - protein, 9 aa, Homo Sapiens
VEEPLEAPV

SEQ ID NO: 718671 - protein, 9 aa, Homo Sapiens
ECAKVLIDL

SEQ ID NO: 718672 - protein, 9 aa, Homo Sapiens
LLVVMAFDL

SEQ ID NO: 718673 - protein, 9 aa, Homo Sapiens
KLKELAAFW

SEQ ID NO: 718674 - protein, 9 aa, Homo Sapiens
DTSQDSPGA

SEQ ID NO: 718675 - protein, 9 aa, Homo Sapiens
MCSGRGIRD

SEQ ID NO: 718676 - protein, 9 aa, Homo Sapiens
VLARATATE

SEQ ID NO: 718677 - protein, 9 aa, Homo Sapiens
SREESQRII

SEQ ID NO: 718678 - protein, 9 aa, Homo Sapiens
TVTTGATAM

SEQ ID NO: 718679 - protein, 9 aa, Homo Sapiens
ILQFTLSVR

SEQ ID NO: 718680 - protein, 9 aa, Homo Sapiens
LKEDILSYV

SEQ ID NO: 718681 - protein, 9 aa, Homo Sapiens
RIVSKAMIA

SEQ ID NO: 718682 - protein, 9 aa, Homo Sapiens
GVRRPEGGL

SEQ ID NO: 718683 - protein, 9 aa, Homo Sapiens
PRGLPPMQK

SEQ ID NO: 718684 - protein, 9 aa, Homo Sapiens
FEEPRVQAE

SEQ ID NO: 718685 - protein, 9 aa, Homo Sapiens
LAALIYELK

SEQ ID NO: 718686 - protein, 9 aa, Homo Sapiens
QSADVTTFQ

SEQ ID NO: 718687 - protein, 9 aa, Homo Sapiens
EISSDKFNE

SEQ ID NO: 718688 - protein, 9 aa, Homo Sapiens
LAGYRESGI

SEQ ID NO: 718689 - protein, 9 aa, Homo Sapiens
SQRSHVVTH

SEQ ID NO: 718690 - protein, 9 aa, Homo Sapiens
DRTGLSAVS

SEQ ID NO: 718691 - protein, 9 aa, Homo Sapiens
ANAKISLSS

SEQ ID NO: 718692 - protein, 9 aa, Homo Sapiens
EVSGIVHMQ

SEQ ID NO: 718693 - protein, 9 aa, Homo Sapiens
SQPGGRPQP

SEQ ID NO: 718694 - protein, 9 aa, Homo Sapiens
ANLGKKTVI

SEQ ID NO: 718695 - protein, 9 aa, Homo Sapiens
RATTMEEEV

SEQ ID NO: 718696 - protein, 9 aa, Homo Sapiens
MAICKQSQH

SEQ ID NO: 718697 - protein, 9 aa, Homo Sapiens
WEEAKKKTV

SEQ ID NO: 718698 - protein, 9 aa, Homo Sapiens
ATTVPARAT

SEQ ID NO: 718699 - protein, 9 aa, Homo Sapiens
MHCPYINTR

SEQ ID NO: 718700 - protein, 9 aa, Homo Sapiens
FDPEMPLQS

SEQ ID NO: 718701 - protein, 9 aa, Homo Sapiens
SWSFSQQRQ

SEQ ID NO: 718702 - protein, 9 aa, Homo Sapiens
KKKTVEWVG

SEQ ID NO: 718703 - protein, 9 aa, Homo Sapiens
PAAKKEPLW

SEQ ID NO: 718704 - protein, 9 aa, Homo Sapiens
LLFQHARIH

SEQ ID NO: 718705 - protein, 9 aa, Homo Sapiens
VGAVTVPAT

SEQ ID NO: 718706 - protein, 9 aa, Homo Sapiens
TTVMAGATA

SEQ ID NO: 718707 - protein, 9 aa, Homo Sapiens
ENRGNPNAM

SEQ ID NO: 718708 - protein, 9 aa, Homo Sapiens
RLECLQWLN

SEQ ID NO: 718709 - protein, 9 aa, Homo Sapiens
ARLMPTVGA

SEQ ID NO: 718710 - protein, 9 aa, Homo Sapiens
EAARSMPTA

SEQ ID NO: 718711 - protein, 9 aa, Homo Sapiens
HHDVAVLLN

SEQ ID NO: 718712 - protein, 9 aa, Homo Sapiens
RLFLKSNSK

SEQ ID NO: 718713 - protein, 9 aa, Homo Sapiens
GATTVPARA

SEQ ID NO: 718714 - protein, 9 aa, Homo Sapiens
CPKIKVDCE

SEQ ID NO: 718715 - protein, 9 aa, Homo Sapiens
EESTYLPLK

SEQ ID NO: 718716 - protein, 9 aa, Homo Sapiens
NRKDICAGF

SEQ ID NO: 718717 - protein, 9 aa, Homo Sapiens
QPQWKIPLL

SEQ ID NO: 718718 - protein, 9 aa, Homo Sapiens
VDGESDTNK

SEQ ID NO: 718719 - protein, 9 aa, Homo Sapiens
IQQPEILSS

SEQ ID NO: 718720 - protein, 9 aa, Homo Sapiens
EILDRTRKG

SEQ ID NO: 718721 - protein, 9 aa, Homo Sapiens
AGATTVPAR

SEQ ID NO: 718722 - protein, 9 aa, Homo Sapiens
HLTKPLLLD

SEQ ID NO: 718723 - protein, 9 aa, Homo Sapiens
ARATATEEE

SEQ ID NO: 718724 - protein, 9 aa, Homo Sapiens
ADIKRSEVE

SEQ ID NO: 718725 - protein, 9 aa, Homo Sapiens
MGFSAWIWM

SEQ ID NO: 718726 - protein, 9 aa, Homo Sapiens
VHVSYFSTD

SEQ ID NO: 718727 - protein, 9 aa, Homo Sapiens
TLNNSTWSN

SEQ ID NO: 718728 - protein, 9 aa, Homo Sapiens
AGATTVPAG

SEQ ID NO: 718729 - protein, 9 aa, Homo Sapiens
AADQPPSEL

SEQ ID NO: 718730 - protein, 9 aa, Homo Sapiens
MIFKKRSTR

SEQ ID NO: 718731 - protein, 9 aa, Homo Sapiens
FRSHNGNSR

SEQ ID NO: 718732 - protein, 9 aa, Homo Sapiens
PFLDRTGLS

SEQ ID NO: 718733 - protein, 9 aa, Homo Sapiens
DGESDTNKT

SEQ ID NO: 718734 - protein, 9 aa, Homo Sapiens
DLTDIVPLE

SEQ ID NO: 718735 - protein, 9 aa, Homo Sapiens
TVGHAKDEL

SEQ ID NO: 718736 - protein, 9 aa, Homo Sapiens
MVTKFCSVL

SEQ ID NO: 718737 - protein, 9 aa, Homo Sapiens
RAARHLCQP

SEQ ID NO: 718738 - protein, 9 aa, Homo Sapiens
FLKSNSKVK

SEQ ID NO: 718739 - protein, 9 aa, Homo Sapiens
AEYSSSQPP

SEQ ID NO: 718740 - protein, 9 aa, Homo Sapiens
SLAENKLDP

SEQ ID NO: 718741 - protein, 9 aa, Homo Sapiens
EFSQSLRLQ

SEQ ID NO: 718742 - protein, 9 aa, Homo Sapiens
VLNPITVPY

SEQ ID NO: 718743 - protein, 9 aa, Homo Sapiens
LGYKIKYSR

SEQ ID NO: 718744 - protein, 9 aa, Homo Sapiens
AIETVGHAK

SEQ ID NO: 718745 - protein, 9 aa, Homo Sapiens
SQKGESDIS

SEQ ID NO: 718746 - protein, 9 aa, Homo Sapiens
EGLGRAPVL

SEQ ID NO: 718747 - protein, 9 aa, Homo Sapiens
IPYAQPPIG

SEQ ID NO: 718748 - protein, 9 aa, Homo Sapiens
NQPKGVTKI

SEQ ID NO: 718749 - protein, 9 aa, Homo Sapiens
IPDAKSPHP

SEQ ID NO: 718750 - protein, 9 aa, Homo Sapiens
VGILEPSSA

SEQ ID NO: 718751 - protein, 9 aa, Homo Sapiens
EIPHGKGKI

SEQ ID NO: 718752 - protein, 9 aa, Homo Sapiens
LIYSVKKLA

SEQ ID NO: 718753 - protein, 9 aa, Homo Sapiens
PSRLEDGAS

SEQ ID NO: 718754 - protein, 9 aa, Homo Sapiens
ESCTPWPCS

SEQ ID NO: 718755 - protein, 9 aa, Homo Sapiens
EPRVQAENS

SEQ ID NO: 718756 - protein, 9 aa, Homo Sapiens
FGGAMHSAF

SEQ ID NO: 718757 - protein, 9 aa, Homo Sapiens
VPVSVTLPV

SEQ ID NO: 718758 - protein, 9 aa, Homo Sapiens
TGTLSKGCL

SEQ ID NO: 718759 - protein, 9 aa, Homo Sapiens
VEKLWLKKH

SEQ ID NO: 718760 - protein, 9 aa, Homo Sapiens
LNSQPRWPS

SEQ ID NO: 718761 - protein, 9 aa, Homo Sapiens
TYLPLKSMQ

SEQ ID NO: 718762 - protein, 9 aa, Homo Sapiens
TGLSAVSHN

SEQ ID NO: 718763 - protein, 9 aa, Homo Sapiens
VTKIINYTT

SEQ ID NO: 718764 - protein, 9 aa, Homo Sapiens
DAEVFQVQT

SEQ ID NO: 718765 - protein, 9 aa, Homo Sapiens
YPDIPKHKA

SEQ ID NO: 718766 - protein, 9 aa, Homo Sapiens
QPLPTPCAS

SEQ ID NO: 718767 - protein, 9 aa, Homo Sapiens
QDQRESPAA

SEQ ID NO: 718768 - protein, 9 aa, Homo Sapiens
PINMGLTSV

SEQ ID NO: 718769 - protein, 9 aa, Homo Sapiens
VFLYQPQWK

SEQ ID NO: 718770 - protein, 9 aa, Homo Sapiens
LQGGLPLEK

SEQ ID NO: 718771 - protein, 9 aa, Homo Sapiens
PSQYSWTIN

SEQ ID NO: 718772 - protein, 9 aa, Homo Sapiens
DDPRRSPFP

SEQ ID NO: 718773 - protein, 9 aa, Homo Sapiens
RHLSLHIEH

SEQ ID NO: 718774 - protein, 9 aa, Homo Sapiens
IKVDCEVEE

SEQ ID NO: 718775 - protein, 9 aa, Homo Sapiens
QVSTWMRAL

SEQ ID NO: 718776 - protein, 9 aa, Homo Sapiens
TVPARATTM

SEQ ID NO: 718777 - protein, 9 aa, Homo Sapiens
MAVKSSSFL

SEQ ID NO: 718778 - protein, 9 aa, Homo Sapiens
TTKSTEAAR

SEQ ID NO: 718779 - protein, 9 aa, Homo Sapiens
HPTPTVGAV

SEQ ID NO: 718780 - protein, 9 aa, Homo Sapiens
TAAHGDTSQ

SEQ ID NO: 718781 - protein, 9 aa, Homo Sapiens
GYVARIRPN

SEQ ID NO: 718782 - protein, 9 aa, Homo Sapiens
PRAQHAGIA

SEQ ID NO: 718783 - protein, 9 aa, Homo Sapiens
APSMPTVEA

SEQ ID NO: 718784 - protein, 9 aa, Homo Sapiens
GATMARGFA

SEQ ID NO: 718785 - protein, 9 aa, Homo Sapiens
YFFMLFGDL

SEQ ID NO: 718786 - protein, 9 aa, Homo Sapiens
IPAEKIDAV

SEQ ID NO: 718787 - protein, 9 aa, Homo Sapiens
TFKDVTVVF

SEQ ID NO: 718788 - protein, 9 aa, Homo Sapiens
LSVGCTGAL

SEQ ID NO: 718789 - protein, 9 aa, Homo Sapiens
VKHCPLEIP

SEQ ID NO: 718790 - protein, 9 aa, Homo Sapiens
IFRAVGPSL

SEQ ID NO: 718791 - protein, 9 aa, Homo Sapiens
FFFFFFPFF

SEQ ID NO: 718792 - protein, 9 aa, Homo Sapiens
SSLLFQHAR

SEQ ID NO: 718793 - protein, 9 aa, Homo Sapiens
TNKTTCEAC

SEQ ID NO: 718794 - protein, 9 aa, Homo Sapiens
NKMQEDTPS

SEQ ID NO: 718795 - protein, 9 aa, Homo Sapiens
TMARGFAVL

SEQ ID NO: 718796 - protein, 9 aa, Homo Sapiens
GTHVVVESI

SEQ ID NO: 718797 - protein, 9 aa, Homo Sapiens
ESLALHNIT

SEQ ID NO: 718798 - protein, 9 aa, Homo Sapiens
LTPTVGAMT

SEQ ID NO: 718799 - protein, 9 aa, Homo Sapiens
LDCWQKDWN

SEQ ID NO: 718800 - protein, 9 aa, Homo Sapiens
IKEAIKKNI

SEQ ID NO: 718801 - protein, 9 aa, Homo Sapiens
KGYSVGCLL

SEQ ID NO: 718802 - protein, 9 aa, Homo Sapiens
LAAEYSSSQ

SEQ ID NO: 718803 - protein, 9 aa, Homo Sapiens
SLHIEHEEG

SEQ ID NO: 718804 - protein, 9 aa, Homo Sapiens
QQIANAKIS

SEQ ID NO: 718805 - protein, 9 aa, Homo Sapiens
GQDLNDENQ

SEQ ID NO: 718806 - protein, 9 aa, Homo Sapiens
GCGHSWNTR

SEQ ID NO: 718807 - protein, 9 aa, Homo Sapiens
SPHPVFAYT

SEQ ID NO: 718808 - protein, 9 aa, Homo Sapiens
VLLLGKLLG

SEQ ID NO: 718809 - protein, 9 aa, Homo Sapiens
MDDYYFTSI

SEQ ID NO: 718810 - protein, 9 aa, Homo Sapiens
EAARLMPTV

SEQ ID NO: 718811 - protein, 9 aa, Homo Sapiens
WEVVLLLGK

SEQ ID NO: 718812 - protein, 9 aa, Homo Sapiens
YSNILSDSY

SEQ ID NO: 718813 - protein, 9 aa, Homo Sapiens
APLMPTVEA

SEQ ID NO: 718814 - protein, 9 aa, Homo Sapiens
AEATHPTPT

SEQ ID NO: 718815 - protein, 9 aa, Homo Sapiens
NSLSSILEG

SEQ ID NO: 718816 - protein, 9 aa, Homo Sapiens
VRLFLKSNS

SEQ ID NO: 718817 - protein, 9 aa, Homo Sapiens
ESLESQKLP

SEQ ID NO: 718818 - protein, 9 aa, Homo Sapiens
GTGTLSKGC

SEQ ID NO: 718819 - protein, 9 aa, Homo Sapiens
EADIKRSEV

SEQ ID NO: 718820 - protein, 9 aa, Homo Sapiens
EEPRVQAEN

SEQ ID NO: 718821 - protein, 9 aa, Homo Sapiens
DVKKLFHFF

SEQ ID NO: 718822 - protein, 9 aa, Homo Sapiens
FKNMQAKTE

SEQ ID NO: 718823 - protein, 9 aa, Homo Sapiens
VSTDGSSLH

SEQ ID NO: 718824 - protein, 9 aa, Homo Sapiens
IIVNNLLKP

SEQ ID NO: 718825 - protein, 9 aa, Homo Sapiens
LTMTTIIKG

SEQ ID NO: 718826 - protein, 9 aa, Homo Sapiens
HPIFGGAMH

SEQ ID NO: 718827 - protein, 9 aa, Homo Sapiens
ATEEEAATR

SEQ ID NO: 718828 - protein, 9 aa, Homo Sapiens
TPWPCSESE

SEQ ID NO: 718829 - protein, 9 aa, Homo Sapiens
HAGIAHTLP

SEQ ID NO: 718830 - protein, 9 aa, Homo Sapiens
TTVPARATA

SEQ ID NO: 718831 - protein, 9 aa, Homo Sapiens
TKAARPMPT

SEQ ID NO: 718832 - protein, 9 aa, Homo Sapiens
DPRRSPFPR

SEQ ID NO: 718833 - protein, 9 aa, Homo Sapiens
QAAQGNDAG

SEQ ID NO: 718834 - protein, 9 aa, Homo Sapiens
RILTDDLGL

SEQ ID NO: 718835 - protein, 9 aa, Homo Sapiens
SDDSYVSAV

SEQ ID NO: 718836 - protein, 9 aa, Homo Sapiens
KVTRNTLVA

SEQ ID NO: 718837 - protein, 9 aa, Homo Sapiens
IRDAGRCVC

SEQ ID NO: 718838 - protein, 9 aa, Homo Sapiens
QEARPTNRL

SEQ ID NO: 718839 - protein, 9 aa, Homo Sapiens
TTVPARATT

SEQ ID NO: 718840 - protein, 9 aa, Homo Sapiens
IVLAGDHMH

SEQ ID NO: 718841 - protein, 9 aa, Homo Sapiens
DQRPPPPYP

SEQ ID NO: 718842 - protein, 9 aa, Homo Sapiens
PWRQDSDED

SEQ ID NO: 718843 - protein, 9 aa, Homo Sapiens
GNSLSSILE

SEQ ID NO: 718844 - protein, 9 aa, Homo Sapiens
TMTTIIKGV

SEQ ID NO: 718845 - protein, 9 aa, Homo Sapiens
VHNAAGQAG

SEQ ID NO: 718846 - protein, 8 aa, Homo Sapiens
AGTNALLM

SEQ ID NO: 718847 - protein, 9 aa, Homo Sapiens
PHVFQGWKD

SEQ ID NO: 718848 - protein, 9 aa, Homo Sapiens
NFEESHGLQ

SEQ ID NO: 718849 - protein, 9 aa, Homo Sapiens
GRDDQRPPP

SEQ ID NO: 718850 - protein, 9 aa, Homo Sapiens
PFTLLLPQA

SEQ ID NO: 718851 - protein, 9 aa, Homo Sapiens
FTLSVRLDY

SEQ ID NO: 718852 - protein, 9 aa, Homo Sapiens
EGVNSSIEE

SEQ ID NO: 718853 - protein, 9 aa, Homo Sapiens
AAEYSSSQP

SEQ ID NO: 718854 - protein, 9 aa, Homo Sapiens
RRTEVTLSM

SEQ ID NO: 718855 - protein, 9 aa, Homo Sapiens
LDQLKDDDI

SEQ ID NO: 718856 - protein, 9 aa, Homo Sapiens
GNVSKQANP

SEQ ID NO: 718857 - protein, 9 aa, Homo Sapiens
HLSLHIEHE

SEQ ID NO: 718858 - protein, 9 aa, Homo Sapiens
EKGYSVGCL

SEQ ID NO: 718859 - protein, 9 aa, Homo Sapiens
VDVGKLVSK

SEQ ID NO: 718860 - protein, 9 aa, Homo Sapiens
CLLQEVMKF

SEQ ID NO: 718861 - protein, 9 aa, Homo Sapiens
PTDAPAADQ

SEQ ID NO: 718862 - protein, 9 aa, Homo Sapiens
GSGPPMQFM

SEQ ID NO: 718863 - protein, 9 aa, Homo Sapiens
EYSSSQPPQ

SEQ ID NO: 718864 - protein, 9 aa, Homo Sapiens
EQYIKATAT

SEQ ID NO: 718865 - protein, 9 aa, Homo Sapiens
CRRSGKWTS

SEQ ID NO: 718866 - protein, 9 aa, Homo Sapiens
KCPPPKTEN

SEQ ID NO: 718867 - protein, 9 aa, Homo Sapiens
GAVKHCPLE

SEQ ID NO: 718868 - protein, 9 aa, Homo Sapiens
SLESQKLPS

SEQ ID NO: 718869 - protein, 9 aa, Homo Sapiens
NRAARHLCQ

SEQ ID NO: 718870 - protein, 9 aa, Homo Sapiens
RLWAAQRIH

SEQ ID NO: 718871 - protein, 9 aa, Homo Sapiens
LTETEGELK

SEQ ID NO: 718872 - protein, 9 aa, Homo Sapiens
ISQPGLSLH

SEQ ID NO: 718873 - protein, 9 aa, Homo Sapiens
QQEARPTNR

SEQ ID NO: 718874 - protein, 9 aa, Homo Sapiens
LAGPLEYPS

SEQ ID NO: 718875 - protein, 9 aa, Homo Sapiens
SSIELKRIH

SEQ ID NO: 718876 - protein, 9 aa, Homo Sapiens
PLLLAFLVI

SEQ ID NO: 718877 - protein, 9 aa, Homo Sapiens
TTALPGGFK

SEQ ID NO: 718878 - protein, 9 aa, Homo Sapiens
SRKAQQEAR

SEQ ID NO: 718879 - protein, 9 aa, Homo Sapiens
PCPKIKVDC

SEQ ID NO: 718880 - protein, 9 aa, Homo Sapiens
AAPLMPTVE

SEQ ID NO: 718881 - protein, 9 aa, Homo Sapiens
TLSKGCLSR

SEQ ID NO: 718882 - protein, 9 aa, Homo Sapiens
CAEGIEGNG

SEQ ID NO: 718883 - protein, 9 aa, Homo Sapiens
QSRILTDDL

SEQ ID NO: 718884 - protein, 9 aa, Homo Sapiens
AKDIVKLVV

SEQ ID NO: 718885 - protein, 9 aa, Homo Sapiens
QSSLVIPTW

SEQ ID NO: 718886 - protein, 9 aa, Homo Sapiens
VAATRIVYP

SEQ ID NO: 718887 - protein, 9 aa, Homo Sapiens
QLAVNQRPE

SEQ ID NO: 718888 - protein, 9 aa, Homo Sapiens
RLPFAAGSV

SEQ ID NO: 718889 - protein, 9 aa, Homo Sapiens
LLPQESKKL

SEQ ID NO: 718890 - protein, 9 aa, Homo Sapiens
LPEINKVPG

SEQ ID NO: 718891 - protein, 9 aa, Homo Sapiens
DLQILLHIR

SEQ ID NO: 718892 - protein, 9 aa, Homo Sapiens
RSEVELQQA

SEQ ID NO: 718893 - protein, 9 aa, Homo Sapiens
IEHEEGSLA

SEQ ID NO: 718894 - protein, 9 aa, Homo Sapiens
AQQEARPTN

SEQ ID NO: 718895 - protein, 9 aa, Homo Sapiens
CVSCLSGQR

SEQ ID NO: 718896 - protein, 9 aa, Homo Sapiens
TYTLVPVSV

SEQ ID NO: 718897 - protein, 9 aa, Homo Sapiens
TETEGELKD

SEQ ID NO: 718898 - protein, 9 aa, Homo Sapiens
DNVELTVST

SEQ ID NO: 718899 - protein, 9 aa, Homo Sapiens
RRQQRANRG

SEQ ID NO: 718900 - protein, 9 aa, Homo Sapiens
SPWRQDSDE

SEQ ID NO: 718901 - protein, 9 aa, Homo Sapiens
EMPLQSCLV

SEQ ID NO: 718902 - protein, 9 aa, Homo Sapiens
VPGVLTWRF

SEQ ID NO: 718903 - protein, 9 aa, Homo Sapiens
AGTTTPKPT

SEQ ID NO: 718904 - protein, 9 aa, Homo Sapiens
WGPRATLTR

SEQ ID NO: 718905 - protein, 9 aa, Homo Sapiens
NQRPEWLVT

SEQ ID NO: 718906 - protein, 9 aa, Homo Sapiens
HKYPSQKPL

SEQ ID NO: 718907 - protein, 9 aa, Homo Sapiens
NAASSTPPS

SEQ ID NO: 718908 - protein, 9 aa, Homo Sapiens
TQMYFFMLF

SEQ ID NO: 718909 - protein, 9 aa, Homo Sapiens
SSLVIPTWL

SEQ ID NO: 718910 - protein, 9 aa, Homo Sapiens
HTISCSYCG

SEQ ID NO: 718911 - protein, 9 aa, Homo Sapiens
VPARATTME

SEQ ID NO: 718912 - protein, 9 aa, Homo Sapiens
KRIHDSMAV

SEQ ID NO: 718913 - protein, 9 aa, Homo Sapiens
ATRSTEAAR

SEQ ID NO: 718914 - protein, 9 aa, Homo Sapiens
ATRSTEAAP

SEQ ID NO: 718915 - protein, 9 aa, Homo Sapiens
RRRGLSRWG

SEQ ID NO: 718916 - protein, 9 aa, Homo Sapiens
SVLAPHFPI

SEQ ID NO: 718917 - protein, 9 aa, Homo Sapiens
KSLGMIFKK

SEQ ID NO: 718918 - protein, 9 aa, Homo Sapiens
SMPTAEAAH

SEQ ID NO: 718919 - protein, 9 aa, Homo Sapiens
ATTVPAGTT

SEQ ID NO: 718920 - protein, 9 aa, Homo Sapiens
ATRSTEAAC

SEQ ID NO: 718921 - protein, 9 aa, Homo Sapiens
PVIQQPEIL

SEQ ID NO: 718922 - protein, 9 aa, Homo Sapiens
HPMPTAGAT

SEQ ID NO: 718923 - protein, 9 aa, Homo Sapiens
DTETAMKEV

SEQ ID NO: 718924 - protein, 9 aa, Homo Sapiens
RATLTRPPR

SEQ ID NO: 718925 - protein, 9 aa, Homo Sapiens
ENQLFPNNF

SEQ ID NO: 718926 - protein, 9 aa, Homo Sapiens
TAGTTTPKP

SEQ ID NO: 718927 - protein, 9 aa, Homo Sapiens
VFAIGFCTG

SEQ ID NO: 718928 - protein, 9 aa, Homo Sapiens
RSTEATRLM

SEQ ID NO: 718929 - protein, 9 aa, Homo Sapiens
LTFGANDVV

SEQ ID NO: 718930 - protein, 9 aa, Homo Sapiens
PDGKEMAQE

SEQ ID NO: 718931 - protein, 9 aa, Homo Sapiens
CELIPADLV

SEQ ID NO: 718932 - protein, 9 aa, Homo Sapiens
KKIPDPYSD

SEQ ID NO: 718933 - protein, 9 aa, Homo Sapiens
LLPFTLLLP

SEQ ID NO: 718934 - protein, 9 aa, Homo Sapiens
WMVVFAIGF

SEQ ID NO: 718935 - protein, 9 aa, Homo Sapiens
TMYGVLNPI

SEQ ID NO: 718936 - protein, 9 aa, Homo Sapiens
NLDQLKDDD

SEQ ID NO: 718937 - protein, 9 aa, Homo Sapiens
EPEKAAGSF

SEQ ID NO: 718938 - protein, 9 aa, Homo Sapiens
GIPTYTLVP

SEQ ID NO: 718939 - protein, 9 aa, Homo Sapiens
HQDTSYVGN

SEQ ID NO: 718940 - protein, 9 aa, Homo Sapiens
LECQQDHKY

SEQ ID NO: 718941 - protein, 9 aa, Homo Sapiens
YKCEAFGKA

SEQ ID NO: 718942 - protein, 9 aa, Homo Sapiens
SQLSKPCRF

SEQ ID NO: 718943 - protein, 9 aa, Homo Sapiens
APPRTPSYL

SEQ ID NO: 718944 - protein, 9 aa, Homo Sapiens
HGRAPQLRE

SEQ ID NO: 718945 - protein, 9 aa, Homo Sapiens
FDLYITICL

SEQ ID NO: 718946 - protein, 9 aa, Homo Sapiens
MVTFKDVTV

SEQ ID NO: 718947 - protein, 9 aa, Homo Sapiens
VEGARAADD

SEQ ID NO: 718948 - protein, 9 aa, Homo Sapiens
QQLKVARKQ

SEQ ID NO: 718949 - protein, 9 aa, Homo Sapiens
TVLARATAT

SEQ ID NO: 718950 - protein, 9 aa, Homo Sapiens
NQTLNNSTW

SEQ ID NO: 718951 - protein, 9 aa, Homo Sapiens
PMPTAGATT

SEQ ID NO: 718952 - protein, 9 aa, Homo Sapiens
ASVFHVINI

SEQ ID NO: 718953 - protein, 9 aa, Homo Sapiens
PITVPYNIQ

SEQ ID NO: 718954 - protein, 9 aa, Homo Sapiens
AAGKVLRSK

SEQ ID NO: 718955 - protein, 9 aa, Homo Sapiens
QPPIGRLRF

SEQ ID NO: 718956 - protein, 9 aa, Homo Sapiens
SDKFNEHYS

SEQ ID NO: 718957 - protein, 9 aa, Homo Sapiens
AQFPYPASI

SEQ ID NO: 718958 - protein, 9 aa, Homo Sapiens
RNNPEPGVR

SEQ ID NO: 718959 - protein, 9 aa, Homo Sapiens
NESCKLTCF

SEQ ID NO: 718960 - protein, 9 aa, Homo Sapiens
FEYVWQLVF

SEQ ID NO: 718961 - protein, 9 aa, Homo Sapiens
SLSSILEGE

SEQ ID NO: 718962 - protein, 9 aa, Homo Sapiens
NDAGLQRQL

SEQ ID NO: 718963 - protein, 9 aa, Homo Sapiens
DVTVVFTEE

SEQ ID NO: 718964 - protein, 9 aa, Homo Sapiens
AVDSLTVWC

SEQ ID NO: 718965 - protein, 9 aa, Homo Sapiens
FPVSSQGCD

SEQ ID NO: 718966 - protein, 9 aa, Homo Sapiens
QQAAQGNDA

SEQ ID NO: 718967 - protein, 9 aa, Homo Sapiens
PGGFKQAIP

SEQ ID NO: 718968 - protein, 9 aa, Homo Sapiens
KFCSVLAPH

SEQ ID NO: 718969 - protein, 9 aa, Homo Sapiens
LNRCVSCLS

SEQ ID NO: 718970 - protein, 9 aa, Homo Sapiens
TVRLFLKSN

SEQ ID NO: 718971 - protein, 9 aa, Homo Sapiens
SLALHNITV

SEQ ID NO: 718972 - protein, 9 aa, Homo Sapiens
EDLKDAEVF

SEQ ID NO: 718973 - protein, 9 aa, Homo Sapiens
VNQRPEWLV

SEQ ID NO: 718974 - protein, 9 aa, Homo Sapiens
CLSGQRDVD

SEQ ID NO: 718975 - protein, 9 aa, Homo Sapiens
ADVFKNMQA

SEQ ID NO: 718976 - protein, 9 aa, Homo Sapiens
GATAMEEEA

SEQ ID NO: 718977 - protein, 9 aa, Homo Sapiens
EINKVPGFL

SEQ ID NO: 718978 - protein, 9 aa, Homo Sapiens
GDHMHLSPF

SEQ ID NO: 718979 - protein, 9 aa, Homo Sapiens
CLTQMYFFM

SEQ ID NO: 718980 - protein, 9 aa, Homo Sapiens
DRTRKGAIL

SEQ ID NO: 718981 - protein, 9 aa, Homo Sapiens
AALPTPTVG

SEQ ID NO: 718982 - protein, 9 aa, Homo Sapiens
VFKNMQAKT

SEQ ID NO: 718983 - protein, 9 aa, Homo Sapiens
ILDRTRKGA

SEQ ID NO: 718984 - protein, 9 aa, Homo Sapiens
RSTEAAPSM

SEQ ID NO: 718985 - protein, 9 aa, Homo Sapiens
GESDTNKTT

SEQ ID NO: 718986 - protein, 9 aa, Homo Sapiens
TLMEQYIKA

SEQ ID NO: 718987 - protein, 9 aa, Homo Sapiens
ANMSSQALQ

SEQ ID NO: 718988 - protein, 9 aa, Homo Sapiens
SCTPWPCSE

SEQ ID NO: 718989 - protein, 9 aa, Homo Sapiens
AATRIVYPL

SEQ ID NO: 718990 - protein, 9 aa, Homo Sapiens
MIPEFFCDR

SEQ ID NO: 718991 - protein, 9 aa, Homo Sapiens
LVVMAFDLY

SEQ ID NO: 718992 - protein, 9 aa, Homo Sapiens
TLVAIRKRI

SEQ ID NO: 718993 - protein, 9 aa, Homo Sapiens
RFGQGVHNA

SEQ ID NO: 718994 - protein, 9 aa, Homo Sapiens
PATVTTGAT

SEQ ID NO: 718995 - protein, 9 aa, Homo Sapiens
REQLEGVNS

SEQ ID NO: 718996 - protein, 9 aa, Homo Sapiens
TTVLARATA

SEQ ID NO: 718997 - protein, 9 aa, Homo Sapiens
SRWGPRATL

SEQ ID NO: 718998 - protein, 9 aa, Homo Sapiens
ELKRIHDSM

SEQ ID NO: 718999 - protein, 9 aa, Homo Sapiens
HCVEGLGRA

SEQ ID NO: 719000 - protein, 9 aa, Homo Sapiens
VFSHLTASQ

SEQ ID NO: 719001 - protein, 9 aa, Homo Sapiens
ASVMVMGCI

SEQ ID NO: 719002 - protein, 9 aa, Homo Sapiens
KSTEAARTT

SEQ ID NO: 719003 - protein, 9 aa, Homo Sapiens
EAARTTPTA

SEQ ID NO: 719004 - protein, 9 aa, Homo Sapiens
TAIPNRAIT

SEQ ID NO: 719005 - protein, 9 aa, Homo Sapiens
AKNGPDTEK

SEQ ID NO: 719006 - protein, 9 aa, Homo Sapiens
SVLAGPCAH

SEQ ID NO: 719007 - protein, 9 aa, Homo Sapiens
LEEDIRQVL

SEQ ID NO: 719008 - protein, 9 aa, Homo Sapiens
QNAQSKMES

SEQ ID NO: 719009 - protein, 9 aa, Homo Sapiens
PPRTPSYLG

SEQ ID NO: 719010 - protein, 9 aa, Homo Sapiens
SVGCLLQEV

SEQ ID NO: 719011 - protein, 9 aa, Homo Sapiens
ETQLAVNQR

SEQ ID NO: 719012 - protein, 9 aa, Homo Sapiens
AKSPHPVFA

SEQ ID NO: 719013 - protein, 9 aa, Homo Sapiens
TAGATTVPA

SEQ ID NO: 719014 - protein, 9 aa, Homo Sapiens
MSSLGLELP

SEQ ID NO: 719015 - protein, 9 aa, Homo Sapiens
TCKCLCTDG

SEQ ID NO: 719016 - protein, 9 aa, Homo Sapiens
PTVGAVTVP

SEQ ID NO: 719017 - protein, 9 aa, Homo Sapiens
QDHKYPSQK

SEQ ID NO: 719018 - protein, 9 aa, Homo Sapiens
CEAFGKAYK

SEQ ID NO: 719019 - protein, 9 aa, Homo Sapiens
MGRTSGYVA

SEQ ID NO: 719020 - protein, 9 aa, Homo Sapiens
CMHCPYINT

SEQ ID NO: 719021 - protein, 9 aa, Homo Sapiens
TPTVGAVTV

SEQ ID NO: 719022 - protein, 9 aa, Homo Sapiens
VPEDLKDAE

SEQ ID NO: 719023 - protein, 9 aa, Homo Sapiens
NSQPRWPSW

SEQ ID NO: 719024 - protein, 9 aa, Homo Sapiens
VMGCIFAFA

SEQ ID NO: 719025 - protein, 9 aa, Homo Sapiens
PLSGTTTTK

SEQ ID NO: 719026 - protein, 9 aa, Homo Sapiens
TEAPRLTPT

SEQ ID NO: 719027 - protein, 9 aa, Homo Sapiens
AFSFDLQNA

SEQ ID NO: 719028 - protein, 9 aa, Homo Sapiens
VYSNILSDS

SEQ ID NO: 719029 - protein, 9 aa, Homo Sapiens
ARKRKHTIS

SEQ ID NO: 719030 - protein, 9 aa, Homo Sapiens
LPGGFKQAI

SEQ ID NO: 719031 - protein, 9 aa, Homo Sapiens
MPTAVAACL

SEQ ID NO: 719032 - protein, 9 aa, Homo Sapiens
AEKGYSVGC

SEQ ID NO: 719033 - protein, 9 aa, Homo Sapiens
SFSQQRQQR

SEQ ID NO: 719034 - protein, 9 aa, Homo Sapiens
GQLDSLFSV

SEQ ID NO: 719035 - protein, 9 aa, Homo Sapiens
EHEEGSLAG

SEQ ID NO: 719036 - protein, 9 aa, Homo Sapiens
LVFAGSEGE

SEQ ID NO: 719037 - protein, 9 aa, Homo Sapiens
EEAAATRST

SEQ ID NO: 719038 - protein, 9 aa, Homo Sapiens
QASVHVSYF

SEQ ID NO: 719039 - protein, 9 aa, Homo Sapiens
YLAGPLEYP

SEQ ID NO: 719040 - protein, 9 aa, Homo Sapiens
QPKGVTKII

SEQ ID NO: 719041 - protein, 9 aa, Homo Sapiens
AARTTPTAG

SEQ ID NO: 719042 - protein, 9 aa, Homo Sapiens
YNFEESHGL

SEQ ID NO: 719043 - protein, 9 aa, Homo Sapiens
TTVPAGTTP

SEQ ID NO: 719044 - protein, 9 aa, Homo Sapiens
ADVTTFQPN

SEQ ID NO: 719045 - protein, 9 aa, Homo Sapiens
NPPSQYSWT

SEQ ID NO: 719046 - protein, 9 aa, Homo Sapiens
KERAANPLL

SEQ ID NO: 719047 - protein, 9 aa, Homo Sapiens
AIKKNIGQA

SEQ ID NO: 719048 - protein, 9 aa, Homo Sapiens
ERANMSSQA

SEQ ID NO: 719049 - protein, 9 aa, Homo Sapiens
AATVSATAM

SEQ ID NO: 719050 - protein, 9 aa, Homo Sapiens
RAVISTVEG

SEQ ID NO: 719051 - protein, 9 aa, Homo Sapiens
QKLPSQVLP

SEQ ID NO: 719052 - protein, 9 aa, Homo Sapiens
PARATTMEE

SEQ ID NO: 719053 - protein, 9 aa, Homo Sapiens
MITAFEEPR

SEQ ID NO: 719054 - protein, 9 aa, Homo Sapiens
VSKQANPEA

SEQ ID NO: 719055 - protein, 9 aa, Homo Sapiens
DDEEEAALE

SEQ ID NO: 719056 - protein, 9 aa, Homo Sapiens
LQKMDSVLS

SEQ ID NO: 719057 - protein, 9 aa, Homo Sapiens
CKCLCTDGY

SEQ ID NO: 719058 - protein, 9 aa, Homo Sapiens
GFDVFKCPP

SEQ ID NO: 719059 - protein, 9 aa, Homo Sapiens
KEAIKKNIG

SEQ ID NO: 719060 - protein, 9 aa, Homo Sapiens
GFELMDDYY

SEQ ID NO: 719061 - protein, 9 aa, Homo Sapiens
KLHQDTSYV

SEQ ID NO: 719062 - protein, 9 aa, Homo Sapiens
SQMLDILLT

SEQ ID NO: 719063 - protein, 9 aa, Homo Sapiens
LLTEFVLTV

SEQ ID NO: 719064 - protein, 9 aa, Homo Sapiens
KSDSTFHNH

SEQ ID NO: 719065 - protein, 9 aa, Homo Sapiens
SQRIIKQQG

SEQ ID NO: 719066 - protein, 9 aa, Homo Sapiens
AQPPIGRLR

SEQ ID NO: 719067 - protein, 9 aa, Homo Sapiens
MQFMDCMAD

SEQ ID NO: 719068 - protein, 9 aa, Homo Sapiens
QEYQDPVPE

SEQ ID NO: 719069 - protein, 9 aa, Homo Sapiens
AHPSVGATG

SEQ ID NO: 719070 - protein, 9 aa, Homo Sapiens
FPQVSTWMR

SEQ ID NO: 719071 - protein, 9 aa, Homo Sapiens
ANSNPPSQY

SEQ ID NO: 719072 - protein, 9 aa, Homo Sapiens
DLYITICLP

SEQ ID NO: 719073 - protein, 9 aa, Homo Sapiens
LHAMLAKSD

SEQ ID NO: 719074 - protein, 9 aa, Homo Sapiens
LSAVSHNGS

SEQ ID NO: 719075 - protein, 9 aa, Homo Sapiens
PPMQFMDCM

SEQ ID NO: 719076 - protein, 9 aa, Homo Sapiens
VPATVTTGA

SEQ ID NO: 719077 - protein, 9 aa, Homo Sapiens
LSRWGPRAT

SEQ ID NO: 719078 - protein, 9 aa, Homo Sapiens
ESIFTNATP

SEQ ID NO: 719079 - protein, 9 aa, Homo Sapiens
AITPGDRGS

SEQ ID NO: 719080 - protein, 9 aa, Homo Sapiens
IETVGHAKD

SEQ ID NO: 719081 - protein, 9 aa, Homo Sapiens
SVTGTAVDS

SEQ ID NO: 719082 - protein, 9 aa, Homo Sapiens
TFGANDVVC

SEQ ID NO: 719083 - protein, 9 aa, Homo Sapiens
DIKRSEVEL

SEQ ID NO: 719084 - protein, 9 aa, Homo Sapiens
GVLTWRFCR

SEQ ID NO: 719085 - protein, 9 aa, Homo Sapiens
CVGDGDEDT

SEQ ID NO: 719086 - protein, 9 aa, Homo Sapiens
WQKDWNSRP

SEQ ID NO: 719087 - protein, 9 aa, Homo Sapiens
RAPTFQVIS

SEQ ID NO: 719088 - protein, 9 aa, Homo Sapiens
GPCAHPSVG

SEQ ID NO: 719089 - protein, 9 aa, Homo Sapiens
PSQKPLSWQ

SEQ ID NO: 719090 - protein, 9 aa, Homo Sapiens
CVAITPGDR

SEQ ID NO: 719091 - protein, 9 aa, Homo Sapiens
FRNTQAAIK

SEQ ID NO: 719092 - protein, 9 aa, Homo Sapiens
PIGRLRFKK

SEQ ID NO: 719093 - protein, 9 aa, Homo Sapiens
GANSCLLKD

SEQ ID NO: 719094 - protein, 9 aa, Homo Sapiens
MPTVEAARP

SEQ ID NO: 719095 - protein, 9 aa, Homo Sapiens
DMGSGTIKA

SEQ ID NO: 719096 - protein, 9 aa, Homo Sapiens
PSATLSPLA

SEQ ID NO: 719097 - protein, 9 aa, Homo Sapiens
MPTVEAARL

SEQ ID NO: 719098 - protein, 9 aa, Homo Sapiens
FAAGSVFSI

SEQ ID NO: 719099 - protein, 9 aa, Homo Sapiens
TINVLQSKD

SEQ ID NO: 719100 - protein, 9 aa, Homo Sapiens
GKEFSQSLR

SEQ ID NO: 719101 - protein, 9 aa, Homo Sapiens
VSQNKSNLT

SEQ ID NO: 719102 - protein, 9 aa, Homo Sapiens
LNRKFRPFR

SEQ ID NO: 719103 - protein, 9 aa, Homo Sapiens
KGESDISNA

SEQ ID NO: 719104 - protein, 9 aa, Homo Sapiens
IVPLETREY

SEQ ID NO: 719105 - protein, 9 aa, Homo Sapiens
WTMVAATRI

SEQ ID NO: 719106 - protein, 9 aa, Homo Sapiens
RTTPTAGAD

SEQ ID NO: 719107 - protein, 9 aa, Homo Sapiens
SYVGNFIST

SEQ ID NO: 719108 - protein, 9 aa, Homo Sapiens
VTTFQPNSN

SEQ ID NO: 719109 - protein, 9 aa, Homo Sapiens
PTTVMAGAT

SEQ ID NO: 719110 - protein, 9 aa, Homo Sapiens
GAMTVPAGA

SEQ ID NO: 719111 - protein, 9 aa, Homo Sapiens
MSSQALQMS

SEQ ID NO: 719112 - protein, 9 aa, Homo Sapiens
GLFRSHNGN

SEQ ID NO: 719113 - protein, 9 aa, Homo Sapiens
KLLKLECKQ

SEQ ID NO: 719114 - protein, 9 aa, Homo Sapiens
RVRAMAICK

SEQ ID NO: 719115 - protein, 9 aa, Homo Sapiens
EHTAIPNRA

SEQ ID NO: 719116 - protein, 9 aa, Homo Sapiens
TRSTEAPRL

SEQ ID NO: 719117 - protein, 9 aa, Homo Sapiens
LETREYDFI

SEQ ID NO: 719118 - protein, 9 aa, Homo Sapiens
IGKDGTRHD

SEQ ID NO: 719119 - protein, 9 aa, Homo Sapiens
RCTVFFQES

SEQ ID NO: 719120 - protein, 9 aa, Homo Sapiens
QGTGTLSKG

SEQ ID NO: 719121 - protein, 9 aa, Homo Sapiens
AGAATVSAT

SEQ ID NO: 719122 - protein, 9 aa, Homo Sapiens
ATRLMPTAE

SEQ ID NO: 719123 - protein, 9 aa, Homo Sapiens
YLAMDESSI

SEQ ID NO: 719124 - protein, 9 aa, Homo Sapiens
AAKKEPLWY

SEQ ID NO: 719125 - protein, 9 aa, Homo Sapiens
TLSPLAAGP

SEQ ID NO: 719126 - protein, 9 aa, Homo Sapiens
VDPNKQNLN

SEQ ID NO: 719127 - protein, 9 aa, Homo Sapiens
SGVLMRMAL

SEQ ID NO: 719128 - protein, 9 aa, Homo Sapiens
VLTMTTIIK

SEQ ID NO: 719129 - protein, 9 aa, Homo Sapiens
GAAASTVPT

SEQ ID NO: 719130 - protein, 9 aa, Homo Sapiens
VPTTVMAGA

SEQ ID NO: 719131 - protein, 9 aa, Homo Sapiens
QKPLSWQPE

SEQ ID NO: 719132 - protein, 9 aa, Homo Sapiens
ALPGHHGNG

SEQ ID NO: 719133 - protein, 9 aa, Homo Sapiens
VVMAFDLYI

SEQ ID NO: 719134 - protein, 9 aa, Homo Sapiens
DHVFPDTSV

SEQ ID NO: 719135 - protein, 9 aa, Homo Sapiens
LHIEHEEGS

SEQ ID NO: 719136 - protein, 9 aa, Homo Sapiens
TKFCSVLAP

SEQ ID NO: 719137 - protein, 9 aa, Homo Sapiens
PLQSCLVHT

SEQ ID NO: 719138 - protein, 9 aa, Homo Sapiens
NDLGQLDSL

SEQ ID NO: 719139 - protein, 9 aa, Homo Sapiens
AMAGVTITE

SEQ ID NO: 719140 - protein, 9 aa, Homo Sapiens
KDIVKLVVR

SEQ ID NO: 719141 - protein, 9 aa, Homo Sapiens
SGQRDVDNA

SEQ ID NO: 719142 - protein, 9 aa, Homo Sapiens
EVTLSMPTA

SEQ ID NO: 719143 - protein, 9 aa, Homo Sapiens
KPVFSIGDA

SEQ ID NO: 719144 - protein, 9 aa, Homo Sapiens
SRQESREVA

SEQ ID NO: 719145 - protein, 9 aa, Homo Sapiens
VMAFDLYIT

SEQ ID NO: 719146 - protein, 9 aa, Homo Sapiens
AICKQSQHM

SEQ ID NO: 719147 - protein, 9 aa, Homo Sapiens
LGMIFKKRS

SEQ ID NO: 719148 - protein, 9 aa, Homo Sapiens
VSCPSSLPM

SEQ ID NO: 719149 - protein, 9 aa, Homo Sapiens
RAGPGCGHS

SEQ ID NO: 719150 - protein, 9 aa, Homo Sapiens
VGVVKVGIL

SEQ ID NO: 719151 - protein, 9 aa, Homo Sapiens
PLEAEDNMK

SEQ ID NO: 719152 - protein, 9 aa, Homo Sapiens
RCGNQRYKR

SEQ ID NO: 719153 - protein, 9 aa, Homo Sapiens
SFCENRLKK

SEQ ID NO: 719154 - protein, 9 aa, Homo Sapiens
YRGRSHDAT

SEQ ID NO: 719155 - protein, 9 aa, Homo Sapiens
HGLQEWVTS

SEQ ID NO: 719156 - protein, 9 aa, Homo Sapiens
EDALPGHHG

SEQ ID NO: 719157 - protein, 9 aa, Homo Sapiens
AKVENRGNP

SEQ ID NO: 719158 - protein, 9 aa, Homo Sapiens
TRPPRTWVP

SEQ ID NO: 719159 - protein, 9 aa, Homo Sapiens
LAKSDLHPI

SEQ ID NO: 719160 - protein, 9 aa, Homo Sapiens
TVTQVGWDG

SEQ ID NO: 719161 - protein, 9 aa, Homo Sapiens
QNKSNLTHW

SEQ ID NO: 719162 - protein, 9 aa, Homo Sapiens
HIEHEEGSL

SEQ ID NO: 719163 - protein, 9 aa, Homo Sapiens
STEAARSMP

SEQ ID NO: 719164 - protein, 9 aa, Homo Sapiens
NDVVCTRIY

SEQ ID NO: 719165 - protein, 9 aa, Homo Sapiens
WRQDSDEDD

SEQ ID NO: 719166 - protein, 9 aa, Homo Sapiens
YRPQDRIVS

SEQ ID NO: 719167 - protein, 9 aa, Homo Sapiens
KVLIDLQIL

SEQ ID NO: 719168 - protein, 9 aa, Homo Sapiens
AAASTVPTT

SEQ ID NO: 719169 - protein, 9 aa, Homo Sapiens
TDDLGLSQD

SEQ ID NO: 719170 - protein, 9 aa, Homo Sapiens
LPPMQKNVV

SEQ ID NO: 719171 - protein, 9 aa, Homo Sapiens
DATVGAALP

SEQ ID NO: 719172 - protein, 9 aa, Homo Sapiens
AEEYDTDEI

SEQ ID NO: 719173 - protein, 9 aa, Homo Sapiens
GLRAPTFQV

SEQ ID NO: 719174 - protein, 9 aa, Homo Sapiens
LSRGRDTRS

SEQ ID NO: 719175 - protein, 9 aa, Homo Sapiens
VFPDTSVSL

SEQ ID NO: 719176 - protein, 9 aa, Homo Sapiens
TRCRKEDAL

SEQ ID NO: 719177 - protein, 9 aa, Homo Sapiens
VQALAALVY

SEQ ID NO: 719178 - protein, 9 aa, Homo Sapiens
PAEEEAATR

SEQ ID NO: 719179 - protein, 9 aa, Homo Sapiens
SVGCTGALP

SEQ ID NO: 719180 - protein, 9 aa, Homo Sapiens
DQLKDDDIL

SEQ ID NO: 719181 - protein, 9 aa, Homo Sapiens
AGAAASTVP

SEQ ID NO: 719182 - protein, 9 aa, Homo Sapiens
SAWIWMLYM

SEQ ID NO: 719183 - protein, 9 aa, Homo Sapiens
RVKAELLRR

SEQ ID NO: 719184 - protein, 9 aa, Homo Sapiens
YTQPQAKGV

SEQ ID NO: 719185 - protein, 9 aa, Homo Sapiens
LYKCEECAK

SEQ ID NO: 719186 - protein, 9 aa, Homo Sapiens
GFHCKPAKA

SEQ ID NO: 719187 - protein, 9 aa, Homo Sapiens
FGKAYKSSS

SEQ ID NO: 719188 - protein, 9 aa, Homo Sapiens
YAQPPIGRL

SEQ ID NO: 719189 - protein, 9 aa, Homo Sapiens
SDISNAEKD

SEQ ID NO: 719190 - protein, 9 aa, Homo Sapiens
PAPAQLTLN

SEQ ID NO: 719191 - protein, 9 aa, Homo Sapiens
HPHVFQGWK

SEQ ID NO: 719192 - protein, 9 aa, Homo Sapiens
MLDCWQKDW

SEQ ID NO: 719193 - protein, 9 aa, Homo Sapiens
YELHAMLAK

SEQ ID NO: 719194 - protein, 9 aa, Homo Sapiens
PDNVELTVS

SEQ ID NO: 719195 - protein, 9 aa, Homo Sapiens
FSQRSHVVT

SEQ ID NO: 719196 - protein, 9 aa, Homo Sapiens
GKEMAQEYD

SEQ ID NO: 719197 - protein, 9 aa, Homo Sapiens
VGPKAFKLL

SEQ ID NO: 719198 - protein, 9 aa, Homo Sapiens
WLFCKTFPF

SEQ ID NO: 719199 - protein, 9 aa, Homo Sapiens
LAAGPGSGG

SEQ ID NO: 719200 - protein, 9 aa, Homo Sapiens
MVAATRIVY

SEQ ID NO: 719201 - protein, 9 aa, Homo Sapiens
LSLHIEHEE

SEQ ID NO: 719202 - protein, 9 aa, Homo Sapiens
ACVSTDGSS

SEQ ID NO: 719203 - protein, 9 aa, Homo Sapiens
FSQSLRLQT

SEQ ID NO: 719204 - protein, 9 aa, Homo Sapiens
APAADQPPS

SEQ ID NO: 719205 - protein, 9 aa, Homo Sapiens
SILEGEARL

SEQ ID NO: 719206 - protein, 9 aa, Homo Sapiens
AMLAKSDLH

SEQ ID NO: 719207 - protein, 9 aa, Homo Sapiens
TQSADVTTF

SEQ ID NO: 719208 - protein, 9 aa, Homo Sapiens
LWGVLCPIY

SEQ ID NO: 719209 - protein, 9 aa, Homo Sapiens
EVELQQASA

SEQ ID NO: 719210 - protein, 9 aa, Homo Sapiens
ITVPYNIQF

SEQ ID NO: 719211 - protein, 9 aa, Homo Sapiens
DGLLGTNLS

SEQ ID NO: 719212 - protein, 9 aa, Homo Sapiens
LAMDESSIF

SEQ ID NO: 719213 - protein, 9 aa, Homo Sapiens
VSKLQDGGT

SEQ ID NO: 719214 - protein, 9 aa, Homo Sapiens
ISSDKFNEH

SEQ ID NO: 719215 - protein, 9 aa, Homo Sapiens
SWGSGPPMQ

SEQ ID NO: 719216 - protein, 9 aa, Homo Sapiens
PRATLTRPP

SEQ ID NO: 719217 - protein, 9 aa, Homo Sapiens
YSSSQPPQQ

SEQ ID NO: 719218 - protein, 9 aa, Homo Sapiens
SQWLPAVIA

SEQ ID NO: 719219 - protein, 9 aa, Homo Sapiens
ESDISNAEK

SEQ ID NO: 719220 - protein, 9 aa, Homo Sapiens
DQPPSELVP

SEQ ID NO: 719221 - protein, 9 aa, Homo Sapiens
KIFMMFWYI

SEQ ID NO: 719222 - protein, 9 aa, Homo Sapiens
PTAGAATVS

SEQ ID NO: 719223 - protein, 9 aa, Homo Sapiens
GDVKKLFHF

SEQ ID NO: 719224 - protein, 9 aa, Homo Sapiens
QRANRGGQR

SEQ ID NO: 719225 - protein, 9 aa, Homo Sapiens
SVFSISMLD

SEQ ID NO: 719226 - protein, 9 aa, Homo Sapiens
AAQQLKVAR

SEQ ID NO: 719227 - protein, 9 aa, Homo Sapiens
RVDDAQFPY

SEQ ID NO: 719228 - protein, 9 aa, Homo Sapiens
KVENRGNPN

SEQ ID NO: 719229 - protein, 9 aa, Homo Sapiens
PSSPWRQDS

SEQ ID NO: 719230 - protein, 9 aa, Homo Sapiens
LYPDIPKHK

SEQ ID NO: 719231 - protein, 9 aa, Homo Sapiens
VVESIFTNA

SEQ ID NO: 719232 - protein, 9 aa, Homo Sapiens
RYRVDDAQF

SEQ ID NO: 719233 - protein, 9 aa, Homo Sapiens
KMITAFEEP

SEQ ID NO: 719234 - protein, 9 aa, Homo Sapiens
ERVRGGVTL

SEQ ID NO: 719235 - protein, 9 aa, Homo Sapiens
TSHPAAEAC

SEQ ID NO: 719236 - protein, 9 aa, Homo Sapiens
ADLVIVTVS

SEQ ID NO: 719237 - protein, 9 aa, Homo Sapiens
GSGRDDQRP

SEQ ID NO: 719238 - protein, 9 aa, Homo Sapiens
NGFDVFKCP

SEQ ID NO: 719239 - protein, 9 aa, Homo Sapiens
LLQGGLPLE

SEQ ID NO: 719240 - protein, 9 aa, Homo Sapiens
HVSYFSTDN

SEQ ID NO: 719241 - protein, 9 aa, Homo Sapiens
ECKQAPPWL

SEQ ID NO: 719242 - protein, 9 aa, Homo Sapiens
KPSAPLEAE

SEQ ID NO: 719243 - protein, 9 aa, Homo Sapiens
GDPDNVELT

SEQ ID NO: 719244 - protein, 9 aa, Homo Sapiens
AELAGWEFV

SEQ ID NO: 719245 - protein, 9 aa, Homo Sapiens
TQEANLGKK

SEQ ID NO: 719246 - protein, 9 aa, Homo Sapiens
TKASPSSPW

SEQ ID NO: 719247 - protein, 9 aa, Homo Sapiens
GKPSAPLEA

SEQ ID NO: 719248 - protein, 9 aa, Homo Sapiens
LQSKDTDSD

SEQ ID NO: 719249 - protein, 9 aa, Homo Sapiens
FDTEISSDK

SEQ ID NO: 719250 - protein, 9 aa, Homo Sapiens
RELFEEFHS

SEQ ID NO: 719251 - protein, 9 aa, Homo Sapiens
HVVVESIFT

SEQ ID NO: 719252 - protein, 9 aa, Homo Sapiens
EGDRFLTDV

SEQ ID NO: 719253 - protein, 9 aa, Homo Sapiens
GTLSKGCLS

SEQ ID NO: 719254 - protein, 9 aa, Homo Sapiens
AVYKCMHCP

SEQ ID NO: 719255 - protein, 9 aa, Homo Sapiens
ALPGGFKQA

SEQ ID NO: 719256 - protein, 9 aa, Homo Sapiens
APSYGQLIA

SEQ ID NO: 719257 - protein, 9 aa, Homo Sapiens
VPLETREYD

SEQ ID NO: 719258 - protein, 9 aa, Homo Sapiens
RTGLSAVSH

SEQ ID NO: 719259 - protein, 9 aa, Homo Sapiens
RCVSCLSGQ

SEQ ID NO: 719260 - protein, 9 aa, Homo Sapiens
PDTSVSLLA

SEQ ID NO: 719261 - protein, 9 aa, Homo Sapiens
VWEVVLLLG

SEQ ID NO: 719262 - protein, 9 aa, Homo Sapiens
PEDLKDAEV

SEQ ID NO: 719263 - protein, 9 aa, Homo Sapiens
ESCKLTCFS

SEQ ID NO: 719264 - protein, 9 aa, Homo Sapiens
PTYTLVPVS

SEQ ID NO: 719265 - protein, 9 aa, Homo Sapiens
YSDDVSEVD

SEQ ID NO: 719266 - protein, 9 aa, Homo Sapiens
VFAGSEGEK

SEQ ID NO: 719267 - protein, 9 aa, Homo Sapiens
QLSRVKAEL

SEQ ID NO: 719268 - protein, 9 aa, Homo Sapiens
LHQDTSYVG

SEQ ID NO: 719269 - protein, 9 aa, Homo Sapiens
SGTTTTKFI

SEQ ID NO: 719270 - protein, 9 aa, Homo Sapiens
VHCVEGLGR

SEQ ID NO: 719271 - protein, 9 aa, Homo Sapiens
MPLQSCLVH

SEQ ID NO: 719272 - protein, 9 aa, Homo Sapiens
APPWLQLEC

SEQ ID NO: 719273 - protein, 9 aa, Homo Sapiens
AFSQRSHVV

SEQ ID NO: 719274 - protein, 9 aa, Homo Sapiens
FWLSDNQSK

SEQ ID NO: 719275 - protein, 9 aa, Homo Sapiens
GSVTGTAVD

SEQ ID NO: 719276 - protein, 9 aa, Homo Sapiens
DALPGHHGN

SEQ ID NO: 719277 - protein, 9 aa, Homo Sapiens
PDIYLVARI

SEQ ID NO: 719278 - protein, 9 aa, Homo Sapiens
SSIFDNGLY

SEQ ID NO: 719279 - protein, 9 aa, Homo Sapiens
LCPIYIPYS

SEQ ID NO: 719280 - protein, 9 aa, Homo Sapiens
QLKVARKQD

SEQ ID NO: 719281 - protein, 9 aa, Homo Sapiens
NSSIEEVEA

SEQ ID NO: 719282 - protein, 9 aa, Homo Sapiens
FDVFKCPPP

SEQ ID NO: 719283 - protein, 9 aa, Homo Sapiens
CLLKDIGDE

SEQ ID NO: 719284 - protein, 9 aa, Homo Sapiens
AVKSSSFLQ

SEQ ID NO: 719285 - protein, 9 aa, Homo Sapiens
ATAMEEAAA

SEQ ID NO: 719286 - protein, 9 aa, Homo Sapiens
VSSQGCDAF

SEQ ID NO: 719287 - protein, 9 aa, Homo Sapiens
STEATRLMP

SEQ ID NO: 719288 - protein, 9 aa, Homo Sapiens
QVLKEETGT

SEQ ID NO: 719289 - protein, 9 aa, Homo Sapiens
FCRRSGKWT

SEQ ID NO: 719290 - protein, 9 aa, Homo Sapiens
NPEATEKHD

SEQ ID NO: 719291 - protein, 9 aa, Homo Sapiens
MWSNQTLNN

SEQ ID NO: 719292 - protein, 9 aa, Homo Sapiens
RSMPTAEAA

SEQ ID NO: 719293 - protein, 9 aa, Homo Sapiens
AKGVGAARN

SEQ ID NO: 719294 - protein, 9 aa, Homo Sapiens
IKLKVEGSP

SEQ ID NO: 719295 - protein, 9 aa, Homo Sapiens
QPCPKIKVD

SEQ ID NO: 719296 - protein, 9 aa, Homo Sapiens
SSPWRQDSD

SEQ ID NO: 719297 - protein, 9 aa, Homo Sapiens
DVGKLVSKL

SEQ ID NO: 719298 - protein, 9 aa, Homo Sapiens
FANSNPPSQ

SEQ ID NO: 719299 - protein, 9 aa, Homo Sapiens
PADLVIVTV

SEQ ID NO: 719300 - protein, 9 aa, Homo Sapiens
KFRPFRDEE

SEQ ID NO: 719301 - protein, 9 aa, Homo Sapiens
YVEKLWLKK

SEQ ID NO: 719302 - protein, 9 aa, Homo Sapiens
ESSIFDNGL

SEQ ID NO: 719303 - protein, 9 aa, Homo Sapiens
ELMDDYYFT

SEQ ID NO: 719304 - protein, 9 aa, Homo Sapiens
APLEAEDNM

SEQ ID NO: 719305 - protein, 9 aa, Homo Sapiens
ICVHPHVFQ

SEQ ID NO: 719306 - protein, 9 aa, Homo Sapiens
LAENKLDPC

SEQ ID NO: 719307 - protein, 9 aa, Homo Sapiens
ARVGSPSGN

SEQ ID NO: 719308 - protein, 9 aa, Homo Sapiens
DPDNVELTV

SEQ ID NO: 719309 - protein, 9 aa, Homo Sapiens
SYLGVSSST

SEQ ID NO: 719310 - protein, 9 aa, Homo Sapiens
KQANPEATE

SEQ ID NO: 719311 - protein, 9 aa, Homo Sapiens
HCPLEIPHG

SEQ ID NO: 719312 - protein, 9 aa, Homo Sapiens
TNLSYLKTK

SEQ ID NO: 719313 - protein, 9 aa, Homo Sapiens
SHVVTHQKI

SEQ ID NO: 719314 - protein, 9 aa, Homo Sapiens
EILQFTLSV

SEQ ID NO: 719315 - protein, 9 aa, Homo Sapiens
YLPLKSMQP

SEQ ID NO: 719316 - protein, 9 aa, Homo Sapiens
EAARPMPTA

SEQ ID NO: 719317 - protein, 9 aa, Homo Sapiens
GLPLEKVLP

SEQ ID NO: 719318 - protein, 9 aa, Homo Sapiens
VTGTAVDSL

SEQ ID NO: 719319 - protein, 9 aa, Homo Sapiens
SRLEDGASL

SEQ ID NO: 719320 - protein, 9 aa, Homo Sapiens
GLIGKDGTR

SEQ ID NO: 719321 - protein, 9 aa, Homo Sapiens
EVVLLLGKL

SEQ ID NO: 719322 - protein, 9 aa, Homo Sapiens
LTDIVPLET

SEQ ID NO: 719323 - protein, 9 aa, Homo Sapiens
AIGDVKKLF

SEQ ID NO: 719324 - protein, 9 aa, Homo Sapiens
TRRTEVTLS

SEQ ID NO: 719325 - protein, 9 aa, Homo Sapiens
CWQKDWNSR

SEQ ID NO: 719326 - protein, 9 aa, Homo Sapiens
TLVKEKPKM

SEQ ID NO: 719327 - protein, 9 aa, Homo Sapiens
WGSGPPMQF

SEQ ID NO: 719328 - protein, 9 aa, Homo Sapiens
IGFFPVSSQ

SEQ ID NO: 719329 - protein, 9 aa, Homo Sapiens
AAHPMPTAG

SEQ ID NO: 719330 - protein, 9 aa, Homo Sapiens
HTAIPNRAI

SEQ ID NO: 719331 - protein, 9 aa, Homo Sapiens
LKDLYNTPS

SEQ ID NO: 719332 - protein, 9 aa, Homo Sapiens
TTPKPTAGA

SEQ ID NO: 719333 - protein, 9 aa, Homo Sapiens
FAELAGWEF

SEQ ID NO: 719334 - protein, 9 aa, Homo Sapiens
WTHREIVQA

SEQ ID NO: 719335 - protein, 9 aa, Homo Sapiens
LLCERGEGE

SEQ ID NO: 719336 - protein, 9 aa, Homo Sapiens
MSDAKVENR

SEQ ID NO: 719337 - protein, 9 aa, Homo Sapiens
MYGVLNPIT

SEQ ID NO: 719338 - protein, 9 aa, Homo Sapiens
TPKPTAGAA

SEQ ID NO: 719339 - protein, 9 aa, Homo Sapiens
LTSVSCPSS

SEQ ID NO: 719340 - protein, 9 aa, Homo Sapiens
RSTEAARSM

SEQ ID NO: 719341 - protein, 9 aa, Homo Sapiens
TVPTTVMAG

SEQ ID NO: 719342 - protein, 9 aa, Homo Sapiens
SAYNFEESH

SEQ ID NO: 719343 - protein, 9 aa, Homo Sapiens
TRNTLVAIR

SEQ ID NO: 719344 - protein, 9 aa, Homo Sapiens
TPTAGADRP

SEQ ID NO: 719345 - protein, 9 aa, Homo Sapiens
VESGVLMRM

SEQ ID NO: 719346 - protein, 9 aa, Homo Sapiens
RNQPKGVTK

SEQ ID NO: 719347 - protein, 9 aa, Homo Sapiens
LPQESKKLL

SEQ ID NO: 719348 - protein, 9 aa, Homo Sapiens
PGSSYLAGP

SEQ ID NO: 719349 - protein, 9 aa, Homo Sapiens
GLTSVSCPS

SEQ ID NO: 719350 - protein, 9 aa, Homo Sapiens
MGLTSVSCP

SEQ ID NO: 719351 - protein, 9 aa, Homo Sapiens
NLTVTQVGW

SEQ ID NO: 719352 - protein, 9 aa, Homo Sapiens
GCLSRGRDT

SEQ ID NO: 719353 - protein, 9 aa, Homo Sapiens
TAMEEEATT

SEQ ID NO: 719354 - protein, 9 aa, Homo Sapiens
NVELTVSTD

SEQ ID NO: 719355 - protein, 9 aa, Homo Sapiens
GVTLVKEKP

SEQ ID NO: 719356 - protein, 9 aa, Homo Sapiens
GTNLSYLKT

SEQ ID NO: 719357 - protein, 9 aa, Homo Sapiens
TEAAPLMPT

SEQ ID NO: 719358 - protein, 9 aa, Homo Sapiens
ILRKEEDTR

SEQ ID NO: 719359 - protein, 9 aa, Homo Sapiens
WLQLECQQD

SEQ ID NO: 719360 - protein, 9 aa, Homo Sapiens
YIKATATQF

SEQ ID NO: 719361 - protein, 9 aa, Homo Sapiens
IPQDQRESP

SEQ ID NO: 719362 - protein, 9 aa, Homo Sapiens
MGKPSAPLE

SEQ ID NO: 719363 - protein, 9 aa, Homo Sapiens
LLMDTRESQ

SEQ ID NO: 719364 - protein, 9 aa, Homo Sapiens
TPSYLGVSS

SEQ ID NO: 719365 - protein, 9 aa, Homo Sapiens
EGELKDLTQ

SEQ ID NO: 719366 - protein, 9 aa, Homo Sapiens
MPSRQESRE

SEQ ID NO: 719367 - protein, 9 aa, Homo Sapiens
WERVRGGVT

SEQ ID NO: 719368 - protein, 9 aa, Homo Sapiens
LRRTASDSQ

SEQ ID NO: 719369 - protein, 9 aa, Homo Sapiens
LEQSRILTD

SEQ ID NO: 719370 - protein, 9 aa, Homo Sapiens
QLLKNKEDS

SEQ ID NO: 719371 - protein, 9 aa, Homo Sapiens
QWLPAVIAA

SEQ ID NO: 719372 - protein, 9 aa, Homo Sapiens
LGKKTVIWK

SEQ ID NO: 719373 - protein, 9 aa, Homo Sapiens
DVTTFQPNS

SEQ ID NO: 719374 - protein, 9 aa, Homo Sapiens
DKMTAVYSN

SEQ ID NO: 719375 - protein, 9 aa, Homo Sapiens
YSWEEAKKK

SEQ ID NO: 719376 - protein, 9 aa, Homo Sapiens
IKGQILVNG

SEQ ID NO: 719377 - protein, 9 aa, Homo Sapiens
AQQLKVARK

SEQ ID NO: 719378 - protein, 9 aa, Homo Sapiens
ATRIVYPLL

SEQ ID NO: 719379 - protein, 9 aa, Homo Sapiens
WKSVLAGPC

SEQ ID NO: 719380 - protein, 9 aa, Homo Sapiens
FKAFDQLFI

SEQ ID NO: 719381 - protein, 9 aa, Homo Sapiens
LECKQAPPW

SEQ ID NO: 719382 - protein, 9 aa, Homo Sapiens
VGATTVLAR

SEQ ID NO: 719383 - protein, 9 aa, Homo Sapiens
MHLSPFVYS

SEQ ID NO: 719384 - protein, 9 aa, Homo Sapiens
SHDATVGAA

SEQ ID NO: 719385 - protein, 9 aa, Homo Sapiens
IHDSMAVKS

SEQ ID NO: 719386 - protein, 9 aa, Homo Sapiens
AARLTPTAG

SEQ ID NO: 719387 - protein, 9 aa, Homo Sapiens
SLGLELPSC

SEQ ID NO: 719388 - protein, 9 aa, Homo Sapiens
WGVLCPIYI

SEQ ID NO: 719389 - protein, 9 aa, Homo Sapiens
PSQVLPRKH

SEQ ID NO: 719390 - protein, 9 aa, Homo Sapiens
LLENQLFPN

SEQ ID NO: 719391 - protein, 9 aa, Homo Sapiens
EAMSDAKVE

SEQ ID NO: 719392 - protein, 9 aa, Homo Sapiens
EDTRTASQS

SEQ ID NO: 719393 - protein, 9 aa, Homo Sapiens
LKLECKQAP

SEQ ID NO: 719394 - protein, 9 aa, Homo Sapiens
KCMHCPYIN

SEQ ID NO: 719395 - protein, 9 aa, Homo Sapiens
TVVFTEEEL

SEQ ID NO: 719396 - protein, 9 aa, Homo Sapiens
NQHAKECGG

SEQ ID NO: 719397 - protein, 9 aa, Homo Sapiens
EAAHPMPTA

SEQ ID NO: 719398 - protein, 9 aa, Homo Sapiens
RSTEAACSM

SEQ ID NO: 719399 - protein, 9 aa, Homo Sapiens
RDISQPGLS

SEQ ID NO: 719400 - protein, 9 aa, Homo Sapiens
FCENRLKKL

SEQ ID NO: 719401 - protein, 9 aa, Homo Sapiens
VGHAKDELL

SEQ ID NO: 719402 - protein, 9 aa, Homo Sapiens
LSMPTAEAT

SEQ ID NO: 719403 - protein, 9 aa, Homo Sapiens
EDDCVGDGD

SEQ ID NO: 719404 - protein, 9 aa, Homo Sapiens
RLAIGFFPV

SEQ ID NO: 719405 - protein, 9 aa, Homo Sapiens
LLLAFLVIY

SEQ ID NO: 719406 - protein, 9 aa, Homo Sapiens
TPTVGAATV

SEQ ID NO: 719407 - protein, 9 aa, Homo Sapiens
GARAADDPR

SEQ ID NO: 719408 - protein, 9 aa, Homo Sapiens
LLLGKLLGT

SEQ ID NO: 719409 - protein, 9 aa, Homo Sapiens
DLLPFTLLL

SEQ ID NO: 719410 - protein, 9 aa, Homo Sapiens
LMDTRESQW

SEQ ID NO: 719411 - protein, 9 aa, Homo Sapiens
SDAKVENRG

SEQ ID NO: 719412 - protein, 9 aa, Homo Sapiens
SPFPRQRRR

SEQ ID NO: 719413 - protein, 9 aa, Homo Sapiens
QLVFAGSEG

SEQ ID NO: 719414 - protein, 9 aa, Homo Sapiens
LTPTAGATT

SEQ ID NO: 719415 - protein, 9 aa, Homo Sapiens
RVRGGVTLV

SEQ ID NO: 719416 - protein, 9 aa, Homo Sapiens
TPTVGAMTV

SEQ ID NO: 719417 - protein, 9 aa, Homo Sapiens
SECVAITPG

SEQ ID NO: 719418 - protein, 9 aa, Homo Sapiens
PTAGATTVP

SEQ ID NO: 719419 - protein, 9 aa, Homo Sapiens
GTAVDSLTV

SEQ ID NO: 719420 - protein, 9 aa, Homo Sapiens
VVFAIGFCT

SEQ ID NO: 719421 - protein, 9 aa, Homo Sapiens
VGATTVPAR

SEQ ID NO: 719422 - protein, 9 aa, Homo Sapiens
GLPPMQKNV

SEQ ID NO: 719423 - protein, 9 aa, Homo Sapiens
LFEEFHSFL

SEQ ID NO: 719424 - protein, 9 aa, Homo Sapiens
RHLCQPLPT

SEQ ID NO: 719425 - protein, 9 aa, Homo Sapiens
DEDDCVGDG

SEQ ID NO: 719426 - protein, 9 aa, Homo Sapiens
DEESCTPWP

SEQ ID NO: 719427 - protein, 9 aa, Homo Sapiens
FRLPFAAGS

SEQ ID NO: 719428 - protein, 9 aa, Homo Sapiens
VPARATAME

SEQ ID NO: 719429 - protein, 9 aa, Homo Sapiens
CSVLAPHFP

SEQ ID NO: 719430 - protein, 9 aa, Homo Sapiens
VELTVSTDT

SEQ ID NO: 719431 - protein, 9 aa, Homo Sapiens
KCEECAKVL

SEQ ID NO: 719432 - protein, 9 aa, Homo Sapiens
MTAVYSNIL

SEQ ID NO: 719433 - protein, 9 aa, Homo Sapiens
PTAEAAHPM

SEQ ID NO: 719434 - protein, 9 aa, Homo Sapiens
NVSKQANPE

SEQ ID NO: 719435 - protein, 9 aa, Homo Sapiens
PTNTAYSFS

SEQ ID NO: 719436 - protein, 9 aa, Homo Sapiens
AKVLIDLQI

SEQ ID NO: 719437 - protein, 9 aa, Homo Sapiens
PTAVAACLT

SEQ ID NO: 719438 - protein, 9 aa, Homo Sapiens
CVHPHVFQG

SEQ ID NO: 719439 - protein, 9 aa, Homo Sapiens
DLLPQSLLP

SEQ ID NO: 719440 - protein, 9 aa, Homo Sapiens
GRTSGYVAR

SEQ ID NO: 719441 - protein, 9 aa, Homo Sapiens
QDTSYVGNF

SEQ ID NO: 719442 - protein, 9 aa, Homo Sapiens
ESKKLLKLE

SEQ ID NO: 719443 - protein, 9 aa, Homo Sapiens
WDAYCYNQH

SEQ ID NO: 719444 - protein, 9 aa, Homo Sapiens
EFVGGFHCK

SEQ ID NO: 719445 - protein, 9 aa, Homo Sapiens
TVGATTVLA

SEQ ID NO: 719446 - protein, 9 aa, Homo Sapiens
EKKKIPDPY

SEQ ID NO: 719447 - protein, 9 aa, Homo Sapiens
SIGDAEEYD

SEQ ID NO: 719448 - protein, 9 aa, Homo Sapiens
RAQHAGIAH

SEQ ID NO: 719449 - protein, 9 aa, Homo Sapiens
CAHPSVGAT

SEQ ID NO: 719450 - protein, 9 aa, Homo Sapiens
VSGLTSHPA

SEQ ID NO: 719451 - protein, 9 aa, Homo Sapiens
DGASLRLHT

SEQ ID NO: 719452 - protein, 9 aa, Homo Sapiens
KMDSVLSSE

SEQ ID NO: 719453 - protein, 9 aa, Homo Sapiens
RSTEAAPLM

SEQ ID NO: 719454 - protein, 9 aa, Homo Sapiens
DVFKNMQAK

SEQ ID NO: 719455 - protein, 9 aa, Homo Sapiens
FHFFMSRGQ

SEQ ID NO: 719456 - protein, 9 aa, Homo Sapiens
EGARAADDP

SEQ ID NO: 719457 - protein, 9 aa, Homo Sapiens
KMTAVYSNI

SEQ ID NO: 719458 - protein, 9 aa, Homo Sapiens
DGYHRQRGF

SEQ ID NO: 719459 - protein, 9 aa, Homo Sapiens
VLSSEAAWV

SEQ ID NO: 719460 - protein, 9 aa, Homo Sapiens
IFMMFWYIM

SEQ ID NO: 719461 - protein, 9 aa, Homo Sapiens
QKNVVFVID

SEQ ID NO: 719462 - protein, 9 aa, Homo Sapiens
PLEIPHGKG

SEQ ID NO: 719463 - protein, 9 aa, Homo Sapiens
LPFAAGSVF

SEQ ID NO: 719464 - protein, 9 aa, Homo Sapiens
NSREPWNPC

SEQ ID NO: 719465 - protein, 9 aa, Homo Sapiens
GCIFAFAAA

SEQ ID NO: 719466 - protein, 9 aa, Homo Sapiens
FPNNFAKRE

SEQ ID NO: 719467 - protein, 9 aa, Homo Sapiens
TDAPAADQP

SEQ ID NO: 719468 - protein, 9 aa, Homo Sapiens
HDSMAVKSS

SEQ ID NO: 719469 - protein, 9 aa, Homo Sapiens
QSCLVHTSE

SEQ ID NO: 719470 - protein, 9 aa, Homo Sapiens
YFTSIKSLL

SEQ ID NO: 719471 - protein, 9 aa, Homo Sapiens
GALIYSVKK

SEQ ID NO: 719472 - protein, 9 aa, Homo Sapiens
DTEKLPTSH

SEQ ID NO: 719473 - protein, 9 aa, Homo Sapiens
DIVKLVVRY

SEQ ID NO: 719474 - protein, 9 aa, Homo Sapiens
SYVSAVEEP

SEQ ID NO: 719475 - protein, 9 aa, Homo Sapiens
QEDTPSAQA

SEQ ID NO: 719476 - protein, 9 aa, Homo Sapiens
AFTKSSLLF

SEQ ID NO: 719477 - protein, 9 aa, Homo Sapiens
KEPLWYQVE

SEQ ID NO: 719478 - protein, 9 aa, Homo Sapiens
KSVNKMQED

SEQ ID NO: 719479 - protein, 9 aa, Homo Sapiens
ATTKSTEAA

SEQ ID NO: 719480 - protein, 9 aa, Homo Sapiens
ARNNPEPGV

SEQ ID NO: 719481 - protein, 9 aa, Homo Sapiens
SLGYKIKYS

SEQ ID NO: 719482 - protein, 9 aa, Homo Sapiens
PMPTAGAAA

SEQ ID NO: 719483 - protein, 9 aa, Homo Sapiens
YAARLAAEY

SEQ ID NO: 719484 - protein, 9 aa, Homo Sapiens
TNTAYSFSF

SEQ ID NO: 719485 - protein, 9 aa, Homo Sapiens
AATVPSRVT

SEQ ID NO: 719486 - protein, 9 aa, Homo Sapiens
TSQDSPGAL

SEQ ID NO: 719487 - protein, 9 aa, Homo Sapiens
RDAGRCVCD

SEQ ID NO: 719488 - protein, 9 aa, Homo Sapiens
RTASDSQPG

SEQ ID NO: 719489 - protein, 9 aa, Homo Sapiens
TVPARATAT

SEQ ID NO: 719490 - protein, 9 aa, Homo Sapiens
FAIGFCTGL

SEQ ID NO: 719491 - protein, 9 aa, Homo Sapiens
QRIIKQQGL

SEQ ID NO: 719492 - protein, 9 aa, Homo Sapiens
PTITAKLHG

SEQ ID NO: 719493 - protein, 9 aa, Homo Sapiens
ATSFCENRL

SEQ ID NO: 719494 - protein, 9 aa, Homo Sapiens
RSHVVTHQK

SEQ ID NO: 719495 - protein, 9 aa, Homo Sapiens
PMWSNQTLN

SEQ ID NO: 719496 - protein, 9 aa, Homo Sapiens
AHGDTSQDS

SEQ ID NO: 719497 - protein, 9 aa, Homo Sapiens
DGSSLHCHN

SEQ ID NO: 719498 - protein, 9 aa, Homo Sapiens
KELAAFWLS

SEQ ID NO: 719499 - protein, 9 aa, Homo Sapiens
LKRRKDLGL

SEQ ID NO: 719500 - protein, 9 aa, Homo Sapiens
FCTGLVGLF

SEQ ID NO: 719501 - protein, 9 aa, Homo Sapiens
STAAHGDTS

SEQ ID NO: 719502 - protein, 9 aa, Homo Sapiens
ETVGHAKDE

SEQ ID NO: 719503 - protein, 9 aa, Homo Sapiens
DLKDLYNTP

SEQ ID NO: 719504 - protein, 9 aa, Homo Sapiens
GEGEHDASR

SEQ ID NO: 719505 - protein, 9 aa, Homo Sapiens
YLGVSSSTS

SEQ ID NO: 719506 - protein, 9 aa, Homo Sapiens
AGVTITEEE

SEQ ID NO: 719507 - protein, 9 aa, Homo Sapiens
MTVPAGATA

SEQ ID NO: 719508 - protein, 9 aa, Homo Sapiens
SLWGVLCPI

SEQ ID NO: 719509 - protein, 9 aa, Homo Sapiens
WSPPAPAQL

SEQ ID NO: 719510 - protein, 9 aa, Homo Sapiens
IKRSEVELQ

SEQ ID NO: 719511 - protein, 9 aa, Homo Sapiens
GDAEEYDTD

SEQ ID NO: 719512 - protein, 9 aa, Homo Sapiens
IVGALIYSV

SEQ ID NO: 719513 - protein, 9 aa, Homo Sapiens
ASTVPTTVM

SEQ ID NO: 719514 - protein, 9 aa, Homo Sapiens
NSSFRDISQ

SEQ ID NO: 719515 - protein, 9 aa, Homo Sapiens
AVETQLAVN

SEQ ID NO: 719516 - protein, 9 aa, Homo Sapiens
DVKDAAGKV

SEQ ID NO: 719517 - protein, 9 aa, Homo Sapiens
KVKEDEDDC

SEQ ID NO: 719518 - protein, 9 aa, Homo Sapiens
PPRTWVPGV

SEQ ID NO: 719519 - protein, 9 aa, Homo Sapiens
WSFELPEIN

SEQ ID NO: 719520 - protein, 9 aa, Homo Sapiens
DREERANMS

SEQ ID NO: 719521 - protein, 9 aa, Homo Sapiens
FETQLSRVK

SEQ ID NO: 719522 - protein, 9 aa, Homo Sapiens
LCICVHPHV

SEQ ID NO: 719523 - protein, 9 aa, Homo Sapiens
RPFAELAGW

SEQ ID NO: 719524 - protein, 9 aa, Homo Sapiens
PQVSTWMRA

SEQ ID NO: 719525 - protein, 9 aa, Homo Sapiens
HFTSDGYHR

SEQ ID NO: 719526 - protein, 9 aa, Homo Sapiens
LDHVFPDTS

SEQ ID NO: 719527 - protein, 9 aa, Homo Sapiens
VWTMVAATR

SEQ ID NO: 719528 - protein, 9 aa, Homo Sapiens
ARTTPTAGA

SEQ ID NO: 719529 - protein, 9 aa, Homo Sapiens
ATRRTEVTL

SEQ ID NO: 719530 - protein, 9 aa, Homo Sapiens
GVTITEEEA

SEQ ID NO: 719531 - protein, 9 aa, Homo Sapiens
AGYRESGIK

SEQ ID NO: 719532 - protein, 9 aa, Homo Sapiens
WQSGLIGKD

SEQ ID NO: 719533 - protein, 9 aa, Homo Sapiens
ISNAEKDTG

SEQ ID NO: 719534 - protein, 9 aa, Homo Sapiens
FPFFFLRRS

SEQ ID NO: 719535 - protein, 9 aa, Homo Sapiens
NNPEPGVRR

SEQ ID NO: 719536 - protein, 9 aa, Homo Sapiens
TRLMPTAEA

SEQ ID NO: 719537 - protein, 9 aa, Homo Sapiens
TWLFCKTFP

SEQ ID NO: 719538 - protein, 9 aa, Homo Sapiens
HEEGSLAGG

SEQ ID NO: 719539 - protein, 9 aa, Homo Sapiens
KAQQEARPT

SEQ ID NO: 719540 - protein, 9 aa, Homo Sapiens
SIELKRIHD

SEQ ID NO: 719541 - protein, 9 aa, Homo Sapiens
PSRQESREV

SEQ ID NO: 719542 - protein, 9 aa, Homo Sapiens
AMEEEATTK

SEQ ID NO: 719543 - protein, 9 aa, Homo Sapiens
VPARATATE

SEQ ID NO: 719544 - protein, 9 aa, Homo Sapiens
QQDHKYPSQ

SEQ ID NO: 719545 - protein, 9 aa, Homo Sapiens
GSGLGEGDR

SEQ ID NO: 719546 - protein, 9 aa, Homo Sapiens
VLLNRKDIC

SEQ ID NO: 719547 - protein, 9 aa, Homo Sapiens
GATTVPAGT

SEQ ID NO: 719548 - protein, 9 aa, Homo Sapiens
CVAVHCVEG

SEQ ID NO: 719549 - protein, 9 aa, Homo Sapiens
ALIYSVKKL

SEQ ID NO: 719550 - protein, 9 aa, Homo Sapiens
GATTVPAGA

SEQ ID NO: 719551 - protein, 9 aa, Homo Sapiens
RQRRRRGLS

SEQ ID NO: 719552 - protein, 9 aa, Homo Sapiens
AMHSAFGLK

SEQ ID NO: 719553 - protein, 9 aa, Homo Sapiens
SMVTKFCSV

SEQ ID NO: 719554 - protein, 9 aa, Homo Sapiens
QKMDSVLSS

SEQ ID NO: 719555 - protein, 9 aa, Homo Sapiens
ENKLDPCML

SEQ ID NO: 719556 - protein, 9 aa, Homo Sapiens
ICKQSQHMT

SEQ ID NO: 719557 - protein, 9 aa, Homo Sapiens
NPGAVYKCM

SEQ ID NO: 719558 - protein, 9 aa, Homo Sapiens
CGHSWNTRH

SEQ ID NO: 719559 - protein, 9 aa, Homo Sapiens
RLHFTSDGY

SEQ ID NO: 719560 - protein, 9 aa, Homo Sapiens
GRSHDATVG

SEQ ID NO: 719561 - protein, 9 aa, Homo Sapiens
PTPTVGATT

SEQ ID NO: 719562 - protein, 9 aa, Homo Sapiens
KAFTKSSLL

SEQ ID NO: 719563 - protein, 9 aa, Homo Sapiens
RWDAYCYNQ

SEQ ID NO: 719564 - protein, 9 aa, Homo Sapiens
PGSPRAQHA

SEQ ID NO: 719565 - protein, 9 aa, Homo Sapiens
WMLYMDHYH

SEQ ID NO: 719566 - protein, 9 aa, Homo Sapiens
QLPLSGTTT

SEQ ID NO: 719567 - protein, 9 aa, Homo Sapiens
QGLQLLKNK

SEQ ID NO: 719568 - protein, 9 aa, Homo Sapiens
TITAKLHGR

SEQ ID NO: 719569 - protein, 9 aa, Homo Sapiens
GSSVHVVYS

SEQ ID NO: 719570 - protein, 9 aa, Homo Sapiens
LQSCLVHTS

SEQ ID NO: 719571 - protein, 9 aa, Homo Sapiens
LKVEGSPSR

SEQ ID NO: 719572 - protein, 9 aa, Homo Sapiens
VKVGILEPS

SEQ ID NO: 719573 - protein, 9 aa, Homo Sapiens
GMIFKKRST

SEQ ID NO: 719574 - protein, 9 aa, Homo Sapiens
TIIKGVNAS

SEQ ID NO: 719575 - protein, 9 aa, Homo Sapiens
EDILSYVEK

SEQ ID NO: 719576 - protein, 9 aa, Homo Sapiens
SHGLQEWVT

SEQ ID NO: 719577 - protein, 9 aa, Homo Sapiens
EAFGKAYKS

SEQ ID NO: 719578 - protein, 9 aa, Homo Sapiens
ALPTPTVGA

SEQ ID NO: 719579 - protein, 9 aa, Homo Sapiens
TLSVRLDYR

SEQ ID NO: 719580 - protein, 9 aa, Homo Sapiens
WVPGVLTWR

SEQ ID NO: 719581 - protein, 9 aa, Homo Sapiens
ECLQWLNSQ

SEQ ID NO: 719582 - protein, 9 aa, Homo Sapiens
GYHRQRGFS

SEQ ID NO: 719583 - protein, 9 aa, Homo Sapiens
FELPEINKV

SEQ ID NO: 719584 - protein, 9 aa, Homo Sapiens
ALIYELKQE

SEQ ID NO: 719585 - protein, 9 aa, Homo Sapiens
YVWQLVFAG

SEQ ID NO: 719586 - protein, 9 aa, Homo Sapiens
CVSTDGSSL

SEQ ID NO: 719587 - protein, 9 aa, Homo Sapiens
GHSWNTRHI

SEQ ID NO: 719588 - protein, 9 aa, Homo Sapiens
PTVGAMTVP

SEQ ID NO: 719589 - protein, 9 aa, Homo Sapiens
QAIPQDQRE

SEQ ID NO: 719590 - protein, 9 aa, Homo Sapiens
ARLTPTAGA

SEQ ID NO: 719591 - protein, 9 aa, Homo Sapiens
AFWLSDNQS

SEQ ID NO: 719592 - protein, 9 aa, Homo Sapiens
DYYFTSIKS

SEQ ID NO: 719593 - protein, 9 aa, Homo Sapiens
FQESRAKDR

SEQ ID NO: 719594 - protein, 9 aa, Homo Sapiens
YMQQIANAK

SEQ ID NO: 719595 - protein, 9 aa, Homo Sapiens
LKSMQPTEA

SEQ ID NO: 719596 - protein, 9 aa, Homo Sapiens
DRIVSKAMI

SEQ ID NO: 719597 - protein, 9 aa, Homo Sapiens
SGGVGANSC

SEQ ID NO: 719598 - protein, 9 aa, Homo Sapiens
WIWMLYMDH

SEQ ID NO: 719599 - protein, 9 aa, Homo Sapiens
HCSSECVAI

SEQ ID NO: 719600 - protein, 9 aa, Homo Sapiens
RKFRPFRDE

SEQ ID NO: 719601 - protein, 9 aa, Homo Sapiens
GIRDAGRCV

SEQ ID NO: 719602 - protein, 9 aa, Homo Sapiens
LNAEVSTKD

SEQ ID NO: 719603 - protein, 9 aa, Homo Sapiens
KKRSTRTRL

SEQ ID NO: 719604 - protein, 9 aa, Homo Sapiens
KQNLNAEVS

SEQ ID NO: 719605 - protein, 9 aa, Homo Sapiens
QWQSGLIGK

SEQ ID NO: 719606 - protein, 9 aa, Homo Sapiens
PGVLTWRFC

SEQ ID NO: 719607 - protein, 9 aa, Homo Sapiens
IGRLRFKKP

SEQ ID NO: 719608 - protein, 9 aa, Homo Sapiens
LNRKDICAG

SEQ ID NO: 719609 - protein, 9 aa, Homo Sapiens
VTTGATAME

SEQ ID NO: 719610 - protein, 9 aa, Homo Sapiens
GGDPDNVEL

SEQ ID NO: 719611 - protein, 9 aa, Homo Sapiens
QQFFFFFFP

SEQ ID NO: 719612 - protein, 9 aa, Homo Sapiens
TAKLHGRAP

SEQ ID NO: 719613 - protein, 9 aa, Homo Sapiens
LAAFWLSDN

SEQ ID NO: 719614 - protein, 9 aa, Homo Sapiens
EEEAATRNT

SEQ ID NO: 719615 - protein, 9 aa, Homo Sapiens
SKQANPEAT

SEQ ID NO: 719616 - protein, 9 aa, Homo Sapiens
TEISSDKFN

SEQ ID NO: 719617 - protein, 9 aa, Homo Sapiens
FCQWQSGLI

SEQ ID NO: 719618 - protein, 9 aa, Homo Sapiens
MDESSIFDN

SEQ ID NO: 719619 - protein, 9 aa, Homo Sapiens
NMQAKTELI

SEQ ID NO: 719620 - protein, 9 aa, Homo Sapiens
MVVFAIGFC

SEQ ID NO: 719621 - protein, 9 aa, Homo Sapiens
PQVPQEYQD

SEQ ID NO: 719622 - protein, 9 aa, Homo Sapiens
LPMWSNQTL

SEQ ID NO: 719623 - protein, 9 aa, Homo Sapiens
EEAKKKTVE

SEQ ID NO: 719624 - protein, 9 aa, Homo Sapiens
VFSIGDAEE

SEQ ID NO: 719625 - protein, 9 aa, Homo Sapiens
SYSIIVNNL

SEQ ID NO: 719626 - protein, 9 aa, Homo Sapiens
YKCEECAKV

SEQ ID NO: 719627 - protein, 9 aa, Homo Sapiens
NGNPESLGY

SEQ ID NO: 719628 - protein, 9 aa, Homo Sapiens
DSLLCERGE

SEQ ID NO: 719629 - protein, 9 aa, Homo Sapiens
KQAPPWLQL

SEQ ID NO: 719630 - protein, 9 aa, Homo Sapiens
FFFPFFFLR

SEQ ID NO: 719631 - protein, 9 aa, Homo Sapiens
IRQVLKEET

SEQ ID NO: 719632 - protein, 9 aa, Homo Sapiens
PPWLQLECQ

SEQ ID NO: 719633 - protein, 9 aa, Homo Sapiens
AMEEAAATR

SEQ ID NO: 719634 - protein, 9 aa, Homo Sapiens
CPIYIPYSF

SEQ ID NO: 719635 - protein, 9 aa, Homo Sapiens
RLTPTAGAT

SEQ ID NO: 719636 - protein, 9 aa, Homo Sapiens
KFYKCEAFG

SEQ ID NO: 719637 - protein, 9 aa, Homo Sapiens
GTTPAEEEA

SEQ ID NO: 719638 - protein, 9 aa, Homo Sapiens
GVESGVLMR

SEQ ID NO: 719639 - protein, 9 aa, Homo Sapiens
ESHGLQEWV

SEQ ID NO: 719640 - protein, 9 aa, Homo Sapiens
TAESLALHN

SEQ ID NO: 719641 - protein, 9 aa, Homo Sapiens
STWMRALPS

SEQ ID NO: 719642 - protein, 9 aa, Homo Sapiens
NKSNLTHWH

SEQ ID NO: 719643 - protein, 9 aa, Homo Sapiens
CVEGLGRAP

SEQ ID NO: 719644 - protein, 9 aa, Homo Sapiens
ILSYVEKLW

SEQ ID NO: 719645 - protein, 9 aa, Homo Sapiens
YFSTDNSGS

SEQ ID NO: 719646 - protein, 9 aa, Homo Sapiens
LFPNNFAKR

SEQ ID NO: 719647 - protein, 9 aa, Homo Sapiens
ARGFAVLLV

SEQ ID NO: 719648 - protein, 9 aa, Homo Sapiens
EATTKSTEA

SEQ ID NO: 719649 - protein, 9 aa, Homo Sapiens
DAEEYDTDE

SEQ ID NO: 719650 - protein, 9 aa, Homo Sapiens
PARATAMEE

SEQ ID NO: 719651 - protein, 9 aa, Homo Sapiens
NVSGLTSHP

SEQ ID NO: 719652 - protein, 9 aa, Homo Sapiens
RNTKAARPM

SEQ ID NO: 719653 - protein, 9 aa, Homo Sapiens
TWRFCRRSG

SEQ ID NO: 719654 - protein, 9 aa, Homo Sapiens
EEEAATRST

SEQ ID NO: 719655 - protein, 9 aa, Homo Sapiens
SSLHCHNPS

SEQ ID NO: 719656 - protein, 9 aa, Homo Sapiens
HGARPFAEL

SEQ ID NO: 719657 - protein, 9 aa, Homo Sapiens
PSAPLEAED

SEQ ID NO: 719658 - protein, 9 aa, Homo Sapiens
PFFFLRRSL

SEQ ID NO: 719659 - protein, 9 aa, Homo Sapiens
RIHDSMAVK

SEQ ID NO: 719660 - protein, 9 aa, Homo Sapiens
NTLVAIRKR

SEQ ID NO: 719661 - protein, 9 aa, Homo Sapiens
GVLMRMALD

SEQ ID NO: 719662 - protein, 9 aa, Homo Sapiens
FSHLTASQL

SEQ ID NO: 719663 - protein, 9 aa, Homo Sapiens
STEAAPLMP

SEQ ID NO: 719664 - protein, 9 aa, Homo Sapiens
VDREERANM

SEQ ID NO: 719665 - protein, 9 aa, Homo Sapiens
HSMPTAVAA

SEQ ID NO: 719666 - protein, 9 aa, Homo Sapiens
SVLSSEAAW

SEQ ID NO: 719667 - protein, 9 aa, Homo Sapiens
GADRPMPTA

SEQ ID NO: 719668 - protein, 9 aa, Homo Sapiens
HGDTSQDSP

SEQ ID NO: 719669 - protein, 9 aa, Homo Sapiens
GSPSRSDYI

SEQ ID NO: 719670 - protein, 9 aa, Homo Sapiens
VKEDEDDCV

SEQ ID NO: 719671 - protein, 9 aa, Homo Sapiens
GNSSFRDIS

SEQ ID NO: 719672 - protein, 9 aa, Homo Sapiens
EMVTFKDVT

SEQ ID NO: 719673 - protein, 9 aa, Homo Sapiens
TEVTLSMPT

SEQ ID NO: 719674 - protein, 9 aa, Homo Sapiens
GAATVSATA

SEQ ID NO: 719675 - protein, 9 aa, Homo Sapiens
ARAADDPRR

SEQ ID NO: 719676 - protein, 9 aa, Homo Sapiens
RLLTFKAFD

SEQ ID NO: 719677 - protein, 9 aa, Homo Sapiens
NAQSKMESA

SEQ ID NO: 719678 - protein, 9 aa, Homo Sapiens
ADQPPSELV

SEQ ID NO: 719679 - protein, 9 aa, Homo Sapiens
TSKVSRCGN

SEQ ID NO: 719680 - protein, 9 aa, Homo Sapiens
RIKLKVEGS

SEQ ID NO: 719681 - protein, 9 aa, Homo Sapiens
GEPEKAAGS

SEQ ID NO: 719682 - protein, 9 aa, Homo Sapiens
PLVDGESDT

SEQ ID NO: 719683 - protein, 9 aa, Homo Sapiens
KPLSWQPEK

SEQ ID NO: 719684 - protein, 9 aa, Homo Sapiens
PYAQPPIGR

SEQ ID NO: 719685 - protein, 9 aa, Homo Sapiens
TTTPKPTAG

SEQ ID NO: 719686 - protein, 9 aa, Homo Sapiens
VMVMGCIFA

SEQ ID NO: 719687 - protein, 9 aa, Homo Sapiens
FPDGKEMAQ

SEQ ID NO: 719688 - protein, 9 aa, Homo Sapiens
AESLALHNI

SEQ ID NO: 719689 - protein, 9 aa, Homo Sapiens
MKEVSGIVH

SEQ ID NO: 719690 - protein, 9 aa, Homo Sapiens
EYNGNPESL

SEQ ID NO: 719691 - protein, 9 aa, Homo Sapiens
DPYSDDVSE

SEQ ID NO: 719692 - protein, 9 aa, Homo Sapiens
LMPTAEAAR

SEQ ID NO: 719693 - protein, 9 aa, Homo Sapiens
VETQLAVNQ

SEQ ID NO: 719694 - protein, 9 aa, Homo Sapiens
CFSPEDDGG

SEQ ID NO: 719695 - protein, 9 aa, Homo Sapiens
SGVGPKAFK

SEQ ID NO: 719696 - protein, 9 aa, Homo Sapiens
TISCSYCGE

SEQ ID NO: 719697 - protein, 9 aa, Homo Sapiens
TAEAAHPMP

SEQ ID NO: 719698 - protein, 9 aa, Homo Sapiens
TVFFQESRA

SEQ ID NO: 719699 - protein, 9 aa, Homo Sapiens
IVQALAALV

SEQ ID NO: 719700 - protein, 9 aa, Homo Sapiens
CTVFFQESR

SEQ ID NO: 719701 - protein, 9 aa, Homo Sapiens
LTNGFDVFK

SEQ ID NO: 719702 - protein, 9 aa, Homo Sapiens
SCLLKDIGD

SEQ ID NO: 719703 - protein, 9 aa, Homo Sapiens
THPTPTVGA

SEQ ID NO: 719704 - protein, 9 aa, Homo Sapiens
SLVIPTWLF

SEQ ID NO: 719705 - protein, 9 aa, Homo Sapiens
TSFCENRLK

SEQ ID NO: 719706 - protein, 9 aa, Homo Sapiens
SVNKMQEDT

SEQ ID NO: 719707 - protein, 9 aa, Homo Sapiens
KIPDPYSDD

SEQ ID NO: 719708 - protein, 9 aa, Homo Sapiens
AEGIEGNGT

SEQ ID NO: 719709 - protein, 9 aa, Homo Sapiens
EAPRLTPTV

SEQ ID NO: 719710 - protein, 9 aa, Homo Sapiens
WRFCRRSGK

SEQ ID NO: 719711 - protein, 9 aa, Homo Sapiens
SAYALFFRN

SEQ ID NO: 719712 - protein, 9 aa, Homo Sapiens
LHQKLTETE

SEQ ID NO: 719713 - protein, 9 aa, Homo Sapiens
DSVLSSEAA

SEQ ID NO: 719714 - protein, 9 aa, Homo Sapiens
STEAPRLTP

SEQ ID NO: 719715 - protein, 9 aa, Homo Sapiens
SEVELQQAS

SEQ ID NO: 719716 - protein, 9 aa, Homo Sapiens
MQQIANAKI

SEQ ID NO: 719717 - protein, 9 aa, Homo Sapiens
VNYTNWYLG

SEQ ID NO: 719718 - protein, 9 aa, Homo Sapiens
INKVPGFLE

SEQ ID NO: 719719 - protein, 9 aa, Homo Sapiens
KAFDQLFIL

SEQ ID NO: 719720 - protein, 9 aa, Homo Sapiens
KEELAALIY

SEQ ID NO: 719721 - protein, 9 aa, Homo Sapiens
GIPYAQPPI

SEQ ID NO: 719722 - protein, 9 aa, Homo Sapiens
TLTRPPRTW

SEQ ID NO: 719723 - protein, 9 aa, Homo Sapiens
AKKEPLWYQ

SEQ ID NO: 719724 - protein, 9 aa, Homo Sapiens
KVDCEVEEI

SEQ ID NO: 719725 - protein, 9 aa, Homo Sapiens
DIPKHKAFG

SEQ ID NO: 719726 - protein, 9 aa, Homo Sapiens
TSVSLLAAY

SEQ ID NO: 719727 - protein, 9 aa, Homo Sapiens
TSDGYHRQR

SEQ ID NO: 719728 - protein, 9 aa, Homo Sapiens
ARHRVWRAF

SEQ ID NO: 719729 - protein, 9 aa, Homo Sapiens
PEINKVPGF

SEQ ID NO: 719730 - protein, 9 aa, Homo Sapiens
DISNAEKDT

SEQ ID NO: 719731 - protein, 9 aa, Homo Sapiens
KLPSRLEDG

SEQ ID NO: 719732 - protein, 9 aa, Homo Sapiens
TITEEEAAT

SEQ ID NO: 719733 - protein, 9 aa, Homo Sapiens
VKAELLRRE

SEQ ID NO: 719734 - protein, 9 aa, Homo Sapiens
KGCLSRGRD

SEQ ID NO: 719735 - protein, 9 aa, Homo Sapiens
GFSAWIWML

SEQ ID NO: 719736 - protein, 9 aa, Homo Sapiens
RGLPPMQKN

SEQ ID NO: 719737 - protein, 9 aa, Homo Sapiens
ARLAAEYSS

SEQ ID NO: 719738 - protein, 9 aa, Homo Sapiens
PRLTPTVGA

SEQ ID NO: 719739 - protein, 9 aa, Homo Sapiens
AEKIDAVFA

SEQ ID NO: 719740 - protein, 9 aa, Homo Sapiens
TQLSRVKAE

SEQ ID NO: 719741 - protein, 9 aa, Homo Sapiens
LQLECQQDH

SEQ ID NO: 719742 - protein, 9 aa, Homo Sapiens
SKKLLKLEC

SEQ ID NO: 719743 - protein, 9 aa, Homo Sapiens
TTMEEEVAH

SEQ ID NO: 719744 - protein, 9 aa, Homo Sapiens
AGSFLALVL

SEQ ID NO: 719745 - protein, 9 aa, Homo Sapiens
VELQQASAK

SEQ ID NO: 719746 - protein, 9 aa, Homo Sapiens
LGQLDSLFS

SEQ ID NO: 719747 - protein, 9 aa, Homo Sapiens
IPNRAITAD

SEQ ID NO: 719748 - protein, 9 aa, Homo Sapiens
ANPEATEKH

SEQ ID NO: 719749 - protein, 9 aa, Homo Sapiens
FDQLFILGC

SEQ ID NO: 719750 - protein, 9 aa, Homo Sapiens
MARGFAVLL

SEQ ID NO: 719751 - protein, 9 aa, Homo Sapiens
AVTVPATVT

SEQ ID NO: 719752 - protein, 9 aa, Homo Sapiens
TSYVGNFIS

SEQ ID NO: 719753 - protein, 9 aa, Homo Sapiens
VTVVFTEEE

SEQ ID NO: 719754 - protein, 9 aa, Homo Sapiens
RAMAICKQS

SEQ ID NO: 719755 - protein, 9 aa, Homo Sapiens
QAPPWLQLE

SEQ ID NO: 719756 - protein, 9 aa, Homo Sapiens
FEFVGGFHC

SEQ ID NO: 719757 - protein, 9 aa, Homo Sapiens
SSGVGPKAF

SEQ ID NO: 719758 - protein, 9 aa, Homo Sapiens
FEEFHSFLP

SEQ ID NO: 719759 - protein, 9 aa, Homo Sapiens
AADDPRRSP

SEQ ID NO: 719760 - protein, 9 aa, Homo Sapiens
LPLSGTTTT

SEQ ID NO: 719761 - protein, 9 aa, Homo Sapiens
VNSSIEEVE

SEQ ID NO: 719762 - protein, 9 aa, Homo Sapiens
QVISSTQAV

SEQ ID NO: 719763 - protein, 9 aa, Homo Sapiens
KKNIGQAKI

SEQ ID NO: 719764 - protein, 9 aa, Homo Sapiens
DRPMPTAGT

SEQ ID NO: 719765 - protein, 9 aa, Homo Sapiens
TPTINVLQS

SEQ ID NO: 719766 - protein, 9 aa, Homo Sapiens
LIDLQILLH

SEQ ID NO: 719767 - protein, 9 aa, Homo Sapiens
LIPADLVIV

SEQ ID NO: 719768 - protein, 9 aa, Homo Sapiens
KGVGAARNA

SEQ ID NO: 719769 - protein, 9 aa, Homo Sapiens
IPTYTLVPV

SEQ ID NO: 719770 - protein, 9 aa, Homo Sapiens
MPVIQQPEI

SEQ ID NO: 719771 - protein, 9 aa, Homo Sapiens
AVAACLTPT

SEQ ID NO: 719772 - protein, 9 aa, Homo Sapiens
ALERRRRAR

SEQ ID NO: 719773 - protein, 9 aa, Homo Sapiens
TVGAALPTP

SEQ ID NO: 719774 - protein, 9 aa, Homo Sapiens
RSHDATVGA

SEQ ID NO: 719775 - protein, 9 aa, Homo Sapiens
QWKIPLLLA

SEQ ID NO: 719776 - protein, 9 aa, Homo Sapiens
VSCLSGQRD

SEQ ID NO: 719777 - protein, 9 aa, Homo Sapiens
AGADRPMPT

SEQ ID NO: 719778 - protein, 9 aa, Homo Sapiens
GPGCGHSWN

SEQ ID NO: 719779 - protein, 9 aa, Homo Sapiens
TVEAARLMP

SEQ ID NO: 719780 - protein, 9 aa, Homo Sapiens
MGCIFAFAA

SEQ ID NO: 719781 - protein, 9 aa, Homo Sapiens
LHFTSDGYH

SEQ ID NO: 719782 - protein, 9 aa, Homo Sapiens
GYRPQDRIV

SEQ ID NO: 719783 - protein, 9 aa, Homo Sapiens
TDIVPLETR

SEQ ID NO: 719784 - protein, 9 aa, Homo Sapiens
YVGNFISTK

SEQ ID NO: 719785 - protein, 9 aa, Homo Sapiens
LLNRKDICA

SEQ ID NO: 719786 - protein, 9 aa, Homo Sapiens
ARATAMEEA

SEQ ID NO: 719787 - protein, 9 aa, Homo Sapiens
CQHNQQQCQ

SEQ ID NO: 719788 - protein, 9 aa, Homo Sapiens
YGTCKCLCT

SEQ ID NO: 719789 - protein, 9 aa, Homo Sapiens
TVEGARAAD

SEQ ID NO: 719790 - protein, 9 aa, Homo Sapiens
STLMEQYIK

SEQ ID NO: 719791 - protein, 9 aa, Homo Sapiens
RANRGGQRQ

SEQ ID NO: 719792 - protein, 9 aa, Homo Sapiens
GAALPTPTV

SEQ ID NO: 719793 - protein, 9 aa, Homo Sapiens
KIKVDCEVE

SEQ ID NO: 719794 - protein, 9 aa, Homo Sapiens
EEEAATRRT

SEQ ID NO: 719795 - protein, 9 aa, Homo Sapiens
YLYPDIPKH

SEQ ID NO: 719796 - protein, 9 aa, Homo Sapiens
EAACSMPTV

SEQ ID NO: 719797 - protein, 9 aa, Homo Sapiens
NYTNWYLGE

SEQ ID NO: 719798 - protein, 9 aa, Homo Sapiens
TRVRAMAIC

SEQ ID NO: 719799 - protein, 9 aa, Homo Sapiens
SLGMIFKKR

SEQ ID NO: 719800 - protein, 9 aa, Homo Sapiens
HQKLTETEG

SEQ ID NO: 719801 - protein, 9 aa, Homo Sapiens
GGAMHSAFG

SEQ ID NO: 719802 - protein, 9 aa, Homo Sapiens
EECAKVLID

SEQ ID NO: 719803 - protein, 9 aa, Homo Sapiens
RNTQAAIKG

SEQ ID NO: 719804 - protein, 9 aa, Homo Sapiens
LDPCMLLAL

SEQ ID NO: 719805 - protein, 9 aa, Homo Sapiens
VPAGATATE

SEQ ID NO: 719806 - protein, 9 aa, Homo Sapiens
CAKVLIDLQ

SEQ ID NO: 719807 - protein, 9 aa, Homo Sapiens
KLHGRAPQL

SEQ ID NO: 719808 - protein, 9 aa, Homo Sapiens
DENQTLTLA

SEQ ID NO: 719809 - protein, 9 aa, Homo Sapiens
HLCQPLPTP

SEQ ID NO: 719810 - protein, 9 aa, Homo Sapiens
AYTQPQAKG

SEQ ID NO: 719811 - protein, 9 aa, Homo Sapiens
PFAAGSVFS

SEQ ID NO: 719812 - protein, 9 aa, Homo Sapiens
VEAARPMPT

SEQ ID NO: 719813 - protein, 9 aa, Homo Sapiens
TVGATTVPA

SEQ ID NO: 719814 - protein, 9 aa, Homo Sapiens
TMVAATRIV

SEQ ID NO: 719815 - protein, 9 aa, Homo Sapiens
MGSGTIKAK

SEQ ID NO: 719816 - protein, 9 aa, Homo Sapiens
QGVHNAAGQ

SEQ ID NO: 719817 - protein, 9 aa, Homo Sapiens
GSPRAQHAG

SEQ ID NO: 719818 - protein, 9 aa, Homo Sapiens
KDAEVFQVQ

SEQ ID NO: 719819 - protein, 9 aa, Homo Sapiens
VTQVGWDGL

SEQ ID NO: 719820 - protein, 9 aa, Homo Sapiens
TEEEAATRN

SEQ ID NO: 719821 - protein, 9 aa, Homo Sapiens
AENKLDPCM

SEQ ID NO: 719822 - protein, 9 aa, Homo Sapiens
TEEEAATRS

SEQ ID NO: 719823 - protein, 9 aa, Homo Sapiens
DMGFSAWIW

SEQ ID NO: 719824 - protein, 9 aa, Homo Sapiens
SSYLAGPLE

SEQ ID NO: 719825 - protein, 9 aa, Homo Sapiens
RLMPTVGAT

SEQ ID NO: 719826 - protein, 9 aa, Homo Sapiens
GNSREPWNP

SEQ ID NO: 719827 - protein, 9 aa, Homo Sapiens
HLTASQLSK

SEQ ID NO: 719828 - protein, 9 aa, Homo Sapiens
AQEYDEKTS

SEQ ID NO: 719829 - protein, 9 aa, Homo Sapiens
ANDLGQLDS

SEQ ID NO: 719830 - protein, 9 aa, Homo Sapiens
ATFASVFHV

SEQ ID NO: 719831 - protein, 9 aa, Homo Sapiens
LYSWEEAKK

SEQ ID NO: 719832 - protein, 9 aa, Homo Sapiens
SMTSKVSRC

SEQ ID NO: 719833 - protein, 9 aa, Homo Sapiens
SCAEGIEGN

SEQ ID NO: 719834 - protein, 9 aa, Homo Sapiens
QLKDDDILR

SEQ ID NO: 719835 - protein, 9 aa, Homo Sapiens
YHRQRGFSA

SEQ ID NO: 719836 - protein, 9 aa, Homo Sapiens
DAPAADQPP

SEQ ID NO: 719837 - protein, 9 aa, Homo Sapiens
MLFGDLESF

SEQ ID NO: 719838 - protein, 9 aa, Homo Sapiens
NAEVSTKDV

SEQ ID NO: 719839 - protein, 9 aa, Homo Sapiens
KLECKQAPP

SEQ ID NO: 719840 - protein, 9 aa, Homo Sapiens
NRKFRPFRD

SEQ ID NO: 719841 - protein, 9 aa, Homo Sapiens
MQKNVVFVI

SEQ ID NO: 719842 - protein, 9 aa, Homo Sapiens
KKEPLWYQV

SEQ ID NO: 719843 - protein, 9 aa, Homo Sapiens
AYCYNQHAK

SEQ ID NO: 719844 - protein, 9 aa, Homo Sapiens
VGAQVSQML

SEQ ID NO: 719845 - protein, 9 aa, Homo Sapiens
RRKDLGLRL

SEQ ID NO: 719846 - protein, 9 aa, Homo Sapiens
RIVYPLLQG

SEQ ID NO: 719847 - protein, 9 aa, Homo Sapiens
GCTGALPLI

SEQ ID NO: 719848 - protein, 9 aa, Homo Sapiens
SMAVKSSSF

SEQ ID NO: 719849 - protein, 9 aa, Homo Sapiens
TALPGGFKQ

SEQ ID NO: 719850 - protein, 8 aa, Homo Sapiens
SDQIKFIM

SEQ ID NO: 719851 - protein, 9 aa, Homo Sapiens
AARSMPTAE

SEQ ID NO: 719852 - protein, 9 aa, Homo Sapiens
ATHPTPTVG

SEQ ID NO: 719853 - protein, 9 aa, Homo Sapiens
EGSPSRSDY

SEQ ID NO: 719854 - protein, 9 aa, Homo Sapiens
PRQRRRRGL

SEQ ID NO: 719855 - protein, 9 aa, Homo Sapiens
GSVFSISML

SEQ ID NO: 719856 - protein, 9 aa, Homo Sapiens
DPEMPLQSC

SEQ ID NO: 719857 - protein, 9 aa, Homo Sapiens
LHNITVCEQ

SEQ ID NO: 719858 - protein, 9 aa, Homo Sapiens
KIINYTTVA

SEQ ID NO: 719859 - protein, 9 aa, Homo Sapiens
DTVRLFLKS

SEQ ID NO: 719860 - protein, 9 aa, Homo Sapiens
AASTVPTTV

SEQ ID NO: 719861 - protein, 9 aa, Homo Sapiens
RGLSRWGPR

SEQ ID NO: 719862 - protein, 9 aa, Homo Sapiens
NKLDPCMLL

SEQ ID NO: 719863 - protein, 9 aa, Homo Sapiens
ESQWLPAVI

SEQ ID NO: 719864 - protein, 9 aa, Homo Sapiens
FGQGVHNAA

SEQ ID NO: 719865 - protein, 9 aa, Homo Sapiens
VEAARLMPT

SEQ ID NO: 719866 - protein, 9 aa, Homo Sapiens
PNNFAKREI

SEQ ID NO: 719867 - protein, 9 aa, Homo Sapiens
IKATATQFV

SEQ ID NO: 719868 - protein, 9 aa, Homo Sapiens
IALSSLNRK

SEQ ID NO: 719869 - protein, 9 aa, Homo Sapiens
KVSRCGNQR

SEQ ID NO: 719870 - protein, 9 aa, Homo Sapiens
AMDESSIFD

SEQ ID NO: 719871 - protein, 9 aa, Homo Sapiens
KEEDTRTAS

SEQ ID NO: 719872 - protein, 9 aa, Homo Sapiens
VLPRKHLTK

SEQ ID NO: 719873 - protein, 9 aa, Homo Sapiens
KEMAQEYDE

SEQ ID NO: 719874 - protein, 9 aa, Homo Sapiens
PRRSPFPRQ

SEQ ID NO: 719875 - protein, 9 aa, Homo Sapiens
YGNSLSSIL

SEQ ID NO: 719876 - protein, 9 aa, Homo Sapiens
NFEFVGGFH

SEQ ID NO: 719877 - protein, 9 aa, Homo Sapiens
TVMAGATAT

SEQ ID NO: 719878 - protein, 9 aa, Homo Sapiens
CEECAKVLI

SEQ ID NO: 719879 - protein, 9 aa, Homo Sapiens
RKEDALPGH

SEQ ID NO: 719880 - protein, 9 aa, Homo Sapiens
GPSLRAGLE

SEQ ID NO: 719881 - protein, 9 aa, Homo Sapiens
QVSQMLDIL

SEQ ID NO: 719882 - protein, 9 aa, Homo Sapiens
MRMALDRYV

SEQ ID NO: 719883 - protein, 9 aa, Homo Sapiens
MAIETVGHA

SEQ ID NO: 719884 - protein, 9 aa, Homo Sapiens
DPCMLLALR

SEQ ID NO: 719885 - protein, 9 aa, Homo Sapiens
AEIVQQQAA

SEQ ID NO: 719886 - protein, 9 aa, Homo Sapiens
DFPQVSTWM

SEQ ID NO: 719887 - protein, 9 aa, Homo Sapiens
EAVTLKAVR

SEQ ID NO: 719888 - protein, 9 aa, Homo Sapiens
NKEDSLLVS

SEQ ID NO: 719889 - protein, 9 aa, Homo Sapiens
VVRRGKVTV

SEQ ID NO: 719890 - protein, 9 aa, Homo Sapiens
EAATRNTKA

SEQ ID NO: 719891 - protein, 9 aa, Homo Sapiens
IIKGVNASM

SEQ ID NO: 719892 - protein, 9 aa, Homo Sapiens
RPHNVAFLL

SEQ ID NO: 719893 - protein, 9 aa, Homo Sapiens
EEFHSFLPG

SEQ ID NO: 719894 - protein, 9 aa, Homo Sapiens
ITAKLHGRA

SEQ ID NO: 719895 - protein, 9 aa, Homo Sapiens
RAANPLLHL

SEQ ID NO: 719896 - protein, 9 aa, Homo Sapiens
SPSSPWRQD

SEQ ID NO: 719897 - protein, 9 aa, Homo Sapiens
DMSSLGLEL

SEQ ID NO: 719898 - protein, 9 aa, Homo Sapiens
LIYELKQEQ

SEQ ID NO: 719899 - protein, 9 aa, Homo Sapiens
TEAAPSMPT

SEQ ID NO: 719900 - protein, 9 aa, Homo Sapiens
RTPSYLGVS

SEQ ID NO: 719901 - protein, 9 aa, Homo Sapiens
AAGSFLALV

SEQ ID NO: 719902 - protein, 9 aa, Homo Sapiens
SRILTDDLG

SEQ ID NO: 719903 - protein, 9 aa, Homo Sapiens
VEGSPSRSD

SEQ ID NO: 719904 - protein, 9 aa, Homo Sapiens
GARPFAELA

SEQ ID NO: 719905 - protein, 9 aa, Homo Sapiens
VLTWRFCRR

SEQ ID NO: 719906 - protein, 9 aa, Homo Sapiens
TVFLYQPQW

SEQ ID NO: 719907 - protein, 9 aa, Homo Sapiens
KVARKQDTR

SEQ ID NO: 719908 - protein, 9 aa, Homo Sapiens
QPQAKGVGA

SEQ ID NO: 719909 - protein, 9 aa, Homo Sapiens
ADDPRRSPF

SEQ ID NO: 719910 - protein, 9 aa, Homo Sapiens
VSYFSTDNS

SEQ ID NO: 719911 - protein, 9 aa, Homo Sapiens
VLMRMALDR

SEQ ID NO: 719912 - protein, 9 aa, Homo Sapiens
LLKRRKDLG

SEQ ID NO: 719913 - protein, 9 aa, Homo Sapiens
FFQESRAKD

SEQ ID NO: 719914 - protein, 9 aa, Homo Sapiens
AKKKTVEWV

SEQ ID NO: 719915 - protein, 9 aa, Homo Sapiens
EESCTPWPC

SEQ ID NO: 719916 - protein, 9 aa, Homo Sapiens
IPLLLAFLV

SEQ ID NO: 719917 - protein, 9 aa, Homo Sapiens
PGSVTGTAV

SEQ ID NO: 719918 - protein, 9 aa, Homo Sapiens
IPDPYSDDV

SEQ ID NO: 719919 - protein, 9 aa, Homo Sapiens
GATTVLARA

SEQ ID NO: 719920 - protein, 9 aa, Homo Sapiens
KLPSQVLPR

SEQ ID NO: 719921 - protein, 9 aa, Homo Sapiens
LTEFVLTVF

SEQ ID NO: 719922 - protein, 9 aa, Homo Sapiens
KPTAGAATV

SEQ ID NO: 719923 - protein, 9 aa, Homo Sapiens
PEPGVRRPE

SEQ ID NO: 719924 - protein, 9 aa, Homo Sapiens
CSSECVAIT

SEQ ID NO: 719925 - protein, 9 aa, Homo Sapiens
EEEATTKST

SEQ ID NO: 719926 - protein, 9 aa, Homo Sapiens
KRKHTISCS

SEQ ID NO: 719927 - protein, 9 aa, Homo Sapiens
INVLQSKDT

SEQ ID NO: 719928 - protein, 9 aa, Homo Sapiens
DAYCYNQHA

SEQ ID NO: 719929 - protein, 9 aa, Homo Sapiens
SSECVAITP

SEQ ID NO: 719930 - protein, 9 aa, Homo Sapiens
NPQVPQEYQ

SEQ ID NO: 719931 - protein, 9 aa, Homo Sapiens
GMRCTVFFQ

SEQ ID NO: 719932 - protein, 9 aa, Homo Sapiens
PMPTAGTTT

SEQ ID NO: 719933 - protein, 9 aa, Homo Sapiens
TASQLSKPC

SEQ ID NO: 719934 - protein, 9 aa, Homo Sapiens
RTRKGAILS

SEQ ID NO: 719935 - protein, 9 aa, Homo Sapiens
KHKAFGKHY

SEQ ID NO: 719936 - protein, 9 aa, Homo Sapiens
NITSSGVGP

SEQ ID NO: 719937 - protein, 9 aa, Homo Sapiens
FLEEDIRQV

SEQ ID NO: 719938 - protein, 9 aa, Homo Sapiens
GSSLHCHNP

SEQ ID NO: 719939 - protein, 9 aa, Homo Sapiens
RRRRGLSRW

SEQ ID NO: 719940 - protein, 9 aa, Homo Sapiens
CQWQSGLIG

SEQ ID NO: 719941 - protein, 9 aa, Homo Sapiens
SSIEEVEAD

SEQ ID NO: 719942 - protein, 9 aa, Homo Sapiens
RGGVTLVKE

SEQ ID NO: 719943 - protein, 9 aa, Homo Sapiens
NKQNLNAEV

SEQ ID NO: 719944 - protein, 9 aa, Homo Sapiens
PEKAAGSFL

SEQ ID NO: 719945 - protein, 9 aa, Homo Sapiens
KAELLRREA

SEQ ID NO: 719946 - protein, 9 aa, Homo Sapiens
NKVPGFLEK

SEQ ID NO: 719947 - protein, 9 aa, Homo Sapiens
GGLPLEKVL

SEQ ID NO: 719948 - protein, 9 aa, Homo Sapiens
EIVQALAAL

SEQ ID NO: 719949 - protein, 9 aa, Homo Sapiens
QWLNSQPRW

SEQ ID NO: 719950 - protein, 9 aa, Homo Sapiens
TAVDSLTVW

SEQ ID NO: 719951 - protein, 9 aa, Homo Sapiens
VTLKAVRQG

SEQ ID NO: 719952 - protein, 9 aa, Homo Sapiens
VGMRCTVFF

SEQ ID NO: 719953 - protein, 9 aa, Homo Sapiens
EESHGLQEW

SEQ ID NO: 719954 - protein, 9 aa, Homo Sapiens
QSWGSGPPM

SEQ ID NO: 719955 - protein, 9 aa, Homo Sapiens
LQFTLSVRL

SEQ ID NO: 719956 - protein, 9 aa, Homo Sapiens
SWTHREIVQ

SEQ ID NO: 719957 - protein, 9 aa, Homo Sapiens
AKGSSVHVV

SEQ ID NO: 719958 - protein, 9 aa, Homo Sapiens
QHAKECGGV

SEQ ID NO: 719959 - protein, 9 aa, Homo Sapiens
QANPEATEK

SEQ ID NO: 719960 - protein, 9 aa, Homo Sapiens
PTVGATTVL

SEQ ID NO: 719961 - protein, 9 aa, Homo Sapiens
ATATEEEAA

SEQ ID NO: 719962 - protein, 9 aa, Homo Sapiens
PTVGATTVP

SEQ ID NO: 719963 - protein, 9 aa, Homo Sapiens
TTVPAGATA

SEQ ID NO: 719964 - protein, 9 aa, Homo Sapiens
FALQKMDSV

SEQ ID NO: 719965 - protein, 9 aa, Homo Sapiens
PTPTVGAVT

SEQ ID NO: 719966 - protein, 9 aa, Homo Sapiens
DISQPGLSL

SEQ ID NO: 719967 - protein, 9 aa, Homo Sapiens
SRVKAELLR

SEQ ID NO: 719968 - protein, 9 aa, Homo Sapiens
SPSGNAASS

SEQ ID NO: 719969 - protein, 9 aa, Homo Sapiens
QESKKLLKL

SEQ ID NO: 719970 - protein, 9 aa, Homo Sapiens
KSSLLFQHA

SEQ ID NO: 719971 - protein, 9 aa, Homo Sapiens
EMAQEYDEK

SEQ ID NO: 719972 - protein, 9 aa, Homo Sapiens
LRAPTFQVI

SEQ ID NO: 719973 - protein, 9 aa, Homo Sapiens
PLLLDLLPQ

SEQ ID NO: 719974 - protein, 9 aa, Homo Sapiens
NKDVKDAAG

SEQ ID NO: 719975 - protein, 9 aa, Homo Sapiens
GLSAVSHNG

SEQ ID NO: 719976 - protein, 9 aa, Homo Sapiens
ATMARGFAV

SEQ ID NO: 719977 - protein, 9 aa, Homo Sapiens
ITSSGVGPK

SEQ ID NO: 719978 - protein, 9 aa, Homo Sapiens
EDGASLRLH

SEQ ID NO: 719979 - protein, 9 aa, Homo Sapiens
SGLIGKDGT

SEQ ID NO: 719980 - protein, 9 aa, Homo Sapiens
KSPHPVFAY

SEQ ID NO: 719981 - protein, 9 aa, Homo Sapiens
GVLCPIYIP

SEQ ID NO: 719982 - protein, 9 aa, Homo Sapiens
FPDTSVSLL

SEQ ID NO: 719983 - protein, 9 aa, Homo Sapiens
FSAWIWMLY

SEQ ID NO: 719984 - protein, 9 aa, Homo Sapiens
EAAPSMPTV

SEQ ID NO: 719985 - protein, 9 aa, Homo Sapiens
KLTETEGEL

SEQ ID NO: 719986 - protein, 9 aa, Homo Sapiens
SGPPMQFMD

SEQ ID NO: 719987 - protein, 9 aa, Homo Sapiens
LKNKEDSLL

SEQ ID NO: 719988 - protein, 9 aa, Homo Sapiens
LLPQSLLPQ

SEQ ID NO: 719989 - protein, 9 aa, Homo Sapiens
HDATVGAAL

SEQ ID NO: 719990 - protein, 9 aa, Homo Sapiens
ALPTMTARH

SEQ ID NO: 719991 - protein, 9 aa, Homo Sapiens
QVLPRKHLT

SEQ ID NO: 719992 - protein, 9 aa, Homo Sapiens
VESLESQKL

SEQ ID NO: 719993 - protein, 9 aa, Homo Sapiens
LRLQTHQRV

SEQ ID NO: 719994 - protein, 9 aa, Homo Sapiens
PQDQRESPA

SEQ ID NO: 719995 - protein, 9 aa, Homo Sapiens
CERGEGEHD

SEQ ID NO: 719996 - protein, 9 aa, Homo Sapiens
FELMDDYYF

SEQ ID NO: 719997 - protein, 9 aa, Homo Sapiens
ESGVLMRMA

SEQ ID NO: 719998 - protein, 9 aa, Homo Sapiens
PVNYTNWYL

SEQ ID NO: 719999 - protein, 9 aa, Homo Sapiens
SATLSPLAA

SEQ ID NO: 720000 - protein, 9 aa, Homo Sapiens
LRAGLEVEP

SEQ ID NO: 720001 - protein, 9 aa, Homo Sapiens
ANSCLLKDI

SEQ ID NO: 720002 - protein, 9 aa, Homo Sapiens
TTTKFIKNP

SEQ ID NO: 720003 - protein, 9 aa, Homo Sapiens
AKATQKKAN

SEQ ID NO: 720004 - protein, 9 aa, Homo Sapiens
LGEPAGRGK

SEQ ID NO: 720005 - protein, 9 aa, Homo Sapiens
FRDISQPGL

SEQ ID NO: 720006 - protein, 9 aa, Homo Sapiens
DTRESQWLP

SEQ ID NO: 720007 - protein, 9 aa, Homo Sapiens
EEGGDPDNV

SEQ ID NO: 720008 - protein, 9 aa, Homo Sapiens
RCRKEDALP

SEQ ID NO: 720009 - protein, 9 aa, Homo Sapiens
NTYGTCKCL

SEQ ID NO: 720010 - protein, 9 aa, Homo Sapiens
CKQAPPWLQ

SEQ ID NO: 720011 - protein, 9 aa, Homo Sapiens
TFKAFDQLF

SEQ ID NO: 720012 - protein, 9 aa, Homo Sapiens
TRSTEAARS

SEQ ID NO: 720013 - protein, 9 aa, Homo Sapiens
MFWYIMEKW

SEQ ID NO: 720014 - protein, 9 aa, Homo Sapiens
PEMPLQSCL

SEQ ID NO: 720015 - protein, 9 aa, Homo Sapiens
EERANMSSQ

SEQ ID NO: 720016 - protein, 9 aa, Homo Sapiens
VHVVYSTPA

SEQ ID NO: 720017 - protein, 9 aa, Homo Sapiens
QHAGIAHTL

SEQ ID NO: 720018 - protein, 9 aa, Homo Sapiens
QQPEILSSG

SEQ ID NO: 720019 - protein, 9 aa, Homo Sapiens
TVPAGTTPA

SEQ ID NO: 720020 - protein, 9 aa, Homo Sapiens
PMQFMDCMA

SEQ ID NO: 720021 - protein, 9 aa, Homo Sapiens
ESPAAKKEP

SEQ ID NO: 720022 - protein, 9 aa, Homo Sapiens
TVPARATAM

SEQ ID NO: 720023 - protein, 9 aa, Homo Sapiens
DAKVENRGN

SEQ ID NO: 720024 - protein, 9 aa, Homo Sapiens
KQAIPQDQR

SEQ ID NO: 720025 - protein, 9 aa, Homo Sapiens
EKLPTSHTC

SEQ ID NO: 720026 - protein, 9 aa, Homo Sapiens
SCQHNQQQC

SEQ ID NO: 720027 - protein, 9 aa, Homo Sapiens
QVGWDGLRL

SEQ ID NO: 720028 - protein, 9 aa, Homo Sapiens
CQPLPTPCA

SEQ ID NO: 720029 - protein, 9 aa, Homo Sapiens
SRCGNQRYK

SEQ ID NO: 720030 - protein, 9 aa, Homo Sapiens
FTKSSLLFQ

SEQ ID NO: 720031 - protein, 9 aa, Homo Sapiens
LQNAQSKME

SEQ ID NO: 720032 - protein, 9 aa, Homo Sapiens
EYVWQLVFA

SEQ ID NO: 720033 - protein, 9 aa, Homo Sapiens
IELKRIHDS

SEQ ID NO: 720034 - protein, 9 aa, Homo Sapiens
PLAAGPGSG

SEQ ID NO: 720035 - protein, 9 aa, Homo Sapiens
PSVGATGSH

SEQ ID NO: 720036 - protein, 9 aa, Homo Sapiens
TPTVGATTV

SEQ ID NO: 720037 - protein, 9 aa, Homo Sapiens
PVFSIGDAE

SEQ ID NO: 720038 - protein, 9 aa, Homo Sapiens
LNPITVPYN

SEQ ID NO: 720039 - protein, 9 aa, Homo Sapiens
TDGSSLHCH

SEQ ID NO: 720040 - protein, 9 aa, Homo Sapiens
DTRTASQSL

SEQ ID NO: 720041 - protein, 9 aa, Homo Sapiens
TATEEEAAT

SEQ ID NO: 720042 - protein, 9 aa, Homo Sapiens
THVVVESIF

SEQ ID NO: 720043 - protein, 9 aa, Homo Sapiens
VGKLVSKLQ

SEQ ID NO: 720044 - protein, 9 aa, Homo Sapiens
VTKFCSVLA

SEQ ID NO: 720045 - protein, 9 aa, Homo Sapiens
KVEGSPSRS

SEQ ID NO: 720046 - protein, 9 aa, Homo Sapiens
KNGPDTEKL

SEQ ID NO: 720047 - protein, 9 aa, Homo Sapiens
FSFDLQNAQ

SEQ ID NO: 720048 - protein, 9 aa, Homo Sapiens
SATAMAGVT

SEQ ID NO: 720049 - protein, 9 aa, Homo Sapiens
CSMPTVEAA

SEQ ID NO: 720050 - protein, 9 aa, Homo Sapiens
FDDMSSLGL

SEQ ID NO: 720051 - protein, 9 aa, Homo Sapiens
TSSGVGPKA

SEQ ID NO: 720052 - protein, 9 aa, Homo Sapiens
PRTWVPGVL

SEQ ID NO: 720053 - protein, 9 aa, Homo Sapiens
DGSGLGEGD

SEQ ID NO: 720054 - protein, 9 aa, Homo Sapiens
RLTPTVGAA

SEQ ID NO: 720055 - protein, 9 aa, Homo Sapiens
TAGAATVSA

SEQ ID NO: 720056 - protein, 9 aa, Homo Sapiens
WNSRPRFAE

SEQ ID NO: 720057 - protein, 9 aa, Homo Sapiens
TVPATVTTG

SEQ ID NO: 720058 - protein, 9 aa, Homo Sapiens
FKKRSTRTR

SEQ ID NO: 720059 - protein, 9 aa, Homo Sapiens
YALFFRNTQ

SEQ ID NO: 720060 - protein, 9 aa, Homo Sapiens
FKDVTVVFT

SEQ ID NO: 720061 - protein, 9 aa, Homo Sapiens
SLLCERGEG

SEQ ID NO: 720062 - protein, 9 aa, Homo Sapiens
MQLLQGGLP

SEQ ID NO: 720063 - protein, 9 aa, Homo Sapiens
TWVPGVLTW

SEQ ID NO: 720064 - protein, 9 aa, Homo Sapiens
RKYVSQNKS

SEQ ID NO: 720065 - protein, 9 aa, Homo Sapiens
ETQLSRVKA

SEQ ID NO: 720066 - protein, 9 aa, Homo Sapiens
AFGKAYKSS

SEQ ID NO: 720067 - protein, 9 aa, Homo Sapiens
YRVDDAQFP

SEQ ID NO: 720068 - protein, 9 aa, Homo Sapiens
DQRESPAAK

SEQ ID NO: 720069 - protein, 9 aa, Homo Sapiens
KAARPMPTA

SEQ ID NO: 720070 - protein, 9 aa, Homo Sapiens
LTFKAFDQL

SEQ ID NO: 720071 - protein, 9 aa, Homo Sapiens
PARATATEE

SEQ ID NO: 720072 - protein, 9 aa, Homo Sapiens
AVLLNRKDI

SEQ ID NO: 720073 - protein, 9 aa, Homo Sapiens
DAQFPYPAS

SEQ ID NO: 720074 - protein, 9 aa, Homo Sapiens
AQVSQMLDI

SEQ ID NO: 720075 - protein, 9 aa, Homo Sapiens
DHMHLSPFV

SEQ ID NO: 720076 - protein, 9 aa, Homo Sapiens
ATAMEEEAT

SEQ ID NO: 720077 - protein, 9 aa, Homo Sapiens
REIVQALAA

SEQ ID NO: 720078 - protein, 9 aa, Homo Sapiens
EGLRAPTFQ

SEQ ID NO: 720079 - protein, 9 aa, Homo Sapiens
YGVLNPITV

SEQ ID NO: 720080 - protein, 9 aa, Homo Sapiens
ACLTPTVGA

SEQ ID NO: 720081 - protein, 9 aa, Homo Sapiens
KDDDILRHC

SEQ ID NO: 720082 - protein, 9 aa, Homo Sapiens
SMPTAVAAC

SEQ ID NO: 720083 - protein, 9 aa, Homo Sapiens
IGGQDLNDE

SEQ ID NO: 720084 - protein, 9 aa, Homo Sapiens
NMGLTSVSC

SEQ ID NO: 720085 - protein, 9 aa, Homo Sapiens
KLVSKLQDG

SEQ ID NO: 720086 - protein, 9 aa, Homo Sapiens
QKRQERNKL

SEQ ID NO: 720087 - protein, 9 aa, Homo Sapiens
CRKYVSQNK

SEQ ID NO: 720088 - protein, 9 aa, Homo Sapiens
PPMQKNVVF

SEQ ID NO: 720089 - protein, 9 aa, Homo Sapiens
ISMTSKVSR

SEQ ID NO: 720090 - protein, 9 aa, Homo Sapiens
GLSRWGPRA

SEQ ID NO: 720091 - protein, 9 aa, Homo Sapiens
STPTINVLQ

SEQ ID NO: 720092 - protein, 9 aa, Homo Sapiens
PFPRQRRRR

SEQ ID NO: 720093 - protein, 9 aa, Homo Sapiens
KRRKDLGLR

SEQ ID NO: 720094 - protein, 9 aa, Homo Sapiens
SPRAQHAGI

SEQ ID NO: 720095 - protein, 9 aa, Homo Sapiens
KLYKCEECA

SEQ ID NO: 720096 - protein, 9 aa, Homo Sapiens
RDDQRPPPP

SEQ ID NO: 720097 - protein, 9 aa, Homo Sapiens
LSPLAAGPG

SEQ ID NO: 720098 - protein, 9 aa, Homo Sapiens
CTVWSPPAP

SEQ ID NO: 720099 - protein, 9 aa, Homo Sapiens
KYPSQKPLS

SEQ ID NO: 720100 - protein, 9 aa, Homo Sapiens
LVSKLQDGG

SEQ ID NO: 720101 - protein, 9 aa, Homo Sapiens
PDPYSDDVS

SEQ ID NO: 720102 - protein, 9 aa, Homo Sapiens
WAAQRIHEG

SEQ ID NO: 720103 - protein, 9 aa, Homo Sapiens
SYLVLRPHN

SEQ ID NO: 720104 - protein, 9 aa, Homo Sapiens
MSCQHNQQQ

SEQ ID NO: 720105 - protein, 9 aa, Homo Sapiens
LLLDLLPQS

SEQ ID NO: 720106 - protein, 9 aa, Homo Sapiens
VRYRVDDAQ

SEQ ID NO: 720107 - protein, 9 aa, Homo Sapiens
RFCRRSGKW

SEQ ID NO: 720108 - protein, 9 aa, Homo Sapiens
EAATRSTEA

SEQ ID NO: 720109 - protein, 9 aa, Homo Sapiens
KADVFKNMQ

SEQ ID NO: 720110 - protein, 9 aa, Homo Sapiens
SVSCPSSLP

SEQ ID NO: 720111 - protein, 9 aa, Homo Sapiens
LAIGFFPVS

SEQ ID NO: 720112 - protein, 9 aa, Homo Sapiens
LQWLNSQPR

SEQ ID NO: 720113 - protein, 9 aa, Homo Sapiens
WSNQTLNNS

SEQ ID NO: 720114 - protein, 9 aa, Homo Sapiens
STEAACSMP

SEQ ID NO: 720115 - protein, 9 aa, Homo Sapiens
SCKLTCFSP

SEQ ID NO: 720116 - protein, 9 aa, Homo Sapiens
THREIVQAL

SEQ ID NO: 720117 - protein, 9 aa, Homo Sapiens
LAGPCAHPS

SEQ ID NO: 720118 - protein, 9 aa, Homo Sapiens
SVFSHLTAS

SEQ ID NO: 720119 - protein, 9 aa, Homo Sapiens
GPDTEKLPT

SEQ ID NO: 720120 - protein, 9 aa, Homo Sapiens
VVKVGILEP

SEQ ID NO: 720121 - protein, 9 aa, Homo Sapiens
VVVESIFTN

SEQ ID NO: 720122 - protein, 9 aa, Homo Sapiens
EAARLTPTA

SEQ ID NO: 720123 - protein, 9 aa, Homo Sapiens
SRRQQRANR

SEQ ID NO: 720124 - protein, 9 aa, Homo Sapiens
LFFRNTQAA

SEQ ID NO: 720125 - protein, 9 aa, Homo Sapiens
SVHVVYSTP

SEQ ID NO: 720126 - protein, 9 aa, Homo Sapiens
YYFTSIKSL

SEQ ID NO: 720127 - protein, 9 aa, Homo Sapiens
VTFKDVTVV

SEQ ID NO: 720128 - protein, 9 aa, Homo Sapiens
PIYIPYSFR

SEQ ID NO: 720129 - protein, 9 aa, Homo Sapiens
QRESPAAKK

SEQ ID NO: 720130 - protein, 9 aa, Homo Sapiens
PVSSQGCDA

SEQ ID NO: 720131 - protein, 9 aa, Homo Sapiens
WGTHVVVES

SEQ ID NO: 720132 - protein, 9 aa, Homo Sapiens
SMPTAEATH

SEQ ID NO: 720133 - protein, 9 aa, Homo Sapiens
NWYLGEPAG

SEQ ID NO: 720134 - protein, 9 aa, Homo Sapiens
IKKNIGQAK

SEQ ID NO: 720135 - protein, 9 aa, Homo Sapiens
FTLLLPQAI

SEQ ID NO: 720136 - protein, 9 aa, Homo Sapiens
GFAVLLVLF

SEQ ID NO: 720137 - protein, 9 aa, Homo Sapiens
CINTYGTCK

SEQ ID NO: 720138 - protein, 9 aa, Homo Sapiens
AGPCAHPSV

SEQ ID NO: 720139 - protein, 9 aa, Homo Sapiens
QTLNNSTWS

SEQ ID NO: 720140 - protein, 9 aa, Homo Sapiens
PMQKNVVFV

SEQ ID NO: 720141 - protein, 9 aa, Homo Sapiens
LKVARKQDT

SEQ ID NO: 720142 - protein, 9 aa, Homo Sapiens
EFHSFLPGA

SEQ ID NO: 720143 - protein, 9 aa, Homo Sapiens
EAAPLMPTV

SEQ ID NO: 720144 - protein, 9 aa, Homo Sapiens
LALHNITVC

SEQ ID NO: 720145 - protein, 9 aa, Homo Sapiens
LIKERAANP

SEQ ID NO: 720146 - protein, 9 aa, Homo Sapiens
LSDKIFMMF

SEQ ID NO: 720147 - protein, 9 aa, Homo Sapiens
KAFSQRSHV

SEQ ID NO: 720148 - protein, 9 aa, Homo Sapiens
QDLKDLYNT

SEQ ID NO: 720149 - protein, 9 aa, Homo Sapiens
ALFTQSADV

SEQ ID NO: 720150 - protein, 9 aa, Homo Sapiens
FYKCEAFGK

SEQ ID NO: 720151 - protein, 9 aa, Homo Sapiens
PRHPGSSYL

SEQ ID NO: 720152 - protein, 9 aa, Homo Sapiens
SGRDDQRPP

SEQ ID NO: 720153 - protein, 9 aa, Homo Sapiens
HGSGRDDQR

SEQ ID NO: 720154 - protein, 9 aa, Homo Sapiens
EKAAGSFLA

SEQ ID NO: 720155 - protein, 9 aa, Homo Sapiens
MTSKVSRCG

SEQ ID NO: 720156 - protein, 9 aa, Homo Sapiens
SPLAAGPGS

SEQ ID NO: 720157 - protein, 9 aa, Homo Sapiens
LKAVRQGGR

SEQ ID NO: 720158 - protein, 9 aa, Homo Sapiens
GSRKAQQEA

SEQ ID NO: 720159 - protein, 9 aa, Homo Sapiens
HNAAGQAGN

SEQ ID NO: 720160 - protein, 9 aa, Homo Sapiens
SPPAPAQLT

SEQ ID NO: 720161 - protein, 9 aa, Homo Sapiens
TGALPLIQS

SEQ ID NO: 720162 - protein, 9 aa, Homo Sapiens
SVGATGSHV

SEQ ID NO: 720163 - protein, 9 aa, Homo Sapiens
LEGVNSSIE

SEQ ID NO: 720164 - protein, 9 aa, Homo Sapiens
HSWNTRHIL

SEQ ID NO: 720165 - protein, 9 aa, Homo Sapiens
NQLFPNNFA

SEQ ID NO: 720166 - protein, 9 aa, Homo Sapiens
VAITPGDRG

SEQ ID NO: 720167 - protein, 9 aa, Homo Sapiens
DCEVEEIDQ

SEQ ID NO: 720168 - protein, 9 aa, Homo Sapiens
IANAKISLS

SEQ ID NO: 720169 - protein, 9 aa, Homo Sapiens
GVVKVGILE

SEQ ID NO: 720170 - protein, 9 aa, Homo Sapiens
HPGSSYLAG

SEQ ID NO: 720171 - protein, 9 aa, Homo Sapiens
EELAALIYE

SEQ ID NO: 720172 - protein, 9 aa, Homo Sapiens
ATLSPLAAG

SEQ ID NO: 720173 - protein, 9 aa, Homo Sapiens
TGTAVDSLT

SEQ ID NO: 720174 - protein, 9 aa, Homo Sapiens
CLTPTVGAM

SEQ ID NO: 720175 - protein, 9 aa, Homo Sapiens
ATTMEEEVA

SEQ ID NO: 720176 - protein, 9 aa, Homo Sapiens
GKVTVNYPP

SEQ ID NO: 720177 - protein, 9 aa, Homo Sapiens
AAAQQLKVA

SEQ ID NO: 720178 - protein, 9 aa, Homo Sapiens
IYLVARIEK

SEQ ID NO: 720179 - protein, 9 aa, Homo Sapiens
TQVGWDGLR

SEQ ID NO: 720180 - protein, 9 aa, Homo Sapiens
SAPLEAEDN

SEQ ID NO: 720181 - protein, 9 aa, Homo Sapiens
TSDGSGLGE

SEQ ID NO: 720182 - protein, 9 aa, Homo Sapiens
ATVGAALPT

SEQ ID NO: 720183 - protein, 9 aa, Homo Sapiens
EEVAHSMPT

SEQ ID NO: 720184 - protein, 9 aa, Homo Sapiens
GIEGNGTCS

SEQ ID NO: 720185 - protein, 9 aa, Homo Sapiens
LPTPTVGAT

SEQ ID NO: 720186 - protein, 9 aa, Homo Sapiens
WYLGEPAGR

SEQ ID NO: 720187 - protein, 9 aa, Homo Sapiens
LTCFSPEDD

SEQ ID NO: 720188 - protein, 9 aa, Homo Sapiens
GEGDRFLTD

SEQ ID NO: 720189 - protein, 9 aa, Homo Sapiens
IQASVHVSY

SEQ ID NO: 720190 - protein, 9 aa, Homo Sapiens
GGFKQAIPQ

SEQ ID NO: 720191 - protein, 9 aa, Homo Sapiens
KSYSIIVNN

SEQ ID NO: 720192 - protein, 9 aa, Homo Sapiens
RKHTISCSY

SEQ ID NO: 720193 - protein, 9 aa, Homo Sapiens
IKAKATQKK

SEQ ID NO: 720194 - protein, 9 aa, Homo Sapiens
AAAAQQLKV

SEQ ID NO: 720195 - protein, 9 aa, Homo Sapiens
KDVKDAAGK

SEQ ID NO: 720196 - protein, 9 aa, Homo Sapiens
LDLTDIVPL

SEQ ID NO: 720197 - protein, 9 aa, Homo Sapiens
LDLATSFCE

SEQ ID NO: 720198 - protein, 9 aa, Homo Sapiens
ADRPMPTAG

SEQ ID NO: 720199 - protein, 9 aa, Homo Sapiens
EAIKKNIGQ

SEQ ID NO: 720200 - protein, 9 aa, Homo Sapiens
DAVFAACQS

SEQ ID NO: 720201 - protein, 9 aa, Homo Sapiens
FMMFWYIME

SEQ ID NO: 720202 - protein, 9 aa, Homo Sapiens
ISREESQRI

SEQ ID NO: 720203 - protein, 9 aa, Homo Sapiens
DTSYVGNFI

SEQ ID NO: 720204 - protein, 9 aa, Homo Sapiens
DKFNEHYSA

SEQ ID NO: 720205 - protein, 9 aa, Homo Sapiens
IWMLYMDHY

SEQ ID NO: 720206 - protein, 9 aa, Homo Sapiens
LTRPPRTWV

SEQ ID NO: 720207 - protein, 9 aa, Homo Sapiens
ATRSTEATR

SEQ ID NO: 720208 - protein, 9 aa, Homo Sapiens
WMCSGRGIR

SEQ ID NO: 720209 - protein, 9 aa, Homo Sapiens
VIVGALIYS

SEQ ID NO: 720210 - protein, 9 aa, Homo Sapiens
IKGVNASMP

SEQ ID NO: 720211 - protein, 9 aa, Homo Sapiens
VARIRPNFK

SEQ ID NO: 720212 - protein, 9 aa, Homo Sapiens
NVLQSKDTD

SEQ ID NO: 720213 - protein, 9 aa, Homo Sapiens
GVDFPQVST

SEQ ID NO: 720214 - protein, 9 aa, Homo Sapiens
MKQQAAQGN

SEQ ID NO: 720215 - protein, 9 aa, Homo Sapiens
YVSAVEEPL

SEQ ID NO: 720216 - protein, 9 aa, Homo Sapiens
QQAAPSYGQ

SEQ ID NO: 720217 - protein, 9 aa, Homo Sapiens
AAQRIHEGA

SEQ ID NO: 720218 - protein, 9 aa, Homo Sapiens
AATRNTKAA

SEQ ID NO: 720219 - protein, 9 aa, Homo Sapiens
AYSFSFFYH

SEQ ID NO: 720220 - protein, 9 aa, Homo Sapiens
EAAATRSTE

SEQ ID NO: 720221 - protein, 9 aa, Homo Sapiens
YLGEPAGRG

SEQ ID NO: 720222 - protein, 9 aa, Homo Sapiens
KLPTSHTCF

SEQ ID NO: 720223 - protein, 9 aa, Homo Sapiens
DCWLLKRRK

SEQ ID NO: 720224 - protein, 9 aa, Homo Sapiens
SDCWLLKRR

SEQ ID NO: 720225 - protein, 9 aa, Homo Sapiens
HSFLPGAII

SEQ ID NO: 720226 - protein, 9 aa, Homo Sapiens
TTPAEEEAA

SEQ ID NO: 720227 - protein, 9 aa, Homo Sapiens
VDCEVEEID

SEQ ID NO: 720228 - protein, 9 aa, Homo Sapiens
STDGSSLHC

SEQ ID NO: 720229 - protein, 9 aa, Homo Sapiens
FGSRKAQQE

SEQ ID NO: 720230 - protein, 9 aa, Homo Sapiens
ILEPSSATS

SEQ ID NO: 720231 - protein, 9 aa, Homo Sapiens
VDSLTVWCQ

SEQ ID NO: 720232 - protein, 9 aa, Homo Sapiens
AVNQRPEWL

SEQ ID NO: 720233 - protein, 9 aa, Homo Sapiens
LPLKSMQPT

SEQ ID NO: 720234 - protein, 9 aa, Homo Sapiens
IFGGAMHSA

SEQ ID NO: 720235 - protein, 9 aa, Homo Sapiens
TPAEEEAAT

SEQ ID NO: 720236 - protein, 9 aa, Homo Sapiens
SHLTASQLS

SEQ ID NO: 720237 - protein, 9 aa, Homo Sapiens
SLRLQTHQR

SEQ ID NO: 720238 - protein, 9 aa, Homo Sapiens
EEDIRQVLK

SEQ ID NO: 720239 - protein, 9 aa, Homo Sapiens
AQHAGIAHT

SEQ ID NO: 720240 - protein, 9 aa, Homo Sapiens
KNNITSSGV

SEQ ID NO: 720241 - protein, 9 aa, Homo Sapiens
RANMSSQAL

SEQ ID NO: 720242 - protein, 9 aa, Homo Sapiens
PTAEAARLT

SEQ ID NO: 720243 - protein, 9 aa, Homo Sapiens
YRESGIKGQ

SEQ ID NO: 720244 - protein, 9 aa, Homo Sapiens
IYELHAMLA

SEQ ID NO: 720245 - protein, 9 aa, Homo Sapiens
PNFEFVGGF

SEQ ID NO: 720246 - protein, 9 aa, Homo Sapiens
ATLTRPPRT

SEQ ID NO: 720247 - protein, 9 aa, Homo Sapiens
TFQVISSTQ

SEQ ID NO: 720248 - protein, 9 aa, Homo Sapiens
PTWLFCKTF

SEQ ID NO: 720249 - protein, 9 aa, Homo Sapiens
KEDEDDCVG

SEQ ID NO: 720250 - protein, 9 aa, Homo Sapiens
GQGVHNAAG

SEQ ID NO: 720251 - protein, 9 aa, Homo Sapiens
SFSFFYHMY

SEQ ID NO: 720252 - protein, 9 aa, Homo Sapiens
PQWKIPLLL

SEQ ID NO: 720253 - protein, 9 aa, Homo Sapiens
YGPTNTAYS

SEQ ID NO: 720254 - protein, 9 aa, Homo Sapiens
RNTLVAIRK

SEQ ID NO: 720255 - protein, 9 aa, Homo Sapiens
FSQQRQQRV

SEQ ID NO: 720256 - protein, 9 aa, Homo Sapiens
AMAICKQSQ

SEQ ID NO: 720257 - protein, 9 aa, Homo Sapiens
AAGSVFSIS

SEQ ID NO: 720258 - protein, 9 aa, Homo Sapiens
KEDALPGHH

SEQ ID NO: 720259 - protein, 9 aa, Homo Sapiens
YLVARIEKV

SEQ ID NO: 720260 - protein, 9 aa, Homo Sapiens
KANDLGQLD

SEQ ID NO: 720261 - protein, 9 aa, Homo Sapiens
IHEGARNIS

SEQ ID NO: 720262 - protein, 9 aa, Homo Sapiens
VDFPQVSTW

SEQ ID NO: 720263 - protein, 9 aa, Homo Sapiens
DDMSSLGLE

SEQ ID NO: 720264 - protein, 9 aa, Homo Sapiens
RRGLSRWGP

SEQ ID NO: 720265 - protein, 9 aa, Homo Sapiens
LPSQVLPRK

SEQ ID NO: 720266 - protein, 9 aa, Homo Sapiens
TGATAMEEE

SEQ ID NO: 720267 - protein, 9 aa, Homo Sapiens
QVPQEYQDP

SEQ ID NO: 720268 - protein, 9 aa, Homo Sapiens
VLTVFLYQP

SEQ ID NO: 720269 - protein, 9 aa, Homo Sapiens
PSRRQQRAN

SEQ ID NO: 720270 - protein, 9 aa, Homo Sapiens
SHPAAEACW

SEQ ID NO: 720271 - protein, 9 aa, Homo Sapiens
MAFDLYITI

SEQ ID NO: 720272 - protein, 9 aa, Homo Sapiens
GTCKCLCTD

SEQ ID NO: 720273 - protein, 9 aa, Homo Sapiens
AAPSYGQLI

SEQ ID NO: 720274 - protein, 9 aa, Homo Sapiens
GILEPSSAT

SEQ ID NO: 720275 - protein, 9 aa, Homo Sapiens
IEILQFTLS

SEQ ID NO: 720276 - protein, 9 aa, Homo Sapiens
KLTCFSPED

SEQ ID NO: 720277 - protein, 9 aa, Homo Sapiens
QQRANRGGQ

SEQ ID NO: 720278 - protein, 9 aa, Homo Sapiens
QYIKATATQ

SEQ ID NO: 720279 - protein, 9 aa, Homo Sapiens
GCLLQEVMK

SEQ ID NO: 720280 - protein, 9 aa, Homo Sapiens
IEGNGTCSC

SEQ ID NO: 720281 - protein, 9 aa, Homo Sapiens
SVMVMGCIF

SEQ ID NO: 720282 - protein, 9 aa, Homo Sapiens
SFDLQNAQS

SEQ ID NO: 720283 - protein, 9 aa, Homo Sapiens
SVHVSYFST

SEQ ID NO: 720284 - protein, 9 aa, Homo Sapiens
LMPTVGATT

SEQ ID NO: 720285 - protein, 9 aa, Homo Sapiens
ALHNITVCE

SEQ ID NO: 720286 - protein, 9 aa, Homo Sapiens
TVGAMTVPA

SEQ ID NO: 720287 - protein, 9 aa, Homo Sapiens
VAACLTPTV

SEQ ID NO: 720288 - protein, 9 aa, Homo Sapiens
CICVHPHVF

SEQ ID NO: 720289 - protein, 9 aa, Homo Sapiens
KLFHFFMSR

SEQ ID NO: 720290 - protein, 9 aa, Homo Sapiens
HEGARNISN

SEQ ID NO: 720291 - protein, 9 aa, Homo Sapiens
MPTAEATHP

SEQ ID NO: 720292 - protein, 9 aa, Homo Sapiens
LEDGASLRL

SEQ ID NO: 720293 - protein, 9 aa, Homo Sapiens
TEATRLMPT

SEQ ID NO: 720294 - protein, 9 aa, Homo Sapiens
VGCLLQEVM

SEQ ID NO: 720295 - protein, 9 aa, Homo Sapiens
RSTEAPRLT

SEQ ID NO: 720296 - protein, 9 aa, Homo Sapiens
LMPTVEAAR

SEQ ID NO: 720297 - protein, 9 aa, Homo Sapiens
VTVPATVTT

SEQ ID NO: 720298 - protein, 9 aa, Homo Sapiens
DDSYVSAVE

SEQ ID NO: 720299 - protein, 9 aa, Homo Sapiens
GESDISNAE

SEQ ID NO: 720300 - protein, 9 aa, Homo Sapiens
VTRNTLVAI

SEQ ID NO: 720301 - protein, 9 aa, Homo Sapiens
AMTVPAGAT

SEQ ID NO: 720302 - protein, 9 aa, Homo Sapiens
LYLAMDESS

SEQ ID NO: 720303 - protein, 9 aa, Homo Sapiens
PLWYQVESL

SEQ ID NO: 720304 - protein, 9 aa, Homo Sapiens
LTQEANLGK

SEQ ID NO: 720305 - protein, 9 aa, Homo Sapiens
GSSYLAGPL

SEQ ID NO: 720306 - protein, 9 aa, Homo Sapiens
KDLYNTPSF

SEQ ID NO: 720307 - protein, 9 aa, Homo Sapiens
VLCPIYIPY

SEQ ID NO: 720308 - protein, 9 aa, Homo Sapiens
NGNSREPWN

SEQ ID NO: 720309 - protein, 9 aa, Homo Sapiens
ITAFEEPRV

SEQ ID NO: 720310 - protein, 9 aa, Homo Sapiens
AGPGCGHSW

SEQ ID NO: 720311 - protein, 9 aa, Homo Sapiens
WQLVFAGSE

SEQ ID NO: 720312 - protein, 9 aa, Homo Sapiens
SWEEAKKKT

SEQ ID NO: 720313 - protein, 9 aa, Homo Sapiens
VGAMTVPAG

SEQ ID NO: 720314 - protein, 9 aa, Homo Sapiens
SGTIKAKAT

SEQ ID NO: 720315 - protein, 9 aa, Homo Sapiens
PTAGAAAST

SEQ ID NO: 720316 - protein, 9 aa, Homo Sapiens
EAATRRTEV

SEQ ID NO: 720317 - protein, 9 aa, Homo Sapiens
NLSYLKTKK

SEQ ID NO: 720318 - protein, 9 aa, Homo Sapiens
GAATVPSRV

SEQ ID NO: 720319 - protein, 9 aa, Homo Sapiens
TAEAARLTP

SEQ ID NO: 720320 - protein, 9 aa, Homo Sapiens
HPDIYLVAR

SEQ ID NO: 720321 - protein, 9 aa, Homo Sapiens
SQKLPSQVL

SEQ ID NO: 720322 - protein, 9 aa, Homo Sapiens
HVVYSTPAC

SEQ ID NO: 720323 - protein, 9 aa, Homo Sapiens
TVWEVVLLL

SEQ ID NO: 720324 - protein, 9 aa, Homo Sapiens
DDDILRHCN

SEQ ID NO: 720325 - protein, 9 aa, Homo Sapiens
MEQYIKATA

SEQ ID NO: 720326 - protein, 9 aa, Homo Sapiens
TNESCKLTC

SEQ ID NO: 720327 - protein, 9 aa, Homo Sapiens
AACLTPTVG

SEQ ID NO: 720328 - protein, 9 aa, Homo Sapiens
HVFPDTSVS

SEQ ID NO: 720329 - protein, 9 aa, Homo Sapiens
VAIRKRIHS

SEQ ID NO: 720330 - protein, 9 aa, Homo Sapiens
KLDPCMLLA

SEQ ID NO: 720331 - protein, 9 aa, Homo Sapiens
VYMQQIANA

SEQ ID NO: 720332 - protein, 9 aa, Homo Sapiens
SQYSWTING

SEQ ID NO: 720333 - protein, 9 aa, Homo Sapiens
STEAAPSMP

SEQ ID NO: 720334 - protein, 9 aa, Homo Sapiens
KFNEHYSAR

SEQ ID NO: 720335 - protein, 9 aa, Homo Sapiens
VTVWEVVLL

SEQ ID NO: 720336 - protein, 9 aa, Homo Sapiens
QIANAKISL

SEQ ID NO: 720337 - protein, 9 aa, Homo Sapiens
DTPSAQATN

SEQ ID NO: 720338 - protein, 9 aa, Homo Sapiens
ITEEEAATR

SEQ ID NO: 720339 - protein, 9 aa, Homo Sapiens
VLAGDHMHL

SEQ ID NO: 720340 - protein, 9 aa, Homo Sapiens
RAADDPRRS

SEQ ID NO: 720341 - protein, 9 aa, Homo Sapiens
MQAKTELIV

SEQ ID NO: 720342 - protein, 9 aa, Homo Sapiens
TMTARHRVW

SEQ ID NO: 720343 - protein, 9 aa, Homo Sapiens
EGIEGNGTC

SEQ ID NO: 720344 - protein, 9 aa, Homo Sapiens
ECQQDHKYP

SEQ ID NO: 720345 - protein, 9 aa, Homo Sapiens
ATVTTGATA

SEQ ID NO: 720346 - protein, 9 aa, Homo Sapiens
SCSYCGEEG

SEQ ID NO: 720347 - protein, 9 aa, Homo Sapiens
AAQGNDAGL

SEQ ID NO: 720348 - protein, 9 aa, Homo Sapiens
LPRKHLTKP

SEQ ID NO: 720349 - protein, 9 aa, Homo Sapiens
LDRTRKGAI

SEQ ID NO: 720350 - protein, 9 aa, Homo Sapiens
ESQKLPSQV

SEQ ID NO: 720351 - protein, 9 aa, Homo Sapiens
LSYLKTKKT

SEQ ID NO: 720352 - protein, 9 aa, Homo Sapiens
PIFGGAMHS

SEQ ID NO: 720353 - protein, 9 aa, Homo Sapiens
LTVTQVGWD

SEQ ID NO: 720354 - protein, 9 aa, Homo Sapiens
AEVFQVQTR

SEQ ID NO: 720355 - protein, 9 aa, Homo Sapiens
ELFEEFHSF

SEQ ID NO: 720356 - protein, 9 aa, Homo Sapiens
RVVGAQVSQ

SEQ ID NO: 720357 - protein, 9 aa, Homo Sapiens
GRFGQGVHN

SEQ ID NO: 720358 - protein, 9 aa, Homo Sapiens
FTSDGYHRQ

SEQ ID NO: 720359 - protein, 9 aa, Homo Sapiens
MVMGCIFAF

SEQ ID NO: 720360 - protein, 9 aa, Homo Sapiens
SGLGEGDRF

SEQ ID NO: 720361 - protein, 9 aa, Homo Sapiens
AAFWLSDNQ

SEQ ID NO: 720362 - protein, 9 aa, Homo Sapiens
SDKIFMMFW

SEQ ID NO: 720363 - protein, 9 aa, Homo Sapiens
KLKVEGSPS

SEQ ID NO: 720364 - protein, 9 aa, Homo Sapiens
GNAASSTPP

SEQ ID NO: 720365 - protein, 9 aa, Homo Sapiens
AIPQDQRES

SEQ ID NO: 720366 - protein, 9 aa, Homo Sapiens
FCSVLAPHF

SEQ ID NO: 720367 - protein, 9 aa, Homo Sapiens
AIGFFPVSS

SEQ ID NO: 720368 - protein, 9 aa, Homo Sapiens
GSGTIKAKA

SEQ ID NO: 720369 - protein, 9 aa, Homo Sapiens
VIPAEKIDA

SEQ ID NO: 720370 - protein, 9 aa, Homo Sapiens
AFLEEDIRQ

SEQ ID NO: 720371 - protein, 9 aa, Homo Sapiens
DSYVSAVEE

SEQ ID NO: 720372 - protein, 9 aa, Homo Sapiens
LEPSSATSG

SEQ ID NO: 720373 - protein, 9 aa, Homo Sapiens
SGRGIRDAG

SEQ ID NO: 720374 - protein, 9 aa, Homo Sapiens
TARHRVWRA

SEQ ID NO: 720375 - protein, 9 aa, Homo Sapiens
PQDRIVSKA

SEQ ID NO: 720376 - protein, 9 aa, Homo Sapiens
QLLQGGLPL

SEQ ID NO: 720377 - protein, 9 aa, Homo Sapiens
HPSVGATGS

SEQ ID NO: 720378 - protein, 9 aa, Homo Sapiens
MDTRESQWL

SEQ ID NO: 720379 - protein, 9 aa, Homo Sapiens
VISTVEGAR

SEQ ID NO: 720380 - protein, 9 aa, Homo Sapiens
WYQVESLES

SEQ ID NO: 720381 - protein, 9 aa, Homo Sapiens
DPNKQNLNA

SEQ ID NO: 720382 - protein, 9 aa, Homo Sapiens
STVEGARAA

SEQ ID NO: 720383 - protein, 9 aa, Homo Sapiens
ELEQSRILT

SEQ ID NO: 720384 - protein, 9 aa, Homo Sapiens
TVSATAMAG

SEQ ID NO: 720385 - protein, 9 aa, Homo Sapiens
ETAMKEVSG

SEQ ID NO: 720386 - protein, 9 aa, Homo Sapiens
CKLTCFSPE

SEQ ID NO: 720387 - protein, 9 aa, Homo Sapiens
NTPSFLNFY

SEQ ID NO: 720388 - protein, 9 aa, Homo Sapiens
NTQAAIKGQ

SEQ ID NO: 720389 - protein, 9 aa, Homo Sapiens
AFDLYITIC

SEQ ID NO: 720390 - protein, 9 aa, Homo Sapiens
LYNTPSFLN

SEQ ID NO: 720391 - protein, 9 aa, Homo Sapiens
AGSVFSISM

SEQ ID NO: 720392 - protein, 9 aa, Homo Sapiens
GPTITAKLH

SEQ ID NO: 720393 - protein, 9 aa, Homo Sapiens
CSGRGIRDA

SEQ ID NO: 720394 - protein, 9 aa, Homo Sapiens
LENLTVTQV

SEQ ID NO: 720395 - protein, 9 aa, Homo Sapiens
SKGCLSRGR

SEQ ID NO: 720396 - protein, 9 aa, Homo Sapiens
SAVSHNGSY

SEQ ID NO: 720397 - protein, 9 aa, Homo Sapiens
SYFSTDNSG

SEQ ID NO: 720398 - protein, 9 aa, Homo Sapiens
RLAAEYSSS

SEQ ID NO: 720399 - protein, 9 aa, Homo Sapiens
SDSTFHNHA

SEQ ID NO: 720400 - protein, 9 aa, Homo Sapiens
GTIKAKATQ

SEQ ID NO: 720401 - protein, 9 aa, Homo Sapiens
RRTASDSQP

SEQ ID NO: 720402 - protein, 9 aa, Homo Sapiens
CTGALPLIQ

SEQ ID NO: 720403 - protein, 9 aa, Homo Sapiens
KYVSQNKSN

SEQ ID NO: 720404 - protein, 9 aa, Homo Sapiens
TEAACSMPT

SEQ ID NO: 720405 - protein, 9 aa, Homo Sapiens
KIPLLLAFL

SEQ ID NO: 720406 - protein, 9 aa, Homo Sapiens
LENQLFPNN

SEQ ID NO: 720407 - protein, 9 aa, Homo Sapiens
QMYFFMLFG

SEQ ID NO: 720408 - protein, 9 aa, Homo Sapiens
RVGSPSGNA

SEQ ID NO: 720409 - protein, 9 aa, Homo Sapiens
VAHSMPTAV

SEQ ID NO: 720410 - protein, 9 aa, Homo Sapiens
AARHLCQPL

SEQ ID NO: 720411 - protein, 9 aa, Homo Sapiens
KVGILEPSS

SEQ ID NO: 720412 - protein, 9 aa, Homo Sapiens
VRAMAICKQ

SEQ ID NO: 720413 - protein, 9 aa, Homo Sapiens
DLYNTPSFL

SEQ ID NO: 720414 - protein, 9 aa, Homo Sapiens
KSMQPTEAM

SEQ ID NO: 720415 - protein, 9 aa, Homo Sapiens
KPLLLDLLP

SEQ ID NO: 720416 - protein, 9 aa, Homo Sapiens
EAFSFDLQN

SEQ ID NO: 720417 - protein, 9 aa, Homo Sapiens
ATRNTKAAR

SEQ ID NO: 720418 - protein, 9 aa, Homo Sapiens
NPEPGVRRP

SEQ ID NO: 720419 - protein, 9 aa, Homo Sapiens
TRSTEAACS

SEQ ID NO: 720420 - protein, 9 aa, Homo Sapiens
EDTPSAQAT

SEQ ID NO: 720421 - protein, 9 aa, Homo Sapiens
VESIFTNAT

SEQ ID NO: 720422 - protein, 9 aa, Homo Sapiens
ANPLLHLRS

SEQ ID NO: 720423 - protein, 9 aa, Homo Sapiens
SLLPQESKK

SEQ ID NO: 720424 - protein, 9 aa, Homo Sapiens
TAYSFSFFY

SEQ ID NO: 720425 - protein, 9 aa, Homo Sapiens
PLKSMQPTE

SEQ ID NO: 720426 - protein, 9 aa, Homo Sapiens
GNPQVPQEY

SEQ ID NO: 720427 - protein, 9 aa, Homo Sapiens
GAQVSQMLD

SEQ ID NO: 720428 - protein, 9 aa, Homo Sapiens
EPVYMQQIA

SEQ ID NO: 720429 - protein, 9 aa, Homo Sapiens
YSVGCLLQE

SEQ ID NO: 720430 - protein, 9 aa, Homo Sapiens
VGAALPTPT

SEQ ID NO: 720431 - protein, 9 aa, Homo Sapiens
RATAMEEAA

SEQ ID NO: 720432 - protein, 9 aa, Homo Sapiens
TKIINYTTV

SEQ ID NO: 720433 - protein, 9 aa, Homo Sapiens
GAVTVPATV

SEQ ID NO: 720434 - protein, 9 aa, Homo Sapiens
PKPTAGAAT

SEQ ID NO: 720435 - protein, 9 aa, Homo Sapiens
ATTVLARAT

SEQ ID NO: 720436 - protein, 9 aa, Homo Sapiens
ISTVEGARA

SEQ ID NO: 720437 - protein, 9 aa, Homo Sapiens
ARPMPTAGA

SEQ ID NO: 720438 - protein, 9 aa, Homo Sapiens
PAADQPPSE

SEQ ID NO: 720439 - protein, 9 aa, Homo Sapiens
DSTFHNHAS

SEQ ID NO: 720440 - protein, 9 aa, Homo Sapiens
RHRVWRAFE

SEQ ID NO: 720441 - protein, 9 aa, Homo Sapiens
LTVFLYQPQ

SEQ ID NO: 720442 - protein, 9 aa, Homo Sapiens
VAVLLNRKD

SEQ ID NO: 720443 - protein, 9 aa, Homo Sapiens
MPTAEAARL

SEQ ID NO: 720444 - protein, 9 aa, Homo Sapiens
LKDAEVFQV

SEQ ID NO: 720445 - protein, 9 aa, Homo Sapiens
YNGNPESLG

SEQ ID NO: 720446 - protein, 9 aa, Homo Sapiens
LSSILEGEA

SEQ ID NO: 720447 - protein, 9 aa, Homo Sapiens
RGFAVLLVL

SEQ ID NO: 720448 - protein, 9 aa, Homo Sapiens
KLQDGGTKI

SEQ ID NO: 720449 - protein, 9 aa, Homo Sapiens
ELAGWEFVN

SEQ ID NO: 720450 - protein, 9 aa, Homo Sapiens
PTAGADRPM

SEQ ID NO: 720451 - protein, 9 aa, Homo Sapiens
RATATEEEA

SEQ ID NO: 720452 - protein, 9 aa, Homo Sapiens
YNQHAKECG

SEQ ID NO: 720453 - protein, 9 aa, Homo Sapiens
VWSPPAPAQ

SEQ ID NO: 720454 - protein, 9 aa, Homo Sapiens
MYFFMLFGD

SEQ ID NO: 720455 - protein, 9 aa, Homo Sapiens
EIVQQQAAP

SEQ ID NO: 720456 - protein, 9 aa, Homo Sapiens
RTEVTLSMP

SEQ ID NO: 720457 - protein, 9 aa, Homo Sapiens
DALTQEANL

SEQ ID NO: 720458 - protein, 9 aa, Homo Sapiens
TTGATAMEE

SEQ ID NO: 720459 - protein, 9 aa, Homo Sapiens
GAVYKCMHC

SEQ ID NO: 720460 - protein, 9 aa, Homo Sapiens
TVEAARPMP

SEQ ID NO: 720461 - protein, 9 aa, Homo Sapiens
QGNDAGLQR

SEQ ID NO: 720462 - protein, 9 aa, Homo Sapiens
AALIYELKQ

SEQ ID NO: 720463 - protein, 9 aa, Homo Sapiens
RGKVTVNYP

SEQ ID NO: 720464 - protein, 9 aa, Homo Sapiens
KQQAAQGND

SEQ ID NO: 720465 - protein, 9 aa, Homo Sapiens
APAQLTLNA

SEQ ID NO: 720466 - protein, 9 aa, Homo Sapiens
DAAGKVLRS

SEQ ID NO: 720467 - protein, 9 aa, Homo Sapiens
VGSPSGNAA

SEQ ID NO: 720468 - protein, 9 aa, Homo Sapiens
LPLIQSRIV

SEQ ID NO: 720469 - protein, 9 aa, Homo Sapiens
PDAKSPHPV

SEQ ID NO: 720470 - protein, 9 aa, Homo Sapiens
CYNQHAKEC

SEQ ID NO: 720471 - protein, 9 aa, Homo Sapiens
RPMPTAGTT

SEQ ID NO: 720472 - protein, 9 aa, Homo Sapiens
TLSMPTAEA

SEQ ID NO: 720473 - protein, 9 aa, Homo Sapiens
QKDWNSRPR

SEQ ID NO: 720474 - protein, 9 aa, Homo Sapiens
RFDDMSSLG

SEQ ID NO: 720475 - protein, 9 aa, Homo Sapiens
RGSCAEGIE

SEQ ID NO: 720476 - protein, 9 aa, Homo Sapiens
EEDTRTASQ

SEQ ID NO: 720477 - protein, 9 aa, Homo Sapiens
AWIWMLYMD

SEQ ID NO: 720478 - protein, 9 aa, Homo Sapiens
FVLTVFLYQ

SEQ ID NO: 720479 - protein, 9 aa, Homo Sapiens
YVARIRPNF

SEQ ID NO: 720480 - protein, 9 aa, Homo Sapiens
ALPLIQSRI

SEQ ID NO: 720481 - protein, 9 aa, Homo Sapiens
NDENQTLTL

SEQ ID NO: 720482 - protein, 9 aa, Homo Sapiens
EQSRILTDD

SEQ ID NO: 720483 - protein, 9 aa, Homo Sapiens
GLTSHPAAE

SEQ ID NO: 720484 - protein, 9 aa, Homo Sapiens
RSHNGNSRE

SEQ ID NO: 720485 - protein, 9 aa, Homo Sapiens
KKKIPDPYS

SEQ ID NO: 720486 - protein, 9 aa, Homo Sapiens
TCPHPDIYL

SEQ ID NO: 720487 - protein, 9 aa, Homo Sapiens
RGIRDAGRC

SEQ ID NO: 720488 - protein, 9 aa, Homo Sapiens
PVVRRGKVT

SEQ ID NO: 720489 - protein, 9 aa, Homo Sapiens
QRIHEGARN

SEQ ID NO: 720490 - protein, 9 aa, Homo Sapiens
MAGVTITEE

SEQ ID NO: 720491 - protein, 9 aa, Homo Sapiens
VGANSCLLK

SEQ ID NO: 720492 - protein, 9 aa, Homo Sapiens
HREIVQALA

SEQ ID NO: 720493 - protein, 9 aa, Homo Sapiens
DEEEAALER

SEQ ID NO: 720494 - protein, 9 aa, Homo Sapiens
DILSYVEKL

SEQ ID NO: 720495 - protein, 9 aa, Homo Sapiens
TNWYLGEPA

SEQ ID NO: 720496 - protein, 9 aa, Homo Sapiens
FKQAIPQDQ

SEQ ID NO: 720497 - protein, 9 aa, Homo Sapiens
AEAARLTPT

SEQ ID NO: 720498 - protein, 9 aa, Homo Sapiens
KNMQAKTEL

SEQ ID NO: 720499 - protein, 9 aa, Homo Sapiens
MAGATATEE

SEQ ID NO: 720500 - protein, 9 aa, Homo Sapiens
PDIPKHKAF

SEQ ID NO: 720501 - protein, 9 aa, Homo Sapiens
AATRSTEAP

SEQ ID NO: 720502 - protein, 9 aa, Homo Sapiens
ARPFAELAG

SEQ ID NO: 720503 - protein, 9 aa, Homo Sapiens
AATRSTEAT

SEQ ID NO: 720504 - protein, 9 aa, Homo Sapiens
APRGLPPMQ

SEQ ID NO: 720505 - protein, 9 aa, Homo Sapiens
SGYVARIRP

SEQ ID NO: 720506 - protein, 9 aa, Homo Sapiens
VRRPEGGLE

SEQ ID NO: 720507 - protein, 9 aa, Homo Sapiens
CQQDHKYPS

SEQ ID NO: 720508 - protein, 9 aa, Homo Sapiens
AATRSTEAA

SEQ ID NO: 720509 - protein, 9 aa, Homo Sapiens
ENQTLTLAL

SEQ ID NO: 720510 - protein, 9 aa, Homo Sapiens
VMQLLQGGL

SEQ ID NO: 720511 - protein, 9 aa, Homo Sapiens
FFPFFFLRR

SEQ ID NO: 720512 - protein, 9 aa, Homo Sapiens
ESYSMPVIQ

SEQ ID NO: 720513 - protein, 9 aa, Homo Sapiens
AGKVLRSKV

SEQ ID NO: 720514 - protein, 9 aa, Homo Sapiens
LLLPQAILE

SEQ ID NO: 720515 - protein, 9 aa, Homo Sapiens
ASTLMEQYI

SEQ ID NO: 720516 - protein, 9 aa, Homo Sapiens
YCYNQHAKE

SEQ ID NO: 720517 - protein, 9 aa, Homo Sapiens
KIPDAKSPH

SEQ ID NO: 720518 - protein, 9 aa, Homo Sapiens
SEHTAIPNR

SEQ ID NO: 720519 - protein, 9 aa, Homo Sapiens
LMDDYYFTS

SEQ ID NO: 720520 - protein, 9 aa, Homo Sapiens
PCAHPSVGA

SEQ ID NO: 720521 - protein, 9 aa, Homo Sapiens
VKSSSFLQA

SEQ ID NO: 720522 - protein, 9 aa, Homo Sapiens
PKIKVDCEV

SEQ ID NO: 720523 - protein, 9 aa, Homo Sapiens
SCLVHTSET

SEQ ID NO: 720524 - protein, 9 aa, Homo Sapiens
AVYSNILSD

SEQ ID NO: 720525 - protein, 9 aa, Homo Sapiens
IVQQQAAPS

SEQ ID NO: 720526 - protein, 9 aa, Homo Sapiens
LVIVTVSLG

SEQ ID NO: 720527 - protein, 9 aa, Homo Sapiens
FCDTVRLFL

SEQ ID NO: 720528 - protein, 9 aa, Homo Sapiens
EEAATRSTE

SEQ ID NO: 720529 - protein, 9 aa, Homo Sapiens
YTNWYLGEP

SEQ ID NO: 720530 - protein, 9 aa, Homo Sapiens
LSEHTAIPN

SEQ ID NO: 720531 - protein, 9 aa, Homo Sapiens
WLLKRRKDL

SEQ ID NO: 720532 - protein, 9 aa, Homo Sapiens
QVESLESQK

SEQ ID NO: 720533 - protein, 9 aa, Homo Sapiens
ASDSQPGGR

SEQ ID NO: 720534 - protein, 9 aa, Homo Sapiens
FKCPPPKTE

SEQ ID NO: 720535 - protein, 9 aa, Homo Sapiens
PKGVTKIIN

SEQ ID NO: 720536 - protein, 9 aa, Homo Sapiens
SIIVNNLLK

SEQ ID NO: 720537 - protein, 9 aa, Homo Sapiens
PAGATATEE

SEQ ID NO: 720538 - protein, 9 aa, Homo Sapiens
VLIDLQILL

SEQ ID NO: 720539 - protein, 9 aa, Homo Sapiens
INTYGTCKC

SEQ ID NO: 720540 - protein, 9 aa, Homo Sapiens
SKSSIELKR

SEQ ID NO: 720541 - protein, 9 aa, Homo Sapiens
IPADLVIVT

SEQ ID NO: 720542 - protein, 9 aa, Homo Sapiens
SCKEAVTLK

SEQ ID NO: 720543 - protein, 9 aa, Homo Sapiens
QEYDEKTSE

SEQ ID NO: 720544 - protein, 9 aa, Homo Sapiens
VENRGNPNA

SEQ ID NO: 720545 - protein, 9 aa, Homo Sapiens
VIQQPEILS

SEQ ID NO: 720546 - protein, 9 aa, Homo Sapiens
VMAGATATE

SEQ ID NO: 720547 - protein, 9 aa, Homo Sapiens
VGCTGALPL

SEQ ID NO: 720548 - protein, 9 aa, Homo Sapiens
PHGSGRDDQ

SEQ ID NO: 720549 - protein, 9 aa, Homo Sapiens
AVFAACQSG

SEQ ID NO: 720550 - protein, 9 aa, Homo Sapiens
NNITSSGVG

SEQ ID NO: 720551 - protein, 9 aa, Homo Sapiens
LAGWEFVNL

SEQ ID NO: 720552 - protein, 9 aa, Homo Sapiens
TLLLPQAIL

SEQ ID NO: 720553 - protein, 9 aa, Homo Sapiens
ATAMAGVTI

SEQ ID NO: 720554 - protein, 9 aa, Homo Sapiens
PTINVLQSK

SEQ ID NO: 720555 - protein, 9 aa, Homo Sapiens
LTDDLGLSQ

SEQ ID NO: 720556 - protein, 9 aa, Homo Sapiens
TGYRPQDRI

SEQ ID NO: 720557 - protein, 9 aa, Homo Sapiens
PNKQNLNAE

SEQ ID NO: 720558 - protein, 9 aa, Homo Sapiens
TRKGAILSG

SEQ ID NO: 720559 - protein, 9 aa, Homo Sapiens
DVAVLLNRK

SEQ ID NO: 720560 - protein, 9 aa, Homo Sapiens
AVTLKAVRQ

SEQ ID NO: 720561 - protein, 9 aa, Homo Sapiens
ESGIKGQIL

SEQ ID NO: 720562 - protein, 9 aa, Homo Sapiens
LVIPTWLFC

SEQ ID NO: 720563 - protein, 9 aa, Homo Sapiens
LLKLECKQA

SEQ ID NO: 720564 - protein, 9 aa, Homo Sapiens
ALSSLNRKF

SEQ ID NO: 720565 - protein, 9 aa, Homo Sapiens
PAGTTPAEE

SEQ ID NO: 720566 - protein, 9 aa, Homo Sapiens
QSKDTDSDR

SEQ ID NO: 720567 - protein, 9 aa, Homo Sapiens
VFKCPPPKT

SEQ ID NO: 720568 - protein, 9 aa, Homo Sapiens
SQSLRLQTH

SEQ ID NO: 720569 - protein, 9 aa, Homo Sapiens
NLGKKTVIW

SEQ ID NO: 720570 - protein, 9 aa, Homo Sapiens
CFANSNPPS

SEQ ID NO: 720571 - protein, 9 aa, Homo Sapiens
ARATTMEEE

SEQ ID NO: 720572 - protein, 9 aa, Homo Sapiens
TSVSCPSSL

SEQ ID NO: 720573 - protein, 9 aa, Homo Sapiens
LFGSRKAQQ

SEQ ID NO: 720574 - protein, 9 aa, Homo Sapiens
VKDAAGKVL

SEQ ID NO: 720575 - protein, 9 aa, Homo Sapiens
LVMQLLQGG

SEQ ID NO: 720576 - protein, 9 aa, Homo Sapiens
IPKHKAFGK

SEQ ID NO: 720577 - protein, 9 aa, Homo Sapiens
AACSMPTVE

SEQ ID NO: 720578 - protein, 9 aa, Homo Sapiens
EKFYKCEAF

SEQ ID NO: 720579 - protein, 9 aa, Homo Sapiens
LRKEEDTRT

SEQ ID NO: 720580 - protein, 9 aa, Homo Sapiens
VIPTWLFCK

SEQ ID NO: 720581 - protein, 9 aa, Homo Sapiens
GFFPVSSQG

SEQ ID NO: 720582 - protein, 9 aa, Homo Sapiens
DCWQKDWNS

SEQ ID NO: 720583 - protein, 9 aa, Homo Sapiens
LQLLKNKED

SEQ ID NO: 720584 - protein, 9 aa, Homo Sapiens
PRTPSYLGV

SEQ ID NO: 720585 - protein, 9 aa, Homo Sapiens
VRRGKVTVN

SEQ ID NO: 720586 - protein, 9 aa, Homo Sapiens
LKDDDILRH

SEQ ID NO: 720587 - protein, 9 aa, Homo Sapiens
RVRYRVDDA

SEQ ID NO: 720588 - protein, 9 aa, Homo Sapiens
AMKEVSGIV

SEQ ID NO: 720589 - protein, 9 aa, Homo Sapiens
ARIKLKVEG

SEQ ID NO: 720590 - protein, 9 aa, Homo Sapiens
AMSDAKVEN

SEQ ID NO: 720591 - protein, 9 aa, Homo Sapiens
AEEEAATRR

SEQ ID NO: 720592 - protein, 9 aa, Homo Sapiens
MHSAFGLKA

SEQ ID NO: 720593 - protein, 9 aa, Homo Sapiens
IPTWLFCKT

SEQ ID NO: 720594 - protein, 9 aa, Homo Sapiens
ISCSYCGEE

SEQ ID NO: 720595 - protein, 9 aa, Homo Sapiens
SYLAGPLEY

SEQ ID NO: 720596 - protein, 9 aa, Homo Sapiens
DLGQLDSLF

SEQ ID NO: 720597 - protein, 9 aa, Homo Sapiens
FFFFPFFFL

SEQ ID NO: 720598 - protein, 9 aa, Homo Sapiens
SSFRDISQP

SEQ ID NO: 720599 - protein, 9 aa, Homo Sapiens
DTSVSLLAA

SEQ ID NO: 720600 - protein, 9 aa, Homo Sapiens
FSIGDAEEY

SEQ ID NO: 720601 - protein, 9 aa, Homo Sapiens
QDRIVSKAM

SEQ ID NO: 720602 - protein, 9 aa, Homo Sapiens
AHPMPTAGA

SEQ ID NO: 720603 - protein, 9 aa, Homo Sapiens
QNLNAEVST

SEQ ID NO: 720604 - protein, 9 aa, Homo Sapiens
PRKHLTKPL

SEQ ID NO: 720605 - protein, 9 aa, Homo Sapiens
ATVPSRVTA

SEQ ID NO: 720606 - protein, 9 aa, Homo Sapiens
ELLKAAKDI

SEQ ID NO: 720607 - protein, 9 aa, Homo Sapiens
RGRSHDATV

SEQ ID NO: 720608 - protein, 9 aa, Homo Sapiens
FEESHGLQE

SEQ ID NO: 720609 - protein, 9 aa, Homo Sapiens
FLRRTASDS

SEQ ID NO: 720610 - protein, 9 aa, Homo Sapiens
REESQRIIK

SEQ ID NO: 720611 - protein, 9 aa, Homo Sapiens
LIGKDGTRH

SEQ ID NO: 720612 - protein, 9 aa, Homo Sapiens
PKHKAFGKH

SEQ ID NO: 720613 - protein, 9 aa, Homo Sapiens
WKIPLLLAF

SEQ ID NO: 720614 - protein, 9 aa, Homo Sapiens
AVHCVEGLG

SEQ ID NO: 720615 - protein, 9 aa, Homo Sapiens
ELIPADLVI

SEQ ID NO: 720616 - protein, 9 aa, Homo Sapiens
KKLLKLECK

SEQ ID NO: 720617 - protein, 9 aa, Homo Sapiens
GKSLGMIFK

SEQ ID NO: 720618 - protein, 9 aa, Homo Sapiens
SDSQPGGRP

SEQ ID NO: 720619 - protein, 9 aa, Homo Sapiens
HAMLAKSDL

SEQ ID NO: 720620 - protein, 9 aa, Homo Sapiens
DTEISSDKF

SEQ ID NO: 720621 - protein, 9 aa, Homo Sapiens
TRESQWLPA

SEQ ID NO: 720622 - protein, 9 aa, Homo Sapiens
VTITEEEAA

SEQ ID NO: 720623 - protein, 9 aa, Homo Sapiens
MEEEATTKS

SEQ ID NO: 720624 - protein, 9 aa, Homo Sapiens
EDIRQVLKE

SEQ ID NO: 720625 - protein, 9 aa, Homo Sapiens
LTKPLLLDL

SEQ ID NO: 720626 - protein, 9 aa, Homo Sapiens
YNVSGLTSH

SEQ ID NO: 720627 - protein, 9 aa, Homo Sapiens
ELILTFGAN

SEQ ID NO: 720628 - protein, 9 aa, Homo Sapiens
AFEEPRVQA

SEQ ID NO: 720629 - protein, 9 aa, Homo Sapiens
VSTWMRALP

SEQ ID NO: 720630 - protein, 9 aa, Homo Sapiens
LVLRPHNVA

SEQ ID NO: 720631 - protein, 9 aa, Homo Sapiens
EEEVAHSMP

SEQ ID NO: 720632 - protein, 9 aa, Homo Sapiens
EAYTQPQAK

SEQ ID NO: 720633 - protein, 9 aa, Homo Sapiens
LWGTHVVVE

SEQ ID NO: 720634 - protein, 9 aa, Homo Sapiens
SFELPEINK

SEQ ID NO: 720635 - protein, 9 aa, Homo Sapiens
VPAGTTPAE

SEQ ID NO: 720636 - protein, 9 aa, Homo Sapiens
CRKEDALPG

SEQ ID NO: 720637 - protein, 9 aa, Homo Sapiens
AQRIHEGAR

SEQ ID NO: 720638 - protein, 9 aa, Homo Sapiens
KIIEILQFT

SEQ ID NO: 720639 - protein, 9 aa, Homo Sapiens
GSPSGNAAS

SEQ ID NO: 720640 - protein, 9 aa, Homo Sapiens
QKLTETEGE

SEQ ID NO: 720641 - protein, 9 aa, Homo Sapiens
AASVMVMGC

SEQ ID NO: 720642 - protein, 9 aa, Homo Sapiens
AALERRRRA

SEQ ID NO: 720643 - protein, 9 aa, Homo Sapiens
KEDSLLVSW

SEQ ID NO: 720644 - protein, 9 aa, Homo Sapiens
PPSQYSWTI

SEQ ID NO: 720645 - protein, 9 aa, Homo Sapiens
ERFDDMSSL

SEQ ID NO: 720646 - protein, 9 aa, Homo Sapiens
DLNDENQTL

SEQ ID NO: 720647 - protein, 9 aa, Homo Sapiens
KNKEDSLLV

SEQ ID NO: 720648 - protein, 9 aa, Homo Sapiens
PSLRAGLEV

SEQ ID NO: 720649 - protein, 9 aa, Homo Sapiens
KAAKDIVKL

SEQ ID NO: 720650 - protein, 9 aa, Homo Sapiens
SDGSGLGEG

SEQ ID NO: 720651 - protein, 9 aa, Homo Sapiens
FFFFFPFFF

SEQ ID NO: 720652 - protein, 9 aa, Homo Sapiens
HVVTHQKIH

SEQ ID NO: 720653 - protein, 9 aa, Homo Sapiens
LGLELPSCE

SEQ ID NO: 720654 - protein, 9 aa, Homo Sapiens
ACSMPTVEA

SEQ ID NO: 720655 - protein, 9 aa, Homo Sapiens
PTVGAATVP

SEQ ID NO: 720656 - protein, 9 aa, Homo Sapiens
EKIDAVFAA

SEQ ID NO: 720657 - protein, 9 aa, Homo Sapiens
TIKAKATQK

SEQ ID NO: 720658 - protein, 9 aa, Homo Sapiens
VYKCMHCPY

SEQ ID NO: 720659 - protein, 9 aa, Homo Sapiens
ECVAITPGD

SEQ ID NO: 720660 - protein, 9 aa, Homo Sapiens
KVIVGALIY

SEQ ID NO: 720661 - protein, 9 aa, Homo Sapiens
LARATATEE

SEQ ID NO: 720662 - protein, 9 aa, Homo Sapiens
VTCPHPDIY

SEQ ID NO: 720663 - protein, 9 aa, Homo Sapiens
PNRAITADV

SEQ ID NO: 720664 - protein, 9 aa, Homo Sapiens
KKLFHFFMS

SEQ ID NO: 720665 - protein, 9 aa, Homo Sapiens
GVNSSIEEV

SEQ ID NO: 720666 - protein, 9 aa, Homo Sapiens
KDAAGKVLR

SEQ ID NO: 720667 - protein, 9 aa, Homo Sapiens
KNIGQAKIF

SEQ ID NO: 720668 - protein, 9 aa, Homo Sapiens
ARSMPTAEA

SEQ ID NO: 720669 - protein, 9 aa, Homo Sapiens
PESLGYKIK

SEQ ID NO: 720670 - protein, 9 aa, Homo Sapiens
HNVAFLLVY

SEQ ID NO: 720671 - protein, 9 aa, Homo Sapiens
KFYGNSLSS

SEQ ID NO: 720672 - protein, 9 aa, Homo Sapiens
TAVAACLTP

SEQ ID NO: 720673 - protein, 9 aa, Homo Sapiens
CPLEIPHGK

SEQ ID NO: 720674 - protein, 9 aa, Homo Sapiens
LPGHHGNGA

SEQ ID NO: 720675 - protein, 9 aa, Homo Sapiens
RRGKVTVNY

SEQ ID NO: 720676 - protein, 9 aa, Homo Sapiens
CWLLKRRKD

SEQ ID NO: 720677 - protein, 9 aa, Homo Sapiens
YSFSFFYHM

SEQ ID NO: 720678 - protein, 9 aa, Homo Sapiens
RLEDGASLR

SEQ ID NO: 720679 - protein, 9 aa, Homo Sapiens
CLQWLNSQP

SEQ ID NO: 720680 - protein, 9 aa, Homo Sapiens
LSSLNRKFR

SEQ ID NO: 720681 - protein, 9 aa, Homo Sapiens
RKRKHTISC

SEQ ID NO: 720682 - protein, 9 aa, Homo Sapiens
TSGYVARIR

SEQ ID NO: 720683 - protein, 9 aa, Homo Sapiens
LVPVSVTLP

SEQ ID NO: 720684 - protein, 9 aa, Homo Sapiens
DDGLLGTNL

SEQ ID NO: 720685 - protein, 9 aa, Homo Sapiens
TRIVYPLLQ

SEQ ID NO: 720686 - protein, 9 aa, Homo Sapiens
DCVGDGDED

SEQ ID NO: 720687 - protein, 9 aa, Homo Sapiens
DDCVGDGDE

SEQ ID NO: 720688 - protein, 9 aa, Homo Sapiens
SLRAGLEVE

SEQ ID NO: 720689 - protein, 9 aa, Homo Sapiens
RPMPTAGAA

SEQ ID NO: 720690 - protein, 9 aa, Homo Sapiens
HVFQGWKDL

SEQ ID NO: 720691 - protein, 9 aa, Homo Sapiens
RPMPTAGAT

SEQ ID NO: 720692 - protein, 9 aa, Homo Sapiens
VDDAQFPYP

SEQ ID NO: 720693 - protein, 9 aa, Homo Sapiens
SVFHVINIY

SEQ ID NO: 720694 - protein, 9 aa, Homo Sapiens
SLNRKFRPF

SEQ ID NO: 720695 - protein, 9 aa, Homo Sapiens
APVVRRGKV

SEQ ID NO: 720696 - protein, 9 aa, Homo Sapiens
AHSMPTAVA

SEQ ID NO: 720697 - protein, 9 aa, Homo Sapiens
GDTSQDSPG

SEQ ID NO: 720698 - protein, 9 aa, Homo Sapiens
GGVTLVKEK

SEQ ID NO: 720699 - protein, 9 aa, Homo Sapiens
QKLHQDTSY

SEQ ID NO: 720700 - protein, 9 aa, Homo Sapiens
QRPPPPYPG

SEQ ID NO: 720701 - protein, 9 aa, Homo Sapiens
IDAVFAACQ

SEQ ID NO: 720702 - protein, 9 aa, Homo Sapiens
NMSSQALQM

SEQ ID NO: 720703 - protein, 9 aa, Homo Sapiens
IVKLVVRYT

SEQ ID NO: 720704 - protein, 9 aa, Homo Sapiens
QAAPSYGQL

SEQ ID NO: 720705 - protein, 9 aa, Homo Sapiens
NNFAKREIL

SEQ ID NO: 720706 - protein, 9 aa, Homo Sapiens
GALPLIQSR

SEQ ID NO: 720707 - protein, 9 aa, Homo Sapiens
PLMPTVEAA

SEQ ID NO: 720708 - protein, 9 aa, Homo Sapiens
TQGTGTLSK

SEQ ID NO: 720709 - protein, 9 aa, Homo Sapiens
QSLRLQTHQ

SEQ ID NO: 720710 - protein, 9 aa, Homo Sapiens
VAAPVVRRG

SEQ ID NO: 720711 - protein, 9 aa, Homo Sapiens
AARLMPTVG

SEQ ID NO: 720712 - protein, 9 aa, Homo Sapiens
KRQERNKLF

SEQ ID NO: 720713 - protein, 9 aa, Homo Sapiens
AAKDIVKLV

SEQ ID NO: 720714 - protein, 9 aa, Homo Sapiens
LKVTRNTLV

SEQ ID NO: 720715 - protein, 9 aa, Homo Sapiens
YKCMHCPYI

SEQ ID NO: 720716 - protein, 9 aa, Homo Sapiens
ESDTNKTTC

SEQ ID NO: 720717 - protein, 9 aa, Homo Sapiens
PTMTARHRV

SEQ ID NO: 720718 - protein, 9 aa, Homo Sapiens
QFTLSVRLD

SEQ ID NO: 720719 - protein, 9 aa, Homo Sapiens
FAVLLVLFL

SEQ ID NO: 720720 - protein, 9 aa, Homo Sapiens
RWGPRATLT

SEQ ID NO: 720721 - protein, 9 aa, Homo Sapiens
SQPGLSLHP

SEQ ID NO: 720722 - protein, 9 aa, Homo Sapiens
TQLAVNQRP

SEQ ID NO: 720723 - protein, 9 aa, Homo Sapiens
FTQSADVTT

SEQ ID NO: 720724 - protein, 9 aa, Homo Sapiens
AGTTPAEEE

SEQ ID NO: 720725 - protein, 9 aa, Homo Sapiens
CKQSQHMTE

SEQ ID NO: 720726 - protein, 9 aa, Homo Sapiens
VFQGWKDLL

SEQ ID NO: 720727 - protein, 9 aa, Homo Sapiens
EATHPTPTV

SEQ ID NO: 720728 - protein, 9 aa, Homo Sapiens
LPFTLLLPQ

SEQ ID NO: 720729 - protein, 9 aa, Homo Sapiens
LWYQVESLE

SEQ ID NO: 720730 - protein, 9 aa, Homo Sapiens
GVGPKAFKL

SEQ ID NO: 720731 - protein, 9 aa, Homo Sapiens
FFPVSSQGC

SEQ ID NO: 720732 - protein, 9 aa, Homo Sapiens
TKPLLLDLL

SEQ ID NO: 720733 - protein, 9 aa, Homo Sapiens
EVAHSMPTA

SEQ ID NO: 720734 - protein, 9 aa, Homo Sapiens
NHASVETLC

SEQ ID NO: 720735 - protein, 9 aa, Homo Sapiens
SNAEKDTGL

SEQ ID NO: 720736 - protein, 9 aa, Homo Sapiens
SKVSRCGNQ

SEQ ID NO: 720737 - protein, 9 aa, Homo Sapiens
AKLHGRAPQ

SEQ ID NO: 720738 - protein, 9 aa, Homo Sapiens
SGNAASSTP

SEQ ID NO: 720739 - protein, 9 aa, Homo Sapiens
LGVSSSTSV

SEQ ID NO: 720740 - protein, 9 aa, Homo Sapiens
HDVAVLLNR

SEQ ID NO: 720741 - protein, 9 aa, Homo Sapiens
SWNTRHILS

SEQ ID NO: 720742 - protein, 9 aa, Homo Sapiens
TRNTKAARP

SEQ ID NO: 720743 - protein, 9 aa, Homo Sapiens
TWMRALPSP

SEQ ID NO: 720744 - protein, 9 aa, Homo Sapiens
TFASVFHVI

SEQ ID NO: 720745 - protein, 9 aa, Homo Sapiens
TEGELKDLT

SEQ ID NO: 720746 - protein, 9 aa, Homo Sapiens
TAFEEPRVQ

SEQ ID NO: 720747 - protein, 9 aa, Homo Sapiens
LLDLATSFC

SEQ ID NO: 720748 - protein, 9 aa, Homo Sapiens
TEAARSMPT

SEQ ID NO: 720749 - protein, 9 aa, Homo Sapiens
VGEPEKAAG

SEQ ID NO: 720750 - protein, 9 aa, Homo Sapiens
ALTQEANLG

SEQ ID NO: 720751 - protein, 9 aa, Homo Sapiens
ANRGGQRQG

SEQ ID NO: 720752 - protein, 9 aa, Homo Sapiens
GPPMQFMDC

SEQ ID NO: 720753 - protein, 9 aa, Homo Sapiens
LLDLLPQSL

SEQ ID NO: 720754 - protein, 9 aa, Homo Sapiens
PTAGTTTPK

SEQ ID NO: 720755 - protein, 9 aa, Homo Sapiens
TKLKELAAF

SEQ ID NO: 720756 - protein, 9 aa, Homo Sapiens
AARLAAEYS

SEQ ID NO: 720757 - protein, 9 aa, Homo Sapiens
LFRSHNGNS

SEQ ID NO: 720758 - protein, 9 aa, Homo Sapiens
EATRLMPTA

SEQ ID NO: 720759 - protein, 9 aa, Homo Sapiens
EESQRIIKQ

SEQ ID NO: 720760 - protein, 9 aa, Homo Sapiens
GLQLLKNKE

SEQ ID NO: 720761 - protein, 9 aa, Homo Sapiens
GKLVSKLQD

SEQ ID NO: 720762 - protein, 9 aa, Homo Sapiens
YCRKYVSQN

SEQ ID NO: 720763 - protein, 9 aa, Homo Sapiens
LMEQYIKAT

SEQ ID NO: 720764 - protein, 9 aa, Homo Sapiens
EDEDDCVGD

SEQ ID NO: 720765 - protein, 9 aa, Homo Sapiens
SRGRDTRSL

SEQ ID NO: 720766 - protein, 9 aa, Homo Sapiens
LDSLFSVVI

SEQ ID NO: 720767 - protein, 9 aa, Homo Sapiens
FFRNTQAAI

SEQ ID NO: 720768 - protein, 9 aa, Homo Sapiens
LLKAAKDIV

SEQ ID NO: 720769 - protein, 9 aa, Homo Sapiens
LWAAQRIHE

SEQ ID NO: 720770 - protein, 9 aa, Homo Sapiens
DDILRHCNP

SEQ ID NO: 720771 - protein, 9 aa, Homo Sapiens
RKAQQEARP

SEQ ID NO: 720772 - protein, 9 aa, Homo Sapiens
SCLSGQRDV

SEQ ID NO: 720773 - protein, 9 aa, Homo Sapiens
RKHLTKPLL

SEQ ID NO: 720774 - protein, 9 aa, Homo Sapiens
LPSRLEDGA

SEQ ID NO: 720775 - protein, 9 aa, Homo Sapiens
QSGLIGKDG

SEQ ID NO: 720776 - protein, 9 aa, Homo Sapiens
LPQSLLPQE

SEQ ID NO: 720777 - protein, 9 aa, Homo Sapiens
AVGPSLRAG

SEQ ID NO: 720778 - protein, 9 aa, Homo Sapiens
KEFSQSLRL

SEQ ID NO: 720779 - protein, 9 aa, Homo Sapiens
SSWTHREIV

SEQ ID NO: 720780 - protein, 9 aa, Homo Sapiens
TAMEEAAAT

SEQ ID NO: 720781 - protein, 9 aa, Homo Sapiens
ETEGELKDL

SEQ ID NO: 720782 - protein, 9 aa, Homo Sapiens
RQERNKLFY

SEQ ID NO: 720783 - protein, 9 aa, Homo Sapiens
SYSMPVIQQ

SEQ ID NO: 720784 - protein, 9 aa, Homo Sapiens
QQQAAPSYG

SEQ ID NO: 720785 - protein, 9 aa, Homo Sapiens
ASVHVSYFS

SEQ ID NO: 720786 - protein, 9 aa, Homo Sapiens
LPTMTARHR

SEQ ID NO: 720787 - protein, 9 aa, Homo Sapiens
LFHFFMSRG

SEQ ID NO: 720788 - protein, 9 aa, Homo Sapiens
SDGYHRQRG

SEQ ID NO: 720789 - protein, 9 aa, Homo Sapiens
TMEEEVAHS

SEQ ID NO: 720790 - protein, 9 aa, Homo Sapiens
TVPAGATAT

SEQ ID NO: 720791 - protein, 9 aa, Homo Sapiens
FGANDVVCT

SEQ ID NO: 720792 - protein, 9 aa, Homo Sapiens
YELKQEQKK

SEQ ID NO: 720793 - protein, 9 aa, Homo Sapiens
LFTQSADVT

SEQ ID NO: 720794 - protein, 9 aa, Homo Sapiens
NPITVPYNI

SEQ ID NO: 720795 - protein, 9 aa, Homo Sapiens
LSLAENKLD

SEQ ID NO: 720796 - protein, 9 aa, Homo Sapiens
KSVLAGPCA

SEQ ID NO: 720797 - protein, 9 aa, Homo Sapiens
GRGIRDAGR

SEQ ID NO: 720798 - protein, 9 aa, Homo Sapiens
IIEILQFTL

SEQ ID NO: 720799 - protein, 9 aa, Homo Sapiens
VVTHQKIHT

SEQ ID NO: 720800 - protein, 9 aa, Homo Sapiens
KMGKPSAPL

SEQ ID NO: 720801 - protein, 9 aa, Homo Sapiens
VTLSMPTAE

SEQ ID NO: 720802 - protein, 9 aa, Homo Sapiens
LKAAKDIVK

SEQ ID NO: 720803 - protein, 9 aa, Homo Sapiens
INMGLTSVS

SEQ ID NO: 720804 - protein, 9 aa, Homo Sapiens
ALFFRNTQA

SEQ ID NO: 720805 - protein, 9 aa, Homo Sapiens
PGAVYKCMH

SEQ ID NO: 720806 - protein, 9 aa, Homo Sapiens
PHPDIYLVA

SEQ ID NO: 720807 - protein, 9 aa, Homo Sapiens
PFAELAGWE

SEQ ID NO: 720808 - protein, 9 aa, Homo Sapiens
HASVETLCL

SEQ ID NO: 720809 - protein, 9 aa, Homo Sapiens
TAMAGVTIT

SEQ ID NO: 720810 - protein, 9 aa, Homo Sapiens
EFVLTVFLY

SEQ ID NO: 720811 - protein, 9 aa, Homo Sapiens
ASQLSKPCR

SEQ ID NO: 720812 - protein, 9 aa, Homo Sapiens
TNGFDVFKC

SEQ ID NO: 720813 - protein, 9 aa, Homo Sapiens
TAGADRPMP

SEQ ID NO: 720814 - protein, 9 aa, Homo Sapiens
DDAQFPYPA

SEQ ID NO: 720815 - protein, 9 aa, Homo Sapiens
TVGAVTVPA

SEQ ID NO: 720816 - protein, 9 aa, Homo Sapiens
GLLGTNLSY

SEQ ID NO: 720817 - protein, 9 aa, Homo Sapiens
IYELKQEQK

SEQ ID NO: 720818 - protein, 9 aa, Homo Sapiens
ERGEGEHDA

SEQ ID NO: 720819 - protein, 9 aa, Homo Sapiens
PTFQVISST

SEQ ID NO: 720820 - protein, 9 aa, Homo Sapiens
TAGAAASTV

SEQ ID NO: 720821 - protein, 9 aa, Homo Sapiens
KDWNSRPRF

SEQ ID NO: 720822 - protein, 9 aa, Homo Sapiens
TYGTCKCLC

SEQ ID NO: 720823 - protein, 9 aa, Homo Sapiens
LAVNQRPEW

SEQ ID NO: 720824 - protein, 9 aa, Homo Sapiens
KAAGSFLAL

SEQ ID NO: 720825 - protein, 9 aa, Homo Sapiens
AAAAAQQLK

SEQ ID NO: 720826 - protein, 9 aa, Homo Sapiens
LCERGEGEH

SEQ ID NO: 720827 - protein, 9 aa, Homo Sapiens
FYGNSLSSI

SEQ ID NO: 720828 - protein, 9 aa, Homo Sapiens
AAPSMPTVE

SEQ ID NO: 720829 - protein, 9 aa, Homo Sapiens
LAGDHMHLS

SEQ ID NO: 720830 - protein, 9 aa, Homo Sapiens
EEAATRNTK

SEQ ID NO: 720831 - protein, 9 aa, Homo Sapiens
TAEATHPTP

SEQ ID NO: 720832 - protein, 9 aa, Homo Sapiens
VLAGPCAHP

SEQ ID NO: 720833 - protein, 9 aa, Homo Sapiens
NGIPTYTLV

SEQ ID NO: 720834 - protein, 9 aa, Homo Sapiens
AAATRSTEA

SEQ ID NO: 720835 - protein, 9 aa, Homo Sapiens
PPAPAQLTL

SEQ ID NO: 720836 - protein, 9 aa, Homo Sapiens
VSQMLDILL

SEQ ID NO: 720837 - protein, 9 aa, Homo Sapiens
GQTAESLAL

SEQ ID NO: 720838 - protein, 9 aa, Homo Sapiens
NSCLLKDIG

SEQ ID NO: 720839 - protein, 9 aa, Homo Sapiens
RKGAILSGQ

SEQ ID NO: 720840 - protein, 9 aa, Homo Sapiens
STVPTTVMA

SEQ ID NO: 720841 - protein, 9 aa, Homo Sapiens
QSLLPQESK

SEQ ID NO: 720842 - protein, 9 aa, Homo Sapiens
EEAATRRTE

SEQ ID NO: 720843 - protein, 9 aa, Homo Sapiens
TPTAGATTV

SEQ ID NO: 720844 - protein, 9 aa, Homo Sapiens
HAKDELLTN

SEQ ID NO: 720845 - protein, 9 aa, Homo Sapiens
VNKMQEDTP

SEQ ID NO: 720846 - protein, 9 aa, Homo Sapiens
SSLGLELPS

SEQ ID NO: 720847 - protein, 9 aa, Homo Sapiens
HPVFAYTRI

SEQ ID NO: 720848 - protein, 9 aa, Homo Sapiens
CKEAVTLKA

SEQ ID NO: 720849 - protein, 9 aa, Homo Sapiens
GNPESLGYK

SEQ ID NO: 720850 - protein, 9 aa, Homo Sapiens
TEAARTTPT

SEQ ID NO: 720851 - protein, 9 aa, Homo Sapiens
QTAESLALH

SEQ ID NO: 720852 - protein, 9 aa, Homo Sapiens
YNTPSFLNF

SEQ ID NO: 720853 - protein, 9 aa, Homo Sapiens
LERRRRARQ

SEQ ID NO: 720854 - protein, 9 aa, Homo Sapiens
AEAAHPMPT

SEQ ID NO: 720855 - protein, 9 aa, Homo Sapiens
VKANDLGQL

SEQ ID NO: 720856 - protein, 9 aa, Homo Sapiens
QRSHVVTHQ

SEQ ID NO: 720857 - protein, 9 aa, Homo Sapiens
GKAFTKSSL

SEQ ID NO: 720858 - protein, 9 aa, Homo Sapiens
PWLQLECQQ

SEQ ID NO: 720859 - protein, 9 aa, Homo Sapiens
YSVKKLADV

SEQ ID NO: 720860 - protein, 9 aa, Homo Sapiens
AAGPGSGGG

SEQ ID NO: 720861 - protein, 9 aa, Homo Sapiens
SVSLLAAYE

SEQ ID NO: 720862 - protein, 9 aa, Homo Sapiens
TFHNHASVE

SEQ ID NO: 720863 - protein, 9 aa, Homo Sapiens
AQDLKDLYN

SEQ ID NO: 720864 - protein, 9 aa, Homo Sapiens
MTARHRVWR

SEQ ID NO: 720865 - protein, 9 aa, Homo Sapiens
RKEEDTRTA

SEQ ID NO: 720866 - protein, 9 aa, Homo Sapiens
TTTTKFIKN

SEQ ID NO: 720867 - protein, 9 aa, Homo Sapiens
DLATSFCEN

SEQ ID NO: 720868 - protein, 9 aa, Homo Sapiens
TRTASQSLL

SEQ ID NO: 720869 - protein, 9 aa, Homo Sapiens
RESPAAKKE

SEQ ID NO: 720870 - protein, 9 aa, Homo Sapiens
DSQPGGRPQ

SEQ ID NO: 720871 - protein, 9 aa, Homo Sapiens
SGIKGQILV

SEQ ID NO: 720872 - protein, 9 aa, Homo Sapiens
LSYVEKLWL

SEQ ID NO: 720873 - protein, 9 aa, Homo Sapiens
KHLTKPLLL

SEQ ID NO: 720874 - protein, 9 aa, Homo Sapiens
RTSGYVARI

SEQ ID NO: 720875 - protein, 9 aa, Homo Sapiens
ANDVVCTRI

SEQ ID NO: 720876 - protein, 9 aa, Homo Sapiens
SNQTLNNST

SEQ ID NO: 720877 - protein, 9 aa, Homo Sapiens
EIKEAIKKN

SEQ ID NO: 720878 - protein, 9 aa, Homo Sapiens
GYSVGCLLQ

SEQ ID NO: 720879 - protein, 9 aa, Homo Sapiens
LVDGESDTN

SEQ ID NO: 720880 - protein, 9 aa, Homo Sapiens
KDVTVVFTE

SEQ ID NO: 720881 - protein, 9 aa, Homo Sapiens
TAVYSNILS

SEQ ID NO: 720882 - protein, 9 aa, Homo Sapiens
SACVSTDGS

SEQ ID NO: 720883 - protein, 9 aa, Homo Sapiens
TLKAVRQGG

SEQ ID NO: 720884 - protein, 9 aa, Homo Sapiens
SKLQDGGTK

SEQ ID NO: 720885 - protein, 9 aa, Homo Sapiens
VDSLLCERG

SEQ ID NO: 720886 - protein, 9 aa, Homo Sapiens
AIPNRAITA

SEQ ID NO: 720887 - protein, 9 aa, Homo Sapiens
EANLGKKTV

SEQ ID NO: 720888 - protein, 9 aa, Homo Sapiens
TLVPVSVTL

SEQ ID NO: 720889 - protein, 9 aa, Homo Sapiens
HNGNSREPW

SEQ ID NO: 720890 - protein, 9 aa, Homo Sapiens
SSDKFNEHY

SEQ ID NO: 720891 - protein, 9 aa, Homo Sapiens
KIDAVFAAC

SEQ ID NO: 720892 - protein, 9 aa, Homo Sapiens
FDLQNAQSK

SEQ ID NO: 720893 - protein, 9 aa, Homo Sapiens
PTAEATHPT

SEQ ID NO: 720894 - protein, 9 aa, Homo Sapiens
PQEYQDPVP

SEQ ID NO: 720895 - protein, 9 aa, Homo Sapiens
GGQDLNDEN

SEQ ID NO: 720896 - protein, 9 aa, Homo Sapiens
VLQSKDTDS

SEQ ID NO: 720897 - protein, 9 aa, Homo Sapiens
HMHLSPFVY

SEQ ID NO: 720898 - protein, 9 aa, Homo Sapiens
EEEAALERR

SEQ ID NO: 720899 - protein, 9 aa, Homo Sapiens
EILRKEEDT

SEQ ID NO: 720900 - protein, 9 aa, Homo Sapiens
PEATEKHDN

SEQ ID NO: 720901 - protein, 9 aa, Homo Sapiens
MAQEYDEKT

SEQ ID NO: 720902 - protein, 9 aa, Homo Sapiens
APTFQVISS

SEQ ID NO: 720903 - protein, 9 aa, Homo Sapiens
ELAALIYEL

SEQ ID NO: 720904 - protein, 9 aa, Homo Sapiens
KSSIELKRI

SEQ ID NO: 720905 - protein, 9 aa, Homo Sapiens
GLGEGDRFL

SEQ ID NO: 720906 - protein, 9 aa, Homo Sapiens
GNDAGLQRQ

SEQ ID NO: 720907 - protein, 9 aa, Homo Sapiens
RLSDKIFMM

SEQ ID NO: 720908 - protein, 9 aa, Homo Sapiens
VKKLFHFFM

SEQ ID NO: 720909 - protein, 9 aa, Homo Sapiens
AVTVWEVVL

SEQ ID NO: 720910 - protein, 9 aa, Homo Sapiens
SDEESCTPW

SEQ ID NO: 720911 - protein, 9 aa, Homo Sapiens
TRSTEATRL

SEQ ID NO: 720912 - protein, 9 aa, Homo Sapiens
TVWSPPAPA

SEQ ID NO: 720913 - protein, 9 aa, Homo Sapiens
IKERAANPL

SEQ ID NO: 720914 - protein, 9 aa, Homo Sapiens
SYVEKLWLK

SEQ ID NO: 720915 - protein, 9 aa, Homo Sapiens
FHNHASVET

SEQ ID NO: 720916 - protein, 9 aa, Homo Sapiens
MPTVGATTV

SEQ ID NO: 720917 - protein, 9 aa, Homo Sapiens
IGDVKKLFH

SEQ ID NO: 720918 - protein, 9 aa, Homo Sapiens
ERAANPLLH

SEQ ID NO: 720919 - protein, 9 aa, Homo Sapiens
HNHASVETL

SEQ ID NO: 720920 - protein, 9 aa, Homo Sapiens
VWQLVFAGS

SEQ ID NO: 720921 - protein, 9 aa, Homo Sapiens
ATTVPAGAT

SEQ ID NO: 720922 - protein, 9 aa, Homo Sapiens
KEVSGIVHM

SEQ ID NO: 720923 - protein, 9 aa, Homo Sapiens
DGKEMAQEY

SEQ ID NO: 720924 - protein, 9 aa, Homo Sapiens
GFCTGLVGL

SEQ ID NO: 720925 - protein, 9 aa, Homo Sapiens
VLRPHNVAF

SEQ ID NO: 720926 - protein, 9 aa, Homo Sapiens
EEATTKSTE

SEQ ID NO: 720927 - protein, 9 aa, Homo Sapiens
VFFQESRAK

SEQ ID NO: 720928 - protein, 9 aa, Homo Sapiens
HKAFGKHYS

SEQ ID NO: 720929 - protein, 9 aa, Homo Sapiens
YQDPVPEQD

SEQ ID NO: 720930 - protein, 9 aa, Homo Sapiens
DWNSRPRFA

SEQ ID NO: 720931 - protein, 9 aa, Homo Sapiens
QAKGVGAAR

SEQ ID NO: 720932 - protein, 9 aa, Homo Sapiens
GANDVVCTR

SEQ ID NO: 720933 - protein, 9 aa, Homo Sapiens
TRSTEAAPS

SEQ ID NO: 720934 - protein, 9 aa, Homo Sapiens
YPSQKPLSW

SEQ ID NO: 720935 - protein, 9 aa, Homo Sapiens
MPTAGAAAS

SEQ ID NO: 720936 - protein, 9 aa, Homo Sapiens
KHTISCSYC

SEQ ID NO: 720937 - protein, 9 aa, Homo Sapiens
CLSRGRDTR

SEQ ID NO: 720938 - protein, 9 aa, Homo Sapiens
LKSNSKVKM

SEQ ID NO: 720939 - protein, 9 aa, Homo Sapiens
IFKKRSTRT

SEQ ID NO: 720940 - protein, 9 aa, Homo Sapiens
AGDHMHLSP

SEQ ID NO: 720941 - protein, 9 aa, Homo Sapiens
AYNFEESHG

SEQ ID NO: 720942 - protein, 9 aa, Homo Sapiens
TRSTEAAPL

SEQ ID NO: 720943 - protein, 9 aa, Homo Sapiens
MDSVLSSEA

SEQ ID NO: 720944 - protein, 9 aa, Homo Sapiens
QGGLPLEKV

SEQ ID NO: 720945 - protein, 9 aa, Homo Sapiens
ELAAFWLSD

SEQ ID NO: 720946 - protein, 9 aa, Homo Sapiens
RKDLGLRLY

SEQ ID NO: 720947 - protein, 9 aa, Homo Sapiens
LKELAAFWL

SEQ ID NO: 720948 - protein, 9 aa, Homo Sapiens
TTPTAGADR

SEQ ID NO: 720949 - protein, 9 aa, Homo Sapiens
YQVESLESQ

SEQ ID NO: 720950 - protein, 9 aa, Homo Sapiens
APRLTPTVG

SEQ ID NO: 720951 - protein, 9 aa, Homo Sapiens
LSRVKAELL

SEQ ID NO: 720952 - protein, 9 aa, Homo Sapiens
RDLLPFTLL

SEQ ID NO: 720953 - protein, 9 aa, Homo Sapiens
GVLNPITVP

SEQ ID NO: 720954 - protein, 9 aa, Homo Sapiens
GATATEEEA

SEQ ID NO: 720955 - protein, 9 aa, Homo Sapiens
KCEAFGKAY

SEQ ID NO: 720956 - protein, 9 aa, Homo Sapiens
LNGKSYSII

SEQ ID NO: 720957 - protein, 9 aa, Homo Sapiens
RTWVPGVLT

SEQ ID NO: 720958 - protein, 9 aa, Homo Sapiens
AARPMPTAG

SEQ ID NO: 720959 - protein, 9 aa, Homo Sapiens
GIKGQILVN

SEQ ID NO: 720960 - protein, 9 aa, Homo Sapiens
LKRIHDSMA

SEQ ID NO: 720961 - protein, 9 aa, Homo Sapiens
CTPWPCSES

SEQ ID NO: 720962 - protein, 9 aa, Homo Sapiens
SMPVIQQPE

SEQ ID NO: 720963 - protein, 9 aa, Homo Sapiens
DCELIPADL

SEQ ID NO: 720964 - protein, 9 aa, Homo Sapiens
QLDSLFSVV

SEQ ID NO: 720965 - protein, 9 aa, Homo Sapiens
LTSHPAAEA

SEQ ID NO: 720966 - protein, 9 aa, Homo Sapiens
LLGTNLSYL

SEQ ID NO: 720967 - protein, 9 aa, Homo Sapiens
LYITICLPL

SEQ ID NO: 720968 - protein, 9 aa, Homo Sapiens
PTVEAARLM

SEQ ID NO: 720969 - protein, 9 aa, Homo Sapiens
WSFSQQRQQ

SEQ ID NO: 720970 - protein, 9 aa, Homo Sapiens
PWPCSESEF

SEQ ID NO: 720971 - protein, 9 aa, Homo Sapiens
TTKFIKNPG

SEQ ID NO: 720972 - protein, 9 aa, Homo Sapiens
RLMPTAEAA

SEQ ID NO: 720973 - protein, 9 aa, Homo Sapiens
KMQEDTPSA

SEQ ID NO: 720974 - protein, 9 aa, Homo Sapiens
PSGNAASST

SEQ ID NO: 720975 - protein, 9 aa, Homo Sapiens
VAVHCVEGL

SEQ ID NO: 720976 - protein, 9 aa, Homo Sapiens
DIVPLETRE

SEQ ID NO: 720977 - protein, 9 aa, Homo Sapiens
ALQKMDSVL

SEQ ID NO: 720978 - protein, 9 aa, Homo Sapiens
SCVAVHCVE

SEQ ID NO: 720979 - protein, 9 aa, Homo Sapiens
LNDENQTLT

SEQ ID NO: 720980 - protein, 9 aa, Homo Sapiens
FHCKPAKAL

SEQ ID NO: 720981 - protein, 9 aa, Homo Sapiens
VQQQAAPSY

SEQ ID NO: 720982 - protein, 9 aa, Homo Sapiens
ELPEINKVP

SEQ ID NO: 720983 - protein, 9 aa, Homo Sapiens
LTPTVGAAT

SEQ ID NO: 720984 - protein, 9 aa, Homo Sapiens
KEDILSYVE

SEQ ID NO: 720985 - protein, 9 aa, Homo Sapiens
FEILDRTRK

SEQ ID NO: 720986 - protein, 9 aa, Homo Sapiens
QKGESDISN

SEQ ID NO: 720987 - protein, 9 aa, Homo Sapiens
VEGLGRAPV

SEQ ID NO: 720988 - protein, 9 aa, Homo Sapiens
MQEDTPSAQ

SEQ ID NO: 720989 - protein, 9 aa, Homo Sapiens
GVHNAAGQA

SEQ ID NO: 720990 - protein, 9 aa, Homo Sapiens
RPPRTWVPG

SEQ ID NO: 720991 - protein, 9 aa, Homo Sapiens
EAALERRRR

SEQ ID NO: 720992 - protein, 9 aa, Homo Sapiens
NRCVSCLSG

SEQ ID NO: 720993 - protein, 9 aa, Homo Sapiens
QLECQQDHK

SEQ ID NO: 720994 - protein, 9 aa, Homo Sapiens
MTTIIKGVN

SEQ ID NO: 720995 - protein, 9 aa, Homo Sapiens
LDLLPQSLL

SEQ ID NO: 720996 - protein, 9 aa, Homo Sapiens
SMPTVEAAR

SEQ ID NO: 720997 - protein, 9 aa, Homo Sapiens
YTLVPVSVT

SEQ ID NO: 720998 - protein, 9 aa, Homo Sapiens
QLFPNNFAK

SEQ ID NO: 720999 - protein, 9 aa, Homo Sapiens
EPLWYQVES

SEQ ID NO: 721000 - protein, 9 aa, Homo Sapiens
ELHAMLAKS

SEQ ID NO: 721001 - protein, 9 aa, Homo Sapiens
DESSIFDNG

SEQ ID NO: 721002 - protein, 9 aa, Homo Sapiens
RPQDRIVSK

SEQ ID NO: 721003 - protein, 9 aa, Homo Sapiens
KGVNASMPR

SEQ ID NO: 721004 - protein, 9 aa, Homo Sapiens
ESLGYKIKY

SEQ ID NO: 721005 - protein, 9 aa, Homo Sapiens
DHKYPSQKP

SEQ ID NO: 721006 - protein, 9 aa, Homo Sapiens
HNQQQCQPP

SEQ ID NO: 721007 - protein, 9 aa, Homo Sapiens
LILTFGAND

SEQ ID NO: 721008 - protein, 9 aa, Homo Sapiens
STFHNHASV

SEQ ID NO: 721009 - protein, 9 aa, Homo Sapiens
SLLFQHARI

SEQ ID NO: 721010 - protein, 9 aa, Homo Sapiens
RQESREVAL

SEQ ID NO: 721011 - protein, 9 aa, Homo Sapiens
LTASQLSKP

SEQ ID NO: 721012 - protein, 9 aa, Homo Sapiens
VVGAQVSQM

SEQ ID NO: 721013 - protein, 9 aa, Homo Sapiens
DSCKEAVTL

SEQ ID NO: 721014 - protein, 9 aa, Homo Sapiens
WLNSQPRWP

SEQ ID NO: 721015 - protein, 9 aa, Homo Sapiens
LSGTTTTKF

SEQ ID NO: 721016 - protein, 9 aa, Homo Sapiens
NLNGKSYSI

SEQ ID NO: 721017 - protein, 9 aa, Homo Sapiens
STEAARTTP

SEQ ID NO: 721018 - protein, 9 aa, Homo Sapiens
TKSTEAART

SEQ ID NO: 721019 - protein, 9 aa, Homo Sapiens
QFFFFFFPF

SEQ ID NO: 721020 - protein, 9 aa, Homo Sapiens
FASVFHVIN

SEQ ID NO: 721021 - protein, 9 aa, Homo Sapiens
SSILEGEAR

SEQ ID NO: 721022 - protein, 9 aa, Homo Sapiens
ATRSTEAPR

SEQ ID NO: 721023 - protein, 9 aa, Homo Sapiens
LLTFKAFDQ

SEQ ID NO: 721024 - protein, 9 aa, Homo Sapiens
ARHLCQPLP

SEQ ID NO: 721025 - protein, 9 aa, Homo Sapiens
SHNGNSREP

SEQ ID NO: 721026 - protein, 9 aa, Homo Sapiens
LCQPLPTPC

SEQ ID NO: 721027 - protein, 9 aa, Homo Sapiens
LMRMALDRY

SEQ ID NO: 721028 - protein, 9 aa, Homo Sapiens
SPAAKKEPL

SEQ ID NO: 721029 - protein, 9 aa, Homo Sapiens
SQDSPGALQ

SEQ ID NO: 721030 - protein, 9 aa, Homo Sapiens
DLKDAEVFQ

SEQ ID NO: 721031 - protein, 9 aa, Homo Sapiens
DSMAVKSSS

SEQ ID NO: 721032 - protein, 9 aa, Homo Sapiens
RAVGPSLRA

SEQ ID NO: 721033 - protein, 9 aa, Homo Sapiens
GVTKIINYT

SEQ ID NO: 721034 - protein, 9 aa, Homo Sapiens
KKTVEWVGS

SEQ ID NO: 721035 - protein, 9 aa, Homo Sapiens
ASPSSPWRQ

SEQ ID NO: 721036 - protein, 9 aa, Homo Sapiens
MEEEVAHSM

SEQ ID NO: 721037 - protein, 9 aa, Homo Sapiens
LNNSTWSNQ

SEQ ID NO: 721038 - protein, 9 aa, Homo Sapiens
GKSYSIIVN

SEQ ID NO: 721039 - protein, 9 aa, Homo Sapiens
GLLDLATSF

SEQ ID NO: 721040 - protein, 9 aa, Homo Sapiens
LHGRAPQLR

SEQ ID NO: 721041 - protein, 9 aa, Homo Sapiens
IGFCTGLVG

SEQ ID NO: 721042 - protein, 9 aa, Homo Sapiens
ATVSATAMA

SEQ ID NO: 721043 - protein, 9 aa, Homo Sapiens
DAKSPHPVF

SEQ ID NO: 721044 - protein, 9 aa, Homo Sapiens
AAHGDTSQD

SEQ ID NO: 721045 - protein, 9 aa, Homo Sapiens
AQGNDAGLQ

SEQ ID NO: 721046 - protein, 9 aa, Homo Sapiens
AIGFCTGLV

SEQ ID NO: 721047 - protein, 9 aa, Homo Sapiens
NPLLHLRSE

SEQ ID NO: 721048 - protein, 9 aa, Homo Sapiens
VVYSTPACY

SEQ ID NO: 721049 - protein, 9 aa, Homo Sapiens
NIGQAKIFF

SEQ ID NO: 721050 - protein, 9 aa, Homo Sapiens
DIRQVLKEE

SEQ ID NO: 721051 - protein, 9 aa, Homo Sapiens
AVISTVEGA

SEQ ID NO: 721052 - protein, 9 aa, Homo Sapiens
REERANMSS

SEQ ID NO: 721053 - protein, 9 aa, Homo Sapiens
NGKSYSIIV

SEQ ID NO: 721054 - protein, 9 aa, Homo Sapiens
VGPSLRAGL

SEQ ID NO: 721055 - protein, 9 aa, Homo Sapiens
VGAATVPSR

SEQ ID NO: 721056 - protein, 9 aa, Homo Sapiens
GVGANSCLL

SEQ ID NO: 721057 - protein, 9 aa, Homo Sapiens
HPAAEACWP

SEQ ID NO: 721058 - protein, 9 aa, Homo Sapiens
NGPDTEKLP

SEQ ID NO: 721059 - protein, 9 aa, Homo Sapiens
WPCSESEFS

SEQ ID NO: 721060 - protein, 9 aa, Homo Sapiens
AYALFFRNT

SEQ ID NO: 721061 - protein, 9 aa, Homo Sapiens
VGALIYSVK

SEQ ID NO: 721062 - protein, 9 aa, Homo Sapiens
QDLNDENQT

SEQ ID NO: 721063 - protein, 9 aa, Homo Sapiens
TCFSPEDDG

SEQ ID NO: 721064 - protein, 9 aa, Homo Sapiens
PYSDDVSEV

SEQ ID NO: 721065 - protein, 9 aa, Homo Sapiens
IVSKAMIAY

SEQ ID NO: 721066 - protein, 9 aa, Homo Sapiens
DLVIVTVSL

SEQ ID NO: 721067 - protein, 9 aa, Homo Sapiens
KHCPLEIPH

SEQ ID NO: 721068 - protein, 9 aa, Homo Sapiens
YLVLRPHNV

SEQ ID NO: 721069 - protein, 9 aa, Homo Sapiens
EPGVRRPEG

SEQ ID NO: 721070 - protein, 9 aa, Homo Sapiens
LLIKERAAN

SEQ ID NO: 721071 - protein, 9 aa, Homo Sapiens
LVAIRKRIH

SEQ ID NO: 721072 - protein, 9 aa, Homo Sapiens
SQNKSNLTH

SEQ ID NO: 721073 - protein, 9 aa, Homo Sapiens
PQAKGVGAA

SEQ ID NO: 721074 - protein, 9 aa, Homo Sapiens
AFDQLFILG

SEQ ID NO: 721075 - protein, 9 aa, Homo Sapiens
LFLKSNSKV

SEQ ID NO: 721076 - protein, 9 aa, Homo Sapiens
LTWRFCRRS

SEQ ID NO: 721077 - protein, 9 aa, Homo Sapiens
QLEGVNSSI

SEQ ID NO: 721078 - protein, 9 aa, Homo Sapiens
PTVEAARPM

SEQ ID NO: 721079 - protein, 9 aa, Homo Sapiens
LDRTGLSAV

SEQ ID NO: 721080 - protein, 9 aa, Homo Sapiens
ELENLTVTQ

SEQ ID NO: 721081 - protein, 9 aa, Homo Sapiens
NLNAEVSTK

SEQ ID NO: 721082 - protein, 9 aa, Homo Sapiens
VYSTPACYL

SEQ ID NO: 721083 - protein, 9 aa, Homo Sapiens
RRSPFPRQR

SEQ ID NO: 721084 - protein, 9 aa, Homo Sapiens
KAKATQKKA

SEQ ID NO: 721085 - protein, 9 aa, Homo Sapiens
DDYYFTSIK

SEQ ID NO: 721086 - protein, 9 aa, Homo Sapiens
AATRRTEVT

SEQ ID NO: 721087 - protein, 9 aa, Homo Sapiens
GRGSCAEGI

SEQ ID NO: 721088 - protein, 9 aa, Homo Sapiens
SGLTSHPAA

SEQ ID NO: 721089 - protein, 9 aa, Homo Sapiens
IYSVKKLAD

SEQ ID NO: 721090 - protein, 9 aa, Homo Sapiens
GYRESGIKG

SEQ ID NO: 721091 - protein, 9 aa, Homo Sapiens
SPGSPRAQH

SEQ ID NO: 721092 - protein, 9 aa, Homo Sapiens
SQKPLSWQP

SEQ ID NO: 721093 - protein, 9 aa, Homo Sapiens
LESQKLPSQ

SEQ ID NO: 721094 - protein, 9 aa, Homo Sapiens
ESQRIIKQQ

SEQ ID NO: 721095 - protein, 9 aa, Homo Sapiens
CIFAFAAAL

SEQ ID NO: 721096 - protein, 9 aa, Homo Sapiens
AVEEPLEAP

SEQ ID NO: 721097 - protein, 9 aa, Homo Sapiens
TTIIKGVNA

SEQ ID NO: 721098 - protein, 9 aa, Homo Sapiens
YSMPVIQQP

SEQ ID NO: 721099 - protein, 9 aa, Homo Sapiens
MMFWYIMEK

SEQ ID NO: 721100 - protein, 9 aa, Homo Sapiens
LECLQWLNS

SEQ ID NO: 721101 - protein, 9 aa, Homo Sapiens
ILTFGANDV

SEQ ID NO: 721102 - protein, 9 aa, Homo Sapiens
SFRDISQPG

SEQ ID NO: 721103 - protein, 9 aa, Homo Sapiens
TETAMKEVS

SEQ ID NO: 721104 - protein, 9 aa, Homo Sapiens
ENLTVTQVG

SEQ ID NO: 721105 - protein, 9 aa, Homo Sapiens
RESQWLPAV

SEQ ID NO: 721106 - protein, 9 aa, Homo Sapiens
GFKQAIPQD

SEQ ID NO: 721107 - protein, 9 aa, Homo Sapiens
PHNVAFLLV

SEQ ID NO: 721108 - protein, 9 aa, Homo Sapiens
SQVLPRKHL

SEQ ID NO: 721109 - protein, 9 aa, Homo Sapiens
EGGDPDNVE

SEQ ID NO: 721110 - protein, 9 aa, Homo Sapiens
TEFVLTVFL

SEQ ID NO: 721111 - protein, 9 aa, Homo Sapiens
LGEGDRFLT

SEQ ID NO: 721112 - protein, 9 aa, Homo Sapiens
EMAIETVGH

SEQ ID NO: 721113 - protein, 9 aa, Homo Sapiens
KGAILSGQL

SEQ ID NO: 721114 - protein, 9 aa, Homo Sapiens
QPPSELVPG

SEQ ID NO: 721115 - protein, 9 aa, Homo Sapiens
DDDEEEAAL

SEQ ID NO: 721116 - protein, 9 aa, Homo Sapiens
MEEAAATRS

SEQ ID NO: 721117 - protein, 9 aa, Homo Sapiens
YVSQNKSNL

SEQ ID NO: 721118 - protein, 9 aa, Homo Sapiens
CPHPDIYLV

SEQ ID NO: 721119 - protein, 9 aa, Homo Sapiens
KEAVTLKAV

SEQ ID NO: 721120 - protein, 9 aa, Homo Sapiens
GTTTPKPTA

SEQ ID NO: 721121 - protein, 9 aa, Homo Sapiens
KGVTKIINY

SEQ ID NO: 721122 - protein, 9 aa, Homo Sapiens
PLETREYDF

SEQ ID NO: 721123 - protein, 9 aa, Homo Sapiens
DKIFMMFWY

SEQ ID NO: 721124 - protein, 9 aa, Homo Sapiens
PSMPTVEAA

SEQ ID NO: 721125 - protein, 9 aa, Homo Sapiens
IGDAEEYDT

SEQ ID NO: 721126 - protein, 9 aa, Homo Sapiens
PVYMQQIAN

SEQ ID NO: 721127 - protein, 9 aa, Homo Sapiens
VSRCGNQRY

SEQ ID NO: 721128 - protein, 9 aa, Homo Sapiens
PSYLGVSSS

SEQ ID NO: 721129 - protein, 9 aa, Homo Sapiens
PHPVFAYTR

SEQ ID NO: 721130 - protein, 9 aa, Homo Sapiens
KGSSVHVVY

SEQ ID NO: 721131 - protein, 9 aa, Homo Sapiens
KASPSSPWR

SEQ ID NO: 721132 - protein, 9 aa, Homo Sapiens
AAPVVRRGK

SEQ ID NO: 721133 - protein, 9 aa, Homo Sapiens
RIHEGARNI

SEQ ID NO: 721134 - protein, 9 aa, Homo Sapiens
QCINTYGTC

SEQ ID NO: 721135 - protein, 9 aa, Homo Sapiens
QAKTELIVR

SEQ ID NO: 721136 - protein, 9 aa, Homo Sapiens
HLSPFVYSE

SEQ ID NO: 721137 - protein, 9 aa, Homo Sapiens
GPRATLTRP

SEQ ID NO: 721138 - protein, 9 aa, Homo Sapiens
RSPFPRQRR

SEQ ID NO: 721139 - protein, 9 aa, Homo Sapiens
AVGEPEKAA

SEQ ID NO: 721140 - protein, 9 aa, Homo Sapiens
LLKNKEDSL

SEQ ID NO: 721141 - protein, 9 aa, Homo Sapiens
QEANLGKKT

SEQ ID NO: 721142 - protein, 9 aa, Homo Sapiens
VVLLLGKLL

SEQ ID NO: 721143 - protein, 9 aa, Homo Sapiens
VRGGVTLVK

SEQ ID NO: 721144 - protein, 9 aa, Homo Sapiens
GGVGANSCL

SEQ ID NO: 721145 - protein, 9 aa, Homo Sapiens
EAKKKTVEW

SEQ ID NO: 721146 - protein, 9 aa, Homo Sapiens
EIYELHAML

SEQ ID NO: 721147 - protein, 9 aa, Homo Sapiens
PPIGRLRFK

SEQ ID NO: 721148 - protein, 9 aa, Homo Sapiens
TAMKEVSGI

SEQ ID NO: 721149 - protein, 9 aa, Homo Sapiens
AANPLLHLR

SEQ ID NO: 721150 - protein, 9 aa, Homo Sapiens
SSVHVVYST

SEQ ID NO: 721151 - protein, 9 aa, Homo Sapiens
MPTAGTTTP

SEQ ID NO: 721152 - protein, 9 aa, Homo Sapiens
DQLFILGCS

SEQ ID NO: 721153 - protein, 9 aa, Homo Sapiens
RMALDRYVA

SEQ ID NO: 721154 - protein, 9 aa, Homo Sapiens
ILTDDLGLS

SEQ ID NO: 721155 - protein, 9 aa, Homo Sapiens
AGATATEEE

SEQ ID NO: 721156 - protein, 9 aa, Homo Sapiens
LSKGCLSRG

SEQ ID NO: 721157 - protein, 9 aa, Homo Sapiens
STYLPLKSM

SEQ ID NO: 721158 - protein, 9 aa, Homo Sapiens
IHPIFGGAM

SEQ ID NO: 721159 - protein, 9 aa, Homo Sapiens
QRRRRGLSR

SEQ ID NO: 721160 - protein, 9 aa, Homo Sapiens
PAEKIDAVF

SEQ ID NO: 721161 - protein, 9 aa, Homo Sapiens
FQVISSTQA

SEQ ID NO: 721162 - protein, 9 aa, Homo Sapiens
EEAALERRR

SEQ ID NO: 721163 - protein, 9 aa, Homo Sapiens
IDTETAMKE

SEQ ID NO: 721164 - protein, 9 aa, Homo Sapiens
SSLNRKFRP

SEQ ID NO: 721165 - protein, 9 aa, Homo Sapiens
RQVLKEETG

SEQ ID NO: 721166 - protein, 9 aa, Homo Sapiens
LATSFCENR

SEQ ID NO: 721167 - protein, 9 aa, Homo Sapiens
LLAFLVIYL

SEQ ID NO: 721168 - protein, 9 aa, Homo Sapiens
IRELFEEFH

SEQ ID NO: 721169 - protein, 9 aa, Homo Sapiens
LSGQRDVDN

SEQ ID NO: 721170 - protein, 9 aa, Homo Sapiens
PQESKKLLK

SEQ ID NO: 721171 - protein, 9 aa, Homo Sapiens
TVGAATVPS

SEQ ID NO: 721172 - protein, 9 aa, Homo Sapiens
MPTAEAAHP

SEQ ID NO: 721173 - protein, 9 aa, Homo Sapiens
LGTNLSYLK

SEQ ID NO: 721174 - protein, 9 aa, Homo Sapiens
PAQLTLNAN

SEQ ID NO: 721175 - protein, 9 aa, Homo Sapiens
DILRHCNPW

SEQ ID NO: 721176 - protein, 9 aa, Homo Sapiens
ESTYLPLKS

SEQ ID NO: 721177 - protein, 9 aa, Homo Sapiens
SAVEEPLEA

SEQ ID NO: 721178 - protein, 9 aa, Homo Sapiens
CLYLAMDES

SEQ ID NO: 721179 - protein, 9 aa, Homo Sapiens
KRSEVELQQ

SEQ ID NO: 721180 - protein, 9 aa, Homo Sapiens
TASDSQPGG

SEQ ID NO: 721181 - protein, 9 aa, Homo Sapiens
HRVWRAFEN

SEQ ID NO: 721182 - protein, 9 aa, Homo Sapiens
ITPGDRGSQ

SEQ ID NO: 721183 - protein, 9 aa, Homo Sapiens
MRCTVFFQE

SEQ ID NO: 721184 - protein, 9 aa, Homo Sapiens
QFEYVWQLV

SEQ ID NO: 721185 - protein, 9 aa, Homo Sapiens
PGCGHSWNT

SEQ ID NO: 721186 - protein, 9 aa, Homo Sapiens
RGEGEHDAS

SEQ ID NO: 721187 - protein, 9 aa, Homo Sapiens
RHPGSSYLA

SEQ ID NO: 721188 - protein, 9 aa, Homo Sapiens
SNILSDSYW

SEQ ID NO: 721189 - protein, 9 aa, Homo Sapiens
RQQRANRGG

SEQ ID NO: 721190 - protein, 9 aa, Homo Sapiens
RESGIKGQI

SEQ ID NO: 721191 - protein, 9 aa, Homo Sapiens
PQSLLPQES

SEQ ID NO: 721192 - protein, 9 aa, Homo Sapiens
VHPHVFQGW

SEQ ID NO: 721193 - protein, 9 aa, Homo Sapiens
FPRQRRRRG

SEQ ID NO: 721194 - protein, 9 aa, Homo Sapiens
TKSSLLFQH

SEQ ID NO: 721195 - protein, 9 aa, Homo Sapiens
AVKHCPLEI

SEQ ID NO: 721196 - protein, 9 aa, Homo Sapiens
NTKAARPMP

SEQ ID NO: 721197 - protein, 9 aa, Homo Sapiens
NVAFLLVYR

SEQ ID NO: 721198 - protein, 9 aa, Homo Sapiens
NTAYSFSFF

SEQ ID NO: 721199 - protein, 9 aa, Homo Sapiens
NRAITADVS

SEQ ID NO: 721200 - protein, 9 aa, Homo Sapiens
MDKMTAVYS

SEQ ID NO: 721201 - protein, 9 aa, Homo Sapiens
DHCELCPKD

SEQ ID NO: 721202 - protein, 9 aa, Homo Sapiens
GFSGSHSCS

SEQ ID NO: 721203 - protein, 9 aa, Homo Sapiens
VCLPFCGPN

SEQ ID NO: 721204 - protein, 9 aa, Homo Sapiens
DLKGVEKVF

SEQ ID NO: 721205 - protein, 9 aa, Homo Sapiens
KRPYGKLVS

SEQ ID NO: 721206 - protein, 9 aa, Homo Sapiens
DPPASAVQS

SEQ ID NO: 721207 - protein, 9 aa, Homo Sapiens
EGHILLFVL

SEQ ID NO: 721208 - protein, 9 aa, Homo Sapiens
QGQGLRQPH

SEQ ID NO: 721209 - protein, 9 aa, Homo Sapiens
SANYFCYEN

SEQ ID NO: 721210 - protein, 9 aa, Homo Sapiens
TKLNRNTGN

SEQ ID NO: 721211 - protein, 9 aa, Homo Sapiens
HHPLVLKTY

SEQ ID NO: 721212 - protein, 9 aa, Homo Sapiens
LNVENPWSL

SEQ ID NO: 721213 - protein, 9 aa, Homo Sapiens
SMDECKVQK

SEQ ID NO: 721214 - protein, 9 aa, Homo Sapiens
QPEATEAQT

SEQ ID NO: 721215 - protein, 9 aa, Homo Sapiens
VALMGKPVS

SEQ ID NO: 721216 - protein, 9 aa, Homo Sapiens
GAWVRGTWP

SEQ ID NO: 721217 - protein, 9 aa, Homo Sapiens
TRCFWSTLW

SEQ ID NO: 721218 - protein, 9 aa, Homo Sapiens
SFRRCITQI

SEQ ID NO: 721219 - protein, 9 aa, Homo Sapiens
MCPSWPRPA

SEQ ID NO: 721220 - protein, 9 aa, Homo Sapiens
GSNISHKLL

SEQ ID NO: 721221 - protein, 9 aa, Homo Sapiens
QKVRGVDVM

SEQ ID NO: 721222 - protein, 9 aa, Homo Sapiens
LQAALINRR

SEQ ID NO: 721223 - protein, 9 aa, Homo Sapiens
ILSCAHLAG

SEQ ID NO: 721224 - protein, 9 aa, Homo Sapiens
HGLSYAWSP

SEQ ID NO: 721225 - protein, 9 aa, Homo Sapiens
GSFDFSCLP

SEQ ID NO: 721226 - protein, 9 aa, Homo Sapiens
CCKSVDECK

SEQ ID NO: 721227 - protein, 9 aa, Homo Sapiens
LYINWQDTA

SEQ ID NO: 721228 - protein, 9 aa, Homo Sapiens
GQRWHQGSW

SEQ ID NO: 721229 - protein, 9 aa, Homo Sapiens
VVSISQSNL

SEQ ID NO: 721230 - protein, 9 aa, Homo Sapiens
GEHALQDAW

SEQ ID NO: 721231 - protein, 9 aa, Homo Sapiens
QGFLSMSRR

SEQ ID NO: 721232 - protein, 9 aa, Homo Sapiens
IRAGDYEGL

SEQ ID NO: 721233 - protein, 9 aa, Homo Sapiens
AGPHYPLHC

SEQ ID NO: 721234 - protein, 9 aa, Homo Sapiens
FRSRLNALV

SEQ ID NO: 721235 - protein, 9 aa, Homo Sapiens
ALTFMTESP

SEQ ID NO: 721236 - protein, 9 aa, Homo Sapiens
HYPPQQPYF

SEQ ID NO: 721237 - protein, 9 aa, Homo Sapiens
HCFPCCMGS

SEQ ID NO: 721238 - protein, 9 aa, Homo Sapiens
PSLVATAAL

SEQ ID NO: 721239 - protein, 9 aa, Homo Sapiens
KEEPPLPSG

SEQ ID NO: 721240 - protein, 9 aa, Homo Sapiens
LVFVIDSSS

SEQ ID NO: 721241 - protein, 9 aa, Homo Sapiens
WLGTVLLNA

SEQ ID NO: 721242 - protein, 9 aa, Homo Sapiens
LAVQSGTRP

SEQ ID NO: 721243 - protein, 9 aa, Homo Sapiens
SHSSTTHNI

SEQ ID NO: 721244 - protein, 9 aa, Homo Sapiens
MAGPHYPLH

SEQ ID NO: 721245 - protein, 9 aa, Homo Sapiens
GRKPILLSQ

SEQ ID NO: 721246 - protein, 9 aa, Homo Sapiens
MEGNMPNGT

SEQ ID NO: 721247 - protein, 9 aa, Homo Sapiens
RFGNKTFPE

SEQ ID NO: 721248 - protein, 9 aa, Homo Sapiens
CIVTHFVVE

SEQ ID NO: 721249 - protein, 9 aa, Homo Sapiens
QRLVPTYES

SEQ ID NO: 721250 - protein, 9 aa, Homo Sapiens
NGQWLGTVL

SEQ ID NO: 721251 - protein, 9 aa, Homo Sapiens
REHRVYVET

SEQ ID NO: 721252 - protein, 9 aa, Homo Sapiens
SQCLRNLLM

SEQ ID NO: 721253 - protein, 9 aa, Homo Sapiens
LLVAQGSTG

SEQ ID NO: 721254 - protein, 9 aa, Homo Sapiens
RSASASNPY

SEQ ID NO: 721255 - protein, 9 aa, Homo Sapiens
TGEHCLTLQ

SEQ ID NO: 721256 - protein, 9 aa, Homo Sapiens
NYVFPKWVQ

SEQ ID NO: 721257 - protein, 9 aa, Homo Sapiens
TSKKHWDGE

SEQ ID NO: 721258 - protein, 9 aa, Homo Sapiens
TAEVYFFQC

SEQ ID NO: 721259 - protein, 9 aa, Homo Sapiens
DNTQENIKA

SEQ ID NO: 721260 - protein, 9 aa, Homo Sapiens
SGPKSPIGH

SEQ ID NO: 721261 - protein, 9 aa, Homo Sapiens
PCPREGHIL

SEQ ID NO: 721262 - protein, 9 aa, Homo Sapiens
VISLLLLMC

SEQ ID NO: 721263 - protein, 9 aa, Homo Sapiens
PSWPRPAPC

SEQ ID NO: 721264 - protein, 9 aa, Homo Sapiens
YERHSNVQC

SEQ ID NO: 721265 - protein, 9 aa, Homo Sapiens
APDSYETQV

SEQ ID NO: 721266 - protein, 9 aa, Homo Sapiens
EELPESVEE

SEQ ID NO: 721267 - protein, 9 aa, Homo Sapiens
MCDWSKCSI

SEQ ID NO: 721268 - protein, 9 aa, Homo Sapiens
NFCWYLLSN

SEQ ID NO: 721269 - protein, 9 aa, Homo Sapiens
RGAADPPAS

SEQ ID NO: 721270 - protein, 9 aa, Homo Sapiens
TQENIKATQ

SEQ ID NO: 721271 - protein, 9 aa, Homo Sapiens
LVTVACEAK

SEQ ID NO: 721272 - protein, 9 aa, Homo Sapiens
YQHSSPVAA

SEQ ID NO: 721273 - protein, 9 aa, Homo Sapiens
TFMTESPRF

SEQ ID NO: 721274 - protein, 9 aa, Homo Sapiens
IGQQWFGNL

SEQ ID NO: 721275 - protein, 9 aa, Homo Sapiens
PPTPHPHPH

SEQ ID NO: 721276 - protein, 9 aa, Homo Sapiens
FVIELLERV

SEQ ID NO: 721277 - protein, 9 aa, Homo Sapiens
KSAEGRKKS

SEQ ID NO: 721278 - protein, 9 aa, Homo Sapiens
HVPETKRHD

SEQ ID NO: 721279 - protein, 9 aa, Homo Sapiens
HQKLAIERA

SEQ ID NO: 721280 - protein, 9 aa, Homo Sapiens
VLLVPNTIN

SEQ ID NO: 721281 - protein, 9 aa, Homo Sapiens
RTFLPDQNQ

SEQ ID NO: 721282 - protein, 9 aa, Homo Sapiens
ESAPPSFKL

SEQ ID NO: 721283 - protein, 9 aa, Homo Sapiens
GSCVPGLDC

SEQ ID NO: 721284 - protein, 9 aa, Homo Sapiens
VSCHGPYKA

SEQ ID NO: 721285 - protein, 9 aa, Homo Sapiens
LCDLYPLMK

SEQ ID NO: 721286 - protein, 9 aa, Homo Sapiens
PLSKQKEPD

SEQ ID NO: 721287 - protein, 9 aa, Homo Sapiens
GERPYPCPH

SEQ ID NO: 721288 - protein, 9 aa, Homo Sapiens
ADVNGLPTP

SEQ ID NO: 721289 - protein, 9 aa, Homo Sapiens
YTCGSHLAV

SEQ ID NO: 721290 - protein, 9 aa, Homo Sapiens
LVNLEPRYT

SEQ ID NO: 721291 - protein, 9 aa, Homo Sapiens
SLWKAPIGE

SEQ ID NO: 721292 - protein, 9 aa, Homo Sapiens
LIQENLPEI

SEQ ID NO: 721293 - protein, 9 aa, Homo Sapiens
FVIPNLPQL

SEQ ID NO: 721294 - protein, 9 aa, Homo Sapiens
VSTGHTTAL

SEQ ID NO: 721295 - protein, 9 aa, Homo Sapiens
PAPVRHRPE

SEQ ID NO: 721296 - protein, 9 aa, Homo Sapiens
WSPRPPRPL

SEQ ID NO: 721297 - protein, 9 aa, Homo Sapiens
AEGLPVGGA

SEQ ID NO: 721298 - protein, 9 aa, Homo Sapiens
SDMQEESQI

SEQ ID NO: 721299 - protein, 9 aa, Homo Sapiens
SILDAAGRG

SEQ ID NO: 721300 - protein, 9 aa, Homo Sapiens
SSTKKESRI

SEQ ID NO: 721301 - protein, 9 aa, Homo Sapiens
RSCAVIEND

SEQ ID NO: 721302 - protein, 9 aa, Homo Sapiens
LEKQHLHNV

SEQ ID NO: 721303 - protein, 9 aa, Homo Sapiens
GTARRSHAN

SEQ ID NO: 721304 - protein, 9 aa, Homo Sapiens
PRIGGVGVQ

SEQ ID NO: 721305 - protein, 9 aa, Homo Sapiens
GVVFAQCAF

SEQ ID NO: 721306 - protein, 9 aa, Homo Sapiens
YDRVAKLIP

SEQ ID NO: 721307 - protein, 9 aa, Homo Sapiens
TSKLFVVSY

SEQ ID NO: 721308 - protein, 9 aa, Homo Sapiens
LGVITVPIF

SEQ ID NO: 721309 - protein, 9 aa, Homo Sapiens
TLEMLFPSW

SEQ ID NO: 721310 - protein, 9 aa, Homo Sapiens
RTLSRVMVS

SEQ ID NO: 721311 - protein, 9 aa, Homo Sapiens
RKRQQQEGN

SEQ ID NO: 721312 - protein, 9 aa, Homo Sapiens
CHAYPHIQN

SEQ ID NO: 721313 - protein, 9 aa, Homo Sapiens
SEENLPTFQ

SEQ ID NO: 721314 - protein, 9 aa, Homo Sapiens
YSCCLVSEV

SEQ ID NO: 721315 - protein, 9 aa, Homo Sapiens
STCLCWAST

SEQ ID NO: 721316 - protein, 9 aa, Homo Sapiens
LMGMNMNIG

SEQ ID NO: 721317 - protein, 9 aa, Homo Sapiens
ASCHTSKKH

SEQ ID NO: 721318 - protein, 9 aa, Homo Sapiens
LPASHPLFG

SEQ ID NO: 721319 - protein, 9 aa, Homo Sapiens
AQEGQRYKM

SEQ ID NO: 721320 - protein, 9 aa, Homo Sapiens
KLFVVSYDA

SEQ ID NO: 721321 - protein, 9 aa, Homo Sapiens
LLWVAPFSV

SEQ ID NO: 721322 - protein, 9 aa, Homo Sapiens
FKRLGSHSF

SEQ ID NO: 721323 - protein, 9 aa, Homo Sapiens
GPITQGTTI

SEQ ID NO: 721324 - protein, 9 aa, Homo Sapiens
LSIAGLIYL

SEQ ID NO: 721325 - protein, 9 aa, Homo Sapiens
CPTTCYFYA

SEQ ID NO: 721326 - protein, 9 aa, Homo Sapiens
SRLKAEKSV

SEQ ID NO: 721327 - protein, 9 aa, Homo Sapiens
GTWPQQALR

SEQ ID NO: 721328 - protein, 9 aa, Homo Sapiens
SPTWGPHWP

SEQ ID NO: 721329 - protein, 9 aa, Homo Sapiens
LRKCCKSVD

SEQ ID NO: 721330 - protein, 9 aa, Homo Sapiens
KPKLIPSSA

SEQ ID NO: 721331 - protein, 9 aa, Homo Sapiens
DDDSESEIK

SEQ ID NO: 721332 - protein, 9 aa, Homo Sapiens
CYHSPCCSL

SEQ ID NO: 721333 - protein, 9 aa, Homo Sapiens
EAIMLGNLL

SEQ ID NO: 721334 - protein, 9 aa, Homo Sapiens
WYGVPLLAA

SEQ ID NO: 721335 - protein, 9 aa, Homo Sapiens
AKLSMQFFI

SEQ ID NO: 721336 - protein, 9 aa, Homo Sapiens
YTMIILASI

SEQ ID NO: 721337 - protein, 9 aa, Homo Sapiens
CDLYPLMKL

SEQ ID NO: 721338 - protein, 9 aa, Homo Sapiens
EENLPTFQK

SEQ ID NO: 721339 - protein, 9 aa, Homo Sapiens
GSIKQYDPH

SEQ ID NO: 721340 - protein, 9 aa, Homo Sapiens
YGYERHSNV

SEQ ID NO: 721341 - protein, 9 aa, Homo Sapiens
SDGYLTSGT

SEQ ID NO: 721342 - protein, 9 aa, Homo Sapiens
GVLEKRPNR

SEQ ID NO: 721343 - protein, 9 aa, Homo Sapiens
CGINGPSDW

SEQ ID NO: 721344 - protein, 9 aa, Homo Sapiens
SRWRVSIPN

SEQ ID NO: 721345 - protein, 9 aa, Homo Sapiens
HSGASSQST

SEQ ID NO: 721346 - protein, 9 aa, Homo Sapiens
TKIMSLRLC

SEQ ID NO: 721347 - protein, 9 aa, Homo Sapiens
TLVESLQDE

SEQ ID NO: 721348 - protein, 9 aa, Homo Sapiens
TTTVTTTPT

SEQ ID NO: 721349 - protein, 9 aa, Homo Sapiens
HAYGRKPIL

SEQ ID NO: 721350 - protein, 9 aa, Homo Sapiens
QFRDSYPGC

SEQ ID NO: 721351 - protein, 9 aa, Homo Sapiens
ASINFTYSL

SEQ ID NO: 721352 - protein, 9 aa, Homo Sapiens
QQSQAQAVL

SEQ ID NO: 721353 - protein, 9 aa, Homo Sapiens
PDSLAHRPQ

SEQ ID NO: 721354 - protein, 9 aa, Homo Sapiens
SLRLHFRIH

SEQ ID NO: 721355 - protein, 9 aa, Homo Sapiens
REAVLVAFL

SEQ ID NO: 721356 - protein, 9 aa, Homo Sapiens
HATPMQKLI

SEQ ID NO: 721357 - protein, 9 aa, Homo Sapiens
WKAPIGESW

SEQ ID NO: 721358 - protein, 9 aa, Homo Sapiens
MLKGEYTYS

SEQ ID NO: 721359 - protein, 9 aa, Homo Sapiens
PGKNGERCG

SEQ ID NO: 721360 - protein, 9 aa, Homo Sapiens
LPLYSLCPG

SEQ ID NO: 721361 - protein, 9 aa, Homo Sapiens
IPNEQSVVI

SEQ ID NO: 721362 - protein, 9 aa, Homo Sapiens
IVESHDGHD

SEQ ID NO: 721363 - protein, 9 aa, Homo Sapiens
GVDVMVGGH

SEQ ID NO: 721364 - protein, 9 aa, Homo Sapiens
LISILDRDD

SEQ ID NO: 721365 - protein, 9 aa, Homo Sapiens
LHVPETKRH

SEQ ID NO: 721366 - protein, 9 aa, Homo Sapiens
RLKAEKSVL

SEQ ID NO: 721367 - protein, 9 aa, Homo Sapiens
RLMQKITTL

SEQ ID NO: 721368 - protein, 9 aa, Homo Sapiens
CMITGTVVS

SEQ ID NO: 721369 - protein, 9 aa, Homo Sapiens
QSPPSPLCL

SEQ ID NO: 721370 - protein, 9 aa, Homo Sapiens
NKELNQNQL

SEQ ID NO: 721371 - protein, 9 aa, Homo Sapiens
GQNIIAILE

SEQ ID NO: 721372 - protein, 9 aa, Homo Sapiens
GPHYPLHCL

SEQ ID NO: 721373 - protein, 9 aa, Homo Sapiens
FSKDTINAE

SEQ ID NO: 721374 - protein, 9 aa, Homo Sapiens
EQLQQLENA

SEQ ID NO: 721375 - protein, 9 aa, Homo Sapiens
EEDEPGLVK

SEQ ID NO: 721376 - protein, 9 aa, Homo Sapiens
INNEVLRNC

SEQ ID NO: 721377 - protein, 9 aa, Homo Sapiens
AHNGRTYFF

SEQ ID NO: 721378 - protein, 9 aa, Homo Sapiens
EKFGHGAHH

SEQ ID NO: 721379 - protein, 9 aa, Homo Sapiens
MFSLGWCQK

SEQ ID NO: 721380 - protein, 9 aa, Homo Sapiens
FYCHKLRYL

SEQ ID NO: 721381 - protein, 9 aa, Homo Sapiens
ISVPSYSGG

SEQ ID NO: 721382 - protein, 9 aa, Homo Sapiens
CKCSECGKS

SEQ ID NO: 721383 - protein, 9 aa, Homo Sapiens
TRRRLRVEI

SEQ ID NO: 721384 - protein, 9 aa, Homo Sapiens
YWKATHPTS

SEQ ID NO: 721385 - protein, 9 aa, Homo Sapiens
VLFVTITAV

SEQ ID NO: 721386 - protein, 9 aa, Homo Sapiens
VSEVLCRLL

SEQ ID NO: 721387 - protein, 9 aa, Homo Sapiens
RRREGAISS

SEQ ID NO: 721388 - protein, 9 aa, Homo Sapiens
ATAALCAVH

SEQ ID NO: 721389 - protein, 9 aa, Homo Sapiens
TTSRYPLPL

SEQ ID NO: 721390 - protein, 9 aa, Homo Sapiens
LSMLDIVSG

SEQ ID NO: 721391 - protein, 9 aa, Homo Sapiens
ETRRRLRVE

SEQ ID NO: 721392 - protein, 9 aa, Homo Sapiens
GPLPASHPL

SEQ ID NO: 721393 - protein, 9 aa, Homo Sapiens
PTTCYFYAT

SEQ ID NO: 721394 - protein, 9 aa, Homo Sapiens
ANGNKFERN

SEQ ID NO: 721395 - protein, 9 aa, Homo Sapiens
TTYEERDAC

SEQ ID NO: 721396 - protein, 9 aa, Homo Sapiens
EGNMPNGTL

SEQ ID NO: 721397 - protein, 9 aa, Homo Sapiens
DKNGNFCWY

SEQ ID NO: 721398 - protein, 9 aa, Homo Sapiens
TPSLTSVDN

SEQ ID NO: 721399 - protein, 9 aa, Homo Sapiens
VLGNYRVNT

SEQ ID NO: 721400 - protein, 9 aa, Homo Sapiens
PCHDVGCHP

SEQ ID NO: 721401 - protein, 9 aa, Homo Sapiens
RGEGRSPPT

SEQ ID NO: 721402 - protein, 9 aa, Homo Sapiens
REGAISSES

SEQ ID NO: 721403 - protein, 9 aa, Homo Sapiens
REYLKNFLL

SEQ ID NO: 721404 - protein, 9 aa, Homo Sapiens
LLAKGSPQG

SEQ ID NO: 721405 - protein, 9 aa, Homo Sapiens
FTVQALQRR

SEQ ID NO: 721406 - protein, 9 aa, Homo Sapiens
FETIYPNIS

SEQ ID NO: 721407 - protein, 9 aa, Homo Sapiens
PAPHVQAAP

SEQ ID NO: 721408 - protein, 9 aa, Homo Sapiens
LQDNCCGIN

SEQ ID NO: 721409 - protein, 9 aa, Homo Sapiens
PFPYAPYAA

SEQ ID NO: 721410 - protein, 9 aa, Homo Sapiens
LFSLEEISY

SEQ ID NO: 721411 - protein, 9 aa, Homo Sapiens
APVRHRPEA

SEQ ID NO: 721412 - protein, 9 aa, Homo Sapiens
KASQMGAVG

SEQ ID NO: 721413 - protein, 9 aa, Homo Sapiens
WSYVRIYKF

SEQ ID NO: 721414 - protein, 9 aa, Homo Sapiens
VPLLAAEHL

SEQ ID NO: 721415 - protein, 9 aa, Homo Sapiens
WRMCDWSKC

SEQ ID NO: 721416 - protein, 9 aa, Homo Sapiens
FSINCCCLR

SEQ ID NO: 721417 - protein, 9 aa, Homo Sapiens
PNEQSVVIY

SEQ ID NO: 721418 - protein, 9 aa, Homo Sapiens
KVLPLDLML

SEQ ID NO: 721419 - protein, 9 aa, Homo Sapiens
RSAPASSPT

SEQ ID NO: 721420 - protein, 9 aa, Homo Sapiens
TFTKLNRNT

SEQ ID NO: 721421 - protein, 9 aa, Homo Sapiens
RDSVVSCRN

SEQ ID NO: 721422 - protein, 9 aa, Homo Sapiens
CSVDENTPI

SEQ ID NO: 721423 - protein, 9 aa, Homo Sapiens
TEFYQQLND

SEQ ID NO: 721424 - protein, 9 aa, Homo Sapiens
VIDSSSSVR

SEQ ID NO: 721425 - protein, 9 aa, Homo Sapiens
SFCPTTCYF

SEQ ID NO: 721426 - protein, 9 aa, Homo Sapiens
SSHCPMPAA

SEQ ID NO: 721427 - protein, 9 aa, Homo Sapiens
PVRHAAAIY

SEQ ID NO: 721428 - protein, 9 aa, Homo Sapiens
QGAWVRGTW

SEQ ID NO: 721429 - protein, 9 aa, Homo Sapiens
PREIPRGFR

SEQ ID NO: 721430 - protein, 9 aa, Homo Sapiens
GVTSAMNVA

SEQ ID NO: 721431 - protein, 9 aa, Homo Sapiens
QPGGNFAFF

SEQ ID NO: 721432 - protein, 9 aa, Homo Sapiens
DPSLDVLHR

SEQ ID NO: 721433 - protein, 9 aa, Homo Sapiens
LLFNAVSSS

SEQ ID NO: 721434 - protein, 9 aa, Homo Sapiens
EQKYADAVN

SEQ ID NO: 721435 - protein, 9 aa, Homo Sapiens
DPNSVSDKE

SEQ ID NO: 721436 - protein, 9 aa, Homo Sapiens
SVAAEPWLR

SEQ ID NO: 721437 - protein, 9 aa, Homo Sapiens
KQTMGFLEK

SEQ ID NO: 721438 - protein, 9 aa, Homo Sapiens
ITGTVVSIS

SEQ ID NO: 721439 - protein, 9 aa, Homo Sapiens
YIPKNVRKG

SEQ ID NO: 721440 - protein, 9 aa, Homo Sapiens
LLMDSVIHA

SEQ ID NO: 721441 - protein, 9 aa, Homo Sapiens
LEIIVILWE

SEQ ID NO: 721442 - protein, 9 aa, Homo Sapiens
WDPAHAGLA

SEQ ID NO: 721443 - protein, 9 aa, Homo Sapiens
PETLSQGQV

SEQ ID NO: 721444 - protein, 9 aa, Homo Sapiens
DPSNAIRIA

SEQ ID NO: 721445 - protein, 9 aa, Homo Sapiens
VFTEPQHCF

SEQ ID NO: 721446 - protein, 9 aa, Homo Sapiens
VMGVFLACL

SEQ ID NO: 721447 - protein, 9 aa, Homo Sapiens
GDLCPLCLQ

SEQ ID NO: 721448 - protein, 9 aa, Homo Sapiens
DLLDWPPCL

SEQ ID NO: 721449 - protein, 9 aa, Homo Sapiens
TIGIGQLIS

SEQ ID NO: 721450 - protein, 9 aa, Homo Sapiens
AQGSTGLYP

SEQ ID NO: 721451 - protein, 9 aa, Homo Sapiens
TVCDASKVV

SEQ ID NO: 721452 - protein, 9 aa, Homo Sapiens
KLVDLTQIA

SEQ ID NO: 721453 - protein, 9 aa, Homo Sapiens
LPKPLTPLW

SEQ ID NO: 721454 - protein, 9 aa, Homo Sapiens
SIKPLVLSL

SEQ ID NO: 721455 - protein, 9 aa, Homo Sapiens
TRQAISLIL

SEQ ID NO: 721456 - protein, 9 aa, Homo Sapiens
RLHFRIHTG

SEQ ID NO: 721457 - protein, 9 aa, Homo Sapiens
VRLPVYDAA

SEQ ID NO: 721458 - protein, 9 aa, Homo Sapiens
NGANVQSRD

SEQ ID NO: 721459 - protein, 9 aa, Homo Sapiens
AKPKLIPSS

SEQ ID NO: 721460 - protein, 9 aa, Homo Sapiens
KVKGLKLQE

SEQ ID NO: 721461 - protein, 9 aa, Homo Sapiens
FGTFFYSIC

SEQ ID NO: 721462 - protein, 9 aa, Homo Sapiens
FVTDKMLCA

SEQ ID NO: 721463 - protein, 9 aa, Homo Sapiens
FCDPGQLLK

SEQ ID NO: 721464 - protein, 9 aa, Homo Sapiens
RIGWAPAPV

SEQ ID NO: 721465 - protein, 9 aa, Homo Sapiens
ASNHRLNPG

SEQ ID NO: 721466 - protein, 9 aa, Homo Sapiens
DYFRLYTDK

SEQ ID NO: 721467 - protein, 9 aa, Homo Sapiens
KKEKEKKRK

SEQ ID NO: 721468 - protein, 9 aa, Homo Sapiens
PVGSCLSRG

SEQ ID NO: 721469 - protein, 9 aa, Homo Sapiens
LSNLVNYIQ

SEQ ID NO: 721470 - protein, 9 aa, Homo Sapiens
SCSPITVES

SEQ ID NO: 721471 - protein, 9 aa, Homo Sapiens
DGATAGVQP

SEQ ID NO: 721472 - protein, 9 aa, Homo Sapiens
SASGIFGML

SEQ ID NO: 721473 - protein, 9 aa, Homo Sapiens
FQDDFGPPQ

SEQ ID NO: 721474 - protein, 9 aa, Homo Sapiens
NVQCLPAFW

SEQ ID NO: 721475 - protein, 9 aa, Homo Sapiens
YITAVLSEK

SEQ ID NO: 721476 - protein, 9 aa, Homo Sapiens
TGHTTALHD

SEQ ID NO: 721477 - protein, 9 aa, Homo Sapiens
GAWYHKPKL

SEQ ID NO: 721478 - protein, 9 aa, Homo Sapiens
QVCSRSVNL

SEQ ID NO: 721479 - protein, 9 aa, Homo Sapiens
RFFFKQLDS

SEQ ID NO: 721480 - protein, 9 aa, Homo Sapiens
QVQRSVGST

SEQ ID NO: 721481 - protein, 9 aa, Homo Sapiens
VEVVALLGN

SEQ ID NO: 721482 - protein, 9 aa, Homo Sapiens
KILVVHDRN

SEQ ID NO: 721483 - protein, 9 aa, Homo Sapiens
SCGVGKRIM

SEQ ID NO: 721484 - protein, 9 aa, Homo Sapiens
PCPHCGKAF

SEQ ID NO: 721485 - protein, 9 aa, Homo Sapiens
SSRLKAEKS

SEQ ID NO: 721486 - protein, 9 aa, Homo Sapiens
LRKQVEGRL

SEQ ID NO: 721487 - protein, 9 aa, Homo Sapiens
IFQSRVMKE

SEQ ID NO: 721488 - protein, 9 aa, Homo Sapiens
GFPMVNNGH

SEQ ID NO: 721489 - protein, 9 aa, Homo Sapiens
KDRLEDLKK

SEQ ID NO: 721490 - protein, 9 aa, Homo Sapiens
GIFHRARGR

SEQ ID NO: 721491 - protein, 9 aa, Homo Sapiens
GISGPKSPI

SEQ ID NO: 721492 - protein, 9 aa, Homo Sapiens
SNLPQEQLI

SEQ ID NO: 721493 - protein, 9 aa, Homo Sapiens
GERCGPGGP

SEQ ID NO: 721494 - protein, 9 aa, Homo Sapiens
PCSPLSAPP

SEQ ID NO: 721495 - protein, 9 aa, Homo Sapiens
WAPLFCQQL

SEQ ID NO: 721496 - protein, 9 aa, Homo Sapiens
VEERSGAQD

SEQ ID NO: 721497 - protein, 9 aa, Homo Sapiens
QCITKCEQT

SEQ ID NO: 721498 - protein, 9 aa, Homo Sapiens
AAKTPCTRL

SEQ ID NO: 721499 - protein, 9 aa, Homo Sapiens
GKENKGRSC

SEQ ID NO: 721500 - protein, 9 aa, Homo Sapiens
LFLTNRVEH

SEQ ID NO: 721501 - protein, 9 aa, Homo Sapiens
SRDAFHEIR

SEQ ID NO: 721502 - protein, 9 aa, Homo Sapiens
CFKRGFFVL

SEQ ID NO: 721503 - protein, 9 aa, Homo Sapiens
RYSEKVPIH

SEQ ID NO: 721504 - protein, 9 aa, Homo Sapiens
PREHRVYVE

SEQ ID NO: 721505 - protein, 9 aa, Homo Sapiens
GGSSSIPPE

SEQ ID NO: 721506 - protein, 9 aa, Homo Sapiens
FFKQLDSLW

SEQ ID NO: 721507 - protein, 9 aa, Homo Sapiens
KELFENAGN

SEQ ID NO: 721508 - protein, 9 aa, Homo Sapiens
EKVLPLDLM

SEQ ID NO: 721509 - protein, 9 aa, Homo Sapiens
CDPNHVTDD

SEQ ID NO: 721510 - protein, 9 aa, Homo Sapiens
PNLPNHLPK

SEQ ID NO: 721511 - protein, 9 aa, Homo Sapiens
GLLGDPGAP

SEQ ID NO: 721512 - protein, 9 aa, Homo Sapiens
WTRCLRMRP

SEQ ID NO: 721513 - protein, 9 aa, Homo Sapiens
EVTVTVTSV

SEQ ID NO: 721514 - protein, 9 aa, Homo Sapiens
LHNNPANRP

SEQ ID NO: 721515 - protein, 9 aa, Homo Sapiens
AGRMGGRHP

SEQ ID NO: 721516 - protein, 9 aa, Homo Sapiens
LKGEYTYSL

SEQ ID NO: 721517 - protein, 9 aa, Homo Sapiens
DSISIECKG

SEQ ID NO: 721518 - protein, 9 aa, Homo Sapiens
FYHAIKSGM

SEQ ID NO: 721519 - protein, 9 aa, Homo Sapiens
KKCKIWMHV

SEQ ID NO: 721520 - protein, 9 aa, Homo Sapiens
ETKDPHATP

SEQ ID NO: 721521 - protein, 9 aa, Homo Sapiens
KKTVKSCED

SEQ ID NO: 721522 - protein, 9 aa, Homo Sapiens
EDLELARGK

SEQ ID NO: 721523 - protein, 9 aa, Homo Sapiens
IPWGRRPSP

SEQ ID NO: 721524 - protein, 9 aa, Homo Sapiens
SYVRIYKFL

SEQ ID NO: 721525 - protein, 9 aa, Homo Sapiens
DHILNLKIL

SEQ ID NO: 721526 - protein, 9 aa, Homo Sapiens
LCMLHKKFW

SEQ ID NO: 721527 - protein, 9 aa, Homo Sapiens
PSPLCLIEA

SEQ ID NO: 721528 - protein, 9 aa, Homo Sapiens
LRGRPRPEE

SEQ ID NO: 721529 - protein, 9 aa, Homo Sapiens
LSLTLRGRP

SEQ ID NO: 721530 - protein, 9 aa, Homo Sapiens
DLGGSYSGA

SEQ ID NO: 721531 - protein, 9 aa, Homo Sapiens
TSIKPLVLS

SEQ ID NO: 721532 - protein, 9 aa, Homo Sapiens
RKPSLLAHT

SEQ ID NO: 721533 - protein, 9 aa, Homo Sapiens
LKDRLEDLK

SEQ ID NO: 721534 - protein, 9 aa, Homo Sapiens
NRQGTSVPA

SEQ ID NO: 721535 - protein, 9 aa, Homo Sapiens
LTCIVHCIR

SEQ ID NO: 721536 - protein, 9 aa, Homo Sapiens
QRWHQGSWY

SEQ ID NO: 721537 - protein, 9 aa, Homo Sapiens
PLFCQQLWR

SEQ ID NO: 721538 - protein, 9 aa, Homo Sapiens
VAICNTLRY

SEQ ID NO: 721539 - protein, 9 aa, Homo Sapiens
YKYEVCKDL

SEQ ID NO: 721540 - protein, 9 aa, Homo Sapiens
LLKNEQMFI

SEQ ID NO: 721541 - protein, 9 aa, Homo Sapiens
LKQSANGNK

SEQ ID NO: 721542 - protein, 9 aa, Homo Sapiens
PLDHEELVL

SEQ ID NO: 721543 - protein, 9 aa, Homo Sapiens
PLTSFGEES

SEQ ID NO: 721544 - protein, 9 aa, Homo Sapiens
VHTGERPCK

SEQ ID NO: 721545 - protein, 9 aa, Homo Sapiens
LTPLWPGST

SEQ ID NO: 721546 - protein, 9 aa, Homo Sapiens
QHQTVHTGS

SEQ ID NO: 721547 - protein, 9 aa, Homo Sapiens
NSVTQWAAL

SEQ ID NO: 721548 - protein, 9 aa, Homo Sapiens
AISSESGAS

SEQ ID NO: 721549 - protein, 9 aa, Homo Sapiens
PGLPGDHAD

SEQ ID NO: 721550 - protein, 9 aa, Homo Sapiens
SQTTTNLVA

SEQ ID NO: 721551 - protein, 9 aa, Homo Sapiens
STEFYQQLN

SEQ ID NO: 721552 - protein, 9 aa, Homo Sapiens
FSWAHNGRT

SEQ ID NO: 721553 - protein, 9 aa, Homo Sapiens
LCDTYPAVL

SEQ ID NO: 721554 - protein, 9 aa, Homo Sapiens
LGEGTMLEI

SEQ ID NO: 721555 - protein, 9 aa, Homo Sapiens
GQPANIRQQ

SEQ ID NO: 721556 - protein, 9 aa, Homo Sapiens
KFSTEFYQQ

SEQ ID NO: 721557 - protein, 9 aa, Homo Sapiens
APYAAAPGP

SEQ ID NO: 721558 - protein, 9 aa, Homo Sapiens
GTAIVESHD

SEQ ID NO: 721559 - protein, 9 aa, Homo Sapiens
WSSDLLPQE

SEQ ID NO: 721560 - protein, 9 aa, Homo Sapiens
SPRPPRPLQ

SEQ ID NO: 721561 - protein, 9 aa, Homo Sapiens
LLGGTALLL

SEQ ID NO: 721562 - protein, 9 aa, Homo Sapiens
PCCPRPRPS

SEQ ID NO: 721563 - protein, 9 aa, Homo Sapiens
REKKEKEKK

SEQ ID NO: 721564 - protein, 9 aa, Homo Sapiens
VEKQENETF

SEQ ID NO: 721565 - protein, 9 aa, Homo Sapiens
MEVEEEPEQ

SEQ ID NO: 721566 - protein, 9 aa, Homo Sapiens
MTWTSPSCQ

SEQ ID NO: 721567 - protein, 9 aa, Homo Sapiens
LVVLILSVC

SEQ ID NO: 721568 - protein, 9 aa, Homo Sapiens
SWTTWVYSI

SEQ ID NO: 721569 - protein, 9 aa, Homo Sapiens
IGQLISLDL

SEQ ID NO: 721570 - protein, 9 aa, Homo Sapiens
PFKLVCTFK

SEQ ID NO: 721571 - protein, 9 aa, Homo Sapiens
LGLSDVHEL

SEQ ID NO: 721572 - protein, 9 aa, Homo Sapiens
IHCVLGPQH

SEQ ID NO: 721573 - protein, 9 aa, Homo Sapiens
TNLELLDLS

SEQ ID NO: 721574 - protein, 9 aa, Homo Sapiens
PELYSKRFL

SEQ ID NO: 721575 - protein, 9 aa, Homo Sapiens
PQLGVGGGR

SEQ ID NO: 721576 - protein, 9 aa, Homo Sapiens
SILYTVPDT

SEQ ID NO: 721577 - protein, 9 aa, Homo Sapiens
RLEDLKKVS

SEQ ID NO: 721578 - protein, 9 aa, Homo Sapiens
EESQIDVLQ

SEQ ID NO: 721579 - protein, 9 aa, Homo Sapiens
EMLFPSWTT

SEQ ID NO: 721580 - protein, 9 aa, Homo Sapiens
NNFFCDPGQ

SEQ ID NO: 721581 - protein, 9 aa, Homo Sapiens
FWNKNKPQE

SEQ ID NO: 721582 - protein, 9 aa, Homo Sapiens
ITLCALLSS

SEQ ID NO: 721583 - protein, 9 aa, Homo Sapiens
MKLACTNTY

SEQ ID NO: 721584 - protein, 9 aa, Homo Sapiens
AGGTGPEGF

SEQ ID NO: 721585 - protein, 9 aa, Homo Sapiens
IAVHADVFT

SEQ ID NO: 721586 - protein, 9 aa, Homo Sapiens
KTYFEEEEE

SEQ ID NO: 721587 - protein, 9 aa, Homo Sapiens
GQHKYDVTP

SEQ ID NO: 721588 - protein, 9 aa, Homo Sapiens
KNGNFCWYL

SEQ ID NO: 721589 - protein, 9 aa, Homo Sapiens
SHLDMERMQ

SEQ ID NO: 721590 - protein, 9 aa, Homo Sapiens
ILVEEGSER

SEQ ID NO: 721591 - protein, 9 aa, Homo Sapiens
NVENPWSLV

SEQ ID NO: 721592 - protein, 9 aa, Homo Sapiens
PPGAPLGLR

SEQ ID NO: 721593 - protein, 9 aa, Homo Sapiens
SASNPYCQL

SEQ ID NO: 721594 - protein, 9 aa, Homo Sapiens
LKGVEKVFG

SEQ ID NO: 721595 - protein, 9 aa, Homo Sapiens
LSCCICLEP

SEQ ID NO: 721596 - protein, 9 aa, Homo Sapiens
IEGKLVDRK

SEQ ID NO: 721597 - protein, 9 aa, Homo Sapiens
GATGKLDSA

SEQ ID NO: 721598 - protein, 9 aa, Homo Sapiens
SLPRVVVGT

SEQ ID NO: 721599 - protein, 9 aa, Homo Sapiens
CIYLIEKPM

SEQ ID NO: 721600 - protein, 9 aa, Homo Sapiens
KQHLLNVEN

SEQ ID NO: 721601 - protein, 9 aa, Homo Sapiens
YALKTVLLA

SEQ ID NO: 721602 - protein, 9 aa, Homo Sapiens
GFVTDKMLC

SEQ ID NO: 721603 - protein, 9 aa, Homo Sapiens
TPLAYRAFS

SEQ ID NO: 721604 - protein, 9 aa, Homo Sapiens
VSPHHPSLV

SEQ ID NO: 721605 - protein, 9 aa, Homo Sapiens
CKELDACSF

SEQ ID NO: 721606 - protein, 9 aa, Homo Sapiens
GTQGAWVRG

SEQ ID NO: 721607 - protein, 9 aa, Homo Sapiens
SLIQENLPE

SEQ ID NO: 721608 - protein, 9 aa, Homo Sapiens
VLTIMNGCD

SEQ ID NO: 721609 - protein, 9 aa, Homo Sapiens
QKALQLAVG

SEQ ID NO: 721610 - protein, 9 aa, Homo Sapiens
TSNRLRSRT

SEQ ID NO: 721611 - protein, 9 aa, Homo Sapiens
GSIQEPPLQ

SEQ ID NO: 721612 - protein, 9 aa, Homo Sapiens
SGIGTEGAK

SEQ ID NO: 721613 - protein, 9 aa, Homo Sapiens
YPAVLVVPY

SEQ ID NO: 721614 - protein, 9 aa, Homo Sapiens
QGNPNEEVS

SEQ ID NO: 721615 - protein, 9 aa, Homo Sapiens
DAPGPPGPQ

SEQ ID NO: 721616 - protein, 9 aa, Homo Sapiens
LQLFFVQHV

SEQ ID NO: 721617 - protein, 9 aa, Homo Sapiens
HITFRRWKS

SEQ ID NO: 721618 - protein, 9 aa, Homo Sapiens
GYLTSGTEP

SEQ ID NO: 721619 - protein, 9 aa, Homo Sapiens
SGSDSWNNN

SEQ ID NO: 721620 - protein, 9 aa, Homo Sapiens
WPRPAPCCP

SEQ ID NO: 721621 - protein, 9 aa, Homo Sapiens
PIAFPQTPA

SEQ ID NO: 721622 - protein, 9 aa, Homo Sapiens
ALKTVLLAV

SEQ ID NO: 721623 - protein, 9 aa, Homo Sapiens
CPRPRPSQP

SEQ ID NO: 721624 - protein, 9 aa, Homo Sapiens
NFVSFFQVM

SEQ ID NO: 721625 - protein, 9 aa, Homo Sapiens
RDGWSTLHI

SEQ ID NO: 721626 - protein, 9 aa, Homo Sapiens
SQSRMVART

SEQ ID NO: 721627 - protein, 9 aa, Homo Sapiens
VTQSPRDGS

SEQ ID NO: 721628 - protein, 9 aa, Homo Sapiens
NVRKGDVLT

SEQ ID NO: 721629 - protein, 9 aa, Homo Sapiens
LVGNQEGGV

SEQ ID NO: 721630 - protein, 9 aa, Homo Sapiens
RLVVEDHLF

SEQ ID NO: 721631 - protein, 9 aa, Homo Sapiens
LSAPPRPPA

SEQ ID NO: 721632 - protein, 9 aa, Homo Sapiens
DESNQTFTA

SEQ ID NO: 721633 - protein, 9 aa, Homo Sapiens
TYPAVLVVP

SEQ ID NO: 721634 - protein, 9 aa, Homo Sapiens
WPLLRKQVE

SEQ ID NO: 721635 - protein, 9 aa, Homo Sapiens
IPVAHISVN

SEQ ID NO: 721636 - protein, 9 aa, Homo Sapiens
SPSSSYAGK

SEQ ID NO: 721637 - protein, 9 aa, Homo Sapiens
RGTWPQQAL

SEQ ID NO: 721638 - protein, 9 aa, Homo Sapiens
RGEIDFVIS

SEQ ID NO: 721639 - protein, 9 aa, Homo Sapiens
FLLQVCSRS

SEQ ID NO: 721640 - protein, 9 aa, Homo Sapiens
IWAIVTSVD

SEQ ID NO: 721641 - protein, 9 aa, Homo Sapiens
PPGGDTTSR

SEQ ID NO: 721642 - protein, 9 aa, Homo Sapiens
HTSKKHWDG

SEQ ID NO: 721643 - protein, 9 aa, Homo Sapiens
TITAVNLSV

SEQ ID NO: 721644 - protein, 9 aa, Homo Sapiens
KLLLSRVKP

SEQ ID NO: 721645 - protein, 9 aa, Homo Sapiens
VVILNDLGQ

SEQ ID NO: 721646 - protein, 9 aa, Homo Sapiens
RRWKSCTAI

SEQ ID NO: 721647 - protein, 9 aa, Homo Sapiens
VGDSISIEC

SEQ ID NO: 721648 - protein, 9 aa, Homo Sapiens
TVLPKSIET

SEQ ID NO: 721649 - protein, 9 aa, Homo Sapiens
LIELLDSSI

SEQ ID NO: 721650 - protein, 9 aa, Homo Sapiens
HANPLEPLP

SEQ ID NO: 721651 - protein, 9 aa, Homo Sapiens
LAELEGAMQ

SEQ ID NO: 721652 - protein, 9 aa, Homo Sapiens
QHHICLKES

SEQ ID NO: 721653 - protein, 9 aa, Homo Sapiens
SANGNKFER

SEQ ID NO: 721654 - protein, 9 aa, Homo Sapiens
LRCPEALFQ

SEQ ID NO: 721655 - protein, 9 aa, Homo Sapiens
NPVDCHAYP

SEQ ID NO: 721656 - protein, 9 aa, Homo Sapiens
LNILRKERG

SEQ ID NO: 721657 - protein, 9 aa, Homo Sapiens
LHFRIHTGE

SEQ ID NO: 721658 - protein, 9 aa, Homo Sapiens
QSRNRQGTS

SEQ ID NO: 721659 - protein, 9 aa, Homo Sapiens
DMALLEDLD

SEQ ID NO: 721660 - protein, 9 aa, Homo Sapiens
SNIRHSFWK

SEQ ID NO: 721661 - protein, 9 aa, Homo Sapiens
EVYNTSIKP

SEQ ID NO: 721662 - protein, 9 aa, Homo Sapiens
CVFYTLPAK

SEQ ID NO: 721663 - protein, 9 aa, Homo Sapiens
GSSEEYRCN

SEQ ID NO: 721664 - protein, 9 aa, Homo Sapiens
KGLSQTTTN

SEQ ID NO: 721665 - protein, 9 aa, Homo Sapiens
TREKPYECH

SEQ ID NO: 721666 - protein, 9 aa, Homo Sapiens
ADICKKCKI

SEQ ID NO: 721667 - protein, 9 aa, Homo Sapiens
KRKRLSDSA

SEQ ID NO: 721668 - protein, 9 aa, Homo Sapiens
CCHCFPCCM

SEQ ID NO: 721669 - protein, 9 aa, Homo Sapiens
SDLFTVQAL

SEQ ID NO: 721670 - protein, 9 aa, Homo Sapiens
LYHREGFQR

SEQ ID NO: 721671 - protein, 9 aa, Homo Sapiens
LTHRLFSAA

SEQ ID NO: 721672 - protein, 9 aa, Homo Sapiens
YSYRTQIDY

SEQ ID NO: 721673 - protein, 9 aa, Homo Sapiens
SIWAIVTSV

SEQ ID NO: 721674 - protein, 9 aa, Homo Sapiens
DVHELRVCL

SEQ ID NO: 721675 - protein, 9 aa, Homo Sapiens
SSASRPGAS

SEQ ID NO: 721676 - protein, 9 aa, Homo Sapiens
LKEEQKDKL

SEQ ID NO: 721677 - protein, 9 aa, Homo Sapiens
FLEKALKLY

SEQ ID NO: 721678 - protein, 9 aa, Homo Sapiens
GTMLKGEYT

SEQ ID NO: 721679 - protein, 9 aa, Homo Sapiens
VNYLLTNPL

SEQ ID NO: 721680 - protein, 9 aa, Homo Sapiens
IAKMNHSPW

SEQ ID NO: 721681 - protein, 9 aa, Homo Sapiens
QIIALCHSP

SEQ ID NO: 721682 - protein, 9 aa, Homo Sapiens
AQMEVTVTV

SEQ ID NO: 721683 - protein, 9 aa, Homo Sapiens
LCKFHRTSV

SEQ ID NO: 721684 - protein, 9 aa, Homo Sapiens
EAMHGVFFY

SEQ ID NO: 721685 - protein, 9 aa, Homo Sapiens
CKSANKYEE

SEQ ID NO: 721686 - protein, 9 aa, Homo Sapiens
PEVQHGKPY

SEQ ID NO: 721687 - protein, 9 aa, Homo Sapiens
MEIQTTQPE

SEQ ID NO: 721688 - protein, 9 aa, Homo Sapiens
RQCLVQGNA

SEQ ID NO: 721689 - protein, 9 aa, Homo Sapiens
MALLEDLDL

SEQ ID NO: 721690 - protein, 9 aa, Homo Sapiens
EAGPGLCRI

SEQ ID NO: 721691 - protein, 9 aa, Homo Sapiens
CCGLCKYCT

SEQ ID NO: 721692 - protein, 9 aa, Homo Sapiens
GKYCKELDA

SEQ ID NO: 721693 - protein, 9 aa, Homo Sapiens
WCENLGIWK

SEQ ID NO: 721694 - protein, 9 aa, Homo Sapiens
QSLQVQPET

SEQ ID NO: 721695 - protein, 9 aa, Homo Sapiens
EKIDFLLQV

SEQ ID NO: 721696 - protein, 9 aa, Homo Sapiens
LQVQPETLS

SEQ ID NO: 721697 - protein, 9 aa, Homo Sapiens
VILWESIDR

SEQ ID NO: 721698 - protein, 9 aa, Homo Sapiens
TIQILFTVC

SEQ ID NO: 721699 - protein, 9 aa, Homo Sapiens
PPRPPACTT

SEQ ID NO: 721700 - protein, 9 aa, Homo Sapiens
PSPSGVPLE

SEQ ID NO: 721701 - protein, 9 aa, Homo Sapiens
SEFWNKNKP

SEQ ID NO: 721702 - protein, 9 aa, Homo Sapiens
TQLFYCHKL

SEQ ID NO: 721703 - protein, 9 aa, Homo Sapiens
YATSCFSIN

SEQ ID NO: 721704 - protein, 9 aa, Homo Sapiens
CYALPTEGA

SEQ ID NO: 721705 - protein, 9 aa, Homo Sapiens
FENEYSYRT

SEQ ID NO: 721706 - protein, 9 aa, Homo Sapiens
GHCHILLGT

SEQ ID NO: 721707 - protein, 9 aa, Homo Sapiens
DSVIHALAE

SEQ ID NO: 721708 - protein, 9 aa, Homo Sapiens
KMGYGAWYH

SEQ ID NO: 721709 - protein, 9 aa, Homo Sapiens
ACPDCGRAL

SEQ ID NO: 721710 - protein, 9 aa, Homo Sapiens
YLLREQYEE

SEQ ID NO: 721711 - protein, 9 aa, Homo Sapiens
LSDVHELRV

SEQ ID NO: 721712 - protein, 9 aa, Homo Sapiens
KLVCTFKNY

SEQ ID NO: 721713 - protein, 9 aa, Homo Sapiens
VQQRDVYYR

SEQ ID NO: 721714 - protein, 9 aa, Homo Sapiens
VFKTKTYFS

SEQ ID NO: 721715 - protein, 9 aa, Homo Sapiens
LQELWLEGN

SEQ ID NO: 721716 - protein, 9 aa, Homo Sapiens
TDLCHLPQT

SEQ ID NO: 721717 - protein, 9 aa, Homo Sapiens
SGSHSCSPI

SEQ ID NO: 721718 - protein, 9 aa, Homo Sapiens
KMKLQTRQW

SEQ ID NO: 721719 - protein, 9 aa, Homo Sapiens
PKDEKLRHY

SEQ ID NO: 721720 - protein, 9 aa, Homo Sapiens
ALSAPAPQL

SEQ ID NO: 721721 - protein, 9 aa, Homo Sapiens
HYIPKNVRK

SEQ ID NO: 721722 - protein, 9 aa, Homo Sapiens
SNQTFTART

SEQ ID NO: 721723 - protein, 9 aa, Homo Sapiens
TGPPSESSS

SEQ ID NO: 721724 - protein, 9 aa, Homo Sapiens
EQLMQLCQR

SEQ ID NO: 721725 - protein, 9 aa, Homo Sapiens
VLLQFQVSA

SEQ ID NO: 721726 - protein, 9 aa, Homo Sapiens
QECKLQGWQ

SEQ ID NO: 721727 - protein, 9 aa, Homo Sapiens
TAALCAVHL

SEQ ID NO: 721728 - protein, 9 aa, Homo Sapiens
EGSIQEPPL

SEQ ID NO: 721729 - protein, 9 aa, Homo Sapiens
LFRQVRCFS

SEQ ID NO: 721730 - protein, 9 aa, Homo Sapiens
DLELARGKR

SEQ ID NO: 721731 - protein, 9 aa, Homo Sapiens
CAFDHEQLR

SEQ ID NO: 721732 - protein, 9 aa, Homo Sapiens
LNSMNPTML

SEQ ID NO: 721733 - protein, 9 aa, Homo Sapiens
QLISILDRD

SEQ ID NO: 721734 - protein, 9 aa, Homo Sapiens
GSWYFGRTW

SEQ ID NO: 721735 - protein, 9 aa, Homo Sapiens
FCWYLLSNL

SEQ ID NO: 721736 - protein, 9 aa, Homo Sapiens
KRLGSHSFD

SEQ ID NO: 721737 - protein, 9 aa, Homo Sapiens
ESGFHIELK

SEQ ID NO: 721738 - protein, 9 aa, Homo Sapiens
VSAPGRGAA

SEQ ID NO: 721739 - protein, 9 aa, Homo Sapiens
CVIKKDAKA

SEQ ID NO: 721740 - protein, 9 aa, Homo Sapiens
DPIDYKCGS

SEQ ID NO: 721741 - protein, 9 aa, Homo Sapiens
QCLRNLLMP

SEQ ID NO: 721742 - protein, 9 aa, Homo Sapiens
DEVFHFHKA

SEQ ID NO: 721743 - protein, 9 aa, Homo Sapiens
DVVKDGQMM

SEQ ID NO: 721744 - protein, 9 aa, Homo Sapiens
GFLSMSRRR

SEQ ID NO: 721745 - protein, 9 aa, Homo Sapiens
RTYYANPAL

SEQ ID NO: 721746 - protein, 9 aa, Homo Sapiens
LLQLPQILQ

SEQ ID NO: 721747 - protein, 9 aa, Homo Sapiens
SIMENPAPN

SEQ ID NO: 721748 - protein, 9 aa, Homo Sapiens
DSADIETYL

SEQ ID NO: 721749 - protein, 9 aa, Homo Sapiens
EYYCNPTFL

SEQ ID NO: 721750 - protein, 9 aa, Homo Sapiens
TFKKLVEAL

SEQ ID NO: 721751 - protein, 9 aa, Homo Sapiens
LAIQIKYND

SEQ ID NO: 721752 - protein, 9 aa, Homo Sapiens
VHFQENEDT

SEQ ID NO: 721753 - protein, 9 aa, Homo Sapiens
DNADFWGPL

SEQ ID NO: 721754 - protein, 9 aa, Homo Sapiens
RGISHATSS

SEQ ID NO: 721755 - protein, 9 aa, Homo Sapiens
RGDQCCFQN

SEQ ID NO: 721756 - protein, 9 aa, Homo Sapiens
AKLPPQERI

SEQ ID NO: 721757 - protein, 9 aa, Homo Sapiens
RDGSGLMLE

SEQ ID NO: 721758 - protein, 9 aa, Homo Sapiens
KPFTCEEYG

SEQ ID NO: 721759 - protein, 9 aa, Homo Sapiens
VELIELLDS

SEQ ID NO: 721760 - protein, 9 aa, Homo Sapiens
AGGSSSIPP

SEQ ID NO: 721761 - protein, 9 aa, Homo Sapiens
NCKVAKVFH

SEQ ID NO: 721762 - protein, 9 aa, Homo Sapiens
FQLPSSTVS

SEQ ID NO: 721763 - protein, 9 aa, Homo Sapiens
RQAISLILV

SEQ ID NO: 721764 - protein, 9 aa, Homo Sapiens
RTQYAIKCA

SEQ ID NO: 721765 - protein, 9 aa, Homo Sapiens
ASGDLLEPD

SEQ ID NO: 721766 - protein, 9 aa, Homo Sapiens
IGWAPAPVQ

SEQ ID NO: 721767 - protein, 9 aa, Homo Sapiens
DFDNVTVST

SEQ ID NO: 721768 - protein, 9 aa, Homo Sapiens
AAQRIGFPL

SEQ ID NO: 721769 - protein, 9 aa, Homo Sapiens
QLRKCCKSV

SEQ ID NO: 721770 - protein, 9 aa, Homo Sapiens
QISVPSYSG

SEQ ID NO: 721771 - protein, 9 aa, Homo Sapiens
NQSLMGMNM

SEQ ID NO: 721772 - protein, 9 aa, Homo Sapiens
MGAVGQSCE

SEQ ID NO: 721773 - protein, 9 aa, Homo Sapiens
RMSSIRFEN

SEQ ID NO: 721774 - protein, 9 aa, Homo Sapiens
HQTVHTGSK

SEQ ID NO: 721775 - protein, 9 aa, Homo Sapiens
NRNTGNYTA

SEQ ID NO: 721776 - protein, 9 aa, Homo Sapiens
VGQHKYDVT

SEQ ID NO: 721777 - protein, 9 aa, Homo Sapiens
RPRPSQPCS

SEQ ID NO: 721778 - protein, 9 aa, Homo Sapiens
PLRYTYVLT

SEQ ID NO: 721779 - protein, 9 aa, Homo Sapiens
EPATDGPAA

SEQ ID NO: 721780 - protein, 9 aa, Homo Sapiens
TKMKLQTRQ

SEQ ID NO: 721781 - protein, 9 aa, Homo Sapiens
GAADPPASA

SEQ ID NO: 721782 - protein, 9 aa, Homo Sapiens
HLAMPWAPL

SEQ ID NO: 721783 - protein, 9 aa, Homo Sapiens
LLLSLYRGF

SEQ ID NO: 721784 - protein, 9 aa, Homo Sapiens
RHSFWKGRQ

SEQ ID NO: 721785 - protein, 9 aa, Homo Sapiens
LLFTKDNSR

SEQ ID NO: 721786 - protein, 9 aa, Homo Sapiens
MDASELLAE

SEQ ID NO: 721787 - protein, 9 aa, Homo Sapiens
MLLLACTGT

SEQ ID NO: 721788 - protein, 9 aa, Homo Sapiens
HGAHHAAGQ

SEQ ID NO: 721789 - protein, 9 aa, Homo Sapiens
TFQLPEDYS

SEQ ID NO: 721790 - protein, 9 aa, Homo Sapiens
LGTAIVESH

SEQ ID NO: 721791 - protein, 9 aa, Homo Sapiens
YSNIRHSFW

SEQ ID NO: 721792 - protein, 9 aa, Homo Sapiens
YVAICNTLR

SEQ ID NO: 721793 - protein, 9 aa, Homo Sapiens
VPCNRLYPE

SEQ ID NO: 721794 - protein, 9 aa, Homo Sapiens
SQAQAVLQQ

SEQ ID NO: 721795 - protein, 9 aa, Homo Sapiens
TYYANPALV

SEQ ID NO: 721796 - protein, 9 aa, Homo Sapiens
TASLPNFWN

SEQ ID NO: 721797 - protein, 9 aa, Homo Sapiens
RCRLVLQEC

SEQ ID NO: 721798 - protein, 9 aa, Homo Sapiens
GYNAYPSYP

SEQ ID NO: 721799 - protein, 9 aa, Homo Sapiens
LAYRAFSTF

SEQ ID NO: 721800 - protein, 9 aa, Homo Sapiens
REKPYECHE

SEQ ID NO: 721801 - protein, 9 aa, Homo Sapiens
LLSDLEGSI

SEQ ID NO: 721802 - protein, 9 aa, Homo Sapiens
PSLELVASL

SEQ ID NO: 721803 - protein, 9 aa, Homo Sapiens
PFSVEKVLP

SEQ ID NO: 721804 - protein, 9 aa, Homo Sapiens
PGAMESGRM

SEQ ID NO: 721805 - protein, 9 aa, Homo Sapiens
GKPYPDIFL

SEQ ID NO: 721806 - protein, 9 aa, Homo Sapiens
RVQQLVTIK

SEQ ID NO: 721807 - protein, 9 aa, Homo Sapiens
VQHGKPYPD

SEQ ID NO: 721808 - protein, 9 aa, Homo Sapiens
FNFKELFEN

SEQ ID NO: 721809 - protein, 9 aa, Homo Sapiens
LPKDEKLRH

SEQ ID NO: 721810 - protein, 9 aa, Homo Sapiens
AEGQQRNTR

SEQ ID NO: 721811 - protein, 9 aa, Homo Sapiens
PFTCEEYGK

SEQ ID NO: 721812 - protein, 9 aa, Homo Sapiens
ECKVQKECY

SEQ ID NO: 721813 - protein, 9 aa, Homo Sapiens
ASLPNSGDL

SEQ ID NO: 721814 - protein, 9 aa, Homo Sapiens
PPSSCEAFS

SEQ ID NO: 721815 - protein, 9 aa, Homo Sapiens
DSSSSVRPF

SEQ ID NO: 721816 - protein, 9 aa, Homo Sapiens
EAMVVRAMK

SEQ ID NO: 721817 - protein, 9 aa, Homo Sapiens
TAEQPVFAA

SEQ ID NO: 721818 - protein, 9 aa, Homo Sapiens
ALVRPHAQI

SEQ ID NO: 721819 - protein, 9 aa, Homo Sapiens
ESEFWNKNK

SEQ ID NO: 721820 - protein, 9 aa, Homo Sapiens
HLPGKSPAR

SEQ ID NO: 721821 - protein, 9 aa, Homo Sapiens
DLASRQELM

SEQ ID NO: 721822 - protein, 9 aa, Homo Sapiens
SLGWCQKRL

SEQ ID NO: 721823 - protein, 9 aa, Homo Sapiens
TSILDAAGR

SEQ ID NO: 721824 - protein, 9 aa, Homo Sapiens
EIGQQWFGN

SEQ ID NO: 721825 - protein, 9 aa, Homo Sapiens
FSQLFLYLG

SEQ ID NO: 721826 - protein, 9 aa, Homo Sapiens
LPGCDPNHV

SEQ ID NO: 721827 - protein, 9 aa, Homo Sapiens
LNQNQLVRK

SEQ ID NO: 721828 - protein, 9 aa, Homo Sapiens
KVVKIMIIV

SEQ ID NO: 721829 - protein, 9 aa, Homo Sapiens
LIQEITVTW

SEQ ID NO: 721830 - protein, 9 aa, Homo Sapiens
PYCQLPHLF

SEQ ID NO: 721831 - protein, 9 aa, Homo Sapiens
ETIQDGADD

SEQ ID NO: 721832 - protein, 9 aa, Homo Sapiens
RDIPNTSIM

SEQ ID NO: 721833 - protein, 9 aa, Homo Sapiens
GIYANLGIG

SEQ ID NO: 721834 - protein, 9 aa, Homo Sapiens
TNIQDAIQA

SEQ ID NO: 721835 - protein, 9 aa, Homo Sapiens
FCFDLSIIS

SEQ ID NO: 721836 - protein, 9 aa, Homo Sapiens
GLSDEKYSV

SEQ ID NO: 721837 - protein, 9 aa, Homo Sapiens
LLLTASLPN

SEQ ID NO: 721838 - protein, 9 aa, Homo Sapiens
LSYAWSPPV

SEQ ID NO: 721839 - protein, 9 aa, Homo Sapiens
EFGSHLDME

SEQ ID NO: 721840 - protein, 9 aa, Homo Sapiens
FRYENVEFG

SEQ ID NO: 721841 - protein, 9 aa, Homo Sapiens
HMTCANCNH

SEQ ID NO: 721842 - protein, 9 aa, Homo Sapiens
VFAQCAFDH

SEQ ID NO: 721843 - protein, 9 aa, Homo Sapiens
VSTLELGDW

SEQ ID NO: 721844 - protein, 9 aa, Homo Sapiens
STNETQVVR

SEQ ID NO: 721845 - protein, 9 aa, Homo Sapiens
EFNEGGSIK

SEQ ID NO: 721846 - protein, 9 aa, Homo Sapiens
FSILPKSYP

SEQ ID NO: 721847 - protein, 9 aa, Homo Sapiens
RVAWLNLST

SEQ ID NO: 721848 - protein, 9 aa, Homo Sapiens
LRNGSRHPR

SEQ ID NO: 721849 - protein, 9 aa, Homo Sapiens
GVDSLDLCH

SEQ ID NO: 721850 - protein, 9 aa, Homo Sapiens
DEWKEGVAK

SEQ ID NO: 721851 - protein, 9 aa, Homo Sapiens
GAKGLLGDP

SEQ ID NO: 721852 - protein, 9 aa, Homo Sapiens
ASRFGLPSV

SEQ ID NO: 721853 - protein, 9 aa, Homo Sapiens
HFLSWFLEN

SEQ ID NO: 721854 - protein, 9 aa, Homo Sapiens
KVPIHNADL

SEQ ID NO: 721855 - protein, 9 aa, Homo Sapiens
GDSISIECK

SEQ ID NO: 721856 - protein, 9 aa, Homo Sapiens
AISFRRCIT

SEQ ID NO: 721857 - protein, 9 aa, Homo Sapiens
LTLVESLQD

SEQ ID NO: 721858 - protein, 9 aa, Homo Sapiens
FHSFINPRE

SEQ ID NO: 721859 - protein, 9 aa, Homo Sapiens
EPPLPSGAG

SEQ ID NO: 721860 - protein, 9 aa, Homo Sapiens
VVEVVALLG

SEQ ID NO: 721861 - protein, 9 aa, Homo Sapiens
YRSSYLYQR

SEQ ID NO: 721862 - protein, 9 aa, Homo Sapiens
GAMQKAKQD

SEQ ID NO: 721863 - protein, 9 aa, Homo Sapiens
IAGYGLEGE

SEQ ID NO: 721864 - protein, 9 aa, Homo Sapiens
LPSVGGRRR

SEQ ID NO: 721865 - protein, 9 aa, Homo Sapiens
PMMNQSLMG

SEQ ID NO: 721866 - protein, 9 aa, Homo Sapiens
SIVRPGRLL

SEQ ID NO: 721867 - protein, 9 aa, Homo Sapiens
DMASTPENI

SEQ ID NO: 721868 - protein, 9 aa, Homo Sapiens
GPFSVEKVL

SEQ ID NO: 721869 - protein, 9 aa, Homo Sapiens
FTKLNRNTG

SEQ ID NO: 721870 - protein, 9 aa, Homo Sapiens
DDWIPDMQI

SEQ ID NO: 721871 - protein, 9 aa, Homo Sapiens
QGPKGEGGR

SEQ ID NO: 721872 - protein, 9 aa, Homo Sapiens
CGLCKYCTK

SEQ ID NO: 721873 - protein, 9 aa, Homo Sapiens
ERESEFWNK

SEQ ID NO: 721874 - protein, 9 aa, Homo Sapiens
PTRWQDKFM

SEQ ID NO: 721875 - protein, 9 aa, Homo Sapiens
AEKEHCSNC

SEQ ID NO: 721876 - protein, 9 aa, Homo Sapiens
RGVDVMVGG

SEQ ID NO: 721877 - protein, 9 aa, Homo Sapiens
TGERPCKCS

SEQ ID NO: 721878 - protein, 9 aa, Homo Sapiens
LPSANYFCY

SEQ ID NO: 721879 - protein, 9 aa, Homo Sapiens
QAKPKLIPS

SEQ ID NO: 721880 - protein, 9 aa, Homo Sapiens
CKMDNEFTT

SEQ ID NO: 721881 - protein, 9 aa, Homo Sapiens
EVSNSDGYL

SEQ ID NO: 721882 - protein, 9 aa, Homo Sapiens
EVSKFYAAA

SEQ ID NO: 721883 - protein, 9 aa, Homo Sapiens
TKATPLSLT

SEQ ID NO: 721884 - protein, 9 aa, Homo Sapiens
FGSHLDMER

SEQ ID NO: 721885 - protein, 9 aa, Homo Sapiens
QAVSAPGRG

SEQ ID NO: 721886 - protein, 9 aa, Homo Sapiens
PAAPPPTPH

SEQ ID NO: 721887 - protein, 9 aa, Homo Sapiens
CSPLSAPPR

SEQ ID NO: 721888 - protein, 9 aa, Homo Sapiens
WESIDRSME

SEQ ID NO: 721889 - protein, 9 aa, Homo Sapiens
LCTSAPAPS

SEQ ID NO: 721890 - protein, 9 aa, Homo Sapiens
SNKKNAAVI

SEQ ID NO: 721891 - protein, 9 aa, Homo Sapiens
NISHKLLLS

SEQ ID NO: 721892 - protein, 9 aa, Homo Sapiens
ETTNGRLPV

SEQ ID NO: 721893 - protein, 9 aa, Homo Sapiens
LCLIEAPEH

SEQ ID NO: 721894 - protein, 9 aa, Homo Sapiens
WQSSRTSSS

SEQ ID NO: 721895 - protein, 9 aa, Homo Sapiens
QAATPQVAA

SEQ ID NO: 721896 - protein, 9 aa, Homo Sapiens
ENKGRSCTP

SEQ ID NO: 721897 - protein, 9 aa, Homo Sapiens
LVTIKKALT

SEQ ID NO: 721898 - protein, 9 aa, Homo Sapiens
KTPCTRLRW

SEQ ID NO: 721899 - protein, 9 aa, Homo Sapiens
FTRSELKCS

SEQ ID NO: 721900 - protein, 9 aa, Homo Sapiens
GTGFTSPDE

SEQ ID NO: 721901 - protein, 9 aa, Homo Sapiens
AVSAPGRGA

SEQ ID NO: 721902 - protein, 9 aa, Homo Sapiens
LAVLLYTVL

SEQ ID NO: 721903 - protein, 9 aa, Homo Sapiens
KIDTTVTMM

SEQ ID NO: 721904 - protein, 9 aa, Homo Sapiens
DPGSDLFTV

SEQ ID NO: 721905 - protein, 9 aa, Homo Sapiens
QEQLIEWIK

SEQ ID NO: 721906 - protein, 9 aa, Homo Sapiens
SMFCPGAED

SEQ ID NO: 721907 - protein, 9 aa, Homo Sapiens
LSLTVTLSM

SEQ ID NO: 721908 - protein, 9 aa, Homo Sapiens
ATALVALMG

SEQ ID NO: 721909 - protein, 9 aa, Homo Sapiens
CHSPPVTQI

SEQ ID NO: 721910 - protein, 9 aa, Homo Sapiens
KSRLVVEDH

SEQ ID NO: 721911 - protein, 9 aa, Homo Sapiens
PELCNKADV

SEQ ID NO: 721912 - protein, 9 aa, Homo Sapiens
GGYGFSILP

SEQ ID NO: 721913 - protein, 9 aa, Homo Sapiens
FLLLVAQGS

SEQ ID NO: 721914 - protein, 9 aa, Homo Sapiens
PNEISVACP

SEQ ID NO: 721915 - protein, 9 aa, Homo Sapiens
VHADVFTIS

SEQ ID NO: 721916 - protein, 9 aa, Homo Sapiens
ECGKIFRHK

SEQ ID NO: 721917 - protein, 9 aa, Homo Sapiens
NSGPTRWQD

SEQ ID NO: 721918 - protein, 9 aa, Homo Sapiens
LQMKLKACT

SEQ ID NO: 721919 - protein, 9 aa, Homo Sapiens
ANCNHGFCW

SEQ ID NO: 721920 - protein, 9 aa, Homo Sapiens
CLRMRPPRS

SEQ ID NO: 721921 - protein, 9 aa, Homo Sapiens
VSGSSHCPM

SEQ ID NO: 721922 - protein, 9 aa, Homo Sapiens
VTDKMLCAG

SEQ ID NO: 721923 - protein, 9 aa, Homo Sapiens
EFTTKIKPR

SEQ ID NO: 721924 - protein, 9 aa, Homo Sapiens
HEELVLLQF

SEQ ID NO: 721925 - protein, 9 aa, Homo Sapiens
QEGGVDGGW

SEQ ID NO: 721926 - protein, 9 aa, Homo Sapiens
LCYHSPCCS

SEQ ID NO: 721927 - protein, 9 aa, Homo Sapiens
SGFVTDKML

SEQ ID NO: 721928 - protein, 9 aa, Homo Sapiens
AECAHFRYE

SEQ ID NO: 721929 - protein, 9 aa, Homo Sapiens
HITLCALLS

SEQ ID NO: 721930 - protein, 9 aa, Homo Sapiens
TPSAQFPRK

SEQ ID NO: 721931 - protein, 9 aa, Homo Sapiens
AGAFDVCQL

SEQ ID NO: 721932 - protein, 9 aa, Homo Sapiens
PYGGGGRYE

SEQ ID NO: 721933 - protein, 9 aa, Homo Sapiens
KGLLGDPGA

SEQ ID NO: 721934 - protein, 9 aa, Homo Sapiens
NILLGVITV

SEQ ID NO: 721935 - protein, 9 aa, Homo Sapiens
QGDVQPLGP

SEQ ID NO: 721936 - protein, 9 aa, Homo Sapiens
FLAFVSVLL

SEQ ID NO: 721937 - protein, 9 aa, Homo Sapiens
TSAELYEAV

SEQ ID NO: 721938 - protein, 9 aa, Homo Sapiens
QLPQILQIL

SEQ ID NO: 721939 - protein, 9 aa, Homo Sapiens
KVFHISSFA

SEQ ID NO: 721940 - protein, 9 aa, Homo Sapiens
SQSEAMVVR

SEQ ID NO: 721941 - protein, 9 aa, Homo Sapiens
GTVVSISQS

SEQ ID NO: 721942 - protein, 9 aa, Homo Sapiens
NTLRYSIIM

SEQ ID NO: 721943 - protein, 9 aa, Homo Sapiens
LIHCVLGPQ

SEQ ID NO: 721944 - protein, 9 aa, Homo Sapiens
GLAEVDVRL

SEQ ID NO: 721945 - protein, 9 aa, Homo Sapiens
PVGGYEVFA

SEQ ID NO: 721946 - protein, 9 aa, Homo Sapiens
SMQFFIGIL

SEQ ID NO: 721947 - protein, 9 aa, Homo Sapiens
DLNGNNQSL

SEQ ID NO: 721948 - protein, 9 aa, Homo Sapiens
WPQQALRAA

SEQ ID NO: 721949 - protein, 9 aa, Homo Sapiens
SRNRQGTSV

SEQ ID NO: 721950 - protein, 9 aa, Homo Sapiens
APYSREEVR

SEQ ID NO: 721951 - protein, 9 aa, Homo Sapiens
TLSQGQVLV

SEQ ID NO: 721952 - protein, 9 aa, Homo Sapiens
QNIIAILES

SEQ ID NO: 721953 - protein, 9 aa, Homo Sapiens
NGHVFHLEN

SEQ ID NO: 721954 - protein, 9 aa, Homo Sapiens
KNLQSLGDN

SEQ ID NO: 721955 - protein, 9 aa, Homo Sapiens
FSVGQHKYD

SEQ ID NO: 721956 - protein, 9 aa, Homo Sapiens
VHGLSYAWS

SEQ ID NO: 721957 - protein, 9 aa, Homo Sapiens
KATPLSLTV

SEQ ID NO: 721958 - protein, 9 aa, Homo Sapiens
THPTSSSLP

SEQ ID NO: 721959 - protein, 9 aa, Homo Sapiens
ITVAWLIFF

SEQ ID NO: 721960 - protein, 9 aa, Homo Sapiens
LGVEASGRR

SEQ ID NO: 721961 - protein, 9 aa, Homo Sapiens
CANPENKWV

SEQ ID NO: 721962 - protein, 9 aa, Homo Sapiens
MLKKSRLVV

SEQ ID NO: 721963 - protein, 9 aa, Homo Sapiens
ASAVQSLPY

SEQ ID NO: 721964 - protein, 9 aa, Homo Sapiens
EVLSGCPEE

SEQ ID NO: 721965 - protein, 9 aa, Homo Sapiens
NCNHGFCWR

SEQ ID NO: 721966 - protein, 9 aa, Homo Sapiens
GLCKYCTKV

SEQ ID NO: 721967 - protein, 9 aa, Homo Sapiens
GVLVGNQEG

SEQ ID NO: 721968 - protein, 9 aa, Homo Sapiens
RVGQCVSFQ

SEQ ID NO: 721969 - protein, 9 aa, Homo Sapiens
PKSPIGHRG

SEQ ID NO: 721970 - protein, 9 aa, Homo Sapiens
SVHGLSYAW

SEQ ID NO: 721971 - protein, 9 aa, Homo Sapiens
YVVTMETFT

SEQ ID NO: 721972 - protein, 9 aa, Homo Sapiens
VELISEDEI

SEQ ID NO: 721973 - protein, 9 aa, Homo Sapiens
PVKEEPPLP

SEQ ID NO: 721974 - protein, 9 aa, Homo Sapiens
LQMSWLIRG

SEQ ID NO: 721975 - protein, 9 aa, Homo Sapiens
QPPPSSCEA

SEQ ID NO: 721976 - protein, 9 aa, Homo Sapiens
VEYYCNPTF

SEQ ID NO: 721977 - protein, 9 aa, Homo Sapiens
LVTVEKQEN

SEQ ID NO: 721978 - protein, 9 aa, Homo Sapiens
SSWTVRKTL

SEQ ID NO: 721979 - protein, 9 aa, Homo Sapiens
MPWETLLAK

SEQ ID NO: 721980 - protein, 9 aa, Homo Sapiens
LWCQERSLI

SEQ ID NO: 721981 - protein, 9 aa, Homo Sapiens
GQQRNTRLG

SEQ ID NO: 721982 - protein, 9 aa, Homo Sapiens
CLYINWQDT

SEQ ID NO: 721983 - protein, 9 aa, Homo Sapiens
FKKLVEALD

SEQ ID NO: 721984 - protein, 9 aa, Homo Sapiens
PSSCEAFST

SEQ ID NO: 721985 - protein, 9 aa, Homo Sapiens
IMVLNILRK

SEQ ID NO: 721986 - protein, 9 aa, Homo Sapiens
LLAVMAYDL

SEQ ID NO: 721987 - protein, 9 aa, Homo Sapiens
TVNYLLTNP

SEQ ID NO: 721988 - protein, 9 aa, Homo Sapiens
HSSPVAAMF

SEQ ID NO: 721989 - protein, 9 aa, Homo Sapiens
LLERLGVGG

SEQ ID NO: 721990 - protein, 9 aa, Homo Sapiens
ANPALVRPH

SEQ ID NO: 721991 - protein, 9 aa, Homo Sapiens
LQSSRHDCY

SEQ ID NO: 721992 - protein, 9 aa, Homo Sapiens
VCATVFLEF

SEQ ID NO: 721993 - protein, 9 aa, Homo Sapiens
SNSYDKTTQ

SEQ ID NO: 721994 - protein, 9 aa, Homo Sapiens
NLEPRYTYR

SEQ ID NO: 721995 - protein, 9 aa, Homo Sapiens
FCPGAEDGS

SEQ ID NO: 721996 - protein, 9 aa, Homo Sapiens
GCDLKFHIY

SEQ ID NO: 721997 - protein, 9 aa, Homo Sapiens
FKVLLSICS

SEQ ID NO: 721998 - protein, 9 aa, Homo Sapiens
NTCGAKNLQ

SEQ ID NO: 721999 - protein, 9 aa, Homo Sapiens
GPAPVGSCL

SEQ ID NO: 722000 - protein, 9 aa, Homo Sapiens
RVNMSNQVQ

SEQ ID NO: 722001 - protein, 9 aa, Homo Sapiens
VAKQTFIKD

SEQ ID NO: 722002 - protein, 9 aa, Homo Sapiens
STPQPPPSS

SEQ ID NO: 722003 - protein, 9 aa, Homo Sapiens
MQMQMQCGD

SEQ ID NO: 722004 - protein, 9 aa, Homo Sapiens
GRSCTPSPK

SEQ ID NO: 722005 - protein, 9 aa, Homo Sapiens
NLDSNSYDK

SEQ ID NO: 722006 - protein, 9 aa, Homo Sapiens
QDNCCGING

SEQ ID NO: 722007 - protein, 9 aa, Homo Sapiens
IELLDSSIL

SEQ ID NO: 722008 - protein, 9 aa, Homo Sapiens
LCKGLSQTT

SEQ ID NO: 722009 - protein, 9 aa, Homo Sapiens
TFAWEQGCK

SEQ ID NO: 722010 - protein, 9 aa, Homo Sapiens
EIIVILWES

SEQ ID NO: 722011 - protein, 9 aa, Homo Sapiens
RALDAKLSM

SEQ ID NO: 722012 - protein, 9 aa, Homo Sapiens
LRSTEIATV

SEQ ID NO: 722013 - protein, 9 aa, Homo Sapiens
LMQKITTLA

SEQ ID NO: 722014 - protein, 9 aa, Homo Sapiens
QSEAMVVRA

SEQ ID NO: 722015 - protein, 9 aa, Homo Sapiens
SNSVTQWAA

SEQ ID NO: 722016 - protein, 9 aa, Homo Sapiens
LAAVVEVVA

SEQ ID NO: 722017 - protein, 9 aa, Homo Sapiens
LLLCGATGV

SEQ ID NO: 722018 - protein, 9 aa, Homo Sapiens
TNTTSAELY

SEQ ID NO: 722019 - protein, 9 aa, Homo Sapiens
IYLLFTKDN

SEQ ID NO: 722020 - protein, 9 aa, Homo Sapiens
SNISHKLLL

SEQ ID NO: 722021 - protein, 9 aa, Homo Sapiens
PLTPLWPGS

SEQ ID NO: 722022 - protein, 9 aa, Homo Sapiens
GGRGTMLKG

SEQ ID NO: 722023 - protein, 9 aa, Homo Sapiens
YKFLRYFFY

SEQ ID NO: 722024 - protein, 9 aa, Homo Sapiens
HFHKAAEDL

SEQ ID NO: 722025 - protein, 9 aa, Homo Sapiens
IKELFSKDT

SEQ ID NO: 722026 - protein, 9 aa, Homo Sapiens
GPEGFRPFA

SEQ ID NO: 722027 - protein, 9 aa, Homo Sapiens
PVIHFLSWF

SEQ ID NO: 722028 - protein, 9 aa, Homo Sapiens
QTRPKPGEL

SEQ ID NO: 722029 - protein, 9 aa, Homo Sapiens
DSKMDTTLE

SEQ ID NO: 722030 - protein, 9 aa, Homo Sapiens
WCQERSLIP

SEQ ID NO: 722031 - protein, 9 aa, Homo Sapiens
ENEDIGKHP

SEQ ID NO: 722032 - protein, 9 aa, Homo Sapiens
QCAFDHEQL

SEQ ID NO: 722033 - protein, 9 aa, Homo Sapiens
HKLKTPPPG

SEQ ID NO: 722034 - protein, 9 aa, Homo Sapiens
SDLEGSIQE

SEQ ID NO: 722035 - protein, 9 aa, Homo Sapiens
QSLMGMNMN

SEQ ID NO: 722036 - protein, 9 aa, Homo Sapiens
KGPLPKPLT

SEQ ID NO: 722037 - protein, 9 aa, Homo Sapiens
PLSLTVTLS

SEQ ID NO: 722038 - protein, 9 aa, Homo Sapiens
CLLPCFLAV

SEQ ID NO: 722039 - protein, 9 aa, Homo Sapiens
LSKLSEIDV

SEQ ID NO: 722040 - protein, 9 aa, Homo Sapiens
GLMALSKLS

SEQ ID NO: 722041 - protein, 9 aa, Homo Sapiens
DWWCENLGI

SEQ ID NO: 722042 - protein, 9 aa, Homo Sapiens
GSYVVTMET

SEQ ID NO: 722043 - protein, 9 aa, Homo Sapiens
LPKSIETPN

SEQ ID NO: 722044 - protein, 9 aa, Homo Sapiens
RPRGQPANI

SEQ ID NO: 722045 - protein, 9 aa, Homo Sapiens
PQTAPTMLR

SEQ ID NO: 722046 - protein, 9 aa, Homo Sapiens
ILSNRTVKS

SEQ ID NO: 722047 - protein, 9 aa, Homo Sapiens
MGLTLSKEI

SEQ ID NO: 722048 - protein, 9 aa, Homo Sapiens
LSCAAYKEA

SEQ ID NO: 722049 - protein, 9 aa, Homo Sapiens
CCLVSEVLC

SEQ ID NO: 722050 - protein, 9 aa, Homo Sapiens
SKCYVWRMC

SEQ ID NO: 722051 - protein, 9 aa, Homo Sapiens
ILSAMVLTV

SEQ ID NO: 722052 - protein, 9 aa, Homo Sapiens
NPANRPTTP

SEQ ID NO: 722053 - protein, 9 aa, Homo Sapiens
GGLSEPYVK

SEQ ID NO: 722054 - protein, 9 aa, Homo Sapiens
VVGTSYGLP

SEQ ID NO: 722055 - protein, 9 aa, Homo Sapiens
HQRLVPTYE

SEQ ID NO: 722056 - protein, 9 aa, Homo Sapiens
FPKWVQGVG

SEQ ID NO: 722057 - protein, 9 aa, Homo Sapiens
CELQMSWLI

SEQ ID NO: 722058 - protein, 9 aa, Homo Sapiens
DLYPLMKLA

SEQ ID NO: 722059 - protein, 9 aa, Homo Sapiens
NETQVVRNE

SEQ ID NO: 722060 - protein, 9 aa, Homo Sapiens
TLWGCQQAK

SEQ ID NO: 722061 - protein, 9 aa, Homo Sapiens
CDNFGHNHS

SEQ ID NO: 722062 - protein, 8 aa, Homo Sapiens
EVLESGEQ

SEQ ID NO: 722063 - protein, 9 aa, Homo Sapiens
EGLGLKHFC

SEQ ID NO: 722064 - protein, 9 aa, Homo Sapiens
DSVGIVADD

SEQ ID NO: 722065 - protein, 9 aa, Homo Sapiens
AAVIDQEPA

SEQ ID NO: 722066 - protein, 9 aa, Homo Sapiens
RWQDKFMYF

SEQ ID NO: 722067 - protein, 9 aa, Homo Sapiens
FCFKRGFFV

SEQ ID NO: 722068 - protein, 9 aa, Homo Sapiens
HSCSPITVE

SEQ ID NO: 722069 - protein, 9 aa, Homo Sapiens
SLDLIYISG

SEQ ID NO: 722070 - protein, 9 aa, Homo Sapiens
RTSSSCSCQ

SEQ ID NO: 722071 - protein, 9 aa, Homo Sapiens
PWGRRPSPP

SEQ ID NO: 722072 - protein, 9 aa, Homo Sapiens
FKRGFFVLF

SEQ ID NO: 722073 - protein, 9 aa, Homo Sapiens
PASAVQSLP

SEQ ID NO: 722074 - protein, 9 aa, Homo Sapiens
ARATRKGPA

SEQ ID NO: 722075 - protein, 9 aa, Homo Sapiens
RPYKCKERG

SEQ ID NO: 722076 - protein, 9 aa, Homo Sapiens
PLTCIVHCI

SEQ ID NO: 722077 - protein, 9 aa, Homo Sapiens
LEGSIQEPP

SEQ ID NO: 722078 - protein, 9 aa, Homo Sapiens
RCGPGGPGP

SEQ ID NO: 722079 - protein, 9 aa, Homo Sapiens
CSLFLNSNS

SEQ ID NO: 722080 - protein, 9 aa, Homo Sapiens
LVESRNPAL

SEQ ID NO: 722081 - protein, 9 aa, Homo Sapiens
EKREEPMEV

SEQ ID NO: 722082 - protein, 9 aa, Homo Sapiens
GIWKASITS

SEQ ID NO: 722083 - protein, 9 aa, Homo Sapiens
PKGEGGRPG

SEQ ID NO: 722084 - protein, 9 aa, Homo Sapiens
CARNVTPNS

SEQ ID NO: 722085 - protein, 9 aa, Homo Sapiens
STVSTGSIL

SEQ ID NO: 722086 - protein, 9 aa, Homo Sapiens
MYVRAASGL

SEQ ID NO: 722087 - protein, 9 aa, Homo Sapiens
RHRRWRTQY

SEQ ID NO: 722088 - protein, 9 aa, Homo Sapiens
WAHNGRTYF

SEQ ID NO: 722089 - protein, 9 aa, Homo Sapiens
GQMGSCGVG

SEQ ID NO: 722090 - protein, 9 aa, Homo Sapiens
SSSIFQDDF

SEQ ID NO: 722091 - protein, 9 aa, Homo Sapiens
HRRWRTQYA

SEQ ID NO: 722092 - protein, 9 aa, Homo Sapiens
RFSDYNGSV

SEQ ID NO: 722093 - protein, 9 aa, Homo Sapiens
EHRPDNGEE

SEQ ID NO: 722094 - protein, 9 aa, Homo Sapiens
QDKFMYFEF

SEQ ID NO: 722095 - protein, 9 aa, Homo Sapiens
ELCNKADVQ

SEQ ID NO: 722096 - protein, 9 aa, Homo Sapiens
RVVVGTSYG

SEQ ID NO: 722097 - protein, 9 aa, Homo Sapiens
PHWPLQPMC

SEQ ID NO: 722098 - protein, 9 aa, Homo Sapiens
CRLVLQECK

SEQ ID NO: 722099 - protein, 9 aa, Homo Sapiens
KGVLEKRPN

SEQ ID NO: 722100 - protein, 9 aa, Homo Sapiens
EISFQPSSV

SEQ ID NO: 722101 - protein, 9 aa, Homo Sapiens
PALKQVREI

SEQ ID NO: 722102 - protein, 9 aa, Homo Sapiens
SHSCSPITV

SEQ ID NO: 722103 - protein, 9 aa, Homo Sapiens
AYPSYPGYG

SEQ ID NO: 722104 - protein, 9 aa, Homo Sapiens
RAASPAIPR

SEQ ID NO: 722105 - protein, 9 aa, Homo Sapiens
GMKSSGIGT

SEQ ID NO: 722106 - protein, 9 aa, Homo Sapiens
KVRGVRQLI

SEQ ID NO: 722107 - protein, 9 aa, Homo Sapiens
YSIQSTKPR

SEQ ID NO: 722108 - protein, 9 aa, Homo Sapiens
VGGAGAFDV

SEQ ID NO: 722109 - protein, 9 aa, Homo Sapiens
SPGSCVPGL

SEQ ID NO: 722110 - protein, 9 aa, Homo Sapiens
DLFTVQALQ

SEQ ID NO: 722111 - protein, 9 aa, Homo Sapiens
EAPNREFFK

SEQ ID NO: 722112 - protein, 9 aa, Homo Sapiens
RLGSHSFDD

SEQ ID NO: 722113 - protein, 9 aa, Homo Sapiens
KKFWQENRP

SEQ ID NO: 722114 - protein, 9 aa, Homo Sapiens
ILAAVVEVV

SEQ ID NO: 722115 - protein, 9 aa, Homo Sapiens
PLPPKIDTT

SEQ ID NO: 722116 - protein, 9 aa, Homo Sapiens
HGVFFYHAI

SEQ ID NO: 722117 - protein, 9 aa, Homo Sapiens
DSSILSAGQ

SEQ ID NO: 722118 - protein, 9 aa, Homo Sapiens
EHRLKVFSG

SEQ ID NO: 722119 - protein, 9 aa, Homo Sapiens
HKGPLPKPL

SEQ ID NO: 722120 - protein, 9 aa, Homo Sapiens
TQAGGFPMV

SEQ ID NO: 722121 - protein, 9 aa, Homo Sapiens
KENKGRSCT

SEQ ID NO: 722122 - protein, 9 aa, Homo Sapiens
RVPRLPEKG

SEQ ID NO: 722123 - protein, 9 aa, Homo Sapiens
YTKIMSLRL

SEQ ID NO: 722124 - protein, 9 aa, Homo Sapiens
CGRALARRS

SEQ ID NO: 722125 - protein, 9 aa, Homo Sapiens
AEGTVLPKS

SEQ ID NO: 722126 - protein, 9 aa, Homo Sapiens
KPWQTKLSI

SEQ ID NO: 722127 - protein, 9 aa, Homo Sapiens
RRWNCIFMR

SEQ ID NO: 722128 - protein, 9 aa, Homo Sapiens
SRATTPSLT

SEQ ID NO: 722129 - protein, 9 aa, Homo Sapiens
KILPRVHQK

SEQ ID NO: 722130 - protein, 9 aa, Homo Sapiens
LLGVITVPI

SEQ ID NO: 722131 - protein, 9 aa, Homo Sapiens
PECGRSQDA

SEQ ID NO: 722132 - protein, 9 aa, Homo Sapiens
DWPPCLAEG

SEQ ID NO: 722133 - protein, 9 aa, Homo Sapiens
LFNETAFET

SEQ ID NO: 722134 - protein, 9 aa, Homo Sapiens
EVQKHITLC

SEQ ID NO: 722135 - protein, 9 aa, Homo Sapiens
HLENGPDSL

SEQ ID NO: 722136 - protein, 9 aa, Homo Sapiens
NKNRCILHS

SEQ ID NO: 722137 - protein, 9 aa, Homo Sapiens
LGWCQKRLN

SEQ ID NO: 722138 - protein, 9 aa, Homo Sapiens
AAEAGGIFH

SEQ ID NO: 722139 - protein, 9 aa, Homo Sapiens
ILLGLSDVH

SEQ ID NO: 722140 - protein, 9 aa, Homo Sapiens
SLPTNTTSA

SEQ ID NO: 722141 - protein, 9 aa, Homo Sapiens
HCRVGQCVS

SEQ ID NO: 722142 - protein, 9 aa, Homo Sapiens
MSFFISLIQ

SEQ ID NO: 722143 - protein, 9 aa, Homo Sapiens
KMDVGGLSE

SEQ ID NO: 722144 - protein, 9 aa, Homo Sapiens
EKSDANSFL

SEQ ID NO: 722145 - protein, 9 aa, Homo Sapiens
EISTVNPEL

SEQ ID NO: 722146 - protein, 9 aa, Homo Sapiens
NEFTTKIKP

SEQ ID NO: 722147 - protein, 9 aa, Homo Sapiens
EVHEMKGRT

SEQ ID NO: 722148 - protein, 9 aa, Homo Sapiens
TEFNEGGSI

SEQ ID NO: 722149 - protein, 9 aa, Homo Sapiens
DMERMQASL

SEQ ID NO: 722150 - protein, 9 aa, Homo Sapiens
GDCVFYTLP

SEQ ID NO: 722151 - protein, 9 aa, Homo Sapiens
ELKPYGLIV

SEQ ID NO: 722152 - protein, 9 aa, Homo Sapiens
HCGKAFRQS

SEQ ID NO: 722153 - protein, 9 aa, Homo Sapiens
ALVALMGKP

SEQ ID NO: 722154 - protein, 9 aa, Homo Sapiens
STGHTTALH

SEQ ID NO: 722155 - protein, 9 aa, Homo Sapiens
NQEGGVDGG

SEQ ID NO: 722156 - protein, 9 aa, Homo Sapiens
QTFTARTCQ

SEQ ID NO: 722157 - protein, 9 aa, Homo Sapiens
PQEQLIEWI

SEQ ID NO: 722158 - protein, 9 aa, Homo Sapiens
EYGKIITSS

SEQ ID NO: 722159 - protein, 9 aa, Homo Sapiens
CAVIENDGL

SEQ ID NO: 722160 - protein, 9 aa, Homo Sapiens
VTSAMNVAK

SEQ ID NO: 722161 - protein, 9 aa, Homo Sapiens
SPPGAPLGL

SEQ ID NO: 722162 - protein, 9 aa, Homo Sapiens
RRRLRVEIH

SEQ ID NO: 722163 - protein, 9 aa, Homo Sapiens
FFGVYEAIM

SEQ ID NO: 722164 - protein, 9 aa, Homo Sapiens
CSPGSCVPG

SEQ ID NO: 722165 - protein, 9 aa, Homo Sapiens
EFWNKNKPQ

SEQ ID NO: 722166 - protein, 9 aa, Homo Sapiens
VILSAMVLT

SEQ ID NO: 722167 - protein, 9 aa, Homo Sapiens
SEGHHITFR

SEQ ID NO: 722168 - protein, 9 aa, Homo Sapiens
GKEYDFPLL

SEQ ID NO: 722169 - protein, 9 aa, Homo Sapiens
KVQKECYNG

SEQ ID NO: 722170 - protein, 9 aa, Homo Sapiens
TSERFFFKQ

SEQ ID NO: 722171 - protein, 9 aa, Homo Sapiens
AGSPSGPSG

SEQ ID NO: 722172 - protein, 9 aa, Homo Sapiens
AMVVRAMKD

SEQ ID NO: 722173 - protein, 9 aa, Homo Sapiens
AKRKVVKIM

SEQ ID NO: 722174 - protein, 9 aa, Homo Sapiens
STPENIRDR

SEQ ID NO: 722175 - protein, 9 aa, Homo Sapiens
NGNFCWYLL

SEQ ID NO: 722176 - protein, 9 aa, Homo Sapiens
RWRVSIPNS

SEQ ID NO: 722177 - protein, 9 aa, Homo Sapiens
VAQFRDSYP

SEQ ID NO: 722178 - protein, 9 aa, Homo Sapiens
FKMTWTSPS

SEQ ID NO: 722179 - protein, 9 aa, Homo Sapiens
SSPAMAGPH

SEQ ID NO: 722180 - protein, 9 aa, Homo Sapiens
VCKDLIKFM

SEQ ID NO: 722181 - protein, 9 aa, Homo Sapiens
VGFSQLFLY

SEQ ID NO: 722182 - protein, 9 aa, Homo Sapiens
EGRSPPTAL

SEQ ID NO: 722183 - protein, 9 aa, Homo Sapiens
LELGDWALY

SEQ ID NO: 722184 - protein, 9 aa, Homo Sapiens
HDDCRRLFS

SEQ ID NO: 722185 - protein, 9 aa, Homo Sapiens
LAEIFMASG

SEQ ID NO: 722186 - protein, 9 aa, Homo Sapiens
AVNNFLDLI

SEQ ID NO: 722187 - protein, 9 aa, Homo Sapiens
GYKESCCLV

SEQ ID NO: 722188 - protein, 9 aa, Homo Sapiens
QLFSNFTGY

SEQ ID NO: 722189 - protein, 9 aa, Homo Sapiens
QAALINRRE

SEQ ID NO: 722190 - protein, 9 aa, Homo Sapiens
YYRLKGVGQ

SEQ ID NO: 722191 - protein, 9 aa, Homo Sapiens
TSIMENPAP

SEQ ID NO: 722192 - protein, 9 aa, Homo Sapiens
VTQPGGNFA

SEQ ID NO: 722193 - protein, 9 aa, Homo Sapiens
TSAMNVAKG

SEQ ID NO: 722194 - protein, 9 aa, Homo Sapiens
NKVFTEPQH

SEQ ID NO: 722195 - protein, 9 aa, Homo Sapiens
ESTSPSHQA

SEQ ID NO: 722196 - protein, 9 aa, Homo Sapiens
RQQSQCLRN

SEQ ID NO: 722197 - protein, 9 aa, Homo Sapiens
SLPNSGDLW

SEQ ID NO: 722198 - protein, 9 aa, Homo Sapiens
GPESGLSDE

SEQ ID NO: 722199 - protein, 9 aa, Homo Sapiens
LTSTLELKI

SEQ ID NO: 722200 - protein, 9 aa, Homo Sapiens
HSPCCSLFL

SEQ ID NO: 722201 - protein, 9 aa, Homo Sapiens
CKPLVEVYQ

SEQ ID NO: 722202 - protein, 9 aa, Homo Sapiens
MLQTETIQD

SEQ ID NO: 722203 - protein, 9 aa, Homo Sapiens
RALARRSTL

SEQ ID NO: 722204 - protein, 9 aa, Homo Sapiens
HHICLKEST

SEQ ID NO: 722205 - protein, 9 aa, Homo Sapiens
APTMLRPPP

SEQ ID NO: 722206 - protein, 9 aa, Homo Sapiens
IRFSDYNGS

SEQ ID NO: 722207 - protein, 9 aa, Homo Sapiens
ELLDSSILS

SEQ ID NO: 722208 - protein, 9 aa, Homo Sapiens
RCVVCMQTL

SEQ ID NO: 722209 - protein, 9 aa, Homo Sapiens
IVIPNEQSV

SEQ ID NO: 722210 - protein, 9 aa, Homo Sapiens
LTSFGEESR

SEQ ID NO: 722211 - protein, 9 aa, Homo Sapiens
TSSSLPNPL

SEQ ID NO: 722212 - protein, 9 aa, Homo Sapiens
ELGNGHVFH

SEQ ID NO: 722213 - protein, 9 aa, Homo Sapiens
LINTFNLAF

SEQ ID NO: 722214 - protein, 9 aa, Homo Sapiens
CVFTMPTLS

SEQ ID NO: 722215 - protein, 9 aa, Homo Sapiens
SHEIGQQWF

SEQ ID NO: 722216 - protein, 9 aa, Homo Sapiens
VPPDKFNHT

SEQ ID NO: 722217 - protein, 9 aa, Homo Sapiens
GREKKCHEK

SEQ ID NO: 722218 - protein, 9 aa, Homo Sapiens
GAEGTVLPK

SEQ ID NO: 722219 - protein, 9 aa, Homo Sapiens
LRAASPAIP

SEQ ID NO: 722220 - protein, 9 aa, Homo Sapiens
AVLSEKQEG

SEQ ID NO: 722221 - protein, 9 aa, Homo Sapiens
LAEGLPVGG

SEQ ID NO: 722222 - protein, 9 aa, Homo Sapiens
IDFVISLLL

SEQ ID NO: 722223 - protein, 9 aa, Homo Sapiens
FMTESPRFL

SEQ ID NO: 722224 - protein, 9 aa, Homo Sapiens
SPCELQMSW

SEQ ID NO: 722225 - protein, 9 aa, Homo Sapiens
APKQHLLNV

SEQ ID NO: 722226 - protein, 9 aa, Homo Sapiens
TGTVVSISQ

SEQ ID NO: 722227 - protein, 9 aa, Homo Sapiens
ETKTHNQIL

SEQ ID NO: 722228 - protein, 9 aa, Homo Sapiens
CNLSIFDPA

SEQ ID NO: 722229 - protein, 9 aa, Homo Sapiens
SNQVQRSVG

SEQ ID NO: 722230 - protein, 9 aa, Homo Sapiens
YDLYAAVCR

SEQ ID NO: 722231 - protein, 9 aa, Homo Sapiens
NGIAQVSFA

SEQ ID NO: 722232 - protein, 9 aa, Homo Sapiens
LWVAPFSVG

SEQ ID NO: 722233 - protein, 9 aa, Homo Sapiens
VTGEHCLTL

SEQ ID NO: 722234 - protein, 9 aa, Homo Sapiens
ERCGPGGPG

SEQ ID NO: 722235 - protein, 9 aa, Homo Sapiens
GPGLCRIGW

SEQ ID NO: 722236 - protein, 9 aa, Homo Sapiens
NPDASLPNS

SEQ ID NO: 722237 - protein, 9 aa, Homo Sapiens
ELLTTFAWE

SEQ ID NO: 722238 - protein, 9 aa, Homo Sapiens
EWGGYPPVA

SEQ ID NO: 722239 - protein, 9 aa, Homo Sapiens
GGQVRVRER

SEQ ID NO: 722240 - protein, 9 aa, Homo Sapiens
QGSWYFGRT

SEQ ID NO: 722241 - protein, 9 aa, Homo Sapiens
RITQELGKN

SEQ ID NO: 722242 - protein, 9 aa, Homo Sapiens
LMESFDSAL

SEQ ID NO: 722243 - protein, 9 aa, Homo Sapiens
NQIFQSRVM

SEQ ID NO: 722244 - protein, 9 aa, Homo Sapiens
IENDGLHAA

SEQ ID NO: 722245 - protein, 9 aa, Homo Sapiens
AIQAATPQV

SEQ ID NO: 722246 - protein, 9 aa, Homo Sapiens
VGLHMGFST

SEQ ID NO: 722247 - protein, 9 aa, Homo Sapiens
PDASLPNSG

SEQ ID NO: 722248 - protein, 9 aa, Homo Sapiens
KEIQMALFM

SEQ ID NO: 722249 - protein, 9 aa, Homo Sapiens
RQVVRDNAD

SEQ ID NO: 722250 - protein, 9 aa, Homo Sapiens
SSGIGTEGA

SEQ ID NO: 722251 - protein, 9 aa, Homo Sapiens
QLMQLCQRL

SEQ ID NO: 722252 - protein, 9 aa, Homo Sapiens
RDVYYRLKG

SEQ ID NO: 722253 - protein, 9 aa, Homo Sapiens
YYANPALVR

SEQ ID NO: 722254 - protein, 9 aa, Homo Sapiens
LKNEQMFIT

SEQ ID NO: 722255 - protein, 9 aa, Homo Sapiens
KLSIAGLIY

SEQ ID NO: 722256 - protein, 9 aa, Homo Sapiens
PTSSSLPNP

SEQ ID NO: 722257 - protein, 9 aa, Homo Sapiens
APQLGVGGG

SEQ ID NO: 722258 - protein, 9 aa, Homo Sapiens
YEELPESVE

SEQ ID NO: 722259 - protein, 9 aa, Homo Sapiens
NNYLSMLDI

SEQ ID NO: 722260 - protein, 9 aa, Homo Sapiens
YHSPCCSLF

SEQ ID NO: 722261 - protein, 9 aa, Homo Sapiens
EDLDLLEDT

SEQ ID NO: 722262 - protein, 9 aa, Homo Sapiens
CRSPTFLPF

SEQ ID NO: 722263 - protein, 9 aa, Homo Sapiens
MHGVFFYHA

SEQ ID NO: 722264 - protein, 9 aa, Homo Sapiens
TSRYPLPLI

SEQ ID NO: 722265 - protein, 9 aa, Homo Sapiens
EELKPYGLI

SEQ ID NO: 722266 - protein, 9 aa, Homo Sapiens
SVVMLLNLE

SEQ ID NO: 722267 - protein, 9 aa, Homo Sapiens
QAVKADEKN

SEQ ID NO: 722268 - protein, 9 aa, Homo Sapiens
KMNSEISLS

SEQ ID NO: 722269 - protein, 9 aa, Homo Sapiens
IQGPKGEGG

SEQ ID NO: 722270 - protein, 9 aa, Homo Sapiens
PTQALGRHS

SEQ ID NO: 722271 - protein, 9 aa, Homo Sapiens
CKYCTKVLT

SEQ ID NO: 722272 - protein, 9 aa, Homo Sapiens
YHKPKLGKK

SEQ ID NO: 722273 - protein, 9 aa, Homo Sapiens
CSLSEESSA

SEQ ID NO: 722274 - protein, 9 aa, Homo Sapiens
LGLKHFCKP

SEQ ID NO: 722275 - protein, 9 aa, Homo Sapiens
LWSWSPRPP

SEQ ID NO: 722276 - protein, 9 aa, Homo Sapiens
TQKNGQWLG

SEQ ID NO: 722277 - protein, 9 aa, Homo Sapiens
AGGIFHRAR

SEQ ID NO: 722278 - protein, 9 aa, Homo Sapiens
AHTGRLVKS

SEQ ID NO: 722279 - protein, 9 aa, Homo Sapiens
DAVNNFLDL

SEQ ID NO: 722280 - protein, 9 aa, Homo Sapiens
PSQRPTFKK

SEQ ID NO: 722281 - protein, 9 aa, Homo Sapiens
RNDLLSSFL

SEQ ID NO: 722282 - protein, 9 aa, Homo Sapiens
ILFTVCLPF

SEQ ID NO: 722283 - protein, 9 aa, Homo Sapiens
YGVPLLAAE

SEQ ID NO: 722284 - protein, 9 aa, Homo Sapiens
LLLTKYCGY

SEQ ID NO: 722285 - protein, 9 aa, Homo Sapiens
LRQYQQRKR

SEQ ID NO: 722286 - protein, 9 aa, Homo Sapiens
PDDPPCHDV

SEQ ID NO: 722287 - protein, 9 aa, Homo Sapiens
VLFSLEEIS

SEQ ID NO: 722288 - protein, 9 aa, Homo Sapiens
KTFPERFLV

SEQ ID NO: 722289 - protein, 9 aa, Homo Sapiens
LLPKDEKLR

SEQ ID NO: 722290 - protein, 9 aa, Homo Sapiens
EPGCPTFFR

SEQ ID NO: 722291 - protein, 9 aa, Homo Sapiens
PFSVGLHMG

SEQ ID NO: 722292 - protein, 9 aa, Homo Sapiens
ERLRCPEAL

SEQ ID NO: 722293 - protein, 9 aa, Homo Sapiens
LAIPINKNE

SEQ ID NO: 722294 - protein, 9 aa, Homo Sapiens
PSEFVRLPV

SEQ ID NO: 722295 - protein, 9 aa, Homo Sapiens
MKVLGNYRV

SEQ ID NO: 722296 - protein, 9 aa, Homo Sapiens
VSGLFRQVR

SEQ ID NO: 722297 - protein, 9 aa, Homo Sapiens
RTLMQSRRT

SEQ ID NO: 722298 - protein, 9 aa, Homo Sapiens
RAPGEDPID

SEQ ID NO: 722299 - protein, 9 aa, Homo Sapiens
AFSEAEGAL

SEQ ID NO: 722300 - protein, 9 aa, Homo Sapiens
EARGEIDFV

SEQ ID NO: 722301 - protein, 9 aa, Homo Sapiens
FLTNRVEHP

SEQ ID NO: 722302 - protein, 9 aa, Homo Sapiens
GCQQAKLPL

SEQ ID NO: 722303 - protein, 9 aa, Homo Sapiens
DGSNSVAAE

SEQ ID NO: 722304 - protein, 9 aa, Homo Sapiens
NKKNAAVID

SEQ ID NO: 722305 - protein, 9 aa, Homo Sapiens
EEGVVAALG

SEQ ID NO: 722306 - protein, 9 aa, Homo Sapiens
MKYSWVFKT

SEQ ID NO: 722307 - protein, 9 aa, Homo Sapiens
KPRGLSWVP

SEQ ID NO: 722308 - protein, 9 aa, Homo Sapiens
NPTFLMKGP

SEQ ID NO: 722309 - protein, 9 aa, Homo Sapiens
EEALRMGIV

SEQ ID NO: 722310 - protein, 9 aa, Homo Sapiens
YKEALPGWM

SEQ ID NO: 722311 - protein, 9 aa, Homo Sapiens
ATQCCVAVY

SEQ ID NO: 722312 - protein, 9 aa, Homo Sapiens
ISILDRDDL

SEQ ID NO: 722313 - protein, 9 aa, Homo Sapiens
VFHISSFAD

SEQ ID NO: 722314 - protein, 9 aa, Homo Sapiens
RVSIWAIVT

SEQ ID NO: 722315 - protein, 9 aa, Homo Sapiens
LNKELNQNQ

SEQ ID NO: 722316 - protein, 9 aa, Homo Sapiens
KTQKNGQWL

SEQ ID NO: 722317 - protein, 9 aa, Homo Sapiens
VQKHITLCA

SEQ ID NO: 722318 - protein, 9 aa, Homo Sapiens
WTVRKTLPA

SEQ ID NO: 722319 - protein, 9 aa, Homo Sapiens
QGSTGLYPH

SEQ ID NO: 722320 - protein, 9 aa, Homo Sapiens
FVLIETLNA

SEQ ID NO: 722321 - protein, 9 aa, Homo Sapiens
DQLISILDR

SEQ ID NO: 722322 - protein, 9 aa, Homo Sapiens
TQYAIKCAP

SEQ ID NO: 722323 - protein, 9 aa, Homo Sapiens
FTMPTLSGQ

SEQ ID NO: 722324 - protein, 9 aa, Homo Sapiens
KSGETVINN

SEQ ID NO: 722325 - protein, 9 aa, Homo Sapiens
QCLVQGNAW

SEQ ID NO: 722326 - protein, 9 aa, Homo Sapiens
ALRAASPAI

SEQ ID NO: 722327 - protein, 9 aa, Homo Sapiens
TLCALLSSN

SEQ ID NO: 722328 - protein, 9 aa, Homo Sapiens
RQGTSVPAS

SEQ ID NO: 722329 - protein, 9 aa, Homo Sapiens
LCKMDNEFT

SEQ ID NO: 722330 - protein, 9 aa, Homo Sapiens
CHPLHYTKI

SEQ ID NO: 722331 - protein, 9 aa, Homo Sapiens
KGRTPIAFP

SEQ ID NO: 722332 - protein, 9 aa, Homo Sapiens
AQAGRGEGR

SEQ ID NO: 722333 - protein, 9 aa, Homo Sapiens
RWNCIFMRN

SEQ ID NO: 722334 - protein, 9 aa, Homo Sapiens
VAKVFHISS

SEQ ID NO: 722335 - protein, 9 aa, Homo Sapiens
SVSNRDIIP

SEQ ID NO: 722336 - protein, 9 aa, Homo Sapiens
TKKESRITQ

SEQ ID NO: 722337 - protein, 9 aa, Homo Sapiens
ILVSRLLRP

SEQ ID NO: 722338 - protein, 9 aa, Homo Sapiens
KSEVHEMKG

SEQ ID NO: 722339 - protein, 9 aa, Homo Sapiens
KEHCSNCLA

SEQ ID NO: 722340 - protein, 9 aa, Homo Sapiens
ICIVTHFVV

SEQ ID NO: 722341 - protein, 9 aa, Homo Sapiens
RQVCANPEN

SEQ ID NO: 722342 - protein, 9 aa, Homo Sapiens
TTTTVTTTP

SEQ ID NO: 722343 - protein, 9 aa, Homo Sapiens
SGDDVIGEV

SEQ ID NO: 722344 - protein, 9 aa, Homo Sapiens
EKKEKEKKR

SEQ ID NO: 722345 - protein, 9 aa, Homo Sapiens
LILSVCFGA

SEQ ID NO: 722346 - protein, 9 aa, Homo Sapiens
TLVTPKLLE

SEQ ID NO: 722347 - protein, 9 aa, Homo Sapiens
KNGERCGPG

SEQ ID NO: 722348 - protein, 9 aa, Homo Sapiens
CRRLFSKEC

SEQ ID NO: 722349 - protein, 9 aa, Homo Sapiens
EEEDLELAR

SEQ ID NO: 722350 - protein, 9 aa, Homo Sapiens
LLHLQSQLA

SEQ ID NO: 722351 - protein, 9 aa, Homo Sapiens
WLNLSTILY

SEQ ID NO: 722352 - protein, 9 aa, Homo Sapiens
LCAIASLWS

SEQ ID NO: 722353 - protein, 9 aa, Homo Sapiens
EERDACVQA

SEQ ID NO: 722354 - protein, 9 aa, Homo Sapiens
SMSISLPMS

SEQ ID NO: 722355 - protein, 9 aa, Homo Sapiens
LRSRTLGPR

SEQ ID NO: 722356 - protein, 9 aa, Homo Sapiens
RPCLYINWQ

SEQ ID NO: 722357 - protein, 9 aa, Homo Sapiens
CDSECSAGR

SEQ ID NO: 722358 - protein, 9 aa, Homo Sapiens
TRLRWWQPV

SEQ ID NO: 722359 - protein, 9 aa, Homo Sapiens
PVSFQQSQA

SEQ ID NO: 722360 - protein, 9 aa, Homo Sapiens
STTTPAVYD

SEQ ID NO: 722361 - protein, 9 aa, Homo Sapiens
QNQLVRKQD

SEQ ID NO: 722362 - protein, 9 aa, Homo Sapiens
VVILSAMVL

SEQ ID NO: 722363 - protein, 9 aa, Homo Sapiens
FLLLTKYCG

SEQ ID NO: 722364 - protein, 9 aa, Homo Sapiens
TNLTAEQPV

SEQ ID NO: 722365 - protein, 9 aa, Homo Sapiens
PANIRQQPG

SEQ ID NO: 722366 - protein, 9 aa, Homo Sapiens
WNCIFMRNH

SEQ ID NO: 722367 - protein, 9 aa, Homo Sapiens
PVGGAGAFD

SEQ ID NO: 722368 - protein, 9 aa, Homo Sapiens
NDLGQPALE

SEQ ID NO: 722369 - protein, 9 aa, Homo Sapiens
QTACAPDSY

SEQ ID NO: 722370 - protein, 9 aa, Homo Sapiens
EKALKLYFP

SEQ ID NO: 722371 - protein, 9 aa, Homo Sapiens
EVRQRLSDL

SEQ ID NO: 722372 - protein, 9 aa, Homo Sapiens
MQEESQIDV

SEQ ID NO: 722373 - protein, 9 aa, Homo Sapiens
PNHLPKASF

SEQ ID NO: 722374 - protein, 9 aa, Homo Sapiens
HTTALHDTD

SEQ ID NO: 722375 - protein, 9 aa, Homo Sapiens
KTSERFFFK

SEQ ID NO: 722376 - protein, 9 aa, Homo Sapiens
MTCANCNHG

SEQ ID NO: 722377 - protein, 9 aa, Homo Sapiens
AFSTITFCA

SEQ ID NO: 722378 - protein, 9 aa, Homo Sapiens
IDLYRSSYL

SEQ ID NO: 722379 - protein, 9 aa, Homo Sapiens
LNQGMTVNY

SEQ ID NO: 722380 - protein, 9 aa, Homo Sapiens
LYTFQLPED

SEQ ID NO: 722381 - protein, 9 aa, Homo Sapiens
IFFFGVYEA

SEQ ID NO: 722382 - protein, 9 aa, Homo Sapiens
FCVVLCGSS

SEQ ID NO: 722383 - protein, 9 aa, Homo Sapiens
EEYRCNEYY

SEQ ID NO: 722384 - protein, 9 aa, Homo Sapiens
HRLNPGATP

SEQ ID NO: 722385 - protein, 9 aa, Homo Sapiens
LLPVGGYEV

SEQ ID NO: 722386 - protein, 9 aa, Homo Sapiens
WYHKPKLGK

SEQ ID NO: 722387 - protein, 9 aa, Homo Sapiens
PLICRSPTF

SEQ ID NO: 722388 - protein, 9 aa, Homo Sapiens
QDEWGGYPP

SEQ ID NO: 722389 - protein, 9 aa, Homo Sapiens
GLPGFNSVV

SEQ ID NO: 722390 - protein, 9 aa, Homo Sapiens
CIFMRNHEI

SEQ ID NO: 722391 - protein, 9 aa, Homo Sapiens
KYNTETDKW

SEQ ID NO: 722392 - protein, 9 aa, Homo Sapiens
VQADTLNLW

SEQ ID NO: 722393 - protein, 9 aa, Homo Sapiens
ECSPGSCVP

SEQ ID NO: 722394 - protein, 9 aa, Homo Sapiens
GNKTFPERF

SEQ ID NO: 722395 - protein, 9 aa, Homo Sapiens
KRLHKTVQR

SEQ ID NO: 722396 - protein, 9 aa, Homo Sapiens
ACQKRPYGK

SEQ ID NO: 722397 - protein, 9 aa, Homo Sapiens
LVRPHAQIP

SEQ ID NO: 722398 - protein, 9 aa, Homo Sapiens
VEESYDVKD

SEQ ID NO: 722399 - protein, 9 aa, Homo Sapiens
KNNWSNNVR

SEQ ID NO: 722400 - protein, 9 aa, Homo Sapiens
LELLDLSSN

SEQ ID NO: 722401 - protein, 9 aa, Homo Sapiens
YRSLLEGED

SEQ ID NO: 722402 - protein, 9 aa, Homo Sapiens
KAKRKVVKI

SEQ ID NO: 722403 - protein, 9 aa, Homo Sapiens
YIRDHLNSM

SEQ ID NO: 722404 - protein, 9 aa, Homo Sapiens
ALRMGIVGP

SEQ ID NO: 722405 - protein, 9 aa, Homo Sapiens
SMLDIVSGN

SEQ ID NO: 722406 - protein, 9 aa, Homo Sapiens
SRMVARTQT

SEQ ID NO: 722407 - protein, 9 aa, Homo Sapiens
RLVAAQRDS

SEQ ID NO: 722408 - protein, 9 aa, Homo Sapiens
SRGVISHVG

SEQ ID NO: 722409 - protein, 9 aa, Homo Sapiens
ASPCIEQVA

SEQ ID NO: 722410 - protein, 9 aa, Homo Sapiens
PHCGKAFRQ

SEQ ID NO: 722411 - protein, 9 aa, Homo Sapiens
LTNRVEHPI

SEQ ID NO: 722412 - protein, 9 aa, Homo Sapiens
PLWPGSTDL

SEQ ID NO: 722413 - protein, 9 aa, Homo Sapiens
GSCLSRGSR

SEQ ID NO: 722414 - protein, 9 aa, Homo Sapiens
QFDDNPDAS

SEQ ID NO: 722415 - protein, 9 aa, Homo Sapiens
ENIAPTTDV

SEQ ID NO: 722416 - protein, 9 aa, Homo Sapiens
TSFGEESRP

SEQ ID NO: 722417 - protein, 9 aa, Homo Sapiens
LTVEEALRM

SEQ ID NO: 722418 - protein, 9 aa, Homo Sapiens
YMLYREHSQ

SEQ ID NO: 722419 - protein, 9 aa, Homo Sapiens
QIPPFRKCM

SEQ ID NO: 722420 - protein, 9 aa, Homo Sapiens
SKLYECKEC

SEQ ID NO: 722421 - protein, 9 aa, Homo Sapiens
CFWSTLWGC

SEQ ID NO: 722422 - protein, 9 aa, Homo Sapiens
SFCRPCLYI

SEQ ID NO: 722423 - protein, 9 aa, Homo Sapiens
EGTQGAWVR

SEQ ID NO: 722424 - protein, 9 aa, Homo Sapiens
CLSRGSRGW

SEQ ID NO: 722425 - protein, 9 aa, Homo Sapiens
SLALEEEDL

SEQ ID NO: 722426 - protein, 9 aa, Homo Sapiens
AEVYFFQCR

SEQ ID NO: 722427 - protein, 9 aa, Homo Sapiens
RMGGRHPSW

SEQ ID NO: 722428 - protein, 9 aa, Homo Sapiens
RRKTQGFLS

SEQ ID NO: 722429 - protein, 9 aa, Homo Sapiens
KFMSVQRPR

SEQ ID NO: 722430 - protein, 9 aa, Homo Sapiens
GVFLACLLP

SEQ ID NO: 722431 - protein, 9 aa, Homo Sapiens
GEESRPHAL

SEQ ID NO: 722432 - protein, 9 aa, Homo Sapiens
HALAELEQK

SEQ ID NO: 722433 - protein, 9 aa, Homo Sapiens
FVTITAVNL

SEQ ID NO: 722434 - protein, 9 aa, Homo Sapiens
GRMGGRHPS

SEQ ID NO: 722435 - protein, 9 aa, Homo Sapiens
IMNGCDLKF

SEQ ID NO: 722436 - protein, 9 aa, Homo Sapiens
RHSSPGTKK

SEQ ID NO: 722437 - protein, 9 aa, Homo Sapiens
FFFGVYEAI

SEQ ID NO: 722438 - protein, 9 aa, Homo Sapiens
LEDQRFALQ

SEQ ID NO: 722439 - protein, 9 aa, Homo Sapiens
GVGVQLGKW

SEQ ID NO: 722440 - protein, 9 aa, Homo Sapiens
SATVIFRKN

SEQ ID NO: 722441 - protein, 9 aa, Homo Sapiens
VDCHAYPHI

SEQ ID NO: 722442 - protein, 9 aa, Homo Sapiens
PSNSVTQWA

SEQ ID NO: 722443 - protein, 9 aa, Homo Sapiens
AISLILVEE

SEQ ID NO: 722444 - protein, 9 aa, Homo Sapiens
GCSLKEKEK

SEQ ID NO: 722445 - protein, 9 aa, Homo Sapiens
LSLSLTLRG

SEQ ID NO: 722446 - protein, 9 aa, Homo Sapiens
IFKETELKR

SEQ ID NO: 722447 - protein, 9 aa, Homo Sapiens
AVHLPEPLM

SEQ ID NO: 722448 - protein, 9 aa, Homo Sapiens
SICLFAWSH

SEQ ID NO: 722449 - protein, 9 aa, Homo Sapiens
ASRWDPAHA

SEQ ID NO: 722450 - protein, 9 aa, Homo Sapiens
SPLCLIEAP

SEQ ID NO: 722451 - protein, 9 aa, Homo Sapiens
MAARDATSC

SEQ ID NO: 722452 - protein, 9 aa, Homo Sapiens
PKIDTTVTM

SEQ ID NO: 722453 - protein, 9 aa, Homo Sapiens
LSAMVLTVT

SEQ ID NO: 722454 - protein, 9 aa, Homo Sapiens
SLCPGERAH

SEQ ID NO: 722455 - protein, 9 aa, Homo Sapiens
QHQRTHTRE

SEQ ID NO: 722456 - protein, 9 aa, Homo Sapiens
TASTCLCWA

SEQ ID NO: 722457 - protein, 9 aa, Homo Sapiens
AINLDSNSY

SEQ ID NO: 722458 - protein, 9 aa, Homo Sapiens
CTRLRWWQP

SEQ ID NO: 722459 - protein, 9 aa, Homo Sapiens
ASPSPSSSY

SEQ ID NO: 722460 - protein, 9 aa, Homo Sapiens
IVSGNSVYE

SEQ ID NO: 722461 - protein, 9 aa, Homo Sapiens
GRGSGSGSG

SEQ ID NO: 722462 - protein, 9 aa, Homo Sapiens
LDRDDLNVD

SEQ ID NO: 722463 - protein, 9 aa, Homo Sapiens
IGRAESDPS

SEQ ID NO: 722464 - protein, 9 aa, Homo Sapiens
ILDAAGRGS

SEQ ID NO: 722465 - protein, 8 aa, Homo Sapiens
DSSTWSPK

SEQ ID NO: 722466 - protein, 9 aa, Homo Sapiens
PHYPLHCLH

SEQ ID NO: 722467 - protein, 9 aa, Homo Sapiens
KFIYEGSFD

SEQ ID NO: 722468 - protein, 9 aa, Homo Sapiens
LRMGIVGPE

SEQ ID NO: 722469 - protein, 9 aa, Homo Sapiens
FSIVRPGRL

SEQ ID NO: 722470 - protein, 9 aa, Homo Sapiens
RHSNVQCLP

SEQ ID NO: 722471 - protein, 9 aa, Homo Sapiens
TTFAWEQGC

SEQ ID NO: 722472 - protein, 9 aa, Homo Sapiens
LANYMLYRE

SEQ ID NO: 722473 - protein, 9 aa, Homo Sapiens
ILLWVAPFS

SEQ ID NO: 722474 - protein, 9 aa, Homo Sapiens
PYPCPHCGK

SEQ ID NO: 722475 - protein, 9 aa, Homo Sapiens
WYPNGIAQV

SEQ ID NO: 722476 - protein, 9 aa, Homo Sapiens
TIQDGADDF

SEQ ID NO: 722477 - protein, 9 aa, Homo Sapiens
SEPATDGPA

SEQ ID NO: 722478 - protein, 9 aa, Homo Sapiens
GQRYKMDDA

SEQ ID NO: 722479 - protein, 9 aa, Homo Sapiens
SLVNLEPRY

SEQ ID NO: 722480 - protein, 9 aa, Homo Sapiens
FSTITFCAS

SEQ ID NO: 722481 - protein, 9 aa, Homo Sapiens
RTQIDYNPK

SEQ ID NO: 722482 - protein, 9 aa, Homo Sapiens
GLDGNFNSM

SEQ ID NO: 722483 - protein, 9 aa, Homo Sapiens
ELCDTYPAV

SEQ ID NO: 722484 - protein, 9 aa, Homo Sapiens
YSWVFKTKT

SEQ ID NO: 722485 - protein, 9 aa, Homo Sapiens
WEGTQGAWV

SEQ ID NO: 722486 - protein, 9 aa, Homo Sapiens
VAWLNLSTI

SEQ ID NO: 722487 - protein, 9 aa, Homo Sapiens
EQKDKLEEI

SEQ ID NO: 722488 - protein, 9 aa, Homo Sapiens
NIMVLNILR

SEQ ID NO: 722489 - protein, 9 aa, Homo Sapiens
DGWSTLHIA

SEQ ID NO: 722490 - protein, 9 aa, Homo Sapiens
ANEHLQLFF

SEQ ID NO: 722491 - protein, 9 aa, Homo Sapiens
QMGSCGVGK

SEQ ID NO: 722492 - protein, 9 aa, Homo Sapiens
LPEKGSSSR

SEQ ID NO: 722493 - protein, 9 aa, Homo Sapiens
CPLCLQGCG

SEQ ID NO: 722494 - protein, 9 aa, Homo Sapiens
HSSTTHNIF

SEQ ID NO: 722495 - protein, 9 aa, Homo Sapiens
CCVLGMGVW

SEQ ID NO: 722496 - protein, 9 aa, Homo Sapiens
YINWQDTAV

SEQ ID NO: 722497 - protein, 9 aa, Homo Sapiens
SLRPTASTC

SEQ ID NO: 722498 - protein, 9 aa, Homo Sapiens
CAAYKEALP

SEQ ID NO: 722499 - protein, 9 aa, Homo Sapiens
TVTTTPTPT

SEQ ID NO: 722500 - protein, 9 aa, Homo Sapiens
RSVGDSISI

SEQ ID NO: 722501 - protein, 9 aa, Homo Sapiens
ADPGSDLFT

SEQ ID NO: 722502 - protein, 9 aa, Homo Sapiens
HGPYKAAIP

SEQ ID NO: 722503 - protein, 9 aa, Homo Sapiens
LLHHRHSLH

SEQ ID NO: 722504 - protein, 9 aa, Homo Sapiens
VRVRERAFH

SEQ ID NO: 722505 - protein, 9 aa, Homo Sapiens
RGEHALQDA

SEQ ID NO: 722506 - protein, 9 aa, Homo Sapiens
TRKILVVHD

SEQ ID NO: 722507 - protein, 9 aa, Homo Sapiens
KGRQEDRLY

SEQ ID NO: 722508 - protein, 9 aa, Homo Sapiens
LSKEIQMAL

SEQ ID NO: 722509 - protein, 9 aa, Homo Sapiens
SRYPLPLIC

SEQ ID NO: 722510 - protein, 9 aa, Homo Sapiens
IFKVLLSIC

SEQ ID NO: 722511 - protein, 9 aa, Homo Sapiens
RPCEPGCPT

SEQ ID NO: 722512 - protein, 9 aa, Homo Sapiens
LEFGSHLDM

SEQ ID NO: 722513 - protein, 9 aa, Homo Sapiens
QRTHTREKP

SEQ ID NO: 722514 - protein, 9 aa, Homo Sapiens
GTTISAYVA

SEQ ID NO: 722515 - protein, 9 aa, Homo Sapiens
ECVIKKDAK

SEQ ID NO: 722516 - protein, 9 aa, Homo Sapiens
PLLFNAVSS

SEQ ID NO: 722517 - protein, 9 aa, Homo Sapiens
GVFFYHAIK

SEQ ID NO: 722518 - protein, 9 aa, Homo Sapiens
CWASTTRSA

SEQ ID NO: 722519 - protein, 9 aa, Homo Sapiens
PHVQAAPQV

SEQ ID NO: 722520 - protein, 9 aa, Homo Sapiens
PPKRTLSRV

SEQ ID NO: 722521 - protein, 9 aa, Homo Sapiens
PNPQVNQGT

SEQ ID NO: 722522 - protein, 9 aa, Homo Sapiens
TTLTLPLWS

SEQ ID NO: 722523 - protein, 9 aa, Homo Sapiens
MQIDPNGLS

SEQ ID NO: 722524 - protein, 9 aa, Homo Sapiens
AESDPSLDV

SEQ ID NO: 722525 - protein, 9 aa, Homo Sapiens
TNKNRCILH

SEQ ID NO: 722526 - protein, 9 aa, Homo Sapiens
IPALKQVRE

SEQ ID NO: 722527 - protein, 9 aa, Homo Sapiens
SEFVRLPVY

SEQ ID NO: 722528 - protein, 9 aa, Homo Sapiens
GIGQLISLD

SEQ ID NO: 722529 - protein, 9 aa, Homo Sapiens
YADAVNNFL

SEQ ID NO: 722530 - protein, 9 aa, Homo Sapiens
PWTRCLRMR

SEQ ID NO: 722531 - protein, 9 aa, Homo Sapiens
TACAPDSYE

SEQ ID NO: 722532 - protein, 9 aa, Homo Sapiens
SQRPTFKKL

SEQ ID NO: 722533 - protein, 9 aa, Homo Sapiens
PLAEELSCC

SEQ ID NO: 722534 - protein, 9 aa, Homo Sapiens
GGYPPVAKM

SEQ ID NO: 722535 - protein, 9 aa, Homo Sapiens
TSEEDEPGL

SEQ ID NO: 722536 - protein, 9 aa, Homo Sapiens
LVAAQRDSV

SEQ ID NO: 722537 - protein, 9 aa, Homo Sapiens
LRCYALPTE

SEQ ID NO: 722538 - protein, 9 aa, Homo Sapiens
TISAYVAKS

SEQ ID NO: 722539 - protein, 9 aa, Homo Sapiens
LHYTKIMSL

SEQ ID NO: 722540 - protein, 9 aa, Homo Sapiens
RAASGLAED

SEQ ID NO: 722541 - protein, 9 aa, Homo Sapiens
SNHRLNPGA

SEQ ID NO: 722542 - protein, 9 aa, Homo Sapiens
AGRGEGRSP

SEQ ID NO: 722543 - protein, 9 aa, Homo Sapiens
SAEGQQRNT

SEQ ID NO: 722544 - protein, 9 aa, Homo Sapiens
LLPGPLPAS

SEQ ID NO: 722545 - protein, 9 aa, Homo Sapiens
AHLAGGQPC

SEQ ID NO: 722546 - protein, 9 aa, Homo Sapiens
LVESLQDEV

SEQ ID NO: 722547 - protein, 9 aa, Homo Sapiens
YIPPSDMQE

SEQ ID NO: 722548 - protein, 9 aa, Homo Sapiens
RPSQPCSPL

SEQ ID NO: 722549 - protein, 9 aa, Homo Sapiens
TTSAELYEA

SEQ ID NO: 722550 - protein, 9 aa, Homo Sapiens
DHYVAICNT

SEQ ID NO: 722551 - protein, 9 aa, Homo Sapiens
KQKETIKTF

SEQ ID NO: 722552 - protein, 9 aa, Homo Sapiens
CSPITVESD

SEQ ID NO: 722553 - protein, 9 aa, Homo Sapiens
ALLGSKQKV

SEQ ID NO: 722554 - protein, 9 aa, Homo Sapiens
LTNLELLDL

SEQ ID NO: 722555 - protein, 9 aa, Homo Sapiens
PRTFLPDQN

SEQ ID NO: 722556 - protein, 9 aa, Homo Sapiens
ELLDLSSNK

SEQ ID NO: 722557 - protein, 9 aa, Homo Sapiens
RLHQRLVPT

SEQ ID NO: 722558 - protein, 9 aa, Homo Sapiens
SWFLENMAV

SEQ ID NO: 722559 - protein, 9 aa, Homo Sapiens
DYESRTSVT

SEQ ID NO: 722560 - protein, 9 aa, Homo Sapiens
SIAGLIYLH

SEQ ID NO: 722561 - protein, 9 aa, Homo Sapiens
FQCRRDFGL

SEQ ID NO: 722562 - protein, 9 aa, Homo Sapiens
SSAVTPLLF

SEQ ID NO: 722563 - protein, 9 aa, Homo Sapiens
EDGIYANLG

SEQ ID NO: 722564 - protein, 9 aa, Homo Sapiens
NQTFTARTC

SEQ ID NO: 722565 - protein, 9 aa, Homo Sapiens
PILLSQMSC

SEQ ID NO: 722566 - protein, 9 aa, Homo Sapiens
FITEEVEWW

SEQ ID NO: 722567 - protein, 9 aa, Homo Sapiens
EFSNLPQEQ

SEQ ID NO: 722568 - protein, 9 aa, Homo Sapiens
QENLPEITV

SEQ ID NO: 722569 - protein, 9 aa, Homo Sapiens
DAESVRNGW

SEQ ID NO: 722570 - protein, 9 aa, Homo Sapiens
MIILASINF

SEQ ID NO: 722571 - protein, 9 aa, Homo Sapiens
MGVFLACLL

SEQ ID NO: 722572 - protein, 9 aa, Homo Sapiens
EMAPFLWCQ

SEQ ID NO: 722573 - protein, 9 aa, Homo Sapiens
IGGVGVQLG

SEQ ID NO: 722574 - protein, 9 aa, Homo Sapiens
GPPVSFQQS

SEQ ID NO: 722575 - protein, 9 aa, Homo Sapiens
SGRMSSIRF

SEQ ID NO: 722576 - protein, 9 aa, Homo Sapiens
AEPWLRPGT

SEQ ID NO: 722577 - protein, 9 aa, Homo Sapiens
ATDGPAASE

SEQ ID NO: 722578 - protein, 9 aa, Homo Sapiens
GNGHVFHLE

SEQ ID NO: 722579 - protein, 9 aa, Homo Sapiens
TAFETIYPN

SEQ ID NO: 722580 - protein, 9 aa, Homo Sapiens
SVEERSGAQ

SEQ ID NO: 722581 - protein, 9 aa, Homo Sapiens
DEKLRHYFR

SEQ ID NO: 722582 - protein, 9 aa, Homo Sapiens
MDLQACIYL

SEQ ID NO: 722583 - protein, 9 aa, Homo Sapiens
QKDKLEEIL

SEQ ID NO: 722584 - protein, 9 aa, Homo Sapiens
PFIRAGDYE

SEQ ID NO: 722585 - protein, 9 aa, Homo Sapiens
LPVGGLVTG

SEQ ID NO: 722586 - protein, 9 aa, Homo Sapiens
ASTCLCWAS

SEQ ID NO: 722587 - protein, 9 aa, Homo Sapiens
PPACTTRCF

SEQ ID NO: 722588 - protein, 9 aa, Homo Sapiens
FLTVCDASK

SEQ ID NO: 722589 - protein, 9 aa, Homo Sapiens
ASTCQAVSA

SEQ ID NO: 722590 - protein, 9 aa, Homo Sapiens
SGIFGMLSQ

SEQ ID NO: 722591 - protein, 9 aa, Homo Sapiens
GVRQLIQRL

SEQ ID NO: 722592 - protein, 9 aa, Homo Sapiens
PWAPLFCQQ

SEQ ID NO: 722593 - protein, 9 aa, Homo Sapiens
GFSILPKSY

SEQ ID NO: 722594 - protein, 9 aa, Homo Sapiens
LPFLLLVAQ

SEQ ID NO: 722595 - protein, 9 aa, Homo Sapiens
DFLHVPETK

SEQ ID NO: 722596 - protein, 9 aa, Homo Sapiens
QPHNATNPG

SEQ ID NO: 722597 - protein, 9 aa, Homo Sapiens
AVLVAFLDD

SEQ ID NO: 722598 - protein, 9 aa, Homo Sapiens
QSQLAPWPG

SEQ ID NO: 722599 - protein, 9 aa, Homo Sapiens
TGTWVYEYM

SEQ ID NO: 722600 - protein, 9 aa, Homo Sapiens
VYALELLTT

SEQ ID NO: 722601 - protein, 9 aa, Homo Sapiens
GYETQAGGF

SEQ ID NO: 722602 - protein, 9 aa, Homo Sapiens
HRLFSAAYS

SEQ ID NO: 722603 - protein, 9 aa, Homo Sapiens
SCSVDENTP

SEQ ID NO: 722604 - protein, 9 aa, Homo Sapiens
HTGSKLYEC

SEQ ID NO: 722605 - protein, 9 aa, Homo Sapiens
PLWSWSPRP

SEQ ID NO: 722606 - protein, 9 aa, Homo Sapiens
FRDIPNTSI

SEQ ID NO: 722607 - protein, 9 aa, Homo Sapiens
SPARGSLPE

SEQ ID NO: 722608 - protein, 9 aa, Homo Sapiens
KEIEDWISS

SEQ ID NO: 722609 - protein, 9 aa, Homo Sapiens
PSLTSVDNE

SEQ ID NO: 722610 - protein, 9 aa, Homo Sapiens
SEKLIQEIT

SEQ ID NO: 722611 - protein, 9 aa, Homo Sapiens
QLRIFKETE

SEQ ID NO: 722612 - protein, 9 aa, Homo Sapiens
DGQMMTASP

SEQ ID NO: 722613 - protein, 9 aa, Homo Sapiens
LALEEEDLE

SEQ ID NO: 722614 - protein, 9 aa, Homo Sapiens
EEPMEVEEE

SEQ ID NO: 722615 - protein, 9 aa, Homo Sapiens
SAQMEVTVT

SEQ ID NO: 722616 - protein, 9 aa, Homo Sapiens
CYVWRMCDW

SEQ ID NO: 722617 - protein, 9 aa, Homo Sapiens
SKEIQMALF

SEQ ID NO: 722618 - protein, 9 aa, Homo Sapiens
FKVEESYDV

SEQ ID NO: 722619 - protein, 9 aa, Homo Sapiens
LAEINKLLQ

SEQ ID NO: 722620 - protein, 9 aa, Homo Sapiens
LNEGFLCRI

SEQ ID NO: 722621 - protein, 9 aa, Homo Sapiens
AWLIFFCVV

SEQ ID NO: 722622 - protein, 9 aa, Homo Sapiens
LEDSKMDTT

SEQ ID NO: 722623 - protein, 9 aa, Homo Sapiens
APFSVGLHM

SEQ ID NO: 722624 - protein, 9 aa, Homo Sapiens
LALVKQLDN

SEQ ID NO: 722625 - protein, 9 aa, Homo Sapiens
DHEELVLLQ

SEQ ID NO: 722626 - protein, 9 aa, Homo Sapiens
RKCCKSVDE

SEQ ID NO: 722627 - protein, 9 aa, Homo Sapiens
LVLQECKLQ

SEQ ID NO: 722628 - protein, 9 aa, Homo Sapiens
HWDGEQSPR

SEQ ID NO: 722629 - protein, 9 aa, Homo Sapiens
IDTTVTMMQ

SEQ ID NO: 722630 - protein, 9 aa, Homo Sapiens
KGVPPDKFN

SEQ ID NO: 722631 - protein, 9 aa, Homo Sapiens
RRNDLLSSF

SEQ ID NO: 722632 - protein, 9 aa, Homo Sapiens
FVSFFQVMN

SEQ ID NO: 722633 - protein, 9 aa, Homo Sapiens
PGNPVDCHA

SEQ ID NO: 722634 - protein, 9 aa, Homo Sapiens
EALRMGIVG

SEQ ID NO: 722635 - protein, 9 aa, Homo Sapiens
SDVHELRVC

SEQ ID NO: 722636 - protein, 9 aa, Homo Sapiens
ALEFEDGIY

SEQ ID NO: 722637 - protein, 9 aa, Homo Sapiens
ATEELSNLV

SEQ ID NO: 722638 - protein, 9 aa, Homo Sapiens
STSLFVLIE

SEQ ID NO: 722639 - protein, 9 aa, Homo Sapiens
APGRGAADP

SEQ ID NO: 722640 - protein, 9 aa, Homo Sapiens
IREMRTRRP

SEQ ID NO: 722641 - protein, 9 aa, Homo Sapiens
LAAQWTEFL

SEQ ID NO: 722642 - protein, 9 aa, Homo Sapiens
QADTLNLWV

SEQ ID NO: 722643 - protein, 9 aa, Homo Sapiens
LQPMCPSWP

SEQ ID NO: 722644 - protein, 9 aa, Homo Sapiens
RKREKKEKE

SEQ ID NO: 722645 - protein, 9 aa, Homo Sapiens
STKKESRIT

SEQ ID NO: 722646 - protein, 9 aa, Homo Sapiens
ACLLPCFLA

SEQ ID NO: 722647 - protein, 9 aa, Homo Sapiens
SSSYAGKTP

SEQ ID NO: 722648 - protein, 9 aa, Homo Sapiens
EVLCRLLGQ

SEQ ID NO: 722649 - protein, 9 aa, Homo Sapiens
GLLVVLILS

SEQ ID NO: 722650 - protein, 9 aa, Homo Sapiens
GRGTMLKGE

SEQ ID NO: 722651 - protein, 9 aa, Homo Sapiens
YSLPRVVVG

SEQ ID NO: 722652 - protein, 9 aa, Homo Sapiens
CLVQGNAWI

SEQ ID NO: 722653 - protein, 9 aa, Homo Sapiens
GKASPCIEQ

SEQ ID NO: 722654 - protein, 9 aa, Homo Sapiens
DLLEPDGEF

SEQ ID NO: 722655 - protein, 9 aa, Homo Sapiens
AKRLHKTVQ

SEQ ID NO: 722656 - protein, 9 aa, Homo Sapiens
TQALGRHSG

SEQ ID NO: 722657 - protein, 9 aa, Homo Sapiens
ERPYKCKER

SEQ ID NO: 722658 - protein, 9 aa, Homo Sapiens
VELIHCVLG

SEQ ID NO: 722659 - protein, 9 aa, Homo Sapiens
RFSGDDVIG

SEQ ID NO: 722660 - protein, 9 aa, Homo Sapiens
VPDTCVIVC

SEQ ID NO: 722661 - protein, 9 aa, Homo Sapiens
PILPRNVVQ

SEQ ID NO: 722662 - protein, 9 aa, Homo Sapiens
ISLLLLMCR

SEQ ID NO: 722663 - protein, 9 aa, Homo Sapiens
PHKGPLPKP

SEQ ID NO: 722664 - protein, 9 aa, Homo Sapiens
EARLCVAQF

SEQ ID NO: 722665 - protein, 9 aa, Homo Sapiens
GFHIELKQR

SEQ ID NO: 722666 - protein, 9 aa, Homo Sapiens
HATSSIVSL

SEQ ID NO: 722667 - protein, 9 aa, Homo Sapiens
VEGRLALPS

SEQ ID NO: 722668 - protein, 9 aa, Homo Sapiens
TFTPQHHIC

SEQ ID NO: 722669 - protein, 9 aa, Homo Sapiens
KEKQHSQPQ

SEQ ID NO: 722670 - protein, 9 aa, Homo Sapiens
AMESGRMSS

SEQ ID NO: 722671 - protein, 9 aa, Homo Sapiens
RDNADFWGP

SEQ ID NO: 722672 - protein, 9 aa, Homo Sapiens
EPTQALGRH

SEQ ID NO: 722673 - protein, 9 aa, Homo Sapiens
DWALYLCAS

SEQ ID NO: 722674 - protein, 9 aa, Homo Sapiens
ITTLALTFG

SEQ ID NO: 722675 - protein, 9 aa, Homo Sapiens
SRTLGPRAW

SEQ ID NO: 722676 - protein, 9 aa, Homo Sapiens
LLEKFSTEF

SEQ ID NO: 722677 - protein, 9 aa, Homo Sapiens
EAEKEHCSN

SEQ ID NO: 722678 - protein, 9 aa, Homo Sapiens
LCRIGWAPA

SEQ ID NO: 722679 - protein, 9 aa, Homo Sapiens
RVMKENLSP

SEQ ID NO: 722680 - protein, 9 aa, Homo Sapiens
VQVPYGDLV

SEQ ID NO: 722681 - protein, 9 aa, Homo Sapiens
SSPSQSRMV

SEQ ID NO: 722682 - protein, 9 aa, Homo Sapiens
QIFQSRVMK

SEQ ID NO: 722683 - protein, 9 aa, Homo Sapiens
QTETIQDGA

SEQ ID NO: 722684 - protein, 9 aa, Homo Sapiens
APLGLRLLA

SEQ ID NO: 722685 - protein, 9 aa, Homo Sapiens
ANPENKWVR

SEQ ID NO: 722686 - protein, 9 aa, Homo Sapiens
APFKVTLTG

SEQ ID NO: 722687 - protein, 9 aa, Homo Sapiens
KIVHVSLHG

SEQ ID NO: 722688 - protein, 9 aa, Homo Sapiens
DSLAHRPQS

SEQ ID NO: 722689 - protein, 9 aa, Homo Sapiens
LEILLGSPA

SEQ ID NO: 722690 - protein, 9 aa, Homo Sapiens
EDSKMDTTL

SEQ ID NO: 722691 - protein, 9 aa, Homo Sapiens
VNLEPRYTY

SEQ ID NO: 722692 - protein, 9 aa, Homo Sapiens
RLHKTVQRL

SEQ ID NO: 722693 - protein, 9 aa, Homo Sapiens
QRSVGSTPL

SEQ ID NO: 722694 - protein, 9 aa, Homo Sapiens
ETISAQMEV

SEQ ID NO: 722695 - protein, 9 aa, Homo Sapiens
WVAPFSVGL

SEQ ID NO: 722696 - protein, 9 aa, Homo Sapiens
VPSSLTSVV

SEQ ID NO: 722697 - protein, 9 aa, Homo Sapiens
EYKTVPLTC

SEQ ID NO: 722698 - protein, 9 aa, Homo Sapiens
LNFGDGPDS

SEQ ID NO: 722699 - protein, 9 aa, Homo Sapiens
DLYAAVCRP

SEQ ID NO: 722700 - protein, 9 aa, Homo Sapiens
IFHRARGRT

SEQ ID NO: 722701 - protein, 9 aa, Homo Sapiens
NCIFMRNHE

SEQ ID NO: 722702 - protein, 9 aa, Homo Sapiens
LPREHRVYV

SEQ ID NO: 722703 - protein, 9 aa, Homo Sapiens
ASSWTVRKT

SEQ ID NO: 722704 - protein, 9 aa, Homo Sapiens
SLPMSCLDS

SEQ ID NO: 722705 - protein, 9 aa, Homo Sapiens
QGMTVNYLL

SEQ ID NO: 722706 - protein, 9 aa, Homo Sapiens
YTIVIRNKH

SEQ ID NO: 722707 - protein, 9 aa, Homo Sapiens
LQTRQWPPG

SEQ ID NO: 722708 - protein, 9 aa, Homo Sapiens
EGAELGLGV

SEQ ID NO: 722709 - protein, 9 aa, Homo Sapiens
ILLGVITVP

SEQ ID NO: 722710 - protein, 9 aa, Homo Sapiens
CPGQTAAYW

SEQ ID NO: 722711 - protein, 9 aa, Homo Sapiens
LHQRLVPTY

SEQ ID NO: 722712 - protein, 9 aa, Homo Sapiens
GGRDSVVSC

SEQ ID NO: 722713 - protein, 9 aa, Homo Sapiens
MAVCATVFL

SEQ ID NO: 722714 - protein, 9 aa, Homo Sapiens
EKMNSEISL

SEQ ID NO: 722715 - protein, 9 aa, Homo Sapiens
HEMKGRTLD

SEQ ID NO: 722716 - protein, 9 aa, Homo Sapiens
LACLLPCFL

SEQ ID NO: 722717 - protein, 9 aa, Homo Sapiens
LFSKECCFR

SEQ ID NO: 722718 - protein, 9 aa, Homo Sapiens
KIQHTARKL

SEQ ID NO: 722719 - protein, 9 aa, Homo Sapiens
SVGIVADDD

SEQ ID NO: 722720 - protein, 9 aa, Homo Sapiens
GRHSGALGN

SEQ ID NO: 722721 - protein, 9 aa, Homo Sapiens
AYSGFVTDK

SEQ ID NO: 722722 - protein, 9 aa, Homo Sapiens
MGQKALQLA

SEQ ID NO: 722723 - protein, 9 aa, Homo Sapiens
SCSVYGCGY

SEQ ID NO: 722724 - protein, 9 aa, Homo Sapiens
SYLSHTIPH

SEQ ID NO: 722725 - protein, 9 aa, Homo Sapiens
NKVRGVRQL

SEQ ID NO: 722726 - protein, 9 aa, Homo Sapiens
MDVGGLSEP

SEQ ID NO: 722727 - protein, 9 aa, Homo Sapiens
TLSKEIQMA

SEQ ID NO: 722728 - protein, 9 aa, Homo Sapiens
LWPMLQMKL

SEQ ID NO: 722729 - protein, 9 aa, Homo Sapiens
KPSLLAHTG

SEQ ID NO: 722730 - protein, 9 aa, Homo Sapiens
FNLLTLVES

SEQ ID NO: 722731 - protein, 9 aa, Homo Sapiens
FQPSSVVVV

SEQ ID NO: 722732 - protein, 9 aa, Homo Sapiens
ANYMLYREH

SEQ ID NO: 722733 - protein, 9 aa, Homo Sapiens
KIMIRGIGS

SEQ ID NO: 722734 - protein, 9 aa, Homo Sapiens
QDAIQAATP

SEQ ID NO: 722735 - protein, 9 aa, Homo Sapiens
YLSHTIPHF

SEQ ID NO: 722736 - protein, 9 aa, Homo Sapiens
FRRCITQIF

SEQ ID NO: 722737 - protein, 9 aa, Homo Sapiens
PLNEGFLCR

SEQ ID NO: 722738 - protein, 9 aa, Homo Sapiens
GEGGRPGKA

SEQ ID NO: 722739 - protein, 9 aa, Homo Sapiens
EEVSKFYAA

SEQ ID NO: 722740 - protein, 9 aa, Homo Sapiens
KINPYVLSY

SEQ ID NO: 722741 - protein, 9 aa, Homo Sapiens
NALVQRSSR

SEQ ID NO: 722742 - protein, 9 aa, Homo Sapiens
EQLAQFKMT

SEQ ID NO: 722743 - protein, 9 aa, Homo Sapiens
TFSSYYQHS

SEQ ID NO: 722744 - protein, 9 aa, Homo Sapiens
ASTTRSAPA

SEQ ID NO: 722745 - protein, 9 aa, Homo Sapiens
NRTSIVNPP

SEQ ID NO: 722746 - protein, 9 aa, Homo Sapiens
LDPSNAIRI

SEQ ID NO: 722747 - protein, 9 aa, Homo Sapiens
REIPRGFRF

SEQ ID NO: 722748 - protein, 9 aa, Homo Sapiens
QLGLEDQRF

SEQ ID NO: 722749 - protein, 9 aa, Homo Sapiens
TCGAKNLQS

SEQ ID NO: 722750 - protein, 9 aa, Homo Sapiens
TQGAWVRGT

SEQ ID NO: 722751 - protein, 9 aa, Homo Sapiens
KRLNWVPRH

SEQ ID NO: 722752 - protein, 9 aa, Homo Sapiens
MGSCGVGKR

SEQ ID NO: 722753 - protein, 9 aa, Homo Sapiens
LRDQSAIDL

SEQ ID NO: 722754 - protein, 9 aa, Homo Sapiens
NTYQLDYDV

SEQ ID NO: 722755 - protein, 9 aa, Homo Sapiens
TQDEVYNTS

SEQ ID NO: 722756 - protein, 9 aa, Homo Sapiens
SSYALKTVL

SEQ ID NO: 722757 - protein, 9 aa, Homo Sapiens
PVLAAQWTE

SEQ ID NO: 722758 - protein, 9 aa, Homo Sapiens
HLNEIKVYV

SEQ ID NO: 722759 - protein, 9 aa, Homo Sapiens
PAVLVVPYR

SEQ ID NO: 722760 - protein, 9 aa, Homo Sapiens
CVFLAFVSV

SEQ ID NO: 722761 - protein, 9 aa, Homo Sapiens
LQECKLQGW

SEQ ID NO: 722762 - protein, 9 aa, Homo Sapiens
NRLRSRTLG

SEQ ID NO: 722763 - protein, 9 aa, Homo Sapiens
PMEVEEEPE

SEQ ID NO: 722764 - protein, 9 aa, Homo Sapiens
HADVFTISK

SEQ ID NO: 722765 - protein, 9 aa, Homo Sapiens
CKSEPNTYQ

SEQ ID NO: 722766 - protein, 9 aa, Homo Sapiens
VVKIMIIVV

SEQ ID NO: 722767 - protein, 9 aa, Homo Sapiens
SQDWDVVKD

SEQ ID NO: 722768 - protein, 9 aa, Homo Sapiens
VKSVNASNY

SEQ ID NO: 722769 - protein, 9 aa, Homo Sapiens
QTMGFLEKA

SEQ ID NO: 722770 - protein, 9 aa, Homo Sapiens
HGDRWREQA

SEQ ID NO: 722771 - protein, 9 aa, Homo Sapiens
PPPGCQGQD

SEQ ID NO: 722772 - protein, 9 aa, Homo Sapiens
PRLPEKGSS

SEQ ID NO: 722773 - protein, 9 aa, Homo Sapiens
TPAVYDRVA

SEQ ID NO: 722774 - protein, 9 aa, Homo Sapiens
RPNEISVAC

SEQ ID NO: 722775 - protein, 9 aa, Homo Sapiens
GFENIAPTT

SEQ ID NO: 722776 - protein, 9 aa, Homo Sapiens
EQLIEWIKY

SEQ ID NO: 722777 - protein, 9 aa, Homo Sapiens
AEGALPLRE

SEQ ID NO: 722778 - protein, 9 aa, Homo Sapiens
KERGKAFIS

SEQ ID NO: 722779 - protein, 9 aa, Homo Sapiens
CNMNINSLA

SEQ ID NO: 722780 - protein, 9 aa, Homo Sapiens
EETPVFMKY

SEQ ID NO: 722781 - protein, 9 aa, Homo Sapiens
GRYVATQCC

SEQ ID NO: 722782 - protein, 9 aa, Homo Sapiens
EELAEIFMA

SEQ ID NO: 722783 - protein, 9 aa, Homo Sapiens
FALYRNLTR

SEQ ID NO: 722784 - protein, 9 aa, Homo Sapiens
IYEGSFDFS

SEQ ID NO: 722785 - protein, 9 aa, Homo Sapiens
RNRQGTSVP

SEQ ID NO: 722786 - protein, 9 aa, Homo Sapiens
LEPRYTYRI

SEQ ID NO: 722787 - protein, 9 aa, Homo Sapiens
EKNDEDGKK

SEQ ID NO: 722788 - protein, 9 aa, Homo Sapiens
GFLCRISGL

SEQ ID NO: 722789 - protein, 9 aa, Homo Sapiens
SEVHEMKGR

SEQ ID NO: 722790 - protein, 9 aa, Homo Sapiens
PGCPTFFRV

SEQ ID NO: 722791 - protein, 9 aa, Homo Sapiens
PPPTPHPHP

SEQ ID NO: 722792 - protein, 9 aa, Homo Sapiens
CNTLRYSII

SEQ ID NO: 722793 - protein, 9 aa, Homo Sapiens
FPVRHAAAI

SEQ ID NO: 722794 - protein, 9 aa, Homo Sapiens
LLLACTGTW

SEQ ID NO: 722795 - protein, 9 aa, Homo Sapiens
LKFIYEGSF

SEQ ID NO: 722796 - protein, 9 aa, Homo Sapiens
GVYDNIGIQ

SEQ ID NO: 722797 - protein, 9 aa, Homo Sapiens
SGETVINNA

SEQ ID NO: 722798 - protein, 9 aa, Homo Sapiens
NRELMESFD

SEQ ID NO: 722799 - protein, 9 aa, Homo Sapiens
KSRSLLPLS

SEQ ID NO: 722800 - protein, 9 aa, Homo Sapiens
GGRPGKAGP

SEQ ID NO: 722801 - protein, 9 aa, Homo Sapiens
GGIFHRARG

SEQ ID NO: 722802 - protein, 9 aa, Homo Sapiens
AGSSPSQSR

SEQ ID NO: 722803 - protein, 9 aa, Homo Sapiens
AGLSVLNVH

SEQ ID NO: 722804 - protein, 9 aa, Homo Sapiens
CCSLFLNSN

SEQ ID NO: 722805 - protein, 9 aa, Homo Sapiens
FLPFLLLVA

SEQ ID NO: 722806 - protein, 9 aa, Homo Sapiens
GFSTPATSL

SEQ ID NO: 722807 - protein, 9 aa, Homo Sapiens
NGCDLKFHI

SEQ ID NO: 722808 - protein, 9 aa, Homo Sapiens
CAALPGCDP

SEQ ID NO: 722809 - protein, 9 aa, Homo Sapiens
NSEISLSCK

SEQ ID NO: 722810 - protein, 9 aa, Homo Sapiens
VQKKVAKQT

SEQ ID NO: 722811 - protein, 9 aa, Homo Sapiens
KLPPQERIT

SEQ ID NO: 722812 - protein, 9 aa, Homo Sapiens
DAPGDELDN

SEQ ID NO: 722813 - protein, 9 aa, Homo Sapiens
CCMGSGKSK

SEQ ID NO: 722814 - protein, 9 aa, Homo Sapiens
FVIDSSSSV

SEQ ID NO: 722815 - protein, 9 aa, Homo Sapiens
ITIGNERLR

SEQ ID NO: 722816 - protein, 9 aa, Homo Sapiens
SWSPRPPRP

SEQ ID NO: 722817 - protein, 9 aa, Homo Sapiens
EHSSRLKAE

SEQ ID NO: 722818 - protein, 9 aa, Homo Sapiens
CNPLRYTYV

SEQ ID NO: 722819 - protein, 9 aa, Homo Sapiens
NNCSDESLC

SEQ ID NO: 722820 - protein, 9 aa, Homo Sapiens
TSQSEAMVV

SEQ ID NO: 722821 - protein, 9 aa, Homo Sapiens
TISAQMEVT

SEQ ID NO: 722822 - protein, 9 aa, Homo Sapiens
RRPSPPRDV

SEQ ID NO: 722823 - protein, 9 aa, Homo Sapiens
GLGLKHFCK

SEQ ID NO: 722824 - protein, 9 aa, Homo Sapiens
LCKYCTKVL

SEQ ID NO: 722825 - protein, 9 aa, Homo Sapiens
PPKIDTTVT

SEQ ID NO: 722826 - protein, 9 aa, Homo Sapiens
QPSSVVVVT

SEQ ID NO: 722827 - protein, 9 aa, Homo Sapiens
LEEISYYFP

SEQ ID NO: 722828 - protein, 9 aa, Homo Sapiens
REKKCHEKA

SEQ ID NO: 722829 - protein, 9 aa, Homo Sapiens
VVVVTWESV

SEQ ID NO: 722830 - protein, 9 aa, Homo Sapiens
RLYTDKLKN

SEQ ID NO: 722831 - protein, 9 aa, Homo Sapiens
CNKADVQAF

SEQ ID NO: 722832 - protein, 9 aa, Homo Sapiens
WPMLQMKLK

SEQ ID NO: 722833 - protein, 9 aa, Homo Sapiens
SYGEDYFRL

SEQ ID NO: 722834 - protein, 9 aa, Homo Sapiens
TVRKTLPAD

SEQ ID NO: 722835 - protein, 9 aa, Homo Sapiens
LKTYFEEEE

SEQ ID NO: 722836 - protein, 9 aa, Homo Sapiens
NLIVHFQEN

SEQ ID NO: 722837 - protein, 9 aa, Homo Sapiens
DEIAKMNHS

SEQ ID NO: 722838 - protein, 9 aa, Homo Sapiens
PPHDAPGPP

SEQ ID NO: 722839 - protein, 9 aa, Homo Sapiens
QKITTLALT

SEQ ID NO: 722840 - protein, 9 aa, Homo Sapiens
RHRPEASPV

SEQ ID NO: 722841 - protein, 9 aa, Homo Sapiens
EKSPPAAPT

SEQ ID NO: 722842 - protein, 9 aa, Homo Sapiens
SDPSLDVLH

SEQ ID NO: 722843 - protein, 9 aa, Homo Sapiens
NQVQRSVGS

SEQ ID NO: 722844 - protein, 9 aa, Homo Sapiens
ALWPMLQMK

SEQ ID NO: 722845 - protein, 9 aa, Homo Sapiens
HTIPHFTDN

SEQ ID NO: 722846 - protein, 9 aa, Homo Sapiens
SCVLPLKML

SEQ ID NO: 722847 - protein, 9 aa, Homo Sapiens
SEVLSGCPE

SEQ ID NO: 722848 - protein, 9 aa, Homo Sapiens
DYFRPPPKR

SEQ ID NO: 722849 - protein, 9 aa, Homo Sapiens
NLPQEQLIE

SEQ ID NO: 722850 - protein, 9 aa, Homo Sapiens
NNQSLTRQK

SEQ ID NO: 722851 - protein, 9 aa, Homo Sapiens
ISCYRGYLP

SEQ ID NO: 722852 - protein, 9 aa, Homo Sapiens
IGKHPASDS

SEQ ID NO: 722853 - protein, 9 aa, Homo Sapiens
IIGIAICIV

SEQ ID NO: 722854 - protein, 9 aa, Homo Sapiens
KKIDPVHYP

SEQ ID NO: 722855 - protein, 9 aa, Homo Sapiens
SWYFGRTWQ

SEQ ID NO: 722856 - protein, 9 aa, Homo Sapiens
DRFSGDDVI

SEQ ID NO: 722857 - protein, 9 aa, Homo Sapiens
GKIFRHKFS

SEQ ID NO: 722858 - protein, 9 aa, Homo Sapiens
HFGATGKLD

SEQ ID NO: 722859 - protein, 9 aa, Homo Sapiens
MEVTVTVTS

SEQ ID NO: 722860 - protein, 9 aa, Homo Sapiens
LRAAVVIST

SEQ ID NO: 722861 - protein, 9 aa, Homo Sapiens
QGTSVPASG

SEQ ID NO: 722862 - protein, 9 aa, Homo Sapiens
RRMEGNMPN

SEQ ID NO: 722863 - protein, 9 aa, Homo Sapiens
GRRPSPPRD

SEQ ID NO: 722864 - protein, 9 aa, Homo Sapiens
SSSSVRPFE

SEQ ID NO: 722865 - protein, 9 aa, Homo Sapiens
NRVEHPIRV

SEQ ID NO: 722866 - protein, 9 aa, Homo Sapiens
DWIPDMQID

SEQ ID NO: 722867 - protein, 9 aa, Homo Sapiens
FPLLPSGII

SEQ ID NO: 722868 - protein, 9 aa, Homo Sapiens
PNGREKKCH

SEQ ID NO: 722869 - protein, 9 aa, Homo Sapiens
AFETIYPNI

SEQ ID NO: 722870 - protein, 9 aa, Homo Sapiens
KKSRLVVED

SEQ ID NO: 722871 - protein, 9 aa, Homo Sapiens
SLAHRPQSS

SEQ ID NO: 722872 - protein, 9 aa, Homo Sapiens
TLLAKGSPQ

SEQ ID NO: 722873 - protein, 9 aa, Homo Sapiens
DEWGGYPPV

SEQ ID NO: 722874 - protein, 9 aa, Homo Sapiens
RKEIEDWIS

SEQ ID NO: 722875 - protein, 9 aa, Homo Sapiens
QQGLAEVDV

SEQ ID NO: 722876 - protein, 9 aa, Homo Sapiens
ATPLSLTVT

SEQ ID NO: 722877 - protein, 9 aa, Homo Sapiens
WGDHCELCP

SEQ ID NO: 722878 - protein, 9 aa, Homo Sapiens
EPRYTYRIC

SEQ ID NO: 722879 - protein, 9 aa, Homo Sapiens
LDSADIETY

SEQ ID NO: 722880 - protein, 9 aa, Homo Sapiens
RSRDAFHEI

SEQ ID NO: 722881 - protein, 9 aa, Homo Sapiens
ARVPRLPEK

SEQ ID NO: 722882 - protein, 9 aa, Homo Sapiens
RLGAVSSAE

SEQ ID NO: 722883 - protein, 9 aa, Homo Sapiens
SPAPVRHRP

SEQ ID NO: 722884 - protein, 9 aa, Homo Sapiens
VLGTAIVES

SEQ ID NO: 722885 - protein, 9 aa, Homo Sapiens
MLAFVGENA

SEQ ID NO: 722886 - protein, 9 aa, Homo Sapiens
NQSLTRQKM

SEQ ID NO: 722887 - protein, 9 aa, Homo Sapiens
GHVFHLENG

SEQ ID NO: 722888 - protein, 9 aa, Homo Sapiens
LHHRHSLHQ

SEQ ID NO: 722889 - protein, 9 aa, Homo Sapiens
PPPNPQVNQ

SEQ ID NO: 722890 - protein, 9 aa, Homo Sapiens
ANVQSRDDG

SEQ ID NO: 722891 - protein, 9 aa, Homo Sapiens
LAEELSCCI

SEQ ID NO: 722892 - protein, 9 aa, Homo Sapiens
KESRITQEL

SEQ ID NO: 722893 - protein, 9 aa, Homo Sapiens
RPLQAPLCT

SEQ ID NO: 722894 - protein, 9 aa, Homo Sapiens
VYDNIGIQG

SEQ ID NO: 722895 - protein, 9 aa, Homo Sapiens
DNCCGINGP

SEQ ID NO: 722896 - protein, 9 aa, Homo Sapiens
QKNGQWLGT

SEQ ID NO: 722897 - protein, 9 aa, Homo Sapiens
LDAAGRGSG

SEQ ID NO: 722898 - protein, 9 aa, Homo Sapiens
QTTQPEATE

SEQ ID NO: 722899 - protein, 9 aa, Homo Sapiens
GRAESDPSL

SEQ ID NO: 722900 - protein, 9 aa, Homo Sapiens
PHNATNPGV

SEQ ID NO: 722901 - protein, 9 aa, Homo Sapiens
QSAIDLLQW

SEQ ID NO: 722902 - protein, 9 aa, Homo Sapiens
AHEALYSVT

SEQ ID NO: 722903 - protein, 9 aa, Homo Sapiens
RPPEPEKSP

SEQ ID NO: 722904 - protein, 9 aa, Homo Sapiens
SPLSAPPRP

SEQ ID NO: 722905 - protein, 9 aa, Homo Sapiens
VIGSFHVTL

SEQ ID NO: 722906 - protein, 9 aa, Homo Sapiens
SCAAYKEAL

SEQ ID NO: 722907 - protein, 9 aa, Homo Sapiens
PLPELCNKA

SEQ ID NO: 722908 - protein, 9 aa, Homo Sapiens
LSIFDPAPF

SEQ ID NO: 722909 - protein, 9 aa, Homo Sapiens
TGSSEEYRC

SEQ ID NO: 722910 - protein, 9 aa, Homo Sapiens
PGCSLKEKE

SEQ ID NO: 722911 - protein, 9 aa, Homo Sapiens
RYTYRICLV

SEQ ID NO: 722912 - protein, 9 aa, Homo Sapiens
EEQKDKLEE

SEQ ID NO: 722913 - protein, 9 aa, Homo Sapiens
DLTQIAGYG

SEQ ID NO: 722914 - protein, 9 aa, Homo Sapiens
CLKESTAKQ

SEQ ID NO: 722915 - protein, 9 aa, Homo Sapiens
SPAIPRLPQ

SEQ ID NO: 722916 - protein, 9 aa, Homo Sapiens
QSNPYGGGG

SEQ ID NO: 722917 - protein, 9 aa, Homo Sapiens
HCDNFGHNH

SEQ ID NO: 722918 - protein, 9 aa, Homo Sapiens
HICLKESTA

SEQ ID NO: 722919 - protein, 9 aa, Homo Sapiens
PRPLQAPLC

SEQ ID NO: 722920 - protein, 9 aa, Homo Sapiens
RWSYVRIYK

SEQ ID NO: 722921 - protein, 9 aa, Homo Sapiens
FRETRRRLR

SEQ ID NO: 722922 - protein, 9 aa, Homo Sapiens
GIVADDDRL

SEQ ID NO: 722923 - protein, 9 aa, Homo Sapiens
VRERAFHLA

SEQ ID NO: 722924 - protein, 9 aa, Homo Sapiens
ARLCVAQFR

SEQ ID NO: 722925 - protein, 9 aa, Homo Sapiens
EKGKASPCI

SEQ ID NO: 722926 - protein, 9 aa, Homo Sapiens
WRVSIPNSA

SEQ ID NO: 722927 - protein, 9 aa, Homo Sapiens
ILINTFNLA

SEQ ID NO: 722928 - protein, 9 aa, Homo Sapiens
YLLSPELTH

SEQ ID NO: 722929 - protein, 9 aa, Homo Sapiens
LPLWSWSPR

SEQ ID NO: 722930 - protein, 9 aa, Homo Sapiens
TQWAALNHL

SEQ ID NO: 722931 - protein, 9 aa, Homo Sapiens
LNLKILHIL

SEQ ID NO: 722932 - protein, 9 aa, Homo Sapiens
DYMGQKALQ

SEQ ID NO: 722933 - protein, 9 aa, Homo Sapiens
DLVTVACEA

SEQ ID NO: 722934 - protein, 9 aa, Homo Sapiens
LSTNETQVV

SEQ ID NO: 722935 - protein, 9 aa, Homo Sapiens
LGDPGAPGV

SEQ ID NO: 722936 - protein, 9 aa, Homo Sapiens
CLPFCGPNV

SEQ ID NO: 722937 - protein, 9 aa, Homo Sapiens
SVGQHKYDV

SEQ ID NO: 722938 - protein, 9 aa, Homo Sapiens
QTVHTGSKL

SEQ ID NO: 722939 - protein, 9 aa, Homo Sapiens
VVRNEGGVV

SEQ ID NO: 722940 - protein, 9 aa, Homo Sapiens
FRKNASISV

SEQ ID NO: 722941 - protein, 9 aa, Homo Sapiens
AWVRGTWPQ

SEQ ID NO: 722942 - protein, 9 aa, Homo Sapiens
LGKTSERFF

SEQ ID NO: 722943 - protein, 9 aa, Homo Sapiens
EWPLLRKQV

SEQ ID NO: 722944 - protein, 9 aa, Homo Sapiens
ERPCKCSEC

SEQ ID NO: 722945 - protein, 9 aa, Homo Sapiens
YNAYPSYPG

SEQ ID NO: 722946 - protein, 9 aa, Homo Sapiens
GILINTFNL

SEQ ID NO: 722947 - protein, 9 aa, Homo Sapiens
PPSDMQEES

SEQ ID NO: 722948 - protein, 9 aa, Homo Sapiens
PYGKLVSVL

SEQ ID NO: 722949 - protein, 9 aa, Homo Sapiens
EKDYEILLK

SEQ ID NO: 722950 - protein, 9 aa, Homo Sapiens
ETLSQGQVL

SEQ ID NO: 722951 - protein, 9 aa, Homo Sapiens
ISTLRSQEA

SEQ ID NO: 722952 - protein, 9 aa, Homo Sapiens
LLSSVEERS

SEQ ID NO: 722953 - protein, 9 aa, Homo Sapiens
TTVTTTPTP

SEQ ID NO: 722954 - protein, 9 aa, Homo Sapiens
MGGRHPSWP

SEQ ID NO: 722955 - protein, 9 aa, Homo Sapiens
YEAIMLGNL

SEQ ID NO: 722956 - protein, 9 aa, Homo Sapiens
VSNSDGYLT

SEQ ID NO: 722957 - protein, 9 aa, Homo Sapiens
MQLGLEDQR

SEQ ID NO: 722958 - protein, 9 aa, Homo Sapiens
PRKAPDTYL

SEQ ID NO: 722959 - protein, 9 aa, Homo Sapiens
GSFHVTLDS

SEQ ID NO: 722960 - protein, 9 aa, Homo Sapiens
STLHIAAFG

SEQ ID NO: 722961 - protein, 9 aa, Homo Sapiens
NGKRSSEEN

SEQ ID NO: 722962 - protein, 9 aa, Homo Sapiens
MTSNMLAFV

SEQ ID NO: 722963 - protein, 9 aa, Homo Sapiens
LPELCNKAD

SEQ ID NO: 722964 - protein, 9 aa, Homo Sapiens
GGSPAPVRH

SEQ ID NO: 722965 - protein, 9 aa, Homo Sapiens
LISLDLIYI

SEQ ID NO: 722966 - protein, 9 aa, Homo Sapiens
RRLRVEIHD

SEQ ID NO: 722967 - protein, 9 aa, Homo Sapiens
ESYDVKDTL

SEQ ID NO: 722968 - protein, 9 aa, Homo Sapiens
FSQLVESRN

SEQ ID NO: 722969 - protein, 9 aa, Homo Sapiens
VLTSQSEAM

SEQ ID NO: 722970 - protein, 9 aa, Homo Sapiens
RGWEGTQGA

SEQ ID NO: 722971 - protein, 9 aa, Homo Sapiens
QDLKGVEKV

SEQ ID NO: 722972 - protein, 9 aa, Homo Sapiens
ITKCEQTRP

SEQ ID NO: 722973 - protein, 9 aa, Homo Sapiens
WQFNLLTLV

SEQ ID NO: 722974 - protein, 9 aa, Homo Sapiens
GDQCCFQNG

SEQ ID NO: 722975 - protein, 9 aa, Homo Sapiens
SRNPALEPL

SEQ ID NO: 722976 - protein, 9 aa, Homo Sapiens
RPPPGGDTT

SEQ ID NO: 722977 - protein, 9 aa, Homo Sapiens
TLNQGMTVN

SEQ ID NO: 722978 - protein, 9 aa, Homo Sapiens
VQSGTRPRN

SEQ ID NO: 722979 - protein, 9 aa, Homo Sapiens
IIPLSKQKE

SEQ ID NO: 722980 - protein, 9 aa, Homo Sapiens
ESRNPALEP

SEQ ID NO: 722981 - protein, 9 aa, Homo Sapiens
SLMGMNMNI

SEQ ID NO: 722982 - protein, 9 aa, Homo Sapiens
VTQWAALNH

SEQ ID NO: 722983 - protein, 9 aa, Homo Sapiens
EHPNLPNHL

SEQ ID NO: 722984 - protein, 9 aa, Homo Sapiens
NKMWYPNGI

SEQ ID NO: 722985 - protein, 9 aa, Homo Sapiens
STSSTRITG

SEQ ID NO: 722986 - protein, 9 aa, Homo Sapiens
LQSLGDNEM

SEQ ID NO: 722987 - protein, 9 aa, Homo Sapiens
PGRLLYMAI

SEQ ID NO: 722988 - protein, 9 aa, Homo Sapiens
INLDSNSYD

SEQ ID NO: 722989 - protein, 9 aa, Homo Sapiens
SPSDMASTP

SEQ ID NO: 722990 - protein, 9 aa, Homo Sapiens
HRPQSSAPT

SEQ ID NO: 722991 - protein, 9 aa, Homo Sapiens
IVLGFPCNQ

SEQ ID NO: 722992 - protein, 9 aa, Homo Sapiens
EKLIQEITV

SEQ ID NO: 722993 - protein, 9 aa, Homo Sapiens
VSYDAKLLF

SEQ ID NO: 722994 - protein, 9 aa, Homo Sapiens
WALYLCAST

SEQ ID NO: 722995 - protein, 9 aa, Homo Sapiens
LHLQSQLAP

SEQ ID NO: 722996 - protein, 9 aa, Homo Sapiens
AKNLQSLGD

SEQ ID NO: 722997 - protein, 9 aa, Homo Sapiens
LIVLGFPCN

SEQ ID NO: 722998 - protein, 9 aa, Homo Sapiens
PNTYQLDYD

SEQ ID NO: 722999 - protein, 9 aa, Homo Sapiens
KDGQMMTAS

SEQ ID NO: 723000 - protein, 9 aa, Homo Sapiens
SGSRWRVSI

SEQ ID NO: 723001 - protein, 9 aa, Homo Sapiens
INAKLPPQE

SEQ ID NO: 723002 - protein, 9 aa, Homo Sapiens
WGPHWPLQP

SEQ ID NO: 723003 - protein, 9 aa, Homo Sapiens
ENFFKRLGS

SEQ ID NO: 723004 - protein, 9 aa, Homo Sapiens
ISHKLLLSR

SEQ ID NO: 723005 - protein, 9 aa, Homo Sapiens
YQLDYDVGE

SEQ ID NO: 723006 - protein, 9 aa, Homo Sapiens
SHANPLEPL

SEQ ID NO: 723007 - protein, 9 aa, Homo Sapiens
SPHHPSLVA

SEQ ID NO: 723008 - protein, 9 aa, Homo Sapiens
DSFRSRLNA

SEQ ID NO: 723009 - protein, 9 aa, Homo Sapiens
AALEFEDGI

SEQ ID NO: 723010 - protein, 9 aa, Homo Sapiens
DSNKTRTFQ

SEQ ID NO: 723011 - protein, 9 aa, Homo Sapiens
IWKASITSG

SEQ ID NO: 723012 - protein, 9 aa, Homo Sapiens
HADVNGLPT

SEQ ID NO: 723013 - protein, 9 aa, Homo Sapiens
HKKFWQENR

SEQ ID NO: 723014 - protein, 9 aa, Homo Sapiens
GGFPMVNNG

SEQ ID NO: 723015 - protein, 9 aa, Homo Sapiens
YANPALVRP

SEQ ID NO: 723016 - protein, 9 aa, Homo Sapiens
MESGRMSSI

SEQ ID NO: 723017 - protein, 9 aa, Homo Sapiens
LHKTVQRLV

SEQ ID NO: 723018 - protein, 9 aa, Homo Sapiens
RYEELPESV

SEQ ID NO: 723019 - protein, 9 aa, Homo Sapiens
KDKLEEILR

SEQ ID NO: 723020 - protein, 9 aa, Homo Sapiens
ALGQDCYTR

SEQ ID NO: 723021 - protein, 9 aa, Homo Sapiens
NVGHRSVGD

SEQ ID NO: 723022 - protein, 9 aa, Homo Sapiens
GQTAAYWVR

SEQ ID NO: 723023 - protein, 9 aa, Homo Sapiens
DKEAAKRAI

SEQ ID NO: 723024 - protein, 9 aa, Homo Sapiens
DPAPFKVTL

SEQ ID NO: 723025 - protein, 9 aa, Homo Sapiens
PRLMQKITT

SEQ ID NO: 723026 - protein, 9 aa, Homo Sapiens
LQPRTDSLL

SEQ ID NO: 723027 - protein, 9 aa, Homo Sapiens
SHATSSIVS

SEQ ID NO: 723028 - protein, 9 aa, Homo Sapiens
QSQCLRNLL

SEQ ID NO: 723029 - protein, 9 aa, Homo Sapiens
FVLRDQSAI

SEQ ID NO: 723030 - protein, 9 aa, Homo Sapiens
NREFFKGLF

SEQ ID NO: 723031 - protein, 9 aa, Homo Sapiens
SNSGPTRWQ

SEQ ID NO: 723032 - protein, 9 aa, Homo Sapiens
LAHTGRLVK

SEQ ID NO: 723033 - protein, 9 aa, Homo Sapiens
VIPALKQVR

SEQ ID NO: 723034 - protein, 9 aa, Homo Sapiens
QMDQDHSGS

SEQ ID NO: 723035 - protein, 9 aa, Homo Sapiens
GFSTNKNRC

SEQ ID NO: 723036 - protein, 9 aa, Homo Sapiens
GLFRQVRCF

SEQ ID NO: 723037 - protein, 9 aa, Homo Sapiens
VVSHEIGQQ

SEQ ID NO: 723038 - protein, 9 aa, Homo Sapiens
LGTVLLNAC

SEQ ID NO: 723039 - protein, 9 aa, Homo Sapiens
APAPSPWPW

SEQ ID NO: 723040 - protein, 9 aa, Homo Sapiens
VNGLPTPSA

SEQ ID NO: 723041 - protein, 9 aa, Homo Sapiens
FMAVCATVF

SEQ ID NO: 723042 - protein, 9 aa, Homo Sapiens
RAGRMGGRH

SEQ ID NO: 723043 - protein, 9 aa, Homo Sapiens
YANIMVLNI

SEQ ID NO: 723044 - protein, 9 aa, Homo Sapiens
YCCGLCKYC

SEQ ID NO: 723045 - protein, 9 aa, Homo Sapiens
SSEEYRCNE

SEQ ID NO: 723046 - protein, 9 aa, Homo Sapiens
ASRPGASPG

SEQ ID NO: 723047 - protein, 9 aa, Homo Sapiens
EIEDWISSL

SEQ ID NO: 723048 - protein, 9 aa, Homo Sapiens
CICLEPFKE

SEQ ID NO: 723049 - protein, 9 aa, Homo Sapiens
SPEARDAGS

SEQ ID NO: 723050 - protein, 9 aa, Homo Sapiens
KGEGGRPGK

SEQ ID NO: 723051 - protein, 9 aa, Homo Sapiens
CGPGGPGPQ

SEQ ID NO: 723052 - protein, 9 aa, Homo Sapiens
QAISLILVE

SEQ ID NO: 723053 - protein, 9 aa, Homo Sapiens
GCDPNHVTD

SEQ ID NO: 723054 - protein, 9 aa, Homo Sapiens
VLGMGVWVH

SEQ ID NO: 723055 - protein, 9 aa, Homo Sapiens
DDGSNSVAA

SEQ ID NO: 723056 - protein, 9 aa, Homo Sapiens
KHKLKTPPP

SEQ ID NO: 723057 - protein, 9 aa, Homo Sapiens
SDESLCKSA

SEQ ID NO: 723058 - protein, 9 aa, Homo Sapiens
ATAGVQPVF

SEQ ID NO: 723059 - protein, 9 aa, Homo Sapiens
CQQAKLPLP

SEQ ID NO: 723060 - protein, 9 aa, Homo Sapiens
TRWQDKFMY

SEQ ID NO: 723061 - protein, 9 aa, Homo Sapiens
AGPGLCRIG

SEQ ID NO: 723062 - protein, 9 aa, Homo Sapiens
ITVTWEEKL

SEQ ID NO: 723063 - protein, 9 aa, Homo Sapiens
SKLAVLLYT

SEQ ID NO: 723064 - protein, 9 aa, Homo Sapiens
ELIHCVLGP

SEQ ID NO: 723065 - protein, 9 aa, Homo Sapiens
SKAVNRLLG

SEQ ID NO: 723066 - protein, 9 aa, Homo Sapiens
LEQLQQLEN

SEQ ID NO: 723067 - protein, 9 aa, Homo Sapiens
ETLIKKRKS

SEQ ID NO: 723068 - protein, 9 aa, Homo Sapiens
SQSELDPAL

SEQ ID NO: 723069 - protein, 9 aa, Homo Sapiens
RCCPFIRAG

SEQ ID NO: 723070 - protein, 9 aa, Homo Sapiens
GQQGLAEVD

SEQ ID NO: 723071 - protein, 9 aa, Homo Sapiens
HCNMNINSL

SEQ ID NO: 723072 - protein, 9 aa, Homo Sapiens
EVEEEPEQK

SEQ ID NO: 723073 - protein, 9 aa, Homo Sapiens
GGDTTSRYP

SEQ ID NO: 723074 - protein, 9 aa, Homo Sapiens
SDANSFLIL

SEQ ID NO: 723075 - protein, 9 aa, Homo Sapiens
DGADDFKER

SEQ ID NO: 723076 - protein, 9 aa, Homo Sapiens
LTAEQPVFA

SEQ ID NO: 723077 - protein, 9 aa, Homo Sapiens
FPSWTTWVY

SEQ ID NO: 723078 - protein, 9 aa, Homo Sapiens
LTIFKVLLS

SEQ ID NO: 723079 - protein, 9 aa, Homo Sapiens
QLGQNIIAI

SEQ ID NO: 723080 - protein, 9 aa, Homo Sapiens
CCVAVYSLC

SEQ ID NO: 723081 - protein, 9 aa, Homo Sapiens
CFPCCMGSG

SEQ ID NO: 723082 - protein, 9 aa, Homo Sapiens
QGTTISAYV

SEQ ID NO: 723083 - protein, 9 aa, Homo Sapiens
TIGFENIAP

SEQ ID NO: 723084 - protein, 9 aa, Homo Sapiens
EIDFVISLL

SEQ ID NO: 723085 - protein, 9 aa, Homo Sapiens
EKPFTCEEY

SEQ ID NO: 723086 - protein, 9 aa, Homo Sapiens
RMCDWSKCS

SEQ ID NO: 723087 - protein, 9 aa, Homo Sapiens
QMSWLIRGV

SEQ ID NO: 723088 - protein, 9 aa, Homo Sapiens
CANCNHGFC

SEQ ID NO: 723089 - protein, 9 aa, Homo Sapiens
FIYEGSFDF

SEQ ID NO: 723090 - protein, 9 aa, Homo Sapiens
ACVQAIQSQ

SEQ ID NO: 723091 - protein, 9 aa, Homo Sapiens
LCAVHLPEP

SEQ ID NO: 723092 - protein, 9 aa, Homo Sapiens
HKDPTWSET

SEQ ID NO: 723093 - protein, 9 aa, Homo Sapiens
TVPLTCIVH

SEQ ID NO: 723094 - protein, 9 aa, Homo Sapiens
EVQKKVAKQ

SEQ ID NO: 723095 - protein, 9 aa, Homo Sapiens
QSTFTLDTS

SEQ ID NO: 723096 - protein, 9 aa, Homo Sapiens
GDRHSSPGT

SEQ ID NO: 723097 - protein, 9 aa, Homo Sapiens
WTTWVYSIN

SEQ ID NO: 723098 - protein, 9 aa, Homo Sapiens
AIASLWSSD

SEQ ID NO: 723099 - protein, 9 aa, Homo Sapiens
AALGLPQAL

SEQ ID NO: 723100 - protein, 9 aa, Homo Sapiens
LALKQSANG

SEQ ID NO: 723101 - protein, 9 aa, Homo Sapiens
AVNAFGESL

SEQ ID NO: 723102 - protein, 9 aa, Homo Sapiens
SPPVTQIIA

SEQ ID NO: 723103 - protein, 9 aa, Homo Sapiens
AYSTPQPPP

SEQ ID NO: 723104 - protein, 9 aa, Homo Sapiens
IVHFQENED

SEQ ID NO: 723105 - protein, 9 aa, Homo Sapiens
SGWMGRTGT

SEQ ID NO: 723106 - protein, 9 aa, Homo Sapiens
ESLCKSANK

SEQ ID NO: 723107 - protein, 9 aa, Homo Sapiens
VTFDLLDWP

SEQ ID NO: 723108 - protein, 9 aa, Homo Sapiens
SNSDGYLTS

SEQ ID NO: 723109 - protein, 9 aa, Homo Sapiens
RSRLNALVQ

SEQ ID NO: 723110 - protein, 9 aa, Homo Sapiens
LQIPPFRKC

SEQ ID NO: 723111 - protein, 9 aa, Homo Sapiens
CHGPYKAAI

SEQ ID NO: 723112 - protein, 9 aa, Homo Sapiens
VLVAFLDDG

SEQ ID NO: 723113 - protein, 9 aa, Homo Sapiens
SSTVSTGSI

SEQ ID NO: 723114 - protein, 9 aa, Homo Sapiens
NKLALVKQL

SEQ ID NO: 723115 - protein, 9 aa, Homo Sapiens
GILLHLQSQ

SEQ ID NO: 723116 - protein, 9 aa, Homo Sapiens
LASINFTYS

SEQ ID NO: 723117 - protein, 9 aa, Homo Sapiens
LPQALIPVQ

SEQ ID NO: 723118 - protein, 9 aa, Homo Sapiens
LPVYDAAAD

SEQ ID NO: 723119 - protein, 9 aa, Homo Sapiens
LSEKQEGAQ

SEQ ID NO: 723120 - protein, 9 aa, Homo Sapiens
LSHTIPHFT

SEQ ID NO: 723121 - protein, 9 aa, Homo Sapiens
AQLRIFKET

SEQ ID NO: 723122 - protein, 9 aa, Homo Sapiens
TFLMKGPNK

SEQ ID NO: 723123 - protein, 9 aa, Homo Sapiens
RPTFKKLVE

SEQ ID NO: 723124 - protein, 9 aa, Homo Sapiens
LPVGGAGAF

SEQ ID NO: 723125 - protein, 9 aa, Homo Sapiens
TSPSHQARP

SEQ ID NO: 723126 - protein, 9 aa, Homo Sapiens
SEGYQDLAS

SEQ ID NO: 723127 - protein, 9 aa, Homo Sapiens
MAECAHFRY

SEQ ID NO: 723128 - protein, 9 aa, Homo Sapiens
GDHADHLPP

SEQ ID NO: 723129 - protein, 9 aa, Homo Sapiens
WGGYPPVAK

SEQ ID NO: 723130 - protein, 9 aa, Homo Sapiens
LHMTCANCN

SEQ ID NO: 723131 - protein, 9 aa, Homo Sapiens
TSVDNEFKL

SEQ ID NO: 723132 - protein, 9 aa, Homo Sapiens
VAWLIFFCV

SEQ ID NO: 723133 - protein, 9 aa, Homo Sapiens
DNIGIQGNF

SEQ ID NO: 723134 - protein, 9 aa, Homo Sapiens
VDVMVGGHS

SEQ ID NO: 723135 - protein, 9 aa, Homo Sapiens
EFTFTKLNR

SEQ ID NO: 723136 - protein, 9 aa, Homo Sapiens
LLDSSILSA

SEQ ID NO: 723137 - protein, 9 aa, Homo Sapiens
LVLEPIPVA

SEQ ID NO: 723138 - protein, 9 aa, Homo Sapiens
QAQLRIFKE

SEQ ID NO: 723139 - protein, 9 aa, Homo Sapiens
QNKMWYPNG

SEQ ID NO: 723140 - protein, 9 aa, Homo Sapiens
NFGHNHSTS

SEQ ID NO: 723141 - protein, 9 aa, Homo Sapiens
TLRYSIIMN

SEQ ID NO: 723142 - protein, 9 aa, Homo Sapiens
VHDRNKLKN

SEQ ID NO: 723143 - protein, 9 aa, Homo Sapiens
GFIDSTSLF

SEQ ID NO: 723144 - protein, 9 aa, Homo Sapiens
STLNQGMTV

SEQ ID NO: 723145 - protein, 9 aa, Homo Sapiens
RRPRKAPDT

SEQ ID NO: 723146 - protein, 9 aa, Homo Sapiens
ELIELLDSS

SEQ ID NO: 723147 - protein, 9 aa, Homo Sapiens
ITRDDDSES

SEQ ID NO: 723148 - protein, 9 aa, Homo Sapiens
NDKALVEVE

SEQ ID NO: 723149 - protein, 9 aa, Homo Sapiens
AVVISTLRS

SEQ ID NO: 723150 - protein, 9 aa, Homo Sapiens
LLPSANYFC

SEQ ID NO: 723151 - protein, 9 aa, Homo Sapiens
TLTNQKRIH

SEQ ID NO: 723152 - protein, 9 aa, Homo Sapiens
PRNVVQGLY

SEQ ID NO: 723153 - protein, 9 aa, Homo Sapiens
TIGNVIGSF

SEQ ID NO: 723154 - protein, 9 aa, Homo Sapiens
PSDMASTPE

SEQ ID NO: 723155 - protein, 9 aa, Homo Sapiens
PRPAPCCPR

SEQ ID NO: 723156 - protein, 9 aa, Homo Sapiens
GGSIKQYDP

SEQ ID NO: 723157 - protein, 9 aa, Homo Sapiens
VLVGEGAEL

SEQ ID NO: 723158 - protein, 9 aa, Homo Sapiens
RPPTPLAYR

SEQ ID NO: 723159 - protein, 9 aa, Homo Sapiens
VEKMNSEIS

SEQ ID NO: 723160 - protein, 9 aa, Homo Sapiens
KADTPGGMQ

SEQ ID NO: 723161 - protein, 9 aa, Homo Sapiens
IPTQLFYCH

SEQ ID NO: 723162 - protein, 9 aa, Homo Sapiens
RTRRPSLVQ

SEQ ID NO: 723163 - protein, 9 aa, Homo Sapiens
NPALVRPHA

SEQ ID NO: 723164 - protein, 9 aa, Homo Sapiens
HHITFRRWK

SEQ ID NO: 723165 - protein, 9 aa, Homo Sapiens
SYPGYGGAA

SEQ ID NO: 723166 - protein, 9 aa, Homo Sapiens
EEFEKADTP

SEQ ID NO: 723167 - protein, 9 aa, Homo Sapiens
HYTKIMSLR

SEQ ID NO: 723168 - protein, 9 aa, Homo Sapiens
IQIKYNDYK

SEQ ID NO: 723169 - protein, 9 aa, Homo Sapiens
QTAPTMLRP

SEQ ID NO: 723170 - protein, 9 aa, Homo Sapiens
HPIRVGEIV

SEQ ID NO: 723171 - protein, 9 aa, Homo Sapiens
TGKLDSADI

SEQ ID NO: 723172 - protein, 9 aa, Homo Sapiens
VAIIGIAIC

SEQ ID NO: 723173 - protein, 9 aa, Homo Sapiens
SVTQWAALN

SEQ ID NO: 723174 - protein, 9 aa, Homo Sapiens
ILASINFTY

SEQ ID NO: 723175 - protein, 9 aa, Homo Sapiens
LGNYRVNTA

SEQ ID NO: 723176 - protein, 9 aa, Homo Sapiens
AYRAFSTFP

SEQ ID NO: 723177 - protein, 9 aa, Homo Sapiens
SFDFSCLPT

SEQ ID NO: 723178 - protein, 9 aa, Homo Sapiens
PRNQGLGIR

SEQ ID NO: 723179 - protein, 9 aa, Homo Sapiens
PQALIPVQL

SEQ ID NO: 723180 - protein, 9 aa, Homo Sapiens
SILPKSYPE

SEQ ID NO: 723181 - protein, 9 aa, Homo Sapiens
EGTVLPKSI

SEQ ID NO: 723182 - protein, 9 aa, Homo Sapiens
QSANGNKFE

SEQ ID NO: 723183 - protein, 9 aa, Homo Sapiens
VFFYHAIKS

SEQ ID NO: 723184 - protein, 9 aa, Homo Sapiens
IDSSSSVRP

SEQ ID NO: 723185 - protein, 9 aa, Homo Sapiens
KLTVEEALR

SEQ ID NO: 723186 - protein, 9 aa, Homo Sapiens
RGFTSQKSD

SEQ ID NO: 723187 - protein, 9 aa, Homo Sapiens
YLFCYVQSP

SEQ ID NO: 723188 - protein, 9 aa, Homo Sapiens
RPDNGEEAV

SEQ ID NO: 723189 - protein, 9 aa, Homo Sapiens
EDEPGLVKF

SEQ ID NO: 723190 - protein, 9 aa, Homo Sapiens
GLPTPSAQF

SEQ ID NO: 723191 - protein, 9 aa, Homo Sapiens
LLDWPPCLA

SEQ ID NO: 723192 - protein, 9 aa, Homo Sapiens
MQKITTLAL

SEQ ID NO: 723193 - protein, 9 aa, Homo Sapiens
CCGINGPSD

SEQ ID NO: 723194 - protein, 9 aa, Homo Sapiens
KQEGAQQTP

SEQ ID NO: 723195 - protein, 9 aa, Homo Sapiens
PCNRLYPEH

SEQ ID NO: 723196 - protein, 9 aa, Homo Sapiens
SCVFLAFVS

SEQ ID NO: 723197 - protein, 9 aa, Homo Sapiens
SKMDTTLEA

SEQ ID NO: 723198 - protein, 9 aa, Homo Sapiens
TPLTSFGEE

SEQ ID NO: 723199 - protein, 9 aa, Homo Sapiens
IDPVHYPSL

SEQ ID NO: 723200 - protein, 9 aa, Homo Sapiens
LKSEVHEMK

SEQ ID NO: 723201 - protein, 9 aa, Homo Sapiens
GGVSRGVIS

SEQ ID NO: 723202 - protein, 9 aa, Homo Sapiens
PQQALRAAS

SEQ ID NO: 723203 - protein, 9 aa, Homo Sapiens
PRPPACTTR

SEQ ID NO: 723204 - protein, 9 aa, Homo Sapiens
QEQLRNGSR

SEQ ID NO: 723205 - protein, 9 aa, Homo Sapiens
LSLYRGFTS

SEQ ID NO: 723206 - protein, 9 aa, Homo Sapiens
RWDPAHAGL

SEQ ID NO: 723207 - protein, 9 aa, Homo Sapiens
GRTYFFKDQ

SEQ ID NO: 723208 - protein, 9 aa, Homo Sapiens
ITGKLSKAG

SEQ ID NO: 723209 - protein, 9 aa, Homo Sapiens
PSPPRDVAI

SEQ ID NO: 723210 - protein, 9 aa, Homo Sapiens
PPFSGKYCK

SEQ ID NO: 723211 - protein, 9 aa, Homo Sapiens
YSLCPGERA

SEQ ID NO: 723212 - protein, 9 aa, Homo Sapiens
AIQIKYNDY

SEQ ID NO: 723213 - protein, 9 aa, Homo Sapiens
TTEVQKHIT

SEQ ID NO: 723214 - protein, 9 aa, Homo Sapiens
EVDVRLQEP

SEQ ID NO: 723215 - protein, 9 aa, Homo Sapiens
RGVISHVGD

SEQ ID NO: 723216 - protein, 9 aa, Homo Sapiens
ETAFETIYP

SEQ ID NO: 723217 - protein, 9 aa, Homo Sapiens
PLPKPLTPL

SEQ ID NO: 723218 - protein, 9 aa, Homo Sapiens
PEVSNSDGY

SEQ ID NO: 723219 - protein, 9 aa, Homo Sapiens
LHKKFWQEN

SEQ ID NO: 723220 - protein, 9 aa, Homo Sapiens
AKIMIRGIG

SEQ ID NO: 723221 - protein, 9 aa, Homo Sapiens
NLELLDLSS

SEQ ID NO: 723222 - protein, 9 aa, Homo Sapiens
RCLRMRPPR

SEQ ID NO: 723223 - protein, 9 aa, Homo Sapiens
YQDLASRQE

SEQ ID NO: 723224 - protein, 9 aa, Homo Sapiens
KLPLLFLRK

SEQ ID NO: 723225 - protein, 9 aa, Homo Sapiens
YAGKTPGTG

SEQ ID NO: 723226 - protein, 9 aa, Homo Sapiens
AKTPCTRLR

SEQ ID NO: 723227 - protein, 9 aa, Homo Sapiens
FMSVQRPRP

SEQ ID NO: 723228 - protein, 9 aa, Homo Sapiens
FSGKYCKEL

SEQ ID NO: 723229 - protein, 9 aa, Homo Sapiens
QTKLSIAGL

SEQ ID NO: 723230 - protein, 9 aa, Homo Sapiens
RLQPRTDSL

SEQ ID NO: 723231 - protein, 9 aa, Homo Sapiens
LMPQQREEK

SEQ ID NO: 723232 - protein, 9 aa, Homo Sapiens
CDPGQLLKL

SEQ ID NO: 723233 - protein, 9 aa, Homo Sapiens
EALYSVTGE

SEQ ID NO: 723234 - protein, 9 aa, Homo Sapiens
LNLWVTSFF

SEQ ID NO: 723235 - protein, 9 aa, Homo Sapiens
LEKKLPLLF

SEQ ID NO: 723236 - protein, 9 aa, Homo Sapiens
SAVQSLPYG

SEQ ID NO: 723237 - protein, 9 aa, Homo Sapiens
VIPNLPQLL

SEQ ID NO: 723238 - protein, 9 aa, Homo Sapiens
CSSFCPTTC

SEQ ID NO: 723239 - protein, 9 aa, Homo Sapiens
KATHPTSSS

SEQ ID NO: 723240 - protein, 9 aa, Homo Sapiens
TPIAFPQTP

SEQ ID NO: 723241 - protein, 9 aa, Homo Sapiens
GIGSVKEGK

SEQ ID NO: 723242 - protein, 9 aa, Homo Sapiens
PSNAIRIAN

SEQ ID NO: 723243 - protein, 9 aa, Homo Sapiens
PGQLLKLSC

SEQ ID NO: 723244 - protein, 9 aa, Homo Sapiens
EDEIAKMNH

SEQ ID NO: 723245 - protein, 9 aa, Homo Sapiens
GRILSSYAL

SEQ ID NO: 723246 - protein, 9 aa, Homo Sapiens
VVMLLNLEA

SEQ ID NO: 723247 - protein, 9 aa, Homo Sapiens
VKGLKLQEL

SEQ ID NO: 723248 - protein, 9 aa, Homo Sapiens
LTNIQDAIQ

SEQ ID NO: 723249 - protein, 9 aa, Homo Sapiens
YHREGFQRC

SEQ ID NO: 723250 - protein, 9 aa, Homo Sapiens
FIDSTSLFV

SEQ ID NO: 723251 - protein, 9 aa, Homo Sapiens
GTFFYSICL

SEQ ID NO: 723252 - protein, 9 aa, Homo Sapiens
EAPSLRPPP

SEQ ID NO: 723253 - protein, 9 aa, Homo Sapiens
KGALKEEQK

SEQ ID NO: 723254 - protein, 9 aa, Homo Sapiens
IQENLPEIT

SEQ ID NO: 723255 - protein, 9 aa, Homo Sapiens
MASTPENIR

SEQ ID NO: 723256 - protein, 9 aa, Homo Sapiens
PEETPVFMK

SEQ ID NO: 723257 - protein, 9 aa, Homo Sapiens
CKVQKECYN

SEQ ID NO: 723258 - protein, 9 aa, Homo Sapiens
ENKWVREYI

SEQ ID NO: 723259 - protein, 9 aa, Homo Sapiens
FFAVFMAVC

SEQ ID NO: 723260 - protein, 9 aa, Homo Sapiens
FKELFENAG

SEQ ID NO: 723261 - protein, 9 aa, Homo Sapiens
FYATSCFSI

SEQ ID NO: 723262 - protein, 9 aa, Homo Sapiens
LLPCFLAVL

SEQ ID NO: 723263 - protein, 9 aa, Homo Sapiens
EVHKECVIK

SEQ ID NO: 723264 - protein, 9 aa, Homo Sapiens
RKQVEGRLA

SEQ ID NO: 723265 - protein, 9 aa, Homo Sapiens
PPPPQPPPL

SEQ ID NO: 723266 - protein, 9 aa, Homo Sapiens
QRRLLYGCD

SEQ ID NO: 723267 - protein, 9 aa, Homo Sapiens
TPEAPNREF

SEQ ID NO: 723268 - protein, 9 aa, Homo Sapiens
PPVTQIIAL

SEQ ID NO: 723269 - protein, 9 aa, Homo Sapiens
SEEYRCNEY

SEQ ID NO: 723270 - protein, 9 aa, Homo Sapiens
RDAGSPSGP

SEQ ID NO: 723271 - protein, 9 aa, Homo Sapiens
SVQRPRPYD

SEQ ID NO: 723272 - protein, 9 aa, Homo Sapiens
THRLFSAAY

SEQ ID NO: 723273 - protein, 9 aa, Homo Sapiens
GISHATSSI

SEQ ID NO: 723274 - protein, 9 aa, Homo Sapiens
LREHRPDNG

SEQ ID NO: 723275 - protein, 9 aa, Homo Sapiens
PNFWNPPTT

SEQ ID NO: 723276 - protein, 9 aa, Homo Sapiens
FSNLPQEQL

SEQ ID NO: 723277 - protein, 9 aa, Homo Sapiens
PAMAGPHYP

SEQ ID NO: 723278 - protein, 9 aa, Homo Sapiens
LERESEFWN

SEQ ID NO: 723279 - protein, 9 aa, Homo Sapiens
DPNSPEETP

SEQ ID NO: 723280 - protein, 9 aa, Homo Sapiens
GCVSEHRLK

SEQ ID NO: 723281 - protein, 9 aa, Homo Sapiens
FGHNHSTSQ

SEQ ID NO: 723282 - protein, 9 aa, Homo Sapiens
IFGMLSQVS

SEQ ID NO: 723283 - protein, 9 aa, Homo Sapiens
HFCKPLVEV

SEQ ID NO: 723284 - protein, 9 aa, Homo Sapiens
AAGRGSGSG

SEQ ID NO: 723285 - protein, 9 aa, Homo Sapiens
ARDATSCSL

SEQ ID NO: 723286 - protein, 9 aa, Homo Sapiens
QIQAKTKNG

SEQ ID NO: 723287 - protein, 9 aa, Homo Sapiens
IFRHKFSLT

SEQ ID NO: 723288 - protein, 9 aa, Homo Sapiens
HCGSLKKQS

SEQ ID NO: 723289 - protein, 9 aa, Homo Sapiens
DANSFLILF

SEQ ID NO: 723290 - protein, 9 aa, Homo Sapiens
LPESVEEYV

SEQ ID NO: 723291 - protein, 9 aa, Homo Sapiens
NPLRYTYVL

SEQ ID NO: 723292 - protein, 9 aa, Homo Sapiens
IPDMQIDPN

SEQ ID NO: 723293 - protein, 9 aa, Homo Sapiens
VVAALGQDC

SEQ ID NO: 723294 - protein, 9 aa, Homo Sapiens
IVVILSAMV

SEQ ID NO: 723295 - protein, 9 aa, Homo Sapiens
TESPRFLLE

SEQ ID NO: 723296 - protein, 9 aa, Homo Sapiens
PPRGDQCCF

SEQ ID NO: 723297 - protein, 9 aa, Homo Sapiens
ARLQPRTDS

SEQ ID NO: 723298 - protein, 9 aa, Homo Sapiens
LRFVIELLE

SEQ ID NO: 723299 - protein, 9 aa, Homo Sapiens
LEKFSTEFY

SEQ ID NO: 723300 - protein, 9 aa, Homo Sapiens
CLHMTCANC

SEQ ID NO: 723301 - protein, 9 aa, Homo Sapiens
YRGYLPSSM

SEQ ID NO: 723302 - protein, 9 aa, Homo Sapiens
WSNNVRASL

SEQ ID NO: 723303 - protein, 9 aa, Homo Sapiens
IGNVIGSFH

SEQ ID NO: 723304 - protein, 9 aa, Homo Sapiens
EHALQDAWQ

SEQ ID NO: 723305 - protein, 9 aa, Homo Sapiens
ENDSMKLGT

SEQ ID NO: 723306 - protein, 9 aa, Homo Sapiens
ISAYVAKSR

SEQ ID NO: 723307 - protein, 9 aa, Homo Sapiens
GHSGASSQS

SEQ ID NO: 723308 - protein, 9 aa, Homo Sapiens
DPRIGGVGV

SEQ ID NO: 723309 - protein, 9 aa, Homo Sapiens
ELTHRLFSA

SEQ ID NO: 723310 - protein, 9 aa, Homo Sapiens
QLIEWIKYS

SEQ ID NO: 723311 - protein, 9 aa, Homo Sapiens
ERPYPCPHC

SEQ ID NO: 723312 - protein, 9 aa, Homo Sapiens
DSENEDIGK

SEQ ID NO: 723313 - protein, 9 aa, Homo Sapiens
ICKKCKIWM

SEQ ID NO: 723314 - protein, 9 aa, Homo Sapiens
SGDLLEPDG

SEQ ID NO: 723315 - protein, 9 aa, Homo Sapiens
YCNPTFLMK

SEQ ID NO: 723316 - protein, 9 aa, Homo Sapiens
TKLSIAGLI

SEQ ID NO: 723317 - protein, 9 aa, Homo Sapiens
DPALSQAFQ

SEQ ID NO: 723318 - protein, 9 aa, Homo Sapiens
CKKTFALYR

SEQ ID NO: 723319 - protein, 9 aa, Homo Sapiens
DLDLLEDTD

SEQ ID NO: 723320 - protein, 9 aa, Homo Sapiens
KQHLHNVYE

SEQ ID NO: 723321 - protein, 9 aa, Homo Sapiens
ISYYFPLKT

SEQ ID NO: 723322 - protein, 9 aa, Homo Sapiens
RKVVKIMII

SEQ ID NO: 723323 - protein, 9 aa, Homo Sapiens
ETQVVRNEG

SEQ ID NO: 723324 - protein, 9 aa, Homo Sapiens
NEHLQLFFV

SEQ ID NO: 723325 - protein, 9 aa, Homo Sapiens
PVQADTLNL

SEQ ID NO: 723326 - protein, 9 aa, Homo Sapiens
VHDDCRRLF

SEQ ID NO: 723327 - protein, 9 aa, Homo Sapiens
TFNLAFYSF

SEQ ID NO: 723328 - protein, 9 aa, Homo Sapiens
QELWLEGNP

SEQ ID NO: 723329 - protein, 9 aa, Homo Sapiens
KLQELWLEG

SEQ ID NO: 723330 - protein, 9 aa, Homo Sapiens
DPGQLLKLS

SEQ ID NO: 723331 - protein, 9 aa, Homo Sapiens
DHLNSMNPT

SEQ ID NO: 723332 - protein, 9 aa, Homo Sapiens
PGSDLFTVQ

SEQ ID NO: 723333 - protein, 9 aa, Homo Sapiens
IIVILWESI

SEQ ID NO: 723334 - protein, 9 aa, Homo Sapiens
RPNRTSIVN

SEQ ID NO: 723335 - protein, 9 aa, Homo Sapiens
GRHPSWPWT

SEQ ID NO: 723336 - protein, 9 aa, Homo Sapiens
SESEIKMKI

SEQ ID NO: 723337 - protein, 9 aa, Homo Sapiens
AVSSAEAQD

SEQ ID NO: 723338 - protein, 9 aa, Homo Sapiens
SRGISHATS

SEQ ID NO: 723339 - protein, 9 aa, Homo Sapiens
ARDAGSPSG

SEQ ID NO: 723340 - protein, 9 aa, Homo Sapiens
LASRQELMA

SEQ ID NO: 723341 - protein, 9 aa, Homo Sapiens
EVLLSSVEE

SEQ ID NO: 723342 - protein, 9 aa, Homo Sapiens
DFHACASEV

SEQ ID NO: 723343 - protein, 9 aa, Homo Sapiens
AHFRYENVE

SEQ ID NO: 723344 - protein, 9 aa, Homo Sapiens
KYCKELDAC

SEQ ID NO: 723345 - protein, 9 aa, Homo Sapiens
EKEKQHSQP

SEQ ID NO: 723346 - protein, 9 aa, Homo Sapiens
ESLKQLGEK

SEQ ID NO: 723347 - protein, 9 aa, Homo Sapiens
QALLERLGV

SEQ ID NO: 723348 - protein, 9 aa, Homo Sapiens
YGFSILPKS

SEQ ID NO: 723349 - protein, 9 aa, Homo Sapiens
YDEWKEGVA

SEQ ID NO: 723350 - protein, 9 aa, Homo Sapiens
ALLRFVIEL

SEQ ID NO: 723351 - protein, 9 aa, Homo Sapiens
DAGSPSGPS

SEQ ID NO: 723352 - protein, 9 aa, Homo Sapiens
RSYSACTND

SEQ ID NO: 723353 - protein, 9 aa, Homo Sapiens
HTKKKPLKY

SEQ ID NO: 723354 - protein, 9 aa, Homo Sapiens
PLVLKTYFE

SEQ ID NO: 723355 - protein, 9 aa, Homo Sapiens
VAQGSTGLY

SEQ ID NO: 723356 - protein, 9 aa, Homo Sapiens
TRSELKCSP

SEQ ID NO: 723357 - protein, 9 aa, Homo Sapiens
SLTSVVQTR

SEQ ID NO: 723358 - protein, 9 aa, Homo Sapiens
GRALARRST

SEQ ID NO: 723359 - protein, 9 aa, Homo Sapiens
QSPRDGSGL

SEQ ID NO: 723360 - protein, 9 aa, Homo Sapiens
TILSNRTVK

SEQ ID NO: 723361 - protein, 9 aa, Homo Sapiens
MVMETKTHN

SEQ ID NO: 723362 - protein, 9 aa, Homo Sapiens
GALPLRENV

SEQ ID NO: 723363 - protein, 9 aa, Homo Sapiens
ICNTLRYSI

SEQ ID NO: 723364 - protein, 9 aa, Homo Sapiens
DMKDAESVR

SEQ ID NO: 723365 - protein, 9 aa, Homo Sapiens
CLQGCGGSP

SEQ ID NO: 723366 - protein, 9 aa, Homo Sapiens
CGRSQDAPP

SEQ ID NO: 723367 - protein, 9 aa, Homo Sapiens
MSLASFAPQ

SEQ ID NO: 723368 - protein, 9 aa, Homo Sapiens
VQQLVTIKK

SEQ ID NO: 723369 - protein, 9 aa, Homo Sapiens
VASLPPSTT

SEQ ID NO: 723370 - protein, 9 aa, Homo Sapiens
SRPGASPGG

SEQ ID NO: 723371 - protein, 9 aa, Homo Sapiens
ASELLAEIN

SEQ ID NO: 723372 - protein, 9 aa, Homo Sapiens
WVRGTWPQQ

SEQ ID NO: 723373 - protein, 9 aa, Homo Sapiens
SKLSEIDVA

SEQ ID NO: 723374 - protein, 9 aa, Homo Sapiens
YLLSNLNIW

SEQ ID NO: 723375 - protein, 9 aa, Homo Sapiens
QPRPRRPRK

SEQ ID NO: 723376 - protein, 9 aa, Homo Sapiens
LCLQGCGGS

SEQ ID NO: 723377 - protein, 9 aa, Homo Sapiens
VHEMKGRTL

SEQ ID NO: 723378 - protein, 9 aa, Homo Sapiens
EEEEYPSEE

SEQ ID NO: 723379 - protein, 9 aa, Homo Sapiens
VTITAVNLS

SEQ ID NO: 723380 - protein, 9 aa, Homo Sapiens
FSNLTNLEL

SEQ ID NO: 723381 - protein, 9 aa, Homo Sapiens
SINFTYSLT

SEQ ID NO: 723382 - protein, 9 aa, Homo Sapiens
QKYADAVNN

SEQ ID NO: 723383 - protein, 9 aa, Homo Sapiens
IVTSVDGSQ

SEQ ID NO: 723384 - protein, 9 aa, Homo Sapiens
GIGTEGAKD

SEQ ID NO: 723385 - protein, 9 aa, Homo Sapiens
PLSCSVDEN

SEQ ID NO: 723386 - protein, 9 aa, Homo Sapiens
LLATALVAL

SEQ ID NO: 723387 - protein, 9 aa, Homo Sapiens
RELLQRVSR

SEQ ID NO: 723388 - protein, 9 aa, Homo Sapiens
SISLPMSCL

SEQ ID NO: 723389 - protein, 9 aa, Homo Sapiens
VDLDNTQEN

SEQ ID NO: 723390 - protein, 9 aa, Homo Sapiens
YCTKVLTSF

SEQ ID NO: 723391 - protein, 9 aa, Homo Sapiens
EKQHLHNVY

SEQ ID NO: 723392 - protein, 9 aa, Homo Sapiens
AVRSRDAFH

SEQ ID NO: 723393 - protein, 9 aa, Homo Sapiens
GPKSPIGHR

SEQ ID NO: 723394 - protein, 9 aa, Homo Sapiens
IFMYVRAAS

SEQ ID NO: 723395 - protein, 9 aa, Homo Sapiens
RPLSCSVDE

SEQ ID NO: 723396 - protein, 9 aa, Homo Sapiens
HAAAIYLKN

SEQ ID NO: 723397 - protein, 9 aa, Homo Sapiens
YGYNAYPSY

SEQ ID NO: 723398 - protein, 9 aa, Homo Sapiens
HLPEPLMWL

SEQ ID NO: 723399 - protein, 9 aa, Homo Sapiens
SGLSDEKYS

SEQ ID NO: 723400 - protein, 9 aa, Homo Sapiens
SLIREMRTR

SEQ ID NO: 723401 - protein, 9 aa, Homo Sapiens
DATSCSLSE

SEQ ID NO: 723402 - protein, 9 aa, Homo Sapiens
KLAVLLYTV

SEQ ID NO: 723403 - protein, 9 aa, Homo Sapiens
HKNLQLRKC

SEQ ID NO: 723404 - protein, 9 aa, Homo Sapiens
TITFCASSC

SEQ ID NO: 723405 - protein, 9 aa, Homo Sapiens
SIPPEKDSG

SEQ ID NO: 723406 - protein, 9 aa, Homo Sapiens
GSPSGPSGS

SEQ ID NO: 723407 - protein, 9 aa, Homo Sapiens
SPELTHRLF

SEQ ID NO: 723408 - protein, 9 aa, Homo Sapiens
GKKTVKSCE

SEQ ID NO: 723409 - protein, 9 aa, Homo Sapiens
SYYQHSSPV

SEQ ID NO: 723410 - protein, 9 aa, Homo Sapiens
HYILSLGGN

SEQ ID NO: 723411 - protein, 9 aa, Homo Sapiens
LFSKDTINA

SEQ ID NO: 723412 - protein, 9 aa, Homo Sapiens
VTVEKQENE

SEQ ID NO: 723413 - protein, 9 aa, Homo Sapiens
LSNRTVKSV

SEQ ID NO: 723414 - protein, 9 aa, Homo Sapiens
RLYHREGFQ

SEQ ID NO: 723415 - protein, 9 aa, Homo Sapiens
DTYPAVLVV

SEQ ID NO: 723416 - protein, 9 aa, Homo Sapiens
LEKALKLYF

SEQ ID NO: 723417 - protein, 9 aa, Homo Sapiens
PSLLAHTGR

SEQ ID NO: 723418 - protein, 9 aa, Homo Sapiens
ERCRLVLQE

SEQ ID NO: 723419 - protein, 9 aa, Homo Sapiens
DTINAETVL

SEQ ID NO: 723420 - protein, 9 aa, Homo Sapiens
DPSSLRLHF

SEQ ID NO: 723421 - protein, 9 aa, Homo Sapiens
TVINNANYH

SEQ ID NO: 723422 - protein, 9 aa, Homo Sapiens
VKIMIIVVM

SEQ ID NO: 723423 - protein, 9 aa, Homo Sapiens
VITVPIFAS

SEQ ID NO: 723424 - protein, 9 aa, Homo Sapiens
RREGAISSE

SEQ ID NO: 723425 - protein, 9 aa, Homo Sapiens
ALKQSANGN

SEQ ID NO: 723426 - protein, 9 aa, Homo Sapiens
EERSGAQDD

SEQ ID NO: 723427 - protein, 9 aa, Homo Sapiens
FFQCRRDFG

SEQ ID NO: 723428 - protein, 9 aa, Homo Sapiens
RKRYSEKVP

SEQ ID NO: 723429 - protein, 9 aa, Homo Sapiens
QKKVAKQTF

SEQ ID NO: 723430 - protein, 9 aa, Homo Sapiens
GLKLQELWL

SEQ ID NO: 723431 - protein, 9 aa, Homo Sapiens
VLSYKDRAN

SEQ ID NO: 723432 - protein, 9 aa, Homo Sapiens
LTTFAWEQG

SEQ ID NO: 723433 - protein, 9 aa, Homo Sapiens
SRLVVEDHL

SEQ ID NO: 723434 - protein, 9 aa, Homo Sapiens
GYMEKIKPI

SEQ ID NO: 723435 - protein, 9 aa, Homo Sapiens
IMIRGIGSV

SEQ ID NO: 723436 - protein, 9 aa, Homo Sapiens
GGTGPEGFR

SEQ ID NO: 723437 - protein, 9 aa, Homo Sapiens
DASLPNSGD

SEQ ID NO: 723438 - protein, 9 aa, Homo Sapiens
NMSNQVQRS

SEQ ID NO: 723439 - protein, 9 aa, Homo Sapiens
GSNSVAAEP

SEQ ID NO: 723440 - protein, 9 aa, Homo Sapiens
LRPTASTCL

SEQ ID NO: 723441 - protein, 9 aa, Homo Sapiens
KPIVRDGVY

SEQ ID NO: 723442 - protein, 9 aa, Homo Sapiens
ETLLAKGSP

SEQ ID NO: 723443 - protein, 9 aa, Homo Sapiens
LSCSVDENT

SEQ ID NO: 723444 - protein, 9 aa, Homo Sapiens
AVHADVFTI

SEQ ID NO: 723445 - protein, 9 aa, Homo Sapiens
DLDADMKDA

SEQ ID NO: 723446 - protein, 9 aa, Homo Sapiens
STLRSQEAC

SEQ ID NO: 723447 - protein, 9 aa, Homo Sapiens
SLDLCHGDR

SEQ ID NO: 723448 - protein, 9 aa, Homo Sapiens
RDGFNFKEL

SEQ ID NO: 723449 - protein, 9 aa, Homo Sapiens
FCFSTLVTP

SEQ ID NO: 723450 - protein, 9 aa, Homo Sapiens
VATAALCAV

SEQ ID NO: 723451 - protein, 9 aa, Homo Sapiens
RLPVYDAAA

SEQ ID NO: 723452 - protein, 9 aa, Homo Sapiens
RTDSLLRAL

SEQ ID NO: 723453 - protein, 9 aa, Homo Sapiens
ILLSQMSCS

SEQ ID NO: 723454 - protein, 9 aa, Homo Sapiens
TSASSWTVR

SEQ ID NO: 723455 - protein, 9 aa, Homo Sapiens
ERHSNVQCL

SEQ ID NO: 723456 - protein, 9 aa, Homo Sapiens
DSLLRALVA

SEQ ID NO: 723457 - protein, 9 aa, Homo Sapiens
DTLNLWVTS

SEQ ID NO: 723458 - protein, 9 aa, Homo Sapiens
NIIAVHADV

SEQ ID NO: 723459 - protein, 9 aa, Homo Sapiens
ILRKERGMN

SEQ ID NO: 723460 - protein, 9 aa, Homo Sapiens
IESGFHIEL

SEQ ID NO: 723461 - protein, 9 aa, Homo Sapiens
SGEPSQGDV

SEQ ID NO: 723462 - protein, 9 aa, Homo Sapiens
CCPFIRAGD

SEQ ID NO: 723463 - protein, 9 aa, Homo Sapiens
GLPVGGAGA

SEQ ID NO: 723464 - protein, 9 aa, Homo Sapiens
LPDQNQDMP

SEQ ID NO: 723465 - protein, 9 aa, Homo Sapiens
YILSLGGNG

SEQ ID NO: 723466 - protein, 9 aa, Homo Sapiens
VLPLDLMLT

SEQ ID NO: 723467 - protein, 9 aa, Homo Sapiens
ACTGTWVYE

SEQ ID NO: 723468 - protein, 9 aa, Homo Sapiens
QALLRFVIE

SEQ ID NO: 723469 - protein, 9 aa, Homo Sapiens
LDLCHGDRW

SEQ ID NO: 723470 - protein, 9 aa, Homo Sapiens
SILDRDDLN

SEQ ID NO: 723471 - protein, 9 aa, Homo Sapiens
DIPNTSIME

SEQ ID NO: 723472 - protein, 9 aa, Homo Sapiens
DGNFNSMRM

SEQ ID NO: 723473 - protein, 9 aa, Homo Sapiens
LCRISGLLL

SEQ ID NO: 723474 - protein, 9 aa, Homo Sapiens
DSGGRPSLC

SEQ ID NO: 723475 - protein, 9 aa, Homo Sapiens
KEEQKDKLE

SEQ ID NO: 723476 - protein, 9 aa, Homo Sapiens
RASSVGRCS

SEQ ID NO: 723477 - protein, 9 aa, Homo Sapiens
SDAEERGEH

SEQ ID NO: 723478 - protein, 9 aa, Homo Sapiens
RAESDPSLD

SEQ ID NO: 723479 - protein, 9 aa, Homo Sapiens
LKKIDPVHY

SEQ ID NO: 723480 - protein, 9 aa, Homo Sapiens
SLYRGFTSQ

SEQ ID NO: 723481 - protein, 9 aa, Homo Sapiens
RLARRLYHR

SEQ ID NO: 723482 - protein, 9 aa, Homo Sapiens
ISFRRCITQ

SEQ ID NO: 723483 - protein, 9 aa, Homo Sapiens
LEDLDLLED

SEQ ID NO: 723484 - protein, 9 aa, Homo Sapiens
GCPGQTAAY

SEQ ID NO: 723485 - protein, 9 aa, Homo Sapiens
SERFFFKQL

SEQ ID NO: 723486 - protein, 9 aa, Homo Sapiens
STENDSMKL

SEQ ID NO: 723487 - protein, 9 aa, Homo Sapiens
FALWPMLQM

SEQ ID NO: 723488 - protein, 9 aa, Homo Sapiens
PRVHQKLAI

SEQ ID NO: 723489 - protein, 9 aa, Homo Sapiens
YLSTENDSM

SEQ ID NO: 723490 - protein, 9 aa, Homo Sapiens
HISSFADLL

SEQ ID NO: 723491 - protein, 9 aa, Homo Sapiens
SVVQTRFRP

SEQ ID NO: 723492 - protein, 9 aa, Homo Sapiens
WPPCLAEGL

SEQ ID NO: 723493 - protein, 9 aa, Homo Sapiens
GAFDVCQLG

SEQ ID NO: 723494 - protein, 9 aa, Homo Sapiens
RLCVAQFRD

SEQ ID NO: 723495 - protein, 9 aa, Homo Sapiens
YYDIRLVAA

SEQ ID NO: 723496 - protein, 9 aa, Homo Sapiens
MKLKACTPR

SEQ ID NO: 723497 - protein, 9 aa, Homo Sapiens
VVEKMNSEI

SEQ ID NO: 723498 - protein, 9 aa, Homo Sapiens
ERQRRNDLL

SEQ ID NO: 723499 - protein, 9 aa, Homo Sapiens
RLSDSALIF

SEQ ID NO: 723500 - protein, 9 aa, Homo Sapiens
FYQQLNDLE

SEQ ID NO: 723501 - protein, 9 aa, Homo Sapiens
QLPEDYSIQ

SEQ ID NO: 723502 - protein, 9 aa, Homo Sapiens
PYPDIFLAC

SEQ ID NO: 723503 - protein, 9 aa, Homo Sapiens
CTPSPKRTS

SEQ ID NO: 723504 - protein, 9 aa, Homo Sapiens
VSIWAIVTS

SEQ ID NO: 723505 - protein, 9 aa, Homo Sapiens
LKEKEKQHS

SEQ ID NO: 723506 - protein, 9 aa, Homo Sapiens
VDEGLEAAQ

SEQ ID NO: 723507 - protein, 9 aa, Homo Sapiens
IPHFTDNCL

SEQ ID NO: 723508 - protein, 9 aa, Homo Sapiens
IGRCCVLGM

SEQ ID NO: 723509 - protein, 9 aa, Homo Sapiens
APPPTPHPH

SEQ ID NO: 723510 - protein, 9 aa, Homo Sapiens
RLRWWQPVF

SEQ ID NO: 723511 - protein, 9 aa, Homo Sapiens
TIVIRNKHG

SEQ ID NO: 723512 - protein, 9 aa, Homo Sapiens
LPRVHQKLA

SEQ ID NO: 723513 - protein, 9 aa, Homo Sapiens
VSALKSEVH

SEQ ID NO: 723514 - protein, 9 aa, Homo Sapiens
SEAMVVRAM

SEQ ID NO: 723515 - protein, 9 aa, Homo Sapiens
VFQDLKGVE

SEQ ID NO: 723516 - protein, 9 aa, Homo Sapiens
SEKQEGAQQ

SEQ ID NO: 723517 - protein, 9 aa, Homo Sapiens
DQNQDMPPH

SEQ ID NO: 723518 - protein, 9 aa, Homo Sapiens
KLAELEGAM

SEQ ID NO: 723519 - protein, 9 aa, Homo Sapiens
DSGLMALSK

SEQ ID NO: 723520 - protein, 9 aa, Homo Sapiens
KLQARLGAV

SEQ ID NO: 723521 - protein, 9 aa, Homo Sapiens
LRAPDPSPS

SEQ ID NO: 723522 - protein, 9 aa, Homo Sapiens
LLDLSSNKI

SEQ ID NO: 723523 - protein, 9 aa, Homo Sapiens
DRAGRMGGR

SEQ ID NO: 723524 - protein, 9 aa, Homo Sapiens
NPQVNQGTL

SEQ ID NO: 723525 - protein, 9 aa, Homo Sapiens
MERMQASLP

SEQ ID NO: 723526 - protein, 9 aa, Homo Sapiens
LERLGVGGR

SEQ ID NO: 723527 - protein, 9 aa, Homo Sapiens
CPGAEDGSV

SEQ ID NO: 723528 - protein, 9 aa, Homo Sapiens
REHRPDNGE

SEQ ID NO: 723529 - protein, 9 aa, Homo Sapiens
IDYYKETTN

SEQ ID NO: 723530 - protein, 9 aa, Homo Sapiens
LLFLRKVDQ

SEQ ID NO: 723531 - protein, 9 aa, Homo Sapiens
EVFHFHKAA

SEQ ID NO: 723532 - protein, 9 aa, Homo Sapiens
YSVTGEHCL

SEQ ID NO: 723533 - protein, 9 aa, Homo Sapiens
ASLPPSTTS

SEQ ID NO: 723534 - protein, 9 aa, Homo Sapiens
NNANYHDTS

SEQ ID NO: 723535 - protein, 9 aa, Homo Sapiens
LDLLEDTDF

SEQ ID NO: 723536 - protein, 9 aa, Homo Sapiens
DDFGPPQCK

SEQ ID NO: 723537 - protein, 9 aa, Homo Sapiens
AVYDRVAKL

SEQ ID NO: 723538 - protein, 9 aa, Homo Sapiens
NSPEETPVF

SEQ ID NO: 723539 - protein, 9 aa, Homo Sapiens
AKMRRFPAG

SEQ ID NO: 723540 - protein, 9 aa, Homo Sapiens
SLCKSANKY

SEQ ID NO: 723541 - protein, 9 aa, Homo Sapiens
AFDVCQLGT

SEQ ID NO: 723542 - protein, 9 aa, Homo Sapiens
MASGEHVTD

SEQ ID NO: 723543 - protein, 9 aa, Homo Sapiens
YLLFTKDNS

SEQ ID NO: 723544 - protein, 9 aa, Homo Sapiens
RSLLEGEDV

SEQ ID NO: 723545 - protein, 9 aa, Homo Sapiens
SSQSTFTLD

SEQ ID NO: 723546 - protein, 9 aa, Homo Sapiens
DAVWSLWKA

SEQ ID NO: 723547 - protein, 9 aa, Homo Sapiens
QDHSGSDSW

SEQ ID NO: 723548 - protein, 9 aa, Homo Sapiens
YVLSYKDRA

SEQ ID NO: 723549 - protein, 9 aa, Homo Sapiens
ERAFHLATF

SEQ ID NO: 723550 - protein, 9 aa, Homo Sapiens
ASYATGSSE

SEQ ID NO: 723551 - protein, 9 aa, Homo Sapiens
PPCLAEGLP

SEQ ID NO: 723552 - protein, 9 aa, Homo Sapiens
GFPCPREGH

SEQ ID NO: 723553 - protein, 9 aa, Homo Sapiens
INARWDAPG

SEQ ID NO: 723554 - protein, 9 aa, Homo Sapiens
NRTVKSVNA

SEQ ID NO: 723555 - protein, 9 aa, Homo Sapiens
RYKMDDAEV

SEQ ID NO: 723556 - protein, 9 aa, Homo Sapiens
TRRWNCIFM

SEQ ID NO: 723557 - protein, 9 aa, Homo Sapiens
SVVALTFMT

SEQ ID NO: 723558 - protein, 9 aa, Homo Sapiens
HLPQTAPTM

SEQ ID NO: 723559 - protein, 9 aa, Homo Sapiens
FHKAAEDLF

SEQ ID NO: 723560 - protein, 9 aa, Homo Sapiens
NYFCYENEL

SEQ ID NO: 723561 - protein, 9 aa, Homo Sapiens
MPVLAAQWT

SEQ ID NO: 723562 - protein, 9 aa, Homo Sapiens
SRTSSSCSC

SEQ ID NO: 723563 - protein, 9 aa, Homo Sapiens
ILNLKILHI

SEQ ID NO: 723564 - protein, 9 aa, Homo Sapiens
WARLQPRTD

SEQ ID NO: 723565 - protein, 9 aa, Homo Sapiens
DEGLEAAQR

SEQ ID NO: 723566 - protein, 9 aa, Homo Sapiens
PTQLFYCHK

SEQ ID NO: 723567 - protein, 9 aa, Homo Sapiens
KVRGVDVMV

SEQ ID NO: 723568 - protein, 9 aa, Homo Sapiens
FANEHLQLF

SEQ ID NO: 723569 - protein, 9 aa, Homo Sapiens
EKVPIHNAD

SEQ ID NO: 723570 - protein, 9 aa, Homo Sapiens
LPYGILLHL

SEQ ID NO: 723571 - protein, 9 aa, Homo Sapiens
LCWASTTRS

SEQ ID NO: 723572 - protein, 9 aa, Homo Sapiens
SRLLATALV

SEQ ID NO: 723573 - protein, 9 aa, Homo Sapiens
PLCTSAPAP

SEQ ID NO: 723574 - protein, 9 aa, Homo Sapiens
RDACVQAIQ

SEQ ID NO: 723575 - protein, 9 aa, Homo Sapiens
AGKSKLAVL

SEQ ID NO: 723576 - protein, 9 aa, Homo Sapiens
LKLLEDSKM

SEQ ID NO: 723577 - protein, 9 aa, Homo Sapiens
CSLKEKEKQ

SEQ ID NO: 723578 - protein, 9 aa, Homo Sapiens
EGLEAAQRI

SEQ ID NO: 723579 - protein, 9 aa, Homo Sapiens
SLLAHTGRL

SEQ ID NO: 723580 - protein, 9 aa, Homo Sapiens
DSESEIKMK

SEQ ID NO: 723581 - protein, 9 aa, Homo Sapiens
TLNLWVTSF

SEQ ID NO: 723582 - protein, 9 aa, Homo Sapiens
GHILLFVLF

SEQ ID NO: 723583 - protein, 9 aa, Homo Sapiens
PRLPQGSSL

SEQ ID NO: 723584 - protein, 9 aa, Homo Sapiens
TKCEQTRPK

SEQ ID NO: 723585 - protein, 9 aa, Homo Sapiens
QLQQLENAK

SEQ ID NO: 723586 - protein, 9 aa, Homo Sapiens
KRSSEENLP

SEQ ID NO: 723587 - protein, 9 aa, Homo Sapiens
PYSREEVRQ

SEQ ID NO: 723588 - protein, 9 aa, Homo Sapiens
TQCITKCEQ

SEQ ID NO: 723589 - protein, 9 aa, Homo Sapiens
HCPMPAAPV

SEQ ID NO: 723590 - protein, 9 aa, Homo Sapiens
VEKVLPLDL

SEQ ID NO: 723591 - protein, 9 aa, Homo Sapiens
FIRAGDYEG

SEQ ID NO: 723592 - protein, 9 aa, Homo Sapiens
MLHKKFWQE

SEQ ID NO: 723593 - protein, 9 aa, Homo Sapiens
GVPCNRLYP

SEQ ID NO: 723594 - protein, 9 aa, Homo Sapiens
QQPYFITNS

SEQ ID NO: 723595 - protein, 9 aa, Homo Sapiens
GDDVIGEVM

SEQ ID NO: 723596 - protein, 9 aa, Homo Sapiens
AWLNLSTIL

SEQ ID NO: 723597 - protein, 9 aa, Homo Sapiens
TLELGDWAL

SEQ ID NO: 723598 - protein, 9 aa, Homo Sapiens
PCLAEGLPV

SEQ ID NO: 723599 - protein, 9 aa, Homo Sapiens
VPLTCIVHC

SEQ ID NO: 723600 - protein, 9 aa, Homo Sapiens
PSYPGYGGA

SEQ ID NO: 723601 - protein, 9 aa, Homo Sapiens
IFMASGEHV

SEQ ID NO: 723602 - protein, 9 aa, Homo Sapiens
MQFFIGILD

SEQ ID NO: 723603 - protein, 9 aa, Homo Sapiens
RILSSYALK

SEQ ID NO: 723604 - protein, 9 aa, Homo Sapiens
PALVRPHAQ

SEQ ID NO: 723605 - protein, 9 aa, Homo Sapiens
QDDFGPPQC

SEQ ID NO: 723606 - protein, 9 aa, Homo Sapiens
EKLQALLRF

SEQ ID NO: 723607 - protein, 9 aa, Homo Sapiens
ALTAEVYFF

SEQ ID NO: 723608 - protein, 9 aa, Homo Sapiens
LLKSINGIL

SEQ ID NO: 723609 - protein, 9 aa, Homo Sapiens
GINGPSDWQ

SEQ ID NO: 723610 - protein, 9 aa, Homo Sapiens
NTAKPTGPP

SEQ ID NO: 723611 - protein, 9 aa, Homo Sapiens
ATQISLSVL

SEQ ID NO: 723612 - protein, 9 aa, Homo Sapiens
SYDVKDTLR

SEQ ID NO: 723613 - protein, 9 aa, Homo Sapiens
IYLIEKPMG

SEQ ID NO: 723614 - protein, 9 aa, Homo Sapiens
PQHHICLKE

SEQ ID NO: 723615 - protein, 9 aa, Homo Sapiens
LQASGDLLE

SEQ ID NO: 723616 - protein, 9 aa, Homo Sapiens
PTRIRFSDY

SEQ ID NO: 723617 - protein, 9 aa, Homo Sapiens
LRWWQPVFS

SEQ ID NO: 723618 - protein, 9 aa, Homo Sapiens
QPRTDSLLR

SEQ ID NO: 723619 - protein, 9 aa, Homo Sapiens
SNCLAEQMI

SEQ ID NO: 723620 - protein, 9 aa, Homo Sapiens
GNPNEEVSK

SEQ ID NO: 723621 - protein, 9 aa, Homo Sapiens
TLEIESGFH

SEQ ID NO: 723622 - protein, 9 aa, Homo Sapiens
GTEGAKDSY

SEQ ID NO: 723623 - protein, 9 aa, Homo Sapiens
QKRLNWVPR

SEQ ID NO: 723624 - protein, 9 aa, Homo Sapiens
LGAEGTVLP

SEQ ID NO: 723625 - protein, 9 aa, Homo Sapiens
TVPDTCVIV

SEQ ID NO: 723626 - protein, 9 aa, Homo Sapiens
TPPPGCQGQ

SEQ ID NO: 723627 - protein, 9 aa, Homo Sapiens
HKTVQRLVP

SEQ ID NO: 723628 - protein, 9 aa, Homo Sapiens
VMETKTHNQ

SEQ ID NO: 723629 - protein, 9 aa, Homo Sapiens
SSPGTKKPL

SEQ ID NO: 723630 - protein, 9 aa, Homo Sapiens
VYEAIMLGN

SEQ ID NO: 723631 - protein, 9 aa, Homo Sapiens
MPQQREEKK

SEQ ID NO: 723632 - protein, 9 aa, Homo Sapiens
RSSTLTNQK

SEQ ID NO: 723633 - protein, 9 aa, Homo Sapiens
PNEEVSKFY

SEQ ID NO: 723634 - protein, 9 aa, Homo Sapiens
LSCAHLAGG

SEQ ID NO: 723635 - protein, 9 aa, Homo Sapiens
TTISAYVAK

SEQ ID NO: 723636 - protein, 9 aa, Homo Sapiens
QFNLLTLVE

SEQ ID NO: 723637 - protein, 9 aa, Homo Sapiens
LDHGAQIQA

SEQ ID NO: 723638 - protein, 9 aa, Homo Sapiens
GPTRWQDKF

SEQ ID NO: 723639 - protein, 9 aa, Homo Sapiens
RVSIPNSAV

SEQ ID NO: 723640 - protein, 9 aa, Homo Sapiens
LRPPPGGDT

SEQ ID NO: 723641 - protein, 9 aa, Homo Sapiens
ATRKGPAPV

SEQ ID NO: 723642 - protein, 9 aa, Homo Sapiens
NMLAFVGEN

SEQ ID NO: 723643 - protein, 9 aa, Homo Sapiens
HHLSFHVVL

SEQ ID NO: 723644 - protein, 9 aa, Homo Sapiens
TGPEGFRPF

SEQ ID NO: 723645 - protein, 9 aa, Homo Sapiens
LYRSSYLYQ

SEQ ID NO: 723646 - protein, 9 aa, Homo Sapiens
EKKCHEKAC

SEQ ID NO: 723647 - protein, 9 aa, Homo Sapiens
EERGEHALQ

SEQ ID NO: 723648 - protein, 9 aa, Homo Sapiens
PGAPLGLRL

SEQ ID NO: 723649 - protein, 9 aa, Homo Sapiens
YDNIGIQGN

SEQ ID NO: 723650 - protein, 9 aa, Homo Sapiens
MVLNILRKE

SEQ ID NO: 723651 - protein, 9 aa, Homo Sapiens
HLQSQLAPW

SEQ ID NO: 723652 - protein, 9 aa, Homo Sapiens
VRGTWPQQA

SEQ ID NO: 723653 - protein, 9 aa, Homo Sapiens
DVGGLSEPY

SEQ ID NO: 723654 - protein, 9 aa, Homo Sapiens
VVSCRNIGK

SEQ ID NO: 723655 - protein, 9 aa, Homo Sapiens
ECKKTFALY

SEQ ID NO: 723656 - protein, 9 aa, Homo Sapiens
EGPSAEGQQ

SEQ ID NO: 723657 - protein, 9 aa, Homo Sapiens
NLLMPQQRE

SEQ ID NO: 723658 - protein, 9 aa, Homo Sapiens
LTAALGLPQ

SEQ ID NO: 723659 - protein, 9 aa, Homo Sapiens
FGPPQCKSI

SEQ ID NO: 723660 - protein, 9 aa, Homo Sapiens
KIDPVHYPS

SEQ ID NO: 723661 - protein, 9 aa, Homo Sapiens
EILLKSING

SEQ ID NO: 723662 - protein, 9 aa, Homo Sapiens
KAPDTYLAQ

SEQ ID NO: 723663 - protein, 9 aa, Homo Sapiens
KEKIDFLLQ

SEQ ID NO: 723664 - protein, 9 aa, Homo Sapiens
ILLDHGAQI

SEQ ID NO: 723665 - protein, 9 aa, Homo Sapiens
MMNQSLMGM

SEQ ID NO: 723666 - protein, 9 aa, Homo Sapiens
GCGYTGLIN

SEQ ID NO: 723667 - protein, 9 aa, Homo Sapiens
GGSYSGAEV

SEQ ID NO: 723668 - protein, 9 aa, Homo Sapiens
VSDKEAAKR

SEQ ID NO: 723669 - protein, 9 aa, Homo Sapiens
DLLPKDEKL

SEQ ID NO: 723670 - protein, 9 aa, Homo Sapiens
EPEKSPPAA

SEQ ID NO: 723671 - protein, 9 aa, Homo Sapiens
VYGCGYTGL

SEQ ID NO: 723672 - protein, 9 aa, Homo Sapiens
GFNSVVMLL

SEQ ID NO: 723673 - protein, 9 aa, Homo Sapiens
ESIDRSMEN

SEQ ID NO: 723674 - protein, 9 aa, Homo Sapiens
ITQGTTISA

SEQ ID NO: 723675 - protein, 9 aa, Homo Sapiens
ITAVNLSVS

SEQ ID NO: 723676 - protein, 9 aa, Homo Sapiens
IEDEEEEYP

SEQ ID NO: 723677 - protein, 9 aa, Homo Sapiens
HADHLPPRG

SEQ ID NO: 723678 - protein, 9 aa, Homo Sapiens
KDAESVRNG

SEQ ID NO: 723679 - protein, 9 aa, Homo Sapiens
REFFKGLFG

SEQ ID NO: 723680 - protein, 9 aa, Homo Sapiens
AENRKEIED

SEQ ID NO: 723681 - protein, 9 aa, Homo Sapiens
DVQENRELM

SEQ ID NO: 723682 - protein, 9 aa, Homo Sapiens
LPPRGDQCC

SEQ ID NO: 723683 - protein, 9 aa, Homo Sapiens
CNRLYPEHR

SEQ ID NO: 723684 - protein, 9 aa, Homo Sapiens
CLFAWSHIL

SEQ ID NO: 723685 - protein, 9 aa, Homo Sapiens
GEDPIDYKC

SEQ ID NO: 723686 - protein, 9 aa, Homo Sapiens
TSVLFANEK

SEQ ID NO: 723687 - protein, 9 aa, Homo Sapiens
VTMETFTNL

SEQ ID NO: 723688 - protein, 9 aa, Homo Sapiens
LSVLFVTIT

SEQ ID NO: 723689 - protein, 9 aa, Homo Sapiens
WVIPALKQV

SEQ ID NO: 723690 - protein, 9 aa, Homo Sapiens
SCTPSPKRT

SEQ ID NO: 723691 - protein, 9 aa, Homo Sapiens
SVSDKEAAK

SEQ ID NO: 723692 - protein, 9 aa, Homo Sapiens
GMLSQVSEV

SEQ ID NO: 723693 - protein, 9 aa, Homo Sapiens
PASSPTWGP

SEQ ID NO: 723694 - protein, 9 aa, Homo Sapiens
AEERGEHAL

SEQ ID NO: 723695 - protein, 9 aa, Homo Sapiens
GDSTSSTRI

SEQ ID NO: 723696 - protein, 9 aa, Homo Sapiens
LKSINGILF

SEQ ID NO: 723697 - protein, 9 aa, Homo Sapiens
AVMAYDLYA

SEQ ID NO: 723698 - protein, 9 aa, Homo Sapiens
LKLQELWLE

SEQ ID NO: 723699 - protein, 9 aa, Homo Sapiens
SCYRGYLPS

SEQ ID NO: 723700 - protein, 9 aa, Homo Sapiens
QPETLSQGQ

SEQ ID NO: 723701 - protein, 9 aa, Homo Sapiens
QSVVIYYKI

SEQ ID NO: 723702 - protein, 9 aa, Homo Sapiens
PASHPLFGR

SEQ ID NO: 723703 - protein, 9 aa, Homo Sapiens
DFLLQVCSR

SEQ ID NO: 723704 - protein, 9 aa, Homo Sapiens
ATRQAISLI

SEQ ID NO: 723705 - protein, 9 aa, Homo Sapiens
TGRHKAFYT

SEQ ID NO: 723706 - protein, 9 aa, Homo Sapiens
EPSQGDVQP

SEQ ID NO: 723707 - protein, 9 aa, Homo Sapiens
VCMQTLTST

SEQ ID NO: 723708 - protein, 9 aa, Homo Sapiens
QKRPYGKLV

SEQ ID NO: 723709 - protein, 9 aa, Homo Sapiens
EKGSSSRAE

SEQ ID NO: 723710 - protein, 9 aa, Homo Sapiens
DAVNAFGES

SEQ ID NO: 723711 - protein, 9 aa, Homo Sapiens
DICKKCKIW

SEQ ID NO: 723712 - protein, 9 aa, Homo Sapiens
CVLGPQHLR

SEQ ID NO: 723713 - protein, 9 aa, Homo Sapiens
KLALVKQLD

SEQ ID NO: 723714 - protein, 9 aa, Homo Sapiens
RLVLEPIPV

SEQ ID NO: 723715 - protein, 9 aa, Homo Sapiens
QIAGYGLEG

SEQ ID NO: 723716 - protein, 9 aa, Homo Sapiens
GIFCFDLSI

SEQ ID NO: 723717 - protein, 9 aa, Homo Sapiens
LTVTLSMSA

SEQ ID NO: 723718 - protein, 9 aa, Homo Sapiens
ALRLLQLPQ

SEQ ID NO: 723719 - protein, 9 aa, Homo Sapiens
TLKDRLEDL

SEQ ID NO: 723720 - protein, 9 aa, Homo Sapiens
LPLRENVPR

SEQ ID NO: 723721 - protein, 9 aa, Homo Sapiens
EKEKKRKAE

SEQ ID NO: 723722 - protein, 9 aa, Homo Sapiens
VSFLQIPPF

SEQ ID NO: 723723 - protein, 9 aa, Homo Sapiens
AQEHSSRLK

SEQ ID NO: 723724 - protein, 9 aa, Homo Sapiens
PPQPPPLLP

SEQ ID NO: 723725 - protein, 9 aa, Homo Sapiens
HNNPANRPT

SEQ ID NO: 723726 - protein, 9 aa, Homo Sapiens
LQACIYLIE

SEQ ID NO: 723727 - protein, 9 aa, Homo Sapiens
YSQLGQNII

SEQ ID NO: 723728 - protein, 9 aa, Homo Sapiens
GLVTGSLTG

SEQ ID NO: 723729 - protein, 9 aa, Homo Sapiens
QSRMVARTQ

SEQ ID NO: 723730 - protein, 9 aa, Homo Sapiens
ENREAVLVA

SEQ ID NO: 723731 - protein, 9 aa, Homo Sapiens
YFRLYTDKL

SEQ ID NO: 723732 - protein, 9 aa, Homo Sapiens
GTGPEGFRP

SEQ ID NO: 723733 - protein, 9 aa, Homo Sapiens
FKLVCTFKN

SEQ ID NO: 723734 - protein, 9 aa, Homo Sapiens
SEAMATEEL

SEQ ID NO: 723735 - protein, 9 aa, Homo Sapiens
GKPVSPHHP

SEQ ID NO: 723736 - protein, 9 aa, Homo Sapiens
KGEYTYSLG

SEQ ID NO: 723737 - protein, 9 aa, Homo Sapiens
LGTWGALWP

SEQ ID NO: 723738 - protein, 9 aa, Homo Sapiens
MGFLEKALK

SEQ ID NO: 723739 - protein, 9 aa, Homo Sapiens
GYGFSILPK

SEQ ID NO: 723740 - protein, 9 aa, Homo Sapiens
ALPGCDPNH

SEQ ID NO: 723741 - protein, 9 aa, Homo Sapiens
FRRWKSCTA

SEQ ID NO: 723742 - protein, 9 aa, Homo Sapiens
NRRELLQRV

SEQ ID NO: 723743 - protein, 9 aa, Homo Sapiens
GMDLQACIY

SEQ ID NO: 723744 - protein, 9 aa, Homo Sapiens
GSHLDMERM

SEQ ID NO: 723745 - protein, 9 aa, Homo Sapiens
ALEEEDLEL

SEQ ID NO: 723746 - protein, 9 aa, Homo Sapiens
QAANTSCVL

SEQ ID NO: 723747 - protein, 9 aa, Homo Sapiens
GRCCVLGMG

SEQ ID NO: 723748 - protein, 9 aa, Homo Sapiens
DHADHLPPR

SEQ ID NO: 723749 - protein, 9 aa, Homo Sapiens
PTMLRPPPG

SEQ ID NO: 723750 - protein, 9 aa, Homo Sapiens
KPTGPPSES

SEQ ID NO: 723751 - protein, 9 aa, Homo Sapiens
DLDNTQENI

SEQ ID NO: 723752 - protein, 9 aa, Homo Sapiens
NCCGINGPS

SEQ ID NO: 723753 - protein, 9 aa, Homo Sapiens
DRLEDLKKV

SEQ ID NO: 723754 - protein, 9 aa, Homo Sapiens
VFTRSELKC

SEQ ID NO: 723755 - protein, 9 aa, Homo Sapiens
MTNLTAEQP

SEQ ID NO: 723756 - protein, 9 aa, Homo Sapiens
CSGVTSAMN

SEQ ID NO: 723757 - protein, 9 aa, Homo Sapiens
QSMHHLSFH

SEQ ID NO: 723758 - protein, 9 aa, Homo Sapiens
LQLPQILQI

SEQ ID NO: 723759 - protein, 9 aa, Homo Sapiens
TPLLFNAVS

SEQ ID NO: 723760 - protein, 9 aa, Homo Sapiens
KDEKLRHYF

SEQ ID NO: 723761 - protein, 9 aa, Homo Sapiens
NLAFYSFHH

SEQ ID NO: 723762 - protein, 9 aa, Homo Sapiens
MFITEEVEW

SEQ ID NO: 723763 - protein, 9 aa, Homo Sapiens
HPSLVATAA

SEQ ID NO: 723764 - protein, 9 aa, Homo Sapiens
CQKRLNWVP

SEQ ID NO: 723765 - protein, 9 aa, Homo Sapiens
TSRLLATAL

SEQ ID NO: 723766 - protein, 9 aa, Homo Sapiens
VLPLKMLRK

SEQ ID NO: 723767 - protein, 9 aa, Homo Sapiens
NIRQQPGMM

SEQ ID NO: 723768 - protein, 9 aa, Homo Sapiens
NCLAEQMIL

SEQ ID NO: 723769 - protein, 9 aa, Homo Sapiens
IQHTARKLF

SEQ ID NO: 723770 - protein, 9 aa, Homo Sapiens
SLSLTLRGR

SEQ ID NO: 723771 - protein, 9 aa, Homo Sapiens
FNETAFETI

SEQ ID NO: 723772 - protein, 9 aa, Homo Sapiens
RCCVLGMGV

SEQ ID NO: 723773 - protein, 9 aa, Homo Sapiens
IHQVELIHC

SEQ ID NO: 723774 - protein, 9 aa, Homo Sapiens
AAPAVSGLF

SEQ ID NO: 723775 - protein, 9 aa, Homo Sapiens
PERFLVSDR

SEQ ID NO: 723776 - protein, 9 aa, Homo Sapiens
ARNVTPNSY

SEQ ID NO: 723777 - protein, 9 aa, Homo Sapiens
STSPSHQAR

SEQ ID NO: 723778 - protein, 9 aa, Homo Sapiens
KCSPQWSHH

SEQ ID NO: 723779 - protein, 9 aa, Homo Sapiens
NLQSLGDNE

SEQ ID NO: 723780 - protein, 9 aa, Homo Sapiens
VIFRKNASI

SEQ ID NO: 723781 - protein, 9 aa, Homo Sapiens
DTCVIVCYV

SEQ ID NO: 723782 - protein, 9 aa, Homo Sapiens
WTQVGFSQL

SEQ ID NO: 723783 - protein, 9 aa, Homo Sapiens
VLNILRKER

SEQ ID NO: 723784 - protein, 9 aa, Homo Sapiens
CMGVMNRRP

SEQ ID NO: 723785 - protein, 9 aa, Homo Sapiens
LQSQLAPWP

SEQ ID NO: 723786 - protein, 9 aa, Homo Sapiens
SPSPSSSYA

SEQ ID NO: 723787 - protein, 9 aa, Homo Sapiens
RTVKSVNAS

SEQ ID NO: 723788 - protein, 9 aa, Homo Sapiens
KMTWTSPSC

SEQ ID NO: 723789 - protein, 9 aa, Homo Sapiens
SLGGNGHRC

SEQ ID NO: 723790 - protein, 9 aa, Homo Sapiens
DDPPCHDVG

SEQ ID NO: 723791 - protein, 9 aa, Homo Sapiens
FGNKTFPER

SEQ ID NO: 723792 - protein, 9 aa, Homo Sapiens
RKPILLSQM

SEQ ID NO: 723793 - protein, 9 aa, Homo Sapiens
HALQDAWQK

SEQ ID NO: 723794 - protein, 9 aa, Homo Sapiens
QTAAYWVRT

SEQ ID NO: 723795 - protein, 9 aa, Homo Sapiens
VVALTFMTE

SEQ ID NO: 723796 - protein, 9 aa, Homo Sapiens
QSELDPALS

SEQ ID NO: 723797 - protein, 9 aa, Homo Sapiens
LFSNFTGYV

SEQ ID NO: 723798 - protein, 9 aa, Homo Sapiens
ELLAEINKL

SEQ ID NO: 723799 - protein, 9 aa, Homo Sapiens
NPENKWVRE

SEQ ID NO: 723800 - protein, 9 aa, Homo Sapiens
PKLIPSSAS

SEQ ID NO: 723801 - protein, 9 aa, Homo Sapiens
QILFTVCLP

SEQ ID NO: 723802 - protein, 9 aa, Homo Sapiens
EYSYRTQID

SEQ ID NO: 723803 - protein, 9 aa, Homo Sapiens
GRTPIAFPQ

SEQ ID NO: 723804 - protein, 9 aa, Homo Sapiens
PPQQPYFIT

SEQ ID NO: 723805 - protein, 9 aa, Homo Sapiens
HKYDVTPLQ

SEQ ID NO: 723806 - protein, 9 aa, Homo Sapiens
FENIAPTTD

SEQ ID NO: 723807 - protein, 9 aa, Homo Sapiens
NRDIIPLSK

SEQ ID NO: 723808 - protein, 9 aa, Homo Sapiens
SKKHWDGEQ

SEQ ID NO: 723809 - protein, 9 aa, Homo Sapiens
HSPPVTQII

SEQ ID NO: 723810 - protein, 9 aa, Homo Sapiens
GNERLRCPE

SEQ ID NO: 723811 - protein, 9 aa, Homo Sapiens
SCSISCYRG

SEQ ID NO: 723812 - protein, 9 aa, Homo Sapiens
HSNVQCLPA

SEQ ID NO: 723813 - protein, 9 aa, Homo Sapiens
LVVHDRNKL

SEQ ID NO: 723814 - protein, 9 aa, Homo Sapiens
LLACTGTWV

SEQ ID NO: 723815 - protein, 9 aa, Homo Sapiens
EYTMIILAS

SEQ ID NO: 723816 - protein, 9 aa, Homo Sapiens
NHRLNPGAT

SEQ ID NO: 723817 - protein, 9 aa, Homo Sapiens
PRPSQPCSP

SEQ ID NO: 723818 - protein, 9 aa, Homo Sapiens
INWQDTAVL

SEQ ID NO: 723819 - protein, 9 aa, Homo Sapiens
EIFMASGEH

SEQ ID NO: 723820 - protein, 9 aa, Homo Sapiens
HRTSVLFAN

SEQ ID NO: 723821 - protein, 9 aa, Homo Sapiens
LGIRPSLEL

SEQ ID NO: 723822 - protein, 9 aa, Homo Sapiens
APASSPTWG

SEQ ID NO: 723823 - protein, 9 aa, Homo Sapiens
ELSCCICLE

SEQ ID NO: 723824 - protein, 9 aa, Homo Sapiens
DFVLRDQSA

SEQ ID NO: 723825 - protein, 9 aa, Homo Sapiens
KQSANGNKF

SEQ ID NO: 723826 - protein, 9 aa, Homo Sapiens
SQSTFTLDT

SEQ ID NO: 723827 - protein, 9 aa, Homo Sapiens
RGAGGSSSI

SEQ ID NO: 723828 - protein, 9 aa, Homo Sapiens
EVSQILKKI

SEQ ID NO: 723829 - protein, 9 aa, Homo Sapiens
KLSMQFFIG

SEQ ID NO: 723830 - protein, 9 aa, Homo Sapiens
KMDNEFTTK

SEQ ID NO: 723831 - protein, 9 aa, Homo Sapiens
SSPVAAMFI

SEQ ID NO: 723832 - protein, 9 aa, Homo Sapiens
PNGHYILSL

SEQ ID NO: 723833 - protein, 9 aa, Homo Sapiens
KRLSDSALI

SEQ ID NO: 723834 - protein, 9 aa, Homo Sapiens
SSCSISCYR

SEQ ID NO: 723835 - protein, 9 aa, Homo Sapiens
LKHKLKTPP

SEQ ID NO: 723836 - protein, 9 aa, Homo Sapiens
PLAYRAFST

SEQ ID NO: 723837 - protein, 9 aa, Homo Sapiens
AVQVPYGDL

SEQ ID NO: 723838 - protein, 9 aa, Homo Sapiens
PRDGSGLML

SEQ ID NO: 723839 - protein, 9 aa, Homo Sapiens
ASTPENIRD

SEQ ID NO: 723840 - protein, 9 aa, Homo Sapiens
LRLLQLPQI

SEQ ID NO: 723841 - protein, 9 aa, Homo Sapiens
PEDYSIQST

SEQ ID NO: 723842 - protein, 9 aa, Homo Sapiens
PLHYTKIMS

SEQ ID NO: 723843 - protein, 9 aa, Homo Sapiens
SSCMGVMNR

SEQ ID NO: 723844 - protein, 9 aa, Homo Sapiens
IPLPPKIDT

SEQ ID NO: 723845 - protein, 9 aa, Homo Sapiens
MGFSTPATS

SEQ ID NO: 723846 - protein, 9 aa, Homo Sapiens
KSKLAVLLY

SEQ ID NO: 723847 - protein, 9 aa, Homo Sapiens
LPNVTFDLL

SEQ ID NO: 723848 - protein, 9 aa, Homo Sapiens
EIIIEGKLV

SEQ ID NO: 723849 - protein, 9 aa, Homo Sapiens
DYEILLKSI

SEQ ID NO: 723850 - protein, 9 aa, Homo Sapiens
EKEHCSNCL

SEQ ID NO: 723851 - protein, 9 aa, Homo Sapiens
NFAFFKVLP

SEQ ID NO: 723852 - protein, 9 aa, Homo Sapiens
AGVQPVFSG

SEQ ID NO: 723853 - protein, 9 aa, Homo Sapiens
DEFTFTKLN

SEQ ID NO: 723854 - protein, 9 aa, Homo Sapiens
NSLAIPINK

SEQ ID NO: 723855 - protein, 9 aa, Homo Sapiens
TTALHDTDA

SEQ ID NO: 723856 - protein, 9 aa, Homo Sapiens
LAEVDVRLQ

SEQ ID NO: 723857 - protein, 9 aa, Homo Sapiens
GKVKGLKLQ

SEQ ID NO: 723858 - protein, 9 aa, Homo Sapiens
HKRRHTKKK

SEQ ID NO: 723859 - protein, 9 aa, Homo Sapiens
EAVLVAFLD

SEQ ID NO: 723860 - protein, 9 aa, Homo Sapiens
YFCYENELA

SEQ ID NO: 723861 - protein, 9 aa, Homo Sapiens
TEELSNLVN

SEQ ID NO: 723862 - protein, 9 aa, Homo Sapiens
YPPVAKMRR

SEQ ID NO: 723863 - protein, 9 aa, Homo Sapiens
ADAVNAFGE

SEQ ID NO: 723864 - protein, 9 aa, Homo Sapiens
ADAVNNFLD

SEQ ID NO: 723865 - protein, 9 aa, Homo Sapiens
TPCTRLRWW

SEQ ID NO: 723866 - protein, 9 aa, Homo Sapiens
AASGLAEDQ

SEQ ID NO: 723867 - protein, 9 aa, Homo Sapiens
PLCLIEAPE

SEQ ID NO: 723868 - protein, 9 aa, Homo Sapiens
GNFCWYLLS

SEQ ID NO: 723869 - protein, 9 aa, Homo Sapiens
GSSLRPTAS

SEQ ID NO: 723870 - protein, 9 aa, Homo Sapiens
LKLTVEEAL

SEQ ID NO: 723871 - protein, 9 aa, Homo Sapiens
VKNNWSNNV

SEQ ID NO: 723872 - protein, 9 aa, Homo Sapiens
WPGLPGDHA

SEQ ID NO: 723873 - protein, 9 aa, Homo Sapiens
IYANLGIGI

SEQ ID NO: 723874 - protein, 9 aa, Homo Sapiens
SSQISVPSY

SEQ ID NO: 723875 - protein, 9 aa, Homo Sapiens
SFDRFSGDD

SEQ ID NO: 723876 - protein, 9 aa, Homo Sapiens
AAPPPTPHP

SEQ ID NO: 723877 - protein, 9 aa, Homo Sapiens
APGEDPIDY

SEQ ID NO: 723878 - protein, 9 aa, Homo Sapiens
PQARLPAPH

SEQ ID NO: 723879 - protein, 9 aa, Homo Sapiens
LGEKRQDGE

SEQ ID NO: 723880 - protein, 9 aa, Homo Sapiens
IKVYVTFHS

SEQ ID NO: 723881 - protein, 9 aa, Homo Sapiens
YVTFHSYSQ

SEQ ID NO: 723882 - protein, 9 aa, Homo Sapiens
MQSRRTKPR

SEQ ID NO: 723883 - protein, 9 aa, Homo Sapiens
PYKAAIPPA

SEQ ID NO: 723884 - protein, 9 aa, Homo Sapiens
FSTLVTPKL

SEQ ID NO: 723885 - protein, 9 aa, Homo Sapiens
TVEKQENET

SEQ ID NO: 723886 - protein, 9 aa, Homo Sapiens
ASEVLSGCP

SEQ ID NO: 723887 - protein, 9 aa, Homo Sapiens
ASPAIPRLP

SEQ ID NO: 723888 - protein, 9 aa, Homo Sapiens
YEERDACVQ

SEQ ID NO: 723889 - protein, 9 aa, Homo Sapiens
PVFMKYAEN

SEQ ID NO: 723890 - protein, 9 aa, Homo Sapiens
RITGKLSKA

SEQ ID NO: 723891 - protein, 9 aa, Homo Sapiens
CRISGLLLC

SEQ ID NO: 723892 - protein, 9 aa, Homo Sapiens
SNAIRIANF

SEQ ID NO: 723893 - protein, 9 aa, Homo Sapiens
LNLSTILYA

SEQ ID NO: 723894 - protein, 9 aa, Homo Sapiens
PGEGWGDHC

SEQ ID NO: 723895 - protein, 9 aa, Homo Sapiens
LSSVEERSG

SEQ ID NO: 723896 - protein, 9 aa, Homo Sapiens
PSAINLDSN

SEQ ID NO: 723897 - protein, 9 aa, Homo Sapiens
TRDDDSESE

SEQ ID NO: 723898 - protein, 9 aa, Homo Sapiens
PVAHISVNF

SEQ ID NO: 723899 - protein, 9 aa, Homo Sapiens
YGRKPILLS

SEQ ID NO: 723900 - protein, 9 aa, Homo Sapiens
VGIVADDDR

SEQ ID NO: 723901 - protein, 9 aa, Homo Sapiens
SQLPVGGLV

SEQ ID NO: 723902 - protein, 9 aa, Homo Sapiens
SVLFVTITA

SEQ ID NO: 723903 - protein, 9 aa, Homo Sapiens
DYYKETTNG

SEQ ID NO: 723904 - protein, 9 aa, Homo Sapiens
HRSQHFLPL

SEQ ID NO: 723905 - protein, 9 aa, Homo Sapiens
SCLSRGSRG

SEQ ID NO: 723906 - protein, 9 aa, Homo Sapiens
AQRQKIQHT

SEQ ID NO: 723907 - protein, 9 aa, Homo Sapiens
ATVIFRKNA

SEQ ID NO: 723908 - protein, 9 aa, Homo Sapiens
AQEQLRNGS

SEQ ID NO: 723909 - protein, 9 aa, Homo Sapiens
VQENRELME

SEQ ID NO: 723910 - protein, 9 aa, Homo Sapiens
PEAPNREFF

SEQ ID NO: 723911 - protein, 9 aa, Homo Sapiens
SLTSVDNEF

SEQ ID NO: 723912 - protein, 9 aa, Homo Sapiens
VSPGNPVDC

SEQ ID NO: 723913 - protein, 9 aa, Homo Sapiens
HTGRLVKSE

SEQ ID NO: 723914 - protein, 9 aa, Homo Sapiens
TEKDYEILL

SEQ ID NO: 723915 - protein, 9 aa, Homo Sapiens
QAVFQDLKG

SEQ ID NO: 723916 - protein, 9 aa, Homo Sapiens
TWPQQALRA

SEQ ID NO: 723917 - protein, 9 aa, Homo Sapiens
LLQLGPAAQ

SEQ ID NO: 723918 - protein, 9 aa, Homo Sapiens
FFYHAIKSG

SEQ ID NO: 723919 - protein, 9 aa, Homo Sapiens
KPYPDIFLA

SEQ ID NO: 723920 - protein, 9 aa, Homo Sapiens
KPLTPLWPG

SEQ ID NO: 723921 - protein, 9 aa, Homo Sapiens
CGDGDGGAL

SEQ ID NO: 723922 - protein, 9 aa, Homo Sapiens
NFTGYVDDR

SEQ ID NO: 723923 - protein, 9 aa, Homo Sapiens
KAVNRLLGV

SEQ ID NO: 723924 - protein, 9 aa, Homo Sapiens
QNGANVQSR

SEQ ID NO: 723925 - protein, 9 aa, Homo Sapiens
GRTGTGFTS

SEQ ID NO: 723926 - protein, 9 aa, Homo Sapiens
ALKEEQKDK

SEQ ID NO: 723927 - protein, 9 aa, Homo Sapiens
DACVQAIQS

SEQ ID NO: 723928 - protein, 9 aa, Homo Sapiens
EVYFFQCRR

SEQ ID NO: 723929 - protein, 9 aa, Homo Sapiens
RGRPRPEES

SEQ ID NO: 723930 - protein, 9 aa, Homo Sapiens
IRHSFWKGR

SEQ ID NO: 723931 - protein, 9 aa, Homo Sapiens
ESRITQELG

SEQ ID NO: 723932 - protein, 9 aa, Homo Sapiens
YKESCCLVS

SEQ ID NO: 723933 - protein, 9 aa, Homo Sapiens
CRPIAVRSR

SEQ ID NO: 723934 - protein, 9 aa, Homo Sapiens
GLVKFLKMN

SEQ ID NO: 723935 - protein, 9 aa, Homo Sapiens
KGPAPVGSC

SEQ ID NO: 723936 - protein, 9 aa, Homo Sapiens
DQLTNDKAL

SEQ ID NO: 723937 - protein, 9 aa, Homo Sapiens
PACTTRCFW

SEQ ID NO: 723938 - protein, 9 aa, Homo Sapiens
YPSEETDII

SEQ ID NO: 723939 - protein, 9 aa, Homo Sapiens
AIRIANFAE

SEQ ID NO: 723940 - protein, 9 aa, Homo Sapiens
TKKKPLKYI

SEQ ID NO: 723941 - protein, 9 aa, Homo Sapiens
ATGSSEEYR

SEQ ID NO: 723942 - protein, 9 aa, Homo Sapiens
AQMQMQMQC

SEQ ID NO: 723943 - protein, 9 aa, Homo Sapiens
YEILLKSIN

SEQ ID NO: 723944 - protein, 9 aa, Homo Sapiens
CLCWASTTR

SEQ ID NO: 723945 - protein, 9 aa, Homo Sapiens
IFRKNASIS

SEQ ID NO: 723946 - protein, 9 aa, Homo Sapiens
AAYKEALPG

SEQ ID NO: 723947 - protein, 9 aa, Homo Sapiens
PAPCCPRPR

SEQ ID NO: 723948 - protein, 9 aa, Homo Sapiens
FKTKTYFSR

SEQ ID NO: 723949 - protein, 9 aa, Homo Sapiens
AQCAFDHEQ

SEQ ID NO: 723950 - protein, 9 aa, Homo Sapiens
GLRQPHNAT

SEQ ID NO: 723951 - protein, 9 aa, Homo Sapiens
NKIVIPNEQ

SEQ ID NO: 723952 - protein, 9 aa, Homo Sapiens
TQVVRNEGG

SEQ ID NO: 723953 - protein, 9 aa, Homo Sapiens
ETQAGGFPM

SEQ ID NO: 723954 - protein, 9 aa, Homo Sapiens
GVVAALGQD

SEQ ID NO: 723955 - protein, 9 aa, Homo Sapiens
ERFFFKQLD

SEQ ID NO: 723956 - protein, 9 aa, Homo Sapiens
SCEAFSTIT

SEQ ID NO: 723957 - protein, 9 aa, Homo Sapiens
LPLLFLRKV

SEQ ID NO: 723958 - protein, 9 aa, Homo Sapiens
ADLLCMLHK

SEQ ID NO: 723959 - protein, 9 aa, Homo Sapiens
KIVIPNEQS

SEQ ID NO: 723960 - protein, 9 aa, Homo Sapiens
WHQGSWYFG

SEQ ID NO: 723961 - protein, 9 aa, Homo Sapiens
HVSVHRSQH

SEQ ID NO: 723962 - protein, 9 aa, Homo Sapiens
PVTQIIALC

SEQ ID NO: 723963 - protein, 9 aa, Homo Sapiens
SLHQPPHLH

SEQ ID NO: 723964 - protein, 9 aa, Homo Sapiens
LLLSRVKPT

SEQ ID NO: 723965 - protein, 9 aa, Homo Sapiens
AVKADEKND

SEQ ID NO: 723966 - protein, 9 aa, Homo Sapiens
STVNPELYS

SEQ ID NO: 723967 - protein, 9 aa, Homo Sapiens
TALVALMGK

SEQ ID NO: 723968 - protein, 9 aa, Homo Sapiens
IGTEGAKDS

SEQ ID NO: 723969 - protein, 9 aa, Homo Sapiens
TTQPEATEA

SEQ ID NO: 723970 - protein, 9 aa, Homo Sapiens
IAICIVTHF

SEQ ID NO: 723971 - protein, 9 aa, Homo Sapiens
CCICLEPFK

SEQ ID NO: 723972 - protein, 9 aa, Homo Sapiens
DKMLCAGFM

SEQ ID NO: 723973 - protein, 9 aa, Homo Sapiens
PLPLICRSP

SEQ ID NO: 723974 - protein, 9 aa, Homo Sapiens
DESLCKSAN

SEQ ID NO: 723975 - protein, 9 aa, Homo Sapiens
QDWDVVKDG

SEQ ID NO: 723976 - protein, 9 aa, Homo Sapiens
EPLKGVPPD

SEQ ID NO: 723977 - protein, 9 aa, Homo Sapiens
SGSSHCPMP

SEQ ID NO: 723978 - protein, 9 aa, Homo Sapiens
SAPSQSELD

SEQ ID NO: 723979 - protein, 9 aa, Homo Sapiens
LENAKAAKL

SEQ ID NO: 723980 - protein, 9 aa, Homo Sapiens
ERPEFHKDP

SEQ ID NO: 723981 - protein, 9 aa, Homo Sapiens
FCPTTCYFY

SEQ ID NO: 723982 - protein, 9 aa, Homo Sapiens
EELGDCVFY

SEQ ID NO: 723983 - protein, 9 aa, Homo Sapiens
RDIIPLSKQ

SEQ ID NO: 723984 - protein, 9 aa, Homo Sapiens
VRNEGGVVV

SEQ ID NO: 723985 - protein, 9 aa, Homo Sapiens
QQALRAASP

SEQ ID NO: 723986 - protein, 9 aa, Homo Sapiens
RIGGVGVQL

SEQ ID NO: 723987 - protein, 9 aa, Homo Sapiens
GNVIGSFHV

SEQ ID NO: 723988 - protein, 9 aa, Homo Sapiens
YFEEEEEVD

SEQ ID NO: 723989 - protein, 9 aa, Homo Sapiens
LARRLYHRE

SEQ ID NO: 723990 - protein, 9 aa, Homo Sapiens
GVLFSLEEI

SEQ ID NO: 723991 - protein, 9 aa, Homo Sapiens
DKTSATVIF

SEQ ID NO: 723992 - protein, 9 aa, Homo Sapiens
CQLGTWGAL

SEQ ID NO: 723993 - protein, 9 aa, Homo Sapiens
LLEPDGEFP

SEQ ID NO: 723994 - protein, 9 aa, Homo Sapiens
APLCTSAPA

SEQ ID NO: 723995 - protein, 9 aa, Homo Sapiens
PKWVQGVGW

SEQ ID NO: 723996 - protein, 9 aa, Homo Sapiens
TTIGFENIA

SEQ ID NO: 723997 - protein, 9 aa, Homo Sapiens
GVGKRIMEE

SEQ ID NO: 723998 - protein, 9 aa, Homo Sapiens
TKDNSRSNN

SEQ ID NO: 723999 - protein, 9 aa, Homo Sapiens
HILLFVLFT

SEQ ID NO: 724000 - protein, 9 aa, Homo Sapiens
GSTGLYPHY

SEQ ID NO: 724001 - protein, 9 aa, Homo Sapiens
LTIMNGCDL

SEQ ID NO: 724002 - protein, 9 aa, Homo Sapiens
LLNVENPWS

SEQ ID NO: 724003 - protein, 9 aa, Homo Sapiens
TRPRNQGLG

SEQ ID NO: 724004 - protein, 9 aa, Homo Sapiens
CVLPLKMLR

SEQ ID NO: 724005 - protein, 9 aa, Homo Sapiens
PGDHADHLP

SEQ ID NO: 724006 - protein, 9 aa, Homo Sapiens
PKRTLSRVM

SEQ ID NO: 724007 - protein, 9 aa, Homo Sapiens
GQKALQLAV

SEQ ID NO: 724008 - protein, 9 aa, Homo Sapiens
AALPGCDPN

SEQ ID NO: 724009 - protein, 9 aa, Homo Sapiens
DQSAIDLLQ

SEQ ID NO: 724010 - protein, 9 aa, Homo Sapiens
FGFSGSHSC

SEQ ID NO: 724011 - protein, 9 aa, Homo Sapiens
YSHDGAFLT

SEQ ID NO: 724012 - protein, 9 aa, Homo Sapiens
TENDSMKLG

SEQ ID NO: 724013 - protein, 9 aa, Homo Sapiens
SCHTSKKHW

SEQ ID NO: 724014 - protein, 9 aa, Homo Sapiens
VSRLLRPTQ

SEQ ID NO: 724015 - protein, 9 aa, Homo Sapiens
QVPNFINAK

SEQ ID NO: 724016 - protein, 9 aa, Homo Sapiens
LLMCRQQSQ

SEQ ID NO: 724017 - protein, 9 aa, Homo Sapiens
PAVYDRVAK

SEQ ID NO: 724018 - protein, 9 aa, Homo Sapiens
SQILKKIDP

SEQ ID NO: 724019 - protein, 9 aa, Homo Sapiens
CTCDFLHVP

SEQ ID NO: 724020 - protein, 9 aa, Homo Sapiens
GNFAFFKVL

SEQ ID NO: 724021 - protein, 9 aa, Homo Sapiens
RLPQGSSLR

SEQ ID NO: 724022 - protein, 9 aa, Homo Sapiens
EEEYPSEET

SEQ ID NO: 724023 - protein, 9 aa, Homo Sapiens
FYRLHQRLV

SEQ ID NO: 724024 - protein, 9 aa, Homo Sapiens
LAHRPQSSA

SEQ ID NO: 724025 - protein, 9 aa, Homo Sapiens
VIDQEPAGD

SEQ ID NO: 724026 - protein, 9 aa, Homo Sapiens
TSVTRRAPS

SEQ ID NO: 724027 - protein, 9 aa, Homo Sapiens
THLPGKSPA

SEQ ID NO: 724028 - protein, 9 aa, Homo Sapiens
LGDWALYLC

SEQ ID NO: 724029 - protein, 9 aa, Homo Sapiens
RKGPAPVGS

SEQ ID NO: 724030 - protein, 9 aa, Homo Sapiens
EMFVFCFKR

SEQ ID NO: 724031 - protein, 9 aa, Homo Sapiens
GPPAAPPPT

SEQ ID NO: 724032 - protein, 9 aa, Homo Sapiens
FHISSFADL

SEQ ID NO: 724033 - protein, 9 aa, Homo Sapiens
PMLQMKLKA

SEQ ID NO: 724034 - protein, 9 aa, Homo Sapiens
ITTTTTVTT

SEQ ID NO: 724035 - protein, 9 aa, Homo Sapiens
PAPSPWPWH

SEQ ID NO: 724036 - protein, 9 aa, Homo Sapiens
IAGLIYLHF

SEQ ID NO: 724037 - protein, 9 aa, Homo Sapiens
ILNYLKSSL

SEQ ID NO: 724038 - protein, 9 aa, Homo Sapiens
PLANYMLYR

SEQ ID NO: 724039 - protein, 9 aa, Homo Sapiens
VGISGPKSP

SEQ ID NO: 724040 - protein, 9 aa, Homo Sapiens
KQVEGRLAL

SEQ ID NO: 724041 - protein, 9 aa, Homo Sapiens
FQQSQAQAV

SEQ ID NO: 724042 - protein, 9 aa, Homo Sapiens
TQCCVAVYS

SEQ ID NO: 724043 - protein, 9 aa, Homo Sapiens
LNGKRSSEE

SEQ ID NO: 724044 - protein, 9 aa, Homo Sapiens
RIRFSDYNG

SEQ ID NO: 724045 - protein, 9 aa, Homo Sapiens
PLLRKQVEG

SEQ ID NO: 724046 - protein, 9 aa, Homo Sapiens
PPDKFNHTA

SEQ ID NO: 724047 - protein, 9 aa, Homo Sapiens
HDAPGPPGP

SEQ ID NO: 724048 - protein, 9 aa, Homo Sapiens
EVRTRDKKE

SEQ ID NO: 724049 - protein, 9 aa, Homo Sapiens
RELMESFDS

SEQ ID NO: 724050 - protein, 9 aa, Homo Sapiens
ITVPIFASG

SEQ ID NO: 724051 - protein, 9 aa, Homo Sapiens
FRLYTDKLK

SEQ ID NO: 724052 - protein, 9 aa, Homo Sapiens
WSASGIFGM

SEQ ID NO: 724053 - protein, 9 aa, Homo Sapiens
PNQAQLRIF

SEQ ID NO: 724054 - protein, 9 aa, Homo Sapiens
SCHGPYKAA

SEQ ID NO: 724055 - protein, 9 aa, Homo Sapiens
PDYESRTSV

SEQ ID NO: 724056 - protein, 9 aa, Homo Sapiens
KGQMGSCGV

SEQ ID NO: 724057 - protein, 9 aa, Homo Sapiens
SRGSRGWEG

SEQ ID NO: 724058 - protein, 9 aa, Homo Sapiens
SGVTSAMNV

SEQ ID NO: 724059 - protein, 9 aa, Homo Sapiens
RALLGSKQK

SEQ ID NO: 724060 - protein, 9 aa, Homo Sapiens
VINNANYHD

SEQ ID NO: 724061 - protein, 9 aa, Homo Sapiens
LKNFLLLTK

SEQ ID NO: 724062 - protein, 9 aa, Homo Sapiens
SMRMDMFSV

SEQ ID NO: 724063 - protein, 9 aa, Homo Sapiens
LMDSVIHAL

SEQ ID NO: 724064 - protein, 9 aa, Homo Sapiens
KDNSRSNNG

SEQ ID NO: 724065 - protein, 9 aa, Homo Sapiens
PGLVKFLKM

SEQ ID NO: 724066 - protein, 9 aa, Homo Sapiens
GQWLGTVLL

SEQ ID NO: 724067 - protein, 9 aa, Homo Sapiens
TEGAKDSYD

SEQ ID NO: 724068 - protein, 9 aa, Homo Sapiens
HRSVGDSIS

SEQ ID NO: 724069 - protein, 9 aa, Homo Sapiens
KALVEVERD

SEQ ID NO: 724070 - protein, 9 aa, Homo Sapiens
FQDLKGVEK

SEQ ID NO: 724071 - protein, 9 aa, Homo Sapiens
LMCRQQSQC

SEQ ID NO: 724072 - protein, 9 aa, Homo Sapiens
GVQPVFSGG

SEQ ID NO: 724073 - protein, 9 aa, Homo Sapiens
QVREICSLF

SEQ ID NO: 724074 - protein, 9 aa, Homo Sapiens
EGYYDIRLV

SEQ ID NO: 724075 - protein, 9 aa, Homo Sapiens
KREEPMEVE

SEQ ID NO: 724076 - protein, 9 aa, Homo Sapiens
GAISSESGA

SEQ ID NO: 724077 - protein, 9 aa, Homo Sapiens
RMLKKSRLV

SEQ ID NO: 724078 - protein, 9 aa, Homo Sapiens
PITQGTTIS

SEQ ID NO: 724079 - protein, 9 aa, Homo Sapiens
CKGLSQTTT

SEQ ID NO: 724080 - protein, 9 aa, Homo Sapiens
IQILFTVCL

SEQ ID NO: 724081 - protein, 9 aa, Homo Sapiens
LGMGVWVHQ

SEQ ID NO: 724082 - protein, 9 aa, Homo Sapiens
QRRNDLLSS

SEQ ID NO: 724083 - protein, 9 aa, Homo Sapiens
LKTPPPGCQ

SEQ ID NO: 724084 - protein, 9 aa, Homo Sapiens
AWYHKPKLG

SEQ ID NO: 724085 - protein, 9 aa, Homo Sapiens
ICHPLHYTK

SEQ ID NO: 724086 - protein, 9 aa, Homo Sapiens
AEPLPELCN

SEQ ID NO: 724087 - protein, 9 aa, Homo Sapiens
NLTNLELLD

SEQ ID NO: 724088 - protein, 9 aa, Homo Sapiens
ICRSPTFLP

SEQ ID NO: 724089 - protein, 9 aa, Homo Sapiens
VCTFKNYYS

SEQ ID NO: 724090 - protein, 9 aa, Homo Sapiens
LCKSANKYE

SEQ ID NO: 724091 - protein, 9 aa, Homo Sapiens
TQIIALCHS

SEQ ID NO: 724092 - protein, 9 aa, Homo Sapiens
HHPSLVATA

SEQ ID NO: 724093 - protein, 9 aa, Homo Sapiens
SGVVFAQCA

SEQ ID NO: 724094 - protein, 9 aa, Homo Sapiens
LQQLENAKA

SEQ ID NO: 724095 - protein, 9 aa, Homo Sapiens
GCDSECSAG

SEQ ID NO: 724096 - protein, 9 aa, Homo Sapiens
TRCLRMRPP

SEQ ID NO: 724097 - protein, 9 aa, Homo Sapiens
GIFGMLSQV

SEQ ID NO: 724098 - protein, 9 aa, Homo Sapiens
GLSWVPIPS

SEQ ID NO: 724099 - protein, 9 aa, Homo Sapiens
LSMSRRRIS

SEQ ID NO: 724100 - protein, 9 aa, Homo Sapiens
AAQLEKQHL

SEQ ID NO: 724101 - protein, 9 aa, Homo Sapiens
TSSIVSLAR

SEQ ID NO: 724102 - protein, 9 aa, Homo Sapiens
RLLQLPQIL

SEQ ID NO: 724103 - protein, 9 aa, Homo Sapiens
GLEAAQRIG

SEQ ID NO: 724104 - protein, 9 aa, Homo Sapiens
AMHGVFFYH

SEQ ID NO: 724105 - protein, 9 aa, Homo Sapiens
EYFGHCHIL

SEQ ID NO: 724106 - protein, 9 aa, Homo Sapiens
LSFDRFSGD

SEQ ID NO: 724107 - protein, 9 aa, Homo Sapiens
PPTPLAYRA

SEQ ID NO: 724108 - protein, 9 aa, Homo Sapiens
PYLSTENDS

SEQ ID NO: 724109 - protein, 9 aa, Homo Sapiens
SVDENTPIS

SEQ ID NO: 724110 - protein, 9 aa, Homo Sapiens
SASRPGASP

SEQ ID NO: 724111 - protein, 9 aa, Homo Sapiens
KELDACSFK

SEQ ID NO: 724112 - protein, 9 aa, Homo Sapiens
RWHQGSWYF

SEQ ID NO: 724113 - protein, 9 aa, Homo Sapiens
QLEKQHLHN

SEQ ID NO: 724114 - protein, 9 aa, Homo Sapiens
FISLIQENL

SEQ ID NO: 724115 - protein, 9 aa, Homo Sapiens
MDECKVQKE

SEQ ID NO: 724116 - protein, 9 aa, Homo Sapiens
TCQAVSAPG

SEQ ID NO: 724117 - protein, 9 aa, Homo Sapiens
SLQVQPETL

SEQ ID NO: 724118 - protein, 9 aa, Homo Sapiens
FVFCFKRGF

SEQ ID NO: 724119 - protein, 9 aa, Homo Sapiens
QLVTIKKAL

SEQ ID NO: 724120 - protein, 9 aa, Homo Sapiens
SSTTHNIFS

SEQ ID NO: 724121 - protein, 9 aa, Homo Sapiens
FPCPREGHI

SEQ ID NO: 724122 - protein, 9 aa, Homo Sapiens
RDEVFHFHK

SEQ ID NO: 724123 - protein, 9 aa, Homo Sapiens
HPTSSSLPN

SEQ ID NO: 724124 - protein, 9 aa, Homo Sapiens
YCHKLRYLD

SEQ ID NO: 724125 - protein, 9 aa, Homo Sapiens
PLSAPPRPP

SEQ ID NO: 724126 - protein, 9 aa, Homo Sapiens
TCEEYGKII

SEQ ID NO: 724127 - protein, 9 aa, Homo Sapiens
NSFLILFRD

SEQ ID NO: 724128 - protein, 9 aa, Homo Sapiens
HCHILLGTF

SEQ ID NO: 724129 - protein, 9 aa, Homo Sapiens
QVCANPENK

SEQ ID NO: 724130 - protein, 9 aa, Homo Sapiens
DRDDLNVDR

SEQ ID NO: 724131 - protein, 9 aa, Homo Sapiens
SSSSASRPG

SEQ ID NO: 724132 - protein, 9 aa, Homo Sapiens
TPGGMQEAT

SEQ ID NO: 724133 - protein, 9 aa, Homo Sapiens
WASTTRSAP

SEQ ID NO: 724134 - protein, 9 aa, Homo Sapiens
APVGSCLSR

SEQ ID NO: 724135 - protein, 9 aa, Homo Sapiens
NPLCKFHRT

SEQ ID NO: 724136 - protein, 9 aa, Homo Sapiens
MFCPGAEDG

SEQ ID NO: 724137 - protein, 9 aa, Homo Sapiens
QQWFGNLVT

SEQ ID NO: 724138 - protein, 9 aa, Homo Sapiens
ASSQISVPS

SEQ ID NO: 724139 - protein, 9 aa, Homo Sapiens
TFRRWKSCT

SEQ ID NO: 724140 - protein, 9 aa, Homo Sapiens
NAKIMIRGI

SEQ ID NO: 724141 - protein, 9 aa, Homo Sapiens
CQAVSAPGR

SEQ ID NO: 724142 - protein, 9 aa, Homo Sapiens
GSSSIPPEK

SEQ ID NO: 724143 - protein, 9 aa, Homo Sapiens
EKQEGAQQT

SEQ ID NO: 724144 - protein, 9 aa, Homo Sapiens
GNTAKPTGP

SEQ ID NO: 724145 - protein, 9 aa, Homo Sapiens
STRITGKLS

SEQ ID NO: 724146 - protein, 9 aa, Homo Sapiens
TIPHFTDNC

SEQ ID NO: 724147 - protein, 9 aa, Homo Sapiens
SSSQSNPYG

SEQ ID NO: 724148 - protein, 9 aa, Homo Sapiens
GRLGHILKY

SEQ ID NO: 724149 - protein, 9 aa, Homo Sapiens
TGSKLYECK

SEQ ID NO: 724150 - protein, 9 aa, Homo Sapiens
ISLILVEEG

SEQ ID NO: 724151 - protein, 9 aa, Homo Sapiens
NPYCQLPHL

SEQ ID NO: 724152 - protein, 9 aa, Homo Sapiens
QEKGKASPC

SEQ ID NO: 724153 - protein, 9 aa, Homo Sapiens
FLPDQNQDM

SEQ ID NO: 724154 - protein, 9 aa, Homo Sapiens
EQSVVIYYK

SEQ ID NO: 724155 - protein, 9 aa, Homo Sapiens
RVVILNDLG

SEQ ID NO: 724156 - protein, 9 aa, Homo Sapiens
TSNMLAFVG

SEQ ID NO: 724157 - protein, 9 aa, Homo Sapiens
VYDEWKEGV

SEQ ID NO: 724158 - protein, 9 aa, Homo Sapiens
SCAVIENDG

SEQ ID NO: 724159 - protein, 9 aa, Homo Sapiens
HNLIVHFQE

SEQ ID NO: 724160 - protein, 9 aa, Homo Sapiens
ELGLGVCQD

SEQ ID NO: 724161 - protein, 9 aa, Homo Sapiens
VLLSSVEER

SEQ ID NO: 724162 - protein, 9 aa, Homo Sapiens
PTLEIESGF

SEQ ID NO: 724163 - protein, 9 aa, Homo Sapiens
TNQKRIHTG

SEQ ID NO: 724164 - protein, 9 aa, Homo Sapiens
KEVHKECVI

SEQ ID NO: 724165 - protein, 9 aa, Homo Sapiens
LACQKRPYG

SEQ ID NO: 724166 - protein, 9 aa, Homo Sapiens
YCKELDACS

SEQ ID NO: 724167 - protein, 9 aa, Homo Sapiens
SYKDRANLI

SEQ ID NO: 724168 - protein, 9 aa, Homo Sapiens
SALKSEVHE

SEQ ID NO: 724169 - protein, 9 aa, Homo Sapiens
NFANEHLQL

SEQ ID NO: 724170 - protein, 9 aa, Homo Sapiens
SRDDGGLIP

SEQ ID NO: 724171 - protein, 9 aa, Homo Sapiens
APAPQLGVG

SEQ ID NO: 724172 - protein, 9 aa, Homo Sapiens
FPCCMGSGK

SEQ ID NO: 724173 - protein, 9 aa, Homo Sapiens
GPKGEGGRP

SEQ ID NO: 724174 - protein, 9 aa, Homo Sapiens
TQPEATEAQ

SEQ ID NO: 724175 - protein, 9 aa, Homo Sapiens
RMVARTQTV

SEQ ID NO: 724176 - protein, 9 aa, Homo Sapiens
TQISLSVLL

SEQ ID NO: 724177 - protein, 9 aa, Homo Sapiens
ESHDGHDDD

SEQ ID NO: 724178 - protein, 9 aa, Homo Sapiens
YGCDSECSA

SEQ ID NO: 724179 - protein, 9 aa, Homo Sapiens
ADFWGPLAV

SEQ ID NO: 724180 - protein, 9 aa, Homo Sapiens
PQSSAPTES

SEQ ID NO: 724181 - protein, 9 aa, Homo Sapiens
FGHGAHHAA

SEQ ID NO: 724182 - protein, 9 aa, Homo Sapiens
YGEDYFRLY

SEQ ID NO: 724183 - protein, 9 aa, Homo Sapiens
HFRYENVEF

SEQ ID NO: 724184 - protein, 9 aa, Homo Sapiens
IQQPENKLA

SEQ ID NO: 724185 - protein, 9 aa, Homo Sapiens
PLLAAEHLE

SEQ ID NO: 724186 - protein, 9 aa, Homo Sapiens
AIHYIPKNV

SEQ ID NO: 724187 - protein, 9 aa, Homo Sapiens
FNAVSSSFR

SEQ ID NO: 724188 - protein, 9 aa, Homo Sapiens
LMGKPVSPH

SEQ ID NO: 724189 - protein, 9 aa, Homo Sapiens
HSFWKGRQE

SEQ ID NO: 724190 - protein, 9 aa, Homo Sapiens
CGSLKKQSP

SEQ ID NO: 724191 - protein, 9 aa, Homo Sapiens
MEKSDANSF

SEQ ID NO: 724192 - protein, 9 aa, Homo Sapiens
PPSTTSRLL

SEQ ID NO: 724193 - protein, 9 aa, Homo Sapiens
TLTLPLWSW

SEQ ID NO: 724194 - protein, 9 aa, Homo Sapiens
QGSSSSASR

SEQ ID NO: 724195 - protein, 9 aa, Homo Sapiens
LKQVREICS

SEQ ID NO: 724196 - protein, 9 aa, Homo Sapiens
VFYTLPAKK

SEQ ID NO: 724197 - protein, 9 aa, Homo Sapiens
QLRSTEIAT

SEQ ID NO: 724198 - protein, 9 aa, Homo Sapiens
KVAKVFHIS

SEQ ID NO: 724199 - protein, 9 aa, Homo Sapiens
ILYTVPDTC

SEQ ID NO: 724200 - protein, 9 aa, Homo Sapiens
SMHHLSFHV

SEQ ID NO: 724201 - protein, 9 aa, Homo Sapiens
ILSSYALKT

SEQ ID NO: 724202 - protein, 9 aa, Homo Sapiens
PQHYPPQQP

SEQ ID NO: 724203 - protein, 9 aa, Homo Sapiens
AIVESHDGH

SEQ ID NO: 724204 - protein, 9 aa, Homo Sapiens
LPKSYPEDT

SEQ ID NO: 724205 - protein, 9 aa, Homo Sapiens
AEIFMASGE

SEQ ID NO: 724206 - protein, 9 aa, Homo Sapiens
HKAISFRRC

SEQ ID NO: 724207 - protein, 9 aa, Homo Sapiens
CAVHLPEPL

SEQ ID NO: 724208 - protein, 9 aa, Homo Sapiens
EAEGALPLR

SEQ ID NO: 724209 - protein, 9 aa, Homo Sapiens
GRLLYMAID

SEQ ID NO: 724210 - protein, 9 aa, Homo Sapiens
SVGLHMGFS

SEQ ID NO: 724211 - protein, 9 aa, Homo Sapiens
CFSINCCCL

SEQ ID NO: 724212 - protein, 9 aa, Homo Sapiens
PTPLAYRAF

SEQ ID NO: 724213 - protein, 9 aa, Homo Sapiens
MLDIVSGNS

SEQ ID NO: 724214 - protein, 9 aa, Homo Sapiens
GVSCHGPYK

SEQ ID NO: 724215 - protein, 9 aa, Homo Sapiens
APWPGLPGD

SEQ ID NO: 724216 - protein, 9 aa, Homo Sapiens
LELVASLPP

SEQ ID NO: 724217 - protein, 9 aa, Homo Sapiens
RGKAFISNS

SEQ ID NO: 724218 - protein, 9 aa, Homo Sapiens
SSTLTNQKR

SEQ ID NO: 724219 - protein, 9 aa, Homo Sapiens
DAAGRGSGS

SEQ ID NO: 724220 - protein, 9 aa, Homo Sapiens
LPLPRPLSP

SEQ ID NO: 724221 - protein, 9 aa, Homo Sapiens
PHHPSLVAT

SEQ ID NO: 724222 - protein, 9 aa, Homo Sapiens
NLSTILYAG

SEQ ID NO: 724223 - protein, 9 aa, Homo Sapiens
CSDESLCKS

SEQ ID NO: 724224 - protein, 9 aa, Homo Sapiens
QWPPGVSHF

SEQ ID NO: 724225 - protein, 9 aa, Homo Sapiens
ASHPLFGRL

SEQ ID NO: 724226 - protein, 9 aa, Homo Sapiens
SLTVTLSMS

SEQ ID NO: 724227 - protein, 9 aa, Homo Sapiens
GYGAWYHKP

SEQ ID NO: 724228 - protein, 9 aa, Homo Sapiens
SLTLRGRPR

SEQ ID NO: 724229 - protein, 9 aa, Homo Sapiens
PWETLLAKG

SEQ ID NO: 724230 - protein, 9 aa, Homo Sapiens
AVTPLLFNA

SEQ ID NO: 724231 - protein, 9 aa, Homo Sapiens
VGENAEVKE

SEQ ID NO: 724232 - protein, 9 aa, Homo Sapiens
GHLAMPWAP

SEQ ID NO: 724233 - protein, 9 aa, Homo Sapiens
HMGFSTPAT

SEQ ID NO: 724234 - protein, 9 aa, Homo Sapiens
NQKRIHTGE

SEQ ID NO: 724235 - protein, 9 aa, Homo Sapiens
DKFNHTAIS

SEQ ID NO: 724236 - protein, 9 aa, Homo Sapiens
CHLPQTAPT

SEQ ID NO: 724237 - protein, 9 aa, Homo Sapiens
SFLILFRDS

SEQ ID NO: 724238 - protein, 9 aa, Homo Sapiens
TIMNGCDLK

SEQ ID NO: 724239 - protein, 9 aa, Homo Sapiens
QRSMSISLP

SEQ ID NO: 724240 - protein, 9 aa, Homo Sapiens
TIKTFLKKL

SEQ ID NO: 724241 - protein, 9 aa, Homo Sapiens
SSPTWGPHW

SEQ ID NO: 724242 - protein, 9 aa, Homo Sapiens
ALMGKPVSP

SEQ ID NO: 724243 - protein, 9 aa, Homo Sapiens
NVRASLYSL

SEQ ID NO: 724244 - protein, 9 aa, Homo Sapiens
VPGLDCVPE

SEQ ID NO: 724245 - protein, 9 aa, Homo Sapiens
LSSFLTLRD

SEQ ID NO: 724246 - protein, 9 aa, Homo Sapiens
ISLSCKKER

SEQ ID NO: 724247 - protein, 9 aa, Homo Sapiens
LAFVGENAE

SEQ ID NO: 724248 - protein, 9 aa, Homo Sapiens
MGSGKSKVG

SEQ ID NO: 724249 - protein, 9 aa, Homo Sapiens
QEITVTWEE

SEQ ID NO: 724250 - protein, 9 aa, Homo Sapiens
VKSCEDGIQ

SEQ ID NO: 724251 - protein, 9 aa, Homo Sapiens
PLCKFHRTS

SEQ ID NO: 724252 - protein, 9 aa, Homo Sapiens
VLGAEGTVL

SEQ ID NO: 724253 - protein, 9 aa, Homo Sapiens
EEYPSEETD

SEQ ID NO: 724254 - protein, 9 aa, Homo Sapiens
TFFYSICLF

SEQ ID NO: 724255 - protein, 9 aa, Homo Sapiens
TMLEILLGS

SEQ ID NO: 724256 - protein, 9 aa, Homo Sapiens
IRLVAAQRD

SEQ ID NO: 724257 - protein, 9 aa, Homo Sapiens
PRPRRPRKA

SEQ ID NO: 724258 - protein, 9 aa, Homo Sapiens
SKALLPVGG

SEQ ID NO: 724259 - protein, 9 aa, Homo Sapiens
FGEESRPHA

SEQ ID NO: 724260 - protein, 9 aa, Homo Sapiens
PIDYKCGSP

SEQ ID NO: 724261 - protein, 9 aa, Homo Sapiens
SCRNIGKEA

SEQ ID NO: 724262 - protein, 9 aa, Homo Sapiens
CREYLKNFL

SEQ ID NO: 724263 - protein, 9 aa, Homo Sapiens
FAVFMAVCA

SEQ ID NO: 724264 - protein, 9 aa, Homo Sapiens
RKTQGFLSM

SEQ ID NO: 724265 - protein, 9 aa, Homo Sapiens
HLLNVENPW

SEQ ID NO: 724266 - protein, 9 aa, Homo Sapiens
HGAQIQAKT

SEQ ID NO: 724267 - protein, 9 aa, Homo Sapiens
SSILSAGQS

SEQ ID NO: 724268 - protein, 9 aa, Homo Sapiens
CEQTRPKPG

SEQ ID NO: 724269 - protein, 9 aa, Homo Sapiens
NDGRSDGLP

SEQ ID NO: 724270 - protein, 9 aa, Homo Sapiens
QGSSLRPTA

SEQ ID NO: 724271 - protein, 9 aa, Homo Sapiens
TQHQRTHTR

SEQ ID NO: 724272 - protein, 9 aa, Homo Sapiens
KTQGFLSMS

SEQ ID NO: 724273 - protein, 9 aa, Homo Sapiens
DVNGLPTPS

SEQ ID NO: 724274 - protein, 9 aa, Homo Sapiens
RNPALEPLT

SEQ ID NO: 724275 - protein, 9 aa, Homo Sapiens
VISTLRSQE

SEQ ID NO: 724276 - protein, 9 aa, Homo Sapiens
VGDIGAIFK

SEQ ID NO: 724277 - protein, 9 aa, Homo Sapiens
PPLPSGAGP

SEQ ID NO: 724278 - protein, 9 aa, Homo Sapiens
PDKFNHTAI

SEQ ID NO: 724279 - protein, 9 aa, Homo Sapiens
LLDVTQSPR

SEQ ID NO: 724280 - protein, 9 aa, Homo Sapiens
PSWPWTRCL

SEQ ID NO: 724281 - protein, 9 aa, Homo Sapiens
PNFINAKLP

SEQ ID NO: 724282 - protein, 9 aa, Homo Sapiens
ADEKNDEDG

SEQ ID NO: 724283 - protein, 9 aa, Homo Sapiens
SRGWEGTQG

SEQ ID NO: 724284 - protein, 9 aa, Homo Sapiens
RSCTPSPKR

SEQ ID NO: 724285 - protein, 9 aa, Homo Sapiens
VALTFMTES

SEQ ID NO: 724286 - protein, 9 aa, Homo Sapiens
FTRRWNCIF

SEQ ID NO: 724287 - protein, 9 aa, Homo Sapiens
SLAGIFCFD

SEQ ID NO: 724288 - protein, 9 aa, Homo Sapiens
SFQPSSVVV

SEQ ID NO: 724289 - protein, 9 aa, Homo Sapiens
LCRRSRASS

SEQ ID NO: 724290 - protein, 9 aa, Homo Sapiens
EAQRQKIQH

SEQ ID NO: 724291 - protein, 9 aa, Homo Sapiens
LDIVSGNSV

SEQ ID NO: 724292 - protein, 9 aa, Homo Sapiens
KQLGEKRQD

SEQ ID NO: 724293 - protein, 9 aa, Homo Sapiens
VKEEPPLPS

SEQ ID NO: 724294 - protein, 9 aa, Homo Sapiens
HKECVIKKD

SEQ ID NO: 724295 - protein, 9 aa, Homo Sapiens
QSSRTSSSC

SEQ ID NO: 724296 - protein, 9 aa, Homo Sapiens
VVNNFFCDP

SEQ ID NO: 724297 - protein, 9 aa, Homo Sapiens
RPRRPRKAP

SEQ ID NO: 724298 - protein, 9 aa, Homo Sapiens
VQRSVGSTP

SEQ ID NO: 724299 - protein, 9 aa, Homo Sapiens
TFLPFLLLV

SEQ ID NO: 724300 - protein, 9 aa, Homo Sapiens
PYGILLHLQ

SEQ ID NO: 724301 - protein, 9 aa, Homo Sapiens
KITRDDDSE

SEQ ID NO: 724302 - protein, 9 aa, Homo Sapiens
IYKFLRYFF

SEQ ID NO: 724303 - protein, 9 aa, Homo Sapiens
NTPMMNQSL

SEQ ID NO: 724304 - protein, 9 aa, Homo Sapiens
RPAPCCPRP

SEQ ID NO: 724305 - protein, 9 aa, Homo Sapiens
NGNKFERNN

SEQ ID NO: 724306 - protein, 9 aa, Homo Sapiens
IRNKHGETS

SEQ ID NO: 724307 - protein, 9 aa, Homo Sapiens
ENRKEIEDW

SEQ ID NO: 724308 - protein, 9 aa, Homo Sapiens
NIDYYKETT

SEQ ID NO: 724309 - protein, 9 aa, Homo Sapiens
TWYGVPLLA

SEQ ID NO: 724310 - protein, 9 aa, Homo Sapiens
YGILLHLQS

SEQ ID NO: 724311 - protein, 9 aa, Homo Sapiens
LPEPLMWLL

SEQ ID NO: 724312 - protein, 9 aa, Homo Sapiens
SLKQLGEKR

SEQ ID NO: 724313 - protein, 9 aa, Homo Sapiens
ALLLCGATG

SEQ ID NO: 724314 - protein, 9 aa, Homo Sapiens
NDLLSSFLT

SEQ ID NO: 724315 - protein, 9 aa, Homo Sapiens
ALVKQLDNI

SEQ ID NO: 724316 - protein, 9 aa, Homo Sapiens
LLRKQVEGR

SEQ ID NO: 724317 - protein, 9 aa, Homo Sapiens
PSAEGQQRN

SEQ ID NO: 724318 - protein, 9 aa, Homo Sapiens
SGASSQSTF

SEQ ID NO: 724319 - protein, 9 aa, Homo Sapiens
ENEDTPKSV

SEQ ID NO: 724320 - protein, 9 aa, Homo Sapiens
SLKEKEKQH

SEQ ID NO: 724321 - protein, 9 aa, Homo Sapiens
MVGGHSNTF

SEQ ID NO: 724322 - protein, 9 aa, Homo Sapiens
RLYPEHRSN

SEQ ID NO: 724323 - protein, 9 aa, Homo Sapiens
DMQIDPNGL

SEQ ID NO: 724324 - protein, 9 aa, Homo Sapiens
SISCYRGYL

SEQ ID NO: 724325 - protein, 9 aa, Homo Sapiens
PNSVSDKEA

SEQ ID NO: 724326 - protein, 9 aa, Homo Sapiens
QLGVGGGRR

SEQ ID NO: 724327 - protein, 9 aa, Homo Sapiens
NNIDYYKET

SEQ ID NO: 724328 - protein, 9 aa, Homo Sapiens
LDAKLSMQF

SEQ ID NO: 724329 - protein, 9 aa, Homo Sapiens
VEFPVRHAA

SEQ ID NO: 724330 - protein, 9 aa, Homo Sapiens
LLQVCSRSV

SEQ ID NO: 724331 - protein, 9 aa, Homo Sapiens
VHPVIHFLS

SEQ ID NO: 724332 - protein, 9 aa, Homo Sapiens
IQSTKPRGL

SEQ ID NO: 724333 - protein, 9 aa, Homo Sapiens
FNGSEIIIE

SEQ ID NO: 724334 - protein, 9 aa, Homo Sapiens
PLCLQGCGG

SEQ ID NO: 724335 - protein, 9 aa, Homo Sapiens
SFGEESRPH

SEQ ID NO: 724336 - protein, 9 aa, Homo Sapiens
SAMNVAKGT

SEQ ID NO: 724337 - protein, 9 aa, Homo Sapiens
LPGDHADHL

SEQ ID NO: 724338 - protein, 9 aa, Homo Sapiens
NDGLHAAFT

SEQ ID NO: 724339 - protein, 9 aa, Homo Sapiens
QYSQLGQNI

SEQ ID NO: 724340 - protein, 9 aa, Homo Sapiens
LLSPELTHR

SEQ ID NO: 724341 - protein, 9 aa, Homo Sapiens
LNYLKSSLL

SEQ ID NO: 724342 - protein, 9 aa, Homo Sapiens
MLEILLGSP

SEQ ID NO: 724343 - protein, 9 aa, Homo Sapiens
AFYTCGSHL

SEQ ID NO: 724344 - protein, 9 aa, Homo Sapiens
LVQGNAWIS

SEQ ID NO: 724345 - protein, 9 aa, Homo Sapiens
YDFPLLPSG

SEQ ID NO: 724346 - protein, 9 aa, Homo Sapiens
GNPVDCHAY

SEQ ID NO: 724347 - protein, 9 aa, Homo Sapiens
AKVFHISSF

SEQ ID NO: 724348 - protein, 9 aa, Homo Sapiens
WMGRTGTGF

SEQ ID NO: 724349 - protein, 9 aa, Homo Sapiens
GYERHSNVQ

SEQ ID NO: 724350 - protein, 9 aa, Homo Sapiens
CPFIRAGDY

SEQ ID NO: 724351 - protein, 9 aa, Homo Sapiens
AAEPWLRPG

SEQ ID NO: 724352 - protein, 9 aa, Homo Sapiens
GNMPNGTLG

SEQ ID NO: 724353 - protein, 9 aa, Homo Sapiens
CEAFSTITF

SEQ ID NO: 724354 - protein, 9 aa, Homo Sapiens
TYVLTNTRV

SEQ ID NO: 724355 - protein, 9 aa, Homo Sapiens
GCSEEQLMQ

SEQ ID NO: 724356 - protein, 9 aa, Homo Sapiens
PTFFRVCLK

SEQ ID NO: 724357 - protein, 9 aa, Homo Sapiens
VACPILTQN

SEQ ID NO: 724358 - protein, 9 aa, Homo Sapiens
VAFLDDGFL

SEQ ID NO: 724359 - protein, 9 aa, Homo Sapiens
VYFFQCRRD

SEQ ID NO: 724360 - protein, 9 aa, Homo Sapiens
ESGLSDEKY

SEQ ID NO: 724361 - protein, 9 aa, Homo Sapiens
STCQAVSAP

SEQ ID NO: 724362 - protein, 9 aa, Homo Sapiens
STGRHKAFY

SEQ ID NO: 724363 - protein, 9 aa, Homo Sapiens
RPGASPGGS

SEQ ID NO: 724364 - protein, 9 aa, Homo Sapiens
NILRKERGM

SEQ ID NO: 724365 - protein, 9 aa, Homo Sapiens
CDWSKCSIT

SEQ ID NO: 724366 - protein, 9 aa, Homo Sapiens
PPVAKMRRF

SEQ ID NO: 724367 - protein, 9 aa, Homo Sapiens
LGLGVCQDT

SEQ ID NO: 724368 - protein, 9 aa, Homo Sapiens
PGGDTTSRY

SEQ ID NO: 724369 - protein, 9 aa, Homo Sapiens
ISAQMEVTV

SEQ ID NO: 724370 - protein, 9 aa, Homo Sapiens
VHQKLAIER

SEQ ID NO: 724371 - protein, 9 aa, Homo Sapiens
PRGQPANIR

SEQ ID NO: 724372 - protein, 9 aa, Homo Sapiens
GSSSSASRP

SEQ ID NO: 724373 - protein, 9 aa, Homo Sapiens
SAEGRKKSY

SEQ ID NO: 724374 - protein, 9 aa, Homo Sapiens
RESEFWNKN

SEQ ID NO: 724375 - protein, 9 aa, Homo Sapiens
PSVGGRRRA

SEQ ID NO: 724376 - protein, 9 aa, Homo Sapiens
LVAQGSTGL

SEQ ID NO: 724377 - protein, 9 aa, Homo Sapiens
HDSSSQSNP

SEQ ID NO: 724378 - protein, 9 aa, Homo Sapiens
AVFMAVCAT

SEQ ID NO: 724379 - protein, 9 aa, Homo Sapiens
AVVEVVALL

SEQ ID NO: 724380 - protein, 9 aa, Homo Sapiens
EKRKRLSDS

SEQ ID NO: 724381 - protein, 9 aa, Homo Sapiens
TRGCVSEHR

SEQ ID NO: 724382 - protein, 9 aa, Homo Sapiens
FLSMSRRRI

SEQ ID NO: 724383 - protein, 9 aa, Homo Sapiens
ILKKIDPVH

SEQ ID NO: 724384 - protein, 9 aa, Homo Sapiens
DLMTNLTAE

SEQ ID NO: 724385 - protein, 9 aa, Homo Sapiens
PEPEKSPPA

SEQ ID NO: 724386 - protein, 9 aa, Homo Sapiens
LYTVPDTCV

SEQ ID NO: 724387 - protein, 9 aa, Homo Sapiens
PPRPLQAPL

SEQ ID NO: 724388 - protein, 9 aa, Homo Sapiens
SEEQLMQLC

SEQ ID NO: 724389 - protein, 9 aa, Homo Sapiens
LRALLGSKQ

SEQ ID NO: 724390 - protein, 9 aa, Homo Sapiens
STVTQPGGN

SEQ ID NO: 724391 - protein, 9 aa, Homo Sapiens
QHLLNVENP

SEQ ID NO: 724392 - protein, 9 aa, Homo Sapiens
SLWSSDLLP

SEQ ID NO: 724393 - protein, 9 aa, Homo Sapiens
LSWFLENMA

SEQ ID NO: 724394 - protein, 9 aa, Homo Sapiens
FRQVRCFST

SEQ ID NO: 724395 - protein, 9 aa, Homo Sapiens
PCIEQVAHG

SEQ ID NO: 724396 - protein, 9 aa, Homo Sapiens
LVLKTYFEE

SEQ ID NO: 724397 - protein, 9 aa, Homo Sapiens
TMETFTNLG

SEQ ID NO: 724398 - protein, 9 aa, Homo Sapiens
ELVASLPPS

SEQ ID NO: 724399 - protein, 9 aa, Homo Sapiens
HNQILKEEL

SEQ ID NO: 724400 - protein, 9 aa, Homo Sapiens
FQVPECGRS

SEQ ID NO: 724401 - protein, 9 aa, Homo Sapiens
SGKYCKELD

SEQ ID NO: 724402 - protein, 9 aa, Homo Sapiens
FINAKLPPQ

SEQ ID NO: 724403 - protein, 9 aa, Homo Sapiens
KALKLYFPE

SEQ ID NO: 724404 - protein, 9 aa, Homo Sapiens
ACIYLIEKP

SEQ ID NO: 724405 - protein, 9 aa, Homo Sapiens
NAKAAKLEQ

SEQ ID NO: 724406 - protein, 9 aa, Homo Sapiens
LANRDGWST

SEQ ID NO: 724407 - protein, 9 aa, Homo Sapiens
GVYEAIMLG

SEQ ID NO: 724408 - protein, 9 aa, Homo Sapiens
EPYVKIHLM

SEQ ID NO: 724409 - protein, 9 aa, Homo Sapiens
ERFLVSDRF

SEQ ID NO: 724410 - protein, 9 aa, Homo Sapiens
VFVIDSSSS

SEQ ID NO: 724411 - protein, 9 aa, Homo Sapiens
QQRKRQQQE

SEQ ID NO: 724412 - protein, 9 aa, Homo Sapiens
FTTKIKPRI

SEQ ID NO: 724413 - protein, 9 aa, Homo Sapiens
SEPNTYQLD

SEQ ID NO: 724414 - protein, 9 aa, Homo Sapiens
NGSRHPRSH

SEQ ID NO: 724415 - protein, 9 aa, Homo Sapiens
IIIEGKLVD

SEQ ID NO: 724416 - protein, 9 aa, Homo Sapiens
LRYTYVLTN

SEQ ID NO: 724417 - protein, 9 aa, Homo Sapiens
NQNQLVRKQ

SEQ ID NO: 724418 - protein, 9 aa, Homo Sapiens
VPFKLVCTF

SEQ ID NO: 724419 - protein, 9 aa, Homo Sapiens
KKVAKQTFI

SEQ ID NO: 724420 - protein, 9 aa, Homo Sapiens
MKDAESVRN

SEQ ID NO: 724421 - protein, 9 aa, Homo Sapiens
RHPSWPWTR

SEQ ID NO: 724422 - protein, 9 aa, Homo Sapiens
SSYLYQRQP

SEQ ID NO: 724423 - protein, 9 aa, Homo Sapiens
ISLIQENLP

SEQ ID NO: 724424 - protein, 9 aa, Homo Sapiens
KEAAKRAIT

SEQ ID NO: 724425 - protein, 9 aa, Homo Sapiens
QSLGDNEML

SEQ ID NO: 724426 - protein, 9 aa, Homo Sapiens
IFDPAPFKV

SEQ ID NO: 724427 - protein, 9 aa, Homo Sapiens
IEEFEKADT

SEQ ID NO: 724428 - protein, 9 aa, Homo Sapiens
AQLEKQHLH

SEQ ID NO: 724429 - protein, 9 aa, Homo Sapiens
NNMKYSWVF

SEQ ID NO: 724430 - protein, 9 aa, Homo Sapiens
KYILSCAHL

SEQ ID NO: 724431 - protein, 9 aa, Homo Sapiens
EMRTRRPSL

SEQ ID NO: 724432 - protein, 9 aa, Homo Sapiens
NFGDGPDSN

SEQ ID NO: 724433 - protein, 9 aa, Homo Sapiens
CTGTWVYEY

SEQ ID NO: 724434 - protein, 9 aa, Homo Sapiens
RWRTQYAIK

SEQ ID NO: 724435 - protein, 9 aa, Homo Sapiens
SHSFDDHLS

SEQ ID NO: 724436 - protein, 9 aa, Homo Sapiens
TTPTPTGTQ

SEQ ID NO: 724437 - protein, 9 aa, Homo Sapiens
VTVTVTSVK

SEQ ID NO: 724438 - protein, 9 aa, Homo Sapiens
MEMFVFCFK

SEQ ID NO: 724439 - protein, 9 aa, Homo Sapiens
AGRGSGSGS

SEQ ID NO: 724440 - protein, 9 aa, Homo Sapiens
CTSAPAPSP

SEQ ID NO: 724441 - protein, 9 aa, Homo Sapiens
QYAIKCAPC

SEQ ID NO: 724442 - protein, 9 aa, Homo Sapiens
TSLTTIGFE

SEQ ID NO: 724443 - protein, 9 aa, Homo Sapiens
DAEERGEHA

SEQ ID NO: 724444 - protein, 9 aa, Homo Sapiens
RRESTSPSH

SEQ ID NO: 724445 - protein, 9 aa, Homo Sapiens
SQLAPWPGL

SEQ ID NO: 724446 - protein, 9 aa, Homo Sapiens
FGATGKLDS

SEQ ID NO: 724447 - protein, 9 aa, Homo Sapiens
ELDPALSQA

SEQ ID NO: 724448 - protein, 9 aa, Homo Sapiens
KASPCIEQV

SEQ ID NO: 724449 - protein, 9 aa, Homo Sapiens
SSLRLHFRI

SEQ ID NO: 724450 - protein, 9 aa, Homo Sapiens
QQKKYKYEV

SEQ ID NO: 724451 - protein, 9 aa, Homo Sapiens
RPTASTCLC

SEQ ID NO: 724452 - protein, 9 aa, Homo Sapiens
LLLLSLYRG

SEQ ID NO: 724453 - protein, 9 aa, Homo Sapiens
CCPRPRPSQ

SEQ ID NO: 724454 - protein, 9 aa, Homo Sapiens
HSGSDSWNN

SEQ ID NO: 724455 - protein, 9 aa, Homo Sapiens
LPSNSVTQW

SEQ ID NO: 724456 - protein, 9 aa, Homo Sapiens
EEYGKIITS

SEQ ID NO: 724457 - protein, 9 aa, Homo Sapiens
HILLGTFEK

SEQ ID NO: 724458 - protein, 9 aa, Homo Sapiens
RPQSSAPTE

SEQ ID NO: 724459 - protein, 9 aa, Homo Sapiens
TPLSLTVTL

SEQ ID NO: 724460 - protein, 9 aa, Homo Sapiens
EGFLCRISG

SEQ ID NO: 724461 - protein, 9 aa, Homo Sapiens
TFLKKLEAL

SEQ ID NO: 724462 - protein, 9 aa, Homo Sapiens
FQVMNLNKR

SEQ ID NO: 724463 - protein, 9 aa, Homo Sapiens
WRTQYAIKC

SEQ ID NO: 724464 - protein, 9 aa, Homo Sapiens
GQQWFGNLV

SEQ ID NO: 724465 - protein, 9 aa, Homo Sapiens
SVIHALAEL

SEQ ID NO: 724466 - protein, 9 aa, Homo Sapiens
HPLHYTKIM

SEQ ID NO: 724467 - protein, 9 aa, Homo Sapiens
TKEPVTKQR

SEQ ID NO: 724468 - protein, 9 aa, Homo Sapiens
LFYCHKLRY

SEQ ID NO: 724469 - protein, 9 aa, Homo Sapiens
EEPPLPSGA

SEQ ID NO: 724470 - protein, 9 aa, Homo Sapiens
YGKLVSVLS

SEQ ID NO: 724471 - protein, 9 aa, Homo Sapiens
PPPSSCEAF

SEQ ID NO: 724472 - protein, 9 aa, Homo Sapiens
LHLTTLTLP

SEQ ID NO: 724473 - protein, 9 aa, Homo Sapiens
SRRREGAIS

SEQ ID NO: 724474 - protein, 9 aa, Homo Sapiens
KMRRFPAGE

SEQ ID NO: 724475 - protein, 9 aa, Homo Sapiens
KTVKSCEDG

SEQ ID NO: 724476 - protein, 9 aa, Homo Sapiens
HQVELIHCV

SEQ ID NO: 724477 - protein, 9 aa, Homo Sapiens
VPECGRSQD

SEQ ID NO: 724478 - protein, 9 aa, Homo Sapiens
LKILHILNM

SEQ ID NO: 724479 - protein, 9 aa, Homo Sapiens
AYDLYAAVC

SEQ ID NO: 724480 - protein, 9 aa, Homo Sapiens
DYNGSVLFE

SEQ ID NO: 724481 - protein, 9 aa, Homo Sapiens
CRPCLYINW

SEQ ID NO: 724482 - protein, 9 aa, Homo Sapiens
KVFTEPQHC

SEQ ID NO: 724483 - protein, 9 aa, Homo Sapiens
CTTRCFWST

SEQ ID NO: 724484 - protein, 9 aa, Homo Sapiens
ANIRQQPGM

SEQ ID NO: 724485 - protein, 9 aa, Homo Sapiens
PCTCDFLHV

SEQ ID NO: 724486 - protein, 9 aa, Homo Sapiens
CRIGWAPAP

SEQ ID NO: 724487 - protein, 9 aa, Homo Sapiens
LAGIFCFDL

SEQ ID NO: 724488 - protein, 9 aa, Homo Sapiens
WWCENLGIW

SEQ ID NO: 724489 - protein, 9 aa, Homo Sapiens
LTQIAGYGL

SEQ ID NO: 724490 - protein, 9 aa, Homo Sapiens
TKDPHATPM

SEQ ID NO: 724491 - protein, 9 aa, Homo Sapiens
GNYVFPKWV

SEQ ID NO: 724492 - protein, 9 aa, Homo Sapiens
VYDAAADGA

SEQ ID NO: 724493 - protein, 9 aa, Homo Sapiens
VCANPENKW

SEQ ID NO: 724494 - protein, 9 aa, Homo Sapiens
VMKENLSPK

SEQ ID NO: 724495 - protein, 9 aa, Homo Sapiens
DTTSRYPLP

SEQ ID NO: 724496 - protein, 9 aa, Homo Sapiens
FHIFQVPEC

SEQ ID NO: 724497 - protein, 9 aa, Homo Sapiens
GTVLPKSIE

SEQ ID NO: 724498 - protein, 9 aa, Homo Sapiens
TSCVLPLKM

SEQ ID NO: 724499 - protein, 9 aa, Homo Sapiens
HTGERPCKC

SEQ ID NO: 724500 - protein, 9 aa, Homo Sapiens
SIQEPPLQA

SEQ ID NO: 724501 - protein, 9 aa, Homo Sapiens
ASLWSSDLL

SEQ ID NO: 724502 - protein, 9 aa, Homo Sapiens
TGLSRAALY

SEQ ID NO: 724503 - protein, 9 aa, Homo Sapiens
VFTMPTLSG

SEQ ID NO: 724504 - protein, 9 aa, Homo Sapiens
LGSHSFDDH

SEQ ID NO: 724505 - protein, 9 aa, Homo Sapiens
EQMDQDHSG

SEQ ID NO: 724506 - protein, 9 aa, Homo Sapiens
VQKECYNGL

SEQ ID NO: 724507 - protein, 9 aa, Homo Sapiens
EPNTYQLDY

SEQ ID NO: 724508 - protein, 9 aa, Homo Sapiens
RNCGSPAFY

SEQ ID NO: 724509 - protein, 9 aa, Homo Sapiens
QGLAEVDVR

SEQ ID NO: 724510 - protein, 9 aa, Homo Sapiens
VSLHGLCVS

SEQ ID NO: 724511 - protein, 9 aa, Homo Sapiens
HSSRLKAEK

SEQ ID NO: 724512 - protein, 9 aa, Homo Sapiens
ILPKSYPED

SEQ ID NO: 724513 - protein, 9 aa, Homo Sapiens
VVEYYCNPT

SEQ ID NO: 724514 - protein, 9 aa, Homo Sapiens
EIKVYVTFH

SEQ ID NO: 724515 - protein, 9 aa, Homo Sapiens
AFSQLRSTE

SEQ ID NO: 724516 - protein, 9 aa, Homo Sapiens
PVAKMRRFP

SEQ ID NO: 724517 - protein, 9 aa, Homo Sapiens
ANRDGWSTL

SEQ ID NO: 724518 - protein, 9 aa, Homo Sapiens
CVPGLDCVP

SEQ ID NO: 724519 - protein, 9 aa, Homo Sapiens
SSPCELQMS

SEQ ID NO: 724520 - protein, 9 aa, Homo Sapiens
FHRTSVLFA

SEQ ID NO: 724521 - protein, 9 aa, Homo Sapiens
IGIAICIVT

SEQ ID NO: 724522 - protein, 9 aa, Homo Sapiens
HILNLKILH

SEQ ID NO: 724523 - protein, 9 aa, Homo Sapiens
ELVLLQFQV

SEQ ID NO: 724524 - protein, 9 aa, Homo Sapiens
PCCSLFLNS

SEQ ID NO: 724525 - protein, 9 aa, Homo Sapiens
HREGFQRCD

SEQ ID NO: 724526 - protein, 9 aa, Homo Sapiens
NDPFVIPNL

SEQ ID NO: 724527 - protein, 9 aa, Homo Sapiens
PIVRDGVYF

SEQ ID NO: 724528 - protein, 9 aa, Homo Sapiens
ASGIFGMLS

SEQ ID NO: 724529 - protein, 9 aa, Homo Sapiens
TTPSLTSVD

SEQ ID NO: 724530 - protein, 9 aa, Homo Sapiens
GEDYFRLYT

SEQ ID NO: 724531 - protein, 9 aa, Homo Sapiens
SDSENEDIG

SEQ ID NO: 724532 - protein, 9 aa, Homo Sapiens
MSISLPMSC

SEQ ID NO: 724533 - protein, 9 aa, Homo Sapiens
PAVSGLFRQ

SEQ ID NO: 724534 - protein, 9 aa, Homo Sapiens
RPEGDRHSS

SEQ ID NO: 724535 - protein, 9 aa, Homo Sapiens
LLPREHRVY

SEQ ID NO: 724536 - protein, 9 aa, Homo Sapiens
QSSRHDCYL

SEQ ID NO: 724537 - protein, 9 aa, Homo Sapiens
SQSNPYGGG

SEQ ID NO: 724538 - protein, 9 aa, Homo Sapiens
TAVLSEKQE

SEQ ID NO: 724539 - protein, 9 aa, Homo Sapiens
ENETFGFEI

SEQ ID NO: 724540 - protein, 9 aa, Homo Sapiens
TARRSHANP

SEQ ID NO: 724541 - protein, 9 aa, Homo Sapiens
PGLCRIGWA

SEQ ID NO: 724542 - protein, 9 aa, Homo Sapiens
ICLFAWSHI

SEQ ID NO: 724543 - protein, 9 aa, Homo Sapiens
EQIHRVQQL

SEQ ID NO: 724544 - protein, 9 aa, Homo Sapiens
LVTPKLLEN

SEQ ID NO: 724545 - protein, 9 aa, Homo Sapiens
LEPDGEFPG

SEQ ID NO: 724546 - protein, 9 aa, Homo Sapiens
YVLTNTRVV

SEQ ID NO: 724547 - protein, 9 aa, Homo Sapiens
ALPLYSLCP

SEQ ID NO: 724548 - protein, 9 aa, Homo Sapiens
EYPSEETDI

SEQ ID NO: 724549 - protein, 9 aa, Homo Sapiens
DYSIQSTKP

SEQ ID NO: 724550 - protein, 9 aa, Homo Sapiens
VGGYEVFAR

SEQ ID NO: 724551 - protein, 9 aa, Homo Sapiens
VLVGNQEGG

SEQ ID NO: 724552 - protein, 9 aa, Homo Sapiens
DWDVVKDGQ

SEQ ID NO: 724553 - protein, 9 aa, Homo Sapiens
MCNSSCMGV

SEQ ID NO: 724554 - protein, 9 aa, Homo Sapiens
QKLAIERAK

SEQ ID NO: 724555 - protein, 9 aa, Homo Sapiens
GVITVPIFA

SEQ ID NO: 724556 - protein, 9 aa, Homo Sapiens
GKEAEKFGH

SEQ ID NO: 724557 - protein, 9 aa, Homo Sapiens
QMQMQMQCG

SEQ ID NO: 724558 - protein, 9 aa, Homo Sapiens
NFLLLTKYC

SEQ ID NO: 724559 - protein, 9 aa, Homo Sapiens
PLPSGAGPL

SEQ ID NO: 724560 - protein, 9 aa, Homo Sapiens
AEAVQALLE

SEQ ID NO: 724561 - protein, 9 aa, Homo Sapiens
TASSQISVP

SEQ ID NO: 724562 - protein, 9 aa, Homo Sapiens
SQMGAVGQS

SEQ ID NO: 724563 - protein, 9 aa, Homo Sapiens
CHKLRYLDL

SEQ ID NO: 724564 - protein, 9 aa, Homo Sapiens
ISLPMSCLD

SEQ ID NO: 724565 - protein, 9 aa, Homo Sapiens
SLGPPPNPQ

SEQ ID NO: 724566 - protein, 9 aa, Homo Sapiens
RLKLLEDSK

SEQ ID NO: 724567 - protein, 9 aa, Homo Sapiens
QRYKMDDAE

SEQ ID NO: 724568 - protein, 9 aa, Homo Sapiens
KTPPPGCQG

SEQ ID NO: 724569 - protein, 9 aa, Homo Sapiens
RPQHYPPQQ

SEQ ID NO: 724570 - protein, 9 aa, Homo Sapiens
LVDLTQIAG

SEQ ID NO: 724571 - protein, 9 aa, Homo Sapiens
CPREGHILL

SEQ ID NO: 724572 - protein, 9 aa, Homo Sapiens
PTFLMKGPN

SEQ ID NO: 724573 - protein, 9 aa, Homo Sapiens
VESHDGHDD

SEQ ID NO: 724574 - protein, 9 aa, Homo Sapiens
LHMGFSTPA

SEQ ID NO: 724575 - protein, 9 aa, Homo Sapiens
QKVSMDLRA

SEQ ID NO: 724576 - protein, 9 aa, Homo Sapiens
TRVAWLNLS

SEQ ID NO: 724577 - protein, 9 aa, Homo Sapiens
TVQALQRRH

SEQ ID NO: 724578 - protein, 9 aa, Homo Sapiens
VFCFKRGFF

SEQ ID NO: 724579 - protein, 9 aa, Homo Sapiens
RPRNQGLGI

SEQ ID NO: 724580 - protein, 9 aa, Homo Sapiens
YETQAGGFP

SEQ ID NO: 724581 - protein, 9 aa, Homo Sapiens
WVQGVGWLM

SEQ ID NO: 724582 - protein, 9 aa, Homo Sapiens
DEKYSVATH

SEQ ID NO: 724583 - protein, 9 aa, Homo Sapiens
EITVTWEEK

SEQ ID NO: 724584 - protein, 9 aa, Homo Sapiens
RLFSIVRPG

SEQ ID NO: 724585 - protein, 9 aa, Homo Sapiens
HDRNKLKNM

SEQ ID NO: 724586 - protein, 9 aa, Homo Sapiens
SFWKGRQED

SEQ ID NO: 724587 - protein, 9 aa, Homo Sapiens
PDSNKTRTF

SEQ ID NO: 724588 - protein, 9 aa, Homo Sapiens
EQTRPKPGE

SEQ ID NO: 724589 - protein, 9 aa, Homo Sapiens
STNKNRCIL

SEQ ID NO: 724590 - protein, 9 aa, Homo Sapiens
SVEKVLPLD

SEQ ID NO: 724591 - protein, 9 aa, Homo Sapiens
TFTARTCQV

SEQ ID NO: 724592 - protein, 9 aa, Homo Sapiens
RSTEIATVH

SEQ ID NO: 724593 - protein, 9 aa, Homo Sapiens
PDTCVIVCY

SEQ ID NO: 724594 - protein, 9 aa, Homo Sapiens
FLLPSANYF

SEQ ID NO: 724595 - protein, 9 aa, Homo Sapiens
VLPKSIETP

SEQ ID NO: 724596 - protein, 9 aa, Homo Sapiens
HLTTLTLPL

SEQ ID NO: 724597 - protein, 9 aa, Homo Sapiens
VNIIAVHAD

SEQ ID NO: 724598 - protein, 9 aa, Homo Sapiens
PWPGLPGDH

SEQ ID NO: 724599 - protein, 9 aa, Homo Sapiens
NRDGWSTLH

SEQ ID NO: 724600 - protein, 9 aa, Homo Sapiens
GPDSNKTRT

SEQ ID NO: 724601 - protein, 9 aa, Homo Sapiens
FSEAEGALP

SEQ ID NO: 724602 - protein, 9 aa, Homo Sapiens
KCKIWMHVD

SEQ ID NO: 724603 - protein, 9 aa, Homo Sapiens
KDSVHGLSY

SEQ ID NO: 724604 - protein, 9 aa, Homo Sapiens
NYMLYREHS

SEQ ID NO: 724605 - protein, 9 aa, Homo Sapiens
PSSSYAGKT

SEQ ID NO: 724606 - protein, 9 aa, Homo Sapiens
FFQVMNLNK

SEQ ID NO: 724607 - protein, 9 aa, Homo Sapiens
LSPELTHRL

SEQ ID NO: 724608 - protein, 9 aa, Homo Sapiens
ILPRVHQKL

SEQ ID NO: 724609 - protein, 9 aa, Homo Sapiens
SCFSINCCC

SEQ ID NO: 724610 - protein, 9 aa, Homo Sapiens
TWCLGLLQL

SEQ ID NO: 724611 - protein, 9 aa, Homo Sapiens
SCMGVMNRR

SEQ ID NO: 724612 - protein, 9 aa, Homo Sapiens
NMKYSWVFK

SEQ ID NO: 724613 - protein, 9 aa, Homo Sapiens
AAPGPALLV

SEQ ID NO: 724614 - protein, 9 aa, Homo Sapiens
PLMKLACTN

SEQ ID NO: 724615 - protein, 9 aa, Homo Sapiens
AMATEELSN

SEQ ID NO: 724616 - protein, 9 aa, Homo Sapiens
VRIYKFLRY

SEQ ID NO: 724617 - protein, 9 aa, Homo Sapiens
VDSLDLCHG

SEQ ID NO: 724618 - protein, 9 aa, Homo Sapiens
SLPNFWNPP

SEQ ID NO: 724619 - protein, 9 aa, Homo Sapiens
LDGNFNSMR

SEQ ID NO: 724620 - protein, 9 aa, Homo Sapiens
ERSCAVIEN

SEQ ID NO: 724621 - protein, 9 aa, Homo Sapiens
NPLEPLPPG

SEQ ID NO: 724622 - protein, 9 aa, Homo Sapiens
FCRPCLYIN

SEQ ID NO: 724623 - protein, 9 aa, Homo Sapiens
GMTVNYLLT

SEQ ID NO: 724624 - protein, 9 aa, Homo Sapiens
VHRSQHFLP

SEQ ID NO: 724625 - protein, 9 aa, Homo Sapiens
ALPLRENVP

SEQ ID NO: 724626 - protein, 9 aa, Homo Sapiens
GAVGQSCED

SEQ ID NO: 724627 - protein, 9 aa, Homo Sapiens
ENDGLHAAF

SEQ ID NO: 724628 - protein, 9 aa, Homo Sapiens
PYAAAPGPA

SEQ ID NO: 724629 - protein, 9 aa, Homo Sapiens
PSQPCSPLS

SEQ ID NO: 724630 - protein, 9 aa, Homo Sapiens
KQVREICSL

SEQ ID NO: 724631 - protein, 9 aa, Homo Sapiens
TKPRGLSWV

SEQ ID NO: 724632 - protein, 9 aa, Homo Sapiens
RLLRPTQSS

SEQ ID NO: 724633 - protein, 9 aa, Homo Sapiens
TCYFYATSC

SEQ ID NO: 724634 - protein, 9 aa, Homo Sapiens
PRYTYRICL

SEQ ID NO: 724635 - protein, 9 aa, Homo Sapiens
PHFTDNCLI

SEQ ID NO: 724636 - protein, 9 aa, Homo Sapiens
MNINSLAIP

SEQ ID NO: 724637 - protein, 9 aa, Homo Sapiens
ALRCYALPT

SEQ ID NO: 724638 - protein, 9 aa, Homo Sapiens
DQCCFQNGR

SEQ ID NO: 724639 - protein, 9 aa, Homo Sapiens
DNEFTTKIK

SEQ ID NO: 724640 - protein, 9 aa, Homo Sapiens
LVSEVLCRL

SEQ ID NO: 724641 - protein, 9 aa, Homo Sapiens
KSMDECKVQ

SEQ ID NO: 724642 - protein, 9 aa, Homo Sapiens
PEGFRPFAK

SEQ ID NO: 724643 - protein, 9 aa, Homo Sapiens
TPENIRDRM

SEQ ID NO: 724644 - protein, 9 aa, Homo Sapiens
DKKEVTIPS

SEQ ID NO: 724645 - protein, 9 aa, Homo Sapiens
QSRDDGGLI

SEQ ID NO: 724646 - protein, 9 aa, Homo Sapiens
FFCVVLCGS

SEQ ID NO: 724647 - protein, 9 aa, Homo Sapiens
FHVVLSTCQ

SEQ ID NO: 724648 - protein, 9 aa, Homo Sapiens
QLGPAAQVM

SEQ ID NO: 724649 - protein, 9 aa, Homo Sapiens
RRHTKKKPL

SEQ ID NO: 724650 - protein, 9 aa, Homo Sapiens
VQTRFRPDS

SEQ ID NO: 724651 - protein, 9 aa, Homo Sapiens
LVSSNTVKI

SEQ ID NO: 724652 - protein, 9 aa, Homo Sapiens
LHNVYESTA

SEQ ID NO: 724653 - protein, 9 aa, Homo Sapiens
LPGPLPASH

SEQ ID NO: 724654 - protein, 9 aa, Homo Sapiens
VMNRRPILT

SEQ ID NO: 724655 - protein, 9 aa, Homo Sapiens
PQPPPLLPL

SEQ ID NO: 724656 - protein, 9 aa, Homo Sapiens
VREICSLFG

SEQ ID NO: 724657 - protein, 9 aa, Homo Sapiens
NRLYPEHRS

SEQ ID NO: 724658 - protein, 9 aa, Homo Sapiens
EGYQDLASR

SEQ ID NO: 724659 - protein, 9 aa, Homo Sapiens
SEKVPIHNA

SEQ ID NO: 724660 - protein, 9 aa, Homo Sapiens
PDCGRALAR

SEQ ID NO: 724661 - protein, 9 aa, Homo Sapiens
QDLASRQEL

SEQ ID NO: 724662 - protein, 9 aa, Homo Sapiens
FEKADTPGG

SEQ ID NO: 724663 - protein, 9 aa, Homo Sapiens
WLNKELNQN

SEQ ID NO: 724664 - protein, 9 aa, Homo Sapiens
TGLYPHYPS

SEQ ID NO: 724665 - protein, 9 aa, Homo Sapiens
MNQSLMGMN

SEQ ID NO: 724666 - protein, 9 aa, Homo Sapiens
EIAKMNHSP

SEQ ID NO: 724667 - protein, 9 aa, Homo Sapiens
QKETIKTFL

SEQ ID NO: 724668 - protein, 9 aa, Homo Sapiens
MPRYEELPE

SEQ ID NO: 724669 - protein, 9 aa, Homo Sapiens
LSRGSRGWE

SEQ ID NO: 724670 - protein, 9 aa, Homo Sapiens
GLHMGFSTP

SEQ ID NO: 724671 - protein, 9 aa, Homo Sapiens
VSNRDIIPL

SEQ ID NO: 724672 - protein, 9 aa, Homo Sapiens
ELSNLVNYI

SEQ ID NO: 724673 - protein, 9 aa, Homo Sapiens
NNVRASLYS

SEQ ID NO: 724674 - protein, 9 aa, Homo Sapiens
LKYNTETDK

SEQ ID NO: 724675 - protein, 9 aa, Homo Sapiens
RDATSCSLS

SEQ ID NO: 724676 - protein, 9 aa, Homo Sapiens
GPPVKEEPP

SEQ ID NO: 724677 - protein, 9 aa, Homo Sapiens
VTPLLFNAV

SEQ ID NO: 724678 - protein, 9 aa, Homo Sapiens
GDLHLTTLT

SEQ ID NO: 724679 - protein, 9 aa, Homo Sapiens
AVNRLLGVE

SEQ ID NO: 724680 - protein, 9 aa, Homo Sapiens
PYGLIVLGF

SEQ ID NO: 724681 - protein, 9 aa, Homo Sapiens
SRRTKPRKS

SEQ ID NO: 724682 - protein, 9 aa, Homo Sapiens
RTSVTRRAP

SEQ ID NO: 724683 - protein, 9 aa, Homo Sapiens
SHDGAFLTV

SEQ ID NO: 724684 - protein, 9 aa, Homo Sapiens
SLTRQKMQQ

SEQ ID NO: 724685 - protein, 9 aa, Homo Sapiens
VVQTRFRPD

SEQ ID NO: 724686 - protein, 9 aa, Homo Sapiens
EESYDVKDT

SEQ ID NO: 724687 - protein, 9 aa, Homo Sapiens
APGPPGPQH

SEQ ID NO: 724688 - protein, 9 aa, Homo Sapiens
APCCPRPRP

SEQ ID NO: 724689 - protein, 9 aa, Homo Sapiens
KYSWVFKTK

SEQ ID NO: 724690 - protein, 9 aa, Homo Sapiens
EGHHITFRR

SEQ ID NO: 724691 - protein, 9 aa, Homo Sapiens
GQLISLDLI

SEQ ID NO: 724692 - protein, 9 aa, Homo Sapiens
GFSQLFLYL

SEQ ID NO: 724693 - protein, 9 aa, Homo Sapiens
KMLCAGFMS

SEQ ID NO: 724694 - protein, 9 aa, Homo Sapiens
ICNPLRYTY

SEQ ID NO: 724695 - protein, 9 aa, Homo Sapiens
DNGEEAVTM

SEQ ID NO: 724696 - protein, 9 aa, Homo Sapiens
RQRRNDLLS

SEQ ID NO: 724697 - protein, 9 aa, Homo Sapiens
SASSWTVRK

SEQ ID NO: 724698 - protein, 9 aa, Homo Sapiens
WDVVKDGQM

SEQ ID NO: 724699 - protein, 9 aa, Homo Sapiens
PGCDPNHVT

SEQ ID NO: 724700 - protein, 9 aa, Homo Sapiens
AWLREHRPD

SEQ ID NO: 724701 - protein, 9 aa, Homo Sapiens
TPQHHICLK

SEQ ID NO: 724702 - protein, 9 aa, Homo Sapiens
LCNKADVQA

SEQ ID NO: 724703 - protein, 9 aa, Homo Sapiens
PSGVPLEAS

SEQ ID NO: 724704 - protein, 9 aa, Homo Sapiens
RSSYLYQRQ

SEQ ID NO: 724705 - protein, 9 aa, Homo Sapiens
VKADEKNDE

SEQ ID NO: 724706 - protein, 9 aa, Homo Sapiens
RWDAPGDEL

SEQ ID NO: 724707 - protein, 9 aa, Homo Sapiens
SSVEERSGA

SEQ ID NO: 724708 - protein, 9 aa, Homo Sapiens
RDAFHEIRP

SEQ ID NO: 724709 - protein, 9 aa, Homo Sapiens
DHGAQIQAK

SEQ ID NO: 724710 - protein, 9 aa, Homo Sapiens
KYEVCKDLI

SEQ ID NO: 724711 - protein, 9 aa, Homo Sapiens
ALTIFKVLL

SEQ ID NO: 724712 - protein, 9 aa, Homo Sapiens
QQPENKLAL

SEQ ID NO: 724713 - protein, 9 aa, Homo Sapiens
EYLKNFLLL

SEQ ID NO: 724714 - protein, 9 aa, Homo Sapiens
AYWKATHPT

SEQ ID NO: 724715 - protein, 9 aa, Homo Sapiens
LGLLQLGPA

SEQ ID NO: 724716 - protein, 9 aa, Homo Sapiens
ADMKDAESV

SEQ ID NO: 724717 - protein, 9 aa, Homo Sapiens
SHCPMPAAP

SEQ ID NO: 724718 - protein, 9 aa, Homo Sapiens
PIHNADLSR

SEQ ID NO: 724719 - protein, 9 aa, Homo Sapiens
EGWGDHCEL

SEQ ID NO: 724720 - protein, 9 aa, Homo Sapiens
AGIFCFDLS

SEQ ID NO: 724721 - protein, 9 aa, Homo Sapiens
RSLQDASRW

SEQ ID NO: 724722 - protein, 9 aa, Homo Sapiens
SPTFLPFLL

SEQ ID NO: 724723 - protein, 9 aa, Homo Sapiens
RPIAVRSRD

SEQ ID NO: 724724 - protein, 9 aa, Homo Sapiens
KVYDEWKEG

SEQ ID NO: 724725 - protein, 9 aa, Homo Sapiens
PGCPGQTAA

SEQ ID NO: 724726 - protein, 9 aa, Homo Sapiens
CPMPAAPVT

SEQ ID NO: 724727 - protein, 9 aa, Homo Sapiens
VTRRAPSPV

SEQ ID NO: 724728 - protein, 9 aa, Homo Sapiens
TRPQHYPPQ

SEQ ID NO: 724729 - protein, 9 aa, Homo Sapiens
GSRWRVSIP

SEQ ID NO: 724730 - protein, 9 aa, Homo Sapiens
PPASAVQSL

SEQ ID NO: 724731 - protein, 9 aa, Homo Sapiens
QPVFSGGQA

SEQ ID NO: 724732 - protein, 9 aa, Homo Sapiens
KTSATVIFR

SEQ ID NO: 724733 - protein, 9 aa, Homo Sapiens
GRPCEPGCP

SEQ ID NO: 724734 - protein, 9 aa, Homo Sapiens
VDYMGQKAL

SEQ ID NO: 724735 - protein, 9 aa, Homo Sapiens
RPYPCPHCG

SEQ ID NO: 724736 - protein, 9 aa, Homo Sapiens
VEHPIRVGE

SEQ ID NO: 724737 - protein, 9 aa, Homo Sapiens
TVKSCEDGI

SEQ ID NO: 724738 - protein, 9 aa, Homo Sapiens
QRQKIQHTA

SEQ ID NO: 724739 - protein, 9 aa, Homo Sapiens
HHRHSLHQP

SEQ ID NO: 724740 - protein, 9 aa, Homo Sapiens
GLCRIGWAP

SEQ ID NO: 724741 - protein, 9 aa, Homo Sapiens
NPNEEVSKF

SEQ ID NO: 724742 - protein, 9 aa, Homo Sapiens
LAMPWAPLF

SEQ ID NO: 724743 - protein, 9 aa, Homo Sapiens
DQDHSGSDS

SEQ ID NO: 724744 - protein, 9 aa, Homo Sapiens
IGSFHVTLD

SEQ ID NO: 724745 - protein, 9 aa, Homo Sapiens
LWESIDRSM

SEQ ID NO: 724746 - protein, 9 aa, Homo Sapiens
YMEKIKPIV

SEQ ID NO: 724747 - protein, 9 aa, Homo Sapiens
AYGRKPILL

SEQ ID NO: 724748 - protein, 9 aa, Homo Sapiens
CPGERAHST

SEQ ID NO: 724749 - protein, 9 aa, Homo Sapiens
CSEEQLMQL

SEQ ID NO: 724750 - protein, 9 aa, Homo Sapiens
DVGCHPVLT

SEQ ID NO: 724751 - protein, 9 aa, Homo Sapiens
HSLHQPPHL

SEQ ID NO: 724752 - protein, 9 aa, Homo Sapiens
VNRLLGVEA

SEQ ID NO: 724753 - protein, 9 aa, Homo Sapiens
NGHYILSLG

SEQ ID NO: 724754 - protein, 9 aa, Homo Sapiens
LHQPPHLHF

SEQ ID NO: 724755 - protein, 9 aa, Homo Sapiens
LQADAVNAF

SEQ ID NO: 724756 - protein, 9 aa, Homo Sapiens
KSETKDPHA

SEQ ID NO: 724757 - protein, 9 aa, Homo Sapiens
SVTGEHCLT

SEQ ID NO: 724758 - protein, 9 aa, Homo Sapiens
GAPLGLRLL

SEQ ID NO: 724759 - protein, 9 aa, Homo Sapiens
SWPWTRCLR

SEQ ID NO: 724760 - protein, 9 aa, Homo Sapiens
SVACPILTQ

SEQ ID NO: 724761 - protein, 9 aa, Homo Sapiens
NDFDNVTVS

SEQ ID NO: 724762 - protein, 9 aa, Homo Sapiens
KNEQMFITE

SEQ ID NO: 724763 - protein, 9 aa, Homo Sapiens
NRCILHSIL

SEQ ID NO: 724764 - protein, 9 aa, Homo Sapiens
SGFQLPSST

SEQ ID NO: 724765 - protein, 9 aa, Homo Sapiens
STKPRGLSW

SEQ ID NO: 724766 - protein, 9 aa, Homo Sapiens
TRSAPASSP

SEQ ID NO: 724767 - protein, 9 aa, Homo Sapiens
KIMIIVVMT

SEQ ID NO: 724768 - protein, 9 aa, Homo Sapiens
SKLFVVSYD

SEQ ID NO: 724769 - protein, 9 aa, Homo Sapiens
VSQILKKID

SEQ ID NO: 724770 - protein, 9 aa, Homo Sapiens
EFYQQLNDL

SEQ ID NO: 724771 - protein, 9 aa, Homo Sapiens
QVPECGRSQ

SEQ ID NO: 724772 - protein, 9 aa, Homo Sapiens
NTTSAELYE

SEQ ID NO: 724773 - protein, 9 aa, Homo Sapiens
HEALYSVTG

SEQ ID NO: 724774 - protein, 9 aa, Homo Sapiens
ADTPGGMQE

SEQ ID NO: 724775 - protein, 9 aa, Homo Sapiens
WGCQQAKLP

SEQ ID NO: 724776 - protein, 9 aa, Homo Sapiens
VLQECKLQG

SEQ ID NO: 724777 - protein, 9 aa, Homo Sapiens
QCRMLKKSR

SEQ ID NO: 724778 - protein, 9 aa, Homo Sapiens
QEHSSRLKA

SEQ ID NO: 724779 - protein, 9 aa, Homo Sapiens
QCGDGDGGA

SEQ ID NO: 724780 - protein, 9 aa, Homo Sapiens
TEIATVHCS

SEQ ID NO: 724781 - protein, 9 aa, Homo Sapiens
SCAHLAGGQ

SEQ ID NO: 724782 - protein, 9 aa, Homo Sapiens
NFNSMRMDM

SEQ ID NO: 724783 - protein, 9 aa, Homo Sapiens
LLAAEHLEE

SEQ ID NO: 724784 - protein, 9 aa, Homo Sapiens
LLTASLPNF

SEQ ID NO: 724785 - protein, 9 aa, Homo Sapiens
RIFKETELK

SEQ ID NO: 724786 - protein, 9 aa, Homo Sapiens
RRLYHREGF

SEQ ID NO: 724787 - protein, 9 aa, Homo Sapiens
EQGSYVVTM

SEQ ID NO: 724788 - protein, 9 aa, Homo Sapiens
VVVGTSYGL

SEQ ID NO: 724789 - protein, 9 aa, Homo Sapiens
RDAVWSLWK

SEQ ID NO: 724790 - protein, 9 aa, Homo Sapiens
PKGQMGSCG

SEQ ID NO: 724791 - protein, 9 aa, Homo Sapiens
LPPHDAPGP

SEQ ID NO: 724792 - protein, 9 aa, Homo Sapiens
CATFSAHCG

SEQ ID NO: 724793 - protein, 9 aa, Homo Sapiens
PQPPPSSCE

SEQ ID NO: 724794 - protein, 9 aa, Homo Sapiens
LFRDEVFHF

SEQ ID NO: 724795 - protein, 9 aa, Homo Sapiens
RFVIELLER

SEQ ID NO: 724796 - protein, 9 aa, Homo Sapiens
VGQCVSFQQ

SEQ ID NO: 724797 - protein, 9 aa, Homo Sapiens
AGGVPILPR

SEQ ID NO: 724798 - protein, 9 aa, Homo Sapiens
DLCHGDRWR

SEQ ID NO: 724799 - protein, 9 aa, Homo Sapiens
CSPQWSHHG

SEQ ID NO: 724800 - protein, 9 aa, Homo Sapiens
QALRAASPA

SEQ ID NO: 724801 - protein, 9 aa, Homo Sapiens
VLEPIPVAH

SEQ ID NO: 724802 - protein, 9 aa, Homo Sapiens
SSYAGKTPG

SEQ ID NO: 724803 - protein, 9 aa, Homo Sapiens
DNPDASLPN

SEQ ID NO: 724804 - protein, 9 aa, Homo Sapiens
ITIGNVIGS

SEQ ID NO: 724805 - protein, 9 aa, Homo Sapiens
IQTTQPEAT

SEQ ID NO: 724806 - protein, 9 aa, Homo Sapiens
LNVHGALAP

SEQ ID NO: 724807 - protein, 9 aa, Homo Sapiens
DNVTVSTII

SEQ ID NO: 724808 - protein, 9 aa, Homo Sapiens
QWSPALTIF

SEQ ID NO: 724809 - protein, 9 aa, Homo Sapiens
GPHWPLQPM

SEQ ID NO: 724810 - protein, 9 aa, Homo Sapiens
CGYTGLINY

SEQ ID NO: 724811 - protein, 9 aa, Homo Sapiens
PTPHPHPHP

SEQ ID NO: 724812 - protein, 9 aa, Homo Sapiens
PDQNQDMPP

SEQ ID NO: 724813 - protein, 9 aa, Homo Sapiens
FSLEEISYY

SEQ ID NO: 724814 - protein, 9 aa, Homo Sapiens
DHLPPRGDQ

SEQ ID NO: 724815 - protein, 9 aa, Homo Sapiens
DFHSFINPR

SEQ ID NO: 724816 - protein, 9 aa, Homo Sapiens
GVPLLAAEH

SEQ ID NO: 724817 - protein, 9 aa, Homo Sapiens
YDVKDTLRT

SEQ ID NO: 724818 - protein, 9 aa, Homo Sapiens
QLGEKRQDG

SEQ ID NO: 724819 - protein, 9 aa, Homo Sapiens
NETAFETIY

SEQ ID NO: 724820 - protein, 9 aa, Homo Sapiens
RSSEENLPT

SEQ ID NO: 724821 - protein, 9 aa, Homo Sapiens
SACTNDGRS

SEQ ID NO: 724822 - protein, 9 aa, Homo Sapiens
DGFNFKELF

SEQ ID NO: 724823 - protein, 9 aa, Homo Sapiens
KHITLCALL

SEQ ID NO: 724824 - protein, 9 aa, Homo Sapiens
SLEKKLPLL

SEQ ID NO: 724825 - protein, 9 aa, Homo Sapiens
VPYGDLVTV

SEQ ID NO: 724826 - protein, 9 aa, Homo Sapiens
GPLPKPLTP

SEQ ID NO: 724827 - protein, 9 aa, Homo Sapiens
GGRHPSWPW

SEQ ID NO: 724828 - protein, 9 aa, Homo Sapiens
RPRKAPDTY

SEQ ID NO: 724829 - protein, 9 aa, Homo Sapiens
RQYQQRKRQ

SEQ ID NO: 724830 - protein, 9 aa, Homo Sapiens
RPLSPPGAP

SEQ ID NO: 724831 - protein, 9 aa, Homo Sapiens
TGFTSPDEM

SEQ ID NO: 724832 - protein, 9 aa, Homo Sapiens
PTFLPFLLL

SEQ ID NO: 724833 - protein, 9 aa, Homo Sapiens
AFVGENAEV

SEQ ID NO: 724834 - protein, 9 aa, Homo Sapiens
KCEQTRPKP

SEQ ID NO: 724835 - protein, 9 aa, Homo Sapiens
MGVWVHQGV

SEQ ID NO: 724836 - protein, 9 aa, Homo Sapiens
LHILNMTSA

SEQ ID NO: 724837 - protein, 9 aa, Homo Sapiens
SQHFLPLTC

SEQ ID NO: 724838 - protein, 9 aa, Homo Sapiens
KKSYLTCST

SEQ ID NO: 724839 - protein, 9 aa, Homo Sapiens
TWGPHWPLQ

SEQ ID NO: 724840 - protein, 9 aa, Homo Sapiens
NSVSDKEAA

SEQ ID NO: 724841 - protein, 9 aa, Homo Sapiens
INERPEFHK

SEQ ID NO: 724842 - protein, 9 aa, Homo Sapiens
AFVSVLLAL

SEQ ID NO: 724843 - protein, 9 aa, Homo Sapiens
RIPWGRRPS

SEQ ID NO: 724844 - protein, 9 aa, Homo Sapiens
AEGRKKSYL

SEQ ID NO: 724845 - protein, 9 aa, Homo Sapiens
ILDRDDLNV

SEQ ID NO: 724846 - protein, 9 aa, Homo Sapiens
LPTNTTSAE

SEQ ID NO: 724847 - protein, 9 aa, Homo Sapiens
TRKGPAPVG

SEQ ID NO: 724848 - protein, 9 aa, Homo Sapiens
LPQEQLIEW

SEQ ID NO: 724849 - protein, 9 aa, Homo Sapiens
QGVLVGNQE

SEQ ID NO: 724850 - protein, 9 aa, Homo Sapiens
MAPFLWCQE

SEQ ID NO: 724851 - protein, 9 aa, Homo Sapiens
VCQLGTWGA

SEQ ID NO: 724852 - protein, 9 aa, Homo Sapiens
DVMVGGHSN

SEQ ID NO: 724853 - protein, 9 aa, Homo Sapiens
GLPGDHADH

SEQ ID NO: 724854 - protein, 9 aa, Homo Sapiens
LDSSILSAG

SEQ ID NO: 724855 - protein, 9 aa, Homo Sapiens
GLPSVGGRR

SEQ ID NO: 724856 - protein, 9 aa, Homo Sapiens
ARLPAPHVQ

SEQ ID NO: 724857 - protein, 9 aa, Homo Sapiens
FDDNPDASL

SEQ ID NO: 724858 - protein, 9 aa, Homo Sapiens
LMQSRRTKP

SEQ ID NO: 724859 - protein, 9 aa, Homo Sapiens
RPYGKLVSV

SEQ ID NO: 724860 - protein, 9 aa, Homo Sapiens
RCITQIFFS

SEQ ID NO: 724861 - protein, 9 aa, Homo Sapiens
PAHVFRQCL

SEQ ID NO: 724862 - protein, 9 aa, Homo Sapiens
ETIKTFLKK

SEQ ID NO: 724863 - protein, 9 aa, Homo Sapiens
TTTPAVYDR

SEQ ID NO: 724864 - protein, 9 aa, Homo Sapiens
SQLGQNIIA

SEQ ID NO: 724865 - protein, 9 aa, Homo Sapiens
YLSMLDIVS

SEQ ID NO: 724866 - protein, 9 aa, Homo Sapiens
NFINAKLPP

SEQ ID NO: 724867 - protein, 9 aa, Homo Sapiens
FTKDNSRSN

SEQ ID NO: 724868 - protein, 9 aa, Homo Sapiens
SGPTRWQDK

SEQ ID NO: 724869 - protein, 9 aa, Homo Sapiens
GHTTALHDT

SEQ ID NO: 724870 - protein, 9 aa, Homo Sapiens
YNDYKIRLG

SEQ ID NO: 724871 - protein, 9 aa, Homo Sapiens
RSMSISLPM

SEQ ID NO: 724872 - protein, 9 aa, Homo Sapiens
EIATVHCSA

SEQ ID NO: 724873 - protein, 9 aa, Homo Sapiens
RAGDYEGLE

SEQ ID NO: 724874 - protein, 9 aa, Homo Sapiens
RLCKMDNEF

SEQ ID NO: 724875 - protein, 9 aa, Homo Sapiens
LCPGERAHS

SEQ ID NO: 724876 - protein, 9 aa, Homo Sapiens
AELGLGVCQ

SEQ ID NO: 724877 - protein, 9 aa, Homo Sapiens
FNEGGSIKQ

SEQ ID NO: 724878 - protein, 9 aa, Homo Sapiens
DSEPATDGP

SEQ ID NO: 724879 - protein, 9 aa, Homo Sapiens
EEEGVVAAL

SEQ ID NO: 724880 - protein, 9 aa, Homo Sapiens
PCMITGTVV

SEQ ID NO: 724881 - protein, 9 aa, Homo Sapiens
KYCTKVLTS

SEQ ID NO: 724882 - protein, 9 aa, Homo Sapiens
EAAQRIGFP

SEQ ID NO: 724883 - protein, 9 aa, Homo Sapiens
TMLKGEYTY

SEQ ID NO: 724884 - protein, 9 aa, Homo Sapiens
LPNHLPKAS

SEQ ID NO: 724885 - protein, 9 aa, Homo Sapiens
TGYKESCCL

SEQ ID NO: 724886 - protein, 9 aa, Homo Sapiens
FNSMRMDMF

SEQ ID NO: 724887 - protein, 9 aa, Homo Sapiens
IAFPQTPAA

SEQ ID NO: 724888 - protein, 9 aa, Homo Sapiens
VRHAAAIYL

SEQ ID NO: 724889 - protein, 9 aa, Homo Sapiens
EELSNLVNY

SEQ ID NO: 724890 - protein, 9 aa, Homo Sapiens
YKCKERGKA

SEQ ID NO: 724891 - protein, 9 aa, Homo Sapiens
LISEDEIAK

SEQ ID NO: 724892 - protein, 9 aa, Homo Sapiens
MDSGGRPSL

SEQ ID NO: 724893 - protein, 9 aa, Homo Sapiens
KKRKSRSLL

SEQ ID NO: 724894 - protein, 9 aa, Homo Sapiens
APLFCQQLW

SEQ ID NO: 724895 - protein, 9 aa, Homo Sapiens
GAFLTVCDA

SEQ ID NO: 724896 - protein, 9 aa, Homo Sapiens
SPPSPLCLI

SEQ ID NO: 724897 - protein, 9 aa, Homo Sapiens
SHPLFGRLV

SEQ ID NO: 724898 - protein, 9 aa, Homo Sapiens
ELQMSWLIR

SEQ ID NO: 724899 - protein, 9 aa, Homo Sapiens
KPVSPHHPS

SEQ ID NO: 724900 - protein, 9 aa, Homo Sapiens
SRLNALVQR

SEQ ID NO: 724901 - protein, 9 aa, Homo Sapiens
VPLSCAAYK

SEQ ID NO: 724902 - protein, 9 aa, Homo Sapiens
RQKIQHTAR

SEQ ID NO: 724903 - protein, 9 aa, Homo Sapiens
KGKASPCIE

SEQ ID NO: 724904 - protein, 9 aa, Homo Sapiens
KAEKSVLEI

SEQ ID NO: 724905 - protein, 9 aa, Homo Sapiens
NCGSPAFYT

SEQ ID NO: 724906 - protein, 9 aa, Homo Sapiens
ECAHFRYEN

SEQ ID NO: 724907 - protein, 9 aa, Homo Sapiens
GAGGSSSIP

SEQ ID NO: 724908 - protein, 9 aa, Homo Sapiens
EAEKFGHGA

SEQ ID NO: 724909 - protein, 9 aa, Homo Sapiens
DGCSEEQLM

SEQ ID NO: 724910 - protein, 9 aa, Homo Sapiens
VAPFSVGLH

SEQ ID NO: 724911 - protein, 9 aa, Homo Sapiens
MITGTVVSI

SEQ ID NO: 724912 - protein, 9 aa, Homo Sapiens
HQGSWYFGR

SEQ ID NO: 724913 - protein, 9 aa, Homo Sapiens
LSMQFFIGI

SEQ ID NO: 724914 - protein, 9 aa, Homo Sapiens
EDEEEEYPS

SEQ ID NO: 724915 - protein, 9 aa, Homo Sapiens
ESRTSVTRR

SEQ ID NO: 724916 - protein, 9 aa, Homo Sapiens
LFCYVQSPG

SEQ ID NO: 724917 - protein, 9 aa, Homo Sapiens
SLFLNSNSF

SEQ ID NO: 724918 - protein, 9 aa, Homo Sapiens
MPWAPLFCQ

SEQ ID NO: 724919 - protein, 9 aa, Homo Sapiens
ICKSEPNTY

SEQ ID NO: 724920 - protein, 9 aa, Homo Sapiens
HEIGQQWFG

SEQ ID NO: 724921 - protein, 9 aa, Homo Sapiens
RCILHSILF

SEQ ID NO: 724922 - protein, 9 aa, Homo Sapiens
KSPARGSLP

SEQ ID NO: 724923 - protein, 9 aa, Homo Sapiens
IRPSLELVA

SEQ ID NO: 724924 - protein, 9 aa, Homo Sapiens
ALSKLSEID

SEQ ID NO: 724925 - protein, 9 aa, Homo Sapiens
SQLFLYLGS

SEQ ID NO: 724926 - protein, 9 aa, Homo Sapiens
RRSRASSVG

SEQ ID NO: 724927 - protein, 9 aa, Homo Sapiens
VRSRDAFHE

SEQ ID NO: 724928 - protein, 9 aa, Homo Sapiens
NTFNLAFYS

SEQ ID NO: 724929 - protein, 9 aa, Homo Sapiens
PNGIAQVSF

SEQ ID NO: 724930 - protein, 9 aa, Homo Sapiens
ILLGTFEKH

SEQ ID NO: 724931 - protein, 9 aa, Homo Sapiens
SYSACTNDG

SEQ ID NO: 724932 - protein, 9 aa, Homo Sapiens
PCELQMSWL

SEQ ID NO: 724933 - protein, 9 aa, Homo Sapiens
GFQLPSSTV

SEQ ID NO: 724934 - protein, 9 aa, Homo Sapiens
SRASSVGRC

SEQ ID NO: 724935 - protein, 9 aa, Homo Sapiens
SSYYQHSSP

SEQ ID NO: 724936 - protein, 9 aa, Homo Sapiens
EDYFRLYTD

SEQ ID NO: 724937 - protein, 9 aa, Homo Sapiens
EGAMQKAKQ

SEQ ID NO: 724938 - protein, 9 aa, Homo Sapiens
DKALVEVER

SEQ ID NO: 724939 - protein, 9 aa, Homo Sapiens
APHKGPLPK

SEQ ID NO: 724940 - protein, 9 aa, Homo Sapiens
DLEGSIQEP

SEQ ID NO: 724941 - protein, 9 aa, Homo Sapiens
STITFCASS

SEQ ID NO: 724942 - protein, 9 aa, Homo Sapiens
RGCVSEHRL

SEQ ID NO: 724943 - protein, 9 aa, Homo Sapiens
PIAVRSRDA

SEQ ID NO: 724944 - protein, 9 aa, Homo Sapiens
SVGDSISIE

SEQ ID NO: 724945 - protein, 9 aa, Homo Sapiens
SGTRPRNQG

SEQ ID NO: 724946 - protein, 9 aa, Homo Sapiens
ISHATSSIV

SEQ ID NO: 724947 - protein, 9 aa, Homo Sapiens
RPTQSSLAR

SEQ ID NO: 724948 - protein, 9 aa, Homo Sapiens
GTRPRNQGL

SEQ ID NO: 724949 - protein, 9 aa, Homo Sapiens
PNGTLGSWF

SEQ ID NO: 724950 - protein, 9 aa, Homo Sapiens
RPPACTTRC

SEQ ID NO: 724951 - protein, 9 aa, Homo Sapiens
DEYFGHCHI

SEQ ID NO: 724952 - protein, 9 aa, Homo Sapiens
AMAGPHYPL

SEQ ID NO: 724953 - protein, 9 aa, Homo Sapiens
TKTHNQILK

SEQ ID NO: 724954 - protein, 9 aa, Homo Sapiens
HSSPGTKKP

SEQ ID NO: 724955 - protein, 9 aa, Homo Sapiens
PQQPYFITN

SEQ ID NO: 724956 - protein, 9 aa, Homo Sapiens
SAGKSKLAV

SEQ ID NO: 724957 - protein, 9 aa, Homo Sapiens
PYAPYAAAP

SEQ ID NO: 724958 - protein, 9 aa, Homo Sapiens
WDAPGDELD

SEQ ID NO: 724959 - protein, 9 aa, Homo Sapiens
QLENAKAAK

SEQ ID NO: 724960 - protein, 9 aa, Homo Sapiens
RHDCYLLRE

SEQ ID NO: 724961 - protein, 9 aa, Homo Sapiens
HRPDNGEEA

SEQ ID NO: 724962 - protein, 9 aa, Homo Sapiens
LPLDLMLTS

SEQ ID NO: 724963 - protein, 9 aa, Homo Sapiens
SNPYGGGGR

SEQ ID NO: 724964 - protein, 9 aa, Homo Sapiens
LAVMAYDLY

SEQ ID NO: 724965 - protein, 9 aa, Homo Sapiens
WGRRPSPPR

SEQ ID NO: 724966 - protein, 9 aa, Homo Sapiens
QVVRNEGGV

SEQ ID NO: 724967 - protein, 9 aa, Homo Sapiens
MGRTGTGFT

SEQ ID NO: 724968 - protein, 9 aa, Homo Sapiens
FPRLMQKIT

SEQ ID NO: 724969 - protein, 9 aa, Homo Sapiens
SMNPTMLAV

SEQ ID NO: 724970 - protein, 9 aa, Homo Sapiens
DVRLQEPIV

SEQ ID NO: 724971 - protein, 9 aa, Homo Sapiens
RDDLNVDRE

SEQ ID NO: 724972 - protein, 9 aa, Homo Sapiens
DSALIFGMF

SEQ ID NO: 724973 - protein, 9 aa, Homo Sapiens
QLISLDLIY

SEQ ID NO: 724974 - protein, 9 aa, Homo Sapiens
VVYSLPRVV

SEQ ID NO: 724975 - protein, 9 aa, Homo Sapiens
VRTRDKKEV

SEQ ID NO: 724976 - protein, 9 aa, Homo Sapiens
HFTDNCLIN

SEQ ID NO: 724977 - protein, 9 aa, Homo Sapiens
YFGHCHILL

SEQ ID NO: 724978 - protein, 9 aa, Homo Sapiens
MVVRAMKDK

SEQ ID NO: 724979 - protein, 9 aa, Homo Sapiens
NEGFLCRIS

SEQ ID NO: 724980 - protein, 9 aa, Homo Sapiens
QHKYDVTPL

SEQ ID NO: 724981 - protein, 9 aa, Homo Sapiens
KFLLPSANY

SEQ ID NO: 724982 - protein, 9 aa, Homo Sapiens
INSLAIPIN

SEQ ID NO: 724983 - protein, 9 aa, Homo Sapiens
ECGRSQDAP

SEQ ID NO: 724984 - protein, 9 aa, Homo Sapiens
PPVKEEPPL

SEQ ID NO: 724985 - protein, 9 aa, Homo Sapiens
FNLAFYSFH

SEQ ID NO: 724986 - protein, 9 aa, Homo Sapiens
IQAATPQVA

SEQ ID NO: 724987 - protein, 9 aa, Homo Sapiens
RKSRSLLPL

SEQ ID NO: 724988 - protein, 9 aa, Homo Sapiens
RFGLPSVGG

SEQ ID NO: 724989 - protein, 9 aa, Homo Sapiens
GEGRSPPTA

SEQ ID NO: 724990 - protein, 9 aa, Homo Sapiens
ELPESVEEY

SEQ ID NO: 724991 - protein, 9 aa, Homo Sapiens
KIFRHKFSL

SEQ ID NO: 724992 - protein, 9 aa, Homo Sapiens
TSCSLSEES

SEQ ID NO: 724993 - protein, 9 aa, Homo Sapiens
VDPRIGGVG

SEQ ID NO: 724994 - protein, 9 aa, Homo Sapiens
KNKVRGVRQ

SEQ ID NO: 724995 - protein, 9 aa, Homo Sapiens
ILGLLVVLI

SEQ ID NO: 724996 - protein, 9 aa, Homo Sapiens
DSMFCPGAE

SEQ ID NO: 724997 - protein, 9 aa, Homo Sapiens
TASNHRLNP

SEQ ID NO: 724998 - protein, 9 aa, Homo Sapiens
VSISQSNLM

SEQ ID NO: 724999 - protein, 9 aa, Homo Sapiens
FIFFFGVYE

SEQ ID NO: 725000 - protein, 9 aa, Homo Sapiens
GRPLSCSVD

SEQ ID NO: 725001 - protein, 9 aa, Homo Sapiens
AALGQDCYT

SEQ ID NO: 725002 - protein, 9 aa, Homo Sapiens
PYVLSYKDR

SEQ ID NO: 725003 - protein, 9 aa, Homo Sapiens
CDLKFHIYN

SEQ ID NO: 725004 - protein, 9 aa, Homo Sapiens
QALIPVQLL

SEQ ID NO: 725005 - protein, 9 aa, Homo Sapiens
KRKSRSLLP

SEQ ID NO: 725006 - protein, 9 aa, Homo Sapiens
PVRHRPEAS

SEQ ID NO: 725007 - protein, 9 aa, Homo Sapiens
AVWSLWKAP

SEQ ID NO: 725008 - protein, 9 aa, Homo Sapiens
ITFCASSCS

SEQ ID NO: 725009 - protein, 9 aa, Homo Sapiens
YRLKGVGQV

SEQ ID NO: 725010 - protein, 9 aa, Homo Sapiens
SYLYQRQPR

SEQ ID NO: 725011 - protein, 9 aa, Homo Sapiens
ILDSVGIVA

SEQ ID NO: 725012 - protein, 9 aa, Homo Sapiens
VQPETLSQG

SEQ ID NO: 725013 - protein, 9 aa, Homo Sapiens
LNDLGQPAL

SEQ ID NO: 725014 - protein, 9 aa, Homo Sapiens
LAPWPGLPG

SEQ ID NO: 725015 - protein, 9 aa, Homo Sapiens
NCVDYMGQK

SEQ ID NO: 725016 - protein, 9 aa, Homo Sapiens
CITKCEQTR

SEQ ID NO: 725017 - protein, 9 aa, Homo Sapiens
QSSPAMAGP

SEQ ID NO: 725018 - protein, 9 aa, Homo Sapiens
AIEDEEEEY

SEQ ID NO: 725019 - protein, 9 aa, Homo Sapiens
SAELYEAVK

SEQ ID NO: 725020 - protein, 9 aa, Homo Sapiens
LKGVPPDKF

SEQ ID NO: 725021 - protein, 9 aa, Homo Sapiens
QMQCGDGDG

SEQ ID NO: 725022 - protein, 9 aa, Homo Sapiens
PGQTAAYWV

SEQ ID NO: 725023 - protein, 9 aa, Homo Sapiens
AGGFPMVNN

SEQ ID NO: 725024 - protein, 9 aa, Homo Sapiens
ASSCSSFCP

SEQ ID NO: 725025 - protein, 9 aa, Homo Sapiens
FDPAPFKVT

SEQ ID NO: 725026 - protein, 9 aa, Homo Sapiens
AIFKIRIGH

SEQ ID NO: 725027 - protein, 9 aa, Homo Sapiens
RMEMFVFCF

SEQ ID NO: 725028 - protein, 9 aa, Homo Sapiens
SSCSCQSSR

SEQ ID NO: 725029 - protein, 9 aa, Homo Sapiens
APSLRPPPP

SEQ ID NO: 725030 - protein, 9 aa, Homo Sapiens
KECVIKKDA

SEQ ID NO: 725031 - protein, 9 aa, Homo Sapiens
RRLFSKECC

SEQ ID NO: 725032 - protein, 9 aa, Homo Sapiens
GWSTLHIAA

SEQ ID NO: 725033 - protein, 9 aa, Homo Sapiens
SLFVLIETL

SEQ ID NO: 725034 - protein, 9 aa, Homo Sapiens
ALCAVHLPE

SEQ ID NO: 725035 - protein, 9 aa, Homo Sapiens
NSMNPTMLA

SEQ ID NO: 725036 - protein, 9 aa, Homo Sapiens
KILDSVGIV

SEQ ID NO: 725037 - protein, 9 aa, Homo Sapiens
DSVHGLSYA

SEQ ID NO: 725038 - protein, 9 aa, Homo Sapiens
QMGAVGQSC

SEQ ID NO: 725039 - protein, 9 aa, Homo Sapiens
IVILWESID

SEQ ID NO: 725040 - protein, 9 aa, Homo Sapiens
LNPRTFLPD

SEQ ID NO: 725041 - protein, 9 aa, Homo Sapiens
IEQRSMSIS

SEQ ID NO: 725042 - protein, 9 aa, Homo Sapiens
SFRSRLNAL

SEQ ID NO: 725043 - protein, 9 aa, Homo Sapiens
KNRCILHSI

SEQ ID NO: 725044 - protein, 9 aa, Homo Sapiens
TNETQVVRN

SEQ ID NO: 725045 - protein, 9 aa, Homo Sapiens
QPPPLLPLL

SEQ ID NO: 725046 - protein, 9 aa, Homo Sapiens
KSSPCELQM

SEQ ID NO: 725047 - protein, 9 aa, Homo Sapiens
FRPPPKRTL

SEQ ID NO: 725048 - protein, 9 aa, Homo Sapiens
RTPIAFPQT

SEQ ID NO: 725049 - protein, 9 aa, Homo Sapiens
LRPNEISVA

SEQ ID NO: 725050 - protein, 9 aa, Homo Sapiens
CWYLLSNLN

SEQ ID NO: 725051 - protein, 9 aa, Homo Sapiens
IVKVYDEWK

SEQ ID NO: 725052 - protein, 9 aa, Homo Sapiens
YFYATSCFS

SEQ ID NO: 725053 - protein, 9 aa, Homo Sapiens
PRPRPSQPC

SEQ ID NO: 725054 - protein, 9 aa, Homo Sapiens
DDNPDASLP

SEQ ID NO: 725055 - protein, 9 aa, Homo Sapiens
CILNYLKSS

SEQ ID NO: 725056 - protein, 9 aa, Homo Sapiens
CGSPAFYTA

SEQ ID NO: 725057 - protein, 9 aa, Homo Sapiens
IVHVSLHGL

SEQ ID NO: 725058 - protein, 9 aa, Homo Sapiens
PGDELDNDN

SEQ ID NO: 725059 - protein, 9 aa, Homo Sapiens
LRNLLMPQQ

SEQ ID NO: 725060 - protein, 9 aa, Homo Sapiens
HKPKLGKKL

SEQ ID NO: 725061 - protein, 9 aa, Homo Sapiens
RVHTGERPC

SEQ ID NO: 725062 - protein, 9 aa, Homo Sapiens
RQPHNATNP

SEQ ID NO: 725063 - protein, 9 aa, Homo Sapiens
QSLSRREST

SEQ ID NO: 725064 - protein, 9 aa, Homo Sapiens
EFPVRHAAA

SEQ ID NO: 725065 - protein, 9 aa, Homo Sapiens
CENLGIWKA

SEQ ID NO: 725066 - protein, 9 aa, Homo Sapiens
QTHLPGKSP

SEQ ID NO: 725067 - protein, 9 aa, Homo Sapiens
KWVQGVGWL

SEQ ID NO: 725068 - protein, 9 aa, Homo Sapiens
IILASINFT

SEQ ID NO: 725069 - protein, 9 aa, Homo Sapiens
LDWPPCLAE

SEQ ID NO: 725070 - protein, 9 aa, Homo Sapiens
DIVSGNSVY

SEQ ID NO: 725071 - protein, 9 aa, Homo Sapiens
QQAKLPLPR

SEQ ID NO: 725072 - protein, 9 aa, Homo Sapiens
GKILPRVHQ

SEQ ID NO: 725073 - protein, 9 aa, Homo Sapiens
ARHRRWRTQ

SEQ ID NO: 725074 - protein, 9 aa, Homo Sapiens
IHALAELEQ

SEQ ID NO: 725075 - protein, 9 aa, Homo Sapiens
SAHCGSLKK

SEQ ID NO: 725076 - protein, 9 aa, Homo Sapiens
EQRSMSISL

SEQ ID NO: 725077 - protein, 9 aa, Homo Sapiens
KEAEKFGHG

SEQ ID NO: 725078 - protein, 9 aa, Homo Sapiens
TLHIAAFGG

SEQ ID NO: 725079 - protein, 9 aa, Homo Sapiens
NADFWGPLA

SEQ ID NO: 725080 - protein, 9 aa, Homo Sapiens
LSWVPIPSQ

SEQ ID NO: 725081 - protein, 9 aa, Homo Sapiens
GPGLPPHDA

SEQ ID NO: 725082 - protein, 9 aa, Homo Sapiens
LRLHFRIHT

SEQ ID NO: 725083 - protein, 9 aa, Homo Sapiens
RTSVLFANE

SEQ ID NO: 725084 - protein, 9 aa, Homo Sapiens
STTHNIFSS

SEQ ID NO: 725085 - protein, 9 aa, Homo Sapiens
YDIRLVAAQ

SEQ ID NO: 725086 - protein, 9 aa, Homo Sapiens
PRGDQCCFQ

SEQ ID NO: 725087 - protein, 9 aa, Homo Sapiens
LFSQLVESR

SEQ ID NO: 725088 - protein, 9 aa, Homo Sapiens
EFFKGLFGG

SEQ ID NO: 725089 - protein, 9 aa, Homo Sapiens
ILLHLQSQL

SEQ ID NO: 725090 - protein, 9 aa, Homo Sapiens
FFKRLGSHS

SEQ ID NO: 725091 - protein, 9 aa, Homo Sapiens
WIFTGGVSR

SEQ ID NO: 725092 - protein, 9 aa, Homo Sapiens
HLAGGQPCV

SEQ ID NO: 725093 - protein, 9 aa, Homo Sapiens
EDMALLEDL

SEQ ID NO: 725094 - protein, 9 aa, Homo Sapiens
SLDVLHRHL

SEQ ID NO: 725095 - protein, 9 aa, Homo Sapiens
RQQQEGNYL

SEQ ID NO: 725096 - protein, 9 aa, Homo Sapiens
DFVISLLLL

SEQ ID NO: 725097 - protein, 9 aa, Homo Sapiens
LDADMKDAE

SEQ ID NO: 725098 - protein, 9 aa, Homo Sapiens
TVCLPFCGP

SEQ ID NO: 725099 - protein, 9 aa, Homo Sapiens
SRTSVTRRA

SEQ ID NO: 725100 - protein, 9 aa, Homo Sapiens
TSVPASGQA

SEQ ID NO: 725101 - protein, 9 aa, Homo Sapiens
GRQEDRLYT

SEQ ID NO: 725102 - protein, 9 aa, Homo Sapiens
SIQSTKPRG

SEQ ID NO: 725103 - protein, 9 aa, Homo Sapiens
RDHLNSMNP

SEQ ID NO: 725104 - protein, 9 aa, Homo Sapiens
QLDPSNAIR

SEQ ID NO: 725105 - protein, 9 aa, Homo Sapiens
YALPTEGAC

SEQ ID NO: 725106 - protein, 9 aa, Homo Sapiens
DFPLLPSGI

SEQ ID NO: 725107 - protein, 9 aa, Homo Sapiens
GPPSESSSS

SEQ ID NO: 725108 - protein, 9 aa, Homo Sapiens
AEGYYDIRL

SEQ ID NO: 725109 - protein, 9 aa, Homo Sapiens
SFQQSQAQA

SEQ ID NO: 725110 - protein, 9 aa, Homo Sapiens
PYKCKERGK

SEQ ID NO: 725111 - protein, 9 aa, Homo Sapiens
ACAPDSYET

SEQ ID NO: 725112 - protein, 9 aa, Homo Sapiens
GLSVLNVHG

SEQ ID NO: 725113 - protein, 9 aa, Homo Sapiens
INGPSDWQK

SEQ ID NO: 725114 - protein, 9 aa, Homo Sapiens
AHCGSLKKQ

SEQ ID NO: 725115 - protein, 9 aa, Homo Sapiens
CPSWPRPAP

SEQ ID NO: 725116 - protein, 9 aa, Homo Sapiens
DIGAIFKIR

SEQ ID NO: 725117 - protein, 9 aa, Homo Sapiens
PGPLPASHP

SEQ ID NO: 725118 - protein, 9 aa, Homo Sapiens
AKIVHVSLH

SEQ ID NO: 725119 - protein, 9 aa, Homo Sapiens
TALRCYALP

SEQ ID NO: 725120 - protein, 9 aa, Homo Sapiens
RLGHILKYN

SEQ ID NO: 725121 - protein, 9 aa, Homo Sapiens
GLIVLGFPC

SEQ ID NO: 725122 - protein, 9 aa, Homo Sapiens
PSSVVVVTW

SEQ ID NO: 725123 - protein, 9 aa, Homo Sapiens
DVYYRLKGV

SEQ ID NO: 725124 - protein, 9 aa, Homo Sapiens
CECDLGGSY

SEQ ID NO: 725125 - protein, 9 aa, Homo Sapiens
PRGLSWVPI

SEQ ID NO: 725126 - protein, 9 aa, Homo Sapiens
EKYILSCAH

SEQ ID NO: 725127 - protein, 9 aa, Homo Sapiens
ELYSKRFLD

SEQ ID NO: 725128 - protein, 9 aa, Homo Sapiens
LILVEEGSE

SEQ ID NO: 725129 - protein, 9 aa, Homo Sapiens
VESRNPALE

SEQ ID NO: 725130 - protein, 9 aa, Homo Sapiens
RRSHANPLE

SEQ ID NO: 725131 - protein, 9 aa, Homo Sapiens
ALVQRSSRL

SEQ ID NO: 725132 - protein, 9 aa, Homo Sapiens
ITQELGKNQ

SEQ ID NO: 725133 - protein, 9 aa, Homo Sapiens
GVSRGVISH

SEQ ID NO: 725134 - protein, 9 aa, Homo Sapiens
NLKILHILN

SEQ ID NO: 725135 - protein, 9 aa, Homo Sapiens
AFYRLHQRL

SEQ ID NO: 725136 - protein, 9 aa, Homo Sapiens
YVFPKWVQG

SEQ ID NO: 725137 - protein, 9 aa, Homo Sapiens
SSQSNPYGG

SEQ ID NO: 725138 - protein, 9 aa, Homo Sapiens
KEALPGWMR

SEQ ID NO: 725139 - protein, 9 aa, Homo Sapiens
DRGAKGLLG

SEQ ID NO: 725140 - protein, 9 aa, Homo Sapiens
RRLLYGCDS

SEQ ID NO: 725141 - protein, 9 aa, Homo Sapiens
VNPELYSKR

SEQ ID NO: 725142 - protein, 9 aa, Homo Sapiens
SILLWVAPF

SEQ ID NO: 725143 - protein, 9 aa, Homo Sapiens
FSVGLHMGF

SEQ ID NO: 725144 - protein, 9 aa, Homo Sapiens
TRRPSLVQT

SEQ ID NO: 725145 - protein, 9 aa, Homo Sapiens
SSVGRCSVP

SEQ ID NO: 725146 - protein, 9 aa, Homo Sapiens
EGLPGFNSV

SEQ ID NO: 725147 - protein, 9 aa, Homo Sapiens
IQDAIQAAT

SEQ ID NO: 725148 - protein, 9 aa, Homo Sapiens
NPRTFLPDQ

SEQ ID NO: 725149 - protein, 9 aa, Homo Sapiens
LSGEPSQGD

SEQ ID NO: 725150 - protein, 9 aa, Homo Sapiens
QAGGFPMVN

SEQ ID NO: 725151 - protein, 9 aa, Homo Sapiens
CAIASLWSS

SEQ ID NO: 725152 - protein, 9 aa, Homo Sapiens
GDLVTVACE

SEQ ID NO: 725153 - protein, 9 aa, Homo Sapiens
GSRGWEGTQ

SEQ ID NO: 725154 - protein, 9 aa, Homo Sapiens
FFISLIQEN

SEQ ID NO: 725155 - protein, 9 aa, Homo Sapiens
APAVSGLFR

SEQ ID NO: 725156 - protein, 9 aa, Homo Sapiens
VIHALAELE

SEQ ID NO: 725157 - protein, 9 aa, Homo Sapiens
PAPQLGVGG

SEQ ID NO: 725158 - protein, 9 aa, Homo Sapiens
NEDIGKHPA

SEQ ID NO: 725159 - protein, 9 aa, Homo Sapiens
LNGNNQSLT

SEQ ID NO: 725160 - protein, 9 aa, Homo Sapiens
SLEEISYYF

SEQ ID NO: 725161 - protein, 9 aa, Homo Sapiens
NGRTYFFKD

SEQ ID NO: 725162 - protein, 9 aa, Homo Sapiens
GRHKAFYTC

SEQ ID NO: 725163 - protein, 9 aa, Homo Sapiens
ACPILTQNL

SEQ ID NO: 725164 - protein, 9 aa, Homo Sapiens
FINPREIPR

SEQ ID NO: 725165 - protein, 9 aa, Homo Sapiens
YALELLTTF

SEQ ID NO: 725166 - protein, 9 aa, Homo Sapiens
KPILLSQMS

SEQ ID NO: 725167 - protein, 9 aa, Homo Sapiens
LGLPQALIP

SEQ ID NO: 725168 - protein, 9 aa, Homo Sapiens
FHFHKAAED

SEQ ID NO: 725169 - protein, 9 aa, Homo Sapiens
FGLPSVGGR

SEQ ID NO: 725170 - protein, 9 aa, Homo Sapiens
CNSSCMGVM

SEQ ID NO: 725171 - protein, 9 aa, Homo Sapiens
PCTRLRWWQ

SEQ ID NO: 725172 - protein, 9 aa, Homo Sapiens
RERAFHLAT

SEQ ID NO: 725173 - protein, 9 aa, Homo Sapiens
RPSPPRDVA

SEQ ID NO: 725174 - protein, 9 aa, Homo Sapiens
DGYLTSGTE

SEQ ID NO: 725175 - protein, 9 aa, Homo Sapiens
VSHEIGQQW

SEQ ID NO: 725176 - protein, 9 aa, Homo Sapiens
GANVQSRDD

SEQ ID NO: 725177 - protein, 9 aa, Homo Sapiens
TPVFMKYAE

SEQ ID NO: 725178 - protein, 9 aa, Homo Sapiens
INNIDYYKE

SEQ ID NO: 725179 - protein, 9 aa, Homo Sapiens
CASEVLSGC

SEQ ID NO: 725180 - protein, 9 aa, Homo Sapiens
LDNTQENIK

SEQ ID NO: 725181 - protein, 9 aa, Homo Sapiens
AAFSWAHNG

SEQ ID NO: 725182 - protein, 9 aa, Homo Sapiens
TAAYWVRTP

SEQ ID NO: 725183 - protein, 9 aa, Homo Sapiens
ITAVLSEKQ

SEQ ID NO: 725184 - protein, 9 aa, Homo Sapiens
WSTLHIAAF

SEQ ID NO: 725185 - protein, 9 aa, Homo Sapiens
LDVTQSPRD

SEQ ID NO: 725186 - protein, 9 aa, Homo Sapiens
NDSMKLGTE

SEQ ID NO: 725187 - protein, 9 aa, Homo Sapiens
CQAVFQDLK

SEQ ID NO: 725188 - protein, 9 aa, Homo Sapiens
SSVVVVTWE

SEQ ID NO: 725189 - protein, 9 aa, Homo Sapiens
GRKKSYLTC

SEQ ID NO: 725190 - protein, 9 aa, Homo Sapiens
DLRAAVVIS

SEQ ID NO: 725191 - protein, 9 aa, Homo Sapiens
KTVQRLVPG

SEQ ID NO: 725192 - protein, 9 aa, Homo Sapiens
SDMASTPEN

SEQ ID NO: 725193 - protein, 9 aa, Homo Sapiens
EPMEVEEEP

SEQ ID NO: 725194 - protein, 9 aa, Homo Sapiens
NFIYLLFTK

SEQ ID NO: 725195 - protein, 9 aa, Homo Sapiens
NLTAEQPVF

SEQ ID NO: 725196 - protein, 9 aa, Homo Sapiens
RKRLSDSAL

SEQ ID NO: 725197 - protein, 9 aa, Homo Sapiens
MCRQQSQCL

SEQ ID NO: 725198 - protein, 9 aa, Homo Sapiens
SLFNETAFE

SEQ ID NO: 725199 - protein, 9 aa, Homo Sapiens
AMVLTVTSY

SEQ ID NO: 725200 - protein, 9 aa, Homo Sapiens
PDPSPSGVP

SEQ ID NO: 725201 - protein, 9 aa, Homo Sapiens
VGVQLGKWA

SEQ ID NO: 725202 - protein, 9 aa, Homo Sapiens
TLMQSRRTK

SEQ ID NO: 725203 - protein, 9 aa, Homo Sapiens
TAGVQPVFS

SEQ ID NO: 725204 - protein, 9 aa, Homo Sapiens
YTFQLPEDY

SEQ ID NO: 725205 - protein, 9 aa, Homo Sapiens
GWTSASSWT

SEQ ID NO: 725206 - protein, 9 aa, Homo Sapiens
GLGIRPSLE

SEQ ID NO: 725207 - protein, 9 aa, Homo Sapiens
FSTNKNRCI

SEQ ID NO: 725208 - protein, 9 aa, Homo Sapiens
CVSEHRLKV

SEQ ID NO: 725209 - protein, 9 aa, Homo Sapiens
TVIFRKNAS

SEQ ID NO: 725210 - protein, 9 aa, Homo Sapiens
VYYRLKGVG

SEQ ID NO: 725211 - protein, 9 aa, Homo Sapiens
DCVFYTLPA

SEQ ID NO: 725212 - protein, 9 aa, Homo Sapiens
HKAFYTCGS

SEQ ID NO: 725213 - protein, 9 aa, Homo Sapiens
NGTLGSWFK

SEQ ID NO: 725214 - protein, 9 aa, Homo Sapiens
TFCASSCSS

SEQ ID NO: 725215 - protein, 9 aa, Homo Sapiens
EELVLLQFQ

SEQ ID NO: 725216 - protein, 9 aa, Homo Sapiens
ALLERLGVG

SEQ ID NO: 725217 - protein, 9 aa, Homo Sapiens
KKHWDGEQS

SEQ ID NO: 725218 - protein, 9 aa, Homo Sapiens
EEISYYFPL

SEQ ID NO: 725219 - protein, 9 aa, Homo Sapiens
KSYLTCSTH

SEQ ID NO: 725220 - protein, 9 aa, Homo Sapiens
KNFLLLTKY

SEQ ID NO: 725221 - protein, 9 aa, Homo Sapiens
CLSVLFVTI

SEQ ID NO: 725222 - protein, 9 aa, Homo Sapiens
NLLTLVESL

SEQ ID NO: 725223 - protein, 9 aa, Homo Sapiens
LCAENRKEI

SEQ ID NO: 725224 - protein, 9 aa, Homo Sapiens
EFHKDPTWS

SEQ ID NO: 725225 - protein, 9 aa, Homo Sapiens
KIKPIVRDG

SEQ ID NO: 725226 - protein, 9 aa, Homo Sapiens
CYRGYLPSS

SEQ ID NO: 725227 - protein, 9 aa, Homo Sapiens
CSNCLAEQM

SEQ ID NO: 725228 - protein, 9 aa, Homo Sapiens
QPCSPLSAP

SEQ ID NO: 725229 - protein, 9 aa, Homo Sapiens
MQLCQRLST

SEQ ID NO: 725230 - protein, 9 aa, Homo Sapiens
MQTLTSTLE

SEQ ID NO: 725231 - protein, 9 aa, Homo Sapiens
GAGAFDVCQ

SEQ ID NO: 725232 - protein, 9 aa, Homo Sapiens
LRALRLLQL

SEQ ID NO: 725233 - protein, 9 aa, Homo Sapiens
KKESRITQE

SEQ ID NO: 725234 - protein, 9 aa, Homo Sapiens
QCCVAVYSL

SEQ ID NO: 725235 - protein, 9 aa, Homo Sapiens
TVEEALRMG

SEQ ID NO: 725236 - protein, 9 aa, Homo Sapiens
LELLTTFAW

SEQ ID NO: 725237 - protein, 9 aa, Homo Sapiens
FSTEFYQQL

SEQ ID NO: 725238 - protein, 9 aa, Homo Sapiens
GEGTMLEIL

SEQ ID NO: 725239 - protein, 9 aa, Homo Sapiens
LMQLCQRLS

SEQ ID NO: 725240 - protein, 9 aa, Homo Sapiens
IHYIPKNVR

SEQ ID NO: 725241 - protein, 9 aa, Homo Sapiens
KYNDYKIRL

SEQ ID NO: 725242 - protein, 9 aa, Homo Sapiens
SNVQCLPAF

SEQ ID NO: 725243 - protein, 9 aa, Homo Sapiens
VIHFLSWFL

SEQ ID NO: 725244 - protein, 9 aa, Homo Sapiens
YVATQCCVA

SEQ ID NO: 725245 - protein, 9 aa, Homo Sapiens
FRQCLVQGN

SEQ ID NO: 725246 - protein, 9 aa, Homo Sapiens
CVLGMGVWV

SEQ ID NO: 725247 - protein, 9 aa, Homo Sapiens
FLHVPETKR

SEQ ID NO: 725248 - protein, 9 aa, Homo Sapiens
RNTPLTSFG

SEQ ID NO: 725249 - protein, 9 aa, Homo Sapiens
PWHCRVGQC

SEQ ID NO: 725250 - protein, 9 aa, Homo Sapiens
LLSQMSCSG

SEQ ID NO: 725251 - protein, 9 aa, Homo Sapiens
GHNHSTSQM

SEQ ID NO: 725252 - protein, 9 aa, Homo Sapiens
QPVRVVILN

SEQ ID NO: 725253 - protein, 9 aa, Homo Sapiens
LQLGPAAQV

SEQ ID NO: 725254 - protein, 9 aa, Homo Sapiens
QSTKPRGLS

SEQ ID NO: 725255 - protein, 9 aa, Homo Sapiens
ALKSEVHEM

SEQ ID NO: 725256 - protein, 9 aa, Homo Sapiens
VQCLPAFWF

SEQ ID NO: 725257 - protein, 9 aa, Homo Sapiens
TVVSISQSN

SEQ ID NO: 725258 - protein, 9 aa, Homo Sapiens
FSTPATSLH

SEQ ID NO: 725259 - protein, 9 aa, Homo Sapiens
SCVPGLDCV

SEQ ID NO: 725260 - protein, 9 aa, Homo Sapiens
GSDLFTVQA

SEQ ID NO: 725261 - protein, 9 aa, Homo Sapiens
FTKATPLSL

SEQ ID NO: 725262 - protein, 9 aa, Homo Sapiens
YGATPYLFC

SEQ ID NO: 725263 - protein, 9 aa, Homo Sapiens
YSEKVPIHN

SEQ ID NO: 725264 - protein, 9 aa, Homo Sapiens
VSTLKDRLE

SEQ ID NO: 725265 - protein, 9 aa, Homo Sapiens
GAVSSAEAQ

SEQ ID NO: 725266 - protein, 9 aa, Homo Sapiens
WDSVDLDNT

SEQ ID NO: 725267 - protein, 9 aa, Homo Sapiens
SVSTGHTTA

SEQ ID NO: 725268 - protein, 9 aa, Homo Sapiens
HSFINPREI

SEQ ID NO: 725269 - protein, 9 aa, Homo Sapiens
IDSTSLFVL

SEQ ID NO: 725270 - protein, 9 aa, Homo Sapiens
ASDSENEDI

SEQ ID NO: 725271 - protein, 9 aa, Homo Sapiens
FWKGRQEDR

SEQ ID NO: 725272 - protein, 9 aa, Homo Sapiens
LEFEDGIYA

SEQ ID NO: 725273 - protein, 9 aa, Homo Sapiens
ATPYLFCYV

SEQ ID NO: 725274 - protein, 9 aa, Homo Sapiens
AVFQDLKGV

SEQ ID NO: 725275 - protein, 9 aa, Homo Sapiens
TGYVDDRGT

SEQ ID NO: 725276 - protein, 9 aa, Homo Sapiens
ETVINNANY

SEQ ID NO: 725277 - protein, 9 aa, Homo Sapiens
ALKQVREIC

SEQ ID NO: 725278 - protein, 9 aa, Homo Sapiens
HPLVLKTYF

SEQ ID NO: 725279 - protein, 9 aa, Homo Sapiens
SRITQELGK

SEQ ID NO: 725280 - protein, 9 aa, Homo Sapiens
SESAPPSFK

SEQ ID NO: 725281 - protein, 9 aa, Homo Sapiens
FHACASEVL

SEQ ID NO: 725282 - protein, 9 aa, Homo Sapiens
TCDFLHVPE

SEQ ID NO: 725283 - protein, 9 aa, Homo Sapiens
GTASSQISV

SEQ ID NO: 725284 - protein, 9 aa, Homo Sapiens
EHLQLFFVQ

SEQ ID NO: 725285 - protein, 9 aa, Homo Sapiens
VGCHPVLTV

SEQ ID NO: 725286 - protein, 9 aa, Homo Sapiens
QENRELMES

SEQ ID NO: 725287 - protein, 9 aa, Homo Sapiens
QGCGGSPVC

SEQ ID NO: 725288 - protein, 9 aa, Homo Sapiens
VSKFYAAAM

SEQ ID NO: 725289 - protein, 9 aa, Homo Sapiens
APSQSELDP

SEQ ID NO: 725290 - protein, 9 aa, Homo Sapiens
KLVEALDKV

SEQ ID NO: 725291 - protein, 9 aa, Homo Sapiens
LLGVEASGR

SEQ ID NO: 725292 - protein, 9 aa, Homo Sapiens
NCSDESLCK

SEQ ID NO: 725293 - protein, 9 aa, Homo Sapiens
KEMQLGLED

SEQ ID NO: 725294 - protein, 9 aa, Homo Sapiens
DRVAKLIPW

SEQ ID NO: 725295 - protein, 9 aa, Homo Sapiens
SPSGVPLEA

SEQ ID NO: 725296 - protein, 9 aa, Homo Sapiens
PPEPEKSPP

SEQ ID NO: 725297 - protein, 9 aa, Homo Sapiens
IMENPAPNK

SEQ ID NO: 725298 - protein, 9 aa, Homo Sapiens
GKDSVHGLS

SEQ ID NO: 725299 - protein, 9 aa, Homo Sapiens
REMRTRRPS

SEQ ID NO: 725300 - protein, 9 aa, Homo Sapiens
YVRIYKFLR

SEQ ID NO: 725301 - protein, 9 aa, Homo Sapiens
ALGLPQALI

SEQ ID NO: 725302 - protein, 9 aa, Homo Sapiens
LYAAVCRPL

SEQ ID NO: 725303 - protein, 9 aa, Homo Sapiens
SIPNSAVDC

SEQ ID NO: 725304 - protein, 9 aa, Homo Sapiens
GLEDQRFAL

SEQ ID NO: 725305 - protein, 9 aa, Homo Sapiens
LAFVSVLLA

SEQ ID NO: 725306 - protein, 9 aa, Homo Sapiens
LARRSTLAK

SEQ ID NO: 725307 - protein, 9 aa, Homo Sapiens
RATTPSLTS

SEQ ID NO: 725308 - protein, 9 aa, Homo Sapiens
NTSIKPLVL

SEQ ID NO: 725309 - protein, 9 aa, Homo Sapiens
PPNPQVNQG

SEQ ID NO: 725310 - protein, 9 aa, Homo Sapiens
MLRPPPGGD

SEQ ID NO: 725311 - protein, 9 aa, Homo Sapiens
KVLGNYRVN

SEQ ID NO: 725312 - protein, 9 aa, Homo Sapiens
RGAKGLLGD

SEQ ID NO: 725313 - protein, 9 aa, Homo Sapiens
LEKRPNRTS

SEQ ID NO: 725314 - protein, 9 aa, Homo Sapiens
LWSSDLLPQ

SEQ ID NO: 725315 - protein, 9 aa, Homo Sapiens
VGHRSVGDS

SEQ ID NO: 725316 - protein, 9 aa, Homo Sapiens
ARWDAPGDE

SEQ ID NO: 725317 - protein, 9 aa, Homo Sapiens
PGLPPHDAP

SEQ ID NO: 725318 - protein, 9 aa, Homo Sapiens
FSNFTGYVD

SEQ ID NO: 725319 - protein, 9 aa, Homo Sapiens
KNDEDGKKD

SEQ ID NO: 725320 - protein, 9 aa, Homo Sapiens
VSLGPPPNP

SEQ ID NO: 725321 - protein, 9 aa, Homo Sapiens
DAIQAATPQ

SEQ ID NO: 725322 - protein, 9 aa, Homo Sapiens
EEAPSLRPP

SEQ ID NO: 725323 - protein, 9 aa, Homo Sapiens
YESLKAGGC

SEQ ID NO: 725324 - protein, 9 aa, Homo Sapiens
RPEFHKDPT

SEQ ID NO: 725325 - protein, 9 aa, Homo Sapiens
FTVCLPFCG

SEQ ID NO: 725326 - protein, 9 aa, Homo Sapiens
QQRNTRLGW

SEQ ID NO: 725327 - protein, 9 aa, Homo Sapiens
ARGEIDFVI

SEQ ID NO: 725328 - protein, 9 aa, Homo Sapiens
PFSGKYCKE

SEQ ID NO: 725329 - protein, 9 aa, Homo Sapiens
GRVSIWAIV

SEQ ID NO: 725330 - protein, 9 aa, Homo Sapiens
PTFKKLVEA

SEQ ID NO: 725331 - protein, 9 aa, Homo Sapiens
PALTIFKVL

SEQ ID NO: 725332 - protein, 9 aa, Homo Sapiens
YVKAQEGQR

SEQ ID NO: 725333 - protein, 9 aa, Homo Sapiens
RLVLQECKL

SEQ ID NO: 725334 - protein, 9 aa, Homo Sapiens
LFTVCLPFC

SEQ ID NO: 725335 - protein, 9 aa, Homo Sapiens
SSIFQDDFG

SEQ ID NO: 725336 - protein, 9 aa, Homo Sapiens
PTWGPHWPL

SEQ ID NO: 725337 - protein, 9 aa, Homo Sapiens
TFLPDQNQD

SEQ ID NO: 725338 - protein, 9 aa, Homo Sapiens
LLLLMCRQQ

SEQ ID NO: 725339 - protein, 9 aa, Homo Sapiens
GERPCKCSE

SEQ ID NO: 725340 - protein, 9 aa, Homo Sapiens
RRELLQRVS

SEQ ID NO: 725341 - protein, 9 aa, Homo Sapiens
HGLCVSPPE

SEQ ID NO: 725342 - protein, 9 aa, Homo Sapiens
YGDLVTVAC

SEQ ID NO: 725343 - protein, 9 aa, Homo Sapiens
SAAEAGGIF

SEQ ID NO: 725344 - protein, 9 aa, Homo Sapiens
EKKLPLLFL

SEQ ID NO: 725345 - protein, 9 aa, Homo Sapiens
DEGPSAEGQ

SEQ ID NO: 725346 - protein, 9 aa, Homo Sapiens
ERGKAFISN

SEQ ID NO: 725347 - protein, 9 aa, Homo Sapiens
SGLMALSKL

SEQ ID NO: 725348 - protein, 9 aa, Homo Sapiens
TTCYFYATS

SEQ ID NO: 725349 - protein, 9 aa, Homo Sapiens
FEHPNLPNH

SEQ ID NO: 725350 - protein, 9 aa, Homo Sapiens
CPTFFRVCL

SEQ ID NO: 725351 - protein, 9 aa, Homo Sapiens
KMDTTLEAD

SEQ ID NO: 725352 - protein, 9 aa, Homo Sapiens
ESNQTFTAR

SEQ ID NO: 725353 - protein, 9 aa, Homo Sapiens
DAGEYTIVI

SEQ ID NO: 725354 - protein, 9 aa, Homo Sapiens
ILNDLGQPA

SEQ ID NO: 725355 - protein, 9 aa, Homo Sapiens
VLSFDRFSG

SEQ ID NO: 725356 - protein, 9 aa, Homo Sapiens
TQGFLSMSR

SEQ ID NO: 725357 - protein, 9 aa, Homo Sapiens
ILMGLTLSK

SEQ ID NO: 725358 - protein, 9 aa, Homo Sapiens
TQPNGREKK

SEQ ID NO: 725359 - protein, 9 aa, Homo Sapiens
IAVRSRDAF

SEQ ID NO: 725360 - protein, 9 aa, Homo Sapiens
FMRNHEIIQ

SEQ ID NO: 725361 - protein, 9 aa, Homo Sapiens
RGRVSIWAI

SEQ ID NO: 725362 - protein, 9 aa, Homo Sapiens
GNKFERNNT

SEQ ID NO: 725363 - protein, 9 aa, Homo Sapiens
MNGCDLKFH

SEQ ID NO: 725364 - protein, 9 aa, Homo Sapiens
RTRDKKEVT

SEQ ID NO: 725365 - protein, 9 aa, Homo Sapiens
GVSLGPPPN

SEQ ID NO: 725366 - protein, 9 aa, Homo Sapiens
YLKNFLLLT

SEQ ID NO: 725367 - protein, 9 aa, Homo Sapiens
TIGNERLRC

SEQ ID NO: 725368 - protein, 9 aa, Homo Sapiens
KELFSKDTI

SEQ ID NO: 725369 - protein, 9 aa, Homo Sapiens
DSSSQSNPY

SEQ ID NO: 725370 - protein, 9 aa, Homo Sapiens
EEQLMQLCQ

SEQ ID NO: 725371 - protein, 9 aa, Homo Sapiens
EVCKDLIKF

SEQ ID NO: 725372 - protein, 9 aa, Homo Sapiens
YKDRANLIN

SEQ ID NO: 725373 - protein, 9 aa, Homo Sapiens
VNMSNQVQR

SEQ ID NO: 725374 - protein, 9 aa, Homo Sapiens
NKGRSCTPS

SEQ ID NO: 725375 - protein, 9 aa, Homo Sapiens
LTTLTLPLW

SEQ ID NO: 725376 - protein, 9 aa, Homo Sapiens
VVHDRNKLK

SEQ ID NO: 725377 - protein, 9 aa, Homo Sapiens
LAQFKMTWT

SEQ ID NO: 725378 - protein, 9 aa, Homo Sapiens
LTNQKRIHT

SEQ ID NO: 725379 - protein, 9 aa, Homo Sapiens
GRDSVVSCR

SEQ ID NO: 725380 - protein, 9 aa, Homo Sapiens
QEELGDCVF

SEQ ID NO: 725381 - protein, 9 aa, Homo Sapiens
DDLDADMKD

SEQ ID NO: 725382 - protein, 9 aa, Homo Sapiens
WAIVTSVDG

SEQ ID NO: 725383 - protein, 9 aa, Homo Sapiens
LNRNTGNYT

SEQ ID NO: 725384 - protein, 9 aa, Homo Sapiens
WSTLWGCQQ

SEQ ID NO: 725385 - protein, 9 aa, Homo Sapiens
PFLWCQERS

SEQ ID NO: 725386 - protein, 9 aa, Homo Sapiens
GGNFAFFKV

SEQ ID NO: 725387 - protein, 9 aa, Homo Sapiens
TDKMLCAGF

SEQ ID NO: 725388 - protein, 9 aa, Homo Sapiens
ILKYNTETD

SEQ ID NO: 725389 - protein, 9 aa, Homo Sapiens
SVTRRAPSP

SEQ ID NO: 725390 - protein, 9 aa, Homo Sapiens
VVRDNADFW

SEQ ID NO: 725391 - protein, 9 aa, Homo Sapiens
VALLGNGAL

SEQ ID NO: 725392 - protein, 9 aa, Homo Sapiens
CATVFLEFW

SEQ ID NO: 725393 - protein, 9 aa, Homo Sapiens
QRPRPYDRP

SEQ ID NO: 725394 - protein, 9 aa, Homo Sapiens
FWSTLWGCQ

SEQ ID NO: 725395 - protein, 9 aa, Homo Sapiens
KKLVEALDK

SEQ ID NO: 725396 - protein, 9 aa, Homo Sapiens
PETQPNGRE

SEQ ID NO: 725397 - protein, 9 aa, Homo Sapiens
TQIAGYGLE

SEQ ID NO: 725398 - protein, 9 aa, Homo Sapiens
AVLLYTVLS

SEQ ID NO: 725399 - protein, 9 aa, Homo Sapiens
VSEHRLKVF

SEQ ID NO: 725400 - protein, 9 aa, Homo Sapiens
SSEENLPTF

SEQ ID NO: 725401 - protein, 9 aa, Homo Sapiens
IIEGKLVDR

SEQ ID NO: 725402 - protein, 9 aa, Homo Sapiens
KTHNQILKE

SEQ ID NO: 725403 - protein, 9 aa, Homo Sapiens
VVALLGNGA

SEQ ID NO: 725404 - protein, 9 aa, Homo Sapiens
SYVVTMETF

SEQ ID NO: 725405 - protein, 9 aa, Homo Sapiens
NGLPTPSAQ

SEQ ID NO: 725406 - protein, 9 aa, Homo Sapiens
PEVLLSSVE

SEQ ID NO: 725407 - protein, 9 aa, Homo Sapiens
GKNGERCGP

SEQ ID NO: 725408 - protein, 9 aa, Homo Sapiens
PCCMGSGKS

SEQ ID NO: 725409 - protein, 9 aa, Homo Sapiens
EGLPVGGAG

SEQ ID NO: 725410 - protein, 9 aa, Homo Sapiens
LPRNVVQGL

SEQ ID NO: 725411 - protein, 9 aa, Homo Sapiens
DADMKDAES

SEQ ID NO: 725412 - protein, 9 aa, Homo Sapiens
STLELGDWA

SEQ ID NO: 725413 - protein, 9 aa, Homo Sapiens
ILLKSINGI

SEQ ID NO: 725414 - protein, 9 aa, Homo Sapiens
WETLLAKGS

SEQ ID NO: 725415 - protein, 9 aa, Homo Sapiens
HPSWPWTRC

SEQ ID NO: 725416 - protein, 9 aa, Homo Sapiens
AQRIGFPLM

SEQ ID NO: 725417 - protein, 9 aa, Homo Sapiens
VRVVILNDL

SEQ ID NO: 725418 - protein, 9 aa, Homo Sapiens
EWKEGVAKM

SEQ ID NO: 725419 - protein, 9 aa, Homo Sapiens
QSLPYGILL

SEQ ID NO: 725420 - protein, 9 aa, Homo Sapiens
GFRPFAKFI

SEQ ID NO: 725421 - protein, 9 aa, Homo Sapiens
WTSASSWTV

SEQ ID NO: 725422 - protein, 9 aa, Homo Sapiens
TCLCWASTT

SEQ ID NO: 725423 - protein, 9 aa, Homo Sapiens
SQISVPSYS

SEQ ID NO: 725424 - protein, 9 aa, Homo Sapiens
PKNVRKGDV

SEQ ID NO: 725425 - protein, 9 aa, Homo Sapiens
DGKKTVKSC

SEQ ID NO: 725426 - protein, 9 aa, Homo Sapiens
SYSGAEVRI

SEQ ID NO: 725427 - protein, 9 aa, Homo Sapiens
LFTVQALQR

SEQ ID NO: 725428 - protein, 9 aa, Homo Sapiens
ASRQELMAF

SEQ ID NO: 725429 - protein, 9 aa, Homo Sapiens
PSANYFCYE

SEQ ID NO: 725430 - protein, 9 aa, Homo Sapiens
PSSLRLHFR

SEQ ID NO: 725431 - protein, 9 aa, Homo Sapiens
SVHRSQHFL

SEQ ID NO: 725432 - protein, 9 aa, Homo Sapiens
RQCVFTMPT

SEQ ID NO: 725433 - protein, 9 aa, Homo Sapiens
CRNIGKEAR

SEQ ID NO: 725434 - protein, 9 aa, Homo Sapiens
SDSALIFGM

SEQ ID NO: 725435 - protein, 9 aa, Homo Sapiens
TGYETQAGG

SEQ ID NO: 725436 - protein, 9 aa, Homo Sapiens
IGSVKEGKV

SEQ ID NO: 725437 - protein, 9 aa, Homo Sapiens
DPHATPMQK

SEQ ID NO: 725438 - protein, 9 aa, Homo Sapiens
SPEETPVFM

SEQ ID NO: 725439 - protein, 9 aa, Homo Sapiens
RHSGALGNF

SEQ ID NO: 725440 - protein, 9 aa, Homo Sapiens
EPGLVKFLK

SEQ ID NO: 725441 - protein, 9 aa, Homo Sapiens
YDAKLLFSA

SEQ ID NO: 725442 - protein, 9 aa, Homo Sapiens
HKLRYLDLS

SEQ ID NO: 725443 - protein, 9 aa, Homo Sapiens
DEEEEYPSE

SEQ ID NO: 725444 - protein, 9 aa, Homo Sapiens
QAGRGEGRS

SEQ ID NO: 725445 - protein, 9 aa, Homo Sapiens
SELLAEINK

SEQ ID NO: 725446 - protein, 9 aa, Homo Sapiens
PGAEDGSVD

SEQ ID NO: 725447 - protein, 9 aa, Homo Sapiens
MTCARNVTP

SEQ ID NO: 725448 - protein, 9 aa, Homo Sapiens
SEHRLKVFS

SEQ ID NO: 725449 - protein, 9 aa, Homo Sapiens
FAQCAFDHE

SEQ ID NO: 725450 - protein, 9 aa, Homo Sapiens
NTSCVLPLK

SEQ ID NO: 725451 - protein, 9 aa, Homo Sapiens
IEDWISSLK

SEQ ID NO: 725452 - protein, 9 aa, Homo Sapiens
RALRLLQLP

SEQ ID NO: 725453 - protein, 9 aa, Homo Sapiens
LRVEIHDKL

SEQ ID NO: 725454 - protein, 9 aa, Homo Sapiens
NVTFDLLDW

SEQ ID NO: 725455 - protein, 9 aa, Homo Sapiens
QLFYCHKLR

SEQ ID NO: 725456 - protein, 9 aa, Homo Sapiens
RVEIHDKLQ

SEQ ID NO: 725457 - protein, 9 aa, Homo Sapiens
CVSFQQSFL

SEQ ID NO: 725458 - protein, 9 aa, Homo Sapiens
EDKDSEPAT

SEQ ID NO: 725459 - protein, 9 aa, Homo Sapiens
PLQPMCPSW

SEQ ID NO: 725460 - protein, 9 aa, Homo Sapiens
WVFKTKTYF

SEQ ID NO: 725461 - protein, 9 aa, Homo Sapiens
WAALNHLSS

SEQ ID NO: 725462 - protein, 9 aa, Homo Sapiens
LFVTITAVN

SEQ ID NO: 725463 - protein, 9 aa, Homo Sapiens
RGSRGWEGT

SEQ ID NO: 725464 - protein, 9 aa, Homo Sapiens
VVISTLRSQ

SEQ ID NO: 725465 - protein, 9 aa, Homo Sapiens
IPRLPQGSS

SEQ ID NO: 725466 - protein, 9 aa, Homo Sapiens
MNSEISLSC

SEQ ID NO: 725467 - protein, 9 aa, Homo Sapiens
LGGSYSGAE

SEQ ID NO: 725468 - protein, 9 aa, Homo Sapiens
KSPIGHRGN

SEQ ID NO: 725469 - protein, 9 aa, Homo Sapiens
PESVEEYVL

SEQ ID NO: 725470 - protein, 9 aa, Homo Sapiens
PLLMDSVIH

SEQ ID NO: 725471 - protein, 9 aa, Homo Sapiens
LLEDSKMDT

SEQ ID NO: 725472 - protein, 9 aa, Homo Sapiens
NQAQLRIFK

SEQ ID NO: 725473 - protein, 9 aa, Homo Sapiens
LGSKQKVSM

SEQ ID NO: 725474 - protein, 9 aa, Homo Sapiens
LYSLCPGER

SEQ ID NO: 725475 - protein, 9 aa, Homo Sapiens
IGNERLRCP

SEQ ID NO: 725476 - protein, 9 aa, Homo Sapiens
FIYLLFTKD

SEQ ID NO: 725477 - protein, 9 aa, Homo Sapiens
QCVSFQQSF

SEQ ID NO: 725478 - protein, 9 aa, Homo Sapiens
PSLRPPPPP

SEQ ID NO: 725479 - protein, 9 aa, Homo Sapiens
TCIVHCIRM

SEQ ID NO: 725480 - protein, 9 aa, Homo Sapiens
VFHFHKAAE

SEQ ID NO: 725481 - protein, 9 aa, Homo Sapiens
LEGAMQKAK

SEQ ID NO: 725482 - protein, 9 aa, Homo Sapiens
DDDWIPDMQ

SEQ ID NO: 725483 - protein, 9 aa, Homo Sapiens
DFCFSTLVT

SEQ ID NO: 725484 - protein, 9 aa, Homo Sapiens
VSFQQSQAQ

SEQ ID NO: 725485 - protein, 9 aa, Homo Sapiens
QKRIHTGER

SEQ ID NO: 725486 - protein, 9 aa, Homo Sapiens
IPPEKDSGL

SEQ ID NO: 725487 - protein, 9 aa, Homo Sapiens
DLHLTTLTL

SEQ ID NO: 725488 - protein, 9 aa, Homo Sapiens
SPGNPVDCH

SEQ ID NO: 725489 - protein, 9 aa, Homo Sapiens
IPNTSIMEN

SEQ ID NO: 725490 - protein, 9 aa, Homo Sapiens
LVALMGKPV

SEQ ID NO: 725491 - protein, 9 aa, Homo Sapiens
LQALLRFVI

SEQ ID NO: 725492 - protein, 9 aa, Homo Sapiens
NNEVLRNCG

SEQ ID NO: 725493 - protein, 9 aa, Homo Sapiens
KRHKRRHTK

SEQ ID NO: 725494 - protein, 9 aa, Homo Sapiens
VATQCCVAV

SEQ ID NO: 725495 - protein, 9 aa, Homo Sapiens
LRPPPPPIS

SEQ ID NO: 725496 - protein, 9 aa, Homo Sapiens
TTVTMMQVE

SEQ ID NO: 725497 - protein, 9 aa, Homo Sapiens
PQGSSLRPT

SEQ ID NO: 725498 - protein, 9 aa, Homo Sapiens
PSSTVSTGS

SEQ ID NO: 725499 - protein, 9 aa, Homo Sapiens
LINRRELLQ

SEQ ID NO: 725500 - protein, 9 aa, Homo Sapiens
CCLVSSNTV

SEQ ID NO: 725501 - protein, 9 aa, Homo Sapiens
VPIFASGMF

SEQ ID NO: 725502 - protein, 9 aa, Homo Sapiens
PHATPMQKL

SEQ ID NO: 725503 - protein, 9 aa, Homo Sapiens
RNGSRHPRS

SEQ ID NO: 725504 - protein, 9 aa, Homo Sapiens
ACTTRCFWS

SEQ ID NO: 725505 - protein, 9 aa, Homo Sapiens
IQDGADDFK

SEQ ID NO: 725506 - protein, 9 aa, Homo Sapiens
PENIRDRMK

SEQ ID NO: 725507 - protein, 9 aa, Homo Sapiens
RGLSWVPIP

SEQ ID NO: 725508 - protein, 9 aa, Homo Sapiens
RHAAAIYLK

SEQ ID NO: 725509 - protein, 9 aa, Homo Sapiens
PSSASAAGQ

SEQ ID NO: 725510 - protein, 9 aa, Homo Sapiens
MIRGIGSVK

SEQ ID NO: 725511 - protein, 9 aa, Homo Sapiens
LQVCSRSVN

SEQ ID NO: 725512 - protein, 9 aa, Homo Sapiens
QEGQRYKMD

SEQ ID NO: 725513 - protein, 9 aa, Homo Sapiens
ECKLQGWQM

SEQ ID NO: 725514 - protein, 9 aa, Homo Sapiens
GAENDPFVI

SEQ ID NO: 725515 - protein, 9 aa, Homo Sapiens
GLLQLGPAA

SEQ ID NO: 725516 - protein, 9 aa, Homo Sapiens
KILHILNMT

SEQ ID NO: 725517 - protein, 9 aa, Homo Sapiens
KEYDFPLLP

SEQ ID NO: 725518 - protein, 9 aa, Homo Sapiens
PEKSPPAAP

SEQ ID NO: 725519 - protein, 9 aa, Homo Sapiens
SIKQYDPHE

SEQ ID NO: 725520 - protein, 9 aa, Homo Sapiens
VGEGAELGL

SEQ ID NO: 725521 - protein, 9 aa, Homo Sapiens
DLLCMLHKK

SEQ ID NO: 725522 - protein, 9 aa, Homo Sapiens
QKIQHTARK

SEQ ID NO: 725523 - protein, 9 aa, Homo Sapiens
LQLRKCCKS

SEQ ID NO: 725524 - protein, 9 aa, Homo Sapiens
PRPPRPLQA

SEQ ID NO: 725525 - protein, 9 aa, Homo Sapiens
VSFFQVMNL

SEQ ID NO: 725526 - protein, 9 aa, Homo Sapiens
RGTMLKGEY

SEQ ID NO: 725527 - protein, 9 aa, Homo Sapiens
LYRGFTSQK

SEQ ID NO: 725528 - protein, 9 aa, Homo Sapiens
RLNPGATPQ

SEQ ID NO: 725529 - protein, 9 aa, Homo Sapiens
PRPPTPLAY

SEQ ID NO: 725530 - protein, 9 aa, Homo Sapiens
ITFRRWKSC

SEQ ID NO: 725531 - protein, 9 aa, Homo Sapiens
VLRDQSAID

SEQ ID NO: 725532 - protein, 9 aa, Homo Sapiens
ITEEVEWWH

SEQ ID NO: 725533 - protein, 9 aa, Homo Sapiens
AGKGRTPIA

SEQ ID NO: 725534 - protein, 9 aa, Homo Sapiens
PGSTDLCHL

SEQ ID NO: 725535 - protein, 9 aa, Homo Sapiens
APGKNGERC

SEQ ID NO: 725536 - protein, 9 aa, Homo Sapiens
SWVFKTKTY

SEQ ID NO: 725537 - protein, 9 aa, Homo Sapiens
CTNDGRSDG

SEQ ID NO: 725538 - protein, 9 aa, Homo Sapiens
PNREFFKGL

SEQ ID NO: 725539 - protein, 9 aa, Homo Sapiens
ESGRMSSIR

SEQ ID NO: 725540 - protein, 9 aa, Homo Sapiens
IVIRNKHGE

SEQ ID NO: 725541 - protein, 9 aa, Homo Sapiens
GDRGAKGLL

SEQ ID NO: 725542 - protein, 9 aa, Homo Sapiens
FLSWFLENM

SEQ ID NO: 725543 - protein, 9 aa, Homo Sapiens
AILVSRLLR

SEQ ID NO: 725544 - protein, 9 aa, Homo Sapiens
LCPLCLQGC

SEQ ID NO: 725545 - protein, 9 aa, Homo Sapiens
LGIWKASIT

SEQ ID NO: 725546 - protein, 9 aa, Homo Sapiens
LTNDKALVE

SEQ ID NO: 725547 - protein, 9 aa, Homo Sapiens
QRDVYYRLK

SEQ ID NO: 725548 - protein, 9 aa, Homo Sapiens
IGIQGNFEK

SEQ ID NO: 725549 - protein, 9 aa, Homo Sapiens
AQIQAKTKN

SEQ ID NO: 725550 - protein, 9 aa, Homo Sapiens
SRHDCYLLR

SEQ ID NO: 725551 - protein, 9 aa, Homo Sapiens
VDLTQIAGY

SEQ ID NO: 725552 - protein, 9 aa, Homo Sapiens
YSGAEVRIR

SEQ ID NO: 725553 - protein, 9 aa, Homo Sapiens
PRVVVGTSY

SEQ ID NO: 725554 - protein, 9 aa, Homo Sapiens
AEKFGHGAH

SEQ ID NO: 725555 - protein, 9 aa, Homo Sapiens
VQSRDDGGL

SEQ ID NO: 725556 - protein, 9 aa, Homo Sapiens
SRQELMAFA

SEQ ID NO: 725557 - protein, 9 aa, Homo Sapiens
FCASSCSSF

SEQ ID NO: 725558 - protein, 9 aa, Homo Sapiens
ALELLTTFA

SEQ ID NO: 725559 - protein, 9 aa, Homo Sapiens
PDMQIDPNG

SEQ ID NO: 725560 - protein, 9 aa, Homo Sapiens
LLAEINKLL

SEQ ID NO: 725561 - protein, 9 aa, Homo Sapiens
PVRVVILND

SEQ ID NO: 725562 - protein, 9 aa, Homo Sapiens
RVRERAFHL

SEQ ID NO: 725563 - protein, 9 aa, Homo Sapiens
RRPPEPEKS

SEQ ID NO: 725564 - protein, 9 aa, Homo Sapiens
ISFQPSSVV

SEQ ID NO: 725565 - protein, 9 aa, Homo Sapiens
MRPRGQPAN

SEQ ID NO: 725566 - protein, 9 aa, Homo Sapiens
QVVRDNADF

SEQ ID NO: 725567 - protein, 9 aa, Homo Sapiens
EYDFPLLPS

SEQ ID NO: 725568 - protein, 9 aa, Homo Sapiens
TSHSSTTHN

SEQ ID NO: 725569 - protein, 9 aa, Homo Sapiens
CGKIFRHKF

SEQ ID NO: 725570 - protein, 9 aa, Homo Sapiens
FCYVQSPGQ

SEQ ID NO: 725571 - protein, 9 aa, Homo Sapiens
IRDHLNSMN

SEQ ID NO: 725572 - protein, 9 aa, Homo Sapiens
EPQHCFDVA

SEQ ID NO: 725573 - protein, 9 aa, Homo Sapiens
CKKCKIWMH

SEQ ID NO: 725574 - protein, 9 aa, Homo Sapiens
EVQHGKPYP

SEQ ID NO: 725575 - protein, 9 aa, Homo Sapiens
QMFITEEVE

SEQ ID NO: 725576 - protein, 9 aa, Homo Sapiens
NSYDKTTQN

SEQ ID NO: 725577 - protein, 9 aa, Homo Sapiens
RLRSRTLGP

SEQ ID NO: 725578 - protein, 9 aa, Homo Sapiens
PLKGVPPDK

SEQ ID NO: 725579 - protein, 9 aa, Homo Sapiens
ATFSAHCGS

SEQ ID NO: 725580 - protein, 9 aa, Homo Sapiens
LSYKDRANL

SEQ ID NO: 725581 - protein, 9 aa, Homo Sapiens
APDPSPSGV

SEQ ID NO: 725582 - protein, 9 aa, Homo Sapiens
EHPIRVGEI

SEQ ID NO: 725583 - protein, 9 aa, Homo Sapiens
FFYSICLFA

SEQ ID NO: 725584 - protein, 9 aa, Homo Sapiens
AASPAIPRL

SEQ ID NO: 725585 - protein, 9 aa, Homo Sapiens
WLREHRPDN

SEQ ID NO: 725586 - protein, 9 aa, Homo Sapiens
HRVQQLVTI

SEQ ID NO: 725587 - protein, 9 aa, Homo Sapiens
LPTPSAQFP

SEQ ID NO: 725588 - protein, 9 aa, Homo Sapiens
IQGNFEKHP

SEQ ID NO: 725589 - protein, 9 aa, Homo Sapiens
ILWESIDRS

SEQ ID NO: 725590 - protein, 9 aa, Homo Sapiens
QWAALNHLS

SEQ ID NO: 725591 - protein, 9 aa, Homo Sapiens
YPPQQPYFI

SEQ ID NO: 725592 - protein, 9 aa, Homo Sapiens
FHKDPTWSE

SEQ ID NO: 725593 - protein, 9 aa, Homo Sapiens
VFRQCLVQG

SEQ ID NO: 725594 - protein, 9 aa, Homo Sapiens
AELEGAMQK

SEQ ID NO: 725595 - protein, 9 aa, Homo Sapiens
LGLLVVLIL

SEQ ID NO: 725596 - protein, 9 aa, Homo Sapiens
AVQSGTRPR

SEQ ID NO: 725597 - protein, 9 aa, Homo Sapiens
VYSLPRVVV

SEQ ID NO: 725598 - protein, 9 aa, Homo Sapiens
KETIKTFLK

SEQ ID NO: 725599 - protein, 9 aa, Homo Sapiens
HLPPRGDQC

SEQ ID NO: 725600 - protein, 9 aa, Homo Sapiens
NPYGGGGRY

SEQ ID NO: 725601 - protein, 9 aa, Homo Sapiens
SFHVVLSTC

SEQ ID NO: 725602 - protein, 9 aa, Homo Sapiens
AKLPLPRPL

SEQ ID NO: 725603 - protein, 9 aa, Homo Sapiens
LGGNGHRCT

SEQ ID NO: 725604 - protein, 9 aa, Homo Sapiens
RPPRPLQAP

SEQ ID NO: 725605 - protein, 9 aa, Homo Sapiens
AEVDVRLQE

SEQ ID NO: 725606 - protein, 9 aa, Homo Sapiens
RRSSTLTNQ

SEQ ID NO: 725607 - protein, 9 aa, Homo Sapiens
STLWGCQQA

SEQ ID NO: 725608 - protein, 9 aa, Homo Sapiens
ARRSHANPL

SEQ ID NO: 725609 - protein, 9 aa, Homo Sapiens
YVDDRGTCQ

SEQ ID NO: 725610 - protein, 9 aa, Homo Sapiens
NIQDAIQAA

SEQ ID NO: 725611 - protein, 9 aa, Homo Sapiens
TNDFDNVTV

SEQ ID NO: 725612 - protein, 9 aa, Homo Sapiens
RSHANPLEP

SEQ ID NO: 725613 - protein, 9 aa, Homo Sapiens
AICNTLRYS

SEQ ID NO: 725614 - protein, 9 aa, Homo Sapiens
GLKHFCKPL

SEQ ID NO: 725615 - protein, 9 aa, Homo Sapiens
GLAVQSGTR

SEQ ID NO: 725616 - protein, 9 aa, Homo Sapiens
TVHTGSKLY

SEQ ID NO: 725617 - protein, 9 aa, Homo Sapiens
LPPSTTSRL

SEQ ID NO: 725618 - protein, 9 aa, Homo Sapiens
VLVVPYRAS

SEQ ID NO: 725619 - protein, 9 aa, Homo Sapiens
VVFAQCAFD

SEQ ID NO: 725620 - protein, 9 aa, Homo Sapiens
DAIVVILSA

SEQ ID NO: 725621 - protein, 9 aa, Homo Sapiens
QLVESRNPA

SEQ ID NO: 725622 - protein, 9 aa, Homo Sapiens
SHKLLLSRV

SEQ ID NO: 725623 - protein, 9 aa, Homo Sapiens
AVSGLFRQV

SEQ ID NO: 725624 - protein, 9 aa, Homo Sapiens
CDLGGSYSG

SEQ ID NO: 725625 - protein, 9 aa, Homo Sapiens
DECKVQKEC

SEQ ID NO: 725626 - protein, 9 aa, Homo Sapiens
ERRTLMQSR

SEQ ID NO: 725627 - protein, 9 aa, Homo Sapiens
NTSIMENPA

SEQ ID NO: 725628 - protein, 9 aa, Homo Sapiens
FVSVLLALR

SEQ ID NO: 725629 - protein, 9 aa, Homo Sapiens
LLSRVKPTD

SEQ ID NO: 725630 - protein, 9 aa, Homo Sapiens
LGHILKYNT

SEQ ID NO: 725631 - protein, 9 aa, Homo Sapiens
FDNVTVSTI

SEQ ID NO: 725632 - protein, 9 aa, Homo Sapiens
AYKEALPGW

SEQ ID NO: 725633 - protein, 9 aa, Homo Sapiens
STLTNQKRI

SEQ ID NO: 725634 - protein, 9 aa, Homo Sapiens
GPSAEGQQR

SEQ ID NO: 725635 - protein, 9 aa, Homo Sapiens
AGYGLEGEM

SEQ ID NO: 725636 - protein, 9 aa, Homo Sapiens
KAPIGESWQ

SEQ ID NO: 725637 - protein, 9 aa, Homo Sapiens
IKQYDPHEP

SEQ ID NO: 725638 - protein, 9 aa, Homo Sapiens
IPPSDMQEE

SEQ ID NO: 725639 - protein, 9 aa, Homo Sapiens
SDDDWIPDM

SEQ ID NO: 725640 - protein, 9 aa, Homo Sapiens
KLIPSSASA

SEQ ID NO: 725641 - protein, 9 aa, Homo Sapiens
FMYVRAASG

SEQ ID NO: 725642 - protein, 9 aa, Homo Sapiens
EQLRNGSRH

SEQ ID NO: 725643 - protein, 9 aa, Homo Sapiens
QLTNDKALV

SEQ ID NO: 725644 - protein, 9 aa, Homo Sapiens
SKDTINAET

SEQ ID NO: 725645 - protein, 9 aa, Homo Sapiens
SLAIPINKN

SEQ ID NO: 725646 - protein, 9 aa, Homo Sapiens
SQLVESRNP

SEQ ID NO: 725647 - protein, 9 aa, Homo Sapiens
SLVATAALC

SEQ ID NO: 725648 - protein, 9 aa, Homo Sapiens
LLTLVESLQ

SEQ ID NO: 725649 - protein, 9 aa, Homo Sapiens
MQKAKQDMA

SEQ ID NO: 725650 - protein, 9 aa, Homo Sapiens
SVLLALRLQ

SEQ ID NO: 725651 - protein, 9 aa, Homo Sapiens
CMGSGKSKV

SEQ ID NO: 725652 - protein, 9 aa, Homo Sapiens
FLQIPPFRK

SEQ ID NO: 725653 - protein, 9 aa, Homo Sapiens
PKQHLLNVE

SEQ ID NO: 725654 - protein, 9 aa, Homo Sapiens
YTVPDTCVI

SEQ ID NO: 725655 - protein, 9 aa, Homo Sapiens
TFALYRNLT

SEQ ID NO: 725656 - protein, 9 aa, Homo Sapiens
TAPTMLRPP

SEQ ID NO: 725657 - protein, 9 aa, Homo Sapiens
ILLLLSLYR

SEQ ID NO: 725658 - protein, 9 aa, Homo Sapiens
PPVSFQQSQ

SEQ ID NO: 725659 - protein, 9 aa, Homo Sapiens
NGERCGPGG

SEQ ID NO: 725660 - protein, 9 aa, Homo Sapiens
IKPIVRDGV

SEQ ID NO: 725661 - protein, 9 aa, Homo Sapiens
KYDVTPLQW

SEQ ID NO: 725662 - protein, 9 aa, Homo Sapiens
ICLKESTAK

SEQ ID NO: 725663 - protein, 9 aa, Homo Sapiens
CECSPGSCV

SEQ ID NO: 725664 - protein, 9 aa, Homo Sapiens
HILKYNTET

SEQ ID NO: 725665 - protein, 9 aa, Homo Sapiens
SFHVTLDSV

SEQ ID NO: 725666 - protein, 9 aa, Homo Sapiens
NGNNQSLTR

SEQ ID NO: 725667 - protein, 9 aa, Homo Sapiens
LQTHLPGKS

SEQ ID NO: 725668 - protein, 9 aa, Homo Sapiens
DDSESEIKM

SEQ ID NO: 725669 - protein, 9 aa, Homo Sapiens
CVVCMQTLT

SEQ ID NO: 725670 - protein, 9 aa, Homo Sapiens
VIENDGLHA

SEQ ID NO: 725671 - protein, 9 aa, Homo Sapiens
STLKDRLED

SEQ ID NO: 725672 - protein, 9 aa, Homo Sapiens
RIANFAEQI

SEQ ID NO: 725673 - protein, 9 aa, Homo Sapiens
CEPGCPTFF

SEQ ID NO: 725674 - protein, 9 aa, Homo Sapiens
PMCPSWPRP

SEQ ID NO: 725675 - protein, 9 aa, Homo Sapiens
QHYPPQQPY

SEQ ID NO: 725676 - protein, 9 aa, Homo Sapiens
EDRLYTFQL

SEQ ID NO: 725677 - protein, 9 aa, Homo Sapiens
LGPPPNPQV

SEQ ID NO: 725678 - protein, 9 aa, Homo Sapiens
RHTKKKPLK

SEQ ID NO: 725679 - protein, 9 aa, Homo Sapiens
HNHSTSQMS

SEQ ID NO: 725680 - protein, 9 aa, Homo Sapiens
QPNGREKKC

SEQ ID NO: 725681 - protein, 9 aa, Homo Sapiens
LSTILYAGN

SEQ ID NO: 725682 - protein, 9 aa, Homo Sapiens
GGVGVQLGK

SEQ ID NO: 725683 - protein, 9 aa, Homo Sapiens
SSSVRPFEF

SEQ ID NO: 725684 - protein, 9 aa, Homo Sapiens
ENKLALVKQ

SEQ ID NO: 725685 - protein, 9 aa, Homo Sapiens
NARWDAPGD

SEQ ID NO: 725686 - protein, 9 aa, Homo Sapiens
MWYPNGIAQ

SEQ ID NO: 725687 - protein, 9 aa, Homo Sapiens
HLDMERMQA

SEQ ID NO: 725688 - protein, 9 aa, Homo Sapiens
LQAPLCTSA

SEQ ID NO: 725689 - protein, 9 aa, Homo Sapiens
PLLPSGIIN

SEQ ID NO: 725690 - protein, 9 aa, Homo Sapiens
EDSGLMALS

SEQ ID NO: 725691 - protein, 9 aa, Homo Sapiens
KDSEPATDG

SEQ ID NO: 725692 - protein, 9 aa, Homo Sapiens
RLLGVEASG

SEQ ID NO: 725693 - protein, 9 aa, Homo Sapiens
LGRHSGALG

SEQ ID NO: 725694 - protein, 9 aa, Homo Sapiens
PGKSPARGS

SEQ ID NO: 725695 - protein, 9 aa, Homo Sapiens
PRPYDRPGT

SEQ ID NO: 725696 - protein, 9 aa, Homo Sapiens
IKTFLKKLE

SEQ ID NO: 725697 - protein, 9 aa, Homo Sapiens
GIAICIVTH

SEQ ID NO: 725698 - protein, 9 aa, Homo Sapiens
LPEDYSIQS

SEQ ID NO: 725699 - protein, 9 aa, Homo Sapiens
YVRAASGLA

SEQ ID NO: 725700 - protein, 9 aa, Homo Sapiens
TRIRFSDYN

SEQ ID NO: 725701 - protein, 9 aa, Homo Sapiens
GAMESGRMS

SEQ ID NO: 725702 - protein, 9 aa, Homo Sapiens
LGGTALLLC

SEQ ID NO: 725703 - protein, 9 aa, Homo Sapiens
TTTNLVAGC

SEQ ID NO: 725704 - protein, 9 aa, Homo Sapiens
LCHGDRWRE

SEQ ID NO: 725705 - protein, 9 aa, Homo Sapiens
AHVFRQCLV

SEQ ID NO: 725706 - protein, 9 aa, Homo Sapiens
RDKKEVTIP

SEQ ID NO: 725707 - protein, 9 aa, Homo Sapiens
AFLTVCDAS

SEQ ID NO: 725708 - protein, 9 aa, Homo Sapiens
VPILPRNVV

SEQ ID NO: 725709 - protein, 9 aa, Homo Sapiens
HDGAFLTVC

SEQ ID NO: 725710 - protein, 9 aa, Homo Sapiens
SEAEGALPL

SEQ ID NO: 725711 - protein, 9 aa, Homo Sapiens
STGLYPHYP

SEQ ID NO: 725712 - protein, 9 aa, Homo Sapiens
TTTPTPTGT

SEQ ID NO: 725713 - protein, 9 aa, Homo Sapiens
LKAEKSVLE

SEQ ID NO: 725714 - protein, 9 aa, Homo Sapiens
TGTGFTSPD

SEQ ID NO: 725715 - protein, 9 aa, Homo Sapiens
LFFVQHVFT

SEQ ID NO: 725716 - protein, 9 aa, Homo Sapiens
EILLGSPAG

SEQ ID NO: 725717 - protein, 9 aa, Homo Sapiens
LIREMRTRR

SEQ ID NO: 725718 - protein, 9 aa, Homo Sapiens
TSLFVLIET

SEQ ID NO: 725719 - protein, 9 aa, Homo Sapiens
VSRGVISHV

SEQ ID NO: 725720 - protein, 9 aa, Homo Sapiens
VHELRVCLF

SEQ ID NO: 725721 - protein, 9 aa, Homo Sapiens
LVTGSLTGI

SEQ ID NO: 725722 - protein, 9 aa, Homo Sapiens
NERLRCPEA

SEQ ID NO: 725723 - protein, 9 aa, Homo Sapiens
QDEVYNTSI

SEQ ID NO: 725724 - protein, 9 aa, Homo Sapiens
SVDLDNTQE

SEQ ID NO: 725725 - protein, 9 aa, Homo Sapiens
VILNDLGQP

SEQ ID NO: 725726 - protein, 9 aa, Homo Sapiens
ATSCFSINC

SEQ ID NO: 725727 - protein, 9 aa, Homo Sapiens
RRTKPRKST

SEQ ID NO: 725728 - protein, 9 aa, Homo Sapiens
HCVLGPQHL

SEQ ID NO: 725729 - protein, 9 aa, Homo Sapiens
LLCGATGVP

SEQ ID NO: 725730 - protein, 9 aa, Homo Sapiens
QWQFNLLTL

SEQ ID NO: 725731 - protein, 9 aa, Homo Sapiens
LPVGGYEVF

SEQ ID NO: 725732 - protein, 9 aa, Homo Sapiens
METKTHNQI

SEQ ID NO: 725733 - protein, 9 aa, Homo Sapiens
FNSVVMLLN

SEQ ID NO: 725734 - protein, 9 aa, Homo Sapiens
SPCIEQVAH

SEQ ID NO: 725735 - protein, 9 aa, Homo Sapiens
KEKEKKRKA

SEQ ID NO: 725736 - protein, 9 aa, Homo Sapiens
YYCNPTFLM

SEQ ID NO: 725737 - protein, 9 aa, Homo Sapiens
VKAQEGQRY

SEQ ID NO: 725738 - protein, 9 aa, Homo Sapiens
PDNGEEAVT

SEQ ID NO: 725739 - protein, 9 aa, Homo Sapiens
TVQRLVPGC

SEQ ID NO: 725740 - protein, 9 aa, Homo Sapiens
EVTIPSQRR

SEQ ID NO: 725741 - protein, 9 aa, Homo Sapiens
FLACLLPCF

SEQ ID NO: 725742 - protein, 9 aa, Homo Sapiens
IRGIGSVKE

SEQ ID NO: 725743 - protein, 9 aa, Homo Sapiens
MTGLSRAAL

SEQ ID NO: 725744 - protein, 9 aa, Homo Sapiens
NQGMTVNYL

SEQ ID NO: 725745 - protein, 9 aa, Homo Sapiens
GFNFKELFE

SEQ ID NO: 725746 - protein, 9 aa, Homo Sapiens
RLCRRSRAS

SEQ ID NO: 725747 - protein, 9 aa, Homo Sapiens
VQPVFSGGQ

SEQ ID NO: 725748 - protein, 9 aa, Homo Sapiens
SGVPCNRLY

SEQ ID NO: 725749 - protein, 9 aa, Homo Sapiens
ASQMGAVGQ

SEQ ID NO: 725750 - protein, 9 aa, Homo Sapiens
LCGATGVPG

SEQ ID NO: 725751 - protein, 9 aa, Homo Sapiens
HLSFHVVLS

SEQ ID NO: 725752 - protein, 9 aa, Homo Sapiens
ATSCSLSEE

SEQ ID NO: 725753 - protein, 9 aa, Homo Sapiens
SAPPRPPAC

SEQ ID NO: 725754 - protein, 9 aa, Homo Sapiens
CLIEAPEHA

SEQ ID NO: 725755 - protein, 9 aa, Homo Sapiens
YYQHSSPVA

SEQ ID NO: 725756 - protein, 9 aa, Homo Sapiens
TSCFSINCC

SEQ ID NO: 725757 - protein, 9 aa, Homo Sapiens
SLPYGILLH

SEQ ID NO: 725758 - protein, 9 aa, Homo Sapiens
QRIGFPLMI

SEQ ID NO: 725759 - protein, 9 aa, Homo Sapiens
CASSCSSFC

SEQ ID NO: 725760 - protein, 9 aa, Homo Sapiens
GLPQALIPV

SEQ ID NO: 725761 - protein, 9 aa, Homo Sapiens
FRDEVFHFH

SEQ ID NO: 725762 - protein, 9 aa, Homo Sapiens
LEAAQRIGF

SEQ ID NO: 725763 - protein, 9 aa, Homo Sapiens
NVTVSTIID

SEQ ID NO: 725764 - protein, 9 aa, Homo Sapiens
SSCSSFCPT

SEQ ID NO: 725765 - protein, 9 aa, Homo Sapiens
PEFHKDPTW

SEQ ID NO: 725766 - protein, 9 aa, Homo Sapiens
AAGLSVLNV

SEQ ID NO: 725767 - protein, 9 aa, Homo Sapiens
IGFENIAPT

SEQ ID NO: 725768 - protein, 9 aa, Homo Sapiens
PWTQVGFSQ

SEQ ID NO: 725769 - protein, 9 aa, Homo Sapiens
VNNFFCDPG

SEQ ID NO: 725770 - protein, 9 aa, Homo Sapiens
PICAALPGC

SEQ ID NO: 725771 - protein, 9 aa, Homo Sapiens
SSSIPPEKD

SEQ ID NO: 725772 - protein, 9 aa, Homo Sapiens
QVRVRERAF

SEQ ID NO: 725773 - protein, 9 aa, Homo Sapiens
ATHPTSSSL

SEQ ID NO: 725774 - protein, 9 aa, Homo Sapiens
TEPQHCFDV

SEQ ID NO: 725775 - protein, 9 aa, Homo Sapiens
WDSMFCPGA

SEQ ID NO: 725776 - protein, 9 aa, Homo Sapiens
FSDYNGSVL

SEQ ID NO: 725777 - protein, 9 aa, Homo Sapiens
LFSIVRPGR

SEQ ID NO: 725778 - protein, 9 aa, Homo Sapiens
LVEVERDNL

SEQ ID NO: 725779 - protein, 9 aa, Homo Sapiens
SRWDPAHAG

SEQ ID NO: 725780 - protein, 9 aa, Homo Sapiens
KMWYPNGIA

SEQ ID NO: 725781 - protein, 9 aa, Homo Sapiens
SEEDEPGLV

SEQ ID NO: 725782 - protein, 9 aa, Homo Sapiens
FFFKQLDSL

SEQ ID NO: 725783 - protein, 9 aa, Homo Sapiens
IFFCVVLCG

SEQ ID NO: 725784 - protein, 9 aa, Homo Sapiens
LSVLLVPNT

SEQ ID NO: 725785 - protein, 9 aa, Homo Sapiens
AVGQSCEDS

SEQ ID NO: 725786 - protein, 9 aa, Homo Sapiens
FTCEEYGKI

SEQ ID NO: 725787 - protein, 9 aa, Homo Sapiens
GRWSYVRIY

SEQ ID NO: 725788 - protein, 9 aa, Homo Sapiens
YPLPLICRS

SEQ ID NO: 725789 - protein, 9 aa, Homo Sapiens
QHLHNVYES

SEQ ID NO: 725790 - protein, 9 aa, Homo Sapiens
GGPGLPPHD

SEQ ID NO: 725791 - protein, 9 aa, Homo Sapiens
EGDRHSSPG

SEQ ID NO: 725792 - protein, 9 aa, Homo Sapiens
YRTQIDYNP

SEQ ID NO: 725793 - protein, 9 aa, Homo Sapiens
PASTCQAVS

SEQ ID NO: 725794 - protein, 9 aa, Homo Sapiens
VAAEPWLRP

SEQ ID NO: 725795 - protein, 9 aa, Homo Sapiens
MLQMKLKAC

SEQ ID NO: 725796 - protein, 9 aa, Homo Sapiens
TQPGGNFAF

SEQ ID NO: 725797 - protein, 9 aa, Homo Sapiens
LFTKDNSRS

SEQ ID NO: 725798 - protein, 9 aa, Homo Sapiens
LICRSPTFL

SEQ ID NO: 725799 - protein, 9 aa, Homo Sapiens
RLFSKECCF

SEQ ID NO: 725800 - protein, 9 aa, Homo Sapiens
AARDATSCS

SEQ ID NO: 725801 - protein, 9 aa, Homo Sapiens
DSVVSCRNI

SEQ ID NO: 725802 - protein, 9 aa, Homo Sapiens
SRRESTSPS

SEQ ID NO: 725803 - protein, 9 aa, Homo Sapiens
SELKCSPQW

SEQ ID NO: 725804 - protein, 9 aa, Homo Sapiens
WIPDMQIDP

SEQ ID NO: 725805 - protein, 9 aa, Homo Sapiens
GRGAADPPA

SEQ ID NO: 725806 - protein, 9 aa, Homo Sapiens
VMNLNKREL

SEQ ID NO: 725807 - protein, 9 aa, Homo Sapiens
MLQDNCCGI

SEQ ID NO: 725808 - protein, 9 aa, Homo Sapiens
HRPEASPVQ

SEQ ID NO: 725809 - protein, 9 aa, Homo Sapiens
LPSSTVSTG

SEQ ID NO: 725810 - protein, 9 aa, Homo Sapiens
VGSCLSRGS

SEQ ID NO: 725811 - protein, 9 aa, Homo Sapiens
ELMESFDSA

SEQ ID NO: 725812 - protein, 9 aa, Homo Sapiens
QISLSVLLV

SEQ ID NO: 725813 - protein, 9 aa, Homo Sapiens
AQFRDSYPG

SEQ ID NO: 725814 - protein, 9 aa, Homo Sapiens
AALCAVHLP

SEQ ID NO: 725815 - protein, 9 aa, Homo Sapiens
VTNDFDNVT

SEQ ID NO: 725816 - protein, 9 aa, Homo Sapiens
MPNGTLGSW

SEQ ID NO: 725817 - protein, 9 aa, Homo Sapiens
LTASLPNFW

SEQ ID NO: 725818 - protein, 9 aa, Homo Sapiens
GTMLEILLG

SEQ ID NO: 725819 - protein, 9 aa, Homo Sapiens
EPLNEGFLC

SEQ ID NO: 725820 - protein, 9 aa, Homo Sapiens
QKSETKDPH

SEQ ID NO: 725821 - protein, 9 aa, Homo Sapiens
AKQTFIKDD

SEQ ID NO: 725822 - protein, 9 aa, Homo Sapiens
PWQTKLSIA

SEQ ID NO: 725823 - protein, 9 aa, Homo Sapiens
KAQEGQRYK

SEQ ID NO: 725824 - protein, 9 aa, Homo Sapiens
AAVVEVVAL

SEQ ID NO: 725825 - protein, 9 aa, Homo Sapiens
AFRCCPFIR

SEQ ID NO: 725826 - protein, 9 aa, Homo Sapiens
SFFQVMNLN

SEQ ID NO: 725827 - protein, 9 aa, Homo Sapiens
GRSYSACTN

SEQ ID NO: 725828 - protein, 9 aa, Homo Sapiens
VLEKRPNRT

SEQ ID NO: 725829 - protein, 9 aa, Homo Sapiens
VAKMRRFPA

SEQ ID NO: 725830 - protein, 9 aa, Homo Sapiens
DIGKHPASD

SEQ ID NO: 725831 - protein, 9 aa, Homo Sapiens
TVGDIGAIF

SEQ ID NO: 725832 - protein, 9 aa, Homo Sapiens
NDFHACASE

SEQ ID NO: 725833 - protein, 9 aa, Homo Sapiens
YLTSGTEPF

SEQ ID NO: 725834 - protein, 9 aa, Homo Sapiens
QSRRTKPRK

SEQ ID NO: 725835 - protein, 9 aa, Homo Sapiens
YGRYVATQC

SEQ ID NO: 725836 - protein, 9 aa, Homo Sapiens
TQVGFSQLF

SEQ ID NO: 725837 - protein, 9 aa, Homo Sapiens
RVESLKQLG

SEQ ID NO: 725838 - protein, 9 aa, Homo Sapiens
RVDPRIGGV

SEQ ID NO: 725839 - protein, 9 aa, Homo Sapiens
PAIPRLPQG

SEQ ID NO: 725840 - protein, 9 aa, Homo Sapiens
KEVTIPSQR

SEQ ID NO: 725841 - protein, 9 aa, Homo Sapiens
GSCGVGKRI

SEQ ID NO: 725842 - protein, 9 aa, Homo Sapiens
EGKLVDRKL

SEQ ID NO: 725843 - protein, 9 aa, Homo Sapiens
RRWRTQYAI

SEQ ID NO: 725844 - protein, 9 aa, Homo Sapiens
SSRTSSSCS

SEQ ID NO: 725845 - protein, 9 aa, Homo Sapiens
GFSILLWVA

SEQ ID NO: 725846 - protein, 9 aa, Homo Sapiens
RLYTFQLPE

SEQ ID NO: 725847 - protein, 9 aa, Homo Sapiens
EGSFDFSCL

SEQ ID NO: 725848 - protein, 9 aa, Homo Sapiens
VCSGVTSAM

SEQ ID NO: 725849 - protein, 9 aa, Homo Sapiens
CSVYGCGYT

SEQ ID NO: 725850 - protein, 9 aa, Homo Sapiens
NTQENIKAT

SEQ ID NO: 725851 - protein, 9 aa, Homo Sapiens
WPGSTDLCH

SEQ ID NO: 725852 - protein, 9 aa, Homo Sapiens
QSQAQAVLQ

SEQ ID NO: 725853 - protein, 9 aa, Homo Sapiens
SAPAPSPWP

SEQ ID NO: 725854 - protein, 9 aa, Homo Sapiens
SVLLVPNTI

SEQ ID NO: 725855 - protein, 9 aa, Homo Sapiens
EVVALLGNG

SEQ ID NO: 725856 - protein, 9 aa, Homo Sapiens
LQNGANVQS

SEQ ID NO: 725857 - protein, 9 aa, Homo Sapiens
NERPEFHKD

SEQ ID NO: 725858 - protein, 9 aa, Homo Sapiens
LSFHVVLST

SEQ ID NO: 725859 - protein, 9 aa, Homo Sapiens
EAGGIFHRA

SEQ ID NO: 725860 - protein, 9 aa, Homo Sapiens
LSAPAPQLG

SEQ ID NO: 725861 - protein, 9 aa, Homo Sapiens
DRLYTFQLP

SEQ ID NO: 725862 - protein, 9 aa, Homo Sapiens
QLFFVQHVF

SEQ ID NO: 725863 - protein, 9 aa, Homo Sapiens
VFMAVCATV

SEQ ID NO: 725864 - protein, 9 aa, Homo Sapiens
QSLTRQKMQ

SEQ ID NO: 725865 - protein, 9 aa, Homo Sapiens
SNSVAAEPW

SEQ ID NO: 725866 - protein, 9 aa, Homo Sapiens
NRLLGVEAS

SEQ ID NO: 725867 - protein, 9 aa, Homo Sapiens
EGVVAALGQ

SEQ ID NO: 725868 - protein, 9 aa, Homo Sapiens
HVFHLENGP

SEQ ID NO: 725869 - protein, 9 aa, Homo Sapiens
ATASNHRLN

SEQ ID NO: 725870 - protein, 9 aa, Homo Sapiens
TVNPELYSK

SEQ ID NO: 725871 - protein, 9 aa, Homo Sapiens
LPAPHVQAA

SEQ ID NO: 725872 - protein, 9 aa, Homo Sapiens
YLYQRQPRS

SEQ ID NO: 725873 - protein, 9 aa, Homo Sapiens
EMQLGLEDQ

SEQ ID NO: 725874 - protein, 9 aa, Homo Sapiens
SREMAPFLW

SEQ ID NO: 725875 - protein, 9 aa, Homo Sapiens
KREKKEKEK

SEQ ID NO: 725876 - protein, 9 aa, Homo Sapiens
LVLLQFQVS

SEQ ID NO: 725877 - protein, 9 aa, Homo Sapiens
KTSCSVYGC

SEQ ID NO: 725878 - protein, 9 aa, Homo Sapiens
LVKFLKMNC

SEQ ID NO: 725879 - protein, 9 aa, Homo Sapiens
ILSLGGNGH

SEQ ID NO: 725880 - protein, 9 aa, Homo Sapiens
IWDSMFCPG

SEQ ID NO: 725881 - protein, 9 aa, Homo Sapiens
GSPAPVRHR

SEQ ID NO: 725882 - protein, 9 aa, Homo Sapiens
TINERPEFH

SEQ ID NO: 725883 - protein, 9 aa, Homo Sapiens
DVTQSPRDG

SEQ ID NO: 725884 - protein, 9 aa, Homo Sapiens
KALLPVGGY

SEQ ID NO: 725885 - protein, 9 aa, Homo Sapiens
QTKEPVTKQ

SEQ ID NO: 725886 - protein, 9 aa, Homo Sapiens
VQGVGWLMA

SEQ ID NO: 725887 - protein, 9 aa, Homo Sapiens
QVEGRLALP

SEQ ID NO: 725888 - protein, 9 aa, Homo Sapiens
SCCLVSEVL

SEQ ID NO: 725889 - protein, 9 aa, Homo Sapiens
CYLLREQYE

SEQ ID NO: 725890 - protein, 9 aa, Homo Sapiens
PTNTTSAEL

SEQ ID NO: 725891 - protein, 9 aa, Homo Sapiens
LEMLFPSWT

SEQ ID NO: 725892 - protein, 9 aa, Homo Sapiens
CYFYATSCF

SEQ ID NO: 725893 - protein, 9 aa, Homo Sapiens
RETRRRLRV

SEQ ID NO: 725894 - protein, 9 aa, Homo Sapiens
ALVEVERDN

SEQ ID NO: 725895 - protein, 9 aa, Homo Sapiens
FTPQHHICL

SEQ ID NO: 725896 - protein, 9 aa, Homo Sapiens
NFFKRLGSH

SEQ ID NO: 725897 - protein, 9 aa, Homo Sapiens
CVQAIQSQI

SEQ ID NO: 725898 - protein, 9 aa, Homo Sapiens
GDGPDSNKT

SEQ ID NO: 725899 - protein, 9 aa, Homo Sapiens
VGNQEGGVD

SEQ ID NO: 725900 - protein, 9 aa, Homo Sapiens
FGMLSQVSE

SEQ ID NO: 725901 - protein, 9 aa, Homo Sapiens
GWCQKRLNW

SEQ ID NO: 725902 - protein, 9 aa, Homo Sapiens
LWGCQQAKL

SEQ ID NO: 725903 - protein, 9 aa, Homo Sapiens
RPPPKRTLS

SEQ ID NO: 725904 - protein, 9 aa, Homo Sapiens
ALLPVGGYE

SEQ ID NO: 725905 - protein, 9 aa, Homo Sapiens
SENEDIGKH

SEQ ID NO: 725906 - protein, 9 aa, Homo Sapiens
VMVGGHSNT

SEQ ID NO: 725907 - protein, 9 aa, Homo Sapiens
HPVIHFLSW

SEQ ID NO: 725908 - protein, 9 aa, Homo Sapiens
VQRLVPGCD

SEQ ID NO: 725909 - protein, 9 aa, Homo Sapiens
FGHCHILLG

SEQ ID NO: 725910 - protein, 9 aa, Homo Sapiens
SDEKYSVAT

SEQ ID NO: 725911 - protein, 9 aa, Homo Sapiens
STTRSAPAS

SEQ ID NO: 725912 - protein, 9 aa, Homo Sapiens
RYVATQCCV

SEQ ID NO: 725913 - protein, 9 aa, Homo Sapiens
GSHSFDDHL

SEQ ID NO: 725914 - protein, 9 aa, Homo Sapiens
GNNQSLTRQ

SEQ ID NO: 725915 - protein, 9 aa, Homo Sapiens
RNVVQGLYP

SEQ ID NO: 725916 - protein, 9 aa, Homo Sapiens
NTPLTSFGE

SEQ ID NO: 725917 - protein, 9 aa, Homo Sapiens
IGIGQLISL

SEQ ID NO: 725918 - protein, 9 aa, Homo Sapiens
WSPALTIFK

SEQ ID NO: 725919 - protein, 9 aa, Homo Sapiens
LFVVSYDAK

SEQ ID NO: 725920 - protein, 9 aa, Homo Sapiens
AIVTSVDGS

SEQ ID NO: 725921 - protein, 9 aa, Homo Sapiens
DMSLASFAP

SEQ ID NO: 725922 - protein, 9 aa, Homo Sapiens
GAELGLGVC

SEQ ID NO: 725923 - protein, 9 aa, Homo Sapiens
IQEITVTWE

SEQ ID NO: 725924 - protein, 9 aa, Homo Sapiens
PSDMQEESQ

SEQ ID NO: 725925 - protein, 9 aa, Homo Sapiens
AEELSCCIC

SEQ ID NO: 725926 - protein, 9 aa, Homo Sapiens
EFEDGIYAN

SEQ ID NO: 725927 - protein, 9 aa, Homo Sapiens
GPPPNPQVN

SEQ ID NO: 725928 - protein, 9 aa, Homo Sapiens
TTRSAPASS

SEQ ID NO: 725929 - protein, 9 aa, Homo Sapiens
EKRPNRTSI

SEQ ID NO: 725930 - protein, 9 aa, Homo Sapiens
PGSCVPGLD

SEQ ID NO: 725931 - protein, 9 aa, Homo Sapiens
LLYGCDSEC

SEQ ID NO: 725932 - protein, 9 aa, Homo Sapiens
SPSQSRMVA

SEQ ID NO: 725933 - protein, 9 aa, Homo Sapiens
ALYRNLTRH

SEQ ID NO: 725934 - protein, 9 aa, Homo Sapiens
MGKPVSPHH

SEQ ID NO: 725935 - protein, 9 aa, Homo Sapiens
QLRNGSRHP

SEQ ID NO: 725936 - protein, 9 aa, Homo Sapiens
MRTRRPSLV

SEQ ID NO: 725937 - protein, 9 aa, Homo Sapiens
QQLENAKAA

SEQ ID NO: 725938 - protein, 9 aa, Homo Sapiens
KRKVVKIMI

SEQ ID NO: 725939 - protein, 9 aa, Homo Sapiens
EKFSTEFYQ

SEQ ID NO: 725940 - protein, 9 aa, Homo Sapiens
IDYKCGSPS

SEQ ID NO: 725941 - protein, 9 aa, Homo Sapiens
DCHAYPHIQ

SEQ ID NO: 725942 - protein, 9 aa, Homo Sapiens
EIESGFHIE

SEQ ID NO: 725943 - protein, 9 aa, Homo Sapiens
GATAGVQPV

SEQ ID NO: 725944 - protein, 9 aa, Homo Sapiens
VVCMQTLTS

SEQ ID NO: 725945 - protein, 9 aa, Homo Sapiens
CVAQFRDSY

SEQ ID NO: 725946 - protein, 9 aa, Homo Sapiens
GTSVPASGQ

SEQ ID NO: 725947 - protein, 9 aa, Homo Sapiens
GKTSERFFF

SEQ ID NO: 725948 - protein, 9 aa, Homo Sapiens
NQGLGIRPS

SEQ ID NO: 725949 - protein, 9 aa, Homo Sapiens
VFHLENGPD

SEQ ID NO: 725950 - protein, 9 aa, Homo Sapiens
ETPVFMKYA

SEQ ID NO: 725951 - protein, 9 aa, Homo Sapiens
SNRTVKSVN

SEQ ID NO: 725952 - protein, 9 aa, Homo Sapiens
MHHLSFHVV

SEQ ID NO: 725953 - protein, 9 aa, Homo Sapiens
NKWVREYIN

SEQ ID NO: 725954 - protein, 9 aa, Homo Sapiens
LPQGSSLRP

SEQ ID NO: 725955 - protein, 9 aa, Homo Sapiens
PGEDPIDYK

SEQ ID NO: 725956 - protein, 9 aa, Homo Sapiens
FDVCQLGTW

SEQ ID NO: 725957 - protein, 9 aa, Homo Sapiens
QLQADAVNA

SEQ ID NO: 725958 - protein, 9 aa, Homo Sapiens
LDLLPKDEK

SEQ ID NO: 725959 - protein, 9 aa, Homo Sapiens
KHKAISFRR

SEQ ID NO: 725960 - protein, 9 aa, Homo Sapiens
ISLDLIYIS

SEQ ID NO: 725961 - protein, 9 aa, Homo Sapiens
LLLVAQGST

SEQ ID NO: 725962 - protein, 9 aa, Homo Sapiens
HVPFKLVCT

SEQ ID NO: 725963 - protein, 9 aa, Homo Sapiens
TSVVQTRFR

SEQ ID NO: 725964 - protein, 9 aa, Homo Sapiens
PFVIPNLPQ

SEQ ID NO: 725965 - protein, 9 aa, Homo Sapiens
EILLDHGAQ

SEQ ID NO: 725966 - protein, 9 aa, Homo Sapiens
GCLHMTCAN

SEQ ID NO: 725967 - protein, 9 aa, Homo Sapiens
GHHITFRRW

SEQ ID NO: 725968 - protein, 9 aa, Homo Sapiens
KSCEDGIQN

SEQ ID NO: 725969 - protein, 9 aa, Homo Sapiens
SSVRPFEFE

SEQ ID NO: 725970 - protein, 9 aa, Homo Sapiens
RESTSPSHQ

SEQ ID NO: 725971 - protein, 9 aa, Homo Sapiens
NPREIPRGF

SEQ ID NO: 725972 - protein, 9 aa, Homo Sapiens
PAPFKVTLT

SEQ ID NO: 725973 - protein, 9 aa, Homo Sapiens
GEIDFVISL

SEQ ID NO: 725974 - protein, 9 aa, Homo Sapiens
LLRPTQSSL

SEQ ID NO: 725975 - protein, 9 aa, Homo Sapiens
RRTLMQSRR

SEQ ID NO: 725976 - protein, 9 aa, Homo Sapiens
VVSYDAKLL

SEQ ID NO: 725977 - protein, 9 aa, Homo Sapiens
AAVVISTLR

SEQ ID NO: 725978 - protein, 9 aa, Homo Sapiens
MDNEFTTKI

SEQ ID NO: 725979 - protein, 9 aa, Homo Sapiens
AFSWAHNGR

SEQ ID NO: 725980 - protein, 9 aa, Homo Sapiens
CMQTLTSTL

SEQ ID NO: 725981 - protein, 9 aa, Homo Sapiens
YTALRCYAL

SEQ ID NO: 725982 - protein, 9 aa, Homo Sapiens
RLRVEIHDK

SEQ ID NO: 725983 - protein, 9 aa, Homo Sapiens
GLSYAWSPP

SEQ ID NO: 725984 - protein, 9 aa, Homo Sapiens
NYLSMLDIV

SEQ ID NO: 725985 - protein, 9 aa, Homo Sapiens
TAKPTGPPS

SEQ ID NO: 725986 - protein, 9 aa, Homo Sapiens
SVGGRRRAA

SEQ ID NO: 725987 - protein, 9 aa, Homo Sapiens
YNGSVLFEH

SEQ ID NO: 725988 - protein, 9 aa, Homo Sapiens
CSISCYRGY

SEQ ID NO: 725989 - protein, 9 aa, Homo Sapiens
SCSLSEESS

SEQ ID NO: 725990 - protein, 9 aa, Homo Sapiens
CNECGKIFR

SEQ ID NO: 725991 - protein, 9 aa, Homo Sapiens
KLDSADIET

SEQ ID NO: 725992 - protein, 9 aa, Homo Sapiens
NEISVACPI

SEQ ID NO: 725993 - protein, 9 aa, Homo Sapiens
NDSGVPCNR

SEQ ID NO: 725994 - protein, 9 aa, Homo Sapiens
ASSPTWGPH

SEQ ID NO: 725995 - protein, 9 aa, Homo Sapiens
TFSVGQHKY

SEQ ID NO: 725996 - protein, 9 aa, Homo Sapiens
GSKQKVSMD

SEQ ID NO: 725997 - protein, 9 aa, Homo Sapiens
ENDPFVIPN

SEQ ID NO: 725998 - protein, 9 aa, Homo Sapiens
HSTSQMSLN

SEQ ID NO: 725999 - protein, 9 aa, Homo Sapiens
IASLWSSDL

SEQ ID NO: 726000 - protein, 9 aa, Homo Sapiens
PQAAGLSVL

SEQ ID NO: 726001 - protein, 9 aa, Homo Sapiens
VIRNKHGET

SEQ ID NO: 726002 - protein, 9 aa, Homo Sapiens
MGYGAWYHK

SEQ ID NO: 726003 - protein, 9 aa, Homo Sapiens
LTTIGFENI

SEQ ID NO: 726004 - protein, 9 aa, Homo Sapiens
QRAPGEDPI

SEQ ID NO: 726005 - protein, 9 aa, Homo Sapiens
TVHDDCRRL

SEQ ID NO: 726006 - protein, 9 aa, Homo Sapiens
SRQCVFTMP

SEQ ID NO: 726007 - protein, 9 aa, Homo Sapiens
SHTIPHFTD

SEQ ID NO: 726008 - protein, 9 aa, Homo Sapiens
MATEELSNL

SEQ ID NO: 726009 - protein, 9 aa, Homo Sapiens
GHILKYNTE

SEQ ID NO: 726010 - protein, 9 aa, Homo Sapiens
FDFSCLPTF

SEQ ID NO: 726011 - protein, 9 aa, Homo Sapiens
SYAWSPPVL

SEQ ID NO: 726012 - protein, 9 aa, Homo Sapiens
YKTVPLTCI

SEQ ID NO: 726013 - protein, 9 aa, Homo Sapiens
HRHSLHQPP

SEQ ID NO: 726014 - protein, 9 aa, Homo Sapiens
SAMVLTVTS

SEQ ID NO: 726015 - protein, 9 aa, Homo Sapiens
NEQSVVIYY

SEQ ID NO: 726016 - protein, 9 aa, Homo Sapiens
SYAGKTPGT

SEQ ID NO: 726017 - protein, 9 aa, Homo Sapiens
AHRPQSSAP

SEQ ID NO: 726018 - protein, 9 aa, Homo Sapiens
CTFKNYYSL

SEQ ID NO: 726019 - protein, 9 aa, Homo Sapiens
CLRNLLMPQ

SEQ ID NO: 726020 - protein, 9 aa, Homo Sapiens
HLNSMNPTM

SEQ ID NO: 726021 - protein, 9 aa, Homo Sapiens
YNTSIKPLV

SEQ ID NO: 726022 - protein, 9 aa, Homo Sapiens
SDYNGSVLF

SEQ ID NO: 726023 - protein, 9 aa, Homo Sapiens
TNDKALVEV

SEQ ID NO: 726024 - protein, 9 aa, Homo Sapiens
KECKKTFAL

SEQ ID NO: 726025 - protein, 9 aa, Homo Sapiens
LLEDLDLLE

SEQ ID NO: 726026 - protein, 9 aa, Homo Sapiens
IPKNVRKGD

SEQ ID NO: 726027 - protein, 9 aa, Homo Sapiens
SNPYCQLPH

SEQ ID NO: 726028 - protein, 9 aa, Homo Sapiens
KLPLPRPLS

SEQ ID NO: 726029 - protein, 9 aa, Homo Sapiens
ESCCLVSSN

SEQ ID NO: 726030 - protein, 9 aa, Homo Sapiens
GSTDLCHLP

SEQ ID NO: 726031 - protein, 9 aa, Homo Sapiens
QQTACAPDS

SEQ ID NO: 726032 - protein, 9 aa, Homo Sapiens
IPNLPQLLT

SEQ ID NO: 726033 - protein, 9 aa, Homo Sapiens
LSLGGNGHR

SEQ ID NO: 726034 - protein, 9 aa, Homo Sapiens
QSSAPTESQ

SEQ ID NO: 726035 - protein, 9 aa, Homo Sapiens
PEELAEIFM

SEQ ID NO: 726036 - protein, 9 aa, Homo Sapiens
MQCGDGDGG

SEQ ID NO: 726037 - protein, 9 aa, Homo Sapiens
GHRSVGDSI

SEQ ID NO: 726038 - protein, 9 aa, Homo Sapiens
TNRVEHPIR

SEQ ID NO: 726039 - protein, 9 aa, Homo Sapiens
DLLSSFLTL

SEQ ID NO: 726040 - protein, 9 aa, Homo Sapiens
LCVAQFRDS

SEQ ID NO: 726041 - protein, 9 aa, Homo Sapiens
FVISLLLLM

SEQ ID NO: 726042 - protein, 9 aa, Homo Sapiens
RGVRQLIQR

SEQ ID NO: 726043 - protein, 9 aa, Homo Sapiens
VDVRLQEPI

SEQ ID NO: 726044 - protein, 9 aa, Homo Sapiens
GYPPVAKMR

SEQ ID NO: 726045 - protein, 9 aa, Homo Sapiens
VTRVAWLNL

SEQ ID NO: 726046 - protein, 9 aa, Homo Sapiens
VIPNEQSVV

SEQ ID NO: 726047 - protein, 9 aa, Homo Sapiens
LEEEDLELA

SEQ ID NO: 726048 - protein, 9 aa, Homo Sapiens
TLIFMYVRA

SEQ ID NO: 726049 - protein, 9 aa, Homo Sapiens
ATSSIVSLA

SEQ ID NO: 726050 - protein, 9 aa, Homo Sapiens
LKHFCKPLV

SEQ ID NO: 726051 - protein, 9 aa, Homo Sapiens
DASELLAEI

SEQ ID NO: 726052 - protein, 9 aa, Homo Sapiens
PLSPPGAPL

SEQ ID NO: 726053 - protein, 9 aa, Homo Sapiens
TNDGRSDGL

SEQ ID NO: 726054 - protein, 9 aa, Homo Sapiens
NEDESNQTF

SEQ ID NO: 726055 - protein, 9 aa, Homo Sapiens
DSTSSTRIT

SEQ ID NO: 726056 - protein, 9 aa, Homo Sapiens
EVLRNCGSP

SEQ ID NO: 726057 - protein, 9 aa, Homo Sapiens
TPHPHPHPH

SEQ ID NO: 726058 - protein, 9 aa, Homo Sapiens
QCCFQNGRR

SEQ ID NO: 726059 - protein, 9 aa, Homo Sapiens
LLTTFAWEQ

SEQ ID NO: 726060 - protein, 9 aa, Homo Sapiens
CAHLAGGQP

SEQ ID NO: 726061 - protein, 9 aa, Homo Sapiens
FYTLPAKKW

SEQ ID NO: 726062 - protein, 9 aa, Homo Sapiens
HLQLFFVQH

SEQ ID NO: 726063 - protein, 9 aa, Homo Sapiens
GWGDHCELC

SEQ ID NO: 726064 - protein, 9 aa, Homo Sapiens
GKSKLAVLL

SEQ ID NO: 726065 - protein, 9 aa, Homo Sapiens
STFTLDTSS

SEQ ID NO: 726066 - protein, 9 aa, Homo Sapiens
QTRQWPPGV

SEQ ID NO: 726067 - protein, 9 aa, Homo Sapiens
DEKNDEDGK

SEQ ID NO: 726068 - protein, 9 aa, Homo Sapiens
GKITRDDDS

SEQ ID NO: 726069 - protein, 9 aa, Homo Sapiens
LCHLPQTAP

SEQ ID NO: 726070 - protein, 9 aa, Homo Sapiens
YSGFVTDKM

SEQ ID NO: 726071 - protein, 9 aa, Homo Sapiens
WGRILSSYA

SEQ ID NO: 726072 - protein, 9 aa, Homo Sapiens
VQRPRPYDR

SEQ ID NO: 726073 - protein, 9 aa, Homo Sapiens
CIEQVAHGG

SEQ ID NO: 726074 - protein, 9 aa, Homo Sapiens
TEVQKHITL

SEQ ID NO: 726075 - protein, 9 aa, Homo Sapiens
LSRRREGAI

SEQ ID NO: 726076 - protein, 9 aa, Homo Sapiens
MPGEGWGDH

SEQ ID NO: 726077 - protein, 9 aa, Homo Sapiens
KDTINAETV

SEQ ID NO: 726078 - protein, 9 aa, Homo Sapiens
SNRDIIPLS

SEQ ID NO: 726079 - protein, 9 aa, Homo Sapiens
CLVSSNTVK

SEQ ID NO: 726080 - protein, 9 aa, Homo Sapiens
VGGLVTGSL

SEQ ID NO: 726081 - protein, 9 aa, Homo Sapiens
AICIVTHFV

SEQ ID NO: 726082 - protein, 9 aa, Homo Sapiens
SAPGRGAAD

SEQ ID NO: 726083 - protein, 9 aa, Homo Sapiens
KFGHGAHHA

SEQ ID NO: 726084 - protein, 9 aa, Homo Sapiens
FTFSVGQHK

SEQ ID NO: 726085 - protein, 9 aa, Homo Sapiens
GKGRTPIAF

SEQ ID NO: 726086 - protein, 9 aa, Homo Sapiens
EGTMLEILL

SEQ ID NO: 726087 - protein, 9 aa, Homo Sapiens
DHVEFPVRH

SEQ ID NO: 726088 - protein, 9 aa, Homo Sapiens
YILSCAHLA

SEQ ID NO: 726089 - protein, 9 aa, Homo Sapiens
AIIGIAICI

SEQ ID NO: 726090 - protein, 9 aa, Homo Sapiens
RQWPPGVSH

SEQ ID NO: 726091 - protein, 9 aa, Homo Sapiens
PKSYPEDTI

SEQ ID NO: 726092 - protein, 9 aa, Homo Sapiens
GAIFKIRIG

SEQ ID NO: 726093 - protein, 9 aa, Homo Sapiens
REAMHGVFF

SEQ ID NO: 726094 - protein, 9 aa, Homo Sapiens
ISLSVLLVP

SEQ ID NO: 726095 - protein, 9 aa, Homo Sapiens
EISVACPIL

SEQ ID NO: 726096 - protein, 9 aa, Homo Sapiens
FVGENAEVK

SEQ ID NO: 726097 - protein, 9 aa, Homo Sapiens
SRSLLPLST

SEQ ID NO: 726098 - protein, 9 aa, Homo Sapiens
GAEAVQALL

SEQ ID NO: 726099 - protein, 9 aa, Homo Sapiens
LYTALRCYA

SEQ ID NO: 726100 - protein, 9 aa, Homo Sapiens
ASSQSTFTL

SEQ ID NO: 726101 - protein, 9 aa, Homo Sapiens
FLSGEPSQG

SEQ ID NO: 726102 - protein, 9 aa, Homo Sapiens
GGTALLLCG

SEQ ID NO: 726103 - protein, 9 aa, Homo Sapiens
FFCDPGQLL

SEQ ID NO: 726104 - protein, 9 aa, Homo Sapiens
QACIYLIEK

SEQ ID NO: 726105 - protein, 9 aa, Homo Sapiens
LYTDKLKNI

SEQ ID NO: 726106 - protein, 9 aa, Homo Sapiens
LRVESLKQL

SEQ ID NO: 726107 - protein, 9 aa, Homo Sapiens
GRGEGRSPP

SEQ ID NO: 726108 - protein, 9 aa, Homo Sapiens
QWLGTVLLN

SEQ ID NO: 726109 - protein, 9 aa, Homo Sapiens
PKPLTPLWP

SEQ ID NO: 726110 - protein, 9 aa, Homo Sapiens
PHVPFKLVC

SEQ ID NO: 726111 - protein, 9 aa, Homo Sapiens
YPSYPGYGG

SEQ ID NO: 726112 - protein, 9 aa, Homo Sapiens
VLCRLLGQE

SEQ ID NO: 726113 - protein, 9 aa, Homo Sapiens
IPSSASAAG

SEQ ID NO: 726114 - protein, 9 aa, Homo Sapiens
EKIKPIVRD

SEQ ID NO: 726115 - protein, 9 aa, Homo Sapiens
FGPESGLSD

SEQ ID NO: 726116 - protein, 9 aa, Homo Sapiens
YCQLPHLFC

SEQ ID NO: 726117 - protein, 9 aa, Homo Sapiens
EELSCCICL

SEQ ID NO: 726118 - protein, 9 aa, Homo Sapiens
KSPPAAPTR

SEQ ID NO: 726119 - protein, 9 aa, Homo Sapiens
HELRVCLFL

SEQ ID NO: 726120 - protein, 9 aa, Homo Sapiens
GEPSQGDVQ

SEQ ID NO: 726121 - protein, 9 aa, Homo Sapiens
DNFGHNHST

SEQ ID NO: 726122 - protein, 9 aa, Homo Sapiens
VFLAFVSVL

SEQ ID NO: 726123 - protein, 9 aa, Homo Sapiens
GNQEGGVDG

SEQ ID NO: 726124 - protein, 9 aa, Homo Sapiens
ETPEAPNRE

SEQ ID NO: 726125 - protein, 9 aa, Homo Sapiens
RVEHPIRVG

SEQ ID NO: 726126 - protein, 9 aa, Homo Sapiens
FVVSYDAKL

SEQ ID NO: 726127 - protein, 9 aa, Homo Sapiens
STDLCHLPQ

SEQ ID NO: 726128 - protein, 9 aa, Homo Sapiens
AAAPGPALL

SEQ ID NO: 726129 - protein, 9 aa, Homo Sapiens
MDQDHSGSD

SEQ ID NO: 726130 - protein, 9 aa, Homo Sapiens
SLTTIGFEN

SEQ ID NO: 726131 - protein, 9 aa, Homo Sapiens
MLAIQIKYN

SEQ ID NO: 726132 - protein, 9 aa, Homo Sapiens
PENKLALVK

SEQ ID NO: 726133 - protein, 9 aa, Homo Sapiens
AMLLLACTG

SEQ ID NO: 726134 - protein, 9 aa, Homo Sapiens
LSDLEGSIQ

SEQ ID NO: 726135 - protein, 9 aa, Homo Sapiens
IRIANFAEQ

SEQ ID NO: 726136 - protein, 9 aa, Homo Sapiens
PLSCAAYKE

SEQ ID NO: 726137 - protein, 9 aa, Homo Sapiens
FHLENGPDS

SEQ ID NO: 726138 - protein, 9 aa, Homo Sapiens
SELDPALSQ

SEQ ID NO: 726139 - protein, 9 aa, Homo Sapiens
IIALCHSPP

SEQ ID NO: 726140 - protein, 9 aa, Homo Sapiens
VSLALEEED

SEQ ID NO: 726141 - protein, 9 aa, Homo Sapiens
GDWALYLCA

SEQ ID NO: 726142 - protein, 9 aa, Homo Sapiens
PALSAPAPQ

SEQ ID NO: 726143 - protein, 9 aa, Homo Sapiens
MKSSGIGTE

SEQ ID NO: 726144 - protein, 9 aa, Homo Sapiens
VPETKRHDI

SEQ ID NO: 726145 - protein, 9 aa, Homo Sapiens
PSQGDVQPL

SEQ ID NO: 726146 - protein, 9 aa, Homo Sapiens
NKADVQAFS

SEQ ID NO: 726147 - protein, 9 aa, Homo Sapiens
HACASEVLS

SEQ ID NO: 726148 - protein, 9 aa, Homo Sapiens
IFKIRIGHT

SEQ ID NO: 726149 - protein, 9 aa, Homo Sapiens
ENLPTFQKS

SEQ ID NO: 726150 - protein, 9 aa, Homo Sapiens
KALQLAVGN

SEQ ID NO: 726151 - protein, 9 aa, Homo Sapiens
QLPSSTVST

SEQ ID NO: 726152 - protein, 9 aa, Homo Sapiens
KKEVTIPSQ

SEQ ID NO: 726153 - protein, 9 aa, Homo Sapiens
HVEFPVRHA

SEQ ID NO: 726154 - protein, 9 aa, Homo Sapiens
SIFQDDFGP

SEQ ID NO: 726155 - protein, 9 aa, Homo Sapiens
YRLHQRLVP

SEQ ID NO: 726156 - protein, 9 aa, Homo Sapiens
MLYREHSQT

SEQ ID NO: 726157 - protein, 9 aa, Homo Sapiens
KDYEILLKS

SEQ ID NO: 726158 - protein, 9 aa, Homo Sapiens
ESDPSLDVL

SEQ ID NO: 726159 - protein, 9 aa, Homo Sapiens
ELGDCVFYT

SEQ ID NO: 726160 - protein, 9 aa, Homo Sapiens
YSREEVRQR

SEQ ID NO: 726161 - protein, 9 aa, Homo Sapiens
LPRPLSPPG

SEQ ID NO: 726162 - protein, 9 aa, Homo Sapiens
LFPSWTTWV

SEQ ID NO: 726163 - protein, 9 aa, Homo Sapiens
IVRPGRLLY

SEQ ID NO: 726164 - protein, 9 aa, Homo Sapiens
TLPLWSWSP

SEQ ID NO: 726165 - protein, 9 aa, Homo Sapiens
KNVRKGDVL

SEQ ID NO: 726166 - protein, 9 aa, Homo Sapiens
APATASNHR

SEQ ID NO: 726167 - protein, 9 aa, Homo Sapiens
SLSLSLTLR

SEQ ID NO: 726168 - protein, 9 aa, Homo Sapiens
GQCVSFQQS

SEQ ID NO: 726169 - protein, 9 aa, Homo Sapiens
GASSQSTFT

SEQ ID NO: 726170 - protein, 9 aa, Homo Sapiens
KEKKRKAEK

SEQ ID NO: 726171 - protein, 9 aa, Homo Sapiens
ADPPASAVQ

SEQ ID NO: 726172 - protein, 9 aa, Homo Sapiens
RLLATALVA

SEQ ID NO: 726173 - protein, 9 aa, Homo Sapiens
DLQACIYLI

SEQ ID NO: 726174 - protein, 9 aa, Homo Sapiens
EDIGKHPAS

SEQ ID NO: 726175 - protein, 9 aa, Homo Sapiens
GWMGRTGTG

SEQ ID NO: 726176 - protein, 9 aa, Homo Sapiens
CHGDRWREQ

SEQ ID NO: 726177 - protein, 9 aa, Homo Sapiens
QENETFGFE

SEQ ID NO: 726178 - protein, 9 aa, Homo Sapiens
LDHEELVLL

SEQ ID NO: 726179 - protein, 9 aa, Homo Sapiens
SPIGHRGNT

SEQ ID NO: 726180 - protein, 9 aa, Homo Sapiens
RNQGLGIRP

SEQ ID NO: 726181 - protein, 9 aa, Homo Sapiens
IPGCSLKEK

SEQ ID NO: 726182 - protein, 9 aa, Homo Sapiens
HIFQVPECG

SEQ ID NO: 726183 - protein, 9 aa, Homo Sapiens
ECATFSAHC

SEQ ID NO: 726184 - protein, 9 aa, Homo Sapiens
SLSRRESTS

SEQ ID NO: 726185 - protein, 9 aa, Homo Sapiens
PGFNSVVML

SEQ ID NO: 726186 - protein, 9 aa, Homo Sapiens
AENDPFVIP

SEQ ID NO: 726187 - protein, 9 aa, Homo Sapiens
GVPPDKFNH

SEQ ID NO: 726188 - protein, 9 aa, Homo Sapiens
VRQLIQRLR

SEQ ID NO: 726189 - protein, 9 aa, Homo Sapiens
TRSRQCVFT

SEQ ID NO: 726190 - protein, 9 aa, Homo Sapiens
DVCQLGTWG

SEQ ID NO: 726191 - protein, 9 aa, Homo Sapiens
CMLHKKFWQ

SEQ ID NO: 726192 - protein, 9 aa, Homo Sapiens
ANTSCVLPL

SEQ ID NO: 726193 - protein, 9 aa, Homo Sapiens
TLIKKRKSR

SEQ ID NO: 726194 - protein, 9 aa, Homo Sapiens
LSRGISHAT

SEQ ID NO: 726195 - protein, 9 aa, Homo Sapiens
SCEDGIQNH

SEQ ID NO: 726196 - protein, 9 aa, Homo Sapiens
PCLYINWQD

SEQ ID NO: 726197 - protein, 9 aa, Homo Sapiens
SSSASRPGA

SEQ ID NO: 726198 - protein, 9 aa, Homo Sapiens
SIFDPAPFK

SEQ ID NO: 726199 - protein, 9 aa, Homo Sapiens
GQSCEDSCG

SEQ ID NO: 726200 - protein, 9 aa, Homo Sapiens
CRRSRASSV

SEQ ID NO: 726201 - protein, 9 aa, Homo Sapiens
RDDDSESEI

SEQ ID NO: 726202 - protein, 9 aa, Homo Sapiens
GFLEKALKL

SEQ ID NO: 726203 - protein, 9 aa, Homo Sapiens
KETTNGRLP

SEQ ID NO: 726204 - protein, 9 aa, Homo Sapiens
APNREFFKG

SEQ ID NO: 726205 - protein, 9 aa, Homo Sapiens
GHGAHHAAG

SEQ ID NO: 726206 - protein, 9 aa, Homo Sapiens
LYSVTGEHC

SEQ ID NO: 726207 - protein, 9 aa, Homo Sapiens
TRDKKEVTI

SEQ ID NO: 726208 - protein, 9 aa, Homo Sapiens
KNAAVIDQE

SEQ ID NO: 726209 - protein, 9 aa, Homo Sapiens
ELISEDEIA

SEQ ID NO: 726210 - protein, 9 aa, Homo Sapiens
WPWTRCLRM

SEQ ID NO: 726211 - protein, 9 aa, Homo Sapiens
TPMMNQSLM

SEQ ID NO: 726212 - protein, 9 aa, Homo Sapiens
FSVEKVLPL

SEQ ID NO: 726213 - protein, 9 aa, Homo Sapiens
SDKEAAKRA

SEQ ID NO: 726214 - protein, 9 aa, Homo Sapiens
APTLEIESG

SEQ ID NO: 726215 - protein, 9 aa, Homo Sapiens
SCCLVSSNT

SEQ ID NO: 726216 - protein, 9 aa, Homo Sapiens
LAQAGRGEG

SEQ ID NO: 726217 - protein, 9 aa, Homo Sapiens
RAPDPSPSG

SEQ ID NO: 726218 - protein, 9 aa, Homo Sapiens
EEVQKKVAK

SEQ ID NO: 726219 - protein, 9 aa, Homo Sapiens
YGKIITSSS

SEQ ID NO: 726220 - protein, 9 aa, Homo Sapiens
QHCFDVAPE

SEQ ID NO: 726221 - protein, 9 aa, Homo Sapiens
EGRKKSYLT

SEQ ID NO: 726222 - protein, 9 aa, Homo Sapiens
FSLGWCQKR

SEQ ID NO: 726223 - protein, 9 aa, Homo Sapiens
CVDYMGQKA

SEQ ID NO: 726224 - protein, 9 aa, Homo Sapiens
LDPALSQAF

SEQ ID NO: 726225 - protein, 9 aa, Homo Sapiens
NWSNNVRAS

SEQ ID NO: 726226 - protein, 9 aa, Homo Sapiens
SLILVEEGS

SEQ ID NO: 726227 - protein, 9 aa, Homo Sapiens
EARDAGSPS

SEQ ID NO: 726228 - protein, 9 aa, Homo Sapiens
GSKLYECKE

SEQ ID NO: 726229 - protein, 9 aa, Homo Sapiens
MSSIRFENM

SEQ ID NO: 726230 - protein, 9 aa, Homo Sapiens
QHTARKLFG

SEQ ID NO: 726231 - protein, 9 aa, Homo Sapiens
PPCHDVGCH

SEQ ID NO: 726232 - protein, 9 aa, Homo Sapiens
TWLNKELNQ

SEQ ID NO: 726233 - protein, 9 aa, Homo Sapiens
VLRNCGSPA

SEQ ID NO: 726234 - protein, 9 aa, Homo Sapiens
QRPTFKKLV

SEQ ID NO: 726235 - protein, 9 aa, Homo Sapiens
ASNPYCQLP

SEQ ID NO: 726236 - protein, 9 aa, Homo Sapiens
WQDKFMYFE

SEQ ID NO: 726237 - protein, 9 aa, Homo Sapiens
KDPHATPMQ

SEQ ID NO: 726238 - protein, 9 aa, Homo Sapiens
VLILSVCFG

SEQ ID NO: 726239 - protein, 9 aa, Homo Sapiens
RQKKYKYEV

SEQ ID NO: 726240 - protein, 9 aa, Homo Sapiens
GRMSSIRFE

SEQ ID NO: 726241 - protein, 9 aa, Homo Sapiens
PREGHILLF

SEQ ID NO: 726242 - protein, 9 aa, Homo Sapiens
KLNRNTGNY

SEQ ID NO: 726243 - protein, 9 aa, Homo Sapiens
FVRLPVYDA

SEQ ID NO: 726244 - protein, 9 aa, Homo Sapiens
TLGPRAWVD

SEQ ID NO: 726245 - protein, 9 aa, Homo Sapiens
NAIRIANFA

SEQ ID NO: 726246 - protein, 9 aa, Homo Sapiens
YTYRICLVP

SEQ ID NO: 726247 - protein, 9 aa, Homo Sapiens
SPCCSLFLN

SEQ ID NO: 726248 - protein, 9 aa, Homo Sapiens
DTPGGMQEA

SEQ ID NO: 726249 - protein, 9 aa, Homo Sapiens
DDCRRLFSK

SEQ ID NO: 726250 - protein, 9 aa, Homo Sapiens
TIFKVLLSI

SEQ ID NO: 726251 - protein, 9 aa, Homo Sapiens
IIAVHADVF

SEQ ID NO: 726252 - protein, 9 aa, Homo Sapiens
ALGRHSGAL

SEQ ID NO: 726253 - protein, 9 aa, Homo Sapiens
LRPTQSSLA

SEQ ID NO: 726254 - protein, 9 aa, Homo Sapiens
NPELYSKRF

SEQ ID NO: 726255 - protein, 9 aa, Homo Sapiens
LPGKSPARG

SEQ ID NO: 726256 - protein, 9 aa, Homo Sapiens
APFLWCQER

SEQ ID NO: 726257 - protein, 9 aa, Homo Sapiens
TFSAHCGSL

SEQ ID NO: 726258 - protein, 9 aa, Homo Sapiens
PPAAPPPTP

SEQ ID NO: 726259 - protein, 9 aa, Homo Sapiens
MQMQCGDGD

SEQ ID NO: 726260 - protein, 9 aa, Homo Sapiens
LDMERMQAS

SEQ ID NO: 726261 - protein, 9 aa, Homo Sapiens
FDLMTNLTA

SEQ ID NO: 726262 - protein, 9 aa, Homo Sapiens
STLVTPKLL

SEQ ID NO: 726263 - protein, 9 aa, Homo Sapiens
ILLGSPAGS

SEQ ID NO: 726264 - protein, 9 aa, Homo Sapiens
MSAAEAGGI

SEQ ID NO: 726265 - protein, 9 aa, Homo Sapiens
LEPIPVAHI

SEQ ID NO: 726266 - protein, 9 aa, Homo Sapiens
GLSQTTTNL

SEQ ID NO: 726267 - protein, 9 aa, Homo Sapiens
HNGRTYFFK

SEQ ID NO: 726268 - protein, 9 aa, Homo Sapiens
MALSKLSEI

SEQ ID NO: 726269 - protein, 9 aa, Homo Sapiens
KKKPLKYIE

SEQ ID NO: 726270 - protein, 9 aa, Homo Sapiens
WLIFFCVVL

SEQ ID NO: 726271 - protein, 9 aa, Homo Sapiens
NFKELFENA

SEQ ID NO: 726272 - protein, 9 aa, Homo Sapiens
FEDGIYANL

SEQ ID NO: 726273 - protein, 9 aa, Homo Sapiens
LMKLACTNT

SEQ ID NO: 726274 - protein, 9 aa, Homo Sapiens
VQQTACAPD

SEQ ID NO: 726275 - protein, 9 aa, Homo Sapiens
TDGPAASED

SEQ ID NO: 726276 - protein, 9 aa, Homo Sapiens
LKKSRLVVE

SEQ ID NO: 726277 - protein, 9 aa, Homo Sapiens
QTTTNLVAG

SEQ ID NO: 726278 - protein, 9 aa, Homo Sapiens
GPGCPGQTA

SEQ ID NO: 726279 - protein, 9 aa, Homo Sapiens
KGRSCTPSP

SEQ ID NO: 726280 - protein, 9 aa, Homo Sapiens
LFNAVSSSF

SEQ ID NO: 726281 - protein, 9 aa, Homo Sapiens
VFPKWVQGV

SEQ ID NO: 726282 - protein, 9 aa, Homo Sapiens
PSSLTSVVQ

SEQ ID NO: 726283 - protein, 9 aa, Homo Sapiens
WCLGLLQLG

SEQ ID NO: 726284 - protein, 9 aa, Homo Sapiens
RIYKFLRYF

SEQ ID NO: 726285 - protein, 9 aa, Homo Sapiens
KKLPLLFLR

SEQ ID NO: 726286 - protein, 9 aa, Homo Sapiens
KGVEKVFGV

SEQ ID NO: 726287 - protein, 9 aa, Homo Sapiens
AIPRLPQGS

SEQ ID NO: 726288 - protein, 9 aa, Homo Sapiens
GKSPARGSL

SEQ ID NO: 726289 - protein, 9 aa, Homo Sapiens
PEARDAGSP

SEQ ID NO: 726290 - protein, 9 aa, Homo Sapiens
PSQSELDPA

SEQ ID NO: 726291 - protein, 9 aa, Homo Sapiens
GPYKAAIPP

SEQ ID NO: 726292 - protein, 9 aa, Homo Sapiens
GTWVYEYMV

SEQ ID NO: 726293 - protein, 9 aa, Homo Sapiens
NDYKIRLGP

SEQ ID NO: 726294 - protein, 9 aa, Homo Sapiens
DSLDLCHGD

SEQ ID NO: 726295 - protein, 9 aa, Homo Sapiens
YEGSFDFSC

SEQ ID NO: 726296 - protein, 9 aa, Homo Sapiens
ISEDEIAKM

SEQ ID NO: 726297 - protein, 9 aa, Homo Sapiens
LMTNLTAEQ

SEQ ID NO: 726298 - protein, 9 aa, Homo Sapiens
THNQILKEE

SEQ ID NO: 726299 - protein, 9 aa, Homo Sapiens
TDFCFSTLV

SEQ ID NO: 726300 - protein, 9 aa, Homo Sapiens
LYPLMKLAC

SEQ ID NO: 726301 - protein, 9 aa, Homo Sapiens
EHCSNCLAE

SEQ ID NO: 726302 - protein, 9 aa, Homo Sapiens
VRDNADFWG

SEQ ID NO: 726303 - protein, 9 aa, Homo Sapiens
YPDIFLACA

SEQ ID NO: 726304 - protein, 9 aa, Homo Sapiens
PTGPPSESS

SEQ ID NO: 726305 - protein, 9 aa, Homo Sapiens
SVYGCGYTG

SEQ ID NO: 726306 - protein, 9 aa, Homo Sapiens
VKDTLRTMG

SEQ ID NO: 726307 - protein, 9 aa, Homo Sapiens
VAPKQHLLN

SEQ ID NO: 726308 - protein, 9 aa, Homo Sapiens
QSGVVFAQC

SEQ ID NO: 726309 - protein, 9 aa, Homo Sapiens
LTSVVQTRF

SEQ ID NO: 726310 - protein, 9 aa, Homo Sapiens
IKKRKSRSL

SEQ ID NO: 726311 - protein, 9 aa, Homo Sapiens
SNKTRTFQA

SEQ ID NO: 726312 - protein, 9 aa, Homo Sapiens
LRQPHNATN

SEQ ID NO: 726313 - protein, 9 aa, Homo Sapiens
EAFSTITFC

SEQ ID NO: 726314 - protein, 9 aa, Homo Sapiens
RTGTGFTSP

SEQ ID NO: 726315 - protein, 9 aa, Homo Sapiens
AADPPASAV

SEQ ID NO: 726316 - protein, 9 aa, Homo Sapiens
YVWRMCDWS

SEQ ID NO: 726317 - protein, 9 aa, Homo Sapiens
ERGEHALQD

SEQ ID NO: 726318 - protein, 9 aa, Homo Sapiens
CLVSEVLCR

SEQ ID NO: 726319 - protein, 9 aa, Homo Sapiens
LSRRESTSP

SEQ ID NO: 726320 - protein, 9 aa, Homo Sapiens
NLGIWKASI

SEQ ID NO: 726321 - protein, 9 aa, Homo Sapiens
QARLGAVSS

SEQ ID NO: 726322 - protein, 9 aa, Homo Sapiens
HVQAAPQVP

SEQ ID NO: 726323 - protein, 9 aa, Homo Sapiens
KELNQNQLV

SEQ ID NO: 726324 - protein, 9 aa, Homo Sapiens
RLNALVQRS

SEQ ID NO: 726325 - protein, 9 aa, Homo Sapiens
KQENETFGF

SEQ ID NO: 726326 - protein, 9 aa, Homo Sapiens
TFDLLDWPP

SEQ ID NO: 726327 - protein, 9 aa, Homo Sapiens
DLCHLPQTA

SEQ ID NO: 726328 - protein, 9 aa, Homo Sapiens
NGREKKCHE

SEQ ID NO: 726329 - protein, 9 aa, Homo Sapiens
LHGLCVSPP

SEQ ID NO: 726330 - protein, 9 aa, Homo Sapiens
HVFRQCLVQ

SEQ ID NO: 726331 - protein, 9 aa, Homo Sapiens
VLSEKQEGA

SEQ ID NO: 726332 - protein, 9 aa, Homo Sapiens
NMPNGTLGS

SEQ ID NO: 726333 - protein, 9 aa, Homo Sapiens
LRIFKETEL

SEQ ID NO: 726334 - protein, 9 aa, Homo Sapiens
RATRKGPAP

SEQ ID NO: 726335 - protein, 9 aa, Homo Sapiens
KLLEDSKMD

SEQ ID NO: 726336 - protein, 9 aa, Homo Sapiens
QVQPETLSQ

SEQ ID NO: 726337 - protein, 9 aa, Homo Sapiens
VLKTYFEEE

SEQ ID NO: 726338 - protein, 9 aa, Homo Sapiens
LYREHSQTC

SEQ ID NO: 726339 - protein, 9 aa, Homo Sapiens
EGQQRNTRL

SEQ ID NO: 726340 - protein, 9 aa, Homo Sapiens
RTLGPRAWV

SEQ ID NO: 726341 - protein, 9 aa, Homo Sapiens
CDTYPAVLV

SEQ ID NO: 726342 - protein, 9 aa, Homo Sapiens
NEVSTLKDR

SEQ ID NO: 726343 - protein, 9 aa, Homo Sapiens
WNKNKPQEN

SEQ ID NO: 726344 - protein, 9 aa, Homo Sapiens
NEYSYRTQI

SEQ ID NO: 726345 - protein, 9 aa, Homo Sapiens
AKPTGPPSE

SEQ ID NO: 726346 - protein, 9 aa, Homo Sapiens
SLLEGEDVK

SEQ ID NO: 726347 - protein, 9 aa, Homo Sapiens
SKFYAAAMN

SEQ ID NO: 726348 - protein, 9 aa, Homo Sapiens
QLAFYRLHQ

SEQ ID NO: 726349 - protein, 9 aa, Homo Sapiens
YPLMKLACT

SEQ ID NO: 726350 - protein, 9 aa, Homo Sapiens
LPQTAPTML

SEQ ID NO: 726351 - protein, 9 aa, Homo Sapiens
QLAQFKMTW

SEQ ID NO: 726352 - protein, 9 aa, Homo Sapiens
YGAWYHKPK

SEQ ID NO: 726353 - protein, 9 aa, Homo Sapiens
VESLKQLGE

SEQ ID NO: 726354 - protein, 9 aa, Homo Sapiens
LIFFCVVLC

SEQ ID NO: 726355 - protein, 9 aa, Homo Sapiens
VLLYTVLSP

SEQ ID NO: 726356 - protein, 9 aa, Homo Sapiens
QVPYGDLVT

SEQ ID NO: 726357 - protein, 9 aa, Homo Sapiens
REGHILLFV

SEQ ID NO: 726358 - protein, 9 aa, Homo Sapiens
YGCGYTGLI

SEQ ID NO: 726359 - protein, 9 aa, Homo Sapiens
ELKCSPQWS

SEQ ID NO: 726360 - protein, 9 aa, Homo Sapiens
HPVQADTLN

SEQ ID NO: 726361 - protein, 9 aa, Homo Sapiens
KNGQWLGTV

SEQ ID NO: 726362 - protein, 9 aa, Homo Sapiens
KTFLKKLEA

SEQ ID NO: 726363 - protein, 9 aa, Homo Sapiens
SNNVRASLY

SEQ ID NO: 726364 - protein, 9 aa, Homo Sapiens
VYVTFHSYS

SEQ ID NO: 726365 - protein, 9 aa, Homo Sapiens
LQGCGGSPV

SEQ ID NO: 726366 - protein, 9 aa, Homo Sapiens
LQARLGAVS

SEQ ID NO: 726367 - protein, 9 aa, Homo Sapiens
VSCRNIGKE

SEQ ID NO: 726368 - protein, 9 aa, Homo Sapiens
FRCCPFIRA

SEQ ID NO: 726369 - protein, 9 aa, Homo Sapiens
HVSLHGLCV

SEQ ID NO: 726370 - protein, 9 aa, Homo Sapiens
MKLQTRQWP

SEQ ID NO: 726371 - protein, 9 aa, Homo Sapiens
QPANIRQQP

SEQ ID NO: 726372 - protein, 9 aa, Homo Sapiens
CAHFRYENV

SEQ ID NO: 726373 - protein, 9 aa, Homo Sapiens
ISGPKSPIG

SEQ ID NO: 726374 - protein, 9 aa, Homo Sapiens
YREHSQTCQ

SEQ ID NO: 726375 - protein, 9 aa, Homo Sapiens
KRTLSRVMV

SEQ ID NO: 726376 - protein, 9 aa, Homo Sapiens
TPQPPPSSC

SEQ ID NO: 726377 - protein, 9 aa, Homo Sapiens
KEKEKQHSQ

SEQ ID NO: 726378 - protein, 9 aa, Homo Sapiens
IFQDDFGPP

SEQ ID NO: 726379 - protein, 9 aa, Homo Sapiens
ESEKLIQEI

SEQ ID NO: 726380 - protein, 9 aa, Homo Sapiens
WSWSPRPPR

SEQ ID NO: 726381 - protein, 9 aa, Homo Sapiens
LSSYALKTV

SEQ ID NO: 726382 - protein, 9 aa, Homo Sapiens
HDCYLLREQ

SEQ ID NO: 726383 - protein, 9 aa, Homo Sapiens
QGNFEKHPK

SEQ ID NO: 726384 - protein, 9 aa, Homo Sapiens
APHVQAAPQ

SEQ ID NO: 726385 - protein, 9 aa, Homo Sapiens
VGGLSEPYV

SEQ ID NO: 726386 - protein, 9 aa, Homo Sapiens
EYTIVIRNK

SEQ ID NO: 726387 - protein, 9 aa, Homo Sapiens
ADTLNLWVT

SEQ ID NO: 726388 - protein, 9 aa, Homo Sapiens
PLLFLRKVD

SEQ ID NO: 726389 - protein, 9 aa, Homo Sapiens
FSAHCGSLK

SEQ ID NO: 726390 - protein, 9 aa, Homo Sapiens
LAFYRLHQR

SEQ ID NO: 726391 - protein, 9 aa, Homo Sapiens
IGGQVRVRE

SEQ ID NO: 726392 - protein, 9 aa, Homo Sapiens
CENREAVLV

SEQ ID NO: 726393 - protein, 9 aa, Homo Sapiens
SGFHIELKQ

SEQ ID NO: 726394 - protein, 9 aa, Homo Sapiens
DASRWDPAH

SEQ ID NO: 726395 - protein, 9 aa, Homo Sapiens
PSQSRMVAR

SEQ ID NO: 726396 - protein, 9 aa, Homo Sapiens
TGRLVKSEE

SEQ ID NO: 726397 - protein, 9 aa, Homo Sapiens
QHSSPVAAM

SEQ ID NO: 726398 - protein, 9 aa, Homo Sapiens
INTFNLAFY

SEQ ID NO: 726399 - protein, 9 aa, Homo Sapiens
SYALKTVLL

SEQ ID NO: 726400 - protein, 9 aa, Homo Sapiens
QHGKPYPDI

SEQ ID NO: 726401 - protein, 9 aa, Homo Sapiens
PANRPTTPV

SEQ ID NO: 726402 - protein, 9 aa, Homo Sapiens
ALINRRELL

SEQ ID NO: 726403 - protein, 9 aa, Homo Sapiens
RPPPPPISG

SEQ ID NO: 726404 - protein, 9 aa, Homo Sapiens
SALIFGMFG

SEQ ID NO: 726405 - protein, 9 aa, Homo Sapiens
LKPYGLIVL

SEQ ID NO: 726406 - protein, 9 aa, Homo Sapiens
TYFEEEEEV

SEQ ID NO: 726407 - protein, 9 aa, Homo Sapiens
PYGYNAYPS

SEQ ID NO: 726408 - protein, 9 aa, Homo Sapiens
LPRVVVGTS

SEQ ID NO: 726409 - protein, 9 aa, Homo Sapiens
GKRSSEENL

SEQ ID NO: 726410 - protein, 9 aa, Homo Sapiens
SYRTQIDYN

SEQ ID NO: 726411 - protein, 9 aa, Homo Sapiens
VNAFGESLQ

SEQ ID NO: 726412 - protein, 9 aa, Homo Sapiens
ELMDASELL

SEQ ID NO: 726413 - protein, 9 aa, Homo Sapiens
NSSCMGVMN

SEQ ID NO: 726414 - protein, 9 aa, Homo Sapiens
LDQLQADAV

SEQ ID NO: 726415 - protein, 9 aa, Homo Sapiens
RCFWSTLWG

SEQ ID NO: 726416 - protein, 9 aa, Homo Sapiens
INNANYHDT

SEQ ID NO: 726417 - protein, 9 aa, Homo Sapiens
NSDGYLTSG

SEQ ID NO: 726418 - protein, 9 aa, Homo Sapiens
VSVHRSQHF

SEQ ID NO: 726419 - protein, 9 aa, Homo Sapiens
LYGCDSECS

SEQ ID NO: 726420 - protein, 9 aa, Homo Sapiens
AEAGGIFHR

SEQ ID NO: 726421 - protein, 9 aa, Homo Sapiens
EDPIDYKCG

SEQ ID NO: 726422 - protein, 9 aa, Homo Sapiens
TRQWPPGVS

SEQ ID NO: 726423 - protein, 9 aa, Homo Sapiens
CKECKKTFA

SEQ ID NO: 726424 - protein, 9 aa, Homo Sapiens
QPENKLALV

SEQ ID NO: 726425 - protein, 9 aa, Homo Sapiens
KLQALLRFV

SEQ ID NO: 726426 - protein, 9 aa, Homo Sapiens
RKAPDTYLA

SEQ ID NO: 726427 - protein, 9 aa, Homo Sapiens
PPPKRTLSR

SEQ ID NO: 726428 - protein, 9 aa, Homo Sapiens
FGDGPDSNK

SEQ ID NO: 726429 - protein, 9 aa, Homo Sapiens
TRITGKLSK

SEQ ID NO: 726430 - protein, 9 aa, Homo Sapiens
ALYSVTGEH

SEQ ID NO: 726431 - protein, 9 aa, Homo Sapiens
EFEKADTPG

SEQ ID NO: 726432 - protein, 9 aa, Homo Sapiens
LTFMTESPR

SEQ ID NO: 726433 - protein, 9 aa, Homo Sapiens
QENEDTPKS

SEQ ID NO: 726434 - protein, 9 aa, Homo Sapiens
ISVACPILT

SEQ ID NO: 726435 - protein, 9 aa, Homo Sapiens
QLPVGGLVT

SEQ ID NO: 726436 - protein, 9 aa, Homo Sapiens
STRKILVVH

SEQ ID NO: 726437 - protein, 9 aa, Homo Sapiens
PENKWVREY

SEQ ID NO: 726438 - protein, 9 aa, Homo Sapiens
AQFKMTWTS

SEQ ID NO: 726439 - protein, 9 aa, Homo Sapiens
AKGSPQGSP

SEQ ID NO: 726440 - protein, 9 aa, Homo Sapiens
AVLVVPYRA

SEQ ID NO: 726441 - protein, 9 aa, Homo Sapiens
LTLRGRPRP

SEQ ID NO: 726442 - protein, 9 aa, Homo Sapiens
MTVNYLLTN

SEQ ID NO: 726443 - protein, 9 aa, Homo Sapiens
TSAPAPSPW

SEQ ID NO: 726444 - protein, 9 aa, Homo Sapiens
SPPAAPTRP

SEQ ID NO: 726445 - protein, 9 aa, Homo Sapiens
MFVFCFKRG

SEQ ID NO: 726446 - protein, 9 aa, Homo Sapiens
FSGDDVIGE

SEQ ID NO: 726447 - protein, 9 aa, Homo Sapiens
KTVPLTCIV

SEQ ID NO: 726448 - protein, 9 aa, Homo Sapiens
SGVPLEASL

SEQ ID NO: 726449 - protein, 9 aa, Homo Sapiens
VHLPEPLMW

SEQ ID NO: 726450 - protein, 9 aa, Homo Sapiens
CKFHRTSVL

SEQ ID NO: 726451 - protein, 9 aa, Homo Sapiens
LGQDCYTRI

SEQ ID NO: 726452 - protein, 9 aa, Homo Sapiens
SVVSCRNIG

SEQ ID NO: 726453 - protein, 9 aa, Homo Sapiens
SVVVVTWES

SEQ ID NO: 726454 - protein, 9 aa, Homo Sapiens
VGGRRRAAP

SEQ ID NO: 726455 - protein, 9 aa, Homo Sapiens
NNFLDLISS

SEQ ID NO: 726456 - protein, 9 aa, Homo Sapiens
QGLRQPHNA

SEQ ID NO: 726457 - protein, 9 aa, Homo Sapiens
STTSRLLAT

SEQ ID NO: 726458 - protein, 9 aa, Homo Sapiens
YSTPQPPPS

SEQ ID NO: 726459 - protein, 9 aa, Homo Sapiens
KHWDGEQSP

SEQ ID NO: 726460 - protein, 9 aa, Homo Sapiens
VQSLPYGIL

SEQ ID NO: 726461 - protein, 9 aa, Homo Sapiens
DIIPLSKQK

SEQ ID NO: 726462 - protein, 9 aa, Homo Sapiens
LLSSFLTLR

SEQ ID NO: 726463 - protein, 9 aa, Homo Sapiens
TMIILASIN

SEQ ID NO: 726464 - protein, 9 aa, Homo Sapiens
GDHCELCPK

SEQ ID NO: 726465 - protein, 9 aa, Homo Sapiens
LLCMLHKKF

SEQ ID NO: 726466 - protein, 9 aa, Homo Sapiens
SSCEAFSTI

SEQ ID NO: 726467 - protein, 9 aa, Homo Sapiens
QKECYNGLN

SEQ ID NO: 726468 - protein, 9 aa, Homo Sapiens
AIVVILSAM

SEQ ID NO: 726469 - protein, 9 aa, Homo Sapiens
HTARKLFGL

SEQ ID NO: 726470 - protein, 9 aa, Homo Sapiens
QKQKETIKT

SEQ ID NO: 726471 - protein, 9 aa, Homo Sapiens
EPDGEFPGR

SEQ ID NO: 726472 - protein, 9 aa, Homo Sapiens
GDELDNDNS

SEQ ID NO: 726473 - protein, 9 aa, Homo Sapiens
QMQMQCGDG

SEQ ID NO: 726474 - protein, 9 aa, Homo Sapiens
CYVQSPGQG

SEQ ID NO: 726475 - protein, 9 aa, Homo Sapiens
RQLIQRLRL

SEQ ID NO: 726476 - protein, 9 aa, Homo Sapiens
QIKYNDYKI

SEQ ID NO: 726477 - protein, 9 aa, Homo Sapiens
AEQPVFAAN

SEQ ID NO: 726478 - protein, 9 aa, Homo Sapiens
CEDGIQNHE

SEQ ID NO: 726479 - protein, 9 aa, Homo Sapiens
LDGATAGVQ

SEQ ID NO: 726480 - protein, 9 aa, Homo Sapiens
SPALTIFKV

SEQ ID NO: 726481 - protein, 9 aa, Homo Sapiens
DSGVPCNRL

SEQ ID NO: 726482 - protein, 9 aa, Homo Sapiens
SWTVRKTLP

SEQ ID NO: 726483 - protein, 9 aa, Homo Sapiens
SNFTGYVDD

SEQ ID NO: 726484 - protein, 9 aa, Homo Sapiens
VNNFLDLIS

SEQ ID NO: 726485 - protein, 9 aa, Homo Sapiens
HCELCPKDD

SEQ ID NO: 726486 - protein, 9 aa, Homo Sapiens
SNLTNLELL

SEQ ID NO: 726487 - protein, 9 aa, Homo Sapiens
MTESPRFLL

SEQ ID NO: 726488 - protein, 9 aa, Homo Sapiens
PFLLLVAQG

SEQ ID NO: 726489 - protein, 9 aa, Homo Sapiens
NDEDGKKDA

SEQ ID NO: 726490 - protein, 9 aa, Homo Sapiens
ISSESGASS

SEQ ID NO: 726491 - protein, 9 aa, Homo Sapiens
PVYDAAADG

SEQ ID NO: 726492 - protein, 9 aa, Homo Sapiens
QSGTRPRNQ

SEQ ID NO: 726493 - protein, 9 aa, Homo Sapiens
IFPRLMQKI

SEQ ID NO: 726494 - protein, 9 aa, Homo Sapiens
NAYPSYPGY

SEQ ID NO: 726495 - protein, 9 aa, Homo Sapiens
NAAVIDQEP

SEQ ID NO: 726496 - protein, 9 aa, Homo Sapiens
RPSLELVAS

SEQ ID NO: 726497 - protein, 9 aa, Homo Sapiens
KIDFLLQVC

SEQ ID NO: 726498 - protein, 9 aa, Homo Sapiens
VPIHNADLS

SEQ ID NO: 726499 - protein, 9 aa, Homo Sapiens
EGGRPGKAG

SEQ ID NO: 726500 - protein, 9 aa, Homo Sapiens
RGIGSVKEG

SEQ ID NO: 726501 - protein, 9 aa, Homo Sapiens
RSQHFLPLT

SEQ ID NO: 726502 - protein, 9 aa, Homo Sapiens
REEVRQRLS

SEQ ID NO: 726503 - protein, 9 aa, Homo Sapiens
TVTQPGGNF

SEQ ID NO: 726504 - protein, 9 aa, Homo Sapiens
YSACTNDGR

SEQ ID NO: 726505 - protein, 9 aa, Homo Sapiens
FPERFLVSD

SEQ ID NO: 726506 - protein, 9 aa, Homo Sapiens
DSMKLGTEA

SEQ ID NO: 726507 - protein, 9 aa, Homo Sapiens
TLTSTLELK

SEQ ID NO: 726508 - protein, 9 aa, Homo Sapiens
RSPTFLPFL

SEQ ID NO: 726509 - protein, 9 aa, Homo Sapiens
WYLLSNLNI

SEQ ID NO: 726510 - protein, 9 aa, Homo Sapiens
ILPRNVVQG

SEQ ID NO: 726511 - protein, 9 aa, Homo Sapiens
HRLKVFSGA

SEQ ID NO: 726512 - protein, 9 aa, Homo Sapiens
SHDGHDDDV

SEQ ID NO: 726513 - protein, 9 aa, Homo Sapiens
YESRTSVTR

SEQ ID NO: 726514 - protein, 9 aa, Homo Sapiens
QARLPAPHV

SEQ ID NO: 726515 - protein, 9 aa, Homo Sapiens
VPNFINAKL

SEQ ID NO: 726516 - protein, 9 aa, Homo Sapiens
STEIATVHC

SEQ ID NO: 726517 - protein, 9 aa, Homo Sapiens
CVKNNWSNN

SEQ ID NO: 726518 - protein, 9 aa, Homo Sapiens
NINSLAIPI

SEQ ID NO: 726519 - protein, 9 aa, Homo Sapiens
ELEGAMQKA

SEQ ID NO: 726520 - protein, 9 aa, Homo Sapiens
NKNKPQENG

SEQ ID NO: 726521 - protein, 9 aa, Homo Sapiens
GSAQEQLRN

SEQ ID NO: 726522 - protein, 9 aa, Homo Sapiens
EMEKSDANS

SEQ ID NO: 726523 - protein, 9 aa, Homo Sapiens
SQPCSPLSA

SEQ ID NO: 726524 - protein, 9 aa, Homo Sapiens
LWKAPIGES

SEQ ID NO: 726525 - protein, 9 aa, Homo Sapiens
TSATVIFRK

SEQ ID NO: 726526 - protein, 9 aa, Homo Sapiens
VLAAQWTEF

SEQ ID NO: 726527 - protein, 9 aa, Homo Sapiens
IKYNDYKIR

SEQ ID NO: 726528 - protein, 9 aa, Homo Sapiens
DPPCHDVGC

SEQ ID NO: 726529 - protein, 9 aa, Homo Sapiens
QADAVNAFG

SEQ ID NO: 726530 - protein, 9 aa, Homo Sapiens
HGKPYPDIF

SEQ ID NO: 726531 - protein, 9 aa, Homo Sapiens
LPNFWNPPT

SEQ ID NO: 726532 - protein, 9 aa, Homo Sapiens
VTTTPTPTG

SEQ ID NO: 726533 - protein, 9 aa, Homo Sapiens
PNVTFDLLD

SEQ ID NO: 726534 - protein, 9 aa, Homo Sapiens
ADVFTISKE

SEQ ID NO: 726535 - protein, 9 aa, Homo Sapiens
EAPYSREEV

SEQ ID NO: 726536 - protein, 9 aa, Homo Sapiens
AAYWVRTPP

SEQ ID NO: 726537 - protein, 9 aa, Homo Sapiens
VEEALRMGI

SEQ ID NO: 726538 - protein, 9 aa, Homo Sapiens
DQLQADAVN

SEQ ID NO: 726539 - protein, 9 aa, Homo Sapiens
VWRMCDWSK

SEQ ID NO: 726540 - protein, 9 aa, Homo Sapiens
LGAVSSAEA

SEQ ID NO: 726541 - protein, 9 aa, Homo Sapiens
ENLGIWKAS

SEQ ID NO: 726542 - protein, 9 aa, Homo Sapiens
KRRHTKKKP

SEQ ID NO: 726543 - protein, 9 aa, Homo Sapiens
DIRLVAAQR

SEQ ID NO: 726544 - protein, 9 aa, Homo Sapiens
CHILLGTFE

SEQ ID NO: 726545 - protein, 9 aa, Homo Sapiens
NLQLRKCCK

SEQ ID NO: 726546 - protein, 9 aa, Homo Sapiens
GVQQRDVYY

SEQ ID NO: 726547 - protein, 9 aa, Homo Sapiens
MKENLSPKW

SEQ ID NO: 726548 - protein, 9 aa, Homo Sapiens
EKADTPGGM

SEQ ID NO: 726549 - protein, 9 aa, Homo Sapiens
LFVLIETLN

SEQ ID NO: 726550 - protein, 9 aa, Homo Sapiens
DEVYNTSIK

SEQ ID NO: 726551 - protein, 9 aa, Homo Sapiens
EGALPLREN

SEQ ID NO: 726552 - protein, 9 aa, Homo Sapiens
YSICLFAWS

SEQ ID NO: 726553 - protein, 9 aa, Homo Sapiens
QKHITLCAL

SEQ ID NO: 726554 - protein, 9 aa, Homo Sapiens
SRLLRPTQS

SEQ ID NO: 726555 - protein, 9 aa, Homo Sapiens
TTRCFWSTL

SEQ ID NO: 726556 - protein, 9 aa, Homo Sapiens
IQEPPLQAW

SEQ ID NO: 726557 - protein, 9 aa, Homo Sapiens
DKDSEPATD

SEQ ID NO: 726558 - protein, 9 aa, Homo Sapiens
PQHCFDVAP

SEQ ID NO: 726559 - protein, 9 aa, Homo Sapiens
GDIGAIFKI

SEQ ID NO: 726560 - protein, 9 aa, Homo Sapiens
SLSVLLVPN

SEQ ID NO: 726561 - protein, 9 aa, Homo Sapiens
LKQLGEKRQ

SEQ ID NO: 726562 - protein, 9 aa, Homo Sapiens
QKKYKYEVC

SEQ ID NO: 726563 - protein, 9 aa, Homo Sapiens
DVKDTLRTM

SEQ ID NO: 726564 - protein, 9 aa, Homo Sapiens
KMVMETKTH

SEQ ID NO: 726565 - protein, 9 aa, Homo Sapiens
FLRALRLLQ

SEQ ID NO: 726566 - protein, 9 aa, Homo Sapiens
AVQSLPYGI

SEQ ID NO: 726567 - protein, 9 aa, Homo Sapiens
HLHNVYEST

SEQ ID NO: 726568 - protein, 9 aa, Homo Sapiens
GIRPSLELV

SEQ ID NO: 726569 - protein, 9 aa, Homo Sapiens
ANYFCYENE

SEQ ID NO: 726570 - protein, 9 aa, Homo Sapiens
HKLLLSRVK

SEQ ID NO: 726571 - protein, 9 aa, Homo Sapiens
FIQGPKGEG

SEQ ID NO: 726572 - protein, 9 aa, Homo Sapiens
PNRTSIVNP

SEQ ID NO: 726573 - protein, 9 aa, Homo Sapiens
QAKLPLPRP

SEQ ID NO: 726574 - protein, 9 aa, Homo Sapiens
SVPASGQAA

SEQ ID NO: 726575 - protein, 9 aa, Homo Sapiens
KTFALYRNL

SEQ ID NO: 726576 - protein, 9 aa, Homo Sapiens
SPGTKKPLD

SEQ ID NO: 726577 - protein, 9 aa, Homo Sapiens
HPNLPNHLP

SEQ ID NO: 726578 - protein, 9 aa, Homo Sapiens
SMSRRRISC

SEQ ID NO: 726579 - protein, 9 aa, Homo Sapiens
PAPVGSCLS

SEQ ID NO: 726580 - protein, 9 aa, Homo Sapiens
KVAKQTFIK

SEQ ID NO: 726581 - protein, 9 aa, Homo Sapiens
LTAEVYFFQ

SEQ ID NO: 726582 - protein, 9 aa, Homo Sapiens
NVQSRDDGG

SEQ ID NO: 726583 - protein, 9 aa, Homo Sapiens
SPGRPLSCS

SEQ ID NO: 726584 - protein, 9 aa, Homo Sapiens
CKERGKAFI

SEQ ID NO: 726585 - protein, 9 aa, Homo Sapiens
PSWTTWVYS

SEQ ID NO: 726586 - protein, 9 aa, Homo Sapiens
KGSPQGSPD

SEQ ID NO: 726587 - protein, 9 aa, Homo Sapiens
TGGVSRGVI

SEQ ID NO: 726588 - protein, 9 aa, Homo Sapiens
APGDELDND

SEQ ID NO: 726589 - protein, 9 aa, Homo Sapiens
TLRGRPRPE

SEQ ID NO: 726590 - protein, 9 aa, Homo Sapiens
YEVCKDLIK

SEQ ID NO: 726591 - protein, 9 aa, Homo Sapiens
FSILLWVAP

SEQ ID NO: 726592 - protein, 9 aa, Homo Sapiens
PPSPLCLIE

SEQ ID NO: 726593 - protein, 9 aa, Homo Sapiens
INPYVLSYK

SEQ ID NO: 726594 - protein, 9 aa, Homo Sapiens
LWPGSTDLC

SEQ ID NO: 726595 - protein, 9 aa, Homo Sapiens
LSDEKYSVA

SEQ ID NO: 726596 - protein, 9 aa, Homo Sapiens
AKGLLGDPG

SEQ ID NO: 726597 - protein, 9 aa, Homo Sapiens
VADDDRLNK

SEQ ID NO: 726598 - protein, 9 aa, Homo Sapiens
CFSTLVTPK

SEQ ID NO: 726599 - protein, 9 aa, Homo Sapiens
ATTPSLTSV

SEQ ID NO: 726600 - protein, 9 aa, Homo Sapiens
DGIYANLGI

SEQ ID NO: 726601 - protein, 9 aa, Homo Sapiens
KCCKSVDEC

SEQ ID NO: 726602 - protein, 9 aa, Homo Sapiens
TVKEMQLGL

SEQ ID NO: 726603 - protein, 9 aa, Homo Sapiens
SCCICLEPF

SEQ ID NO: 726604 - protein, 9 aa, Homo Sapiens
HWPLQPMCP

SEQ ID NO: 726605 - protein, 9 aa, Homo Sapiens
GYEVFAREA

SEQ ID NO: 726606 - protein, 9 aa, Homo Sapiens
EKQENETFG

SEQ ID NO: 726607 - protein, 9 aa, Homo Sapiens
GATPYLFCY

SEQ ID NO: 726608 - protein, 9 aa, Homo Sapiens
AVIDQEPAG

SEQ ID NO: 726609 - protein, 9 aa, Homo Sapiens
IVGISGPKS

SEQ ID NO: 726610 - protein, 9 aa, Homo Sapiens
GDLLEPDGE

SEQ ID NO: 726611 - protein, 9 aa, Homo Sapiens
YKAAIPPAP

SEQ ID NO: 726612 - protein, 9 aa, Homo Sapiens
LTSVDNEFK

SEQ ID NO: 726613 - protein, 9 aa, Homo Sapiens
EFVRLPVYD

SEQ ID NO: 726614 - protein, 9 aa, Homo Sapiens
CRVGQCVSF

SEQ ID NO: 726615 - protein, 9 aa, Homo Sapiens
AALINRREL

SEQ ID NO: 726616 - protein, 9 aa, Homo Sapiens
GDVQPLGPS

SEQ ID NO: 726617 - protein, 9 aa, Homo Sapiens
NSVVMLLNL

SEQ ID NO: 726618 - protein, 9 aa, Homo Sapiens
ASSVGRCSV

SEQ ID NO: 726619 - protein, 9 aa, Homo Sapiens
EGAISSESG

SEQ ID NO: 726620 - protein, 9 aa, Homo Sapiens
TDSLLRALV

SEQ ID NO: 726621 - protein, 9 aa, Homo Sapiens
TAIVESHDG

SEQ ID NO: 726622 - protein, 9 aa, Homo Sapiens
NEGGSIKQY

SEQ ID NO: 726623 - protein, 9 aa, Homo Sapiens
GGGPGLPPH

SEQ ID NO: 726624 - protein, 9 aa, Homo Sapiens
CNPTFLMKG

SEQ ID NO: 726625 - protein, 9 aa, Homo Sapiens
QQRDVYYRL

SEQ ID NO: 726626 - protein, 9 aa, Homo Sapiens
ISRDGFNFK

SEQ ID NO: 726627 - protein, 9 aa, Homo Sapiens
SSLRPTAST

SEQ ID NO: 726628 - protein, 9 aa, Homo Sapiens
SQGDVQPLG

SEQ ID NO: 726629 - protein, 9 aa, Homo Sapiens
VVKDGQMMT

SEQ ID NO: 726630 - protein, 9 aa, Homo Sapiens
SLLHHRHSL

SEQ ID NO: 726631 - protein, 9 aa, Homo Sapiens
SLLDLLPKD

SEQ ID NO: 726632 - protein, 9 aa, Homo Sapiens
GALKEEQKD

SEQ ID NO: 726633 - protein, 9 aa, Homo Sapiens
VRPGRLLYM

SEQ ID NO: 726634 - protein, 9 aa, Homo Sapiens
NSMRMDMFS

SEQ ID NO: 726635 - protein, 9 aa, Homo Sapiens
MNFVSFFQV

SEQ ID NO: 726636 - protein, 9 aa, Homo Sapiens
VEEEPEQKP

SEQ ID NO: 726637 - protein, 9 aa, Homo Sapiens
FTEPQHCFD

SEQ ID NO: 726638 - protein, 9 aa, Homo Sapiens
QAPLCTSAP

SEQ ID NO: 726639 - protein, 9 aa, Homo Sapiens
LILGLLVVL

SEQ ID NO: 726640 - protein, 9 aa, Homo Sapiens
GSSHCPMPA

SEQ ID NO: 726641 - protein, 9 aa, Homo Sapiens
DGTASSQIS

SEQ ID NO: 726642 - protein, 9 aa, Homo Sapiens
KSEPNTYQL

SEQ ID NO: 726643 - protein, 9 aa, Homo Sapiens
LSPPGAPLG

SEQ ID NO: 726644 - protein, 9 aa, Homo Sapiens
LTSQSEAMV

SEQ ID NO: 726645 - protein, 9 aa, Homo Sapiens
QEDRLYTFQ

SEQ ID NO: 726646 - protein, 9 aa, Homo Sapiens
SSPEARDAG

SEQ ID NO: 726647 - protein, 9 aa, Homo Sapiens
NNPANRPTT

SEQ ID NO: 726648 - protein, 9 aa, Homo Sapiens
GLPPHDAPG

SEQ ID NO: 726649 - protein, 9 aa, Homo Sapiens
LTLSKEIQM

SEQ ID NO: 726650 - protein, 9 aa, Homo Sapiens
CPDCGRALA

SEQ ID NO: 726651 - protein, 9 aa, Homo Sapiens
EQMFITEEV

SEQ ID NO: 726652 - protein, 9 aa, Homo Sapiens
TVKSVNASN

SEQ ID NO: 726653 - protein, 9 aa, Homo Sapiens
SKNKVRGVR

SEQ ID NO: 726654 - protein, 9 aa, Homo Sapiens
KAAIPPAPV

SEQ ID NO: 726655 - protein, 9 aa, Homo Sapiens
MDSVIHALA

SEQ ID NO: 726656 - protein, 9 aa, Homo Sapiens
CRQQSQCLR

SEQ ID NO: 726657 - protein, 9 aa, Homo Sapiens
YLIEKPMGI

SEQ ID NO: 726658 - protein, 9 aa, Homo Sapiens
SLELVASLP

SEQ ID NO: 726659 - protein, 9 aa, Homo Sapiens
LGQNIIAIL

SEQ ID NO: 726660 - protein, 9 aa, Homo Sapiens
QDGADDFKE

SEQ ID NO: 726661 - protein, 9 aa, Homo Sapiens
SEIIIEGKL

SEQ ID NO: 726662 - protein, 9 aa, Homo Sapiens
NLPNHLPKA

SEQ ID NO: 726663 - protein, 9 aa, Homo Sapiens
WSLWKAPIG

SEQ ID NO: 726664 - protein, 9 aa, Homo Sapiens
EGQRYKMDD

SEQ ID NO: 726665 - protein, 9 aa, Homo Sapiens
CLGLLQLGP

SEQ ID NO: 726666 - protein, 9 aa, Homo Sapiens
RHKRRHTKK

SEQ ID NO: 726667 - protein, 9 aa, Homo Sapiens
YTYVLTNTR

SEQ ID NO: 726668 - protein, 9 aa, Homo Sapiens
SSTRITGKL

SEQ ID NO: 726669 - protein, 9 aa, Homo Sapiens
RPRPYDRPG

SEQ ID NO: 726670 - protein, 9 aa, Homo Sapiens
NAKLPPQER

SEQ ID NO: 726671 - protein, 9 aa, Homo Sapiens
NIGIQGNFE

SEQ ID NO: 726672 - protein, 9 aa, Homo Sapiens
RMEGNMPNG

SEQ ID NO: 726673 - protein, 9 aa, Homo Sapiens
RAAVVISTL

SEQ ID NO: 726674 - protein, 9 aa, Homo Sapiens
NEVLRNCGS

SEQ ID NO: 726675 - protein, 9 aa, Homo Sapiens
NEQMFITEE

SEQ ID NO: 726676 - protein, 9 aa, Homo Sapiens
KGLKLQELW

SEQ ID NO: 726677 - protein, 9 aa, Homo Sapiens
CAENRKEIE

SEQ ID NO: 726678 - protein, 9 aa, Homo Sapiens
EEDLELARG

SEQ ID NO: 726679 - protein, 9 aa, Homo Sapiens
SAPASSPTW

SEQ ID NO: 726680 - protein, 9 aa, Homo Sapiens
RLPAPHVQA

SEQ ID NO: 726681 - protein, 9 aa, Homo Sapiens
LNALVQRSS

SEQ ID NO: 726682 - protein, 9 aa, Homo Sapiens
MGVMNRRPI

SEQ ID NO: 726683 - protein, 9 aa, Homo Sapiens
LLRFVIELL

SEQ ID NO: 726684 - protein, 9 aa, Homo Sapiens
PGRGAADPP

SEQ ID NO: 726685 - protein, 9 aa, Homo Sapiens
QHFLPLTCR

SEQ ID NO: 726686 - protein, 9 aa, Homo Sapiens
DTTVTMMQV

SEQ ID NO: 726687 - protein, 9 aa, Homo Sapiens
SGILINTFN

SEQ ID NO: 726688 - protein, 9 aa, Homo Sapiens
DLYRSSYLY

SEQ ID NO: 726689 - protein, 9 aa, Homo Sapiens
NLSIFDPAP

SEQ ID NO: 726690 - protein, 9 aa, Homo Sapiens
PLPASHPLF

SEQ ID NO: 726691 - protein, 9 aa, Homo Sapiens
KQTFIKDDY

SEQ ID NO: 726692 - protein, 9 aa, Homo Sapiens
EGFRPFAKF

SEQ ID NO: 726693 - protein, 9 aa, Homo Sapiens
GVMNRRPIL

SEQ ID NO: 726694 - protein, 9 aa, Homo Sapiens
DCRRLFSKE

SEQ ID NO: 726695 - protein, 9 aa, Homo Sapiens
RGSGSGSGS

SEQ ID NO: 726696 - protein, 9 aa, Homo Sapiens
FDRFSGDDV

SEQ ID NO: 726697 - protein, 9 aa, Homo Sapiens
MSVQRPRPY

SEQ ID NO: 726698 - protein, 9 aa, Homo Sapiens
SVPSYSGGK

SEQ ID NO: 726699 - protein, 9 aa, Homo Sapiens
QEESQIDVL

SEQ ID NO: 726700 - protein, 9 aa, Homo Sapiens
RPGRLLYMA

SEQ ID NO: 726701 - protein, 9 aa, Homo Sapiens
GSDSWNNND

SEQ ID NO: 726702 - protein, 9 aa, Homo Sapiens
GEGAELGLG

SEQ ID NO: 726703 - protein, 9 aa, Homo Sapiens
LGPAAQVMA

SEQ ID NO: 726704 - protein, 9 aa, Homo Sapiens
GEGWGDHCE

SEQ ID NO: 726705 - protein, 9 aa, Homo Sapiens
NLASLAGIF

SEQ ID NO: 726706 - protein, 9 aa, Homo Sapiens
FTFTKLNRN

SEQ ID NO: 726707 - protein, 9 aa, Homo Sapiens
GAKNLQSLG

SEQ ID NO: 726708 - protein, 9 aa, Homo Sapiens
INRRELLQR

SEQ ID NO: 726709 - protein, 9 aa, Homo Sapiens
IFTGGVSRG

SEQ ID NO: 726710 - protein, 9 aa, Homo Sapiens
SLQDASRWD

SEQ ID NO: 726711 - protein, 9 aa, Homo Sapiens
ALCAIASLW

SEQ ID NO: 726712 - protein, 9 aa, Homo Sapiens
NKTFPERFL

SEQ ID NO: 726713 - protein, 9 aa, Homo Sapiens
PGRPLSCSV

SEQ ID NO: 726714 - protein, 9 aa, Homo Sapiens
WCQKRLNWV

SEQ ID NO: 726715 - protein, 9 aa, Homo Sapiens
VSVLLALRL

SEQ ID NO: 726716 - protein, 9 aa, Homo Sapiens
EAVQALLER

SEQ ID NO: 726717 - protein, 9 aa, Homo Sapiens
SQYSQLGQN

SEQ ID NO: 726718 - protein, 9 aa, Homo Sapiens
FKETELKRV

SEQ ID NO: 726719 - protein, 9 aa, Homo Sapiens
GSSPSQSRM

SEQ ID NO: 726720 - protein, 9 aa, Homo Sapiens
NIIAILESS

SEQ ID NO: 726721 - protein, 9 aa, Homo Sapiens
WKEGVAKMD

SEQ ID NO: 726722 - protein, 9 aa, Homo Sapiens
LLSLYRGFT

SEQ ID NO: 726723 - protein, 9 aa, Homo Sapiens
LTRQKMQQL

SEQ ID NO: 726724 - protein, 9 aa, Homo Sapiens
EDYSIQSTK

SEQ ID NO: 726725 - protein, 9 aa, Homo Sapiens
SWPRPAPCC

SEQ ID NO: 726726 - protein, 9 aa, Homo Sapiens
HYVAICNTL

SEQ ID NO: 726727 - protein, 9 aa, Homo Sapiens
AVQALLERL

SEQ ID NO: 726728 - protein, 9 aa, Homo Sapiens
PPPPISGGG

SEQ ID NO: 726729 - protein, 9 aa, Homo Sapiens
QLFLYLGSG

SEQ ID NO: 726730 - protein, 9 aa, Homo Sapiens
GVPILPRNV

SEQ ID NO: 726731 - protein, 9 aa, Homo Sapiens
IVADDDRLN

SEQ ID NO: 726732 - protein, 9 aa, Homo Sapiens
MLFPSWTTW

SEQ ID NO: 726733 - protein, 9 aa, Homo Sapiens
QSRVMKENL

SEQ ID NO: 726734 - protein, 9 aa, Homo Sapiens
TAALGLPQA

SEQ ID NO: 726735 - protein, 9 aa, Homo Sapiens
LQTETIQDG

SEQ ID NO: 726736 - protein, 9 aa, Homo Sapiens
LDSNSYDKT

SEQ ID NO: 726737 - protein, 9 aa, Homo Sapiens
ASLAGIFCF

SEQ ID NO: 726738 - protein, 9 aa, Homo Sapiens
NSSCSISCY

SEQ ID NO: 726739 - protein, 9 aa, Homo Sapiens
KPYGLIVLG

SEQ ID NO: 726740 - protein, 9 aa, Homo Sapiens
TQGTTISAY

SEQ ID NO: 726741 - protein, 9 aa, Homo Sapiens
ELGDWALYL

SEQ ID NO: 726742 - protein, 9 aa, Homo Sapiens
TGGRGTMLK

SEQ ID NO: 726743 - protein, 9 aa, Homo Sapiens
QIHRVQQLV

SEQ ID NO: 726744 - protein, 9 aa, Homo Sapiens
FTARTCQVD

SEQ ID NO: 726745 - protein, 9 aa, Homo Sapiens
LLDLLPKDE

SEQ ID NO: 726746 - protein, 9 aa, Homo Sapiens
MSNQVQRSV

SEQ ID NO: 726747 - protein, 9 aa, Homo Sapiens
VAHISVNFS

SEQ ID NO: 726748 - protein, 9 aa, Homo Sapiens
GGLVTGSLT

SEQ ID NO: 726749 - protein, 9 aa, Homo Sapiens
RLRCPEALF

SEQ ID NO: 726750 - protein, 9 aa, Homo Sapiens
FMASGEHVT

SEQ ID NO: 726751 - protein, 9 aa, Homo Sapiens
PSPSSSYAG

SEQ ID NO: 726752 - protein, 9 aa, Homo Sapiens
RGQPANIRQ

SEQ ID NO: 726753 - protein, 9 aa, Homo Sapiens
SAVTPLLFN

SEQ ID NO: 726754 - protein, 9 aa, Homo Sapiens
GSEIIIEGK

SEQ ID NO: 726755 - protein, 9 aa, Homo Sapiens
RPCKCSECG

SEQ ID NO: 726756 - protein, 9 aa, Homo Sapiens
DHVSVHRSQ

SEQ ID NO: 726757 - protein, 9 aa, Homo Sapiens
LTDFCFSTL

SEQ ID NO: 726758 - protein, 9 aa, Homo Sapiens
SREEVRQRL

SEQ ID NO: 726759 - protein, 9 aa, Homo Sapiens
RLPEKGSSS

SEQ ID NO: 726760 - protein, 9 aa, Homo Sapiens
YAAAPGPAL

SEQ ID NO: 726761 - protein, 9 aa, Homo Sapiens
SFFISLIQE

SEQ ID NO: 726762 - protein, 9 aa, Homo Sapiens
GLLLTASLP

SEQ ID NO: 726763 - protein, 9 aa, Homo Sapiens
QDASRWDPA

SEQ ID NO: 726764 - protein, 9 aa, Homo Sapiens
YSKAVNRLL

SEQ ID NO: 726765 - protein, 9 aa, Homo Sapiens
KKTFALYRN

SEQ ID NO: 726766 - protein, 9 aa, Homo Sapiens
RVHQKLAIE

SEQ ID NO: 726767 - protein, 9 aa, Homo Sapiens
LLGSKQKVS

SEQ ID NO: 726768 - protein, 9 aa, Homo Sapiens
MPAAPVTDH

SEQ ID NO: 726769 - protein, 9 aa, Homo Sapiens
REEPMEVEE

SEQ ID NO: 726770 - protein, 9 aa, Homo Sapiens
SEISLSCKK

SEQ ID NO: 726771 - protein, 9 aa, Homo Sapiens
LPPKIDTTV

SEQ ID NO: 726772 - protein, 9 aa, Homo Sapiens
GEYTIVIRN

SEQ ID NO: 726773 - protein, 9 aa, Homo Sapiens
VADICKKCK

SEQ ID NO: 726774 - protein, 9 aa, Homo Sapiens
GAGKGRTPI

SEQ ID NO: 726775 - protein, 9 aa, Homo Sapiens
APPRPPACT

SEQ ID NO: 726776 - protein, 9 aa, Homo Sapiens
TGNTAKPTG

SEQ ID NO: 726777 - protein, 9 aa, Homo Sapiens
IKSSPCELQ

SEQ ID NO: 726778 - protein, 9 aa, Homo Sapiens
ANPLEPLPP

SEQ ID NO: 726779 - protein, 9 aa, Homo Sapiens
LMPRYEELP

SEQ ID NO: 726780 - protein, 9 aa, Homo Sapiens
SPRDGSGLM

SEQ ID NO: 726781 - protein, 9 aa, Homo Sapiens
IPLSKQKEP

SEQ ID NO: 726782 - protein, 9 aa, Homo Sapiens
TINAETVLV

SEQ ID NO: 726783 - protein, 9 aa, Homo Sapiens
PSTTSRLLA

SEQ ID NO: 726784 - protein, 9 aa, Homo Sapiens
PVQQTACAP

SEQ ID NO: 726785 - protein, 9 aa, Homo Sapiens
GYYDIRLVA

SEQ ID NO: 726786 - protein, 9 aa, Homo Sapiens
KLVTVEKQE

SEQ ID NO: 726787 - protein, 9 aa, Homo Sapiens
LSVLNVHGA

SEQ ID NO: 726788 - protein, 9 aa, Homo Sapiens
SQNKMWYPN

SEQ ID NO: 726789 - protein, 9 aa, Homo Sapiens
RLLYGCDSE

SEQ ID NO: 726790 - protein, 9 aa, Homo Sapiens
RCYALPTEG

SEQ ID NO: 726791 - protein, 9 aa, Homo Sapiens
GLTLSKEIQ

SEQ ID NO: 726792 - protein, 9 aa, Homo Sapiens
GGYEVFARE

SEQ ID NO: 726793 - protein, 9 aa, Homo Sapiens
LLDHGAQIQ

SEQ ID NO: 726794 - protein, 9 aa, Homo Sapiens
LTLPLWSWS

SEQ ID NO: 726795 - protein, 9 aa, Homo Sapiens
ITVGDIGAI

SEQ ID NO: 726796 - protein, 9 aa, Homo Sapiens
SFINPREIP

SEQ ID NO: 726797 - protein, 9 aa, Homo Sapiens
SAINLDSNS

SEQ ID NO: 726798 - protein, 9 aa, Homo Sapiens
PRRPRKAPD

SEQ ID NO: 726799 - protein, 9 aa, Homo Sapiens
ETQPNGREK

SEQ ID NO: 726800 - protein, 9 aa, Homo Sapiens
GLSEPYVKI

SEQ ID NO: 726801 - protein, 9 aa, Homo Sapiens
VYDRVAKLI

SEQ ID NO: 726802 - protein, 9 aa, Homo Sapiens
MIWDSMFCP

SEQ ID NO: 726803 - protein, 9 aa, Homo Sapiens
ICAALPGCD

SEQ ID NO: 726804 - protein, 9 aa, Homo Sapiens
DRHSSPGTK

SEQ ID NO: 726805 - protein, 9 aa, Homo Sapiens
RSRTLGPRA

SEQ ID NO: 726806 - protein, 9 aa, Homo Sapiens
GMGVWVHQG

SEQ ID NO: 726807 - protein, 9 aa, Homo Sapiens
SNRLRSRTL

SEQ ID NO: 726808 - protein, 9 aa, Homo Sapiens
TALLLCGAT

SEQ ID NO: 726809 - protein, 9 aa, Homo Sapiens
WKATHPTSS

SEQ ID NO: 726810 - protein, 9 aa, Homo Sapiens
YAPYAAAPG

SEQ ID NO: 726811 - protein, 9 aa, Homo Sapiens
TCARNVTPN

SEQ ID NO: 726812 - protein, 9 aa, Homo Sapiens
QYQQRKRQQ

SEQ ID NO: 726813 - protein, 9 aa, Homo Sapiens
QLGTWGALW

SEQ ID NO: 726814 - protein, 9 aa, Homo Sapiens
TMGFLEKAL

SEQ ID NO: 726815 - protein, 9 aa, Homo Sapiens
VVTMETFTN

SEQ ID NO: 726816 - protein, 9 aa, Homo Sapiens
LSEPYVKIH

SEQ ID NO: 726817 - protein, 9 aa, Homo Sapiens
EPIPVAHIS

SEQ ID NO: 726818 - protein, 9 aa, Homo Sapiens
YFFQCRRDF

SEQ ID NO: 726819 - protein, 9 aa, Homo Sapiens
RSELKCSPQ

SEQ ID NO: 726820 - protein, 9 aa, Homo Sapiens
VSSAEAQDN

SEQ ID NO: 726821 - protein, 9 aa, Homo Sapiens
RTRGCVSEH

SEQ ID NO: 726822 - protein, 9 aa, Homo Sapiens
SGLFRQVRC

SEQ ID NO: 726823 - protein, 9 aa, Homo Sapiens
YTILSNRTV

SEQ ID NO: 726824 - protein, 9 aa, Homo Sapiens
DAKLSMQFF

SEQ ID NO: 726825 - protein, 9 aa, Homo Sapiens
ENRELMESF

SEQ ID NO: 726826 - protein, 9 aa, Homo Sapiens
RYTYVLTNT

SEQ ID NO: 726827 - protein, 9 aa, Homo Sapiens
VRHRPEASP

SEQ ID NO: 726828 - protein, 9 aa, Homo Sapiens
LNEIKVYVT

SEQ ID NO: 726829 - protein, 9 aa, Homo Sapiens
TMLRPPPGG

SEQ ID NO: 726830 - protein, 9 aa, Homo Sapiens
DPFVIPNLP

SEQ ID NO: 726831 - protein, 9 aa, Homo Sapiens
VQALLERLG

SEQ ID NO: 726832 - protein, 9 aa, Homo Sapiens
RTRSRQCVF

SEQ ID NO: 726833 - protein, 9 aa, Homo Sapiens
PLGLRLLAC

SEQ ID NO: 726834 - protein, 9 aa, Homo Sapiens
TYQLDYDVG

SEQ ID NO: 726835 - protein, 9 aa, Homo Sapiens
SSLFNETAF

SEQ ID NO: 726836 - protein, 9 aa, Homo Sapiens
LMGLTLSKE

SEQ ID NO: 726837 - protein, 9 aa, Homo Sapiens
SETKDPHAT

SEQ ID NO: 726838 - protein, 9 aa, Homo Sapiens
QPLDHEELV

SEQ ID NO: 726839 - protein, 9 aa, Homo Sapiens
SALPLYSLC

SEQ ID NO: 726840 - protein, 9 aa, Homo Sapiens
IGAIFKIRI

SEQ ID NO: 726841 - protein, 9 aa, Homo Sapiens
KESCCLVSS

SEQ ID NO: 726842 - protein, 9 aa, Homo Sapiens
ADHLPPRGD

SEQ ID NO: 726843 - protein, 9 aa, Homo Sapiens
LVSRLLRPT

SEQ ID NO: 726844 - protein, 9 aa, Homo Sapiens
SFLQIPPFR

SEQ ID NO: 726845 - protein, 9 aa, Homo Sapiens
CKVAKVFHI

SEQ ID NO: 726846 - protein, 9 aa, Homo Sapiens
RKILVVHDR

SEQ ID NO: 726847 - protein, 9 aa, Homo Sapiens
EISLSCKKE

SEQ ID NO: 726848 - protein, 9 aa, Homo Sapiens
KCYVWRMCD

SEQ ID NO: 726849 - protein, 9 aa, Homo Sapiens
VTFHSYSQM

SEQ ID NO: 726850 - protein, 9 aa, Homo Sapiens
QVMNLNKRE

SEQ ID NO: 726851 - protein, 9 aa, Homo Sapiens
QQLVTIKKA

SEQ ID NO: 726852 - protein, 9 aa, Homo Sapiens
YRGFTSQKS

SEQ ID NO: 726853 - protein, 9 aa, Homo Sapiens
PEKGSSSRA

SEQ ID NO: 726854 - protein, 9 aa, Homo Sapiens
SSGSRWRVS

SEQ ID NO: 726855 - protein, 9 aa, Homo Sapiens
ALDAKLSMQ

SEQ ID NO: 726856 - protein, 9 aa, Homo Sapiens
KRYSEKVPI

SEQ ID NO: 726857 - protein, 9 aa, Homo Sapiens
FRDSYPGCQ

SEQ ID NO: 726858 - protein, 9 aa, Homo Sapiens
LLAHTGRLV

SEQ ID NO: 726859 - protein, 9 aa, Homo Sapiens
RHKAFYTCG

SEQ ID NO: 726860 - protein, 9 aa, Homo Sapiens
KQKVSMDLR

SEQ ID NO: 726861 - protein, 9 aa, Homo Sapiens
NPYVLSYKD

SEQ ID NO: 726862 - protein, 9 aa, Homo Sapiens
NLCKGLSQT

SEQ ID NO: 726863 - protein, 9 aa, Homo Sapiens
QCVFTMPTL

SEQ ID NO: 726864 - protein, 9 aa, Homo Sapiens
VMAYDLYAA

SEQ ID NO: 726865 - protein, 9 aa, Homo Sapiens
NECGKIFRH

SEQ ID NO: 726866 - protein, 9 aa, Homo Sapiens
EAMATEELS

SEQ ID NO: 726867 - protein, 9 aa, Homo Sapiens
SCSSFCPTT

SEQ ID NO: 726868 - protein, 9 aa, Homo Sapiens
SPPRDVAIL

SEQ ID NO: 726869 - protein, 9 aa, Homo Sapiens
LASLAGIFC

SEQ ID NO: 726870 - protein, 9 aa, Homo Sapiens
SWAHNGRTY

SEQ ID NO: 726871 - protein, 9 aa, Homo Sapiens
DVFTISKEL

SEQ ID NO: 726872 - protein, 9 aa, Homo Sapiens
WQTKLSIAG

SEQ ID NO: 726873 - protein, 9 aa, Homo Sapiens
VHKECVIKK

SEQ ID NO: 726874 - protein, 9 aa, Homo Sapiens
REGFQRCDV

SEQ ID NO: 726875 - protein, 9 aa, Homo Sapiens
HSGALGNFS

SEQ ID NO: 726876 - protein, 9 aa, Homo Sapiens
INPREIPRG

SEQ ID NO: 726877 - protein, 9 aa, Homo Sapiens
EVSTLKDRL

SEQ ID NO: 726878 - protein, 9 aa, Homo Sapiens
FGVYEAIML

SEQ ID NO: 726879 - protein, 9 aa, Homo Sapiens
KRQQQEGNY

SEQ ID NO: 726880 - protein, 9 aa, Homo Sapiens
LQDASRWDP

SEQ ID NO: 726881 - protein, 9 aa, Homo Sapiens
WKGRQEDRL

SEQ ID NO: 726882 - protein, 9 aa, Homo Sapiens
DCGRALARR

SEQ ID NO: 726883 - protein, 9 aa, Homo Sapiens
LGNGHVFHL

SEQ ID NO: 726884 - protein, 9 aa, Homo Sapiens
FQENEDTPK

SEQ ID NO: 726885 - protein, 9 aa, Homo Sapiens
PRYEELPES

SEQ ID NO: 726886 - protein, 9 aa, Homo Sapiens
ANIMVLNIL

SEQ ID NO: 726887 - protein, 9 aa, Homo Sapiens
VAALGQDCY

SEQ ID NO: 726888 - protein, 9 aa, Homo Sapiens
ATGKLDSAD

SEQ ID NO: 726889 - protein, 9 aa, Homo Sapiens
LVAFLDDGF

SEQ ID NO: 726890 - protein, 9 aa, Homo Sapiens
SYIRDHLNS

SEQ ID NO: 726891 - protein, 9 aa, Homo Sapiens
MQSPPSPLC

SEQ ID NO: 726892 - protein, 9 aa, Homo Sapiens
FYTCGSHLA

SEQ ID NO: 726893 - protein, 9 aa, Homo Sapiens
PHDAPGPPG

SEQ ID NO: 726894 - protein, 9 aa, Homo Sapiens
FLWCQERSL

SEQ ID NO: 726895 - protein, 9 aa, Homo Sapiens
VHVSLHGLC

SEQ ID NO: 726896 - protein, 9 aa, Homo Sapiens
GQVRVRERA

SEQ ID NO: 726897 - protein, 9 aa, Homo Sapiens
VYNTSIKPL

SEQ ID NO: 726898 - protein, 9 aa, Homo Sapiens
RKKSYLTCS

SEQ ID NO: 726899 - protein, 9 aa, Homo Sapiens
CHCFPCCMG

SEQ ID NO: 726900 - protein, 9 aa, Homo Sapiens
ADPNSVSDK

SEQ ID NO: 726901 - protein, 9 aa, Homo Sapiens
PIPVAHISV

SEQ ID NO: 726902 - protein, 9 aa, Homo Sapiens
DHSGSDSWN

SEQ ID NO: 726903 - protein, 9 aa, Homo Sapiens
WHCRVGQCV

SEQ ID NO: 726904 - protein, 9 aa, Homo Sapiens
QQSQCLRNL

SEQ ID NO: 726905 - protein, 9 aa, Homo Sapiens
ILVVHDRNK

SEQ ID NO: 726906 - protein, 9 aa, Homo Sapiens
VPRLPEKGS

SEQ ID NO: 726907 - protein, 9 aa, Homo Sapiens
TSSTRITGK

SEQ ID NO: 726908 - protein, 9 aa, Homo Sapiens
VTQIIALCH

SEQ ID NO: 726909 - protein, 9 aa, Homo Sapiens
HFQENEDTP

SEQ ID NO: 726910 - protein, 9 aa, Homo Sapiens
SEVLCRLLG

SEQ ID NO: 726911 - protein, 9 aa, Homo Sapiens
FSSYYQHSS

SEQ ID NO: 726912 - protein, 9 aa, Homo Sapiens
MAYDLYAAV

SEQ ID NO: 726913 - protein, 9 aa, Homo Sapiens
CGAKNLQSL

SEQ ID NO: 726914 - protein, 9 aa, Homo Sapiens
WPLQPMCPS

SEQ ID NO: 726915 - protein, 9 aa, Homo Sapiens
VTVSTIIDK

SEQ ID NO: 726916 - protein, 9 aa, Homo Sapiens
LRNCGSPAF

SEQ ID NO: 726917 - protein, 9 aa, Homo Sapiens
PPPGGDTTS

SEQ ID NO: 726918 - protein, 9 aa, Homo Sapiens
LLVPNTING

SEQ ID NO: 726919 - protein, 9 aa, Homo Sapiens
GPYLSTEND

SEQ ID NO: 726920 - protein, 9 aa, Homo Sapiens
SQLRSTEIA

SEQ ID NO: 726921 - protein, 9 aa, Homo Sapiens
FSILYTVPD

SEQ ID NO: 726922 - protein, 9 aa, Homo Sapiens
NIRHSFWKG

SEQ ID NO: 726923 - protein, 9 aa, Homo Sapiens
VRAASGLAE

SEQ ID NO: 726924 - protein, 9 aa, Homo Sapiens
LSQTTTNLV

SEQ ID NO: 726925 - protein, 9 aa, Homo Sapiens
LACTGTWVY

SEQ ID NO: 726926 - protein, 9 aa, Homo Sapiens
SLHGLCVSP

SEQ ID NO: 726927 - protein, 9 aa, Homo Sapiens
SEPYVKIHL

SEQ ID NO: 726928 - protein, 9 aa, Homo Sapiens
LLYTALRCY

SEQ ID NO: 726929 - protein, 9 aa, Homo Sapiens
SKQKVSMDL

SEQ ID NO: 726930 - protein, 9 aa, Homo Sapiens
AANTSCVLP

SEQ ID NO: 726931 - protein, 9 aa, Homo Sapiens
TCANCNHGF

SEQ ID NO: 726932 - protein, 9 aa, Homo Sapiens
PVGGLVTGS

SEQ ID NO: 726933 - protein, 9 aa, Homo Sapiens
KTWYGVPLL

SEQ ID NO: 726934 - protein, 9 aa, Homo Sapiens
PPVQQTACA

SEQ ID NO: 726935 - protein, 9 aa, Homo Sapiens
EEVRQRLSD

SEQ ID NO: 726936 - protein, 9 aa, Homo Sapiens
SSRHDCYLL

SEQ ID NO: 726937 - protein, 9 aa, Homo Sapiens
DMQEESQID

SEQ ID NO: 726938 - protein, 9 aa, Homo Sapiens
KSDANSFLI

SEQ ID NO: 726939 - protein, 9 aa, Homo Sapiens
QVELIHCVL

SEQ ID NO: 726940 - protein, 9 aa, Homo Sapiens
GCPTFFRVC

SEQ ID NO: 726941 - protein, 9 aa, Homo Sapiens
PPGCQGQDL

SEQ ID NO: 726942 - protein, 9 aa, Homo Sapiens
VFLACLLPC

SEQ ID NO: 726943 - protein, 9 aa, Homo Sapiens
ANSFLILFR

SEQ ID NO: 726944 - protein, 9 aa, Homo Sapiens
IHRVQQLVT

SEQ ID NO: 726945 - protein, 9 aa, Homo Sapiens
SRVMKENLS

SEQ ID NO: 726946 - protein, 9 aa, Homo Sapiens
TPYLFCYVQ

SEQ ID NO: 726947 - protein, 9 aa, Homo Sapiens
RRCITQIFF

SEQ ID NO: 726948 - protein, 9 aa, Homo Sapiens
LAKGSPQGS

SEQ ID NO: 726949 - protein, 9 aa, Homo Sapiens
GQGLRQPHN

SEQ ID NO: 726950 - protein, 9 aa, Homo Sapiens
IDFLLQVCS

SEQ ID NO: 726951 - protein, 9 aa, Homo Sapiens
PPPPPISGG

SEQ ID NO: 726952 - protein, 9 aa, Homo Sapiens
MGFSTNKNR

SEQ ID NO: 726953 - protein, 9 aa, Homo Sapiens
RPYDRPGTA

SEQ ID NO: 726954 - protein, 9 aa, Homo Sapiens
SYATGSSEE

SEQ ID NO: 726955 - protein, 9 aa, Homo Sapiens
REMAPFLWC

SEQ ID NO: 726956 - protein, 9 aa, Homo Sapiens
AMPWAPLFC

SEQ ID NO: 726957 - protein, 9 aa, Homo Sapiens
CRMLKKSRL

SEQ ID NO: 726958 - protein, 9 aa, Homo Sapiens
DGAFLTVCD

SEQ ID NO: 726959 - protein, 9 aa, Homo Sapiens
DPSPSGVPL

SEQ ID NO: 726960 - protein, 9 aa, Homo Sapiens
VKVYDEWKE

SEQ ID NO: 726961 - protein, 9 aa, Homo Sapiens
EGGSIKQYD

SEQ ID NO: 726962 - protein, 9 aa, Homo Sapiens
ASLPNFWNP

SEQ ID NO: 726963 - protein, 9 aa, Homo Sapiens
RYENVEFGS

SEQ ID NO: 726964 - protein, 9 aa, Homo Sapiens
FTGYVDDRG

SEQ ID NO: 726965 - protein, 9 aa, Homo Sapiens
TYEERDACV

SEQ ID NO: 726966 - protein, 9 aa, Homo Sapiens
TTPAVYDRV

SEQ ID NO: 726967 - protein, 9 aa, Homo Sapiens
LTVCDASKV

SEQ ID NO: 726968 - protein, 9 aa, Homo Sapiens
NGSEIIIEG

SEQ ID NO: 726969 - protein, 9 aa, Homo Sapiens
PLPRPLSPP

SEQ ID NO: 726970 - protein, 9 aa, Homo Sapiens
GTALLLCGA

SEQ ID NO: 726971 - protein, 9 aa, Homo Sapiens
ACASEVLSG

SEQ ID NO: 726972 - protein, 9 aa, Homo Sapiens
SSIPPEKDS

SEQ ID NO: 726973 - protein, 9 aa, Homo Sapiens
PGLAVQSGT

SEQ ID NO: 726974 - protein, 9 aa, Homo Sapiens
RYPLPLICR

SEQ ID NO: 726975 - protein, 9 aa, Homo Sapiens
PMPAAPVTD

SEQ ID NO: 726976 - protein, 9 aa, Homo Sapiens
MLSQVSEVP

SEQ ID NO: 726977 - protein, 9 aa, Homo Sapiens
NEQGSYVVT

SEQ ID NO: 726978 - protein, 9 aa, Homo Sapiens
SLRPPPPPI

SEQ ID NO: 726979 - protein, 9 aa, Homo Sapiens
FDLLDWPPC

SEQ ID NO: 726980 - protein, 9 aa, Homo Sapiens
PNTSIMENP

SEQ ID NO: 726981 - protein, 9 aa, Homo Sapiens
PATASNHRL

SEQ ID NO: 726982 - protein, 9 aa, Homo Sapiens
CTKVLTSFK

SEQ ID NO: 726983 - protein, 9 aa, Homo Sapiens
PLQAPLCTS

SEQ ID NO: 726984 - protein, 9 aa, Homo Sapiens
ENAKAAKLE

SEQ ID NO: 726985 - protein, 9 aa, Homo Sapiens
QRKRQQQEG

SEQ ID NO: 726986 - protein, 9 aa, Homo Sapiens
KMAECAHFR

SEQ ID NO: 726987 - protein, 9 aa, Homo Sapiens
RSRASSVGR

SEQ ID NO: 726988 - protein, 9 aa, Homo Sapiens
FKEVHKECV

SEQ ID NO: 726989 - protein, 9 aa, Homo Sapiens
NLWVTSFFM

SEQ ID NO: 726990 - protein, 9 aa, Homo Sapiens
IFMRNHEII

SEQ ID NO: 726991 - protein, 9 aa, Homo Sapiens
KLKTPPPGC

SEQ ID NO: 726992 - protein, 9 aa, Homo Sapiens
KGSSSRAED

SEQ ID NO: 726993 - protein, 9 aa, Homo Sapiens
MESFDSALQ

SEQ ID NO: 726994 - protein, 9 aa, Homo Sapiens
GETVINNAN

SEQ ID NO: 726995 - protein, 9 aa, Homo Sapiens
KLQTRQWPP

SEQ ID NO: 726996 - protein, 9 aa, Homo Sapiens
DLCPLCLQG

SEQ ID NO: 726997 - protein, 9 aa, Homo Sapiens
DCYLLREQY

SEQ ID NO: 726998 - protein, 9 aa, Homo Sapiens
KCKERGKAF

SEQ ID NO: 726999 - protein, 9 aa, Homo Sapiens
KADEKNDED

SEQ ID NO: 727000 - protein, 9 aa, Homo Sapiens
YVVSHEIGQ

SEQ ID NO: 727001 - protein, 9 aa, Homo Sapiens
KHFCKPLVE

SEQ ID NO: 727002 - protein, 9 aa, Homo Sapiens
GDTTSRYPL

SEQ ID NO: 727003 - protein, 9 aa, Homo Sapiens
VWSLWKAPI

SEQ ID NO: 727004 - protein, 9 aa, Homo Sapiens
PELTHRLFS

SEQ ID NO: 727005 - protein, 9 aa, Homo Sapiens
LFLRKVDQK

SEQ ID NO: 727006 - protein, 9 aa, Homo Sapiens
ARLGAVSSA

SEQ ID NO: 727007 - protein, 9 aa, Homo Sapiens
PSLDVLHRH

SEQ ID NO: 727008 - protein, 9 aa, Homo Sapiens
ARRLYHREG

SEQ ID NO: 727009 - protein, 9 aa, Homo Sapiens
ELAEIFMAS

SEQ ID NO: 727010 - protein, 9 aa, Homo Sapiens
KKNAAVIDQ

SEQ ID NO: 727011 - protein, 9 aa, Homo Sapiens
QMKLKACTP

SEQ ID NO: 727012 - protein, 9 aa, Homo Sapiens
SASASNPYC

SEQ ID NO: 727013 - protein, 9 aa, Homo Sapiens
QTLTSTLEL

SEQ ID NO: 727014 - protein, 9 aa, Homo Sapiens
PPLANYMLY

SEQ ID NO: 727015 - protein, 9 aa, Homo Sapiens
IDQEPAGDR

SEQ ID NO: 727016 - protein, 9 aa, Homo Sapiens
CDFLHVPET

SEQ ID NO: 727017 - protein, 9 aa, Homo Sapiens
NNWSNNVRA

SEQ ID NO: 727018 - protein, 9 aa, Homo Sapiens
DLACQKRPY

SEQ ID NO: 727019 - protein, 9 aa, Homo Sapiens
LVGEGAELG

SEQ ID NO: 727020 - protein, 9 aa, Homo Sapiens
EIQTTQPEA

SEQ ID NO: 727021 - protein, 9 aa, Homo Sapiens
KAISFRRCI

SEQ ID NO: 727022 - protein, 9 aa, Homo Sapiens
QLAPWPGLP

SEQ ID NO: 727023 - protein, 9 aa, Homo Sapiens
GYQDLASRQ

SEQ ID NO: 727024 - protein, 9 aa, Homo Sapiens
NSVAAEPWL

SEQ ID NO: 727025 - protein, 9 aa, Homo Sapiens
GSYSGAEVR

SEQ ID NO: 727026 - protein, 9 aa, Homo Sapiens
NREAVLVAF

SEQ ID NO: 727027 - protein, 9 aa, Homo Sapiens
PKTWYGVPL

SEQ ID NO: 727028 - protein, 9 aa, Homo Sapiens
IFCFDLSII

SEQ ID NO: 727029 - protein, 9 aa, Homo Sapiens
CKIWMHVDA

SEQ ID NO: 727030 - protein, 9 aa, Homo Sapiens
VTGSLTGIG

SEQ ID NO: 727031 - protein, 9 aa, Homo Sapiens
LVASLPPST

SEQ ID NO: 727032 - protein, 9 aa, Homo Sapiens
YPCPHCGKA

SEQ ID NO: 727033 - protein, 9 aa, Homo Sapiens
GIQGNFEKH

SEQ ID NO: 727034 - protein, 9 aa, Homo Sapiens
FPYAPYAAA

SEQ ID NO: 727035 - protein, 9 aa, Homo Sapiens
NEIKVYVTF

SEQ ID NO: 727036 - protein, 9 aa, Homo Sapiens
LYSKRFLDF

SEQ ID NO: 727037 - protein, 9 aa, Homo Sapiens
ECDLGGSYS

SEQ ID NO: 727038 - protein, 9 aa, Homo Sapiens
GAQIQAKTK

SEQ ID NO: 727039 - protein, 9 aa, Homo Sapiens
EPLPELCNK

SEQ ID NO: 727040 - protein, 9 aa, Homo Sapiens
LIPSSASAA

SEQ ID NO: 727041 - protein, 9 aa, Homo Sapiens
KYKYEVCKD

SEQ ID NO: 727042 - protein, 9 aa, Homo Sapiens
RSRQCVFTM

SEQ ID NO: 727043 - protein, 9 aa, Homo Sapiens
SAIDLLQWS

SEQ ID NO: 727044 - protein, 9 aa, Homo Sapiens
PESGLSDEK

SEQ ID NO: 727045 - protein, 9 aa, Homo Sapiens
SLLLLMCRQ

SEQ ID NO: 727046 - protein, 9 aa, Homo Sapiens
QFKMTWTSP

SEQ ID NO: 727047 - protein, 9 aa, Homo Sapiens
ERDACVQAI

SEQ ID NO: 727048 - protein, 9 aa, Homo Sapiens
YRAFSTFPS

SEQ ID NO: 727049 - protein, 9 aa, Homo Sapiens
DQAANTSCV

SEQ ID NO: 727050 - protein, 9 aa, Homo Sapiens
NEEVSKFYA

SEQ ID NO: 727051 - protein, 9 aa, Homo Sapiens
SVLNVHGAL

SEQ ID NO: 727052 - protein, 9 aa, Homo Sapiens
VRGVRQLIQ

SEQ ID NO: 727053 - protein, 9 aa, Homo Sapiens
QPMCPSWPR

SEQ ID NO: 727054 - protein, 9 aa, Homo Sapiens
QILKKIDPV

SEQ ID NO: 727055 - protein, 9 aa, Homo Sapiens
FCKPLVEVY

SEQ ID NO: 727056 - protein, 9 aa, Homo Sapiens
EISYYFPLK

SEQ ID NO: 727057 - protein, 9 aa, Homo Sapiens
AMQKAKQDM

SEQ ID NO: 727058 - protein, 9 aa, Homo Sapiens
EGGVDGGWS

SEQ ID NO: 727059 - protein, 9 aa, Homo Sapiens
CHTSKKHWD

SEQ ID NO: 727060 - protein, 9 aa, Homo Sapiens
TIDLYRSSY

SEQ ID NO: 727061 - protein, 9 aa, Homo Sapiens
SNMLAFVGE

SEQ ID NO: 727062 - protein, 9 aa, Homo Sapiens
NFFCDPGQL

SEQ ID NO: 727063 - protein, 9 aa, Homo Sapiens
DGPDSNKTR

SEQ ID NO: 727064 - protein, 9 aa, Homo Sapiens
QRLVPGCDV

SEQ ID NO: 727065 - protein, 9 aa, Homo Sapiens
LLLMCRQQS

SEQ ID NO: 727066 - protein, 9 aa, Homo Sapiens
GNFNSMRMD

SEQ ID NO: 727067 - protein, 9 aa, Homo Sapiens
PTASTCLCW

SEQ ID NO: 727068 - protein, 9 aa, Homo Sapiens
LIVHFQENE

SEQ ID NO: 727069 - protein, 9 aa, Homo Sapiens
SAPAPQLGV

SEQ ID NO: 727070 - protein, 9 aa, Homo Sapiens
KITTLALTF

SEQ ID NO: 727071 - protein, 9 aa, Homo Sapiens
KSSGIGTEG

SEQ ID NO: 727072 - protein, 9 aa, Homo Sapiens
TPLWPGSTD

SEQ ID NO: 727073 - protein, 9 aa, Homo Sapiens
TSCSVYGCG

SEQ ID NO: 727074 - protein, 9 aa, Homo Sapiens
ENEYSYRTQ

SEQ ID NO: 727075 - protein, 9 aa, Homo Sapiens
FLCRISGLL

SEQ ID NO: 727076 - protein, 9 aa, Homo Sapiens
QGLGIRPSL

SEQ ID NO: 727077 - protein, 9 aa, Homo Sapiens
PFEHPNLPN

SEQ ID NO: 727078 - protein, 9 aa, Homo Sapiens
RHSLHQPPH

SEQ ID NO: 727079 - protein, 9 aa, Homo Sapiens
IHFLSWFLE

SEQ ID NO: 727080 - protein, 9 aa, Homo Sapiens
CHDVGCHPV

SEQ ID NO: 727081 - protein, 9 aa, Homo Sapiens
SAQEQLRNG

SEQ ID NO: 727082 - protein, 9 aa, Homo Sapiens
YKETTNGRL

SEQ ID NO: 727083 - protein, 9 aa, Homo Sapiens
LGLEDQRFA

SEQ ID NO: 727084 - protein, 9 aa, Homo Sapiens
SIVKVYDEW

SEQ ID NO: 727085 - protein, 9 aa, Homo Sapiens
TFPERFLVS

SEQ ID NO: 727086 - protein, 9 aa, Homo Sapiens
TVPIFASGM

SEQ ID NO: 727087 - protein, 9 aa, Homo Sapiens
FTGGVSRGV

SEQ ID NO: 727088 - protein, 9 aa, Homo Sapiens
LMALSKLSE

SEQ ID NO: 727089 - protein, 9 aa, Homo Sapiens
AVADICKKC

SEQ ID NO: 727090 - protein, 9 aa, Homo Sapiens
TQSPRDGSG

SEQ ID NO: 727091 - protein, 9 aa, Homo Sapiens
GYVDDRGTC

SEQ ID NO: 727092 - protein, 9 aa, Homo Sapiens
GKLDSADIE

SEQ ID NO: 727093 - protein, 9 aa, Homo Sapiens
VAIHYIPKN

SEQ ID NO: 727094 - protein, 9 aa, Homo Sapiens
LLGDPGAPG

SEQ ID NO: 727095 - protein, 9 aa, Homo Sapiens
MEKIKPIVR

SEQ ID NO: 727096 - protein, 9 aa, Homo Sapiens
LVLTIMNGC

SEQ ID NO: 727097 - protein, 9 aa, Homo Sapiens
VSIPNSAVD

SEQ ID NO: 727098 - protein, 9 aa, Homo Sapiens
ELNQNQLVR

SEQ ID NO: 727099 - protein, 9 aa, Homo Sapiens
LSTENDSMK

SEQ ID NO: 727100 - protein, 9 aa, Homo Sapiens
LSDSALIFG

SEQ ID NO: 727101 - protein, 9 aa, Homo Sapiens
GHYILSLGG

SEQ ID NO: 727102 - protein, 9 aa, Homo Sapiens
SYLTCSTHL

SEQ ID NO: 727103 - protein, 9 aa, Homo Sapiens
SRFGLPSVG

SEQ ID NO: 727104 - protein, 9 aa, Homo Sapiens
NRKEIEDWI

SEQ ID NO: 727105 - protein, 9 aa, Homo Sapiens
SYDAKLLFS

SEQ ID NO: 727106 - protein, 9 aa, Homo Sapiens
LPLICRSPT

SEQ ID NO: 727107 - protein, 9 aa, Homo Sapiens
RNLLMPQQR

SEQ ID NO: 727108 - protein, 9 aa, Homo Sapiens
SRDGFNFKE

SEQ ID NO: 727109 - protein, 9 aa, Homo Sapiens
VDGKEYDFP

SEQ ID NO: 727110 - protein, 9 aa, Homo Sapiens
KYADAVNNF

SEQ ID NO: 727111 - protein, 9 aa, Homo Sapiens
TSSSCSCQS

SEQ ID NO: 727112 - protein, 9 aa, Homo Sapiens
KNLQLRKCC

SEQ ID NO: 727113 - protein, 9 aa, Homo Sapiens
PYLFCYVQS

SEQ ID NO: 727114 - protein, 9 aa, Homo Sapiens
CAPDSYETQ

SEQ ID NO: 727115 - protein, 9 aa, Homo Sapiens
PRTDSLLRA

SEQ ID NO: 727116 - protein, 9 aa, Homo Sapiens
STPATSLHP

SEQ ID NO: 727117 - protein, 9 aa, Homo Sapiens
LDSVGIVAD

SEQ ID NO: 727118 - protein, 9 aa, Homo Sapiens
GGAGAFDVC

SEQ ID NO: 727119 - protein, 9 aa, Homo Sapiens
KEPVTKQRC

SEQ ID NO: 727120 - protein, 9 aa, Homo Sapiens
ISTVNPELY

SEQ ID NO: 727121 - protein, 9 aa, Homo Sapiens
SAPPSFKLL

SEQ ID NO: 727122 - protein, 9 aa, Homo Sapiens
IFQVPECGR

SEQ ID NO: 727123 - protein, 9 aa, Homo Sapiens
PPPQPPPLL

SEQ ID NO: 727124 - protein, 9 aa, Homo Sapiens
NMNINSLAI

SEQ ID NO: 727125 - protein, 9 aa, Homo Sapiens
YFRPPPKRT

SEQ ID NO: 727126 - protein, 9 aa, Homo Sapiens
PGGNFAFFK

SEQ ID NO: 727127 - protein, 9 aa, Homo Sapiens
SLPPSTTSR

SEQ ID NO: 727128 - protein, 9 aa, Homo Sapiens
QVGFSQLFL

SEQ ID NO: 727129 - protein, 9 aa, Homo Sapiens
SEDEIAKMN

SEQ ID NO: 727130 - protein, 9 aa, Homo Sapiens
QGSYVVTME

SEQ ID NO: 727131 - protein, 9 aa, Homo Sapiens
LLGLSDVHE

SEQ ID NO: 727132 - protein, 9 aa, Homo Sapiens
VKDGQMMTA

SEQ ID NO: 727133 - protein, 9 aa, Homo Sapiens
PEGDRHSSP

SEQ ID NO: 727134 - protein, 9 aa, Homo Sapiens
YPNGIAQVS

SEQ ID NO: 727135 - protein, 9 aa, Homo Sapiens
CGVGKRIME

SEQ ID NO: 727136 - protein, 9 aa, Homo Sapiens
TETIQDGAD

SEQ ID NO: 727137 - protein, 9 aa, Homo Sapiens
HDVGCHPVL

SEQ ID NO: 727138 - protein, 9 aa, Homo Sapiens
PLYSLCPGE

SEQ ID NO: 727139 - protein, 9 aa, Homo Sapiens
LVCTFKNYY

SEQ ID NO: 727140 - protein, 9 aa, Homo Sapiens
LMDASELLA

SEQ ID NO: 727141 - protein, 9 aa, Homo Sapiens
VDFVLRDQS

SEQ ID NO: 727142 - protein, 9 aa, Homo Sapiens
QMEVTVTVT

SEQ ID NO: 727143 - protein, 9 aa, Homo Sapiens
SSLTSVVQT

SEQ ID NO: 727144 - protein, 9 aa, Homo Sapiens
QALGRHSGA

SEQ ID NO: 727145 - protein, 9 aa, Homo Sapiens
ILHILNMTS

SEQ ID NO: 727146 - protein, 9 aa, Homo Sapiens
ACTNDGRSD

SEQ ID NO: 727147 - protein, 9 aa, Homo Sapiens
VRQRLSDLY

SEQ ID NO: 727148 - protein, 9 aa, Homo Sapiens
RQEDRLYTF

SEQ ID NO: 727149 - protein, 9 aa, Homo Sapiens
FLCDLYPLM

SEQ ID NO: 727150 - protein, 9 aa, Homo Sapiens
PYGDLVTVA

SEQ ID NO: 727151 - protein, 9 aa, Homo Sapiens
DEYKTVPLT

SEQ ID NO: 727152 - protein, 9 aa, Homo Sapiens
PCEPGCPTF

SEQ ID NO: 727153 - protein, 9 aa, Homo Sapiens
DSVDLDNTQ

SEQ ID NO: 727154 - protein, 9 aa, Homo Sapiens
NVIGSFHVT

SEQ ID NO: 727155 - protein, 9 aa, Homo Sapiens
FYSICLFAW

SEQ ID NO: 727156 - protein, 9 aa, Homo Sapiens
SFKEVHKEC

SEQ ID NO: 727157 - protein, 9 aa, Homo Sapiens
QASGDLLEP

SEQ ID NO: 727158 - protein, 9 aa, Homo Sapiens
DSTSLFVLI

SEQ ID NO: 727159 - protein, 9 aa, Homo Sapiens
TVAWLIFFC

SEQ ID NO: 727160 - protein, 9 aa, Homo Sapiens
NHSTSQMSL

SEQ ID NO: 727161 - protein, 9 aa, Homo Sapiens
LFENEYSYR

SEQ ID NO: 727162 - protein, 9 aa, Homo Sapiens
CEEYGKIIT

SEQ ID NO: 727163 - protein, 9 aa, Homo Sapiens
KKYKYEVCK

SEQ ID NO: 727164 - protein, 9 aa, Homo Sapiens
VVLILSVCF

SEQ ID NO: 727165 - protein, 9 aa, Homo Sapiens
LLVVLILSV

SEQ ID NO: 727166 - protein, 9 aa, Homo Sapiens
FQLPEDYSI

SEQ ID NO: 727167 - protein, 9 aa, Homo Sapiens
TTSRLLATA

SEQ ID NO: 727168 - protein, 9 aa, Homo Sapiens
SPAMAGPHY

SEQ ID NO: 727169 - protein, 9 aa, Homo Sapiens
AGEYTIVIR

SEQ ID NO: 727170 - protein, 9 aa, Homo Sapiens
PRPLSPPGA

SEQ ID NO: 727171 - protein, 9 aa, Homo Sapiens
GSHSCSPIT

SEQ ID NO: 727172 - protein, 9 aa, Homo Sapiens
VLNVHGALA

SEQ ID NO: 727173 - protein, 9 aa, Homo Sapiens
GGVPILPRN

SEQ ID NO: 727174 - protein, 9 aa, Homo Sapiens
LLMPQQREE

SEQ ID NO: 727175 - protein, 9 aa, Homo Sapiens
DFGPPQCKS

SEQ ID NO: 727176 - protein, 9 aa, Homo Sapiens
GWEGTQGAW

SEQ ID NO: 727177 - protein, 9 aa, Homo Sapiens
CQKRPYGKL

SEQ ID NO: 727178 - protein, 9 aa, Homo Sapiens
KRPNRTSIV

SEQ ID NO: 727179 - protein, 9 aa, Homo Sapiens
HVVLSTCQI

SEQ ID NO: 727180 - protein, 9 aa, Homo Sapiens
LVATAALCA

SEQ ID NO: 727181 - protein, 9 aa, Homo Sapiens
DEPGLVKFL

SEQ ID NO: 727182 - protein, 9 aa, Homo Sapiens
AVCATVFLE

SEQ ID NO: 727183 - protein, 9 aa, Homo Sapiens
AVIENDGLH

SEQ ID NO: 727184 - protein, 9 aa, Homo Sapiens
VHTGSKLYE

SEQ ID NO: 727185 - protein, 9 aa, Homo Sapiens
LATALVALM

SEQ ID NO: 727186 - protein, 9 aa, Homo Sapiens
IMIIVVMTF

SEQ ID NO: 727187 - protein, 9 aa, Homo Sapiens
KFHRTSVLF

SEQ ID NO: 727188 - protein, 9 aa, Homo Sapiens
KVEESYDVK

SEQ ID NO: 727189 - protein, 9 aa, Homo Sapiens
CLAEGLPVG

SEQ ID NO: 727190 - protein, 9 aa, Homo Sapiens
LKCSPQWSH

SEQ ID NO: 727191 - protein, 9 aa, Homo Sapiens
EKKRKAEKH

SEQ ID NO: 727192 - protein, 9 aa, Homo Sapiens
HNATNPGVR

SEQ ID NO: 727193 - protein, 9 aa, Homo Sapiens
ELFSKDTIN

SEQ ID NO: 727194 - protein, 9 aa, Homo Sapiens
RRPSLVQTQ

SEQ ID NO: 727195 - protein, 9 aa, Homo Sapiens
LIFMYVRAA

SEQ ID NO: 727196 - protein, 9 aa, Homo Sapiens
EVTNDFDNV

SEQ ID NO: 727197 - protein, 9 aa, Homo Sapiens
VITIGNERL

SEQ ID NO: 727198 - protein, 9 aa, Homo Sapiens
LPGFNSVVM

SEQ ID NO: 727199 - protein, 9 aa, Homo Sapiens
PVDCHAYPH

SEQ ID NO: 727200 - protein, 9 aa, Homo Sapiens
PVSPHHPSL

SEQ ID NO: 727201 - protein, 9 aa, Homo Sapiens
YYKETTNGR

SEQ ID NO: 727202 - protein, 9 aa, Homo Sapiens
DGKEYDFPL

SEQ ID NO: 727203 - protein, 9 aa, Homo Sapiens
VGRLGHILK

SEQ ID NO: 727204 - protein, 9 aa, Homo Sapiens
YGLIVLGFP

SEQ ID NO: 727205 - protein, 9 aa, Homo Sapiens
KAFYTCGSH

SEQ ID NO: 727206 - protein, 9 aa, Homo Sapiens
GLSDVHELR

SEQ ID NO: 727207 - protein, 9 aa, Homo Sapiens
ASASNPYCQ

SEQ ID NO: 727208 - protein, 9 aa, Homo Sapiens
FSQLRSTEI

SEQ ID NO: 727209 - protein, 9 aa, Homo Sapiens
TTTTTVTTT

SEQ ID NO: 727210 - protein, 9 aa, Homo Sapiens
TWTSPSCQN

SEQ ID NO: 727211 - protein, 9 aa, Homo Sapiens
ALLEDLDLL

SEQ ID NO: 727212 - protein, 9 aa, Homo Sapiens
VRGVDVMVG

SEQ ID NO: 727213 - protein, 9 aa, Homo Sapiens
EDESNQTFT

SEQ ID NO: 727214 - protein, 9 aa, Homo Sapiens
LGDCVFYTL

SEQ ID NO: 727215 - protein, 9 aa, Homo Sapiens
DSNSYDKTT

SEQ ID NO: 727216 - protein, 9 aa, Homo Sapiens
PATDGPAAS

SEQ ID NO: 727217 - protein, 9 aa, Homo Sapiens
KLIQEITVT

SEQ ID NO: 727218 - protein, 9 aa, Homo Sapiens
QAAGLSVLN

SEQ ID NO: 727219 - protein, 9 aa, Homo Sapiens
YQQRKRQQQ

SEQ ID NO: 727220 - protein, 9 aa, Homo Sapiens
YMGQKALQL

SEQ ID NO: 727221 - protein, 9 aa, Homo Sapiens
WYFGRTWQP

SEQ ID NO: 727222 - protein, 9 aa, Homo Sapiens
SLASFAPQR

SEQ ID NO: 727223 - protein, 9 aa, Homo Sapiens
SSFCPTTCY

SEQ ID NO: 727224 - protein, 9 aa, Homo Sapiens
ALARRSTLA

SEQ ID NO: 727225 - protein, 9 aa, Homo Sapiens
HCSNCLAEQ

SEQ ID NO: 727226 - protein, 9 aa, Homo Sapiens
TVSTGSILT

SEQ ID NO: 727227 - protein, 9 aa, Homo Sapiens
RDQSAIDLL

SEQ ID NO: 727228 - protein, 9 aa, Homo Sapiens
KVYVTFHSY

SEQ ID NO: 727229 - protein, 9 aa, Homo Sapiens
VGQSCEDSC

SEQ ID NO: 727230 - protein, 9 aa, Homo Sapiens
PNSPEETPV

SEQ ID NO: 727231 - protein, 9 aa, Homo Sapiens
NRQVVRDNA

SEQ ID NO: 727232 - protein, 9 aa, Homo Sapiens
LEIESGFHI

SEQ ID NO: 727233 - protein, 9 aa, Homo Sapiens
FQSRVMKEN

SEQ ID NO: 727234 - protein, 9 aa, Homo Sapiens
LIKKRKSRS

SEQ ID NO: 727235 - protein, 9 aa, Homo Sapiens
YATGSSEEY

SEQ ID NO: 727236 - protein, 9 aa, Homo Sapiens
IVRDGVYFL

SEQ ID NO: 727237 - protein, 9 aa, Homo Sapiens
ARTECYITD

SEQ ID NO: 727238 - protein, 9 aa, Homo Sapiens
GLVGASVHV

SEQ ID NO: 727239 - protein, 9 aa, Homo Sapiens
PAKVAQVAG

SEQ ID NO: 727240 - protein, 9 aa, Homo Sapiens
QKRLQTLEK

SEQ ID NO: 727241 - protein, 9 aa, Homo Sapiens
TEFLSLLEL

SEQ ID NO: 727242 - protein, 9 aa, Homo Sapiens
MSHAPPGHH

SEQ ID NO: 727243 - protein, 9 aa, Homo Sapiens
CFVCKDKLS

SEQ ID NO: 727244 - protein, 9 aa, Homo Sapiens
STHLDIRGN

SEQ ID NO: 727245 - protein, 9 aa, Homo Sapiens
ELASGTFTL

SEQ ID NO: 727246 - protein, 9 aa, Homo Sapiens
PVVQSIYSD

SEQ ID NO: 727247 - protein, 9 aa, Homo Sapiens
CECAEFGKS

SEQ ID NO: 727248 - protein, 9 aa, Homo Sapiens
HVDEGVGWQ

SEQ ID NO: 727249 - protein, 9 aa, Homo Sapiens
VIVMQTYYR

SEQ ID NO: 727250 - protein, 9 aa, Homo Sapiens
KKKQRQRLF

SEQ ID NO: 727251 - protein, 9 aa, Homo Sapiens
YTHSDYQCS

SEQ ID NO: 727252 - protein, 9 aa, Homo Sapiens
CLEEDLCPQ

SEQ ID NO: 727253 - protein, 9 aa, Homo Sapiens
GPLGPGTPP

SEQ ID NO: 727254 - protein, 9 aa, Homo Sapiens
PWGRGTGPS

SEQ ID NO: 727255 - protein, 9 aa, Homo Sapiens
IQCPAEGAR

SEQ ID NO: 727256 - protein, 9 aa, Homo Sapiens
LVLLALEDV

SEQ ID NO: 727257 - protein, 9 aa, Homo Sapiens
TNVSLERYW

SEQ ID NO: 727258 - protein, 9 aa, Homo Sapiens
AVTEPMNHD

SEQ ID NO: 727259 - protein, 9 aa, Homo Sapiens
NIPKEQTQA

SEQ ID NO: 727260 - protein, 9 aa, Homo Sapiens
GSLEIHHFF

SEQ ID NO: 727261 - protein, 9 aa, Homo Sapiens
GSIPYIFDV

SEQ ID NO: 727262 - protein, 9 aa, Homo Sapiens
EAANSNPSE

SEQ ID NO: 727263 - protein, 9 aa, Homo Sapiens
RFDNRGGSG

SEQ ID NO: 727264 - protein, 9 aa, Homo Sapiens
ATNVNYKLP

SEQ ID NO: 727265 - protein, 9 aa, Homo Sapiens
SQSPQKQHQ

SEQ ID NO: 727266 - protein, 9 aa, Homo Sapiens
ASTVPTAST

SEQ ID NO: 727267 - protein, 9 aa, Homo Sapiens
GQVLGALEV

SEQ ID NO: 727268 - protein, 9 aa, Homo Sapiens
KKRFFQAAT

SEQ ID NO: 727269 - protein, 9 aa, Homo Sapiens
VDEGVGWQE

SEQ ID NO: 727270 - protein, 9 aa, Homo Sapiens
QLLDGVDGE

SEQ ID NO: 727271 - protein, 9 aa, Homo Sapiens
RQSEAANSN

SEQ ID NO: 727272 - protein, 9 aa, Homo Sapiens
SNWKDYDER

SEQ ID NO: 727273 - protein, 9 aa, Homo Sapiens
HVLTITEVS

SEQ ID NO: 727274 - protein, 9 aa, Homo Sapiens
ADAINRNSP

SEQ ID NO: 727275 - protein, 9 aa, Homo Sapiens
NCWEEDAEK

SEQ ID NO: 727276 - protein, 9 aa, Homo Sapiens
GPEGTSPSR

SEQ ID NO: 727277 - protein, 9 aa, Homo Sapiens
VLVQLLQVP

SEQ ID NO: 727278 - protein, 9 aa, Homo Sapiens
IVPPASLDT

SEQ ID NO: 727279 - protein, 9 aa, Homo Sapiens
LLQVPGQVL

SEQ ID NO: 727280 - protein, 9 aa, Homo Sapiens
LLRGEMFVF

SEQ ID NO: 727281 - protein, 9 aa, Homo Sapiens
TQTMMTTNH

SEQ ID NO: 727282 - protein, 9 aa, Homo Sapiens
DLVPYSIIN

SEQ ID NO: 727283 - protein, 9 aa, Homo Sapiens
NDSTSVSAL

SEQ ID NO: 727284 - protein, 9 aa, Homo Sapiens
IANSTPSEG

SEQ ID NO: 727285 - protein, 9 aa, Homo Sapiens
LQVPGQVLG

SEQ ID NO: 727286 - protein, 9 aa, Homo Sapiens
FDRPLWFEV

SEQ ID NO: 727287 - protein, 9 aa, Homo Sapiens
RYTPLDYFA

SEQ ID NO: 727288 - protein, 9 aa, Homo Sapiens
AEDNDENED

SEQ ID NO: 727289 - protein, 9 aa, Homo Sapiens
RGGSGFRGR

SEQ ID NO: 727290 - protein, 9 aa, Homo Sapiens
LNSSYYMIG

SEQ ID NO: 727291 - protein, 9 aa, Homo Sapiens
AKVAQVAGV

SEQ ID NO: 727292 - protein, 9 aa, Homo Sapiens
ALEVVHVDE

SEQ ID NO: 727293 - protein, 9 aa, Homo Sapiens
PGQQSQSGS

SEQ ID NO: 727294 - protein, 9 aa, Homo Sapiens
WKDYDEREP

SEQ ID NO: 727295 - protein, 9 aa, Homo Sapiens
KPVIVKPEG

SEQ ID NO: 727296 - protein, 9 aa, Homo Sapiens
IISGTLYIF

SEQ ID NO: 727297 - protein, 9 aa, Homo Sapiens
MNEDIDLMI

SEQ ID NO: 727298 - protein, 9 aa, Homo Sapiens
VHVDEGVGW

SEQ ID NO: 727299 - protein, 9 aa, Homo Sapiens
DEAEDNDEN

SEQ ID NO: 727300 - protein, 9 aa, Homo Sapiens
EPLVVASAG

SEQ ID NO: 727301 - protein, 9 aa, Homo Sapiens
NGIVALAKD

SEQ ID NO: 727302 - protein, 9 aa, Homo Sapiens
SPSRGSSGE

SEQ ID NO: 727303 - protein, 9 aa, Homo Sapiens
RGSLEIHHF

SEQ ID NO: 727304 - protein, 9 aa, Homo Sapiens
GHTSDSSSV

SEQ ID NO: 727305 - protein, 9 aa, Homo Sapiens
ISESMLERL

SEQ ID NO: 727306 - protein, 9 aa, Homo Sapiens
SGHLHSTPF

SEQ ID NO: 727307 - protein, 9 aa, Homo Sapiens
NGKDFVVLP

SEQ ID NO: 727308 - protein, 9 aa, Homo Sapiens
VAWCLLATV

SEQ ID NO: 727309 - protein, 9 aa, Homo Sapiens
KSLDDTSNE

SEQ ID NO: 727310 - protein, 9 aa, Homo Sapiens
KVVKIHLKL

SEQ ID NO: 727311 - protein, 9 aa, Homo Sapiens
TVDSRKRKL

SEQ ID NO: 727312 - protein, 9 aa, Homo Sapiens
SKNLNLKLM

SEQ ID NO: 727313 - protein, 9 aa, Homo Sapiens
SEQRAKVLL

SEQ ID NO: 727314 - protein, 9 aa, Homo Sapiens
PEELQAIDN

SEQ ID NO: 727315 - protein, 9 aa, Homo Sapiens
EIQCPAEGA

SEQ ID NO: 727316 - protein, 9 aa, Homo Sapiens
NRLQSVPPG

SEQ ID NO: 727317 - protein, 9 aa, Homo Sapiens
PDTPGYNRD

SEQ ID NO: 727318 - protein, 9 aa, Homo Sapiens
RTECYITDW

SEQ ID NO: 727319 - protein, 9 aa, Homo Sapiens
AQVAGVVLV

SEQ ID NO: 727320 - protein, 9 aa, Homo Sapiens
GTSPSRGSS

SEQ ID NO: 727321 - protein, 9 aa, Homo Sapiens
KVSSSFRQA

SEQ ID NO: 727322 - protein, 9 aa, Homo Sapiens
TTNHGNFLR

SEQ ID NO: 727323 - protein, 9 aa, Homo Sapiens
CTCAPGWRE

SEQ ID NO: 727324 - protein, 9 aa, Homo Sapiens
VPPASLDTF

SEQ ID NO: 727325 - protein, 9 aa, Homo Sapiens
YIFDVHTKI

SEQ ID NO: 727326 - protein, 9 aa, Homo Sapiens
PCLYGSLTC

SEQ ID NO: 727327 - protein, 9 aa, Homo Sapiens
ARIPDSISV

SEQ ID NO: 727328 - protein, 9 aa, Homo Sapiens
FENQYSIGG

SEQ ID NO: 727329 - protein, 9 aa, Homo Sapiens
SCSHSRQQS

SEQ ID NO: 727330 - protein, 9 aa, Homo Sapiens
SDPRRERPP

SEQ ID NO: 727331 - protein, 9 aa, Homo Sapiens
FDNRGGSGF

SEQ ID NO: 727332 - protein, 9 aa, Homo Sapiens
GGLTEPKKD

SEQ ID NO: 727333 - protein, 9 aa, Homo Sapiens
STTENTTRT

SEQ ID NO: 727334 - protein, 9 aa, Homo Sapiens
ELVPGQRLH

SEQ ID NO: 727335 - protein, 9 aa, Homo Sapiens
LQGVPPQLL

SEQ ID NO: 727336 - protein, 9 aa, Homo Sapiens
GKRVTTWDC

SEQ ID NO: 727337 - protein, 9 aa, Homo Sapiens
NISSYYASL

SEQ ID NO: 727338 - protein, 9 aa, Homo Sapiens
AGVVLVQLL

SEQ ID NO: 727339 - protein, 9 aa, Homo Sapiens
LKKELLEKQ

SEQ ID NO: 727340 - protein, 9 aa, Homo Sapiens
KEFFSCRGI

SEQ ID NO: 727341 - protein, 9 aa, Homo Sapiens
LPDEPYIEV

SEQ ID NO: 727342 - protein, 9 aa, Homo Sapiens
IYLITVLGN

SEQ ID NO: 727343 - protein, 9 aa, Homo Sapiens
SALTNQKRI

SEQ ID NO: 727344 - protein, 9 aa, Homo Sapiens
VLLALEDVS

SEQ ID NO: 727345 - protein, 9 aa, Homo Sapiens
WDICQYYKF

SEQ ID NO: 727346 - protein, 9 aa, Homo Sapiens
SPFSNLTWY

SEQ ID NO: 727347 - protein, 9 aa, Homo Sapiens
AAWNLPYVL

SEQ ID NO: 727348 - protein, 9 aa, Homo Sapiens
ATVRIMCSH

SEQ ID NO: 727349 - protein, 9 aa, Homo Sapiens
FVLIQGLCL

SEQ ID NO: 727350 - protein, 9 aa, Homo Sapiens
NSSYYMIGE

SEQ ID NO: 727351 - protein, 9 aa, Homo Sapiens
LPRQFNGIV

SEQ ID NO: 727352 - protein, 9 aa, Homo Sapiens
ETFLSFPEH

SEQ ID NO: 727353 - protein, 9 aa, Homo Sapiens
LSSEVSGKN

SEQ ID NO: 727354 - protein, 9 aa, Homo Sapiens
IVMQTYYRQ

SEQ ID NO: 727355 - protein, 9 aa, Homo Sapiens
KQHQLLDGV

SEQ ID NO: 727356 - protein, 9 aa, Homo Sapiens
SDYQCSQRS

SEQ ID NO: 727357 - protein, 9 aa, Homo Sapiens
VLAGMKSLW

SEQ ID NO: 727358 - protein, 9 aa, Homo Sapiens
PFCRHQKIY

SEQ ID NO: 727359 - protein, 9 aa, Homo Sapiens
NTTRTPEKP

SEQ ID NO: 727360 - protein, 9 aa, Homo Sapiens
VWKLEWPLE

SEQ ID NO: 727361 - protein, 9 aa, Homo Sapiens
AGPGPPFAG

SEQ ID NO: 727362 - protein, 9 aa, Homo Sapiens
PPPQAAGSP

SEQ ID NO: 727363 - protein, 9 aa, Homo Sapiens
ARFDRPLWF

SEQ ID NO: 727364 - protein, 9 aa, Homo Sapiens
VYDYKNTGR

SEQ ID NO: 727365 - protein, 9 aa, Homo Sapiens
SHAPPGHHS

SEQ ID NO: 727366 - protein, 9 aa, Homo Sapiens
GHIVELIRQ

SEQ ID NO: 727367 - protein, 9 aa, Homo Sapiens
EIRTVAQEI

SEQ ID NO: 727368 - protein, 9 aa, Homo Sapiens
GTGEFLPIQ

SEQ ID NO: 727369 - protein, 9 aa, Homo Sapiens
SELGWTHKK

SEQ ID NO: 727370 - protein, 9 aa, Homo Sapiens
MERSGKRVT

SEQ ID NO: 727371 - protein, 9 aa, Homo Sapiens
AANSNPSEL

SEQ ID NO: 727372 - protein, 9 aa, Homo Sapiens
EELQAIDNV

SEQ ID NO: 727373 - protein, 9 aa, Homo Sapiens
LYATVRIMC

SEQ ID NO: 727374 - protein, 9 aa, Homo Sapiens
LKLMPGEKK

SEQ ID NO: 727375 - protein, 9 aa, Homo Sapiens
SNLTWYKQD

SEQ ID NO: 727376 - protein, 9 aa, Homo Sapiens
LTFHLHYCG

SEQ ID NO: 727377 - protein, 9 aa, Homo Sapiens
AGHCYKPYI

SEQ ID NO: 727378 - protein, 9 aa, Homo Sapiens
IYSGEKSCE

SEQ ID NO: 727379 - protein, 9 aa, Homo Sapiens
DSISVIQQL

SEQ ID NO: 727380 - protein, 9 aa, Homo Sapiens
GVVLVQLLQ

SEQ ID NO: 727381 - protein, 9 aa, Homo Sapiens
NLINYSVDR

SEQ ID NO: 727382 - protein, 9 aa, Homo Sapiens
RFFQAATEH

SEQ ID NO: 727383 - protein, 9 aa, Homo Sapiens
WPLENLEKS

SEQ ID NO: 727384 - protein, 9 aa, Homo Sapiens
WCLLATVPR

SEQ ID NO: 727385 - protein, 9 aa, Homo Sapiens
NGSRSPDFA

SEQ ID NO: 727386 - protein, 9 aa, Homo Sapiens
LVSDKITGQ

SEQ ID NO: 727387 - protein, 9 aa, Homo Sapiens
PLGQGLVGA

SEQ ID NO: 727388 - protein, 9 aa, Homo Sapiens
LRTVREMRL

SEQ ID NO: 727389 - protein, 9 aa, Homo Sapiens
ILRGTCLEE

SEQ ID NO: 727390 - protein, 9 aa, Homo Sapiens
EKWAFDSAV

SEQ ID NO: 727391 - protein, 9 aa, Homo Sapiens
VTGISWGVG

SEQ ID NO: 727392 - protein, 9 aa, Homo Sapiens
CGLGWNPAS

SEQ ID NO: 727393 - protein, 9 aa, Homo Sapiens
DPRRERPPG

SEQ ID NO: 727394 - protein, 9 aa, Homo Sapiens
TNPEGSQKD

SEQ ID NO: 727395 - protein, 9 aa, Homo Sapiens
EVIIADFRF

SEQ ID NO: 727396 - protein, 9 aa, Homo Sapiens
PLCKNGSRS

SEQ ID NO: 727397 - protein, 9 aa, Homo Sapiens
NVVVYGLFI

SEQ ID NO: 727398 - protein, 9 aa, Homo Sapiens
SLQALVVAH

SEQ ID NO: 727399 - protein, 9 aa, Homo Sapiens
KVWKLEWPL

SEQ ID NO: 727400 - protein, 9 aa, Homo Sapiens
YMSEVAAER

SEQ ID NO: 727401 - protein, 9 aa, Homo Sapiens
VLLLQAELE

SEQ ID NO: 727402 - protein, 9 aa, Homo Sapiens
KPKVVKIHL

SEQ ID NO: 727403 - protein, 9 aa, Homo Sapiens
DRQSCSRCD

SEQ ID NO: 727404 - protein, 9 aa, Homo Sapiens
RTREDVPWI

SEQ ID NO: 727405 - protein, 9 aa, Homo Sapiens
TGGLTEPKK

SEQ ID NO: 727406 - protein, 9 aa, Homo Sapiens
FHLHYCGPN

SEQ ID NO: 727407 - protein, 9 aa, Homo Sapiens
ANSELGWTH

SEQ ID NO: 727408 - protein, 9 aa, Homo Sapiens
LSLLELGFS

SEQ ID NO: 727409 - protein, 9 aa, Homo Sapiens
RDPALRLLR

SEQ ID NO: 727410 - protein, 9 aa, Homo Sapiens
SDTLIKPVI

SEQ ID NO: 727411 - protein, 9 aa, Homo Sapiens
NSPGQQSQS

SEQ ID NO: 727412 - protein, 9 aa, Homo Sapiens
WTVDSRKRK

SEQ ID NO: 727413 - protein, 9 aa, Homo Sapiens
DEDIGVDIS

SEQ ID NO: 727414 - protein, 9 aa, Homo Sapiens
KTTSTTENT

SEQ ID NO: 727415 - protein, 9 aa, Homo Sapiens
SLFPTPVDD

SEQ ID NO: 727416 - protein, 9 aa, Homo Sapiens
LPYVLVFLL

SEQ ID NO: 727417 - protein, 9 aa, Homo Sapiens
CFLHKLPSF

SEQ ID NO: 727418 - protein, 9 aa, Homo Sapiens
HGPLGQGLV

SEQ ID NO: 727419 - protein, 9 aa, Homo Sapiens
HLHYCGPNW

SEQ ID NO: 727420 - protein, 9 aa, Homo Sapiens
HFFCDVQAM

SEQ ID NO: 727421 - protein, 9 aa, Homo Sapiens
EELASGTFT

SEQ ID NO: 727422 - protein, 9 aa, Homo Sapiens
NSMGDSDSL

SEQ ID NO: 727423 - protein, 9 aa, Homo Sapiens
LAGMKSLWN

SEQ ID NO: 727424 - protein, 9 aa, Homo Sapiens
SNQLHHIFC

SEQ ID NO: 727425 - protein, 9 aa, Homo Sapiens
NNQENHLSR

SEQ ID NO: 727426 - protein, 9 aa, Homo Sapiens
MTFPFRGSL

SEQ ID NO: 727427 - protein, 9 aa, Homo Sapiens
FASSTHLDI

SEQ ID NO: 727428 - protein, 9 aa, Homo Sapiens
SPYMSEVAA

SEQ ID NO: 727429 - protein, 9 aa, Homo Sapiens
LGWNPASGA

SEQ ID NO: 727430 - protein, 9 aa, Homo Sapiens
YGSLFFMYS

SEQ ID NO: 727431 - protein, 9 aa, Homo Sapiens
NQENHLSRR

SEQ ID NO: 727432 - protein, 9 aa, Homo Sapiens
CFSAIGCAS

SEQ ID NO: 727433 - protein, 9 aa, Homo Sapiens
DRAKTAVTE

SEQ ID NO: 727434 - protein, 9 aa, Homo Sapiens
ISYANVTGT

SEQ ID NO: 727435 - protein, 9 aa, Homo Sapiens
SSGHLHSTP

SEQ ID NO: 727436 - protein, 9 aa, Homo Sapiens
QEGKKEMFH

SEQ ID NO: 727437 - protein, 9 aa, Homo Sapiens
NIFRFASST

SEQ ID NO: 727438 - protein, 9 aa, Homo Sapiens
FCTFHGRCF

SEQ ID NO: 727439 - protein, 9 aa, Homo Sapiens
RDDYVFGPK

SEQ ID NO: 727440 - protein, 9 aa, Homo Sapiens
AGLYRCDIM

SEQ ID NO: 727441 - protein, 9 aa, Homo Sapiens
QLLGDVVGV

SEQ ID NO: 727442 - protein, 9 aa, Homo Sapiens
LPSFLFMKR

SEQ ID NO: 727443 - protein, 9 aa, Homo Sapiens
STVPTASTA

SEQ ID NO: 727444 - protein, 9 aa, Homo Sapiens
PGPEGTSPS

SEQ ID NO: 727445 - protein, 9 aa, Homo Sapiens
NLLQAELEK

SEQ ID NO: 727446 - protein, 9 aa, Homo Sapiens
DICQYYKFL

SEQ ID NO: 727447 - protein, 9 aa, Homo Sapiens
KLRVYSRDN

SEQ ID NO: 727448 - protein, 9 aa, Homo Sapiens
SISVIQQLS

SEQ ID NO: 727449 - protein, 9 aa, Homo Sapiens
ACLNITVFA

SEQ ID NO: 727450 - protein, 9 aa, Homo Sapiens
TMVHGNLTT

SEQ ID NO: 727451 - protein, 9 aa, Homo Sapiens
LEEKWAFDS

SEQ ID NO: 727452 - protein, 9 aa, Homo Sapiens
SLFFMYSRP

SEQ ID NO: 727453 - protein, 9 aa, Homo Sapiens
LQFSTMKMS

SEQ ID NO: 727454 - protein, 9 aa, Homo Sapiens
WQEPLVVAS

SEQ ID NO: 727455 - protein, 9 aa, Homo Sapiens
GPLCKNGSR

SEQ ID NO: 727456 - protein, 9 aa, Homo Sapiens
EDVPWIPYQ

SEQ ID NO: 727457 - protein, 9 aa, Homo Sapiens
YDEREPRHK

SEQ ID NO: 727458 - protein, 9 aa, Homo Sapiens
SLSSGHLHS

SEQ ID NO: 727459 - protein, 9 aa, Homo Sapiens
IIVETSQKV

SEQ ID NO: 727460 - protein, 9 aa, Homo Sapiens
YQCSQRSQA

SEQ ID NO: 727461 - protein, 9 aa, Homo Sapiens
LLRSVLYAT

SEQ ID NO: 727462 - protein, 9 aa, Homo Sapiens
ESEDKYRKM

SEQ ID NO: 727463 - protein, 9 aa, Homo Sapiens
TSQKVSPTE

SEQ ID NO: 727464 - protein, 9 aa, Homo Sapiens
VLGALEVVH

SEQ ID NO: 727465 - protein, 9 aa, Homo Sapiens
FSTMKMSHA

SEQ ID NO: 727466 - protein, 9 aa, Homo Sapiens
ERPPGADPR

SEQ ID NO: 727467 - protein, 9 aa, Homo Sapiens
LNLKLMPGE

SEQ ID NO: 727468 - protein, 9 aa, Homo Sapiens
GTEITYTLQ

SEQ ID NO: 727469 - protein, 9 aa, Homo Sapiens
EGPDTPGYN

SEQ ID NO: 727470 - protein, 9 aa, Homo Sapiens
YEAGPGPPF

SEQ ID NO: 727471 - protein, 9 aa, Homo Sapiens
PPGKPCLYG

SEQ ID NO: 727472 - protein, 9 aa, Homo Sapiens
AVIVMQTYY

SEQ ID NO: 727473 - protein, 9 aa, Homo Sapiens
DSKLASSMP

SEQ ID NO: 727474 - protein, 9 aa, Homo Sapiens
GSGFRGRGG

SEQ ID NO: 727475 - protein, 9 aa, Homo Sapiens
FCRHQKIYH

SEQ ID NO: 727476 - protein, 9 aa, Homo Sapiens
TVRVFLTYT

SEQ ID NO: 727477 - protein, 9 aa, Homo Sapiens
TGISWGVGF

SEQ ID NO: 727478 - protein, 9 aa, Homo Sapiens
PGWREEKCE

SEQ ID NO: 727479 - protein, 9 aa, Homo Sapiens
INYSVDRHT

SEQ ID NO: 727480 - protein, 9 aa, Homo Sapiens
TQNQQKLLK

SEQ ID NO: 727481 - protein, 9 aa, Homo Sapiens
PGQVLGALE

SEQ ID NO: 727482 - protein, 9 aa, Homo Sapiens
EITYTLQEP

SEQ ID NO: 727483 - protein, 9 aa, Homo Sapiens
RWTVDSRKR

SEQ ID NO: 727484 - protein, 9 aa, Homo Sapiens
ILTFHLHYC

SEQ ID NO: 727485 - protein, 9 aa, Homo Sapiens
NQYSIGGPQ

SEQ ID NO: 727486 - protein, 9 aa, Homo Sapiens
AITHGLKEF

SEQ ID NO: 727487 - protein, 9 aa, Homo Sapiens
RGTCLEEDL

SEQ ID NO: 727488 - protein, 9 aa, Homo Sapiens
GFDQFYEAG

SEQ ID NO: 727489 - protein, 9 aa, Homo Sapiens
NDENEDDDE

SEQ ID NO: 727490 - protein, 9 aa, Homo Sapiens
EMSLQALVV

SEQ ID NO: 727491 - protein, 9 aa, Homo Sapiens
WKLEWPLEN

SEQ ID NO: 727492 - protein, 9 aa, Homo Sapiens
LASGTFTLR

SEQ ID NO: 727493 - protein, 9 aa, Homo Sapiens
HPPGKPCLY

SEQ ID NO: 727494 - protein, 9 aa, Homo Sapiens
YCVLAGMKS

SEQ ID NO: 727495 - protein, 9 aa, Homo Sapiens
PKEQTQAGT

SEQ ID NO: 727496 - protein, 9 aa, Homo Sapiens
NLPYVLVFL

SEQ ID NO: 727497 - protein, 9 aa, Homo Sapiens
MSLQALVVA

SEQ ID NO: 727498 - protein, 9 aa, Homo Sapiens
TFLSFPEHV

SEQ ID NO: 727499 - protein, 9 aa, Homo Sapiens
YCVPQEREL

SEQ ID NO: 727500 - protein, 9 aa, Homo Sapiens
RQRLFPQPG

SEQ ID NO: 727501 - protein, 9 aa, Homo Sapiens
RLPPAKVAQ

SEQ ID NO: 727502 - protein, 9 aa, Homo Sapiens
ATEFLSLLE

SEQ ID NO: 727503 - protein, 9 aa, Homo Sapiens
FLVIMDALN

SEQ ID NO: 727504 - protein, 9 aa, Homo Sapiens
LPFCRHQKI

SEQ ID NO: 727505 - protein, 9 aa, Homo Sapiens
PPASLDTFP

SEQ ID NO: 727506 - protein, 9 aa, Homo Sapiens
RLKAVIVMQ

SEQ ID NO: 727507 - protein, 9 aa, Homo Sapiens
PYIQVRLGE

SEQ ID NO: 727508 - protein, 9 aa, Homo Sapiens
WGVGFIRFD

SEQ ID NO: 727509 - protein, 9 aa, Homo Sapiens
GTPPPLLFL

SEQ ID NO: 727510 - protein, 9 aa, Homo Sapiens
QGVPPQLLG

SEQ ID NO: 727511 - protein, 9 aa, Homo Sapiens
TTENTTRTP

SEQ ID NO: 727512 - protein, 9 aa, Homo Sapiens
EQKAVPAPV

SEQ ID NO: 727513 - protein, 9 aa, Homo Sapiens
RRERPPGAD

SEQ ID NO: 727514 - protein, 9 aa, Homo Sapiens
GVRVTDEAA

SEQ ID NO: 727515 - protein, 9 aa, Homo Sapiens
AELEKLRAV

SEQ ID NO: 727516 - protein, 9 aa, Homo Sapiens
SARIPDSIS

SEQ ID NO: 727517 - protein, 9 aa, Homo Sapiens
EHEEEGINI

SEQ ID NO: 727518 - protein, 9 aa, Homo Sapiens
IVKPEGVLV

SEQ ID NO: 727519 - protein, 9 aa, Homo Sapiens
GASGATSLC

SEQ ID NO: 727520 - protein, 9 aa, Homo Sapiens
AGAQHHGHG

SEQ ID NO: 727521 - protein, 9 aa, Homo Sapiens
YIFWKEMPE

SEQ ID NO: 727522 - protein, 9 aa, Homo Sapiens
KAVPAPVEL

SEQ ID NO: 727523 - protein, 9 aa, Homo Sapiens
ITYTLQEPI

SEQ ID NO: 727524 - protein, 9 aa, Homo Sapiens
VQSIYSDKF

SEQ ID NO: 727525 - protein, 9 aa, Homo Sapiens
FLPHFTMTP

SEQ ID NO: 727526 - protein, 9 aa, Homo Sapiens
NHPFPTGDT

SEQ ID NO: 727527 - protein, 9 aa, Homo Sapiens
GLIHDANQN

SEQ ID NO: 727528 - protein, 9 aa, Homo Sapiens
ESLPPPQAA

SEQ ID NO: 727529 - protein, 9 aa, Homo Sapiens
LCKTILSSE

SEQ ID NO: 727530 - protein, 9 aa, Homo Sapiens
QAREEYDLS

SEQ ID NO: 727531 - protein, 9 aa, Homo Sapiens
CPAASTLIT

SEQ ID NO: 727532 - protein, 9 aa, Homo Sapiens
QALVVAHPG

SEQ ID NO: 727533 - protein, 9 aa, Homo Sapiens
PAFLPHFTM

SEQ ID NO: 727534 - protein, 9 aa, Homo Sapiens
QSSVITLYT

SEQ ID NO: 727535 - protein, 9 aa, Homo Sapiens
GHKKRFFQA

SEQ ID NO: 727536 - protein, 9 aa, Homo Sapiens
TDEGPDTPG

SEQ ID NO: 727537 - protein, 9 aa, Homo Sapiens
RPQRLPPAK

SEQ ID NO: 727538 - protein, 9 aa, Homo Sapiens
KDYDEREPR

SEQ ID NO: 727539 - protein, 9 aa, Homo Sapiens
GSDPRRERP

SEQ ID NO: 727540 - protein, 9 aa, Homo Sapiens
LVQTRQVQP

SEQ ID NO: 727541 - protein, 9 aa, Homo Sapiens
LGDVVGVQG

SEQ ID NO: 727542 - protein, 9 aa, Homo Sapiens
PHLVQTRQV

SEQ ID NO: 727543 - protein, 9 aa, Homo Sapiens
NESKETFFT

SEQ ID NO: 727544 - protein, 9 aa, Homo Sapiens
RSPDFAEKK

SEQ ID NO: 727545 - protein, 9 aa, Homo Sapiens
ETSQKVSPT

SEQ ID NO: 727546 - protein, 9 aa, Homo Sapiens
LLGDVVGVQ

SEQ ID NO: 727547 - protein, 9 aa, Homo Sapiens
LFFMYSRPS

SEQ ID NO: 727548 - protein, 9 aa, Homo Sapiens
LLLNFTLVG

SEQ ID NO: 727549 - protein, 9 aa, Homo Sapiens
VYRFVLIQG

SEQ ID NO: 727550 - protein, 9 aa, Homo Sapiens
NSTPSEGST

SEQ ID NO: 727551 - protein, 9 aa, Homo Sapiens
PETTYCVPQ

SEQ ID NO: 727552 - protein, 9 aa, Homo Sapiens
SSNQLHHIF

SEQ ID NO: 727553 - protein, 9 aa, Homo Sapiens
GFHTNPEGS

SEQ ID NO: 727554 - protein, 9 aa, Homo Sapiens
LPLHHYTYL

SEQ ID NO: 727555 - protein, 9 aa, Homo Sapiens
LSSGHLHST

SEQ ID NO: 727556 - protein, 9 aa, Homo Sapiens
VKMFLHGRP

SEQ ID NO: 727557 - protein, 9 aa, Homo Sapiens
HFTMTPEAL

SEQ ID NO: 727558 - protein, 9 aa, Homo Sapiens
HKLPSFLFM

SEQ ID NO: 727559 - protein, 9 aa, Homo Sapiens
FLHGRPVTM

SEQ ID NO: 727560 - protein, 9 aa, Homo Sapiens
RDRAKTAVT

SEQ ID NO: 727561 - protein, 9 aa, Homo Sapiens
EAFEIDLLT

SEQ ID NO: 727562 - protein, 9 aa, Homo Sapiens
LKPPKDDPN

SEQ ID NO: 727563 - protein, 9 aa, Homo Sapiens
PKGGSSWMR

SEQ ID NO: 727564 - protein, 9 aa, Homo Sapiens
SAGSPWGRG

SEQ ID NO: 727565 - protein, 9 aa, Homo Sapiens
LPLPFCRHQ

SEQ ID NO: 727566 - protein, 9 aa, Homo Sapiens
PQKQHQLLD

SEQ ID NO: 727567 - protein, 9 aa, Homo Sapiens
GKKEMFHAT

SEQ ID NO: 727568 - protein, 9 aa, Homo Sapiens
DGAYAGRPL

SEQ ID NO: 727569 - protein, 9 aa, Homo Sapiens
ILDWDICQY

SEQ ID NO: 727570 - protein, 9 aa, Homo Sapiens
GAYQCFVCK

SEQ ID NO: 727571 - protein, 9 aa, Homo Sapiens
VDKIISVFY

SEQ ID NO: 727572 - protein, 9 aa, Homo Sapiens
LERYWTGNA

SEQ ID NO: 727573 - protein, 9 aa, Homo Sapiens
PEGTSPSRG

SEQ ID NO: 727574 - protein, 9 aa, Homo Sapiens
RLQTLEKQY

SEQ ID NO: 727575 - protein, 9 aa, Homo Sapiens
DEAAHPVPS

SEQ ID NO: 727576 - protein, 9 aa, Homo Sapiens
NPASGASIL

SEQ ID NO: 727577 - protein, 9 aa, Homo Sapiens
ISGTLYIFW

SEQ ID NO: 727578 - protein, 9 aa, Homo Sapiens
DSGDGAYAG

SEQ ID NO: 727579 - protein, 9 aa, Homo Sapiens
AEGTSIANS

SEQ ID NO: 727580 - protein, 9 aa, Homo Sapiens
IPSDFTMNY

SEQ ID NO: 727581 - protein, 9 aa, Homo Sapiens
MASCSRDYT

SEQ ID NO: 727582 - protein, 9 aa, Homo Sapiens
VHLEMSLQA

SEQ ID NO: 727583 - protein, 9 aa, Homo Sapiens
DKDEKGDLV

SEQ ID NO: 727584 - protein, 9 aa, Homo Sapiens
CSRDYTVRL

SEQ ID NO: 727585 - protein, 9 aa, Homo Sapiens
VSPISESML

SEQ ID NO: 727586 - protein, 9 aa, Homo Sapiens
LFPTPVDDD

SEQ ID NO: 727587 - protein, 9 aa, Homo Sapiens
ALLSLRTVR

SEQ ID NO: 727588 - protein, 9 aa, Homo Sapiens
TGEKSYKSE

SEQ ID NO: 727589 - protein, 9 aa, Homo Sapiens
GESASTVPT

SEQ ID NO: 727590 - protein, 9 aa, Homo Sapiens
VGASVHVHL

SEQ ID NO: 727591 - protein, 9 aa, Homo Sapiens
TSIANSTPS

SEQ ID NO: 727592 - protein, 9 aa, Homo Sapiens
AYIVDLDCD

SEQ ID NO: 727593 - protein, 9 aa, Homo Sapiens
RQVQPQNLQ

SEQ ID NO: 727594 - protein, 9 aa, Homo Sapiens
KLPSFLFMK

SEQ ID NO: 727595 - protein, 9 aa, Homo Sapiens
RAASILSDE

SEQ ID NO: 727596 - protein, 9 aa, Homo Sapiens
VSSSFRQAQ

SEQ ID NO: 727597 - protein, 9 aa, Homo Sapiens
PITLLLNFT

SEQ ID NO: 727598 - protein, 9 aa, Homo Sapiens
GGLLNVVVY

SEQ ID NO: 727599 - protein, 9 aa, Homo Sapiens
KPETTYCVP

SEQ ID NO: 727600 - protein, 9 aa, Homo Sapiens
KLGRKGRGR

SEQ ID NO: 727601 - protein, 9 aa, Homo Sapiens
TACLNITVF

SEQ ID NO: 727602 - protein, 9 aa, Homo Sapiens
SSVESSGGH

SEQ ID NO: 727603 - protein, 9 aa, Homo Sapiens
VHVHLEMSL

SEQ ID NO: 727604 - protein, 9 aa, Homo Sapiens
FSNLTWYKQ

SEQ ID NO: 727605 - protein, 9 aa, Homo Sapiens
EGHKKRFFQ

SEQ ID NO: 727606 - protein, 9 aa, Homo Sapiens
FAYIVDLDC

SEQ ID NO: 727607 - protein, 9 aa, Homo Sapiens
GCIAGFHTN

SEQ ID NO: 727608 - protein, 9 aa, Homo Sapiens
HVHLEMSLQ

SEQ ID NO: 727609 - protein, 9 aa, Homo Sapiens
GPNPVVQSI

SEQ ID NO: 727610 - protein, 9 aa, Homo Sapiens
PDSISVIQQ

SEQ ID NO: 727611 - protein, 9 aa, Homo Sapiens
YRFVLIQGL

SEQ ID NO: 727612 - protein, 9 aa, Homo Sapiens
ADIHINGWA

SEQ ID NO: 727613 - protein, 9 aa, Homo Sapiens
QKPETTYCV

SEQ ID NO: 727614 - protein, 9 aa, Homo Sapiens
RRIIPLKKT

SEQ ID NO: 727615 - protein, 9 aa, Homo Sapiens
YKRTREDVP

SEQ ID NO: 727616 - protein, 9 aa, Homo Sapiens
QGVLEGQVE

SEQ ID NO: 727617 - protein, 9 aa, Homo Sapiens
DVVGVQGVL

SEQ ID NO: 727618 - protein, 9 aa, Homo Sapiens
MGDSDSLHK

SEQ ID NO: 727619 - protein, 9 aa, Homo Sapiens
SSVETKPGT

SEQ ID NO: 727620 - protein, 9 aa, Homo Sapiens
EGTSPSRGS

SEQ ID NO: 727621 - protein, 9 aa, Homo Sapiens
KKQRQRLFP

SEQ ID NO: 727622 - protein, 9 aa, Homo Sapiens
SIYSDKFRD

SEQ ID NO: 727623 - protein, 9 aa, Homo Sapiens
HLVQTRQVQ

SEQ ID NO: 727624 - protein, 9 aa, Homo Sapiens
TFENQYSIG

SEQ ID NO: 727625 - protein, 9 aa, Homo Sapiens
VPTASTATL

SEQ ID NO: 727626 - protein, 9 aa, Homo Sapiens
YDSRWTVDS

SEQ ID NO: 727627 - protein, 9 aa, Homo Sapiens
ENQYSIGGP

SEQ ID NO: 727628 - protein, 9 aa, Homo Sapiens
LRLEFWLWM

SEQ ID NO: 727629 - protein, 9 aa, Homo Sapiens
RPQDNASYT

SEQ ID NO: 727630 - protein, 9 aa, Homo Sapiens
HLSRRIIPL

SEQ ID NO: 727631 - protein, 9 aa, Homo Sapiens
CWEARSLVA

SEQ ID NO: 727632 - protein, 9 aa, Homo Sapiens
PVIVKPEGV

SEQ ID NO: 727633 - protein, 9 aa, Homo Sapiens
MVHGNLTTG

SEQ ID NO: 727634 - protein, 9 aa, Homo Sapiens
CAKAFSVRS

SEQ ID NO: 727635 - protein, 9 aa, Homo Sapiens
SFPEHVAVP

SEQ ID NO: 727636 - protein, 9 aa, Homo Sapiens
QSIYSDKFR

SEQ ID NO: 727637 - protein, 9 aa, Homo Sapiens
LASGGASGA

SEQ ID NO: 727638 - protein, 9 aa, Homo Sapiens
THGLKEFFS

SEQ ID NO: 727639 - protein, 9 aa, Homo Sapiens
FETQEGKKE

SEQ ID NO: 727640 - protein, 9 aa, Homo Sapiens
CKNGSRSPD

SEQ ID NO: 727641 - protein, 9 aa, Homo Sapiens
AYAGRPLSV

SEQ ID NO: 727642 - protein, 9 aa, Homo Sapiens
LEIHHFFCE

SEQ ID NO: 727643 - protein, 9 aa, Homo Sapiens
IKPVIVKPE

SEQ ID NO: 727644 - protein, 9 aa, Homo Sapiens
LRIRPSKVS

SEQ ID NO: 727645 - protein, 9 aa, Homo Sapiens
DTSNETIYY

SEQ ID NO: 727646 - protein, 9 aa, Homo Sapiens
SGFRGRGGG

SEQ ID NO: 727647 - protein, 9 aa, Homo Sapiens
FQAREEYDL

SEQ ID NO: 727648 - protein, 9 aa, Homo Sapiens
QFSTMKMSH

SEQ ID NO: 727649 - protein, 9 aa, Homo Sapiens
ENTTRTPEK

SEQ ID NO: 727650 - protein, 9 aa, Homo Sapiens
HHGHGPGLQ

SEQ ID NO: 727651 - protein, 9 aa, Homo Sapiens
VKIHLKLVG

SEQ ID NO: 727652 - protein, 9 aa, Homo Sapiens
SYCVLAGMK

SEQ ID NO: 727653 - protein, 9 aa, Homo Sapiens
REDVPWIPY

SEQ ID NO: 727654 - protein, 9 aa, Homo Sapiens
ALNSSYYMI

SEQ ID NO: 727655 - protein, 9 aa, Homo Sapiens
AEKRPDFKK

SEQ ID NO: 727656 - protein, 9 aa, Homo Sapiens
VAGGPRGSS

SEQ ID NO: 727657 - protein, 9 aa, Homo Sapiens
MMTTNHGNF

SEQ ID NO: 727658 - protein, 9 aa, Homo Sapiens
TENTTRTPE

SEQ ID NO: 727659 - protein, 9 aa, Homo Sapiens
KTILSSEVS

SEQ ID NO: 727660 - protein, 9 aa, Homo Sapiens
ERSGKRVTT

SEQ ID NO: 727661 - protein, 9 aa, Homo Sapiens
ASSMPYVET

SEQ ID NO: 727662 - protein, 9 aa, Homo Sapiens
LGWTHKKSL

SEQ ID NO: 727663 - protein, 9 aa, Homo Sapiens
TLLLNFTLV

SEQ ID NO: 727664 - protein, 9 aa, Homo Sapiens
TEPKKDEPK

SEQ ID NO: 727665 - protein, 9 aa, Homo Sapiens
RNVSLELRC

SEQ ID NO: 727666 - protein, 9 aa, Homo Sapiens
CHPPGKPCL

SEQ ID NO: 727667 - protein, 9 aa, Homo Sapiens
TKECKMRKT

SEQ ID NO: 727668 - protein, 9 aa, Homo Sapiens
WNLPYVLVF

SEQ ID NO: 727669 - protein, 9 aa, Homo Sapiens
KYRKMNEDI

SEQ ID NO: 727670 - protein, 9 aa, Homo Sapiens
SAGAQHHGH

SEQ ID NO: 727671 - protein, 9 aa, Homo Sapiens
GTGLIHDAN

SEQ ID NO: 727672 - protein, 9 aa, Homo Sapiens
TLEKQYEEK

SEQ ID NO: 727673 - protein, 9 aa, Homo Sapiens
GEKSCECAE

SEQ ID NO: 727674 - protein, 9 aa, Homo Sapiens
EILDWDICQ

SEQ ID NO: 727675 - protein, 9 aa, Homo Sapiens
LYIFWKEMP

SEQ ID NO: 727676 - protein, 9 aa, Homo Sapiens
DYQCSQRSQ

SEQ ID NO: 727677 - protein, 9 aa, Homo Sapiens
LQALVVAHP

SEQ ID NO: 727678 - protein, 9 aa, Homo Sapiens
WDGEDIKHE

SEQ ID NO: 727679 - protein, 9 aa, Homo Sapiens
CKDKLSAQD

SEQ ID NO: 727680 - protein, 9 aa, Homo Sapiens
SRRIIPLKK

SEQ ID NO: 727681 - protein, 9 aa, Homo Sapiens
HLEMSLQAL

SEQ ID NO: 727682 - protein, 9 aa, Homo Sapiens
DYTVRLWSL

SEQ ID NO: 727683 - protein, 9 aa, Homo Sapiens
EGVGWQEPL

SEQ ID NO: 727684 - protein, 9 aa, Homo Sapiens
RLQSVPPGA

SEQ ID NO: 727685 - protein, 9 aa, Homo Sapiens
RFDRPLWFE

SEQ ID NO: 727686 - protein, 9 aa, Homo Sapiens
PSASLFPTP

SEQ ID NO: 727687 - protein, 9 aa, Homo Sapiens
STNVSLERY

SEQ ID NO: 727688 - protein, 9 aa, Homo Sapiens
DSRKRKLAA

SEQ ID NO: 727689 - protein, 9 aa, Homo Sapiens
KKINTGEKP

SEQ ID NO: 727690 - protein, 9 aa, Homo Sapiens
EDDEPVKKL

SEQ ID NO: 727691 - protein, 9 aa, Homo Sapiens
LKKGGGSSC

SEQ ID NO: 727692 - protein, 9 aa, Homo Sapiens
EGSDPRRER

SEQ ID NO: 727693 - protein, 9 aa, Homo Sapiens
GEDIKHEGT

SEQ ID NO: 727694 - protein, 9 aa, Homo Sapiens
ELQAPLFIM

SEQ ID NO: 727695 - protein, 9 aa, Homo Sapiens
PGTPPPLLF

SEQ ID NO: 727696 - protein, 9 aa, Homo Sapiens
TMTPEALLQ

SEQ ID NO: 727697 - protein, 9 aa, Homo Sapiens
ISSYYASLP

SEQ ID NO: 727698 - protein, 9 aa, Homo Sapiens
DIARNLSSC

SEQ ID NO: 727699 - protein, 9 aa, Homo Sapiens
KTTNMLEKI

SEQ ID NO: 727700 - protein, 9 aa, Homo Sapiens
LEWPLENLE

SEQ ID NO: 727701 - protein, 9 aa, Homo Sapiens
SESMLERLS

SEQ ID NO: 727702 - protein, 9 aa, Homo Sapiens
SPQSTKPVA

SEQ ID NO: 727703 - protein, 9 aa, Homo Sapiens
ESMLERLSK

SEQ ID NO: 727704 - protein, 9 aa, Homo Sapiens
RLFPQPGSL

SEQ ID NO: 727705 - protein, 9 aa, Homo Sapiens
ISVFYTIFT

SEQ ID NO: 727706 - protein, 9 aa, Homo Sapiens
ADRQSCSRC

SEQ ID NO: 727707 - protein, 9 aa, Homo Sapiens
LKEQKAVPA

SEQ ID NO: 727708 - protein, 9 aa, Homo Sapiens
NMLEKISTL

SEQ ID NO: 727709 - protein, 9 aa, Homo Sapiens
FFMYSRPSS

SEQ ID NO: 727710 - protein, 9 aa, Homo Sapiens
RNSPGQQSQ

SEQ ID NO: 727711 - protein, 9 aa, Homo Sapiens
LLLQAELET

SEQ ID NO: 727712 - protein, 9 aa, Homo Sapiens
ESCKLVSDK

SEQ ID NO: 727713 - protein, 9 aa, Homo Sapiens
QSPQKQHQL

SEQ ID NO: 727714 - protein, 9 aa, Homo Sapiens
DQWYLDYTG

SEQ ID NO: 727715 - protein, 9 aa, Homo Sapiens
SLRTVREMR

SEQ ID NO: 727716 - protein, 9 aa, Homo Sapiens
LGRKGRGRG

SEQ ID NO: 727717 - protein, 9 aa, Homo Sapiens
NRQSEAANS

SEQ ID NO: 727718 - protein, 9 aa, Homo Sapiens
DPALRLLRQ

SEQ ID NO: 727719 - protein, 9 aa, Homo Sapiens
AINRNSPGQ

SEQ ID NO: 727720 - protein, 9 aa, Homo Sapiens
PKVVKIHLK

SEQ ID NO: 727721 - protein, 9 aa, Homo Sapiens
QNQQKLLKL

SEQ ID NO: 727722 - protein, 9 aa, Homo Sapiens
SFLFMKRPG

SEQ ID NO: 727723 - protein, 9 aa, Homo Sapiens
LIRQQQFLE

SEQ ID NO: 727724 - protein, 9 aa, Homo Sapiens
VLYATVRIM

SEQ ID NO: 727725 - protein, 9 aa, Homo Sapiens
KIYSGEKSC

SEQ ID NO: 727726 - protein, 9 aa, Homo Sapiens
TEITYTLQE

SEQ ID NO: 727727 - protein, 9 aa, Homo Sapiens
SQKRLQTLE

SEQ ID NO: 727728 - protein, 9 aa, Homo Sapiens
YITDWGETQ

SEQ ID NO: 727729 - protein, 9 aa, Homo Sapiens
KIHLKLVGG

SEQ ID NO: 727730 - protein, 9 aa, Homo Sapiens
SVTPITLLL

SEQ ID NO: 727731 - protein, 9 aa, Homo Sapiens
LLLIYLITV

SEQ ID NO: 727732 - protein, 9 aa, Homo Sapiens
EAEDNDENE

SEQ ID NO: 727733 - protein, 9 aa, Homo Sapiens
SQKVSPTED

SEQ ID NO: 727734 - protein, 9 aa, Homo Sapiens
LTYTDPNEN

SEQ ID NO: 727735 - protein, 9 aa, Homo Sapiens
PYIFDVHTK

SEQ ID NO: 727736 - protein, 9 aa, Homo Sapiens
IKHEGTKPQ

SEQ ID NO: 727737 - protein, 9 aa, Homo Sapiens
LLLLIYLIT

SEQ ID NO: 727738 - protein, 9 aa, Homo Sapiens
AFSTIAIQL

SEQ ID NO: 727739 - protein, 9 aa, Homo Sapiens
TQPHLVQTR

SEQ ID NO: 727740 - protein, 9 aa, Homo Sapiens
LQAPLFIMF

SEQ ID NO: 727741 - protein, 9 aa, Homo Sapiens
DWDICQYYK

SEQ ID NO: 727742 - protein, 9 aa, Homo Sapiens
MKSLWNSSV

SEQ ID NO: 727743 - protein, 9 aa, Homo Sapiens
ERMNVGLDK

SEQ ID NO: 727744 - protein, 9 aa, Homo Sapiens
VMLFYGSLF

SEQ ID NO: 727745 - protein, 9 aa, Homo Sapiens
NEQAERMNV

SEQ ID NO: 727746 - protein, 9 aa, Homo Sapiens
YKLPLHHYT

SEQ ID NO: 727747 - protein, 9 aa, Homo Sapiens
VYGLFIIGW

SEQ ID NO: 727748 - protein, 9 aa, Homo Sapiens
INRNSPGQQ

SEQ ID NO: 727749 - protein, 9 aa, Homo Sapiens
VQGTGLIHD

SEQ ID NO: 727750 - protein, 9 aa, Homo Sapiens
RCFTRGSWG

SEQ ID NO: 727751 - protein, 9 aa, Homo Sapiens
PVKKLGRKG

SEQ ID NO: 727752 - protein, 9 aa, Homo Sapiens
CGCIAGFHT

SEQ ID NO: 727753 - protein, 9 aa, Homo Sapiens
KTAVTEPMN

SEQ ID NO: 727754 - protein, 9 aa, Homo Sapiens
NALPRQFNG

SEQ ID NO: 727755 - protein, 9 aa, Homo Sapiens
QTQAGTSNT

SEQ ID NO: 727756 - protein, 9 aa, Homo Sapiens
DHETFLSFP

SEQ ID NO: 727757 - protein, 9 aa, Homo Sapiens
ITEVSERDT

SEQ ID NO: 727758 - protein, 9 aa, Homo Sapiens
PPAKVAQVA

SEQ ID NO: 727759 - protein, 9 aa, Homo Sapiens
YNPSASLFP

SEQ ID NO: 727760 - protein, 9 aa, Homo Sapiens
LTNQKRIHT

SEQ ID NO: 727761 - protein, 9 aa, Homo Sapiens
NFLRLEFWL

SEQ ID NO: 727762 - protein, 9 aa, Homo Sapiens
NSLIRQLVN

SEQ ID NO: 727763 - protein, 9 aa, Homo Sapiens
EEYDLSDCA

SEQ ID NO: 727764 - protein, 9 aa, Homo Sapiens
GTVANSNPT

SEQ ID NO: 727765 - protein, 9 aa, Homo Sapiens
NNRLQSVPP

SEQ ID NO: 727766 - protein, 9 aa, Homo Sapiens
LLIYLITVL

SEQ ID NO: 727767 - protein, 9 aa, Homo Sapiens
PGQRLHHGP

SEQ ID NO: 727768 - protein, 9 aa, Homo Sapiens
EGINIYCLN

SEQ ID NO: 727769 - protein, 9 aa, Homo Sapiens
QPHLVQTRQ

SEQ ID NO: 727770 - protein, 9 aa, Homo Sapiens
KHEGTKPQG

SEQ ID NO: 727771 - protein, 9 aa, Homo Sapiens
RTVREMRLS

SEQ ID NO: 727772 - protein, 9 aa, Homo Sapiens
RPPGADPRE

SEQ ID NO: 727773 - protein, 9 aa, Homo Sapiens
PAPVELFSK

SEQ ID NO: 727774 - protein, 9 aa, Homo Sapiens
GPGLQGVPP

SEQ ID NO: 727775 - protein, 9 aa, Homo Sapiens
SGGASGATS

SEQ ID NO: 727776 - protein, 9 aa, Homo Sapiens
LLSLRTVRE

SEQ ID NO: 727777 - protein, 9 aa, Homo Sapiens
ETQEGKKEM

SEQ ID NO: 727778 - protein, 9 aa, Homo Sapiens
SKLASSMPY

SEQ ID NO: 727779 - protein, 9 aa, Homo Sapiens
AGLAEIQCP

SEQ ID NO: 727780 - protein, 9 aa, Homo Sapiens
APGWREEKC

SEQ ID NO: 727781 - protein, 9 aa, Homo Sapiens
ICQYYKFLA

SEQ ID NO: 727782 - protein, 9 aa, Homo Sapiens
SVIQQLSPK

SEQ ID NO: 727783 - protein, 9 aa, Homo Sapiens
GINIYCLNC

SEQ ID NO: 727784 - protein, 9 aa, Homo Sapiens
GDLVPYSII

SEQ ID NO: 727785 - protein, 9 aa, Homo Sapiens
HYTHSDYQC

SEQ ID NO: 727786 - protein, 9 aa, Homo Sapiens
QAIDNVCII

SEQ ID NO: 727787 - protein, 9 aa, Homo Sapiens
TGQTGGLTE

SEQ ID NO: 727788 - protein, 9 aa, Homo Sapiens
VVASAGAQH

SEQ ID NO: 727789 - protein, 9 aa, Homo Sapiens
QRLHHGPLG

SEQ ID NO: 727790 - protein, 9 aa, Homo Sapiens
GDIARNLSS

SEQ ID NO: 727791 - protein, 9 aa, Homo Sapiens
DVSALSRKV

SEQ ID NO: 727792 - protein, 9 aa, Homo Sapiens
DYKNTGRMT

SEQ ID NO: 727793 - protein, 9 aa, Homo Sapiens
RAKTAVTEP

SEQ ID NO: 727794 - protein, 9 aa, Homo Sapiens
LLQAELETS

SEQ ID NO: 727795 - protein, 9 aa, Homo Sapiens
VYNPSASLF

SEQ ID NO: 727796 - protein, 9 aa, Homo Sapiens
GLAEIQCPA

SEQ ID NO: 727797 - protein, 9 aa, Homo Sapiens
ASILSDEDI

SEQ ID NO: 727798 - protein, 9 aa, Homo Sapiens
VPAPVELFS

SEQ ID NO: 727799 - protein, 9 aa, Homo Sapiens
GPGPPFAGP

SEQ ID NO: 727800 - protein, 9 aa, Homo Sapiens
DDYVFGPKG

SEQ ID NO: 727801 - protein, 9 aa, Homo Sapiens
EDIKHEGTK

SEQ ID NO: 727802 - protein, 9 aa, Homo Sapiens
YTMEIVPPA

SEQ ID NO: 727803 - protein, 9 aa, Homo Sapiens
LIQGLCLSS

SEQ ID NO: 727804 - protein, 9 aa, Homo Sapiens
PPQAAGSPR

SEQ ID NO: 727805 - protein, 9 aa, Homo Sapiens
VAQVAGVVL

SEQ ID NO: 727806 - protein, 9 aa, Homo Sapiens
KLEEKWAFD

SEQ ID NO: 727807 - protein, 9 aa, Homo Sapiens
QENHLSRRI

SEQ ID NO: 727808 - protein, 9 aa, Homo Sapiens
SLLELGFSS

SEQ ID NO: 727809 - protein, 9 aa, Homo Sapiens
RPLWFEVSD

SEQ ID NO: 727810 - protein, 9 aa, Homo Sapiens
VAITHGLKE

SEQ ID NO: 727811 - protein, 9 aa, Homo Sapiens
LEETNYRLK

SEQ ID NO: 727812 - protein, 9 aa, Homo Sapiens
LVGASVHVH

SEQ ID NO: 727813 - protein, 9 aa, Homo Sapiens
GLYRCDIMY

SEQ ID NO: 727814 - protein, 9 aa, Homo Sapiens
FRFLRIRTK

SEQ ID NO: 727815 - protein, 9 aa, Homo Sapiens
IFGSIPYIF

SEQ ID NO: 727816 - protein, 9 aa, Homo Sapiens
RLEFWLWMK

SEQ ID NO: 727817 - protein, 9 aa, Homo Sapiens
ALVSPISES

SEQ ID NO: 727818 - protein, 9 aa, Homo Sapiens
KLRAVVEQT

SEQ ID NO: 727819 - protein, 9 aa, Homo Sapiens
KVSPTEDGK

SEQ ID NO: 727820 - protein, 9 aa, Homo Sapiens
VGWQEPLVV

SEQ ID NO: 727821 - protein, 9 aa, Homo Sapiens
HETFLSFPE

SEQ ID NO: 727822 - protein, 9 aa, Homo Sapiens
FVEVTLSYK

SEQ ID NO: 727823 - protein, 9 aa, Homo Sapiens
HHGPLGQGL

SEQ ID NO: 727824 - protein, 9 aa, Homo Sapiens
DSSSVESSG

SEQ ID NO: 727825 - protein, 9 aa, Homo Sapiens
LWMKGVWYL

SEQ ID NO: 727826 - protein, 9 aa, Homo Sapiens
DLLTKRDDE

SEQ ID NO: 727827 - protein, 9 aa, Homo Sapiens
INTGEKPYK

SEQ ID NO: 727828 - protein, 9 aa, Homo Sapiens
TVALLRGEM

SEQ ID NO: 727829 - protein, 9 aa, Homo Sapiens
LNCICPAAS

SEQ ID NO: 727830 - protein, 9 aa, Homo Sapiens
DIKHEGTKP

SEQ ID NO: 727831 - protein, 9 aa, Homo Sapiens
LRSVLYATV

SEQ ID NO: 727832 - protein, 9 aa, Homo Sapiens
HIPGFVEVT

SEQ ID NO: 727833 - protein, 9 aa, Homo Sapiens
ASGATSLCF

SEQ ID NO: 727834 - protein, 9 aa, Homo Sapiens
NQLHHIFCD

SEQ ID NO: 727835 - protein, 9 aa, Homo Sapiens
NLKLMPGEK

SEQ ID NO: 727836 - protein, 9 aa, Homo Sapiens
SEILDWDIC

SEQ ID NO: 727837 - protein, 9 aa, Homo Sapiens
WYLDYTGDQ

SEQ ID NO: 727838 - protein, 9 aa, Homo Sapiens
EKSCECAEF

SEQ ID NO: 727839 - protein, 9 aa, Homo Sapiens
SPGQQSQSG

SEQ ID NO: 727840 - protein, 9 aa, Homo Sapiens
LPHFTMTPE

SEQ ID NO: 727841 - protein, 9 aa, Homo Sapiens
SYDSRWTVD

SEQ ID NO: 727842 - protein, 9 aa, Homo Sapiens
QAGTSNTTS

SEQ ID NO: 727843 - protein, 9 aa, Homo Sapiens
DYTGDQWSL

SEQ ID NO: 727844 - protein, 9 aa, Homo Sapiens
KCRADRQSC

SEQ ID NO: 727845 - protein, 9 aa, Homo Sapiens
HTGEKSYKS

SEQ ID NO: 727846 - protein, 9 aa, Homo Sapiens
CLLATVPRL

SEQ ID NO: 727847 - protein, 9 aa, Homo Sapiens
NTGEKPYKC

SEQ ID NO: 727848 - protein, 9 aa, Homo Sapiens
NGTEITYTL

SEQ ID NO: 727849 - protein, 9 aa, Homo Sapiens
LINYSVDRH

SEQ ID NO: 727850 - protein, 9 aa, Homo Sapiens
FSVSEIRTV

SEQ ID NO: 727851 - protein, 9 aa, Homo Sapiens
SPWGRGTGP

SEQ ID NO: 727852 - protein, 9 aa, Homo Sapiens
DLDCDTADK

SEQ ID NO: 727853 - protein, 9 aa, Homo Sapiens
HGPGLQGVP

SEQ ID NO: 727854 - protein, 9 aa, Homo Sapiens
FTMTPEALL

SEQ ID NO: 727855 - protein, 9 aa, Homo Sapiens
HPFPTGDTG

SEQ ID NO: 727856 - protein, 9 aa, Homo Sapiens
AREEYDLSD

SEQ ID NO: 727857 - protein, 9 aa, Homo Sapiens
CEHCVEGDI

SEQ ID NO: 727858 - protein, 9 aa, Homo Sapiens
YANVTGTVA

SEQ ID NO: 727859 - protein, 9 aa, Homo Sapiens
VGLDKLMEA

SEQ ID NO: 727860 - protein, 9 aa, Homo Sapiens
DIHINGWAV

SEQ ID NO: 727861 - protein, 9 aa, Homo Sapiens
PYIEVRICF

SEQ ID NO: 727862 - protein, 9 aa, Homo Sapiens
SGDGAYAGR

SEQ ID NO: 727863 - protein, 9 aa, Homo Sapiens
KRFFQAATE

SEQ ID NO: 727864 - protein, 9 aa, Homo Sapiens
SAGHCYKPY

SEQ ID NO: 727865 - protein, 9 aa, Homo Sapiens
TEVSERDTG

SEQ ID NO: 727866 - protein, 9 aa, Homo Sapiens
FLHKLPSFL

SEQ ID NO: 727867 - protein, 9 aa, Homo Sapiens
EALSNHPFP

SEQ ID NO: 727868 - protein, 9 aa, Homo Sapiens
LHGHIVELI

SEQ ID NO: 727869 - protein, 9 aa, Homo Sapiens
SSYYASLPR

SEQ ID NO: 727870 - protein, 9 aa, Homo Sapiens
TPITLLLNF

SEQ ID NO: 727871 - protein, 9 aa, Homo Sapiens
DEGVGWQEP

SEQ ID NO: 727872 - protein, 9 aa, Homo Sapiens
LQAELEKLR

SEQ ID NO: 727873 - protein, 9 aa, Homo Sapiens
KLVSDKITG

SEQ ID NO: 727874 - protein, 9 aa, Homo Sapiens
LHSTPFQAG

SEQ ID NO: 727875 - protein, 9 aa, Homo Sapiens
MEIVPPASL

SEQ ID NO: 727876 - protein, 9 aa, Homo Sapiens
RAKVLLLQA

SEQ ID NO: 727877 - protein, 9 aa, Homo Sapiens
ASSTHLDIR

SEQ ID NO: 727878 - protein, 9 aa, Homo Sapiens
RIPDSISVI

SEQ ID NO: 727879 - protein, 9 aa, Homo Sapiens
TTGHGLLVE

SEQ ID NO: 727880 - protein, 9 aa, Homo Sapiens
FAQLQLDEG

SEQ ID NO: 727881 - protein, 9 aa, Homo Sapiens
DEGTGEFLP

SEQ ID NO: 727882 - protein, 9 aa, Homo Sapiens
EWPLENLEK

SEQ ID NO: 727883 - protein, 9 aa, Homo Sapiens
RFLRIRTKG

SEQ ID NO: 727884 - protein, 9 aa, Homo Sapiens
AFEIDLLTK

SEQ ID NO: 727885 - protein, 9 aa, Homo Sapiens
QGTGLIHDA

SEQ ID NO: 727886 - protein, 9 aa, Homo Sapiens
GRCFTRGSW

SEQ ID NO: 727887 - protein, 9 aa, Homo Sapiens
CYITDWGET

SEQ ID NO: 727888 - protein, 9 aa, Homo Sapiens
HGRCFTRGS

SEQ ID NO: 727889 - protein, 9 aa, Homo Sapiens
QVTGISWGV

SEQ ID NO: 727890 - protein, 9 aa, Homo Sapiens
PYVETQSMQ

SEQ ID NO: 727891 - protein, 9 aa, Homo Sapiens
EQRAKVLLL

SEQ ID NO: 727892 - protein, 9 aa, Homo Sapiens
KSYKSEECG

SEQ ID NO: 727893 - protein, 9 aa, Homo Sapiens
REETACLNI

SEQ ID NO: 727894 - protein, 9 aa, Homo Sapiens
SDFTMNYTT

SEQ ID NO: 727895 - protein, 9 aa, Homo Sapiens
PATEFLSLL

SEQ ID NO: 727896 - protein, 9 aa, Homo Sapiens
QRRDPALRL

SEQ ID NO: 727897 - protein, 9 aa, Homo Sapiens
KMRKTAEEM

SEQ ID NO: 727898 - protein, 9 aa, Homo Sapiens
MDALNSSYY

SEQ ID NO: 727899 - protein, 9 aa, Homo Sapiens
EGVYDYKNT

SEQ ID NO: 727900 - protein, 9 aa, Homo Sapiens
FGSIPYIFD

SEQ ID NO: 727901 - protein, 9 aa, Homo Sapiens
LEKISTLNL

SEQ ID NO: 727902 - protein, 9 aa, Homo Sapiens
KSKTPCMVR

SEQ ID NO: 727903 - protein, 9 aa, Homo Sapiens
CLYGSLTCQ

SEQ ID NO: 727904 - protein, 9 aa, Homo Sapiens
VELVPGQRL

SEQ ID NO: 727905 - protein, 9 aa, Homo Sapiens
NSTFENQYS

SEQ ID NO: 727906 - protein, 9 aa, Homo Sapiens
DALNSSYYM

SEQ ID NO: 727907 - protein, 9 aa, Homo Sapiens
QAPLFIMFT

SEQ ID NO: 727908 - protein, 9 aa, Homo Sapiens
TRQVQPQNL

SEQ ID NO: 727909 - protein, 9 aa, Homo Sapiens
NRNSPGQQS

SEQ ID NO: 727910 - protein, 9 aa, Homo Sapiens
HGNFLRLEF

SEQ ID NO: 727911 - protein, 9 aa, Homo Sapiens
KNTGRMTQK

SEQ ID NO: 727912 - protein, 9 aa, Homo Sapiens
DYDEREPRH

SEQ ID NO: 727913 - protein, 9 aa, Homo Sapiens
PLDREETAC

SEQ ID NO: 727914 - protein, 9 aa, Homo Sapiens
KEAFEIDLL

SEQ ID NO: 727915 - protein, 9 aa, Homo Sapiens
PPKDDPNPA

SEQ ID NO: 727916 - protein, 9 aa, Homo Sapiens
YKLRVYSRD

SEQ ID NO: 727917 - protein, 9 aa, Homo Sapiens
AGMKSLWNS

SEQ ID NO: 727918 - protein, 9 aa, Homo Sapiens
LRGTCLEED

SEQ ID NO: 727919 - protein, 9 aa, Homo Sapiens
YIQVRLGEH

SEQ ID NO: 727920 - protein, 9 aa, Homo Sapiens
NASYTCQVS

SEQ ID NO: 727921 - protein, 9 aa, Homo Sapiens
GHLHSTPFQ

SEQ ID NO: 727922 - protein, 9 aa, Homo Sapiens
FLYSVQNRK

SEQ ID NO: 727923 - protein, 9 aa, Homo Sapiens
IKKKQRQRL

SEQ ID NO: 727924 - protein, 9 aa, Homo Sapiens
TLYIFWKEM

SEQ ID NO: 727925 - protein, 9 aa, Homo Sapiens
QKQHQLLDG

SEQ ID NO: 727926 - protein, 9 aa, Homo Sapiens
TCQKPETTY

SEQ ID NO: 727927 - protein, 9 aa, Homo Sapiens
ECAKAFSVR

SEQ ID NO: 727928 - protein, 9 aa, Homo Sapiens
GIVALAKDK

SEQ ID NO: 727929 - protein, 9 aa, Homo Sapiens
LSRRIIPLK

SEQ ID NO: 727930 - protein, 9 aa, Homo Sapiens
SDSSSVESS

SEQ ID NO: 727931 - protein, 9 aa, Homo Sapiens
LKNLRPQDN

SEQ ID NO: 727932 - protein, 9 aa, Homo Sapiens
KMNEDIDLM

SEQ ID NO: 727933 - protein, 9 aa, Homo Sapiens
YDLSDCAVP

SEQ ID NO: 727934 - protein, 9 aa, Homo Sapiens
FHTNPEGSQ

SEQ ID NO: 727935 - protein, 9 aa, Homo Sapiens
EPYIEVRIC

SEQ ID NO: 727936 - protein, 9 aa, Homo Sapiens
KGGGSSCSH

SEQ ID NO: 727937 - protein, 9 aa, Homo Sapiens
IMYGIEDTQ

SEQ ID NO: 727938 - protein, 9 aa, Homo Sapiens
RCNECAKAF

SEQ ID NO: 727939 - protein, 9 aa, Homo Sapiens
PSNWKDYDE

SEQ ID NO: 727940 - protein, 9 aa, Homo Sapiens
RVTDEAAHP

SEQ ID NO: 727941 - protein, 9 aa, Homo Sapiens
KKCRADRQS

SEQ ID NO: 727942 - protein, 9 aa, Homo Sapiens
LSNHPFPTG

SEQ ID NO: 727943 - protein, 9 aa, Homo Sapiens
EDNDENEDD

SEQ ID NO: 727944 - protein, 9 aa, Homo Sapiens
PVAESITYA

SEQ ID NO: 727945 - protein, 9 aa, Homo Sapiens
QVELVPGQR

SEQ ID NO: 727946 - protein, 9 aa, Homo Sapiens
TMNYTTVWI

SEQ ID NO: 727947 - protein, 9 aa, Homo Sapiens
YLDYTGDQW

SEQ ID NO: 727948 - protein, 9 aa, Homo Sapiens
STSVSALAS

SEQ ID NO: 727949 - protein, 9 aa, Homo Sapiens
DCDTADKFL

SEQ ID NO: 727950 - protein, 9 aa, Homo Sapiens
RIRPSKVSS

SEQ ID NO: 727951 - protein, 9 aa, Homo Sapiens
PGYNRDNSI

SEQ ID NO: 727952 - protein, 9 aa, Homo Sapiens
GWNPASGAS

SEQ ID NO: 727953 - protein, 9 aa, Homo Sapiens
TNYRLKKEL

SEQ ID NO: 727954 - protein, 9 aa, Homo Sapiens
NFCTFHGRC

SEQ ID NO: 727955 - protein, 9 aa, Homo Sapiens
QPSSQEQSL

SEQ ID NO: 727956 - protein, 9 aa, Homo Sapiens
WAFDSAVAK

SEQ ID NO: 727957 - protein, 9 aa, Homo Sapiens
VELIRQQQF

SEQ ID NO: 727958 - protein, 9 aa, Homo Sapiens
TVPTASTAT

SEQ ID NO: 727959 - protein, 9 aa, Homo Sapiens
LKEFFSCRG

SEQ ID NO: 727960 - protein, 9 aa, Homo Sapiens
GARPQRLPP

SEQ ID NO: 727961 - protein, 9 aa, Homo Sapiens
SALASNMRD

SEQ ID NO: 727962 - protein, 9 aa, Homo Sapiens
YRCDIMYGI

SEQ ID NO: 727963 - protein, 9 aa, Homo Sapiens
LKAVIVMQT

SEQ ID NO: 727964 - protein, 9 aa, Homo Sapiens
EEGVYDYKN

SEQ ID NO: 727965 - protein, 9 aa, Homo Sapiens
LLATVPRLV

SEQ ID NO: 727966 - protein, 9 aa, Homo Sapiens
SYANVTGTV

SEQ ID NO: 727967 - protein, 9 aa, Homo Sapiens
SPISESMLE

SEQ ID NO: 727968 - protein, 9 aa, Homo Sapiens
QSTKPVAES

SEQ ID NO: 727969 - protein, 9 aa, Homo Sapiens
SLERYWTGN

SEQ ID NO: 727970 - protein, 9 aa, Homo Sapiens
NCICPAAST

SEQ ID NO: 727971 - protein, 9 aa, Homo Sapiens
GLQGVPPQL

SEQ ID NO: 727972 - protein, 9 aa, Homo Sapiens
RHKQADIHI

SEQ ID NO: 727973 - protein, 9 aa, Homo Sapiens
VVVYGLFII

SEQ ID NO: 727974 - protein, 9 aa, Homo Sapiens
GRDRAKTAV

SEQ ID NO: 727975 - protein, 9 aa, Homo Sapiens
LELGFSSTE

SEQ ID NO: 727976 - protein, 9 aa, Homo Sapiens
GGSGFRGRG

SEQ ID NO: 727977 - protein, 9 aa, Homo Sapiens
SRSPDFAEK

SEQ ID NO: 727978 - protein, 9 aa, Homo Sapiens
LNVVVYGLF

SEQ ID NO: 727979 - protein, 9 aa, Homo Sapiens
IRTVAQEIT

SEQ ID NO: 727980 - protein, 9 aa, Homo Sapiens
RSLVAGGPR

SEQ ID NO: 727981 - protein, 9 aa, Homo Sapiens
KETFFTCLH

SEQ ID NO: 727982 - protein, 9 aa, Homo Sapiens
HINGWAVEC

SEQ ID NO: 727983 - protein, 9 aa, Homo Sapiens
IVDLDCDTA

SEQ ID NO: 727984 - protein, 9 aa, Homo Sapiens
PTGDTGNPV

SEQ ID NO: 727985 - protein, 9 aa, Homo Sapiens
TDEAAHPVP

SEQ ID NO: 727986 - protein, 9 aa, Homo Sapiens
PNSGLLQSS

SEQ ID NO: 727987 - protein, 9 aa, Homo Sapiens
LTWYKQDTG

SEQ ID NO: 727988 - protein, 9 aa, Homo Sapiens
AMFYLLKPP

SEQ ID NO: 727989 - protein, 9 aa, Homo Sapiens
GSLFFMYSR

SEQ ID NO: 727990 - protein, 9 aa, Homo Sapiens
AEIQCPAEG

SEQ ID NO: 727991 - protein, 9 aa, Homo Sapiens
DEREPRHKG

SEQ ID NO: 727992 - protein, 9 aa, Homo Sapiens
PLVVASAGA

SEQ ID NO: 727993 - protein, 9 aa, Homo Sapiens
GHVLTITEV

SEQ ID NO: 727994 - protein, 9 aa, Homo Sapiens
DNIFRFASS

SEQ ID NO: 727995 - protein, 9 aa, Homo Sapiens
ASTLITLLV

SEQ ID NO: 727996 - protein, 9 aa, Homo Sapiens
PQLLGDVVG

SEQ ID NO: 727997 - protein, 9 aa, Homo Sapiens
VQGVLEGQV

SEQ ID NO: 727998 - protein, 9 aa, Homo Sapiens
HEGTKPQGA

SEQ ID NO: 727999 - protein, 9 aa, Homo Sapiens
HKKSLVERE

SEQ ID NO: 728000 - protein, 9 aa, Homo Sapiens
GNLTTGHGL

SEQ ID NO: 728001 - protein, 9 aa, Homo Sapiens
MPGEKKPGF

SEQ ID NO: 728002 - protein, 9 aa, Homo Sapiens
QAMVTLACM

SEQ ID NO: 728003 - protein, 9 aa, Homo Sapiens
KDEKGDLVP

SEQ ID NO: 728004 - protein, 9 aa, Homo Sapiens
YVLVFLLVP

SEQ ID NO: 728005 - protein, 9 aa, Homo Sapiens
VVGVQGVLE

SEQ ID NO: 728006 - protein, 9 aa, Homo Sapiens
PASGASILP

SEQ ID NO: 728007 - protein, 9 aa, Homo Sapiens
RPSKVSSSF

SEQ ID NO: 728008 - protein, 9 aa, Homo Sapiens
PAEGARPQR

SEQ ID NO: 728009 - protein, 9 aa, Homo Sapiens
VAESITYAA

SEQ ID NO: 728010 - protein, 9 aa, Homo Sapiens
GPDTPGYNR

SEQ ID NO: 728011 - protein, 9 aa, Homo Sapiens
MLFYGSLFF

SEQ ID NO: 728012 - protein, 9 aa, Homo Sapiens
GVYDYKNTG

SEQ ID NO: 728013 - protein, 9 aa, Homo Sapiens
LLNFTLVGK

SEQ ID NO: 728014 - protein, 9 aa, Homo Sapiens
ALPRQFNGI

SEQ ID NO: 728015 - protein, 9 aa, Homo Sapiens
FYLLKPPKD

SEQ ID NO: 728016 - protein, 9 aa, Homo Sapiens
ELLCKTILS

SEQ ID NO: 728017 - protein, 9 aa, Homo Sapiens
FLPDEPYIE

SEQ ID NO: 728018 - protein, 9 aa, Homo Sapiens
TYCVPQERE

SEQ ID NO: 728019 - protein, 9 aa, Homo Sapiens
QTLEKQYEE

SEQ ID NO: 728020 - protein, 9 aa, Homo Sapiens
LIHDANQNF

SEQ ID NO: 728021 - protein, 9 aa, Homo Sapiens
GGSSCSHSR

SEQ ID NO: 728022 - protein, 9 aa, Homo Sapiens
QFYEAGPGP

SEQ ID NO: 728023 - protein, 9 aa, Homo Sapiens
DVPWIPYQY

SEQ ID NO: 728024 - protein, 9 aa, Homo Sapiens
DSVTPITLL

SEQ ID NO: 728025 - protein, 9 aa, Homo Sapiens
CICPAASTL

SEQ ID NO: 728026 - protein, 9 aa, Homo Sapiens
KTKECKMRK

SEQ ID NO: 728027 - protein, 9 aa, Homo Sapiens
LRHKQADIH

SEQ ID NO: 728028 - protein, 9 aa, Homo Sapiens
GQTGGLTEP

SEQ ID NO: 728029 - protein, 9 aa, Homo Sapiens
FNTVALLRG

SEQ ID NO: 728030 - protein, 9 aa, Homo Sapiens
NVTGTVANS

SEQ ID NO: 728031 - protein, 9 aa, Homo Sapiens
VKCFSAIGC

SEQ ID NO: 728032 - protein, 9 aa, Homo Sapiens
SVLYATVRI

SEQ ID NO: 728033 - protein, 9 aa, Homo Sapiens
LSDCAVPIS

SEQ ID NO: 728034 - protein, 9 aa, Homo Sapiens
ALASNMRDD

SEQ ID NO: 728035 - protein, 9 aa, Homo Sapiens
IAGFHTNPE

SEQ ID NO: 728036 - protein, 9 aa, Homo Sapiens
SRALLSLRT

SEQ ID NO: 728037 - protein, 9 aa, Homo Sapiens
LPPAKVAQV

SEQ ID NO: 728038 - protein, 9 aa, Homo Sapiens
LIYLITVLG

SEQ ID NO: 728039 - protein, 9 aa, Homo Sapiens
TYTLQEPID

SEQ ID NO: 728040 - protein, 9 aa, Homo Sapiens
SASTVPTAS

SEQ ID NO: 728041 - protein, 9 aa, Homo Sapiens
VETSQKVSP

SEQ ID NO: 728042 - protein, 9 aa, Homo Sapiens
QNISSYYAS

SEQ ID NO: 728043 - protein, 9 aa, Homo Sapiens
KLASSMPYV

SEQ ID NO: 728044 - protein, 9 aa, Homo Sapiens
KLMPGEKKP

SEQ ID NO: 728045 - protein, 9 aa, Homo Sapiens
SMGDSDSLH

SEQ ID NO: 728046 - protein, 9 aa, Homo Sapiens
KNLNLKLMP

SEQ ID NO: 728047 - protein, 9 aa, Homo Sapiens
TYKLRVYSR

SEQ ID NO: 728048 - protein, 9 aa, Homo Sapiens
VIMDALNSS

SEQ ID NO: 728049 - protein, 9 aa, Homo Sapiens
YSGEKSCEC

SEQ ID NO: 728050 - protein, 9 aa, Homo Sapiens
NLTWYKQDT

SEQ ID NO: 728051 - protein, 9 aa, Homo Sapiens
TSPSRGSSG

SEQ ID NO: 728052 - protein, 9 aa, Homo Sapiens
AQHHGHGPG

SEQ ID NO: 728053 - protein, 9 aa, Homo Sapiens
GQRRDPALR

SEQ ID NO: 728054 - protein, 9 aa, Homo Sapiens
KSEECGKAF

SEQ ID NO: 728055 - protein, 9 aa, Homo Sapiens
EKLRAVVEQ

SEQ ID NO: 728056 - protein, 9 aa, Homo Sapiens
SEECGKAFL

SEQ ID NO: 728057 - protein, 9 aa, Homo Sapiens
DRPLWFEVS

SEQ ID NO: 728058 - protein, 9 aa, Homo Sapiens
FWLWMKGVW

SEQ ID NO: 728059 - protein, 9 aa, Homo Sapiens
SVSALASNM

SEQ ID NO: 728060 - protein, 9 aa, Homo Sapiens
CRADRQSCS

SEQ ID NO: 728061 - protein, 9 aa, Homo Sapiens
PAEGTSIAN

SEQ ID NO: 728062 - protein, 9 aa, Homo Sapiens
IFCDISPVL

SEQ ID NO: 728063 - protein, 9 aa, Homo Sapiens
VMQTYYRQW

SEQ ID NO: 728064 - protein, 9 aa, Homo Sapiens
TTYCVPQER

SEQ ID NO: 728065 - protein, 9 aa, Homo Sapiens
TVANSNPTG

SEQ ID NO: 728066 - protein, 9 aa, Homo Sapiens
EKQKLEEKW

SEQ ID NO: 728067 - protein, 9 aa, Homo Sapiens
MCEEHEEEG

SEQ ID NO: 728068 - protein, 9 aa, Homo Sapiens
TSKVATKTK

SEQ ID NO: 728069 - protein, 9 aa, Homo Sapiens
APLFIMFTL

SEQ ID NO: 728070 - protein, 9 aa, Homo Sapiens
VNYKLPLHH

SEQ ID NO: 728071 - protein, 9 aa, Homo Sapiens
IRPSKVSSS

SEQ ID NO: 728072 - protein, 9 aa, Homo Sapiens
RLKKELLEK

SEQ ID NO: 728073 - protein, 9 aa, Homo Sapiens
KLALQQYPR

SEQ ID NO: 728074 - protein, 9 aa, Homo Sapiens
EDSAGSPWG

SEQ ID NO: 728075 - protein, 9 aa, Homo Sapiens
IDLLTKRDD

SEQ ID NO: 728076 - protein, 9 aa, Homo Sapiens
GNFLRLEFW

SEQ ID NO: 728077 - protein, 9 aa, Homo Sapiens
VPGQRLHHG

SEQ ID NO: 728078 - protein, 9 aa, Homo Sapiens
TELLCKTIL

SEQ ID NO: 728079 - protein, 9 aa, Homo Sapiens
VRVTDEAAH

SEQ ID NO: 728080 - protein, 9 aa, Homo Sapiens
VKNCWEEDA

SEQ ID NO: 728081 - protein, 9 aa, Homo Sapiens
ESASTVPTA

SEQ ID NO: 728082 - protein, 9 aa, Homo Sapiens
IRQQQFLEI

SEQ ID NO: 728083 - protein, 9 aa, Homo Sapiens
DSAGSPWGR

SEQ ID NO: 728084 - protein, 9 aa, Homo Sapiens
FRGSLEIHH

SEQ ID NO: 728085 - protein, 9 aa, Homo Sapiens
FGPKGGSSW

SEQ ID NO: 728086 - protein, 9 aa, Homo Sapiens
LTEPKKDEP

SEQ ID NO: 728087 - protein, 9 aa, Homo Sapiens
LLKLALQQY

SEQ ID NO: 728088 - protein, 9 aa, Homo Sapiens
ITDWGETQG

SEQ ID NO: 728089 - protein, 9 aa, Homo Sapiens
GYVKMFLHG

SEQ ID NO: 728090 - protein, 9 aa, Homo Sapiens
PISESMLER

SEQ ID NO: 728091 - protein, 9 aa, Homo Sapiens
GAQHHGHGP

SEQ ID NO: 728092 - protein, 9 aa, Homo Sapiens
TPPRHIPGF

SEQ ID NO: 728093 - protein, 9 aa, Homo Sapiens
VFLTYTDPN

SEQ ID NO: 728094 - protein, 9 aa, Homo Sapiens
SEIRTVAQE

SEQ ID NO: 728095 - protein, 9 aa, Homo Sapiens
GSSCSHSRQ

SEQ ID NO: 728096 - protein, 9 aa, Homo Sapiens
VKKLGRKGR

SEQ ID NO: 728097 - protein, 9 aa, Homo Sapiens
MFYLLKPPK

SEQ ID NO: 728098 - protein, 9 aa, Homo Sapiens
HIFCDISPV

SEQ ID NO: 728099 - protein, 9 aa, Homo Sapiens
GTCLEEDLC

SEQ ID NO: 728100 - protein, 9 aa, Homo Sapiens
RKSKTPCMV

SEQ ID NO: 728101 - protein, 9 aa, Homo Sapiens
EDKTTNMLE

SEQ ID NO: 728102 - protein, 9 aa, Homo Sapiens
KWAFDSAVA

SEQ ID NO: 728103 - protein, 9 aa, Homo Sapiens
CTFHGRCFT

SEQ ID NO: 728104 - protein, 9 aa, Homo Sapiens
FPFRGSLEI

SEQ ID NO: 728105 - protein, 9 aa, Homo Sapiens
QLLQVPGQV

SEQ ID NO: 728106 - protein, 9 aa, Homo Sapiens
NWKDYDERE

SEQ ID NO: 728107 - protein, 9 aa, Homo Sapiens
KRNVSLELR

SEQ ID NO: 728108 - protein, 9 aa, Homo Sapiens
AIDNVCIIC

SEQ ID NO: 728109 - protein, 9 aa, Homo Sapiens
IARNLSSCM

SEQ ID NO: 728110 - protein, 9 aa, Homo Sapiens
YTTVWISVA

SEQ ID NO: 728111 - protein, 9 aa, Homo Sapiens
CEEHEEEGI

SEQ ID NO: 728112 - protein, 9 aa, Homo Sapiens
CLNITVFAA

SEQ ID NO: 728113 - protein, 9 aa, Homo Sapiens
EKQYEEKLM

SEQ ID NO: 728114 - protein, 9 aa, Homo Sapiens
FDQFYEAGP

SEQ ID NO: 728115 - protein, 9 aa, Homo Sapiens
NSNPSELKY

SEQ ID NO: 728116 - protein, 9 aa, Homo Sapiens
GKPCLYGSL

SEQ ID NO: 728117 - protein, 9 aa, Homo Sapiens
TPEELQAID

SEQ ID NO: 728118 - protein, 9 aa, Homo Sapiens
DESLPPPQA

SEQ ID NO: 728119 - protein, 9 aa, Homo Sapiens
IPYIFDVHT

SEQ ID NO: 728120 - protein, 9 aa, Homo Sapiens
DFTMNYTTV

SEQ ID NO: 728121 - protein, 9 aa, Homo Sapiens
VSPTEDGKD

SEQ ID NO: 728122 - protein, 9 aa, Homo Sapiens
HYCGPNWIQ

SEQ ID NO: 728123 - protein, 9 aa, Homo Sapiens
EDQWYLDYT

SEQ ID NO: 728124 - protein, 9 aa, Homo Sapiens
ALTNQKRIH

SEQ ID NO: 728125 - protein, 9 aa, Homo Sapiens
EDAEKRPDF

SEQ ID NO: 728126 - protein, 9 aa, Homo Sapiens
MPYVETQSM

SEQ ID NO: 728127 - protein, 9 aa, Homo Sapiens
AWNLPYVLV

SEQ ID NO: 728128 - protein, 9 aa, Homo Sapiens
QVLGALEVV

SEQ ID NO: 728129 - protein, 9 aa, Homo Sapiens
QRLKAVIVM

SEQ ID NO: 728130 - protein, 9 aa, Homo Sapiens
KGDLVPYSI

SEQ ID NO: 728131 - protein, 9 aa, Homo Sapiens
GWREEKCEL

SEQ ID NO: 728132 - protein, 9 aa, Homo Sapiens
VESSGGHRP

SEQ ID NO: 728133 - protein, 9 aa, Homo Sapiens
REEKCELPC

SEQ ID NO: 728134 - protein, 9 aa, Homo Sapiens
SKVSSSFRQ

SEQ ID NO: 728135 - protein, 9 aa, Homo Sapiens
EGTSIANST

SEQ ID NO: 728136 - protein, 9 aa, Homo Sapiens
VPPQLLGDV

SEQ ID NO: 728137 - protein, 9 aa, Homo Sapiens
ALNCICPAA

SEQ ID NO: 728138 - protein, 9 aa, Homo Sapiens
RSSDNSLIR

SEQ ID NO: 728139 - protein, 9 aa, Homo Sapiens
KVAQVAGVV

SEQ ID NO: 728140 - protein, 9 aa, Homo Sapiens
ELGWTHKKS

SEQ ID NO: 728141 - protein, 9 aa, Homo Sapiens
QKNESKETF

SEQ ID NO: 728142 - protein, 9 aa, Homo Sapiens
EIYSPYMSE

SEQ ID NO: 728143 - protein, 9 aa, Homo Sapiens
RYWTGNATL

SEQ ID NO: 728144 - protein, 9 aa, Homo Sapiens
KPYIQVRLG

SEQ ID NO: 728145 - protein, 9 aa, Homo Sapiens
ETTYCVPQE

SEQ ID NO: 728146 - protein, 9 aa, Homo Sapiens
EGTGEFLPI

SEQ ID NO: 728147 - protein, 9 aa, Homo Sapiens
SSSLSSGHL

SEQ ID NO: 728148 - protein, 9 aa, Homo Sapiens
PRRERPPGA

SEQ ID NO: 728149 - protein, 9 aa, Homo Sapiens
KLEWPLENL

SEQ ID NO: 728150 - protein, 9 aa, Homo Sapiens
QWYLDYTGD

SEQ ID NO: 728151 - protein, 9 aa, Homo Sapiens
QVPGQVLGA

SEQ ID NO: 728152 - protein, 9 aa, Homo Sapiens
WEARSLVAG

SEQ ID NO: 728153 - protein, 9 aa, Homo Sapiens
CSGNGTEIT

SEQ ID NO: 728154 - protein, 9 aa, Homo Sapiens
TGHGLLVEL

SEQ ID NO: 728155 - protein, 9 aa, Homo Sapiens
GPGTPPPLL

SEQ ID NO: 728156 - protein, 9 aa, Homo Sapiens
SVETKPGTS

SEQ ID NO: 728157 - protein, 9 aa, Homo Sapiens
CGAVVAWCL

SEQ ID NO: 728158 - protein, 9 aa, Homo Sapiens
GTFTLRSMA

SEQ ID NO: 728159 - protein, 9 aa, Homo Sapiens
LVPYSIINN

SEQ ID NO: 728160 - protein, 9 aa, Homo Sapiens
SVDKIISVF

SEQ ID NO: 728161 - protein, 9 aa, Homo Sapiens
LEGQVELVP

SEQ ID NO: 728162 - protein, 9 aa, Homo Sapiens
NPSASLFPT

SEQ ID NO: 728163 - protein, 9 aa, Homo Sapiens
EGTKPQGAS

SEQ ID NO: 728164 - protein, 9 aa, Homo Sapiens
YTDPNENFS

SEQ ID NO: 728165 - protein, 9 aa, Homo Sapiens
LPEGHKKRF

SEQ ID NO: 728166 - protein, 9 aa, Homo Sapiens
PNPVVQSIY

SEQ ID NO: 728167 - protein, 9 aa, Homo Sapiens
ARNNLINYS

SEQ ID NO: 728168 - protein, 9 aa, Homo Sapiens
GLLNVVVYG

SEQ ID NO: 728169 - protein, 9 aa, Homo Sapiens
GMTYKLRVY

SEQ ID NO: 728170 - protein, 9 aa, Homo Sapiens
DDEPVKKLG

SEQ ID NO: 728171 - protein, 9 aa, Homo Sapiens
MASKRKSKT

SEQ ID NO: 728172 - protein, 9 aa, Homo Sapiens
VDQVTGISW

SEQ ID NO: 728173 - protein, 9 aa, Homo Sapiens
CFLYSVQNR

SEQ ID NO: 728174 - protein, 9 aa, Homo Sapiens
QAELEKLRA

SEQ ID NO: 728175 - protein, 9 aa, Homo Sapiens
EQAERMNVG

SEQ ID NO: 728176 - protein, 9 aa, Homo Sapiens
QGLVGASVH

SEQ ID NO: 728177 - protein, 9 aa, Homo Sapiens
QKLEEKWAF

SEQ ID NO: 728178 - protein, 9 aa, Homo Sapiens
TTSTTENTT

SEQ ID NO: 728179 - protein, 9 aa, Homo Sapiens
VAGVVLVQL

SEQ ID NO: 728180 - protein, 9 aa, Homo Sapiens
LLPLPFCRH

SEQ ID NO: 728181 - protein, 9 aa, Homo Sapiens
ANSNPSELK

SEQ ID NO: 728182 - protein, 9 aa, Homo Sapiens
QHKKINTGE

SEQ ID NO: 728183 - protein, 9 aa, Homo Sapiens
IVELIRQQQ

SEQ ID NO: 728184 - protein, 9 aa, Homo Sapiens
TKPVAESIT

SEQ ID NO: 728185 - protein, 9 aa, Homo Sapiens
SDEDIGVDI

SEQ ID NO: 728186 - protein, 9 aa, Homo Sapiens
IESCKLVSD

SEQ ID NO: 728187 - protein, 9 aa, Homo Sapiens
KPVAESITY

SEQ ID NO: 728188 - protein, 9 aa, Homo Sapiens
PAASTLITL

SEQ ID NO: 728189 - protein, 9 aa, Homo Sapiens
TCAPGWREE

SEQ ID NO: 728190 - protein, 9 aa, Homo Sapiens
CSQRSQAGH

SEQ ID NO: 728191 - protein, 9 aa, Homo Sapiens
VFGPKGGSS

SEQ ID NO: 728192 - protein, 9 aa, Homo Sapiens
QFNGIVALA

SEQ ID NO: 728193 - protein, 9 aa, Homo Sapiens
SLHKHANNA

SEQ ID NO: 728194 - protein, 9 aa, Homo Sapiens
KTAEEMSAL

SEQ ID NO: 728195 - protein, 9 aa, Homo Sapiens
KAVIVMQTY

SEQ ID NO: 728196 - protein, 9 aa, Homo Sapiens
KKELLEKQK

SEQ ID NO: 728197 - protein, 9 aa, Homo Sapiens
DTPGYNRDN

SEQ ID NO: 728198 - protein, 9 aa, Homo Sapiens
NYSVDRHTD

SEQ ID NO: 728199 - protein, 9 aa, Homo Sapiens
RFASSTHLD

SEQ ID NO: 728200 - protein, 9 aa, Homo Sapiens
YVFGPKGGS

SEQ ID NO: 728201 - protein, 9 aa, Homo Sapiens
HKKRFFQAA

SEQ ID NO: 728202 - protein, 9 aa, Homo Sapiens
TVSPFSNLT

SEQ ID NO: 728203 - protein, 9 aa, Homo Sapiens
GSARFDRPL

SEQ ID NO: 728204 - protein, 9 aa, Homo Sapiens
HLKLVGGPY

SEQ ID NO: 728205 - protein, 9 aa, Homo Sapiens
HCVEGDIAR

SEQ ID NO: 728206 - protein, 9 aa, Homo Sapiens
YVSDSGDGA

SEQ ID NO: 728207 - protein, 9 aa, Homo Sapiens
WNPASGASI

SEQ ID NO: 728208 - protein, 9 aa, Homo Sapiens
CKTILSSEV

SEQ ID NO: 728209 - protein, 9 aa, Homo Sapiens
TIFGSIPYI

SEQ ID NO: 728210 - protein, 9 aa, Homo Sapiens
SNHPFPTGD

SEQ ID NO: 728211 - protein, 9 aa, Homo Sapiens
MRKTAEEMS

SEQ ID NO: 728212 - protein, 9 aa, Homo Sapiens
QTGGLTEPK

SEQ ID NO: 728213 - protein, 9 aa, Homo Sapiens
SSTHLDIRG

SEQ ID NO: 728214 - protein, 9 aa, Homo Sapiens
HSDYQCSQR

SEQ ID NO: 728215 - protein, 9 aa, Homo Sapiens
HGHIVELIR

SEQ ID NO: 728216 - protein, 9 aa, Homo Sapiens
EEPGPEGTS

SEQ ID NO: 728217 - protein, 9 aa, Homo Sapiens
EAGPGPPFA

SEQ ID NO: 728218 - protein, 9 aa, Homo Sapiens
TTNMLEKIS

SEQ ID NO: 728219 - protein, 9 aa, Homo Sapiens
NHLSRRIIP

SEQ ID NO: 728220 - protein, 9 aa, Homo Sapiens
NNLINYSVD

SEQ ID NO: 728221 - protein, 9 aa, Homo Sapiens
PLGPGTPPP

SEQ ID NO: 728222 - protein, 9 aa, Homo Sapiens
TFPFRGSLE

SEQ ID NO: 728223 - protein, 9 aa, Homo Sapiens
SIANSTPSE

SEQ ID NO: 728224 - protein, 9 aa, Homo Sapiens
SPQKQHQLL

SEQ ID NO: 728225 - protein, 9 aa, Homo Sapiens
CNECAKAFS

SEQ ID NO: 728226 - protein, 9 aa, Homo Sapiens
LTITEVSER

SEQ ID NO: 728227 - protein, 9 aa, Homo Sapiens
VGVQGVLEG

SEQ ID NO: 728228 - protein, 9 aa, Homo Sapiens
DKYRKMNED

SEQ ID NO: 728229 - protein, 9 aa, Homo Sapiens
YIVDLDCDT

SEQ ID NO: 728230 - protein, 9 aa, Homo Sapiens
LHHIFCDIS

SEQ ID NO: 728231 - protein, 9 aa, Homo Sapiens
ENEDDDEEE

SEQ ID NO: 728232 - protein, 9 aa, Homo Sapiens
SVSEIRTVA

SEQ ID NO: 728233 - protein, 9 aa, Homo Sapiens
KMSHAPPGH

SEQ ID NO: 728234 - protein, 9 aa, Homo Sapiens
CDVQAMVTL

SEQ ID NO: 728235 - protein, 9 aa, Homo Sapiens
PFSNLTWYK

SEQ ID NO: 728236 - protein, 9 aa, Homo Sapiens
DTLIKPVIV

SEQ ID NO: 728237 - protein, 9 aa, Homo Sapiens
FTMNYTTVW

SEQ ID NO: 728238 - protein, 9 aa, Homo Sapiens
GGAYQCFVC

SEQ ID NO: 728239 - protein, 9 aa, Homo Sapiens
CSHSRQQSP

SEQ ID NO: 728240 - protein, 9 aa, Homo Sapiens
LEEDLCPQY

SEQ ID NO: 728241 - protein, 9 aa, Homo Sapiens
TSNETIYYE

SEQ ID NO: 728242 - protein, 9 aa, Homo Sapiens
QTRQVQPQN

SEQ ID NO: 728243 - protein, 9 aa, Homo Sapiens
KNGSRSPDF

SEQ ID NO: 728244 - protein, 9 aa, Homo Sapiens
AVPAPVELF

SEQ ID NO: 728245 - protein, 9 aa, Homo Sapiens
DAINRNSPG

SEQ ID NO: 728246 - protein, 9 aa, Homo Sapiens
SARFDRPLW

SEQ ID NO: 728247 - protein, 9 aa, Homo Sapiens
MLEKISTLN

SEQ ID NO: 728248 - protein, 9 aa, Homo Sapiens
PYVLVFLLV

SEQ ID NO: 728249 - protein, 9 aa, Homo Sapiens
NTVALLRGE

SEQ ID NO: 728250 - protein, 9 aa, Homo Sapiens
LRPQDNASY

SEQ ID NO: 728251 - protein, 9 aa, Homo Sapiens
SGTLYIFWK

SEQ ID NO: 728252 - protein, 9 aa, Homo Sapiens
PEGHKKRFF

SEQ ID NO: 728253 - protein, 9 aa, Homo Sapiens
KSLWNSSVP

SEQ ID NO: 728254 - protein, 9 aa, Homo Sapiens
KNLRPQDNA

SEQ ID NO: 728255 - protein, 9 aa, Homo Sapiens
TFHGRCFTR

SEQ ID NO: 728256 - protein, 9 aa, Homo Sapiens
EARSLVAGG

SEQ ID NO: 728257 - protein, 9 aa, Homo Sapiens
DQFYEAGPG

SEQ ID NO: 728258 - protein, 9 aa, Homo Sapiens
TNAPELQAP

SEQ ID NO: 728259 - protein, 9 aa, Homo Sapiens
GLKEFFSCR

SEQ ID NO: 728260 - protein, 9 aa, Homo Sapiens
SSALTNQKR

SEQ ID NO: 728261 - protein, 9 aa, Homo Sapiens
RRSSALTNQ

SEQ ID NO: 728262 - protein, 9 aa, Homo Sapiens
AYQCFVCKD

SEQ ID NO: 728263 - protein, 9 aa, Homo Sapiens
RLTQHKKIN

SEQ ID NO: 728264 - protein, 9 aa, Homo Sapiens
SYKSEECGK

SEQ ID NO: 728265 - protein, 9 aa, Homo Sapiens
EDLCPQYTN

SEQ ID NO: 728266 - protein, 9 aa, Homo Sapiens
PSFLFMKRP

SEQ ID NO: 728267 - protein, 9 aa, Homo Sapiens
SDSLHKHAN

SEQ ID NO: 728268 - protein, 9 aa, Homo Sapiens
GPLGQGLVG

SEQ ID NO: 728269 - protein, 9 aa, Homo Sapiens
ITHGLKEFF

SEQ ID NO: 728270 - protein, 9 aa, Homo Sapiens
RCDIMYGIE

SEQ ID NO: 728271 - protein, 9 aa, Homo Sapiens
LGQGLVGAS

SEQ ID NO: 728272 - protein, 9 aa, Homo Sapiens
IPKEQTQAG

SEQ ID NO: 728273 - protein, 9 aa, Homo Sapiens
KINTGEKPY

SEQ ID NO: 728274 - protein, 9 aa, Homo Sapiens
VLIQGLCLS

SEQ ID NO: 728275 - protein, 9 aa, Homo Sapiens
EREPRHKGQ

SEQ ID NO: 728276 - protein, 9 aa, Homo Sapiens
VSEIRTVAQ

SEQ ID NO: 728277 - protein, 9 aa, Homo Sapiens
VEGDIARNL

SEQ ID NO: 728278 - protein, 9 aa, Homo Sapiens
AIIISGTLY

SEQ ID NO: 728279 - protein, 9 aa, Homo Sapiens
PDARNNLIN

SEQ ID NO: 728280 - protein, 9 aa, Homo Sapiens
GVPPQLLGD

SEQ ID NO: 728281 - protein, 9 aa, Homo Sapiens
CQKPETTYC

SEQ ID NO: 728282 - protein, 9 aa, Homo Sapiens
DCWEARSLV

SEQ ID NO: 728283 - protein, 9 aa, Homo Sapiens
DEPYIEVRI

SEQ ID NO: 728284 - protein, 9 aa, Homo Sapiens
LAEIQCPAE

SEQ ID NO: 728285 - protein, 9 aa, Homo Sapiens
CVEGDIARN

SEQ ID NO: 728286 - protein, 9 aa, Homo Sapiens
QDNASYTCQ

SEQ ID NO: 728287 - protein, 9 aa, Homo Sapiens
PPRHIPGFV

SEQ ID NO: 728288 - protein, 9 aa, Homo Sapiens
PFPTGDTGN

SEQ ID NO: 728289 - protein, 9 aa, Homo Sapiens
NVGLDKLME

SEQ ID NO: 728290 - protein, 9 aa, Homo Sapiens
ICPAASTLI

SEQ ID NO: 728291 - protein, 9 aa, Homo Sapiens
FPTPVDDDE

SEQ ID NO: 728292 - protein, 9 aa, Homo Sapiens
YRLKKELLE

SEQ ID NO: 728293 - protein, 9 aa, Homo Sapiens
VRVFLTYTD

SEQ ID NO: 728294 - protein, 9 aa, Homo Sapiens
SCHPPGKPC

SEQ ID NO: 728295 - protein, 9 aa, Homo Sapiens
LGALEVVHV

SEQ ID NO: 728296 - protein, 9 aa, Homo Sapiens
AKVLLLQAE

SEQ ID NO: 728297 - protein, 9 aa, Homo Sapiens
AASTLITLL

SEQ ID NO: 728298 - protein, 9 aa, Homo Sapiens
TSDSSSVES

SEQ ID NO: 728299 - protein, 9 aa, Homo Sapiens
LKLALQQYP

SEQ ID NO: 728300 - protein, 9 aa, Homo Sapiens
NLNLKLMPG

SEQ ID NO: 728301 - protein, 9 aa, Homo Sapiens
LHYCGPNWI

SEQ ID NO: 728302 - protein, 9 aa, Homo Sapiens
DEKGDLVPY

SEQ ID NO: 728303 - protein, 9 aa, Homo Sapiens
WTHKKSLVE

SEQ ID NO: 728304 - protein, 9 aa, Homo Sapiens
PGKPCLYGS

SEQ ID NO: 728305 - protein, 9 aa, Homo Sapiens
EFFSCRGIA

SEQ ID NO: 728306 - protein, 9 aa, Homo Sapiens
INHFFCDVQ

SEQ ID NO: 728307 - protein, 9 aa, Homo Sapiens
AEDSAGSPW

SEQ ID NO: 728308 - protein, 9 aa, Homo Sapiens
RDYTVRLWS

SEQ ID NO: 728309 - protein, 9 aa, Homo Sapiens
QAAGSPRWA

SEQ ID NO: 728310 - protein, 9 aa, Homo Sapiens
PRHIPGFVE

SEQ ID NO: 728311 - protein, 9 aa, Homo Sapiens
PPQLLGDVV

SEQ ID NO: 728312 - protein, 9 aa, Homo Sapiens
GGGSSCSHS

SEQ ID NO: 728313 - protein, 9 aa, Homo Sapiens
MFLHGRPVT

SEQ ID NO: 728314 - protein, 9 aa, Homo Sapiens
ISVIQQLSP

SEQ ID NO: 728315 - protein, 9 aa, Homo Sapiens
EGARPQRLP

SEQ ID NO: 728316 - protein, 9 aa, Homo Sapiens
DENEDDDEE

SEQ ID NO: 728317 - protein, 9 aa, Homo Sapiens
SGKRVTTWD

SEQ ID NO: 728318 - protein, 9 aa, Homo Sapiens
YLLKPPKDD

SEQ ID NO: 728319 - protein, 9 aa, Homo Sapiens
NDKDEKGDL

SEQ ID NO: 728320 - protein, 9 aa, Homo Sapiens
LLALEDVSA

SEQ ID NO: 728321 - protein, 9 aa, Homo Sapiens
QLDEGTGEF

SEQ ID NO: 728322 - protein, 9 aa, Homo Sapiens
AGSPWGRGT

SEQ ID NO: 728323 - protein, 9 aa, Homo Sapiens
QKLLKLALQ

SEQ ID NO: 728324 - protein, 9 aa, Homo Sapiens
GTSKVATKT

SEQ ID NO: 728325 - protein, 9 aa, Homo Sapiens
NYKLPLHHY

SEQ ID NO: 728326 - protein, 9 aa, Homo Sapiens
LTTGHGLLV

SEQ ID NO: 728327 - protein, 9 aa, Homo Sapiens
YIEVRICFV

SEQ ID NO: 728328 - protein, 9 aa, Homo Sapiens
VLTITEVSE

SEQ ID NO: 728329 - protein, 9 aa, Homo Sapiens
KRTREDVPW

SEQ ID NO: 728330 - protein, 9 aa, Homo Sapiens
RVFLTYTDP

SEQ ID NO: 728331 - protein, 9 aa, Homo Sapiens
GQVELVPGQ

SEQ ID NO: 728332 - protein, 9 aa, Homo Sapiens
VVLVQLLQV

SEQ ID NO: 728333 - protein, 9 aa, Homo Sapiens
VIIADFRFL

SEQ ID NO: 728334 - protein, 9 aa, Homo Sapiens
SAAWNLPYV

SEQ ID NO: 728335 - protein, 9 aa, Homo Sapiens
TPPPLLFLN

SEQ ID NO: 728336 - protein, 9 aa, Homo Sapiens
NVSLERYWT

SEQ ID NO: 728337 - protein, 9 aa, Homo Sapiens
HIVELIRQQ

SEQ ID NO: 728338 - protein, 9 aa, Homo Sapiens
TFTLRSMAG

SEQ ID NO: 728339 - protein, 9 aa, Homo Sapiens
VATNVNYKL

SEQ ID NO: 728340 - protein, 9 aa, Homo Sapiens
VDLDCDTAD

SEQ ID NO: 728341 - protein, 9 aa, Homo Sapiens
LTQHKKINT

SEQ ID NO: 728342 - protein, 9 aa, Homo Sapiens
QAILTFHLH

SEQ ID NO: 728343 - protein, 9 aa, Homo Sapiens
GLTEPKKDE

SEQ ID NO: 728344 - protein, 9 aa, Homo Sapiens
TFHLHYCGP

SEQ ID NO: 728345 - protein, 9 aa, Homo Sapiens
KKLGRKGRG

SEQ ID NO: 728346 - protein, 9 aa, Homo Sapiens
CVLAGMKSL

SEQ ID NO: 728347 - protein, 9 aa, Homo Sapiens
TQHKKINTG

SEQ ID NO: 728348 - protein, 9 aa, Homo Sapiens
LDWDICQYY

SEQ ID NO: 728349 - protein, 9 aa, Homo Sapiens
HDANQNFGP

SEQ ID NO: 728350 - protein, 9 aa, Homo Sapiens
GGASGATSL

SEQ ID NO: 728351 - protein, 9 aa, Homo Sapiens
ITLLLNFTL

SEQ ID NO: 728352 - protein, 9 aa, Homo Sapiens
KEMFHATVA

SEQ ID NO: 728353 - protein, 9 aa, Homo Sapiens
TILSSEVSG

SEQ ID NO: 728354 - protein, 9 aa, Homo Sapiens
ATPEELQAI

SEQ ID NO: 728355 - protein, 9 aa, Homo Sapiens
DREETACLN

SEQ ID NO: 728356 - protein, 9 aa, Homo Sapiens
CRHQKIYHF

SEQ ID NO: 728357 - protein, 9 aa, Homo Sapiens
EAAHPVPSQ

SEQ ID NO: 728358 - protein, 9 aa, Homo Sapiens
PGTSKVATK

SEQ ID NO: 728359 - protein, 9 aa, Homo Sapiens
VQNRKPSLY

SEQ ID NO: 728360 - protein, 9 aa, Homo Sapiens
YKSEECGKA

SEQ ID NO: 728361 - protein, 9 aa, Homo Sapiens
MTTNHGNFL

SEQ ID NO: 728362 - protein, 9 aa, Homo Sapiens
VSALSRKVL

SEQ ID NO: 728363 - protein, 9 aa, Homo Sapiens
TGTVANSNP

SEQ ID NO: 728364 - protein, 9 aa, Homo Sapiens
KPYRCNECA

SEQ ID NO: 728365 - protein, 9 aa, Homo Sapiens
TGLIHDANQ

SEQ ID NO: 728366 - protein, 9 aa, Homo Sapiens
LQNISSYYA

SEQ ID NO: 728367 - protein, 9 aa, Homo Sapiens
LLPEGHKKR

SEQ ID NO: 728368 - protein, 9 aa, Homo Sapiens
VVKIHLKLV

SEQ ID NO: 728369 - protein, 9 aa, Homo Sapiens
GVQGVLEGQ

SEQ ID NO: 728370 - protein, 9 aa, Homo Sapiens
YSVQNRKPS

SEQ ID NO: 728371 - protein, 9 aa, Homo Sapiens
RADRQSCSR

SEQ ID NO: 728372 - protein, 9 aa, Homo Sapiens
ENHLSRRII

SEQ ID NO: 728373 - protein, 9 aa, Homo Sapiens
QRAKVLLLQ

SEQ ID NO: 728374 - protein, 9 aa, Homo Sapiens
EKSYKSEEC

SEQ ID NO: 728375 - protein, 9 aa, Homo Sapiens
SSCSHSRQQ

SEQ ID NO: 728376 - protein, 9 aa, Homo Sapiens
QEPLVVASA

SEQ ID NO: 728377 - protein, 9 aa, Homo Sapiens
EIESCKLVS

SEQ ID NO: 728378 - protein, 9 aa, Homo Sapiens
CPAEGARPQ

SEQ ID NO: 728379 - protein, 9 aa, Homo Sapiens
LASNMRDDE

SEQ ID NO: 728380 - protein, 9 aa, Homo Sapiens
KQKLEEKWA

SEQ ID NO: 728381 - protein, 9 aa, Homo Sapiens
IHLKLVGGP

SEQ ID NO: 728382 - protein, 9 aa, Homo Sapiens
GAYAGRPLS

SEQ ID NO: 728383 - protein, 9 aa, Homo Sapiens
KEQTQAGTS

SEQ ID NO: 728384 - protein, 9 aa, Homo Sapiens
KPPKDDPNP

SEQ ID NO: 728385 - protein, 9 aa, Homo Sapiens
LANNRLQSV

SEQ ID NO: 728386 - protein, 9 aa, Homo Sapiens
KRVTTWDCD

SEQ ID NO: 728387 - protein, 9 aa, Homo Sapiens
DLYPGMTYK

SEQ ID NO: 728388 - protein, 9 aa, Homo Sapiens
KQADIHING

SEQ ID NO: 728389 - protein, 9 aa, Homo Sapiens
FRFASSTHL

SEQ ID NO: 728390 - protein, 9 aa, Homo Sapiens
DSRWTVDSR

SEQ ID NO: 728391 - protein, 9 aa, Homo Sapiens
LYRCDIMYG

SEQ ID NO: 728392 - protein, 9 aa, Homo Sapiens
SRYSVDKII

SEQ ID NO: 728393 - protein, 9 aa, Homo Sapiens
LEMSLQALV

SEQ ID NO: 728394 - protein, 9 aa, Homo Sapiens
LLCKTILSS

SEQ ID NO: 728395 - protein, 9 aa, Homo Sapiens
FHGRCFTRG

SEQ ID NO: 728396 - protein, 9 aa, Homo Sapiens
LLNVVVYGL

SEQ ID NO: 728397 - protein, 9 aa, Homo Sapiens
TGDQWSLGF

SEQ ID NO: 728398 - protein, 9 aa, Homo Sapiens
SDSGDGAYA

SEQ ID NO: 728399 - protein, 9 aa, Homo Sapiens
GASVHVHLE

SEQ ID NO: 728400 - protein, 9 aa, Homo Sapiens
QHHGHGPGL

SEQ ID NO: 728401 - protein, 9 aa, Homo Sapiens
VSLERYWTG

SEQ ID NO: 728402 - protein, 9 aa, Homo Sapiens
SYYASLPRF

SEQ ID NO: 728403 - protein, 9 aa, Homo Sapiens
ELQAIDNVC

SEQ ID NO: 728404 - protein, 9 aa, Homo Sapiens
ETACLNITV

SEQ ID NO: 728405 - protein, 9 aa, Homo Sapiens
LVQLLQVPG

SEQ ID NO: 728406 - protein, 9 aa, Homo Sapiens
EPVKKLGRK

SEQ ID NO: 728407 - protein, 9 aa, Homo Sapiens
GVLEGQVEL

SEQ ID NO: 728408 - protein, 9 aa, Homo Sapiens
TVRIMCSHF

SEQ ID NO: 728409 - protein, 9 aa, Homo Sapiens
RIKSLDDTS

SEQ ID NO: 728410 - protein, 9 aa, Homo Sapiens
PKGSARFDR

SEQ ID NO: 728411 - protein, 9 aa, Homo Sapiens
RLHHGPLGQ

SEQ ID NO: 728412 - protein, 9 aa, Homo Sapiens
EDIGVDISL

SEQ ID NO: 728413 - protein, 9 aa, Homo Sapiens
IFRFASSTH

SEQ ID NO: 728414 - protein, 9 aa, Homo Sapiens
RHLLLANNR

SEQ ID NO: 728415 - protein, 9 aa, Homo Sapiens
AAHPVPSQI

SEQ ID NO: 728416 - protein, 9 aa, Homo Sapiens
VVHVDEGVG

SEQ ID NO: 728417 - protein, 9 aa, Homo Sapiens
GHGPGLQGV

SEQ ID NO: 728418 - protein, 9 aa, Homo Sapiens
VSALASNMR

SEQ ID NO: 728419 - protein, 9 aa, Homo Sapiens
TQAGTSNTT

SEQ ID NO: 728420 - protein, 9 aa, Homo Sapiens
GNLASGGAS

SEQ ID NO: 728421 - protein, 9 aa, Homo Sapiens
NRGGSGFRG

SEQ ID NO: 728422 - protein, 9 aa, Homo Sapiens
QPNSGLLQS

SEQ ID NO: 728423 - protein, 9 aa, Homo Sapiens
STFENQYSI

SEQ ID NO: 728424 - protein, 9 aa, Homo Sapiens
RSSALTNQK

SEQ ID NO: 728425 - protein, 9 aa, Homo Sapiens
LQTLEKQYE

SEQ ID NO: 728426 - protein, 9 aa, Homo Sapiens
CYKPYIQVR

SEQ ID NO: 728427 - protein, 9 aa, Homo Sapiens
LPPPQAAGS

SEQ ID NO: 728428 - protein, 9 aa, Homo Sapiens
LVIMDALNS

SEQ ID NO: 728429 - protein, 9 aa, Homo Sapiens
AQLQLDEGT

SEQ ID NO: 728430 - protein, 9 aa, Homo Sapiens
YKPYIQVRL

SEQ ID NO: 728431 - protein, 9 aa, Homo Sapiens
LYPGMTYKL

SEQ ID NO: 728432 - protein, 9 aa, Homo Sapiens
SAFSTIAIQ

SEQ ID NO: 728433 - protein, 9 aa, Homo Sapiens
SVESSGGHR

SEQ ID NO: 728434 - protein, 9 aa, Homo Sapiens
CAPGWREEK

SEQ ID NO: 728435 - protein, 9 aa, Homo Sapiens
TPGYNRDNS

SEQ ID NO: 728436 - protein, 9 aa, Homo Sapiens
GSPWGRGTG

SEQ ID NO: 728437 - protein, 9 aa, Homo Sapiens
HHIFCDISP

SEQ ID NO: 728438 - protein, 9 aa, Homo Sapiens
YSPYMSEVA

SEQ ID NO: 728439 - protein, 9 aa, Homo Sapiens
YLKEQKAVP

SEQ ID NO: 728440 - protein, 9 aa, Homo Sapiens
DNASYTCQV

SEQ ID NO: 728441 - protein, 9 aa, Homo Sapiens
AKEAFEIDL

SEQ ID NO: 728442 - protein, 9 aa, Homo Sapiens
CDTADKFLQ

SEQ ID NO: 728443 - protein, 9 aa, Homo Sapiens
VDSRKRKLA

SEQ ID NO: 728444 - protein, 9 aa, Homo Sapiens
STMKMSHAP

SEQ ID NO: 728445 - protein, 9 aa, Homo Sapiens
SRWTVDSRK

SEQ ID NO: 728446 - protein, 9 aa, Homo Sapiens
PYMSEVAAE

SEQ ID NO: 728447 - protein, 9 aa, Homo Sapiens
GLGWNPASG

SEQ ID NO: 728448 - protein, 9 aa, Homo Sapiens
TMMTTNHGN

SEQ ID NO: 728449 - protein, 9 aa, Homo Sapiens
ASLFPTPVD

SEQ ID NO: 728450 - protein, 9 aa, Homo Sapiens
QMFSVSEIR

SEQ ID NO: 728451 - protein, 9 aa, Homo Sapiens
MKMSHAPPG

SEQ ID NO: 728452 - protein, 9 aa, Homo Sapiens
YATVRIMCS

SEQ ID NO: 728453 - protein, 9 aa, Homo Sapiens
GWQEPLVVA

SEQ ID NO: 728454 - protein, 9 aa, Homo Sapiens
NECAKAFSV

SEQ ID NO: 728455 - protein, 9 aa, Homo Sapiens
WLWMKGVWY

SEQ ID NO: 728456 - protein, 9 aa, Homo Sapiens
NHGNFLRLE

SEQ ID NO: 728457 - protein, 9 aa, Homo Sapiens
YWTGNATLI

SEQ ID NO: 728458 - protein, 9 aa, Homo Sapiens
DARNNLINY

SEQ ID NO: 728459 - protein, 9 aa, Homo Sapiens
QGRDRAKTA

SEQ ID NO: 728460 - protein, 9 aa, Homo Sapiens
LDREETACL

SEQ ID NO: 728461 - protein, 9 aa, Homo Sapiens
PSKVSSSFR

SEQ ID NO: 728462 - protein, 9 aa, Homo Sapiens
HQLLDGVDG

SEQ ID NO: 728463 - protein, 9 aa, Homo Sapiens
RHIPGFVEV

SEQ ID NO: 728464 - protein, 9 aa, Homo Sapiens
STVRVFLTY

SEQ ID NO: 728465 - protein, 9 aa, Homo Sapiens
EGYVKMFLH

SEQ ID NO: 728466 - protein, 9 aa, Homo Sapiens
DYVFGPKGG

SEQ ID NO: 728467 - protein, 9 aa, Homo Sapiens
LVAGGPRGS

SEQ ID NO: 728468 - protein, 9 aa, Homo Sapiens
LVVASAGAQ

SEQ ID NO: 728469 - protein, 9 aa, Homo Sapiens
SGEKSCECA

SEQ ID NO: 728470 - protein, 9 aa, Homo Sapiens
HGLKEFFSC

SEQ ID NO: 728471 - protein, 9 aa, Homo Sapiens
RYSVDKIIS

SEQ ID NO: 728472 - protein, 9 aa, Homo Sapiens
FSAIGCASR

SEQ ID NO: 728473 - protein, 9 aa, Homo Sapiens
KNESKETFF

SEQ ID NO: 728474 - protein, 9 aa, Homo Sapiens
PASLDTFPS

SEQ ID NO: 728475 - protein, 9 aa, Homo Sapiens
STIAIQLAH

SEQ ID NO: 728476 - protein, 9 aa, Homo Sapiens
NVSLELRCR

SEQ ID NO: 728477 - protein, 9 aa, Homo Sapiens
LALEDVSAL

SEQ ID NO: 728478 - protein, 9 aa, Homo Sapiens
EETACLNIT

SEQ ID NO: 728479 - protein, 9 aa, Homo Sapiens
LQAIDNVCI

SEQ ID NO: 728480 - protein, 9 aa, Homo Sapiens
PAGLAEIQC

SEQ ID NO: 728481 - protein, 9 aa, Homo Sapiens
LLKPPKDDP

SEQ ID NO: 728482 - protein, 9 aa, Homo Sapiens
LYSVQNRKP

SEQ ID NO: 728483 - protein, 9 aa, Homo Sapiens
TLIKPVIVK

SEQ ID NO: 728484 - protein, 9 aa, Homo Sapiens
VSDKITGQS

SEQ ID NO: 728485 - protein, 9 aa, Homo Sapiens
TNHGNFLRL

SEQ ID NO: 728486 - protein, 9 aa, Homo Sapiens
KRFDNRGGS

SEQ ID NO: 728487 - protein, 9 aa, Homo Sapiens
VPCFLYSVQ

SEQ ID NO: 728488 - protein, 9 aa, Homo Sapiens
SDKITGQSL

SEQ ID NO: 728489 - protein, 9 aa, Homo Sapiens
GKPKVVKIH

SEQ ID NO: 728490 - protein, 9 aa, Homo Sapiens
PDEPYIEVR

SEQ ID NO: 728491 - protein, 9 aa, Homo Sapiens
YDYKNTGRM

SEQ ID NO: 728492 - protein, 9 aa, Homo Sapiens
RKTAEEMSA

SEQ ID NO: 728493 - protein, 9 aa, Homo Sapiens
PGMTYKLRV

SEQ ID NO: 728494 - protein, 9 aa, Homo Sapiens
RCFLHKLPS

SEQ ID NO: 728495 - protein, 9 aa, Homo Sapiens
DKTTNMLEK

SEQ ID NO: 728496 - protein, 9 aa, Homo Sapiens
FNGIVALAK

SEQ ID NO: 728497 - protein, 9 aa, Homo Sapiens
DWGETQGTF

SEQ ID NO: 728498 - protein, 9 aa, Homo Sapiens
ANSTPSEGS

SEQ ID NO: 728499 - protein, 9 aa, Homo Sapiens
ADFRFLRIR

SEQ ID NO: 728500 - protein, 9 aa, Homo Sapiens
ALSNHPFPT

SEQ ID NO: 728501 - protein, 9 aa, Homo Sapiens
ASCSRDYTV

SEQ ID NO: 728502 - protein, 9 aa, Homo Sapiens
SGNGTEITY

SEQ ID NO: 728503 - protein, 9 aa, Homo Sapiens
TREDVPWIP

SEQ ID NO: 728504 - protein, 9 aa, Homo Sapiens
TECYITDWG

SEQ ID NO: 728505 - protein, 9 aa, Homo Sapiens
YSVDKIISV

SEQ ID NO: 728506 - protein, 9 aa, Homo Sapiens
IHINGWAVE

SEQ ID NO: 728507 - protein, 9 aa, Homo Sapiens
EFLSLLELG

SEQ ID NO: 728508 - protein, 9 aa, Homo Sapiens
WGRGTGPSA

SEQ ID NO: 728509 - protein, 9 aa, Homo Sapiens
LLANNRLQS

SEQ ID NO: 728510 - protein, 9 aa, Homo Sapiens
HKKINTGEK

SEQ ID NO: 728511 - protein, 9 aa, Homo Sapiens
RKMNEDIDL

SEQ ID NO: 728512 - protein, 9 aa, Homo Sapiens
TMASCSRDY

SEQ ID NO: 728513 - protein, 9 aa, Homo Sapiens
SVQNRKPSL

SEQ ID NO: 728514 - protein, 9 aa, Homo Sapiens
NLTTGHGLL

SEQ ID NO: 728515 - protein, 9 aa, Homo Sapiens
EEDLCPQYT

SEQ ID NO: 728516 - protein, 9 aa, Homo Sapiens
VHGNLTTGH

SEQ ID NO: 728517 - protein, 9 aa, Homo Sapiens
VLEGQVELV

SEQ ID NO: 728518 - protein, 9 aa, Homo Sapiens
EDVSALSRK

SEQ ID NO: 728519 - protein, 9 aa, Homo Sapiens
GPGPLGPGT

SEQ ID NO: 728520 - protein, 9 aa, Homo Sapiens
LIRQLVNHP

SEQ ID NO: 728521 - protein, 9 aa, Homo Sapiens
AEGARPQRL

SEQ ID NO: 728522 - protein, 9 aa, Homo Sapiens
LSDEDIGVD

SEQ ID NO: 728523 - protein, 9 aa, Homo Sapiens
LHHGPLGQG

SEQ ID NO: 728524 - protein, 9 aa, Homo Sapiens
GNFNTVALL

SEQ ID NO: 728525 - protein, 9 aa, Homo Sapiens
CWEEDAEKR

SEQ ID NO: 728526 - protein, 9 aa, Homo Sapiens
DDESLPPPQ

SEQ ID NO: 728527 - protein, 9 aa, Homo Sapiens
QKAVPAPVE

SEQ ID NO: 728528 - protein, 9 aa, Homo Sapiens
FCDVQAMVT

SEQ ID NO: 728529 - protein, 9 aa, Homo Sapiens
SLVAGGPRG

SEQ ID NO: 728530 - protein, 9 aa, Homo Sapiens
SLDDTSNET

SEQ ID NO: 728531 - protein, 9 aa, Homo Sapiens
ECYITDWGE

SEQ ID NO: 728532 - protein, 9 aa, Homo Sapiens
FLRLEFWLW

SEQ ID NO: 728533 - protein, 9 aa, Homo Sapiens
ASGASILPE

SEQ ID NO: 728534 - protein, 9 aa, Homo Sapiens
CKLVSDKIT

SEQ ID NO: 728535 - protein, 9 aa, Homo Sapiens
HGHGPGLQG

SEQ ID NO: 728536 - protein, 9 aa, Homo Sapiens
GALEVVHVD

SEQ ID NO: 728537 - protein, 9 aa, Homo Sapiens
ASVHVHLEM

SEQ ID NO: 728538 - protein, 9 aa, Homo Sapiens
PFRGSLEIH

SEQ ID NO: 728539 - protein, 9 aa, Homo Sapiens
GEKSYKSEE

SEQ ID NO: 728540 - protein, 9 aa, Homo Sapiens
MQTYYRQWH

SEQ ID NO: 728541 - protein, 9 aa, Homo Sapiens
SEDKYRKMN

SEQ ID NO: 728542 - protein, 9 aa, Homo Sapiens
MDGASAFST

SEQ ID NO: 728543 - protein, 9 aa, Homo Sapiens
LDYTGDQWS

SEQ ID NO: 728544 - protein, 9 aa, Homo Sapiens
NEEGVYDYK

SEQ ID NO: 728545 - protein, 9 aa, Homo Sapiens
IMDGASAFS

SEQ ID NO: 728546 - protein, 9 aa, Homo Sapiens
SCKLVSDKI

SEQ ID NO: 728547 - protein, 9 aa, Homo Sapiens
VSPQSTKPV

SEQ ID NO: 728548 - protein, 9 aa, Homo Sapiens
TKPGTSKVA

SEQ ID NO: 728549 - protein, 9 aa, Homo Sapiens
MEIYSPYMS

SEQ ID NO: 728550 - protein, 9 aa, Homo Sapiens
QKVSPTEDG

SEQ ID NO: 728551 - protein, 9 aa, Homo Sapiens
VPWIPYQYY

SEQ ID NO: 728552 - protein, 9 aa, Homo Sapiens
GAVVAWCLL

SEQ ID NO: 728553 - protein, 9 aa, Homo Sapiens
QAERMNVGL

SEQ ID NO: 728554 - protein, 9 aa, Homo Sapiens
YTGDQWSLG

SEQ ID NO: 728555 - protein, 9 aa, Homo Sapiens
GWTHKKSLV

SEQ ID NO: 728556 - protein, 9 aa, Homo Sapiens
LLELGFSST

SEQ ID NO: 728557 - protein, 9 aa, Homo Sapiens
GTSIANSTP

SEQ ID NO: 728558 - protein, 9 aa, Homo Sapiens
LRSSDNSLI

SEQ ID NO: 728559 - protein, 9 aa, Homo Sapiens
VVYGLFIIG

SEQ ID NO: 728560 - protein, 9 aa, Homo Sapiens
AWCLLATVP

SEQ ID NO: 728561 - protein, 9 aa, Homo Sapiens
TFETQEGKK

SEQ ID NO: 728562 - protein, 9 aa, Homo Sapiens
NVNYKLPLH

SEQ ID NO: 728563 - protein, 9 aa, Homo Sapiens
TSVSALASN

SEQ ID NO: 728564 - protein, 9 aa, Homo Sapiens
MNVGLDKLM

SEQ ID NO: 728565 - protein, 9 aa, Homo Sapiens
QCFVCKDKL

SEQ ID NO: 728566 - protein, 9 aa, Homo Sapiens
LQSSVITLY

SEQ ID NO: 728567 - protein, 9 aa, Homo Sapiens
QKRIHTGER

SEQ ID NO: 728568 - protein, 9 aa, Homo Sapiens
ASAGAQHHG

SEQ ID NO: 728569 - protein, 9 aa, Homo Sapiens
DFRFLRIRT

SEQ ID NO: 728570 - protein, 9 aa, Homo Sapiens
PGFVEVTLS

SEQ ID NO: 728571 - protein, 9 aa, Homo Sapiens
LLLANNRLQ

SEQ ID NO: 728572 - protein, 9 aa, Homo Sapiens
SASLFPTPV

SEQ ID NO: 728573 - protein, 9 aa, Homo Sapiens
LIKPVIVKP

SEQ ID NO: 728574 - protein, 9 aa, Homo Sapiens
LQLDEGTGE

SEQ ID NO: 728575 - protein, 9 aa, Homo Sapiens
TMEIVPPAS

SEQ ID NO: 728576 - protein, 9 aa, Homo Sapiens
PGPLGPGTP

SEQ ID NO: 728577 - protein, 9 aa, Homo Sapiens
IYKRTREDV

SEQ ID NO: 728578 - protein, 9 aa, Homo Sapiens
ECKMRKTAE

SEQ ID NO: 728579 - protein, 9 aa, Homo Sapiens
DNRGGSGFR

SEQ ID NO: 728580 - protein, 9 aa, Homo Sapiens
GYNRDNSIS

SEQ ID NO: 728581 - protein, 9 aa, Homo Sapiens
VQLLQVPGQ

SEQ ID NO: 728582 - protein, 9 aa, Homo Sapiens
ASGTFTLRS

SEQ ID NO: 728583 - protein, 9 aa, Homo Sapiens
KLLKLALQQ

SEQ ID NO: 728584 - protein, 9 aa, Homo Sapiens
VALLRGEMF

SEQ ID NO: 728585 - protein, 9 aa, Homo Sapiens
TAVTEPMNH

SEQ ID NO: 728586 - protein, 9 aa, Homo Sapiens
YVKMFLHGR

SEQ ID NO: 728587 - protein, 9 aa, Homo Sapiens
TLKVWKLEW

SEQ ID NO: 728588 - protein, 9 aa, Homo Sapiens
GNGTEITYT

SEQ ID NO: 728589 - protein, 9 aa, Homo Sapiens
GQRLHHGPL

SEQ ID NO: 728590 - protein, 9 aa, Homo Sapiens
RFVLIQGLC

SEQ ID NO: 728591 - protein, 9 aa, Homo Sapiens
RQSCSRCDD

SEQ ID NO: 728592 - protein, 9 aa, Homo Sapiens
QSEAANSNP

SEQ ID NO: 728593 - protein, 9 aa, Homo Sapiens
PQDNASYTC

SEQ ID NO: 728594 - protein, 9 aa, Homo Sapiens
VSDSGDGAY

SEQ ID NO: 728595 - protein, 9 aa, Homo Sapiens
SCECAEFGK

SEQ ID NO: 728596 - protein, 9 aa, Homo Sapiens
KNCWEEDAE

SEQ ID NO: 728597 - protein, 9 aa, Homo Sapiens
AFLPHFTMT

SEQ ID NO: 728598 - protein, 9 aa, Homo Sapiens
GKDFVVLPW

SEQ ID NO: 728599 - protein, 9 aa, Homo Sapiens
TASTATLLS

SEQ ID NO: 728600 - protein, 9 aa, Homo Sapiens
DLRIRPSKV

SEQ ID NO: 728601 - protein, 9 aa, Homo Sapiens
LASSMPYVE

SEQ ID NO: 728602 - protein, 9 aa, Homo Sapiens
DVQAMVTLA

SEQ ID NO: 728603 - protein, 9 aa, Homo Sapiens
YQCFVCKDK

SEQ ID NO: 728604 - protein, 9 aa, Homo Sapiens
KMFLHGRPV

SEQ ID NO: 728605 - protein, 9 aa, Homo Sapiens
IPQNSTFEN

SEQ ID NO: 728606 - protein, 9 aa, Homo Sapiens
GSRSPDFAE

SEQ ID NO: 728607 - protein, 9 aa, Homo Sapiens
DAGLYRCDI

SEQ ID NO: 728608 - protein, 9 aa, Homo Sapiens
DEPVKKLGR

SEQ ID NO: 728609 - protein, 9 aa, Homo Sapiens
LEDVSALSR

SEQ ID NO: 728610 - protein, 9 aa, Homo Sapiens
QADIHINGW

SEQ ID NO: 728611 - protein, 9 aa, Homo Sapiens
TVREMRLSN

SEQ ID NO: 728612 - protein, 9 aa, Homo Sapiens
MTYKLRVYS

SEQ ID NO: 728613 - protein, 9 aa, Homo Sapiens
SILSDEDIG

SEQ ID NO: 728614 - protein, 9 aa, Homo Sapiens
EKGDLVPYS

SEQ ID NO: 728615 - protein, 9 aa, Homo Sapiens
AGFHTNPEG

SEQ ID NO: 728616 - protein, 9 aa, Homo Sapiens
DGEDIKHEG

SEQ ID NO: 728617 - protein, 9 aa, Homo Sapiens
GPKGGSSWM

SEQ ID NO: 728618 - protein, 9 aa, Homo Sapiens
NSGLLQSSV

SEQ ID NO: 728619 - protein, 9 aa, Homo Sapiens
MFSVSEIRT

SEQ ID NO: 728620 - protein, 9 aa, Homo Sapiens
ELIRQQQFL

SEQ ID NO: 728621 - protein, 9 aa, Homo Sapiens
ANNRLQSVP

SEQ ID NO: 728622 - protein, 9 aa, Homo Sapiens
AERMNVGLD

SEQ ID NO: 728623 - protein, 9 aa, Homo Sapiens
QQKLLKLAL

SEQ ID NO: 728624 - protein, 9 aa, Homo Sapiens
LEKLRAVVE

SEQ ID NO: 728625 - protein, 9 aa, Homo Sapiens
QCSQRSQAG

SEQ ID NO: 728626 - protein, 9 aa, Homo Sapiens
KEQKAVPAP

SEQ ID NO: 728627 - protein, 9 aa, Homo Sapiens
ERYWTGNAT

SEQ ID NO: 728628 - protein, 9 aa, Homo Sapiens
HLLLANNRL

SEQ ID NO: 728629 - protein, 9 aa, Homo Sapiens
HCYKPYIQV

SEQ ID NO: 728630 - protein, 9 aa, Homo Sapiens
YKNTGRMTQ

SEQ ID NO: 728631 - protein, 9 aa, Homo Sapiens
ETKPGTSKV

SEQ ID NO: 728632 - protein, 9 aa, Homo Sapiens
PVYRFVLIQ

SEQ ID NO: 728633 - protein, 9 aa, Homo Sapiens
LEVVHVDEG

SEQ ID NO: 728634 - protein, 9 aa, Homo Sapiens
FEIDLLTKR

SEQ ID NO: 728635 - protein, 9 aa, Homo Sapiens
LTNAPELQA

SEQ ID NO: 728636 - protein, 9 aa, Homo Sapiens
FPTGDTGNP

SEQ ID NO: 728637 - protein, 9 aa, Homo Sapiens
IVETSQKVS

SEQ ID NO: 728638 - protein, 9 aa, Homo Sapiens
QLHHIFCDI

SEQ ID NO: 728639 - protein, 9 aa, Homo Sapiens
DNDENEDDD

SEQ ID NO: 728640 - protein, 9 aa, Homo Sapiens
EKTTSTTEN

SEQ ID NO: 728641 - protein, 9 aa, Homo Sapiens
HKQADIHIN

SEQ ID NO: 728642 - protein, 9 aa, Homo Sapiens
IMDALNSSY

SEQ ID NO: 728643 - protein, 9 aa, Homo Sapiens
HGNLTTGHG

SEQ ID NO: 728644 - protein, 9 aa, Homo Sapiens
QTMMTTNHG

SEQ ID NO: 728645 - protein, 9 aa, Homo Sapiens
STKPVAESI

SEQ ID NO: 728646 - protein, 9 aa, Homo Sapiens
LCKNGSRSP

SEQ ID NO: 728647 - protein, 8 aa, Homo Sapiens
GCSGCSGG

SEQ ID NO: 728648 - protein, 9 aa, Homo Sapiens
ALEDVSALS

SEQ ID NO: 728649 - protein, 9 aa, Homo Sapiens
ELEKLRAVV

SEQ ID NO: 728650 - protein, 9 aa, Homo Sapiens
NYTMEIVPP

SEQ ID NO: 728651 - protein, 9 aa, Homo Sapiens
LEKQYEEKL

SEQ ID NO: 728652 - protein, 9 aa, Homo Sapiens
VIVKPEGVL

SEQ ID NO: 728653 - protein, 9 aa, Homo Sapiens
SKRKSKTPC

SEQ ID NO: 728654 - protein, 9 aa, Homo Sapiens
EEEGINIYC

SEQ ID NO: 728655 - protein, 9 aa, Homo Sapiens
NPVVQSIYS

SEQ ID NO: 728656 - protein, 9 aa, Homo Sapiens
DQVTGISWG

SEQ ID NO: 728657 - protein, 9 aa, Homo Sapiens
EGDIARNLS

SEQ ID NO: 728658 - protein, 9 aa, Homo Sapiens
HTSDSSSVE

SEQ ID NO: 728659 - protein, 9 aa, Homo Sapiens
VQTRQVQPQ

SEQ ID NO: 728660 - protein, 9 aa, Homo Sapiens
PQSTKPVAE

SEQ ID NO: 728661 - protein, 9 aa, Homo Sapiens
DDTSNETIY

SEQ ID NO: 728662 - protein, 9 aa, Homo Sapiens
DAEKRPDFK

SEQ ID NO: 728663 - protein, 9 aa, Homo Sapiens
PTASTATLL

SEQ ID NO: 728664 - protein, 9 aa, Homo Sapiens
VETKPGTSK

SEQ ID NO: 728665 - protein, 9 aa, Homo Sapiens
KAGHVLTIT

SEQ ID NO: 728666 - protein, 9 aa, Homo Sapiens
SSLSSGHLH

SEQ ID NO: 728667 - protein, 9 aa, Homo Sapiens
LDEGTGEFL

SEQ ID NO: 728668 - protein, 9 aa, Homo Sapiens
DNSMGDSDS

SEQ ID NO: 728669 - protein, 9 aa, Homo Sapiens
PQRLPPAKV

SEQ ID NO: 728670 - protein, 9 aa, Homo Sapiens
GASAFSTIA

SEQ ID NO: 728671 - protein, 9 aa, Homo Sapiens
IHDANQNFG

SEQ ID NO: 728672 - protein, 9 aa, Homo Sapiens
AASILSDED

SEQ ID NO: 728673 - protein, 9 aa, Homo Sapiens
KRLQTLEKQ

SEQ ID NO: 728674 - protein, 9 aa, Homo Sapiens
VTGTVANSN

SEQ ID NO: 728675 - protein, 9 aa, Homo Sapiens
LEFWLWMKG

SEQ ID NO: 728676 - protein, 9 aa, Homo Sapiens
GMKSLWNSS

SEQ ID NO: 728677 - protein, 9 aa, Homo Sapiens
AKAFSVRST

SEQ ID NO: 728678 - protein, 9 aa, Homo Sapiens
VQAMVTLAC

SEQ ID NO: 728679 - protein, 9 aa, Homo Sapiens
SGATSLCFV

SEQ ID NO: 728680 - protein, 9 aa, Homo Sapiens
GFVEVTLSY

SEQ ID NO: 728681 - protein, 9 aa, Homo Sapiens
SRIKSLDDT

SEQ ID NO: 728682 - protein, 9 aa, Homo Sapiens
QRLFPQPGS

SEQ ID NO: 728683 - protein, 9 aa, Homo Sapiens
PYRCNECAK

SEQ ID NO: 728684 - protein, 9 aa, Homo Sapiens
APELQAPLF

SEQ ID NO: 728685 - protein, 9 aa, Homo Sapiens
VVAWCLLAT

SEQ ID NO: 728686 - protein, 9 aa, Homo Sapiens
MVKCFSAIG

SEQ ID NO: 728687 - protein, 9 aa, Homo Sapiens
QVAGVVLVQ

SEQ ID NO: 728688 - protein, 9 aa, Homo Sapiens
FYEAGPGPP

SEQ ID NO: 728689 - protein, 9 aa, Homo Sapiens
SSDNSLIRQ

SEQ ID NO: 728690 - protein, 9 aa, Homo Sapiens
EAKEAFEID

SEQ ID NO: 728691 - protein, 9 aa, Homo Sapiens
PELQAPLFI

SEQ ID NO: 728692 - protein, 9 aa, Homo Sapiens
FTLRSMAGG

SEQ ID NO: 728693 - protein, 9 aa, Homo Sapiens
LSLRTVREM

SEQ ID NO: 728694 - protein, 9 aa, Homo Sapiens
MNGKDFVVL

SEQ ID NO: 728695 - protein, 9 aa, Homo Sapiens
AKTAVTEPM

SEQ ID NO: 728696 - protein, 9 aa, Homo Sapiens
EEKCELPCQ

SEQ ID NO: 728697 - protein, 9 aa, Homo Sapiens
AGHVLTITE

SEQ ID NO: 728698 - protein, 9 aa, Homo Sapiens
RHQKIYHFF

SEQ ID NO: 728699 - protein, 9 aa, Homo Sapiens
SWGVGFIRF

SEQ ID NO: 728700 - protein, 9 aa, Homo Sapiens
PQNSTFENQ

SEQ ID NO: 728701 - protein, 9 aa, Homo Sapiens
LGPGTPPPL

SEQ ID NO: 728702 - protein, 9 aa, Homo Sapiens
ASGGASGAT

SEQ ID NO: 728703 - protein, 9 aa, Homo Sapiens
EPKKDEPKK

SEQ ID NO: 728704 - protein, 9 aa, Homo Sapiens
HLHSTPFQA

SEQ ID NO: 728705 - protein, 9 aa, Homo Sapiens
EGKKEMFHA

SEQ ID NO: 728706 - protein, 9 aa, Homo Sapiens
TWYKQDTGR

SEQ ID NO: 728707 - protein, 9 aa, Homo Sapiens
TCLEEDLCP

SEQ ID NO: 728708 - protein, 9 aa, Homo Sapiens
PLPFCRHQK

SEQ ID NO: 728709 - protein, 9 aa, Homo Sapiens
NHFFCDVQA

SEQ ID NO: 728710 - protein, 9 aa, Homo Sapiens
IIISGTLYI

SEQ ID NO: 728711 - protein, 9 aa, Homo Sapiens
NPAFLPHFT

SEQ ID NO: 728712 - protein, 9 aa, Homo Sapiens
KPCLYGSLT

SEQ ID NO: 728713 - protein, 9 aa, Homo Sapiens
LHKLPSFLF

SEQ ID NO: 728714 - protein, 9 aa, Homo Sapiens
KGGSSWMRE

SEQ ID NO: 728715 - protein, 9 aa, Homo Sapiens
SGTFTLRSM

SEQ ID NO: 728716 - protein, 9 aa, Homo Sapiens
GDVVGVQGV

SEQ ID NO: 728717 - protein, 9 aa, Homo Sapiens
EYDLSDCAV

SEQ ID NO: 728718 - protein, 9 aa, Homo Sapiens
VVQSIYSDK

SEQ ID NO: 728719 - protein, 9 aa, Homo Sapiens
GDGAYAGRP

SEQ ID NO: 728720 - protein, 9 aa, Homo Sapiens
LFPQPGSLY

SEQ ID NO: 728721 - protein, 9 aa, Homo Sapiens
SCSRDYTVR

SEQ ID NO: 728722 - protein, 9 aa, Homo Sapiens
EEDAEKRPD

SEQ ID NO: 728723 - protein, 9 aa, Homo Sapiens
ASKRKSKTP

SEQ ID NO: 728724 - protein, 9 aa, Homo Sapiens
NSELGWTHK

SEQ ID NO: 728725 - protein, 9 aa, Homo Sapiens
NYTTVWISV

SEQ ID NO: 728726 - protein, 9 aa, Homo Sapiens
EVRICFVAG

SEQ ID NO: 728727 - protein, 9 aa, Homo Sapiens
ASAFSTIAI

SEQ ID NO: 728728 - protein, 9 aa, Homo Sapiens
DSLHKHANN

SEQ ID NO: 728729 - protein, 9 aa, Homo Sapiens
KPGTSKVAT

SEQ ID NO: 728730 - protein, 9 aa, Homo Sapiens
LMPGEKKPG

SEQ ID NO: 728731 - protein, 9 aa, Homo Sapiens
NAPELQAPL

SEQ ID NO: 728732 - protein, 9 aa, Homo Sapiens
SSVITLYTM

SEQ ID NO: 728733 - protein, 9 aa, Homo Sapiens
SVHVHLEMS

SEQ ID NO: 728734 - protein, 9 aa, Homo Sapiens
LLRSSDNSL

SEQ ID NO: 728735 - protein, 9 aa, Homo Sapiens
EVVHVDEGV

SEQ ID NO: 728736 - protein, 9 aa, Homo Sapiens
EGQRRDPAL

SEQ ID NO: 728737 - protein, 9 aa, Homo Sapiens
KECKMRKTA

SEQ ID NO: 728738 - protein, 9 aa, Homo Sapiens
ETNYRLKKE

SEQ ID NO: 728739 - protein, 9 aa, Homo Sapiens
CIAGFHTNP

SEQ ID NO: 728740 - protein, 9 aa, Homo Sapiens
WREEKCELP

SEQ ID NO: 728741 - protein, 9 aa, Homo Sapiens
IPGFVEVTL

SEQ ID NO: 728742 - protein, 9 aa, Homo Sapiens
LSFPEHVAV

SEQ ID NO: 728743 - protein, 9 aa, Homo Sapiens
KVLLLQAEL

SEQ ID NO: 728744 - protein, 9 aa, Homo Sapiens
TYTDPNENF

SEQ ID NO: 728745 - protein, 9 aa, Homo Sapiens
TMKMSHAPP

SEQ ID NO: 728746 - protein, 9 aa, Homo Sapiens
ARPQRLPPA

SEQ ID NO: 728747 - protein, 9 aa, Homo Sapiens
KKGGGSSCS

SEQ ID NO: 728748 - protein, 9 aa, Homo Sapiens
QSCSRCDDN

SEQ ID NO: 728749 - protein, 9 aa, Homo Sapiens
PQAAGSPRW

SEQ ID NO: 728750 - protein, 9 aa, Homo Sapiens
VCKDKLSAQ

SEQ ID NO: 728751 - protein, 9 aa, Homo Sapiens
GISWGVGFI

SEQ ID NO: 728752 - protein, 9 aa, Homo Sapiens
SVQGTGLIH

SEQ ID NO: 728753 - protein, 9 aa, Homo Sapiens
TLRSMAGGM

SEQ ID NO: 728754 - protein, 9 aa, Homo Sapiens
IADFRFLRI

SEQ ID NO: 728755 - protein, 9 aa, Homo Sapiens
RALLSLRTV

SEQ ID NO: 728756 - protein, 9 aa, Homo Sapiens
PCFLYSVQN

SEQ ID NO: 728757 - protein, 9 aa, Homo Sapiens
HGRPVTMYM

SEQ ID NO: 728758 - protein, 9 aa, Homo Sapiens
NLRPQDNAS

SEQ ID NO: 728759 - protein, 9 aa, Homo Sapiens
IKSLDDTSN

SEQ ID NO: 728760 - protein, 9 aa, Homo Sapiens
MNYTTVWIS

SEQ ID NO: 728761 - protein, 9 aa, Homo Sapiens
THSDYQCSQ

SEQ ID NO: 728762 - protein, 9 aa, Homo Sapiens
KGSARFDRP

SEQ ID NO: 728763 - protein, 9 aa, Homo Sapiens
LVPCFLYSV

SEQ ID NO: 728764 - protein, 9 aa, Homo Sapiens
EDKYRKMNE

SEQ ID NO: 728765 - protein, 9 aa, Homo Sapiens
KLPLHHYTY

SEQ ID NO: 728766 - protein, 9 aa, Homo Sapiens
KKEMFHATV

SEQ ID NO: 728767 - protein, 9 aa, Homo Sapiens
RQFNGIVAL

SEQ ID NO: 728768 - protein, 9 aa, Homo Sapiens
REEYDLSDC

SEQ ID NO: 728769 - protein, 9 aa, Homo Sapiens
CQYYKFLAE

SEQ ID NO: 728770 - protein, 9 aa, Homo Sapiens
VTPITLLLN

SEQ ID NO: 728771 - protein, 9 aa, Homo Sapiens
FPEHVAVPP

SEQ ID NO: 728772 - protein, 9 aa, Homo Sapiens
YEDKTTNML

SEQ ID NO: 728773 - protein, 9 aa, Homo Sapiens
KTIFGSIPY

SEQ ID NO: 728774 - protein, 9 aa, Homo Sapiens
LDHETFLSF

SEQ ID NO: 728775 - protein, 9 aa, Homo Sapiens
FLSLLELGF

SEQ ID NO: 728776 - protein, 9 aa, Homo Sapiens
TITEVSERD

SEQ ID NO: 728777 - protein, 9 aa, Homo Sapiens
IPVYRFVLI

SEQ ID NO: 728778 - protein, 9 aa, Homo Sapiens
EEVIIADFR

SEQ ID NO: 728779 - protein, 9 aa, Homo Sapiens
VPGQVLGAL

SEQ ID NO: 728780 - protein, 9 aa, Homo Sapiens
SIPYIFDVH

SEQ ID NO: 728781 - protein, 9 aa, Homo Sapiens
YRKMNEDID

SEQ ID NO: 728782 - protein, 9 aa, Homo Sapiens
KTPCMVRTS

SEQ ID NO: 728783 - protein, 9 aa, Homo Sapiens
CKMRKTAEE

SEQ ID NO: 728784 - protein, 9 aa, Homo Sapiens
TNQKRIHTG

SEQ ID NO: 728785 - protein, 9 aa, Homo Sapiens
DNSLIRQLV

SEQ ID NO: 728786 - protein, 9 aa, Homo Sapiens
VASAGAQHH

SEQ ID NO: 728787 - protein, 9 aa, Homo Sapiens
EIDLLTKRD

SEQ ID NO: 728788 - protein, 9 aa, Homo Sapiens
AILTFHLHY

SEQ ID NO: 728789 - protein, 9 aa, Homo Sapiens
IPDSISVIQ

SEQ ID NO: 728790 - protein, 9 aa, Homo Sapiens
IDNVCIICR

SEQ ID NO: 728791 - protein, 9 aa, Homo Sapiens
SDNSLIRQL

SEQ ID NO: 728792 - protein, 9 aa, Homo Sapiens
QNSTFENQY

SEQ ID NO: 728793 - protein, 9 aa, Homo Sapiens
SSMPYVETQ

SEQ ID NO: 728794 - protein, 9 aa, Homo Sapiens
TDWGETQGT

SEQ ID NO: 728795 - protein, 9 aa, Homo Sapiens
CKKCRADRQ

SEQ ID NO: 728796 - protein, 9 aa, Homo Sapiens
ERYTPLDYF

SEQ ID NO: 728797 - protein, 9 aa, Homo Sapiens
SLIRQLVNH

SEQ ID NO: 728798 - protein, 9 aa, Homo Sapiens
QRQRLFPQP

SEQ ID NO: 728799 - protein, 9 aa, Homo Sapiens
DSTSVSALA

SEQ ID NO: 728800 - protein, 9 aa, Homo Sapiens
FFCDVQAMV

SEQ ID NO: 728801 - protein, 9 aa, Homo Sapiens
LVSPISESM

SEQ ID NO: 728802 - protein, 9 aa, Homo Sapiens
VLVFLLVPA

SEQ ID NO: 728803 - protein, 9 aa, Homo Sapiens
FLSFPEHVA

SEQ ID NO: 728804 - protein, 9 aa, Homo Sapiens
DEGPDTPGY

SEQ ID NO: 728805 - protein, 9 aa, Homo Sapiens
KRKSKTPCM

SEQ ID NO: 728806 - protein, 9 aa, Homo Sapiens
VTDEAAHPV

SEQ ID NO: 728807 - protein, 9 aa, Homo Sapiens
RNNLINYSV

SEQ ID NO: 728808 - protein, 9 aa, Homo Sapiens
PHFTMTPEA

SEQ ID NO: 728809 - protein, 9 aa, Homo Sapiens
YRCNECAKA

SEQ ID NO: 728810 - protein, 9 aa, Homo Sapiens
RSVLYATVR

SEQ ID NO: 728811 - protein, 9 aa, Homo Sapiens
RERPPGADP

SEQ ID NO: 728812 - protein, 9 aa, Homo Sapiens
LHGRPVTMY

SEQ ID NO: 728813 - protein, 9 aa, Homo Sapiens
SLPPPQAAG

SEQ ID NO: 728814 - protein, 9 aa, Homo Sapiens
DSDSLHKHA

SEQ ID NO: 728815 - protein, 9 aa, Homo Sapiens
CDIMYGIED

SEQ ID NO: 728816 - protein, 9 aa, Homo Sapiens
EFWLWMKGV

SEQ ID NO: 728817 - protein, 9 aa, Homo Sapiens
SGASILPEH

SEQ ID NO: 728818 - protein, 9 aa, Homo Sapiens
AVVAWCLLA

SEQ ID NO: 728819 - protein, 9 aa, Homo Sapiens
YTVRLWSLT

SEQ ID NO: 728820 - protein, 9 aa, Homo Sapiens
HTNPEGSQK

SEQ ID NO: 728821 - protein, 9 aa, Homo Sapiens
DIMYGIEDT

SEQ ID NO: 728822 - protein, 9 aa, Homo Sapiens
LLQAELEKL

SEQ ID NO: 728823 - protein, 9 aa, Homo Sapiens
ALLRGEMFV

SEQ ID NO: 728824 - protein, 9 aa, Homo Sapiens
EEKWAFDSA

SEQ ID NO: 728825 - protein, 9 aa, Homo Sapiens
RNRQSEAAN

SEQ ID NO: 728826 - protein, 9 aa, Homo Sapiens
SRDYTVRLW

SEQ ID NO: 728827 - protein, 9 aa, Homo Sapiens
KQRQRLFPQ

SEQ ID NO: 728828 - protein, 9 aa, Homo Sapiens
SEAANSNPS

SEQ ID NO: 728829 - protein, 9 aa, Homo Sapiens
YGLFIIGWM

SEQ ID NO: 728830 - protein, 9 aa, Homo Sapiens
FLTYTDPNE

SEQ ID NO: 728831 - protein, 9 aa, Homo Sapiens
PNIPKEQTQ

SEQ ID NO: 728832 - protein, 9 aa, Homo Sapiens
CFTRGSWGF

SEQ ID NO: 728833 - protein, 9 aa, Homo Sapiens
RRDPALRLL

SEQ ID NO: 728834 - protein, 9 aa, Homo Sapiens
AHPVPSQIQ

SEQ ID NO: 728835 - protein, 9 aa, Homo Sapiens
SKETFFTCL

SEQ ID NO: 728836 - protein, 9 aa, Homo Sapiens
TSTTENTTR

SEQ ID NO: 728837 - protein, 9 aa, Homo Sapiens
YTPLDYFAW

SEQ ID NO: 728838 - protein, 9 aa, Homo Sapiens
ARSLVAGGP

SEQ ID NO: 728839 - protein, 9 aa, Homo Sapiens
ILSSEVSGK

SEQ ID NO: 728840 - protein, 9 aa, Homo Sapiens
ESKETFFTC

SEQ ID NO: 728841 - protein, 9 aa, Homo Sapiens
QLQLDEGTG

SEQ ID NO: 728842 - protein, 9 aa, Homo Sapiens
AALVSPISE

SEQ ID NO: 728843 - protein, 9 aa, Homo Sapiens
QCPAEGARP

SEQ ID NO: 728844 - protein, 9 aa, Homo Sapiens
LDCDTADKF

SEQ ID NO: 728845 - protein, 9 aa, Homo Sapiens
TQEGKKEMF

SEQ ID NO: 728846 - protein, 9 aa, Homo Sapiens
EQTQAGTSN

SEQ ID NO: 728847 - protein, 9 aa, Homo Sapiens
LLLLLIYLI

SEQ ID NO: 728848 - protein, 9 aa, Homo Sapiens
SKTPCMVRT

SEQ ID NO: 728849 - protein, 9 aa, Homo Sapiens
SMPYVETQS

SEQ ID NO: 728850 - protein, 9 aa, Homo Sapiens
PGLQGVPPQ

SEQ ID NO: 728851 - protein, 9 aa, Homo Sapiens
HQKIYHFFC

SEQ ID NO: 728852 - protein, 9 aa, Homo Sapiens
RTVAQEITD

SEQ ID NO: 728853 - protein, 9 aa, Homo Sapiens
EPGPEGTSP

SEQ ID NO: 728854 - protein, 9 aa, Homo Sapiens
QRLPPAKVA

SEQ ID NO: 728855 - protein, 9 aa, Homo Sapiens
ILSDEDIGV

SEQ ID NO: 728856 - protein, 9 aa, Homo Sapiens
THKKSLVER

SEQ ID NO: 728857 - protein, 9 aa, Homo Sapiens
TNMLEKIST

SEQ ID NO: 728858 - protein, 9 aa, Homo Sapiens
GHCYKPYIQ

SEQ ID NO: 728859 - protein, 9 aa, Homo Sapiens
EGQVELVPG

SEQ ID NO: 728860 - protein, 9 aa, Homo Sapiens
NQKRIHTGE

SEQ ID NO: 728861 - protein, 9 aa, Homo Sapiens
EIVPPASLD

SEQ ID NO: 728862 - protein, 9 aa, Homo Sapiens
TNVNYKLPL

SEQ ID NO: 728863 - protein, 9 aa, Homo Sapiens
QHQLLDGVD

SEQ ID NO: 728864 - protein, 9 aa, Homo Sapiens
EEHEEEGIN

SEQ ID NO: 728865 - protein, 9 aa, Homo Sapiens
IIADFRFLR

SEQ ID NO: 728866 - protein, 9 aa, Homo Sapiens
IEVRICFVA

SEQ ID NO: 728867 - protein, 9 aa, Homo Sapiens
RSGKRVTTW

SEQ ID NO: 728868 - protein, 9 aa, Homo Sapiens
LVPGQRLHH

SEQ ID NO: 728869 - protein, 9 aa, Homo Sapiens
GQGLVGASV

SEQ ID NO: 728870 - protein, 9 aa, Homo Sapiens
NFNTVALLR

SEQ ID NO: 728871 - protein, 9 aa, Homo Sapiens
LKVWKLEWP

SEQ ID NO: 728872 - protein, 9 aa, Homo Sapiens
EEGINIYCL

SEQ ID NO: 728873 - protein, 9 aa, Homo Sapiens
DGASAFSTI

SEQ ID NO: 728874 - protein, 9 aa, Homo Sapiens
YPGMTYKLR

SEQ ID NO: 728875 - protein, 9 aa, Homo Sapiens
PSDFTMNYT

SEQ ID NO: 728876 - protein, 9 aa, Homo Sapiens
GDSDSLHKH

SEQ ID NO: 728877 - protein, 9 aa, Homo Sapiens
IYSPYMSEV

SEQ ID NO: 728878 - protein, 9 aa, Homo Sapiens
EHCVEGDIA

SEQ ID NO: 728879 - protein, 9 aa, Homo Sapiens
LLQSSVITL

SEQ ID NO: 728880 - protein, 9 aa, Homo Sapiens
HSSNQLHHI

SEQ ID NO: 728881 - protein, 9 aa, Homo Sapiens
KCFSAIGCA

SEQ ID NO: 728882 - protein, 9 aa, Homo Sapiens
PRQFNGIVA

SEQ ID NO: 728883 - protein, 9 aa, Homo Sapiens
FVCKDKLSA

SEQ ID NO: 728884 - protein, 9 aa, Homo Sapiens
EETNYRLKK

SEQ ID NO: 728885 - protein, 9 aa, Homo Sapiens
ISWGVGFIR

SEQ ID NO: 728886 - protein, 9 aa, Homo Sapiens
ANVTGTVAN

SEQ ID NO: 728887 - protein, 9 aa, Homo Sapiens
NQQKLLKLA

SEQ ID NO: 728888 - protein, 9 aa, Homo Sapiens
KSCECAEFG

SEQ ID NO: 728889 - protein, 9 aa, Homo Sapiens
VSPFSNLTW

SEQ ID NO: 728890 - protein, 9 aa, Homo Sapiens
HEEEGINIY

SEQ ID NO: 728891 - protein, 9 aa, Homo Sapiens
NYRLKKELL

SEQ ID NO: 728892 - protein, 9 aa, Homo Sapiens
SSSVESSGG

SEQ ID NO: 728893 - protein, 9 aa, Homo Sapiens
WEEDAEKRP

SEQ ID NO: 728894 - protein, 9 aa, Homo Sapiens
FSTIAIQLA

SEQ ID NO: 728895 - protein, 9 aa, Homo Sapiens
AAMFYLLKP

SEQ ID NO: 728896 - protein, 9 aa, Homo Sapiens
GVGWQEPLV

SEQ ID NO: 728897 - protein, 9 aa, Homo Sapiens
GTLYIFWKE

SEQ ID NO: 728898 - protein, 9 aa, Homo Sapiens
LDDTSNETI

SEQ ID NO: 728899 - protein, 9 aa, Homo Sapiens
RMNVGLDKL

SEQ ID NO: 728900 - protein, 9 aa, Homo Sapiens
DLSDCAVPI

SEQ ID NO: 728901 - protein, 9 aa, Homo Sapiens
NLASGGASG

SEQ ID NO: 728902 - protein, 9 aa, Homo Sapiens
DGPNPVVQS

SEQ ID NO: 728903 - protein, 9 aa, Homo Sapiens
IPASSPAAI

SEQ ID NO: 728904 - protein, 9 aa, Homo Sapiens
ERVLRIFLM

SEQ ID NO: 728905 - protein, 9 aa, Homo Sapiens
GGPSSLWSC

SEQ ID NO: 728906 - protein, 9 aa, Homo Sapiens
FQDTFLASN

SEQ ID NO: 728907 - protein, 9 aa, Homo Sapiens
ACPGTLKAI

SEQ ID NO: 728908 - protein, 9 aa, Homo Sapiens
GNGAVIIIF

SEQ ID NO: 728909 - protein, 9 aa, Homo Sapiens
SHTWSLELS

SEQ ID NO: 728910 - protein, 9 aa, Homo Sapiens
SNKIFMLFW

SEQ ID NO: 728911 - protein, 9 aa, Homo Sapiens
YICLATKKV

SEQ ID NO: 728912 - protein, 9 aa, Homo Sapiens
KLAAEDFKL

SEQ ID NO: 728913 - protein, 9 aa, Homo Sapiens
CPLVGNCVG

SEQ ID NO: 728914 - protein, 9 aa, Homo Sapiens
SGHHSGGCC

SEQ ID NO: 728915 - protein, 9 aa, Homo Sapiens
PKSNHSLDK

SEQ ID NO: 728916 - protein, 9 aa, Homo Sapiens
SAQGGKNTG

SEQ ID NO: 728917 - protein, 9 aa, Homo Sapiens
LQALLFLTF

SEQ ID NO: 728918 - protein, 9 aa, Homo Sapiens
PVPAMSRNQ

SEQ ID NO: 728919 - protein, 9 aa, Homo Sapiens
KEPEALTIR

SEQ ID NO: 728920 - protein, 9 aa, Homo Sapiens
KDKRRELGD

SEQ ID NO: 728921 - protein, 9 aa, Homo Sapiens
KSFKTQKAM

SEQ ID NO: 728922 - protein, 9 aa, Homo Sapiens
TMEKVLIHL

SEQ ID NO: 728923 - protein, 9 aa, Homo Sapiens
FSFVFFYTQ

SEQ ID NO: 728924 - protein, 9 aa, Homo Sapiens
NEDTPPQEH

SEQ ID NO: 728925 - protein, 9 aa, Homo Sapiens
CSSSALEDR

SEQ ID NO: 728926 - protein, 9 aa, Homo Sapiens
SSSALEDRF

SEQ ID NO: 728927 - protein, 9 aa, Homo Sapiens
YQMDVQAMD

SEQ ID NO: 728928 - protein, 9 aa, Homo Sapiens
TTNPTTGLS

SEQ ID NO: 728929 - protein, 9 aa, Homo Sapiens
GSTWDATTY

SEQ ID NO: 728930 - protein, 9 aa, Homo Sapiens
MGRIGIPSQ

SEQ ID NO: 728931 - protein, 9 aa, Homo Sapiens
SKAMSVLPE

SEQ ID NO: 728932 - protein, 9 aa, Homo Sapiens
FKLKYETER

SEQ ID NO: 728933 - protein, 9 aa, Homo Sapiens
KLKYETERG

SEQ ID NO: 728934 - protein, 9 aa, Homo Sapiens
ASEYGILEA

SEQ ID NO: 728935 - protein, 9 aa, Homo Sapiens
SVALKEEVA

SEQ ID NO: 728936 - protein, 9 aa, Homo Sapiens
PDDFNVWIG

SEQ ID NO: 728937 - protein, 9 aa, Homo Sapiens
HKVLSDIEL

SEQ ID NO: 728938 - protein, 9 aa, Homo Sapiens
EPTFKRSQS

SEQ ID NO: 728939 - protein, 9 aa, Homo Sapiens
RYVAVSDRL

SEQ ID NO: 728940 - protein, 9 aa, Homo Sapiens
QPGRGYLVS

SEQ ID NO: 728941 - protein, 9 aa, Homo Sapiens
GTVIVNIGR

SEQ ID NO: 728942 - protein, 9 aa, Homo Sapiens
SALAPKKGS

SEQ ID NO: 728943 - protein, 9 aa, Homo Sapiens
ECQFAVPVT

SEQ ID NO: 728944 - protein, 9 aa, Homo Sapiens
PADVEVWAG

SEQ ID NO: 728945 - protein, 9 aa, Homo Sapiens
TSPFQPGRG

SEQ ID NO: 728946 - protein, 9 aa, Homo Sapiens
PFRKEPDLW

SEQ ID NO: 728947 - protein, 9 aa, Homo Sapiens
HLGLNLGGA

SEQ ID NO: 728948 - protein, 9 aa, Homo Sapiens
SSDVLARQF

SEQ ID NO: 728949 - protein, 9 aa, Homo Sapiens
NSMLCVFQI

SEQ ID NO: 728950 - protein, 9 aa, Homo Sapiens
MEKVLIHLS

SEQ ID NO: 728951 - protein, 9 aa, Homo Sapiens
LSESLTSDS

SEQ ID NO: 728952 - protein, 9 aa, Homo Sapiens
KSYVTGCAI

SEQ ID NO: 728953 - protein, 9 aa, Homo Sapiens
LAKFSPYLS

SEQ ID NO: 728954 - protein, 9 aa, Homo Sapiens
LFGEKITSS

SEQ ID NO: 728955 - protein, 9 aa, Homo Sapiens
TSSTISGVY

SEQ ID NO: 728956 - protein, 9 aa, Homo Sapiens
LSFEVPCDQ

SEQ ID NO: 728957 - protein, 9 aa, Homo Sapiens
LKGENKNLQ

SEQ ID NO: 728958 - protein, 9 aa, Homo Sapiens
QFLISWPRL

SEQ ID NO: 728959 - protein, 9 aa, Homo Sapiens
PEKEHEEMD

SEQ ID NO: 728960 - protein, 9 aa, Homo Sapiens
FLTFLGIYL

SEQ ID NO: 728961 - protein, 9 aa, Homo Sapiens
FRHSMTHIA

SEQ ID NO: 728962 - protein, 9 aa, Homo Sapiens
TSQRYSNGI

SEQ ID NO: 728963 - protein, 9 aa, Homo Sapiens
EHNKQVEPL

SEQ ID NO: 728964 - protein, 9 aa, Homo Sapiens
ADGLFFQGN

SEQ ID NO: 728965 - protein, 9 aa, Homo Sapiens
NECKTLQGV

SEQ ID NO: 728966 - protein, 9 aa, Homo Sapiens
FKQMESAQE

SEQ ID NO: 728967 - protein, 9 aa, Homo Sapiens
GIWLSRYKK

SEQ ID NO: 728968 - protein, 9 aa, Homo Sapiens
TTHKSIHTE

SEQ ID NO: 728969 - protein, 9 aa, Homo Sapiens
ADINAKNTV

SEQ ID NO: 728970 - protein, 9 aa, Homo Sapiens
GRNCVYENE

SEQ ID NO: 728971 - protein, 9 aa, Homo Sapiens
SLFRSPEEQ

SEQ ID NO: 728972 - protein, 9 aa, Homo Sapiens
RDLKPVNIL

SEQ ID NO: 728973 - protein, 9 aa, Homo Sapiens
HKNRSPTKY

SEQ ID NO: 728974 - protein, 9 aa, Homo Sapiens
TRVRHRMNI

SEQ ID NO: 728975 - protein, 9 aa, Homo Sapiens
TSSGSSDAE

SEQ ID NO: 728976 - protein, 9 aa, Homo Sapiens
CHIGYLYVD

SEQ ID NO: 728977 - protein, 9 aa, Homo Sapiens
NLDLTGQTM

SEQ ID NO: 728978 - protein, 9 aa, Homo Sapiens
VRDIKDHAP

SEQ ID NO: 728979 - protein, 9 aa, Homo Sapiens
LFQIHERMH

SEQ ID NO: 728980 - protein, 9 aa, Homo Sapiens
ISGVYAEYA

SEQ ID NO: 728981 - protein, 9 aa, Homo Sapiens
LCTNWISRD

SEQ ID NO: 728982 - protein, 9 aa, Homo Sapiens
CGLKKLRIL

SEQ ID NO: 728983 - protein, 9 aa, Homo Sapiens
TMIKIGQFH

SEQ ID NO: 728984 - protein, 9 aa, Homo Sapiens
KSINYGFIS

SEQ ID NO: 728985 - protein, 9 aa, Homo Sapiens
KKVDEHQTF

SEQ ID NO: 728986 - protein, 9 aa, Homo Sapiens
KDHAPEFPA

SEQ ID NO: 728987 - protein, 9 aa, Homo Sapiens
VLCAFAKKH

SEQ ID NO: 728988 - protein, 9 aa, Homo Sapiens
CFKQTMEKV

SEQ ID NO: 728989 - protein, 9 aa, Homo Sapiens
YHSVVSCAP

SEQ ID NO: 728990 - protein, 9 aa, Homo Sapiens
VPCSKTINR

SEQ ID NO: 728991 - protein, 9 aa, Homo Sapiens
PFGLELRVA

SEQ ID NO: 728992 - protein, 9 aa, Homo Sapiens
NVSFSIQLW

SEQ ID NO: 728993 - protein, 9 aa, Homo Sapiens
SCWFPSSKL

SEQ ID NO: 728994 - protein, 9 aa, Homo Sapiens
NRSPTKYMD

SEQ ID NO: 728995 - protein, 9 aa, Homo Sapiens
AKSRRLELE

SEQ ID NO: 728996 - protein, 9 aa, Homo Sapiens
SNYPPFCLG

SEQ ID NO: 728997 - protein, 9 aa, Homo Sapiens
CQVIGFQDT

SEQ ID NO: 728998 - protein, 9 aa, Homo Sapiens
KPEEEVARL

SEQ ID NO: 728999 - protein, 9 aa, Homo Sapiens
AAMAPSTAM

SEQ ID NO: 729000 - protein, 9 aa, Homo Sapiens
SPTPRAPPT

SEQ ID NO: 729001 - protein, 9 aa, Homo Sapiens
SGVYAEYAL

SEQ ID NO: 729002 - protein, 9 aa, Homo Sapiens
QFYGEGGWR

SEQ ID NO: 729003 - protein, 9 aa, Homo Sapiens
QIANCHLSR

SEQ ID NO: 729004 - protein, 9 aa, Homo Sapiens
PLPSPEPSN

SEQ ID NO: 729005 - protein, 9 aa, Homo Sapiens
RLDANRLSN

SEQ ID NO: 729006 - protein, 9 aa, Homo Sapiens
ANEAHFSAN

SEQ ID NO: 729007 - protein, 9 aa, Homo Sapiens
NYIRLFVQH

SEQ ID NO: 729008 - protein, 9 aa, Homo Sapiens
AIWTLLGTV

SEQ ID NO: 729009 - protein, 9 aa, Homo Sapiens
VEKTYKCEE

SEQ ID NO: 729010 - protein, 9 aa, Homo Sapiens
GRAIQGATS

SEQ ID NO: 729011 - protein, 9 aa, Homo Sapiens
LLKIQCQEG

SEQ ID NO: 729012 - protein, 9 aa, Homo Sapiens
SNFSLFQIH

SEQ ID NO: 729013 - protein, 9 aa, Homo Sapiens
QANIAELSH

SEQ ID NO: 729014 - protein, 9 aa, Homo Sapiens
SGNNVLAHG

SEQ ID NO: 729015 - protein, 9 aa, Homo Sapiens
LLPADGLFF

SEQ ID NO: 729016 - protein, 9 aa, Homo Sapiens
ALKEEVAIL

SEQ ID NO: 729017 - protein, 9 aa, Homo Sapiens
RSSGHLTSV

SEQ ID NO: 729018 - protein, 9 aa, Homo Sapiens
WIAECIAQC

SEQ ID NO: 729019 - protein, 9 aa, Homo Sapiens
IIIDCGEQR

SEQ ID NO: 729020 - protein, 9 aa, Homo Sapiens
FQPQSLEFT

SEQ ID NO: 729021 - protein, 9 aa, Homo Sapiens
PCIELLVVV

SEQ ID NO: 729022 - protein, 9 aa, Homo Sapiens
AMAPSTAMS

SEQ ID NO: 729023 - protein, 9 aa, Homo Sapiens
EPEALTIRG

SEQ ID NO: 729024 - protein, 9 aa, Homo Sapiens
FLAHGAVLA

SEQ ID NO: 729025 - protein, 9 aa, Homo Sapiens
DQLETLKGE

SEQ ID NO: 729026 - protein, 9 aa, Homo Sapiens
AIACLQRAF

SEQ ID NO: 729027 - protein, 9 aa, Homo Sapiens
RKEPDLWEL

SEQ ID NO: 729028 - protein, 9 aa, Homo Sapiens
YSALNPREL

SEQ ID NO: 729029 - protein, 9 aa, Homo Sapiens
QGAQPIFVQ

SEQ ID NO: 729030 - protein, 9 aa, Homo Sapiens
LMSEFIFPT

SEQ ID NO: 729031 - protein, 9 aa, Homo Sapiens
DTVFKQMES

SEQ ID NO: 729032 - protein, 9 aa, Homo Sapiens
NWKIQKIAY

SEQ ID NO: 729033 - protein, 9 aa, Homo Sapiens
SGLSTNRHV

SEQ ID NO: 729034 - protein, 9 aa, Homo Sapiens
RSQSSHQRP

SEQ ID NO: 729035 - protein, 9 aa, Homo Sapiens
IPSQALGIA

SEQ ID NO: 729036 - protein, 9 aa, Homo Sapiens
RNQDHNLLS

SEQ ID NO: 729037 - protein, 9 aa, Homo Sapiens
SWFSPPPPG

SEQ ID NO: 729038 - protein, 9 aa, Homo Sapiens
TNEAALQKM

SEQ ID NO: 729039 - protein, 9 aa, Homo Sapiens
RQHRQIAIH

SEQ ID NO: 729040 - protein, 9 aa, Homo Sapiens
IFCPSPPLF

SEQ ID NO: 729041 - protein, 9 aa, Homo Sapiens
IDLGVTRVR

SEQ ID NO: 729042 - protein, 9 aa, Homo Sapiens
ALEILQAAN

SEQ ID NO: 729043 - protein, 9 aa, Homo Sapiens
HGLVMPVDA

SEQ ID NO: 729044 - protein, 9 aa, Homo Sapiens
AYFTSVLTT

SEQ ID NO: 729045 - protein, 9 aa, Homo Sapiens
VSRSWNELH

SEQ ID NO: 729046 - protein, 9 aa, Homo Sapiens
RTHTGGKLY

SEQ ID NO: 729047 - protein, 9 aa, Homo Sapiens
HSVVSCAPV

SEQ ID NO: 729048 - protein, 9 aa, Homo Sapiens
RLSNKIFML

SEQ ID NO: 729049 - protein, 9 aa, Homo Sapiens
LYYNDEQYE

SEQ ID NO: 729050 - protein, 9 aa, Homo Sapiens
IELLKDPRN

SEQ ID NO: 729051 - protein, 9 aa, Homo Sapiens
LFVQHEQLL

SEQ ID NO: 729052 - protein, 9 aa, Homo Sapiens
GPLGGPSSL

SEQ ID NO: 729053 - protein, 9 aa, Homo Sapiens
PGHLGIPGR

SEQ ID NO: 729054 - protein, 9 aa, Homo Sapiens
VIQKKWRDY

SEQ ID NO: 729055 - protein, 9 aa, Homo Sapiens
LGTGYIFSA

SEQ ID NO: 729056 - protein, 9 aa, Homo Sapiens
VHSSSGAIW

SEQ ID NO: 729057 - protein, 9 aa, Homo Sapiens
PAMSRNQDH

SEQ ID NO: 729058 - protein, 9 aa, Homo Sapiens
RNGDLVNPP

SEQ ID NO: 729059 - protein, 9 aa, Homo Sapiens
QSLGSSMYF

SEQ ID NO: 729060 - protein, 9 aa, Homo Sapiens
TSVLTTIGN

SEQ ID NO: 729061 - protein, 9 aa, Homo Sapiens
TWSLELSES

SEQ ID NO: 729062 - protein, 9 aa, Homo Sapiens
ELIRDSLIS

SEQ ID NO: 729063 - protein, 9 aa, Homo Sapiens
NTLQKNVNK

SEQ ID NO: 729064 - protein, 9 aa, Homo Sapiens
KDRCTLAVK

SEQ ID NO: 729065 - protein, 9 aa, Homo Sapiens
HSNSRSHSS

SEQ ID NO: 729066 - protein, 9 aa, Homo Sapiens
VSRKQLLDW

SEQ ID NO: 729067 - protein, 9 aa, Homo Sapiens
TKQEKDFLW

SEQ ID NO: 729068 - protein, 9 aa, Homo Sapiens
PNGSSDTGM

SEQ ID NO: 729069 - protein, 9 aa, Homo Sapiens
PSLRKRLGS

SEQ ID NO: 729070 - protein, 9 aa, Homo Sapiens
ECKTLQGVC

SEQ ID NO: 729071 - protein, 9 aa, Homo Sapiens
VNEQQETKK

SEQ ID NO: 729072 - protein, 9 aa, Homo Sapiens
GGKNTGISG

SEQ ID NO: 729073 - protein, 9 aa, Homo Sapiens
FAKKHKRTP

SEQ ID NO: 729074 - protein, 9 aa, Homo Sapiens
RIQLFLDLS

SEQ ID NO: 729075 - protein, 9 aa, Homo Sapiens
GSGSPVPTR

SEQ ID NO: 729076 - protein, 9 aa, Homo Sapiens
GSTQFLAHG

SEQ ID NO: 729077 - protein, 9 aa, Homo Sapiens
TLQKNVNKY

SEQ ID NO: 729078 - protein, 9 aa, Homo Sapiens
FLLNTLQKN

SEQ ID NO: 729079 - protein, 9 aa, Homo Sapiens
SSKLQDPSL

SEQ ID NO: 729080 - protein, 9 aa, Homo Sapiens
STAMSVVSD

SEQ ID NO: 729081 - protein, 9 aa, Homo Sapiens
IDLAVSREV

SEQ ID NO: 729082 - protein, 9 aa, Homo Sapiens
ILFGEKITS

SEQ ID NO: 729083 - protein, 9 aa, Homo Sapiens
ILLFLNILE

SEQ ID NO: 729084 - protein, 9 aa, Homo Sapiens
MHGEANITG

SEQ ID NO: 729085 - protein, 9 aa, Homo Sapiens
TILEAATIL

SEQ ID NO: 729086 - protein, 9 aa, Homo Sapiens
RGQQGMFVQ

SEQ ID NO: 729087 - protein, 9 aa, Homo Sapiens
SYVTGCAIH

SEQ ID NO: 729088 - protein, 9 aa, Homo Sapiens
REKLKKAKS

SEQ ID NO: 729089 - protein, 9 aa, Homo Sapiens
NKLLKIQCQ

SEQ ID NO: 729090 - protein, 9 aa, Homo Sapiens
TAMSVVSDS

SEQ ID NO: 729091 - protein, 9 aa, Homo Sapiens
RDIKDHAPE

SEQ ID NO: 729092 - protein, 9 aa, Homo Sapiens
LHGLVMPVD

SEQ ID NO: 729093 - protein, 9 aa, Homo Sapiens
SNVSLAKFR

SEQ ID NO: 729094 - protein, 9 aa, Homo Sapiens
YRILQACTK

SEQ ID NO: 729095 - protein, 9 aa, Homo Sapiens
YFTSVLTTI

SEQ ID NO: 729096 - protein, 9 aa, Homo Sapiens
IQILEKLSK

SEQ ID NO: 729097 - protein, 9 aa, Homo Sapiens
KYRYQNEDT

SEQ ID NO: 729098 - protein, 9 aa, Homo Sapiens
PQLSACGHS

SEQ ID NO: 729099 - protein, 9 aa, Homo Sapiens
AIFRFSATF

SEQ ID NO: 729100 - protein, 9 aa, Homo Sapiens
SCEGPQEES

SEQ ID NO: 729101 - protein, 9 aa, Homo Sapiens
QGDGRNCVY

SEQ ID NO: 729102 - protein, 9 aa, Homo Sapiens
TQGRTLYGF

SEQ ID NO: 729103 - protein, 9 aa, Homo Sapiens
HGIWLSRYK

SEQ ID NO: 729104 - protein, 9 aa, Homo Sapiens
PFRLTHWRT

SEQ ID NO: 729105 - protein, 9 aa, Homo Sapiens
ESGFYQMDV

SEQ ID NO: 729106 - protein, 9 aa, Homo Sapiens
KSALAPKKG

SEQ ID NO: 729107 - protein, 9 aa, Homo Sapiens
DTLYNFLIK

SEQ ID NO: 729108 - protein, 9 aa, Homo Sapiens
NECKGSPLV

SEQ ID NO: 729109 - protein, 9 aa, Homo Sapiens
FPFGLELRV

SEQ ID NO: 729110 - protein, 9 aa, Homo Sapiens
EGPQEESED

SEQ ID NO: 729111 - protein, 9 aa, Homo Sapiens
DFPESNSLK

SEQ ID NO: 729112 - protein, 9 aa, Homo Sapiens
ANCHLSRLM

SEQ ID NO: 729113 - protein, 9 aa, Homo Sapiens
DHDSRYQNH

SEQ ID NO: 729114 - protein, 9 aa, Homo Sapiens
PISEWDEII

SEQ ID NO: 729115 - protein, 9 aa, Homo Sapiens
KGFISFLFF

SEQ ID NO: 729116 - protein, 9 aa, Homo Sapiens
CVLAGAFAT

SEQ ID NO: 729117 - protein, 9 aa, Homo Sapiens
PRRPSNRWL

SEQ ID NO: 729118 - protein, 9 aa, Homo Sapiens
FKQTMEKVL

SEQ ID NO: 729119 - protein, 9 aa, Homo Sapiens
LPPGGPVLS

SEQ ID NO: 729120 - protein, 9 aa, Homo Sapiens
RKRPSFPNF

SEQ ID NO: 729121 - protein, 9 aa, Homo Sapiens
PAELQASIQ

SEQ ID NO: 729122 - protein, 9 aa, Homo Sapiens
LALASFKIP

SEQ ID NO: 729123 - protein, 9 aa, Homo Sapiens
MPRRPSNRW

SEQ ID NO: 729124 - protein, 9 aa, Homo Sapiens
NPPFSLKLS

SEQ ID NO: 729125 - protein, 9 aa, Homo Sapiens
DEAVGKVSR

SEQ ID NO: 729126 - protein, 9 aa, Homo Sapiens
QDTVFKQME

SEQ ID NO: 729127 - protein, 9 aa, Homo Sapiens
KYMDSEEKE

SEQ ID NO: 729128 - protein, 9 aa, Homo Sapiens
GIGWARKTG

SEQ ID NO: 729129 - protein, 9 aa, Homo Sapiens
RNQPYFART

SEQ ID NO: 729130 - protein, 9 aa, Homo Sapiens
SATNEAALQ

SEQ ID NO: 729131 - protein, 9 aa, Homo Sapiens
QRYSNGIQP

SEQ ID NO: 729132 - protein, 9 aa, Homo Sapiens
MDNAVPVVP

SEQ ID NO: 729133 - protein, 9 aa, Homo Sapiens
ESNKHFLWP

SEQ ID NO: 729134 - protein, 9 aa, Homo Sapiens
AASVSQDRA

SEQ ID NO: 729135 - protein, 9 aa, Homo Sapiens
NYKKKRQGK

SEQ ID NO: 729136 - protein, 9 aa, Homo Sapiens
DLGVTRVRH

SEQ ID NO: 729137 - protein, 9 aa, Homo Sapiens
TRASPSCVD

SEQ ID NO: 729138 - protein, 9 aa, Homo Sapiens
LLLGYSALY

SEQ ID NO: 729139 - protein, 9 aa, Homo Sapiens
AHGAVLASC

SEQ ID NO: 729140 - protein, 9 aa, Homo Sapiens
GGKLYECKQ

SEQ ID NO: 729141 - protein, 9 aa, Homo Sapiens
SITDAGGSG

SEQ ID NO: 729142 - protein, 9 aa, Homo Sapiens
ELWDMWHPT

SEQ ID NO: 729143 - protein, 9 aa, Homo Sapiens
SNGIQPSSF

SEQ ID NO: 729144 - protein, 8 aa, Homo Sapiens
ITGVFSMR

SEQ ID NO: 729145 - protein, 9 aa, Homo Sapiens
AAIMQSALA

SEQ ID NO: 729146 - protein, 9 aa, Homo Sapiens
GDLVEKFDL

SEQ ID NO: 729147 - protein, 9 aa, Homo Sapiens
NFTSFLGCQ

SEQ ID NO: 729148 - protein, 9 aa, Homo Sapiens
SLMSEFIFP

SEQ ID NO: 729149 - protein, 9 aa, Homo Sapiens
EMKSPELCT

SEQ ID NO: 729150 - protein, 9 aa, Homo Sapiens
IRKGVAHRF

SEQ ID NO: 729151 - protein, 9 aa, Homo Sapiens
ATPKTEEKD

SEQ ID NO: 729152 - protein, 9 aa, Homo Sapiens
IDGAKKIDT

SEQ ID NO: 729153 - protein, 9 aa, Homo Sapiens
HDSFLYYND

SEQ ID NO: 729154 - protein, 9 aa, Homo Sapiens
TPKFKMPVM

SEQ ID NO: 729155 - protein, 9 aa, Homo Sapiens
SFRVERGIG

SEQ ID NO: 729156 - protein, 9 aa, Homo Sapiens
ILQAANIVR

SEQ ID NO: 729157 - protein, 9 aa, Homo Sapiens
ELQALLFLT

SEQ ID NO: 729158 - protein, 9 aa, Homo Sapiens
LSGPLGGPS

SEQ ID NO: 729159 - protein, 9 aa, Homo Sapiens
LRPTAALQS

SEQ ID NO: 729160 - protein, 9 aa, Homo Sapiens
EFPFGLELR

SEQ ID NO: 729161 - protein, 9 aa, Homo Sapiens
VFKQMESAQ

SEQ ID NO: 729162 - protein, 9 aa, Homo Sapiens
AAIVIQKKW

SEQ ID NO: 729163 - protein, 9 aa, Homo Sapiens
IIYNNADGT

SEQ ID NO: 729164 - protein, 9 aa, Homo Sapiens
PSSVGCCSS

SEQ ID NO: 729165 - protein, 9 aa, Homo Sapiens
SNFLHLKCN

SEQ ID NO: 729166 - protein, 9 aa, Homo Sapiens
DAVPCSKTI

SEQ ID NO: 729167 - protein, 9 aa, Homo Sapiens
LSVFDIDRF

SEQ ID NO: 729168 - protein, 9 aa, Homo Sapiens
NAFFKDKRR

SEQ ID NO: 729169 - protein, 9 aa, Homo Sapiens
NLGWVVGHS

SEQ ID NO: 729170 - protein, 9 aa, Homo Sapiens
RDSTTQKTD

SEQ ID NO: 729171 - protein, 9 aa, Homo Sapiens
LRDSTTQKT

SEQ ID NO: 729172 - protein, 9 aa, Homo Sapiens
INQSQLSAH

SEQ ID NO: 729173 - protein, 9 aa, Homo Sapiens
SACFSFIEG

SEQ ID NO: 729174 - protein, 9 aa, Homo Sapiens
SSDAEQRDP

SEQ ID NO: 729175 - protein, 9 aa, Homo Sapiens
ATSHHLGQN

SEQ ID NO: 729176 - protein, 9 aa, Homo Sapiens
RSPTKYMDS

SEQ ID NO: 729177 - protein, 9 aa, Homo Sapiens
TTQKTDDLL

SEQ ID NO: 729178 - protein, 9 aa, Homo Sapiens
AIEHNKQVE

SEQ ID NO: 729179 - protein, 9 aa, Homo Sapiens
FDLIDKFVH

SEQ ID NO: 729180 - protein, 9 aa, Homo Sapiens
AVESVTERI

SEQ ID NO: 729181 - protein, 9 aa, Homo Sapiens
SSGAIWTLL

SEQ ID NO: 729182 - protein, 9 aa, Homo Sapiens
NKIFMLFWY

SEQ ID NO: 729183 - protein, 9 aa, Homo Sapiens
YTLTTHKSI

SEQ ID NO: 729184 - protein, 9 aa, Homo Sapiens
TPNVSFSIQ

SEQ ID NO: 729185 - protein, 9 aa, Homo Sapiens
GYSALYLCA

SEQ ID NO: 729186 - protein, 9 aa, Homo Sapiens
ANRLSNKIF

SEQ ID NO: 729187 - protein, 9 aa, Homo Sapiens
LDMGRIGIP

SEQ ID NO: 729188 - protein, 9 aa, Homo Sapiens
FHKVLSDIE

SEQ ID NO: 729189 - protein, 9 aa, Homo Sapiens
LKEEVAILD

SEQ ID NO: 729190 - protein, 9 aa, Homo Sapiens
RSPTPRAPP

SEQ ID NO: 729191 - protein, 9 aa, Homo Sapiens
GPSSVGCCS

SEQ ID NO: 729192 - protein, 9 aa, Homo Sapiens
STGSALSGP

SEQ ID NO: 729193 - protein, 9 aa, Homo Sapiens
AEVTERLEE

SEQ ID NO: 729194 - protein, 9 aa, Homo Sapiens
ILELFYYAQ

SEQ ID NO: 729195 - protein, 9 aa, Homo Sapiens
IQCQEGGIW

SEQ ID NO: 729196 - protein, 9 aa, Homo Sapiens
YSNGIQPSS

SEQ ID NO: 729197 - protein, 9 aa, Homo Sapiens
IAELSHANN

SEQ ID NO: 729198 - protein, 9 aa, Homo Sapiens
ATKKVEEQT

SEQ ID NO: 729199 - protein, 9 aa, Homo Sapiens
VALEQSIEL

SEQ ID NO: 729200 - protein, 9 aa, Homo Sapiens
DQLCSSSAL

SEQ ID NO: 729201 - protein, 9 aa, Homo Sapiens
AKEEPKQAY

SEQ ID NO: 729202 - protein, 9 aa, Homo Sapiens
RERSHQSYA

SEQ ID NO: 729203 - protein, 9 aa, Homo Sapiens
YPMFQIHRY

SEQ ID NO: 729204 - protein, 9 aa, Homo Sapiens
SIINECKGS

SEQ ID NO: 729205 - protein, 9 aa, Homo Sapiens
YGILEANHV

SEQ ID NO: 729206 - protein, 9 aa, Homo Sapiens
SRERSSPAS

SEQ ID NO: 729207 - protein, 9 aa, Homo Sapiens
VLSPSTGSA

SEQ ID NO: 729208 - protein, 9 aa, Homo Sapiens
PVYQHTSIT

SEQ ID NO: 729209 - protein, 9 aa, Homo Sapiens
RRPSNRWLR

SEQ ID NO: 729210 - protein, 9 aa, Homo Sapiens
HQSYAKNYS

SEQ ID NO: 729211 - protein, 9 aa, Homo Sapiens
FRKIRLLGR

SEQ ID NO: 729212 - protein, 9 aa, Homo Sapiens
AGAAVLSGQ

SEQ ID NO: 729213 - protein, 9 aa, Homo Sapiens
DIKDHAPEF

SEQ ID NO: 729214 - protein, 9 aa, Homo Sapiens
PAKGPGPAA

SEQ ID NO: 729215 - protein, 9 aa, Homo Sapiens
VAASVSQDR

SEQ ID NO: 729216 - protein, 9 aa, Homo Sapiens
LCVFQITTS

SEQ ID NO: 729217 - protein, 9 aa, Homo Sapiens
CKTLQGVCG

SEQ ID NO: 729218 - protein, 9 aa, Homo Sapiens
HKSIHTEDK

SEQ ID NO: 729219 - protein, 9 aa, Homo Sapiens
SASDCINSV

SEQ ID NO: 729220 - protein, 9 aa, Homo Sapiens
GSCCGPSSV

SEQ ID NO: 729221 - protein, 9 aa, Homo Sapiens
PPPVSSASL

SEQ ID NO: 729222 - protein, 9 aa, Homo Sapiens
AQGGKNTGI

SEQ ID NO: 729223 - protein, 9 aa, Homo Sapiens
SVSQDRAAP

SEQ ID NO: 729224 - protein, 9 aa, Homo Sapiens
NAVPVVPQA

SEQ ID NO: 729225 - protein, 9 aa, Homo Sapiens
VTGCAIHQA

SEQ ID NO: 729226 - protein, 9 aa, Homo Sapiens
RLGSGLSTN

SEQ ID NO: 729227 - protein, 9 aa, Homo Sapiens
TPTINQANI

SEQ ID NO: 729228 - protein, 9 aa, Homo Sapiens
NRLSNKIFM

SEQ ID NO: 729229 - protein, 9 aa, Homo Sapiens
LIAQEINDV

SEQ ID NO: 729230 - protein, 9 aa, Homo Sapiens
ESNSLKLLQ

SEQ ID NO: 729231 - protein, 9 aa, Homo Sapiens
NCQPCRCNS

SEQ ID NO: 729232 - protein, 9 aa, Homo Sapiens
APPQLLIRV

SEQ ID NO: 729233 - protein, 9 aa, Homo Sapiens
CTIVFVSPL

SEQ ID NO: 729234 - protein, 9 aa, Homo Sapiens
SINYGFISA

SEQ ID NO: 729235 - protein, 9 aa, Homo Sapiens
LLGSNDLLA

SEQ ID NO: 729236 - protein, 9 aa, Homo Sapiens
CQEGGIWEQ

SEQ ID NO: 729237 - protein, 9 aa, Homo Sapiens
LAVKLGGSA

SEQ ID NO: 729238 - protein, 9 aa, Homo Sapiens
NAKNTVLLR

SEQ ID NO: 729239 - protein, 9 aa, Homo Sapiens
PEGIVFEAE

SEQ ID NO: 729240 - protein, 9 aa, Homo Sapiens
SIMYLRFSD

SEQ ID NO: 729241 - protein, 9 aa, Homo Sapiens
SFNDSHYGQ

SEQ ID NO: 729242 - protein, 9 aa, Homo Sapiens
YNDEQYEVI

SEQ ID NO: 729243 - protein, 9 aa, Homo Sapiens
QEESEDDSH

SEQ ID NO: 729244 - protein, 9 aa, Homo Sapiens
ICAMNNISR

SEQ ID NO: 729245 - protein, 9 aa, Homo Sapiens
LKPRPKPKE

SEQ ID NO: 729246 - protein, 9 aa, Homo Sapiens
SEGNDQVVT

SEQ ID NO: 729247 - protein, 9 aa, Homo Sapiens
NGYRIIYNN

SEQ ID NO: 729248 - protein, 9 aa, Homo Sapiens
IMYLRFSDT

SEQ ID NO: 729249 - protein, 9 aa, Homo Sapiens
SSTNQSIGG

SEQ ID NO: 729250 - protein, 9 aa, Homo Sapiens
QSQLSAHLG

SEQ ID NO: 729251 - protein, 9 aa, Homo Sapiens
KRRELGDKM

SEQ ID NO: 729252 - protein, 9 aa, Homo Sapiens
HGEQQRRTV

SEQ ID NO: 729253 - protein, 9 aa, Homo Sapiens
LERVMHGEA

SEQ ID NO: 729254 - protein, 9 aa, Homo Sapiens
TVFKQMESA

SEQ ID NO: 729255 - protein, 9 aa, Homo Sapiens
DHHCPLVGN

SEQ ID NO: 729256 - protein, 9 aa, Homo Sapiens
KCESPHCKG

SEQ ID NO: 729257 - protein, 9 aa, Homo Sapiens
WLPQSVYSL

SEQ ID NO: 729258 - protein, 9 aa, Homo Sapiens
QQETKKNSL

SEQ ID NO: 729259 - protein, 9 aa, Homo Sapiens
LWELQLQKA

SEQ ID NO: 729260 - protein, 9 aa, Homo Sapiens
ERLEEFRNE

SEQ ID NO: 729261 - protein, 9 aa, Homo Sapiens
ILMDTEHFQ

SEQ ID NO: 729262 - protein, 9 aa, Homo Sapiens
LDQEGSLEL

SEQ ID NO: 729263 - protein, 9 aa, Homo Sapiens
LRFQSSAVI

SEQ ID NO: 729264 - protein, 9 aa, Homo Sapiens
FQGNDLKID

SEQ ID NO: 729265 - protein, 9 aa, Homo Sapiens
QVRTCMKMT

SEQ ID NO: 729266 - protein, 9 aa, Homo Sapiens
MSRNQDHNL

SEQ ID NO: 729267 - protein, 9 aa, Homo Sapiens
KELVIHILH

SEQ ID NO: 729268 - protein, 9 aa, Homo Sapiens
TLLRDSIKR

SEQ ID NO: 729269 - protein, 9 aa, Homo Sapiens
ASPSCVDAS

SEQ ID NO: 729270 - protein, 9 aa, Homo Sapiens
VSWLRRSPT

SEQ ID NO: 729271 - protein, 9 aa, Homo Sapiens
ALLLGYSAL

SEQ ID NO: 729272 - protein, 9 aa, Homo Sapiens
QDHNLLSQP

SEQ ID NO: 729273 - protein, 9 aa, Homo Sapiens
RQDIDLAVS

SEQ ID NO: 729274 - protein, 9 aa, Homo Sapiens
SCITSFHVT

SEQ ID NO: 729275 - protein, 9 aa, Homo Sapiens
EQNVCVMNL

SEQ ID NO: 729276 - protein, 9 aa, Homo Sapiens
MGRYSAVES

SEQ ID NO: 729277 - protein, 9 aa, Homo Sapiens
SAKNLKNIL

SEQ ID NO: 729278 - protein, 9 aa, Homo Sapiens
PVDAQKKPS

SEQ ID NO: 729279 - protein, 9 aa, Homo Sapiens
PKFKMPVMH

SEQ ID NO: 729280 - protein, 9 aa, Homo Sapiens
VERGIGWAR

SEQ ID NO: 729281 - protein, 9 aa, Homo Sapiens
SCCGPSSVG

SEQ ID NO: 729282 - protein, 9 aa, Homo Sapiens
TVQTVPVYQ

SEQ ID NO: 729283 - protein, 9 aa, Homo Sapiens
PLLATVLFI

SEQ ID NO: 729284 - protein, 9 aa, Homo Sapiens
ETGITLASL

SEQ ID NO: 729285 - protein, 9 aa, Homo Sapiens
RRSPTPRAP

SEQ ID NO: 729286 - protein, 9 aa, Homo Sapiens
RNITPTINQ

SEQ ID NO: 729287 - protein, 9 aa, Homo Sapiens
GLVMPVDAQ

SEQ ID NO: 729288 - protein, 9 aa, Homo Sapiens
GAPSSRERS

SEQ ID NO: 729289 - protein, 9 aa, Homo Sapiens
AKNLKNILE

SEQ ID NO: 729290 - protein, 9 aa, Homo Sapiens
GHPGHLGIP

SEQ ID NO: 729291 - protein, 9 aa, Homo Sapiens
VIGFQDTFL

SEQ ID NO: 729292 - protein, 9 aa, Homo Sapiens
LFLTFLGIY

SEQ ID NO: 729293 - protein, 9 aa, Homo Sapiens
ASFKIPPFE

SEQ ID NO: 729294 - protein, 9 aa, Homo Sapiens
DAQKKPSLT

SEQ ID NO: 729295 - protein, 9 aa, Homo Sapiens
LEGRRLDFN

SEQ ID NO: 729296 - protein, 9 aa, Homo Sapiens
KNRLVVANL

SEQ ID NO: 729297 - protein, 9 aa, Homo Sapiens
SPELCTVDI

SEQ ID NO: 729298 - protein, 9 aa, Homo Sapiens
EGRRLDFNY

SEQ ID NO: 729299 - protein, 9 aa, Homo Sapiens
AAITHIMQQ

SEQ ID NO: 729300 - protein, 9 aa, Homo Sapiens
GLIMLIARQ

SEQ ID NO: 729301 - protein, 9 aa, Homo Sapiens
NSPEKEHEE

SEQ ID NO: 729302 - protein, 9 aa, Homo Sapiens
AMPRRPSNR

SEQ ID NO: 729303 - protein, 9 aa, Homo Sapiens
VTTVGFGDF

SEQ ID NO: 729304 - protein, 9 aa, Homo Sapiens
LQACTKKVD

SEQ ID NO: 729305 - protein, 9 aa, Homo Sapiens
VFQPQSLEF

SEQ ID NO: 729306 - protein, 9 aa, Homo Sapiens
NPCIELLVV

SEQ ID NO: 729307 - protein, 9 aa, Homo Sapiens
SGPDDFNVW

SEQ ID NO: 729308 - protein, 9 aa, Homo Sapiens
IIRLLSKRR

SEQ ID NO: 729309 - protein, 9 aa, Homo Sapiens
TAIEHNKQV

SEQ ID NO: 729310 - protein, 9 aa, Homo Sapiens
PFQPGRGYL

SEQ ID NO: 729311 - protein, 9 aa, Homo Sapiens
QSIATILLF

SEQ ID NO: 729312 - protein, 9 aa, Homo Sapiens
KLKKAKSVQ

SEQ ID NO: 729313 - protein, 9 aa, Homo Sapiens
LRVATRWDI

SEQ ID NO: 729314 - protein, 9 aa, Homo Sapiens
HPVYIVQEI

SEQ ID NO: 729315 - protein, 9 aa, Homo Sapiens
SSGSSDAEQ

SEQ ID NO: 729316 - protein, 9 aa, Homo Sapiens
SEITKQEKD

SEQ ID NO: 729317 - protein, 9 aa, Homo Sapiens
QVEKEFCLL

SEQ ID NO: 729318 - protein, 9 aa, Homo Sapiens
PNPQLLTIL

SEQ ID NO: 729319 - protein, 9 aa, Homo Sapiens
TNTGSTWDA

SEQ ID NO: 729320 - protein, 9 aa, Homo Sapiens
EAHFSANLK

SEQ ID NO: 729321 - protein, 9 aa, Homo Sapiens
MLIARQDYE

SEQ ID NO: 729322 - protein, 9 aa, Homo Sapiens
TFAILAERS

SEQ ID NO: 729323 - protein, 9 aa, Homo Sapiens
YVAVSDRLR

SEQ ID NO: 729324 - protein, 9 aa, Homo Sapiens
EWDEIIQLY

SEQ ID NO: 729325 - protein, 9 aa, Homo Sapiens
STYTSVVIS

SEQ ID NO: 729326 - protein, 9 aa, Homo Sapiens
SGRAIQGAT

SEQ ID NO: 729327 - protein, 9 aa, Homo Sapiens
APTVPADVE

SEQ ID NO: 729328 - protein, 9 aa, Homo Sapiens
NILELFYYA

SEQ ID NO: 729329 - protein, 9 aa, Homo Sapiens
SPSCVDASI

SEQ ID NO: 729330 - protein, 9 aa, Homo Sapiens
APEFFRKIR

SEQ ID NO: 729331 - protein, 9 aa, Homo Sapiens
AELRVWVQL

SEQ ID NO: 729332 - protein, 9 aa, Homo Sapiens
DLVEKFDLI

SEQ ID NO: 729333 - protein, 9 aa, Homo Sapiens
NWLCTNWIS

SEQ ID NO: 729334 - protein, 9 aa, Homo Sapiens
PCSKTINRN

SEQ ID NO: 729335 - protein, 9 aa, Homo Sapiens
DAEKDCRRS

SEQ ID NO: 729336 - protein, 9 aa, Homo Sapiens
FPESNSLKL

SEQ ID NO: 729337 - protein, 9 aa, Homo Sapiens
WLSRYKKMH

SEQ ID NO: 729338 - protein, 9 aa, Homo Sapiens
LPSPEPSNP

SEQ ID NO: 729339 - protein, 9 aa, Homo Sapiens
GHSNSRSHS

SEQ ID NO: 729340 - protein, 9 aa, Homo Sapiens
TNQSIGGVI

SEQ ID NO: 729341 - protein, 9 aa, Homo Sapiens
KNILELFYY

SEQ ID NO: 729342 - protein, 9 aa, Homo Sapiens
NLLASDLPS

SEQ ID NO: 729343 - protein, 9 aa, Homo Sapiens
QHWGPAEDN

SEQ ID NO: 729344 - protein, 9 aa, Homo Sapiens
YHTHLLQFY

SEQ ID NO: 729345 - protein, 9 aa, Homo Sapiens
NPRELWDMW

SEQ ID NO: 729346 - protein, 9 aa, Homo Sapiens
FCKHILQKT

SEQ ID NO: 729347 - protein, 9 aa, Homo Sapiens
CVEKLNDTQ

SEQ ID NO: 729348 - protein, 9 aa, Homo Sapiens
VFEAENKPS

SEQ ID NO: 729349 - protein, 9 aa, Homo Sapiens
ACFSFIEGR

SEQ ID NO: 729350 - protein, 9 aa, Homo Sapiens
PFSNFSLFQ

SEQ ID NO: 729351 - protein, 9 aa, Homo Sapiens
VDSSTNQSI

SEQ ID NO: 729352 - protein, 9 aa, Homo Sapiens
TERQHRQIA

SEQ ID NO: 729353 - protein, 9 aa, Homo Sapiens
RSSSPAHKD

SEQ ID NO: 729354 - protein, 9 aa, Homo Sapiens
FKSYVTGCA

SEQ ID NO: 729355 - protein, 9 aa, Homo Sapiens
VLSGQHEEV

SEQ ID NO: 729356 - protein, 9 aa, Homo Sapiens
RHRMNIERA

SEQ ID NO: 729357 - protein, 9 aa, Homo Sapiens
TLCGDVLLM

SEQ ID NO: 729358 - protein, 9 aa, Homo Sapiens
KESELDRAM

SEQ ID NO: 729359 - protein, 9 aa, Homo Sapiens
GEHGEQQRR

SEQ ID NO: 729360 - protein, 9 aa, Homo Sapiens
LPHFIEETD

SEQ ID NO: 729361 - protein, 9 aa, Homo Sapiens
MNNISRQIY

SEQ ID NO: 729362 - protein, 9 aa, Homo Sapiens
KQTMEKVLI

SEQ ID NO: 729363 - protein, 9 aa, Homo Sapiens
FDHHCPLVG

SEQ ID NO: 729364 - protein, 9 aa, Homo Sapiens
SASMSGAAR

SEQ ID NO: 729365 - protein, 9 aa, Homo Sapiens
FVIALGQCV

SEQ ID NO: 729366 - protein, 9 aa, Homo Sapiens
VLFIMGYAV

SEQ ID NO: 729367 - protein, 9 aa, Homo Sapiens
TLTTHKSIH

SEQ ID NO: 729368 - protein, 9 aa, Homo Sapiens
EGVPLAYTY

SEQ ID NO: 729369 - protein, 9 aa, Homo Sapiens
WIRERSHQS

SEQ ID NO: 729370 - protein, 9 aa, Homo Sapiens
CAPVVLTPM

SEQ ID NO: 729371 - protein, 9 aa, Homo Sapiens
LSILPAELR

SEQ ID NO: 729372 - protein, 9 aa, Homo Sapiens
ANLDKLHTA

SEQ ID NO: 729373 - protein, 9 aa, Homo Sapiens
ISGPRPQLQ

SEQ ID NO: 729374 - protein, 9 aa, Homo Sapiens
LKNILELFY

SEQ ID NO: 729375 - protein, 9 aa, Homo Sapiens
DCEEIRDNT

SEQ ID NO: 729376 - protein, 9 aa, Homo Sapiens
RFGKGNIWS

SEQ ID NO: 729377 - protein, 9 aa, Homo Sapiens
LASDLPSVS

SEQ ID NO: 729378 - protein, 9 aa, Homo Sapiens
NLSFNDSHY

SEQ ID NO: 729379 - protein, 9 aa, Homo Sapiens
IQEMFPEVP

SEQ ID NO: 729380 - protein, 9 aa, Homo Sapiens
RVRHRMNIE

SEQ ID NO: 729381 - protein, 9 aa, Homo Sapiens
TAGAAVLSG

SEQ ID NO: 729382 - protein, 9 aa, Homo Sapiens
KRFGKSKDG

SEQ ID NO: 729383 - protein, 9 aa, Homo Sapiens
PTFKRSQSS

SEQ ID NO: 729384 - protein, 9 aa, Homo Sapiens
FQIHRYIIT

SEQ ID NO: 729385 - protein, 9 aa, Homo Sapiens
KLSKAMSVL

SEQ ID NO: 729386 - protein, 9 aa, Homo Sapiens
GPVLSPSTG

SEQ ID NO: 729387 - protein, 9 aa, Homo Sapiens
CEGPQEESE

SEQ ID NO: 729388 - protein, 9 aa, Homo Sapiens
GKPFSNFSL

SEQ ID NO: 729389 - protein, 9 aa, Homo Sapiens
NSLKLLQNA

SEQ ID NO: 729390 - protein, 9 aa, Homo Sapiens
LTAYLTLDP

SEQ ID NO: 729391 - protein, 9 aa, Homo Sapiens
KQIRKGVAH

SEQ ID NO: 729392 - protein, 9 aa, Homo Sapiens
NALPSGTLQ

SEQ ID NO: 729393 - protein, 9 aa, Homo Sapiens
HRQIAIHKR

SEQ ID NO: 729394 - protein, 9 aa, Homo Sapiens
SNDLLASAS

SEQ ID NO: 729395 - protein, 9 aa, Homo Sapiens
GGGSGHHSG

SEQ ID NO: 729396 - protein, 9 aa, Homo Sapiens
EVPYHLVLQ

SEQ ID NO: 729397 - protein, 9 aa, Homo Sapiens
LSACFSFIE

SEQ ID NO: 729398 - protein, 9 aa, Homo Sapiens
SPPPPGYNA

SEQ ID NO: 729399 - protein, 9 aa, Homo Sapiens
AVIALQEAS

SEQ ID NO: 729400 - protein, 9 aa, Homo Sapiens
YQDVDTLYN

SEQ ID NO: 729401 - protein, 9 aa, Homo Sapiens
SVVSCAPVV

SEQ ID NO: 729402 - protein, 9 aa, Homo Sapiens
ANLITDLQD

SEQ ID NO: 729403 - protein, 9 aa, Homo Sapiens
CITSFHVTC

SEQ ID NO: 729404 - protein, 9 aa, Homo Sapiens
LDTWPEEGI

SEQ ID NO: 729405 - protein, 9 aa, Homo Sapiens
HWRTRYKTI

SEQ ID NO: 729406 - protein, 9 aa, Homo Sapiens
GVSDLLLLL

SEQ ID NO: 729407 - protein, 9 aa, Homo Sapiens
SGEHGEQQR

SEQ ID NO: 729408 - protein, 9 aa, Homo Sapiens
RQSWFSPPP

SEQ ID NO: 729409 - protein, 9 aa, Homo Sapiens
HTVEKTYKC

SEQ ID NO: 729410 - protein, 9 aa, Homo Sapiens
SMYFFLASL

SEQ ID NO: 729411 - protein, 9 aa, Homo Sapiens
SSPAAITHI

SEQ ID NO: 729412 - protein, 9 aa, Homo Sapiens
FFRKIRLLG

SEQ ID NO: 729413 - protein, 9 aa, Homo Sapiens
VQEVQDTVF

SEQ ID NO: 729414 - protein, 9 aa, Homo Sapiens
VSSEASEYG

SEQ ID NO: 729415 - protein, 9 aa, Homo Sapiens
DKKPVPIFL

SEQ ID NO: 729416 - protein, 9 aa, Homo Sapiens
WSLELSESL

SEQ ID NO: 729417 - protein, 9 aa, Homo Sapiens
RGYLVSTDD

SEQ ID NO: 729418 - protein, 9 aa, Homo Sapiens
IISSQTERF

SEQ ID NO: 729419 - protein, 9 aa, Homo Sapiens
EVQDTVFKQ

SEQ ID NO: 729420 - protein, 9 aa, Homo Sapiens
SIQGAQPIF

SEQ ID NO: 729421 - protein, 9 aa, Homo Sapiens
KIHTVEKTY

SEQ ID NO: 729422 - protein, 9 aa, Homo Sapiens
YCKPEEEVA

SEQ ID NO: 729423 - protein, 9 aa, Homo Sapiens
AVSREVFDF

SEQ ID NO: 729424 - protein, 9 aa, Homo Sapiens
FRFSATFAL

SEQ ID NO: 729425 - protein, 9 aa, Homo Sapiens
LHRDLKPVN

SEQ ID NO: 729426 - protein, 9 aa, Homo Sapiens
PEPSNPASV

SEQ ID NO: 729427 - protein, 9 aa, Homo Sapiens
AACVVYIDG

SEQ ID NO: 729428 - protein, 9 aa, Homo Sapiens
DCRRSSGHL

SEQ ID NO: 729429 - protein, 9 aa, Homo Sapiens
TLGILFVND

SEQ ID NO: 729430 - protein, 9 aa, Homo Sapiens
EQSNVSLAK

SEQ ID NO: 729431 - protein, 9 aa, Homo Sapiens
DPRNQPYFA

SEQ ID NO: 729432 - protein, 9 aa, Homo Sapiens
LPWASLPPG

SEQ ID NO: 729433 - protein, 9 aa, Homo Sapiens
GITLASLER

SEQ ID NO: 729434 - protein, 9 aa, Homo Sapiens
LVVVDINED

SEQ ID NO: 729435 - protein, 9 aa, Homo Sapiens
SALSGPLGG

SEQ ID NO: 729436 - protein, 9 aa, Homo Sapiens
ATAGAAVLS

SEQ ID NO: 729437 - protein, 9 aa, Homo Sapiens
LEDPVLCAF

SEQ ID NO: 729438 - protein, 9 aa, Homo Sapiens
GTESLFRSP

SEQ ID NO: 729439 - protein, 9 aa, Homo Sapiens
VVEVVKETI

SEQ ID NO: 729440 - protein, 9 aa, Homo Sapiens
DRYVAVSDR

SEQ ID NO: 729441 - protein, 9 aa, Homo Sapiens
ALASFKIPP

SEQ ID NO: 729442 - protein, 9 aa, Homo Sapiens
SNPASVSSP

SEQ ID NO: 729443 - protein, 9 aa, Homo Sapiens
FSNFSLFQI

SEQ ID NO: 729444 - protein, 9 aa, Homo Sapiens
SNQKAQGKD

SEQ ID NO: 729445 - protein, 9 aa, Homo Sapiens
HWGPAEDNV

SEQ ID NO: 729446 - protein, 9 aa, Homo Sapiens
ETDDAYIIK

SEQ ID NO: 729447 - protein, 9 aa, Homo Sapiens
LVMPVDAQK

SEQ ID NO: 729448 - protein, 9 aa, Homo Sapiens
QPSAASMVA

SEQ ID NO: 729449 - protein, 9 aa, Homo Sapiens
VDVNECKTL

SEQ ID NO: 729450 - protein, 9 aa, Homo Sapiens
KEEPKQAYV

SEQ ID NO: 729451 - protein, 9 aa, Homo Sapiens
IQGATSHHL

SEQ ID NO: 729452 - protein, 9 aa, Homo Sapiens
AGTVIVNIG

SEQ ID NO: 729453 - protein, 9 aa, Homo Sapiens
HLKCNEKSV

SEQ ID NO: 729454 - protein, 9 aa, Homo Sapiens
VTCKCESPH

SEQ ID NO: 729455 - protein, 9 aa, Homo Sapiens
NTVLLRPID

SEQ ID NO: 729456 - protein, 9 aa, Homo Sapiens
YLTLDPGTA

SEQ ID NO: 729457 - protein, 9 aa, Homo Sapiens
GFNRSEPCP

SEQ ID NO: 729458 - protein, 9 aa, Homo Sapiens
EQSLQAIDS

SEQ ID NO: 729459 - protein, 9 aa, Homo Sapiens
QLVLFPTQI

SEQ ID NO: 729460 - protein, 9 aa, Homo Sapiens
RSHQSYAKN

SEQ ID NO: 729461 - protein, 9 aa, Homo Sapiens
LSQAAIMQS

SEQ ID NO: 729462 - protein, 9 aa, Homo Sapiens
ELCGLKKLR

SEQ ID NO: 729463 - protein, 9 aa, Homo Sapiens
SRSETWRRR

SEQ ID NO: 729464 - protein, 9 aa, Homo Sapiens
PEEPTFKRS

SEQ ID NO: 729465 - protein, 9 aa, Homo Sapiens
VYQHTSITT

SEQ ID NO: 729466 - protein, 9 aa, Homo Sapiens
ESVTFAILA

SEQ ID NO: 729467 - protein, 9 aa, Homo Sapiens
GKGNIWSAE

SEQ ID NO: 729468 - protein, 9 aa, Homo Sapiens
TVIHDPSYK

SEQ ID NO: 729469 - protein, 9 aa, Homo Sapiens
KQVEPLLGR

SEQ ID NO: 729470 - protein, 9 aa, Homo Sapiens
SMSGAARKT

SEQ ID NO: 729471 - protein, 9 aa, Homo Sapiens
SFIEGRERD

SEQ ID NO: 729472 - protein, 9 aa, Homo Sapiens
KKWRDYYRR

SEQ ID NO: 729473 - protein, 9 aa, Homo Sapiens
FFRHSMTHI

SEQ ID NO: 729474 - protein, 9 aa, Homo Sapiens
MAAFVSYVG

SEQ ID NO: 729475 - protein, 9 aa, Homo Sapiens
HTHLLQFYG

SEQ ID NO: 729476 - protein, 9 aa, Homo Sapiens
NPTTGLSLG

SEQ ID NO: 729477 - protein, 9 aa, Homo Sapiens
KSIPASSPA

SEQ ID NO: 729478 - protein, 9 aa, Homo Sapiens
ASNLGWVVG

SEQ ID NO: 729479 - protein, 9 aa, Homo Sapiens
LSHANNRVD

SEQ ID NO: 729480 - protein, 9 aa, Homo Sapiens
ASGRYCKPE

SEQ ID NO: 729481 - protein, 9 aa, Homo Sapiens
IQLWVIILA

SEQ ID NO: 729482 - protein, 9 aa, Homo Sapiens
SFKIPPFEC

SEQ ID NO: 729483 - protein, 9 aa, Homo Sapiens
KSNHSLDKD

SEQ ID NO: 729484 - protein, 9 aa, Homo Sapiens
TSDSAQGGK

SEQ ID NO: 729485 - protein, 9 aa, Homo Sapiens
EQSIELIRD

SEQ ID NO: 729486 - protein, 9 aa, Homo Sapiens
HRLTAYLTL

SEQ ID NO: 729487 - protein, 9 aa, Homo Sapiens
PEFFRKIRL

SEQ ID NO: 729488 - protein, 9 aa, Homo Sapiens
NTENQRQNE

SEQ ID NO: 729489 - protein, 9 aa, Homo Sapiens
LLNEIIADS

SEQ ID NO: 729490 - protein, 9 aa, Homo Sapiens
RAAAIVIQK

SEQ ID NO: 729491 - protein, 9 aa, Homo Sapiens
EKDCRRSSG

SEQ ID NO: 729492 - protein, 9 aa, Homo Sapiens
QDIDLAVSR

SEQ ID NO: 729493 - protein, 9 aa, Homo Sapiens
NQRTLAAAA

SEQ ID NO: 729494 - protein, 9 aa, Homo Sapiens
DSNYPPFCL

SEQ ID NO: 729495 - protein, 9 aa, Homo Sapiens
PVMHFKAPK

SEQ ID NO: 729496 - protein, 9 aa, Homo Sapiens
NSFRVERGI

SEQ ID NO: 729497 - protein, 9 aa, Homo Sapiens
PELQALLFL

SEQ ID NO: 729498 - protein, 9 aa, Homo Sapiens
PGVHELPWA

SEQ ID NO: 729499 - protein, 9 aa, Homo Sapiens
IINECKGSP

SEQ ID NO: 729500 - protein, 9 aa, Homo Sapiens
LVVANLDKL

SEQ ID NO: 729501 - protein, 9 aa, Homo Sapiens
KLEQLKPRP

SEQ ID NO: 729502 - protein, 9 aa, Homo Sapiens
FLISWPRLF

SEQ ID NO: 729503 - protein, 9 aa, Homo Sapiens
ASSPAAITH

SEQ ID NO: 729504 - protein, 9 aa, Homo Sapiens
CRCNSGGSF

SEQ ID NO: 729505 - protein, 9 aa, Homo Sapiens
DIDLAVSRE

SEQ ID NO: 729506 - protein, 9 aa, Homo Sapiens
SDELLSKPK

SEQ ID NO: 729507 - protein, 9 aa, Homo Sapiens
NCVYENECA

SEQ ID NO: 729508 - protein, 9 aa, Homo Sapiens
MLCVFQITT

SEQ ID NO: 729509 - protein, 9 aa, Homo Sapiens
HKIVVVQSP

SEQ ID NO: 729510 - protein, 9 aa, Homo Sapiens
PLSEITKQE

SEQ ID NO: 729511 - protein, 9 aa, Homo Sapiens
FFGSVSIMY

SEQ ID NO: 729512 - protein, 9 aa, Homo Sapiens
PQAPSLRRH

SEQ ID NO: 729513 - protein, 9 aa, Homo Sapiens
PPQLLIRVE

SEQ ID NO: 729514 - protein, 9 aa, Homo Sapiens
DGRVFYVGC

SEQ ID NO: 729515 - protein, 9 aa, Homo Sapiens
PTGKITRES

SEQ ID NO: 729516 - protein, 9 aa, Homo Sapiens
QEGSLELSW

SEQ ID NO: 729517 - protein, 9 aa, Homo Sapiens
AFFKDKRRE

SEQ ID NO: 729518 - protein, 9 aa, Homo Sapiens
GIVFEAENK

SEQ ID NO: 729519 - protein, 9 aa, Homo Sapiens
QLWVIILAI

SEQ ID NO: 729520 - protein, 9 aa, Homo Sapiens
TTSSEGNDQ

SEQ ID NO: 729521 - protein, 9 aa, Homo Sapiens
RNPRCDVVK

SEQ ID NO: 729522 - protein, 9 aa, Homo Sapiens
LSKAMSVLP

SEQ ID NO: 729523 - protein, 9 aa, Homo Sapiens
LPAAAVLIA

SEQ ID NO: 729524 - protein, 9 aa, Homo Sapiens
AHFSANLKT

SEQ ID NO: 729525 - protein, 9 aa, Homo Sapiens
IGVSDLLLL

SEQ ID NO: 729526 - protein, 9 aa, Homo Sapiens
VEKYRYQNE

SEQ ID NO: 729527 - protein, 9 aa, Homo Sapiens
ENALPSGTL

SEQ ID NO: 729528 - protein, 9 aa, Homo Sapiens
DLWELQLQK

SEQ ID NO: 729529 - protein, 9 aa, Homo Sapiens
TFANSMLCV

SEQ ID NO: 729530 - protein, 9 aa, Homo Sapiens
YMDSEEKEI

SEQ ID NO: 729531 - protein, 9 aa, Homo Sapiens
SDSAQGGKN

SEQ ID NO: 729532 - protein, 9 aa, Homo Sapiens
YALKTQGRT

SEQ ID NO: 729533 - protein, 9 aa, Homo Sapiens
MTTTAPPPE

SEQ ID NO: 729534 - protein, 9 aa, Homo Sapiens
CQSSNCCDR

SEQ ID NO: 729535 - protein, 9 aa, Homo Sapiens
GRYCKPEEE

SEQ ID NO: 729536 - protein, 9 aa, Homo Sapiens
TYPMFQIHR

SEQ ID NO: 729537 - protein, 9 aa, Homo Sapiens
TRESRSETW

SEQ ID NO: 729538 - protein, 9 aa, Homo Sapiens
LVAASVSQD

SEQ ID NO: 729539 - protein, 9 aa, Homo Sapiens
LEPDRPQVF

SEQ ID NO: 729540 - protein, 9 aa, Homo Sapiens
KSTGTSNQK

SEQ ID NO: 729541 - protein, 9 aa, Homo Sapiens
ILPAELRVW

SEQ ID NO: 729542 - protein, 9 aa, Homo Sapiens
SAHLGLNLG

SEQ ID NO: 729543 - protein, 9 aa, Homo Sapiens
LPADGLFFQ

SEQ ID NO: 729544 - protein, 9 aa, Homo Sapiens
HQGNQTTVT

SEQ ID NO: 729545 - protein, 9 aa, Homo Sapiens
IIDCGEQRT

SEQ ID NO: 729546 - protein, 9 aa, Homo Sapiens
PLAPEFFRK

SEQ ID NO: 729547 - protein, 9 aa, Homo Sapiens
SIPASSPAA

SEQ ID NO: 729548 - protein, 9 aa, Homo Sapiens
VKLNCKILG

SEQ ID NO: 729549 - protein, 9 aa, Homo Sapiens
ALSGPLGGP

SEQ ID NO: 729550 - protein, 9 aa, Homo Sapiens
SNHNPQAYY

SEQ ID NO: 729551 - protein, 9 aa, Homo Sapiens
VDETGITLA

SEQ ID NO: 729552 - protein, 9 aa, Homo Sapiens
HGEANITGF

SEQ ID NO: 729553 - protein, 9 aa, Homo Sapiens
HGAVLASCS

SEQ ID NO: 729554 - protein, 9 aa, Homo Sapiens
VPVYQHTSI

SEQ ID NO: 729555 - protein, 9 aa, Homo Sapiens
SAEDTLGIL

SEQ ID NO: 729556 - protein, 9 aa, Homo Sapiens
GRYSAVESV

SEQ ID NO: 729557 - protein, 9 aa, Homo Sapiens
TKKVEEQTE

SEQ ID NO: 729558 - protein, 9 aa, Homo Sapiens
QSIELIRDS

SEQ ID NO: 729559 - protein, 9 aa, Homo Sapiens
PLVGNCVGA

SEQ ID NO: 729560 - protein, 9 aa, Homo Sapiens
LAYFTSVLT

SEQ ID NO: 729561 - protein, 9 aa, Homo Sapiens
LGRVNLSFN

SEQ ID NO: 729562 - protein, 9 aa, Homo Sapiens
SCTIVFVSP

SEQ ID NO: 729563 - protein, 9 aa, Homo Sapiens
EHQILVDKK

SEQ ID NO: 729564 - protein, 9 aa, Homo Sapiens
FFKDKRREL

SEQ ID NO: 729565 - protein, 9 aa, Homo Sapiens
QVFEQRAEI

SEQ ID NO: 729566 - protein, 9 aa, Homo Sapiens
LSPSTGSAL

SEQ ID NO: 729567 - protein, 9 aa, Homo Sapiens
PENPPASLY

SEQ ID NO: 729568 - protein, 9 aa, Homo Sapiens
GIVIKTKEQ

SEQ ID NO: 729569 - protein, 9 aa, Homo Sapiens
VVTVTTVGF

SEQ ID NO: 729570 - protein, 9 aa, Homo Sapiens
NEQQETKKN

SEQ ID NO: 729571 - protein, 9 aa, Homo Sapiens
ESELDRAML

SEQ ID NO: 729572 - protein, 9 aa, Homo Sapiens
AGTTRASPS

SEQ ID NO: 729573 - protein, 9 aa, Homo Sapiens
KLQDPSLRK

SEQ ID NO: 729574 - protein, 9 aa, Homo Sapiens
FVSPLIVRE

SEQ ID NO: 729575 - protein, 9 aa, Homo Sapiens
PASSPAAIT

SEQ ID NO: 729576 - protein, 9 aa, Homo Sapiens
ALEDRFEAT

SEQ ID NO: 729577 - protein, 9 aa, Homo Sapiens
CFSFIEGRE

SEQ ID NO: 729578 - protein, 9 aa, Homo Sapiens
GLQGHPGHL

SEQ ID NO: 729579 - protein, 9 aa, Homo Sapiens
EMLKKEPEA

SEQ ID NO: 729580 - protein, 9 aa, Homo Sapiens
IQKKWRDYY

SEQ ID NO: 729581 - protein, 9 aa, Homo Sapiens
FVFFYTQLV

SEQ ID NO: 729582 - protein, 9 aa, Homo Sapiens
LHRLTAYLT

SEQ ID NO: 729583 - protein, 9 aa, Homo Sapiens
PYYNEALSF

SEQ ID NO: 729584 - protein, 9 aa, Homo Sapiens
VQKGDEGAR

SEQ ID NO: 729585 - protein, 9 aa, Homo Sapiens
FMQSIATIL

SEQ ID NO: 729586 - protein, 9 aa, Homo Sapiens
AVGKVSRKQ

SEQ ID NO: 729587 - protein, 9 aa, Homo Sapiens
QTYICLATK

SEQ ID NO: 729588 - protein, 9 aa, Homo Sapiens
AIGNGAVII

SEQ ID NO: 729589 - protein, 9 aa, Homo Sapiens
GLFFQGNDL

SEQ ID NO: 729590 - protein, 9 aa, Homo Sapiens
KTINRNRMG

SEQ ID NO: 729591 - protein, 9 aa, Homo Sapiens
WPISEWDEI

SEQ ID NO: 729592 - protein, 9 aa, Homo Sapiens
CKHILQKTA

SEQ ID NO: 729593 - protein, 9 aa, Homo Sapiens
INYGFISAI

SEQ ID NO: 729594 - protein, 9 aa, Homo Sapiens
FYQMDVQAM

SEQ ID NO: 729595 - protein, 9 aa, Homo Sapiens
VVVTVTTVG

SEQ ID NO: 729596 - protein, 9 aa, Homo Sapiens
QVAGTTRAS

SEQ ID NO: 729597 - protein, 9 aa, Homo Sapiens
FCLGTGYIF

SEQ ID NO: 729598 - protein, 9 aa, Homo Sapiens
FNLAPLQYQ

SEQ ID NO: 729599 - protein, 9 aa, Homo Sapiens
FIMSSLMSE

SEQ ID NO: 729600 - protein, 9 aa, Homo Sapiens
DSFLYYNDE

SEQ ID NO: 729601 - protein, 9 aa, Homo Sapiens
FIEGRERDH

SEQ ID NO: 729602 - protein, 9 aa, Homo Sapiens
SSFSETDTQ

SEQ ID NO: 729603 - protein, 9 aa, Homo Sapiens
QNEDTPPQE

SEQ ID NO: 729604 - protein, 9 aa, Homo Sapiens
PRGQQGMFV

SEQ ID NO: 729605 - protein, 9 aa, Homo Sapiens
VCVMNLDLT

SEQ ID NO: 729606 - protein, 9 aa, Homo Sapiens
LRKLYRPDM

SEQ ID NO: 729607 - protein, 9 aa, Homo Sapiens
IEPSAAMTT

SEQ ID NO: 729608 - protein, 9 aa, Homo Sapiens
MLHRLTAYL

SEQ ID NO: 729609 - protein, 9 aa, Homo Sapiens
SSGKSINYG

SEQ ID NO: 729610 - protein, 9 aa, Homo Sapiens
GSIISTGIV

SEQ ID NO: 729611 - protein, 9 aa, Homo Sapiens
DSTTQKTDD

SEQ ID NO: 729612 - protein, 9 aa, Homo Sapiens
GYRIIYNNA

SEQ ID NO: 729613 - protein, 9 aa, Homo Sapiens
FIEETDDAY

SEQ ID NO: 729614 - protein, 9 aa, Homo Sapiens
QRAFNLAPL

SEQ ID NO: 729615 - protein, 9 aa, Homo Sapiens
KISSFGHNE

SEQ ID NO: 729616 - protein, 9 aa, Homo Sapiens
PPNQRTLAA

SEQ ID NO: 729617 - protein, 9 aa, Homo Sapiens
AYLTLDPGT

SEQ ID NO: 729618 - protein, 9 aa, Homo Sapiens
TGLSLGPSF

SEQ ID NO: 729619 - protein, 9 aa, Homo Sapiens
FISFLFFSQ

SEQ ID NO: 729620 - protein, 9 aa, Homo Sapiens
SPFRKEPDL

SEQ ID NO: 729621 - protein, 9 aa, Homo Sapiens
AMSRNQDHN

SEQ ID NO: 729622 - protein, 9 aa, Homo Sapiens
LWDMWHPTL

SEQ ID NO: 729623 - protein, 9 aa, Homo Sapiens
VPSGEHGEQ

SEQ ID NO: 729624 - protein, 9 aa, Homo Sapiens
PEEGIENSQ

SEQ ID NO: 729625 - protein, 9 aa, Homo Sapiens
SIELIRDSL

SEQ ID NO: 729626 - protein, 9 aa, Homo Sapiens
SAAMTTTAP

SEQ ID NO: 729627 - protein, 9 aa, Homo Sapiens
VSIMYLRFS

SEQ ID NO: 729628 - protein, 9 aa, Homo Sapiens
LGILFVNDT

SEQ ID NO: 729629 - protein, 9 aa, Homo Sapiens
SLFQIHERM

SEQ ID NO: 729630 - protein, 9 aa, Homo Sapiens
GHRQRDHDS

SEQ ID NO: 729631 - protein, 9 aa, Homo Sapiens
HHELSTLGK

SEQ ID NO: 729632 - protein, 9 aa, Homo Sapiens
EASEYGILE

SEQ ID NO: 729633 - protein, 9 aa, Homo Sapiens
MRKNRLVVA

SEQ ID NO: 729634 - protein, 9 aa, Homo Sapiens
LHLKCNEKS

SEQ ID NO: 729635 - protein, 9 aa, Homo Sapiens
VLLRPIDVA

SEQ ID NO: 729636 - protein, 9 aa, Homo Sapiens
SSASLSSPS

SEQ ID NO: 729637 - protein, 9 aa, Homo Sapiens
AECIAQCHR

SEQ ID NO: 729638 - protein, 9 aa, Homo Sapiens
PVNILVMGE

SEQ ID NO: 729639 - protein, 9 aa, Homo Sapiens
AASNLGWVV

SEQ ID NO: 729640 - protein, 9 aa, Homo Sapiens
RTERQHRQI

SEQ ID NO: 729641 - protein, 9 aa, Homo Sapiens
SNSLKLLQN

SEQ ID NO: 729642 - protein, 9 aa, Homo Sapiens
ELLVVVDIN

SEQ ID NO: 729643 - protein, 9 aa, Homo Sapiens
CCGGGSGHH

SEQ ID NO: 729644 - protein, 9 aa, Homo Sapiens
IAGKPYECK

SEQ ID NO: 729645 - protein, 9 aa, Homo Sapiens
VTLLRDSIK

SEQ ID NO: 729646 - protein, 9 aa, Homo Sapiens
YSCEGPQEE

SEQ ID NO: 729647 - protein, 9 aa, Homo Sapiens
VFQITTSAG

SEQ ID NO: 729648 - protein, 9 aa, Homo Sapiens
LRGRFGKGN

SEQ ID NO: 729649 - protein, 9 aa, Homo Sapiens
RFSATFALY

SEQ ID NO: 729650 - protein, 9 aa, Homo Sapiens
SEFIFPTQS

SEQ ID NO: 729651 - protein, 9 aa, Homo Sapiens
QGNQTTVTE

SEQ ID NO: 729652 - protein, 9 aa, Homo Sapiens
SFSISSFSE

SEQ ID NO: 729653 - protein, 9 aa, Homo Sapiens
TGISILLVS

SEQ ID NO: 729654 - protein, 9 aa, Homo Sapiens
NYPPFCLGT

SEQ ID NO: 729655 - protein, 9 aa, Homo Sapiens
RELWDMWHP

SEQ ID NO: 729656 - protein, 9 aa, Homo Sapiens
HLSVFDIDR

SEQ ID NO: 729657 - protein, 9 aa, Homo Sapiens
QTVPVYQHT

SEQ ID NO: 729658 - protein, 9 aa, Homo Sapiens
VLRIFLMTN

SEQ ID NO: 729659 - protein, 9 aa, Homo Sapiens
GLAPPQLLI

SEQ ID NO: 729660 - protein, 9 aa, Homo Sapiens
RLTHWRTRY

SEQ ID NO: 729661 - protein, 9 aa, Homo Sapiens
MLKKEPEAL

SEQ ID NO: 729662 - protein, 9 aa, Homo Sapiens
PELCTVDIG

SEQ ID NO: 729663 - protein, 9 aa, Homo Sapiens
CLQRAFNLA

SEQ ID NO: 729664 - protein, 9 aa, Homo Sapiens
LASLERFST

SEQ ID NO: 729665 - protein, 9 aa, Homo Sapiens
WWAASNLGW

SEQ ID NO: 729666 - protein, 9 aa, Homo Sapiens
ILFSVDSST

SEQ ID NO: 729667 - protein, 9 aa, Homo Sapiens
VTFALKDGR

SEQ ID NO: 729668 - protein, 9 aa, Homo Sapiens
SQMINLRRL

SEQ ID NO: 729669 - protein, 9 aa, Homo Sapiens
TTSQRYSNG

SEQ ID NO: 729670 - protein, 9 aa, Homo Sapiens
KNLKNILEL

SEQ ID NO: 729671 - protein, 9 aa, Homo Sapiens
SEPCPRDTR

SEQ ID NO: 729672 - protein, 9 aa, Homo Sapiens
GLKKLRILD

SEQ ID NO: 729673 - protein, 9 aa, Homo Sapiens
KAMSVLPED

SEQ ID NO: 729674 - protein, 9 aa, Homo Sapiens
QARELLRLG

SEQ ID NO: 729675 - protein, 9 aa, Homo Sapiens
MFPEVPYHL

SEQ ID NO: 729676 - protein, 9 aa, Homo Sapiens
SFYQFLISW

SEQ ID NO: 729677 - protein, 9 aa, Homo Sapiens
IGFQDTFLA

SEQ ID NO: 729678 - protein, 9 aa, Homo Sapiens
AKGPGPAAP

SEQ ID NO: 729679 - protein, 9 aa, Homo Sapiens
YQHTSITTI

SEQ ID NO: 729680 - protein, 9 aa, Homo Sapiens
EITKQEKDF

SEQ ID NO: 729681 - protein, 9 aa, Homo Sapiens
KEELDSTYT

SEQ ID NO: 729682 - protein, 9 aa, Homo Sapiens
TQFLAHGAV

SEQ ID NO: 729683 - protein, 9 aa, Homo Sapiens
LELSESLTS

SEQ ID NO: 729684 - protein, 9 aa, Homo Sapiens
FCPSPPLFS

SEQ ID NO: 729685 - protein, 9 aa, Homo Sapiens
VTFAILAER

SEQ ID NO: 729686 - protein, 9 aa, Homo Sapiens
VVKRFGKSK

SEQ ID NO: 729687 - protein, 9 aa, Homo Sapiens
KQEKDFLWS

SEQ ID NO: 729688 - protein, 9 aa, Homo Sapiens
AVPCSKTIN

SEQ ID NO: 729689 - protein, 9 aa, Homo Sapiens
LTHWRTRYK

SEQ ID NO: 729690 - protein, 9 aa, Homo Sapiens
TDDAYIIKS

SEQ ID NO: 729691 - protein, 9 aa, Homo Sapiens
QILEKLSKA

SEQ ID NO: 729692 - protein, 9 aa, Homo Sapiens
ISILLVSSV

SEQ ID NO: 729693 - protein, 9 aa, Homo Sapiens
VANLDKLHT

SEQ ID NO: 729694 - protein, 9 aa, Homo Sapiens
PSFPNFTSF

SEQ ID NO: 729695 - protein, 9 aa, Homo Sapiens
RPQVFEQRA

SEQ ID NO: 729696 - protein, 9 aa, Homo Sapiens
WDATTYITT

SEQ ID NO: 729697 - protein, 9 aa, Homo Sapiens
YSAVESVTE

SEQ ID NO: 729698 - protein, 9 aa, Homo Sapiens
GVPLAYTYS

SEQ ID NO: 729699 - protein, 9 aa, Homo Sapiens
QMDVQAMDN

SEQ ID NO: 729700 - protein, 9 aa, Homo Sapiens
PNQRTLAAA

SEQ ID NO: 729701 - protein, 9 aa, Homo Sapiens
ILLVSSVIL

SEQ ID NO: 729702 - protein, 9 aa, Homo Sapiens
LWPYNPVSP

SEQ ID NO: 729703 - protein, 9 aa, Homo Sapiens
SSLEPIVTM

SEQ ID NO: 729704 - protein, 9 aa, Homo Sapiens
IMQSALAKE

SEQ ID NO: 729705 - protein, 9 aa, Homo Sapiens
VPVTKPLCL

SEQ ID NO: 729706 - protein, 9 aa, Homo Sapiens
IQKIAYHKD

SEQ ID NO: 729707 - protein, 9 aa, Homo Sapiens
PGHRQRDHD

SEQ ID NO: 729708 - protein, 9 aa, Homo Sapiens
SGKSINYGF

SEQ ID NO: 729709 - protein, 9 aa, Homo Sapiens
SFLLNTLQK

SEQ ID NO: 729710 - protein, 9 aa, Homo Sapiens
AILMDTEHF

SEQ ID NO: 729711 - protein, 9 aa, Homo Sapiens
PSSLWSCWF

SEQ ID NO: 729712 - protein, 9 aa, Homo Sapiens
PHIIIDCGE

SEQ ID NO: 729713 - protein, 9 aa, Homo Sapiens
WGPAEDNVD

SEQ ID NO: 729714 - protein, 9 aa, Homo Sapiens
EKFDLIDKF

SEQ ID NO: 729715 - protein, 9 aa, Homo Sapiens
SQFICLVFI

SEQ ID NO: 729716 - protein, 9 aa, Homo Sapiens
HRQRDHDSR

SEQ ID NO: 729717 - protein, 9 aa, Homo Sapiens
YQNEDTPPQ

SEQ ID NO: 729718 - protein, 9 aa, Homo Sapiens
ARQDYELIQ

SEQ ID NO: 729719 - protein, 9 aa, Homo Sapiens
SIATILLFL

SEQ ID NO: 729720 - protein, 9 aa, Homo Sapiens
LVIHILHKQ

SEQ ID NO: 729721 - protein, 9 aa, Homo Sapiens
YIVQEIPPQ

SEQ ID NO: 729722 - protein, 9 aa, Homo Sapiens
FNRSEPCPR

SEQ ID NO: 729723 - protein, 9 aa, Homo Sapiens
LDSTYTSVV

SEQ ID NO: 729724 - protein, 9 aa, Homo Sapiens
PSTAMSVVS

SEQ ID NO: 729725 - protein, 9 aa, Homo Sapiens
VMNLDLTGQ

SEQ ID NO: 729726 - protein, 9 aa, Homo Sapiens
FPEVPYHLV

SEQ ID NO: 729727 - protein, 9 aa, Homo Sapiens
RQRDHDSRY

SEQ ID NO: 729728 - protein, 9 aa, Homo Sapiens
LRDSIKRRE

SEQ ID NO: 729729 - protein, 9 aa, Homo Sapiens
EPKQAYVPA

SEQ ID NO: 729730 - protein, 9 aa, Homo Sapiens
DLVNPPFSL

SEQ ID NO: 729731 - protein, 9 aa, Homo Sapiens
LVYRPRLSK

SEQ ID NO: 729732 - protein, 9 aa, Homo Sapiens
LDAVPCSKT

SEQ ID NO: 729733 - protein, 9 aa, Homo Sapiens
DPVLCAFAK

SEQ ID NO: 729734 - protein, 9 aa, Homo Sapiens
DGSLSQAAI

SEQ ID NO: 729735 - protein, 9 aa, Homo Sapiens
TAALQSRAL

SEQ ID NO: 729736 - protein, 9 aa, Homo Sapiens
QGGKNTGIS

SEQ ID NO: 729737 - protein, 9 aa, Homo Sapiens
EDFKLKYET

SEQ ID NO: 729738 - protein, 9 aa, Homo Sapiens
SGFYQMDVQ

SEQ ID NO: 729739 - protein, 9 aa, Homo Sapiens
GFSLCWLPQ

SEQ ID NO: 729740 - protein, 9 aa, Homo Sapiens
AAMTTTAPP

SEQ ID NO: 729741 - protein, 9 aa, Homo Sapiens
TLVPLLATV

SEQ ID NO: 729742 - protein, 9 aa, Homo Sapiens
QNNWLCTNW

SEQ ID NO: 729743 - protein, 9 aa, Homo Sapiens
ALKTQGRTL

SEQ ID NO: 729744 - protein, 9 aa, Homo Sapiens
DLALIAQEI

SEQ ID NO: 729745 - protein, 9 aa, Homo Sapiens
NDLLASASL

SEQ ID NO: 729746 - protein, 9 aa, Homo Sapiens
EFCLLQWAV

SEQ ID NO: 729747 - protein, 9 aa, Homo Sapiens
GRRLDFNYK

SEQ ID NO: 729748 - protein, 9 aa, Homo Sapiens
SNHSLDKDK

SEQ ID NO: 729749 - protein, 9 aa, Homo Sapiens
ATNEAALQK

SEQ ID NO: 729750 - protein, 9 aa, Homo Sapiens
ENPPASLYT

SEQ ID NO: 729751 - protein, 9 aa, Homo Sapiens
EAEEQSNVS

SEQ ID NO: 729752 - protein, 9 aa, Homo Sapiens
AARKTIYKD

SEQ ID NO: 729753 - protein, 9 aa, Homo Sapiens
LTQDGRVFY

SEQ ID NO: 729754 - protein, 9 aa, Homo Sapiens
QPQSLEFTK

SEQ ID NO: 729755 - protein, 9 aa, Homo Sapiens
QRDHDSRYQ

SEQ ID NO: 729756 - protein, 9 aa, Homo Sapiens
NGDLVNPPF

SEQ ID NO: 729757 - protein, 9 aa, Homo Sapiens
MEAILMDTE

SEQ ID NO: 729758 - protein, 9 aa, Homo Sapiens
PGAPSSRER

SEQ ID NO: 729759 - protein, 9 aa, Homo Sapiens
IAGAIGNGA

SEQ ID NO: 729760 - protein, 9 aa, Homo Sapiens
AALQSRALG

SEQ ID NO: 729761 - protein, 9 aa, Homo Sapiens
AALQKMLFK

SEQ ID NO: 729762 - protein, 9 aa, Homo Sapiens
LGVTRVRHR

SEQ ID NO: 729763 - protein, 9 aa, Homo Sapiens
LAHGAVLAS

SEQ ID NO: 729764 - protein, 9 aa, Homo Sapiens
AIVIQKKWR

SEQ ID NO: 729765 - protein, 9 aa, Homo Sapiens
PRCDVVKRF

SEQ ID NO: 729766 - protein, 9 aa, Homo Sapiens
VQDTVFKQM

SEQ ID NO: 729767 - protein, 9 aa, Homo Sapiens
HTWSLELSE

SEQ ID NO: 729768 - protein, 9 aa, Homo Sapiens
LSFNDSHYG

SEQ ID NO: 729769 - protein, 9 aa, Homo Sapiens
KTKEQDEEE

SEQ ID NO: 729770 - protein, 9 aa, Homo Sapiens
TEGIVIKTK

SEQ ID NO: 729771 - protein, 9 aa, Homo Sapiens
GTTRASPSC

SEQ ID NO: 729772 - protein, 9 aa, Homo Sapiens
KTVIHDPSY

SEQ ID NO: 729773 - protein, 9 aa, Homo Sapiens
LLASASLVN

SEQ ID NO: 729774 - protein, 9 aa, Homo Sapiens
LQHWGPAED

SEQ ID NO: 729775 - protein, 9 aa, Homo Sapiens
GSSMYFFLA

SEQ ID NO: 729776 - protein, 9 aa, Homo Sapiens
VLLMAAFVS

SEQ ID NO: 729777 - protein, 9 aa, Homo Sapiens
RPQLQQVPR

SEQ ID NO: 729778 - protein, 9 aa, Homo Sapiens
EEWICAMNN

SEQ ID NO: 729779 - protein, 9 aa, Homo Sapiens
MNLDLTGQT

SEQ ID NO: 729780 - protein, 9 aa, Homo Sapiens
HNEAGSEPH

SEQ ID NO: 729781 - protein, 9 aa, Homo Sapiens
SALNPRELW

SEQ ID NO: 729782 - protein, 9 aa, Homo Sapiens
QSNVSLAKF

SEQ ID NO: 729783 - protein, 9 aa, Homo Sapiens
AAAIVIQKK

SEQ ID NO: 729784 - protein, 9 aa, Homo Sapiens
HTGGKLYEC

SEQ ID NO: 729785 - protein, 9 aa, Homo Sapiens
MVLESVTFA

SEQ ID NO: 729786 - protein, 9 aa, Homo Sapiens
EQGAGTVIV

SEQ ID NO: 729787 - protein, 9 aa, Homo Sapiens
ISSQTERFR

SEQ ID NO: 729788 - protein, 9 aa, Homo Sapiens
QVIGFQDTF

SEQ ID NO: 729789 - protein, 9 aa, Homo Sapiens
RSLGPQAPS

SEQ ID NO: 729790 - protein, 9 aa, Homo Sapiens
DKDKMASVF

SEQ ID NO: 729791 - protein, 9 aa, Homo Sapiens
ELSESLTSD

SEQ ID NO: 729792 - protein, 9 aa, Homo Sapiens
QAHSIINEC

SEQ ID NO: 729793 - protein, 9 aa, Homo Sapiens
GSLPLSEGG

SEQ ID NO: 729794 - protein, 9 aa, Homo Sapiens
VMHFKAPKI

SEQ ID NO: 729795 - protein, 9 aa, Homo Sapiens
MQGFNRSEP

SEQ ID NO: 729796 - protein, 9 aa, Homo Sapiens
RRLELERST

SEQ ID NO: 729797 - protein, 9 aa, Homo Sapiens
ELHKIVVVQ

SEQ ID NO: 729798 - protein, 9 aa, Homo Sapiens
IQLFLDLSN

SEQ ID NO: 729799 - protein, 9 aa, Homo Sapiens
FHTTSSEGN

SEQ ID NO: 729800 - protein, 9 aa, Homo Sapiens
SDAEQRDPA

SEQ ID NO: 729801 - protein, 9 aa, Homo Sapiens
RPQLSACGH

SEQ ID NO: 729802 - protein, 9 aa, Homo Sapiens
MIPVFPPNQ

SEQ ID NO: 729803 - protein, 9 aa, Homo Sapiens
FICLVFITT

SEQ ID NO: 729804 - protein, 9 aa, Homo Sapiens
IYNNADGTE

SEQ ID NO: 729805 - protein, 9 aa, Homo Sapiens
QEMFPEVPY

SEQ ID NO: 729806 - protein, 9 aa, Homo Sapiens
VTSAEDTLG

SEQ ID NO: 729807 - protein, 9 aa, Homo Sapiens
ATVLFIMGY

SEQ ID NO: 729808 - protein, 9 aa, Homo Sapiens
LCSSSALED

SEQ ID NO: 729809 - protein, 9 aa, Homo Sapiens
KLHLSVFDI

SEQ ID NO: 729810 - protein, 9 aa, Homo Sapiens
SILLVSSVI

SEQ ID NO: 729811 - protein, 9 aa, Homo Sapiens
SPYLSQMIN

SEQ ID NO: 729812 - protein, 9 aa, Homo Sapiens
CNSGGSFSE

SEQ ID NO: 729813 - protein, 9 aa, Homo Sapiens
NTFTFKVLK

SEQ ID NO: 729814 - protein, 9 aa, Homo Sapiens
LPSVSYAMV

SEQ ID NO: 729815 - protein, 9 aa, Homo Sapiens
ISSDKTTHH

SEQ ID NO: 729816 - protein, 9 aa, Homo Sapiens
EFIFPTQSL

SEQ ID NO: 729817 - protein, 9 aa, Homo Sapiens
KKAKSVQIK

SEQ ID NO: 729818 - protein, 9 aa, Homo Sapiens
ACLRGRFGK

SEQ ID NO: 729819 - protein, 9 aa, Homo Sapiens
GAIGNGAVI

SEQ ID NO: 729820 - protein, 9 aa, Homo Sapiens
FIDGAKKID

SEQ ID NO: 729821 - protein, 9 aa, Homo Sapiens
PASAVHRPQ

SEQ ID NO: 729822 - protein, 9 aa, Homo Sapiens
VKRFGKSKD

SEQ ID NO: 729823 - protein, 9 aa, Homo Sapiens
DVNECKTLQ

SEQ ID NO: 729824 - protein, 9 aa, Homo Sapiens
QDTFLASNA

SEQ ID NO: 729825 - protein, 9 aa, Homo Sapiens
TNPTTGLSL

SEQ ID NO: 729826 - protein, 9 aa, Homo Sapiens
QAPSLRRHV

SEQ ID NO: 729827 - protein, 9 aa, Homo Sapiens
TISGVYAEY

SEQ ID NO: 729828 - protein, 9 aa, Homo Sapiens
LKKEPEALT

SEQ ID NO: 729829 - protein, 9 aa, Homo Sapiens
EMFPEVPYH

SEQ ID NO: 729830 - protein, 9 aa, Homo Sapiens
QDVDTLYNF

SEQ ID NO: 729831 - protein, 9 aa, Homo Sapiens
FPSSKLQDP

SEQ ID NO: 729832 - protein, 9 aa, Homo Sapiens
SSEGNDQVV

SEQ ID NO: 729833 - protein, 9 aa, Homo Sapiens
DSVFQPQSL

SEQ ID NO: 729834 - protein, 9 aa, Homo Sapiens
LDANRLSNK

SEQ ID NO: 729835 - protein, 9 aa, Homo Sapiens
PKQAYVPAA

SEQ ID NO: 729836 - protein, 9 aa, Homo Sapiens
LCGLKKLRI

SEQ ID NO: 729837 - protein, 9 aa, Homo Sapiens
SLCWLPQSV

SEQ ID NO: 729838 - protein, 9 aa, Homo Sapiens
VALEILQAA

SEQ ID NO: 729839 - protein, 9 aa, Homo Sapiens
DMGRIGIPS

SEQ ID NO: 729840 - protein, 9 aa, Homo Sapiens
ASQSLGSSM

SEQ ID NO: 729841 - protein, 9 aa, Homo Sapiens
KKKRQSWFS

SEQ ID NO: 729842 - protein, 9 aa, Homo Sapiens
KVKEFLSTW

SEQ ID NO: 729843 - protein, 9 aa, Homo Sapiens
WFPSSKLQD

SEQ ID NO: 729844 - protein, 9 aa, Homo Sapiens
QHRQIAIHK

SEQ ID NO: 729845 - protein, 9 aa, Homo Sapiens
FYVGCMTQL

SEQ ID NO: 729846 - protein, 9 aa, Homo Sapiens
AFNLAPLQY

SEQ ID NO: 729847 - protein, 9 aa, Homo Sapiens
AEEQSNVSL

SEQ ID NO: 729848 - protein, 9 aa, Homo Sapiens
NLKNILELF

SEQ ID NO: 729849 - protein, 9 aa, Homo Sapiens
LQASIQGAQ

SEQ ID NO: 729850 - protein, 9 aa, Homo Sapiens
SSFGHNEAG

SEQ ID NO: 729851 - protein, 9 aa, Homo Sapiens
LDVALEILQ

SEQ ID NO: 729852 - protein, 9 aa, Homo Sapiens
ILDMEAILM

SEQ ID NO: 729853 - protein, 9 aa, Homo Sapiens
KEFCLLQWA

SEQ ID NO: 729854 - protein, 9 aa, Homo Sapiens
TYTSVVISS

SEQ ID NO: 729855 - protein, 9 aa, Homo Sapiens
SDSVFQPQS

SEQ ID NO: 729856 - protein, 9 aa, Homo Sapiens
NSCIRCFCK

SEQ ID NO: 729857 - protein, 9 aa, Homo Sapiens
FKMPVMHFK

SEQ ID NO: 729858 - protein, 9 aa, Homo Sapiens
YNEALSFEV

SEQ ID NO: 729859 - protein, 9 aa, Homo Sapiens
VTKPLCLLV

SEQ ID NO: 729860 - protein, 9 aa, Homo Sapiens
QGHPGHLGI

SEQ ID NO: 729861 - protein, 9 aa, Homo Sapiens
RLKTWVCGV

SEQ ID NO: 729862 - protein, 9 aa, Homo Sapiens
LDMEAILMD

SEQ ID NO: 729863 - protein, 9 aa, Homo Sapiens
DTWPEEGIE

SEQ ID NO: 729864 - protein, 9 aa, Homo Sapiens
SRRLELERS

SEQ ID NO: 729865 - protein, 9 aa, Homo Sapiens
EYGILEANH

SEQ ID NO: 729866 - protein, 9 aa, Homo Sapiens
DIPENPPAS

SEQ ID NO: 729867 - protein, 9 aa, Homo Sapiens
GDGRNCVYE

SEQ ID NO: 729868 - protein, 9 aa, Homo Sapiens
PGFKHQIVL

SEQ ID NO: 729869 - protein, 9 aa, Homo Sapiens
DLLASASLV

SEQ ID NO: 729870 - protein, 9 aa, Homo Sapiens
EQQRRTVHY

SEQ ID NO: 729871 - protein, 9 aa, Homo Sapiens
EKITSSDVV

SEQ ID NO: 729872 - protein, 9 aa, Homo Sapiens
GFQDTFLAS

SEQ ID NO: 729873 - protein, 9 aa, Homo Sapiens
LSIISSQTE

SEQ ID NO: 729874 - protein, 9 aa, Homo Sapiens
PAKSALAPK

SEQ ID NO: 729875 - protein, 9 aa, Homo Sapiens
SLGMLSAIT

SEQ ID NO: 729876 - protein, 9 aa, Homo Sapiens
GIVSWLRRS

SEQ ID NO: 729877 - protein, 9 aa, Homo Sapiens
KTQGRTLYG

SEQ ID NO: 729878 - protein, 9 aa, Homo Sapiens
GAVLASCSP

SEQ ID NO: 729879 - protein, 9 aa, Homo Sapiens
HELPWASLP

SEQ ID NO: 729880 - protein, 9 aa, Homo Sapiens
PQLLTILEA

SEQ ID NO: 729881 - protein, 9 aa, Homo Sapiens
LSRYKKMHF

SEQ ID NO: 729882 - protein, 9 aa, Homo Sapiens
GDLVNPPFS

SEQ ID NO: 729883 - protein, 9 aa, Homo Sapiens
DSRYQNHSS

SEQ ID NO: 729884 - protein, 9 aa, Homo Sapiens
SSIKENALP

SEQ ID NO: 729885 - protein, 9 aa, Homo Sapiens
NFSLFQIHE

SEQ ID NO: 729886 - protein, 9 aa, Homo Sapiens
LQARELLRL

SEQ ID NO: 729887 - protein, 9 aa, Homo Sapiens
FFQGNDLKI

SEQ ID NO: 729888 - protein, 9 aa, Homo Sapiens
MQPEGIVFE

SEQ ID NO: 729889 - protein, 9 aa, Homo Sapiens
DHIQIANCH

SEQ ID NO: 729890 - protein, 9 aa, Homo Sapiens
VPADVEVWA

SEQ ID NO: 729891 - protein, 9 aa, Homo Sapiens
MGSIISTGI

SEQ ID NO: 729892 - protein, 9 aa, Homo Sapiens
EPDLWELQL

SEQ ID NO: 729893 - protein, 9 aa, Homo Sapiens
DGLAPPQLL

SEQ ID NO: 729894 - protein, 9 aa, Homo Sapiens
PVASGRYCK

SEQ ID NO: 729895 - protein, 9 aa, Homo Sapiens
TFALKDGRV

SEQ ID NO: 729896 - protein, 9 aa, Homo Sapiens
CGPSSVGCC

SEQ ID NO: 729897 - protein, 9 aa, Homo Sapiens
DPLSEITKQ

SEQ ID NO: 729898 - protein, 9 aa, Homo Sapiens
ATFALYILT

SEQ ID NO: 729899 - protein, 9 aa, Homo Sapiens
FAVPVTKPL

SEQ ID NO: 729900 - protein, 9 aa, Homo Sapiens
ERGIGWARK

SEQ ID NO: 729901 - protein, 9 aa, Homo Sapiens
YGEGGWRFE

SEQ ID NO: 729902 - protein, 9 aa, Homo Sapiens
LQGHPGHLG

SEQ ID NO: 729903 - protein, 9 aa, Homo Sapiens
ELRVATRWD

SEQ ID NO: 729904 - protein, 9 aa, Homo Sapiens
KSCITSFHV

SEQ ID NO: 729905 - protein, 9 aa, Homo Sapiens
ARQFAIMTP

SEQ ID NO: 729906 - protein, 9 aa, Homo Sapiens
ASGRAIQGA

SEQ ID NO: 729907 - protein, 9 aa, Homo Sapiens
EEPTFKRSQ

SEQ ID NO: 729908 - protein, 9 aa, Homo Sapiens
TYPHCVEKL

SEQ ID NO: 729909 - protein, 9 aa, Homo Sapiens
ALKTVIHDP

SEQ ID NO: 729910 - protein, 9 aa, Homo Sapiens
IMLIARQDY

SEQ ID NO: 729911 - protein, 9 aa, Homo Sapiens
MTSCTIVFV

SEQ ID NO: 729912 - protein, 9 aa, Homo Sapiens
AAEDFKLKY

SEQ ID NO: 729913 - protein, 9 aa, Homo Sapiens
IRERSHQSY

SEQ ID NO: 729914 - protein, 9 aa, Homo Sapiens
RILQACTKK

SEQ ID NO: 729915 - protein, 9 aa, Homo Sapiens
VLRKWKQLL

SEQ ID NO: 729916 - protein, 9 aa, Homo Sapiens
DSIKRREEF

SEQ ID NO: 729917 - protein, 9 aa, Homo Sapiens
PSSKLQDPS

SEQ ID NO: 729918 - protein, 9 aa, Homo Sapiens
VYALKTQGR

SEQ ID NO: 729919 - protein, 9 aa, Homo Sapiens
CSKTINRNR

SEQ ID NO: 729920 - protein, 9 aa, Homo Sapiens
NPGAPSSRE

SEQ ID NO: 729921 - protein, 9 aa, Homo Sapiens
TSSDVLARQ

SEQ ID NO: 729922 - protein, 9 aa, Homo Sapiens
VFDIDRFSR

SEQ ID NO: 729923 - protein, 9 aa, Homo Sapiens
STQFLAHGA

SEQ ID NO: 729924 - protein, 9 aa, Homo Sapiens
AKLAAEDFK

SEQ ID NO: 729925 - protein, 9 aa, Homo Sapiens
CNEKSVSVT

SEQ ID NO: 729926 - protein, 9 aa, Homo Sapiens
YFVVVTVTT

SEQ ID NO: 729927 - protein, 9 aa, Homo Sapiens
RDPLSEITK

SEQ ID NO: 729928 - protein, 9 aa, Homo Sapiens
TSSEGNDQV

SEQ ID NO: 729929 - protein, 9 aa, Homo Sapiens
LIAQVYSAV

SEQ ID NO: 729930 - protein, 9 aa, Homo Sapiens
IKISSFGHN

SEQ ID NO: 729931 - protein, 9 aa, Homo Sapiens
SFSIQLWVI

SEQ ID NO: 729932 - protein, 9 aa, Homo Sapiens
GFKHQIVLC

SEQ ID NO: 729933 - protein, 9 aa, Homo Sapiens
MRKVFIDGA

SEQ ID NO: 729934 - protein, 9 aa, Homo Sapiens
IRLFVQHEQ

SEQ ID NO: 729935 - protein, 9 aa, Homo Sapiens
GPDDFNVWI

SEQ ID NO: 729936 - protein, 9 aa, Homo Sapiens
RVRDIKDHA

SEQ ID NO: 729937 - protein, 9 aa, Homo Sapiens
KGVTFALKD

SEQ ID NO: 729938 - protein, 9 aa, Homo Sapiens
VLARQFAIM

SEQ ID NO: 729939 - protein, 9 aa, Homo Sapiens
QHILDMEAI

SEQ ID NO: 729940 - protein, 9 aa, Homo Sapiens
IIADSDELL

SEQ ID NO: 729941 - protein, 9 aa, Homo Sapiens
DSTYTSVVI

SEQ ID NO: 729942 - protein, 9 aa, Homo Sapiens
QKNVNKYQQ

SEQ ID NO: 729943 - protein, 9 aa, Homo Sapiens
LFSVDSSTN

SEQ ID NO: 729944 - protein, 9 aa, Homo Sapiens
GLAYFTSVL

SEQ ID NO: 729945 - protein, 9 aa, Homo Sapiens
IGQFHKVLS

SEQ ID NO: 729946 - protein, 9 aa, Homo Sapiens
NNWLCTNWI

SEQ ID NO: 729947 - protein, 9 aa, Homo Sapiens
SRSWNELHK

SEQ ID NO: 729948 - protein, 9 aa, Homo Sapiens
STGTSNQKA

SEQ ID NO: 729949 - protein, 9 aa, Homo Sapiens
PTAALQSRA

SEQ ID NO: 729950 - protein, 9 aa, Homo Sapiens
VFGKGVTFA

SEQ ID NO: 729951 - protein, 9 aa, Homo Sapiens
GAPTVPADV

SEQ ID NO: 729952 - protein, 9 aa, Homo Sapiens
GISILLVSS

SEQ ID NO: 729953 - protein, 9 aa, Homo Sapiens
GKVSRKQLL

SEQ ID NO: 729954 - protein, 9 aa, Homo Sapiens
CVVYIDGIG

SEQ ID NO: 729955 - protein, 9 aa, Homo Sapiens
HLKEQSLQA

SEQ ID NO: 729956 - protein, 9 aa, Homo Sapiens
QFLAHGAVL

SEQ ID NO: 729957 - protein, 9 aa, Homo Sapiens
TSCTIVFVS

SEQ ID NO: 729958 - protein, 9 aa, Homo Sapiens
NALLLGYSA

SEQ ID NO: 729959 - protein, 9 aa, Homo Sapiens
GATSHHLGQ

SEQ ID NO: 729960 - protein, 9 aa, Homo Sapiens
ISSFGHNEA

SEQ ID NO: 729961 - protein, 9 aa, Homo Sapiens
LVEKFDLID

SEQ ID NO: 729962 - protein, 9 aa, Homo Sapiens
VEILFGEKI

SEQ ID NO: 729963 - protein, 9 aa, Homo Sapiens
QHVNEQQET

SEQ ID NO: 729964 - protein, 9 aa, Homo Sapiens
HDSRYQNHS

SEQ ID NO: 729965 - protein, 9 aa, Homo Sapiens
FGKGVTFAL

SEQ ID NO: 729966 - protein, 9 aa, Homo Sapiens
PAAAVLIAQ

SEQ ID NO: 729967 - protein, 9 aa, Homo Sapiens
EAILMDTEH

SEQ ID NO: 729968 - protein, 9 aa, Homo Sapiens
SSASLGMLS

SEQ ID NO: 729969 - protein, 9 aa, Homo Sapiens
IDRFSRHDM

SEQ ID NO: 729970 - protein, 9 aa, Homo Sapiens
KEMKSPELC

SEQ ID NO: 729971 - protein, 9 aa, Homo Sapiens
ARELLRLGK

SEQ ID NO: 729972 - protein, 9 aa, Homo Sapiens
SPPPVSSAS

SEQ ID NO: 729973 - protein, 9 aa, Homo Sapiens
AEDFKLKYE

SEQ ID NO: 729974 - protein, 9 aa, Homo Sapiens
GNPGAPSSR

SEQ ID NO: 729975 - protein, 9 aa, Homo Sapiens
KVQRSLGPQ

SEQ ID NO: 729976 - protein, 9 aa, Homo Sapiens
TILLFLNIL

SEQ ID NO: 729977 - protein, 9 aa, Homo Sapiens
NQDHNLLSQ

SEQ ID NO: 729978 - protein, 9 aa, Homo Sapiens
SSDKTTHHE

SEQ ID NO: 729979 - protein, 9 aa, Homo Sapiens
LVSEVIGVS

SEQ ID NO: 729980 - protein, 9 aa, Homo Sapiens
YYNEALSFE

SEQ ID NO: 729981 - protein, 9 aa, Homo Sapiens
FQSSAVIAL

SEQ ID NO: 729982 - protein, 9 aa, Homo Sapiens
KIQCQEGGI

SEQ ID NO: 729983 - protein, 9 aa, Homo Sapiens
GLKKESELD

SEQ ID NO: 729984 - protein, 9 aa, Homo Sapiens
NTGSTWDAT

SEQ ID NO: 729985 - protein, 9 aa, Homo Sapiens
KKIHTVEKT

SEQ ID NO: 729986 - protein, 9 aa, Homo Sapiens
DCINSVVEG

SEQ ID NO: 729987 - protein, 9 aa, Homo Sapiens
RIIYNNADG

SEQ ID NO: 729988 - protein, 9 aa, Homo Sapiens
AELQASIQG

SEQ ID NO: 729989 - protein, 9 aa, Homo Sapiens
AWLQARELL

SEQ ID NO: 729990 - protein, 9 aa, Homo Sapiens
KMPVMHFKA

SEQ ID NO: 729991 - protein, 9 aa, Homo Sapiens
IHRYIITLH

SEQ ID NO: 729992 - protein, 9 aa, Homo Sapiens
GRGYLVSTD

SEQ ID NO: 729993 - protein, 9 aa, Homo Sapiens
IAQEINDVA

SEQ ID NO: 729994 - protein, 9 aa, Homo Sapiens
VAGTTRASP

SEQ ID NO: 729995 - protein, 9 aa, Homo Sapiens
TFALYILTP

SEQ ID NO: 729996 - protein, 9 aa, Homo Sapiens
KQSTRNITP

SEQ ID NO: 729997 - protein, 9 aa, Homo Sapiens
VVKETIKGH

SEQ ID NO: 729998 - protein, 9 aa, Homo Sapiens
GAAVLSGQH

SEQ ID NO: 729999 - protein, 9 aa, Homo Sapiens
SAVESVTER

SEQ ID NO: 730000 - protein, 9 aa, Homo Sapiens
QFICLVFIT

SEQ ID NO: 730001 - protein, 9 aa, Homo Sapiens
QLKPRPKPK

SEQ ID NO: 730002 - protein, 9 aa, Homo Sapiens
FNDSHYGQQ

SEQ ID NO: 730003 - protein, 9 aa, Homo Sapiens
PYIFACPGT

SEQ ID NO: 730004 - protein, 9 aa, Homo Sapiens
FGSVSIMYL

SEQ ID NO: 730005 - protein, 9 aa, Homo Sapiens
SEVIGVSDL

SEQ ID NO: 730006 - protein, 9 aa, Homo Sapiens
VGKVSRKQL

SEQ ID NO: 730007 - protein, 9 aa, Homo Sapiens
HSIINECKG

SEQ ID NO: 730008 - protein, 9 aa, Homo Sapiens
CEEIRDNTE

SEQ ID NO: 730009 - protein, 9 aa, Homo Sapiens
NGIQPSSFS

SEQ ID NO: 730010 - protein, 9 aa, Homo Sapiens
SPEPSNPAS

SEQ ID NO: 730011 - protein, 9 aa, Homo Sapiens
RQFAIMTPL

SEQ ID NO: 730012 - protein, 9 aa, Homo Sapiens
GPAEDNVDH

SEQ ID NO: 730013 - protein, 9 aa, Homo Sapiens
ACQVIGFQD

SEQ ID NO: 730014 - protein, 9 aa, Homo Sapiens
FTFKVLKKH

SEQ ID NO: 730015 - protein, 9 aa, Homo Sapiens
LEAATILLA

SEQ ID NO: 730016 - protein, 9 aa, Homo Sapiens
RLVVANLDK

SEQ ID NO: 730017 - protein, 9 aa, Homo Sapiens
TLPHFIEET

SEQ ID NO: 730018 - protein, 9 aa, Homo Sapiens
PDLWELQLQ

SEQ ID NO: 730019 - protein, 9 aa, Homo Sapiens
GKLYECKQC

SEQ ID NO: 730020 - protein, 9 aa, Homo Sapiens
GQQGMFVQK

SEQ ID NO: 730021 - protein, 9 aa, Homo Sapiens
AMEMLKKEP

SEQ ID NO: 730022 - protein, 9 aa, Homo Sapiens
ERVMHGEAN

SEQ ID NO: 730023 - protein, 9 aa, Homo Sapiens
LGSGLSTNR

SEQ ID NO: 730024 - protein, 9 aa, Homo Sapiens
ELVIHILHK

SEQ ID NO: 730025 - protein, 9 aa, Homo Sapiens
RGRFGKGNI

SEQ ID NO: 730026 - protein, 9 aa, Homo Sapiens
GEVWWAASN

SEQ ID NO: 730027 - protein, 9 aa, Homo Sapiens
TSFVHAACV

SEQ ID NO: 730028 - protein, 9 aa, Homo Sapiens
FPPNQRTLA

SEQ ID NO: 730029 - protein, 9 aa, Homo Sapiens
GAARKTIYK

SEQ ID NO: 730030 - protein, 9 aa, Homo Sapiens
ELCTVDIGF

SEQ ID NO: 730031 - protein, 9 aa, Homo Sapiens
ISTGIVQGS

SEQ ID NO: 730032 - protein, 9 aa, Homo Sapiens
SEYGILEAN

SEQ ID NO: 730033 - protein, 9 aa, Homo Sapiens
DGAKKIDTI

SEQ ID NO: 730034 - protein, 9 aa, Homo Sapiens
EAMPRRPSN

SEQ ID NO: 730035 - protein, 9 aa, Homo Sapiens
FKRSQSSHQ

SEQ ID NO: 730036 - protein, 9 aa, Homo Sapiens
DINAKNTVL

SEQ ID NO: 730037 - protein, 9 aa, Homo Sapiens
RVFYVGCMT

SEQ ID NO: 730038 - protein, 9 aa, Homo Sapiens
FSLFQIHER

SEQ ID NO: 730039 - protein, 9 aa, Homo Sapiens
LCWLPQSVY

SEQ ID NO: 730040 - protein, 9 aa, Homo Sapiens
AIQGATSHH

SEQ ID NO: 730041 - protein, 9 aa, Homo Sapiens
CTVDIGFKD

SEQ ID NO: 730042 - protein, 9 aa, Homo Sapiens
KFSPYLSQM

SEQ ID NO: 730043 - protein, 9 aa, Homo Sapiens
QLSAHLGLN

SEQ ID NO: 730044 - protein, 9 aa, Homo Sapiens
RESRSETWR

SEQ ID NO: 730045 - protein, 9 aa, Homo Sapiens
VLDSPAKGP

SEQ ID NO: 730046 - protein, 9 aa, Homo Sapiens
VPVVPQAPA

SEQ ID NO: 730047 - protein, 9 aa, Homo Sapiens
FANSMLCVF

SEQ ID NO: 730048 - protein, 9 aa, Homo Sapiens
HHCPLVGNC

SEQ ID NO: 730049 - protein, 9 aa, Homo Sapiens
MVAVAQRSM

SEQ ID NO: 730050 - protein, 9 aa, Homo Sapiens
LLIRVEGNL

SEQ ID NO: 730051 - protein, 9 aa, Homo Sapiens
VTRVRHRMN

SEQ ID NO: 730052 - protein, 9 aa, Homo Sapiens
CHLSRLMVG

SEQ ID NO: 730053 - protein, 9 aa, Homo Sapiens
QTERFRARN

SEQ ID NO: 730054 - protein, 9 aa, Homo Sapiens
SISSFSETD

SEQ ID NO: 730055 - protein, 9 aa, Homo Sapiens
DGRNCVYEN

SEQ ID NO: 730056 - protein, 9 aa, Homo Sapiens
QLSACGHSS

SEQ ID NO: 730057 - protein, 9 aa, Homo Sapiens
LSNHNPQAY

SEQ ID NO: 730058 - protein, 9 aa, Homo Sapiens
DVDETGITL

SEQ ID NO: 730059 - protein, 9 aa, Homo Sapiens
QACTKKVDE

SEQ ID NO: 730060 - protein, 9 aa, Homo Sapiens
QEINDVAGE

SEQ ID NO: 730061 - protein, 9 aa, Homo Sapiens
NRLVVANLD

SEQ ID NO: 730062 - protein, 9 aa, Homo Sapiens
SFKTQKAMK

SEQ ID NO: 730063 - protein, 9 aa, Homo Sapiens
QKAQGKDRH

SEQ ID NO: 730064 - protein, 9 aa, Homo Sapiens
INECKGSPL

SEQ ID NO: 730065 - protein, 9 aa, Homo Sapiens
AEQRDPAAP

SEQ ID NO: 730066 - protein, 9 aa, Homo Sapiens
YIRLFVQHE

SEQ ID NO: 730067 - protein, 9 aa, Homo Sapiens
NSNYQDVDT

SEQ ID NO: 730068 - protein, 9 aa, Homo Sapiens
SNYIRLFVQ

SEQ ID NO: 730069 - protein, 9 aa, Homo Sapiens
PLAYTYSAF

SEQ ID NO: 730070 - protein, 9 aa, Homo Sapiens
QKTDDLLVA

SEQ ID NO: 730071 - protein, 9 aa, Homo Sapiens
NYGFISAIL

SEQ ID NO: 730072 - protein, 9 aa, Homo Sapiens
EKYRYQNED

SEQ ID NO: 730073 - protein, 9 aa, Homo Sapiens
TSNQKAQGK

SEQ ID NO: 730074 - protein, 9 aa, Homo Sapiens
EVWWAASNL

SEQ ID NO: 730075 - protein, 9 aa, Homo Sapiens
KIGQFHKVL

SEQ ID NO: 730076 - protein, 9 aa, Homo Sapiens
ASLRVRDIK

SEQ ID NO: 730077 - protein, 9 aa, Homo Sapiens
PQSVYSLLS

SEQ ID NO: 730078 - protein, 9 aa, Homo Sapiens
NRSEPCPRD

SEQ ID NO: 730079 - protein, 9 aa, Homo Sapiens
THSRMGSII

SEQ ID NO: 730080 - protein, 9 aa, Homo Sapiens
EPCPRDTRI

SEQ ID NO: 730081 - protein, 9 aa, Homo Sapiens
NIAELSHAN

SEQ ID NO: 730082 - protein, 9 aa, Homo Sapiens
KNRSPTKYM

SEQ ID NO: 730083 - protein, 9 aa, Homo Sapiens
PHFIEETDD

SEQ ID NO: 730084 - protein, 9 aa, Homo Sapiens
LIAGAIGNG

SEQ ID NO: 730085 - protein, 9 aa, Homo Sapiens
IQHVNEQQE

SEQ ID NO: 730086 - protein, 9 aa, Homo Sapiens
ITLASLERF

SEQ ID NO: 730087 - protein, 9 aa, Homo Sapiens
NLITDLQDQ

SEQ ID NO: 730088 - protein, 9 aa, Homo Sapiens
VYENECATG

SEQ ID NO: 730089 - protein, 9 aa, Homo Sapiens
RIGIPSQAL

SEQ ID NO: 730090 - protein, 9 aa, Homo Sapiens
ICLVFITTV

SEQ ID NO: 730091 - protein, 9 aa, Homo Sapiens
ALPSGTLQE

SEQ ID NO: 730092 - protein, 9 aa, Homo Sapiens
VHELPWASL

SEQ ID NO: 730093 - protein, 9 aa, Homo Sapiens
CTLAVKLGG

SEQ ID NO: 730094 - protein, 9 aa, Homo Sapiens
STVSFSISS

SEQ ID NO: 730095 - protein, 9 aa, Homo Sapiens
RAIQGATSH

SEQ ID NO: 730096 - protein, 9 aa, Homo Sapiens
LIMLIARQD

SEQ ID NO: 730097 - protein, 9 aa, Homo Sapiens
ASLSSPSPA

SEQ ID NO: 730098 - protein, 9 aa, Homo Sapiens
GMGRYSAVE

SEQ ID NO: 730099 - protein, 9 aa, Homo Sapiens
WFSPPPPGY

SEQ ID NO: 730100 - protein, 9 aa, Homo Sapiens
QEVQDTVFK

SEQ ID NO: 730101 - protein, 9 aa, Homo Sapiens
SDCINSVVE

SEQ ID NO: 730102 - protein, 9 aa, Homo Sapiens
KIPPFECEQ

SEQ ID NO: 730103 - protein, 9 aa, Homo Sapiens
LPGRAWLQA

SEQ ID NO: 730104 - protein, 9 aa, Homo Sapiens
PVLSPSTGS

SEQ ID NO: 730105 - protein, 9 aa, Homo Sapiens
EPSAAMTTT

SEQ ID NO: 730106 - protein, 9 aa, Homo Sapiens
CDVVKRFGK

SEQ ID NO: 730107 - protein, 9 aa, Homo Sapiens
SVDSSTNQS

SEQ ID NO: 730108 - protein, 9 aa, Homo Sapiens
VSSASLSSP

SEQ ID NO: 730109 - protein, 9 aa, Homo Sapiens
AVKLGGSAV

SEQ ID NO: 730110 - protein, 9 aa, Homo Sapiens
PTTNPTTGL

SEQ ID NO: 730111 - protein, 9 aa, Homo Sapiens
TVPADVEVW

SEQ ID NO: 730112 - protein, 9 aa, Homo Sapiens
KSPELCTVD

SEQ ID NO: 730113 - protein, 9 aa, Homo Sapiens
ASLIKESGP

SEQ ID NO: 730114 - protein, 9 aa, Homo Sapiens
LKKAKSVQI

SEQ ID NO: 730115 - protein, 9 aa, Homo Sapiens
LVGNCVGAG

SEQ ID NO: 730116 - protein, 9 aa, Homo Sapiens
TDAGGSGSP

SEQ ID NO: 730117 - protein, 9 aa, Homo Sapiens
FGHNEAGSE

SEQ ID NO: 730118 - protein, 9 aa, Homo Sapiens
SMTHIAGKP

SEQ ID NO: 730119 - protein, 9 aa, Homo Sapiens
VEKFDLIDK

SEQ ID NO: 730120 - protein, 9 aa, Homo Sapiens
GRVFYVGCM

SEQ ID NO: 730121 - protein, 9 aa, Homo Sapiens
SALALASFK

SEQ ID NO: 730122 - protein, 9 aa, Homo Sapiens
AMTTTAPPP

SEQ ID NO: 730123 - protein, 9 aa, Homo Sapiens
LQAIDSLIS

SEQ ID NO: 730124 - protein, 9 aa, Homo Sapiens
NEAALQKML

SEQ ID NO: 730125 - protein, 9 aa, Homo Sapiens
WNELHKIVV

SEQ ID NO: 730126 - protein, 9 aa, Homo Sapiens
CCDRGSGQQ

SEQ ID NO: 730127 - protein, 9 aa, Homo Sapiens
VFIDGAKKI

SEQ ID NO: 730128 - protein, 9 aa, Homo Sapiens
NKHFLWPYN

SEQ ID NO: 730129 - protein, 9 aa, Homo Sapiens
SCCGGGSGH

SEQ ID NO: 730130 - protein, 9 aa, Homo Sapiens
PSAAMTTTA

SEQ ID NO: 730131 - protein, 9 aa, Homo Sapiens
PRPKPKEAD

SEQ ID NO: 730132 - protein, 9 aa, Homo Sapiens
FGKGNIWSA

SEQ ID NO: 730133 - protein, 9 aa, Homo Sapiens
IELIRDSLI

SEQ ID NO: 730134 - protein, 9 aa, Homo Sapiens
TWVCGVAAG

SEQ ID NO: 730135 - protein, 9 aa, Homo Sapiens
TLKGENKNL

SEQ ID NO: 730136 - protein, 9 aa, Homo Sapiens
SGKTDLSSL

SEQ ID NO: 730137 - protein, 9 aa, Homo Sapiens
CLVAASVSQ

SEQ ID NO: 730138 - protein, 9 aa, Homo Sapiens
TAYLTLDPG

SEQ ID NO: 730139 - protein, 9 aa, Homo Sapiens
LKEQSLQAI

SEQ ID NO: 730140 - protein, 9 aa, Homo Sapiens
LTYPMFQIH

SEQ ID NO: 730141 - protein, 9 aa, Homo Sapiens
FSVDSSTNQ

SEQ ID NO: 730142 - protein, 9 aa, Homo Sapiens
YIFACPGTL

SEQ ID NO: 730143 - protein, 9 aa, Homo Sapiens
ATILLFLNI

SEQ ID NO: 730144 - protein, 9 aa, Homo Sapiens
TGMKSLVNK

SEQ ID NO: 730145 - protein, 9 aa, Homo Sapiens
NPASVSSPE

SEQ ID NO: 730146 - protein, 9 aa, Homo Sapiens
VKETIKGHS

SEQ ID NO: 730147 - protein, 8 aa, Homo Sapiens
VGKMWPVL

SEQ ID NO: 730148 - protein, 9 aa, Homo Sapiens
SGSSDAEQR

SEQ ID NO: 730149 - protein, 9 aa, Homo Sapiens
ATSSGKSIN

SEQ ID NO: 730150 - protein, 9 aa, Homo Sapiens
KKESELDRA

SEQ ID NO: 730151 - protein, 9 aa, Homo Sapiens
VTVTTVGFG

SEQ ID NO: 730152 - protein, 9 aa, Homo Sapiens
SEWDEIIQL

SEQ ID NO: 730153 - protein, 9 aa, Homo Sapiens
PFCLGTGYI

SEQ ID NO: 730154 - protein, 9 aa, Homo Sapiens
RGPLVTCKC

SEQ ID NO: 730155 - protein, 9 aa, Homo Sapiens
DGRLKTWVC

SEQ ID NO: 730156 - protein, 9 aa, Homo Sapiens
PKPKEADES

SEQ ID NO: 730157 - protein, 9 aa, Homo Sapiens
MSEFIFPTQ

SEQ ID NO: 730158 - protein, 9 aa, Homo Sapiens
KRSQSSHQR

SEQ ID NO: 730159 - protein, 9 aa, Homo Sapiens
LKKESELDR

SEQ ID NO: 730160 - protein, 9 aa, Homo Sapiens
ETAIEHNKQ

SEQ ID NO: 730161 - protein, 9 aa, Homo Sapiens
VERILDTWP

SEQ ID NO: 730162 - protein, 9 aa, Homo Sapiens
SNKHFLWPY

SEQ ID NO: 730163 - protein, 9 aa, Homo Sapiens
HFLWPYNPV

SEQ ID NO: 730164 - protein, 9 aa, Homo Sapiens
NGAVIIIFC

SEQ ID NO: 730165 - protein, 9 aa, Homo Sapiens
KKMHFFNVP

SEQ ID NO: 730166 - protein, 9 aa, Homo Sapiens
IVHSSSGAI

SEQ ID NO: 730167 - protein, 9 aa, Homo Sapiens
EKEHEEMDE

SEQ ID NO: 730168 - protein, 9 aa, Homo Sapiens
AGAPTVPAD

SEQ ID NO: 730169 - protein, 9 aa, Homo Sapiens
VQHEQLLNN

SEQ ID NO: 730170 - protein, 9 aa, Homo Sapiens
IADSDELLS

SEQ ID NO: 730171 - protein, 9 aa, Homo Sapiens
HIGYLYVDL

SEQ ID NO: 730172 - protein, 9 aa, Homo Sapiens
GSVSIMYLR

SEQ ID NO: 730173 - protein, 9 aa, Homo Sapiens
EAMVLESVT

SEQ ID NO: 730174 - protein, 9 aa, Homo Sapiens
IVFVSPLIV

SEQ ID NO: 730175 - protein, 9 aa, Homo Sapiens
ENEEWICAM

SEQ ID NO: 730176 - protein, 9 aa, Homo Sapiens
DVQAMDNAG

SEQ ID NO: 730177 - protein, 9 aa, Homo Sapiens
RCQSSNCCD

SEQ ID NO: 730178 - protein, 9 aa, Homo Sapiens
RDEVEAKAN

SEQ ID NO: 730179 - protein, 9 aa, Homo Sapiens
NFLHLKCNE

SEQ ID NO: 730180 - protein, 9 aa, Homo Sapiens
ESASMSGAA

SEQ ID NO: 730181 - protein, 9 aa, Homo Sapiens
DVLARQFAI

SEQ ID NO: 730182 - protein, 9 aa, Homo Sapiens
CSIKSCITS

SEQ ID NO: 730183 - protein, 9 aa, Homo Sapiens
DVLLMAAFV

SEQ ID NO: 730184 - protein, 9 aa, Homo Sapiens
SLRKRLGSG

SEQ ID NO: 730185 - protein, 9 aa, Homo Sapiens
HSSSGAIWT

SEQ ID NO: 730186 - protein, 9 aa, Homo Sapiens
RRVLRKWKQ

SEQ ID NO: 730187 - protein, 9 aa, Homo Sapiens
ARQTASVAL

SEQ ID NO: 730188 - protein, 9 aa, Homo Sapiens
MSVVSDSIK

SEQ ID NO: 730189 - protein, 9 aa, Homo Sapiens
MFVQKGDEG

SEQ ID NO: 730190 - protein, 9 aa, Homo Sapiens
QFHKVLSDI

SEQ ID NO: 730191 - protein, 9 aa, Homo Sapiens
EESFDIPEN

SEQ ID NO: 730192 - protein, 9 aa, Homo Sapiens
RDHDSRYQN

SEQ ID NO: 730193 - protein, 9 aa, Homo Sapiens
CVMNLDLTG

SEQ ID NO: 730194 - protein, 9 aa, Homo Sapiens
QVEPLLGRA

SEQ ID NO: 730195 - protein, 9 aa, Homo Sapiens
HIAGKPYEC

SEQ ID NO: 730196 - protein, 9 aa, Homo Sapiens
AMSVVSDSI

SEQ ID NO: 730197 - protein, 9 aa, Homo Sapiens
GLIAGAIGN

SEQ ID NO: 730198 - protein, 9 aa, Homo Sapiens
YTSVVISSC

SEQ ID NO: 730199 - protein, 9 aa, Homo Sapiens
TYICLATKK

SEQ ID NO: 730200 - protein, 9 aa, Homo Sapiens
ASDCINSVV

SEQ ID NO: 730201 - protein, 9 aa, Homo Sapiens
GHLGIPGRV

SEQ ID NO: 730202 - protein, 9 aa, Homo Sapiens
LVTCKCESP

SEQ ID NO: 730203 - protein, 9 aa, Homo Sapiens
IWLSRYKKM

SEQ ID NO: 730204 - protein, 9 aa, Homo Sapiens
PSNRWLRLL

SEQ ID NO: 730205 - protein, 9 aa, Homo Sapiens
SGAARKTIY

SEQ ID NO: 730206 - protein, 9 aa, Homo Sapiens
QFKSYVTGC

SEQ ID NO: 730207 - protein, 9 aa, Homo Sapiens
SALEDRFEA

SEQ ID NO: 730208 - protein, 9 aa, Homo Sapiens
PEQAHSIIN

SEQ ID NO: 730209 - protein, 9 aa, Homo Sapiens
YVTGCAIHQ

SEQ ID NO: 730210 - protein, 9 aa, Homo Sapiens
SRMGSIIST

SEQ ID NO: 730211 - protein, 9 aa, Homo Sapiens
CLRGRFGKG

SEQ ID NO: 730212 - protein, 9 aa, Homo Sapiens
HTTSSEGND

SEQ ID NO: 730213 - protein, 9 aa, Homo Sapiens
TLASLERFS

SEQ ID NO: 730214 - protein, 9 aa, Homo Sapiens
ESHTWSLEL

SEQ ID NO: 730215 - protein, 9 aa, Homo Sapiens
GAIWTLLGT

SEQ ID NO: 730216 - protein, 9 aa, Homo Sapiens
CIELLVVVD

SEQ ID NO: 730217 - protein, 9 aa, Homo Sapiens
QCHRAKIDN

SEQ ID NO: 730218 - protein, 9 aa, Homo Sapiens
RYKKMHFFN

SEQ ID NO: 730219 - protein, 9 aa, Homo Sapiens
VVTLLRDSI

SEQ ID NO: 730220 - protein, 9 aa, Homo Sapiens
IARQDYELI

SEQ ID NO: 730221 - protein, 9 aa, Homo Sapiens
IYFVVVTVT

SEQ ID NO: 730222 - protein, 9 aa, Homo Sapiens
DGLKKESEL

SEQ ID NO: 730223 - protein, 9 aa, Homo Sapiens
STRNITPTI

SEQ ID NO: 730224 - protein, 9 aa, Homo Sapiens
PAEDNVDHN

SEQ ID NO: 730225 - protein, 9 aa, Homo Sapiens
AELSHANNR

SEQ ID NO: 730226 - protein, 9 aa, Homo Sapiens
SVEKYRYQN

SEQ ID NO: 730227 - protein, 9 aa, Homo Sapiens
AIDSLISAL

SEQ ID NO: 730228 - protein, 9 aa, Homo Sapiens
LQSRALGPG

SEQ ID NO: 730229 - protein, 9 aa, Homo Sapiens
EIFCPSPPL

SEQ ID NO: 730230 - protein, 9 aa, Homo Sapiens
LATVLFIMG

SEQ ID NO: 730231 - protein, 9 aa, Homo Sapiens
LCTVDIGFK

SEQ ID NO: 730232 - protein, 9 aa, Homo Sapiens
AVLSGQHEE

SEQ ID NO: 730233 - protein, 9 aa, Homo Sapiens
QPCRCNSGG

SEQ ID NO: 730234 - protein, 9 aa, Homo Sapiens
NGSSDTGMK

SEQ ID NO: 730235 - protein, 9 aa, Homo Sapiens
EQFLSILPA

SEQ ID NO: 730236 - protein, 9 aa, Homo Sapiens
SSLWSCWFP

SEQ ID NO: 730237 - protein, 9 aa, Homo Sapiens
KRQSWFSPP

SEQ ID NO: 730238 - protein, 9 aa, Homo Sapiens
QLFLDLSNH

SEQ ID NO: 730239 - protein, 9 aa, Homo Sapiens
PPGGPVLSP

SEQ ID NO: 730240 - protein, 9 aa, Homo Sapiens
TTRASPSCV

SEQ ID NO: 730241 - protein, 9 aa, Homo Sapiens
FYTQLVLFP

SEQ ID NO: 730242 - protein, 9 aa, Homo Sapiens
TGTSNQKAQ

SEQ ID NO: 730243 - protein, 9 aa, Homo Sapiens
TPKTEEKDS

SEQ ID NO: 730244 - protein, 9 aa, Homo Sapiens
VHAACVVYI

SEQ ID NO: 730245 - protein, 9 aa, Homo Sapiens
STTQKTDDL

SEQ ID NO: 730246 - protein, 9 aa, Homo Sapiens
IRCFCKHIL

SEQ ID NO: 730247 - protein, 9 aa, Homo Sapiens
IPENPPASL

SEQ ID NO: 730248 - protein, 9 aa, Homo Sapiens
TLRDSTTQK

SEQ ID NO: 730249 - protein, 9 aa, Homo Sapiens
DVVYALKTQ

SEQ ID NO: 730250 - protein, 9 aa, Homo Sapiens
IGWARKTGQ

SEQ ID NO: 730251 - protein, 9 aa, Homo Sapiens
SLQAIDSLI

SEQ ID NO: 730252 - protein, 9 aa, Homo Sapiens
ADSDELLSK

SEQ ID NO: 730253 - protein, 9 aa, Homo Sapiens
IQIANCHLS

SEQ ID NO: 730254 - protein, 9 aa, Homo Sapiens
GKGFISFLF

SEQ ID NO: 730255 - protein, 9 aa, Homo Sapiens
VNECKTLQG

SEQ ID NO: 730256 - protein, 9 aa, Homo Sapiens
FKTQKAMKN

SEQ ID NO: 730257 - protein, 9 aa, Homo Sapiens
LSSLEPIVT

SEQ ID NO: 730258 - protein, 9 aa, Homo Sapiens
LHKIVVVQS

SEQ ID NO: 730259 - protein, 9 aa, Homo Sapiens
EELCGLKKL

SEQ ID NO: 730260 - protein, 9 aa, Homo Sapiens
SGSPVPTRR

SEQ ID NO: 730261 - protein, 9 aa, Homo Sapiens
LPGVHELPW

SEQ ID NO: 730262 - protein, 9 aa, Homo Sapiens
ISEWDEIIQ

SEQ ID NO: 730263 - protein, 9 aa, Homo Sapiens
HVNEQQETK

SEQ ID NO: 730264 - protein, 9 aa, Homo Sapiens
ELLKDPRNQ

SEQ ID NO: 730265 - protein, 9 aa, Homo Sapiens
QLETLKGEN

SEQ ID NO: 730266 - protein, 9 aa, Homo Sapiens
LFFQGNDLK

SEQ ID NO: 730267 - protein, 9 aa, Homo Sapiens
THLLQFYGE

SEQ ID NO: 730268 - protein, 9 aa, Homo Sapiens
VIVNIGRDA

SEQ ID NO: 730269 - protein, 9 aa, Homo Sapiens
SIHTEDKPY

SEQ ID NO: 730270 - protein, 9 aa, Homo Sapiens
KLNCKILGV

SEQ ID NO: 730271 - protein, 9 aa, Homo Sapiens
RAFNLAPLQ

SEQ ID NO: 730272 - protein, 9 aa, Homo Sapiens
IHTVEKTYK

SEQ ID NO: 730273 - protein, 9 aa, Homo Sapiens
SSQTERFRA

SEQ ID NO: 730274 - protein, 9 aa, Homo Sapiens
MVEAEGVPL

SEQ ID NO: 730275 - protein, 9 aa, Homo Sapiens
CWLPQSVYS

SEQ ID NO: 730276 - protein, 9 aa, Homo Sapiens
KLYRPDMII

SEQ ID NO: 730277 - protein, 9 aa, Homo Sapiens
VIKTKEQDE

SEQ ID NO: 730278 - protein, 9 aa, Homo Sapiens
QGATSHHLG

SEQ ID NO: 730279 - protein, 9 aa, Homo Sapiens
CIAQCHRAK

SEQ ID NO: 730280 - protein, 9 aa, Homo Sapiens
RLEEFRNEA

SEQ ID NO: 730281 - protein, 9 aa, Homo Sapiens
VFYVGCMTQ

SEQ ID NO: 730282 - protein, 9 aa, Homo Sapiens
QTTVTEFIL

SEQ ID NO: 730283 - protein, 9 aa, Homo Sapiens
NCCDRGSGQ

SEQ ID NO: 730284 - protein, 9 aa, Homo Sapiens
DLQFKSYVT

SEQ ID NO: 730285 - protein, 9 aa, Homo Sapiens
EWICAMNNI

SEQ ID NO: 730286 - protein, 9 aa, Homo Sapiens
VHRPQLSAC

SEQ ID NO: 730287 - protein, 9 aa, Homo Sapiens
KGENKNLQQ

SEQ ID NO: 730288 - protein, 9 aa, Homo Sapiens
ERSHQSYAK

SEQ ID NO: 730289 - protein, 9 aa, Homo Sapiens
LLATVLFIM

SEQ ID NO: 730290 - protein, 9 aa, Homo Sapiens
RKPLSLVYR

SEQ ID NO: 730291 - protein, 9 aa, Homo Sapiens
RQINGYRII

SEQ ID NO: 730292 - protein, 9 aa, Homo Sapiens
GMFVQKGDE

SEQ ID NO: 730293 - protein, 9 aa, Homo Sapiens
SFGHNEAGS

SEQ ID NO: 730294 - protein, 9 aa, Homo Sapiens
TKYMDSEEK

SEQ ID NO: 730295 - protein, 9 aa, Homo Sapiens
EATAGAAVL

SEQ ID NO: 730296 - protein, 9 aa, Homo Sapiens
SVFDIDRFS

SEQ ID NO: 730297 - protein, 9 aa, Homo Sapiens
LAYTYSAFF

SEQ ID NO: 730298 - protein, 9 aa, Homo Sapiens
CLLQWAVDP

SEQ ID NO: 730299 - protein, 9 aa, Homo Sapiens
ALALASFKI

SEQ ID NO: 730300 - protein, 9 aa, Homo Sapiens
IAQCHRAKI

SEQ ID NO: 730301 - protein, 9 aa, Homo Sapiens
FYQFLISWP

SEQ ID NO: 730302 - protein, 9 aa, Homo Sapiens
RKNRLVVAN

SEQ ID NO: 730303 - protein, 9 aa, Homo Sapiens
EEMDEGSQS

SEQ ID NO: 730304 - protein, 9 aa, Homo Sapiens
ALQSRALGP

SEQ ID NO: 730305 - protein, 9 aa, Homo Sapiens
SLPPGGPVL

SEQ ID NO: 730306 - protein, 9 aa, Homo Sapiens
HLDAVPCSK

SEQ ID NO: 730307 - protein, 9 aa, Homo Sapiens
HPGHLGIPG

SEQ ID NO: 730308 - protein, 9 aa, Homo Sapiens
RCTLAVKLG

SEQ ID NO: 730309 - protein, 9 aa, Homo Sapiens
PPFCLGTGY

SEQ ID NO: 730310 - protein, 9 aa, Homo Sapiens
DFNYKKKRQ

SEQ ID NO: 730311 - protein, 9 aa, Homo Sapiens
NDHIQIANC

SEQ ID NO: 730312 - protein, 9 aa, Homo Sapiens
TQDFPESNS

SEQ ID NO: 730313 - protein, 9 aa, Homo Sapiens
AYVPAAVTA

SEQ ID NO: 730314 - protein, 9 aa, Homo Sapiens
YPHCVEKLN

SEQ ID NO: 730315 - protein, 9 aa, Homo Sapiens
VDTLYNFLI

SEQ ID NO: 730316 - protein, 9 aa, Homo Sapiens
EAVKLNCKI

SEQ ID NO: 730317 - protein, 9 aa, Homo Sapiens
NSVVEGSEL

SEQ ID NO: 730318 - protein, 9 aa, Homo Sapiens
LLSKRRFSS

SEQ ID NO: 730319 - protein, 9 aa, Homo Sapiens
RMDNAVPVV

SEQ ID NO: 730320 - protein, 9 aa, Homo Sapiens
SVLDSPAKG

SEQ ID NO: 730321 - protein, 9 aa, Homo Sapiens
KDCRRSSGH

SEQ ID NO: 730322 - protein, 9 aa, Homo Sapiens
PQVFEQRAE

SEQ ID NO: 730323 - protein, 9 aa, Homo Sapiens
ILEAATILL

SEQ ID NO: 730324 - protein, 9 aa, Homo Sapiens
MGLRKLYRP

SEQ ID NO: 730325 - protein, 9 aa, Homo Sapiens
EKLKKAKSV

SEQ ID NO: 730326 - protein, 9 aa, Homo Sapiens
LKIQCQEGG

SEQ ID NO: 730327 - protein, 9 aa, Homo Sapiens
SASLGMLSA

SEQ ID NO: 730328 - protein, 9 aa, Homo Sapiens
RRELGDKMD

SEQ ID NO: 730329 - protein, 9 aa, Homo Sapiens
LTTHKSIHT

SEQ ID NO: 730330 - protein, 9 aa, Homo Sapiens
IFRFSATFA

SEQ ID NO: 730331 - protein, 9 aa, Homo Sapiens
EGNDQVVTM

SEQ ID NO: 730332 - protein, 9 aa, Homo Sapiens
PKTEEKDSK

SEQ ID NO: 730333 - protein, 9 aa, Homo Sapiens
MSGAARKTI

SEQ ID NO: 730334 - protein, 9 aa, Homo Sapiens
HKQDHQYVI

SEQ ID NO: 730335 - protein, 9 aa, Homo Sapiens
LQFKSYVTG

SEQ ID NO: 730336 - protein, 9 aa, Homo Sapiens
WKIQKIAYH

SEQ ID NO: 730337 - protein, 9 aa, Homo Sapiens
PGGPVLSPS

SEQ ID NO: 730338 - protein, 9 aa, Homo Sapiens
ERQHRQIAI

SEQ ID NO: 730339 - protein, 9 aa, Homo Sapiens
LIKESGPDD

SEQ ID NO: 730340 - protein, 9 aa, Homo Sapiens
VNIGRDARL

SEQ ID NO: 730341 - protein, 9 aa, Homo Sapiens
HRPQLSACG

SEQ ID NO: 730342 - protein, 9 aa, Homo Sapiens
FSPYLSQMI

SEQ ID NO: 730343 - protein, 9 aa, Homo Sapiens
LQKMLFKII

SEQ ID NO: 730344 - protein, 9 aa, Homo Sapiens
IAQVYSAVL

SEQ ID NO: 730345 - protein, 9 aa, Homo Sapiens
AQCHRAKID

SEQ ID NO: 730346 - protein, 9 aa, Homo Sapiens
ALAPKKGSK

SEQ ID NO: 730347 - protein, 9 aa, Homo Sapiens
EQQETKKNS

SEQ ID NO: 730348 - protein, 9 aa, Homo Sapiens
VSLAKFRKL

SEQ ID NO: 730349 - protein, 9 aa, Homo Sapiens
HQIQEMFPE

SEQ ID NO: 730350 - protein, 9 aa, Homo Sapiens
IDCGEQRTL

SEQ ID NO: 730351 - protein, 9 aa, Homo Sapiens
RPSNRWLRL

SEQ ID NO: 730352 - protein, 9 aa, Homo Sapiens
TKEELDSTY

SEQ ID NO: 730353 - protein, 9 aa, Homo Sapiens
PYLSQMINL

SEQ ID NO: 730354 - protein, 9 aa, Homo Sapiens
TDLSSLEPI

SEQ ID NO: 730355 - protein, 9 aa, Homo Sapiens
NVNALLLGY

SEQ ID NO: 730356 - protein, 9 aa, Homo Sapiens
FQPGRGYLV

SEQ ID NO: 730357 - protein, 9 aa, Homo Sapiens
PEALTIRGV

SEQ ID NO: 730358 - protein, 9 aa, Homo Sapiens
IELSSEAKK

SEQ ID NO: 730359 - protein, 9 aa, Homo Sapiens
LKPVNILVM

SEQ ID NO: 730360 - protein, 9 aa, Homo Sapiens
PNVSFSIQL

SEQ ID NO: 730361 - protein, 9 aa, Homo Sapiens
SFVHAACVV

SEQ ID NO: 730362 - protein, 9 aa, Homo Sapiens
LQAANIVRA

SEQ ID NO: 730363 - protein, 9 aa, Homo Sapiens
ATTYITTTD

SEQ ID NO: 730364 - protein, 9 aa, Homo Sapiens
LEQSIELIR

SEQ ID NO: 730365 - protein, 9 aa, Homo Sapiens
PESNSLKLL

SEQ ID NO: 730366 - protein, 9 aa, Homo Sapiens
SSALEDRFE

SEQ ID NO: 730367 - protein, 9 aa, Homo Sapiens
SRNQDHNLL

SEQ ID NO: 730368 - protein, 9 aa, Homo Sapiens
LDKDKMASV

SEQ ID NO: 730369 - protein, 9 aa, Homo Sapiens
VQEIPPQSP

SEQ ID NO: 730370 - protein, 9 aa, Homo Sapiens
KGPGPAAPA

SEQ ID NO: 730371 - protein, 9 aa, Homo Sapiens
AKSVQIKEE

SEQ ID NO: 730372 - protein, 9 aa, Homo Sapiens
VLAGAFATY

SEQ ID NO: 730373 - protein, 9 aa, Homo Sapiens
MIKIGQFHK

SEQ ID NO: 730374 - protein, 9 aa, Homo Sapiens
SSTISGVYA

SEQ ID NO: 730375 - protein, 9 aa, Homo Sapiens
SPEKEHEEM

SEQ ID NO: 730376 - protein, 9 aa, Homo Sapiens
IKIGQFHKV

SEQ ID NO: 730377 - protein, 9 aa, Homo Sapiens
TERFRARNQ

SEQ ID NO: 730378 - protein, 9 aa, Homo Sapiens
VSPLIVREI

SEQ ID NO: 730379 - protein, 9 aa, Homo Sapiens
TVLLRPIDV

SEQ ID NO: 730380 - protein, 9 aa, Homo Sapiens
DAEQRDPAA

SEQ ID NO: 730381 - protein, 9 aa, Homo Sapiens
ITSSDVVAG

SEQ ID NO: 730382 - protein, 9 aa, Homo Sapiens
GRFGKGNIW

SEQ ID NO: 730383 - protein, 9 aa, Homo Sapiens
HIQIANCHL

SEQ ID NO: 730384 - protein, 9 aa, Homo Sapiens
AMNNISRQI

SEQ ID NO: 730385 - protein, 9 aa, Homo Sapiens
EIRDNTENQ

SEQ ID NO: 730386 - protein, 9 aa, Homo Sapiens
CVFQITTSA

SEQ ID NO: 730387 - protein, 9 aa, Homo Sapiens
DLPSVSYAM

SEQ ID NO: 730388 - protein, 9 aa, Homo Sapiens
YSYSCEGPQ

SEQ ID NO: 730389 - protein, 9 aa, Homo Sapiens
GGNRSQFIC

SEQ ID NO: 730390 - protein, 9 aa, Homo Sapiens
LCGDVLLMA

SEQ ID NO: 730391 - protein, 9 aa, Homo Sapiens
HIIIDCGEQ

SEQ ID NO: 730392 - protein, 9 aa, Homo Sapiens
THWRTRYKT

SEQ ID NO: 730393 - protein, 9 aa, Homo Sapiens
AISSDKTTH

SEQ ID NO: 730394 - protein, 9 aa, Homo Sapiens
SRKQLLDWL

SEQ ID NO: 730395 - protein, 9 aa, Homo Sapiens
HNKQVEPLL

SEQ ID NO: 730396 - protein, 9 aa, Homo Sapiens
KKRQSWFSP

SEQ ID NO: 730397 - protein, 9 aa, Homo Sapiens
IAYHKDNKE

SEQ ID NO: 730398 - protein, 9 aa, Homo Sapiens
IGGDLVEKF

SEQ ID NO: 730399 - protein, 9 aa, Homo Sapiens
KRTHTGGKL

SEQ ID NO: 730400 - protein, 9 aa, Homo Sapiens
APEYLWSGS

SEQ ID NO: 730401 - protein, 9 aa, Homo Sapiens
PDRPQVFEQ

SEQ ID NO: 730402 - protein, 9 aa, Homo Sapiens
LLTILEAAT

SEQ ID NO: 730403 - protein, 9 aa, Homo Sapiens
LELFYYAQK

SEQ ID NO: 730404 - protein, 9 aa, Homo Sapiens
AHLGLNLGG

SEQ ID NO: 730405 - protein, 9 aa, Homo Sapiens
TVSFSISSF

SEQ ID NO: 730406 - protein, 9 aa, Homo Sapiens
KVSRKQLLD

SEQ ID NO: 730407 - protein, 9 aa, Homo Sapiens
KSIHTEDKP

SEQ ID NO: 730408 - protein, 9 aa, Homo Sapiens
LDFNYKKKR

SEQ ID NO: 730409 - protein, 9 aa, Homo Sapiens
SIKRREEFD

SEQ ID NO: 730410 - protein, 9 aa, Homo Sapiens
PQLLIRVEG

SEQ ID NO: 730411 - protein, 9 aa, Homo Sapiens
VESVTERIF

SEQ ID NO: 730412 - protein, 9 aa, Homo Sapiens
QIHRYIITL

SEQ ID NO: 730413 - protein, 9 aa, Homo Sapiens
EEESFDIPE

SEQ ID NO: 730414 - protein, 9 aa, Homo Sapiens
IKSCITSFH

SEQ ID NO: 730415 - protein, 9 aa, Homo Sapiens
SDVLARQFA

SEQ ID NO: 730416 - protein, 9 aa, Homo Sapiens
DIELLKDPR

SEQ ID NO: 730417 - protein, 9 aa, Homo Sapiens
FDMGLRKLY

SEQ ID NO: 730418 - protein, 9 aa, Homo Sapiens
RMGSIISTG

SEQ ID NO: 730419 - protein, 9 aa, Homo Sapiens
EVEAKANLI

SEQ ID NO: 730420 - protein, 9 aa, Homo Sapiens
PSGEHGEQQ

SEQ ID NO: 730421 - protein, 9 aa, Homo Sapiens
CLVFITTVV

SEQ ID NO: 730422 - protein, 9 aa, Homo Sapiens
FSATFALYI

SEQ ID NO: 730423 - protein, 9 aa, Homo Sapiens
QKIAYHKDN

SEQ ID NO: 730424 - protein, 9 aa, Homo Sapiens
TTGLSLGPS

SEQ ID NO: 730425 - protein, 9 aa, Homo Sapiens
GNDQVVTML

SEQ ID NO: 730426 - protein, 9 aa, Homo Sapiens
YSALYLCAS

SEQ ID NO: 730427 - protein, 9 aa, Homo Sapiens
AVKLNCKIL

SEQ ID NO: 730428 - protein, 9 aa, Homo Sapiens
KIQKIAYHK

SEQ ID NO: 730429 - protein, 9 aa, Homo Sapiens
CTKKVDEHQ

SEQ ID NO: 730430 - protein, 9 aa, Homo Sapiens
DGLFFQGND

SEQ ID NO: 730431 - protein, 9 aa, Homo Sapiens
TLEPDRPQV

SEQ ID NO: 730432 - protein, 9 aa, Homo Sapiens
VLHRDLKPV

SEQ ID NO: 730433 - protein, 9 aa, Homo Sapiens
SFPNFTSFL

SEQ ID NO: 730434 - protein, 9 aa, Homo Sapiens
VLIAQVYSA

SEQ ID NO: 730435 - protein, 9 aa, Homo Sapiens
IVFEAENKP

SEQ ID NO: 730436 - protein, 9 aa, Homo Sapiens
ALSFEVPCD

SEQ ID NO: 730437 - protein, 9 aa, Homo Sapiens
WAASNLGWV

SEQ ID NO: 730438 - protein, 9 aa, Homo Sapiens
GAGTVIVNI

SEQ ID NO: 730439 - protein, 9 aa, Homo Sapiens
RRSSGHLTS

SEQ ID NO: 730440 - protein, 9 aa, Homo Sapiens
STVQTVPVY

SEQ ID NO: 730441 - protein, 9 aa, Homo Sapiens
MAPSTAMSV

SEQ ID NO: 730442 - protein, 9 aa, Homo Sapiens
PQSLEFTKS

SEQ ID NO: 730443 - protein, 9 aa, Homo Sapiens
QGMFVQKGD

SEQ ID NO: 730444 - protein, 9 aa, Homo Sapiens
SATFALYIL

SEQ ID NO: 730445 - protein, 9 aa, Homo Sapiens
LYRPDMIIL

SEQ ID NO: 730446 - protein, 9 aa, Homo Sapiens
RLLSKRRFS

SEQ ID NO: 730447 - protein, 9 aa, Homo Sapiens
LDLTGQTMG

SEQ ID NO: 730448 - protein, 9 aa, Homo Sapiens
NELHKIVVV

SEQ ID NO: 730449 - protein, 9 aa, Homo Sapiens
YRIIYNNAD

SEQ ID NO: 730450 - protein, 9 aa, Homo Sapiens
IFFGSVSIM

SEQ ID NO: 730451 - protein, 9 aa, Homo Sapiens
DEVEAKANL

SEQ ID NO: 730452 - protein, 9 aa, Homo Sapiens
PMFQIHRYI

SEQ ID NO: 730453 - protein, 9 aa, Homo Sapiens
GIQPSSFSK

SEQ ID NO: 730454 - protein, 9 aa, Homo Sapiens
SSSPAHKDE

SEQ ID NO: 730455 - protein, 9 aa, Homo Sapiens
APSTAMSVV

SEQ ID NO: 730456 - protein, 9 aa, Homo Sapiens
GGDLVEKFD

SEQ ID NO: 730457 - protein, 9 aa, Homo Sapiens
VRHRMNIER

SEQ ID NO: 730458 - protein, 9 aa, Homo Sapiens
IFACPGTLK

SEQ ID NO: 730459 - protein, 9 aa, Homo Sapiens
CTNWISRDA

SEQ ID NO: 730460 - protein, 9 aa, Homo Sapiens
PLSLVYRPR

SEQ ID NO: 730461 - protein, 9 aa, Homo Sapiens
GVTRVRHRM

SEQ ID NO: 730462 - protein, 9 aa, Homo Sapiens
RNCVYENEC

SEQ ID NO: 730463 - protein, 9 aa, Homo Sapiens
FRNGDLVNP

SEQ ID NO: 730464 - protein, 9 aa, Homo Sapiens
PSAASMVAV

SEQ ID NO: 730465 - protein, 9 aa, Homo Sapiens
VNALLLGYS

SEQ ID NO: 730466 - protein, 9 aa, Homo Sapiens
VYIVQEIPP

SEQ ID NO: 730467 - protein, 9 aa, Homo Sapiens
ALEQSIELI

SEQ ID NO: 730468 - protein, 9 aa, Homo Sapiens
PAELRVWVQ

SEQ ID NO: 730469 - protein, 9 aa, Homo Sapiens
LLQWAVDPP

SEQ ID NO: 730470 - protein, 9 aa, Homo Sapiens
ASMSGAARK

SEQ ID NO: 730471 - protein, 9 aa, Homo Sapiens
THIAGKPYE

SEQ ID NO: 730472 - protein, 9 aa, Homo Sapiens
NCKILGVGI

SEQ ID NO: 730473 - protein, 9 aa, Homo Sapiens
LFLDLSNHN

SEQ ID NO: 730474 - protein, 9 aa, Homo Sapiens
LDQLCSSSA

SEQ ID NO: 730475 - protein, 9 aa, Homo Sapiens
WICAMNNIS

SEQ ID NO: 730476 - protein, 9 aa, Homo Sapiens
NYQDVDTLY

SEQ ID NO: 730477 - protein, 9 aa, Homo Sapiens
RAWLQAREL

SEQ ID NO: 730478 - protein, 9 aa, Homo Sapiens
RFQSSAVIA

SEQ ID NO: 730479 - protein, 9 aa, Homo Sapiens
PSPPLFSME

SEQ ID NO: 730480 - protein, 9 aa, Homo Sapiens
YENECATGF

SEQ ID NO: 730481 - protein, 9 aa, Homo Sapiens
SKTINRNRM

SEQ ID NO: 730482 - protein, 9 aa, Homo Sapiens
NITPTINQA

SEQ ID NO: 730483 - protein, 9 aa, Homo Sapiens
GSSDTGMKS

SEQ ID NO: 730484 - protein, 9 aa, Homo Sapiens
CQFAVPVTK

SEQ ID NO: 730485 - protein, 9 aa, Homo Sapiens
KAKSVQIKE

SEQ ID NO: 730486 - protein, 9 aa, Homo Sapiens
IAECIAQCH

SEQ ID NO: 730487 - protein, 9 aa, Homo Sapiens
ISSFSETDT

SEQ ID NO: 730488 - protein, 9 aa, Homo Sapiens
YTQLVLFPT

SEQ ID NO: 730489 - protein, 9 aa, Homo Sapiens
LLVSSVILL

SEQ ID NO: 730490 - protein, 9 aa, Homo Sapiens
IKDHAPEFP

SEQ ID NO: 730491 - protein, 9 aa, Homo Sapiens
ILLGLAYFT

SEQ ID NO: 730492 - protein, 9 aa, Homo Sapiens
ASAVHRPQL

SEQ ID NO: 730493 - protein, 9 aa, Homo Sapiens
VIALGQCVL

SEQ ID NO: 730494 - protein, 9 aa, Homo Sapiens
TASVALKEE

SEQ ID NO: 730495 - protein, 9 aa, Homo Sapiens
LTSPFQPGR

SEQ ID NO: 730496 - protein, 9 aa, Homo Sapiens
TEIEPSAAM

SEQ ID NO: 730497 - protein, 9 aa, Homo Sapiens
NQSQLSAHL

SEQ ID NO: 730498 - protein, 9 aa, Homo Sapiens
VIGVSDLLL

SEQ ID NO: 730499 - protein, 9 aa, Homo Sapiens
HLGIPGRVG

SEQ ID NO: 730500 - protein, 9 aa, Homo Sapiens
MPVMHFKAP

SEQ ID NO: 730501 - protein, 9 aa, Homo Sapiens
IINLLASDL

SEQ ID NO: 730502 - protein, 9 aa, Homo Sapiens
SGGSFSEVC

SEQ ID NO: 730503 - protein, 9 aa, Homo Sapiens
HEEMDEGSQ

SEQ ID NO: 730504 - protein, 9 aa, Homo Sapiens
IVIQKKWRD

SEQ ID NO: 730505 - protein, 9 aa, Homo Sapiens
HGSLPLSEG

SEQ ID NO: 730506 - protein, 9 aa, Homo Sapiens
QFLSILPAE

SEQ ID NO: 730507 - protein, 9 aa, Homo Sapiens
GKTDLSSLE

SEQ ID NO: 730508 - protein, 9 aa, Homo Sapiens
TGSALSGPL

SEQ ID NO: 730509 - protein, 9 aa, Homo Sapiens
AQVEKEFCL

SEQ ID NO: 730510 - protein, 9 aa, Homo Sapiens
ACTKKVDEH

SEQ ID NO: 730511 - protein, 9 aa, Homo Sapiens
WRQDIDLAV

SEQ ID NO: 730512 - protein, 9 aa, Homo Sapiens
YECVPYIFA

SEQ ID NO: 730513 - protein, 9 aa, Homo Sapiens
QASIQGAQP

SEQ ID NO: 730514 - protein, 9 aa, Homo Sapiens
AIMQSALAK

SEQ ID NO: 730515 - protein, 9 aa, Homo Sapiens
QGAGTVIVN

SEQ ID NO: 730516 - protein, 9 aa, Homo Sapiens
PPLFSMEDI

SEQ ID NO: 730517 - protein, 9 aa, Homo Sapiens
RDNTENQRQ

SEQ ID NO: 730518 - protein, 9 aa, Homo Sapiens
FVQKGDEGA

SEQ ID NO: 730519 - protein, 9 aa, Homo Sapiens
MGHSNSRSH

SEQ ID NO: 730520 - protein, 9 aa, Homo Sapiens
ASNYIRLFV

SEQ ID NO: 730521 - protein, 9 aa, Homo Sapiens
EPSNPASVS

SEQ ID NO: 730522 - protein, 9 aa, Homo Sapiens
DRVVEVVKE

SEQ ID NO: 730523 - protein, 9 aa, Homo Sapiens
SPAKGPGPA

SEQ ID NO: 730524 - protein, 9 aa, Homo Sapiens
CLATKKVEE

SEQ ID NO: 730525 - protein, 9 aa, Homo Sapiens
GDVLLMAAF

SEQ ID NO: 730526 - protein, 9 aa, Homo Sapiens
THKSIHTED

SEQ ID NO: 730527 - protein, 9 aa, Homo Sapiens
VPLAYTYSA

SEQ ID NO: 730528 - protein, 9 aa, Homo Sapiens
EDPVLCAFA

SEQ ID NO: 730529 - protein, 9 aa, Homo Sapiens
KAQGKDRHC

SEQ ID NO: 730530 - protein, 9 aa, Homo Sapiens
EVIGVSDLL

SEQ ID NO: 730531 - protein, 9 aa, Homo Sapiens
SSVILLIVC

SEQ ID NO: 730532 - protein, 9 aa, Homo Sapiens
TTHHELSTL

SEQ ID NO: 730533 - protein, 9 aa, Homo Sapiens
ILEKLSKAM

SEQ ID NO: 730534 - protein, 9 aa, Homo Sapiens
RLELERSTN

SEQ ID NO: 730535 - protein, 9 aa, Homo Sapiens
PLGGPSSLW

SEQ ID NO: 730536 - protein, 9 aa, Homo Sapiens
ARVGCHIGY

SEQ ID NO: 730537 - protein, 9 aa, Homo Sapiens
MEMLKKEPE

SEQ ID NO: 730538 - protein, 9 aa, Homo Sapiens
LLFLTFLGI

SEQ ID NO: 730539 - protein, 9 aa, Homo Sapiens
SMLCVFQIT

SEQ ID NO: 730540 - protein, 9 aa, Homo Sapiens
SHQSYAKNY

SEQ ID NO: 730541 - protein, 9 aa, Homo Sapiens
VMHGEANIT

SEQ ID NO: 730542 - protein, 9 aa, Homo Sapiens
ANIAELSHA

SEQ ID NO: 730543 - protein, 9 aa, Homo Sapiens
IPANEAHFS

SEQ ID NO: 730544 - protein, 9 aa, Homo Sapiens
ESLFRSPEE

SEQ ID NO: 730545 - protein, 9 aa, Homo Sapiens
ITKQEKDFL

SEQ ID NO: 730546 - protein, 9 aa, Homo Sapiens
SIISTGIVQ

SEQ ID NO: 730547 - protein, 9 aa, Homo Sapiens
KCGPGFKHQ

SEQ ID NO: 730548 - protein, 9 aa, Homo Sapiens
NNVLAHGSL

SEQ ID NO: 730549 - protein, 9 aa, Homo Sapiens
PHCVEKLND

SEQ ID NO: 730550 - protein, 9 aa, Homo Sapiens
TFTFKVLKK

SEQ ID NO: 730551 - protein, 9 aa, Homo Sapiens
GFISFLFFS

SEQ ID NO: 730552 - protein, 9 aa, Homo Sapiens
LTFLGIYLT

SEQ ID NO: 730553 - protein, 9 aa, Homo Sapiens
GSALSGPLG

SEQ ID NO: 730554 - protein, 9 aa, Homo Sapiens
AKFSPYLSQ

SEQ ID NO: 730555 - protein, 9 aa, Homo Sapiens
AAAVLIAQV

SEQ ID NO: 730556 - protein, 9 aa, Homo Sapiens
SSSGAIWTL

SEQ ID NO: 730557 - protein, 9 aa, Homo Sapiens
SVFGKGVTF

SEQ ID NO: 730558 - protein, 9 aa, Homo Sapiens
SLELSESLT

SEQ ID NO: 730559 - protein, 9 aa, Homo Sapiens
YLDVALEIL

SEQ ID NO: 730560 - protein, 9 aa, Homo Sapiens
GNAFFKDKR

SEQ ID NO: 730561 - protein, 9 aa, Homo Sapiens
GEQQRRTVH

SEQ ID NO: 730562 - protein, 9 aa, Homo Sapiens
SQTERFRAR

SEQ ID NO: 730563 - protein, 9 aa, Homo Sapiens
VSFSISSFS

SEQ ID NO: 730564 - protein, 9 aa, Homo Sapiens
QIVLCKSSD

SEQ ID NO: 730565 - protein, 9 aa, Homo Sapiens
QSTRNITPT

SEQ ID NO: 730566 - protein, 9 aa, Homo Sapiens
AQEINDVAG

SEQ ID NO: 730567 - protein, 9 aa, Homo Sapiens
EAALQKMLF

SEQ ID NO: 730568 - protein, 9 aa, Homo Sapiens
AHSIINECK

SEQ ID NO: 730569 - protein, 9 aa, Homo Sapiens
RLTAYLTLD

SEQ ID NO: 730570 - protein, 9 aa, Homo Sapiens
INGYRIIYN

SEQ ID NO: 730571 - protein, 9 aa, Homo Sapiens
KNTVLLRPI

SEQ ID NO: 730572 - protein, 9 aa, Homo Sapiens
SIISSQTER

SEQ ID NO: 730573 - protein, 9 aa, Homo Sapiens
NPQLLTILE

SEQ ID NO: 730574 - protein, 9 aa, Homo Sapiens
PVFPPNQRT

SEQ ID NO: 730575 - protein, 9 aa, Homo Sapiens
VVSCAPVVL

SEQ ID NO: 730576 - protein, 9 aa, Homo Sapiens
SQAAIMQSA

SEQ ID NO: 730577 - protein, 9 aa, Homo Sapiens
TGGKLYECK

SEQ ID NO: 730578 - protein, 9 aa, Homo Sapiens
PTTGLSLGP

SEQ ID NO: 730579 - protein, 9 aa, Homo Sapiens
FLTQDGRVF

SEQ ID NO: 730580 - protein, 9 aa, Homo Sapiens
AGGSGSPVP

SEQ ID NO: 730581 - protein, 9 aa, Homo Sapiens
QEGGIWEQG

SEQ ID NO: 730582 - protein, 9 aa, Homo Sapiens
TKEQDEEEE

SEQ ID NO: 730583 - protein, 9 aa, Homo Sapiens
RPTAALQSR

SEQ ID NO: 730584 - protein, 9 aa, Homo Sapiens
QSYAKNYSV

SEQ ID NO: 730585 - protein, 9 aa, Homo Sapiens
FNYKKKRQG

SEQ ID NO: 730586 - protein, 9 aa, Homo Sapiens
QCQEGGIWE

SEQ ID NO: 730587 - protein, 9 aa, Homo Sapiens
DMGLRKLYR

SEQ ID NO: 730588 - protein, 9 aa, Homo Sapiens
YVPAAVTAA

SEQ ID NO: 730589 - protein, 9 aa, Homo Sapiens
QDFPESNSL

SEQ ID NO: 730590 - protein, 9 aa, Homo Sapiens
RGIGWARKT

SEQ ID NO: 730591 - protein, 9 aa, Homo Sapiens
TGCAIHQAY

SEQ ID NO: 730592 - protein, 9 aa, Homo Sapiens
LLQFYGEGG

SEQ ID NO: 730593 - protein, 9 aa, Homo Sapiens
PAAITHIMQ

SEQ ID NO: 730594 - protein, 9 aa, Homo Sapiens
CRRSSGHLT

SEQ ID NO: 730595 - protein, 9 aa, Homo Sapiens
SSRERSSPA

SEQ ID NO: 730596 - protein, 9 aa, Homo Sapiens
VPLLATVLF

SEQ ID NO: 730597 - protein, 9 aa, Homo Sapiens
SRYKKMHFF

SEQ ID NO: 730598 - protein, 9 aa, Homo Sapiens
GGPVLSPST

SEQ ID NO: 730599 - protein, 9 aa, Homo Sapiens
HAACVVYID

SEQ ID NO: 730600 - protein, 9 aa, Homo Sapiens
SCAPVVLTP

SEQ ID NO: 730601 - protein, 9 aa, Homo Sapiens
CGGGSGHHS

SEQ ID NO: 730602 - protein, 9 aa, Homo Sapiens
EAKANLITD

SEQ ID NO: 730603 - protein, 9 aa, Homo Sapiens
DTLGILFVN

SEQ ID NO: 730604 - protein, 9 aa, Homo Sapiens
LPYHIPLDQ

SEQ ID NO: 730605 - protein, 9 aa, Homo Sapiens
KEIQHVNEQ

SEQ ID NO: 730606 - protein, 9 aa, Homo Sapiens
LSLVYRPRL

SEQ ID NO: 730607 - protein, 9 aa, Homo Sapiens
RPSFPNFTS

SEQ ID NO: 730608 - protein, 9 aa, Homo Sapiens
SLGSSMYFF

SEQ ID NO: 730609 - protein, 9 aa, Homo Sapiens
LNSPEKEHE

SEQ ID NO: 730610 - protein, 9 aa, Homo Sapiens
VVDINEDKL

SEQ ID NO: 730611 - protein, 9 aa, Homo Sapiens
GNRSQFICL

SEQ ID NO: 730612 - protein, 9 aa, Homo Sapiens
KSRRLELER

SEQ ID NO: 730613 - protein, 9 aa, Homo Sapiens
SHANNRVDQ

SEQ ID NO: 730614 - protein, 9 aa, Homo Sapiens
ALHISGPRP

SEQ ID NO: 730615 - protein, 9 aa, Homo Sapiens
APSSRERSS

SEQ ID NO: 730616 - protein, 9 aa, Homo Sapiens
PVTKPLCLL

SEQ ID NO: 730617 - protein, 9 aa, Homo Sapiens
YTYPHCVEK

SEQ ID NO: 730618 - protein, 9 aa, Homo Sapiens
LAPKKGSKK

SEQ ID NO: 730619 - protein, 9 aa, Homo Sapiens
ILHKQDHQY

SEQ ID NO: 730620 - protein, 9 aa, Homo Sapiens
NQTYICLAT

SEQ ID NO: 730621 - protein, 9 aa, Homo Sapiens
VFRNGDLVN

SEQ ID NO: 730622 - protein, 9 aa, Homo Sapiens
AKNTVLLRP

SEQ ID NO: 730623 - protein, 9 aa, Homo Sapiens
FKHQIVLCK

SEQ ID NO: 730624 - protein, 9 aa, Homo Sapiens
PEYLWSGSL

SEQ ID NO: 730625 - protein, 9 aa, Homo Sapiens
LNCKILGVG

SEQ ID NO: 730626 - protein, 9 aa, Homo Sapiens
VASGRYCKP

SEQ ID NO: 730627 - protein, 9 aa, Homo Sapiens
MTHIAGKPY

SEQ ID NO: 730628 - protein, 9 aa, Homo Sapiens
PNSNYQDVD

SEQ ID NO: 730629 - protein, 9 aa, Homo Sapiens
HSMTHIAGK

SEQ ID NO: 730630 - protein, 9 aa, Homo Sapiens
KPRPKPKEA

SEQ ID NO: 730631 - protein, 9 aa, Homo Sapiens
PRELWDMWH

SEQ ID NO: 730632 - protein, 9 aa, Homo Sapiens
PVYIVQEIP

SEQ ID NO: 730633 - protein, 9 aa, Homo Sapiens
SSMYFFLAS

SEQ ID NO: 730634 - protein, 9 aa, Homo Sapiens
DFKLKYETE

SEQ ID NO: 730635 - protein, 9 aa, Homo Sapiens
TLAVKLGGS

SEQ ID NO: 730636 - protein, 9 aa, Homo Sapiens
EEFRNEAKY

SEQ ID NO: 730637 - protein, 9 aa, Homo Sapiens
GNQTTVTEF

SEQ ID NO: 730638 - protein, 9 aa, Homo Sapiens
GNNVLAHGS

SEQ ID NO: 730639 - protein, 9 aa, Homo Sapiens
DVEVWAGNR

SEQ ID NO: 730640 - protein, 9 aa, Homo Sapiens
ESGPDDFNV

SEQ ID NO: 730641 - protein, 9 aa, Homo Sapiens
DLAVSREVF

SEQ ID NO: 730642 - protein, 9 aa, Homo Sapiens
EREKLKKAK

SEQ ID NO: 730643 - protein, 9 aa, Homo Sapiens
VGCCSSGAG

SEQ ID NO: 730644 - protein, 9 aa, Homo Sapiens
SLSQAAIMQ

SEQ ID NO: 730645 - protein, 9 aa, Homo Sapiens
AKANLITDL

SEQ ID NO: 730646 - protein, 9 aa, Homo Sapiens
EEIRDNTEN

SEQ ID NO: 730647 - protein, 9 aa, Homo Sapiens
PEFPFGLEL

SEQ ID NO: 730648 - protein, 9 aa, Homo Sapiens
SMVAVAQRS

SEQ ID NO: 730649 - protein, 9 aa, Homo Sapiens
VRMDNAVPV

SEQ ID NO: 730650 - protein, 9 aa, Homo Sapiens
TGSTWDATT

SEQ ID NO: 730651 - protein, 9 aa, Homo Sapiens
IQGAQPIFV

SEQ ID NO: 730652 - protein, 9 aa, Homo Sapiens
LKTQGRTLY

SEQ ID NO: 730653 - protein, 9 aa, Homo Sapiens
VVYIDGIGS

SEQ ID NO: 730654 - protein, 9 aa, Homo Sapiens
VMPVDAQKK

SEQ ID NO: 730655 - protein, 9 aa, Homo Sapiens
AVPVVPQAP

SEQ ID NO: 730656 - protein, 9 aa, Homo Sapiens
KTTHHELST

SEQ ID NO: 730657 - protein, 9 aa, Homo Sapiens
GVHELPWAS

SEQ ID NO: 730658 - protein, 9 aa, Homo Sapiens
IGYLYVDLR

SEQ ID NO: 730659 - protein, 9 aa, Homo Sapiens
FVHAACVVY

SEQ ID NO: 730660 - protein, 9 aa, Homo Sapiens
IACLQRAFN

SEQ ID NO: 730661 - protein, 9 aa, Homo Sapiens
IVSWLRRSP

SEQ ID NO: 730662 - protein, 9 aa, Homo Sapiens
AASMVAVAQ

SEQ ID NO: 730663 - protein, 9 aa, Homo Sapiens
GSGLSTNRH

SEQ ID NO: 730664 - protein, 9 aa, Homo Sapiens
VVPQAPAAQ

SEQ ID NO: 730665 - protein, 9 aa, Homo Sapiens
CCGPSSVGC

SEQ ID NO: 730666 - protein, 9 aa, Homo Sapiens
NALKTVIHD

SEQ ID NO: 730667 - protein, 9 aa, Homo Sapiens
IGVSFYQFL

SEQ ID NO: 730668 - protein, 9 aa, Homo Sapiens
EELDSTYTS

SEQ ID NO: 730669 - protein, 9 aa, Homo Sapiens
SSVGCCSSG

SEQ ID NO: 730670 - protein, 9 aa, Homo Sapiens
RPKPKEADE

SEQ ID NO: 730671 - protein, 9 aa, Homo Sapiens
QIRKGVAHR

SEQ ID NO: 730672 - protein, 9 aa, Homo Sapiens
MSNFLHLKC

SEQ ID NO: 730673 - protein, 9 aa, Homo Sapiens
VNLSFNDSH

SEQ ID NO: 730674 - protein, 9 aa, Homo Sapiens
LRVRDIKDH

SEQ ID NO: 730675 - protein, 9 aa, Homo Sapiens
ILQACTKKV

SEQ ID NO: 730676 - protein, 9 aa, Homo Sapiens
RERSSPASS

SEQ ID NO: 730677 - protein, 9 aa, Homo Sapiens
IMSSLMSEF

SEQ ID NO: 730678 - protein, 9 aa, Homo Sapiens
DPAKSALAP

SEQ ID NO: 730679 - protein, 9 aa, Homo Sapiens
VGCHIGYLY

SEQ ID NO: 730680 - protein, 9 aa, Homo Sapiens
LHLSVFDID

SEQ ID NO: 730681 - protein, 9 aa, Homo Sapiens
GAKKIDTIS

SEQ ID NO: 730682 - protein, 9 aa, Homo Sapiens
FSLCWLPQS

SEQ ID NO: 730683 - protein, 9 aa, Homo Sapiens
SRSSSPAHK

SEQ ID NO: 730684 - protein, 9 aa, Homo Sapiens
FSFIEGRER

SEQ ID NO: 730685 - protein, 9 aa, Homo Sapiens
LHISGPRPQ

SEQ ID NO: 730686 - protein, 9 aa, Homo Sapiens
LVQPFRLTH

SEQ ID NO: 730687 - protein, 9 aa, Homo Sapiens
NKQVEPLLG

SEQ ID NO: 730688 - protein, 9 aa, Homo Sapiens
EILQAANIV

SEQ ID NO: 730689 - protein, 9 aa, Homo Sapiens
SAASMVAVA

SEQ ID NO: 730690 - protein, 9 aa, Homo Sapiens
MAKSRRLEL

SEQ ID NO: 730691 - protein, 9 aa, Homo Sapiens
GIIRLLSKR

SEQ ID NO: 730692 - protein, 9 aa, Homo Sapiens
SGPRPQLQQ

SEQ ID NO: 730693 - protein, 9 aa, Homo Sapiens
FCLLQWAVD

SEQ ID NO: 730694 - protein, 9 aa, Homo Sapiens
QQGMFVQKG

SEQ ID NO: 730695 - protein, 9 aa, Homo Sapiens
NHSLDKDKM

SEQ ID NO: 730696 - protein, 9 aa, Homo Sapiens
TVEKTYKCE

SEQ ID NO: 730697 - protein, 9 aa, Homo Sapiens
VEVVKETIK

SEQ ID NO: 730698 - protein, 9 aa, Homo Sapiens
HLLQFYGEG

SEQ ID NO: 730699 - protein, 9 aa, Homo Sapiens
RDSIKRREE

SEQ ID NO: 730700 - protein, 9 aa, Homo Sapiens
DSPAKGPGP

SEQ ID NO: 730701 - protein, 9 aa, Homo Sapiens
KNVNKYQQV

SEQ ID NO: 730702 - protein, 9 aa, Homo Sapiens
DMEAILMDT

SEQ ID NO: 730703 - protein, 9 aa, Homo Sapiens
IGIPSQALG

SEQ ID NO: 730704 - protein, 9 aa, Homo Sapiens
FDIDRFSRH

SEQ ID NO: 730705 - protein, 9 aa, Homo Sapiens
SWNELHKIV

SEQ ID NO: 730706 - protein, 9 aa, Homo Sapiens
SIQLWVIIL

SEQ ID NO: 730707 - protein, 9 aa, Homo Sapiens
RSQFICLVF

SEQ ID NO: 730708 - protein, 9 aa, Homo Sapiens
KENALPSGT

SEQ ID NO: 730709 - protein, 9 aa, Homo Sapiens
KKEPEALTI

SEQ ID NO: 730710 - protein, 9 aa, Homo Sapiens
FALYILTPF

SEQ ID NO: 730711 - protein, 9 aa, Homo Sapiens
TSPSSASLG

SEQ ID NO: 730712 - protein, 9 aa, Homo Sapiens
INSVVEGSE

SEQ ID NO: 730713 - protein, 9 aa, Homo Sapiens
LNEIIADSD

SEQ ID NO: 730714 - protein, 9 aa, Homo Sapiens
SSNCCDRGS

SEQ ID NO: 730715 - protein, 9 aa, Homo Sapiens
YKKMHFFNV

SEQ ID NO: 730716 - protein, 9 aa, Homo Sapiens
VKTKQIRKG

SEQ ID NO: 730717 - protein, 9 aa, Homo Sapiens
GRLKTWVCG

SEQ ID NO: 730718 - protein, 9 aa, Homo Sapiens
ELDSTYTSV

SEQ ID NO: 730719 - protein, 9 aa, Homo Sapiens
STWDATTYI

SEQ ID NO: 730720 - protein, 9 aa, Homo Sapiens
GTSSDVLAR

SEQ ID NO: 730721 - protein, 9 aa, Homo Sapiens
SFVFFYTQL

SEQ ID NO: 730722 - protein, 9 aa, Homo Sapiens
RYSNGIQPS

SEQ ID NO: 730723 - protein, 9 aa, Homo Sapiens
RVLRIFLMT

SEQ ID NO: 730724 - protein, 9 aa, Homo Sapiens
KVSSEASEY

SEQ ID NO: 730725 - protein, 9 aa, Homo Sapiens
YLSQMINLR

SEQ ID NO: 730726 - protein, 9 aa, Homo Sapiens
EANITGFQI

SEQ ID NO: 730727 - protein, 9 aa, Homo Sapiens
SPNGSSDTG

SEQ ID NO: 730728 - protein, 9 aa, Homo Sapiens
PSQALGIAQ

SEQ ID NO: 730729 - protein, 9 aa, Homo Sapiens
TKPLCLLVP

SEQ ID NO: 730730 - protein, 9 aa, Homo Sapiens
RQIAIHKRF

SEQ ID NO: 730731 - protein, 9 aa, Homo Sapiens
GIPSQALGI

SEQ ID NO: 730732 - protein, 9 aa, Homo Sapiens
SPSSASLGM

SEQ ID NO: 730733 - protein, 9 aa, Homo Sapiens
SLSSPSPAP

SEQ ID NO: 730734 - protein, 9 aa, Homo Sapiens
CVYENECAT

SEQ ID NO: 730735 - protein, 9 aa, Homo Sapiens
QSVYSLLSV

SEQ ID NO: 730736 - protein, 9 aa, Homo Sapiens
ALLFLTFLG

SEQ ID NO: 730737 - protein, 9 aa, Homo Sapiens
GLSLGPSFN

SEQ ID NO: 730738 - protein, 9 aa, Homo Sapiens
LIARQDYEL

SEQ ID NO: 730739 - protein, 9 aa, Homo Sapiens
LGSNDLLAS

SEQ ID NO: 730740 - protein, 9 aa, Homo Sapiens
IPLDQEGSL

SEQ ID NO: 730741 - protein, 9 aa, Homo Sapiens
VSFYQFLIS

SEQ ID NO: 730742 - protein, 9 aa, Homo Sapiens
CFCKHILQK

SEQ ID NO: 730743 - protein, 9 aa, Homo Sapiens
QLCSSSALE

SEQ ID NO: 730744 - protein, 9 aa, Homo Sapiens
DLKPVNILV

SEQ ID NO: 730745 - protein, 9 aa, Homo Sapiens
HILDMEAIL

SEQ ID NO: 730746 - protein, 9 aa, Homo Sapiens
AVHRPQLSA

SEQ ID NO: 730747 - protein, 9 aa, Homo Sapiens
LEEFRNEAK

SEQ ID NO: 730748 - protein, 9 aa, Homo Sapiens
GKSINYGFI

SEQ ID NO: 730749 - protein, 9 aa, Homo Sapiens
TESLFRSPE

SEQ ID NO: 730750 - protein, 9 aa, Homo Sapiens
TWDATTYIT

SEQ ID NO: 730751 - protein, 9 aa, Homo Sapiens
LEQLKPRPK

SEQ ID NO: 730752 - protein, 9 aa, Homo Sapiens
LHKQDHQYV

SEQ ID NO: 730753 - protein, 9 aa, Homo Sapiens
KRPSFPNFT

SEQ ID NO: 730754 - protein, 9 aa, Homo Sapiens
LETLKGENK

SEQ ID NO: 730755 - protein, 9 aa, Homo Sapiens
VWWAASNLG

SEQ ID NO: 730756 - protein, 9 aa, Homo Sapiens
IDRVVEVVK

SEQ ID NO: 730757 - protein, 9 aa, Homo Sapiens
MDVQAMDNA

SEQ ID NO: 730758 - protein, 9 aa, Homo Sapiens
SIYFVVVTV

SEQ ID NO: 730759 - protein, 9 aa, Homo Sapiens
IKESGPDDF

SEQ ID NO: 730760 - protein, 9 aa, Homo Sapiens
PNFTSFLGC

SEQ ID NO: 730761 - protein, 9 aa, Homo Sapiens
VAVAQRSMP

SEQ ID NO: 730762 - protein, 9 aa, Homo Sapiens
KEPDLWELQ

SEQ ID NO: 730763 - protein, 9 aa, Homo Sapiens
TVPVYQHTS

SEQ ID NO: 730764 - protein, 9 aa, Homo Sapiens
LACLRGRFG

SEQ ID NO: 730765 - protein, 9 aa, Homo Sapiens
LPSGTLQEE

SEQ ID NO: 730766 - protein, 9 aa, Homo Sapiens
LAEVTERLE

SEQ ID NO: 730767 - protein, 9 aa, Homo Sapiens
THHELSTLG

SEQ ID NO: 730768 - protein, 9 aa, Homo Sapiens
RVGCHIGYL

SEQ ID NO: 730769 - protein, 9 aa, Homo Sapiens
RQDYELIQR

SEQ ID NO: 730770 - protein, 9 aa, Homo Sapiens
GQFHKVLSD

SEQ ID NO: 730771 - protein, 9 aa, Homo Sapiens
SGAIWTLLG

SEQ ID NO: 730772 - protein, 9 aa, Homo Sapiens
ASLPPGGPV

SEQ ID NO: 730773 - protein, 9 aa, Homo Sapiens
DAGGSGSPV

SEQ ID NO: 730774 - protein, 9 aa, Homo Sapiens
YYNDEQYEV

SEQ ID NO: 730775 - protein, 9 aa, Homo Sapiens
DNAVPVVPQ

SEQ ID NO: 730776 - protein, 9 aa, Homo Sapiens
EKEFCLLQW

SEQ ID NO: 730777 - protein, 9 aa, Homo Sapiens
SNLGWVVGH

SEQ ID NO: 730778 - protein, 9 aa, Homo Sapiens
DQEGSLELS

SEQ ID NO: 730779 - protein, 9 aa, Homo Sapiens
LLKDPRNQP

SEQ ID NO: 730780 - protein, 9 aa, Homo Sapiens
LGPQAPSLR

SEQ ID NO: 730781 - protein, 9 aa, Homo Sapiens
RCFCKHILQ

SEQ ID NO: 730782 - protein, 9 aa, Homo Sapiens
KFDHHCPLV

SEQ ID NO: 730783 - protein, 9 aa, Homo Sapiens
PEELCGLKK

SEQ ID NO: 730784 - protein, 9 aa, Homo Sapiens
IKTKEQDEE

SEQ ID NO: 730785 - protein, 9 aa, Homo Sapiens
LCAFAKKHK

SEQ ID NO: 730786 - protein, 9 aa, Homo Sapiens
QLLIRVEGN

SEQ ID NO: 730787 - protein, 9 aa, Homo Sapiens
GVTFALKDG

SEQ ID NO: 730788 - protein, 9 aa, Homo Sapiens
KTQKAMKNH

SEQ ID NO: 730789 - protein, 9 aa, Homo Sapiens
EIPANEAHF

SEQ ID NO: 730790 - protein, 9 aa, Homo Sapiens
VEKEFCLLQ

SEQ ID NO: 730791 - protein, 9 aa, Homo Sapiens
GPQAPSLRR

SEQ ID NO: 730792 - protein, 9 aa, Homo Sapiens
NEEWICAMN

SEQ ID NO: 730793 - protein, 9 aa, Homo Sapiens
IRDNTENQR

SEQ ID NO: 730794 - protein, 9 aa, Homo Sapiens
ADVEVWAGN

SEQ ID NO: 730795 - protein, 9 aa, Homo Sapiens
SLIKESGPD

SEQ ID NO: 730796 - protein, 9 aa, Homo Sapiens
NVSLAKFRK

SEQ ID NO: 730797 - protein, 9 aa, Homo Sapiens
NCFKQTMEK

SEQ ID NO: 730798 - protein, 9 aa, Homo Sapiens
RCRCQSSNC

SEQ ID NO: 730799 - protein, 9 aa, Homo Sapiens
DNTENQRQN

SEQ ID NO: 730800 - protein, 9 aa, Homo Sapiens
QSLEFTKSG

SEQ ID NO: 730801 - protein, 9 aa, Homo Sapiens
SYTLTTHKS

SEQ ID NO: 730802 - protein, 9 aa, Homo Sapiens
NQTTVTEFI

SEQ ID NO: 730803 - protein, 9 aa, Homo Sapiens
LSLGPSFNP

SEQ ID NO: 730804 - protein, 9 aa, Homo Sapiens
VDAQKKPSL

SEQ ID NO: 730805 - protein, 9 aa, Homo Sapiens
VFFYTQLVL

SEQ ID NO: 730806 - protein, 9 aa, Homo Sapiens
ACVVYIDGI

SEQ ID NO: 730807 - protein, 9 aa, Homo Sapiens
EDTLGILFV

SEQ ID NO: 730808 - protein, 9 aa, Homo Sapiens
VSDLLLLLG

SEQ ID NO: 730809 - protein, 9 aa, Homo Sapiens
TTVTEFILL

SEQ ID NO: 730810 - protein, 9 aa, Homo Sapiens
WSCWFPSSK

SEQ ID NO: 730811 - protein, 9 aa, Homo Sapiens
KTWVCGVAA

SEQ ID NO: 730812 - protein, 9 aa, Homo Sapiens
FTSVLTTIG

SEQ ID NO: 730813 - protein, 9 aa, Homo Sapiens
MSSLMSEFI

SEQ ID NO: 730814 - protein, 9 aa, Homo Sapiens
GEHQILVDK

SEQ ID NO: 730815 - protein, 9 aa, Homo Sapiens
FKQSTRNIT

SEQ ID NO: 730816 - protein, 9 aa, Homo Sapiens
AVLIAQVYS

SEQ ID NO: 730817 - protein, 9 aa, Homo Sapiens
ACDKSFKTQ

SEQ ID NO: 730818 - protein, 9 aa, Homo Sapiens
PRPQLQQVP

SEQ ID NO: 730819 - protein, 9 aa, Homo Sapiens
AEDNVDHNE

SEQ ID NO: 730820 - protein, 9 aa, Homo Sapiens
QTASVALKE

SEQ ID NO: 730821 - protein, 9 aa, Homo Sapiens
LKDPRNQPY

SEQ ID NO: 730822 - protein, 9 aa, Homo Sapiens
EETDDAYII

SEQ ID NO: 730823 - protein, 9 aa, Homo Sapiens
TSAEDTLGI

SEQ ID NO: 730824 - protein, 9 aa, Homo Sapiens
LAPEFFRKI

SEQ ID NO: 730825 - protein, 9 aa, Homo Sapiens
RVVEVVKET

SEQ ID NO: 730826 - protein, 9 aa, Homo Sapiens
MFDMGLRKL

SEQ ID NO: 730827 - protein, 9 aa, Homo Sapiens
LQDPSLRKR

SEQ ID NO: 730828 - protein, 9 aa, Homo Sapiens
DSSTNQSIG

SEQ ID NO: 730829 - protein, 9 aa, Homo Sapiens
EVVKETIKG

SEQ ID NO: 730830 - protein, 9 aa, Homo Sapiens
KSVQIKEEM

SEQ ID NO: 730831 - protein, 9 aa, Homo Sapiens
LMIPVFPPN

SEQ ID NO: 730832 - protein, 9 aa, Homo Sapiens
VQRSLGPQA

SEQ ID NO: 730833 - protein, 9 aa, Homo Sapiens
LESVTFAIL

SEQ ID NO: 730834 - protein, 9 aa, Homo Sapiens
SSAVIALQE

SEQ ID NO: 730835 - protein, 9 aa, Homo Sapiens
FGLELRVAT

SEQ ID NO: 730836 - protein, 9 aa, Homo Sapiens
IVNIGRDAR

SEQ ID NO: 730837 - protein, 9 aa, Homo Sapiens
FLYYNDEQY

SEQ ID NO: 730838 - protein, 9 aa, Homo Sapiens
EPNQNNWLC

SEQ ID NO: 730839 - protein, 9 aa, Homo Sapiens
ITRESRSET

SEQ ID NO: 730840 - protein, 9 aa, Homo Sapiens
ECVPYIFAC

SEQ ID NO: 730841 - protein, 9 aa, Homo Sapiens
SQSLGSSMY

SEQ ID NO: 730842 - protein, 9 aa, Homo Sapiens
NEALSFEVP

SEQ ID NO: 730843 - protein, 9 aa, Homo Sapiens
TERLEEFRN

SEQ ID NO: 730844 - protein, 9 aa, Homo Sapiens
SGRYCKPEE

SEQ ID NO: 730845 - protein, 9 aa, Homo Sapiens
VSEVIGVSD

SEQ ID NO: 730846 - protein, 9 aa, Homo Sapiens
VEAKANLIT

SEQ ID NO: 730847 - protein, 9 aa, Homo Sapiens
CLGTGYIFS

SEQ ID NO: 730848 - protein, 9 aa, Homo Sapiens
LLASDLPSV

SEQ ID NO: 730849 - protein, 9 aa, Homo Sapiens
PADGLFFQG

SEQ ID NO: 730850 - protein, 9 aa, Homo Sapiens
QKKWRDYYR

SEQ ID NO: 730851 - protein, 9 aa, Homo Sapiens
TIVFVSPLI

SEQ ID NO: 730852 - protein, 9 aa, Homo Sapiens
LLGLAYFTS

SEQ ID NO: 730853 - protein, 9 aa, Homo Sapiens
SLEPIVTMS

SEQ ID NO: 730854 - protein, 9 aa, Homo Sapiens
PANEAHFSA

SEQ ID NO: 730855 - protein, 9 aa, Homo Sapiens
SEASEYGIL

SEQ ID NO: 730856 - protein, 9 aa, Homo Sapiens
PLDQEGSLE

SEQ ID NO: 730857 - protein, 9 aa, Homo Sapiens
PIFFGSVSI

SEQ ID NO: 730858 - protein, 9 aa, Homo Sapiens
NEAHFSANL

SEQ ID NO: 730859 - protein, 9 aa, Homo Sapiens
ILGRVNLSF

SEQ ID NO: 730860 - protein, 9 aa, Homo Sapiens
LVDKKPVPI

SEQ ID NO: 730861 - protein, 9 aa, Homo Sapiens
TSSGKSINY

SEQ ID NO: 730862 - protein, 9 aa, Homo Sapiens
IPVFPPNQR

SEQ ID NO: 730863 - protein, 9 aa, Homo Sapiens
SWLRRSPTP

SEQ ID NO: 730864 - protein, 9 aa, Homo Sapiens
KICLVAASV

SEQ ID NO: 730865 - protein, 9 aa, Homo Sapiens
MPDPAKSAL

SEQ ID NO: 730866 - protein, 9 aa, Homo Sapiens
VSCAPVVLT

SEQ ID NO: 730867 - protein, 9 aa, Homo Sapiens
DVVKRFGKS

SEQ ID NO: 730868 - protein, 9 aa, Homo Sapiens
KPLSLVYRP

SEQ ID NO: 730869 - protein, 9 aa, Homo Sapiens
DKRRELGDK

SEQ ID NO: 730870 - protein, 9 aa, Homo Sapiens
PSTGSALSG

SEQ ID NO: 730871 - protein, 9 aa, Homo Sapiens
VIALQEASE

SEQ ID NO: 730872 - protein, 9 aa, Homo Sapiens
SIVHSSSGA

SEQ ID NO: 730873 - protein, 9 aa, Homo Sapiens
QALLFLTFL

SEQ ID NO: 730874 - protein, 9 aa, Homo Sapiens
SELDRAMLA

SEQ ID NO: 730875 - protein, 9 aa, Homo Sapiens
YRYQNEDTP

SEQ ID NO: 730876 - protein, 9 aa, Homo Sapiens
SDKTTHHEL

SEQ ID NO: 730877 - protein, 9 aa, Homo Sapiens
VVEGSELKK

SEQ ID NO: 730878 - protein, 9 aa, Homo Sapiens
GVSFYQFLI

SEQ ID NO: 730879 - protein, 9 aa, Homo Sapiens
GLLRPTAAL

SEQ ID NO: 730880 - protein, 9 aa, Homo Sapiens
SDGLAPPQL

SEQ ID NO: 730881 - protein, 9 aa, Homo Sapiens
RILDTWPEE

SEQ ID NO: 730882 - protein, 9 aa, Homo Sapiens
VQPFRLTHW

SEQ ID NO: 730883 - protein, 9 aa, Homo Sapiens
LLVVVDINE

SEQ ID NO: 730884 - protein, 9 aa, Homo Sapiens
EMRKVFIDG

SEQ ID NO: 730885 - protein, 9 aa, Homo Sapiens
LSAHLGLNL

SEQ ID NO: 730886 - protein, 9 aa, Homo Sapiens
LDRAMLALT

SEQ ID NO: 730887 - protein, 9 aa, Homo Sapiens
KESGPDDFN

SEQ ID NO: 730888 - protein, 9 aa, Homo Sapiens
AEDTLGILF

SEQ ID NO: 730889 - protein, 9 aa, Homo Sapiens
EKLSKAMSV

SEQ ID NO: 730890 - protein, 9 aa, Homo Sapiens
YQFLISWPR

SEQ ID NO: 730891 - protein, 9 aa, Homo Sapiens
QKAMKNHEK

SEQ ID NO: 730892 - protein, 9 aa, Homo Sapiens
ALIAQEIND

SEQ ID NO: 730893 - protein, 9 aa, Homo Sapiens
AEKDCRRSS

SEQ ID NO: 730894 - protein, 9 aa, Homo Sapiens
KPFSNFSLF

SEQ ID NO: 730895 - protein, 9 aa, Homo Sapiens
HSRMGSIIS

SEQ ID NO: 730896 - protein, 9 aa, Homo Sapiens
AAVLSGQHE

SEQ ID NO: 730897 - protein, 9 aa, Homo Sapiens
GCHIGYLYV

SEQ ID NO: 730898 - protein, 9 aa, Homo Sapiens
SASLSSPSP

SEQ ID NO: 730899 - protein, 9 aa, Homo Sapiens
DVDTLYNFL

SEQ ID NO: 730900 - protein, 9 aa, Homo Sapiens
HISGPRPQL

SEQ ID NO: 730901 - protein, 9 aa, Homo Sapiens
FDIPENPPA

SEQ ID NO: 730902 - protein, 9 aa, Homo Sapiens
SVVEGSELK

SEQ ID NO: 730903 - protein, 9 aa, Homo Sapiens
GEKITSSDV

SEQ ID NO: 730904 - protein, 9 aa, Homo Sapiens
STISGVYAE

SEQ ID NO: 730905 - protein, 9 aa, Homo Sapiens
GKITRESRS

SEQ ID NO: 730906 - protein, 9 aa, Homo Sapiens
HDPSYKENI

SEQ ID NO: 730907 - protein, 9 aa, Homo Sapiens
FTSFLGCQL

SEQ ID NO: 730908 - protein, 9 aa, Homo Sapiens
SGPLGGPSS

SEQ ID NO: 730909 - protein, 9 aa, Homo Sapiens
KHFLWPYNP

SEQ ID NO: 730910 - protein, 9 aa, Homo Sapiens
NDQVVTMLG

SEQ ID NO: 730911 - protein, 9 aa, Homo Sapiens
DSDELLSKP

SEQ ID NO: 730912 - protein, 9 aa, Homo Sapiens
FLSILPAEL

SEQ ID NO: 730913 - protein, 9 aa, Homo Sapiens
SDTGMKSLV

SEQ ID NO: 730914 - protein, 9 aa, Homo Sapiens
IGNGAVIII

SEQ ID NO: 730915 - protein, 9 aa, Homo Sapiens
QDGRVFYVG

SEQ ID NO: 730916 - protein, 9 aa, Homo Sapiens
GEANITGFQ

SEQ ID NO: 730917 - protein, 9 aa, Homo Sapiens
KITSSDVVA

SEQ ID NO: 730918 - protein, 9 aa, Homo Sapiens
NLPAAAVLI

SEQ ID NO: 730919 - protein, 9 aa, Homo Sapiens
WLQARELLR

SEQ ID NO: 730920 - protein, 9 aa, Homo Sapiens
LELLGSNDL

SEQ ID NO: 730921 - protein, 9 aa, Homo Sapiens
SLGPQAPSL

SEQ ID NO: 730922 - protein, 9 aa, Homo Sapiens
FGEKITSSD

SEQ ID NO: 730923 - protein, 9 aa, Homo Sapiens
QSSAVIALQ

SEQ ID NO: 730924 - protein, 9 aa, Homo Sapiens
KITRESRSE

SEQ ID NO: 730925 - protein, 9 aa, Homo Sapiens
RSWNELHKI

SEQ ID NO: 730926 - protein, 9 aa, Homo Sapiens
LISWPRLFP

SEQ ID NO: 730927 - protein, 9 aa, Homo Sapiens
RYQNEDTPP

SEQ ID NO: 730928 - protein, 9 aa, Homo Sapiens
VYTYPHCVE

SEQ ID NO: 730929 - protein, 9 aa, Homo Sapiens
PYHIPLDQE

SEQ ID NO: 730930 - protein, 9 aa, Homo Sapiens
EPDRPQVFE

SEQ ID NO: 730931 - protein, 9 aa, Homo Sapiens
QNVCVMNLD

SEQ ID NO: 730932 - protein, 9 aa, Homo Sapiens
TENQRQNEC

SEQ ID NO: 730933 - protein, 9 aa, Homo Sapiens
FRKEPDLWE

SEQ ID NO: 730934 - protein, 9 aa, Homo Sapiens
LVPLLATVL

SEQ ID NO: 730935 - protein, 9 aa, Homo Sapiens
RKVFIDGAK

SEQ ID NO: 730936 - protein, 9 aa, Homo Sapiens
QSLQAIDSL

SEQ ID NO: 730937 - protein, 9 aa, Homo Sapiens
ITPTINQAN

SEQ ID NO: 730938 - protein, 9 aa, Homo Sapiens
SFSETDTQS

SEQ ID NO: 730939 - protein, 9 aa, Homo Sapiens
ESPNGSSDT

SEQ ID NO: 730940 - protein, 9 aa, Homo Sapiens
RYSAVESVT

SEQ ID NO: 730941 - protein, 9 aa, Homo Sapiens
EQNWKIQKI

SEQ ID NO: 730942 - protein, 9 aa, Homo Sapiens
DTGMKSLVN

SEQ ID NO: 730943 - protein, 9 aa, Homo Sapiens
IAIHKRFFT

SEQ ID NO: 730944 - protein, 9 aa, Homo Sapiens
YPPFCLGTG

SEQ ID NO: 730945 - protein, 9 aa, Homo Sapiens
FVVVTVTTV

SEQ ID NO: 730946 - protein, 9 aa, Homo Sapiens
AKSALAPKK

SEQ ID NO: 730947 - protein, 9 aa, Homo Sapiens
AMVLESVTF

SEQ ID NO: 730948 - protein, 9 aa, Homo Sapiens
PTVPADVEV

SEQ ID NO: 730949 - protein, 9 aa, Homo Sapiens
LGSSMYFFL

SEQ ID NO: 730950 - protein, 9 aa, Homo Sapiens
ELDRAMLAL

SEQ ID NO: 730951 - protein, 9 aa, Homo Sapiens
DANRLSNKI

SEQ ID NO: 730952 - protein, 9 aa, Homo Sapiens
SCIRCFCKH

SEQ ID NO: 730953 - protein, 9 aa, Homo Sapiens
LALIAQEIN

SEQ ID NO: 730954 - protein, 9 aa, Homo Sapiens
QAAIMQSAL

SEQ ID NO: 730955 - protein, 9 aa, Homo Sapiens
NVLAHGSLP

SEQ ID NO: 730956 - protein, 9 aa, Homo Sapiens
LASFKIPPF

SEQ ID NO: 730957 - protein, 9 aa, Homo Sapiens
ESVTERIFT

SEQ ID NO: 730958 - protein, 9 aa, Homo Sapiens
KLLKIQCQE

SEQ ID NO: 730959 - protein, 9 aa, Homo Sapiens
CVPYIFACP

SEQ ID NO: 730960 - protein, 9 aa, Homo Sapiens
NCHLSRLMV

SEQ ID NO: 730961 - protein, 9 aa, Homo Sapiens
LLMAAFVSY

SEQ ID NO: 730962 - protein, 9 aa, Homo Sapiens
MASQSLGSS

SEQ ID NO: 730963 - protein, 9 aa, Homo Sapiens
EEPKQAYVP

SEQ ID NO: 730964 - protein, 9 aa, Homo Sapiens
QIAIHKRFF

SEQ ID NO: 730965 - protein, 9 aa, Homo Sapiens
ASMVAVAQR

SEQ ID NO: 730966 - protein, 9 aa, Homo Sapiens
SAVIALQEA

SEQ ID NO: 730967 - protein, 9 aa, Homo Sapiens
AVPVTKPLC

SEQ ID NO: 730968 - protein, 9 aa, Homo Sapiens
YDRYVAVSD

SEQ ID NO: 730969 - protein, 9 aa, Homo Sapiens
ITDAGGSGS

SEQ ID NO: 730970 - protein, 9 aa, Homo Sapiens
LQRAFNLAP

SEQ ID NO: 730971 - protein, 9 aa, Homo Sapiens
HILHKQDHQ

SEQ ID NO: 730972 - protein, 9 aa, Homo Sapiens
KVFIDGAKK

SEQ ID NO: 730973 - protein, 9 aa, Homo Sapiens
PCRCNSGGS

SEQ ID NO: 730974 - protein, 9 aa, Homo Sapiens
ILVDKKPVP

SEQ ID NO: 730975 - protein, 9 aa, Homo Sapiens
DKSFKTQKA

SEQ ID NO: 730976 - protein, 9 aa, Homo Sapiens
EEATAGAAV

SEQ ID NO: 730977 - protein, 9 aa, Homo Sapiens
TKQIRKGVA

SEQ ID NO: 730978 - protein, 9 aa, Homo Sapiens
IRLLSKRRF

SEQ ID NO: 730979 - protein, 9 aa, Homo Sapiens
SFHVTCAFE

SEQ ID NO: 730980 - protein, 9 aa, Homo Sapiens
KLVSEVIGV

SEQ ID NO: 730981 - protein, 9 aa, Homo Sapiens
ALNPRELWD

SEQ ID NO: 730982 - protein, 9 aa, Homo Sapiens
LAVSREVFD

SEQ ID NO: 730983 - protein, 9 aa, Homo Sapiens
PGRGYLVST

SEQ ID NO: 730984 - protein, 9 aa, Homo Sapiens
SIKSCITSF

SEQ ID NO: 730985 - protein, 9 aa, Homo Sapiens
RVNLSFNDS

SEQ ID NO: 730986 - protein, 9 aa, Homo Sapiens
HCVEKLNDT

SEQ ID NO: 730987 - protein, 9 aa, Homo Sapiens
QIQEMFPEV

SEQ ID NO: 730988 - protein, 9 aa, Homo Sapiens
KTKQIRKGV

SEQ ID NO: 730989 - protein, 9 aa, Homo Sapiens
IHDPSYKEN

SEQ ID NO: 730990 - protein, 9 aa, Homo Sapiens
SLWSCWFPS

SEQ ID NO: 730991 - protein, 9 aa, Homo Sapiens
LLRDSIKRR

SEQ ID NO: 730992 - protein, 9 aa, Homo Sapiens
PRNQPYFAR

SEQ ID NO: 730993 - protein, 9 aa, Homo Sapiens
EGIVFEAEN

SEQ ID NO: 730994 - protein, 9 aa, Homo Sapiens
LWRQDIDLA

SEQ ID NO: 730995 - protein, 9 aa, Homo Sapiens
PTSPSSASL

SEQ ID NO: 730996 - protein, 9 aa, Homo Sapiens
NEIIADSDE

SEQ ID NO: 730997 - protein, 9 aa, Homo Sapiens
EAVGKVSRK

SEQ ID NO: 730998 - protein, 9 aa, Homo Sapiens
LTILEAATI

SEQ ID NO: 730999 - protein, 9 aa, Homo Sapiens
GSNDLLASA

SEQ ID NO: 731000 - protein, 9 aa, Homo Sapiens
TQKAMKNHE

SEQ ID NO: 731001 - protein, 9 aa, Homo Sapiens
SFLYYNDEQ

SEQ ID NO: 731002 - protein, 9 aa, Homo Sapiens
MHQGNQTTV

SEQ ID NO: 731003 - protein, 9 aa, Homo Sapiens
GRAWLQARE

SEQ ID NO: 731004 - protein, 9 aa, Homo Sapiens
EIIADSDEL

SEQ ID NO: 731005 - protein, 9 aa, Homo Sapiens
PSGTLQEEQ

SEQ ID NO: 731006 - protein, 9 aa, Homo Sapiens
LPAELRVWV

SEQ ID NO: 731007 - protein, 9 aa, Homo Sapiens
HCVDVNECK

SEQ ID NO: 731008 - protein, 9 aa, Homo Sapiens
WLCTNWISR

SEQ ID NO: 731009 - protein, 9 aa, Homo Sapiens
YHIPLDQEG

SEQ ID NO: 731010 - protein, 9 aa, Homo Sapiens
FRVERGIGW

SEQ ID NO: 731011 - protein, 9 aa, Homo Sapiens
SLDKDKMAS

SEQ ID NO: 731012 - protein, 9 aa, Homo Sapiens
RKRLGSGLS

SEQ ID NO: 731013 - protein, 9 aa, Homo Sapiens
GPGFKHQIV

SEQ ID NO: 731014 - protein, 9 aa, Homo Sapiens
ELQASIQGA

SEQ ID NO: 731015 - protein, 9 aa, Homo Sapiens
NQKAQGKDR

SEQ ID NO: 731016 - protein, 9 aa, Homo Sapiens
SLVYRPRLS

SEQ ID NO: 731017 - protein, 9 aa, Homo Sapiens
TVIVNIGRD

SEQ ID NO: 731018 - protein, 9 aa, Homo Sapiens
RASPSCVDA

SEQ ID NO: 731019 - protein, 9 aa, Homo Sapiens
FLDLSNHNP

SEQ ID NO: 731020 - protein, 9 aa, Homo Sapiens
KTLQGVCGA

SEQ ID NO: 731021 - protein, 9 aa, Homo Sapiens
QPEGIVFEA

SEQ ID NO: 731022 - protein, 9 aa, Homo Sapiens
FLHLKCNEK

SEQ ID NO: 731023 - protein, 9 aa, Homo Sapiens
VLAHGSLPL

SEQ ID NO: 731024 - protein, 9 aa, Homo Sapiens
RCDVVKRFG

SEQ ID NO: 731025 - protein, 9 aa, Homo Sapiens
DRCTLAVKL

SEQ ID NO: 731026 - protein, 9 aa, Homo Sapiens
PDEAVGKVS

SEQ ID NO: 731027 - protein, 9 aa, Homo Sapiens
QINGYRIIY

SEQ ID NO: 731028 - protein, 9 aa, Homo Sapiens
NSGGSFSEV

SEQ ID NO: 731029 - protein, 9 aa, Homo Sapiens
MQSIATILL

SEQ ID NO: 731030 - protein, 9 aa, Homo Sapiens
TQKTDDLLV

SEQ ID NO: 731031 - protein, 9 aa, Homo Sapiens
DVVTLLRDS

SEQ ID NO: 731032 - protein, 9 aa, Homo Sapiens
LKTVIHDPS

SEQ ID NO: 731033 - protein, 9 aa, Homo Sapiens
TGITLASLE

SEQ ID NO: 731034 - protein, 9 aa, Homo Sapiens
NQNNWLCTN

SEQ ID NO: 731035 - protein, 9 aa, Homo Sapiens
QSWFSPPPP

SEQ ID NO: 731036 - protein, 9 aa, Homo Sapiens
RSPEEQSGA

SEQ ID NO: 731037 - protein, 9 aa, Homo Sapiens
CKPEEEVAR

SEQ ID NO: 731038 - protein, 9 aa, Homo Sapiens
IALQEASEA

SEQ ID NO: 731039 - protein, 9 aa, Homo Sapiens
YERKPLSLV

SEQ ID NO: 731040 - protein, 9 aa, Homo Sapiens
QFAVPVTKP

SEQ ID NO: 731041 - protein, 9 aa, Homo Sapiens
KHQIVLCKS

SEQ ID NO: 731042 - protein, 9 aa, Homo Sapiens
THTGGKLYE

SEQ ID NO: 731043 - protein, 9 aa, Homo Sapiens
LMAAFVSYV

SEQ ID NO: 731044 - protein, 9 aa, Homo Sapiens
KGVAHRFFD

SEQ ID NO: 731045 - protein, 9 aa, Homo Sapiens
QAYVPAAVT

SEQ ID NO: 731046 - protein, 9 aa, Homo Sapiens
ECIAQCHRA

SEQ ID NO: 731047 - protein, 9 aa, Homo Sapiens
LAAEDFKLK

SEQ ID NO: 731048 - protein, 9 aa, Homo Sapiens
LSITDAGGS

SEQ ID NO: 731049 - protein, 9 aa, Homo Sapiens
KIRLLGRRP

SEQ ID NO: 731050 - protein, 9 aa, Homo Sapiens
KIAYHKDNK

SEQ ID NO: 731051 - protein, 9 aa, Homo Sapiens
VTERLEEFR

SEQ ID NO: 731052 - protein, 9 aa, Homo Sapiens
WLRRSPTPR

SEQ ID NO: 731053 - protein, 9 aa, Homo Sapiens
VKLGGSAVI

SEQ ID NO: 731054 - protein, 9 aa, Homo Sapiens
WASLPPGGP

SEQ ID NO: 731055 - protein, 9 aa, Homo Sapiens
ARKTIYKDM

SEQ ID NO: 731056 - protein, 9 aa, Homo Sapiens
KNTGISGIL

SEQ ID NO: 731057 - protein, 9 aa, Homo Sapiens
LNPRELWDM

SEQ ID NO: 731058 - protein, 9 aa, Homo Sapiens
HRYIITLHE

SEQ ID NO: 731059 - protein, 9 aa, Homo Sapiens
ASLGMLSAI

SEQ ID NO: 731060 - protein, 9 aa, Homo Sapiens
QVYTYPHCV

SEQ ID NO: 731061 - protein, 9 aa, Homo Sapiens
LPQSVYSLL

SEQ ID NO: 731062 - protein, 9 aa, Homo Sapiens
ESFDIPENP

SEQ ID NO: 731063 - protein, 9 aa, Homo Sapiens
FACPGTLKA

SEQ ID NO: 731064 - protein, 9 aa, Homo Sapiens
EIEPSAAMT

SEQ ID NO: 731065 - protein, 9 aa, Homo Sapiens
PCPRDTRIV

SEQ ID NO: 731066 - protein, 9 aa, Homo Sapiens
VFVSPLIVR

SEQ ID NO: 731067 - protein, 9 aa, Homo Sapiens
EEKDSKKEE

SEQ ID NO: 731068 - protein, 9 aa, Homo Sapiens
GSVLDSPAK

SEQ ID NO: 731069 - protein, 9 aa, Homo Sapiens
RRLDFNYKK

SEQ ID NO: 731070 - protein, 9 aa, Homo Sapiens
AKFDHHCPL

SEQ ID NO: 731071 - protein, 9 aa, Homo Sapiens
VQTVPVYQH

SEQ ID NO: 731072 - protein, 9 aa, Homo Sapiens
SQLSAHLGL

SEQ ID NO: 731073 - protein, 9 aa, Homo Sapiens
AHGSLPLSE

SEQ ID NO: 731074 - protein, 9 aa, Homo Sapiens
LDLSNHNPQ

SEQ ID NO: 731075 - protein, 9 aa, Homo Sapiens
VIHILHKQD

SEQ ID NO: 731076 - protein, 9 aa, Homo Sapiens
SKLQDPSLR

SEQ ID NO: 731077 - protein, 9 aa, Homo Sapiens
LDQLETLKG

SEQ ID NO: 731078 - protein, 9 aa, Homo Sapiens
EEQSNVSLA

SEQ ID NO: 731079 - protein, 9 aa, Homo Sapiens
HCPLVGNCV

SEQ ID NO: 731080 - protein, 9 aa, Homo Sapiens
QDPSLRKRL

SEQ ID NO: 731081 - protein, 9 aa, Homo Sapiens
HFSANLKTL

SEQ ID NO: 731082 - protein, 9 aa, Homo Sapiens
ALSACFSFI

SEQ ID NO: 731083 - protein, 9 aa, Homo Sapiens
EFFRKIRLL

SEQ ID NO: 731084 - protein, 9 aa, Homo Sapiens
IEETDDAYI

SEQ ID NO: 731085 - protein, 9 aa, Homo Sapiens
KILGVGIST

SEQ ID NO: 731086 - protein, 9 aa, Homo Sapiens
PWASLPPGG

SEQ ID NO: 731087 - protein, 9 aa, Homo Sapiens
AEGVPLAYT

SEQ ID NO: 731088 - protein, 9 aa, Homo Sapiens
PPHIIIDCG

SEQ ID NO: 731089 - protein, 9 aa, Homo Sapiens
EHEEMDEGS

SEQ ID NO: 731090 - protein, 9 aa, Homo Sapiens
ELSHANNRV

SEQ ID NO: 731091 - protein, 9 aa, Homo Sapiens
VNILVMGEG

SEQ ID NO: 731092 - protein, 9 aa, Homo Sapiens
VSFSIQLWV

SEQ ID NO: 731093 - protein, 9 aa, Homo Sapiens
EKDSKKEEA

SEQ ID NO: 731094 - protein, 9 aa, Homo Sapiens
ASDLPSVSY

SEQ ID NO: 731095 - protein, 9 aa, Homo Sapiens
QEIPPQSPA

SEQ ID NO: 731096 - protein, 9 aa, Homo Sapiens
FPNFTSFLG

SEQ ID NO: 731097 - protein, 9 aa, Homo Sapiens
RVMHGEANI

SEQ ID NO: 731098 - protein, 9 aa, Homo Sapiens
ITSFHVTCA

SEQ ID NO: 731099 - protein, 9 aa, Homo Sapiens
HQIVLCKSS

SEQ ID NO: 731100 - protein, 9 aa, Homo Sapiens
QPEEPTFKR

SEQ ID NO: 731101 - protein, 9 aa, Homo Sapiens
LLSIISSQT

SEQ ID NO: 731102 - protein, 9 aa, Homo Sapiens
VSQDRAAPS

SEQ ID NO: 731103 - protein, 9 aa, Homo Sapiens
VPYIFACPG

SEQ ID NO: 731104 - protein, 9 aa, Homo Sapiens
RVERGIGWA

SEQ ID NO: 731105 - protein, 9 aa, Homo Sapiens
DLSNHNPQA

SEQ ID NO: 731106 - protein, 9 aa, Homo Sapiens
EQLKPRPKP

SEQ ID NO: 731107 - protein, 9 aa, Homo Sapiens
SILPAELRV

SEQ ID NO: 731108 - protein, 9 aa, Homo Sapiens
CINSVVEGS

SEQ ID NO: 731109 - protein, 9 aa, Homo Sapiens
LKTWVCGVA

SEQ ID NO: 731110 - protein, 9 aa, Homo Sapiens
PVVLTPMEP

SEQ ID NO: 731111 - protein, 9 aa, Homo Sapiens
QRSLGPQAP

SEQ ID NO: 731112 - protein, 9 aa, Homo Sapiens
VVYALKTQG

SEQ ID NO: 731113 - protein, 9 aa, Homo Sapiens
EGIVIKTKE

SEQ ID NO: 731114 - protein, 9 aa, Homo Sapiens
KEQSLQAID

SEQ ID NO: 731115 - protein, 9 aa, Homo Sapiens
IISTGIVQG

SEQ ID NO: 731116 - protein, 9 aa, Homo Sapiens
DPPHIIIDC

SEQ ID NO: 731117 - protein, 9 aa, Homo Sapiens
RKGVAHRFF

SEQ ID NO: 731118 - protein, 9 aa, Homo Sapiens
CQPCRCNSG

SEQ ID NO: 731119 - protein, 9 aa, Homo Sapiens
LELRVATRW

SEQ ID NO: 731120 - protein, 9 aa, Homo Sapiens
QPFRLTHWR

SEQ ID NO: 731121 - protein, 9 aa, Homo Sapiens
SNYQDVDTL

SEQ ID NO: 731122 - protein, 9 aa, Homo Sapiens
ERKPLSLVY

SEQ ID NO: 731123 - protein, 9 aa, Homo Sapiens
CGDVLLMAA

SEQ ID NO: 731124 - protein, 9 aa, Homo Sapiens
EVTERLEEF

SEQ ID NO: 731125 - protein, 9 aa, Homo Sapiens
TSNCFKQTM

SEQ ID NO: 731126 - protein, 9 aa, Homo Sapiens
QILVDKKPV

SEQ ID NO: 731127 - protein, 9 aa, Homo Sapiens
SFDIPENPP

SEQ ID NO: 731128 - protein, 9 aa, Homo Sapiens
LLNTLQKNV

SEQ ID NO: 731129 - protein, 9 aa, Homo Sapiens
GACQVIGFQ

SEQ ID NO: 731130 - protein, 9 aa, Homo Sapiens
SIKENALPS

SEQ ID NO: 731131 - protein, 9 aa, Homo Sapiens
SYSCEGPQE

SEQ ID NO: 731132 - protein, 9 aa, Homo Sapiens
TVTTVGFGD

SEQ ID NO: 731133 - protein, 9 aa, Homo Sapiens
RKLYRPDMI

SEQ ID NO: 731134 - protein, 9 aa, Homo Sapiens
LVNPPFSLK

SEQ ID NO: 731135 - protein, 9 aa, Homo Sapiens
QLLTILEAA

SEQ ID NO: 731136 - protein, 9 aa, Homo Sapiens
FRSPEEQSG

SEQ ID NO: 731137 - protein, 9 aa, Homo Sapiens
CGEQRTLDP

SEQ ID NO: 731138 - protein, 9 aa, Homo Sapiens
MPVDAQKKP

SEQ ID NO: 731139 - protein, 9 aa, Homo Sapiens
LAHGSLPLS

SEQ ID NO: 731140 - protein, 9 aa, Homo Sapiens
SSEASEYGI

SEQ ID NO: 731141 - protein, 9 aa, Homo Sapiens
SSGHLTSVH

SEQ ID NO: 731142 - protein, 9 aa, Homo Sapiens
PVLCAFAKK

SEQ ID NO: 731143 - protein, 9 aa, Homo Sapiens
SNCFKQTME

SEQ ID NO: 731144 - protein, 9 aa, Homo Sapiens
LDSPAKGPG

SEQ ID NO: 731145 - protein, 9 aa, Homo Sapiens
LQVYTYPHC

SEQ ID NO: 731146 - protein, 9 aa, Homo Sapiens
IATILLFLN

SEQ ID NO: 731147 - protein, 9 aa, Homo Sapiens
DLGTESLFR

SEQ ID NO: 731148 - protein, 9 aa, Homo Sapiens
LAPPQLLIR

SEQ ID NO: 731149 - protein, 9 aa, Homo Sapiens
FSISSFSET

SEQ ID NO: 731150 - protein, 9 aa, Homo Sapiens
CHRAKIDNY

SEQ ID NO: 731151 - protein, 9 aa, Homo Sapiens
HYERKPLSL

SEQ ID NO: 731152 - protein, 9 aa, Homo Sapiens
GLRKLYRPD

SEQ ID NO: 731153 - protein, 9 aa, Homo Sapiens
KTPKFKMPV

SEQ ID NO: 731154 - protein, 9 aa, Homo Sapiens
LATKKVEEQ

SEQ ID NO: 731155 - protein, 9 aa, Homo Sapiens
LNTLQKNVN

SEQ ID NO: 731156 - protein, 9 aa, Homo Sapiens
TFKRSQSSH

SEQ ID NO: 731157 - protein, 9 aa, Homo Sapiens
PNQNNWLCT

SEQ ID NO: 731158 - protein, 9 aa, Homo Sapiens
GVLPEELCG

SEQ ID NO: 731159 - protein, 9 aa, Homo Sapiens
ESRSETWRR

SEQ ID NO: 731160 - protein, 9 aa, Homo Sapiens
LVSSVILLI

SEQ ID NO: 731161 - protein, 9 aa, Homo Sapiens
EDNVDHNEK

SEQ ID NO: 731162 - protein, 9 aa, Homo Sapiens
FKIPPFECE

SEQ ID NO: 731163 - protein, 9 aa, Homo Sapiens
LPEELCGLK

SEQ ID NO: 731164 - protein, 9 aa, Homo Sapiens
CIRCFCKHI

SEQ ID NO: 731165 - protein, 9 aa, Homo Sapiens
DCGEQRTLD

SEQ ID NO: 731166 - protein, 9 aa, Homo Sapiens
SVSIMYLRF

SEQ ID NO: 731167 - protein, 9 aa, Homo Sapiens
PDPAKSALA

SEQ ID NO: 731168 - protein, 9 aa, Homo Sapiens
TRNITPTIN

SEQ ID NO: 731169 - protein, 9 aa, Homo Sapiens
EQRDPAAPE

SEQ ID NO: 731170 - protein, 9 aa, Homo Sapiens
LGLAYFTSV

SEQ ID NO: 731171 - protein, 9 aa, Homo Sapiens
DIDRFSRHD

SEQ ID NO: 731172 - protein, 9 aa, Homo Sapiens
CGPGFKHQI

SEQ ID NO: 731173 - protein, 9 aa, Homo Sapiens
PSSRERSSP

SEQ ID NO: 731174 - protein, 9 aa, Homo Sapiens
IELLVVVDI

SEQ ID NO: 731175 - protein, 9 aa, Homo Sapiens
AAVLIAQVY

SEQ ID NO: 731176 - protein, 9 aa, Homo Sapiens
GKGVTFALK

SEQ ID NO: 731177 - protein, 9 aa, Homo Sapiens
EILFGEKIT

SEQ ID NO: 731178 - protein, 9 aa, Homo Sapiens
LLFLNILEI

SEQ ID NO: 731179 - protein, 9 aa, Homo Sapiens
VVANLDKLH

SEQ ID NO: 731180 - protein, 9 aa, Homo Sapiens
SLRVRDIKD

SEQ ID NO: 731181 - protein, 9 aa, Homo Sapiens
FKDKRRELG

SEQ ID NO: 731182 - protein, 9 aa, Homo Sapiens
VYAEYALAA

SEQ ID NO: 731183 - protein, 9 aa, Homo Sapiens
PGRAWLQAR

SEQ ID NO: 731184 - protein, 9 aa, Homo Sapiens
DSAQGGKNT

SEQ ID NO: 731185 - protein, 9 aa, Homo Sapiens
RWIRERSHQ

SEQ ID NO: 731186 - protein, 9 aa, Homo Sapiens
TKKVDEHQT

SEQ ID NO: 731187 - protein, 9 aa, Homo Sapiens
MGKGFISFL

SEQ ID NO: 731188 - protein, 9 aa, Homo Sapiens
GSGHHSGGC

SEQ ID NO: 731189 - protein, 9 aa, Homo Sapiens
LLRPTAALQ

SEQ ID NO: 731190 - protein, 9 aa, Homo Sapiens
KMLHRLTAY

SEQ ID NO: 731191 - protein, 9 aa, Homo Sapiens
ICLATKKVE

SEQ ID NO: 731192 - protein, 9 aa, Homo Sapiens
EALSFEVPC

SEQ ID NO: 731193 - protein, 9 aa, Homo Sapiens
ALQKMLFKI

SEQ ID NO: 731194 - protein, 9 aa, Homo Sapiens
AGAIGNGAV

SEQ ID NO: 731195 - protein, 9 aa, Homo Sapiens
EHGEQQRRT

SEQ ID NO: 731196 - protein, 9 aa, Homo Sapiens
ASIQGAQPI

SEQ ID NO: 731197 - protein, 9 aa, Homo Sapiens
YESNKHFLW

SEQ ID NO: 731198 - protein, 9 aa, Homo Sapiens
CKILGVGIS

SEQ ID NO: 731199 - protein, 9 aa, Homo Sapiens
GGSGHHSGG

SEQ ID NO: 731200 - protein, 9 aa, Homo Sapiens
GSLSQAAIM

SEQ ID NO: 731201 - protein, 9 aa, Homo Sapiens
CKCESPHCK

SEQ ID NO: 731202 - protein, 9 aa, Homo Sapiens
APVVLTPME

SEQ ID NO: 731203 - protein, 9 aa, Homo Sapiens
LWSCWFPSS

SEQ ID NO: 731204 - protein, 9 aa, Homo Sapiens
YQANIAELS

SEQ ID NO: 731205 - protein, 9 aa, Homo Sapiens
GRVNLSFND

SEQ ID NO: 731206 - protein, 9 aa, Homo Sapiens
MKSPELCTV

SEQ ID NO: 731207 - protein, 9 aa, Homo Sapiens
ENSCIRCFC

SEQ ID NO: 731208 - protein, 9 aa, Homo Sapiens
VIHDPSYKE

SEQ ID NO: 731209 - protein, 9 aa, Homo Sapiens
SRGPLVTCK

SEQ ID NO: 731210 - protein, 9 aa, Homo Sapiens
KEQDEEEEE

SEQ ID NO: 731211 - protein, 9 aa, Homo Sapiens
IPPQSPANI

SEQ ID NO: 731212 - protein, 9 aa, Homo Sapiens
WPYNPVSPC

SEQ ID NO: 731213 - protein, 9 aa, Homo Sapiens
QGFNRSEPC

SEQ ID NO: 731214 - protein, 9 aa, Homo Sapiens
QKMLFKIID

SEQ ID NO: 731215 - protein, 9 aa, Homo Sapiens
SVFQPQSLE

SEQ ID NO: 731216 - protein, 9 aa, Homo Sapiens
LNALKTVIH

SEQ ID NO: 731217 - protein, 9 aa, Homo Sapiens
LSNKIFMLF

SEQ ID NO: 731218 - protein, 9 aa, Homo Sapiens
TQDGRVFYV

SEQ ID NO: 731219 - protein, 9 aa, Homo Sapiens
GGSGSPVPT

SEQ ID NO: 731220 - protein, 9 aa, Homo Sapiens
EIQHVNEQQ

SEQ ID NO: 731221 - protein, 9 aa, Homo Sapiens
EIPPQSPAN

SEQ ID NO: 731222 - protein, 9 aa, Homo Sapiens
SQRYSNGIQ

SEQ ID NO: 731223 - protein, 9 aa, Homo Sapiens
WVCGVAAGA

SEQ ID NO: 731224 - protein, 9 aa, Homo Sapiens
IVQEIPPQS

SEQ ID NO: 731225 - protein, 9 aa, Homo Sapiens
MFQIHRYII

SEQ ID NO: 731226 - protein, 9 aa, Homo Sapiens
KTDLSSLEP

SEQ ID NO: 731227 - protein, 9 aa, Homo Sapiens
KEHEEMDEG

SEQ ID NO: 731228 - protein, 9 aa, Homo Sapiens
AEAVKLNCK

SEQ ID NO: 731229 - protein, 9 aa, Homo Sapiens
SLAKFRKLQ

SEQ ID NO: 731230 - protein, 9 aa, Homo Sapiens
CAFAKKHKR

SEQ ID NO: 731231 - protein, 9 aa, Homo Sapiens
DRPQVFEQR

SEQ ID NO: 731232 - protein, 9 aa, Homo Sapiens
LLERVMHGE

SEQ ID NO: 731233 - protein, 9 aa, Homo Sapiens
VNPPFSLKL

SEQ ID NO: 731234 - protein, 9 aa, Homo Sapiens
AFAKKHKRT

SEQ ID NO: 731235 - protein, 9 aa, Homo Sapiens
GSVFGKGVT

SEQ ID NO: 731236 - protein, 9 aa, Homo Sapiens
ERILDTWPE

SEQ ID NO: 731237 - protein, 9 aa, Homo Sapiens
DPSLRKRLG

SEQ ID NO: 731238 - protein, 9 aa, Homo Sapiens
FYGEGGWRF

SEQ ID NO: 731239 - protein, 9 aa, Homo Sapiens
DKTTHHELS

SEQ ID NO: 731240 - protein, 9 aa, Homo Sapiens
NDEQYEVIE

SEQ ID NO: 731241 - protein, 9 aa, Homo Sapiens
RKIRLLGRR

SEQ ID NO: 731242 - protein, 9 aa, Homo Sapiens
IIKISSFGH

SEQ ID NO: 731243 - protein, 9 aa, Homo Sapiens
EESGFYQMD

SEQ ID NO: 731244 - protein, 9 aa, Homo Sapiens
TQLVLFPTQ

SEQ ID NO: 731245 - protein, 9 aa, Homo Sapiens
RYCKPEEEV

SEQ ID NO: 731246 - protein, 9 aa, Homo Sapiens
GKNTGISGI

SEQ ID NO: 731247 - protein, 9 aa, Homo Sapiens
STNQSIGGV

SEQ ID NO: 731248 - protein, 9 aa, Homo Sapiens
RCNSGGSFS

SEQ ID NO: 731249 - protein, 9 aa, Homo Sapiens
TSFHVTCAF

SEQ ID NO: 731250 - protein, 9 aa, Homo Sapiens
LNTFTFKVL

SEQ ID NO: 731251 - protein, 9 aa, Homo Sapiens
GFYQMDVQA

SEQ ID NO: 731252 - protein, 9 aa, Homo Sapiens
FSANLKTLN

SEQ ID NO: 731253 - protein, 9 aa, Homo Sapiens
LGGPSSLWS

SEQ ID NO: 731254 - protein, 9 aa, Homo Sapiens
RHSMTHIAG

SEQ ID NO: 731255 - protein, 9 aa, Homo Sapiens
CWFPSSKLQ

SEQ ID NO: 731256 - protein, 9 aa, Homo Sapiens
HQILVDKKP

SEQ ID NO: 731257 - protein, 9 aa, Homo Sapiens
SPFQPGRGY

SEQ ID NO: 731258 - protein, 9 aa, Homo Sapiens
VIELSSEAK

SEQ ID NO: 731259 - protein, 9 aa, Homo Sapiens
VALKEEVAI

SEQ ID NO: 731260 - protein, 9 aa, Homo Sapiens
KTDDLLVAS

SEQ ID NO: 731261 - protein, 9 aa, Homo Sapiens
INAKNTVLL

SEQ ID NO: 731262 - protein, 9 aa, Homo Sapiens
MDVVYALKT

SEQ ID NO: 731263 - protein, 9 aa, Homo Sapiens
SPSTGSALS

SEQ ID NO: 731264 - protein, 9 aa, Homo Sapiens
SPPLFSMED

SEQ ID NO: 731265 - protein, 9 aa, Homo Sapiens
KDKMASVFY

SEQ ID NO: 731266 - protein, 9 aa, Homo Sapiens
SSDTGMKSL

SEQ ID NO: 731267 - protein, 9 aa, Homo Sapiens
LNPYYNEAL

SEQ ID NO: 731268 - protein, 9 aa, Homo Sapiens
CAMNNISRQ

SEQ ID NO: 731269 - protein, 9 aa, Homo Sapiens
RQTASVALK

SEQ ID NO: 731270 - protein, 9 aa, Homo Sapiens
LQKNVNKYQ

SEQ ID NO: 731271 - protein, 9 aa, Homo Sapiens
VSSVILLIV

SEQ ID NO: 731272 - protein, 9 aa, Homo Sapiens
DETGITLAS

SEQ ID NO: 731273 - protein, 9 aa, Homo Sapiens
CVDVNECKT

SEQ ID NO: 731274 - protein, 9 aa, Homo Sapiens
HIPLDQEGS

SEQ ID NO: 731275 - protein, 9 aa, Homo Sapiens
SAVHRPQLS

SEQ ID NO: 731276 - protein, 9 aa, Homo Sapiens
SNRWLRLLQ

SEQ ID NO: 731277 - protein, 9 aa, Homo Sapiens
LGYSALYLC

SEQ ID NO: 731278 - protein, 9 aa, Homo Sapiens
VKDRCTLAV

SEQ ID NO: 731279 - protein, 9 aa, Homo Sapiens
SQDLALIAQ

SEQ ID NO: 731280 - protein, 9 aa, Homo Sapiens
VVTSAEDTL

SEQ ID NO: 731281 - protein, 9 aa, Homo Sapiens
SPTKYMDSE

SEQ ID NO: 731282 - protein, 9 aa, Homo Sapiens
QAIDSLISA

SEQ ID NO: 731283 - protein, 9 aa, Homo Sapiens
FEAMPRRPS

SEQ ID NO: 731284 - protein, 9 aa, Homo Sapiens
KETIKGHSV

SEQ ID NO: 731285 - protein, 9 aa, Homo Sapiens
GPQEESEDD

SEQ ID NO: 731286 - protein, 9 aa, Homo Sapiens
LEKLSKAMS

SEQ ID NO: 731287 - protein, 9 aa, Homo Sapiens
SVTFAILAE

SEQ ID NO: 731288 - protein, 9 aa, Homo Sapiens
VEAEGVPLA

SEQ ID NO: 731289 - protein, 9 aa, Homo Sapiens
LIRDSLISS

SEQ ID NO: 731290 - protein, 9 aa, Homo Sapiens
EQAHSIINE

SEQ ID NO: 731291 - protein, 9 aa, Homo Sapiens
SDLPSVSYA

SEQ ID NO: 731292 - protein, 9 aa, Homo Sapiens
DLSSLEPIV

SEQ ID NO: 731293 - protein, 9 aa, Homo Sapiens
RVLRKWKQL

SEQ ID NO: 731294 - protein, 9 aa, Homo Sapiens
KFDLIDKFV

SEQ ID NO: 731295 - protein, 9 aa, Homo Sapiens
LRIFLMTNH

SEQ ID NO: 731296 - protein, 9 aa, Homo Sapiens
LLGYSALYL

SEQ ID NO: 731297 - protein, 9 aa, Homo Sapiens
LRRSPTPRA

SEQ ID NO: 731298 - protein, 9 aa, Homo Sapiens
GPSSLWSCW

SEQ ID NO: 731299 - protein, 9 aa, Homo Sapiens
SLKLLQNAQ

SEQ ID NO: 731300 - protein, 9 aa, Homo Sapiens
KQAYVPAAV

SEQ ID NO: 731301 - protein, 9 aa, Homo Sapiens
LFRSPEEQS

SEQ ID NO: 731302 - protein, 9 aa, Homo Sapiens
LGTESLFRS

SEQ ID NO: 731303 - protein, 9 aa, Homo Sapiens
VLPEELCGL

SEQ ID NO: 731304 - protein, 9 aa, Homo Sapiens
FRLTHWRTR

SEQ ID NO: 731305 - protein, 9 aa, Homo Sapiens
SNCCDRGSG

SEQ ID NO: 731306 - protein, 9 aa, Homo Sapiens
VFPPNQRTL

SEQ ID NO: 731307 - protein, 9 aa, Homo Sapiens
CDKSFKTQK

SEQ ID NO: 731308 - protein, 9 aa, Homo Sapiens
QQRRTVHYE

SEQ ID NO: 731309 - protein, 9 aa, Homo Sapiens
KDPRNQPYF

SEQ ID NO: 731310 - protein, 9 aa, Homo Sapiens
GENKNLQQE

SEQ ID NO: 731311 - protein, 9 aa, Homo Sapiens
VDKKPVPIF

SEQ ID NO: 731312 - protein, 9 aa, Homo Sapiens
PSSASLGML

SEQ ID NO: 731313 - protein, 9 aa, Homo Sapiens
FSIQLWVII

SEQ ID NO: 731314 - protein, 9 aa, Homo Sapiens
LQFYGEGGW

SEQ ID NO: 731315 - protein, 9 aa, Homo Sapiens
KPVNILVMG

SEQ ID NO: 731316 - protein, 9 aa, Homo Sapiens
VVVDINEDK

SEQ ID NO: 731317 - protein, 9 aa, Homo Sapiens
WPEEGIENS

SEQ ID NO: 731318 - protein, 9 aa, Homo Sapiens
VPAMSRNQD

SEQ ID NO: 731319 - protein, 9 aa, Homo Sapiens
CPSPPLFSM

SEQ ID NO: 731320 - protein, 9 aa, Homo Sapiens
IKENALPSG

SEQ ID NO: 731321 - protein, 9 aa, Homo Sapiens
PSNPASVSS

SEQ ID NO: 731322 - protein, 9 aa, Homo Sapiens
GSSDAEQRD

SEQ ID NO: 731323 - protein, 9 aa, Homo Sapiens
PSPEPSNPA

SEQ ID NO: 731324 - protein, 9 aa, Homo Sapiens
ASVSQDRAA

SEQ ID NO: 731325 - protein, 9 aa, Homo Sapiens
FFYTQLVLF

SEQ ID NO: 731326 - protein, 9 aa, Homo Sapiens
PVVPQAPAA

SEQ ID NO: 731327 - protein, 9 aa, Homo Sapiens
LSEITKQEK

SEQ ID NO: 731328 - protein, 9 aa, Homo Sapiens
TGKITRESR

SEQ ID NO: 731329 - protein, 9 aa, Homo Sapiens
GVYAEYALA

SEQ ID NO: 731330 - protein, 9 aa, Homo Sapiens
ETLKGENKN

SEQ ID NO: 731331 - protein, 9 aa, Homo Sapiens
PEVPYHLVL

SEQ ID NO: 731332 - protein, 9 aa, Homo Sapiens
YLQHWGPAE

SEQ ID NO: 731333 - protein, 9 aa, Homo Sapiens
IANCHLSRL

SEQ ID NO: 731334 - protein, 9 aa, Homo Sapiens
NPYYNEALS

SEQ ID NO: 731335 - protein, 9 aa, Homo Sapiens
LGMLSAITN

SEQ ID NO: 731336 - protein, 9 aa, Homo Sapiens
PTKYMDSEE

SEQ ID NO: 731337 - protein, 9 aa, Homo Sapiens
VLESVTFAI

SEQ ID NO: 731338 - protein, 9 aa, Homo Sapiens
GHNEAGSEP

SEQ ID NO: 731339 - protein, 9 aa, Homo Sapiens
GRIGIPSQA

SEQ ID NO: 731340 - protein, 9 aa, Homo Sapiens
NRSQFICLV

SEQ ID NO: 731341 - protein, 9 aa, Homo Sapiens
PLVTCKCES

SEQ ID NO: 731342 - protein, 9 aa, Homo Sapiens
QDLALIAQE

SEQ ID NO: 731343 - protein, 9 aa, Homo Sapiens
IVIKTKEQD

SEQ ID NO: 731344 - protein, 9 aa, Homo Sapiens
YLYVDLRDG

SEQ ID NO: 731345 - protein, 9 aa, Homo Sapiens
PQEESEDDS

SEQ ID NO: 731346 - protein, 9 aa, Homo Sapiens
QDYELIQRF

SEQ ID NO: 731347 - protein, 9 aa, Homo Sapiens
SSLMSEFIF

SEQ ID NO: 731348 - protein, 9 aa, Homo Sapiens
IEHNKQVEP

SEQ ID NO: 731349 - protein, 9 aa, Homo Sapiens
CRCQSSNCC

SEQ ID NO: 731350 - protein, 9 aa, Homo Sapiens
GTSNQKAQG

SEQ ID NO: 731351 - protein, 9 aa, Homo Sapiens
IEGRERDHE

SEQ ID NO: 731352 - protein, 9 aa, Homo Sapiens
HSLDKDKMA

SEQ ID NO: 731353 - protein, 9 aa, Homo Sapiens
ELPWASLPP

SEQ ID NO: 731354 - protein, 9 aa, Homo Sapiens
INLLASDLP

SEQ ID NO: 731355 - protein, 9 aa, Homo Sapiens
LRKRLGSGL

SEQ ID NO: 731356 - protein, 9 aa, Homo Sapiens
IALGQCVLA

SEQ ID NO: 731357 - protein, 9 aa, Homo Sapiens
CGVAAGAFV

SEQ ID NO: 731358 - protein, 9 aa, Homo Sapiens
KRLGSGLST

SEQ ID NO: 731359 - protein, 9 aa, Homo Sapiens
VHDSFLYYN

SEQ ID NO: 731360 - protein, 9 aa, Homo Sapiens
ANSMLCVFQ

SEQ ID NO: 731361 - protein, 9 aa, Homo Sapiens
SVGCCSSGA

SEQ ID NO: 731362 - protein, 9 aa, Homo Sapiens
ASDSVFQPQ

SEQ ID NO: 731363 - protein, 9 aa, Homo Sapiens
QNWKIQKIA

SEQ ID NO: 731364 - protein, 9 aa, Homo Sapiens
GLELRVATR

SEQ ID NO: 731365 - protein, 9 aa, Homo Sapiens
HFIEETDDA

SEQ ID NO: 731366 - protein, 9 aa, Homo Sapiens
RLFVQHEQL

SEQ ID NO: 731367 - protein, 9 aa, Homo Sapiens
ELLGSNDLL

SEQ ID NO: 731368 - protein, 9 aa, Homo Sapiens
LEILQAANI

SEQ ID NO: 731369 - protein, 9 aa, Homo Sapiens
FTSSTISGV

SEQ ID NO: 731370 - protein, 9 aa, Homo Sapiens
LKCNEKSVS

SEQ ID NO: 731371 - protein, 9 aa, Homo Sapiens
EALHISGPR

SEQ ID NO: 731372 - protein, 9 aa, Homo Sapiens
TEEKDSKKE

SEQ ID NO: 731373 - protein, 9 aa, Homo Sapiens
FSPPPPGYN

SEQ ID NO: 731374 - protein, 9 aa, Homo Sapiens
TWPEEGIEN

SEQ ID NO: 731375 - protein, 9 aa, Homo Sapiens
KFKMPVMHF

SEQ ID NO: 731376 - protein, 9 aa, Homo Sapiens
VCGVAAGAF

SEQ ID NO: 731377 - protein, 9 aa, Homo Sapiens
LARQFAIMT

SEQ ID NO: 731378 - protein, 9 aa, Homo Sapiens
KKPVPIFLV

SEQ ID NO: 731379 - protein, 9 aa, Homo Sapiens
FLWPYNPVS

SEQ ID NO: 731380 - protein, 9 aa, Homo Sapiens
KANLITDLQ

SEQ ID NO: 731381 - protein, 9 aa, Homo Sapiens
IHILHKQDH

SEQ ID NO: 731382 - protein, 9 aa, Homo Sapiens
NVCVMNLDL

SEQ ID NO: 731383 - protein, 9 aa, Homo Sapiens
EAEGVPLAY

SEQ ID NO: 731384 - protein, 9 aa, Homo Sapiens
NPRCDVVKR

SEQ ID NO: 731385 - protein, 9 aa, Homo Sapiens
ILDTWPEEG

SEQ ID NO: 731386 - protein, 9 aa, Homo Sapiens
GPRPQLQQV

SEQ ID NO: 731387 - protein, 9 aa, Homo Sapiens
ITLEPDRPQ

SEQ ID NO: 731388 - protein, 9 aa, Homo Sapiens
GYLYVDLRD

SEQ ID NO: 731389 - protein, 9 aa, Homo Sapiens
DATTYITTT

SEQ ID NO: 731390 - protein, 9 aa, Homo Sapiens
FVQHEQLLN

SEQ ID NO: 731391 - protein, 9 aa, Homo Sapiens
RSEPCPRDT

SEQ ID NO: 731392 - protein, 9 aa, Homo Sapiens
ICLVAASVS

SEQ ID NO: 731393 - protein, 9 aa, Homo Sapiens
QTMEKVLIH

SEQ ID NO: 731394 - protein, 9 aa, Homo Sapiens
LSQMINLRR

SEQ ID NO: 731395 - protein, 9 aa, Homo Sapiens
TVLFIMGYA

SEQ ID NO: 731396 - protein, 9 aa, Homo Sapiens
YQPSAASMV

SEQ ID NO: 731397 - protein, 9 aa, Homo Sapiens
SPAAITHIM

SEQ ID NO: 731398 - protein, 9 aa, Homo Sapiens
SSPAHKDEH

SEQ ID NO: 731399 - protein, 9 aa, Homo Sapiens
QSSNCCDRG

SEQ ID NO: 731400 - protein, 9 aa, Homo Sapiens
GPLVTCKCE

SEQ ID NO: 731401 - protein, 9 aa, Homo Sapiens
KCNEKSVSV

SEQ ID NO: 731402 - protein, 9 aa, Homo Sapiens
ACLQRAFNL

SEQ ID NO: 731403 - protein, 9 aa, Homo Sapiens
ASVALKEEV

SEQ ID NO: 731404 - protein, 9 aa, Homo Sapiens
KTEEKDSKK

SEQ ID NO: 731405 - protein, 9 aa, Homo Sapiens
TCKCESPHC

SEQ ID NO: 731406 - protein, 9 aa, Homo Sapiens
DVALEILQA

SEQ ID NO: 731407 - protein, 9 aa, Homo Sapiens
RLDFNYKKK

SEQ ID NO: 731408 - protein, 9 aa, Homo Sapiens
LGIPGRVGL

SEQ ID NO: 731409 - protein, 9 aa, Homo Sapiens
QQSEQNMKL

SEQ ID NO: 731410 - protein, 9 aa, Homo Sapiens
ILEGEMQAR

SEQ ID NO: 731411 - protein, 9 aa, Homo Sapiens
HLVMHQLRC

SEQ ID NO: 731412 - protein, 9 aa, Homo Sapiens
PLDAGVDKI

SEQ ID NO: 731413 - protein, 9 aa, Homo Sapiens
QMPPEAGSV

SEQ ID NO: 731414 - protein, 9 aa, Homo Sapiens
KRCKVMLRE

SEQ ID NO: 731415 - protein, 9 aa, Homo Sapiens
NYNWKSFGL

SEQ ID NO: 731416 - protein, 9 aa, Homo Sapiens
KLDGTTPVW

SEQ ID NO: 731417 - protein, 9 aa, Homo Sapiens
ERQRNQLEG

SEQ ID NO: 731418 - protein, 9 aa, Homo Sapiens
SMTVKDVET

SEQ ID NO: 731419 - protein, 9 aa, Homo Sapiens
SLWNLVVSL

SEQ ID NO: 731420 - protein, 9 aa, Homo Sapiens
GVPQLSSRV

SEQ ID NO: 731421 - protein, 9 aa, Homo Sapiens
QNESDNLRQ

SEQ ID NO: 731422 - protein, 9 aa, Homo Sapiens
TVTYDLKSV

SEQ ID NO: 731423 - protein, 9 aa, Homo Sapiens
LPSCSILPR

SEQ ID NO: 731424 - protein, 9 aa, Homo Sapiens
AIFDGSYLG

SEQ ID NO: 731425 - protein, 9 aa, Homo Sapiens
KKIHAGEKP

SEQ ID NO: 731426 - protein, 9 aa, Homo Sapiens
KAGELKVVS

SEQ ID NO: 731427 - protein, 9 aa, Homo Sapiens
PFTYEDPKE

SEQ ID NO: 731428 - protein, 9 aa, Homo Sapiens
EMFKALNDA

SEQ ID NO: 731429 - protein, 9 aa, Homo Sapiens
KHEFQDAWK

SEQ ID NO: 731430 - protein, 9 aa, Homo Sapiens
SKRKRSKSK

SEQ ID NO: 731431 - protein, 9 aa, Homo Sapiens
RNQLEGVKQ

SEQ ID NO: 731432 - protein, 9 aa, Homo Sapiens
SDDEWPVAS

SEQ ID NO: 731433 - protein, 9 aa, Homo Sapiens
KQRKTAAEM

SEQ ID NO: 731434 - protein, 9 aa, Homo Sapiens
QNMKLCQEN

SEQ ID NO: 731435 - protein, 9 aa, Homo Sapiens
TWTILVEPG

SEQ ID NO: 731436 - protein, 9 aa, Homo Sapiens
PRKGTQLST

SEQ ID NO: 731437 - protein, 9 aa, Homo Sapiens
ELRVYPLKT

SEQ ID NO: 731438 - protein, 9 aa, Homo Sapiens
NHESNYSLH

SEQ ID NO: 731439 - protein, 9 aa, Homo Sapiens
SAAGPKRKG

SEQ ID NO: 731440 - protein, 9 aa, Homo Sapiens
PPHQGHPQD

SEQ ID NO: 731441 - protein, 9 aa, Homo Sapiens
RPGFMGTYC

SEQ ID NO: 731442 - protein, 9 aa, Homo Sapiens
ERHAGSLLD

SEQ ID NO: 731443 - protein, 9 aa, Homo Sapiens
ELPRHYRKH

SEQ ID NO: 731444 - protein, 9 aa, Homo Sapiens
QGNIFSADV

SEQ ID NO: 731445 - protein, 9 aa, Homo Sapiens
TSGVSHRPF

SEQ ID NO: 731446 - protein, 9 aa, Homo Sapiens
IILHKALST

SEQ ID NO: 731447 - protein, 9 aa, Homo Sapiens
RPGGPAVRE

SEQ ID NO: 731448 - protein, 9 aa, Homo Sapiens
VSAAGPKRK

SEQ ID NO: 731449 - protein, 9 aa, Homo Sapiens
LCILGSGVQ

SEQ ID NO: 731450 - protein, 9 aa, Homo Sapiens
NEAKYIPFT

SEQ ID NO: 731451 - protein, 9 aa, Homo Sapiens
KYWSSLWNL

SEQ ID NO: 731452 - protein, 9 aa, Homo Sapiens
TNEQDIANR

SEQ ID NO: 731453 - protein, 9 aa, Homo Sapiens
SLDGSISAA

SEQ ID NO: 731454 - protein, 9 aa, Homo Sapiens
TQSTWMWWS

SEQ ID NO: 731455 - protein, 9 aa, Homo Sapiens
KNRSCIILH

SEQ ID NO: 731456 - protein, 9 aa, Homo Sapiens
DNHLVMHQL

SEQ ID NO: 731457 - protein, 9 aa, Homo Sapiens
TPGQGCPAS

SEQ ID NO: 731458 - protein, 9 aa, Homo Sapiens
SGLRKEEKP

SEQ ID NO: 731459 - protein, 9 aa, Homo Sapiens
ANSDDEWPV

SEQ ID NO: 731460 - protein, 9 aa, Homo Sapiens
LGRVQFSLV

SEQ ID NO: 731461 - protein, 9 aa, Homo Sapiens
FEDRYVDCS

SEQ ID NO: 731462 - protein, 9 aa, Homo Sapiens
CLPSCSILP

SEQ ID NO: 731463 - protein, 9 aa, Homo Sapiens
IPPPPLPKN

SEQ ID NO: 731464 - protein, 9 aa, Homo Sapiens
KYIPFTMYT

SEQ ID NO: 731465 - protein, 9 aa, Homo Sapiens
TPELRVYPL

SEQ ID NO: 731466 - protein, 9 aa, Homo Sapiens
FSSQSLNIG

SEQ ID NO: 731467 - protein, 9 aa, Homo Sapiens
QSSCRRRSS

SEQ ID NO: 731468 - protein, 9 aa, Homo Sapiens
GHPQDGVAL

SEQ ID NO: 731469 - protein, 9 aa, Homo Sapiens
GKFSWRVIK

SEQ ID NO: 731470 - protein, 9 aa, Homo Sapiens
WSCTPMPCR

SEQ ID NO: 731471 - protein, 9 aa, Homo Sapiens
SISQSLDAL

SEQ ID NO: 731472 - protein, 9 aa, Homo Sapiens
ISCSGCALQ

SEQ ID NO: 731473 - protein, 9 aa, Homo Sapiens
RSNGVQTMV

SEQ ID NO: 731474 - protein, 9 aa, Homo Sapiens
GTITQAPPC

SEQ ID NO: 731475 - protein, 9 aa, Homo Sapiens
WDLEEGKTS

SEQ ID NO: 731476 - protein, 9 aa, Homo Sapiens
FKNRSCIIL

SEQ ID NO: 731477 - protein, 9 aa, Homo Sapiens
RHISCSGCA

SEQ ID NO: 731478 - protein, 9 aa, Homo Sapiens
HIQEDPNGK

SEQ ID NO: 731479 - protein, 9 aa, Homo Sapiens
LYDSFKFWR

SEQ ID NO: 731480 - protein, 9 aa, Homo Sapiens
SNVESELSG

SEQ ID NO: 731481 - protein, 9 aa, Homo Sapiens
EPQPVLVLK

SEQ ID NO: 731482 - protein, 9 aa, Homo Sapiens
SCFSPSPLS

SEQ ID NO: 731483 - protein, 9 aa, Homo Sapiens
KKHEIVHTG

SEQ ID NO: 731484 - protein, 9 aa, Homo Sapiens
HIANGYKIF

SEQ ID NO: 731485 - protein, 9 aa, Homo Sapiens
RHAPQLHTL

SEQ ID NO: 731486 - protein, 9 aa, Homo Sapiens
PRHAPQLHT

SEQ ID NO: 731487 - protein, 9 aa, Homo Sapiens
NMKEWQDWL

SEQ ID NO: 731488 - protein, 9 aa, Homo Sapiens
TFSFDPEFT

SEQ ID NO: 731489 - protein, 9 aa, Homo Sapiens
DRDLTALCK

SEQ ID NO: 731490 - protein, 9 aa, Homo Sapiens
LERPAEEQR

SEQ ID NO: 731491 - protein, 9 aa, Homo Sapiens
LPKLSITVT

SEQ ID NO: 731492 - protein, 9 aa, Homo Sapiens
QELHGEPTH

SEQ ID NO: 731493 - protein, 9 aa, Homo Sapiens
YPLKTLYVP

SEQ ID NO: 731494 - protein, 9 aa, Homo Sapiens
WPPPCASCG

SEQ ID NO: 731495 - protein, 9 aa, Homo Sapiens
LSDNKIIDG

SEQ ID NO: 731496 - protein, 9 aa, Homo Sapiens
SCIILHKAL

SEQ ID NO: 731497 - protein, 9 aa, Homo Sapiens
LERFHENPA

SEQ ID NO: 731498 - protein, 9 aa, Homo Sapiens
TPSMKVHGV

SEQ ID NO: 731499 - protein, 9 aa, Homo Sapiens
NFNEAKYIP

SEQ ID NO: 731500 - protein, 9 aa, Homo Sapiens
QIWRMINRS

SEQ ID NO: 731501 - protein, 9 aa, Homo Sapiens
VRPNSSLLF

SEQ ID NO: 731502 - protein, 9 aa, Homo Sapiens
HKKIHAGEK

SEQ ID NO: 731503 - protein, 9 aa, Homo Sapiens
QLSVRHYDR

SEQ ID NO: 731504 - protein, 9 aa, Homo Sapiens
EEQEAQAGK

SEQ ID NO: 731505 - protein, 9 aa, Homo Sapiens
VCHCFAFLP

SEQ ID NO: 731506 - protein, 9 aa, Homo Sapiens
QDLIRVEGN

SEQ ID NO: 731507 - protein, 9 aa, Homo Sapiens
NLMTFQVKF

SEQ ID NO: 731508 - protein, 9 aa, Homo Sapiens
EVLITQGGS

SEQ ID NO: 731509 - protein, 9 aa, Homo Sapiens
PIMGSLNLF

SEQ ID NO: 731510 - protein, 9 aa, Homo Sapiens
DAGVDKIKD

SEQ ID NO: 731511 - protein, 9 aa, Homo Sapiens
VARKSEFSR

SEQ ID NO: 731512 - protein, 9 aa, Homo Sapiens
PDHKHRGGS

SEQ ID NO: 731513 - protein, 9 aa, Homo Sapiens
LQAEEQSSC

SEQ ID NO: 731514 - protein, 9 aa, Homo Sapiens
VVSGAAASQ

SEQ ID NO: 731515 - protein, 9 aa, Homo Sapiens
YVDCSATGH

SEQ ID NO: 731516 - protein, 9 aa, Homo Sapiens
ACLLASSVS

SEQ ID NO: 731517 - protein, 9 aa, Homo Sapiens
TIDIGPRSA

SEQ ID NO: 731518 - protein, 9 aa, Homo Sapiens
LTGRRHISC

SEQ ID NO: 731519 - protein, 9 aa, Homo Sapiens
APSKVLEDA

SEQ ID NO: 731520 - protein, 9 aa, Homo Sapiens
YTLVVKRGD

SEQ ID NO: 731521 - protein, 9 aa, Homo Sapiens
NGLYDSFKF

SEQ ID NO: 731522 - protein, 9 aa, Homo Sapiens
AKVPAPPHQ

SEQ ID NO: 731523 - protein, 9 aa, Homo Sapiens
AEEQSSCRR

SEQ ID NO: 731524 - protein, 9 aa, Homo Sapiens
GIHFSAISV

SEQ ID NO: 731525 - protein, 9 aa, Homo Sapiens
EVQILEDSP

SEQ ID NO: 731526 - protein, 9 aa, Homo Sapiens
PESRLVQTL

SEQ ID NO: 731527 - protein, 9 aa, Homo Sapiens
SRLVQTLCV

SEQ ID NO: 731528 - protein, 9 aa, Homo Sapiens
WQDWLRALL

SEQ ID NO: 731529 - protein, 9 aa, Homo Sapiens
ALSFIKCGN

SEQ ID NO: 731530 - protein, 9 aa, Homo Sapiens
GVDKIKDKK

SEQ ID NO: 731531 - protein, 9 aa, Homo Sapiens
EAGSGIPVF

SEQ ID NO: 731532 - protein, 9 aa, Homo Sapiens
NEGVLRVVK

SEQ ID NO: 731533 - protein, 9 aa, Homo Sapiens
ASSVSDDSL

SEQ ID NO: 731534 - protein, 9 aa, Homo Sapiens
QSTWMWWSS

SEQ ID NO: 731535 - protein, 9 aa, Homo Sapiens
EWPVASDND

SEQ ID NO: 731536 - protein, 9 aa, Homo Sapiens
AFSTCSTHL

SEQ ID NO: 731537 - protein, 9 aa, Homo Sapiens
ESPSQESPS

SEQ ID NO: 731538 - protein, 9 aa, Homo Sapiens
DTFSFDPEF

SEQ ID NO: 731539 - protein, 9 aa, Homo Sapiens
FPIGKRLLG

SEQ ID NO: 731540 - protein, 9 aa, Homo Sapiens
QDIANRFKE

SEQ ID NO: 731541 - protein, 9 aa, Homo Sapiens
LQPQELKPE

SEQ ID NO: 731542 - protein, 9 aa, Homo Sapiens
HLPKLSITV

SEQ ID NO: 731543 - protein, 9 aa, Homo Sapiens
SEFNFSCKT

SEQ ID NO: 731544 - protein, 9 aa, Homo Sapiens
QRVQAEERE

SEQ ID NO: 731545 - protein, 9 aa, Homo Sapiens
LSISLSDML

SEQ ID NO: 731546 - protein, 9 aa, Homo Sapiens
FSADVHGLE

SEQ ID NO: 731547 - protein, 9 aa, Homo Sapiens
IQRVQAEER

SEQ ID NO: 731548 - protein, 9 aa, Homo Sapiens
DLEEGKTSG

SEQ ID NO: 731549 - protein, 9 aa, Homo Sapiens
SPALASAPE

SEQ ID NO: 731550 - protein, 9 aa, Homo Sapiens
IKCGNAMEQ

SEQ ID NO: 731551 - protein, 9 aa, Homo Sapiens
HLSLIDLTY

SEQ ID NO: 731552 - protein, 9 aa, Homo Sapiens
NGYKIFGKE

SEQ ID NO: 731553 - protein, 9 aa, Homo Sapiens
AKGYSLRTC

SEQ ID NO: 731554 - protein, 9 aa, Homo Sapiens
TTDNLTEAW

SEQ ID NO: 731555 - protein, 9 aa, Homo Sapiens
FPSYAHVRC

SEQ ID NO: 731556 - protein, 9 aa, Homo Sapiens
QTVESGTER

SEQ ID NO: 731557 - protein, 9 aa, Homo Sapiens
FLQSFQQRL

SEQ ID NO: 731558 - protein, 9 aa, Homo Sapiens
LVVGVQHVD

SEQ ID NO: 731559 - protein, 9 aa, Homo Sapiens
STARKPEAS

SEQ ID NO: 731560 - protein, 9 aa, Homo Sapiens
ILCGAQDRI

SEQ ID NO: 731561 - protein, 9 aa, Homo Sapiens
EPDGTKNKS

SEQ ID NO: 731562 - protein, 9 aa, Homo Sapiens
CSGCALQMF

SEQ ID NO: 731563 - protein, 9 aa, Homo Sapiens
PPPLPKNVA

SEQ ID NO: 731564 - protein, 9 aa, Homo Sapiens
IDIGPRSAT

SEQ ID NO: 731565 - protein, 9 aa, Homo Sapiens
LPSVQHSPY

SEQ ID NO: 731566 - protein, 9 aa, Homo Sapiens
PILCGAQDR

SEQ ID NO: 731567 - protein, 9 aa, Homo Sapiens
ISLLTQTVE

SEQ ID NO: 731568 - protein, 9 aa, Homo Sapiens
CWPRGTCSP

SEQ ID NO: 731569 - protein, 9 aa, Homo Sapiens
TSRLITGRG

SEQ ID NO: 731570 - protein, 9 aa, Homo Sapiens
TLPVSDPTA

SEQ ID NO: 731571 - protein, 9 aa, Homo Sapiens
KDYQDVPGI

SEQ ID NO: 731572 - protein, 9 aa, Homo Sapiens
SRRGALREL

SEQ ID NO: 731573 - protein, 9 aa, Homo Sapiens
GQKPYECNQ

SEQ ID NO: 731574 - protein, 9 aa, Homo Sapiens
WSSRQRTWS

SEQ ID NO: 731575 - protein, 9 aa, Homo Sapiens
QESPSQESP

SEQ ID NO: 731576 - protein, 9 aa, Homo Sapiens
MLRETVSSE

SEQ ID NO: 731577 - protein, 9 aa, Homo Sapiens
KFSWRVIKE

SEQ ID NO: 731578 - protein, 9 aa, Homo Sapiens
GFRLCNLLK

SEQ ID NO: 731579 - protein, 9 aa, Homo Sapiens
NESDNLRQQ

SEQ ID NO: 731580 - protein, 9 aa, Homo Sapiens
RPQQSSSPV

SEQ ID NO: 731581 - protein, 9 aa, Homo Sapiens
LSLVARKDP

SEQ ID NO: 731582 - protein, 9 aa, Homo Sapiens
NYLCHGQLI

SEQ ID NO: 731583 - protein, 9 aa, Homo Sapiens
NRKLRRSNR

SEQ ID NO: 731584 - protein, 9 aa, Homo Sapiens
FFPSYAHVR

SEQ ID NO: 731585 - protein, 9 aa, Homo Sapiens
PTIDIGPRS

SEQ ID NO: 731586 - protein, 9 aa, Homo Sapiens
LERLMGQKD

SEQ ID NO: 731587 - protein, 9 aa, Homo Sapiens
HFSAISVVK

SEQ ID NO: 731588 - protein, 9 aa, Homo Sapiens
KISANEFLE

SEQ ID NO: 731589 - protein, 9 aa, Homo Sapiens
RSDELPRHY

SEQ ID NO: 731590 - protein, 9 aa, Homo Sapiens
GRTKQLNLS

SEQ ID NO: 731591 - protein, 9 aa, Homo Sapiens
LLVLLNQTQ

SEQ ID NO: 731592 - protein, 9 aa, Homo Sapiens
FLVKSKDRD

SEQ ID NO: 731593 - protein, 9 aa, Homo Sapiens
ARKSEFSRT

SEQ ID NO: 731594 - protein, 9 aa, Homo Sapiens
NNYIIKGNH

SEQ ID NO: 731595 - protein, 9 aa, Homo Sapiens
ARQFGHDIH

SEQ ID NO: 731596 - protein, 9 aa, Homo Sapiens
APRAKGYSL

SEQ ID NO: 731597 - protein, 9 aa, Homo Sapiens
TNFTLIPNR

SEQ ID NO: 731598 - protein, 9 aa, Homo Sapiens
ELCGDYDDV

SEQ ID NO: 731599 - protein, 9 aa, Homo Sapiens
TQTVESGTE

SEQ ID NO: 731600 - protein, 9 aa, Homo Sapiens
EDEVLITQG

SEQ ID NO: 731601 - protein, 9 aa, Homo Sapiens
GRACQRYTE

SEQ ID NO: 731602 - protein, 9 aa, Homo Sapiens
PMYFFINHL

SEQ ID NO: 731603 - protein, 9 aa, Homo Sapiens
FCNELRVAP

SEQ ID NO: 731604 - protein, 9 aa, Homo Sapiens
KLRCVTTEP

SEQ ID NO: 731605 - protein, 9 aa, Homo Sapiens
GSYLGYSVA

SEQ ID NO: 731606 - protein, 9 aa, Homo Sapiens
SLVARKDPK

SEQ ID NO: 731607 - protein, 9 aa, Homo Sapiens
GNHFEPVVN

SEQ ID NO: 731608 - protein, 9 aa, Homo Sapiens
NDCYSLLRR

SEQ ID NO: 731609 - protein, 9 aa, Homo Sapiens
FAKQQPWWL

SEQ ID NO: 731610 - protein, 9 aa, Homo Sapiens
TAMTLPVSD

SEQ ID NO: 731611 - protein, 9 aa, Homo Sapiens
CYSLLRRLV

SEQ ID NO: 731612 - protein, 9 aa, Homo Sapiens
LPVSDPTAW

SEQ ID NO: 731613 - protein, 9 aa, Homo Sapiens
AQEGLKPGT

SEQ ID NO: 731614 - protein, 9 aa, Homo Sapiens
IWKIVRSNG

SEQ ID NO: 731615 - protein, 9 aa, Homo Sapiens
MKDKALADT

SEQ ID NO: 731616 - protein, 9 aa, Homo Sapiens
CTPMPCRSS

SEQ ID NO: 731617 - protein, 9 aa, Homo Sapiens
KQVYRQDCE

SEQ ID NO: 731618 - protein, 9 aa, Homo Sapiens
SDLECTLCM

SEQ ID NO: 731619 - protein, 9 aa, Homo Sapiens
SPSCSAEPR

SEQ ID NO: 731620 - protein, 9 aa, Homo Sapiens
VSSGEEHVL

SEQ ID NO: 731621 - protein, 9 aa, Homo Sapiens
PQPVLVLKA

SEQ ID NO: 731622 - protein, 9 aa, Homo Sapiens
KAPTIDIGP

SEQ ID NO: 731623 - protein, 9 aa, Homo Sapiens
LSVTDATPD

SEQ ID NO: 731624 - protein, 9 aa, Homo Sapiens
AKQRKNVWI

SEQ ID NO: 731625 - protein, 9 aa, Homo Sapiens
VKRALCCTV

SEQ ID NO: 731626 - protein, 9 aa, Homo Sapiens
SKTKEIKQV

SEQ ID NO: 731627 - protein, 9 aa, Homo Sapiens
PDGTKNKSL

SEQ ID NO: 731628 - protein, 9 aa, Homo Sapiens
VLEDAKVPA

SEQ ID NO: 731629 - protein, 9 aa, Homo Sapiens
KELFKKPER

SEQ ID NO: 731630 - protein, 9 aa, Homo Sapiens
GPKRKGHKE

SEQ ID NO: 731631 - protein, 9 aa, Homo Sapiens
IKGNHFEPV

SEQ ID NO: 731632 - protein, 9 aa, Homo Sapiens
GIPRHAPQL

SEQ ID NO: 731633 - protein, 9 aa, Homo Sapiens
KPERHAGSL

SEQ ID NO: 731634 - protein, 9 aa, Homo Sapiens
TWMWWSSRQ

SEQ ID NO: 731635 - protein, 9 aa, Homo Sapiens
VFGDKEPTN

SEQ ID NO: 731636 - protein, 9 aa, Homo Sapiens
LNYLCHGQL

SEQ ID NO: 731637 - protein, 9 aa, Homo Sapiens
TKSEFNFSC

SEQ ID NO: 731638 - protein, 9 aa, Homo Sapiens
DLNGLYDSF

SEQ ID NO: 731639 - protein, 9 aa, Homo Sapiens
GGSPDHKHR

SEQ ID NO: 731640 - protein, 9 aa, Homo Sapiens
GNIAPVICH

SEQ ID NO: 731641 - protein, 9 aa, Homo Sapiens
MTRKISANE

SEQ ID NO: 731642 - protein, 9 aa, Homo Sapiens
EMTRKISAN

SEQ ID NO: 731643 - protein, 9 aa, Homo Sapiens
APPCAVAAP

SEQ ID NO: 731644 - protein, 9 aa, Homo Sapiens
SVTDATPDS

SEQ ID NO: 731645 - protein, 9 aa, Homo Sapiens
DPFTYEDPK

SEQ ID NO: 731646 - protein, 9 aa, Homo Sapiens
LITGRGTLS

SEQ ID NO: 731647 - protein, 9 aa, Homo Sapiens
WNLVVSLLN

SEQ ID NO: 731648 - protein, 9 aa, Homo Sapiens
WIINHLQEA

SEQ ID NO: 731649 - protein, 9 aa, Homo Sapiens
YKKRKSREY

SEQ ID NO: 731650 - protein, 9 aa, Homo Sapiens
PKELFKKPE

SEQ ID NO: 731651 - protein, 9 aa, Homo Sapiens
ADTGKTETT

SEQ ID NO: 731652 - protein, 9 aa, Homo Sapiens
TSIPESRLV

SEQ ID NO: 731653 - protein, 9 aa, Homo Sapiens
NILQHLIPP

SEQ ID NO: 731654 - protein, 9 aa, Homo Sapiens
LQLSDNKII

SEQ ID NO: 731655 - protein, 9 aa, Homo Sapiens
AVVVSLAFL

SEQ ID NO: 731656 - protein, 9 aa, Homo Sapiens
TRKNHESNY

SEQ ID NO: 731657 - protein, 9 aa, Homo Sapiens
DIFEDEVLI

SEQ ID NO: 731658 - protein, 9 aa, Homo Sapiens
VTYDLKSVL

SEQ ID NO: 731659 - protein, 9 aa, Homo Sapiens
DGTTPVWYG

SEQ ID NO: 731660 - protein, 9 aa, Homo Sapiens
RHYDRFGRN

SEQ ID NO: 731661 - protein, 9 aa, Homo Sapiens
MGVPQLSSR

SEQ ID NO: 731662 - protein, 9 aa, Homo Sapiens
ERPAEEQRL

SEQ ID NO: 731663 - protein, 9 aa, Homo Sapiens
AGELKVVSG

SEQ ID NO: 731664 - protein, 9 aa, Homo Sapiens
SSRVILTVY

SEQ ID NO: 731665 - protein, 9 aa, Homo Sapiens
SALLAERFP

SEQ ID NO: 731666 - protein, 9 aa, Homo Sapiens
CGAQDRIHT

SEQ ID NO: 731667 - protein, 9 aa, Homo Sapiens
VDYEMFKAL

SEQ ID NO: 731668 - protein, 9 aa, Homo Sapiens
ISGLVFRVH

SEQ ID NO: 731669 - protein, 9 aa, Homo Sapiens
ELKVVSGAA

SEQ ID NO: 731670 - protein, 9 aa, Homo Sapiens
YKIMFVVNA

SEQ ID NO: 731671 - protein, 9 aa, Homo Sapiens
ADTPSMKVH

SEQ ID NO: 731672 - protein, 9 aa, Homo Sapiens
AVCVNCIKK

SEQ ID NO: 731673 - protein, 9 aa, Homo Sapiens
ASDLECTLC

SEQ ID NO: 731674 - protein, 9 aa, Homo Sapiens
SITVTYDLK

SEQ ID NO: 731675 - protein, 9 aa, Homo Sapiens
PAPPHQGHP

SEQ ID NO: 731676 - protein, 9 aa, Homo Sapiens
SGSSPSCSA

SEQ ID NO: 731677 - protein, 9 aa, Homo Sapiens
FSTCSTHLL

SEQ ID NO: 731678 - protein, 9 aa, Homo Sapiens
LPSLTKKSP

SEQ ID NO: 731679 - protein, 9 aa, Homo Sapiens
DITGRACQR

SEQ ID NO: 731680 - protein, 9 aa, Homo Sapiens
FSLVARVCK

SEQ ID NO: 731681 - protein, 9 aa, Homo Sapiens
QSEQNMKLC

SEQ ID NO: 731682 - protein, 9 aa, Homo Sapiens
ELFKKPERK

SEQ ID NO: 731683 - protein, 9 aa, Homo Sapiens
SPYSGNIAP

SEQ ID NO: 731684 - protein, 9 aa, Homo Sapiens
LRVVKPLNY

SEQ ID NO: 731685 - protein, 9 aa, Homo Sapiens
LGTWTRTLS

SEQ ID NO: 731686 - protein, 9 aa, Homo Sapiens
LKVVSGAAA

SEQ ID NO: 731687 - protein, 9 aa, Homo Sapiens
SISLSDMLC

SEQ ID NO: 731688 - protein, 9 aa, Homo Sapiens
NYEQEYKIM

SEQ ID NO: 731689 - protein, 9 aa, Homo Sapiens
GVCHCFAFL

SEQ ID NO: 731690 - protein, 9 aa, Homo Sapiens
TLCMRLFYE

SEQ ID NO: 731691 - protein, 9 aa, Homo Sapiens
ACQRYTEIT

SEQ ID NO: 731692 - protein, 9 aa, Homo Sapiens
TNEGVLRVV

SEQ ID NO: 731693 - protein, 9 aa, Homo Sapiens
ITVTYDLKS

SEQ ID NO: 731694 - protein, 9 aa, Homo Sapiens
SWRVIKEKR

SEQ ID NO: 731695 - protein, 9 aa, Homo Sapiens
PQLHTLAHG

SEQ ID NO: 731696 - protein, 9 aa, Homo Sapiens
RQRTWSCTP

SEQ ID NO: 731697 - protein, 9 aa, Homo Sapiens
PPPFPVRPN

SEQ ID NO: 731698 - protein, 9 aa, Homo Sapiens
QAPPCAVAA

SEQ ID NO: 731699 - protein, 9 aa, Homo Sapiens
EGVLRVVKP

SEQ ID NO: 731700 - protein, 9 aa, Homo Sapiens
EVTTDEDVE

SEQ ID NO: 731701 - protein, 9 aa, Homo Sapiens
SVSSGEEHV

SEQ ID NO: 731702 - protein, 9 aa, Homo Sapiens
SSSPVQLNS

SEQ ID NO: 731703 - protein, 9 aa, Homo Sapiens
RTSRLITGR

SEQ ID NO: 731704 - protein, 9 aa, Homo Sapiens
LIPNRKLRR

SEQ ID NO: 731705 - protein, 9 aa, Homo Sapiens
SCSGCALQM

SEQ ID NO: 731706 - protein, 9 aa, Homo Sapiens
DLSVARKSE

SEQ ID NO: 731707 - protein, 9 aa, Homo Sapiens
DWLRALLPN

SEQ ID NO: 731708 - protein, 9 aa, Homo Sapiens
IFDGSYLGY

SEQ ID NO: 731709 - protein, 9 aa, Homo Sapiens
ETWPPPCAS

SEQ ID NO: 731710 - protein, 9 aa, Homo Sapiens
QHVDLSVAR

SEQ ID NO: 731711 - protein, 9 aa, Homo Sapiens
NTNEGVLRV

SEQ ID NO: 731712 - protein, 9 aa, Homo Sapiens
CCGAETWPP

SEQ ID NO: 731713 - protein, 9 aa, Homo Sapiens
LQETEKIIP

SEQ ID NO: 731714 - protein, 9 aa, Homo Sapiens
GKPDDTFSF

SEQ ID NO: 731715 - protein, 9 aa, Homo Sapiens
RKLRRSNRQ

SEQ ID NO: 731716 - protein, 9 aa, Homo Sapiens
VALVVGVQH

SEQ ID NO: 731717 - protein, 9 aa, Homo Sapiens
QDSMTVKDV

SEQ ID NO: 731718 - protein, 9 aa, Homo Sapiens
SASCCWPRG

SEQ ID NO: 731719 - protein, 9 aa, Homo Sapiens
PHGWQRTSR

SEQ ID NO: 731720 - protein, 9 aa, Homo Sapiens
IPNRKLRRS

SEQ ID NO: 731721 - protein, 9 aa, Homo Sapiens
VHLYQHQDP

SEQ ID NO: 731722 - protein, 9 aa, Homo Sapiens
LKLFGPESG

SEQ ID NO: 731723 - protein, 9 aa, Homo Sapiens
VDCSATGHN

SEQ ID NO: 731724 - protein, 9 aa, Homo Sapiens
HEPSLCAHV

SEQ ID NO: 731725 - protein, 9 aa, Homo Sapiens
DPRFQHVLV

SEQ ID NO: 731726 - protein, 9 aa, Homo Sapiens
MLQSQGSQA

SEQ ID NO: 731727 - protein, 9 aa, Homo Sapiens
DGMRTSGSI

SEQ ID NO: 731728 - protein, 9 aa, Homo Sapiens
GSLLDICHD

SEQ ID NO: 731729 - protein, 9 aa, Homo Sapiens
NNQLFFPSY

SEQ ID NO: 731730 - protein, 9 aa, Homo Sapiens
YWSSLWNLV

SEQ ID NO: 731731 - protein, 9 aa, Homo Sapiens
PELRVYPLK

SEQ ID NO: 731732 - protein, 9 aa, Homo Sapiens
EFLVKSKDR

SEQ ID NO: 731733 - protein, 9 aa, Homo Sapiens
GREARQFGH

SEQ ID NO: 731734 - protein, 9 aa, Homo Sapiens
STWMWWSSR

SEQ ID NO: 731735 - protein, 9 aa, Homo Sapiens
MGSLNLFRL

SEQ ID NO: 731736 - protein, 9 aa, Homo Sapiens
LFKKPERKG

SEQ ID NO: 731737 - protein, 9 aa, Homo Sapiens
IIPELNETW

SEQ ID NO: 731738 - protein, 9 aa, Homo Sapiens
ANGYKIFGK

SEQ ID NO: 731739 - protein, 9 aa, Homo Sapiens
GELSVTDAT

SEQ ID NO: 731740 - protein, 9 aa, Homo Sapiens
KGNHFEPVV

SEQ ID NO: 731741 - protein, 9 aa, Homo Sapiens
NVFSTCASH

SEQ ID NO: 731742 - protein, 9 aa, Homo Sapiens
DELPRHYRK

SEQ ID NO: 731743 - protein, 9 aa, Homo Sapiens
LLRRLVPTI

SEQ ID NO: 731744 - protein, 9 aa, Homo Sapiens
CDKHEFQDA

SEQ ID NO: 731745 - protein, 9 aa, Homo Sapiens
RAKGYSLRT

SEQ ID NO: 731746 - protein, 9 aa, Homo Sapiens
QAEEQSSCR

SEQ ID NO: 731747 - protein, 9 aa, Homo Sapiens
SVQHSPYSG

SEQ ID NO: 731748 - protein, 9 aa, Homo Sapiens
CNLLKLPKA

SEQ ID NO: 731749 - protein, 9 aa, Homo Sapiens
NVESELSGS

SEQ ID NO: 731750 - protein, 9 aa, Homo Sapiens
SHLGLASSN

SEQ ID NO: 731751 - protein, 9 aa, Homo Sapiens
TKTTPAGEI

SEQ ID NO: 731752 - protein, 9 aa, Homo Sapiens
LEAVLMQHL

SEQ ID NO: 731753 - protein, 9 aa, Homo Sapiens
WSSLWNLVV

SEQ ID NO: 731754 - protein, 9 aa, Homo Sapiens
PRISGLVFR

SEQ ID NO: 731755 - protein, 9 aa, Homo Sapiens
WWLKLFGPE

SEQ ID NO: 731756 - protein, 9 aa, Homo Sapiens
DLALVTQLA

SEQ ID NO: 731757 - protein, 9 aa, Homo Sapiens
KALSDLRAV

SEQ ID NO: 731758 - protein, 9 aa, Homo Sapiens
RMDYKKRKS

SEQ ID NO: 731759 - protein, 9 aa, Homo Sapiens
PKLPEPQPV

SEQ ID NO: 731760 - protein, 9 aa, Homo Sapiens
HKHRGGSGG

SEQ ID NO: 731761 - protein, 9 aa, Homo Sapiens
ISFGIHFSA

SEQ ID NO: 731762 - protein, 9 aa, Homo Sapiens
VTKYWSSLW

SEQ ID NO: 731763 - protein, 9 aa, Homo Sapiens
EAVLMQHLI

SEQ ID NO: 731764 - protein, 9 aa, Homo Sapiens
KNTVCIWDL

SEQ ID NO: 731765 - protein, 9 aa, Homo Sapiens
LFRLGTWTR

SEQ ID NO: 731766 - protein, 9 aa, Homo Sapiens
SDRKVLTRR

SEQ ID NO: 731767 - protein, 9 aa, Homo Sapiens
RCRPGFMGT

SEQ ID NO: 731768 - protein, 9 aa, Homo Sapiens
PNYNWKSFG

SEQ ID NO: 731769 - protein, 9 aa, Homo Sapiens
STAMTLPVS

SEQ ID NO: 731770 - protein, 9 aa, Homo Sapiens
SLNLFRLGT

SEQ ID NO: 731771 - protein, 9 aa, Homo Sapiens
TASTASNYP

SEQ ID NO: 731772 - protein, 9 aa, Homo Sapiens
SLGRRSHGP

SEQ ID NO: 731773 - protein, 9 aa, Homo Sapiens
EEQSSCRRR

SEQ ID NO: 731774 - protein, 9 aa, Homo Sapiens
GQPGEPGPL

SEQ ID NO: 731775 - protein, 9 aa, Homo Sapiens
LRCVTTEPS

SEQ ID NO: 731776 - protein, 9 aa, Homo Sapiens
LNMKEWQDW

SEQ ID NO: 731777 - protein, 9 aa, Homo Sapiens
SKISFPIGK

SEQ ID NO: 731778 - protein, 9 aa, Homo Sapiens
QIEQQSEQN

SEQ ID NO: 731779 - protein, 9 aa, Homo Sapiens
EQSSCRRRS

SEQ ID NO: 731780 - protein, 9 aa, Homo Sapiens
TILVEPGDT

SEQ ID NO: 731781 - protein, 9 aa, Homo Sapiens
TTDRNAVCV

SEQ ID NO: 731782 - protein, 9 aa, Homo Sapiens
RLERFHENP

SEQ ID NO: 731783 - protein, 9 aa, Homo Sapiens
AGSVSSGEE

SEQ ID NO: 731784 - protein, 9 aa, Homo Sapiens
HGVLDKLRC

SEQ ID NO: 731785 - protein, 9 aa, Homo Sapiens
FINHLSLID

SEQ ID NO: 731786 - protein, 9 aa, Homo Sapiens
TIPLSLVAR

SEQ ID NO: 731787 - protein, 9 aa, Homo Sapiens
PWWLKLFGP

SEQ ID NO: 731788 - protein, 9 aa, Homo Sapiens
RSSWRSASC

SEQ ID NO: 731789 - protein, 9 aa, Homo Sapiens
PPEAGSVSS

SEQ ID NO: 731790 - protein, 9 aa, Homo Sapiens
RPAEEQRLF

SEQ ID NO: 731791 - protein, 9 aa, Homo Sapiens
VEPGDTIAL

SEQ ID NO: 731792 - protein, 9 aa, Homo Sapiens
LGTPPRPGR

SEQ ID NO: 731793 - protein, 9 aa, Homo Sapiens
SFDIFEDEV

SEQ ID NO: 731794 - protein, 9 aa, Homo Sapiens
NKIIDGRQR

SEQ ID NO: 731795 - protein, 9 aa, Homo Sapiens
GVMDNHLVM

SEQ ID NO: 731796 - protein, 9 aa, Homo Sapiens
QFSLVARVC

SEQ ID NO: 731797 - protein, 9 aa, Homo Sapiens
RQRNQLEGV

SEQ ID NO: 731798 - protein, 9 aa, Homo Sapiens
APVICHVPL

SEQ ID NO: 731799 - protein, 9 aa, Homo Sapiens
GQNNVFSTC

SEQ ID NO: 731800 - protein, 9 aa, Homo Sapiens
HGWQRTSRL

SEQ ID NO: 731801 - protein, 9 aa, Homo Sapiens
IFEDEVLIT

SEQ ID NO: 731802 - protein, 9 aa, Homo Sapiens
NNVFSTCAS

SEQ ID NO: 731803 - protein, 9 aa, Homo Sapiens
GEPGPLGPK

SEQ ID NO: 731804 - protein, 9 aa, Homo Sapiens
RVYPLKTLY

SEQ ID NO: 731805 - protein, 9 aa, Homo Sapiens
DGTKNKSLL

SEQ ID NO: 731806 - protein, 9 aa, Homo Sapiens
WLSTARKPE

SEQ ID NO: 731807 - protein, 9 aa, Homo Sapiens
MPRKGTQLS

SEQ ID NO: 731808 - protein, 9 aa, Homo Sapiens
GSGSRRGAL

SEQ ID NO: 731809 - protein, 9 aa, Homo Sapiens
HSAAGSGSR

SEQ ID NO: 731810 - protein, 9 aa, Homo Sapiens
MHEPSLCAH

SEQ ID NO: 731811 - protein, 9 aa, Homo Sapiens
LASSVSDDS

SEQ ID NO: 731812 - protein, 9 aa, Homo Sapiens
CSILPRISG

SEQ ID NO: 731813 - protein, 9 aa, Homo Sapiens
LCGDYDDVQ

SEQ ID NO: 731814 - protein, 9 aa, Homo Sapiens
LRETVSSET

SEQ ID NO: 731815 - protein, 9 aa, Homo Sapiens
CGPTASARA

SEQ ID NO: 731816 - protein, 9 aa, Homo Sapiens
AGPADTGKT

SEQ ID NO: 731817 - protein, 9 aa, Homo Sapiens
ELSGSASMA

SEQ ID NO: 731818 - protein, 9 aa, Homo Sapiens
TLLKDYQDV

SEQ ID NO: 731819 - protein, 9 aa, Homo Sapiens
KVVSGAAAS

SEQ ID NO: 731820 - protein, 9 aa, Homo Sapiens
LFFPSYAHV

SEQ ID NO: 731821 - protein, 9 aa, Homo Sapiens
DSSNYEQEY

SEQ ID NO: 731822 - protein, 9 aa, Homo Sapiens
MKEWQDWLR

SEQ ID NO: 731823 - protein, 9 aa, Homo Sapiens
KNHESNYSL

SEQ ID NO: 731824 - protein, 9 aa, Homo Sapiens
PGPVGGPVS

SEQ ID NO: 731825 - protein, 9 aa, Homo Sapiens
KFAQSISQS

SEQ ID NO: 731826 - protein, 9 aa, Homo Sapiens
KLPEPQPVL

SEQ ID NO: 731827 - protein, 9 aa, Homo Sapiens
NFTLIPNRK

SEQ ID NO: 731828 - protein, 9 aa, Homo Sapiens
QELGTPPRP

SEQ ID NO: 731829 - protein, 9 aa, Homo Sapiens
MTVSLGRRS

SEQ ID NO: 731830 - protein, 9 aa, Homo Sapiens
TCSPSGSSP

SEQ ID NO: 731831 - protein, 9 aa, Homo Sapiens
AALLEESAL

SEQ ID NO: 731832 - protein, 9 aa, Homo Sapiens
SLLRRLVPT

SEQ ID NO: 731833 - protein, 9 aa, Homo Sapiens
SADVHGLES

SEQ ID NO: 731834 - protein, 9 aa, Homo Sapiens
LKAPSKVLE

SEQ ID NO: 731835 - protein, 9 aa, Homo Sapiens
AEMLQSQGS

SEQ ID NO: 731836 - protein, 9 aa, Homo Sapiens
ASCGPTASA

SEQ ID NO: 731837 - protein, 9 aa, Homo Sapiens
QPLDAGVDK

SEQ ID NO: 731838 - protein, 9 aa, Homo Sapiens
SSALLVLLN

SEQ ID NO: 731839 - protein, 9 aa, Homo Sapiens
KQLNLSRSR

SEQ ID NO: 731840 - protein, 9 aa, Homo Sapiens
DAEVTTDED

SEQ ID NO: 731841 - protein, 9 aa, Homo Sapiens
TITQAPPCA

SEQ ID NO: 731842 - protein, 9 aa, Homo Sapiens
VPAPPHQGH

SEQ ID NO: 731843 - protein, 9 aa, Homo Sapiens
GEMQARDEV

SEQ ID NO: 731844 - protein, 9 aa, Homo Sapiens
QPFPSGVCC

SEQ ID NO: 731845 - protein, 9 aa, Homo Sapiens
VQHSPYSGN

SEQ ID NO: 731846 - protein, 9 aa, Homo Sapiens
MLIAVVVSL

SEQ ID NO: 731847 - protein, 9 aa, Homo Sapiens
LTQTVESGT

SEQ ID NO: 731848 - protein, 9 aa, Homo Sapiens
RTYKGEKFP

SEQ ID NO: 731849 - protein, 9 aa, Homo Sapiens
NKSLLTFED

SEQ ID NO: 731850 - protein, 9 aa, Homo Sapiens
IHFSAISVV

SEQ ID NO: 731851 - protein, 9 aa, Homo Sapiens
KVLTRRERR

SEQ ID NO: 731852 - protein, 9 aa, Homo Sapiens
LVTQLAGVH

SEQ ID NO: 731853 - protein, 9 aa, Homo Sapiens
SWRSASCCW

SEQ ID NO: 731854 - protein, 9 aa, Homo Sapiens
RKVLTRRER

SEQ ID NO: 731855 - protein, 9 aa, Homo Sapiens
GKKKNSKRK

SEQ ID NO: 731856 - protein, 9 aa, Homo Sapiens
DCTWTILVE

SEQ ID NO: 731857 - protein, 9 aa, Homo Sapiens
SDNKIIDGR

SEQ ID NO: 731858 - protein, 9 aa, Homo Sapiens
IWRMINRSN

SEQ ID NO: 731859 - protein, 9 aa, Homo Sapiens
PRHYRKHTG

SEQ ID NO: 731860 - protein, 9 aa, Homo Sapiens
TCSTHLLVV

SEQ ID NO: 731861 - protein, 9 aa, Homo Sapiens
NACGCDKHE

SEQ ID NO: 731862 - protein, 9 aa, Homo Sapiens
KKPERKGKE

SEQ ID NO: 731863 - protein, 9 aa, Homo Sapiens
AQDGGSTCS

SEQ ID NO: 731864 - protein, 9 aa, Homo Sapiens
VSDDSLYDD

SEQ ID NO: 731865 - protein, 9 aa, Homo Sapiens
QPGEPGPLG

SEQ ID NO: 731866 - protein, 9 aa, Homo Sapiens
ILQHLIPPA

SEQ ID NO: 731867 - protein, 9 aa, Homo Sapiens
RSMESHQMP

SEQ ID NO: 731868 - protein, 9 aa, Homo Sapiens
QTNSNVESE

SEQ ID NO: 731869 - protein, 9 aa, Homo Sapiens
QAEEREQIK

SEQ ID NO: 731870 - protein, 9 aa, Homo Sapiens
YVMLIAVVV

SEQ ID NO: 731871 - protein, 9 aa, Homo Sapiens
KNVWIINHL

SEQ ID NO: 731872 - protein, 9 aa, Homo Sapiens
LECTLCMRL

SEQ ID NO: 731873 - protein, 9 aa, Homo Sapiens
RGDEHIPGS

SEQ ID NO: 731874 - protein, 9 aa, Homo Sapiens
PEPQPVLVL

SEQ ID NO: 731875 - protein, 9 aa, Homo Sapiens
PCRSSWRKP

SEQ ID NO: 731876 - protein, 9 aa, Homo Sapiens
DYEMFKALN

SEQ ID NO: 731877 - protein, 9 aa, Homo Sapiens
HPQDGVALV

SEQ ID NO: 731878 - protein, 9 aa, Homo Sapiens
PGPLGPKGP

SEQ ID NO: 731879 - protein, 9 aa, Homo Sapiens
FSCKTYQEF

SEQ ID NO: 731880 - protein, 9 aa, Homo Sapiens
AKQLQNESD

SEQ ID NO: 731881 - protein, 9 aa, Homo Sapiens
WLSGLRKEE

SEQ ID NO: 731882 - protein, 9 aa, Homo Sapiens
LEESALLAE

SEQ ID NO: 731883 - protein, 9 aa, Homo Sapiens
NIFSADVHG

SEQ ID NO: 731884 - protein, 9 aa, Homo Sapiens
LELCGDYDD

SEQ ID NO: 731885 - protein, 9 aa, Homo Sapiens
LCRDAAMHA

SEQ ID NO: 731886 - protein, 9 aa, Homo Sapiens
KTLTKTTPA

SEQ ID NO: 731887 - protein, 9 aa, Homo Sapiens
KSKDRDLTA

SEQ ID NO: 731888 - protein, 9 aa, Homo Sapiens
PRLGELSVT

SEQ ID NO: 731889 - protein, 9 aa, Homo Sapiens
KIIPELNET

SEQ ID NO: 731890 - protein, 9 aa, Homo Sapiens
EIFGRTKQL

SEQ ID NO: 731891 - protein, 9 aa, Homo Sapiens
MTGKKKNSK

SEQ ID NO: 731892 - protein, 9 aa, Homo Sapiens
ASTLTAHKK

SEQ ID NO: 731893 - protein, 9 aa, Homo Sapiens
FAQSISQSL

SEQ ID NO: 731894 - protein, 9 aa, Homo Sapiens
RRSHGPHGW

SEQ ID NO: 731895 - protein, 9 aa, Homo Sapiens
DGVALVVGV

SEQ ID NO: 731896 - protein, 9 aa, Homo Sapiens
IINHLQEAR

SEQ ID NO: 731897 - protein, 9 aa, Homo Sapiens
SLVARVCKR

SEQ ID NO: 731898 - protein, 9 aa, Homo Sapiens
KNATNEQDI

SEQ ID NO: 731899 - protein, 9 aa, Homo Sapiens
DVEREEQEA

SEQ ID NO: 731900 - protein, 9 aa, Homo Sapiens
VNQRLKDEN

SEQ ID NO: 731901 - protein, 9 aa, Homo Sapiens
KEIKQVYRQ

SEQ ID NO: 731902 - protein, 9 aa, Homo Sapiens
QLPKLPEPQ

SEQ ID NO: 731903 - protein, 9 aa, Homo Sapiens
VLPSLTKKS

SEQ ID NO: 731904 - protein, 9 aa, Homo Sapiens
AVNQRLKDE

SEQ ID NO: 731905 - protein, 9 aa, Homo Sapiens
QNNVFSTCA

SEQ ID NO: 731906 - protein, 9 aa, Homo Sapiens
PFPSGVCCL

SEQ ID NO: 731907 - protein, 9 aa, Homo Sapiens
RYSCFSPSP

SEQ ID NO: 731908 - protein, 9 aa, Homo Sapiens
THQFAFPTG

SEQ ID NO: 731909 - protein, 9 aa, Homo Sapiens
FCQGQNNVF

SEQ ID NO: 731910 - protein, 9 aa, Homo Sapiens
RKNVWIINH

SEQ ID NO: 731911 - protein, 9 aa, Homo Sapiens
NVDYEMFKA

SEQ ID NO: 731912 - protein, 9 aa, Homo Sapiens
PQFFPSGPP

SEQ ID NO: 731913 - protein, 9 aa, Homo Sapiens
ESNDLNGLY

SEQ ID NO: 731914 - protein, 9 aa, Homo Sapiens
WKIVRSNGV

SEQ ID NO: 731915 - protein, 9 aa, Homo Sapiens
GCPASTPAQ

SEQ ID NO: 731916 - protein, 9 aa, Homo Sapiens
YDSFKFWRA

SEQ ID NO: 731917 - protein, 9 aa, Homo Sapiens
GQGCPASTP

SEQ ID NO: 731918 - protein, 9 aa, Homo Sapiens
SGGSRRGCL

SEQ ID NO: 731919 - protein, 9 aa, Homo Sapiens
LSRPQQSSS

SEQ ID NO: 731920 - protein, 9 aa, Homo Sapiens
ESRLVQTLC

SEQ ID NO: 731921 - protein, 9 aa, Homo Sapiens
TVHLYQHQD

SEQ ID NO: 731922 - protein, 9 aa, Homo Sapiens
GPHGWQRTS

SEQ ID NO: 731923 - protein, 9 aa, Homo Sapiens
GLRKEEKPP

SEQ ID NO: 731924 - protein, 9 aa, Homo Sapiens
LSSRVILTV

SEQ ID NO: 731925 - protein, 9 aa, Homo Sapiens
GRRHISCSG

SEQ ID NO: 731926 - protein, 9 aa, Homo Sapiens
QLEGVKQQL

SEQ ID NO: 731927 - protein, 9 aa, Homo Sapiens
TGRERMDYK

SEQ ID NO: 731928 - protein, 9 aa, Homo Sapiens
CSQLPSVQH

SEQ ID NO: 731929 - protein, 9 aa, Homo Sapiens
DIGPRSATI

SEQ ID NO: 731930 - protein, 9 aa, Homo Sapiens
IERYSCFSP

SEQ ID NO: 731931 - protein, 9 aa, Homo Sapiens
TAAEMLQSQ

SEQ ID NO: 731932 - protein, 9 aa, Homo Sapiens
GRRSHGPHG

SEQ ID NO: 731933 - protein, 9 aa, Homo Sapiens
EWLSTARKP

SEQ ID NO: 731934 - protein, 9 aa, Homo Sapiens
SRLITGRGT

SEQ ID NO: 731935 - protein, 9 aa, Homo Sapiens
ELGTPPRPG

SEQ ID NO: 731936 - protein, 9 aa, Homo Sapiens
RRLERLMGQ

SEQ ID NO: 731937 - protein, 9 aa, Homo Sapiens
CGCDKHEFQ

SEQ ID NO: 731938 - protein, 9 aa, Homo Sapiens
AALSFIKCG

SEQ ID NO: 731939 - protein, 9 aa, Homo Sapiens
ASDFLSPQA

SEQ ID NO: 731940 - protein, 9 aa, Homo Sapiens
SSVSDDSLY

SEQ ID NO: 731941 - protein, 9 aa, Homo Sapiens
LAPPQDLIR

SEQ ID NO: 731942 - protein, 9 aa, Homo Sapiens
EQEAQAGKK

SEQ ID NO: 731943 - protein, 9 aa, Homo Sapiens
RLGVSDPIM

SEQ ID NO: 731944 - protein, 9 aa, Homo Sapiens
RERMDYKKR

SEQ ID NO: 731945 - protein, 9 aa, Homo Sapiens
EKLQAEEQS

SEQ ID NO: 731946 - protein, 9 aa, Homo Sapiens
LEEGKTSGV

SEQ ID NO: 731947 - protein, 9 aa, Homo Sapiens
MPKPERHAG

SEQ ID NO: 731948 - protein, 9 aa, Homo Sapiens
CFAFLPCRP

SEQ ID NO: 731949 - protein, 9 aa, Homo Sapiens
DAKAVYDFT

SEQ ID NO: 731950 - protein, 9 aa, Homo Sapiens
CHGQLIVND

SEQ ID NO: 731951 - protein, 9 aa, Homo Sapiens
LDGTTPVWY

SEQ ID NO: 731952 - protein, 9 aa, Homo Sapiens
ERDSMYSQI

SEQ ID NO: 731953 - protein, 9 aa, Homo Sapiens
SDFLSPQAA

SEQ ID NO: 731954 - protein, 9 aa, Homo Sapiens
LNGLYDSFK

SEQ ID NO: 731955 - protein, 9 aa, Homo Sapiens
FGRTKQLNL

SEQ ID NO: 731956 - protein, 9 aa, Homo Sapiens
FNFSCKTYQ

SEQ ID NO: 731957 - protein, 9 aa, Homo Sapiens
FDASDLECT

SEQ ID NO: 731958 - protein, 9 aa, Homo Sapiens
KEAVREFAK

SEQ ID NO: 731959 - protein, 9 aa, Homo Sapiens
QGCPASTPA

SEQ ID NO: 731960 - protein, 9 aa, Homo Sapiens
VLITQGGSG

SEQ ID NO: 731961 - protein, 9 aa, Homo Sapiens
SQESPSQES

SEQ ID NO: 731962 - protein, 9 aa, Homo Sapiens
LRGSQKARP

SEQ ID NO: 731963 - protein, 9 aa, Homo Sapiens
EEPSTASTA

SEQ ID NO: 731964 - protein, 9 aa, Homo Sapiens
VSLAFLLMF

SEQ ID NO: 731965 - protein, 9 aa, Homo Sapiens
PVWYGLRLN

SEQ ID NO: 731966 - protein, 9 aa, Homo Sapiens
NYSLHHVPN

SEQ ID NO: 731967 - protein, 9 aa, Homo Sapiens
YLGSLPEGS

SEQ ID NO: 731968 - protein, 9 aa, Homo Sapiens
KLQLSDNKI

SEQ ID NO: 731969 - protein, 9 aa, Homo Sapiens
PGVCHCFAF

SEQ ID NO: 731970 - protein, 9 aa, Homo Sapiens
TYEDPKEAV

SEQ ID NO: 731971 - protein, 9 aa, Homo Sapiens
QTPGQGCPA

SEQ ID NO: 731972 - protein, 9 aa, Homo Sapiens
THFCQGQNN

SEQ ID NO: 731973 - protein, 9 aa, Homo Sapiens
TPVWYGLRL

SEQ ID NO: 731974 - protein, 9 aa, Homo Sapiens
RTLQLSVRH

SEQ ID NO: 731975 - protein, 9 aa, Homo Sapiens
YIIKGNHFE

SEQ ID NO: 731976 - protein, 9 aa, Homo Sapiens
TLSAKLPWK

SEQ ID NO: 731977 - protein, 9 aa, Homo Sapiens
PPRPGRQVE

SEQ ID NO: 731978 - protein, 9 aa, Homo Sapiens
PSCEGKFSW

SEQ ID NO: 731979 - protein, 9 aa, Homo Sapiens
LCGAQDRIH

SEQ ID NO: 731980 - protein, 9 aa, Homo Sapiens
PVRPNSSLL

SEQ ID NO: 731981 - protein, 9 aa, Homo Sapiens
TEEPSTAST

SEQ ID NO: 731982 - protein, 9 aa, Homo Sapiens
KALADTPSM

SEQ ID NO: 731983 - protein, 9 aa, Homo Sapiens
LDAGVDKIK

SEQ ID NO: 731984 - protein, 9 aa, Homo Sapiens
RDAAMHALL

SEQ ID NO: 731985 - protein, 9 aa, Homo Sapiens
ITQAPPCAV

SEQ ID NO: 731986 - protein, 9 aa, Homo Sapiens
FKKPERKGK

SEQ ID NO: 731987 - protein, 9 aa, Homo Sapiens
VSLGRRSHG

SEQ ID NO: 731988 - protein, 9 aa, Homo Sapiens
HQMPMSLPS

SEQ ID NO: 731989 - protein, 9 aa, Homo Sapiens
RTWSCTPMP

SEQ ID NO: 731990 - protein, 9 aa, Homo Sapiens
DPAIQRVQA

SEQ ID NO: 731991 - protein, 9 aa, Homo Sapiens
TPQFFPSGP

SEQ ID NO: 731992 - protein, 9 aa, Homo Sapiens
TRTLSPHMT

SEQ ID NO: 731993 - protein, 9 aa, Homo Sapiens
PKPERHAGS

SEQ ID NO: 731994 - protein, 9 aa, Homo Sapiens
KPCCGAETW

SEQ ID NO: 731995 - protein, 9 aa, Homo Sapiens
DIANRFKEF

SEQ ID NO: 731996 - protein, 9 aa, Homo Sapiens
GLEWKSSAL

SEQ ID NO: 731997 - protein, 9 aa, Homo Sapiens
GYKIFGKEA

SEQ ID NO: 731998 - protein, 9 aa, Homo Sapiens
IVPEERLQD

SEQ ID NO: 731999 - protein, 9 aa, Homo Sapiens
KKSPSHKES

SEQ ID NO: 732000 - protein, 9 aa, Homo Sapiens
AEDVEREEQ

SEQ ID NO: 732001 - protein, 9 aa, Homo Sapiens
EKNVDYEMF

SEQ ID NO: 732002 - protein, 9 aa, Homo Sapiens
ASHLGLASS

SEQ ID NO: 732003 - protein, 9 aa, Homo Sapiens
AETWPPPCA

SEQ ID NO: 732004 - protein, 9 aa, Homo Sapiens
QHLIPPALN

SEQ ID NO: 732005 - protein, 9 aa, Homo Sapiens
PTHIQEDPN

SEQ ID NO: 732006 - protein, 9 aa, Homo Sapiens
DLRAVNQRL

SEQ ID NO: 732007 - protein, 9 aa, Homo Sapiens
VLDKLRCVT

SEQ ID NO: 732008 - protein, 9 aa, Homo Sapiens
CKRCKVMLR

SEQ ID NO: 732009 - protein, 9 aa, Homo Sapiens
LSAKLPWKK

SEQ ID NO: 732010 - protein, 9 aa, Homo Sapiens
ACGCDKHEF

SEQ ID NO: 732011 - protein, 9 aa, Homo Sapiens
KTKEIKQVY

SEQ ID NO: 732012 - protein, 9 aa, Homo Sapiens
DRIHTHGVF

SEQ ID NO: 732013 - protein, 9 aa, Homo Sapiens
HEFQDAWKL

SEQ ID NO: 732014 - protein, 9 aa, Homo Sapiens
HNLMTFQVK

SEQ ID NO: 732015 - protein, 9 aa, Homo Sapiens
SSNLDEDII

SEQ ID NO: 732016 - protein, 9 aa, Homo Sapiens
IMGSLNLFR

SEQ ID NO: 732017 - protein, 9 aa, Homo Sapiens
GSISAASTS

SEQ ID NO: 732018 - protein, 9 aa, Homo Sapiens
SPQAASPAP

SEQ ID NO: 732019 - protein, 9 aa, Homo Sapiens
FMGTYCELH

SEQ ID NO: 732020 - protein, 9 aa, Homo Sapiens
IFGRTKQLN

SEQ ID NO: 732021 - protein, 9 aa, Homo Sapiens
TWPPPCASC

SEQ ID NO: 732022 - protein, 9 aa, Homo Sapiens
AGREARQFG

SEQ ID NO: 732023 - protein, 9 aa, Homo Sapiens
CRRRSSWRS

SEQ ID NO: 732024 - protein, 9 aa, Homo Sapiens
VGVQHVDLS

SEQ ID NO: 732025 - protein, 9 aa, Homo Sapiens
QKPYECNQC

SEQ ID NO: 732026 - protein, 9 aa, Homo Sapiens
FRLCNLLKL

SEQ ID NO: 732027 - protein, 9 aa, Homo Sapiens
PQDGVALVV

SEQ ID NO: 732028 - protein, 9 aa, Homo Sapiens
SCGPTASAR

SEQ ID NO: 732029 - protein, 9 aa, Homo Sapiens
GSPDHKHRG

SEQ ID NO: 732030 - protein, 9 aa, Homo Sapiens
LCNLLKLPK

SEQ ID NO: 732031 - protein, 9 aa, Homo Sapiens
MTFQVKFFY

SEQ ID NO: 732032 - protein, 9 aa, Homo Sapiens
LMQHLIARE

SEQ ID NO: 732033 - protein, 9 aa, Homo Sapiens
TGKKKNSKR

SEQ ID NO: 732034 - protein, 9 aa, Homo Sapiens
LILLTIPLS

SEQ ID NO: 732035 - protein, 9 aa, Homo Sapiens
RAWSCSGGS

SEQ ID NO: 732036 - protein, 9 aa, Homo Sapiens
GSSPSCSAE

SEQ ID NO: 732037 - protein, 9 aa, Homo Sapiens
NTVCIWDLE

SEQ ID NO: 732038 - protein, 9 aa, Homo Sapiens
KYPPPFPVR

SEQ ID NO: 732039 - protein, 9 aa, Homo Sapiens
AEVTTDEDV

SEQ ID NO: 732040 - protein, 9 aa, Homo Sapiens
VRHYDRFGR

SEQ ID NO: 732041 - protein, 9 aa, Homo Sapiens
FARSDELPR

SEQ ID NO: 732042 - protein, 9 aa, Homo Sapiens
CNELRVAPE

SEQ ID NO: 732043 - protein, 9 aa, Homo Sapiens
KTTPAGEIV

SEQ ID NO: 732044 - protein, 9 aa, Homo Sapiens
DGFAGSLDG

SEQ ID NO: 732045 - protein, 9 aa, Homo Sapiens
LPKLPEPQP

SEQ ID NO: 732046 - protein, 9 aa, Homo Sapiens
DYPLEAVLM

SEQ ID NO: 732047 - protein, 9 aa, Homo Sapiens
QPVLVLKAP

SEQ ID NO: 732048 - protein, 9 aa, Homo Sapiens
MQARDEVIG

SEQ ID NO: 732049 - protein, 9 aa, Homo Sapiens
AIQRVQAEE

SEQ ID NO: 732050 - protein, 9 aa, Homo Sapiens
SKDRDLTAL

SEQ ID NO: 732051 - protein, 9 aa, Homo Sapiens
PMPCRSSWR

SEQ ID NO: 732052 - protein, 9 aa, Homo Sapiens
SQAGREARQ

SEQ ID NO: 732053 - protein, 9 aa, Homo Sapiens
KSLLTFEDV

SEQ ID NO: 732054 - protein, 9 aa, Homo Sapiens
LVDAEVTTD

SEQ ID NO: 732055 - protein, 9 aa, Homo Sapiens
SSPSCSAEP

SEQ ID NO: 732056 - protein, 9 aa, Homo Sapiens
PPPPLPKNV

SEQ ID NO: 732057 - protein, 9 aa, Homo Sapiens
ILNYLCHGQ

SEQ ID NO: 732058 - protein, 9 aa, Homo Sapiens
TLSPHMTVS

SEQ ID NO: 732059 - protein, 9 aa, Homo Sapiens
DLIRVEGNL

SEQ ID NO: 732060 - protein, 9 aa, Homo Sapiens
KNSKRKRSK

SEQ ID NO: 732061 - protein, 9 aa, Homo Sapiens
MYFFINHLS

SEQ ID NO: 732062 - protein, 9 aa, Homo Sapiens
ESELSGSAS

SEQ ID NO: 732063 - protein, 9 aa, Homo Sapiens
DAKQLQNES

SEQ ID NO: 732064 - protein, 9 aa, Homo Sapiens
QRKNVWIIN

SEQ ID NO: 732065 - protein, 9 aa, Homo Sapiens
YSFYSRTQS

SEQ ID NO: 732066 - protein, 9 aa, Homo Sapiens
TFREDLALV

SEQ ID NO: 732067 - protein, 9 aa, Homo Sapiens
AEAALSFIK

SEQ ID NO: 732068 - protein, 9 aa, Homo Sapiens
QFAFPTGIS

SEQ ID NO: 732069 - protein, 9 aa, Homo Sapiens
DAPRAKGYS

SEQ ID NO: 732070 - protein, 9 aa, Homo Sapiens
PLEAVLMQH

SEQ ID NO: 732071 - protein, 9 aa, Homo Sapiens
SQSLDALHK

SEQ ID NO: 732072 - protein, 9 aa, Homo Sapiens
PADTGKTET

SEQ ID NO: 732073 - protein, 9 aa, Homo Sapiens
GKRLLGSKR

SEQ ID NO: 732074 - protein, 9 aa, Homo Sapiens
STLKKHEIV

SEQ ID NO: 732075 - protein, 9 aa, Homo Sapiens
PNTNEGVLR

SEQ ID NO: 732076 - protein, 9 aa, Homo Sapiens
SHSDPRFQH

SEQ ID NO: 732077 - protein, 9 aa, Homo Sapiens
FTNNQLFFP

SEQ ID NO: 732078 - protein, 9 aa, Homo Sapiens
ATNEQDIAN

SEQ ID NO: 732079 - protein, 9 aa, Homo Sapiens
EIKQVYRQD

SEQ ID NO: 732080 - protein, 9 aa, Homo Sapiens
TLIPNRKLR

SEQ ID NO: 732081 - protein, 9 aa, Homo Sapiens
PEEWLSTAR

SEQ ID NO: 732082 - protein, 9 aa, Homo Sapiens
SQSLNIGQI

SEQ ID NO: 732083 - protein, 9 aa, Homo Sapiens
LADTPSMKV

SEQ ID NO: 732084 - protein, 9 aa, Homo Sapiens
LQSFQQRLE

SEQ ID NO: 732085 - protein, 9 aa, Homo Sapiens
ESHQMPMSL

SEQ ID NO: 732086 - protein, 9 aa, Homo Sapiens
PERKGKESS

SEQ ID NO: 732087 - protein, 9 aa, Homo Sapiens
TPDGMRTSG

SEQ ID NO: 732088 - protein, 9 aa, Homo Sapiens
LSLLSDRKV

SEQ ID NO: 732089 - protein, 9 aa, Homo Sapiens
GAPAGPADT

SEQ ID NO: 732090 - protein, 9 aa, Homo Sapiens
PPCASCGPT

SEQ ID NO: 732091 - protein, 9 aa, Homo Sapiens
FASDFLSPQ

SEQ ID NO: 732092 - protein, 9 aa, Homo Sapiens
VKRGDEHIP

SEQ ID NO: 732093 - protein, 9 aa, Homo Sapiens
NLTEAWLQE

SEQ ID NO: 732094 - protein, 9 aa, Homo Sapiens
QHSPYSGNI

SEQ ID NO: 732095 - protein, 9 aa, Homo Sapiens
FIKCGNAME

SEQ ID NO: 732096 - protein, 9 aa, Homo Sapiens
EWQDWLRAL

SEQ ID NO: 732097 - protein, 9 aa, Homo Sapiens
VMLIAVVVS

SEQ ID NO: 732098 - protein, 9 aa, Homo Sapiens
PKEAVREFA

SEQ ID NO: 732099 - protein, 9 aa, Homo Sapiens
TDNLTEAWL

SEQ ID NO: 732100 - protein, 9 aa, Homo Sapiens
GGPVSSGAK

SEQ ID NO: 732101 - protein, 9 aa, Homo Sapiens
LRVYPLKTL

SEQ ID NO: 732102 - protein, 9 aa, Homo Sapiens
SFIKCGNAM

SEQ ID NO: 732103 - protein, 9 aa, Homo Sapiens
SFQQRLERF

SEQ ID NO: 732104 - protein, 9 aa, Homo Sapiens
LSTARKPEA

SEQ ID NO: 732105 - protein, 9 aa, Homo Sapiens
GSRRGALRE

SEQ ID NO: 732106 - protein, 9 aa, Homo Sapiens
AAGSVHSPF

SEQ ID NO: 732107 - protein, 9 aa, Homo Sapiens
VPQLSSRVI

SEQ ID NO: 732108 - protein, 9 aa, Homo Sapiens
HISCSGCAL

SEQ ID NO: 732109 - protein, 9 aa, Homo Sapiens
ATPDGMRTS

SEQ ID NO: 732110 - protein, 9 aa, Homo Sapiens
SRQRTWSCT

SEQ ID NO: 732111 - protein, 9 aa, Homo Sapiens
TVESGTERY

SEQ ID NO: 732112 - protein, 9 aa, Homo Sapiens
INNTVITPC

SEQ ID NO: 732113 - protein, 9 aa, Homo Sapiens
EKTHTGQKP

SEQ ID NO: 732114 - protein, 9 aa, Homo Sapiens
AQSISQSLD

SEQ ID NO: 732115 - protein, 9 aa, Homo Sapiens
FNEAKYIPF

SEQ ID NO: 732116 - protein, 9 aa, Homo Sapiens
PQELKPERA

SEQ ID NO: 732117 - protein, 9 aa, Homo Sapiens
EDPKEAVRE

SEQ ID NO: 732118 - protein, 9 aa, Homo Sapiens
GMRTSGSIQ

SEQ ID NO: 732119 - protein, 9 aa, Homo Sapiens
CGAETWPPP

SEQ ID NO: 732120 - protein, 9 aa, Homo Sapiens
EEGKTSGVS

SEQ ID NO: 732121 - protein, 9 aa, Homo Sapiens
LCAHVECPP

SEQ ID NO: 732122 - protein, 9 aa, Homo Sapiens
ARAWSCSGG

SEQ ID NO: 732123 - protein, 9 aa, Homo Sapiens
GEYTLVVKR

SEQ ID NO: 732124 - protein, 9 aa, Homo Sapiens
PGGPAVREA

SEQ ID NO: 732125 - protein, 9 aa, Homo Sapiens
HRSMESHQM

SEQ ID NO: 732126 - protein, 9 aa, Homo Sapiens
IEIFGRTKQ

SEQ ID NO: 732127 - protein, 9 aa, Homo Sapiens
PLSLVARKD

SEQ ID NO: 732128 - protein, 9 aa, Homo Sapiens
PGFMGTYCE

SEQ ID NO: 732129 - protein, 9 aa, Homo Sapiens
EDRYVDCSA

SEQ ID NO: 732130 - protein, 9 aa, Homo Sapiens
VICHVPLLG

SEQ ID NO: 732131 - protein, 9 aa, Homo Sapiens
VSDPTAWAT

SEQ ID NO: 732132 - protein, 9 aa, Homo Sapiens
PPFPVRPNS

SEQ ID NO: 732133 - protein, 9 aa, Homo Sapiens
RLVQTLCVL

SEQ ID NO: 732134 - protein, 9 aa, Homo Sapiens
KSPSHKESP

SEQ ID NO: 732135 - protein, 9 aa, Homo Sapiens
PEAGSVSSG

SEQ ID NO: 732136 - protein, 9 aa, Homo Sapiens
VYDFTDTVI

SEQ ID NO: 732137 - protein, 9 aa, Homo Sapiens
VDAEVTTDE

SEQ ID NO: 732138 - protein, 9 aa, Homo Sapiens
LGELSVTDA

SEQ ID NO: 732139 - protein, 9 aa, Homo Sapiens
TLQLSVRHY

SEQ ID NO: 732140 - protein, 9 aa, Homo Sapiens
NSDDEWPVA

SEQ ID NO: 732141 - protein, 9 aa, Homo Sapiens
IDPAIQRVQ

SEQ ID NO: 732142 - protein, 9 aa, Homo Sapiens
AAEMLQSQG

SEQ ID NO: 732143 - protein, 9 aa, Homo Sapiens
SPFTSMATS

SEQ ID NO: 732144 - protein, 9 aa, Homo Sapiens
GRVQFSLVA

SEQ ID NO: 732145 - protein, 9 aa, Homo Sapiens
ETEKIIPEL

SEQ ID NO: 732146 - protein, 9 aa, Homo Sapiens
LGVSDPIMG

SEQ ID NO: 732147 - protein, 9 aa, Homo Sapiens
RALCCTVHL

SEQ ID NO: 732148 - protein, 9 aa, Homo Sapiens
TPQTPGQGC

SEQ ID NO: 732149 - protein, 9 aa, Homo Sapiens
SNYEQEYKI

SEQ ID NO: 732150 - protein, 9 aa, Homo Sapiens
GTTPVWYGL

SEQ ID NO: 732151 - protein, 9 aa, Homo Sapiens
TQAPPCAVA

SEQ ID NO: 732152 - protein, 9 aa, Homo Sapiens
GSLNLFRLG

SEQ ID NO: 732153 - protein, 9 aa, Homo Sapiens
GLHRSMESH

SEQ ID NO: 732154 - protein, 9 aa, Homo Sapiens
RETVSSETT

SEQ ID NO: 732155 - protein, 9 aa, Homo Sapiens
FNACGCDKH

SEQ ID NO: 732156 - protein, 9 aa, Homo Sapiens
CCQLPKLPE

SEQ ID NO: 732157 - protein, 9 aa, Homo Sapiens
TCSQLPSVQ

SEQ ID NO: 732158 - protein, 9 aa, Homo Sapiens
LKTLYVPNR

SEQ ID NO: 732159 - protein, 9 aa, Homo Sapiens
QLQNESDNL

SEQ ID NO: 732160 - protein, 9 aa, Homo Sapiens
DCSATGHNL

SEQ ID NO: 732161 - protein, 9 aa, Homo Sapiens
LPKNVARML

SEQ ID NO: 732162 - protein, 9 aa, Homo Sapiens
THIQEDPNG

SEQ ID NO: 732163 - protein, 9 aa, Homo Sapiens
MNDCYSLLR

SEQ ID NO: 732164 - protein, 9 aa, Homo Sapiens
LKPGTLCTV

SEQ ID NO: 732165 - protein, 9 aa, Homo Sapiens
VQAEEREQI

SEQ ID NO: 732166 - protein, 9 aa, Homo Sapiens
LVKSKDRDL

SEQ ID NO: 732167 - protein, 9 aa, Homo Sapiens
SSTLKKHEI

SEQ ID NO: 732168 - protein, 9 aa, Homo Sapiens
GISLLTQTV

SEQ ID NO: 732169 - protein, 9 aa, Homo Sapiens
GSGVQAYSH

SEQ ID NO: 732170 - protein, 9 aa, Homo Sapiens
SQKIGFRLC

SEQ ID NO: 732171 - protein, 9 aa, Homo Sapiens
RTSGSIQQM

SEQ ID NO: 732172 - protein, 9 aa, Homo Sapiens
LEWKSSALL

SEQ ID NO: 732173 - protein, 9 aa, Homo Sapiens
NGVQTMVVL

SEQ ID NO: 732174 - protein, 9 aa, Homo Sapiens
RTTDNLTEA

SEQ ID NO: 732175 - protein, 9 aa, Homo Sapiens
GSQKARPGG

SEQ ID NO: 732176 - protein, 9 aa, Homo Sapiens
FTSMATSSQ

SEQ ID NO: 732177 - protein, 9 aa, Homo Sapiens
CCWPRGTCS

SEQ ID NO: 732178 - protein, 9 aa, Homo Sapiens
SGVQAYSHY

SEQ ID NO: 732179 - protein, 9 aa, Homo Sapiens
LYEVQILED

SEQ ID NO: 732180 - protein, 9 aa, Homo Sapiens
QDWLRALLP

SEQ ID NO: 732181 - protein, 9 aa, Homo Sapiens
GPPPHSPLS

SEQ ID NO: 732182 - protein, 9 aa, Homo Sapiens
LGPKGPTGD

SEQ ID NO: 732183 - protein, 9 aa, Homo Sapiens
LSTARRREE

SEQ ID NO: 732184 - protein, 9 aa, Homo Sapiens
SLNIGQIST

SEQ ID NO: 732185 - protein, 9 aa, Homo Sapiens
GAGIPRHAP

SEQ ID NO: 732186 - protein, 9 aa, Homo Sapiens
WPVASDNDD

SEQ ID NO: 732187 - protein, 9 aa, Homo Sapiens
NTEEPSTAS

SEQ ID NO: 732188 - protein, 9 aa, Homo Sapiens
VYSFYSRTQ

SEQ ID NO: 732189 - protein, 9 aa, Homo Sapiens
ERYSCFSPS

SEQ ID NO: 732190 - protein, 9 aa, Homo Sapiens
SSPVQLNSG

SEQ ID NO: 732191 - protein, 9 aa, Homo Sapiens
VCCQLPKLP

SEQ ID NO: 732192 - protein, 9 aa, Homo Sapiens
RRGCLPSCS

SEQ ID NO: 732193 - protein, 9 aa, Homo Sapiens
IIKGNHFEP

SEQ ID NO: 732194 - protein, 9 aa, Homo Sapiens
CRSSWRKPC

SEQ ID NO: 732195 - protein, 9 aa, Homo Sapiens
KPKELFKKP

SEQ ID NO: 732196 - protein, 9 aa, Homo Sapiens
PTTHQFAFP

SEQ ID NO: 732197 - protein, 9 aa, Homo Sapiens
DRYVDCSAT

SEQ ID NO: 732198 - protein, 9 aa, Homo Sapiens
EGVKQQLYH

SEQ ID NO: 732199 - protein, 9 aa, Homo Sapiens
MDNHLVMHQ

SEQ ID NO: 732200 - protein, 9 aa, Homo Sapiens
LQLSVRHYD

SEQ ID NO: 732201 - protein, 9 aa, Homo Sapiens
DKLRCVTTE

SEQ ID NO: 732202 - protein, 9 aa, Homo Sapiens
TQLSTARRR

SEQ ID NO: 732203 - protein, 9 aa, Homo Sapiens
AVRETHKIV

SEQ ID NO: 732204 - protein, 9 aa, Homo Sapiens
KLQAEEQSS

SEQ ID NO: 732205 - protein, 9 aa, Homo Sapiens
GVSDPIMGS

SEQ ID NO: 732206 - protein, 9 aa, Homo Sapiens
TEKIIPELN

SEQ ID NO: 732207 - protein, 9 aa, Homo Sapiens
AFPTGISMT

SEQ ID NO: 732208 - protein, 9 aa, Homo Sapiens
SVHSPFTSM

SEQ ID NO: 732209 - protein, 9 aa, Homo Sapiens
TSGSIQQME

SEQ ID NO: 732210 - protein, 9 aa, Homo Sapiens
PQTPGQGCP

SEQ ID NO: 732211 - protein, 9 aa, Homo Sapiens
YSLLRRLVP

SEQ ID NO: 732212 - protein, 9 aa, Homo Sapiens
GTKNKSLLT

SEQ ID NO: 732213 - protein, 9 aa, Homo Sapiens
SQPFPSGVC

SEQ ID NO: 732214 - protein, 9 aa, Homo Sapiens
YKIFGKEAP

SEQ ID NO: 732215 - protein, 9 aa, Homo Sapiens
AGEIVAFDY

SEQ ID NO: 732216 - protein, 9 aa, Homo Sapiens
KQLQNESDN

SEQ ID NO: 732217 - protein, 9 aa, Homo Sapiens
DGISLLTQT

SEQ ID NO: 732218 - protein, 9 aa, Homo Sapiens
SACLLASSV

SEQ ID NO: 732219 - protein, 9 aa, Homo Sapiens
LQHLIPPAL

SEQ ID NO: 732220 - protein, 9 aa, Homo Sapiens
QQPWWLKLF

SEQ ID NO: 732221 - protein, 9 aa, Homo Sapiens
SRRGCLPSC

SEQ ID NO: 732222 - protein, 9 aa, Homo Sapiens
VLRVVKPLN

SEQ ID NO: 732223 - protein, 9 aa, Homo Sapiens
EVLCILGSG

SEQ ID NO: 732224 - protein, 9 aa, Homo Sapiens
PFTMYTTCI

SEQ ID NO: 732225 - protein, 9 aa, Homo Sapiens
RNAVCVNCI

SEQ ID NO: 732226 - protein, 9 aa, Homo Sapiens
LSITVTYDL

SEQ ID NO: 732227 - protein, 9 aa, Homo Sapiens
SVRHYDRFG

SEQ ID NO: 732228 - protein, 9 aa, Homo Sapiens
LTKTTPAGE

SEQ ID NO: 732229 - protein, 9 aa, Homo Sapiens
QAPALSPAL

SEQ ID NO: 732230 - protein, 9 aa, Homo Sapiens
PDDTFSFDP

SEQ ID NO: 732231 - protein, 9 aa, Homo Sapiens
EYKIMFVVN

SEQ ID NO: 732232 - protein, 9 aa, Homo Sapiens
RQAALLEES

SEQ ID NO: 732233 - protein, 9 aa, Homo Sapiens
RKNHESNYS

SEQ ID NO: 732234 - protein, 9 aa, Homo Sapiens
QLSISLSDM

SEQ ID NO: 732235 - protein, 9 aa, Homo Sapiens
GEPTHIQED

SEQ ID NO: 732236 - protein, 9 aa, Homo Sapiens
VQWRTYKGE

SEQ ID NO: 732237 - protein, 9 aa, Homo Sapiens
NEQDIANRF

SEQ ID NO: 732238 - protein, 9 aa, Homo Sapiens
PVFGDKEPT

SEQ ID NO: 732239 - protein, 9 aa, Homo Sapiens
RKTAAEMLQ

SEQ ID NO: 732240 - protein, 9 aa, Homo Sapiens
ADLTALCRD

SEQ ID NO: 732241 - protein, 9 aa, Homo Sapiens
PHNLMTFQV

SEQ ID NO: 732242 - protein, 9 aa, Homo Sapiens
TPAGEIVAF

SEQ ID NO: 732243 - protein, 9 aa, Homo Sapiens
RTLSPHMTV

SEQ ID NO: 732244 - protein, 9 aa, Homo Sapiens
CAVAAPPLA

SEQ ID NO: 732245 - protein, 9 aa, Homo Sapiens
ADCTWTILV

SEQ ID NO: 732246 - protein, 9 aa, Homo Sapiens
RSHGPHGWQ

SEQ ID NO: 732247 - protein, 9 aa, Homo Sapiens
SAEDAKAVY

SEQ ID NO: 732248 - protein, 9 aa, Homo Sapiens
WLRALLPNI

SEQ ID NO: 732249 - protein, 9 aa, Homo Sapiens
RASHLGLAS

SEQ ID NO: 732250 - protein, 9 aa, Homo Sapiens
LRAVNQRLK

SEQ ID NO: 732251 - protein, 9 aa, Homo Sapiens
MHSAAGSGS

SEQ ID NO: 732252 - protein, 9 aa, Homo Sapiens
RDSMYSQIW

SEQ ID NO: 732253 - protein, 9 aa, Homo Sapiens
AAGPKRKGH

SEQ ID NO: 732254 - protein, 9 aa, Homo Sapiens
SATGHNLSV

SEQ ID NO: 732255 - protein, 9 aa, Homo Sapiens
RKGHKERHK

SEQ ID NO: 732256 - protein, 9 aa, Homo Sapiens
QRTWSCTPM

SEQ ID NO: 732257 - protein, 9 aa, Homo Sapiens
QLPSVQHSP

SEQ ID NO: 732258 - protein, 9 aa, Homo Sapiens
FGIHFSAIS

SEQ ID NO: 732259 - protein, 9 aa, Homo Sapiens
PSLCAHVEC

SEQ ID NO: 732260 - protein, 9 aa, Homo Sapiens
KSEFSRTVY

SEQ ID NO: 732261 - protein, 9 aa, Homo Sapiens
GFMGTYCEL

SEQ ID NO: 732262 - protein, 9 aa, Homo Sapiens
AQAIFDGSY

SEQ ID NO: 732263 - protein, 9 aa, Homo Sapiens
REEQEAQAG

SEQ ID NO: 732264 - protein, 9 aa, Homo Sapiens
HESNYSLHH

SEQ ID NO: 732265 - protein, 9 aa, Homo Sapiens
CQGQNNVFS

SEQ ID NO: 732266 - protein, 9 aa, Homo Sapiens
VTQLAGVHR

SEQ ID NO: 732267 - protein, 9 aa, Homo Sapiens
KDLPNYNWK

SEQ ID NO: 732268 - protein, 9 aa, Homo Sapiens
REPDGTKNK

SEQ ID NO: 732269 - protein, 9 aa, Homo Sapiens
LLFKNRSCI

SEQ ID NO: 732270 - protein, 9 aa, Homo Sapiens
PPCAVAAPP

SEQ ID NO: 732271 - protein, 9 aa, Homo Sapiens
QDGVALVVG

SEQ ID NO: 732272 - protein, 9 aa, Homo Sapiens
SALLVLLNQ

SEQ ID NO: 732273 - protein, 9 aa, Homo Sapiens
GTPPRPGRQ

SEQ ID NO: 732274 - protein, 9 aa, Homo Sapiens
LKKHEIVHT

SEQ ID NO: 732275 - protein, 9 aa, Homo Sapiens
SDPIMGSLN

SEQ ID NO: 732276 - protein, 9 aa, Homo Sapiens
QLSSRVILT

SEQ ID NO: 732277 - protein, 9 aa, Homo Sapiens
FFINHLSLI

SEQ ID NO: 732278 - protein, 9 aa, Homo Sapiens
QVETSVCCQ

SEQ ID NO: 732279 - protein, 9 aa, Homo Sapiens
QLFFPSYAH

SEQ ID NO: 732280 - protein, 9 aa, Homo Sapiens
PSYAHVRCN

SEQ ID NO: 732281 - protein, 9 aa, Homo Sapiens
MCRCRPGFM

SEQ ID NO: 732282 - protein, 9 aa, Homo Sapiens
NQPLDAGVD

SEQ ID NO: 732283 - protein, 9 aa, Homo Sapiens
CKTYQEFNH

SEQ ID NO: 732284 - protein, 9 aa, Homo Sapiens
SDPRFQHVL

SEQ ID NO: 732285 - protein, 9 aa, Homo Sapiens
PVSSGAKGE

SEQ ID NO: 732286 - protein, 9 aa, Homo Sapiens
MGTYCELHV

SEQ ID NO: 732287 - protein, 9 aa, Homo Sapiens
ACVYSFYSR

SEQ ID NO: 732288 - protein, 9 aa, Homo Sapiens
YSLHHVPNW

SEQ ID NO: 732289 - protein, 9 aa, Homo Sapiens
LDKLRCVTT

SEQ ID NO: 732290 - protein, 9 aa, Homo Sapiens
TGRACQRYT

SEQ ID NO: 732291 - protein, 9 aa, Homo Sapiens
VQHVDLSVA

SEQ ID NO: 732292 - protein, 9 aa, Homo Sapiens
PCCGAETWP

SEQ ID NO: 732293 - protein, 9 aa, Homo Sapiens
SARAWSCSG

SEQ ID NO: 732294 - protein, 9 aa, Homo Sapiens
PRFQHVLVY

SEQ ID NO: 732295 - protein, 9 aa, Homo Sapiens
GSLPEGSGF

SEQ ID NO: 732296 - protein, 9 aa, Homo Sapiens
SRPQQSSSP

SEQ ID NO: 732297 - protein, 9 aa, Homo Sapiens
WMWWSSRQR

SEQ ID NO: 732298 - protein, 9 aa, Homo Sapiens
PELNETWEE

SEQ ID NO: 732299 - protein, 9 aa, Homo Sapiens
RQRRYLGSL

SEQ ID NO: 732300 - protein, 9 aa, Homo Sapiens
LLEESALLA

SEQ ID NO: 732301 - protein, 9 aa, Homo Sapiens
ASCCWPRGT

SEQ ID NO: 732302 - protein, 9 aa, Homo Sapiens
SMESHQMPM

SEQ ID NO: 732303 - protein, 9 aa, Homo Sapiens
DRKVLTRRE

SEQ ID NO: 732304 - protein, 9 aa, Homo Sapiens
THLLVVSLF

SEQ ID NO: 732305 - protein, 9 aa, Homo Sapiens
KKRKSREYE

SEQ ID NO: 732306 - protein, 9 aa, Homo Sapiens
SSRQRTWSC

SEQ ID NO: 732307 - protein, 9 aa, Homo Sapiens
TPILCGAQD

SEQ ID NO: 732308 - protein, 9 aa, Homo Sapiens
PAGPADTGK

SEQ ID NO: 732309 - protein, 9 aa, Homo Sapiens
SPSGSSPSC

SEQ ID NO: 732310 - protein, 9 aa, Homo Sapiens
GTCSPSGSS

SEQ ID NO: 732311 - protein, 9 aa, Homo Sapiens
QKIGFRLCN

SEQ ID NO: 732312 - protein, 9 aa, Homo Sapiens
SKVLEDAKV

SEQ ID NO: 732313 - protein, 9 aa, Homo Sapiens
GGSTCSQLP

SEQ ID NO: 732314 - protein, 9 aa, Homo Sapiens
IAVVVSLAF

SEQ ID NO: 732315 - protein, 9 aa, Homo Sapiens
KIWHHTFCN

SEQ ID NO: 732316 - protein, 9 aa, Homo Sapiens
PAIQRVQAE

SEQ ID NO: 732317 - protein, 9 aa, Homo Sapiens
TFCNELRVA

SEQ ID NO: 732318 - protein, 9 aa, Homo Sapiens
RLGTWTRTL

SEQ ID NO: 732319 - protein, 9 aa, Homo Sapiens
VPILLNILQ

SEQ ID NO: 732320 - protein, 9 aa, Homo Sapiens
EPGPLGPKG

SEQ ID NO: 732321 - protein, 9 aa, Homo Sapiens
TRTLQLSVR

SEQ ID NO: 732322 - protein, 9 aa, Homo Sapiens
RISGLVFRV

SEQ ID NO: 732323 - protein, 9 aa, Homo Sapiens
DDEWPVASD

SEQ ID NO: 732324 - protein, 9 aa, Homo Sapiens
TRKISANEF

SEQ ID NO: 732325 - protein, 9 aa, Homo Sapiens
PERHAGSLL

SEQ ID NO: 732326 - protein, 9 aa, Homo Sapiens
GPRSATIQM

SEQ ID NO: 732327 - protein, 9 aa, Homo Sapiens
MPPEAGSVS

SEQ ID NO: 732328 - protein, 9 aa, Homo Sapiens
DFLSPQAAS

SEQ ID NO: 732329 - protein, 9 aa, Homo Sapiens
EYTLVVKRG

SEQ ID NO: 732330 - protein, 9 aa, Homo Sapiens
NATNEQDIA

SEQ ID NO: 732331 - protein, 9 aa, Homo Sapiens
LSGLRKEEK

SEQ ID NO: 732332 - protein, 9 aa, Homo Sapiens
ITGRACQRY

SEQ ID NO: 732333 - protein, 9 aa, Homo Sapiens
TTPVWYGLR

SEQ ID NO: 732334 - protein, 9 aa, Homo Sapiens
QPWWLKLFG

SEQ ID NO: 732335 - protein, 9 aa, Homo Sapiens
APPQDLIRV

SEQ ID NO: 732336 - protein, 9 aa, Homo Sapiens
AAGSGSRRG

SEQ ID NO: 732337 - protein, 9 aa, Homo Sapiens
GIPVFGDKE

SEQ ID NO: 732338 - protein, 9 aa, Homo Sapiens
PTASARAWS

SEQ ID NO: 732339 - protein, 9 aa, Homo Sapiens
PRAKGYSLR

SEQ ID NO: 732340 - protein, 9 aa, Homo Sapiens
PIGKRLLGS

SEQ ID NO: 732341 - protein, 9 aa, Homo Sapiens
EGKTSGVSH

SEQ ID NO: 732342 - protein, 9 aa, Homo Sapiens
AKAVYDFTD

SEQ ID NO: 732343 - protein, 9 aa, Homo Sapiens
KIFGKEAPY

SEQ ID NO: 732344 - protein, 9 aa, Homo Sapiens
KRLLGSKRK

SEQ ID NO: 732345 - protein, 9 aa, Homo Sapiens
KETLILWLM

SEQ ID NO: 732346 - protein, 9 aa, Homo Sapiens
WRKPCCGAE

SEQ ID NO: 732347 - protein, 9 aa, Homo Sapiens
AMTLPVSDP

SEQ ID NO: 732348 - protein, 9 aa, Homo Sapiens
CGDYDDVQR

SEQ ID NO: 732349 - protein, 9 aa, Homo Sapiens
CVTTEPSSL

SEQ ID NO: 732350 - protein, 9 aa, Homo Sapiens
GLAPPQDLI

SEQ ID NO: 732351 - protein, 9 aa, Homo Sapiens
VEREEQEAQ

SEQ ID NO: 732352 - protein, 9 aa, Homo Sapiens
PTSHSDPRF

SEQ ID NO: 732353 - protein, 9 aa, Homo Sapiens
GDYPLEAVL

SEQ ID NO: 732354 - protein, 9 aa, Homo Sapiens
TVSLGRRSH

SEQ ID NO: 732355 - protein, 9 aa, Homo Sapiens
PQQSSSPVQ

SEQ ID NO: 732356 - protein, 9 aa, Homo Sapiens
WPRGTCSPS

SEQ ID NO: 732357 - protein, 9 aa, Homo Sapiens
LGLASSNLD

SEQ ID NO: 732358 - protein, 9 aa, Homo Sapiens
IKPRLGELS

SEQ ID NO: 732359 - protein, 9 aa, Homo Sapiens
CSTHLLVVS

SEQ ID NO: 732360 - protein, 9 aa, Homo Sapiens
GLVDAEVTT

SEQ ID NO: 732361 - protein, 9 aa, Homo Sapiens
WWSSRQRTW

SEQ ID NO: 732362 - protein, 9 aa, Homo Sapiens
ECTLCMRLF

SEQ ID NO: 732363 - protein, 9 aa, Homo Sapiens
KTAAEMLQS

SEQ ID NO: 732364 - protein, 9 aa, Homo Sapiens
CCTVHLYQH

SEQ ID NO: 732365 - protein, 9 aa, Homo Sapiens
TITSIPESR

SEQ ID NO: 732366 - protein, 9 aa, Homo Sapiens
LFKNRSCII

SEQ ID NO: 732367 - protein, 9 aa, Homo Sapiens
LPRAQEGLK

SEQ ID NO: 732368 - protein, 9 aa, Homo Sapiens
ILGSGVQAY

SEQ ID NO: 732369 - protein, 9 aa, Homo Sapiens
MPCRSSWRK

SEQ ID NO: 732370 - protein, 9 aa, Homo Sapiens
LQNESDNLR

SEQ ID NO: 732371 - protein, 9 aa, Homo Sapiens
LRKEEKPPF

SEQ ID NO: 732372 - protein, 9 aa, Homo Sapiens
MTLPVSDPT

SEQ ID NO: 732373 - protein, 9 aa, Homo Sapiens
RRRSSWRSA

SEQ ID NO: 732374 - protein, 9 aa, Homo Sapiens
PQAASPAPN

SEQ ID NO: 732375 - protein, 9 aa, Homo Sapiens
PWKKYPLPE

SEQ ID NO: 732376 - protein, 9 aa, Homo Sapiens
RQVETSVCC

SEQ ID NO: 732377 - protein, 9 aa, Homo Sapiens
VPGVCHCFA

SEQ ID NO: 732378 - protein, 9 aa, Homo Sapiens
GLASSNLDE

SEQ ID NO: 732379 - protein, 9 aa, Homo Sapiens
CSGGSRRGC

SEQ ID NO: 732380 - protein, 9 aa, Homo Sapiens
RKFAQSISQ

SEQ ID NO: 732381 - protein, 9 aa, Homo Sapiens
KNQPLDAGV

SEQ ID NO: 732382 - protein, 9 aa, Homo Sapiens
VSDPIMGSL

SEQ ID NO: 732383 - protein, 9 aa, Homo Sapiens
KVMLRETVS

SEQ ID NO: 732384 - protein, 9 aa, Homo Sapiens
SCTPMPCRS

SEQ ID NO: 732385 - protein, 9 aa, Homo Sapiens
SFYSRTQST

SEQ ID NO: 732386 - protein, 9 aa, Homo Sapiens
LALVTQLAG

SEQ ID NO: 732387 - protein, 9 aa, Homo Sapiens
WTRTLSPHM

SEQ ID NO: 732388 - protein, 9 aa, Homo Sapiens
AGIPRHAPQ

SEQ ID NO: 732389 - protein, 9 aa, Homo Sapiens
TFQVKFFYI

SEQ ID NO: 732390 - protein, 9 aa, Homo Sapiens
PSCSILPRI

SEQ ID NO: 732391 - protein, 9 aa, Homo Sapiens
TSHSDPRFQ

SEQ ID NO: 732392 - protein, 9 aa, Homo Sapiens
ADAPRAKGY

SEQ ID NO: 732393 - protein, 9 aa, Homo Sapiens
GNIFSADVH

SEQ ID NO: 732394 - protein, 9 aa, Homo Sapiens
FAGSLDGSI

SEQ ID NO: 732395 - protein, 9 aa, Homo Sapiens
DMNDCYSLL

SEQ ID NO: 732396 - protein, 9 aa, Homo Sapiens
TTDEDVEFS

SEQ ID NO: 732397 - protein, 9 aa, Homo Sapiens
DRNAVCVNC

SEQ ID NO: 732398 - protein, 9 aa, Homo Sapiens
KIVRSNGVQ

SEQ ID NO: 732399 - protein, 9 aa, Homo Sapiens
DYQDVPGIE

SEQ ID NO: 732400 - protein, 9 aa, Homo Sapiens
TQDSMTVKD

SEQ ID NO: 732401 - protein, 9 aa, Homo Sapiens
EESALLAER

SEQ ID NO: 732402 - protein, 9 aa, Homo Sapiens
HFCQGQNNV

SEQ ID NO: 732403 - protein, 9 aa, Homo Sapiens
ILEDSPVGS

SEQ ID NO: 732404 - protein, 9 aa, Homo Sapiens
LVLKAPSKV

SEQ ID NO: 732405 - protein, 9 aa, Homo Sapiens
MERQRNQLE

SEQ ID NO: 732406 - protein, 9 aa, Homo Sapiens
TASARAWSC

SEQ ID NO: 732407 - protein, 9 aa, Homo Sapiens
HGPHGWQRT

SEQ ID NO: 732408 - protein, 9 aa, Homo Sapiens
HVDLSVARK

SEQ ID NO: 732409 - protein, 9 aa, Homo Sapiens
ILELCGDYD

SEQ ID NO: 732410 - protein, 9 aa, Homo Sapiens
LLTIPLSLV

SEQ ID NO: 732411 - protein, 9 aa, Homo Sapiens
SLLSDRKVL

SEQ ID NO: 732412 - protein, 9 aa, Homo Sapiens
THEKTHTGQ

SEQ ID NO: 732413 - protein, 9 aa, Homo Sapiens
HQAFSTCST

SEQ ID NO: 732414 - protein, 9 aa, Homo Sapiens
LRRRLERLM

SEQ ID NO: 732415 - protein, 9 aa, Homo Sapiens
EARQFGHDI

SEQ ID NO: 732416 - protein, 9 aa, Homo Sapiens
DSMYSQIWR

SEQ ID NO: 732417 - protein, 9 aa, Homo Sapiens
QDVPGIEKV

SEQ ID NO: 732418 - protein, 9 aa, Homo Sapiens
VVSLAFLLM

SEQ ID NO: 732419 - protein, 9 aa, Homo Sapiens
LHGEPTHIQ

SEQ ID NO: 732420 - protein, 9 aa, Homo Sapiens
FDGSYLGYS

SEQ ID NO: 732421 - protein, 9 aa, Homo Sapiens
NLFRLGTWT

SEQ ID NO: 732422 - protein, 9 aa, Homo Sapiens
IPLSLVARK

SEQ ID NO: 732423 - protein, 9 aa, Homo Sapiens
AGSLDGSIS

SEQ ID NO: 732424 - protein, 9 aa, Homo Sapiens
YFFINHLSL

SEQ ID NO: 732425 - protein, 9 aa, Homo Sapiens
SVSDDSLYD

SEQ ID NO: 732426 - protein, 9 aa, Homo Sapiens
DAKVPAPPH

SEQ ID NO: 732427 - protein, 9 aa, Homo Sapiens
VTTDEDVEF

SEQ ID NO: 732428 - protein, 9 aa, Homo Sapiens
DKHEFQDAW

SEQ ID NO: 732429 - protein, 9 aa, Homo Sapiens
ISQSLDALH

SEQ ID NO: 732430 - protein, 9 aa, Homo Sapiens
YNWKSFGLR

SEQ ID NO: 732431 - protein, 9 aa, Homo Sapiens
VHSPFTSMA

SEQ ID NO: 732432 - protein, 9 aa, Homo Sapiens
LPEGSGFCS

SEQ ID NO: 732433 - protein, 9 aa, Homo Sapiens
FEDEVLITQ

SEQ ID NO: 732434 - protein, 9 aa, Homo Sapiens
ETLILWLMI

SEQ ID NO: 732435 - protein, 9 aa, Homo Sapiens
RKGTQLSTA

SEQ ID NO: 732436 - protein, 9 aa, Homo Sapiens
QPQELKPER

SEQ ID NO: 732437 - protein, 9 aa, Homo Sapiens
NRSCIILHK

SEQ ID NO: 732438 - protein, 9 aa, Homo Sapiens
KQQPWWLKL

SEQ ID NO: 732439 - protein, 9 aa, Homo Sapiens
MFKALNDAC

SEQ ID NO: 732440 - protein, 9 aa, Homo Sapiens
WTILVEPGD

SEQ ID NO: 732441 - protein, 9 aa, Homo Sapiens
RYVDCSATG

SEQ ID NO: 732442 - protein, 9 aa, Homo Sapiens
RKEEKPPFQ

SEQ ID NO: 732443 - protein, 9 aa, Homo Sapiens
FTYEDPKEA

SEQ ID NO: 732444 - protein, 9 aa, Homo Sapiens
HKIVPEERL

SEQ ID NO: 732445 - protein, 9 aa, Homo Sapiens
SAKLPWKKY

SEQ ID NO: 732446 - protein, 9 aa, Homo Sapiens
YKGEKFPST

SEQ ID NO: 732447 - protein, 9 aa, Homo Sapiens
CPASTPAQT

SEQ ID NO: 732448 - protein, 9 aa, Homo Sapiens
QQRLERFHE

SEQ ID NO: 732449 - protein, 9 aa, Homo Sapiens
SEQNMKLCQ

SEQ ID NO: 732450 - protein, 9 aa, Homo Sapiens
SLIPPPPLP

SEQ ID NO: 732451 - protein, 9 aa, Homo Sapiens
VSQAGREAR

SEQ ID NO: 732452 - protein, 9 aa, Homo Sapiens
IPESRLVQT

SEQ ID NO: 732453 - protein, 9 aa, Homo Sapiens
CFSPSPLSI

SEQ ID NO: 732454 - protein, 9 aa, Homo Sapiens
TKQLNLSRS

SEQ ID NO: 732455 - protein, 9 aa, Homo Sapiens
WKSFGLRFG

SEQ ID NO: 732456 - protein, 9 aa, Homo Sapiens
KTSGVSHRP

SEQ ID NO: 732457 - protein, 9 aa, Homo Sapiens
PFPVRPNSS

SEQ ID NO: 732458 - protein, 9 aa, Homo Sapiens
QEGLKPGTL

SEQ ID NO: 732459 - protein, 9 aa, Homo Sapiens
KSPGVMDNH

SEQ ID NO: 732460 - protein, 9 aa, Homo Sapiens
GYSLRTCYP

SEQ ID NO: 732461 - protein, 9 aa, Homo Sapiens
EPEEWLSTA

SEQ ID NO: 732462 - protein, 9 aa, Homo Sapiens
TTPAGEIVA

SEQ ID NO: 732463 - protein, 9 aa, Homo Sapiens
KWLSGLRKE

SEQ ID NO: 732464 - protein, 9 aa, Homo Sapiens
SSQGSPSQE

SEQ ID NO: 732465 - protein, 9 aa, Homo Sapiens
KIGFRLCNL

SEQ ID NO: 732466 - protein, 9 aa, Homo Sapiens
CEKNVDYEM

SEQ ID NO: 732467 - protein, 9 aa, Homo Sapiens
RSSWRKPCC

SEQ ID NO: 732468 - protein, 9 aa, Homo Sapiens
STLLKDYQD

SEQ ID NO: 732469 - protein, 9 aa, Homo Sapiens
TSVCCQLPK

SEQ ID NO: 732470 - protein, 9 aa, Homo Sapiens
LLASSVSDD

SEQ ID NO: 732471 - protein, 9 aa, Homo Sapiens
CDMNDCYSL

SEQ ID NO: 732472 - protein, 9 aa, Homo Sapiens
WSCSGGSRR

SEQ ID NO: 732473 - protein, 9 aa, Homo Sapiens
ESALLAERF

SEQ ID NO: 732474 - protein, 9 aa, Homo Sapiens
RKLEQLERP

SEQ ID NO: 732475 - protein, 9 aa, Homo Sapiens
LPRISGLVF

SEQ ID NO: 732476 - protein, 9 aa, Homo Sapiens
CILGSGVQA

SEQ ID NO: 732477 - protein, 9 aa, Homo Sapiens
SVCCQLPKL

SEQ ID NO: 732478 - protein, 9 aa, Homo Sapiens
EKIIPELNE

SEQ ID NO: 732479 - protein, 9 aa, Homo Sapiens
QTLSAKLPW

SEQ ID NO: 732480 - protein, 9 aa, Homo Sapiens
AWSCSGGSR

SEQ ID NO: 732481 - protein, 9 aa, Homo Sapiens
KSSALLVLL

SEQ ID NO: 732482 - protein, 9 aa, Homo Sapiens
ETHKIVPEE

SEQ ID NO: 732483 - protein, 9 aa, Homo Sapiens
SGPPPHSPL

SEQ ID NO: 732484 - protein, 9 aa, Homo Sapiens
RVILTVYVH

SEQ ID NO: 732485 - protein, 9 aa, Homo Sapiens
IGPRSATIQ

SEQ ID NO: 732486 - protein, 9 aa, Homo Sapiens
IANGYKIFG

SEQ ID NO: 732487 - protein, 9 aa, Homo Sapiens
REARQFGHD

SEQ ID NO: 732488 - protein, 9 aa, Homo Sapiens
VRETHKIVP

SEQ ID NO: 732489 - protein, 9 aa, Homo Sapiens
TALCRDAAM

SEQ ID NO: 732490 - protein, 9 aa, Homo Sapiens
CSPSGSSPS

SEQ ID NO: 732491 - protein, 9 aa, Homo Sapiens
RVQAEEREQ

SEQ ID NO: 732492 - protein, 9 aa, Homo Sapiens
SWRKPCCGA

SEQ ID NO: 732493 - protein, 9 aa, Homo Sapiens
AQAPALSPA

SEQ ID NO: 732494 - protein, 9 aa, Homo Sapiens
RVVKPLNYE

SEQ ID NO: 732495 - protein, 9 aa, Homo Sapiens
VRSNGVQTM

SEQ ID NO: 732496 - protein, 9 aa, Homo Sapiens
PVLVLKAPS

SEQ ID NO: 732497 - protein, 9 aa, Homo Sapiens
DTPSMKVHG

SEQ ID NO: 732498 - protein, 9 aa, Homo Sapiens
DGSYLGYSV

SEQ ID NO: 732499 - protein, 9 aa, Homo Sapiens
VMDNHLVMH

SEQ ID NO: 732500 - protein, 9 aa, Homo Sapiens
TDRNAVCVN

SEQ ID NO: 732501 - protein, 9 aa, Homo Sapiens
LLKDYQDVP

SEQ ID NO: 732502 - protein, 9 aa, Homo Sapiens
DEVLITQGG

SEQ ID NO: 732503 - protein, 9 aa, Homo Sapiens
SILEGEMQA

SEQ ID NO: 732504 - protein, 9 aa, Homo Sapiens
PAEEQRLFL

SEQ ID NO: 732505 - protein, 9 aa, Homo Sapiens
VSLIPPPPL

SEQ ID NO: 732506 - protein, 9 aa, Homo Sapiens
EPTHIQEDP

SEQ ID NO: 732507 - protein, 9 aa, Homo Sapiens
NYIIKGNHF

SEQ ID NO: 732508 - protein, 9 aa, Homo Sapiens
HTFCNELRV

SEQ ID NO: 732509 - protein, 9 aa, Homo Sapiens
AEDAKAVYD

SEQ ID NO: 732510 - protein, 9 aa, Homo Sapiens
CHCFAFLPC

SEQ ID NO: 732511 - protein, 9 aa, Homo Sapiens
NMTGKKKNS

SEQ ID NO: 732512 - protein, 9 aa, Homo Sapiens
LASSNLDED

SEQ ID NO: 732513 - protein, 9 aa, Homo Sapiens
EMLQSQGSQ

SEQ ID NO: 732514 - protein, 9 aa, Homo Sapiens
LVVKRGDEH

SEQ ID NO: 732515 - protein, 9 aa, Homo Sapiens
ALASAPEEA

SEQ ID NO: 732516 - protein, 9 aa, Homo Sapiens
LLYEVQILE

SEQ ID NO: 732517 - protein, 9 aa, Homo Sapiens
PKLSITVTY

SEQ ID NO: 732518 - protein, 9 aa, Homo Sapiens
NHFEPVVNA

SEQ ID NO: 732519 - protein, 9 aa, Homo Sapiens
QSISQSLDA

SEQ ID NO: 732520 - protein, 9 aa, Homo Sapiens
TVSAAGPKR

SEQ ID NO: 732521 - protein, 9 aa, Homo Sapiens
LSPHMTVSL

SEQ ID NO: 732522 - protein, 9 aa, Homo Sapiens
HSPFTSMAT

SEQ ID NO: 732523 - protein, 9 aa, Homo Sapiens
LISFGIHFS

SEQ ID NO: 732524 - protein, 9 aa, Homo Sapiens
KDRDLTALC

SEQ ID NO: 732525 - protein, 9 aa, Homo Sapiens
KRGDEHIPG

SEQ ID NO: 732526 - protein, 9 aa, Homo Sapiens
ALADTPSMK

SEQ ID NO: 732527 - protein, 9 aa, Homo Sapiens
YIPFTMYTT

SEQ ID NO: 732528 - protein, 9 aa, Homo Sapiens
DGSISAAST

SEQ ID NO: 732529 - protein, 9 aa, Homo Sapiens
NSNVESELS

SEQ ID NO: 732530 - protein, 9 aa, Homo Sapiens
IFGKEAPYF

SEQ ID NO: 732531 - protein, 9 aa, Homo Sapiens
TKKSPSHKE

SEQ ID NO: 732532 - protein, 9 aa, Homo Sapiens
SCKTYQEFN

SEQ ID NO: 732533 - protein, 9 aa, Homo Sapiens
KKNSKRKRS

SEQ ID NO: 732534 - protein, 9 aa, Homo Sapiens
FQHVLVYFF

SEQ ID NO: 732535 - protein, 9 aa, Homo Sapiens
VLVLKAPSK

SEQ ID NO: 732536 - protein, 9 aa, Homo Sapiens
YQTLSAKLP

SEQ ID NO: 732537 - protein, 9 aa, Homo Sapiens
QRKTAAEML

SEQ ID NO: 732538 - protein, 9 aa, Homo Sapiens
ADVHGLESD

SEQ ID NO: 732539 - protein, 9 aa, Homo Sapiens
SHQMPMSLP

SEQ ID NO: 732540 - protein, 9 aa, Homo Sapiens
EKIWHHTFC

SEQ ID NO: 732541 - protein, 9 aa, Homo Sapiens
EWKSSALLV

SEQ ID NO: 732542 - protein, 9 aa, Homo Sapiens
PILNYLCHG

SEQ ID NO: 732543 - protein, 9 aa, Homo Sapiens
FDIFEDEVL

SEQ ID NO: 732544 - protein, 9 aa, Homo Sapiens
AVLMQHLIA

SEQ ID NO: 732545 - protein, 9 aa, Homo Sapiens
GAQDRIHTH

SEQ ID NO: 732546 - protein, 9 aa, Homo Sapiens
KHRGGSGGS

SEQ ID NO: 732547 - protein, 9 aa, Homo Sapiens
APPHQGHPQ

SEQ ID NO: 732548 - protein, 9 aa, Homo Sapiens
LSDLRAVNQ

SEQ ID NO: 732549 - protein, 9 aa, Homo Sapiens
LKDYQDVPG

SEQ ID NO: 732550 - protein, 9 aa, Homo Sapiens
ERAGSSLTS

SEQ ID NO: 732551 - protein, 9 aa, Homo Sapiens
YSQIWRMIN

SEQ ID NO: 732552 - protein, 9 aa, Homo Sapiens
ILVEPGDTI

SEQ ID NO: 732553 - protein, 9 aa, Homo Sapiens
CIWDLEEGK

SEQ ID NO: 732554 - protein, 9 aa, Homo Sapiens
QLERPAEEQ

SEQ ID NO: 732555 - protein, 9 aa, Homo Sapiens
TLKKHEIVH

SEQ ID NO: 732556 - protein, 9 aa, Homo Sapiens
KNKSLLTFE

SEQ ID NO: 732557 - protein, 9 aa, Homo Sapiens
KEWQDWLRA

SEQ ID NO: 732558 - protein, 9 aa, Homo Sapiens
LLSILEGEM

SEQ ID NO: 732559 - protein, 9 aa, Homo Sapiens
IVRSNGVQT

SEQ ID NO: 732560 - protein, 9 aa, Homo Sapiens
EQNMKLCQE

SEQ ID NO: 732561 - protein, 9 aa, Homo Sapiens
CRCRPGFMG

SEQ ID NO: 732562 - protein, 9 aa, Homo Sapiens
MYSQIWRMI

SEQ ID NO: 732563 - protein, 9 aa, Homo Sapiens
IGQISTDFL

SEQ ID NO: 732564 - protein, 9 aa, Homo Sapiens
REDLALVTQ

SEQ ID NO: 732565 - protein, 9 aa, Homo Sapiens
TGRRHISCS

SEQ ID NO: 732566 - protein, 9 aa, Homo Sapiens
KRKGHKERH

SEQ ID NO: 732567 - protein, 9 aa, Homo Sapiens
SPHMTVSLG

SEQ ID NO: 732568 - protein, 9 aa, Homo Sapiens
LPEPQPVLV

SEQ ID NO: 732569 - protein, 9 aa, Homo Sapiens
DDTFSFDPE

SEQ ID NO: 732570 - protein, 9 aa, Homo Sapiens
ALCCTVHLY

SEQ ID NO: 732571 - protein, 9 aa, Homo Sapiens
PRPGRQVET

SEQ ID NO: 732572 - protein, 9 aa, Homo Sapiens
ASSNLDEDI

SEQ ID NO: 732573 - protein, 9 aa, Homo Sapiens
FPSGPPPHS

SEQ ID NO: 732574 - protein, 9 aa, Homo Sapiens
PCAVAAPPL

SEQ ID NO: 732575 - protein, 9 aa, Homo Sapiens
WKSSALLVL

SEQ ID NO: 732576 - protein, 9 aa, Homo Sapiens
HSPYSGNIA

SEQ ID NO: 732577 - protein, 9 aa, Homo Sapiens
VCVNCIKKC

SEQ ID NO: 732578 - protein, 9 aa, Homo Sapiens
DKALADTPS

SEQ ID NO: 732579 - protein, 9 aa, Homo Sapiens
PVSDPTAWA

SEQ ID NO: 732580 - protein, 9 aa, Homo Sapiens
EPQVQWRTY

SEQ ID NO: 732581 - protein, 9 aa, Homo Sapiens
SFDPEFTAK

SEQ ID NO: 732582 - protein, 9 aa, Homo Sapiens
EQEYKIMFV

SEQ ID NO: 732583 - protein, 9 aa, Homo Sapiens
VVGVQHVDL

SEQ ID NO: 732584 - protein, 9 aa, Homo Sapiens
NHLSLIDLT

SEQ ID NO: 732585 - protein, 9 aa, Homo Sapiens
QWRTYKGEK

SEQ ID NO: 732586 - protein, 9 aa, Homo Sapiens
NKWLSGLRK

SEQ ID NO: 732587 - protein, 9 aa, Homo Sapiens
MSKETLILW

SEQ ID NO: 732588 - protein, 9 aa, Homo Sapiens
GPTTHQFAF

SEQ ID NO: 732589 - protein, 9 aa, Homo Sapiens
HRGGSGGSG

SEQ ID NO: 732590 - protein, 9 aa, Homo Sapiens
FSWRVIKEK

SEQ ID NO: 732591 - protein, 9 aa, Homo Sapiens
QSFQQRLER

SEQ ID NO: 732592 - protein, 9 aa, Homo Sapiens
AKLPWKKYP

SEQ ID NO: 732593 - protein, 9 aa, Homo Sapiens
KNVDYEMFK

SEQ ID NO: 732594 - protein, 9 aa, Homo Sapiens
PGQGCPAST

SEQ ID NO: 732595 - protein, 9 aa, Homo Sapiens
EAEDVEREE

SEQ ID NO: 732596 - protein, 9 aa, Homo Sapiens
SVARKSEFS

SEQ ID NO: 732597 - protein, 9 aa, Homo Sapiens
SSWRKPCCG

SEQ ID NO: 732598 - protein, 9 aa, Homo Sapiens
REAILELCG

SEQ ID NO: 732599 - protein, 9 aa, Homo Sapiens
FQQRLERFH

SEQ ID NO: 732600 - protein, 9 aa, Homo Sapiens
EIVHTGEKL

SEQ ID NO: 732601 - protein, 9 aa, Homo Sapiens
LIAVVVSLA

SEQ ID NO: 732602 - protein, 9 aa, Homo Sapiens
VESELSGSA

SEQ ID NO: 732603 - protein, 9 aa, Homo Sapiens
GPTASARAW

SEQ ID NO: 732604 - protein, 9 aa, Homo Sapiens
PHMTVSLGR

SEQ ID NO: 732605 - protein, 9 aa, Homo Sapiens
WYGLRLNMD

SEQ ID NO: 732606 - protein, 9 aa, Homo Sapiens
GSGIPVFGD

SEQ ID NO: 732607 - protein, 9 aa, Homo Sapiens
CLLASSVSD

SEQ ID NO: 732608 - protein, 9 aa, Homo Sapiens
GPVGGPVSS

SEQ ID NO: 732609 - protein, 9 aa, Homo Sapiens
SPDHKHRGG

SEQ ID NO: 732610 - protein, 9 aa, Homo Sapiens
RGCLPSCSI

SEQ ID NO: 732611 - protein, 9 aa, Homo Sapiens
LLSDRKVLT

SEQ ID NO: 732612 - protein, 9 aa, Homo Sapiens
NSKRKRSKS

SEQ ID NO: 732613 - protein, 9 aa, Homo Sapiens
NAVCVNCIK

SEQ ID NO: 732614 - protein, 9 aa, Homo Sapiens
LPRHYRKHT

SEQ ID NO: 732615 - protein, 9 aa, Homo Sapiens
AGSVHSPFT

SEQ ID NO: 732616 - protein, 9 aa, Homo Sapiens
LCHGQLIVN

SEQ ID NO: 732617 - protein, 9 aa, Homo Sapiens
KHEIVHTGE

SEQ ID NO: 732618 - protein, 9 aa, Homo Sapiens
DVPGIEKVD

SEQ ID NO: 732619 - protein, 9 aa, Homo Sapiens
SEVLCILGS

SEQ ID NO: 732620 - protein, 9 aa, Homo Sapiens
SFGIHFSAI

SEQ ID NO: 732621 - protein, 9 aa, Homo Sapiens
VSGAAASQP

SEQ ID NO: 732622 - protein, 9 aa, Homo Sapiens
RPGRQVETS

SEQ ID NO: 732623 - protein, 9 aa, Homo Sapiens
PSVQHSPYS

SEQ ID NO: 732624 - protein, 9 aa, Homo Sapiens
YEQEYKIMF

SEQ ID NO: 732625 - protein, 9 aa, Homo Sapiens
WRTYKGEKF

SEQ ID NO: 732626 - protein, 9 aa, Homo Sapiens
FEPILNYLC

SEQ ID NO: 732627 - protein, 9 aa, Homo Sapiens
FLSPQAASP

SEQ ID NO: 732628 - protein, 9 aa, Homo Sapiens
VFEIRTTDN

SEQ ID NO: 732629 - protein, 9 aa, Homo Sapiens
LEDSPVGSQ

SEQ ID NO: 732630 - protein, 9 aa, Homo Sapiens
SLCAHVECP

SEQ ID NO: 732631 - protein, 9 aa, Homo Sapiens
TAHKKIHAG

SEQ ID NO: 732632 - protein, 9 aa, Homo Sapiens
AGSGIPVFG

SEQ ID NO: 732633 - protein, 9 aa, Homo Sapiens
SPVQLNSGS

SEQ ID NO: 732634 - protein, 9 aa, Homo Sapiens
VYPLKTLYV

SEQ ID NO: 732635 - protein, 9 aa, Homo Sapiens
LEDAKVPAP

SEQ ID NO: 732636 - protein, 9 aa, Homo Sapiens
QILEDSPVG

SEQ ID NO: 732637 - protein, 9 aa, Homo Sapiens
KSFGLRFGK

SEQ ID NO: 732638 - protein, 9 aa, Homo Sapiens
AHKKIHAGE

SEQ ID NO: 732639 - protein, 9 aa, Homo Sapiens
DLECTLCMR

SEQ ID NO: 732640 - protein, 9 aa, Homo Sapiens
DSMTVKDVE

SEQ ID NO: 732641 - protein, 9 aa, Homo Sapiens
DNKIIDGRQ

SEQ ID NO: 732642 - protein, 9 aa, Homo Sapiens
PVGGPVSSG

SEQ ID NO: 732643 - protein, 9 aa, Homo Sapiens
QQSSSPVQL

SEQ ID NO: 732644 - protein, 9 aa, Homo Sapiens
PPQDLIRVE

SEQ ID NO: 732645 - protein, 9 aa, Homo Sapiens
EPILNYLCH

SEQ ID NO: 732646 - protein, 9 aa, Homo Sapiens
SILPRISGL

SEQ ID NO: 732647 - protein, 9 aa, Homo Sapiens
EREEQEAQA

SEQ ID NO: 732648 - protein, 9 aa, Homo Sapiens
LLTQTVESG

SEQ ID NO: 732649 - protein, 9 aa, Homo Sapiens
TEEMTRKIS

SEQ ID NO: 732650 - protein, 9 aa, Homo Sapiens
RKISANEFL

SEQ ID NO: 732651 - protein, 9 aa, Homo Sapiens
EQLERPAEE

SEQ ID NO: 732652 - protein, 9 aa, Homo Sapiens
QVPGVCHCF

SEQ ID NO: 732653 - protein, 9 aa, Homo Sapiens
ESNYSLHHV

SEQ ID NO: 732654 - protein, 9 aa, Homo Sapiens
MESHQMPMS

SEQ ID NO: 732655 - protein, 9 aa, Homo Sapiens
STCSQLPSV

SEQ ID NO: 732656 - protein, 9 aa, Homo Sapiens
GPLGPKGPT

SEQ ID NO: 732657 - protein, 9 aa, Homo Sapiens
PSQESPSQE

SEQ ID NO: 732658 - protein, 9 aa, Homo Sapiens
KVLEDAKVP

SEQ ID NO: 732659 - protein, 9 aa, Homo Sapiens
SGLVFRVHQ

SEQ ID NO: 732660 - protein, 9 aa, Homo Sapiens
RPNSSLLFS

SEQ ID NO: 732661 - protein, 9 aa, Homo Sapiens
LEGVKQQLY

SEQ ID NO: 732662 - protein, 9 aa, Homo Sapiens
AGSGSRRGA

SEQ ID NO: 732663 - protein, 9 aa, Homo Sapiens
EIRTTDNLT

SEQ ID NO: 732664 - protein, 9 aa, Homo Sapiens
VLTRRERRE

SEQ ID NO: 732665 - protein, 9 aa, Homo Sapiens
GSVHSPFTS

SEQ ID NO: 732666 - protein, 9 aa, Homo Sapiens
CTWTILVEP

SEQ ID NO: 732667 - protein, 9 aa, Homo Sapiens
QKARPGGPA

SEQ ID NO: 732668 - protein, 9 aa, Homo Sapiens
LVEPGDTIA

SEQ ID NO: 732669 - protein, 9 aa, Homo Sapiens
HCFAFLPCR

SEQ ID NO: 732670 - protein, 9 aa, Homo Sapiens
ITGRGTLSC

SEQ ID NO: 732671 - protein, 9 aa, Homo Sapiens
KLEQLERPA

SEQ ID NO: 732672 - protein, 9 aa, Homo Sapiens
GQVPGVCHC

SEQ ID NO: 732673 - protein, 9 aa, Homo Sapiens
LTALCRDAA

SEQ ID NO: 732674 - protein, 9 aa, Homo Sapiens
SSQSLNIGQ

SEQ ID NO: 732675 - protein, 9 aa, Homo Sapiens
KAPSKVLED

SEQ ID NO: 732676 - protein, 9 aa, Homo Sapiens
LTQDSMTVK

SEQ ID NO: 732677 - protein, 9 aa, Homo Sapiens
WRSASCCWP

SEQ ID NO: 732678 - protein, 9 aa, Homo Sapiens
ETSVCCQLP

SEQ ID NO: 732679 - protein, 9 aa, Homo Sapiens
VLMQHLIAR

SEQ ID NO: 732680 - protein, 9 aa, Homo Sapiens
KGTQLSTAR

SEQ ID NO: 732681 - protein, 9 aa, Homo Sapiens
KSEFNFSCK

SEQ ID NO: 732682 - protein, 9 aa, Homo Sapiens
HAPQLHTLA

SEQ ID NO: 732683 - protein, 9 aa, Homo Sapiens
PALSPALAS

SEQ ID NO: 732684 - protein, 9 aa, Homo Sapiens
EPSTASTAS

SEQ ID NO: 732685 - protein, 9 aa, Homo Sapiens
VVKRGDEHI

SEQ ID NO: 732686 - protein, 9 aa, Homo Sapiens
SELSGSASM

SEQ ID NO: 732687 - protein, 9 aa, Homo Sapiens
AGSLLDICH

SEQ ID NO: 732688 - protein, 9 aa, Homo Sapiens
LPNYNWKSF

SEQ ID NO: 732689 - protein, 9 aa, Homo Sapiens
QDRIHTHGV

SEQ ID NO: 732690 - protein, 9 aa, Homo Sapiens
RTQSTWMWW

SEQ ID NO: 732691 - protein, 9 aa, Homo Sapiens
VWYGLRLNM

SEQ ID NO: 732692 - protein, 9 aa, Homo Sapiens
LGSLPEGSG

SEQ ID NO: 732693 - protein, 9 aa, Homo Sapiens
QIERYSCFS

SEQ ID NO: 732694 - protein, 9 aa, Homo Sapiens
QRNQLEGVK

SEQ ID NO: 732695 - protein, 9 aa, Homo Sapiens
PQLSSRVIL

SEQ ID NO: 732696 - protein, 9 aa, Homo Sapiens
RLGELSVTD

SEQ ID NO: 732697 - protein, 9 aa, Homo Sapiens
WLKLFGPES

SEQ ID NO: 732698 - protein, 9 aa, Homo Sapiens
QFFPSGPPP

SEQ ID NO: 732699 - protein, 9 aa, Homo Sapiens
LKPERAGSS

SEQ ID NO: 732700 - protein, 9 aa, Homo Sapiens
HQGHPQDGV

SEQ ID NO: 732701 - protein, 9 aa, Homo Sapiens
DAAMHALLH

SEQ ID NO: 732702 - protein, 9 aa, Homo Sapiens
EDAKAVYDF

SEQ ID NO: 732703 - protein, 9 aa, Homo Sapiens
QAIFDGSYL

SEQ ID NO: 732704 - protein, 9 aa, Homo Sapiens
YPLEAVLMQ

SEQ ID NO: 732705 - protein, 9 aa, Homo Sapiens
DASDLECTL

SEQ ID NO: 732706 - protein, 9 aa, Homo Sapiens
EEWLSTARK

SEQ ID NO: 732707 - protein, 9 aa, Homo Sapiens
KPDDTFSFD

SEQ ID NO: 732708 - protein, 9 aa, Homo Sapiens
PYSGNIAPV

SEQ ID NO: 732709 - protein, 9 aa, Homo Sapiens
PDITGRACQ

SEQ ID NO: 732710 - protein, 9 aa, Homo Sapiens
IRTTDNLTE

SEQ ID NO: 732711 - protein, 9 aa, Homo Sapiens
SGSRRGALR

SEQ ID NO: 732712 - protein, 9 aa, Homo Sapiens
HMTVSLGRR

SEQ ID NO: 732713 - protein, 9 aa, Homo Sapiens
DYKKRKSRE

SEQ ID NO: 732714 - protein, 9 aa, Homo Sapiens
GCLPSCSIL

SEQ ID NO: 732715 - protein, 9 aa, Homo Sapiens
IASKTKEIK

SEQ ID NO: 732716 - protein, 9 aa, Homo Sapiens
LSFIKCGNA

SEQ ID NO: 732717 - protein, 9 aa, Homo Sapiens
MDYKKRKSR

SEQ ID NO: 732718 - protein, 9 aa, Homo Sapiens
LSPQAASPA

SEQ ID NO: 732719 - protein, 9 aa, Homo Sapiens
HAGSLLDIC

SEQ ID NO: 732720 - protein, 9 aa, Homo Sapiens
ARPGGPAVR

SEQ ID NO: 732721 - protein, 9 aa, Homo Sapiens
DPKEAVREF

SEQ ID NO: 732722 - protein, 9 aa, Homo Sapiens
QRLERFHEN

SEQ ID NO: 732723 - protein, 9 aa, Homo Sapiens
EQQSEQNMK

SEQ ID NO: 732724 - protein, 9 aa, Homo Sapiens
PRGTCSPSG

SEQ ID NO: 732725 - protein, 9 aa, Homo Sapiens
APALSPALA

SEQ ID NO: 732726 - protein, 9 aa, Homo Sapiens
RAQEGLKPG

SEQ ID NO: 732727 - protein, 9 aa, Homo Sapiens
ISFPIGKRL

SEQ ID NO: 732728 - protein, 9 aa, Homo Sapiens
RGTCSPSGS

SEQ ID NO: 732729 - protein, 9 aa, Homo Sapiens
SPGVMDNHL

SEQ ID NO: 732730 - protein, 9 aa, Homo Sapiens
STASTASNY

SEQ ID NO: 732731 - protein, 9 aa, Homo Sapiens
LGRRSHGPH

SEQ ID NO: 732732 - protein, 9 aa, Homo Sapiens
YLCHGQLIV

SEQ ID NO: 732733 - protein, 9 aa, Homo Sapiens
PGVMDNHLV

SEQ ID NO: 732734 - protein, 9 aa, Homo Sapiens
AGVDKIKDK

SEQ ID NO: 732735 - protein, 9 aa, Homo Sapiens
AATPDGMRT

SEQ ID NO: 732736 - protein, 9 aa, Homo Sapiens
PNRKLRRSN

SEQ ID NO: 732737 - protein, 9 aa, Homo Sapiens
GTWTRTLSP

SEQ ID NO: 732738 - protein, 9 aa, Homo Sapiens
KLLYEVQIL

SEQ ID NO: 732739 - protein, 9 aa, Homo Sapiens
RCVTTEPSS

SEQ ID NO: 732740 - protein, 9 aa, Homo Sapiens
CIILHKALS

SEQ ID NO: 732741 - protein, 9 aa, Homo Sapiens
RFQHVLVYF

SEQ ID NO: 732742 - protein, 9 aa, Homo Sapiens
HSDPRFQHV

SEQ ID NO: 732743 - protein, 9 aa, Homo Sapiens
SDGLAPPQD

SEQ ID NO: 732744 - protein, 9 aa, Homo Sapiens
TTHQFAFPT

SEQ ID NO: 732745 - protein, 9 aa, Homo Sapiens
HEIVHTGEK

SEQ ID NO: 732746 - protein, 9 aa, Homo Sapiens
LTAHKKIHA

SEQ ID NO: 732747 - protein, 9 aa, Homo Sapiens
QETEKIIPE

SEQ ID NO: 732748 - protein, 9 aa, Homo Sapiens
EQDIANRFK

SEQ ID NO: 732749 - protein, 9 aa, Homo Sapiens
PVICHVPLL

SEQ ID NO: 732750 - protein, 9 aa, Homo Sapiens
RRRLERLMG

SEQ ID NO: 732751 - protein, 9 aa, Homo Sapiens
IWDLEEGKT

SEQ ID NO: 732752 - protein, 9 aa, Homo Sapiens
RLERLMGQK

SEQ ID NO: 732753 - protein, 9 aa, Homo Sapiens
HHTFCNELR

SEQ ID NO: 732754 - protein, 9 aa, Homo Sapiens
PFTSMATSS

SEQ ID NO: 732755 - protein, 9 aa, Homo Sapiens
EIWKIVRSN

SEQ ID NO: 732756 - protein, 9 aa, Homo Sapiens
VSSGAKGES

SEQ ID NO: 732757 - protein, 9 aa, Homo Sapiens
NVWIINHLQ

SEQ ID NO: 732758 - protein, 9 aa, Homo Sapiens
ISTEEMTRK

SEQ ID NO: 732759 - protein, 9 aa, Homo Sapiens
DHKHRGGSG

SEQ ID NO: 732760 - protein, 9 aa, Homo Sapiens
IWHHTFCNE

SEQ ID NO: 732761 - protein, 9 aa, Homo Sapiens
IKQVYRQDC

SEQ ID NO: 732762 - protein, 9 aa, Homo Sapiens
VKLQLSDNK

SEQ ID NO: 732763 - protein, 9 aa, Homo Sapiens
VCIWDLEEG

SEQ ID NO: 732764 - protein, 9 aa, Homo Sapiens
VVVSLAFLL

SEQ ID NO: 732765 - protein, 9 aa, Homo Sapiens
RETHKIVPE

SEQ ID NO: 732766 - protein, 9 aa, Homo Sapiens
YEMFKALND

SEQ ID NO: 732767 - protein, 9 aa, Homo Sapiens
SMYSQIWRM

SEQ ID NO: 732768 - protein, 9 aa, Homo Sapiens
IAPVICHVP

SEQ ID NO: 732769 - protein, 9 aa, Homo Sapiens
TPMYFFINH

SEQ ID NO: 732770 - protein, 9 aa, Homo Sapiens
AVKLQLSDN

SEQ ID NO: 732771 - protein, 9 aa, Homo Sapiens
TVKDVETLI

SEQ ID NO: 732772 - protein, 9 aa, Homo Sapiens
ERMDYKKRK

SEQ ID NO: 732773 - protein, 9 aa, Homo Sapiens
PLKTLYVPN

SEQ ID NO: 732774 - protein, 9 aa, Homo Sapiens
IGFRLCNLL

SEQ ID NO: 732775 - protein, 9 aa, Homo Sapiens
YSLRTCYPR

SEQ ID NO: 732776 - protein, 9 aa, Homo Sapiens
YPPPFPVRP

SEQ ID NO: 732777 - protein, 9 aa, Homo Sapiens
KLPWKKYPL

SEQ ID NO: 732778 - protein, 9 aa, Homo Sapiens
EGLKPGTLC

SEQ ID NO: 732779 - protein, 9 aa, Homo Sapiens
LDGSISAAS

SEQ ID NO: 732780 - protein, 9 aa, Homo Sapiens
QRTSRLITG

SEQ ID NO: 732781 - protein, 9 aa, Homo Sapiens
IPRHAPQLH

SEQ ID NO: 732782 - protein, 9 aa, Homo Sapiens
QGQNNVFST

SEQ ID NO: 732783 - protein, 9 aa, Homo Sapiens
DGGSTCSQL

SEQ ID NO: 732784 - protein, 9 aa, Homo Sapiens
FKAPTIDIG

SEQ ID NO: 732785 - protein, 9 aa, Homo Sapiens
MEPEEWLST

SEQ ID NO: 732786 - protein, 9 aa, Homo Sapiens
KAVYDFTDT

SEQ ID NO: 732787 - protein, 9 aa, Homo Sapiens
DLPNYNWKS

SEQ ID NO: 732788 - protein, 9 aa, Homo Sapiens
SQIWRMINR

SEQ ID NO: 732789 - protein, 9 aa, Homo Sapiens
LNILQHLIP

SEQ ID NO: 732790 - protein, 9 aa, Homo Sapiens
CTVHLYQHQ

SEQ ID NO: 732791 - protein, 9 aa, Homo Sapiens
SDNLRQQNE

SEQ ID NO: 732792 - protein, 9 aa, Homo Sapiens
SQLPSVQHS

SEQ ID NO: 732793 - protein, 9 aa, Homo Sapiens
LSILEGEMQ

SEQ ID NO: 732794 - protein, 9 aa, Homo Sapiens
IEQQSEQNM

SEQ ID NO: 732795 - protein, 9 aa, Homo Sapiens
SCCWPRGTC

SEQ ID NO: 732796 - protein, 9 aa, Homo Sapiens
VQFSLVARV

SEQ ID NO: 732797 - protein, 9 aa, Homo Sapiens
GSVSSGEEH

SEQ ID NO: 732798 - protein, 9 aa, Homo Sapiens
EEMTRKISA

SEQ ID NO: 732799 - protein, 9 aa, Homo Sapiens
DTGKTETTK

SEQ ID NO: 732800 - protein, 9 aa, Homo Sapiens
TNNQLFFPS

SEQ ID NO: 732801 - protein, 9 aa, Homo Sapiens
EGKFSWRVI

SEQ ID NO: 732802 - protein, 9 aa, Homo Sapiens
IGKRLLGSK

SEQ ID NO: 732803 - protein, 9 aa, Homo Sapiens
RSCIILHKA

SEQ ID NO: 732804 - protein, 9 aa, Homo Sapiens
ALVVGVQHV

SEQ ID NO: 732805 - protein, 9 aa, Homo Sapiens
YEVQILEDS

SEQ ID NO: 732806 - protein, 9 aa, Homo Sapiens
PSCSAEPRL

SEQ ID NO: 732807 - protein, 9 aa, Homo Sapiens
FGKEAPYFY

SEQ ID NO: 732808 - protein, 9 aa, Homo Sapiens
TKNKSLLTF

SEQ ID NO: 732809 - protein, 9 aa, Homo Sapiens
TLILWLMIE

SEQ ID NO: 732810 - protein, 9 aa, Homo Sapiens
TYKGEKFPS

SEQ ID NO: 732811 - protein, 9 aa, Homo Sapiens
VWIINHLQE

SEQ ID NO: 732812 - protein, 9 aa, Homo Sapiens
EDAKVPAPP

SEQ ID NO: 732813 - protein, 9 aa, Homo Sapiens
SQKARPGGP

SEQ ID NO: 732814 - protein, 9 aa, Homo Sapiens
KVPAPPHQG

SEQ ID NO: 732815 - protein, 9 aa, Homo Sapiens
DVHGLESDT

SEQ ID NO: 732816 - protein, 9 aa, Homo Sapiens
KPRLGELSV

SEQ ID NO: 732817 - protein, 9 aa, Homo Sapiens
QLSDNKIID

SEQ ID NO: 732818 - protein, 9 aa, Homo Sapiens
ALVTQLAGV

SEQ ID NO: 732819 - protein, 9 aa, Homo Sapiens
KEEKPPFQS

SEQ ID NO: 732820 - protein, 9 aa, Homo Sapiens
AEFLVKSKD

SEQ ID NO: 732821 - protein, 9 aa, Homo Sapiens
KQIERYSCF

SEQ ID NO: 732822 - protein, 9 aa, Homo Sapiens
DEWPVASDN

SEQ ID NO: 732823 - protein, 9 aa, Homo Sapiens
EFNFSCKTY

SEQ ID NO: 732824 - protein, 9 aa, Homo Sapiens
STHLLVVSL

SEQ ID NO: 732825 - protein, 9 aa, Homo Sapiens
VDLSVARKS

SEQ ID NO: 732826 - protein, 9 aa, Homo Sapiens
GVLRVVKPL

SEQ ID NO: 732827 - protein, 9 aa, Homo Sapiens
RPGPVGGPV

SEQ ID NO: 732828 - protein, 9 aa, Homo Sapiens
EDVEREEQE

SEQ ID NO: 732829 - protein, 9 aa, Homo Sapiens
TQGNIFSAD

SEQ ID NO: 732830 - protein, 9 aa, Homo Sapiens
AILELCGDY

SEQ ID NO: 732831 - protein, 9 aa, Homo Sapiens
YSGNIAPVI

SEQ ID NO: 732832 - protein, 9 aa, Homo Sapiens
NIGQISTDF

SEQ ID NO: 732833 - protein, 9 aa, Homo Sapiens
PLGPKGPTG

SEQ ID NO: 732834 - protein, 9 aa, Homo Sapiens
LSPALASAP

SEQ ID NO: 732835 - protein, 9 aa, Homo Sapiens
FSAISVVKI

SEQ ID NO: 732836 - protein, 9 aa, Homo Sapiens
LNIGQISTD

SEQ ID NO: 732837 - protein, 9 aa, Homo Sapiens
FTLIPNRKL

SEQ ID NO: 732838 - protein, 9 aa, Homo Sapiens
SSWRSASCC

SEQ ID NO: 732839 - protein, 9 aa, Homo Sapiens
KCGNAMEQG

SEQ ID NO: 732840 - protein, 9 aa, Homo Sapiens
GLKPGTLCT

SEQ ID NO: 732841 - protein, 9 aa, Homo Sapiens
SGKPDDTFS

SEQ ID NO: 732842 - protein, 9 aa, Homo Sapiens
PALASAPEE

SEQ ID NO: 732843 - protein, 9 aa, Homo Sapiens
HQFAFPTGI

SEQ ID NO: 732844 - protein, 9 aa, Homo Sapiens
VMLRETVSS

SEQ ID NO: 732845 - protein, 9 aa, Homo Sapiens
CRDAAMHAL

SEQ ID NO: 732846 - protein, 9 aa, Homo Sapiens
QAALLEESA

SEQ ID NO: 732847 - protein, 9 aa, Homo Sapiens
KPERAGSSL

SEQ ID NO: 732848 - protein, 9 aa, Homo Sapiens
QAFSTCSTH

SEQ ID NO: 732849 - protein, 9 aa, Homo Sapiens
ELKPERAGS

SEQ ID NO: 732850 - protein, 9 aa, Homo Sapiens
PRAQEGLKP

SEQ ID NO: 732851 - protein, 9 aa, Homo Sapiens
KDVETLIKE

SEQ ID NO: 732852 - protein, 9 aa, Homo Sapiens
FRLGTWTRT

SEQ ID NO: 732853 - protein, 9 aa, Homo Sapiens
KGYSLRTCY

SEQ ID NO: 732854 - protein, 9 aa, Homo Sapiens
NWKSFGLRF

SEQ ID NO: 732855 - protein, 9 aa, Homo Sapiens
SNTEEPSTA

SEQ ID NO: 732856 - protein, 9 aa, Homo Sapiens
SDMLCKLAF

SEQ ID NO: 732857 - protein, 9 aa, Homo Sapiens
LTIPLSLVA

SEQ ID NO: 732858 - protein, 9 aa, Homo Sapiens
NQLFFPSYA

SEQ ID NO: 732859 - protein, 9 aa, Homo Sapiens
RTAQAIFDG

SEQ ID NO: 732860 - protein, 9 aa, Homo Sapiens
KSAEDAKAV

SEQ ID NO: 732861 - protein, 9 aa, Homo Sapiens
RACQRYTEI

SEQ ID NO: 732862 - protein, 9 aa, Homo Sapiens
PKQIERYSC

SEQ ID NO: 732863 - protein, 9 aa, Homo Sapiens
HLGLASSNL

SEQ ID NO: 732864 - protein, 9 aa, Homo Sapiens
LHRSMESHQ

SEQ ID NO: 732865 - protein, 9 aa, Homo Sapiens
PERAGSSLT

SEQ ID NO: 732866 - protein, 9 aa, Homo Sapiens
NTTDRNAVC

SEQ ID NO: 732867 - protein, 9 aa, Homo Sapiens
RLCNLLKLP

SEQ ID NO: 732868 - protein, 9 aa, Homo Sapiens
AQDRIHTHG

SEQ ID NO: 732869 - protein, 9 aa, Homo Sapiens
ESDNLRQQN

SEQ ID NO: 732870 - protein, 9 aa, Homo Sapiens
ILLTIPLSL

SEQ ID NO: 732871 - protein, 9 aa, Homo Sapiens
PILLNILQH

SEQ ID NO: 732872 - protein, 9 aa, Homo Sapiens
LIPPPPLPK

SEQ ID NO: 732873 - protein, 9 aa, Homo Sapiens
EAKYIPFTM

SEQ ID NO: 732874 - protein, 9 aa, Homo Sapiens
SGAAASQPP

SEQ ID NO: 732875 - protein, 9 aa, Homo Sapiens
LSDRKVLTR

SEQ ID NO: 732876 - protein, 9 aa, Homo Sapiens
VKFFYISQL

SEQ ID NO: 732877 - protein, 9 aa, Homo Sapiens
SDELPRHYR

SEQ ID NO: 732878 - protein, 9 aa, Homo Sapiens
EKANSDDEW

SEQ ID NO: 732879 - protein, 9 aa, Homo Sapiens
ALLVLLNQT

SEQ ID NO: 732880 - protein, 9 aa, Homo Sapiens
GFAGSLDGS

SEQ ID NO: 732881 - protein, 9 aa, Homo Sapiens
PHQGHPQDG

SEQ ID NO: 732882 - protein, 9 aa, Homo Sapiens
RFARSDELP

SEQ ID NO: 732883 - protein, 9 aa, Homo Sapiens
HFEPVVNAL

SEQ ID NO: 732884 - protein, 9 aa, Homo Sapiens
QVKFFYISQ

SEQ ID NO: 732885 - protein, 9 aa, Homo Sapiens
TVCIWDLEE

SEQ ID NO: 732886 - protein, 9 aa, Homo Sapiens
DPIMGSLNL

SEQ ID NO: 732887 - protein, 9 aa, Homo Sapiens
FAFPTGISM

SEQ ID NO: 732888 - protein, 9 aa, Homo Sapiens
KARPGGPAV

SEQ ID NO: 732889 - protein, 9 aa, Homo Sapiens
RRHISCSGC

SEQ ID NO: 732890 - protein, 9 aa, Homo Sapiens
WHHTFCNEL

SEQ ID NO: 732891 - protein, 9 aa, Homo Sapiens
GKTSGVSHR

SEQ ID NO: 732892 - protein, 9 aa, Homo Sapiens
SLLTQTVES

SEQ ID NO: 732893 - protein, 9 aa, Homo Sapiens
ASARAWSCS

SEQ ID NO: 732894 - protein, 9 aa, Homo Sapiens
GSRRGCLPS

SEQ ID NO: 732895 - protein, 9 aa, Homo Sapiens
EAGSVSSGE

SEQ ID NO: 732896 - protein, 9 aa, Homo Sapiens
QVQWRTYKG

SEQ ID NO: 732897 - protein, 9 aa, Homo Sapiens
SNDLNGLYD

SEQ ID NO: 732898 - protein, 9 aa, Homo Sapiens
EGEMQARDE

SEQ ID NO: 732899 - protein, 9 aa, Homo Sapiens
STEEMTRKI

SEQ ID NO: 732900 - protein, 9 aa, Homo Sapiens
RGGSGGSGG

SEQ ID NO: 732901 - protein, 9 aa, Homo Sapiens
STCSTHLLV

SEQ ID NO: 732902 - protein, 9 aa, Homo Sapiens
CASCGPTAS

SEQ ID NO: 732903 - protein, 9 aa, Homo Sapiens
SLTKKSPSH

SEQ ID NO: 732904 - protein, 9 aa, Homo Sapiens
FREDLALVT

SEQ ID NO: 732905 - protein, 9 aa, Homo Sapiens
YIEIFGRTK

SEQ ID NO: 732906 - protein, 9 aa, Homo Sapiens
LSSTLKKHE

SEQ ID NO: 732907 - protein, 9 aa, Homo Sapiens
CNTTDRNAV

SEQ ID NO: 732908 - protein, 9 aa, Homo Sapiens
TPPRPGRQV

SEQ ID NO: 732909 - protein, 9 aa, Homo Sapiens
LCCTVHLYQ

SEQ ID NO: 732910 - protein, 9 aa, Homo Sapiens
QLSTARRRE

SEQ ID NO: 732911 - protein, 9 aa, Homo Sapiens
GELKVVSGA

SEQ ID NO: 732912 - protein, 9 aa, Homo Sapiens
PKRKGHKER

SEQ ID NO: 732913 - protein, 9 aa, Homo Sapiens
ELSVTDATP

SEQ ID NO: 732914 - protein, 9 aa, Homo Sapiens
GGSRRGCLP

SEQ ID NO: 732915 - protein, 9 aa, Homo Sapiens
PPLPKNVAR

SEQ ID NO: 732916 - protein, 9 aa, Homo Sapiens
RKPCCGAET

SEQ ID NO: 732917 - protein, 9 aa, Homo Sapiens
TWTRTLSPH

SEQ ID NO: 732918 - protein, 9 aa, Homo Sapiens
EAILELCGD

SEQ ID NO: 732919 - protein, 9 aa, Homo Sapiens
AKYIPFTMY

SEQ ID NO: 732920 - protein, 9 aa, Homo Sapiens
LMTFQVKFF

SEQ ID NO: 732921 - protein, 9 aa, Homo Sapiens
FPTGISMTG

SEQ ID NO: 732922 - protein, 9 aa, Homo Sapiens
RTKQLNLSR

SEQ ID NO: 732923 - protein, 9 aa, Homo Sapiens
SNYSLHHVP

SEQ ID NO: 732924 - protein, 9 aa, Homo Sapiens
PDGMRTSGS

SEQ ID NO: 732925 - protein, 9 aa, Homo Sapiens
SKETLILWL

SEQ ID NO: 732926 - protein, 9 aa, Homo Sapiens
TLVVKRGDE

SEQ ID NO: 732927 - protein, 9 aa, Homo Sapiens
THKIVPEER

SEQ ID NO: 732928 - protein, 9 aa, Homo Sapiens
SCSGGSRRG

SEQ ID NO: 732929 - protein, 9 aa, Homo Sapiens
PSGPPPHSP

SEQ ID NO: 732930 - protein, 9 aa, Homo Sapiens
PLPKNVARM

SEQ ID NO: 732931 - protein, 9 aa, Homo Sapiens
GSTCSQLPS

SEQ ID NO: 732932 - protein, 9 aa, Homo Sapiens
APTIDIGPR

SEQ ID NO: 732933 - protein, 9 aa, Homo Sapiens
QELKPERAG

SEQ ID NO: 732934 - protein, 9 aa, Homo Sapiens
IFSADVHGL

SEQ ID NO: 732935 - protein, 9 aa, Homo Sapiens
SPDITGRAC

SEQ ID NO: 732936 - protein, 9 aa, Homo Sapiens
RRYLGSLPE

SEQ ID NO: 732937 - protein, 9 aa, Homo Sapiens
SGNIAPVIC

SEQ ID NO: 732938 - protein, 9 aa, Homo Sapiens
RCKVMLRET

SEQ ID NO: 732939 - protein, 9 aa, Homo Sapiens
ELHGEPTHI

SEQ ID NO: 732940 - protein, 9 aa, Homo Sapiens
GTQLSTARR

SEQ ID NO: 732941 - protein, 9 aa, Homo Sapiens
VETSVCCQL

SEQ ID NO: 732942 - protein, 9 aa, Homo Sapiens
GCDKHEFQD

SEQ ID NO: 732943 - protein, 9 aa, Homo Sapiens
GSLDGSISA

SEQ ID NO: 732944 - protein, 9 aa, Homo Sapiens
FEIRTTDNL

SEQ ID NO: 732945 - protein, 9 aa, Homo Sapiens
TARKPEASS

SEQ ID NO: 732946 - protein, 9 aa, Homo Sapiens
QRRYLGSLP

SEQ ID NO: 732947 - protein, 9 aa, Homo Sapiens
LEGEMQARD

SEQ ID NO: 732948 - protein, 9 aa, Homo Sapiens
AKQQPWWLK

SEQ ID NO: 732949 - protein, 9 aa, Homo Sapiens
GPADTGKTE

SEQ ID NO: 732950 - protein, 9 aa, Homo Sapiens
SFPIGKRLL

SEQ ID NO: 732951 - protein, 9 aa, Homo Sapiens
GVALVVGVQ

SEQ ID NO: 732952 - protein, 9 aa, Homo Sapiens
CQLPKLPEP

SEQ ID NO: 732953 - protein, 9 aa, Homo Sapiens
KPERKGKES

SEQ ID NO: 732954 - protein, 9 aa, Homo Sapiens
SSLWNLVVS

SEQ ID NO: 732955 - protein, 9 aa, Homo Sapiens
SRTQSTWMW

SEQ ID NO: 732956 - protein, 9 aa, Homo Sapiens
KDKALADTP

SEQ ID NO: 732957 - protein, 9 aa, Homo Sapiens
FFPSGPPPH

SEQ ID NO: 732958 - protein, 9 aa, Homo Sapiens
TKYWSSLWN

SEQ ID NO: 732959 - protein, 9 aa, Homo Sapiens
QSLNIGQIS

SEQ ID NO: 732960 - protein, 9 aa, Homo Sapiens
MWWSSRQRT

SEQ ID NO: 732961 - protein, 9 aa, Homo Sapiens
LEQLERPAE

SEQ ID NO: 732962 - protein, 9 aa, Homo Sapiens
EDLALVTQL

SEQ ID NO: 732963 - protein, 9 aa, Homo Sapiens
RGSQKARPG

SEQ ID NO: 732964 - protein, 9 aa, Homo Sapiens
GRERMDYKK

SEQ ID NO: 732965 - protein, 9 aa, Homo Sapiens
VLKAPSKVL

SEQ ID NO: 732966 - protein, 9 aa, Homo Sapiens
KRALCCTVH

SEQ ID NO: 732967 - protein, 9 aa, Homo Sapiens
ARSDELPRH

SEQ ID NO: 732968 - protein, 9 aa, Homo Sapiens
VKDVETLIK

SEQ ID NO: 732969 - protein, 9 aa, Homo Sapiens
DNLTEAWLQ

SEQ ID NO: 732970 - protein, 9 aa, Homo Sapiens
VQILEDSPV

SEQ ID NO: 732971 - protein, 9 aa, Homo Sapiens
KIVPEERLQ

SEQ ID NO: 732972 - protein, 9 aa, Homo Sapiens
LSVARKSEF

SEQ ID NO: 732973 - protein, 9 aa, Homo Sapiens
RQFGHDIHH

SEQ ID NO: 732974 - protein, 9 aa, Homo Sapiens
PGRQVETSV

SEQ ID NO: 732975 - protein, 9 aa, Homo Sapiens
TGQKPYECN

SEQ ID NO: 732976 - protein, 9 aa, Homo Sapiens
RLGRVQFSL

SEQ ID NO: 732977 - protein, 9 aa, Homo Sapiens
HGEPTHIQE

SEQ ID NO: 732978 - protein, 9 aa, Homo Sapiens
AAVRETHKI

SEQ ID NO: 732979 - protein, 9 aa, Homo Sapiens
YSCFSPSPL

SEQ ID NO: 732980 - protein, 9 aa, Homo Sapiens
SLPEGSGFC

SEQ ID NO: 732981 - protein, 9 aa, Homo Sapiens
PAGEIVAFD

SEQ ID NO: 732982 - protein, 9 aa, Homo Sapiens
SLISFGIHF

SEQ ID NO: 732983 - protein, 9 aa, Homo Sapiens
LSVRHYDRF

SEQ ID NO: 732984 - protein, 9 aa, Homo Sapiens
IPELNETWE

SEQ ID NO: 732985 - protein, 9 aa, Homo Sapiens
SCEGKFSWR

SEQ ID NO: 732986 - protein, 9 aa, Homo Sapiens
GQIEQQSEQ

SEQ ID NO: 732987 - protein, 9 aa, Homo Sapiens
RYLGSLPEG

SEQ ID NO: 732988 - protein, 9 aa, Homo Sapiens
LTKKSPSHK

SEQ ID NO: 732989 - protein, 9 aa, Homo Sapiens
ASKTKEIKQ

SEQ ID NO: 732990 - protein, 9 aa, Homo Sapiens
QGHPQDGVA

SEQ ID NO: 732991 - protein, 9 aa, Homo Sapiens
QAGREARQF

SEQ ID NO: 732992 - protein, 9 aa, Homo Sapiens
ETPQFFPSG

SEQ ID NO: 732993 - protein, 9 aa, Homo Sapiens
TLTKTTPAG

SEQ ID NO: 732994 - protein, 9 aa, Homo Sapiens
WQRTSRLIT

SEQ ID NO: 732995 - protein, 9 aa, Homo Sapiens
FSFDPEFTA

SEQ ID NO: 732996 - protein, 9 aa, Homo Sapiens
GVQHVDLSV

SEQ ID NO: 732997 - protein, 9 aa, Homo Sapiens
ILPRISGLV

SEQ ID NO: 732998 - protein, 9 aa, Homo Sapiens
EAALSFIKC

SEQ ID NO: 732999 - protein, 9 aa, Homo Sapiens
MTVKDVETL

SEQ ID NO: 733000 - protein, 9 aa, Homo Sapiens
DSTAMTLPV

SEQ ID NO: 733001 - protein, 9 aa, Homo Sapiens
IANRFKEFG

SEQ ID NO: 733002 - protein, 9 aa, Homo Sapiens
TDEDVEFSC

SEQ ID NO: 733003 - protein, 9 aa, Homo Sapiens
TPMPCRSSW

SEQ ID NO: 733004 - protein, 9 aa, Homo Sapiens
SLSDMLCKL

SEQ ID NO: 733005 - protein, 9 aa, Homo Sapiens
SEFSRTVYF

SEQ ID NO: 733006 - protein, 9 aa, Homo Sapiens
TAQAIFDGS

SEQ ID NO: 733007 - protein, 9 aa, Homo Sapiens
LPWKKYPLP

SEQ ID NO: 733008 - protein, 9 aa, Homo Sapiens
GPVSSGAKG

SEQ ID NO: 733009 - protein, 9 aa, Homo Sapiens
KKKNSKRKR

SEQ ID NO: 733010 - protein, 9 aa, Homo Sapiens
TWSCTPMPC

SEQ ID NO: 733011 - protein, 9 aa, Homo Sapiens
CVYSFYSRT

SEQ ID NO: 733012 - protein, 9 aa, Homo Sapiens
LNLFRLGTW

SEQ ID NO: 733013 - protein, 9 aa, Homo Sapiens
LSDMLCKLA

SEQ ID NO: 733014 - protein, 9 aa, Homo Sapiens
RRSSWRSAS

SEQ ID NO: 733015 - protein, 9 aa, Homo Sapiens
QAASPAPNP

SEQ ID NO: 733016 - protein, 9 aa, Homo Sapiens
PSKVLEDAK

SEQ ID NO: 733017 - protein, 9 aa, Homo Sapiens
ASTASNYPD

SEQ ID NO: 733018 - protein, 9 aa, Homo Sapiens
RAVNQRLKD

SEQ ID NO: 733019 - protein, 9 aa, Homo Sapiens
FPVRPNSSL

SEQ ID NO: 733020 - protein, 9 aa, Homo Sapiens
GWQRTSRLI

SEQ ID NO: 733021 - protein, 9 aa, Homo Sapiens
ALCRDAAMH

SEQ ID NO: 733022 - protein, 9 aa, Homo Sapiens
RKSEFSRTV

SEQ ID NO: 733023 - protein, 9 aa, Homo Sapiens
RVQFSLVAR

SEQ ID NO: 733024 - protein, 9 aa, Homo Sapiens
NIAPVICHV

SEQ ID NO: 733025 - protein, 9 aa, Homo Sapiens
PCASCGPTA

SEQ ID NO: 733026 - protein, 9 aa, Homo Sapiens
RHAGSLLDI

SEQ ID NO: 733027 - protein, 9 aa, Homo Sapiens
YQDVPGIEK

SEQ ID NO: 733028 - protein, 9 aa, Homo Sapiens
AVYDFTDTV

SEQ ID NO: 733029 - protein, 9 aa, Homo Sapiens
INHLSLIDL

SEQ ID NO: 733030 - protein, 9 aa, Homo Sapiens
LVARVCKRD

SEQ ID NO: 733031 - protein, 9 aa, Homo Sapiens
SSCRRRSSW

SEQ ID NO: 733032 - protein, 9 aa, Homo Sapiens
EPSLCAHVE

SEQ ID NO: 733033 - protein, 9 aa, Homo Sapiens
CVLPSLTKK

SEQ ID NO: 733034 - protein, 9 aa, Homo Sapiens
SHGPHGWQR

SEQ ID NO: 733035 - protein, 9 aa, Homo Sapiens
SKNQPLDAG

SEQ ID NO: 733036 - protein, 9 aa, Homo Sapiens
TKEIKQVYR

SEQ ID NO: 733037 - protein, 9 aa, Homo Sapiens
DGLAPPQDL

SEQ ID NO: 733038 - protein, 9 aa, Homo Sapiens
FPSCEGKFS

SEQ ID NO: 733039 - protein, 9 aa, Homo Sapiens
PSTASTASN

SEQ ID NO: 733040 - protein, 9 aa, Homo Sapiens
SAAGSGSRR

SEQ ID NO: 733041 - protein, 9 aa, Homo Sapiens
NHLVMHQLR

SEQ ID NO: 733042 - protein, 9 aa, Homo Sapiens
FQVKFFYIS

SEQ ID NO: 733043 - protein, 9 aa, Homo Sapiens
APQLHTLAH

SEQ ID NO: 733044 - protein, 9 aa, Homo Sapiens
NDLNGLYDS

SEQ ID NO: 733045 - protein, 9 aa, Homo Sapiens
NFSCKTYQE

SEQ ID NO: 733046 - protein, 9 aa, Homo Sapiens
RSASCCWPR

SEQ ID NO: 733047 - protein, 9 aa, Homo Sapiens
LWNLVVSLL

SEQ ID NO: 733048 - protein, 9 aa, Homo Sapiens
QDGGSTCSQ

SEQ ID NO: 733049 - protein, 9 aa, Homo Sapiens
DCYSLLRRL

SEQ ID NO: 733050 - protein, 9 aa, Homo Sapiens
PPPCASCGP

SEQ ID NO: 733051 - protein, 9 aa, Homo Sapiens
IPVFGDKEP

SEQ ID NO: 733052 - protein, 9 aa, Homo Sapiens
GVLDKLRCV

SEQ ID NO: 733053 - protein, 9 aa, Homo Sapiens
SNGVQTMVV

SEQ ID NO: 733054 - protein, 9 aa, Homo Sapiens
CEGKFSWRV

SEQ ID NO: 733055 - protein, 9 aa, Homo Sapiens
FSQPFPSGV

SEQ ID NO: 733056 - protein, 9 aa, Homo Sapiens
PQVQWRTYK

SEQ ID NO: 733057 - protein, 9 aa, Homo Sapiens
PGEPGPLGP

SEQ ID NO: 733058 - protein, 9 aa, Homo Sapiens
AGPKRKGHK

SEQ ID NO: 733059 - protein, 9 aa, Homo Sapiens
SCSILPRIS

SEQ ID NO: 733060 - protein, 9 aa, Homo Sapiens
NQLEGVKQQ

SEQ ID NO: 733061 - protein, 9 aa, Homo Sapiens
GRQVETSVC

SEQ ID NO: 733062 - protein, 9 aa, Homo Sapiens
SSNYEQEYK

SEQ ID NO: 733063 - protein, 9 aa, Homo Sapiens
ITSIPESRL

SEQ ID NO: 733064 - protein, 9 aa, Homo Sapiens
ALSPALASA

SEQ ID NO: 733065 - protein, 9 aa, Homo Sapiens
HEKTHTGQK

SEQ ID NO: 733066 - protein, 9 aa, Homo Sapiens
QSSSPVQLN

SEQ ID NO: 733067 - protein, 9 aa, Homo Sapiens
KPGTLCTVA

SEQ ID NO: 733068 - protein, 9 aa, Homo Sapiens
IPFTMYTTC

SEQ ID NO: 733069 - protein, 9 aa, Homo Sapiens
KISFPIGKR

SEQ ID NO: 733070 - protein, 9 aa, Homo Sapiens
GDYDDVQRE

SEQ ID NO: 733071 - protein, 9 aa, Homo Sapiens
SDLRAVNQR

SEQ ID NO: 733072 - protein, 9 aa, Homo Sapiens
DLTALCRDA

SEQ ID NO: 733073 - protein, 9 aa, Homo Sapiens
SRVILTVYV

SEQ ID NO: 733074 - protein, 9 aa, Homo Sapiens
KLSITVTYD

SEQ ID NO: 733075 - protein, 9 aa, Homo Sapiens
ILLNILQHL

SEQ ID NO: 733076 - protein, 9 aa, Homo Sapiens
KANSDDEWP

SEQ ID NO: 733077 - protein, 9 aa, Homo Sapiens
PQDLIRVEG

SEQ ID NO: 733078 - protein, 9 aa, Homo Sapiens
CQRYTEITR

SEQ ID NO: 733079 - protein, 9 aa, Homo Sapiens
MRTSGSIQQ

SEQ ID NO: 733080 - protein, 9 aa, Homo Sapiens
RLITGRGTL

SEQ ID NO: 733081 - protein, 9 aa, Homo Sapiens
VRKFAQSIS

SEQ ID NO: 733082 - protein, 9 aa, Homo Sapiens
PSLTKKSPS

SEQ ID NO: 733083 - protein, 9 aa, Homo Sapiens
ISLSDMLCK

SEQ ID NO: 733084 - protein, 9 aa, Homo Sapiens
SGIPVFGDK

SEQ ID NO: 733085 - protein, 9 aa, Homo Sapiens
ALLEESALL

SEQ ID NO: 733086 - protein, 9 aa, Homo Sapiens
SCRRRSSWR

SEQ ID NO: 733087 - protein, 9 aa, Homo Sapiens
CKVMLRETV

SEQ ID NO: 733088 - protein, 9 aa, Homo Sapiens
VLCILGSGV

SEQ ID NO: 733089 - protein, 9 aa, Homo Sapiens
CTLCMRLFY

SEQ ID NO: 733090 - protein, 9 aa, Homo Sapiens
QEYKIMFVV

SEQ ID NO: 733091 - protein, 9 aa, Homo Sapiens
YSRTQSTWM

SEQ ID NO: 733092 - protein, 9 aa, Homo Sapiens
CRPGFMGTY

SEQ ID NO: 733093 - protein, 9 aa, Homo Sapiens
VGGPVSSGA

SEQ ID NO: 733094 - protein, 9 aa, Homo Sapiens
ALSDLRAVN

SEQ ID NO: 733095 - protein, 9 aa, Homo Sapiens
LGSGVQAYS

SEQ ID NO: 733096 - protein, 9 aa, Homo Sapiens
GGAPAGPAD

SEQ ID NO: 733097 - protein, 9 aa, Homo Sapiens
GQISTDFLK

SEQ ID NO: 733098 - protein, 9 aa, Homo Sapiens
YEDPKEAVR

SEQ ID NO: 733099 - protein, 9 aa, Homo Sapiens
GLYDSFKFW

SEQ ID NO: 733100 - protein, 9 aa, Homo Sapiens
FYSRTQSTW

SEQ ID NO: 733101 - protein, 9 aa, Homo Sapiens
GAETWPPPC

SEQ ID NO: 733102 - protein, 9 aa, Homo Sapiens
TNSNVESEL

SEQ ID NO: 733103 - protein, 9 aa, Homo Sapiens
LLNILQHLI

SEQ ID NO: 733104 - protein, 9 aa, Homo Sapiens
APAGPADTG

SEQ ID NO: 733105 - protein, 9 aa, Homo Sapiens
EMQARDEVI

SEQ ID NO: 733106 - protein, 9 aa, Homo Sapiens
CSATGHNLS

SEQ ID NO: 733107 - protein, 9 aa, Homo Sapiens
SIPESRLVQ

SEQ ID NO: 733108 - protein, 9 aa, Homo Sapiens
KQRKNVWII

SEQ ID NO: 733109 - protein, 9 aa, Homo Sapiens
PSGSSPSCS

SEQ ID NO: 733110 - protein, 9 aa, Homo Sapiens
VKSKDRDLT

SEQ ID NO: 733111 - protein, 9 aa, Homo Sapiens
PGHEEGFDY

SEQ ID NO: 733112 - protein, 9 aa, Homo Sapiens
HCHTANIQT

SEQ ID NO: 733113 - protein, 9 aa, Homo Sapiens
SAGGAPTPA

SEQ ID NO: 733114 - protein, 9 aa, Homo Sapiens
QASPQQEPE

SEQ ID NO: 733115 - protein, 9 aa, Homo Sapiens
PPTQPKVSK

SEQ ID NO: 733116 - protein, 9 aa, Homo Sapiens
FGSGSGPMT

SEQ ID NO: 733117 - protein, 9 aa, Homo Sapiens
APQLGLATQ

SEQ ID NO: 733118 - protein, 9 aa, Homo Sapiens
HCPPSPAKP

SEQ ID NO: 733119 - protein, 9 aa, Homo Sapiens
SSISSSNSN

SEQ ID NO: 733120 - protein, 9 aa, Homo Sapiens
LAVTSLSSV

SEQ ID NO: 733121 - protein, 9 aa, Homo Sapiens
EDMDKIEKI

SEQ ID NO: 733122 - protein, 9 aa, Homo Sapiens
LIRGLQQDV

SEQ ID NO: 733123 - protein, 9 aa, Homo Sapiens
GAQKSIKAM

SEQ ID NO: 733124 - protein, 9 aa, Homo Sapiens
IPHHMKPLP

SEQ ID NO: 733125 - protein, 9 aa, Homo Sapiens
LNAEDMDKI

SEQ ID NO: 733126 - protein, 9 aa, Homo Sapiens
IQQDSACKV

SEQ ID NO: 733127 - protein, 9 aa, Homo Sapiens
ESLGLSLNN

SEQ ID NO: 733128 - protein, 9 aa, Homo Sapiens
KNQYQLLKL

SEQ ID NO: 733129 - protein, 9 aa, Homo Sapiens
INHGKIYSG

SEQ ID NO: 733130 - protein, 9 aa, Homo Sapiens
RKKQIDVAM

SEQ ID NO: 733131 - protein, 9 aa, Homo Sapiens
WLSMYCVNQ

SEQ ID NO: 733132 - protein, 9 aa, Homo Sapiens
SRGIGDSVL

SEQ ID NO: 733133 - protein, 9 aa, Homo Sapiens
AQPHVPPAR

SEQ ID NO: 733134 - protein, 9 aa, Homo Sapiens
NLAAGVYEE

SEQ ID NO: 733135 - protein, 9 aa, Homo Sapiens
APREPAGWP

SEQ ID NO: 733136 - protein, 9 aa, Homo Sapiens
QCRFWISFF

SEQ ID NO: 733137 - protein, 9 aa, Homo Sapiens
DPVPTNFPL

SEQ ID NO: 733138 - protein, 9 aa, Homo Sapiens
EGTLALLNN

SEQ ID NO: 733139 - protein, 9 aa, Homo Sapiens
NDWTLQNCD

SEQ ID NO: 733140 - protein, 9 aa, Homo Sapiens
NSGRRIWCT

SEQ ID NO: 733141 - protein, 9 aa, Homo Sapiens
DPKYVGLVL

SEQ ID NO: 733142 - protein, 9 aa, Homo Sapiens
SSNSGRRIW

SEQ ID NO: 733143 - protein, 9 aa, Homo Sapiens
IPKVDAYVM

SEQ ID NO: 733144 - protein, 9 aa, Homo Sapiens
LAPQTCTPS

SEQ ID NO: 733145 - protein, 9 aa, Homo Sapiens
NSGRLIHLA

SEQ ID NO: 733146 - protein, 9 aa, Homo Sapiens
NLSFTDFCY

SEQ ID NO: 733147 - protein, 9 aa, Homo Sapiens
DPVLLEDKT

SEQ ID NO: 733148 - protein, 9 aa, Homo Sapiens
KGRGAQRDT

SEQ ID NO: 733149 - protein, 9 aa, Homo Sapiens
MQNGECRGV

SEQ ID NO: 733150 - protein, 9 aa, Homo Sapiens
YEERSEAND

SEQ ID NO: 733151 - protein, 9 aa, Homo Sapiens
WTVQEGAIS

SEQ ID NO: 733152 - protein, 9 aa, Homo Sapiens
VRLYYKKCP

SEQ ID NO: 733153 - protein, 9 aa, Homo Sapiens
IRGLQQDVK

SEQ ID NO: 733154 - protein, 9 aa, Homo Sapiens
RLFSRFHDG

SEQ ID NO: 733155 - protein, 9 aa, Homo Sapiens
YMDDIEKGN

SEQ ID NO: 733156 - protein, 9 aa, Homo Sapiens
PLSASQPSV

SEQ ID NO: 733157 - protein, 9 aa, Homo Sapiens
PAARPPYPA

SEQ ID NO: 733158 - protein, 9 aa, Homo Sapiens
DVLDTDGDK

SEQ ID NO: 733159 - protein, 9 aa, Homo Sapiens
AEGQDGHVP

SEQ ID NO: 733160 - protein, 9 aa, Homo Sapiens
NHGKIYSGE

SEQ ID NO: 733161 - protein, 9 aa, Homo Sapiens
RREHLGKLH

SEQ ID NO: 733162 - protein, 9 aa, Homo Sapiens
HGGLNGQVA

SEQ ID NO: 733163 - protein, 9 aa, Homo Sapiens
AQQCRFWIS

SEQ ID NO: 733164 - protein, 9 aa, Homo Sapiens
LRDYDPDEC

SEQ ID NO: 733165 - protein, 9 aa, Homo Sapiens
PPKAEKEQT

SEQ ID NO: 733166 - protein, 9 aa, Homo Sapiens
PKAEKEQTC

SEQ ID NO: 733167 - protein, 9 aa, Homo Sapiens
IMWITYMVF

SEQ ID NO: 733168 - protein, 9 aa, Homo Sapiens
PTLELPAPE

SEQ ID NO: 733169 - protein, 9 aa, Homo Sapiens
LSASQPSVP

SEQ ID NO: 733170 - protein, 9 aa, Homo Sapiens
SQNKEEVVE

SEQ ID NO: 733171 - protein, 9 aa, Homo Sapiens
GDSRQPQAS

SEQ ID NO: 733172 - protein, 9 aa, Homo Sapiens
GFLADFLVC

SEQ ID NO: 733173 - protein, 9 aa, Homo Sapiens
LHLHYQKDK

SEQ ID NO: 733174 - protein, 9 aa, Homo Sapiens
PLEDPFWAL

SEQ ID NO: 733175 - protein, 9 aa, Homo Sapiens
PGFPGVPGM

SEQ ID NO: 733176 - protein, 9 aa, Homo Sapiens
PKVSKPDLP

SEQ ID NO: 733177 - protein, 9 aa, Homo Sapiens
VDVFEKKDK

SEQ ID NO: 733178 - protein, 9 aa, Homo Sapiens
DYDRYLAIC

SEQ ID NO: 733179 - protein, 9 aa, Homo Sapiens
EYCTDEGFI

SEQ ID NO: 733180 - protein, 9 aa, Homo Sapiens
CRLTAQRIS

SEQ ID NO: 733181 - protein, 9 aa, Homo Sapiens
PVPTNFPLR

SEQ ID NO: 733182 - protein, 9 aa, Homo Sapiens
EEGSGGHAQ

SEQ ID NO: 733183 - protein, 9 aa, Homo Sapiens
DMNVKDNAG

SEQ ID NO: 733184 - protein, 9 aa, Homo Sapiens
KETLESKHN

SEQ ID NO: 733185 - protein, 9 aa, Homo Sapiens
FPGVPGMPG

SEQ ID NO: 733186 - protein, 9 aa, Homo Sapiens
VKAMPLVEQ

SEQ ID NO: 733187 - protein, 9 aa, Homo Sapiens
YTGEKPYEC

SEQ ID NO: 733188 - protein, 9 aa, Homo Sapiens
AQTCQCLNG

SEQ ID NO: 733189 - protein, 9 aa, Homo Sapiens
SRECEIPHH

SEQ ID NO: 733190 - protein, 9 aa, Homo Sapiens
VQSELRDYD

SEQ ID NO: 733191 - protein, 9 aa, Homo Sapiens
GQAPCSSSI

SEQ ID NO: 733192 - protein, 9 aa, Homo Sapiens
TPFDGDLNK

SEQ ID NO: 733193 - protein, 9 aa, Homo Sapiens
YLVDVFEKK

SEQ ID NO: 733194 - protein, 9 aa, Homo Sapiens
VAQLLAGIR

SEQ ID NO: 733195 - protein, 9 aa, Homo Sapiens
PYPAAVYAG

SEQ ID NO: 733196 - protein, 9 aa, Homo Sapiens
RPLAGLLSS

SEQ ID NO: 733197 - protein, 9 aa, Homo Sapiens
FLKYMDDIE

SEQ ID NO: 733198 - protein, 9 aa, Homo Sapiens
RDPVPTNFP

SEQ ID NO: 733199 - protein, 9 aa, Homo Sapiens
LESKHNVTK

SEQ ID NO: 733200 - protein, 9 aa, Homo Sapiens
ETLTQLGVL

SEQ ID NO: 733201 - protein, 9 aa, Homo Sapiens
ELAGPERIT

SEQ ID NO: 733202 - protein, 9 aa, Homo Sapiens
GKVGFCSIL

SEQ ID NO: 733203 - protein, 9 aa, Homo Sapiens
CRCSFRSRP

SEQ ID NO: 733204 - protein, 9 aa, Homo Sapiens
STDAAPQLG

SEQ ID NO: 733205 - protein, 9 aa, Homo Sapiens
VPLMLSNTL

SEQ ID NO: 733206 - protein, 9 aa, Homo Sapiens
ALFYTVITP

SEQ ID NO: 733207 - protein, 9 aa, Homo Sapiens
ATPGHFSTT

SEQ ID NO: 733208 - protein, 9 aa, Homo Sapiens
ATSLIQADK

SEQ ID NO: 733209 - protein, 9 aa, Homo Sapiens
KPLKATISP

SEQ ID NO: 733210 - protein, 9 aa, Homo Sapiens
RRDSHKGVS

SEQ ID NO: 733211 - protein, 9 aa, Homo Sapiens
PAGVPEMLK

SEQ ID NO: 733212 - protein, 9 aa, Homo Sapiens
YFGSGSGPM

SEQ ID NO: 733213 - protein, 9 aa, Homo Sapiens
LESITCKLQ

SEQ ID NO: 733214 - protein, 9 aa, Homo Sapiens
LALKECLRI

SEQ ID NO: 733215 - protein, 9 aa, Homo Sapiens
SSSTQEDES

SEQ ID NO: 733216 - protein, 9 aa, Homo Sapiens
AEDLPYEEE

SEQ ID NO: 733217 - protein, 9 aa, Homo Sapiens
LRKWYNLII

SEQ ID NO: 733218 - protein, 9 aa, Homo Sapiens
AEHRNRSQS

SEQ ID NO: 733219 - protein, 9 aa, Homo Sapiens
GYAGPRGDS

SEQ ID NO: 733220 - protein, 9 aa, Homo Sapiens
CFGFLPSIY

SEQ ID NO: 733221 - protein, 9 aa, Homo Sapiens
KRMAIESLF

SEQ ID NO: 733222 - protein, 9 aa, Homo Sapiens
PLLSFASGG

SEQ ID NO: 733223 - protein, 9 aa, Homo Sapiens
GHQITEEEW

SEQ ID NO: 733224 - protein, 9 aa, Homo Sapiens
TYMVFLLVF

SEQ ID NO: 733225 - protein, 9 aa, Homo Sapiens
DPGYAGPRG

SEQ ID NO: 733226 - protein, 9 aa, Homo Sapiens
QDDSSGTCH

SEQ ID NO: 733227 - protein, 9 aa, Homo Sapiens
MDVLDTDGD

SEQ ID NO: 733228 - protein, 9 aa, Homo Sapiens
HEDEMEIYG

SEQ ID NO: 733229 - protein, 9 aa, Homo Sapiens
LDICIHSSP

SEQ ID NO: 733230 - protein, 9 aa, Homo Sapiens
RELGFFQPS

SEQ ID NO: 733231 - protein, 9 aa, Homo Sapiens
FVFLDICIH

SEQ ID NO: 733232 - protein, 9 aa, Homo Sapiens
AGSRRPRIC

SEQ ID NO: 733233 - protein, 9 aa, Homo Sapiens
ELQMEKVQL

SEQ ID NO: 733234 - protein, 9 aa, Homo Sapiens
NSPFVLYLL

SEQ ID NO: 733235 - protein, 9 aa, Homo Sapiens
TVQEGAISE

SEQ ID NO: 733236 - protein, 9 aa, Homo Sapiens
VVLMAHGSE

SEQ ID NO: 733237 - protein, 9 aa, Homo Sapiens
ELGFFQPSG

SEQ ID NO: 733238 - protein, 9 aa, Homo Sapiens
ASNNHWFHS

SEQ ID NO: 733239 - protein, 9 aa, Homo Sapiens
GAISEVLVD

SEQ ID NO: 733240 - protein, 9 aa, Homo Sapiens
TTTVVQIIL

SEQ ID NO: 733241 - protein, 9 aa, Homo Sapiens
TLELPAPEA

SEQ ID NO: 733242 - protein, 9 aa, Homo Sapiens
AMLGERVLN

SEQ ID NO: 733243 - protein, 9 aa, Homo Sapiens
AAEDQAFLP

SEQ ID NO: 733244 - protein, 9 aa, Homo Sapiens
ISKGCVVPL

SEQ ID NO: 733245 - protein, 9 aa, Homo Sapiens
NQGHEDEME

SEQ ID NO: 733246 - protein, 9 aa, Homo Sapiens
HVPPARQPC

SEQ ID NO: 733247 - protein, 9 aa, Homo Sapiens
FLPRDYLAI

SEQ ID NO: 733248 - protein, 9 aa, Homo Sapiens
CASYNCAIS

SEQ ID NO: 733249 - protein, 9 aa, Homo Sapiens
DHNTLLHFF

SEQ ID NO: 733250 - protein, 9 aa, Homo Sapiens
LSKHQIIHL

SEQ ID NO: 733251 - protein, 9 aa, Homo Sapiens
GSGPMTLDD

SEQ ID NO: 733252 - protein, 9 aa, Homo Sapiens
VYPTLPQAN

SEQ ID NO: 733253 - protein, 9 aa, Homo Sapiens
GSMYLNALV

SEQ ID NO: 733254 - protein, 9 aa, Homo Sapiens
PLVQLTFCR

SEQ ID NO: 733255 - protein, 9 aa, Homo Sapiens
FGWMPQAAP

SEQ ID NO: 733256 - protein, 9 aa, Homo Sapiens
PVGRKLKEK

SEQ ID NO: 733257 - protein, 9 aa, Homo Sapiens
DQSDKAQEK

SEQ ID NO: 733258 - protein, 9 aa, Homo Sapiens
NQGTVCTLE

SEQ ID NO: 733259 - protein, 9 aa, Homo Sapiens
SMLSSPAAS

SEQ ID NO: 733260 - protein, 9 aa, Homo Sapiens
AVQQLRQAT

SEQ ID NO: 733261 - protein, 9 aa, Homo Sapiens
MKGPRSLPP

SEQ ID NO: 733262 - protein, 9 aa, Homo Sapiens
RRGQQPANL

SEQ ID NO: 733263 - protein, 9 aa, Homo Sapiens
SFHGGLNGQ

SEQ ID NO: 733264 - protein, 9 aa, Homo Sapiens
MDYDRYLAI

SEQ ID NO: 733265 - protein, 9 aa, Homo Sapiens
AEKEQTCPV

SEQ ID NO: 733266 - protein, 9 aa, Homo Sapiens
SSNSSNSSS

SEQ ID NO: 733267 - protein, 9 aa, Homo Sapiens
RGQQPANLR

SEQ ID NO: 733268 - protein, 9 aa, Homo Sapiens
REEDEPEEQ

SEQ ID NO: 733269 - protein, 9 aa, Homo Sapiens
AYTWFNLQV

SEQ ID NO: 733270 - protein, 9 aa, Homo Sapiens
MRRLVGCIS

SEQ ID NO: 733271 - protein, 9 aa, Homo Sapiens
LYLVYQQWT

SEQ ID NO: 733272 - protein, 9 aa, Homo Sapiens
ILSDPNDIS

SEQ ID NO: 733273 - protein, 9 aa, Homo Sapiens
GMNFTHCHT

SEQ ID NO: 733274 - protein, 9 aa, Homo Sapiens
CIWGPSGWG

SEQ ID NO: 733275 - protein, 9 aa, Homo Sapiens
MHCYLYLVY

SEQ ID NO: 733276 - protein, 9 aa, Homo Sapiens
ANLSSTGSM

SEQ ID NO: 733277 - protein, 9 aa, Homo Sapiens
YVVHRPGTP

SEQ ID NO: 733278 - protein, 9 aa, Homo Sapiens
LQAGDWSPC

SEQ ID NO: 733279 - protein, 9 aa, Homo Sapiens
KECRKTFSH

SEQ ID NO: 733280 - protein, 9 aa, Homo Sapiens
IVHQKTYRR

SEQ ID NO: 733281 - protein, 9 aa, Homo Sapiens
NGHSLQYPS

SEQ ID NO: 733282 - protein, 9 aa, Homo Sapiens
TCTPSLTSS

SEQ ID NO: 733283 - protein, 9 aa, Homo Sapiens
SGACCSLHH

SEQ ID NO: 733284 - protein, 9 aa, Homo Sapiens
IKLHGILIL

SEQ ID NO: 733285 - protein, 9 aa, Homo Sapiens
QPVLFAMFS

SEQ ID NO: 733286 - protein, 9 aa, Homo Sapiens
DPVVNRERS

SEQ ID NO: 733287 - protein, 9 aa, Homo Sapiens
ADFGWMPQA

SEQ ID NO: 733288 - protein, 9 aa, Homo Sapiens
SLLYLTPSR

SEQ ID NO: 733289 - protein, 9 aa, Homo Sapiens
WCTTPLTTT

SEQ ID NO: 733290 - protein, 9 aa, Homo Sapiens
VPTNFPLRC

SEQ ID NO: 733291 - protein, 9 aa, Homo Sapiens
LAGPPETGK

SEQ ID NO: 733292 - protein, 9 aa, Homo Sapiens
VRHRWTHHG

SEQ ID NO: 733293 - protein, 9 aa, Homo Sapiens
RNDWTLQNC

SEQ ID NO: 733294 - protein, 9 aa, Homo Sapiens
PPLVMAAFD

SEQ ID NO: 733295 - protein, 9 aa, Homo Sapiens
AEEKKEEPE

SEQ ID NO: 733296 - protein, 9 aa, Homo Sapiens
NSSSNSSNS

SEQ ID NO: 733297 - protein, 9 aa, Homo Sapiens
LELPAPEAV

SEQ ID NO: 733298 - protein, 9 aa, Homo Sapiens
LFTSLVSGV

SEQ ID NO: 733299 - protein, 9 aa, Homo Sapiens
MLSSPAAST

SEQ ID NO: 733300 - protein, 9 aa, Homo Sapiens
RCFPQPPRC

SEQ ID NO: 733301 - protein, 9 aa, Homo Sapiens
PLAGLLSSR

SEQ ID NO: 733302 - protein, 9 aa, Homo Sapiens
NRALRAELL

SEQ ID NO: 733303 - protein, 9 aa, Homo Sapiens
KLYSLSLLY

SEQ ID NO: 733304 - protein, 9 aa, Homo Sapiens
TTQIEPSAA

SEQ ID NO: 733305 - protein, 9 aa, Homo Sapiens
LPASHPLFG

SEQ ID NO: 733306 - protein, 9 aa, Homo Sapiens
EKKEEPEAE

SEQ ID NO: 733307 - protein, 9 aa, Homo Sapiens
RLQLYQGFH

SEQ ID NO: 733308 - protein, 9 aa, Homo Sapiens
HCLIMISLY

SEQ ID NO: 733309 - protein, 9 aa, Homo Sapiens
NVRLLENVP

SEQ ID NO: 733310 - protein, 9 aa, Homo Sapiens
MASPNWSIV

SEQ ID NO: 733311 - protein, 9 aa, Homo Sapiens
MWITYMVFL

SEQ ID NO: 733312 - protein, 9 aa, Homo Sapiens
MEGALGTAR

SEQ ID NO: 733313 - protein, 9 aa, Homo Sapiens
LGGLEACTR

SEQ ID NO: 733314 - protein, 9 aa, Homo Sapiens
HLRGPADFG

SEQ ID NO: 733315 - protein, 9 aa, Homo Sapiens
WTHHGENPY

SEQ ID NO: 733316 - protein, 9 aa, Homo Sapiens
ELRDYDPDE

SEQ ID NO: 733317 - protein, 9 aa, Homo Sapiens
KINEIYSGC

SEQ ID NO: 733318 - protein, 9 aa, Homo Sapiens
PSSEGLGIV

SEQ ID NO: 733319 - protein, 9 aa, Homo Sapiens
PEPIGVGGG

SEQ ID NO: 733320 - protein, 9 aa, Homo Sapiens
MVKEVGKTI

SEQ ID NO: 733321 - protein, 9 aa, Homo Sapiens
EGVLSLTAA

SEQ ID NO: 733322 - protein, 9 aa, Homo Sapiens
SNSSNSSSS

SEQ ID NO: 733323 - protein, 9 aa, Homo Sapiens
TAKHLNDES

SEQ ID NO: 733324 - protein, 9 aa, Homo Sapiens
WCLDGEHIL

SEQ ID NO: 733325 - protein, 9 aa, Homo Sapiens
IVPEEERNI

SEQ ID NO: 733326 - protein, 9 aa, Homo Sapiens
PTAACSTRS

SEQ ID NO: 733327 - protein, 9 aa, Homo Sapiens
KYMDDIEKG

SEQ ID NO: 733328 - protein, 9 aa, Homo Sapiens
FRSRPAPSL

SEQ ID NO: 733329 - protein, 9 aa, Homo Sapiens
SLLFNIGAL

SEQ ID NO: 733330 - protein, 9 aa, Homo Sapiens
DAGCQELAG

SEQ ID NO: 733331 - protein, 9 aa, Homo Sapiens
YEELGGLEA

SEQ ID NO: 733332 - protein, 9 aa, Homo Sapiens
HDAMSAAFQ

SEQ ID NO: 733333 - protein, 9 aa, Homo Sapiens
QDKPEEQWW

SEQ ID NO: 733334 - protein, 9 aa, Homo Sapiens
ELKHEIHVC

SEQ ID NO: 733335 - protein, 9 aa, Homo Sapiens
CQELAGPER

SEQ ID NO: 733336 - protein, 9 aa, Homo Sapiens
LAAWHPIKL

SEQ ID NO: 733337 - protein, 9 aa, Homo Sapiens
MHAQAAVAG

SEQ ID NO: 733338 - protein, 9 aa, Homo Sapiens
YPEPVYPTL

SEQ ID NO: 733339 - protein, 9 aa, Homo Sapiens
EDDPVVNRE

SEQ ID NO: 733340 - protein, 9 aa, Homo Sapiens
NCLVLWTVF

SEQ ID NO: 733341 - protein, 9 aa, Homo Sapiens
DLDFLKYMD

SEQ ID NO: 733342 - protein, 9 aa, Homo Sapiens
DFLVCCPHS

SEQ ID NO: 733343 - protein, 9 aa, Homo Sapiens
PAFDRTIYN

SEQ ID NO: 733344 - protein, 9 aa, Homo Sapiens
DFGEDENVV

SEQ ID NO: 733345 - protein, 9 aa, Homo Sapiens
QGEQWRGGD

SEQ ID NO: 733346 - protein, 9 aa, Homo Sapiens
NFGNRTLRR

SEQ ID NO: 733347 - protein, 9 aa, Homo Sapiens
LASNKTLAL

SEQ ID NO: 733348 - protein, 9 aa, Homo Sapiens
QYPSTQAHT

SEQ ID NO: 733349 - protein, 9 aa, Homo Sapiens
ADSKEGVLS

SEQ ID NO: 733350 - protein, 9 aa, Homo Sapiens
ERPTAACST

SEQ ID NO: 733351 - protein, 9 aa, Homo Sapiens
TSHGLRAEV

SEQ ID NO: 733352 - protein, 9 aa, Homo Sapiens
MTDEQKMAQ

SEQ ID NO: 733353 - protein, 9 aa, Homo Sapiens
TNYLVDVFE

SEQ ID NO: 733354 - protein, 9 aa, Homo Sapiens
QSEYGEDLY

SEQ ID NO: 733355 - protein, 9 aa, Homo Sapiens
LDGLEEEDD

SEQ ID NO: 733356 - protein, 9 aa, Homo Sapiens
ATAAALLYG

SEQ ID NO: 733357 - protein, 9 aa, Homo Sapiens
SSSNSSNSS

SEQ ID NO: 733358 - protein, 9 aa, Homo Sapiens
GHTNQVNAI

SEQ ID NO: 733359 - protein, 9 aa, Homo Sapiens
ECFKRQKIS

SEQ ID NO: 733360 - protein, 9 aa, Homo Sapiens
PKGHLPDYT

SEQ ID NO: 733361 - protein, 9 aa, Homo Sapiens
IANPPKAEK

SEQ ID NO: 733362 - protein, 9 aa, Homo Sapiens
YENCGFKNS

SEQ ID NO: 733363 - protein, 9 aa, Homo Sapiens
KEQTCPVPQ

SEQ ID NO: 733364 - protein, 9 aa, Homo Sapiens
GTNYLVDVF

SEQ ID NO: 733365 - protein, 9 aa, Homo Sapiens
EEQSGDETP

SEQ ID NO: 733366 - protein, 9 aa, Homo Sapiens
VGFCSILFI

SEQ ID NO: 733367 - protein, 9 aa, Homo Sapiens
HQITEEEWE

SEQ ID NO: 733368 - protein, 9 aa, Homo Sapiens
DNSPFVLYL

SEQ ID NO: 733369 - protein, 9 aa, Homo Sapiens
RRHKRSYTG

SEQ ID NO: 733370 - protein, 9 aa, Homo Sapiens
VNSLHERYE

SEQ ID NO: 733371 - protein, 9 aa, Homo Sapiens
QELAGPERI

SEQ ID NO: 733372 - protein, 9 aa, Homo Sapiens
ACLHHSLSH

SEQ ID NO: 733373 - protein, 9 aa, Homo Sapiens
QLLDEHDAM

SEQ ID NO: 733374 - protein, 9 aa, Homo Sapiens
ELRNDWTLQ

SEQ ID NO: 733375 - protein, 9 aa, Homo Sapiens
YSLSLLYLT

SEQ ID NO: 733376 - protein, 9 aa, Homo Sapiens
GLTPSLAGK

SEQ ID NO: 733377 - protein, 9 aa, Homo Sapiens
EQERLISDA

SEQ ID NO: 733378 - protein, 9 aa, Homo Sapiens
NPRINQLST

SEQ ID NO: 733379 - protein, 9 aa, Homo Sapiens
FQRAPQGIP

SEQ ID NO: 733380 - protein, 9 aa, Homo Sapiens
GAGFFLPQD

SEQ ID NO: 733381 - protein, 9 aa, Homo Sapiens
ESKHNVTKL

SEQ ID NO: 733382 - protein, 9 aa, Homo Sapiens
PAGWPARKR

SEQ ID NO: 733383 - protein, 9 aa, Homo Sapiens
FAMFSKTGS

SEQ ID NO: 733384 - protein, 9 aa, Homo Sapiens
GRMRRFFSR

SEQ ID NO: 733385 - protein, 9 aa, Homo Sapiens
LRPLAGLLS

SEQ ID NO: 733386 - protein, 9 aa, Homo Sapiens
LNKCVSPQE

SEQ ID NO: 733387 - protein, 9 aa, Homo Sapiens
LSTDAAPQL

SEQ ID NO: 733388 - protein, 9 aa, Homo Sapiens
TTPVPTPSL

SEQ ID NO: 733389 - protein, 9 aa, Homo Sapiens
KIQQDSACK

SEQ ID NO: 733390 - protein, 9 aa, Homo Sapiens
CSELRCPTE

SEQ ID NO: 733391 - protein, 9 aa, Homo Sapiens
GSTKHGLEI

SEQ ID NO: 733392 - protein, 9 aa, Homo Sapiens
NSTWAQTEG

SEQ ID NO: 733393 - protein, 9 aa, Homo Sapiens
CSFKINEIY

SEQ ID NO: 733394 - protein, 9 aa, Homo Sapiens
RAPQGIPSS

SEQ ID NO: 733395 - protein, 9 aa, Homo Sapiens
PAGSRRPRI

SEQ ID NO: 733396 - protein, 9 aa, Homo Sapiens
LVQLTFCRV

SEQ ID NO: 733397 - protein, 9 aa, Homo Sapiens
CGKVFGQNS

SEQ ID NO: 733398 - protein, 9 aa, Homo Sapiens
LAALGCQVY

SEQ ID NO: 733399 - protein, 9 aa, Homo Sapiens
TSGSTGSPV

SEQ ID NO: 733400 - protein, 9 aa, Homo Sapiens
RGDELHGQA

SEQ ID NO: 733401 - protein, 9 aa, Homo Sapiens
LGRATARWR

SEQ ID NO: 733402 - protein, 9 aa, Homo Sapiens
LGFFMVKEV

SEQ ID NO: 733403 - protein, 9 aa, Homo Sapiens
GELLACGQW

SEQ ID NO: 733404 - protein, 9 aa, Homo Sapiens
DSDFGEDEN

SEQ ID NO: 733405 - protein, 9 aa, Homo Sapiens
MDDIEKGNT

SEQ ID NO: 733406 - protein, 9 aa, Homo Sapiens
EQPEAQSSQ

SEQ ID NO: 733407 - protein, 9 aa, Homo Sapiens
EGLGIVTKY

SEQ ID NO: 733408 - protein, 9 aa, Homo Sapiens
GLPGFPGVP

SEQ ID NO: 733409 - protein, 9 aa, Homo Sapiens
GLLALVLCT

SEQ ID NO: 733410 - protein, 9 aa, Homo Sapiens
VAMKVLKQG

SEQ ID NO: 733411 - protein, 9 aa, Homo Sapiens
VIGRLYVKK

SEQ ID NO: 733412 - protein, 9 aa, Homo Sapiens
RLYVKKPLK

SEQ ID NO: 733413 - protein, 9 aa, Homo Sapiens
RLWLYHVAS

SEQ ID NO: 733414 - protein, 9 aa, Homo Sapiens
LSQAVQQLR

SEQ ID NO: 733415 - protein, 9 aa, Homo Sapiens
WGGKDGAVG

SEQ ID NO: 733416 - protein, 9 aa, Homo Sapiens
RRIWCTTPL

SEQ ID NO: 733417 - protein, 9 aa, Homo Sapiens
LLGAFITKV

SEQ ID NO: 733418 - protein, 9 aa, Homo Sapiens
PPVAQGGSP

SEQ ID NO: 733419 - protein, 9 aa, Homo Sapiens
AMPLVEQTS

SEQ ID NO: 733420 - protein, 9 aa, Homo Sapiens
AHSEEPAYR

SEQ ID NO: 733421 - protein, 9 aa, Homo Sapiens
SPAKPMHPE

SEQ ID NO: 733422 - protein, 9 aa, Homo Sapiens
RGLQQDVKV

SEQ ID NO: 733423 - protein, 9 aa, Homo Sapiens
KTGAHEIEV

SEQ ID NO: 733424 - protein, 9 aa, Homo Sapiens
NPRTGVINI

SEQ ID NO: 733425 - protein, 9 aa, Homo Sapiens
GSKLHRTKL

SEQ ID NO: 733426 - protein, 9 aa, Homo Sapiens
LSTRWQQVW

SEQ ID NO: 733427 - protein, 9 aa, Homo Sapiens
HYQKDKKGI

SEQ ID NO: 733428 - protein, 9 aa, Homo Sapiens
IYTKPKGHL

SEQ ID NO: 733429 - protein, 9 aa, Homo Sapiens
PVVKAFLES

SEQ ID NO: 733430 - protein, 9 aa, Homo Sapiens
AKIEEHLAM

SEQ ID NO: 733431 - protein, 9 aa, Homo Sapiens
VTSHGLRAE

SEQ ID NO: 733432 - protein, 9 aa, Homo Sapiens
DFRLNPVVR

SEQ ID NO: 733433 - protein, 9 aa, Homo Sapiens
RALRAELLR

SEQ ID NO: 733434 - protein, 9 aa, Homo Sapiens
PTADSTSVE

SEQ ID NO: 733435 - protein, 9 aa, Homo Sapiens
TDAAPQLGL

SEQ ID NO: 733436 - protein, 9 aa, Homo Sapiens
GELQAGDWS

SEQ ID NO: 733437 - protein, 9 aa, Homo Sapiens
GDILRIQDK

SEQ ID NO: 733438 - protein, 9 aa, Homo Sapiens
FFLYNLSFT

SEQ ID NO: 733439 - protein, 9 aa, Homo Sapiens
VGISLANKQ

SEQ ID NO: 733440 - protein, 9 aa, Homo Sapiens
CNWLLGHLG

SEQ ID NO: 733441 - protein, 9 aa, Homo Sapiens
SLAGKSPCP

SEQ ID NO: 733442 - protein, 9 aa, Homo Sapiens
PVISMHAQA

SEQ ID NO: 733443 - protein, 9 aa, Homo Sapiens
AQKSIKAMW

SEQ ID NO: 733444 - protein, 9 aa, Homo Sapiens
PHVPPARQP

SEQ ID NO: 733445 - protein, 9 aa, Homo Sapiens
GLAAGPGSA

SEQ ID NO: 733446 - protein, 9 aa, Homo Sapiens
YGCGYGFGC

SEQ ID NO: 733447 - protein, 9 aa, Homo Sapiens
QEKVKSAAA

SEQ ID NO: 733448 - protein, 9 aa, Homo Sapiens
PPLIRVEGN

SEQ ID NO: 733449 - protein, 9 aa, Homo Sapiens
GPLPASHPL

SEQ ID NO: 733450 - protein, 9 aa, Homo Sapiens
FSMSANIMH

SEQ ID NO: 733451 - protein, 9 aa, Homo Sapiens
NLRYIETGA

SEQ ID NO: 733452 - protein, 9 aa, Homo Sapiens
GVLLAKMKH

SEQ ID NO: 733453 - protein, 9 aa, Homo Sapiens
TLALLNNAK

SEQ ID NO: 733454 - protein, 9 aa, Homo Sapiens
WPQYTTRAT

SEQ ID NO: 733455 - protein, 9 aa, Homo Sapiens
SATSLIQAD

SEQ ID NO: 733456 - protein, 9 aa, Homo Sapiens
MLKKSLHSC

SEQ ID NO: 733457 - protein, 9 aa, Homo Sapiens
HQKTYRRKP

SEQ ID NO: 733458 - protein, 9 aa, Homo Sapiens
QELAQVEVK

SEQ ID NO: 733459 - protein, 9 aa, Homo Sapiens
KRSYTGEKP

SEQ ID NO: 733460 - protein, 9 aa, Homo Sapiens
VRKRKYFKK

SEQ ID NO: 733461 - protein, 9 aa, Homo Sapiens
PAEPAGTGK

SEQ ID NO: 733462 - protein, 9 aa, Homo Sapiens
FQQFKEAVR

SEQ ID NO: 733463 - protein, 9 aa, Homo Sapiens
QCFTVQSEY

SEQ ID NO: 733464 - protein, 9 aa, Homo Sapiens
TSVELVRLR

SEQ ID NO: 733465 - protein, 9 aa, Homo Sapiens
GSRECEIPH

SEQ ID NO: 733466 - protein, 9 aa, Homo Sapiens
PGHGGARRL

SEQ ID NO: 733467 - protein, 9 aa, Homo Sapiens
YGPPTSYPN

SEQ ID NO: 733468 - protein, 9 aa, Homo Sapiens
GSTPTPAGH

SEQ ID NO: 733469 - protein, 9 aa, Homo Sapiens
RIKELASCY

SEQ ID NO: 733470 - protein, 9 aa, Homo Sapiens
TAIGKNIGA

SEQ ID NO: 733471 - protein, 9 aa, Homo Sapiens
FLGINLYEL

SEQ ID NO: 733472 - protein, 9 aa, Homo Sapiens
LKEQCMTER

SEQ ID NO: 733473 - protein, 9 aa, Homo Sapiens
KQEEGSGGH

SEQ ID NO: 733474 - protein, 9 aa, Homo Sapiens
PGRPRSKQE

SEQ ID NO: 733475 - protein, 9 aa, Homo Sapiens
QVRKRKYFK

SEQ ID NO: 733476 - protein, 9 aa, Homo Sapiens
LHCRCSFRS

SEQ ID NO: 733477 - protein, 9 aa, Homo Sapiens
GSNRALRAE

SEQ ID NO: 733478 - protein, 9 aa, Homo Sapiens
RLIHLAMRG

SEQ ID NO: 733479 - protein, 9 aa, Homo Sapiens
ALVSVRLYY

SEQ ID NO: 733480 - protein, 9 aa, Homo Sapiens
EVNSLHERY

SEQ ID NO: 733481 - protein, 9 aa, Homo Sapiens
ELLGTTQFL

SEQ ID NO: 733482 - protein, 9 aa, Homo Sapiens
DMDKIEKID

SEQ ID NO: 733483 - protein, 9 aa, Homo Sapiens
KNLRYIETG

SEQ ID NO: 733484 - protein, 9 aa, Homo Sapiens
YSSLLSKHQ

SEQ ID NO: 733485 - protein, 9 aa, Homo Sapiens
LSQCPKGRA

SEQ ID NO: 733486 - protein, 9 aa, Homo Sapiens
EYAEYCTDE

SEQ ID NO: 733487 - protein, 9 aa, Homo Sapiens
CETAIGKNI

SEQ ID NO: 733488 - protein, 9 aa, Homo Sapiens
RRLVGCISH

SEQ ID NO: 733489 - protein, 9 aa, Homo Sapiens
ALKECLRIA

SEQ ID NO: 733490 - protein, 9 aa, Homo Sapiens
SLVSGVVLV

SEQ ID NO: 733491 - protein, 9 aa, Homo Sapiens
GACCSLHHA

SEQ ID NO: 733492 - protein, 9 aa, Homo Sapiens
DAAQTCQCL

SEQ ID NO: 733493 - protein, 9 aa, Homo Sapiens
MNVKDNAGW

SEQ ID NO: 733494 - protein, 9 aa, Homo Sapiens
RLYHCASYN

SEQ ID NO: 733495 - protein, 9 aa, Homo Sapiens
LNSGRLIHL

SEQ ID NO: 733496 - protein, 9 aa, Homo Sapiens
TTTPESTTQ

SEQ ID NO: 733497 - protein, 9 aa, Homo Sapiens
FQNMILQAP

SEQ ID NO: 733498 - protein, 9 aa, Homo Sapiens
LSVQTPHLP

SEQ ID NO: 733499 - protein, 9 aa, Homo Sapiens
SWTVQEGAI

SEQ ID NO: 733500 - protein, 9 aa, Homo Sapiens
HLAMVEAVT

SEQ ID NO: 733501 - protein, 9 aa, Homo Sapiens
GRGAQRDTD

SEQ ID NO: 733502 - protein, 9 aa, Homo Sapiens
LDGLIHPFI

SEQ ID NO: 733503 - protein, 9 aa, Homo Sapiens
GPGSAGGAP

SEQ ID NO: 733504 - protein, 9 aa, Homo Sapiens
HQKKVGSQN

SEQ ID NO: 733505 - protein, 9 aa, Homo Sapiens
HSSQVPSFA

SEQ ID NO: 733506 - protein, 9 aa, Homo Sapiens
RATARWRWV

SEQ ID NO: 733507 - protein, 9 aa, Homo Sapiens
GHEEGFDYN

SEQ ID NO: 733508 - protein, 9 aa, Homo Sapiens
GKDGAVGFA

SEQ ID NO: 733509 - protein, 9 aa, Homo Sapiens
RAPPREQRR

SEQ ID NO: 733510 - protein, 9 aa, Homo Sapiens
HLPDYTSPV

SEQ ID NO: 733511 - protein, 9 aa, Homo Sapiens
QLVTSHGLR

SEQ ID NO: 733512 - protein, 9 aa, Homo Sapiens
FHGQIGFTC

SEQ ID NO: 733513 - protein, 9 aa, Homo Sapiens
REFLALKEC

SEQ ID NO: 733514 - protein, 9 aa, Homo Sapiens
VSVRLYYKK

SEQ ID NO: 733515 - protein, 9 aa, Homo Sapiens
ENFSKEFQE

SEQ ID NO: 733516 - protein, 9 aa, Homo Sapiens
ILAPQTCTP

SEQ ID NO: 733517 - protein, 9 aa, Homo Sapiens
LVCCPHSPN

SEQ ID NO: 733518 - protein, 9 aa, Homo Sapiens
LGKLESITC

SEQ ID NO: 733519 - protein, 9 aa, Homo Sapiens
CIALVSVRL

SEQ ID NO: 733520 - protein, 9 aa, Homo Sapiens
ISLANKQYV

SEQ ID NO: 733521 - protein, 9 aa, Homo Sapiens
SNKTLALFY

SEQ ID NO: 733522 - protein, 9 aa, Homo Sapiens
FSRFHDGIK

SEQ ID NO: 733523 - protein, 9 aa, Homo Sapiens
AQHHLYKLV

SEQ ID NO: 733524 - protein, 9 aa, Homo Sapiens
VNRIVNDAR

SEQ ID NO: 733525 - protein, 9 aa, Homo Sapiens
NTQNSRKEG

SEQ ID NO: 733526 - protein, 9 aa, Homo Sapiens
KFAKVKNQY

SEQ ID NO: 733527 - protein, 9 aa, Homo Sapiens
TSHPPWERP

SEQ ID NO: 733528 - protein, 9 aa, Homo Sapiens
PETGKTALA

SEQ ID NO: 733529 - protein, 9 aa, Homo Sapiens
QRAPQGIPS

SEQ ID NO: 733530 - protein, 9 aa, Homo Sapiens
NSSSSSSNS

SEQ ID NO: 733531 - protein, 9 aa, Homo Sapiens
LHYQKDKKG

SEQ ID NO: 733532 - protein, 9 aa, Homo Sapiens
HQHSPDTYI

SEQ ID NO: 733533 - protein, 9 aa, Homo Sapiens
CGYGFGCGY

SEQ ID NO: 733534 - protein, 9 aa, Homo Sapiens
RGSNRALRA

SEQ ID NO: 733535 - protein, 9 aa, Homo Sapiens
LWGGKDGAV

SEQ ID NO: 733536 - protein, 9 aa, Homo Sapiens
PANLREGVA

SEQ ID NO: 733537 - protein, 9 aa, Homo Sapiens
IETGAFINL

SEQ ID NO: 733538 - protein, 9 aa, Homo Sapiens
SLPSRQRLR

SEQ ID NO: 733539 - protein, 9 aa, Homo Sapiens
DQDQSDKAQ

SEQ ID NO: 733540 - protein, 9 aa, Homo Sapiens
KLHGILILG

SEQ ID NO: 733541 - protein, 9 aa, Homo Sapiens
GHGGARRLQ

SEQ ID NO: 733542 - protein, 9 aa, Homo Sapiens
ANLREGVAK

SEQ ID NO: 733543 - protein, 9 aa, Homo Sapiens
LGTARAEAA

SEQ ID NO: 733544 - protein, 9 aa, Homo Sapiens
RGDPGYAGP

SEQ ID NO: 733545 - protein, 9 aa, Homo Sapiens
IRILSVLII

SEQ ID NO: 733546 - protein, 9 aa, Homo Sapiens
FLLAALGCQ

SEQ ID NO: 733547 - protein, 9 aa, Homo Sapiens
GRSHSKIQK

SEQ ID NO: 733548 - protein, 9 aa, Homo Sapiens
GPRWRAQLA

SEQ ID NO: 733549 - protein, 9 aa, Homo Sapiens
GCSASGACC

SEQ ID NO: 733550 - protein, 9 aa, Homo Sapiens
RWILVGAPW

SEQ ID NO: 733551 - protein, 9 aa, Homo Sapiens
KRDADGIRE

SEQ ID NO: 733552 - protein, 9 aa, Homo Sapiens
KYVGLVLSA

SEQ ID NO: 733553 - protein, 9 aa, Homo Sapiens
FQGHTNQVN

SEQ ID NO: 733554 - protein, 9 aa, Homo Sapiens
IFCFEAVIK

SEQ ID NO: 733555 - protein, 9 aa, Homo Sapiens
GEPVLWLAC

SEQ ID NO: 733556 - protein, 9 aa, Homo Sapiens
TEGSGWLDD

SEQ ID NO: 733557 - protein, 9 aa, Homo Sapiens
AMTDEQKMA

SEQ ID NO: 733558 - protein, 9 aa, Homo Sapiens
FLSILVELC

SEQ ID NO: 733559 - protein, 9 aa, Homo Sapiens
PRPVISMHA

SEQ ID NO: 733560 - protein, 9 aa, Homo Sapiens
AKAPSSVRD

SEQ ID NO: 733561 - protein, 9 aa, Homo Sapiens
TQIEPSAAL

SEQ ID NO: 733562 - protein, 9 aa, Homo Sapiens
VYSTTPVPT

SEQ ID NO: 733563 - protein, 9 aa, Homo Sapiens
LSDPNDISS

SEQ ID NO: 733564 - protein, 9 aa, Homo Sapiens
HRTRLLWRP

SEQ ID NO: 733565 - protein, 9 aa, Homo Sapiens
EEVCSLRPP

SEQ ID NO: 733566 - protein, 9 aa, Homo Sapiens
SFSCGSSPG

SEQ ID NO: 733567 - protein, 9 aa, Homo Sapiens
EIHVCRLTA

SEQ ID NO: 733568 - protein, 9 aa, Homo Sapiens
LLHFFCDLA

SEQ ID NO: 733569 - protein, 9 aa, Homo Sapiens
AALAMLGER

SEQ ID NO: 733570 - protein, 9 aa, Homo Sapiens
RHKRSYTGE

SEQ ID NO: 733571 - protein, 9 aa, Homo Sapiens
LVKTGIYNP

SEQ ID NO: 733572 - protein, 9 aa, Homo Sapiens
FVIELCESI

SEQ ID NO: 733573 - protein, 9 aa, Homo Sapiens
EPLQPSNAQ

SEQ ID NO: 733574 - protein, 9 aa, Homo Sapiens
PVETGKNGG

SEQ ID NO: 733575 - protein, 9 aa, Homo Sapiens
RYHVRREHL

SEQ ID NO: 733576 - protein, 9 aa, Homo Sapiens
RGHCPPSPA

SEQ ID NO: 733577 - protein, 9 aa, Homo Sapiens
SNSNSSSNS

SEQ ID NO: 733578 - protein, 9 aa, Homo Sapiens
AQLLAGIRT

SEQ ID NO: 733579 - protein, 9 aa, Homo Sapiens
NHQVQNPKG

SEQ ID NO: 733580 - protein, 9 aa, Homo Sapiens
YLIAKEQER

SEQ ID NO: 733581 - protein, 9 aa, Homo Sapiens
INKGKAGGT

SEQ ID NO: 733582 - protein, 9 aa, Homo Sapiens
SLGIKKPVG

SEQ ID NO: 733583 - protein, 9 aa, Homo Sapiens
KQIDVAMKV

SEQ ID NO: 733584 - protein, 9 aa, Homo Sapiens
RECEIPHHM

SEQ ID NO: 733585 - protein, 9 aa, Homo Sapiens
EEKCGHQIT

SEQ ID NO: 733586 - protein, 9 aa, Homo Sapiens
QPKVSKPDL

SEQ ID NO: 733587 - protein, 9 aa, Homo Sapiens
NTLGAQKPI

SEQ ID NO: 733588 - protein, 9 aa, Homo Sapiens
LQEMEAMTD

SEQ ID NO: 733589 - protein, 9 aa, Homo Sapiens
GPSRDSEGG

SEQ ID NO: 733590 - protein, 9 aa, Homo Sapiens
QIEPSAALT

SEQ ID NO: 733591 - protein, 9 aa, Homo Sapiens
NPPKAEKEQ

SEQ ID NO: 733592 - protein, 9 aa, Homo Sapiens
VVKAFLESP

SEQ ID NO: 733593 - protein, 9 aa, Homo Sapiens
WYNLIIQNK

SEQ ID NO: 733594 - protein, 9 aa, Homo Sapiens
AMKVLKQGT

SEQ ID NO: 733595 - protein, 9 aa, Homo Sapiens
SLLNPQPFL

SEQ ID NO: 733596 - protein, 9 aa, Homo Sapiens
CYLYLVYQQ

SEQ ID NO: 733597 - protein, 9 aa, Homo Sapiens
GVYEERSEA

SEQ ID NO: 733598 - protein, 9 aa, Homo Sapiens
TLVWLSMYC

SEQ ID NO: 733599 - protein, 9 aa, Homo Sapiens
AFEKGSLLF

SEQ ID NO: 733600 - protein, 9 aa, Homo Sapiens
VGRKLKEKQ

SEQ ID NO: 733601 - protein, 9 aa, Homo Sapiens
TTRATPGHF

SEQ ID NO: 733602 - protein, 9 aa, Homo Sapiens
FLVCCPHSP

SEQ ID NO: 733603 - protein, 9 aa, Homo Sapiens
VCISIPKVD

SEQ ID NO: 733604 - protein, 9 aa, Homo Sapiens
FLLGTTGNC

SEQ ID NO: 733605 - protein, 9 aa, Homo Sapiens
VLFAMFSKT

SEQ ID NO: 733606 - protein, 9 aa, Homo Sapiens
PQLGLATQA

SEQ ID NO: 733607 - protein, 9 aa, Homo Sapiens
RGIGDSVLL

SEQ ID NO: 733608 - protein, 9 aa, Homo Sapiens
NKGKAGGTQ

SEQ ID NO: 733609 - protein, 9 aa, Homo Sapiens
LALLNNAKY

SEQ ID NO: 733610 - protein, 9 aa, Homo Sapiens
RINKGKAGG

SEQ ID NO: 733611 - protein, 9 aa, Homo Sapiens
QAELHRFQD

SEQ ID NO: 733612 - protein, 9 aa, Homo Sapiens
VLIIVMCIA

SEQ ID NO: 733613 - protein, 9 aa, Homo Sapiens
AHIFVLHSF

SEQ ID NO: 733614 - protein, 9 aa, Homo Sapiens
YMRRLVGCI

SEQ ID NO: 733615 - protein, 9 aa, Homo Sapiens
SRESLGLSL

SEQ ID NO: 733616 - protein, 9 aa, Homo Sapiens
TGFRLRPLA

SEQ ID NO: 733617 - protein, 9 aa, Homo Sapiens
HNGHSLQYP

SEQ ID NO: 733618 - protein, 9 aa, Homo Sapiens
YNVRLLENV

SEQ ID NO: 733619 - protein, 9 aa, Homo Sapiens
QFKEAVREL

SEQ ID NO: 733620 - protein, 9 aa, Homo Sapiens
YGEDLYFSV

SEQ ID NO: 733621 - protein, 9 aa, Homo Sapiens
QAVQQLRQA

SEQ ID NO: 733622 - protein, 9 aa, Homo Sapiens
REHLGKLHR

SEQ ID NO: 733623 - protein, 9 aa, Homo Sapiens
SFEGCMAHI

SEQ ID NO: 733624 - protein, 9 aa, Homo Sapiens
YFGSKLHRT

SEQ ID NO: 733625 - protein, 9 aa, Homo Sapiens
PGPRGLPGF

SEQ ID NO: 733626 - protein, 9 aa, Homo Sapiens
ETRLDLTGS

SEQ ID NO: 733627 - protein, 9 aa, Homo Sapiens
ECLRIAEHR

SEQ ID NO: 733628 - protein, 9 aa, Homo Sapiens
QMEKVQLEF

SEQ ID NO: 733629 - protein, 9 aa, Homo Sapiens
GVKTPPEEK

SEQ ID NO: 733630 - protein, 9 aa, Homo Sapiens
GVPGGPVET

SEQ ID NO: 733631 - protein, 9 aa, Homo Sapiens
QNSRKEGVL

SEQ ID NO: 733632 - protein, 9 aa, Homo Sapiens
LSSTGSMYL

SEQ ID NO: 733633 - protein, 9 aa, Homo Sapiens
SEGFLKGED

SEQ ID NO: 733634 - protein, 9 aa, Homo Sapiens
VSKPDLPEE

SEQ ID NO: 733635 - protein, 9 aa, Homo Sapiens
ANKQYVSGD

SEQ ID NO: 733636 - protein, 9 aa, Homo Sapiens
LVLSAMINS

SEQ ID NO: 733637 - protein, 9 aa, Homo Sapiens
FKRHTNTVC

SEQ ID NO: 733638 - protein, 9 aa, Homo Sapiens
TPCGELQAG

SEQ ID NO: 733639 - protein, 9 aa, Homo Sapiens
TVGISLANK

SEQ ID NO: 733640 - protein, 9 aa, Homo Sapiens
PCPNHYYTD

SEQ ID NO: 733641 - protein, 9 aa, Homo Sapiens
QTFADRTDL

SEQ ID NO: 733642 - protein, 9 aa, Homo Sapiens
LAGIRTVPI

SEQ ID NO: 733643 - protein, 9 aa, Homo Sapiens
SNLVVEEKL

SEQ ID NO: 733644 - protein, 9 aa, Homo Sapiens
GHCPPSPAK

SEQ ID NO: 733645 - protein, 9 aa, Homo Sapiens
LSNTLGAQK

SEQ ID NO: 733646 - protein, 9 aa, Homo Sapiens
QKVVVSRVA

SEQ ID NO: 733647 - protein, 9 aa, Homo Sapiens
EAWSTHNTV

SEQ ID NO: 733648 - protein, 9 aa, Homo Sapiens
QIGFTCNQK

SEQ ID NO: 733649 - protein, 9 aa, Homo Sapiens
PCAKDFHGQ

SEQ ID NO: 733650 - protein, 9 aa, Homo Sapiens
EVCSLRPPR

SEQ ID NO: 733651 - protein, 9 aa, Homo Sapiens
YFALDLLMQ

SEQ ID NO: 733652 - protein, 9 aa, Homo Sapiens
AFTDLHLHY

SEQ ID NO: 733653 - protein, 9 aa, Homo Sapiens
HIFVLHSFV

SEQ ID NO: 733654 - protein, 9 aa, Homo Sapiens
QRKLLFTSL

SEQ ID NO: 733655 - protein, 9 aa, Homo Sapiens
RTLPFRADY

SEQ ID NO: 733656 - protein, 9 aa, Homo Sapiens
CKQFQRAPQ

SEQ ID NO: 733657 - protein, 9 aa, Homo Sapiens
CSFRSRPAP

SEQ ID NO: 733658 - protein, 9 aa, Homo Sapiens
YPSTQAHTR

SEQ ID NO: 733659 - protein, 9 aa, Homo Sapiens
AQSSQADRD

SEQ ID NO: 733660 - protein, 9 aa, Homo Sapiens
SSGVTPVQS

SEQ ID NO: 733661 - protein, 9 aa, Homo Sapiens
GRRGPRWRA

SEQ ID NO: 733662 - protein, 9 aa, Homo Sapiens
TFQGHTNQV

SEQ ID NO: 733663 - protein, 9 aa, Homo Sapiens
LLMQNGECR

SEQ ID NO: 733664 - protein, 9 aa, Homo Sapiens
KHGLEIDES

SEQ ID NO: 733665 - protein, 9 aa, Homo Sapiens
HRWTHHGEN

SEQ ID NO: 733666 - protein, 9 aa, Homo Sapiens
LIHLAMRGL

SEQ ID NO: 733667 - protein, 9 aa, Homo Sapiens
ENTRAQRQR

SEQ ID NO: 733668 - protein, 9 aa, Homo Sapiens
DGMNFTHCH

SEQ ID NO: 733669 - protein, 9 aa, Homo Sapiens
DSDIEMAKA

SEQ ID NO: 733670 - protein, 9 aa, Homo Sapiens
VMAAFDGRH

SEQ ID NO: 733671 - protein, 9 aa, Homo Sapiens
YHCASYNCA

SEQ ID NO: 733672 - protein, 9 aa, Homo Sapiens
QNGECRGVI

SEQ ID NO: 733673 - protein, 9 aa, Homo Sapiens
VNRERSGCA

SEQ ID NO: 733674 - protein, 9 aa, Homo Sapiens
QAKKETLES

SEQ ID NO: 733675 - protein, 9 aa, Homo Sapiens
TKPKGHLPD

SEQ ID NO: 733676 - protein, 9 aa, Homo Sapiens
SNSGRRIWC

SEQ ID NO: 733677 - protein, 9 aa, Homo Sapiens
MTYFNGSTK

SEQ ID NO: 733678 - protein, 9 aa, Homo Sapiens
FETLTQLGV

SEQ ID NO: 733679 - protein, 9 aa, Homo Sapiens
ILEEVVGLP

SEQ ID NO: 733680 - protein, 9 aa, Homo Sapiens
EHGAQHHLY

SEQ ID NO: 733681 - protein, 9 aa, Homo Sapiens
CTTPLTTTR

SEQ ID NO: 733682 - protein, 9 aa, Homo Sapiens
LAMVEAVTK

SEQ ID NO: 733683 - protein, 9 aa, Homo Sapiens
VKEVGKTIG

SEQ ID NO: 733684 - protein, 9 aa, Homo Sapiens
TLLGRFFQG

SEQ ID NO: 733685 - protein, 9 aa, Homo Sapiens
LDLTGSSPT

SEQ ID NO: 733686 - protein, 9 aa, Homo Sapiens
GELIRGLQQ

SEQ ID NO: 733687 - protein, 9 aa, Homo Sapiens
PDSDFGEDE

SEQ ID NO: 733688 - protein, 9 aa, Homo Sapiens
CHILEEVVG

SEQ ID NO: 733689 - protein, 9 aa, Homo Sapiens
YCTDEGFIP

SEQ ID NO: 733690 - protein, 9 aa, Homo Sapiens
ELCLWLHLA

SEQ ID NO: 733691 - protein, 9 aa, Homo Sapiens
ARRLQRTSH

SEQ ID NO: 733692 - protein, 9 aa, Homo Sapiens
ADRTDLCRS

SEQ ID NO: 733693 - protein, 9 aa, Homo Sapiens
VEEKLIPPE

SEQ ID NO: 733694 - protein, 9 aa, Homo Sapiens
MAHGSEGFL

SEQ ID NO: 733695 - protein, 9 aa, Homo Sapiens
APVFDVFQA

SEQ ID NO: 733696 - protein, 9 aa, Homo Sapiens
QVEVKQHAQ

SEQ ID NO: 733697 - protein, 9 aa, Homo Sapiens
PDTYIQYFK

SEQ ID NO: 733698 - protein, 9 aa, Homo Sapiens
CHDRWFDKS

SEQ ID NO: 733699 - protein, 9 aa, Homo Sapiens
ILQAPDFLS

SEQ ID NO: 733700 - protein, 9 aa, Homo Sapiens
CGGYIQVKS

SEQ ID NO: 733701 - protein, 9 aa, Homo Sapiens
CIHSSPIGR

SEQ ID NO: 733702 - protein, 9 aa, Homo Sapiens
DTYIQYFKN

SEQ ID NO: 733703 - protein, 9 aa, Homo Sapiens
ERINKGKAG

SEQ ID NO: 733704 - protein, 9 aa, Homo Sapiens
QHHLYKLVK

SEQ ID NO: 733705 - protein, 9 aa, Homo Sapiens
QDSACKVQI

SEQ ID NO: 733706 - protein, 9 aa, Homo Sapiens
FPQPPRCNW

SEQ ID NO: 733707 - protein, 9 aa, Homo Sapiens
KHLDAHSEE

SEQ ID NO: 733708 - protein, 9 aa, Homo Sapiens
KSPCPRLLP

SEQ ID NO: 733709 - protein, 9 aa, Homo Sapiens
IGGDPGDAE

SEQ ID NO: 733710 - protein, 9 aa, Homo Sapiens
NKMLTKISG

SEQ ID NO: 733711 - protein, 9 aa, Homo Sapiens
FPDLQKQTI

SEQ ID NO: 733712 - protein, 9 aa, Homo Sapiens
NPATEVSCR

SEQ ID NO: 733713 - protein, 9 aa, Homo Sapiens
VRLRFLEKN

SEQ ID NO: 733714 - protein, 9 aa, Homo Sapiens
HEIHQACQR

SEQ ID NO: 733715 - protein, 9 aa, Homo Sapiens
LLYYSSLIR

SEQ ID NO: 733716 - protein, 9 aa, Homo Sapiens
RATPGHFST

SEQ ID NO: 733717 - protein, 9 aa, Homo Sapiens
CPPSPAKPM

SEQ ID NO: 733718 - protein, 9 aa, Homo Sapiens
SISSSNSNS

SEQ ID NO: 733719 - protein, 9 aa, Homo Sapiens
NLVVEEKLI

SEQ ID NO: 733720 - protein, 9 aa, Homo Sapiens
VGLPPKRSS

SEQ ID NO: 733721 - protein, 9 aa, Homo Sapiens
EKEQTCPVP

SEQ ID NO: 733722 - protein, 9 aa, Homo Sapiens
HLDVFFEEE

SEQ ID NO: 733723 - protein, 9 aa, Homo Sapiens
KAPSSVRDD

SEQ ID NO: 733724 - protein, 9 aa, Homo Sapiens
PAVQAFHIW

SEQ ID NO: 733725 - protein, 9 aa, Homo Sapiens
RGKGGKGWC

SEQ ID NO: 733726 - protein, 9 aa, Homo Sapiens
RLPPQENTR

SEQ ID NO: 733727 - protein, 9 aa, Homo Sapiens
LGHIQATPR

SEQ ID NO: 733728 - protein, 9 aa, Homo Sapiens
YQTSPTHED

SEQ ID NO: 733729 - protein, 9 aa, Homo Sapiens
LLSQAVQQL

SEQ ID NO: 733730 - protein, 9 aa, Homo Sapiens
PFITLLADT

SEQ ID NO: 733731 - protein, 9 aa, Homo Sapiens
INPRTGVIN

SEQ ID NO: 733732 - protein, 9 aa, Homo Sapiens
PPGTLLSVP

SEQ ID NO: 733733 - protein, 9 aa, Homo Sapiens
GKMTDLGLL

SEQ ID NO: 733734 - protein, 9 aa, Homo Sapiens
YHVASTVFL

SEQ ID NO: 733735 - protein, 9 aa, Homo Sapiens
AEDMDKIEK

SEQ ID NO: 733736 - protein, 9 aa, Homo Sapiens
QADKNLMNA

SEQ ID NO: 733737 - protein, 9 aa, Homo Sapiens
SGVTPVQSS

SEQ ID NO: 733738 - protein, 9 aa, Homo Sapiens
PSSSTQEDE

SEQ ID NO: 733739 - protein, 9 aa, Homo Sapiens
EFNYLQKVV

SEQ ID NO: 733740 - protein, 9 aa, Homo Sapiens
GWHEIHQAC

SEQ ID NO: 733741 - protein, 9 aa, Homo Sapiens
FDVFQAFLN

SEQ ID NO: 733742 - protein, 9 aa, Homo Sapiens
VGLVLSAMI

SEQ ID NO: 733743 - protein, 9 aa, Homo Sapiens
STSSSSSRE

SEQ ID NO: 733744 - protein, 9 aa, Homo Sapiens
SIVPEEERN

SEQ ID NO: 733745 - protein, 9 aa, Homo Sapiens
AGRCHDRWF

SEQ ID NO: 733746 - protein, 9 aa, Homo Sapiens
AILSDPNDI

SEQ ID NO: 733747 - protein, 9 aa, Homo Sapiens
HKRSYTGEK

SEQ ID NO: 733748 - protein, 9 aa, Homo Sapiens
IGIFCFEAV

SEQ ID NO: 733749 - protein, 9 aa, Homo Sapiens
TVCTLEFAV

SEQ ID NO: 733750 - protein, 9 aa, Homo Sapiens
VVEPVFLGF

SEQ ID NO: 733751 - protein, 9 aa, Homo Sapiens
KKETLESKH

SEQ ID NO: 733752 - protein, 9 aa, Homo Sapiens
TVNVYGHVL

SEQ ID NO: 733753 - protein, 9 aa, Homo Sapiens
RRRLYHCAS

SEQ ID NO: 733754 - protein, 9 aa, Homo Sapiens
TRWQQVWLL

SEQ ID NO: 733755 - protein, 9 aa, Homo Sapiens
DRQLVELGY

SEQ ID NO: 733756 - protein, 9 aa, Homo Sapiens
LDFLKYMDD

SEQ ID NO: 733757 - protein, 9 aa, Homo Sapiens
VRCGELLAC

SEQ ID NO: 733758 - protein, 9 aa, Homo Sapiens
ILGVKTPPE

SEQ ID NO: 733759 - protein, 9 aa, Homo Sapiens
TSRLPPQEN

SEQ ID NO: 733760 - protein, 9 aa, Homo Sapiens
CLNGSLATF

SEQ ID NO: 733761 - protein, 9 aa, Homo Sapiens
LEDKTGAHE

SEQ ID NO: 733762 - protein, 9 aa, Homo Sapiens
INKIQQDSA

SEQ ID NO: 733763 - protein, 9 aa, Homo Sapiens
LTRNLLLSR

SEQ ID NO: 733764 - protein, 9 aa, Homo Sapiens
QYTTRATPG

SEQ ID NO: 733765 - protein, 9 aa, Homo Sapiens
ELIRGLQQD

SEQ ID NO: 733766 - protein, 9 aa, Homo Sapiens
GDSVLLQTM

SEQ ID NO: 733767 - protein, 9 aa, Homo Sapiens
FHDGIKLDR

SEQ ID NO: 733768 - protein, 9 aa, Homo Sapiens
RRPRICPHQ

SEQ ID NO: 733769 - protein, 9 aa, Homo Sapiens
GKVFGQNSA

SEQ ID NO: 733770 - protein, 9 aa, Homo Sapiens
PHSLLNPQP

SEQ ID NO: 733771 - protein, 9 aa, Homo Sapiens
GCRFKRHTN

SEQ ID NO: 733772 - protein, 9 aa, Homo Sapiens
GIGDSVLLQ

SEQ ID NO: 733773 - protein, 9 aa, Homo Sapiens
GNRGSNRAL

SEQ ID NO: 733774 - protein, 9 aa, Homo Sapiens
EVPDCGHPH

SEQ ID NO: 733775 - protein, 9 aa, Homo Sapiens
GQRWILVGA

SEQ ID NO: 733776 - protein, 9 aa, Homo Sapiens
WAPCPDGYR

SEQ ID NO: 733777 - protein, 9 aa, Homo Sapiens
CRFKRHTNT

SEQ ID NO: 733778 - protein, 9 aa, Homo Sapiens
TSLNSTNPS

SEQ ID NO: 733779 - protein, 9 aa, Homo Sapiens
EQCMTERKR

SEQ ID NO: 733780 - protein, 9 aa, Homo Sapiens
DLGLLGAFI

SEQ ID NO: 733781 - protein, 9 aa, Homo Sapiens
AQGGSPARF

SEQ ID NO: 733782 - protein, 9 aa, Homo Sapiens
FTSLVSGVV

SEQ ID NO: 733783 - protein, 9 aa, Homo Sapiens
LGIKKPVGR

SEQ ID NO: 733784 - protein, 9 aa, Homo Sapiens
MEAMTDEQK

SEQ ID NO: 733785 - protein, 9 aa, Homo Sapiens
VTTVFQQMY

SEQ ID NO: 733786 - protein, 9 aa, Homo Sapiens
PWERPTAAC

SEQ ID NO: 733787 - protein, 9 aa, Homo Sapiens
AIRRGARPR

SEQ ID NO: 733788 - protein, 9 aa, Homo Sapiens
PNGLDGLEE

SEQ ID NO: 733789 - protein, 9 aa, Homo Sapiens
RPHPREAPG

SEQ ID NO: 733790 - protein, 9 aa, Homo Sapiens
KIQKFSESF

SEQ ID NO: 733791 - protein, 9 aa, Homo Sapiens
SRELACLHH

SEQ ID NO: 733792 - protein, 9 aa, Homo Sapiens
QENTRAQRQ

SEQ ID NO: 733793 - protein, 9 aa, Homo Sapiens
GRRWRAIRR

SEQ ID NO: 733794 - protein, 9 aa, Homo Sapiens
SMYCVNQAQ

SEQ ID NO: 733795 - protein, 9 aa, Homo Sapiens
ERKTINQGH

SEQ ID NO: 733796 - protein, 9 aa, Homo Sapiens
ACLILGVKT

SEQ ID NO: 733797 - protein, 9 aa, Homo Sapiens
PPRCNWLLG

SEQ ID NO: 733798 - protein, 9 aa, Homo Sapiens
ISHSEVEQL

SEQ ID NO: 733799 - protein, 9 aa, Homo Sapiens
QGIPSSNDH

SEQ ID NO: 733800 - protein, 9 aa, Homo Sapiens
GSRRPRICP

SEQ ID NO: 733801 - protein, 9 aa, Homo Sapiens
NPGSSRRRD

SEQ ID NO: 733802 - protein, 9 aa, Homo Sapiens
RDYLAIYYS

SEQ ID NO: 733803 - protein, 9 aa, Homo Sapiens
LQLYQGFHC

SEQ ID NO: 733804 - protein, 9 aa, Homo Sapiens
LLWRPSRKS

SEQ ID NO: 733805 - protein, 9 aa, Homo Sapiens
AVDNFGNRT

SEQ ID NO: 733806 - protein, 9 aa, Homo Sapiens
PQPPRCNWL

SEQ ID NO: 733807 - protein, 9 aa, Homo Sapiens
LHRFQDTKR

SEQ ID NO: 733808 - protein, 9 aa, Homo Sapiens
GTLALLNNA

SEQ ID NO: 733809 - protein, 9 aa, Homo Sapiens
ECRKTFSHP

SEQ ID NO: 733810 - protein, 9 aa, Homo Sapiens
SGSGPMTLD

SEQ ID NO: 733811 - protein, 9 aa, Homo Sapiens
DAHSEEPAY

SEQ ID NO: 733812 - protein, 9 aa, Homo Sapiens
LVDVFEKKD

SEQ ID NO: 733813 - protein, 9 aa, Homo Sapiens
LPGPLPASH

SEQ ID NO: 733814 - protein, 9 aa, Homo Sapiens
LLYLTPSRV

SEQ ID NO: 733815 - protein, 9 aa, Homo Sapiens
PGYAGPRGD

SEQ ID NO: 733816 - protein, 9 aa, Homo Sapiens
ADSTSVELV

SEQ ID NO: 733817 - protein, 9 aa, Homo Sapiens
GYSPQDAQE

SEQ ID NO: 733818 - protein, 9 aa, Homo Sapiens
MVEAVTKEI

SEQ ID NO: 733819 - protein, 9 aa, Homo Sapiens
TKNLRYIET

SEQ ID NO: 733820 - protein, 9 aa, Homo Sapiens
IHVCRLTAQ

SEQ ID NO: 733821 - protein, 9 aa, Homo Sapiens
TGVLSVQTP

SEQ ID NO: 733822 - protein, 9 aa, Homo Sapiens
RAQLASLWA

SEQ ID NO: 733823 - protein, 9 aa, Homo Sapiens
TGNCLVLWT

SEQ ID NO: 733824 - protein, 9 aa, Homo Sapiens
KSQWMKGPR

SEQ ID NO: 733825 - protein, 9 aa, Homo Sapiens
CASAAAATA

SEQ ID NO: 733826 - protein, 9 aa, Homo Sapiens
GDAEDLAAK

SEQ ID NO: 733827 - protein, 9 aa, Homo Sapiens
ATARWRWVV

SEQ ID NO: 733828 - protein, 9 aa, Homo Sapiens
LSEEFEAYI

SEQ ID NO: 733829 - protein, 9 aa, Homo Sapiens
LQQDVKVSK

SEQ ID NO: 733830 - protein, 9 aa, Homo Sapiens
AAPQLGLAT

SEQ ID NO: 733831 - protein, 9 aa, Homo Sapiens
VAPTAARTL

SEQ ID NO: 733832 - protein, 9 aa, Homo Sapiens
SGNQGTVCT

SEQ ID NO: 733833 - protein, 9 aa, Homo Sapiens
FDRTIYNVR

SEQ ID NO: 733834 - protein, 9 aa, Homo Sapiens
SDGLAPPLI

SEQ ID NO: 733835 - protein, 9 aa, Homo Sapiens
IYVVEPVFL

SEQ ID NO: 733836 - protein, 9 aa, Homo Sapiens
FEGCMAHIF

SEQ ID NO: 733837 - protein, 9 aa, Homo Sapiens
ISDLLFIRT

SEQ ID NO: 733838 - protein, 9 aa, Homo Sapiens
FIRTLPFRA

SEQ ID NO: 733839 - protein, 9 aa, Homo Sapiens
YLLESHGGL

SEQ ID NO: 733840 - protein, 9 aa, Homo Sapiens
SSRESLGLS

SEQ ID NO: 733841 - protein, 9 aa, Homo Sapiens
FKEAVRELG

SEQ ID NO: 733842 - protein, 9 aa, Homo Sapiens
VFLDICIHS

SEQ ID NO: 733843 - protein, 9 aa, Homo Sapiens
STHSSLSFH

SEQ ID NO: 733844 - protein, 9 aa, Homo Sapiens
CPNHYYTDS

SEQ ID NO: 733845 - protein, 9 aa, Homo Sapiens
MENFSKEFQ

SEQ ID NO: 733846 - protein, 9 aa, Homo Sapiens
QTSRELACL

SEQ ID NO: 733847 - protein, 9 aa, Homo Sapiens
LLSKHQIIH

SEQ ID NO: 733848 - protein, 9 aa, Homo Sapiens
RFWISFFPK

SEQ ID NO: 733849 - protein, 9 aa, Homo Sapiens
WRAIRRGAR

SEQ ID NO: 733850 - protein, 9 aa, Homo Sapiens
AHGSEGFLK

SEQ ID NO: 733851 - protein, 9 aa, Homo Sapiens
YFNGSTKHG

SEQ ID NO: 733852 - protein, 9 aa, Homo Sapiens
QGHTNQVNA

SEQ ID NO: 733853 - protein, 9 aa, Homo Sapiens
DIEMAKAPS

SEQ ID NO: 733854 - protein, 9 aa, Homo Sapiens
AKHLNDEST

SEQ ID NO: 733855 - protein, 9 aa, Homo Sapiens
RNDPKYVGL

SEQ ID NO: 733856 - protein, 9 aa, Homo Sapiens
CFKRQKISF

SEQ ID NO: 733857 - protein, 9 aa, Homo Sapiens
AGHEDQPLT

SEQ ID NO: 733858 - protein, 9 aa, Homo Sapiens
HEEGFDYNE

SEQ ID NO: 733859 - protein, 9 aa, Homo Sapiens
WRAQLASLW

SEQ ID NO: 733860 - protein, 9 aa, Homo Sapiens
GYIQVKSGT

SEQ ID NO: 733861 - protein, 9 aa, Homo Sapiens
LCLSLQAYA

SEQ ID NO: 733862 - protein, 9 aa, Homo Sapiens
LRYIETGAF

SEQ ID NO: 733863 - protein, 9 aa, Homo Sapiens
ERLISDANQ

SEQ ID NO: 733864 - protein, 9 aa, Homo Sapiens
GVIRILSVL

SEQ ID NO: 733865 - protein, 9 aa, Homo Sapiens
SYTVQSELR

SEQ ID NO: 733866 - protein, 9 aa, Homo Sapiens
PLMLSNTLG

SEQ ID NO: 733867 - protein, 9 aa, Homo Sapiens
LLAGPPETG

SEQ ID NO: 733868 - protein, 9 aa, Homo Sapiens
HSPDTYIQY

SEQ ID NO: 733869 - protein, 9 aa, Homo Sapiens
CSSSISSSN

SEQ ID NO: 733870 - protein, 9 aa, Homo Sapiens
DGLFHCSCE

SEQ ID NO: 733871 - protein, 9 aa, Homo Sapiens
HPFITLLAD

SEQ ID NO: 733872 - protein, 9 aa, Homo Sapiens
GRFLLQAQD

SEQ ID NO: 733873 - protein, 9 aa, Homo Sapiens
ELDFRLNPV

SEQ ID NO: 733874 - protein, 9 aa, Homo Sapiens
GGHAQAPLP

SEQ ID NO: 733875 - protein, 9 aa, Homo Sapiens
DKAQEKMVY

SEQ ID NO: 733876 - protein, 9 aa, Homo Sapiens
NSLHERYEN

SEQ ID NO: 733877 - protein, 9 aa, Homo Sapiens
EDPFWALHS

SEQ ID NO: 733878 - protein, 9 aa, Homo Sapiens
ICIHSSPIG

SEQ ID NO: 733879 - protein, 9 aa, Homo Sapiens
IHSSPIGRL

SEQ ID NO: 733880 - protein, 9 aa, Homo Sapiens
PGEAEHRNR

SEQ ID NO: 733881 - protein, 9 aa, Homo Sapiens
VRPPGTLLS

SEQ ID NO: 733882 - protein, 9 aa, Homo Sapiens
DLLMQNGEC

SEQ ID NO: 733883 - protein, 9 aa, Homo Sapiens
KHNVTKLLT

SEQ ID NO: 733884 - protein, 9 aa, Homo Sapiens
VQSEYGEDL

SEQ ID NO: 733885 - protein, 9 aa, Homo Sapiens
QHNGHSLQY

SEQ ID NO: 733886 - protein, 9 aa, Homo Sapiens
FWISFFPKV

SEQ ID NO: 733887 - protein, 9 aa, Homo Sapiens
NAQELQMEK

SEQ ID NO: 733888 - protein, 9 aa, Homo Sapiens
IQKFSESFE

SEQ ID NO: 733889 - protein, 9 aa, Homo Sapiens
ELHRFQDTK

SEQ ID NO: 733890 - protein, 9 aa, Homo Sapiens
MQRYGPPTS

SEQ ID NO: 733891 - protein, 9 aa, Homo Sapiens
VFLLADVCF

SEQ ID NO: 733892 - protein, 9 aa, Homo Sapiens
VVRHRWTHH

SEQ ID NO: 733893 - protein, 9 aa, Homo Sapiens
MKVLKQGTE

SEQ ID NO: 733894 - protein, 9 aa, Homo Sapiens
IRGLCEFTP

SEQ ID NO: 733895 - protein, 9 aa, Homo Sapiens
RFHDGIKLD

SEQ ID NO: 733896 - protein, 9 aa, Homo Sapiens
IYLIAKEQE

SEQ ID NO: 733897 - protein, 9 aa, Homo Sapiens
LPGFPGVPG

SEQ ID NO: 733898 - protein, 9 aa, Homo Sapiens
KGRARFDGP

SEQ ID NO: 733899 - protein, 9 aa, Homo Sapiens
SQGRIPVKR

SEQ ID NO: 733900 - protein, 9 aa, Homo Sapiens
RILSVLIIV

SEQ ID NO: 733901 - protein, 9 aa, Homo Sapiens
AVMDYDRYL

SEQ ID NO: 733902 - protein, 9 aa, Homo Sapiens
PGGPVETGK

SEQ ID NO: 733903 - protein, 9 aa, Homo Sapiens
TWTEQPEAQ

SEQ ID NO: 733904 - protein, 9 aa, Homo Sapiens
KEGVLLAKM

SEQ ID NO: 733905 - protein, 9 aa, Homo Sapiens
SGSSSSGVT

SEQ ID NO: 733906 - protein, 9 aa, Homo Sapiens
PPTSYPNLK

SEQ ID NO: 733907 - protein, 9 aa, Homo Sapiens
NHWFHSSQV

SEQ ID NO: 733908 - protein, 9 aa, Homo Sapiens
SEEFEAYIN

SEQ ID NO: 733909 - protein, 9 aa, Homo Sapiens
HLQELAQVE

SEQ ID NO: 733910 - protein, 9 aa, Homo Sapiens
RTKLIGIGC

SEQ ID NO: 733911 - protein, 9 aa, Homo Sapiens
RPTAACSTR

SEQ ID NO: 733912 - protein, 9 aa, Homo Sapiens
VAVAAEDQA

SEQ ID NO: 733913 - protein, 9 aa, Homo Sapiens
QITEEEWEK

SEQ ID NO: 733914 - protein, 9 aa, Homo Sapiens
RVYQTSPTH

SEQ ID NO: 733915 - protein, 9 aa, Homo Sapiens
WFHSSQVPS

SEQ ID NO: 733916 - protein, 9 aa, Homo Sapiens
VEVKQHAQE

SEQ ID NO: 733917 - protein, 9 aa, Homo Sapiens
DKKGTNYLV

SEQ ID NO: 733918 - protein, 9 aa, Homo Sapiens
FVHCLIMIS

SEQ ID NO: 733919 - protein, 9 aa, Homo Sapiens
GAQGAQKSI

SEQ ID NO: 733920 - protein, 9 aa, Homo Sapiens
KVKNQYQLL

SEQ ID NO: 733921 - protein, 9 aa, Homo Sapiens
CGELLACGQ

SEQ ID NO: 733922 - protein, 9 aa, Homo Sapiens
MSMGGAPAE

SEQ ID NO: 733923 - protein, 9 aa, Homo Sapiens
KSAAAWTCQ

SEQ ID NO: 733924 - protein, 9 aa, Homo Sapiens
AQTSRELAC

SEQ ID NO: 733925 - protein, 9 aa, Homo Sapiens
APQTCTPSL

SEQ ID NO: 733926 - protein, 9 aa, Homo Sapiens
RGLPGFPGV

SEQ ID NO: 733927 - protein, 9 aa, Homo Sapiens
LAGPERITD

SEQ ID NO: 733928 - protein, 9 aa, Homo Sapiens
GVKERINKG

SEQ ID NO: 733929 - protein, 9 aa, Homo Sapiens
QRRATRGGL

SEQ ID NO: 733930 - protein, 9 aa, Homo Sapiens
PSVQGQFYY

SEQ ID NO: 733931 - protein, 9 aa, Homo Sapiens
IKKPVGRKL

SEQ ID NO: 733932 - protein, 9 aa, Homo Sapiens
EYGEDLYFS

SEQ ID NO: 733933 - protein, 9 aa, Homo Sapiens
SRDNELYPL

SEQ ID NO: 733934 - protein, 9 aa, Homo Sapiens
SIQVKQLDI

SEQ ID NO: 733935 - protein, 9 aa, Homo Sapiens
GLIHPFITL

SEQ ID NO: 733936 - protein, 9 aa, Homo Sapiens
TNTDGLFHC

SEQ ID NO: 733937 - protein, 9 aa, Homo Sapiens
FENQVNRIV

SEQ ID NO: 733938 - protein, 9 aa, Homo Sapiens
GHEDEMEIY

SEQ ID NO: 733939 - protein, 9 aa, Homo Sapiens
EKFAKVKNQ

SEQ ID NO: 733940 - protein, 9 aa, Homo Sapiens
SVLIIVMCI

SEQ ID NO: 733941 - protein, 9 aa, Homo Sapiens
IFSMSANIM

SEQ ID NO: 733942 - protein, 9 aa, Homo Sapiens
VVGLPPKRS

SEQ ID NO: 733943 - protein, 9 aa, Homo Sapiens
MSAAFQAGV

SEQ ID NO: 733944 - protein, 9 aa, Homo Sapiens
KTGIYNPAK

SEQ ID NO: 733945 - protein, 9 aa, Homo Sapiens
RELACLHHS

SEQ ID NO: 733946 - protein, 9 aa, Homo Sapiens
TECSSRGLC

SEQ ID NO: 733947 - protein, 9 aa, Homo Sapiens
TRARECVAQ

SEQ ID NO: 733948 - protein, 9 aa, Homo Sapiens
IELCESIQV

SEQ ID NO: 733949 - protein, 9 aa, Homo Sapiens
SLCSFKINE

SEQ ID NO: 733950 - protein, 9 aa, Homo Sapiens
GHVPEQFSG

SEQ ID NO: 733951 - protein, 9 aa, Homo Sapiens
RIPVKRMAI

SEQ ID NO: 733952 - protein, 9 aa, Homo Sapiens
RRWRAIRRG

SEQ ID NO: 733953 - protein, 9 aa, Homo Sapiens
PKYVGLVLS

SEQ ID NO: 733954 - protein, 9 aa, Homo Sapiens
KTFQGHTNQ

SEQ ID NO: 733955 - protein, 9 aa, Homo Sapiens
SLPGIDMNV

SEQ ID NO: 733956 - protein, 9 aa, Homo Sapiens
VPPARQPCD

SEQ ID NO: 733957 - protein, 9 aa, Homo Sapiens
PEAQSSQAD

SEQ ID NO: 733958 - protein, 9 aa, Homo Sapiens
RFFQGWGTW

SEQ ID NO: 733959 - protein, 9 aa, Homo Sapiens
QIWNLNPVF

SEQ ID NO: 733960 - protein, 9 aa, Homo Sapiens
SELRCPTEC

SEQ ID NO: 733961 - protein, 9 aa, Homo Sapiens
PPCHPFPDL

SEQ ID NO: 733962 - protein, 9 aa, Homo Sapiens
SDPNDISSG

SEQ ID NO: 733963 - protein, 9 aa, Homo Sapiens
NPPTQPKVS

SEQ ID NO: 733964 - protein, 9 aa, Homo Sapiens
GGQRWILVG

SEQ ID NO: 733965 - protein, 9 aa, Homo Sapiens
LCESIQVKQ

SEQ ID NO: 733966 - protein, 9 aa, Homo Sapiens
DSTYFAWCL

SEQ ID NO: 733967 - protein, 9 aa, Homo Sapiens
KGPRSLPPP

SEQ ID NO: 733968 - protein, 9 aa, Homo Sapiens
DSRQPQASY

SEQ ID NO: 733969 - protein, 9 aa, Homo Sapiens
LYSLSLLYL

SEQ ID NO: 733970 - protein, 9 aa, Homo Sapiens
NWSIVPEEE

SEQ ID NO: 733971 - protein, 9 aa, Homo Sapiens
HLHYQKDKK

SEQ ID NO: 733972 - protein, 9 aa, Homo Sapiens
KWYNLIIQN

SEQ ID NO: 733973 - protein, 9 aa, Homo Sapiens
REPAGWPAR

SEQ ID NO: 733974 - protein, 9 aa, Homo Sapiens
FWALHSVMN

SEQ ID NO: 733975 - protein, 9 aa, Homo Sapiens
IRRHKRSYT

SEQ ID NO: 733976 - protein, 9 aa, Homo Sapiens
ISEVLVDAA

SEQ ID NO: 733977 - protein, 9 aa, Homo Sapiens
PATEVSCRH

SEQ ID NO: 733978 - protein, 9 aa, Homo Sapiens
DPNDISSGL

SEQ ID NO: 733979 - protein, 9 aa, Homo Sapiens
SKQEAWSTH

SEQ ID NO: 733980 - protein, 9 aa, Homo Sapiens
WAILSDPND

SEQ ID NO: 733981 - protein, 9 aa, Homo Sapiens
QEAWSTHNT

SEQ ID NO: 733982 - protein, 9 aa, Homo Sapiens
EAPGPSRDS

SEQ ID NO: 733983 - protein, 9 aa, Homo Sapiens
RWTHHGENP

SEQ ID NO: 733984 - protein, 9 aa, Homo Sapiens
EAEDLPYEE

SEQ ID NO: 733985 - protein, 9 aa, Homo Sapiens
GHAQAPLPV

SEQ ID NO: 733986 - protein, 9 aa, Homo Sapiens
HNTLLHFFC

SEQ ID NO: 733987 - protein, 9 aa, Homo Sapiens
RSRPAPSLC

SEQ ID NO: 733988 - protein, 9 aa, Homo Sapiens
AACSTRSPA

SEQ ID NO: 733989 - protein, 9 aa, Homo Sapiens
KDDGMNFTH

SEQ ID NO: 733990 - protein, 9 aa, Homo Sapiens
LSTTVNVYG

SEQ ID NO: 733991 - protein, 9 aa, Homo Sapiens
AGWPARKRS

SEQ ID NO: 733992 - protein, 9 aa, Homo Sapiens
LLNNAKYSL

SEQ ID NO: 733993 - protein, 9 aa, Homo Sapiens
CQCLNGSLA

SEQ ID NO: 733994 - protein, 9 aa, Homo Sapiens
ALWAPCPDG

SEQ ID NO: 733995 - protein, 9 aa, Homo Sapiens
RKTINQGHE

SEQ ID NO: 733996 - protein, 9 aa, Homo Sapiens
GRPRSKQEA

SEQ ID NO: 733997 - protein, 9 aa, Homo Sapiens
GVTPVQSSV

SEQ ID NO: 733998 - protein, 9 aa, Homo Sapiens
PCSRGIGDS

SEQ ID NO: 733999 - protein, 9 aa, Homo Sapiens
TARWRWVVK

SEQ ID NO: 734000 - protein, 9 aa, Homo Sapiens
CGHPHQEMP

SEQ ID NO: 734001 - protein, 9 aa, Homo Sapiens
EPVFLGFTV

SEQ ID NO: 734002 - protein, 9 aa, Homo Sapiens
TNPAVQAFH

SEQ ID NO: 734003 - protein, 9 aa, Homo Sapiens
ACSTRSPAS

SEQ ID NO: 734004 - protein, 9 aa, Homo Sapiens
VVQIILQAV

SEQ ID NO: 734005 - protein, 9 aa, Homo Sapiens
CSRGIGDSV

SEQ ID NO: 734006 - protein, 9 aa, Homo Sapiens
PCALWAPCP

SEQ ID NO: 734007 - protein, 9 aa, Homo Sapiens
LSLLYLTPS

SEQ ID NO: 734008 - protein, 9 aa, Homo Sapiens
RLDGPHEAR

SEQ ID NO: 734009 - protein, 9 aa, Homo Sapiens
LLLSRDNEL

SEQ ID NO: 734010 - protein, 9 aa, Homo Sapiens
SLNSTNPSV

SEQ ID NO: 734011 - protein, 9 aa, Homo Sapiens
QAQDARGAV

SEQ ID NO: 734012 - protein, 9 aa, Homo Sapiens
SNSSSSSSN

SEQ ID NO: 734013 - protein, 9 aa, Homo Sapiens
LLRKWYNLI

SEQ ID NO: 734014 - protein, 9 aa, Homo Sapiens
AGPPETGKT

SEQ ID NO: 734015 - protein, 9 aa, Homo Sapiens
GSAGGAPTP

SEQ ID NO: 734016 - protein, 9 aa, Homo Sapiens
SLHERYENC

SEQ ID NO: 734017 - protein, 9 aa, Homo Sapiens
MYCVNQAQV

SEQ ID NO: 734018 - protein, 9 aa, Homo Sapiens
SSTGSMYLN

SEQ ID NO: 734019 - protein, 9 aa, Homo Sapiens
ALAMLGERV

SEQ ID NO: 734020 - protein, 9 aa, Homo Sapiens
CEFTPLYPM

SEQ ID NO: 734021 - protein, 9 aa, Homo Sapiens
CSLRPPRLI

SEQ ID NO: 734022 - protein, 9 aa, Homo Sapiens
TERKRSRLK

SEQ ID NO: 734023 - protein, 9 aa, Homo Sapiens
KVKSAAAWT

SEQ ID NO: 734024 - protein, 9 aa, Homo Sapiens
DADGIRELL

SEQ ID NO: 734025 - protein, 9 aa, Homo Sapiens
QIILQAVKQ

SEQ ID NO: 734026 - protein, 9 aa, Homo Sapiens
KQEAWSTHN

SEQ ID NO: 734027 - protein, 9 aa, Homo Sapiens
HIWLNSTEY

SEQ ID NO: 734028 - protein, 9 aa, Homo Sapiens
ALRFTAKHL

SEQ ID NO: 734029 - protein, 9 aa, Homo Sapiens
STTQIEPSA

SEQ ID NO: 734030 - protein, 9 aa, Homo Sapiens
DFHGQIGFT

SEQ ID NO: 734031 - protein, 9 aa, Homo Sapiens
EEHLAMVEA

SEQ ID NO: 734032 - protein, 9 aa, Homo Sapiens
LPNGLDGLE

SEQ ID NO: 734033 - protein, 9 aa, Homo Sapiens
TQLGVLPAL

SEQ ID NO: 734034 - protein, 9 aa, Homo Sapiens
SPVAPTAAR

SEQ ID NO: 734035 - protein, 9 aa, Homo Sapiens
PQYTTRATP

SEQ ID NO: 734036 - protein, 9 aa, Homo Sapiens
YIQVKSGTV

SEQ ID NO: 734037 - protein, 9 aa, Homo Sapiens
KEQERLISD

SEQ ID NO: 734038 - protein, 9 aa, Homo Sapiens
LRLQLYQGF

SEQ ID NO: 734039 - protein, 9 aa, Homo Sapiens
QNPKGRLET

SEQ ID NO: 734040 - protein, 9 aa, Homo Sapiens
HAQAPLPVL

SEQ ID NO: 734041 - protein, 9 aa, Homo Sapiens
KKGTNYLVD

SEQ ID NO: 734042 - protein, 9 aa, Homo Sapiens
LSFASGGRS

SEQ ID NO: 734043 - protein, 9 aa, Homo Sapiens
PLFEELRPS

SEQ ID NO: 734044 - protein, 9 aa, Homo Sapiens
RPGCRFKRH

SEQ ID NO: 734045 - protein, 9 aa, Homo Sapiens
GNQGTVCTL

SEQ ID NO: 734046 - protein, 9 aa, Homo Sapiens
PREAPGPSR

SEQ ID NO: 734047 - protein, 9 aa, Homo Sapiens
QCLNGSLAT

SEQ ID NO: 734048 - protein, 9 aa, Homo Sapiens
LEDETLDRQ

SEQ ID NO: 734049 - protein, 9 aa, Homo Sapiens
CSTRSPASR

SEQ ID NO: 734050 - protein, 9 aa, Homo Sapiens
SASQIWNLN

SEQ ID NO: 734051 - protein, 9 aa, Homo Sapiens
AGPGSAGGA

SEQ ID NO: 734052 - protein, 9 aa, Homo Sapiens
PPPQEPLQP

SEQ ID NO: 734053 - protein, 9 aa, Homo Sapiens
SDSGNQGTV

SEQ ID NO: 734054 - protein, 9 aa, Homo Sapiens
LGLLGAFIT

SEQ ID NO: 734055 - protein, 9 aa, Homo Sapiens
GGLLALVLC

SEQ ID NO: 734056 - protein, 9 aa, Homo Sapiens
CMAHIFVLH

SEQ ID NO: 734057 - protein, 9 aa, Homo Sapiens
LQELAQVEV

SEQ ID NO: 734058 - protein, 9 aa, Homo Sapiens
FLLQAQDAR

SEQ ID NO: 734059 - protein, 9 aa, Homo Sapiens
LLFTSLVSG

SEQ ID NO: 734060 - protein, 9 aa, Homo Sapiens
DSVLLQTMH

SEQ ID NO: 734061 - protein, 9 aa, Homo Sapiens
LHGQAPCSS

SEQ ID NO: 734062 - protein, 9 aa, Homo Sapiens
AELHRFQDT

SEQ ID NO: 734063 - protein, 9 aa, Homo Sapiens
TINPRTGVI

SEQ ID NO: 734064 - protein, 9 aa, Homo Sapiens
LVTSHGLRA

SEQ ID NO: 734065 - protein, 9 aa, Homo Sapiens
FMRSLPSRQ

SEQ ID NO: 734066 - protein, 9 aa, Homo Sapiens
GSEGFLKGE

SEQ ID NO: 734067 - protein, 9 aa, Homo Sapiens
CMTSLNSTN

SEQ ID NO: 734068 - protein, 9 aa, Homo Sapiens
AAATAAALL

SEQ ID NO: 734069 - protein, 9 aa, Homo Sapiens
VAQGGSPAR

SEQ ID NO: 734070 - protein, 9 aa, Homo Sapiens
SIECFKRQK

SEQ ID NO: 734071 - protein, 9 aa, Homo Sapiens
ELCESIQVK

SEQ ID NO: 734072 - protein, 9 aa, Homo Sapiens
QPSVPQRAT

SEQ ID NO: 734073 - protein, 9 aa, Homo Sapiens
PPAYEYVVH

SEQ ID NO: 734074 - protein, 9 aa, Homo Sapiens
SSSISSSNS

SEQ ID NO: 734075 - protein, 9 aa, Homo Sapiens
IIQNKDDLA

SEQ ID NO: 734076 - protein, 9 aa, Homo Sapiens
WFVIELCES

SEQ ID NO: 734077 - protein, 9 aa, Homo Sapiens
HCYLYLVYQ

SEQ ID NO: 734078 - protein, 9 aa, Homo Sapiens
YFAWCLDGE

SEQ ID NO: 734079 - protein, 9 aa, Homo Sapiens
RTRLLWRPS

SEQ ID NO: 734080 - protein, 9 aa, Homo Sapiens
GHIQATPRP

SEQ ID NO: 734081 - protein, 9 aa, Homo Sapiens
LYHVASTVF

SEQ ID NO: 734082 - protein, 9 aa, Homo Sapiens
LTFCRVCSM

SEQ ID NO: 734083 - protein, 9 aa, Homo Sapiens
HGLRAEVSG

SEQ ID NO: 734084 - protein, 9 aa, Homo Sapiens
LRAFEPLLS

SEQ ID NO: 734085 - protein, 9 aa, Homo Sapiens
GEGTLALLN

SEQ ID NO: 734086 - protein, 9 aa, Homo Sapiens
GIYNPAKQK

SEQ ID NO: 734087 - protein, 9 aa, Homo Sapiens
NRERSGCAL

SEQ ID NO: 734088 - protein, 9 aa, Homo Sapiens
KLHRTKLIG

SEQ ID NO: 734089 - protein, 9 aa, Homo Sapiens
RAFEPLLSF

SEQ ID NO: 734090 - protein, 9 aa, Homo Sapiens
GRLYVKKPL

SEQ ID NO: 734091 - protein, 9 aa, Homo Sapiens
EVTTPDSDF

SEQ ID NO: 734092 - protein, 9 aa, Homo Sapiens
AQAQPHVPP

SEQ ID NO: 734093 - protein, 9 aa, Homo Sapiens
KISKGCVVP

SEQ ID NO: 734094 - protein, 9 aa, Homo Sapiens
GLEACTRKR

SEQ ID NO: 734095 - protein, 9 aa, Homo Sapiens
TYGQTFADR

SEQ ID NO: 734096 - protein, 9 aa, Homo Sapiens
ALVNSIECF

SEQ ID NO: 734097 - protein, 9 aa, Homo Sapiens
SGPMTLDDV

SEQ ID NO: 734098 - protein, 9 aa, Homo Sapiens
FGNVTTVFQ

SEQ ID NO: 734099 - protein, 9 aa, Homo Sapiens
QTEGSGWLD

SEQ ID NO: 734100 - protein, 9 aa, Homo Sapiens
SHGGLLALV

SEQ ID NO: 734101 - protein, 9 aa, Homo Sapiens
ANGKPLSEE

SEQ ID NO: 734102 - protein, 9 aa, Homo Sapiens
SSGTRTPVV

SEQ ID NO: 734103 - protein, 9 aa, Homo Sapiens
EAAEEKKEE

SEQ ID NO: 734104 - protein, 9 aa, Homo Sapiens
DEASNLVVE

SEQ ID NO: 734105 - protein, 9 aa, Homo Sapiens
KHLQELAQV

SEQ ID NO: 734106 - protein, 9 aa, Homo Sapiens
ESHGGLLAL

SEQ ID NO: 734107 - protein, 9 aa, Homo Sapiens
VKERINKGK

SEQ ID NO: 734108 - protein, 9 aa, Homo Sapiens
FEAEDLPYE

SEQ ID NO: 734109 - protein, 9 aa, Homo Sapiens
GNHQVQNPK

SEQ ID NO: 734110 - protein, 9 aa, Homo Sapiens
DAAPQLGLA

SEQ ID NO: 734111 - protein, 9 aa, Homo Sapiens
RAIRRGARP

SEQ ID NO: 734112 - protein, 9 aa, Homo Sapiens
PTVLGFLLA

SEQ ID NO: 734113 - protein, 9 aa, Homo Sapiens
LMQAELHRF

SEQ ID NO: 734114 - protein, 9 aa, Homo Sapiens
ILGHIQATP

SEQ ID NO: 734115 - protein, 9 aa, Homo Sapiens
FKINEIYSG

SEQ ID NO: 734116 - protein, 9 aa, Homo Sapiens
WNLNPVFGG

SEQ ID NO: 734117 - protein, 9 aa, Homo Sapiens
AKVKNQYQL

SEQ ID NO: 734118 - protein, 9 aa, Homo Sapiens
RLLWRPSRK

SEQ ID NO: 734119 - protein, 9 aa, Homo Sapiens
KTYRRKPYE

SEQ ID NO: 734120 - protein, 9 aa, Homo Sapiens
TQPAGVPEM

SEQ ID NO: 734121 - protein, 9 aa, Homo Sapiens
TTALCLSLQ

SEQ ID NO: 734122 - protein, 9 aa, Homo Sapiens
VQIILQAVK

SEQ ID NO: 734123 - protein, 9 aa, Homo Sapiens
ESTEEVCSL

SEQ ID NO: 734124 - protein, 9 aa, Homo Sapiens
ERGGAGGLD

SEQ ID NO: 734125 - protein, 9 aa, Homo Sapiens
THEDEEDEE

SEQ ID NO: 734126 - protein, 9 aa, Homo Sapiens
YTVQSELRD

SEQ ID NO: 734127 - protein, 9 aa, Homo Sapiens
VQGQFYYIS

SEQ ID NO: 734128 - protein, 9 aa, Homo Sapiens
KELDFRLNP

SEQ ID NO: 734129 - protein, 9 aa, Homo Sapiens
RNRSQSLAI

SEQ ID NO: 734130 - protein, 9 aa, Homo Sapiens
KEEPEAEEE

SEQ ID NO: 734131 - protein, 9 aa, Homo Sapiens
AFHIWLNST

SEQ ID NO: 734132 - protein, 9 aa, Homo Sapiens
CCSLHHATM

SEQ ID NO: 734133 - protein, 9 aa, Homo Sapiens
QEEGSGGHA

SEQ ID NO: 734134 - protein, 9 aa, Homo Sapiens
VYGHVLAVS

SEQ ID NO: 734135 - protein, 9 aa, Homo Sapiens
IGRLYVKKP

SEQ ID NO: 734136 - protein, 9 aa, Homo Sapiens
DVCISIPKV

SEQ ID NO: 734137 - protein, 9 aa, Homo Sapiens
RKLLFTSLV

SEQ ID NO: 734138 - protein, 9 aa, Homo Sapiens
APCAGTTDA

SEQ ID NO: 734139 - protein, 9 aa, Homo Sapiens
FALDLLMQN

SEQ ID NO: 734140 - protein, 9 aa, Homo Sapiens
KIQQREKEW

SEQ ID NO: 734141 - protein, 9 aa, Homo Sapiens
FVLYLLQNG

SEQ ID NO: 734142 - protein, 9 aa, Homo Sapiens
KGSLLFNIG

SEQ ID NO: 734143 - protein, 9 aa, Homo Sapiens
AEPAAALAM

SEQ ID NO: 734144 - protein, 9 aa, Homo Sapiens
VYEERSEAN

SEQ ID NO: 734145 - protein, 9 aa, Homo Sapiens
FEAVIKIIA

SEQ ID NO: 734146 - protein, 9 aa, Homo Sapiens
LRAELLRLE

SEQ ID NO: 734147 - protein, 9 aa, Homo Sapiens
AQLKIQQRE

SEQ ID NO: 734148 - protein, 9 aa, Homo Sapiens
VFEAEDLPY

SEQ ID NO: 734149 - protein, 9 aa, Homo Sapiens
PSLCSFKIN

SEQ ID NO: 734150 - protein, 9 aa, Homo Sapiens
ISIPKVDAY

SEQ ID NO: 734151 - protein, 9 aa, Homo Sapiens
RDADGIREL

SEQ ID NO: 734152 - protein, 9 aa, Homo Sapiens
GYGFGCGYG

SEQ ID NO: 734153 - protein, 9 aa, Homo Sapiens
HEIHVCRLT

SEQ ID NO: 734154 - protein, 9 aa, Homo Sapiens
FPTADSTSV

SEQ ID NO: 734155 - protein, 9 aa, Homo Sapiens
LLAGRCHDR

SEQ ID NO: 734156 - protein, 9 aa, Homo Sapiens
VELCLWLHL

SEQ ID NO: 734157 - protein, 9 aa, Homo Sapiens
VISMHAQAA

SEQ ID NO: 734158 - protein, 9 aa, Homo Sapiens
GIADENGWH

SEQ ID NO: 734159 - protein, 9 aa, Homo Sapiens
GAVGFADFV

SEQ ID NO: 734160 - protein, 9 aa, Homo Sapiens
LWAPCPDGY

SEQ ID NO: 734161 - protein, 9 aa, Homo Sapiens
ALLNNAKYS

SEQ ID NO: 734162 - protein, 9 aa, Homo Sapiens
QSELRDYDP

SEQ ID NO: 734163 - protein, 9 aa, Homo Sapiens
ITCKLQKME

SEQ ID NO: 734164 - protein, 9 aa, Homo Sapiens
EKCGHQITE

SEQ ID NO: 734165 - protein, 9 aa, Homo Sapiens
FEFLGINLY

SEQ ID NO: 734166 - protein, 9 aa, Homo Sapiens
LWLACRADE

SEQ ID NO: 734167 - protein, 9 aa, Homo Sapiens
SDILAPQTC

SEQ ID NO: 734168 - protein, 9 aa, Homo Sapiens
IPVKRMAIE

SEQ ID NO: 734169 - protein, 9 aa, Homo Sapiens
LGLATQAYS

SEQ ID NO: 734170 - protein, 9 aa, Homo Sapiens
KVLGQGEQW

SEQ ID NO: 734171 - protein, 9 aa, Homo Sapiens
HGGARRLQR

SEQ ID NO: 734172 - protein, 9 aa, Homo Sapiens
RWVVKVKPH

SEQ ID NO: 734173 - protein, 9 aa, Homo Sapiens
TVFQQMYAN

SEQ ID NO: 734174 - protein, 9 aa, Homo Sapiens
LVSVRLYYK

SEQ ID NO: 734175 - protein, 9 aa, Homo Sapiens
LLVARLDGP

SEQ ID NO: 734176 - protein, 9 aa, Homo Sapiens
LVNSIECFK

SEQ ID NO: 734177 - protein, 9 aa, Homo Sapiens
FGNRTLRRR

SEQ ID NO: 734178 - protein, 9 aa, Homo Sapiens
DICIHSSPI

SEQ ID NO: 734179 - protein, 9 aa, Homo Sapiens
VINITSVVD

SEQ ID NO: 734180 - protein, 9 aa, Homo Sapiens
GRIPVKRMA

SEQ ID NO: 734181 - protein, 9 aa, Homo Sapiens
RKEGVLLAK

SEQ ID NO: 734182 - protein, 9 aa, Homo Sapiens
IRRGARPRG

SEQ ID NO: 734183 - protein, 9 aa, Homo Sapiens
LYQGFHCGN

SEQ ID NO: 734184 - protein, 9 aa, Homo Sapiens
ELGGLEACT

SEQ ID NO: 734185 - protein, 9 aa, Homo Sapiens
CDHNTLLHF

SEQ ID NO: 734186 - protein, 9 aa, Homo Sapiens
YPPCHPFPD

SEQ ID NO: 734187 - protein, 9 aa, Homo Sapiens
GIVTKYITK

SEQ ID NO: 734188 - protein, 9 aa, Homo Sapiens
ASNLVVEEK

SEQ ID NO: 734189 - protein, 9 aa, Homo Sapiens
SAAAWTCQQ

SEQ ID NO: 734190 - protein, 9 aa, Homo Sapiens
SMYLNALVD

SEQ ID NO: 734191 - protein, 9 aa, Homo Sapiens
FPLFFVHCL

SEQ ID NO: 734192 - protein, 9 aa, Homo Sapiens
FTPCGELQA

SEQ ID NO: 734193 - protein, 9 aa, Homo Sapiens
PVYPTLPQA

SEQ ID NO: 734194 - protein, 9 aa, Homo Sapiens
LTGSSPTQG

SEQ ID NO: 734195 - protein, 9 aa, Homo Sapiens
APKVPTLEL

SEQ ID NO: 734196 - protein, 9 aa, Homo Sapiens
PDLSISHSE

SEQ ID NO: 734197 - protein, 9 aa, Homo Sapiens
VSDSFSCGS

SEQ ID NO: 734198 - protein, 9 aa, Homo Sapiens
FSCGSSPGS

SEQ ID NO: 734199 - protein, 9 aa, Homo Sapiens
TYPEPVYPT

SEQ ID NO: 734200 - protein, 9 aa, Homo Sapiens
QNNPATEVS

SEQ ID NO: 734201 - protein, 9 aa, Homo Sapiens
YEYVVHRPG

SEQ ID NO: 734202 - protein, 9 aa, Homo Sapiens
AMEFNYLQK

SEQ ID NO: 734203 - protein, 9 aa, Homo Sapiens
LPQDDSSGT

SEQ ID NO: 734204 - protein, 9 aa, Homo Sapiens
PTHEDEEDE

SEQ ID NO: 734205 - protein, 9 aa, Homo Sapiens
QTCQCLNGS

SEQ ID NO: 734206 - protein, 9 aa, Homo Sapiens
LPEPIGVGG

SEQ ID NO: 734207 - protein, 9 aa, Homo Sapiens
QAQAQPHVP

SEQ ID NO: 734208 - protein, 9 aa, Homo Sapiens
SLSLLYLTP

SEQ ID NO: 734209 - protein, 9 aa, Homo Sapiens
SLANKQYVS

SEQ ID NO: 734210 - protein, 9 aa, Homo Sapiens
KVGSQNKEE

SEQ ID NO: 734211 - protein, 9 aa, Homo Sapiens
GLDGLEEED

SEQ ID NO: 734212 - protein, 9 aa, Homo Sapiens
RAQQCRFWI

SEQ ID NO: 734213 - protein, 9 aa, Homo Sapiens
LFETLTQLG

SEQ ID NO: 734214 - protein, 9 aa, Homo Sapiens
ATEVSCRHN

SEQ ID NO: 734215 - protein, 9 aa, Homo Sapiens
EELGGLEAC

SEQ ID NO: 734216 - protein, 9 aa, Homo Sapiens
KEAAEEKKE

SEQ ID NO: 734217 - protein, 9 aa, Homo Sapiens
RGPRWRAQL

SEQ ID NO: 734218 - protein, 9 aa, Homo Sapiens
TRNLLLSRD

SEQ ID NO: 734219 - protein, 9 aa, Homo Sapiens
VLGQGEQWR

SEQ ID NO: 734220 - protein, 9 aa, Homo Sapiens
LVMAAFDGR

SEQ ID NO: 734221 - protein, 9 aa, Homo Sapiens
IQADKNLMN

SEQ ID NO: 734222 - protein, 9 aa, Homo Sapiens
RSLPPPAPP

SEQ ID NO: 734223 - protein, 9 aa, Homo Sapiens
NECGKVFGQ

SEQ ID NO: 734224 - protein, 9 aa, Homo Sapiens
PLIRVEGNL

SEQ ID NO: 734225 - protein, 9 aa, Homo Sapiens
PRAPPREQR

SEQ ID NO: 734226 - protein, 9 aa, Homo Sapiens
NLSSTGSMY

SEQ ID NO: 734227 - protein, 9 aa, Homo Sapiens
RSMLSSPAA

SEQ ID NO: 734228 - protein, 9 aa, Homo Sapiens
DFGWMPQAA

SEQ ID NO: 734229 - protein, 9 aa, Homo Sapiens
YSTTPVPTP

SEQ ID NO: 734230 - protein, 9 aa, Homo Sapiens
LPPPQEPLQ

SEQ ID NO: 734231 - protein, 9 aa, Homo Sapiens
TDLHLHYQK

SEQ ID NO: 734232 - protein, 9 aa, Homo Sapiens
SEYGEDLYF

SEQ ID NO: 734233 - protein, 9 aa, Homo Sapiens
ALDLLMQNG

SEQ ID NO: 734234 - protein, 9 aa, Homo Sapiens
PRSKQEAWS

SEQ ID NO: 734235 - protein, 9 aa, Homo Sapiens
ADGIRELLG

SEQ ID NO: 734236 - protein, 9 aa, Homo Sapiens
DGVPGGPVE

SEQ ID NO: 734237 - protein, 9 aa, Homo Sapiens
VAAEDQAFL

SEQ ID NO: 734238 - protein, 9 aa, Homo Sapiens
PTQPKVSKP

SEQ ID NO: 734239 - protein, 9 aa, Homo Sapiens
ILSVLIIVM

SEQ ID NO: 734240 - protein, 9 aa, Homo Sapiens
GIKKPVGRK

SEQ ID NO: 734241 - protein, 9 aa, Homo Sapiens
KKEAAEEKK

SEQ ID NO: 734242 - protein, 9 aa, Homo Sapiens
SHPLFGRLV

SEQ ID NO: 734243 - protein, 9 aa, Homo Sapiens
GTTGNCLVL

SEQ ID NO: 734244 - protein, 9 aa, Homo Sapiens
SGTRTPVVK

SEQ ID NO: 734245 - protein, 9 aa, Homo Sapiens
DEHDAMSAA

SEQ ID NO: 734246 - protein, 9 aa, Homo Sapiens
RRLYHCASY

SEQ ID NO: 734247 - protein, 9 aa, Homo Sapiens
NSTNPSVAT

SEQ ID NO: 734248 - protein, 9 aa, Homo Sapiens
LQNCDLDQQ

SEQ ID NO: 734249 - protein, 9 aa, Homo Sapiens
PLFFVHCLI

SEQ ID NO: 734250 - protein, 9 aa, Homo Sapiens
LVARLDGPH

SEQ ID NO: 734251 - protein, 9 aa, Homo Sapiens
HLDAHSEEP

SEQ ID NO: 734252 - protein, 9 aa, Homo Sapiens
ETGAFINLP

SEQ ID NO: 734253 - protein, 9 aa, Homo Sapiens
GPCALWAPC

SEQ ID NO: 734254 - protein, 9 aa, Homo Sapiens
CLRIAEHRI

SEQ ID NO: 734255 - protein, 9 aa, Homo Sapiens
RCGELLACG

SEQ ID NO: 734256 - protein, 9 aa, Homo Sapiens
DVCFGFLPS

SEQ ID NO: 734257 - protein, 9 aa, Homo Sapiens
LANKQYVSG

SEQ ID NO: 734258 - protein, 9 aa, Homo Sapiens
NLIIQNKDD

SEQ ID NO: 734259 - protein, 9 aa, Homo Sapiens
PRGHCPPSP

SEQ ID NO: 734260 - protein, 9 aa, Homo Sapiens
RSYTGEKPY

SEQ ID NO: 734261 - protein, 9 aa, Homo Sapiens
IYNPAKQKT

SEQ ID NO: 734262 - protein, 9 aa, Homo Sapiens
SASGACCSL

SEQ ID NO: 734263 - protein, 9 aa, Homo Sapiens
FNYLQKVVV

SEQ ID NO: 734264 - protein, 9 aa, Homo Sapiens
LESHGGLLA

SEQ ID NO: 734265 - protein, 9 aa, Homo Sapiens
VIMWITYMV

SEQ ID NO: 734266 - protein, 9 aa, Homo Sapiens
VCRLTAQRI

SEQ ID NO: 734267 - protein, 9 aa, Homo Sapiens
KCGHQITEE

SEQ ID NO: 734268 - protein, 9 aa, Homo Sapiens
HLGKLHRAA

SEQ ID NO: 734269 - protein, 9 aa, Homo Sapiens
NNHWFHSSQ

SEQ ID NO: 734270 - protein, 9 aa, Homo Sapiens
HTLLGRFFQ

SEQ ID NO: 734271 - protein, 9 aa, Homo Sapiens
SSLLSKHQI

SEQ ID NO: 734272 - protein, 9 aa, Homo Sapiens
SDFGEDENV

SEQ ID NO: 734273 - protein, 9 aa, Homo Sapiens
GRGDELHGQ

SEQ ID NO: 734274 - protein, 9 aa, Homo Sapiens
TTPDSDFGE

SEQ ID NO: 734275 - protein, 9 aa, Homo Sapiens
RARECVAQH

SEQ ID NO: 734276 - protein, 9 aa, Homo Sapiens
LIAKEQERL

SEQ ID NO: 734277 - protein, 9 aa, Homo Sapiens
NKIQQDSAC

SEQ ID NO: 734278 - protein, 9 aa, Homo Sapiens
QNKEEVVEL

SEQ ID NO: 734279 - protein, 9 aa, Homo Sapiens
DTTALCLSL

SEQ ID NO: 734280 - protein, 9 aa, Homo Sapiens
TDSGVRPLP

SEQ ID NO: 734281 - protein, 9 aa, Homo Sapiens
HQNNPATEV

SEQ ID NO: 734282 - protein, 9 aa, Homo Sapiens
FGEDENVVM

SEQ ID NO: 734283 - protein, 9 aa, Homo Sapiens
CFTPCGELQ

SEQ ID NO: 734284 - protein, 9 aa, Homo Sapiens
DLAPCAGTT

SEQ ID NO: 734285 - protein, 9 aa, Homo Sapiens
SVELVRLRS

SEQ ID NO: 734286 - protein, 9 aa, Homo Sapiens
TSWGDSRQP

SEQ ID NO: 734287 - protein, 9 aa, Homo Sapiens
SAFNTTGVL

SEQ ID NO: 734288 - protein, 9 aa, Homo Sapiens
TFMRSLPSR

SEQ ID NO: 734289 - protein, 9 aa, Homo Sapiens
IRTVPIQPF

SEQ ID NO: 734290 - protein, 9 aa, Homo Sapiens
RGYSPQDAQ

SEQ ID NO: 734291 - protein, 9 aa, Homo Sapiens
PLTTTRDPG

SEQ ID NO: 734292 - protein, 9 aa, Homo Sapiens
IMTHTAGKP

SEQ ID NO: 734293 - protein, 9 aa, Homo Sapiens
SSGSSSSGV

SEQ ID NO: 734294 - protein, 9 aa, Homo Sapiens
ESITCKLQK

SEQ ID NO: 734295 - protein, 9 aa, Homo Sapiens
IWNLNPVFG

SEQ ID NO: 734296 - protein, 9 aa, Homo Sapiens
QSEKFAKVK

SEQ ID NO: 734297 - protein, 9 aa, Homo Sapiens
TKHGLEIDE

SEQ ID NO: 734298 - protein, 9 aa, Homo Sapiens
VQNPKGRLE

SEQ ID NO: 734299 - protein, 9 aa, Homo Sapiens
GSSPGSSAF

SEQ ID NO: 734300 - protein, 9 aa, Homo Sapiens
DSDGLAPPL

SEQ ID NO: 734301 - protein, 9 aa, Homo Sapiens
RLSASQIWN

SEQ ID NO: 734302 - protein, 9 aa, Homo Sapiens
EKEWEELYK

SEQ ID NO: 734303 - protein, 9 aa, Homo Sapiens
SLIQADKNL

SEQ ID NO: 734304 - protein, 9 aa, Homo Sapiens
ISSSNSNSS

SEQ ID NO: 734305 - protein, 9 aa, Homo Sapiens
FADRTDLCR

SEQ ID NO: 734306 - protein, 9 aa, Homo Sapiens
NFSKEFQEN

SEQ ID NO: 734307 - protein, 9 aa, Homo Sapiens
CSASGACCS

SEQ ID NO: 734308 - protein, 9 aa, Homo Sapiens
DSGNQGTVC

SEQ ID NO: 734309 - protein, 9 aa, Homo Sapiens
VHCLIMISL

SEQ ID NO: 734310 - protein, 9 aa, Homo Sapiens
TDEQKMAQK

SEQ ID NO: 734311 - protein, 9 aa, Homo Sapiens
LQMEKVQLE

SEQ ID NO: 734312 - protein, 9 aa, Homo Sapiens
HRFQDTKRL

SEQ ID NO: 734313 - protein, 9 aa, Homo Sapiens
KAPPGHEEG

SEQ ID NO: 734314 - protein, 9 aa, Homo Sapiens
QRWILVGAP

SEQ ID NO: 734315 - protein, 9 aa, Homo Sapiens
PCGELQAGD

SEQ ID NO: 734316 - protein, 9 aa, Homo Sapiens
YLLQNGSAP

SEQ ID NO: 734317 - protein, 9 aa, Homo Sapiens
HPPWERPTA

SEQ ID NO: 734318 - protein, 9 aa, Homo Sapiens
TPGHFSTTP

SEQ ID NO: 734319 - protein, 9 aa, Homo Sapiens
LDGPHEARL

SEQ ID NO: 734320 - protein, 9 aa, Homo Sapiens
HVGGGQRWI

SEQ ID NO: 734321 - protein, 9 aa, Homo Sapiens
LPRDYLAIY

SEQ ID NO: 734322 - protein, 9 aa, Homo Sapiens
KQAQAQPHV

SEQ ID NO: 734323 - protein, 9 aa, Homo Sapiens
SPSSSTQED

SEQ ID NO: 734324 - protein, 9 aa, Homo Sapiens
LLALVLCTV

SEQ ID NO: 734325 - protein, 9 aa, Homo Sapiens
WILVGAPWD

SEQ ID NO: 734326 - protein, 9 aa, Homo Sapiens
EHDAMSAAF

SEQ ID NO: 734327 - protein, 9 aa, Homo Sapiens
NTLLHFFCD

SEQ ID NO: 734328 - protein, 9 aa, Homo Sapiens
FHLDVFFEE

SEQ ID NO: 734329 - protein, 9 aa, Homo Sapiens
GDELHGQAP

SEQ ID NO: 734330 - protein, 9 aa, Homo Sapiens
DETLDRQLV

SEQ ID NO: 734331 - protein, 9 aa, Homo Sapiens
TIYVVEPVF

SEQ ID NO: 734332 - protein, 9 aa, Homo Sapiens
GLAPPLIRV

SEQ ID NO: 734333 - protein, 9 aa, Homo Sapiens
YAGPRGDSG

SEQ ID NO: 734334 - protein, 9 aa, Homo Sapiens
IRTLPFRAD

SEQ ID NO: 734335 - protein, 9 aa, Homo Sapiens
VCSLRPPRL

SEQ ID NO: 734336 - protein, 9 aa, Homo Sapiens
ETAIGKNIG

SEQ ID NO: 734337 - protein, 9 aa, Homo Sapiens
TWFNLQVRK

SEQ ID NO: 734338 - protein, 9 aa, Homo Sapiens
GNVTTVFQQ

SEQ ID NO: 734339 - protein, 9 aa, Homo Sapiens
ECGKVFGQN

SEQ ID NO: 734340 - protein, 9 aa, Homo Sapiens
LLEDKTGAH

SEQ ID NO: 734341 - protein, 9 aa, Homo Sapiens
QCPKGRARF

SEQ ID NO: 734342 - protein, 9 aa, Homo Sapiens
EFLGINLYE

SEQ ID NO: 734343 - protein, 9 aa, Homo Sapiens
TTGVLSVQT

SEQ ID NO: 734344 - protein, 9 aa, Homo Sapiens
RDGVPGGPV

SEQ ID NO: 734345 - protein, 9 aa, Homo Sapiens
TRLDLTGSS

SEQ ID NO: 734346 - protein, 9 aa, Homo Sapiens
TACDLAPCA

SEQ ID NO: 734347 - protein, 9 aa, Homo Sapiens
TPPEVPDCG

SEQ ID NO: 734348 - protein, 9 aa, Homo Sapiens
VETGKNGGF

SEQ ID NO: 734349 - protein, 9 aa, Homo Sapiens
RWRAQLASL

SEQ ID NO: 734350 - protein, 9 aa, Homo Sapiens
ISFFPKVLE

SEQ ID NO: 734351 - protein, 9 aa, Homo Sapiens
RSHSKIQKF

SEQ ID NO: 734352 - protein, 9 aa, Homo Sapiens
QSGDETPGS

SEQ ID NO: 734353 - protein, 9 aa, Homo Sapiens
AMQRYGPPT

SEQ ID NO: 734354 - protein, 9 aa, Homo Sapiens
AGIRTVPIQ

SEQ ID NO: 734355 - protein, 9 aa, Homo Sapiens
GHEDQPLTP

SEQ ID NO: 734356 - protein, 9 aa, Homo Sapiens
TPLAVTSLS

SEQ ID NO: 734357 - protein, 9 aa, Homo Sapiens
RPPYPAAVY

SEQ ID NO: 734358 - protein, 9 aa, Homo Sapiens
KELRNDWTL

SEQ ID NO: 734359 - protein, 9 aa, Homo Sapiens
PGSAGGAPT

SEQ ID NO: 734360 - protein, 9 aa, Homo Sapiens
GRKLKEKQK

SEQ ID NO: 734361 - protein, 9 aa, Homo Sapiens
LWLYHVAST

SEQ ID NO: 734362 - protein, 9 aa, Homo Sapiens
APSVQGQFY

SEQ ID NO: 734363 - protein, 9 aa, Homo Sapiens
GFLLAALGC

SEQ ID NO: 734364 - protein, 9 aa, Homo Sapiens
SMHAQAAVA

SEQ ID NO: 734365 - protein, 9 aa, Homo Sapiens
VARLDGPHE

SEQ ID NO: 734366 - protein, 9 aa, Homo Sapiens
NSNSSSNSS

SEQ ID NO: 734367 - protein, 9 aa, Homo Sapiens
RELGQKRFK

SEQ ID NO: 734368 - protein, 9 aa, Homo Sapiens
PSLAGKSPC

SEQ ID NO: 734369 - protein, 9 aa, Homo Sapiens
CTPSLTSSW

SEQ ID NO: 734370 - protein, 9 aa, Homo Sapiens
DVFFEEEFS

SEQ ID NO: 734371 - protein, 9 aa, Homo Sapiens
KPPAYEYVV

SEQ ID NO: 734372 - protein, 9 aa, Homo Sapiens
SYEELGGLE

SEQ ID NO: 734373 - protein, 9 aa, Homo Sapiens
AFNYSSLLS

SEQ ID NO: 734374 - protein, 9 aa, Homo Sapiens
ETLLSQAVQ

SEQ ID NO: 734375 - protein, 9 aa, Homo Sapiens
KEVGKTIGS

SEQ ID NO: 734376 - protein, 9 aa, Homo Sapiens
EEKKEEPEA

SEQ ID NO: 734377 - protein, 9 aa, Homo Sapiens
GGARRLQRT

SEQ ID NO: 734378 - protein, 9 aa, Homo Sapiens
RCSFRSRPA

SEQ ID NO: 734379 - protein, 9 aa, Homo Sapiens
APAEPAGTG

SEQ ID NO: 734380 - protein, 9 aa, Homo Sapiens
AEYCTDEGF

SEQ ID NO: 734381 - protein, 9 aa, Homo Sapiens
VVNRERSGC

SEQ ID NO: 734382 - protein, 9 aa, Homo Sapiens
LGPLEDPFW

SEQ ID NO: 734383 - protein, 9 aa, Homo Sapiens
HIQATPRPF

SEQ ID NO: 734384 - protein, 9 aa, Homo Sapiens
SEKFAKVKN

SEQ ID NO: 734385 - protein, 9 aa, Homo Sapiens
LINHGKIYS

SEQ ID NO: 734386 - protein, 9 aa, Homo Sapiens
PCPDGYRQT

SEQ ID NO: 734387 - protein, 9 aa, Homo Sapiens
LLFNIGALH

SEQ ID NO: 734388 - protein, 9 aa, Homo Sapiens
PNDISSGLK

SEQ ID NO: 734389 - protein, 9 aa, Homo Sapiens
EKGSLLFNI

SEQ ID NO: 734390 - protein, 9 aa, Homo Sapiens
VKTGIYNPA

SEQ ID NO: 734391 - protein, 9 aa, Homo Sapiens
LYYKKCPSV

SEQ ID NO: 734392 - protein, 9 aa, Homo Sapiens
VLGFLLAAL

SEQ ID NO: 734393 - protein, 9 aa, Homo Sapiens
PIGVGGGIS

SEQ ID NO: 734394 - protein, 9 aa, Homo Sapiens
LLFIRTLPF

SEQ ID NO: 734395 - protein, 9 aa, Homo Sapiens
LKECLRIAE

SEQ ID NO: 734396 - protein, 9 aa, Homo Sapiens
TRATPGHFS

SEQ ID NO: 734397 - protein, 9 aa, Homo Sapiens
LAVMDYDRY

SEQ ID NO: 734398 - protein, 9 aa, Homo Sapiens
PPGHEEGFD

SEQ ID NO: 734399 - protein, 9 aa, Homo Sapiens
CSGPAGSRR

SEQ ID NO: 734400 - protein, 9 aa, Homo Sapiens
CLPEPIGVG

SEQ ID NO: 734401 - protein, 9 aa, Homo Sapiens
KGDTTALCL

SEQ ID NO: 734402 - protein, 9 aa, Homo Sapiens
MTERKRSRL

SEQ ID NO: 734403 - protein, 9 aa, Homo Sapiens
QAKKKCIWG

SEQ ID NO: 734404 - protein, 9 aa, Homo Sapiens
KYRNAQELQ

SEQ ID NO: 734405 - protein, 9 aa, Homo Sapiens
CQLQVRCGE

SEQ ID NO: 734406 - protein, 9 aa, Homo Sapiens
YHVRREHLG

SEQ ID NO: 734407 - protein, 9 aa, Homo Sapiens
SPFVLYLLQ

SEQ ID NO: 734408 - protein, 9 aa, Homo Sapiens
YLQKVVVSR

SEQ ID NO: 734409 - protein, 9 aa, Homo Sapiens
LCHILEEVV

SEQ ID NO: 734410 - protein, 9 aa, Homo Sapiens
NSSNSSSSS

SEQ ID NO: 734411 - protein, 9 aa, Homo Sapiens
WGLGFFMVK

SEQ ID NO: 734412 - protein, 9 aa, Homo Sapiens
LQVRCGELL

SEQ ID NO: 734413 - protein, 9 aa, Homo Sapiens
SLLSKHQII

SEQ ID NO: 734414 - protein, 9 aa, Homo Sapiens
YKCKECRKT

SEQ ID NO: 734415 - protein, 9 aa, Homo Sapiens
SKIQKFSES

SEQ ID NO: 734416 - protein, 9 aa, Homo Sapiens
ITYMVFLLV

SEQ ID NO: 734417 - protein, 9 aa, Homo Sapiens
AQRDTDSGV

SEQ ID NO: 734418 - protein, 9 aa, Homo Sapiens
PQENTRAQR

SEQ ID NO: 734419 - protein, 9 aa, Homo Sapiens
TPESTTQIE

SEQ ID NO: 734420 - protein, 9 aa, Homo Sapiens
ARMHCYLYL

SEQ ID NO: 734421 - protein, 9 aa, Homo Sapiens
NLIVHQKTY

SEQ ID NO: 734422 - protein, 9 aa, Homo Sapiens
VWLSMYCVN

SEQ ID NO: 734423 - protein, 9 aa, Homo Sapiens
AARPPYPAA

SEQ ID NO: 734424 - protein, 9 aa, Homo Sapiens
PDCGHPHQE

SEQ ID NO: 734425 - protein, 9 aa, Homo Sapiens
AFSTAVYST

SEQ ID NO: 734426 - protein, 9 aa, Homo Sapiens
EASNLVVEE

SEQ ID NO: 734427 - protein, 9 aa, Homo Sapiens
TLESKHNVT

SEQ ID NO: 734428 - protein, 9 aa, Homo Sapiens
THTLLGRFF

SEQ ID NO: 734429 - protein, 9 aa, Homo Sapiens
QGQFYYISD

SEQ ID NO: 734430 - protein, 9 aa, Homo Sapiens
SGYHQHSPD

SEQ ID NO: 734431 - protein, 9 aa, Homo Sapiens
CSILFIYII

SEQ ID NO: 734432 - protein, 9 aa, Homo Sapiens
AKAPPGHEE

SEQ ID NO: 734433 - protein, 9 aa, Homo Sapiens
LYLTPSRVM

SEQ ID NO: 734434 - protein, 9 aa, Homo Sapiens
PVAQGGSPA

SEQ ID NO: 734435 - protein, 9 aa, Homo Sapiens
EIRRHKRSY

SEQ ID NO: 734436 - protein, 9 aa, Homo Sapiens
TSLVSGVVL

SEQ ID NO: 734437 - protein, 9 aa, Homo Sapiens
CTIYVVEPV

SEQ ID NO: 734438 - protein, 9 aa, Homo Sapiens
CANGKPLSE

SEQ ID NO: 734439 - protein, 9 aa, Homo Sapiens
LPSRQRLRQ

SEQ ID NO: 734440 - protein, 9 aa, Homo Sapiens
RFLLQAQDA

SEQ ID NO: 734441 - protein, 9 aa, Homo Sapiens
NLREGVAKA

SEQ ID NO: 734442 - protein, 9 aa, Homo Sapiens
VNVYGHVLA

SEQ ID NO: 734443 - protein, 9 aa, Homo Sapiens
VTTPDSDFG

SEQ ID NO: 734444 - protein, 9 aa, Homo Sapiens
CGRRWRAIR

SEQ ID NO: 734445 - protein, 9 aa, Homo Sapiens
VQEGAISEV

SEQ ID NO: 734446 - protein, 9 aa, Homo Sapiens
QWMKGPRSL

SEQ ID NO: 734447 - protein, 9 aa, Homo Sapiens
DLKEYAEYC

SEQ ID NO: 734448 - protein, 9 aa, Homo Sapiens
EEFEAYINA

SEQ ID NO: 734449 - protein, 9 aa, Homo Sapiens
ARPPYPAAV

SEQ ID NO: 734450 - protein, 9 aa, Homo Sapiens
CGELQAGDW

SEQ ID NO: 734451 - protein, 9 aa, Homo Sapiens
KPLSEEFEA

SEQ ID NO: 734452 - protein, 9 aa, Homo Sapiens
NPKGRLETV

SEQ ID NO: 734453 - protein, 9 aa, Homo Sapiens
FEPLLSFAS

SEQ ID NO: 734454 - protein, 9 aa, Homo Sapiens
CVLLAVMDY

SEQ ID NO: 734455 - protein, 9 aa, Homo Sapiens
DFQNMILQA

SEQ ID NO: 734456 - protein, 9 aa, Homo Sapiens
TGAFINLPR

SEQ ID NO: 734457 - protein, 9 aa, Homo Sapiens
VIKIIALGF

SEQ ID NO: 734458 - protein, 9 aa, Homo Sapiens
ELRCPTECS

SEQ ID NO: 734459 - protein, 9 aa, Homo Sapiens
ETLDRQLVE

SEQ ID NO: 734460 - protein, 9 aa, Homo Sapiens
NAEDMDKIE

SEQ ID NO: 734461 - protein, 9 aa, Homo Sapiens
QPAGVPEML

SEQ ID NO: 734462 - protein, 9 aa, Homo Sapiens
EPVLWLACR

SEQ ID NO: 734463 - protein, 9 aa, Homo Sapiens
LILGVKTPP

SEQ ID NO: 734464 - protein, 9 aa, Homo Sapiens
RLYYKKCPS

SEQ ID NO: 734465 - protein, 9 aa, Homo Sapiens
KVFGQNSAL

SEQ ID NO: 734466 - protein, 9 aa, Homo Sapiens
TALCLSLQA

SEQ ID NO: 734467 - protein, 9 aa, Homo Sapiens
LNSTNPSVA

SEQ ID NO: 734468 - protein, 9 aa, Homo Sapiens
GARRLQRTS

SEQ ID NO: 734469 - protein, 9 aa, Homo Sapiens
SPNWSIVPE

SEQ ID NO: 734470 - protein, 9 aa, Homo Sapiens
IQATPRPFL

SEQ ID NO: 734471 - protein, 9 aa, Homo Sapiens
PRWRAQLAS

SEQ ID NO: 734472 - protein, 9 aa, Homo Sapiens
RINQLSTRW

SEQ ID NO: 734473 - protein, 9 aa, Homo Sapiens
YTTRATPGH

SEQ ID NO: 734474 - protein, 9 aa, Homo Sapiens
MTDLGLLGA

SEQ ID NO: 734475 - protein, 9 aa, Homo Sapiens
EQSGDETPG

SEQ ID NO: 734476 - protein, 9 aa, Homo Sapiens
HCASYNCAI

SEQ ID NO: 734477 - protein, 9 aa, Homo Sapiens
DWTLQNCDL

SEQ ID NO: 734478 - protein, 9 aa, Homo Sapiens
PVFDVFQAF

SEQ ID NO: 734479 - protein, 9 aa, Homo Sapiens
QENLVKTGI

SEQ ID NO: 734480 - protein, 9 aa, Homo Sapiens
GALGTARAE

SEQ ID NO: 734481 - protein, 9 aa, Homo Sapiens
GALYIRGLC

SEQ ID NO: 734482 - protein, 9 aa, Homo Sapiens
DNLAAGVYE

SEQ ID NO: 734483 - protein, 9 aa, Homo Sapiens
LNALRFTAK

SEQ ID NO: 734484 - protein, 9 aa, Homo Sapiens
ERRELGFFQ

SEQ ID NO: 734485 - protein, 9 aa, Homo Sapiens
LTLMDVLDT

SEQ ID NO: 734486 - protein, 9 aa, Homo Sapiens
EPLLSFASG

SEQ ID NO: 734487 - protein, 9 aa, Homo Sapiens
INQLSTRWQ

SEQ ID NO: 734488 - protein, 9 aa, Homo Sapiens
ASQIWNLNP

SEQ ID NO: 734489 - protein, 9 aa, Homo Sapiens
SLTAASTAP

SEQ ID NO: 734490 - protein, 9 aa, Homo Sapiens
LPPQENTRA

SEQ ID NO: 734491 - protein, 9 aa, Homo Sapiens
HVRREHLGK

SEQ ID NO: 734492 - protein, 9 aa, Homo Sapiens
YMVFLLVFF

SEQ ID NO: 734493 - protein, 9 aa, Homo Sapiens
IEEHLAMVE

SEQ ID NO: 734494 - protein, 9 aa, Homo Sapiens
QPHVPPARQ

SEQ ID NO: 734495 - protein, 9 aa, Homo Sapiens
QGCTNTDGL

SEQ ID NO: 734496 - protein, 9 aa, Homo Sapiens
STSVELVRL

SEQ ID NO: 734497 - protein, 9 aa, Homo Sapiens
GLLGAFITK

SEQ ID NO: 734498 - protein, 9 aa, Homo Sapiens
QLLAGIRTV

SEQ ID NO: 734499 - protein, 9 aa, Homo Sapiens
VCTLEFAVQ

SEQ ID NO: 734500 - protein, 9 aa, Homo Sapiens
ERYENCGFK

SEQ ID NO: 734501 - protein, 9 aa, Homo Sapiens
SLGPLEDPF

SEQ ID NO: 734502 - protein, 9 aa, Homo Sapiens
KQFQRAPQG

SEQ ID NO: 734503 - protein, 9 aa, Homo Sapiens
QWRGGDGIN

SEQ ID NO: 734504 - protein, 9 aa, Homo Sapiens
ECEIPHHMK

SEQ ID NO: 734505 - protein, 9 aa, Homo Sapiens
TPRPFLVRL

SEQ ID NO: 734506 - protein, 9 aa, Homo Sapiens
VRREHLGKL

SEQ ID NO: 734507 - protein, 9 aa, Homo Sapiens
CTNTDGLFH

SEQ ID NO: 734508 - protein, 9 aa, Homo Sapiens
TGIYNPAKQ

SEQ ID NO: 734509 - protein, 9 aa, Homo Sapiens
SQCPKGRAR

SEQ ID NO: 734510 - protein, 9 aa, Homo Sapiens
STWAQTEGS

SEQ ID NO: 734511 - protein, 9 aa, Homo Sapiens
LKIQQREKE

SEQ ID NO: 734512 - protein, 9 aa, Homo Sapiens
SDLLFIRTL

SEQ ID NO: 734513 - protein, 9 aa, Homo Sapiens
QQEPEELLI

SEQ ID NO: 734514 - protein, 9 aa, Homo Sapiens
MTLDDVECS

SEQ ID NO: 734515 - protein, 9 aa, Homo Sapiens
GAQHHLYKL

SEQ ID NO: 734516 - protein, 9 aa, Homo Sapiens
HTNQVNAIK

SEQ ID NO: 734517 - protein, 9 aa, Homo Sapiens
EHRTRLLWR

SEQ ID NO: 734518 - protein, 9 aa, Homo Sapiens
TIYNVRLLE

SEQ ID NO: 734519 - protein, 9 aa, Homo Sapiens
DEHRTRLLW

SEQ ID NO: 734520 - protein, 9 aa, Homo Sapiens
SQAVQQLRQ

SEQ ID NO: 734521 - protein, 9 aa, Homo Sapiens
AGCQELAGP

SEQ ID NO: 734522 - protein, 9 aa, Homo Sapiens
NLVKTGIYN

SEQ ID NO: 734523 - protein, 9 aa, Homo Sapiens
DGDLNKCVS

SEQ ID NO: 734524 - protein, 9 aa, Homo Sapiens
LRCPTECSS

SEQ ID NO: 734525 - protein, 9 aa, Homo Sapiens
PLVMAAFDG

SEQ ID NO: 734526 - protein, 9 aa, Homo Sapiens
MILQAPDFL

SEQ ID NO: 734527 - protein, 9 aa, Homo Sapiens
RESLGLSLN

SEQ ID NO: 734528 - protein, 9 aa, Homo Sapiens
DLHLHYQKD

SEQ ID NO: 734529 - protein, 9 aa, Homo Sapiens
SQPSVPQRA

SEQ ID NO: 734530 - protein, 9 aa, Homo Sapiens
ECVLLAVMD

SEQ ID NO: 734531 - protein, 9 aa, Homo Sapiens
PVVNRERSG

SEQ ID NO: 734532 - protein, 9 aa, Homo Sapiens
NRIVNDARD

SEQ ID NO: 734533 - protein, 9 aa, Homo Sapiens
LYHCASYNC

SEQ ID NO: 734534 - protein, 9 aa, Homo Sapiens
TINQGHEDE

SEQ ID NO: 734535 - protein, 9 aa, Homo Sapiens
WDAAQTCQC

SEQ ID NO: 734536 - protein, 9 aa, Homo Sapiens
LGFFQPSGV

SEQ ID NO: 734537 - protein, 9 aa, Homo Sapiens
ESDFAVDNF

SEQ ID NO: 734538 - protein, 9 aa, Homo Sapiens
QVQNPKGRL

SEQ ID NO: 734539 - protein, 9 aa, Homo Sapiens
TSYPNLKIP

SEQ ID NO: 734540 - protein, 9 aa, Homo Sapiens
TVQSELRDY

SEQ ID NO: 734541 - protein, 9 aa, Homo Sapiens
DAEDLAAKR

SEQ ID NO: 734542 - protein, 9 aa, Homo Sapiens
VPGGPVETG

SEQ ID NO: 734543 - protein, 9 aa, Homo Sapiens
GDTTALCLS

SEQ ID NO: 734544 - protein, 9 aa, Homo Sapiens
TRTPVVKAF

SEQ ID NO: 734545 - protein, 9 aa, Homo Sapiens
TVVQIILQA

SEQ ID NO: 734546 - protein, 9 aa, Homo Sapiens
THCHTANIQ

SEQ ID NO: 734547 - protein, 9 aa, Homo Sapiens
KQYVSGDGS

SEQ ID NO: 734548 - protein, 9 aa, Homo Sapiens
TDFCYSSVI

SEQ ID NO: 734549 - protein, 9 aa, Homo Sapiens
PRDYLAIYY

SEQ ID NO: 734550 - protein, 9 aa, Homo Sapiens
KLESITCKL

SEQ ID NO: 734551 - protein, 9 aa, Homo Sapiens
KGRSHSKIQ

SEQ ID NO: 734552 - protein, 9 aa, Homo Sapiens
YQGFHCGNG

SEQ ID NO: 734553 - protein, 9 aa, Homo Sapiens
DDPVVNRER

SEQ ID NO: 734554 - protein, 9 aa, Homo Sapiens
ITFEFLGIN

SEQ ID NO: 734555 - protein, 9 aa, Homo Sapiens
AEDQAFLPE

SEQ ID NO: 734556 - protein, 9 aa, Homo Sapiens
TLLSVPVLS

SEQ ID NO: 734557 - protein, 9 aa, Homo Sapiens
WMKGPRSLP

SEQ ID NO: 734558 - protein, 9 aa, Homo Sapiens
CPETRLDLT

SEQ ID NO: 734559 - protein, 9 aa, Homo Sapiens
GVPEMLKKS

SEQ ID NO: 734560 - protein, 9 aa, Homo Sapiens
LLSLPGIDM

SEQ ID NO: 734561 - protein, 9 aa, Homo Sapiens
QAFHIWLNS

SEQ ID NO: 734562 - protein, 9 aa, Homo Sapiens
QEPEELLIV

SEQ ID NO: 734563 - protein, 9 aa, Homo Sapiens
KVPTLELPA

SEQ ID NO: 734564 - protein, 9 aa, Homo Sapiens
EDQAFLPEP

SEQ ID NO: 734565 - protein, 9 aa, Homo Sapiens
LAQVEVKQH

SEQ ID NO: 734566 - protein, 9 aa, Homo Sapiens
SHSEVEQLV

SEQ ID NO: 734567 - protein, 9 aa, Homo Sapiens
CVNQAQVQR

SEQ ID NO: 734568 - protein, 9 aa, Homo Sapiens
RNAQELQME

SEQ ID NO: 734569 - protein, 9 aa, Homo Sapiens
SCGRRWRAI

SEQ ID NO: 734570 - protein, 9 aa, Homo Sapiens
NKQYVSGDG

SEQ ID NO: 734571 - protein, 9 aa, Homo Sapiens
ELWGGKDGA

SEQ ID NO: 734572 - protein, 9 aa, Homo Sapiens
ARAEAAAAA

SEQ ID NO: 734573 - protein, 9 aa, Homo Sapiens
NQVNAIKWD

SEQ ID NO: 734574 - protein, 9 aa, Homo Sapiens
LLQAQDARG

SEQ ID NO: 734575 - protein, 9 aa, Homo Sapiens
LRFTAKHLN

SEQ ID NO: 734576 - protein, 9 aa, Homo Sapiens
IGVGGGISD

SEQ ID NO: 734577 - protein, 9 aa, Homo Sapiens
ESTTQIEPS

SEQ ID NO: 734578 - protein, 9 aa, Homo Sapiens
AQGAQKSIK

SEQ ID NO: 734579 - protein, 9 aa, Homo Sapiens
CALWAPCPD

SEQ ID NO: 734580 - protein, 9 aa, Homo Sapiens
LLGTTGNCL

SEQ ID NO: 734581 - protein, 9 aa, Homo Sapiens
STGSMYLNA

SEQ ID NO: 734582 - protein, 9 aa, Homo Sapiens
LLESHGGLL

SEQ ID NO: 734583 - protein, 9 aa, Homo Sapiens
KLQEMEAMT

SEQ ID NO: 734584 - protein, 9 aa, Homo Sapiens
TCQCLNGSL

SEQ ID NO: 734585 - protein, 9 aa, Homo Sapiens
KEYAEYCTD

SEQ ID NO: 734586 - protein, 9 aa, Homo Sapiens
REQRRATRG

SEQ ID NO: 734587 - protein, 9 aa, Homo Sapiens
CPDGYRQTK

SEQ ID NO: 734588 - protein, 9 aa, Homo Sapiens
RPRSKQEAW

SEQ ID NO: 734589 - protein, 9 aa, Homo Sapiens
LIQADKNLM

SEQ ID NO: 734590 - protein, 9 aa, Homo Sapiens
SEAPREPAG

SEQ ID NO: 734591 - protein, 9 aa, Homo Sapiens
EMAKAPSSV

SEQ ID NO: 734592 - protein, 9 aa, Homo Sapiens
SPRGHCPPS

SEQ ID NO: 734593 - protein, 9 aa, Homo Sapiens
ALYIRGLCE

SEQ ID NO: 734594 - protein, 9 aa, Homo Sapiens
VGVKERINK

SEQ ID NO: 734595 - protein, 9 aa, Homo Sapiens
LGRFFQGWG

SEQ ID NO: 734596 - protein, 9 aa, Homo Sapiens
SSEGLGIVT

SEQ ID NO: 734597 - protein, 9 aa, Homo Sapiens
DPTLHTPMY

SEQ ID NO: 734598 - protein, 9 aa, Homo Sapiens
YTWFNLQVR

SEQ ID NO: 734599 - protein, 9 aa, Homo Sapiens
GRVRPPGTL

SEQ ID NO: 734600 - protein, 9 aa, Homo Sapiens
QAQPHVPPA

SEQ ID NO: 734601 - protein, 9 aa, Homo Sapiens
LAGKSPCPR

SEQ ID NO: 734602 - protein, 9 aa, Homo Sapiens
MQAELHRFQ

SEQ ID NO: 734603 - protein, 9 aa, Homo Sapiens
AVLLAGPPE

SEQ ID NO: 734604 - protein, 9 aa, Homo Sapiens
CITFEFLGI

SEQ ID NO: 734605 - protein, 9 aa, Homo Sapiens
SWGDSRQPQ

SEQ ID NO: 734606 - protein, 9 aa, Homo Sapiens
GSRGDPGYA

SEQ ID NO: 734607 - protein, 9 aa, Homo Sapiens
AHALLAGRC

SEQ ID NO: 734608 - protein, 9 aa, Homo Sapiens
LLAALGCQV

SEQ ID NO: 734609 - protein, 9 aa, Homo Sapiens
RSVFFRHIM

SEQ ID NO: 734610 - protein, 9 aa, Homo Sapiens
GISLANKQY

SEQ ID NO: 734611 - protein, 9 aa, Homo Sapiens
TQPKVSKPD

SEQ ID NO: 734612 - protein, 9 aa, Homo Sapiens
PQDAQEFLR

SEQ ID NO: 734613 - protein, 9 aa, Homo Sapiens
DESEVHFKI

SEQ ID NO: 734614 - protein, 9 aa, Homo Sapiens
FRLRPLAGL

SEQ ID NO: 734615 - protein, 9 aa, Homo Sapiens
YLAIYYSFD

SEQ ID NO: 734616 - protein, 9 aa, Homo Sapiens
QEPLQPSNA

SEQ ID NO: 734617 - protein, 9 aa, Homo Sapiens
STAVYSTTP

SEQ ID NO: 734618 - protein, 9 aa, Homo Sapiens
SGGHAQAPL

SEQ ID NO: 734619 - protein, 9 aa, Homo Sapiens
TTCMTSLNS

SEQ ID NO: 734620 - protein, 9 aa, Homo Sapiens
QERLISDAN

SEQ ID NO: 734621 - protein, 9 aa, Homo Sapiens
GKSPCPRLL

SEQ ID NO: 734622 - protein, 9 aa, Homo Sapiens
LQAKKETLE

SEQ ID NO: 734623 - protein, 9 aa, Homo Sapiens
WFNLQVRKR

SEQ ID NO: 734624 - protein, 9 aa, Homo Sapiens
KKKCIWGPS

SEQ ID NO: 734625 - protein, 9 aa, Homo Sapiens
AATAAALLY

SEQ ID NO: 734626 - protein, 9 aa, Homo Sapiens
CPTECSSRG

SEQ ID NO: 734627 - protein, 9 aa, Homo Sapiens
SRKEGVLLA

SEQ ID NO: 734628 - protein, 9 aa, Homo Sapiens
LQAQDARGA

SEQ ID NO: 734629 - protein, 9 aa, Homo Sapiens
TPDSDFGED

SEQ ID NO: 734630 - protein, 9 aa, Homo Sapiens
YRNAQELQM

SEQ ID NO: 734631 - protein, 9 aa, Homo Sapiens
LASCYPVVL

SEQ ID NO: 734632 - protein, 9 aa, Homo Sapiens
EKVKSAAAW

SEQ ID NO: 734633 - protein, 9 aa, Homo Sapiens
PQASYYKFQ

SEQ ID NO: 734634 - protein, 9 aa, Homo Sapiens
AAGPGSAGG

SEQ ID NO: 734635 - protein, 9 aa, Homo Sapiens
CLVLWTVFR

SEQ ID NO: 734636 - protein, 9 aa, Homo Sapiens
HVPEQFSGL

SEQ ID NO: 734637 - protein, 9 aa, Homo Sapiens
YYLEDETLD

SEQ ID NO: 734638 - protein, 9 aa, Homo Sapiens
NGSTKHGLE

SEQ ID NO: 734639 - protein, 9 aa, Homo Sapiens
RDPGHGGAR

SEQ ID NO: 734640 - protein, 9 aa, Homo Sapiens
QLKIQQREK

SEQ ID NO: 734641 - protein, 9 aa, Homo Sapiens
VLLEDKTGA

SEQ ID NO: 734642 - protein, 9 aa, Homo Sapiens
PQGIPSSND

SEQ ID NO: 734643 - protein, 9 aa, Homo Sapiens
STRWQQVWL

SEQ ID NO: 734644 - protein, 9 aa, Homo Sapiens
VKKPLKATI

SEQ ID NO: 734645 - protein, 9 aa, Homo Sapiens
CFEAVIKII

SEQ ID NO: 734646 - protein, 9 aa, Homo Sapiens
KELASCYPV

SEQ ID NO: 734647 - protein, 9 aa, Homo Sapiens
VKRMAIESL

SEQ ID NO: 734648 - protein, 9 aa, Homo Sapiens
CGNPGSSRR

SEQ ID NO: 734649 - protein, 9 aa, Homo Sapiens
QTSLLEDSS

SEQ ID NO: 734650 - protein, 9 aa, Homo Sapiens
HGSEGFLKG

SEQ ID NO: 734651 - protein, 9 aa, Homo Sapiens
LWRPSRKSE

SEQ ID NO: 734652 - protein, 9 aa, Homo Sapiens
PGPLPASHP

SEQ ID NO: 734653 - protein, 9 aa, Homo Sapiens
LHRTKLIGI

SEQ ID NO: 734654 - protein, 9 aa, Homo Sapiens
DILRIQDKP

SEQ ID NO: 734655 - protein, 9 aa, Homo Sapiens
ASCYPVVLE

SEQ ID NO: 734656 - protein, 9 aa, Homo Sapiens
RARDPVPTN

SEQ ID NO: 734657 - protein, 9 aa, Homo Sapiens
RRELGFFQP

SEQ ID NO: 734658 - protein, 9 aa, Homo Sapiens
STTPVPTPS

SEQ ID NO: 734659 - protein, 9 aa, Homo Sapiens
FNTTGVLSV

SEQ ID NO: 734660 - protein, 9 aa, Homo Sapiens
MLGERVLNA

SEQ ID NO: 734661 - protein, 9 aa, Homo Sapiens
KLDGLIHPF

SEQ ID NO: 734662 - protein, 9 aa, Homo Sapiens
LIHPFITLL

SEQ ID NO: 734663 - protein, 9 aa, Homo Sapiens
QQPANLREG

SEQ ID NO: 734664 - protein, 9 aa, Homo Sapiens
LQPSNAQEF

SEQ ID NO: 734665 - protein, 9 aa, Homo Sapiens
AISEVLVDA

SEQ ID NO: 734666 - protein, 9 aa, Homo Sapiens
RMHCYLYLV

SEQ ID NO: 734667 - protein, 9 aa, Homo Sapiens
TVLGFLLAA

SEQ ID NO: 734668 - protein, 9 aa, Homo Sapiens
ECSSRGLCV

SEQ ID NO: 734669 - protein, 9 aa, Homo Sapiens
RRGPRWRAQ

SEQ ID NO: 734670 - protein, 9 aa, Homo Sapiens
FAWCLDGEH

SEQ ID NO: 734671 - protein, 9 aa, Homo Sapiens
QQCRFWISF

SEQ ID NO: 734672 - protein, 9 aa, Homo Sapiens
QREKEWEEL

SEQ ID NO: 734673 - protein, 9 aa, Homo Sapiens
GFFMVKEVG

SEQ ID NO: 734674 - protein, 9 aa, Homo Sapiens
KPYIKIFSM

SEQ ID NO: 734675 - protein, 9 aa, Homo Sapiens
KPCSRGIGD

SEQ ID NO: 734676 - protein, 9 aa, Homo Sapiens
MPAKAPPGH

SEQ ID NO: 734677 - protein, 9 aa, Homo Sapiens
YLDPTLHTP

SEQ ID NO: 734678 - protein, 9 aa, Homo Sapiens
TSLIQADKN

SEQ ID NO: 734679 - protein, 9 aa, Homo Sapiens
TKLIGIGCF

SEQ ID NO: 734680 - protein, 9 aa, Homo Sapiens
MSANIMHAK

SEQ ID NO: 734681 - protein, 9 aa, Homo Sapiens
EDNLAAGVY

SEQ ID NO: 734682 - protein, 9 aa, Homo Sapiens
TCMTSLNST

SEQ ID NO: 734683 - protein, 9 aa, Homo Sapiens
APCSSSISS

SEQ ID NO: 734684 - protein, 9 aa, Homo Sapiens
PGPSRDSEG

SEQ ID NO: 734685 - protein, 9 aa, Homo Sapiens
HQVQNPKGR

SEQ ID NO: 734686 - protein, 9 aa, Homo Sapiens
QYMRRLVGC

SEQ ID NO: 734687 - protein, 9 aa, Homo Sapiens
APPGHEEGF

SEQ ID NO: 734688 - protein, 9 aa, Homo Sapiens
ELQAGDWSP

SEQ ID NO: 734689 - protein, 9 aa, Homo Sapiens
SSSSGVTPV

SEQ ID NO: 734690 - protein, 9 aa, Homo Sapiens
PTSYPNLKI

SEQ ID NO: 734691 - protein, 9 aa, Homo Sapiens
GHQNNPATE

SEQ ID NO: 734692 - protein, 9 aa, Homo Sapiens
LVEQTSLLE

SEQ ID NO: 734693 - protein, 9 aa, Homo Sapiens
GCGYGFGCG

SEQ ID NO: 734694 - protein, 9 aa, Homo Sapiens
VNSIECFKR

SEQ ID NO: 734695 - protein, 9 aa, Homo Sapiens
LQKVVVSRV

SEQ ID NO: 734696 - protein, 9 aa, Homo Sapiens
RELFPPLVM

SEQ ID NO: 734697 - protein, 9 aa, Homo Sapiens
SVRLYYKKC

SEQ ID NO: 734698 - protein, 9 aa, Homo Sapiens
HGAQHHLYK

SEQ ID NO: 734699 - protein, 9 aa, Homo Sapiens
GVINITSVV

SEQ ID NO: 734700 - protein, 9 aa, Homo Sapiens
PSNTNNRSM

SEQ ID NO: 734701 - protein, 9 aa, Homo Sapiens
NYLQKVVVS

SEQ ID NO: 734702 - protein, 9 aa, Homo Sapiens
PPETGKTAL

SEQ ID NO: 734703 - protein, 9 aa, Homo Sapiens
ENLVKTGIY

SEQ ID NO: 734704 - protein, 9 aa, Homo Sapiens
LNNAKYSLE

SEQ ID NO: 734705 - protein, 9 aa, Homo Sapiens
TAVYSTTPV

SEQ ID NO: 734706 - protein, 9 aa, Homo Sapiens
PGTLLSVPV

SEQ ID NO: 734707 - protein, 9 aa, Homo Sapiens
RHRWTHHGE

SEQ ID NO: 734708 - protein, 9 aa, Homo Sapiens
FDGDLNKCV

SEQ ID NO: 734709 - protein, 9 aa, Homo Sapiens
IYYSFDGSP

SEQ ID NO: 734710 - protein, 9 aa, Homo Sapiens
EHLGKLHRA

SEQ ID NO: 734711 - protein, 9 aa, Homo Sapiens
FCITFEFLG

SEQ ID NO: 734712 - protein, 9 aa, Homo Sapiens
IGDSVLLQT

SEQ ID NO: 734713 - protein, 9 aa, Homo Sapiens
KLLFTSLVS

SEQ ID NO: 734714 - protein, 9 aa, Homo Sapiens
RTSHPPWER

SEQ ID NO: 734715 - protein, 9 aa, Homo Sapiens
MPLVEQTSL

SEQ ID NO: 734716 - protein, 9 aa, Homo Sapiens
LDRQLVELG

SEQ ID NO: 734717 - protein, 9 aa, Homo Sapiens
LDPLVQLTF

SEQ ID NO: 734718 - protein, 9 aa, Homo Sapiens
QFQRAPQGI

SEQ ID NO: 734719 - protein, 9 aa, Homo Sapiens
ELFPPLVMA

SEQ ID NO: 734720 - protein, 9 aa, Homo Sapiens
KCVSPQEAA

SEQ ID NO: 734721 - protein, 9 aa, Homo Sapiens
TTGNCLVLW

SEQ ID NO: 734722 - protein, 9 aa, Homo Sapiens
RMAIESLFD

SEQ ID NO: 734723 - protein, 9 aa, Homo Sapiens
QLSTRWQQV

SEQ ID NO: 734724 - protein, 9 aa, Homo Sapiens
KPRPLLYYS

SEQ ID NO: 734725 - protein, 9 aa, Homo Sapiens
EDKTGAHEI

SEQ ID NO: 734726 - protein, 9 aa, Homo Sapiens
AAWHPIKLH

SEQ ID NO: 734727 - protein, 9 aa, Homo Sapiens
STYFAWCLD

SEQ ID NO: 734728 - protein, 9 aa, Homo Sapiens
GQGEQWRGG

SEQ ID NO: 734729 - protein, 9 aa, Homo Sapiens
TLGAQKPIS

SEQ ID NO: 734730 - protein, 9 aa, Homo Sapiens
DPKKAPSVQ

SEQ ID NO: 734731 - protein, 9 aa, Homo Sapiens
AWCLDGEHI

SEQ ID NO: 734732 - protein, 9 aa, Homo Sapiens
ELHGQAPCS

SEQ ID NO: 734733 - protein, 9 aa, Homo Sapiens
EMEAMTDEQ

SEQ ID NO: 734734 - protein, 9 aa, Homo Sapiens
PNHYYTDSW

SEQ ID NO: 734735 - protein, 9 aa, Homo Sapiens
RIQDKPEEQ

SEQ ID NO: 734736 - protein, 9 aa, Homo Sapiens
TLQNCDLDQ

SEQ ID NO: 734737 - protein, 9 aa, Homo Sapiens
SNNHWFHSS

SEQ ID NO: 734738 - protein, 9 aa, Homo Sapiens
VLLAVMDYD

SEQ ID NO: 734739 - protein, 9 aa, Homo Sapiens
SRPAPSLCW

SEQ ID NO: 734740 - protein, 9 aa, Homo Sapiens
GSSSSGVTP

SEQ ID NO: 734741 - protein, 9 aa, Homo Sapiens
PSVPQRATG

SEQ ID NO: 734742 - protein, 9 aa, Homo Sapiens
PPQEPLQPS

SEQ ID NO: 734743 - protein, 9 aa, Homo Sapiens
DGLEEEDDD

SEQ ID NO: 734744 - protein, 9 aa, Homo Sapiens
LIGGDPGDA

SEQ ID NO: 734745 - protein, 9 aa, Homo Sapiens
APPLIRVEG

SEQ ID NO: 734746 - protein, 9 aa, Homo Sapiens
VFLLVFFGA

SEQ ID NO: 734747 - protein, 9 aa, Homo Sapiens
GQTFADRTD

SEQ ID NO: 734748 - protein, 9 aa, Homo Sapiens
KMTDLGLLG

SEQ ID NO: 734749 - protein, 9 aa, Homo Sapiens
VVPLMLSNT

SEQ ID NO: 734750 - protein, 9 aa, Homo Sapiens
VKSGTVLSP

SEQ ID NO: 734751 - protein, 9 aa, Homo Sapiens
NTRAQRQRL

SEQ ID NO: 734752 - protein, 9 aa, Homo Sapiens
ARECVAQHG

SEQ ID NO: 734753 - protein, 9 aa, Homo Sapiens
APPREQRRA

SEQ ID NO: 734754 - protein, 9 aa, Homo Sapiens
GGPVETGKN

SEQ ID NO: 734755 - protein, 9 aa, Homo Sapiens
QLNAEDMDK

SEQ ID NO: 734756 - protein, 9 aa, Homo Sapiens
LNFPLFFVH

SEQ ID NO: 734757 - protein, 9 aa, Homo Sapiens
SCYPVVLEE

SEQ ID NO: 734758 - protein, 9 aa, Homo Sapiens
STKHGLEID

SEQ ID NO: 734759 - protein, 9 aa, Homo Sapiens
LVFLLADVC

SEQ ID NO: 734760 - protein, 9 aa, Homo Sapiens
LPAPEAVSS

SEQ ID NO: 734761 - protein, 9 aa, Homo Sapiens
GTRARECVA

SEQ ID NO: 734762 - protein, 9 aa, Homo Sapiens
DILAPQTCT

SEQ ID NO: 734763 - protein, 9 aa, Homo Sapiens
VQLTFCRVC

SEQ ID NO: 734764 - protein, 9 aa, Homo Sapiens
CFTVQSEYG

SEQ ID NO: 734765 - protein, 9 aa, Homo Sapiens
TRLLWRPSR

SEQ ID NO: 734766 - protein, 9 aa, Homo Sapiens
KKQIDVAMK

SEQ ID NO: 734767 - protein, 9 aa, Homo Sapiens
MEFNYLQKV

SEQ ID NO: 734768 - protein, 9 aa, Homo Sapiens
EQTSLLEDS

SEQ ID NO: 734769 - protein, 9 aa, Homo Sapiens
LGRVRPPGT

SEQ ID NO: 734770 - protein, 9 aa, Homo Sapiens
HGQIGFTCN

SEQ ID NO: 734771 - protein, 9 aa, Homo Sapiens
NQLSTRWQQ

SEQ ID NO: 734772 - protein, 9 aa, Homo Sapiens
EVEQLVNKT

SEQ ID NO: 734773 - protein, 9 aa, Homo Sapiens
YPAAVYAGY

SEQ ID NO: 734774 - protein, 9 aa, Homo Sapiens
LGTTGNCLV

SEQ ID NO: 734775 - protein, 9 aa, Homo Sapiens
AGVPEMLKK

SEQ ID NO: 734776 - protein, 9 aa, Homo Sapiens
ELACLHHSL

SEQ ID NO: 734777 - protein, 9 aa, Homo Sapiens
VHQKTYRRK

SEQ ID NO: 734778 - protein, 9 aa, Homo Sapiens
PVLFAMFSK

SEQ ID NO: 734779 - protein, 9 aa, Homo Sapiens
VMDAGCQEL

SEQ ID NO: 734780 - protein, 9 aa, Homo Sapiens
GYGCGYGFG

SEQ ID NO: 734781 - protein, 9 aa, Homo Sapiens
PPREQRRAT

SEQ ID NO: 734782 - protein, 9 aa, Homo Sapiens
LSFTDFCYS

SEQ ID NO: 734783 - protein, 9 aa, Homo Sapiens
LEEEDDDDY

SEQ ID NO: 734784 - protein, 9 aa, Homo Sapiens
IWCTTPLTT

SEQ ID NO: 734785 - protein, 9 aa, Homo Sapiens
IFPTADSTS

SEQ ID NO: 734786 - protein, 9 aa, Homo Sapiens
QEGAISEVL

SEQ ID NO: 734787 - protein, 9 aa, Homo Sapiens
FTDFCYSSV

SEQ ID NO: 734788 - protein, 9 aa, Homo Sapiens
ALRAELLRL

SEQ ID NO: 734789 - protein, 9 aa, Homo Sapiens
HVASTVFLD

SEQ ID NO: 734790 - protein, 9 aa, Homo Sapiens
RHIMTHTAG

SEQ ID NO: 734791 - protein, 9 aa, Homo Sapiens
YRSVFFRHI

SEQ ID NO: 734792 - protein, 9 aa, Homo Sapiens
TIFGNVTTV

SEQ ID NO: 734793 - protein, 9 aa, Homo Sapiens
PPSPAKPMH

SEQ ID NO: 734794 - protein, 9 aa, Homo Sapiens
DGLAPPLIR

SEQ ID NO: 734795 - protein, 9 aa, Homo Sapiens
CGYGCGYGF

SEQ ID NO: 734796 - protein, 9 aa, Homo Sapiens
SCGSSPGSS

SEQ ID NO: 734797 - protein, 9 aa, Homo Sapiens
CRFWISFFP

SEQ ID NO: 734798 - protein, 9 aa, Homo Sapiens
RCPTECSSR

SEQ ID NO: 734799 - protein, 9 aa, Homo Sapiens
MFLSILVEL

SEQ ID NO: 734800 - protein, 9 aa, Homo Sapiens
NNPATEVSC

SEQ ID NO: 734801 - protein, 9 aa, Homo Sapiens
ARLDGPHEA

SEQ ID NO: 734802 - protein, 9 aa, Homo Sapiens
QSYEELGGL

SEQ ID NO: 734803 - protein, 9 aa, Homo Sapiens
CESIQVKQL

SEQ ID NO: 734804 - protein, 9 aa, Homo Sapiens
RQYMRRLVG

SEQ ID NO: 734805 - protein, 9 aa, Homo Sapiens
DPFWALHSV

SEQ ID NO: 734806 - protein, 9 aa, Homo Sapiens
LTPSLAGKS

SEQ ID NO: 734807 - protein, 9 aa, Homo Sapiens
WLYHVASTV

SEQ ID NO: 734808 - protein, 9 aa, Homo Sapiens
VKVLGQGEQ

SEQ ID NO: 734809 - protein, 9 aa, Homo Sapiens
EAMTDEQKM

SEQ ID NO: 734810 - protein, 9 aa, Homo Sapiens
GEAEHRNRS

SEQ ID NO: 734811 - protein, 9 aa, Homo Sapiens
QAPCSSSIS

SEQ ID NO: 734812 - protein, 9 aa, Homo Sapiens
PQTCTPSLT

SEQ ID NO: 734813 - protein, 9 aa, Homo Sapiens
ISFEGCMAH

SEQ ID NO: 734814 - protein, 9 aa, Homo Sapiens
VASTVFLDV

SEQ ID NO: 734815 - protein, 9 aa, Homo Sapiens
RFLEKNKDL

SEQ ID NO: 734816 - protein, 9 aa, Homo Sapiens
KTVCAPCPN

SEQ ID NO: 734817 - protein, 9 aa, Homo Sapiens
GGKMTDLGL

SEQ ID NO: 734818 - protein, 9 aa, Homo Sapiens
VIELCESIQ

SEQ ID NO: 734819 - protein, 9 aa, Homo Sapiens
VFFRHIMTH

SEQ ID NO: 734820 - protein, 9 aa, Homo Sapiens
FNGSTKHGL

SEQ ID NO: 734821 - protein, 9 aa, Homo Sapiens
CLHHSLSHS

SEQ ID NO: 734822 - protein, 9 aa, Homo Sapiens
VTPVQSSVS

SEQ ID NO: 734823 - protein, 9 aa, Homo Sapiens
LDIICETAI

SEQ ID NO: 734824 - protein, 9 aa, Homo Sapiens
TLMDVLDTD

SEQ ID NO: 734825 - protein, 9 aa, Homo Sapiens
LGRFLLQAQ

SEQ ID NO: 734826 - protein, 9 aa, Homo Sapiens
SRRRDSHKG

SEQ ID NO: 734827 - protein, 9 aa, Homo Sapiens
PAFTDLHLH

SEQ ID NO: 734828 - protein, 9 aa, Homo Sapiens
QVRCGELLA

SEQ ID NO: 734829 - protein, 9 aa, Homo Sapiens
VLRAFEPLL

SEQ ID NO: 734830 - protein, 9 aa, Homo Sapiens
PASHPLFGR

SEQ ID NO: 734831 - protein, 9 aa, Homo Sapiens
VEPVFLGFT

SEQ ID NO: 734832 - protein, 9 aa, Homo Sapiens
PVLLEDKTG

SEQ ID NO: 734833 - protein, 9 aa, Homo Sapiens
WAQTEGSGW

SEQ ID NO: 734834 - protein, 9 aa, Homo Sapiens
NGLDGLEEE

SEQ ID NO: 734835 - protein, 9 aa, Homo Sapiens
DCGHPHQEM

SEQ ID NO: 734836 - protein, 9 aa, Homo Sapiens
GIRELLGTT

SEQ ID NO: 734837 - protein, 9 aa, Homo Sapiens
TFADRTDLC

SEQ ID NO: 734838 - protein, 9 aa, Homo Sapiens
CSLHHATMK

SEQ ID NO: 734839 - protein, 9 aa, Homo Sapiens
PKGRLETVR

SEQ ID NO: 734840 - protein, 9 aa, Homo Sapiens
PLSEEFEAY

SEQ ID NO: 734841 - protein, 9 aa, Homo Sapiens
PLPASHPLF

SEQ ID NO: 734842 - protein, 9 aa, Homo Sapiens
SKLHRTKLI

SEQ ID NO: 734843 - protein, 9 aa, Homo Sapiens
GTRTPVVKA

SEQ ID NO: 734844 - protein, 9 aa, Homo Sapiens
HRTKLIGIG

SEQ ID NO: 734845 - protein, 9 aa, Homo Sapiens
ADVCFGFLP

SEQ ID NO: 734846 - protein, 9 aa, Homo Sapiens
AQLASLWAL

SEQ ID NO: 734847 - protein, 9 aa, Homo Sapiens
SRLSASQIW

SEQ ID NO: 734848 - protein, 9 aa, Homo Sapiens
VFFEEEFSC

SEQ ID NO: 734849 - protein, 9 aa, Homo Sapiens
AVIKIIALG

SEQ ID NO: 734850 - protein, 9 aa, Homo Sapiens
KHEIHVCRL

SEQ ID NO: 734851 - protein, 9 aa, Homo Sapiens
HWFHSSQVP

SEQ ID NO: 734852 - protein, 9 aa, Homo Sapiens
FLALKECLR

SEQ ID NO: 734853 - protein, 9 aa, Homo Sapiens
LMLSNTLGA

SEQ ID NO: 734854 - protein, 9 aa, Homo Sapiens
LSVLIIVMC

SEQ ID NO: 734855 - protein, 9 aa, Homo Sapiens
TLHTPMYFF

SEQ ID NO: 734856 - protein, 9 aa, Homo Sapiens
WTEQPEAQS

SEQ ID NO: 734857 - protein, 9 aa, Homo Sapiens
STGSPVAPT

SEQ ID NO: 734858 - protein, 9 aa, Homo Sapiens
DPGHGGARR

SEQ ID NO: 734859 - protein, 9 aa, Homo Sapiens
LLGRFFQGW

SEQ ID NO: 734860 - protein, 9 aa, Homo Sapiens
IFGNVTTVF

SEQ ID NO: 734861 - protein, 9 aa, Homo Sapiens
ACCSLHHAT

SEQ ID NO: 734862 - protein, 9 aa, Homo Sapiens
LLQNGSAPC

SEQ ID NO: 734863 - protein, 9 aa, Homo Sapiens
ALGTARAEA

SEQ ID NO: 734864 - protein, 9 aa, Homo Sapiens
HVCRLTAQR

SEQ ID NO: 734865 - protein, 9 aa, Homo Sapiens
LAPCAGTTD

SEQ ID NO: 734866 - protein, 9 aa, Homo Sapiens
GQEKVKSAA

SEQ ID NO: 734867 - protein, 9 aa, Homo Sapiens
EAVIKIIAL

SEQ ID NO: 734868 - protein, 9 aa, Homo Sapiens
TTVNVYGHV

SEQ ID NO: 734869 - protein, 9 aa, Homo Sapiens
AVRELGQKR

SEQ ID NO: 734870 - protein, 9 aa, Homo Sapiens
TFKPPAYEY

SEQ ID NO: 734871 - protein, 9 aa, Homo Sapiens
DFAVDNFGN

SEQ ID NO: 734872 - protein, 9 aa, Homo Sapiens
KERINKGKA

SEQ ID NO: 734873 - protein, 9 aa, Homo Sapiens
SLMQAELHR

SEQ ID NO: 734874 - protein, 9 aa, Homo Sapiens
FQPSGVTDG

SEQ ID NO: 734875 - protein, 9 aa, Homo Sapiens
DLNKCVSPQ

SEQ ID NO: 734876 - protein, 9 aa, Homo Sapiens
CGSSPGSSA

SEQ ID NO: 734877 - protein, 9 aa, Homo Sapiens
PTECSSRGL

SEQ ID NO: 734878 - protein, 9 aa, Homo Sapiens
TLDRQLVEL

SEQ ID NO: 734879 - protein, 9 aa, Homo Sapiens
GPRSLPPPA

SEQ ID NO: 734880 - protein, 9 aa, Homo Sapiens
EPIGVGGGI

SEQ ID NO: 734881 - protein, 9 aa, Homo Sapiens
FFEEEFSCS

SEQ ID NO: 734882 - protein, 9 aa, Homo Sapiens
TNRQYMRRL

SEQ ID NO: 734883 - protein, 9 aa, Homo Sapiens
RTGVINITS

SEQ ID NO: 734884 - protein, 9 aa, Homo Sapiens
GPMTLDDVE

SEQ ID NO: 734885 - protein, 9 aa, Homo Sapiens
KIFSMSANI

SEQ ID NO: 734886 - protein, 9 aa, Homo Sapiens
PRPLLYYSS

SEQ ID NO: 734887 - protein, 9 aa, Homo Sapiens
RRPGCRFKR

SEQ ID NO: 734888 - protein, 9 aa, Homo Sapiens
AKKKCIWGP

SEQ ID NO: 734889 - protein, 9 aa, Homo Sapiens
QGTVCTLEF

SEQ ID NO: 734890 - protein, 9 aa, Homo Sapiens
VKNQYQLLK

SEQ ID NO: 734891 - protein, 9 aa, Homo Sapiens
PTFRGYSPQ

SEQ ID NO: 734892 - protein, 9 aa, Homo Sapiens
YNLSFTDFC

SEQ ID NO: 734893 - protein, 9 aa, Homo Sapiens
FLADFLVCC

SEQ ID NO: 734894 - protein, 9 aa, Homo Sapiens
TFCRVCSMF

SEQ ID NO: 734895 - protein, 9 aa, Homo Sapiens
LCEFTPLYP

SEQ ID NO: 734896 - protein, 9 aa, Homo Sapiens
RFKRHTNTV

SEQ ID NO: 734897 - protein, 9 aa, Homo Sapiens
GDLNKCVSP

SEQ ID NO: 734898 - protein, 9 aa, Homo Sapiens
SHPPWERPT

SEQ ID NO: 734899 - protein, 9 aa, Homo Sapiens
SSSSNSGRR

SEQ ID NO: 734900 - protein, 9 aa, Homo Sapiens
EYVVHRPGT

SEQ ID NO: 734901 - protein, 9 aa, Homo Sapiens
YIKIFSMSA

SEQ ID NO: 734902 - protein, 9 aa, Homo Sapiens
PFDGDLNKC

SEQ ID NO: 734903 - protein, 9 aa, Homo Sapiens
TVTQLVTSH

SEQ ID NO: 734904 - protein, 9 aa, Homo Sapiens
GGLEACTRK

SEQ ID NO: 734905 - protein, 9 aa, Homo Sapiens
LLSFASGGR

SEQ ID NO: 734906 - protein, 9 aa, Homo Sapiens
CYPVVLEES

SEQ ID NO: 734907 - protein, 9 aa, Homo Sapiens
NRGSNRALR

SEQ ID NO: 734908 - protein, 9 aa, Homo Sapiens
HSEVEQLVN

SEQ ID NO: 734909 - protein, 9 aa, Homo Sapiens
LIIQNKDDL

SEQ ID NO: 734910 - protein, 9 aa, Homo Sapiens
SKHNVTKLL

SEQ ID NO: 734911 - protein, 9 aa, Homo Sapiens
NTTGVLSVQ

SEQ ID NO: 734912 - protein, 9 aa, Homo Sapiens
ATPLAVTSL

SEQ ID NO: 734913 - protein, 9 aa, Homo Sapiens
KAQEKMVYI

SEQ ID NO: 734914 - protein, 9 aa, Homo Sapiens
DGLIHPFIT

SEQ ID NO: 734915 - protein, 9 aa, Homo Sapiens
YCVNQAQVQ

SEQ ID NO: 734916 - protein, 9 aa, Homo Sapiens
ELLACGQWH

SEQ ID NO: 734917 - protein, 9 aa, Homo Sapiens
QRARDPVPT

SEQ ID NO: 734918 - protein, 9 aa, Homo Sapiens
FLKELDFRL

SEQ ID NO: 734919 - protein, 9 aa, Homo Sapiens
TYFNGSTKH

SEQ ID NO: 734920 - protein, 9 aa, Homo Sapiens
QEMEAMTDE

SEQ ID NO: 734921 - protein, 9 aa, Homo Sapiens
SVQGQFYYI

SEQ ID NO: 734922 - protein, 9 aa, Homo Sapiens
SLSFHGGLN

SEQ ID NO: 734923 - protein, 9 aa, Homo Sapiens
LAAGPGSAG

SEQ ID NO: 734924 - protein, 9 aa, Homo Sapiens
AISDLLFIR

SEQ ID NO: 734925 - protein, 9 aa, Homo Sapiens
LDPTLHTPM

SEQ ID NO: 734926 - protein, 9 aa, Homo Sapiens
DLLFIRTLP

SEQ ID NO: 734927 - protein, 9 aa, Homo Sapiens
MVFLLVFFG

SEQ ID NO: 734928 - protein, 9 aa, Homo Sapiens
IIISYLDPT

SEQ ID NO: 734929 - protein, 9 aa, Homo Sapiens
FGCGYGCGY

SEQ ID NO: 734930 - protein, 9 aa, Homo Sapiens
KEGVLSLTA

SEQ ID NO: 734931 - protein, 9 aa, Homo Sapiens
KAPSVQGQF

SEQ ID NO: 734932 - protein, 9 aa, Homo Sapiens
FSKEFQENT

SEQ ID NO: 734933 - protein, 9 aa, Homo Sapiens
RARFDGPLW

SEQ ID NO: 734934 - protein, 9 aa, Homo Sapiens
ASHPLFGRL

SEQ ID NO: 734935 - protein, 9 aa, Homo Sapiens
CLDGEHILT

SEQ ID NO: 734936 - protein, 9 aa, Homo Sapiens
SRFHDGIKL

SEQ ID NO: 734937 - protein, 9 aa, Homo Sapiens
GCTNTDGLF

SEQ ID NO: 734938 - protein, 9 aa, Homo Sapiens
NNAKYSLER

SEQ ID NO: 734939 - protein, 9 aa, Homo Sapiens
VMDYDRYLA

SEQ ID NO: 734940 - protein, 9 aa, Homo Sapiens
QLEEKCGHQ

SEQ ID NO: 734941 - protein, 9 aa, Homo Sapiens
EEVVGLPPK

SEQ ID NO: 734942 - protein, 9 aa, Homo Sapiens
IADENGWHE

SEQ ID NO: 734943 - protein, 9 aa, Homo Sapiens
ILVGAPWDG

SEQ ID NO: 734944 - protein, 9 aa, Homo Sapiens
RDTDSGVRP

SEQ ID NO: 734945 - protein, 9 aa, Homo Sapiens
KTPPEEKLM

SEQ ID NO: 734946 - protein, 9 aa, Homo Sapiens
LKELDFRLN

SEQ ID NO: 734947 - protein, 9 aa, Homo Sapiens
LFCDHNTLL

SEQ ID NO: 734948 - protein, 9 aa, Homo Sapiens
CMTERKRSR

SEQ ID NO: 734949 - protein, 9 aa, Homo Sapiens
QLQVRCGEL

SEQ ID NO: 734950 - protein, 9 aa, Homo Sapiens
FNLQVRKRK

SEQ ID NO: 734951 - protein, 9 aa, Homo Sapiens
SKEGVLSLT

SEQ ID NO: 734952 - protein, 9 aa, Homo Sapiens
EMLKKSLHS

SEQ ID NO: 734953 - protein, 9 aa, Homo Sapiens
QPQASYYKF

SEQ ID NO: 734954 - protein, 9 aa, Homo Sapiens
KKEEPEAEE

SEQ ID NO: 734955 - protein, 9 aa, Homo Sapiens
LRGPADFGW

SEQ ID NO: 734956 - protein, 9 aa, Homo Sapiens
AFNTTGVLS

SEQ ID NO: 734957 - protein, 9 aa, Homo Sapiens
PRLWLYHVA

SEQ ID NO: 734958 - protein, 9 aa, Homo Sapiens
TTPESTTQI

SEQ ID NO: 734959 - protein, 9 aa, Homo Sapiens
DKQAKKKCI

SEQ ID NO: 734960 - protein, 9 aa, Homo Sapiens
LLDEHDAMS

SEQ ID NO: 734961 - protein, 9 aa, Homo Sapiens
YPVVLEESK

SEQ ID NO: 734962 - protein, 9 aa, Homo Sapiens
NVTTVFQQM

SEQ ID NO: 734963 - protein, 9 aa, Homo Sapiens
DVFQAFLNT

SEQ ID NO: 734964 - protein, 9 aa, Homo Sapiens
VLWLACRAD

SEQ ID NO: 734965 - protein, 9 aa, Homo Sapiens
ICETAIGKN

SEQ ID NO: 734966 - protein, 9 aa, Homo Sapiens
LKYMDDIEK

SEQ ID NO: 734967 - protein, 9 aa, Homo Sapiens
TPVVKAFLE

SEQ ID NO: 734968 - protein, 9 aa, Homo Sapiens
NYSSLLSKH

SEQ ID NO: 734969 - protein, 9 aa, Homo Sapiens
AWHPIKLHG

SEQ ID NO: 734970 - protein, 9 aa, Homo Sapiens
MRRFFSRRR

SEQ ID NO: 734971 - protein, 9 aa, Homo Sapiens
PSLNSGRLI

SEQ ID NO: 734972 - protein, 9 aa, Homo Sapiens
DQAFLPEPL

SEQ ID NO: 734973 - protein, 9 aa, Homo Sapiens
LEEKCGHQI

SEQ ID NO: 734974 - protein, 9 aa, Homo Sapiens
FPPLVMAAF

SEQ ID NO: 734975 - protein, 9 aa, Homo Sapiens
NHFCITFEF

SEQ ID NO: 734976 - protein, 9 aa, Homo Sapiens
QIDVAMKVL

SEQ ID NO: 734977 - protein, 9 aa, Homo Sapiens
TFRGYSPQD

SEQ ID NO: 734978 - protein, 9 aa, Homo Sapiens
KGDILRIQD

SEQ ID NO: 734979 - protein, 9 aa, Homo Sapiens
TDLGLLGAF

SEQ ID NO: 734980 - protein, 9 aa, Homo Sapiens
FHIWLNSTE

SEQ ID NO: 734981 - protein, 9 aa, Homo Sapiens
HERYENCGF

SEQ ID NO: 734982 - protein, 9 aa, Homo Sapiens
GEQWRGGDG

SEQ ID NO: 734983 - protein, 9 aa, Homo Sapiens
NGKPLSEEF

SEQ ID NO: 734984 - protein, 9 aa, Homo Sapiens
RWRAIRRGA

SEQ ID NO: 734985 - protein, 9 aa, Homo Sapiens
DNFGNRTLR

SEQ ID NO: 734986 - protein, 9 aa, Homo Sapiens
PQEPLQPSN

SEQ ID NO: 734987 - protein, 9 aa, Homo Sapiens
QENTQHLLD

SEQ ID NO: 734988 - protein, 9 aa, Homo Sapiens
ETGKTALAL

SEQ ID NO: 734989 - protein, 9 aa, Homo Sapiens
KIEEHLAMV

SEQ ID NO: 734990 - protein, 9 aa, Homo Sapiens
GLTLMDVLD

SEQ ID NO: 734991 - protein, 9 aa, Homo Sapiens
DSTGKVGFC

SEQ ID NO: 734992 - protein, 9 aa, Homo Sapiens
EGSGGHAQA

SEQ ID NO: 734993 - protein, 9 aa, Homo Sapiens
LHGILILGQ

SEQ ID NO: 734994 - protein, 9 aa, Homo Sapiens
HILEEVVGL

SEQ ID NO: 734995 - protein, 9 aa, Homo Sapiens
QKKVGSQNK

SEQ ID NO: 734996 - protein, 9 aa, Homo Sapiens
SMSANIMHA

SEQ ID NO: 734997 - protein, 9 aa, Homo Sapiens
PRINQLSTR

SEQ ID NO: 734998 - protein, 9 aa, Homo Sapiens
AVQAFHIWL

SEQ ID NO: 734999 - protein, 9 aa, Homo Sapiens
WISFFPKVL

SEQ ID NO: 735000 - protein, 9 aa, Homo Sapiens
PIKLHGILI

SEQ ID NO: 735001 - protein, 9 aa, Homo Sapiens
SNRALRAEL

SEQ ID NO: 735002 - protein, 9 aa, Homo Sapiens
LQKHLDAHS

SEQ ID NO: 735003 - protein, 9 aa, Homo Sapiens
AGFFLPQDD

SEQ ID NO: 735004 - protein, 9 aa, Homo Sapiens
LPRLWLYHV

SEQ ID NO: 735005 - protein, 9 aa, Homo Sapiens
DEPEEQSGD

SEQ ID NO: 735006 - protein, 9 aa, Homo Sapiens
SKPDLPEEK

SEQ ID NO: 735007 - protein, 9 aa, Homo Sapiens
SSSSSRESL

SEQ ID NO: 735008 - protein, 9 aa, Homo Sapiens
IECFKRQKI

SEQ ID NO: 735009 - protein, 9 aa, Homo Sapiens
RGLCEFTPL

SEQ ID NO: 735010 - protein, 9 aa, Homo Sapiens
LHFFCDLAP

SEQ ID NO: 735011 - protein, 9 aa, Homo Sapiens
CRKTFSHPS

SEQ ID NO: 735012 - protein, 9 aa, Homo Sapiens
LCGGYIQVK

SEQ ID NO: 735013 - protein, 9 aa, Homo Sapiens
PCSSSISSS

SEQ ID NO: 735014 - protein, 9 aa, Homo Sapiens
TSRELACLH

SEQ ID NO: 735015 - protein, 9 aa, Homo Sapiens
KPSSEGLGI

SEQ ID NO: 735016 - protein, 9 aa, Homo Sapiens
PAGHEDQPL

SEQ ID NO: 735017 - protein, 9 aa, Homo Sapiens
EGVLLAKMK

SEQ ID NO: 735018 - protein, 9 aa, Homo Sapiens
FKPPAYEYV

SEQ ID NO: 735019 - protein, 9 aa, Homo Sapiens
KCIWGPSGW

SEQ ID NO: 735020 - protein, 9 aa, Homo Sapiens
PREQRRATR

SEQ ID NO: 735021 - protein, 9 aa, Homo Sapiens
LACRADELL

SEQ ID NO: 735022 - protein, 9 aa, Homo Sapiens
SYLDPTLHT

SEQ ID NO: 735023 - protein, 9 aa, Homo Sapiens
LDAHSEEPA

SEQ ID NO: 735024 - protein, 9 aa, Homo Sapiens
DGHVPEQFS

SEQ ID NO: 735025 - protein, 9 aa, Homo Sapiens
RYENCGFKN

SEQ ID NO: 735026 - protein, 9 aa, Homo Sapiens
RPRICPHQH

SEQ ID NO: 735027 - protein, 9 aa, Homo Sapiens
YGQTFADRT

SEQ ID NO: 735028 - protein, 9 aa, Homo Sapiens
NPAVQAFHI

SEQ ID NO: 735029 - protein, 9 aa, Homo Sapiens
GFGCGYGCG

SEQ ID NO: 735030 - protein, 9 aa, Homo Sapiens
DRTDLCRSA

SEQ ID NO: 735031 - protein, 9 aa, Homo Sapiens
QQDSACKVQ

SEQ ID NO: 735032 - protein, 9 aa, Homo Sapiens
GCQELAGPE

SEQ ID NO: 735033 - protein, 9 aa, Homo Sapiens
TNNRSMLSS

SEQ ID NO: 735034 - protein, 9 aa, Homo Sapiens
STTCMTSLN

SEQ ID NO: 735035 - protein, 9 aa, Homo Sapiens
EEEFSCSIK

SEQ ID NO: 735036 - protein, 9 aa, Homo Sapiens
LAAGVYEER

SEQ ID NO: 735037 - protein, 9 aa, Homo Sapiens
GRATARWRW

SEQ ID NO: 735038 - protein, 9 aa, Homo Sapiens
PLVEQTSLL

SEQ ID NO: 735039 - protein, 9 aa, Homo Sapiens
VLSLTAAST

SEQ ID NO: 735040 - protein, 9 aa, Homo Sapiens
LGTRARECV

SEQ ID NO: 735041 - protein, 9 aa, Homo Sapiens
VVRRVFGRM

SEQ ID NO: 735042 - protein, 9 aa, Homo Sapiens
ARDPVPTNF

SEQ ID NO: 735043 - protein, 9 aa, Homo Sapiens
VFLGFTVQP

SEQ ID NO: 735044 - protein, 9 aa, Homo Sapiens
DSKEGVLSL

SEQ ID NO: 735045 - protein, 9 aa, Homo Sapiens
HSKIQKFSE

SEQ ID NO: 735046 - protein, 9 aa, Homo Sapiens
FAVDNFGNR

SEQ ID NO: 735047 - protein, 9 aa, Homo Sapiens
TADSTSVEL

SEQ ID NO: 735048 - protein, 9 aa, Homo Sapiens
NTNNRSMLS

SEQ ID NO: 735049 - protein, 9 aa, Homo Sapiens
RYRLFSRFH

SEQ ID NO: 735050 - protein, 9 aa, Homo Sapiens
LRNDWTLQN

SEQ ID NO: 735051 - protein, 9 aa, Homo Sapiens
YTKPKGHLP

SEQ ID NO: 735052 - protein, 9 aa, Homo Sapiens
FNYSSLLSK

SEQ ID NO: 735053 - protein, 9 aa, Homo Sapiens
KDGAVGFAD

SEQ ID NO: 735054 - protein, 9 aa, Homo Sapiens
LDGEHILTA

SEQ ID NO: 735055 - protein, 9 aa, Homo Sapiens
CLSLQAYAS

SEQ ID NO: 735056 - protein, 9 aa, Homo Sapiens
LFAMFSKTG

SEQ ID NO: 735057 - protein, 9 aa, Homo Sapiens
HSLQYPSTQ

SEQ ID NO: 735058 - protein, 9 aa, Homo Sapiens
YTACDLAPC

SEQ ID NO: 735059 - protein, 9 aa, Homo Sapiens
ACRADELLS

SEQ ID NO: 735060 - protein, 9 aa, Homo Sapiens
GGKDGAVGF

SEQ ID NO: 735061 - protein, 9 aa, Homo Sapiens
WERPTAACS

SEQ ID NO: 735062 - protein, 9 aa, Homo Sapiens
WGDSRQPQA

SEQ ID NO: 735063 - protein, 9 aa, Homo Sapiens
DDSSGTCHI

SEQ ID NO: 735064 - protein, 9 aa, Homo Sapiens
CIIQPVLFA

SEQ ID NO: 735065 - protein, 9 aa, Homo Sapiens
TPLTTTRDP

SEQ ID NO: 735066 - protein, 9 aa, Homo Sapiens
FEEEFSCSI

SEQ ID NO: 735067 - protein, 9 aa, Homo Sapiens
LSRDNELYP

SEQ ID NO: 735068 - protein, 9 aa, Homo Sapiens
RTVPIQPFG

SEQ ID NO: 735069 - protein, 9 aa, Homo Sapiens
FLYNLSFTD

SEQ ID NO: 735070 - protein, 9 aa, Homo Sapiens
DSFSCGSSP

SEQ ID NO: 735071 - protein, 9 aa, Homo Sapiens
APCPDGYRQ

SEQ ID NO: 735072 - protein, 9 aa, Homo Sapiens
STPTPAGHE

SEQ ID NO: 735073 - protein, 9 aa, Homo Sapiens
CSTYPEPVY

SEQ ID NO: 735074 - protein, 9 aa, Homo Sapiens
WITYMVFLL

SEQ ID NO: 735075 - protein, 9 aa, Homo Sapiens
CAKDFHGQI

SEQ ID NO: 735076 - protein, 9 aa, Homo Sapiens
EGCMAHIFV

SEQ ID NO: 735077 - protein, 9 aa, Homo Sapiens
HPIKLHGIL

SEQ ID NO: 735078 - protein, 9 aa, Homo Sapiens
PSPAKPMHP

SEQ ID NO: 735079 - protein, 9 aa, Homo Sapiens
LYVKKPLKA

SEQ ID NO: 735080 - protein, 9 aa, Homo Sapiens
YLYLVYQQW

SEQ ID NO: 735081 - protein, 9 aa, Homo Sapiens
TNSTWAQTE

SEQ ID NO: 735082 - protein, 9 aa, Homo Sapiens
RGAQRDTDS

SEQ ID NO: 735083 - protein, 9 aa, Homo Sapiens
PPYPAAVYA

SEQ ID NO: 735084 - protein, 9 aa, Homo Sapiens
THSSLSFHG

SEQ ID NO: 735085 - protein, 9 aa, Homo Sapiens
KEAVRELGQ

SEQ ID NO: 735086 - protein, 9 aa, Homo Sapiens
SSNVVRHRW

SEQ ID NO: 735087 - protein, 9 aa, Homo Sapiens
NKTLALFYT

SEQ ID NO: 735088 - protein, 9 aa, Homo Sapiens
ETLESKHNV

SEQ ID NO: 735089 - protein, 9 aa, Homo Sapiens
TPPEEKLMS

SEQ ID NO: 735090 - protein, 9 aa, Homo Sapiens
QLTFCRVCS

SEQ ID NO: 735091 - protein, 9 aa, Homo Sapiens
LRTFMRSLP

SEQ ID NO: 735092 - protein, 9 aa, Homo Sapiens
AESTEEVCS

SEQ ID NO: 735093 - protein, 9 aa, Homo Sapiens
NFTHCHTAN

SEQ ID NO: 735094 - protein, 9 aa, Homo Sapiens
RNLLLSRDN

SEQ ID NO: 735095 - protein, 9 aa, Homo Sapiens
LAFEKGSLL

SEQ ID NO: 735096 - protein, 9 aa, Homo Sapiens
TLTQLGVLP

SEQ ID NO: 735097 - protein, 9 aa, Homo Sapiens
IDVAMKVLK

SEQ ID NO: 735098 - protein, 9 aa, Homo Sapiens
FRGYSPQDA

SEQ ID NO: 735099 - protein, 9 aa, Homo Sapiens
QGAQKSIKA

SEQ ID NO: 735100 - protein, 9 aa, Homo Sapiens
ASPNWSIVP

SEQ ID NO: 735101 - protein, 9 aa, Homo Sapiens
GQDGHVPEQ

SEQ ID NO: 735102 - protein, 9 aa, Homo Sapiens
QLGLATQAY

SEQ ID NO: 735103 - protein, 9 aa, Homo Sapiens
RDYDPDECG

SEQ ID NO: 735104 - protein, 9 aa, Homo Sapiens
QGGSPARFP

SEQ ID NO: 735105 - protein, 9 aa, Homo Sapiens
QKFSESFER

SEQ ID NO: 735106 - protein, 9 aa, Homo Sapiens
PKPRPLLYY

SEQ ID NO: 735107 - protein, 9 aa, Homo Sapiens
SIPKVDAYV

SEQ ID NO: 735108 - protein, 9 aa, Homo Sapiens
MRSLPSRQR

SEQ ID NO: 735109 - protein, 9 aa, Homo Sapiens
GKLESITCK

SEQ ID NO: 735110 - protein, 9 aa, Homo Sapiens
EAVRELGQK

SEQ ID NO: 735111 - protein, 9 aa, Homo Sapiens
SNTNNRSML

SEQ ID NO: 735112 - protein, 9 aa, Homo Sapiens
EHRNRSQSL

SEQ ID NO: 735113 - protein, 9 aa, Homo Sapiens
GTLLSVPVL

SEQ ID NO: 735114 - protein, 9 aa, Homo Sapiens
HGKIYSGEK

SEQ ID NO: 735115 - protein, 9 aa, Homo Sapiens
PDQDQSDKA

SEQ ID NO: 735116 - protein, 9 aa, Homo Sapiens
TRDPGHGGA

SEQ ID NO: 735117 - protein, 9 aa, Homo Sapiens
HRNRSQSLA

SEQ ID NO: 735118 - protein, 9 aa, Homo Sapiens
GIFCFEAVI

SEQ ID NO: 735119 - protein, 9 aa, Homo Sapiens
FYPPCHPFP

SEQ ID NO: 735120 - protein, 9 aa, Homo Sapiens
NHYYTDSWH

SEQ ID NO: 735121 - protein, 9 aa, Homo Sapiens
EPAGTGKTE

SEQ ID NO: 735122 - protein, 9 aa, Homo Sapiens
EAQSSQADR

SEQ ID NO: 735123 - protein, 9 aa, Homo Sapiens
CHPFPDLQK

SEQ ID NO: 735124 - protein, 9 aa, Homo Sapiens
SNTLGAQKP

SEQ ID NO: 735125 - protein, 9 aa, Homo Sapiens
SGRRIWCTT

SEQ ID NO: 735126 - protein, 9 aa, Homo Sapiens
RTIYNVRLL

SEQ ID NO: 735127 - protein, 9 aa, Homo Sapiens
TTRDPGHGG

SEQ ID NO: 735128 - protein, 9 aa, Homo Sapiens
SDIEMAKAP

SEQ ID NO: 735129 - protein, 9 aa, Homo Sapiens
FGRMRRFFS

SEQ ID NO: 735130 - protein, 9 aa, Homo Sapiens
PETRLDLTG

SEQ ID NO: 735131 - protein, 9 aa, Homo Sapiens
DLVFEAEDL

SEQ ID NO: 735132 - protein, 9 aa, Homo Sapiens
CAPCPNHYY

SEQ ID NO: 735133 - protein, 9 aa, Homo Sapiens
HCSTYPEPV

SEQ ID NO: 735134 - protein, 9 aa, Homo Sapiens
RTPVVKAFL

SEQ ID NO: 735135 - protein, 9 aa, Homo Sapiens
HPFPDLQKQ

SEQ ID NO: 735136 - protein, 9 aa, Homo Sapiens
IQQREKEWE

SEQ ID NO: 735137 - protein, 9 aa, Homo Sapiens
AAAATAAAL

SEQ ID NO: 735138 - protein, 9 aa, Homo Sapiens
DANRKVRLR

SEQ ID NO: 735139 - protein, 9 aa, Homo Sapiens
RILGHIQAT

SEQ ID NO: 735140 - protein, 9 aa, Homo Sapiens
AQDARGAVH

SEQ ID NO: 735141 - protein, 9 aa, Homo Sapiens
TYFAWCLDG

SEQ ID NO: 735142 - protein, 9 aa, Homo Sapiens
PCHPFPDLQ

SEQ ID NO: 735143 - protein, 9 aa, Homo Sapiens
TWAQTEGSG

SEQ ID NO: 735144 - protein, 9 aa, Homo Sapiens
LGIVTKYIT

SEQ ID NO: 735145 - protein, 9 aa, Homo Sapiens
IALVSVRLY

SEQ ID NO: 735146 - protein, 9 aa, Homo Sapiens
HEDEEDEES

SEQ ID NO: 735147 - protein, 9 aa, Homo Sapiens
AVYSTTPVP

SEQ ID NO: 735148 - protein, 9 aa, Homo Sapiens
ISGSRECEI

SEQ ID NO: 735149 - protein, 9 aa, Homo Sapiens
AQTEGSGWL

SEQ ID NO: 735150 - protein, 9 aa, Homo Sapiens
TTGLTLMDV

SEQ ID NO: 735151 - protein, 9 aa, Homo Sapiens
YAEYCTDEG

SEQ ID NO: 735152 - protein, 9 aa, Homo Sapiens
LFHCSCEEG

SEQ ID NO: 735153 - protein, 9 aa, Homo Sapiens
VLMAHGSEG

SEQ ID NO: 735154 - protein, 9 aa, Homo Sapiens
RKVRLRFLE

SEQ ID NO: 735155 - protein, 9 aa, Homo Sapiens
TCKLQKMEA

SEQ ID NO: 735156 - protein, 9 aa, Homo Sapiens
LDLLMQNGE

SEQ ID NO: 735157 - protein, 9 aa, Homo Sapiens
SPQQEPEEL

SEQ ID NO: 735158 - protein, 9 aa, Homo Sapiens
DPLVQLTFC

SEQ ID NO: 735159 - protein, 9 aa, Homo Sapiens
LAGLLSSRD

SEQ ID NO: 735160 - protein, 9 aa, Homo Sapiens
ERKRSRLKP

SEQ ID NO: 735161 - protein, 9 aa, Homo Sapiens
KTLALFYTV

SEQ ID NO: 735162 - protein, 9 aa, Homo Sapiens
IDLQKHLDA

SEQ ID NO: 735163 - protein, 9 aa, Homo Sapiens
CTGFRLRPL

SEQ ID NO: 735164 - protein, 9 aa, Homo Sapiens
SELRDYDPD

SEQ ID NO: 735165 - protein, 9 aa, Homo Sapiens
QTSPTHEDE

SEQ ID NO: 735166 - protein, 9 aa, Homo Sapiens
CAGTTDAAH

SEQ ID NO: 735167 - protein, 9 aa, Homo Sapiens
DYLAIYYSF

SEQ ID NO: 735168 - protein, 9 aa, Homo Sapiens
FTVQSEYGE

SEQ ID NO: 735169 - protein, 9 aa, Homo Sapiens
NPTFRGYSP

SEQ ID NO: 735170 - protein, 9 aa, Homo Sapiens
NFPLFFVHC

SEQ ID NO: 735171 - protein, 9 aa, Homo Sapiens
NALRFTAKH

SEQ ID NO: 735172 - protein, 9 aa, Homo Sapiens
LLNPQPFLQ

SEQ ID NO: 735173 - protein, 9 aa, Homo Sapiens
SYTGEKPYE

SEQ ID NO: 735174 - protein, 9 aa, Homo Sapiens
RWRWVVKVK

SEQ ID NO: 735175 - protein, 9 aa, Homo Sapiens
LPFLKELDF

SEQ ID NO: 735176 - protein, 9 aa, Homo Sapiens
RLRPLAGLL

SEQ ID NO: 735177 - protein, 9 aa, Homo Sapiens
YLTPSRVMD

SEQ ID NO: 735178 - protein, 9 aa, Homo Sapiens
HSSLSFHGG

SEQ ID NO: 735179 - protein, 9 aa, Homo Sapiens
EDESEVHFK

SEQ ID NO: 735180 - protein, 9 aa, Homo Sapiens
HSSPIGRLI

SEQ ID NO: 735181 - protein, 9 aa, Homo Sapiens
PPEVPDCGH

SEQ ID NO: 735182 - protein, 9 aa, Homo Sapiens
DTDSGVRPL

SEQ ID NO: 735183 - protein, 9 aa, Homo Sapiens
IGPLFEELR

SEQ ID NO: 735184 - protein, 9 aa, Homo Sapiens
PHPREAPGP

SEQ ID NO: 735185 - protein, 9 aa, Homo Sapiens
CFPQPPRCN

SEQ ID NO: 735186 - protein, 9 aa, Homo Sapiens
KTTTVVQII

SEQ ID NO: 735187 - protein, 9 aa, Homo Sapiens
DCFTPCGEL

SEQ ID NO: 735188 - protein, 9 aa, Homo Sapiens
MHPHSLLNP

SEQ ID NO: 735189 - protein, 9 aa, Homo Sapiens
LLADVCFGF

SEQ ID NO: 735190 - protein, 9 aa, Homo Sapiens
DSAEGQDGH

SEQ ID NO: 735191 - protein, 9 aa, Homo Sapiens
QQFKEAVRE

SEQ ID NO: 735192 - protein, 9 aa, Homo Sapiens
KGRLETVRP

SEQ ID NO: 735193 - protein, 9 aa, Homo Sapiens
LYYSSLIRH

SEQ ID NO: 735194 - protein, 9 aa, Homo Sapiens
GPVETGKNG

SEQ ID NO: 735195 - protein, 9 aa, Homo Sapiens
YYSSLIRHA

SEQ ID NO: 735196 - protein, 9 aa, Homo Sapiens
IRELLGTTQ

SEQ ID NO: 735197 - protein, 9 aa, Homo Sapiens
LGEPVLWLA

SEQ ID NO: 735198 - protein, 9 aa, Homo Sapiens
PGDAEDLAA

SEQ ID NO: 735199 - protein, 9 aa, Homo Sapiens
GAGGLDSWV

SEQ ID NO: 735200 - protein, 9 aa, Homo Sapiens
IALVNSIEC

SEQ ID NO: 735201 - protein, 9 aa, Homo Sapiens
TPTPAGHED

SEQ ID NO: 735202 - protein, 9 aa, Homo Sapiens
QVNAIKWDP

SEQ ID NO: 735203 - protein, 9 aa, Homo Sapiens
ASGACCSLH

SEQ ID NO: 735204 - protein, 9 aa, Homo Sapiens
GFFLPQDDS

SEQ ID NO: 735205 - protein, 9 aa, Homo Sapiens
MLSNTLGAQ

SEQ ID NO: 735206 - protein, 9 aa, Homo Sapiens
EGALGTARA

SEQ ID NO: 735207 - protein, 9 aa, Homo Sapiens
QKSIKAMWR

SEQ ID NO: 735208 - protein, 9 aa, Homo Sapiens
GQIGFTCNQ

SEQ ID NO: 735209 - protein, 9 aa, Homo Sapiens
TEVSCRHNP

SEQ ID NO: 735210 - protein, 9 aa, Homo Sapiens
PEEQSGDET

SEQ ID NO: 735211 - protein, 9 aa, Homo Sapiens
GHATPLAVT

SEQ ID NO: 735212 - protein, 9 aa, Homo Sapiens
GAQRDTDSG

SEQ ID NO: 735213 - protein, 9 aa, Homo Sapiens
VKSAAAWTC

SEQ ID NO: 735214 - protein, 9 aa, Homo Sapiens
AVGFADFVY

SEQ ID NO: 735215 - protein, 9 aa, Homo Sapiens
LDEHRTRLL

SEQ ID NO: 735216 - protein, 9 aa, Homo Sapiens
GRGKGGKGW

SEQ ID NO: 735217 - protein, 9 aa, Homo Sapiens
MTSLNSTNP

SEQ ID NO: 735218 - protein, 9 aa, Homo Sapiens
ALLVARLDG

SEQ ID NO: 735219 - protein, 9 aa, Homo Sapiens
MCPETRLDL

SEQ ID NO: 735220 - protein, 9 aa, Homo Sapiens
CISIPKVDA

SEQ ID NO: 735221 - protein, 9 aa, Homo Sapiens
TDGLFHCSC

SEQ ID NO: 735222 - protein, 9 aa, Homo Sapiens
FAKVKNQYQ

SEQ ID NO: 735223 - protein, 9 aa, Homo Sapiens
FRLNPVVRK

SEQ ID NO: 735224 - protein, 9 aa, Homo Sapiens
CGHQITEEE

SEQ ID NO: 735225 - protein, 9 aa, Homo Sapiens
LSILVELCL

SEQ ID NO: 735226 - protein, 9 aa, Homo Sapiens
EDETLDRQL

SEQ ID NO: 735227 - protein, 9 aa, Homo Sapiens
AMVEAVTKE

SEQ ID NO: 735228 - protein, 9 aa, Homo Sapiens
FMVKEVGKT

SEQ ID NO: 735229 - protein, 9 aa, Homo Sapiens
SDKAQEKMV

SEQ ID NO: 735230 - protein, 9 aa, Homo Sapiens
HHLYKLVKD

SEQ ID NO: 735231 - protein, 9 aa, Homo Sapiens
QDGHVPEQF

SEQ ID NO: 735232 - protein, 9 aa, Homo Sapiens
RKISKGCVV

SEQ ID NO: 735233 - protein, 9 aa, Homo Sapiens
FHGGLNGQV

SEQ ID NO: 735234 - protein, 9 aa, Homo Sapiens
GSGSGPMTL

SEQ ID NO: 735235 - protein, 9 aa, Homo Sapiens
LFSRFHDGI

SEQ ID NO: 735236 - protein, 9 aa, Homo Sapiens
EQRRATRGG

SEQ ID NO: 735237 - protein, 9 aa, Homo Sapiens
PAAVYAGYA

SEQ ID NO: 735238 - protein, 9 aa, Homo Sapiens
TVQSEYGED

SEQ ID NO: 735239 - protein, 9 aa, Homo Sapiens
LMAHGSEGF

SEQ ID NO: 735240 - protein, 9 aa, Homo Sapiens
LAPPLIRVE

SEQ ID NO: 735241 - protein, 9 aa, Homo Sapiens
GLQQDVKVS

SEQ ID NO: 735242 - protein, 9 aa, Homo Sapiens
FCSILFIYI

SEQ ID NO: 735243 - protein, 9 aa, Homo Sapiens
RSKQEAWST

SEQ ID NO: 735244 - protein, 9 aa, Homo Sapiens
GDPGDAEDL

SEQ ID NO: 735245 - protein, 9 aa, Homo Sapiens
SACKVQISP

SEQ ID NO: 735246 - protein, 9 aa, Homo Sapiens
YIRGLCEFT

SEQ ID NO: 735247 - protein, 9 aa, Homo Sapiens
HQRARDPVP

SEQ ID NO: 735248 - protein, 9 aa, Homo Sapiens
SERGGAGGL

SEQ ID NO: 735249 - protein, 9 aa, Homo Sapiens
PKGRARFDG

SEQ ID NO: 735250 - protein, 9 aa, Homo Sapiens
PESTTQIEP

SEQ ID NO: 735251 - protein, 9 aa, Homo Sapiens
GALLVARLD

SEQ ID NO: 735252 - protein, 9 aa, Homo Sapiens
SDSFSCGSS

SEQ ID NO: 735253 - protein, 9 aa, Homo Sapiens
GRFFQGWGT

SEQ ID NO: 735254 - protein, 9 aa, Homo Sapiens
MNFTHCHTA

SEQ ID NO: 735255 - protein, 9 aa, Homo Sapiens
VYQTSPTHE

SEQ ID NO: 735256 - protein, 9 aa, Homo Sapiens
QAFLNTDNI

SEQ ID NO: 735257 - protein, 9 aa, Homo Sapiens
RYGPPTSYP

SEQ ID NO: 735258 - protein, 9 aa, Homo Sapiens
QHMHPHSLL

SEQ ID NO: 735259 - protein, 9 aa, Homo Sapiens
TQNSRKEGV

SEQ ID NO: 735260 - protein, 9 aa, Homo Sapiens
LSISHSEVE

SEQ ID NO: 735261 - protein, 9 aa, Homo Sapiens
SSPGSSAFS

SEQ ID NO: 735262 - protein, 9 aa, Homo Sapiens
YSPQDAQEF

SEQ ID NO: 735263 - protein, 9 aa, Homo Sapiens
NMILQAPDF

SEQ ID NO: 735264 - protein, 9 aa, Homo Sapiens
IVNDARDKT

SEQ ID NO: 735265 - protein, 9 aa, Homo Sapiens
SHGLRAEVS

SEQ ID NO: 735266 - protein, 9 aa, Homo Sapiens
IQPVLFAMF

SEQ ID NO: 735267 - protein, 9 aa, Homo Sapiens
RQPQASYYK

SEQ ID NO: 735268 - protein, 9 aa, Homo Sapiens
QSSQADRDR

SEQ ID NO: 735269 - protein, 9 aa, Homo Sapiens
EQWRGGDGI

SEQ ID NO: 735270 - protein, 9 aa, Homo Sapiens
NCLRLQLYQ

SEQ ID NO: 735271 - protein, 9 aa, Homo Sapiens
TLALFYTVI

SEQ ID NO: 735272 - protein, 9 aa, Homo Sapiens
ADENGWHEI

SEQ ID NO: 735273 - protein, 9 aa, Homo Sapiens
QCIIQPVLF

SEQ ID NO: 735274 - protein, 9 aa, Homo Sapiens
ASQPSVPQR

SEQ ID NO: 735275 - protein, 9 aa, Homo Sapiens
SEHGAQHHL

SEQ ID NO: 735276 - protein, 9 aa, Homo Sapiens
QEDESEVHF

SEQ ID NO: 735277 - protein, 9 aa, Homo Sapiens
LRRGQQPAN

SEQ ID NO: 735278 - protein, 9 aa, Homo Sapiens
GPPETGKTA

SEQ ID NO: 735279 - protein, 9 aa, Homo Sapiens
KVDAYVMVL

SEQ ID NO: 735280 - protein, 9 aa, Homo Sapiens
LPGIDMNVK

SEQ ID NO: 735281 - protein, 9 aa, Homo Sapiens
STEEVCSLR

SEQ ID NO: 735282 - protein, 9 aa, Homo Sapiens
GVLSLTAAS

SEQ ID NO: 735283 - protein, 9 aa, Homo Sapiens
GLGFFMVKE

SEQ ID NO: 735284 - protein, 9 aa, Homo Sapiens
GPADFGWMP

SEQ ID NO: 735285 - protein, 9 aa, Homo Sapiens
NDPKYVGLV

SEQ ID NO: 735286 - protein, 9 aa, Homo Sapiens
WHEIHQACQ

SEQ ID NO: 735287 - protein, 9 aa, Homo Sapiens
VKTPPEEKL

SEQ ID NO: 735288 - protein, 9 aa, Homo Sapiens
VEQTSLLED

SEQ ID NO: 735289 - protein, 9 aa, Homo Sapiens
HPREAPGPS

SEQ ID NO: 735290 - protein, 9 aa, Homo Sapiens
AFDRTIYNV

SEQ ID NO: 735291 - protein, 9 aa, Homo Sapiens
AYEYVVHRP

SEQ ID NO: 735292 - protein, 9 aa, Homo Sapiens
YQSYEELGG

SEQ ID NO: 735293 - protein, 9 aa, Homo Sapiens
ASSGTRTPV

SEQ ID NO: 735294 - protein, 9 aa, Homo Sapiens
GLVLSAMIN

SEQ ID NO: 735295 - protein, 9 aa, Homo Sapiens
PVKRMAIES

SEQ ID NO: 735296 - protein, 9 aa, Homo Sapiens
PAAALAMLG

SEQ ID NO: 735297 - protein, 9 aa, Homo Sapiens
GSPVAPTAA

SEQ ID NO: 735298 - protein, 9 aa, Homo Sapiens
HDGIKLDRE

SEQ ID NO: 735299 - protein, 9 aa, Homo Sapiens
TSPTHEDEE

SEQ ID NO: 735300 - protein, 9 aa, Homo Sapiens
ALFETLTQL

SEQ ID NO: 735301 - protein, 9 aa, Homo Sapiens
LPRPVISMH

SEQ ID NO: 735302 - protein, 9 aa, Homo Sapiens
TLLSQAVQQ

SEQ ID NO: 735303 - protein, 9 aa, Homo Sapiens
ASPQQEPEE

SEQ ID NO: 735304 - protein, 9 aa, Homo Sapiens
QLWAPPVAQ

SEQ ID NO: 735305 - protein, 9 aa, Homo Sapiens
AKKETLESK

SEQ ID NO: 735306 - protein, 9 aa, Homo Sapiens
LAGRCHDRW

SEQ ID NO: 735307 - protein, 9 aa, Homo Sapiens
LSMYCVNQA

SEQ ID NO: 735308 - protein, 9 aa, Homo Sapiens
RKTFSHPSS

SEQ ID NO: 735309 - protein, 9 aa, Homo Sapiens
TGAHEIEVG

SEQ ID NO: 735310 - protein, 9 aa, Homo Sapiens
QPPRCNWLL

SEQ ID NO: 735311 - protein, 9 aa, Homo Sapiens
GFPGVPGMP

SEQ ID NO: 735312 - protein, 9 aa, Homo Sapiens
YGFGCGYGC

SEQ ID NO: 735313 - protein, 9 aa, Homo Sapiens
PQQEPEELL

SEQ ID NO: 735314 - protein, 9 aa, Homo Sapiens
GGAGGLDSW

SEQ ID NO: 735315 - protein, 9 aa, Homo Sapiens
LRFLEKNKD

SEQ ID NO: 735316 - protein, 9 aa, Homo Sapiens
GIRTVPIQP

SEQ ID NO: 735317 - protein, 9 aa, Homo Sapiens
DAMSAAFQA

SEQ ID NO: 735318 - protein, 9 aa, Homo Sapiens
IGKNIGAQS

SEQ ID NO: 735319 - protein, 9 aa, Homo Sapiens
RELLGTTQF

SEQ ID NO: 735320 - protein, 9 aa, Homo Sapiens
TGVINITSV

SEQ ID NO: 735321 - protein, 9 aa, Homo Sapiens
TAAALLYGT

SEQ ID NO: 735322 - protein, 9 aa, Homo Sapiens
RLRFLEKNK

SEQ ID NO: 735323 - protein, 9 aa, Homo Sapiens
LYLLQNGSA

SEQ ID NO: 735324 - protein, 9 aa, Homo Sapiens
PFWALHSVM

SEQ ID NO: 735325 - protein, 9 aa, Homo Sapiens
AAEEKKEEP

SEQ ID NO: 735326 - protein, 9 aa, Homo Sapiens
PEVPDCGHP

SEQ ID NO: 735327 - protein, 9 aa, Homo Sapiens
IEMAKAPSS

SEQ ID NO: 735328 - protein, 9 aa, Homo Sapiens
EDFQNMILQ

SEQ ID NO: 735329 - protein, 9 aa, Homo Sapiens
VGSQNKEEV

SEQ ID NO: 735330 - protein, 9 aa, Homo Sapiens
EFQENTQHL

SEQ ID NO: 735331 - protein, 9 aa, Homo Sapiens
RCHDRWFDK

SEQ ID NO: 735332 - protein, 9 aa, Homo Sapiens
RMRRFFSRR

SEQ ID NO: 735333 - protein, 9 aa, Homo Sapiens
VPEEERNIQ

SEQ ID NO: 735334 - protein, 9 aa, Homo Sapiens
IKELASCYP

SEQ ID NO: 735335 - protein, 9 aa, Homo Sapiens
HFHLDVFFE

SEQ ID NO: 735336 - protein, 9 aa, Homo Sapiens
LSLQAYASL

SEQ ID NO: 735337 - protein, 9 aa, Homo Sapiens
EVVGLPPKR

SEQ ID NO: 735338 - protein, 9 aa, Homo Sapiens
SISHSEVEQ

SEQ ID NO: 735339 - protein, 9 aa, Homo Sapiens
SQWMKGPRS

SEQ ID NO: 735340 - protein, 9 aa, Homo Sapiens
PFLKELDFR

SEQ ID NO: 735341 - protein, 9 aa, Homo Sapiens
GHLRGPADF

SEQ ID NO: 735342 - protein, 9 aa, Homo Sapiens
LQVRKRKYF

SEQ ID NO: 735343 - protein, 9 aa, Homo Sapiens
KSIKAMWRV

SEQ ID NO: 735344 - protein, 9 aa, Homo Sapiens
HATPLAVTS

SEQ ID NO: 735345 - protein, 9 aa, Homo Sapiens
TPAGHEDQP

SEQ ID NO: 735346 - protein, 9 aa, Homo Sapiens
ARWRWVVKV

SEQ ID NO: 735347 - protein, 9 aa, Homo Sapiens
QHSNLINHG

SEQ ID NO: 735348 - protein, 9 aa, Homo Sapiens
FFRHIMTHT

SEQ ID NO: 735349 - protein, 9 aa, Homo Sapiens
HGQAPCSSS

SEQ ID NO: 735350 - protein, 9 aa, Homo Sapiens
ALLAGRCHD

SEQ ID NO: 735351 - protein, 9 aa, Homo Sapiens
KKCIWGPSG

SEQ ID NO: 735352 - protein, 9 aa, Homo Sapiens
GGDPGDAED

SEQ ID NO: 735353 - protein, 9 aa, Homo Sapiens
CKLDGLIHP

SEQ ID NO: 735354 - protein, 9 aa, Homo Sapiens
ENQVNRIVN

SEQ ID NO: 735355 - protein, 9 aa, Homo Sapiens
PFVLYLLQN

SEQ ID NO: 735356 - protein, 9 aa, Homo Sapiens
GGAPAEPAG

SEQ ID NO: 735357 - protein, 9 aa, Homo Sapiens
WRWVVKVKP

SEQ ID NO: 735358 - protein, 9 aa, Homo Sapiens
FSLMQAELH

SEQ ID NO: 735359 - protein, 9 aa, Homo Sapiens
AGVYEERSE

SEQ ID NO: 735360 - protein, 9 aa, Homo Sapiens
IKIFSMSAN

SEQ ID NO: 735361 - protein, 9 aa, Homo Sapiens
HEDQPLTPT

SEQ ID NO: 735362 - protein, 9 aa, Homo Sapiens
GRRIWCTTP

SEQ ID NO: 735363 - protein, 9 aa, Homo Sapiens
LLAVMDYDR

SEQ ID NO: 735364 - protein, 9 aa, Homo Sapiens
SVPQRATGD

SEQ ID NO: 735365 - protein, 9 aa, Homo Sapiens
EGSGWLDDL

SEQ ID NO: 735366 - protein, 9 aa, Homo Sapiens
PRCNWLLGH

SEQ ID NO: 735367 - protein, 9 aa, Homo Sapiens
LFFVHCLIM

SEQ ID NO: 735368 - protein, 9 aa, Homo Sapiens
RTDLCRSAL

SEQ ID NO: 735369 - protein, 9 aa, Homo Sapiens
PAYEYVVHR

SEQ ID NO: 735370 - protein, 9 aa, Homo Sapiens
KVRLRFLEK

SEQ ID NO: 735371 - protein, 9 aa, Homo Sapiens
GGGQRWILV

SEQ ID NO: 735372 - protein, 9 aa, Homo Sapiens
TQEDESEVH

SEQ ID NO: 735373 - protein, 9 aa, Homo Sapiens
NRSMLSSPA

SEQ ID NO: 735374 - protein, 9 aa, Homo Sapiens
QQREKEWEE

SEQ ID NO: 735375 - protein, 9 aa, Homo Sapiens
SGPAGSRRP

SEQ ID NO: 735376 - protein, 9 aa, Homo Sapiens
NKCVSPQEA

SEQ ID NO: 735377 - protein, 9 aa, Homo Sapiens
EDEPEEQSG

SEQ ID NO: 735378 - protein, 9 aa, Homo Sapiens
QAPVFDVFQ

SEQ ID NO: 735379 - protein, 9 aa, Homo Sapiens
LHERYENCG

SEQ ID NO: 735380 - protein, 9 aa, Homo Sapiens
HMHPHSLLN

SEQ ID NO: 735381 - protein, 9 aa, Homo Sapiens
ISMHAQAAV

SEQ ID NO: 735382 - protein, 9 aa, Homo Sapiens
QGSRGDPGY

SEQ ID NO: 735383 - protein, 9 aa, Homo Sapiens
CEIPHHMKP

SEQ ID NO: 735384 - protein, 9 aa, Homo Sapiens
VQAFHIWLN

SEQ ID NO: 735385 - protein, 9 aa, Homo Sapiens
TTPLTTTRD

SEQ ID NO: 735386 - protein, 9 aa, Homo Sapiens
QQLRQATQV

SEQ ID NO: 735387 - protein, 9 aa, Homo Sapiens
VPDCGHPHQ

SEQ ID NO: 735388 - protein, 9 aa, Homo Sapiens
NNRSMLSSP

SEQ ID NO: 735389 - protein, 9 aa, Homo Sapiens
IHPFITLLA

SEQ ID NO: 735390 - protein, 9 aa, Homo Sapiens
ASNKTLALF

SEQ ID NO: 735391 - protein, 9 aa, Homo Sapiens
VTQLVTSHG

SEQ ID NO: 735392 - protein, 9 aa, Homo Sapiens
ALCLSLQAY

SEQ ID NO: 735393 - protein, 9 aa, Homo Sapiens
NLLLSRDNE

SEQ ID NO: 735394 - protein, 9 aa, Homo Sapiens
KKPLKATIS

SEQ ID NO: 735395 - protein, 9 aa, Homo Sapiens
PAKAPPGHE

SEQ ID NO: 735396 - protein, 9 aa, Homo Sapiens
QATPRPFLV

SEQ ID NO: 735397 - protein, 9 aa, Homo Sapiens
KGHLPDYTS

SEQ ID NO: 735398 - protein, 9 aa, Homo Sapiens
MDKIEKIDY

SEQ ID NO: 735399 - protein, 9 aa, Homo Sapiens
RLDLTGSSP

SEQ ID NO: 735400 - protein, 9 aa, Homo Sapiens
RYIETGAFI

SEQ ID NO: 735401 - protein, 9 aa, Homo Sapiens
INQGHEDEM

SEQ ID NO: 735402 - protein, 9 aa, Homo Sapiens
KWAILSDPN

SEQ ID NO: 735403 - protein, 9 aa, Homo Sapiens
VRRVFGRMR

SEQ ID NO: 735404 - protein, 9 aa, Homo Sapiens
MGGAPAEPA

SEQ ID NO: 735405 - protein, 9 aa, Homo Sapiens
VRELGQKRF

SEQ ID NO: 735406 - protein, 9 aa, Homo Sapiens
RGGAGGLDS

SEQ ID NO: 735407 - protein, 9 aa, Homo Sapiens
QVNRIVNDA

SEQ ID NO: 735408 - protein, 9 aa, Homo Sapiens
SRRPRICPH

SEQ ID NO: 735409 - protein, 9 aa, Homo Sapiens
VERRELGFF

SEQ ID NO: 735410 - protein, 9 aa, Homo Sapiens
QPEAQSSQA

SEQ ID NO: 735411 - protein, 9 aa, Homo Sapiens
LALFYTVIT

SEQ ID NO: 735412 - protein, 9 aa, Homo Sapiens
RHQRARDPV

SEQ ID NO: 735413 - protein, 9 aa, Homo Sapiens
SLQYPSTQA

SEQ ID NO: 735414 - protein, 9 aa, Homo Sapiens
PGSSRRRDS

SEQ ID NO: 735415 - protein, 9 aa, Homo Sapiens
GFFQPSGVT

SEQ ID NO: 735416 - protein, 9 aa, Homo Sapiens
GRCHDRWFD

SEQ ID NO: 735417 - protein, 9 aa, Homo Sapiens
PADFGWMPQ

SEQ ID NO: 735418 - protein, 9 aa, Homo Sapiens
ANPPKAEKE

SEQ ID NO: 735419 - protein, 9 aa, Homo Sapiens
AQELQMEKV

SEQ ID NO: 735420 - protein, 9 aa, Homo Sapiens
VIRILSVLI

SEQ ID NO: 735421 - protein, 9 aa, Homo Sapiens
DGAVGFADF

SEQ ID NO: 735422 - protein, 9 aa, Homo Sapiens
AVTSLSSVS

SEQ ID NO: 735423 - protein, 9 aa, Homo Sapiens
FLDICIHSS

SEQ ID NO: 735424 - protein, 9 aa, Homo Sapiens
WSIVPEEER

SEQ ID NO: 735425 - protein, 9 aa, Homo Sapiens
CCASAAAAT

SEQ ID NO: 735426 - protein, 9 aa, Homo Sapiens
PVLWLACRA

SEQ ID NO: 735427 - protein, 9 aa, Homo Sapiens
QHSPDTYIQ

SEQ ID NO: 735428 - protein, 9 aa, Homo Sapiens
RPDLVFEAE

SEQ ID NO: 735429 - protein, 9 aa, Homo Sapiens
QAQASPQQE

SEQ ID NO: 735430 - protein, 9 aa, Homo Sapiens
VGGGQRWIL

SEQ ID NO: 735431 - protein, 9 aa, Homo Sapiens
GDPGYAGPR

SEQ ID NO: 735432 - protein, 9 aa, Homo Sapiens
PPQENTRAQ

SEQ ID NO: 735433 - protein, 9 aa, Homo Sapiens
TSSSSSRES

SEQ ID NO: 735434 - protein, 9 aa, Homo Sapiens
HSNLINHGK

SEQ ID NO: 735435 - protein, 9 aa, Homo Sapiens
KECLRIAEH

SEQ ID NO: 735436 - protein, 9 aa, Homo Sapiens
VDNFGNRTL

SEQ ID NO: 735437 - protein, 9 aa, Homo Sapiens
DPGDAEDLA

SEQ ID NO: 735438 - protein, 9 aa, Homo Sapiens
GQQPANLRE

SEQ ID NO: 735439 - protein, 9 aa, Homo Sapiens
TFEFLGINL

SEQ ID NO: 735440 - protein, 9 aa, Homo Sapiens
RPVISMHAQ

SEQ ID NO: 735441 - protein, 9 aa, Homo Sapiens
PRELFPPLV

SEQ ID NO: 735442 - protein, 9 aa, Homo Sapiens
RKWYNLIIQ

SEQ ID NO: 735443 - protein, 9 aa, Homo Sapiens
DRTIYNVRL

SEQ ID NO: 735444 - protein, 9 aa, Homo Sapiens
AGKSPCPRL

SEQ ID NO: 735445 - protein, 9 aa, Homo Sapiens
NSIECFKRQ

SEQ ID NO: 735446 - protein, 9 aa, Homo Sapiens
PRTGVINIT

SEQ ID NO: 735447 - protein, 9 aa, Homo Sapiens
STYPEPVYP

SEQ ID NO: 735448 - protein, 9 aa, Homo Sapiens
KQAKKKCIW

SEQ ID NO: 735449 - protein, 9 aa, Homo Sapiens
PPWERPTAA

SEQ ID NO: 735450 - protein, 9 aa, Homo Sapiens
RPLLYYSSL

SEQ ID NO: 735451 - protein, 9 aa, Homo Sapiens
EVSCRHNPI

SEQ ID NO: 735452 - protein, 9 aa, Homo Sapiens
QGRIPVKRM

SEQ ID NO: 735453 - protein, 9 aa, Homo Sapiens
LFYTVITPL

SEQ ID NO: 735454 - protein, 9 aa, Homo Sapiens
LLSRDNELY

SEQ ID NO: 735455 - protein, 9 aa, Homo Sapiens
EAPREPAGW

SEQ ID NO: 735456 - protein, 9 aa, Homo Sapiens
GKTTTVVQI

SEQ ID NO: 735457 - protein, 9 aa, Homo Sapiens
DVNCLPEPI

SEQ ID NO: 735458 - protein, 9 aa, Homo Sapiens
YLVYQQWTE

SEQ ID NO: 735459 - protein, 9 aa, Homo Sapiens
QTCTPSLTS

SEQ ID NO: 735460 - protein, 9 aa, Homo Sapiens
KGCVVPLKR

SEQ ID NO: 735461 - protein, 9 aa, Homo Sapiens
VLLAGPPET

SEQ ID NO: 735462 - protein, 9 aa, Homo Sapiens
GHSLQYPST

SEQ ID NO: 735463 - protein, 9 aa, Homo Sapiens
IDMNVKDNA

SEQ ID NO: 735464 - protein, 9 aa, Homo Sapiens
KKAPSVQGQ

SEQ ID NO: 735465 - protein, 9 aa, Homo Sapiens
HALLAGRCH

SEQ ID NO: 735466 - protein, 9 aa, Homo Sapiens
PRYHVRREH

SEQ ID NO: 735467 - protein, 9 aa, Homo Sapiens
SFTDFCYSS

SEQ ID NO: 735468 - protein, 9 aa, Homo Sapiens
FTHCHTANI

SEQ ID NO: 735469 - protein, 9 aa, Homo Sapiens
LSLTAASTA

SEQ ID NO: 735470 - protein, 9 aa, Homo Sapiens
CPKGRARFD

SEQ ID NO: 735471 - protein, 9 aa, Homo Sapiens
GPLFEELRP

SEQ ID NO: 735472 - protein, 9 aa, Homo Sapiens
SVFFRHIMT

SEQ ID NO: 735473 - protein, 9 aa, Homo Sapiens
AKDFHGQIG

SEQ ID NO: 735474 - protein, 9 aa, Homo Sapiens
ACDLAPCAG

SEQ ID NO: 735475 - protein, 9 aa, Homo Sapiens
TGSPVAPTA

SEQ ID NO: 735476 - protein, 9 aa, Homo Sapiens
TTVFQQMYA

SEQ ID NO: 735477 - protein, 9 aa, Homo Sapiens
LAIYYSFDG

SEQ ID NO: 735478 - protein, 9 aa, Homo Sapiens
VLSVQTPHL

SEQ ID NO: 735479 - protein, 9 aa, Homo Sapiens
LQYPSTQAH

SEQ ID NO: 735480 - protein, 9 aa, Homo Sapiens
EHLAMVEAV

SEQ ID NO: 735481 - protein, 9 aa, Homo Sapiens
VLYLLQNGS

SEQ ID NO: 735482 - protein, 9 aa, Homo Sapiens
ILRIQDKPE

SEQ ID NO: 735483 - protein, 9 aa, Homo Sapiens
QKHLDAHSE

SEQ ID NO: 735484 - protein, 9 aa, Homo Sapiens
LYNLSFTDF

SEQ ID NO: 735485 - protein, 9 aa, Homo Sapiens
LGFLLAALG

SEQ ID NO: 735486 - protein, 9 aa, Homo Sapiens
RRKISKGCV

SEQ ID NO: 735487 - protein, 9 aa, Homo Sapiens
CQHMHPHSL

SEQ ID NO: 735488 - protein, 9 aa, Homo Sapiens
CDLAPCAGT

SEQ ID NO: 735489 - protein, 9 aa, Homo Sapiens
NLQVRKRKY

SEQ ID NO: 735490 - protein, 9 aa, Homo Sapiens
DDGMNFTHC

SEQ ID NO: 735491 - protein, 9 aa, Homo Sapiens
ALAFEKGSL

SEQ ID NO: 735492 - protein, 9 aa, Homo Sapiens
SSSGVTPVQ

SEQ ID NO: 735493 - protein, 9 aa, Homo Sapiens
AIGKNIGAQ

SEQ ID NO: 735494 - protein, 9 aa, Homo Sapiens
QAPDFLSTF

SEQ ID NO: 735495 - protein, 9 aa, Homo Sapiens
AFEPLLSFA

SEQ ID NO: 735496 - protein, 9 aa, Homo Sapiens
SSSSSNSGR

SEQ ID NO: 735497 - protein, 9 aa, Homo Sapiens
PEPVYPTLP

SEQ ID NO: 735498 - protein, 9 aa, Homo Sapiens
GLPNGLDGL

SEQ ID NO: 735499 - protein, 9 aa, Homo Sapiens
KVSKPDLPE

SEQ ID NO: 735500 - protein, 9 aa, Homo Sapiens
NRQYMRRLV

SEQ ID NO: 735501 - protein, 9 aa, Homo Sapiens
FFQPSGVTD

SEQ ID NO: 735502 - protein, 9 aa, Homo Sapiens
SFKINEIYS

SEQ ID NO: 735503 - protein, 9 aa, Homo Sapiens
SNLINHGKI

SEQ ID NO: 735504 - protein, 9 aa, Homo Sapiens
AEDLAAKRL

SEQ ID NO: 735505 - protein, 9 aa, Homo Sapiens
LADVCFGFL

SEQ ID NO: 735506 - protein, 9 aa, Homo Sapiens
YIETGAFIN

SEQ ID NO: 735507 - protein, 9 aa, Homo Sapiens
GYHQHSPDT

SEQ ID NO: 735508 - protein, 9 aa, Homo Sapiens
TEEVCSLRP

SEQ ID NO: 735509 - protein, 9 aa, Homo Sapiens
PCAGTTDAA

SEQ ID NO: 735510 - protein, 9 aa, Homo Sapiens
HSLLNPQPF

SEQ ID NO: 735511 - protein, 9 aa, Homo Sapiens
DELHGQAPC

SEQ ID NO: 735512 - protein, 9 aa, Homo Sapiens
LSASQIWNL

SEQ ID NO: 735513 - protein, 9 aa, Homo Sapiens
IQDKPEEQW

SEQ ID NO: 735514 - protein, 9 aa, Homo Sapiens
DKTGAHEIE

SEQ ID NO: 735515 - protein, 9 aa, Homo Sapiens
FSTHTLLGR

SEQ ID NO: 735516 - protein, 9 aa, Homo Sapiens
LDVFFEEEF

SEQ ID NO: 735517 - protein, 9 aa, Homo Sapiens
QVKSGTVLS

SEQ ID NO: 735518 - protein, 9 aa, Homo Sapiens
QQDVKVSKD

SEQ ID NO: 735519 - protein, 9 aa, Homo Sapiens
RGPADFGWM

SEQ ID NO: 735520 - protein, 9 aa, Homo Sapiens
VVGVKERIN

SEQ ID NO: 735521 - protein, 9 aa, Homo Sapiens
SEGLGIVTK

SEQ ID NO: 735522 - protein, 9 aa, Homo Sapiens
VQQLRQATQ

SEQ ID NO: 735523 - protein, 9 aa, Homo Sapiens
NSRKEGVLL

SEQ ID NO: 735524 - protein, 9 aa, Homo Sapiens
EGQDGHVPE

SEQ ID NO: 735525 - protein, 9 aa, Homo Sapiens
QCMTERKRS

SEQ ID NO: 735526 - protein, 9 aa, Homo Sapiens
AAESTEEVC

SEQ ID NO: 735527 - protein, 9 aa, Homo Sapiens
VFGRMRRFF

SEQ ID NO: 735528 - protein, 9 aa, Homo Sapiens
GRLIHLAMR

SEQ ID NO: 735529 - protein, 9 aa, Homo Sapiens
EPAAALAML

SEQ ID NO: 735530 - protein, 9 aa, Homo Sapiens
LLPGPLPAS

SEQ ID NO: 735531 - protein, 9 aa, Homo Sapiens
RPPGTLLSV

SEQ ID NO: 735532 - protein, 9 aa, Homo Sapiens
VFDVFQAFL

SEQ ID NO: 735533 - protein, 9 aa, Homo Sapiens
TLLHFFCDL

SEQ ID NO: 735534 - protein, 9 aa, Homo Sapiens
STGKVGFCS

SEQ ID NO: 735535 - protein, 9 aa, Homo Sapiens
GNPGSSRRR

SEQ ID NO: 735536 - protein, 9 aa, Homo Sapiens
LIVHQKTYR

SEQ ID NO: 735537 - protein, 9 aa, Homo Sapiens
VPQRATGDG

SEQ ID NO: 735538 - protein, 9 aa, Homo Sapiens
SSTQEDESE

SEQ ID NO: 735539 - protein, 9 aa, Homo Sapiens
GSERGGAGG

SEQ ID NO: 735540 - protein, 9 aa, Homo Sapiens
KKVGSQNKE

SEQ ID NO: 735541 - protein, 9 aa, Homo Sapiens
LPDQDQSDK

SEQ ID NO: 735542 - protein, 9 aa, Homo Sapiens
VPEMLKKSL

SEQ ID NO: 735543 - protein, 9 aa, Homo Sapiens
VARMHCYLY

SEQ ID NO: 735544 - protein, 9 aa, Homo Sapiens
APPVAQGGS

SEQ ID NO: 735545 - protein, 9 aa, Homo Sapiens
DVAMKVLKQ

SEQ ID NO: 735546 - protein, 9 aa, Homo Sapiens
QDQSDKAQE

SEQ ID NO: 735547 - protein, 9 aa, Homo Sapiens
REKEWEELY

SEQ ID NO: 735548 - protein, 9 aa, Homo Sapiens
LKPSSEGLG

SEQ ID NO: 735549 - protein, 9 aa, Homo Sapiens
MYLNALVDS

SEQ ID NO: 735550 - protein, 9 aa, Homo Sapiens
YLEDETLDR

SEQ ID NO: 735551 - protein, 9 aa, Homo Sapiens
DLSISHSEV

SEQ ID NO: 735552 - protein, 9 aa, Homo Sapiens
MASNNHWFH

SEQ ID NO: 735553 - protein, 9 aa, Homo Sapiens
IQVKSGTVL

SEQ ID NO: 735554 - protein, 9 aa, Homo Sapiens
TNQVNAIKW

SEQ ID NO: 735555 - protein, 9 aa, Homo Sapiens
KDALFETLT

SEQ ID NO: 735556 - protein, 9 aa, Homo Sapiens
LQAPDFLST

SEQ ID NO: 735557 - protein, 9 aa, Homo Sapiens
KAMPLVEQT

SEQ ID NO: 735558 - protein, 9 aa, Homo Sapiens
ADFLVCCPH

SEQ ID NO: 735559 - protein, 9 aa, Homo Sapiens
IAMEFNYLQ

SEQ ID NO: 735560 - protein, 9 aa, Homo Sapiens
LEDDPVVNR

SEQ ID NO: 735561 - protein, 9 aa, Homo Sapiens
HPHSLLNPQ

SEQ ID NO: 735562 - protein, 9 aa, Homo Sapiens
LLNALRFTA

SEQ ID NO: 735563 - protein, 9 aa, Homo Sapiens
FSTAVYSTT

SEQ ID NO: 735564 - protein, 9 aa, Homo Sapiens
GPPTSYPNL

SEQ ID NO: 735565 - protein, 9 aa, Homo Sapiens
ATPRPFLVR

SEQ ID NO: 735566 - protein, 9 aa, Homo Sapiens
DFLKYMDDI

SEQ ID NO: 735567 - protein, 9 aa, Homo Sapiens
VVPLKRPRL

SEQ ID NO: 735568 - protein, 9 aa, Homo Sapiens
SPDTYIQYF

SEQ ID NO: 735569 - protein, 9 aa, Homo Sapiens
FTDLHLHYQ

SEQ ID NO: 735570 - protein, 9 aa, Homo Sapiens
AAVYAGYAP

SEQ ID NO: 735571 - protein, 9 aa, Homo Sapiens
AMSAAFQAG

SEQ ID NO: 735572 - protein, 9 aa, Homo Sapiens
PLLYYSSLI

SEQ ID NO: 735573 - protein, 9 aa, Homo Sapiens
LSFHGGLNG

SEQ ID NO: 735574 - protein, 9 aa, Homo Sapiens
LYIRGLCEF

SEQ ID NO: 735575 - protein, 9 aa, Homo Sapiens
SKGCVVPLK

SEQ ID NO: 735576 - protein, 9 aa, Homo Sapiens
NQVNRIVND

SEQ ID NO: 735577 - protein, 9 aa, Homo Sapiens
YGHVLAVSD

SEQ ID NO: 735578 - protein, 9 aa, Homo Sapiens
SITCKLQKM

SEQ ID NO: 735579 - protein, 9 aa, Homo Sapiens
LWAPPVAQG

SEQ ID NO: 735580 - protein, 9 aa, Homo Sapiens
GAPAEPAGT

SEQ ID NO: 735581 - protein, 9 aa, Homo Sapiens
LSLPGIDMN

SEQ ID NO: 735582 - protein, 9 aa, Homo Sapiens
YVGLVLSAM

SEQ ID NO: 735583 - protein, 9 aa, Homo Sapiens
AQVEVKQHA

SEQ ID NO: 735584 - protein, 9 aa, Homo Sapiens
PDLVFEAED

SEQ ID NO: 735585 - protein, 9 aa, Homo Sapiens
PGLAAGPGS

SEQ ID NO: 735586 - protein, 9 aa, Homo Sapiens
SLRRPGCRF

SEQ ID NO: 735587 - protein, 9 aa, Homo Sapiens
APRAPPREQ

SEQ ID NO: 735588 - protein, 9 aa, Homo Sapiens
TGKTTTVVQ

SEQ ID NO: 735589 - protein, 9 aa, Homo Sapiens
LQAQASPQQ

SEQ ID NO: 735590 - protein, 9 aa, Homo Sapiens
SILVELCLW

SEQ ID NO: 735591 - protein, 9 aa, Homo Sapiens
LQRTSHPPW

SEQ ID NO: 735592 - protein, 9 aa, Homo Sapiens
VNDARDKTG

SEQ ID NO: 735593 - protein, 9 aa, Homo Sapiens
KEFQENTQH

SEQ ID NO: 735594 - protein, 9 aa, Homo Sapiens
PTPAGHEDQ

SEQ ID NO: 735595 - protein, 9 aa, Homo Sapiens
RFTAKHLND

SEQ ID NO: 735596 - protein, 9 aa, Homo Sapiens
TEQPEAQSS

SEQ ID NO: 735597 - protein, 9 aa, Homo Sapiens
QPANLREGV

SEQ ID NO: 735598 - protein, 9 aa, Homo Sapiens
RKRSRLKPL

SEQ ID NO: 735599 - protein, 9 aa, Homo Sapiens
RVFGRMRRF

SEQ ID NO: 735600 - protein, 9 aa, Homo Sapiens
SPTVLGFLL

SEQ ID NO: 735601 - protein, 9 aa, Homo Sapiens
ANRKVRLRF

SEQ ID NO: 735602 - protein, 9 aa, Homo Sapiens
SRGDPGYAG

SEQ ID NO: 735603 - protein, 9 aa, Homo Sapiens
NTDGLFHCS

SEQ ID NO: 735604 - protein, 9 aa, Homo Sapiens
STTVNVYGH

SEQ ID NO: 735605 - protein, 9 aa, Homo Sapiens
DSTSVELVR

SEQ ID NO: 735606 - protein, 9 aa, Homo Sapiens
AEPAGTGKT

SEQ ID NO: 735607 - protein, 9 aa, Homo Sapiens
DSACKVQIS

SEQ ID NO: 735608 - protein, 9 aa, Homo Sapiens
HGGLLALVL

SEQ ID NO: 735609 - protein, 9 aa, Homo Sapiens
REAPGPSRD

SEQ ID NO: 735610 - protein, 9 aa, Homo Sapiens
QGHEDEMEI

SEQ ID NO: 735611 - protein, 9 aa, Homo Sapiens
RIYTKPKGH

SEQ ID NO: 735612 - protein, 9 aa, Homo Sapiens
NCLPEPIGV

SEQ ID NO: 735613 - protein, 9 aa, Homo Sapiens
CLRLQLYQG

SEQ ID NO: 735614 - protein, 9 aa, Homo Sapiens
GFCSILFIY

SEQ ID NO: 735615 - protein, 9 aa, Homo Sapiens
MGAQGAQKS

SEQ ID NO: 735616 - protein, 9 aa, Homo Sapiens
DALFETLTQ

SEQ ID NO: 735617 - protein, 9 aa, Homo Sapiens
ELAQVEVKQ

SEQ ID NO: 735618 - protein, 9 aa, Homo Sapiens
ELPAPEAVS

SEQ ID NO: 735619 - protein, 9 aa, Homo Sapiens
PRSLPPPAP

SEQ ID NO: 735620 - protein, 9 aa, Homo Sapiens
RIVNDARDK

SEQ ID NO: 735621 - protein, 9 aa, Homo Sapiens
GPAGSRRPR

SEQ ID NO: 735622 - protein, 9 aa, Homo Sapiens
EDVCISIPK

SEQ ID NO: 735623 - protein, 9 aa, Homo Sapiens
LMDVLDTDG

SEQ ID NO: 735624 - protein, 9 aa, Homo Sapiens
SKHQIIHLG

SEQ ID NO: 735625 - protein, 9 aa, Homo Sapiens
RVRPPGTLL

SEQ ID NO: 735626 - protein, 9 aa, Homo Sapiens
DGELIRGLQ

SEQ ID NO: 735627 - protein, 9 aa, Homo Sapiens
HIMTHTAGK

SEQ ID NO: 735628 - protein, 9 aa, Homo Sapiens
FVVLMAHGS

SEQ ID NO: 735629 - protein, 9 aa, Homo Sapiens
GFRLRPLAG

SEQ ID NO: 735630 - protein, 9 aa, Homo Sapiens
APGPSRDSE

SEQ ID NO: 735631 - protein, 9 aa, Homo Sapiens
LDFRLNPVV

SEQ ID NO: 735632 - protein, 9 aa, Homo Sapiens
ELASCYPVV

SEQ ID NO: 735633 - protein, 9 aa, Homo Sapiens
EIPHHMKPL

SEQ ID NO: 735634 - protein, 9 aa, Homo Sapiens
TVCAPCPNH

SEQ ID NO: 735635 - protein, 9 aa, Homo Sapiens
LVELCLWLH

SEQ ID NO: 735636 - protein, 9 aa, Homo Sapiens
SQIWNLNPV

SEQ ID NO: 735637 - protein, 9 aa, Homo Sapiens
GSLLFNIGA

SEQ ID NO: 735638 - protein, 9 aa, Homo Sapiens
PQDDSSGTC

SEQ ID NO: 735639 - protein, 9 aa, Homo Sapiens
KTINQGHED

SEQ ID NO: 735640 - protein, 9 aa, Homo Sapiens
VLDTDGDKW

SEQ ID NO: 735641 - protein, 9 aa, Homo Sapiens
VNCLPEPIG

SEQ ID NO: 735642 - protein, 9 aa, Homo Sapiens
SFRSRPAPS

SEQ ID NO: 735643 - protein, 9 aa, Homo Sapiens
QKTYRRKPY

SEQ ID NO: 735644 - protein, 9 aa, Homo Sapiens
LEEVVGLPP

SEQ ID NO: 735645 - protein, 9 aa, Homo Sapiens
SPQDAQEFL

SEQ ID NO: 735646 - protein, 9 aa, Homo Sapiens
LRRPGCRFK

SEQ ID NO: 735647 - protein, 9 aa, Homo Sapiens
GSTGSPVAP

SEQ ID NO: 735648 - protein, 9 aa, Homo Sapiens
SLNSGRLIH

SEQ ID NO: 735649 - protein, 9 aa, Homo Sapiens
RRVFGRMRR

SEQ ID NO: 735650 - protein, 9 aa, Homo Sapiens
KAEKEQTCP

SEQ ID NO: 735651 - protein, 9 aa, Homo Sapiens
FHSSQVPSF

SEQ ID NO: 735652 - protein, 9 aa, Homo Sapiens
VLSTTVNVY

SEQ ID NO: 735653 - protein, 9 aa, Homo Sapiens
LDLDFLKYM

SEQ ID NO: 735654 - protein, 9 aa, Homo Sapiens
IICETAIGK

SEQ ID NO: 735655 - protein, 9 aa, Homo Sapiens
DGIRELLGT

SEQ ID NO: 735656 - protein, 9 aa, Homo Sapiens
DLQKHLDAH

SEQ ID NO: 735657 - protein, 9 aa, Homo Sapiens
YVVEPVFLG

SEQ ID NO: 735658 - protein, 9 aa, Homo Sapiens
HTNRQYMRR

SEQ ID NO: 735659 - protein, 9 aa, Homo Sapiens
AKEQERLIS

SEQ ID NO: 735660 - protein, 9 aa, Homo Sapiens
LVFEAEDLP

SEQ ID NO: 735661 - protein, 9 aa, Homo Sapiens
RTFMRSLPS

SEQ ID NO: 735662 - protein, 9 aa, Homo Sapiens
FTINPRTGV

SEQ ID NO: 735663 - protein, 9 aa, Homo Sapiens
SAEGQDGHV

SEQ ID NO: 735664 - protein, 9 aa, Homo Sapiens
RDNELYPLS

SEQ ID NO: 735665 - protein, 9 aa, Homo Sapiens
GIDMNVKDN

SEQ ID NO: 735666 - protein, 9 aa, Homo Sapiens
NRKVRLRFL

SEQ ID NO: 735667 - protein, 9 aa, Homo Sapiens
GKIYSGEKP

SEQ ID NO: 735668 - protein, 9 aa, Homo Sapiens
RERSGCALT

SEQ ID NO: 735669 - protein, 9 aa, Homo Sapiens
QELQMEKVQ

SEQ ID NO: 735670 - protein, 9 aa, Homo Sapiens
LADFLVCCP

SEQ ID NO: 735671 - protein, 9 aa, Homo Sapiens
KKGDILRIQ

SEQ ID NO: 735672 - protein, 9 aa, Homo Sapiens
LLRTFMRSL

SEQ ID NO: 735673 - protein, 9 aa, Homo Sapiens
FLLADVCFG

SEQ ID NO: 735674 - protein, 9 aa, Homo Sapiens
SRQPQASYY

SEQ ID NO: 735675 - protein, 9 aa, Homo Sapiens
HFCITFEFL

SEQ ID NO: 735676 - protein, 9 aa, Homo Sapiens
SSNSNSSSN

SEQ ID NO: 735677 - protein, 9 aa, Homo Sapiens
ALCGGYIQV

SEQ ID NO: 735678 - protein, 9 aa, Homo Sapiens
PVFLGFTVQ

SEQ ID NO: 735679 - protein, 9 aa, Homo Sapiens
QRDTDSGVR

SEQ ID NO: 735680 - protein, 9 aa, Homo Sapiens
PNWSIVPEE

SEQ ID NO: 735681 - protein, 9 aa, Homo Sapiens
PKVDAYVMV

SEQ ID NO: 735682 - protein, 9 aa, Homo Sapiens
RCNWLLGHL

SEQ ID NO: 735683 - protein, 9 aa, Homo Sapiens
IIQPVLFAM

SEQ ID NO: 735684 - protein, 9 aa, Homo Sapiens
VPTLELPAP

SEQ ID NO: 735685 - protein, 9 aa, Homo Sapiens
STHTLLGRF

SEQ ID NO: 735686 - protein, 9 aa, Homo Sapiens
ILVELCLWL

SEQ ID NO: 735687 - protein, 9 aa, Homo Sapiens
PKVPTLELP

SEQ ID NO: 735688 - protein, 9 aa, Homo Sapiens
LMQNGECRG

SEQ ID NO: 735689 - protein, 9 aa, Homo Sapiens
EQRKLLFTS

SEQ ID NO: 735690 - protein, 9 aa, Homo Sapiens
EPEEQSGDE

SEQ ID NO: 735691 - protein, 9 aa, Homo Sapiens
AVAAEDQAF

SEQ ID NO: 735692 - protein, 9 aa, Homo Sapiens
SSSSRESLG

SEQ ID NO: 735693 - protein, 9 aa, Homo Sapiens
PYIKIFSMS

SEQ ID NO: 735694 - protein, 9 aa, Homo Sapiens
PLQPSNAQE

SEQ ID NO: 735695 - protein, 9 aa, Homo Sapiens
KDFHGQIGF

SEQ ID NO: 735696 - protein, 9 aa, Homo Sapiens
AAAWTCQQL

SEQ ID NO: 735697 - protein, 9 aa, Homo Sapiens
VFQAFLNTD

SEQ ID NO: 735698 - protein, 9 aa, Homo Sapiens
GLFHCSCEE

SEQ ID NO: 735699 - protein, 9 aa, Homo Sapiens
RLVGCISHF

SEQ ID NO: 735700 - protein, 9 aa, Homo Sapiens
APCPNHYYT

SEQ ID NO: 735701 - protein, 9 aa, Homo Sapiens
ADKNLMNAV

SEQ ID NO: 735702 - protein, 9 aa, Homo Sapiens
FFVHCLIMI

SEQ ID NO: 735703 - protein, 9 aa, Homo Sapiens
FGSKLHRTK

SEQ ID NO: 735704 - protein, 9 aa, Homo Sapiens
NVYGHVLAV

SEQ ID NO: 735705 - protein, 9 aa, Homo Sapiens
RRLQRTSHP

SEQ ID NO: 735706 - protein, 9 aa, Homo Sapiens
EFLALKECL

SEQ ID NO: 735707 - protein, 9 aa, Homo Sapiens
PVAPTAART

SEQ ID NO: 735708 - protein, 9 aa, Homo Sapiens
WAPPVAQGG

SEQ ID NO: 735709 - protein, 9 aa, Homo Sapiens
PREPAGWPA

SEQ ID NO: 735710 - protein, 9 aa, Homo Sapiens
VLDPLVQLT

SEQ ID NO: 735711 - protein, 9 aa, Homo Sapiens
ISYLDPTLH

SEQ ID NO: 735712 - protein, 9 aa, Homo Sapiens
GCVVPLKRP

SEQ ID NO: 735713 - protein, 9 aa, Homo Sapiens
PPGEAEHRN

SEQ ID NO: 735714 - protein, 9 aa, Homo Sapiens
SRLPPQENT

SEQ ID NO: 735715 - protein, 9 aa, Homo Sapiens
VCAPCPNHY

SEQ ID NO: 735716 - protein, 9 aa, Homo Sapiens
VFGQNSALV

SEQ ID NO: 735717 - protein, 9 aa, Homo Sapiens
VCFGFLPSI

SEQ ID NO: 735718 - protein, 9 aa, Homo Sapiens
STQEDESEV

SEQ ID NO: 735719 - protein, 9 aa, Homo Sapiens
APQGIPSSN

SEQ ID NO: 735720 - protein, 9 aa, Homo Sapiens
FFMVKEVGK

SEQ ID NO: 735721 - protein, 9 aa, Homo Sapiens
YRLFSRFHD

SEQ ID NO: 735722 - protein, 9 aa, Homo Sapiens
LVVEEKLIP

SEQ ID NO: 735723 - protein, 9 aa, Homo Sapiens
GTARAEAAA

SEQ ID NO: 735724 - protein, 9 aa, Homo Sapiens
GNCLVLWTV

SEQ ID NO: 735725 - protein, 9 aa, Homo Sapiens
LCSFKINEI

SEQ ID NO: 735726 - protein, 9 aa, Homo Sapiens
DLTGSSPTQ

SEQ ID NO: 735727 - protein, 9 aa, Homo Sapiens
KKPVGRKLK

SEQ ID NO: 735728 - protein, 9 aa, Homo Sapiens
KEQCMTERK

SEQ ID NO: 735729 - protein, 9 aa, Homo Sapiens
LEDPFWALH

SEQ ID NO: 735730 - protein, 9 aa, Homo Sapiens
PPKPRPLLY

SEQ ID NO: 735731 - protein, 9 aa, Homo Sapiens
AAGVYEERS

SEQ ID NO: 735732 - protein, 9 aa, Homo Sapiens
LRIQDKPEE

SEQ ID NO: 735733 - protein, 9 aa, Homo Sapiens
GHLPDYTSP

SEQ ID NO: 735734 - protein, 9 aa, Homo Sapiens
SSSRESLGL

SEQ ID NO: 735735 - protein, 9 aa, Homo Sapiens
IAKEQERLI

SEQ ID NO: 735736 - protein, 9 aa, Homo Sapiens
QPSLCSFKI

SEQ ID NO: 735737 - protein, 9 aa, Homo Sapiens
AIYYSFDGS

SEQ ID NO: 735738 - protein, 9 aa, Homo Sapiens
CVVPLKRPR

SEQ ID NO: 735739 - protein, 9 aa, Homo Sapiens
SGSTGSPVA

SEQ ID NO: 735740 - protein, 9 aa, Homo Sapiens
SGRLIHLAM

SEQ ID NO: 735741 - protein, 9 aa, Homo Sapiens
LGQGEQWRG

SEQ ID NO: 735742 - protein, 9 aa, Homo Sapiens
SSRRRDSHK

SEQ ID NO: 735743 - protein, 9 aa, Homo Sapiens
WGQEKVKSA

SEQ ID NO: 735744 - protein, 9 aa, Homo Sapiens
SNSSSNSSN

SEQ ID NO: 735745 - protein, 9 aa, Homo Sapiens
AQASPQQEP

SEQ ID NO: 735746 - protein, 9 aa, Homo Sapiens
FEKGSLLFN

SEQ ID NO: 735747 - protein, 9 aa, Homo Sapiens
SDKQAKKKC

SEQ ID NO: 735748 - protein, 9 aa, Homo Sapiens
GPLEDPFWA

SEQ ID NO: 735749 - protein, 9 aa, Homo Sapiens
FQAFLNTDN

SEQ ID NO: 735750 - protein, 9 aa, Homo Sapiens
GLCEFTPLY

SEQ ID NO: 735751 - protein, 9 aa, Homo Sapiens
LVWLSMYCV

SEQ ID NO: 735752 - protein, 9 aa, Homo Sapiens
HAQAAVAGP

SEQ ID NO: 735753 - protein, 9 aa, Homo Sapiens
YVKKPLKAT

SEQ ID NO: 735754 - protein, 9 aa, Homo Sapiens
TAACSTRSP

SEQ ID NO: 735755 - protein, 9 aa, Homo Sapiens
CKLQKMEAY

SEQ ID NO: 735756 - protein, 9 aa, Homo Sapiens
AAALAMLGE

SEQ ID NO: 735757 - protein, 9 aa, Homo Sapiens
FLPQDDSSG

SEQ ID NO: 735758 - protein, 9 aa, Homo Sapiens
RRRDSHKGV

SEQ ID NO: 735759 - protein, 9 aa, Homo Sapiens
ESIQVKQLD

SEQ ID NO: 735760 - protein, 9 aa, Homo Sapiens
LFPPLVMAA

SEQ ID NO: 735761 - protein, 9 aa, Homo Sapiens
HCRCSFRSR

SEQ ID NO: 735762 - protein, 9 aa, Homo Sapiens
EPVYPTLPQ

SEQ ID NO: 735763 - protein, 9 aa, Homo Sapiens
ACKVQISPD

SEQ ID NO: 735764 - protein, 9 aa, Homo Sapiens
RLQRTSHPP

SEQ ID NO: 735765 - protein, 9 aa, Homo Sapiens
TPSLAGKSP

SEQ ID NO: 735766 - protein, 9 aa, Homo Sapiens
NYLVDVFEK

SEQ ID NO: 735767 - protein, 9 aa, Homo Sapiens
EGAISEVLV

SEQ ID NO: 735768 - protein, 9 aa, Homo Sapiens
QLYQGFHCG

SEQ ID NO: 735769 - protein, 9 aa, Homo Sapiens
RIWCTTPLT

SEQ ID NO: 735770 - protein, 9 aa, Homo Sapiens
ETPPEVPDC

SEQ ID NO: 735771 - protein, 9 aa, Homo Sapiens
SASQPSVPQ

SEQ ID NO: 735772 - protein, 9 aa, Homo Sapiens
GLGIVTKYI

SEQ ID NO: 735773 - protein, 9 aa, Homo Sapiens
QRTSHPPWE

SEQ ID NO: 735774 - protein, 9 aa, Homo Sapiens
NVVRHRWTH

SEQ ID NO: 735775 - protein, 9 aa, Homo Sapiens
FFLPQDDSS

SEQ ID NO: 735776 - protein, 9 aa, Homo Sapiens
FCDHNTLLH

SEQ ID NO: 735777 - protein, 9 aa, Homo Sapiens
ALSQCPKGR

SEQ ID NO: 735778 - protein, 9 aa, Homo Sapiens
EAEHRNRSQ

SEQ ID NO: 735779 - protein, 9 aa, Homo Sapiens
PTLHTPMYF

SEQ ID NO: 735780 - protein, 9 aa, Homo Sapiens
TQLVTSHGL

SEQ ID NO: 735781 - protein, 9 aa, Homo Sapiens
KPKGHLPDY

SEQ ID NO: 735782 - protein, 9 aa, Homo Sapiens
GSSRRRDSH

SEQ ID NO: 735783 - protein, 9 aa, Homo Sapiens
SPTHEDEED

SEQ ID NO: 735784 - protein, 9 aa, Homo Sapiens
DDEASNLVV

SEQ ID NO: 735785 - protein, 9 aa, Homo Sapiens
FTAKHLNDE

SEQ ID NO: 735786 - protein, 9 aa, Homo Sapiens
LACLHHSLS

SEQ ID NO: 735787 - protein, 9 aa, Homo Sapiens
TTTRDPGHG

SEQ ID NO: 735788 - protein, 9 aa, Homo Sapiens
YFYPPCHPF

SEQ ID NO: 735789 - protein, 9 aa, Homo Sapiens
GCMAHIFVL

SEQ ID NO: 735790 - protein, 9 aa, Homo Sapiens
KGTNYLVDV

SEQ ID NO: 735791 - protein, 9 aa, Homo Sapiens
CLILGVKTP

SEQ ID NO: 735792 - protein, 9 aa, Homo Sapiens
LTTTRDPGH

SEQ ID NO: 735793 - protein, 9 aa, Homo Sapiens
SMGGAPAEP

SEQ ID NO: 735794 - protein, 9 aa, Homo Sapiens
PSEAPREPA

SEQ ID NO: 735795 - protein, 9 aa, Homo Sapiens
ASYNCAISV

SEQ ID NO: 735796 - protein, 9 aa, Homo Sapiens
SNVVRHRWT

SEQ ID NO: 735797 - protein, 9 aa, Homo Sapiens
VVEEKLIPP

SEQ ID NO: 735798 - protein, 9 aa, Homo Sapiens
WLACRADEL

SEQ ID NO: 735799 - protein, 9 aa, Homo Sapiens
GLEEEDDDD

SEQ ID NO: 735800 - protein, 9 aa, Homo Sapiens
NRSQSLAIC

SEQ ID NO: 735801 - protein, 9 aa, Homo Sapiens
DIICETAIG

SEQ ID NO: 735802 - protein, 9 aa, Homo Sapiens
MAHIFVLHS

SEQ ID NO: 735803 - protein, 9 aa, Homo Sapiens
GSGGHAQAP

SEQ ID NO: 735804 - protein, 9 aa, Homo Sapiens
TGKVGFCSI

SEQ ID NO: 735805 - protein, 9 aa, Homo Sapiens
TARAEAAAA

SEQ ID NO: 735806 - protein, 9 aa, Homo Sapiens
AAQTCQCLN

SEQ ID NO: 735807 - protein, 9 aa, Homo Sapiens
KVGFCSILF

SEQ ID NO: 735808 - protein, 9 aa, Homo Sapiens
GVLSVQTPH

SEQ ID NO: 735809 - protein, 9 aa, Homo Sapiens
PGIDMNVKD

SEQ ID NO: 735810 - protein, 9 aa, Homo Sapiens
IISYLDPTL

SEQ ID NO: 735811 - protein, 9 aa, Homo Sapiens
KHQKKVGSQ

SEQ ID NO: 735812 - protein, 9 aa, Homo Sapiens
NDISSGLKG

SEQ ID NO: 735813 - protein, 9 aa, Homo Sapiens
PNCLRLQLY

SEQ ID NO: 735814 - protein, 9 aa, Homo Sapiens
SSSSSSNSG

SEQ ID NO: 735815 - protein, 9 aa, Homo Sapiens
PFPDLQKQT

SEQ ID NO: 735816 - protein, 9 aa, Homo Sapiens
GSQNKEEVV

SEQ ID NO: 735817 - protein, 9 aa, Homo Sapiens
NGWHEIHQA

SEQ ID NO: 735818 - protein, 9 aa, Homo Sapiens
SYNCAISVI

SEQ ID NO: 735819 - protein, 9 aa, Homo Sapiens
FQENTQHLL

SEQ ID NO: 735820 - protein, 9 aa, Homo Sapiens
PEMLKKSLH

SEQ ID NO: 735821 - protein, 9 aa, Homo Sapiens
EEDEPEEQS

SEQ ID NO: 735822 - protein, 9 aa, Homo Sapiens
QNMILQAPD

SEQ ID NO: 735823 - protein, 9 aa, Homo Sapiens
QRYGPPTSY

SEQ ID NO: 735824 - protein, 9 aa, Homo Sapiens
TGLTLMDVL

SEQ ID NO: 735825 - protein, 9 aa, Homo Sapiens
YHQHSPDTY

SEQ ID NO: 735826 - protein, 9 aa, Homo Sapiens
LTQLGVLPA

SEQ ID NO: 735827 - protein, 9 aa, Homo Sapiens
LDEHDAMSA

SEQ ID NO: 735828 - protein, 9 aa, Homo Sapiens
SSLSFHGGL

SEQ ID NO: 735829 - protein, 9 aa, Homo Sapiens
PKKAPSVQG

SEQ ID NO: 735830 - protein, 9 aa, Homo Sapiens
YNLIIQNKD

SEQ ID NO: 735831 - protein, 9 aa, Homo Sapiens
SSSNSGRRI

SEQ ID NO: 735832 - protein, 9 aa, Homo Sapiens
VMEGALGTA

SEQ ID NO: 735833 - protein, 9 aa, Homo Sapiens
EPAGWPARK

SEQ ID NO: 735834 - protein, 9 aa, Homo Sapiens
RSLPSRQRL

SEQ ID NO: 735835 - protein, 9 aa, Homo Sapiens
LGVKTPPEE

SEQ ID NO: 735836 - protein, 9 aa, Homo Sapiens
SDLKEYAEY

SEQ ID NO: 735837 - protein, 9 aa, Homo Sapiens
TTVVQIILQ

SEQ ID NO: 735838 - protein, 9 aa, Homo Sapiens
TGSMYLNAL

SEQ ID NO: 735839 - protein, 9 aa, Homo Sapiens
SKEFQENTQ

SEQ ID NO: 735840 - protein, 9 aa, Homo Sapiens
QDSDIEMAK

SEQ ID NO: 735841 - protein, 9 aa, Homo Sapiens
PVAVAAEDQ

SEQ ID NO: 735842 - protein, 9 aa, Homo Sapiens
SHSKIQKFS

SEQ ID NO: 735843 - protein, 9 aa, Homo Sapiens
LKEYAEYCT

SEQ ID NO: 735844 - protein, 9 aa, Homo Sapiens
QAFLPEPLA

SEQ ID NO: 735845 - protein, 9 aa, Homo Sapiens
PMTLDDVEC

SEQ ID NO: 735846 - protein, 9 aa, Homo Sapiens
LKHEIHVCR

SEQ ID NO: 735847 - protein, 9 aa, Homo Sapiens
GKPLSEEFE

SEQ ID NO: 735848 - protein, 9 aa, Homo Sapiens
GRARFDGPL

SEQ ID NO: 735849 - protein, 9 aa, Homo Sapiens
SDFAVDNFG

SEQ ID NO: 735850 - protein, 9 aa, Homo Sapiens
PGVIRILSV

SEQ ID NO: 735851 - protein, 9 aa, Homo Sapiens
DGPHEARLR

SEQ ID NO: 735852 - protein, 9 aa, Homo Sapiens
KPVGRKLKE

SEQ ID NO: 735853 - protein, 9 aa, Homo Sapiens
LAMLGERVL

SEQ ID NO: 735854 - protein, 9 aa, Homo Sapiens
FRHIMTHTA

SEQ ID NO: 735855 - protein, 9 aa, Homo Sapiens
MAKAPSSVR

SEQ ID NO: 735856 - protein, 9 aa, Homo Sapiens
QSDKAQEKM

SEQ ID NO: 735857 - protein, 9 aa, Homo Sapiens
GTVCTLEFA

SEQ ID NO: 735858 - protein, 9 aa, Homo Sapiens
MDAGCQELA

SEQ ID NO: 735859 - protein, 9 aa, Homo Sapiens
GQPSLCSFK

SEQ ID NO: 735860 - protein, 9 aa, Homo Sapiens
NLINHGKIY

SEQ ID NO: 735861 - protein, 9 aa, Homo Sapiens
ERPDLVFEA

SEQ ID NO: 735862 - protein, 9 aa, Homo Sapiens
WHPIKLHGI

SEQ ID NO: 735863 - protein, 9 aa, Homo Sapiens
DKNLMNAVV

SEQ ID NO: 735864 - protein, 9 aa, Homo Sapiens
IHLAMRGLG

SEQ ID NO: 735865 - protein, 9 aa, Homo Sapiens
SEVEQLVNK

SEQ ID NO: 735866 - protein, 9 aa, Homo Sapiens
QDARGAVHV

SEQ ID NO: 735867 - protein, 9 aa, Homo Sapiens
VFQQMYANT

SEQ ID NO: 735868 - protein, 9 aa, Homo Sapiens
WTLQNCDLD

SEQ ID NO: 735869 - protein, 9 aa, Homo Sapiens
LFIRTLPFR

SEQ ID NO: 735870 - protein, 9 aa, Homo Sapiens
GGYIQVKSG

SEQ ID NO: 735871 - protein, 9 aa, Homo Sapiens
PGCRFKRHT

SEQ ID NO: 735872 - protein, 9 aa, Homo Sapiens
FCFEAVIKI

SEQ ID NO: 735873 - protein, 9 aa, Homo Sapiens
QPSNAQEFL

SEQ ID NO: 735874 - protein, 9 aa, Homo Sapiens
LLAGIRTVP

SEQ ID NO: 735875 - protein, 9 aa, Homo Sapiens
GAPASRPQL

SEQ ID NO: 735876 - protein, 9 aa, Homo Sapiens
HLEQPFLDL

SEQ ID NO: 735877 - protein, 9 aa, Homo Sapiens
LHLFLLFLG

SEQ ID NO: 735878 - protein, 9 aa, Homo Sapiens
TALGYVQAF

SEQ ID NO: 735879 - protein, 9 aa, Homo Sapiens
GCAVATCPN

SEQ ID NO: 735880 - protein, 9 aa, Homo Sapiens
GSAEDGTDS

SEQ ID NO: 735881 - protein, 9 aa, Homo Sapiens
TVNPAAPHG

SEQ ID NO: 735882 - protein, 9 aa, Homo Sapiens
LCCRRCKSE

SEQ ID NO: 735883 - protein, 9 aa, Homo Sapiens
TEDLGQILY

SEQ ID NO: 735884 - protein, 9 aa, Homo Sapiens
GSSGDVKPS

SEQ ID NO: 735885 - protein, 9 aa, Homo Sapiens
DTIMQCAMG

SEQ ID NO: 735886 - protein, 9 aa, Homo Sapiens
DSRFTHTLN

SEQ ID NO: 735887 - protein, 9 aa, Homo Sapiens
QTLTVVSHL

SEQ ID NO: 735888 - protein, 9 aa, Homo Sapiens
FSLRVPLPR

SEQ ID NO: 735889 - protein, 9 aa, Homo Sapiens
DIKDCSTLG

SEQ ID NO: 735890 - protein, 9 aa, Homo Sapiens
NQTLTVVSH

SEQ ID NO: 735891 - protein, 9 aa, Homo Sapiens
GVNGYSLQA

SEQ ID NO: 735892 - protein, 9 aa, Homo Sapiens
PSCWLSFPW

SEQ ID NO: 735893 - protein, 9 aa, Homo Sapiens
CKNAGPRIK

SEQ ID NO: 735894 - protein, 9 aa, Homo Sapiens
IIHKNIVCP

SEQ ID NO: 735895 - protein, 9 aa, Homo Sapiens
EDITFKGCM

SEQ ID NO: 735896 - protein, 9 aa, Homo Sapiens
EVENKNGTE

SEQ ID NO: 735897 - protein, 9 aa, Homo Sapiens
GSVKNKVGP

SEQ ID NO: 735898 - protein, 9 aa, Homo Sapiens
FFFDVIHEG

SEQ ID NO: 735899 - protein, 9 aa, Homo Sapiens
QLFEWLLIG

SEQ ID NO: 735900 - protein, 9 aa, Homo Sapiens
SEKASEQSA

SEQ ID NO: 735901 - protein, 9 aa, Homo Sapiens
KRLQLRKAP

SEQ ID NO: 735902 - protein, 9 aa, Homo Sapiens
DAFQILVEL

SEQ ID NO: 735903 - protein, 9 aa, Homo Sapiens
DLKRPSGDQ

SEQ ID NO: 735904 - protein, 9 aa, Homo Sapiens
GAPRRVDEA

SEQ ID NO: 735905 - protein, 9 aa, Homo Sapiens
TPVTQGDVY

SEQ ID NO: 735906 - protein, 9 aa, Homo Sapiens
WLLPPSSAN

SEQ ID NO: 735907 - protein, 9 aa, Homo Sapiens
SSLKRSFFR

SEQ ID NO: 735908 - protein, 9 aa, Homo Sapiens
TNSVEKGNS

SEQ ID NO: 735909 - protein, 9 aa, Homo Sapiens
KQWRHLCCG

SEQ ID NO: 735910 - protein, 9 aa, Homo Sapiens
VNGYSLQAM

SEQ ID NO: 735911 - protein, 9 aa, Homo Sapiens
RYSSSGCPA

SEQ ID NO: 735912 - protein, 9 aa, Homo Sapiens
ETFNISLFS

SEQ ID NO: 735913 - protein, 9 aa, Homo Sapiens
CWGGGCGLP

SEQ ID NO: 735914 - protein, 9 aa, Homo Sapiens
GKHSQPWQV

SEQ ID NO: 735915 - protein, 9 aa, Homo Sapiens
PGNTQPPIR

SEQ ID NO: 735916 - protein, 9 aa, Homo Sapiens
LDGGGLSGK

SEQ ID NO: 735917 - protein, 9 aa, Homo Sapiens
VTKYCDEKC

SEQ ID NO: 735918 - protein, 9 aa, Homo Sapiens
QEIAPYFQR

SEQ ID NO: 735919 - protein, 9 aa, Homo Sapiens
LFYGLAIIT

SEQ ID NO: 735920 - protein, 9 aa, Homo Sapiens
LLAANPFCQ

SEQ ID NO: 735921 - protein, 9 aa, Homo Sapiens
SCSRQPEPF

SEQ ID NO: 735922 - protein, 9 aa, Homo Sapiens
GATDHSSPA

SEQ ID NO: 735923 - protein, 9 aa, Homo Sapiens
FTCALLEFK

SEQ ID NO: 735924 - protein, 9 aa, Homo Sapiens
LLPPMPEDI

SEQ ID NO: 735925 - protein, 9 aa, Homo Sapiens
PHRSYGDLS

SEQ ID NO: 735926 - protein, 9 aa, Homo Sapiens
AANPFCQAS

SEQ ID NO: 735927 - protein, 9 aa, Homo Sapiens
HFGLCDSCT

SEQ ID NO: 735928 - protein, 9 aa, Homo Sapiens
EALIDVGEE

SEQ ID NO: 735929 - protein, 9 aa, Homo Sapiens
RFKGSMQRL

SEQ ID NO: 735930 - protein, 9 aa, Homo Sapiens
CGNGFCCSS

SEQ ID NO: 735931 - protein, 9 aa, Homo Sapiens
IKKPEAHAV

SEQ ID NO: 735932 - protein, 9 aa, Homo Sapiens
VAERFQESK

SEQ ID NO: 735933 - protein, 9 aa, Homo Sapiens
STIGWAAEE

SEQ ID NO: 735934 - protein, 9 aa, Homo Sapiens
FTHLNTTTS

SEQ ID NO: 735935 - protein, 9 aa, Homo Sapiens
PIFCPGVMQ

SEQ ID NO: 735936 - protein, 9 aa, Homo Sapiens
FLRLCLMDH

SEQ ID NO: 735937 - protein, 9 aa, Homo Sapiens
VSPAAPAGP

SEQ ID NO: 735938 - protein, 9 aa, Homo Sapiens
LLHRLGQPM

SEQ ID NO: 735939 - protein, 9 aa, Homo Sapiens
ILKPHLFPE

SEQ ID NO: 735940 - protein, 9 aa, Homo Sapiens
QDVNKNLIS

SEQ ID NO: 735941 - protein, 9 aa, Homo Sapiens
KQRQTRELQ

SEQ ID NO: 735942 - protein, 9 aa, Homo Sapiens
TAMGAADQL

SEQ ID NO: 735943 - protein, 9 aa, Homo Sapiens
VMEQADRQS

SEQ ID NO: 735944 - protein, 9 aa, Homo Sapiens
AEWGGWAAA

SEQ ID NO: 735945 - protein, 9 aa, Homo Sapiens
AAPEETGSS

SEQ ID NO: 735946 - protein, 9 aa, Homo Sapiens
GGDVGPLGQ

SEQ ID NO: 735947 - protein, 9 aa, Homo Sapiens
IPCTVDAGG

SEQ ID NO: 735948 - protein, 9 aa, Homo Sapiens
GSHLEQPFL

SEQ ID NO: 735949 - protein, 9 aa, Homo Sapiens
IKCLRNKHP

SEQ ID NO: 735950 - protein, 9 aa, Homo Sapiens
LTLLRPKMD

SEQ ID NO: 735951 - protein, 9 aa, Homo Sapiens
DQLSMQAST

SEQ ID NO: 735952 - protein, 9 aa, Homo Sapiens
STPKHKKFQ

SEQ ID NO: 735953 - protein, 9 aa, Homo Sapiens
WTGRHDAFQ

SEQ ID NO: 735954 - protein, 9 aa, Homo Sapiens
RMLGIVHDA

SEQ ID NO: 735955 - protein, 9 aa, Homo Sapiens
VKPTVGMKL

SEQ ID NO: 735956 - protein, 9 aa, Homo Sapiens
IDDKGNVRP

SEQ ID NO: 735957 - protein, 9 aa, Homo Sapiens
MYATGDRHP

SEQ ID NO: 735958 - protein, 9 aa, Homo Sapiens
LRPCARLAP

SEQ ID NO: 735959 - protein, 9 aa, Homo Sapiens
CWLRLQAMQ

SEQ ID NO: 735960 - protein, 9 aa, Homo Sapiens
RCQNTNSVE

SEQ ID NO: 735961 - protein, 9 aa, Homo Sapiens
CSHMMAVTL

SEQ ID NO: 735962 - protein, 9 aa, Homo Sapiens
IPNVTVMKT

SEQ ID NO: 735963 - protein, 9 aa, Homo Sapiens
CFPCCRGSV

SEQ ID NO: 735964 - protein, 9 aa, Homo Sapiens
GSGKNTTLH

SEQ ID NO: 735965 - protein, 9 aa, Homo Sapiens
FFPVFLYMR

SEQ ID NO: 735966 - protein, 9 aa, Homo Sapiens
VADEPLAAH

SEQ ID NO: 735967 - protein, 9 aa, Homo Sapiens
LIQSLYRMH

SEQ ID NO: 735968 - protein, 9 aa, Homo Sapiens
TCCSHMMAV

SEQ ID NO: 735969 - protein, 9 aa, Homo Sapiens
ILQGSKLIW

SEQ ID NO: 735970 - protein, 9 aa, Homo Sapiens
EVEALDGGG

SEQ ID NO: 735971 - protein, 9 aa, Homo Sapiens
ELAWQSLLR

SEQ ID NO: 735972 - protein, 9 aa, Homo Sapiens
PCGEWQVGD

SEQ ID NO: 735973 - protein, 9 aa, Homo Sapiens
SSPRYSTID

SEQ ID NO: 735974 - protein, 9 aa, Homo Sapiens
DLENHYHTF

SEQ ID NO: 735975 - protein, 9 aa, Homo Sapiens
EILLQKYRL

SEQ ID NO: 735976 - protein, 9 aa, Homo Sapiens
GMKLSEQLM

SEQ ID NO: 735977 - protein, 9 aa, Homo Sapiens
RSLDGIPCT

SEQ ID NO: 735978 - protein, 9 aa, Homo Sapiens
TSSSLKRSF

SEQ ID NO: 735979 - protein, 9 aa, Homo Sapiens
QAGEALGLV

SEQ ID NO: 735980 - protein, 9 aa, Homo Sapiens
LVHVTKKGV

SEQ ID NO: 735981 - protein, 9 aa, Homo Sapiens
SSDDRSPRH

SEQ ID NO: 735982 - protein, 9 aa, Homo Sapiens
KLQNLGKLN

SEQ ID NO: 735983 - protein, 9 aa, Homo Sapiens
PLQQTALQE

SEQ ID NO: 735984 - protein, 9 aa, Homo Sapiens
NEGEETCAV

SEQ ID NO: 735985 - protein, 9 aa, Homo Sapiens
SAISSQMFC

SEQ ID NO: 735986 - protein, 9 aa, Homo Sapiens
VDMVHQSCN

SEQ ID NO: 735987 - protein, 9 aa, Homo Sapiens
AWQSLLRDQ

SEQ ID NO: 735988 - protein, 9 aa, Homo Sapiens
EKSVHAIQD

SEQ ID NO: 735989 - protein, 9 aa, Homo Sapiens
IKDCSTLGE

SEQ ID NO: 735990 - protein, 9 aa, Homo Sapiens
DLSAGPITG

SEQ ID NO: 735991 - protein, 9 aa, Homo Sapiens
NVFSTATFR

SEQ ID NO: 735992 - protein, 9 aa, Homo Sapiens
LHSKWGPLK

SEQ ID NO: 735993 - protein, 9 aa, Homo Sapiens
LIVMSAISS

SEQ ID NO: 735994 - protein, 9 aa, Homo Sapiens
GHKWVDGGL

SEQ ID NO: 735995 - protein, 9 aa, Homo Sapiens
GSGHQVPVP

SEQ ID NO: 735996 - protein, 9 aa, Homo Sapiens
YKNGPAIDG

SEQ ID NO: 735997 - protein, 9 aa, Homo Sapiens
IIYMLLIKI

SEQ ID NO: 735998 - protein, 9 aa, Homo Sapiens
HLEIREAKA

SEQ ID NO: 735999 - protein, 9 aa, Homo Sapiens
IDLDTKYQV

SEQ ID NO: 736000 - protein, 9 aa, Homo Sapiens
FEIESYGYT

SEQ ID NO: 736001 - protein, 9 aa, Homo Sapiens
ETNNQTLTV

SEQ ID NO: 736002 - protein, 9 aa, Homo Sapiens
IKERIGYAD

SEQ ID NO: 736003 - protein, 9 aa, Homo Sapiens
NGLDDIKDC

SEQ ID NO: 736004 - protein, 9 aa, Homo Sapiens
LIRYVGQNL

SEQ ID NO: 736005 - protein, 9 aa, Homo Sapiens
ILQSRQSFV

SEQ ID NO: 736006 - protein, 9 aa, Homo Sapiens
QPPGRKLRG

SEQ ID NO: 736007 - protein, 9 aa, Homo Sapiens
DLEPKYWKN

SEQ ID NO: 736008 - protein, 9 aa, Homo Sapiens
VAGLDLSHN

SEQ ID NO: 736009 - protein, 9 aa, Homo Sapiens
AVIRLCFLK

SEQ ID NO: 736010 - protein, 9 aa, Homo Sapiens
VQEWEEEQS

SEQ ID NO: 736011 - protein, 9 aa, Homo Sapiens
DVKPSLSPK

SEQ ID NO: 736012 - protein, 9 aa, Homo Sapiens
DDANATQCS

SEQ ID NO: 736013 - protein, 9 aa, Homo Sapiens
LLVHVHPGY

SEQ ID NO: 736014 - protein, 9 aa, Homo Sapiens
TKLYDYNLW

SEQ ID NO: 736015 - protein, 9 aa, Homo Sapiens
DGHCIPHDN

SEQ ID NO: 736016 - protein, 9 aa, Homo Sapiens
RLALLLLCG

SEQ ID NO: 736017 - protein, 9 aa, Homo Sapiens
TGTPPPNYD

SEQ ID NO: 736018 - protein, 9 aa, Homo Sapiens
ALIDVGEEF

SEQ ID NO: 736019 - protein, 9 aa, Homo Sapiens
SKIIGVFTI

SEQ ID NO: 736020 - protein, 9 aa, Homo Sapiens
GAHGAHVGV

SEQ ID NO: 736021 - protein, 9 aa, Homo Sapiens
ATCPNLGGA

SEQ ID NO: 736022 - protein, 9 aa, Homo Sapiens
VEWLERAEL

SEQ ID NO: 736023 - protein, 9 aa, Homo Sapiens
IGYADDIVS

SEQ ID NO: 736024 - protein, 9 aa, Homo Sapiens
YAVPHRNQA

SEQ ID NO: 736025 - protein, 9 aa, Homo Sapiens
VMPMVNVDG

SEQ ID NO: 736026 - protein, 9 aa, Homo Sapiens
QGQPYFCVE

SEQ ID NO: 736027 - protein, 9 aa, Homo Sapiens
AAEWGGWAA

SEQ ID NO: 736028 - protein, 9 aa, Homo Sapiens
RTPVNLVSC

SEQ ID NO: 736029 - protein, 9 aa, Homo Sapiens
QTNRTFVTY

SEQ ID NO: 736030 - protein, 9 aa, Homo Sapiens
HKKFQKGSA

SEQ ID NO: 736031 - protein, 9 aa, Homo Sapiens
ARCPVFERQ

SEQ ID NO: 736032 - protein, 9 aa, Homo Sapiens
GRAFFFDVI

SEQ ID NO: 736033 - protein, 9 aa, Homo Sapiens
VRDDPLEAQ

SEQ ID NO: 736034 - protein, 9 aa, Homo Sapiens
GSFEFPKEE

SEQ ID NO: 736035 - protein, 9 aa, Homo Sapiens
SIRDLHLAA

SEQ ID NO: 736036 - protein, 9 aa, Homo Sapiens
TIGWAAEEC

SEQ ID NO: 736037 - protein, 9 aa, Homo Sapiens
MLTSYTLIW

SEQ ID NO: 736038 - protein, 9 aa, Homo Sapiens
RSEQHQNQA

SEQ ID NO: 736039 - protein, 9 aa, Homo Sapiens
SRVCLLIQH

SEQ ID NO: 736040 - protein, 9 aa, Homo Sapiens
YRYDPHLNC

SEQ ID NO: 736041 - protein, 9 aa, Homo Sapiens
FHQIRNPLR

SEQ ID NO: 736042 - protein, 9 aa, Homo Sapiens
AQCLIASRK

SEQ ID NO: 736043 - protein, 9 aa, Homo Sapiens
VLRDSFVGQ

SEQ ID NO: 736044 - protein, 9 aa, Homo Sapiens
KGVWKNPVL

SEQ ID NO: 736045 - protein, 9 aa, Homo Sapiens
SWVAGLDLS

SEQ ID NO: 736046 - protein, 9 aa, Homo Sapiens
LGDAEEDNS

SEQ ID NO: 736047 - protein, 9 aa, Homo Sapiens
TAYLWIHQI

SEQ ID NO: 736048 - protein, 9 aa, Homo Sapiens
LDVQIFYCA

SEQ ID NO: 736049 - protein, 9 aa, Homo Sapiens
LDGAPRRVD

SEQ ID NO: 736050 - protein, 9 aa, Homo Sapiens
LPRDEVTGR

SEQ ID NO: 736051 - protein, 9 aa, Homo Sapiens
TIRYPDPLM

SEQ ID NO: 736052 - protein, 9 aa, Homo Sapiens
EDLEPKYWK

SEQ ID NO: 736053 - protein, 9 aa, Homo Sapiens
DCSTPSQCR

SEQ ID NO: 736054 - protein, 9 aa, Homo Sapiens
GTLKKSELE

SEQ ID NO: 736055 - protein, 9 aa, Homo Sapiens
QRVERNDPL

SEQ ID NO: 736056 - protein, 9 aa, Homo Sapiens
RPYTAPGNT

SEQ ID NO: 736057 - protein, 9 aa, Homo Sapiens
YYCNQHVEI

SEQ ID NO: 736058 - protein, 9 aa, Homo Sapiens
EPPRPRDPL

SEQ ID NO: 736059 - protein, 9 aa, Homo Sapiens
GDNLCKDGD

SEQ ID NO: 736060 - protein, 9 aa, Homo Sapiens
YYNRNAEML

SEQ ID NO: 736061 - protein, 9 aa, Homo Sapiens
LNCWLRLQA

SEQ ID NO: 736062 - protein, 9 aa, Homo Sapiens
FRTVNYGFE

SEQ ID NO: 736063 - protein, 9 aa, Homo Sapiens
NSTRYFLFR

SEQ ID NO: 736064 - protein, 9 aa, Homo Sapiens
LNGCFEDQY

SEQ ID NO: 736065 - protein, 9 aa, Homo Sapiens
HGTGSKVFP

SEQ ID NO: 736066 - protein, 9 aa, Homo Sapiens
GGLKTRFSS

SEQ ID NO: 736067 - protein, 9 aa, Homo Sapiens
TAPGNTQPP

SEQ ID NO: 736068 - protein, 9 aa, Homo Sapiens
QPTPSATAM

SEQ ID NO: 736069 - protein, 9 aa, Homo Sapiens
TGAQRSTAT

SEQ ID NO: 736070 - protein, 9 aa, Homo Sapiens
CLHQRLQWH

SEQ ID NO: 736071 - protein, 9 aa, Homo Sapiens
DPARSAGKT

SEQ ID NO: 736072 - protein, 9 aa, Homo Sapiens
PDLENHYHT

SEQ ID NO: 736073 - protein, 9 aa, Homo Sapiens
DRTLPVSTP

SEQ ID NO: 736074 - protein, 9 aa, Homo Sapiens
LDTTAPVLM

SEQ ID NO: 736075 - protein, 9 aa, Homo Sapiens
GHGASGPGA

SEQ ID NO: 736076 - protein, 9 aa, Homo Sapiens
RFQESKGDS

SEQ ID NO: 736077 - protein, 9 aa, Homo Sapiens
LSEDCPQAS

SEQ ID NO: 736078 - protein, 9 aa, Homo Sapiens
RHDRLREKM

SEQ ID NO: 736079 - protein, 9 aa, Homo Sapiens
GPIRDVCSK

SEQ ID NO: 736080 - protein, 9 aa, Homo Sapiens
LQAMNSLSA

SEQ ID NO: 736081 - protein, 9 aa, Homo Sapiens
LQQRPRAAL

SEQ ID NO: 736082 - protein, 9 aa, Homo Sapiens
MVEAANGAA

SEQ ID NO: 736083 - protein, 9 aa, Homo Sapiens
HRSLDGIPC

SEQ ID NO: 736084 - protein, 9 aa, Homo Sapiens
RANGSEGEC

SEQ ID NO: 736085 - protein, 9 aa, Homo Sapiens
CQIVGVQRV

SEQ ID NO: 736086 - protein, 9 aa, Homo Sapiens
LPTNLLLDT

SEQ ID NO: 736087 - protein, 9 aa, Homo Sapiens
SQCRMKDKS

SEQ ID NO: 736088 - protein, 9 aa, Homo Sapiens
TVVYIPDLT

SEQ ID NO: 736089 - protein, 9 aa, Homo Sapiens
GLINHSPWN

SEQ ID NO: 736090 - protein, 9 aa, Homo Sapiens
HFLPTNLLL

SEQ ID NO: 736091 - protein, 9 aa, Homo Sapiens
QVSEPVNPD

SEQ ID NO: 736092 - protein, 9 aa, Homo Sapiens
EDEQIAISA

SEQ ID NO: 736093 - protein, 9 aa, Homo Sapiens
SHDQVDMPY

SEQ ID NO: 736094 - protein, 9 aa, Homo Sapiens
LADPASSDD

SEQ ID NO: 736095 - protein, 9 aa, Homo Sapiens
CKAKRFVET

SEQ ID NO: 736096 - protein, 9 aa, Homo Sapiens
VPSCWLSFP

SEQ ID NO: 736097 - protein, 9 aa, Homo Sapiens
NSDPFAHSR

SEQ ID NO: 736098 - protein, 9 aa, Homo Sapiens
DISFMTPNT

SEQ ID NO: 736099 - protein, 9 aa, Homo Sapiens
TQPPIRLQP

SEQ ID NO: 736100 - protein, 9 aa, Homo Sapiens
HSGPPSTSR

SEQ ID NO: 736101 - protein, 9 aa, Homo Sapiens
TPKHKKFQK

SEQ ID NO: 736102 - protein, 9 aa, Homo Sapiens
KGNVRPPGT

SEQ ID NO: 736103 - protein, 9 aa, Homo Sapiens
CWALSSGNK

SEQ ID NO: 736104 - protein, 9 aa, Homo Sapiens
RRRIILDLL

SEQ ID NO: 736105 - protein, 9 aa, Homo Sapiens
PTQAEGRTS

SEQ ID NO: 736106 - protein, 9 aa, Homo Sapiens
ALYCLRLDQ

SEQ ID NO: 736107 - protein, 9 aa, Homo Sapiens
MLLIKIATF

SEQ ID NO: 736108 - protein, 9 aa, Homo Sapiens
EVLHAAQLP

SEQ ID NO: 736109 - protein, 9 aa, Homo Sapiens
MLHNKGLTV

SEQ ID NO: 736110 - protein, 9 aa, Homo Sapiens
EKYVSVMKK

SEQ ID NO: 736111 - protein, 9 aa, Homo Sapiens
EHGVAPDAQ

SEQ ID NO: 736112 - protein, 9 aa, Homo Sapiens
DEHTKKSNR

SEQ ID NO: 736113 - protein, 9 aa, Homo Sapiens
FYVMPMVNV

SEQ ID NO: 736114 - protein, 9 aa, Homo Sapiens
FLNQMNYSS

SEQ ID NO: 736115 - protein, 9 aa, Homo Sapiens
TGSNSEKAS

SEQ ID NO: 736116 - protein, 9 aa, Homo Sapiens
TKQEKDFLW

SEQ ID NO: 736117 - protein, 9 aa, Homo Sapiens
PAGADMDRN

SEQ ID NO: 736118 - protein, 9 aa, Homo Sapiens
YSLQAMNSL

SEQ ID NO: 736119 - protein, 9 aa, Homo Sapiens
KYCDEKCVW

SEQ ID NO: 736120 - protein, 9 aa, Homo Sapiens
GKRRPECKS

SEQ ID NO: 736121 - protein, 9 aa, Homo Sapiens
EVSKRVLIP

SEQ ID NO: 736122 - protein, 9 aa, Homo Sapiens
PVTQVTPRL

SEQ ID NO: 736123 - protein, 9 aa, Homo Sapiens
IVSQRKHIK

SEQ ID NO: 736124 - protein, 9 aa, Homo Sapiens
MEFYMWTFR

SEQ ID NO: 736125 - protein, 9 aa, Homo Sapiens
SNVFSTATF

SEQ ID NO: 736126 - protein, 9 aa, Homo Sapiens
CFEDQYTPT

SEQ ID NO: 736127 - protein, 9 aa, Homo Sapiens
LEEKYVSVM

SEQ ID NO: 736128 - protein, 9 aa, Homo Sapiens
RDVCSKWYM

SEQ ID NO: 736129 - protein, 9 aa, Homo Sapiens
ETGSSDDTA

SEQ ID NO: 736130 - protein, 9 aa, Homo Sapiens
RLCLMDHNF

SEQ ID NO: 736131 - protein, 9 aa, Homo Sapiens
DEVTGRLLH

SEQ ID NO: 736132 - protein, 9 aa, Homo Sapiens
TGSFEFPKE

SEQ ID NO: 736133 - protein, 9 aa, Homo Sapiens
CGKSFSRVC

SEQ ID NO: 736134 - protein, 9 aa, Homo Sapiens
KPKSKLLVK

SEQ ID NO: 736135 - protein, 9 aa, Homo Sapiens
FNEESVEHD

SEQ ID NO: 736136 - protein, 9 aa, Homo Sapiens
SYDAEDLEE

SEQ ID NO: 736137 - protein, 9 aa, Homo Sapiens
ATQCSFLID

SEQ ID NO: 736138 - protein, 9 aa, Homo Sapiens
ALLDEHTKK

SEQ ID NO: 736139 - protein, 9 aa, Homo Sapiens
PLSSEHAKS

SEQ ID NO: 736140 - protein, 9 aa, Homo Sapiens
DTKYQVTFT

SEQ ID NO: 736141 - protein, 9 aa, Homo Sapiens
GKEGLVDLE

SEQ ID NO: 736142 - protein, 9 aa, Homo Sapiens
SIVSVAARL

SEQ ID NO: 736143 - protein, 9 aa, Homo Sapiens
DTSAYLERM

SEQ ID NO: 736144 - protein, 9 aa, Homo Sapiens
PLGQRLRVV

SEQ ID NO: 736145 - protein, 9 aa, Homo Sapiens
NDYIISIVA

SEQ ID NO: 736146 - protein, 9 aa, Homo Sapiens
KMDGAATKV

SEQ ID NO: 736147 - protein, 9 aa, Homo Sapiens
HQGLPGPKG

SEQ ID NO: 736148 - protein, 9 aa, Homo Sapiens
SLQAMNSLS

SEQ ID NO: 736149 - protein, 9 aa, Homo Sapiens
INGNICNER

SEQ ID NO: 736150 - protein, 9 aa, Homo Sapiens
VYIPDLTTG

SEQ ID NO: 736151 - protein, 9 aa, Homo Sapiens
RAAIPAGPR

SEQ ID NO: 736152 - protein, 9 aa, Homo Sapiens
SVKAILQGS

SEQ ID NO: 736153 - protein, 9 aa, Homo Sapiens
TTFTFLGFS

SEQ ID NO: 736154 - protein, 9 aa, Homo Sapiens
EINQSAHNL

SEQ ID NO: 736155 - protein, 9 aa, Homo Sapiens
RQHHSGPPS

SEQ ID NO: 736156 - protein, 9 aa, Homo Sapiens
VFERQALEG

SEQ ID NO: 736157 - protein, 9 aa, Homo Sapiens
EAMLAEAHL

SEQ ID NO: 736158 - protein, 9 aa, Homo Sapiens
HGPSQLIRY

SEQ ID NO: 736159 - protein, 9 aa, Homo Sapiens
PFAHSRDAS

SEQ ID NO: 736160 - protein, 9 aa, Homo Sapiens
LAVAPLVIT

SEQ ID NO: 736161 - protein, 9 aa, Homo Sapiens
NVFTKKMGN

SEQ ID NO: 736162 - protein, 9 aa, Homo Sapiens
LIRRGLRLW

SEQ ID NO: 736163 - protein, 9 aa, Homo Sapiens
LEGGDVGPL

SEQ ID NO: 736164 - protein, 9 aa, Homo Sapiens
GHSQRIPGS

SEQ ID NO: 736165 - protein, 9 aa, Homo Sapiens
LVGEEMEFP

SEQ ID NO: 736166 - protein, 9 aa, Homo Sapiens
YGIKFVRAF

SEQ ID NO: 736167 - protein, 9 aa, Homo Sapiens
TLLRPKMDG

SEQ ID NO: 736168 - protein, 9 aa, Homo Sapiens
SPGRDGHQG

SEQ ID NO: 736169 - protein, 9 aa, Homo Sapiens
LSGRIVAGV

SEQ ID NO: 736170 - protein, 9 aa, Homo Sapiens
TTRLLLAAD

SEQ ID NO: 736171 - protein, 9 aa, Homo Sapiens
HCSCHRGFE

SEQ ID NO: 736172 - protein, 9 aa, Homo Sapiens
SVLSLSTDP

SEQ ID NO: 736173 - protein, 9 aa, Homo Sapiens
CQHSKEALH

SEQ ID NO: 736174 - protein, 9 aa, Homo Sapiens
YDSVEQHGD

SEQ ID NO: 736175 - protein, 9 aa, Homo Sapiens
SKNSNFATV

SEQ ID NO: 736176 - protein, 9 aa, Homo Sapiens
GSNKYYCNQ

SEQ ID NO: 736177 - protein, 9 aa, Homo Sapiens
GQRLRVVRD

SEQ ID NO: 736178 - protein, 9 aa, Homo Sapiens
GLDKCQFQF

SEQ ID NO: 736179 - protein, 9 aa, Homo Sapiens
LDLSENNLT

SEQ ID NO: 736180 - protein, 9 aa, Homo Sapiens
ENATLSATT

SEQ ID NO: 736181 - protein, 9 aa, Homo Sapiens
IGLYLRKRH

SEQ ID NO: 736182 - protein, 9 aa, Homo Sapiens
VSHVYEYIP

SEQ ID NO: 736183 - protein, 9 aa, Homo Sapiens
ADLAVAPLV

SEQ ID NO: 736184 - protein, 9 aa, Homo Sapiens
TLHWQVIGN

SEQ ID NO: 736185 - protein, 9 aa, Homo Sapiens
KYEYRVDMV

SEQ ID NO: 736186 - protein, 9 aa, Homo Sapiens
GVMDLQEIS

SEQ ID NO: 736187 - protein, 9 aa, Homo Sapiens
SFVAYMIRL

SEQ ID NO: 736188 - protein, 9 aa, Homo Sapiens
FTIIDDPET

SEQ ID NO: 736189 - protein, 9 aa, Homo Sapiens
ADRQSSRGK

SEQ ID NO: 736190 - protein, 9 aa, Homo Sapiens
DSGDRAAIP

SEQ ID NO: 736191 - protein, 9 aa, Homo Sapiens
GYYLQIHPD

SEQ ID NO: 736192 - protein, 9 aa, Homo Sapiens
KGSMQRLPL

SEQ ID NO: 736193 - protein, 9 aa, Homo Sapiens
ASSDDRSPR

SEQ ID NO: 736194 - protein, 9 aa, Homo Sapiens
MPSWLRQEL

SEQ ID NO: 736195 - protein, 9 aa, Homo Sapiens
PRRVDEARC

SEQ ID NO: 736196 - protein, 9 aa, Homo Sapiens
PVLVPLQEF

SEQ ID NO: 736197 - protein, 9 aa, Homo Sapiens
DGHQGLPGP

SEQ ID NO: 736198 - protein, 9 aa, Homo Sapiens
THLNTTTSA

SEQ ID NO: 736199 - protein, 9 aa, Homo Sapiens
QSLRSPIYF

SEQ ID NO: 736200 - protein, 9 aa, Homo Sapiens
RMVEAANGA

SEQ ID NO: 736201 - protein, 9 aa, Homo Sapiens
KKGVWKNPV

SEQ ID NO: 736202 - protein, 9 aa, Homo Sapiens
HGPGRAEPP

SEQ ID NO: 736203 - protein, 9 aa, Homo Sapiens
PLDVQIFYC

SEQ ID NO: 736204 - protein, 9 aa, Homo Sapiens
DPWFAASSN

SEQ ID NO: 736205 - protein, 9 aa, Homo Sapiens
ESKSGQSSY

SEQ ID NO: 736206 - protein, 9 aa, Homo Sapiens
HILVLPMEV

SEQ ID NO: 736207 - protein, 9 aa, Homo Sapiens
RNEAAPQEK

SEQ ID NO: 736208 - protein, 9 aa, Homo Sapiens
SYIPDKMPG

SEQ ID NO: 736209 - protein, 9 aa, Homo Sapiens
VALLTCHGL

SEQ ID NO: 736210 - protein, 9 aa, Homo Sapiens
VMVLLKQAA

SEQ ID NO: 736211 - protein, 9 aa, Homo Sapiens
SPRRRIILD

SEQ ID NO: 736212 - protein, 9 aa, Homo Sapiens
NIDYGIKFV

SEQ ID NO: 736213 - protein, 9 aa, Homo Sapiens
IDKRREYVY

SEQ ID NO: 736214 - protein, 9 aa, Homo Sapiens
CKSEEHLDA

SEQ ID NO: 736215 - protein, 9 aa, Homo Sapiens
LDALYCLRL

SEQ ID NO: 736216 - protein, 9 aa, Homo Sapiens
HLNTTTSAT

SEQ ID NO: 736217 - protein, 9 aa, Homo Sapiens
RLRFKGSMQ

SEQ ID NO: 736218 - protein, 9 aa, Homo Sapiens
LVWFPGGAI

SEQ ID NO: 736219 - protein, 9 aa, Homo Sapiens
QHHSGPPST

SEQ ID NO: 736220 - protein, 9 aa, Homo Sapiens
GARGQAGMM

SEQ ID NO: 736221 - protein, 9 aa, Homo Sapiens
PRPFTHLNT

SEQ ID NO: 736222 - protein, 9 aa, Homo Sapiens
QYLARFLQG

SEQ ID NO: 736223 - protein, 9 aa, Homo Sapiens
KEQDTSAYL

SEQ ID NO: 736224 - protein, 9 aa, Homo Sapiens
IPPRPFTHL

SEQ ID NO: 736225 - protein, 9 aa, Homo Sapiens
WLCCRRCKS

SEQ ID NO: 736226 - protein, 9 aa, Homo Sapiens
LVLRDSFVG

SEQ ID NO: 736227 - protein, 9 aa, Homo Sapiens
RYNSILTNT

SEQ ID NO: 736228 - protein, 9 aa, Homo Sapiens
LGRARSLVH

SEQ ID NO: 736229 - protein, 9 aa, Homo Sapiens
SLEEKYVSV

SEQ ID NO: 736230 - protein, 9 aa, Homo Sapiens
WGVREGGPG

SEQ ID NO: 736231 - protein, 9 aa, Homo Sapiens
PDYAAGRQV

SEQ ID NO: 736232 - protein, 9 aa, Homo Sapiens
HVTKKGVWK

SEQ ID NO: 736233 - protein, 9 aa, Homo Sapiens
ALSSGNKKW

SEQ ID NO: 736234 - protein, 9 aa, Homo Sapiens
RGLRNEAAP

SEQ ID NO: 736235 - protein, 9 aa, Homo Sapiens
LSCWGGGCG

SEQ ID NO: 736236 - protein, 9 aa, Homo Sapiens
RDLSYLHNQ

SEQ ID NO: 736237 - protein, 9 aa, Homo Sapiens
HTENNVGLR

SEQ ID NO: 736238 - protein, 9 aa, Homo Sapiens
TGEAESKNS

SEQ ID NO: 736239 - protein, 9 aa, Homo Sapiens
QSSRGKNTF

SEQ ID NO: 736240 - protein, 9 aa, Homo Sapiens
SLINGNICN

SEQ ID NO: 736241 - protein, 9 aa, Homo Sapiens
HCQIVGVQR

SEQ ID NO: 736242 - protein, 9 aa, Homo Sapiens
SSSCATFGD

SEQ ID NO: 736243 - protein, 9 aa, Homo Sapiens
YDEDEQIAI

SEQ ID NO: 736244 - protein, 9 aa, Homo Sapiens
RYESQLFEW

SEQ ID NO: 736245 - protein, 9 aa, Homo Sapiens
HSRDASSTS

SEQ ID NO: 736246 - protein, 9 aa, Homo Sapiens
FPFFFFPVF

SEQ ID NO: 736247 - protein, 9 aa, Homo Sapiens
QRLRLPERE

SEQ ID NO: 736248 - protein, 9 aa, Homo Sapiens
PSATAMGAA

SEQ ID NO: 736249 - protein, 9 aa, Homo Sapiens
HASTEAGGF

SEQ ID NO: 736250 - protein, 9 aa, Homo Sapiens
AYDEDEQIA

SEQ ID NO: 736251 - protein, 9 aa, Homo Sapiens
QNQAQDSSL

SEQ ID NO: 736252 - protein, 9 aa, Homo Sapiens
LLPPSSANP

SEQ ID NO: 736253 - protein, 9 aa, Homo Sapiens
PNVTVMKTN

SEQ ID NO: 736254 - protein, 9 aa, Homo Sapiens
RYFLFRNRG

SEQ ID NO: 736255 - protein, 9 aa, Homo Sapiens
DDSTVDQLS

SEQ ID NO: 736256 - protein, 9 aa, Homo Sapiens
DGPPGPMVP

SEQ ID NO: 736257 - protein, 9 aa, Homo Sapiens
STATFRFGH

SEQ ID NO: 736258 - protein, 9 aa, Homo Sapiens
DCSTLGEKL

SEQ ID NO: 736259 - protein, 9 aa, Homo Sapiens
RAGRDREVG

SEQ ID NO: 736260 - protein, 9 aa, Homo Sapiens
WECGKHSQP

SEQ ID NO: 736261 - protein, 9 aa, Homo Sapiens
VGDWSPCSA

SEQ ID NO: 736262 - protein, 9 aa, Homo Sapiens
GDVKPSLSP

SEQ ID NO: 736263 - protein, 9 aa, Homo Sapiens
HLGAAIWPK

SEQ ID NO: 736264 - protein, 9 aa, Homo Sapiens
RGSNVAFYK

SEQ ID NO: 736265 - protein, 9 aa, Homo Sapiens
FYMWTFRHM

SEQ ID NO: 736266 - protein, 9 aa, Homo Sapiens
TNNQTLTVV

SEQ ID NO: 736267 - protein, 9 aa, Homo Sapiens
SGAKSTSLV

SEQ ID NO: 736268 - protein, 9 aa, Homo Sapiens
DPHLNCWLR

SEQ ID NO: 736269 - protein, 9 aa, Homo Sapiens
REGGPGEPG

SEQ ID NO: 736270 - protein, 9 aa, Homo Sapiens
SELCAGQFT

SEQ ID NO: 736271 - protein, 9 aa, Homo Sapiens
LSVLRDLSY

SEQ ID NO: 736272 - protein, 9 aa, Homo Sapiens
ELSLSTGMQ

SEQ ID NO: 736273 - protein, 9 aa, Homo Sapiens
SFLGCVAHV

SEQ ID NO: 736274 - protein, 9 aa, Homo Sapiens
AFNSTRYFL

SEQ ID NO: 736275 - protein, 9 aa, Homo Sapiens
HLVAPHACV

SEQ ID NO: 736276 - protein, 9 aa, Homo Sapiens
KDQIWKYCE

SEQ ID NO: 736277 - protein, 9 aa, Homo Sapiens
GISSPSSGL

SEQ ID NO: 736278 - protein, 9 aa, Homo Sapiens
CLMDHNFPA

SEQ ID NO: 736279 - protein, 9 aa, Homo Sapiens
AIKTGSASI

SEQ ID NO: 736280 - protein, 9 aa, Homo Sapiens
VICVFYILQ

SEQ ID NO: 736281 - protein, 9 aa, Homo Sapiens
GPGHRVPHH

SEQ ID NO: 736282 - protein, 9 aa, Homo Sapiens
PVPGEALVV

SEQ ID NO: 736283 - protein, 9 aa, Homo Sapiens
ASSDDDDVS

SEQ ID NO: 736284 - protein, 9 aa, Homo Sapiens
GKFSVISND

SEQ ID NO: 736285 - protein, 9 aa, Homo Sapiens
LPLVLPDLE

SEQ ID NO: 736286 - protein, 9 aa, Homo Sapiens
KTLDAMELY

SEQ ID NO: 736287 - protein, 9 aa, Homo Sapiens
KADAVLRCS

SEQ ID NO: 736288 - protein, 9 aa, Homo Sapiens
PGFMVWCGE

SEQ ID NO: 736289 - protein, 9 aa, Homo Sapiens
NQSAHNLHI

SEQ ID NO: 736290 - protein, 9 aa, Homo Sapiens
CPLCRNVTA

SEQ ID NO: 736291 - protein, 9 aa, Homo Sapiens
SVMKKLQFD

SEQ ID NO: 736292 - protein, 9 aa, Homo Sapiens
TPCGEWQVG

SEQ ID NO: 736293 - protein, 9 aa, Homo Sapiens
SAHNLHIFL

SEQ ID NO: 736294 - protein, 9 aa, Homo Sapiens
GQAGMMGFP

SEQ ID NO: 736295 - protein, 9 aa, Homo Sapiens
AVLYLLKGR

SEQ ID NO: 736296 - protein, 9 aa, Homo Sapiens
VAAVEEVGL

SEQ ID NO: 736297 - protein, 9 aa, Homo Sapiens
ISFLGCVAH

SEQ ID NO: 736298 - protein, 9 aa, Homo Sapiens
LRYESQLFE

SEQ ID NO: 736299 - protein, 9 aa, Homo Sapiens
SSLSLLIDL

SEQ ID NO: 736300 - protein, 9 aa, Homo Sapiens
SPDAYLKSG

SEQ ID NO: 736301 - protein, 9 aa, Homo Sapiens
LLQKYRLSA

SEQ ID NO: 736302 - protein, 9 aa, Homo Sapiens
QEMEFYMWT

SEQ ID NO: 736303 - protein, 9 aa, Homo Sapiens
KDGDKSFIA

SEQ ID NO: 736304 - protein, 9 aa, Homo Sapiens
PFYRCQNTN

SEQ ID NO: 736305 - protein, 9 aa, Homo Sapiens
PAAPAGPAA

SEQ ID NO: 736306 - protein, 9 aa, Homo Sapiens
GSTQQTQQK

SEQ ID NO: 736307 - protein, 9 aa, Homo Sapiens
QEVQEWEEE

SEQ ID NO: 736308 - protein, 9 aa, Homo Sapiens
QALEGGDVG

SEQ ID NO: 736309 - protein, 9 aa, Homo Sapiens
LSHDQVDMP

SEQ ID NO: 736310 - protein, 9 aa, Homo Sapiens
QLTPKSQPA

SEQ ID NO: 736311 - protein, 9 aa, Homo Sapiens
LLIDLDTKY

SEQ ID NO: 736312 - protein, 9 aa, Homo Sapiens
LSSEHAKSL

SEQ ID NO: 736313 - protein, 9 aa, Homo Sapiens
GASGPGAAR

SEQ ID NO: 736314 - protein, 9 aa, Homo Sapiens
VTTFTKQDV

SEQ ID NO: 736315 - protein, 9 aa, Homo Sapiens
ECVEFTAQP

SEQ ID NO: 736316 - protein, 9 aa, Homo Sapiens
TLVLRDSFV

SEQ ID NO: 736317 - protein, 9 aa, Homo Sapiens
QGSGHQVPV

SEQ ID NO: 736318 - protein, 9 aa, Homo Sapiens
PGLPGPPGT

SEQ ID NO: 736319 - protein, 9 aa, Homo Sapiens
PELTASLPQ

SEQ ID NO: 736320 - protein, 9 aa, Homo Sapiens
PHAEQIVSQ

SEQ ID NO: 736321 - protein, 9 aa, Homo Sapiens
ECRSRTPVN

SEQ ID NO: 736322 - protein, 9 aa, Homo Sapiens
RGQRLPLDV

SEQ ID NO: 736323 - protein, 9 aa, Homo Sapiens
PSLQAPLSM

SEQ ID NO: 736324 - protein, 9 aa, Homo Sapiens
EVRGSNVAF

SEQ ID NO: 736325 - protein, 9 aa, Homo Sapiens
INFDSFVAY

SEQ ID NO: 736326 - protein, 9 aa, Homo Sapiens
GFLNQMNYS

SEQ ID NO: 736327 - protein, 9 aa, Homo Sapiens
EQVRKGGSV

SEQ ID NO: 736328 - protein, 9 aa, Homo Sapiens
RTPIFCPGV

SEQ ID NO: 736329 - protein, 9 aa, Homo Sapiens
IKTGSASIF

SEQ ID NO: 736330 - protein, 9 aa, Homo Sapiens
PKSQPAPAD

SEQ ID NO: 736331 - protein, 9 aa, Homo Sapiens
GLDFQAKQQ

SEQ ID NO: 736332 - protein, 9 aa, Homo Sapiens
YVMPMVNVD

SEQ ID NO: 736333 - protein, 9 aa, Homo Sapiens
YNYHGTGSK

SEQ ID NO: 736334 - protein, 9 aa, Homo Sapiens
IGWPLICMI

SEQ ID NO: 736335 - protein, 9 aa, Homo Sapiens
AGLKLLSSC

SEQ ID NO: 736336 - protein, 9 aa, Homo Sapiens
GQRLPLDVQ

SEQ ID NO: 736337 - protein, 9 aa, Homo Sapiens
EARCPVFER

SEQ ID NO: 736338 - protein, 9 aa, Homo Sapiens
FRKEVTGSS

SEQ ID NO: 736339 - protein, 9 aa, Homo Sapiens
WCGELSLST

SEQ ID NO: 736340 - protein, 9 aa, Homo Sapiens
IVSNLNVTA

SEQ ID NO: 736341 - protein, 9 aa, Homo Sapiens
GDKVNGNCT

SEQ ID NO: 736342 - protein, 9 aa, Homo Sapiens
EDYDSVEQH

SEQ ID NO: 736343 - protein, 9 aa, Homo Sapiens
PVFERQALE

SEQ ID NO: 736344 - protein, 9 aa, Homo Sapiens
SIHCPHNRT

SEQ ID NO: 736345 - protein, 9 aa, Homo Sapiens
PGARGQAGM

SEQ ID NO: 736346 - protein, 9 aa, Homo Sapiens
CCSSAYITH

SEQ ID NO: 736347 - protein, 9 aa, Homo Sapiens
AAPAGPAAP

SEQ ID NO: 736348 - protein, 9 aa, Homo Sapiens
GNLRQHILQ

SEQ ID NO: 736349 - protein, 9 aa, Homo Sapiens
PMQPVPQSS

SEQ ID NO: 736350 - protein, 9 aa, Homo Sapiens
WTFRHMRPE

SEQ ID NO: 736351 - protein, 9 aa, Homo Sapiens
ALPITGTPP

SEQ ID NO: 736352 - protein, 9 aa, Homo Sapiens
LPHHHHHHQ

SEQ ID NO: 736353 - protein, 9 aa, Homo Sapiens
KCLRNKHPQ

SEQ ID NO: 736354 - protein, 9 aa, Homo Sapiens
QTSLLCRVN

SEQ ID NO: 736355 - protein, 9 aa, Homo Sapiens
CSTPSQCRM

SEQ ID NO: 736356 - protein, 9 aa, Homo Sapiens
LRRSPDDIS

SEQ ID NO: 736357 - protein, 9 aa, Homo Sapiens
RIILDLLET

SEQ ID NO: 736358 - protein, 9 aa, Homo Sapiens
APDPFFGIM

SEQ ID NO: 736359 - protein, 9 aa, Homo Sapiens
AHVGVHAQE

SEQ ID NO: 736360 - protein, 9 aa, Homo Sapiens
GVHGCRGHG

SEQ ID NO: 736361 - protein, 9 aa, Homo Sapiens
DCKSLADPA

SEQ ID NO: 736362 - protein, 9 aa, Homo Sapiens
VGEEFSGRG

SEQ ID NO: 736363 - protein, 9 aa, Homo Sapiens
VANGKGIMA

SEQ ID NO: 736364 - protein, 9 aa, Homo Sapiens
SKLIWSKYI

SEQ ID NO: 736365 - protein, 9 aa, Homo Sapiens
RDVPRQILL

SEQ ID NO: 736366 - protein, 9 aa, Homo Sapiens
FASGQLVKF

SEQ ID NO: 736367 - protein, 9 aa, Homo Sapiens
RFTHTLNST

SEQ ID NO: 736368 - protein, 9 aa, Homo Sapiens
HGCRGHGPG

SEQ ID NO: 736369 - protein, 9 aa, Homo Sapiens
GQPMPSWLR

SEQ ID NO: 736370 - protein, 9 aa, Homo Sapiens
GLKTRFSSC

SEQ ID NO: 736371 - protein, 9 aa, Homo Sapiens
LTGDNLCKD

SEQ ID NO: 736372 - protein, 9 aa, Homo Sapiens
PIKKPEAHA

SEQ ID NO: 736373 - protein, 9 aa, Homo Sapiens
MGGMNRGPI

SEQ ID NO: 736374 - protein, 9 aa, Homo Sapiens
TVFPGPVVD

SEQ ID NO: 736375 - protein, 9 aa, Homo Sapiens
RGMEGTTAR

SEQ ID NO: 736376 - protein, 9 aa, Homo Sapiens
DHNFPAFVE

SEQ ID NO: 736377 - protein, 9 aa, Homo Sapiens
RLRGEDSRG

SEQ ID NO: 736378 - protein, 9 aa, Homo Sapiens
LSEYQEPLH

SEQ ID NO: 736379 - protein, 9 aa, Homo Sapiens
LSYHKNNPH

SEQ ID NO: 736380 - protein, 9 aa, Homo Sapiens
ALLMQDTHR

SEQ ID NO: 736381 - protein, 9 aa, Homo Sapiens
PDAYLKSGG

SEQ ID NO: 736382 - protein, 9 aa, Homo Sapiens
EAENATLSA

SEQ ID NO: 736383 - protein, 9 aa, Homo Sapiens
IIKLEGTLK

SEQ ID NO: 736384 - protein, 9 aa, Homo Sapiens
NVGLRNAWN

SEQ ID NO: 736385 - protein, 9 aa, Homo Sapiens
PITGTPPPN

SEQ ID NO: 736386 - protein, 9 aa, Homo Sapiens
NFDSFVAYM

SEQ ID NO: 736387 - protein, 9 aa, Homo Sapiens
KTMIPLRPC

SEQ ID NO: 736388 - protein, 9 aa, Homo Sapiens
HGASGPGAA

SEQ ID NO: 736389 - protein, 9 aa, Homo Sapiens
KSMDSKCQK

SEQ ID NO: 736390 - protein, 9 aa, Homo Sapiens
CLRNKHPQE

SEQ ID NO: 736391 - protein, 9 aa, Homo Sapiens
DTTAPVLMG

SEQ ID NO: 736392 - protein, 9 aa, Homo Sapiens
PRYSTIDQK

SEQ ID NO: 736393 - protein, 9 aa, Homo Sapiens
DTASSDDRS

SEQ ID NO: 736394 - protein, 9 aa, Homo Sapiens
SEQALPITG

SEQ ID NO: 736395 - protein, 9 aa, Homo Sapiens
IVMSAISSQ

SEQ ID NO: 736396 - protein, 9 aa, Homo Sapiens
IPCQHSKEA

SEQ ID NO: 736397 - protein, 9 aa, Homo Sapiens
DREGKPKSS

SEQ ID NO: 736398 - protein, 9 aa, Homo Sapiens
YPPVDDPQS

SEQ ID NO: 736399 - protein, 9 aa, Homo Sapiens
LLPMQPVPQ

SEQ ID NO: 736400 - protein, 9 aa, Homo Sapiens
PFVLRALRS

SEQ ID NO: 736401 - protein, 9 aa, Homo Sapiens
GLRHFGLCD

SEQ ID NO: 736402 - protein, 9 aa, Homo Sapiens
DNAPVFDHY

SEQ ID NO: 736403 - protein, 9 aa, Homo Sapiens
NSLSELCAG

SEQ ID NO: 736404 - protein, 9 aa, Homo Sapiens
QGYYLQIHP

SEQ ID NO: 736405 - protein, 9 aa, Homo Sapiens
FLPKETVHS

SEQ ID NO: 736406 - protein, 9 aa, Homo Sapiens
PPHPTTRLL

SEQ ID NO: 736407 - protein, 9 aa, Homo Sapiens
KNGTETLAP

SEQ ID NO: 736408 - protein, 9 aa, Homo Sapiens
ISIVAKNSV

SEQ ID NO: 736409 - protein, 9 aa, Homo Sapiens
VSYDAEDLE

SEQ ID NO: 736410 - protein, 9 aa, Homo Sapiens
EIAPYFQRL

SEQ ID NO: 736411 - protein, 9 aa, Homo Sapiens
LPPSSANPG

SEQ ID NO: 736412 - protein, 9 aa, Homo Sapiens
SDDRSPRHY

SEQ ID NO: 736413 - protein, 9 aa, Homo Sapiens
KKDETMSYG

SEQ ID NO: 736414 - protein, 9 aa, Homo Sapiens
EESVEHDVL

SEQ ID NO: 736415 - protein, 9 aa, Homo Sapiens
EMEFPCHLW

SEQ ID NO: 736416 - protein, 9 aa, Homo Sapiens
ANRNIVSNL

SEQ ID NO: 736417 - protein, 9 aa, Homo Sapiens
GAESATVPY

SEQ ID NO: 736418 - protein, 9 aa, Homo Sapiens
CVSYFRSKN

SEQ ID NO: 736419 - protein, 9 aa, Homo Sapiens
LQSRQSFVF

SEQ ID NO: 736420 - protein, 9 aa, Homo Sapiens
PECKSMEVL

SEQ ID NO: 736421 - protein, 9 aa, Homo Sapiens
RLRVVRDGP

SEQ ID NO: 736422 - protein, 9 aa, Homo Sapiens
PTNLLLDTL

SEQ ID NO: 736423 - protein, 9 aa, Homo Sapiens
HRSYGDLSP

SEQ ID NO: 736424 - protein, 9 aa, Homo Sapiens
TQTAKEAQL

SEQ ID NO: 736425 - protein, 9 aa, Homo Sapiens
FNSTRYFLF

SEQ ID NO: 736426 - protein, 9 aa, Homo Sapiens
KIATFQIAA

SEQ ID NO: 736427 - protein, 9 aa, Homo Sapiens
EVQEWEEEQ

SEQ ID NO: 736428 - protein, 9 aa, Homo Sapiens
MLAEAHLEI

SEQ ID NO: 736429 - protein, 9 aa, Homo Sapiens
QAAVTSESS

SEQ ID NO: 736430 - protein, 9 aa, Homo Sapiens
FPCIIQLYM

SEQ ID NO: 736431 - protein, 9 aa, Homo Sapiens
SSNMTDGDS

SEQ ID NO: 736432 - protein, 9 aa, Homo Sapiens
PPATQGSTG

SEQ ID NO: 736433 - protein, 9 aa, Homo Sapiens
ESKNSNFAT

SEQ ID NO: 736434 - protein, 9 aa, Homo Sapiens
NQSIHCPHN

SEQ ID NO: 736435 - protein, 9 aa, Homo Sapiens
SGNRSDGSG

SEQ ID NO: 736436 - protein, 9 aa, Homo Sapiens
QNLGKLNKV

SEQ ID NO: 736437 - protein, 9 aa, Homo Sapiens
DLDTKYQVT

SEQ ID NO: 736438 - protein, 9 aa, Homo Sapiens
AQRLRLPER

SEQ ID NO: 736439 - protein, 9 aa, Homo Sapiens
GPRIKCVWN

SEQ ID NO: 736440 - protein, 9 aa, Homo Sapiens
GTSYYLSPE

SEQ ID NO: 736441 - protein, 9 aa, Homo Sapiens
ITAPEKRSL

SEQ ID NO: 736442 - protein, 9 aa, Homo Sapiens
ASSNVGINR

SEQ ID NO: 736443 - protein, 9 aa, Homo Sapiens
EGLASPHDV

SEQ ID NO: 736444 - protein, 9 aa, Homo Sapiens
QGPRRGLGH

SEQ ID NO: 736445 - protein, 9 aa, Homo Sapiens
FGQHESKSG

SEQ ID NO: 736446 - protein, 9 aa, Homo Sapiens
SECLLLSMM

SEQ ID NO: 736447 - protein, 9 aa, Homo Sapiens
VKNKVGPWG

SEQ ID NO: 736448 - protein, 9 aa, Homo Sapiens
STVLSMYVA

SEQ ID NO: 736449 - protein, 9 aa, Homo Sapiens
FKILLYSQH

SEQ ID NO: 736450 - protein, 9 aa, Homo Sapiens
DPFAHSRDA

SEQ ID NO: 736451 - protein, 9 aa, Homo Sapiens
ISFMTPNTI

SEQ ID NO: 736452 - protein, 9 aa, Homo Sapiens
RQALEGGDV

SEQ ID NO: 736453 - protein, 9 aa, Homo Sapiens
SLADPASSD

SEQ ID NO: 736454 - protein, 9 aa, Homo Sapiens
IHDSQTNRT

SEQ ID NO: 736455 - protein, 9 aa, Homo Sapiens
TCPNLGGAS

SEQ ID NO: 736456 - protein, 9 aa, Homo Sapiens
REGKPKSSG

SEQ ID NO: 736457 - protein, 9 aa, Homo Sapiens
VFTKKMGNQ

SEQ ID NO: 736458 - protein, 9 aa, Homo Sapiens
QRLRVVRDG

SEQ ID NO: 736459 - protein, 9 aa, Homo Sapiens
EKAPPVSHV

SEQ ID NO: 736460 - protein, 9 aa, Homo Sapiens
EEMKKCIKD

SEQ ID NO: 736461 - protein, 9 aa, Homo Sapiens
QSIHCPHNR

SEQ ID NO: 736462 - protein, 9 aa, Homo Sapiens
RGHQAAVTS

SEQ ID NO: 736463 - protein, 9 aa, Homo Sapiens
SVHAIQDPA

SEQ ID NO: 736464 - protein, 9 aa, Homo Sapiens
RVNTGRSTV

SEQ ID NO: 736465 - protein, 9 aa, Homo Sapiens
GLGPAKRAL

SEQ ID NO: 736466 - protein, 9 aa, Homo Sapiens
VYFEGTRDS

SEQ ID NO: 736467 - protein, 9 aa, Homo Sapiens
FYRCQNTNS

SEQ ID NO: 736468 - protein, 9 aa, Homo Sapiens
RNIIHETQT

SEQ ID NO: 736469 - protein, 9 aa, Homo Sapiens
VFTDAVIHG

SEQ ID NO: 736470 - protein, 9 aa, Homo Sapiens
GDAGAAAEW

SEQ ID NO: 736471 - protein, 9 aa, Homo Sapiens
FQILVELLQ

SEQ ID NO: 736472 - protein, 9 aa, Homo Sapiens
GRTPIFCPG

SEQ ID NO: 736473 - protein, 9 aa, Homo Sapiens
SEITKQEKD

SEQ ID NO: 736474 - protein, 9 aa, Homo Sapiens
YCNQHVEIA

SEQ ID NO: 736475 - protein, 9 aa, Homo Sapiens
LPAGADMDR

SEQ ID NO: 736476 - protein, 9 aa, Homo Sapiens
HKAFSTCCS

SEQ ID NO: 736477 - protein, 9 aa, Homo Sapiens
ELCKNAGPR

SEQ ID NO: 736478 - protein, 9 aa, Homo Sapiens
EGGGRRAWP

SEQ ID NO: 736479 - protein, 9 aa, Homo Sapiens
SRSTGSSLH

SEQ ID NO: 736480 - protein, 9 aa, Homo Sapiens
AGRDREVGS

SEQ ID NO: 736481 - protein, 9 aa, Homo Sapiens
AARLALLLL

SEQ ID NO: 736482 - protein, 9 aa, Homo Sapiens
VGVHAQELQ

SEQ ID NO: 736483 - protein, 9 aa, Homo Sapiens
FSRVCLLIQ

SEQ ID NO: 736484 - protein, 9 aa, Homo Sapiens
QIEGLINHS

SEQ ID NO: 736485 - protein, 9 aa, Homo Sapiens
VNGNCTGIK

SEQ ID NO: 736486 - protein, 9 aa, Homo Sapiens
QILYIFSDK

SEQ ID NO: 736487 - protein, 9 aa, Homo Sapiens
LVKFLPAAV

SEQ ID NO: 736488 - protein, 9 aa, Homo Sapiens
PGLDPERHD

SEQ ID NO: 736489 - protein, 9 aa, Homo Sapiens
IVMVLLKQA

SEQ ID NO: 736490 - protein, 9 aa, Homo Sapiens
HGVAPDAQR

SEQ ID NO: 736491 - protein, 9 aa, Homo Sapiens
DHSSPALSS

SEQ ID NO: 736492 - protein, 9 aa, Homo Sapiens
WPTLWFQSE

SEQ ID NO: 736493 - protein, 9 aa, Homo Sapiens
AQLPGRVAD

SEQ ID NO: 736494 - protein, 9 aa, Homo Sapiens
RCKSEEHLD

SEQ ID NO: 736495 - protein, 9 aa, Homo Sapiens
LPLGIYSAT

SEQ ID NO: 736496 - protein, 9 aa, Homo Sapiens
HHHDELGVL

SEQ ID NO: 736497 - protein, 9 aa, Homo Sapiens
PPGPMVPPG

SEQ ID NO: 736498 - protein, 9 aa, Homo Sapiens
PRLLELAWQ

SEQ ID NO: 736499 - protein, 9 aa, Homo Sapiens
CPVFERQAL

SEQ ID NO: 736500 - protein, 9 aa, Homo Sapiens
ALLPLQQTA

SEQ ID NO: 736501 - protein, 9 aa, Homo Sapiens
PLDSVHQMT

SEQ ID NO: 736502 - protein, 9 aa, Homo Sapiens
SSCDPPALA

SEQ ID NO: 736503 - protein, 9 aa, Homo Sapiens
LKTRFSSCN

SEQ ID NO: 736504 - protein, 9 aa, Homo Sapiens
HDRLREKMR

SEQ ID NO: 736505 - protein, 9 aa, Homo Sapiens
LEPKYWKNR

SEQ ID NO: 736506 - protein, 9 aa, Homo Sapiens
PWFAASSNV

SEQ ID NO: 736507 - protein, 9 aa, Homo Sapiens
TAKGLDFQA

SEQ ID NO: 736508 - protein, 9 aa, Homo Sapiens
MKDSFSNSS

SEQ ID NO: 736509 - protein, 9 aa, Homo Sapiens
GLVDLETLS

SEQ ID NO: 736510 - protein, 9 aa, Homo Sapiens
NAGPRIKCV

SEQ ID NO: 736511 - protein, 9 aa, Homo Sapiens
CAVATCPNL

SEQ ID NO: 736512 - protein, 9 aa, Homo Sapiens
VHQMTIPCG

SEQ ID NO: 736513 - protein, 9 aa, Homo Sapiens
NATLSATTL

SEQ ID NO: 736514 - protein, 9 aa, Homo Sapiens
QTLHWQVIG

SEQ ID NO: 736515 - protein, 9 aa, Homo Sapiens
PKEVHPMVQ

SEQ ID NO: 736516 - protein, 9 aa, Homo Sapiens
TLLPPIIHK

SEQ ID NO: 736517 - protein, 9 aa, Homo Sapiens
IFLLVHVHP

SEQ ID NO: 736518 - protein, 9 aa, Homo Sapiens
NQAQDSSLS

SEQ ID NO: 736519 - protein, 9 aa, Homo Sapiens
RKSSARLPL

SEQ ID NO: 736520 - protein, 9 aa, Homo Sapiens
HQNFEDLEP

SEQ ID NO: 736521 - protein, 9 aa, Homo Sapiens
HLFLLFLGI

SEQ ID NO: 736522 - protein, 9 aa, Homo Sapiens
FTLTQMGPV

SEQ ID NO: 736523 - protein, 9 aa, Homo Sapiens
DRQSSRGKN

SEQ ID NO: 736524 - protein, 9 aa, Homo Sapiens
SSSLKRSFF

SEQ ID NO: 736525 - protein, 9 aa, Homo Sapiens
NRGPILTII

SEQ ID NO: 736526 - protein, 9 aa, Homo Sapiens
KNYDPLLPP

SEQ ID NO: 736527 - protein, 9 aa, Homo Sapiens
PAVEFTLTQ

SEQ ID NO: 736528 - protein, 9 aa, Homo Sapiens
LAMFVQTEM

SEQ ID NO: 736529 - protein, 9 aa, Homo Sapiens
VGLRNAWNI

SEQ ID NO: 736530 - protein, 9 aa, Homo Sapiens
KRVLIPLPV

SEQ ID NO: 736531 - protein, 9 aa, Homo Sapiens
IGVFTIIDD

SEQ ID NO: 736532 - protein, 9 aa, Homo Sapiens
GKASRLAHY

SEQ ID NO: 736533 - protein, 9 aa, Homo Sapiens
PPIIHKNIV

SEQ ID NO: 736534 - protein, 9 aa, Homo Sapiens
LDPGKEGLV

SEQ ID NO: 736535 - protein, 9 aa, Homo Sapiens
FYNTVGMLS

SEQ ID NO: 736536 - protein, 9 aa, Homo Sapiens
LLGANGSAN

SEQ ID NO: 736537 - protein, 9 aa, Homo Sapiens
SAQPLSGSP

SEQ ID NO: 736538 - protein, 9 aa, Homo Sapiens
LSRSTGSSL

SEQ ID NO: 736539 - protein, 9 aa, Homo Sapiens
RARSLVHDL

SEQ ID NO: 736540 - protein, 9 aa, Homo Sapiens
DKGNVRPPG

SEQ ID NO: 736541 - protein, 9 aa, Homo Sapiens
PRDEVTGRL

SEQ ID NO: 736542 - protein, 9 aa, Homo Sapiens
GLGAHGAHV

SEQ ID NO: 736543 - protein, 9 aa, Homo Sapiens
CEQDIKKVC

SEQ ID NO: 736544 - protein, 9 aa, Homo Sapiens
IYSAGDSLI

SEQ ID NO: 736545 - protein, 9 aa, Homo Sapiens
WAHGPSQLI

SEQ ID NO: 736546 - protein, 9 aa, Homo Sapiens
GHFLPTNLL

SEQ ID NO: 736547 - protein, 9 aa, Homo Sapiens
CGKLLGVMA

SEQ ID NO: 736548 - protein, 9 aa, Homo Sapiens
DSRGARYSF

SEQ ID NO: 736549 - protein, 9 aa, Homo Sapiens
TKQDVNKNL

SEQ ID NO: 736550 - protein, 9 aa, Homo Sapiens
SRGARYSFI

SEQ ID NO: 736551 - protein, 9 aa, Homo Sapiens
LTKESYPLV

SEQ ID NO: 736552 - protein, 9 aa, Homo Sapiens
HAVTVPEVP

SEQ ID NO: 736553 - protein, 9 aa, Homo Sapiens
IKALRGGGG

SEQ ID NO: 736554 - protein, 9 aa, Homo Sapiens
LGIVHDAVV

SEQ ID NO: 736555 - protein, 9 aa, Homo Sapiens
MELYRKANY

SEQ ID NO: 736556 - protein, 9 aa, Homo Sapiens
CVEFTAQPA

SEQ ID NO: 736557 - protein, 9 aa, Homo Sapiens
PRIKCVWNK

SEQ ID NO: 736558 - protein, 9 aa, Homo Sapiens
YQPQWKIPM

SEQ ID NO: 736559 - protein, 9 aa, Homo Sapiens
RNAWNIIQA

SEQ ID NO: 736560 - protein, 9 aa, Homo Sapiens
RYDPHLNCW

SEQ ID NO: 736561 - protein, 9 aa, Homo Sapiens
KYVSVMKKL

SEQ ID NO: 736562 - protein, 9 aa, Homo Sapiens
TETLAPSNT

SEQ ID NO: 736563 - protein, 9 aa, Homo Sapiens
IEILLQKYR

SEQ ID NO: 736564 - protein, 9 aa, Homo Sapiens
KVNGNCTGI

SEQ ID NO: 736565 - protein, 9 aa, Homo Sapiens
AGLAYRAAR

SEQ ID NO: 736566 - protein, 9 aa, Homo Sapiens
SSARLPLKW

SEQ ID NO: 736567 - protein, 9 aa, Homo Sapiens
PSLKTMIPL

SEQ ID NO: 736568 - protein, 9 aa, Homo Sapiens
QSLQRDFSL

SEQ ID NO: 736569 - protein, 9 aa, Homo Sapiens
YFLFRNRGF

SEQ ID NO: 736570 - protein, 9 aa, Homo Sapiens
DVGPLGQRL

SEQ ID NO: 736571 - protein, 9 aa, Homo Sapiens
EMEFYMWTF

SEQ ID NO: 736572 - protein, 9 aa, Homo Sapiens
TKNFNKDQI

SEQ ID NO: 736573 - protein, 9 aa, Homo Sapiens
VSRFLNGCF

SEQ ID NO: 736574 - protein, 9 aa, Homo Sapiens
HDKDDDEEE

SEQ ID NO: 736575 - protein, 9 aa, Homo Sapiens
VEHDVLDDN

SEQ ID NO: 736576 - protein, 9 aa, Homo Sapiens
EDSRGARYS

SEQ ID NO: 736577 - protein, 9 aa, Homo Sapiens
LQILQISNL

SEQ ID NO: 736578 - protein, 9 aa, Homo Sapiens
LYPPVDDPQ

SEQ ID NO: 736579 - protein, 9 aa, Homo Sapiens
NTGRSTVHL

SEQ ID NO: 736580 - protein, 9 aa, Homo Sapiens
MTGSFEFPK

SEQ ID NO: 736581 - protein, 9 aa, Homo Sapiens
PKEVILKMA

SEQ ID NO: 736582 - protein, 9 aa, Homo Sapiens
IRLCFLKAR

SEQ ID NO: 736583 - protein, 9 aa, Homo Sapiens
VFPGPVVDY

SEQ ID NO: 736584 - protein, 9 aa, Homo Sapiens
TPSATAMGA

SEQ ID NO: 736585 - protein, 9 aa, Homo Sapiens
AFSTCCSHM

SEQ ID NO: 736586 - protein, 9 aa, Homo Sapiens
SLSELCAGQ

SEQ ID NO: 736587 - protein, 9 aa, Homo Sapiens
YQEELGEVW

SEQ ID NO: 736588 - protein, 9 aa, Homo Sapiens
EKASEQSAE

SEQ ID NO: 736589 - protein, 9 aa, Homo Sapiens
ENNVGLRNA

SEQ ID NO: 736590 - protein, 9 aa, Homo Sapiens
LVAPHACVL

SEQ ID NO: 736591 - protein, 9 aa, Homo Sapiens
YRYKQRQTR

SEQ ID NO: 736592 - protein, 9 aa, Homo Sapiens
RVFASGQLV

SEQ ID NO: 736593 - protein, 9 aa, Homo Sapiens
LTAYLWIHQ

SEQ ID NO: 736594 - protein, 9 aa, Homo Sapiens
GFSEQGIGL

SEQ ID NO: 736595 - protein, 9 aa, Homo Sapiens
MNLTVNPAA

SEQ ID NO: 736596 - protein, 9 aa, Homo Sapiens
RGVHGCRGH

SEQ ID NO: 736597 - protein, 9 aa, Homo Sapiens
GGGRRAWPT

SEQ ID NO: 736598 - protein, 9 aa, Homo Sapiens
QHVEIARAL

SEQ ID NO: 736599 - protein, 9 aa, Homo Sapiens
DKDDDEEEE

SEQ ID NO: 736600 - protein, 9 aa, Homo Sapiens
ISGDKVNGN

SEQ ID NO: 736601 - protein, 9 aa, Homo Sapiens
KFSVISNDF

SEQ ID NO: 736602 - protein, 9 aa, Homo Sapiens
LQGSKLIWS

SEQ ID NO: 736603 - protein, 9 aa, Homo Sapiens
GRRAWPTLW

SEQ ID NO: 736604 - protein, 9 aa, Homo Sapiens
ALNVTVFPG

SEQ ID NO: 736605 - protein, 9 aa, Homo Sapiens
TKESYPLVV

SEQ ID NO: 736606 - protein, 9 aa, Homo Sapiens
PHHHHHHQP

SEQ ID NO: 736607 - protein, 9 aa, Homo Sapiens
SRFTHTLNS

SEQ ID NO: 736608 - protein, 9 aa, Homo Sapiens
QLSMQASTQ

SEQ ID NO: 736609 - protein, 9 aa, Homo Sapiens
LSLSTDPLV

SEQ ID NO: 736610 - protein, 9 aa, Homo Sapiens
VCSKWYMPR

SEQ ID NO: 736611 - protein, 9 aa, Homo Sapiens
PERHDRLRE

SEQ ID NO: 736612 - protein, 9 aa, Homo Sapiens
ASLPQELTL

SEQ ID NO: 736613 - protein, 9 aa, Homo Sapiens
YYLQIHPDG

SEQ ID NO: 736614 - protein, 9 aa, Homo Sapiens
ALLHSDDDG

SEQ ID NO: 736615 - protein, 9 aa, Homo Sapiens
QPPLFTNTV

SEQ ID NO: 736616 - protein, 9 aa, Homo Sapiens
GGRRAWPTL

SEQ ID NO: 736617 - protein, 9 aa, Homo Sapiens
LRPKMDGAA

SEQ ID NO: 736618 - protein, 9 aa, Homo Sapiens
DVCSKWYMP

SEQ ID NO: 736619 - protein, 9 aa, Homo Sapiens
DEKCVWFKH

SEQ ID NO: 736620 - protein, 9 aa, Homo Sapiens
DWVRKDSRV

SEQ ID NO: 736621 - protein, 9 aa, Homo Sapiens
PPGRKLRGV

SEQ ID NO: 736622 - protein, 9 aa, Homo Sapiens
TVCLSVLRD

SEQ ID NO: 736623 - protein, 9 aa, Homo Sapiens
VAPLVITYV

SEQ ID NO: 736624 - protein, 9 aa, Homo Sapiens
IANRNIVSN

SEQ ID NO: 736625 - protein, 9 aa, Homo Sapiens
GIKFVRAFV

SEQ ID NO: 736626 - protein, 9 aa, Homo Sapiens
TNTVKDRDH

SEQ ID NO: 736627 - protein, 9 aa, Homo Sapiens
EFIRFHQIR

SEQ ID NO: 736628 - protein, 9 aa, Homo Sapiens
GFLFPFLIM

SEQ ID NO: 736629 - protein, 9 aa, Homo Sapiens
EQPSAQPLS

SEQ ID NO: 736630 - protein, 9 aa, Homo Sapiens
HDSQTNRTF

SEQ ID NO: 736631 - protein, 9 aa, Homo Sapiens
IRYVGQNLS

SEQ ID NO: 736632 - protein, 9 aa, Homo Sapiens
KHPQEILLN

SEQ ID NO: 736633 - protein, 9 aa, Homo Sapiens
LQNLGKLNK

SEQ ID NO: 736634 - protein, 9 aa, Homo Sapiens
PQELTLQDV

SEQ ID NO: 736635 - protein, 9 aa, Homo Sapiens
VTFTFLLPI

SEQ ID NO: 736636 - protein, 9 aa, Homo Sapiens
ARGGLPRDE

SEQ ID NO: 736637 - protein, 9 aa, Homo Sapiens
APVFDHYLP

SEQ ID NO: 736638 - protein, 9 aa, Homo Sapiens
EVTGRLLHG

SEQ ID NO: 736639 - protein, 9 aa, Homo Sapiens
PPGYQPGDL

SEQ ID NO: 736640 - protein, 9 aa, Homo Sapiens
ECGKHSQPW

SEQ ID NO: 736641 - protein, 9 aa, Homo Sapiens
PYALLDEHT

SEQ ID NO: 736642 - protein, 9 aa, Homo Sapiens
CRGRAFFFD

SEQ ID NO: 736643 - protein, 9 aa, Homo Sapiens
IKVLPKETL

SEQ ID NO: 736644 - protein, 9 aa, Homo Sapiens
TFTFLGFSD

SEQ ID NO: 736645 - protein, 9 aa, Homo Sapiens
QHLCVFRTV

SEQ ID NO: 736646 - protein, 9 aa, Homo Sapiens
PDAQRLRLP

SEQ ID NO: 736647 - protein, 9 aa, Homo Sapiens
QLPLLMHFQ

SEQ ID NO: 736648 - protein, 9 aa, Homo Sapiens
FHTPSTDTR

SEQ ID NO: 736649 - protein, 9 aa, Homo Sapiens
HSKEALHSK

SEQ ID NO: 736650 - protein, 9 aa, Homo Sapiens
AMPLALQGV

SEQ ID NO: 736651 - protein, 9 aa, Homo Sapiens
IHPDGALDG

SEQ ID NO: 736652 - protein, 9 aa, Homo Sapiens
DEMLHNKGL

SEQ ID NO: 736653 - protein, 9 aa, Homo Sapiens
DFQAKQQYI

SEQ ID NO: 736654 - protein, 9 aa, Homo Sapiens
CLRLDQAWP

SEQ ID NO: 736655 - protein, 9 aa, Homo Sapiens
IVHDAVVFL

SEQ ID NO: 736656 - protein, 9 aa, Homo Sapiens
DPLMKVNDT

SEQ ID NO: 736657 - protein, 9 aa, Homo Sapiens
YVAERFQES

SEQ ID NO: 736658 - protein, 9 aa, Homo Sapiens
KEEWSQISE

SEQ ID NO: 736659 - protein, 9 aa, Homo Sapiens
DANATQCSF

SEQ ID NO: 736660 - protein, 9 aa, Homo Sapiens
GRSTIGMSF

SEQ ID NO: 736661 - protein, 9 aa, Homo Sapiens
QEVLHAAQL

SEQ ID NO: 736662 - protein, 9 aa, Homo Sapiens
YKVVEDEKI

SEQ ID NO: 736663 - protein, 9 aa, Homo Sapiens
CMIFEIYGF

SEQ ID NO: 736664 - protein, 9 aa, Homo Sapiens
PDLKRPSGD

SEQ ID NO: 736665 - protein, 9 aa, Homo Sapiens
KFEDPVLVP

SEQ ID NO: 736666 - protein, 9 aa, Homo Sapiens
AHGAHVGVH

SEQ ID NO: 736667 - protein, 9 aa, Homo Sapiens
KQEKDYKEE

SEQ ID NO: 736668 - protein, 9 aa, Homo Sapiens
ANCEDSSSC

SEQ ID NO: 736669 - protein, 9 aa, Homo Sapiens
LERMGIAQG

SEQ ID NO: 736670 - protein, 9 aa, Homo Sapiens
PLCRNVTAV

SEQ ID NO: 736671 - protein, 9 aa, Homo Sapiens
RITRLPDLK

SEQ ID NO: 736672 - protein, 9 aa, Homo Sapiens
PAAPHGPGA

SEQ ID NO: 736673 - protein, 9 aa, Homo Sapiens
AQEVLHAAQ

SEQ ID NO: 736674 - protein, 9 aa, Homo Sapiens
CEDSSSCAT

SEQ ID NO: 736675 - protein, 9 aa, Homo Sapiens
SHLSQGLRH

SEQ ID NO: 736676 - protein, 9 aa, Homo Sapiens
ATAHPPGYQ

SEQ ID NO: 736677 - protein, 9 aa, Homo Sapiens
GSTGAQRST

SEQ ID NO: 736678 - protein, 9 aa, Homo Sapiens
SSRTSTTSC

SEQ ID NO: 736679 - protein, 9 aa, Homo Sapiens
YHGTGSKVF

SEQ ID NO: 736680 - protein, 9 aa, Homo Sapiens
QCRMKDKST

SEQ ID NO: 736681 - protein, 9 aa, Homo Sapiens
LWGVREGGP

SEQ ID NO: 736682 - protein, 9 aa, Homo Sapiens
ALTNREIVE

SEQ ID NO: 736683 - protein, 9 aa, Homo Sapiens
QELTLQDVE

SEQ ID NO: 736684 - protein, 9 aa, Homo Sapiens
QAKQQYILH

SEQ ID NO: 736685 - protein, 9 aa, Homo Sapiens
GQLDHTQQN

SEQ ID NO: 736686 - protein, 9 aa, Homo Sapiens
KGFSEQGIG

SEQ ID NO: 736687 - protein, 9 aa, Homo Sapiens
VHVHPGYIT

SEQ ID NO: 736688 - protein, 9 aa, Homo Sapiens
FPKEEWSQI

SEQ ID NO: 736689 - protein, 9 aa, Homo Sapiens
AILQGSKLI

SEQ ID NO: 736690 - protein, 9 aa, Homo Sapiens
DMVHQSCND

SEQ ID NO: 736691 - protein, 9 aa, Homo Sapiens
KPAESWELI

SEQ ID NO: 736692 - protein, 9 aa, Homo Sapiens
KDCSTLGEK

SEQ ID NO: 736693 - protein, 9 aa, Homo Sapiens
QPVLQVLGV

SEQ ID NO: 736694 - protein, 9 aa, Homo Sapiens
SALLPLQQT

SEQ ID NO: 736695 - protein, 9 aa, Homo Sapiens
ETCAVSPAA

SEQ ID NO: 736696 - protein, 9 aa, Homo Sapiens
MDGAATKVD

SEQ ID NO: 736697 - protein, 9 aa, Homo Sapiens
GRHDAFQIL

SEQ ID NO: 736698 - protein, 9 aa, Homo Sapiens
GRRSQSSPR

SEQ ID NO: 736699 - protein, 9 aa, Homo Sapiens
FLLVHVHPG

SEQ ID NO: 736700 - protein, 9 aa, Homo Sapiens
QMNYSSHSV

SEQ ID NO: 736701 - protein, 9 aa, Homo Sapiens
KLYDYNLWS

SEQ ID NO: 736702 - protein, 9 aa, Homo Sapiens
NTQPPIRLQ

SEQ ID NO: 736703 - protein, 9 aa, Homo Sapiens
TRDSPLEHH

SEQ ID NO: 736704 - protein, 9 aa, Homo Sapiens
RRAWPTLWF

SEQ ID NO: 736705 - protein, 9 aa, Homo Sapiens
SKYEYRVDM

SEQ ID NO: 736706 - protein, 9 aa, Homo Sapiens
AHNLHIFLL

SEQ ID NO: 736707 - protein, 9 aa, Homo Sapiens
WALSSGNKK

SEQ ID NO: 736708 - protein, 9 aa, Homo Sapiens
CLIASRKMD

SEQ ID NO: 736709 - protein, 9 aa, Homo Sapiens
YATGDRHPT

SEQ ID NO: 736710 - protein, 9 aa, Homo Sapiens
RIVAGVWWF

SEQ ID NO: 736711 - protein, 9 aa, Homo Sapiens
PLSEITKQE

SEQ ID NO: 736712 - protein, 9 aa, Homo Sapiens
SCQSSRTST

SEQ ID NO: 736713 - protein, 9 aa, Homo Sapiens
TYPEPIYLT

SEQ ID NO: 736714 - protein, 9 aa, Homo Sapiens
EQHGDEPGP

SEQ ID NO: 736715 - protein, 9 aa, Homo Sapiens
IRSPLRYNS

SEQ ID NO: 736716 - protein, 9 aa, Homo Sapiens
RNDSRFTHT

SEQ ID NO: 736717 - protein, 9 aa, Homo Sapiens
NVAFYKGFI

SEQ ID NO: 736718 - protein, 9 aa, Homo Sapiens
APAGPAAPA

SEQ ID NO: 736719 - protein, 9 aa, Homo Sapiens
AVIRANGSE

SEQ ID NO: 736720 - protein, 9 aa, Homo Sapiens
PCQHSKEAL

SEQ ID NO: 736721 - protein, 9 aa, Homo Sapiens
SSANPGTGT

SEQ ID NO: 736722 - protein, 9 aa, Homo Sapiens
PMPSWLRQE

SEQ ID NO: 736723 - protein, 9 aa, Homo Sapiens
LTKNFNKDQ

SEQ ID NO: 736724 - protein, 9 aa, Homo Sapiens
MSAISSQMF

SEQ ID NO: 736725 - protein, 9 aa, Homo Sapiens
EHRRHKKRI

SEQ ID NO: 736726 - protein, 9 aa, Homo Sapiens
NVCGNQSIH

SEQ ID NO: 736727 - protein, 9 aa, Homo Sapiens
EKNKTLDAM

SEQ ID NO: 736728 - protein, 9 aa, Homo Sapiens
VGVQRVERN

SEQ ID NO: 736729 - protein, 9 aa, Homo Sapiens
KFQKGSAFT

SEQ ID NO: 736730 - protein, 9 aa, Homo Sapiens
VSQRKHIKR

SEQ ID NO: 736731 - protein, 9 aa, Homo Sapiens
IRKNECRSR

SEQ ID NO: 736732 - protein, 9 aa, Homo Sapiens
IPDKMPGKI

SEQ ID NO: 736733 - protein, 9 aa, Homo Sapiens
HNFPAFVEE

SEQ ID NO: 736734 - protein, 9 aa, Homo Sapiens
VEVLVRDDP

SEQ ID NO: 736735 - protein, 9 aa, Homo Sapiens
SDGSGKNTT

SEQ ID NO: 736736 - protein, 9 aa, Homo Sapiens
PASSDDDDV

SEQ ID NO: 736737 - protein, 9 aa, Homo Sapiens
NIVSNLNVT

SEQ ID NO: 736738 - protein, 9 aa, Homo Sapiens
VKERLCPWS

SEQ ID NO: 736739 - protein, 9 aa, Homo Sapiens
CMGGMNRGP

SEQ ID NO: 736740 - protein, 9 aa, Homo Sapiens
TLANTGCWA

SEQ ID NO: 736741 - protein, 9 aa, Homo Sapiens
KILKPHLFP

SEQ ID NO: 736742 - protein, 9 aa, Homo Sapiens
LLKQAALKQ

SEQ ID NO: 736743 - protein, 9 aa, Homo Sapiens
DRNPRAALE

SEQ ID NO: 736744 - protein, 9 aa, Homo Sapiens
GQILYIFSD

SEQ ID NO: 736745 - protein, 9 aa, Homo Sapiens
EKDYKEEKK

SEQ ID NO: 736746 - protein, 9 aa, Homo Sapiens
VRGHQAAVT

SEQ ID NO: 736747 - protein, 9 aa, Homo Sapiens
ALQGVMDLQ

SEQ ID NO: 736748 - protein, 9 aa, Homo Sapiens
MKLSEQLMD

SEQ ID NO: 736749 - protein, 9 aa, Homo Sapiens
EMWYVTVIN

SEQ ID NO: 736750 - protein, 9 aa, Homo Sapiens
EQADRQSSR

SEQ ID NO: 736751 - protein, 9 aa, Homo Sapiens
QRKSMDSKC

SEQ ID NO: 736752 - protein, 9 aa, Homo Sapiens
KDMEQTVKD

SEQ ID NO: 736753 - protein, 9 aa, Homo Sapiens
NELQVPSCW

SEQ ID NO: 736754 - protein, 9 aa, Homo Sapiens
IYFFLTFLS

SEQ ID NO: 736755 - protein, 9 aa, Homo Sapiens
NPDSFVALL

SEQ ID NO: 736756 - protein, 9 aa, Homo Sapiens
IPMFLAFLV

SEQ ID NO: 736757 - protein, 9 aa, Homo Sapiens
LARTCIGTS

SEQ ID NO: 736758 - protein, 9 aa, Homo Sapiens
QLSYHKNNP

SEQ ID NO: 736759 - protein, 9 aa, Homo Sapiens
SEDCPQASS

SEQ ID NO: 736760 - protein, 9 aa, Homo Sapiens
RNPLRQRLE

SEQ ID NO: 736761 - protein, 9 aa, Homo Sapiens
SVIKVLPKE

SEQ ID NO: 736762 - protein, 9 aa, Homo Sapiens
DSTVDQLSM

SEQ ID NO: 736763 - protein, 9 aa, Homo Sapiens
MIKEEEKRL

SEQ ID NO: 736764 - protein, 9 aa, Homo Sapiens
VAARLALLL

SEQ ID NO: 736765 - protein, 9 aa, Homo Sapiens
NSSEGLASP

SEQ ID NO: 736766 - protein, 9 aa, Homo Sapiens
SNMTDGDSF

SEQ ID NO: 736767 - protein, 9 aa, Homo Sapiens
VDQLSMQAS

SEQ ID NO: 736768 - protein, 9 aa, Homo Sapiens
TFEIESYGY

SEQ ID NO: 736769 - protein, 9 aa, Homo Sapiens
IPDLTTGYK

SEQ ID NO: 736770 - protein, 9 aa, Homo Sapiens
CALLEFKIL

SEQ ID NO: 736771 - protein, 9 aa, Homo Sapiens
LPGPPGTPG

SEQ ID NO: 736772 - protein, 9 aa, Homo Sapiens
KIPMFLAFL

SEQ ID NO: 736773 - protein, 9 aa, Homo Sapiens
PMVQCPFTR

SEQ ID NO: 736774 - protein, 9 aa, Homo Sapiens
VIKVLPKET

SEQ ID NO: 736775 - protein, 9 aa, Homo Sapiens
PKETVHSFI

SEQ ID NO: 736776 - protein, 9 aa, Homo Sapiens
IKKVCETVY

SEQ ID NO: 736777 - protein, 9 aa, Homo Sapiens
AAHEEHLAD

SEQ ID NO: 736778 - protein, 9 aa, Homo Sapiens
QRNSWTPPI

SEQ ID NO: 736779 - protein, 9 aa, Homo Sapiens
GGAIKTGSA

SEQ ID NO: 736780 - protein, 9 aa, Homo Sapiens
KGLDFQAKQ

SEQ ID NO: 736781 - protein, 9 aa, Homo Sapiens
LGHFLPTNL

SEQ ID NO: 736782 - protein, 9 aa, Homo Sapiens
SLPQELTLQ

SEQ ID NO: 736783 - protein, 9 aa, Homo Sapiens
SQTLLPPII

SEQ ID NO: 736784 - protein, 9 aa, Homo Sapiens
TLLSVIKVL

SEQ ID NO: 736785 - protein, 9 aa, Homo Sapiens
YRVDMVHQS

SEQ ID NO: 736786 - protein, 9 aa, Homo Sapiens
DLPVQGSGH

SEQ ID NO: 736787 - protein, 9 aa, Homo Sapiens
QILVELLQA

SEQ ID NO: 736788 - protein, 9 aa, Homo Sapiens
ILYIFSDKT

SEQ ID NO: 736789 - protein, 9 aa, Homo Sapiens
GGFLNQMNY

SEQ ID NO: 736790 - protein, 9 aa, Homo Sapiens
EDSSSCATF

SEQ ID NO: 736791 - protein, 9 aa, Homo Sapiens
EWGGWAAAA

SEQ ID NO: 736792 - protein, 9 aa, Homo Sapiens
ISLFSVAGG

SEQ ID NO: 736793 - protein, 9 aa, Homo Sapiens
PQLPLLMHF

SEQ ID NO: 736794 - protein, 9 aa, Homo Sapiens
LNFTSPSLQ

SEQ ID NO: 736795 - protein, 9 aa, Homo Sapiens
SRVGAGIDS

SEQ ID NO: 736796 - protein, 9 aa, Homo Sapiens
LTPKSQPAP

SEQ ID NO: 736797 - protein, 9 aa, Homo Sapiens
SKSADSLYY

SEQ ID NO: 736798 - protein, 9 aa, Homo Sapiens
PCNTERLDL

SEQ ID NO: 736799 - protein, 9 aa, Homo Sapiens
PDYVRKSSA

SEQ ID NO: 736800 - protein, 9 aa, Homo Sapiens
LRDSFVGQN

SEQ ID NO: 736801 - protein, 9 aa, Homo Sapiens
SEQHQNQAQ

SEQ ID NO: 736802 - protein, 9 aa, Homo Sapiens
DPLLPPMPE

SEQ ID NO: 736803 - protein, 9 aa, Homo Sapiens
YQPGDLGAV

SEQ ID NO: 736804 - protein, 9 aa, Homo Sapiens
VAPHACVLD

SEQ ID NO: 736805 - protein, 9 aa, Homo Sapiens
KKDMEQTVK

SEQ ID NO: 736806 - protein, 9 aa, Homo Sapiens
TKKGVWKNP

SEQ ID NO: 736807 - protein, 9 aa, Homo Sapiens
HHDELGVLG

SEQ ID NO: 736808 - protein, 9 aa, Homo Sapiens
HTKKSNRDS

SEQ ID NO: 736809 - protein, 9 aa, Homo Sapiens
SVISNDFVI

SEQ ID NO: 736810 - protein, 9 aa, Homo Sapiens
TEGKNAVIR

SEQ ID NO: 736811 - protein, 9 aa, Homo Sapiens
HPSKFEDPV

SEQ ID NO: 736812 - protein, 9 aa, Homo Sapiens
PPPGTNKKH

SEQ ID NO: 736813 - protein, 9 aa, Homo Sapiens
HQNQAQDSS

SEQ ID NO: 736814 - protein, 9 aa, Homo Sapiens
DGLRQLLAA

SEQ ID NO: 736815 - protein, 9 aa, Homo Sapiens
GAVLYLLKG

SEQ ID NO: 736816 - protein, 9 aa, Homo Sapiens
DGTDSGFAA

SEQ ID NO: 736817 - protein, 9 aa, Homo Sapiens
DLDGAPRRV

SEQ ID NO: 736818 - protein, 9 aa, Homo Sapiens
DPFFGIMSV

SEQ ID NO: 736819 - protein, 9 aa, Homo Sapiens
DVPRQILLG

SEQ ID NO: 736820 - protein, 9 aa, Homo Sapiens
VPPGLPGLK

SEQ ID NO: 736821 - protein, 9 aa, Homo Sapiens
YVYQLQEFL

SEQ ID NO: 736822 - protein, 9 aa, Homo Sapiens
RLLSHDQVD

SEQ ID NO: 736823 - protein, 9 aa, Homo Sapiens
APLDSVHQM

SEQ ID NO: 736824 - protein, 9 aa, Homo Sapiens
YNSLSELCA

SEQ ID NO: 736825 - protein, 9 aa, Homo Sapiens
YDPHLNCWL

SEQ ID NO: 736826 - protein, 9 aa, Homo Sapiens
CRVNTGRST

SEQ ID NO: 736827 - protein, 9 aa, Homo Sapiens
LSSLGAQCL

SEQ ID NO: 736828 - protein, 9 aa, Homo Sapiens
GPAKRALYR

SEQ ID NO: 736829 - protein, 9 aa, Homo Sapiens
ARGQAGMMG

SEQ ID NO: 736830 - protein, 9 aa, Homo Sapiens
KPKSSGFVC

SEQ ID NO: 736831 - protein, 9 aa, Homo Sapiens
NKKDETMSY

SEQ ID NO: 736832 - protein, 9 aa, Homo Sapiens
GNICNERYV

SEQ ID NO: 736833 - protein, 9 aa, Homo Sapiens
LDFQAKQQY

SEQ ID NO: 736834 - protein, 9 aa, Homo Sapiens
KALRGGGGK

SEQ ID NO: 736835 - protein, 9 aa, Homo Sapiens
GSFHCSCHR

SEQ ID NO: 736836 - protein, 9 aa, Homo Sapiens
DPLVQVSVE

SEQ ID NO: 736837 - protein, 9 aa, Homo Sapiens
PDDISFMTP

SEQ ID NO: 736838 - protein, 9 aa, Homo Sapiens
DAVLRCSVK

SEQ ID NO: 736839 - protein, 9 aa, Homo Sapiens
KRIAAELKC

SEQ ID NO: 736840 - protein, 9 aa, Homo Sapiens
AEHRRHKKR

SEQ ID NO: 736841 - protein, 9 aa, Homo Sapiens
SHVYEYIPH

SEQ ID NO: 736842 - protein, 9 aa, Homo Sapiens
SRDASSTSS

SEQ ID NO: 736843 - protein, 9 aa, Homo Sapiens
VPGEALVVA

SEQ ID NO: 736844 - protein, 9 aa, Homo Sapiens
SRTSTTSCS

SEQ ID NO: 736845 - protein, 9 aa, Homo Sapiens
EWIGLGPAK

SEQ ID NO: 736846 - protein, 9 aa, Homo Sapiens
PPGTPGPPG

SEQ ID NO: 736847 - protein, 9 aa, Homo Sapiens
CVAHVFLAC

SEQ ID NO: 736848 - protein, 9 aa, Homo Sapiens
TGDVADPSH

SEQ ID NO: 736849 - protein, 9 aa, Homo Sapiens
QEGSTQQTQ

SEQ ID NO: 736850 - protein, 9 aa, Homo Sapiens
WFAASSNVG

SEQ ID NO: 736851 - protein, 9 aa, Homo Sapiens
RQILLGASA

SEQ ID NO: 736852 - protein, 9 aa, Homo Sapiens
ERHDRLREK

SEQ ID NO: 736853 - protein, 9 aa, Homo Sapiens
VILKMAADL

SEQ ID NO: 736854 - protein, 9 aa, Homo Sapiens
IAFLPRMEG

SEQ ID NO: 736855 - protein, 9 aa, Homo Sapiens
ERYSSSGCP

SEQ ID NO: 736856 - protein, 9 aa, Homo Sapiens
PDLTTGYKP

SEQ ID NO: 736857 - protein, 9 aa, Homo Sapiens
YDPLLPPMP

SEQ ID NO: 736858 - protein, 9 aa, Homo Sapiens
QQMIKEEEK

SEQ ID NO: 736859 - protein, 9 aa, Homo Sapiens
ELGVLGHGR

SEQ ID NO: 736860 - protein, 9 aa, Homo Sapiens
DYDSVEQHG

SEQ ID NO: 736861 - protein, 9 aa, Homo Sapiens
LLMQDTHRR

SEQ ID NO: 736862 - protein, 9 aa, Homo Sapiens
QAMNSLSAM

SEQ ID NO: 736863 - protein, 9 aa, Homo Sapiens
RTVNYGFED

SEQ ID NO: 736864 - protein, 9 aa, Homo Sapiens
GGLDALYCL

SEQ ID NO: 736865 - protein, 9 aa, Homo Sapiens
LINHSPWNL

SEQ ID NO: 736866 - protein, 9 aa, Homo Sapiens
TSTTSCSCQ

SEQ ID NO: 736867 - protein, 9 aa, Homo Sapiens
DVGEEFSGR

SEQ ID NO: 736868 - protein, 9 aa, Homo Sapiens
MGIAQGNLR

SEQ ID NO: 736869 - protein, 9 aa, Homo Sapiens
HGKRRPECK

SEQ ID NO: 736870 - protein, 9 aa, Homo Sapiens
SLIIRFRTD

SEQ ID NO: 736871 - protein, 9 aa, Homo Sapiens
AQPAGMQDI

SEQ ID NO: 736872 - protein, 9 aa, Homo Sapiens
SGRSKQGGK

SEQ ID NO: 736873 - protein, 9 aa, Homo Sapiens
YIISIVAKN

SEQ ID NO: 736874 - protein, 9 aa, Homo Sapiens
TPHSSGEAS

SEQ ID NO: 736875 - protein, 9 aa, Homo Sapiens
ILVLPMEVL

SEQ ID NO: 736876 - protein, 9 aa, Homo Sapiens
PRMEGTLQA

SEQ ID NO: 736877 - protein, 9 aa, Homo Sapiens
LLEFKILLY

SEQ ID NO: 736878 - protein, 9 aa, Homo Sapiens
YCLRLDQAW

SEQ ID NO: 736879 - protein, 9 aa, Homo Sapiens
QLAYLRKNH

SEQ ID NO: 736880 - protein, 9 aa, Homo Sapiens
GRIVAGVWW

SEQ ID NO: 736881 - protein, 9 aa, Homo Sapiens
GFMVWCGEL

SEQ ID NO: 736882 - protein, 9 aa, Homo Sapiens
ADMDRNPRA

SEQ ID NO: 736883 - protein, 9 aa, Homo Sapiens
VKPSLSPKE

SEQ ID NO: 736884 - protein, 9 aa, Homo Sapiens
QLLAAFVQE

SEQ ID NO: 736885 - protein, 9 aa, Homo Sapiens
LAEAHLEIR

SEQ ID NO: 736886 - protein, 9 aa, Homo Sapiens
QMGLDKCQF

SEQ ID NO: 736887 - protein, 9 aa, Homo Sapiens
LNVTVFPGP

SEQ ID NO: 736888 - protein, 9 aa, Homo Sapiens
EGEETCAVS

SEQ ID NO: 736889 - protein, 9 aa, Homo Sapiens
YVTVINPKM

SEQ ID NO: 736890 - protein, 9 aa, Homo Sapiens
EEKRLQLRK

SEQ ID NO: 736891 - protein, 9 aa, Homo Sapiens
ENVQKQWRH

SEQ ID NO: 736892 - protein, 9 aa, Homo Sapiens
QSAHNLHIF

SEQ ID NO: 736893 - protein, 9 aa, Homo Sapiens
VLGHGRDAR

SEQ ID NO: 736894 - protein, 9 aa, Homo Sapiens
GDSNSHFEP

SEQ ID NO: 736895 - protein, 9 aa, Homo Sapiens
SQRKHIKRK

SEQ ID NO: 736896 - protein, 9 aa, Homo Sapiens
GMSFGNVHL

SEQ ID NO: 736897 - protein, 9 aa, Homo Sapiens
PLLPPMPED

SEQ ID NO: 736898 - protein, 9 aa, Homo Sapiens
FAASSNVGI

SEQ ID NO: 736899 - protein, 9 aa, Homo Sapiens
ISNDFVIAI

SEQ ID NO: 736900 - protein, 9 aa, Homo Sapiens
LPLDVQIFY

SEQ ID NO: 736901 - protein, 9 aa, Homo Sapiens
CKSMEVLSV

SEQ ID NO: 736902 - protein, 9 aa, Homo Sapiens
HRRLLERGY

SEQ ID NO: 736903 - protein, 9 aa, Homo Sapiens
VHSFIPLPF

SEQ ID NO: 736904 - protein, 9 aa, Homo Sapiens
APDAQRLRL

SEQ ID NO: 736905 - protein, 9 aa, Homo Sapiens
EQPPLFTNT

SEQ ID NO: 736906 - protein, 9 aa, Homo Sapiens
NLKLLDLSE

SEQ ID NO: 736907 - protein, 9 aa, Homo Sapiens
PQEGYLQIL

SEQ ID NO: 736908 - protein, 9 aa, Homo Sapiens
AYLWIHQIW

SEQ ID NO: 736909 - protein, 9 aa, Homo Sapiens
STEHTSSSL

SEQ ID NO: 736910 - protein, 9 aa, Homo Sapiens
GHQAAVTSE

SEQ ID NO: 736911 - protein, 9 aa, Homo Sapiens
PPGTNKKHL

SEQ ID NO: 736912 - protein, 9 aa, Homo Sapiens
ALCGDVCTH

SEQ ID NO: 736913 - protein, 9 aa, Homo Sapiens
KAILQGSKL

SEQ ID NO: 736914 - protein, 9 aa, Homo Sapiens
PQPPGRKLR

SEQ ID NO: 736915 - protein, 9 aa, Homo Sapiens
HQIRNPLRQ

SEQ ID NO: 736916 - protein, 9 aa, Homo Sapiens
SPIYFFLTF

SEQ ID NO: 736917 - protein, 9 aa, Homo Sapiens
VLRCSVKEQ

SEQ ID NO: 736918 - protein, 9 aa, Homo Sapiens
WFPGGAIKT

SEQ ID NO: 736919 - protein, 9 aa, Homo Sapiens
YVSVMKKLQ

SEQ ID NO: 736920 - protein, 9 aa, Homo Sapiens
KCIKDFKKI

SEQ ID NO: 736921 - protein, 9 aa, Homo Sapiens
RKRKRTSIT

SEQ ID NO: 736922 - protein, 9 aa, Homo Sapiens
SLQAPLSMA

SEQ ID NO: 736923 - protein, 9 aa, Homo Sapiens
TRLPDLKRP

SEQ ID NO: 736924 - protein, 9 aa, Homo Sapiens
QTAKEAQLG

SEQ ID NO: 736925 - protein, 9 aa, Homo Sapiens
SKSGQSSYG

SEQ ID NO: 736926 - protein, 9 aa, Homo Sapiens
GAKSTSLVA

SEQ ID NO: 736927 - protein, 9 aa, Homo Sapiens
QSSLSLLID

SEQ ID NO: 736928 - protein, 9 aa, Homo Sapiens
KEALIDVGE

SEQ ID NO: 736929 - protein, 9 aa, Homo Sapiens
ECKSMEVLS

SEQ ID NO: 736930 - protein, 9 aa, Homo Sapiens
PQLALLLLL

SEQ ID NO: 736931 - protein, 9 aa, Homo Sapiens
YGLAIITYM

SEQ ID NO: 736932 - protein, 9 aa, Homo Sapiens
PKSKLLVKV

SEQ ID NO: 736933 - protein, 9 aa, Homo Sapiens
EWLLIGVVA

SEQ ID NO: 736934 - protein, 9 aa, Homo Sapiens
PVSTPTMAG

SEQ ID NO: 736935 - protein, 9 aa, Homo Sapiens
HSTIGWAAE

SEQ ID NO: 736936 - protein, 9 aa, Homo Sapiens
TAKEAQLGN

SEQ ID NO: 736937 - protein, 9 aa, Homo Sapiens
DVADPSHTK

SEQ ID NO: 736938 - protein, 9 aa, Homo Sapiens
HQAAVTSES

SEQ ID NO: 736939 - protein, 9 aa, Homo Sapiens
PIYFFLTFL

SEQ ID NO: 736940 - protein, 9 aa, Homo Sapiens
GSPGRDGHQ

SEQ ID NO: 736941 - protein, 9 aa, Homo Sapiens
VLMGTEQLS

SEQ ID NO: 736942 - protein, 9 aa, Homo Sapiens
GKPKSSGFV

SEQ ID NO: 736943 - protein, 9 aa, Homo Sapiens
VVRGHQAAV

SEQ ID NO: 736944 - protein, 9 aa, Homo Sapiens
STEAGGFFS

SEQ ID NO: 736945 - protein, 9 aa, Homo Sapiens
VLVPADVLR

SEQ ID NO: 736946 - protein, 9 aa, Homo Sapiens
KLTKESYPL

SEQ ID NO: 736947 - protein, 9 aa, Homo Sapiens
MEGTTARVK

SEQ ID NO: 736948 - protein, 9 aa, Homo Sapiens
DEQNCTFEI

SEQ ID NO: 736949 - protein, 9 aa, Homo Sapiens
TSITAPEKR

SEQ ID NO: 736950 - protein, 9 aa, Homo Sapiens
HIDKRREYV

SEQ ID NO: 736951 - protein, 9 aa, Homo Sapiens
PFFGIMSVD

SEQ ID NO: 736952 - protein, 9 aa, Homo Sapiens
MWYVTVINP

SEQ ID NO: 736953 - protein, 9 aa, Homo Sapiens
LYQEIAPYF

SEQ ID NO: 736954 - protein, 9 aa, Homo Sapiens
TFRFGHATI

SEQ ID NO: 736955 - protein, 9 aa, Homo Sapiens
GSNVAFYKG

SEQ ID NO: 736956 - protein, 9 aa, Homo Sapiens
ELQQRPRAA

SEQ ID NO: 736957 - protein, 9 aa, Homo Sapiens
EHAKSLIYA

SEQ ID NO: 736958 - protein, 9 aa, Homo Sapiens
TALCGDVCT

SEQ ID NO: 736959 - protein, 9 aa, Homo Sapiens
HSQRIPGST

SEQ ID NO: 736960 - protein, 9 aa, Homo Sapiens
QSLWDEMLH

SEQ ID NO: 736961 - protein, 9 aa, Homo Sapiens
QVSYIPDKM

SEQ ID NO: 736962 - protein, 9 aa, Homo Sapiens
QKYRLSAFV

SEQ ID NO: 736963 - protein, 9 aa, Homo Sapiens
GGDGERNSL

SEQ ID NO: 736964 - protein, 9 aa, Homo Sapiens
LSGAKSTSL

SEQ ID NO: 736965 - protein, 9 aa, Homo Sapiens
EITKQEKDF

SEQ ID NO: 736966 - protein, 9 aa, Homo Sapiens
LAANPFCQA

SEQ ID NO: 736967 - protein, 9 aa, Homo Sapiens
REIVEVFSG

SEQ ID NO: 736968 - protein, 9 aa, Homo Sapiens
NPFCQASAS

SEQ ID NO: 736969 - protein, 9 aa, Homo Sapiens
GFGQHESKS

SEQ ID NO: 736970 - protein, 9 aa, Homo Sapiens
GSSSGSSAR

SEQ ID NO: 736971 - protein, 9 aa, Homo Sapiens
AHRDVPRQI

SEQ ID NO: 736972 - protein, 9 aa, Homo Sapiens
ADSLYYPFI

SEQ ID NO: 736973 - protein, 9 aa, Homo Sapiens
ICMIFEIYG

SEQ ID NO: 736974 - protein, 9 aa, Homo Sapiens
KQEKDFLWS

SEQ ID NO: 736975 - protein, 9 aa, Homo Sapiens
ERMKKDMEQ

SEQ ID NO: 736976 - protein, 9 aa, Homo Sapiens
QDPARSAGK

SEQ ID NO: 736977 - protein, 9 aa, Homo Sapiens
AESWELIID

SEQ ID NO: 736978 - protein, 9 aa, Homo Sapiens
FCPFYNTVG

SEQ ID NO: 736979 - protein, 9 aa, Homo Sapiens
GCPANSFHF

SEQ ID NO: 736980 - protein, 9 aa, Homo Sapiens
VWFPGGAIK

SEQ ID NO: 736981 - protein, 9 aa, Homo Sapiens
LLPPIIHKN

SEQ ID NO: 736982 - protein, 9 aa, Homo Sapiens
TAQPAGMQD

SEQ ID NO: 736983 - protein, 9 aa, Homo Sapiens
NKTLDAMEL

SEQ ID NO: 736984 - protein, 9 aa, Homo Sapiens
EEWGQLDHT

SEQ ID NO: 736985 - protein, 9 aa, Homo Sapiens
LHQRLQWHF

SEQ ID NO: 736986 - protein, 9 aa, Homo Sapiens
NPKMLVDFL

SEQ ID NO: 736987 - protein, 9 aa, Homo Sapiens
RSPDDISFM

SEQ ID NO: 736988 - protein, 9 aa, Homo Sapiens
LIMLTSYTL

SEQ ID NO: 736989 - protein, 9 aa, Homo Sapiens
RKADAVLRC

SEQ ID NO: 736990 - protein, 9 aa, Homo Sapiens
FVLVPADVL

SEQ ID NO: 736991 - protein, 9 aa, Homo Sapiens
GLRQLLAAF

SEQ ID NO: 736992 - protein, 9 aa, Homo Sapiens
CVFYILQSS

SEQ ID NO: 736993 - protein, 9 aa, Homo Sapiens
RLLHGDLPV

SEQ ID NO: 736994 - protein, 9 aa, Homo Sapiens
FQCKFCVSY

SEQ ID NO: 736995 - protein, 9 aa, Homo Sapiens
HKNNPHDPM

SEQ ID NO: 736996 - protein, 9 aa, Homo Sapiens
IRRGLRLWT

SEQ ID NO: 736997 - protein, 9 aa, Homo Sapiens
GDSLIIRFR

SEQ ID NO: 736998 - protein, 9 aa, Homo Sapiens
ATLIQSLYR

SEQ ID NO: 736999 - protein, 9 aa, Homo Sapiens
ALLEFKILL

SEQ ID NO: 737000 - protein, 9 aa, Homo Sapiens
YLQILQISN

SEQ ID NO: 737001 - protein, 9 aa, Homo Sapiens
GWECGKHSQ

SEQ ID NO: 737002 - protein, 9 aa, Homo Sapiens
LETLLSVIK

SEQ ID NO: 737003 - protein, 9 aa, Homo Sapiens
VSSLDTPHR

SEQ ID NO: 737004 - protein, 9 aa, Homo Sapiens
NREIVEVFS

SEQ ID NO: 737005 - protein, 9 aa, Homo Sapiens
DAPDPFFGI

SEQ ID NO: 737006 - protein, 9 aa, Homo Sapiens
GVMARWLRG

SEQ ID NO: 737007 - protein, 9 aa, Homo Sapiens
LLIKIATFQ

SEQ ID NO: 737008 - protein, 9 aa, Homo Sapiens
VPRNIPCNT

SEQ ID NO: 737009 - protein, 9 aa, Homo Sapiens
GPPGTPGPP

SEQ ID NO: 737010 - protein, 9 aa, Homo Sapiens
RDEVTGRLL

SEQ ID NO: 737011 - protein, 9 aa, Homo Sapiens
DAEEDNSGG

SEQ ID NO: 737012 - protein, 9 aa, Homo Sapiens
PVFDHYLPR

SEQ ID NO: 737013 - protein, 9 aa, Homo Sapiens
LKRSFFRSS

SEQ ID NO: 737014 - protein, 9 aa, Homo Sapiens
LICMIFEIY

SEQ ID NO: 737015 - protein, 9 aa, Homo Sapiens
SVEHDVLDD

SEQ ID NO: 737016 - protein, 9 aa, Homo Sapiens
FERQALEGG

SEQ ID NO: 737017 - protein, 9 aa, Homo Sapiens
EEKYVSVMK

SEQ ID NO: 737018 - protein, 9 aa, Homo Sapiens
HQHLCVFRT

SEQ ID NO: 737019 - protein, 9 aa, Homo Sapiens
LLDLSENNL

SEQ ID NO: 737020 - protein, 9 aa, Homo Sapiens
PPRGISSPS

SEQ ID NO: 737021 - protein, 9 aa, Homo Sapiens
TPHRSYGDL

SEQ ID NO: 737022 - protein, 9 aa, Homo Sapiens
LLSRSTGSS

SEQ ID NO: 737023 - protein, 9 aa, Homo Sapiens
GVHAQELQQ

SEQ ID NO: 737024 - protein, 9 aa, Homo Sapiens
SGSSSGSSA

SEQ ID NO: 737025 - protein, 9 aa, Homo Sapiens
LENHYHTFL

SEQ ID NO: 737026 - protein, 9 aa, Homo Sapiens
TVGMKLSEQ

SEQ ID NO: 737027 - protein, 9 aa, Homo Sapiens
AGDSLIIRF

SEQ ID NO: 737028 - protein, 9 aa, Homo Sapiens
NTSGTTFTF

SEQ ID NO: 737029 - protein, 9 aa, Homo Sapiens
HYLPRNLSV

SEQ ID NO: 737030 - protein, 9 aa, Homo Sapiens
LQVPSCWLS

SEQ ID NO: 737031 - protein, 9 aa, Homo Sapiens
RPQLALLLL

SEQ ID NO: 737032 - protein, 9 aa, Homo Sapiens
AGADMDRNP

SEQ ID NO: 737033 - protein, 9 aa, Homo Sapiens
HEEHLADGE

SEQ ID NO: 737034 - protein, 9 aa, Homo Sapiens
DEKRTPHSS

SEQ ID NO: 737035 - protein, 9 aa, Homo Sapiens
PFCQASASI

SEQ ID NO: 737036 - protein, 9 aa, Homo Sapiens
HSDDDGLRQ

SEQ ID NO: 737037 - protein, 9 aa, Homo Sapiens
KMEVAKPAE

SEQ ID NO: 737038 - protein, 9 aa, Homo Sapiens
GELSLSTGM

SEQ ID NO: 737039 - protein, 9 aa, Homo Sapiens
AKRALYRDV

SEQ ID NO: 737040 - protein, 9 aa, Homo Sapiens
TIIDDPETK

SEQ ID NO: 737041 - protein, 9 aa, Homo Sapiens
KECGNGFCC

SEQ ID NO: 737042 - protein, 9 aa, Homo Sapiens
NECRSRTPV

SEQ ID NO: 737043 - protein, 9 aa, Homo Sapiens
ALLHSKWGP

SEQ ID NO: 737044 - protein, 9 aa, Homo Sapiens
NVTAVPGGL

SEQ ID NO: 737045 - protein, 9 aa, Homo Sapiens
RSQSSPRYS

SEQ ID NO: 737046 - protein, 9 aa, Homo Sapiens
PDPFFGIMS

SEQ ID NO: 737047 - protein, 9 aa, Homo Sapiens
LQSSNMTDG

SEQ ID NO: 737048 - protein, 9 aa, Homo Sapiens
TASSDDRSP

SEQ ID NO: 737049 - protein, 9 aa, Homo Sapiens
MNRGPILTI

SEQ ID NO: 737050 - protein, 9 aa, Homo Sapiens
IVAKNSVGS

SEQ ID NO: 737051 - protein, 9 aa, Homo Sapiens
LVAAVFSVV

SEQ ID NO: 737052 - protein, 9 aa, Homo Sapiens
ENEGEETCA

SEQ ID NO: 737053 - protein, 9 aa, Homo Sapiens
VSVEPQGDQ

SEQ ID NO: 737054 - protein, 9 aa, Homo Sapiens
ETLLSVIKV

SEQ ID NO: 737055 - protein, 9 aa, Homo Sapiens
YIPDKMPGK

SEQ ID NO: 737056 - protein, 9 aa, Homo Sapiens
GSLLSRSTG

SEQ ID NO: 737057 - protein, 9 aa, Homo Sapiens
GCVAHVFLA

SEQ ID NO: 737058 - protein, 9 aa, Homo Sapiens
YLTLPQANH

SEQ ID NO: 737059 - protein, 9 aa, Homo Sapiens
GVICVFYIL

SEQ ID NO: 737060 - protein, 9 aa, Homo Sapiens
TMIPLRPCA

SEQ ID NO: 737061 - protein, 9 aa, Homo Sapiens
PRLPVPRAP

SEQ ID NO: 737062 - protein, 9 aa, Homo Sapiens
KLRGVHGCR

SEQ ID NO: 737063 - protein, 9 aa, Homo Sapiens
VALTNREIV

SEQ ID NO: 737064 - protein, 9 aa, Homo Sapiens
HEEFRKEVT

SEQ ID NO: 737065 - protein, 9 aa, Homo Sapiens
RVGATDHSS

SEQ ID NO: 737066 - protein, 9 aa, Homo Sapiens
GGLPRDEVT

SEQ ID NO: 737067 - protein, 9 aa, Homo Sapiens
AYSKLAMFV

SEQ ID NO: 737068 - protein, 9 aa, Homo Sapiens
PRPRDPLFG

SEQ ID NO: 737069 - protein, 9 aa, Homo Sapiens
MMGFPGPKG

SEQ ID NO: 737070 - protein, 9 aa, Homo Sapiens
GSTFYVIMP

SEQ ID NO: 737071 - protein, 9 aa, Homo Sapiens
KERIGYADD

SEQ ID NO: 737072 - protein, 9 aa, Homo Sapiens
PLFTNTVKD

SEQ ID NO: 737073 - protein, 9 aa, Homo Sapiens
RGPILTIIT

SEQ ID NO: 737074 - protein, 9 aa, Homo Sapiens
RCPVFERQA

SEQ ID NO: 737075 - protein, 9 aa, Homo Sapiens
CLSVLRDLS

SEQ ID NO: 737076 - protein, 9 aa, Homo Sapiens
LLGVMARWL

SEQ ID NO: 737077 - protein, 9 aa, Homo Sapiens
VFDHYLPRN

SEQ ID NO: 737078 - protein, 9 aa, Homo Sapiens
DLGQILYIF

SEQ ID NO: 737079 - protein, 9 aa, Homo Sapiens
CDEKCVWFK

SEQ ID NO: 737080 - protein, 9 aa, Homo Sapiens
TRITRLPDL

SEQ ID NO: 737081 - protein, 9 aa, Homo Sapiens
SVPRNIPCN

SEQ ID NO: 737082 - protein, 9 aa, Homo Sapiens
LGYVQAFVG

SEQ ID NO: 737083 - protein, 9 aa, Homo Sapiens
GLGHGASGP

SEQ ID NO: 737084 - protein, 9 aa, Homo Sapiens
IPAGPRKSP

SEQ ID NO: 737085 - protein, 9 aa, Homo Sapiens
RRGLGHGAS

SEQ ID NO: 737086 - protein, 9 aa, Homo Sapiens
NIPCNTERL

SEQ ID NO: 737087 - protein, 9 aa, Homo Sapiens
CCSHMMAVT

SEQ ID NO: 737088 - protein, 9 aa, Homo Sapiens
HHSGPPSTS

SEQ ID NO: 737089 - protein, 9 aa, Homo Sapiens
SPRHYLGDA

SEQ ID NO: 737090 - protein, 9 aa, Homo Sapiens
GPAIDGSGI

SEQ ID NO: 737091 - protein, 9 aa, Homo Sapiens
ALDGGGLSG

SEQ ID NO: 737092 - protein, 9 aa, Homo Sapiens
DQLTPKSQP

SEQ ID NO: 737093 - protein, 9 aa, Homo Sapiens
PSQCRMKDK

SEQ ID NO: 737094 - protein, 9 aa, Homo Sapiens
FLNGCFEDQ

SEQ ID NO: 737095 - protein, 9 aa, Homo Sapiens
IHCPHNRTL

SEQ ID NO: 737096 - protein, 9 aa, Homo Sapiens
VPHRNQAPL

SEQ ID NO: 737097 - protein, 9 aa, Homo Sapiens
WRHLCCGRF

SEQ ID NO: 737098 - protein, 9 aa, Homo Sapiens
VCLLIQHLR

SEQ ID NO: 737099 - protein, 9 aa, Homo Sapiens
IKDFKKIHI

SEQ ID NO: 737100 - protein, 9 aa, Homo Sapiens
TATFRFGHA

SEQ ID NO: 737101 - protein, 9 aa, Homo Sapiens
NCTFEIESY

SEQ ID NO: 737102 - protein, 9 aa, Homo Sapiens
MDHNFPAFV

SEQ ID NO: 737103 - protein, 9 aa, Homo Sapiens
IRNPLRQRL

SEQ ID NO: 737104 - protein, 9 aa, Homo Sapiens
VDEARCPVF

SEQ ID NO: 737105 - protein, 9 aa, Homo Sapiens
YGYFTILNG

SEQ ID NO: 737106 - protein, 9 aa, Homo Sapiens
VLQVLGVDA

SEQ ID NO: 737107 - protein, 9 aa, Homo Sapiens
NTGCWALSS

SEQ ID NO: 737108 - protein, 9 aa, Homo Sapiens
VRPPGTEGD

SEQ ID NO: 737109 - protein, 9 aa, Homo Sapiens
SLLSRSTGS

SEQ ID NO: 737110 - protein, 9 aa, Homo Sapiens
RTSITAPEK

SEQ ID NO: 737111 - protein, 9 aa, Homo Sapiens
KYYCNQHVE

SEQ ID NO: 737112 - protein, 9 aa, Homo Sapiens
LGTALCGDV

SEQ ID NO: 737113 - protein, 9 aa, Homo Sapiens
KEEEKRLQL

SEQ ID NO: 737114 - protein, 9 aa, Homo Sapiens
LTIDTYYNR

SEQ ID NO: 737115 - protein, 9 aa, Homo Sapiens
PPVSHVYEY

SEQ ID NO: 737116 - protein, 9 aa, Homo Sapiens
LYDYNLWSI

SEQ ID NO: 737117 - protein, 9 aa, Homo Sapiens
NSGNRSDGS

SEQ ID NO: 737118 - protein, 9 aa, Homo Sapiens
MKKDMEQTV

SEQ ID NO: 737119 - protein, 9 aa, Homo Sapiens
VDQLTPKSQ

SEQ ID NO: 737120 - protein, 9 aa, Homo Sapiens
RVLIPLPVS

SEQ ID NO: 737121 - protein, 9 aa, Homo Sapiens
ANGSEGECQ

SEQ ID NO: 737122 - protein, 9 aa, Homo Sapiens
RIIYMLLIK

SEQ ID NO: 737123 - protein, 9 aa, Homo Sapiens
DKLFHVTPV

SEQ ID NO: 737124 - protein, 9 aa, Homo Sapiens
MIKALRGGG

SEQ ID NO: 737125 - protein, 9 aa, Homo Sapiens
PDGSHLEQP

SEQ ID NO: 737126 - protein, 9 aa, Homo Sapiens
YEFHTPSTD

SEQ ID NO: 737127 - protein, 9 aa, Homo Sapiens
ELPADTVKR

SEQ ID NO: 737128 - protein, 9 aa, Homo Sapiens
NDFVIAITS

SEQ ID NO: 737129 - protein, 9 aa, Homo Sapiens
ITCPLCRNV

SEQ ID NO: 737130 - protein, 9 aa, Homo Sapiens
DCPQASSVL

SEQ ID NO: 737131 - protein, 9 aa, Homo Sapiens
LSENNLTHL

SEQ ID NO: 737132 - protein, 9 aa, Homo Sapiens
EEEMKKCIK

SEQ ID NO: 737133 - protein, 9 aa, Homo Sapiens
LRFKGSMQR

SEQ ID NO: 737134 - protein, 9 aa, Homo Sapiens
PQKLQNLGK

SEQ ID NO: 737135 - protein, 9 aa, Homo Sapiens
SDSEGQLPD

SEQ ID NO: 737136 - protein, 9 aa, Homo Sapiens
RFVLVPADV

SEQ ID NO: 737137 - protein, 9 aa, Homo Sapiens
EQDTSAYLE

SEQ ID NO: 737138 - protein, 9 aa, Homo Sapiens
PHDPMSGGW

SEQ ID NO: 737139 - protein, 9 aa, Homo Sapiens
SYFRSKNLL

SEQ ID NO: 737140 - protein, 9 aa, Homo Sapiens
PEQPPLFTN

SEQ ID NO: 737141 - protein, 9 aa, Homo Sapiens
SATKFWMYV

SEQ ID NO: 737142 - protein, 9 aa, Homo Sapiens
SDIPCQHSK

SEQ ID NO: 737143 - protein, 9 aa, Homo Sapiens
TNREIVEVF

SEQ ID NO: 737144 - protein, 9 aa, Homo Sapiens
ILQSSLSLL

SEQ ID NO: 737145 - protein, 9 aa, Homo Sapiens
TPHAEQIVS

SEQ ID NO: 737146 - protein, 9 aa, Homo Sapiens
KKMGNQQKV

SEQ ID NO: 737147 - protein, 9 aa, Homo Sapiens
LPMQPVPQS

SEQ ID NO: 737148 - protein, 9 aa, Homo Sapiens
DYGIKFVRA

SEQ ID NO: 737149 - protein, 9 aa, Homo Sapiens
RDSFVGQNS

SEQ ID NO: 737150 - protein, 9 aa, Homo Sapiens
TEYEYKCGD

SEQ ID NO: 737151 - protein, 9 aa, Homo Sapiens
GQLPDYAAG

SEQ ID NO: 737152 - protein, 9 aa, Homo Sapiens
LVEYKGHKW

SEQ ID NO: 737153 - protein, 9 aa, Homo Sapiens
QGIGLYLRK

SEQ ID NO: 737154 - protein, 9 aa, Homo Sapiens
LPQELTLQD

SEQ ID NO: 737155 - protein, 9 aa, Homo Sapiens
SAGDSLIIR

SEQ ID NO: 737156 - protein, 9 aa, Homo Sapiens
VAKPAESWE

SEQ ID NO: 737157 - protein, 9 aa, Homo Sapiens
MMAFDRYKA

SEQ ID NO: 737158 - protein, 9 aa, Homo Sapiens
YADDIVSND

SEQ ID NO: 737159 - protein, 9 aa, Homo Sapiens
SPPQMFPCI

SEQ ID NO: 737160 - protein, 9 aa, Homo Sapiens
QSLYRMHRA

SEQ ID NO: 737161 - protein, 9 aa, Homo Sapiens
SPMKDSFSN

SEQ ID NO: 737162 - protein, 9 aa, Homo Sapiens
EDGTDSGFA

SEQ ID NO: 737163 - protein, 9 aa, Homo Sapiens
HAKSLIYAQ

SEQ ID NO: 737164 - protein, 9 aa, Homo Sapiens
LRCSVKEQQ

SEQ ID NO: 737165 - protein, 9 aa, Homo Sapiens
LVYFEGTRD

SEQ ID NO: 737166 - protein, 9 aa, Homo Sapiens
EMLHNKGLT

SEQ ID NO: 737167 - protein, 9 aa, Homo Sapiens
EFTAQPAGM

SEQ ID NO: 737168 - protein, 9 aa, Homo Sapiens
VLIPLPVSN

SEQ ID NO: 737169 - protein, 9 aa, Homo Sapiens
IPCNTERLD

SEQ ID NO: 737170 - protein, 9 aa, Homo Sapiens
RNTQHQRSA

SEQ ID NO: 737171 - protein, 9 aa, Homo Sapiens
LRLWTSASD

SEQ ID NO: 737172 - protein, 9 aa, Homo Sapiens
PHACVLDSR

SEQ ID NO: 737173 - protein, 9 aa, Homo Sapiens
IIDDKGNVR

SEQ ID NO: 737174 - protein, 9 aa, Homo Sapiens
LRLLQAGEA

SEQ ID NO: 737175 - protein, 9 aa, Homo Sapiens
FVRAFVDAK

SEQ ID NO: 737176 - protein, 9 aa, Homo Sapiens
PSEQALPIT

SEQ ID NO: 737177 - protein, 9 aa, Homo Sapiens
TTGYKPQIS

SEQ ID NO: 737178 - protein, 9 aa, Homo Sapiens
GDLWLLPPS

SEQ ID NO: 737179 - protein, 9 aa, Homo Sapiens
TVINPKMLV

SEQ ID NO: 737180 - protein, 9 aa, Homo Sapiens
FEWLLIGVV

SEQ ID NO: 737181 - protein, 9 aa, Homo Sapiens
NSILTNTQV

SEQ ID NO: 737182 - protein, 9 aa, Homo Sapiens
ETRITRLPD

SEQ ID NO: 737183 - protein, 9 aa, Homo Sapiens
FSVVFTDAV

SEQ ID NO: 737184 - protein, 9 aa, Homo Sapiens
SFEFPKEEW

SEQ ID NO: 737185 - protein, 9 aa, Homo Sapiens
FDHYLPRNL

SEQ ID NO: 737186 - protein, 9 aa, Homo Sapiens
IRDVCSKWY

SEQ ID NO: 737187 - protein, 9 aa, Homo Sapiens
GPSQLIRYV

SEQ ID NO: 737188 - protein, 9 aa, Homo Sapiens
QTRELQEDI

SEQ ID NO: 737189 - protein, 9 aa, Homo Sapiens
LRHFGLCDS

SEQ ID NO: 737190 - protein, 9 aa, Homo Sapiens
IAQGNLRQH

SEQ ID NO: 737191 - protein, 9 aa, Homo Sapiens
PQWKIPMFL

SEQ ID NO: 737192 - protein, 9 aa, Homo Sapiens
KNSPMKDSF

SEQ ID NO: 737193 - protein, 9 aa, Homo Sapiens
EGSTQQTQQ

SEQ ID NO: 737194 - protein, 9 aa, Homo Sapiens
PWSCSRQPE

SEQ ID NO: 737195 - protein, 9 aa, Homo Sapiens
FTAQPAGMQ

SEQ ID NO: 737196 - protein, 9 aa, Homo Sapiens
LINGNICNE

SEQ ID NO: 737197 - protein, 9 aa, Homo Sapiens
VFRTVNYGF

SEQ ID NO: 737198 - protein, 9 aa, Homo Sapiens
IGTSYYLSP

SEQ ID NO: 737199 - protein, 9 aa, Homo Sapiens
GQPYFCVEP

SEQ ID NO: 737200 - protein, 9 aa, Homo Sapiens
EDLGQILYI

SEQ ID NO: 737201 - protein, 9 aa, Homo Sapiens
SLRVPLPRL

SEQ ID NO: 737202 - protein, 9 aa, Homo Sapiens
AMELYRKAN

SEQ ID NO: 737203 - protein, 9 aa, Homo Sapiens
RHGKRRPEC

SEQ ID NO: 737204 - protein, 9 aa, Homo Sapiens
PDSFVALLT

SEQ ID NO: 737205 - protein, 9 aa, Homo Sapiens
GYSLQAMNS

SEQ ID NO: 737206 - protein, 9 aa, Homo Sapiens
RPRAALLHS

SEQ ID NO: 737207 - protein, 9 aa, Homo Sapiens
QGSTGAQRS

SEQ ID NO: 737208 - protein, 9 aa, Homo Sapiens
HRSGSLLSR

SEQ ID NO: 737209 - protein, 9 aa, Homo Sapiens
QPQPPGRKL

SEQ ID NO: 737210 - protein, 9 aa, Homo Sapiens
MGNQQKVND

SEQ ID NO: 737211 - protein, 9 aa, Homo Sapiens
DEDSEAENA

SEQ ID NO: 737212 - protein, 9 aa, Homo Sapiens
GDAEEDNSG

SEQ ID NO: 737213 - protein, 9 aa, Homo Sapiens
TVPYQEELG

SEQ ID NO: 737214 - protein, 9 aa, Homo Sapiens
MSGRSKQGG

SEQ ID NO: 737215 - protein, 9 aa, Homo Sapiens
PFTHLNTTT

SEQ ID NO: 737216 - protein, 9 aa, Homo Sapiens
LASPHDVLE

SEQ ID NO: 737217 - protein, 9 aa, Homo Sapiens
VRDGPGHRV

SEQ ID NO: 737218 - protein, 9 aa, Homo Sapiens
ERIGYADDI

SEQ ID NO: 737219 - protein, 9 aa, Homo Sapiens
GPPGPMVPP

SEQ ID NO: 737220 - protein, 9 aa, Homo Sapiens
GPRRGLGHG

SEQ ID NO: 737221 - protein, 9 aa, Homo Sapiens
CQNTNSVEK

SEQ ID NO: 737222 - protein, 9 aa, Homo Sapiens
GAQRSTATQ

SEQ ID NO: 737223 - protein, 9 aa, Homo Sapiens
EAESKNSNF

SEQ ID NO: 737224 - protein, 9 aa, Homo Sapiens
AHGPSQLIR

SEQ ID NO: 737225 - protein, 9 aa, Homo Sapiens
QIVGVQRVE

SEQ ID NO: 737226 - protein, 9 aa, Homo Sapiens
LPADTVKRI

SEQ ID NO: 737227 - protein, 9 aa, Homo Sapiens
QGVMDLQEI

SEQ ID NO: 737228 - protein, 9 aa, Homo Sapiens
CVWFKHPEN

SEQ ID NO: 737229 - protein, 9 aa, Homo Sapiens
NNVGLRNAW

SEQ ID NO: 737230 - protein, 9 aa, Homo Sapiens
CCRGSVKNK

SEQ ID NO: 737231 - protein, 9 aa, Homo Sapiens
EAQEVLHAA

SEQ ID NO: 737232 - protein, 9 aa, Homo Sapiens
EQIVSQQRI

SEQ ID NO: 737233 - protein, 9 aa, Homo Sapiens
CPPHPTTRL

SEQ ID NO: 737234 - protein, 9 aa, Homo Sapiens
QRSASTAPS

SEQ ID NO: 737235 - protein, 9 aa, Homo Sapiens
LDEQNCTFE

SEQ ID NO: 737236 - protein, 9 aa, Homo Sapiens
LPKETVHSF

SEQ ID NO: 737237 - protein, 9 aa, Homo Sapiens
PSVLSLSTD

SEQ ID NO: 737238 - protein, 9 aa, Homo Sapiens
DTPHRSYGD

SEQ ID NO: 737239 - protein, 9 aa, Homo Sapiens
GLAYRAARE

SEQ ID NO: 737240 - protein, 9 aa, Homo Sapiens
RGGLPRDEV

SEQ ID NO: 737241 - protein, 9 aa, Homo Sapiens
LVDLETLSA

SEQ ID NO: 737242 - protein, 9 aa, Homo Sapiens
YVAYSTQSS

SEQ ID NO: 737243 - protein, 9 aa, Homo Sapiens
VQIFYCARP

SEQ ID NO: 737244 - protein, 9 aa, Homo Sapiens
KCVWFKHPE

SEQ ID NO: 737245 - protein, 9 aa, Homo Sapiens
EDEKILKPH

SEQ ID NO: 737246 - protein, 9 aa, Homo Sapiens
SIGRLSEYQ

SEQ ID NO: 737247 - protein, 9 aa, Homo Sapiens
LKHASTEAG

SEQ ID NO: 737248 - protein, 9 aa, Homo Sapiens
QCAMGDRGM

SEQ ID NO: 737249 - protein, 9 aa, Homo Sapiens
SLSGRIVAG

SEQ ID NO: 737250 - protein, 9 aa, Homo Sapiens
QCKFCVSYF

SEQ ID NO: 737251 - protein, 9 aa, Homo Sapiens
VLVPLQEFA

SEQ ID NO: 737252 - protein, 9 aa, Homo Sapiens
SLYYPFIVP

SEQ ID NO: 737253 - protein, 9 aa, Homo Sapiens
EVGLGAHGA

SEQ ID NO: 737254 - protein, 9 aa, Homo Sapiens
FQAKQQYIL

SEQ ID NO: 737255 - protein, 9 aa, Homo Sapiens
EALDGGGLS

SEQ ID NO: 737256 - protein, 9 aa, Homo Sapiens
APRRVDEAR

SEQ ID NO: 737257 - protein, 9 aa, Homo Sapiens
PSAQPLSGS

SEQ ID NO: 737258 - protein, 9 aa, Homo Sapiens
GVAPDAQRL

SEQ ID NO: 737259 - protein, 9 aa, Homo Sapiens
SGRIVAGVW

SEQ ID NO: 737260 - protein, 9 aa, Homo Sapiens
APEETGSSD

SEQ ID NO: 737261 - protein, 9 aa, Homo Sapiens
SYLKHASTE

SEQ ID NO: 737262 - protein, 9 aa, Homo Sapiens
LDSVHQMTI

SEQ ID NO: 737263 - protein, 9 aa, Homo Sapiens
YSSSGCPAN

SEQ ID NO: 737264 - protein, 9 aa, Homo Sapiens
KTAKGLDFQ

SEQ ID NO: 737265 - protein, 9 aa, Homo Sapiens
PLVITYVRE

SEQ ID NO: 737266 - protein, 9 aa, Homo Sapiens
TGSSDDTAS

SEQ ID NO: 737267 - protein, 9 aa, Homo Sapiens
DMPYQWEYP

SEQ ID NO: 737268 - protein, 9 aa, Homo Sapiens
VIGNPRCQG

SEQ ID NO: 737269 - protein, 9 aa, Homo Sapiens
QWKIPMFLA

SEQ ID NO: 737270 - protein, 9 aa, Homo Sapiens
KNGPAIDGS

SEQ ID NO: 737271 - protein, 9 aa, Homo Sapiens
DPLSEITKQ

SEQ ID NO: 737272 - protein, 9 aa, Homo Sapiens
RIGYADDIV

SEQ ID NO: 737273 - protein, 9 aa, Homo Sapiens
WRRMEEQQH

SEQ ID NO: 737274 - protein, 9 aa, Homo Sapiens
CAALNVTVF

SEQ ID NO: 737275 - protein, 9 aa, Homo Sapiens
DVNKNLISY

SEQ ID NO: 737276 - protein, 9 aa, Homo Sapiens
NIIHETQTA

SEQ ID NO: 737277 - protein, 9 aa, Homo Sapiens
QVDQLTPKS

SEQ ID NO: 737278 - protein, 9 aa, Homo Sapiens
IYLTLPQAN

SEQ ID NO: 737279 - protein, 9 aa, Homo Sapiens
PELQLHLFL

SEQ ID NO: 737280 - protein, 9 aa, Homo Sapiens
IGMSFGNVH

SEQ ID NO: 737281 - protein, 9 aa, Homo Sapiens
GLYLRKRHH

SEQ ID NO: 737282 - protein, 9 aa, Homo Sapiens
PASRPQLAL

SEQ ID NO: 737283 - protein, 9 aa, Homo Sapiens
SALLHSKWG

SEQ ID NO: 737284 - protein, 9 aa, Homo Sapiens
NAPVFDHYL

SEQ ID NO: 737285 - protein, 9 aa, Homo Sapiens
MAADESVGT

SEQ ID NO: 737286 - protein, 9 aa, Homo Sapiens
TENNVGLRN

SEQ ID NO: 737287 - protein, 9 aa, Homo Sapiens
SFVGQNSST

SEQ ID NO: 737288 - protein, 9 aa, Homo Sapiens
GDVADPSHT

SEQ ID NO: 737289 - protein, 9 aa, Homo Sapiens
FTSPSLQAP

SEQ ID NO: 737290 - protein, 9 aa, Homo Sapiens
KDDDEEEEE

SEQ ID NO: 737291 - protein, 9 aa, Homo Sapiens
HLERMKKDM

SEQ ID NO: 737292 - protein, 9 aa, Homo Sapiens
LFHVTPVTQ

SEQ ID NO: 737293 - protein, 9 aa, Homo Sapiens
NGPAIDGSG

SEQ ID NO: 737294 - protein, 9 aa, Homo Sapiens
LGVDADLDG

SEQ ID NO: 737295 - protein, 9 aa, Homo Sapiens
SKGDSPQEK

SEQ ID NO: 737296 - protein, 9 aa, Homo Sapiens
EGTRDSPLE

SEQ ID NO: 737297 - protein, 9 aa, Homo Sapiens
WQVIGNPRC

SEQ ID NO: 737298 - protein, 9 aa, Homo Sapiens
QTLLPPIIH

SEQ ID NO: 737299 - protein, 9 aa, Homo Sapiens
FEGTRDSPL

SEQ ID NO: 737300 - protein, 9 aa, Homo Sapiens
ANGKGIMAA

SEQ ID NO: 737301 - protein, 9 aa, Homo Sapiens
LCLMDHNFP

SEQ ID NO: 737302 - protein, 9 aa, Homo Sapiens
LYYPFIVPK

SEQ ID NO: 737303 - protein, 9 aa, Homo Sapiens
CCRRCKSEE

SEQ ID NO: 737304 - protein, 9 aa, Homo Sapiens
PGTNKKHLS

SEQ ID NO: 737305 - protein, 9 aa, Homo Sapiens
PAESWELII

SEQ ID NO: 737306 - protein, 9 aa, Homo Sapiens
RDPLSEITK

SEQ ID NO: 737307 - protein, 9 aa, Homo Sapiens
DDISFMTPN

SEQ ID NO: 737308 - protein, 9 aa, Homo Sapiens
VAHVFLACS

SEQ ID NO: 737309 - protein, 9 aa, Homo Sapiens
TIGMSFGNV

SEQ ID NO: 737310 - protein, 9 aa, Homo Sapiens
GDRAAIPAG

SEQ ID NO: 737311 - protein, 9 aa, Homo Sapiens
KAKRFVETL

SEQ ID NO: 737312 - protein, 9 aa, Homo Sapiens
PSHTKYSLQ

SEQ ID NO: 737313 - protein, 9 aa, Homo Sapiens
PDTIMQCAM

SEQ ID NO: 737314 - protein, 9 aa, Homo Sapiens
MFPCIIQLY

SEQ ID NO: 737315 - protein, 9 aa, Homo Sapiens
EHTSSSLKR

SEQ ID NO: 737316 - protein, 9 aa, Homo Sapiens
LVTMNKKDE

SEQ ID NO: 737317 - protein, 9 aa, Homo Sapiens
CQASASIMA

SEQ ID NO: 737318 - protein, 9 aa, Homo Sapiens
HVHPGYITR

SEQ ID NO: 737319 - protein, 9 aa, Homo Sapiens
QGDQGLESL

SEQ ID NO: 737320 - protein, 9 aa, Homo Sapiens
KLLDLSENN

SEQ ID NO: 737321 - protein, 9 aa, Homo Sapiens
QSSDGLLTV

SEQ ID NO: 737322 - protein, 9 aa, Homo Sapiens
ANGAAANPE

SEQ ID NO: 737323 - protein, 9 aa, Homo Sapiens
QSHQEGSTQ

SEQ ID NO: 737324 - protein, 9 aa, Homo Sapiens
FLIMLTSYT

SEQ ID NO: 737325 - protein, 9 aa, Homo Sapiens
LADGEVAQP

SEQ ID NO: 737326 - protein, 9 aa, Homo Sapiens
VTVFPGPVV

SEQ ID NO: 737327 - protein, 9 aa, Homo Sapiens
KDETMSYGG

SEQ ID NO: 737328 - protein, 9 aa, Homo Sapiens
VCISILYPP

SEQ ID NO: 737329 - protein, 9 aa, Homo Sapiens
NFTSPSLQA

SEQ ID NO: 737330 - protein, 9 aa, Homo Sapiens
IGCSLSEDC

SEQ ID NO: 737331 - protein, 9 aa, Homo Sapiens
HETQTAKEA

SEQ ID NO: 737332 - protein, 9 aa, Homo Sapiens
QLIRRGLRL

SEQ ID NO: 737333 - protein, 9 aa, Homo Sapiens
ATQGSTGAQ

SEQ ID NO: 737334 - protein, 9 aa, Homo Sapiens
SHLVAPHAC

SEQ ID NO: 737335 - protein, 9 aa, Homo Sapiens
SKQGGKARA

SEQ ID NO: 737336 - protein, 9 aa, Homo Sapiens
GPILTIITL

SEQ ID NO: 737337 - protein, 9 aa, Homo Sapiens
DAGAAAEWG

SEQ ID NO: 737338 - protein, 9 aa, Homo Sapiens
ISSQMFCFV

SEQ ID NO: 737339 - protein, 9 aa, Homo Sapiens
RKHIKRKAP

SEQ ID NO: 737340 - protein, 9 aa, Homo Sapiens
LIDVGEEFS

SEQ ID NO: 737341 - protein, 9 aa, Homo Sapiens
SATAMGAAD

SEQ ID NO: 737342 - protein, 9 aa, Homo Sapiens
YLKSGGRQS

SEQ ID NO: 737343 - protein, 9 aa, Homo Sapiens
DSEAENATL

SEQ ID NO: 737344 - protein, 9 aa, Homo Sapiens
RAEPPRPRD

SEQ ID NO: 737345 - protein, 9 aa, Homo Sapiens
LLRPKMDGA

SEQ ID NO: 737346 - protein, 9 aa, Homo Sapiens
VVRDGPGHR

SEQ ID NO: 737347 - protein, 9 aa, Homo Sapiens
AVKEALIDV

SEQ ID NO: 737348 - protein, 9 aa, Homo Sapiens
INQSAHNLH

SEQ ID NO: 737349 - protein, 9 aa, Homo Sapiens
SLLIDLDTK

SEQ ID NO: 737350 - protein, 9 aa, Homo Sapiens
QEITHCHDK

SEQ ID NO: 737351 - protein, 9 aa, Homo Sapiens
MEQADRQSS

SEQ ID NO: 737352 - protein, 9 aa, Homo Sapiens
TCAVSPAAP

SEQ ID NO: 737353 - protein, 9 aa, Homo Sapiens
PKYWKNRIY

SEQ ID NO: 737354 - protein, 9 aa, Homo Sapiens
ACEQDIKKV

SEQ ID NO: 737355 - protein, 9 aa, Homo Sapiens
RSPRHYLGD

SEQ ID NO: 737356 - protein, 9 aa, Homo Sapiens
SRAGRDREV

SEQ ID NO: 737357 - protein, 9 aa, Homo Sapiens
LPLQQTALQ

SEQ ID NO: 737358 - protein, 9 aa, Homo Sapiens
KSTSLVAAR

SEQ ID NO: 737359 - protein, 9 aa, Homo Sapiens
RLVYFEGTR

SEQ ID NO: 737360 - protein, 9 aa, Homo Sapiens
VLPDLENHY

SEQ ID NO: 737361 - protein, 9 aa, Homo Sapiens
TIVSQRKHI

SEQ ID NO: 737362 - protein, 9 aa, Homo Sapiens
PKMDGAATK

SEQ ID NO: 737363 - protein, 9 aa, Homo Sapiens
TLIQSLYRM

SEQ ID NO: 737364 - protein, 9 aa, Homo Sapiens
TARVKNWLG

SEQ ID NO: 737365 - protein, 9 aa, Homo Sapiens
PEETGSSDD

SEQ ID NO: 737366 - protein, 9 aa, Homo Sapiens
FVAYMIRLE

SEQ ID NO: 737367 - protein, 9 aa, Homo Sapiens
HTSSSLKRS

SEQ ID NO: 737368 - protein, 9 aa, Homo Sapiens
GYQPGDLGA

SEQ ID NO: 737369 - protein, 9 aa, Homo Sapiens
VLRDLSYLH

SEQ ID NO: 737370 - protein, 9 aa, Homo Sapiens
HCHDKDDDE

SEQ ID NO: 737371 - protein, 9 aa, Homo Sapiens
NRNIVSNLN

SEQ ID NO: 737372 - protein, 9 aa, Homo Sapiens
LLSSCDPPA

SEQ ID NO: 737373 - protein, 9 aa, Homo Sapiens
RKLRGVHGC

SEQ ID NO: 737374 - protein, 9 aa, Homo Sapiens
GFCCSSAYI

SEQ ID NO: 737375 - protein, 9 aa, Homo Sapiens
LGAHGAHVG

SEQ ID NO: 737376 - protein, 9 aa, Homo Sapiens
EVILKMAAD

SEQ ID NO: 737377 - protein, 9 aa, Homo Sapiens
QRPRAALLH

SEQ ID NO: 737378 - protein, 9 aa, Homo Sapiens
PATQGSTGA

SEQ ID NO: 737379 - protein, 9 aa, Homo Sapiens
NVTVFPGPV

SEQ ID NO: 737380 - protein, 9 aa, Homo Sapiens
LLHSDDDGL

SEQ ID NO: 737381 - protein, 9 aa, Homo Sapiens
WRFEQEVQE

SEQ ID NO: 737382 - protein, 9 aa, Homo Sapiens
DSFVALLTC

SEQ ID NO: 737383 - protein, 9 aa, Homo Sapiens
QKLQNLGKL

SEQ ID NO: 737384 - protein, 9 aa, Homo Sapiens
EQIAISAGA

SEQ ID NO: 737385 - protein, 9 aa, Homo Sapiens
VGSVLPAGN

SEQ ID NO: 737386 - protein, 9 aa, Homo Sapiens
DYNLWSITE

SEQ ID NO: 737387 - protein, 9 aa, Homo Sapiens
AWWHPKVHA

SEQ ID NO: 737388 - protein, 9 aa, Homo Sapiens
CIIQLYMVR

SEQ ID NO: 737389 - protein, 9 aa, Homo Sapiens
KMGNQQKVN

SEQ ID NO: 737390 - protein, 9 aa, Homo Sapiens
AVEFTLTQM

SEQ ID NO: 737391 - protein, 9 aa, Homo Sapiens
RRPECKSME

SEQ ID NO: 737392 - protein, 9 aa, Homo Sapiens
MVVILFYGL

SEQ ID NO: 737393 - protein, 9 aa, Homo Sapiens
GTRDSPLEH

SEQ ID NO: 737394 - protein, 9 aa, Homo Sapiens
AMFVQTEMR

SEQ ID NO: 737395 - protein, 9 aa, Homo Sapiens
GEVAQPVLQ

SEQ ID NO: 737396 - protein, 9 aa, Homo Sapiens
FTPCGEWQV

SEQ ID NO: 737397 - protein, 9 aa, Homo Sapiens
HRLGQPMPS

SEQ ID NO: 737398 - protein, 9 aa, Homo Sapiens
AAFVQEQRQ

SEQ ID NO: 737399 - protein, 9 aa, Homo Sapiens
QNCTFEIES

SEQ ID NO: 737400 - protein, 9 aa, Homo Sapiens
VTPVTQGDV

SEQ ID NO: 737401 - protein, 9 aa, Homo Sapiens
CEILRRHSF

SEQ ID NO: 737402 - protein, 9 aa, Homo Sapiens
YTRKAGVRS

SEQ ID NO: 737403 - protein, 9 aa, Homo Sapiens
LSGSPPRRA

SEQ ID NO: 737404 - protein, 9 aa, Homo Sapiens
FPFLIMLTS

SEQ ID NO: 737405 - protein, 9 aa, Homo Sapiens
YQVTFTFLL

SEQ ID NO: 737406 - protein, 9 aa, Homo Sapiens
RHYLGDAEE

SEQ ID NO: 737407 - protein, 9 aa, Homo Sapiens
LGKLNKVLA

SEQ ID NO: 737408 - protein, 9 aa, Homo Sapiens
GLDLSHNRL

SEQ ID NO: 737409 - protein, 9 aa, Homo Sapiens
VCDCSTPSQ

SEQ ID NO: 737410 - protein, 9 aa, Homo Sapiens
LALVGEEME

SEQ ID NO: 737411 - protein, 9 aa, Homo Sapiens
FHVTPVTQG

SEQ ID NO: 737412 - protein, 9 aa, Homo Sapiens
LSPDTIMQC

SEQ ID NO: 737413 - protein, 9 aa, Homo Sapiens
ESSQIHILV

SEQ ID NO: 737414 - protein, 9 aa, Homo Sapiens
QHQNQAQDS

SEQ ID NO: 737415 - protein, 9 aa, Homo Sapiens
TSLLCRVNT

SEQ ID NO: 737416 - protein, 9 aa, Homo Sapiens
VYQLQEFLV

SEQ ID NO: 737417 - protein, 9 aa, Homo Sapiens
ALEGGDVGP

SEQ ID NO: 737418 - protein, 9 aa, Homo Sapiens
SIVMVLLKQ

SEQ ID NO: 737419 - protein, 9 aa, Homo Sapiens
YKCGDGHCI

SEQ ID NO: 737420 - protein, 9 aa, Homo Sapiens
EHLADGEVA

SEQ ID NO: 737421 - protein, 9 aa, Homo Sapiens
CGELSLSTG

SEQ ID NO: 737422 - protein, 9 aa, Homo Sapiens
ETQTAKEAQ

SEQ ID NO: 737423 - protein, 9 aa, Homo Sapiens
LSELCAGQF

SEQ ID NO: 737424 - protein, 9 aa, Homo Sapiens
ADTVKRIAA

SEQ ID NO: 737425 - protein, 9 aa, Homo Sapiens
VRAFVDAKE

SEQ ID NO: 737426 - protein, 9 aa, Homo Sapiens
RSTIGMSFG

SEQ ID NO: 737427 - protein, 9 aa, Homo Sapiens
GLDDIKDCS

SEQ ID NO: 737428 - protein, 9 aa, Homo Sapiens
RLPLDVQIF

SEQ ID NO: 737429 - protein, 9 aa, Homo Sapiens
LVKVPLQRV

SEQ ID NO: 737430 - protein, 9 aa, Homo Sapiens
LLQAGEALG

SEQ ID NO: 737431 - protein, 9 aa, Homo Sapiens
PGRAEPPRP

SEQ ID NO: 737432 - protein, 9 aa, Homo Sapiens
VEYKGHKWV

SEQ ID NO: 737433 - protein, 9 aa, Homo Sapiens
TAHPPGYQP

SEQ ID NO: 737434 - protein, 9 aa, Homo Sapiens
TGDNLCKDG

SEQ ID NO: 737435 - protein, 9 aa, Homo Sapiens
WVRKDSRVG

SEQ ID NO: 737436 - protein, 9 aa, Homo Sapiens
HSPWNLKLV

SEQ ID NO: 737437 - protein, 9 aa, Homo Sapiens
CSKWYMPRD

SEQ ID NO: 737438 - protein, 9 aa, Homo Sapiens
MVNVDGYDY

SEQ ID NO: 737439 - protein, 9 aa, Homo Sapiens
STTSCSCQS

SEQ ID NO: 737440 - protein, 9 aa, Homo Sapiens
HRRHKKRIQ

SEQ ID NO: 737441 - protein, 9 aa, Homo Sapiens
NLTIDTYYN

SEQ ID NO: 737442 - protein, 9 aa, Homo Sapiens
STRYFLFRN

SEQ ID NO: 737443 - protein, 9 aa, Homo Sapiens
IHQIWHDAY

SEQ ID NO: 737444 - protein, 9 aa, Homo Sapiens
RIKCVWNKN

SEQ ID NO: 737445 - protein, 9 aa, Homo Sapiens
TPGPPGPPA

SEQ ID NO: 737446 - protein, 9 aa, Homo Sapiens
LIASRKMDV

SEQ ID NO: 737447 - protein, 9 aa, Homo Sapiens
HPPGYQPGD

SEQ ID NO: 737448 - protein, 9 aa, Homo Sapiens
YLLKGRKTF

SEQ ID NO: 737449 - protein, 9 aa, Homo Sapiens
NQFNEESVE

SEQ ID NO: 737450 - protein, 9 aa, Homo Sapiens
PLAAHEEHL

SEQ ID NO: 737451 - protein, 9 aa, Homo Sapiens
VHPMVQCPF

SEQ ID NO: 737452 - protein, 9 aa, Homo Sapiens
GCGLPSVHS

SEQ ID NO: 737453 - protein, 9 aa, Homo Sapiens
RIVGGWECG

SEQ ID NO: 737454 - protein, 9 aa, Homo Sapiens
LDTPHRSYG

SEQ ID NO: 737455 - protein, 9 aa, Homo Sapiens
CPFYNTVGM

SEQ ID NO: 737456 - protein, 9 aa, Homo Sapiens
PGEALVVAA

SEQ ID NO: 737457 - protein, 9 aa, Homo Sapiens
LHWQVIGNP

SEQ ID NO: 737458 - protein, 9 aa, Homo Sapiens
LGHGRDARG

SEQ ID NO: 737459 - protein, 9 aa, Homo Sapiens
KGAVLYLLK

SEQ ID NO: 737460 - protein, 9 aa, Homo Sapiens
GNGFCCSSA

SEQ ID NO: 737461 - protein, 9 aa, Homo Sapiens
LWSITESSL

SEQ ID NO: 737462 - protein, 9 aa, Homo Sapiens
CIKDFKKIH

SEQ ID NO: 737463 - protein, 9 aa, Homo Sapiens
TQGSTGAQR

SEQ ID NO: 737464 - protein, 9 aa, Homo Sapiens
NVTVMKTNM

SEQ ID NO: 737465 - protein, 9 aa, Homo Sapiens
SSQIHILVL

SEQ ID NO: 737466 - protein, 9 aa, Homo Sapiens
YHEMPNREP

SEQ ID NO: 737467 - protein, 9 aa, Homo Sapiens
QQRPRAALL

SEQ ID NO: 737468 - protein, 9 aa, Homo Sapiens
LPDLKRPSG

SEQ ID NO: 737469 - protein, 9 aa, Homo Sapiens
FSTCCSHMM

SEQ ID NO: 737470 - protein, 9 aa, Homo Sapiens
FVALLTCHG

SEQ ID NO: 737471 - protein, 9 aa, Homo Sapiens
PLRYNSILT

SEQ ID NO: 737472 - protein, 9 aa, Homo Sapiens
LRDLSYLHN

SEQ ID NO: 737473 - protein, 9 aa, Homo Sapiens
HQRSASTAP

SEQ ID NO: 737474 - protein, 9 aa, Homo Sapiens
RDSPLEHHL

SEQ ID NO: 737475 - protein, 9 aa, Homo Sapiens
KLHFPFFFF

SEQ ID NO: 737476 - protein, 9 aa, Homo Sapiens
SHQEGSTQQ

SEQ ID NO: 737477 - protein, 9 aa, Homo Sapiens
EPVNPDLSA

SEQ ID NO: 737478 - protein, 9 aa, Homo Sapiens
RDASSTSSG

SEQ ID NO: 737479 - protein, 9 aa, Homo Sapiens
FQESKGDSP

SEQ ID NO: 737480 - protein, 9 aa, Homo Sapiens
DNQFNEESV

SEQ ID NO: 737481 - protein, 9 aa, Homo Sapiens
SCWLSFPWP

SEQ ID NO: 737482 - protein, 9 aa, Homo Sapiens
SLQRDFSLR

SEQ ID NO: 737483 - protein, 9 aa, Homo Sapiens
QDIKKVCET

SEQ ID NO: 737484 - protein, 9 aa, Homo Sapiens
HQRLQWHFY

SEQ ID NO: 737485 - protein, 9 aa, Homo Sapiens
EKRLQLRKA

SEQ ID NO: 737486 - protein, 9 aa, Homo Sapiens
GGWECGKHS

SEQ ID NO: 737487 - protein, 9 aa, Homo Sapiens
DMEQTVKDL

SEQ ID NO: 737488 - protein, 9 aa, Homo Sapiens
GMMGFPGPK

SEQ ID NO: 737489 - protein, 9 aa, Homo Sapiens
VFASGQLVK

SEQ ID NO: 737490 - protein, 9 aa, Homo Sapiens
SPAAPAGPA

SEQ ID NO: 737491 - protein, 9 aa, Homo Sapiens
CDPPALASQ

SEQ ID NO: 737492 - protein, 9 aa, Homo Sapiens
DSQTNRTFV

SEQ ID NO: 737493 - protein, 9 aa, Homo Sapiens
TGCWALSSG

SEQ ID NO: 737494 - protein, 9 aa, Homo Sapiens
KSSGFVCFK

SEQ ID NO: 737495 - protein, 9 aa, Homo Sapiens
LQKYRLSAF

SEQ ID NO: 737496 - protein, 9 aa, Homo Sapiens
NSPMKDSFS

SEQ ID NO: 737497 - protein, 9 aa, Homo Sapiens
PLVLPDLEN

SEQ ID NO: 737498 - protein, 9 aa, Homo Sapiens
QKQWRHLCC

SEQ ID NO: 737499 - protein, 9 aa, Homo Sapiens
YILQSSLSL

SEQ ID NO: 737500 - protein, 9 aa, Homo Sapiens
TEAGGFFSL

SEQ ID NO: 737501 - protein, 9 aa, Homo Sapiens
SPQLIRRGL

SEQ ID NO: 737502 - protein, 9 aa, Homo Sapiens
KRFVETLHI

SEQ ID NO: 737503 - protein, 9 aa, Homo Sapiens
SVEPQGDQG

SEQ ID NO: 737504 - protein, 9 aa, Homo Sapiens
TDGDSFNEM

SEQ ID NO: 737505 - protein, 9 aa, Homo Sapiens
SEGLASPHD

SEQ ID NO: 737506 - protein, 9 aa, Homo Sapiens
PAAWCTVGQ

SEQ ID NO: 737507 - protein, 9 aa, Homo Sapiens
EEMEFPCHL

SEQ ID NO: 737508 - protein, 9 aa, Homo Sapiens
LHNKGLTVI

SEQ ID NO: 737509 - protein, 9 aa, Homo Sapiens
FDETNNQTL

SEQ ID NO: 737510 - protein, 9 aa, Homo Sapiens
LGLVEVEVL

SEQ ID NO: 737511 - protein, 9 aa, Homo Sapiens
VGRQHHSGP

SEQ ID NO: 737512 - protein, 9 aa, Homo Sapiens
GVLGHGRDA

SEQ ID NO: 737513 - protein, 9 aa, Homo Sapiens
KSGQSSYGQ

SEQ ID NO: 737514 - protein, 9 aa, Homo Sapiens
AENATLSAT

SEQ ID NO: 737515 - protein, 9 aa, Homo Sapiens
QVIGNPRCQ

SEQ ID NO: 737516 - protein, 9 aa, Homo Sapiens
FTFLLPISI

SEQ ID NO: 737517 - protein, 9 aa, Homo Sapiens
DRFCPFYNT

SEQ ID NO: 737518 - protein, 9 aa, Homo Sapiens
GTTARVKNW

SEQ ID NO: 737519 - protein, 9 aa, Homo Sapiens
GSLSALLHS

SEQ ID NO: 737520 - protein, 9 aa, Homo Sapiens
SVREQQEDI

SEQ ID NO: 737521 - protein, 9 aa, Homo Sapiens
DMDRNPRAA

SEQ ID NO: 737522 - protein, 9 aa, Homo Sapiens
WQVGDWSPC

SEQ ID NO: 737523 - protein, 9 aa, Homo Sapiens
YSSHSVLQP

SEQ ID NO: 737524 - protein, 9 aa, Homo Sapiens
KSLADPASS

SEQ ID NO: 737525 - protein, 9 aa, Homo Sapiens
VTKKGVWKN

SEQ ID NO: 737526 - protein, 9 aa, Homo Sapiens
EALGLVEVE

SEQ ID NO: 737527 - protein, 9 aa, Homo Sapiens
QGSKLIWSK

SEQ ID NO: 737528 - protein, 9 aa, Homo Sapiens
DPSHTKYSL

SEQ ID NO: 737529 - protein, 9 aa, Homo Sapiens
LQAPLSMAA

SEQ ID NO: 737530 - protein, 9 aa, Homo Sapiens
IRDLHLAAS

SEQ ID NO: 737531 - protein, 9 aa, Homo Sapiens
SLKTMIPLR

SEQ ID NO: 737532 - protein, 9 aa, Homo Sapiens
SQMGLDKCQ

SEQ ID NO: 737533 - protein, 9 aa, Homo Sapiens
TSAYLERMK

SEQ ID NO: 737534 - protein, 9 aa, Homo Sapiens
GAIKTGSAS

SEQ ID NO: 737535 - protein, 9 aa, Homo Sapiens
TRYFLFRNR

SEQ ID NO: 737536 - protein, 9 aa, Homo Sapiens
RCSVKEQQE

SEQ ID NO: 737537 - protein, 9 aa, Homo Sapiens
SNSSEGLAS

SEQ ID NO: 737538 - protein, 9 aa, Homo Sapiens
RKNECRSRT

SEQ ID NO: 737539 - protein, 9 aa, Homo Sapiens
SLKRSFFRS

SEQ ID NO: 737540 - protein, 9 aa, Homo Sapiens
VAGVWWFFT

SEQ ID NO: 737541 - protein, 9 aa, Homo Sapiens
SGDKVNGNC

SEQ ID NO: 737542 - protein, 9 aa, Homo Sapiens
ADPASSDDD

SEQ ID NO: 737543 - protein, 9 aa, Homo Sapiens
KNFNKDQIW

SEQ ID NO: 737544 - protein, 9 aa, Homo Sapiens
DDDGLRQLL

SEQ ID NO: 737545 - protein, 9 aa, Homo Sapiens
QHSKEALHS

SEQ ID NO: 737546 - protein, 9 aa, Homo Sapiens
ECKAKRFVE

SEQ ID NO: 737547 - protein, 9 aa, Homo Sapiens
CDVISGDKV

SEQ ID NO: 737548 - protein, 9 aa, Homo Sapiens
TKYQVTFTF

SEQ ID NO: 737549 - protein, 9 aa, Homo Sapiens
VMKTNMSLG

SEQ ID NO: 737550 - protein, 9 aa, Homo Sapiens
FFDVIHEGC

SEQ ID NO: 737551 - protein, 9 aa, Homo Sapiens
RDGPGHRVP

SEQ ID NO: 737552 - protein, 9 aa, Homo Sapiens
EGLVDLETL

SEQ ID NO: 737553 - protein, 9 aa, Homo Sapiens
RVRFVLVPA

SEQ ID NO: 737554 - protein, 9 aa, Homo Sapiens
LYCLRLDQA

SEQ ID NO: 737555 - protein, 9 aa, Homo Sapiens
KDYKEEKKD

SEQ ID NO: 737556 - protein, 9 aa, Homo Sapiens
QPSAQPLSG

SEQ ID NO: 737557 - protein, 9 aa, Homo Sapiens
PVMIKALRG

SEQ ID NO: 737558 - protein, 9 aa, Homo Sapiens
IFCPGVMQS

SEQ ID NO: 737559 - protein, 9 aa, Homo Sapiens
LLTCHGLHG

SEQ ID NO: 737560 - protein, 9 aa, Homo Sapiens
LLHGDLPVQ

SEQ ID NO: 737561 - protein, 9 aa, Homo Sapiens
RRSQSSPRY

SEQ ID NO: 737562 - protein, 9 aa, Homo Sapiens
SFHCSCHRG

SEQ ID NO: 737563 - protein, 9 aa, Homo Sapiens
VKFLPAAVA

SEQ ID NO: 737564 - protein, 9 aa, Homo Sapiens
KKCIKDFKK

SEQ ID NO: 737565 - protein, 9 aa, Homo Sapiens
TSQSLRSPI

SEQ ID NO: 737566 - protein, 9 aa, Homo Sapiens
EIKQSHQEG

SEQ ID NO: 737567 - protein, 9 aa, Homo Sapiens
LVLPDLENH

SEQ ID NO: 737568 - protein, 9 aa, Homo Sapiens
FFFPVFLYM

SEQ ID NO: 737569 - protein, 9 aa, Homo Sapiens
TLSGAKSTS

SEQ ID NO: 737570 - protein, 9 aa, Homo Sapiens
ECGNGFCCS

SEQ ID NO: 737571 - protein, 9 aa, Homo Sapiens
GIVHDAVVF

SEQ ID NO: 737572 - protein, 9 aa, Homo Sapiens
QVVVANILQ

SEQ ID NO: 737573 - protein, 9 aa, Homo Sapiens
HGRDARGGL

SEQ ID NO: 737574 - protein, 9 aa, Homo Sapiens
MTDGDSFNE

SEQ ID NO: 737575 - protein, 9 aa, Homo Sapiens
LRSPIYFFL

SEQ ID NO: 737576 - protein, 9 aa, Homo Sapiens
PGRTPIFCP

SEQ ID NO: 737577 - protein, 9 aa, Homo Sapiens
NEESVEHDV

SEQ ID NO: 737578 - protein, 9 aa, Homo Sapiens
HGAHVGVHA

SEQ ID NO: 737579 - protein, 9 aa, Homo Sapiens
LQRDFSLRV

SEQ ID NO: 737580 - protein, 9 aa, Homo Sapiens
SCWGGGCGL

SEQ ID NO: 737581 - protein, 9 aa, Homo Sapiens
LERVRFVLV

SEQ ID NO: 737582 - protein, 9 aa, Homo Sapiens
EAHLEIREA

SEQ ID NO: 737583 - protein, 9 aa, Homo Sapiens
VMARWLRGA

SEQ ID NO: 737584 - protein, 9 aa, Homo Sapiens
EGTTARVKN

SEQ ID NO: 737585 - protein, 9 aa, Homo Sapiens
KRTSITAPE

SEQ ID NO: 737586 - protein, 9 aa, Homo Sapiens
TPIFCPGVM

SEQ ID NO: 737587 - protein, 9 aa, Homo Sapiens
GYPVMIKAL

SEQ ID NO: 737588 - protein, 9 aa, Homo Sapiens
VTGRLLHGD

SEQ ID NO: 737589 - protein, 9 aa, Homo Sapiens
APRYHEMPN

SEQ ID NO: 737590 - protein, 9 aa, Homo Sapiens
LTLPQANHD

SEQ ID NO: 737591 - protein, 9 aa, Homo Sapiens
VCLSVLRDL

SEQ ID NO: 737592 - protein, 9 aa, Homo Sapiens
VNKNLISYK

SEQ ID NO: 737593 - protein, 9 aa, Homo Sapiens
EEEEQVRKG

SEQ ID NO: 737594 - protein, 9 aa, Homo Sapiens
SFGEECEIL

SEQ ID NO: 737595 - protein, 9 aa, Homo Sapiens
SRSEQHQNQ

SEQ ID NO: 737596 - protein, 9 aa, Homo Sapiens
DGSHLEQPF

SEQ ID NO: 737597 - protein, 9 aa, Homo Sapiens
AAAEWGGWA

SEQ ID NO: 737598 - protein, 9 aa, Homo Sapiens
LTCHGLHGM

SEQ ID NO: 737599 - protein, 9 aa, Homo Sapiens
LVITYVREK

SEQ ID NO: 737600 - protein, 9 aa, Homo Sapiens
GAPRYHEMP

SEQ ID NO: 737601 - protein, 9 aa, Homo Sapiens
CNQHVEIAR

SEQ ID NO: 737602 - protein, 9 aa, Homo Sapiens
EDDEKRTPH

SEQ ID NO: 737603 - protein, 9 aa, Homo Sapiens
RDLHLAASS

SEQ ID NO: 737604 - protein, 9 aa, Homo Sapiens
KCGDGHCIP

SEQ ID NO: 737605 - protein, 9 aa, Homo Sapiens
QNVLGTALC

SEQ ID NO: 737606 - protein, 9 aa, Homo Sapiens
YLQIHPDGA

SEQ ID NO: 737607 - protein, 9 aa, Homo Sapiens
GNLTYGYFT

SEQ ID NO: 737608 - protein, 9 aa, Homo Sapiens
ADDANATQC

SEQ ID NO: 737609 - protein, 9 aa, Homo Sapiens
MQDTHRRLL

SEQ ID NO: 737610 - protein, 9 aa, Homo Sapiens
LGQRLRVVR

SEQ ID NO: 737611 - protein, 9 aa, Homo Sapiens
EPQGDQGLE

SEQ ID NO: 737612 - protein, 9 aa, Homo Sapiens
SEYQEPLHL

SEQ ID NO: 737613 - protein, 9 aa, Homo Sapiens
GMNRGPILT

SEQ ID NO: 737614 - protein, 9 aa, Homo Sapiens
GGPIRDVCS

SEQ ID NO: 737615 - protein, 9 aa, Homo Sapiens
RKEVTGSSA

SEQ ID NO: 737616 - protein, 9 aa, Homo Sapiens
VRNTQHQRS

SEQ ID NO: 737617 - protein, 9 aa, Homo Sapiens
VADPSHTKY

SEQ ID NO: 737618 - protein, 9 aa, Homo Sapiens
TVFPHLGAA

SEQ ID NO: 737619 - protein, 9 aa, Homo Sapiens
PIRDVCSKW

SEQ ID NO: 737620 - protein, 9 aa, Homo Sapiens
VVFTDAVIH

SEQ ID NO: 737621 - protein, 9 aa, Homo Sapiens
KSGGRQSSR

SEQ ID NO: 737622 - protein, 9 aa, Homo Sapiens
TPKSQPAPA

SEQ ID NO: 737623 - protein, 9 aa, Homo Sapiens
LPITGTPPP

SEQ ID NO: 737624 - protein, 9 aa, Homo Sapiens
LPLLMHFQA

SEQ ID NO: 737625 - protein, 9 aa, Homo Sapiens
SLSEDCPQA

SEQ ID NO: 737626 - protein, 9 aa, Homo Sapiens
PAGPAAPAA

SEQ ID NO: 737627 - protein, 9 aa, Homo Sapiens
ARLALLLLC

SEQ ID NO: 737628 - protein, 9 aa, Homo Sapiens
GDVGPLGQR

SEQ ID NO: 737629 - protein, 9 aa, Homo Sapiens
IAGKASRLA

SEQ ID NO: 737630 - protein, 9 aa, Homo Sapiens
TKYCDEKCV

SEQ ID NO: 737631 - protein, 9 aa, Homo Sapiens
AKSTSLVAA

SEQ ID NO: 737632 - protein, 9 aa, Homo Sapiens
YLWIHQIWH

SEQ ID NO: 737633 - protein, 9 aa, Homo Sapiens
LGHGASGPG

SEQ ID NO: 737634 - protein, 9 aa, Homo Sapiens
RGLGHGASG

SEQ ID NO: 737635 - protein, 9 aa, Homo Sapiens
GTETLAPSN

SEQ ID NO: 737636 - protein, 9 aa, Homo Sapiens
LQGVMDLQE

SEQ ID NO: 737637 - protein, 9 aa, Homo Sapiens
ALVGEEMEF

SEQ ID NO: 737638 - protein, 9 aa, Homo Sapiens
AYMIRLETL

SEQ ID NO: 737639 - protein, 9 aa, Homo Sapiens
QEGYLQILQ

SEQ ID NO: 737640 - protein, 9 aa, Homo Sapiens
ENKNGTETL

SEQ ID NO: 737641 - protein, 9 aa, Homo Sapiens
KKEQDTSAY

SEQ ID NO: 737642 - protein, 9 aa, Homo Sapiens
LKGRKTFLI

SEQ ID NO: 737643 - protein, 9 aa, Homo Sapiens
INHSPWNLK

SEQ ID NO: 737644 - protein, 9 aa, Homo Sapiens
KGIMAADES

SEQ ID NO: 737645 - protein, 9 aa, Homo Sapiens
QILLGASAP

SEQ ID NO: 737646 - protein, 9 aa, Homo Sapiens
GEWQVGDWS

SEQ ID NO: 737647 - protein, 9 aa, Homo Sapiens
ADGEVAQPV

SEQ ID NO: 737648 - protein, 9 aa, Homo Sapiens
SHLEQPFLD

SEQ ID NO: 737649 - protein, 9 aa, Homo Sapiens
FVQEQRQGP

SEQ ID NO: 737650 - protein, 9 aa, Homo Sapiens
EWQVGDWSP

SEQ ID NO: 737651 - protein, 9 aa, Homo Sapiens
WSITESSLW

SEQ ID NO: 737652 - protein, 9 aa, Homo Sapiens
SVGRSTIGM

SEQ ID NO: 737653 - protein, 9 aa, Homo Sapiens
LCKDGDKSF

SEQ ID NO: 737654 - protein, 9 aa, Homo Sapiens
QILVHVTKK

SEQ ID NO: 737655 - protein, 9 aa, Homo Sapiens
AAGLAYRAA

SEQ ID NO: 737656 - protein, 9 aa, Homo Sapiens
DETMSYGGC

SEQ ID NO: 737657 - protein, 9 aa, Homo Sapiens
PPQMFPCII

SEQ ID NO: 737658 - protein, 9 aa, Homo Sapiens
DVISGDKVN

SEQ ID NO: 737659 - protein, 9 aa, Homo Sapiens
LVMEQADRQ

SEQ ID NO: 737660 - protein, 9 aa, Homo Sapiens
QSSPRYSTI

SEQ ID NO: 737661 - protein, 9 aa, Homo Sapiens
LPDGSHLEQ

SEQ ID NO: 737662 - protein, 9 aa, Homo Sapiens
AAVFSVVFT

SEQ ID NO: 737663 - protein, 9 aa, Homo Sapiens
PHRNQAPLL

SEQ ID NO: 737664 - protein, 9 aa, Homo Sapiens
SEAENATLS

SEQ ID NO: 737665 - protein, 9 aa, Homo Sapiens
LTASLPQEL

SEQ ID NO: 737666 - protein, 9 aa, Homo Sapiens
AERFQESKG

SEQ ID NO: 737667 - protein, 9 aa, Homo Sapiens
QSDIPCQHS

SEQ ID NO: 737668 - protein, 9 aa, Homo Sapiens
EIVEVFSGD

SEQ ID NO: 737669 - protein, 9 aa, Homo Sapiens
EQLAYLRKN

SEQ ID NO: 737670 - protein, 9 aa, Homo Sapiens
DITFKGCMA

SEQ ID NO: 737671 - protein, 9 aa, Homo Sapiens
SAAVSYDAE

SEQ ID NO: 737672 - protein, 9 aa, Homo Sapiens
PGRDGHQGL

SEQ ID NO: 737673 - protein, 9 aa, Homo Sapiens
KEVILKMAA

SEQ ID NO: 737674 - protein, 9 aa, Homo Sapiens
FTKQDVNKN

SEQ ID NO: 737675 - protein, 9 aa, Homo Sapiens
LGIYSATKF

SEQ ID NO: 737676 - protein, 9 aa, Homo Sapiens
GEAESKNSN

SEQ ID NO: 737677 - protein, 9 aa, Homo Sapiens
TPRLPVPRA

SEQ ID NO: 737678 - protein, 9 aa, Homo Sapiens
NRNAEMLST

SEQ ID NO: 737679 - protein, 9 aa, Homo Sapiens
RNPRAALER

SEQ ID NO: 737680 - protein, 9 aa, Homo Sapiens
AGPAAPAAP

SEQ ID NO: 737681 - protein, 9 aa, Homo Sapiens
DKNDYIISI

SEQ ID NO: 737682 - protein, 9 aa, Homo Sapiens
CGLPSVHSE

SEQ ID NO: 737683 - protein, 9 aa, Homo Sapiens
IGLGPAKRA

SEQ ID NO: 737684 - protein, 9 aa, Homo Sapiens
RVGAGIDSY

SEQ ID NO: 737685 - protein, 9 aa, Homo Sapiens
RSGSLLSRS

SEQ ID NO: 737686 - protein, 9 aa, Homo Sapiens
CVEPETGII

SEQ ID NO: 737687 - protein, 9 aa, Homo Sapiens
IRANGSEGE

SEQ ID NO: 737688 - protein, 9 aa, Homo Sapiens
PHLNCWLRL

SEQ ID NO: 737689 - protein, 9 aa, Homo Sapiens
FTHTLNSTT

SEQ ID NO: 737690 - protein, 9 aa, Homo Sapiens
ALLTCHGLH

SEQ ID NO: 737691 - protein, 9 aa, Homo Sapiens
MDSKCQKTY

SEQ ID NO: 737692 - protein, 9 aa, Homo Sapiens
VILFYGLAI

SEQ ID NO: 737693 - protein, 9 aa, Homo Sapiens
VLSMYVAYS

SEQ ID NO: 737694 - protein, 9 aa, Homo Sapiens
KPTVGMKLS

SEQ ID NO: 737695 - protein, 9 aa, Homo Sapiens
SERYSSSGC

SEQ ID NO: 737696 - protein, 9 aa, Homo Sapiens
AAPQEKKPK

SEQ ID NO: 737697 - protein, 9 aa, Homo Sapiens
VAYMIRLET

SEQ ID NO: 737698 - protein, 9 aa, Homo Sapiens
REEWGQLDH

SEQ ID NO: 737699 - protein, 9 aa, Homo Sapiens
DLHLAASSS

SEQ ID NO: 737700 - protein, 9 aa, Homo Sapiens
SLRSPIYFF

SEQ ID NO: 737701 - protein, 9 aa, Homo Sapiens
RDFSLRVPL

SEQ ID NO: 737702 - protein, 9 aa, Homo Sapiens
QNTNSVEKG

SEQ ID NO: 737703 - protein, 9 aa, Homo Sapiens
NLWSITESS

SEQ ID NO: 737704 - protein, 9 aa, Homo Sapiens
GLRLWTSAS

SEQ ID NO: 737705 - protein, 9 aa, Homo Sapiens
EGTLKKSEL

SEQ ID NO: 737706 - protein, 9 aa, Homo Sapiens
SMDSKCQKT

SEQ ID NO: 737707 - protein, 9 aa, Homo Sapiens
YFQRLPCPR

SEQ ID NO: 737708 - protein, 9 aa, Homo Sapiens
LEIREAKAV

SEQ ID NO: 737709 - protein, 9 aa, Homo Sapiens
KTRFSSCNV

SEQ ID NO: 737710 - protein, 9 aa, Homo Sapiens
LKKSELELK

SEQ ID NO: 737711 - protein, 9 aa, Homo Sapiens
MSFGNVHLD

SEQ ID NO: 737712 - protein, 9 aa, Homo Sapiens
VCGNQSIHC

SEQ ID NO: 737713 - protein, 9 aa, Homo Sapiens
GNTQPPIRL

SEQ ID NO: 737714 - protein, 9 aa, Homo Sapiens
CWLSFPWPE

SEQ ID NO: 737715 - protein, 9 aa, Homo Sapiens
KLLGANGSA

SEQ ID NO: 737716 - protein, 9 aa, Homo Sapiens
HRDVPRQIL

SEQ ID NO: 737717 - protein, 9 aa, Homo Sapiens
MQIEGLKEQ

SEQ ID NO: 737718 - protein, 9 aa, Homo Sapiens
RFLQGLALD

SEQ ID NO: 737719 - protein, 9 aa, Homo Sapiens
AGEALGLVE

SEQ ID NO: 737720 - protein, 9 aa, Homo Sapiens
RMEEQQHHW

SEQ ID NO: 737721 - protein, 9 aa, Homo Sapiens
YYPFIVPKV

SEQ ID NO: 737722 - protein, 9 aa, Homo Sapiens
CKFCVSYFR

SEQ ID NO: 737723 - protein, 9 aa, Homo Sapiens
CQRNSWTPP

SEQ ID NO: 737724 - protein, 9 aa, Homo Sapiens
IRFHQIRNP

SEQ ID NO: 737725 - protein, 9 aa, Homo Sapiens
VSNSSEGLA

SEQ ID NO: 737726 - protein, 9 aa, Homo Sapiens
FSPPQMFPC

SEQ ID NO: 737727 - protein, 9 aa, Homo Sapiens
QHGDEPGPQ

SEQ ID NO: 737728 - protein, 9 aa, Homo Sapiens
SGFVCFKHP

SEQ ID NO: 737729 - protein, 9 aa, Homo Sapiens
DAGIYEFHT

SEQ ID NO: 737730 - protein, 9 aa, Homo Sapiens
VTVMKTNMS

SEQ ID NO: 737731 - protein, 9 aa, Homo Sapiens
GRSKQGGKA

SEQ ID NO: 737732 - protein, 9 aa, Homo Sapiens
QSSRTSTTS

SEQ ID NO: 737733 - protein, 9 aa, Homo Sapiens
TWYKNGPAI

SEQ ID NO: 737734 - protein, 9 aa, Homo Sapiens
SYPLVVAES

SEQ ID NO: 737735 - protein, 9 aa, Homo Sapiens
VRKDSRVGA

SEQ ID NO: 737736 - protein, 9 aa, Homo Sapiens
NRSDGSGKN

SEQ ID NO: 737737 - protein, 9 aa, Homo Sapiens
LYIFSDKTG

SEQ ID NO: 737738 - protein, 9 aa, Homo Sapiens
LAASSSFRS

SEQ ID NO: 737739 - protein, 9 aa, Homo Sapiens
SEDVSVEPQ

SEQ ID NO: 737740 - protein, 9 aa, Homo Sapiens
CIGTSYYLS

SEQ ID NO: 737741 - protein, 9 aa, Homo Sapiens
VREGGPGEP

SEQ ID NO: 737742 - protein, 9 aa, Homo Sapiens
YLGDAEEDN

SEQ ID NO: 737743 - protein, 9 aa, Homo Sapiens
MIPLRPCAR

SEQ ID NO: 737744 - protein, 9 aa, Homo Sapiens
RDREVGSVL

SEQ ID NO: 737745 - protein, 9 aa, Homo Sapiens
MVWCGELSL

SEQ ID NO: 737746 - protein, 9 aa, Homo Sapiens
AAQLPGRVA

SEQ ID NO: 737747 - protein, 9 aa, Homo Sapiens
EGRTSGQID

SEQ ID NO: 737748 - protein, 9 aa, Homo Sapiens
SSPSSGLTA

SEQ ID NO: 737749 - protein, 9 aa, Homo Sapiens
RNIPCNTER

SEQ ID NO: 737750 - protein, 9 aa, Homo Sapiens
SDDTASSDD

SEQ ID NO: 737751 - protein, 9 aa, Homo Sapiens
ETGSNSEKA

SEQ ID NO: 737752 - protein, 9 aa, Homo Sapiens
QDGPPGPMV

SEQ ID NO: 737753 - protein, 9 aa, Homo Sapiens
TCALLEFKI

SEQ ID NO: 737754 - protein, 9 aa, Homo Sapiens
DSECLLLSM

SEQ ID NO: 737755 - protein, 9 aa, Homo Sapiens
VEVFSGDLL

SEQ ID NO: 737756 - protein, 9 aa, Homo Sapiens
RLCPPHPTT

SEQ ID NO: 737757 - protein, 9 aa, Homo Sapiens
GRKLRGVHG

SEQ ID NO: 737758 - protein, 9 aa, Homo Sapiens
KAGVRSLDR

SEQ ID NO: 737759 - protein, 9 aa, Homo Sapiens
DAMELYRKA

SEQ ID NO: 737760 - protein, 9 aa, Homo Sapiens
KNDYIISIV

SEQ ID NO: 737761 - protein, 9 aa, Homo Sapiens
DGIPCTVDA

SEQ ID NO: 737762 - protein, 9 aa, Homo Sapiens
FTKKMGNQQ

SEQ ID NO: 737763 - protein, 9 aa, Homo Sapiens
LLMHFQAAM

SEQ ID NO: 737764 - protein, 9 aa, Homo Sapiens
FRVGATDHS

SEQ ID NO: 737765 - protein, 9 aa, Homo Sapiens
SHEEFRKEV

SEQ ID NO: 737766 - protein, 9 aa, Homo Sapiens
GIMAADESV

SEQ ID NO: 737767 - protein, 9 aa, Homo Sapiens
GRAEPPRPR

SEQ ID NO: 737768 - protein, 9 aa, Homo Sapiens
EGQLPDYAA

SEQ ID NO: 737769 - protein, 9 aa, Homo Sapiens
RGQAGMMGF

SEQ ID NO: 737770 - protein, 9 aa, Homo Sapiens
CPANSFHFK

SEQ ID NO: 737771 - protein, 9 aa, Homo Sapiens
QFNEESVEH

SEQ ID NO: 737772 - protein, 9 aa, Homo Sapiens
KLSEQLMDY

SEQ ID NO: 737773 - protein, 9 aa, Homo Sapiens
HNKGLTVID

SEQ ID NO: 737774 - protein, 9 aa, Homo Sapiens
IAPYFQRLP

SEQ ID NO: 737775 - protein, 9 aa, Homo Sapiens
FPCCRGSVK

SEQ ID NO: 737776 - protein, 9 aa, Homo Sapiens
VKRIAAELK

SEQ ID NO: 737777 - protein, 9 aa, Homo Sapiens
RSRTPVNLV

SEQ ID NO: 737778 - protein, 9 aa, Homo Sapiens
IKIATFQIA

SEQ ID NO: 737779 - protein, 9 aa, Homo Sapiens
QCSFLIDMR

SEQ ID NO: 737780 - protein, 9 aa, Homo Sapiens
SPFVLRALR

SEQ ID NO: 737781 - protein, 9 aa, Homo Sapiens
RVPHHHDEL

SEQ ID NO: 737782 - protein, 9 aa, Homo Sapiens
LEGTLKKSE

SEQ ID NO: 737783 - protein, 9 aa, Homo Sapiens
QLPGRVADE

SEQ ID NO: 737784 - protein, 9 aa, Homo Sapiens
ATAMGAADQ

SEQ ID NO: 737785 - protein, 9 aa, Homo Sapiens
TQVTPRLPV

SEQ ID NO: 737786 - protein, 9 aa, Homo Sapiens
MWTFRHMRP

SEQ ID NO: 737787 - protein, 9 aa, Homo Sapiens
PGKEGLVDL

SEQ ID NO: 737788 - protein, 9 aa, Homo Sapiens
SMYVAYSTQ

SEQ ID NO: 737789 - protein, 9 aa, Homo Sapiens
KYRLSAFVD

SEQ ID NO: 737790 - protein, 9 aa, Homo Sapiens
INPKMLVDF

SEQ ID NO: 737791 - protein, 9 aa, Homo Sapiens
EETGSNSEK

SEQ ID NO: 737792 - protein, 9 aa, Homo Sapiens
DAQRLRLPE

SEQ ID NO: 737793 - protein, 9 aa, Homo Sapiens
PVPQSSDGL

SEQ ID NO: 737794 - protein, 9 aa, Homo Sapiens
IQSLYRMHR

SEQ ID NO: 737795 - protein, 9 aa, Homo Sapiens
QIEGLKEQL

SEQ ID NO: 737796 - protein, 9 aa, Homo Sapiens
HFPFFFFPV

SEQ ID NO: 737797 - protein, 9 aa, Homo Sapiens
PTPHAEQIV

SEQ ID NO: 737798 - protein, 9 aa, Homo Sapiens
GRVADEPLA

SEQ ID NO: 737799 - protein, 9 aa, Homo Sapiens
LVLPMEVLM

SEQ ID NO: 737800 - protein, 9 aa, Homo Sapiens
QSRGMEGTT

SEQ ID NO: 737801 - protein, 9 aa, Homo Sapiens
VSVMKKLQF

SEQ ID NO: 737802 - protein, 9 aa, Homo Sapiens
MYVAYSTQS

SEQ ID NO: 737803 - protein, 9 aa, Homo Sapiens
FFGIMSVDP

SEQ ID NO: 737804 - protein, 9 aa, Homo Sapiens
KAFSTCCSH

SEQ ID NO: 737805 - protein, 9 aa, Homo Sapiens
LELAWQSLL

SEQ ID NO: 737806 - protein, 9 aa, Homo Sapiens
RMKKDMEQT

SEQ ID NO: 737807 - protein, 9 aa, Homo Sapiens
IYNYHGTGS

SEQ ID NO: 737808 - protein, 9 aa, Homo Sapiens
LVRDDPLEA

SEQ ID NO: 737809 - protein, 9 aa, Homo Sapiens
VAQPVLQVL

SEQ ID NO: 737810 - protein, 9 aa, Homo Sapiens
EGGDVGPLG

SEQ ID NO: 737811 - protein, 9 aa, Homo Sapiens
KASEQSAEE

SEQ ID NO: 737812 - protein, 9 aa, Homo Sapiens
DIKKVCETV

SEQ ID NO: 737813 - protein, 9 aa, Homo Sapiens
KRTPHSSGE

SEQ ID NO: 737814 - protein, 9 aa, Homo Sapiens
QVRKGGSVG

SEQ ID NO: 737815 - protein, 9 aa, Homo Sapiens
DPQPTPSAT

SEQ ID NO: 737816 - protein, 9 aa, Homo Sapiens
QPMPSWLRQ

SEQ ID NO: 737817 - protein, 9 aa, Homo Sapiens
VGPLGQRLR

SEQ ID NO: 737818 - protein, 9 aa, Homo Sapiens
YHKNNPHDP

SEQ ID NO: 737819 - protein, 9 aa, Homo Sapiens
FVLRALRSM

SEQ ID NO: 737820 - protein, 9 aa, Homo Sapiens
GANGSANIN

SEQ ID NO: 737821 - protein, 9 aa, Homo Sapiens
LYRMHRAKV

SEQ ID NO: 737822 - protein, 9 aa, Homo Sapiens
CSIRDLHLA

SEQ ID NO: 737823 - protein, 9 aa, Homo Sapiens
SLSTDPLVQ

SEQ ID NO: 737824 - protein, 9 aa, Homo Sapiens
LHGDLPVQG

SEQ ID NO: 737825 - protein, 9 aa, Homo Sapiens
FYGLAIITY

SEQ ID NO: 737826 - protein, 9 aa, Homo Sapiens
RHKAFSTCC

SEQ ID NO: 737827 - protein, 9 aa, Homo Sapiens
PAKRALYRD

SEQ ID NO: 737828 - protein, 9 aa, Homo Sapiens
HQMTIPCGS

SEQ ID NO: 737829 - protein, 9 aa, Homo Sapiens
QEKDYKEEK

SEQ ID NO: 737830 - protein, 9 aa, Homo Sapiens
TCIGTSYYL

SEQ ID NO: 737831 - protein, 9 aa, Homo Sapiens
LKLLSSCDP

SEQ ID NO: 737832 - protein, 9 aa, Homo Sapiens
TSIPNVTVM

SEQ ID NO: 737833 - protein, 9 aa, Homo Sapiens
GSNSEKASE

SEQ ID NO: 737834 - protein, 9 aa, Homo Sapiens
ANATQCSFL

SEQ ID NO: 737835 - protein, 9 aa, Homo Sapiens
HVGVHAQEL

SEQ ID NO: 737836 - protein, 9 aa, Homo Sapiens
ERIAGKASR

SEQ ID NO: 737837 - protein, 9 aa, Homo Sapiens
LHAAQLPGR

SEQ ID NO: 737838 - protein, 9 aa, Homo Sapiens
EHMAHSHST

SEQ ID NO: 737839 - protein, 9 aa, Homo Sapiens
SELWGVREG

SEQ ID NO: 737840 - protein, 9 aa, Homo Sapiens
GNQSIHCPH

SEQ ID NO: 737841 - protein, 9 aa, Homo Sapiens
TTARVKNWL

SEQ ID NO: 737842 - protein, 9 aa, Homo Sapiens
KHASTEAGG

SEQ ID NO: 737843 - protein, 9 aa, Homo Sapiens
RSKQGGKAR

SEQ ID NO: 737844 - protein, 9 aa, Homo Sapiens
SMMAFDRYK

SEQ ID NO: 737845 - protein, 9 aa, Homo Sapiens
IDTYYNRNA

SEQ ID NO: 737846 - protein, 9 aa, Homo Sapiens
GLRNAWNII

SEQ ID NO: 737847 - protein, 9 aa, Homo Sapiens
YEYKCGDGH

SEQ ID NO: 737848 - protein, 9 aa, Homo Sapiens
TDPLVQVSV

SEQ ID NO: 737849 - protein, 9 aa, Homo Sapiens
VVILFYGLA

SEQ ID NO: 737850 - protein, 9 aa, Homo Sapiens
NNQTLTVVS

SEQ ID NO: 737851 - protein, 9 aa, Homo Sapiens
LLYAPIGFC

SEQ ID NO: 737852 - protein, 9 aa, Homo Sapiens
RTSTTSCSC

SEQ ID NO: 737853 - protein, 9 aa, Homo Sapiens
RNQAPLLHE

SEQ ID NO: 737854 - protein, 9 aa, Homo Sapiens
GASPDAYLK

SEQ ID NO: 737855 - protein, 9 aa, Homo Sapiens
VLHAAQLPG

SEQ ID NO: 737856 - protein, 9 aa, Homo Sapiens
VGLGAHGAH

SEQ ID NO: 737857 - protein, 9 aa, Homo Sapiens
FGEECEILR

SEQ ID NO: 737858 - protein, 9 aa, Homo Sapiens
GEALGLVEV

SEQ ID NO: 737859 - protein, 9 aa, Homo Sapiens
GSMQRLPLN

SEQ ID NO: 737860 - protein, 9 aa, Homo Sapiens
MFLAFLVIY

SEQ ID NO: 737861 - protein, 9 aa, Homo Sapiens
SNLNVTAGE

SEQ ID NO: 737862 - protein, 9 aa, Homo Sapiens
SPEKAPPVS

SEQ ID NO: 737863 - protein, 9 aa, Homo Sapiens
LSEQLMDYH

SEQ ID NO: 737864 - protein, 9 aa, Homo Sapiens
PHHHDELGV

SEQ ID NO: 737865 - protein, 9 aa, Homo Sapiens
CRNVTAVPG

SEQ ID NO: 737866 - protein, 9 aa, Homo Sapiens
AQGNLRQHI

SEQ ID NO: 737867 - protein, 9 aa, Homo Sapiens
LEAQEVLHA

SEQ ID NO: 737868 - protein, 9 aa, Homo Sapiens
SSQMFCFVE

SEQ ID NO: 737869 - protein, 9 aa, Homo Sapiens
ALPLGIYSA

SEQ ID NO: 737870 - protein, 9 aa, Homo Sapiens
RQSSRGKNT

SEQ ID NO: 737871 - protein, 9 aa, Homo Sapiens
ELQLHLFLL

SEQ ID NO: 737872 - protein, 9 aa, Homo Sapiens
CPGVMQSPP

SEQ ID NO: 737873 - protein, 9 aa, Homo Sapiens
MYWRRMEEQ

SEQ ID NO: 737874 - protein, 9 aa, Homo Sapiens
PENEGEETC

SEQ ID NO: 737875 - protein, 9 aa, Homo Sapiens
ATDHSSPAL

SEQ ID NO: 737876 - protein, 9 aa, Homo Sapiens
VQEQRQGPR

SEQ ID NO: 737877 - protein, 9 aa, Homo Sapiens
PAAPAAPEE

SEQ ID NO: 737878 - protein, 9 aa, Homo Sapiens
YFCVEPETG

SEQ ID NO: 737879 - protein, 9 aa, Homo Sapiens
LSLLIDLDT

SEQ ID NO: 737880 - protein, 9 aa, Homo Sapiens
VGSFGAPRY

SEQ ID NO: 737881 - protein, 9 aa, Homo Sapiens
YSAGDSLII

SEQ ID NO: 737882 - protein, 9 aa, Homo Sapiens
LMQDTHRRL

SEQ ID NO: 737883 - protein, 9 aa, Homo Sapiens
TDSGFAAAD

SEQ ID NO: 737884 - protein, 9 aa, Homo Sapiens
FYILQSSLS

SEQ ID NO: 737885 - protein, 9 aa, Homo Sapiens
TYYNRNAEM

SEQ ID NO: 737886 - protein, 9 aa, Homo Sapiens
RPKMDGAAT

SEQ ID NO: 737887 - protein, 9 aa, Homo Sapiens
VPHHHDELG

SEQ ID NO: 737888 - protein, 9 aa, Homo Sapiens
ISSPSSGLT

SEQ ID NO: 737889 - protein, 9 aa, Homo Sapiens
SLGAQCLIA

SEQ ID NO: 737890 - protein, 9 aa, Homo Sapiens
RMEGTLQAS

SEQ ID NO: 737891 - protein, 9 aa, Homo Sapiens
VHAIQDPAR

SEQ ID NO: 737892 - protein, 9 aa, Homo Sapiens
LRQLLAAFV

SEQ ID NO: 737893 - protein, 9 aa, Homo Sapiens
FPGGAIKTG

SEQ ID NO: 737894 - protein, 9 aa, Homo Sapiens
FDSFVAYMI

SEQ ID NO: 737895 - protein, 9 aa, Homo Sapiens
CNTERLDLN

SEQ ID NO: 737896 - protein, 9 aa, Homo Sapiens
IIKCLRNKH

SEQ ID NO: 737897 - protein, 9 aa, Homo Sapiens
AQDAGIYEF

SEQ ID NO: 737898 - protein, 9 aa, Homo Sapiens
RNSWTPPIS

SEQ ID NO: 737899 - protein, 9 aa, Homo Sapiens
PDPLMKVND

SEQ ID NO: 737900 - protein, 9 aa, Homo Sapiens
QMFPCIIQL

SEQ ID NO: 737901 - protein, 9 aa, Homo Sapiens
LFSVAGGGR

SEQ ID NO: 737902 - protein, 9 aa, Homo Sapiens
SGFGQHESK

SEQ ID NO: 737903 - protein, 9 aa, Homo Sapiens
DEKILKPHL

SEQ ID NO: 737904 - protein, 9 aa, Homo Sapiens
TTAPVLMGT

SEQ ID NO: 737905 - protein, 9 aa, Homo Sapiens
QEQRQGPRR

SEQ ID NO: 737906 - protein, 9 aa, Homo Sapiens
LRSMDRAGA

SEQ ID NO: 737907 - protein, 9 aa, Homo Sapiens
TRYTRKAGV

SEQ ID NO: 737908 - protein, 9 aa, Homo Sapiens
LRGEDSRGA

SEQ ID NO: 737909 - protein, 9 aa, Homo Sapiens
ELQVPSCWL

SEQ ID NO: 737910 - protein, 9 aa, Homo Sapiens
PIIHKNIVC

SEQ ID NO: 737911 - protein, 9 aa, Homo Sapiens
PCTVDAGGL

SEQ ID NO: 737912 - protein, 9 aa, Homo Sapiens
IVANGKGIM

SEQ ID NO: 737913 - protein, 9 aa, Homo Sapiens
PLVVAESMY

SEQ ID NO: 737914 - protein, 9 aa, Homo Sapiens
KFVRAFVDA

SEQ ID NO: 737915 - protein, 9 aa, Homo Sapiens
KLLGVMARW

SEQ ID NO: 737916 - protein, 9 aa, Homo Sapiens
KSADSLYYP

SEQ ID NO: 737917 - protein, 9 aa, Homo Sapiens
TLKKSELEL

SEQ ID NO: 737918 - protein, 9 aa, Homo Sapiens
SGDSNSHFE

SEQ ID NO: 737919 - protein, 9 aa, Homo Sapiens
RGSVKNKVG

SEQ ID NO: 737920 - protein, 9 aa, Homo Sapiens
DSNSHFEPY

SEQ ID NO: 737921 - protein, 9 aa, Homo Sapiens
SSEGLASPH

SEQ ID NO: 737922 - protein, 9 aa, Homo Sapiens
ERMGIAQGN

SEQ ID NO: 737923 - protein, 9 aa, Homo Sapiens
PSKFEDPVL

SEQ ID NO: 737924 - protein, 9 aa, Homo Sapiens
HAQELQQRP

SEQ ID NO: 737925 - protein, 9 aa, Homo Sapiens
ASTEAGGFF

SEQ ID NO: 737926 - protein, 9 aa, Homo Sapiens
WVYLPDGSH

SEQ ID NO: 737927 - protein, 9 aa, Homo Sapiens
RKGGSVGSL

SEQ ID NO: 737928 - protein, 9 aa, Homo Sapiens
CHRGFELSS

SEQ ID NO: 737929 - protein, 9 aa, Homo Sapiens
NSEKASEQS

SEQ ID NO: 737930 - protein, 9 aa, Homo Sapiens
TIDTYYNRN

SEQ ID NO: 737931 - protein, 9 aa, Homo Sapiens
VEVRGSNVA

SEQ ID NO: 737932 - protein, 9 aa, Homo Sapiens
GLKLLSSCD

SEQ ID NO: 737933 - protein, 9 aa, Homo Sapiens
GTNKKHLSI

SEQ ID NO: 737934 - protein, 9 aa, Homo Sapiens
SNSEKASEQ

SEQ ID NO: 737935 - protein, 9 aa, Homo Sapiens
VVAAVEEVG

SEQ ID NO: 737936 - protein, 9 aa, Homo Sapiens
IRYPDPLMK

SEQ ID NO: 737937 - protein, 9 aa, Homo Sapiens
IIRFRTDDT

SEQ ID NO: 737938 - protein, 9 aa, Homo Sapiens
ASPFVLRAL

SEQ ID NO: 737939 - protein, 9 aa, Homo Sapiens
ANTGCWALS

SEQ ID NO: 737940 - protein, 9 aa, Homo Sapiens
CLYQEIAPY

SEQ ID NO: 737941 - protein, 9 aa, Homo Sapiens
EEEQVRKGG

SEQ ID NO: 737942 - protein, 9 aa, Homo Sapiens
RRMEEQQHH

SEQ ID NO: 737943 - protein, 9 aa, Homo Sapiens
AGPRIKCVW

SEQ ID NO: 737944 - protein, 9 aa, Homo Sapiens
NQTLHWQVI

SEQ ID NO: 737945 - protein, 9 aa, Homo Sapiens
EGKPKSSGF

SEQ ID NO: 737946 - protein, 9 aa, Homo Sapiens
KDSRVGAGI

SEQ ID NO: 737947 - protein, 9 aa, Homo Sapiens
SEGECQPRR

SEQ ID NO: 737948 - protein, 9 aa, Homo Sapiens
DRLREKMRR

SEQ ID NO: 737949 - protein, 9 aa, Homo Sapiens
FEDLEPKYW

SEQ ID NO: 737950 - protein, 9 aa, Homo Sapiens
SLDPGKEGL

SEQ ID NO: 737951 - protein, 9 aa, Homo Sapiens
VSEPVNPDL

SEQ ID NO: 737952 - protein, 9 aa, Homo Sapiens
EQGIGLYLR

SEQ ID NO: 737953 - protein, 9 aa, Homo Sapiens
EVGSVLPAG

SEQ ID NO: 737954 - protein, 9 aa, Homo Sapiens
SVEWLERAE

SEQ ID NO: 737955 - protein, 9 aa, Homo Sapiens
CSTLGEKLG

SEQ ID NO: 737956 - protein, 9 aa, Homo Sapiens
ACKQEKDYK

SEQ ID NO: 737957 - protein, 9 aa, Homo Sapiens
YNLWSITES

SEQ ID NO: 737958 - protein, 9 aa, Homo Sapiens
SENNLTHLP

SEQ ID NO: 737959 - protein, 9 aa, Homo Sapiens
LEFKILLYS

SEQ ID NO: 737960 - protein, 9 aa, Homo Sapiens
NDNAPVFDH

SEQ ID NO: 737961 - protein, 9 aa, Homo Sapiens
VNPDLSAGP

SEQ ID NO: 737962 - protein, 9 aa, Homo Sapiens
FSEQGIGLY

SEQ ID NO: 737963 - protein, 9 aa, Homo Sapiens
LRMLGIVHD

SEQ ID NO: 737964 - protein, 9 aa, Homo Sapiens
EYQEPLHLP

SEQ ID NO: 737965 - protein, 9 aa, Homo Sapiens
LLKGRKTFL

SEQ ID NO: 737966 - protein, 9 aa, Homo Sapiens
LWLLPPSSA

SEQ ID NO: 737967 - protein, 9 aa, Homo Sapiens
RSLSGRIVA

SEQ ID NO: 737968 - protein, 9 aa, Homo Sapiens
FGAPRYHEM

SEQ ID NO: 737969 - protein, 9 aa, Homo Sapiens
CTVDAGGLI

SEQ ID NO: 737970 - protein, 9 aa, Homo Sapiens
PAAPEETGS

SEQ ID NO: 737971 - protein, 9 aa, Homo Sapiens
NPHDPMSGG

SEQ ID NO: 737972 - protein, 9 aa, Homo Sapiens
VIIYNYHGT

SEQ ID NO: 737973 - protein, 9 aa, Homo Sapiens
LGAQCLIAS

SEQ ID NO: 737974 - protein, 9 aa, Homo Sapiens
PRAALLHSD

SEQ ID NO: 737975 - protein, 9 aa, Homo Sapiens
QAPLLHEVN

SEQ ID NO: 737976 - protein, 9 aa, Homo Sapiens
HQEGSTQQT

SEQ ID NO: 737977 - protein, 9 aa, Homo Sapiens
SRYTCQRNS

SEQ ID NO: 737978 - protein, 9 aa, Homo Sapiens
QIRNPLRQR

SEQ ID NO: 737979 - protein, 9 aa, Homo Sapiens
AYSTQSSLL

SEQ ID NO: 737980 - protein, 9 aa, Homo Sapiens
IDKLFHVTP

SEQ ID NO: 737981 - protein, 9 aa, Homo Sapiens
PFYNTVGML

SEQ ID NO: 737982 - protein, 9 aa, Homo Sapiens
VVYIPDLTT

SEQ ID NO: 737983 - protein, 9 aa, Homo Sapiens
YVRKSSARL

SEQ ID NO: 737984 - protein, 9 aa, Homo Sapiens
RFSSCNVKF

SEQ ID NO: 737985 - protein, 9 aa, Homo Sapiens
KDPDYVRKS

SEQ ID NO: 737986 - protein, 9 aa, Homo Sapiens
LRALRSMDR

SEQ ID NO: 737987 - protein, 9 aa, Homo Sapiens
YLKHASTEA

SEQ ID NO: 737988 - protein, 9 aa, Homo Sapiens
EQQHHWDDR

SEQ ID NO: 737989 - protein, 9 aa, Homo Sapiens
NSVEKGNSA

SEQ ID NO: 737990 - protein, 9 aa, Homo Sapiens
QPLSGSPPR

SEQ ID NO: 737991 - protein, 9 aa, Homo Sapiens
VSKRVLIPL

SEQ ID NO: 737992 - protein, 9 aa, Homo Sapiens
TRKAGVRSL

SEQ ID NO: 737993 - protein, 9 aa, Homo Sapiens
FEFPKEEWS

SEQ ID NO: 737994 - protein, 9 aa, Homo Sapiens
KCQKTYAPS

SEQ ID NO: 737995 - protein, 9 aa, Homo Sapiens
LRNKHPQEI

SEQ ID NO: 737996 - protein, 9 aa, Homo Sapiens
AYLERMKKN

SEQ ID NO: 737997 - protein, 9 aa, Homo Sapiens
GRNDSRFTH

SEQ ID NO: 737998 - protein, 9 aa, Homo Sapiens
AAIPAGPRK

SEQ ID NO: 737999 - protein, 9 aa, Homo Sapiens
AATLIQSLY

SEQ ID NO: 738000 - protein, 9 aa, Homo Sapiens
MPLALQGVM

SEQ ID NO: 738001 - protein, 9 aa, Homo Sapiens
AEGRTSGQI

SEQ ID NO: 738002 - protein, 9 aa, Homo Sapiens
CKDGDKSFI

SEQ ID NO: 738003 - protein, 9 aa, Homo Sapiens
ETMSYGGCV

SEQ ID NO: 738004 - protein, 9 aa, Homo Sapiens
LAWQSLLRD

SEQ ID NO: 738005 - protein, 9 aa, Homo Sapiens
PGRLRGEDS

SEQ ID NO: 738006 - protein, 9 aa, Homo Sapiens
RKSMDSKCQ

SEQ ID NO: 738007 - protein, 9 aa, Homo Sapiens
RPECKSMEV

SEQ ID NO: 738008 - protein, 9 aa, Homo Sapiens
TRELQEDIQ

SEQ ID NO: 738009 - protein, 9 aa, Homo Sapiens
GRDARGGLP

SEQ ID NO: 738010 - protein, 9 aa, Homo Sapiens
NGCFEDQYT

SEQ ID NO: 738011 - protein, 9 aa, Homo Sapiens
WYKNGPAID

SEQ ID NO: 738012 - protein, 9 aa, Homo Sapiens
LDKCQFQFR

SEQ ID NO: 738013 - protein, 9 aa, Homo Sapiens
VVANILQSR

SEQ ID NO: 738014 - protein, 9 aa, Homo Sapiens
QIHILVLPM

SEQ ID NO: 738015 - protein, 9 aa, Homo Sapiens
NKKHLSIEQ

SEQ ID NO: 738016 - protein, 9 aa, Homo Sapiens
GNRSDGSGK

SEQ ID NO: 738017 - protein, 9 aa, Homo Sapiens
APIGFCLLV

SEQ ID NO: 738018 - protein, 9 aa, Homo Sapiens
SRTPVNLVS

SEQ ID NO: 738019 - protein, 9 aa, Homo Sapiens
KIIGVFTII

SEQ ID NO: 738020 - protein, 9 aa, Homo Sapiens
QLIRYVGQN

SEQ ID NO: 738021 - protein, 9 aa, Homo Sapiens
QRKHIKRKA

SEQ ID NO: 738022 - protein, 9 aa, Homo Sapiens
VLYLLKGRK

SEQ ID NO: 738023 - protein, 9 aa, Homo Sapiens
LANTGCWAL

SEQ ID NO: 738024 - protein, 9 aa, Homo Sapiens
QLVKFLPAA

SEQ ID NO: 738025 - protein, 9 aa, Homo Sapiens
FTFLGFSDY

SEQ ID NO: 738026 - protein, 9 aa, Homo Sapiens
VGATDHSSP

SEQ ID NO: 738027 - protein, 9 aa, Homo Sapiens
SILYPPVDD

SEQ ID NO: 738028 - protein, 9 aa, Homo Sapiens
QSSNMTDGD

SEQ ID NO: 738029 - protein, 9 aa, Homo Sapiens
SQGLRHFGL

SEQ ID NO: 738030 - protein, 9 aa, Homo Sapiens
LYAPIGFCL

SEQ ID NO: 738031 - protein, 9 aa, Homo Sapiens
YEYRVDMVH

SEQ ID NO: 738032 - protein, 9 aa, Homo Sapiens
ADLDGAPRR

SEQ ID NO: 738033 - protein, 9 aa, Homo Sapiens
QWRHLCCGR

SEQ ID NO: 738034 - protein, 9 aa, Homo Sapiens
RRCKSEEHL

SEQ ID NO: 738035 - protein, 9 aa, Homo Sapiens
QSSHEEFRK

SEQ ID NO: 738036 - protein, 9 aa, Homo Sapiens
YHMEVEALD

SEQ ID NO: 738037 - protein, 9 aa, Homo Sapiens
NTGEAESKN

SEQ ID NO: 738038 - protein, 9 aa, Homo Sapiens
GRDGHQGLP

SEQ ID NO: 738039 - protein, 9 aa, Homo Sapiens
DKLHFPFFF

SEQ ID NO: 738040 - protein, 9 aa, Homo Sapiens
HRGFELSSD

SEQ ID NO: 738041 - protein, 9 aa, Homo Sapiens
MDRNPRAAL

SEQ ID NO: 738042 - protein, 9 aa, Homo Sapiens
MQCAMGDRG

SEQ ID NO: 738043 - protein, 9 aa, Homo Sapiens
SYHMEVEAL

SEQ ID NO: 738044 - protein, 9 aa, Homo Sapiens
VTMNKKDET

SEQ ID NO: 738045 - protein, 9 aa, Homo Sapiens
IIYNYHGTG

SEQ ID NO: 738046 - protein, 9 aa, Homo Sapiens
EFYMWTFRH

SEQ ID NO: 738047 - protein, 9 aa, Homo Sapiens
NMTDGDSFN

SEQ ID NO: 738048 - protein, 9 aa, Homo Sapiens
VAYSTQSSL

SEQ ID NO: 738049 - protein, 9 aa, Homo Sapiens
GVREGGPGE

SEQ ID NO: 738050 - protein, 9 aa, Homo Sapiens
QVLGVDADL

SEQ ID NO: 738051 - protein, 9 aa, Homo Sapiens
SPDTIMQCA

SEQ ID NO: 738052 - protein, 9 aa, Homo Sapiens
VDADLDGAP

SEQ ID NO: 738053 - protein, 9 aa, Homo Sapiens
TYGYFTILN

SEQ ID NO: 738054 - protein, 9 aa, Homo Sapiens
RRSPDDISF

SEQ ID NO: 738055 - protein, 9 aa, Homo Sapiens
QGNLRQHIL

SEQ ID NO: 738056 - protein, 9 aa, Homo Sapiens
VPQSSDGLL

SEQ ID NO: 738057 - protein, 9 aa, Homo Sapiens
GGMNLTVNP

SEQ ID NO: 738058 - protein, 9 aa, Homo Sapiens
HFQAAMANP

SEQ ID NO: 738059 - protein, 9 aa, Homo Sapiens
KSQPAPADG

SEQ ID NO: 738060 - protein, 9 aa, Homo Sapiens
EPKYWKNRI

SEQ ID NO: 738061 - protein, 9 aa, Homo Sapiens
GSALLPLQQ

SEQ ID NO: 738062 - protein, 9 aa, Homo Sapiens
PSQLIRYVG

SEQ ID NO: 738063 - protein, 9 aa, Homo Sapiens
SKNSPMKDS

SEQ ID NO: 738064 - protein, 9 aa, Homo Sapiens
PTPSATAMG

SEQ ID NO: 738065 - protein, 9 aa, Homo Sapiens
CRQGYYLQI

SEQ ID NO: 738066 - protein, 9 aa, Homo Sapiens
FCCSSAYIT

SEQ ID NO: 738067 - protein, 9 aa, Homo Sapiens
EKCVWFKHP

SEQ ID NO: 738068 - protein, 9 aa, Homo Sapiens
DIFERIAGK

SEQ ID NO: 738069 - protein, 9 aa, Homo Sapiens
QELQQRPRA

SEQ ID NO: 738070 - protein, 9 aa, Homo Sapiens
SQMFCFVEE

SEQ ID NO: 738071 - protein, 9 aa, Homo Sapiens
AAVEEVGLG

SEQ ID NO: 738072 - protein, 9 aa, Homo Sapiens
SFGAPRYHE

SEQ ID NO: 738073 - protein, 9 aa, Homo Sapiens
MEEQQHHWD

SEQ ID NO: 738074 - protein, 9 aa, Homo Sapiens
EQPELQLHL

SEQ ID NO: 738075 - protein, 9 aa, Homo Sapiens
GDGHCIPHD

SEQ ID NO: 738076 - protein, 9 aa, Homo Sapiens
IPLRPCARL

SEQ ID NO: 738077 - protein, 9 aa, Homo Sapiens
LESSQIHIL

SEQ ID NO: 738078 - protein, 9 aa, Homo Sapiens
NFEDLEPKY

SEQ ID NO: 738079 - protein, 9 aa, Homo Sapiens
VISGDKVNG

SEQ ID NO: 738080 - protein, 9 aa, Homo Sapiens
SEGQLPDYA

SEQ ID NO: 738081 - protein, 9 aa, Homo Sapiens
RNVTAVPGG

SEQ ID NO: 738082 - protein, 9 aa, Homo Sapiens
ESWELIIDP

SEQ ID NO: 738083 - protein, 9 aa, Homo Sapiens
IEGLINHSP

SEQ ID NO: 738084 - protein, 9 aa, Homo Sapiens
PAAALRLLQ

SEQ ID NO: 738085 - protein, 9 aa, Homo Sapiens
QDTSAYLER

SEQ ID NO: 738086 - protein, 9 aa, Homo Sapiens
YKEEKKDAA

SEQ ID NO: 738087 - protein, 9 aa, Homo Sapiens
LKMAADLVE

SEQ ID NO: 738088 - protein, 9 aa, Homo Sapiens
NCWLRLQAM

SEQ ID NO: 738089 - protein, 9 aa, Homo Sapiens
MFSVEWLER

SEQ ID NO: 738090 - protein, 9 aa, Homo Sapiens
EQHQNQAQD

SEQ ID NO: 738091 - protein, 9 aa, Homo Sapiens
SCATFGDGT

SEQ ID NO: 738092 - protein, 9 aa, Homo Sapiens
PAYSKLAMF

SEQ ID NO: 738093 - protein, 9 aa, Homo Sapiens
ARMVEAANG

SEQ ID NO: 738094 - protein, 9 aa, Homo Sapiens
IIGVFTIID

SEQ ID NO: 738095 - protein, 9 aa, Homo Sapiens
PLMKVNDTV

SEQ ID NO: 738096 - protein, 9 aa, Homo Sapiens
LTVNPAAPH

SEQ ID NO: 738097 - protein, 9 aa, Homo Sapiens
ALRSMDRAG

SEQ ID NO: 738098 - protein, 9 aa, Homo Sapiens
NGSEGECQP

SEQ ID NO: 738099 - protein, 9 aa, Homo Sapiens
RDARGGLPR

SEQ ID NO: 738100 - protein, 9 aa, Homo Sapiens
KETVHSFIP

SEQ ID NO: 738101 - protein, 9 aa, Homo Sapiens
LHFPFFFFP

SEQ ID NO: 738102 - protein, 9 aa, Homo Sapiens
SRGMEGTTA

SEQ ID NO: 738103 - protein, 9 aa, Homo Sapiens
NGTETLAPS

SEQ ID NO: 738104 - protein, 9 aa, Homo Sapiens
MLGIVHDAV

SEQ ID NO: 738105 - protein, 9 aa, Homo Sapiens
DQVDMPYQW

SEQ ID NO: 738106 - protein, 9 aa, Homo Sapiens
AGAAAEWGG

SEQ ID NO: 738107 - protein, 9 aa, Homo Sapiens
EQQEDITFK

SEQ ID NO: 738108 - protein, 9 aa, Homo Sapiens
MNYSSHSVL

SEQ ID NO: 738109 - protein, 9 aa, Homo Sapiens
GIAQGNLRQ

SEQ ID NO: 738110 - protein, 9 aa, Homo Sapiens
KHIKRKAPR

SEQ ID NO: 738111 - protein, 9 aa, Homo Sapiens
PSLSPKEPK

SEQ ID NO: 738112 - protein, 9 aa, Homo Sapiens
PLSGSPPRR

SEQ ID NO: 738113 - protein, 9 aa, Homo Sapiens
AKSLIYAQD

SEQ ID NO: 738114 - protein, 9 aa, Homo Sapiens
PQMFPCIIQ

SEQ ID NO: 738115 - protein, 9 aa, Homo Sapiens
EQALPITGT

SEQ ID NO: 738116 - protein, 9 aa, Homo Sapiens
SDDDGLRQL

SEQ ID NO: 738117 - protein, 9 aa, Homo Sapiens
EQDIKKVCE

SEQ ID NO: 738118 - protein, 9 aa, Homo Sapiens
SPWNLKLVQ

SEQ ID NO: 738119 - protein, 9 aa, Homo Sapiens
FSVEWLERA

SEQ ID NO: 738120 - protein, 9 aa, Homo Sapiens
SSSGSSART

SEQ ID NO: 738121 - protein, 9 aa, Homo Sapiens
NVRPPGTEG

SEQ ID NO: 738122 - protein, 9 aa, Homo Sapiens
LNTTTSATH

SEQ ID NO: 738123 - protein, 9 aa, Homo Sapiens
RYTRKAGVR

SEQ ID NO: 738124 - protein, 9 aa, Homo Sapiens
NLNVTAGEY

SEQ ID NO: 738125 - protein, 9 aa, Homo Sapiens
TQCSFLIDM

SEQ ID NO: 738126 - protein, 9 aa, Homo Sapiens
GLAIITYMT

SEQ ID NO: 738127 - protein, 9 aa, Homo Sapiens
TIFLLVHVH

SEQ ID NO: 738128 - protein, 9 aa, Homo Sapiens
SQTNRTFVT

SEQ ID NO: 738129 - protein, 9 aa, Homo Sapiens
MNTGEAESK

SEQ ID NO: 738130 - protein, 9 aa, Homo Sapiens
DLSENNLTH

SEQ ID NO: 738131 - protein, 9 aa, Homo Sapiens
TAPVLMGTE

SEQ ID NO: 738132 - protein, 9 aa, Homo Sapiens
AAPAAPEET

SEQ ID NO: 738133 - protein, 9 aa, Homo Sapiens
LQAGEALGL

SEQ ID NO: 738134 - protein, 9 aa, Homo Sapiens
GMNLTVNPA

SEQ ID NO: 738135 - protein, 9 aa, Homo Sapiens
QIHPDGALD

SEQ ID NO: 738136 - protein, 9 aa, Homo Sapiens
LIDLDTKYQ

SEQ ID NO: 738137 - protein, 9 aa, Homo Sapiens
PEPIYLTLP

SEQ ID NO: 738138 - protein, 9 aa, Homo Sapiens
SGDVKPSLS

SEQ ID NO: 738139 - protein, 9 aa, Homo Sapiens
FSSCNVKFE

SEQ ID NO: 738140 - protein, 9 aa, Homo Sapiens
AKPKSKLLV

SEQ ID NO: 738141 - protein, 9 aa, Homo Sapiens
RALRSMDRA

SEQ ID NO: 738142 - protein, 9 aa, Homo Sapiens
EMKKCIKDF

SEQ ID NO: 738143 - protein, 9 aa, Homo Sapiens
NADDANATQ

SEQ ID NO: 738144 - protein, 9 aa, Homo Sapiens
PGRKLRGVH

SEQ ID NO: 738145 - protein, 9 aa, Homo Sapiens
KILLYSQHY

SEQ ID NO: 738146 - protein, 9 aa, Homo Sapiens
PEAHAVTVP

SEQ ID NO: 738147 - protein, 9 aa, Homo Sapiens
SITCPLCRN

SEQ ID NO: 738148 - protein, 9 aa, Homo Sapiens
IYEFHTPST

SEQ ID NO: 738149 - protein, 9 aa, Homo Sapiens
EDSEAENAT

SEQ ID NO: 738150 - protein, 9 aa, Homo Sapiens
QIAFLPRME

SEQ ID NO: 738151 - protein, 9 aa, Homo Sapiens
DEDEQIAIS

SEQ ID NO: 738152 - protein, 9 aa, Homo Sapiens
TQIAFLPRM

SEQ ID NO: 738153 - protein, 9 aa, Homo Sapiens
HRNQAPLLH

SEQ ID NO: 738154 - protein, 9 aa, Homo Sapiens
LLLYAPIGF

SEQ ID NO: 738155 - protein, 9 aa, Homo Sapiens
RYTCQRNSW

SEQ ID NO: 738156 - protein, 9 aa, Homo Sapiens
GATVFPHLG

SEQ ID NO: 738157 - protein, 9 aa, Homo Sapiens
RFVETLHIT

SEQ ID NO: 738158 - protein, 9 aa, Homo Sapiens
HRVPHHHDE

SEQ ID NO: 738159 - protein, 9 aa, Homo Sapiens
DNLCKDGDK

SEQ ID NO: 738160 - protein, 9 aa, Homo Sapiens
DYAAGRQVP

SEQ ID NO: 738161 - protein, 9 aa, Homo Sapiens
AYLKSGGRQ

SEQ ID NO: 738162 - protein, 9 aa, Homo Sapiens
GKLLGVMAR

SEQ ID NO: 738163 - protein, 9 aa, Homo Sapiens
YLPDGSHLE

SEQ ID NO: 738164 - protein, 9 aa, Homo Sapiens
DARGGLPRD

SEQ ID NO: 738165 - protein, 9 aa, Homo Sapiens
SVGRQHHSG

SEQ ID NO: 738166 - protein, 9 aa, Homo Sapiens
LPSIGRLSE

SEQ ID NO: 738167 - protein, 9 aa, Homo Sapiens
QQEDITFKG

SEQ ID NO: 738168 - protein, 9 aa, Homo Sapiens
NGKGIMAAD

SEQ ID NO: 738169 - protein, 9 aa, Homo Sapiens
MVPPGLPGL

SEQ ID NO: 738170 - protein, 9 aa, Homo Sapiens
GWPLICMIF

SEQ ID NO: 738171 - protein, 9 aa, Homo Sapiens
PYQEELGEV

SEQ ID NO: 738172 - protein, 9 aa, Homo Sapiens
DKRREYVYQ

SEQ ID NO: 738173 - protein, 9 aa, Homo Sapiens
TASLPQELT

SEQ ID NO: 738174 - protein, 9 aa, Homo Sapiens
SPSSGLTAA

SEQ ID NO: 738175 - protein, 9 aa, Homo Sapiens
SEPVNPDLS

SEQ ID NO: 738176 - protein, 9 aa, Homo Sapiens
DADLDGAPR

SEQ ID NO: 738177 - protein, 9 aa, Homo Sapiens
LVDFYVMPM

SEQ ID NO: 738178 - protein, 9 aa, Homo Sapiens
GEEMEFPCH

SEQ ID NO: 738179 - protein, 9 aa, Homo Sapiens
LAAHEEHLA

SEQ ID NO: 738180 - protein, 9 aa, Homo Sapiens
KMAADLVEA

SEQ ID NO: 738181 - protein, 9 aa, Homo Sapiens
ILALVGEEM

SEQ ID NO: 738182 - protein, 9 aa, Homo Sapiens
VVEDEKILK

SEQ ID NO: 738183 - protein, 9 aa, Homo Sapiens
KNKTLDAME

SEQ ID NO: 738184 - protein, 9 aa, Homo Sapiens
FSIVSVAAR

SEQ ID NO: 738185 - protein, 9 aa, Homo Sapiens
EFTLTQMGP

SEQ ID NO: 738186 - protein, 9 aa, Homo Sapiens
VTWYKNGPA

SEQ ID NO: 738187 - protein, 9 aa, Homo Sapiens
AIHDSQTNR

SEQ ID NO: 738188 - protein, 9 aa, Homo Sapiens
DIDKLFHVT

SEQ ID NO: 738189 - protein, 9 aa, Homo Sapiens
SKRVLIPLP

SEQ ID NO: 738190 - protein, 9 aa, Homo Sapiens
GRLLHGDLP

SEQ ID NO: 738191 - protein, 9 aa, Homo Sapiens
TVKRIAAEL

SEQ ID NO: 738192 - protein, 9 aa, Homo Sapiens
QVDMPYQWE

SEQ ID NO: 738193 - protein, 9 aa, Homo Sapiens
FFQCKFCVS

SEQ ID NO: 738194 - protein, 9 aa, Homo Sapiens
LGANGSANI

SEQ ID NO: 738195 - protein, 9 aa, Homo Sapiens
STVDQLSMQ

SEQ ID NO: 738196 - protein, 9 aa, Homo Sapiens
LAHRDVPRQ

SEQ ID NO: 738197 - protein, 9 aa, Homo Sapiens
ELSCWGGGC

SEQ ID NO: 738198 - protein, 9 aa, Homo Sapiens
ALRLLQAGE

SEQ ID NO: 738199 - protein, 9 aa, Homo Sapiens
RAWPTLWFQ

SEQ ID NO: 738200 - protein, 9 aa, Homo Sapiens
GHQVPVPGE

SEQ ID NO: 738201 - protein, 9 aa, Homo Sapiens
FSTATFRFG

SEQ ID NO: 738202 - protein, 9 aa, Homo Sapiens
RYKQRQTRE

SEQ ID NO: 738203 - protein, 9 aa, Homo Sapiens
RKRTSITAP

SEQ ID NO: 738204 - protein, 9 aa, Homo Sapiens
SEHAKSLIY

SEQ ID NO: 738205 - protein, 9 aa, Homo Sapiens
FHCSCHRGF

SEQ ID NO: 738206 - protein, 9 aa, Homo Sapiens
EQNCTFEIE

SEQ ID NO: 738207 - protein, 9 aa, Homo Sapiens
RTPHSSGEA

SEQ ID NO: 738208 - protein, 9 aa, Homo Sapiens
GLASPHDVL

SEQ ID NO: 738209 - protein, 9 aa, Homo Sapiens
EAKPKSKLL

SEQ ID NO: 738210 - protein, 9 aa, Homo Sapiens
DILQSSNMT

SEQ ID NO: 738211 - protein, 9 aa, Homo Sapiens
PYFQRLPCP

SEQ ID NO: 738212 - protein, 9 aa, Homo Sapiens
YTALGYVQA

SEQ ID NO: 738213 - protein, 9 aa, Homo Sapiens
VHPGYITRP

SEQ ID NO: 738214 - protein, 9 aa, Homo Sapiens
PDKMPGKIA

SEQ ID NO: 738215 - protein, 9 aa, Homo Sapiens
EEFRKEVTG

SEQ ID NO: 738216 - protein, 9 aa, Homo Sapiens
LPTQAEGRT

SEQ ID NO: 738217 - protein, 9 aa, Homo Sapiens
EGKNAVIRL

SEQ ID NO: 738218 - protein, 9 aa, Homo Sapiens
IIDDPETKR

SEQ ID NO: 738219 - protein, 9 aa, Homo Sapiens
GCRGHGPGR

SEQ ID NO: 738220 - protein, 9 aa, Homo Sapiens
QETLSGAKS

SEQ ID NO: 738221 - protein, 9 aa, Homo Sapiens
MKVNDTVQI

SEQ ID NO: 738222 - protein, 9 aa, Homo Sapiens
MVLLKQAAL

SEQ ID NO: 738223 - protein, 9 aa, Homo Sapiens
LQGQPYFCV

SEQ ID NO: 738224 - protein, 9 aa, Homo Sapiens
SLSLLIDLD

SEQ ID NO: 738225 - protein, 9 aa, Homo Sapiens
EQEVQEWEE

SEQ ID NO: 738226 - protein, 9 aa, Homo Sapiens
YALLDEHTK

SEQ ID NO: 738227 - protein, 9 aa, Homo Sapiens
PHPTTRLLL

SEQ ID NO: 738228 - protein, 9 aa, Homo Sapiens
LFLPKETVH

SEQ ID NO: 738229 - protein, 9 aa, Homo Sapiens
LDTKYQVTF

SEQ ID NO: 738230 - protein, 9 aa, Homo Sapiens
VEVEVLVRD

SEQ ID NO: 738231 - protein, 9 aa, Homo Sapiens
EQRQGPRRG

SEQ ID NO: 738232 - protein, 9 aa, Homo Sapiens
PGRVADEPL

SEQ ID NO: 738233 - protein, 9 aa, Homo Sapiens
AHSHSTIGW

SEQ ID NO: 738234 - protein, 9 aa, Homo Sapiens
LRVVRDGPG

SEQ ID NO: 738235 - protein, 9 aa, Homo Sapiens
LRVPLPRLD

SEQ ID NO: 738236 - protein, 9 aa, Homo Sapiens
EFRKEVTGS

SEQ ID NO: 738237 - protein, 9 aa, Homo Sapiens
GLRMLGIVH

SEQ ID NO: 738238 - protein, 9 aa, Homo Sapiens
EPAVEFTLT

SEQ ID NO: 738239 - protein, 9 aa, Homo Sapiens
GVDADLDGA

SEQ ID NO: 738240 - protein, 9 aa, Homo Sapiens
KPSLSPKEP

SEQ ID NO: 738241 - protein, 9 aa, Homo Sapiens
GDWVRKDSR

SEQ ID NO: 738242 - protein, 9 aa, Homo Sapiens
GTDSGFAAA

SEQ ID NO: 738243 - protein, 9 aa, Homo Sapiens
SSEHAKSLI

SEQ ID NO: 738244 - protein, 9 aa, Homo Sapiens
DEARCPVFE

SEQ ID NO: 738245 - protein, 9 aa, Homo Sapiens
TGRLLHGDL

SEQ ID NO: 738246 - protein, 9 aa, Homo Sapiens
ERLCPWSCS

SEQ ID NO: 738247 - protein, 9 aa, Homo Sapiens
HLSQGLRHF

SEQ ID NO: 738248 - protein, 9 aa, Homo Sapiens
GHQGLPGPK

SEQ ID NO: 738249 - protein, 9 aa, Homo Sapiens
KLAMFVQTE

SEQ ID NO: 738250 - protein, 9 aa, Homo Sapiens
PMVPPGLPG

SEQ ID NO: 738251 - protein, 9 aa, Homo Sapiens
VIRLCFLKA

SEQ ID NO: 738252 - protein, 9 aa, Homo Sapiens
GAQCLIASR

SEQ ID NO: 738253 - protein, 9 aa, Homo Sapiens
NAVIRLCFL

SEQ ID NO: 738254 - protein, 9 aa, Homo Sapiens
VYTALGYVQ

SEQ ID NO: 738255 - protein, 9 aa, Homo Sapiens
ANILQSRQS

SEQ ID NO: 738256 - protein, 9 aa, Homo Sapiens
SGSSARTPT

SEQ ID NO: 738257 - protein, 9 aa, Homo Sapiens
HTKYSLQYY

SEQ ID NO: 738258 - protein, 9 aa, Homo Sapiens
SSLDTPHRS

SEQ ID NO: 738259 - protein, 9 aa, Homo Sapiens
QGLDTTAPV

SEQ ID NO: 738260 - protein, 9 aa, Homo Sapiens
LNQMNYSSH

SEQ ID NO: 738261 - protein, 9 aa, Homo Sapiens
VGEEMEFPC

SEQ ID NO: 738262 - protein, 9 aa, Homo Sapiens
GRDREVGSV

SEQ ID NO: 738263 - protein, 9 aa, Homo Sapiens
VLRGLRNEA

SEQ ID NO: 738264 - protein, 9 aa, Homo Sapiens
GGMNRGPIL

SEQ ID NO: 738265 - protein, 9 aa, Homo Sapiens
LTTGYKPQI

SEQ ID NO: 738266 - protein, 9 aa, Homo Sapiens
DIITRYTRK

SEQ ID NO: 738267 - protein, 9 aa, Homo Sapiens
PFFFFPVFL

SEQ ID NO: 738268 - protein, 9 aa, Homo Sapiens
AAYDEDEQI

SEQ ID NO: 738269 - protein, 9 aa, Homo Sapiens
TLTVVSHLH

SEQ ID NO: 738270 - protein, 9 aa, Homo Sapiens
QDSGDRAAI

SEQ ID NO: 738271 - protein, 9 aa, Homo Sapiens
ADEPLAAHE

SEQ ID NO: 738272 - protein, 9 aa, Homo Sapiens
YDYNLWSIT

SEQ ID NO: 738273 - protein, 9 aa, Homo Sapiens
PLGIYSATK

SEQ ID NO: 738274 - protein, 9 aa, Homo Sapiens
WIGLGPAKR

SEQ ID NO: 738275 - protein, 9 aa, Homo Sapiens
SLSPKEPKT

SEQ ID NO: 738276 - protein, 9 aa, Homo Sapiens
EEQQHHWDD

SEQ ID NO: 738277 - protein, 9 aa, Homo Sapiens
NQMNYSSHS

SEQ ID NO: 738278 - protein, 9 aa, Homo Sapiens
AWPTLWFQS

SEQ ID NO: 738279 - protein, 9 aa, Homo Sapiens
REVGSVLPA

SEQ ID NO: 738280 - protein, 9 aa, Homo Sapiens
GHGRDARGG

SEQ ID NO: 738281 - protein, 9 aa, Homo Sapiens
IANCEDSSS

SEQ ID NO: 738282 - protein, 9 aa, Homo Sapiens
HIKRKAPRG

SEQ ID NO: 738283 - protein, 9 aa, Homo Sapiens
QIVSQQRIL

SEQ ID NO: 738284 - protein, 9 aa, Homo Sapiens
PQGDQGLES

SEQ ID NO: 738285 - protein, 9 aa, Homo Sapiens
SVHQMTIPC

SEQ ID NO: 738286 - protein, 9 aa, Homo Sapiens
KNNPHDPMS

SEQ ID NO: 738287 - protein, 9 aa, Homo Sapiens
DKVNGNCTG

SEQ ID NO: 738288 - protein, 9 aa, Homo Sapiens
SADSLYYPF

SEQ ID NO: 738289 - protein, 9 aa, Homo Sapiens
CSCHRGFEL

SEQ ID NO: 738290 - protein, 9 aa, Homo Sapiens
IHETQTAKE

SEQ ID NO: 738291 - protein, 9 aa, Homo Sapiens
VQGSGHQVP

SEQ ID NO: 738292 - protein, 9 aa, Homo Sapiens
WLSFPWPEQ

SEQ ID NO: 738293 - protein, 9 aa, Homo Sapiens
IGFCLLVLR

SEQ ID NO: 738294 - protein, 9 aa, Homo Sapiens
ACVLDSRVA

SEQ ID NO: 738295 - protein, 9 aa, Homo Sapiens
GLPGPPGTP

SEQ ID NO: 738296 - protein, 9 aa, Homo Sapiens
LPGRVADEP

SEQ ID NO: 738297 - protein, 9 aa, Homo Sapiens
WGGWAAAAL

SEQ ID NO: 738298 - protein, 9 aa, Homo Sapiens
FMVWCGELS

SEQ ID NO: 738299 - protein, 9 aa, Homo Sapiens
VLRALRSMD

SEQ ID NO: 738300 - protein, 9 aa, Homo Sapiens
AQSDIPCQH

SEQ ID NO: 738301 - protein, 9 aa, Homo Sapiens
EGECQPRRN

SEQ ID NO: 738302 - protein, 9 aa, Homo Sapiens
DGEVAQPVL

SEQ ID NO: 738303 - protein, 9 aa, Homo Sapiens
ITRYTRKAG

SEQ ID NO: 738304 - protein, 9 aa, Homo Sapiens
RHDAFQILV

SEQ ID NO: 738305 - protein, 9 aa, Homo Sapiens
IYSATKFWM

SEQ ID NO: 738306 - protein, 9 aa, Homo Sapiens
IVEVFSGDL

SEQ ID NO: 738307 - protein, 9 aa, Homo Sapiens
IITRYTRKA

SEQ ID NO: 738308 - protein, 9 aa, Homo Sapiens
LVHVHPGYI

SEQ ID NO: 738309 - protein, 9 aa, Homo Sapiens
SCHRGFELS

SEQ ID NO: 738310 - protein, 9 aa, Homo Sapiens
IQDPARSAG

SEQ ID NO: 738311 - protein, 9 aa, Homo Sapiens
VAQKNYDPL

SEQ ID NO: 738312 - protein, 9 aa, Homo Sapiens
GQLECKAKR

SEQ ID NO: 738313 - protein, 9 aa, Homo Sapiens
SGDRAAIPA

SEQ ID NO: 738314 - protein, 9 aa, Homo Sapiens
DRSPRHYLG

SEQ ID NO: 738315 - protein, 9 aa, Homo Sapiens
ALGYVQAFV

SEQ ID NO: 738316 - protein, 9 aa, Homo Sapiens
ESYPLVVAE

SEQ ID NO: 738317 - protein, 9 aa, Homo Sapiens
GIGLYLRKR

SEQ ID NO: 738318 - protein, 9 aa, Homo Sapiens
RDDPLEAQE

SEQ ID NO: 738319 - protein, 9 aa, Homo Sapiens
HAEQIVSQQ

SEQ ID NO: 738320 - protein, 9 aa, Homo Sapiens
ASRPQLALL

SEQ ID NO: 738321 - protein, 9 aa, Homo Sapiens
NKYYCNQHV

SEQ ID NO: 738322 - protein, 9 aa, Homo Sapiens
SGQLVKFLP

SEQ ID NO: 738323 - protein, 9 aa, Homo Sapiens
AVAPLVITY

SEQ ID NO: 738324 - protein, 9 aa, Homo Sapiens
CGKHSQPWQ

SEQ ID NO: 738325 - protein, 9 aa, Homo Sapiens
LFTNTVKDR

SEQ ID NO: 738326 - protein, 9 aa, Homo Sapiens
AAFNSTRYF

SEQ ID NO: 738327 - protein, 9 aa, Homo Sapiens
EKILKPHLF

SEQ ID NO: 738328 - protein, 9 aa, Homo Sapiens
YVQAFVGGL

SEQ ID NO: 738329 - protein, 9 aa, Homo Sapiens
GNQTLHWQV

SEQ ID NO: 738330 - protein, 9 aa, Homo Sapiens
VYLPDGSHL

SEQ ID NO: 738331 - protein, 9 aa, Homo Sapiens
HDAFQILVE

SEQ ID NO: 738332 - protein, 9 aa, Homo Sapiens
ASGQLVKFL

SEQ ID NO: 738333 - protein, 9 aa, Homo Sapiens
IKLEGTLKK

SEQ ID NO: 738334 - protein, 9 aa, Homo Sapiens
GDVCISILY

SEQ ID NO: 738335 - protein, 9 aa, Homo Sapiens
RFCPFYNTV

SEQ ID NO: 738336 - protein, 9 aa, Homo Sapiens
AGIYEFHTP

SEQ ID NO: 738337 - protein, 9 aa, Homo Sapiens
KVLPKETLR

SEQ ID NO: 738338 - protein, 9 aa, Homo Sapiens
DIPCQHSKE

SEQ ID NO: 738339 - protein, 9 aa, Homo Sapiens
AKPAESWEL

SEQ ID NO: 738340 - protein, 9 aa, Homo Sapiens
LIPLPVSNI

SEQ ID NO: 738341 - protein, 9 aa, Homo Sapiens
RLPDLKRPS

SEQ ID NO: 738342 - protein, 9 aa, Homo Sapiens
NEAAPQEKK

SEQ ID NO: 738343 - protein, 9 aa, Homo Sapiens
GIPCTVDAG

SEQ ID NO: 738344 - protein, 9 aa, Homo Sapiens
TLDAMELYR

SEQ ID NO: 738345 - protein, 9 aa, Homo Sapiens
FTILNGSDI

SEQ ID NO: 738346 - protein, 9 aa, Homo Sapiens
RYHEMPNRE

SEQ ID NO: 738347 - protein, 9 aa, Homo Sapiens
RYNSLSELC

SEQ ID NO: 738348 - protein, 9 aa, Homo Sapiens
TTSCSCQSS

SEQ ID NO: 738349 - protein, 9 aa, Homo Sapiens
SLSALLHSK

SEQ ID NO: 738350 - protein, 9 aa, Homo Sapiens
DSVEQHGDE

SEQ ID NO: 738351 - protein, 9 aa, Homo Sapiens
TSGTTFTFL

SEQ ID NO: 738352 - protein, 9 aa, Homo Sapiens
FSLFSAAVS

SEQ ID NO: 738353 - protein, 9 aa, Homo Sapiens
PRGISSPSS

SEQ ID NO: 738354 - protein, 9 aa, Homo Sapiens
DELGVLGHG

SEQ ID NO: 738355 - protein, 9 aa, Homo Sapiens
SSTLTRHKS

SEQ ID NO: 738356 - protein, 9 aa, Homo Sapiens
IKFVRAFVD

SEQ ID NO: 738357 - protein, 9 aa, Homo Sapiens
AECVEFTAQ

SEQ ID NO: 738358 - protein, 9 aa, Homo Sapiens
VLIGWPLIC

SEQ ID NO: 738359 - protein, 9 aa, Homo Sapiens
DEPLAAHEE

SEQ ID NO: 738360 - protein, 9 aa, Homo Sapiens
IVSVAARLA

SEQ ID NO: 738361 - protein, 9 aa, Homo Sapiens
HMEVEALDG

SEQ ID NO: 738362 - protein, 9 aa, Homo Sapiens
QELAIHDSQ

SEQ ID NO: 738363 - protein, 9 aa, Homo Sapiens
TMNKKDETM

SEQ ID NO: 738364 - protein, 9 aa, Homo Sapiens
KVVEDEKIL

SEQ ID NO: 738365 - protein, 9 aa, Homo Sapiens
LPPIIHKNI

SEQ ID NO: 738366 - protein, 9 aa, Homo Sapiens
LIGWPLICM

SEQ ID NO: 738367 - protein, 9 aa, Homo Sapiens
KERLCPWSC

SEQ ID NO: 738368 - protein, 9 aa, Homo Sapiens
SNSHFEPYY

SEQ ID NO: 738369 - protein, 9 aa, Homo Sapiens
LKQAALKQL

SEQ ID NO: 738370 - protein, 9 aa, Homo Sapiens
EVHPMVQCP

SEQ ID NO: 738371 - protein, 9 aa, Homo Sapiens
IVGGWECGK

SEQ ID NO: 738372 - protein, 9 aa, Homo Sapiens
SSRSEQHQN

SEQ ID NO: 738373 - protein, 9 aa, Homo Sapiens
PMVNVDGYD

SEQ ID NO: 738374 - protein, 9 aa, Homo Sapiens
SGPPSTSRP

SEQ ID NO: 738375 - protein, 9 aa, Homo Sapiens
TIRSPLRYN

SEQ ID NO: 738376 - protein, 9 aa, Homo Sapiens
HLCVFRTVN

SEQ ID NO: 738377 - protein, 9 aa, Homo Sapiens
QLHLFLLFL

SEQ ID NO: 738378 - protein, 9 aa, Homo Sapiens
DKCQFQFRN

SEQ ID NO: 738379 - protein, 9 aa, Homo Sapiens
FSVAGGGRL

SEQ ID NO: 738380 - protein, 9 aa, Homo Sapiens
SGPGAARTP

SEQ ID NO: 738381 - protein, 9 aa, Homo Sapiens
ITHCHDKDD

SEQ ID NO: 738382 - protein, 9 aa, Homo Sapiens
MARWLRGAR

SEQ ID NO: 738383 - protein, 9 aa, Homo Sapiens
LCVFRTVNY

SEQ ID NO: 738384 - protein, 9 aa, Homo Sapiens
TETFNISLF

SEQ ID NO: 738385 - protein, 9 aa, Homo Sapiens
VEFTAQPAG

SEQ ID NO: 738386 - protein, 9 aa, Homo Sapiens
HMAHSHSTI

SEQ ID NO: 738387 - protein, 9 aa, Homo Sapiens
RQGPRRGLG

SEQ ID NO: 738388 - protein, 9 aa, Homo Sapiens
SSKNSPMKD

SEQ ID NO: 738389 - protein, 9 aa, Homo Sapiens
APLVITYVR

SEQ ID NO: 738390 - protein, 9 aa, Homo Sapiens
RAAREPEAA

SEQ ID NO: 738391 - protein, 9 aa, Homo Sapiens
ERLRFKGSM

SEQ ID NO: 738392 - protein, 9 aa, Homo Sapiens
GTTFTFLGF

SEQ ID NO: 738393 - protein, 9 aa, Homo Sapiens
FYVGCAVAT

SEQ ID NO: 738394 - protein, 9 aa, Homo Sapiens
AGMMGFPGP

SEQ ID NO: 738395 - protein, 9 aa, Homo Sapiens
STSIPNVTV

SEQ ID NO: 738396 - protein, 9 aa, Homo Sapiens
LPSWVAGLD

SEQ ID NO: 738397 - protein, 9 aa, Homo Sapiens
PSTPKHKKF

SEQ ID NO: 738398 - protein, 9 aa, Homo Sapiens
FFFFPVFLY

SEQ ID NO: 738399 - protein, 9 aa, Homo Sapiens
PEKAPPVSH

SEQ ID NO: 738400 - protein, 9 aa, Homo Sapiens
SKLLVKVPL

SEQ ID NO: 738401 - protein, 9 aa, Homo Sapiens
SPRYSTIDQ

SEQ ID NO: 738402 - protein, 9 aa, Homo Sapiens
YESQLFEWL

SEQ ID NO: 738403 - protein, 9 aa, Homo Sapiens
RPVTQVTPR

SEQ ID NO: 738404 - protein, 9 aa, Homo Sapiens
LLSHDQVDM

SEQ ID NO: 738405 - protein, 9 aa, Homo Sapiens
YLGHFLPTN

SEQ ID NO: 738406 - protein, 9 aa, Homo Sapiens
KHKKFQKGS

SEQ ID NO: 738407 - protein, 9 aa, Homo Sapiens
GLSPDTIMQ

SEQ ID NO: 738408 - protein, 9 aa, Homo Sapiens
EYKCGDGHC

SEQ ID NO: 738409 - protein, 9 aa, Homo Sapiens
NTNSVEKGN

SEQ ID NO: 738410 - protein, 9 aa, Homo Sapiens
PTLWFQSES

SEQ ID NO: 738411 - protein, 9 aa, Homo Sapiens
SRFLNGCFE

SEQ ID NO: 738412 - protein, 9 aa, Homo Sapiens
RLGQPMPSW

SEQ ID NO: 738413 - protein, 9 aa, Homo Sapiens
GSSDDTASS

SEQ ID NO: 738414 - protein, 9 aa, Homo Sapiens
LSPRRRIIL

SEQ ID NO: 738415 - protein, 9 aa, Homo Sapiens
EFPKEEWSQ

SEQ ID NO: 738416 - protein, 9 aa, Homo Sapiens
NNPHDPMSG

SEQ ID NO: 738417 - protein, 9 aa, Homo Sapiens
EAGGFFSLY

SEQ ID NO: 738418 - protein, 9 aa, Homo Sapiens
PRYHEMPNR

SEQ ID NO: 738419 - protein, 9 aa, Homo Sapiens
DERLRFKGS

SEQ ID NO: 738420 - protein, 9 aa, Homo Sapiens
FEQEVQEWE

SEQ ID NO: 738421 - protein, 9 aa, Homo Sapiens
SNVAFYKGF

SEQ ID NO: 738422 - protein, 9 aa, Homo Sapiens
FLQGLALDM

SEQ ID NO: 738423 - protein, 9 aa, Homo Sapiens
SEQGIGLYL

SEQ ID NO: 738424 - protein, 9 aa, Homo Sapiens
ADAVLRCSV

SEQ ID NO: 738425 - protein, 9 aa, Homo Sapiens
SGSPPRRAY

SEQ ID NO: 738426 - protein, 9 aa, Homo Sapiens
SASTAPSST

SEQ ID NO: 738427 - protein, 9 aa, Homo Sapiens
SFWLCCRRC

SEQ ID NO: 738428 - protein, 9 aa, Homo Sapiens
LNYLGHFLP

SEQ ID NO: 738429 - protein, 9 aa, Homo Sapiens
FLPRMEGTL

SEQ ID NO: 738430 - protein, 9 aa, Homo Sapiens
KGRKTFLIP

SEQ ID NO: 738431 - protein, 9 aa, Homo Sapiens
MEGTLQASP

SEQ ID NO: 738432 - protein, 9 aa, Homo Sapiens
AVPHRNQAP

SEQ ID NO: 738433 - protein, 9 aa, Homo Sapiens
GLDTTAPVL

SEQ ID NO: 738434 - protein, 9 aa, Homo Sapiens
VEFTLTQMG

SEQ ID NO: 738435 - protein, 9 aa, Homo Sapiens
LTNREIVEV

SEQ ID NO: 738436 - protein, 9 aa, Homo Sapiens
VSNVFSTAT

SEQ ID NO: 738437 - protein, 9 aa, Homo Sapiens
STDPLVQVS

SEQ ID NO: 738438 - protein, 9 aa, Homo Sapiens
TQHQRSAST

SEQ ID NO: 738439 - protein, 9 aa, Homo Sapiens
NYSSHSVLQ

SEQ ID NO: 738440 - protein, 9 aa, Homo Sapiens
QQHHWDDRR

SEQ ID NO: 738441 - protein, 9 aa, Homo Sapiens
RSPIYFFLT

SEQ ID NO: 738442 - protein, 9 aa, Homo Sapiens
VENKNGTET

SEQ ID NO: 738443 - protein, 9 aa, Homo Sapiens
AGSALLPLQ

SEQ ID NO: 738444 - protein, 9 aa, Homo Sapiens
VFSVVFTDA

SEQ ID NO: 738445 - protein, 9 aa, Homo Sapiens
GPGRAEPPR

SEQ ID NO: 738446 - protein, 9 aa, Homo Sapiens
APIKKPEAH

SEQ ID NO: 738447 - protein, 9 aa, Homo Sapiens
LFPFLIMLT

SEQ ID NO: 738448 - protein, 9 aa, Homo Sapiens
LVLLLYAPI

SEQ ID NO: 738449 - protein, 9 aa, Homo Sapiens
LQLHLFLLF

SEQ ID NO: 738450 - protein, 9 aa, Homo Sapiens
LPKEVILKM

SEQ ID NO: 738451 - protein, 9 aa, Homo Sapiens
KRRPECKSM

SEQ ID NO: 738452 - protein, 9 aa, Homo Sapiens
AALLHSDDD

SEQ ID NO: 738453 - protein, 9 aa, Homo Sapiens
ATFRFGHAT

SEQ ID NO: 738454 - protein, 9 aa, Homo Sapiens
SKLAMFVQT

SEQ ID NO: 738455 - protein, 9 aa, Homo Sapiens
LSTDPLVQV

SEQ ID NO: 738456 - protein, 9 aa, Homo Sapiens
GVIIYNYHG

SEQ ID NO: 738457 - protein, 9 aa, Homo Sapiens
CRGHGPGRA

SEQ ID NO: 738458 - protein, 9 aa, Homo Sapiens
VTSESSPNG

SEQ ID NO: 738459 - protein, 9 aa, Homo Sapiens
VGGWECGKH

SEQ ID NO: 738460 - protein, 9 aa, Homo Sapiens
NTVKDRDHI

SEQ ID NO: 738461 - protein, 9 aa, Homo Sapiens
PVLMGTEQL

SEQ ID NO: 738462 - protein, 9 aa, Homo Sapiens
SLFSVAGGG

SEQ ID NO: 738463 - protein, 9 aa, Homo Sapiens
GRQHHSGPP

SEQ ID NO: 738464 - protein, 9 aa, Homo Sapiens
VINPKMLVD

SEQ ID NO: 738465 - protein, 9 aa, Homo Sapiens
PRRGLGHGA

SEQ ID NO: 738466 - protein, 9 aa, Homo Sapiens
KQSHQEGST

SEQ ID NO: 738467 - protein, 9 aa, Homo Sapiens
LVEVEVLVR

SEQ ID NO: 738468 - protein, 9 aa, Homo Sapiens
YLSREEWGQ

SEQ ID NO: 738469 - protein, 9 aa, Homo Sapiens
GLRNEAAPQ

SEQ ID NO: 738470 - protein, 9 aa, Homo Sapiens
NCEDSSSCA

SEQ ID NO: 738471 - protein, 9 aa, Homo Sapiens
HESKSGQSS

SEQ ID NO: 738472 - protein, 9 aa, Homo Sapiens
GKNAVIRLC

SEQ ID NO: 738473 - protein, 9 aa, Homo Sapiens
DSVHQMTIP

SEQ ID NO: 738474 - protein, 9 aa, Homo Sapiens
IMSVDPRLP

SEQ ID NO: 738475 - protein, 9 aa, Homo Sapiens
AHVFLACSF

SEQ ID NO: 738476 - protein, 9 aa, Homo Sapiens
RSTGSSLHT

SEQ ID NO: 738477 - protein, 9 aa, Homo Sapiens
ILQGQPYFC

SEQ ID NO: 738478 - protein, 9 aa, Homo Sapiens
APPPGTNKK

SEQ ID NO: 738479 - protein, 9 aa, Homo Sapiens
SREEWGQLD

SEQ ID NO: 738480 - protein, 9 aa, Homo Sapiens
DSRVGAGID

SEQ ID NO: 738481 - protein, 9 aa, Homo Sapiens
YPDPLMKVN

SEQ ID NO: 738482 - protein, 9 aa, Homo Sapiens
QNFEDLEPK

SEQ ID NO: 738483 - protein, 9 aa, Homo Sapiens
NYHGTGSKV

SEQ ID NO: 738484 - protein, 9 aa, Homo Sapiens
SSSGCPANS

SEQ ID NO: 738485 - protein, 9 aa, Homo Sapiens
LCGDVCTHS

SEQ ID NO: 738486 - protein, 9 aa, Homo Sapiens
GKSFSRVCL

SEQ ID NO: 738487 - protein, 9 aa, Homo Sapiens
AIPAGPRKS

SEQ ID NO: 738488 - protein, 9 aa, Homo Sapiens
GAAAEWGGW

SEQ ID NO: 738489 - protein, 9 aa, Homo Sapiens
KPEAHAVTV

SEQ ID NO: 738490 - protein, 9 aa, Homo Sapiens
HAIQDPARS

SEQ ID NO: 738491 - protein, 9 aa, Homo Sapiens
ALGLVEVEV

SEQ ID NO: 738492 - protein, 9 aa, Homo Sapiens
AQPLSGSPP

SEQ ID NO: 738493 - protein, 9 aa, Homo Sapiens
FNKDQIWKY

SEQ ID NO: 738494 - protein, 9 aa, Homo Sapiens
AASSNVGIN

SEQ ID NO: 738495 - protein, 9 aa, Homo Sapiens
VHDAVVFLI

SEQ ID NO: 738496 - protein, 9 aa, Homo Sapiens
LPVQGSGHQ

SEQ ID NO: 738497 - protein, 9 aa, Homo Sapiens
IIHETQTAK

SEQ ID NO: 738498 - protein, 9 aa, Homo Sapiens
ANGSANINS

SEQ ID NO: 738499 - protein, 9 aa, Homo Sapiens
AGVWWFFTL

SEQ ID NO: 738500 - protein, 9 aa, Homo Sapiens
AHSRDASST

SEQ ID NO: 738501 - protein, 9 aa, Homo Sapiens
FQKGSAFTF

SEQ ID NO: 738502 - protein, 9 aa, Homo Sapiens
QEDITFKGC

SEQ ID NO: 738503 - protein, 9 aa, Homo Sapiens
LVVAAVEEV

SEQ ID NO: 738504 - protein, 9 aa, Homo Sapiens
SFVALLTCH

SEQ ID NO: 738505 - protein, 9 aa, Homo Sapiens
GRLSEYQEP

SEQ ID NO: 738506 - protein, 9 aa, Homo Sapiens
VVVANILQS

SEQ ID NO: 738507 - protein, 9 aa, Homo Sapiens
RNIVSNLNV

SEQ ID NO: 738508 - protein, 9 aa, Homo Sapiens
FAHSRDASS

SEQ ID NO: 738509 - protein, 9 aa, Homo Sapiens
SGSLLSRST

SEQ ID NO: 738510 - protein, 9 aa, Homo Sapiens
ENPAYSKLA

SEQ ID NO: 738511 - protein, 9 aa, Homo Sapiens
TCQRNSWTP

SEQ ID NO: 738512 - protein, 9 aa, Homo Sapiens
DYKEEKKDA

SEQ ID NO: 738513 - protein, 9 aa, Homo Sapiens
RLLQAGEAL

SEQ ID NO: 738514 - protein, 9 aa, Homo Sapiens
IISIVAKNS

SEQ ID NO: 738515 - protein, 9 aa, Homo Sapiens
RYPDPLMKV

SEQ ID NO: 738516 - protein, 9 aa, Homo Sapiens
HSSPALSSE

SEQ ID NO: 738517 - protein, 9 aa, Homo Sapiens
SSLGAQCLI

SEQ ID NO: 738518 - protein, 9 aa, Homo Sapiens
KLEGTLKKS

SEQ ID NO: 738519 - protein, 9 aa, Homo Sapiens
RVVRDGPGH

SEQ ID NO: 738520 - protein, 9 aa, Homo Sapiens
AKRFVETLH

SEQ ID NO: 738521 - protein, 9 aa, Homo Sapiens
LQSSLSLLI

SEQ ID NO: 738522 - protein, 9 aa, Homo Sapiens
RMGIAQGNL

SEQ ID NO: 738523 - protein, 9 aa, Homo Sapiens
GLKEQLAYL

SEQ ID NO: 738524 - protein, 9 aa, Homo Sapiens
SLIYAQDKE

SEQ ID NO: 738525 - protein, 9 aa, Homo Sapiens
DLTTGYKPQ

SEQ ID NO: 738526 - protein, 9 aa, Homo Sapiens
VQKQWRHLC

SEQ ID NO: 738527 - protein, 9 aa, Homo Sapiens
LLELAWQSL

SEQ ID NO: 738528 - protein, 9 aa, Homo Sapiens
RDGHQGLPG

SEQ ID NO: 738529 - protein, 9 aa, Homo Sapiens
GPMVPPGLP

SEQ ID NO: 738530 - protein, 9 aa, Homo Sapiens
EHTKKSNRD

SEQ ID NO: 738531 - protein, 9 aa, Homo Sapiens
FQAAMANPR

SEQ ID NO: 738532 - protein, 9 aa, Homo Sapiens
TTFTKQDVN

SEQ ID NO: 738533 - protein, 9 aa, Homo Sapiens
DVCISILYP

SEQ ID NO: 738534 - protein, 9 aa, Homo Sapiens
PVLQVLGVD

SEQ ID NO: 738535 - protein, 9 aa, Homo Sapiens
IPGSTFYVI

SEQ ID NO: 738536 - protein, 9 aa, Homo Sapiens
SSGCPANSF

SEQ ID NO: 738537 - protein, 9 aa, Homo Sapiens
RRVDEARCP

SEQ ID NO: 738538 - protein, 9 aa, Homo Sapiens
NGGPIRDVC

SEQ ID NO: 738539 - protein, 9 aa, Homo Sapiens
PSSANPGTG

SEQ ID NO: 738540 - protein, 9 aa, Homo Sapiens
CSVREQQED

SEQ ID NO: 738541 - protein, 9 aa, Homo Sapiens
PVQGSGHQV

SEQ ID NO: 738542 - protein, 9 aa, Homo Sapiens
ESKGDSPQE

SEQ ID NO: 738543 - protein, 9 aa, Homo Sapiens
PRHYLGDAE

SEQ ID NO: 738544 - protein, 9 aa, Homo Sapiens
SPSLQAPLS

SEQ ID NO: 738545 - protein, 9 aa, Homo Sapiens
HPTTRLLLA

SEQ ID NO: 738546 - protein, 9 aa, Homo Sapiens
GGGCGLPSV

SEQ ID NO: 738547 - protein, 9 aa, Homo Sapiens
LGVMARWLR

SEQ ID NO: 738548 - protein, 9 aa, Homo Sapiens
WDEMLHNKG

SEQ ID NO: 738549 - protein, 9 aa, Homo Sapiens
LKLLDLSEN

SEQ ID NO: 738550 - protein, 9 aa, Homo Sapiens
LRGLRNEAA

SEQ ID NO: 738551 - protein, 9 aa, Homo Sapiens
LFEWLLIGV

SEQ ID NO: 738552 - protein, 9 aa, Homo Sapiens
TARMVEAAN

SEQ ID NO: 738553 - protein, 9 aa, Homo Sapiens
VAPDAQRLR

SEQ ID NO: 738554 - protein, 9 aa, Homo Sapiens
NLCKDGDKS

SEQ ID NO: 738555 - protein, 9 aa, Homo Sapiens
RQGYYLQIH

SEQ ID NO: 738556 - protein, 9 aa, Homo Sapiens
ASPDAYLKS

SEQ ID NO: 738557 - protein, 9 aa, Homo Sapiens
PLRPCARLA

SEQ ID NO: 738558 - protein, 9 aa, Homo Sapiens
NGGDGERNS

SEQ ID NO: 738559 - protein, 9 aa, Homo Sapiens
LPPRGISSP

SEQ ID NO: 738560 - protein, 9 aa, Homo Sapiens
NTEPAVEFT

SEQ ID NO: 738561 - protein, 9 aa, Homo Sapiens
PSIGRLSEY

SEQ ID NO: 738562 - protein, 9 aa, Homo Sapiens
FEDPVLVPL

SEQ ID NO: 738563 - protein, 9 aa, Homo Sapiens
ELTASLPQE

SEQ ID NO: 738564 - protein, 9 aa, Homo Sapiens
QRQGPRRGL

SEQ ID NO: 738565 - protein, 9 aa, Homo Sapiens
STYPEPIYL

SEQ ID NO: 738566 - protein, 9 aa, Homo Sapiens
ITEDLGQIL

SEQ ID NO: 738567 - protein, 9 aa, Homo Sapiens
RIAGKASRL

SEQ ID NO: 738568 - protein, 9 aa, Homo Sapiens
RFHQIRNPL

SEQ ID NO: 738569 - protein, 9 aa, Homo Sapiens
EDPVLVPLQ

SEQ ID NO: 738570 - protein, 9 aa, Homo Sapiens
SSGSSARTP

SEQ ID NO: 738571 - protein, 9 aa, Homo Sapiens
WKIPMFLAF

SEQ ID NO: 738572 - protein, 9 aa, Homo Sapiens
SSGFVCFKH

SEQ ID NO: 738573 - protein, 9 aa, Homo Sapiens
EETCAVSPA

SEQ ID NO: 738574 - protein, 9 aa, Homo Sapiens
QRQTRELQE

SEQ ID NO: 738575 - protein, 9 aa, Homo Sapiens
GYLQILQIS

SEQ ID NO: 738576 - protein, 9 aa, Homo Sapiens
GNVRPPGTE

SEQ ID NO: 738577 - protein, 9 aa, Homo Sapiens
YNTVGMLSN

SEQ ID NO: 738578 - protein, 9 aa, Homo Sapiens
PAIDGSGII

SEQ ID NO: 738579 - protein, 9 aa, Homo Sapiens
TRFSSCNVK

SEQ ID NO: 738580 - protein, 9 aa, Homo Sapiens
EECEILRRH

SEQ ID NO: 738581 - protein, 9 aa, Homo Sapiens
QMIKEEEKR

SEQ ID NO: 738582 - protein, 9 aa, Homo Sapiens
QRDFSLRVP

SEQ ID NO: 738583 - protein, 9 aa, Homo Sapiens
VRFVLVPAD

SEQ ID NO: 738584 - protein, 9 aa, Homo Sapiens
SCDPPALAS

SEQ ID NO: 738585 - protein, 9 aa, Homo Sapiens
RTCIGTSYY

SEQ ID NO: 738586 - protein, 9 aa, Homo Sapiens
LCRGRAFFF

SEQ ID NO: 738587 - protein, 9 aa, Homo Sapiens
KASRLAHYN

SEQ ID NO: 738588 - protein, 9 aa, Homo Sapiens
AESATVPYQ

SEQ ID NO: 738589 - protein, 9 aa, Homo Sapiens
AYRAAREPE

SEQ ID NO: 738590 - protein, 9 aa, Homo Sapiens
NILQSRQSF

SEQ ID NO: 738591 - protein, 9 aa, Homo Sapiens
FGIMSVDPR

SEQ ID NO: 738592 - protein, 9 aa, Homo Sapiens
FCVSYFRSK

SEQ ID NO: 738593 - protein, 9 aa, Homo Sapiens
KSFSRVCLL

SEQ ID NO: 738594 - protein, 9 aa, Homo Sapiens
LGQILYIFS

SEQ ID NO: 738595 - protein, 9 aa, Homo Sapiens
VLSLSTDPL

SEQ ID NO: 738596 - protein, 9 aa, Homo Sapiens
GSSARTPTT

SEQ ID NO: 738597 - protein, 9 aa, Homo Sapiens
NKNGTETLA

SEQ ID NO: 738598 - protein, 9 aa, Homo Sapiens
HQIWHDAYL

SEQ ID NO: 738599 - protein, 9 aa, Homo Sapiens
CKECGNGFC

SEQ ID NO: 738600 - protein, 9 aa, Homo Sapiens
QGLRHFGLC

SEQ ID NO: 738601 - protein, 9 aa, Homo Sapiens
EPLPSWVAG

SEQ ID NO: 738602 - protein, 9 aa, Homo Sapiens
KYRYKQRQT

SEQ ID NO: 738603 - protein, 9 aa, Homo Sapiens
YTCQRNSWT

SEQ ID NO: 738604 - protein, 9 aa, Homo Sapiens
ARFLQGLAL

SEQ ID NO: 738605 - protein, 9 aa, Homo Sapiens
EEVGLGAHG

SEQ ID NO: 738606 - protein, 9 aa, Homo Sapiens
VTVINPKML

SEQ ID NO: 738607 - protein, 9 aa, Homo Sapiens
LALQGVMDL

SEQ ID NO: 738608 - protein, 9 aa, Homo Sapiens
EVEVLVRDD

SEQ ID NO: 738609 - protein, 9 aa, Homo Sapiens
TEHTSSSLK

SEQ ID NO: 738610 - protein, 9 aa, Homo Sapiens
TDHSSPALS

SEQ ID NO: 738611 - protein, 9 aa, Homo Sapiens
ILKMAADLV

SEQ ID NO: 738612 - protein, 9 aa, Homo Sapiens
ESVEHDVLD

SEQ ID NO: 738613 - protein, 9 aa, Homo Sapiens
LGVLGHGRD

SEQ ID NO: 738614 - protein, 9 aa, Homo Sapiens
VDMPYQWEY

SEQ ID NO: 738615 - protein, 9 aa, Homo Sapiens
NFNKDQIWK

SEQ ID NO: 738616 - protein, 9 aa, Homo Sapiens
PRQILLGAS

SEQ ID NO: 738617 - protein, 9 aa, Homo Sapiens
MSELWGVRE

SEQ ID NO: 738618 - protein, 9 aa, Homo Sapiens
GSQMGLDKC

SEQ ID NO: 738619 - protein, 9 aa, Homo Sapiens
NTQHQRSAS

SEQ ID NO: 738620 - protein, 9 aa, Homo Sapiens
DPGKEGLVD

SEQ ID NO: 738621 - protein, 9 aa, Homo Sapiens
TEPAVEFTL

SEQ ID NO: 738622 - protein, 9 aa, Homo Sapiens
VLGTALCGD

SEQ ID NO: 738623 - protein, 9 aa, Homo Sapiens
RVCLLIQHL

SEQ ID NO: 738624 - protein, 9 aa, Homo Sapiens
NPAYSKLAM

SEQ ID NO: 738625 - protein, 9 aa, Homo Sapiens
SLYRMHRAK

SEQ ID NO: 738626 - protein, 9 aa, Homo Sapiens
RKDSRVGAG

SEQ ID NO: 738627 - protein, 9 aa, Homo Sapiens
RTLPVSTPT

SEQ ID NO: 738628 - protein, 9 aa, Homo Sapiens
LDGIPCTVD

SEQ ID NO: 738629 - protein, 9 aa, Homo Sapiens
FLFPFLIML

SEQ ID NO: 738630 - protein, 9 aa, Homo Sapiens
HKWVDGGLT

SEQ ID NO: 738631 - protein, 9 aa, Homo Sapiens
ILLQKYRLS

SEQ ID NO: 738632 - protein, 9 aa, Homo Sapiens
NDSRFTHTL

SEQ ID NO: 738633 - protein, 9 aa, Homo Sapiens
QPVPQSSDG

SEQ ID NO: 738634 - protein, 9 aa, Homo Sapiens
PLEAQEVLH

SEQ ID NO: 738635 - protein, 9 aa, Homo Sapiens
AEDGTDSGF

SEQ ID NO: 738636 - protein, 9 aa, Homo Sapiens
RVADEPLAA

SEQ ID NO: 738637 - protein, 9 aa, Homo Sapiens
PYFCVEPET

SEQ ID NO: 738638 - protein, 9 aa, Homo Sapiens
GEECEILRR

SEQ ID NO: 738639 - protein, 9 aa, Homo Sapiens
LFSAAVSYD

SEQ ID NO: 738640 - protein, 9 aa, Homo Sapiens
CSLSEDCPQ

SEQ ID NO: 738641 - protein, 9 aa, Homo Sapiens
IAISAGATV

SEQ ID NO: 738642 - protein, 9 aa, Homo Sapiens
HRPVTQVTP

SEQ ID NO: 738643 - protein, 9 aa, Homo Sapiens
TLPVSTPTM

SEQ ID NO: 738644 - protein, 9 aa, Homo Sapiens
DTVKRIAAE

SEQ ID NO: 738645 - protein, 9 aa, Homo Sapiens
VRKGGSVGS

SEQ ID NO: 738646 - protein, 9 aa, Homo Sapiens
QLDHTQQNF

SEQ ID NO: 738647 - protein, 9 aa, Homo Sapiens
PLLMHFQAA

SEQ ID NO: 738648 - protein, 9 aa, Homo Sapiens
KRREYVYQL

SEQ ID NO: 738649 - protein, 9 aa, Homo Sapiens
ELAIHDSQT

SEQ ID NO: 738650 - protein, 9 aa, Homo Sapiens
LVHDLPVRV

SEQ ID NO: 738651 - protein, 9 aa, Homo Sapiens
TRLLLAADP

SEQ ID NO: 738652 - protein, 9 aa, Homo Sapiens
GYADDIVSN

SEQ ID NO: 738653 - protein, 9 aa, Homo Sapiens
EGLINHSPW

SEQ ID NO: 738654 - protein, 9 aa, Homo Sapiens
AQELQQRPR

SEQ ID NO: 738655 - protein, 9 aa, Homo Sapiens
FNISLFSVA

SEQ ID NO: 738656 - protein, 9 aa, Homo Sapiens
SQLFEWLLI

SEQ ID NO: 738657 - protein, 9 aa, Homo Sapiens
LDLLETEEI

SEQ ID NO: 738658 - protein, 9 aa, Homo Sapiens
TRKADAVLR

SEQ ID NO: 738659 - protein, 9 aa, Homo Sapiens
FPHLGAAIW

SEQ ID NO: 738660 - protein, 9 aa, Homo Sapiens
LMHFQAAMA

SEQ ID NO: 738661 - protein, 9 aa, Homo Sapiens
LYLLKGRKT

SEQ ID NO: 738662 - protein, 9 aa, Homo Sapiens
LPRMEGTLQ

SEQ ID NO: 738663 - protein, 9 aa, Homo Sapiens
LHRLGQPMP

SEQ ID NO: 738664 - protein, 9 aa, Homo Sapiens
IMAADESVG

SEQ ID NO: 738665 - protein, 9 aa, Homo Sapiens
LAIITYMTP

SEQ ID NO: 738666 - protein, 9 aa, Homo Sapiens
YKQRQTREL

SEQ ID NO: 738667 - protein, 9 aa, Homo Sapiens
CQKTYAPSF

SEQ ID NO: 738668 - protein, 9 aa, Homo Sapiens
PGSTFYVIM

SEQ ID NO: 738669 - protein, 9 aa, Homo Sapiens
QHQRSASTA

SEQ ID NO: 738670 - protein, 9 aa, Homo Sapiens
RGRAFFFDV

SEQ ID NO: 738671 - protein, 9 aa, Homo Sapiens
CDCSTPSQC

SEQ ID NO: 738672 - protein, 9 aa, Homo Sapiens
AQKNYDPLL

SEQ ID NO: 738673 - protein, 9 aa, Homo Sapiens
AFFFDVIHE

SEQ ID NO: 738674 - protein, 9 aa, Homo Sapiens
GYVQAFVGG

SEQ ID NO: 738675 - protein, 9 aa, Homo Sapiens
GVFTIIDDP

SEQ ID NO: 738676 - protein, 9 aa, Homo Sapiens
PQSSDGLLT

SEQ ID NO: 738677 - protein, 9 aa, Homo Sapiens
PMKDSFSNS

SEQ ID NO: 738678 - protein, 9 aa, Homo Sapiens
KEGLVDLET

SEQ ID NO: 738679 - protein, 9 aa, Homo Sapiens
TFNISLFSV

SEQ ID NO: 738680 - protein, 9 aa, Homo Sapiens
VEEEEEQVR

SEQ ID NO: 738681 - protein, 9 aa, Homo Sapiens
AGLDLSHNR

SEQ ID NO: 738682 - protein, 9 aa, Homo Sapiens
PHLGAAIWP

SEQ ID NO: 738683 - protein, 9 aa, Homo Sapiens
AISSQMFCF

SEQ ID NO: 738684 - protein, 9 aa, Homo Sapiens
VMIKALRGG

SEQ ID NO: 738685 - protein, 9 aa, Homo Sapiens
RQTRELQED

SEQ ID NO: 738686 - protein, 9 aa, Homo Sapiens
IQEMEFYMW

SEQ ID NO: 738687 - protein, 9 aa, Homo Sapiens
EYKGHKWVD

SEQ ID NO: 738688 - protein, 9 aa, Homo Sapiens
AHPPGYQPG

SEQ ID NO: 738689 - protein, 9 aa, Homo Sapiens
DSKCQKTYA

SEQ ID NO: 738690 - protein, 9 aa, Homo Sapiens
RLCPWSCSR

SEQ ID NO: 738691 - protein, 9 aa, Homo Sapiens
QALPITGTP

SEQ ID NO: 738692 - protein, 9 aa, Homo Sapiens
PMFLAFLVI

SEQ ID NO: 738693 - protein, 9 aa, Homo Sapiens
VEALDGGGL

SEQ ID NO: 738694 - protein, 9 aa, Homo Sapiens
HGDEPGPQR

SEQ ID NO: 738695 - protein, 9 aa, Homo Sapiens
QMTIPCGSQ

SEQ ID NO: 738696 - protein, 9 aa, Homo Sapiens
RREYVYQLQ

SEQ ID NO: 738697 - protein, 9 aa, Homo Sapiens
YYIEILLQK

SEQ ID NO: 738698 - protein, 9 aa, Homo Sapiens
VQAFVGGLA

SEQ ID NO: 738699 - protein, 9 aa, Homo Sapiens
DGSGKNTTL

SEQ ID NO: 738700 - protein, 9 aa, Homo Sapiens
KGHKWVDGG

SEQ ID NO: 738701 - protein, 9 aa, Homo Sapiens
VFYILQSSL

SEQ ID NO: 738702 - protein, 9 aa, Homo Sapiens
EPIYLTLPQ

SEQ ID NO: 738703 - protein, 9 aa, Homo Sapiens
DLWLLPPSS

SEQ ID NO: 738704 - protein, 9 aa, Homo Sapiens
GSANINSKL

SEQ ID NO: 738705 - protein, 9 aa, Homo Sapiens
DYIISIVAK

SEQ ID NO: 738706 - protein, 9 aa, Homo Sapiens
QPAGMQDIV

SEQ ID NO: 738707 - protein, 9 aa, Homo Sapiens
TNKKHLSIE

SEQ ID NO: 738708 - protein, 9 aa, Homo Sapiens
ESQLFEWLL

SEQ ID NO: 738709 - protein, 9 aa, Homo Sapiens
EEHLADGEV

SEQ ID NO: 738710 - protein, 9 aa, Homo Sapiens
SLGRARSLV

SEQ ID NO: 738711 - protein, 9 aa, Homo Sapiens
LSALLHSKW

SEQ ID NO: 738712 - protein, 9 aa, Homo Sapiens
MVQCPFTRN

SEQ ID NO: 738713 - protein, 9 aa, Homo Sapiens
KKFQKGSAF

SEQ ID NO: 738714 - protein, 9 aa, Homo Sapiens
RVERNDPLA

SEQ ID NO: 738715 - protein, 9 aa, Homo Sapiens
HYLGDAEED

SEQ ID NO: 738716 - protein, 9 aa, Homo Sapiens
TVEVRGSNV

SEQ ID NO: 738717 - protein, 9 aa, Homo Sapiens
VHVTKKGVW

SEQ ID NO: 738718 - protein, 9 aa, Homo Sapiens
NAQVSYIPD

SEQ ID NO: 738719 - protein, 9 aa, Homo Sapiens
PPLFTNTVK

SEQ ID NO: 738720 - protein, 9 aa, Homo Sapiens
GKGIMAADE

SEQ ID NO: 738721 - protein, 9 aa, Homo Sapiens
VFTIIDDPE

SEQ ID NO: 738722 - protein, 9 aa, Homo Sapiens
PADTVKRIA

SEQ ID NO: 738723 - protein, 9 aa, Homo Sapiens
RAALLHSDD

SEQ ID NO: 738724 - protein, 9 aa, Homo Sapiens
SSLGRARSL

SEQ ID NO: 738725 - protein, 9 aa, Homo Sapiens
SQSSPRYST

SEQ ID NO: 738726 - protein, 9 aa, Homo Sapiens
LDAMELYRK

SEQ ID NO: 738727 - protein, 9 aa, Homo Sapiens
MHFQAAMAN

SEQ ID NO: 738728 - protein, 9 aa, Homo Sapiens
CAGQFTGLM

SEQ ID NO: 738729 - protein, 9 aa, Homo Sapiens
CGNQSIHCP

SEQ ID NO: 738730 - protein, 9 aa, Homo Sapiens
QRLPLDVQI

SEQ ID NO: 738731 - protein, 9 aa, Homo Sapiens
STPTMAGGL

SEQ ID NO: 738732 - protein, 9 aa, Homo Sapiens
LRGVHGCRG

SEQ ID NO: 738733 - protein, 9 aa, Homo Sapiens
DLAVAPLVI

SEQ ID NO: 738734 - protein, 9 aa, Homo Sapiens
DDKGNVRPP

SEQ ID NO: 738735 - protein, 9 aa, Homo Sapiens
QVPSCWLSF

SEQ ID NO: 738736 - protein, 9 aa, Homo Sapiens
HSHSTIGWA

SEQ ID NO: 738737 - protein, 9 aa, Homo Sapiens
REYVYQLQE

SEQ ID NO: 738738 - protein, 9 aa, Homo Sapiens
FVGQNSSTC

SEQ ID NO: 738739 - protein, 9 aa, Homo Sapiens
VEDEKILKP

SEQ ID NO: 738740 - protein, 9 aa, Homo Sapiens
IGRLSEYQE

SEQ ID NO: 738741 - protein, 9 aa, Homo Sapiens
IEGLKEQLA

SEQ ID NO: 738742 - protein, 9 aa, Homo Sapiens
VITYVREKV

SEQ ID NO: 738743 - protein, 9 aa, Homo Sapiens
PCCRGSVKN

SEQ ID NO: 738744 - protein, 9 aa, Homo Sapiens
NQAPLLHEV

SEQ ID NO: 738745 - protein, 9 aa, Homo Sapiens
HDAPPPGTN

SEQ ID NO: 738746 - protein, 9 aa, Homo Sapiens
LCPPHPTTR

SEQ ID NO: 738747 - protein, 9 aa, Homo Sapiens
PACKQEKDY

SEQ ID NO: 738748 - protein, 9 aa, Homo Sapiens
STCCSHMMA

SEQ ID NO: 738749 - protein, 9 aa, Homo Sapiens
AQPVLQVLG

SEQ ID NO: 738750 - protein, 9 aa, Homo Sapiens
ECEILRRHS

SEQ ID NO: 738751 - protein, 9 aa, Homo Sapiens
DGPGHRVPH

SEQ ID NO: 738752 - protein, 9 aa, Homo Sapiens
NNVFTKKMG

SEQ ID NO: 738753 - protein, 9 aa, Homo Sapiens
ILFYGLAII

SEQ ID NO: 738754 - protein, 9 aa, Homo Sapiens
VEPQGDQGL

SEQ ID NO: 738755 - protein, 9 aa, Homo Sapiens
VRGSNVAFY

SEQ ID NO: 738756 - protein, 9 aa, Homo Sapiens
DSFVGQNSS

SEQ ID NO: 738757 - protein, 9 aa, Homo Sapiens
RSLVHDLPV

SEQ ID NO: 738758 - protein, 9 aa, Homo Sapiens
SLFSAAVSY

SEQ ID NO: 738759 - protein, 9 aa, Homo Sapiens
DVQIFYCAR

SEQ ID NO: 738760 - protein, 9 aa, Homo Sapiens
AAALRLLQA

SEQ ID NO: 738761 - protein, 9 aa, Homo Sapiens
AFQILVELL

SEQ ID NO: 738762 - protein, 9 aa, Homo Sapiens
RGHGPGRAE

SEQ ID NO: 738763 - protein, 9 aa, Homo Sapiens
AVTSESSPN

SEQ ID NO: 738764 - protein, 9 aa, Homo Sapiens
RIPGSTFYV

SEQ ID NO: 738765 - protein, 9 aa, Homo Sapiens
DAPPPGTNK

SEQ ID NO: 738766 - protein, 9 aa, Homo Sapiens
CRRCKSEEH

SEQ ID NO: 738767 - protein, 9 aa, Homo Sapiens
DFVIAITSD

SEQ ID NO: 738768 - protein, 9 aa, Homo Sapiens
IHILVLPME

SEQ ID NO: 738769 - protein, 9 aa, Homo Sapiens
EPLAAHEEH

SEQ ID NO: 738770 - protein, 9 aa, Homo Sapiens
PKHKKFQKG

SEQ ID NO: 738771 - protein, 9 aa, Homo Sapiens
LSSCDPPAL

SEQ ID NO: 738772 - protein, 9 aa, Homo Sapiens
IVGVQRVER

SEQ ID NO: 738773 - protein, 9 aa, Homo Sapiens
QKNYDPLLP

SEQ ID NO: 738774 - protein, 9 aa, Homo Sapiens
NGYSLQAMN

SEQ ID NO: 738775 - protein, 9 aa, Homo Sapiens
PSVGRQHHS

SEQ ID NO: 738776 - protein, 9 aa, Homo Sapiens
REAGSALLP

SEQ ID NO: 738777 - protein, 9 aa, Homo Sapiens
PPRLLELAW

SEQ ID NO: 738778 - protein, 9 aa, Homo Sapiens
DYVRKSSAR

SEQ ID NO: 738779 - protein, 9 aa, Homo Sapiens
YMIRLETLF

SEQ ID NO: 738780 - protein, 9 aa, Homo Sapiens
RFEQEVQEW

SEQ ID NO: 738781 - protein, 9 aa, Homo Sapiens
SYYLSPEIC

SEQ ID NO: 738782 - protein, 9 aa, Homo Sapiens
SPLRYNSIL

SEQ ID NO: 738783 - protein, 9 aa, Homo Sapiens
HDELGVLGH

SEQ ID NO: 738784 - protein, 9 aa, Homo Sapiens
KKVCETVYQ

SEQ ID NO: 738785 - protein, 9 aa, Homo Sapiens
ETLSGAKST

SEQ ID NO: 738786 - protein, 9 aa, Homo Sapiens
RGAPASRPQ

SEQ ID NO: 738787 - protein, 9 aa, Homo Sapiens
DSFVAYMIR

SEQ ID NO: 738788 - protein, 9 aa, Homo Sapiens
SRPQLALLL

SEQ ID NO: 738789 - protein, 9 aa, Homo Sapiens
KKPEAHAVT

SEQ ID NO: 738790 - protein, 9 aa, Homo Sapiens
PPRPFTHLN

SEQ ID NO: 738791 - protein, 9 aa, Homo Sapiens
GDGERNSLV

SEQ ID NO: 738792 - protein, 9 aa, Homo Sapiens
LWDEMLHNK

SEQ ID NO: 738793 - protein, 9 aa, Homo Sapiens
YSKLAMFVQ

SEQ ID NO: 738794 - protein, 9 aa, Homo Sapiens
QAGMMGFPG

SEQ ID NO: 738795 - protein, 9 aa, Homo Sapiens
ILYPPVDDP

SEQ ID NO: 738796 - protein, 9 aa, Homo Sapiens
THCHDKDDD

SEQ ID NO: 738797 - protein, 9 aa, Homo Sapiens
CFSSKNSPM

SEQ ID NO: 738798 - protein, 9 aa, Homo Sapiens
AIQDPARSA

SEQ ID NO: 738799 - protein, 9 aa, Homo Sapiens
WGQLDHTQQ

SEQ ID NO: 738800 - protein, 9 aa, Homo Sapiens
STIGMSFGN

SEQ ID NO: 738801 - protein, 9 aa, Homo Sapiens
LLVKVPLQR

SEQ ID NO: 738802 - protein, 9 aa, Homo Sapiens
VNPAAPHGP

SEQ ID NO: 738803 - protein, 9 aa, Homo Sapiens
EAGSALLPL

SEQ ID NO: 738804 - protein, 9 aa, Homo Sapiens
DFSLRVPLP

SEQ ID NO: 738805 - protein, 9 aa, Homo Sapiens
VLVRDDPLE

SEQ ID NO: 738806 - protein, 9 aa, Homo Sapiens
STGAQRSTA

SEQ ID NO: 738807 - protein, 9 aa, Homo Sapiens
VREQQEDIT

SEQ ID NO: 738808 - protein, 9 aa, Homo Sapiens
YGVNGYSLQ

SEQ ID NO: 738809 - protein, 9 aa, Homo Sapiens
SSCATFGDG

SEQ ID NO: 738810 - protein, 9 aa, Homo Sapiens
HCPHNRTLN

SEQ ID NO: 738811 - protein, 9 aa, Homo Sapiens
DLSYLHNQG

SEQ ID NO: 738812 - protein, 9 aa, Homo Sapiens
LMKVNDTVQ

SEQ ID NO: 738813 - protein, 9 aa, Homo Sapiens
APLLHEVNS

SEQ ID NO: 738814 - protein, 9 aa, Homo Sapiens
PVNPDLSAG

SEQ ID NO: 738815 - protein, 9 aa, Homo Sapiens
GAHVGVHAQ

SEQ ID NO: 738816 - protein, 9 aa, Homo Sapiens
KNAGPRIKC

SEQ ID NO: 738817 - protein, 9 aa, Homo Sapiens
PIGFCLLVL

SEQ ID NO: 738818 - protein, 9 aa, Homo Sapiens
EFHTPSTDT

SEQ ID NO: 738819 - protein, 9 aa, Homo Sapiens
LCAGQFTGL

SEQ ID NO: 738820 - protein, 9 aa, Homo Sapiens
CRGSVKNKV

SEQ ID NO: 738821 - protein, 9 aa, Homo Sapiens
NYDPLLPPM

SEQ ID NO: 738822 - protein, 9 aa, Homo Sapiens
KSVHAIQDP

SEQ ID NO: 738823 - protein, 9 aa, Homo Sapiens
QVPVPGEAL

SEQ ID NO: 738824 - protein, 9 aa, Homo Sapiens
TSKYEYRVD

SEQ ID NO: 738825 - protein, 9 aa, Homo Sapiens
QFDETNNQT

SEQ ID NO: 738826 - protein, 9 aa, Homo Sapiens
SITAPEKRS

SEQ ID NO: 738827 - protein, 9 aa, Homo Sapiens
LKTMIPLRP

SEQ ID NO: 738828 - protein, 9 aa, Homo Sapiens
SVLRDLSYL

SEQ ID NO: 738829 - protein, 9 aa, Homo Sapiens
FQETLSGAK

SEQ ID NO: 738830 - protein, 9 aa, Homo Sapiens
SSGSAEDGT

SEQ ID NO: 738831 - protein, 9 aa, Homo Sapiens
GGSLSALLH

SEQ ID NO: 738832 - protein, 9 aa, Homo Sapiens
VSVAARLAL

SEQ ID NO: 738833 - protein, 9 aa, Homo Sapiens
VPRQILLGA

SEQ ID NO: 738834 - protein, 9 aa, Homo Sapiens
AIKERIGYA

SEQ ID NO: 738835 - protein, 9 aa, Homo Sapiens
AEQIVSQQR

SEQ ID NO: 738836 - protein, 9 aa, Homo Sapiens
YWRRMEEQQ

SEQ ID NO: 738837 - protein, 9 aa, Homo Sapiens
GEETCAVSP

SEQ ID NO: 738838 - protein, 9 aa, Homo Sapiens
SGTTFTFLG

SEQ ID NO: 738839 - protein, 9 aa, Homo Sapiens
SHTKYSLQY

SEQ ID NO: 738840 - protein, 9 aa, Homo Sapiens
IKEEEKRLQ

SEQ ID NO: 738841 - protein, 9 aa, Homo Sapiens
KDFKKIHIP

SEQ ID NO: 738842 - protein, 9 aa, Homo Sapiens
RHFGLCDSC

SEQ ID NO: 738843 - protein, 9 aa, Homo Sapiens
GGCGLPSVH

SEQ ID NO: 738844 - protein, 9 aa, Homo Sapiens
LRYNSILTN

SEQ ID NO: 738845 - protein, 9 aa, Homo Sapiens
LIKIATFQI

SEQ ID NO: 738846 - protein, 9 aa, Homo Sapiens
WGGGCGLPS

SEQ ID NO: 738847 - protein, 9 aa, Homo Sapiens
ASGPGAART

SEQ ID NO: 738848 - protein, 9 aa, Homo Sapiens
LLSVIKVLP

SEQ ID NO: 738849 - protein, 9 aa, Homo Sapiens
TQAEGRTSG

SEQ ID NO: 738850 - protein, 9 aa, Homo Sapiens
LSREEWGQL

SEQ ID NO: 738851 - protein, 9 aa, Homo Sapiens
HPQEILLNE

SEQ ID NO: 738852 - protein, 9 aa, Homo Sapiens
GPSRYTCQR

SEQ ID NO: 738853 - protein, 9 aa, Homo Sapiens
KNECRSRTP

SEQ ID NO: 738854 - protein, 9 aa, Homo Sapiens
VATCPNLGG

SEQ ID NO: 738855 - protein, 9 aa, Homo Sapiens
VDFYVMPMV

SEQ ID NO: 738856 - protein, 9 aa, Homo Sapiens
TVMKTNMSL

SEQ ID NO: 738857 - protein, 9 aa, Homo Sapiens
KYQVTFTFL

SEQ ID NO: 738858 - protein, 9 aa, Homo Sapiens
ISILYPPVD

SEQ ID NO: 738859 - protein, 9 aa, Homo Sapiens
SKCQKTYAP

SEQ ID NO: 738860 - protein, 9 aa, Homo Sapiens
KGDRTLPVS

SEQ ID NO: 738861 - protein, 9 aa, Homo Sapiens
GLVEVEVLV

SEQ ID NO: 738862 - protein, 9 aa, Homo Sapiens
DDPLEAQEV

SEQ ID NO: 738863 - protein, 9 aa, Homo Sapiens
MGLDKCQFQ

SEQ ID NO: 738864 - protein, 9 aa, Homo Sapiens
RPFTHLNTT

SEQ ID NO: 738865 - protein, 9 aa, Homo Sapiens
PDLSAGPIT

SEQ ID NO: 738866 - protein, 9 aa, Homo Sapiens
KSLIYAQDK

SEQ ID NO: 738867 - protein, 9 aa, Homo Sapiens
DSLIIRFRT

SEQ ID NO: 738868 - protein, 9 aa, Homo Sapiens
LIIRFRTDD

SEQ ID NO: 738869 - protein, 9 aa, Homo Sapiens
FWLCCRRCK

SEQ ID NO: 738870 - protein, 9 aa, Homo Sapiens
FCQASASIM

SEQ ID NO: 738871 - protein, 9 aa, Homo Sapiens
GLPRDEVTG

SEQ ID NO: 738872 - protein, 9 aa, Homo Sapiens
FSAAVSYDA

SEQ ID NO: 738873 - protein, 9 aa, Homo Sapiens
FCVEPETGI

SEQ ID NO: 738874 - protein, 9 aa, Homo Sapiens
YVGCAVATC

SEQ ID NO: 738875 - protein, 9 aa, Homo Sapiens
GQLVKFLPA

SEQ ID NO: 738876 - protein, 9 aa, Homo Sapiens
KVGGLKTRF

SEQ ID NO: 738877 - protein, 9 aa, Homo Sapiens
GTALCGDVC

SEQ ID NO: 738878 - protein, 9 aa, Homo Sapiens
VTQVTPRLP

SEQ ID NO: 738879 - protein, 9 aa, Homo Sapiens
PGHSQRIPG

SEQ ID NO: 738880 - protein, 9 aa, Homo Sapiens
DDRSPRHYL

SEQ ID NO: 738881 - protein, 9 aa, Homo Sapiens
TGRHDAFQI

SEQ ID NO: 738882 - protein, 9 aa, Homo Sapiens
GIYSATKFW

SEQ ID NO: 738883 - protein, 9 aa, Homo Sapiens
ILQISNLYL

SEQ ID NO: 738884 - protein, 9 aa, Homo Sapiens
ILDLLETEE

SEQ ID NO: 738885 - protein, 9 aa, Homo Sapiens
GSEGECQPR

SEQ ID NO: 738886 - protein, 9 aa, Homo Sapiens
KLNKVLAHR

SEQ ID NO: 738887 - protein, 9 aa, Homo Sapiens
KSKLLVKVP

SEQ ID NO: 738888 - protein, 9 aa, Homo Sapiens
CVFRTVNYG

SEQ ID NO: 738889 - protein, 9 aa, Homo Sapiens
LLERVRFVL

SEQ ID NO: 738890 - protein, 9 aa, Homo Sapiens
PLICMIFEI

SEQ ID NO: 738891 - protein, 9 aa, Homo Sapiens
PGHRVPHHH

SEQ ID NO: 738892 - protein, 9 aa, Homo Sapiens
GMEGTTARV

SEQ ID NO: 738893 - protein, 9 aa, Homo Sapiens
KRKRTSITA

SEQ ID NO: 738894 - protein, 9 aa, Homo Sapiens
MKKCIKDFK

SEQ ID NO: 738895 - protein, 9 aa, Homo Sapiens
AVEEVGLGA

SEQ ID NO: 738896 - protein, 9 aa, Homo Sapiens
SAYLERMKK

SEQ ID NO: 738897 - protein, 9 aa, Homo Sapiens
LLPPRGISS

SEQ ID NO: 738898 - protein, 9 aa, Homo Sapiens
SKFEDPVLV

SEQ ID NO: 738899 - protein, 9 aa, Homo Sapiens
QLECKAKRF

SEQ ID NO: 738900 - protein, 9 aa, Homo Sapiens
EWGQLDHTQ

SEQ ID NO: 738901 - protein, 9 aa, Homo Sapiens
LMDHNFPAF

SEQ ID NO: 738902 - protein, 9 aa, Homo Sapiens
VWCGELSLS

SEQ ID NO: 738903 - protein, 9 aa, Homo Sapiens
LRNAWNIIQ

SEQ ID NO: 738904 - protein, 9 aa, Homo Sapiens
SVAARLALL

SEQ ID NO: 738905 - protein, 9 aa, Homo Sapiens
PTVGMKLSE

SEQ ID NO: 738906 - protein, 9 aa, Homo Sapiens
EFKILLYSQ

SEQ ID NO: 738907 - protein, 9 aa, Homo Sapiens
FNAQVSYIP

SEQ ID NO: 738908 - protein, 9 aa, Homo Sapiens
RLTLLRPKM

SEQ ID NO: 738909 - protein, 9 aa, Homo Sapiens
CQSSRTSTT

SEQ ID NO: 738910 - protein, 9 aa, Homo Sapiens
HVTPVTQGD

SEQ ID NO: 738911 - protein, 9 aa, Homo Sapiens
DEQIAISAG

SEQ ID NO: 738912 - protein, 9 aa, Homo Sapiens
PLALQGVMD

SEQ ID NO: 738913 - protein, 9 aa, Homo Sapiens
ELCAGQFTG

SEQ ID NO: 738914 - protein, 9 aa, Homo Sapiens
QVGDWSPCS

SEQ ID NO: 738915 - protein, 9 aa, Homo Sapiens
ITKQEKDFL

SEQ ID NO: 738916 - protein, 9 aa, Homo Sapiens
GQHESKSGQ

SEQ ID NO: 738917 - protein, 9 aa, Homo Sapiens
AHEEHLADG

SEQ ID NO: 738918 - protein, 9 aa, Homo Sapiens
LCGKLLGVM

SEQ ID NO: 738919 - protein, 9 aa, Homo Sapiens
YFEGTRDSP

SEQ ID NO: 738920 - protein, 9 aa, Homo Sapiens
LWIHQIWHD

SEQ ID NO: 738921 - protein, 9 aa, Homo Sapiens
SQIHILVLP

SEQ ID NO: 738922 - protein, 9 aa, Homo Sapiens
LRGGGGKGM

SEQ ID NO: 738923 - protein, 9 aa, Homo Sapiens
RAFFFDVIH

SEQ ID NO: 738924 - protein, 9 aa, Homo Sapiens
QIAISAGAT

SEQ ID NO: 738925 - protein, 9 aa, Homo Sapiens
NGNICNERY

SEQ ID NO: 738926 - protein, 9 aa, Homo Sapiens
DHYLPRNLS

SEQ ID NO: 738927 - protein, 9 aa, Homo Sapiens
MQPVPQSSD

SEQ ID NO: 738928 - protein, 9 aa, Homo Sapiens
QPYFCVEPE

SEQ ID NO: 738929 - protein, 9 aa, Homo Sapiens
RVDMVHQSC

SEQ ID NO: 738930 - protein, 9 aa, Homo Sapiens
CKQEKDYKE

SEQ ID NO: 738931 - protein, 9 aa, Homo Sapiens
VIRANGSEG

SEQ ID NO: 738932 - protein, 9 aa, Homo Sapiens
LLDEHTKKS

SEQ ID NO: 738933 - protein, 9 aa, Homo Sapiens
VLGVDADLD

SEQ ID NO: 738934 - protein, 9 aa, Homo Sapiens
AESFGEECE

SEQ ID NO: 738935 - protein, 9 aa, Homo Sapiens
VHAQELQQR

SEQ ID NO: 738936 - protein, 9 aa, Homo Sapiens
LELPADTVK

SEQ ID NO: 738937 - protein, 9 aa, Homo Sapiens
TSPSLQAPL

SEQ ID NO: 738938 - protein, 9 aa, Homo Sapiens
VAFYKGFIK

SEQ ID NO: 738939 - protein, 9 aa, Homo Sapiens
AAVSYDAED

SEQ ID NO: 738940 - protein, 9 aa, Homo Sapiens
TFTKQDVNK

SEQ ID NO: 738941 - protein, 9 aa, Homo Sapiens
YNSILTNTQ

SEQ ID NO: 738942 - protein, 9 aa, Homo Sapiens
YTAPGNTQP

SEQ ID NO: 738943 - protein, 9 aa, Homo Sapiens
QESKGDSPQ

SEQ ID NO: 738944 - protein, 9 aa, Homo Sapiens
TFTFLLPIS

SEQ ID NO: 738945 - protein, 9 aa, Homo Sapiens
VPYALLDEH

SEQ ID NO: 738946 - protein, 9 aa, Homo Sapiens
LARFLQGLA

SEQ ID NO: 738947 - protein, 9 aa, Homo Sapiens
QSRQSFVFI

SEQ ID NO: 738948 - protein, 9 aa, Homo Sapiens
VSYFRSKNL

SEQ ID NO: 738949 - protein, 9 aa, Homo Sapiens
ADDIVSNDN

SEQ ID NO: 738950 - protein, 9 aa, Homo Sapiens
QHESKSGQS

SEQ ID NO: 738951 - protein, 9 aa, Homo Sapiens
VGCAVATCP

SEQ ID NO: 738952 - protein, 9 aa, Homo Sapiens
CCLHQRLQW

SEQ ID NO: 738953 - protein, 9 aa, Homo Sapiens
PPSSANPGT

SEQ ID NO: 738954 - protein, 9 aa, Homo Sapiens
KIGCSLSED

SEQ ID NO: 738955 - protein, 9 aa, Homo Sapiens
LKLLGANGS

SEQ ID NO: 738956 - protein, 9 aa, Homo Sapiens
RFLNGCFED

SEQ ID NO: 738957 - protein, 9 aa, Homo Sapiens
CTFEIESYG

SEQ ID NO: 738958 - protein, 9 aa, Homo Sapiens
SLVHDLPVR

SEQ ID NO: 738959 - protein, 9 aa, Homo Sapiens
SLWDEMLHN

SEQ ID NO: 738960 - protein, 9 aa, Homo Sapiens
WSCSRQPEP

SEQ ID NO: 738961 - protein, 9 aa, Homo Sapiens
KEQLAYLRK

SEQ ID NO: 738962 - protein, 9 aa, Homo Sapiens
SCMGGMNRG

SEQ ID NO: 738963 - protein, 9 aa, Homo Sapiens
HVFLACSFG

SEQ ID NO: 738964 - protein, 9 aa, Homo Sapiens
WIHQIWHDA

SEQ ID NO: 738965 - protein, 9 aa, Homo Sapiens
IFERIAGKA

SEQ ID NO: 738966 - protein, 9 aa, Homo Sapiens
YPLVVAESM

SEQ ID NO: 738967 - protein, 9 aa, Homo Sapiens
CPWSCSRQP

SEQ ID NO: 738968 - protein, 9 aa, Homo Sapiens
VANILQSRQ

SEQ ID NO: 738969 - protein, 9 aa, Homo Sapiens
SHSTIGWAA

SEQ ID NO: 738970 - protein, 9 aa, Homo Sapiens
AANGAAANP

SEQ ID NO: 738971 - protein, 9 aa, Homo Sapiens
NLTVNPAAP

SEQ ID NO: 738972 - protein, 9 aa, Homo Sapiens
VEAANGAAA

SEQ ID NO: 738973 - protein, 9 aa, Homo Sapiens
QVTFTFLLP

SEQ ID NO: 738974 - protein, 9 aa, Homo Sapiens
SGSAEDGTD

SEQ ID NO: 738975 - protein, 9 aa, Homo Sapiens
HAAQLPGRV

SEQ ID NO: 738976 - protein, 9 aa, Homo Sapiens
LLPLQQTAL

SEQ ID NO: 738977 - protein, 9 aa, Homo Sapiens
AQVSYIPDK

SEQ ID NO: 738978 - protein, 9 aa, Homo Sapiens
RGFELSSDG

SEQ ID NO: 738979 - protein, 9 aa, Homo Sapiens
GPAAPAAPE

SEQ ID NO: 738980 - protein, 9 aa, Homo Sapiens
LGCVAHVFL

SEQ ID NO: 738981 - protein, 9 aa, Homo Sapiens
NKHPQEILL

SEQ ID NO: 738982 - protein, 9 aa, Homo Sapiens
SEQPELQLH

SEQ ID NO: 738983 - protein, 9 aa, Homo Sapiens
LGGLDALYC

SEQ ID NO: 738984 - protein, 9 aa, Homo Sapiens
LCRNVTAVP

SEQ ID NO: 738985 - protein, 9 aa, Homo Sapiens
DPVLVPLQE

SEQ ID NO: 738986 - protein, 9 aa, Homo Sapiens
RLSEYQEPL

SEQ ID NO: 738987 - protein, 9 aa, Homo Sapiens
GEDSRGARY

SEQ ID NO: 738988 - protein, 9 aa, Homo Sapiens
VFPHLGAAI

SEQ ID NO: 738989 - protein, 9 aa, Homo Sapiens
IVAGVWWFF

SEQ ID NO: 738990 - protein, 9 aa, Homo Sapiens
YCDEKCVWF

SEQ ID NO: 738991 - protein, 9 aa, Homo Sapiens
GEALVVAAV

SEQ ID NO: 738992 - protein, 9 aa, Homo Sapiens
VKAILQGSK

SEQ ID NO: 738993 - protein, 9 aa, Homo Sapiens
MPMVNVDGY

SEQ ID NO: 738994 - protein, 9 aa, Homo Sapiens
ETVHSFIPL

SEQ ID NO: 738995 - protein, 9 aa, Homo Sapiens
EAAPQEKKP

SEQ ID NO: 738996 - protein, 9 aa, Homo Sapiens
ATVFPHLGA

SEQ ID NO: 738997 - protein, 9 aa, Homo Sapiens
APYFQRLPC

SEQ ID NO: 738998 - protein, 9 aa, Homo Sapiens
EETGSSDDT

SEQ ID NO: 738999 - protein, 9 aa, Homo Sapiens
NPAAPHGPG

SEQ ID NO: 739000 - protein, 9 aa, Homo Sapiens
GCFEDQYTP

SEQ ID NO: 739001 - protein, 9 aa, Homo Sapiens
IHKNIVCPT

SEQ ID NO: 739002 - protein, 9 aa, Homo Sapiens
LKLVEYKGH

SEQ ID NO: 739003 - protein, 9 aa, Homo Sapiens
LSQGLRHFG

SEQ ID NO: 739004 - protein, 9 aa, Homo Sapiens
DALYCLRLD

SEQ ID NO: 739005 - protein, 9 aa, Homo Sapiens
DGDKSFIAN

SEQ ID NO: 739006 - protein, 9 aa, Homo Sapiens
NATQCSFLI

SEQ ID NO: 739007 - protein, 9 aa, Homo Sapiens
KGNLTYGYF

SEQ ID NO: 739008 - protein, 9 aa, Homo Sapiens
LCKNAGPRI

SEQ ID NO: 739009 - protein, 9 aa, Homo Sapiens
AVSYDAEDL

SEQ ID NO: 739010 - protein, 9 aa, Homo Sapiens
EWLERAELC

SEQ ID NO: 739011 - protein, 9 aa, Homo Sapiens
FCPGVMQSP

SEQ ID NO: 739012 - protein, 9 aa, Homo Sapiens
FERIAGKAS

SEQ ID NO: 739013 - protein, 9 aa, Homo Sapiens
APGNTQPPI

SEQ ID NO: 739014 - protein, 9 aa, Homo Sapiens
FLGCVAHVF

SEQ ID NO: 739015 - protein, 9 aa, Homo Sapiens
MQPQPPGRK

SEQ ID NO: 739016 - protein, 9 aa, Homo Sapiens
MEVAKPAES

SEQ ID NO: 739017 - protein, 9 aa, Homo Sapiens
ELWGVREGG

SEQ ID NO: 739018 - protein, 9 aa, Homo Sapiens
APAAPEETG

SEQ ID NO: 739019 - protein, 9 aa, Homo Sapiens
SVEQHGDEP

SEQ ID NO: 739020 - protein, 9 aa, Homo Sapiens
YPEPIYLTL

SEQ ID NO: 739021 - protein, 9 aa, Homo Sapiens
PQLIRRGLR

SEQ ID NO: 739022 - protein, 9 aa, Homo Sapiens
HSSGEASST

SEQ ID NO: 739023 - protein, 9 aa, Homo Sapiens
TKKMGNQQK

SEQ ID NO: 739024 - protein, 9 aa, Homo Sapiens
YAPIGFCLL

SEQ ID NO: 739025 - protein, 9 aa, Homo Sapiens
VLLLYAPIG

SEQ ID NO: 739026 - protein, 9 aa, Homo Sapiens
PPRPRDPLF

SEQ ID NO: 739027 - protein, 9 aa, Homo Sapiens
ECSIRDLHL

SEQ ID NO: 739028 - protein, 9 aa, Homo Sapiens
VSNLNVTAG

SEQ ID NO: 739029 - protein, 9 aa, Homo Sapiens
EEQVRKGGS

SEQ ID NO: 739030 - protein, 9 aa, Homo Sapiens
IDYGIKFVR

SEQ ID NO: 739031 - protein, 9 aa, Homo Sapiens
AVFSVVFTD

SEQ ID NO: 739032 - protein, 9 aa, Homo Sapiens
AVLRCSVKE

SEQ ID NO: 739033 - protein, 9 aa, Homo Sapiens
PYTAPGNTQ

SEQ ID NO: 739034 - protein, 9 aa, Homo Sapiens
VGQNSSTCM

SEQ ID NO: 739035 - protein, 9 aa, Homo Sapiens
RRGLRLWTS

SEQ ID NO: 739036 - protein, 9 aa, Homo Sapiens
LTYGYFTIL

SEQ ID NO: 739037 - protein, 9 aa, Homo Sapiens
VAAVFSVVF

SEQ ID NO: 739038 - protein, 9 aa, Homo Sapiens
PRRRIILDL

SEQ ID NO: 739039 - protein, 9 aa, Homo Sapiens
SMQRLPLNN

SEQ ID NO: 739040 - protein, 9 aa, Homo Sapiens
WPLICMIFE

SEQ ID NO: 739041 - protein, 9 aa, Homo Sapiens
SFMTPNTIT

SEQ ID NO: 739042 - protein, 9 aa, Homo Sapiens
GYFTILNGS

SEQ ID NO: 739043 - protein, 9 aa, Homo Sapiens
MAHSHSTIG

SEQ ID NO: 739044 - protein, 9 aa, Homo Sapiens
SDPFAHSRD

SEQ ID NO: 739045 - protein, 9 aa, Homo Sapiens
CKSLADPAS

SEQ ID NO: 739046 - protein, 9 aa, Homo Sapiens
YPFIVPKVQ

SEQ ID NO: 739047 - protein, 9 aa, Homo Sapiens
KHPKEVHPM

SEQ ID NO: 739048 - protein, 9 aa, Homo Sapiens
SQRIPGSTF

SEQ ID NO: 739049 - protein, 9 aa, Homo Sapiens
ARTCIGTSY

SEQ ID NO: 739050 - protein, 9 aa, Homo Sapiens
EAHAVTVPE

SEQ ID NO: 739051 - protein, 9 aa, Homo Sapiens
RSVPRNIPC

SEQ ID NO: 739052 - protein, 9 aa, Homo Sapiens
EAANGAAAN

SEQ ID NO: 739053 - protein, 9 aa, Homo Sapiens
EALVVAAVE

SEQ ID NO: 739054 - protein, 9 aa, Homo Sapiens
KCQFQFRNG

SEQ ID NO: 739055 - protein, 9 aa, Homo Sapiens
KEVTGSSAV

SEQ ID NO: 739056 - protein, 9 aa, Homo Sapiens
SQLIRYVGQ

SEQ ID NO: 739057 - protein, 9 aa, Homo Sapiens
QEWEEEQSC

SEQ ID NO: 739058 - protein, 9 aa, Homo Sapiens
ITGTPPPNY

SEQ ID NO: 739059 - protein, 9 aa, Homo Sapiens
SQPAPADGH

SEQ ID NO: 739060 - protein, 9 aa, Homo Sapiens
LSEITKQEK

SEQ ID NO: 739061 - protein, 9 aa, Homo Sapiens
KRALYRDVM

SEQ ID NO: 739062 - protein, 9 aa, Homo Sapiens
LKEQLAYLR

SEQ ID NO: 739063 - protein, 9 aa, Homo Sapiens
SSHEEFRKE

SEQ ID NO: 739064 - protein, 9 aa, Homo Sapiens
VGGLKTRFS

SEQ ID NO: 739065 - protein, 9 aa, Homo Sapiens
GLDPERHDR

SEQ ID NO: 739066 - protein, 9 aa, Homo Sapiens
ITRLPDLKR

SEQ ID NO: 739067 - protein, 9 aa, Homo Sapiens
YGRNDSRFT

SEQ ID NO: 739068 - protein, 9 aa, Homo Sapiens
CRSRTPVNL

SEQ ID NO: 739069 - protein, 9 aa, Homo Sapiens
AVSPAAPAG

SEQ ID NO: 739070 - protein, 9 aa, Homo Sapiens
SGKNTTLHN

SEQ ID NO: 739071 - protein, 9 aa, Homo Sapiens
PTTRLLLAA

SEQ ID NO: 739072 - protein, 9 aa, Homo Sapiens
PSWVAGLDL

SEQ ID NO: 739073 - protein, 9 aa, Homo Sapiens
DFYVMPMVN

SEQ ID NO: 739074 - protein, 9 aa, Homo Sapiens
YNRNAEMLS

SEQ ID NO: 739075 - protein, 9 aa, Homo Sapiens
HDQVDMPYQ

SEQ ID NO: 739076 - protein, 9 aa, Homo Sapiens
NGVIIYNYH

SEQ ID NO: 739077 - protein, 9 aa, Homo Sapiens
SGCPANSFH

SEQ ID NO: 739078 - protein, 9 aa, Homo Sapiens
PGYQPGDLG

SEQ ID NO: 739079 - protein, 9 aa, Homo Sapiens
LDEHTKKSN

SEQ ID NO: 739080 - protein, 9 aa, Homo Sapiens
DVSVEPQGD

SEQ ID NO: 739081 - protein, 9 aa, Homo Sapiens
DREVGSVLP

SEQ ID NO: 739082 - protein, 9 aa, Homo Sapiens
SNDFVIAIT

SEQ ID NO: 739083 - protein, 9 aa, Homo Sapiens
GHGPGRAEP

SEQ ID NO: 739084 - protein, 9 aa, Homo Sapiens
GCSLSEDCP

SEQ ID NO: 739085 - protein, 9 aa, Homo Sapiens
HLNCWLRLQ

SEQ ID NO: 739086 - protein, 9 aa, Homo Sapiens
LHSDDDGLR

SEQ ID NO: 739087 - protein, 9 aa, Homo Sapiens
TLLAANPFC

SEQ ID NO: 739088 - protein, 9 aa, Homo Sapiens
PSRYTCQRN

SEQ ID NO: 739089 - protein, 9 aa, Homo Sapiens
KQDVNKNLI

SEQ ID NO: 739090 - protein, 9 aa, Homo Sapiens
SAEDGTDSG

SEQ ID NO: 739091 - protein, 9 aa, Homo Sapiens
WVAGLDLSH

SEQ ID NO: 739092 - protein, 9 aa, Homo Sapiens
AKGLDFQAK

SEQ ID NO: 739093 - protein, 9 aa, Homo Sapiens
CGEWQVGDW

SEQ ID NO: 739094 - protein, 9 aa, Homo Sapiens
DPQEGYLQI

SEQ ID NO: 739095 - protein, 9 aa, Homo Sapiens
INTEPAVEF

SEQ ID NO: 739096 - protein, 9 aa, Homo Sapiens
CISILYPPV

SEQ ID NO: 739097 - protein, 9 aa, Homo Sapiens
HGDLPVQGS

SEQ ID NO: 739098 - protein, 9 aa, Homo Sapiens
LECKAKRFV

SEQ ID NO: 739099 - protein, 9 aa, Homo Sapiens
NGSANINSK

SEQ ID NO: 739100 - protein, 9 aa, Homo Sapiens
TVSNSSEGL

SEQ ID NO: 739101 - protein, 9 aa, Homo Sapiens
RRIILDLLE

SEQ ID NO: 739102 - protein, 9 aa, Homo Sapiens
HNLHIFLLI

SEQ ID NO: 739103 - protein, 9 aa, Homo Sapiens
IMLTSYTLI

SEQ ID NO: 739104 - protein, 9 aa, Homo Sapiens
LCPWSCSRQ

SEQ ID NO: 739105 - protein, 9 aa, Homo Sapiens
PGPMVPPGL

SEQ ID NO: 739106 - protein, 9 aa, Homo Sapiens
VFSTATFRF

SEQ ID NO: 739107 - protein, 9 aa, Homo Sapiens
LSMYVAYST

SEQ ID NO: 739108 - protein, 9 aa, Homo Sapiens
CGDVCTHSV

SEQ ID NO: 739109 - protein, 9 aa, Homo Sapiens
NQHVEIARA

SEQ ID NO: 739110 - protein, 9 aa, Homo Sapiens
RGISSPSSG

SEQ ID NO: 739111 - protein, 9 aa, Homo Sapiens
PFLIMLTSY

SEQ ID NO: 739112 - protein, 9 aa, Homo Sapiens
RNKHPQEIL

SEQ ID NO: 739113 - protein, 9 aa, Homo Sapiens
RKAGVRSLD

SEQ ID NO: 739114 - protein, 9 aa, Homo Sapiens
LHLAASSSF

SEQ ID NO: 739115 - protein, 9 aa, Homo Sapiens
LQVLGVDAD

SEQ ID NO: 739116 - protein, 9 aa, Homo Sapiens
TVDQLSMQA

SEQ ID NO: 739117 - protein, 9 aa, Homo Sapiens
IDVGEEFSG

SEQ ID NO: 739118 - protein, 9 aa, Homo Sapiens
KNAVIRLCF

SEQ ID NO: 739119 - protein, 9 aa, Homo Sapiens
EVTWYKNGP

SEQ ID NO: 739120 - protein, 9 aa, Homo Sapiens
RPPGTEGDI

SEQ ID NO: 739121 - protein, 9 aa, Homo Sapiens
SANINSKLR

SEQ ID NO: 739122 - protein, 9 aa, Homo Sapiens
DPDYVRKSS

SEQ ID NO: 739123 - protein, 9 aa, Homo Sapiens
IYMLLIKIA

SEQ ID NO: 739124 - protein, 9 aa, Homo Sapiens
GLDALYCLR

SEQ ID NO: 739125 - protein, 9 aa, Homo Sapiens
CGDGHCIPH

SEQ ID NO: 739126 - protein, 9 aa, Homo Sapiens
KLFHVTPVT

SEQ ID NO: 739127 - protein, 9 aa, Homo Sapiens
KLLSSCDPP

SEQ ID NO: 739128 - protein, 9 aa, Homo Sapiens
ATLSATTLG

SEQ ID NO: 739129 - protein, 9 aa, Homo Sapiens
TIMQCAMGD

SEQ ID NO: 739130 - protein, 9 aa, Homo Sapiens
TFLGFSDYP

SEQ ID NO: 739131 - protein, 9 aa, Homo Sapiens
SSPALSSEA

SEQ ID NO: 739132 - protein, 9 aa, Homo Sapiens
GCWALSSGN

SEQ ID NO: 739133 - protein, 9 aa, Homo Sapiens
MAADLVEAL

SEQ ID NO: 739134 - protein, 9 aa, Homo Sapiens
QILQISNLY

SEQ ID NO: 739135 - protein, 9 aa, Homo Sapiens
NKDQIWKYC

SEQ ID NO: 739136 - protein, 9 aa, Homo Sapiens
IKQSHQEGS

SEQ ID NO: 739137 - protein, 9 aa, Homo Sapiens
QAEGRTSGQ

SEQ ID NO: 739138 - protein, 9 aa, Homo Sapiens
DGAPRRVDE

SEQ ID NO: 739139 - protein, 9 aa, Homo Sapiens
PLDEQNCTF

SEQ ID NO: 739140 - protein, 9 aa, Homo Sapiens
YMWTFRHMR

SEQ ID NO: 739141 - protein, 9 aa, Homo Sapiens
EVLVRDDPL

SEQ ID NO: 739142 - protein, 9 aa, Homo Sapiens
LPVSTPTMA

SEQ ID NO: 739143 - protein, 9 aa, Homo Sapiens
SNKYYCNQH

SEQ ID NO: 739144 - protein, 9 aa, Homo Sapiens
APASRPQLA

SEQ ID NO: 739145 - protein, 9 aa, Homo Sapiens
QCLIASRKM

SEQ ID NO: 739146 - protein, 9 aa, Homo Sapiens
DDEKRTPHS

SEQ ID NO: 739147 - protein, 9 aa, Homo Sapiens
DPLEAQEVL

SEQ ID NO: 739148 - protein, 9 aa, Homo Sapiens
NNNVFTKKM

SEQ ID NO: 739149 - protein, 9 aa, Homo Sapiens
SSGDVKPSL

SEQ ID NO: 739150 - protein, 9 aa, Homo Sapiens
HLADGEVAQ

SEQ ID NO: 739151 - protein, 9 aa, Homo Sapiens
SEINQSAHN

SEQ ID NO: 739152 - protein, 9 aa, Homo Sapiens
AHAVTVPEV

SEQ ID NO: 739153 - protein, 9 aa, Homo Sapiens
VNTGRSTVH

SEQ ID NO: 739154 - protein, 9 aa, Homo Sapiens
PVSHVYEYI

SEQ ID NO: 739155 - protein, 9 aa, Homo Sapiens
LACEQDIKK

SEQ ID NO: 739156 - protein, 9 aa, Homo Sapiens
NEVSKRVLI

SEQ ID NO: 739157 - protein, 9 aa, Homo Sapiens
QLPDYAAGR

SEQ ID NO: 739158 - protein, 9 aa, Homo Sapiens
HVSSLDTPH

SEQ ID NO: 739159 - protein, 9 aa, Homo Sapiens
KESYPLVVA

SEQ ID NO: 739160 - protein, 9 aa, Homo Sapiens
ALRGGGGKG

SEQ ID NO: 739161 - protein, 9 aa, Homo Sapiens
CLLIQHLRI

SEQ ID NO: 739162 - protein, 9 aa, Homo Sapiens
LERMKKDME

SEQ ID NO: 739163 - protein, 9 aa, Homo Sapiens
ERQALEGGD

SEQ ID NO: 739164 - protein, 9 aa, Homo Sapiens
EYVYQLQEF

SEQ ID NO: 739165 - protein, 9 aa, Homo Sapiens
QAESFGEEC

SEQ ID NO: 739166 - protein, 9 aa, Homo Sapiens
ALVVAAVEE

SEQ ID NO: 739167 - protein, 9 aa, Homo Sapiens
NVQKQWRHL

SEQ ID NO: 739168 - protein, 9 aa, Homo Sapiens
EGYLQILQI

SEQ ID NO: 739169 - protein, 9 aa, Homo Sapiens
CAVSPAAPA

SEQ ID NO: 739170 - protein, 9 aa, Homo Sapiens
LLCRVNTGR

SEQ ID NO: 739171 - protein, 9 aa, Homo Sapiens
DAMPLALQG

SEQ ID NO: 739172 - protein, 9 aa, Homo Sapiens
ESATVPYQE

SEQ ID NO: 739173 - protein, 9 aa, Homo Sapiens
NGAAANPEN

SEQ ID NO: 739174 - protein, 9 aa, Homo Sapiens
SLFLPKETV

SEQ ID NO: 739175 - protein, 9 aa, Homo Sapiens
ILQSSNMTD

SEQ ID NO: 739176 - protein, 9 aa, Homo Sapiens
RGLRLWTSA

SEQ ID NO: 739177 - protein, 9 aa, Homo Sapiens
ATVPYQEEL

SEQ ID NO: 739178 - protein, 9 aa, Homo Sapiens
AAWCTVGQD

SEQ ID NO: 739179 - protein, 9 aa, Homo Sapiens
GRTSGQIDG

SEQ ID NO: 739180 - protein, 9 aa, Homo Sapiens
GKLNKVLAH

SEQ ID NO: 739181 - protein, 9 aa, Homo Sapiens
GADMDRNPR

SEQ ID NO: 739182 - protein, 9 aa, Homo Sapiens
LAIHDSQTN

SEQ ID NO: 739183 - protein, 9 aa, Homo Sapiens
SSDDTASSD

SEQ ID NO: 739184 - protein, 9 aa, Homo Sapiens
MEFPCHLWP

SEQ ID NO: 739185 - protein, 9 aa, Homo Sapiens
IVSRFLNGC

SEQ ID NO: 739186 - protein, 9 aa, Homo Sapiens
EVAQPVLQV

SEQ ID NO: 739187 - protein, 9 aa, Homo Sapiens
HSKWGPLKD

SEQ ID NO: 739188 - protein, 9 aa, Homo Sapiens
CHDKDDDEE

SEQ ID NO: 739189 - protein, 9 aa, Homo Sapiens
NGFCCSSAY

SEQ ID NO: 739190 - protein, 9 aa, Homo Sapiens
IILDLLETE

SEQ ID NO: 739191 - protein, 9 aa, Homo Sapiens
YLERMKKNM

SEQ ID NO: 739192 - protein, 9 aa, Homo Sapiens
VGRSTIGMS

SEQ ID NO: 739193 - protein, 9 aa, Homo Sapiens
DRAAIPAGP

SEQ ID NO: 739194 - protein, 9 aa, Homo Sapiens
GIMSVDPRL

SEQ ID NO: 739195 - protein, 9 aa, Homo Sapiens
FSVISNDFV

SEQ ID NO: 739196 - protein, 9 aa, Homo Sapiens
SIVAKNSVG

SEQ ID NO: 739197 - protein, 9 aa, Homo Sapiens
VRKSSARLP

SEQ ID NO: 739198 - protein, 9 aa, Homo Sapiens
GPLGQRLRV

SEQ ID NO: 739199 - protein, 9 aa, Homo Sapiens
SLDTPHRSY

SEQ ID NO: 739200 - protein, 9 aa, Homo Sapiens
DLNFTSPSL

SEQ ID NO: 739201 - protein, 9 aa, Homo Sapiens
SVVFTDAVI

SEQ ID NO: 739202 - protein, 9 aa, Homo Sapiens
AEPPRPRDP

SEQ ID NO: 739203 - protein, 9 aa, Homo Sapiens
KNSNFATVG

SEQ ID NO: 739204 - protein, 9 aa, Homo Sapiens
AAAAGLAYR

SEQ ID NO: 739205 - protein, 9 aa, Homo Sapiens
AGGATVFPH

SEQ ID NO: 739206 - protein, 9 aa, Homo Sapiens
VLLKQAALK

SEQ ID NO: 739207 - protein, 9 aa, Homo Sapiens
GSKLIWSKY

SEQ ID NO: 739208 - protein, 9 aa, Homo Sapiens
EITHCHDKD

SEQ ID NO: 739209 - protein, 9 aa, Homo Sapiens
DPASSDDDD

SEQ ID NO: 739210 - protein, 9 aa, Homo Sapiens
HPGYITRPS

SEQ ID NO: 739211 - protein, 9 aa, Homo Sapiens
DSLYYPFIV

SEQ ID NO: 739212 - protein, 9 aa, Homo Sapiens
NISLFSVAG

SEQ ID NO: 739213 - protein, 9 aa, Homo Sapiens
RGEDSRGAR

SEQ ID NO: 739214 - protein, 9 aa, Homo Sapiens
NVLGTALCG

SEQ ID NO: 739215 - protein, 9 aa, Homo Sapiens
SATVPYQEE

SEQ ID NO: 739216 - protein, 9 aa, Homo Sapiens
EVAKPAESW

SEQ ID NO: 739217 - protein, 9 aa, Homo Sapiens
DDTASSDDR

SEQ ID NO: 739218 - protein, 9 aa, Homo Sapiens
DTHRRLLER

SEQ ID NO: 739219 - protein, 9 aa, Homo Sapiens
SIPNVTVMK

SEQ ID NO: 739220 - protein, 9 aa, Homo Sapiens
VTPRLPVPR

SEQ ID NO: 739221 - protein, 9 aa, Homo Sapiens
WLERAELCE

SEQ ID NO: 739222 - protein, 9 aa, Homo Sapiens
FTNTVKDRD

SEQ ID NO: 739223 - protein, 9 aa, Homo Sapiens
NLTYGYFTI

SEQ ID NO: 739224 - protein, 9 aa, Homo Sapiens
VSYIPDKMP

SEQ ID NO: 739225 - protein, 9 aa, Homo Sapiens
FKGSMQRLP

SEQ ID NO: 739226 - protein, 9 aa, Homo Sapiens
NLGKLNKVL

SEQ ID NO: 739227 - protein, 9 aa, Homo Sapiens
KSLEEKYVS

SEQ ID NO: 739228 - protein, 9 aa, Homo Sapiens
WYVTVINPK

SEQ ID NO: 739229 - protein, 9 aa, Homo Sapiens
MAEHRRHKK

SEQ ID NO: 739230 - protein, 9 aa, Homo Sapiens
YLARFLQGL

SEQ ID NO: 739231 - protein, 9 aa, Homo Sapiens
LNEVSKRVL

SEQ ID NO: 739232 - protein, 9 aa, Homo Sapiens
ERFQESKGD

SEQ ID NO: 739233 - protein, 9 aa, Homo Sapiens
EGGPGEPGP

SEQ ID NO: 739234 - protein, 9 aa, Homo Sapiens
VPYQEELGE

SEQ ID NO: 739235 - protein, 9 aa, Homo Sapiens
HWQVIGNPR

SEQ ID NO: 739236 - protein, 9 aa, Homo Sapiens
ESFGEECEI

SEQ ID NO: 739237 - protein, 9 aa, Homo Sapiens
IDDSTVDQL

SEQ ID NO: 739238 - protein, 9 aa, Homo Sapiens
AAAGLAYRA

SEQ ID NO: 739239 - protein, 9 aa, Homo Sapiens
YKGHKWVDG

SEQ ID NO: 739240 - protein, 9 aa, Homo Sapiens
RLLELAWQS

SEQ ID NO: 739241 - protein, 9 aa, Homo Sapiens
SLLCRVNTG

SEQ ID NO: 739242 - protein, 9 aa, Homo Sapiens
FSSKNSPMK

SEQ ID NO: 739243 - protein, 9 aa, Homo Sapiens
TYSIVMVLL

SEQ ID NO: 739244 - protein, 9 aa, Homo Sapiens
EEEKRLQLR

SEQ ID NO: 739245 - protein, 9 aa, Homo Sapiens
KLLVKVPLQ

SEQ ID NO: 739246 - protein, 9 aa, Homo Sapiens
VLCRGRAFF

SEQ ID NO: 739247 - protein, 9 aa, Homo Sapiens
LRLCLMDHN

SEQ ID NO: 739248 - protein, 9 aa, Homo Sapiens
HACVLDSRV

SEQ ID NO: 739249 - protein, 9 aa, Homo Sapiens
RYSTIDQKL

SEQ ID NO: 739250 - protein, 9 aa, Homo Sapiens
GDRTLPVST

SEQ ID NO: 739251 - protein, 9 aa, Homo Sapiens
NTVGMLSNM

SEQ ID NO: 739252 - protein, 9 aa, Homo Sapiens
DETNNQTLT

SEQ ID NO: 739253 - protein, 9 aa, Homo Sapiens
VKEALIDVG

SEQ ID NO: 739254 - protein, 9 aa, Homo Sapiens
TPSQCRMKD

SEQ ID NO: 739255 - protein, 9 aa, Homo Sapiens
PPTPHAEQI

SEQ ID NO: 739256 - protein, 9 aa, Homo Sapiens
PGGAIKTGS

SEQ ID NO: 739257 - protein, 9 aa, Homo Sapiens
STPSQCRMK

SEQ ID NO: 739258 - protein, 9 aa, Homo Sapiens
LSVIKVLPK

SEQ ID NO: 739259 - protein, 9 aa, Homo Sapiens
YFTILNGSD

SEQ ID NO: 739260 - protein, 9 aa, Homo Sapiens
EYEYKCGDG

SEQ ID NO: 739261 - protein, 9 aa, Homo Sapiens
RSPLRYNSI

SEQ ID NO: 739262 - protein, 9 aa, Homo Sapiens
NGLRMLGIV

SEQ ID NO: 739263 - protein, 9 aa, Homo Sapiens
RAATLIQSL

SEQ ID NO: 739264 - protein, 9 aa, Homo Sapiens
DSSSCATFG

SEQ ID NO: 739265 - protein, 9 aa, Homo Sapiens
LAYRAAREP

SEQ ID NO: 739266 - protein, 9 aa, Homo Sapiens
VISNDFVIA

SEQ ID NO: 739267 - protein, 9 aa, Homo Sapiens
VEQHGDEPG

SEQ ID NO: 739268 - protein, 9 aa, Homo Sapiens
QGLALDMGT

SEQ ID NO: 739269 - protein, 9 aa, Homo Sapiens
AMLAEAHLE

SEQ ID NO: 739270 - protein, 9 aa, Homo Sapiens
EGSQMGLDK

SEQ ID NO: 739271 - protein, 9 aa, Homo Sapiens
NYLGHFLPT

SEQ ID NO: 739272 - protein, 9 aa, Homo Sapiens
LLAAFVQEQ

SEQ ID NO: 739273 - protein, 9 aa, Homo Sapiens
IVSQQRILI

SEQ ID NO: 739274 - protein, 9 aa, Homo Sapiens
QGLPGPKGS

SEQ ID NO: 739275 - protein, 9 aa, Homo Sapiens
GHRVPHHHD

SEQ ID NO: 739276 - protein, 9 aa, Homo Sapiens
GDLPVQGSG

SEQ ID NO: 739277 - protein, 9 aa, Homo Sapiens
FLPTNLLLD

SEQ ID NO: 739278 - protein, 9 aa, Homo Sapiens
SAAFNSTRY

SEQ ID NO: 739279 - protein, 9 aa, Homo Sapiens
CVLDSRVAS

SEQ ID NO: 739280 - protein, 9 aa, Homo Sapiens
LPDYAAGRQ

SEQ ID NO: 739281 - protein, 9 aa, Homo Sapiens
SALPLGIYS

SEQ ID NO: 739282 - protein, 9 aa, Homo Sapiens
FIRFHQIRN

SEQ ID NO: 739283 - protein, 9 aa, Homo Sapiens
LLHSKWGPL

SEQ ID NO: 739284 - protein, 9 aa, Homo Sapiens
APVLMGTEQ

SEQ ID NO: 739285 - protein, 9 aa, Homo Sapiens
ANPFCQASA

SEQ ID NO: 739286 - protein, 9 aa, Homo Sapiens
TVLSMYVAY

SEQ ID NO: 739287 - protein, 9 aa, Homo Sapiens
NHSPWNLKL

SEQ ID NO: 739288 - protein, 9 aa, Homo Sapiens
ICVFYILQS

SEQ ID NO: 739289 - protein, 9 aa, Homo Sapiens
LKSGGRQSS

SEQ ID NO: 739290 - protein, 9 aa, Homo Sapiens
YRAAREPEA

SEQ ID NO: 739291 - protein, 9 aa, Homo Sapiens
AALRLLQAG

SEQ ID NO: 739292 - protein, 9 aa, Homo Sapiens
PKSSGFVCF

SEQ ID NO: 739293 - protein, 9 aa, Homo Sapiens
GGATVFPHL

SEQ ID NO: 739294 - protein, 9 aa, Homo Sapiens
NPDLSAGPI

SEQ ID NO: 739295 - protein, 9 aa, Homo Sapiens
AESKNSNFA

SEQ ID NO: 739296 - protein, 9 aa, Homo Sapiens
EGLKEQLAY

SEQ ID NO: 739297 - protein, 9 aa, Homo Sapiens
HPKEVHPMV

SEQ ID NO: 739298 - protein, 9 aa, Homo Sapiens
VSTPTMAGG

SEQ ID NO: 739299 - protein, 9 aa, Homo Sapiens
ELLERVRFV

SEQ ID NO: 739300 - protein, 9 aa, Homo Sapiens
KAPPVSHVY

SEQ ID NO: 739301 - protein, 9 aa, Homo Sapiens
TAPEKRSLE

SEQ ID NO: 739302 - protein, 9 aa, Homo Sapiens
SFSRVCLLI

SEQ ID NO: 739303 - protein, 9 aa, Homo Sapiens
GSFGAPRYH

SEQ ID NO: 739304 - protein, 9 aa, Homo Sapiens
SPDDISFMT

SEQ ID NO: 739305 - protein, 9 aa, Homo Sapiens
LGQPMPSWL

SEQ ID NO: 739306 - protein, 9 aa, Homo Sapiens
NWRFEQEVQ

SEQ ID NO: 739307 - protein, 9 aa, Homo Sapiens
RQYLARFLQ

SEQ ID NO: 739308 - protein, 9 aa, Homo Sapiens
KFCVSYFRS

SEQ ID NO: 739309 - protein, 9 aa, Homo Sapiens
EDCPQASSV

SEQ ID NO: 739310 - protein, 9 aa, Homo Sapiens
ALPLVLPDL

SEQ ID NO: 739311 - protein, 9 aa, Homo Sapiens
KLVEYKGHK

SEQ ID NO: 739312 - protein, 9 aa, Homo Sapiens
VQRVERNDP

SEQ ID NO: 739313 - protein, 9 aa, Homo Sapiens
PRNIPCNTE

SEQ ID NO: 739314 - protein, 9 aa, Homo Sapiens
QVTPRLPVP

SEQ ID NO: 739315 - protein, 9 aa, Homo Sapiens
AALNVTVFP

SEQ ID NO: 739316 - protein, 9 aa, Homo Sapiens
LGPAKRALY

SEQ ID NO: 739317 - protein, 9 aa, Homo Sapiens
DTYYNRNAE

SEQ ID NO: 739318 - protein, 9 aa, Homo Sapiens
LSMQASTQM

SEQ ID NO: 739319 - protein, 9 aa, Homo Sapiens
PIYLTLPQA

SEQ ID NO: 739320 - protein, 9 aa, Homo Sapiens
DAYLKSGGR

SEQ ID NO: 739321 - protein, 9 aa, Homo Sapiens
KEVHPMVQC

SEQ ID NO: 739322 - protein, 9 aa, Homo Sapiens
THRRLLERG

SEQ ID NO: 739323 - protein, 9 aa, Homo Sapiens
LPGRTPIFC

SEQ ID NO: 739324 - protein, 9 aa, Homo Sapiens
QDAGIYEFH

SEQ ID NO: 739325 - protein, 9 aa, Homo Sapiens
RVDEARCPV

SEQ ID NO: 739326 - protein, 9 aa, Homo Sapiens
QPELQLHLF

SEQ ID NO: 739327 - protein, 9 aa, Homo Sapiens
REQQEDITF

SEQ ID NO: 739328 - protein, 9 aa, Homo Sapiens
DPERHDRLR

SEQ ID NO: 739329 - protein, 9 aa, Homo Sapiens
FPGPVVDYL

SEQ ID NO: 739330 - protein, 9 aa, Homo Sapiens
DDGLRQLLA

SEQ ID NO: 739331 - protein, 9 aa, Homo Sapiens
RRLPTQAEG

SEQ ID NO: 739332 - protein, 9 aa, Homo Sapiens
STIVSQRKH

SEQ ID NO: 739333 - protein, 9 aa, Homo Sapiens
EYRVDMVHQ

SEQ ID NO: 739334 - protein, 9 aa, Homo Sapiens
DSEGQLPDY

SEQ ID NO: 739335 - protein, 9 aa, Homo Sapiens
LRNEAAPQE

SEQ ID NO: 739336 - protein, 9 aa, Homo Sapiens
DDIKDCSTL

SEQ ID NO: 739337 - protein, 9 aa, Homo Sapiens
APHACVLDS

SEQ ID NO: 739338 - protein, 9 aa, Homo Sapiens
VHGCRGHGP

SEQ ID NO: 739339 - protein, 9 aa, Homo Sapiens
QDTHRRLLE

SEQ ID NO: 739340 - protein, 9 aa, Homo Sapiens
FLGFSDYPE

SEQ ID NO: 739341 - protein, 9 aa, Homo Sapiens
YQEIAPYFQ

SEQ ID NO: 739342 - protein, 9 aa, Homo Sapiens
ARSLVHDLP

SEQ ID NO: 739343 - protein, 9 aa, Homo Sapiens
YRCQNTNSV

SEQ ID NO: 739344 - protein, 9 aa, Homo Sapiens
GIYEFHTPS

SEQ ID NO: 739345 - protein, 9 aa, Homo Sapiens
VEEVGLGAH

SEQ ID NO: 739346 - protein, 9 aa, Homo Sapiens
YMLLIKIAT

SEQ ID NO: 739347 - protein, 9 aa, Homo Sapiens
VPVPGEALV

SEQ ID NO: 739348 - protein, 9 aa, Homo Sapiens
MNKKDETMS

SEQ ID NO: 739349 - protein, 9 aa, Homo Sapiens
LPDLENHYH

SEQ ID NO: 739350 - protein, 9 aa, Homo Sapiens
RQLLAAFVQ

SEQ ID NO: 739351 - protein, 9 aa, Homo Sapiens
YSATKFWMY

SEQ ID NO: 739352 - protein, 9 aa, Homo Sapiens
YSIVMVLLK

SEQ ID NO: 739353 - protein, 9 aa, Homo Sapiens
AAVTSESSP

SEQ ID NO: 739354 - protein, 9 aa, Homo Sapiens
TSYYLSPEI

SEQ ID NO: 739355 - protein, 9 aa, Homo Sapiens
ILTAYLWIH

SEQ ID NO: 739356 - protein, 9 aa, Homo Sapiens
PQPTPSATA

SEQ ID NO: 739357 - protein, 9 aa, Homo Sapiens
ENNLTHLPK

SEQ ID NO: 739358 - protein, 9 aa, Homo Sapiens
RSASTAPSS

SEQ ID NO: 739359 - protein, 9 aa, Homo Sapiens
EEEEEQVRK

SEQ ID NO: 739360 - protein, 9 aa, Homo Sapiens
RSDGSGKNT

SEQ ID NO: 739361 - protein, 9 aa, Homo Sapiens
GRARSLVHD

SEQ ID NO: 739362 - protein, 9 aa, Homo Sapiens
EDVSVEPQG

SEQ ID NO: 739363 - protein, 9 aa, Homo Sapiens
MEVEALDGG

SEQ ID NO: 739364 - protein, 9 aa, Homo Sapiens
QADRQSSRG

SEQ ID NO: 739365 - protein, 9 aa, Homo Sapiens
FLACEQDIK

SEQ ID NO: 739366 - protein, 9 aa, Homo Sapiens
LVVAESMYG

SEQ ID NO: 739367 - protein, 9 aa, Homo Sapiens
EKRTPHSSG

SEQ ID NO: 739368 - protein, 9 aa, Homo Sapiens
LCRVNTGRS

SEQ ID NO: 739369 - protein, 9 aa, Homo Sapiens
AFLPRMEGT

SEQ ID NO: 739370 - protein, 9 aa, Homo Sapiens
HQVPVPGEA

SEQ ID NO: 739371 - protein, 9 aa, Homo Sapiens
WQSLLRDQA

SEQ ID NO: 739372 - protein, 9 aa, Homo Sapiens
YIPDLTTGY

SEQ ID NO: 739373 - protein, 9 aa, Homo Sapiens
AGKASRLAH

SEQ ID NO: 739374 - protein, 9 aa, Homo Sapiens
TEVENKNGT

SEQ ID NO: 739375 - protein, 9 aa, Homo Sapiens
PHSSGEASS

SEQ ID NO: 739376 - protein, 9 aa, Homo Sapiens
QHQHLCVFR

SEQ ID NO: 739377 - protein, 9 aa, Homo Sapiens
VGMKLSEQL

SEQ ID NO: 739378 - protein, 9 aa, Homo Sapiens
SLDGIPCTV

SEQ ID NO: 739379 - protein, 9 aa, Homo Sapiens
GRLRGEDSR

SEQ ID NO: 739380 - protein, 9 aa, Homo Sapiens
DTEGKNAVI

SEQ ID NO: 739381 - protein, 9 aa, Homo Sapiens
QPQWKIPMF

SEQ ID NO: 739382 - protein, 9 aa, Homo Sapiens
LAAFVQEQR

SEQ ID NO: 739383 - protein, 9 aa, Homo Sapiens
AHLEIREAK

SEQ ID NO: 739384 - protein, 9 aa, Homo Sapiens
AHLERMKKD

SEQ ID NO: 739385 - protein, 9 aa, Homo Sapiens
TCPLCRNVT

SEQ ID NO: 739386 - protein, 9 aa, Homo Sapiens
YDRFCPFYN

SEQ ID NO: 739387 - protein, 9 aa, Homo Sapiens
YIEILLQKY

SEQ ID NO: 739388 - protein, 9 aa, Homo Sapiens
ILVHVTKKG

SEQ ID NO: 739389 - protein, 9 aa, Homo Sapiens
RHLCCGRFR

SEQ ID NO: 739390 - protein, 9 aa, Homo Sapiens
AFVQEQRQG

SEQ ID NO: 739391 - protein, 9 aa, Homo Sapiens
HPMVQCPFT

SEQ ID NO: 739392 - protein, 9 aa, Homo Sapiens
QRIPGSTFY

SEQ ID NO: 739393 - protein, 9 aa, Homo Sapiens
YPVMIKALR

SEQ ID NO: 739394 - protein, 9 aa, Homo Sapiens
PCIIQLYMV

SEQ ID NO: 739395 - protein, 9 aa, Homo Sapiens
SVKNKVGPW

SEQ ID NO: 739396 - protein, 9 aa, Homo Sapiens
AVATCPNLG

SEQ ID NO: 739397 - protein, 9 aa, Homo Sapiens
RLPTQAEGR

SEQ ID NO: 739398 - protein, 9 aa, Homo Sapiens
PKEEWSQIS

SEQ ID NO: 739399 - protein, 9 aa, Homo Sapiens
LQGLALDMG

SEQ ID NO: 739400 - protein, 9 aa, Homo Sapiens
TVHSFIPLP

SEQ ID NO: 739401 - protein, 9 aa, Homo Sapiens
APPVSHVYE

SEQ ID NO: 739402 - protein, 9 aa, Homo Sapiens
SGHQVPVPG

SEQ ID NO: 739403 - protein, 9 aa, Homo Sapiens
SYHKNNPHD

SEQ ID NO: 739404 - protein, 9 aa, Homo Sapiens
ERVRFVLVP

SEQ ID NO: 739405 - protein, 9 aa, Homo Sapiens
LDDIKDCST

SEQ ID NO: 739406 - protein, 9 aa, Homo Sapiens
PLPSWVAGL

SEQ ID NO: 739407 - protein, 9 aa, Homo Sapiens
HLAASSSFR

SEQ ID NO: 739408 - protein, 9 aa, Homo Sapiens
KKSELELKE

SEQ ID NO: 739409 - protein, 9 aa, Homo Sapiens
IMQCAMGDR

SEQ ID NO: 739410 - protein, 9 aa, Homo Sapiens
QPGDLGAVG

SEQ ID NO: 739411 - protein, 9 aa, Homo Sapiens
VMSAISSQM

SEQ ID NO: 739412 - protein, 9 aa, Homo Sapiens
SQSLRSPIY

SEQ ID NO: 739413 - protein, 9 aa, Homo Sapiens
ADPSHTKYS

SEQ ID NO: 739414 - protein, 9 aa, Homo Sapiens
VYGRNDSRF

SEQ ID NO: 739415 - protein, 9 aa, Homo Sapiens
LDPERHDRL

SEQ ID NO: 739416 - protein, 9 aa, Homo Sapiens
LQIHPDGAL

SEQ ID NO: 739417 - protein, 9 aa, Homo Sapiens
RSEINQSAH

SEQ ID NO: 739418 - protein, 9 aa, Homo Sapiens
AEAHLEIRE

SEQ ID NO: 739419 - protein, 9 aa, Homo Sapiens
KSSARLPLK

SEQ ID NO: 739420 - protein, 9 aa, Homo Sapiens
GVQRVERND

SEQ ID NO: 739421 - protein, 9 aa, Homo Sapiens
WSWPDELEP

SEQ ID NO: 739422 - protein, 9 aa, Homo Sapiens
CNHVSTGAQ

SEQ ID NO: 739423 - protein, 9 aa, Homo Sapiens
FANDRDVTR

SEQ ID NO: 739424 - protein, 9 aa, Homo Sapiens
VRDQTRMQV

SEQ ID NO: 739425 - protein, 9 aa, Homo Sapiens
GLAVASYPA

SEQ ID NO: 739426 - protein, 9 aa, Homo Sapiens
PVKTPIHMS

SEQ ID NO: 739427 - protein, 9 aa, Homo Sapiens
QGAGEEEAN

SEQ ID NO: 739428 - protein, 9 aa, Homo Sapiens
TYDDTLVYG

SEQ ID NO: 739429 - protein, 9 aa, Homo Sapiens
SWPDELEPV

SEQ ID NO: 739430 - protein, 9 aa, Homo Sapiens
REVDGDNTS

SEQ ID NO: 739431 - protein, 9 aa, Homo Sapiens
FCGSREIDH

SEQ ID NO: 739432 - protein, 9 aa, Homo Sapiens
PGPGSGPPG

SEQ ID NO: 739433 - protein, 9 aa, Homo Sapiens
SFVILLSVT

SEQ ID NO: 739434 - protein, 9 aa, Homo Sapiens
CRLRNFQDP

SEQ ID NO: 739435 - protein, 9 aa, Homo Sapiens
PDNFRLSLE

SEQ ID NO: 739436 - protein, 9 aa, Homo Sapiens
SAECWFHLF

SEQ ID NO: 739437 - protein, 9 aa, Homo Sapiens
CCVCMERPG

SEQ ID NO: 739438 - protein, 9 aa, Homo Sapiens
GAPWPRLNP

SEQ ID NO: 739439 - protein, 9 aa, Homo Sapiens
KTPIHMSFQ

SEQ ID NO: 739440 - protein, 9 aa, Homo Sapiens
SVDGRPMRL

SEQ ID NO: 739441 - protein, 9 aa, Homo Sapiens
LDYHRCLNT

SEQ ID NO: 739442 - protein, 9 aa, Homo Sapiens
EYLSQRLHI

SEQ ID NO: 739443 - protein, 9 aa, Homo Sapiens
NLTPEEFKK

SEQ ID NO: 739444 - protein, 9 aa, Homo Sapiens
GGVDTGSWF

SEQ ID NO: 739445 - protein, 9 aa, Homo Sapiens
WLLLEVEEP

SEQ ID NO: 739446 - protein, 9 aa, Homo Sapiens
VSVDGRPMR

SEQ ID NO: 739447 - protein, 9 aa, Homo Sapiens
CWKSFSKNE

SEQ ID NO: 739448 - protein, 9 aa, Homo Sapiens
PNTNTCVCT

SEQ ID NO: 739449 - protein, 9 aa, Homo Sapiens
LSLSSITFY

SEQ ID NO: 739450 - protein, 9 aa, Homo Sapiens
ICLLSNKTS

SEQ ID NO: 739451 - protein, 9 aa, Homo Sapiens
STPSVYLEL

SEQ ID NO: 739452 - protein, 9 aa, Homo Sapiens
TCTEQIVAK

SEQ ID NO: 739453 - protein, 9 aa, Homo Sapiens
LKRQKSFLH

SEQ ID NO: 739454 - protein, 9 aa, Homo Sapiens
VLVHIDDLR

SEQ ID NO: 739455 - protein, 9 aa, Homo Sapiens
QSEAEYCYI

SEQ ID NO: 739456 - protein, 9 aa, Homo Sapiens
AQRVELQEQ

SEQ ID NO: 739457 - protein, 9 aa, Homo Sapiens
LRAGGWYQS

SEQ ID NO: 739458 - protein, 9 aa, Homo Sapiens
NGLPFGPES

SEQ ID NO: 739459 - protein, 9 aa, Homo Sapiens
SCKPGYSNS

SEQ ID NO: 739460 - protein, 9 aa, Homo Sapiens
SERKTETTM

SEQ ID NO: 739461 - protein, 9 aa, Homo Sapiens
EFQVPRLVL

SEQ ID NO: 739462 - protein, 9 aa, Homo Sapiens
HKTRPAAPR

SEQ ID NO: 739463 - protein, 9 aa, Homo Sapiens
IPGAPDTTL

SEQ ID NO: 739464 - protein, 9 aa, Homo Sapiens
AQSKAGPWS

SEQ ID NO: 739465 - protein, 9 aa, Homo Sapiens
SVYLELTDS

SEQ ID NO: 739466 - protein, 9 aa, Homo Sapiens
NFYCELGDK

SEQ ID NO: 739467 - protein, 9 aa, Homo Sapiens
RASATGARS

SEQ ID NO: 739468 - protein, 9 aa, Homo Sapiens
SLKQVQLEG

SEQ ID NO: 739469 - protein, 9 aa, Homo Sapiens
TPGSHGQPG

SEQ ID NO: 739470 - protein, 9 aa, Homo Sapiens
YNLLLMVTC

SEQ ID NO: 739471 - protein, 9 aa, Homo Sapiens
PMRLQLCDT

SEQ ID NO: 739472 - protein, 9 aa, Homo Sapiens
ANLSLPISP

SEQ ID NO: 739473 - protein, 9 aa, Homo Sapiens
STYEELALA

SEQ ID NO: 739474 - protein, 9 aa, Homo Sapiens
LVHQQKIPN

SEQ ID NO: 739475 - protein, 9 aa, Homo Sapiens
VLIAIYTFQ

SEQ ID NO: 739476 - protein, 9 aa, Homo Sapiens
MRLQLCDTA

SEQ ID NO: 739477 - protein, 9 aa, Homo Sapiens
FRCRLRNFQ

SEQ ID NO: 739478 - protein, 9 aa, Homo Sapiens
SSEDSCDES

SEQ ID NO: 739479 - protein, 9 aa, Homo Sapiens
LQVQPVSWK

SEQ ID NO: 739480 - protein, 9 aa, Homo Sapiens
ITFYSNGTY

SEQ ID NO: 739481 - protein, 9 aa, Homo Sapiens
QAFLQAIAN

SEQ ID NO: 739482 - protein, 9 aa, Homo Sapiens
EYRLKINAL

SEQ ID NO: 739483 - protein, 9 aa, Homo Sapiens
LTRNCCLTE

SEQ ID NO: 739484 - protein, 9 aa, Homo Sapiens
WVLNPSQAF

SEQ ID NO: 739485 - protein, 9 aa, Homo Sapiens
DGRECVGSV

SEQ ID NO: 739486 - protein, 9 aa, Homo Sapiens
ESLVLLWRL

SEQ ID NO: 739487 - protein, 9 aa, Homo Sapiens
DLRWEGVPF

SEQ ID NO: 739488 - protein, 9 aa, Homo Sapiens
TRGRAAGRL

SEQ ID NO: 739489 - protein, 9 aa, Homo Sapiens
CLLSNKTSS

SEQ ID NO: 739490 - protein, 9 aa, Homo Sapiens
PRCEVKYCD

SEQ ID NO: 739491 - protein, 9 aa, Homo Sapiens
AFLQAIANN

SEQ ID NO: 739492 - protein, 9 aa, Homo Sapiens
CSSLTTHKA

SEQ ID NO: 739493 - protein, 9 aa, Homo Sapiens
AQLAGELAG

SEQ ID NO: 739494 - protein, 9 aa, Homo Sapiens
KQPKNIINP

SEQ ID NO: 739495 - protein, 9 aa, Homo Sapiens
PPGSQEEEE

SEQ ID NO: 739496 - protein, 9 aa, Homo Sapiens
GRSPSSNAK

SEQ ID NO: 739497 - protein, 9 aa, Homo Sapiens
KSITVKVSG

SEQ ID NO: 739498 - protein, 9 aa, Homo Sapiens
HKSAVNMDG

SEQ ID NO: 739499 - protein, 9 aa, Homo Sapiens
RLLKCPPPF

SEQ ID NO: 739500 - protein, 9 aa, Homo Sapiens
NNNIQDHNV

SEQ ID NO: 739501 - protein, 9 aa, Homo Sapiens
GDEEANLSL

SEQ ID NO: 739502 - protein, 9 aa, Homo Sapiens
SSLRQLYKD

SEQ ID NO: 739503 - protein, 9 aa, Homo Sapiens
GAIRDHTES

SEQ ID NO: 739504 - protein, 9 aa, Homo Sapiens
GMVPGRSES

SEQ ID NO: 739505 - protein, 9 aa, Homo Sapiens
YIKYSSRSM

SEQ ID NO: 739506 - protein, 9 aa, Homo Sapiens
RVCGAVRKT

SEQ ID NO: 739507 - protein, 9 aa, Homo Sapiens
NELLSEKLY

SEQ ID NO: 739508 - protein, 9 aa, Homo Sapiens
LRDKHRGQL

SEQ ID NO: 739509 - protein, 9 aa, Homo Sapiens
FDVVLEKCT

SEQ ID NO: 739510 - protein, 9 aa, Homo Sapiens
SDLMGKTLT

SEQ ID NO: 739511 - protein, 9 aa, Homo Sapiens
KNRAFQTCA

SEQ ID NO: 739512 - protein, 9 aa, Homo Sapiens
ETTVGAIRD

SEQ ID NO: 739513 - protein, 9 aa, Homo Sapiens
RTDERDLNY

SEQ ID NO: 739514 - protein, 9 aa, Homo Sapiens
VFYNSSAKV

SEQ ID NO: 739515 - protein, 9 aa, Homo Sapiens
SSVICEGDT

SEQ ID NO: 739516 - protein, 9 aa, Homo Sapiens
VASYPASMV

SEQ ID NO: 739517 - protein, 9 aa, Homo Sapiens
GLEDISGEF

SEQ ID NO: 739518 - protein, 9 aa, Homo Sapiens
RLRNFQDPI

SEQ ID NO: 739519 - protein, 9 aa, Homo Sapiens
NPVVYGVRT

SEQ ID NO: 739520 - protein, 9 aa, Homo Sapiens
SPARSLPAA

SEQ ID NO: 739521 - protein, 9 aa, Homo Sapiens
GYTKCGAEC

SEQ ID NO: 739522 - protein, 9 aa, Homo Sapiens
LLLPAISHS

SEQ ID NO: 739523 - protein, 9 aa, Homo Sapiens
VQRVAAFGA

SEQ ID NO: 739524 - protein, 9 aa, Homo Sapiens
PSTDSIQKD

SEQ ID NO: 739525 - protein, 9 aa, Homo Sapiens
VSKNCSQKH

SEQ ID NO: 739526 - protein, 9 aa, Homo Sapiens
YSQSEALCV

SEQ ID NO: 739527 - protein, 9 aa, Homo Sapiens
ADLDPMDMP

SEQ ID NO: 739528 - protein, 9 aa, Homo Sapiens
VATTGTVGA

SEQ ID NO: 739529 - protein, 9 aa, Homo Sapiens
SWCSSLTTH

SEQ ID NO: 739530 - protein, 9 aa, Homo Sapiens
SHCNHVSTG

SEQ ID NO: 739531 - protein, 9 aa, Homo Sapiens
GITFLTRNC

SEQ ID NO: 739532 - protein, 9 aa, Homo Sapiens
LYNKYVVRL

SEQ ID NO: 739533 - protein, 9 aa, Homo Sapiens
GRLSPARSL

SEQ ID NO: 739534 - protein, 9 aa, Homo Sapiens
TAFFSAGLS

SEQ ID NO: 739535 - protein, 9 aa, Homo Sapiens
KAEVRLLKC

SEQ ID NO: 739536 - protein, 9 aa, Homo Sapiens
QSWTTSPIT

SEQ ID NO: 739537 - protein, 9 aa, Homo Sapiens
PSAELYSNV

SEQ ID NO: 739538 - protein, 9 aa, Homo Sapiens
GGWYQSVGG

SEQ ID NO: 739539 - protein, 9 aa, Homo Sapiens
GRGSTFPRR

SEQ ID NO: 739540 - protein, 9 aa, Homo Sapiens
LVTDTNDHS

SEQ ID NO: 739541 - protein, 9 aa, Homo Sapiens
SNMSSSRGP

SEQ ID NO: 739542 - protein, 9 aa, Homo Sapiens
ELVHQQKIP

SEQ ID NO: 739543 - protein, 9 aa, Homo Sapiens
YDCDKCWKS

SEQ ID NO: 739544 - protein, 9 aa, Homo Sapiens
LNTRTRRGK

SEQ ID NO: 739545 - protein, 9 aa, Homo Sapiens
LGDRRPVLA

SEQ ID NO: 739546 - protein, 9 aa, Homo Sapiens
PSNSACLTP

SEQ ID NO: 739547 - protein, 9 aa, Homo Sapiens
VICEGDTVS

SEQ ID NO: 739548 - protein, 9 aa, Homo Sapiens
GVRDQTRMQ

SEQ ID NO: 739549 - protein, 9 aa, Homo Sapiens
LESNASMSC

SEQ ID NO: 739550 - protein, 9 aa, Homo Sapiens
QPLLYHDNE

SEQ ID NO: 739551 - protein, 9 aa, Homo Sapiens
NICLLSNKT

SEQ ID NO: 739552 - protein, 9 aa, Homo Sapiens
ETSDSLREV

SEQ ID NO: 739553 - protein, 9 aa, Homo Sapiens
CGAVRKTGE

SEQ ID NO: 739554 - protein, 9 aa, Homo Sapiens
HVHKSAVNM

SEQ ID NO: 739555 - protein, 9 aa, Homo Sapiens
DEFVQRVAA

SEQ ID NO: 739556 - protein, 9 aa, Homo Sapiens
LSTNTHHLA

SEQ ID NO: 739557 - protein, 9 aa, Homo Sapiens
QGYAYVVDA

SEQ ID NO: 739558 - protein, 9 aa, Homo Sapiens
HLWLCREEW

SEQ ID NO: 739559 - protein, 9 aa, Homo Sapiens
YSVAILPVS

SEQ ID NO: 739560 - protein, 9 aa, Homo Sapiens
VNMDGKDSE

SEQ ID NO: 739561 - protein, 9 aa, Homo Sapiens
TKIITLSHL

SEQ ID NO: 739562 - protein, 9 aa, Homo Sapiens
YHLNSEKFD

SEQ ID NO: 739563 - protein, 9 aa, Homo Sapiens
SPITVPGPA

SEQ ID NO: 739564 - protein, 9 aa, Homo Sapiens
HMLKSKEQG

SEQ ID NO: 739565 - protein, 9 aa, Homo Sapiens
TYEELALAY

SEQ ID NO: 739566 - protein, 9 aa, Homo Sapiens
LDLNDNAPE

SEQ ID NO: 739567 - protein, 9 aa, Homo Sapiens
FGDHPGYSY

SEQ ID NO: 739568 - protein, 9 aa, Homo Sapiens
LLAPWAIRT

SEQ ID NO: 739569 - protein, 9 aa, Homo Sapiens
ATPHVALVM

SEQ ID NO: 739570 - protein, 9 aa, Homo Sapiens
YTKEYRLKI

SEQ ID NO: 739571 - protein, 9 aa, Homo Sapiens
EFQDDSVLQ

SEQ ID NO: 739572 - protein, 9 aa, Homo Sapiens
LNPEMSRST

SEQ ID NO: 739573 - protein, 9 aa, Homo Sapiens
YPFRHPERP

SEQ ID NO: 739574 - protein, 9 aa, Homo Sapiens
QKHKKDSKN

SEQ ID NO: 739575 - protein, 9 aa, Homo Sapiens
DTSLEDQKG

SEQ ID NO: 739576 - protein, 9 aa, Homo Sapiens
GDRRPVLAG

SEQ ID NO: 739577 - protein, 9 aa, Homo Sapiens
NEKDSSKVP

SEQ ID NO: 739578 - protein, 9 aa, Homo Sapiens
DSVKIRMQS

SEQ ID NO: 739579 - protein, 9 aa, Homo Sapiens
MYPVDSVKI

SEQ ID NO: 739580 - protein, 9 aa, Homo Sapiens
KGTASPAST

SEQ ID NO: 739581 - protein, 9 aa, Homo Sapiens
EPPRIRGSG

SEQ ID NO: 739582 - protein, 9 aa, Homo Sapiens
SPSSNAKHV

SEQ ID NO: 739583 - protein, 9 aa, Homo Sapiens
VGRPLPQTD

SEQ ID NO: 739584 - protein, 9 aa, Homo Sapiens
GSTFSCDCL

SEQ ID NO: 739585 - protein, 9 aa, Homo Sapiens
KMDDFKCVT

SEQ ID NO: 739586 - protein, 9 aa, Homo Sapiens
PHSQNGLPF

SEQ ID NO: 739587 - protein, 9 aa, Homo Sapiens
GIFGDHPGY

SEQ ID NO: 739588 - protein, 9 aa, Homo Sapiens
RIRTSEGKN

SEQ ID NO: 739589 - protein, 9 aa, Homo Sapiens
LLKCPPPFE

SEQ ID NO: 739590 - protein, 9 aa, Homo Sapiens
NGYPFRHPE

SEQ ID NO: 739591 - protein, 9 aa, Homo Sapiens
WSFVILLSV

SEQ ID NO: 739592 - protein, 9 aa, Homo Sapiens
VSSKVSSAQ

SEQ ID NO: 739593 - protein, 9 aa, Homo Sapiens
FLATERQEP

SEQ ID NO: 739594 - protein, 9 aa, Homo Sapiens
VHIDDLRWE

SEQ ID NO: 739595 - protein, 9 aa, Homo Sapiens
RSTFKSYDE

SEQ ID NO: 739596 - protein, 9 aa, Homo Sapiens
DQGLYVVLD

SEQ ID NO: 739597 - protein, 9 aa, Homo Sapiens
EFVQRVAAF

SEQ ID NO: 739598 - protein, 9 aa, Homo Sapiens
AIRDHTESS

SEQ ID NO: 739599 - protein, 9 aa, Homo Sapiens
EDPSARTSR

SEQ ID NO: 739600 - protein, 9 aa, Homo Sapiens
IQEDAEAPK

SEQ ID NO: 739601 - protein, 9 aa, Homo Sapiens
LSSAESPVC

SEQ ID NO: 739602 - protein, 9 aa, Homo Sapiens
KTHIEGKHF

SEQ ID NO: 739603 - protein, 9 aa, Homo Sapiens
AGELAGQEM

SEQ ID NO: 739604 - protein, 9 aa, Homo Sapiens
AGSQPRFIS

SEQ ID NO: 739605 - protein, 9 aa, Homo Sapiens
SWKKLQLVG

SEQ ID NO: 739606 - protein, 9 aa, Homo Sapiens
SSPELKSCK

SEQ ID NO: 739607 - protein, 9 aa, Homo Sapiens
TGNLHVVPG

SEQ ID NO: 739608 - protein, 9 aa, Homo Sapiens
LRDGNKLAG

SEQ ID NO: 739609 - protein, 9 aa, Homo Sapiens
RHGPVRALL

SEQ ID NO: 739610 - protein, 9 aa, Homo Sapiens
CSQKHKKDS

SEQ ID NO: 739611 - protein, 9 aa, Homo Sapiens
ASLLLLLLR

SEQ ID NO: 739612 - protein, 9 aa, Homo Sapiens
NGHCPNGVT

SEQ ID NO: 739613 - protein, 9 aa, Homo Sapiens
PQAVTYAAV

SEQ ID NO: 739614 - protein, 9 aa, Homo Sapiens
WSASAACHC

SEQ ID NO: 739615 - protein, 9 aa, Homo Sapiens
PVRALLTLL

SEQ ID NO: 739616 - protein, 9 aa, Homo Sapiens
RYVSTGQSV

SEQ ID NO: 739617 - protein, 9 aa, Homo Sapiens
RDHTESSVH

SEQ ID NO: 739618 - protein, 9 aa, Homo Sapiens
NRRGGYHGG

SEQ ID NO: 739619 - protein, 9 aa, Homo Sapiens
TIDYVNRGL

SEQ ID NO: 739620 - protein, 9 aa, Homo Sapiens
GPGSGPPGS

SEQ ID NO: 739621 - protein, 9 aa, Homo Sapiens
YNPCGAIVT

SEQ ID NO: 739622 - protein, 9 aa, Homo Sapiens
GLGDGSGLL

SEQ ID NO: 739623 - protein, 9 aa, Homo Sapiens
HLNSEKFDL

SEQ ID NO: 739624 - protein, 9 aa, Homo Sapiens
FWLELVSHL

SEQ ID NO: 739625 - protein, 9 aa, Homo Sapiens
FLQVQPVSW

SEQ ID NO: 739626 - protein, 9 aa, Homo Sapiens
FFVFWSFVI

SEQ ID NO: 739627 - protein, 9 aa, Homo Sapiens
DKHRGQLLK

SEQ ID NO: 739628 - protein, 9 aa, Homo Sapiens
LYNAENKIR

SEQ ID NO: 739629 - protein, 9 aa, Homo Sapiens
DEEANLSLP

SEQ ID NO: 739630 - protein, 9 aa, Homo Sapiens
EELALAYEH

SEQ ID NO: 739631 - protein, 9 aa, Homo Sapiens
SQQPPPPAP

SEQ ID NO: 739632 - protein, 9 aa, Homo Sapiens
GDKQYHKHQ

SEQ ID NO: 739633 - protein, 9 aa, Homo Sapiens
DSSKVPQSS

SEQ ID NO: 739634 - protein, 9 aa, Homo Sapiens
YQSWTTSPI

SEQ ID NO: 739635 - protein, 9 aa, Homo Sapiens
ALKMDDFKC

SEQ ID NO: 739636 - protein, 9 aa, Homo Sapiens
FVILLSVTI

SEQ ID NO: 739637 - protein, 9 aa, Homo Sapiens
KAGPWSCGM

SEQ ID NO: 739638 - protein, 9 aa, Homo Sapiens
AARPHSQNG

SEQ ID NO: 739639 - protein, 9 aa, Homo Sapiens
VPCTTYGWR

SEQ ID NO: 739640 - protein, 9 aa, Homo Sapiens
AVKHSRPRR

SEQ ID NO: 739641 - protein, 9 aa, Homo Sapiens
RHKTRPAAP

SEQ ID NO: 739642 - protein, 9 aa, Homo Sapiens
TLPQSKLLT

SEQ ID NO: 739643 - protein, 9 aa, Homo Sapiens
VETFNHALR

SEQ ID NO: 739644 - protein, 9 aa, Homo Sapiens
PRGPATRGR

SEQ ID NO: 739645 - protein, 9 aa, Homo Sapiens
ENGYPFRHP

SEQ ID NO: 739646 - protein, 9 aa, Homo Sapiens
KCTLDALLA

SEQ ID NO: 739647 - protein, 9 aa, Homo Sapiens
QMSSRTFLR

SEQ ID NO: 739648 - protein, 9 aa, Homo Sapiens
LVSDVFYNS

SEQ ID NO: 739649 - protein, 9 aa, Homo Sapiens
KAQLSQGRS

SEQ ID NO: 739650 - protein, 9 aa, Homo Sapiens
RDRDSPETG

SEQ ID NO: 739651 - protein, 9 aa, Homo Sapiens
GYSYGDLPG

SEQ ID NO: 739652 - protein, 9 aa, Homo Sapiens
DSCDESDSS

SEQ ID NO: 739653 - protein, 9 aa, Homo Sapiens
MKLDVPEQV

SEQ ID NO: 739654 - protein, 9 aa, Homo Sapiens
APWAIRTRY

SEQ ID NO: 739655 - protein, 9 aa, Homo Sapiens
EPEPWLLLE

SEQ ID NO: 739656 - protein, 9 aa, Homo Sapiens
RSYEFSSNS

SEQ ID NO: 739657 - protein, 9 aa, Homo Sapiens
HEPPAKKAA

SEQ ID NO: 739658 - protein, 9 aa, Homo Sapiens
VVIPKLNPI

SEQ ID NO: 739659 - protein, 9 aa, Homo Sapiens
GGGLSPDTR

SEQ ID NO: 739660 - protein, 9 aa, Homo Sapiens
NSTGCQLIP

SEQ ID NO: 739661 - protein, 9 aa, Homo Sapiens
SSTPNGHCP

SEQ ID NO: 739662 - protein, 9 aa, Homo Sapiens
SYPASMVPR

SEQ ID NO: 739663 - protein, 9 aa, Homo Sapiens
AKSRKCSKE

SEQ ID NO: 739664 - protein, 9 aa, Homo Sapiens
ASAACHCMQ

SEQ ID NO: 739665 - protein, 9 aa, Homo Sapiens
QSYTRQTCI

SEQ ID NO: 739666 - protein, 9 aa, Homo Sapiens
EANGGKRPK

SEQ ID NO: 739667 - protein, 9 aa, Homo Sapiens
KSYDCDKCW

SEQ ID NO: 739668 - protein, 9 aa, Homo Sapiens
LNDNAPELT

SEQ ID NO: 739669 - protein, 9 aa, Homo Sapiens
LTAKTEEFR

SEQ ID NO: 739670 - protein, 9 aa, Homo Sapiens
KTVLTMTTI

SEQ ID NO: 739671 - protein, 9 aa, Homo Sapiens
ADYEEASYG

SEQ ID NO: 739672 - protein, 9 aa, Homo Sapiens
KYCDDFLGQ

SEQ ID NO: 739673 - protein, 9 aa, Homo Sapiens
RPAEETHVK

SEQ ID NO: 739674 - protein, 9 aa, Homo Sapiens
VTPDYHLNS

SEQ ID NO: 739675 - protein, 9 aa, Homo Sapiens
PVESSEDSC

SEQ ID NO: 739676 - protein, 9 aa, Homo Sapiens
GSPWSWPDE

SEQ ID NO: 739677 - protein, 9 aa, Homo Sapiens
IHMSFQPVP

SEQ ID NO: 739678 - protein, 9 aa, Homo Sapiens
TLVYGMIPP

SEQ ID NO: 739679 - protein, 9 aa, Homo Sapiens
VFLRVCGAV

SEQ ID NO: 739680 - protein, 9 aa, Homo Sapiens
EETHVKVQP

SEQ ID NO: 739681 - protein, 9 aa, Homo Sapiens
DDFKCVTPK

SEQ ID NO: 739682 - protein, 9 aa, Homo Sapiens
MHLPTNRAL

SEQ ID NO: 739683 - protein, 9 aa, Homo Sapiens
LLPPWVLNP

SEQ ID NO: 739684 - protein, 9 aa, Homo Sapiens
YYRADLDPM

SEQ ID NO: 739685 - protein, 9 aa, Homo Sapiens
LSEKLYNAE

SEQ ID NO: 739686 - protein, 9 aa, Homo Sapiens
YCELGDKQY

SEQ ID NO: 739687 - protein, 9 aa, Homo Sapiens
DRRPVLAGL

SEQ ID NO: 739688 - protein, 9 aa, Homo Sapiens
PGSPWSWPD

SEQ ID NO: 739689 - protein, 9 aa, Homo Sapiens
EAEYCYINI

SEQ ID NO: 739690 - protein, 9 aa, Homo Sapiens
QFYSVAILP

SEQ ID NO: 739691 - protein, 9 aa, Homo Sapiens
PDTRDRDSP

SEQ ID NO: 739692 - protein, 9 aa, Homo Sapiens
TFNHALRHV

SEQ ID NO: 739693 - protein, 9 aa, Homo Sapiens
SKDNEQSPR

SEQ ID NO: 739694 - protein, 9 aa, Homo Sapiens
SYTRQTCIV

SEQ ID NO: 739695 - protein, 9 aa, Homo Sapiens
AEVRLLKCP

SEQ ID NO: 739696 - protein, 9 aa, Homo Sapiens
RSTDTEYNP

SEQ ID NO: 739697 - protein, 9 aa, Homo Sapiens
FLRVCGAVR

SEQ ID NO: 739698 - protein, 9 aa, Homo Sapiens
CLGYNLLLM

SEQ ID NO: 739699 - protein, 9 aa, Homo Sapiens
ISAFANDRD

SEQ ID NO: 739700 - protein, 9 aa, Homo Sapiens
QALRLRAHK

SEQ ID NO: 739701 - protein, 9 aa, Homo Sapiens
QLFTELRED

SEQ ID NO: 739702 - protein, 9 aa, Homo Sapiens
PSYLLVRGI

SEQ ID NO: 739703 - protein, 9 aa, Homo Sapiens
NTDGRECVG

SEQ ID NO: 739704 - protein, 9 aa, Homo Sapiens
TRDRDSPET

SEQ ID NO: 739705 - protein, 9 aa, Homo Sapiens
GELAGQEMH

SEQ ID NO: 739706 - protein, 9 aa, Homo Sapiens
PACGYTKCG

SEQ ID NO: 739707 - protein, 9 aa, Homo Sapiens
EEEANGGKR

SEQ ID NO: 739708 - protein, 9 aa, Homo Sapiens
VLRTDERDL

SEQ ID NO: 739709 - protein, 9 aa, Homo Sapiens
VSLGIKTVL

SEQ ID NO: 739710 - protein, 9 aa, Homo Sapiens
LPSIKGVSS

SEQ ID NO: 739711 - protein, 9 aa, Homo Sapiens
YQGHMLKSK

SEQ ID NO: 739712 - protein, 9 aa, Homo Sapiens
RELPEKSKM

SEQ ID NO: 739713 - protein, 9 aa, Homo Sapiens
ASVTKLAKQ

SEQ ID NO: 739714 - protein, 9 aa, Homo Sapiens
PEKTTAEFQ

SEQ ID NO: 739715 - protein, 9 aa, Homo Sapiens
PEPEPEPWL

SEQ ID NO: 739716 - protein, 9 aa, Homo Sapiens
LWLCREEWE

SEQ ID NO: 739717 - protein, 9 aa, Homo Sapiens
MGKTLTEDD

SEQ ID NO: 739718 - protein, 9 aa, Homo Sapiens
YGMIPPTSK

SEQ ID NO: 739719 - protein, 9 aa, Homo Sapiens
IRASATGAR

SEQ ID NO: 739720 - protein, 9 aa, Homo Sapiens
GSFITNYFQ

SEQ ID NO: 739721 - protein, 9 aa, Homo Sapiens
SMDFLDKGT

SEQ ID NO: 739722 - protein, 9 aa, Homo Sapiens
SKVSSAQHS

SEQ ID NO: 739723 - protein, 9 aa, Homo Sapiens
SKVPQSSSG

SEQ ID NO: 739724 - protein, 9 aa, Homo Sapiens
SAVNMDGKD

SEQ ID NO: 739725 - protein, 9 aa, Homo Sapiens
CGCYIYIYL

SEQ ID NO: 739726 - protein, 9 aa, Homo Sapiens
VYLELTDSC

SEQ ID NO: 739727 - protein, 9 aa, Homo Sapiens
SSQTRSHCN

SEQ ID NO: 739728 - protein, 9 aa, Homo Sapiens
PQSKLLTRG

SEQ ID NO: 739729 - protein, 9 aa, Homo Sapiens
TYTAFFSAG

SEQ ID NO: 739730 - protein, 9 aa, Homo Sapiens
FENKEKTIL

SEQ ID NO: 739731 - protein, 9 aa, Homo Sapiens
RCRLRNFQD

SEQ ID NO: 739732 - protein, 9 aa, Homo Sapiens
AEILLAPWA

SEQ ID NO: 739733 - protein, 9 aa, Homo Sapiens
LCREEWERR

SEQ ID NO: 739734 - protein, 9 aa, Homo Sapiens
TAKTEEFRQ

SEQ ID NO: 739735 - protein, 9 aa, Homo Sapiens
VDLMSSVIC

SEQ ID NO: 739736 - protein, 9 aa, Homo Sapiens
IEGKHFICI

SEQ ID NO: 739737 - protein, 9 aa, Homo Sapiens
MYIKYSSRS

SEQ ID NO: 739738 - protein, 9 aa, Homo Sapiens
RADLDPMDM

SEQ ID NO: 739739 - protein, 9 aa, Homo Sapiens
TMLVLIAIY

SEQ ID NO: 739740 - protein, 9 aa, Homo Sapiens
FLQAIANNN

SEQ ID NO: 739741 - protein, 9 aa, Homo Sapiens
EFKKFKMKL

SEQ ID NO: 739742 - protein, 9 aa, Homo Sapiens
GAGEEEANG

SEQ ID NO: 739743 - protein, 9 aa, Homo Sapiens
KEYRLKINA

SEQ ID NO: 739744 - protein, 9 aa, Homo Sapiens
PGLLPPWVL

SEQ ID NO: 739745 - protein, 9 aa, Homo Sapiens
PVRRLELLS

SEQ ID NO: 739746 - protein, 9 aa, Homo Sapiens
RFISTHRVA

SEQ ID NO: 739747 - protein, 9 aa, Homo Sapiens
QATPHVALV

SEQ ID NO: 739748 - protein, 9 aa, Homo Sapiens
YKLALRAMK

SEQ ID NO: 739749 - protein, 9 aa, Homo Sapiens
DVVLEKCTL

SEQ ID NO: 739750 - protein, 9 aa, Homo Sapiens
DVFYNSSAK

SEQ ID NO: 739751 - protein, 9 aa, Homo Sapiens
IRNSVDDLN

SEQ ID NO: 739752 - protein, 9 aa, Homo Sapiens
QSEALCVLL

SEQ ID NO: 739753 - protein, 9 aa, Homo Sapiens
SPSPSGSML

SEQ ID NO: 739754 - protein, 9 aa, Homo Sapiens
KQSEAEYCY

SEQ ID NO: 739755 - protein, 9 aa, Homo Sapiens
EYNPCGAIV

SEQ ID NO: 739756 - protein, 9 aa, Homo Sapiens
TNQPRQYFI

SEQ ID NO: 739757 - protein, 9 aa, Homo Sapiens
LVMPLDRFI

SEQ ID NO: 739758 - protein, 9 aa, Homo Sapiens
VQPVSWKKL

SEQ ID NO: 739759 - protein, 9 aa, Homo Sapiens
VICGCYIYI

SEQ ID NO: 739760 - protein, 9 aa, Homo Sapiens
VPQSSSGVN

SEQ ID NO: 739761 - protein, 9 aa, Homo Sapiens
GPRYAQLPP

SEQ ID NO: 739762 - protein, 9 aa, Homo Sapiens
GEFGDEFVQ

SEQ ID NO: 739763 - protein, 9 aa, Homo Sapiens
DASVTKLAK

SEQ ID NO: 739764 - protein, 9 aa, Homo Sapiens
TQENICLLS

SEQ ID NO: 739765 - protein, 9 aa, Homo Sapiens
EYTKEYRLK

SEQ ID NO: 739766 - protein, 9 aa, Homo Sapiens
SHGQPGRDG

SEQ ID NO: 739767 - protein, 9 aa, Homo Sapiens
ESSEDSCDE

SEQ ID NO: 739768 - protein, 9 aa, Homo Sapiens
AISHSKTSR

SEQ ID NO: 739769 - protein, 9 aa, Homo Sapiens
LATERQEPG

SEQ ID NO: 739770 - protein, 9 aa, Homo Sapiens
RSPSTDSIQ

SEQ ID NO: 739771 - protein, 9 aa, Homo Sapiens
SFDVVLEKC

SEQ ID NO: 739772 - protein, 9 aa, Homo Sapiens
DYHLNSEKF

SEQ ID NO: 739773 - protein, 9 aa, Homo Sapiens
RNSVDDLNN

SEQ ID NO: 739774 - protein, 9 aa, Homo Sapiens
WLSPFQAVV

SEQ ID NO: 739775 - protein, 9 aa, Homo Sapiens
WCSSLTTHK

SEQ ID NO: 739776 - protein, 9 aa, Homo Sapiens
LKAQLSQGR

SEQ ID NO: 739777 - protein, 9 aa, Homo Sapiens
ASYPASMVP

SEQ ID NO: 739778 - protein, 9 aa, Homo Sapiens
APIRASATG

SEQ ID NO: 739779 - protein, 9 aa, Homo Sapiens
TLARSPSTD

SEQ ID NO: 739780 - protein, 9 aa, Homo Sapiens
SGLLNNRLV

SEQ ID NO: 739781 - protein, 9 aa, Homo Sapiens
EDKNIVGDD

SEQ ID NO: 739782 - protein, 9 aa, Homo Sapiens
VKIRMQSLS

SEQ ID NO: 739783 - protein, 9 aa, Homo Sapiens
PSPRHKTRP

SEQ ID NO: 739784 - protein, 9 aa, Homo Sapiens
ITNYFQNQL

SEQ ID NO: 739785 - protein, 9 aa, Homo Sapiens
DLDPMDMPC

SEQ ID NO: 739786 - protein, 9 aa, Homo Sapiens
NPQKDEKLE

SEQ ID NO: 739787 - protein, 9 aa, Homo Sapiens
ILLERKDIR

SEQ ID NO: 739788 - protein, 9 aa, Homo Sapiens
DDTLVYGMI

SEQ ID NO: 739789 - protein, 9 aa, Homo Sapiens
GNKLAGTDG

SEQ ID NO: 739790 - protein, 9 aa, Homo Sapiens
GGPGLLPPW

SEQ ID NO: 739791 - protein, 9 aa, Homo Sapiens
SVKIRMQSL

SEQ ID NO: 739792 - protein, 9 aa, Homo Sapiens
SRSTDTEYN

SEQ ID NO: 739793 - protein, 9 aa, Homo Sapiens
SGSMLFTDE

SEQ ID NO: 739794 - protein, 9 aa, Homo Sapiens
CWRPMRSTF

SEQ ID NO: 739795 - protein, 9 aa, Homo Sapiens
HSQNGLPFG

SEQ ID NO: 739796 - protein, 9 aa, Homo Sapiens
EFDQGLYVV

SEQ ID NO: 739797 - protein, 9 aa, Homo Sapiens
EEFKKFKMK

SEQ ID NO: 739798 - protein, 9 aa, Homo Sapiens
DNEGDQLAA

SEQ ID NO: 739799 - protein, 9 aa, Homo Sapiens
DFKCVTPKL

SEQ ID NO: 739800 - protein, 9 aa, Homo Sapiens
YHMKTLASY

SEQ ID NO: 739801 - protein, 9 aa, Homo Sapiens
SEDSCDESD

SEQ ID NO: 739802 - protein, 9 aa, Homo Sapiens
LGANTKGMC

SEQ ID NO: 739803 - protein, 9 aa, Homo Sapiens
ERWHTGNLH

SEQ ID NO: 739804 - protein, 9 aa, Homo Sapiens
RLRAGGWYQ

SEQ ID NO: 739805 - protein, 9 aa, Homo Sapiens
TLSHLEMTW

SEQ ID NO: 739806 - protein, 9 aa, Homo Sapiens
RWHTGNLHV

SEQ ID NO: 739807 - protein, 9 aa, Homo Sapiens
YPVDSVKIR

SEQ ID NO: 739808 - protein, 9 aa, Homo Sapiens
PGAPDTTLT

SEQ ID NO: 739809 - protein, 9 aa, Homo Sapiens
QSKDNEQSP

SEQ ID NO: 739810 - protein, 9 aa, Homo Sapiens
YCYINIART

SEQ ID NO: 739811 - protein, 9 aa, Homo Sapiens
ISTHRVAEC

SEQ ID NO: 739812 - protein, 9 aa, Homo Sapiens
LPPWVLNPS

SEQ ID NO: 739813 - protein, 9 aa, Homo Sapiens
NSNMSSSRG

SEQ ID NO: 739814 - protein, 9 aa, Homo Sapiens
EGKHFICID

SEQ ID NO: 739815 - protein, 9 aa, Homo Sapiens
GKTLTEDDD

SEQ ID NO: 739816 - protein, 9 aa, Homo Sapiens
LSLPISPFM

SEQ ID NO: 739817 - protein, 9 aa, Homo Sapiens
RQKSFLHLA

SEQ ID NO: 739818 - protein, 9 aa, Homo Sapiens
EGLEDISGE

SEQ ID NO: 739819 - protein, 9 aa, Homo Sapiens
NYHMKTLAS

SEQ ID NO: 739820 - protein, 9 aa, Homo Sapiens
CCHLWSKAS

SEQ ID NO: 739821 - protein, 9 aa, Homo Sapiens
LGVFATGPR

SEQ ID NO: 739822 - protein, 9 aa, Homo Sapiens
STFSCDCLP

SEQ ID NO: 739823 - protein, 9 aa, Homo Sapiens
LMGKTLTED

SEQ ID NO: 739824 - protein, 9 aa, Homo Sapiens
EFSSNSCSQ

SEQ ID NO: 739825 - protein, 9 aa, Homo Sapiens
SSLSSLRQL

SEQ ID NO: 739826 - protein, 9 aa, Homo Sapiens
QGDGVVPCT

SEQ ID NO: 739827 - protein, 9 aa, Homo Sapiens
KTRPAAPRQ

SEQ ID NO: 739828 - protein, 9 aa, Homo Sapiens
TNYFQNQLL

SEQ ID NO: 739829 - protein, 9 aa, Homo Sapiens
LWRLLAWDL

SEQ ID NO: 739830 - protein, 9 aa, Homo Sapiens
TERQEPGLM

SEQ ID NO: 739831 - protein, 9 aa, Homo Sapiens
CSYTEDALC

SEQ ID NO: 739832 - protein, 9 aa, Homo Sapiens
SINPQKDEK

SEQ ID NO: 739833 - protein, 9 aa, Homo Sapiens
GTPGSHGQP

SEQ ID NO: 739834 - protein, 9 aa, Homo Sapiens
YLSQRLHIK

SEQ ID NO: 739835 - protein, 9 aa, Homo Sapiens
NCGEGTYSL

SEQ ID NO: 739836 - protein, 9 aa, Homo Sapiens
YNKYVVRLQ

SEQ ID NO: 739837 - protein, 9 aa, Homo Sapiens
RTPSICLAM

SEQ ID NO: 739838 - protein, 9 aa, Homo Sapiens
WHTGNLHVV

SEQ ID NO: 739839 - protein, 9 aa, Homo Sapiens
VVLEKCTLD

SEQ ID NO: 739840 - protein, 9 aa, Homo Sapiens
VFNLLRKHR

SEQ ID NO: 739841 - protein, 9 aa, Homo Sapiens
STFKSYDEA

SEQ ID NO: 739842 - protein, 9 aa, Homo Sapiens
ISHSKTSRP

SEQ ID NO: 739843 - protein, 9 aa, Homo Sapiens
IYTFQFQDF

SEQ ID NO: 739844 - protein, 9 aa, Homo Sapiens
SYLLVRGIS

SEQ ID NO: 739845 - protein, 9 aa, Homo Sapiens
LRHGPVRAL

SEQ ID NO: 739846 - protein, 9 aa, Homo Sapiens
DPWSASAAC

SEQ ID NO: 739847 - protein, 9 aa, Homo Sapiens
ASPPCPRPH

SEQ ID NO: 739848 - protein, 9 aa, Homo Sapiens
RCLNTRTRR

SEQ ID NO: 739849 - protein, 9 aa, Homo Sapiens
VGEQAKAQV

SEQ ID NO: 739850 - protein, 9 aa, Homo Sapiens
ESNASMSCN

SEQ ID NO: 739851 - protein, 9 aa, Homo Sapiens
YNAENKIRS

SEQ ID NO: 739852 - protein, 9 aa, Homo Sapiens
AEFQVPRLV

SEQ ID NO: 739853 - protein, 9 aa, Homo Sapiens
CGYTKCGAE

SEQ ID NO: 739854 - protein, 9 aa, Homo Sapiens
STDSIQKDP

SEQ ID NO: 739855 - protein, 9 aa, Homo Sapiens
DLNYWTSRY

SEQ ID NO: 739856 - protein, 9 aa, Homo Sapiens
GSTFPRRIN

SEQ ID NO: 739857 - protein, 9 aa, Homo Sapiens
RTSEGKNRA

SEQ ID NO: 739858 - protein, 9 aa, Homo Sapiens
SITVKVSGP

SEQ ID NO: 739859 - protein, 9 aa, Homo Sapiens
LLFLFATQI

SEQ ID NO: 739860 - protein, 9 aa, Homo Sapiens
GLLPPWVLN

SEQ ID NO: 739861 - protein, 9 aa, Homo Sapiens
PRFISTHRV

SEQ ID NO: 739862 - protein, 9 aa, Homo Sapiens
FYSNGTYVC

SEQ ID NO: 739863 - protein, 9 aa, Homo Sapiens
KLTEESIMD

SEQ ID NO: 739864 - protein, 9 aa, Homo Sapiens
LDEIQMSSR

SEQ ID NO: 739865 - protein, 9 aa, Homo Sapiens
RDVTREAAT

SEQ ID NO: 739866 - protein, 9 aa, Homo Sapiens
PPALNPVVY

SEQ ID NO: 739867 - protein, 9 aa, Homo Sapiens
EAFTHSTSY

SEQ ID NO: 739868 - protein, 9 aa, Homo Sapiens
VSIFYTVVI

SEQ ID NO: 739869 - protein, 9 aa, Homo Sapiens
TYTECCVCM

SEQ ID NO: 739870 - protein, 9 aa, Homo Sapiens
IGLAVASYP

SEQ ID NO: 739871 - protein, 9 aa, Homo Sapiens
ATRDFENKE

SEQ ID NO: 739872 - protein, 9 aa, Homo Sapiens
AFWLELVSH

SEQ ID NO: 739873 - protein, 9 aa, Homo Sapiens
IYNKQPKNI

SEQ ID NO: 739874 - protein, 9 aa, Homo Sapiens
LTPEEFKKF

SEQ ID NO: 739875 - protein, 9 aa, Homo Sapiens
NCSQKHKKD

SEQ ID NO: 739876 - protein, 9 aa, Homo Sapiens
SELGSFITN

SEQ ID NO: 739877 - protein, 9 aa, Homo Sapiens
SACLTPLRY

SEQ ID NO: 739878 - protein, 9 aa, Homo Sapiens
APRCEVKYC

SEQ ID NO: 739879 - protein, 9 aa, Homo Sapiens
LEWSGKHCE

SEQ ID NO: 739880 - protein, 9 aa, Homo Sapiens
EEFDQGLYV

SEQ ID NO: 739881 - protein, 9 aa, Homo Sapiens
AGAPWPRLN

SEQ ID NO: 739882 - protein, 9 aa, Homo Sapiens
PGACSVPSA

SEQ ID NO: 739883 - protein, 9 aa, Homo Sapiens
ICGCYIYIY

SEQ ID NO: 739884 - protein, 9 aa, Homo Sapiens
SLKAQLSQG

SEQ ID NO: 739885 - protein, 9 aa, Homo Sapiens
VYGMIPPTS

SEQ ID NO: 739886 - protein, 9 aa, Homo Sapiens
NLLLMVTCT

SEQ ID NO: 739887 - protein, 9 aa, Homo Sapiens
HTLPQSKLL

SEQ ID NO: 739888 - protein, 9 aa, Homo Sapiens
REEFDQGLY

SEQ ID NO: 739889 - protein, 9 aa, Homo Sapiens
SALTQENIC

SEQ ID NO: 739890 - protein, 9 aa, Homo Sapiens
SCNTPLVRI

SEQ ID NO: 739891 - protein, 9 aa, Homo Sapiens
KNKHVLTPL

SEQ ID NO: 739892 - protein, 9 aa, Homo Sapiens
LEVFNLLRK

SEQ ID NO: 739893 - protein, 9 aa, Homo Sapiens
RLNPKALAA

SEQ ID NO: 739894 - protein, 9 aa, Homo Sapiens
EIDHFFCEF

SEQ ID NO: 739895 - protein, 9 aa, Homo Sapiens
EPGPPSPAG

SEQ ID NO: 739896 - protein, 9 aa, Homo Sapiens
MQVKPNATL

SEQ ID NO: 739897 - protein, 9 aa, Homo Sapiens
FYFFTHYDT

SEQ ID NO: 739898 - protein, 9 aa, Homo Sapiens
RTRDKKGSN

SEQ ID NO: 739899 - protein, 9 aa, Homo Sapiens
RSQQPPPPA

SEQ ID NO: 739900 - protein, 9 aa, Homo Sapiens
HVALVMPLD

SEQ ID NO: 739901 - protein, 9 aa, Homo Sapiens
ELEEEENEE

SEQ ID NO: 739902 - protein, 9 aa, Homo Sapiens
SLIGCLGYN

SEQ ID NO: 739903 - protein, 9 aa, Homo Sapiens
IESKNKHVL

SEQ ID NO: 739904 - protein, 9 aa, Homo Sapiens
ERLDRDSHH

SEQ ID NO: 739905 - protein, 9 aa, Homo Sapiens
HTGNLHVVP

SEQ ID NO: 739906 - protein, 9 aa, Homo Sapiens
NHVSTGAQV

SEQ ID NO: 739907 - protein, 9 aa, Homo Sapiens
CPPPFEDPL

SEQ ID NO: 739908 - protein, 9 aa, Homo Sapiens
YSYGDLPGP

SEQ ID NO: 739909 - protein, 9 aa, Homo Sapiens
LDTNQPRQY

SEQ ID NO: 739910 - protein, 9 aa, Homo Sapiens
SWSSSFTEH

SEQ ID NO: 739911 - protein, 9 aa, Homo Sapiens
DLNDNAPEL

SEQ ID NO: 739912 - protein, 9 aa, Homo Sapiens
RVLDLNDNA

SEQ ID NO: 739913 - protein, 9 aa, Homo Sapiens
HCWRPMRST

SEQ ID NO: 739914 - protein, 9 aa, Homo Sapiens
VAFWLELVS

SEQ ID NO: 739915 - protein, 9 aa, Homo Sapiens
AKTEEFRQK

SEQ ID NO: 739916 - protein, 9 aa, Homo Sapiens
AAPRCEVKY

SEQ ID NO: 739917 - protein, 9 aa, Homo Sapiens
TPDYHLNSE

SEQ ID NO: 739918 - protein, 9 aa, Homo Sapiens
LEGDEYAKH

SEQ ID NO: 739919 - protein, 9 aa, Homo Sapiens
KILSENPAN

SEQ ID NO: 739920 - protein, 9 aa, Homo Sapiens
KASEPVIWE

SEQ ID NO: 739921 - protein, 9 aa, Homo Sapiens
IPPALNPVV

SEQ ID NO: 739922 - protein, 9 aa, Homo Sapiens
IKTVLTMTT

SEQ ID NO: 739923 - protein, 9 aa, Homo Sapiens
CYIYIYLTV

SEQ ID NO: 739924 - protein, 9 aa, Homo Sapiens
AKHVMSRLS

SEQ ID NO: 739925 - protein, 9 aa, Homo Sapiens
CPKSQGYAY

SEQ ID NO: 739926 - protein, 9 aa, Homo Sapiens
FSTLGSPDN

SEQ ID NO: 739927 - protein, 9 aa, Homo Sapiens
SVDDLNNNV

SEQ ID NO: 739928 - protein, 9 aa, Homo Sapiens
GARFLATER

SEQ ID NO: 739929 - protein, 9 aa, Homo Sapiens
PWSASAACH

SEQ ID NO: 739930 - protein, 9 aa, Homo Sapiens
SEKLYNAEN

SEQ ID NO: 739931 - protein, 9 aa, Homo Sapiens
VELEEEENE

SEQ ID NO: 739932 - protein, 9 aa, Homo Sapiens
GPPSPAGER

SEQ ID NO: 739933 - protein, 9 aa, Homo Sapiens
GKILSENPA

SEQ ID NO: 739934 - protein, 9 aa, Homo Sapiens
GDGVVPCTT

SEQ ID NO: 739935 - protein, 9 aa, Homo Sapiens
RCEVKYCDD

SEQ ID NO: 739936 - protein, 9 aa, Homo Sapiens
ITLSHLEMT

SEQ ID NO: 739937 - protein, 9 aa, Homo Sapiens
SSSFTEHKR

SEQ ID NO: 739938 - protein, 9 aa, Homo Sapiens
TVLVTDTND

SEQ ID NO: 739939 - protein, 9 aa, Homo Sapiens
PQKDEKLET

SEQ ID NO: 739940 - protein, 9 aa, Homo Sapiens
TPHVALVMP

SEQ ID NO: 739941 - protein, 9 aa, Homo Sapiens
ISGEFLVLD

SEQ ID NO: 739942 - protein, 9 aa, Homo Sapiens
PDYHLNSEK

SEQ ID NO: 739943 - protein, 9 aa, Homo Sapiens
LNYWTSRYW

SEQ ID NO: 739944 - protein, 9 aa, Homo Sapiens
QPEPEPEPW

SEQ ID NO: 739945 - protein, 9 aa, Homo Sapiens
SSRSMEQGK

SEQ ID NO: 739946 - protein, 9 aa, Homo Sapiens
TECCVCMER

SEQ ID NO: 739947 - protein, 9 aa, Homo Sapiens
PVLAGLFPY

SEQ ID NO: 739948 - protein, 9 aa, Homo Sapiens
KSERKTETT

SEQ ID NO: 739949 - protein, 9 aa, Homo Sapiens
VHCWRPMRS

SEQ ID NO: 739950 - protein, 9 aa, Homo Sapiens
LLNPSNSAC

SEQ ID NO: 739951 - protein, 9 aa, Homo Sapiens
SQGYAYVVD

SEQ ID NO: 739952 - protein, 9 aa, Homo Sapiens
YHDNEGDQL

SEQ ID NO: 739953 - protein, 9 aa, Homo Sapiens
VSHLHNLNE

SEQ ID NO: 739954 - protein, 9 aa, Homo Sapiens
QVKRLLKLE

SEQ ID NO: 739955 - protein, 9 aa, Homo Sapiens
GTDGRGSTF

SEQ ID NO: 739956 - protein, 9 aa, Homo Sapiens
EIERLTAKT

SEQ ID NO: 739957 - protein, 9 aa, Homo Sapiens
FKLRAFLYN

SEQ ID NO: 739958 - protein, 9 aa, Homo Sapiens
SLRQLYKDA

SEQ ID NO: 739959 - protein, 9 aa, Homo Sapiens
MLFTDEGVP

SEQ ID NO: 739960 - protein, 9 aa, Homo Sapiens
ICVSSKVSS

SEQ ID NO: 739961 - protein, 9 aa, Homo Sapiens
LPAISHSKT

SEQ ID NO: 739962 - protein, 9 aa, Homo Sapiens
GSEFQDDSV

SEQ ID NO: 739963 - protein, 9 aa, Homo Sapiens
FVSSLKRQK

SEQ ID NO: 739964 - protein, 9 aa, Homo Sapiens
KKAKSRKCS

SEQ ID NO: 739965 - protein, 9 aa, Homo Sapiens
IERLTAKTE

SEQ ID NO: 739966 - protein, 9 aa, Homo Sapiens
GYAYVVDAC

SEQ ID NO: 739967 - protein, 9 aa, Homo Sapiens
HSTSYAVNV

SEQ ID NO: 739968 - protein, 9 aa, Homo Sapiens
SKNCSQKHK

SEQ ID NO: 739969 - protein, 9 aa, Homo Sapiens
LKSEVVSPS

SEQ ID NO: 739970 - protein, 9 aa, Homo Sapiens
FILLERKDI

SEQ ID NO: 739971 - protein, 9 aa, Homo Sapiens
GKVFSWCSS

SEQ ID NO: 739972 - protein, 9 aa, Homo Sapiens
EMKNQVCSN

SEQ ID NO: 739973 - protein, 9 aa, Homo Sapiens
ITVLVTDTN

SEQ ID NO: 739974 - protein, 9 aa, Homo Sapiens
ELQEQTTTL

SEQ ID NO: 739975 - protein, 9 aa, Homo Sapiens
LSSSSVLHE

SEQ ID NO: 739976 - protein, 9 aa, Homo Sapiens
LLVATTGTV

SEQ ID NO: 739977 - protein, 9 aa, Homo Sapiens
QETTVGAIR

SEQ ID NO: 739978 - protein, 9 aa, Homo Sapiens
YQSVGGLSF

SEQ ID NO: 739979 - protein, 9 aa, Homo Sapiens
FLFATQITL

SEQ ID NO: 739980 - protein, 9 aa, Homo Sapiens
KSFLHLAQI

SEQ ID NO: 739981 - protein, 9 aa, Homo Sapiens
ASYECEKHP

SEQ ID NO: 739982 - protein, 9 aa, Homo Sapiens
NPPRGPATR

SEQ ID NO: 739983 - protein, 9 aa, Homo Sapiens
KINALAQKL

SEQ ID NO: 739984 - protein, 9 aa, Homo Sapiens
AGPWSCGMC

SEQ ID NO: 739985 - protein, 9 aa, Homo Sapiens
SYTEDALCI

SEQ ID NO: 739986 - protein, 9 aa, Homo Sapiens
VGLKKRMDK

SEQ ID NO: 739987 - protein, 9 aa, Homo Sapiens
NKQPKNIIN

SEQ ID NO: 739988 - protein, 9 aa, Homo Sapiens
ITFLTRNCC

SEQ ID NO: 739989 - protein, 9 aa, Homo Sapiens
SPWSWPDEL

SEQ ID NO: 739990 - protein, 9 aa, Homo Sapiens
CLAMYRAFG

SEQ ID NO: 739991 - protein, 9 aa, Homo Sapiens
ESKNKHVLT

SEQ ID NO: 739992 - protein, 9 aa, Homo Sapiens
DKQFYSVAI

SEQ ID NO: 739993 - protein, 9 aa, Homo Sapiens
QMVDLNPEM

SEQ ID NO: 739994 - protein, 9 aa, Homo Sapiens
AFTHSTSYA

SEQ ID NO: 739995 - protein, 9 aa, Homo Sapiens
EPWLLLEVE

SEQ ID NO: 739996 - protein, 9 aa, Homo Sapiens
CSCPLEWSG

SEQ ID NO: 739997 - protein, 9 aa, Homo Sapiens
KQYAKENGT

SEQ ID NO: 739998 - protein, 9 aa, Homo Sapiens
KENEQSKDN

SEQ ID NO: 739999 - protein, 9 aa, Homo Sapiens
SSSVLHEPP

SEQ ID NO: 740000 - protein, 9 aa, Homo Sapiens
KHVLTPLLL

SEQ ID NO: 740001 - protein, 9 aa, Homo Sapiens
YFGMLLFLF

SEQ ID NO: 740002 - protein, 9 aa, Homo Sapiens
LGLGDGSGL

SEQ ID NO: 740003 - protein, 9 aa, Homo Sapiens
ATERQEPGL

SEQ ID NO: 740004 - protein, 9 aa, Homo Sapiens
LNPVVYGVR

SEQ ID NO: 740005 - protein, 9 aa, Homo Sapiens
LPAARPHSQ

SEQ ID NO: 740006 - protein, 9 aa, Homo Sapiens
YVVLDDNQN

SEQ ID NO: 740007 - protein, 9 aa, Homo Sapiens
NKEKTILTG

SEQ ID NO: 740008 - protein, 9 aa, Homo Sapiens
AECWFHLFD

SEQ ID NO: 740009 - protein, 9 aa, Homo Sapiens
LTWLKAAVR

SEQ ID NO: 740010 - protein, 9 aa, Homo Sapiens
SQRLHIKEE

SEQ ID NO: 740011 - protein, 9 aa, Homo Sapiens
RPYQSWTTS

SEQ ID NO: 740012 - protein, 9 aa, Homo Sapiens
LELLSSAES

SEQ ID NO: 740013 - protein, 9 aa, Homo Sapiens
MKNQVCSNC

SEQ ID NO: 740014 - protein, 9 aa, Homo Sapiens
KAKSRKCSK

SEQ ID NO: 740015 - protein, 9 aa, Homo Sapiens
HALRHVAYM

SEQ ID NO: 740016 - protein, 9 aa, Homo Sapiens
AEETHVKVQ

SEQ ID NO: 740017 - protein, 9 aa, Homo Sapiens
PFQAVVIPV

SEQ ID NO: 740018 - protein, 9 aa, Homo Sapiens
VVPCTTYGW

SEQ ID NO: 740019 - protein, 9 aa, Homo Sapiens
IVGDDITEQ

SEQ ID NO: 740020 - protein, 9 aa, Homo Sapiens
HHLASGLST

SEQ ID NO: 740021 - protein, 9 aa, Homo Sapiens
CVGSVNTGR

SEQ ID NO: 740022 - protein, 9 aa, Homo Sapiens
KSRKCSKEE

SEQ ID NO: 740023 - protein, 9 aa, Homo Sapiens
EWSGKHCEL

SEQ ID NO: 740024 - protein, 9 aa, Homo Sapiens
TVGALTDEE

SEQ ID NO: 740025 - protein, 9 aa, Homo Sapiens
ARSLPAARP

SEQ ID NO: 740026 - protein, 9 aa, Homo Sapiens
LRTDERDLN

SEQ ID NO: 740027 - protein, 9 aa, Homo Sapiens
LQEADYEEA

SEQ ID NO: 740028 - protein, 9 aa, Homo Sapiens
SSTYEELAL

SEQ ID NO: 740029 - protein, 9 aa, Homo Sapiens
DCLPGYAGD

SEQ ID NO: 740030 - protein, 9 aa, Homo Sapiens
IRGSGTREL

SEQ ID NO: 740031 - protein, 9 aa, Homo Sapiens
CELGDKQYH

SEQ ID NO: 740032 - protein, 9 aa, Homo Sapiens
TEESIMDLE

SEQ ID NO: 740033 - protein, 9 aa, Homo Sapiens
SQLSTNTHH

SEQ ID NO: 740034 - protein, 9 aa, Homo Sapiens
DKKGSNYSQ

SEQ ID NO: 740035 - protein, 9 aa, Homo Sapiens
NEQSKDNEQ

SEQ ID NO: 740036 - protein, 9 aa, Homo Sapiens
LSQRLHIKE

SEQ ID NO: 740037 - protein, 9 aa, Homo Sapiens
RPGACSVPS

SEQ ID NO: 740038 - protein, 9 aa, Homo Sapiens
RLDRDSHHN

SEQ ID NO: 740039 - protein, 9 aa, Homo Sapiens
TQDTRSLKA

SEQ ID NO: 740040 - protein, 9 aa, Homo Sapiens
GNLHVVPGV

SEQ ID NO: 740041 - protein, 9 aa, Homo Sapiens
GNEKDSSKV

SEQ ID NO: 740042 - protein, 9 aa, Homo Sapiens
NFRLSLEQV

SEQ ID NO: 740043 - protein, 9 aa, Homo Sapiens
CWGPAPGVR

SEQ ID NO: 740044 - protein, 9 aa, Homo Sapiens
YTRQTCIVL

SEQ ID NO: 740045 - protein, 9 aa, Homo Sapiens
PNRTPSICL

SEQ ID NO: 740046 - protein, 9 aa, Homo Sapiens
PALNPVVYG

SEQ ID NO: 740047 - protein, 9 aa, Homo Sapiens
AVTYAAVKH

SEQ ID NO: 740048 - protein, 9 aa, Homo Sapiens
ELGSFITNY

SEQ ID NO: 740049 - protein, 9 aa, Homo Sapiens
LGDGSGLLN

SEQ ID NO: 740050 - protein, 9 aa, Homo Sapiens
QSKAGPWSC

SEQ ID NO: 740051 - protein, 9 aa, Homo Sapiens
IGCLGYNLL

SEQ ID NO: 740052 - protein, 9 aa, Homo Sapiens
LIPPALNPV

SEQ ID NO: 740053 - protein, 9 aa, Homo Sapiens
IAIYTFQFQ

SEQ ID NO: 740054 - protein, 9 aa, Homo Sapiens
HFICIDCGK

SEQ ID NO: 740055 - protein, 9 aa, Homo Sapiens
ESMDFLDKG

SEQ ID NO: 740056 - protein, 9 aa, Homo Sapiens
LELVSHLHN

SEQ ID NO: 740057 - protein, 9 aa, Homo Sapiens
RSLSSPICF

SEQ ID NO: 740058 - protein, 9 aa, Homo Sapiens
HPTYTAFFS

SEQ ID NO: 740059 - protein, 9 aa, Homo Sapiens
LARSPSTDS

SEQ ID NO: 740060 - protein, 9 aa, Homo Sapiens
NEGDQLAAL

SEQ ID NO: 740061 - protein, 9 aa, Homo Sapiens
RNCCLTELY

SEQ ID NO: 740062 - protein, 9 aa, Homo Sapiens
ELREDPSAR

SEQ ID NO: 740063 - protein, 9 aa, Homo Sapiens
MRSTFKSYD

SEQ ID NO: 740064 - protein, 9 aa, Homo Sapiens
SFCGSREID

SEQ ID NO: 740065 - protein, 9 aa, Homo Sapiens
TDTNDHSPV

SEQ ID NO: 740066 - protein, 9 aa, Homo Sapiens
DHPGYSYGD

SEQ ID NO: 740067 - protein, 9 aa, Homo Sapiens
PLSSSSVLH

SEQ ID NO: 740068 - protein, 9 aa, Homo Sapiens
YIYLTVRNP

SEQ ID NO: 740069 - protein, 9 aa, Homo Sapiens
PEPEPWLLL

SEQ ID NO: 740070 - protein, 9 aa, Homo Sapiens
ALAYEHAKL

SEQ ID NO: 740071 - protein, 9 aa, Homo Sapiens
HIEGKHFIC

SEQ ID NO: 740072 - protein, 9 aa, Homo Sapiens
RLKINALAQ

SEQ ID NO: 740073 - protein, 9 aa, Homo Sapiens
IKQSQHMTE

SEQ ID NO: 740074 - protein, 9 aa, Homo Sapiens
FRHPERPGG

SEQ ID NO: 740075 - protein, 9 aa, Homo Sapiens
SCPLEWSGK

SEQ ID NO: 740076 - protein, 9 aa, Homo Sapiens
GACSVPSAP

SEQ ID NO: 740077 - protein, 9 aa, Homo Sapiens
EEDKNIVGD

SEQ ID NO: 740078 - protein, 9 aa, Homo Sapiens
PRQTLEVFN

SEQ ID NO: 740079 - protein, 9 aa, Homo Sapiens
RGQLLKTES

SEQ ID NO: 740080 - protein, 9 aa, Homo Sapiens
PLEWSGKHC

SEQ ID NO: 740081 - protein, 9 aa, Homo Sapiens
KIPNFSTLL

SEQ ID NO: 740082 - protein, 9 aa, Homo Sapiens
EKDSSKVPQ

SEQ ID NO: 740083 - protein, 9 aa, Homo Sapiens
MVDLMSSVI

SEQ ID NO: 740084 - protein, 9 aa, Homo Sapiens
TSEGKNRAF

SEQ ID NO: 740085 - protein, 9 aa, Homo Sapiens
PYQSWTTSP

SEQ ID NO: 740086 - protein, 9 aa, Homo Sapiens
QTLEVFNLL

SEQ ID NO: 740087 - protein, 9 aa, Homo Sapiens
TEEFRQKSL

SEQ ID NO: 740088 - protein, 9 aa, Homo Sapiens
WERRTQVQV

SEQ ID NO: 740089 - protein, 9 aa, Homo Sapiens
NIVGDDITE

SEQ ID NO: 740090 - protein, 9 aa, Homo Sapiens
LDGPNTNTC

SEQ ID NO: 740091 - protein, 9 aa, Homo Sapiens
AVLVHIDDL

SEQ ID NO: 740092 - protein, 9 aa, Homo Sapiens
SEPVIWEVL

SEQ ID NO: 740093 - protein, 9 aa, Homo Sapiens
AAVLVHIDD

SEQ ID NO: 740094 - protein, 9 aa, Homo Sapiens
TRNCCLTEL

SEQ ID NO: 740095 - protein, 9 aa, Homo Sapiens
RPVLAGLFP

SEQ ID NO: 740096 - protein, 9 aa, Homo Sapiens
STSYAVNVE

SEQ ID NO: 740097 - protein, 9 aa, Homo Sapiens
TGKEISKSI

SEQ ID NO: 740098 - protein, 9 aa, Homo Sapiens
LEKERTCTE

SEQ ID NO: 740099 - protein, 9 aa, Homo Sapiens
SSKVSSAQH

SEQ ID NO: 740100 - protein, 9 aa, Homo Sapiens
LLNNRLVGL

SEQ ID NO: 740101 - protein, 9 aa, Homo Sapiens
LYVVLDDNQ

SEQ ID NO: 740102 - protein, 9 aa, Homo Sapiens
RRPVLAGLF

SEQ ID NO: 740103 - protein, 9 aa, Homo Sapiens
VKYCDDFLG

SEQ ID NO: 740104 - protein, 9 aa, Homo Sapiens
AMAIKQSQH

SEQ ID NO: 740105 - protein, 9 aa, Homo Sapiens
TDGRECVGS

SEQ ID NO: 740106 - protein, 9 aa, Homo Sapiens
AMKLPVLEN

SEQ ID NO: 740107 - protein, 9 aa, Homo Sapiens
DLKLTEESI

SEQ ID NO: 740108 - protein, 9 aa, Homo Sapiens
VRELPEKSK

SEQ ID NO: 740109 - protein, 9 aa, Homo Sapiens
NMNSTGCQL

SEQ ID NO: 740110 - protein, 9 aa, Homo Sapiens
YTECCVCME

SEQ ID NO: 740111 - protein, 9 aa, Homo Sapiens
LGSPDNFRL

SEQ ID NO: 740112 - protein, 9 aa, Homo Sapiens
SLPSIKGVS

SEQ ID NO: 740113 - protein, 9 aa, Homo Sapiens
SCDCLPGYA

SEQ ID NO: 740114 - protein, 9 aa, Homo Sapiens
LKLTEESIM

SEQ ID NO: 740115 - protein, 9 aa, Homo Sapiens
VLVTDTNDH

SEQ ID NO: 740116 - protein, 9 aa, Homo Sapiens
GSPDNFRLS

SEQ ID NO: 740117 - protein, 9 aa, Homo Sapiens
QTPRRRCWG

SEQ ID NO: 740118 - protein, 9 aa, Homo Sapiens
VDTGSWFCA

SEQ ID NO: 740119 - protein, 9 aa, Homo Sapiens
SMSCNTPLV

SEQ ID NO: 740120 - protein, 9 aa, Homo Sapiens
HQVVMWRMK

SEQ ID NO: 740121 - protein, 9 aa, Homo Sapiens
ECVGSVNTG

SEQ ID NO: 740122 - protein, 9 aa, Homo Sapiens
DEKLETEKA

SEQ ID NO: 740123 - protein, 9 aa, Homo Sapiens
GYPFRHPER

SEQ ID NO: 740124 - protein, 9 aa, Homo Sapiens
INQQLDTNQ

SEQ ID NO: 740125 - protein, 9 aa, Homo Sapiens
TTVGAIRDH

SEQ ID NO: 740126 - protein, 9 aa, Homo Sapiens
INRRGGYHG

SEQ ID NO: 740127 - protein, 9 aa, Homo Sapiens
APKMTWMKV

SEQ ID NO: 740128 - protein, 9 aa, Homo Sapiens
DGSEFQDDS

SEQ ID NO: 740129 - protein, 9 aa, Homo Sapiens
LGIKTVLTM

SEQ ID NO: 740130 - protein, 9 aa, Homo Sapiens
VPEQVKRLL

SEQ ID NO: 740131 - protein, 9 aa, Homo Sapiens
SYHCSCPLE

SEQ ID NO: 740132 - protein, 9 aa, Homo Sapiens
FTYTGLGKI

SEQ ID NO: 740133 - protein, 9 aa, Homo Sapiens
TLTEDDDIT

SEQ ID NO: 740134 - protein, 9 aa, Homo Sapiens
LLYHDNEGD

SEQ ID NO: 740135 - protein, 9 aa, Homo Sapiens
KHKKDSKNS

SEQ ID NO: 740136 - protein, 9 aa, Homo Sapiens
KERTCTEQI

SEQ ID NO: 740137 - protein, 9 aa, Homo Sapiens
VLLWRLLAW

SEQ ID NO: 740138 - protein, 9 aa, Homo Sapiens
RGSTFPRRI

SEQ ID NO: 740139 - protein, 9 aa, Homo Sapiens
RGPATRGRA

SEQ ID NO: 740140 - protein, 9 aa, Homo Sapiens
DDGGYSMNS

SEQ ID NO: 740141 - protein, 9 aa, Homo Sapiens
PRRRCWGPA

SEQ ID NO: 740142 - protein, 9 aa, Homo Sapiens
SRKCSKEES

SEQ ID NO: 740143 - protein, 9 aa, Homo Sapiens
DYVNRGLYW

SEQ ID NO: 740144 - protein, 9 aa, Homo Sapiens
SKAGPWSCG

SEQ ID NO: 740145 - protein, 9 aa, Homo Sapiens
TTAEFQVPR

SEQ ID NO: 740146 - protein, 9 aa, Homo Sapiens
FWSFVILLS

SEQ ID NO: 740147 - protein, 9 aa, Homo Sapiens
PVSWKKLQL

SEQ ID NO: 740148 - protein, 9 aa, Homo Sapiens
LHVVPGVER

SEQ ID NO: 740149 - protein, 9 aa, Homo Sapiens
YSMNSNMSS

SEQ ID NO: 740150 - protein, 9 aa, Homo Sapiens
AAALPGPRY

SEQ ID NO: 740151 - protein, 9 aa, Homo Sapiens
SYAVNVETH

SEQ ID NO: 740152 - protein, 9 aa, Homo Sapiens
GITANCCHL

SEQ ID NO: 740153 - protein, 9 aa, Homo Sapiens
RLTAKTEEF

SEQ ID NO: 740154 - protein, 9 aa, Homo Sapiens
ILLAPWAIR

SEQ ID NO: 740155 - protein, 9 aa, Homo Sapiens
GSMLFTDEG

SEQ ID NO: 740156 - protein, 9 aa, Homo Sapiens
LWSKASEEE

SEQ ID NO: 740157 - protein, 9 aa, Homo Sapiens
KLYNAENKI

SEQ ID NO: 740158 - protein, 9 aa, Homo Sapiens
GSVNTGRSC

SEQ ID NO: 740159 - protein, 9 aa, Homo Sapiens
MLLFLFATQ

SEQ ID NO: 740160 - protein, 9 aa, Homo Sapiens
RKTETTMQV

SEQ ID NO: 740161 - protein, 9 aa, Homo Sapiens
KQFYSVAIL

SEQ ID NO: 740162 - protein, 9 aa, Homo Sapiens
TGSWFCAGN

SEQ ID NO: 740163 - protein, 9 aa, Homo Sapiens
DHFFCEFPS

SEQ ID NO: 740164 - protein, 9 aa, Homo Sapiens
WRPMRSTFK

SEQ ID NO: 740165 - protein, 9 aa, Homo Sapiens
LQSYTRQTC

SEQ ID NO: 740166 - protein, 9 aa, Homo Sapiens
ENLTPEEFK

SEQ ID NO: 740167 - protein, 9 aa, Homo Sapiens
PKSQGYAYV

SEQ ID NO: 740168 - protein, 9 aa, Homo Sapiens
SRSMEQGKV

SEQ ID NO: 740169 - protein, 9 aa, Homo Sapiens
SASAACHCM

SEQ ID NO: 740170 - protein, 9 aa, Homo Sapiens
HGGSTFSCD

SEQ ID NO: 740171 - protein, 9 aa, Homo Sapiens
PNMNSTGCQ

SEQ ID NO: 740172 - protein, 9 aa, Homo Sapiens
DYEEASYGL

SEQ ID NO: 740173 - protein, 9 aa, Homo Sapiens
DTRSLKAQL

SEQ ID NO: 740174 - protein, 9 aa, Homo Sapiens
SMLFTDEGV

SEQ ID NO: 740175 - protein, 9 aa, Homo Sapiens
TSYAVNVET

SEQ ID NO: 740176 - protein, 9 aa, Homo Sapiens
RGLYWADEN

SEQ ID NO: 740177 - protein, 9 aa, Homo Sapiens
SIYNKQPKN

SEQ ID NO: 740178 - protein, 9 aa, Homo Sapiens
SFTEHKRIH

SEQ ID NO: 740179 - protein, 9 aa, Homo Sapiens
VVICGCYIY

SEQ ID NO: 740180 - protein, 9 aa, Homo Sapiens
EKKAKSRKC

SEQ ID NO: 740181 - protein, 9 aa, Homo Sapiens
TKEYRLKIN

SEQ ID NO: 740182 - protein, 9 aa, Homo Sapiens
ECGKVFSWC

SEQ ID NO: 740183 - protein, 9 aa, Homo Sapiens
SHPTYTAFF

SEQ ID NO: 740184 - protein, 9 aa, Homo Sapiens
TTAASPPCP

SEQ ID NO: 740185 - protein, 9 aa, Homo Sapiens
ALRLRAHKE

SEQ ID NO: 740186 - protein, 9 aa, Homo Sapiens
SHHSQPERL

SEQ ID NO: 740187 - protein, 9 aa, Homo Sapiens
PSPAGERGP

SEQ ID NO: 740188 - protein, 9 aa, Homo Sapiens
GPSIYNKQP

SEQ ID NO: 740189 - protein, 9 aa, Homo Sapiens
GYNLLLMVT

SEQ ID NO: 740190 - protein, 9 aa, Homo Sapiens
PAISHSKTS

SEQ ID NO: 740191 - protein, 9 aa, Homo Sapiens
PARSLPAAR

SEQ ID NO: 740192 - protein, 9 aa, Homo Sapiens
LKENGYPFR

SEQ ID NO: 740193 - protein, 9 aa, Homo Sapiens
FLDYHRCLN

SEQ ID NO: 740194 - protein, 9 aa, Homo Sapiens
HSKTSRPKM

SEQ ID NO: 740195 - protein, 9 aa, Homo Sapiens
RMQVKPNAT

SEQ ID NO: 740196 - protein, 9 aa, Homo Sapiens
SPICFGPQP

SEQ ID NO: 740197 - protein, 9 aa, Homo Sapiens
KQVQLEGDE

SEQ ID NO: 740198 - protein, 9 aa, Homo Sapiens
AGGWYQSVG

SEQ ID NO: 740199 - protein, 9 aa, Homo Sapiens
LLGVFATGP

SEQ ID NO: 740200 - protein, 9 aa, Homo Sapiens
IVSIFYTVV

SEQ ID NO: 740201 - protein, 9 aa, Homo Sapiens
EEWERRTQV

SEQ ID NO: 740202 - protein, 9 aa, Homo Sapiens
RAHKECWDR

SEQ ID NO: 740203 - protein, 9 aa, Homo Sapiens
CPLEWSGKH

SEQ ID NO: 740204 - protein, 9 aa, Homo Sapiens
TRSLKAQLS

SEQ ID NO: 740205 - protein, 9 aa, Homo Sapiens
KYAADILSN

SEQ ID NO: 740206 - protein, 9 aa, Homo Sapiens
GSGTRELEL

SEQ ID NO: 740207 - protein, 9 aa, Homo Sapiens
MNSNMSSSR

SEQ ID NO: 740208 - protein, 9 aa, Homo Sapiens
PLWLSPFQA

SEQ ID NO: 740209 - protein, 9 aa, Homo Sapiens
THEVRYVST

SEQ ID NO: 740210 - protein, 9 aa, Homo Sapiens
SSNAKHVMS

SEQ ID NO: 740211 - protein, 9 aa, Homo Sapiens
TLASYECEK

SEQ ID NO: 740212 - protein, 9 aa, Homo Sapiens
DILSNIRFG

SEQ ID NO: 740213 - protein, 9 aa, Homo Sapiens
LLSEKLYNA

SEQ ID NO: 740214 - protein, 9 aa, Homo Sapiens
TYTGLGKIL

SEQ ID NO: 740215 - protein, 9 aa, Homo Sapiens
KNQVCSNCG

SEQ ID NO: 740216 - protein, 9 aa, Homo Sapiens
PAARPHSQN

SEQ ID NO: 740217 - protein, 9 aa, Homo Sapiens
TNTCVCTEG

SEQ ID NO: 740218 - protein, 9 aa, Homo Sapiens
CTLDALLAG

SEQ ID NO: 740219 - protein, 9 aa, Homo Sapiens
NGTENINRR

SEQ ID NO: 740220 - protein, 9 aa, Homo Sapiens
GTLARSPST

SEQ ID NO: 740221 - protein, 9 aa, Homo Sapiens
SPPCPRPHG

SEQ ID NO: 740222 - protein, 9 aa, Homo Sapiens
KYSSRSMEQ

SEQ ID NO: 740223 - protein, 9 aa, Homo Sapiens
GRSLSSPIC

SEQ ID NO: 740224 - protein, 9 aa, Homo Sapiens
NRTPSICLA

SEQ ID NO: 740225 - protein, 9 aa, Homo Sapiens
PARVSLGIK

SEQ ID NO: 740226 - protein, 9 aa, Homo Sapiens
RECVGSVNT

SEQ ID NO: 740227 - protein, 9 aa, Homo Sapiens
KAAVRELPE

SEQ ID NO: 740228 - protein, 9 aa, Homo Sapiens
KVQPSTEET

SEQ ID NO: 740229 - protein, 9 aa, Homo Sapiens
LVLLWRLLA

SEQ ID NO: 740230 - protein, 9 aa, Homo Sapiens
GWYQSVGGL

SEQ ID NO: 740231 - protein, 9 aa, Homo Sapiens
HMKTLASYE

SEQ ID NO: 740232 - protein, 9 aa, Homo Sapiens
VALVMPLDR

SEQ ID NO: 740233 - protein, 9 aa, Homo Sapiens
QVQPVSWKK

SEQ ID NO: 740234 - protein, 9 aa, Homo Sapiens
ERKTETTMQ

SEQ ID NO: 740235 - protein, 9 aa, Homo Sapiens
GEEEANGGK

SEQ ID NO: 740236 - protein, 9 aa, Homo Sapiens
ERKDIRQVG

SEQ ID NO: 740237 - protein, 9 aa, Homo Sapiens
YRLKINALA

SEQ ID NO: 740238 - protein, 9 aa, Homo Sapiens
DKGTASPAS

SEQ ID NO: 740239 - protein, 9 aa, Homo Sapiens
IIVSIFYTV

SEQ ID NO: 740240 - protein, 9 aa, Homo Sapiens
KAFSWSSSF

SEQ ID NO: 740241 - protein, 9 aa, Homo Sapiens
EIQMSSRTF

SEQ ID NO: 740242 - protein, 9 aa, Homo Sapiens
GDGSGLLNN

SEQ ID NO: 740243 - protein, 9 aa, Homo Sapiens
HRGQLLKTE

SEQ ID NO: 740244 - protein, 9 aa, Homo Sapiens
GPWSCGMCL

SEQ ID NO: 740245 - protein, 9 aa, Homo Sapiens
TPRRRCWGP

SEQ ID NO: 740246 - protein, 9 aa, Homo Sapiens
RRRCWGPAP

SEQ ID NO: 740247 - protein, 9 aa, Homo Sapiens
ACGYTKCGA

SEQ ID NO: 740248 - protein, 9 aa, Homo Sapiens
KDIRQVGVC

SEQ ID NO: 740249 - protein, 9 aa, Homo Sapiens
YFFTHYDTS

SEQ ID NO: 740250 - protein, 9 aa, Homo Sapiens
DLNNNVEAV

SEQ ID NO: 740251 - protein, 9 aa, Homo Sapiens
WPDELEPVV

SEQ ID NO: 740252 - protein, 9 aa, Homo Sapiens
MAAGMVPGR

SEQ ID NO: 740253 - protein, 9 aa, Homo Sapiens
DSLREVDGD

SEQ ID NO: 740254 - protein, 9 aa, Homo Sapiens
HRCLNTRTR

SEQ ID NO: 740255 - protein, 9 aa, Homo Sapiens
TVFLRVCGA

SEQ ID NO: 740256 - protein, 9 aa, Homo Sapiens
TLEKERTCT

SEQ ID NO: 740257 - protein, 9 aa, Homo Sapiens
TFSCDCLPG

SEQ ID NO: 740258 - protein, 9 aa, Homo Sapiens
GHTLPQSKL

SEQ ID NO: 740259 - protein, 9 aa, Homo Sapiens
QSSQTRSHC

SEQ ID NO: 740260 - protein, 9 aa, Homo Sapiens
RTCTEQIVA

SEQ ID NO: 740261 - protein, 9 aa, Homo Sapiens
NTCVCTEGY

SEQ ID NO: 740262 - protein, 9 aa, Homo Sapiens
VAVSAECWF

SEQ ID NO: 740263 - protein, 9 aa, Homo Sapiens
QSPAGPRHQ

SEQ ID NO: 740264 - protein, 9 aa, Homo Sapiens
KGSNYSQSE

SEQ ID NO: 740265 - protein, 9 aa, Homo Sapiens
TDSIQKDPR

SEQ ID NO: 740266 - protein, 9 aa, Homo Sapiens
SPFQAVVIP

SEQ ID NO: 740267 - protein, 9 aa, Homo Sapiens
SLGIKTVLT

SEQ ID NO: 740268 - protein, 9 aa, Homo Sapiens
GTLLGVFAT

SEQ ID NO: 740269 - protein, 9 aa, Homo Sapiens
VSSLKRQKS

SEQ ID NO: 740270 - protein, 9 aa, Homo Sapiens
TAEFQVPRL

SEQ ID NO: 740271 - protein, 9 aa, Homo Sapiens
PSVYLELTD

SEQ ID NO: 740272 - protein, 9 aa, Homo Sapiens
HCSCPLEWS

SEQ ID NO: 740273 - protein, 9 aa, Homo Sapiens
PWAIRTRYL

SEQ ID NO: 740274 - protein, 9 aa, Homo Sapiens
LFILLERKD

SEQ ID NO: 740275 - protein, 9 aa, Homo Sapiens
DPMDMPCTT

SEQ ID NO: 740276 - protein, 9 aa, Homo Sapiens
NYFQNQLLA

SEQ ID NO: 740277 - protein, 9 aa, Homo Sapiens
CGKVFSWCS

SEQ ID NO: 740278 - protein, 9 aa, Homo Sapiens
PMDMPCTTI

SEQ ID NO: 740279 - protein, 9 aa, Homo Sapiens
VHKSAVNMD

SEQ ID NO: 740280 - protein, 9 aa, Homo Sapiens
FLDKGTASP

SEQ ID NO: 740281 - protein, 9 aa, Homo Sapiens
PPRIRGSGT

SEQ ID NO: 740282 - protein, 9 aa, Homo Sapiens
LMSSVICEG

SEQ ID NO: 740283 - protein, 9 aa, Homo Sapiens
PGSGPPGSQ

SEQ ID NO: 740284 - protein, 9 aa, Homo Sapiens
QNCPKSQGY

SEQ ID NO: 740285 - protein, 9 aa, Homo Sapiens
GPVRALLTL

SEQ ID NO: 740286 - protein, 9 aa, Homo Sapiens
ITANCCHLW

SEQ ID NO: 740287 - protein, 9 aa, Homo Sapiens
TDGRGSTFP

SEQ ID NO: 740288 - protein, 9 aa, Homo Sapiens
IDDLRWEGV

SEQ ID NO: 740289 - protein, 9 aa, Homo Sapiens
SLKRQKSFL

SEQ ID NO: 740290 - protein, 9 aa, Homo Sapiens
YHRCLNTRT

SEQ ID NO: 740291 - protein, 9 aa, Homo Sapiens
DIESKNKHV

SEQ ID NO: 740292 - protein, 9 aa, Homo Sapiens
RCWGPAPGV

SEQ ID NO: 740293 - protein, 9 aa, Homo Sapiens
AQVGLKKRM

SEQ ID NO: 740294 - protein, 9 aa, Homo Sapiens
GRAAGRLSP

SEQ ID NO: 740295 - protein, 9 aa, Homo Sapiens
LTQENICLL

SEQ ID NO: 740296 - protein, 9 aa, Homo Sapiens
SVLHEPPAK

SEQ ID NO: 740297 - protein, 9 aa, Homo Sapiens
TDERDLNYW

SEQ ID NO: 740298 - protein, 9 aa, Homo Sapiens
ACHCMQSSQ

SEQ ID NO: 740299 - protein, 9 aa, Homo Sapiens
NSVDDLNNN

SEQ ID NO: 740300 - protein, 9 aa, Homo Sapiens
CMERPGACS

SEQ ID NO: 740301 - protein, 9 aa, Homo Sapiens
TRVRAMAIK

SEQ ID NO: 740302 - protein, 9 aa, Homo Sapiens
KLDVPEQVK

SEQ ID NO: 740303 - protein, 9 aa, Homo Sapiens
EEERPNEIQ

SEQ ID NO: 740304 - protein, 9 aa, Homo Sapiens
FNLLRKHRE

SEQ ID NO: 740305 - protein, 9 aa, Homo Sapiens
EPVIWEVLR

SEQ ID NO: 740306 - protein, 9 aa, Homo Sapiens
HPGYSYGDL

SEQ ID NO: 740307 - protein, 9 aa, Homo Sapiens
SSVLHEPPA

SEQ ID NO: 740308 - protein, 9 aa, Homo Sapiens
VSSRAGNVQ

SEQ ID NO: 740309 - protein, 9 aa, Homo Sapiens
NQVCSNCGE

SEQ ID NO: 740310 - protein, 9 aa, Homo Sapiens
EADYEEASY

SEQ ID NO: 740311 - protein, 9 aa, Homo Sapiens
AGGVDTGSW

SEQ ID NO: 740312 - protein, 9 aa, Homo Sapiens
LLSSAESPV

SEQ ID NO: 740313 - protein, 9 aa, Homo Sapiens
LAVASYPAS

SEQ ID NO: 740314 - protein, 9 aa, Homo Sapiens
EKLYNAENK

SEQ ID NO: 740315 - protein, 9 aa, Homo Sapiens
GKNRAFQTC

SEQ ID NO: 740316 - protein, 9 aa, Homo Sapiens
SMNSNMSSS

SEQ ID NO: 740317 - protein, 9 aa, Homo Sapiens
THVKVQPST

SEQ ID NO: 740318 - protein, 9 aa, Homo Sapiens
QEEDKNIVG

SEQ ID NO: 740319 - protein, 9 aa, Homo Sapiens
LYLVSDVFY

SEQ ID NO: 740320 - protein, 9 aa, Homo Sapiens
PCTTYGWRT

SEQ ID NO: 740321 - protein, 9 aa, Homo Sapiens
RSPSSNAKH

SEQ ID NO: 740322 - protein, 9 aa, Homo Sapiens
STNTHHLAS

SEQ ID NO: 740323 - protein, 9 aa, Homo Sapiens
SSLKRQKSF

SEQ ID NO: 740324 - protein, 9 aa, Homo Sapiens
RDGNKLAGT

SEQ ID NO: 740325 - protein, 9 aa, Homo Sapiens
TNTHHLASG

SEQ ID NO: 740326 - protein, 9 aa, Homo Sapiens
QSPVKTPIH

SEQ ID NO: 740327 - protein, 9 aa, Homo Sapiens
DGNKLAGTD

SEQ ID NO: 740328 - protein, 9 aa, Homo Sapiens
KLAGTDGRG

SEQ ID NO: 740329 - protein, 9 aa, Homo Sapiens
GGLSPDTRD

SEQ ID NO: 740330 - protein, 9 aa, Homo Sapiens
YVNRGLYWA

SEQ ID NO: 740331 - protein, 9 aa, Homo Sapiens
RLHIKEEDM

SEQ ID NO: 740332 - protein, 9 aa, Homo Sapiens
NTHHLASGL

SEQ ID NO: 740333 - protein, 9 aa, Homo Sapiens
KIITLSHLE

SEQ ID NO: 740334 - protein, 9 aa, Homo Sapiens
CVSSKVSSA

SEQ ID NO: 740335 - protein, 9 aa, Homo Sapiens
SQSEALCVL

SEQ ID NO: 740336 - protein, 9 aa, Homo Sapiens
LLKSERKTE

SEQ ID NO: 740337 - protein, 9 aa, Homo Sapiens
IANNNIQDH

SEQ ID NO: 740338 - protein, 9 aa, Homo Sapiens
QPERLDRDS

SEQ ID NO: 740339 - protein, 9 aa, Homo Sapiens
DCDKCWKSF

SEQ ID NO: 740340 - protein, 9 aa, Homo Sapiens
VFWSFVILL

SEQ ID NO: 740341 - protein, 9 aa, Homo Sapiens
LAPWAIRTR

SEQ ID NO: 740342 - protein, 9 aa, Homo Sapiens
EFGDEFVQR

SEQ ID NO: 740343 - protein, 9 aa, Homo Sapiens
FYTVVIPKL

SEQ ID NO: 740344 - protein, 9 aa, Homo Sapiens
PRLNPKALA

SEQ ID NO: 740345 - protein, 9 aa, Homo Sapiens
KEKTILTGD

SEQ ID NO: 740346 - protein, 9 aa, Homo Sapiens
FNHALRHVA

SEQ ID NO: 740347 - protein, 9 aa, Homo Sapiens
AAAALPGPR

SEQ ID NO: 740348 - protein, 9 aa, Homo Sapiens
HIKEEDMRL

SEQ ID NO: 740349 - protein, 9 aa, Homo Sapiens
LCIDGTIEV

SEQ ID NO: 740350 - protein, 9 aa, Homo Sapiens
LEGDLKLTE

SEQ ID NO: 740351 - protein, 9 aa, Homo Sapiens
MVDLNPEMS

SEQ ID NO: 740352 - protein, 9 aa, Homo Sapiens
SVTKLAKQY

SEQ ID NO: 740353 - protein, 9 aa, Homo Sapiens
THIEGKHFI

SEQ ID NO: 740354 - protein, 9 aa, Homo Sapiens
EKCTLDALL

SEQ ID NO: 740355 - protein, 9 aa, Homo Sapiens
PWPRLNPKA

SEQ ID NO: 740356 - protein, 9 aa, Homo Sapiens
MQSSQTRSH

SEQ ID NO: 740357 - protein, 9 aa, Homo Sapiens
EKLETEKAQ

SEQ ID NO: 740358 - protein, 9 aa, Homo Sapiens
EAAGGVDTG

SEQ ID NO: 740359 - protein, 9 aa, Homo Sapiens
LHIKEEDMR

SEQ ID NO: 740360 - protein, 9 aa, Homo Sapiens
SVVSILTSV

SEQ ID NO: 740361 - protein, 9 aa, Homo Sapiens
VSPSYLLVR

SEQ ID NO: 740362 - protein, 9 aa, Homo Sapiens
GTENINRRG

SEQ ID NO: 740363 - protein, 9 aa, Homo Sapiens
EGKNRAFQT

SEQ ID NO: 740364 - protein, 9 aa, Homo Sapiens
WRLLAWDLD

SEQ ID NO: 740365 - protein, 9 aa, Homo Sapiens
ENPPRGPAT

SEQ ID NO: 740366 - protein, 9 aa, Homo Sapiens
AALPGPRYA

SEQ ID NO: 740367 - protein, 9 aa, Homo Sapiens
QDDSVLQVL

SEQ ID NO: 740368 - protein, 9 aa, Homo Sapiens
LRQLYKDAN

SEQ ID NO: 740369 - protein, 9 aa, Homo Sapiens
HSQPERLDR

SEQ ID NO: 740370 - protein, 9 aa, Homo Sapiens
KDNEQSPRV

SEQ ID NO: 740371 - protein, 9 aa, Homo Sapiens
AVASYPASM

SEQ ID NO: 740372 - protein, 9 aa, Homo Sapiens
LKINALAQK

SEQ ID NO: 740373 - protein, 9 aa, Homo Sapiens
SDVFYNSSA

SEQ ID NO: 740374 - protein, 9 aa, Homo Sapiens
ENICLLSNK

SEQ ID NO: 740375 - protein, 9 aa, Homo Sapiens
AFLYNKYVV

SEQ ID NO: 740376 - protein, 9 aa, Homo Sapiens
KQPLLYHDN

SEQ ID NO: 740377 - protein, 9 aa, Homo Sapiens
QEDAEAPKA

SEQ ID NO: 740378 - protein, 9 aa, Homo Sapiens
EICVSSKVS

SEQ ID NO: 740379 - protein, 9 aa, Homo Sapiens
LLLVATTGT

SEQ ID NO: 740380 - protein, 9 aa, Homo Sapiens
FSDTKIITL

SEQ ID NO: 740381 - protein, 9 aa, Homo Sapiens
EGDEYAKHI

SEQ ID NO: 740382 - protein, 9 aa, Homo Sapiens
DEIQMSSRT

SEQ ID NO: 740383 - protein, 9 aa, Homo Sapiens
IFYTVVIPK

SEQ ID NO: 740384 - protein, 9 aa, Homo Sapiens
SLQEADYEE

SEQ ID NO: 740385 - protein, 9 aa, Homo Sapiens
AAGGVDTGS

SEQ ID NO: 740386 - protein, 9 aa, Homo Sapiens
LGSFITNYF

SEQ ID NO: 740387 - protein, 9 aa, Homo Sapiens
GPGPGSGPP

SEQ ID NO: 740388 - protein, 9 aa, Homo Sapiens
EPGSPWSWP

SEQ ID NO: 740389 - protein, 9 aa, Homo Sapiens
TTSPITVPG

SEQ ID NO: 740390 - protein, 9 aa, Homo Sapiens
YEFSSNSCS

SEQ ID NO: 740391 - protein, 9 aa, Homo Sapiens
LWLSPFQAV

SEQ ID NO: 740392 - protein, 9 aa, Homo Sapiens
HQQKIPNFS

SEQ ID NO: 740393 - protein, 9 aa, Homo Sapiens
ASEPVIWEV

SEQ ID NO: 740394 - protein, 9 aa, Homo Sapiens
SPSGSMLFT

SEQ ID NO: 740395 - protein, 9 aa, Homo Sapiens
RINQQLDTN

SEQ ID NO: 740396 - protein, 9 aa, Homo Sapiens
SPAGERGPI

SEQ ID NO: 740397 - protein, 9 aa, Homo Sapiens
MAIKQSQHM

SEQ ID NO: 740398 - protein, 9 aa, Homo Sapiens
GTASPASTK

SEQ ID NO: 740399 - protein, 9 aa, Homo Sapiens
LATRDFENK

SEQ ID NO: 740400 - protein, 9 aa, Homo Sapiens
VKYAADILS

SEQ ID NO: 740401 - protein, 9 aa, Homo Sapiens
LDVPEQVKR

SEQ ID NO: 740402 - protein, 9 aa, Homo Sapiens
KLAKQYAKE

SEQ ID NO: 740403 - protein, 9 aa, Homo Sapiens
ARFLATERQ

SEQ ID NO: 740404 - protein, 9 aa, Homo Sapiens
VGDDITEQK

SEQ ID NO: 740405 - protein, 9 aa, Homo Sapiens
LGYNLLLMV

SEQ ID NO: 740406 - protein, 9 aa, Homo Sapiens
LNPSNSACL

SEQ ID NO: 740407 - protein, 9 aa, Homo Sapiens
ENEQSKDNE

SEQ ID NO: 740408 - protein, 9 aa, Homo Sapiens
PVIWEVLRK

SEQ ID NO: 740409 - protein, 9 aa, Homo Sapiens
PCPRPHGER

SEQ ID NO: 740410 - protein, 9 aa, Homo Sapiens
YLVSDVFYN

SEQ ID NO: 740411 - protein, 9 aa, Homo Sapiens
FQDPINADS

SEQ ID NO: 740412 - protein, 9 aa, Homo Sapiens
YSNVLPVGL

SEQ ID NO: 740413 - protein, 9 aa, Homo Sapiens
EKERTCTEQ

SEQ ID NO: 740414 - protein, 9 aa, Homo Sapiens
YRADLDPMD

SEQ ID NO: 740415 - protein, 9 aa, Homo Sapiens
GRPMRLQLC

SEQ ID NO: 740416 - protein, 9 aa, Homo Sapiens
LRVCGAVRK

SEQ ID NO: 740417 - protein, 9 aa, Homo Sapiens
SPRHKTRPA

SEQ ID NO: 740418 - protein, 9 aa, Homo Sapiens
MNGNKASEP

SEQ ID NO: 740419 - protein, 9 aa, Homo Sapiens
SHLHNLNEI

SEQ ID NO: 740420 - protein, 9 aa, Homo Sapiens
TEQIVAKIE

SEQ ID NO: 740421 - protein, 9 aa, Homo Sapiens
MLVLIAIYT

SEQ ID NO: 740422 - protein, 9 aa, Homo Sapiens
QPGRDGRDG

SEQ ID NO: 740423 - protein, 9 aa, Homo Sapiens
AGEEEANGG

SEQ ID NO: 740424 - protein, 9 aa, Homo Sapiens
TSPITVPGP

SEQ ID NO: 740425 - protein, 9 aa, Homo Sapiens
MTDKQFYSV

SEQ ID NO: 740426 - protein, 9 aa, Homo Sapiens
KTTAEFQVP

SEQ ID NO: 740427 - protein, 9 aa, Homo Sapiens
EASYGLQHN

SEQ ID NO: 740428 - protein, 9 aa, Homo Sapiens
PDTTLTPVP

SEQ ID NO: 740429 - protein, 9 aa, Homo Sapiens
KRQKSFLHL

SEQ ID NO: 740430 - protein, 9 aa, Homo Sapiens
SLSSITFYS

SEQ ID NO: 740431 - protein, 9 aa, Homo Sapiens
HDNEGDQLA

SEQ ID NO: 740432 - protein, 9 aa, Homo Sapiens
IRTSEGKNR

SEQ ID NO: 740433 - protein, 9 aa, Homo Sapiens
RVKYAADIL

SEQ ID NO: 740434 - protein, 9 aa, Homo Sapiens
KGEPGPPSP

SEQ ID NO: 740435 - protein, 9 aa, Homo Sapiens
TELREDPSA

SEQ ID NO: 740436 - protein, 9 aa, Homo Sapiens
HAIYLGANT

SEQ ID NO: 740437 - protein, 9 aa, Homo Sapiens
CEPPRIRGS

SEQ ID NO: 740438 - protein, 9 aa, Homo Sapiens
EDSCDESDS

SEQ ID NO: 740439 - protein, 9 aa, Homo Sapiens
NMDGKDSET

SEQ ID NO: 740440 - protein, 9 aa, Homo Sapiens
PTNRALEEE

SEQ ID NO: 740441 - protein, 9 aa, Homo Sapiens
AGPRHQVVM

SEQ ID NO: 740442 - protein, 9 aa, Homo Sapiens
SEAEYCYIN

SEQ ID NO: 740443 - protein, 9 aa, Homo Sapiens
DNFRLSLEQ

SEQ ID NO: 740444 - protein, 9 aa, Homo Sapiens
WLELVSHLH

SEQ ID NO: 740445 - protein, 9 aa, Homo Sapiens
KLETEKAQY

SEQ ID NO: 740446 - protein, 9 aa, Homo Sapiens
DLMSSVICE

SEQ ID NO: 740447 - protein, 9 aa, Homo Sapiens
SLVLLWRLL

SEQ ID NO: 740448 - protein, 9 aa, Homo Sapiens
ISKSITVKV

SEQ ID NO: 740449 - protein, 9 aa, Homo Sapiens
KCPPPFEDP

SEQ ID NO: 740450 - protein, 9 aa, Homo Sapiens
LERKDIRQV

SEQ ID NO: 740451 - protein, 9 aa, Homo Sapiens
SREIDHFFC

SEQ ID NO: 740452 - protein, 9 aa, Homo Sapiens
TEHAIYLGA

SEQ ID NO: 740453 - protein, 9 aa, Homo Sapiens
KDSSKVPQS

SEQ ID NO: 740454 - protein, 9 aa, Homo Sapiens
FSWCSSLTT

SEQ ID NO: 740455 - protein, 9 aa, Homo Sapiens
AFRCRLRNF

SEQ ID NO: 740456 - protein, 9 aa, Homo Sapiens
WMKVGRPLP

SEQ ID NO: 740457 - protein, 9 aa, Homo Sapiens
DLMGKTLTE

SEQ ID NO: 740458 - protein, 9 aa, Homo Sapiens
PGSHGQPGR

SEQ ID NO: 740459 - protein, 9 aa, Homo Sapiens
QGDEEANLS

SEQ ID NO: 740460 - protein, 9 aa, Homo Sapiens
TRMQVKPNA

SEQ ID NO: 740461 - protein, 9 aa, Homo Sapiens
EQTTTLEQA

SEQ ID NO: 740462 - protein, 9 aa, Homo Sapiens
IITLSHLEM

SEQ ID NO: 740463 - protein, 9 aa, Homo Sapiens
LKSERKTET

SEQ ID NO: 740464 - protein, 9 aa, Homo Sapiens
HLPTNRALE

SEQ ID NO: 740465 - protein, 9 aa, Homo Sapiens
QRPNMNSTG

SEQ ID NO: 740466 - protein, 9 aa, Homo Sapiens
EILLAPWAI

SEQ ID NO: 740467 - protein, 9 aa, Homo Sapiens
STLGSPDNF

SEQ ID NO: 740468 - protein, 9 aa, Homo Sapiens
NTRTRRGKS

SEQ ID NO: 740469 - protein, 9 aa, Homo Sapiens
ELYSNVLPV

SEQ ID NO: 740470 - protein, 9 aa, Homo Sapiens
GSGPPGSQE

SEQ ID NO: 740471 - protein, 9 aa, Homo Sapiens
TCIVLNRPV

SEQ ID NO: 740472 - protein, 9 aa, Homo Sapiens
QAVTYAAVK

SEQ ID NO: 740473 - protein, 9 aa, Homo Sapiens
EESIMDLEN

SEQ ID NO: 740474 - protein, 9 aa, Homo Sapiens
LRAMKLPVL

SEQ ID NO: 740475 - protein, 9 aa, Homo Sapiens
KVFSWCSSL

SEQ ID NO: 740476 - protein, 9 aa, Homo Sapiens
TPSICLAMY

SEQ ID NO: 740477 - protein, 9 aa, Homo Sapiens
NPEMSRSTP

SEQ ID NO: 740478 - protein, 9 aa, Homo Sapiens
SLLLLLLRL

SEQ ID NO: 740479 - protein, 9 aa, Homo Sapiens
TSLEDQKGL

SEQ ID NO: 740480 - protein, 9 aa, Homo Sapiens
QQLDTNQPR

SEQ ID NO: 740481 - protein, 9 aa, Homo Sapiens
IDHFFCEFP

SEQ ID NO: 740482 - protein, 9 aa, Homo Sapiens
RKCSKEESG

SEQ ID NO: 740483 - protein, 9 aa, Homo Sapiens
CPACGYTKC

SEQ ID NO: 740484 - protein, 9 aa, Homo Sapiens
KANFYCELG

SEQ ID NO: 740485 - protein, 9 aa, Homo Sapiens
HPRQTLEVF

SEQ ID NO: 740486 - protein, 9 aa, Homo Sapiens
AADILSNIR

SEQ ID NO: 740487 - protein, 9 aa, Homo Sapiens
AVNMDGKDS

SEQ ID NO: 740488 - protein, 9 aa, Homo Sapiens
QPVSWKKLQ

SEQ ID NO: 740489 - protein, 9 aa, Homo Sapiens
NRAFQTCAS

SEQ ID NO: 740490 - protein, 9 aa, Homo Sapiens
ELLSSAESP

SEQ ID NO: 740491 - protein, 9 aa, Homo Sapiens
DQRPNMNST

SEQ ID NO: 740492 - protein, 9 aa, Homo Sapiens
VRSYEFSSN

SEQ ID NO: 740493 - protein, 9 aa, Homo Sapiens
FLYNKYVVR

SEQ ID NO: 740494 - protein, 9 aa, Homo Sapiens
QEADYEEAS

SEQ ID NO: 740495 - protein, 9 aa, Homo Sapiens
EDEEEEGEN

SEQ ID NO: 740496 - protein, 9 aa, Homo Sapiens
LLVAVSAEC

SEQ ID NO: 740497 - protein, 9 aa, Homo Sapiens
LEKCTLDAL

SEQ ID NO: 740498 - protein, 9 aa, Homo Sapiens
GHMLKSKEQ

SEQ ID NO: 740499 - protein, 9 aa, Homo Sapiens
RPHSQNGLP

SEQ ID NO: 740500 - protein, 9 aa, Homo Sapiens
SGPPGSQEE

SEQ ID NO: 740501 - protein, 9 aa, Homo Sapiens
ETFNHALRH

SEQ ID NO: 740502 - protein, 9 aa, Homo Sapiens
GNKASEPVI

SEQ ID NO: 740503 - protein, 9 aa, Homo Sapiens
RPNMNSTGC

SEQ ID NO: 740504 - protein, 9 aa, Homo Sapiens
CALKMDDFK

SEQ ID NO: 740505 - protein, 9 aa, Homo Sapiens
GAPDTTLTP

SEQ ID NO: 740506 - protein, 9 aa, Homo Sapiens
SMVLYCHIG

SEQ ID NO: 740507 - protein, 9 aa, Homo Sapiens
LKENEQSKD

SEQ ID NO: 740508 - protein, 9 aa, Homo Sapiens
KLLKSERKT

SEQ ID NO: 740509 - protein, 9 aa, Homo Sapiens
RQTCIVLNR

SEQ ID NO: 740510 - protein, 9 aa, Homo Sapiens
PGYSYGDLP

SEQ ID NO: 740511 - protein, 9 aa, Homo Sapiens
LTEESIMDL

SEQ ID NO: 740512 - protein, 9 aa, Homo Sapiens
YCDDFLGQL

SEQ ID NO: 740513 - protein, 9 aa, Homo Sapiens
FSMVLYCHI

SEQ ID NO: 740514 - protein, 9 aa, Homo Sapiens
TVVIPKLNP

SEQ ID NO: 740515 - protein, 9 aa, Homo Sapiens
MTWMKVGRP

SEQ ID NO: 740516 - protein, 9 aa, Homo Sapiens
VSTGQSVAC

SEQ ID NO: 740517 - protein, 9 aa, Homo Sapiens
VVRVLDLND

SEQ ID NO: 740518 - protein, 9 aa, Homo Sapiens
VKVQPSTEE

SEQ ID NO: 740519 - protein, 9 aa, Homo Sapiens
SNVLPVGLP

SEQ ID NO: 740520 - protein, 9 aa, Homo Sapiens
ASSTPNGHC

SEQ ID NO: 740521 - protein, 9 aa, Homo Sapiens
AAGRLSPAR

SEQ ID NO: 740522 - protein, 9 aa, Homo Sapiens
PICFGPQPG

SEQ ID NO: 740523 - protein, 9 aa, Homo Sapiens
EKGEPGPPS

SEQ ID NO: 740524 - protein, 9 aa, Homo Sapiens
NASMSCNTP

SEQ ID NO: 740525 - protein, 9 aa, Homo Sapiens
IKYSSRSME

SEQ ID NO: 740526 - protein, 9 aa, Homo Sapiens
TRDFENKEK

SEQ ID NO: 740527 - protein, 9 aa, Homo Sapiens
WSSSFTEHK

SEQ ID NO: 740528 - protein, 9 aa, Homo Sapiens
LAGQEMHGE

SEQ ID NO: 740529 - protein, 9 aa, Homo Sapiens
NTNTCVCTE

SEQ ID NO: 740530 - protein, 9 aa, Homo Sapiens
LALAYEHAK

SEQ ID NO: 740531 - protein, 9 aa, Homo Sapiens
SSNSCSQRA

SEQ ID NO: 740532 - protein, 9 aa, Homo Sapiens
GSQPRFIST

SEQ ID NO: 740533 - protein, 9 aa, Homo Sapiens
ATTGTVGAL

SEQ ID NO: 740534 - protein, 9 aa, Homo Sapiens
RAMKLPVLE

SEQ ID NO: 740535 - protein, 9 aa, Homo Sapiens
CLNTRTRRG

SEQ ID NO: 740536 - protein, 9 aa, Homo Sapiens
LREDPSART

SEQ ID NO: 740537 - protein, 9 aa, Homo Sapiens
QPRFISTHR

SEQ ID NO: 740538 - protein, 9 aa, Homo Sapiens
ERQEPGLMG

SEQ ID NO: 740539 - protein, 9 aa, Homo Sapiens
LAKQYAKEN

SEQ ID NO: 740540 - protein, 9 aa, Homo Sapiens
RPMRSTFKS

SEQ ID NO: 740541 - protein, 9 aa, Homo Sapiens
LSPFQAVVI

SEQ ID NO: 740542 - protein, 9 aa, Homo Sapiens
VKTPIHMSF

SEQ ID NO: 740543 - protein, 9 aa, Homo Sapiens
SPDNFRLSL

SEQ ID NO: 740544 - protein, 9 aa, Homo Sapiens
TEYNPCGAI

SEQ ID NO: 740545 - protein, 9 aa, Homo Sapiens
PWVLNPSQA

SEQ ID NO: 740546 - protein, 9 aa, Homo Sapiens
SIPGAPDTT

SEQ ID NO: 740547 - protein, 9 aa, Homo Sapiens
VLYCHIGNK

SEQ ID NO: 740548 - protein, 9 aa, Homo Sapiens
EVKYCDDFL

SEQ ID NO: 740549 - protein, 9 aa, Homo Sapiens
IFGDHPGYS

SEQ ID NO: 740550 - protein, 9 aa, Homo Sapiens
GDLKLTEES

SEQ ID NO: 740551 - protein, 9 aa, Homo Sapiens
EERPNEIQE

SEQ ID NO: 740552 - protein, 9 aa, Homo Sapiens
VHQQKIPNF

SEQ ID NO: 740553 - protein, 9 aa, Homo Sapiens
IPNFSTLLC

SEQ ID NO: 740554 - protein, 9 aa, Homo Sapiens
EYCYINIAR

SEQ ID NO: 740555 - protein, 9 aa, Homo Sapiens
FVFWSFVIL

SEQ ID NO: 740556 - protein, 9 aa, Homo Sapiens
MPETSDSLR

SEQ ID NO: 740557 - protein, 9 aa, Homo Sapiens
GTVGALTDE

SEQ ID NO: 740558 - protein, 9 aa, Homo Sapiens
YFSGLSVTK

SEQ ID NO: 740559 - protein, 9 aa, Homo Sapiens
AIANNNIQD

SEQ ID NO: 740560 - protein, 9 aa, Homo Sapiens
NKASEPVIW

SEQ ID NO: 740561 - protein, 9 aa, Homo Sapiens
AVVIPVGSE

SEQ ID NO: 740562 - protein, 9 aa, Homo Sapiens
ALRAMKLPV

SEQ ID NO: 740563 - protein, 9 aa, Homo Sapiens
MSSVICEGD

SEQ ID NO: 740564 - protein, 9 aa, Homo Sapiens
TDKQFYSVA

SEQ ID NO: 740565 - protein, 9 aa, Homo Sapiens
FKCVTPKLE

SEQ ID NO: 740566 - protein, 9 aa, Homo Sapiens
VRTRDKKGS

SEQ ID NO: 740567 - protein, 9 aa, Homo Sapiens
DGPNTNTCV

SEQ ID NO: 740568 - protein, 9 aa, Homo Sapiens
CIVLNRPVL

SEQ ID NO: 740569 - protein, 9 aa, Homo Sapiens
RNGTENINR

SEQ ID NO: 740570 - protein, 9 aa, Homo Sapiens
HVRSQQPPP

SEQ ID NO: 740571 - protein, 9 aa, Homo Sapiens
VTYAAVKHS

SEQ ID NO: 740572 - protein, 9 aa, Homo Sapiens
YDDTLVYGM

SEQ ID NO: 740573 - protein, 9 aa, Homo Sapiens
DFLDKGTAS

SEQ ID NO: 740574 - protein, 9 aa, Homo Sapiens
TFLTRNCCL

SEQ ID NO: 740575 - protein, 9 aa, Homo Sapiens
ELALAYEHA

SEQ ID NO: 740576 - protein, 9 aa, Homo Sapiens
QRVELQEQT

SEQ ID NO: 740577 - protein, 9 aa, Homo Sapiens
SSSSVLHEP

SEQ ID NO: 740578 - protein, 9 aa, Homo Sapiens
KSCKPGYSN

SEQ ID NO: 740579 - protein, 9 aa, Homo Sapiens
DRDVTREAA

SEQ ID NO: 740580 - protein, 9 aa, Homo Sapiens
AFFSAGLSS

SEQ ID NO: 740581 - protein, 9 aa, Homo Sapiens
MKTLASYEC

SEQ ID NO: 740582 - protein, 9 aa, Homo Sapiens
TQATPHVAL

SEQ ID NO: 740583 - protein, 9 aa, Homo Sapiens
TRSHCNHVS

SEQ ID NO: 740584 - protein, 9 aa, Homo Sapiens
VCGAVRKTG

SEQ ID NO: 740585 - protein, 9 aa, Homo Sapiens
FYSVAILPV

SEQ ID NO: 740586 - protein, 9 aa, Homo Sapiens
VDGRPMRLQ

SEQ ID NO: 740587 - protein, 9 aa, Homo Sapiens
EGDLKLTEE

SEQ ID NO: 740588 - protein, 9 aa, Homo Sapiens
LQEQTTTLE

SEQ ID NO: 740589 - protein, 9 aa, Homo Sapiens
THVRSQQPP

SEQ ID NO: 740590 - protein, 9 aa, Homo Sapiens
DVPEQVKRL

SEQ ID NO: 740591 - protein, 9 aa, Homo Sapiens
QQKIPNFST

SEQ ID NO: 740592 - protein, 9 aa, Homo Sapiens
NKLAGTDGR

SEQ ID NO: 740593 - protein, 9 aa, Homo Sapiens
ILSENPANR

SEQ ID NO: 740594 - protein, 9 aa, Homo Sapiens
QVQLEGDEY

SEQ ID NO: 740595 - protein, 9 aa, Homo Sapiens
ENKEKTILT

SEQ ID NO: 740596 - protein, 9 aa, Homo Sapiens
ANNNIQDHN

SEQ ID NO: 740597 - protein, 9 aa, Homo Sapiens
KIRMQSLSP

SEQ ID NO: 740598 - protein, 9 aa, Homo Sapiens
WAIRTRYLR

SEQ ID NO: 740599 - protein, 9 aa, Homo Sapiens
LAYEHAKLE

SEQ ID NO: 740600 - protein, 9 aa, Homo Sapiens
EEANGGKRP

SEQ ID NO: 740601 - protein, 9 aa, Homo Sapiens
VSLPSIKGV

SEQ ID NO: 740602 - protein, 9 aa, Homo Sapiens
RQEPGLMGD

SEQ ID NO: 740603 - protein, 9 aa, Homo Sapiens
MLKSKEQGY

SEQ ID NO: 740604 - protein, 9 aa, Homo Sapiens
EHAIYLGAN

SEQ ID NO: 740605 - protein, 9 aa, Homo Sapiens
IDYVNRGLY

SEQ ID NO: 740606 - protein, 9 aa, Homo Sapiens
KRQMVDLNP

SEQ ID NO: 740607 - protein, 9 aa, Homo Sapiens
KAQVGLKKR

SEQ ID NO: 740608 - protein, 9 aa, Homo Sapiens
FTHSTSYAV

SEQ ID NO: 740609 - protein, 9 aa, Homo Sapiens
ILSNIRFGT

SEQ ID NO: 740610 - protein, 9 aa, Homo Sapiens
LGVRDQTRM

SEQ ID NO: 740611 - protein, 9 aa, Homo Sapiens
GPATRGRAA

SEQ ID NO: 740612 - protein, 9 aa, Homo Sapiens
NPSNSACLT

SEQ ID NO: 740613 - protein, 9 aa, Homo Sapiens
AELYSNVLP

SEQ ID NO: 740614 - protein, 9 aa, Homo Sapiens
DKNIVGDDI

SEQ ID NO: 740615 - protein, 9 aa, Homo Sapiens
AKAQVGLKK

SEQ ID NO: 740616 - protein, 9 aa, Homo Sapiens
FFSAGLSSC

SEQ ID NO: 740617 - protein, 9 aa, Homo Sapiens
LLPAISHSK

SEQ ID NO: 740618 - protein, 9 aa, Homo Sapiens
RDKKGSNYS

SEQ ID NO: 740619 - protein, 9 aa, Homo Sapiens
QENICLLSN

SEQ ID NO: 740620 - protein, 9 aa, Homo Sapiens
PAPTHVRSQ

SEQ ID NO: 740621 - protein, 9 aa, Homo Sapiens
SIKGVSSRA

SEQ ID NO: 740622 - protein, 9 aa, Homo Sapiens
VCSNCGEGT

SEQ ID NO: 740623 - protein, 9 aa, Homo Sapiens
PVDSVKIRM

SEQ ID NO: 740624 - protein, 9 aa, Homo Sapiens
GLSVTKRWK

SEQ ID NO: 740625 - protein, 9 aa, Homo Sapiens
KNIVGDDIT

SEQ ID NO: 740626 - protein, 9 aa, Homo Sapiens
PAAAALPGP

SEQ ID NO: 740627 - protein, 9 aa, Homo Sapiens
RRCWGPAPG

SEQ ID NO: 740628 - protein, 9 aa, Homo Sapiens
LVAVSAECW

SEQ ID NO: 740629 - protein, 9 aa, Homo Sapiens
MNSTGCQLI

SEQ ID NO: 740630 - protein, 9 aa, Homo Sapiens
NHALRHVAY

SEQ ID NO: 740631 - protein, 9 aa, Homo Sapiens
NVLPVGLPL

SEQ ID NO: 740632 - protein, 9 aa, Homo Sapiens
VTDTNDHSP

SEQ ID NO: 740633 - protein, 9 aa, Homo Sapiens
YTMLVLIAI

SEQ ID NO: 740634 - protein, 9 aa, Homo Sapiens
FISTHRVAE

SEQ ID NO: 740635 - protein, 9 aa, Homo Sapiens
TYITVLVTD

SEQ ID NO: 740636 - protein, 9 aa, Homo Sapiens
ATRGRAAGR

SEQ ID NO: 740637 - protein, 9 aa, Homo Sapiens
PEEFKKFKM

SEQ ID NO: 740638 - protein, 9 aa, Homo Sapiens
CTEQIVAKI

SEQ ID NO: 740639 - protein, 9 aa, Homo Sapiens
TANCCHLWS

SEQ ID NO: 740640 - protein, 9 aa, Homo Sapiens
SPELKSCKP

SEQ ID NO: 740641 - protein, 9 aa, Homo Sapiens
GDEYAKHIK

SEQ ID NO: 740642 - protein, 9 aa, Homo Sapiens
VLEKCTLDA

SEQ ID NO: 740643 - protein, 9 aa, Homo Sapiens
PRHQVVMWR

SEQ ID NO: 740644 - protein, 9 aa, Homo Sapiens
SQNGLPFGP

SEQ ID NO: 740645 - protein, 9 aa, Homo Sapiens
AHKECWDRD

SEQ ID NO: 740646 - protein, 9 aa, Homo Sapiens
NPKALAAAR

SEQ ID NO: 740647 - protein, 9 aa, Homo Sapiens
VSDVFYNSS

SEQ ID NO: 740648 - protein, 9 aa, Homo Sapiens
GMIPPTSKT

SEQ ID NO: 740649 - protein, 9 aa, Homo Sapiens
SKTSRPKMS

SEQ ID NO: 740650 - protein, 9 aa, Homo Sapiens
TTYTECCVC

SEQ ID NO: 740651 - protein, 9 aa, Homo Sapiens
GLYWADENH

SEQ ID NO: 740652 - protein, 9 aa, Homo Sapiens
YACPACGYT

SEQ ID NO: 740653 - protein, 9 aa, Homo Sapiens
PSRSTDTEY

SEQ ID NO: 740654 - protein, 9 aa, Homo Sapiens
FSSNSCSQR

SEQ ID NO: 740655 - protein, 9 aa, Homo Sapiens
YTVVIPKLN

SEQ ID NO: 740656 - protein, 9 aa, Homo Sapiens
ELVSHLHNL

SEQ ID NO: 740657 - protein, 9 aa, Homo Sapiens
GSNYSQSEA

SEQ ID NO: 740658 - protein, 9 aa, Homo Sapiens
GVSSRAGNV

SEQ ID NO: 740659 - protein, 9 aa, Homo Sapiens
PPRGPATRG

SEQ ID NO: 740660 - protein, 9 aa, Homo Sapiens
QEQTTTLEQ

SEQ ID NO: 740661 - protein, 9 aa, Homo Sapiens
LLERKDIRQ

SEQ ID NO: 740662 - protein, 9 aa, Homo Sapiens
KCWKSFSKN

SEQ ID NO: 740663 - protein, 9 aa, Homo Sapiens
DSSSSSSGQ

SEQ ID NO: 740664 - protein, 9 aa, Homo Sapiens
RIRGSGTRE

SEQ ID NO: 740665 - protein, 9 aa, Homo Sapiens
SYDCDKCWK

SEQ ID NO: 740666 - protein, 9 aa, Homo Sapiens
TPSVYLELT

SEQ ID NO: 740667 - protein, 9 aa, Homo Sapiens
KENGYPFRH

SEQ ID NO: 740668 - protein, 9 aa, Homo Sapiens
NLHVVPGVE

SEQ ID NO: 740669 - protein, 9 aa, Homo Sapiens
WLKAAVREL

SEQ ID NO: 740670 - protein, 9 aa, Homo Sapiens
HPNRTPSIC

SEQ ID NO: 740671 - protein, 9 aa, Homo Sapiens
GCLGYNLLL

SEQ ID NO: 740672 - protein, 9 aa, Homo Sapiens
SATGARSTS

SEQ ID NO: 740673 - protein, 9 aa, Homo Sapiens
SSFTEHKRI

SEQ ID NO: 740674 - protein, 9 aa, Homo Sapiens
QSKLLTRGQ

SEQ ID NO: 740675 - protein, 9 aa, Homo Sapiens
PWSWPDELE

SEQ ID NO: 740676 - protein, 9 aa, Homo Sapiens
QREDEEEEG

SEQ ID NO: 740677 - protein, 9 aa, Homo Sapiens
PIRNSVDDL

SEQ ID NO: 740678 - protein, 9 aa, Homo Sapiens
LRAHKECWD

SEQ ID NO: 740679 - protein, 9 aa, Homo Sapiens
KTEEFRQKS

SEQ ID NO: 740680 - protein, 9 aa, Homo Sapiens
FTEHKRIHA

SEQ ID NO: 740681 - protein, 9 aa, Homo Sapiens
VVSVDGRPM

SEQ ID NO: 740682 - protein, 9 aa, Homo Sapiens
GENPPRGPA

SEQ ID NO: 740683 - protein, 9 aa, Homo Sapiens
GIKTVLTMT

SEQ ID NO: 740684 - protein, 9 aa, Homo Sapiens
EANLSLPIS

SEQ ID NO: 740685 - protein, 9 aa, Homo Sapiens
SEFQDDSVL

SEQ ID NO: 740686 - protein, 9 aa, Homo Sapiens
QLEGDEYAK

SEQ ID NO: 740687 - protein, 9 aa, Homo Sapiens
AASPPCPRP

SEQ ID NO: 740688 - protein, 9 aa, Homo Sapiens
HYDTSLEDQ

SEQ ID NO: 740689 - protein, 9 aa, Homo Sapiens
AGRLSPARS

SEQ ID NO: 740690 - protein, 9 aa, Homo Sapiens
ARSPSTDSI

SEQ ID NO: 740691 - protein, 9 aa, Homo Sapiens
PNEIQEDAE

SEQ ID NO: 740692 - protein, 9 aa, Homo Sapiens
QVCSNCGEG

SEQ ID NO: 740693 - protein, 9 aa, Homo Sapiens
PERLDRDSH

SEQ ID NO: 740694 - protein, 9 aa, Homo Sapiens
STDTEYNPC

SEQ ID NO: 740695 - protein, 9 aa, Homo Sapiens
QAVVIPVGS

SEQ ID NO: 740696 - protein, 9 aa, Homo Sapiens
MYQGHMLKS

SEQ ID NO: 740697 - protein, 9 aa, Homo Sapiens
DTRDRDSPE

SEQ ID NO: 740698 - protein, 9 aa, Homo Sapiens
GLYFGMLLF

SEQ ID NO: 740699 - protein, 9 aa, Homo Sapiens
QLYKDANLG

SEQ ID NO: 740700 - protein, 9 aa, Homo Sapiens
LVVRVLDLN

SEQ ID NO: 740701 - protein, 9 aa, Homo Sapiens
TYAAVKHSR

SEQ ID NO: 740702 - protein, 9 aa, Homo Sapiens
GCYIYIYLT

SEQ ID NO: 740703 - protein, 9 aa, Homo Sapiens
CHLWSKASE

SEQ ID NO: 740704 - protein, 9 aa, Homo Sapiens
MQNCPKSQG

SEQ ID NO: 740705 - protein, 9 aa, Homo Sapiens
GPRHQVVMW

SEQ ID NO: 740706 - protein, 9 aa, Homo Sapiens
THYDTSLED

SEQ ID NO: 740707 - protein, 9 aa, Homo Sapiens
VFSMVLYCH

SEQ ID NO: 740708 - protein, 9 aa, Homo Sapiens
GLGKILSEN

SEQ ID NO: 740709 - protein, 9 aa, Homo Sapiens
RDKHRGQLL

SEQ ID NO: 740710 - protein, 9 aa, Homo Sapiens
ASMSCNTPL

SEQ ID NO: 740711 - protein, 9 aa, Homo Sapiens
AVELEEEEN

SEQ ID NO: 740712 - protein, 9 aa, Homo Sapiens
DDLRWEGVP

SEQ ID NO: 740713 - protein, 9 aa, Homo Sapiens
CVCMERPGA

SEQ ID NO: 740714 - protein, 9 aa, Homo Sapiens
YAVNVETHI

SEQ ID NO: 740715 - protein, 9 aa, Homo Sapiens
NDRDVTREA

SEQ ID NO: 740716 - protein, 9 aa, Homo Sapiens
ALNPVVYGV

SEQ ID NO: 740717 - protein, 9 aa, Homo Sapiens
GDHPGYSYG

SEQ ID NO: 740718 - protein, 9 aa, Homo Sapiens
NFSDTKIIT

SEQ ID NO: 740719 - protein, 9 aa, Homo Sapiens
ERPGACSVP

SEQ ID NO: 740720 - protein, 9 aa, Homo Sapiens
GGYSMNSNM

SEQ ID NO: 740721 - protein, 9 aa, Homo Sapiens
TGARSTSFM

SEQ ID NO: 740722 - protein, 9 aa, Homo Sapiens
CMQSSQTRS

SEQ ID NO: 740723 - protein, 9 aa, Homo Sapiens
AAVKHSRPR

SEQ ID NO: 740724 - protein, 9 aa, Homo Sapiens
KSEVVSPSY

SEQ ID NO: 740725 - protein, 9 aa, Homo Sapiens
KRWKPFLYR

SEQ ID NO: 740726 - protein, 9 aa, Homo Sapiens
LSSLRQLYK

SEQ ID NO: 740727 - protein, 9 aa, Homo Sapiens
LPQSKLLTR

SEQ ID NO: 740728 - protein, 9 aa, Homo Sapiens
SNASMSCNT

SEQ ID NO: 740729 - protein, 9 aa, Homo Sapiens
FGMLLFLFA

SEQ ID NO: 740730 - protein, 9 aa, Homo Sapiens
TTGTVGALT

SEQ ID NO: 740731 - protein, 9 aa, Homo Sapiens
PPCPRPHGE

SEQ ID NO: 740732 - protein, 9 aa, Homo Sapiens
GRECVGSVN

SEQ ID NO: 740733 - protein, 9 aa, Homo Sapiens
YDTSLEDQK

SEQ ID NO: 740734 - protein, 9 aa, Homo Sapiens
SNSACLTPL

SEQ ID NO: 740735 - protein, 9 aa, Homo Sapiens
FQVPRLVLA

SEQ ID NO: 740736 - protein, 9 aa, Homo Sapiens
CCLTELYLN

SEQ ID NO: 740737 - protein, 9 aa, Homo Sapiens
SHSKTSRPK

SEQ ID NO: 740738 - protein, 9 aa, Homo Sapiens
PAEETHVKV

SEQ ID NO: 740739 - protein, 9 aa, Homo Sapiens
TWMKVGRPL

SEQ ID NO: 740740 - protein, 9 aa, Homo Sapiens
LNSEKFDLN

SEQ ID NO: 740741 - protein, 9 aa, Homo Sapiens
TLEVFNLLR

SEQ ID NO: 740742 - protein, 9 aa, Homo Sapiens
ICLAMYRAF

SEQ ID NO: 740743 - protein, 9 aa, Homo Sapiens
SVTKRWKPF

SEQ ID NO: 740744 - protein, 9 aa, Homo Sapiens
YPASMVPRI

SEQ ID NO: 740745 - protein, 9 aa, Homo Sapiens
SNYSQSEAL

SEQ ID NO: 740746 - protein, 9 aa, Homo Sapiens
AIKQSQHMT

SEQ ID NO: 740747 - protein, 9 aa, Homo Sapiens
SAFANDRDV

SEQ ID NO: 740748 - protein, 9 aa, Homo Sapiens
RLELLSSAE

SEQ ID NO: 740749 - protein, 9 aa, Homo Sapiens
QKIPNFSTL

SEQ ID NO: 740750 - protein, 9 aa, Homo Sapiens
KGVSSRAGN

SEQ ID NO: 740751 - protein, 9 aa, Homo Sapiens
LIGCLGYNL

SEQ ID NO: 740752 - protein, 9 aa, Homo Sapiens
SLVVRVLDL

SEQ ID NO: 740753 - protein, 9 aa, Homo Sapiens
FITNYFQNQ

SEQ ID NO: 740754 - protein, 9 aa, Homo Sapiens
QDTRSLKAQ

SEQ ID NO: 740755 - protein, 9 aa, Homo Sapiens
TPSIPGAPD

SEQ ID NO: 740756 - protein, 9 aa, Homo Sapiens
QAIANNNIQ

SEQ ID NO: 740757 - protein, 9 aa, Homo Sapiens
PRHKTRPAA

SEQ ID NO: 740758 - protein, 9 aa, Homo Sapiens
VELVHQQKI

SEQ ID NO: 740759 - protein, 9 aa, Homo Sapiens
LASYECEKH

SEQ ID NO: 740760 - protein, 9 aa, Homo Sapiens
VRSQQPPPP

SEQ ID NO: 740761 - protein, 9 aa, Homo Sapiens
WKSFSKNED

SEQ ID NO: 740762 - protein, 9 aa, Homo Sapiens
RAFLYNKYV

SEQ ID NO: 740763 - protein, 9 aa, Homo Sapiens
DDSVLQVLR

SEQ ID NO: 740764 - protein, 9 aa, Homo Sapiens
QLAGELAGQ

SEQ ID NO: 740765 - protein, 9 aa, Homo Sapiens
GLYVVLDDN

SEQ ID NO: 740766 - protein, 9 aa, Homo Sapiens
HLWSKASEE

SEQ ID NO: 740767 - protein, 9 aa, Homo Sapiens
DISGEFLVL

SEQ ID NO: 740768 - protein, 9 aa, Homo Sapiens
WGPAPGVRT

SEQ ID NO: 740769 - protein, 9 aa, Homo Sapiens
CTTYGWRTT

SEQ ID NO: 740770 - protein, 9 aa, Homo Sapiens
DTEYNPCGA
